United States Patent 7,691,997 (FUNCTIONAL AND HYPERFUNCTIONAL SIRNA) - sequence listing, part 11

SEQ ID NO: 416598 - RNA, 19 nt, Homo sapiens
agaagaggguccaacguau

SEQ ID NO: 416599 - RNA, 19 nt, Homo sapiens
gcauaugacccgucucuca

SEQ ID NO: 416600 - RNA, 19 nt, Homo sapiens
cugcuaaaguugcaaguga

SEQ ID NO: 416601 - RNA, 19 nt, Homo sapiens
ugaagacauucguauuaug

SEQ ID NO: 416602 - RNA, 19 nt, Homo sapiens
ggauguagaagaagacaga

SEQ ID NO: 416603 - RNA, 19 nt, Homo sapiens
ugugauaacuacaccauuc

SEQ ID NO: 416604 - RNA, 19 nt, Homo sapiens
aagccgguauucauuuaua

SEQ ID NO: 416605 - RNA, 19 nt, Homo sapiens
gccaauaaacucuuaauac

SEQ ID NO: 416606 - RNA, 19 nt, Homo sapiens
cagcaauguugacuuuguu

SEQ ID NO: 416607 - RNA, 19 nt, Homo sapiens
accagaaucuugcugcuaa

SEQ ID NO: 416608 - RNA, 19 nt, Homo sapiens
gaagacugggcaacauauu

SEQ ID NO: 416609 - RNA, 19 nt, Homo sapiens
ggaagacugggcaacauau

SEQ ID NO: 416610 - RNA, 19 nt, Homo sapiens
gcugaaagaagaaggaguu

SEQ ID NO: 416611 - RNA, 19 nt, Homo sapiens
caugcuggauguagaagaa

SEQ ID NO: 416612 - RNA, 19 nt, Homo sapiens
ugagaaaugugugcuauac

SEQ ID NO: 416613 - RNA, 19 nt, Homo sapiens
cagcagaguguguuuaaga

SEQ ID NO: 416614 - RNA, 19 nt, Homo sapiens
caaagacaguccacagcau

SEQ ID NO: 416615 - RNA, 19 nt, Homo sapiens
gcgcugggcaugcucagua

SEQ ID NO: 416616 - RNA, 19 nt, Homo sapiens
cacaagacauugagaagag

SEQ ID NO: 416617 - RNA, 19 nt, Homo sapiens
gggaagccgguauucauuu

SEQ ID NO: 416618 - RNA, 19 nt, Homo sapiens
uucgaaaccuugucuuaaa

SEQ ID NO: 416619 - RNA, 19 nt, Homo sapiens
uggaaucucucucucaaca

SEQ ID NO: 416620 - RNA, 19 nt, Homo sapiens
gauugucauuggguauaua

SEQ ID NO: 416621 - RNA, 19 nt, Homo sapiens
gcaauggaaggaaggagaa

SEQ ID NO: 416622 - RNA, 19 nt, Homo sapiens
gaaaccuugucuuaaagca

SEQ ID NO: 416623 - RNA, 19 nt, Homo sapiens
uuucucagcaucuuuguua

SEQ ID NO: 416624 - RNA, 19 nt, Homo sapiens
gcaaacgccaccagauugu

SEQ ID NO: 416625 - RNA, 19 nt, Homo sapiens
uaacguguuugaugauucu

SEQ ID NO: 416626 - RNA, 19 nt, Homo sapiens
guaacguguuugaugauuc

SEQ ID NO: 416627 - RNA, 19 nt, Homo sapiens
cuucaggaaugauauaauc

SEQ ID NO: 416628 - RNA, 19 nt, Homo sapiens
uaaaguugcaagugauuga

SEQ ID NO: 416629 - RNA, 19 nt, Homo sapiens
gauauaaucugucccauuu

SEQ ID NO: 416630 - RNA, 19 nt, Homo sapiens
caacguaucucuuacauug

SEQ ID NO: 416631 - RNA, 19 nt, Homo sapiens
gcaccuacauuaaugcuaa

SEQ ID NO: 416632 - RNA, 19 nt, Homo sapiens
ggaaaugugucuugauaau

SEQ ID NO: 416633 - RNA, 19 nt, Homo sapiens
gcuauuaccuuucucaguu

SEQ ID NO: 416634 - RNA, 19 nt, Homo sapiens
gaaucucucucucaacaaa

SEQ ID NO: 416635 - RNA, 19 nt, Homo sapiens
gcacuacacugaauggaau

SEQ ID NO: 416636 - RNA, 19 nt, Homo sapiens
caaagugaauucauggaaa

SEQ ID NO: 416637 - RNA, 19 nt, Homo sapiens
gcugaagacauucguauua

SEQ ID NO: 416638 - RNA, 19 nt, Homo sapiens
gcugagggauguuuagaaa

SEQ ID NO: 416639 - RNA, 19 nt, Homo sapiens
gaaucuugcugcuaaaguu

SEQ ID NO: 416640 - RNA, 19 nt, Homo sapiens
uagcaacucugaaguauca

SEQ ID NO: 416641 - RNA, 19 nt, Homo sapiens
gagaagaggguccaacgua

SEQ ID NO: 416642 - RNA, 19 nt, Homo sapiens
gaaagaagaaggaguugug

SEQ ID NO: 416643 - RNA, 19 nt, Homo sapiens
guauaugccuucaggaaug

SEQ ID NO: 416644 - RNA, 19 nt, Homo sapiens
gaagugcuauuaccuuucu

SEQ ID NO: 416645 - RNA, 19 nt, Homo sapiens
gucaacagcugaaagaaga

SEQ ID NO: 416646 - RNA, 19 nt, Homo sapiens
cccaacaugugaagcauua

SEQ ID NO: 416647 - RNA, 19 nt, Homo sapiens
ucauugagcaccuacauua

SEQ ID NO: 416648 - RNA, 19 nt, Homo sapiens
gcagcaauguugacuuugu

SEQ ID NO: 416649 - RNA, 19 nt, Homo sapiens
gcaagugauugauaaugga

SEQ ID NO: 416650 - RNA, 19 nt, Homo sapiens
uagcuguucugcucauaua

SEQ ID NO: 416651 - RNA, 19 nt, Homo sapiens
ccagugagcaguaugaauu

SEQ ID NO: 416652 - RNA, 19 nt, Homo sapiens
caaagguacugaauguugu

SEQ ID NO: 416653 - RNA, 19 nt, Homo sapiens
gagagacgcugagggaugu

SEQ ID NO: 416654 - RNA, 19 nt, Homo sapiens
gaagaagacagacuugcuu

SEQ ID NO: 416655 - RNA, 19 nt, Homo sapiens
ucacaagacuccagacagu

SEQ ID NO: 416656 - RNA, 19 nt, Homo sapiens
gauuucagcuuuccuuaag

SEQ ID NO: 416657 - RNA, 19 nt, Homo sapiens
uguguuagaugcuuuaaug

SEQ ID NO: 416658 - RNA, 19 nt, Homo sapiens
ccaaagaaauugauauucc

SEQ ID NO: 416659 - RNA, 19 nt, Homo sapiens
cguggcaaguucacauuua

SEQ ID NO: 416660 - RNA, 19 nt, Homo sapiens
cugcauaggagacuaaaua

SEQ ID NO: 416661 - RNA, 19 nt, Homo sapiens
uaacuacccucagcaaaca

SEQ ID NO: 416662 - RNA, 19 nt, Homo sapiens
gcagaugguuuggcaggaa

SEQ ID NO: 416663 - RNA, 19 nt, Homo sapiens
ucaacaccguggaugauuu

SEQ ID NO: 416664 - RNA, 19 nt, Homo sapiens
gaagguagcaauggaguau

SEQ ID NO: 416665 - RNA, 19 nt, Homo sapiens
ccaaagguacugaauguug

SEQ ID NO: 416666 - RNA, 19 nt, Homo sapiens
cauaggagacuaaauaauc

SEQ ID NO: 416667 - RNA, 19 nt, Homo sapiens
ccagaacucuauccacugu

SEQ ID NO: 416668 - RNA, 19 nt, Homo sapiens
ccacacagaauguauguau

SEQ ID NO: 416669 - RNA, 19 nt, Homo sapiens
agacugggcaacauauuua

SEQ ID NO: 416670 - RNA, 19 nt, Homo sapiens
gaaaagagagggauauaug

SEQ ID NO: 416671 - RNA, 19 nt, Homo sapiens
gcagucagccagccgaauu

SEQ ID NO: 416672 - RNA, 19 nt, Homo sapiens
ucugaaguaucaagaguuu

SEQ ID NO: 416673 - RNA, 19 nt, Homo sapiens
gggagaagguagcaaugga

SEQ ID NO: 416674 - RNA, 19 nt, Homo sapiens
cguguuugaugauucuuua

SEQ ID NO: 416675 - RNA, 19 nt, Homo sapiens
cucagcaucuuuguuauua

SEQ ID NO: 416676 - RNA, 19 nt, Homo sapiens
gguuaucaguguaaaugaa

SEQ ID NO: 416677 - RNA, 19 nt, Homo sapiens
gaacauugaacccuuugug

SEQ ID NO: 416678 - RNA, 19 nt, Homo sapiens
cuauuaccuuucucaguua

SEQ ID NO: 416679 - RNA, 19 nt, Homo sapiens
cauaggacuucaagagaga

SEQ ID NO: 416680 - RNA, 19 nt, Homo sapiens
auaguaacguguuugauga

SEQ ID NO: 416681 - RNA, 19 nt, Homo sapiens
gucauuggguauauaugua

SEQ ID NO: 416682 - RNA, 19 nt, Homo sapiens
auggaaaugugucuugaua

SEQ ID NO: 416683 - RNA, 19 nt, Homo sapiens
agaaaugugugcuauacug

SEQ ID NO: 416684 - RNA, 19 nt, Homo sapiens
uggcauggauuguggaaga

SEQ ID NO: 416685 - RNA, 19 nt, Homo sapiens
ggaaggagaagcucugaag

SEQ ID NO: 416686 - RNA, 19 nt, Homo sapiens
agagagggauauauggaaa

SEQ ID NO: 416687 - RNA, 19 nt, Homo sapiens
cacauuuacuccaaaguga

SEQ ID NO: 416688 - RNA, 19 nt, Homo sapiens
agaagaggguccaacguau

SEQ ID NO: 416689 - RNA, 19 nt, Homo sapiens
cugcuaaaguugcaaguga

SEQ ID NO: 416690 - RNA, 19 nt, Homo sapiens
ugaagacauucguauuaug

SEQ ID NO: 416691 - RNA, 19 nt, Homo sapiens
ggauguagaagaagacaga

SEQ ID NO: 416692 - RNA, 19 nt, Homo sapiens
ugugauaacuacaccauuc

SEQ ID NO: 416693 - RNA, 19 nt, Homo sapiens
gccaauaaacucuuaauac

SEQ ID NO: 416694 - RNA, 19 nt, Homo sapiens
cagcaauguugacuuuguu

SEQ ID NO: 416695 - RNA, 19 nt, Homo sapiens
accagaaucuugcugcuaa

SEQ ID NO: 416696 - RNA, 19 nt, Homo sapiens
gaagacugggcaacauauu

SEQ ID NO: 416697 - RNA, 19 nt, Homo sapiens
ggaagacugggcaacauau

SEQ ID NO: 416698 - RNA, 19 nt, Homo sapiens
gcugaaagaagaaggaguu

SEQ ID NO: 416699 - RNA, 19 nt, Homo sapiens
caugcuggauguagaagaa

SEQ ID NO: 416700 - RNA, 19 nt, Homo sapiens
ugagaaaugugugcuauac

SEQ ID NO: 416701 - RNA, 19 nt, Homo sapiens
cagcagaguguguuuaaga

SEQ ID NO: 416702 - RNA, 19 nt, Homo sapiens
caaagacaguccacagcau

SEQ ID NO: 416703 - RNA, 19 nt, Homo sapiens
uucgaaaccuugucuuaaa

SEQ ID NO: 416704 - RNA, 19 nt, Homo sapiens
uggaaucucucucucaaca

SEQ ID NO: 416705 - RNA, 19 nt, Homo sapiens
gauugucauuggguauaua

SEQ ID NO: 416706 - RNA, 19 nt, Homo sapiens
gcaauggaaggaaggagaa

SEQ ID NO: 416707 - RNA, 19 nt, Homo sapiens
gaaaccuugucuuaaagca

SEQ ID NO: 416708 - RNA, 19 nt, Homo sapiens
uuucucagcaucuuuguua

SEQ ID NO: 416709 - RNA, 19 nt, Homo sapiens
uaacguguuugaugauucu

SEQ ID NO: 416710 - RNA, 19 nt, Homo sapiens
guaacguguuugaugauuc

SEQ ID NO: 416711 - RNA, 19 nt, Homo sapiens
cuucaggaaugauauaauc

SEQ ID NO: 416712 - RNA, 19 nt, Homo sapiens
uaaaguugcaagugauuga

SEQ ID NO: 416713 - RNA, 19 nt, Homo sapiens
uaaggcagauuuuguuuug

SEQ ID NO: 416714 - RNA, 19 nt, Homo sapiens
gaugauggagguaugauag

SEQ ID NO: 416715 - RNA, 19 nt, Homo sapiens
ggcagucuguugucuuaga

SEQ ID NO: 416716 - RNA, 19 nt, Homo sapiens
gaagaggguccaacguauc

SEQ ID NO: 416717 - RNA, 19 nt, Homo sapiens
gacaaaaucuggagcaaag

SEQ ID NO: 416718 - RNA, 19 nt, Homo sapiens
agaacucuauccacuguau

SEQ ID NO: 416719 - RNA, 19 nt, Homo sapiens
uugaagugcuauuaccuuu

SEQ ID NO: 416720 - RNA, 19 nt, Homo sapiens
cugaagacauucguauuau

SEQ ID NO: 416721 - RNA, 19 nt, Homo sapiens
uauaguaacguguuugaug

SEQ ID NO: 416722 - RNA, 19 nt, Homo sapiens
augcagcaauguugacuuu

SEQ ID NO: 416723 - RNA, 19 nt, Homo sapiens
uggaugagcugcugaagac

SEQ ID NO: 416724 - RNA, 19 nt, Homo sapiens
cacagaauguauguaugua

SEQ ID NO: 416725 - RNA, 19 nt, Homo sapiens
ucucuuacauuggacauga

SEQ ID NO: 416726 - RNA, 19 nt, Homo sapiens
gagcaaagaaggauuuuau

SEQ ID NO: 416727 - RNA, 19 nt, Homo sapiens
gcucugugccuguaugaga

SEQ ID NO: 416728 - RNA, 19 nt, Homo sapiens
aaaguugagguucugguua

SEQ ID NO: 416729 - RNA, 19 nt, Homo sapiens
gaacaaacccgacaguaaa

SEQ ID NO: 416730 - RNA, 19 nt, Homo sapiens
gcaagaaggucaacucuca

SEQ ID NO: 416731 - RNA, 19 nt, Homo sapiens
ccaaaugccuccugaacaa

SEQ ID NO: 416732 - RNA, 19 nt, Homo sapiens
gaggagcccugcagauuga

SEQ ID NO: 416733 - RNA, 19 nt, Homo sapiens
gcacauuccuccuuuccuu

SEQ ID NO: 416734 - RNA, 19 nt, Homo sapiens
guccagagcuauuucauug

SEQ ID NO: 416735 - RNA, 19 nt, Homo sapiens
cagauccuguguccuauua

SEQ ID NO: 416736 - RNA, 19 nt, Homo sapiens
gugccaaucugccuuguaa

SEQ ID NO: 416737 - RNA, 19 nt, Homo sapiens
gaggagaagucacggauca

SEQ ID NO: 416738 - RNA, 19 nt, Homo sapiens
cgagugaccuggaacaaga

SEQ ID NO: 416739 - RNA, 19 nt, Homo sapiens
gaagagcgagccuaccuuu

SEQ ID NO: 416740 - RNA, 19 nt, Homo sapiens
gaccaagucucgcccaaga

SEQ ID NO: 416741 - RNA, 19 nt, Homo sapiens
ucaaauacuuggcacauuc

SEQ ID NO: 416742 - RNA, 19 nt, Homo sapiens
caacaugccucaguauauc

SEQ ID NO: 416743 - RNA, 19 nt, Homo sapiens
ucaaacagcugcgaucaga

SEQ ID NO: 416744 - RNA, 19 nt, Homo sapiens
ggacucccauggugacuga

SEQ ID NO: 416745 - RNA, 19 nt, Homo sapiens
aagaauggcuccagugaga

SEQ ID NO: 416746 - RNA, 19 nt, Homo sapiens
ggucaacucucagcgcuuu

SEQ ID NO: 416747 - RNA, 19 nt, Homo sapiens
ggagggcucugacuacauc

SEQ ID NO: 416748 - RNA, 19 nt, Homo sapiens
ggacauggaucuggaagag

SEQ ID NO: 416749 - RNA, 19 nt, Homo sapiens
uagauccgauggcagaaua

SEQ ID NO: 416750 - RNA, 19 nt, Homo sapiens
ggagaagugucaccaguac

SEQ ID NO: 416751 - RNA, 19 nt, Homo sapiens
ccaucgagcuggccacauu

SEQ ID NO: 416752 - RNA, 19 nt, Homo sapiens
ggaggucgcugccaagcau

SEQ ID NO: 416753 - RNA, 19 nt, Homo sapiens
caaggacccuguggaaaug

SEQ ID NO: 416754 - RNA, 19 nt, Homo sapiens
caggucacguugcuagaua

SEQ ID NO: 416755 - RNA, 19 nt, Homo sapiens
gaagugaacaagccgaaga

SEQ ID NO: 416756 - RNA, 19 nt, Homo sapiens
gaacagggugugccaaagu

SEQ ID NO: 416757 - RNA, 19 nt, Homo sapiens
gcaauggacgcaucaaaca

SEQ ID NO: 416758 - RNA, 19 nt, Homo sapiens
gcucgaggccucucuguga

SEQ ID NO: 416759 - RNA, 19 nt, Homo sapiens
ucacagcccuccauugucu

SEQ ID NO: 416760 - RNA, 19 nt, Homo sapiens
acacgucacuggcauggaa

SEQ ID NO: 416761 - RNA, 19 nt, Homo sapiens
agaacaaacccgacaguaa

SEQ ID NO: 416762 - RNA, 19 nt, Homo sapiens
ccagagcuauuucauugug

SEQ ID NO: 416763 - RNA, 19 nt, Homo sapiens
cgacaugggcccacaguug

SEQ ID NO: 416764 - RNA, 19 nt, Homo sapiens
caucaacgccagcuucauu

SEQ ID NO: 416765 - RNA, 19 nt, Homo sapiens
ugacgcggcuggaggagaa

SEQ ID NO: 416766 - RNA, 19 nt, Homo sapiens
ccaaggacccuguggaaau

SEQ ID NO: 416767 - RNA, 19 nt, Homo sapiens
ugaccacuaugcaaccuaa

SEQ ID NO: 416768 - RNA, 19 nt, Homo sapiens
aauacaacaugccucagua

SEQ ID NO: 416769 - RNA, 19 nt, Homo sapiens
gaauggcuccagugagaaa

SEQ ID NO: 416770 - RNA, 19 nt, Homo sapiens
ccuacaagauccaguacaa

SEQ ID NO: 416771 - RNA, 19 nt, Homo sapiens
cgauggcgcucgcagcaaa

SEQ ID NO: 416772 - RNA, 19 nt, Homo sapiens
aaacagcugcgaucagaaa

SEQ ID NO: 416773 - RNA, 19 nt, Homo sapiens
gaacaagaagggcaagaag

SEQ ID NO: 416774 - RNA, 19 nt, Homo sapiens
augaaggucuccuggauuu

SEQ ID NO: 416775 - RNA, 19 nt, Homo sapiens
gccaagugcauaagacuaa

SEQ ID NO: 416776 - RNA, 19 nt, Homo sapiens
aggagaguaucaucaagua

SEQ ID NO: 416777 - RNA, 19 nt, Homo sapiens
gacaugggcccacaguuga

SEQ ID NO: 416778 - RNA, 19 nt, Homo sapiens
caacgcccuuccuggcuuu

SEQ ID NO: 416779 - RNA, 19 nt, Homo sapiens
ggccguaucagauuaaaga

SEQ ID NO: 416780 - RNA, 19 nt, Homo sapiens
gaauacaacaugccucagu

SEQ ID NO: 416781 - RNA, 19 nt, Homo sapiens
ggugaaaucucuccccaaa

SEQ ID NO: 416782 - RNA, 19 nt, Homo sapiens
ggaacaagaagggcaagaa

SEQ ID NO: 416783 - RNA, 19 nt, Homo sapiens
gggagaagugucaccagua

SEQ ID NO: 416784 - RNA, 19 nt, Homo sapiens
cgucagaacgcguacauug

SEQ ID NO: 416785 - RNA, 19 nt, Homo sapiens
gcaacuggcagaagcacaa

SEQ ID NO: 416786 - RNA, 19 nt, Homo sapiens
ccaugaaggucuccuggau

SEQ ID NO: 416787 - RNA, 19 nt, Homo sapiens
ggaugacacggccgaauau

SEQ ID NO: 416788 - RNA, 19 nt, Homo sapiens
gcaggagaguaucaucaag

SEQ ID NO: 416789 - RNA, 19 nt, Homo sapiens
aaaccgaccagggcaaaua

SEQ ID NO: 416790 - RNA, 19 nt, Homo sapiens
uugagacgauugaguuuga

SEQ ID NO: 416791 - RNA, 19 nt, Homo sapiens
gagcgagccuaccuuugca

SEQ ID NO: 416792 - RNA, 19 nt, Homo sapiens
ugaaagcacuccgauucga

SEQ ID NO: 416793 - RNA, 19 nt, Homo sapiens
cggaagcuuugaccacuau

SEQ ID NO: 416794 - RNA, 19 nt, Homo sapiens
gcagacagaggaugaguac

SEQ ID NO: 416795 - RNA, 19 nt, Homo sapiens
ggaacagggugugccaaag

SEQ ID NO: 416796 - RNA, 19 nt, Homo sapiens
ucaagugugaucaguauug

SEQ ID NO: 416797 - RNA, 19 nt, Homo sapiens
cauaaucugcauugucauu

SEQ ID NO: 416798 - RNA, 19 nt, Homo sapiens
gccguggucuucauaaucu

SEQ ID NO: 416799 - RNA, 19 nt, Homo sapiens
ccaccgcuauguccucuuc

SEQ ID NO: 416800 - RNA, 19 nt, Homo sapiens
cggaugacacggccgaaua

SEQ ID NO: 416801 - RNA, 19 nt, Homo sapiens
ggaaaccgaccagggcaaa

SEQ ID NO: 416802 - RNA, 19 nt, Homo sapiens
ggaguaccucggaagcuuu

SEQ ID NO: 416803 - RNA, 19 nt, Homo sapiens
gcucugcccgcuaccagua

SEQ ID NO: 416804 - RNA, 19 nt, Homo sapiens
ugaccaagcugcgggagau

SEQ ID NO: 416805 - RNA, 19 nt, Homo sapiens
ucaagcggcuggcuaacuc

SEQ ID NO: 416806 - RNA, 19 nt, Homo sapiens
gagcggaucaagccagaga

SEQ ID NO: 416807 - RNA, 19 nt, Homo sapiens
uucauaaucugcauuguca

SEQ ID NO: 416808 - RNA, 19 nt, Homo sapiens
gcuuugagacgauugaguu

SEQ ID NO: 416809 - RNA, 19 nt, Homo sapiens
gacauucucucugcacaag

SEQ ID NO: 416810 - RNA, 19 nt, Homo sapiens
gaucaugaagacaucaguu

SEQ ID NO: 416811 - RNA, 19 nt, Homo sapiens
cucaagacguuaaaugugu

SEQ ID NO: 416812 - RNA, 19 nt, Homo sapiens
ucaaggacucggccaacua

SEQ ID NO: 416813 - RNA, 19 nt, Homo sapiens
cgaggagcccugcagauug

SEQ ID NO: 416814 - RNA, 19 nt, Homo sapiens
augaguaccaguucuguua

SEQ ID NO: 416815 - RNA, 19 nt, Homo sapiens
acaacaugccucaguauau

SEQ ID NO: 416816 - RNA, 19 nt, Homo sapiens
gauggcagaauacaacaug

SEQ ID NO: 416817 - RNA, 19 nt, Homo sapiens
caguauggcggcuucgaua

SEQ ID NO: 416818 - RNA, 19 nt, Homo sapiens
gagcggaugcgguaugaag

SEQ ID NO: 416819 - RNA, 19 nt, Homo sapiens
guccgccaguuccaguuua

SEQ ID NO: 416820 - RNA, 19 nt, Homo sapiens
uacaagauccaguacaaug

SEQ ID NO: 416821 - RNA, 19 nt, Homo sapiens
caaguacgagcuccucuuc

SEQ ID NO: 416822 - RNA, 19 nt, Homo sapiens
gcugcgaucagaaaccuuu

SEQ ID NO: 416823 - RNA, 19 nt, Homo sapiens
uacaacaugccucaguaua

SEQ ID NO: 416824 - RNA, 19 nt, Homo sapiens
ucaagaaccgccuggugaa

SEQ ID NO: 416825 - RNA, 19 nt, Homo sapiens
gcccacacgucacgcuuca

SEQ ID NO: 416826 - RNA, 19 nt, Homo sapiens
acaagaauggcuccaguga

SEQ ID NO: 416827 - RNA, 19 nt, Homo sapiens
ggaacucacagaugucaag

SEQ ID NO: 416828 - RNA, 19 nt, Homo sapiens
ucucacagcccuccauugu

SEQ ID NO: 416829 - RNA, 19 nt, Homo sapiens
gaacaaacccgacaguaaa

SEQ ID NO: 416830 - RNA, 19 nt, Homo sapiens
gcaagaaggucaacucuca

SEQ ID NO: 416831 - RNA, 19 nt, Homo sapiens
ccaaaugccuccugaacaa

SEQ ID NO: 416832 - RNA, 19 nt, Homo sapiens
gcacauuccuccuuuccuu

SEQ ID NO: 416833 - RNA, 19 nt, Homo sapiens
guccagagcuauuucauug

SEQ ID NO: 416834 - RNA, 19 nt, Homo sapiens
cagauccuguguccuauua

SEQ ID NO: 416835 - RNA, 19 nt, Homo sapiens
gugccaaucugccuuguaa

SEQ ID NO: 416836 - RNA, 19 nt, Homo sapiens
gaggagaagucacggauca

SEQ ID NO: 416837 - RNA, 19 nt, Homo sapiens
cgagugaccuggaacaaga

SEQ ID NO: 416838 - RNA, 19 nt, Homo sapiens
gaagagcgagccuaccuuu

SEQ ID NO: 416839 - RNA, 19 nt, Homo sapiens
ucaaauacuuggcacauuc

SEQ ID NO: 416840 - RNA, 19 nt, Homo sapiens
caacaugccucaguauauc

SEQ ID NO: 416841 - RNA, 19 nt, Homo sapiens
ggacucccauggugacuga

SEQ ID NO: 416842 - RNA, 19 nt, Homo sapiens
aagaauggcuccagugaga

SEQ ID NO: 416843 - RNA, 19 nt, Homo sapiens
ggucaacucucagcgcuuu

SEQ ID NO: 416844 - RNA, 19 nt, Homo sapiens
ggagggcucugacuacauc

SEQ ID NO: 416845 - RNA, 19 nt, Homo sapiens
ggacauggaucuggaagag

SEQ ID NO: 416846 - RNA, 19 nt, Homo sapiens
uagauccgauggcagaaua

SEQ ID NO: 416847 - RNA, 19 nt, Homo sapiens
ggagaagugucaccaguac

SEQ ID NO: 416848 - RNA, 19 nt, Homo sapiens
ccaucgagcuggccacauu

SEQ ID NO: 416849 - RNA, 19 nt, Homo sapiens
ggaggucgcugccaagcau

SEQ ID NO: 416850 - RNA, 19 nt, Homo sapiens
caaggacccuguggaaaug

SEQ ID NO: 416851 - RNA, 19 nt, Homo sapiens
caggucacguugcuagaua

SEQ ID NO: 416852 - RNA, 19 nt, Homo sapiens
gaagugaacaagccgaaga

SEQ ID NO: 416853 - RNA, 19 nt, Homo sapiens
gaacagggugugccaaagu

SEQ ID NO: 416854 - RNA, 19 nt, Homo sapiens
gcaauggacgcaucaaaca

SEQ ID NO: 416855 - RNA, 19 nt, Homo sapiens
gcucgaggccucucuguga

SEQ ID NO: 416856 - RNA, 19 nt, Homo sapiens
ucacagcccuccauugucu

SEQ ID NO: 416857 - RNA, 19 nt, Homo sapiens
acacgucacuggcauggaa

SEQ ID NO: 416858 - RNA, 19 nt, Homo sapiens
agaacaaacccgacaguaa

SEQ ID NO: 416859 - RNA, 19 nt, Homo sapiens
ccagagcuauuucauugug

SEQ ID NO: 416860 - RNA, 19 nt, Homo sapiens
cgacaugggcccacaguug

SEQ ID NO: 416861 - RNA, 19 nt, Homo sapiens
caucaacgccagcuucauu

SEQ ID NO: 416862 - RNA, 19 nt, Homo sapiens
ugacgcggcuggaggagaa

SEQ ID NO: 416863 - RNA, 19 nt, Homo sapiens
ccaaggacccuguggaaau

SEQ ID NO: 416864 - RNA, 19 nt, Homo sapiens
ugaccacuaugcaaccuaa

SEQ ID NO: 416865 - RNA, 19 nt, Homo sapiens
aauacaacaugccucagua

SEQ ID NO: 416866 - RNA, 19 nt, Homo sapiens
gaauggcuccagugagaaa

SEQ ID NO: 416867 - RNA, 19 nt, Homo sapiens
ccuacaagauccaguacaa

SEQ ID NO: 416868 - RNA, 19 nt, Homo sapiens
gaacaagaagggcaagaag

SEQ ID NO: 416869 - RNA, 19 nt, Homo sapiens
augaaggucuccuggauuu

SEQ ID NO: 416870 - RNA, 19 nt, Homo sapiens
gccaagugcauaagacuaa

SEQ ID NO: 416871 - RNA, 19 nt, Homo sapiens
aggagaguaucaucaagua

SEQ ID NO: 416872 - RNA, 19 nt, Homo sapiens
gacaugggcccacaguuga

SEQ ID NO: 416873 - RNA, 19 nt, Homo sapiens
caacgcccuuccuggcuuu

SEQ ID NO: 416874 - RNA, 19 nt, Homo sapiens
ggccguaucagauuaaaga

SEQ ID NO: 416875 - RNA, 19 nt, Homo sapiens
gaauacaacaugccucagu

SEQ ID NO: 416876 - RNA, 19 nt, Homo sapiens
ggugaaaucucuccccaaa

SEQ ID NO: 416877 - RNA, 19 nt, Homo sapiens
ggaacaagaagggcaagaa

SEQ ID NO: 416878 - RNA, 19 nt, Homo sapiens
ccaugaaggucuccuggau

SEQ ID NO: 416879 - RNA, 19 nt, Homo sapiens
gggagaagugucaccagua

SEQ ID NO: 416880 - RNA, 19 nt, Homo sapiens
cgucagaacgcguacauug

SEQ ID NO: 416881 - RNA, 19 nt, Homo sapiens
gcaacuggcagaagcacaa

SEQ ID NO: 416882 - RNA, 19 nt, Homo sapiens
gcaggagaguaucaucaag

SEQ ID NO: 416883 - RNA, 19 nt, Homo sapiens
aaaccgaccagggcaaaua

SEQ ID NO: 416884 - RNA, 19 nt, Homo sapiens
uugagacgauugaguuuga

SEQ ID NO: 416885 - RNA, 19 nt, Homo sapiens
gagcgagccuaccuuugca

SEQ ID NO: 416886 - RNA, 19 nt, Homo sapiens
cggaagcuuugaccacuau

SEQ ID NO: 416887 - RNA, 19 nt, Homo sapiens
gcagacagaggaugaguac

SEQ ID NO: 416888 - RNA, 19 nt, Homo sapiens
ggaacagggugugccaaag

SEQ ID NO: 416889 - RNA, 19 nt, Homo sapiens
ucaagugugaucaguauug

SEQ ID NO: 416890 - RNA, 19 nt, Homo sapiens
cauaaucugcauugucauu

SEQ ID NO: 416891 - RNA, 19 nt, Homo sapiens
gccguggucuucauaaucu

SEQ ID NO: 416892 - RNA, 19 nt, Homo sapiens
ccaccgcuauguccucuuc

SEQ ID NO: 416893 - RNA, 19 nt, Homo sapiens
ggaaaccgaccagggcaaa

SEQ ID NO: 416894 - RNA, 19 nt, Homo sapiens
ggaguaccucggaagcuuu

SEQ ID NO: 416895 - RNA, 19 nt, Homo sapiens
gcucugcccgcuaccagua

SEQ ID NO: 416896 - RNA, 19 nt, Homo sapiens
ugaccaagcugcgggagau

SEQ ID NO: 416897 - RNA, 19 nt, Homo sapiens
ucaagcggcuggcuaacuc

SEQ ID NO: 416898 - RNA, 19 nt, Homo sapiens
gagcggaucaagccagaga

SEQ ID NO: 416899 - RNA, 19 nt, Homo sapiens
uucauaaucugcauuguca

SEQ ID NO: 416900 - RNA, 19 nt, Homo sapiens
gacauucucucugcacaag

SEQ ID NO: 416901 - RNA, 19 nt, Homo sapiens
gaucaugaagacaucaguu

SEQ ID NO: 416902 - RNA, 19 nt, Homo sapiens
ucaaggacucggccaacua

SEQ ID NO: 416903 - RNA, 19 nt, Homo sapiens
gcuuugagacgauugaguu

SEQ ID NO: 416904 - RNA, 19 nt, Homo sapiens
augaguaccaguucuguua

SEQ ID NO: 416905 - RNA, 19 nt, Homo sapiens
acaacaugccucaguauau

SEQ ID NO: 416906 - RNA, 19 nt, Homo sapiens
gauggcagaauacaacaug

SEQ ID NO: 416907 - RNA, 19 nt, Homo sapiens
caguauggcggcuucgaua

SEQ ID NO: 416908 - RNA, 19 nt, Homo sapiens
gagcggaugcgguaugaag

SEQ ID NO: 416909 - RNA, 19 nt, Homo sapiens
guccgccaguuccaguuua

SEQ ID NO: 416910 - RNA, 19 nt, Homo sapiens
uacaagauccaguacaaug

SEQ ID NO: 416911 - RNA, 19 nt, Homo sapiens
caaguacgagcuccucuuc

SEQ ID NO: 416912 - RNA, 19 nt, Homo sapiens
uacaacaugccucaguaua

SEQ ID NO: 416913 - RNA, 19 nt, Homo sapiens
ucaagaaccgccuggugaa

SEQ ID NO: 416914 - RNA, 19 nt, Homo sapiens
gcccacacgucacgcuuca

SEQ ID NO: 416915 - RNA, 19 nt, Homo sapiens
acaagaauggcuccaguga

SEQ ID NO: 416916 - RNA, 19 nt, Homo sapiens
ggaacucacagaugucaag

SEQ ID NO: 416917 - RNA, 19 nt, Homo sapiens
cagagaagacagucgaugu

SEQ ID NO: 416918 - RNA, 19 nt, Homo sapiens
gaccauggcgugcccgaau

SEQ ID NO: 416919 - RNA, 19 nt, Homo sapiens
ggacauucucucugcacaa

SEQ ID NO: 416920 - RNA, 19 nt, Homo sapiens
ucacguugcuagauaccau

SEQ ID NO: 416921 - RNA, 19 nt, Homo sapiens
ucucacagcccuccauugu

SEQ ID NO: 416922 - RNA, 19 nt, Homo sapiens
gaggaugaguaccaguucu

SEQ ID NO: 416923 - RNA, 19 nt, Homo sapiens
caagugugaucaguauugg

SEQ ID NO: 416924 - RNA, 19 nt, Homo sapiens
gaacgugcuggaacucaca

SEQ ID NO: 416925 - RNA, 19 nt, Homo sapiens
ucaccugguucaaggacuu

SEQ ID NO: 416926 - RNA, 19 nt, Homo sapiens
gggcuucaucgacuucauu

SEQ ID NO: 416927 - RNA, 19 nt, Homo sapiens
gggagggcuucaucgacuu

SEQ ID NO: 416928 - RNA, 19 nt, Homo sapiens
gaagucacggaucaagugu

SEQ ID NO: 416929 - RNA, 19 nt, Homo sapiens
gaacaaacccgacaguaaa

SEQ ID NO: 416930 - RNA, 19 nt, Homo sapiens
gcaagaaggucaacucuca

SEQ ID NO: 416931 - RNA, 19 nt, Homo sapiens
ccaaaugccuccugaacaa

SEQ ID NO: 416932 - RNA, 19 nt, Homo sapiens
gcacauuccuccuuuccuu

SEQ ID NO: 416933 - RNA, 19 nt, Homo sapiens
guccagagcuauuucauug

SEQ ID NO: 416934 - RNA, 19 nt, Homo sapiens
cagauccuguguccuauua

SEQ ID NO: 416935 - RNA, 19 nt, Homo sapiens
gugccaaucugccuuguaa

SEQ ID NO: 416936 - RNA, 19 nt, Homo sapiens
gaggagaagucacggauca

SEQ ID NO: 416937 - RNA, 19 nt, Homo sapiens
cgagugaccuggaacaaga

SEQ ID NO: 416938 - RNA, 19 nt, Homo sapiens
gaagagcgagccuaccuuu

SEQ ID NO: 416939 - RNA, 19 nt, Homo sapiens
gaccaagucucgcccaaga

SEQ ID NO: 416940 - RNA, 19 nt, Homo sapiens
ucaaauacuuggcacauuc

SEQ ID NO: 416941 - RNA, 19 nt, Homo sapiens
caacaugccucaguauauc

SEQ ID NO: 416942 - RNA, 19 nt, Homo sapiens
ggacucccauggugacuga

SEQ ID NO: 416943 - RNA, 19 nt, Homo sapiens
aagaauggcuccagugaga

SEQ ID NO: 416944 - RNA, 19 nt, Homo sapiens
ggucaacucucagcgcuuu

SEQ ID NO: 416945 - RNA, 19 nt, Homo sapiens
ggagggcucugacuacauc

SEQ ID NO: 416946 - RNA, 19 nt, Homo sapiens
ggacauggaucuggaagag

SEQ ID NO: 416947 - RNA, 19 nt, Homo sapiens
uagauccgauggcagaaua

SEQ ID NO: 416948 - RNA, 19 nt, Homo sapiens
ggagaagugucaccaguac

SEQ ID NO: 416949 - RNA, 19 nt, Homo sapiens
ccaucgagcuggccacauu

SEQ ID NO: 416950 - RNA, 19 nt, Homo sapiens
ggaggucgcugccaagcau

SEQ ID NO: 416951 - RNA, 19 nt, Homo sapiens
caaggacccuguggaaaug

SEQ ID NO: 416952 - RNA, 19 nt, Homo sapiens
caggucacguugcuagaua

SEQ ID NO: 416953 - RNA, 19 nt, Homo sapiens
gaagugaacaagccgaaga

SEQ ID NO: 416954 - RNA, 19 nt, Homo sapiens
gaacagggugugccaaagu

SEQ ID NO: 416955 - RNA, 19 nt, Homo sapiens
gcaauggacgcaucaaaca

SEQ ID NO: 416956 - RNA, 19 nt, Homo sapiens
gcucgaggccucucuguga

SEQ ID NO: 416957 - RNA, 19 nt, Homo sapiens
ucacagcccuccauugucu

SEQ ID NO: 416958 - RNA, 19 nt, Homo sapiens
acacgucacuggcauggaa

SEQ ID NO: 416959 - RNA, 19 nt, Homo sapiens
agaacaaacccgacaguaa

SEQ ID NO: 416960 - RNA, 19 nt, Homo sapiens
ccagagcuauuucauugug

SEQ ID NO: 416961 - RNA, 19 nt, Homo sapiens
cgacaugggcccacaguug

SEQ ID NO: 416962 - RNA, 19 nt, Homo sapiens
caucaacgccagcuucauu

SEQ ID NO: 416963 - RNA, 19 nt, Homo sapiens
ugacgcggcuggaggagaa

SEQ ID NO: 416964 - RNA, 19 nt, Homo sapiens
ccaaggacccuguggaaau

SEQ ID NO: 416965 - RNA, 19 nt, Homo sapiens
ugaccacuaugcaaccuaa

SEQ ID NO: 416966 - RNA, 19 nt, Homo sapiens
aauacaacaugccucagua

SEQ ID NO: 416967 - RNA, 19 nt, Homo sapiens
gaauggcuccagugagaaa

SEQ ID NO: 416968 - RNA, 19 nt, Homo sapiens
ccuacaagauccaguacaa

SEQ ID NO: 416969 - RNA, 19 nt, Homo sapiens
cgauggcgcucgcagcaaa

SEQ ID NO: 416970 - RNA, 19 nt, Homo sapiens
gaacaagaagggcaagaag

SEQ ID NO: 416971 - RNA, 19 nt, Homo sapiens
augaaggucuccuggauuu

SEQ ID NO: 416972 - RNA, 19 nt, Homo sapiens
gccaagugcauaagacuaa

SEQ ID NO: 416973 - RNA, 19 nt, Homo sapiens
aggagaguaucaucaagua

SEQ ID NO: 416974 - RNA, 19 nt, Homo sapiens
gacaugggcccacaguuga

SEQ ID NO: 416975 - RNA, 19 nt, Homo sapiens
caacgcccuuccuggcuuu

SEQ ID NO: 416976 - RNA, 19 nt, Homo sapiens
ggccguaucagauuaaaga

SEQ ID NO: 416977 - RNA, 19 nt, Homo sapiens
gaauacaacaugccucagu

SEQ ID NO: 416978 - RNA, 19 nt, Homo sapiens
ggugaaaucucuccccaaa

SEQ ID NO: 416979 - RNA, 19 nt, Homo sapiens
ggaacaagaagggcaagaa

SEQ ID NO: 416980 - RNA, 19 nt, Homo sapiens
gggagaagugucaccagua

SEQ ID NO: 416981 - RNA, 19 nt, Homo sapiens
cgucagaacgcguacauug

SEQ ID NO: 416982 - RNA, 19 nt, Homo sapiens
ccaugaaggucuccuggau

SEQ ID NO: 416983 - RNA, 19 nt, Homo sapiens
gcaacuggcagaagcacaa

SEQ ID NO: 416984 - RNA, 19 nt, Homo sapiens
gcaggagaguaucaucaag

SEQ ID NO: 416985 - RNA, 19 nt, Homo sapiens
aaaccgaccagggcaaaua

SEQ ID NO: 416986 - RNA, 19 nt, Homo sapiens
uugagacgauugaguuuga

SEQ ID NO: 416987 - RNA, 19 nt, Homo sapiens
gagcgagccuaccuuugca

SEQ ID NO: 416988 - RNA, 19 nt, Homo sapiens
cggaagcuuugaccacuau

SEQ ID NO: 416989 - RNA, 19 nt, Homo sapiens
gcagacagaggaugaguac

SEQ ID NO: 416990 - RNA, 19 nt, Homo sapiens
ggaacagggugugccaaag

SEQ ID NO: 416991 - RNA, 19 nt, Homo sapiens
ucaagugugaucaguauug

SEQ ID NO: 416992 - RNA, 19 nt, Homo sapiens
cauaaucugcauugucauu

SEQ ID NO: 416993 - RNA, 19 nt, Homo sapiens
gccguggucuucauaaucu

SEQ ID NO: 416994 - RNA, 19 nt, Homo sapiens
ccaccgcuauguccucuuc

SEQ ID NO: 416995 - RNA, 19 nt, Homo sapiens
ggaaaccgaccagggcaaa

SEQ ID NO: 416996 - RNA, 19 nt, Homo sapiens
ggaguaccucggaagcuuu

SEQ ID NO: 416997 - RNA, 19 nt, Homo sapiens
gcucugcccgcuaccagua

SEQ ID NO: 416998 - RNA, 19 nt, Homo sapiens
ugaccaagcugcgggagau

SEQ ID NO: 416999 - RNA, 19 nt, Homo sapiens
ucaagcggcuggcuaacuc

SEQ ID NO: 417000 - RNA, 19 nt, Homo sapiens
gagcggaucaagccagaga

SEQ ID NO: 417001 - RNA, 19 nt, Homo sapiens
uucauaaucugcauuguca

SEQ ID NO: 417002 - RNA, 19 nt, Homo sapiens
gacauucucucugcacaag

SEQ ID NO: 417003 - RNA, 19 nt, Homo sapiens
gaucaugaagacaucaguu

SEQ ID NO: 417004 - RNA, 19 nt, Homo sapiens
gcuuugagacgauugaguu

SEQ ID NO: 417005 - RNA, 19 nt, Homo sapiens
cucaagacguuaaaugugu

SEQ ID NO: 417006 - RNA, 19 nt, Homo sapiens
ucaaggacucggccaacua

SEQ ID NO: 417007 - RNA, 19 nt, Homo sapiens
augaguaccaguucuguua

SEQ ID NO: 417008 - RNA, 19 nt, Homo sapiens
acaacaugccucaguauau

SEQ ID NO: 417009 - RNA, 19 nt, Homo sapiens
gauggcagaauacaacaug

SEQ ID NO: 417010 - RNA, 19 nt, Homo sapiens
caguauggcggcuucgaua

SEQ ID NO: 417011 - RNA, 19 nt, Homo sapiens
gagcggaugcgguaugaag

SEQ ID NO: 417012 - RNA, 19 nt, Homo sapiens
guccgccaguuccaguuua

SEQ ID NO: 417013 - RNA, 19 nt, Homo sapiens
uacaagauccaguacaaug

SEQ ID NO: 417014 - RNA, 19 nt, Homo sapiens
caaguacgagcuccucuuc

SEQ ID NO: 417015 - RNA, 19 nt, Homo sapiens
uacaacaugccucaguaua

SEQ ID NO: 417016 - RNA, 19 nt, Homo sapiens
ucaagaaccgccuggugaa

SEQ ID NO: 417017 - RNA, 19 nt, Homo sapiens
gcccacacgucacgcuuca

SEQ ID NO: 417018 - RNA, 19 nt, Homo sapiens
acaagaauggcuccaguga

SEQ ID NO: 417019 - RNA, 19 nt, Homo sapiens
ggaacucacagaugucaag

SEQ ID NO: 417020 - RNA, 19 nt, Homo sapiens
cagagaagacagucgaugu

SEQ ID NO: 417021 - RNA, 19 nt, Homo sapiens
gaccauggcgugcccgaau

SEQ ID NO: 417022 - RNA, 19 nt, Homo sapiens
ggacauucucucugcacaa

SEQ ID NO: 417023 - RNA, 19 nt, Homo sapiens
ucacguugcuagauaccau

SEQ ID NO: 417024 - RNA, 19 nt, Homo sapiens
ucucacagcccuccauugu

SEQ ID NO: 417025 - RNA, 19 nt, Homo sapiens
gaggaugaguaccaguucu

SEQ ID NO: 417026 - RNA, 19 nt, Homo sapiens
caagugugaucaguauugg

SEQ ID NO: 417027 - RNA, 19 nt, Homo sapiens
gaacgugcuggaacucaca

SEQ ID NO: 417028 - RNA, 19 nt, Homo sapiens
ucaccugguucaaggacuu

SEQ ID NO: 417029 - RNA, 19 nt, Homo sapiens
gaacaaacccgacaguaaa

SEQ ID NO: 417030 - RNA, 19 nt, Homo sapiens
gcaagaaggucaacucuca

SEQ ID NO: 417031 - RNA, 19 nt, Homo sapiens
ccaaaugccuccugaacaa

SEQ ID NO: 417032 - RNA, 19 nt, Homo sapiens
gcacauuccuccuuuccuu

SEQ ID NO: 417033 - RNA, 19 nt, Homo sapiens
guccagagcuauuucauug

SEQ ID NO: 417034 - RNA, 19 nt, Homo sapiens
cagauccuguguccuauua

SEQ ID NO: 417035 - RNA, 19 nt, Homo sapiens
gugccaaucugccuuguaa

SEQ ID NO: 417036 - RNA, 19 nt, Homo sapiens
gaggagaagucacggauca

SEQ ID NO: 417037 - RNA, 19 nt, Homo sapiens
cgagugaccuggaacaaga

SEQ ID NO: 417038 - RNA, 19 nt, Homo sapiens
gaagagcgagccuaccuuu

SEQ ID NO: 417039 - RNA, 19 nt, Homo sapiens
ucaaauacuuggcacauuc

SEQ ID NO: 417040 - RNA, 19 nt, Homo sapiens
caacaugccucaguauauc

SEQ ID NO: 417041 - RNA, 19 nt, Homo sapiens
ggacucccauggugacuga

SEQ ID NO: 417042 - RNA, 19 nt, Homo sapiens
aagaauggcuccagugaga

SEQ ID NO: 417043 - RNA, 19 nt, Homo sapiens
ggucaacucucagcgcuuu

SEQ ID NO: 417044 - RNA, 19 nt, Homo sapiens
ggagggcucugacuacauc

SEQ ID NO: 417045 - RNA, 19 nt, Homo sapiens
ggacauggaucuggaagag

SEQ ID NO: 417046 - RNA, 19 nt, Homo sapiens
uagauccgauggcagaaua

SEQ ID NO: 417047 - RNA, 19 nt, Homo sapiens
ggagaagugucaccaguac

SEQ ID NO: 417048 - RNA, 19 nt, Homo sapiens
ccaucgagcuggccacauu

SEQ ID NO: 417049 - RNA, 19 nt, Homo sapiens
ggaggucgcugccaagcau

SEQ ID NO: 417050 - RNA, 19 nt, Homo sapiens
caaggacccuguggaaaug

SEQ ID NO: 417051 - RNA, 19 nt, Homo sapiens
caggucacguugcuagaua

SEQ ID NO: 417052 - RNA, 19 nt, Homo sapiens
gaagugaacaagccgaaga

SEQ ID NO: 417053 - RNA, 19 nt, Homo sapiens
gaacagggugugccaaagu

SEQ ID NO: 417054 - RNA, 19 nt, Homo sapiens
gcaauggacgcaucaaaca

SEQ ID NO: 417055 - RNA, 19 nt, Homo sapiens
gcucgaggccucucuguga

SEQ ID NO: 417056 - RNA, 19 nt, Homo sapiens
ucacagcccuccauugucu

SEQ ID NO: 417057 - RNA, 19 nt, Homo sapiens
acacgucacuggcauggaa

SEQ ID NO: 417058 - RNA, 19 nt, Homo sapiens
agaacaaacccgacaguaa

SEQ ID NO: 417059 - RNA, 19 nt, Homo sapiens
ccagagcuauuucauugug

SEQ ID NO: 417060 - RNA, 19 nt, Homo sapiens
cgacaugggcccacaguug

SEQ ID NO: 417061 - RNA, 19 nt, Homo sapiens
caucaacgccagcuucauu

SEQ ID NO: 417062 - RNA, 19 nt, Homo sapiens
ugacgcggcuggaggagaa

SEQ ID NO: 417063 - RNA, 19 nt, Homo sapiens
ccaaggacccuguggaaau

SEQ ID NO: 417064 - RNA, 19 nt, Homo sapiens
ugaccacuaugcaaccuaa

SEQ ID NO: 417065 - RNA, 19 nt, Homo sapiens
aauacaacaugccucagua

SEQ ID NO: 417066 - RNA, 19 nt, Homo sapiens
gaauggcuccagugagaaa

SEQ ID NO: 417067 - RNA, 19 nt, Homo sapiens
ccuacaagauccaguacaa

SEQ ID NO: 417068 - RNA, 19 nt, Homo sapiens
gaacaagaagggcaagaag

SEQ ID NO: 417069 - RNA, 19 nt, Homo sapiens
augaaggucuccuggauuu

SEQ ID NO: 417070 - RNA, 19 nt, Homo sapiens
gccaagugcauaagacuaa

SEQ ID NO: 417071 - RNA, 19 nt, Homo sapiens
aggagaguaucaucaagua

SEQ ID NO: 417072 - RNA, 19 nt, Homo sapiens
gacaugggcccacaguuga

SEQ ID NO: 417073 - RNA, 19 nt, Homo sapiens
caacgcccuuccuggcuuu

SEQ ID NO: 417074 - RNA, 19 nt, Homo sapiens
ggccguaucagauuaaaga

SEQ ID NO: 417075 - RNA, 19 nt, Homo sapiens
gaauacaacaugccucagu

SEQ ID NO: 417076 - RNA, 19 nt, Homo sapiens
ggugaaaucucuccccaaa

SEQ ID NO: 417077 - RNA, 19 nt, Homo sapiens
ggaacaagaagggcaagaa

SEQ ID NO: 417078 - RNA, 19 nt, Homo sapiens
ccaugaaggucuccuggau

SEQ ID NO: 417079 - RNA, 19 nt, Homo sapiens
gggagaagugucaccagua

SEQ ID NO: 417080 - RNA, 19 nt, Homo sapiens
cgucagaacgcguacauug

SEQ ID NO: 417081 - RNA, 19 nt, Homo sapiens
gcaacuggcagaagcacaa

SEQ ID NO: 417082 - RNA, 19 nt, Homo sapiens
gcaggagaguaucaucaag

SEQ ID NO: 417083 - RNA, 19 nt, Homo sapiens
aaaccgaccagggcaaaua

SEQ ID NO: 417084 - RNA, 19 nt, Homo sapiens
uugagacgauugaguuuga

SEQ ID NO: 417085 - RNA, 19 nt, Homo sapiens
gagcgagccuaccuuugca

SEQ ID NO: 417086 - RNA, 19 nt, Homo sapiens
cggaagcuuugaccacuau

SEQ ID NO: 417087 - RNA, 19 nt, Homo sapiens
gcagacagaggaugaguac

SEQ ID NO: 417088 - RNA, 19 nt, Homo sapiens
ggaacagggugugccaaag

SEQ ID NO: 417089 - RNA, 19 nt, Homo sapiens
ucaagugugaucaguauug

SEQ ID NO: 417090 - RNA, 19 nt, Homo sapiens
cauaaucugcauugucauu

SEQ ID NO: 417091 - RNA, 19 nt, Homo sapiens
gccguggucuucauaaucu

SEQ ID NO: 417092 - RNA, 19 nt, Homo sapiens
ccaccgcuauguccucuuc

SEQ ID NO: 417093 - RNA, 19 nt, Homo sapiens
ggaaaccgaccagggcaaa

SEQ ID NO: 417094 - RNA, 19 nt, Homo sapiens
ggaguaccucggaagcuuu

SEQ ID NO: 417095 - RNA, 19 nt, Homo sapiens
gcucugcccgcuaccagua

SEQ ID NO: 417096 - RNA, 19 nt, Homo sapiens
ugaccaagcugcgggagau

SEQ ID NO: 417097 - RNA, 19 nt, Homo sapiens
ucaagcggcuggcuaacuc

SEQ ID NO: 417098 - RNA, 19 nt, Homo sapiens
gagcggaucaagccagaga

SEQ ID NO: 417099 - RNA, 19 nt, Homo sapiens
uucauaaucugcauuguca

SEQ ID NO: 417100 - RNA, 19 nt, Homo sapiens
gacauucucucugcacaag

SEQ ID NO: 417101 - RNA, 19 nt, Homo sapiens
gaucaugaagacaucaguu

SEQ ID NO: 417102 - RNA, 19 nt, Homo sapiens
ucaaggacucggccaacua

SEQ ID NO: 417103 - RNA, 19 nt, Homo sapiens
gcuuugagacgauugaguu

SEQ ID NO: 417104 - RNA, 19 nt, Homo sapiens
augaguaccaguucuguua

SEQ ID NO: 417105 - RNA, 19 nt, Homo sapiens
acaacaugccucaguauau

SEQ ID NO: 417106 - RNA, 19 nt, Homo sapiens
gauggcagaauacaacaug

SEQ ID NO: 417107 - RNA, 19 nt, Homo sapiens
caguauggcggcuucgaua

SEQ ID NO: 417108 - RNA, 19 nt, Homo sapiens
gagcggaugcgguaugaag

SEQ ID NO: 417109 - RNA, 19 nt, Homo sapiens
guccgccaguuccaguuua

SEQ ID NO: 417110 - RNA, 19 nt, Homo sapiens
uacaagauccaguacaaug

SEQ ID NO: 417111 - RNA, 19 nt, Homo sapiens
caaguacgagcuccucuuc

SEQ ID NO: 417112 - RNA, 19 nt, Homo sapiens
uacaacaugccucaguaua

SEQ ID NO: 417113 - RNA, 19 nt, Homo sapiens
ucaagaaccgccuggugaa

SEQ ID NO: 417114 - RNA, 19 nt, Homo sapiens
gcccacacgucacgcuuca

SEQ ID NO: 417115 - RNA, 19 nt, Homo sapiens
acaagaauggcuccaguga

SEQ ID NO: 417116 - RNA, 19 nt, Homo sapiens
ggaacucacagaugucaag

SEQ ID NO: 417117 - RNA, 19 nt, Homo sapiens
cagagaagacagucgaugu

SEQ ID NO: 417118 - RNA, 19 nt, Homo sapiens
gaccauggcgugcccgaau

SEQ ID NO: 417119 - RNA, 19 nt, Homo sapiens
ggacauucucucugcacaa

SEQ ID NO: 417120 - RNA, 19 nt, Homo sapiens
ucacguugcuagauaccau

SEQ ID NO: 417121 - RNA, 19 nt, Homo sapiens
ucucacagcccuccauugu

SEQ ID NO: 417122 - RNA, 19 nt, Homo sapiens
gaggaugaguaccaguucu

SEQ ID NO: 417123 - RNA, 19 nt, Homo sapiens
caagugugaucaguauugg

SEQ ID NO: 417124 - RNA, 19 nt, Homo sapiens
gaacgugcuggaacucaca

SEQ ID NO: 417125 - RNA, 19 nt, Homo sapiens
ucaccugguucaaggacuu

SEQ ID NO: 417126 - RNA, 19 nt, Homo sapiens
gggcuucaucgacuucauu

SEQ ID NO: 417127 - RNA, 19 nt, Homo sapiens
gggagggcuucaucgacuu

SEQ ID NO: 417128 - RNA, 19 nt, Homo sapiens
gaagucacggaucaagugu

SEQ ID NO: 417129 - RNA, 19 nt, Homo sapiens
caacauauuuggcuucuua

SEQ ID NO: 417130 - RNA, 19 nt, Homo sapiens
gcacaagaaucgauacaua

SEQ ID NO: 417131 - RNA, 19 nt, Homo sapiens
gaacacaaaugucuaucua

SEQ ID NO: 417132 - RNA, 19 nt, Homo sapiens
cgaaggaacugucaacaua

SEQ ID NO: 417133 - RNA, 19 nt, Homo sapiens
ggaaagaccucgagucguu

SEQ ID NO: 417134 - RNA, 19 nt, Homo sapiens
gagauuggcugguccuaua

SEQ ID NO: 417135 - RNA, 19 nt, Homo sapiens
uaacaaaccucguggagaa

SEQ ID NO: 417136 - RNA, 19 nt, Homo sapiens
gaacauaucccaaggguau

SEQ ID NO: 417137 - RNA, 19 nt, Homo sapiens
guuaagagcuuuauccauu

SEQ ID NO: 417138 - RNA, 19 nt, Homo sapiens
gagcuguacuguugacuua

SEQ ID NO: 417139 - RNA, 19 nt, Homo sapiens
aaacaaagcuagagaaaca

SEQ ID NO: 417140 - RNA, 19 nt, Homo sapiens
caacucagcucuuauuuua

SEQ ID NO: 417141 - RNA, 19 nt, Homo sapiens
gugcagagcuguacuguug

SEQ ID NO: 417142 - RNA, 19 nt, Homo sapiens
guucuuagaucuccacaua

SEQ ID NO: 417143 - RNA, 19 nt, Homo sapiens
caaagcauguugcagauuu

SEQ ID NO: 417144 - RNA, 19 nt, Homo sapiens
gcaggugacucagaaauaa

SEQ ID NO: 417145 - RNA, 19 nt, Homo sapiens
gcaaauuccuucuuucaau

SEQ ID NO: 417146 - RNA, 19 nt, Homo sapiens
acaccuaucuuuccaauuu

SEQ ID NO: 417147 - RNA, 19 nt, Homo sapiens
gaaaugguguuuaaagcaa

SEQ ID NO: 417148 - RNA, 19 nt, Homo sapiens
gaagaaggcgcuauuguga

SEQ ID NO: 417149 - RNA, 19 nt, Homo sapiens
uaucaggguuccuuauuua

SEQ ID NO: 417150 - RNA, 19 nt, Homo sapiens
gaagugaauucucuggaaa

SEQ ID NO: 417151 - RNA, 19 nt, Homo sapiens
agaaauaacuccuggauuc

SEQ ID NO: 417152 - RNA, 19 nt, Homo sapiens
ggaaagaaauauccaacau

SEQ ID NO: 417153 - RNA, 19 nt, Homo sapiens
gaauggaauugugguauuu

SEQ ID NO: 417154 - RNA, 19 nt, Homo sapiens
ggaaguuauugucaugaua

SEQ ID NO: 417155 - RNA, 19 nt, Homo sapiens
ggagcaauaugucuucauu

SEQ ID NO: 417156 - RNA, 19 nt, Homo sapiens
ggaagugaauucucuggaa

SEQ ID NO: 417157 - RNA, 19 nt, Homo sapiens
gaaaggaagagauucauga

SEQ ID NO: 417158 - RNA, 19 nt, Homo sapiens
caauaugucuucauucaug

SEQ ID NO: 417159 - RNA, 19 nt, Homo sapiens
aaacucaacugacaaguau

SEQ ID NO: 417160 - RNA, 19 nt, Homo sapiens
ggaagaacaggcacauaua

SEQ ID NO: 417161 - RNA, 19 nt, Homo sapiens
ucuauacacuggaggauua

SEQ ID NO: 417162 - RNA, 19 nt, Homo sapiens
gcagaggccaguaauagua

SEQ ID NO: 417163 - RNA, 19 nt, Homo sapiens
caaaucugaugccgguuua

SEQ ID NO: 417164 - RNA, 19 nt, Homo sapiens
cauaugcacuaauggcuua

SEQ ID NO: 417165 - RNA, 19 nt, Homo sapiens
gcaacaaucugguuauguc

SEQ ID NO: 417166 - RNA, 19 nt, Homo sapiens
ggaaaacaguggaaauuaa

SEQ ID NO: 417167 - RNA, 19 nt, Homo sapiens
gacaguaacuuucaugaca

SEQ ID NO: 417168 - RNA, 19 nt, Homo sapiens
ugacagcccuuaacauuuc

SEQ ID NO: 417169 - RNA, 19 nt, Homo sapiens
gcacaaggcaggaagagaa

SEQ ID NO: 417170 - RNA, 19 nt, Homo sapiens
guacaguaaugaugaguug

SEQ ID NO: 417171 - RNA, 19 nt, Homo sapiens
gaaauguuaucuccuucaa

SEQ ID NO: 417172 - RNA, 19 nt, Homo sapiens
ccaccucucuggacaguaa

SEQ ID NO: 417173 - RNA, 19 nt, Homo sapiens
uaaauaucguugccuauga

SEQ ID NO: 417174 - RNA, 19 nt, Homo sapiens
ugagaaauaugaaccaguu

SEQ ID NO: 417175 - RNA, 19 nt, Homo sapiens
ggcagaagaugaauuuguu

SEQ ID NO: 417176 - RNA, 19 nt, Homo sapiens
gaagaacaggcacauauau

SEQ ID NO: 417177 - RNA, 19 nt, Homo sapiens
gcauucagcuccucugugu

SEQ ID NO: 417178 - RNA, 19 nt, Homo sapiens
ucagauagccuuaaugaga

SEQ ID NO: 417179 - RNA, 19 nt, Homo sapiens
gauaauagagucacaagug

SEQ ID NO: 417180 - RNA, 19 nt, Homo sapiens
aagaugagccuauaaauug

SEQ ID NO: 417181 - RNA, 19 nt, Homo sapiens
caaacugacugauuauauc

SEQ ID NO: 417182 - RNA, 19 nt, Homo sapiens
gcauacaguuucucaaauc

SEQ ID NO: 417183 - RNA, 19 nt, Homo sapiens
ggagggaaaugugugguuu

SEQ ID NO: 417184 - RNA, 19 nt, Homo sapiens
gagcuuagagucuuuaguu

SEQ ID NO: 417185 - RNA, 19 nt, Homo sapiens
gcaaacugacugauuauau

SEQ ID NO: 417186 - RNA, 19 nt, Homo sapiens
gaaugagacuuccacagau

SEQ ID NO: 417187 - RNA, 19 nt, Homo sapiens
gggcaguucugacaaguga

SEQ ID NO: 417188 - RNA, 19 nt, Homo sapiens
ugagauacguguugaugaa

SEQ ID NO: 417189 - RNA, 19 nt, Homo sapiens
gaagaacacaaaugucuau

SEQ ID NO: 417190 - RNA, 19 nt, Homo sapiens
gaaucgaacuucuucuauc

SEQ ID NO: 417191 - RNA, 19 nt, Homo sapiens
aaacacauccguucacaaa

SEQ ID NO: 417192 - RNA, 19 nt, Homo sapiens
cagauagccuuaaugagaa

SEQ ID NO: 417193 - RNA, 19 nt, Homo sapiens
caaauuccuucuuucaaug

SEQ ID NO: 417194 - RNA, 19 nt, Homo sapiens
gaucaaggguuggcauuuc

SEQ ID NO: 417195 - RNA, 19 nt, Homo sapiens
cgacaugccuacugauaau

SEQ ID NO: 417196 - RNA, 19 nt, Homo sapiens
acuaauggcuuauauggaa

SEQ ID NO: 417197 - RNA, 19 nt, Homo sapiens
gaucagagcauaguuuaga

SEQ ID NO: 417198 - RNA, 19 nt, Homo sapiens
gagaauaacaccuuaccaa

SEQ ID NO: 417199 - RNA, 19 nt, Homo sapiens
gcacucugcuucacuucaa

SEQ ID NO: 417200 - RNA, 19 nt, Homo sapiens
caacugcaguauucaccua

SEQ ID NO: 417201 - RNA, 19 nt, Homo sapiens
cagguuugcuagaaauaua

SEQ ID NO: 417202 - RNA, 19 nt, Homo sapiens
acacauccguucacaaaga

SEQ ID NO: 417203 - RNA, 19 nt, Homo sapiens
cagaaguccugguaaauca

SEQ ID NO: 417204 - RNA, 19 nt, Homo sapiens
gguaagguauuugcuggua

SEQ ID NO: 417205 - RNA, 19 nt, Homo sapiens
gcccagugauccaauauug

SEQ ID NO: 417206 - RNA, 19 nt, Homo sapiens
uaaguugaaugcgucuuua

SEQ ID NO: 417207 - RNA, 19 nt, Homo sapiens
gauaauaaggcgcuuucua

SEQ ID NO: 417208 - RNA, 19 nt, Homo sapiens
gaaagaaauauccaacaug

SEQ ID NO: 417209 - RNA, 19 nt, Homo sapiens
gcuuagagucuuuaguuua

SEQ ID NO: 417210 - RNA, 19 nt, Homo sapiens
gaacaggcacauauauugu

SEQ ID NO: 417211 - RNA, 19 nt, Homo sapiens
ucaaauccuuccacaaguu

SEQ ID NO: 417212 - RNA, 19 nt, Homo sapiens
uauaccagccuucuuguua

SEQ ID NO: 417213 - RNA, 19 nt, Homo sapiens
aauaacaccuuaccaaaca

SEQ ID NO: 417214 - RNA, 19 nt, Homo sapiens
guauucaccuaaaguagaa

SEQ ID NO: 417215 - RNA, 19 nt, Homo sapiens
gguuaggaauuccaaacua

SEQ ID NO: 417216 - RNA, 19 nt, Homo sapiens
ggaacuuucuggucacuca

SEQ ID NO: 417217 - RNA, 19 nt, Homo sapiens
ucagaaguguuccacguuu

SEQ ID NO: 417218 - RNA, 19 nt, Homo sapiens
gcuuauacauuccgaugaa

SEQ ID NO: 417219 - RNA, 19 nt, Homo sapiens
caaauucugcuucaaguga

SEQ ID NO: 417220 - RNA, 19 nt, Homo sapiens
cagagacaauaacauauga

SEQ ID NO: 417221 - RNA, 19 nt, Homo sapiens
gcagaauccuuaaauacag

SEQ ID NO: 417222 - RNA, 19 nt, Homo sapiens
caacaccuaucuuuccaau

SEQ ID NO: 417223 - RNA, 19 nt, Homo sapiens
gacaagugaugaagaaagu

SEQ ID NO: 417224 - RNA, 19 nt, Homo sapiens
uaagguauuugcugguauu

SEQ ID NO: 417225 - RNA, 19 nt, Homo sapiens
ggaauuugguagugaaucu

SEQ ID NO: 417226 - RNA, 19 nt, Homo sapiens
caaacucaacugacaagua

SEQ ID NO: 417227 - RNA, 19 nt, Homo sapiens
gcaguauucaccuaaagua

SEQ ID NO: 417228 - RNA, 19 nt, Homo sapiens
aaacauggcagaagaugaa

SEQ ID NO: 417229 - RNA, 19 nt, Homo sapiens
gaaucuggcugaucucaaa

SEQ ID NO: 417230 - RNA, 19 nt, Homo sapiens
gcucuggagugccuauuua

SEQ ID NO: 417231 - RNA, 19 nt, Homo sapiens
gaagaaaacuugaaacugu

SEQ ID NO: 417232 - RNA, 19 nt, Homo sapiens
gacaguacauggagagauu

SEQ ID NO: 417233 - RNA, 19 nt, Homo sapiens
gcacaaagcccaguuucuu

SEQ ID NO: 417234 - RNA, 19 nt, Homo sapiens
ggugugggauuauuugaaa

SEQ ID NO: 417235 - RNA, 19 nt, Homo sapiens
ucgaguaggugaaucuuaa

SEQ ID NO: 417236 - RNA, 19 nt, Homo sapiens
gaucauaagaaucuggaua

SEQ ID NO: 417237 - RNA, 19 nt, Homo sapiens
gccaugggcacaauuauaa

SEQ ID NO: 417238 - RNA, 19 nt, Homo sapiens
ggaaaugcaacaauccaaa

SEQ ID NO: 417239 - RNA, 19 nt, Homo sapiens
gggacaaccuccagaaagu

SEQ ID NO: 417240 - RNA, 19 nt, Homo sapiens
auaagaaucuggauaugga

SEQ ID NO: 417241 - RNA, 19 nt, Homo sapiens
gggcacaauuauaaaguug

SEQ ID NO: 417242 - RNA, 19 nt, Homo sapiens
gaaaugcaacaauccaaau

SEQ ID NO: 417243 - RNA, 19 nt, Homo sapiens
gagcacgacugaaaaugua

SEQ ID NO: 417244 - RNA, 19 nt, Homo sapiens
gagugccuauuuauugaaa

SEQ ID NO: 417245 - RNA, 19 nt, Homo sapiens
cuacgggaaugguuaugaa

SEQ ID NO: 417246 - RNA, 19 nt, Homo sapiens
ggccaugggcacaauuaua

SEQ ID NO: 417247 - RNA, 19 nt, Homo sapiens
ccaguuucuuucuguguuu

SEQ ID NO: 417248 - RNA, 19 nt, Homo sapiens
cuguaggaguucuuuauaa

SEQ ID NO: 417249 - RNA, 19 nt, Homo sapiens
uggagugccuauuuauuga

SEQ ID NO: 417250 - RNA, 19 nt, Homo sapiens
ggacaaccuccagaaaguu

SEQ ID NO: 417251 - RNA, 19 nt, Homo sapiens
guggugagcacgacugaaa

SEQ ID NO: 417252 - RNA, 19 nt, Homo sapiens
ccgauuguacaguaaauuu

SEQ ID NO: 417253 - RNA, 19 nt, Homo sapiens
ggagagauugacccugcua

SEQ ID NO: 417254 - RNA, 19 nt, Homo sapiens
cauuguaagaccuguuaua

SEQ ID NO: 417255 - RNA, 19 nt, Homo sapiens
uuaugaaucuggcugaucu

SEQ ID NO: 417256 - RNA, 19 nt, Homo sapiens
ccuguaggaguucuuuaua

SEQ ID NO: 417257 - RNA, 19 nt, Homo sapiens
agccaccgauuguacagua

SEQ ID NO: 417258 - RNA, 19 nt, Homo sapiens
ggagugccuauuuauugaa

SEQ ID NO: 417259 - RNA, 19 nt, Homo sapiens
cuggagugccuauuuauug

SEQ ID NO: 417260 - RNA, 19 nt, Homo sapiens
gaggucaacacgugauugu

SEQ ID NO: 417261 - RNA, 19 nt, Homo sapiens
gaaucuggauauggaugug

SEQ ID NO: 417262 - RNA, 19 nt, Homo sapiens
cgggaaugguuaugaaucu

SEQ ID NO: 417263 - RNA, 19 nt, Homo sapiens
gacaaccuccagaaaguuc

SEQ ID NO: 417264 - RNA, 19 nt, Homo sapiens
cugaaaauguagcuguuua

SEQ ID NO: 417265 - RNA, 19 nt, Homo sapiens
ugccauacuuugcagaugu

SEQ ID NO: 417266 - RNA, 19 nt, Homo sapiens
gcuuaugugacuucgagua

SEQ ID NO: 417267 - RNA, 19 nt, Homo sapiens
gggaaaugcaacaauccaa

SEQ ID NO: 417268 - RNA, 19 nt, Homo sapiens
gccaccgauuguacaguaa

SEQ ID NO: 417269 - RNA, 19 nt, Homo sapiens
ugggcacaauuauaaaguu

SEQ ID NO: 417270 - RNA, 19 nt, Homo sapiens
gccauacuuugcagaugug

SEQ ID NO: 417271 - RNA, 19 nt, Homo sapiens
gggaaugguuaugaaucug

SEQ ID NO: 417272 - RNA, 19 nt, Homo sapiens
uaugugacuucgaguaggu

SEQ ID NO: 417273 - RNA, 19 nt, Homo sapiens
ggguuagcauugcacaaag

SEQ ID NO: 417274 - RNA, 19 nt, Homo sapiens
uuauaaaguuguggugaca

SEQ ID NO: 417275 - RNA, 19 nt, Homo sapiens
auaaaguuguggugacagu

SEQ ID NO: 417276 - RNA, 19 nt, Homo sapiens
guauacgaaacugacaaua

SEQ ID NO: 417277 - RNA, 19 nt, Homo sapiens
caaauggccaugggcacaa

SEQ ID NO: 417278 - RNA, 19 nt, Homo sapiens
gcuacgggaaugguuauga

SEQ ID NO: 417279 - RNA, 19 nt, Homo sapiens
cgaguaggugaaucuuaaa

SEQ ID NO: 417280 - RNA, 19 nt, Homo sapiens
cccaguuucuuucuguguu

SEQ ID NO: 417281 - RNA, 19 nt, Homo sapiens
aagcccaguuucuuucugu

SEQ ID NO: 417282 - RNA, 19 nt, Homo sapiens
ccaccgauuguacaguaaa

SEQ ID NO: 417283 - RNA, 19 nt, Homo sapiens
gaagaugagcacggaaggu

SEQ ID NO: 417284 - RNA, 19 nt, Homo sapiens
gcgcgagccaccgauugua

SEQ ID NO: 417285 - RNA, 19 nt, Homo sapiens
caccgauuguacaguaaau

SEQ ID NO: 417286 - RNA, 19 nt, Homo sapiens
aaaugcaacaauccaaaug

SEQ ID NO: 417287 - RNA, 19 nt, Homo sapiens
uaaaguuguggugacagua

SEQ ID NO: 417288 - RNA, 19 nt, Homo sapiens
uuugggaaaugcaacaauc

SEQ ID NO: 417289 - RNA, 19 nt, Homo sapiens
ccaugggcacaauuauaaa

SEQ ID NO: 417290 - RNA, 19 nt, Homo sapiens
ggaugugccauacuuugca

SEQ ID NO: 417291 - RNA, 19 nt, Homo sapiens
gaaagaaacucacacuuaa

SEQ ID NO: 417292 - RNA, 19 nt, Homo sapiens
gcacaaagaggaauccaua

SEQ ID NO: 417293 - RNA, 19 nt, Homo sapiens
caaggugacuuaacaacua

SEQ ID NO: 417294 - RNA, 19 nt, Homo sapiens
caaugaggcuugagucuuu

SEQ ID NO: 417295 - RNA, 19 nt, Homo sapiens
guaaagcucuacuguaaau

SEQ ID NO: 417296 - RNA, 19 nt, Homo sapiens
agaaagaaacucacacuua

SEQ ID NO: 417297 - RNA, 19 nt, Homo sapiens
ccacagauguauuaaacaa

SEQ ID NO: 417298 - RNA, 19 nt, Homo sapiens
caaagccacagauguauua

SEQ ID NO: 417299 - RNA, 19 nt, Homo sapiens
gaacucggaugauuaugau

SEQ ID NO: 417300 - RNA, 19 nt, Homo sapiens
ggucaaagccacagaugua

SEQ ID NO: 417301 - RNA, 19 nt, Homo sapiens
uaggaacacuugagacuaa

SEQ ID NO: 417302 - RNA, 19 nt, Homo sapiens
gaguugagaccaaucuuua

SEQ ID NO: 417303 - RNA, 19 nt, Homo sapiens
cauaugaaauccagcugua

SEQ ID NO: 417304 - RNA, 19 nt, Homo sapiens
caaagaggaauccauauga

SEQ ID NO: 417305 - RNA, 19 nt, Homo sapiens
uuguaaagcucuacuguaa

SEQ ID NO: 417306 - RNA, 19 nt, Homo sapiens
uaagauuuguuguccauug

SEQ ID NO: 417307 - RNA, 19 nt, Homo sapiens
uggcuuugaugaaacauua

SEQ ID NO: 417308 - RNA, 19 nt, Homo sapiens
gaaggaaagacauuggaaa

SEQ ID NO: 417309 - RNA, 19 nt, Homo sapiens
gcaaugaagagauaagaga

SEQ ID NO: 417310 - RNA, 19 nt, Homo sapiens
aaagaggaauccauaugaa

SEQ ID NO: 417311 - RNA, 19 nt, Homo sapiens
ggugguggcuuugaugaaa

SEQ ID NO: 417312 - RNA, 19 nt, Homo sapiens
gaacaaacugguugcugaa

SEQ ID NO: 417313 - RNA, 19 nt, Homo sapiens
gccaaauacugaauaaaca

SEQ ID NO: 417314 - RNA, 19 nt, Homo sapiens
gaacacuugagacuaauga

SEQ ID NO: 417315 - RNA, 19 nt, Homo sapiens
ccaaugcguuccaagaaga

SEQ ID NO: 417316 - RNA, 19 nt, Homo sapiens
ggccacaggucacauuguu

SEQ ID NO: 417317 - RNA, 19 nt, Homo sapiens
gggacaagcucuucaucau

SEQ ID NO: 417318 - RNA, 19 nt, Homo sapiens
ugagaccaaucuuuauuug

SEQ ID NO: 417319 - RNA, 19 nt, Homo sapiens
cuggagaacucgcagauga

SEQ ID NO: 417320 - RNA, 19 nt, Homo sapiens
ugaauaaacaguugaagga

SEQ ID NO: 417321 - RNA, 19 nt, Homo sapiens
gaaauccagcuguaucuca

SEQ ID NO: 417322 - RNA, 19 nt, Homo sapiens
ggacaacgaaauagacaau

SEQ ID NO: 417323 - RNA, 19 nt, Homo sapiens
gaucucauguaugugaauu

SEQ ID NO: 417324 - RNA, 19 nt, Homo sapiens
ggacaagcucuucaucaug

SEQ ID NO: 417325 - RNA, 19 nt, Homo sapiens
gagaagauagucauauaag

SEQ ID NO: 417326 - RNA, 19 nt, Homo sapiens
gggauaguguucuuagcaa

SEQ ID NO: 417327 - RNA, 19 nt, Homo sapiens
gaauaaacaguugaaggaa

SEQ ID NO: 417328 - RNA, 19 nt, Homo sapiens
ucucuggucugcaguguug

SEQ ID NO: 417329 - RNA, 19 nt, Homo sapiens
uggaggagcucaguauguu

SEQ ID NO: 417330 - RNA, 19 nt, Homo sapiens
cuaccaauccauaguguuu

SEQ ID NO: 417331 - RNA, 19 nt, Homo sapiens
ggauaguguucuuagcaau

SEQ ID NO: 417332 - RNA, 19 nt, Homo sapiens
uauacuacaaggugacuua

SEQ ID NO: 417333 - RNA, 19 nt, Homo sapiens
gaugaaacauuagccuucu

SEQ ID NO: 417334 - RNA, 19 nt, Homo sapiens
ucauguaugugaauuugga

SEQ ID NO: 417335 - RNA, 19 nt, Homo sapiens
uguccauuguucauuguua

SEQ ID NO: 417336 - RNA, 19 nt, Homo sapiens
aaaggacuguauuguugaa

SEQ ID NO: 417337 - RNA, 19 nt, Homo sapiens
ggagcagagucuugucaca

SEQ ID NO: 417338 - RNA, 19 nt, Homo sapiens
ggauaauguuacuagacuu

SEQ ID NO: 417339 - RNA, 19 nt, Homo sapiens
gggaaggucugaaaacuca

SEQ ID NO: 417340 - RNA, 19 nt, Homo sapiens
ucucauguaugugaauuug

SEQ ID NO: 417341 - RNA, 19 nt, Homo sapiens
gaaaacucagugcauaaua

SEQ ID NO: 417342 - RNA, 19 nt, Homo sapiens
auaaacaguugaaggaaag

SEQ ID NO: 417343 - RNA, 19 nt, Homo sapiens
guugagaccaaucuuuauu

SEQ ID NO: 417344 - RNA, 19 nt, Homo sapiens
ccacuugaagccaaagaaa

SEQ ID NO: 417345 - RNA, 19 nt, Homo sapiens
gauaguguucuuagcaaug

SEQ ID NO: 417346 - RNA, 19 nt, Homo sapiens
ggagaacucgcagaugaga

SEQ ID NO: 417347 - RNA, 19 nt, Homo sapiens
auaaucgaaugucacguuu

SEQ ID NO: 417348 - RNA, 19 nt, Homo sapiens
acuacaaggugacuuaaca

SEQ ID NO: 417349 - RNA, 19 nt, Homo sapiens
ggaggagcucaguauguuu

SEQ ID NO: 417350 - RNA, 19 nt, Homo sapiens
uauaaucgaaugucacguu

SEQ ID NO: 417351 - RNA, 19 nt, Homo sapiens
gauuuguuguccauuguuc

SEQ ID NO: 417352 - RNA, 19 nt, Homo sapiens
ggccaaauacugaauaaac

SEQ ID NO: 417353 - RNA, 19 nt, Homo sapiens
gaccaaucuuuauuuguac

SEQ ID NO: 417354 - RNA, 19 nt, Homo sapiens
gaggagcucaguauguuuc

SEQ ID NO: 417355 - RNA, 19 nt, Homo sapiens
ucacaggcuucaauaucug

SEQ ID NO: 417356 - RNA, 19 nt, Homo sapiens
guggguaaauggugaacug

SEQ ID NO: 417357 - RNA, 19 nt, Homo sapiens
caccuggaauucagaggaa

SEQ ID NO: 417358 - RNA, 19 nt, Homo sapiens
gaggaauccauaugaaauc

SEQ ID NO: 417359 - RNA, 19 nt, Homo sapiens
acaaagaggaauccauaug

SEQ ID NO: 417360 - RNA, 19 nt, Homo sapiens
caacgaaauagacaaugga

SEQ ID NO: 417361 - RNA, 19 nt, Homo sapiens
acaacgaaauagacaaugg

SEQ ID NO: 417362 - RNA, 19 nt, Homo sapiens
agacucacaggcuucaaua

SEQ ID NO: 417363 - RNA, 19 nt, Homo sapiens
gccggcagguugugaaaca

SEQ ID NO: 417364 - RNA, 19 nt, Homo sapiens
ccaaagaaagaaacucaca

SEQ ID NO: 417365 - RNA, 19 nt, Homo sapiens
ggaaugggacaagcucuuc

SEQ ID NO: 417366 - RNA, 19 nt, Homo sapiens
ucucagcuaccaauccaua

SEQ ID NO: 417367 - RNA, 19 nt, Homo sapiens
ggaagcgugcauccaguga

SEQ ID NO: 417368 - RNA, 19 nt, Homo sapiens
agaacucggaugauuauga

SEQ ID NO: 417369 - RNA, 19 nt, Homo sapiens
guccauuguucauuguuau

SEQ ID NO: 417370 - RNA, 19 nt, Homo sapiens
ucaaagccacagauguauu

SEQ ID NO: 417371 - RNA, 19 nt, Homo sapiens
ggugacuuaacaacuauaa

SEQ ID NO: 417372 - RNA, 19 nt, Homo sapiens
ggccagagaugaauuuuac

SEQ ID NO: 417373 - RNA, 19 nt, Homo sapiens
ugaggauaauguuacuaga

SEQ ID NO: 417374 - RNA, 19 nt, Homo sapiens
agagagaguugagaccaau

SEQ ID NO: 417375 - RNA, 19 nt, Homo sapiens
acagagauccagccacaug

SEQ ID NO: 417376 - RNA, 19 nt, Homo sapiens
auaguguucuuagcaauga

SEQ ID NO: 417377 - RNA, 19 nt, Homo sapiens
agaggaauccauaugaaau

SEQ ID NO: 417378 - RNA, 19 nt, Homo sapiens
gagaugaauuuuacauugg

SEQ ID NO: 417379 - RNA, 19 nt, Homo sapiens
cuaaugaaagagagaguug

SEQ ID NO: 417380 - RNA, 19 nt, Homo sapiens
acacuugagacuaaugaaa

SEQ ID NO: 417381 - RNA, 19 nt, Homo sapiens
ggcuaccacuguugagaug

SEQ ID NO: 417382 - RNA, 19 nt, Homo sapiens
aagaggaauccauaugaaa

SEQ ID NO: 417383 - RNA, 19 nt, Homo sapiens
aagcgugcauccagugaga

SEQ ID NO: 417384 - RNA, 19 nt, Homo sapiens
guucauuguuauugguaug

SEQ ID NO: 417385 - RNA, 19 nt, Homo sapiens
guacuggccaaauacugaa

SEQ ID NO: 417386 - RNA, 19 nt, Homo sapiens
aagagagaguugagaccaa

SEQ ID NO: 417387 - RNA, 19 nt, Homo sapiens
gagacucacaggcuucaau

SEQ ID NO: 417388 - RNA, 19 nt, Homo sapiens
uaucucagcuaccaaucca

SEQ ID NO: 417389 - RNA, 19 nt, Homo sapiens
ugaaggaaagacauuggaa

SEQ ID NO: 417390 - RNA, 19 nt, Homo sapiens
gaaacucacacuuaaaaca

SEQ ID NO: 417391 - RNA, 19 nt, Homo sapiens
guagagggcauguaaauaa

SEQ ID NO: 417392 - RNA, 19 nt, Homo sapiens
gaacucaugggaauaauug

SEQ ID NO: 417393 - RNA, 19 nt, Homo sapiens
gcaaaacucugccucaaaa

SEQ ID NO: 417394 - RNA, 19 nt, Homo sapiens
guaugacaauucacugaua

SEQ ID NO: 417395 - RNA, 19 nt, Homo sapiens
caaagugugugcaagcaaa

SEQ ID NO: 417396 - RNA, 19 nt, Homo sapiens
gcaaggucauguacccuaa

SEQ ID NO: 417397 - RNA, 19 nt, Homo sapiens
gaagauggacaaauauguu

SEQ ID NO: 417398 - RNA, 19 nt, Homo sapiens
ucauguacccuaauaguua

SEQ ID NO: 417399 - RNA, 19 nt, Homo sapiens
uaacagaggcuuccuuuca

SEQ ID NO: 417400 - RNA, 19 nt, Homo sapiens
gauuagaaaugaagaugga

SEQ ID NO: 417401 - RNA, 19 nt, Homo sapiens
ggaagagucuguuacuuuu

SEQ ID NO: 417402 - RNA, 19 nt, Homo sapiens
gauaacagaggcuuccuuu

SEQ ID NO: 417403 - RNA, 19 nt, Homo sapiens
gcauuaguccuaucuugua

SEQ ID NO: 417404 - RNA, 19 nt, Homo sapiens
gucaacagauacaagauuu

SEQ ID NO: 417405 - RNA, 19 nt, Homo sapiens
ccacguguuucgcaacuaa

SEQ ID NO: 417406 - RNA, 19 nt, Homo sapiens
gaaucugagucuugaguau

SEQ ID NO: 417407 - RNA, 19 nt, Homo sapiens
ggaagcauuucauuguaau

SEQ ID NO: 417408 - RNA, 19 nt, Homo sapiens
uuaggaaucucuccacuau

SEQ ID NO: 417409 - RNA, 19 nt, Homo sapiens
ugaagaaguuccugaaucu

SEQ ID NO: 417410 - RNA, 19 nt, Homo sapiens
gauacaagauuuccuuacu

SEQ ID NO: 417411 - RNA, 19 nt, Homo sapiens
gaaguucccaccuugacua

SEQ ID NO: 417412 - RNA, 19 nt, Homo sapiens
gauggaagcauuucauugu

SEQ ID NO: 417413 - RNA, 19 nt, Homo sapiens
cgagugaaguccuacaaau

SEQ ID NO: 417414 - RNA, 19 nt, Homo sapiens
agugaaguccuacaaauua

SEQ ID NO: 417415 - RNA, 19 nt, Homo sapiens
gagggcauguaaauaaaug

SEQ ID NO: 417416 - RNA, 19 nt, Homo sapiens
uacaagauuuccuuacuga

SEQ ID NO: 417417 - RNA, 19 nt, Homo sapiens
uagagggcauguaaauaaa

SEQ ID NO: 417418 - RNA, 19 nt, Homo sapiens
acaguacucuuugucauuu

SEQ ID NO: 417419 - RNA, 19 nt, Homo sapiens
gaaguucuuauucugagua

SEQ ID NO: 417420 - RNA, 19 nt, Homo sapiens
gcauuucauuguaaucaga

SEQ ID NO: 417421 - RNA, 19 nt, Homo sapiens
aguccuaucuuguaaggua

SEQ ID NO: 417422 - RNA, 19 nt, Homo sapiens
agacccaagucaacagaua

SEQ ID NO: 417423 - RNA, 19 nt, Homo sapiens
uggaagcauuucauuguaa

SEQ ID NO: 417424 - RNA, 19 nt, Homo sapiens
gaaaugaagauggacaaau

SEQ ID NO: 417425 - RNA, 19 nt, Homo sapiens
gagugaaguccuacaaauu

SEQ ID NO: 417426 - RNA, 19 nt, Homo sapiens
gaugaaguucuuauucuga

SEQ ID NO: 417427 - RNA, 19 nt, Homo sapiens
uaacugcacuucgaaugug

SEQ ID NO: 417428 - RNA, 19 nt, Homo sapiens
cauuaguccuaucuuguaa

SEQ ID NO: 417429 - RNA, 19 nt, Homo sapiens
caagccuuauuucagguua

SEQ ID NO: 417430 - RNA, 19 nt, Homo sapiens
cagcaccaauguuauuaau

SEQ ID NO: 417431 - RNA, 19 nt, Homo sapiens
uggaauauuucaggaguuu

SEQ ID NO: 417432 - RNA, 19 nt, Homo sapiens
gaaaccccaucucuacuaa

SEQ ID NO: 417433 - RNA, 19 nt, Homo sapiens
caagucaacagauacaaga

SEQ ID NO: 417434 - RNA, 19 nt, Homo sapiens
cagaggcuuccuuucauua

SEQ ID NO: 417435 - RNA, 19 nt, Homo sapiens
aaggucauguacccuaaua

SEQ ID NO: 417436 - RNA, 19 nt, Homo sapiens
gcagcaccaauguuauuaa

SEQ ID NO: 417437 - RNA, 19 nt, Homo sapiens
gacuuuaacugcacuucga

SEQ ID NO: 417438 - RNA, 19 nt, Homo sapiens
acagaggcuuccuuucauu

SEQ ID NO: 417439 - RNA, 19 nt, Homo sapiens
gaggagacccuggacuuug

SEQ ID NO: 417440 - RNA, 19 nt, Homo sapiens
aggaagagucuguuacuuu

SEQ ID NO: 417441 - RNA, 19 nt, Homo sapiens
gaaucucuccacuaucuug

SEQ ID NO: 417442 - RNA, 19 nt, Homo sapiens
cugcugcccugaugaagaa

SEQ ID NO: 417443 - RNA, 19 nt, Homo sapiens
caaaaucaauacacaggaa

SEQ ID NO: 417444 - RNA, 19 nt, Homo sapiens
agacgaggaugaucaguac

SEQ ID NO: 417445 - RNA, 19 nt, Homo sapiens
aggaaucucuccacuaucu

SEQ ID NO: 417446 - RNA, 19 nt, Homo sapiens
acaaaggcauuaguccuau

SEQ ID NO: 417447 - RNA, 19 nt, Homo sapiens
guaaucagacccaagucaa

SEQ ID NO: 417448 - RNA, 19 nt, Homo sapiens
aggagacccuggacuuuga

SEQ ID NO: 417449 - RNA, 19 nt, Homo sapiens
guucaggaagagucuguua

SEQ ID NO: 417450 - RNA, 19 nt, Homo sapiens
gcuuuaaucccagcacuuu

SEQ ID NO: 417451 - RNA, 19 nt, Homo sapiens
gugagucagcguaacauuu

SEQ ID NO: 417452 - RNA, 19 nt, Homo sapiens
guccuuuaguucugucuuu

SEQ ID NO: 417453 - RNA, 19 nt, Homo sapiens
uacaaaggcauuaguccua

SEQ ID NO: 417454 - RNA, 19 nt, Homo sapiens
aauuggauaugacgaguga

SEQ ID NO: 417455 - RNA, 19 nt, Homo sapiens
gaguaugacaauucacuga

SEQ ID NO: 417456 - RNA, 19 nt, Homo sapiens
uuucaggaguuuaaaguuc

SEQ ID NO: 417457 - RNA, 19 nt, Homo sapiens
ugagucagcguaacauuuc

SEQ ID NO: 417458 - RNA, 19 nt, Homo sapiens
gauaggagcaaggucaugu

SEQ ID NO: 417459 - RNA, 19 nt, Homo sapiens
gaugaagaaguuccugaau

SEQ ID NO: 417460 - RNA, 19 nt, Homo sapiens
gaggcuuccuuucauuaca

SEQ ID NO: 417461 - RNA, 19 nt, Homo sapiens
cugaaacccucuacaaagg

SEQ ID NO: 417462 - RNA, 19 nt, Homo sapiens
cagauacaagauuuccuua

SEQ ID NO: 417463 - RNA, 19 nt, Homo sapiens
uaugacgagugaaguccua

SEQ ID NO: 417464 - RNA, 19 nt, Homo sapiens
ggccagccuugacaacguu

SEQ ID NO: 417465 - RNA, 19 nt, Homo sapiens
aagaaguuccugaaucuga

SEQ ID NO: 417466 - RNA, 19 nt, Homo sapiens
uuacugaaacccucuacaa

SEQ ID NO: 417467 - RNA, 19 nt, Homo sapiens
ucucuccacuaucuugaaa

SEQ ID NO: 417468 - RNA, 19 nt, Homo sapiens
ggucauguacccuaauagu

SEQ ID NO: 417469 - RNA, 19 nt, Homo sapiens
caaaggcauuaguccuauc

SEQ ID NO: 417470 - RNA, 19 nt, Homo sapiens
gugaaguccuacaaauuac

SEQ ID NO: 417471 - RNA, 19 nt, Homo sapiens
caggaagagucuguuacuu

SEQ ID NO: 417472 - RNA, 19 nt, Homo sapiens
gcaaagugugugcaagcaa

SEQ ID NO: 417473 - RNA, 19 nt, Homo sapiens
gagcaaaacucugccucaa

SEQ ID NO: 417474 - RNA, 19 nt, Homo sapiens
auacaagauuuccuuacug

SEQ ID NO: 417475 - RNA, 19 nt, Homo sapiens
auggaagcauuucauugua

SEQ ID NO: 417476 - RNA, 19 nt, Homo sapiens
ggaauauuucaggaguuua

SEQ ID NO: 417477 - RNA, 19 nt, Homo sapiens
aaaccagccugaccaacgu

SEQ ID NO: 417478 - RNA, 19 nt, Homo sapiens
cagcguaacauuucaagag

SEQ ID NO: 417479 - RNA, 19 nt, Homo sapiens
ugaagcauuuucugaauug

SEQ ID NO: 417480 - RNA, 19 nt, Homo sapiens
cguaacauuucaagagucu

SEQ ID NO: 417481 - RNA, 19 nt, Homo sapiens
uuccuguagucauagauua

SEQ ID NO: 417482 - RNA, 19 nt, Homo sapiens
gggcauguaaauaaauguu

SEQ ID NO: 417483 - RNA, 19 nt, Homo sapiens
augaagaaguuccugaauc

SEQ ID NO: 417484 - RNA, 19 nt, Homo sapiens
aggcauuaguccuaucuug

SEQ ID NO: 417485 - RNA, 19 nt, Homo sapiens
guuaggaaucucuccacua

SEQ ID NO: 417486 - RNA, 19 nt, Homo sapiens
agaugaaguucuuauucug

SEQ ID NO: 417487 - RNA, 19 nt, Homo sapiens
ugaagauggacaaauaugu

SEQ ID NO: 417488 - RNA, 19 nt, Homo sapiens
cugauuugauggaagcauu

SEQ ID NO: 417489 - RNA, 19 nt, Homo sapiens
gacccuggacuuugauuuc

SEQ ID NO: 417490 - RNA, 19 nt, Homo sapiens
ggaguuuaaaguucaggaa

SEQ ID NO: 417491 - RNA, 19 nt, Homo sapiens
guagagggcauguaaauaa

SEQ ID NO: 417492 - RNA, 19 nt, Homo sapiens
gaacucaugggaauaauug

SEQ ID NO: 417493 - RNA, 19 nt, Homo sapiens
gcaaaacucugccucaaaa

SEQ ID NO: 417494 - RNA, 19 nt, Homo sapiens
guaugacaauucacugaua

SEQ ID NO: 417495 - RNA, 19 nt, Homo sapiens
caaagugugugcaagcaaa

SEQ ID NO: 417496 - RNA, 19 nt, Homo sapiens
gcaaggucauguacccuaa

SEQ ID NO: 417497 - RNA, 19 nt, Homo sapiens
gaagauggacaaauauguu

SEQ ID NO: 417498 - RNA, 19 nt, Homo sapiens
ucauguacccuaauaguua

SEQ ID NO: 417499 - RNA, 19 nt, Homo sapiens
uaacagaggcuuccuuuca

SEQ ID NO: 417500 - RNA, 19 nt, Homo sapiens
gauuagaaaugaagaugga

SEQ ID NO: 417501 - RNA, 19 nt, Homo sapiens
gauaacagaggcuuccuuu

SEQ ID NO: 417502 - RNA, 19 nt, Homo sapiens
gcauuaguccuaucuugua

SEQ ID NO: 417503 - RNA, 19 nt, Homo sapiens
gucaacagauacaagauuu

SEQ ID NO: 417504 - RNA, 19 nt, Homo sapiens
ccacguguuucgcaacuaa

SEQ ID NO: 417505 - RNA, 19 nt, Homo sapiens
gaaucugagucuugaguau

SEQ ID NO: 417506 - RNA, 19 nt, Homo sapiens
ggaagcauuucauuguaau

SEQ ID NO: 417507 - RNA, 19 nt, Homo sapiens
uuaggaaucucuccacuau

SEQ ID NO: 417508 - RNA, 19 nt, Homo sapiens
ugaagaaguuccugaaucu

SEQ ID NO: 417509 - RNA, 19 nt, Homo sapiens
gauacaagauuuccuuacu

SEQ ID NO: 417510 - RNA, 19 nt, Homo sapiens
gaaguucccaccuugacua

SEQ ID NO: 417511 - RNA, 19 nt, Homo sapiens
gauggaagcauuucauugu

SEQ ID NO: 417512 - RNA, 19 nt, Homo sapiens
cgagugaaguccuacaaau

SEQ ID NO: 417513 - RNA, 19 nt, Homo sapiens
agugaaguccuacaaauua

SEQ ID NO: 417514 - RNA, 19 nt, Homo sapiens
gagggcauguaaauaaaug

SEQ ID NO: 417515 - RNA, 19 nt, Homo sapiens
uacaagauuuccuuacuga

SEQ ID NO: 417516 - RNA, 19 nt, Homo sapiens
uagagggcauguaaauaaa

SEQ ID NO: 417517 - RNA, 19 nt, Homo sapiens
acaguacucuuugucauuu

SEQ ID NO: 417518 - RNA, 19 nt, Homo sapiens
gaaguucuuauucugagua

SEQ ID NO: 417519 - RNA, 19 nt, Homo sapiens
gcauuucauuguaaucaga

SEQ ID NO: 417520 - RNA, 19 nt, Homo sapiens
aguccuaucuuguaaggua

SEQ ID NO: 417521 - RNA, 19 nt, Homo sapiens
agacccaagucaacagaua

SEQ ID NO: 417522 - RNA, 19 nt, Homo sapiens
uggaagcauuucauuguaa

SEQ ID NO: 417523 - RNA, 19 nt, Homo sapiens
gaaaugaagauggacaaau

SEQ ID NO: 417524 - RNA, 19 nt, Homo sapiens
gagugaaguccuacaaauu

SEQ ID NO: 417525 - RNA, 19 nt, Homo sapiens
gaugaaguucuuauucuga

SEQ ID NO: 417526 - RNA, 19 nt, Homo sapiens
uaacugcacuucgaaugug

SEQ ID NO: 417527 - RNA, 19 nt, Homo sapiens
cauuaguccuaucuuguaa

SEQ ID NO: 417528 - RNA, 19 nt, Homo sapiens
caagccuuauuucagguua

SEQ ID NO: 417529 - RNA, 19 nt, Homo sapiens
cagcaccaauguuauuaau

SEQ ID NO: 417530 - RNA, 19 nt, Homo sapiens
gaaaccccaucucuacuaa

SEQ ID NO: 417531 - RNA, 19 nt, Homo sapiens
caagucaacagauacaaga

SEQ ID NO: 417532 - RNA, 19 nt, Homo sapiens
cagaggcuuccuuucauua

SEQ ID NO: 417533 - RNA, 19 nt, Homo sapiens
aaggucauguacccuaaua

SEQ ID NO: 417534 - RNA, 19 nt, Homo sapiens
gcagcaccaauguuauuaa

SEQ ID NO: 417535 - RNA, 19 nt, Homo sapiens
gacuuuaacugcacuucga

SEQ ID NO: 417536 - RNA, 19 nt, Homo sapiens
acagaggcuuccuuucauu

SEQ ID NO: 417537 - RNA, 19 nt, Homo sapiens
gaggagacccuggacuuug

SEQ ID NO: 417538 - RNA, 19 nt, Homo sapiens
gaaucucuccacuaucuug

SEQ ID NO: 417539 - RNA, 19 nt, Homo sapiens
cugcugcccugaugaagaa

SEQ ID NO: 417540 - RNA, 19 nt, Homo sapiens
caaaaucaauacacaggaa

SEQ ID NO: 417541 - RNA, 19 nt, Homo sapiens
agacgaggaugaucaguac

SEQ ID NO: 417542 - RNA, 19 nt, Homo sapiens
aggaaucucuccacuaucu

SEQ ID NO: 417543 - RNA, 19 nt, Homo sapiens
acaaaggcauuaguccuau

SEQ ID NO: 417544 - RNA, 19 nt, Homo sapiens
guaaucagacccaagucaa

SEQ ID NO: 417545 - RNA, 19 nt, Homo sapiens
aggagacccuggacuuuga

SEQ ID NO: 417546 - RNA, 19 nt, Homo sapiens
gcuuuaaucccagcacuuu

SEQ ID NO: 417547 - RNA, 19 nt, Homo sapiens
gugagucagcguaacauuu

SEQ ID NO: 417548 - RNA, 19 nt, Homo sapiens
guccuuuaguucugucuuu

SEQ ID NO: 417549 - RNA, 19 nt, Homo sapiens
uacaaaggcauuaguccua

SEQ ID NO: 417550 - RNA, 19 nt, Homo sapiens
aauuggauaugacgaguga

SEQ ID NO: 417551 - RNA, 19 nt, Homo sapiens
gaguaugacaauucacuga

SEQ ID NO: 417552 - RNA, 19 nt, Homo sapiens
ugagucagcguaacauuuc

SEQ ID NO: 417553 - RNA, 19 nt, Homo sapiens
gauaggagcaaggucaugu

SEQ ID NO: 417554 - RNA, 19 nt, Homo sapiens
gaugaagaaguuccugaau

SEQ ID NO: 417555 - RNA, 19 nt, Homo sapiens
gaggcuuccuuucauuaca

SEQ ID NO: 417556 - RNA, 19 nt, Homo sapiens
ggccagccuugacaacguu

SEQ ID NO: 417557 - RNA, 19 nt, Homo sapiens
cugaaacccucuacaaagg

SEQ ID NO: 417558 - RNA, 19 nt, Homo sapiens
cagauacaagauuuccuua

SEQ ID NO: 417559 - RNA, 19 nt, Homo sapiens
uaugacgagugaaguccua

SEQ ID NO: 417560 - RNA, 19 nt, Homo sapiens
aagaaguuccugaaucuga

SEQ ID NO: 417561 - RNA, 19 nt, Homo sapiens
ucucuccacuaucuugaaa

SEQ ID NO: 417562 - RNA, 19 nt, Homo sapiens
uuacugaaacccucuacaa

SEQ ID NO: 417563 - RNA, 19 nt, Homo sapiens
ggucauguacccuaauagu

SEQ ID NO: 417564 - RNA, 19 nt, Homo sapiens
caaaggcauuaguccuauc

SEQ ID NO: 417565 - RNA, 19 nt, Homo sapiens
gugaaguccuacaaauuac

SEQ ID NO: 417566 - RNA, 19 nt, Homo sapiens
gcaaagugugugcaagcaa

SEQ ID NO: 417567 - RNA, 19 nt, Homo sapiens
gagcaaaacucugccucaa

SEQ ID NO: 417568 - RNA, 19 nt, Homo sapiens
auacaagauuuccuuacug

SEQ ID NO: 417569 - RNA, 19 nt, Homo sapiens
auggaagcauuucauugua

SEQ ID NO: 417570 - RNA, 19 nt, Homo sapiens
aaaccagccugaccaacgu

SEQ ID NO: 417571 - RNA, 19 nt, Homo sapiens
cagcguaacauuucaagag

SEQ ID NO: 417572 - RNA, 19 nt, Homo sapiens
ugaagcauuuucugaauug

SEQ ID NO: 417573 - RNA, 19 nt, Homo sapiens
cguaacauuucaagagucu

SEQ ID NO: 417574 - RNA, 19 nt, Homo sapiens
guuaggaaucucuccacua

SEQ ID NO: 417575 - RNA, 19 nt, Homo sapiens
uuccuguagucauagauua

SEQ ID NO: 417576 - RNA, 19 nt, Homo sapiens
gggcauguaaauaaauguu

SEQ ID NO: 417577 - RNA, 19 nt, Homo sapiens
augaagaaguuccugaauc

SEQ ID NO: 417578 - RNA, 19 nt, Homo sapiens
aggcauuaguccuaucuug

SEQ ID NO: 417579 - RNA, 19 nt, Homo sapiens
agaugaaguucuuauucug

SEQ ID NO: 417580 - RNA, 19 nt, Homo sapiens
ugaagauggacaaauaugu

SEQ ID NO: 417581 - RNA, 19 nt, Homo sapiens
cugauuugauggaagcauu

SEQ ID NO: 417582 - RNA, 19 nt, Homo sapiens
gacccuggacuuugauuuc

SEQ ID NO: 417583 - RNA, 19 nt, Homo sapiens
gcaggaaaauugcuugaac

SEQ ID NO: 417584 - RNA, 19 nt, Homo sapiens
ggucaggaguucgaaacca

SEQ ID NO: 417585 - RNA, 19 nt, Homo sapiens
uaucaaaguaacaguggaa

SEQ ID NO: 417586 - RNA, 19 nt, Homo sapiens
ugaggagacccuggacuuu

SEQ ID NO: 417587 - RNA, 19 nt, Homo sapiens
cauguacccuaauaguuac

SEQ ID NO: 417588 - RNA, 19 nt, Homo sapiens
aagacgaggaugaucagua

SEQ ID NO: 417589 - RNA, 19 nt, Homo sapiens
aacagaggcuuccuuucau

SEQ ID NO: 417590 - RNA, 19 nt, Homo sapiens
gcgauccgccgagaaguug

SEQ ID NO: 417591 - RNA, 19 nt, Homo sapiens
ccaaagcgcugggauuaua

SEQ ID NO: 417592 - RNA, 19 nt, Homo sapiens
guagagggcauguaaauaa

SEQ ID NO: 417593 - RNA, 19 nt, Homo sapiens
gaacucaugggaauaauug

SEQ ID NO: 417594 - RNA, 19 nt, Homo sapiens
gcaaaacucugccucaaaa

SEQ ID NO: 417595 - RNA, 19 nt, Homo sapiens
guaugacaauucacugaua

SEQ ID NO: 417596 - RNA, 19 nt, Homo sapiens
caaagugugugcaagcaaa

SEQ ID NO: 417597 - RNA, 19 nt, Homo sapiens
gcaaggucauguacccuaa

SEQ ID NO: 417598 - RNA, 19 nt, Homo sapiens
gaagauggacaaauauguu

SEQ ID NO: 417599 - RNA, 19 nt, Homo sapiens
ucauguacccuaauaguua

SEQ ID NO: 417600 - RNA, 19 nt, Homo sapiens
uaacagaggcuuccuuuca

SEQ ID NO: 417601 - RNA, 19 nt, Homo sapiens
gauuagaaaugaagaugga

SEQ ID NO: 417602 - RNA, 19 nt, Homo sapiens
ggaagagucuguuacuuuu

SEQ ID NO: 417603 - RNA, 19 nt, Homo sapiens
gauaacagaggcuuccuuu

SEQ ID NO: 417604 - RNA, 19 nt, Homo sapiens
gcauuaguccuaucuugua

SEQ ID NO: 417605 - RNA, 19 nt, Homo sapiens
gucaacagauacaagauuu

SEQ ID NO: 417606 - RNA, 19 nt, Homo sapiens
ccacguguuucgcaacuaa

SEQ ID NO: 417607 - RNA, 19 nt, Homo sapiens
gaaucugagucuugaguau

SEQ ID NO: 417608 - RNA, 19 nt, Homo sapiens
ggaagcauuucauuguaau

SEQ ID NO: 417609 - RNA, 19 nt, Homo sapiens
uuaggaaucucuccacuau

SEQ ID NO: 417610 - RNA, 19 nt, Homo sapiens
ugaagaaguuccugaaucu

SEQ ID NO: 417611 - RNA, 19 nt, Homo sapiens
gauacaagauuuccuuacu

SEQ ID NO: 417612 - RNA, 19 nt, Homo sapiens
gaaguucccaccuugacua

SEQ ID NO: 417613 - RNA, 19 nt, Homo sapiens
gauggaagcauuucauugu

SEQ ID NO: 417614 - RNA, 19 nt, Homo sapiens
cgagugaaguccuacaaau

SEQ ID NO: 417615 - RNA, 19 nt, Homo sapiens
agugaaguccuacaaauua

SEQ ID NO: 417616 - RNA, 19 nt, Homo sapiens
gagggcauguaaauaaaug

SEQ ID NO: 417617 - RNA, 19 nt, Homo sapiens
uacaagauuuccuuacuga

SEQ ID NO: 417618 - RNA, 19 nt, Homo sapiens
uagagggcauguaaauaaa

SEQ ID NO: 417619 - RNA, 19 nt, Homo sapiens
acaguacucuuugucauuu

SEQ ID NO: 417620 - RNA, 19 nt, Homo sapiens
gaaguucuuauucugagua

SEQ ID NO: 417621 - RNA, 19 nt, Homo sapiens
gcauuucauuguaaucaga

SEQ ID NO: 417622 - RNA, 19 nt, Homo sapiens
aguccuaucuuguaaggua

SEQ ID NO: 417623 - RNA, 19 nt, Homo sapiens
agacccaagucaacagaua

SEQ ID NO: 417624 - RNA, 19 nt, Homo sapiens
uggaagcauuucauuguaa

SEQ ID NO: 417625 - RNA, 19 nt, Homo sapiens
ucacugcaguuucaaguuc

SEQ ID NO: 417626 - RNA, 19 nt, Homo sapiens
gaaaugaagauggacaaau

SEQ ID NO: 417627 - RNA, 19 nt, Homo sapiens
gagugaaguccuacaaauu

SEQ ID NO: 417628 - RNA, 19 nt, Homo sapiens
gaugaaguucuuauucuga

SEQ ID NO: 417629 - RNA, 19 nt, Homo sapiens
uaacugcacuucgaaugug

SEQ ID NO: 417630 - RNA, 19 nt, Homo sapiens
cauuaguccuaucuuguaa

SEQ ID NO: 417631 - RNA, 19 nt, Homo sapiens
caagccuuauuucagguua

SEQ ID NO: 417632 - RNA, 19 nt, Homo sapiens
cagcaccaauguuauuaau

SEQ ID NO: 417633 - RNA, 19 nt, Homo sapiens
uggaauauuucaggaguuu

SEQ ID NO: 417634 - RNA, 19 nt, Homo sapiens
gaaaccccaucucuacuaa

SEQ ID NO: 417635 - RNA, 19 nt, Homo sapiens
caagucaacagauacaaga

SEQ ID NO: 417636 - RNA, 19 nt, Homo sapiens
cagaggcuuccuuucauua

SEQ ID NO: 417637 - RNA, 19 nt, Homo sapiens
aaggucauguacccuaaua

SEQ ID NO: 417638 - RNA, 19 nt, Homo sapiens
gcagcaccaauguuauuaa

SEQ ID NO: 417639 - RNA, 19 nt, Homo sapiens
gacuuuaacugcacuucga

SEQ ID NO: 417640 - RNA, 19 nt, Homo sapiens
acagaggcuuccuuucauu

SEQ ID NO: 417641 - RNA, 19 nt, Homo sapiens
gaggagacccuggacuuug

SEQ ID NO: 417642 - RNA, 19 nt, Homo sapiens
aggaagagucuguuacuuu

SEQ ID NO: 417643 - RNA, 19 nt, Homo sapiens
gaaucucuccacuaucuug

SEQ ID NO: 417644 - RNA, 19 nt, Homo sapiens
cugcugcccugaugaagaa

SEQ ID NO: 417645 - RNA, 19 nt, Homo sapiens
caaaaucaauacacaggaa

SEQ ID NO: 417646 - RNA, 19 nt, Homo sapiens
agacgaggaugaucaguac

SEQ ID NO: 417647 - RNA, 19 nt, Homo sapiens
ucaaguuccugggcucaaa

SEQ ID NO: 417648 - RNA, 19 nt, Homo sapiens
aggaaucucuccacuaucu

SEQ ID NO: 417649 - RNA, 19 nt, Homo sapiens
acaaaggcauuaguccuau

SEQ ID NO: 417650 - RNA, 19 nt, Homo sapiens
guaaucagacccaagucaa

SEQ ID NO: 417651 - RNA, 19 nt, Homo sapiens
aggagacccuggacuuuga

SEQ ID NO: 417652 - RNA, 19 nt, Homo sapiens
guucaggaagagucuguua

SEQ ID NO: 417653 - RNA, 19 nt, Homo sapiens
gcuuuaaucccagcacuuu

SEQ ID NO: 417654 - RNA, 19 nt, Homo sapiens
gugagucagcguaacauuu

SEQ ID NO: 417655 - RNA, 19 nt, Homo sapiens
guccuuuaguucugucuuu

SEQ ID NO: 417656 - RNA, 19 nt, Homo sapiens
uacaaaggcauuaguccua

SEQ ID NO: 417657 - RNA, 19 nt, Homo sapiens
aauuggauaugacgaguga

SEQ ID NO: 417658 - RNA, 19 nt, Homo sapiens
gaguaugacaauucacuga

SEQ ID NO: 417659 - RNA, 19 nt, Homo sapiens
uuucaggaguuuaaaguuc

SEQ ID NO: 417660 - RNA, 19 nt, Homo sapiens
ugagucagcguaacauuuc

SEQ ID NO: 417661 - RNA, 19 nt, Homo sapiens
gauaggagcaaggucaugu

SEQ ID NO: 417662 - RNA, 19 nt, Homo sapiens
gaugaagaaguuccugaau

SEQ ID NO: 417663 - RNA, 19 nt, Homo sapiens
ggccagccuugacaacguu

SEQ ID NO: 417664 - RNA, 19 nt, Homo sapiens
gaggcuuccuuucauuaca

SEQ ID NO: 417665 - RNA, 19 nt, Homo sapiens
cugaaacccucuacaaagg

SEQ ID NO: 417666 - RNA, 19 nt, Homo sapiens
cagauacaagauuuccuua

SEQ ID NO: 417667 - RNA, 19 nt, Homo sapiens
uaugacgagugaaguccua

SEQ ID NO: 417668 - RNA, 19 nt, Homo sapiens
aagaaguuccugaaucuga

SEQ ID NO: 417669 - RNA, 19 nt, Homo sapiens
uuacugaaacccucuacaa

SEQ ID NO: 417670 - RNA, 19 nt, Homo sapiens
ucucuccacuaucuugaaa

SEQ ID NO: 417671 - RNA, 19 nt, Homo sapiens
ggucauguacccuaauagu

SEQ ID NO: 417672 - RNA, 19 nt, Homo sapiens
caaaggcauuaguccuauc

SEQ ID NO: 417673 - RNA, 19 nt, Homo sapiens
gugaaguccuacaaauuac

SEQ ID NO: 417674 - RNA, 19 nt, Homo sapiens
caggaagagucuguuacuu

SEQ ID NO: 417675 - RNA, 19 nt, Homo sapiens
gcaaagugugugcaagcaa

SEQ ID NO: 417676 - RNA, 19 nt, Homo sapiens
gagcaaaacucugccucaa

SEQ ID NO: 417677 - RNA, 19 nt, Homo sapiens
auacaagauuuccuuacug

SEQ ID NO: 417678 - RNA, 19 nt, Homo sapiens
auggaagcauuucauugua

SEQ ID NO: 417679 - RNA, 19 nt, Homo sapiens
ggaauauuucaggaguuua

SEQ ID NO: 417680 - RNA, 19 nt, Homo sapiens
aaaccagccugaccaacgu

SEQ ID NO: 417681 - RNA, 19 nt, Homo sapiens
cagcguaacauuucaagag

SEQ ID NO: 417682 - RNA, 19 nt, Homo sapiens
ugaagcauuuucugaauug

SEQ ID NO: 417683 - RNA, 19 nt, Homo sapiens
cguaacauuucaagagucu

SEQ ID NO: 417684 - RNA, 19 nt, Homo sapiens
uuccuguagucauagauua

SEQ ID NO: 417685 - RNA, 19 nt, Homo sapiens
gggcauguaaauaaauguu

SEQ ID NO: 417686 - RNA, 19 nt, Homo sapiens
augaagaaguuccugaauc

SEQ ID NO: 417687 - RNA, 19 nt, Homo sapiens
aggcauuaguccuaucuug

SEQ ID NO: 417688 - RNA, 19 nt, Homo sapiens
guuaggaaucucuccacua

SEQ ID NO: 417689 - RNA, 19 nt, Homo sapiens
agaugaaguucuuauucug

SEQ ID NO: 417690 - RNA, 19 nt, Homo sapiens
ugaagauggacaaauaugu

SEQ ID NO: 417691 - RNA, 19 nt, Homo sapiens
gaagauugaucaaacugaa

SEQ ID NO: 417692 - RNA, 19 nt, Homo sapiens
ggaagaagauugaucaaac

SEQ ID NO: 417693 - RNA, 19 nt, Homo sapiens
ggacacaccuucugcaagu

SEQ ID NO: 417694 - RNA, 19 nt, Homo sapiens
gaagaagauugaucaaacu

SEQ ID NO: 417695 - RNA, 19 nt, Homo sapiens
gaagaagauucaagagaag

SEQ ID NO: 417696 - RNA, 19 nt, Homo sapiens
gaugugggcuccaacaagu

SEQ ID NO: 417697 - RNA, 19 nt, Homo sapiens
gcgagaaccgcaaguacua

SEQ ID NO: 417698 - RNA, 19 nt, Homo sapiens
cggaggagaugaagaagau

SEQ ID NO: 417699 - RNA, 19 nt, Homo sapiens
caacaagcgcuucuucuuc

SEQ ID NO: 417700 - RNA, 19 nt, Homo sapiens
ggacaacaagcgcuucuuc

SEQ ID NO: 417701 - RNA, 19 nt, Homo sapiens
acacacacaugcauacaca

SEQ ID NO: 417702 - RNA, 19 nt, Homo sapiens
gggaagaagauugaucaaa

SEQ ID NO: 417703 - RNA, 19 nt, Homo sapiens
gaaccgcaaguacuacaug

SEQ ID NO: 417704 - RNA, 19 nt, Homo sapiens
gcaaguacucggaggagau

SEQ ID NO: 417705 - RNA, 19 nt, Homo sapiens
gcuucuaccuggacgugaa

SEQ ID NO: 417706 - RNA, 19 nt, Homo sapiens
acacaugcauacacacaca

SEQ ID NO: 417707 - RNA, 19 nt, Homo sapiens
acacacacacacaugcaua

SEQ ID NO: 417708 - RNA, 19 nt, Homo sapiens
gaggagaugaagaagauuc

SEQ ID NO: 417709 - RNA, 19 nt, Homo sapiens
ggcaacaagagccgccuua

SEQ ID NO: 417710 - RNA, 19 nt, Homo sapiens
gacacaccuucugcaagua

SEQ ID NO: 417711 - RNA, 19 nt, Homo sapiens
ccaagcucaucgacgacua

SEQ ID NO: 417712 - RNA, 19 nt, Homo sapiens
gcaaguacuacauggaucu

SEQ ID NO: 417713 - RNA, 19 nt, Homo sapiens
ugaucaaacugaaugaaac

SEQ ID NO: 417714 - RNA, 19 nt, Homo sapiens
gcgacuaccugggcgacuu

SEQ ID NO: 417715 - RNA, 19 nt, Homo sapiens
gcgacuucaucgagcacua

SEQ ID NO: 417716 - RNA, 19 nt, Homo sapiens
acacacagccacacacaca

SEQ ID NO: 417717 - RNA, 19 nt, Homo sapiens
caaguacggcguguuuaug

SEQ ID NO: 417718 - RNA, 19 nt, Homo sapiens
acaaguacggcguguuuau

SEQ ID NO: 417719 - RNA, 19 nt, Homo sapiens
acaacaagcgcuucuucuu

SEQ ID NO: 417720 - RNA, 19 nt, Homo sapiens
caacaagagccgccuuacu

SEQ ID NO: 417721 - RNA, 19 nt, Homo sapiens
ggaagaaggggaagaagau

SEQ ID NO: 417722 - RNA, 19 nt, Homo sapiens
gagaaccgcaaguacuaca

SEQ ID NO: 417723 - RNA, 19 nt, Homo sapiens
aacaagagccgccuuacuc

SEQ ID NO: 417724 - RNA, 19 nt, Homo sapiens
gcauacacacacacacaca

SEQ ID NO: 417725 - RNA, 19 nt, Homo sapiens
acucggaggagaugaagaa

SEQ ID NO: 417726 - RNA, 19 nt, Homo sapiens
caaguacucggaggagaug

SEQ ID NO: 417727 - RNA, 19 nt, Homo sapiens
caaggugugggccaaguuc

SEQ ID NO: 417728 - RNA, 19 nt, Homo sapiens
agaagcgggcugccuguga

SEQ ID NO: 417729 - RNA, 19 nt, Homo sapiens
aagagaagcagagggagaa

SEQ ID NO: 417730 - RNA, 19 nt, Homo sapiens
ccaucaccgugcccuacaa

SEQ ID NO: 417731 - RNA, 19 nt, Homo sapiens
acgcagggccagaccauug

SEQ ID NO: 417732 - RNA, 19 nt, Homo sapiens
gacaacaagcgcuucuucu

SEQ ID NO: 417733 - RNA, 19 nt, Homo sapiens
ccacacacacagaaaauau

SEQ ID NO: 417734 - RNA, 19 nt, Homo sapiens
acacagccacacacacaga

SEQ ID NO: 417735 - RNA, 19 nt, Homo sapiens
agaagauugaucaaacuga

SEQ ID NO: 417736 - RNA, 19 nt, Homo sapiens
ccaccuaucgcaacuccau

SEQ ID NO: 417737 - RNA, 19 nt, Homo sapiens
ccuugacuguggacaacaa

SEQ ID NO: 417738 - RNA, 19 nt, Homo sapiens
gaacaagcgcuucuacuua

SEQ ID NO: 417739 - RNA, 19 nt, Homo sapiens
gaugugggcugcaacaaau

SEQ ID NO: 417740 - RNA, 19 nt, Homo sapiens
ggagguggaugaggauuga

SEQ ID NO: 417741 - RNA, 19 nt, Homo sapiens
cggaugagaugaaagaaau

SEQ ID NO: 417742 - RNA, 19 nt, Homo sapiens
cgacagagggauaagcuuu

SEQ ID NO: 417743 - RNA, 19 nt, Homo sapiens
gacagagggauaagcuuua

SEQ ID NO: 417744 - RNA, 19 nt, Homo sapiens
gaugaaagaaauccaggaa

SEQ ID NO: 417745 - RNA, 19 nt, Homo sapiens
gugagaaccgcaaguacua

SEQ ID NO: 417746 - RNA, 19 nt, Homo sapiens
gaaagaaauccaggaacga

SEQ ID NO: 417747 - RNA, 19 nt, Homo sapiens
aacaagcgcuucuacuuag

SEQ ID NO: 417748 - RNA, 19 nt, Homo sapiens
gcugggcgacuucauagaa

SEQ ID NO: 417749 - RNA, 19 nt, Homo sapiens
caaguucggaggcgccuuu

SEQ ID NO: 417750 - RNA, 19 nt, Homo sapiens
guaugcggaugagaugaaa

SEQ ID NO: 417751 - RNA, 19 nt, Homo sapiens
gcggaugagaugaaagaaa

SEQ ID NO: 417752 - RNA, 19 nt, Homo sapiens
caggaacgacagagggaua

SEQ ID NO: 417753 - RNA, 19 nt, Homo sapiens
gguaugcggaugagaugaa

SEQ ID NO: 417754 - RNA, 19 nt, Homo sapiens
gaaauccaggaacgacaga

SEQ ID NO: 417755 - RNA, 19 nt, Homo sapiens
acuuagaugugaagcagaa

SEQ ID NO: 417756 - RNA, 19 nt, Homo sapiens
cgaugugggcugcaacaaa

SEQ ID NO: 417757 - RNA, 19 nt, Homo sapiens
cgcagggccucaucgaguu

SEQ ID NO: 417758 - RNA, 19 nt, Homo sapiens
gcgacuucauagaacacua

SEQ ID NO: 417759 - RNA, 19 nt, Homo sapiens
ggacuccaagcgcuucuuc

SEQ ID NO: 417760 - RNA, 19 nt, Homo sapiens
cgaagcucauagacgacua

SEQ ID NO: 417761 - RNA, 19 nt, Homo sapiens
gcuagagaauucccuuucc

SEQ ID NO: 417762 - RNA, 19 nt, Homo sapiens
gaagccguccuaccgcaau

SEQ ID NO: 417763 - RNA, 19 nt, Homo sapiens
aguacuaccuggaccucaa

SEQ ID NO: 417764 - RNA, 19 nt, Homo sapiens
caucaccguacccuucaaa

SEQ ID NO: 417765 - RNA, 19 nt, Homo sapiens
aaacaaaacguaacacagu

SEQ ID NO: 417766 - RNA, 19 nt, Homo sapiens
ccaagcgcuucuucuucga

SEQ ID NO: 417767 - RNA, 19 nt, Homo sapiens
ggauugaaacgggcagcuu

SEQ ID NO: 417768 - RNA, 19 nt, Homo sapiens
gauggcugcuggagacaaa

SEQ ID NO: 417769 - RNA, 19 nt, Homo sapiens
gaagaagguguuucacaug

SEQ ID NO: 417770 - RNA, 19 nt, Homo sapiens
ggacaaaaguggcuucauc

SEQ ID NO: 417771 - RNA, 19 nt, Homo sapiens
ucugguggcugaaagcuaa

SEQ ID NO: 417772 - RNA, 19 nt, Homo sapiens
caaauggucggccugaaga

SEQ ID NO: 417773 - RNA, 19 nt, Homo sapiens
gcugaacgcugaggacauc

SEQ ID NO: 417774 - RNA, 19 nt, Homo sapiens
cggaugaugugaagaaggu

SEQ ID NO: 417775 - RNA, 19 nt, Homo sapiens
gugcggaugaugugaagaa

SEQ ID NO: 417776 - RNA, 19 nt, Homo sapiens
gagugcggaugaugugaag

SEQ ID NO: 417777 - RNA, 19 nt, Homo sapiens
ccaaauggucggccugaag

SEQ ID NO: 417778 - RNA, 19 nt, Homo sapiens
cacccgaguugcaggaugu

SEQ ID NO: 417779 - RNA, 19 nt, Homo sapiens
gaacgcugaggacaucaag

SEQ ID NO: 417780 - RNA, 19 nt, Homo sapiens
aaagagugcggaugaugug

SEQ ID NO: 417781 - RNA, 19 nt, Homo sapiens
cuaaagaaaccaagaugcu

SEQ ID NO: 417782 - RNA, 19 nt, Homo sapiens
gaggaugagcugggauuca

SEQ ID NO: 417783 - RNA, 19 nt, Homo sapiens
acgcugaggacaucaagaa

SEQ ID NO: 417784 - RNA, 19 nt, Homo sapiens
cgacuccuucgaccacaaa

SEQ ID NO: 417785 - RNA, 19 nt, Homo sapiens
gaugacagacuugcugaac

SEQ ID NO: 417786 - RNA, 19 nt, Homo sapiens
ccacacggcugaccucaua

SEQ ID NO: 417787 - RNA, 19 nt, Homo sapiens
gaacagcucuucccaggau

SEQ ID NO: 417788 - RNA, 19 nt, Homo sapiens
cagcagaauuccucuuaua

SEQ ID NO: 417789 - RNA, 19 nt, Homo sapiens
ggacagagauuaagaucag

SEQ ID NO: 417790 - RNA, 19 nt, Homo sapiens
gcaagaaugugaccugcaa

SEQ ID NO: 417791 - RNA, 19 nt, Homo sapiens
gaacauugguugcuuuggu

SEQ ID NO: 417792 - RNA, 19 nt, Homo sapiens
caccauaaaucacaucauu

SEQ ID NO: 417793 - RNA, 19 nt, Homo sapiens
gcagaauuccucuuauaaa

SEQ ID NO: 417794 - RNA, 19 nt, Homo sapiens
ggaaauaacccacaaaaga

SEQ ID NO: 417795 - RNA, 19 nt, Homo sapiens
gaucgggauuuauuucuau

SEQ ID NO: 417796 - RNA, 19 nt, Homo sapiens
ggaucgggauuuauuucua

SEQ ID NO: 417797 - RNA, 19 nt, Homo sapiens
ccaaucaacacaacuuuaa

SEQ ID NO: 417798 - RNA, 19 nt, Homo sapiens
gacagcagaauuccucuua

SEQ ID NO: 417799 - RNA, 19 nt, Homo sapiens
gcaagaaguacugccaaua

SEQ ID NO: 417800 - RNA, 19 nt, Homo sapiens
gcucacaguuacaguuuau

SEQ ID NO: 417801 - RNA, 19 nt, Homo sapiens
gcacccagaaucucauuaa

SEQ ID NO: 417802 - RNA, 19 nt, Homo sapiens
cagaauuccucuuauaaag

SEQ ID NO: 417803 - RNA, 19 nt, Homo sapiens
guuaagccuuuacugcaua

SEQ ID NO: 417804 - RNA, 19 nt, Homo sapiens
ccaaagugcugaauuaagc

SEQ ID NO: 417805 - RNA, 19 nt, Homo sapiens
gaaauaacccacaaaagaa

SEQ ID NO: 417806 - RNA, 19 nt, Homo sapiens
ggacaaaccaaucaacaca

SEQ ID NO: 417807 - RNA, 19 nt, Homo sapiens
gggccaagaugcuaaaugg

SEQ ID NO: 417808 - RNA, 19 nt, Homo sapiens
cggcugaccucauacauca

SEQ ID NO: 417809 - RNA, 19 nt, Homo sapiens
gcagcucacucgagaucuu

SEQ ID NO: 417810 - RNA, 19 nt, Homo sapiens
gaaggacucacuagacuca

SEQ ID NO: 417811 - RNA, 19 nt, Homo sapiens
caacuacaccugccuguuc

SEQ ID NO: 417812 - RNA, 19 nt, Homo sapiens
gccuugagcuucuaaaucu

SEQ ID NO: 417813 - RNA, 19 nt, Homo sapiens
gcuaugauaacaacuggua

SEQ ID NO: 417814 - RNA, 19 nt, Homo sapiens
cucccaaagugcugaauua

SEQ ID NO: 417815 - RNA, 19 nt, Homo sapiens
agaccacccuccuuucauu

SEQ ID NO: 417816 - RNA, 19 nt, Homo sapiens
ccucauacaucaagccaau

SEQ ID NO: 417817 - RNA, 19 nt, Homo sapiens
gaauuaagcagcucaccau

SEQ ID NO: 417818 - RNA, 19 nt, Homo sapiens
gcacguaagcuccuugucu

SEQ ID NO: 417819 - RNA, 19 nt, Homo sapiens
ggagauaaaggaacauugg

SEQ ID NO: 417820 - RNA, 19 nt, Homo sapiens
gaagagccgggaacagaga

SEQ ID NO: 417821 - RNA, 19 nt, Homo sapiens
cccaggagcugaggauaaa

SEQ ID NO: 417822 - RNA, 19 nt, Homo sapiens
ccaaacggcuggaauucgu

SEQ ID NO: 417823 - RNA, 19 nt, Homo sapiens
gggcaugucuccuauucag

SEQ ID NO: 417824 - RNA, 19 nt, Homo sapiens
ggauauuggugcccucaag

SEQ ID NO: 417825 - RNA, 19 nt, Homo sapiens
ccacagaguuggggagaua

SEQ ID NO: 417826 - RNA, 19 nt, Homo sapiens
ccauaaaucacaucauuag

SEQ ID NO: 417827 - RNA, 19 nt, Homo sapiens
caagaaguacugccaauac

SEQ ID NO: 417828 - RNA, 19 nt, Homo sapiens
ugacaacaugcaagaagua

SEQ ID NO: 417829 - RNA, 19 nt, Homo sapiens
uccaagggcuuagagauga

SEQ ID NO: 417830 - RNA, 19 nt, Homo sapiens
gcaggagcguggauaucug

SEQ ID NO: 417831 - RNA, 19 nt, Homo sapiens
ccacgucuggcuaaucuuu

SEQ ID NO: 417832 - RNA, 19 nt, Homo sapiens
uagaaggacucacuagacu

SEQ ID NO: 417833 - RNA, 19 nt, Homo sapiens
ucucugugguuacaagaaa

SEQ ID NO: 417834 - RNA, 19 nt, Homo sapiens
caagaccacccuccuuuca

SEQ ID NO: 417835 - RNA, 19 nt, Homo sapiens
cuaaugggcaugucuccua

SEQ ID NO: 417836 - RNA, 19 nt, Homo sapiens
gguuaagccuuuacugcau

SEQ ID NO: 417837 - RNA, 19 nt, Homo sapiens
gcccaggagcugaggauaa

SEQ ID NO: 417838 - RNA, 19 nt, Homo sapiens
caacaugcaagaaguacug

SEQ ID NO: 417839 - RNA, 19 nt, Homo sapiens
guaaaaggacagagauuaa

SEQ ID NO: 417840 - RNA, 19 nt, Homo sapiens
cagaaucucauuaaagcuu

SEQ ID NO: 417841 - RNA, 19 nt, Homo sapiens
gaaaacuacuagaugugaa

SEQ ID NO: 417842 - RNA, 19 nt, Homo sapiens
caccagaggcugcaauuca

SEQ ID NO: 417843 - RNA, 19 nt, Homo sapiens
gagauuaagaucagcaaag

SEQ ID NO: 417844 - RNA, 19 nt, Homo sapiens
uaaugggcaugucuccuau

SEQ ID NO: 417845 - RNA, 19 nt, Homo sapiens
gcacgagagcuuugagaag

SEQ ID NO: 417846 - RNA, 19 nt, Homo sapiens
cacccagaaucucauuaaa

SEQ ID NO: 417847 - RNA, 19 nt, Homo sapiens
aaaggaacauugguugcuu

SEQ ID NO: 417848 - RNA, 19 nt, Homo sapiens
uacuagaugugaacuugaa

SEQ ID NO: 417849 - RNA, 19 nt, Homo sapiens
ccaaaucaccuggcacuca

SEQ ID NO: 417850 - RNA, 19 nt, Homo sapiens
acucaggcaugucccguaa

SEQ ID NO: 417851 - RNA, 19 nt, Homo sapiens
guaagcuccuugucugucu

SEQ ID NO: 417852 - RNA, 19 nt, Homo sapiens
aaggaacauugguugcuuu

SEQ ID NO: 417853 - RNA, 19 nt, Homo sapiens
ggcaggaaauaacccacaa

SEQ ID NO: 417854 - RNA, 19 nt, Homo sapiens
cauagcagaccacacagaa

SEQ ID NO: 417855 - RNA, 19 nt, Homo sapiens
ccaagggcuuagagaugaa

SEQ ID NO: 417856 - RNA, 19 nt, Homo sapiens
gagggcagacagcagaauu

SEQ ID NO: 417857 - RNA, 19 nt, Homo sapiens
gcaggaaauaacccacaaa

SEQ ID NO: 417858 - RNA, 19 nt, Homo sapiens
ccagaacacagcugagguu

SEQ ID NO: 417859 - RNA, 19 nt, Homo sapiens
uuaagcagcucaccaucca

SEQ ID NO: 417860 - RNA, 19 nt, Homo sapiens
caccacgucuggcuaaucu

SEQ ID NO: 417861 - RNA, 19 nt, Homo sapiens
gcacacguuccacgacaga

SEQ ID NO: 417862 - RNA, 19 nt, Homo sapiens
cccagaaucucauuaaagc

SEQ ID NO: 417863 - RNA, 19 nt, Homo sapiens
uaagcaggacagaggauuu

SEQ ID NO: 417864 - RNA, 19 nt, Homo sapiens
cagcaucugcagccacuuu

SEQ ID NO: 417865 - RNA, 19 nt, Homo sapiens
gugacaacaugcaagaagu

SEQ ID NO: 417866 - RNA, 19 nt, Homo sapiens
ggcucacaguuacaguuua

SEQ ID NO: 417867 - RNA, 19 nt, Homo sapiens
gacgugggccuccagaguu

SEQ ID NO: 417868 - RNA, 19 nt, Homo sapiens
acacaacuuuaaucugcaa

SEQ ID NO: 417869 - RNA, 19 nt, Homo sapiens
gaaccucaccguguacuac

SEQ ID NO: 417870 - RNA, 19 nt, Homo sapiens
gaccacccuccuuucauuu

SEQ ID NO: 417871 - RNA, 19 nt, Homo sapiens
acuacuagaugugaacuug

SEQ ID NO: 417872 - RNA, 19 nt, Homo sapiens
gagcuucuaaaucucugua

SEQ ID NO: 417873 - RNA, 19 nt, Homo sapiens
aaaugggaaugcaaagcuu

SEQ ID NO: 417874 - RNA, 19 nt, Homo sapiens
aaaggucuaugaucuugag

SEQ ID NO: 417875 - RNA, 19 nt, Homo sapiens
ucagcuaccaggcaggaua

SEQ ID NO: 417876 - RNA, 19 nt, Homo sapiens
gggcaggugcaaguucaua

SEQ ID NO: 417877 - RNA, 19 nt, Homo sapiens
gcagcaggagcguggauau

SEQ ID NO: 417878 - RNA, 19 nt, Homo sapiens
aaaccaaucaacacaacuu

SEQ ID NO: 417879 - RNA, 19 nt, Homo sapiens
uggaagagccgggaacaga

SEQ ID NO: 417880 - RNA, 19 nt, Homo sapiens
gcauagcagaccacacaga

SEQ ID NO: 417881 - RNA, 19 nt, Homo sapiens
cgucaccaaugcccuagga

SEQ ID NO: 417882 - RNA, 19 nt, Homo sapiens
gacaaaccaaucaacacaa

SEQ ID NO: 417883 - RNA, 19 nt, Homo sapiens
agagaaaacuacuagaugu

SEQ ID NO: 417884 - RNA, 19 nt, Homo sapiens
guucugggaauccugguuu

SEQ ID NO: 417885 - RNA, 19 nt, Homo sapiens
acaaaccaaucaacacaac

SEQ ID NO: 417886 - RNA, 19 nt, Homo sapiens
ggacuuggcugagaacaug

SEQ ID NO: 417887 - RNA, 19 nt, Homo sapiens
gaacgacgggucuuucauu

SEQ ID NO: 417888 - RNA, 19 nt, Homo sapiens
ggaggucaauaucacagaa

SEQ ID NO: 417889 - RNA, 19 nt, Homo sapiens
gccuggagcuggaggauga

SEQ ID NO: 417890 - RNA, 19 nt, Homo sapiens
gcaccaagaagcacgugua

SEQ ID NO: 417891 - RNA, 19 nt, Homo sapiens
ccaagaagcacguguaugg

SEQ ID NO: 417892 - RNA, 19 nt, Homo sapiens
ucaagggacccaucaacua

SEQ ID NO: 417893 - RNA, 19 nt, Homo sapiens
gaacguggccaucuacaac

SEQ ID NO: 417894 - RNA, 19 nt, Homo sapiens
gaaagccagcucaaucuca

SEQ ID NO: 417895 - RNA, 19 nt, Homo sapiens
cgagaaagccagcucaauc

SEQ ID NO: 417896 - RNA, 19 nt, Homo sapiens
gagaaagccagcucaaucu

SEQ ID NO: 417897 - RNA, 19 nt, Homo sapiens
uggcagaaguccaccaaug

SEQ ID NO: 417898 - RNA, 19 nt, Homo sapiens
gaagaucacccaggucaca

SEQ ID NO: 417899 - RNA, 19 nt, Homo sapiens
ggugaacgacuccauguau

SEQ ID NO: 417900 - RNA, 19 nt, Homo sapiens
gugaacgacuccauguaug

SEQ ID NO: 417901 - RNA, 19 nt, Homo sapiens
aaggaaagccucacucuca

SEQ ID NO: 417902 - RNA, 19 nt, Homo sapiens
cugcaaagcugaugcuaac

SEQ ID NO: 417903 - RNA, 19 nt, Homo sapiens
gcaguaugagccugaggua

SEQ ID NO: 417904 - RNA, 19 nt, Homo sapiens
caaacccaccaauuggaua

SEQ ID NO: 417905 - RNA, 19 nt, Homo sapiens
gaaggagugguacguguag

SEQ ID NO: 417906 - RNA, 19 nt, Homo sapiens
cgacgggucuuucauuucc

SEQ ID NO: 417907 - RNA, 19 nt, Homo sapiens
aacgacgggucuuucauuu

SEQ ID NO: 417908 - RNA, 19 nt, Homo sapiens
ccacauggaccgcuucaag

SEQ ID NO: 417909 - RNA, 19 nt, Homo sapiens
caagggacccaucaacuac

SEQ ID NO: 417910 - RNA, 19 nt, Homo sapiens
uggccaaacccaccaauug

SEQ ID NO: 417911 - RNA, 19 nt, Homo sapiens
agccugagguaaccauuga

SEQ ID NO: 417912 - RNA, 19 nt, Homo sapiens
aggaaagccucacucucaa

SEQ ID NO: 417913 - RNA, 19 nt, Homo sapiens
agaaggagugguacgugua

SEQ ID NO: 417914 - RNA, 19 nt, Homo sapiens
cgacucagacgacgagaag

SEQ ID NO: 417915 - RNA, 19 nt, Homo sapiens
gguuugauggcaacuggua

SEQ ID NO: 417916 - RNA, 19 nt, Homo sapiens
uggcacagaaccugcagua

SEQ ID NO: 417917 - RNA, 19 nt, Homo sapiens
gagccugagguaaccauug

SEQ ID NO: 417918 - RNA, 19 nt, Homo sapiens
uggccugcaucgucaacua

SEQ ID NO: 417919 - RNA, 19 nt, Homo sapiens
gcagaacguggccaucuac

SEQ ID NO: 417920 - RNA, 19 nt, Homo sapiens
gcauccugcugguguugau

SEQ ID NO: 417921 - RNA, 19 nt, Homo sapiens
caucgucaacuaccacaug

SEQ ID NO: 417922 - RNA, 19 nt, Homo sapiens
ggcagggaccuacaucugu

SEQ ID NO: 417923 - RNA, 19 nt, Homo sapiens
ccaauggcuccaagcagaa

SEQ ID NO: 417924 - RNA, 19 nt, Homo sapiens
gaagccucccaguguggua

SEQ ID NO: 417925 - RNA, 19 nt, Homo sapiens
agcagaacguggccaucua

SEQ ID NO: 417926 - RNA, 19 nt, Homo sapiens
ggcagaaguccaccaaugg

SEQ ID NO: 417927 - RNA, 19 nt, Homo sapiens
auggaccgcuucaaggaaa

SEQ ID NO: 417928 - RNA, 19 nt, Homo sapiens
caggucacauggcagaagu

SEQ ID NO: 417929 - RNA, 19 nt, Homo sapiens
cagcaccacccaccaaugg

SEQ ID NO: 417930 - RNA, 19 nt, Homo sapiens
cggcuugaccgcauucuuc

SEQ ID NO: 417931 - RNA, 19 nt, Homo sapiens
cagaacgacgggucuuuca

SEQ ID NO: 417932 - RNA, 19 nt, Homo sapiens
ggucaauaucacagaauuc

SEQ ID NO: 417933 - RNA, 19 nt, Homo sapiens
ccacuggaccacgcuaaau

SEQ ID NO: 417934 - RNA, 19 nt, Homo sapiens
caucggcacagacgugguu

SEQ ID NO: 417935 - RNA, 19 nt, Homo sapiens
acucagacgacgagaagaa

SEQ ID NO: 417936 - RNA, 19 nt, Homo sapiens
gugacuacagcaccaagaa

SEQ ID NO: 417937 - RNA, 19 nt, Homo sapiens
aggucaauaucacagaauu

SEQ ID NO: 417938 - RNA, 19 nt, Homo sapiens
ccgcgagcguguggaauuc

SEQ ID NO: 417939 - RNA, 19 nt, Homo sapiens
ggaaagccucacucucaac

SEQ ID NO: 417940 - RNA, 19 nt, Homo sapiens
uaaaaggugaggcagagua

SEQ ID NO: 417941 - RNA, 19 nt, Homo sapiens
caccaagaagcacguguau

SEQ ID NO: 417942 - RNA, 19 nt, Homo sapiens
ucaaggaaagccucacucu

SEQ ID NO: 417943 - RNA, 19 nt, Homo sapiens
ccaagaaggggcaggauga

SEQ ID NO: 417944 - RNA, 19 nt, Homo sapiens
gaacacugccucccacuuu

SEQ ID NO: 417945 - RNA, 19 nt, Homo sapiens
caaagagacucagguguca

SEQ ID NO: 417946 - RNA, 19 nt, Homo sapiens
ggacacagacagagacaga

SEQ ID NO: 417947 - RNA, 19 nt, Homo sapiens
ggaaccagauggcaaggau

SEQ ID NO: 417948 - RNA, 19 nt, Homo sapiens
ggacuucucccgucucuag

SEQ ID NO: 417949 - RNA, 19 nt, Homo sapiens
gaacagcacacuggacuuc

SEQ ID NO: 417950 - RNA, 19 nt, Homo sapiens
ggacggcucccucaucuca

SEQ ID NO: 417951 - RNA, 19 nt, Homo sapiens
ggucaucuuuguccgagaa

SEQ ID NO: 417952 - RNA, 19 nt, Homo sapiens
cgaggaaccagcccugaua

SEQ ID NO: 417953 - RNA, 19 nt, Homo sapiens
ggaagagaaggcagagaaa

SEQ ID NO: 417954 - RNA, 19 nt, Homo sapiens
gcgggcaguuuauguguga

SEQ ID NO: 417955 - RNA, 19 nt, Homo sapiens
agagaaaggccucauguug

SEQ ID NO: 417956 - RNA, 19 nt, Homo sapiens
gcucagguguugggaaaug

SEQ ID NO: 417957 - RNA, 19 nt, Homo sapiens
gcuaugaugacaacuggua

SEQ ID NO: 417958 - RNA, 19 nt, Homo sapiens
gcagagaaaggccucaugu

SEQ ID NO: 417959 - RNA, 19 nt, Homo sapiens
gcacugggcaagacacaga

SEQ ID NO: 417960 - RNA, 19 nt, Homo sapiens
auaaaugccuuggaggaaa

SEQ ID NO: 417961 - RNA, 19 nt, Homo sapiens
aagcucagguguugggaaa

SEQ ID NO: 417962 - RNA, 19 nt, Homo sapiens
gcagagcacugggcaagac

SEQ ID NO: 417963 - RNA, 19 nt, Homo sapiens
uccgaaagcucagguguug

SEQ ID NO: 417964 - RNA, 19 nt, Homo sapiens
gcgcugagcaggucaucuu

SEQ ID NO: 417965 - RNA, 19 nt, Homo sapiens
gaagagaaggcagagaaag

SEQ ID NO: 417966 - RNA, 19 nt, Homo sapiens
ggacugggaagccaaagag

SEQ ID NO: 417967 - RNA, 19 nt, Homo sapiens
cagacugguuggacuuguu

SEQ ID NO: 417968 - RNA, 19 nt, Homo sapiens
ccugcaaaguggagcauga

SEQ ID NO: 417969 - RNA, 19 nt, Homo sapiens
cugagcaggucaucuuugu

SEQ ID NO: 417970 - RNA, 19 nt, Homo sapiens
gcucccagcuggucaucca

SEQ ID NO: 417971 - RNA, 19 nt, Homo sapiens
gcaugagagcuucgaggaa

SEQ ID NO: 417972 - RNA, 19 nt, Homo sapiens
uaaaugccuuggaggaaaa

SEQ ID NO: 417973 - RNA, 19 nt, Homo sapiens
ccacaggcaccuacuaaac

SEQ ID NO: 417974 - RNA, 19 nt, Homo sapiens
ggaaaccggagcccaggau

SEQ ID NO: 417975 - RNA, 19 nt, Homo sapiens
acgcuacccuccugaagug

SEQ ID NO: 417976 - RNA, 19 nt, Homo sapiens
ggaacacugccucccacuu

SEQ ID NO: 417977 - RNA, 19 nt, Homo sapiens
ggaggaggaggaagagaag

SEQ ID NO: 417978 - RNA, 19 nt, Homo sapiens
cagagaaaggccucauguu

SEQ ID NO: 417979 - RNA, 19 nt, Homo sapiens
gugaggaggaggaggaaga

SEQ ID NO: 417980 - RNA, 19 nt, Homo sapiens
ugugcgaguucaagugcua

SEQ ID NO: 417981 - RNA, 19 nt, Homo sapiens
gaccuggcucagagucaua

SEQ ID NO: 417982 - RNA, 19 nt, Homo sapiens
gccaggacccuacgacagu

SEQ ID NO: 417983 - RNA, 19 nt, Homo sapiens
ggacgagggcaacuacacu

SEQ ID NO: 417984 - RNA, 19 nt, Homo sapiens
ggaggacgagggcaacuac

SEQ ID NO: 417985 - RNA, 19 nt, Homo sapiens
aggaagagaaggcagagaa

SEQ ID NO: 417986 - RNA, 19 nt, Homo sapiens
aauaaaugccuuggaggaa

SEQ ID NO: 417987 - RNA, 19 nt, Homo sapiens
ggaggaggaggaggaggaa

SEQ ID NO: 417988 - RNA, 19 nt, Homo sapiens
gcugagcaggucaucuuug

SEQ ID NO: 417989 - RNA, 19 nt, Homo sapiens
gacgagggcaacuacacuu

SEQ ID NO: 417990 - RNA, 19 nt, Homo sapiens
ggaacagcacacuggacuu

SEQ ID NO: 417991 - RNA, 19 nt, Homo sapiens
ggaugugcgaguucaagug

SEQ ID NO: 417992 - RNA, 19 nt, Homo sapiens
aaccagauggcaaggauga

SEQ ID NO: 417993 - RNA, 19 nt, Homo sapiens
uagccaagcccaagaacca

SEQ ID NO: 417994 - RNA, 19 nt, Homo sapiens
cugcgaaccaccagaaugu

SEQ ID NO: 417995 - RNA, 19 nt, Homo sapiens
gcccagaaggucacguuca

SEQ ID NO: 417996 - RNA, 19 nt, Homo sapiens
gaaguucgcuuaccgguuu

SEQ ID NO: 417997 - RNA, 19 nt, Homo sapiens
ggaaggagcuggacaagau

SEQ ID NO: 417998 - RNA, 19 nt, Homo sapiens
ccaaguacuucuucaauaa

SEQ ID NO: 417999 - RNA, 19 nt, Homo sapiens
gagaacagcugaaauacug

SEQ ID NO: 418000 - RNA, 19 nt, Homo sapiens
gaacggugaugaauguuga

SEQ ID NO: 418001 - RNA, 19 nt, Homo sapiens
ccagagaacagcugaaaua

SEQ ID NO: 418002 - RNA, 19 nt, Homo sapiens
gggacaaccucaucuacua

SEQ ID NO: 418003 - RNA, 19 nt, Homo sapiens
gccaaguacuucuucaaua

SEQ ID NO: 418004 - RNA, 19 nt, Homo sapiens
gaacuuuguaugagacuua

SEQ ID NO: 418005 - RNA, 19 nt, Homo sapiens
ccugacagcugcagcauuu

SEQ ID NO: 418006 - RNA, 19 nt, Homo sapiens
acacugaacucacagauca

SEQ ID NO: 418007 - RNA, 19 nt, Homo sapiens
gcacacauguagcccauca

SEQ ID NO: 418008 - RNA, 19 nt, Homo sapiens
ggaagaagcgggaguucaa

SEQ ID NO: 418009 - RNA, 19 nt, Homo sapiens
ucacaugaacuuuguauga

SEQ ID NO: 418010 - RNA, 19 nt, Homo sapiens
ucagagagguauucacaug

SEQ ID NO: 418011 - RNA, 19 nt, Homo sapiens
gauaaagaacuuagggauu

SEQ ID NO: 418012 - RNA, 19 nt, Homo sapiens
agucuacacuucagauuaa

SEQ ID NO: 418013 - RNA, 19 nt, Homo sapiens
caucguggccugcuucuuu

SEQ ID NO: 418014 - RNA, 19 nt, Homo sapiens
caauggaaauucaguuauc

SEQ ID NO: 418015 - RNA, 19 nt, Homo sapiens
cgacggccgugaugaaguu

SEQ ID NO: 418016 - RNA, 19 nt, Homo sapiens
caggaaaggugacaugagu

SEQ ID NO: 418017 - RNA, 19 nt, Homo sapiens
gagcagauucucaugaaga

SEQ ID NO: 418018 - RNA, 19 nt, Homo sapiens
acucacggcuggccaagua

SEQ ID NO: 418019 - RNA, 19 nt, Homo sapiens
ggagaaagugcuggaguuu

SEQ ID NO: 418020 - RNA, 19 nt, Homo sapiens
gcaguacgcacuagcaguu

SEQ ID NO: 418021 - RNA, 19 nt, Homo sapiens
ggaaaggugacaugaguuc

SEQ ID NO: 418022 - RNA, 19 nt, Homo sapiens
ggcaauagagucacuguau

SEQ ID NO: 418023 - RNA, 19 nt, Homo sapiens
gcaauggaaauucaguuau

SEQ ID NO: 418024 - RNA, 19 nt, Homo sapiens
gaagagaugcuggccuaga

SEQ ID NO: 418025 - RNA, 19 nt, Homo sapiens
ggacaaccucaucuacuau

SEQ ID NO: 418026 - RNA, 19 nt, Homo sapiens
ugugaacggugaugaaugu

SEQ ID NO: 418027 - RNA, 19 nt, Homo sapiens
guagcuggaaccacuauaa

SEQ ID NO: 418028 - RNA, 19 nt, Homo sapiens
uaacaugcaguacgcacua

SEQ ID NO: 418029 - RNA, 19 nt, Homo sapiens
gcugcagcauuucauaaga

SEQ ID NO: 418030 - RNA, 19 nt, Homo sapiens
gcugaaauacugucacuag

SEQ ID NO: 418031 - RNA, 19 nt, Homo sapiens
gcagagacucagaagaaga

SEQ ID NO: 418032 - RNA, 19 nt, Homo sapiens
ucacuguauuugaccuuaa

SEQ ID NO: 418033 - RNA, 19 nt, Homo sapiens
gcaggaaggagcuggacaa

SEQ ID NO: 418034 - RNA, 19 nt, Homo sapiens
gggcaggcaugaccucaag

SEQ ID NO: 418035 - RNA, 19 nt, Homo sapiens
gcccaucaguggucugugu

SEQ ID NO: 418036 - RNA, 19 nt, Homo sapiens
ucacaaacugcucauguug

SEQ ID NO: 418037 - RNA, 19 nt, Homo sapiens
uggagaaagugcuggaguu

SEQ ID NO: 418038 - RNA, 19 nt, Homo sapiens
gaaggagcuggacaagauu

SEQ ID NO: 418039 - RNA, 19 nt, Homo sapiens
aggcagagacucagaagaa

SEQ ID NO: 418040 - RNA, 19 nt, Homo sapiens
ggacacccgcgugcucuuu

SEQ ID NO: 418041 - RNA, 19 nt, Homo sapiens
uucaugagcugccagaguu

SEQ ID NO: 418042 - RNA, 19 nt, Homo sapiens
ccucuggacucacaaacug

SEQ ID NO: 418043 - RNA, 19 nt, Homo sapiens
caggcaggcuccuugaugu

SEQ ID NO: 418044 - RNA, 19 nt, Homo sapiens
ggugaccggugugaccuuu

SEQ ID NO: 418045 - RNA, 19 nt, Homo sapiens
cugcagcauuucauaagaa

SEQ ID NO: 418046 - RNA, 19 nt, Homo sapiens
ugaacuguauguggagaaa

SEQ ID NO: 418047 - RNA, 19 nt, Homo sapiens
caaccuggcacuaauugau

SEQ ID NO: 418048 - RNA, 19 nt, Homo sapiens
gguucgagaucucuugcaa

SEQ ID NO: 418049 - RNA, 19 nt, Homo sapiens
cgggaggcauguccaaguu

SEQ ID NO: 418050 - RNA, 19 nt, Homo sapiens
ucacagguaccgaaacuuc

SEQ ID NO: 418051 - RNA, 19 nt, Homo sapiens
ggcaggaaguuuguuguca

SEQ ID NO: 418052 - RNA, 19 nt, Homo sapiens
ugaaauacugucacuagug

SEQ ID NO: 418053 - RNA, 19 nt, Homo sapiens
ggaggaggcagaagcaucu

SEQ ID NO: 418054 - RNA, 19 nt, Homo sapiens
acaaacugcucauguugca

SEQ ID NO: 418055 - RNA, 19 nt, Homo sapiens
ggaggauggagucgcgaua

SEQ ID NO: 418056 - RNA, 19 nt, Homo sapiens
ccacccaguucuccugugu

SEQ ID NO: 418057 - RNA, 19 nt, Homo sapiens
acaugaacuuuguaugaga

SEQ ID NO: 418058 - RNA, 19 nt, Homo sapiens
ggacgcugcugccugucau

SEQ ID NO: 418059 - RNA, 19 nt, Homo sapiens
gcacuucaaaccugagauc

SEQ ID NO: 418060 - RNA, 19 nt, Homo sapiens
gcgccuaugggacauguuu

SEQ ID NO: 418061 - RNA, 19 nt, Homo sapiens
gaaucuuccaucuucauga

SEQ ID NO: 418062 - RNA, 19 nt, Homo sapiens
ucauucaguuccuccagaa

SEQ ID NO: 418063 - RNA, 19 nt, Homo sapiens
ggcgugggaaccuaaauuu

SEQ ID NO: 418064 - RNA, 19 nt, Homo sapiens
ucacaaaggguaacauugc

SEQ ID NO: 418065 - RNA, 19 nt, Homo sapiens
ggugaugaauguugaaaau

SEQ ID NO: 418066 - RNA, 19 nt, Homo sapiens
cacuguauuugaccuuaaa

SEQ ID NO: 418067 - RNA, 19 nt, Homo sapiens
gcacaaaacgcucccuaga

SEQ ID NO: 418068 - RNA, 19 nt, Homo sapiens
cagcugcagcauuucauaa

SEQ ID NO: 418069 - RNA, 19 nt, Homo sapiens
uaccugcaauggaaauuca

SEQ ID NO: 418070 - RNA, 19 nt, Homo sapiens
ccaaguucgugugcaucua

SEQ ID NO: 418071 - RNA, 19 nt, Homo sapiens
gacaagacggugcgccuau

SEQ ID NO: 418072 - RNA, 19 nt, Homo sapiens
ugcaauggaaauucaguua

SEQ ID NO: 418073 - RNA, 19 nt, Homo sapiens
gagaagacaggaaaaguga

SEQ ID NO: 418074 - RNA, 19 nt, Homo sapiens
ggaaagcagaccuguugca

SEQ ID NO: 418075 - RNA, 19 nt, Homo sapiens
cuggaaagcagaccuguug

SEQ ID NO: 418076 - RNA, 19 nt, Homo sapiens
cacaugaacuuuguaugag

SEQ ID NO: 418077 - RNA, 19 nt, Homo sapiens
caggaaguuuguugucaca

SEQ ID NO: 418078 - RNA, 19 nt, Homo sapiens
ggacacgaagggcccauca

SEQ ID NO: 418079 - RNA, 19 nt, Homo sapiens
uggcuuugcuucuggaauc

SEQ ID NO: 418080 - RNA, 19 nt, Homo sapiens
gugcagacgggcuccauug

SEQ ID NO: 418081 - RNA, 19 nt, Homo sapiens
gauggcaggaaguuuguug

SEQ ID NO: 418082 - RNA, 19 nt, Homo sapiens
ggguaacauugcccagaug

SEQ ID NO: 418083 - RNA, 19 nt, Homo sapiens
ggcaggcuccuugauguuu

SEQ ID NO: 418084 - RNA, 19 nt, Homo sapiens
cagcagggccacuucaaca

SEQ ID NO: 418085 - RNA, 19 nt, Homo sapiens
ggccaaguacuucuucaau

SEQ ID NO: 418086 - RNA, 19 nt, Homo sapiens
guaccggcgugggaaccua

SEQ ID NO: 418087 - RNA, 19 nt, Homo sapiens
gcuuaccgguuuucaaauu

SEQ ID NO: 418088 - RNA, 19 nt, Homo sapiens
cagcugaaauacugucacu

SEQ ID NO: 418089 - RNA, 19 nt, Homo sapiens
gcuggaaccacuauaacau

SEQ ID NO: 418090 - RNA, 19 nt, Homo sapiens
cucacaaacugcucauguu

SEQ ID NO: 418091 - RNA, 19 nt, Homo sapiens
ggaccgugcgagccuuuga

SEQ ID NO: 418092 - RNA, 19 nt, Homo sapiens
caugagcugccagaguuua

SEQ ID NO: 418093 - RNA, 19 nt, Homo sapiens
cagagagguauucacauga

SEQ ID NO: 418094 - RNA, 19 nt, Homo sapiens
gcuucugcuucgucacuuu

SEQ ID NO: 418095 - RNA, 19 nt, Homo sapiens
gcaaggucaagguguggaa

SEQ ID NO: 418096 - RNA, 19 nt, Homo sapiens
ggaaagugcucuugaugau

SEQ ID NO: 418097 - RNA, 19 nt, Homo sapiens
gauacauucuggcuuauuu

SEQ ID NO: 418098 - RNA, 19 nt, Homo sapiens
gaacugauaccuaccugua

SEQ ID NO: 418099 - RNA, 19 nt, Homo sapiens
acacugauguucaccuuua

SEQ ID NO: 418100 - RNA, 19 nt, Homo sapiens
aaagugcucuugaugauuu

SEQ ID NO: 418101 - RNA, 19 nt, Homo sapiens
gcccagaucugaauguaaa

SEQ ID NO: 418102 - RNA, 19 nt, Homo sapiens
gguuuaagcuguauaugaa

SEQ ID NO: 418103 - RNA, 19 nt, Homo sapiens
ggaaggaaauguucucaag

SEQ ID NO: 418104 - RNA, 19 nt, Homo sapiens
gaccuuggcugacauaugu

SEQ ID NO: 418105 - RNA, 19 nt, Homo sapiens
cauguucccuugaguauuu

SEQ ID NO: 418106 - RNA, 19 nt, Homo sapiens
ggaguuggcugaggaagaa

SEQ ID NO: 418107 - RNA, 19 nt, Homo sapiens
gcacaagucugcagaucau

SEQ ID NO: 418108 - RNA, 19 nt, Homo sapiens
gauaugaccucccaacaag

SEQ ID NO: 418109 - RNA, 19 nt, Homo sapiens
uugaagaccuuacauguuu

SEQ ID NO: 418110 - RNA, 19 nt, Homo sapiens
gaaagcccuucaaguggua

SEQ ID NO: 418111 - RNA, 19 nt, Homo sapiens
guagaaagcccuucaagug

SEQ ID NO: 418112 - RNA, 19 nt, Homo sapiens
ggacaucucuagcauuucu

SEQ ID NO: 418113 - RNA, 19 nt, Homo sapiens
ugacauauguugguaggua

SEQ ID NO: 418114 - RNA, 19 nt, Homo sapiens
cuaaauagaugcccuaguc

SEQ ID NO: 418115 - RNA, 19 nt, Homo sapiens
gcaagaaugugucacuagu

SEQ ID NO: 418116 - RNA, 19 nt, Homo sapiens
gaauucacuucuugccuaa

SEQ ID NO: 418117 - RNA, 19 nt, Homo sapiens
gcuuugagcuucugacaug

SEQ ID NO: 418118 - RNA, 19 nt, Homo sapiens
aagaaugugucacuaguaa

SEQ ID NO: 418119 - RNA, 19 nt, Homo sapiens
aaggacaucucuagcauuu

SEQ ID NO: 418120 - RNA, 19 nt, Homo sapiens
gagacuaguucuacacaau

SEQ ID NO: 418121 - RNA, 19 nt, Homo sapiens
guccuucacuuaucaauau

SEQ ID NO: 418122 - RNA, 19 nt, Homo sapiens
gacccuagcagaacugaua

SEQ ID NO: 418123 - RNA, 19 nt, Homo sapiens
ugaauucucuaaagggaaa

SEQ ID NO: 418124 - RNA, 19 nt, Homo sapiens
gaccugggacucuguauuu

SEQ ID NO: 418125 - RNA, 19 nt, Homo sapiens
caaaauaugugagcaguuu

SEQ ID NO: 418126 - RNA, 19 nt, Homo sapiens
ccuuaaagcuccagccaaa

SEQ ID NO: 418127 - RNA, 19 nt, Homo sapiens
ggagucagcagaaccauug

SEQ ID NO: 418128 - RNA, 19 nt, Homo sapiens
gaguuucacuuccagagaa

SEQ ID NO: 418129 - RNA, 19 nt, Homo sapiens
gaagagcccagaucugaau

SEQ ID NO: 418130 - RNA, 19 nt, Homo sapiens
gaaaguagcuuggaaaagg

SEQ ID NO: 418131 - RNA, 19 nt, Homo sapiens
guaaggacaucucuagcau

SEQ ID NO: 418132 - RNA, 19 nt, Homo sapiens
gagcccagaucugaaugua

SEQ ID NO: 418133 - RNA, 19 nt, Homo sapiens
cuacaaugcugugugauau

SEQ ID NO: 418134 - RNA, 19 nt, Homo sapiens
gcagagccuuugagaaugg

SEQ ID NO: 418135 - RNA, 19 nt, Homo sapiens
gaacagugucugaucaugu

SEQ ID NO: 418136 - RNA, 19 nt, Homo sapiens
agacuguucuguagguuaa

SEQ ID NO: 418137 - RNA, 19 nt, Homo sapiens
caaauucacaugcauuaug

SEQ ID NO: 418138 - RNA, 19 nt, Homo sapiens
caaagcaaauucacaugca

SEQ ID NO: 418139 - RNA, 19 nt, Homo sapiens
ggauaucacagcaacauug

SEQ ID NO: 418140 - RNA, 19 nt, Homo sapiens
aaagagaggccuuaggauu

SEQ ID NO: 418141 - RNA, 19 nt, Homo sapiens
cauucaagauugugccaua

SEQ ID NO: 418142 - RNA, 19 nt, Homo sapiens
gaaauuccaacuccuauac

SEQ ID NO: 418143 - RNA, 19 nt, Homo sapiens
uaaagaagggcccauccua

SEQ ID NO: 418144 - RNA, 19 nt, Homo sapiens
acaauagaguugaaagaga

SEQ ID NO: 418145 - RNA, 19 nt, Homo sapiens
cagaaugguugcagaguca

SEQ ID NO: 418146 - RNA, 19 nt, Homo sapiens
cuucagaacuccagcaugu

SEQ ID NO: 418147 - RNA, 19 nt, Homo sapiens
ggugaacagugucugauca

SEQ ID NO: 418148 - RNA, 19 nt, Homo sapiens
agagugagguauauuagga

SEQ ID NO: 418149 - RNA, 19 nt, Homo sapiens
cauuuacgauucucacuga

SEQ ID NO: 418150 - RNA, 19 nt, Homo sapiens
ugaaggagaucacagaaaa

SEQ ID NO: 418151 - RNA, 19 nt, Homo sapiens
gguauggaguucacacugu

SEQ ID NO: 418152 - RNA, 19 nt, Homo sapiens
gaagggcccauccuauuuc

SEQ ID NO: 418153 - RNA, 19 nt, Homo sapiens
ugaaagagaggccuuagga

SEQ ID NO: 418154 - RNA, 19 nt, Homo sapiens
guuacaaagcuuagguuua

SEQ ID NO: 418155 - RNA, 19 nt, Homo sapiens
uaaguccauugaucaugua

SEQ ID NO: 418156 - RNA, 19 nt, Homo sapiens
gaaagugcucuugaugauu

SEQ ID NO: 418157 - RNA, 19 nt, Homo sapiens
gggacucuguauuucuaua

SEQ ID NO: 418158 - RNA, 19 nt, Homo sapiens
augcgacucucaaacuuua

SEQ ID NO: 418159 - RNA, 19 nt, Homo sapiens
caagaaugugucacuagua

SEQ ID NO: 418160 - RNA, 19 nt, Homo sapiens
uggaggagcuucuggaaag

SEQ ID NO: 418161 - RNA, 19 nt, Homo sapiens
gacuaguucuacacaauau

SEQ ID NO: 418162 - RNA, 19 nt, Homo sapiens
uggguggcuucaugaauua

SEQ ID NO: 418163 - RNA, 19 nt, Homo sapiens
cagcaagaaugugucacua

SEQ ID NO: 418164 - RNA, 19 nt, Homo sapiens
gauaucacagcaacauuga

SEQ ID NO: 418165 - RNA, 19 nt, Homo sapiens
ggcagucuuucucaaacua

SEQ ID NO: 418166 - RNA, 19 nt, Homo sapiens
acaaauaaacccaguguca

SEQ ID NO: 418167 - RNA, 19 nt, Homo sapiens
ugcagcagcuacaagauuu

SEQ ID NO: 418168 - RNA, 19 nt, Homo sapiens
ggagacuaguucuacacaa

SEQ ID NO: 418169 - RNA, 19 nt, Homo sapiens
gaaaaggaguagggguaua

SEQ ID NO: 418170 - RNA, 19 nt, Homo sapiens
uggcagagccuuugagaau

SEQ ID NO: 418171 - RNA, 19 nt, Homo sapiens
agaaggcaaugaaggaguu

SEQ ID NO: 418172 - RNA, 19 nt, Homo sapiens
uaucacagcaacauugaaa

SEQ ID NO: 418173 - RNA, 19 nt, Homo sapiens
caaacuauguaugguaaag

SEQ ID NO: 418174 - RNA, 19 nt, Homo sapiens
caaggucucaggcuauuug

SEQ ID NO: 418175 - RNA, 19 nt, Homo sapiens
ucaggaaaguagcuuggaa

SEQ ID NO: 418176 - RNA, 19 nt, Homo sapiens
cauucuggcuuauuugaga

SEQ ID NO: 418177 - RNA, 19 nt, Homo sapiens
gaauagggucuguuucaca

SEQ ID NO: 418178 - RNA, 19 nt, Homo sapiens
uuaaguccauugaucaugu

SEQ ID NO: 418179 - RNA, 19 nt, Homo sapiens
cuaguccacuuuaucuuug

SEQ ID NO: 418180 - RNA, 19 nt, Homo sapiens
ggaagagcccagaucugaa

SEQ ID NO: 418181 - RNA, 19 nt, Homo sapiens
agaagggcccauccuauuu

SEQ ID NO: 418182 - RNA, 19 nt, Homo sapiens
ccacacugauguucaccuu

SEQ ID NO: 418183 - RNA, 19 nt, Homo sapiens
cuuguucucuccuauuuga

SEQ ID NO: 418184 - RNA, 19 nt, Homo sapiens
ucaaaugguuacccugcuu

SEQ ID NO: 418185 - RNA, 19 nt, Homo sapiens
ucucuugccuucagacaga

SEQ ID NO: 418186 - RNA, 19 nt, Homo sapiens
guccauugaucauguacuu

SEQ ID NO: 418187 - RNA, 19 nt, Homo sapiens
caaacuggccagacuguuc

SEQ ID NO: 418188 - RNA, 19 nt, Homo sapiens
cucaaacuauguaugguaa

SEQ ID NO: 418189 - RNA, 19 nt, Homo sapiens
gauugaaugugagcagguu

SEQ ID NO: 418190 - RNA, 19 nt, Homo sapiens
gaaagagaggccuuaggau

SEQ ID NO: 418191 - RNA, 19 nt, Homo sapiens
gcagcagcuacaagauuua

SEQ ID NO: 418192 - RNA, 19 nt, Homo sapiens
uggaagagcccagaucuga

SEQ ID NO: 418193 - RNA, 19 nt, Homo sapiens
caggagacacugccaaaga

SEQ ID NO: 418194 - RNA, 19 nt, Homo sapiens
ggccaucuuuccucauguu

SEQ ID NO: 418195 - RNA, 19 nt, Homo sapiens
agacuaguucuacacaaua

SEQ ID NO: 418196 - RNA, 19 nt, Homo sapiens
gaguaaggcucacuaaaua

SEQ ID NO: 418197 - RNA, 19 nt, Homo sapiens
guuagaagcccauucauua

SEQ ID NO: 418198 - RNA, 19 nt, Homo sapiens
ccaaauaccuugccacugu

SEQ ID NO: 418199 - RNA, 19 nt, Homo sapiens
agagaaaucuggagaacua

SEQ ID NO: 418200 - RNA, 19 nt, Homo sapiens
ggaaaucucuuuggaaaca

SEQ ID NO: 418201 - RNA, 19 nt, Homo sapiens
gggaauuucugaccuagua

SEQ ID NO: 418202 - RNA, 19 nt, Homo sapiens
ccucuuaucucucugguua

SEQ ID NO: 418203 - RNA, 19 nt, Homo sapiens
ucaauaagcuagauacgaa

SEQ ID NO: 418204 - RNA, 19 nt, Homo sapiens
gaagggaauuucugaccua

SEQ ID NO: 418205 - RNA, 19 nt, Homo sapiens
ggaaacaucaugaguacua

SEQ ID NO: 418206 - RNA, 19 nt, Homo sapiens
gaaguguggugguuauuug

SEQ ID NO: 418207 - RNA, 19 nt, Homo sapiens
gaauggcgauggcaagauu

SEQ ID NO: 418208 - RNA, 19 nt, Homo sapiens
aaacugugcuuccgaguaa

SEQ ID NO: 418209 - RNA, 19 nt, Homo sapiens
gggcuaauguucuaauuug

SEQ ID NO: 418210 - RNA, 19 nt, Homo sapiens
guggaaggcuacauuuaua

SEQ ID NO: 418211 - RNA, 19 nt, Homo sapiens
ccaaauggcugcggaaaga

SEQ ID NO: 418212 - RNA, 19 nt, Homo sapiens
uagcgaacuuguauacuua

SEQ ID NO: 418213 - RNA, 19 nt, Homo sapiens
gaaauaaugcacugaguau

SEQ ID NO: 418214 - RNA, 19 nt, Homo sapiens
ggauauugcuaauugugua

SEQ ID NO: 418215 - RNA, 19 nt, Homo sapiens
ggaaggcacuacaugaaau

SEQ ID NO: 418216 - RNA, 19 nt, Homo sapiens
uaggaaaucucuuuggaaa

SEQ ID NO: 418217 - RNA, 19 nt, Homo sapiens
gcacaauggucucacaaca

SEQ ID NO: 418218 - RNA, 19 nt, Homo sapiens
uggaacaccuacauaauuu

SEQ ID NO: 418219 - RNA, 19 nt, Homo sapiens
gaaggaauacuuagacaau

SEQ ID NO: 418220 - RNA, 19 nt, Homo sapiens
guacugaauuccauaauac

SEQ ID NO: 418221 - RNA, 19 nt, Homo sapiens
aaacugauguacugaauuc

SEQ ID NO: 418222 - RNA, 19 nt, Homo sapiens
ucaaacagauaacagaaga

SEQ ID NO: 418223 - RNA, 19 nt, Homo sapiens
agagacagguuacuuggua

SEQ ID NO: 418224 - RNA, 19 nt, Homo sapiens
cacaaacagugaagaaauu

SEQ ID NO: 418225 - RNA, 19 nt, Homo sapiens
gaaggcacuacaugaaaua

SEQ ID NO: 418226 - RNA, 19 nt, Homo sapiens
caccuaaucuucccaaugu

SEQ ID NO: 418227 - RNA, 19 nt, Homo sapiens
caagugauauauccagaug

SEQ ID NO: 418228 - RNA, 19 nt, Homo sapiens
gugaagaaauugccuuuua

SEQ ID NO: 418229 - RNA, 19 nt, Homo sapiens
ggucguagcaggaaagauu

SEQ ID NO: 418230 - RNA, 19 nt, Homo sapiens
guaaacugauguacugaau

SEQ ID NO: 418231 - RNA, 19 nt, Homo sapiens
gcaaugcuaucacugucuu

SEQ ID NO: 418232 - RNA, 19 nt, Homo sapiens
gauaacagaagauacaguu

SEQ ID NO: 418233 - RNA, 19 nt, Homo sapiens
aggaguaucuucaagcuuu

SEQ ID NO: 418234 - RNA, 19 nt, Homo sapiens
gcuggugucucgaacauau

SEQ ID NO: 418235 - RNA, 19 nt, Homo sapiens
uaacagaagauacaguuga

SEQ ID NO: 418236 - RNA, 19 nt, Homo sapiens
ggugaauuauggccucuuu

SEQ ID NO: 418237 - RNA, 19 nt, Homo sapiens
cauaggaaaucucuuugga

SEQ ID NO: 418238 - RNA, 19 nt, Homo sapiens
gcaaaaguaugaaggagaa

SEQ ID NO: 418239 - RNA, 19 nt, Homo sapiens
ggcacuacaugaaauaaug

SEQ ID NO: 418240 - RNA, 19 nt, Homo sapiens
gaacaccuacauaauuuca

SEQ ID NO: 418241 - RNA, 19 nt, Homo sapiens
ugaaguauggguuaaauga

SEQ ID NO: 418242 - RNA, 19 nt, Homo sapiens
cauggucccuagaacauuu

SEQ ID NO: 418243 - RNA, 19 nt, Homo sapiens
gaagauacaguugaguuug

SEQ ID NO: 418244 - RNA, 19 nt, Homo sapiens
ccucagagaccuuacauga

SEQ ID NO: 418245 - RNA, 19 nt, Homo sapiens
ggcgugaaaugacuagauu

SEQ ID NO: 418246 - RNA, 19 nt, Homo sapiens
gaagacccauugguaagau

SEQ ID NO: 418247 - RNA, 19 nt, Homo sapiens
gaauaauggagaacaaguu

SEQ ID NO: 418248 - RNA, 19 nt, Homo sapiens
gaaaggcaaaguacauugu

SEQ ID NO: 418249 - RNA, 19 nt, Homo sapiens
gaagaaugcuuuugcgaau

SEQ ID NO: 418250 - RNA, 19 nt, Homo sapiens
gaggauuacuaccaaagug

SEQ ID NO: 418251 - RNA, 19 nt, Homo sapiens
cgaguaaggcucacuaaau

SEQ ID NO: 418252 - RNA, 19 nt, Homo sapiens
uaaagagacagguuacuug

SEQ ID NO: 418253 - RNA, 19 nt, Homo sapiens
gaacuauaccugcuucagu

SEQ ID NO: 418254 - RNA, 19 nt, Homo sapiens
gcagaggcaacuaugaauu

SEQ ID NO: 418255 - RNA, 19 nt, Homo sapiens
ggaaaaggguauugaagga

SEQ ID NO: 418256 - RNA, 19 nt, Homo sapiens
cggaacuucuagaggauua

SEQ ID NO: 418257 - RNA, 19 nt, Homo sapiens
guggaacaccuacauaauu

SEQ ID NO: 418258 - RNA, 19 nt, Homo sapiens
ucucaaggcucauacagau

SEQ ID NO: 418259 - RNA, 19 nt, Homo sapiens
cgaagaugauuucaguuca

SEQ ID NO: 418260 - RNA, 19 nt, Homo sapiens
ugaaauaaugcacugagua

SEQ ID NO: 418261 - RNA, 19 nt, Homo sapiens
uaccauguaucacaccuaa

SEQ ID NO: 418262 - RNA, 19 nt, Homo sapiens
caucauuuguccuguucua

SEQ ID NO: 418263 - RNA, 19 nt, Homo sapiens
gauacagaauaauggagaa

SEQ ID NO: 418264 - RNA, 19 nt, Homo sapiens
caguugaguuuggcucuua

SEQ ID NO: 418265 - RNA, 19 nt, Homo sapiens
gcaucacucucuucacugu

SEQ ID NO: 418266 - RNA, 19 nt, Homo sapiens
caaauaccuugccacuguu

SEQ ID NO: 418267 - RNA, 19 nt, Homo sapiens
acagguuacuugguacuua

SEQ ID NO: 418268 - RNA, 19 nt, Homo sapiens
uaaaguauaugugcagucu

SEQ ID NO: 418269 - RNA, 19 nt, Homo sapiens
ccaguugggucauauccuu

SEQ ID NO: 418270 - RNA, 19 nt, Homo sapiens
gcaaguacugaaggauuua

SEQ ID NO: 418271 - RNA, 19 nt, Homo sapiens
uuagcgaacuuguauacuu

SEQ ID NO: 418272 - RNA, 19 nt, Homo sapiens
cagggagaauugaaacuga

SEQ ID NO: 418273 - RNA, 19 nt, Homo sapiens
aggcaacuaugaauucaaa

SEQ ID NO: 418274 - RNA, 19 nt, Homo sapiens
caugaguacuaccugcaua

SEQ ID NO: 418275 - RNA, 19 nt, Homo sapiens
gggcuucauugauaguauu

SEQ ID NO: 418276 - RNA, 19 nt, Homo sapiens
uaagcuagauacgaaauca

SEQ ID NO: 418277 - RNA, 19 nt, Homo sapiens
aagcgaagaugauuucagu

SEQ ID NO: 418278 - RNA, 19 nt, Homo sapiens
acacaaaguccuuaacaug

SEQ ID NO: 418279 - RNA, 19 nt, Homo sapiens
uaacaucauugcauaacag

SEQ ID NO: 418280 - RNA, 19 nt, Homo sapiens
ggucaucauuuguccuguu

SEQ ID NO: 418281 - RNA, 19 nt, Homo sapiens
cuaccaaaguggaagaaug

SEQ ID NO: 418282 - RNA, 19 nt, Homo sapiens
uaaguuaacgagugcaauu

SEQ ID NO: 418283 - RNA, 19 nt, Homo sapiens
uagucgaucuguauucaaa

SEQ ID NO: 418284 - RNA, 19 nt, Homo sapiens
ggcgauggcaagauuauuu

SEQ ID NO: 418285 - RNA, 19 nt, Homo sapiens
gggacaguguucaggauug

SEQ ID NO: 418286 - RNA, 19 nt, Homo sapiens
ugcaaguacugaaggauuu

SEQ ID NO: 418287 - RNA, 19 nt, Homo sapiens
ugacuagauuggccgguuu

SEQ ID NO: 418288 - RNA, 19 nt, Homo sapiens
gcucugggucgaauaguuu

SEQ ID NO: 418289 - RNA, 19 nt, Homo sapiens
caugauggccuacuugguu

SEQ ID NO: 418290 - RNA, 19 nt, Homo sapiens
gcgaagaugauuucaguuc

SEQ ID NO: 418291 - RNA, 19 nt, Homo sapiens
agaagcccauucauuagaa

SEQ ID NO: 418292 - RNA, 19 nt, Homo sapiens
aaguauaugugcagucuug

SEQ ID NO: 418293 - RNA, 19 nt, Homo sapiens
ugugguaguuggaaacaaa

SEQ ID NO: 418294 - RNA, 19 nt, Homo sapiens
gcaaauaugagcgcacaau

SEQ ID NO: 418295 - RNA, 19 nt, Homo sapiens
gcaguauugaguuguuuaa

SEQ ID NO: 418296 - RNA, 19 nt, Homo sapiens
gaacaacaacagcaaauua

SEQ ID NO: 418297 - RNA, 19 nt, Homo sapiens
gaugggagcugaugagaau

SEQ ID NO: 418298 - RNA, 19 nt, Homo sapiens
gaagagcuuugaucaguuc

SEQ ID NO: 418299 - RNA, 19 nt, Homo sapiens
guaaaucccuuuccccuua

SEQ ID NO: 418300 - RNA, 19 nt, Homo sapiens
guuagaaccugaaccacua

SEQ ID NO: 418301 - RNA, 19 nt, Homo sapiens
ccaaggagcucuggcugua

SEQ ID NO: 418302 - RNA, 19 nt, Homo sapiens
cagguuagaucugcaauuu

SEQ ID NO: 418303 - RNA, 19 nt, Homo sapiens
ccacgacgcucucagaugu

SEQ ID NO: 418304 - RNA, 19 nt, Homo sapiens
gaaguuucauuccuugguu

SEQ ID NO: 418305 - RNA, 19 nt, Homo sapiens
gagaggaucuugagguucu

SEQ ID NO: 418306 - RNA, 19 nt, Homo sapiens
gcagagccuugagaaguuu

SEQ ID NO: 418307 - RNA, 19 nt, Homo sapiens
caacagcaaauuagacaaa

SEQ ID NO: 418308 - RNA, 19 nt, Homo sapiens
ggaagugugagaucuguaa

SEQ ID NO: 418309 - RNA, 19 nt, Homo sapiens
ucaaggaucugagccuaaa

SEQ ID NO: 418310 - RNA, 19 nt, Homo sapiens
ugugagaucuguaagaaau

SEQ ID NO: 418311 - RNA, 19 nt, Homo sapiens
gguuagaucugcaauuucu

SEQ ID NO: 418312 - RNA, 19 nt, Homo sapiens
gaaucaaaguggaaugaag

SEQ ID NO: 418313 - RNA, 19 nt, Homo sapiens
ggcagagccuugagaaguu

SEQ ID NO: 418314 - RNA, 19 nt, Homo sapiens
gaucauguuugcuaaagag

SEQ ID NO: 418315 - RNA, 19 nt, Homo sapiens
gcacagaauugggcagcuu

SEQ ID NO: 418316 - RNA, 19 nt, Homo sapiens
agagggagcugauguccaa

SEQ ID NO: 418317 - RNA, 19 nt, Homo sapiens
cuacagagcugggcaugug

SEQ ID NO: 418318 - RNA, 19 nt, Homo sapiens
ccaguucaguugucuaugu

SEQ ID NO: 418319 - RNA, 19 nt, Homo sapiens
gacuggaacugguaugaug

SEQ ID NO: 418320 - RNA, 19 nt, Homo sapiens
cugcuguucuggaaucuua

SEQ ID NO: 418321 - RNA, 19 nt, Homo sapiens
aaagagaaaucuggaagug

SEQ ID NO: 418322 - RNA, 19 nt, Homo sapiens
gcugauuaccuacaaauga

SEQ ID NO: 418323 - RNA, 19 nt, Homo sapiens
gaaccugaaccacuaacuu

SEQ ID NO: 418324 - RNA, 19 nt, Homo sapiens
cauguuugcuaaagagaaa

SEQ ID NO: 418325 - RNA, 19 nt, Homo sapiens
gggagacgcuucuggacau

SEQ ID NO: 418326 - RNA, 19 nt, Homo sapiens
ugagaucuguaagaaauga

SEQ ID NO: 418327 - RNA, 19 nt, Homo sapiens
gguggccucuggacgagua

SEQ ID NO: 418328 - RNA, 19 nt, Homo sapiens
ggaacaacaacagcaaauu

SEQ ID NO: 418329 - RNA, 19 nt, Homo sapiens
uaccuuaacccaaaugaaa

SEQ ID NO: 418330 - RNA, 19 nt, Homo sapiens
gucaagagaucuggaaauc

SEQ ID NO: 418331 - RNA, 19 nt, Homo sapiens
gagcccaggucuagguuuc

SEQ ID NO: 418332 - RNA, 19 nt, Homo sapiens
gagaaucaaaguggaauga

SEQ ID NO: 418333 - RNA, 19 nt, Homo sapiens
cagcaagaaugccuuugug

SEQ ID NO: 418334 - RNA, 19 nt, Homo sapiens
gguuuaagacucugacauu

SEQ ID NO: 418335 - RNA, 19 nt, Homo sapiens
guucaguugucuauguauu

SEQ ID NO: 418336 - RNA, 19 nt, Homo sapiens
uugaagugcugauuaccua

SEQ ID NO: 418337 - RNA, 19 nt, Homo sapiens
acacagcauuucuccuuga

SEQ ID NO: 418338 - RNA, 19 nt, Homo sapiens
ugaagagcuuugaucaguu

SEQ ID NO: 418339 - RNA, 19 nt, Homo sapiens
caguucaguugucuaugua

SEQ ID NO: 418340 - RNA, 19 nt, Homo sapiens
ccagcaagcucaucaucuc

SEQ ID NO: 418341 - RNA, 19 nt, Homo sapiens
gccaggacguggagcgauu

SEQ ID NO: 418342 - RNA, 19 nt, Homo sapiens
uggcaggccuguccaacuu

SEQ ID NO: 418343 - RNA, 19 nt, Homo sapiens
acacucugcuguucuggaa

SEQ ID NO: 418344 - RNA, 19 nt, Homo sapiens
caacaccuuugacuaucug

SEQ ID NO: 418345 - RNA, 19 nt, Homo sapiens
gauuucagaucauguuugc

SEQ ID NO: 418346 - RNA, 19 nt, Homo sapiens
ccugcaaccugcuguaugu

SEQ ID NO: 418347 - RNA, 19 nt, Homo sapiens
ccaggcuucuguacuucua

SEQ ID NO: 418348 - RNA, 19 nt, Homo sapiens
gaugagaaucaaaguggaa

SEQ ID NO: 418349 - RNA, 19 nt, Homo sapiens
gaagaugggagcugaugag

SEQ ID NO: 418350 - RNA, 19 nt, Homo sapiens
gggagcaggugauauaucc

SEQ ID NO: 418351 - RNA, 19 nt, Homo sapiens
gaguuacugugcccaaagu

SEQ ID NO: 418352 - RNA, 19 nt, Homo sapiens
ccaguguuguguaguuaga

SEQ ID NO: 418353 - RNA, 19 nt, Homo sapiens
ugucuucucuaucauggaa

SEQ ID NO: 418354 - RNA, 19 nt, Homo sapiens
agacacagcauuucuccuu

SEQ ID NO: 418355 - RNA, 19 nt, Homo sapiens
gaaguacgcagugcuugau

SEQ ID NO: 418356 - RNA, 19 nt, Homo sapiens
gaucuugagguucuuggaa

SEQ ID NO: 418357 - RNA, 19 nt, Homo sapiens
gugagcaucuucggguauu

SEQ ID NO: 418358 - RNA, 19 nt, Homo sapiens
caaagacuuggaaggguuu

SEQ ID NO: 418359 - RNA, 19 nt, Homo sapiens
gaugaugagaggaucuuga

SEQ ID NO: 418360 - RNA, 19 nt, Homo sapiens
gggaaacaaagacuuggaa

SEQ ID NO: 418361 - RNA, 19 nt, Homo sapiens
caaagcaugagguggaguu

SEQ ID NO: 418362 - RNA, 19 nt, Homo sapiens
cagaaagcacaaagcauga

SEQ ID NO: 418363 - RNA, 19 nt, Homo sapiens
ggagucaagagaucuggaa

SEQ ID NO: 418364 - RNA, 19 nt, Homo sapiens
cugcagauacugaagguuu

SEQ ID NO: 418365 - RNA, 19 nt, Homo sapiens
cugauuaccuacaaaugau

SEQ ID NO: 418366 - RNA, 19 nt, Homo sapiens
ggaagaugggagcugauga

SEQ ID NO: 418367 - RNA, 19 nt, Homo sapiens
agugugagaucuguaagaa

SEQ ID NO: 418368 - RNA, 19 nt, Homo sapiens
cgaaguacgcagugcuuga

SEQ ID NO: 418369 - RNA, 19 nt, Homo sapiens
gcacccuggucagcaagaa

SEQ ID NO: 418370 - RNA, 19 nt, Homo sapiens
gggagcugauguccaagga

SEQ ID NO: 418371 - RNA, 19 nt, Homo sapiens
ggagccugcugcuuucuac

SEQ ID NO: 418372 - RNA, 19 nt, Homo sapiens
ucaacgugcugcgggauga

SEQ ID NO: 418373 - RNA, 19 nt, Homo sapiens
guuuaagacucugacauuc

SEQ ID NO: 418374 - RNA, 19 nt, Homo sapiens
aaucuuaugcccaggguuu

SEQ ID NO: 418375 - RNA, 19 nt, Homo sapiens
cagaucauguuugcuaaag

SEQ ID NO: 418376 - RNA, 19 nt, Homo sapiens
uuucagaucauguuugcua

SEQ ID NO: 418377 - RNA, 19 nt, Homo sapiens
ugggcagcauccugaguua

SEQ ID NO: 418378 - RNA, 19 nt, Homo sapiens
ugacccuacuggagcaauu

SEQ ID NO: 418379 - RNA, 19 nt, Homo sapiens
uaccuuccuuaccuucaua

SEQ ID NO: 418380 - RNA, 19 nt, Homo sapiens
gggaacaacaacagcaaau

SEQ ID NO: 418381 - RNA, 19 nt, Homo sapiens
ugcccuaccuuaacccaaa

SEQ ID NO: 418382 - RNA, 19 nt, Homo sapiens
acaucucccuuuccacuug

SEQ ID NO: 418383 - RNA, 19 nt, Homo sapiens
ggagcaauuugugaucuac

SEQ ID NO: 418384 - RNA, 19 nt, Homo sapiens
gagcucagguucgccacau

SEQ ID NO: 418385 - RNA, 19 nt, Homo sapiens
guacgcagugcuugaugaa

SEQ ID NO: 418386 - RNA, 19 nt, Homo sapiens
gccagcagacacagcauuu

SEQ ID NO: 418387 - RNA, 19 nt, Homo sapiens
cugcagagacuccuucaga

SEQ ID NO: 418388 - RNA, 19 nt, Homo sapiens
acacuuaacauagauggaa

SEQ ID NO: 418389 - RNA, 19 nt, Homo sapiens
guauuaccuuccuuaccuu

SEQ ID NO: 418390 - RNA, 19 nt, Homo sapiens
uguauuaccuuccuuaccu

SEQ ID NO: 418391 - RNA, 19 nt, Homo sapiens
caacaacagcaaauuagac

SEQ ID NO: 418392 - RNA, 19 nt, Homo sapiens
gaaaucuggaagugugaga

SEQ ID NO: 418393 - RNA, 19 nt, Homo sapiens
gagaaaucuggaaguguga

SEQ ID NO: 418394 - RNA, 19 nt, Homo sapiens
uugagaaguuucauuccuu

SEQ ID NO: 418395 - RNA, 19 nt, Homo sapiens
ggagacgcuucuggacaug

SEQ ID NO: 418396 - RNA, 19 nt, Homo sapiens
gaacaacaacagcaaauua

SEQ ID NO: 418397 - RNA, 19 nt, Homo sapiens
gaugggagcugaugagaau

SEQ ID NO: 418398 - RNA, 19 nt, Homo sapiens
gaagagcuuugaucaguuc

SEQ ID NO: 418399 - RNA, 19 nt, Homo sapiens
guaaaucccuuuccccuua

SEQ ID NO: 418400 - RNA, 19 nt, Homo sapiens
guuagaaccugaaccacua

SEQ ID NO: 418401 - RNA, 19 nt, Homo sapiens
ccaaggagcucuggcugua

SEQ ID NO: 418402 - RNA, 19 nt, Homo sapiens
cagguuagaucugcaauuu

SEQ ID NO: 418403 - RNA, 19 nt, Homo sapiens
ccacgacgcucucagaugu

SEQ ID NO: 418404 - RNA, 19 nt, Homo sapiens
gaaguuucauuccuugguu

SEQ ID NO: 418405 - RNA, 19 nt, Homo sapiens
gagaggaucuugagguucu

SEQ ID NO: 418406 - RNA, 19 nt, Homo sapiens
gcagagccuugagaaguuu

SEQ ID NO: 418407 - RNA, 19 nt, Homo sapiens
caacagcaaauuagacaaa

SEQ ID NO: 418408 - RNA, 19 nt, Homo sapiens
ggaagugugagaucuguaa

SEQ ID NO: 418409 - RNA, 19 nt, Homo sapiens
ucaaggaucugagccuaaa

SEQ ID NO: 418410 - RNA, 19 nt, Homo sapiens
ugugagaucuguaagaaau

SEQ ID NO: 418411 - RNA, 19 nt, Homo sapiens
gguuagaucugcaauuucu

SEQ ID NO: 418412 - RNA, 19 nt, Homo sapiens
gaaucaaaguggaaugaag

SEQ ID NO: 418413 - RNA, 19 nt, Homo sapiens
ggcagagccuugagaaguu

SEQ ID NO: 418414 - RNA, 19 nt, Homo sapiens
gaucauguuugcuaaagag

SEQ ID NO: 418415 - RNA, 19 nt, Homo sapiens
gcacagaauugggcagcuu

SEQ ID NO: 418416 - RNA, 19 nt, Homo sapiens
agagggagcugauguccaa

SEQ ID NO: 418417 - RNA, 19 nt, Homo sapiens
cuacagagcugggcaugug

SEQ ID NO: 418418 - RNA, 19 nt, Homo sapiens
ccaguucaguugucuaugu

SEQ ID NO: 418419 - RNA, 19 nt, Homo sapiens
gacuggaacugguaugaug

SEQ ID NO: 418420 - RNA, 19 nt, Homo sapiens
cugcuguucuggaaucuua

SEQ ID NO: 418421 - RNA, 19 nt, Homo sapiens
aaagagaaaucuggaagug

SEQ ID NO: 418422 - RNA, 19 nt, Homo sapiens
gcugauuaccuacaaauga

SEQ ID NO: 418423 - RNA, 19 nt, Homo sapiens
gaaccugaaccacuaacuu

SEQ ID NO: 418424 - RNA, 19 nt, Homo sapiens
cauguuugcuaaagagaaa

SEQ ID NO: 418425 - RNA, 19 nt, Homo sapiens
gggagacgcuucuggacau

SEQ ID NO: 418426 - RNA, 19 nt, Homo sapiens
ugagaucuguaagaaauga

SEQ ID NO: 418427 - RNA, 19 nt, Homo sapiens
gguggccucuggacgagua

SEQ ID NO: 418428 - RNA, 19 nt, Homo sapiens
ggaacaacaacagcaaauu

SEQ ID NO: 418429 - RNA, 19 nt, Homo sapiens
uaccuuaacccaaaugaaa

SEQ ID NO: 418430 - RNA, 19 nt, Homo sapiens
gucaagagaucuggaaauc

SEQ ID NO: 418431 - RNA, 19 nt, Homo sapiens
gagcccaggucuagguuuc

SEQ ID NO: 418432 - RNA, 19 nt, Homo sapiens
gagaaucaaaguggaauga

SEQ ID NO: 418433 - RNA, 19 nt, Homo sapiens
cagcaagaaugccuuugug

SEQ ID NO: 418434 - RNA, 19 nt, Homo sapiens
guucaguugucuauguauu

SEQ ID NO: 418435 - RNA, 19 nt, Homo sapiens
uugaagugcugauuaccua

SEQ ID NO: 418436 - RNA, 19 nt, Homo sapiens
acacagcauuucuccuuga

SEQ ID NO: 418437 - RNA, 19 nt, Homo sapiens
ugaagagcuuugaucaguu

SEQ ID NO: 418438 - RNA, 19 nt, Homo sapiens
caguucaguugucuaugua

SEQ ID NO: 418439 - RNA, 19 nt, Homo sapiens
ccagcaagcucaucaucuc

SEQ ID NO: 418440 - RNA, 19 nt, Homo sapiens
gccaggacguggagcgauu

SEQ ID NO: 418441 - RNA, 19 nt, Homo sapiens
uggcaggccuguccaacuu

SEQ ID NO: 418442 - RNA, 19 nt, Homo sapiens
acacucugcuguucuggaa

SEQ ID NO: 418443 - RNA, 19 nt, Homo sapiens
caacaccuuugacuaucug

SEQ ID NO: 418444 - RNA, 19 nt, Homo sapiens
gauuucagaucauguuugc

SEQ ID NO: 418445 - RNA, 19 nt, Homo sapiens
ccugcaaccugcuguaugu

SEQ ID NO: 418446 - RNA, 19 nt, Homo sapiens
ccaggcuucuguacuucua

SEQ ID NO: 418447 - RNA, 19 nt, Homo sapiens
gaugagaaucaaaguggaa

SEQ ID NO: 418448 - RNA, 19 nt, Homo sapiens
gaagaugggagcugaugag

SEQ ID NO: 418449 - RNA, 19 nt, Homo sapiens
gggagcaggugauauaucc

SEQ ID NO: 418450 - RNA, 19 nt, Homo sapiens
gaguuacugugcccaaagu

SEQ ID NO: 418451 - RNA, 19 nt, Homo sapiens
ccaguguuguguaguuaga

SEQ ID NO: 418452 - RNA, 19 nt, Homo sapiens
ugucuucucuaucauggaa

SEQ ID NO: 418453 - RNA, 19 nt, Homo sapiens
agacacagcauuucuccuu

SEQ ID NO: 418454 - RNA, 19 nt, Homo sapiens
gaaguacgcagugcuugau

SEQ ID NO: 418455 - RNA, 19 nt, Homo sapiens
gaucuugagguucuuggaa

SEQ ID NO: 418456 - RNA, 19 nt, Homo sapiens
gugagcaucuucggguauu

SEQ ID NO: 418457 - RNA, 19 nt, Homo sapiens
gaugaugagaggaucuuga

SEQ ID NO: 418458 - RNA, 19 nt, Homo sapiens
caaagcaugagguggaguu

SEQ ID NO: 418459 - RNA, 19 nt, Homo sapiens
cagaaagcacaaagcauga

SEQ ID NO: 418460 - RNA, 19 nt, Homo sapiens
ggagucaagagaucuggaa

SEQ ID NO: 418461 - RNA, 19 nt, Homo sapiens
cugcagauacugaagguuu

SEQ ID NO: 418462 - RNA, 19 nt, Homo sapiens
cugauuaccuacaaaugau

SEQ ID NO: 418463 - RNA, 19 nt, Homo sapiens
ggaagaugggagcugauga

SEQ ID NO: 418464 - RNA, 19 nt, Homo sapiens
agugugagaucuguaagaa

SEQ ID NO: 418465 - RNA, 19 nt, Homo sapiens
cgaaguacgcagugcuuga

SEQ ID NO: 418466 - RNA, 19 nt, Homo sapiens
gcacccuggucagcaagaa

SEQ ID NO: 418467 - RNA, 19 nt, Homo sapiens
gggagcugauguccaagga

SEQ ID NO: 418468 - RNA, 19 nt, Homo sapiens
ggagccugcugcuuucuac

SEQ ID NO: 418469 - RNA, 19 nt, Homo sapiens
ucaacgugcugcgggauga

SEQ ID NO: 418470 - RNA, 19 nt, Homo sapiens
aaucuuaugcccaggguuu

SEQ ID NO: 418471 - RNA, 19 nt, Homo sapiens
cagaucauguuugcuaaag

SEQ ID NO: 418472 - RNA, 19 nt, Homo sapiens
uuucagaucauguuugcua

SEQ ID NO: 418473 - RNA, 19 nt, Homo sapiens
ugggcagcauccugaguua

SEQ ID NO: 418474 - RNA, 19 nt, Homo sapiens
uaccuuccuuaccuucaua

SEQ ID NO: 418475 - RNA, 19 nt, Homo sapiens
gggaacaacaacagcaaau

SEQ ID NO: 418476 - RNA, 19 nt, Homo sapiens
ugcccuaccuuaacccaaa

SEQ ID NO: 418477 - RNA, 19 nt, Homo sapiens
acaucucccuuuccacuug

SEQ ID NO: 418478 - RNA, 19 nt, Homo sapiens
gagcucagguucgccacau

SEQ ID NO: 418479 - RNA, 19 nt, Homo sapiens
guacgcagugcuugaugaa

SEQ ID NO: 418480 - RNA, 19 nt, Homo sapiens
gccagcagacacagcauuu

SEQ ID NO: 418481 - RNA, 19 nt, Homo sapiens
cugcagagacuccuucaga

SEQ ID NO: 418482 - RNA, 19 nt, Homo sapiens
acacuuaacauagauggaa

SEQ ID NO: 418483 - RNA, 19 nt, Homo sapiens
guauuaccuuccuuaccuu

SEQ ID NO: 418484 - RNA, 19 nt, Homo sapiens
uguauuaccuuccuuaccu

SEQ ID NO: 418485 - RNA, 19 nt, Homo sapiens
caacaacagcaaauuagac

SEQ ID NO: 418486 - RNA, 19 nt, Homo sapiens
gaaaucuggaagugugaga

SEQ ID NO: 418487 - RNA, 19 nt, Homo sapiens
gagaaaucuggaaguguga

SEQ ID NO: 418488 - RNA, 19 nt, Homo sapiens
uugagaaguuucauuccuu

SEQ ID NO: 418489 - RNA, 19 nt, Homo sapiens
ggagacgcuucuggacaug

SEQ ID NO: 418490 - RNA, 19 nt, Homo sapiens
guaguuagaaccugaacca

SEQ ID NO: 418491 - RNA, 19 nt, Homo sapiens
gaagugcugauuaccuaca

SEQ ID NO: 418492 - RNA, 19 nt, Homo sapiens
ggucagcaagaaugccuuu

SEQ ID NO: 418493 - RNA, 19 nt, Homo sapiens
ugccaguguuguguaguua

SEQ ID NO: 418494 - RNA, 19 nt, Homo sapiens
gcuaaagagaaaucuggaa

SEQ ID NO: 418495 - RNA, 19 nt, Homo sapiens
gaugcaacggcucuccuuu

SEQ ID NO: 418496 - RNA, 19 nt, Homo sapiens
gaacaacaacagcaaauua

SEQ ID NO: 418497 - RNA, 19 nt, Homo sapiens
gaugggagcugaugagaau

SEQ ID NO: 418498 - RNA, 19 nt, Homo sapiens
guaaaucccuuuccccuua

SEQ ID NO: 418499 - RNA, 19 nt, Homo sapiens
guuagaaccugaaccacua

SEQ ID NO: 418500 - RNA, 19 nt, Homo sapiens
ccaaggagcucuggcugua

SEQ ID NO: 418501 - RNA, 19 nt, Homo sapiens
cagguuagaucugcaauuu

SEQ ID NO: 418502 - RNA, 19 nt, Homo sapiens
ccacgacgcucucagaugu

SEQ ID NO: 418503 - RNA, 19 nt, Homo sapiens
gaaguuucauuccuugguu

SEQ ID NO: 418504 - RNA, 19 nt, Homo sapiens
gagaggaucuugagguucu

SEQ ID NO: 418505 - RNA, 19 nt, Homo sapiens
gcagagccuugagaaguuu

SEQ ID NO: 418506 - RNA, 19 nt, Homo sapiens
caacagcaaauuagacaaa

SEQ ID NO: 418507 - RNA, 19 nt, Homo sapiens
ggaagugugagaucuguaa

SEQ ID NO: 418508 - RNA, 19 nt, Homo sapiens
ucaaggaucugagccuaaa

SEQ ID NO: 418509 - RNA, 19 nt, Homo sapiens
ugugagaucuguaagaaau

SEQ ID NO: 418510 - RNA, 19 nt, Homo sapiens
gaaucaaaguggaaugaag

SEQ ID NO: 418511 - RNA, 19 nt, Homo sapiens
ggcagagccuugagaaguu

SEQ ID NO: 418512 - RNA, 19 nt, Homo sapiens
gguuagaucugcaauuucu

SEQ ID NO: 418513 - RNA, 19 nt, Homo sapiens
gaucauguuugcuaaagag

SEQ ID NO: 418514 - RNA, 19 nt, Homo sapiens
gcacagaauugggcagcuu

SEQ ID NO: 418515 - RNA, 19 nt, Homo sapiens
agagggagcugauguccaa

SEQ ID NO: 418516 - RNA, 19 nt, Homo sapiens
cuacagagcugggcaugug

SEQ ID NO: 418517 - RNA, 19 nt, Homo sapiens
ccaguucaguugucuaugu

SEQ ID NO: 418518 - RNA, 19 nt, Homo sapiens
gacuggaacugguaugaug

SEQ ID NO: 418519 - RNA, 19 nt, Homo sapiens
cugcuguucuggaaucuua

SEQ ID NO: 418520 - RNA, 19 nt, Homo sapiens
aaagagaaaucuggaagug

SEQ ID NO: 418521 - RNA, 19 nt, Homo sapiens
gcugauuaccuacaaauga

SEQ ID NO: 418522 - RNA, 19 nt, Homo sapiens
gaaccugaaccacuaacuu

SEQ ID NO: 418523 - RNA, 19 nt, Homo sapiens
cauguuugcuaaagagaaa

SEQ ID NO: 418524 - RNA, 19 nt, Homo sapiens
gggagacgcuucuggacau

SEQ ID NO: 418525 - RNA, 19 nt, Homo sapiens
ugagaucuguaagaaauga

SEQ ID NO: 418526 - RNA, 19 nt, Homo sapiens
gguggccucuggacgagua

SEQ ID NO: 418527 - RNA, 19 nt, Homo sapiens
ggaacaacaacagcaaauu

SEQ ID NO: 418528 - RNA, 19 nt, Homo sapiens
uaccuuaacccaaaugaaa

SEQ ID NO: 418529 - RNA, 19 nt, Homo sapiens
gucaagagaucuggaaauc

SEQ ID NO: 418530 - RNA, 19 nt, Homo sapiens
gagcccaggucuagguuuc

SEQ ID NO: 418531 - RNA, 19 nt, Homo sapiens
gagaaucaaaguggaauga

SEQ ID NO: 418532 - RNA, 19 nt, Homo sapiens
cagcaagaaugccuuugug

SEQ ID NO: 418533 - RNA, 19 nt, Homo sapiens
gguuuaagacucugacauu

SEQ ID NO: 418534 - RNA, 19 nt, Homo sapiens
guucaguugucuauguauu

SEQ ID NO: 418535 - RNA, 19 nt, Homo sapiens
uugaagugcugauuaccua

SEQ ID NO: 418536 - RNA, 19 nt, Homo sapiens
acacagcauuucuccuuga

SEQ ID NO: 418537 - RNA, 19 nt, Homo sapiens
caguucaguugucuaugua

SEQ ID NO: 418538 - RNA, 19 nt, Homo sapiens
ccagcaagcucaucaucuc

SEQ ID NO: 418539 - RNA, 19 nt, Homo sapiens
gccaggacguggagcgauu

SEQ ID NO: 418540 - RNA, 19 nt, Homo sapiens
uggcaggccuguccaacuu

SEQ ID NO: 418541 - RNA, 19 nt, Homo sapiens
acacucugcuguucuggaa

SEQ ID NO: 418542 - RNA, 19 nt, Homo sapiens
caacaccuuugacuaucug

SEQ ID NO: 418543 - RNA, 19 nt, Homo sapiens
gauuucagaucauguuugc

SEQ ID NO: 418544 - RNA, 19 nt, Homo sapiens
ccaggcuucuguacuucua

SEQ ID NO: 418545 - RNA, 19 nt, Homo sapiens
gaugagaaucaaaguggaa

SEQ ID NO: 418546 - RNA, 19 nt, Homo sapiens
gaagaugggagcugaugag

SEQ ID NO: 418547 - RNA, 19 nt, Homo sapiens
gggagcaggugauauaucc

SEQ ID NO: 418548 - RNA, 19 nt, Homo sapiens
gaguuacugugcccaaagu

SEQ ID NO: 418549 - RNA, 19 nt, Homo sapiens
ccaguguuguguaguuaga

SEQ ID NO: 418550 - RNA, 19 nt, Homo sapiens
ugucuucucuaucauggaa

SEQ ID NO: 418551 - RNA, 19 nt, Homo sapiens
agacacagcauuucuccuu

SEQ ID NO: 418552 - RNA, 19 nt, Homo sapiens
gaaguacgcagugcuugau

SEQ ID NO: 418553 - RNA, 19 nt, Homo sapiens
gaucuugagguucuuggaa

SEQ ID NO: 418554 - RNA, 19 nt, Homo sapiens
gugagcaucuucggguauu

SEQ ID NO: 418555 - RNA, 19 nt, Homo sapiens
caaagacuuggaaggguuu

SEQ ID NO: 418556 - RNA, 19 nt, Homo sapiens
gaugaugagaggaucuuga

SEQ ID NO: 418557 - RNA, 19 nt, Homo sapiens
gggaaacaaagacuuggaa

SEQ ID NO: 418558 - RNA, 19 nt, Homo sapiens
caaagcaugagguggaguu

SEQ ID NO: 418559 - RNA, 19 nt, Homo sapiens
cagaaagcacaaagcauga

SEQ ID NO: 418560 - RNA, 19 nt, Homo sapiens
ggagucaagagaucuggaa

SEQ ID NO: 418561 - RNA, 19 nt, Homo sapiens
cugauuaccuacaaaugau

SEQ ID NO: 418562 - RNA, 19 nt, Homo sapiens
cugcagauacugaagguuu

SEQ ID NO: 418563 - RNA, 19 nt, Homo sapiens
ggaagaugggagcugauga

SEQ ID NO: 418564 - RNA, 19 nt, Homo sapiens
agugugagaucuguaagaa

SEQ ID NO: 418565 - RNA, 19 nt, Homo sapiens
cgaaguacgcagugcuuga

SEQ ID NO: 418566 - RNA, 19 nt, Homo sapiens
gcacccuggucagcaagaa

SEQ ID NO: 418567 - RNA, 19 nt, Homo sapiens
gggagcugauguccaagga

SEQ ID NO: 418568 - RNA, 19 nt, Homo sapiens
ggagccugcugcuuucuac

SEQ ID NO: 418569 - RNA, 19 nt, Homo sapiens
guuuaagacucugacauuc

SEQ ID NO: 418570 - RNA, 19 nt, Homo sapiens
aaucuuaugcccaggguuu

SEQ ID NO: 418571 - RNA, 19 nt, Homo sapiens
cagaucauguuugcuaaag

SEQ ID NO: 418572 - RNA, 19 nt, Homo sapiens
uuucagaucauguuugcua

SEQ ID NO: 418573 - RNA, 19 nt, Homo sapiens
ugggcagcauccugaguua

SEQ ID NO: 418574 - RNA, 19 nt, Homo sapiens
ugacccuacuggagcaauu

SEQ ID NO: 418575 - RNA, 19 nt, Homo sapiens
uaccuuccuuaccuucaua

SEQ ID NO: 418576 - RNA, 19 nt, Homo sapiens
gggaacaacaacagcaaau

SEQ ID NO: 418577 - RNA, 19 nt, Homo sapiens
ugcccuaccuuaacccaaa

SEQ ID NO: 418578 - RNA, 19 nt, Homo sapiens
acaucucccuuuccacuug

SEQ ID NO: 418579 - RNA, 19 nt, Homo sapiens
gagcucagguucgccacau

SEQ ID NO: 418580 - RNA, 19 nt, Homo sapiens
guacgcagugcuugaugaa

SEQ ID NO: 418581 - RNA, 19 nt, Homo sapiens
gccagcagacacagcauuu

SEQ ID NO: 418582 - RNA, 19 nt, Homo sapiens
ggagcaauuugugaucuac

SEQ ID NO: 418583 - RNA, 19 nt, Homo sapiens
cugcagagacuccuucaga

SEQ ID NO: 418584 - RNA, 19 nt, Homo sapiens
acacuuaacauagauggaa

SEQ ID NO: 418585 - RNA, 19 nt, Homo sapiens
guauuaccuuccuuaccuu

SEQ ID NO: 418586 - RNA, 19 nt, Homo sapiens
uguauuaccuuccuuaccu

SEQ ID NO: 418587 - RNA, 19 nt, Homo sapiens
caacaacagcaaauuagac

SEQ ID NO: 418588 - RNA, 19 nt, Homo sapiens
gaaaucuggaagugugaga

SEQ ID NO: 418589 - RNA, 19 nt, Homo sapiens
gagaaaucuggaaguguga

SEQ ID NO: 418590 - RNA, 19 nt, Homo sapiens
uugagaaguuucauuccuu

SEQ ID NO: 418591 - RNA, 19 nt, Homo sapiens
ggagacgcuucuggacaug

SEQ ID NO: 418592 - RNA, 19 nt, Homo sapiens
guaguuagaaccugaacca

SEQ ID NO: 418593 - RNA, 19 nt, Homo sapiens
gaagugcugauuaccuaca

SEQ ID NO: 418594 - RNA, 19 nt, Homo sapiens
ggucagcaagaaugccuuu

SEQ ID NO: 418595 - RNA, 19 nt, Homo sapiens
uggagcaauuugugaucua

SEQ ID NO: 418596 - RNA, 19 nt, Homo sapiens
gaacaacaacagcaaauua

SEQ ID NO: 418597 - RNA, 19 nt, Homo sapiens
gaugggagcugaugagaau

SEQ ID NO: 418598 - RNA, 19 nt, Homo sapiens
gaagagcuuugaucaguuc

SEQ ID NO: 418599 - RNA, 19 nt, Homo sapiens
guaaaucccuuuccccuua

SEQ ID NO: 418600 - RNA, 19 nt, Homo sapiens
guuagaaccugaaccacua

SEQ ID NO: 418601 - RNA, 19 nt, Homo sapiens
ccaaggagcucuggcugua

SEQ ID NO: 418602 - RNA, 19 nt, Homo sapiens
cagguuagaucugcaauuu

SEQ ID NO: 418603 - RNA, 19 nt, Homo sapiens
ccacgacgcucucagaugu

SEQ ID NO: 418604 - RNA, 19 nt, Homo sapiens
gagaggaucuugagguucu

SEQ ID NO: 418605 - RNA, 19 nt, Homo sapiens
caacagcaaauuagacaaa

SEQ ID NO: 418606 - RNA, 19 nt, Homo sapiens
ggaagugugagaucuguaa

SEQ ID NO: 418607 - RNA, 19 nt, Homo sapiens
ucaaggaucugagccuaaa

SEQ ID NO: 418608 - RNA, 19 nt, Homo sapiens
ugugagaucuguaagaaau

SEQ ID NO: 418609 - RNA, 19 nt, Homo sapiens
gguuagaucugcaauuucu

SEQ ID NO: 418610 - RNA, 19 nt, Homo sapiens
gaaucaaaguggaaugaag

SEQ ID NO: 418611 - RNA, 19 nt, Homo sapiens
gaucauguuugcuaaagag

SEQ ID NO: 418612 - RNA, 19 nt, Homo sapiens
gcacagaauugggcagcuu

SEQ ID NO: 418613 - RNA, 19 nt, Homo sapiens
agagggagcugauguccaa

SEQ ID NO: 418614 - RNA, 19 nt, Homo sapiens
cuacagagcugggcaugug

SEQ ID NO: 418615 - RNA, 19 nt, Homo sapiens
ccaguucaguugucuaugu

SEQ ID NO: 418616 - RNA, 19 nt, Homo sapiens
gacuggaacugguaugaug

SEQ ID NO: 418617 - RNA, 19 nt, Homo sapiens
cugcuguucuggaaucuua

SEQ ID NO: 418618 - RNA, 19 nt, Homo sapiens
aaagagaaaucuggaagug

SEQ ID NO: 418619 - RNA, 19 nt, Homo sapiens
gcugauuaccuacaaauga

SEQ ID NO: 418620 - RNA, 19 nt, Homo sapiens
gaaccugaaccacuaacuu

SEQ ID NO: 418621 - RNA, 19 nt, Homo sapiens
cauguuugcuaaagagaaa

SEQ ID NO: 418622 - RNA, 19 nt, Homo sapiens
gugguggucucuuguaguu

SEQ ID NO: 418623 - RNA, 19 nt, Homo sapiens
gggagacgcuucuggacau

SEQ ID NO: 418624 - RNA, 19 nt, Homo sapiens
gguggucucuuguaguuuc

SEQ ID NO: 418625 - RNA, 19 nt, Homo sapiens
ugagaucuguaagaaauga

SEQ ID NO: 418626 - RNA, 19 nt, Homo sapiens
gguggccucuggacgagua

SEQ ID NO: 418627 - RNA, 19 nt, Homo sapiens
ggaacaacaacagcaaauu

SEQ ID NO: 418628 - RNA, 19 nt, Homo sapiens
uaccuuaacccaaaugaaa

SEQ ID NO: 418629 - RNA, 19 nt, Homo sapiens
gucaagagaucuggaaauc

SEQ ID NO: 418630 - RNA, 19 nt, Homo sapiens
gagcccaggucuagguuuc

SEQ ID NO: 418631 - RNA, 19 nt, Homo sapiens
gagaaucaaaguggaauga

SEQ ID NO: 418632 - RNA, 19 nt, Homo sapiens
cagcaagaaugccuuugug

SEQ ID NO: 418633 - RNA, 19 nt, Homo sapiens
gguuuaagacucugacauu

SEQ ID NO: 418634 - RNA, 19 nt, Homo sapiens
guucaguugucuauguauu

SEQ ID NO: 418635 - RNA, 19 nt, Homo sapiens
uugaagugcugauuaccua

SEQ ID NO: 418636 - RNA, 19 nt, Homo sapiens
guaguuucauuccuugguu

SEQ ID NO: 418637 - RNA, 19 nt, Homo sapiens
acacagcauuucuccuuga

SEQ ID NO: 418638 - RNA, 19 nt, Homo sapiens
ugaagagcuuugaucaguu

SEQ ID NO: 418639 - RNA, 19 nt, Homo sapiens
gaagguacccgugcucaca

SEQ ID NO: 418640 - RNA, 19 nt, Homo sapiens
caguucaguugucuaugua

SEQ ID NO: 418641 - RNA, 19 nt, Homo sapiens
ccagcaagcucaucaucuc

SEQ ID NO: 418642 - RNA, 19 nt, Homo sapiens
gccaggacguggagcgauu

SEQ ID NO: 418643 - RNA, 19 nt, Homo sapiens
uggcaggccuguccaacuu

SEQ ID NO: 418644 - RNA, 19 nt, Homo sapiens
acacucugcuguucuggaa

SEQ ID NO: 418645 - RNA, 19 nt, Homo sapiens
caacaccuuugacuaucug

SEQ ID NO: 418646 - RNA, 19 nt, Homo sapiens
gauuucagaucauguuugc

SEQ ID NO: 418647 - RNA, 19 nt, Homo sapiens
ccugcaaccugcuguaugu

SEQ ID NO: 418648 - RNA, 19 nt, Homo sapiens
ccaggcuucuguacuucua

SEQ ID NO: 418649 - RNA, 19 nt, Homo sapiens
gaugagaaucaaaguggaa

SEQ ID NO: 418650 - RNA, 19 nt, Homo sapiens
gaagaugggagcugaugag

SEQ ID NO: 418651 - RNA, 19 nt, Homo sapiens
gggagcaggugauauaucc

SEQ ID NO: 418652 - RNA, 19 nt, Homo sapiens
gaguuacugugcccaaagu

SEQ ID NO: 418653 - RNA, 19 nt, Homo sapiens
ccaguguuguguaguuaga

SEQ ID NO: 418654 - RNA, 19 nt, Homo sapiens
ugucuucucuaucauggaa

SEQ ID NO: 418655 - RNA, 19 nt, Homo sapiens
agacacagcauuucuccuu

SEQ ID NO: 418656 - RNA, 19 nt, Homo sapiens
gaaguacgcagugcuugau

SEQ ID NO: 418657 - RNA, 19 nt, Homo sapiens
gaucuugagguucuuggaa

SEQ ID NO: 418658 - RNA, 19 nt, Homo sapiens
gugagcaucuucggguauu

SEQ ID NO: 418659 - RNA, 19 nt, Homo sapiens
caaagacuuggaaggguuu

SEQ ID NO: 418660 - RNA, 19 nt, Homo sapiens
gaugaugagaggaucuuga

SEQ ID NO: 418661 - RNA, 19 nt, Homo sapiens
gggaaacaaagacuuggaa

SEQ ID NO: 418662 - RNA, 19 nt, Homo sapiens
caaagcaugagguggaguu

SEQ ID NO: 418663 - RNA, 19 nt, Homo sapiens
cagaaagcacaaagcauga

SEQ ID NO: 418664 - RNA, 19 nt, Homo sapiens
ggagucaagagaucuggaa

SEQ ID NO: 418665 - RNA, 19 nt, Homo sapiens
cugcagauacugaagguuu

SEQ ID NO: 418666 - RNA, 19 nt, Homo sapiens
cugauuaccuacaaaugau

SEQ ID NO: 418667 - RNA, 19 nt, Homo sapiens
ggaagaugggagcugauga

SEQ ID NO: 418668 - RNA, 19 nt, Homo sapiens
agugugagaucuguaagaa

SEQ ID NO: 418669 - RNA, 19 nt, Homo sapiens
ggccugaggaggagaaaga

SEQ ID NO: 418670 - RNA, 19 nt, Homo sapiens
cgaaguacgcagugcuuga

SEQ ID NO: 418671 - RNA, 19 nt, Homo sapiens
gcacccuggucagcaagaa

SEQ ID NO: 418672 - RNA, 19 nt, Homo sapiens
gggagcugauguccaagga

SEQ ID NO: 418673 - RNA, 19 nt, Homo sapiens
ggagccugcugcuuucuac

SEQ ID NO: 418674 - RNA, 19 nt, Homo sapiens
ucaacgugcugcgggauga

SEQ ID NO: 418675 - RNA, 19 nt, Homo sapiens
guuuaagacucugacauuc

SEQ ID NO: 418676 - RNA, 19 nt, Homo sapiens
aaucuuaugcccaggguuu

SEQ ID NO: 418677 - RNA, 19 nt, Homo sapiens
cagaucauguuugcuaaag

SEQ ID NO: 418678 - RNA, 19 nt, Homo sapiens
uuucagaucauguuugcua

SEQ ID NO: 418679 - RNA, 19 nt, Homo sapiens
ugacccuacuggagcaauu

SEQ ID NO: 418680 - RNA, 19 nt, Homo sapiens
ugggcagcauccugaguua

SEQ ID NO: 418681 - RNA, 19 nt, Homo sapiens
uaccuuccuuaccuucaua

SEQ ID NO: 418682 - RNA, 19 nt, Homo sapiens
gggaacaacaacagcaaau

SEQ ID NO: 418683 - RNA, 19 nt, Homo sapiens
ugcccuaccuuaacccaaa

SEQ ID NO: 418684 - RNA, 19 nt, Homo sapiens
acaucucccuuuccacuug

SEQ ID NO: 418685 - RNA, 19 nt, Homo sapiens
gagcucagguucgccacau

SEQ ID NO: 418686 - RNA, 19 nt, Homo sapiens
ggagcaauuugugaucuac

SEQ ID NO: 418687 - RNA, 19 nt, Homo sapiens
ggucucuuguaguuucauu

SEQ ID NO: 418688 - RNA, 19 nt, Homo sapiens
guacgcagugcuugaugaa

SEQ ID NO: 418689 - RNA, 19 nt, Homo sapiens
gccagcagacacagcauuu

SEQ ID NO: 418690 - RNA, 19 nt, Homo sapiens
cugcagagacuccuucaga

SEQ ID NO: 418691 - RNA, 19 nt, Homo sapiens
acacuuaacauagauggaa

SEQ ID NO: 418692 - RNA, 19 nt, Homo sapiens
guauuaccuuccuuaccuu

SEQ ID NO: 418693 - RNA, 19 nt, Homo sapiens
uguauuaccuuccuuaccu

SEQ ID NO: 418694 - RNA, 19 nt, Homo sapiens
caacaacagcaaauuagac

SEQ ID NO: 418695 - RNA, 19 nt, Homo sapiens
gaaaucuggaagugugaga

SEQ ID NO: 418696 - RNA, 19 nt, Homo sapiens
gaacaacaacagcaaauua

SEQ ID NO: 418697 - RNA, 19 nt, Homo sapiens
gaugggagcugaugagaau

SEQ ID NO: 418698 - RNA, 19 nt, Homo sapiens
gaagagcuuugaucaguuc

SEQ ID NO: 418699 - RNA, 19 nt, Homo sapiens
guaaaucccuuuccccuua

SEQ ID NO: 418700 - RNA, 19 nt, Homo sapiens
guuagaaccugaaccacua

SEQ ID NO: 418701 - RNA, 19 nt, Homo sapiens
ccaaggagcucuggcugua

SEQ ID NO: 418702 - RNA, 19 nt, Homo sapiens
cagguuagaucugcaauuu

SEQ ID NO: 418703 - RNA, 19 nt, Homo sapiens
ccacgacgcucucagaugu

SEQ ID NO: 418704 - RNA, 19 nt, Homo sapiens
gaaguuucauuccuugguu

SEQ ID NO: 418705 - RNA, 19 nt, Homo sapiens
gagaggaucuugagguucu

SEQ ID NO: 418706 - RNA, 19 nt, Homo sapiens
caaggacucacgccaaaua

SEQ ID NO: 418707 - RNA, 19 nt, Homo sapiens
gcagagccuugagaaguuu

SEQ ID NO: 418708 - RNA, 19 nt, Homo sapiens
caacagcaaauuagacaaa

SEQ ID NO: 418709 - RNA, 19 nt, Homo sapiens
ggaagugugagaucuguaa

SEQ ID NO: 418710 - RNA, 19 nt, Homo sapiens
gaacugcuggcucuaagaa

SEQ ID NO: 418711 - RNA, 19 nt, Homo sapiens
ucaaggaucugagccuaaa

SEQ ID NO: 418712 - RNA, 19 nt, Homo sapiens
ugacaagucucagguccua

SEQ ID NO: 418713 - RNA, 19 nt, Homo sapiens
gguuagaucugcaauuucu

SEQ ID NO: 418714 - RNA, 19 nt, Homo sapiens
ugugagaucuguaagaaau

SEQ ID NO: 418715 - RNA, 19 nt, Homo sapiens
gaaucaaaguggaaugaag

SEQ ID NO: 418716 - RNA, 19 nt, Homo sapiens
ggcagagccuugagaaguu

SEQ ID NO: 418717 - RNA, 19 nt, Homo sapiens
ggcaaggacucacgccaaa

SEQ ID NO: 418718 - RNA, 19 nt, Homo sapiens
gaucauguuugcuaaagag

SEQ ID NO: 418719 - RNA, 19 nt, Homo sapiens
gcacagaauugggcagcuu

SEQ ID NO: 418720 - RNA, 19 nt, Homo sapiens
agagggagcugauguccaa

SEQ ID NO: 418721 - RNA, 19 nt, Homo sapiens
cuacagagcugggcaugug

SEQ ID NO: 418722 - RNA, 19 nt, Homo sapiens
ccaguucaguugucuaugu

SEQ ID NO: 418723 - RNA, 19 nt, Homo sapiens
gacuggaacugguaugaug

SEQ ID NO: 418724 - RNA, 19 nt, Homo sapiens
cugcuguucuggaaucuua

SEQ ID NO: 418725 - RNA, 19 nt, Homo sapiens
aaagagaaaucuggaagug

SEQ ID NO: 418726 - RNA, 19 nt, Homo sapiens
gcugauuaccuacaaauga

SEQ ID NO: 418727 - RNA, 19 nt, Homo sapiens
gaaccugaaccacuaacuu

SEQ ID NO: 418728 - RNA, 19 nt, Homo sapiens
cauguuugcuaaagagaaa

SEQ ID NO: 418729 - RNA, 19 nt, Homo sapiens
gggagacgcuucuggacau

SEQ ID NO: 418730 - RNA, 19 nt, Homo sapiens
gagcaggucagucuaguuc

SEQ ID NO: 418731 - RNA, 19 nt, Homo sapiens
ugagaucuguaagaaauga

SEQ ID NO: 418732 - RNA, 19 nt, Homo sapiens
gguggccucuggacgagua

SEQ ID NO: 418733 - RNA, 19 nt, Homo sapiens
ggaacaacaacagcaaauu

SEQ ID NO: 418734 - RNA, 19 nt, Homo sapiens
uaccuuaacccaaaugaaa

SEQ ID NO: 418735 - RNA, 19 nt, Homo sapiens
gucaagagaucuggaaauc

SEQ ID NO: 418736 - RNA, 19 nt, Homo sapiens
gagcccaggucuagguuuc

SEQ ID NO: 418737 - RNA, 19 nt, Homo sapiens
gagaaucaaaguggaauga

SEQ ID NO: 418738 - RNA, 19 nt, Homo sapiens
ggauugggcccacuacuca

SEQ ID NO: 418739 - RNA, 19 nt, Homo sapiens
cagcaagaaugccuuugug

SEQ ID NO: 418740 - RNA, 19 nt, Homo sapiens
gguuuaagacucugacauu

SEQ ID NO: 418741 - RNA, 19 nt, Homo sapiens
guucaguugucuauguauu

SEQ ID NO: 418742 - RNA, 19 nt, Homo sapiens
uugaagugcugauuaccua

SEQ ID NO: 418743 - RNA, 19 nt, Homo sapiens
acacagcauuucuccuuga

SEQ ID NO: 418744 - RNA, 19 nt, Homo sapiens
ugaagagcuuugaucaguu

SEQ ID NO: 418745 - RNA, 19 nt, Homo sapiens
caguucaguugucuaugua

SEQ ID NO: 418746 - RNA, 19 nt, Homo sapiens
ccagcaagcucaucaucuc

SEQ ID NO: 418747 - RNA, 19 nt, Homo sapiens
gccaggacguggagcgauu

SEQ ID NO: 418748 - RNA, 19 nt, Homo sapiens
uggcaggccuguccaacuu

SEQ ID NO: 418749 - RNA, 19 nt, Homo sapiens
acacucugcuguucuggaa

SEQ ID NO: 418750 - RNA, 19 nt, Homo sapiens
caacaccuuugacuaucug

SEQ ID NO: 418751 - RNA, 19 nt, Homo sapiens
gauuucagaucauguuugc

SEQ ID NO: 418752 - RNA, 19 nt, Homo sapiens
aaggugagguggugaagug

SEQ ID NO: 418753 - RNA, 19 nt, Homo sapiens
ccugcaaccugcuguaugu

SEQ ID NO: 418754 - RNA, 19 nt, Homo sapiens
ccaggcuucuguacuucua

SEQ ID NO: 418755 - RNA, 19 nt, Homo sapiens
gaugagaaucaaaguggaa

SEQ ID NO: 418756 - RNA, 19 nt, Homo sapiens
gaagaugggagcugaugag

SEQ ID NO: 418757 - RNA, 19 nt, Homo sapiens
gaguuacugugcccaaagu

SEQ ID NO: 418758 - RNA, 19 nt, Homo sapiens
ccaguguuguguaguuaga

SEQ ID NO: 418759 - RNA, 19 nt, Homo sapiens
ugucuucucuaucauggaa

SEQ ID NO: 418760 - RNA, 19 nt, Homo sapiens
agacacagcauuucuccuu

SEQ ID NO: 418761 - RNA, 19 nt, Homo sapiens
gaaguacgcagugcuugau

SEQ ID NO: 418762 - RNA, 19 nt, Homo sapiens
gaucuugagguucuuggaa

SEQ ID NO: 418763 - RNA, 19 nt, Homo sapiens
gugagcaucuucggguauu

SEQ ID NO: 418764 - RNA, 19 nt, Homo sapiens
caaagacuuggaaggguuu

SEQ ID NO: 418765 - RNA, 19 nt, Homo sapiens
gaugaugagaggaucuuga

SEQ ID NO: 418766 - RNA, 19 nt, Homo sapiens
gggaaacaaagacuuggaa

SEQ ID NO: 418767 - RNA, 19 nt, Homo sapiens
caaagcaugagguggaguu

SEQ ID NO: 418768 - RNA, 19 nt, Homo sapiens
cagaaagcacaaagcauga

SEQ ID NO: 418769 - RNA, 19 nt, Homo sapiens
ggagucaagagaucuggaa

SEQ ID NO: 418770 - RNA, 19 nt, Homo sapiens
cugauuaccuacaaaugau

SEQ ID NO: 418771 - RNA, 19 nt, Homo sapiens
ggaagaugggagcugauga

SEQ ID NO: 418772 - RNA, 19 nt, Homo sapiens
gggaacugcuggcucuaag

SEQ ID NO: 418773 - RNA, 19 nt, Homo sapiens
gcaggucagucuaguucag

SEQ ID NO: 418774 - RNA, 19 nt, Homo sapiens
cugcagauacugaagguuu

SEQ ID NO: 418775 - RNA, 19 nt, Homo sapiens
agugugagaucuguaagaa

SEQ ID NO: 418776 - RNA, 19 nt, Homo sapiens
cgaaguacgcagugcuuga

SEQ ID NO: 418777 - RNA, 19 nt, Homo sapiens
gcacccuggucagcaagaa

SEQ ID NO: 418778 - RNA, 19 nt, Homo sapiens
gggagcugauguccaagga

SEQ ID NO: 418779 - RNA, 19 nt, Homo sapiens
ggagccugcugcuuucuac

SEQ ID NO: 418780 - RNA, 19 nt, Homo sapiens
ucaacgugcugcgggauga

SEQ ID NO: 418781 - RNA, 19 nt, Homo sapiens
guuuaagacucugacauuc

SEQ ID NO: 418782 - RNA, 19 nt, Homo sapiens
ugacccuacuggagcaauu

SEQ ID NO: 418783 - RNA, 19 nt, Homo sapiens
aaucuuaugcccaggguuu

SEQ ID NO: 418784 - RNA, 19 nt, Homo sapiens
cagaucauguuugcuaaag

SEQ ID NO: 418785 - RNA, 19 nt, Homo sapiens
uuucagaucauguuugcua

SEQ ID NO: 418786 - RNA, 19 nt, Homo sapiens
ggacucacgccaaauacca

SEQ ID NO: 418787 - RNA, 19 nt, Homo sapiens
ugggcagcauccugaguua

SEQ ID NO: 418788 - RNA, 19 nt, Homo sapiens
uaccuuccuuaccuucaua

SEQ ID NO: 418789 - RNA, 19 nt, Homo sapiens
ggagcaauuugugaucuac

SEQ ID NO: 418790 - RNA, 19 nt, Homo sapiens
cagagucccucgggucuca

SEQ ID NO: 418791 - RNA, 19 nt, Homo sapiens
gggaacaacaacagcaaau

SEQ ID NO: 418792 - RNA, 19 nt, Homo sapiens
ugcccuaccuuaacccaaa

SEQ ID NO: 418793 - RNA, 19 nt, Homo sapiens
acaucucccuuuccacuug

SEQ ID NO: 418794 - RNA, 19 nt, Homo sapiens
gagcucagguucgccacau

SEQ ID NO: 418795 - RNA, 19 nt, Homo sapiens
guacgcagugcuugaugaa

SEQ ID NO: 418796 - RNA, 19 nt, Homo sapiens
cgaauuaggaucacaauaa

SEQ ID NO: 418797 - RNA, 19 nt, Homo sapiens
gaggcaguuucaauuguua

SEQ ID NO: 418798 - RNA, 19 nt, Homo sapiens
gcaccggccuuccucaugu

SEQ ID NO: 418799 - RNA, 19 nt, Homo sapiens
uggcagcucuguucuggua

SEQ ID NO: 418800 - RNA, 19 nt, Homo sapiens
ggaucacaauaaacgauaa

SEQ ID NO: 418801 - RNA, 19 nt, Homo sapiens
uaaugcagguucuucaaug

SEQ ID NO: 418802 - RNA, 19 nt, Homo sapiens
ccacuacaguucaucaaca

SEQ ID NO: 418803 - RNA, 19 nt, Homo sapiens
cgaggcaguuucaauuguu

SEQ ID NO: 418804 - RNA, 19 nt, Homo sapiens
ucagaacccugucuuuuaa

SEQ ID NO: 418805 - RNA, 19 nt, Homo sapiens
ggauagagaaacagaaauc

SEQ ID NO: 418806 - RNA, 19 nt, Homo sapiens
aaagaaaacucuagaaguc

SEQ ID NO: 418807 - RNA, 19 nt, Homo sapiens
gcagcucuguucugguaug

SEQ ID NO: 418808 - RNA, 19 nt, Homo sapiens
ucaacuacgucccucugaa

SEQ ID NO: 418809 - RNA, 19 nt, Homo sapiens
gauaaugcagguucuucaa

SEQ ID NO: 418810 - RNA, 19 nt, Homo sapiens
ggacgccacuacaguucau

SEQ ID NO: 418811 - RNA, 19 nt, Homo sapiens
caaccuggcagcucuguuc

SEQ ID NO: 418812 - RNA, 19 nt, Homo sapiens
ccucugagauaugccguuu

SEQ ID NO: 418813 - RNA, 19 nt, Homo sapiens
aaugauggauagagaaaca

SEQ ID NO: 418814 - RNA, 19 nt, Homo sapiens
cuacgucccucugaaguuc

SEQ ID NO: 418815 - RNA, 19 nt, Homo sapiens
ugagucacuucuucuacuu

SEQ ID NO: 418816 - RNA, 19 nt, Homo sapiens
cccagaugauugagaagaa

SEQ ID NO: 418817 - RNA, 19 nt, Homo sapiens
ugucagcacuugggaacuu

SEQ ID NO: 418818 - RNA, 19 nt, Homo sapiens
ucggugggccucugagaua

SEQ ID NO: 418819 - RNA, 19 nt, Homo sapiens
ucugagauaugccguuuac

SEQ ID NO: 418820 - RNA, 19 nt, Homo sapiens
caacuacgucccucugaag

SEQ ID NO: 418821 - RNA, 19 nt, Homo sapiens
uggcccagaugauugagaa

SEQ ID NO: 418822 - RNA, 19 nt, Homo sapiens
ggaccgaauuaggaucaca

SEQ ID NO: 418823 - RNA, 19 nt, Homo sapiens
ucgaggcaguuucaauugu

SEQ ID NO: 418824 - RNA, 19 nt, Homo sapiens
gucagaacccugucuuuua

SEQ ID NO: 418825 - RNA, 19 nt, Homo sapiens
gacgaccgcugggagaaca

SEQ ID NO: 418826 - RNA, 19 nt, Homo sapiens
cacaauaaacgauaaugca

SEQ ID NO: 418827 - RNA, 19 nt, Homo sapiens
cuacaguucaucaacauca

SEQ ID NO: 418828 - RNA, 19 nt, Homo sapiens
guuacuguggaccgaauua

SEQ ID NO: 418829 - RNA, 19 nt, Homo sapiens
ucacuucuucuacuucuuc

SEQ ID NO: 418830 - RNA, 19 nt, Homo sapiens
aaacgauaaugcagguucu

SEQ ID NO: 418831 - RNA, 19 nt, Homo sapiens
agucgaggcaguuucaauu

SEQ ID NO: 418832 - RNA, 19 nt, Homo sapiens
ccagaugauugagaagaag

SEQ ID NO: 418833 - RNA, 19 nt, Homo sapiens
guuuacggguucuucuuca

SEQ ID NO: 418834 - RNA, 19 nt, Homo sapiens
ccccagaaacuuaaaauuu

SEQ ID NO: 418835 - RNA, 19 nt, Homo sapiens
cggccuuccucauguuguu

SEQ ID NO: 418836 - RNA, 19 nt, Homo sapiens
gauagagaaacagaaaucu

SEQ ID NO: 418837 - RNA, 19 nt, Homo sapiens
cgauaaugcagguucuuca

SEQ ID NO: 418838 - RNA, 19 nt, Homo sapiens
gaccgaauuaggaucacaa

SEQ ID NO: 418839 - RNA, 19 nt, Homo sapiens
cacuacaguucaucaacau

SEQ ID NO: 418840 - RNA, 19 nt, Homo sapiens
ccgaauuaggaucacaaua

SEQ ID NO: 418841 - RNA, 19 nt, Homo sapiens
gauggauagagaaacagaa

SEQ ID NO: 418842 - RNA, 19 nt, Homo sapiens
ucaucaacaucaacuacgu

SEQ ID NO: 418843 - RNA, 19 nt, Homo sapiens
gcccagaugauugagaaga

SEQ ID NO: 418844 - RNA, 19 nt, Homo sapiens
caccggccuuccucauguu

SEQ ID NO: 418845 - RNA, 19 nt, Homo sapiens
gaagaacgaugcuaugauu

SEQ ID NO: 418846 - RNA, 19 nt, Homo sapiens
gaaauuaggugggcugauu

SEQ ID NO: 418847 - RNA, 19 nt, Homo sapiens
gaacuucucuggcaugguu

SEQ ID NO: 418848 - RNA, 19 nt, Homo sapiens
aaacaagguuggauucuaa

SEQ ID NO: 418849 - RNA, 19 nt, Homo sapiens
gaaaccaugugauucuaaa

SEQ ID NO: 418850 - RNA, 19 nt, Homo sapiens
uaggugggcugauuaauuu

SEQ ID NO: 418851 - RNA, 19 nt, Homo sapiens
gcaaggauuucacagaaga

SEQ ID NO: 418852 - RNA, 19 nt, Homo sapiens
gaaguuggcuuugaauaca

SEQ ID NO: 418853 - RNA, 19 nt, Homo sapiens
gcaaacagagugcuaagaa

SEQ ID NO: 418854 - RNA, 19 nt, Homo sapiens
uaaguggucuggaaccuaa

SEQ ID NO: 418855 - RNA, 19 nt, Homo sapiens
aaacagagugcuaagaaua

SEQ ID NO: 418856 - RNA, 19 nt, Homo sapiens
gcacagaaguacacagucu

SEQ ID NO: 418857 - RNA, 19 nt, Homo sapiens
gauaucagccacccaguaa

SEQ ID NO: 418858 - RNA, 19 nt, Homo sapiens
gaacgaugcuaugauuugu

SEQ ID NO: 418859 - RNA, 19 nt, Homo sapiens
cagaagaacuuggagcaaa

SEQ ID NO: 418860 - RNA, 19 nt, Homo sapiens
aggcaugacugaaaucuaa

SEQ ID NO: 418861 - RNA, 19 nt, Homo sapiens
gcuaugauuuguuucgaaa

SEQ ID NO: 418862 - RNA, 19 nt, Homo sapiens
gaaucgagaugucagaagu

SEQ ID NO: 418863 - RNA, 19 nt, Homo sapiens
caccaugccucacaccaua

SEQ ID NO: 418864 - RNA, 19 nt, Homo sapiens
gaacgucuccuagguauuc

SEQ ID NO: 418865 - RNA, 19 nt, Homo sapiens
cagagaauguuucagagaa

SEQ ID NO: 418866 - RNA, 19 nt, Homo sapiens
caaagaaugcgcucuaugu

SEQ ID NO: 418867 - RNA, 19 nt, Homo sapiens
cauccuaaguauaccauuu

SEQ ID NO: 418868 - RNA, 19 nt, Homo sapiens
gcuauaggcuguccagucu

SEQ ID NO: 418869 - RNA, 19 nt, Homo sapiens
ccaguuggaugcacuugaa

SEQ ID NO: 418870 - RNA, 19 nt, Homo sapiens
ugagggagcugcaggaaca

SEQ ID NO: 418871 - RNA, 19 nt, Homo sapiens
aagacaagcuuuccagaga

SEQ ID NO: 418872 - RNA, 19 nt, Homo sapiens
caaacagagugcuaagaau

SEQ ID NO: 418873 - RNA, 19 nt, Homo sapiens
gcuguuagcucgcuuugag

SEQ ID NO: 418874 - RNA, 19 nt, Homo sapiens
cuaguuuggucccaguuua

SEQ ID NO: 418875 - RNA, 19 nt, Homo sapiens
ggaaaccaugugauucuaa

SEQ ID NO: 418876 - RNA, 19 nt, Homo sapiens
gaaaucaggaaucgagaug

SEQ ID NO: 418877 - RNA, 19 nt, Homo sapiens
cauaggaugugagcauauu

SEQ ID NO: 418878 - RNA, 19 nt, Homo sapiens
aagccaagcugucuucaug

SEQ ID NO: 418879 - RNA, 19 nt, Homo sapiens
cagaacgucuccuagguau

SEQ ID NO: 418880 - RNA, 19 nt, Homo sapiens
caagaauaauggacagcuu

SEQ ID NO: 418881 - RNA, 19 nt, Homo sapiens
ucagugcuuucauggauuu

SEQ ID NO: 418882 - RNA, 19 nt, Homo sapiens
agacauggcuuccagaaaa

SEQ ID NO: 418883 - RNA, 19 nt, Homo sapiens
caccguguuuaaauucuua

SEQ ID NO: 418884 - RNA, 19 nt, Homo sapiens
gacaagcuuuccagagaau

SEQ ID NO: 418885 - RNA, 19 nt, Homo sapiens
guacuuuacuuguccuaag

SEQ ID NO: 418886 - RNA, 19 nt, Homo sapiens
gacagaacgucuccuaggu

SEQ ID NO: 418887 - RNA, 19 nt, Homo sapiens
uggaugcacuugaacuaaa

SEQ ID NO: 418888 - RNA, 19 nt, Homo sapiens
gagcuucuggcaaguauga

SEQ ID NO: 418889 - RNA, 19 nt, Homo sapiens
gcaguucucguugguguaa

SEQ ID NO: 418890 - RNA, 19 nt, Homo sapiens
gcaccguguuuaaauucuu

SEQ ID NO: 418891 - RNA, 19 nt, Homo sapiens
cgagaugucagaaguaaau

SEQ ID NO: 418892 - RNA, 19 nt, Homo sapiens
ucaagcagugugugaauuu

SEQ ID NO: 418893 - RNA, 19 nt, Homo sapiens
acgaugcuaugauuuguuu

SEQ ID NO: 418894 - RNA, 19 nt, Homo sapiens
agacaagcuuuccagagaa

SEQ ID NO: 418895 - RNA, 19 nt, Homo sapiens
gcaaagaaugcgcucuaug

SEQ ID NO: 418896 - RNA, 19 nt, Homo sapiens
uauaggcuguccagucuug

SEQ ID NO: 418897 - RNA, 19 nt, Homo sapiens
aggcaaggauuucacagaa

SEQ ID NO: 418898 - RNA, 19 nt, Homo sapiens
gugagcauauuuucuguua

SEQ ID NO: 418899 - RNA, 19 nt, Homo sapiens
cuaaagcgcaguucucguu

SEQ ID NO: 418900 - RNA, 19 nt, Homo sapiens
gugcuuucauggauuuaaa

SEQ ID NO: 418901 - RNA, 19 nt, Homo sapiens
ucaggugacuacuaacaau

SEQ ID NO: 418902 - RNA, 19 nt, Homo sapiens
gcaccuaauagugacaaua

SEQ ID NO: 418903 - RNA, 19 nt, Homo sapiens
ccaguuuacucagugcuuu

SEQ ID NO: 418904 - RNA, 19 nt, Homo sapiens
gcaaguaugaggcaaggau

SEQ ID NO: 418905 - RNA, 19 nt, Homo sapiens
ggcuuugaauacaugaaua

SEQ ID NO: 418906 - RNA, 19 nt, Homo sapiens
gguaugcuguuuguacaau

SEQ ID NO: 418907 - RNA, 19 nt, Homo sapiens
auuuaaaccugggcuguua

SEQ ID NO: 418908 - RNA, 19 nt, Homo sapiens
gaaaagagaaugcgaagag

SEQ ID NO: 418909 - RNA, 19 nt, Homo sapiens
ggauuucacagaagaacuu

SEQ ID NO: 418910 - RNA, 19 nt, Homo sapiens
gguuggauucuaaagauaa

SEQ ID NO: 418911 - RNA, 19 nt, Homo sapiens
ggcaaagaaugcgcucuau

SEQ ID NO: 418912 - RNA, 19 nt, Homo sapiens
aagguuggauucuaaagau

SEQ ID NO: 418913 - RNA, 19 nt, Homo sapiens
gacagucaguuuugaauau

SEQ ID NO: 418914 - RNA, 19 nt, Homo sapiens
caagguuggauucuaaaga

SEQ ID NO: 418915 - RNA, 19 nt, Homo sapiens
gcuccuagccacugucuuc

SEQ ID NO: 418916 - RNA, 19 nt, Homo sapiens
uuaggugggcugauuaauu

SEQ ID NO: 418917 - RNA, 19 nt, Homo sapiens
gguggcaggugguuagaag

SEQ ID NO: 418918 - RNA, 19 nt, Homo sapiens
aaaccaucauuuagcauca

SEQ ID NO: 418919 - RNA, 19 nt, Homo sapiens
ucgaaaccaucauuuagca

SEQ ID NO: 418920 - RNA, 19 nt, Homo sapiens
uagaagaacgaugcuauga

SEQ ID NO: 418921 - RNA, 19 nt, Homo sapiens
aaugcaccguguuuaaauu

SEQ ID NO: 418922 - RNA, 19 nt, Homo sapiens
aaauuaggugggcugauua

SEQ ID NO: 418923 - RNA, 19 nt, Homo sapiens
ggaaagucaagcagugugu

SEQ ID NO: 418924 - RNA, 19 nt, Homo sapiens
agaacgaugcuaugauuug

SEQ ID NO: 418925 - RNA, 19 nt, Homo sapiens
guuagaagaacgaugcuau

SEQ ID NO: 418926 - RNA, 19 nt, Homo sapiens
ggaugcacuugaacuaaac

SEQ ID NO: 418927 - RNA, 19 nt, Homo sapiens
gaggcaaggauuucacaga

SEQ ID NO: 418928 - RNA, 19 nt, Homo sapiens
uaaaauugcuuccuuugag

SEQ ID NO: 418929 - RNA, 19 nt, Homo sapiens
uuaucaauguccagaaguu

SEQ ID NO: 418930 - RNA, 19 nt, Homo sapiens
acagaacgucuccuaggua

SEQ ID NO: 418931 - RNA, 19 nt, Homo sapiens
gucaagcagugugugaauu

SEQ ID NO: 418932 - RNA, 19 nt, Homo sapiens
guaugcuguuuguacaauu

SEQ ID NO: 418933 - RNA, 19 nt, Homo sapiens
aaucugguaugcuguuugu

SEQ ID NO: 418934 - RNA, 19 nt, Homo sapiens
uggaaaccaugugauucua

SEQ ID NO: 418935 - RNA, 19 nt, Homo sapiens
gccacugucuucuccuuuc

SEQ ID NO: 418936 - RNA, 19 nt, Homo sapiens
ccagagaauguuucagaga

SEQ ID NO: 418937 - RNA, 19 nt, Homo sapiens
ucuuaccacuuaucaaugu

SEQ ID NO: 418938 - RNA, 19 nt, Homo sapiens
gugaaguuggcuuugaaua

SEQ ID NO: 418939 - RNA, 19 nt, Homo sapiens
uaugcuguuuguacaauug

SEQ ID NO: 418940 - RNA, 19 nt, Homo sapiens
acucagugcuuucauggau

SEQ ID NO: 418941 - RNA, 19 nt, Homo sapiens
gcuaagaauaagccaguug

SEQ ID NO: 418942 - RNA, 19 nt, Homo sapiens
ggacagucaguuuugaaua

SEQ ID NO: 418943 - RNA, 19 nt, Homo sapiens
aacagagugcuaagaauaa

SEQ ID NO: 418944 - RNA, 19 nt, Homo sapiens
aaccuaaccugcagugucu

SEQ ID NO: 418945 - RNA, 19 nt, Homo sapiens
ggaaagcugugucugauuu

SEQ ID NO: 418946 - RNA, 19 nt, Homo sapiens
gaaaucagcugagccuuca

SEQ ID NO: 418947 - RNA, 19 nt, Homo sapiens
ggucugaugucuccacuuu

SEQ ID NO: 418948 - RNA, 19 nt, Homo sapiens
gaagaguguugcacccuuu

SEQ ID NO: 418949 - RNA, 19 nt, Homo sapiens
gaaacugguugaagagugu

SEQ ID NO: 418950 - RNA, 19 nt, Homo sapiens
gaauucauaucgccugaga

SEQ ID NO: 418951 - RNA, 19 nt, Homo sapiens
uggcuucgcugucggauuu

SEQ ID NO: 418952 - RNA, 19 nt, Homo sapiens
gauggugucugguguguag

SEQ ID NO: 418953 - RNA, 19 nt, Homo sapiens
caacuggaaaccacacaua

SEQ ID NO: 418954 - RNA, 19 nt, Homo sapiens
caacugcgacugugaccua

SEQ ID NO: 418955 - RNA, 19 nt, Homo sapiens
gcagcaaccuuucugaacu

SEQ ID NO: 418956 - RNA, 19 nt, Homo sapiens
caaacggccuguguucuug

SEQ ID NO: 418957 - RNA, 19 nt, Homo sapiens
ugacgucucuuuggucuug

SEQ ID NO: 418958 - RNA, 19 nt, Homo sapiens
gcaauaauguuuucuaguc

SEQ ID NO: 418959 - RNA, 19 nt, Homo sapiens
ugauuuaccucugggcaua

SEQ ID NO: 418960 - RNA, 19 nt, Homo sapiens
ggaaaccccuucuuuacuu

SEQ ID NO: 418961 - RNA, 19 nt, Homo sapiens
cgaccuaauugucuuuguu

SEQ ID NO: 418962 - RNA, 19 nt, Homo sapiens
ggccuuaccgcucuguuua

SEQ ID NO: 418963 - RNA, 19 nt, Homo sapiens
acacugagguugaauucau

SEQ ID NO: 418964 - RNA, 19 nt, Homo sapiens
auaaauccauccauccaaa

SEQ ID NO: 418965 - RNA, 19 nt, Homo sapiens
cauaucgccugagauguuu

SEQ ID NO: 418966 - RNA, 19 nt, Homo sapiens
gaacgacaagccuuacugu

SEQ ID NO: 418967 - RNA, 19 nt, Homo sapiens
cuaauugucuuuguucugu

SEQ ID NO: 418968 - RNA, 19 nt, Homo sapiens
agucagugguuauuugaaa

SEQ ID NO: 418969 - RNA, 19 nt, Homo sapiens
ucuuuggucuuguugauuu

SEQ ID NO: 418970 - RNA, 19 nt, Homo sapiens
ccuagaauucugaacuuua

SEQ ID NO: 418971 - RNA, 19 nt, Homo sapiens
gggccauccuggagaacua

SEQ ID NO: 418972 - RNA, 19 nt, Homo sapiens
ggacguggcacccugaaca

SEQ ID NO: 418973 - RNA, 19 nt, Homo sapiens
caggaaagcugugucugau

SEQ ID NO: 418974 - RNA, 19 nt, Homo sapiens
ggccuagaauucugaacuu

SEQ ID NO: 418975 - RNA, 19 nt, Homo sapiens
ucaaggagcagaacgacaa

SEQ ID NO: 418976 - RNA, 19 nt, Homo sapiens
uaagggagcaugauaggau

SEQ ID NO: 418977 - RNA, 19 nt, Homo sapiens
ccaaacggccuguguucuu

SEQ ID NO: 418978 - RNA, 19 nt, Homo sapiens
gcugucggauuucaaguuc

SEQ ID NO: 418979 - RNA, 19 nt, Homo sapiens
ccuuaccgcucuguuuaua

SEQ ID NO: 418980 - RNA, 19 nt, Homo sapiens
ucugaugucuccacuuuca

SEQ ID NO: 418981 - RNA, 19 nt, Homo sapiens
cacugaaacugguugaaga

SEQ ID NO: 418982 - RNA, 19 nt, Homo sapiens
uauaaacugcugcuauuug

SEQ ID NO: 418983 - RNA, 19 nt, Homo sapiens
ggacuacuucgacauguuc

SEQ ID NO: 418984 - RNA, 19 nt, Homo sapiens
gcugcuuccugucugagua

SEQ ID NO: 418985 - RNA, 19 nt, Homo sapiens
ucauaucgccugagauguu

SEQ ID NO: 418986 - RNA, 19 nt, Homo sapiens
guccgacuuugauagauuu

SEQ ID NO: 418987 - RNA, 19 nt, Homo sapiens
aaaagccucuccagcaaua

SEQ ID NO: 418988 - RNA, 19 nt, Homo sapiens
ugacgaaagagaagccuaa

SEQ ID NO: 418989 - RNA, 19 nt, Homo sapiens
cacugagguugaauucaua

SEQ ID NO: 418990 - RNA, 19 nt, Homo sapiens
ccgaaggguuccacgagaa

SEQ ID NO: 418991 - RNA, 19 nt, Homo sapiens
agccaucucuuccucauau

SEQ ID NO: 418992 - RNA, 19 nt, Homo sapiens
ucaccgccauggccaagaa

SEQ ID NO: 418993 - RNA, 19 nt, Homo sapiens
gccuagaauucugaacuuu

SEQ ID NO: 418994 - RNA, 19 nt, Homo sapiens
aaacugcugcuauuuggaa

SEQ ID NO: 418995 - RNA, 19 nt, Homo sapiens
gacccgcacuccccuuuua

SEQ ID NO: 418996 - RNA, 19 nt, Homo sapiens
ggacuaccacaaccucuuc

SEQ ID NO: 418997 - RNA, 19 nt, Homo sapiens
ugucuuuguucugugauua

SEQ ID NO: 418998 - RNA, 19 nt, Homo sapiens
ggagccaucucuuccucau

SEQ ID NO: 418999 - RNA, 19 nt, Homo sapiens
ccacacauaccaggagauu

SEQ ID NO: 419000 - RNA, 19 nt, Homo sapiens
guacggcuccagugccaaa

SEQ ID NO: 419001 - RNA, 19 nt, Homo sapiens
caaggacuacuucgacaug

SEQ ID NO: 419002 - RNA, 19 nt, Homo sapiens
ggacucugacgucucuuug

SEQ ID NO: 419003 - RNA, 19 nt, Homo sapiens
ucccaggacuguuuuauaa

SEQ ID NO: 419004 - RNA, 19 nt, Homo sapiens
uauaccugcucuuguucua

SEQ ID NO: 419005 - RNA, 19 nt, Homo sapiens
cgacugccccugccuuuua

SEQ ID NO: 419006 - RNA, 19 nt, Homo sapiens
cauuucaauuccugugauu

SEQ ID NO: 419007 - RNA, 19 nt, Homo sapiens
uuaccgcucuguuuauagu

SEQ ID NO: 419008 - RNA, 19 nt, Homo sapiens
auaaacugcugcuauuugg

SEQ ID NO: 419009 - RNA, 19 nt, Homo sapiens
ccacugggccuucacugau

SEQ ID NO: 419010 - RNA, 19 nt, Homo sapiens
uguccgacuuugauagauu

SEQ ID NO: 419011 - RNA, 19 nt, Homo sapiens
gcauaaauccauccaucca

SEQ ID NO: 419012 - RNA, 19 nt, Homo sapiens
cauccugagugcuuugugu

SEQ ID NO: 419013 - RNA, 19 nt, Homo sapiens
gggcagcaaccuuucugaa

SEQ ID NO: 419014 - RNA, 19 nt, Homo sapiens
caauuccugugauuuaugc

SEQ ID NO: 419015 - RNA, 19 nt, Homo sapiens
ggccuugggcuccugauga

SEQ ID NO: 419016 - RNA, 19 nt, Homo sapiens
guguguagauugcuuuguc

SEQ ID NO: 419017 - RNA, 19 nt, Homo sapiens
ggacggcaaggccuacugu

SEQ ID NO: 419018 - RNA, 19 nt, Homo sapiens
uuacuucucuauacaccau

SEQ ID NO: 419019 - RNA, 19 nt, Homo sapiens
gaccuaauugucuuuguuc

SEQ ID NO: 419020 - RNA, 19 nt, Homo sapiens
cagcaaccuuucugaacuc

SEQ ID NO: 419021 - RNA, 19 nt, Homo sapiens
ccugugauuuaugccaaua

SEQ ID NO: 419022 - RNA, 19 nt, Homo sapiens
gcauaucccuuccccagau

SEQ ID NO: 419023 - RNA, 19 nt, Homo sapiens
uuguaucucuucuucauca

SEQ ID NO: 419024 - RNA, 19 nt, Homo sapiens
acucauacccaacuggaaa

SEQ ID NO: 419025 - RNA, 19 nt, Homo sapiens
guggcacccugaacacuuc

SEQ ID NO: 419026 - RNA, 19 nt, Homo sapiens
caacagcagacacgcaucu

SEQ ID NO: 419027 - RNA, 19 nt, Homo sapiens
aagggagcaugauaggauu

SEQ ID NO: 419028 - RNA, 19 nt, Homo sapiens
ccaaaggcagagaaccaaa

SEQ ID NO: 419029 - RNA, 19 nt, Homo sapiens
gagccaucucuuccucaua

SEQ ID NO: 419030 - RNA, 19 nt, Homo sapiens
acugugaccuagagacuuc

SEQ ID NO: 419031 - RNA, 19 nt, Homo sapiens
ccauuucaauuccugugau

SEQ ID NO: 419032 - RNA, 19 nt, Homo sapiens
ugagucagugguuauuuga

SEQ ID NO: 419033 - RNA, 19 nt, Homo sapiens
ccccagagcucuuuaccaa

SEQ ID NO: 419034 - RNA, 19 nt, Homo sapiens
acacauaccaggagauugc

SEQ ID NO: 419035 - RNA, 19 nt, Homo sapiens
uccucaagcucuucugcua

SEQ ID NO: 419036 - RNA, 19 nt, Homo sapiens
gcaaggacuacuucgacau

SEQ ID NO: 419037 - RNA, 19 nt, Homo sapiens
agucugaccugaacaagcu

SEQ ID NO: 419038 - RNA, 19 nt, Homo sapiens
gagaaggggaaguauguuu

SEQ ID NO: 419039 - RNA, 19 nt, Homo sapiens
gccagcaagccuucacuga

SEQ ID NO: 419040 - RNA, 19 nt, Homo sapiens
agaaaagccucuccagcaa

SEQ ID NO: 419041 - RNA, 19 nt, Homo sapiens
caaaggcagagaaccaaag

SEQ ID NO: 419042 - RNA, 19 nt, Homo sapiens
uauagugacccacccuaga

SEQ ID NO: 419043 - RNA, 19 nt, Homo sapiens
acacuguccgacuuugaua

SEQ ID NO: 419044 - RNA, 19 nt, Homo sapiens
cauaaauccauccauccaa

SEQ ID NO: 419045 - RNA, 19 nt, Homo sapiens
gcaaauagguucaguguua

SEQ ID NO: 419046 - RNA, 19 nt, Homo sapiens
gcacgaugcugaugcaaua

SEQ ID NO: 419047 - RNA, 19 nt, Homo sapiens
ggaauugagccaacuguua

SEQ ID NO: 419048 - RNA, 19 nt, Homo sapiens
caagucagcuauagaguug

SEQ ID NO: 419049 - RNA, 19 nt, Homo sapiens
ggaggugucuggagcuaaa

SEQ ID NO: 419050 - RNA, 19 nt, Homo sapiens
gaggaagguuugcuuguga

SEQ ID NO: 419051 - RNA, 19 nt, Homo sapiens
ggauguaacucaggauuau

SEQ ID NO: 419052 - RNA, 19 nt, Homo sapiens
gcacacggccagugacuuu

SEQ ID NO: 419053 - RNA, 19 nt, Homo sapiens
gaauugagccaacuguuau

SEQ ID NO: 419054 - RNA, 19 nt, Homo sapiens
gguagucuguguucuaguu

SEQ ID NO: 419055 - RNA, 19 nt, Homo sapiens
aaacacaucugcccuugau

SEQ ID NO: 419056 - RNA, 19 nt, Homo sapiens
guacgaagaauaaauggaa

SEQ ID NO: 419057 - RNA, 19 nt, Homo sapiens
gaaaauugguucagaaagu

SEQ ID NO: 419058 - RNA, 19 nt, Homo sapiens
ggaggaagguuugcuugug

SEQ ID NO: 419059 - RNA, 19 nt, Homo sapiens
gauuccauccugaaauuua

SEQ ID NO: 419060 - RNA, 19 nt, Homo sapiens
cauggaagcuuggcaguau

SEQ ID NO: 419061 - RNA, 19 nt, Homo sapiens
gcaauaguccugugucauc

SEQ ID NO: 419062 - RNA, 19 nt, Homo sapiens
guuaggaguuggccuguug

SEQ ID NO: 419063 - RNA, 19 nt, Homo sapiens
ugagccaacuguuauagaa

SEQ ID NO: 419064 - RNA, 19 nt, Homo sapiens
caagaacuauuagccauca

SEQ ID NO: 419065 - RNA, 19 nt, Homo sapiens
gagcucugauucccuguga

SEQ ID NO: 419066 - RNA, 19 nt, Homo sapiens
ggcagagaaugaacaagaa

SEQ ID NO: 419067 - RNA, 19 nt, Homo sapiens
gaacgagccaagucagcua

SEQ ID NO: 419068 - RNA, 19 nt, Homo sapiens
gaagagaucaagggcugua

SEQ ID NO: 419069 - RNA, 19 nt, Homo sapiens
gggagggacuagaucagaa

SEQ ID NO: 419070 - RNA, 19 nt, Homo sapiens
caucugcccuugauaugga

SEQ ID NO: 419071 - RNA, 19 nt, Homo sapiens
gauagggucuaccacaucu

SEQ ID NO: 419072 - RNA, 19 nt, Homo sapiens
ugggaucucucuugucuga

SEQ ID NO: 419073 - RNA, 19 nt, Homo sapiens
gggacuagaucagaagaga

SEQ ID NO: 419074 - RNA, 19 nt, Homo sapiens
gaauaaauggaacugaugu

SEQ ID NO: 419075 - RNA, 19 nt, Homo sapiens
gggagcagcuuggauucuu

SEQ ID NO: 419076 - RNA, 19 nt, Homo sapiens
uagguucaguguuaccaua

SEQ ID NO: 419077 - RNA, 19 nt, Homo sapiens
ggguugaauuguugauuug

SEQ ID NO: 419078 - RNA, 19 nt, Homo sapiens
gaggugccaugucggagaa

SEQ ID NO: 419079 - RNA, 19 nt, Homo sapiens
cccaagaauucaucucuga

SEQ ID NO: 419080 - RNA, 19 nt, Homo sapiens
gcaaucccucauccucuua

SEQ ID NO: 419081 - RNA, 19 nt, Homo sapiens
caagggcuguauucaggaa

SEQ ID NO: 419082 - RNA, 19 nt, Homo sapiens
gcucaugguucugucauuc

SEQ ID NO: 419083 - RNA, 19 nt, Homo sapiens
ccgcugggcugaggaauau

SEQ ID NO: 419084 - RNA, 19 nt, Homo sapiens
ugacuggucccaagaauuc

SEQ ID NO: 419085 - RNA, 19 nt, Homo sapiens
cuaaugaucagagagauuu

SEQ ID NO: 419086 - RNA, 19 nt, Homo sapiens
gccaauugcuacagagugu

SEQ ID NO: 419087 - RNA, 19 nt, Homo sapiens
ucgcugguaugaugaauau

SEQ ID NO: 419088 - RNA, 19 nt, Homo sapiens
gggagaaccugagggaaca

SEQ ID NO: 419089 - RNA, 19 nt, Homo sapiens
ccucuugccuugucuuuag

SEQ ID NO: 419090 - RNA, 19 nt, Homo sapiens
ggcaaucccucauccucuu

SEQ ID NO: 419091 - RNA, 19 nt, Homo sapiens
aagguuugcuugugaaaug

SEQ ID NO: 419092 - RNA, 19 nt, Homo sapiens
uggguugaauuguugauuu

SEQ ID NO: 419093 - RNA, 19 nt, Homo sapiens
gguaggaccccacgauuua

SEQ ID NO: 419094 - RNA, 19 nt, Homo sapiens
auucugaguuccugaaauu

SEQ ID NO: 419095 - RNA, 19 nt, Homo sapiens
cgucagcuaccuaugauaa

SEQ ID NO: 419096 - RNA, 19 nt, Homo sapiens
gaaauucgugcggcagauu

SEQ ID NO: 419097 - RNA, 19 nt, Homo sapiens
caaaguggaugaccccaaa

SEQ ID NO: 419098 - RNA, 19 nt, Homo sapiens
cagcugccauuucugauag

SEQ ID NO: 419099 - RNA, 19 nt, Homo sapiens
cauaagcgguacggccuuu

SEQ ID NO: 419100 - RNA, 19 nt, Homo sapiens
caaaugcugugcugcuuuu

SEQ ID NO: 419101 - RNA, 19 nt, Homo sapiens
gaagaauaaauggaacuga

SEQ ID NO: 419102 - RNA, 19 nt, Homo sapiens
gagcagagcugaguuuugg

SEQ ID NO: 419103 - RNA, 19 nt, Homo sapiens
ucuaguuccuacauaauug

SEQ ID NO: 419104 - RNA, 19 nt, Homo sapiens
gacuuggccuugucugaga

SEQ ID NO: 419105 - RNA, 19 nt, Homo sapiens
ggagcagcuuggauucuuc

SEQ ID NO: 419106 - RNA, 19 nt, Homo sapiens
caauaguccugugucauca

SEQ ID NO: 419107 - RNA, 19 nt, Homo sapiens
ccuguuggguugaauuguu

SEQ ID NO: 419108 - RNA, 19 nt, Homo sapiens
ugagggagcagcuuggauu

SEQ ID NO: 419109 - RNA, 19 nt, Homo sapiens
gagaucaagggcuguauuc

SEQ ID NO: 419110 - RNA, 19 nt, Homo sapiens
ccaagucagcuauagaguu

SEQ ID NO: 419111 - RNA, 19 nt, Homo sapiens
caagaccaguaaacacauc

SEQ ID NO: 419112 - RNA, 19 nt, Homo sapiens
caaauagguucaguguuac

SEQ ID NO: 419113 - RNA, 19 nt, Homo sapiens
ugagcugugucaucucuga

SEQ ID NO: 419114 - RNA, 19 nt, Homo sapiens
gcagcaggguacaucagau

SEQ ID NO: 419115 - RNA, 19 nt, Homo sapiens
gagccaacuguuauagaaa

SEQ ID NO: 419116 - RNA, 19 nt, Homo sapiens
gagcugccagggccaauug

SEQ ID NO: 419117 - RNA, 19 nt, Homo sapiens
gagaaugaacaagaacuau

SEQ ID NO: 419118 - RNA, 19 nt, Homo sapiens
gugaucacccucagccuuu

SEQ ID NO: 419119 - RNA, 19 nt, Homo sapiens
gauaagggguaccaguuug

SEQ ID NO: 419120 - RNA, 19 nt, Homo sapiens
acacaucugcccuugauau

SEQ ID NO: 419121 - RNA, 19 nt, Homo sapiens
cuagaucgaaggaagauga

SEQ ID NO: 419122 - RNA, 19 nt, Homo sapiens
uggcauaggaggaagguuu

SEQ ID NO: 419123 - RNA, 19 nt, Homo sapiens
gaucuguccacccuccuaa

SEQ ID NO: 419124 - RNA, 19 nt, Homo sapiens
gggaggcuguggagcacuu

SEQ ID NO: 419125 - RNA, 19 nt, Homo sapiens
gagaugcuguggauguaac

SEQ ID NO: 419126 - RNA, 19 nt, Homo sapiens
acagugggcagcagaguuu

SEQ ID NO: 419127 - RNA, 19 nt, Homo sapiens
ugaggaauauuuggagcaa

SEQ ID NO: 419128 - RNA, 19 nt, Homo sapiens
uagaagcaccugugaaugg

SEQ ID NO: 419129 - RNA, 19 nt, Homo sapiens
uguucuaguuccuacauaa

SEQ ID NO: 419130 - RNA, 19 nt, Homo sapiens
ccagagugaagaagcagua

SEQ ID NO: 419131 - RNA, 19 nt, Homo sapiens
aaaccagagugaagaagca

SEQ ID NO: 419132 - RNA, 19 nt, Homo sapiens
ccaauggaaaccagaguga

SEQ ID NO: 419133 - RNA, 19 nt, Homo sapiens
ccugggaucucucuugucu

SEQ ID NO: 419134 - RNA, 19 nt, Homo sapiens
gauguaacucaggauuaua

SEQ ID NO: 419135 - RNA, 19 nt, Homo sapiens
uuacgucagcuaccuauga

SEQ ID NO: 419136 - RNA, 19 nt, Homo sapiens
gcugggcugaggaauauuu

SEQ ID NO: 419137 - RNA, 19 nt, Homo sapiens
gcuaaugaucagagagauu

SEQ ID NO: 419138 - RNA, 19 nt, Homo sapiens
uggagaugcuguggaugua

SEQ ID NO: 419139 - RNA, 19 nt, Homo sapiens
gaucaagggcuguauucag

SEQ ID NO: 419140 - RNA, 19 nt, Homo sapiens
ggagaugcuguggauguaa

SEQ ID NO: 419141 - RNA, 19 nt, Homo sapiens
gcugagcagagcugaguuu

SEQ ID NO: 419142 - RNA, 19 nt, Homo sapiens
uguccacccuccuaacuau

SEQ ID NO: 419143 - RNA, 19 nt, Homo sapiens
ggaucucucuugucugacu

SEQ ID NO: 419144 - RNA, 19 nt, Homo sapiens
gcaggauccuaagcacaug

SEQ ID NO: 419145 - RNA, 19 nt, Homo sapiens
gcaucugccuuacugauua

SEQ ID NO: 419146 - RNA, 19 nt, Homo sapiens
gaagaggaccugauugaug

SEQ ID NO: 419147 - RNA, 19 nt, Homo sapiens
acagcaaaguggaaaguua

SEQ ID NO: 419148 - RNA, 19 nt, Homo sapiens
gcagaucccauggacauuu

SEQ ID NO: 419149 - RNA, 19 nt, Homo sapiens
caucugccuuacugauuaa

SEQ ID NO: 419150 - RNA, 19 nt, Homo sapiens
cagaucccauggacauuug

SEQ ID NO: 419151 - RNA, 19 nt, Homo sapiens
ucucuucucuugucacuag

SEQ ID NO: 419152 - RNA, 19 nt, Homo sapiens
ccaguguccugacuucugu

SEQ ID NO: 419153 - RNA, 19 nt, Homo sapiens
ucagcuccauugagaagaa

SEQ ID NO: 419154 - RNA, 19 nt, Homo sapiens
gguggaagaggaccugauu

SEQ ID NO: 419155 - RNA, 19 nt, Homo sapiens
ggaggccuucaacugauua

SEQ ID NO: 419156 - RNA, 19 nt, Homo sapiens
ggagggugcuaucaguucu

SEQ ID NO: 419157 - RNA, 19 nt, Homo sapiens
agaagaccauccuggacaa

SEQ ID NO: 419158 - RNA, 19 nt, Homo sapiens
uggaagaggaccugauuga

SEQ ID NO: 419159 - RNA, 19 nt, Homo sapiens
ggaccaccuuccucuagag

SEQ ID NO: 419160 - RNA, 19 nt, Homo sapiens
caggccagcucaaggacaa

SEQ ID NO: 419161 - RNA, 19 nt, Homo sapiens
ggaagaggaccugauugau

SEQ ID NO: 419162 - RNA, 19 nt, Homo sapiens
accaucagcuccauugaga

SEQ ID NO: 419163 - RNA, 19 nt, Homo sapiens
uuucuucucugcucccaaa

SEQ ID NO: 419164 - RNA, 19 nt, Homo sapiens
gugggagggugguuacugu

SEQ ID NO: 419165 - RNA, 19 nt, Homo sapiens
guccuggcccuuucaguuu

SEQ ID NO: 419166 - RNA, 19 nt, Homo sapiens
ggacagcaaaguggaaagu

SEQ ID NO: 419167 - RNA, 19 nt, Homo sapiens
guggaggccuucaacugau

SEQ ID NO: 419168 - RNA, 19 nt, Homo sapiens
caccuucucuucucuuguc

SEQ ID NO: 419169 - RNA, 19 nt, Homo sapiens
ggaccuggccacaguuucu

SEQ ID NO: 419170 - RNA, 19 nt, Homo sapiens
cacgggagcugcaguccau

SEQ ID NO: 419171 - RNA, 19 nt, Homo sapiens
gccuucaacugauuagaca

SEQ ID NO: 419172 - RNA, 19 nt, Homo sapiens
gaauaguggaggccuucaa

SEQ ID NO: 419173 - RNA, 19 nt, Homo sapiens
cagcaaaguggaaaguuag

SEQ ID NO: 419174 - RNA, 19 nt, Homo sapiens
acauggaccuggccacagu

SEQ ID NO: 419175 - RNA, 19 nt, Homo sapiens
uggaggccuucaacugauu

SEQ ID NO: 419176 - RNA, 19 nt, Homo sapiens
guucuguccuggcccuuuc

SEQ ID NO: 419177 - RNA, 19 nt, Homo sapiens
gggagggugcuaucaguuc

SEQ ID NO: 419178 - RNA, 19 nt, Homo sapiens
cacagcagcaggcgucuug

SEQ ID NO: 419179 - RNA, 19 nt, Homo sapiens
caccagccgccaucaagaa

SEQ ID NO: 419180 - RNA, 19 nt, Homo sapiens
caucagcuccauugagaag

SEQ ID NO: 419181 - RNA, 19 nt, Homo sapiens
aguggaggccuucaacuga

SEQ ID NO: 419182 - RNA, 19 nt, Homo sapiens
ugagagcaaaggucaagga

SEQ ID NO: 419183 - RNA, 19 nt, Homo sapiens
caaccucaaccuccuuucu

SEQ ID NO: 419184 - RNA, 19 nt, Homo sapiens
ccaccaccuucucuucucu

SEQ ID NO: 419185 - RNA, 19 nt, Homo sapiens
agaugcugcugcacucaga

SEQ ID NO: 419186 - RNA, 19 nt, Homo sapiens
uacuguggguggaauagug

SEQ ID NO: 419187 - RNA, 19 nt, Homo sapiens
aaaucucuguggucugcaa

SEQ ID NO: 419188 - RNA, 19 nt, Homo sapiens
gcaucugccuuacugauua

SEQ ID NO: 419189 - RNA, 19 nt, Homo sapiens
gaagaggaccugauugaug

SEQ ID NO: 419190 - RNA, 19 nt, Homo sapiens
acagcaaaguggaaaguua

SEQ ID NO: 419191 - RNA, 19 nt, Homo sapiens
gcagaucccauggacauuu

SEQ ID NO: 419192 - RNA, 19 nt, Homo sapiens
caucugccuuacugauuaa

SEQ ID NO: 419193 - RNA, 19 nt, Homo sapiens
cagaucccauggacauuug

SEQ ID NO: 419194 - RNA, 19 nt, Homo sapiens
ccaguguccugacuucugu

SEQ ID NO: 419195 - RNA, 19 nt, Homo sapiens
ucagcuccauugagaagaa

SEQ ID NO: 419196 - RNA, 19 nt, Homo sapiens
gguggaagaggaccugauu

SEQ ID NO: 419197 - RNA, 19 nt, Homo sapiens
ggaggccuucaacugauua

SEQ ID NO: 419198 - RNA, 19 nt, Homo sapiens
ggagggugcuaucaguucu

SEQ ID NO: 419199 - RNA, 19 nt, Homo sapiens
agaagaccauccuggacaa

SEQ ID NO: 419200 - RNA, 19 nt, Homo sapiens
uggaagaggaccugauuga

SEQ ID NO: 419201 - RNA, 19 nt, Homo sapiens
ggaccaccuuccucuagag

SEQ ID NO: 419202 - RNA, 19 nt, Homo sapiens
caggccagcucaaggacaa

SEQ ID NO: 419203 - RNA, 19 nt, Homo sapiens
ggaagaggaccugauugau

SEQ ID NO: 419204 - RNA, 19 nt, Homo sapiens
accaucagcuccauugaga

SEQ ID NO: 419205 - RNA, 19 nt, Homo sapiens
gugggagggugguuacugu

SEQ ID NO: 419206 - RNA, 19 nt, Homo sapiens
guccuggcccuuucaguuu

SEQ ID NO: 419207 - RNA, 19 nt, Homo sapiens
ggacagcaaaguggaaagu

SEQ ID NO: 419208 - RNA, 19 nt, Homo sapiens
guggaggccuucaacugau

SEQ ID NO: 419209 - RNA, 19 nt, Homo sapiens
ggaccuggccacaguuucu

SEQ ID NO: 419210 - RNA, 19 nt, Homo sapiens
cacgggagcugcaguccau

SEQ ID NO: 419211 - RNA, 19 nt, Homo sapiens
gccuucaacugauuagaca

SEQ ID NO: 419212 - RNA, 19 nt, Homo sapiens
gaauaguggaggccuucaa

SEQ ID NO: 419213 - RNA, 19 nt, Homo sapiens
cagcaaaguggaaaguuag

SEQ ID NO: 419214 - RNA, 19 nt, Homo sapiens
acauggaccuggccacagu

SEQ ID NO: 419215 - RNA, 19 nt, Homo sapiens
uggaggccuucaacugauu

SEQ ID NO: 419216 - RNA, 19 nt, Homo sapiens
guucuguccuggcccuuuc

SEQ ID NO: 419217 - RNA, 19 nt, Homo sapiens
gggagggugcuaucaguuc

SEQ ID NO: 419218 - RNA, 19 nt, Homo sapiens
cacagcagcaggcgucuug

SEQ ID NO: 419219 - RNA, 19 nt, Homo sapiens
caccagccgccaucaagaa

SEQ ID NO: 419220 - RNA, 19 nt, Homo sapiens
caucagcuccauugagaag

SEQ ID NO: 419221 - RNA, 19 nt, Homo sapiens
aguggaggccuucaacuga

SEQ ID NO: 419222 - RNA, 19 nt, Homo sapiens
ugagagcaaaggucaagga

SEQ ID NO: 419223 - RNA, 19 nt, Homo sapiens
agaugcugcugcacucaga

SEQ ID NO: 419224 - RNA, 19 nt, Homo sapiens
uacuguggguggaauagug

SEQ ID NO: 419225 - RNA, 19 nt, Homo sapiens
ccacugagcuggaggaaua

SEQ ID NO: 419226 - RNA, 19 nt, Homo sapiens
gaagggaucugucacaugu

SEQ ID NO: 419227 - RNA, 19 nt, Homo sapiens
ccaauuaucuucuaggauu

SEQ ID NO: 419228 - RNA, 19 nt, Homo sapiens
gagcagaaauuauccauca

SEQ ID NO: 419229 - RNA, 19 nt, Homo sapiens
gagcagagagcagaaauua

SEQ ID NO: 419230 - RNA, 19 nt, Homo sapiens
ggaauuaugcauugaagua

SEQ ID NO: 419231 - RNA, 19 nt, Homo sapiens
aaacugaucucuugauugu

SEQ ID NO: 419232 - RNA, 19 nt, Homo sapiens
gagaagaaguugaagaucu

SEQ ID NO: 419233 - RNA, 19 nt, Homo sapiens
gaagauacuuugguuagug

SEQ ID NO: 419234 - RNA, 19 nt, Homo sapiens
guaaugcuuuggagacuuu

SEQ ID NO: 419235 - RNA, 19 nt, Homo sapiens
ggcaauggcuuguuacuca

SEQ ID NO: 419236 - RNA, 19 nt, Homo sapiens
gcagagagcagaaauuauc

SEQ ID NO: 419237 - RNA, 19 nt, Homo sapiens
caaaaggucuucacguuaa

SEQ ID NO: 419238 - RNA, 19 nt, Homo sapiens
gcucaggacaccauuauuu

SEQ ID NO: 419239 - RNA, 19 nt, Homo sapiens
gcagugaugcuugaaauuu

SEQ ID NO: 419240 - RNA, 19 nt, Homo sapiens
gggaauggguggcauggaa

SEQ ID NO: 419241 - RNA, 19 nt, Homo sapiens
gaaccucaauggaacacuu

SEQ ID NO: 419242 - RNA, 19 nt, Homo sapiens
ggagcaacaucccguuuau

SEQ ID NO: 419243 - RNA, 19 nt, Homo sapiens
acaagugacugucccaauu

SEQ ID NO: 419244 - RNA, 19 nt, Homo sapiens
ggaagaaaguugguaccuu

SEQ ID NO: 419245 - RNA, 19 nt, Homo sapiens
uaucagugcugcagaauca

SEQ ID NO: 419246 - RNA, 19 nt, Homo sapiens
gaccuggaauuaugcauug

SEQ ID NO: 419247 - RNA, 19 nt, Homo sapiens
guacaaccgucuucagauc

SEQ ID NO: 419248 - RNA, 19 nt, Homo sapiens
gaugcaaagcuuauugaua

SEQ ID NO: 419249 - RNA, 19 nt, Homo sapiens
ggacuugagggacugcuua

SEQ ID NO: 419250 - RNA, 19 nt, Homo sapiens
gaaaacugaucucuugauu

SEQ ID NO: 419251 - RNA, 19 nt, Homo sapiens
ggguaaauguuauuagugu

SEQ ID NO: 419252 - RNA, 19 nt, Homo sapiens
cagcugagcccaacaguga

SEQ ID NO: 419253 - RNA, 19 nt, Homo sapiens
caaguccaauuaucuucua

SEQ ID NO: 419254 - RNA, 19 nt, Homo sapiens
aaauuugccuccuaucuga

SEQ ID NO: 419255 - RNA, 19 nt, Homo sapiens
ggucagagacauccagaaa

SEQ ID NO: 419256 - RNA, 19 nt, Homo sapiens
caugaacuccuuagaauga

SEQ ID NO: 419257 - RNA, 19 nt, Homo sapiens
gcacuucuguuguuauugc

SEQ ID NO: 419258 - RNA, 19 nt, Homo sapiens
ugaggaagauacuuugguu

SEQ ID NO: 419259 - RNA, 19 nt, Homo sapiens
ccaggaggcucucucaauc

SEQ ID NO: 419260 - RNA, 19 nt, Homo sapiens
gcacacagcaaccggauuc

SEQ ID NO: 419261 - RNA, 19 nt, Homo sapiens
agaaccagcugaaagaaau

SEQ ID NO: 419262 - RNA, 19 nt, Homo sapiens
gaaaacccauggcugcuuu

SEQ ID NO: 419263 - RNA, 19 nt, Homo sapiens
caugagaaccucccuauuc

SEQ ID NO: 419264 - RNA, 19 nt, Homo sapiens
ugaagucacuccgaacuga

SEQ ID NO: 419265 - RNA, 19 nt, Homo sapiens
gaugcaaguuucaggaugu

SEQ ID NO: 419266 - RNA, 19 nt, Homo sapiens
gcaauggcuuguuacucaa

SEQ ID NO: 419267 - RNA, 19 nt, Homo sapiens
caagguggcacuucuguug

SEQ ID NO: 419268 - RNA, 19 nt, Homo sapiens
ggaagauacuuugguuagu

SEQ ID NO: 419269 - RNA, 19 nt, Homo sapiens
gcugaagcaugccaagaga

SEQ ID NO: 419270 - RNA, 19 nt, Homo sapiens
gcauugaaguaguggacaa

SEQ ID NO: 419271 - RNA, 19 nt, Homo sapiens
ccaagagaaucguggugaa

SEQ ID NO: 419272 - RNA, 19 nt, Homo sapiens
uuaauaagcauuccagaug

SEQ ID NO: 419273 - RNA, 19 nt, Homo sapiens
gaggaagauacuuugguua

SEQ ID NO: 419274 - RNA, 19 nt, Homo sapiens
ggaccagcgugaugagauc

SEQ ID NO: 419275 - RNA, 19 nt, Homo sapiens
ucaucuggcugaucuguug

SEQ ID NO: 419276 - RNA, 19 nt, Homo sapiens
caucagacauguucguucu

SEQ ID NO: 419277 - RNA, 19 nt, Homo sapiens
cuucagaucucauuguauc

SEQ ID NO: 419278 - RNA, 19 nt, Homo sapiens
ggucuucacguuaaacuug

SEQ ID NO: 419279 - RNA, 19 nt, Homo sapiens
agagaaacaccaacugaaa

SEQ ID NO: 419280 - RNA, 19 nt, Homo sapiens
ggaaucaguacaucgagaa

SEQ ID NO: 419281 - RNA, 19 nt, Homo sapiens
ucaccaggcuagucagaga

SEQ ID NO: 419282 - RNA, 19 nt, Homo sapiens
ggagaucagcagucuguga

SEQ ID NO: 419283 - RNA, 19 nt, Homo sapiens
ugaaagaaauggcaauucc

SEQ ID NO: 419284 - RNA, 19 nt, Homo sapiens
gguggcacuucuguuguua

SEQ ID NO: 419285 - RNA, 19 nt, Homo sapiens
aauggcaauuccagucuua

SEQ ID NO: 419286 - RNA, 19 nt, Homo sapiens
ggaccuggaauuaugcauu

SEQ ID NO: 419287 - RNA, 19 nt, Homo sapiens
caauggaacacuucaugaa

SEQ ID NO: 419288 - RNA, 19 nt, Homo sapiens
ucagacauguucguucuug

SEQ ID NO: 419289 - RNA, 19 nt, Homo sapiens
gagggacugcuuacuacua

SEQ ID NO: 419290 - RNA, 19 nt, Homo sapiens
gaagugggaaucaguacau

SEQ ID NO: 419291 - RNA, 19 nt, Homo sapiens
gcugagaguggaacaggua

SEQ ID NO: 419292 - RNA, 19 nt, Homo sapiens
ucagcagucugugacauuu

SEQ ID NO: 419293 - RNA, 19 nt, Homo sapiens
gcgcuuggcaucuauuguu

SEQ ID NO: 419294 - RNA, 19 nt, Homo sapiens
ucucagagcauggaaguuu

SEQ ID NO: 419295 - RNA, 19 nt, Homo sapiens
gaauaccagagaagaaguu

SEQ ID NO: 419296 - RNA, 19 nt, Homo sapiens
caagugacugucccaauug

SEQ ID NO: 419297 - RNA, 19 nt, Homo sapiens
gcagaaauuauccaucauc

SEQ ID NO: 419298 - RNA, 19 nt, Homo sapiens
ccagucauccuuaacaaau

SEQ ID NO: 419299 - RNA, 19 nt, Homo sapiens
ucacguuaaacuugucuua

SEQ ID NO: 419300 - RNA, 19 nt, Homo sapiens
caaauuugccuccuaucug

SEQ ID NO: 419301 - RNA, 19 nt, Homo sapiens
ucagagacauccagaaagc

SEQ ID NO: 419302 - RNA, 19 nt, Homo sapiens
aaguggcaauggcuuguua

SEQ ID NO: 419303 - RNA, 19 nt, Homo sapiens
gauguuggccaccuuggaa

SEQ ID NO: 419304 - RNA, 19 nt, Homo sapiens
gaugaugcaaagcuuauug

SEQ ID NO: 419305 - RNA, 19 nt, Homo sapiens
gaaauggcaauuccagucu

SEQ ID NO: 419306 - RNA, 19 nt, Homo sapiens
aagauacuuugguuaguga

SEQ ID NO: 419307 - RNA, 19 nt, Homo sapiens
agggacugcuuacuacuaa

SEQ ID NO: 419308 - RNA, 19 nt, Homo sapiens
aaugaaaacugaucucuug

SEQ ID NO: 419309 - RNA, 19 nt, Homo sapiens
ggcagaaccagcugaaaga

SEQ ID NO: 419310 - RNA, 19 nt, Homo sapiens
caguggagccguagccuuu

SEQ ID NO: 419311 - RNA, 19 nt, Homo sapiens
caacaucccguuuaucacu

SEQ ID NO: 419312 - RNA, 19 nt, Homo sapiens
cagcaggagaugcaaguuu

SEQ ID NO: 419313 - RNA, 19 nt, Homo sapiens
gaagauugaccuuuuguau

SEQ ID NO: 419314 - RNA, 19 nt, Homo sapiens
uagagccagucauccuuaa

SEQ ID NO: 419315 - RNA, 19 nt, Homo sapiens
gucuucagaucucauugua

SEQ ID NO: 419316 - RNA, 19 nt, Homo sapiens
ccagcugccuguaaugcuu

SEQ ID NO: 419317 - RNA, 19 nt, Homo sapiens
gaucuuugccgccuagaca

SEQ ID NO: 419318 - RNA, 19 nt, Homo sapiens
cagagaagaaguugaagau

SEQ ID NO: 419319 - RNA, 19 nt, Homo sapiens
cagaaauuauccaucaucu

SEQ ID NO: 419320 - RNA, 19 nt, Homo sapiens
gcacgucaucacagacauu

SEQ ID NO: 419321 - RNA, 19 nt, Homo sapiens
uggcacuucuguuguuauu

SEQ ID NO: 419322 - RNA, 19 nt, Homo sapiens
aaacacagcggaguucuuc

SEQ ID NO: 419323 - RNA, 19 nt, Homo sapiens
gaucagcagucugugacau

SEQ ID NO: 419324 - RNA, 19 nt, Homo sapiens
acccauggcugcuuugugu

SEQ ID NO: 419325 - RNA, 19 nt, Homo sapiens
gcuaugacauggugcauua

SEQ ID NO: 419326 - RNA, 19 nt, Homo sapiens
guacauggcugacggaaau

SEQ ID NO: 419327 - RNA, 19 nt, Homo sapiens
ggaaaucucuuugguacaa

SEQ ID NO: 419328 - RNA, 19 nt, Homo sapiens
cagcagagcuccuaaguca

SEQ ID NO: 419329 - RNA, 19 nt, Homo sapiens
uagagacccuggacaaaua

SEQ ID NO: 419330 - RNA, 19 nt, Homo sapiens
ggacaccuaugaggaagua

SEQ ID NO: 419331 - RNA, 19 nt, Homo sapiens
gcagcaaccucaccacaga

SEQ ID NO: 419332 - RNA, 19 nt, Homo sapiens
gcagagaggcccuacauca

SEQ ID NO: 419333 - RNA, 19 nt, Homo sapiens
uauggacucuguucuguuu

SEQ ID NO: 419334 - RNA, 19 nt, Homo sapiens
gcgcgauggugacuucuaa

SEQ ID NO: 419335 - RNA, 19 nt, Homo sapiens
gggagacagucaucuaugu

SEQ ID NO: 419336 - RNA, 19 nt, Homo sapiens
ggagcgcgauggugacuuc

SEQ ID NO: 419337 - RNA, 19 nt, Homo sapiens
ggaggucaaucacuacaag

SEQ ID NO: 419338 - RNA, 19 nt, Homo sapiens
ccuacaaggugccugguuu

SEQ ID NO: 419339 - RNA, 19 nt, Homo sapiens
caaauacaacugugacuuc

SEQ ID NO: 419340 - RNA, 19 nt, Homo sapiens
gcacaccgaugaggagauc

SEQ ID NO: 419341 - RNA, 19 nt, Homo sapiens
cagaagaucauccaguuug

SEQ ID NO: 419342 - RNA, 19 nt, Homo sapiens
ggagauguccucugaguac

SEQ ID NO: 419343 - RNA, 19 nt, Homo sapiens
ggacucuguucuguuugua

SEQ ID NO: 419344 - RNA, 19 nt, Homo sapiens
ggagaggccggaagugaga

SEQ ID NO: 419345 - RNA, 19 nt, Homo sapiens
gggaguaugcagacaguuu

SEQ ID NO: 419346 - RNA, 19 nt, Homo sapiens
gcugggagguacagagaau

SEQ ID NO: 419347 - RNA, 19 nt, Homo sapiens
ucacucaggaggagagaua

SEQ ID NO: 419348 - RNA, 19 nt, Homo sapiens
cugcagacaucucagaaga

SEQ ID NO: 419349 - RNA, 19 nt, Homo sapiens
ugacggaaaucucuuuggu

SEQ ID NO: 419350 - RNA, 19 nt, Homo sapiens
auacaacugugacuucugu

SEQ ID NO: 419351 - RNA, 19 nt, Homo sapiens
gcagagcuccuaagucacu

SEQ ID NO: 419352 - RNA, 19 nt, Homo sapiens
uaaagcaggcugggaggua

SEQ ID NO: 419353 - RNA, 19 nt, Homo sapiens
gacggaaaucucuuuggua

SEQ ID NO: 419354 - RNA, 19 nt, Homo sapiens
ugucagaaguggugauugg

SEQ ID NO: 419355 - RNA, 19 nt, Homo sapiens
cucagaagaucauccaguu

SEQ ID NO: 419356 - RNA, 19 nt, Homo sapiens
ugacaucacccugacugua

SEQ ID NO: 419357 - RNA, 19 nt, Homo sapiens
gggaagaacuaccccauca

SEQ ID NO: 419358 - RNA, 19 nt, Homo sapiens
accaggaggucaaucacua

SEQ ID NO: 419359 - RNA, 19 nt, Homo sapiens
caacugugacuucuguguu

SEQ ID NO: 419360 - RNA, 19 nt, Homo sapiens
ggucacagcagagcuccua

SEQ ID NO: 419361 - RNA, 19 nt, Homo sapiens
gacaucacccugacuguag

SEQ ID NO: 419362 - RNA, 19 nt, Homo sapiens
cuacgucacuacacuagag

SEQ ID NO: 419363 - RNA, 19 nt, Homo sapiens
ggagacagucaucuaugug

SEQ ID NO: 419364 - RNA, 19 nt, Homo sapiens
ggaggagagauacaagaug

SEQ ID NO: 419365 - RNA, 19 nt, Homo sapiens
guggugcgauggcugcuau

SEQ ID NO: 419366 - RNA, 19 nt, Homo sapiens
aaacacgcuugccuuccuu

SEQ ID NO: 419367 - RNA, 19 nt, Homo sapiens
ggagaucgccaagcacaag

SEQ ID NO: 419368 - RNA, 19 nt, Homo sapiens
gaacuaccccaucaugaau

SEQ ID NO: 419369 - RNA, 19 nt, Homo sapiens
gaagaacuaccccaucaug

SEQ ID NO: 419370 - RNA, 19 nt, Homo sapiens
ucagaagaucauccaguuu

SEQ ID NO: 419371 - RNA, 19 nt, Homo sapiens
ggagguacagagaaugcaa

SEQ ID NO: 419372 - RNA, 19 nt, Homo sapiens
ugcgauggcugcuaugaca

SEQ ID NO: 419373 - RNA, 19 nt, Homo sapiens
gccgguacgugucagaagu

SEQ ID NO: 419374 - RNA, 19 nt, Homo sapiens
cuagagacccuggacaaau

SEQ ID NO: 419375 - RNA, 19 nt, Homo sapiens
cagcggaucaucaccaaca

SEQ ID NO: 419376 - RNA, 19 nt, Homo sapiens
aaauacaacugugacuucu

SEQ ID NO: 419377 - RNA, 19 nt, Homo sapiens
guggagaggccggaaguga

SEQ ID NO: 419378 - RNA, 19 nt, Homo sapiens
ucacggcaagacagaaauu

SEQ ID NO: 419379 - RNA, 19 nt, Homo sapiens
cagagaggcccuacaucau

SEQ ID NO: 419380 - RNA, 19 nt, Homo sapiens
caucgggcauguggacuuc

SEQ ID NO: 419381 - RNA, 19 nt, Homo sapiens
gaucauccaguuugcuucu

SEQ ID NO: 419382 - RNA, 19 nt, Homo sapiens
agaagaaggaagccaagga

SEQ ID NO: 419383 - RNA, 19 nt, Homo sapiens
agagaggcccuacaucauc

SEQ ID NO: 419384 - RNA, 19 nt, Homo sapiens
cuuauggacucuguucugu

SEQ ID NO: 419385 - RNA, 19 nt, Homo sapiens
cuucgccacucuccuuaug

SEQ ID NO: 419386 - RNA, 19 nt, Homo sapiens
cagcuucgccacucuccuu

SEQ ID NO: 419387 - RNA, 19 nt, Homo sapiens
uuaguucucuggguguaga

SEQ ID NO: 419388 - RNA, 19 nt, Homo sapiens
cggcaagacagaaauuauc

SEQ ID NO: 419389 - RNA, 19 nt, Homo sapiens
gggugacuaccucaucgua

SEQ ID NO: 419390 - RNA, 19 nt, Homo sapiens
gaaaucucuuugguacaac

SEQ ID NO: 419391 - RNA, 19 nt, Homo sapiens
ucgccacucuccuuaugga

SEQ ID NO: 419392 - RNA, 19 nt, Homo sapiens
ucuccgcucuuuccagcaa

SEQ ID NO: 419393 - RNA, 19 nt, Homo sapiens
cuacaaggugccugguuug

SEQ ID NO: 419394 - RNA, 19 nt, Homo sapiens
ggccgcaugcugcugguaa

SEQ ID NO: 419395 - RNA, 19 nt, Homo sapiens
ggaguaugcagacaguuuu

SEQ ID NO: 419396 - RNA, 19 nt, Homo sapiens
augaggagaucgccaagca

SEQ ID NO: 419397 - RNA, 19 nt, Homo sapiens
acaaauacaacugugacuu

SEQ ID NO: 419398 - RNA, 19 nt, Homo sapiens
cugcaugaacggacucuga

SEQ ID NO: 419399 - RNA, 19 nt, Homo sapiens
ggaccgggguaucccaguu

SEQ ID NO: 419400 - RNA, 19 nt, Homo sapiens
acaccuaugaggaaguaaa

SEQ ID NO: 419401 - RNA, 19 nt, Homo sapiens
uggacucuguucuguuugu

SEQ ID NO: 419402 - RNA, 19 nt, Homo sapiens
acaucacccugacuguaga

SEQ ID NO: 419403 - RNA, 19 nt, Homo sapiens
gaaacuagcugaagccuuu

SEQ ID NO: 419404 - RNA, 19 nt, Homo sapiens
ccagagaaguuccagaaua

SEQ ID NO: 419405 - RNA, 19 nt, Homo sapiens
cagagaaguuccagaauaa

SEQ ID NO: 419406 - RNA, 19 nt, Homo sapiens
gaacuuggcugagaacauc

SEQ ID NO: 419407 - RNA, 19 nt, Homo sapiens
ccaagaaggucaucaggaa

SEQ ID NO: 419408 - RNA, 19 nt, Homo sapiens
gaaggaaugugcuagaagu

SEQ ID NO: 419409 - RNA, 19 nt, Homo sapiens
ggaaggagcugcggcugaa

SEQ ID NO: 419410 - RNA, 19 nt, Homo sapiens
gaaaauaacuacacaugga

SEQ ID NO: 419411 - RNA, 19 nt, Homo sapiens
ggugacagguugaaaguga

SEQ ID NO: 419412 - RNA, 19 nt, Homo sapiens
gaacuuugcacacaucuug

SEQ ID NO: 419413 - RNA, 19 nt, Homo sapiens
ugaagaggauccacgagua

SEQ ID NO: 419414 - RNA, 19 nt, Homo sapiens
gcccaggacuguuaugauu

SEQ ID NO: 419415 - RNA, 19 nt, Homo sapiens
gcacgcagcagcacuacua

SEQ ID NO: 419416 - RNA, 19 nt, Homo sapiens
ggaauccgcuaugaauuug

SEQ ID NO: 419417 - RNA, 19 nt, Homo sapiens
caacauggcccaccugugu

SEQ ID NO: 419418 - RNA, 19 nt, Homo sapiens
guuacugccuugugagaua

SEQ ID NO: 419419 - RNA, 19 nt, Homo sapiens
ccagagcacuacagccuuu

SEQ ID NO: 419420 - RNA, 19 nt, Homo sapiens
gccgaugucuuuaguguug

SEQ ID NO: 419421 - RNA, 19 nt, Homo sapiens
uguauuagccgaugucuuu

SEQ ID NO: 419422 - RNA, 19 nt, Homo sapiens
gaagaagaccugugcauac

SEQ ID NO: 419423 - RNA, 19 nt, Homo sapiens
gaaccuguuucgagacguu

SEQ ID NO: 419424 - RNA, 19 nt, Homo sapiens
gcuccuaguuucuuguaaa

SEQ ID NO: 419425 - RNA, 19 nt, Homo sapiens
ggacaaggccugggaaauc

SEQ ID NO: 419426 - RNA, 19 nt, Homo sapiens
gauaaucuaugccaucaac

SEQ ID NO: 419427 - RNA, 19 nt, Homo sapiens
gacaaggccugggaaauca

SEQ ID NO: 419428 - RNA, 19 nt, Homo sapiens
ugaaguggcuggacacaca

SEQ ID NO: 419429 - RNA, 19 nt, Homo sapiens
gcacaggcaacaugaaguu

SEQ ID NO: 419430 - RNA, 19 nt, Homo sapiens
ugaaacagucggucuuuaa

SEQ ID NO: 419431 - RNA, 19 nt, Homo sapiens
gugaaacagucggucuuua

SEQ ID NO: 419432 - RNA, 19 nt, Homo sapiens
caagguguuugcagacuau

SEQ ID NO: 419433 - RNA, 19 nt, Homo sapiens
cgaagaagaccugugcaua

SEQ ID NO: 419434 - RNA, 19 nt, Homo sapiens
gaccggaacuuggcugaga

SEQ ID NO: 419435 - RNA, 19 nt, Homo sapiens
gcuauggaauccgcuauga

SEQ ID NO: 419436 - RNA, 19 nt, Homo sapiens
gaaaugaaacuagcugaag

SEQ ID NO: 419437 - RNA, 19 nt, Homo sapiens
gagaaguuccagaauaaga

SEQ ID NO: 419438 - RNA, 19 nt, Homo sapiens
gaaccugggccuucagaau

SEQ ID NO: 419439 - RNA, 19 nt, Homo sapiens
ggaauugccgagaaaucua

SEQ ID NO: 419440 - RNA, 19 nt, Homo sapiens
ggaaaugaaacuagcugaa

SEQ ID NO: 419441 - RNA, 19 nt, Homo sapiens
uagaagugcuccuaguuuc

SEQ ID NO: 419442 - RNA, 19 nt, Homo sapiens
gaccagcgggcauuuguuu

SEQ ID NO: 419443 - RNA, 19 nt, Homo sapiens
ucaaggacaucgugaacau

SEQ ID NO: 419444 - RNA, 19 nt, Homo sapiens
ccgagaaccucuucaucuu

SEQ ID NO: 419445 - RNA, 19 nt, Homo sapiens
uaacuacacauggaaauga

SEQ ID NO: 419446 - RNA, 19 nt, Homo sapiens
ugaggugcauuuccuguug

SEQ ID NO: 419447 - RNA, 19 nt, Homo sapiens
guaaaggaagccagaguug

SEQ ID NO: 419448 - RNA, 19 nt, Homo sapiens
gaccugagccagcugaaga

SEQ ID NO: 419449 - RNA, 19 nt, Homo sapiens
ccugggaaaucacgaagaa

SEQ ID NO: 419450 - RNA, 19 nt, Homo sapiens
ccaagcgcauuuauuaucu

SEQ ID NO: 419451 - RNA, 19 nt, Homo sapiens
gaaacagucggucuuuaag

SEQ ID NO: 419452 - RNA, 19 nt, Homo sapiens
uggaauccgcuaugaauuu

SEQ ID NO: 419453 - RNA, 19 nt, Homo sapiens
ggaggaacucgaggagaua

SEQ ID NO: 419454 - RNA, 19 nt, Homo sapiens
ccuaguuucuuguaaagga

SEQ ID NO: 419455 - RNA, 19 nt, Homo sapiens
gaagugcuccuaguuucuu

SEQ ID NO: 419456 - RNA, 19 nt, Homo sapiens
ucaagguguuugcagacua

SEQ ID NO: 419457 - RNA, 19 nt, Homo sapiens
ccaaggagccagacugcuu

SEQ ID NO: 419458 - RNA, 19 nt, Homo sapiens
ucgaggagauagaagaaga

SEQ ID NO: 419459 - RNA, 19 nt, Homo sapiens
ccaaggaguggaccaagaa

SEQ ID NO: 419460 - RNA, 19 nt, Homo sapiens
gcuugugucugcugucuca

SEQ ID NO: 419461 - RNA, 19 nt, Homo sapiens
acucggagaucgugaaaca

SEQ ID NO: 419462 - RNA, 19 nt, Homo sapiens
aagaagaccugugcauaca

SEQ ID NO: 419463 - RNA, 19 nt, Homo sapiens
ccagaacuuugcacacauc

SEQ ID NO: 419464 - RNA, 19 nt, Homo sapiens
gaagccagaguugacagua

SEQ ID NO: 419465 - RNA, 19 nt, Homo sapiens
guaaggaaggaaugugcua

SEQ ID NO: 419466 - RNA, 19 nt, Homo sapiens
gcgagaagcggaagcagau

SEQ ID NO: 419467 - RNA, 19 nt, Homo sapiens
acaaucgaaucaagagaga

SEQ ID NO: 419468 - RNA, 19 nt, Homo sapiens
uagccgaugucuuuagugu

SEQ ID NO: 419469 - RNA, 19 nt, Homo sapiens
ggagauagaagaagaugcu

SEQ ID NO: 419470 - RNA, 19 nt, Homo sapiens
uggaggaacucgaggagau

SEQ ID NO: 419471 - RNA, 19 nt, Homo sapiens
cauuguuacugccuuguga

SEQ ID NO: 419472 - RNA, 19 nt, Homo sapiens
gcacuacagccuuuuauug

SEQ ID NO: 419473 - RNA, 19 nt, Homo sapiens
aauuguacuuggucacuuu

SEQ ID NO: 419474 - RNA, 19 nt, Homo sapiens
uaaaggaagccagaguuga

SEQ ID NO: 419475 - RNA, 19 nt, Homo sapiens
cagaaugccugcgaugaag

SEQ ID NO: 419476 - RNA, 19 nt, Homo sapiens
caagcgcauuuauuaucuu

SEQ ID NO: 419477 - RNA, 19 nt, Homo sapiens
ccaggacuguuaugauugg

SEQ ID NO: 419478 - RNA, 19 nt, Homo sapiens
gaagaggauccacgaguac

SEQ ID NO: 419479 - RNA, 19 nt, Homo sapiens
ucagaaugccugcgaugaa

SEQ ID NO: 419480 - RNA, 19 nt, Homo sapiens
gccacagccucgucuggaa

SEQ ID NO: 419481 - RNA, 19 nt, Homo sapiens
gcugaagccuuuucuuguu

SEQ ID NO: 419482 - RNA, 19 nt, Homo sapiens
ggaacucgaggagauagaa

SEQ ID NO: 419483 - RNA, 19 nt, Homo sapiens
aacagucggucuuuaagga

SEQ ID NO: 419484 - RNA, 19 nt, Homo sapiens
ucaaugguguggcgaggau

SEQ ID NO: 419485 - RNA, 19 nt, Homo sapiens
gagaagcggaagcagauca

SEQ ID NO: 419486 - RNA, 19 nt, Homo sapiens
uuacugccuugugagauaa

SEQ ID NO: 419487 - RNA, 19 nt, Homo sapiens
ggaaggaaugugcuagaag

SEQ ID NO: 419488 - RNA, 19 nt, Homo sapiens
ugagagagcaggguaagga

SEQ ID NO: 419489 - RNA, 19 nt, Homo sapiens
guccuuggcugagaaagug

SEQ ID NO: 419490 - RNA, 19 nt, Homo sapiens
gguccuguauccaaaugau

SEQ ID NO: 419491 - RNA, 19 nt, Homo sapiens
caacgugggagacuacauc

SEQ ID NO: 419492 - RNA, 19 nt, Homo sapiens
ccaaggcucccaacgacuu

SEQ ID NO: 419493 - RNA, 19 nt, Homo sapiens
uauggaauccgcuaugaau

SEQ ID NO: 419494 - RNA, 19 nt, Homo sapiens
gaggugcauuuccuguugu

SEQ ID NO: 419495 - RNA, 19 nt, Homo sapiens
gaauugccgagaaaucuag

SEQ ID NO: 419496 - RNA, 19 nt, Homo sapiens
ccuugggccuggcagcaua

SEQ ID NO: 419497 - RNA, 19 nt, Homo sapiens
ugaucuuccuggagaacua

SEQ ID NO: 419498 - RNA, 19 nt, Homo sapiens
aguacaaggugaagaucaa

SEQ ID NO: 419499 - RNA, 19 nt, Homo sapiens
gaagccuuuucuuguuuua

SEQ ID NO: 419500 - RNA, 19 nt, Homo sapiens
uagugaagccugggaauga

SEQ ID NO: 419501 - RNA, 19 nt, Homo sapiens
guguugagccucuggauuc

SEQ ID NO: 419502 - RNA, 19 nt, Homo sapiens
gagagagcaggguaaggaa

SEQ ID NO: 419503 - RNA, 19 nt, Homo sapiens
aaacauagcuucuuacuga

SEQ ID NO: 419504 - RNA, 19 nt, Homo sapiens
gaaagacccuaagaaguua

SEQ ID NO: 419505 - RNA, 19 nt, Homo sapiens
gcuagaaccugacaaguuu

SEQ ID NO: 419506 - RNA, 19 nt, Homo sapiens
ggaaggagcuaagauugaa

SEQ ID NO: 419507 - RNA, 19 nt, Homo sapiens
ucauaaagcugaucacuuc

SEQ ID NO: 419508 - RNA, 19 nt, Homo sapiens
ggaagcaaguugaaaguca

SEQ ID NO: 419509 - RNA, 19 nt, Homo sapiens
gaacaaugacccuaugguu

SEQ ID NO: 419510 - RNA, 19 nt, Homo sapiens
ggaugucucugauagaaga

SEQ ID NO: 419511 - RNA, 19 nt, Homo sapiens
gcacgcagcagcacuacua

SEQ ID NO: 419512 - RNA, 19 nt, Homo sapiens
ccaaaggccuggaacacaa

SEQ ID NO: 419513 - RNA, 19 nt, Homo sapiens
agaaagacccuaagaaguu

SEQ ID NO: 419514 - RNA, 19 nt, Homo sapiens
ugaagaggauacaugagua

SEQ ID NO: 419515 - RNA, 19 nt, Homo sapiens
gaacacaaugguacucaaa

SEQ ID NO: 419516 - RNA, 19 nt, Homo sapiens
ugagucagcuguacaugaa

SEQ ID NO: 419517 - RNA, 19 nt, Homo sapiens
ggacuucagugagcuagaa

SEQ ID NO: 419518 - RNA, 19 nt, Homo sapiens
gcauuuagauagaauugug

SEQ ID NO: 419519 - RNA, 19 nt, Homo sapiens
ugaagaagaugcuggacuu

SEQ ID NO: 419520 - RNA, 19 nt, Homo sapiens
uuacaugggccgaacauua

SEQ ID NO: 419521 - RNA, 19 nt, Homo sapiens
ggacaggcaauaugaaguu

SEQ ID NO: 419522 - RNA, 19 nt, Homo sapiens
cagauguggugaacaauga

SEQ ID NO: 419523 - RNA, 19 nt, Homo sapiens
caaugaaucuaacaaaguc

SEQ ID NO: 419524 - RNA, 19 nt, Homo sapiens
uagaugauguggcugcuuu

SEQ ID NO: 419525 - RNA, 19 nt, Homo sapiens
caacccauccuccauguuu

SEQ ID NO: 419526 - RNA, 19 nt, Homo sapiens
ucagaagcauuuagauaga

SEQ ID NO: 419527 - RNA, 19 nt, Homo sapiens
uuucaaagccuccaaguuu

SEQ ID NO: 419528 - RNA, 19 nt, Homo sapiens
uaugucaagugucaagaua

SEQ ID NO: 419529 - RNA, 19 nt, Homo sapiens
uggcagagcugaagaagag

SEQ ID NO: 419530 - RNA, 19 nt, Homo sapiens
cuaacaaagucaauggaaa

SEQ ID NO: 419531 - RNA, 19 nt, Homo sapiens
gagaagacuaugugaaaga

SEQ ID NO: 419532 - RNA, 19 nt, Homo sapiens
cguggaaccuucagaucua

SEQ ID NO: 419533 - RNA, 19 nt, Homo sapiens
ugucaagugucaagauaaa

SEQ ID NO: 419534 - RNA, 19 nt, Homo sapiens
gcuggucauugaucaaauu

SEQ ID NO: 419535 - RNA, 19 nt, Homo sapiens
ggauauagaagaguuagaa

SEQ ID NO: 419536 - RNA, 19 nt, Homo sapiens
gaagcaaguugaaagucau

SEQ ID NO: 419537 - RNA, 19 nt, Homo sapiens
uaagaaagacccuaagaag

SEQ ID NO: 419538 - RNA, 19 nt, Homo sapiens
agacuaaaguauucaagga

SEQ ID NO: 419539 - RNA, 19 nt, Homo sapiens
agaaggaugucucugauag

SEQ ID NO: 419540 - RNA, 19 nt, Homo sapiens
ggaaauggcagaagaagcu

SEQ ID NO: 419541 - RNA, 19 nt, Homo sapiens
guacaaccgcauuaagaaa

SEQ ID NO: 419542 - RNA, 19 nt, Homo sapiens
uaagauugaagcaggaaua

SEQ ID NO: 419543 - RNA, 19 nt, Homo sapiens
gcagaugauuggcucagau

SEQ ID NO: 419544 - RNA, 19 nt, Homo sapiens
gauuggauauagaagaguu

SEQ ID NO: 419545 - RNA, 19 nt, Homo sapiens
ggaacacaaugguacucaa

SEQ ID NO: 419546 - RNA, 19 nt, Homo sapiens
caagcagccugaccucuuc

SEQ ID NO: 419547 - RNA, 19 nt, Homo sapiens
agaauaagcugaaguuuuc

SEQ ID NO: 419548 - RNA, 19 nt, Homo sapiens
ggagaagacuaugugaaag

SEQ ID NO: 419549 - RNA, 19 nt, Homo sapiens
cgugaagacuaaaguauuc

SEQ ID NO: 419550 - RNA, 19 nt, Homo sapiens
gauaucauccgccguuuca

SEQ ID NO: 419551 - RNA, 19 nt, Homo sapiens
ccucagagacuuuaauguu

SEQ ID NO: 419552 - RNA, 19 nt, Homo sapiens
gaacguggaaccuucagau

SEQ ID NO: 419553 - RNA, 19 nt, Homo sapiens
gaggauacaugaguacaag

SEQ ID NO: 419554 - RNA, 19 nt, Homo sapiens
uuaccucucucuggaauuu

SEQ ID NO: 419555 - RNA, 19 nt, Homo sapiens
gauugaagcaggaauacuu

SEQ ID NO: 419556 - RNA, 19 nt, Homo sapiens
agauuucucuauccaauga

SEQ ID NO: 419557 - RNA, 19 nt, Homo sapiens
caugacagguuuaaagucu

SEQ ID NO: 419558 - RNA, 19 nt, Homo sapiens
uggcagauguggugaacaa

SEQ ID NO: 419559 - RNA, 19 nt, Homo sapiens
caaggacaguuaucauugg

SEQ ID NO: 419560 - RNA, 19 nt, Homo sapiens
ccaaggacaguuaucauug

SEQ ID NO: 419561 - RNA, 19 nt, Homo sapiens
gagacggaguacaaaguga

SEQ ID NO: 419562 - RNA, 19 nt, Homo sapiens
gggaaggagcuaagauuga

SEQ ID NO: 419563 - RNA, 19 nt, Homo sapiens
ccagugaccgaacaauuaa

SEQ ID NO: 419564 - RNA, 19 nt, Homo sapiens
gcauuaagaaagacccuaa

SEQ ID NO: 419565 - RNA, 19 nt, Homo sapiens
cagaagcauuuagauagaa

SEQ ID NO: 419566 - RNA, 19 nt, Homo sapiens
cagcuuggauuggauauag

SEQ ID NO: 419567 - RNA, 19 nt, Homo sapiens
gaacauuacagaacaccau

SEQ ID NO: 419568 - RNA, 19 nt, Homo sapiens
uccagugaccgaacaauua

SEQ ID NO: 419569 - RNA, 19 nt, Homo sapiens
cuacgaagccuaugucaag

SEQ ID NO: 419570 - RNA, 19 nt, Homo sapiens
ggugaacaaugacccuaug

SEQ ID NO: 419571 - RNA, 19 nt, Homo sapiens
gcugcucccucgacauuug

SEQ ID NO: 419572 - RNA, 19 nt, Homo sapiens
gaguaucucuugcugaaaa

SEQ ID NO: 419573 - RNA, 19 nt, Homo sapiens
ugaaagucaucuucuugga

SEQ ID NO: 419574 - RNA, 19 nt, Homo sapiens
gagaauaagcugaaguuuu

SEQ ID NO: 419575 - RNA, 19 nt, Homo sapiens
ggccgaacauuacagaaca

SEQ ID NO: 419576 - RNA, 19 nt, Homo sapiens
gcagauguggugaacaaug

SEQ ID NO: 419577 - RNA, 19 nt, Homo sapiens
uggagaagacuaugugaaa

SEQ ID NO: 419578 - RNA, 19 nt, Homo sapiens
uuacagaacaccaugauca

SEQ ID NO: 419579 - RNA, 19 nt, Homo sapiens
gcagguagaagaagcagau

SEQ ID NO: 419580 - RNA, 19 nt, Homo sapiens
ccaaugaaucuaacaaagu

SEQ ID NO: 419581 - RNA, 19 nt, Homo sapiens
cgaagccuaugucaagugu

SEQ ID NO: 419582 - RNA, 19 nt, Homo sapiens
gccaaggacaguuaucauu

SEQ ID NO: 419583 - RNA, 19 nt, Homo sapiens
aaggaugucucugauagaa

SEQ ID NO: 419584 - RNA, 19 nt, Homo sapiens
gaaggaugucucugauaga

SEQ ID NO: 419585 - RNA, 19 nt, Homo sapiens
gagauaaaucagaagcauu

SEQ ID NO: 419586 - RNA, 19 nt, Homo sapiens
ccugugcacuucuauggaa

SEQ ID NO: 419587 - RNA, 19 nt, Homo sapiens
cuaaagauuucucuaucca

SEQ ID NO: 419588 - RNA, 19 nt, Homo sapiens
gaacguggcagagcugaag

SEQ ID NO: 419589 - RNA, 19 nt, Homo sapiens
cagacaucgugaagacuaa

SEQ ID NO: 419590 - RNA, 19 nt, Homo sapiens
cucagagacuuuaauguug

SEQ ID NO: 419591 - RNA, 19 nt, Homo sapiens
gaugauuggcucagauaug

SEQ ID NO: 419592 - RNA, 19 nt, Homo sapiens
uagaagaagcagaugauug

SEQ ID NO: 419593 - RNA, 19 nt, Homo sapiens
gauaucaucaacaugcuau

SEQ ID NO: 419594 - RNA, 19 nt, Homo sapiens
uuggagaacuacagaguau

SEQ ID NO: 419595 - RNA, 19 nt, Homo sapiens
ggagacggaguacaaagug

SEQ ID NO: 419596 - RNA, 19 nt, Homo sapiens
ucagacaucgugaagacua

SEQ ID NO: 419597 - RNA, 19 nt, Homo sapiens
gaagggaaggagcuaagau

SEQ ID NO: 419598 - RNA, 19 nt, Homo sapiens
cagaugauuggcucagaua

SEQ ID NO: 419599 - RNA, 19 nt, Homo sapiens
ggagaacuacagaguaucu

SEQ ID NO: 419600 - RNA, 19 nt, Homo sapiens
gauaucacauggccaaaau

SEQ ID NO: 419601 - RNA, 19 nt, Homo sapiens
gggcaccaaaugacuuuaa

SEQ ID NO: 419602 - RNA, 19 nt, Homo sapiens
gaccgaacaauuaaagaau

SEQ ID NO: 419603 - RNA, 19 nt, Homo sapiens
gaaguuugcugccuaccua

SEQ ID NO: 419604 - RNA, 19 nt, Homo sapiens
gaacgugacugagcugaaa

SEQ ID NO: 419605 - RNA, 19 nt, Homo sapiens
ccucauaaguuccagaaua

SEQ ID NO: 419606 - RNA, 19 nt, Homo sapiens
ggaaggagcugcggcugaa

SEQ ID NO: 419607 - RNA, 19 nt, Homo sapiens
gcacgcagcagcacuacua

SEQ ID NO: 419608 - RNA, 19 nt, Homo sapiens
gaaccuggccuuagagaau

SEQ ID NO: 419609 - RNA, 19 nt, Homo sapiens
ggauaagcuugaccaaaga

SEQ ID NO: 419610 - RNA, 19 nt, Homo sapiens
gggaggacuucaucucuga

SEQ ID NO: 419611 - RNA, 19 nt, Homo sapiens
uuaaagucuucgcagauua

SEQ ID NO: 419612 - RNA, 19 nt, Homo sapiens
ccacgagacuacuacuuug

SEQ ID NO: 419613 - RNA, 19 nt, Homo sapiens
cucauaaguuccagaauaa

SEQ ID NO: 419614 - RNA, 19 nt, Homo sapiens
cagcagcacuacuaugaga

SEQ ID NO: 419615 - RNA, 19 nt, Homo sapiens
gaaaacuucuucaucuuug

SEQ ID NO: 419616 - RNA, 19 nt, Homo sapiens
uggauaagcuugaccaaag

SEQ ID NO: 419617 - RNA, 19 nt, Homo sapiens
uggaggagcuggaggaaau

SEQ ID NO: 419618 - RNA, 19 nt, Homo sapiens
gcuggagccucauaaguuc

SEQ ID NO: 419619 - RNA, 19 nt, Homo sapiens
agagggagcccaauaaguu

SEQ ID NO: 419620 - RNA, 19 nt, Homo sapiens
gaacaagccaggccagucu

SEQ ID NO: 419621 - RNA, 19 nt, Homo sapiens
gaccaaagaggguacaaug

SEQ ID NO: 419622 - RNA, 19 nt, Homo sapiens
ccaaguggguggacacaca

SEQ ID NO: 419623 - RNA, 19 nt, Homo sapiens
gaucuacuaccugucuuua

SEQ ID NO: 419624 - RNA, 19 nt, Homo sapiens
ucaagagggagcccaauaa

SEQ ID NO: 419625 - RNA, 19 nt, Homo sapiens
cuucaagucuuccaaguuc

SEQ ID NO: 419626 - RNA, 19 nt, Homo sapiens
gggauucgcuaugaguuug

SEQ ID NO: 419627 - RNA, 19 nt, Homo sapiens
gcuacgggauucgcuauga

SEQ ID NO: 419628 - RNA, 19 nt, Homo sapiens
cuaccugucuuuagaguuc

SEQ ID NO: 419629 - RNA, 19 nt, Homo sapiens
aaagaaagcaaaucagugu

SEQ ID NO: 419630 - RNA, 19 nt, Homo sapiens
gagggagcccaauaaguuu

SEQ ID NO: 419631 - RNA, 19 nt, Homo sapiens
ggacggacgcuacagaaca

SEQ ID NO: 419632 - RNA, 19 nt, Homo sapiens
gaaagucagcgccuuguac

SEQ ID NO: 419633 - RNA, 19 nt, Homo sapiens
gcugagcaguggcuucuuc

SEQ ID NO: 419634 - RNA, 19 nt, Homo sapiens
gaauacaaaguccacauca

SEQ ID NO: 419635 - RNA, 19 nt, Homo sapiens
gacaaggcgugggauguga

SEQ ID NO: 419636 - RNA, 19 nt, Homo sapiens
ccaaugacuucaaccucaa

SEQ ID NO: 419637 - RNA, 19 nt, Homo sapiens
gaggaaaacuucuucaucu

SEQ ID NO: 419638 - RNA, 19 nt, Homo sapiens
ggcugaagcaggaguauuu

SEQ ID NO: 419639 - RNA, 19 nt, Homo sapiens
cauuaaaccaguaugauga

SEQ ID NO: 419640 - RNA, 19 nt, Homo sapiens
ccaagacccucccauugca

SEQ ID NO: 419641 - RNA, 19 nt, Homo sapiens
gacagaagaccaugugcaa

SEQ ID NO: 419642 - RNA, 19 nt, Homo sapiens
ccaguggccucugcuaguu

SEQ ID NO: 419643 - RNA, 19 nt, Homo sapiens
ggaguacuacgaucgcauu

SEQ ID NO: 419644 - RNA, 19 nt, Homo sapiens
ggaaaacuucuucaucuuu

SEQ ID NO: 419645 - RNA, 19 nt, Homo sapiens
gcuggcugguucuguguaa

SEQ ID NO: 419646 - RNA, 19 nt, Homo sapiens
gcagugaagcgcaucaaca

SEQ ID NO: 419647 - RNA, 19 nt, Homo sapiens
gagcaucccucuccaaaag

SEQ ID NO: 419648 - RNA, 19 nt, Homo sapiens
gguacaaugcccaggagua

SEQ ID NO: 419649 - RNA, 19 nt, Homo sapiens
ggacaaggcgugggaugug

SEQ ID NO: 419650 - RNA, 19 nt, Homo sapiens
acuccgagauccucaagaa

SEQ ID NO: 419651 - RNA, 19 nt, Homo sapiens
caucauccgucgcuucaag

SEQ ID NO: 419652 - RNA, 19 nt, Homo sapiens
aaaccaguaugaugaugga

SEQ ID NO: 419653 - RNA, 19 nt, Homo sapiens
ggccaagacccucccauug

SEQ ID NO: 419654 - RNA, 19 nt, Homo sapiens
caaaccagcccuugagucu

SEQ ID NO: 419655 - RNA, 19 nt, Homo sapiens
uaaagucuucgcagauuau

SEQ ID NO: 419656 - RNA, 19 nt, Homo sapiens
uuuaaagucuucgcagauu

SEQ ID NO: 419657 - RNA, 19 nt, Homo sapiens
gcaugcggguggaggaugu

SEQ ID NO: 419658 - RNA, 19 nt, Homo sapiens
ccaacucacucuucgacau

SEQ ID NO: 419659 - RNA, 19 nt, Homo sapiens
cauaaguuccagaauaaga

SEQ ID NO: 419660 - RNA, 19 nt, Homo sapiens
cagauaagguggccaucca

SEQ ID NO: 419661 - RNA, 19 nt, Homo sapiens
ggaggaaauugaggaggau

SEQ ID NO: 419662 - RNA, 19 nt, Homo sapiens
ggaauacaaaguccacauc

SEQ ID NO: 419663 - RNA, 19 nt, Homo sapiens
gcgcaaacugcucuccuuu

SEQ ID NO: 419664 - RNA, 19 nt, Homo sapiens
gcacuucuacggccaugug

SEQ ID NO: 419665 - RNA, 19 nt, Homo sapiens
ccaagaggaucuacuaccu

SEQ ID NO: 419666 - RNA, 19 nt, Homo sapiens
gaaaagaaagcaaaucagu

SEQ ID NO: 419667 - RNA, 19 nt, Homo sapiens
ucacacaaccucccucaca

SEQ ID NO: 419668 - RNA, 19 nt, Homo sapiens
uucgaugccuucccagaua

SEQ ID NO: 419669 - RNA, 19 nt, Homo sapiens
ccaaggcucccaaugacuu

SEQ ID NO: 419670 - RNA, 19 nt, Homo sapiens
guacuggaguuagaucucu

SEQ ID NO: 419671 - RNA, 19 nt, Homo sapiens
ccgagggccuauaggacua

SEQ ID NO: 419672 - RNA, 19 nt, Homo sapiens
ggguggaggauguggauaa

SEQ ID NO: 419673 - RNA, 19 nt, Homo sapiens
gcuaugaguuugggauuuu

SEQ ID NO: 419674 - RNA, 19 nt, Homo sapiens
aaccagcccuugagucugu

SEQ ID NO: 419675 - RNA, 19 nt, Homo sapiens
caugaccgguuuaaagucu

SEQ ID NO: 419676 - RNA, 19 nt, Homo sapiens
guacuacgaucgcauuccu

SEQ ID NO: 419677 - RNA, 19 nt, Homo sapiens
acaaugcccaggaguacua

SEQ ID NO: 419678 - RNA, 19 nt, Homo sapiens
gcaccggcaacaugaaguu

SEQ ID NO: 419679 - RNA, 19 nt, Homo sapiens
gguaccacauggccaagau

SEQ ID NO: 419680 - RNA, 19 nt, Homo sapiens
ucgaugccuucccagauaa

SEQ ID NO: 419681 - RNA, 19 nt, Homo sapiens
aauacaaaguccacaucaa

SEQ ID NO: 419682 - RNA, 19 nt, Homo sapiens
gagcuggagccucauaagu

SEQ ID NO: 419683 - RNA, 19 nt, Homo sapiens
gcauuucacacucguaaag

SEQ ID NO: 419684 - RNA, 19 nt, Homo sapiens
gggaaugccucaguuucuc

SEQ ID NO: 419685 - RNA, 19 nt, Homo sapiens
caacggggcucugaccauu

SEQ ID NO: 419686 - RNA, 19 nt, Homo sapiens
ccaaugauaauuucuucga

SEQ ID NO: 419687 - RNA, 19 nt, Homo sapiens
gagaaaagaaagcaaauca

SEQ ID NO: 419688 - RNA, 19 nt, Homo sapiens
gaagaggcgggagaggaaa

SEQ ID NO: 419689 - RNA, 19 nt, Homo sapiens
ucaucuuccuggagaacua

SEQ ID NO: 419690 - RNA, 19 nt, Homo sapiens
gaucaucagacucgucaca

SEQ ID NO: 419691 - RNA, 19 nt, Homo sapiens
aacgacagcuccucaacug

SEQ ID NO: 419692 - RNA, 19 nt, Homo sapiens
uacaagaacccaagagagu

SEQ ID NO: 419693 - RNA, 19 nt, Homo sapiens
caccaugaccgguuuaaag

SEQ ID NO: 419694 - RNA, 19 nt, Homo sapiens
caagagggagcccaauaag

SEQ ID NO: 419695 - RNA, 19 nt, Homo sapiens
gacaucauccgucgcuuca

SEQ ID NO: 419696 - RNA, 19 nt, Homo sapiens
ggaucuacuaccugucuuu

SEQ ID NO: 419697 - RNA, 19 nt, Homo sapiens
uuaaaugccaggagaaagu

SEQ ID NO: 419698 - RNA, 19 nt, Homo sapiens
gcaccaugaccgguuuaaa

SEQ ID NO: 419699 - RNA, 19 nt, Homo sapiens
agaagaggcgggagaggaa

SEQ ID NO: 419700 - RNA, 19 nt, Homo sapiens
ccacauggccaagaugauc

SEQ ID NO: 419701 - RNA, 19 nt, Homo sapiens
ggauguggccaaagugaag

SEQ ID NO: 419702 - RNA, 19 nt, Homo sapiens
accgaaaccuggcggagaa

SEQ ID NO: 419703 - RNA, 19 nt, Homo sapiens
ugaaggaucucaccaauuu

SEQ ID NO: 419704 - RNA, 19 nt, Homo sapiens
caacaacaaccuccuauua

SEQ ID NO: 419705 - RNA, 19 nt, Homo sapiens
ggagaagaauccuauugua

SEQ ID NO: 419706 - RNA, 19 nt, Homo sapiens
gcacgaauguucaucuuug

SEQ ID NO: 419707 - RNA, 19 nt, Homo sapiens
agacagacuucuucauuua

SEQ ID NO: 419708 - RNA, 19 nt, Homo sapiens
ggaguuauuugucucuaua

SEQ ID NO: 419709 - RNA, 19 nt, Homo sapiens
caacaaccauguccucauu

SEQ ID NO: 419710 - RNA, 19 nt, Homo sapiens
gaccauauguuccucaauu

SEQ ID NO: 419711 - RNA, 19 nt, Homo sapiens
caacuaacauugugaagug

SEQ ID NO: 419712 - RNA, 19 nt, Homo sapiens
auacugaacucacuugaua

SEQ ID NO: 419713 - RNA, 19 nt, Homo sapiens
ugaaugacgccaauuauua

SEQ ID NO: 419714 - RNA, 19 nt, Homo sapiens
gcuagaagcuggcaucaau

SEQ ID NO: 419715 - RNA, 19 nt, Homo sapiens
uaaggaagcugugaaagaa

SEQ ID NO: 419716 - RNA, 19 nt, Homo sapiens
ggagaggucuucacacuca

SEQ ID NO: 419717 - RNA, 19 nt, Homo sapiens
gaacucacuugauaaggaa

SEQ ID NO: 419718 - RNA, 19 nt, Homo sapiens
caucaaauguggucaaaga

SEQ ID NO: 419719 - RNA, 19 nt, Homo sapiens
ggacagaagugagcaacaa

SEQ ID NO: 419720 - RNA, 19 nt, Homo sapiens
gauccuacaucuucauuga

SEQ ID NO: 419721 - RNA, 19 nt, Homo sapiens
caaaucagacgcuaaguuu

SEQ ID NO: 419722 - RNA, 19 nt, Homo sapiens
gaagaauccuauuguaucu

SEQ ID NO: 419723 - RNA, 19 nt, Homo sapiens
acacuuggcucacagcuuu

SEQ ID NO: 419724 - RNA, 19 nt, Homo sapiens
gcaaacaggaucagugaaa

SEQ ID NO: 419725 - RNA, 19 nt, Homo sapiens
gaacugauuccacugauau

SEQ ID NO: 419726 - RNA, 19 nt, Homo sapiens
gugauacccuuaaauaaug

SEQ ID NO: 419727 - RNA, 19 nt, Homo sapiens
uauguucccuuaucaagua

SEQ ID NO: 419728 - RNA, 19 nt, Homo sapiens
ccaauaaacucuucuucau

SEQ ID NO: 419729 - RNA, 19 nt, Homo sapiens
ggaauucagucaacagcuu

SEQ ID NO: 419730 - RNA, 19 nt, Homo sapiens
cuacagaaccgcaguauau

SEQ ID NO: 419731 - RNA, 19 nt, Homo sapiens
agagacagcugaacuacaa

SEQ ID NO: 419732 - RNA, 19 nt, Homo sapiens
gaacagaacaugguccuau

SEQ ID NO: 419733 - RNA, 19 nt, Homo sapiens
agaaucagguggaaggaua

SEQ ID NO: 419734 - RNA, 19 nt, Homo sapiens
ggaauggaguuauuugucu

SEQ ID NO: 419735 - RNA, 19 nt, Homo sapiens
gaccugaccucugcaacua

SEQ ID NO: 419736 - RNA, 19 nt, Homo sapiens
gaaggacaauggcuguuuc

SEQ ID NO: 419737 - RNA, 19 nt, Homo sapiens
acaguaagauuccguguug

SEQ ID NO: 419738 - RNA, 19 nt, Homo sapiens
cagacaaacccauguauaa

SEQ ID NO: 419739 - RNA, 19 nt, Homo sapiens
gaacaggugacaaaucaga

SEQ ID NO: 419740 - RNA, 19 nt, Homo sapiens
gagaagaauccuauuguau

SEQ ID NO: 419741 - RNA, 19 nt, Homo sapiens
guagagagaccauauguuc

SEQ ID NO: 419742 - RNA, 19 nt, Homo sapiens
acaaccauguccucauuua

SEQ ID NO: 419743 - RNA, 19 nt, Homo sapiens
uagaaggaauggaguuauu

SEQ ID NO: 419744 - RNA, 19 nt, Homo sapiens
ccuaugugcuccucgcuua

SEQ ID NO: 419745 - RNA, 19 nt, Homo sapiens
aaagggagguguagaagau

SEQ ID NO: 419746 - RNA, 19 nt, Homo sapiens
gguggaggcugaagguauu

SEQ ID NO: 419747 - RNA, 19 nt, Homo sapiens
agacauccaugaaauacaa

SEQ ID NO: 419748 - RNA, 19 nt, Homo sapiens
gcucaacaaugccauaaag

SEQ ID NO: 419749 - RNA, 19 nt, Homo sapiens
caaauguggucaaagaauc

SEQ ID NO: 419750 - RNA, 19 nt, Homo sapiens
aaugugaacuucucaguga

SEQ ID NO: 419751 - RNA, 19 nt, Homo sapiens
ccacugauauaccuugaga

SEQ ID NO: 419752 - RNA, 19 nt, Homo sapiens
gaugguaucugguuuuauu

SEQ ID NO: 419753 - RNA, 19 nt, Homo sapiens
ugccagagcuucuuucuca

SEQ ID NO: 419754 - RNA, 19 nt, Homo sapiens
gaagacaaccucguccauu

SEQ ID NO: 419755 - RNA, 19 nt, Homo sapiens
ugaacucacuugauaagga

SEQ ID NO: 419756 - RNA, 19 nt, Homo sapiens
ggagucagccuggaaugua

SEQ ID NO: 419757 - RNA, 19 nt, Homo sapiens
gucaacagcuuaacagcaa

SEQ ID NO: 419758 - RNA, 19 nt, Homo sapiens
gaaggaauggaguuauuug

SEQ ID NO: 419759 - RNA, 19 nt, Homo sapiens
uggaacaggugacaaauca

SEQ ID NO: 419760 - RNA, 19 nt, Homo sapiens
acacaacccugagauuuau

SEQ ID NO: 419761 - RNA, 19 nt, Homo sapiens
gaauucagucaacagcuua

SEQ ID NO: 419762 - RNA, 19 nt, Homo sapiens
ccaagaagaaaucgaauug

SEQ ID NO: 419763 - RNA, 19 nt, Homo sapiens
gaagccagcaauuguuaaa

SEQ ID NO: 419764 - RNA, 19 nt, Homo sapiens
gagaaauacugaacucacu

SEQ ID NO: 419765 - RNA, 19 nt, Homo sapiens
ucacagaccuuuucuacaa

SEQ ID NO: 419766 - RNA, 19 nt, Homo sapiens
gaaauacugaacucacuug

SEQ ID NO: 419767 - RNA, 19 nt, Homo sapiens
gcaaugcaguccuuagaac

SEQ ID NO: 419768 - RNA, 19 nt, Homo sapiens
gaagaugcuggacuuggua

SEQ ID NO: 419769 - RNA, 19 nt, Homo sapiens
ucauuuaugucuugugcua

SEQ ID NO: 419770 - RNA, 19 nt, Homo sapiens
aaagugugcugcucaugaa

SEQ ID NO: 419771 - RNA, 19 nt, Homo sapiens
gcacaguuuucaaucaaua

SEQ ID NO: 419772 - RNA, 19 nt, Homo sapiens
guacuucuggucaaacuaa

SEQ ID NO: 419773 - RNA, 19 nt, Homo sapiens
ugaaguggaucaugaagca

SEQ ID NO: 419774 - RNA, 19 nt, Homo sapiens
cagaauagagaaauacuga

SEQ ID NO: 419775 - RNA, 19 nt, Homo sapiens
ucacguggcucucccagau

SEQ ID NO: 419776 - RNA, 19 nt, Homo sapiens
gaacuacaaacaccaagau

SEQ ID NO: 419777 - RNA, 19 nt, Homo sapiens
caaagugugcugcucauga

SEQ ID NO: 419778 - RNA, 19 nt, Homo sapiens
ugaacugauuccacugaua

SEQ ID NO: 419779 - RNA, 19 nt, Homo sapiens
ucucuguccuauacauuua

SEQ ID NO: 419780 - RNA, 19 nt, Homo sapiens
gaaagaggacuccccauuu

SEQ ID NO: 419781 - RNA, 19 nt, Homo sapiens
gcuaucucaucacugguua

SEQ ID NO: 419782 - RNA, 19 nt, Homo sapiens
ugaacuaucugaaugaaac

SEQ ID NO: 419783 - RNA, 19 nt, Homo sapiens
gcagggucuugcacaguuu

SEQ ID NO: 419784 - RNA, 19 nt, Homo sapiens
ggaggucugugaggaauuc

SEQ ID NO: 419785 - RNA, 19 nt, Homo sapiens
gccagugacucaaacucua

SEQ ID NO: 419786 - RNA, 19 nt, Homo sapiens
aagacaaccucguccauug

SEQ ID NO: 419787 - RNA, 19 nt, Homo sapiens
ccaaagucguguucaguca

SEQ ID NO: 419788 - RNA, 19 nt, Homo sapiens
ggagucaggagacaugaaa

SEQ ID NO: 419789 - RNA, 19 nt, Homo sapiens
accaguaucucgguuaaua

SEQ ID NO: 419790 - RNA, 19 nt, Homo sapiens
ccaaugcaaccaccaauga

SEQ ID NO: 419791 - RNA, 19 nt, Homo sapiens
caaacaggaucagugaaau

SEQ ID NO: 419792 - RNA, 19 nt, Homo sapiens
uaucucguguucuuaauug

SEQ ID NO: 419793 - RNA, 19 nt, Homo sapiens
acaggagccucuucacuga

SEQ ID NO: 419794 - RNA, 19 nt, Homo sapiens
gaaauuccucucccaguca

SEQ ID NO: 419795 - RNA, 19 nt, Homo sapiens
cguccuuucuucauucaua

SEQ ID NO: 419796 - RNA, 19 nt, Homo sapiens
ggaagaacaaggacacugu

SEQ ID NO: 419797 - RNA, 19 nt, Homo sapiens
ugccaaagauaaucaguau

SEQ ID NO: 419798 - RNA, 19 nt, Homo sapiens
gauuguugauguaaagaug

SEQ ID NO: 419799 - RNA, 19 nt, Homo sapiens
gacuugcgauggacacaaa

SEQ ID NO: 419800 - RNA, 19 nt, Homo sapiens
gaagugagagacaaaccuu

SEQ ID NO: 419801 - RNA, 19 nt, Homo sapiens
gaaacggugcgaagcuauu

SEQ ID NO: 419802 - RNA, 19 nt, Homo sapiens
aauacgggcuuugaaauga

SEQ ID NO: 419803 - RNA, 19 nt, Homo sapiens
guaagaagauccacacuga

SEQ ID NO: 419804 - RNA, 19 nt, Homo sapiens
gcaaugcacuggacgucua

SEQ ID NO: 419805 - RNA, 19 nt, Homo sapiens
caaaggaugugguggagaa

SEQ ID NO: 419806 - RNA, 19 nt, Homo sapiens
ggaugaagcuggugaugga

SEQ ID NO: 419807 - RNA, 19 nt, Homo sapiens
gcaaaaugaucaagaauga

SEQ ID NO: 419808 - RNA, 19 nt, Homo sapiens
ggacaaauggugcaucuau

SEQ ID NO: 419809 - RNA, 19 nt, Homo sapiens
gcacuaugcuguugucucu

SEQ ID NO: 419810 - RNA, 19 nt, Homo sapiens
ccaaauuccaugucaauaa

SEQ ID NO: 419811 - RNA, 19 nt, Homo sapiens
gcacugaaccuaccucauc

SEQ ID NO: 419812 - RNA, 19 nt, Homo sapiens
ggaaaggugugagcuggaa

SEQ ID NO: 419813 - RNA, 19 nt, Homo sapiens
ccacggcucuuuacacuca

SEQ ID NO: 419814 - RNA, 19 nt, Homo sapiens
ccaaagccaucaauuucaa

SEQ ID NO: 419815 - RNA, 19 nt, Homo sapiens
ugaggugccugguggauuu

SEQ ID NO: 419816 - RNA, 19 nt, Homo sapiens
ccaauggaauccugcauau

SEQ ID NO: 419817 - RNA, 19 nt, Homo sapiens
gaagugggcagauggcaaa

SEQ ID NO: 419818 - RNA, 19 nt, Homo sapiens
gcgcugcccuugaguaugu

SEQ ID NO: 419819 - RNA, 19 nt, Homo sapiens
ggagccacaucuucuagaa

SEQ ID NO: 419820 - RNA, 19 nt, Homo sapiens
gagcucaaaggccauaaua

SEQ ID NO: 419821 - RNA, 19 nt, Homo sapiens
cuacacaccuuacaaaguc

SEQ ID NO: 419822 - RNA, 19 nt, Homo sapiens
cuaccgggauccuguuaua

SEQ ID NO: 419823 - RNA, 19 nt, Homo sapiens
gaacagcuaaauucuccua

SEQ ID NO: 419824 - RNA, 19 nt, Homo sapiens
gauggaggauggcaagaug

SEQ ID NO: 419825 - RNA, 19 nt, Homo sapiens
gaaggaagacccaggaaag

SEQ ID NO: 419826 - RNA, 19 nt, Homo sapiens
ucauugagcugcagcaugu

SEQ ID NO: 419827 - RNA, 19 nt, Homo sapiens
gauggacccuguagccuau

SEQ ID NO: 419828 - RNA, 19 nt, Homo sapiens
gcauacaggcuacgucauu

SEQ ID NO: 419829 - RNA, 19 nt, Homo sapiens
ggaagauccuccagcuugu

SEQ ID NO: 419830 - RNA, 19 nt, Homo sapiens
gcacaagaacccugaagau

SEQ ID NO: 419831 - RNA, 19 nt, Homo sapiens
ucacauaugcgucugacua

SEQ ID NO: 419832 - RNA, 19 nt, Homo sapiens
gcuaagcgcugcccuugag

SEQ ID NO: 419833 - RNA, 19 nt, Homo sapiens
gguggaacguuaccauuuc

SEQ ID NO: 419834 - RNA, 19 nt, Homo sapiens
gcgagacgcucaagaacuc

SEQ ID NO: 419835 - RNA, 19 nt, Homo sapiens
aggcugaucuggagaagaa

SEQ ID NO: 419836 - RNA, 19 nt, Homo sapiens
cauaugcgucugacuauuu

SEQ ID NO: 419837 - RNA, 19 nt, Homo sapiens
gaaggaggaagcaaaguuc

SEQ ID NO: 419838 - RNA, 19 nt, Homo sapiens
ccacaagccuggugagaac

SEQ ID NO: 419839 - RNA, 19 nt, Homo sapiens
ugagaggacugacuucaag

SEQ ID NO: 419840 - RNA, 19 nt, Homo sapiens
ggagagaccgucccaugga

SEQ ID NO: 419841 - RNA, 19 nt, Homo sapiens
gaagauccuccagcuugua

SEQ ID NO: 419842 - RNA, 19 nt, Homo sapiens
ccaugaaucuacuaaagca

SEQ ID NO: 419843 - RNA, 19 nt, Homo sapiens
cuacauagccaguaagaag

SEQ ID NO: 419844 - RNA, 19 nt, Homo sapiens
gaacguuaccauuucaaca

SEQ ID NO: 419845 - RNA, 19 nt, Homo sapiens
gaugacccacggcucuuua

SEQ ID NO: 419846 - RNA, 19 nt, Homo sapiens
aauggaauccugcauauug

SEQ ID NO: 419847 - RNA, 19 nt, Homo sapiens
caccaugaaucuacuaaag

SEQ ID NO: 419848 - RNA, 19 nt, Homo sapiens
acuaugcuguugucucuaa

SEQ ID NO: 419849 - RNA, 19 nt, Homo sapiens
gacaaauggugcaucuauc

SEQ ID NO: 419850 - RNA, 19 nt, Homo sapiens
agccaucaauuucaacuuu

SEQ ID NO: 419851 - RNA, 19 nt, Homo sapiens
gcucaaaggccauaauacu

SEQ ID NO: 419852 - RNA, 19 nt, Homo sapiens
cccauugucuucauugaga

SEQ ID NO: 419853 - RNA, 19 nt, Homo sapiens
aagcagcaccuggagauua

SEQ ID NO: 419854 - RNA, 19 nt, Homo sapiens
caagaacccugaagauccu

SEQ ID NO: 419855 - RNA, 19 nt, Homo sapiens
ggagccagagccaggauuu

SEQ ID NO: 419856 - RNA, 19 nt, Homo sapiens
ucgacaaguuccaguuuga

SEQ ID NO: 419857 - RNA, 19 nt, Homo sapiens
gcaggggucuggcuuaugu

SEQ ID NO: 419858 - RNA, 19 nt, Homo sapiens
cgucucuccuuccuuguaa

SEQ ID NO: 419859 - RNA, 19 nt, Homo sapiens
ggcaaaagcucggcuagaa

SEQ ID NO: 419860 - RNA, 19 nt, Homo sapiens
agaaugaaguggacaugca

SEQ ID NO: 419861 - RNA, 19 nt, Homo sapiens
gccaucaauuucaacuuug

SEQ ID NO: 419862 - RNA, 19 nt, Homo sapiens
caucgacacuguggacuuc

SEQ ID NO: 419863 - RNA, 19 nt, Homo sapiens
gaacugucacacugaagga

SEQ ID NO: 419864 - RNA, 19 nt, Homo sapiens
cauacaggcuacgucauug

SEQ ID NO: 419865 - RNA, 19 nt, Homo sapiens
ggucaucaucaccaacuuu

SEQ ID NO: 419866 - RNA, 19 nt, Homo sapiens
uaaagcagcaccuggagau

SEQ ID NO: 419867 - RNA, 19 nt, Homo sapiens
gagccagagccaggauuua

SEQ ID NO: 419868 - RNA, 19 nt, Homo sapiens
agucacugcugcucuuuga

SEQ ID NO: 419869 - RNA, 19 nt, Homo sapiens
ugcgugaugugcugaauga

SEQ ID NO: 419870 - RNA, 19 nt, Homo sapiens
cucaagaacucggcucuga

SEQ ID NO: 419871 - RNA, 19 nt, Homo sapiens
ccacacaccaugaaucuac

SEQ ID NO: 419872 - RNA, 19 nt, Homo sapiens
gcaaaacccuucgacaagu

SEQ ID NO: 419873 - RNA, 19 nt, Homo sapiens
caaaggcuuccaucagguu

SEQ ID NO: 419874 - RNA, 19 nt, Homo sapiens
gcaucuaucccaccuacga

SEQ ID NO: 419875 - RNA, 19 nt, Homo sapiens
gaggagaggagcucaaagg

SEQ ID NO: 419876 - RNA, 19 nt, Homo sapiens
ggacuucgagcgggaaugu

SEQ ID NO: 419877 - RNA, 19 nt, Homo sapiens
gggaggcccuuaaguucca

SEQ ID NO: 419878 - RNA, 19 nt, Homo sapiens
acagcuaaauucuccuaga

SEQ ID NO: 419879 - RNA, 19 nt, Homo sapiens
ggcagaugcuggagagaag

SEQ ID NO: 419880 - RNA, 19 nt, Homo sapiens
gccaaagccaucaauuuca

SEQ ID NO: 419881 - RNA, 19 nt, Homo sapiens
gcuggaagcacugaaccua

SEQ ID NO: 419882 - RNA, 19 nt, Homo sapiens
gaaccuggcaucacuacac

SEQ ID NO: 419883 - RNA, 19 nt, Homo sapiens
ucaaaggccauaauacucu

SEQ ID NO: 419884 - RNA, 19 nt, Homo sapiens
gcuacacaccuuacaaagu

SEQ ID NO: 419885 - RNA, 19 nt, Homo sapiens
ggacaugccaaagccauca

SEQ ID NO: 419886 - RNA, 19 nt, Homo sapiens
ggaggacggcaaaggaugu

SEQ ID NO: 419887 - RNA, 19 nt, Homo sapiens
gaauguggcguggguguca

SEQ ID NO: 419888 - RNA, 19 nt, Homo sapiens
gggcagaugcuggagagaa

SEQ ID NO: 419889 - RNA, 19 nt, Homo sapiens
caccugaggccaucaacaa

SEQ ID NO: 419890 - RNA, 19 nt, Homo sapiens
ccgacgcucuuccuacuuc

SEQ ID NO: 419891 - RNA, 19 nt, Homo sapiens
uagccuaucgagucaagua

SEQ ID NO: 419892 - RNA, 19 nt, Homo sapiens
agaaggaggaagcaaaguu

SEQ ID NO: 419893 - RNA, 19 nt, Homo sapiens
acaccaacccugagaagga

SEQ ID NO: 419894 - RNA, 19 nt, Homo sapiens
caauuucaacuuuggcuau

SEQ ID NO: 419895 - RNA, 19 nt, Homo sapiens
guggaacguuaccauuuca

SEQ ID NO: 419896 - RNA, 19 nt, Homo sapiens
ugaaggaagacccaggaaa

SEQ ID NO: 419897 - RNA, 19 nt, Homo sapiens
uugagcgucuuggauauuu

SEQ ID NO: 419898 - RNA, 19 nt, Homo sapiens
caaaacccuucgacaaguu

SEQ ID NO: 419899 - RNA, 19 nt, Homo sapiens
gcacccauugucuucauug

SEQ ID NO: 419900 - RNA, 19 nt, Homo sapiens
gaccaaaggcuuccaucag

SEQ ID NO: 419901 - RNA, 19 nt, Homo sapiens
gcgaggagaggagcucaaa

SEQ ID NO: 419902 - RNA, 19 nt, Homo sapiens
gaugacaccaacccugaga

SEQ ID NO: 419903 - RNA, 19 nt, Homo sapiens
gaagguggaugcaauucuu

SEQ ID NO: 419904 - RNA, 19 nt, Homo sapiens
gcgcuacgaucauuguuaa

SEQ ID NO: 419905 - RNA, 19 nt, Homo sapiens
gagauaaugaguccuauuu

SEQ ID NO: 419906 - RNA, 19 nt, Homo sapiens
ccuaauaaaugcacuuguu

SEQ ID NO: 419907 - RNA, 19 nt, Homo sapiens
caaacuacauggacucugu

SEQ ID NO: 419908 - RNA, 19 nt, Homo sapiens
gguuaagugugcaagauaa

SEQ ID NO: 419909 - RNA, 19 nt, Homo sapiens
ggaaagcucuugggugaag

SEQ ID NO: 419910 - RNA, 19 nt, Homo sapiens
ucaaauagcauccgucaau

SEQ ID NO: 419911 - RNA, 19 nt, Homo sapiens
caucuugacuacuuuguug

SEQ ID NO: 419912 - RNA, 19 nt, Homo sapiens
uaagaacugugaccugaug

SEQ ID NO: 419913 - RNA, 19 nt, Homo sapiens
gaaaacgcauccuugaauu

SEQ ID NO: 419914 - RNA, 19 nt, Homo sapiens
uaaacugccuuaacuccuu

SEQ ID NO: 419915 - RNA, 19 nt, Homo sapiens
ugacuacuuuguugauuug

SEQ ID NO: 419916 - RNA, 19 nt, Homo sapiens
ccaggugacugcugagguu

SEQ ID NO: 419917 - RNA, 19 nt, Homo sapiens
gaccuuggcuggcgcaaag

SEQ ID NO: 419918 - RNA, 19 nt, Homo sapiens
gguauaagcaaacuacaug

SEQ ID NO: 419919 - RNA, 19 nt, Homo sapiens
aaacgcauccuugaauuaa

SEQ ID NO: 419920 - RNA, 19 nt, Homo sapiens
cuauagcggugucauguug

SEQ ID NO: 419921 - RNA, 19 nt, Homo sapiens
ggaugggacuccugguaug

SEQ ID NO: 419922 - RNA, 19 nt, Homo sapiens
cagaauguuguuccuaaua

SEQ ID NO: 419923 - RNA, 19 nt, Homo sapiens
agagaugaguauacuagaa

SEQ ID NO: 419924 - RNA, 19 nt, Homo sapiens
cuuguugucugucuucuuu

SEQ ID NO: 419925 - RNA, 19 nt, Homo sapiens
cuacuuuguugauuuguug

SEQ ID NO: 419926 - RNA, 19 nt, Homo sapiens
aaauccaagucucucuuua

SEQ ID NO: 419927 - RNA, 19 nt, Homo sapiens
gagaugaguauacuagaau

SEQ ID NO: 419928 - RNA, 19 nt, Homo sapiens
ugacagacucguucacuga

SEQ ID NO: 419929 - RNA, 19 nt, Homo sapiens
ggccagcgcuacgaucauu

SEQ ID NO: 419930 - RNA, 19 nt, Homo sapiens
caaauagcauccgucaauc

SEQ ID NO: 419931 - RNA, 19 nt, Homo sapiens
caaauccaagucucucuuu

SEQ ID NO: 419932 - RNA, 19 nt, Homo sapiens
aaacugccuuaacuccuuu

SEQ ID NO: 419933 - RNA, 19 nt, Homo sapiens
aagagaagguggaugcaau

SEQ ID NO: 419934 - RNA, 19 nt, Homo sapiens
gaaggaaggacggaacuca

SEQ ID NO: 419935 - RNA, 19 nt, Homo sapiens
gcguugaugugguggagaa

SEQ ID NO: 419936 - RNA, 19 nt, Homo sapiens
gcauaggaggcucucgaua

SEQ ID NO: 419937 - RNA, 19 nt, Homo sapiens
gaagagaagguggaugcaa

SEQ ID NO: 419938 - RNA, 19 nt, Homo sapiens
uaccaagcaucucaaggaa

SEQ ID NO: 419939 - RNA, 19 nt, Homo sapiens
cauaggaggcucucgauag

SEQ ID NO: 419940 - RNA, 19 nt, Homo sapiens
ugaguauacuagaaucaug

SEQ ID NO: 419941 - RNA, 19 nt, Homo sapiens
acugugaccugauguggaa

SEQ ID NO: 419942 - RNA, 19 nt, Homo sapiens
uaagugugcaagauaacua

SEQ ID NO: 419943 - RNA, 19 nt, Homo sapiens
cuaccaagcaucucaagga

SEQ ID NO: 419944 - RNA, 19 nt, Homo sapiens
auacagcagucagagauga

SEQ ID NO: 419945 - RNA, 19 nt, Homo sapiens
uucagaauguuguuccuaa

SEQ ID NO: 419946 - RNA, 19 nt, Homo sapiens
ccuagggacaaguguaaua

SEQ ID NO: 419947 - RNA, 19 nt, Homo sapiens
cgcaaaggcugcccuggau

SEQ ID NO: 419948 - RNA, 19 nt, Homo sapiens
ccuuagaauuccuaguuga

SEQ ID NO: 419949 - RNA, 19 nt, Homo sapiens
aauccaagucucucuuuaa

SEQ ID NO: 419950 - RNA, 19 nt, Homo sapiens
uguugucugucuucuuuaa

SEQ ID NO: 419951 - RNA, 19 nt, Homo sapiens
gcacuuguugucugucuuc

SEQ ID NO: 419952 - RNA, 19 nt, Homo sapiens
cuaauaaaugcacuuguug

SEQ ID NO: 419953 - RNA, 19 nt, Homo sapiens
ucagaauguuguuccuaau

SEQ ID NO: 419954 - RNA, 19 nt, Homo sapiens
ucagagaugaguauacuag

SEQ ID NO: 419955 - RNA, 19 nt, Homo sapiens
gcagucagagaugaguaua

SEQ ID NO: 419956 - RNA, 19 nt, Homo sapiens
uugaugugguggagaauga

SEQ ID NO: 419957 - RNA, 19 nt, Homo sapiens
ggucuggccuagguuaagu

SEQ ID NO: 419958 - RNA, 19 nt, Homo sapiens
gaaugucauguuuauguca

SEQ ID NO: 419959 - RNA, 19 nt, Homo sapiens
cagagcauauggacaucga

SEQ ID NO: 419960 - RNA, 19 nt, Homo sapiens
gaagaggccagcgcuacga

SEQ ID NO: 419961 - RNA, 19 nt, Homo sapiens
ugaaugucauguuuauguc

SEQ ID NO: 419962 - RNA, 19 nt, Homo sapiens
gaacucaccccagcauauu

SEQ ID NO: 419963 - RNA, 19 nt, Homo sapiens
gaugggacuccugguauga

SEQ ID NO: 419964 - RNA, 19 nt, Homo sapiens
aaucuguguuaacugcaua

SEQ ID NO: 419965 - RNA, 19 nt, Homo sapiens
gacugguggccgucaaaua

SEQ ID NO: 419966 - RNA, 19 nt, Homo sapiens
gaugaacaggaaaucaaug

SEQ ID NO: 419967 - RNA, 19 nt, Homo sapiens
uagguuaagugugcaagau

SEQ ID NO: 419968 - RNA, 19 nt, Homo sapiens
aagcagagcauauggacau

SEQ ID NO: 419969 - RNA, 19 nt, Homo sapiens
guagaaaacgcauccuuga

SEQ ID NO: 419970 - RNA, 19 nt, Homo sapiens
gagcucaggaagccuaauc

SEQ ID NO: 419971 - RNA, 19 nt, Homo sapiens
uagaauuccuaguugaaac

SEQ ID NO: 419972 - RNA, 19 nt, Homo sapiens
ccuggacacccuuagaauu

SEQ ID NO: 419973 - RNA, 19 nt, Homo sapiens
aaaugcacuuguugucugu

SEQ ID NO: 419974 - RNA, 19 nt, Homo sapiens
uaacuccuuuugugguaua

SEQ ID NO: 419975 - RNA, 19 nt, Homo sapiens
ccgaugaacaggaaaucaa

SEQ ID NO: 419976 - RNA, 19 nt, Homo sapiens
gaugaguauacuagaauca

SEQ ID NO: 419977 - RNA, 19 nt, Homo sapiens
gaggccagcgcuacgauca

SEQ ID NO: 419978 - RNA, 19 nt, Homo sapiens
uaugugaaguaagacaaug

SEQ ID NO: 419979 - RNA, 19 nt, Homo sapiens
gcaaugccaaauccaaguc

SEQ ID NO: 419980 - RNA, 19 nt, Homo sapiens
ccaaauccaagucucucuu

SEQ ID NO: 419981 - RNA, 19 nt, Homo sapiens
ggugacugcugagguugga

SEQ ID NO: 419982 - RNA, 19 nt, Homo sapiens
gcuauagcggugucauguu

SEQ ID NO: 419983 - RNA, 19 nt, Homo sapiens
caaucuguguuaacugcau

SEQ ID NO: 419984 - RNA, 19 nt, Homo sapiens
gagacugguggccgucaaa

SEQ ID NO: 419985 - RNA, 19 nt, Homo sapiens
cgagauaaugaguccuauu

SEQ ID NO: 419986 - RNA, 19 nt, Homo sapiens
cuggacacccuuagaauuc

SEQ ID NO: 419987 - RNA, 19 nt, Homo sapiens
agagaagguggaugcaauu

SEQ ID NO: 419988 - RNA, 19 nt, Homo sapiens
agucagagaugaguauacu

SEQ ID NO: 419989 - RNA, 19 nt, Homo sapiens
ugucugucuucuuuaauca

SEQ ID NO: 419990 - RNA, 19 nt, Homo sapiens
gagaagguggaugcaauuc

SEQ ID NO: 419991 - RNA, 19 nt, Homo sapiens
gauguggaagcagagcaua

SEQ ID NO: 419992 - RNA, 19 nt, Homo sapiens
cauccgucaaucuguguua

SEQ ID NO: 419993 - RNA, 19 nt, Homo sapiens
ugaggggccugccagaaaa

SEQ ID NO: 419994 - RNA, 19 nt, Homo sapiens
ggccuaccaugguuucaac

SEQ ID NO: 419995 - RNA, 19 nt, Homo sapiens
ggaacucaccccagcauau

SEQ ID NO: 419996 - RNA, 19 nt, Homo sapiens
cgaugaacaggaaaucaau

SEQ ID NO: 419997 - RNA, 19 nt, Homo sapiens
ugacugcugagguuggaaa

SEQ ID NO: 419998 - RNA, 19 nt, Homo sapiens
ccuguggucuggccuaggu

SEQ ID NO: 419999 - RNA, 19 nt, Homo sapiens
uauaagcaaacuacaugga

SEQ ID NO: 420000 - RNA, 19 nt, Homo sapiens
aaaacgcauccuugaauua

SEQ ID NO: 420001 - RNA, 19 nt, Homo sapiens
gaccaucuccagccaucug

SEQ ID NO: 420002 - RNA, 19 nt, Homo sapiens
cgagacugguggccgucaa

SEQ ID NO: 420003 - RNA, 19 nt, Homo sapiens
ggagguugcugcuaaauuu

SEQ ID NO: 420004 - RNA, 19 nt, Homo sapiens
gcugagaaguccaauguua

SEQ ID NO: 420005 - RNA, 19 nt, Homo sapiens
gaacaaucaccuccaguua

SEQ ID NO: 420006 - RNA, 19 nt, Homo sapiens
guagaacagucuuucauga

SEQ ID NO: 420007 - RNA, 19 nt, Homo sapiens
caaucaagcuucaaauaug

SEQ ID NO: 420008 - RNA, 19 nt, Homo sapiens
gcaugaaucccgaauauga

SEQ ID NO: 420009 - RNA, 19 nt, Homo sapiens
gauggcagcugagauuaaa

SEQ ID NO: 420010 - RNA, 19 nt, Homo sapiens
ggaaaccagugcuaagaau

SEQ ID NO: 420011 - RNA, 19 nt, Homo sapiens
cagcaugaaucccgaauau

SEQ ID NO: 420012 - RNA, 19 nt, Homo sapiens
acaaucaccuccaguuauu

SEQ ID NO: 420013 - RNA, 19 nt, Homo sapiens
caaugaauuugcaaucuga

SEQ ID NO: 420014 - RNA, 19 nt, Homo sapiens
ggacacagcaggccaggaa

SEQ ID NO: 420015 - RNA, 19 nt, Homo sapiens
gggaacaaaugugaucuga

SEQ ID NO: 420016 - RNA, 19 nt, Homo sapiens
ggaaagucuugccuucuuc

SEQ ID NO: 420017 - RNA, 19 nt, Homo sapiens
aaauuugccuccauccuuu

SEQ ID NO: 420018 - RNA, 19 nt, Homo sapiens
gcgaaggaauuugcugauu

SEQ ID NO: 420019 - RNA, 19 nt, Homo sapiens
gcagugacauguccagcau

SEQ ID NO: 420020 - RNA, 19 nt, Homo sapiens
gaacguagaacagucuuuc

SEQ ID NO: 420021 - RNA, 19 nt, Homo sapiens
ucagagcacuccagucaag

SEQ ID NO: 420022 - RNA, 19 nt, Homo sapiens
gaucugaccacaaagaaag

SEQ ID NO: 420023 - RNA, 19 nt, Homo sapiens
gcccauggcaucauaguug

SEQ ID NO: 420024 - RNA, 19 nt, Homo sapiens
ggaaaacaaucaagcuuca

SEQ ID NO: 420025 - RNA, 19 nt, Homo sapiens
ugagaaguccaauguuaaa

SEQ ID NO: 420026 - RNA, 19 nt, Homo sapiens
gacgauggcagcugagauu

SEQ ID NO: 420027 - RNA, 19 nt, Homo sapiens
uaaauuugccuccauccuu

SEQ ID NO: 420028 - RNA, 19 nt, Homo sapiens
uggaaagucuugccuucuu

SEQ ID NO: 420029 - RNA, 19 nt, Homo sapiens
gaaugcaacgaacguagaa

SEQ ID NO: 420030 - RNA, 19 nt, Homo sapiens
gaaaccagugcuaagaaug

SEQ ID NO: 420031 - RNA, 19 nt, Homo sapiens
ccacaaagaaaguaguaga

SEQ ID NO: 420032 - RNA, 19 nt, Homo sapiens
gaccacaaagaaaguagua

SEQ ID NO: 420033 - RNA, 19 nt, Homo sapiens
ugcaggaaauagaucguua

SEQ ID NO: 420034 - RNA, 19 nt, Homo sapiens
caauugguguggauuucaa

SEQ ID NO: 420035 - RNA, 19 nt, Homo sapiens
guuugcagaugauacauau

SEQ ID NO: 420036 - RNA, 19 nt, Homo sapiens
gguggagguugcugcuaaa

SEQ ID NO: 420037 - RNA, 19 nt, Homo sapiens
acacaacagcgaaggaauu

SEQ ID NO: 420038 - RNA, 19 nt, Homo sapiens
cagcaggccaggaaagauu

SEQ ID NO: 420039 - RNA, 19 nt, Homo sapiens
aacaguggcugcaggaaau

SEQ ID NO: 420040 - RNA, 19 nt, Homo sapiens
cgaacaaucaccuccaguu

SEQ ID NO: 420041 - RNA, 19 nt, Homo sapiens
gcaaucugaacccaaguga

SEQ ID NO: 420042 - RNA, 19 nt, Homo sapiens
gcaggaaauagaucguuau

SEQ ID NO: 420043 - RNA, 19 nt, Homo sapiens
aaacaguggcugcaggaaa

SEQ ID NO: 420044 - RNA, 19 nt, Homo sapiens
aaucaagcuucaaauaugg

SEQ ID NO: 420045 - RNA, 19 nt, Homo sapiens
gugcuaagaaugcaacgaa

SEQ ID NO: 420046 - RNA, 19 nt, Homo sapiens
gaaagcuacaucagcacaa

SEQ ID NO: 420047 - RNA, 19 nt, Homo sapiens
cagaugauacauauacaga

SEQ ID NO: 420048 - RNA, 19 nt, Homo sapiens
gugcugagaaguccaaugu

SEQ ID NO: 420049 - RNA, 19 nt, Homo sapiens
caacagcgaaggaauuugc

SEQ ID NO: 420050 - RNA, 19 nt, Homo sapiens
cacaacagcgaaggaauuu

SEQ ID NO: 420051 - RNA, 19 nt, Homo sapiens
cuucuuagguuugcagaug

SEQ ID NO: 420052 - RNA, 19 nt, Homo sapiens
cgauggcagcugagauuaa

SEQ ID NO: 420053 - RNA, 19 nt, Homo sapiens
agguggagguugcugcuaa

SEQ ID NO: 420054 - RNA, 19 nt, Homo sapiens
cugagaaguccaauguuaa

SEQ ID NO: 420055 - RNA, 19 nt, Homo sapiens
gcaacgaacguagaacagu

SEQ ID NO: 420056 - RNA, 19 nt, Homo sapiens
guagggaacaaaugugauc

SEQ ID NO: 420057 - RNA, 19 nt, Homo sapiens
aaagcuacaucagcacaau

SEQ ID NO: 420058 - RNA, 19 nt, Homo sapiens
uaagaaugcaacgaacgua

SEQ ID NO: 420059 - RNA, 19 nt, Homo sapiens
caccuccaguuauuacaga

SEQ ID NO: 420060 - RNA, 19 nt, Homo sapiens
gguuugcagaugauacaua

SEQ ID NO: 420061 - RNA, 19 nt, Homo sapiens
caaucaccuccaguuauua

SEQ ID NO: 420062 - RNA, 19 nt, Homo sapiens
agucuugccuucuucuuag

SEQ ID NO: 420063 - RNA, 19 nt, Homo sapiens
aggagcccauggcaucaua

SEQ ID NO: 420064 - RNA, 19 nt, Homo sapiens
gaaagucuugccuucuucu

SEQ ID NO: 420065 - RNA, 19 nt, Homo sapiens
gagguugcugcuaaauuug

SEQ ID NO: 420066 - RNA, 19 nt, Homo sapiens
aacaaucaccuccaguuau

SEQ ID NO: 420067 - RNA, 19 nt, Homo sapiens
ccagcaugaaucccgaaua

SEQ ID NO: 420068 - RNA, 19 nt, Homo sapiens
cguagaacagucuuucaug

SEQ ID NO: 420069 - RNA, 19 nt, Homo sapiens
aagucuugccuucuucuua

SEQ ID NO: 420070 - RNA, 19 nt, Homo sapiens
cagugaaaaugucaacaaa

SEQ ID NO: 420071 - RNA, 19 nt, Homo sapiens
caggaaauagaucguuaug

SEQ ID NO: 420072 - RNA, 19 nt, Homo sapiens
auucagagcacuccaguca

SEQ ID NO: 420073 - RNA, 19 nt, Homo sapiens
gcagaugauacauauacag

SEQ ID NO: 420074 - RNA, 19 nt, Homo sapiens
cuacacaacagcgaaggaa

SEQ ID NO: 420075 - RNA, 19 nt, Homo sapiens
gaucguuaugccagugaaa

SEQ ID NO: 420076 - RNA, 19 nt, Homo sapiens
uggaaaccagugcuaagaa

SEQ ID NO: 420077 - RNA, 19 nt, Homo sapiens
guugguagggaacaaaugu

SEQ ID NO: 420078 - RNA, 19 nt, Homo sapiens
caugaaucccgaauaugau

SEQ ID NO: 420079 - RNA, 19 nt, Homo sapiens
ugauacauauacagaaagc

SEQ ID NO: 420080 - RNA, 19 nt, Homo sapiens
agaaugcaacgaacguaga

SEQ ID NO: 420081 - RNA, 19 nt, Homo sapiens
gugaucugaccacaaagaa

SEQ ID NO: 420082 - RNA, 19 nt, Homo sapiens
ggaguccuucaauaauguu

SEQ ID NO: 420083 - RNA, 19 nt, Homo sapiens
gaaggagucuuugacauua

SEQ ID NO: 420084 - RNA, 19 nt, Homo sapiens
ggacucaucuucauggaaa

SEQ ID NO: 420085 - RNA, 19 nt, Homo sapiens
gauauuacacggagagaua

SEQ ID NO: 420086 - RNA, 19 nt, Homo sapiens
guagaagaggcauuuauua

SEQ ID NO: 420087 - RNA, 19 nt, Homo sapiens
gaacauggacucaucuuca

SEQ ID NO: 420088 - RNA, 19 nt, Homo sapiens
gcaggagcuuuacuaguuu

SEQ ID NO: 420089 - RNA, 19 nt, Homo sapiens
gaaauggcuuuaugucaca

SEQ ID NO: 420090 - RNA, 19 nt, Homo sapiens
gcugagacaugaaacuauu

SEQ ID NO: 420091 - RNA, 19 nt, Homo sapiens
gggcaagaauccuuucguu

SEQ ID NO: 420092 - RNA, 19 nt, Homo sapiens
gugcaugaccuuacuauug

SEQ ID NO: 420093 - RNA, 19 nt, Homo sapiens
acgccuaucucuucaagua

SEQ ID NO: 420094 - RNA, 19 nt, Homo sapiens
agcaggagcuuuacuaguu

SEQ ID NO: 420095 - RNA, 19 nt, Homo sapiens
gcucgaaugauaacuauug

SEQ ID NO: 420096 - RNA, 19 nt, Homo sapiens
gaaucuagaagagaaguaa

SEQ ID NO: 420097 - RNA, 19 nt, Homo sapiens
gagauacauucaaccacuu

SEQ ID NO: 420098 - RNA, 19 nt, Homo sapiens
gagcuuuacuaguuuacga

SEQ ID NO: 420099 - RNA, 19 nt, Homo sapiens
caggagcuuuacuaguuua

SEQ ID NO: 420100 - RNA, 19 nt, Homo sapiens
ggaaacagauaaaacuuca

SEQ ID NO: 420101 - RNA, 19 nt, Homo sapiens
acuacgaacugaauuguau

SEQ ID NO: 420102 - RNA, 19 nt, Homo sapiens
gcccuuaacuacgaacuga

SEQ ID NO: 420103 - RNA, 19 nt, Homo sapiens
gauaacuauugaugggaaa

SEQ ID NO: 420104 - RNA, 19 nt, Homo sapiens
cgaaugauaacuauugaug

SEQ ID NO: 420105 - RNA, 19 nt, Homo sapiens
agaaggagucuuugacauu

SEQ ID NO: 420106 - RNA, 19 nt, Homo sapiens
gcauuccaauuccaacaug

SEQ ID NO: 420107 - RNA, 19 nt, Homo sapiens
agaagaaggugaagcuuuu

SEQ ID NO: 420108 - RNA, 19 nt, Homo sapiens
caagaauccuuucguucca

SEQ ID NO: 420109 - RNA, 19 nt, Homo sapiens
aaacuucagauaugggaua

SEQ ID NO: 420110 - RNA, 19 nt, Homo sapiens
caacauggucauuaugcuu

SEQ ID NO: 420111 - RNA, 19 nt, Homo sapiens
gugcucgaaugauaacuau

SEQ ID NO: 420112 - RNA, 19 nt, Homo sapiens
ccgucaaauucuuguauaa

SEQ ID NO: 420113 - RNA, 19 nt, Homo sapiens
ggagagauacauucaacca

SEQ ID NO: 420114 - RNA, 19 nt, Homo sapiens
guacgccuaucucuucaag

SEQ ID NO: 420115 - RNA, 19 nt, Homo sapiens
ggcuuuaugucacagaaga

SEQ ID NO: 420116 - RNA, 19 nt, Homo sapiens
ccuacucacuuauucuuuc

SEQ ID NO: 420117 - RNA, 19 nt, Homo sapiens
gguaaaucaugcuuauugc

SEQ ID NO: 420118 - RNA, 19 nt, Homo sapiens
ugaccuuacuauuggugua

SEQ ID NO: 420119 - RNA, 19 nt, Homo sapiens
uaggucaauugaugugauu

SEQ ID NO: 420120 - RNA, 19 nt, Homo sapiens
uguagaagaggcauuuauu

SEQ ID NO: 420121 - RNA, 19 nt, Homo sapiens
aagaagaaggugaagcuuu

SEQ ID NO: 420122 - RNA, 19 nt, Homo sapiens
gacuuuaauccgucaaauu

SEQ ID NO: 420123 - RNA, 19 nt, Homo sapiens
ugguaaaucaugcuuauug

SEQ ID NO: 420124 - RNA, 19 nt, Homo sapiens
gcuuauugcuacaguuuac

SEQ ID NO: 420125 - RNA, 19 nt, Homo sapiens
cagcugagacaugaaacua

SEQ ID NO: 420126 - RNA, 19 nt, Homo sapiens
ugcaugaccuuacuauugg

SEQ ID NO: 420127 - RNA, 19 nt, Homo sapiens
caacacaugcaggcaauca

SEQ ID NO: 420128 - RNA, 19 nt, Homo sapiens
aaggagucuuugacauuaa

SEQ ID NO: 420129 - RNA, 19 nt, Homo sapiens
ccaucacaaggucguauua

SEQ ID NO: 420130 - RNA, 19 nt, Homo sapiens
uguuaaauguugucuugug

SEQ ID NO: 420131 - RNA, 19 nt, Homo sapiens
cuacucacuuauucuuuca

SEQ ID NO: 420132 - RNA, 19 nt, Homo sapiens
ucauggaaacgucugcuaa

SEQ ID NO: 420133 - RNA, 19 nt, Homo sapiens
gucauuaugcuuauuggaa

SEQ ID NO: 420134 - RNA, 19 nt, Homo sapiens
aacauggucauuaugcuua

SEQ ID NO: 420135 - RNA, 19 nt, Homo sapiens
ggucaauugaugugauuau

SEQ ID NO: 420136 - RNA, 19 nt, Homo sapiens
uccgucaaauucuuguaua

SEQ ID NO: 420137 - RNA, 19 nt, Homo sapiens
cacaaggucguauuacaga

SEQ ID NO: 420138 - RNA, 19 nt, Homo sapiens
gauaaaacuucagauaugg

SEQ ID NO: 420139 - RNA, 19 nt, Homo sapiens
gccuaucucuucaaguaca

SEQ ID NO: 420140 - RNA, 19 nt, Homo sapiens
gguuucagccagugcauga

SEQ ID NO: 420141 - RNA, 19 nt, Homo sapiens
ggauacggcagggcaagaa

SEQ ID NO: 420142 - RNA, 19 nt, Homo sapiens
ucucuucaaguacaucaua

SEQ ID NO: 420143 - RNA, 19 nt, Homo sapiens
uaacuacgaacugaauugu

SEQ ID NO: 420144 - RNA, 19 nt, Homo sapiens
aaagacagauuuuggagau

SEQ ID NO: 420145 - RNA, 19 nt, Homo sapiens
cggcugcuguugagucugu

SEQ ID NO: 420146 - RNA, 19 nt, Homo sapiens
gcagcaggagcuuuacuag

SEQ ID NO: 420147 - RNA, 19 nt, Homo sapiens
ggugcucgaaugauaacua

SEQ ID NO: 420148 - RNA, 19 nt, Homo sapiens
acgagaacauggacucauc

SEQ ID NO: 420149 - RNA, 19 nt, Homo sapiens
gcuuuacuaguuuacgaua

SEQ ID NO: 420150 - RNA, 19 nt, Homo sapiens
caucauaaucggcgacaca

SEQ ID NO: 420151 - RNA, 19 nt, Homo sapiens
ggagucuuugacauuaaua

SEQ ID NO: 420152 - RNA, 19 nt, Homo sapiens
gagaacauggacucaucuu

SEQ ID NO: 420153 - RNA, 19 nt, Homo sapiens
cuaggucaauugaugugau

SEQ ID NO: 420154 - RNA, 19 nt, Homo sapiens
ucacagaagacuuuaaucc

SEQ ID NO: 420155 - RNA, 19 nt, Homo sapiens
gagacaugaaacuauuuga

SEQ ID NO: 420156 - RNA, 19 nt, Homo sapiens
ugagacaugaaacuauuug

SEQ ID NO: 420157 - RNA, 19 nt, Homo sapiens
uuaauaaugaggcaaaugg

SEQ ID NO: 420158 - RNA, 19 nt, Homo sapiens
gcucugcgggugucaguuc

SEQ ID NO: 420159 - RNA, 19 nt, Homo sapiens
acacggagagauacauuca

SEQ ID NO: 420160 - RNA, 19 nt, Homo sapiens
ugucuugugcccuuaacua

SEQ ID NO: 420161 - RNA, 19 nt, Homo sapiens
uuaugucacagaagacuuu

SEQ ID NO: 420162 - RNA, 19 nt, Homo sapiens
auuccaacauggucauuau

SEQ ID NO: 420163 - RNA, 19 nt, Homo sapiens
cuugugcccuuaacuacga

SEQ ID NO: 420164 - RNA, 19 nt, Homo sapiens
acuuuaauccgucaaauuc

SEQ ID NO: 420165 - RNA, 19 nt, Homo sapiens
ugucacagaagacuuuaau

SEQ ID NO: 420166 - RNA, 19 nt, Homo sapiens
gcacgagaacauggacuca

SEQ ID NO: 420167 - RNA, 19 nt, Homo sapiens
ucacaaggucguauuacag

SEQ ID NO: 420168 - RNA, 19 nt, Homo sapiens
gcguacgccuaucucuuca

SEQ ID NO: 420169 - RNA, 19 nt, Homo sapiens
uuaacuacgaacugaauug

SEQ ID NO: 420170 - RNA, 19 nt, Homo sapiens
agacuuuaauccgucaaau

SEQ ID NO: 420171 - RNA, 19 nt, Homo sapiens
uacuauugguguagaguuc

SEQ ID NO: 420172 - RNA, 19 nt, Homo sapiens
aacauggacucaucuucau

SEQ ID NO: 420173 - RNA, 19 nt, Homo sapiens
agacagauuuuggagauug

SEQ ID NO: 420174 - RNA, 19 nt, Homo sapiens
ggccuacucacuuauucuu

SEQ ID NO: 420175 - RNA, 19 nt, Homo sapiens
ugauuucuaggucaauuga

SEQ ID NO: 420176 - RNA, 19 nt, Homo sapiens
cucgaaugauaacuauuga

SEQ ID NO: 420177 - RNA, 19 nt, Homo sapiens
aggagucuuugacauuaau

SEQ ID NO: 420178 - RNA, 19 nt, Homo sapiens
auggaaacgucugcuaaga

SEQ ID NO: 420179 - RNA, 19 nt, Homo sapiens
gccagugcaugaccuuacu

SEQ ID NO: 420180 - RNA, 19 nt, Homo sapiens
ccaacauggucauuaugcu

SEQ ID NO: 420181 - RNA, 19 nt, Homo sapiens
acggagagauacauucaac

SEQ ID NO: 420182 - RNA, 19 nt, Homo sapiens
uuacacggagagauacauu

SEQ ID NO: 420183 - RNA, 19 nt, Homo sapiens
gagaauggauacaucaauu

SEQ ID NO: 420184 - RNA, 19 nt, Homo sapiens
gggaacuggugucuuauaa

SEQ ID NO: 420185 - RNA, 19 nt, Homo sapiens
gaaugaaugucguggcuau

SEQ ID NO: 420186 - RNA, 19 nt, Homo sapiens
ggauggagcuucacacgau

SEQ ID NO: 420187 - RNA, 19 nt, Homo sapiens
gaagauggcagugucuaua

SEQ ID NO: 420188 - RNA, 19 nt, Homo sapiens
ugugggaacuggugucuua

SEQ ID NO: 420189 - RNA, 19 nt, Homo sapiens
ggaggauggugccguguuu

SEQ ID NO: 420190 - RNA, 19 nt, Homo sapiens
caaccuggcuggccucuca

SEQ ID NO: 420191 - RNA, 19 nt, Homo sapiens
caaguuggauaccugugua

SEQ ID NO: 420192 - RNA, 19 nt, Homo sapiens
cuugagagcuucuuacuuc

SEQ ID NO: 420193 - RNA, 19 nt, Homo sapiens
agacagaaauucagaaagg

SEQ ID NO: 420194 - RNA, 19 nt, Homo sapiens
caacagagguagccaucuc

SEQ ID NO: 420195 - RNA, 19 nt, Homo sapiens
gaacuggugucuuauaacc

SEQ ID NO: 420196 - RNA, 19 nt, Homo sapiens
cgaagguccucuacugcua

SEQ ID NO: 420197 - RNA, 19 nt, Homo sapiens
guguauagcuucccaccuu

SEQ ID NO: 420198 - RNA, 19 nt, Homo sapiens
uuacagaagucaugguguu

SEQ ID NO: 420199 - RNA, 19 nt, Homo sapiens
gcacuguucugaggaggaa

SEQ ID NO: 420200 - RNA, 19 nt, Homo sapiens
gagagcuucuuacuucaga

SEQ ID NO: 420201 - RNA, 19 nt, Homo sapiens
ucacacaguuuaacaaggu

SEQ ID NO: 420202 - RNA, 19 nt, Homo sapiens
guuccucgcugaccacuug

SEQ ID NO: 420203 - RNA, 19 nt, Homo sapiens
ccacggauguccugguguu

SEQ ID NO: 420204 - RNA, 19 nt, Homo sapiens
ggacagccucagagucuuu

SEQ ID NO: 420205 - RNA, 19 nt, Homo sapiens
uauaucacauugagacaga

SEQ ID NO: 420206 - RNA, 19 nt, Homo sapiens
uggaagcccuugaaucuca

SEQ ID NO: 420207 - RNA, 19 nt, Homo sapiens
ggacugaugugagcuucau

SEQ ID NO: 420208 - RNA, 19 nt, Homo sapiens
ccaaaacacuaccugaaaa

SEQ ID NO: 420209 - RNA, 19 nt, Homo sapiens
gcccuugaaucucauccua

SEQ ID NO: 420210 - RNA, 19 nt, Homo sapiens
gcuggaagcccuugaaucu

SEQ ID NO: 420211 - RNA, 19 nt, Homo sapiens
ggauaauuauucccagagu

SEQ ID NO: 420212 - RNA, 19 nt, Homo sapiens
gauggagcuucacacgauu

SEQ ID NO: 420213 - RNA, 19 nt, Homo sapiens
ugcaguggcuucagaguau

SEQ ID NO: 420214 - RNA, 19 nt, Homo sapiens
ggaagaggaggaggaagaa

SEQ ID NO: 420215 - RNA, 19 nt, Homo sapiens
ggaagauggcagugucuau

SEQ ID NO: 420216 - RNA, 19 nt, Homo sapiens
ggagaauggauacaucaau

SEQ ID NO: 420217 - RNA, 19 nt, Homo sapiens
cagcugacccugcuagaug

SEQ ID NO: 420218 - RNA, 19 nt, Homo sapiens
cggcgaagguccucuacug

SEQ ID NO: 420219 - RNA, 19 nt, Homo sapiens
ucagucguguccuuaagaa

SEQ ID NO: 420220 - RNA, 19 nt, Homo sapiens
ccagacagcugagaaaucc

SEQ ID NO: 420221 - RNA, 19 nt, Homo sapiens
ugaaugguggcaauuauau

SEQ ID NO: 420222 - RNA, 19 nt, Homo sapiens
ccugaaugguggcaauuau

SEQ ID NO: 420223 - RNA, 19 nt, Homo sapiens
caauaucgaccucuugauc

SEQ ID NO: 420224 - RNA, 19 nt, Homo sapiens
ucagacaccuacuggauac

SEQ ID NO: 420225 - RNA, 19 nt, Homo sapiens
ugcgacggcuccagaauga

SEQ ID NO: 420226 - RNA, 19 nt, Homo sapiens
ggucagacaccuacuggau

SEQ ID NO: 420227 - RNA, 19 nt, Homo sapiens
ucacauugagacagaaauu

SEQ ID NO: 420228 - RNA, 19 nt, Homo sapiens
gagaugaggcgccuacaac

SEQ ID NO: 420229 - RNA, 19 nt, Homo sapiens
ggagaugaggcgccuacaa

SEQ ID NO: 420230 - RNA, 19 nt, Homo sapiens
ggaugcagccuccaaggau

SEQ ID NO: 420231 - RNA, 19 nt, Homo sapiens
ccgaggaggauaauuauuc

SEQ ID NO: 420232 - RNA, 19 nt, Homo sapiens
gggcagugguuaguucugu

SEQ ID NO: 420233 - RNA, 19 nt, Homo sapiens
ugugacaacacuaagauaa

SEQ ID NO: 420234 - RNA, 19 nt, Homo sapiens
gaagucaugguguucauac

SEQ ID NO: 420235 - RNA, 19 nt, Homo sapiens
acuagacucugccuuggaa

SEQ ID NO: 420236 - RNA, 19 nt, Homo sapiens
gccaauaucgaccucuuga

SEQ ID NO: 420237 - RNA, 19 nt, Homo sapiens
ugagacagaaauucagaaa

SEQ ID NO: 420238 - RNA, 19 nt, Homo sapiens
gauggcagugucuauaaga

SEQ ID NO: 420239 - RNA, 19 nt, Homo sapiens
ggaggaagaggaggaggaa

SEQ ID NO: 420240 - RNA, 19 nt, Homo sapiens
guagccaucucuguacugu

SEQ ID NO: 420241 - RNA, 19 nt, Homo sapiens
gagcucuucuucccacucu

SEQ ID NO: 420242 - RNA, 19 nt, Homo sapiens
ccuccaaccugaccaugau

SEQ ID NO: 420243 - RNA, 19 nt, Homo sapiens
gucagacaccuacuggaua

SEQ ID NO: 420244 - RNA, 19 nt, Homo sapiens
gaacuagagaggacaacag

SEQ ID NO: 420245 - RNA, 19 nt, Homo sapiens
gaggauggugccguguuua

SEQ ID NO: 420246 - RNA, 19 nt, Homo sapiens
ccaucugucucgucacuag

SEQ ID NO: 420247 - RNA, 19 nt, Homo sapiens
cgucacaagccgccaauau

SEQ ID NO: 420248 - RNA, 19 nt, Homo sapiens
cagcuugaccggcuugaga

SEQ ID NO: 420249 - RNA, 19 nt, Homo sapiens
agccaucucuguacuguca

SEQ ID NO: 420250 - RNA, 19 nt, Homo sapiens
ugucaucagucguguccuu

SEQ ID NO: 420251 - RNA, 19 nt, Homo sapiens
aagauggcagugucuauaa

SEQ ID NO: 420252 - RNA, 19 nt, Homo sapiens
aggaugaguuggagaaugg

SEQ ID NO: 420253 - RNA, 19 nt, Homo sapiens
ggaggaggaagaagaagag

SEQ ID NO: 420254 - RNA, 19 nt, Homo sapiens
caucagucguguccuuaag

SEQ ID NO: 420255 - RNA, 19 nt, Homo sapiens
cgacggcuccagaaugaau

SEQ ID NO: 420256 - RNA, 19 nt, Homo sapiens
cugaaugguggcaauuaua

SEQ ID NO: 420257 - RNA, 19 nt, Homo sapiens
gcaguggcuucagaguaug

SEQ ID NO: 420258 - RNA, 19 nt, Homo sapiens
uugcaguccuuucugaguu

SEQ ID NO: 420259 - RNA, 19 nt, Homo sapiens
ggaguuugcaguccuuucu

SEQ ID NO: 420260 - RNA, 19 nt, Homo sapiens
guuggagaauggauacauc

SEQ ID NO: 420261 - RNA, 19 nt, Homo sapiens
uguccgagcuacugucaca

SEQ ID NO: 420262 - RNA, 19 nt, Homo sapiens
cacaugaaguggccaucug

SEQ ID NO: 420263 - RNA, 19 nt, Homo sapiens
guggguagccauccugaau

SEQ ID NO: 420264 - RNA, 19 nt, Homo sapiens
ggaagcccuugaaucucau

SEQ ID NO: 420265 - RNA, 19 nt, Homo sapiens
gccaucguguauccuguga

SEQ ID NO: 420266 - RNA, 19 nt, Homo sapiens
gugacaacacuaagauaau

SEQ ID NO: 420267 - RNA, 19 nt, Homo sapiens
gaaugguggcaauuauauc

SEQ ID NO: 420268 - RNA, 19 nt, Homo sapiens
cagaagucaugguguucau

SEQ ID NO: 420269 - RNA, 19 nt, Homo sapiens
cccguuggcuuacagaagu

SEQ ID NO: 420270 - RNA, 19 nt, Homo sapiens
ucagagccaucguguaucc

SEQ ID NO: 420271 - RNA, 19 nt, Homo sapiens
agagaggacaacagaggua

SEQ ID NO: 420272 - RNA, 19 nt, Homo sapiens
cauccugaaugguggcaau

SEQ ID NO: 420273 - RNA, 19 nt, Homo sapiens
ggccaucugucucgucacu

SEQ ID NO: 420274 - RNA, 19 nt, Homo sapiens
ucacaagccgccaauaucg

SEQ ID NO: 420275 - RNA, 19 nt, Homo sapiens
ucccauaccuuggcaccuu

SEQ ID NO: 420276 - RNA, 19 nt, Homo sapiens
gcuccgaaacuucucuuca

SEQ ID NO: 420277 - RNA, 19 nt, Homo sapiens
acacagguagugcuggaaa

SEQ ID NO: 420278 - RNA, 19 nt, Homo sapiens
ggugucuuauaaccaaguu

SEQ ID NO: 420279 - RNA, 19 nt, Homo sapiens
uggaggcccuggucagaca

SEQ ID NO: 420280 - RNA, 19 nt, Homo sapiens
aagaggaggaggaagaaga

SEQ ID NO: 420281 - RNA, 19 nt, Homo sapiens
agaggaggaggaagaagaa

SEQ ID NO: 420282 - RNA, 19 nt, Homo sapiens
gggaagauggcagugucua

SEQ ID NO: 420283 - RNA, 19 nt, Homo sapiens
gaucagaacuucgacuaca

SEQ ID NO: 420284 - RNA, 19 nt, Homo sapiens
guucugaccucaugagugu

SEQ ID NO: 420285 - RNA, 19 nt, Homo sapiens
ccgucacccuuauuuauua

SEQ ID NO: 420286 - RNA, 19 nt, Homo sapiens
ccacccagaucaagaccua

SEQ ID NO: 420287 - RNA, 19 nt, Homo sapiens
ggacaacauuaacgucaag

SEQ ID NO: 420288 - RNA, 19 nt, Homo sapiens
gaaacaagugugacaugga

SEQ ID NO: 420289 - RNA, 19 nt, Homo sapiens
gaccuguucugaccucaug

SEQ ID NO: 420290 - RNA, 19 nt, Homo sapiens
gcgccaaggacaacauuaa

SEQ ID NO: 420291 - RNA, 19 nt, Homo sapiens
gacuacauguucaagauuc

SEQ ID NO: 420292 - RNA, 19 nt, Homo sapiens
acacuacacgcacccaaua

SEQ ID NO: 420293 - RNA, 19 nt, Homo sapiens
cauccacaguugucaguug

SEQ ID NO: 420294 - RNA, 19 nt, Homo sapiens
ugacaucaccaacgaggaa

SEQ ID NO: 420295 - RNA, 19 nt, Homo sapiens
guucaagauucucaucauc

SEQ ID NO: 420296 - RNA, 19 nt, Homo sapiens
uguaugacaucaccaacga

SEQ ID NO: 420297 - RNA, 19 nt, Homo sapiens
ggacacagcagggcaagag

SEQ ID NO: 420298 - RNA, 19 nt, Homo sapiens
gcccgucacccuuauuuau

SEQ ID NO: 420299 - RNA, 19 nt, Homo sapiens
agugugacauggaggauga

SEQ ID NO: 420300 - RNA, 19 nt, Homo sapiens
ggaccaucaccaccgcaua

SEQ ID NO: 420301 - RNA, 19 nt, Homo sapiens
ucgacuacauguucaagau

SEQ ID NO: 420302 - RNA, 19 nt, Homo sapiens
cgacuacauguucaagauu

SEQ ID NO: 420303 - RNA, 19 nt, Homo sapiens
gagcgguaccggaccauca

SEQ ID NO: 420304 - RNA, 19 nt, Homo sapiens
gcaucgacuucaaggucaa

SEQ ID NO: 420305 - RNA, 19 nt, Homo sapiens
ggccagaugacacccuaaa

SEQ ID NO: 420306 - RNA, 19 nt, Homo sapiens
guaggaaacaagugugaca

SEQ ID NO: 420307 - RNA, 19 nt, Homo sapiens
ccucaugagugucaaacgu

SEQ ID NO: 420308 - RNA, 19 nt, Homo sapiens
cagaugacacccuaaagca

SEQ ID NO: 420309 - RNA, 19 nt, Homo sapiens
cgucacccuuauuuauuau

SEQ ID NO: 420310 - RNA, 19 nt, Homo sapiens
gccacagacucgcgcuaug

SEQ ID NO: 420311 - RNA, 19 nt, Homo sapiens
gggcuucauccucauguau

SEQ ID NO: 420312 - RNA, 19 nt, Homo sapiens
gcaggcugaucgggcaaug

SEQ ID NO: 420313 - RNA, 19 nt, Homo sapiens
gaccccugcuccugacuua

SEQ ID NO: 420314 - RNA, 19 nt, Homo sapiens
ggugugcuguggguauuca

SEQ ID NO: 420315 - RNA, 19 nt, Homo sapiens
uaacgucaagcagaccuuu

SEQ ID NO: 420316 - RNA, 19 nt, Homo sapiens
gaccaucaccaccgcauac

SEQ ID NO: 420317 - RNA, 19 nt, Homo sapiens
ccaaggacaacauuaacgu

SEQ ID NO: 420318 - RNA, 19 nt, Homo sapiens
ucagaacuucgacuacaug

SEQ ID NO: 420319 - RNA, 19 nt, Homo sapiens
gcugguaggaaacaagugu

SEQ ID NO: 420320 - RNA, 19 nt, Homo sapiens
caucaccaccgcauacuac

SEQ ID NO: 420321 - RNA, 19 nt, Homo sapiens
cggaucagaacuucgacua

SEQ ID NO: 420322 - RNA, 19 nt, Homo sapiens
gagccaucccacucccuuu

SEQ ID NO: 420323 - RNA, 19 nt, Homo sapiens
gcaacgacaagaggaucaa

SEQ ID NO: 420324 - RNA, 19 nt, Homo sapiens
uagcccgucacccuuauuu

SEQ ID NO: 420325 - RNA, 19 nt, Homo sapiens
cuacacgcacccaauaaag

SEQ ID NO: 420326 - RNA, 19 nt, Homo sapiens
cccgucacccuuauuuauu

SEQ ID NO: 420327 - RNA, 19 nt, Homo sapiens
ccacagacucgcgcuaugg

SEQ ID NO: 420328 - RNA, 19 nt, Homo sapiens
gaaacacacuuaagagaaa

SEQ ID NO: 420329 - RNA, 19 nt, Homo sapiens
gcacuagacuaacauaaca

SEQ ID NO: 420330 - RNA, 19 nt, Homo sapiens
gcagauggucccaguaaua

SEQ ID NO: 420331 - RNA, 19 nt, Homo sapiens
ggacaaugcacaaguuauu

SEQ ID NO: 420332 - RNA, 19 nt, Homo sapiens
gccaugggcuucauucuga

SEQ ID NO: 420333 - RNA, 19 nt, Homo sapiens
caagaugaguugcugcuau

SEQ ID NO: 420334 - RNA, 19 nt, Homo sapiens
cuacucagaucaagaccua

SEQ ID NO: 420335 - RNA, 19 nt, Homo sapiens
uguaugacaucaccaauga

SEQ ID NO: 420336 - RNA, 19 nt, Homo sapiens
gagcucagacucucuaaug

SEQ ID NO: 420337 - RNA, 19 nt, Homo sapiens
uagcuaauccuguuaaaga

SEQ ID NO: 420338 - RNA, 19 nt, Homo sapiens
cagagcagcuuggguuuga

SEQ ID NO: 420339 - RNA, 19 nt, Homo sapiens
caacgugcuuguuuccuau

SEQ ID NO: 420340 - RNA, 19 nt, Homo sapiens
caaaggagaacaucagugu

SEQ ID NO: 420341 - RNA, 19 nt, Homo sapiens
cuacacgggugcagaauca

SEQ ID NO: 420342 - RNA, 19 nt, Homo sapiens
uaacauaacaggucacuac

SEQ ID NO: 420343 - RNA, 19 nt, Homo sapiens
aaagacaacuucucaaagc

SEQ ID NO: 420344 - RNA, 19 nt, Homo sapiens
cugcauagcuaauccuguu

SEQ ID NO: 420345 - RNA, 19 nt, Homo sapiens
uaauagauacucagcacua

SEQ ID NO: 420346 - RNA, 19 nt, Homo sapiens
aagaugaguugcugcuauu

SEQ ID NO: 420347 - RNA, 19 nt, Homo sapiens
cgaggcggguggaucauga

SEQ ID NO: 420348 - RNA, 19 nt, Homo sapiens
gcauagcuaauccuguuaa

SEQ ID NO: 420349 - RNA, 19 nt, Homo sapiens
aaggagaacaucaguguaa

SEQ ID NO: 420350 - RNA, 19 nt, Homo sapiens
cugauucgcuggacacaga

SEQ ID NO: 420351 - RNA, 19 nt, Homo sapiens
gcuuggguuugauuucuuu

SEQ ID NO: 420352 - RNA, 19 nt, Homo sapiens
cagaaacacacuuaagaga

SEQ ID NO: 420353 - RNA, 19 nt, Homo sapiens
auacucagcacuagacuaa

SEQ ID NO: 420354 - RNA, 19 nt, Homo sapiens
gaaaccccgucucuacuaa

SEQ ID NO: 420355 - RNA, 19 nt, Homo sapiens
agacugggcuacucagauc

SEQ ID NO: 420356 - RNA, 19 nt, Homo sapiens
uuaaacugcuuaucauugg

SEQ ID NO: 420357 - RNA, 19 nt, Homo sapiens
agaaacacacuuaagagaa

SEQ ID NO: 420358 - RNA, 19 nt, Homo sapiens
ugagucagaaacacacuua

SEQ ID NO: 420359 - RNA, 19 nt, Homo sapiens
ucaaagcccugcgccuguu

SEQ ID NO: 420360 - RNA, 19 nt, Homo sapiens
cauagcuaauccuguuaaa

SEQ ID NO: 420361 - RNA, 19 nt, Homo sapiens
gcaugccaauugcguaaag

SEQ ID NO: 420362 - RNA, 19 nt, Homo sapiens
gggcaugccaauugcguaa

SEQ ID NO: 420363 - RNA, 19 nt, Homo sapiens
gagcagcuuggguuugauu

SEQ ID NO: 420364 - RNA, 19 nt, Homo sapiens
gggugaaacugcagaucug

SEQ ID NO: 420365 - RNA, 19 nt, Homo sapiens
gucagaaacacacuuaaga

SEQ ID NO: 420366 - RNA, 19 nt, Homo sapiens
cuaauccuguuaaagacaa

SEQ ID NO: 420367 - RNA, 19 nt, Homo sapiens
ggaacaagugugacaugga

SEQ ID NO: 420368 - RNA, 19 nt, Homo sapiens
uaaagacaacuucucaaag

SEQ ID NO: 420369 - RNA, 19 nt, Homo sapiens
ucgagaccauccuggcuaa

SEQ ID NO: 420370 - RNA, 19 nt, Homo sapiens
caaagcccugcgccuguua

SEQ ID NO: 420371 - RNA, 19 nt, Homo sapiens
cuacauguuuaaacugcuu

SEQ ID NO: 420372 - RNA, 19 nt, Homo sapiens
gggcuucauucugauguau

SEQ ID NO: 420373 - RNA, 19 nt, Homo sapiens
gcucagacucucuaaugau

SEQ ID NO: 420374 - RNA, 19 nt, Homo sapiens
acucagcacuagacuaaca

SEQ ID NO: 420375 - RNA, 19 nt, Homo sapiens
gauggucccaguaauagau

SEQ ID NO: 420376 - RNA, 19 nt, Homo sapiens
cgcgauggcuucagugaca

SEQ ID NO: 420377 - RNA, 19 nt, Homo sapiens
agaccauccuggcuaacaa

SEQ ID NO: 420378 - RNA, 19 nt, Homo sapiens
gaucaugaggucaggagau

SEQ ID NO: 420379 - RNA, 19 nt, Homo sapiens
ccugguggaugccauuugu

SEQ ID NO: 420380 - RNA, 19 nt, Homo sapiens
gcagagcagcuuggguuug

SEQ ID NO: 420381 - RNA, 19 nt, Homo sapiens
ugacaucaccaaugaagag

SEQ ID NO: 420382 - RNA, 19 nt, Homo sapiens
ccaucacaacagccuauua

SEQ ID NO: 420383 - RNA, 19 nt, Homo sapiens
gucaggagaucgagaccau

SEQ ID NO: 420384 - RNA, 19 nt, Homo sapiens
ccuguaaucccagcacuuu

SEQ ID NO: 420385 - RNA, 19 nt, Homo sapiens
cucagacucucuaaugaug

SEQ ID NO: 420386 - RNA, 19 nt, Homo sapiens
ucacuacacgggugcagaa

SEQ ID NO: 420387 - RNA, 19 nt, Homo sapiens
cagcuuggguuugauuucu

SEQ ID NO: 420388 - RNA, 19 nt, Homo sapiens
gagcgguaccggaccauca

SEQ ID NO: 420389 - RNA, 19 nt, Homo sapiens
ugcagaaucacuuuacaaa

SEQ ID NO: 420390 - RNA, 19 nt, Homo sapiens
ggugcagaaucacuuuaca

SEQ ID NO: 420391 - RNA, 19 nt, Homo sapiens
gauacucagcacuagacua

SEQ ID NO: 420392 - RNA, 19 nt, Homo sapiens
cugcagauggucccaguaa

SEQ ID NO: 420393 - RNA, 19 nt, Homo sapiens
augcugggcuccuccaaga

SEQ ID NO: 420394 - RNA, 19 nt, Homo sapiens
uggguuugauuucuuugaa

SEQ ID NO: 420395 - RNA, 19 nt, Homo sapiens
caucacaacagccuauuac

SEQ ID NO: 420396 - RNA, 19 nt, Homo sapiens
gaccaucacaacagccuau

SEQ ID NO: 420397 - RNA, 19 nt, Homo sapiens
gugcagaaucacuuuacaa

SEQ ID NO: 420398 - RNA, 19 nt, Homo sapiens
agugugacauggaggaaga

SEQ ID NO: 420399 - RNA, 19 nt, Homo sapiens
gacaaugcacaaguuauuc

SEQ ID NO: 420400 - RNA, 19 nt, Homo sapiens
gagaguuccuccauuuacc

SEQ ID NO: 420401 - RNA, 19 nt, Homo sapiens
cagauggucccaguaauag

SEQ ID NO: 420402 - RNA, 19 nt, Homo sapiens
gaguugcugcuauucuuug

SEQ ID NO: 420403 - RNA, 19 nt, Homo sapiens
ggaggaagagaggguuguu

SEQ ID NO: 420404 - RNA, 19 nt, Homo sapiens
ucagaaacacacuuaagag

SEQ ID NO: 420405 - RNA, 19 nt, Homo sapiens
ggcuuucucucacuacaag

SEQ ID NO: 420406 - RNA, 19 nt, Homo sapiens
cuacagggacuuagagaac

SEQ ID NO: 420407 - RNA, 19 nt, Homo sapiens
gcagaaucacuuuacaaaa

SEQ ID NO: 420408 - RNA, 19 nt, Homo sapiens
cagcccacucucccuguua

SEQ ID NO: 420409 - RNA, 19 nt, Homo sapiens
cuucaaugcuguccaagac

SEQ ID NO: 420410 - RNA, 19 nt, Homo sapiens
guccuucaaugcuguccaa

SEQ ID NO: 420411 - RNA, 19 nt, Homo sapiens
gcuaugcugaugacacguu

SEQ ID NO: 420412 - RNA, 19 nt, Homo sapiens
ugguaaaacuggagucaaa

SEQ ID NO: 420413 - RNA, 19 nt, Homo sapiens
cugggacaaugcacaaguu

SEQ ID NO: 420414 - RNA, 19 nt, Homo sapiens
gagaccauccuggcuaaca

SEQ ID NO: 420415 - RNA, 19 nt, Homo sapiens
agaagacucuguuuuacga

SEQ ID NO: 420416 - RNA, 19 nt, Homo sapiens
cagcacuagacuaacauaa

SEQ ID NO: 420417 - RNA, 19 nt, Homo sapiens
ugaguugcugcuauucuuu

SEQ ID NO: 420418 - RNA, 19 nt, Homo sapiens
aaaggagaacaucagugua

SEQ ID NO: 420419 - RNA, 19 nt, Homo sapiens
gcuaauccuguuaaagaca

SEQ ID NO: 420420 - RNA, 19 nt, Homo sapiens
ggagaacaucaguguaagg

SEQ ID NO: 420421 - RNA, 19 nt, Homo sapiens
gagucaaagaugccucuga

SEQ ID NO: 420422 - RNA, 19 nt, Homo sapiens
gggacaaugcacaaguuau

SEQ ID NO: 420423 - RNA, 19 nt, Homo sapiens
aagacaacuucucaaagca

SEQ ID NO: 420424 - RNA, 19 nt, Homo sapiens
ggguuugauuucuuugaag

SEQ ID NO: 420425 - RNA, 19 nt, Homo sapiens
gcagcuuggguuugauuuc

SEQ ID NO: 420426 - RNA, 19 nt, Homo sapiens
ugggacaaugcacaaguua

SEQ ID NO: 420427 - RNA, 19 nt, Homo sapiens
gaccuacuccugggacaau

SEQ ID NO: 420428 - RNA, 19 nt, Homo sapiens
guaacgcgaucucuauuua

SEQ ID NO: 420429 - RNA, 19 nt, Homo sapiens
gcaaggagguggacacaau

SEQ ID NO: 420430 - RNA, 19 nt, Homo sapiens
acaacacgcucaccauuga

SEQ ID NO: 420431 - RNA, 19 nt, Homo sapiens
ggacaacacgcucaccauu

SEQ ID NO: 420432 - RNA, 19 nt, Homo sapiens
ccaaagccuuguuaagaug

SEQ ID NO: 420433 - RNA, 19 nt, Homo sapiens
gaauguaacgcgaucucua

SEQ ID NO: 420434 - RNA, 19 nt, Homo sapiens
cagaauggauggacagaca

SEQ ID NO: 420435 - RNA, 19 nt, Homo sapiens
uaaaggacgaggaauguga

SEQ ID NO: 420436 - RNA, 19 nt, Homo sapiens
gaagcaggcggcaucagaa

SEQ ID NO: 420437 - RNA, 19 nt, Homo sapiens
gagagaagggcuccgaguu

SEQ ID NO: 420438 - RNA, 19 nt, Homo sapiens
cccaaagccuuguuaagau

SEQ ID NO: 420439 - RNA, 19 nt, Homo sapiens
gaagcuaaaggacgaggaa

SEQ ID NO: 420440 - RNA, 19 nt, Homo sapiens
ggacgcagagcccauguuc

SEQ ID NO: 420441 - RNA, 19 nt, Homo sapiens
gacaacacgcucaccauug

SEQ ID NO: 420442 - RNA, 19 nt, Homo sapiens
gaacacagacagggcuuca

SEQ ID NO: 420443 - RNA, 19 nt, Homo sapiens
ucugggagaucaugagguu

SEQ ID NO: 420444 - RNA, 19 nt, Homo sapiens
uaacgcgaucucuauuuaa

SEQ ID NO: 420445 - RNA, 19 nt, Homo sapiens
ccauggagauccgagagaa

SEQ ID NO: 420446 - RNA, 19 nt, Homo sapiens
caaaagccauuacuacauc

SEQ ID NO: 420447 - RNA, 19 nt, Homo sapiens
gcuaaaggacgaggaaugu

SEQ ID NO: 420448 - RNA, 19 nt, Homo sapiens
ccagggagcucggauccau

SEQ ID NO: 420449 - RNA, 19 nt, Homo sapiens
agacagggcuucagaucac

SEQ ID NO: 420450 - RNA, 19 nt, Homo sapiens
gcacagaauugccccaaag

SEQ ID NO: 420451 - RNA, 19 nt, Homo sapiens
ggcaggcuuuguugguaaa

SEQ ID NO: 420452 - RNA, 19 nt, Homo sapiens
gaaggaggagcugcacaga

SEQ ID NO: 420453 - RNA, 19 nt, Homo sapiens
gaggugacagccuugaaga

SEQ ID NO: 420454 - RNA, 19 nt, Homo sapiens
ugaagcaggcggcaucaga

SEQ ID NO: 420455 - RNA, 19 nt, Homo sapiens
gugagcggcuguccaaggu

SEQ ID NO: 420456 - RNA, 19 nt, Homo sapiens
guccggauuuccuucuuug

SEQ ID NO: 420457 - RNA, 19 nt, Homo sapiens
gagaagccaacaugaagca

SEQ ID NO: 420458 - RNA, 19 nt, Homo sapiens
aggcaggcuuuguugguaa

SEQ ID NO: 420459 - RNA, 19 nt, Homo sapiens
aaggcaggcuuuguuggua

SEQ ID NO: 420460 - RNA, 19 nt, Homo sapiens
cguccggauuuccuucuuu

SEQ ID NO: 420461 - RNA, 19 nt, Homo sapiens
acacagacagggcuucaga

SEQ ID NO: 420462 - RNA, 19 nt, Homo sapiens
caaagccuuguuaagauga

SEQ ID NO: 420463 - RNA, 19 nt, Homo sapiens
uggcuugucuucagaaagg

SEQ ID NO: 420464 - RNA, 19 nt, Homo sapiens
gccugcaggugccuuguug

SEQ ID NO: 420465 - RNA, 19 nt, Homo sapiens
gcaacuucuucaccuacau

SEQ ID NO: 420466 - RNA, 19 nt, Homo sapiens
uggccgagguugacuguag

SEQ ID NO: 420467 - RNA, 19 nt, Homo sapiens
gguggacacaauccuguuu

SEQ ID NO: 420468 - RNA, 19 nt, Homo sapiens
aacgcgaucucuauuuaau

SEQ ID NO: 420469 - RNA, 19 nt, Homo sapiens
cggauuuccuucuuuggau

SEQ ID NO: 420470 - RNA, 19 nt, Homo sapiens
gagcgcagaaggagcugaa

SEQ ID NO: 420471 - RNA, 19 nt, Homo sapiens
gcuggcuugucuucagaaa

SEQ ID NO: 420472 - RNA, 19 nt, Homo sapiens
uagaacaggagcuggaaga

SEQ ID NO: 420473 - RNA, 19 nt, Homo sapiens
ugaagacacuggucaucac

SEQ ID NO: 420474 - RNA, 19 nt, Homo sapiens
ugacagccuugaagacacu

SEQ ID NO: 420475 - RNA, 19 nt, Homo sapiens
ggugacagccuugaagaca

SEQ ID NO: 420476 - RNA, 19 nt, Homo sapiens
gggccuccauagcacagaa

SEQ ID NO: 420477 - RNA, 19 nt, Homo sapiens
ccucaccacguccggauuu

SEQ ID NO: 420478 - RNA, 19 nt, Homo sapiens
gccauccugugccuuguuc

SEQ ID NO: 420479 - RNA, 19 nt, Homo sapiens
cagaaaagcagcugaagga

SEQ ID NO: 420480 - RNA, 19 nt, Homo sapiens
agagaagggcuccgaguuc

SEQ ID NO: 420481 - RNA, 19 nt, Homo sapiens
uguaacgcgaucucuauuu

SEQ ID NO: 420482 - RNA, 19 nt, Homo sapiens
gcaaacacccaccccagaa

SEQ ID NO: 420483 - RNA, 19 nt, Homo sapiens
uagcagcaccaacacaugu

SEQ ID NO: 420484 - RNA, 19 nt, Homo sapiens
aauguaacgcgaucucuau

SEQ ID NO: 420485 - RNA, 19 nt, Homo sapiens
ucacaagaugguucgagaa

SEQ ID NO: 420486 - RNA, 19 nt, Homo sapiens
gcagugugcaacuucuuca

SEQ ID NO: 420487 - RNA, 19 nt, Homo sapiens
uacuacaucucgccaucuu

SEQ ID NO: 420488 - RNA, 19 nt, Homo sapiens
gaagguggccgagguugac

SEQ ID NO: 420489 - RNA, 19 nt, Homo sapiens
ggagcucucggugcuggua

SEQ ID NO: 420490 - RNA, 19 nt, Homo sapiens
uucuuuggauggaauguaa

SEQ ID NO: 420491 - RNA, 19 nt, Homo sapiens
cagaacaagccgacacaca

SEQ ID NO: 420492 - RNA, 19 nt, Homo sapiens
ucaccuacauccgcuacau

SEQ ID NO: 420493 - RNA, 19 nt, Homo sapiens
gacuguagcagcaccaaca

SEQ ID NO: 420494 - RNA, 19 nt, Homo sapiens
gcagaggugacagccuuga

SEQ ID NO: 420495 - RNA, 19 nt, Homo sapiens
ugacggccagccuguuuga

SEQ ID NO: 420496 - RNA, 19 nt, Homo sapiens
uggcagggccuccauagca

SEQ ID NO: 420497 - RNA, 19 nt, Homo sapiens
uggccucccuauuggacua

SEQ ID NO: 420498 - RNA, 19 nt, Homo sapiens
gccaccaccaggaggauuu

SEQ ID NO: 420499 - RNA, 19 nt, Homo sapiens
guucgagaagccaacauga

SEQ ID NO: 420500 - RNA, 19 nt, Homo sapiens
cagacagggcuucagauca

SEQ ID NO: 420501 - RNA, 19 nt, Homo sapiens
ucgagaagccaacaugaag

SEQ ID NO: 420502 - RNA, 19 nt, Homo sapiens
caacuucuucaccuacauc

SEQ ID NO: 420503 - RNA, 19 nt, Homo sapiens
ugaagguggccgagguuga

SEQ ID NO: 420504 - RNA, 19 nt, Homo sapiens
ggacacaauccuguuugca

SEQ ID NO: 420505 - RNA, 19 nt, Homo sapiens
ugugcaacuucuucaccua

SEQ ID NO: 420506 - RNA, 19 nt, Homo sapiens
ucaccgcagugugcaacuu

SEQ ID NO: 420507 - RNA, 19 nt, Homo sapiens
gcuagaacaggagcuggaa

SEQ ID NO: 420508 - RNA, 19 nt, Homo sapiens
guagcagcaccaacacaug

SEQ ID NO: 420509 - RNA, 19 nt, Homo sapiens
cauggaaucugauguauga

SEQ ID NO: 420510 - RNA, 19 nt, Homo sapiens
caguagacauucacuaaua

SEQ ID NO: 420511 - RNA, 19 nt, Homo sapiens
gaaagaaugggcucaggua

SEQ ID NO: 420512 - RNA, 19 nt, Homo sapiens
ggaaucugauguaugauau

SEQ ID NO: 420513 - RNA, 19 nt, Homo sapiens
ggacaacaccguuagaugu

SEQ ID NO: 420514 - RNA, 19 nt, Homo sapiens
ggaugcagaucgugaaguu

SEQ ID NO: 420515 - RNA, 19 nt, Homo sapiens
caaagacucuggcauugau

SEQ ID NO: 420516 - RNA, 19 nt, Homo sapiens
gcacagcaaaucauauaaa

SEQ ID NO: 420517 - RNA, 19 nt, Homo sapiens
uggaguaccugcucuguuu

SEQ ID NO: 420518 - RNA, 19 nt, Homo sapiens
uaacuccguuuacuacauu

SEQ ID NO: 420519 - RNA, 19 nt, Homo sapiens
caaauacaauagaccaugu

SEQ ID NO: 420520 - RNA, 19 nt, Homo sapiens
ggaaguauaucuggaguac

SEQ ID NO: 420521 - RNA, 19 nt, Homo sapiens
ggauacagcaggacaagaa

SEQ ID NO: 420522 - RNA, 19 nt, Homo sapiens
uaaggaaaccuacuaaauc

SEQ ID NO: 420523 - RNA, 19 nt, Homo sapiens
guuaacagaugcccgaaug

SEQ ID NO: 420524 - RNA, 19 nt, Homo sapiens
uuagaagccuccagauuug

SEQ ID NO: 420525 - RNA, 19 nt, Homo sapiens
gagacuagcacuaaggauu

SEQ ID NO: 420526 - RNA, 19 nt, Homo sapiens
gcucauccacuuccaguuu

SEQ ID NO: 420527 - RNA, 19 nt, Homo sapiens
uaaauggacaacaccguua

SEQ ID NO: 420528 - RNA, 19 nt, Homo sapiens
ggaaacaagugcgcucaca

SEQ ID NO: 420529 - RNA, 19 nt, Homo sapiens
cuuagaagccuccagauuu

SEQ ID NO: 420530 - RNA, 19 nt, Homo sapiens
uaaauggacaccacucaaa

SEQ ID NO: 420531 - RNA, 19 nt, Homo sapiens
ucaaagaugacucaaauca

SEQ ID NO: 420532 - RNA, 19 nt, Homo sapiens
guuggaaccugaagaaucu

SEQ ID NO: 420533 - RNA, 19 nt, Homo sapiens
gauaucaccagccgagaaa

SEQ ID NO: 420534 - RNA, 19 nt, Homo sapiens
caugcuauauguacuguau

SEQ ID NO: 420535 - RNA, 19 nt, Homo sapiens
gggcucuccucgucuauga

SEQ ID NO: 420536 - RNA, 19 nt, Homo sapiens
gauccacacuugaaauacu

SEQ ID NO: 420537 - RNA, 19 nt, Homo sapiens
gaccugauauucaaagacu

SEQ ID NO: 420538 - RNA, 19 nt, Homo sapiens
cagcauggaaucugaugua

SEQ ID NO: 420539 - RNA, 19 nt, Homo sapiens
cgaauuaaauggacaacac

SEQ ID NO: 420540 - RNA, 19 nt, Homo sapiens
cguuagauguguauguaaa

SEQ ID NO: 420541 - RNA, 19 nt, Homo sapiens
caauaggaguggaauuugg

SEQ ID NO: 420542 - RNA, 19 nt, Homo sapiens
cucagcaguugaucaaaua

SEQ ID NO: 420543 - RNA, 19 nt, Homo sapiens
gacauucacuaauauacca

SEQ ID NO: 420544 - RNA, 19 nt, Homo sapiens
gaucauccuuuguggaaac

SEQ ID NO: 420545 - RNA, 19 nt, Homo sapiens
gcugugagacuagcacuaa

SEQ ID NO: 420546 - RNA, 19 nt, Homo sapiens
ggucaguucaggaaguaua

SEQ ID NO: 420547 - RNA, 19 nt, Homo sapiens
ggaguggaauuugguucaa

SEQ ID NO: 420548 - RNA, 19 nt, Homo sapiens
gugauccacacuugaaaua

SEQ ID NO: 420549 - RNA, 19 nt, Homo sapiens
cagcaaaucauauaaaucg

SEQ ID NO: 420550 - RNA, 19 nt, Homo sapiens
gcucuccucgucuaugaua

SEQ ID NO: 420551 - RNA, 19 nt, Homo sapiens
uggcacagcaaaucauaua

SEQ ID NO: 420552 - RNA, 19 nt, Homo sapiens
ccugaagaaucugaaguuu

SEQ ID NO: 420553 - RNA, 19 nt, Homo sapiens
gcucaggagugugguuguu

SEQ ID NO: 420554 - RNA, 19 nt, Homo sapiens
uugcuuacuucaucaguuu

SEQ ID NO: 420555 - RNA, 19 nt, Homo sapiens
ccuacuaaauccaguuaau

SEQ ID NO: 420556 - RNA, 19 nt, Homo sapiens
uacaauaggaguggaauuu

SEQ ID NO: 420557 - RNA, 19 nt, Homo sapiens
ucucagcaguugaucaaau

SEQ ID NO: 420558 - RNA, 19 nt, Homo sapiens
caggucaguucaggaagua

SEQ ID NO: 420559 - RNA, 19 nt, Homo sapiens
caaaguggcacagcaaauc

SEQ ID NO: 420560 - RNA, 19 nt, Homo sapiens
cggagaugcugccuugaga

SEQ ID NO: 420561 - RNA, 19 nt, Homo sapiens
caucauguugguuauauug

SEQ ID NO: 420562 - RNA, 19 nt, Homo sapiens
ggaccuggaugcagaucgu

SEQ ID NO: 420563 - RNA, 19 nt, Homo sapiens
auacuucucucagcaguug

SEQ ID NO: 420564 - RNA, 19 nt, Homo sapiens
caaaccuacugggcuacua

SEQ ID NO: 420565 - RNA, 19 nt, Homo sapiens
gaucaguagacauucacua

SEQ ID NO: 420566 - RNA, 19 nt, Homo sapiens
cuagaucaguagacauuca

SEQ ID NO: 420567 - RNA, 19 nt, Homo sapiens
gggcucagguauucaguac

SEQ ID NO: 420568 - RNA, 19 nt, Homo sapiens
acuaauugguuaacagaug

SEQ ID NO: 420569 - RNA, 19 nt, Homo sapiens
uacaaugcgcuuacuaauu

SEQ ID NO: 420570 - RNA, 19 nt, Homo sapiens
cuacugggcuacuaauacu

SEQ ID NO: 420571 - RNA, 19 nt, Homo sapiens
gugaucauccuuuguggaa

SEQ ID NO: 420572 - RNA, 19 nt, Homo sapiens
gccagaacauugugaucau

SEQ ID NO: 420573 - RNA, 19 nt, Homo sapiens
guucuugguuauuggaaau

SEQ ID NO: 420574 - RNA, 19 nt, Homo sapiens
uccgugaacuuuauacugu

SEQ ID NO: 420575 - RNA, 19 nt, Homo sapiens
uggaaucugauguaugaua

SEQ ID NO: 420576 - RNA, 19 nt, Homo sapiens
uccuuucacuuucgguuua

SEQ ID NO: 420577 - RNA, 19 nt, Homo sapiens
gaacauugugaucauccuu

SEQ ID NO: 420578 - RNA, 19 nt, Homo sapiens
guccagcucuguugauuuu

SEQ ID NO: 420579 - RNA, 19 nt, Homo sapiens
gacaacaccguuagaugug

SEQ ID NO: 420580 - RNA, 19 nt, Homo sapiens
ggugguaaauauguaaagu

SEQ ID NO: 420581 - RNA, 19 nt, Homo sapiens
cuccagauuugcucaagaa

SEQ ID NO: 420582 - RNA, 19 nt, Homo sapiens
ccuacaaugcgcuuacuaa

SEQ ID NO: 420583 - RNA, 19 nt, Homo sapiens
ugcaggaacuggcaaaucu

SEQ ID NO: 420584 - RNA, 19 nt, Homo sapiens
ccaggucaguucaggaagu

SEQ ID NO: 420585 - RNA, 19 nt, Homo sapiens
uuacaaauaugggauacag

SEQ ID NO: 420586 - RNA, 19 nt, Homo sapiens
ccaguguguuuucuuauuu

SEQ ID NO: 420587 - RNA, 19 nt, Homo sapiens
auugauagccaguguguuu

SEQ ID NO: 420588 - RNA, 19 nt, Homo sapiens
gcauugauagccagugugu

SEQ ID NO: 420589 - RNA, 19 nt, Homo sapiens
aaaucuugcuuacuucauc

SEQ ID NO: 420590 - RNA, 19 nt, Homo sapiens
aagaaugggcucagguauu

SEQ ID NO: 420591 - RNA, 19 nt, Homo sapiens
aaaccuacugggcuacuaa

SEQ ID NO: 420592 - RNA, 19 nt, Homo sapiens
cuagcgagccagaacauug

SEQ ID NO: 420593 - RNA, 19 nt, Homo sapiens
aaggaaaccuacuaaaucc

SEQ ID NO: 420594 - RNA, 19 nt, Homo sapiens
gcauggaaucugauguaug

SEQ ID NO: 420595 - RNA, 19 nt, Homo sapiens
ucaggagugugguuguuag

SEQ ID NO: 420596 - RNA, 19 nt, Homo sapiens
gagaugcugccuugagaca

SEQ ID NO: 420597 - RNA, 19 nt, Homo sapiens
gcaguugaucaaauacaau

SEQ ID NO: 420598 - RNA, 19 nt, Homo sapiens
uuucucaucauguugguua

SEQ ID NO: 420599 - RNA, 19 nt, Homo sapiens
gcaggaacuggcaaaucuu

SEQ ID NO: 420600 - RNA, 19 nt, Homo sapiens
uagccaguguguuuucuua

SEQ ID NO: 420601 - RNA, 19 nt, Homo sapiens
gguauucaguacggagaug

SEQ ID NO: 420602 - RNA, 19 nt, Homo sapiens
ccagaacauugugaucauc

SEQ ID NO: 420603 - RNA, 19 nt, Homo sapiens
gcgcuuacuaauugguuaa

SEQ ID NO: 420604 - RNA, 19 nt, Homo sapiens
cuacaaugcgcuuacuaau

SEQ ID NO: 420605 - RNA, 19 nt, Homo sapiens
uguccgaaaccuacgauuu

SEQ ID NO: 420606 - RNA, 19 nt, Homo sapiens
gguccgugacgagaaguua

SEQ ID NO: 420607 - RNA, 19 nt, Homo sapiens
auucaaagacucuggcauu

SEQ ID NO: 420608 - RNA, 19 nt, Homo sapiens
accguuagauguguaugua

SEQ ID NO: 420609 - RNA, 19 nt, Homo sapiens
gaaggagauucuaaaguua

SEQ ID NO: 420610 - RNA, 19 nt, Homo sapiens
ggauacagcuggucaagaa

SEQ ID NO: 420611 - RNA, 19 nt, Homo sapiens
uaggagaacuuguacauuu

SEQ ID NO: 420612 - RNA, 19 nt, Homo sapiens
gcaagcaaguccuaacauu

SEQ ID NO: 420613 - RNA, 19 nt, Homo sapiens
ggaagaguauuaaugguau

SEQ ID NO: 420614 - RNA, 19 nt, Homo sapiens
uaaauaggguacugcauug

SEQ ID NO: 420615 - RNA, 19 nt, Homo sapiens
guaaauaggguacugcauu

SEQ ID NO: 420616 - RNA, 19 nt, Homo sapiens
ucaaacaugugaguucuuu

SEQ ID NO: 420617 - RNA, 19 nt, Homo sapiens
gccaaauacuggaaauaaa

SEQ ID NO: 420618 - RNA, 19 nt, Homo sapiens
ccugguaccuguauuuaaa

SEQ ID NO: 420619 - RNA, 19 nt, Homo sapiens
uaugaaagcuaccaugugu

SEQ ID NO: 420620 - RNA, 19 nt, Homo sapiens
ggaauaauuucucaucacu

SEQ ID NO: 420621 - RNA, 19 nt, Homo sapiens
gucaaugcacuaacaauua

SEQ ID NO: 420622 - RNA, 19 nt, Homo sapiens
gggaagaguauuaauggua

SEQ ID NO: 420623 - RNA, 19 nt, Homo sapiens
caaacuguaugucuugaug

SEQ ID NO: 420624 - RNA, 19 nt, Homo sapiens
guucaccaguguuuaguuu

SEQ ID NO: 420625 - RNA, 19 nt, Homo sapiens
ggucaguguuccuuucaaa

SEQ ID NO: 420626 - RNA, 19 nt, Homo sapiens
aggagaacuuguacauuua

SEQ ID NO: 420627 - RNA, 19 nt, Homo sapiens
caugugaguucuuuaacaa

SEQ ID NO: 420628 - RNA, 19 nt, Homo sapiens
ggaagaggaguagaccuua

SEQ ID NO: 420629 - RNA, 19 nt, Homo sapiens
gcauuuaaccagcccagua

SEQ ID NO: 420630 - RNA, 19 nt, Homo sapiens
aggaaucaguguuguagua

SEQ ID NO: 420631 - RNA, 19 nt, Homo sapiens
gcacaagcagccauaguug

SEQ ID NO: 420632 - RNA, 19 nt, Homo sapiens
gcagaugacaauaguuuau

SEQ ID NO: 420633 - RNA, 19 nt, Homo sapiens
cuccauaucuguauuacuu

SEQ ID NO: 420634 - RNA, 19 nt, Homo sapiens
ggacacuuguuucauugga

SEQ ID NO: 420635 - RNA, 19 nt, Homo sapiens
ggccaaauacuggaaauaa

SEQ ID NO: 420636 - RNA, 19 nt, Homo sapiens
gcuagaaccauaauaaaca

SEQ ID NO: 420637 - RNA, 19 nt, Homo sapiens
agaacuauguggacacuug

SEQ ID NO: 420638 - RNA, 19 nt, Homo sapiens
cuaggaauauagacaaaug

SEQ ID NO: 420639 - RNA, 19 nt, Homo sapiens
gaagaggaguagaccuuac

SEQ ID NO: 420640 - RNA, 19 nt, Homo sapiens
ucucaucacuaggaauaua

SEQ ID NO: 420641 - RNA, 19 nt, Homo sapiens
gcacaguccuaugcagaug

SEQ ID NO: 420642 - RNA, 19 nt, Homo sapiens
caauguacccguaauuugu

SEQ ID NO: 420643 - RNA, 19 nt, Homo sapiens
gacauaauauagucaaugc

SEQ ID NO: 420644 - RNA, 19 nt, Homo sapiens
ggaaucaguguuguaguaa

SEQ ID NO: 420645 - RNA, 19 nt, Homo sapiens
gcuaaaacaucaaugaaug

SEQ ID NO: 420646 - RNA, 19 nt, Homo sapiens
gaucuucagcuguacugua

SEQ ID NO: 420647 - RNA, 19 nt, Homo sapiens
ugaagagucugaaauuagg

SEQ ID NO: 420648 - RNA, 19 nt, Homo sapiens
aaacaaggccgaccuagca

SEQ ID NO: 420649 - RNA, 19 nt, Homo sapiens
acacuacaguaaaguuuga

SEQ ID NO: 420650 - RNA, 19 nt, Homo sapiens
gccaaagaaugaaccacaa

SEQ ID NO: 420651 - RNA, 19 nt, Homo sapiens
gcaaccccaucuuguuuua

SEQ ID NO: 420652 - RNA, 19 nt, Homo sapiens
gccauaguauucaggcaaa

SEQ ID NO: 420653 - RNA, 19 nt, Homo sapiens
caagcaaguccuaacauug

SEQ ID NO: 420654 - RNA, 19 nt, Homo sapiens
aagcagccauaguuguaua

SEQ ID NO: 420655 - RNA, 19 nt, Homo sapiens
gugcucagguuggaauaaa

SEQ ID NO: 420656 - RNA, 19 nt, Homo sapiens
ggagaacuuguacauuuau

SEQ ID NO: 420657 - RNA, 19 nt, Homo sapiens
gcaccuuaauggucagugu

SEQ ID NO: 420658 - RNA, 19 nt, Homo sapiens
uguggacacuuguuucauu

SEQ ID NO: 420659 - RNA, 19 nt, Homo sapiens
aggccgaccuagcaaauaa

SEQ ID NO: 420660 - RNA, 19 nt, Homo sapiens
gagaacuuguacauuuaug

SEQ ID NO: 420661 - RNA, 19 nt, Homo sapiens
uaaacaauguacccguaau

SEQ ID NO: 420662 - RNA, 19 nt, Homo sapiens
uaaaagagcaguagauuuc

SEQ ID NO: 420663 - RNA, 19 nt, Homo sapiens
gaacuucagaggcaagcaa

SEQ ID NO: 420664 - RNA, 19 nt, Homo sapiens
gaaaacgguucaccagugu

SEQ ID NO: 420665 - RNA, 19 nt, Homo sapiens
cccguaauuuguaacauaa

SEQ ID NO: 420666 - RNA, 19 nt, Homo sapiens
ccacacaaccaaccaggaa

SEQ ID NO: 420667 - RNA, 19 nt, Homo sapiens
gcaaguccuaacauuguaa

SEQ ID NO: 420668 - RNA, 19 nt, Homo sapiens
gaagaguauuaaugguauc

SEQ ID NO: 420669 - RNA, 19 nt, Homo sapiens
acaguuaaccagcccauuu

SEQ ID NO: 420670 - RNA, 19 nt, Homo sapiens
guggacacuuguuucauug

SEQ ID NO: 420671 - RNA, 19 nt, Homo sapiens
gcaugggucccucucacua

SEQ ID NO: 420672 - RNA, 19 nt, Homo sapiens
gagucaaguuucuaauaca

SEQ ID NO: 420673 - RNA, 19 nt, Homo sapiens
agaguccgcuguuggcaaa

SEQ ID NO: 420674 - RNA, 19 nt, Homo sapiens
acccguaauuuguaacaua

SEQ ID NO: 420675 - RNA, 19 nt, Homo sapiens
uaaaccaggugucugugau

SEQ ID NO: 420676 - RNA, 19 nt, Homo sapiens
ucaccaguguuuaguuuua

SEQ ID NO: 420677 - RNA, 19 nt, Homo sapiens
cauugaagagucugaaauu

SEQ ID NO: 420678 - RNA, 19 nt, Homo sapiens
ccaaagaaugaaccacaaa

SEQ ID NO: 420679 - RNA, 19 nt, Homo sapiens
ugaaagcuaccauguguca

SEQ ID NO: 420680 - RNA, 19 nt, Homo sapiens
aaacaauguacccguaauu

SEQ ID NO: 420681 - RNA, 19 nt, Homo sapiens
agagucaaguuucuaauac

SEQ ID NO: 420682 - RNA, 19 nt, Homo sapiens
ugacacuacaguaaaguuu

SEQ ID NO: 420683 - RNA, 19 nt, Homo sapiens
gaacuaauaaaugcaccuu

SEQ ID NO: 420684 - RNA, 19 nt, Homo sapiens
uaauagcuuuaucgggaaa

SEQ ID NO: 420685 - RNA, 19 nt, Homo sapiens
aaaggccaauuucaugaau

SEQ ID NO: 420686 - RNA, 19 nt, Homo sapiens
aaucaccgcuggccauuac

SEQ ID NO: 420687 - RNA, 19 nt, Homo sapiens
aaauaaaccaggugucugu

SEQ ID NO: 420688 - RNA, 19 nt, Homo sapiens
gggaauaauuucucaucac

SEQ ID NO: 420689 - RNA, 19 nt, Homo sapiens
caaccaaccaggaaucagu

SEQ ID NO: 420690 - RNA, 19 nt, Homo sapiens
agacccaacgggccaaaua

SEQ ID NO: 420691 - RNA, 19 nt, Homo sapiens
gcuaggagaacuuguacau

SEQ ID NO: 420692 - RNA, 19 nt, Homo sapiens
gcauuguagucuccauauc

SEQ ID NO: 420693 - RNA, 19 nt, Homo sapiens
aauucgaucuucagcugua

SEQ ID NO: 420694 - RNA, 19 nt, Homo sapiens
gacacuuguuucauuggaa

SEQ ID NO: 420695 - RNA, 19 nt, Homo sapiens
acaauguacccguaauuug

SEQ ID NO: 420696 - RNA, 19 nt, Homo sapiens
aagcaaguccuaacauugu

SEQ ID NO: 420697 - RNA, 19 nt, Homo sapiens
ggacugcuaggagaacuug

SEQ ID NO: 420698 - RNA, 19 nt, Homo sapiens
uaccaugugucagagauga

SEQ ID NO: 420699 - RNA, 19 nt, Homo sapiens
ugaugacacuacaguaaag

SEQ ID NO: 420700 - RNA, 19 nt, Homo sapiens
gcuaccaugugucagagau

SEQ ID NO: 420701 - RNA, 19 nt, Homo sapiens
uugcugcggucucagguuu

SEQ ID NO: 420702 - RNA, 19 nt, Homo sapiens
cuucagcuguacuguaaau

SEQ ID NO: 420703 - RNA, 19 nt, Homo sapiens
uuacacagguuuuguuguu

SEQ ID NO: 420704 - RNA, 19 nt, Homo sapiens
aaccaggugucugugauuu

SEQ ID NO: 420705 - RNA, 19 nt, Homo sapiens
ucacuaggaauauagacaa

SEQ ID NO: 420706 - RNA, 19 nt, Homo sapiens
gaacuauguggacacuugu

SEQ ID NO: 420707 - RNA, 19 nt, Homo sapiens
gaaucaguguuguaguaac

SEQ ID NO: 420708 - RNA, 19 nt, Homo sapiens
cuacagaggagcacaagca

SEQ ID NO: 420709 - RNA, 19 nt, Homo sapiens
gcacaagagcuaagaaaua

SEQ ID NO: 420710 - RNA, 19 nt, Homo sapiens
gaacgugaaugaucucuuc

SEQ ID NO: 420711 - RNA, 19 nt, Homo sapiens
gcuaagaaguugccaaaga

SEQ ID NO: 420712 - RNA, 19 nt, Homo sapiens
ggagcgauaucacagcuua

SEQ ID NO: 420713 - RNA, 19 nt, Homo sapiens
cacaagagcuaagaaauaa

SEQ ID NO: 420714 - RNA, 19 nt, Homo sapiens
caaacuuucuucacuugua

SEQ ID NO: 420715 - RNA, 19 nt, Homo sapiens
guacccauccucugauuua

SEQ ID NO: 420716 - RNA, 19 nt, Homo sapiens
ggcaauagcuaagaaguug

SEQ ID NO: 420717 - RNA, 19 nt, Homo sapiens
acacaacagugaaguuuga

SEQ ID NO: 420718 - RNA, 19 nt, Homo sapiens
gaaggagguuuccaguuca

SEQ ID NO: 420719 - RNA, 19 nt, Homo sapiens
gaacugagaaggagguuuc

SEQ ID NO: 420720 - RNA, 19 nt, Homo sapiens
ggacuuaccuuccaaaaca

SEQ ID NO: 420721 - RNA, 19 nt, Homo sapiens
guauggagcuagcacaaga

SEQ ID NO: 420722 - RNA, 19 nt, Homo sapiens
ggucaacuguggcucugua

SEQ ID NO: 420723 - RNA, 19 nt, Homo sapiens
agaaggagguuuccaguuc

SEQ ID NO: 420724 - RNA, 19 nt, Homo sapiens
gcaaacaaguauggagcua

SEQ ID NO: 420725 - RNA, 19 nt, Homo sapiens
ucacgcagccucuuaggua

SEQ ID NO: 420726 - RNA, 19 nt, Homo sapiens
caagacagcgacuuacgua

SEQ ID NO: 420727 - RNA, 19 nt, Homo sapiens
gguacaagacagcgacuua

SEQ ID NO: 420728 - RNA, 19 nt, Homo sapiens
ucaaagggcaguuccauga

SEQ ID NO: 420729 - RNA, 19 nt, Homo sapiens
gguuggaguuucucauauu

SEQ ID NO: 420730 - RNA, 19 nt, Homo sapiens
acaaacguaugguggagua

SEQ ID NO: 420731 - RNA, 19 nt, Homo sapiens
ggagggacaguuucuggua

SEQ ID NO: 420732 - RNA, 19 nt, Homo sapiens
gaaagucaagccugguauu

SEQ ID NO: 420733 - RNA, 19 nt, Homo sapiens
guuggaguuucucauauuu

SEQ ID NO: 420734 - RNA, 19 nt, Homo sapiens
gagguuuccaguucauuua

SEQ ID NO: 420735 - RNA, 19 nt, Homo sapiens
aagcugcaaucgugguuua

SEQ ID NO: 420736 - RNA, 19 nt, Homo sapiens
aagcugaccuggccaacaa

SEQ ID NO: 420737 - RNA, 19 nt, Homo sapiens
gcucugcuguagucugauu

SEQ ID NO: 420738 - RNA, 19 nt, Homo sapiens
ggagguuuccaguucauuu

SEQ ID NO: 420739 - RNA, 19 nt, Homo sapiens
gauaaucuggccaugacua

SEQ ID NO: 420740 - RNA, 19 nt, Homo sapiens
cuaagaaguugccaaagag

SEQ ID NO: 420741 - RNA, 19 nt, Homo sapiens
agacagcuaugaacgugaa

SEQ ID NO: 420742 - RNA, 19 nt, Homo sapiens
uggaguuucucauauuuga

SEQ ID NO: 420743 - RNA, 19 nt, Homo sapiens
gacagcgacuuacguaucu

SEQ ID NO: 420744 - RNA, 19 nt, Homo sapiens
gaacagucccagcagaaca

SEQ ID NO: 420745 - RNA, 19 nt, Homo sapiens
aaagucaagccugguauua

SEQ ID NO: 420746 - RNA, 19 nt, Homo sapiens
ugacacaacagugaaguuu

SEQ ID NO: 420747 - RNA, 19 nt, Homo sapiens
caaagaauuuucacugguu

SEQ ID NO: 420748 - RNA, 19 nt, Homo sapiens
gcuaugaacgugaaugauc

SEQ ID NO: 420749 - RNA, 19 nt, Homo sapiens
gcagaugacaacagcuuau

SEQ ID NO: 420750 - RNA, 19 nt, Homo sapiens
gcaggagggaguaaggaaa

SEQ ID NO: 420751 - RNA, 19 nt, Homo sapiens
gggaaagucaagccuggua

SEQ ID NO: 420752 - RNA, 19 nt, Homo sapiens
gagaaggagguuuccaguu

SEQ ID NO: 420753 - RNA, 19 nt, Homo sapiens
gagaaucugcagugggaaa

SEQ ID NO: 420754 - RNA, 19 nt, Homo sapiens
gcuagcagcaaacaaguau

SEQ ID NO: 420755 - RNA, 19 nt, Homo sapiens
agacaugggugaaggaacu

SEQ ID NO: 420756 - RNA, 19 nt, Homo sapiens
gcacagcuaggcccaaugg

SEQ ID NO: 420757 - RNA, 19 nt, Homo sapiens
gaagaggcccaggcauaug

SEQ ID NO: 420758 - RNA, 19 nt, Homo sapiens
cagcugggcaggagcgaua

SEQ ID NO: 420759 - RNA, 19 nt, Homo sapiens
uggaggguguuccuaggua

SEQ ID NO: 420760 - RNA, 19 nt, Homo sapiens
ggucagucccuguucuuga

SEQ ID NO: 420761 - RNA, 19 nt, Homo sapiens
gagcaaagacaugggugaa

SEQ ID NO: 420762 - RNA, 19 nt, Homo sapiens
cuagaugacacaacaguga

SEQ ID NO: 420763 - RNA, 19 nt, Homo sapiens
aacaaacuuucuucacuug

SEQ ID NO: 420764 - RNA, 19 nt, Homo sapiens
ccucugauuuauacauaug

SEQ ID NO: 420765 - RNA, 19 nt, Homo sapiens
ccaguucauuuacauuaag

SEQ ID NO: 420766 - RNA, 19 nt, Homo sapiens
uagcuaagaaguugccaaa

SEQ ID NO: 420767 - RNA, 19 nt, Homo sapiens
caacagugaaguuugagau

SEQ ID NO: 420768 - RNA, 19 nt, Homo sapiens
ugaagaggcccaggcauau

SEQ ID NO: 420769 - RNA, 19 nt, Homo sapiens
ggaaagucaagccugguau

SEQ ID NO: 420770 - RNA, 19 nt, Homo sapiens
aagggcaguuccaugagua

SEQ ID NO: 420771 - RNA, 19 nt, Homo sapiens
uggcucugcuguagucuga

SEQ ID NO: 420772 - RNA, 19 nt, Homo sapiens
gagggaguaaggaaacauu

SEQ ID NO: 420773 - RNA, 19 nt, Homo sapiens
ggccaguccuagcaucguu

SEQ ID NO: 420774 - RNA, 19 nt, Homo sapiens
ccaguccguuugucuagau

SEQ ID NO: 420775 - RNA, 19 nt, Homo sapiens
agaaguugccaaagaguga

SEQ ID NO: 420776 - RNA, 19 nt, Homo sapiens
aaagggcaguuccaugagu

SEQ ID NO: 420777 - RNA, 19 nt, Homo sapiens
uuacuaaucaggaaaccuu

SEQ ID NO: 420778 - RNA, 19 nt, Homo sapiens
caagccugguauuacguuu

SEQ ID NO: 420779 - RNA, 19 nt, Homo sapiens
cagcuaugaacgugaauga

SEQ ID NO: 420780 - RNA, 19 nt, Homo sapiens
gaccuggccaacaaacgua

SEQ ID NO: 420781 - RNA, 19 nt, Homo sapiens
cuaugaacgugaaugaucu

SEQ ID NO: 420782 - RNA, 19 nt, Homo sapiens
augaagaggcccaggcaua

SEQ ID NO: 420783 - RNA, 19 nt, Homo sapiens
cgacaggccaguccuagca

SEQ ID NO: 420784 - RNA, 19 nt, Homo sapiens
caacuguggcucuguaacu

SEQ ID NO: 420785 - RNA, 19 nt, Homo sapiens
aacguaugguggaguauga

SEQ ID NO: 420786 - RNA, 19 nt, Homo sapiens
caaagacaugggugaagga

SEQ ID NO: 420787 - RNA, 19 nt, Homo sapiens
cccauccucugauuuauac

SEQ ID NO: 420788 - RNA, 19 nt, Homo sapiens
gcagaacaagagccagugu

SEQ ID NO: 420789 - RNA, 19 nt, Homo sapiens
gggcaggagcgauaucaca

SEQ ID NO: 420790 - RNA, 19 nt, Homo sapiens
gaacccaggaacugagaag

SEQ ID NO: 420791 - RNA, 19 nt, Homo sapiens
agacagcgacuuacguauc

SEQ ID NO: 420792 - RNA, 19 nt, Homo sapiens
gaaguugccaaagagugaa

SEQ ID NO: 420793 - RNA, 19 nt, Homo sapiens
gacacaacagugaaguuug

SEQ ID NO: 420794 - RNA, 19 nt, Homo sapiens
cagugaaguuugagaucug

SEQ ID NO: 420795 - RNA, 19 nt, Homo sapiens
cuaaugguguuuccccuaa

SEQ ID NO: 420796 - RNA, 19 nt, Homo sapiens
cagcgacuuacguaucuuu

SEQ ID NO: 420797 - RNA, 19 nt, Homo sapiens
acagugaaguuugagaucu

SEQ ID NO: 420798 - RNA, 19 nt, Homo sapiens
cagaugacaacagcuuauu

SEQ ID NO: 420799 - RNA, 19 nt, Homo sapiens
aagcacagcuaggcccaau

SEQ ID NO: 420800 - RNA, 19 nt, Homo sapiens
cugauaaucuggccaugac

SEQ ID NO: 420801 - RNA, 19 nt, Homo sapiens
gagcaggagggaguaagga

SEQ ID NO: 420802 - RNA, 19 nt, Homo sapiens
gucagucccuguucuugag

SEQ ID NO: 420803 - RNA, 19 nt, Homo sapiens
ggaguuucucauauuugaa

SEQ ID NO: 420804 - RNA, 19 nt, Homo sapiens
ugguuggaguuucucauau

SEQ ID NO: 420805 - RNA, 19 nt, Homo sapiens
gguuuccaguucauuuaca

SEQ ID NO: 420806 - RNA, 19 nt, Homo sapiens
ggcuagcagcaaacaagua

SEQ ID NO: 420807 - RNA, 19 nt, Homo sapiens
ccaggcauaugcagaugac

SEQ ID NO: 420808 - RNA, 19 nt, Homo sapiens
gcccaggcauaugcagaug

SEQ ID NO: 420809 - RNA, 19 nt, Homo sapiens
gagaaaugcuuacagauaa

SEQ ID NO: 420810 - RNA, 19 nt, Homo sapiens
ccaaagagcugaauguuau

SEQ ID NO: 420811 - RNA, 19 nt, Homo sapiens
gcagauuuaugccuuauuu

SEQ ID NO: 420812 - RNA, 19 nt, Homo sapiens
ggaaaagccugcugaauuu

SEQ ID NO: 420813 - RNA, 19 nt, Homo sapiens
aaacagaucuugcugacaa

SEQ ID NO: 420814 - RNA, 19 nt, Homo sapiens
gcaaacaaauauacuagga

SEQ ID NO: 420815 - RNA, 19 nt, Homo sapiens
ggaauccgcugaggaaauu

SEQ ID NO: 420816 - RNA, 19 nt, Homo sapiens
ucagagagcacuuggauua

SEQ ID NO: 420817 - RNA, 19 nt, Homo sapiens
gaaagaggaagugauguua

SEQ ID NO: 420818 - RNA, 19 nt, Homo sapiens
caaaguggauugaugaugu

SEQ ID NO: 420819 - RNA, 19 nt, Homo sapiens
ggaaaucucaacaguauga

SEQ ID NO: 420820 - RNA, 19 nt, Homo sapiens
gcacuuggauuauggaucu

SEQ ID NO: 420821 - RNA, 19 nt, Homo sapiens
gcaaagcguuggaaagaca

SEQ ID NO: 420822 - RNA, 19 nt, Homo sapiens
aauauuggcuugaaccuuu

SEQ ID NO: 420823 - RNA, 19 nt, Homo sapiens
gagcaaagcguuggaaaga

SEQ ID NO: 420824 - RNA, 19 nt, Homo sapiens
gaaaccucuuuaagcaaua

SEQ ID NO: 420825 - RNA, 19 nt, Homo sapiens
ccauuggaauuauccuuua

SEQ ID NO: 420826 - RNA, 19 nt, Homo sapiens
gaaaggagagaauggaaau

SEQ ID NO: 420827 - RNA, 19 nt, Homo sapiens
gucaagaguuauucuguuu

SEQ ID NO: 420828 - RNA, 19 nt, Homo sapiens
gcaaggcacuguaaaaguu

SEQ ID NO: 420829 - RNA, 19 nt, Homo sapiens
gagcugaauguuauguuua

SEQ ID NO: 420830 - RNA, 19 nt, Homo sapiens
agagaaaugcuuacagaua

SEQ ID NO: 420831 - RNA, 19 nt, Homo sapiens
acaaauggcucuuucacau

SEQ ID NO: 420832 - RNA, 19 nt, Homo sapiens
ccacauaccaguaacuuau

SEQ ID NO: 420833 - RNA, 19 nt, Homo sapiens
gccaaagagcugaauguua

SEQ ID NO: 420834 - RNA, 19 nt, Homo sapiens
gcagaucagguaaagcaua

SEQ ID NO: 420835 - RNA, 19 nt, Homo sapiens
gucuaaagcuuaccaacaa

SEQ ID NO: 420836 - RNA, 19 nt, Homo sapiens
caaaaugaguccuaaagaa

SEQ ID NO: 420837 - RNA, 19 nt, Homo sapiens
aaauuacggucuucuuuga

SEQ ID NO: 420838 - RNA, 19 nt, Homo sapiens
aaacuuugcucaggacauu

SEQ ID NO: 420839 - RNA, 19 nt, Homo sapiens
caagaguuauucuguuugu

SEQ ID NO: 420840 - RNA, 19 nt, Homo sapiens
gaacagaaagaggaaguga

SEQ ID NO: 420841 - RNA, 19 nt, Homo sapiens
gaugaugucagaacagaaa

SEQ ID NO: 420842 - RNA, 19 nt, Homo sapiens
aggcaaggguugacucuuu

SEQ ID NO: 420843 - RNA, 19 nt, Homo sapiens
aagaugggauggaguugua

SEQ ID NO: 420844 - RNA, 19 nt, Homo sapiens
gauuauggaucugaauaga

SEQ ID NO: 420845 - RNA, 19 nt, Homo sapiens
ggaaaggagagaauggaaa

SEQ ID NO: 420846 - RNA, 19 nt, Homo sapiens
gguaaagcauacauaguag

SEQ ID NO: 420847 - RNA, 19 nt, Homo sapiens
gggauggaguuguaaagug

SEQ ID NO: 420848 - RNA, 19 nt, Homo sapiens
gauguuucguugaaucuau

SEQ ID NO: 420849 - RNA, 19 nt, Homo sapiens
auagagaaaugcuuacaga

SEQ ID NO: 420850 - RNA, 19 nt, Homo sapiens
gauggaaaucucaacagua

SEQ ID NO: 420851 - RNA, 19 nt, Homo sapiens
uuauggaucugaauagaga

SEQ ID NO: 420852 - RNA, 19 nt, Homo sapiens
agaaaccucuuuaagcaau

SEQ ID NO: 420853 - RNA, 19 nt, Homo sapiens
ggcauguccugaaauaaau

SEQ ID NO: 420854 - RNA, 19 nt, Homo sapiens
gaaguagaagaacauaaga

SEQ ID NO: 420855 - RNA, 19 nt, Homo sapiens
gguaggcagugcuugaaug

SEQ ID NO: 420856 - RNA, 19 nt, Homo sapiens
cuacaaaguggauugauga

SEQ ID NO: 420857 - RNA, 19 nt, Homo sapiens
gagagcacuuggauuaugg

SEQ ID NO: 420858 - RNA, 19 nt, Homo sapiens
uaaauuacggucuucuuug

SEQ ID NO: 420859 - RNA, 19 nt, Homo sapiens
cuugagcacugauauaaau

SEQ ID NO: 420860 - RNA, 19 nt, Homo sapiens
ggcaaggguugacucuuug

SEQ ID NO: 420861 - RNA, 19 nt, Homo sapiens
cugcugaauuuauguugua

SEQ ID NO: 420862 - RNA, 19 nt, Homo sapiens
aaagaacccucagcagaau

SEQ ID NO: 420863 - RNA, 19 nt, Homo sapiens
gaaccaguggaagaauuua

SEQ ID NO: 420864 - RNA, 19 nt, Homo sapiens
cagaagaaccaguggaaga

SEQ ID NO: 420865 - RNA, 19 nt, Homo sapiens
ucacaugugcuuuauuaga

SEQ ID NO: 420866 - RNA, 19 nt, Homo sapiens
aaauggcucuuucacaugu

SEQ ID NO: 420867 - RNA, 19 nt, Homo sapiens
gauauaaauuacggucuuc

SEQ ID NO: 420868 - RNA, 19 nt, Homo sapiens
auggaaaucucaacaguau

SEQ ID NO: 420869 - RNA, 19 nt, Homo sapiens
cugcuaaucucccauguca

SEQ ID NO: 420870 - RNA, 19 nt, Homo sapiens
agagcugaauguuauguuu

SEQ ID NO: 420871 - RNA, 19 nt, Homo sapiens
gagcuucaccauggcaaua

SEQ ID NO: 420872 - RNA, 19 nt, Homo sapiens
guucacagccuacuuuauc

SEQ ID NO: 420873 - RNA, 19 nt, Homo sapiens
gcuaaucucccaugucauc

SEQ ID NO: 420874 - RNA, 19 nt, Homo sapiens
ggaucugaauagagaaaug

SEQ ID NO: 420875 - RNA, 19 nt, Homo sapiens
aacaagagauggcaaagca

SEQ ID NO: 420876 - RNA, 19 nt, Homo sapiens
guaugaguauggcuugguu

SEQ ID NO: 420877 - RNA, 19 nt, Homo sapiens
gcagcucuuucgacgugua

SEQ ID NO: 420878 - RNA, 19 nt, Homo sapiens
agaggcaagugucaauuga

SEQ ID NO: 420879 - RNA, 19 nt, Homo sapiens
cugcagcuguaguaguuua

SEQ ID NO: 420880 - RNA, 19 nt, Homo sapiens
cugaauagagaaaugcuua

SEQ ID NO: 420881 - RNA, 19 nt, Homo sapiens
gagcacugauauaaauuac

SEQ ID NO: 420882 - RNA, 19 nt, Homo sapiens
uggcaaagcagcaguucua

SEQ ID NO: 420883 - RNA, 19 nt, Homo sapiens
ccaguuacauccgugauuc

SEQ ID NO: 420884 - RNA, 19 nt, Homo sapiens
guagccucauucccaguua

SEQ ID NO: 420885 - RNA, 19 nt, Homo sapiens
uggcauguccugaaauaaa

SEQ ID NO: 420886 - RNA, 19 nt, Homo sapiens
agguaaagcauacauagua

SEQ ID NO: 420887 - RNA, 19 nt, Homo sapiens
aagaaccaguggaagaauu

SEQ ID NO: 420888 - RNA, 19 nt, Homo sapiens
guggauugaugaugucaga

SEQ ID NO: 420889 - RNA, 19 nt, Homo sapiens
gggaacggcccuagcuuug

SEQ ID NO: 420890 - RNA, 19 nt, Homo sapiens
agagagcacuuggauuaug

SEQ ID NO: 420891 - RNA, 19 nt, Homo sapiens
aggcagugcuugaaugaga

SEQ ID NO: 420892 - RNA, 19 nt, Homo sapiens
accaagauguccaaaauua

SEQ ID NO: 420893 - RNA, 19 nt, Homo sapiens
uguaguaguuuacgauauc

SEQ ID NO: 420894 - RNA, 19 nt, Homo sapiens
gaaauucaagcugguguuc

SEQ ID NO: 420895 - RNA, 19 nt, Homo sapiens
cgugagaggucccagauac

SEQ ID NO: 420896 - RNA, 19 nt, Homo sapiens
ugucaagaguuauucuguu

SEQ ID NO: 420897 - RNA, 19 nt, Homo sapiens
caaagcagcaguucuacca

SEQ ID NO: 420898 - RNA, 19 nt, Homo sapiens
cuuuaucucuccuugcuuu

SEQ ID NO: 420899 - RNA, 19 nt, Homo sapiens
aagaggaagugauguuauc

SEQ ID NO: 420900 - RNA, 19 nt, Homo sapiens
gaucaccagauucauguau

SEQ ID NO: 420901 - RNA, 19 nt, Homo sapiens
aggagagaauggaaauaaa

SEQ ID NO: 420902 - RNA, 19 nt, Homo sapiens
gagagaaaauuaaccaagu

SEQ ID NO: 420903 - RNA, 19 nt, Homo sapiens
caacaccuaucaggcaaca

SEQ ID NO: 420904 - RNA, 19 nt, Homo sapiens
gcauguccugaaauaaaua

SEQ ID NO: 420905 - RNA, 19 nt, Homo sapiens
cuccuccacuucccacuua

SEQ ID NO: 420906 - RNA, 19 nt, Homo sapiens
aagcauuacuuaacacagu

SEQ ID NO: 420907 - RNA, 19 nt, Homo sapiens
agauugcuguguaagcuaa

SEQ ID NO: 420908 - RNA, 19 nt, Homo sapiens
ucagauguuucguugaauc

SEQ ID NO: 420909 - RNA, 19 nt, Homo sapiens
gaaguaauccugagaaaug

SEQ ID NO: 420910 - RNA, 19 nt, Homo sapiens
ggagaccuaugacauguuu

SEQ ID NO: 420911 - RNA, 19 nt, Homo sapiens
agagagaacuauauuggua

SEQ ID NO: 420912 - RNA, 19 nt, Homo sapiens
gcgcaaagguggcuacaau

SEQ ID NO: 420913 - RNA, 19 nt, Homo sapiens
gaaggcaucuacacacuca

SEQ ID NO: 420914 - RNA, 19 nt, Homo sapiens
gcagcuaccucaggaauga

SEQ ID NO: 420915 - RNA, 19 nt, Homo sapiens
caccugagcugaccuuuga

SEQ ID NO: 420916 - RNA, 19 nt, Homo sapiens
caagauuccugacaccaaa

SEQ ID NO: 420917 - RNA, 19 nt, Homo sapiens
gcaaagguggcuacaauga

SEQ ID NO: 420918 - RNA, 19 nt, Homo sapiens
gaaacugacccacugaaug

SEQ ID NO: 420919 - RNA, 19 nt, Homo sapiens
ggacagggacacaauccua

SEQ ID NO: 420920 - RNA, 19 nt, Homo sapiens
aaacugacccacugaauga

SEQ ID NO: 420921 - RNA, 19 nt, Homo sapiens
gguaugagccgcugcagaa

SEQ ID NO: 420922 - RNA, 19 nt, Homo sapiens
ccagggagaugucaaacug

SEQ ID NO: 420923 - RNA, 19 nt, Homo sapiens
uggagaagcugauuucaca

SEQ ID NO: 420924 - RNA, 19 nt, Homo sapiens
cagaaguaauccugagaaa

SEQ ID NO: 420925 - RNA, 19 nt, Homo sapiens
ggagaucacagaugaaaca

SEQ ID NO: 420926 - RNA, 19 nt, Homo sapiens
cccaggagaucacagauga

SEQ ID NO: 420927 - RNA, 19 nt, Homo sapiens
ggacacuacugggaaagga

SEQ ID NO: 420928 - RNA, 19 nt, Homo sapiens
ccucggagauccaguuuca

SEQ ID NO: 420929 - RNA, 19 nt, Homo sapiens
gaccaagaauccuaagaag

SEQ ID NO: 420930 - RNA, 19 nt, Homo sapiens
ggaaugaccgcuuguggau

SEQ ID NO: 420931 - RNA, 19 nt, Homo sapiens
ccaagaauccuaagaagag

SEQ ID NO: 420932 - RNA, 19 nt, Homo sapiens
gcacagcaaccucuacauc

SEQ ID NO: 420933 - RNA, 19 nt, Homo sapiens
acugugagcuggagaccua

SEQ ID NO: 420934 - RNA, 19 nt, Homo sapiens
uaagagagaacuauauugg

SEQ ID NO: 420935 - RNA, 19 nt, Homo sapiens
guaauccugagaaauguuu

SEQ ID NO: 420936 - RNA, 19 nt, Homo sapiens
ggaaauccacgcacaucug

SEQ ID NO: 420937 - RNA, 19 nt, Homo sapiens
ggaaacugacccacugaau

SEQ ID NO: 420938 - RNA, 19 nt, Homo sapiens
ugaccaagaauccuaagaa

SEQ ID NO: 420939 - RNA, 19 nt, Homo sapiens
gaagauccacagagacauc

SEQ ID NO: 420940 - RNA, 19 nt, Homo sapiens
gccgaagccuggauaccaa

SEQ ID NO: 420941 - RNA, 19 nt, Homo sapiens
gagcugaccuuugauuucc

SEQ ID NO: 420942 - RNA, 19 nt, Homo sapiens
gaacaacgugcugcuguca

SEQ ID NO: 420943 - RNA, 19 nt, Homo sapiens
gggaagauccacagagaca

SEQ ID NO: 420944 - RNA, 19 nt, Homo sapiens
aaacuggcccugaccaaga

SEQ ID NO: 420945 - RNA, 19 nt, Homo sapiens
gagagaacuauauugguau

SEQ ID NO: 420946 - RNA, 19 nt, Homo sapiens
cgcccaaacugagagauaa

SEQ ID NO: 420947 - RNA, 19 nt, Homo sapiens
gcuuugcucuguccaccaa

SEQ ID NO: 420948 - RNA, 19 nt, Homo sapiens
gagaagcugauuucacauc

SEQ ID NO: 420949 - RNA, 19 nt, Homo sapiens
ucuccaaggucuucaaugg

SEQ ID NO: 420950 - RNA, 19 nt, Homo sapiens
ugaagauagucaagcuaga

SEQ ID NO: 420951 - RNA, 19 nt, Homo sapiens
uaugacauguuuccagaca

SEQ ID NO: 420952 - RNA, 19 nt, Homo sapiens
uggagagcauucccacuga

SEQ ID NO: 420953 - RNA, 19 nt, Homo sapiens
gcaccugagcugaccuuug

SEQ ID NO: 420954 - RNA, 19 nt, Homo sapiens
acacaauccuagucagcuu

SEQ ID NO: 420955 - RNA, 19 nt, Homo sapiens
gcuacaaugagcuauguga

SEQ ID NO: 420956 - RNA, 19 nt, Homo sapiens
ggaccuauggcgacgucua

SEQ ID NO: 420957 - RNA, 19 nt, Homo sapiens
ccagagcaccuacuaagag

SEQ ID NO: 420958 - RNA, 19 nt, Homo sapiens
caggagaucacagaugaaa

SEQ ID NO: 420959 - RNA, 19 nt, Homo sapiens
gaagccuggauaccaauga

SEQ ID NO: 420960 - RNA, 19 nt, Homo sapiens
gaacgcugugugaggauug

SEQ ID NO: 420961 - RNA, 19 nt, Homo sapiens
gcuggagaccuaugacaug

SEQ ID NO: 420962 - RNA, 19 nt, Homo sapiens
ccacauuuccuuucuacuc

SEQ ID NO: 420963 - RNA, 19 nt, Homo sapiens
guuccacauuuccuuucua

SEQ ID NO: 420964 - RNA, 19 nt, Homo sapiens
gaagauagucaagcuagac

SEQ ID NO: 420965 - RNA, 19 nt, Homo sapiens
ccagaauuuccaccacuuu

SEQ ID NO: 420966 - RNA, 19 nt, Homo sapiens
cauuuccuuucuacucuuu

SEQ ID NO: 420967 - RNA, 19 nt, Homo sapiens
aaugaccgcuuguggaucu

SEQ ID NO: 420968 - RNA, 19 nt, Homo sapiens
ccaagauuccugacaccaa

SEQ ID NO: 420969 - RNA, 19 nt, Homo sapiens
ccaccacuuucucaaacug

SEQ ID NO: 420970 - RNA, 19 nt, Homo sapiens
cacauuuccuuucuacucu

SEQ ID NO: 420971 - RNA, 19 nt, Homo sapiens
ugaccucccaggccuguuu

SEQ ID NO: 420972 - RNA, 19 nt, Homo sapiens
caacucccaaggugcauau

SEQ ID NO: 420973 - RNA, 19 nt, Homo sapiens
ccaccagagcaccuacuaa

SEQ ID NO: 420974 - RNA, 19 nt, Homo sapiens
guauuaaagcugguuuguu

SEQ ID NO: 420975 - RNA, 19 nt, Homo sapiens
ggccauccauuccauuuug

SEQ ID NO: 420976 - RNA, 19 nt, Homo sapiens
augagccgcugcagaaguu

SEQ ID NO: 420977 - RNA, 19 nt, Homo sapiens
cgaggaaggcaucuacaca

SEQ ID NO: 420978 - RNA, 19 nt, Homo sapiens
ucggucagccucagaauuc

SEQ ID NO: 420979 - RNA, 19 nt, Homo sapiens
caaagccagugacccucau

SEQ ID NO: 420980 - RNA, 19 nt, Homo sapiens
gcccugaccaagaauccua

SEQ ID NO: 420981 - RNA, 19 nt, Homo sapiens
cagcgucuguggccaagag

SEQ ID NO: 420982 - RNA, 19 nt, Homo sapiens
caccagagcaccuacuaag

SEQ ID NO: 420983 - RNA, 19 nt, Homo sapiens
ggaucugcauggaguucug

SEQ ID NO: 420984 - RNA, 19 nt, Homo sapiens
gaaugagccgugggaggaa

SEQ ID NO: 420985 - RNA, 19 nt, Homo sapiens
ucacagaugaaacaaggau

SEQ ID NO: 420986 - RNA, 19 nt, Homo sapiens
ugagcugaccuuugauuuc

SEQ ID NO: 420987 - RNA, 19 nt, Homo sapiens
ugugaggauugucaacaug

SEQ ID NO: 420988 - RNA, 19 nt, Homo sapiens
gugugaggauugucaacau

SEQ ID NO: 420989 - RNA, 19 nt, Homo sapiens
ugaacgcugugugaggauu

SEQ ID NO: 420990 - RNA, 19 nt, Homo sapiens
caaagguggcuacaaugag

SEQ ID NO: 420991 - RNA, 19 nt, Homo sapiens
gguauuaaagcugguuugu

SEQ ID NO: 420992 - RNA, 19 nt, Homo sapiens
cugcauuuguccugggaaa

SEQ ID NO: 420993 - RNA, 19 nt, Homo sapiens
gaggugacccaggagauca

SEQ ID NO: 420994 - RNA, 19 nt, Homo sapiens
gaauuuccaccacuuucuc

SEQ ID NO: 420995 - RNA, 19 nt, Homo sapiens
gguauuuaagagagaacua

SEQ ID NO: 420996 - RNA, 19 nt, Homo sapiens
acagugugcuggccuucug

SEQ ID NO: 420997 - RNA, 19 nt, Homo sapiens
gaggcuacagcaacagguu

SEQ ID NO: 420998 - RNA, 19 nt, Homo sapiens
uggcuacaaugagcuaugu

SEQ ID NO: 420999 - RNA, 19 nt, Homo sapiens
aggauacgcuggagaagcu

SEQ ID NO: 421000 - RNA, 19 nt, Homo sapiens
ccgcccaaacugagagaua

SEQ ID NO: 421001 - RNA, 19 nt, Homo sapiens
gcgcacagcaaccucuaca

SEQ ID NO: 421002 - RNA, 19 nt, Homo sapiens
gagagcauucccacugaca

SEQ ID NO: 421003 - RNA, 19 nt, Homo sapiens
cccaggcgcuuugcucugu

SEQ ID NO: 421004 - RNA, 19 nt, Homo sapiens
gagcuggagaccuaugaca

SEQ ID NO: 421005 - RNA, 19 nt, Homo sapiens
cccagaauuuccaccacuu

SEQ ID NO: 421006 - RNA, 19 nt, Homo sapiens
gcucuguccaccaagauuc

SEQ ID NO: 421007 - RNA, 19 nt, Homo sapiens
gcuuguggaucugcaugga

SEQ ID NO: 421008 - RNA, 19 nt, Homo sapiens
cuggagaccuaugacaugu

SEQ ID NO: 421009 - RNA, 19 nt, Homo sapiens
ggaagaagaucaaacuaca

SEQ ID NO: 421010 - RNA, 19 nt, Homo sapiens
gcacuacacuagggaauuu

SEQ ID NO: 421011 - RNA, 19 nt, Homo sapiens
ucacauagguagaugguaa

SEQ ID NO: 421012 - RNA, 19 nt, Homo sapiens
gaagggagaggaaugaauu

SEQ ID NO: 421013 - RNA, 19 nt, Homo sapiens
caagagcgguucaagacaa

SEQ ID NO: 421014 - RNA, 19 nt, Homo sapiens
gaggacaacuucaacaaca

SEQ ID NO: 421015 - RNA, 19 nt, Homo sapiens
gaaagaaggcaaggaggua

SEQ ID NO: 421016 - RNA, 19 nt, Homo sapiens
guaaagagaaugaggagaa

SEQ ID NO: 421017 - RNA, 19 nt, Homo sapiens
ggaauuugcuccuguucug

SEQ ID NO: 421018 - RNA, 19 nt, Homo sapiens
gcaaggagguaggaagaga

SEQ ID NO: 421019 - RNA, 19 nt, Homo sapiens
ggaaugaauugaggaagug

SEQ ID NO: 421020 - RNA, 19 nt, Homo sapiens
guacugaccugaaaacuug

SEQ ID NO: 421021 - RNA, 19 nt, Homo sapiens
uaaagagaaugaggagaaa

SEQ ID NO: 421022 - RNA, 19 nt, Homo sapiens
gucauggucuuucuuggua

SEQ ID NO: 421023 - RNA, 19 nt, Homo sapiens
gcaacaagccucccaguac

SEQ ID NO: 421024 - RNA, 19 nt, Homo sapiens
agaaggagcaggccgauaa

SEQ ID NO: 421025 - RNA, 19 nt, Homo sapiens
gaauugaggaagugaaaga

SEQ ID NO: 421026 - RNA, 19 nt, Homo sapiens
ggagcaggccgauaaguug

SEQ ID NO: 421027 - RNA, 19 nt, Homo sapiens
caacaagccucccaguacu

SEQ ID NO: 421028 - RNA, 19 nt, Homo sapiens
guacccggauccucgaauu

SEQ ID NO: 421029 - RNA, 19 nt, Homo sapiens
gaaaggaaggagagagaug

SEQ ID NO: 421030 - RNA, 19 nt, Homo sapiens
agaggaaggugcagaagga

SEQ ID NO: 421031 - RNA, 19 nt, Homo sapiens
caauaacuacugccuacua

SEQ ID NO: 421032 - RNA, 19 nt, Homo sapiens
ucacggaugagaaaucuuu

SEQ ID NO: 421033 - RNA, 19 nt, Homo sapiens
gaagaucaaacuacaaguc

SEQ ID NO: 421034 - RNA, 19 nt, Homo sapiens
gaagaagaucaaacuacaa

SEQ ID NO: 421035 - RNA, 19 nt, Homo sapiens
ggagaagggagaggaauga

SEQ ID NO: 421036 - RNA, 19 nt, Homo sapiens
ggucuuucuugguauuaaa

SEQ ID NO: 421037 - RNA, 19 nt, Homo sapiens
gggcuuggagggucacaua

SEQ ID NO: 421038 - RNA, 19 nt, Homo sapiens
gaagagagggaggaggaaa

SEQ ID NO: 421039 - RNA, 19 nt, Homo sapiens
gagcgguucaagacaauaa

SEQ ID NO: 421040 - RNA, 19 nt, Homo sapiens
gguagaugguaaagagaau

SEQ ID NO: 421041 - RNA, 19 nt, Homo sapiens
gcauuauccuaguauacga

SEQ ID NO: 421042 - RNA, 19 nt, Homo sapiens
acaagaagaacaccaacaa

SEQ ID NO: 421043 - RNA, 19 nt, Homo sapiens
uuucgaaacuagugcuaaa

SEQ ID NO: 421044 - RNA, 19 nt, Homo sapiens
ucgagaauauucagaacug

SEQ ID NO: 421045 - RNA, 19 nt, Homo sapiens
guuacuagaucagguuuua

SEQ ID NO: 421046 - RNA, 19 nt, Homo sapiens
auagguagaugguaaagag

SEQ ID NO: 421047 - RNA, 19 nt, Homo sapiens
caugggcauuauccuagua

SEQ ID NO: 421048 - RNA, 19 nt, Homo sapiens
acacuuacaucuccaccau

SEQ ID NO: 421049 - RNA, 19 nt, Homo sapiens
ccucaggcuucagaccuua

SEQ ID NO: 421050 - RNA, 19 nt, Homo sapiens
cuaaauccaguaugaaugu

SEQ ID NO: 421051 - RNA, 19 nt, Homo sapiens
gcuaaauccaguaugaaug

SEQ ID NO: 421052 - RNA, 19 nt, Homo sapiens
gggaaaagcagaaaggaaa

SEQ ID NO: 421053 - RNA, 19 nt, Homo sapiens
agaagaacaccaacaagug

SEQ ID NO: 421054 - RNA, 19 nt, Homo sapiens
agugcuaaauccaguauga

SEQ ID NO: 421055 - RNA, 19 nt, Homo sapiens
gcuccgugccgcucuguuu

SEQ ID NO: 421056 - RNA, 19 nt, Homo sapiens
gcagaggacaacuucaaca

SEQ ID NO: 421057 - RNA, 19 nt, Homo sapiens
gaaacuagugcuaaaucca

SEQ ID NO: 421058 - RNA, 19 nt, Homo sapiens
gggaagaagaucaaacuac

SEQ ID NO: 421059 - RNA, 19 nt, Homo sapiens
ucccaguacugaccugaaa

SEQ ID NO: 421060 - RNA, 19 nt, Homo sapiens
gaauguggaugaggcuuuu

SEQ ID NO: 421061 - RNA, 19 nt, Homo sapiens
ccaagaggaaggugcagaa

SEQ ID NO: 421062 - RNA, 19 nt, Homo sapiens
cauggucuuucuugguauu

SEQ ID NO: 421063 - RNA, 19 nt, Homo sapiens
ugaaaagcaucaaggagaa

SEQ ID NO: 421064 - RNA, 19 nt, Homo sapiens
acgaccaccucuucaaguu

SEQ ID NO: 421065 - RNA, 19 nt, Homo sapiens
cagaggacaacuucaacaa

SEQ ID NO: 421066 - RNA, 19 nt, Homo sapiens
gccaagagcgguucaagac

SEQ ID NO: 421067 - RNA, 19 nt, Homo sapiens
gggcugaggacccuuucuu

SEQ ID NO: 421068 - RNA, 19 nt, Homo sapiens
aagaagaacaccaacaagu

SEQ ID NO: 421069 - RNA, 19 nt, Homo sapiens
ccuguucugucacuuguca

SEQ ID NO: 421070 - RNA, 19 nt, Homo sapiens
aggaaugaauugaggaagu

SEQ ID NO: 421071 - RNA, 19 nt, Homo sapiens
gggagaagggagaggaaug

SEQ ID NO: 421072 - RNA, 19 nt, Homo sapiens
uagggaauuugcuccuguu

SEQ ID NO: 421073 - RNA, 19 nt, Homo sapiens
ggaaaggaaggagagagau

SEQ ID NO: 421074 - RNA, 19 nt, Homo sapiens
caagaagaacaccaacaag

SEQ ID NO: 421075 - RNA, 19 nt, Homo sapiens
ugaauguggaugaggcuuu

SEQ ID NO: 421076 - RNA, 19 nt, Homo sapiens
ccaguaugaauguggauga

SEQ ID NO: 421077 - RNA, 19 nt, Homo sapiens
gagaagggagaggaaugaa

SEQ ID NO: 421078 - RNA, 19 nt, Homo sapiens
gaaaagggaaaagcagaaa

SEQ ID NO: 421079 - RNA, 19 nt, Homo sapiens
ugucugaucauucgcuuug

SEQ ID NO: 421080 - RNA, 19 nt, Homo sapiens
gaaggagcaggccgauaag

SEQ ID NO: 421081 - RNA, 19 nt, Homo sapiens
guggagccaugggcauuau

SEQ ID NO: 421082 - RNA, 19 nt, Homo sapiens
ggccaagagcgguucaaga

SEQ ID NO: 421083 - RNA, 19 nt, Homo sapiens
gaccuuaccuggguuuuca

SEQ ID NO: 421084 - RNA, 19 nt, Homo sapiens
gacaagaagaacaccaaca

SEQ ID NO: 421085 - RNA, 19 nt, Homo sapiens
ggaggccggagaucaggaa

SEQ ID NO: 421086 - RNA, 19 nt, Homo sapiens
cgaaacuagugcuaaaucc

SEQ ID NO: 421087 - RNA, 19 nt, Homo sapiens
aauaacuacugccuacuac

SEQ ID NO: 421088 - RNA, 19 nt, Homo sapiens
acaacuucaacaacacuua

SEQ ID NO: 421089 - RNA, 19 nt, Homo sapiens
ggaagagagggaggaggaa

SEQ ID NO: 421090 - RNA, 19 nt, Homo sapiens
gaaugaauugaggaaguga

SEQ ID NO: 421091 - RNA, 19 nt, Homo sapiens
ggaaaagcagaaaggaaaa

SEQ ID NO: 421092 - RNA, 19 nt, Homo sapiens
uaaauccaguaugaaugug

SEQ ID NO: 421093 - RNA, 19 nt, Homo sapiens
ggacaacuucaacaacacu

SEQ ID NO: 421094 - RNA, 19 nt, Homo sapiens
agagggaggaggaaaggaa

SEQ ID NO: 421095 - RNA, 19 nt, Homo sapiens
uagaugguaaagagaauga

SEQ ID NO: 421096 - RNA, 19 nt, Homo sapiens
caucuccaccaucggaauu

SEQ ID NO: 421097 - RNA, 19 nt, Homo sapiens
caacuucaacaacacuuac

SEQ ID NO: 421098 - RNA, 19 nt, Homo sapiens
aagaagaucaaacuacaag

SEQ ID NO: 421099 - RNA, 19 nt, Homo sapiens
acauggaggccaagaggaa

SEQ ID NO: 421100 - RNA, 19 nt, Homo sapiens
cgaccaccucuucaaguug

SEQ ID NO: 421101 - RNA, 19 nt, Homo sapiens
ggagugagcaggggagaaa

SEQ ID NO: 421102 - RNA, 19 nt, Homo sapiens
aagagcgguucaagacaau

SEQ ID NO: 421103 - RNA, 19 nt, Homo sapiens
uuucagggcaaacauaaau

SEQ ID NO: 421104 - RNA, 19 nt, Homo sapiens
ccaugggcauuauccuagu

SEQ ID NO: 421105 - RNA, 19 nt, Homo sapiens
ggaggaaaggaaggagaga

SEQ ID NO: 421106 - RNA, 19 nt, Homo sapiens
gugacaagaagaacaccaa

SEQ ID NO: 421107 - RNA, 19 nt, Homo sapiens
gggcauuauccuaguauac

SEQ ID NO: 421108 - RNA, 19 nt, Homo sapiens
gaacauagcuggugcuuau

SEQ ID NO: 421109 - RNA, 19 nt, Homo sapiens
gaucuuacaugcaguuaua

SEQ ID NO: 421110 - RNA, 19 nt, Homo sapiens
gagcaaaguuuccucaaug

SEQ ID NO: 421111 - RNA, 19 nt, Homo sapiens
ggagagguuucguagcuua

SEQ ID NO: 421112 - RNA, 19 nt, Homo sapiens
caaagugucuucauaccaa

SEQ ID NO: 421113 - RNA, 19 nt, Homo sapiens
gaaguauucuguagccuau

SEQ ID NO: 421114 - RNA, 19 nt, Homo sapiens
ggacaaaucauggcuauau

SEQ ID NO: 421115 - RNA, 19 nt, Homo sapiens
gaaagaggaggaagccaua

SEQ ID NO: 421116 - RNA, 19 nt, Homo sapiens
gaaauaucacucaccauaa

SEQ ID NO: 421117 - RNA, 19 nt, Homo sapiens
uaagaugccuguuugcuau

SEQ ID NO: 421118 - RNA, 19 nt, Homo sapiens
ccaguguacuuuaccaaua

SEQ ID NO: 421119 - RNA, 19 nt, Homo sapiens
gaauauaggacaaaucaug

SEQ ID NO: 421120 - RNA, 19 nt, Homo sapiens
gcccagagucuuacauuua

SEQ ID NO: 421121 - RNA, 19 nt, Homo sapiens
cuacugaguucuucauuau

SEQ ID NO: 421122 - RNA, 19 nt, Homo sapiens
ccugggaucuucucuauga

SEQ ID NO: 421123 - RNA, 19 nt, Homo sapiens
aaacauaagccaagcaauu

SEQ ID NO: 421124 - RNA, 19 nt, Homo sapiens
agaaauaucacucaccaua

SEQ ID NO: 421125 - RNA, 19 nt, Homo sapiens
ggaagaccaguguacuuua

SEQ ID NO: 421126 - RNA, 19 nt, Homo sapiens
cgacagcguucuucagaga

SEQ ID NO: 421127 - RNA, 19 nt, Homo sapiens
gaauauacaugcacaucag

SEQ ID NO: 421128 - RNA, 19 nt, Homo sapiens
ugacaaaugagcaaaguuu

SEQ ID NO: 421129 - RNA, 19 nt, Homo sapiens
gaauccaccugcaguuaug

SEQ ID NO: 421130 - RNA, 19 nt, Homo sapiens
gaagaccaguguacuuuac

SEQ ID NO: 421131 - RNA, 19 nt, Homo sapiens
auacaaccuuagccuauua

SEQ ID NO: 421132 - RNA, 19 nt, Homo sapiens
gcauguggcuguugagaag

SEQ ID NO: 421133 - RNA, 19 nt, Homo sapiens
gagaauccaccugcaguua

SEQ ID NO: 421134 - RNA, 19 nt, Homo sapiens
cccagagucuuacauuuaa

SEQ ID NO: 421135 - RNA, 19 nt, Homo sapiens
caacagugggcauugauuu

SEQ ID NO: 421136 - RNA, 19 nt, Homo sapiens
ucacagaagaguguauuua

SEQ ID NO: 421137 - RNA, 19 nt, Homo sapiens
gaucaaaacuuccagagau

SEQ ID NO: 421138 - RNA, 19 nt, Homo sapiens
ccauuagaccuacgaauaa

SEQ ID NO: 421139 - RNA, 19 nt, Homo sapiens
cuuaauggcuauauaggaa

SEQ ID NO: 421140 - RNA, 19 nt, Homo sapiens
uaaagcauccgguucuaaa

SEQ ID NO: 421141 - RNA, 19 nt, Homo sapiens
gaauaaagcauccgguucu

SEQ ID NO: 421142 - RNA, 19 nt, Homo sapiens
ccauagcacucgcagagaa

SEQ ID NO: 421143 - RNA, 19 nt, Homo sapiens
uacauaagaugccuguuug

SEQ ID NO: 421144 - RNA, 19 nt, Homo sapiens
ugccauaggugacauucua

SEQ ID NO: 421145 - RNA, 19 nt, Homo sapiens
gggaagaccaguguacuuu

SEQ ID NO: 421146 - RNA, 19 nt, Homo sapiens
gggaucuucucuaugauug

SEQ ID NO: 421147 - RNA, 19 nt, Homo sapiens
gaagaggacaugugauugg

SEQ ID NO: 421148 - RNA, 19 nt, Homo sapiens
ugguagaacuguaauuaga

SEQ ID NO: 421149 - RNA, 19 nt, Homo sapiens
uguugcagcuuuguaaaua

SEQ ID NO: 421150 - RNA, 19 nt, Homo sapiens
ccaaauuuaucacaacagu

SEQ ID NO: 421151 - RNA, 19 nt, Homo sapiens
ucacauuuguacuguaguu

SEQ ID NO: 421152 - RNA, 19 nt, Homo sapiens
uuacauaagaugccuguuu

SEQ ID NO: 421153 - RNA, 19 nt, Homo sapiens
ucagagaugcuauggguuu

SEQ ID NO: 421154 - RNA, 19 nt, Homo sapiens
ucacaacagugggcauuga

SEQ ID NO: 421155 - RNA, 19 nt, Homo sapiens
gguggaagauagauguuca

SEQ ID NO: 421156 - RNA, 19 nt, Homo sapiens
caaaucauggcuauaucua

SEQ ID NO: 421157 - RNA, 19 nt, Homo sapiens
cuacggaucaguuaaguga

SEQ ID NO: 421158 - RNA, 19 nt, Homo sapiens
gauaaugaagcgaauggaa

SEQ ID NO: 421159 - RNA, 19 nt, Homo sapiens
gccaaugggacaaacauaa

SEQ ID NO: 421160 - RNA, 19 nt, Homo sapiens
caaaguuuccucaauguca

SEQ ID NO: 421161 - RNA, 19 nt, Homo sapiens
ggcuauauaggaagaaaua

SEQ ID NO: 421162 - RNA, 19 nt, Homo sapiens
uuugaagacucaugccaua

SEQ ID NO: 421163 - RNA, 19 nt, Homo sapiens
cauuagaccuacgaauaaa

SEQ ID NO: 421164 - RNA, 19 nt, Homo sapiens
cccauuagaccuacgaaua

SEQ ID NO: 421165 - RNA, 19 nt, Homo sapiens
acaaauugcuucucaccau

SEQ ID NO: 421166 - RNA, 19 nt, Homo sapiens
gcacagugagagauuaaug

SEQ ID NO: 421167 - RNA, 19 nt, Homo sapiens
ugauggagauuaugauuac

SEQ ID NO: 421168 - RNA, 19 nt, Homo sapiens
acuacugaguucuucauua

SEQ ID NO: 421169 - RNA, 19 nt, Homo sapiens
uauauuugcgugaugguua

SEQ ID NO: 421170 - RNA, 19 nt, Homo sapiens
gaucuuaauggcuauauag

SEQ ID NO: 421171 - RNA, 19 nt, Homo sapiens
gaagacucaugccauaggu

SEQ ID NO: 421172 - RNA, 19 nt, Homo sapiens
ggaguggugcgaucaaaug

SEQ ID NO: 421173 - RNA, 19 nt, Homo sapiens
caguguacuuuaccaauau

SEQ ID NO: 421174 - RNA, 19 nt, Homo sapiens
ggacaugugauuggaaguu

SEQ ID NO: 421175 - RNA, 19 nt, Homo sapiens
gcucuguauuguugauauu

SEQ ID NO: 421176 - RNA, 19 nt, Homo sapiens
ggcccagagucuuacauuu

SEQ ID NO: 421177 - RNA, 19 nt, Homo sapiens
gaucuucucuaugauugau

SEQ ID NO: 421178 - RNA, 19 nt, Homo sapiens
gauauagugcuguguggaa

SEQ ID NO: 421179 - RNA, 19 nt, Homo sapiens
uauugaagcagucacauuu

SEQ ID NO: 421180 - RNA, 19 nt, Homo sapiens
gcaggcuggcuuaauguaa

SEQ ID NO: 421181 - RNA, 19 nt, Homo sapiens
gacaaaucauggcuauauc

SEQ ID NO: 421182 - RNA, 19 nt, Homo sapiens
uugccaagaucauuuauuc

SEQ ID NO: 421183 - RNA, 19 nt, Homo sapiens
ucaggcugcagcuuuauua

SEQ ID NO: 421184 - RNA, 19 nt, Homo sapiens
uauacaaccuuagccuauu

SEQ ID NO: 421185 - RNA, 19 nt, Homo sapiens
gacaugugauuggaaguug

SEQ ID NO: 421186 - RNA, 19 nt, Homo sapiens
gguagaacuguaauuagaa

SEQ ID NO: 421187 - RNA, 19 nt, Homo sapiens
uugccaaagugucuucaua

SEQ ID NO: 421188 - RNA, 19 nt, Homo sapiens
cauuaugucugauggagau

SEQ ID NO: 421189 - RNA, 19 nt, Homo sapiens
ggaagauagauguucauau

SEQ ID NO: 421190 - RNA, 19 nt, Homo sapiens
gaccuuggauaaacuggau

SEQ ID NO: 421191 - RNA, 19 nt, Homo sapiens
caggagagguuucguagcu

SEQ ID NO: 421192 - RNA, 19 nt, Homo sapiens
acuagaagcccagacuuua

SEQ ID NO: 421193 - RNA, 19 nt, Homo sapiens
uaggacaaaucauggcuau

SEQ ID NO: 421194 - RNA, 19 nt, Homo sapiens
ggaauccccuacuuugaaa

SEQ ID NO: 421195 - RNA, 19 nt, Homo sapiens
gauaagccagcuacagaug

SEQ ID NO: 421196 - RNA, 19 nt, Homo sapiens
ucauguaucuaaacuguac

SEQ ID NO: 421197 - RNA, 19 nt, Homo sapiens
caaguauauuugcgugaug

SEQ ID NO: 421198 - RNA, 19 nt, Homo sapiens
gugcuuaugccgaguuauu

SEQ ID NO: 421199 - RNA, 19 nt, Homo sapiens
cacugugauuguacauuua

SEQ ID NO: 421200 - RNA, 19 nt, Homo sapiens
aguaggccauucugacuuu

SEQ ID NO: 421201 - RNA, 19 nt, Homo sapiens
gguacugucaccugccuua

SEQ ID NO: 421202 - RNA, 19 nt, Homo sapiens
gcagagaaauauggaaucc

SEQ ID NO: 421203 - RNA, 19 nt, Homo sapiens
caggcuggcuuaauguaau

SEQ ID NO: 421204 - RNA, 19 nt, Homo sapiens
uggaaguugucaauuguug

SEQ ID NO: 421205 - RNA, 19 nt, Homo sapiens
ggaccagagaguagugaaa

SEQ ID NO: 421206 - RNA, 19 nt, Homo sapiens
gcccagacuuuacgacuac

SEQ ID NO: 421207 - RNA, 19 nt, Homo sapiens
uaauggcuauauaggaaga

SEQ ID NO: 421208 - RNA, 19 nt, Homo sapiens
caacagagcuucuuaaaug

SEQ ID NO: 421209 - RNA, 19 nt, Homo sapiens
ccaauaagcuguacuagaa

SEQ ID NO: 421210 - RNA, 19 nt, Homo sapiens
gaucaaagauuucccaaug

SEQ ID NO: 421211 - RNA, 19 nt, Homo sapiens
ggaacuggcugacaaauau

SEQ ID NO: 421212 - RNA, 19 nt, Homo sapiens
caaguuaccugucacauug

SEQ ID NO: 421213 - RNA, 19 nt, Homo sapiens
gaauggaucuucagggaaa

SEQ ID NO: 421214 - RNA, 19 nt, Homo sapiens
gaagaaauaucagugaguu

SEQ ID NO: 421215 - RNA, 19 nt, Homo sapiens
gaaggaaaccucucugaaa

SEQ ID NO: 421216 - RNA, 19 nt, Homo sapiens
caucauggauacucaauuu

SEQ ID NO: 421217 - RNA, 19 nt, Homo sapiens
gccaugggcuucuuauuaa

SEQ ID NO: 421218 - RNA, 19 nt, Homo sapiens
gcaaaugcuuauugugaaa

SEQ ID NO: 421219 - RNA, 19 nt, Homo sapiens
ggagaaagcuguagaaacc

SEQ ID NO: 421220 - RNA, 19 nt, Homo sapiens
gaacacagaaagaagaauu

SEQ ID NO: 421221 - RNA, 19 nt, Homo sapiens
ugagucagaugcauacuuu

SEQ ID NO: 421222 - RNA, 19 nt, Homo sapiens
cauagaaacugaacaucaa

SEQ ID NO: 421223 - RNA, 19 nt, Homo sapiens
gauacacaaugaagaauuc

SEQ ID NO: 421224 - RNA, 19 nt, Homo sapiens
aaaccucucugaaaucuga

SEQ ID NO: 421225 - RNA, 19 nt, Homo sapiens
ggaaaccucucugaaaucu

SEQ ID NO: 421226 - RNA, 19 nt, Homo sapiens
gaucucaucaucauggaua

SEQ ID NO: 421227 - RNA, 19 nt, Homo sapiens
ggagaacacagaaagaaga

SEQ ID NO: 421228 - RNA, 19 nt, Homo sapiens
uaagaaaccagaauaguca

SEQ ID NO: 421229 - RNA, 19 nt, Homo sapiens
ucaaagauuucccaaugug

SEQ ID NO: 421230 - RNA, 19 nt, Homo sapiens
cagaacaaguuaccuguca

SEQ ID NO: 421231 - RNA, 19 nt, Homo sapiens
ggaaggaaaccucucugaa

SEQ ID NO: 421232 - RNA, 19 nt, Homo sapiens
aaggaaaccucucugaaau

SEQ ID NO: 421233 - RNA, 19 nt, Homo sapiens
cgccaugggcuucuuauua

SEQ ID NO: 421234 - RNA, 19 nt, Homo sapiens
uaaagugcaucuucagcuu

SEQ ID NO: 421235 - RNA, 19 nt, Homo sapiens
gcacaaggaccgaauggau

SEQ ID NO: 421236 - RNA, 19 nt, Homo sapiens
caagaagaaauaucaguga

SEQ ID NO: 421237 - RNA, 19 nt, Homo sapiens
gggaacuggcugacaaaua

SEQ ID NO: 421238 - RNA, 19 nt, Homo sapiens
gaaagcauuuaaagugcau

SEQ ID NO: 421239 - RNA, 19 nt, Homo sapiens
uggaaauucuggaaacuug

SEQ ID NO: 421240 - RNA, 19 nt, Homo sapiens
cgaccaagaccaucacuau

SEQ ID NO: 421241 - RNA, 19 nt, Homo sapiens
ggauacacaaugaagaauu

SEQ ID NO: 421242 - RNA, 19 nt, Homo sapiens
ccaaauucaucacuacagu

SEQ ID NO: 421243 - RNA, 19 nt, Homo sapiens
cuucuuauauugagucaga

SEQ ID NO: 421244 - RNA, 19 nt, Homo sapiens
gaaccccaccaaaauauua

SEQ ID NO: 421245 - RNA, 19 nt, Homo sapiens
caacaaggcagaccuacca

SEQ ID NO: 421246 - RNA, 19 nt, Homo sapiens
caaauucaucacuacagua

SEQ ID NO: 421247 - RNA, 19 nt, Homo sapiens
cgauggagacuaugauuau

SEQ ID NO: 421248 - RNA, 19 nt, Homo sapiens
gggaaaauguacuagcuaa

SEQ ID NO: 421249 - RNA, 19 nt, Homo sapiens
gagaacacagaaagaagaa

SEQ ID NO: 421250 - RNA, 19 nt, Homo sapiens
gaacaaguuaccugucaca

SEQ ID NO: 421251 - RNA, 19 nt, Homo sapiens
cauggauacucaauuuguu

SEQ ID NO: 421252 - RNA, 19 nt, Homo sapiens
gaaacuggaugagccaacu

SEQ ID NO: 421253 - RNA, 19 nt, Homo sapiens
ccagaauagucaacagugu

SEQ ID NO: 421254 - RNA, 19 nt, Homo sapiens
gaguaaaccacgcacaaug

SEQ ID NO: 421255 - RNA, 19 nt, Homo sapiens
uaugaccgauggagacuau

SEQ ID NO: 421256 - RNA, 19 nt, Homo sapiens
caccagagaagaaauguau

SEQ ID NO: 421257 - RNA, 19 nt, Homo sapiens
agacacaaaucccugauac

SEQ ID NO: 421258 - RNA, 19 nt, Homo sapiens
gacagaauguggagaaagc

SEQ ID NO: 421259 - RNA, 19 nt, Homo sapiens
ugagccaacugcaagcaaa

SEQ ID NO: 421260 - RNA, 19 nt, Homo sapiens
caagaaccccaccaaaaua

SEQ ID NO: 421261 - RNA, 19 nt, Homo sapiens
agacuaugauuaucugauc

SEQ ID NO: 421262 - RNA, 19 nt, Homo sapiens
gaaauucuggaaacuugga

SEQ ID NO: 421263 - RNA, 19 nt, Homo sapiens
gcauuuaaagugcaucuuc

SEQ ID NO: 421264 - RNA, 19 nt, Homo sapiens
acaauggcaugucuuucuu

SEQ ID NO: 421265 - RNA, 19 nt, Homo sapiens
ugaaacaagugcagcaacu

SEQ ID NO: 421266 - RNA, 19 nt, Homo sapiens
aauaagcuguacuagaaug

SEQ ID NO: 421267 - RNA, 19 nt, Homo sapiens
gaauguggagaaagcugua

SEQ ID NO: 421268 - RNA, 19 nt, Homo sapiens
aggcagaccuaccagauca

SEQ ID NO: 421269 - RNA, 19 nt, Homo sapiens
cagagcuucuuaaauguca

SEQ ID NO: 421270 - RNA, 19 nt, Homo sapiens
cauuuaaagugcaucuuca

SEQ ID NO: 421271 - RNA, 19 nt, Homo sapiens
gauggagacuaugauuauc

SEQ ID NO: 421272 - RNA, 19 nt, Homo sapiens
caaagauuucccaauguga

SEQ ID NO: 421273 - RNA, 19 nt, Homo sapiens
gggcuucuuauuaauguuu

SEQ ID NO: 421274 - RNA, 19 nt, Homo sapiens
gggaaggaaaccucucuga

SEQ ID NO: 421275 - RNA, 19 nt, Homo sapiens
gcuguacuagaaugaauaa

SEQ ID NO: 421276 - RNA, 19 nt, Homo sapiens
ccgauggagacuaugauua

SEQ ID NO: 421277 - RNA, 19 nt, Homo sapiens
gaucagagggaagucaaug

SEQ ID NO: 421278 - RNA, 19 nt, Homo sapiens
gaucuucagggaaagcauu

SEQ ID NO: 421279 - RNA, 19 nt, Homo sapiens
aaucccaaauucaucacua

SEQ ID NO: 421280 - RNA, 19 nt, Homo sapiens
acaaguuaccugucacauu

SEQ ID NO: 421281 - RNA, 19 nt, Homo sapiens
acacaaaucccugauacug

SEQ ID NO: 421282 - RNA, 19 nt, Homo sapiens
gaacaguguguggagaaga

SEQ ID NO: 421283 - RNA, 19 nt, Homo sapiens
gaacuggcugacaaauaug

SEQ ID NO: 421284 - RNA, 19 nt, Homo sapiens
gaaaccagaauagucaaca

SEQ ID NO: 421285 - RNA, 19 nt, Homo sapiens
gaccaagaccaucacuaug

SEQ ID NO: 421286 - RNA, 19 nt, Homo sapiens
ggaacaguguguggagaag

SEQ ID NO: 421287 - RNA, 19 nt, Homo sapiens
gucaacagagcuucuuaaa

SEQ ID NO: 421288 - RNA, 19 nt, Homo sapiens
ucagagggaagucaaugaa

SEQ ID NO: 421289 - RNA, 19 nt, Homo sapiens
caaggcagaccuaccagau

SEQ ID NO: 421290 - RNA, 19 nt, Homo sapiens
accaagaccaucacuauga

SEQ ID NO: 421291 - RNA, 19 nt, Homo sapiens
agggaaagcauuuaaagug

SEQ ID NO: 421292 - RNA, 19 nt, Homo sapiens
ccaagaccaucacuaugac

SEQ ID NO: 421293 - RNA, 19 nt, Homo sapiens
uaaagggagaacacagaaa

SEQ ID NO: 421294 - RNA, 19 nt, Homo sapiens
gcacuaaagggagaacaca

SEQ ID NO: 421295 - RNA, 19 nt, Homo sapiens
gaaaaggguaggcacuaaa

SEQ ID NO: 421296 - RNA, 19 nt, Homo sapiens
gaggcccuuucaaacauga

SEQ ID NO: 421297 - RNA, 19 nt, Homo sapiens
uuaagaaaccagaauaguc

SEQ ID NO: 421298 - RNA, 19 nt, Homo sapiens
caauuguuguugaguaaac

SEQ ID NO: 421299 - RNA, 19 nt, Homo sapiens
acauagaaacugaacauca

SEQ ID NO: 421300 - RNA, 19 nt, Homo sapiens
cuacauagaaacugaacau

SEQ ID NO: 421301 - RNA, 19 nt, Homo sapiens
uacaguaggaauagacuuu

SEQ ID NO: 421302 - RNA, 19 nt, Homo sapiens
gaagcgaauggaacagugu

SEQ ID NO: 421303 - RNA, 19 nt, Homo sapiens
gaccucaccagucaacaga

SEQ ID NO: 421304 - RNA, 19 nt, Homo sapiens
gaaacaagugcagcaacug

SEQ ID NO: 421305 - RNA, 19 nt, Homo sapiens
ucaacagagcuucuuaaau

SEQ ID NO: 421306 - RNA, 19 nt, Homo sapiens
gagcgguuccggagucuca

SEQ ID NO: 421307 - RNA, 19 nt, Homo sapiens
ggacacugcgggacaagag

SEQ ID NO: 421308 - RNA, 19 nt, Homo sapiens
ccacagugcugcagucuga

SEQ ID NO: 421309 - RNA, 19 nt, Homo sapiens
gagaauagcgugcucaaga

SEQ ID NO: 421310 - RNA, 19 nt, Homo sapiens
gaagucuccugaagaguug

SEQ ID NO: 421311 - RNA, 19 nt, Homo sapiens
gcaccuggcucacaaggau

SEQ ID NO: 421312 - RNA, 19 nt, Homo sapiens
aauaaauggugccugcuua

SEQ ID NO: 421313 - RNA, 19 nt, Homo sapiens
gagcuagccuucacugaca

SEQ ID NO: 421314 - RNA, 19 nt, Homo sapiens
gaacugacaagccagauuc

SEQ ID NO: 421315 - RNA, 19 nt, Homo sapiens
ggccagugauaaugcaaua

SEQ ID NO: 421316 - RNA, 19 nt, Homo sapiens
gcagcguccucaccuaaga

SEQ ID NO: 421317 - RNA, 19 nt, Homo sapiens
gugcucaccucuuguggaa

SEQ ID NO: 421318 - RNA, 19 nt, Homo sapiens
agaaggagacccugcagua

SEQ ID NO: 421319 - RNA, 19 nt, Homo sapiens
gaauaaauggugccugcuu

SEQ ID NO: 421320 - RNA, 19 nt, Homo sapiens
gcuggagccugagaauaaa

SEQ ID NO: 421321 - RNA, 19 nt, Homo sapiens
gagcuggaauccuguaagg

SEQ ID NO: 421322 - RNA, 19 nt, Homo sapiens
ugacacuucucuccucaga

SEQ ID NO: 421323 - RNA, 19 nt, Homo sapiens
ggacgaggccugucugacu

SEQ ID NO: 421324 - RNA, 19 nt, Homo sapiens
gcagugcuccagccucuug

SEQ ID NO: 421325 - RNA, 19 nt, Homo sapiens
gaauagcgugcucaagaug

SEQ ID NO: 421326 - RNA, 19 nt, Homo sapiens
agaauagcgugcucaagau

SEQ ID NO: 421327 - RNA, 19 nt, Homo sapiens
gagcuggagccugagaaua

SEQ ID NO: 421328 - RNA, 19 nt, Homo sapiens
cgacagacgagcagcuauu

SEQ ID NO: 421329 - RNA, 19 nt, Homo sapiens
caggcgauguccagaaaga

SEQ ID NO: 421330 - RNA, 19 nt, Homo sapiens
ccagaaagaaugcgugcuu

SEQ ID NO: 421331 - RNA, 19 nt, Homo sapiens
aggaugugcugcucaaaga

SEQ ID NO: 421332 - RNA, 19 nt, Homo sapiens
gcuacgugauugacacuuc

SEQ ID NO: 421333 - RNA, 19 nt, Homo sapiens
ggaacugacaagccagauu

SEQ ID NO: 421334 - RNA, 19 nt, Homo sapiens
uggaacagcugcucuuggu

SEQ ID NO: 421335 - RNA, 19 nt, Homo sapiens
cccgaaacuucuccaacua

SEQ ID NO: 421336 - RNA, 19 nt, Homo sapiens
gggcaacguaucuggauga

SEQ ID NO: 421337 - RNA, 19 nt, Homo sapiens
agaagucuccugaagaguu

SEQ ID NO: 421338 - RNA, 19 nt, Homo sapiens
ggagcucugugcccguuuc

SEQ ID NO: 421339 - RNA, 19 nt, Homo sapiens
uaacuuauugggacugaau

SEQ ID NO: 421340 - RNA, 19 nt, Homo sapiens
ccagugauaaugcaauaga

SEQ ID NO: 421341 - RNA, 19 nt, Homo sapiens
ucacccaucuugacuuguc

SEQ ID NO: 421342 - RNA, 19 nt, Homo sapiens
ugacagugcucugccaucu

SEQ ID NO: 421343 - RNA, 19 nt, Homo sapiens
acauacauuucgcgucauu

SEQ ID NO: 421344 - RNA, 19 nt, Homo sapiens
gcaggccagugauaaugca

SEQ ID NO: 421345 - RNA, 19 nt, Homo sapiens
acacuucucuccucagacu

SEQ ID NO: 421346 - RNA, 19 nt, Homo sapiens
ccucaucacccgaaacuuc

SEQ ID NO: 421347 - RNA, 19 nt, Homo sapiens
acccuugcccuuuaacuua

SEQ ID NO: 421348 - RNA, 19 nt, Homo sapiens
gggacugaauaaagaaugg

SEQ ID NO: 421349 - RNA, 19 nt, Homo sapiens
uagcagcguccucaccuaa

SEQ ID NO: 421350 - RNA, 19 nt, Homo sapiens
gaaggagacccugcaguac

SEQ ID NO: 421351 - RNA, 19 nt, Homo sapiens
gcugugggcggagcuagua

SEQ ID NO: 421352 - RNA, 19 nt, Homo sapiens
aggagacccugcaguacuu

SEQ ID NO: 421353 - RNA, 19 nt, Homo sapiens
caggaccucucuacacucu

SEQ ID NO: 421354 - RNA, 19 nt, Homo sapiens
uggaugagcggaacuuuca

SEQ ID NO: 421355 - RNA, 19 nt, Homo sapiens
gagcugcuacugugcaaca

SEQ ID NO: 421356 - RNA, 19 nt, Homo sapiens
cauuaccgcuccugucucu

SEQ ID NO: 421357 - RNA, 19 nt, Homo sapiens
cgaaacuucuccaacuacu

SEQ ID NO: 421358 - RNA, 19 nt, Homo sapiens
gccaagcggugggcaucuu

SEQ ID NO: 421359 - RNA, 19 nt, Homo sapiens
gaggaugugcugcucaaag

SEQ ID NO: 421360 - RNA, 19 nt, Homo sapiens
agcuggagccugagaauaa

SEQ ID NO: 421361 - RNA, 19 nt, Homo sapiens
agcaggcgauguccagaaa

SEQ ID NO: 421362 - RNA, 19 nt, Homo sapiens
gcugcagucugagcuggaa

SEQ ID NO: 421363 - RNA, 19 nt, Homo sapiens
aaacuucuccaacuacucu

SEQ ID NO: 421364 - RNA, 19 nt, Homo sapiens
gugcugcaggccagugaua

SEQ ID NO: 421365 - RNA, 19 nt, Homo sapiens
uggaugaccugcgcagcaa

SEQ ID NO: 421366 - RNA, 19 nt, Homo sapiens
aagaaugcgugcuuuuaaa

SEQ ID NO: 421367 - RNA, 19 nt, Homo sapiens
ggaugaguccgugcuggaa

SEQ ID NO: 421368 - RNA, 19 nt, Homo sapiens
ggagcuggagccugagaau

SEQ ID NO: 421369 - RNA, 19 nt, Homo sapiens
gaucuugcugcucaugguu

SEQ ID NO: 421370 - RNA, 19 nt, Homo sapiens
gcgauguccagaaagaaug

SEQ ID NO: 421371 - RNA, 19 nt, Homo sapiens
ggugaagacgucagaagag

SEQ ID NO: 421372 - RNA, 19 nt, Homo sapiens
auacauuucgcgucauuug

SEQ ID NO: 421373 - RNA, 19 nt, Homo sapiens
uuaccgcuccugucucuug

SEQ ID NO: 421374 - RNA, 19 nt, Homo sapiens
cccaggaccucucuacacu

SEQ ID NO: 421375 - RNA, 19 nt, Homo sapiens
gacagacgagcagcuauuc

SEQ ID NO: 421376 - RNA, 19 nt, Homo sapiens
uuagcagcguccucaccua

SEQ ID NO: 421377 - RNA, 19 nt, Homo sapiens
gaaggugaagacgucagaa

SEQ ID NO: 421378 - RNA, 19 nt, Homo sapiens
ggcgauguccagaaagaau

SEQ ID NO: 421379 - RNA, 19 nt, Homo sapiens
cagcaggcgauguccagaa

SEQ ID NO: 421380 - RNA, 19 nt, Homo sapiens
ggcuagagcgagagcagaa

SEQ ID NO: 421381 - RNA, 19 nt, Homo sapiens
ggacugaauaaagaaugga

SEQ ID NO: 421382 - RNA, 19 nt, Homo sapiens
cccuugcccuuuaacuuau

SEQ ID NO: 421383 - RNA, 19 nt, Homo sapiens
ccccuacccuugcccuuua

SEQ ID NO: 421384 - RNA, 19 nt, Homo sapiens
uggagcaacuggcugaacu

SEQ ID NO: 421385 - RNA, 19 nt, Homo sapiens
cuacgugauugacacuucu

SEQ ID NO: 421386 - RNA, 19 nt, Homo sapiens
ggagaaacaugcagauuau

SEQ ID NO: 421387 - RNA, 19 nt, Homo sapiens
gaagagauucuggcauuua

SEQ ID NO: 421388 - RNA, 19 nt, Homo sapiens
gagaaugaguggcaucuau

SEQ ID NO: 421389 - RNA, 19 nt, Homo sapiens
gcucaaagaaagaugauua

SEQ ID NO: 421390 - RNA, 19 nt, Homo sapiens
ggauagaacccauacauga

SEQ ID NO: 421391 - RNA, 19 nt, Homo sapiens
gaacuuugacgguggauuu

SEQ ID NO: 421392 - RNA, 19 nt, Homo sapiens
gagauucuggcauuuauua

SEQ ID NO: 421393 - RNA, 19 nt, Homo sapiens
gagauaugguggauccuuu

SEQ ID NO: 421394 - RNA, 19 nt, Homo sapiens
gcacaggauuucuggcuau

SEQ ID NO: 421395 - RNA, 19 nt, Homo sapiens
cagauuauaucgcauccua

SEQ ID NO: 421396 - RNA, 19 nt, Homo sapiens
uuacuuggcugguggcuuu

SEQ ID NO: 421397 - RNA, 19 nt, Homo sapiens
gcaaguugauguaaauugg

SEQ ID NO: 421398 - RNA, 19 nt, Homo sapiens
uuaaaggucuacagaaaga

SEQ ID NO: 421399 - RNA, 19 nt, Homo sapiens
caaaauaaauggcuguuga

SEQ ID NO: 421400 - RNA, 19 nt, Homo sapiens
acaagaauguuaacugaug

SEQ ID NO: 421401 - RNA, 19 nt, Homo sapiens
gauguaaauugguuuguca

SEQ ID NO: 421402 - RNA, 19 nt, Homo sapiens
gaagcuugaugcuauuaau

SEQ ID NO: 421403 - RNA, 19 nt, Homo sapiens
agacuucauuggauugaua

SEQ ID NO: 421404 - RNA, 19 nt, Homo sapiens
gauagaacccauacaugaa

SEQ ID NO: 421405 - RNA, 19 nt, Homo sapiens
caagaauguuaacugauga

SEQ ID NO: 421406 - RNA, 19 nt, Homo sapiens
ccacagaaggauguuauua

SEQ ID NO: 421407 - RNA, 19 nt, Homo sapiens
gcagacaggccaggagaua

SEQ ID NO: 421408 - RNA, 19 nt, Homo sapiens
gaaauugacacaagauucu

SEQ ID NO: 421409 - RNA, 19 nt, Homo sapiens
gggagaaauugacacaaga

SEQ ID NO: 421410 - RNA, 19 nt, Homo sapiens
gaaguuaccagauguaugc

SEQ ID NO: 421411 - RNA, 19 nt, Homo sapiens
gggcagaucuauuguugca

SEQ ID NO: 421412 - RNA, 19 nt, Homo sapiens
ggaaaaggcaaucgaauuu

SEQ ID NO: 421413 - RNA, 19 nt, Homo sapiens
uguuaaaggucuacagaaa

SEQ ID NO: 421414 - RNA, 19 nt, Homo sapiens
ggaauauguuaaaggucua

SEQ ID NO: 421415 - RNA, 19 nt, Homo sapiens
uggagaaacaugcagauua

SEQ ID NO: 421416 - RNA, 19 nt, Homo sapiens
gguccuggcuucccuaaag

SEQ ID NO: 421417 - RNA, 19 nt, Homo sapiens
acagaaggauguuauuauc

SEQ ID NO: 421418 - RNA, 19 nt, Homo sapiens
guaaauugguuugucaaca

SEQ ID NO: 421419 - RNA, 19 nt, Homo sapiens
ugacuacaguucuuugugu

SEQ ID NO: 421420 - RNA, 19 nt, Homo sapiens
ucaguugcaucaaguaaau

SEQ ID NO: 421421 - RNA, 19 nt, Homo sapiens
ugacguaaauaaaguugug

SEQ ID NO: 421422 - RNA, 19 nt, Homo sapiens
gaaugaguggcaucuauug

SEQ ID NO: 421423 - RNA, 19 nt, Homo sapiens
gaaacaugcagauuauauc

SEQ ID NO: 421424 - RNA, 19 nt, Homo sapiens
uggaauugcuggauuguca

SEQ ID NO: 421425 - RNA, 19 nt, Homo sapiens
caagucaguugcaucaagu

SEQ ID NO: 421426 - RNA, 19 nt, Homo sapiens
gaacccauacaugaauuaa

SEQ ID NO: 421427 - RNA, 19 nt, Homo sapiens
cuagguuucuacuugauuu

SEQ ID NO: 421428 - RNA, 19 nt, Homo sapiens
gaaggauguuauuaucaag

SEQ ID NO: 421429 - RNA, 19 nt, Homo sapiens
ugaaugugguggaauaagu

SEQ ID NO: 421430 - RNA, 19 nt, Homo sapiens
ggagaaguuaccagaugua

SEQ ID NO: 421431 - RNA, 19 nt, Homo sapiens
ccggagaaguuaccagaug

SEQ ID NO: 421432 - RNA, 19 nt, Homo sapiens
uauccuguaugaacuuuga

SEQ ID NO: 421433 - RNA, 19 nt, Homo sapiens
ggaauaagugcuaguaucg

SEQ ID NO: 421434 - RNA, 19 nt, Homo sapiens
gagaaacaugcagauuaua

SEQ ID NO: 421435 - RNA, 19 nt, Homo sapiens
gauuauaucgcauccuaug

SEQ ID NO: 421436 - RNA, 19 nt, Homo sapiens
gagaaauugacacaagauu

SEQ ID NO: 421437 - RNA, 19 nt, Homo sapiens
gaaaguugcauaguauagu

SEQ ID NO: 421438 - RNA, 19 nt, Homo sapiens
uggcauuuauuaagucuug

SEQ ID NO: 421439 - RNA, 19 nt, Homo sapiens
aagagauucuggcauuuau

SEQ ID NO: 421440 - RNA, 19 nt, Homo sapiens
uagaacccauacaugaauu

SEQ ID NO: 421441 - RNA, 19 nt, Homo sapiens
ugacccugcucucuccuuu

SEQ ID NO: 421442 - RNA, 19 nt, Homo sapiens
uggaauaagugcuaguauc

SEQ ID NO: 421443 - RNA, 19 nt, Homo sapiens
ccuuucaucuguucuauag

SEQ ID NO: 421444 - RNA, 19 nt, Homo sapiens
ggaagcuugaugcuauuaa

SEQ ID NO: 421445 - RNA, 19 nt, Homo sapiens
gcuaguaucggacaugauc

SEQ ID NO: 421446 - RNA, 19 nt, Homo sapiens
uugcaugccugaagaagug

SEQ ID NO: 421447 - RNA, 19 nt, Homo sapiens
gguggcaacuuuggcuuug

SEQ ID NO: 421448 - RNA, 19 nt, Homo sapiens
auucugaaguccuguuauu

SEQ ID NO: 421449 - RNA, 19 nt, Homo sapiens
gcacuccacagaaggaugu

SEQ ID NO: 421450 - RNA, 19 nt, Homo sapiens
gacaugggcacuccacaga

SEQ ID NO: 421451 - RNA, 19 nt, Homo sapiens
ggagauauuuggggagaaa

SEQ ID NO: 421452 - RNA, 19 nt, Homo sapiens
cacagaaggauguuauuau

SEQ ID NO: 421453 - RNA, 19 nt, Homo sapiens
ucuuagugcuguccagauu

SEQ ID NO: 421454 - RNA, 19 nt, Homo sapiens
uauuaagucuugccaacau

SEQ ID NO: 421455 - RNA, 19 nt, Homo sapiens
guauaccuuucaucuguuc

SEQ ID NO: 421456 - RNA, 19 nt, Homo sapiens
auacuucugugucuguuau

SEQ ID NO: 421457 - RNA, 19 nt, Homo sapiens
gauguaugcuacucauggu

SEQ ID NO: 421458 - RNA, 19 nt, Homo sapiens
caggauuucuggcuauuac

SEQ ID NO: 421459 - RNA, 19 nt, Homo sapiens
ggagaaauugacacaagau

SEQ ID NO: 421460 - RNA, 19 nt, Homo sapiens
gaaugugguggaauaagug

SEQ ID NO: 421461 - RNA, 19 nt, Homo sapiens
acaagucaguugcaucaag

SEQ ID NO: 421462 - RNA, 19 nt, Homo sapiens
gugcuaguaucggacauga

SEQ ID NO: 421463 - RNA, 19 nt, Homo sapiens
uaacugaugaaaguggaua

SEQ ID NO: 421464 - RNA, 19 nt, Homo sapiens
ccagauguaugcuacucau

SEQ ID NO: 421465 - RNA, 19 nt, Homo sapiens
cggagaaguuaccagaugu

SEQ ID NO: 421466 - RNA, 19 nt, Homo sapiens
cugggcagaucuauuguug

SEQ ID NO: 421467 - RNA, 19 nt, Homo sapiens
guuauuaucaagucagaug

SEQ ID NO: 421468 - RNA, 19 nt, Homo sapiens
uuacaagucaguugcauca

SEQ ID NO: 421469 - RNA, 19 nt, Homo sapiens
ggcaaucgaauuuguuuua

SEQ ID NO: 421470 - RNA, 19 nt, Homo sapiens
gggaagcuugaugcuauua

SEQ ID NO: 421471 - RNA, 19 nt, Homo sapiens
uuugugcgguggcaacuuu

SEQ ID NO: 421472 - RNA, 19 nt, Homo sapiens
gaucucaugggacaacuuc

SEQ ID NO: 421473 - RNA, 19 nt, Homo sapiens
caugggcacuccacagaag

SEQ ID NO: 421474 - RNA, 19 nt, Homo sapiens
ucugaguauuugagaauga

SEQ ID NO: 421475 - RNA, 19 nt, Homo sapiens
ggagauaugguggauccuu

SEQ ID NO: 421476 - RNA, 19 nt, Homo sapiens
uggcuucccuaaagauaau

SEQ ID NO: 421477 - RNA, 19 nt, Homo sapiens
gagaaguuaccagauguau

SEQ ID NO: 421478 - RNA, 19 nt, Homo sapiens
gguggaauaagugcuagua

SEQ ID NO: 421479 - RNA, 19 nt, Homo sapiens
acucuagguuucuacuuga

SEQ ID NO: 421480 - RNA, 19 nt, Homo sapiens
cagaaggauguuauuauca

SEQ ID NO: 421481 - RNA, 19 nt, Homo sapiens
ggauuucuggcuauuacaa

SEQ ID NO: 421482 - RNA, 19 nt, Homo sapiens
gcucucuccuuucccuguu

SEQ ID NO: 421483 - RNA, 19 nt, Homo sapiens
gcuugaugcuauuaaugug

SEQ ID NO: 421484 - RNA, 19 nt, Homo sapiens
uggcaacuuuggcuuuguu

SEQ ID NO: 421485 - RNA, 19 nt, Homo sapiens
uguggaauauguuaaaggu

SEQ ID NO: 421486 - RNA, 19 nt, Homo sapiens
cacaagaacuggccuuuaa

SEQ ID NO: 421487 - RNA, 19 nt, Homo sapiens
guacuaaacagaaaccuua

SEQ ID NO: 421488 - RNA, 19 nt, Homo sapiens
gaaccuaagcuaagcauuu

SEQ ID NO: 421489 - RNA, 19 nt, Homo sapiens
ggucacauguccaucguua

SEQ ID NO: 421490 - RNA, 19 nt, Homo sapiens
ccacuaaccagaaacauua

SEQ ID NO: 421491 - RNA, 19 nt, Homo sapiens
caacaacaguaacaacaaa

SEQ ID NO: 421492 - RNA, 19 nt, Homo sapiens
caagaaggcauacaaauau

SEQ ID NO: 421493 - RNA, 19 nt, Homo sapiens
ucaagaaggcauacaaaua

SEQ ID NO: 421494 - RNA, 19 nt, Homo sapiens
gauaucagcagacguguuu

SEQ ID NO: 421495 - RNA, 19 nt, Homo sapiens
gagagugacuuuguuguau

SEQ ID NO: 421496 - RNA, 19 nt, Homo sapiens
ggucauuucuauuuccuuu

SEQ ID NO: 421497 - RNA, 19 nt, Homo sapiens
ccagaugcauggauacaaa

SEQ ID NO: 421498 - RNA, 19 nt, Homo sapiens
ccagaaacauuacuuugga

SEQ ID NO: 421499 - RNA, 19 nt, Homo sapiens
guacaugccuccugcuuag

SEQ ID NO: 421500 - RNA, 19 nt, Homo sapiens
gaaaugacucacugucgua

SEQ ID NO: 421501 - RNA, 19 nt, Homo sapiens
gaacgaguuucccaugagu

SEQ ID NO: 421502 - RNA, 19 nt, Homo sapiens
cguagaaggaaguuuauua

SEQ ID NO: 421503 - RNA, 19 nt, Homo sapiens
caaacaaacaacaacagua

SEQ ID NO: 421504 - RNA, 19 nt, Homo sapiens
aaacagaguuauccacaca

SEQ ID NO: 421505 - RNA, 19 nt, Homo sapiens
ugccacaucuggacaagua

SEQ ID NO: 421506 - RNA, 19 nt, Homo sapiens
gccaaauguugcccuagua

SEQ ID NO: 421507 - RNA, 19 nt, Homo sapiens
guaccagcauguccauuug

SEQ ID NO: 421508 - RNA, 19 nt, Homo sapiens
uggcuuccuucuccaauua

SEQ ID NO: 421509 - RNA, 19 nt, Homo sapiens
gaauaggaaaccauaguau

SEQ ID NO: 421510 - RNA, 19 nt, Homo sapiens
uuaaaccacuaaccagaaa

SEQ ID NO: 421511 - RNA, 19 nt, Homo sapiens
cugcuuaguucacuuugua

SEQ ID NO: 421512 - RNA, 19 nt, Homo sapiens
gguuaauccugcuuccuaa

SEQ ID NO: 421513 - RNA, 19 nt, Homo sapiens
ggaugcaucucuaauacca

SEQ ID NO: 421514 - RNA, 19 nt, Homo sapiens
gggcugcucuaacaguuug

SEQ ID NO: 421515 - RNA, 19 nt, Homo sapiens
cuugugaucuacaguaauu

SEQ ID NO: 421516 - RNA, 19 nt, Homo sapiens
gaugguggcugcaguaagc

SEQ ID NO: 421517 - RNA, 19 nt, Homo sapiens
aaauugaguuugagacuag

SEQ ID NO: 421518 - RNA, 19 nt, Homo sapiens
gaaggugagaagcagauuu

SEQ ID NO: 421519 - RNA, 19 nt, Homo sapiens
ccuaaagccucaaguacau

SEQ ID NO: 421520 - RNA, 19 nt, Homo sapiens
ccacaagaacuggccuuua

SEQ ID NO: 421521 - RNA, 19 nt, Homo sapiens
ugaauaggaaaccauagua

SEQ ID NO: 421522 - RNA, 19 nt, Homo sapiens
ccaauuauuccaucauuuc

SEQ ID NO: 421523 - RNA, 19 nt, Homo sapiens
caagaacuggccuuuaaug

SEQ ID NO: 421524 - RNA, 19 nt, Homo sapiens
ugucguagaaggaaguuua

SEQ ID NO: 421525 - RNA, 19 nt, Homo sapiens
uggcuacccuugugaucua

SEQ ID NO: 421526 - RNA, 19 nt, Homo sapiens
acacugugcuuaccuccaa

SEQ ID NO: 421527 - RNA, 19 nt, Homo sapiens
ccucuucccuugaaaucuu

SEQ ID NO: 421528 - RNA, 19 nt, Homo sapiens
guugaggacauguucauuu

SEQ ID NO: 421529 - RNA, 19 nt, Homo sapiens
guaucggucauuucuauuu

SEQ ID NO: 421530 - RNA, 19 nt, Homo sapiens
gcaauugagagaacugugu

SEQ ID NO: 421531 - RNA, 19 nt, Homo sapiens
ggauacaaauuuccauagc

SEQ ID NO: 421532 - RNA, 19 nt, Homo sapiens
gaguggaggguguaggaua

SEQ ID NO: 421533 - RNA, 19 nt, Homo sapiens
ugagagugacuuuguugua

SEQ ID NO: 421534 - RNA, 19 nt, Homo sapiens
ggccuuuaaugugguauaa

SEQ ID NO: 421535 - RNA, 19 nt, Homo sapiens
uagaugacaagaacaguuu

SEQ ID NO: 421536 - RNA, 19 nt, Homo sapiens
gcaguaagccaagaucaca

SEQ ID NO: 421537 - RNA, 19 nt, Homo sapiens
ucuaguugcuuccucauuc

SEQ ID NO: 421538 - RNA, 19 nt, Homo sapiens
gauacaaauuuccauagcu

SEQ ID NO: 421539 - RNA, 19 nt, Homo sapiens
ggagcagccgagcgaguua

SEQ ID NO: 421540 - RNA, 19 nt, Homo sapiens
ccacacaagucaggagcaa

SEQ ID NO: 421541 - RNA, 19 nt, Homo sapiens
ucacauguccaucguuaug

SEQ ID NO: 421542 - RNA, 19 nt, Homo sapiens
ggguuaauccugcuuccua

SEQ ID NO: 421543 - RNA, 19 nt, Homo sapiens
ugagaacugccaaauguug

SEQ ID NO: 421544 - RNA, 19 nt, Homo sapiens
gagcaaaacccaaguagau

SEQ ID NO: 421545 - RNA, 19 nt, Homo sapiens
gaugcauggauacaaauuu

SEQ ID NO: 421546 - RNA, 19 nt, Homo sapiens
gucaccaccucuacuauuc

SEQ ID NO: 421547 - RNA, 19 nt, Homo sapiens
guuaggccuuugccacauu

SEQ ID NO: 421548 - RNA, 19 nt, Homo sapiens
guuauggcaugugcagaaa

SEQ ID NO: 421549 - RNA, 19 nt, Homo sapiens
uaucagcagacguguuuaa

SEQ ID NO: 421550 - RNA, 19 nt, Homo sapiens
uuaggccuuugccacauua

SEQ ID NO: 421551 - RNA, 19 nt, Homo sapiens
gagaguggaggguguagga

SEQ ID NO: 421552 - RNA, 19 nt, Homo sapiens
ucucuaauaccauguuuga

SEQ ID NO: 421553 - RNA, 19 nt, Homo sapiens
aaacauuacuuuggaugca

SEQ ID NO: 421554 - RNA, 19 nt, Homo sapiens
ucagcuccaucuccaaaga

SEQ ID NO: 421555 - RNA, 19 nt, Homo sapiens
uguuuaagccuucaacuug

SEQ ID NO: 421556 - RNA, 19 nt, Homo sapiens
caacccaggauacaaacuu

SEQ ID NO: 421557 - RNA, 19 nt, Homo sapiens
gaugacacauaacaaaaga

SEQ ID NO: 421558 - RNA, 19 nt, Homo sapiens
gaaagauggcuuccuucuc

SEQ ID NO: 421559 - RNA, 19 nt, Homo sapiens
caucucuaauaccauguuu

SEQ ID NO: 421560 - RNA, 19 nt, Homo sapiens
uaucggucauuucuauuuc

SEQ ID NO: 421561 - RNA, 19 nt, Homo sapiens
gacccugucucaaacaaac

SEQ ID NO: 421562 - RNA, 19 nt, Homo sapiens
aaagaugguggcugcagua

SEQ ID NO: 421563 - RNA, 19 nt, Homo sapiens
ccaaggacgugggcaacau

SEQ ID NO: 421564 - RNA, 19 nt, Homo sapiens
ggacgugggcaacaucaag

SEQ ID NO: 421565 - RNA, 19 nt, Homo sapiens
guuuauaauuugccacauc

SEQ ID NO: 421566 - RNA, 19 nt, Homo sapiens
agagugacuuuguuguaug

SEQ ID NO: 421567 - RNA, 19 nt, Homo sapiens
gaccccaucucuauuuaaa

SEQ ID NO: 421568 - RNA, 19 nt, Homo sapiens
gagacuagccugggcaaca

SEQ ID NO: 421569 - RNA, 19 nt, Homo sapiens
gcacauggccccucacauc

SEQ ID NO: 421570 - RNA, 19 nt, Homo sapiens
gcucuaacaguuugauauc

SEQ ID NO: 421571 - RNA, 19 nt, Homo sapiens
cagaaacauuacuuuggau

SEQ ID NO: 421572 - RNA, 19 nt, Homo sapiens
gagugacuuuguuguaugg

SEQ ID NO: 421573 - RNA, 19 nt, Homo sapiens
gaaggcauacaaauaucug

SEQ ID NO: 421574 - RNA, 19 nt, Homo sapiens
gaacaugcagaggguuaau

SEQ ID NO: 421575 - RNA, 19 nt, Homo sapiens
gaucugaaagaaauaaagg

SEQ ID NO: 421576 - RNA, 19 nt, Homo sapiens
acguaucggucauuucuau

SEQ ID NO: 421577 - RNA, 19 nt, Homo sapiens
guugcuuccucauuccuuu

SEQ ID NO: 421578 - RNA, 19 nt, Homo sapiens
uaucugagagugacuuugu

SEQ ID NO: 421579 - RNA, 19 nt, Homo sapiens
uuaguaagcaauugagaga

SEQ ID NO: 421580 - RNA, 19 nt, Homo sapiens
cccuugaaaucuuguaguu

SEQ ID NO: 421581 - RNA, 19 nt, Homo sapiens
ggaccaauuggcuggcauu

SEQ ID NO: 421582 - RNA, 19 nt, Homo sapiens
aagaaggcauacaaauauc

SEQ ID NO: 421583 - RNA, 19 nt, Homo sapiens
caaacaacaacaguaacaa

SEQ ID NO: 421584 - RNA, 19 nt, Homo sapiens
acaaacaacaacaguaaca

SEQ ID NO: 421585 - RNA, 19 nt, Homo sapiens
caagccagaaccuaagcua

SEQ ID NO: 421586 - RNA, 19 nt, Homo sapiens
gaacaagaucugucaauuu

SEQ ID NO: 421587 - RNA, 19 nt, Homo sapiens
cuaagaagcuucccaagaa

SEQ ID NO: 421588 - RNA, 19 nt, Homo sapiens
ggaacaagaucugucaauu

SEQ ID NO: 421589 - RNA, 19 nt, Homo sapiens
caucacaucucacuuuguu

SEQ ID NO: 421590 - RNA, 19 nt, Homo sapiens
cuaagugccucuuugcaua

SEQ ID NO: 421591 - RNA, 19 nt, Homo sapiens
gcaaugaacgugaacgaaa

SEQ ID NO: 421592 - RNA, 19 nt, Homo sapiens
gagcaucacaucucacuuu

SEQ ID NO: 421593 - RNA, 19 nt, Homo sapiens
ggaauccacucuaaccaau

SEQ ID NO: 421594 - RNA, 19 nt, Homo sapiens
gaacgugaacgaaaucuuc

SEQ ID NO: 421595 - RNA, 19 nt, Homo sapiens
caacacagauacauuugca

SEQ ID NO: 421596 - RNA, 19 nt, Homo sapiens
caagaucugucaauuuaag

SEQ ID NO: 421597 - RNA, 19 nt, Homo sapiens
ggaaaccacagcauuauca

SEQ ID NO: 421598 - RNA, 19 nt, Homo sapiens
caaugaacgugaacgaaau

SEQ ID NO: 421599 - RNA, 19 nt, Homo sapiens
ccaccaugauuucuccaua

SEQ ID NO: 421600 - RNA, 19 nt, Homo sapiens
cagcaaagacugcaaugaa

SEQ ID NO: 421601 - RNA, 19 nt, Homo sapiens
uauaugaucuucugcucuu

SEQ ID NO: 421602 - RNA, 19 nt, Homo sapiens
gcuaagaagcuucccaaga

SEQ ID NO: 421603 - RNA, 19 nt, Homo sapiens
ggaguggucuuugguuugg

SEQ ID NO: 421604 - RNA, 19 nt, Homo sapiens
ucauugcacucgcggguaa

SEQ ID NO: 421605 - RNA, 19 nt, Homo sapiens
caccaacacagauacauuu

SEQ ID NO: 421606 - RNA, 19 nt, Homo sapiens
ggacaggagcgguaucaca

SEQ ID NO: 421607 - RNA, 19 nt, Homo sapiens
agaagagcaucacaucuca

SEQ ID NO: 421608 - RNA, 19 nt, Homo sapiens
gugcagcuacccuuucuuu

SEQ ID NO: 421609 - RNA, 19 nt, Homo sapiens
caccaugauuucuccauau

SEQ ID NO: 421610 - RNA, 19 nt, Homo sapiens
ccaggaagcacaagccuau

SEQ ID NO: 421611 - RNA, 19 nt, Homo sapiens
gacaucaccaacacagaua

SEQ ID NO: 421612 - RNA, 19 nt, Homo sapiens
ucuaaccaaucgcacuuaa

SEQ ID NO: 421613 - RNA, 19 nt, Homo sapiens
caaucaguaucuugucaau

SEQ ID NO: 421614 - RNA, 19 nt, Homo sapiens
cauuaucacagcauuauug

SEQ ID NO: 421615 - RNA, 19 nt, Homo sapiens
accaugauuucuccauaua

SEQ ID NO: 421616 - RNA, 19 nt, Homo sapiens
ugaaugacccgacuggaau

SEQ ID NO: 421617 - RNA, 19 nt, Homo sapiens
caacauguaaccaaucagu

SEQ ID NO: 421618 - RNA, 19 nt, Homo sapiens
agacugcaaugaacgugaa

SEQ ID NO: 421619 - RNA, 19 nt, Homo sapiens
uaaccaaucaguaucuugu

SEQ ID NO: 421620 - RNA, 19 nt, Homo sapiens
aggcagaccuggccagcaa

SEQ ID NO: 421621 - RNA, 19 nt, Homo sapiens
gcccuguucugaccaaauc

SEQ ID NO: 421622 - RNA, 19 nt, Homo sapiens
agggacaguuucacgagua

SEQ ID NO: 421623 - RNA, 19 nt, Homo sapiens
ugacagccacgaacccauu

SEQ ID NO: 421624 - RNA, 19 nt, Homo sapiens
cugggaaaccacagcauua

SEQ ID NO: 421625 - RNA, 19 nt, Homo sapiens
ucggaguggucuuugguuu

SEQ ID NO: 421626 - RNA, 19 nt, Homo sapiens
cagaagagcaucacaucuc

SEQ ID NO: 421627 - RNA, 19 nt, Homo sapiens
cuucugcucuucccacuuc

SEQ ID NO: 421628 - RNA, 19 nt, Homo sapiens
gaaaucuucauggcaauag

SEQ ID NO: 421629 - RNA, 19 nt, Homo sapiens
cgaaaucuucauggcaaua

SEQ ID NO: 421630 - RNA, 19 nt, Homo sapiens
ggagacaucagcaaagacu

SEQ ID NO: 421631 - RNA, 19 nt, Homo sapiens
gagcggccuuccucacaca

SEQ ID NO: 421632 - RNA, 19 nt, Homo sapiens
cagcauuaucacagcauua

SEQ ID NO: 421633 - RNA, 19 nt, Homo sapiens
uaagaagcuucccaagaac

SEQ ID NO: 421634 - RNA, 19 nt, Homo sapiens
ucauggcaauagcuaagaa

SEQ ID NO: 421635 - RNA, 19 nt, Homo sapiens
ucaccaacacagauacauu

SEQ ID NO: 421636 - RNA, 19 nt, Homo sapiens
ugacaucaccaacacagau

SEQ ID NO: 421637 - RNA, 19 nt, Homo sapiens
gggaacaagaucugucaau

SEQ ID NO: 421638 - RNA, 19 nt, Homo sapiens
acauguaaccaaucaguau

SEQ ID NO: 421639 - RNA, 19 nt, Homo sapiens
ggaguagccacaugcucuu

SEQ ID NO: 421640 - RNA, 19 nt, Homo sapiens
ggagucugcgguaggcaaa

SEQ ID NO: 421641 - RNA, 19 nt, Homo sapiens
gaacugggugaaggagcua

SEQ ID NO: 421642 - RNA, 19 nt, Homo sapiens
guaccaggagagcacaauu

SEQ ID NO: 421643 - RNA, 19 nt, Homo sapiens
ccaagaacugggugaagga

SEQ ID NO: 421644 - RNA, 19 nt, Homo sapiens
ccaugauuucuccauauaa

SEQ ID NO: 421645 - RNA, 19 nt, Homo sapiens
cacgcucucuggaccacua

SEQ ID NO: 421646 - RNA, 19 nt, Homo sapiens
gacacaacagucaaguuug

SEQ ID NO: 421647 - RNA, 19 nt, Homo sapiens
gcauuaucacagcauuauu

SEQ ID NO: 421648 - RNA, 19 nt, Homo sapiens
gcagcuacccuuucuuucc

SEQ ID NO: 421649 - RNA, 19 nt, Homo sapiens
gcagaccuggccagcaaga

SEQ ID NO: 421650 - RNA, 19 nt, Homo sapiens
guaaccaaucaguaucuug

SEQ ID NO: 421651 - RNA, 19 nt, Homo sapiens
cuacugcucucccauuuuc

SEQ ID NO: 421652 - RNA, 19 nt, Homo sapiens
uaaccaaucgcacuuaacg

SEQ ID NO: 421653 - RNA, 19 nt, Homo sapiens
gaaugacccgacuggaauc

SEQ ID NO: 421654 - RNA, 19 nt, Homo sapiens
cugaaugacccgacuggaa

SEQ ID NO: 421655 - RNA, 19 nt, Homo sapiens
ucauggagacaucagcaaa

SEQ ID NO: 421656 - RNA, 19 nt, Homo sapiens
ggaagcacaagccuaugca

SEQ ID NO: 421657 - RNA, 19 nt, Homo sapiens
gggaaaccacagcauuauc

SEQ ID NO: 421658 - RNA, 19 nt, Homo sapiens
gaccagaagagcaucacau

SEQ ID NO: 421659 - RNA, 19 nt, Homo sapiens
cagcuacccuuucuuuccu

SEQ ID NO: 421660 - RNA, 19 nt, Homo sapiens
uucaacauguaaccaauca

SEQ ID NO: 421661 - RNA, 19 nt, Homo sapiens
cagugcagcuacccuuucu

SEQ ID NO: 421662 - RNA, 19 nt, Homo sapiens
uaccaggagagcacaauug

SEQ ID NO: 421663 - RNA, 19 nt, Homo sapiens
ccaaucaguaucuugucaa

SEQ ID NO: 421664 - RNA, 19 nt, Homo sapiens
uaagugccucuuugcauag

SEQ ID NO: 421665 - RNA, 19 nt, Homo sapiens
gggacaguuucacgaguac

SEQ ID NO: 421666 - RNA, 19 nt, Homo sapiens
caaagacugcaaugaacgu

SEQ ID NO: 421667 - RNA, 19 nt, Homo sapiens
guucugaccaaaucaugau

SEQ ID NO: 421668 - RNA, 19 nt, Homo sapiens
caucguggucuaugacauc

SEQ ID NO: 421669 - RNA, 19 nt, Homo sapiens
ucuaugacaucaccaacac

SEQ ID NO: 421670 - RNA, 19 nt, Homo sapiens
agcaaagacugcaaugaac

SEQ ID NO: 421671 - RNA, 19 nt, Homo sapiens
auggagacaucagcaaaga

SEQ ID NO: 421672 - RNA, 19 nt, Homo sapiens
augcagacgacaacaguuu

SEQ ID NO: 421673 - RNA, 19 nt, Homo sapiens
gagaauauaucccuacugu

SEQ ID NO: 421674 - RNA, 19 nt, Homo sapiens
gaaaaugccugcuguugua

SEQ ID NO: 421675 - RNA, 19 nt, Homo sapiens
ggaacuaaacuugaucuua

SEQ ID NO: 421676 - RNA, 19 nt, Homo sapiens
gaauauaucccuacugucu

SEQ ID NO: 421677 - RNA, 19 nt, Homo sapiens
cagauguguucuuaauuug

SEQ ID NO: 421678 - RNA, 19 nt, Homo sapiens
ugugaguccugcaucauuu

SEQ ID NO: 421679 - RNA, 19 nt, Homo sapiens
auauaucccuacugucuuu

SEQ ID NO: 421680 - RNA, 19 nt, Homo sapiens
ugacaauuauucugccaau

SEQ ID NO: 421681 - RNA, 19 nt, Homo sapiens
gguaaaacuugccuacuga

SEQ ID NO: 421682 - RNA, 19 nt, Homo sapiens
gauguguucuuaauuugcu

SEQ ID NO: 421683 - RNA, 19 nt, Homo sapiens
uauccuauccgcaaacaga

SEQ ID NO: 421684 - RNA, 19 nt, Homo sapiens
gaucuuagggaugauaaag

SEQ ID NO: 421685 - RNA, 19 nt, Homo sapiens
cggcaccacugucccaaca

SEQ ID NO: 421686 - RNA, 19 nt, Homo sapiens
gacaauuauucugccaaug

SEQ ID NO: 421687 - RNA, 19 nt, Homo sapiens
acacagcgaggccucaaga

SEQ ID NO: 421688 - RNA, 19 nt, Homo sapiens
aguccugcaucauuugaaa

SEQ ID NO: 421689 - RNA, 19 nt, Homo sapiens
aacuugaucuuagggauga

SEQ ID NO: 421690 - RNA, 19 nt, Homo sapiens
gagaaaaugccugcuguug

SEQ ID NO: 421691 - RNA, 19 nt, Homo sapiens
agugggaacuaaacuugau

SEQ ID NO: 421692 - RNA, 19 nt, Homo sapiens
ggauacagcuggacaagaa

SEQ ID NO: 421693 - RNA, 19 nt, Homo sapiens
gagaauauaucccuacugu

SEQ ID NO: 421694 - RNA, 19 nt, Homo sapiens
gaaaaugccugcuguugua

SEQ ID NO: 421695 - RNA, 19 nt, Homo sapiens
acaagaagauuaugacaga

SEQ ID NO: 421696 - RNA, 19 nt, Homo sapiens
ggaacuaaacuugaucuua

SEQ ID NO: 421697 - RNA, 19 nt, Homo sapiens
gccgauguguucuuaauuu

SEQ ID NO: 421698 - RNA, 19 nt, Homo sapiens
gaauauaucccuacugucu

SEQ ID NO: 421699 - RNA, 19 nt, Homo sapiens
gcaaacaguuggagaaacg

SEQ ID NO: 421700 - RNA, 19 nt, Homo sapiens
gauugccgauguguucuua

SEQ ID NO: 421701 - RNA, 19 nt, Homo sapiens
gaaacguacgguaaggaua

SEQ ID NO: 421702 - RNA, 19 nt, Homo sapiens
ugugaguccugcaucauuu

SEQ ID NO: 421703 - RNA, 19 nt, Homo sapiens
cagcuggacaagaagauua

SEQ ID NO: 421704 - RNA, 19 nt, Homo sapiens
auauaucccuacugucuuu

SEQ ID NO: 421705 - RNA, 19 nt, Homo sapiens
ggagaaacguacgguaagg

SEQ ID NO: 421706 - RNA, 19 nt, Homo sapiens
ugacaauuauucugccaau

SEQ ID NO: 421707 - RNA, 19 nt, Homo sapiens
aaacguacgguaaggauau

SEQ ID NO: 421708 - RNA, 19 nt, Homo sapiens
gguaaaacuugccuacuga

SEQ ID NO: 421709 - RNA, 19 nt, Homo sapiens
ggacaagaagauuaugaca

SEQ ID NO: 421710 - RNA, 19 nt, Homo sapiens
ccgauguguucuuaauuug

SEQ ID NO: 421711 - RNA, 19 nt, Homo sapiens
acaagccgauugccgaugu

SEQ ID NO: 421712 - RNA, 19 nt, Homo sapiens
gauguguucuuaauuugcu

SEQ ID NO: 421713 - RNA, 19 nt, Homo sapiens
gggcaaagacaagccgauu

SEQ ID NO: 421714 - RNA, 19 nt, Homo sapiens
gaucuuagggaugauaaag

SEQ ID NO: 421715 - RNA, 19 nt, Homo sapiens
cggcaccacugucccaaca

SEQ ID NO: 421716 - RNA, 19 nt, Homo sapiens
gacaauuauucugccaaug

SEQ ID NO: 421717 - RNA, 19 nt, Homo sapiens
caagaagauuaugacagau

SEQ ID NO: 421718 - RNA, 19 nt, Homo sapiens
acacagcgaggccucaaga

SEQ ID NO: 421719 - RNA, 19 nt, Homo sapiens
aguccugcaucauuugaaa

SEQ ID NO: 421720 - RNA, 19 nt, Homo sapiens
ggcaaagacaagccgauug

SEQ ID NO: 421721 - RNA, 19 nt, Homo sapiens
gagaaacguacgguaagga

SEQ ID NO: 421722 - RNA, 19 nt, Homo sapiens
aaacaguuggagaaacgua

SEQ ID NO: 421723 - RNA, 19 nt, Homo sapiens
aacuugaucuuagggauga

SEQ ID NO: 421724 - RNA, 19 nt, Homo sapiens
gccgauugccgauguguuc

SEQ ID NO: 421725 - RNA, 19 nt, Homo sapiens
uauccuauccgcaaacagu

SEQ ID NO: 421726 - RNA, 19 nt, Homo sapiens
gagaaaaugccugcuguug

SEQ ID NO: 421727 - RNA, 19 nt, Homo sapiens
agugggaacuaaacuugau

SEQ ID NO: 421728 - RNA, 19 nt, Homo sapiens
aacguacgguaaggauaua

SEQ ID NO: 421729 - RNA, 19 nt, Homo sapiens
uuggagaaacguacgguaa

SEQ ID NO: 421730 - RNA, 19 nt, Homo sapiens
ccgcaaacaguuggagaaa

SEQ ID NO: 421731 - RNA, 19 nt, Homo sapiens
uugccgauguguucuuaau

SEQ ID NO: 421732 - RNA, 19 nt, Homo sapiens
gaggccagcugcucuaaua

SEQ ID NO: 421733 - RNA, 19 nt, Homo sapiens
gagcugcacuuaccuguga

SEQ ID NO: 421734 - RNA, 19 nt, Homo sapiens
gugagagucuucaaacuuu

SEQ ID NO: 421735 - RNA, 19 nt, Homo sapiens
ccaggaacgugcaaauuug

SEQ ID NO: 421736 - RNA, 19 nt, Homo sapiens
ggaagcaucuacccguuca

SEQ ID NO: 421737 - RNA, 19 nt, Homo sapiens
gagauugacucggugaaau

SEQ ID NO: 421738 - RNA, 19 nt, Homo sapiens
gccaggaacgugcaaauuu

SEQ ID NO: 421739 - RNA, 19 nt, Homo sapiens
ucgagaaacugaaggagaa

SEQ ID NO: 421740 - RNA, 19 nt, Homo sapiens
ggccucaguucuccucuuu

SEQ ID NO: 421741 - RNA, 19 nt, Homo sapiens
ugacaacuauucagccaau

SEQ ID NO: 421742 - RNA, 19 nt, Homo sapiens
ugccauuucuuaagacuuu

SEQ ID NO: 421743 - RNA, 19 nt, Homo sapiens
cugcagagcuucguugaug

SEQ ID NO: 421744 - RNA, 19 nt, Homo sapiens
gagcuucguugauggucuu

SEQ ID NO: 421745 - RNA, 19 nt, Homo sapiens
gauaucugcucagccaaug

SEQ ID NO: 421746 - RNA, 19 nt, Homo sapiens
caaggacaccaucgagaaa

SEQ ID NO: 421747 - RNA, 19 nt, Homo sapiens
ccaccguguuugacaacua

SEQ ID NO: 421748 - RNA, 19 nt, Homo sapiens
ggaaacugcaggccagaug

SEQ ID NO: 421749 - RNA, 19 nt, Homo sapiens
ccaagugguucccagaagu

SEQ ID NO: 421750 - RNA, 19 nt, Homo sapiens
ggagauugacucggugaaa

SEQ ID NO: 421751 - RNA, 19 nt, Homo sapiens
cagcugcucuaauaucgau

SEQ ID NO: 421752 - RNA, 19 nt, Homo sapiens
caacucaaccugcuuaagc

SEQ ID NO: 421753 - RNA, 19 nt, Homo sapiens
agauugacucggugaaaua

SEQ ID NO: 421754 - RNA, 19 nt, Homo sapiens
acaaggacaccaucgagaa

SEQ ID NO: 421755 - RNA, 19 nt, Homo sapiens
caccguguuugacaacuau

SEQ ID NO: 421756 - RNA, 19 nt, Homo sapiens
ggauaucugcucagccaau

SEQ ID NO: 421757 - RNA, 19 nt, Homo sapiens
gccaagugguucccagaag

SEQ ID NO: 421758 - RNA, 19 nt, Homo sapiens
ccaccuagaugggucugau

SEQ ID NO: 421759 - RNA, 19 nt, Homo sapiens
gcacuggccaaggagauug

SEQ ID NO: 421760 - RNA, 19 nt, Homo sapiens
caacuauucagccaaugug

SEQ ID NO: 421761 - RNA, 19 nt, Homo sapiens
guacauccccaccguguuu

SEQ ID NO: 421762 - RNA, 19 nt, Homo sapiens
cuacaccaccaacgccuuu

SEQ ID NO: 421763 - RNA, 19 nt, Homo sapiens
ggacagcaagccagugaac

SEQ ID NO: 421764 - RNA, 19 nt, Homo sapiens
ugugagagucuucaaacuu

SEQ ID NO: 421765 - RNA, 19 nt, Homo sapiens
ggccaggaacgugcaaauu

SEQ ID NO: 421766 - RNA, 19 nt, Homo sapiens
gccagcugcucuaauaucg

SEQ ID NO: 421767 - RNA, 19 nt, Homo sapiens
guggacagcaagccaguga

SEQ ID NO: 421768 - RNA, 19 nt, Homo sapiens
gagagucuucaaacuuuua

SEQ ID NO: 421769 - RNA, 19 nt, Homo sapiens
gaguuccucuacccagcaa

SEQ ID NO: 421770 - RNA, 19 nt, Homo sapiens
ccaacugccgcauguggaa

SEQ ID NO: 421771 - RNA, 19 nt, Homo sapiens
caagaccugccuucucauc

SEQ ID NO: 421772 - RNA, 19 nt, Homo sapiens
caagugguucccagaagug

SEQ ID NO: 421773 - RNA, 19 nt, Homo sapiens
gugcuccucuggccucagu

SEQ ID NO: 421774 - RNA, 19 nt, Homo sapiens
gcagagcuucguugauggu

SEQ ID NO: 421775 - RNA, 19 nt, Homo sapiens
agaaacugaaggagaagaa

SEQ ID NO: 421776 - RNA, 19 nt, Homo sapiens
gacaccaucgagaaacuga

SEQ ID NO: 421777 - RNA, 19 nt, Homo sapiens
ccucaguucuccucuuuug

SEQ ID NO: 421778 - RNA, 19 nt, Homo sapiens
ggccagcugcucuaauauc

SEQ ID NO: 421779 - RNA, 19 nt, Homo sapiens
gaaacugaaggagaagaag

SEQ ID NO: 421780 - RNA, 19 nt, Homo sapiens
cuauucagccaaugugaug

SEQ ID NO: 421781 - RNA, 19 nt, Homo sapiens
gagaaacugaaggagaaga

SEQ ID NO: 421782 - RNA, 19 nt, Homo sapiens
gcccagccucuuaugagaa

SEQ ID NO: 421783 - RNA, 19 nt, Homo sapiens
gagauuggcucugugaaau

SEQ ID NO: 421784 - RNA, 19 nt, Homo sapiens
ggagauuggcucugugaaa

SEQ ID NO: 421785 - RNA, 19 nt, Homo sapiens
aaacugacgucuuucugau

SEQ ID NO: 421786 - RNA, 19 nt, Homo sapiens
caaacugacgucuuucuga

SEQ ID NO: 421787 - RNA, 19 nt, Homo sapiens
gauuggcucugugaaauac

SEQ ID NO: 421788 - RNA, 19 nt, Homo sapiens
gaagacaugcuugcugauc

SEQ ID NO: 421789 - RNA, 19 nt, Homo sapiens
cgggaaaccagucaacuug

SEQ ID NO: 421790 - RNA, 19 nt, Homo sapiens
aagacaugcuugcugauca

SEQ ID NO: 421791 - RNA, 19 nt, Homo sapiens
agauuggcucugugaaaua

SEQ ID NO: 421792 - RNA, 19 nt, Homo sapiens
cgacgacaaggacaccauu

SEQ ID NO: 421793 - RNA, 19 nt, Homo sapiens
cgacaaggacaccauugag

SEQ ID NO: 421794 - RNA, 19 nt, Homo sapiens
cagcgggucaggaggacua

SEQ ID NO: 421795 - RNA, 19 nt, Homo sapiens
gccugaagacaguguuuga

SEQ ID NO: 421796 - RNA, 19 nt, Homo sapiens
ccaugcaggccaucaagug

SEQ ID NO: 421797 - RNA, 19 nt, Homo sapiens
ggacgggaaaccagucaac

SEQ ID NO: 421798 - RNA, 19 nt, Homo sapiens
ucagcaaacuugaaucuua

SEQ ID NO: 421799 - RNA, 19 nt, Homo sapiens
gacauugacucuuacauga

SEQ ID NO: 421800 - RNA, 19 nt, Homo sapiens
ggugaaggcugaaccaaga

SEQ ID NO: 421801 - RNA, 19 nt, Homo sapiens
ccaaagccauggugacuga

SEQ ID NO: 421802 - RNA, 19 nt, Homo sapiens
gaauccagcuuugaccuuu

SEQ ID NO: 421803 - RNA, 19 nt, Homo sapiens
gcuguaagauccugaugaa

SEQ ID NO: 421804 - RNA, 19 nt, Homo sapiens
ggaaaccacuauaggcaau

SEQ ID NO: 421805 - RNA, 19 nt, Homo sapiens
gaugaagucuuuccugucu

SEQ ID NO: 421806 - RNA, 19 nt, Homo sapiens
ccguggagcugacaaguuu

SEQ ID NO: 421807 - RNA, 19 nt, Homo sapiens
ggacgcugcuauugauuca

SEQ ID NO: 421808 - RNA, 19 nt, Homo sapiens
gcgcugacuuggaauucua

SEQ ID NO: 421809 - RNA, 19 nt, Homo sapiens
guaagauccugaugaaguc

SEQ ID NO: 421810 - RNA, 19 nt, Homo sapiens
gcccugaacuacugacguu

SEQ ID NO: 421811 - RNA, 19 nt, Homo sapiens
cagcaaacuugaaucuuag

SEQ ID NO: 421812 - RNA, 19 nt, Homo sapiens
gaaguuccgcucacuguuc

SEQ ID NO: 421813 - RNA, 19 nt, Homo sapiens
gaagugacgcugggcauug

SEQ ID NO: 421814 - RNA, 19 nt, Homo sapiens
ggacuggacgcugcuauug

SEQ ID NO: 421815 - RNA, 19 nt, Homo sapiens
ggcagugucuuagauguga

SEQ ID NO: 421816 - RNA, 19 nt, Homo sapiens
guuccuaccucuuauuucu

SEQ ID NO: 421817 - RNA, 19 nt, Homo sapiens
cgacauugacucuuacaug

SEQ ID NO: 421818 - RNA, 19 nt, Homo sapiens
augacgacauugacucuua

SEQ ID NO: 421819 - RNA, 19 nt, Homo sapiens
ggagagcugggcaguguug

SEQ ID NO: 421820 - RNA, 19 nt, Homo sapiens
uuuccuugcuuuccugaua

SEQ ID NO: 421821 - RNA, 19 nt, Homo sapiens
ccagaggccuuggacuaga

SEQ ID NO: 421822 - RNA, 19 nt, Homo sapiens
cggacgacuuugccaauga

SEQ ID NO: 421823 - RNA, 19 nt, Homo sapiens
ugaagucuuuccugucugu

SEQ ID NO: 421824 - RNA, 19 nt, Homo sapiens
cagcuucucugccaaucau

SEQ ID NO: 421825 - RNA, 19 nt, Homo sapiens
ucaggacuuuccagacuug

SEQ ID NO: 421826 - RNA, 19 nt, Homo sapiens
cauugacucuuacaugauc

SEQ ID NO: 421827 - RNA, 19 nt, Homo sapiens
ggacgagcucuaccuggaa

SEQ ID NO: 421828 - RNA, 19 nt, Homo sapiens
acgcugcuauugauucauu

SEQ ID NO: 421829 - RNA, 19 nt, Homo sapiens
aauccagcuuugaccuuua

SEQ ID NO: 421830 - RNA, 19 nt, Homo sapiens
ugacguuccuaccucuuau

SEQ ID NO: 421831 - RNA, 19 nt, Homo sapiens
aaaccacuauaggcaauga

SEQ ID NO: 421832 - RNA, 19 nt, Homo sapiens
uguaagauccugaugaagu

SEQ ID NO: 421833 - RNA, 19 nt, Homo sapiens
gccaggcagugucuuagau

SEQ ID NO: 421834 - RNA, 19 nt, Homo sapiens
aaucaggacuuuccagacu

SEQ ID NO: 421835 - RNA, 19 nt, Homo sapiens
ggacgacuuugccaaugac

SEQ ID NO: 421836 - RNA, 19 nt, Homo sapiens
gaccugcugcgcuguaaga

SEQ ID NO: 421837 - RNA, 19 nt, Homo sapiens
gcagagucagcaaacuuga

SEQ ID NO: 421838 - RNA, 19 nt, Homo sapiens
ccaagaaguuccgcucacu

SEQ ID NO: 421839 - RNA, 19 nt, Homo sapiens
gccuaugccugcuuucucu

SEQ ID NO: 421840 - RNA, 19 nt, Homo sapiens
gacuggacgcugcuauuga

SEQ ID NO: 421841 - RNA, 19 nt, Homo sapiens
cagcuuugaccuuuauuca

SEQ ID NO: 421842 - RNA, 19 nt, Homo sapiens
uggcgagaauccagcuuug

SEQ ID NO: 421843 - RNA, 19 nt, Homo sapiens
cuuuggcgcugacuuggaa

SEQ ID NO: 421844 - RNA, 19 nt, Homo sapiens
acuggacgcugcuauugau

SEQ ID NO: 421845 - RNA, 19 nt, Homo sapiens
gggacuggacgcugcuauu

SEQ ID NO: 421846 - RNA, 19 nt, Homo sapiens
ugacuuggaauucuaagag

SEQ ID NO: 421847 - RNA, 19 nt, Homo sapiens
ugacgacauugacucuuac

SEQ ID NO: 421848 - RNA, 19 nt, Homo sapiens
cggaggccauggcgagaau

SEQ ID NO: 421849 - RNA, 19 nt, Homo sapiens
caggcagugucuuagaugu

SEQ ID NO: 421850 - RNA, 19 nt, Homo sapiens
ucagaaaggugggcuugcu

SEQ ID NO: 421851 - RNA, 19 nt, Homo sapiens
ccugagcuuugcagaguca

SEQ ID NO: 421852 - RNA, 19 nt, Homo sapiens
uaccucuuauuucucauug

SEQ ID NO: 421853 - RNA, 19 nt, Homo sapiens
cacuggcgaugcuggagaa

SEQ ID NO: 421854 - RNA, 19 nt, Homo sapiens
uaugccugcuuucucuuug

SEQ ID NO: 421855 - RNA, 19 nt, Homo sapiens
gcugcuauugauucauuaa

SEQ ID NO: 421856 - RNA, 19 nt, Homo sapiens
agauccugaugaagucuuu

SEQ ID NO: 421857 - RNA, 19 nt, Homo sapiens
cugacguuccuaccucuua

SEQ ID NO: 421858 - RNA, 19 nt, Homo sapiens
cagacuuggcccugaacua

SEQ ID NO: 421859 - RNA, 19 nt, Homo sapiens
acccagaggccuuggacua

SEQ ID NO: 421860 - RNA, 19 nt, Homo sapiens
gaaaccacuauaggcaaug

SEQ ID NO: 421861 - RNA, 19 nt, Homo sapiens
cagagucagcaaacuugaa

SEQ ID NO: 421862 - RNA, 19 nt, Homo sapiens
cuccugagcuuugcagagu

SEQ ID NO: 421863 - RNA, 19 nt, Homo sapiens
gugaauaacucaagucaua

SEQ ID NO: 421864 - RNA, 19 nt, Homo sapiens
gaaucaagcuuccauaugu

SEQ ID NO: 421865 - RNA, 19 nt, Homo sapiens
gcaaagauguuucucuguu

SEQ ID NO: 421866 - RNA, 19 nt, Homo sapiens
caacaaagcccgaggauau

SEQ ID NO: 421867 - RNA, 19 nt, Homo sapiens
acacaugccuggagacuua

SEQ ID NO: 421868 - RNA, 19 nt, Homo sapiens
cuacauagauuucuucaug

SEQ ID NO: 421869 - RNA, 19 nt, Homo sapiens
ccaaagaaauucaggaaga

SEQ ID NO: 421870 - RNA, 19 nt, Homo sapiens
gaauugcugucgaaaguuu

SEQ ID NO: 421871 - RNA, 19 nt, Homo sapiens
caaauagaauugccugauu

SEQ ID NO: 421872 - RNA, 19 nt, Homo sapiens
aaacucagcuauugccaua

SEQ ID NO: 421873 - RNA, 19 nt, Homo sapiens
ggaaauugaugauauugug

SEQ ID NO: 421874 - RNA, 19 nt, Homo sapiens
uaaacugugugccuuauuu

SEQ ID NO: 421875 - RNA, 19 nt, Homo sapiens
gaagauaauucugguugaa

SEQ ID NO: 421876 - RNA, 19 nt, Homo sapiens
caaagauguuucucuguuu

SEQ ID NO: 421877 - RNA, 19 nt, Homo sapiens
gcaagugaauucaugguau

SEQ ID NO: 421878 - RNA, 19 nt, Homo sapiens
ggaagaguguucuaucuca

SEQ ID NO: 421879 - RNA, 19 nt, Homo sapiens
guacaagaguggauuaauc

SEQ ID NO: 421880 - RNA, 19 nt, Homo sapiens
gaaagacaacgaccuuaaa

SEQ ID NO: 421881 - RNA, 19 nt, Homo sapiens
caaagaguuucuacuaaga

SEQ ID NO: 421882 - RNA, 19 nt, Homo sapiens
ggaaagacaacgaccuuaa

SEQ ID NO: 421883 - RNA, 19 nt, Homo sapiens
gcggagggcugaacaaugu

SEQ ID NO: 421884 - RNA, 19 nt, Homo sapiens
ccucagugguuucuaauaa

SEQ ID NO: 421885 - RNA, 19 nt, Homo sapiens
aaccauggguggauaaaua

SEQ ID NO: 421886 - RNA, 19 nt, Homo sapiens
gaacagauuuaugguuuag

SEQ ID NO: 421887 - RNA, 19 nt, Homo sapiens
cagggaacauggaaugaua

SEQ ID NO: 421888 - RNA, 19 nt, Homo sapiens
ccagugaauuucugaguuu

SEQ ID NO: 421889 - RNA, 19 nt, Homo sapiens
uaacucaagucauagaaga

SEQ ID NO: 421890 - RNA, 19 nt, Homo sapiens
uaagagcgacaaaguauaa

SEQ ID NO: 421891 - RNA, 19 nt, Homo sapiens
gggaaauacuggaaaugaa

SEQ ID NO: 421892 - RNA, 19 nt, Homo sapiens
gagcaucuuuaacagaauu

SEQ ID NO: 421893 - RNA, 19 nt, Homo sapiens
caagugaauucaugguauu

SEQ ID NO: 421894 - RNA, 19 nt, Homo sapiens
gaagccagccugcuaauca

SEQ ID NO: 421895 - RNA, 19 nt, Homo sapiens
gaucaagccuucaaaucuc

SEQ ID NO: 421896 - RNA, 19 nt, Homo sapiens
ccuggagacuuauuuaauu

SEQ ID NO: 421897 - RNA, 19 nt, Homo sapiens
cgacaaaguauaacaaguu

SEQ ID NO: 421898 - RNA, 19 nt, Homo sapiens
cagaauugcugucgaaagu

SEQ ID NO: 421899 - RNA, 19 nt, Homo sapiens
gaaaccuacucuucuguca

SEQ ID NO: 421900 - RNA, 19 nt, Homo sapiens
gaagaguguucuaucucaa

SEQ ID NO: 421901 - RNA, 19 nt, Homo sapiens
ggagcaugguauucaagua

SEQ ID NO: 421902 - RNA, 19 nt, Homo sapiens
ucaaagaguuucuacuaag

SEQ ID NO: 421903 - RNA, 19 nt, Homo sapiens
gcucuuuacucagggaaua

SEQ ID NO: 421904 - RNA, 19 nt, Homo sapiens
cgggauacauuacuuguug

SEQ ID NO: 421905 - RNA, 19 nt, Homo sapiens
guaaaguaguccaguauac

SEQ ID NO: 421906 - RNA, 19 nt, Homo sapiens
ucgauguccucuuauauuu

SEQ ID NO: 421907 - RNA, 19 nt, Homo sapiens
agauuuaccuaaccaguuu

SEQ ID NO: 421908 - RNA, 19 nt, Homo sapiens
gagaacugauaagaagaua

SEQ ID NO: 421909 - RNA, 19 nt, Homo sapiens
gauaucagaagugcaauaa

SEQ ID NO: 421910 - RNA, 19 nt, Homo sapiens
gcaccaacaauuaugauga

SEQ ID NO: 421911 - RNA, 19 nt, Homo sapiens
ggaaguaugugaggauugg

SEQ ID NO: 421912 - RNA, 19 nt, Homo sapiens
aaacaggguggaucuauuu

SEQ ID NO: 421913 - RNA, 19 nt, Homo sapiens
ccaguauacuuuccaaugu

SEQ ID NO: 421914 - RNA, 19 nt, Homo sapiens
caguauacuuuccaaugua

SEQ ID NO: 421915 - RNA, 19 nt, Homo sapiens
gaugaucugagaacugaua

SEQ ID NO: 421916 - RNA, 19 nt, Homo sapiens
uaucagaagugcaauaaac

SEQ ID NO: 421917 - RNA, 19 nt, Homo sapiens
ggguggaucuauuuuauua

SEQ ID NO: 421918 - RNA, 19 nt, Homo sapiens
ugugagagccagugaauuu

SEQ ID NO: 421919 - RNA, 19 nt, Homo sapiens
cgaaaugaaucagguaaca

SEQ ID NO: 421920 - RNA, 19 nt, Homo sapiens
ccggaaaccuggucucuuc

SEQ ID NO: 421921 - RNA, 19 nt, Homo sapiens
gaagcgacacuuuggaaga

SEQ ID NO: 421922 - RNA, 19 nt, Homo sapiens
cgagaggugugaugcauuc

SEQ ID NO: 421923 - RNA, 19 nt, Homo sapiens
cagaugcugugcugucaaa

SEQ ID NO: 421924 - RNA, 19 nt, Homo sapiens
caccaacaauuaugaugaa

SEQ ID NO: 421925 - RNA, 19 nt, Homo sapiens
caaaggagcaugguauuca

SEQ ID NO: 421926 - RNA, 19 nt, Homo sapiens
gaacgggauacauuacuug

SEQ ID NO: 421927 - RNA, 19 nt, Homo sapiens
gaaauacuggaaaugaaga

SEQ ID NO: 421928 - RNA, 19 nt, Homo sapiens
uaacaagaauggaggaaaa

SEQ ID NO: 421929 - RNA, 19 nt, Homo sapiens
gaucugagaacugauaaga

SEQ ID NO: 421930 - RNA, 19 nt, Homo sapiens
gaauaacucaagucauaga

SEQ ID NO: 421931 - RNA, 19 nt, Homo sapiens
aguggcgucucuacuauua

SEQ ID NO: 421932 - RNA, 19 nt, Homo sapiens
ccaaauaucaagaugugaa

SEQ ID NO: 421933 - RNA, 19 nt, Homo sapiens
augaagaccugcaacugua

SEQ ID NO: 421934 - RNA, 19 nt, Homo sapiens
ccuccaaacuguaaaguag

SEQ ID NO: 421935 - RNA, 19 nt, Homo sapiens
gaaaccuggucucuuccuu

SEQ ID NO: 421936 - RNA, 19 nt, Homo sapiens
guuauuguuucccaaagaa

SEQ ID NO: 421937 - RNA, 19 nt, Homo sapiens
uacaugaaguucuaaggaa

SEQ ID NO: 421938 - RNA, 19 nt, Homo sapiens
caaguacaagaguggauua

SEQ ID NO: 421939 - RNA, 19 nt, Homo sapiens
ggacgaaaugaaucaggua

SEQ ID NO: 421940 - RNA, 19 nt, Homo sapiens
aaucagaauugcugucgaa

SEQ ID NO: 421941 - RNA, 19 nt, Homo sapiens
ggaaauacuggaaaugaag

SEQ ID NO: 421942 - RNA, 19 nt, Homo sapiens
uuaaaucugugagugguuu

SEQ ID NO: 421943 - RNA, 19 nt, Homo sapiens
cauagaagccagccugcua

SEQ ID NO: 421944 - RNA, 19 nt, Homo sapiens
ccuccaaacucagcuauug

SEQ ID NO: 421945 - RNA, 19 nt, Homo sapiens
aauacacgcucuuuacuca

SEQ ID NO: 421946 - RNA, 19 nt, Homo sapiens
caacuuacggccaaggaaa

SEQ ID NO: 421947 - RNA, 19 nt, Homo sapiens
ucugagaacugauaagaag

SEQ ID NO: 421948 - RNA, 19 nt, Homo sapiens
cuacuucacagcuucauuu

SEQ ID NO: 421949 - RNA, 19 nt, Homo sapiens
ggagguaguagaaauguca

SEQ ID NO: 421950 - RNA, 19 nt, Homo sapiens
caaagaaauucaggaagag

SEQ ID NO: 421951 - RNA, 19 nt, Homo sapiens
gccuucaaaucucuuaauu

SEQ ID NO: 421952 - RNA, 19 nt, Homo sapiens
gccagugaauuucugaguu

SEQ ID NO: 421953 - RNA, 19 nt, Homo sapiens
ccucucauuuaucagaaua

SEQ ID NO: 421954 - RNA, 19 nt, Homo sapiens
caagagguccaagcuauug

SEQ ID NO: 421955 - RNA, 19 nt, Homo sapiens
ucgggauucucauacuuua

SEQ ID NO: 421956 - RNA, 19 nt, Homo sapiens
uacaaaugcuuggagauga

SEQ ID NO: 421957 - RNA, 19 nt, Homo sapiens
ugaacuugcugugcauaaa

SEQ ID NO: 421958 - RNA, 19 nt, Homo sapiens
gaaaggggccaagauuaua

SEQ ID NO: 421959 - RNA, 19 nt, Homo sapiens
gaaacgucacagucucuaa

SEQ ID NO: 421960 - RNA, 19 nt, Homo sapiens
gaaaugaagaccugcaacu

SEQ ID NO: 421961 - RNA, 19 nt, Homo sapiens
aaacugugugccuuauuua

SEQ ID NO: 421962 - RNA, 19 nt, Homo sapiens
cuacucuucugucaucuug

SEQ ID NO: 421963 - RNA, 19 nt, Homo sapiens
gugaauaacucaagucaua

SEQ ID NO: 421964 - RNA, 19 nt, Homo sapiens
gaaucaagcuuccauaugu

SEQ ID NO: 421965 - RNA, 19 nt, Homo sapiens
gcaaagauguuucucuguu

SEQ ID NO: 421966 - RNA, 19 nt, Homo sapiens
caacaaagcccgaggauau

SEQ ID NO: 421967 - RNA, 19 nt, Homo sapiens
acacaugccuggagacuua

SEQ ID NO: 421968 - RNA, 19 nt, Homo sapiens
ggaaacaagugaauucaug

SEQ ID NO: 421969 - RNA, 19 nt, Homo sapiens
cuacauagauuucuucaug

SEQ ID NO: 421970 - RNA, 19 nt, Homo sapiens
ccaaagaaauucaggaaga

SEQ ID NO: 421971 - RNA, 19 nt, Homo sapiens
gaauugcugucgaaaguuu

SEQ ID NO: 421972 - RNA, 19 nt, Homo sapiens
caaauagaauugccugauu

SEQ ID NO: 421973 - RNA, 19 nt, Homo sapiens
aaacucagcuauugccaua

SEQ ID NO: 421974 - RNA, 19 nt, Homo sapiens
ggaaauugaugauauugug

SEQ ID NO: 421975 - RNA, 19 nt, Homo sapiens
uaaacugugugccuuauuu

SEQ ID NO: 421976 - RNA, 19 nt, Homo sapiens
gaagauaauucugguugaa

SEQ ID NO: 421977 - RNA, 19 nt, Homo sapiens
caaagauguuucucuguuu

SEQ ID NO: 421978 - RNA, 19 nt, Homo sapiens
ggaagaguguucuaucuca

SEQ ID NO: 421979 - RNA, 19 nt, Homo sapiens
guacaagaguggauuaauc

SEQ ID NO: 421980 - RNA, 19 nt, Homo sapiens
gaaagacaacgaccuuaaa

SEQ ID NO: 421981 - RNA, 19 nt, Homo sapiens
caaagaguuucuacuaaga

SEQ ID NO: 421982 - RNA, 19 nt, Homo sapiens
ggaaagacaacgaccuuaa

SEQ ID NO: 421983 - RNA, 19 nt, Homo sapiens
ccucagugguuucuaauaa

SEQ ID NO: 421984 - RNA, 19 nt, Homo sapiens
aaccauggguggauaaaua

SEQ ID NO: 421985 - RNA, 19 nt, Homo sapiens
gaacagauuuaugguuuag

SEQ ID NO: 421986 - RNA, 19 nt, Homo sapiens
cagggaacauggaaugaua

SEQ ID NO: 421987 - RNA, 19 nt, Homo sapiens
ccagugaauuucugaguuu

SEQ ID NO: 421988 - RNA, 19 nt, Homo sapiens
uaacucaagucauagaaga

SEQ ID NO: 421989 - RNA, 19 nt, Homo sapiens
uaagagcgacaaaguauaa

SEQ ID NO: 421990 - RNA, 19 nt, Homo sapiens
gggaaauacuggaaaugaa

SEQ ID NO: 421991 - RNA, 19 nt, Homo sapiens
gagcaucuuuaacagaauu

SEQ ID NO: 421992 - RNA, 19 nt, Homo sapiens
caagugaauucaugguauu

SEQ ID NO: 421993 - RNA, 19 nt, Homo sapiens
gaagccagccugcuaauca

SEQ ID NO: 421994 - RNA, 19 nt, Homo sapiens
gaucaagccuucaaaucuc

SEQ ID NO: 421995 - RNA, 19 nt, Homo sapiens
ccuggagacuuauuuaauu

SEQ ID NO: 421996 - RNA, 19 nt, Homo sapiens
cgacaaaguauaacaaguu

SEQ ID NO: 421997 - RNA, 19 nt, Homo sapiens
cagaauugcugucgaaagu

SEQ ID NO: 421998 - RNA, 19 nt, Homo sapiens
ccaaagguaucuuccacaa

SEQ ID NO: 421999 - RNA, 19 nt, Homo sapiens
cuacggaugggaacuauua

SEQ ID NO: 422000 - RNA, 19 nt, Homo sapiens
gaaaccuacucuucuguca

SEQ ID NO: 422001 - RNA, 19 nt, Homo sapiens
gaagaguguucuaucucaa

SEQ ID NO: 422002 - RNA, 19 nt, Homo sapiens
ggagcaugguauucaagua

SEQ ID NO: 422003 - RNA, 19 nt, Homo sapiens
aaagguaucuuccacaaag

SEQ ID NO: 422004 - RNA, 19 nt, Homo sapiens
gacaaaaggugaauuauag

SEQ ID NO: 422005 - RNA, 19 nt, Homo sapiens
ucaaagaguuucuacuaag

SEQ ID NO: 422006 - RNA, 19 nt, Homo sapiens
gcucuuuacucagggaaua

SEQ ID NO: 422007 - RNA, 19 nt, Homo sapiens
cgggauacauuacuuguug

SEQ ID NO: 422008 - RNA, 19 nt, Homo sapiens
ucgauguccucuuauauuu

SEQ ID NO: 422009 - RNA, 19 nt, Homo sapiens
agauuuaccuaaccaguuu

SEQ ID NO: 422010 - RNA, 19 nt, Homo sapiens
gagaacugauaagaagaua

SEQ ID NO: 422011 - RNA, 19 nt, Homo sapiens
gauaucagaagugcaauaa

SEQ ID NO: 422012 - RNA, 19 nt, Homo sapiens
gcaccaacaauuaugauga

SEQ ID NO: 422013 - RNA, 19 nt, Homo sapiens
ggaaguaugugaggauugg

SEQ ID NO: 422014 - RNA, 19 nt, Homo sapiens
aaacaggguggaucuauuu

SEQ ID NO: 422015 - RNA, 19 nt, Homo sapiens
ccagguggcugcccuuuca

SEQ ID NO: 422016 - RNA, 19 nt, Homo sapiens
gaugaucugagaacugaua

SEQ ID NO: 422017 - RNA, 19 nt, Homo sapiens
uaucagaagugcaauaaac

SEQ ID NO: 422018 - RNA, 19 nt, Homo sapiens
ggguggaucuauuuuauua

SEQ ID NO: 422019 - RNA, 19 nt, Homo sapiens
ugugagagccagugaauuu

SEQ ID NO: 422020 - RNA, 19 nt, Homo sapiens
cgaaaugaaucagguaaca

SEQ ID NO: 422021 - RNA, 19 nt, Homo sapiens
ccggaaaccuggucucuuc

SEQ ID NO: 422022 - RNA, 19 nt, Homo sapiens
gaagcgacacuuuggaaga

SEQ ID NO: 422023 - RNA, 19 nt, Homo sapiens
cgagaggugugaugcauuc

SEQ ID NO: 422024 - RNA, 19 nt, Homo sapiens
cagaugcugugcugucaaa

SEQ ID NO: 422025 - RNA, 19 nt, Homo sapiens
caccaacaauuaugaugaa

SEQ ID NO: 422026 - RNA, 19 nt, Homo sapiens
caaaggagcaugguauuca

SEQ ID NO: 422027 - RNA, 19 nt, Homo sapiens
gaacgggauacauuacuug

SEQ ID NO: 422028 - RNA, 19 nt, Homo sapiens
gaaauacuggaaaugaaga

SEQ ID NO: 422029 - RNA, 19 nt, Homo sapiens
uaacaagaauggaggaaaa

SEQ ID NO: 422030 - RNA, 19 nt, Homo sapiens
gaucugagaacugauaaga

SEQ ID NO: 422031 - RNA, 19 nt, Homo sapiens
gaauaacucaagucauaga

SEQ ID NO: 422032 - RNA, 19 nt, Homo sapiens
aguggcgucucuacuauua

SEQ ID NO: 422033 - RNA, 19 nt, Homo sapiens
ccaaauaucaagaugugaa

SEQ ID NO: 422034 - RNA, 19 nt, Homo sapiens
augaagaccugcaacugua

SEQ ID NO: 422035 - RNA, 19 nt, Homo sapiens
gaaaccuggucucuuccuu

SEQ ID NO: 422036 - RNA, 19 nt, Homo sapiens
guuauuguuucccaaagaa

SEQ ID NO: 422037 - RNA, 19 nt, Homo sapiens
uacaugaaguucuaaggaa

SEQ ID NO: 422038 - RNA, 19 nt, Homo sapiens
ggaaauacuggaaaugaag

SEQ ID NO: 422039 - RNA, 19 nt, Homo sapiens
acaagugaauucaugguau

SEQ ID NO: 422040 - RNA, 19 nt, Homo sapiens
caaguacaagaguggauua

SEQ ID NO: 422041 - RNA, 19 nt, Homo sapiens
ggacgaaaugaaucaggua

SEQ ID NO: 422042 - RNA, 19 nt, Homo sapiens
aaucagaauugcugucgaa

SEQ ID NO: 422043 - RNA, 19 nt, Homo sapiens
uuaaaucugugagugguuu

SEQ ID NO: 422044 - RNA, 19 nt, Homo sapiens
cauagaagccagccugcua

SEQ ID NO: 422045 - RNA, 19 nt, Homo sapiens
aauacacgcucuuuacuca

SEQ ID NO: 422046 - RNA, 19 nt, Homo sapiens
caacuuacggccaaggaaa

SEQ ID NO: 422047 - RNA, 19 nt, Homo sapiens
ucugagaacugauaagaag

SEQ ID NO: 422048 - RNA, 19 nt, Homo sapiens
cuacuucacagcuucauuu

SEQ ID NO: 422049 - RNA, 19 nt, Homo sapiens
ggagguaguagaaauguca

SEQ ID NO: 422050 - RNA, 19 nt, Homo sapiens
caaagaaauucaggaagag

SEQ ID NO: 422051 - RNA, 19 nt, Homo sapiens
gccuucaaaucucuuaauu

SEQ ID NO: 422052 - RNA, 19 nt, Homo sapiens
gccagugaauuucugaguu

SEQ ID NO: 422053 - RNA, 19 nt, Homo sapiens
gaaaugaagaccugcaacu

SEQ ID NO: 422054 - RNA, 19 nt, Homo sapiens
ccucucauuuaucagaaua

SEQ ID NO: 422055 - RNA, 19 nt, Homo sapiens
caagagguccaagcuauug

SEQ ID NO: 422056 - RNA, 19 nt, Homo sapiens
ucgggauucucauacuuua

SEQ ID NO: 422057 - RNA, 19 nt, Homo sapiens
uacaaaugcuuggagauga

SEQ ID NO: 422058 - RNA, 19 nt, Homo sapiens
ugaacuugcugugcauaaa

SEQ ID NO: 422059 - RNA, 19 nt, Homo sapiens
gaaaggggccaagauuaua

SEQ ID NO: 422060 - RNA, 19 nt, Homo sapiens
aaacugugugccuuauuua

SEQ ID NO: 422061 - RNA, 19 nt, Homo sapiens
cuacucuucugucaucuug

SEQ ID NO: 422062 - RNA, 19 nt, Homo sapiens
gccauaccuugcucuacua

SEQ ID NO: 422063 - RNA, 19 nt, Homo sapiens
gugaauaacucaagucaua

SEQ ID NO: 422064 - RNA, 19 nt, Homo sapiens
gaaucaagcuuccauaugu

SEQ ID NO: 422065 - RNA, 19 nt, Homo sapiens
gcaaagauguuucucuguu

SEQ ID NO: 422066 - RNA, 19 nt, Homo sapiens
caacaaagcccgaggauau

SEQ ID NO: 422067 - RNA, 19 nt, Homo sapiens
acacaugccuggagacuua

SEQ ID NO: 422068 - RNA, 19 nt, Homo sapiens
cuacauagauuucuucaug

SEQ ID NO: 422069 - RNA, 19 nt, Homo sapiens
ccaaagaaauucaggaaga

SEQ ID NO: 422070 - RNA, 19 nt, Homo sapiens
aaacucagcuauugccaua

SEQ ID NO: 422071 - RNA, 19 nt, Homo sapiens
ggaaauugaugauauugug

SEQ ID NO: 422072 - RNA, 19 nt, Homo sapiens
uaaacugugugccuuauuu

SEQ ID NO: 422073 - RNA, 19 nt, Homo sapiens
gaagauaauucugguugaa

SEQ ID NO: 422074 - RNA, 19 nt, Homo sapiens
caaagauguuucucuguuu

SEQ ID NO: 422075 - RNA, 19 nt, Homo sapiens
ggaagaguguucuaucuca

SEQ ID NO: 422076 - RNA, 19 nt, Homo sapiens
guacaagaguggauuaauc

SEQ ID NO: 422077 - RNA, 19 nt, Homo sapiens
gaaagacaacgaccuuaaa

SEQ ID NO: 422078 - RNA, 19 nt, Homo sapiens
caaagaguuucuacuaaga

SEQ ID NO: 422079 - RNA, 19 nt, Homo sapiens
ggaaagacaacgaccuuaa

SEQ ID NO: 422080 - RNA, 19 nt, Homo sapiens
ccucagugguuucuaauaa

SEQ ID NO: 422081 - RNA, 19 nt, Homo sapiens
aaccauggguggauaaaua

SEQ ID NO: 422082 - RNA, 19 nt, Homo sapiens
gaacagauuuaugguuuag

SEQ ID NO: 422083 - RNA, 19 nt, Homo sapiens
cagggaacauggaaugaua

SEQ ID NO: 422084 - RNA, 19 nt, Homo sapiens
ccagugaauuucugaguuu

SEQ ID NO: 422085 - RNA, 19 nt, Homo sapiens
uaacucaagucauagaaga

SEQ ID NO: 422086 - RNA, 19 nt, Homo sapiens
uaagagcgacaaaguauaa

SEQ ID NO: 422087 - RNA, 19 nt, Homo sapiens
gagcaucuuuaacagaauu

SEQ ID NO: 422088 - RNA, 19 nt, Homo sapiens
gaagccagccugcuaauca

SEQ ID NO: 422089 - RNA, 19 nt, Homo sapiens
gaucaagccuucaaaucuc

SEQ ID NO: 422090 - RNA, 19 nt, Homo sapiens
ccuggagacuuauuuaauu

SEQ ID NO: 422091 - RNA, 19 nt, Homo sapiens
ccaaagguaucuuccacaa

SEQ ID NO: 422092 - RNA, 19 nt, Homo sapiens
cgacaaaguauaacaaguu

SEQ ID NO: 422093 - RNA, 19 nt, Homo sapiens
cuacggaugggaacuauua

SEQ ID NO: 422094 - RNA, 19 nt, Homo sapiens
gaaaccuacucuucuguca

SEQ ID NO: 422095 - RNA, 19 nt, Homo sapiens
aaagguaucuuccacaaag

SEQ ID NO: 422096 - RNA, 19 nt, Homo sapiens
gaagaguguucuaucucaa

SEQ ID NO: 422097 - RNA, 19 nt, Homo sapiens
ggagcaugguauucaagua

SEQ ID NO: 422098 - RNA, 19 nt, Homo sapiens
ucaaagaguuucuacuaag

SEQ ID NO: 422099 - RNA, 19 nt, Homo sapiens
gcucuuuacucagggaaua

SEQ ID NO: 422100 - RNA, 19 nt, Homo sapiens
cgggauacauuacuuguug

SEQ ID NO: 422101 - RNA, 19 nt, Homo sapiens
ucgauguccucuuauauuu

SEQ ID NO: 422102 - RNA, 19 nt, Homo sapiens
agauuuaccuaaccaguuu

SEQ ID NO: 422103 - RNA, 19 nt, Homo sapiens
gagaacugauaagaagaua

SEQ ID NO: 422104 - RNA, 19 nt, Homo sapiens
gauaucagaagugcaauaa

SEQ ID NO: 422105 - RNA, 19 nt, Homo sapiens
gcaccaacaauuaugauga

SEQ ID NO: 422106 - RNA, 19 nt, Homo sapiens
ggaaguaugugaggauugg

SEQ ID NO: 422107 - RNA, 19 nt, Homo sapiens
aaacaggguggaucuauuu

SEQ ID NO: 422108 - RNA, 19 nt, Homo sapiens
gaugaucugagaacugaua

SEQ ID NO: 422109 - RNA, 19 nt, Homo sapiens
uaucagaagugcaauaaac

SEQ ID NO: 422110 - RNA, 19 nt, Homo sapiens
ggguggaucuauuuuauua

SEQ ID NO: 422111 - RNA, 19 nt, Homo sapiens
ugugagagccagugaauuu

SEQ ID NO: 422112 - RNA, 19 nt, Homo sapiens
ccggaaaccuggucucuuc

SEQ ID NO: 422113 - RNA, 19 nt, Homo sapiens
gaagcgacacuuuggaaga

SEQ ID NO: 422114 - RNA, 19 nt, Homo sapiens
cgagaggugugaugcauuc

SEQ ID NO: 422115 - RNA, 19 nt, Homo sapiens
cagaugcugugcugucaaa

SEQ ID NO: 422116 - RNA, 19 nt, Homo sapiens
caccaacaauuaugaugaa

SEQ ID NO: 422117 - RNA, 19 nt, Homo sapiens
caaaggagcaugguauuca

SEQ ID NO: 422118 - RNA, 19 nt, Homo sapiens
gaacgggauacauuacuug

SEQ ID NO: 422119 - RNA, 19 nt, Homo sapiens
uaacaagaauggaggaaaa

SEQ ID NO: 422120 - RNA, 19 nt, Homo sapiens
gaucugagaacugauaaga

SEQ ID NO: 422121 - RNA, 19 nt, Homo sapiens
aguggcgucucuacuauua

SEQ ID NO: 422122 - RNA, 19 nt, Homo sapiens
gaauaacucaagucauaga

SEQ ID NO: 422123 - RNA, 19 nt, Homo sapiens
ccaaauaucaagaugugaa

SEQ ID NO: 422124 - RNA, 19 nt, Homo sapiens
gaaaccuggucucuuccuu

SEQ ID NO: 422125 - RNA, 19 nt, Homo sapiens
guuauuguuucccaaagaa

SEQ ID NO: 422126 - RNA, 19 nt, Homo sapiens
uacaugaaguucuaaggaa

SEQ ID NO: 422127 - RNA, 19 nt, Homo sapiens
caaguacaagaguggauua

SEQ ID NO: 422128 - RNA, 19 nt, Homo sapiens
uuaaaucugugagugguuu

SEQ ID NO: 422129 - RNA, 19 nt, Homo sapiens
cauagaagccagccugcua

SEQ ID NO: 422130 - RNA, 19 nt, Homo sapiens
aauacacgcucuuuacuca

SEQ ID NO: 422131 - RNA, 19 nt, Homo sapiens
caacuuacggccaaggaaa

SEQ ID NO: 422132 - RNA, 19 nt, Homo sapiens
ucugagaacugauaagaag

SEQ ID NO: 422133 - RNA, 19 nt, Homo sapiens
cuacuucacagcuucauuu

SEQ ID NO: 422134 - RNA, 19 nt, Homo sapiens
ggagguaguagaaauguca

SEQ ID NO: 422135 - RNA, 19 nt, Homo sapiens
caaagaaauucaggaagag

SEQ ID NO: 422136 - RNA, 19 nt, Homo sapiens
gccuucaaaucucuuaauu

SEQ ID NO: 422137 - RNA, 19 nt, Homo sapiens
gccagugaauuucugaguu

SEQ ID NO: 422138 - RNA, 19 nt, Homo sapiens
ccucucauuuaucagaaua

SEQ ID NO: 422139 - RNA, 19 nt, Homo sapiens
caagagguccaagcuauug

SEQ ID NO: 422140 - RNA, 19 nt, Homo sapiens
ucgggauucucauacuuua

SEQ ID NO: 422141 - RNA, 19 nt, Homo sapiens
uacaaaugcuuggagauga

SEQ ID NO: 422142 - RNA, 19 nt, Homo sapiens
ugaacuugcugugcauaaa

SEQ ID NO: 422143 - RNA, 19 nt, Homo sapiens
aaacugugugccuuauuua

SEQ ID NO: 422144 - RNA, 19 nt, Homo sapiens
cuacucuucugucaucuug

SEQ ID NO: 422145 - RNA, 19 nt, Homo sapiens
gccauaccuugcucuacua

SEQ ID NO: 422146 - RNA, 19 nt, Homo sapiens
caaggaggaggaucaaguu

SEQ ID NO: 422147 - RNA, 19 nt, Homo sapiens
ugugaugcauuccaacaaa

SEQ ID NO: 422148 - RNA, 19 nt, Homo sapiens
gaggugugaugcauuccaa

SEQ ID NO: 422149 - RNA, 19 nt, Homo sapiens
aaagauguuucucuguuuc

SEQ ID NO: 422150 - RNA, 19 nt, Homo sapiens
gggauguucuggugauauc

SEQ ID NO: 422151 - RNA, 19 nt, Homo sapiens
ugacaaaacuucucuagag

SEQ ID NO: 422152 - RNA, 19 nt, Homo sapiens
caucauuaggugugaauaa

SEQ ID NO: 422153 - RNA, 19 nt, Homo sapiens
gguuauuguuucccaaaga

SEQ ID NO: 422154 - RNA, 19 nt, Homo sapiens
ucugucaucuugaaguaaa

SEQ ID NO: 422155 - RNA, 19 nt, Homo sapiens
ugaacgggauacauuacuu

SEQ ID NO: 422156 - RNA, 19 nt, Homo sapiens
ggugauaucagaagugcaa

SEQ ID NO: 422157 - RNA, 19 nt, Homo sapiens
caggaagaguguucuaucu

SEQ ID NO: 422158 - RNA, 19 nt, Homo sapiens
gagcggucaguguguauaa

SEQ ID NO: 422159 - RNA, 19 nt, Homo sapiens
aauaugaacgggauacauu

SEQ ID NO: 422160 - RNA, 19 nt, Homo sapiens
cuauagaagcuaacaagaa

SEQ ID NO: 422161 - RNA, 19 nt, Homo sapiens
cgauguccucuuauauuua

SEQ ID NO: 422162 - RNA, 19 nt, Homo sapiens
auuggucgauguccucuua

SEQ ID NO: 422163 - RNA, 19 nt, Homo sapiens
gugaauaacucaagucaua

SEQ ID NO: 422164 - RNA, 19 nt, Homo sapiens
gaaucaagcuuccauaugu

SEQ ID NO: 422165 - RNA, 19 nt, Homo sapiens
gcaaagauguuucucuguu

SEQ ID NO: 422166 - RNA, 19 nt, Homo sapiens
caacaaagcccgaggauau

SEQ ID NO: 422167 - RNA, 19 nt, Homo sapiens
acacaugccuggagacuua

SEQ ID NO: 422168 - RNA, 19 nt, Homo sapiens
cuacauagauuucuucaug

SEQ ID NO: 422169 - RNA, 19 nt, Homo sapiens
ccaaagaaauucaggaaga

SEQ ID NO: 422170 - RNA, 19 nt, Homo sapiens
caaauagaauugccugauu

SEQ ID NO: 422171 - RNA, 19 nt, Homo sapiens
aaacucagcuauugccaua

SEQ ID NO: 422172 - RNA, 19 nt, Homo sapiens
ggaaauugaugauauugug

SEQ ID NO: 422173 - RNA, 19 nt, Homo sapiens
uaaacugugugccuuauuu

SEQ ID NO: 422174 - RNA, 19 nt, Homo sapiens
gaagauaauucugguugaa

SEQ ID NO: 422175 - RNA, 19 nt, Homo sapiens
caaagauguuucucuguuu

SEQ ID NO: 422176 - RNA, 19 nt, Homo sapiens
ggaagaguguucuaucuca

SEQ ID NO: 422177 - RNA, 19 nt, Homo sapiens
guacaagaguggauuaauc

SEQ ID NO: 422178 - RNA, 19 nt, Homo sapiens
gaaagacaacgaccuuaaa

SEQ ID NO: 422179 - RNA, 19 nt, Homo sapiens
caaagaguuucuacuaaga

SEQ ID NO: 422180 - RNA, 19 nt, Homo sapiens
ggaaagacaacgaccuuaa

SEQ ID NO: 422181 - RNA, 19 nt, Homo sapiens
ccucagugguuucuaauaa

SEQ ID NO: 422182 - RNA, 19 nt, Homo sapiens
aaccauggguggauaaaua

SEQ ID NO: 422183 - RNA, 19 nt, Homo sapiens
gaacagauuuaugguuuag

SEQ ID NO: 422184 - RNA, 19 nt, Homo sapiens
cagggaacauggaaugaua

SEQ ID NO: 422185 - RNA, 19 nt, Homo sapiens
ccagugaauuucugaguuu

SEQ ID NO: 422186 - RNA, 19 nt, Homo sapiens
uaacucaagucauagaaga

SEQ ID NO: 422187 - RNA, 19 nt, Homo sapiens
gggaaauacuggaaaugaa

SEQ ID NO: 422188 - RNA, 19 nt, Homo sapiens
uaagagcgacaaaguauaa

SEQ ID NO: 422189 - RNA, 19 nt, Homo sapiens
gagcaucuuuaacagaauu

SEQ ID NO: 422190 - RNA, 19 nt, Homo sapiens
gaagccagccugcuaauca

SEQ ID NO: 422191 - RNA, 19 nt, Homo sapiens
gaucaagccuucaaaucuc

SEQ ID NO: 422192 - RNA, 19 nt, Homo sapiens
ccuggagacuuauuuaauu

SEQ ID NO: 422193 - RNA, 19 nt, Homo sapiens
cgacaaaguauaacaaguu

SEQ ID NO: 422194 - RNA, 19 nt, Homo sapiens
gaaaccuacucuucuguca

SEQ ID NO: 422195 - RNA, 19 nt, Homo sapiens
gaagaguguucuaucucaa

SEQ ID NO: 422196 - RNA, 19 nt, Homo sapiens
ggagcaugguauucaagua

SEQ ID NO: 422197 - RNA, 19 nt, Homo sapiens
ucaaagaguuucuacuaag

SEQ ID NO: 422198 - RNA, 19 nt, Homo sapiens
gcucuuuacucagggaaua

SEQ ID NO: 422199 - RNA, 19 nt, Homo sapiens
cgggauacauuacuuguug

SEQ ID NO: 422200 - RNA, 19 nt, Homo sapiens
ucgauguccucuuauauuu

SEQ ID NO: 422201 - RNA, 19 nt, Homo sapiens
agauuuaccuaaccaguuu

SEQ ID NO: 422202 - RNA, 19 nt, Homo sapiens
gagaacugauaagaagaua

SEQ ID NO: 422203 - RNA, 19 nt, Homo sapiens
gauaucagaagugcaauaa

SEQ ID NO: 422204 - RNA, 19 nt, Homo sapiens
gcaccaacaauuaugauga

SEQ ID NO: 422205 - RNA, 19 nt, Homo sapiens
ggaaguaugugaggauugg

SEQ ID NO: 422206 - RNA, 19 nt, Homo sapiens
aaacaggguggaucuauuu

SEQ ID NO: 422207 - RNA, 19 nt, Homo sapiens
gaugaucugagaacugaua

SEQ ID NO: 422208 - RNA, 19 nt, Homo sapiens
uaucagaagugcaauaaac

SEQ ID NO: 422209 - RNA, 19 nt, Homo sapiens
ggguggaucuauuuuauua

SEQ ID NO: 422210 - RNA, 19 nt, Homo sapiens
ugugagagccagugaauuu

SEQ ID NO: 422211 - RNA, 19 nt, Homo sapiens
ccggaaaccuggucucuuc

SEQ ID NO: 422212 - RNA, 19 nt, Homo sapiens
gaagcgacacuuuggaaga

SEQ ID NO: 422213 - RNA, 19 nt, Homo sapiens
cgagaggugugaugcauuc

SEQ ID NO: 422214 - RNA, 19 nt, Homo sapiens
cagaugcugugcugucaaa

SEQ ID NO: 422215 - RNA, 19 nt, Homo sapiens
caccaacaauuaugaugaa

SEQ ID NO: 422216 - RNA, 19 nt, Homo sapiens
caaaggagcaugguauuca

SEQ ID NO: 422217 - RNA, 19 nt, Homo sapiens
gaacgggauacauuacuug

SEQ ID NO: 422218 - RNA, 19 nt, Homo sapiens
gaaauacuggaaaugaaga

SEQ ID NO: 422219 - RNA, 19 nt, Homo sapiens
aguggcgucucuacuauua

SEQ ID NO: 422220 - RNA, 19 nt, Homo sapiens
uaacaagaauggaggaaaa

SEQ ID NO: 422221 - RNA, 19 nt, Homo sapiens
gaucugagaacugauaaga

SEQ ID NO: 422222 - RNA, 19 nt, Homo sapiens
gaauaacucaagucauaga

SEQ ID NO: 422223 - RNA, 19 nt, Homo sapiens
ccaaauaucaagaugugaa

SEQ ID NO: 422224 - RNA, 19 nt, Homo sapiens
augaagaccugcaacugua

SEQ ID NO: 422225 - RNA, 19 nt, Homo sapiens
gaaaccuggucucuuccuu

SEQ ID NO: 422226 - RNA, 19 nt, Homo sapiens
ggaaauacuggaaaugaag

SEQ ID NO: 422227 - RNA, 19 nt, Homo sapiens
guuauuguuucccaaagaa

SEQ ID NO: 422228 - RNA, 19 nt, Homo sapiens
uacaugaaguucuaaggaa

SEQ ID NO: 422229 - RNA, 19 nt, Homo sapiens
caaguacaagaguggauua

SEQ ID NO: 422230 - RNA, 19 nt, Homo sapiens
uuaaaucugugagugguuu

SEQ ID NO: 422231 - RNA, 19 nt, Homo sapiens
cauagaagccagccugcua

SEQ ID NO: 422232 - RNA, 19 nt, Homo sapiens
aauacacgcucuuuacuca

SEQ ID NO: 422233 - RNA, 19 nt, Homo sapiens
caacuuacggccaaggaaa

SEQ ID NO: 422234 - RNA, 19 nt, Homo sapiens
ucugagaacugauaagaag

SEQ ID NO: 422235 - RNA, 19 nt, Homo sapiens
cuacuucacagcuucauuu

SEQ ID NO: 422236 - RNA, 19 nt, Homo sapiens
ggagguaguagaaauguca

SEQ ID NO: 422237 - RNA, 19 nt, Homo sapiens
caaagaaauucaggaagag

SEQ ID NO: 422238 - RNA, 19 nt, Homo sapiens
gccuucaaaucucuuaauu

SEQ ID NO: 422239 - RNA, 19 nt, Homo sapiens
gccagugaauuucugaguu

SEQ ID NO: 422240 - RNA, 19 nt, Homo sapiens
gaaaugaagaccugcaacu

SEQ ID NO: 422241 - RNA, 19 nt, Homo sapiens
ccucucauuuaucagaaua

SEQ ID NO: 422242 - RNA, 19 nt, Homo sapiens
caagagguccaagcuauug

SEQ ID NO: 422243 - RNA, 19 nt, Homo sapiens
ucgggauucucauacuuua

SEQ ID NO: 422244 - RNA, 19 nt, Homo sapiens
uacaaaugcuuggagauga

SEQ ID NO: 422245 - RNA, 19 nt, Homo sapiens
ugaacuugcugugcauaaa

SEQ ID NO: 422246 - RNA, 19 nt, Homo sapiens
aaacugugugccuuauuua

SEQ ID NO: 422247 - RNA, 19 nt, Homo sapiens
cuacucuucugucaucuug

SEQ ID NO: 422248 - RNA, 19 nt, Homo sapiens
gccauaccuugcucuacua

SEQ ID NO: 422249 - RNA, 19 nt, Homo sapiens
caaggaggaggaucaaguu

SEQ ID NO: 422250 - RNA, 19 nt, Homo sapiens
ugugaugcauuccaacaaa

SEQ ID NO: 422251 - RNA, 19 nt, Homo sapiens
gaggugugaugcauuccaa

SEQ ID NO: 422252 - RNA, 19 nt, Homo sapiens
caucauuaggugugaauaa

SEQ ID NO: 422253 - RNA, 19 nt, Homo sapiens
aaagauguuucucuguuuc

SEQ ID NO: 422254 - RNA, 19 nt, Homo sapiens
gggauguucuggugauauc

SEQ ID NO: 422255 - RNA, 19 nt, Homo sapiens
ugacaaaacuucucuagag

SEQ ID NO: 422256 - RNA, 19 nt, Homo sapiens
gguuauuguuucccaaaga

SEQ ID NO: 422257 - RNA, 19 nt, Homo sapiens
ucugucaucuugaaguaaa

SEQ ID NO: 422258 - RNA, 19 nt, Homo sapiens
ugaacgggauacauuacuu

SEQ ID NO: 422259 - RNA, 19 nt, Homo sapiens
ggugauaucagaagugcaa

SEQ ID NO: 422260 - RNA, 19 nt, Homo sapiens
caggaagaguguucuaucu

SEQ ID NO: 422261 - RNA, 19 nt, Homo sapiens
gagcggucaguguguauaa

SEQ ID NO: 422262 - RNA, 19 nt, Homo sapiens
aauaugaacgggauacauu

SEQ ID NO: 422263 - RNA, 19 nt, Homo sapiens
gaaucaagcuuccauaugu

SEQ ID NO: 422264 - RNA, 19 nt, Homo sapiens
gcaaagauguuucucuguu

SEQ ID NO: 422265 - RNA, 19 nt, Homo sapiens
caacaaagcccgaggauau

SEQ ID NO: 422266 - RNA, 19 nt, Homo sapiens
acacaugccuggagacuua

SEQ ID NO: 422267 - RNA, 19 nt, Homo sapiens
cuacauagauuucuucaug

SEQ ID NO: 422268 - RNA, 19 nt, Homo sapiens
ccaaagaaauucaggaaga

SEQ ID NO: 422269 - RNA, 19 nt, Homo sapiens
gaauugcugucgaaaguuu

SEQ ID NO: 422270 - RNA, 19 nt, Homo sapiens
caaauagaauugccugauu

SEQ ID NO: 422271 - RNA, 19 nt, Homo sapiens
aaacucagcuauugccaua

SEQ ID NO: 422272 - RNA, 19 nt, Homo sapiens
ggaaauugaugauauugug

SEQ ID NO: 422273 - RNA, 19 nt, Homo sapiens
uaaacugugugccuuauuu

SEQ ID NO: 422274 - RNA, 19 nt, Homo sapiens
gaagauaauucugguugaa

SEQ ID NO: 422275 - RNA, 19 nt, Homo sapiens
caaagauguuucucuguuu

SEQ ID NO: 422276 - RNA, 19 nt, Homo sapiens
ggaagaguguucuaucuca

SEQ ID NO: 422277 - RNA, 19 nt, Homo sapiens
guacaagaguggauuaauc

SEQ ID NO: 422278 - RNA, 19 nt, Homo sapiens
gaaagacaacgaccuuaaa

SEQ ID NO: 422279 - RNA, 19 nt, Homo sapiens
caaagaguuucuacuaaga

SEQ ID NO: 422280 - RNA, 19 nt, Homo sapiens
ggaaagacaacgaccuuaa

SEQ ID NO: 422281 - RNA, 19 nt, Homo sapiens
ccucagugguuucuaauaa

SEQ ID NO: 422282 - RNA, 19 nt, Homo sapiens
cagggaacauggaaugaua

SEQ ID NO: 422283 - RNA, 19 nt, Homo sapiens
ccagugaauuucugaguuu

SEQ ID NO: 422284 - RNA, 19 nt, Homo sapiens
gggaaauacuggaaaugaa

SEQ ID NO: 422285 - RNA, 19 nt, Homo sapiens
uaagagcgacaaaguauaa

SEQ ID NO: 422286 - RNA, 19 nt, Homo sapiens
gagcaucuuuaacagaauu

SEQ ID NO: 422287 - RNA, 19 nt, Homo sapiens
gaagccagccugcuaauca

SEQ ID NO: 422288 - RNA, 19 nt, Homo sapiens
gaucaagccuucaaaucuc

SEQ ID NO: 422289 - RNA, 19 nt, Homo sapiens
ccuggagacuuauuuaauu

SEQ ID NO: 422290 - RNA, 19 nt, Homo sapiens
cgacaaaguauaacaaguu

SEQ ID NO: 422291 - RNA, 19 nt, Homo sapiens
cagaauugcugucgaaagu

SEQ ID NO: 422292 - RNA, 19 nt, Homo sapiens
gaaaccuacucuucuguca

SEQ ID NO: 422293 - RNA, 19 nt, Homo sapiens
gaagaguguucuaucucaa

SEQ ID NO: 422294 - RNA, 19 nt, Homo sapiens
ggagcaugguauucaagua

SEQ ID NO: 422295 - RNA, 19 nt, Homo sapiens
ucaaagaguuucuacuaag

SEQ ID NO: 422296 - RNA, 19 nt, Homo sapiens
gcucuuuacucagggaaua

SEQ ID NO: 422297 - RNA, 19 nt, Homo sapiens
cgggauacauuacuuguug

SEQ ID NO: 422298 - RNA, 19 nt, Homo sapiens
ucgauguccucuuauauuu

SEQ ID NO: 422299 - RNA, 19 nt, Homo sapiens
agauuuaccuaaccaguuu

SEQ ID NO: 422300 - RNA, 19 nt, Homo sapiens
gagaacugauaagaagaua

SEQ ID NO: 422301 - RNA, 19 nt, Homo sapiens
gauaucagaagugcaauaa

SEQ ID NO: 422302 - RNA, 19 nt, Homo sapiens
gcaccaacaauuaugauga

SEQ ID NO: 422303 - RNA, 19 nt, Homo sapiens
ggaaguaugugaggauugg

SEQ ID NO: 422304 - RNA, 19 nt, Homo sapiens
aaacaggguggaucuauuu

SEQ ID NO: 422305 - RNA, 19 nt, Homo sapiens
gaugaucugagaacugaua

SEQ ID NO: 422306 - RNA, 19 nt, Homo sapiens
cgaaaugaaucagcaugaa

SEQ ID NO: 422307 - RNA, 19 nt, Homo sapiens
uaucagaagugcaauaaac

SEQ ID NO: 422308 - RNA, 19 nt, Homo sapiens
ggguggaucuauuuuauua

SEQ ID NO: 422309 - RNA, 19 nt, Homo sapiens
ugugagagccagugaauuu

SEQ ID NO: 422310 - RNA, 19 nt, Homo sapiens
ccggaaaccuggucucuuc

SEQ ID NO: 422311 - RNA, 19 nt, Homo sapiens
gaagcgacacuuuggaaga

SEQ ID NO: 422312 - RNA, 19 nt, Homo sapiens
cgagaggugugaugcauuc

SEQ ID NO: 422313 - RNA, 19 nt, Homo sapiens
cagaugcugugcugucaaa

SEQ ID NO: 422314 - RNA, 19 nt, Homo sapiens
caccaacaauuaugaugaa

SEQ ID NO: 422315 - RNA, 19 nt, Homo sapiens
caaaggagcaugguauuca

SEQ ID NO: 422316 - RNA, 19 nt, Homo sapiens
gaacgggauacauuacuug

SEQ ID NO: 422317 - RNA, 19 nt, Homo sapiens
gaaauacuggaaaugaaga

SEQ ID NO: 422318 - RNA, 19 nt, Homo sapiens
uaacaagaauggaggaaaa

SEQ ID NO: 422319 - RNA, 19 nt, Homo sapiens
gaucugagaacugauaaga

SEQ ID NO: 422320 - RNA, 19 nt, Homo sapiens
ccaaauaucaagaugugaa

SEQ ID NO: 422321 - RNA, 19 nt, Homo sapiens
augaagaccugcaacugua

SEQ ID NO: 422322 - RNA, 19 nt, Homo sapiens
gaaaccuggucucuuccuu

SEQ ID NO: 422323 - RNA, 19 nt, Homo sapiens
ggaaauacuggaaaugaag

SEQ ID NO: 422324 - RNA, 19 nt, Homo sapiens
guuauuguuucccaaagaa

SEQ ID NO: 422325 - RNA, 19 nt, Homo sapiens
aaucagaauugcugucgaa

SEQ ID NO: 422326 - RNA, 19 nt, Homo sapiens
uacaugaaguucuaaggaa

SEQ ID NO: 422327 - RNA, 19 nt, Homo sapiens
caaguacaagaguggauua

SEQ ID NO: 422328 - RNA, 19 nt, Homo sapiens
uuaaaucugugagugguuu

SEQ ID NO: 422329 - RNA, 19 nt, Homo sapiens
cauagaagccagccugcua

SEQ ID NO: 422330 - RNA, 19 nt, Homo sapiens
aauacacgcucuuuacuca

SEQ ID NO: 422331 - RNA, 19 nt, Homo sapiens
caacuuacggccaaggaaa

SEQ ID NO: 422332 - RNA, 19 nt, Homo sapiens
ucugagaacugauaagaag

SEQ ID NO: 422333 - RNA, 19 nt, Homo sapiens
cuacuucacagcuucauuu

SEQ ID NO: 422334 - RNA, 19 nt, Homo sapiens
ggagguaguagaaauguca

SEQ ID NO: 422335 - RNA, 19 nt, Homo sapiens
caaagaaauucaggaagag

SEQ ID NO: 422336 - RNA, 19 nt, Homo sapiens
gccuucaaaucucuuaauu

SEQ ID NO: 422337 - RNA, 19 nt, Homo sapiens
gccagugaauuucugaguu

SEQ ID NO: 422338 - RNA, 19 nt, Homo sapiens
gaaaugaagaccugcaacu

SEQ ID NO: 422339 - RNA, 19 nt, Homo sapiens
ccucucauuuaucagaaua

SEQ ID NO: 422340 - RNA, 19 nt, Homo sapiens
caagagguccaagcuauug

SEQ ID NO: 422341 - RNA, 19 nt, Homo sapiens
ucgggauucucauacuuua

SEQ ID NO: 422342 - RNA, 19 nt, Homo sapiens
uacaaaugcuuggagauga

SEQ ID NO: 422343 - RNA, 19 nt, Homo sapiens
gaaaggggccaagauuaua

SEQ ID NO: 422344 - RNA, 19 nt, Homo sapiens
ugaacuugcugugcauaaa

SEQ ID NO: 422345 - RNA, 19 nt, Homo sapiens
aaacugugugccuuauuua

SEQ ID NO: 422346 - RNA, 19 nt, Homo sapiens
cuacucuucugucaucuug

SEQ ID NO: 422347 - RNA, 19 nt, Homo sapiens
gccauaccuugcucuacua

SEQ ID NO: 422348 - RNA, 19 nt, Homo sapiens
caaggaggaggaucaaguu

SEQ ID NO: 422349 - RNA, 19 nt, Homo sapiens
ugugaugcauuccaacaaa

SEQ ID NO: 422350 - RNA, 19 nt, Homo sapiens
gaggugugaugcauuccaa

SEQ ID NO: 422351 - RNA, 19 nt, Homo sapiens
aaagauguuucucuguuuc

SEQ ID NO: 422352 - RNA, 19 nt, Homo sapiens
gggauguucuggugauauc

SEQ ID NO: 422353 - RNA, 19 nt, Homo sapiens
ugacaaaacuucucuagag

SEQ ID NO: 422354 - RNA, 19 nt, Homo sapiens
gguuauuguuucccaaaga

SEQ ID NO: 422355 - RNA, 19 nt, Homo sapiens
ucugucaucuugaaguaaa

SEQ ID NO: 422356 - RNA, 19 nt, Homo sapiens
ugaacgggauacauuacuu

SEQ ID NO: 422357 - RNA, 19 nt, Homo sapiens
ggugauaucagaagugcaa

SEQ ID NO: 422358 - RNA, 19 nt, Homo sapiens
caggaagaguguucuaucu

SEQ ID NO: 422359 - RNA, 19 nt, Homo sapiens
auaugggaguccacauuua

SEQ ID NO: 422360 - RNA, 19 nt, Homo sapiens
gagcggucaguguguauaa

SEQ ID NO: 422361 - RNA, 19 nt, Homo sapiens
aauaugaacgggauacauu

SEQ ID NO: 422362 - RNA, 19 nt, Homo sapiens
cuauagaagcuaacaagaa

SEQ ID NO: 422363 - RNA, 19 nt, Homo sapiens
gugaauaacucaagucaua

SEQ ID NO: 422364 - RNA, 19 nt, Homo sapiens
gaaucaagcuuccauaugu

SEQ ID NO: 422365 - RNA, 19 nt, Homo sapiens
gcaaagauguuucucuguu

SEQ ID NO: 422366 - RNA, 19 nt, Homo sapiens
caacaaagcccgaggauau

SEQ ID NO: 422367 - RNA, 19 nt, Homo sapiens
acacaugccuggagacuua

SEQ ID NO: 422368 - RNA, 19 nt, Homo sapiens
ggaaacaagugaauucaug

SEQ ID NO: 422369 - RNA, 19 nt, Homo sapiens
cuacauagauuucuucaug

SEQ ID NO: 422370 - RNA, 19 nt, Homo sapiens
ccaaagaaauucaggaaga

SEQ ID NO: 422371 - RNA, 19 nt, Homo sapiens
gaauugcugucgaaaguuu

SEQ ID NO: 422372 - RNA, 19 nt, Homo sapiens
caaauagaauugccugauu

SEQ ID NO: 422373 - RNA, 19 nt, Homo sapiens
aaacucagcuauugccaua

SEQ ID NO: 422374 - RNA, 19 nt, Homo sapiens
ggaaauugaugauauugug

SEQ ID NO: 422375 - RNA, 19 nt, Homo sapiens
uaaacugugugccuuauuu

SEQ ID NO: 422376 - RNA, 19 nt, Homo sapiens
gaagauaauucugguugaa

SEQ ID NO: 422377 - RNA, 19 nt, Homo sapiens
caaagauguuucucuguuu

SEQ ID NO: 422378 - RNA, 19 nt, Homo sapiens
ggaagaguguucuaucuca

SEQ ID NO: 422379 - RNA, 19 nt, Homo sapiens
guacaagaguggauuaauc

SEQ ID NO: 422380 - RNA, 19 nt, Homo sapiens
gaaagacaacgaccuuaaa

SEQ ID NO: 422381 - RNA, 19 nt, Homo sapiens
caaagaguuucuacuaaga

SEQ ID NO: 422382 - RNA, 19 nt, Homo sapiens
ggaaagacaacgaccuuaa

SEQ ID NO: 422383 - RNA, 19 nt, Homo sapiens
ccucagugguuucuaauaa

SEQ ID NO: 422384 - RNA, 19 nt, Homo sapiens
aaccauggguggauaaaua

SEQ ID NO: 422385 - RNA, 19 nt, Homo sapiens
gaacagauuuaugguuuag

SEQ ID NO: 422386 - RNA, 19 nt, Homo sapiens
cagggaacauggaaugaua

SEQ ID NO: 422387 - RNA, 19 nt, Homo sapiens
ccagugaauuucugaguuu

SEQ ID NO: 422388 - RNA, 19 nt, Homo sapiens
uaacucaagucauagaaga

SEQ ID NO: 422389 - RNA, 19 nt, Homo sapiens
uaagagcgacaaaguauaa

SEQ ID NO: 422390 - RNA, 19 nt, Homo sapiens
gggaaauacuggaaaugaa

SEQ ID NO: 422391 - RNA, 19 nt, Homo sapiens
gagcaucuuuaacagaauu

SEQ ID NO: 422392 - RNA, 19 nt, Homo sapiens
caagugaauucaugguauu

SEQ ID NO: 422393 - RNA, 19 nt, Homo sapiens
gaagccagccugcuaauca

SEQ ID NO: 422394 - RNA, 19 nt, Homo sapiens
gaucaagccuucaaaucuc

SEQ ID NO: 422395 - RNA, 19 nt, Homo sapiens
ccuggagacuuauuuaauu

SEQ ID NO: 422396 - RNA, 19 nt, Homo sapiens
cgacaaaguauaacaaguu

SEQ ID NO: 422397 - RNA, 19 nt, Homo sapiens
cagaauugcugucgaaagu

SEQ ID NO: 422398 - RNA, 19 nt, Homo sapiens
gaaaccuacucuucuguca

SEQ ID NO: 422399 - RNA, 19 nt, Homo sapiens
gaagaguguucuaucucaa

SEQ ID NO: 422400 - RNA, 19 nt, Homo sapiens
ggagcaugguauucaagua

SEQ ID NO: 422401 - RNA, 19 nt, Homo sapiens
ucaaagaguuucuacuaag

SEQ ID NO: 422402 - RNA, 19 nt, Homo sapiens
gcucuuuacucagggaaua

SEQ ID NO: 422403 - RNA, 19 nt, Homo sapiens
cgggauacauuacuuguug

SEQ ID NO: 422404 - RNA, 19 nt, Homo sapiens
ucgauguccucuuauauuu

SEQ ID NO: 422405 - RNA, 19 nt, Homo sapiens
agauuuaccuaaccaguuu

SEQ ID NO: 422406 - RNA, 19 nt, Homo sapiens
gagaacugauaagaagaua

SEQ ID NO: 422407 - RNA, 19 nt, Homo sapiens
gauaucagaagugcaauaa

SEQ ID NO: 422408 - RNA, 19 nt, Homo sapiens
gcaccaacaauuaugauga

SEQ ID NO: 422409 - RNA, 19 nt, Homo sapiens
ggaaguaugugaggauugg

SEQ ID NO: 422410 - RNA, 19 nt, Homo sapiens
aaacaggguggaucuauuu

SEQ ID NO: 422411 - RNA, 19 nt, Homo sapiens
ccagguggcugcccuuuca

SEQ ID NO: 422412 - RNA, 19 nt, Homo sapiens
gaugaucugagaacugaua

SEQ ID NO: 422413 - RNA, 19 nt, Homo sapiens
uaucagaagugcaauaaac

SEQ ID NO: 422414 - RNA, 19 nt, Homo sapiens
ggguggaucuauuuuauua

SEQ ID NO: 422415 - RNA, 19 nt, Homo sapiens
ugugagagccagugaauuu

SEQ ID NO: 422416 - RNA, 19 nt, Homo sapiens
cgaaaugaaucagguaaca

SEQ ID NO: 422417 - RNA, 19 nt, Homo sapiens
ccggaaaccuggucucuuc

SEQ ID NO: 422418 - RNA, 19 nt, Homo sapiens
gaagcgacacuuuggaaga

SEQ ID NO: 422419 - RNA, 19 nt, Homo sapiens
cgagaggugugaugcauuc

SEQ ID NO: 422420 - RNA, 19 nt, Homo sapiens
cagaugcugugcugucaaa

SEQ ID NO: 422421 - RNA, 19 nt, Homo sapiens
caccaacaauuaugaugaa

SEQ ID NO: 422422 - RNA, 19 nt, Homo sapiens
caaaggagcaugguauuca

SEQ ID NO: 422423 - RNA, 19 nt, Homo sapiens
gaacgggauacauuacuug

SEQ ID NO: 422424 - RNA, 19 nt, Homo sapiens
gaaauacuggaaaugaaga

SEQ ID NO: 422425 - RNA, 19 nt, Homo sapiens
uaacaagaauggaggaaaa

SEQ ID NO: 422426 - RNA, 19 nt, Homo sapiens
gaucugagaacugauaaga

SEQ ID NO: 422427 - RNA, 19 nt, Homo sapiens
gaauaacucaagucauaga

SEQ ID NO: 422428 - RNA, 19 nt, Homo sapiens
aguggcgucucuacuauua

SEQ ID NO: 422429 - RNA, 19 nt, Homo sapiens
ccaaauaucaagaugugaa

SEQ ID NO: 422430 - RNA, 19 nt, Homo sapiens
augaagaccugcaacugua

SEQ ID NO: 422431 - RNA, 19 nt, Homo sapiens
gaaaccuggucucuuccuu

SEQ ID NO: 422432 - RNA, 19 nt, Homo sapiens
guuauuguuucccaaagaa

SEQ ID NO: 422433 - RNA, 19 nt, Homo sapiens
uacaugaaguucuaaggaa

SEQ ID NO: 422434 - RNA, 19 nt, Homo sapiens
aaucagaauugcugucgaa

SEQ ID NO: 422435 - RNA, 19 nt, Homo sapiens
ggaaauacuggaaaugaag

SEQ ID NO: 422436 - RNA, 19 nt, Homo sapiens
acaagugaauucaugguau

SEQ ID NO: 422437 - RNA, 19 nt, Homo sapiens
caaguacaagaguggauua

SEQ ID NO: 422438 - RNA, 19 nt, Homo sapiens
ggacgaaaugaaucaggua

SEQ ID NO: 422439 - RNA, 19 nt, Homo sapiens
uuaaaucugugagugguuu

SEQ ID NO: 422440 - RNA, 19 nt, Homo sapiens
cauagaagccagccugcua

SEQ ID NO: 422441 - RNA, 19 nt, Homo sapiens
aauacacgcucuuuacuca

SEQ ID NO: 422442 - RNA, 19 nt, Homo sapiens
caacuuacggccaaggaaa

SEQ ID NO: 422443 - RNA, 19 nt, Homo sapiens
ucugagaacugauaagaag

SEQ ID NO: 422444 - RNA, 19 nt, Homo sapiens
cuacuucacagcuucauuu

SEQ ID NO: 422445 - RNA, 19 nt, Homo sapiens
ggagguaguagaaauguca

SEQ ID NO: 422446 - RNA, 19 nt, Homo sapiens
caaagaaauucaggaagag

SEQ ID NO: 422447 - RNA, 19 nt, Homo sapiens
gccuucaaaucucuuaauu

SEQ ID NO: 422448 - RNA, 19 nt, Homo sapiens
gccagugaauuucugaguu

SEQ ID NO: 422449 - RNA, 19 nt, Homo sapiens
ccucucauuuaucagaaua

SEQ ID NO: 422450 - RNA, 19 nt, Homo sapiens
caagagguccaagcuauug

SEQ ID NO: 422451 - RNA, 19 nt, Homo sapiens
ucgggauucucauacuuua

SEQ ID NO: 422452 - RNA, 19 nt, Homo sapiens
gaaaggggccaagauuaua

SEQ ID NO: 422453 - RNA, 19 nt, Homo sapiens
uacaaaugcuuggagauga

SEQ ID NO: 422454 - RNA, 19 nt, Homo sapiens
gaaaugaagaccugcaacu

SEQ ID NO: 422455 - RNA, 19 nt, Homo sapiens
ugaacuugcugugcauaaa

SEQ ID NO: 422456 - RNA, 19 nt, Homo sapiens
aaacugugugccuuauuua

SEQ ID NO: 422457 - RNA, 19 nt, Homo sapiens
cuacucuucugucaucuug

SEQ ID NO: 422458 - RNA, 19 nt, Homo sapiens
gccauaccuugcucuacua

SEQ ID NO: 422459 - RNA, 19 nt, Homo sapiens
caaggaggaggaucaaguu

SEQ ID NO: 422460 - RNA, 19 nt, Homo sapiens
ugugaugcauuccaacaaa

SEQ ID NO: 422461 - RNA, 19 nt, Homo sapiens
gaggugugaugcauuccaa

SEQ ID NO: 422462 - RNA, 19 nt, Homo sapiens
aaagauguuucucuguuuc

SEQ ID NO: 422463 - RNA, 19 nt, Homo sapiens
gugaauaacucaagucaua

SEQ ID NO: 422464 - RNA, 19 nt, Homo sapiens
gaaucaagcuuccauaugu

SEQ ID NO: 422465 - RNA, 19 nt, Homo sapiens
gcaaagauguuucucuguu

SEQ ID NO: 422466 - RNA, 19 nt, Homo sapiens
caacaaagcccgaggauau

SEQ ID NO: 422467 - RNA, 19 nt, Homo sapiens
acacaugccuggagacuua

SEQ ID NO: 422468 - RNA, 19 nt, Homo sapiens
cuacauagauuucuucaug

SEQ ID NO: 422469 - RNA, 19 nt, Homo sapiens
ccaaagaaauucaggaaga

SEQ ID NO: 422470 - RNA, 19 nt, Homo sapiens
gaauugcugucgaaaguuu

SEQ ID NO: 422471 - RNA, 19 nt, Homo sapiens
caaauagaauugccugauu

SEQ ID NO: 422472 - RNA, 19 nt, Homo sapiens
aaacucagcuauugccaua

SEQ ID NO: 422473 - RNA, 19 nt, Homo sapiens
ggaaauugaugauauugug

SEQ ID NO: 422474 - RNA, 19 nt, Homo sapiens
uaaacugugugccuuauuu

SEQ ID NO: 422475 - RNA, 19 nt, Homo sapiens
gaagauaauucugguugaa

SEQ ID NO: 422476 - RNA, 19 nt, Homo sapiens
gcaagugaauucaugguau

SEQ ID NO: 422477 - RNA, 19 nt, Homo sapiens
caaagauguuucucuguuu

SEQ ID NO: 422478 - RNA, 19 nt, Homo sapiens
ggaagaguguucuaucuca

SEQ ID NO: 422479 - RNA, 19 nt, Homo sapiens
guacaagaguggauuaauc

SEQ ID NO: 422480 - RNA, 19 nt, Homo sapiens
gaaagacaacgaccuuaaa

SEQ ID NO: 422481 - RNA, 19 nt, Homo sapiens
caaagaguuucuacuaaga

SEQ ID NO: 422482 - RNA, 19 nt, Homo sapiens
ggaaagacaacgaccuuaa

SEQ ID NO: 422483 - RNA, 19 nt, Homo sapiens
ccucagugguuucuaauaa

SEQ ID NO: 422484 - RNA, 19 nt, Homo sapiens
aaccauggguggauaaaua

SEQ ID NO: 422485 - RNA, 19 nt, Homo sapiens
gaacagauuuaugguuuag

SEQ ID NO: 422486 - RNA, 19 nt, Homo sapiens
cagggaacauggaaugaua

SEQ ID NO: 422487 - RNA, 19 nt, Homo sapiens
ccagugaauuucugaguuu

SEQ ID NO: 422488 - RNA, 19 nt, Homo sapiens
uaacucaagucauagaaga

SEQ ID NO: 422489 - RNA, 19 nt, Homo sapiens
gggaaauacuggaaaugaa

SEQ ID NO: 422490 - RNA, 19 nt, Homo sapiens
uaagagcgacaaaguauaa

SEQ ID NO: 422491 - RNA, 19 nt, Homo sapiens
caagugaauucaugguauu

SEQ ID NO: 422492 - RNA, 19 nt, Homo sapiens
gagcaucuuuaacagaauu

SEQ ID NO: 422493 - RNA, 19 nt, Homo sapiens
gaagccagccugcuaauca

SEQ ID NO: 422494 - RNA, 19 nt, Homo sapiens
gaucaagccuucaaaucuc

SEQ ID NO: 422495 - RNA, 19 nt, Homo sapiens
ccuggagacuuauuuaauu

SEQ ID NO: 422496 - RNA, 19 nt, Homo sapiens
cgacaaaguauaacaaguu

SEQ ID NO: 422497 - RNA, 19 nt, Homo sapiens
cagaauugcugucgaaagu

SEQ ID NO: 422498 - RNA, 19 nt, Homo sapiens
gaaaccuacucuucuguca

SEQ ID NO: 422499 - RNA, 19 nt, Homo sapiens
gaagaguguucuaucucaa

SEQ ID NO: 422500 - RNA, 19 nt, Homo sapiens
ggagcaugguauucaagua

SEQ ID NO: 422501 - RNA, 19 nt, Homo sapiens
ucaaagaguuucuacuaag

SEQ ID NO: 422502 - RNA, 19 nt, Homo sapiens
gcucuuuacucagggaaua

SEQ ID NO: 422503 - RNA, 19 nt, Homo sapiens
cgggauacauuacuuguug

SEQ ID NO: 422504 - RNA, 19 nt, Homo sapiens
ucgauguccucuuauauuu

SEQ ID NO: 422505 - RNA, 19 nt, Homo sapiens
agauuuaccuaaccaguuu

SEQ ID NO: 422506 - RNA, 19 nt, Homo sapiens
gagaacugauaagaagaua

SEQ ID NO: 422507 - RNA, 19 nt, Homo sapiens
gauaucagaagugcaauaa

SEQ ID NO: 422508 - RNA, 19 nt, Homo sapiens
gcaccaacaauuaugauga

SEQ ID NO: 422509 - RNA, 19 nt, Homo sapiens
ggaaguaugugaggauugg

SEQ ID NO: 422510 - RNA, 19 nt, Homo sapiens
aaacaggguggaucuauuu

SEQ ID NO: 422511 - RNA, 19 nt, Homo sapiens
gaugaucugagaacugaua

SEQ ID NO: 422512 - RNA, 19 nt, Homo sapiens
uaucagaagugcaauaaac

SEQ ID NO: 422513 - RNA, 19 nt, Homo sapiens
ggguggaucuauuuuauua

SEQ ID NO: 422514 - RNA, 19 nt, Homo sapiens
ugugagagccagugaauuu

SEQ ID NO: 422515 - RNA, 19 nt, Homo sapiens
cgaaaugaaucagguaaca

SEQ ID NO: 422516 - RNA, 19 nt, Homo sapiens
ccggaaaccuggucucuuc

SEQ ID NO: 422517 - RNA, 19 nt, Homo sapiens
gaagcgacacuuuggaaga

SEQ ID NO: 422518 - RNA, 19 nt, Homo sapiens
cgagaggugugaugcauuc

SEQ ID NO: 422519 - RNA, 19 nt, Homo sapiens
cagaugcugugcugucaaa

SEQ ID NO: 422520 - RNA, 19 nt, Homo sapiens
caccaacaauuaugaugaa

SEQ ID NO: 422521 - RNA, 19 nt, Homo sapiens
caaaggagcaugguauuca

SEQ ID NO: 422522 - RNA, 19 nt, Homo sapiens
gaacgggauacauuacuug

SEQ ID NO: 422523 - RNA, 19 nt, Homo sapiens
gaaauacuggaaaugaaga

SEQ ID NO: 422524 - RNA, 19 nt, Homo sapiens
uaacaagaauggaggaaaa

SEQ ID NO: 422525 - RNA, 19 nt, Homo sapiens
gaccgcaagugaauucaug

SEQ ID NO: 422526 - RNA, 19 nt, Homo sapiens
gaucugagaacugauaaga

SEQ ID NO: 422527 - RNA, 19 nt, Homo sapiens
gaauaacucaagucauaga

SEQ ID NO: 422528 - RNA, 19 nt, Homo sapiens
aguggcgucucuacuauua

SEQ ID NO: 422529 - RNA, 19 nt, Homo sapiens
ccaaauaucaagaugugaa

SEQ ID NO: 422530 - RNA, 19 nt, Homo sapiens
augaagaccugcaacugua

SEQ ID NO: 422531 - RNA, 19 nt, Homo sapiens
gaaaccuggucucuuccuu

SEQ ID NO: 422532 - RNA, 19 nt, Homo sapiens
guuauuguuucccaaagaa

SEQ ID NO: 422533 - RNA, 19 nt, Homo sapiens
aaucagaauugcugucgaa

SEQ ID NO: 422534 - RNA, 19 nt, Homo sapiens
uacaugaaguucuaaggaa

SEQ ID NO: 422535 - RNA, 19 nt, Homo sapiens
ggaaauacuggaaaugaag

SEQ ID NO: 422536 - RNA, 19 nt, Homo sapiens
caaguacaagaguggauua

SEQ ID NO: 422537 - RNA, 19 nt, Homo sapiens
ggacgaaaugaaucaggua

SEQ ID NO: 422538 - RNA, 19 nt, Homo sapiens
uuaaaucugugagugguuu

SEQ ID NO: 422539 - RNA, 19 nt, Homo sapiens
cauagaagccagccugcua

SEQ ID NO: 422540 - RNA, 19 nt, Homo sapiens
aauacacgcucuuuacuca

SEQ ID NO: 422541 - RNA, 19 nt, Homo sapiens
caacuuacggccaaggaaa

SEQ ID NO: 422542 - RNA, 19 nt, Homo sapiens
ucugagaacugauaagaag

SEQ ID NO: 422543 - RNA, 19 nt, Homo sapiens
cuacuucacagcuucauuu

SEQ ID NO: 422544 - RNA, 19 nt, Homo sapiens
ggagguaguagaaauguca

SEQ ID NO: 422545 - RNA, 19 nt, Homo sapiens
caaagaaauucaggaagag

SEQ ID NO: 422546 - RNA, 19 nt, Homo sapiens
gccuucaaaucucuuaauu

SEQ ID NO: 422547 - RNA, 19 nt, Homo sapiens
gccagugaauuucugaguu

SEQ ID NO: 422548 - RNA, 19 nt, Homo sapiens
gaaaugaagaccugcaacu

SEQ ID NO: 422549 - RNA, 19 nt, Homo sapiens
ccucucauuuaucagaaua

SEQ ID NO: 422550 - RNA, 19 nt, Homo sapiens
caagagguccaagcuauug

SEQ ID NO: 422551 - RNA, 19 nt, Homo sapiens
ucgggauucucauacuuua

SEQ ID NO: 422552 - RNA, 19 nt, Homo sapiens
gaaaggggccaagauuaua

SEQ ID NO: 422553 - RNA, 19 nt, Homo sapiens
uacaaaugcuuggagauga

SEQ ID NO: 422554 - RNA, 19 nt, Homo sapiens
ugaacuugcugugcauaaa

SEQ ID NO: 422555 - RNA, 19 nt, Homo sapiens
aaacugugugccuuauuua

SEQ ID NO: 422556 - RNA, 19 nt, Homo sapiens
cuacucuucugucaucuug

SEQ ID NO: 422557 - RNA, 19 nt, Homo sapiens
gccauaccuugcucuacua

SEQ ID NO: 422558 - RNA, 19 nt, Homo sapiens
caaggaggaggaucaaguu

SEQ ID NO: 422559 - RNA, 19 nt, Homo sapiens
ugugaugcauuccaacaaa

SEQ ID NO: 422560 - RNA, 19 nt, Homo sapiens
gaggugugaugcauuccaa

SEQ ID NO: 422561 - RNA, 19 nt, Homo sapiens
aaagauguuucucuguuuc

SEQ ID NO: 422562 - RNA, 19 nt, Homo sapiens
gggauguucuggugauauc

SEQ ID NO: 422563 - RNA, 19 nt, Homo sapiens
gugaauaacucaagucaua

SEQ ID NO: 422564 - RNA, 19 nt, Homo sapiens
gaaucaagcuuccauaugu

SEQ ID NO: 422565 - RNA, 19 nt, Homo sapiens
gcaaagauguuucucuguu

SEQ ID NO: 422566 - RNA, 19 nt, Homo sapiens
caacaaagcccgaggauau

SEQ ID NO: 422567 - RNA, 19 nt, Homo sapiens
acacaugccuggagacuua

SEQ ID NO: 422568 - RNA, 19 nt, Homo sapiens
cuacauagauuucuucaug

SEQ ID NO: 422569 - RNA, 19 nt, Homo sapiens
ccaaagaaauucaggaaga

SEQ ID NO: 422570 - RNA, 19 nt, Homo sapiens
gaauugcugucgaaaguuu

SEQ ID NO: 422571 - RNA, 19 nt, Homo sapiens
aaacucagcuauugccaua

SEQ ID NO: 422572 - RNA, 19 nt, Homo sapiens
ggaaauugaugauauugug

SEQ ID NO: 422573 - RNA, 19 nt, Homo sapiens
uaaacugugugccuuauuu

SEQ ID NO: 422574 - RNA, 19 nt, Homo sapiens
gaagauaauucugguugaa

SEQ ID NO: 422575 - RNA, 19 nt, Homo sapiens
caaagauguuucucuguuu

SEQ ID NO: 422576 - RNA, 19 nt, Homo sapiens
ggaagaguguucuaucuca

SEQ ID NO: 422577 - RNA, 19 nt, Homo sapiens
guacaagaguggauuaauc

SEQ ID NO: 422578 - RNA, 19 nt, Homo sapiens
gaaagacaacgaccuuaaa

SEQ ID NO: 422579 - RNA, 19 nt, Homo sapiens
caaagaguuucuacuaaga

SEQ ID NO: 422580 - RNA, 19 nt, Homo sapiens
ggaaagacaacgaccuuaa

SEQ ID NO: 422581 - RNA, 19 nt, Homo sapiens
ccucagugguuucuaauaa

SEQ ID NO: 422582 - RNA, 19 nt, Homo sapiens
aaccauggguggauaaaua

SEQ ID NO: 422583 - RNA, 19 nt, Homo sapiens
gaacagauuuaugguuuag

SEQ ID NO: 422584 - RNA, 19 nt, Homo sapiens
cagggaacauggaaugaua

SEQ ID NO: 422585 - RNA, 19 nt, Homo sapiens
ccagugaauuucugaguuu

SEQ ID NO: 422586 - RNA, 19 nt, Homo sapiens
uaacucaagucauagaaga

SEQ ID NO: 422587 - RNA, 19 nt, Homo sapiens
uaagagcgacaaaguauaa

SEQ ID NO: 422588 - RNA, 19 nt, Homo sapiens
gagcaucuuuaacagaauu

SEQ ID NO: 422589 - RNA, 19 nt, Homo sapiens
gaagccagccugcuaauca

SEQ ID NO: 422590 - RNA, 19 nt, Homo sapiens
gaucaagccuucaaaucuc

SEQ ID NO: 422591 - RNA, 19 nt, Homo sapiens
ccuggagacuuauuuaauu

SEQ ID NO: 422592 - RNA, 19 nt, Homo sapiens
cagaauugcugucgaaagu

SEQ ID NO: 422593 - RNA, 19 nt, Homo sapiens
cgacaaaguauaacaaguu

SEQ ID NO: 422594 - RNA, 19 nt, Homo sapiens
gaaaccuacucuucuguca

SEQ ID NO: 422595 - RNA, 19 nt, Homo sapiens
gaagaguguucuaucucaa

SEQ ID NO: 422596 - RNA, 19 nt, Homo sapiens
ggagcaugguauucaagua

SEQ ID NO: 422597 - RNA, 19 nt, Homo sapiens
ucaaagaguuucuacuaag

SEQ ID NO: 422598 - RNA, 19 nt, Homo sapiens
gcucuuuacucagggaaua

SEQ ID NO: 422599 - RNA, 19 nt, Homo sapiens
cgggauacauuacuuguug

SEQ ID NO: 422600 - RNA, 19 nt, Homo sapiens
ucgauguccucuuauauuu

SEQ ID NO: 422601 - RNA, 19 nt, Homo sapiens
agauuuaccuaaccaguuu

SEQ ID NO: 422602 - RNA, 19 nt, Homo sapiens
gagaacugauaagaagaua

SEQ ID NO: 422603 - RNA, 19 nt, Homo sapiens
gauaucagaagugcaauaa

SEQ ID NO: 422604 - RNA, 19 nt, Homo sapiens
gcaccaacaauuaugauga

SEQ ID NO: 422605 - RNA, 19 nt, Homo sapiens
ggaaguaugugaggauugg

SEQ ID NO: 422606 - RNA, 19 nt, Homo sapiens
aaacaggguggaucuauuu

SEQ ID NO: 422607 - RNA, 19 nt, Homo sapiens
ccagguggcugcccuuuca

SEQ ID NO: 422608 - RNA, 19 nt, Homo sapiens
gaugaucugagaacugaua

SEQ ID NO: 422609 - RNA, 19 nt, Homo sapiens
uaucagaagugcaauaaac

SEQ ID NO: 422610 - RNA, 19 nt, Homo sapiens
ggguggaucuauuuuauua

SEQ ID NO: 422611 - RNA, 19 nt, Homo sapiens
ugugagagccagugaauuu

SEQ ID NO: 422612 - RNA, 19 nt, Homo sapiens
cgaaaugaaucagguaaca

SEQ ID NO: 422613 - RNA, 19 nt, Homo sapiens
ccggaaaccuggucucuuc

SEQ ID NO: 422614 - RNA, 19 nt, Homo sapiens
gaagcgacacuuuggaaga

SEQ ID NO: 422615 - RNA, 19 nt, Homo sapiens
cgagaggugugaugcauuc

SEQ ID NO: 422616 - RNA, 19 nt, Homo sapiens
cagaugcugugcugucaaa

SEQ ID NO: 422617 - RNA, 19 nt, Homo sapiens
caccaacaauuaugaugaa

SEQ ID NO: 422618 - RNA, 19 nt, Homo sapiens
caaaggagcaugguauuca

SEQ ID NO: 422619 - RNA, 19 nt, Homo sapiens
gaacgggauacauuacuug

SEQ ID NO: 422620 - RNA, 19 nt, Homo sapiens
uaacaagaauggaggaaaa

SEQ ID NO: 422621 - RNA, 19 nt, Homo sapiens
gaucugagaacugauaaga

SEQ ID NO: 422622 - RNA, 19 nt, Homo sapiens
gaauaacucaagucauaga

SEQ ID NO: 422623 - RNA, 19 nt, Homo sapiens
aguggcgucucuacuauua

SEQ ID NO: 422624 - RNA, 19 nt, Homo sapiens
ccaaauaucaagaugugaa

SEQ ID NO: 422625 - RNA, 19 nt, Homo sapiens
ggaugcagcuccgggaaau

SEQ ID NO: 422626 - RNA, 19 nt, Homo sapiens
gaaaccuggucucuuccuu

SEQ ID NO: 422627 - RNA, 19 nt, Homo sapiens
guuauuguuucccaaagaa

SEQ ID NO: 422628 - RNA, 19 nt, Homo sapiens
uacaugaaguucuaaggaa

SEQ ID NO: 422629 - RNA, 19 nt, Homo sapiens
caaguacaagaguggauua

SEQ ID NO: 422630 - RNA, 19 nt, Homo sapiens
aaucagaauugcugucgaa

SEQ ID NO: 422631 - RNA, 19 nt, Homo sapiens
ggacgaaaugaaucaggua

SEQ ID NO: 422632 - RNA, 19 nt, Homo sapiens
uuaaaucugugagugguuu

SEQ ID NO: 422633 - RNA, 19 nt, Homo sapiens
cauagaagccagccugcua

SEQ ID NO: 422634 - RNA, 19 nt, Homo sapiens
aauacacgcucuuuacuca

SEQ ID NO: 422635 - RNA, 19 nt, Homo sapiens
caacuuacggccaaggaaa

SEQ ID NO: 422636 - RNA, 19 nt, Homo sapiens
ucugagaacugauaagaag

SEQ ID NO: 422637 - RNA, 19 nt, Homo sapiens
cuacuucacagcuucauuu

SEQ ID NO: 422638 - RNA, 19 nt, Homo sapiens
ggagguaguagaaauguca

SEQ ID NO: 422639 - RNA, 19 nt, Homo sapiens
caaagaaauucaggaagag

SEQ ID NO: 422640 - RNA, 19 nt, Homo sapiens
gccuucaaaucucuuaauu

SEQ ID NO: 422641 - RNA, 19 nt, Homo sapiens
gccagugaauuucugaguu

SEQ ID NO: 422642 - RNA, 19 nt, Homo sapiens
ccucucauuuaucagaaua

SEQ ID NO: 422643 - RNA, 19 nt, Homo sapiens
caagagguccaagcuauug

SEQ ID NO: 422644 - RNA, 19 nt, Homo sapiens
gaaaggggccaagauuaua

SEQ ID NO: 422645 - RNA, 19 nt, Homo sapiens
ucgggauucucauacuuua

SEQ ID NO: 422646 - RNA, 19 nt, Homo sapiens
uacaaaugcuuggagauga

SEQ ID NO: 422647 - RNA, 19 nt, Homo sapiens
ugaacuugcugugcauaaa

SEQ ID NO: 422648 - RNA, 19 nt, Homo sapiens
aaacugugugccuuauuua

SEQ ID NO: 422649 - RNA, 19 nt, Homo sapiens
cuacucuucugucaucuug

SEQ ID NO: 422650 - RNA, 19 nt, Homo sapiens
gccauaccuugcucuacua

SEQ ID NO: 422651 - RNA, 19 nt, Homo sapiens
caaggaggaggaucaaguu

SEQ ID NO: 422652 - RNA, 19 nt, Homo sapiens
ugugaugcauuccaacaaa

SEQ ID NO: 422653 - RNA, 19 nt, Homo sapiens
gaggugugaugcauuccaa

SEQ ID NO: 422654 - RNA, 19 nt, Homo sapiens
aaagauguuucucuguuuc

SEQ ID NO: 422655 - RNA, 19 nt, Homo sapiens
gggauguucuggugauauc

SEQ ID NO: 422656 - RNA, 19 nt, Homo sapiens
ugacaaaacuucucuagag

SEQ ID NO: 422657 - RNA, 19 nt, Homo sapiens
gguuauuguuucccaaaga

SEQ ID NO: 422658 - RNA, 19 nt, Homo sapiens
caucauuaggugugaauaa

SEQ ID NO: 422659 - RNA, 19 nt, Homo sapiens
ucugucaucuugaaguaaa

SEQ ID NO: 422660 - RNA, 19 nt, Homo sapiens
ugaacgggauacauuacuu

SEQ ID NO: 422661 - RNA, 19 nt, Homo sapiens
ggugauaucagaagugcaa

SEQ ID NO: 422662 - RNA, 19 nt, Homo sapiens
caggaagaguguucuaucu

SEQ ID NO: 422663 - RNA, 19 nt, Homo sapiens
ggaccaagguuccauauua

SEQ ID NO: 422664 - RNA, 19 nt, Homo sapiens
ccaaauaucugucagcuaa

SEQ ID NO: 422665 - RNA, 19 nt, Homo sapiens
gaacagaugugugcaauau

SEQ ID NO: 422666 - RNA, 19 nt, Homo sapiens
gaaauuguguuaugacuga

SEQ ID NO: 422667 - RNA, 19 nt, Homo sapiens
gaaaaugccugacaguuua

SEQ ID NO: 422668 - RNA, 19 nt, Homo sapiens
ggacugaccugguuuaaag

SEQ ID NO: 422669 - RNA, 19 nt, Homo sapiens
gaaaucaugugacuguuau

SEQ ID NO: 422670 - RNA, 19 nt, Homo sapiens
gaaagaagauggaacaaaa

SEQ ID NO: 422671 - RNA, 19 nt, Homo sapiens
ggaagaagcauuugcauug

SEQ ID NO: 422672 - RNA, 19 nt, Homo sapiens
ggucauuaguuucuuguua

SEQ ID NO: 422673 - RNA, 19 nt, Homo sapiens
gaaauccuauauccaguuu

SEQ ID NO: 422674 - RNA, 19 nt, Homo sapiens
gaaauugcccugccuacua

SEQ ID NO: 422675 - RNA, 19 nt, Homo sapiens
gaacagagcaccagcaauc

SEQ ID NO: 422676 - RNA, 19 nt, Homo sapiens
ggaugaggaugauaaugua

SEQ ID NO: 422677 - RNA, 19 nt, Homo sapiens
gagggaaacugauuagaug

SEQ ID NO: 422678 - RNA, 19 nt, Homo sapiens
gcaaagcuaggccugauua

SEQ ID NO: 422679 - RNA, 19 nt, Homo sapiens
gagcccaacuuagugauua

SEQ ID NO: 422680 - RNA, 19 nt, Homo sapiens
gaggagaggcagauaauuu

SEQ ID NO: 422681 - RNA, 19 nt, Homo sapiens
gaaagagacaggaggagua

SEQ ID NO: 422682 - RNA, 19 nt, Homo sapiens
gaugguaucugaaacaaca

SEQ ID NO: 422683 - RNA, 19 nt, Homo sapiens
cauuauagcuaguguuuga

SEQ ID NO: 422684 - RNA, 19 nt, Homo sapiens
cagaagaaccuccaaauau

SEQ ID NO: 422685 - RNA, 19 nt, Homo sapiens
uagaguagagugacuauua

SEQ ID NO: 422686 - RNA, 19 nt, Homo sapiens
ccaguuuccuguaauuuaa

SEQ ID NO: 422687 - RNA, 19 nt, Homo sapiens
gcucagccuuuguggaaua

SEQ ID NO: 422688 - RNA, 19 nt, Homo sapiens
gggaguaguucgaaucuau

SEQ ID NO: 422689 - RNA, 19 nt, Homo sapiens
gaagaaagaagauggaaca

SEQ ID NO: 422690 - RNA, 19 nt, Homo sapiens
gaaccaaugccaaccauga

SEQ ID NO: 422691 - RNA, 19 nt, Homo sapiens
gaccaagguuccauauuau

SEQ ID NO: 422692 - RNA, 19 nt, Homo sapiens
ucaaagaguuggauagcaa

SEQ ID NO: 422693 - RNA, 19 nt, Homo sapiens
ggaagaggaugaagaugca

SEQ ID NO: 422694 - RNA, 19 nt, Homo sapiens
acaauuagagcccaacuua

SEQ ID NO: 422695 - RNA, 19 nt, Homo sapiens
gaacucguaauuacuguuu

SEQ ID NO: 422696 - RNA, 19 nt, Homo sapiens
acuaacggcuucucugaua

SEQ ID NO: 422697 - RNA, 19 nt, Homo sapiens
ccagaagaaccuccaaaua

SEQ ID NO: 422698 - RNA, 19 nt, Homo sapiens
gcagauaauuuggaugaau

SEQ ID NO: 422699 - RNA, 19 nt, Homo sapiens
ccagcaaucugaaugagaa

SEQ ID NO: 422700 - RNA, 19 nt, Homo sapiens
acagaugugugcaauauug

SEQ ID NO: 422701 - RNA, 19 nt, Homo sapiens
agaagaaccuccaaauauc

SEQ ID NO: 422702 - RNA, 19 nt, Homo sapiens
ggaaauaccaccuguagag

SEQ ID NO: 422703 - RNA, 19 nt, Homo sapiens
agaggaagcuaauuguuga

SEQ ID NO: 422704 - RNA, 19 nt, Homo sapiens
gaaaugaugguggaauauu

SEQ ID NO: 422705 - RNA, 19 nt, Homo sapiens
gaagaaccguacagugaca

SEQ ID NO: 422706 - RNA, 19 nt, Homo sapiens
ccagauagcaucagaaauc

SEQ ID NO: 422707 - RNA, 19 nt, Homo sapiens
gacaucaggacaucucuua

SEQ ID NO: 422708 - RNA, 19 nt, Homo sapiens
gggcaaaguuaacacugaa

SEQ ID NO: 422709 - RNA, 19 nt, Homo sapiens
auaaggagcuagaagcauu

SEQ ID NO: 422710 - RNA, 19 nt, Homo sapiens
agaaauugaugauguggaa

SEQ ID NO: 422711 - RNA, 19 nt, Homo sapiens
gaagcuaauuguugacagu

SEQ ID NO: 422712 - RNA, 19 nt, Homo sapiens
gaagaagcauuugcauugg

SEQ ID NO: 422713 - RNA, 19 nt, Homo sapiens
cggcuucucugauauuuau

SEQ ID NO: 422714 - RNA, 19 nt, Homo sapiens
agaguagagugacuauuaa

SEQ ID NO: 422715 - RNA, 19 nt, Homo sapiens
acacagaacccuuugagaa

SEQ ID NO: 422716 - RNA, 19 nt, Homo sapiens
gcagaacaaacauagauga

SEQ ID NO: 422717 - RNA, 19 nt, Homo sapiens
gaagaggaagcuaauuguu

SEQ ID NO: 422718 - RNA, 19 nt, Homo sapiens
gagaagaaguugggaacau

SEQ ID NO: 422719 - RNA, 19 nt, Homo sapiens
ccaagaaauugaugaugug

SEQ ID NO: 422720 - RNA, 19 nt, Homo sapiens
gauaagaagcuaaccaaag

SEQ ID NO: 422721 - RNA, 19 nt, Homo sapiens
gaaguugggaacaucagua

SEQ ID NO: 422722 - RNA, 19 nt, Homo sapiens
ucagagugguaauuguaua

SEQ ID NO: 422723 - RNA, 19 nt, Homo sapiens
gcaacgaaauccuauaucc

SEQ ID NO: 422724 - RNA, 19 nt, Homo sapiens
gagcaaagcuaggccugau

SEQ ID NO: 422725 - RNA, 19 nt, Homo sapiens
caacaauggucacccucuu

SEQ ID NO: 422726 - RNA, 19 nt, Homo sapiens
ucaguuugcuugaguuaug

SEQ ID NO: 422727 - RNA, 19 nt, Homo sapiens
gcauuggagccuauugaua

SEQ ID NO: 422728 - RNA, 19 nt, Homo sapiens
gaugacgacauguuaguaa

SEQ ID NO: 422729 - RNA, 19 nt, Homo sapiens
gaguagaguggaagagaua

SEQ ID NO: 422730 - RNA, 19 nt, Homo sapiens
ucuaggagcuauaaaucaa

SEQ ID NO: 422731 - RNA, 19 nt, Homo sapiens
gauuagauggguuguguuu

SEQ ID NO: 422732 - RNA, 19 nt, Homo sapiens
cacuagugcuuacaaauug

SEQ ID NO: 422733 - RNA, 19 nt, Homo sapiens
aggaaaugaugguggaaua

SEQ ID NO: 422734 - RNA, 19 nt, Homo sapiens
aauaugaugugccuguaaa

SEQ ID NO: 422735 - RNA, 19 nt, Homo sapiens
gaccagauagcaucagaaa

SEQ ID NO: 422736 - RNA, 19 nt, Homo sapiens
uauauccaguuuccuguaa

SEQ ID NO: 422737 - RNA, 19 nt, Homo sapiens
acagacugaugggaaauua

SEQ ID NO: 422738 - RNA, 19 nt, Homo sapiens
gcaauauuggugcauguaa

SEQ ID NO: 422739 - RNA, 19 nt, Homo sapiens
gcaaaguucuacagcuucu

SEQ ID NO: 422740 - RNA, 19 nt, Homo sapiens
ucgaugagcccauuauuga

SEQ ID NO: 422741 - RNA, 19 nt, Homo sapiens
guugggaacaucaguauuu

SEQ ID NO: 422742 - RNA, 19 nt, Homo sapiens
aaacucagacuucagugua

SEQ ID NO: 422743 - RNA, 19 nt, Homo sapiens
caucagaaaucaugugacu

SEQ ID NO: 422744 - RNA, 19 nt, Homo sapiens
acacuucuuuccaucagua

SEQ ID NO: 422745 - RNA, 19 nt, Homo sapiens
ucacuagugcuuacaaauu

SEQ ID NO: 422746 - RNA, 19 nt, Homo sapiens
gaagaaccuccaaauaucu

SEQ ID NO: 422747 - RNA, 19 nt, Homo sapiens
uuggauagcaagacaauua

SEQ ID NO: 422748 - RNA, 19 nt, Homo sapiens
ggaagaggaagcuaauugu

SEQ ID NO: 422749 - RNA, 19 nt, Homo sapiens
gauagcaucagaaaucaug

SEQ ID NO: 422750 - RNA, 19 nt, Homo sapiens
ggagcuagaagcauuauag

SEQ ID NO: 422751 - RNA, 19 nt, Homo sapiens
aaauugcuauugcagcuuu

SEQ ID NO: 422752 - RNA, 19 nt, Homo sapiens
caauauuggugcauguaau

SEQ ID NO: 422753 - RNA, 19 nt, Homo sapiens
uuagauggguuguguuugu

SEQ ID NO: 422754 - RNA, 19 nt, Homo sapiens
ccgcaaaguucuacagcuu

SEQ ID NO: 422755 - RNA, 19 nt, Homo sapiens
cuuaucggguuuaauauug

SEQ ID NO: 422756 - RNA, 19 nt, Homo sapiens
agaaaucaugugacuguua

SEQ ID NO: 422757 - RNA, 19 nt, Homo sapiens
cacagaacccuuugagaaa

SEQ ID NO: 422758 - RNA, 19 nt, Homo sapiens
gcagaugcuucauggucuu

SEQ ID NO: 422759 - RNA, 19 nt, Homo sapiens
ggaugaauuccucaaagaa

SEQ ID NO: 422760 - RNA, 19 nt, Homo sapiens
cauuggagccuauugauau

SEQ ID NO: 422761 - RNA, 19 nt, Homo sapiens
gaaaacagcaccccaagga

SEQ ID NO: 422762 - RNA, 19 nt, Homo sapiens
cuugaguuaugucgaaaua

SEQ ID NO: 422763 - RNA, 19 nt, Homo sapiens
gaacuuugaugacgaguga

SEQ ID NO: 422764 - RNA, 19 nt, Homo sapiens
gcccaaaucuuuccaucua

SEQ ID NO: 422765 - RNA, 19 nt, Homo sapiens
caacuuugauccuccauug

SEQ ID NO: 422766 - RNA, 19 nt, Homo sapiens
ggacagaaacucaucuaug

SEQ ID NO: 422767 - RNA, 19 nt, Homo sapiens
gacagaaacucaucuaugc

SEQ ID NO: 422768 - RNA, 19 nt, Homo sapiens
gaagauagaagcugagaag

SEQ ID NO: 422769 - RNA, 19 nt, Homo sapiens
ggagaacccucagcuuuua

SEQ ID NO: 422770 - RNA, 19 nt, Homo sapiens
gggcuaacaucagcucauu

SEQ ID NO: 422771 - RNA, 19 nt, Homo sapiens
ggagaaagaagcuauagag

SEQ ID NO: 422772 - RNA, 19 nt, Homo sapiens
caggagaacccucagcuuu

SEQ ID NO: 422773 - RNA, 19 nt, Homo sapiens
ugaguugcauguuguguga

SEQ ID NO: 422774 - RNA, 19 nt, Homo sapiens
uaacaucagcucauuguca

SEQ ID NO: 422775 - RNA, 19 nt, Homo sapiens
ugacggagaucauguccau

SEQ ID NO: 422776 - RNA, 19 nt, Homo sapiens
ugaaggugcuaaaggagaa

SEQ ID NO: 422777 - RNA, 19 nt, Homo sapiens
gagaaagaagcuauagaga

SEQ ID NO: 422778 - RNA, 19 nt, Homo sapiens
gaacaugcggcaggugauu

SEQ ID NO: 422779 - RNA, 19 nt, Homo sapiens
gcaggagaaagaagcuaua

SEQ ID NO: 422780 - RNA, 19 nt, Homo sapiens
gaucuugagugacgauguc

SEQ ID NO: 422781 - RNA, 19 nt, Homo sapiens
ucuguucccucuucaggua

SEQ ID NO: 422782 - RNA, 19 nt, Homo sapiens
caagagcccaucagaggaa

SEQ ID NO: 422783 - RNA, 19 nt, Homo sapiens
gcuaacaucagcucauugu

SEQ ID NO: 422784 - RNA, 19 nt, Homo sapiens
gauaaagguuuugaaguga

SEQ ID NO: 422785 - RNA, 19 nt, Homo sapiens
ccaacuuccuccugaguca

SEQ ID NO: 422786 - RNA, 19 nt, Homo sapiens
ggaagcagcaggagagaac

SEQ ID NO: 422787 - RNA, 19 nt, Homo sapiens
gaacuuuguggucgucaug

SEQ ID NO: 422788 - RNA, 19 nt, Homo sapiens
cggcgugaguugcauguug

SEQ ID NO: 422789 - RNA, 19 nt, Homo sapiens
gaagcuauagagagguuga

SEQ ID NO: 422790 - RNA, 19 nt, Homo sapiens
ggcaggugauucagcagaa

SEQ ID NO: 422791 - RNA, 19 nt, Homo sapiens
agacgaugcugacggagau

SEQ ID NO: 422792 - RNA, 19 nt, Homo sapiens
ugauaaagguuuugaagug

SEQ ID NO: 422793 - RNA, 19 nt, Homo sapiens
cggugaaggugcuaaagga

SEQ ID NO: 422794 - RNA, 19 nt, Homo sapiens
aagaagcuauagagagguu

SEQ ID NO: 422795 - RNA, 19 nt, Homo sapiens
aacaucagcucauugucaa

SEQ ID NO: 422796 - RNA, 19 nt, Homo sapiens
ugagucagaacuuugauga

SEQ ID NO: 422797 - RNA, 19 nt, Homo sapiens
ggagcuggcggacaucuca

SEQ ID NO: 422798 - RNA, 19 nt, Homo sapiens
ccagcuuccuguccuccua

SEQ ID NO: 422799 - RNA, 19 nt, Homo sapiens
gcagcagaccuucaagauc

SEQ ID NO: 422800 - RNA, 19 nt, Homo sapiens
gagugacgaugucccuauc

SEQ ID NO: 422801 - RNA, 19 nt, Homo sapiens
ggagaagggcuaacaucag

SEQ ID NO: 422802 - RNA, 19 nt, Homo sapiens
ggcgugaguugcauguugu

SEQ ID NO: 422803 - RNA, 19 nt, Homo sapiens
ugacgccgcaggagaaaga

SEQ ID NO: 422804 - RNA, 19 nt, Homo sapiens
gcuaaaggagaagauagaa

SEQ ID NO: 422805 - RNA, 19 nt, Homo sapiens
ugacgggcucugaguauga

SEQ ID NO: 422806 - RNA, 19 nt, Homo sapiens
gagaagauagaagcugaga

SEQ ID NO: 422807 - RNA, 19 nt, Homo sapiens
ggucauccaggccuauuuc

SEQ ID NO: 422808 - RNA, 19 nt, Homo sapiens
gcugagaagggucgugaug

SEQ ID NO: 422809 - RNA, 19 nt, Homo sapiens
cagagagccuggucaucca

SEQ ID NO: 422810 - RNA, 19 nt, Homo sapiens
gcaucgaugagaagaacuu

SEQ ID NO: 422811 - RNA, 19 nt, Homo sapiens
cuacccuuauuccaugaaa

SEQ ID NO: 422812 - RNA, 19 nt, Homo sapiens
gcucugaguaugagacgau

SEQ ID NO: 422813 - RNA, 19 nt, Homo sapiens
gugacgggcucugaguaug

SEQ ID NO: 422814 - RNA, 19 nt, Homo sapiens
ggugcuaaaggagaagaua

SEQ ID NO: 422815 - RNA, 19 nt, Homo sapiens
cagcagcagaccuucaaga

SEQ ID NO: 422816 - RNA, 19 nt, Homo sapiens
ucgaugagaagaacuuugu

SEQ ID NO: 422817 - RNA, 19 nt, Homo sapiens
uggagaagggcuaacauca

SEQ ID NO: 422818 - RNA, 19 nt, Homo sapiens
ugagagccagcuacaacaa

SEQ ID NO: 422819 - RNA, 19 nt, Homo sapiens
caggcucuguucccucuuc

SEQ ID NO: 422820 - RNA, 19 nt, Homo sapiens
ccuuauuccaugaaaguuu

SEQ ID NO: 422821 - RNA, 19 nt, Homo sapiens
aggccuauuucgcguguga

SEQ ID NO: 422822 - RNA, 19 nt, Homo sapiens
ggacugggaggcgacagau

SEQ ID NO: 422823 - RNA, 19 nt, Homo sapiens
gcaggugauucagcagaac

SEQ ID NO: 422824 - RNA, 19 nt, Homo sapiens
ugagugacgaugucccuau

SEQ ID NO: 422825 - RNA, 19 nt, Homo sapiens
caagauaucucauggcaua

SEQ ID NO: 422826 - RNA, 19 nt, Homo sapiens
caacagaugagacaaauua

SEQ ID NO: 422827 - RNA, 19 nt, Homo sapiens
gaacuuugaugaagauuga

SEQ ID NO: 422828 - RNA, 19 nt, Homo sapiens
aaacagaaaugccaaauug

SEQ ID NO: 422829 - RNA, 19 nt, Homo sapiens
guaaugcccugcuuuauau

SEQ ID NO: 422830 - RNA, 19 nt, Homo sapiens
gcagauaggucgagagaau

SEQ ID NO: 422831 - RNA, 19 nt, Homo sapiens
uaacugagaucaugucaau

SEQ ID NO: 422832 - RNA, 19 nt, Homo sapiens
gauaauggcuuugugaaau

SEQ ID NO: 422833 - RNA, 19 nt, Homo sapiens
gaacuacauucaaguaaca

SEQ ID NO: 422834 - RNA, 19 nt, Homo sapiens
gagaagcuguacaaguaua

SEQ ID NO: 422835 - RNA, 19 nt, Homo sapiens
gguauaagguaguagauug

SEQ ID NO: 422836 - RNA, 19 nt, Homo sapiens
ugaaagcacugaaagagaa

SEQ ID NO: 422837 - RNA, 19 nt, Homo sapiens
uugagaagcuguacaagua

SEQ ID NO: 422838 - RNA, 19 nt, Homo sapiens
gauguuaaaugaaccaguu

SEQ ID NO: 422839 - RNA, 19 nt, Homo sapiens
cagcagaccuucaagauag

SEQ ID NO: 422840 - RNA, 19 nt, Homo sapiens
gggcagaugucuacuuguu

SEQ ID NO: 422841 - RNA, 19 nt, Homo sapiens
gugcaugucugcuucaauu

SEQ ID NO: 422842 - RNA, 19 nt, Homo sapiens
gaaguggucauaugaacua

SEQ ID NO: 422843 - RNA, 19 nt, Homo sapiens
ggaaucagccucaguuuca

SEQ ID NO: 422844 - RNA, 19 nt, Homo sapiens
auacugcucucaaagaaua

SEQ ID NO: 422845 - RNA, 19 nt, Homo sapiens
gcagaugucuacuuguuca

SEQ ID NO: 422846 - RNA, 19 nt, Homo sapiens
guaaggaagcccauucuuu

SEQ ID NO: 422847 - RNA, 19 nt, Homo sapiens
ucgagagaauccucaauua

SEQ ID NO: 422848 - RNA, 19 nt, Homo sapiens
ucaagaagcugguggucaa

SEQ ID NO: 422849 - RNA, 19 nt, Homo sapiens
auugguaggugucuaauua

SEQ ID NO: 422850 - RNA, 19 nt, Homo sapiens
gcagaacuuugaugaagau

SEQ ID NO: 422851 - RNA, 19 nt, Homo sapiens
guuaaaggcauuaggauuu

SEQ ID NO: 422852 - RNA, 19 nt, Homo sapiens
gcagaauccuuccuugcuu

SEQ ID NO: 422853 - RNA, 19 nt, Homo sapiens
gcagcagaccuucaagaua

SEQ ID NO: 422854 - RNA, 19 nt, Homo sapiens
gcaaaauccucaaugauga

SEQ ID NO: 422855 - RNA, 19 nt, Homo sapiens
ggaagcccauucuuucaug

SEQ ID NO: 422856 - RNA, 19 nt, Homo sapiens
gugagaagaaugagaauuu

SEQ ID NO: 422857 - RNA, 19 nt, Homo sapiens
uaauagcaguguuggcuuu

SEQ ID NO: 422858 - RNA, 19 nt, Homo sapiens
gcauuacacuaacuuguuc

SEQ ID NO: 422859 - RNA, 19 nt, Homo sapiens
ccagaaacuuaguguaaug

SEQ ID NO: 422860 - RNA, 19 nt, Homo sapiens
gagaauaugguaacugaga

SEQ ID NO: 422861 - RNA, 19 nt, Homo sapiens
aaucuuagcuaccuagaau

SEQ ID NO: 422862 - RNA, 19 nt, Homo sapiens
gcucauauccacaauacuu

SEQ ID NO: 422863 - RNA, 19 nt, Homo sapiens
gacaaauuauucagcagaa

SEQ ID NO: 422864 - RNA, 19 nt, Homo sapiens
guaggugucuaauuacugu

SEQ ID NO: 422865 - RNA, 19 nt, Homo sapiens
acaaguauaggcagaguua

SEQ ID NO: 422866 - RNA, 19 nt, Homo sapiens
uaaggaagcccauucuuuc

SEQ ID NO: 422867 - RNA, 19 nt, Homo sapiens
uguggaaucuccuucauug

SEQ ID NO: 422868 - RNA, 19 nt, Homo sapiens
cagcagaacuuugaugaag

SEQ ID NO: 422869 - RNA, 19 nt, Homo sapiens
gcacugaaagagaagauug

SEQ ID NO: 422870 - RNA, 19 nt, Homo sapiens
gugagacccuucuaacaug

SEQ ID NO: 422871 - RNA, 19 nt, Homo sapiens
uguaaugcccugcuuuaua

SEQ ID NO: 422872 - RNA, 19 nt, Homo sapiens
gacaguacaucgggugauu

SEQ ID NO: 422873 - RNA, 19 nt, Homo sapiens
ggauaauggcuuugugaaa

SEQ ID NO: 422874 - RNA, 19 nt, Homo sapiens
gaacgagagcaaguaauug

SEQ ID NO: 422875 - RNA, 19 nt, Homo sapiens
caaguaacaccucaggaaa

SEQ ID NO: 422876 - RNA, 19 nt, Homo sapiens
cagaugagacaaauuauuc

SEQ ID NO: 422877 - RNA, 19 nt, Homo sapiens
gaaugugagacccuucuaa

SEQ ID NO: 422878 - RNA, 19 nt, Homo sapiens
gggcagggauaaauacagu

SEQ ID NO: 422879 - RNA, 19 nt, Homo sapiens
ugagaagaaugagaauuug

SEQ ID NO: 422880 - RNA, 19 nt, Homo sapiens
gaagcuauagaaagguuaa

SEQ ID NO: 422881 - RNA, 19 nt, Homo sapiens
agagaauccucaauuacuu

SEQ ID NO: 422882 - RNA, 19 nt, Homo sapiens
guacaucgggugauucuuc

SEQ ID NO: 422883 - RNA, 19 nt, Homo sapiens
ugauacugcucucaaagaa

SEQ ID NO: 422884 - RNA, 19 nt, Homo sapiens
ggugucuaauuacuguuua

SEQ ID NO: 422885 - RNA, 19 nt, Homo sapiens
gggcucauauccacaauac

SEQ ID NO: 422886 - RNA, 19 nt, Homo sapiens
gagagaauccucaauuacu

SEQ ID NO: 422887 - RNA, 19 nt, Homo sapiens
ugaacgagagcaaguaauu

SEQ ID NO: 422888 - RNA, 19 nt, Homo sapiens
acgagaauaugguaacuga

SEQ ID NO: 422889 - RNA, 19 nt, Homo sapiens
gcaacgagugcacuuguga

SEQ ID NO: 422890 - RNA, 19 nt, Homo sapiens
gaugucuacuuguucaguu

SEQ ID NO: 422891 - RNA, 19 nt, Homo sapiens
guggugagcuagcggauuc

SEQ ID NO: 422892 - RNA, 19 nt, Homo sapiens
ugacagagcaguggaguau

SEQ ID NO: 422893 - RNA, 19 nt, Homo sapiens
caagagaagccugcagaaa

SEQ ID NO: 422894 - RNA, 19 nt, Homo sapiens
cuucuaacaugauuugaga

SEQ ID NO: 422895 - RNA, 19 nt, Homo sapiens
uggcaacacuggauaaugg

SEQ ID NO: 422896 - RNA, 19 nt, Homo sapiens
gauguaucccuuugugaaa

SEQ ID NO: 422897 - RNA, 19 nt, Homo sapiens
uaacaugauuugagaagcu

SEQ ID NO: 422898 - RNA, 19 nt, Homo sapiens
uagaaagguuaaaggcauu

SEQ ID NO: 422899 - RNA, 19 nt, Homo sapiens
ucaaguaacaccucaggaa

SEQ ID NO: 422900 - RNA, 19 nt, Homo sapiens
ggucuuuauuucuucugua

SEQ ID NO: 422901 - RNA, 19 nt, Homo sapiens
ggauaaauacagugcaugu

SEQ ID NO: 422902 - RNA, 19 nt, Homo sapiens
gaagcuggaaguggucaua

SEQ ID NO: 422903 - RNA, 19 nt, Homo sapiens
gauaagaguguauuaccau

SEQ ID NO: 422904 - RNA, 19 nt, Homo sapiens
uacuagauccagaaacuua

SEQ ID NO: 422905 - RNA, 19 nt, Homo sapiens
gccaacaccaggagcauuu

SEQ ID NO: 422906 - RNA, 19 nt, Homo sapiens
gaaucagccucaguuucaa

SEQ ID NO: 422907 - RNA, 19 nt, Homo sapiens
uaugguaacugagaucaug

SEQ ID NO: 422908 - RNA, 19 nt, Homo sapiens
ugaugauacugcucucaaa

SEQ ID NO: 422909 - RNA, 19 nt, Homo sapiens
gcccauucuuucauguuaa

SEQ ID NO: 422910 - RNA, 19 nt, Homo sapiens
gagauguggcuggaaagua

SEQ ID NO: 422911 - RNA, 19 nt, Homo sapiens
gaagcccauucuuucaugu

SEQ ID NO: 422912 - RNA, 19 nt, Homo sapiens
aaugccaaauugaugguua

SEQ ID NO: 422913 - RNA, 19 nt, Homo sapiens
gagggagggaucuaggaua

SEQ ID NO: 422914 - RNA, 19 nt, Homo sapiens
gcuggaaguggucauauga

SEQ ID NO: 422915 - RNA, 19 nt, Homo sapiens
ggacauccccuugaauuuu

SEQ ID NO: 422916 - RNA, 19 nt, Homo sapiens
gcaguggaguaucuuuuaa

SEQ ID NO: 422917 - RNA, 19 nt, Homo sapiens
gcacuacagcaguuacuuc

SEQ ID NO: 422918 - RNA, 19 nt, Homo sapiens
ugagacccuucuaacauga

SEQ ID NO: 422919 - RNA, 19 nt, Homo sapiens
gauuugagaagcuguacaa

SEQ ID NO: 422920 - RNA, 19 nt, Homo sapiens
uugcaggucuuuauuucuu

SEQ ID NO: 422921 - RNA, 19 nt, Homo sapiens
ggauacagggcagggauaa

SEQ ID NO: 422922 - RNA, 19 nt, Homo sapiens
ggagggaucuaggauacag

SEQ ID NO: 422923 - RNA, 19 nt, Homo sapiens
cugaaggacuugugauaca

SEQ ID NO: 422924 - RNA, 19 nt, Homo sapiens
uuaaaggcauuaggauuuc

SEQ ID NO: 422925 - RNA, 19 nt, Homo sapiens
gaaaggccauguacauuga

SEQ ID NO: 422926 - RNA, 19 nt, Homo sapiens
gcagugauguccuggauaa

SEQ ID NO: 422927 - RNA, 19 nt, Homo sapiens
gaagcuauguucgccauua

SEQ ID NO: 422928 - RNA, 19 nt, Homo sapiens
ccaaagagcuugacaaacu

SEQ ID NO: 422929 - RNA, 19 nt, Homo sapiens
gaaaucccaucucuacaaa

SEQ ID NO: 422930 - RNA, 19 nt, Homo sapiens
guagagaaguggagcguaa

SEQ ID NO: 422931 - RNA, 19 nt, Homo sapiens
ucagagaucauacagauua

SEQ ID NO: 422932 - RNA, 19 nt, Homo sapiens
ccaacgaugugaagaaauu

SEQ ID NO: 422933 - RNA, 19 nt, Homo sapiens
ggucagagaucauacagau

SEQ ID NO: 422934 - RNA, 19 nt, Homo sapiens
gccaaagacugaaucauug

SEQ ID NO: 422935 - RNA, 19 nt, Homo sapiens
caaagagcuugacaaacua

SEQ ID NO: 422936 - RNA, 19 nt, Homo sapiens
caaagaaggagcuaauaaa

SEQ ID NO: 422937 - RNA, 19 nt, Homo sapiens
ggaaaggccauguacauug

SEQ ID NO: 422938 - RNA, 19 nt, Homo sapiens
ggagagaccugacccuucu

SEQ ID NO: 422939 - RNA, 19 nt, Homo sapiens
ugaaugaucuuguguaagg

SEQ ID NO: 422940 - RNA, 19 nt, Homo sapiens
uaaguugucugucugaaug

SEQ ID NO: 422941 - RNA, 19 nt, Homo sapiens
guaaacagauuugauugug

SEQ ID NO: 422942 - RNA, 19 nt, Homo sapiens
gcaacugaauuccaccaaa

SEQ ID NO: 422943 - RNA, 19 nt, Homo sapiens
gguaugcacugcuuauugu

SEQ ID NO: 422944 - RNA, 19 nt, Homo sapiens
ccaaagaaggagcuaauaa

SEQ ID NO: 422945 - RNA, 19 nt, Homo sapiens
ggagacaggucaguaguca

SEQ ID NO: 422946 - RNA, 19 nt, Homo sapiens
ggugguagcucaaguggau

SEQ ID NO: 422947 - RNA, 19 nt, Homo sapiens
ccauguacauugacacuga

SEQ ID NO: 422948 - RNA, 19 nt, Homo sapiens
agacccagcuccuuuauca

SEQ ID NO: 422949 - RNA, 19 nt, Homo sapiens
caacugaauuccaccaaag

SEQ ID NO: 422950 - RNA, 19 nt, Homo sapiens
agaaauguuuggagaauuc

SEQ ID NO: 422951 - RNA, 19 nt, Homo sapiens
gaauugagacuggaucuau

SEQ ID NO: 422952 - RNA, 19 nt, Homo sapiens
ccuagagucuuaaagcauu

SEQ ID NO: 422953 - RNA, 19 nt, Homo sapiens
agauaauccuagagucuua

SEQ ID NO: 422954 - RNA, 19 nt, Homo sapiens
caaaggcggucagagauca

SEQ ID NO: 422955 - RNA, 19 nt, Homo sapiens
gggaauuagugaagccaaa

SEQ ID NO: 422956 - RNA, 19 nt, Homo sapiens
gagggcaaguaaacagauu

SEQ ID NO: 422957 - RNA, 19 nt, Homo sapiens
ucugaaugaucuuguguaa

SEQ ID NO: 422958 - RNA, 19 nt, Homo sapiens
guauuaaucucuguguguu

SEQ ID NO: 422959 - RNA, 19 nt, Homo sapiens
cuuaagugcugcagccuaa

SEQ ID NO: 422960 - RNA, 19 nt, Homo sapiens
ggauggagcagcgauguuu

SEQ ID NO: 422961 - RNA, 19 nt, Homo sapiens
gagaucauacagauuacua

SEQ ID NO: 422962 - RNA, 19 nt, Homo sapiens
gcaaguaaacagauuugau

SEQ ID NO: 422963 - RNA, 19 nt, Homo sapiens
ggaagacccagaucuguca

SEQ ID NO: 422964 - RNA, 19 nt, Homo sapiens
gaggugggagaaucacuua

SEQ ID NO: 422965 - RNA, 19 nt, Homo sapiens
aggaaugacuuggguuuaa

SEQ ID NO: 422966 - RNA, 19 nt, Homo sapiens
cauggugccuuaggaauga

SEQ ID NO: 422967 - RNA, 19 nt, Homo sapiens
guaaggguuugguuaugga

SEQ ID NO: 422968 - RNA, 19 nt, Homo sapiens
gacuggaucuaucacagaa

SEQ ID NO: 422969 - RNA, 19 nt, Homo sapiens
gcaagcgaguagagaagug

SEQ ID NO: 422970 - RNA, 19 nt, Homo sapiens
uaucaucgcccaugcauca

SEQ ID NO: 422971 - RNA, 19 nt, Homo sapiens
gugauguccuggauaaugu

SEQ ID NO: 422972 - RNA, 19 nt, Homo sapiens
ugaggcuucuaauaaagua

SEQ ID NO: 422973 - RNA, 19 nt, Homo sapiens
ugaaaucccaucucuacaa

SEQ ID NO: 422974 - RNA, 19 nt, Homo sapiens
uauggagucuugugccaaa

SEQ ID NO: 422975 - RNA, 19 nt, Homo sapiens
gauugugaggcuucuaaua

SEQ ID NO: 422976 - RNA, 19 nt, Homo sapiens
ggugaaaucccaucucuac

SEQ ID NO: 422977 - RNA, 19 nt, Homo sapiens
ucuuugacauggugccuua

SEQ ID NO: 422978 - RNA, 19 nt, Homo sapiens
uaucaagcaucagccauga

SEQ ID NO: 422979 - RNA, 19 nt, Homo sapiens
acagaaauguuuggagaau

SEQ ID NO: 422980 - RNA, 19 nt, Homo sapiens
gauuacuacuggcuccaaa

SEQ ID NO: 422981 - RNA, 19 nt, Homo sapiens
agccaaagcugauaaaauu

SEQ ID NO: 422982 - RNA, 19 nt, Homo sapiens
cuaagacuaacucaagaua

SEQ ID NO: 422983 - RNA, 19 nt, Homo sapiens
acccuucucucacuucuaa

SEQ ID NO: 422984 - RNA, 19 nt, Homo sapiens
ggaaugacuuggguuuaac

SEQ ID NO: 422985 - RNA, 19 nt, Homo sapiens
gauuguaucugaggaaagg

SEQ ID NO: 422986 - RNA, 19 nt, Homo sapiens
cagaaauguuuggagaauu

SEQ ID NO: 422987 - RNA, 19 nt, Homo sapiens
gguggaaguugcagugagu

SEQ ID NO: 422988 - RNA, 19 nt, Homo sapiens
gugaagaaauuggaagaag

SEQ ID NO: 422989 - RNA, 19 nt, Homo sapiens
uaaaaugccucagcuaugu

SEQ ID NO: 422990 - RNA, 19 nt, Homo sapiens
uuagagcaguguggcauaa

SEQ ID NO: 422991 - RNA, 19 nt, Homo sapiens
ugccaaagacugaaucauu

SEQ ID NO: 422992 - RNA, 19 nt, Homo sapiens
ccugccagcuucccauuga

SEQ ID NO: 422993 - RNA, 19 nt, Homo sapiens
caagauaauccuagagucu

SEQ ID NO: 422994 - RNA, 19 nt, Homo sapiens
gaucuuguguaaggguuug

SEQ ID NO: 422995 - RNA, 19 nt, Homo sapiens
aagcuauguucgccauuaa

SEQ ID NO: 422996 - RNA, 19 nt, Homo sapiens
ggcaguggcugagagguau

SEQ ID NO: 422997 - RNA, 19 nt, Homo sapiens
gaagaaauuggaagaagcu

SEQ ID NO: 422998 - RNA, 19 nt, Homo sapiens
uaaucuggacacacuguua

SEQ ID NO: 422999 - RNA, 19 nt, Homo sapiens
uggccaagauggugaaauc

SEQ ID NO: 423000 - RNA, 19 nt, Homo sapiens
acuggacaaucuuauguuu

SEQ ID NO: 423001 - RNA, 19 nt, Homo sapiens
gaaguaucuuugacauggu

SEQ ID NO: 423002 - RNA, 19 nt, Homo sapiens
uuccuucuguaguguauua

SEQ ID NO: 423003 - RNA, 19 nt, Homo sapiens
cuacgacucucccugucuu

SEQ ID NO: 423004 - RNA, 19 nt, Homo sapiens
gaaggaaaggccauguaca

SEQ ID NO: 423005 - RNA, 19 nt, Homo sapiens
gcugggaacugcaacucau

SEQ ID NO: 423006 - RNA, 19 nt, Homo sapiens
caccaaaggcggucagaga

SEQ ID NO: 423007 - RNA, 19 nt, Homo sapiens
ggguggaggugaaggaaag

SEQ ID NO: 423008 - RNA, 19 nt, Homo sapiens
uugugaggcuucuaauaaa

SEQ ID NO: 423009 - RNA, 19 nt, Homo sapiens
guuuauuccuucuguagug

SEQ ID NO: 423010 - RNA, 19 nt, Homo sapiens
gggagaugccaaagacuga

SEQ ID NO: 423011 - RNA, 19 nt, Homo sapiens
caccagacccagcuccuuu

SEQ ID NO: 423012 - RNA, 19 nt, Homo sapiens
gagcuugacaaacuacuuc

SEQ ID NO: 423013 - RNA, 19 nt, Homo sapiens
agagugagaccauguuuca

SEQ ID NO: 423014 - RNA, 19 nt, Homo sapiens
agaaagcuuuggcccacaa

SEQ ID NO: 423015 - RNA, 19 nt, Homo sapiens
cuagagucuuaaagcauuu

SEQ ID NO: 423016 - RNA, 19 nt, Homo sapiens
gagcaguguggcauaaaug

SEQ ID NO: 423017 - RNA, 19 nt, Homo sapiens
gccaaagaaggagcuaaua

SEQ ID NO: 423018 - RNA, 19 nt, Homo sapiens
auugugaggcuucuaauaa

SEQ ID NO: 423019 - RNA, 19 nt, Homo sapiens
cauuagcccuucaccaucu

SEQ ID NO: 423020 - RNA, 19 nt, Homo sapiens
gguaugaaguaucuuugac

SEQ ID NO: 423021 - RNA, 19 nt, Homo sapiens
gucacaaacugaucuaaaa

SEQ ID NO: 423022 - RNA, 19 nt, Homo sapiens
acaggucaguagucacaaa

SEQ ID NO: 423023 - RNA, 19 nt, Homo sapiens
uguugugacugccaggaua

SEQ ID NO: 423024 - RNA, 19 nt, Homo sapiens
ugaagcaaaugcagauacu

SEQ ID NO: 423025 - RNA, 19 nt, Homo sapiens
gcagugauguccuggauaa

SEQ ID NO: 423026 - RNA, 19 nt, Homo sapiens
gaagcuauguucgccauua

SEQ ID NO: 423027 - RNA, 19 nt, Homo sapiens
gaaaucccaucucuacaaa

SEQ ID NO: 423028 - RNA, 19 nt, Homo sapiens
guagagaaguggagcguaa

SEQ ID NO: 423029 - RNA, 19 nt, Homo sapiens
ccaacgaugugaagaaauu

SEQ ID NO: 423030 - RNA, 19 nt, Homo sapiens
gccaaagacugaaucauug

SEQ ID NO: 423031 - RNA, 19 nt, Homo sapiens
caaagaaggagcuaauaaa

SEQ ID NO: 423032 - RNA, 19 nt, Homo sapiens
ggagagaccugacccuucu

SEQ ID NO: 423033 - RNA, 19 nt, Homo sapiens
ugaaugaucuuguguaagg

SEQ ID NO: 423034 - RNA, 19 nt, Homo sapiens
uaaguugucugucugaaug

SEQ ID NO: 423035 - RNA, 19 nt, Homo sapiens
guaaacagauuugauugug

SEQ ID NO: 423036 - RNA, 19 nt, Homo sapiens
gguaugcacugcuuauugu

SEQ ID NO: 423037 - RNA, 19 nt, Homo sapiens
ccaaagaaggagcuaauaa

SEQ ID NO: 423038 - RNA, 19 nt, Homo sapiens
ggagacaggucaguaguca

SEQ ID NO: 423039 - RNA, 19 nt, Homo sapiens
ggugguagcucaaguggau

SEQ ID NO: 423040 - RNA, 19 nt, Homo sapiens
agacccagcuccuuuauca

SEQ ID NO: 423041 - RNA, 19 nt, Homo sapiens
ccuagagucuuaaagcauu

SEQ ID NO: 423042 - RNA, 19 nt, Homo sapiens
agauaauccuagagucuua

SEQ ID NO: 423043 - RNA, 19 nt, Homo sapiens
gggaauuagugaagccaaa

SEQ ID NO: 423044 - RNA, 19 nt, Homo sapiens
gagggcaaguaaacagauu

SEQ ID NO: 423045 - RNA, 19 nt, Homo sapiens
ucugaaugaucuuguguaa

SEQ ID NO: 423046 - RNA, 19 nt, Homo sapiens
guauuaaucucuguguguu

SEQ ID NO: 423047 - RNA, 19 nt, Homo sapiens
cuuaagugcugcagccuaa

SEQ ID NO: 423048 - RNA, 19 nt, Homo sapiens
ggauggagcagcgauguuu

SEQ ID NO: 423049 - RNA, 19 nt, Homo sapiens
gcaaguaaacagauuugau

SEQ ID NO: 423050 - RNA, 19 nt, Homo sapiens
gaggugggagaaucacuua

SEQ ID NO: 423051 - RNA, 19 nt, Homo sapiens
aggaaugacuuggguuuaa

SEQ ID NO: 423052 - RNA, 19 nt, Homo sapiens
cauggugccuuaggaauga

SEQ ID NO: 423053 - RNA, 19 nt, Homo sapiens
gcaagcgaguagagaagug

SEQ ID NO: 423054 - RNA, 19 nt, Homo sapiens
guaaggguuugguuaugga

SEQ ID NO: 423055 - RNA, 19 nt, Homo sapiens
uaucaucgcccaugcauca

SEQ ID NO: 423056 - RNA, 19 nt, Homo sapiens
gugauguccuggauaaugu

SEQ ID NO: 423057 - RNA, 19 nt, Homo sapiens
ugaggcuucuaauaaagua

SEQ ID NO: 423058 - RNA, 19 nt, Homo sapiens
ugaaaucccaucucuacaa

SEQ ID NO: 423059 - RNA, 19 nt, Homo sapiens
uauggagucuugugccaaa

SEQ ID NO: 423060 - RNA, 19 nt, Homo sapiens
gauugugaggcuucuaaua

SEQ ID NO: 423061 - RNA, 19 nt, Homo sapiens
ggugaaaucccaucucuac

SEQ ID NO: 423062 - RNA, 19 nt, Homo sapiens
ucuuugacauggugccuua

SEQ ID NO: 423063 - RNA, 19 nt, Homo sapiens
uaucaagcaucagccauga

SEQ ID NO: 423064 - RNA, 19 nt, Homo sapiens
agccaaagcugauaaaauu

SEQ ID NO: 423065 - RNA, 19 nt, Homo sapiens
cuaagacuaacucaagaua

SEQ ID NO: 423066 - RNA, 19 nt, Homo sapiens
acccuucucucacuucuaa

SEQ ID NO: 423067 - RNA, 19 nt, Homo sapiens
ggaaugacuuggguuuaac

SEQ ID NO: 423068 - RNA, 19 nt, Homo sapiens
gauuguaucugaggaaagg

SEQ ID NO: 423069 - RNA, 19 nt, Homo sapiens
gguggaaguugcagugagu

SEQ ID NO: 423070 - RNA, 19 nt, Homo sapiens
gugaagaaauuggaagaag

SEQ ID NO: 423071 - RNA, 19 nt, Homo sapiens
uaaaaugccucagcuaugu

SEQ ID NO: 423072 - RNA, 19 nt, Homo sapiens
ugccaaagacugaaucauu

SEQ ID NO: 423073 - RNA, 19 nt, Homo sapiens
uuagagcaguguggcauaa

SEQ ID NO: 423074 - RNA, 19 nt, Homo sapiens
caagauaauccuagagucu

SEQ ID NO: 423075 - RNA, 19 nt, Homo sapiens
gaucuuguguaaggguuug

SEQ ID NO: 423076 - RNA, 19 nt, Homo sapiens
aagcuauguucgccauuaa

SEQ ID NO: 423077 - RNA, 19 nt, Homo sapiens
ggcaguggcugagagguau

SEQ ID NO: 423078 - RNA, 19 nt, Homo sapiens
gaagaaauuggaagaagcu

SEQ ID NO: 423079 - RNA, 19 nt, Homo sapiens
uaaucuggacacacuguua

SEQ ID NO: 423080 - RNA, 19 nt, Homo sapiens
uggccaagauggugaaauc

SEQ ID NO: 423081 - RNA, 19 nt, Homo sapiens
gcugggaacugcaacucau

SEQ ID NO: 423082 - RNA, 19 nt, Homo sapiens
acuggacaaucuuauguuu

SEQ ID NO: 423083 - RNA, 19 nt, Homo sapiens
gaaguaucuuugacauggu

SEQ ID NO: 423084 - RNA, 19 nt, Homo sapiens
uuccuucuguaguguauua

SEQ ID NO: 423085 - RNA, 19 nt, Homo sapiens
cuacgacucucccugucuu

SEQ ID NO: 423086 - RNA, 19 nt, Homo sapiens
uugugaggcuucuaauaaa

SEQ ID NO: 423087 - RNA, 19 nt, Homo sapiens
guuuauuccuucuguagug

SEQ ID NO: 423088 - RNA, 19 nt, Homo sapiens
gggagaugccaaagacuga

SEQ ID NO: 423089 - RNA, 19 nt, Homo sapiens
caccagacccagcuccuuu

SEQ ID NO: 423090 - RNA, 19 nt, Homo sapiens
gagcaguguggcauaaaug

SEQ ID NO: 423091 - RNA, 19 nt, Homo sapiens
agagugagaccauguuuca

SEQ ID NO: 423092 - RNA, 19 nt, Homo sapiens
cuagagucuuaaagcauuu

SEQ ID NO: 423093 - RNA, 19 nt, Homo sapiens
agaaagcuuuggcccacaa

SEQ ID NO: 423094 - RNA, 19 nt, Homo sapiens
gccaaagaaggagcuaaua

SEQ ID NO: 423095 - RNA, 19 nt, Homo sapiens
auugugaggcuucuaauaa

SEQ ID NO: 423096 - RNA, 19 nt, Homo sapiens
ugaagcaaaugcagauacu

SEQ ID NO: 423097 - RNA, 19 nt, Homo sapiens
cauuagcccuucaccaucu

SEQ ID NO: 423098 - RNA, 19 nt, Homo sapiens
gguaugaaguaucuuugac

SEQ ID NO: 423099 - RNA, 19 nt, Homo sapiens
gucacaaacugaucuaaaa

SEQ ID NO: 423100 - RNA, 19 nt, Homo sapiens
acaggucaguagucacaaa

SEQ ID NO: 423101 - RNA, 19 nt, Homo sapiens
uguugugacugccaggaua

SEQ ID NO: 423102 - RNA, 19 nt, Homo sapiens
gauaauccuagagucuuaa

SEQ ID NO: 423103 - RNA, 19 nt, Homo sapiens
gccauuagcccuucaccau

SEQ ID NO: 423104 - RNA, 19 nt, Homo sapiens
ugccaacgaugugaagaaa

SEQ ID NO: 423105 - RNA, 19 nt, Homo sapiens
gcuauguucgccauuaaug

SEQ ID NO: 423106 - RNA, 19 nt, Homo sapiens
gcagauggagugggagaug

SEQ ID NO: 423107 - RNA, 19 nt, Homo sapiens
gcccaugcaucaacaacca

SEQ ID NO: 423108 - RNA, 19 nt, Homo sapiens
gcuccuuuaucaagcauca

SEQ ID NO: 423109 - RNA, 19 nt, Homo sapiens
gggcaaguaaacagauuug

SEQ ID NO: 423110 - RNA, 19 nt, Homo sapiens
caaaugcagauacuucagu

SEQ ID NO: 423111 - RNA, 19 nt, Homo sapiens
gggaaaacagcuauuauau

SEQ ID NO: 423112 - RNA, 19 nt, Homo sapiens
agugagaccauguuucaaa

SEQ ID NO: 423113 - RNA, 19 nt, Homo sapiens
ugacauggugccuuaggaa

SEQ ID NO: 423114 - RNA, 19 nt, Homo sapiens
cagcuuuucugaugguaua

SEQ ID NO: 423115 - RNA, 19 nt, Homo sapiens
ggaaaacagcuauuauauc

SEQ ID NO: 423116 - RNA, 19 nt, Homo sapiens
agagcaguguggcauaaau

SEQ ID NO: 423117 - RNA, 19 nt, Homo sapiens
guguaaggguuugguuaug

SEQ ID NO: 423118 - RNA, 19 nt, Homo sapiens
gaaugacuuggguuuaaca

SEQ ID NO: 423119 - RNA, 19 nt, Homo sapiens
ggguaugaaguaucuuuga

SEQ ID NO: 423120 - RNA, 19 nt, Homo sapiens
ggaggagggguaugaagua

SEQ ID NO: 423121 - RNA, 19 nt, Homo sapiens
cauaaaugccaacgaugug

SEQ ID NO: 423122 - RNA, 19 nt, Homo sapiens
uaaaugccaacgaugugaa

SEQ ID NO: 423123 - RNA, 19 nt, Homo sapiens
gugaagccaaagcugauaa

SEQ ID NO: 423124 - RNA, 19 nt, Homo sapiens
agucccagcuacucuauag

SEQ ID NO: 423125 - RNA, 19 nt, Homo sapiens
gugaaacccuccgagcuua

SEQ ID NO: 423126 - RNA, 19 nt, Homo sapiens
guucagcacuagaugauau

SEQ ID NO: 423127 - RNA, 19 nt, Homo sapiens
guacagcacuggaacuucu

SEQ ID NO: 423128 - RNA, 19 nt, Homo sapiens
caggaaaccaaauaagaua

SEQ ID NO: 423129 - RNA, 19 nt, Homo sapiens
cuuagaaacucugcaaauu

SEQ ID NO: 423130 - RNA, 19 nt, Homo sapiens
ggagugcccuuaaugaaaa

SEQ ID NO: 423131 - RNA, 19 nt, Homo sapiens
gaaacucugcaaauuauca

SEQ ID NO: 423132 - RNA, 19 nt, Homo sapiens
gcagaagccuuagaaacuc

SEQ ID NO: 423133 - RNA, 19 nt, Homo sapiens
uaaagcagaagccuuagaa

SEQ ID NO: 423134 - RNA, 19 nt, Homo sapiens
acccagggcuucauaauca

SEQ ID NO: 423135 - RNA, 19 nt, Homo sapiens
ccuccgagcuuagcaaaga

SEQ ID NO: 423136 - RNA, 19 nt, Homo sapiens
gauaugcugguacaucuga

SEQ ID NO: 423137 - RNA, 19 nt, Homo sapiens
cauaaucaccuucuguuca

SEQ ID NO: 423138 - RNA, 19 nt, Homo sapiens
uaaguguguaugugcauua

SEQ ID NO: 423139 - RNA, 19 nt, Homo sapiens
gaaugucucacaaauaaac

SEQ ID NO: 423140 - RNA, 19 nt, Homo sapiens
ggugaaacccuccgagcuu

SEQ ID NO: 423141 - RNA, 19 nt, Homo sapiens
gaagacguuccgcuuugaa

SEQ ID NO: 423142 - RNA, 19 nt, Homo sapiens
caaauaaaccaagauaugc

SEQ ID NO: 423143 - RNA, 19 nt, Homo sapiens
caccuucuguucagcacua

SEQ ID NO: 423144 - RNA, 19 nt, Homo sapiens
ggguggguuuaauaacaua

SEQ ID NO: 423145 - RNA, 19 nt, Homo sapiens
ucucacaaauaaaccaaga

SEQ ID NO: 423146 - RNA, 19 nt, Homo sapiens
gcaaauuaucagaagagaa

SEQ ID NO: 423147 - RNA, 19 nt, Homo sapiens
ucaggaaaccaaauaagau

SEQ ID NO: 423148 - RNA, 19 nt, Homo sapiens
aaggguggguuuaauaaca

SEQ ID NO: 423149 - RNA, 19 nt, Homo sapiens
gcacuagaugauauucuug

SEQ ID NO: 423150 - RNA, 19 nt, Homo sapiens
gcauacccagggcuucaua

SEQ ID NO: 423151 - RNA, 19 nt, Homo sapiens
gguggagugcccuuaauga

SEQ ID NO: 423152 - RNA, 19 nt, Homo sapiens
caucugagucacacaagaa

SEQ ID NO: 423153 - RNA, 19 nt, Homo sapiens
guacaucugagucacacaa

SEQ ID NO: 423154 - RNA, 19 nt, Homo sapiens
caagauaugcugguacauc

SEQ ID NO: 423155 - RNA, 19 nt, Homo sapiens
gucaggaaaccaaauaaga

SEQ ID NO: 423156 - RNA, 19 nt, Homo sapiens
uggagugcccuuaaugaaa

SEQ ID NO: 423157 - RNA, 19 nt, Homo sapiens
gagcauacccagggcuuca

SEQ ID NO: 423158 - RNA, 19 nt, Homo sapiens
gcagcgggauuuggugagu

SEQ ID NO: 423159 - RNA, 19 nt, Homo sapiens
guggagugcccuuaaugaa

SEQ ID NO: 423160 - RNA, 19 nt, Homo sapiens
gacguuccgcuuugaaaug

SEQ ID NO: 423161 - RNA, 19 nt, Homo sapiens
guguguaugugcauuaaac

SEQ ID NO: 423162 - RNA, 19 nt, Homo sapiens
cagaagccuuagaaacucu

SEQ ID NO: 423163 - RNA, 19 nt, Homo sapiens
agcacuagaugauauucuu

SEQ ID NO: 423164 - RNA, 19 nt, Homo sapiens
auaaucaccuucuguucag

SEQ ID NO: 423165 - RNA, 19 nt, Homo sapiens
aaguguguaugugcauuaa

SEQ ID NO: 423166 - RNA, 19 nt, Homo sapiens
uuaaguguguaugugcauu

SEQ ID NO: 423167 - RNA, 19 nt, Homo sapiens
agcgggauuuggugaguuu

SEQ ID NO: 423168 - RNA, 19 nt, Homo sapiens
ccuuagaaacucugcaaau

SEQ ID NO: 423169 - RNA, 19 nt, Homo sapiens
cagcgggauuuggugaguu

SEQ ID NO: 423170 - RNA, 19 nt, Homo sapiens
aucuaaagcagaagccuua

SEQ ID NO: 423171 - RNA, 19 nt, Homo sapiens
ccagacugcugaggaacuc

SEQ ID NO: 423172 - RNA, 19 nt, Homo sapiens
ccaaucagaugacaacaaa

SEQ ID NO: 423173 - RNA, 19 nt, Homo sapiens
ccucagggauuuagagaua

SEQ ID NO: 423174 - RNA, 19 nt, Homo sapiens
gggacaugcugcuacaaua

SEQ ID NO: 423175 - RNA, 19 nt, Homo sapiens
ggauuucacucuugauaau

SEQ ID NO: 423176 - RNA, 19 nt, Homo sapiens
gaagaauuauaacccagaa

SEQ ID NO: 423177 - RNA, 19 nt, Homo sapiens
gagauacuguuguuacuuc

SEQ ID NO: 423178 - RNA, 19 nt, Homo sapiens
gaaaagcuuuggaggauuu

SEQ ID NO: 423179 - RNA, 19 nt, Homo sapiens
gcacaaguuuaucuucuuc

SEQ ID NO: 423180 - RNA, 19 nt, Homo sapiens
ggcaguagaugugcagaua

SEQ ID NO: 423181 - RNA, 19 nt, Homo sapiens
gaugaccugucucuucgua

SEQ ID NO: 423182 - RNA, 19 nt, Homo sapiens
gugaaacccuccgagcuua

SEQ ID NO: 423183 - RNA, 19 nt, Homo sapiens
gaucagccuugcaaauaau

SEQ ID NO: 423184 - RNA, 19 nt, Homo sapiens
agaaacaaaucucaaagug

SEQ ID NO: 423185 - RNA, 19 nt, Homo sapiens
guucagcacuagaugauau

SEQ ID NO: 423186 - RNA, 19 nt, Homo sapiens
guacagcacuggaacuucu

SEQ ID NO: 423187 - RNA, 19 nt, Homo sapiens
gaaaucaggccuugcuugu

SEQ ID NO: 423188 - RNA, 19 nt, Homo sapiens
caauacggcuaaucuuuca

SEQ ID NO: 423189 - RNA, 19 nt, Homo sapiens
ugaucagccuugcaaauaa

SEQ ID NO: 423190 - RNA, 19 nt, Homo sapiens
guugugaaaucaaugugua

SEQ ID NO: 423191 - RNA, 19 nt, Homo sapiens
gaaacaaaucucaaagugu

SEQ ID NO: 423192 - RNA, 19 nt, Homo sapiens
gaggauuucacucuugaua

SEQ ID NO: 423193 - RNA, 19 nt, Homo sapiens
cuuagaaacucugcaaauu

SEQ ID NO: 423194 - RNA, 19 nt, Homo sapiens
caaaugaucagccuugcaa

SEQ ID NO: 423195 - RNA, 19 nt, Homo sapiens
ggagugcccuuaaugaaaa

SEQ ID NO: 423196 - RNA, 19 nt, Homo sapiens
gaaacucugcaaauuauca

SEQ ID NO: 423197 - RNA, 19 nt, Homo sapiens
gcagaagccuuagaaacuc

SEQ ID NO: 423198 - RNA, 19 nt, Homo sapiens
aaucaggccuugcuuguuc

SEQ ID NO: 423199 - RNA, 19 nt, Homo sapiens
uaaagcagaagccuuagaa

SEQ ID NO: 423200 - RNA, 19 nt, Homo sapiens
cguacucgguuauuaaaug

SEQ ID NO: 423201 - RNA, 19 nt, Homo sapiens
uaaacacacuauggcauga

SEQ ID NO: 423202 - RNA, 19 nt, Homo sapiens
agacccagaggaagaauua

SEQ ID NO: 423203 - RNA, 19 nt, Homo sapiens
ccuccgagcuuagcaaaga

SEQ ID NO: 423204 - RNA, 19 nt, Homo sapiens
ggauuuagagauacuguug

SEQ ID NO: 423205 - RNA, 19 nt, Homo sapiens
ccagaaggaaugcacagua

SEQ ID NO: 423206 - RNA, 19 nt, Homo sapiens
acccagggcuucauaauca

SEQ ID NO: 423207 - RNA, 19 nt, Homo sapiens
gauaguggaugguauugcu

SEQ ID NO: 423208 - RNA, 19 nt, Homo sapiens
ugaccuagaugaccugucu

SEQ ID NO: 423209 - RNA, 19 nt, Homo sapiens
gcagauaccagaauguuuu

SEQ ID NO: 423210 - RNA, 19 nt, Homo sapiens
gaaggaaugcacaguacug

SEQ ID NO: 423211 - RNA, 19 nt, Homo sapiens
gcaguuggcaguagaugug

SEQ ID NO: 423212 - RNA, 19 nt, Homo sapiens
acaauuauguaugcaguug

SEQ ID NO: 423213 - RNA, 19 nt, Homo sapiens
gauaugcugguacaucuga

SEQ ID NO: 423214 - RNA, 19 nt, Homo sapiens
cagaaggaaugcacaguac

SEQ ID NO: 423215 - RNA, 19 nt, Homo sapiens
cauaaucaccuucuguuca

SEQ ID NO: 423216 - RNA, 19 nt, Homo sapiens
guacucgguuauuaaaugg

SEQ ID NO: 423217 - RNA, 19 nt, Homo sapiens
cagauuuccuuucagaaca

SEQ ID NO: 423218 - RNA, 19 nt, Homo sapiens
aaaucaauguguacaagug

SEQ ID NO: 423219 - RNA, 19 nt, Homo sapiens
gaaaucaauguguacaagu

SEQ ID NO: 423220 - RNA, 19 nt, Homo sapiens
ugaaaucaauguguacaag

SEQ ID NO: 423221 - RNA, 19 nt, Homo sapiens
uacaauacggcuaaucuuu

SEQ ID NO: 423222 - RNA, 19 nt, Homo sapiens
ggugaaacccuccgagcuu

SEQ ID NO: 423223 - RNA, 19 nt, Homo sapiens
gaaugucucacaaauaaac

SEQ ID NO: 423224 - RNA, 19 nt, Homo sapiens
gaagacguuccgcuuugaa

SEQ ID NO: 423225 - RNA, 19 nt, Homo sapiens
cagaugacaacaaagauug

SEQ ID NO: 423226 - RNA, 19 nt, Homo sapiens
ggcacaaguuuaucuucuu

SEQ ID NO: 423227 - RNA, 19 nt, Homo sapiens
caaauaaaccaagauaugc

SEQ ID NO: 423228 - RNA, 19 nt, Homo sapiens
ucaaagguucgacuaguga

SEQ ID NO: 423229 - RNA, 19 nt, Homo sapiens
caccuucuguucagcacua

SEQ ID NO: 423230 - RNA, 19 nt, Homo sapiens
ggacaugcugcuacaauac

SEQ ID NO: 423231 - RNA, 19 nt, Homo sapiens
ucucacaaauaaaccaaga

SEQ ID NO: 423232 - RNA, 19 nt, Homo sapiens
aaucagaugacaacaaaga

SEQ ID NO: 423233 - RNA, 19 nt, Homo sapiens
gcaaauuaucagaagagaa

SEQ ID NO: 423234 - RNA, 19 nt, Homo sapiens
gcacuagaugauauucuug

SEQ ID NO: 423235 - RNA, 19 nt, Homo sapiens
gcauacccagggcuucaua

SEQ ID NO: 423236 - RNA, 19 nt, Homo sapiens
gaauuauaacccagaaaca

SEQ ID NO: 423237 - RNA, 19 nt, Homo sapiens
ucagaugacaacaaagauu

SEQ ID NO: 423238 - RNA, 19 nt, Homo sapiens
cuagaugaccugucucuuc

SEQ ID NO: 423239 - RNA, 19 nt, Homo sapiens
gguggagugcccuuaauga

SEQ ID NO: 423240 - RNA, 19 nt, Homo sapiens
caagauaugcugguacauc

SEQ ID NO: 423241 - RNA, 19 nt, Homo sapiens
guacaucugagucacacaa

SEQ ID NO: 423242 - RNA, 19 nt, Homo sapiens
caucugagucacacaagaa

SEQ ID NO: 423243 - RNA, 19 nt, Homo sapiens
uggaggauuucacucuuga

SEQ ID NO: 423244 - RNA, 19 nt, Homo sapiens
guaugcaguuggcaguaga

SEQ ID NO: 423245 - RNA, 19 nt, Homo sapiens
cccagaggaagaauuauaa

SEQ ID NO: 423246 - RNA, 19 nt, Homo sapiens
ugacaacaaagauugauag

SEQ ID NO: 423247 - RNA, 19 nt, Homo sapiens
cagaguuacuggcacaagu

SEQ ID NO: 423248 - RNA, 19 nt, Homo sapiens
auucagcaccuucagcuua

SEQ ID NO: 423249 - RNA, 19 nt, Homo sapiens
uaugguugauagaguggua

SEQ ID NO: 423250 - RNA, 19 nt, Homo sapiens
gaaguuuuaugguugauag

SEQ ID NO: 423251 - RNA, 19 nt, Homo sapiens
ggccuagcccagcaaauga

SEQ ID NO: 423252 - RNA, 19 nt, Homo sapiens
uggagugcccuuaaugaaa

SEQ ID NO: 423253 - RNA, 19 nt, Homo sapiens
gagcauacccagggcuuca

SEQ ID NO: 423254 - RNA, 19 nt, Homo sapiens
guggacuuguuaccuuaaa

SEQ ID NO: 423255 - RNA, 19 nt, Homo sapiens
acaauacggcuaaucuuuc

SEQ ID NO: 423256 - RNA, 19 nt, Homo sapiens
gcagcgggauuuggugagu

SEQ ID NO: 423257 - RNA, 19 nt, Homo sapiens
guuacuggcacaaguuuau

SEQ ID NO: 423258 - RNA, 19 nt, Homo sapiens
gaguuacuggcacaaguuu

SEQ ID NO: 423259 - RNA, 19 nt, Homo sapiens
cacuauggcaugaaugaaa

SEQ ID NO: 423260 - RNA, 19 nt, Homo sapiens
cagaaacaaaucucaaagu

SEQ ID NO: 423261 - RNA, 19 nt, Homo sapiens
gcuacaauacggcuaaucu

SEQ ID NO: 423262 - RNA, 19 nt, Homo sapiens
gacaacaaagauugauaga

SEQ ID NO: 423263 - RNA, 19 nt, Homo sapiens
guggagugcccuuaaugaa

SEQ ID NO: 423264 - RNA, 19 nt, Homo sapiens
gacguuccgcuuugaaaug

SEQ ID NO: 423265 - RNA, 19 nt, Homo sapiens
augaucagccuugcaaaua

SEQ ID NO: 423266 - RNA, 19 nt, Homo sapiens
uaaccaaucagaugacaac

SEQ ID NO: 423267 - RNA, 19 nt, Homo sapiens
gugcagauaccagaauguu

SEQ ID NO: 423268 - RNA, 19 nt, Homo sapiens
cuucguacucgguuauuaa

SEQ ID NO: 423269 - RNA, 19 nt, Homo sapiens
gauguugugaaaucaaugu

SEQ ID NO: 423270 - RNA, 19 nt, Homo sapiens
uagagauacuguuguuacu

SEQ ID NO: 423271 - RNA, 19 nt, Homo sapiens
ucagcaccuucagcuuaua

SEQ ID NO: 423272 - RNA, 19 nt, Homo sapiens
ccaaucagaugacaacaaa

SEQ ID NO: 423273 - RNA, 19 nt, Homo sapiens
ccucagggauuuagagaua

SEQ ID NO: 423274 - RNA, 19 nt, Homo sapiens
gggacaugcugcuacaaua

SEQ ID NO: 423275 - RNA, 19 nt, Homo sapiens
ggauuucacucuugauaau

SEQ ID NO: 423276 - RNA, 19 nt, Homo sapiens
gaagaauuauaacccagaa

SEQ ID NO: 423277 - RNA, 19 nt, Homo sapiens
gagauacuguuguuacuuc

SEQ ID NO: 423278 - RNA, 19 nt, Homo sapiens
gaaaagcuuuggaggauuu

SEQ ID NO: 423279 - RNA, 19 nt, Homo sapiens
gcacaaguuuaucuucuuc

SEQ ID NO: 423280 - RNA, 19 nt, Homo sapiens
gaugaccugucucuucgua

SEQ ID NO: 423281 - RNA, 19 nt, Homo sapiens
gugaaacccuccgagcuua

SEQ ID NO: 423282 - RNA, 19 nt, Homo sapiens
gaucagccuugcaaauaau

SEQ ID NO: 423283 - RNA, 19 nt, Homo sapiens
agaaacaaaucucaaagug

SEQ ID NO: 423284 - RNA, 19 nt, Homo sapiens
guucagcacuagaugauau

SEQ ID NO: 423285 - RNA, 19 nt, Homo sapiens
guacagcacuggaacuucu

SEQ ID NO: 423286 - RNA, 19 nt, Homo sapiens
gaaaucaggccuugcuugu

SEQ ID NO: 423287 - RNA, 19 nt, Homo sapiens
caauacggcuaaucuuuca

SEQ ID NO: 423288 - RNA, 19 nt, Homo sapiens
ugaucagccuugcaaauaa

SEQ ID NO: 423289 - RNA, 19 nt, Homo sapiens
guugugaaaucaaugugua

SEQ ID NO: 423290 - RNA, 19 nt, Homo sapiens
gaaacaaaucucaaagugu

SEQ ID NO: 423291 - RNA, 19 nt, Homo sapiens
gaggauuucacucuugaua

SEQ ID NO: 423292 - RNA, 19 nt, Homo sapiens
cuuagaaacucugcaaauu

SEQ ID NO: 423293 - RNA, 19 nt, Homo sapiens
caaaugaucagccuugcaa

SEQ ID NO: 423294 - RNA, 19 nt, Homo sapiens
ggagugcccuuaaugaaaa

SEQ ID NO: 423295 - RNA, 19 nt, Homo sapiens
gaaacucugcaaauuauca

SEQ ID NO: 423296 - RNA, 19 nt, Homo sapiens
gcagaagccuuagaaacuc

SEQ ID NO: 423297 - RNA, 19 nt, Homo sapiens
aaucaggccuugcuuguuc

SEQ ID NO: 423298 - RNA, 19 nt, Homo sapiens
uaaagcagaagccuuagaa

SEQ ID NO: 423299 - RNA, 19 nt, Homo sapiens
cguacucgguuauuaaaug

SEQ ID NO: 423300 - RNA, 19 nt, Homo sapiens
uaaacacacuauggcauga

SEQ ID NO: 423301 - RNA, 19 nt, Homo sapiens
agacccagaggaagaauua

SEQ ID NO: 423302 - RNA, 19 nt, Homo sapiens
ggauuuagagauacuguug

SEQ ID NO: 423303 - RNA, 19 nt, Homo sapiens
ccuccgagcuuagcaaaga

SEQ ID NO: 423304 - RNA, 19 nt, Homo sapiens
ccagaaggaaugcacagua

SEQ ID NO: 423305 - RNA, 19 nt, Homo sapiens
acccagggcuucauaauca

SEQ ID NO: 423306 - RNA, 19 nt, Homo sapiens
gauaguggaugguauugcu

SEQ ID NO: 423307 - RNA, 19 nt, Homo sapiens
ugaccuagaugaccugucu

SEQ ID NO: 423308 - RNA, 19 nt, Homo sapiens
gaaggaaugcacaguacug

SEQ ID NO: 423309 - RNA, 19 nt, Homo sapiens
gauaugcugguacaucuga

SEQ ID NO: 423310 - RNA, 19 nt, Homo sapiens
cagaaggaaugcacaguac

SEQ ID NO: 423311 - RNA, 19 nt, Homo sapiens
cauaaucaccuucuguuca

SEQ ID NO: 423312 - RNA, 19 nt, Homo sapiens
guacucgguuauuaaaugg

SEQ ID NO: 423313 - RNA, 19 nt, Homo sapiens
cagauuuccuuucagaaca

SEQ ID NO: 423314 - RNA, 19 nt, Homo sapiens
aaaucaauguguacaagug

SEQ ID NO: 423315 - RNA, 19 nt, Homo sapiens
gaaaucaauguguacaagu

SEQ ID NO: 423316 - RNA, 19 nt, Homo sapiens
ugaaaucaauguguacaag

SEQ ID NO: 423317 - RNA, 19 nt, Homo sapiens
uacaauacggcuaaucuuu

SEQ ID NO: 423318 - RNA, 19 nt, Homo sapiens
ggugaaacccuccgagcuu

SEQ ID NO: 423319 - RNA, 19 nt, Homo sapiens
gaaugucucacaaauaaac

SEQ ID NO: 423320 - RNA, 19 nt, Homo sapiens
gaagacguuccgcuuugaa

SEQ ID NO: 423321 - RNA, 19 nt, Homo sapiens
cagaugacaacaaagauug

SEQ ID NO: 423322 - RNA, 19 nt, Homo sapiens
ggcacaaguuuaucuucuu

SEQ ID NO: 423323 - RNA, 19 nt, Homo sapiens
caaauaaaccaagauaugc

SEQ ID NO: 423324 - RNA, 19 nt, Homo sapiens
ucaaagguucgacuaguga

SEQ ID NO: 423325 - RNA, 19 nt, Homo sapiens
caccuucuguucagcacua

SEQ ID NO: 423326 - RNA, 19 nt, Homo sapiens
ggacaugcugcuacaauac

SEQ ID NO: 423327 - RNA, 19 nt, Homo sapiens
aaucagaugacaacaaaga

SEQ ID NO: 423328 - RNA, 19 nt, Homo sapiens
gcaaauuaucagaagagaa

SEQ ID NO: 423329 - RNA, 19 nt, Homo sapiens
ucucacaaauaaaccaaga

SEQ ID NO: 423330 - RNA, 19 nt, Homo sapiens
gcacuagaugauauucuug

SEQ ID NO: 423331 - RNA, 19 nt, Homo sapiens
gcauacccagggcuucaua

SEQ ID NO: 423332 - RNA, 19 nt, Homo sapiens
gaauuauaacccagaaaca

SEQ ID NO: 423333 - RNA, 19 nt, Homo sapiens
ucagaugacaacaaagauu

SEQ ID NO: 423334 - RNA, 19 nt, Homo sapiens
cuagaugaccugucucuuc

SEQ ID NO: 423335 - RNA, 19 nt, Homo sapiens
caagauaugcugguacauc

SEQ ID NO: 423336 - RNA, 19 nt, Homo sapiens
gguggagugcccuuaauga

SEQ ID NO: 423337 - RNA, 19 nt, Homo sapiens
caucugagucacacaagaa

SEQ ID NO: 423338 - RNA, 19 nt, Homo sapiens
guacaucugagucacacaa

SEQ ID NO: 423339 - RNA, 19 nt, Homo sapiens
uggaggauuucacucuuga

SEQ ID NO: 423340 - RNA, 19 nt, Homo sapiens
cccagaggaagaauuauaa

SEQ ID NO: 423341 - RNA, 19 nt, Homo sapiens
ugacaacaaagauugauag

SEQ ID NO: 423342 - RNA, 19 nt, Homo sapiens
cagaguuacuggcacaagu

SEQ ID NO: 423343 - RNA, 19 nt, Homo sapiens
ggccuagcccagcaaauga

SEQ ID NO: 423344 - RNA, 19 nt, Homo sapiens
uggagugcccuuaaugaaa

SEQ ID NO: 423345 - RNA, 19 nt, Homo sapiens
gagcauacccagggcuuca

SEQ ID NO: 423346 - RNA, 19 nt, Homo sapiens
guggacuuguuaccuuaaa

SEQ ID NO: 423347 - RNA, 19 nt, Homo sapiens
acaauacggcuaaucuuuc

SEQ ID NO: 423348 - RNA, 19 nt, Homo sapiens
gcagcgggauuuggugagu

SEQ ID NO: 423349 - RNA, 19 nt, Homo sapiens
guuacuggcacaaguuuau

SEQ ID NO: 423350 - RNA, 19 nt, Homo sapiens
gaguuacuggcacaaguuu

SEQ ID NO: 423351 - RNA, 19 nt, Homo sapiens
cagaaacaaaucucaaagu

SEQ ID NO: 423352 - RNA, 19 nt, Homo sapiens
gcuacaauacggcuaaucu

SEQ ID NO: 423353 - RNA, 19 nt, Homo sapiens
gacaacaaagauugauaga

SEQ ID NO: 423354 - RNA, 19 nt, Homo sapiens
guggagugcccuuaaugaa

SEQ ID NO: 423355 - RNA, 19 nt, Homo sapiens
gacguuccgcuuugaaaug

SEQ ID NO: 423356 - RNA, 19 nt, Homo sapiens
augaucagccuugcaaaua

SEQ ID NO: 423357 - RNA, 19 nt, Homo sapiens
uaaccaaucagaugacaac

SEQ ID NO: 423358 - RNA, 19 nt, Homo sapiens
cuucguacucgguuauuaa

SEQ ID NO: 423359 - RNA, 19 nt, Homo sapiens
gauguugugaaaucaaugu

SEQ ID NO: 423360 - RNA, 19 nt, Homo sapiens
uagagauacuguuguuacu

SEQ ID NO: 423361 - RNA, 19 nt, Homo sapiens
aacacacuauggcaugaaa

SEQ ID NO: 423362 - RNA, 19 nt, Homo sapiens
acccagaggaagaauuaua

SEQ ID NO: 423363 - RNA, 19 nt, Homo sapiens
guuguuacuucugcauguu

SEQ ID NO: 423364 - RNA, 19 nt, Homo sapiens
uggcaacauuguacaaguc

SEQ ID NO: 423365 - RNA, 19 nt, Homo sapiens
aaagguucgacuagugaua

SEQ ID NO: 423366 - RNA, 19 nt, Homo sapiens
cagaagccuuagaaacucu

SEQ ID NO: 423367 - RNA, 19 nt, Homo sapiens
uuccagauuuccuuucaga

SEQ ID NO: 423368 - RNA, 19 nt, Homo sapiens
uggcacaaguuuaucuucu

SEQ ID NO: 423369 - RNA, 19 nt, Homo sapiens
gcugcuacaauacggcuaa

SEQ ID NO: 423370 - RNA, 19 nt, Homo sapiens
cucaaagguucgacuagug

SEQ ID NO: 423371 - RNA, 19 nt, Homo sapiens
acaauuaugaacaccgaaa

SEQ ID NO: 423372 - RNA, 19 nt, Homo sapiens
gcaaacggcuuaugggaua

SEQ ID NO: 423373 - RNA, 19 nt, Homo sapiens
ggaaauaccuggagucaca

SEQ ID NO: 423374 - RNA, 19 nt, Homo sapiens
gcacaaaggucugcugauu

SEQ ID NO: 423375 - RNA, 19 nt, Homo sapiens
gcaagacccauaaccauua

SEQ ID NO: 423376 - RNA, 19 nt, Homo sapiens
acaguaaucugcaucauaa

SEQ ID NO: 423377 - RNA, 19 nt, Homo sapiens
gcaacuagauaucaugaug

SEQ ID NO: 423378 - RNA, 19 nt, Homo sapiens
caucaguacuucauucuuu

SEQ ID NO: 423379 - RNA, 19 nt, Homo sapiens
ggauguaucucacaaguag

SEQ ID NO: 423380 - RNA, 19 nt, Homo sapiens
uauagugucugucuucuuu

SEQ ID NO: 423381 - RNA, 19 nt, Homo sapiens
caaguaggaucaagaacaa

SEQ ID NO: 423382 - RNA, 19 nt, Homo sapiens
gaaggugacuggucugagu

SEQ ID NO: 423383 - RNA, 19 nt, Homo sapiens
cagcuuaagucauggaauu

SEQ ID NO: 423384 - RNA, 19 nt, Homo sapiens
ccaccaaucuacuuuguug

SEQ ID NO: 423385 - RNA, 19 nt, Homo sapiens
gugcaaaccuguucaucuu

SEQ ID NO: 423386 - RNA, 19 nt, Homo sapiens
cuacuacccuuucugcuuu

SEQ ID NO: 423387 - RNA, 19 nt, Homo sapiens
cagcaucucugucuaguuc

SEQ ID NO: 423388 - RNA, 19 nt, Homo sapiens
ccaguuaucuugacgaauc

SEQ ID NO: 423389 - RNA, 19 nt, Homo sapiens
gagcugugguguacauuga

SEQ ID NO: 423390 - RNA, 19 nt, Homo sapiens
ggaaucauauagugucugu

SEQ ID NO: 423391 - RNA, 19 nt, Homo sapiens
guauuuggcugaggaguuu

SEQ ID NO: 423392 - RNA, 19 nt, Homo sapiens
acaaaggucugcugauuuc

SEQ ID NO: 423393 - RNA, 19 nt, Homo sapiens
ugaaagacugguugaaaua

SEQ ID NO: 423394 - RNA, 19 nt, Homo sapiens
caacaugggaggauuagaa

SEQ ID NO: 423395 - RNA, 19 nt, Homo sapiens
gaacaggaaaugggaauga

SEQ ID NO: 423396 - RNA, 19 nt, Homo sapiens
ucaaggcaaucucaaagaa

SEQ ID NO: 423397 - RNA, 19 nt, Homo sapiens
ugauggaggugaaauuuau

SEQ ID NO: 423398 - RNA, 19 nt, Homo sapiens
gaacaagcccaacaguaau

SEQ ID NO: 423399 - RNA, 19 nt, Homo sapiens
agaacaagcccaacaguaa

SEQ ID NO: 423400 - RNA, 19 nt, Homo sapiens
ggaagaagaaauuaucuca

SEQ ID NO: 423401 - RNA, 19 nt, Homo sapiens
aaugggcacugauuugaua

SEQ ID NO: 423402 - RNA, 19 nt, Homo sapiens
gaaaugggaaugagagcaa

SEQ ID NO: 423403 - RNA, 19 nt, Homo sapiens
gaaguucuacaaaggauug

SEQ ID NO: 423404 - RNA, 19 nt, Homo sapiens
caaagaugcaaacggcuua

SEQ ID NO: 423405 - RNA, 19 nt, Homo sapiens
gaggauguaucucacaagu

SEQ ID NO: 423406 - RNA, 19 nt, Homo sapiens
uccaugaacuucuauguau

SEQ ID NO: 423407 - RNA, 19 nt, Homo sapiens
gguguagcgugcaucagua

SEQ ID NO: 423408 - RNA, 19 nt, Homo sapiens
gcuauggcuuuaccuauuc

SEQ ID NO: 423409 - RNA, 19 nt, Homo sapiens
ccagcauucuuaucuacua

SEQ ID NO: 423410 - RNA, 19 nt, Homo sapiens
cauccuccuugaaguauuu

SEQ ID NO: 423411 - RNA, 19 nt, Homo sapiens
caaccagcaucucugucua

SEQ ID NO: 423412 - RNA, 19 nt, Homo sapiens
gagcaaggguuggguugug

SEQ ID NO: 423413 - RNA, 19 nt, Homo sapiens
guaccuugauucagagaga

SEQ ID NO: 423414 - RNA, 19 nt, Homo sapiens
cggcauggguagcaagaaa

SEQ ID NO: 423415 - RNA, 19 nt, Homo sapiens
gcacacagggaacaggaaa

SEQ ID NO: 423416 - RNA, 19 nt, Homo sapiens
gcugaaagacugguugaaa

SEQ ID NO: 423417 - RNA, 19 nt, Homo sapiens
gugaugaaguucuacaaag

SEQ ID NO: 423418 - RNA, 19 nt, Homo sapiens
cugaaagacugguugaaau

SEQ ID NO: 423419 - RNA, 19 nt, Homo sapiens
ucaccagcauucuuaucua

SEQ ID NO: 423420 - RNA, 19 nt, Homo sapiens
gaaagacugguugaaauag

SEQ ID NO: 423421 - RNA, 19 nt, Homo sapiens
uccaguaccuugauucaga

SEQ ID NO: 423422 - RNA, 19 nt, Homo sapiens
agaaggagcugugguguac

SEQ ID NO: 423423 - RNA, 19 nt, Homo sapiens
gacaaugggcacugauuug

SEQ ID NO: 423424 - RNA, 19 nt, Homo sapiens
caaagaaagaaacaaguuc

SEQ ID NO: 423425 - RNA, 19 nt, Homo sapiens
ccagauauuuuaacacuga

SEQ ID NO: 423426 - RNA, 19 nt, Homo sapiens
aauauugcauugucaggaa

SEQ ID NO: 423427 - RNA, 19 nt, Homo sapiens
gugcaucaguacuucauuc

SEQ ID NO: 423428 - RNA, 19 nt, Homo sapiens
caaucuacuuuguugcuau

SEQ ID NO: 423429 - RNA, 19 nt, Homo sapiens
gaaacccaccaaucuacuu

SEQ ID NO: 423430 - RNA, 19 nt, Homo sapiens
ugacaaugggcacugauuu

SEQ ID NO: 423431 - RNA, 19 nt, Homo sapiens
ucacaaguaggaucaagaa

SEQ ID NO: 423432 - RNA, 19 nt, Homo sapiens
gaguagacaucagauccuu

SEQ ID NO: 423433 - RNA, 19 nt, Homo sapiens
ucagagagaagacagauuc

SEQ ID NO: 423434 - RNA, 19 nt, Homo sapiens
ggauccagcugugugauag

SEQ ID NO: 423435 - RNA, 19 nt, Homo sapiens
ggacgaagcccugcauggu

SEQ ID NO: 423436 - RNA, 19 nt, Homo sapiens
ccaaucuacuuuguugcua

SEQ ID NO: 423437 - RNA, 19 nt, Homo sapiens
gauggaggugaaauuuaua

SEQ ID NO: 423438 - RNA, 19 nt, Homo sapiens
caaggcaaucucaaagaaa

SEQ ID NO: 423439 - RNA, 19 nt, Homo sapiens
cacaaaggucugcugauuu

SEQ ID NO: 423440 - RNA, 19 nt, Homo sapiens
acaauuccguggcaacuag

SEQ ID NO: 423441 - RNA, 19 nt, Homo sapiens
cuucaagccuauggaaauu

SEQ ID NO: 423442 - RNA, 19 nt, Homo sapiens
ugugauagccgcacuagga

SEQ ID NO: 423443 - RNA, 19 nt, Homo sapiens
gaugaaguucuacaaagga

SEQ ID NO: 423444 - RNA, 19 nt, Homo sapiens
guggaucccucacagagau

SEQ ID NO: 423445 - RNA, 19 nt, Homo sapiens
uagaggauguaucucacaa

SEQ ID NO: 423446 - RNA, 19 nt, Homo sapiens
gauagccgcacuaggaaau

SEQ ID NO: 423447 - RNA, 19 nt, Homo sapiens
caacuucaaggcaaucuca

SEQ ID NO: 423448 - RNA, 19 nt, Homo sapiens
caccugugaugaaguucua

SEQ ID NO: 423449 - RNA, 19 nt, Homo sapiens
ccaccaacaugggaggauu

SEQ ID NO: 423450 - RNA, 19 nt, Homo sapiens
gcaaccagcaucucugucu

SEQ ID NO: 423451 - RNA, 19 nt, Homo sapiens
ccaugaacuucuauguaug

SEQ ID NO: 423452 - RNA, 19 nt, Homo sapiens
cgaguggguuuaucacaag

SEQ ID NO: 423453 - RNA, 19 nt, Homo sapiens
cacuggagcuuaugaaggu

SEQ ID NO: 423454 - RNA, 19 nt, Homo sapiens
uaaccauuaugcaaguguu

SEQ ID NO: 423455 - RNA, 19 nt, Homo sapiens
guccaugaacuucuaugua

SEQ ID NO: 423456 - RNA, 19 nt, Homo sapiens
ccacagaaacaaaauauug

SEQ ID NO: 423457 - RNA, 19 nt, Homo sapiens
ucauuugucuacaccauca

SEQ ID NO: 423458 - RNA, 19 nt, Homo sapiens
ugaugaaguucuacaaagg

SEQ ID NO: 423459 - RNA, 19 nt, Homo sapiens
uaccuauucuggauauuuc

SEQ ID NO: 423460 - RNA, 19 nt, Homo sapiens
ugcuauggcuuuaccuauu

SEQ ID NO: 423461 - RNA, 19 nt, Homo sapiens
aagaacaagcccaacagua

SEQ ID NO: 423462 - RNA, 19 nt, Homo sapiens
gauuacaacccaucugagu

SEQ ID NO: 423463 - RNA, 19 nt, Homo sapiens
cuuaagucauggaauucua

SEQ ID NO: 423464 - RNA, 19 nt, Homo sapiens
ggaggaaggccugguucuu

SEQ ID NO: 423465 - RNA, 19 nt, Homo sapiens
ugacuggucugaguuaucg

SEQ ID NO: 423466 - RNA, 19 nt, Homo sapiens
ugucuucuuucacuaguau

SEQ ID NO: 423467 - RNA, 19 nt, Homo sapiens
caacaguaaucugcaucau

SEQ ID NO: 423468 - RNA, 19 nt, Homo sapiens
gcauccuccuugaaguauu

SEQ ID NO: 423469 - RNA, 19 nt, Homo sapiens
aaaggaguuugaugcacaa

SEQ ID NO: 423470 - RNA, 19 nt, Homo sapiens
aaacccaccaaucuacuuu

SEQ ID NO: 423471 - RNA, 19 nt, Homo sapiens
uuucucaccagcauucuua

SEQ ID NO: 423472 - RNA, 19 nt, Homo sapiens
gcaaacggcuuaugggaua

SEQ ID NO: 423473 - RNA, 19 nt, Homo sapiens
ggaaauaccuggagucaca

SEQ ID NO: 423474 - RNA, 19 nt, Homo sapiens
gcacaaaggucugcugauu

SEQ ID NO: 423475 - RNA, 19 nt, Homo sapiens
gcaagacccauaaccauua

SEQ ID NO: 423476 - RNA, 19 nt, Homo sapiens
acaguaaucugcaucauaa

SEQ ID NO: 423477 - RNA, 19 nt, Homo sapiens
gcaacuagauaucaugaug

SEQ ID NO: 423478 - RNA, 19 nt, Homo sapiens
caucaguacuucauucuuu

SEQ ID NO: 423479 - RNA, 19 nt, Homo sapiens
ggauguaucucacaaguag

SEQ ID NO: 423480 - RNA, 19 nt, Homo sapiens
uauagugucugucuucuuu

SEQ ID NO: 423481 - RNA, 19 nt, Homo sapiens
caaguaggaucaagaacaa

SEQ ID NO: 423482 - RNA, 19 nt, Homo sapiens
gaaggugacuggucugagu

SEQ ID NO: 423483 - RNA, 19 nt, Homo sapiens
cagcuuaagucauggaauu

SEQ ID NO: 423484 - RNA, 19 nt, Homo sapiens
ccaccaaucuacuuuguug

SEQ ID NO: 423485 - RNA, 19 nt, Homo sapiens
gugcaaaccuguucaucuu

SEQ ID NO: 423486 - RNA, 19 nt, Homo sapiens
cuacuacccuuucugcuuu

SEQ ID NO: 423487 - RNA, 19 nt, Homo sapiens
cagcaucucugucuaguuc

SEQ ID NO: 423488 - RNA, 19 nt, Homo sapiens
ccaguuaucuugacgaauc

SEQ ID NO: 423489 - RNA, 19 nt, Homo sapiens
gagcugugguguacauuga

SEQ ID NO: 423490 - RNA, 19 nt, Homo sapiens
ggaaucauauagugucugu

SEQ ID NO: 423491 - RNA, 19 nt, Homo sapiens
guauuuggcugaggaguuu

SEQ ID NO: 423492 - RNA, 19 nt, Homo sapiens
acaaaggucugcugauuuc

SEQ ID NO: 423493 - RNA, 19 nt, Homo sapiens
ugaaagacugguugaaaua

SEQ ID NO: 423494 - RNA, 19 nt, Homo sapiens
caacaugggaggauuagaa

SEQ ID NO: 423495 - RNA, 19 nt, Homo sapiens
gaacaggaaaugggaauga

SEQ ID NO: 423496 - RNA, 19 nt, Homo sapiens
ucaaggcaaucucaaagaa

SEQ ID NO: 423497 - RNA, 19 nt, Homo sapiens
ugauggaggugaaauuuau

SEQ ID NO: 423498 - RNA, 19 nt, Homo sapiens
gaacaagcccaacaguaau

SEQ ID NO: 423499 - RNA, 19 nt, Homo sapiens
agaacaagcccaacaguaa

SEQ ID NO: 423500 - RNA, 19 nt, Homo sapiens
ggaagaagaaauuaucuca

SEQ ID NO: 423501 - RNA, 19 nt, Homo sapiens
aaugggcacugauuugaua

SEQ ID NO: 423502 - RNA, 19 nt, Homo sapiens
gaaaugggaaugagagcaa

SEQ ID NO: 423503 - RNA, 19 nt, Homo sapiens
gaaguucuacaaaggauug

SEQ ID NO: 423504 - RNA, 19 nt, Homo sapiens
caaagaugcaaacggcuua

SEQ ID NO: 423505 - RNA, 19 nt, Homo sapiens
gaggauguaucucacaagu

SEQ ID NO: 423506 - RNA, 19 nt, Homo sapiens
uccaugaacuucuauguau

SEQ ID NO: 423507 - RNA, 19 nt, Homo sapiens
gguguagcgugcaucagua

SEQ ID NO: 423508 - RNA, 19 nt, Homo sapiens
gcuauggcuuuaccuauuc

SEQ ID NO: 423509 - RNA, 19 nt, Homo sapiens
ccagcauucuuaucuacua

SEQ ID NO: 423510 - RNA, 19 nt, Homo sapiens
cauccuccuugaaguauuu

SEQ ID NO: 423511 - RNA, 19 nt, Homo sapiens
caaccagcaucucugucua

SEQ ID NO: 423512 - RNA, 19 nt, Homo sapiens
gagcaaggguuggguugug

SEQ ID NO: 423513 - RNA, 19 nt, Homo sapiens
guaccuugauucagagaga

SEQ ID NO: 423514 - RNA, 19 nt, Homo sapiens
gcacacagggaacaggaaa

SEQ ID NO: 423515 - RNA, 19 nt, Homo sapiens
gcugaaagacugguugaaa

SEQ ID NO: 423516 - RNA, 19 nt, Homo sapiens
cggcauggguagcaagaaa

SEQ ID NO: 423517 - RNA, 19 nt, Homo sapiens
gugaugaaguucuacaaag

SEQ ID NO: 423518 - RNA, 19 nt, Homo sapiens
cugaaagacugguugaaau

SEQ ID NO: 423519 - RNA, 19 nt, Homo sapiens
ucaccagcauucuuaucua

SEQ ID NO: 423520 - RNA, 19 nt, Homo sapiens
gaaagacugguugaaauag

SEQ ID NO: 423521 - RNA, 19 nt, Homo sapiens
uccaguaccuugauucaga

SEQ ID NO: 423522 - RNA, 19 nt, Homo sapiens
agaaggagcugugguguac

SEQ ID NO: 423523 - RNA, 19 nt, Homo sapiens
gacaaugggcacugauuug

SEQ ID NO: 423524 - RNA, 19 nt, Homo sapiens
caaagaaagaaacaaguuc

SEQ ID NO: 423525 - RNA, 19 nt, Homo sapiens
ccagauauuuuaacacuga

SEQ ID NO: 423526 - RNA, 19 nt, Homo sapiens
aauauugcauugucaggaa

SEQ ID NO: 423527 - RNA, 19 nt, Homo sapiens
gugcaucaguacuucauuc

SEQ ID NO: 423528 - RNA, 19 nt, Homo sapiens
caaucuacuuuguugcuau

SEQ ID NO: 423529 - RNA, 19 nt, Homo sapiens
gaaacccaccaaucuacuu

SEQ ID NO: 423530 - RNA, 19 nt, Homo sapiens
ugacaaugggcacugauuu

SEQ ID NO: 423531 - RNA, 19 nt, Homo sapiens
ucacaaguaggaucaagaa

SEQ ID NO: 423532 - RNA, 19 nt, Homo sapiens
ucagagagaagacagauuc

SEQ ID NO: 423533 - RNA, 19 nt, Homo sapiens
ggauccagcugugugauag

SEQ ID NO: 423534 - RNA, 19 nt, Homo sapiens
gaguagacaucagauccuu

SEQ ID NO: 423535 - RNA, 19 nt, Homo sapiens
ggacgaagcccugcauggu

SEQ ID NO: 423536 - RNA, 19 nt, Homo sapiens
ccaaucuacuuuguugcua

SEQ ID NO: 423537 - RNA, 19 nt, Homo sapiens
gauggaggugaaauuuaua

SEQ ID NO: 423538 - RNA, 19 nt, Homo sapiens
caaggcaaucucaaagaaa

SEQ ID NO: 423539 - RNA, 19 nt, Homo sapiens
cacaaaggucugcugauuu

SEQ ID NO: 423540 - RNA, 19 nt, Homo sapiens
acaauuccguggcaacuag

SEQ ID NO: 423541 - RNA, 19 nt, Homo sapiens
cuucaagccuauggaaauu

SEQ ID NO: 423542 - RNA, 19 nt, Homo sapiens
ugugauagccgcacuagga

SEQ ID NO: 423543 - RNA, 19 nt, Homo sapiens
gaugaaguucuacaaagga

SEQ ID NO: 423544 - RNA, 19 nt, Homo sapiens
guggaucccucacagagau

SEQ ID NO: 423545 - RNA, 19 nt, Homo sapiens
uagaggauguaucucacaa

SEQ ID NO: 423546 - RNA, 19 nt, Homo sapiens
gauagccgcacuaggaaau

SEQ ID NO: 423547 - RNA, 19 nt, Homo sapiens
caacuucaaggcaaucuca

SEQ ID NO: 423548 - RNA, 19 nt, Homo sapiens
caccugugaugaaguucua

SEQ ID NO: 423549 - RNA, 19 nt, Homo sapiens
ccaccaacaugggaggauu

SEQ ID NO: 423550 - RNA, 19 nt, Homo sapiens
cacuggagcuuaugaaggu

SEQ ID NO: 423551 - RNA, 19 nt, Homo sapiens
gcaaccagcaucucugucu

SEQ ID NO: 423552 - RNA, 19 nt, Homo sapiens
cgaguggguuuaucacaag

SEQ ID NO: 423553 - RNA, 19 nt, Homo sapiens
ccaugaacuucuauguaug

SEQ ID NO: 423554 - RNA, 19 nt, Homo sapiens
guccaugaacuucuaugua

SEQ ID NO: 423555 - RNA, 19 nt, Homo sapiens
uaaccauuaugcaaguguu

SEQ ID NO: 423556 - RNA, 19 nt, Homo sapiens
ccacagaaacaaaauauug

SEQ ID NO: 423557 - RNA, 19 nt, Homo sapiens
ucauuugucuacaccauca

SEQ ID NO: 423558 - RNA, 19 nt, Homo sapiens
ugaugaaguucuacaaagg

SEQ ID NO: 423559 - RNA, 19 nt, Homo sapiens
uaccuauucuggauauuuc

SEQ ID NO: 423560 - RNA, 19 nt, Homo sapiens
ugcuauggcuuuaccuauu

SEQ ID NO: 423561 - RNA, 19 nt, Homo sapiens
aagaacaagcccaacagua

SEQ ID NO: 423562 - RNA, 19 nt, Homo sapiens
gauuacaacccaucugagu

SEQ ID NO: 423563 - RNA, 19 nt, Homo sapiens
ucgagaccauccuggcuaa

SEQ ID NO: 423564 - RNA, 19 nt, Homo sapiens
cuuaagucauggaauucua

SEQ ID NO: 423565 - RNA, 19 nt, Homo sapiens
ggaggaaggccugguucuu

SEQ ID NO: 423566 - RNA, 19 nt, Homo sapiens
ugucuucuuucacuaguau

SEQ ID NO: 423567 - RNA, 19 nt, Homo sapiens
ugacuggucugaguuaucg

SEQ ID NO: 423568 - RNA, 19 nt, Homo sapiens
caacaguaaucugcaucau

SEQ ID NO: 423569 - RNA, 19 nt, Homo sapiens
gcauccuccuugaaguauu

SEQ ID NO: 423570 - RNA, 19 nt, Homo sapiens
aaaggaguuugaugcacaa

SEQ ID NO: 423571 - RNA, 19 nt, Homo sapiens
aaacccaccaaucuacuuu

SEQ ID NO: 423572 - RNA, 19 nt, Homo sapiens
gcaaacggcuuaugggaua

SEQ ID NO: 423573 - RNA, 19 nt, Homo sapiens
ggaaauaccuggagucaca

SEQ ID NO: 423574 - RNA, 19 nt, Homo sapiens
gcacaaaggucugcugauu

SEQ ID NO: 423575 - RNA, 19 nt, Homo sapiens
gcacuuauauagcaccuuu

SEQ ID NO: 423576 - RNA, 19 nt, Homo sapiens
uaacagauuugcuccuaaa

SEQ ID NO: 423577 - RNA, 19 nt, Homo sapiens
gaggaugacuaacaagauu

SEQ ID NO: 423578 - RNA, 19 nt, Homo sapiens
gaacauuuccgaauaaagu

SEQ ID NO: 423579 - RNA, 19 nt, Homo sapiens
ggaggaggaugacuaacaa

SEQ ID NO: 423580 - RNA, 19 nt, Homo sapiens
gaaggugacuggucugagu

SEQ ID NO: 423581 - RNA, 19 nt, Homo sapiens
ggaaacggaagcugacaua

SEQ ID NO: 423582 - RNA, 19 nt, Homo sapiens
cuacuacccuuucugcuuu

SEQ ID NO: 423583 - RNA, 19 nt, Homo sapiens
gaugucaacagccauaaua

SEQ ID NO: 423584 - RNA, 19 nt, Homo sapiens
ccaguuaucuugacgaauc

SEQ ID NO: 423585 - RNA, 19 nt, Homo sapiens
gagcugugguguacauuga

SEQ ID NO: 423586 - RNA, 19 nt, Homo sapiens
guauuuggcugaggaguuu

SEQ ID NO: 423587 - RNA, 19 nt, Homo sapiens
acaaaggucugcugauuuc

SEQ ID NO: 423588 - RNA, 19 nt, Homo sapiens
gucaacagccauaauaaua

SEQ ID NO: 423589 - RNA, 19 nt, Homo sapiens
gguaacagauuugcuccua

SEQ ID NO: 423590 - RNA, 19 nt, Homo sapiens
ugaaagacugguugaaaua

SEQ ID NO: 423591 - RNA, 19 nt, Homo sapiens
caacaugggaggauuagaa

SEQ ID NO: 423592 - RNA, 19 nt, Homo sapiens
ucaaggcaaucucaaagaa

SEQ ID NO: 423593 - RNA, 19 nt, Homo sapiens
gggauuaauuaguugauug

SEQ ID NO: 423594 - RNA, 19 nt, Homo sapiens
ggaagaagaaauuaucuca

SEQ ID NO: 423595 - RNA, 19 nt, Homo sapiens
cagggaaggugaagaugaa

SEQ ID NO: 423596 - RNA, 19 nt, Homo sapiens
ccauugagcuagcgauuuc

SEQ ID NO: 423597 - RNA, 19 nt, Homo sapiens
guaacagauuugcuccuaa

SEQ ID NO: 423598 - RNA, 19 nt, Homo sapiens
gaaguucuacaaaggauug

SEQ ID NO: 423599 - RNA, 19 nt, Homo sapiens
caaagaugcaaacggcuua

SEQ ID NO: 423600 - RNA, 19 nt, Homo sapiens
aacggaagcugacauaaug

SEQ ID NO: 423601 - RNA, 19 nt, Homo sapiens
uccaugaacuucuauguau

SEQ ID NO: 423602 - RNA, 19 nt, Homo sapiens
gagaggaggaggaugacua

SEQ ID NO: 423603 - RNA, 19 nt, Homo sapiens
guugauugcuguugagaug

SEQ ID NO: 423604 - RNA, 19 nt, Homo sapiens
ccagcauucuuaucuacua

SEQ ID NO: 423605 - RNA, 19 nt, Homo sapiens
cauccuccuugaaguauuu

SEQ ID NO: 423606 - RNA, 19 nt, Homo sapiens
gcagggaaggugaagauga

SEQ ID NO: 423607 - RNA, 19 nt, Homo sapiens
guaccuugauucagagaga

SEQ ID NO: 423608 - RNA, 19 nt, Homo sapiens
ggaaggugaagaugaagaa

SEQ ID NO: 423609 - RNA, 19 nt, Homo sapiens
gggauacugugaccuuugu

SEQ ID NO: 423610 - RNA, 19 nt, Homo sapiens
cggcauggguagcaagaaa

SEQ ID NO: 423611 - RNA, 19 nt, Homo sapiens
gcugaaagacugguugaaa

SEQ ID NO: 423612 - RNA, 19 nt, Homo sapiens
aagagaagccauagggaua

SEQ ID NO: 423613 - RNA, 19 nt, Homo sapiens
gugaugaaguucuacaaag

SEQ ID NO: 423614 - RNA, 19 nt, Homo sapiens
cugaaagacugguugaaau

SEQ ID NO: 423615 - RNA, 19 nt, Homo sapiens
ucaccagcauucuuaucua

SEQ ID NO: 423616 - RNA, 19 nt, Homo sapiens
guucaggucucuagauguc

SEQ ID NO: 423617 - RNA, 19 nt, Homo sapiens
gaaagacugguugaaauag

SEQ ID NO: 423618 - RNA, 19 nt, Homo sapiens
uccaguaccuugauucaga

SEQ ID NO: 423619 - RNA, 19 nt, Homo sapiens
agaaggagcugugguguac

SEQ ID NO: 423620 - RNA, 19 nt, Homo sapiens
gaaacggaagcugacauaa

SEQ ID NO: 423621 - RNA, 19 nt, Homo sapiens
caaagaaagaaacaaguuc

SEQ ID NO: 423622 - RNA, 19 nt, Homo sapiens
aaacaggaccguacugcuu

SEQ ID NO: 423623 - RNA, 19 nt, Homo sapiens
ccagauauuuuaacacuga

SEQ ID NO: 423624 - RNA, 19 nt, Homo sapiens
aaacggaagcugacauaau

SEQ ID NO: 423625 - RNA, 19 nt, Homo sapiens
ucagagagaagacagauuc

SEQ ID NO: 423626 - RNA, 19 nt, Homo sapiens
ggauccagcugugugauag

SEQ ID NO: 423627 - RNA, 19 nt, Homo sapiens
gaguagacaucagauccuu

SEQ ID NO: 423628 - RNA, 19 nt, Homo sapiens
cagauuugcuccuaaacca

SEQ ID NO: 423629 - RNA, 19 nt, Homo sapiens
ggacgaagcccugcauggu

SEQ ID NO: 423630 - RNA, 19 nt, Homo sapiens
aaaguauugucuaccagaa

SEQ ID NO: 423631 - RNA, 19 nt, Homo sapiens
gauuugcuccuaaaccauu

SEQ ID NO: 423632 - RNA, 19 nt, Homo sapiens
caaggcaaucucaaagaaa

SEQ ID NO: 423633 - RNA, 19 nt, Homo sapiens
cacaaaggucugcugauuu

SEQ ID NO: 423634 - RNA, 19 nt, Homo sapiens
ggaggaugacuaacaagau

SEQ ID NO: 423635 - RNA, 19 nt, Homo sapiens
ugugauagccgcacuagga

SEQ ID NO: 423636 - RNA, 19 nt, Homo sapiens
gaugaaguucuacaaagga

SEQ ID NO: 423637 - RNA, 19 nt, Homo sapiens
guggaucccucacagagau

SEQ ID NO: 423638 - RNA, 19 nt, Homo sapiens
gauagccgcacuaggaaau

SEQ ID NO: 423639 - RNA, 19 nt, Homo sapiens
caacuucaaggcaaucuca

SEQ ID NO: 423640 - RNA, 19 nt, Homo sapiens
caccugugaugaaguucua

SEQ ID NO: 423641 - RNA, 19 nt, Homo sapiens
ccaccaacaugggaggauu

SEQ ID NO: 423642 - RNA, 19 nt, Homo sapiens
gcuagcgauuucagaccua

SEQ ID NO: 423643 - RNA, 19 nt, Homo sapiens
ccaugaacuucuauguaug

SEQ ID NO: 423644 - RNA, 19 nt, Homo sapiens
cgaguggguuuaucacaag

SEQ ID NO: 423645 - RNA, 19 nt, Homo sapiens
cacuggagcuuaugaaggu

SEQ ID NO: 423646 - RNA, 19 nt, Homo sapiens
ggaugacuaacaagauuug

SEQ ID NO: 423647 - RNA, 19 nt, Homo sapiens
gaugaagaagccuuuguuc

SEQ ID NO: 423648 - RNA, 19 nt, Homo sapiens
guugagaugguaacagauu

SEQ ID NO: 423649 - RNA, 19 nt, Homo sapiens
ugaccuuugucuagaguug

SEQ ID NO: 423650 - RNA, 19 nt, Homo sapiens
ucauuugucuacaccauca

SEQ ID NO: 423651 - RNA, 19 nt, Homo sapiens
ugaugaaguucuacaaagg

SEQ ID NO: 423652 - RNA, 19 nt, Homo sapiens
guccaugaacuucuaugua

SEQ ID NO: 423653 - RNA, 19 nt, Homo sapiens
gauuacaacccaucugagu

SEQ ID NO: 423654 - RNA, 19 nt, Homo sapiens
ggaggaaggccugguucuu

SEQ ID NO: 423655 - RNA, 19 nt, Homo sapiens
ugacuggucugaguuaucg

SEQ ID NO: 423656 - RNA, 19 nt, Homo sapiens
gcauccuccuugaaguauu

SEQ ID NO: 423657 - RNA, 19 nt, Homo sapiens
aaaggaguuugaugcacaa

SEQ ID NO: 423658 - RNA, 19 nt, Homo sapiens
uuucucaccagcauucuua

SEQ ID NO: 423659 - RNA, 19 nt, Homo sapiens
uuaucgagguguccaugaa

SEQ ID NO: 423660 - RNA, 19 nt, Homo sapiens
gcaccucaaagcgguuuaa

SEQ ID NO: 423661 - RNA, 19 nt, Homo sapiens
aaggcaaucucaaagaaag

SEQ ID NO: 423662 - RNA, 19 nt, Homo sapiens
uagaaggagcuguggugua

SEQ ID NO: 423663 - RNA, 19 nt, Homo sapiens
caccaacaugggaggauua

SEQ ID NO: 423664 - RNA, 19 nt, Homo sapiens
agaggaggaggaugacuaa

SEQ ID NO: 423665 - RNA, 19 nt, Homo sapiens
gaagaugaagaagccuuug

SEQ ID NO: 423666 - RNA, 19 nt, Homo sapiens
ugaagaugaagaagccuuu

SEQ ID NO: 423667 - RNA, 19 nt, Homo sapiens
acgaguggguuuaucacaa

SEQ ID NO: 423668 - RNA, 19 nt, Homo sapiens
gaagccauagggauacugu

SEQ ID NO: 423669 - RNA, 19 nt, Homo sapiens
caaggaggaaggccugguu

SEQ ID NO: 423670 - RNA, 19 nt, Homo sapiens
ugacaaguaguaaaguuca

SEQ ID NO: 423671 - RNA, 19 nt, Homo sapiens
gucuccagcugaugauuug

SEQ ID NO: 423672 - RNA, 19 nt, Homo sapiens
gcacuaauaugugaacuua

SEQ ID NO: 423673 - RNA, 19 nt, Homo sapiens
agaauaagcugucguuaaa

SEQ ID NO: 423674 - RNA, 19 nt, Homo sapiens
uaaaugaacuggaccaaau

SEQ ID NO: 423675 - RNA, 19 nt, Homo sapiens
gaacuuauggacaugaaua

SEQ ID NO: 423676 - RNA, 19 nt, Homo sapiens
guaagucccuggaucauau

SEQ ID NO: 423677 - RNA, 19 nt, Homo sapiens
caucaugucuuaccaguga

SEQ ID NO: 423678 - RNA, 19 nt, Homo sapiens
ggagcgccaucaugucuua

SEQ ID NO: 423679 - RNA, 19 nt, Homo sapiens
aguaacagcugccagauuu

SEQ ID NO: 423680 - RNA, 19 nt, Homo sapiens
gggagaagauacccauuau

SEQ ID NO: 423681 - RNA, 19 nt, Homo sapiens
gaaacuacuaugcauguaa

SEQ ID NO: 423682 - RNA, 19 nt, Homo sapiens
gcggaaaggcggaagauaa

SEQ ID NO: 423683 - RNA, 19 nt, Homo sapiens
gcauuucugugauguguug

SEQ ID NO: 423684 - RNA, 19 nt, Homo sapiens
ggcaggaaauacuuuguaa

SEQ ID NO: 423685 - RNA, 19 nt, Homo sapiens
gggcuaauauacuuguaaa

SEQ ID NO: 423686 - RNA, 19 nt, Homo sapiens
gaagacagauccgcagaag

SEQ ID NO: 423687 - RNA, 19 nt, Homo sapiens
ggacaugaauauuuaugag

SEQ ID NO: 423688 - RNA, 19 nt, Homo sapiens
ggaaacuacuaugcaugua

SEQ ID NO: 423689 - RNA, 19 nt, Homo sapiens
gaaacagucccuaaagcaa

SEQ ID NO: 423690 - RNA, 19 nt, Homo sapiens
aggaauaccucuacuaaca

SEQ ID NO: 423691 - RNA, 19 nt, Homo sapiens
guucugggcuaauauacuu

SEQ ID NO: 423692 - RNA, 19 nt, Homo sapiens
gaucauauucacagaaaug

SEQ ID NO: 423693 - RNA, 19 nt, Homo sapiens
gcuuggaucuggaacaaau

SEQ ID NO: 423694 - RNA, 19 nt, Homo sapiens
gcacugaggcgccugaauc

SEQ ID NO: 423695 - RNA, 19 nt, Homo sapiens
ccaagaugaagaacuauaa

SEQ ID NO: 423696 - RNA, 19 nt, Homo sapiens
gcacuauauguaccaguua

SEQ ID NO: 423697 - RNA, 19 nt, Homo sapiens
gauggaaacuacuaugcau

SEQ ID NO: 423698 - RNA, 19 nt, Homo sapiens
gaaguuaugaagaugcaaa

SEQ ID NO: 423699 - RNA, 19 nt, Homo sapiens
gagcaggcauuucugugau

SEQ ID NO: 423700 - RNA, 19 nt, Homo sapiens
ucaggaauaccucuacuaa

SEQ ID NO: 423701 - RNA, 19 nt, Homo sapiens
agacagauccgcagaagga

SEQ ID NO: 423702 - RNA, 19 nt, Homo sapiens
agaagauccucaccaaguu

SEQ ID NO: 423703 - RNA, 19 nt, Homo sapiens
gaacuggaccaaaucucaa

SEQ ID NO: 423704 - RNA, 19 nt, Homo sapiens
gcagaaacagucccuaaag

SEQ ID NO: 423705 - RNA, 19 nt, Homo sapiens
gaauaccucuacuaacaac

SEQ ID NO: 423706 - RNA, 19 nt, Homo sapiens
ggaauaccucuacuaacaa

SEQ ID NO: 423707 - RNA, 19 nt, Homo sapiens
aagaauaagcugucguuaa

SEQ ID NO: 423708 - RNA, 19 nt, Homo sapiens
uaaagaauaagcugucguu

SEQ ID NO: 423709 - RNA, 19 nt, Homo sapiens
gauguucugggcuaauaua

SEQ ID NO: 423710 - RNA, 19 nt, Homo sapiens
gaaaguauugagcaaguca

SEQ ID NO: 423711 - RNA, 19 nt, Homo sapiens
gcaccggaaccacucagua

SEQ ID NO: 423712 - RNA, 19 nt, Homo sapiens
uggaucauauucacagaaa

SEQ ID NO: 423713 - RNA, 19 nt, Homo sapiens
ccugagagauggaaacuac

SEQ ID NO: 423714 - RNA, 19 nt, Homo sapiens
gggcaggaaauacuuugua

SEQ ID NO: 423715 - RNA, 19 nt, Homo sapiens
cagaagauccucaccaagu

SEQ ID NO: 423716 - RNA, 19 nt, Homo sapiens
aaacaaacgagcaggcauu

SEQ ID NO: 423717 - RNA, 19 nt, Homo sapiens
caaacgagcaggcauuucu

SEQ ID NO: 423718 - RNA, 19 nt, Homo sapiens
gaugaagaacuauaaagca

SEQ ID NO: 423719 - RNA, 19 nt, Homo sapiens
gaaaggcggaagauaacug

SEQ ID NO: 423720 - RNA, 19 nt, Homo sapiens
gcugccagauuuccaagga

SEQ ID NO: 423721 - RNA, 19 nt, Homo sapiens
gaacagaggaaaacagaga

SEQ ID NO: 423722 - RNA, 19 nt, Homo sapiens
guaaaugaacuggaccaaa

SEQ ID NO: 423723 - RNA, 19 nt, Homo sapiens
ccucuuuccuggaguaaau

SEQ ID NO: 423724 - RNA, 19 nt, Homo sapiens
gaagaugcaaagccugaga

SEQ ID NO: 423725 - RNA, 19 nt, Homo sapiens
acgcaaugguggccuauga

SEQ ID NO: 423726 - RNA, 19 nt, Homo sapiens
gaagauccucaccaaguuc

SEQ ID NO: 423727 - RNA, 19 nt, Homo sapiens
gcacacccgcucagaagau

SEQ ID NO: 423728 - RNA, 19 nt, Homo sapiens
ggaacugcccaaacuaaag

SEQ ID NO: 423729 - RNA, 19 nt, Homo sapiens
ucauggaacugcccaaacu

SEQ ID NO: 423730 - RNA, 19 nt, Homo sapiens
caccggaaccacucaguaa

SEQ ID NO: 423731 - RNA, 19 nt, Homo sapiens
cgagagcuaugaauuuuga

SEQ ID NO: 423732 - RNA, 19 nt, Homo sapiens
uggaauauuucacagagau

SEQ ID NO: 423733 - RNA, 19 nt, Homo sapiens
cauauucacagaaauggaa

SEQ ID NO: 423734 - RNA, 19 nt, Homo sapiens
gagcuaauacgagggagaa

SEQ ID NO: 423735 - RNA, 19 nt, Homo sapiens
cgagagauccaagcacuga

SEQ ID NO: 423736 - RNA, 19 nt, Homo sapiens
cugauggguucuacacgua

SEQ ID NO: 423737 - RNA, 19 nt, Homo sapiens
ugagagauggaaacuacua

SEQ ID NO: 423738 - RNA, 19 nt, Homo sapiens
gcaggcauuucugugaugu

SEQ ID NO: 423739 - RNA, 19 nt, Homo sapiens
cuauaaagcaauuggcaaa

SEQ ID NO: 423740 - RNA, 19 nt, Homo sapiens
gugcuuggaucuggaacaa

SEQ ID NO: 423741 - RNA, 19 nt, Homo sapiens
gacgaggaccggccuaugu

SEQ ID NO: 423742 - RNA, 19 nt, Homo sapiens
cagaaacagucccuaaagc

SEQ ID NO: 423743 - RNA, 19 nt, Homo sapiens
ucacagagauguaaaacca

SEQ ID NO: 423744 - RNA, 19 nt, Homo sapiens
uauguugcaugaagugguu

SEQ ID NO: 423745 - RNA, 19 nt, Homo sapiens
aggauguucugggcuaaua

SEQ ID NO: 423746 - RNA, 19 nt, Homo sapiens
gaucaggaauaccucuacu

SEQ ID NO: 423747 - RNA, 19 nt, Homo sapiens
gcaagucaacaaccuacga

SEQ ID NO: 423748 - RNA, 19 nt, Homo sapiens
cgagcaggcauuucuguga

SEQ ID NO: 423749 - RNA, 19 nt, Homo sapiens
gaacugcccaaacuaaagc

SEQ ID NO: 423750 - RNA, 19 nt, Homo sapiens
aauaggagagggaacguuu

SEQ ID NO: 423751 - RNA, 19 nt, Homo sapiens
gcagcugccuaggauguuc

SEQ ID NO: 423752 - RNA, 19 nt, Homo sapiens
gcaaugguggccuaugauc

SEQ ID NO: 423753 - RNA, 19 nt, Homo sapiens
agggagaagauacccauua

SEQ ID NO: 423754 - RNA, 19 nt, Homo sapiens
gugaacuuauggacaugaa

SEQ ID NO: 423755 - RNA, 19 nt, Homo sapiens
gcacccaaacauucuuaug

SEQ ID NO: 423756 - RNA, 19 nt, Homo sapiens
cuacuaugcauguaaacaa

SEQ ID NO: 423757 - RNA, 19 nt, Homo sapiens
ugacaccccugacuuuuau

SEQ ID NO: 423758 - RNA, 19 nt, Homo sapiens
caggaaauacuuuguaacu

SEQ ID NO: 423759 - RNA, 19 nt, Homo sapiens
augcaaagccugagagaug

SEQ ID NO: 423760 - RNA, 19 nt, Homo sapiens
aagcagaaacagucccuaa

SEQ ID NO: 423761 - RNA, 19 nt, Homo sapiens
gucaacaaccuacgagaga

SEQ ID NO: 423762 - RNA, 19 nt, Homo sapiens
gaauauuucacagagaugu

SEQ ID NO: 423763 - RNA, 19 nt, Homo sapiens
cuaugcauguaaacaaaug

SEQ ID NO: 423764 - RNA, 19 nt, Homo sapiens
agucgagagcuaugaauuu

SEQ ID NO: 423765 - RNA, 19 nt, Homo sapiens
ugaacuggaccaaaucuca

SEQ ID NO: 423766 - RNA, 19 nt, Homo sapiens
cacuauauguaccaguuau

SEQ ID NO: 423767 - RNA, 19 nt, Homo sapiens
gcgcagcugccuaggaugu

SEQ ID NO: 423768 - RNA, 19 nt, Homo sapiens
cucagaagauccucaccaa

SEQ ID NO: 423769 - RNA, 19 nt, Homo sapiens
gcuaauacgagggagaaga

SEQ ID NO: 423770 - RNA, 19 nt, Homo sapiens
gugcugagacccuugaagu

SEQ ID NO: 423771 - RNA, 19 nt, Homo sapiens
gagagauggaaacuacuau

SEQ ID NO: 423772 - RNA, 19 nt, Homo sapiens
gaaauacucuucuucaucu

SEQ ID NO: 423773 - RNA, 19 nt, Homo sapiens
agaagugacugaaauugua

SEQ ID NO: 423774 - RNA, 19 nt, Homo sapiens
gcaggugacugguucuuca

SEQ ID NO: 423775 - RNA, 19 nt, Homo sapiens
gacaugaccugugcuguug

SEQ ID NO: 423776 - RNA, 19 nt, Homo sapiens
agagguagcucagaaaugu

SEQ ID NO: 423777 - RNA, 19 nt, Homo sapiens
ggacugugcccuggccuua

SEQ ID NO: 423778 - RNA, 19 nt, Homo sapiens
caguaacgccugcuguuua

SEQ ID NO: 423779 - RNA, 19 nt, Homo sapiens
gaacugaagaccucuacug

SEQ ID NO: 423780 - RNA, 19 nt, Homo sapiens
agaaauguggcuugucuua

SEQ ID NO: 423781 - RNA, 19 nt, Homo sapiens
cgggaaagccucuaacuug

SEQ ID NO: 423782 - RNA, 19 nt, Homo sapiens
caacuuuucuucccaguaa

SEQ ID NO: 423783 - RNA, 19 nt, Homo sapiens
caacagguuuccaggagau

SEQ ID NO: 423784 - RNA, 19 nt, Homo sapiens
ggcauuggcagucuugaua

SEQ ID NO: 423785 - RNA, 19 nt, Homo sapiens
gcuggcgacuggauggaua

SEQ ID NO: 423786 - RNA, 19 nt, Homo sapiens
gaagagguagcucagaaau

SEQ ID NO: 423787 - RNA, 19 nt, Homo sapiens
aaauguggcuugucuuaca

SEQ ID NO: 423788 - RNA, 19 nt, Homo sapiens
ucagaaauguggcuugucu

SEQ ID NO: 423789 - RNA, 19 nt, Homo sapiens
ggaagagguagcucagaaa

SEQ ID NO: 423790 - RNA, 19 nt, Homo sapiens
agagcagagugccacauua

SEQ ID NO: 423791 - RNA, 19 nt, Homo sapiens
gagaagugacugaaauugu

SEQ ID NO: 423792 - RNA, 19 nt, Homo sapiens
uggaagagguagcucagaa

SEQ ID NO: 423793 - RNA, 19 nt, Homo sapiens
gcaugcauuugacaucuuc

SEQ ID NO: 423794 - RNA, 19 nt, Homo sapiens
ucagguaugucucuguaug

SEQ ID NO: 423795 - RNA, 19 nt, Homo sapiens
gcucagaaauguggcuugu

SEQ ID NO: 423796 - RNA, 19 nt, Homo sapiens
gaccugugcuguuguuugg

SEQ ID NO: 423797 - RNA, 19 nt, Homo sapiens
gcaaaacguccuauaugua

SEQ ID NO: 423798 - RNA, 19 nt, Homo sapiens
gcuugaugcuggucucuau

SEQ ID NO: 423799 - RNA, 19 nt, Homo sapiens
ggagaagugacugaaauug

SEQ ID NO: 423800 - RNA, 19 nt, Homo sapiens
uuccuucccuuauuucuaa

SEQ ID NO: 423801 - RNA, 19 nt, Homo sapiens
gcccauggccugcagcaaa

SEQ ID NO: 423802 - RNA, 19 nt, Homo sapiens
gcauuggcagucuugauaa

SEQ ID NO: 423803 - RNA, 19 nt, Homo sapiens
gcgaggacccagaaauuca

SEQ ID NO: 423804 - RNA, 19 nt, Homo sapiens
cgagggagcaggagcauca

SEQ ID NO: 423805 - RNA, 19 nt, Homo sapiens
acucagguaugucucugua

SEQ ID NO: 423806 - RNA, 19 nt, Homo sapiens
cauuggcagucuugauaaa

SEQ ID NO: 423807 - RNA, 19 nt, Homo sapiens
gggaaacagggaagcauug

SEQ ID NO: 423808 - RNA, 19 nt, Homo sapiens
gagcagagugccacauuac

SEQ ID NO: 423809 - RNA, 19 nt, Homo sapiens
gaagugacugaaauuguag

SEQ ID NO: 423810 - RNA, 19 nt, Homo sapiens
agacaugaccugugcuguu

SEQ ID NO: 423811 - RNA, 19 nt, Homo sapiens
cuggagaagugacugaaau

SEQ ID NO: 423812 - RNA, 19 nt, Homo sapiens
cacguuuccuucccuuauu

SEQ ID NO: 423813 - RNA, 19 nt, Homo sapiens
ccaguaacgccugcuguuu

SEQ ID NO: 423814 - RNA, 19 nt, Homo sapiens
caugaccugugcuguuguu

SEQ ID NO: 423815 - RNA, 19 nt, Homo sapiens
ggacagcgggaggcucaaa

SEQ ID NO: 423816 - RNA, 19 nt, Homo sapiens
cagaagcucuccggaggau

SEQ ID NO: 423817 - RNA, 19 nt, Homo sapiens
uggcucaguucucggcuuu

SEQ ID NO: 423818 - RNA, 19 nt, Homo sapiens
gaggacccagaaauucaua

SEQ ID NO: 423819 - RNA, 19 nt, Homo sapiens
guuacuggguggaaauaag

SEQ ID NO: 423820 - RNA, 19 nt, Homo sapiens
ucauacuggugccacguuu

SEQ ID NO: 423821 - RNA, 19 nt, Homo sapiens
gugacugguucuucaggaa

SEQ ID NO: 423822 - RNA, 19 nt, Homo sapiens
uuucuaacguguauguuuc

SEQ ID NO: 423823 - RNA, 19 nt, Homo sapiens
ccacguuuccuucccuuau

SEQ ID NO: 423824 - RNA, 19 nt, Homo sapiens
cucacucucuguaagcaua

SEQ ID NO: 423825 - RNA, 19 nt, Homo sapiens
gcgccuguguccucucuag

SEQ ID NO: 423826 - RNA, 19 nt, Homo sapiens
cagagcagagugccacauu

SEQ ID NO: 423827 - RNA, 19 nt, Homo sapiens
ccagguggugcaugcauuu

SEQ ID NO: 423828 - RNA, 19 nt, Homo sapiens
gcauugcgaggacccagaa

SEQ ID NO: 423829 - RNA, 19 nt, Homo sapiens
gcagagugccacauuacag

SEQ ID NO: 423830 - RNA, 19 nt, Homo sapiens
gaaauguggcuugucuuac

SEQ ID NO: 423831 - RNA, 19 nt, Homo sapiens
ccuuauuucuaacguguau

SEQ ID NO: 423832 - RNA, 19 nt, Homo sapiens
gccacaggaucaagacagu

SEQ ID NO: 423833 - RNA, 19 nt, Homo sapiens
gaguuacuggguggaaaua

SEQ ID NO: 423834 - RNA, 19 nt, Homo sapiens
gugcaugcauuugacaucu

SEQ ID NO: 423835 - RNA, 19 nt, Homo sapiens
caaaacguccuauauguag

SEQ ID NO: 423836 - RNA, 19 nt, Homo sapiens
ugucucugccuuuccauuu

SEQ ID NO: 423837 - RNA, 19 nt, Homo sapiens
acagggugaucagacauga

SEQ ID NO: 423838 - RNA, 19 nt, Homo sapiens
gcagcaaaacguccuauau

SEQ ID NO: 423839 - RNA, 19 nt, Homo sapiens
cggcaaaacucagguaugu

SEQ ID NO: 423840 - RNA, 19 nt, Homo sapiens
aaaaggcaauuccccgaaa

SEQ ID NO: 423841 - RNA, 19 nt, Homo sapiens
uagcucugucucugaguua

SEQ ID NO: 423842 - RNA, 19 nt, Homo sapiens
gggugcugcuggcucaguu

SEQ ID NO: 423843 - RNA, 19 nt, Homo sapiens
uggcacuggugacuacaga

SEQ ID NO: 423844 - RNA, 19 nt, Homo sapiens
ggaaacagggaagcauugg

SEQ ID NO: 423845 - RNA, 19 nt, Homo sapiens
uccagcugcuucaggcuaa

SEQ ID NO: 423846 - RNA, 19 nt, Homo sapiens
cuugauaaacugcuugaug

SEQ ID NO: 423847 - RNA, 19 nt, Homo sapiens
uuagcucugucucugaguu

SEQ ID NO: 423848 - RNA, 19 nt, Homo sapiens
acguuuccuucccuuauuu

SEQ ID NO: 423849 - RNA, 19 nt, Homo sapiens
auaaaccacaggcgaaaga

SEQ ID NO: 423850 - RNA, 19 nt, Homo sapiens
uccaggagaugguagacau

SEQ ID NO: 423851 - RNA, 19 nt, Homo sapiens
gcaaaacucagguaugucu

SEQ ID NO: 423852 - RNA, 19 nt, Homo sapiens
uugcgaggacccagaaauu

SEQ ID NO: 423853 - RNA, 19 nt, Homo sapiens
caggagaugguagacauug

SEQ ID NO: 423854 - RNA, 19 nt, Homo sapiens
ggauucuccuggacaccau

SEQ ID NO: 423855 - RNA, 19 nt, Homo sapiens
uggagaagugacugaaauu

SEQ ID NO: 423856 - RNA, 19 nt, Homo sapiens
ucucugccuuuccauuugu

SEQ ID NO: 423857 - RNA, 19 nt, Homo sapiens
gucucugccuuuccauuug

SEQ ID NO: 423858 - RNA, 19 nt, Homo sapiens
uaacgccugcuguuuacug

SEQ ID NO: 423859 - RNA, 19 nt, Homo sapiens
ggaggaacaggcagaagcu

SEQ ID NO: 423860 - RNA, 19 nt, Homo sapiens
ugaccugugcuguuguuug

SEQ ID NO: 423861 - RNA, 19 nt, Homo sapiens
ccacauuacagggugauca

SEQ ID NO: 423862 - RNA, 19 nt, Homo sapiens
cccgacagccaacagguuu

SEQ ID NO: 423863 - RNA, 19 nt, Homo sapiens
cagcaaaacguccuauaug

SEQ ID NO: 423864 - RNA, 19 nt, Homo sapiens
gaaauacucuucuucaucu

SEQ ID NO: 423865 - RNA, 19 nt, Homo sapiens
agaagugacugaaauugua

SEQ ID NO: 423866 - RNA, 19 nt, Homo sapiens
gcaggugacugguucuuca

SEQ ID NO: 423867 - RNA, 19 nt, Homo sapiens
gacaugaccugugcuguug

SEQ ID NO: 423868 - RNA, 19 nt, Homo sapiens
agagguagcucagaaaugu

SEQ ID NO: 423869 - RNA, 19 nt, Homo sapiens
ggacugugcccuggccuua

SEQ ID NO: 423870 - RNA, 19 nt, Homo sapiens
caguaacgccugcuguuua

SEQ ID NO: 423871 - RNA, 19 nt, Homo sapiens
agaaauguggcuugucuua

SEQ ID NO: 423872 - RNA, 19 nt, Homo sapiens
cgggaaagccucuaacuug

SEQ ID NO: 423873 - RNA, 19 nt, Homo sapiens
caacuuuucuucccaguaa

SEQ ID NO: 423874 - RNA, 19 nt, Homo sapiens
caacagguuuccaggagau

SEQ ID NO: 423875 - RNA, 19 nt, Homo sapiens
gcuggcgacuggauggaua

SEQ ID NO: 423876 - RNA, 19 nt, Homo sapiens
gaagagguagcucagaaau

SEQ ID NO: 423877 - RNA, 19 nt, Homo sapiens
aaauguggcuugucuuaca

SEQ ID NO: 423878 - RNA, 19 nt, Homo sapiens
ucagaaauguggcuugucu

SEQ ID NO: 423879 - RNA, 19 nt, Homo sapiens
ggaagagguagcucagaaa

SEQ ID NO: 423880 - RNA, 19 nt, Homo sapiens
agagcagagugccacauua

SEQ ID NO: 423881 - RNA, 19 nt, Homo sapiens
gagaagugacugaaauugu

SEQ ID NO: 423882 - RNA, 19 nt, Homo sapiens
uggaagagguagcucagaa

SEQ ID NO: 423883 - RNA, 19 nt, Homo sapiens
gcaugcauuugacaucuuc

SEQ ID NO: 423884 - RNA, 19 nt, Homo sapiens
ucagguaugucucuguaug

SEQ ID NO: 423885 - RNA, 19 nt, Homo sapiens
gcucagaaauguggcuugu

SEQ ID NO: 423886 - RNA, 19 nt, Homo sapiens
gaccugugcuguuguuugg

SEQ ID NO: 423887 - RNA, 19 nt, Homo sapiens
gcaaaacguccuauaugua

SEQ ID NO: 423888 - RNA, 19 nt, Homo sapiens
gcuugaugcuggucucuau

SEQ ID NO: 423889 - RNA, 19 nt, Homo sapiens
ggagaagugacugaaauug

SEQ ID NO: 423890 - RNA, 19 nt, Homo sapiens
uuccuucccuuauuucuaa

SEQ ID NO: 423891 - RNA, 19 nt, Homo sapiens
gcccauggccugcagcaaa

SEQ ID NO: 423892 - RNA, 19 nt, Homo sapiens
gcgaggacccagaaauuca

SEQ ID NO: 423893 - RNA, 19 nt, Homo sapiens
cgagggagcaggagcauca

SEQ ID NO: 423894 - RNA, 19 nt, Homo sapiens
acucagguaugucucugua

SEQ ID NO: 423895 - RNA, 19 nt, Homo sapiens
gggaaacagggaagcauug

SEQ ID NO: 423896 - RNA, 19 nt, Homo sapiens
gagcagagugccacauuac

SEQ ID NO: 423897 - RNA, 19 nt, Homo sapiens
gaagugacugaaauuguag

SEQ ID NO: 423898 - RNA, 19 nt, Homo sapiens
agacaugaccugugcuguu

SEQ ID NO: 423899 - RNA, 19 nt, Homo sapiens
cuggagaagugacugaaau

SEQ ID NO: 423900 - RNA, 19 nt, Homo sapiens
cacguuuccuucccuuauu

SEQ ID NO: 423901 - RNA, 19 nt, Homo sapiens
ccaguaacgccugcuguuu

SEQ ID NO: 423902 - RNA, 19 nt, Homo sapiens
caugaccugugcuguuguu

SEQ ID NO: 423903 - RNA, 19 nt, Homo sapiens
ggacagcgggaggcucaaa

SEQ ID NO: 423904 - RNA, 19 nt, Homo sapiens
cagaagcucuccggaggau

SEQ ID NO: 423905 - RNA, 19 nt, Homo sapiens
gaggacccagaaauucaua

SEQ ID NO: 423906 - RNA, 19 nt, Homo sapiens
guuacuggguggaaauaag

SEQ ID NO: 423907 - RNA, 19 nt, Homo sapiens
ucauacuggugccacguuu

SEQ ID NO: 423908 - RNA, 19 nt, Homo sapiens
gugacugguucuucaggaa

SEQ ID NO: 423909 - RNA, 19 nt, Homo sapiens
uuucuaacguguauguuuc

SEQ ID NO: 423910 - RNA, 19 nt, Homo sapiens
ccacguuuccuucccuuau

SEQ ID NO: 423911 - RNA, 19 nt, Homo sapiens
cucacucucuguaagcaua

SEQ ID NO: 423912 - RNA, 19 nt, Homo sapiens
gcgccuguguccucucuag

SEQ ID NO: 423913 - RNA, 19 nt, Homo sapiens
cagagcagagugccacauu

SEQ ID NO: 423914 - RNA, 19 nt, Homo sapiens
ccagguggugcaugcauuu

SEQ ID NO: 423915 - RNA, 19 nt, Homo sapiens
gcauugcgaggacccagaa

SEQ ID NO: 423916 - RNA, 19 nt, Homo sapiens
gcagagugccacauuacag

SEQ ID NO: 423917 - RNA, 19 nt, Homo sapiens
ccuuauuucuaacguguau

SEQ ID NO: 423918 - RNA, 19 nt, Homo sapiens
gccacaggaucaagacagu

SEQ ID NO: 423919 - RNA, 19 nt, Homo sapiens
gaaauguggcuugucuuac

SEQ ID NO: 423920 - RNA, 19 nt, Homo sapiens
gaguuacuggguggaaaua

SEQ ID NO: 423921 - RNA, 19 nt, Homo sapiens
gugcaugcauuugacaucu

SEQ ID NO: 423922 - RNA, 19 nt, Homo sapiens
caaaacguccuauauguag

SEQ ID NO: 423923 - RNA, 19 nt, Homo sapiens
ugucucugccuuuccauuu

SEQ ID NO: 423924 - RNA, 19 nt, Homo sapiens
acagggugaucagacauga

SEQ ID NO: 423925 - RNA, 19 nt, Homo sapiens
gcagcaaaacguccuauau

SEQ ID NO: 423926 - RNA, 19 nt, Homo sapiens
cggcaaaacucagguaugu

SEQ ID NO: 423927 - RNA, 19 nt, Homo sapiens
uagcucugucucugaguua

SEQ ID NO: 423928 - RNA, 19 nt, Homo sapiens
uggcacuggugacuacaga

SEQ ID NO: 423929 - RNA, 19 nt, Homo sapiens
ggaaacagggaagcauugg

SEQ ID NO: 423930 - RNA, 19 nt, Homo sapiens
cuugauaaacugcuugaug

SEQ ID NO: 423931 - RNA, 19 nt, Homo sapiens
uccagcugcuucaggcuaa

SEQ ID NO: 423932 - RNA, 19 nt, Homo sapiens
uuagcucugucucugaguu

SEQ ID NO: 423933 - RNA, 19 nt, Homo sapiens
acguuuccuucccuuauuu

SEQ ID NO: 423934 - RNA, 19 nt, Homo sapiens
auaaaccacaggcgaaaga

SEQ ID NO: 423935 - RNA, 19 nt, Homo sapiens
uccaggagaugguagacau

SEQ ID NO: 423936 - RNA, 19 nt, Homo sapiens
gcaaaacucagguaugucu

SEQ ID NO: 423937 - RNA, 19 nt, Homo sapiens
uugcgaggacccagaaauu

SEQ ID NO: 423938 - RNA, 19 nt, Homo sapiens
caggagaugguagacauug

SEQ ID NO: 423939 - RNA, 19 nt, Homo sapiens
ggauucuccuggacaccau

SEQ ID NO: 423940 - RNA, 19 nt, Homo sapiens
uggagaagugacugaaauu

SEQ ID NO: 423941 - RNA, 19 nt, Homo sapiens
ucucugccuuuccauuugu

SEQ ID NO: 423942 - RNA, 19 nt, Homo sapiens
gucucugccuuuccauuug

SEQ ID NO: 423943 - RNA, 19 nt, Homo sapiens
uaacgccugcuguuuacug

SEQ ID NO: 423944 - RNA, 19 nt, Homo sapiens
ggaggaacaggcagaagcu

SEQ ID NO: 423945 - RNA, 19 nt, Homo sapiens
ugaccugugcuguuguuug

SEQ ID NO: 423946 - RNA, 19 nt, Homo sapiens
ccacauuacagggugauca

SEQ ID NO: 423947 - RNA, 19 nt, Homo sapiens
cccgacagccaacagguuu

SEQ ID NO: 423948 - RNA, 19 nt, Homo sapiens
cagcaaaacguccuauaug

SEQ ID NO: 423949 - RNA, 19 nt, Homo sapiens
gaaauacucuucuucaucu

SEQ ID NO: 423950 - RNA, 19 nt, Homo sapiens
gcagguaugucucuguaug

SEQ ID NO: 423951 - RNA, 19 nt, Homo sapiens
gcaggugacugguucuuca

SEQ ID NO: 423952 - RNA, 19 nt, Homo sapiens
gacaugaccugugcuguug

SEQ ID NO: 423953 - RNA, 19 nt, Homo sapiens
agagguagcucagaaaugu

SEQ ID NO: 423954 - RNA, 19 nt, Homo sapiens
ggacugugcccuggccuua

SEQ ID NO: 423955 - RNA, 19 nt, Homo sapiens
caguaacgccugcuguuua

SEQ ID NO: 423956 - RNA, 19 nt, Homo sapiens
gaacugaagaccucuacug

SEQ ID NO: 423957 - RNA, 19 nt, Homo sapiens
agaaauguggcuugucuua

SEQ ID NO: 423958 - RNA, 19 nt, Homo sapiens
cgggaaagccucuaacuug

SEQ ID NO: 423959 - RNA, 19 nt, Homo sapiens
caacuuuucuucccaguaa

SEQ ID NO: 423960 - RNA, 19 nt, Homo sapiens
caacagguuuccaggagau

SEQ ID NO: 423961 - RNA, 19 nt, Homo sapiens
gcuggcgacuggauggaua

SEQ ID NO: 423962 - RNA, 19 nt, Homo sapiens
gaagagguagcucagaaau

SEQ ID NO: 423963 - RNA, 19 nt, Homo sapiens
aaauguggcuugucuuaca

SEQ ID NO: 423964 - RNA, 19 nt, Homo sapiens
ucagaaauguggcuugucu

SEQ ID NO: 423965 - RNA, 19 nt, Homo sapiens
ggaagagguagcucagaaa

SEQ ID NO: 423966 - RNA, 19 nt, Homo sapiens
agagcagagugccacauua

SEQ ID NO: 423967 - RNA, 19 nt, Homo sapiens
uggaagagguagcucagaa

SEQ ID NO: 423968 - RNA, 19 nt, Homo sapiens
gcaugcauuugacaucuuc

SEQ ID NO: 423969 - RNA, 19 nt, Homo sapiens
ccacuggcauuggcaggua

SEQ ID NO: 423970 - RNA, 19 nt, Homo sapiens
gcucagaaauguggcuugu

SEQ ID NO: 423971 - RNA, 19 nt, Homo sapiens
gaccugugcuguuguuugg

SEQ ID NO: 423972 - RNA, 19 nt, Homo sapiens
gcaaaacguccuauaugua

SEQ ID NO: 423973 - RNA, 19 nt, Homo sapiens
uuccuucccuuauuucuaa

SEQ ID NO: 423974 - RNA, 19 nt, Homo sapiens
gcccauggccugcagcaaa

SEQ ID NO: 423975 - RNA, 19 nt, Homo sapiens
uggcagguaugucucugua

SEQ ID NO: 423976 - RNA, 19 nt, Homo sapiens
gcgaggacccagaaauuca

SEQ ID NO: 423977 - RNA, 19 nt, Homo sapiens
cgagggagcaggagcauca

SEQ ID NO: 423978 - RNA, 19 nt, Homo sapiens
gggaaacagggaagcauug

SEQ ID NO: 423979 - RNA, 19 nt, Homo sapiens
gagcagagugccacauuac

SEQ ID NO: 423980 - RNA, 19 nt, Homo sapiens
agacaugaccugugcuguu

SEQ ID NO: 423981 - RNA, 19 nt, Homo sapiens
cacguuuccuucccuuauu

SEQ ID NO: 423982 - RNA, 19 nt, Homo sapiens
ccaguaacgccugcuguuu

SEQ ID NO: 423983 - RNA, 19 nt, Homo sapiens
caugaccugugcuguuguu

SEQ ID NO: 423984 - RNA, 19 nt, Homo sapiens
ggacagcgggaggcucaaa

SEQ ID NO: 423985 - RNA, 19 nt, Homo sapiens
cagaagcucuccggaggau

SEQ ID NO: 423986 - RNA, 19 nt, Homo sapiens
uggcucaguucucggcuuu

SEQ ID NO: 423987 - RNA, 19 nt, Homo sapiens
gaggacccagaaauucaua

SEQ ID NO: 423988 - RNA, 19 nt, Homo sapiens
guuacuggguggaaauaag

SEQ ID NO: 423989 - RNA, 19 nt, Homo sapiens
ucauacuggugccacguuu

SEQ ID NO: 423990 - RNA, 19 nt, Homo sapiens
gugacugguucuucaggaa

SEQ ID NO: 423991 - RNA, 19 nt, Homo sapiens
uuucuaacguguauguuuc

SEQ ID NO: 423992 - RNA, 19 nt, Homo sapiens
ccacguuuccuucccuuau

SEQ ID NO: 423993 - RNA, 19 nt, Homo sapiens
cucacucucuguaagcaua

SEQ ID NO: 423994 - RNA, 19 nt, Homo sapiens
gcgccuguguccucucuag

SEQ ID NO: 423995 - RNA, 19 nt, Homo sapiens
cagagcagagugccacauu

SEQ ID NO: 423996 - RNA, 19 nt, Homo sapiens
ccagguggugcaugcauuu

SEQ ID NO: 423997 - RNA, 19 nt, Homo sapiens
gcauugcgaggacccagaa

SEQ ID NO: 423998 - RNA, 19 nt, Homo sapiens
gcagagugccacauuacag

SEQ ID NO: 423999 - RNA, 19 nt, Homo sapiens
ccuuauuucuaacguguau

SEQ ID NO: 424000 - RNA, 19 nt, Homo sapiens
gaaauguggcuugucuuac

SEQ ID NO: 424001 - RNA, 19 nt, Homo sapiens
gccacaggaucaagacagu

SEQ ID NO: 424002 - RNA, 19 nt, Homo sapiens
gaguuacuggguggaaaua

SEQ ID NO: 424003 - RNA, 19 nt, Homo sapiens
gugcaugcauuugacaucu

SEQ ID NO: 424004 - RNA, 19 nt, Homo sapiens
caaaacguccuauauguag

SEQ ID NO: 424005 - RNA, 19 nt, Homo sapiens
ugucucugccuuuccauuu

SEQ ID NO: 424006 - RNA, 19 nt, Homo sapiens
acagggugaucagacauga

SEQ ID NO: 424007 - RNA, 19 nt, Homo sapiens
gcagcaaaacguccuauau

SEQ ID NO: 424008 - RNA, 19 nt, Homo sapiens
aaaaggcaauuccccgaaa

SEQ ID NO: 424009 - RNA, 19 nt, Homo sapiens
uagcucugucucugaguua

SEQ ID NO: 424010 - RNA, 19 nt, Homo sapiens
gggugcugcuggcucaguu

SEQ ID NO: 424011 - RNA, 19 nt, Homo sapiens
uggcacuggugacuacaga

SEQ ID NO: 424012 - RNA, 19 nt, Homo sapiens
ggaaacagggaagcauugg

SEQ ID NO: 424013 - RNA, 19 nt, Homo sapiens
uccagcugcuucaggcuaa

SEQ ID NO: 424014 - RNA, 19 nt, Homo sapiens
uuagcucugucucugaguu

SEQ ID NO: 424015 - RNA, 19 nt, Homo sapiens
acguuuccuucccuuauuu

SEQ ID NO: 424016 - RNA, 19 nt, Homo sapiens
auaaaccacaggcgaaaga

SEQ ID NO: 424017 - RNA, 19 nt, Homo sapiens
uccaggagaugguagacau

SEQ ID NO: 424018 - RNA, 19 nt, Homo sapiens
uugcgaggacccagaaauu

SEQ ID NO: 424019 - RNA, 19 nt, Homo sapiens
caggagaugguagacauug

SEQ ID NO: 424020 - RNA, 19 nt, Homo sapiens
ggauucuccuggacaccau

SEQ ID NO: 424021 - RNA, 19 nt, Homo sapiens
ucucugccuuuccauuugu

SEQ ID NO: 424022 - RNA, 19 nt, Homo sapiens
gucucugccuuuccauuug

SEQ ID NO: 424023 - RNA, 19 nt, Homo sapiens
uaacgccugcuguuuacug

SEQ ID NO: 424024 - RNA, 19 nt, Homo sapiens
ggaggaacaggcagaagcu

SEQ ID NO: 424025 - RNA, 19 nt, Homo sapiens
ugaccugugcuguuguuug

SEQ ID NO: 424026 - RNA, 19 nt, Homo sapiens
ccacauuacagggugauca

SEQ ID NO: 424027 - RNA, 19 nt, Homo sapiens
cccgacagccaacagguuu

SEQ ID NO: 424028 - RNA, 19 nt, Homo sapiens
cagcaaaacguccuauaug

SEQ ID NO: 424029 - RNA, 19 nt, Homo sapiens
ggcauuggcagguaugucu

SEQ ID NO: 424030 - RNA, 19 nt, Homo sapiens
gaaauacucuucuucaucu

SEQ ID NO: 424031 - RNA, 19 nt, Homo sapiens
gcaggugacugguucuuca

SEQ ID NO: 424032 - RNA, 19 nt, Homo sapiens
gacaugaccugugcuguug

SEQ ID NO: 424033 - RNA, 19 nt, Homo sapiens
agagguagcucagaaaugu

SEQ ID NO: 424034 - RNA, 19 nt, Homo sapiens
ggacugugcccuggccuua

SEQ ID NO: 424035 - RNA, 19 nt, Homo sapiens
caguaacgccugcuguuua

SEQ ID NO: 424036 - RNA, 19 nt, Homo sapiens
agaaauguggcuugucuua

SEQ ID NO: 424037 - RNA, 19 nt, Homo sapiens
cgggaaagccucuaacuug

SEQ ID NO: 424038 - RNA, 19 nt, Homo sapiens
caacuuuucuucccaguaa

SEQ ID NO: 424039 - RNA, 19 nt, Homo sapiens
caacagguuuccaggagau

SEQ ID NO: 424040 - RNA, 19 nt, Homo sapiens
gcuggcgacuggauggaua

SEQ ID NO: 424041 - RNA, 19 nt, Homo sapiens
gaagagguagcucagaaau

SEQ ID NO: 424042 - RNA, 19 nt, Homo sapiens
aaauguggcuugucuuaca

SEQ ID NO: 424043 - RNA, 19 nt, Homo sapiens
ucagaaauguggcuugucu

SEQ ID NO: 424044 - RNA, 19 nt, Homo sapiens
ggaagagguagcucagaaa

SEQ ID NO: 424045 - RNA, 19 nt, Homo sapiens
agagcagagugccacauua

SEQ ID NO: 424046 - RNA, 19 nt, Homo sapiens
uggaagagguagcucagaa

SEQ ID NO: 424047 - RNA, 19 nt, Homo sapiens
gcaugcauuugacaucuuc

SEQ ID NO: 424048 - RNA, 19 nt, Homo sapiens
gcucagaaauguggcuugu

SEQ ID NO: 424049 - RNA, 19 nt, Homo sapiens
gaccugugcuguuguuugg

SEQ ID NO: 424050 - RNA, 19 nt, Homo sapiens
uuccuucccuuauuucuaa

SEQ ID NO: 424051 - RNA, 19 nt, Homo sapiens
gcgaggacccagaaauuca

SEQ ID NO: 424052 - RNA, 19 nt, Homo sapiens
cgagggagcaggagcauca

SEQ ID NO: 424053 - RNA, 19 nt, Homo sapiens
gggaaacagggaagcauug

SEQ ID NO: 424054 - RNA, 19 nt, Homo sapiens
gagcagagugccacauuac

SEQ ID NO: 424055 - RNA, 19 nt, Homo sapiens
agacaugaccugugcuguu

SEQ ID NO: 424056 - RNA, 19 nt, Homo sapiens
cacguuuccuucccuuauu

SEQ ID NO: 424057 - RNA, 19 nt, Homo sapiens
ccaguaacgccugcuguuu

SEQ ID NO: 424058 - RNA, 19 nt, Homo sapiens
caugaccugugcuguuguu

SEQ ID NO: 424059 - RNA, 19 nt, Homo sapiens
ggacagcgggaggcucaaa

SEQ ID NO: 424060 - RNA, 19 nt, Homo sapiens
cagaagcucuccggaggau

SEQ ID NO: 424061 - RNA, 19 nt, Homo sapiens
gaggacccagaaauucaua

SEQ ID NO: 424062 - RNA, 19 nt, Homo sapiens
guuacuggguggaaauaag

SEQ ID NO: 424063 - RNA, 19 nt, Homo sapiens
ucauacuggugccacguuu

SEQ ID NO: 424064 - RNA, 19 nt, Homo sapiens
gugacugguucuucaggaa

SEQ ID NO: 424065 - RNA, 19 nt, Homo sapiens
uuucuaacguguauguuuc

SEQ ID NO: 424066 - RNA, 19 nt, Homo sapiens
ccacguuuccuucccuuau

SEQ ID NO: 424067 - RNA, 19 nt, Homo sapiens
cucacucucuguaagcaua

SEQ ID NO: 424068 - RNA, 19 nt, Homo sapiens
cagagcagagugccacauu

SEQ ID NO: 424069 - RNA, 19 nt, Homo sapiens
ccagguggugcaugcauuu

SEQ ID NO: 424070 - RNA, 19 nt, Homo sapiens
gcgccuguguccucucuag

SEQ ID NO: 424071 - RNA, 19 nt, Homo sapiens
gcauugcgaggacccagaa

SEQ ID NO: 424072 - RNA, 19 nt, Homo sapiens
gcagagugccacauuacag

SEQ ID NO: 424073 - RNA, 19 nt, Homo sapiens
ccuuauuucuaacguguau

SEQ ID NO: 424074 - RNA, 19 nt, Homo sapiens
gccacaggaucaagacagu

SEQ ID NO: 424075 - RNA, 19 nt, Homo sapiens
gaaauguggcuugucuuac

SEQ ID NO: 424076 - RNA, 19 nt, Homo sapiens
gaguuacuggguggaaaua

SEQ ID NO: 424077 - RNA, 19 nt, Homo sapiens
gugcaugcauuugacaucu

SEQ ID NO: 424078 - RNA, 19 nt, Homo sapiens
ugucucugccuuuccauuu

SEQ ID NO: 424079 - RNA, 19 nt, Homo sapiens
acagggugaucagacauga

SEQ ID NO: 424080 - RNA, 19 nt, Homo sapiens
uagcucugucucugaguua

SEQ ID NO: 424081 - RNA, 19 nt, Homo sapiens
uggcacuggugacuacaga

SEQ ID NO: 424082 - RNA, 19 nt, Homo sapiens
ggaaacagggaagcauugg

SEQ ID NO: 424083 - RNA, 19 nt, Homo sapiens
uuagcucugucucugaguu

SEQ ID NO: 424084 - RNA, 19 nt, Homo sapiens
acguuuccuucccuuauuu

SEQ ID NO: 424085 - RNA, 19 nt, Homo sapiens
auaaaccacaggcgaaaga

SEQ ID NO: 424086 - RNA, 19 nt, Homo sapiens
uccaggagaugguagacau

SEQ ID NO: 424087 - RNA, 19 nt, Homo sapiens
uugcgaggacccagaaauu

SEQ ID NO: 424088 - RNA, 19 nt, Homo sapiens
caggagaugguagacauug

SEQ ID NO: 424089 - RNA, 19 nt, Homo sapiens
ggauucuccuggacaccau

SEQ ID NO: 424090 - RNA, 19 nt, Homo sapiens
ucucugccuuuccauuugu

SEQ ID NO: 424091 - RNA, 19 nt, Homo sapiens
gucucugccuuuccauuug

SEQ ID NO: 424092 - RNA, 19 nt, Homo sapiens
uaacgccugcuguuuacug

SEQ ID NO: 424093 - RNA, 19 nt, Homo sapiens
ugaccugugcuguuguuug

SEQ ID NO: 424094 - RNA, 19 nt, Homo sapiens
ccacauuacagggugauca

SEQ ID NO: 424095 - RNA, 19 nt, Homo sapiens
cccgacagccaacagguuu

SEQ ID NO: 424096 - RNA, 19 nt, Homo sapiens
gaaauacucuucuucaucu

SEQ ID NO: 424097 - RNA, 19 nt, Homo sapiens
agaagugacugaaauugua

SEQ ID NO: 424098 - RNA, 19 nt, Homo sapiens
gcaggugacugguucuuca

SEQ ID NO: 424099 - RNA, 19 nt, Homo sapiens
gacaugaccugugcuguug

SEQ ID NO: 424100 - RNA, 19 nt, Homo sapiens
agagguagcucagaaaugu

SEQ ID NO: 424101 - RNA, 19 nt, Homo sapiens
ggacugugcccuggccuua

SEQ ID NO: 424102 - RNA, 19 nt, Homo sapiens
caguaacgccugcuguuua

SEQ ID NO: 424103 - RNA, 19 nt, Homo sapiens
agaaauguggcuugucuua

SEQ ID NO: 424104 - RNA, 19 nt, Homo sapiens
cgggaaagccucuaacuug

SEQ ID NO: 424105 - RNA, 19 nt, Homo sapiens
caacuuuucuucccaguaa

SEQ ID NO: 424106 - RNA, 19 nt, Homo sapiens
caacagguuuccaggagau

SEQ ID NO: 424107 - RNA, 19 nt, Homo sapiens
gcuggcgacuggauggaua

SEQ ID NO: 424108 - RNA, 19 nt, Homo sapiens
gaagagguagcucagaaau

SEQ ID NO: 424109 - RNA, 19 nt, Homo sapiens
aaauguggcuugucuuaca

SEQ ID NO: 424110 - RNA, 19 nt, Homo sapiens
ucagaaauguggcuugucu

SEQ ID NO: 424111 - RNA, 19 nt, Homo sapiens
ggaagagguagcucagaaa

SEQ ID NO: 424112 - RNA, 19 nt, Homo sapiens
agagcagagugccacauua

SEQ ID NO: 424113 - RNA, 19 nt, Homo sapiens
gagaagugacugaaauugu

SEQ ID NO: 424114 - RNA, 19 nt, Homo sapiens
uggaagagguagcucagaa

SEQ ID NO: 424115 - RNA, 19 nt, Homo sapiens
gcaugcauuugacaucuuc

SEQ ID NO: 424116 - RNA, 19 nt, Homo sapiens
gcucagaaauguggcuugu

SEQ ID NO: 424117 - RNA, 19 nt, Homo sapiens
gaccugugcuguuguuugg

SEQ ID NO: 424118 - RNA, 19 nt, Homo sapiens
gcuugaugcuggucucuau

SEQ ID NO: 424119 - RNA, 19 nt, Homo sapiens
ggagaagugacugaaauug

SEQ ID NO: 424120 - RNA, 19 nt, Homo sapiens
uuccuucccuuauuucuaa

SEQ ID NO: 424121 - RNA, 19 nt, Homo sapiens
gcgaggacccagaaauuca

SEQ ID NO: 424122 - RNA, 19 nt, Homo sapiens
cgagggagcaggagcauca

SEQ ID NO: 424123 - RNA, 19 nt, Homo sapiens
gggaaacagggaagcauug

SEQ ID NO: 424124 - RNA, 19 nt, Homo sapiens
gagcagagugccacauuac

SEQ ID NO: 424125 - RNA, 19 nt, Homo sapiens
gaagugacugaaauuguag

SEQ ID NO: 424126 - RNA, 19 nt, Homo sapiens
agacaugaccugugcuguu

SEQ ID NO: 424127 - RNA, 19 nt, Homo sapiens
cuggagaagugacugaaau

SEQ ID NO: 424128 - RNA, 19 nt, Homo sapiens
cacguuuccuucccuuauu

SEQ ID NO: 424129 - RNA, 19 nt, Homo sapiens
ccaguaacgccugcuguuu

SEQ ID NO: 424130 - RNA, 19 nt, Homo sapiens
caugaccugugcuguuguu

SEQ ID NO: 424131 - RNA, 19 nt, Homo sapiens
ggacagcgggaggcucaaa

SEQ ID NO: 424132 - RNA, 19 nt, Homo sapiens
cagaagcucuccggaggau

SEQ ID NO: 424133 - RNA, 19 nt, Homo sapiens
gaggacccagaaauucaua

SEQ ID NO: 424134 - RNA, 19 nt, Homo sapiens
guuacuggguggaaauaag

SEQ ID NO: 424135 - RNA, 19 nt, Homo sapiens
ucauacuggugccacguuu

SEQ ID NO: 424136 - RNA, 19 nt, Homo sapiens
gugacugguucuucaggaa

SEQ ID NO: 424137 - RNA, 19 nt, Homo sapiens
uuucuaacguguauguuuc

SEQ ID NO: 424138 - RNA, 19 nt, Homo sapiens
ccacguuuccuucccuuau

SEQ ID NO: 424139 - RNA, 19 nt, Homo sapiens
cucacucucuguaagcaua

SEQ ID NO: 424140 - RNA, 19 nt, Homo sapiens
gcgccuguguccucucuag

SEQ ID NO: 424141 - RNA, 19 nt, Homo sapiens
cagagcagagugccacauu

SEQ ID NO: 424142 - RNA, 19 nt, Homo sapiens
ccagguggugcaugcauuu

SEQ ID NO: 424143 - RNA, 19 nt, Homo sapiens
gcauugcgaggacccagaa

SEQ ID NO: 424144 - RNA, 19 nt, Homo sapiens
gcagagugccacauuacag

SEQ ID NO: 424145 - RNA, 19 nt, Homo sapiens
ccuuauuucuaacguguau

SEQ ID NO: 424146 - RNA, 19 nt, Homo sapiens
gaaauguggcuugucuuac

SEQ ID NO: 424147 - RNA, 19 nt, Homo sapiens
gccacaggaucaagacagu

SEQ ID NO: 424148 - RNA, 19 nt, Homo sapiens
gaguuacuggguggaaaua

SEQ ID NO: 424149 - RNA, 19 nt, Homo sapiens
gugcaugcauuugacaucu

SEQ ID NO: 424150 - RNA, 19 nt, Homo sapiens
ugucucugccuuuccauuu

SEQ ID NO: 424151 - RNA, 19 nt, Homo sapiens
acagggugaucagacauga

SEQ ID NO: 424152 - RNA, 19 nt, Homo sapiens
uagcucugucucugaguua

SEQ ID NO: 424153 - RNA, 19 nt, Homo sapiens
cuugauaaacugcuugaug

SEQ ID NO: 424154 - RNA, 19 nt, Homo sapiens
uggcacuggugacuacaga

SEQ ID NO: 424155 - RNA, 19 nt, Homo sapiens
ggaaacagggaagcauugg

SEQ ID NO: 424156 - RNA, 19 nt, Homo sapiens
uuagcucugucucugaguu

SEQ ID NO: 424157 - RNA, 19 nt, Homo sapiens
acguuuccuucccuuauuu

SEQ ID NO: 424158 - RNA, 19 nt, Homo sapiens
auaaaccacaggcgaaaga

SEQ ID NO: 424159 - RNA, 19 nt, Homo sapiens
uccaggagaugguagacau

SEQ ID NO: 424160 - RNA, 19 nt, Homo sapiens
uugcgaggacccagaaauu

SEQ ID NO: 424161 - RNA, 19 nt, Homo sapiens
caggagaugguagacauug

SEQ ID NO: 424162 - RNA, 19 nt, Homo sapiens
ggauucuccuggacaccau

SEQ ID NO: 424163 - RNA, 19 nt, Homo sapiens
uggagaagugacugaaauu

SEQ ID NO: 424164 - RNA, 19 nt, Homo sapiens
ucucugccuuuccauuugu

SEQ ID NO: 424165 - RNA, 19 nt, Homo sapiens
gucucugccuuuccauuug

SEQ ID NO: 424166 - RNA, 19 nt, Homo sapiens
uaacgccugcuguuuacug

SEQ ID NO: 424167 - RNA, 19 nt, Homo sapiens
cggcaaaacucaggcagaa

SEQ ID NO: 424168 - RNA, 19 nt, Homo sapiens
ugaccugugcuguuguuug

SEQ ID NO: 424169 - RNA, 19 nt, Homo sapiens
ccacauuacagggugauca

SEQ ID NO: 424170 - RNA, 19 nt, Homo sapiens
cccgacagccaacagguuu

SEQ ID NO: 424171 - RNA, 19 nt, Homo sapiens
ggaaauaugauccaucuua

SEQ ID NO: 424172 - RNA, 19 nt, Homo sapiens
ggaaggaaauaaucaucua

SEQ ID NO: 424173 - RNA, 19 nt, Homo sapiens
uaauuaaucuggccaauga

SEQ ID NO: 424174 - RNA, 19 nt, Homo sapiens
ucucagagcauuucaauua

SEQ ID NO: 424175 - RNA, 19 nt, Homo sapiens
uaccugagaucacuaaaua

SEQ ID NO: 424176 - RNA, 19 nt, Homo sapiens
ggacaaagacuaccugaga

SEQ ID NO: 424177 - RNA, 19 nt, Homo sapiens
uaacccaccuugaccauaa

SEQ ID NO: 424178 - RNA, 19 nt, Homo sapiens
cauaacgucugccuucuuu

SEQ ID NO: 424179 - RNA, 19 nt, Homo sapiens
gaaacuguauucuggacaa

SEQ ID NO: 424180 - RNA, 19 nt, Homo sapiens
gcaauugucuacauucagu

SEQ ID NO: 424181 - RNA, 19 nt, Homo sapiens
guucaucgcugcuggagaa

SEQ ID NO: 424182 - RNA, 19 nt, Homo sapiens
gaaauaugauccaucuuac

SEQ ID NO: 424183 - RNA, 19 nt, Homo sapiens
gcaaaucguauaccuuauu

SEQ ID NO: 424184 - RNA, 19 nt, Homo sapiens
gcaccugccucagcaauug

SEQ ID NO: 424185 - RNA, 19 nt, Homo sapiens
ccacauaauuggacucugu

SEQ ID NO: 424186 - RNA, 19 nt, Homo sapiens
ggaaggaggcggugacaga

SEQ ID NO: 424187 - RNA, 19 nt, Homo sapiens
guccaaggcuuuaucuuug

SEQ ID NO: 424188 - RNA, 19 nt, Homo sapiens
cgucagugcucagaaauuu

SEQ ID NO: 424189 - RNA, 19 nt, Homo sapiens
aagcaaaucguauaccuua

SEQ ID NO: 424190 - RNA, 19 nt, Homo sapiens
guccaugccuuuaauguug

SEQ ID NO: 424191 - RNA, 19 nt, Homo sapiens
ggaaugcacuuggaaacug

SEQ ID NO: 424192 - RNA, 19 nt, Homo sapiens
cagaaggugugcuacauug

SEQ ID NO: 424193 - RNA, 19 nt, Homo sapiens
ugagaaagcaaaucguaua

SEQ ID NO: 424194 - RNA, 19 nt, Homo sapiens
gaaagcaaaucguauaccu

SEQ ID NO: 424195 - RNA, 19 nt, Homo sapiens
gauguugguuaugguguua

SEQ ID NO: 424196 - RNA, 19 nt, Homo sapiens
gaggucacguguggaauuu

SEQ ID NO: 424197 - RNA, 19 nt, Homo sapiens
aggcuacaaucuucauuua

SEQ ID NO: 424198 - RNA, 19 nt, Homo sapiens
ucacgucagugcucagaaa

SEQ ID NO: 424199 - RNA, 19 nt, Homo sapiens
ggagaaagacuuccuugca

SEQ ID NO: 424200 - RNA, 19 nt, Homo sapiens
ccaguugccucuugaagug

SEQ ID NO: 424201 - RNA, 19 nt, Homo sapiens
gaaggaugguucauaucau

SEQ ID NO: 424202 - RNA, 19 nt, Homo sapiens
caucgcugcuggagaauga

SEQ ID NO: 424203 - RNA, 19 nt, Homo sapiens
ucaugaagauguugguuau

SEQ ID NO: 424204 - RNA, 19 nt, Homo sapiens
gacaaagacuaccugagau

SEQ ID NO: 424205 - RNA, 19 nt, Homo sapiens
ucauagugcucagauguuu

SEQ ID NO: 424206 - RNA, 19 nt, Homo sapiens
gaaugcacuuggaaacugu

SEQ ID NO: 424207 - RNA, 19 nt, Homo sapiens
ggaagagccaggacaugaa

SEQ ID NO: 424208 - RNA, 19 nt, Homo sapiens
gcacuuggaaacuguauuc

SEQ ID NO: 424209 - RNA, 19 nt, Homo sapiens
ggaaacugggaaucucaua

SEQ ID NO: 424210 - RNA, 19 nt, Homo sapiens
gaccaacgcacaacaggaa

SEQ ID NO: 424211 - RNA, 19 nt, Homo sapiens
gaagacaacucugaaaagu

SEQ ID NO: 424212 - RNA, 19 nt, Homo sapiens
aguuagagcugagcacuuu

SEQ ID NO: 424213 - RNA, 19 nt, Homo sapiens
cagcaauugucuacauuca

SEQ ID NO: 424214 - RNA, 19 nt, Homo sapiens
uaacuaaagcgaagagaca

SEQ ID NO: 424215 - RNA, 19 nt, Homo sapiens
gaucucagagcauuucaau

SEQ ID NO: 424216 - RNA, 19 nt, Homo sapiens
ucaccuguguuucguguau

SEQ ID NO: 424217 - RNA, 19 nt, Homo sapiens
ugagauguuugguuacaau

SEQ ID NO: 424218 - RNA, 19 nt, Homo sapiens
ggucaucggguaauuaauc

SEQ ID NO: 424219 - RNA, 19 nt, Homo sapiens
ggaauucaccuguguuucg

SEQ ID NO: 424220 - RNA, 19 nt, Homo sapiens
ccacgccaguugccucuug

SEQ ID NO: 424221 - RNA, 19 nt, Homo sapiens
uugcuuaucugaaaugcuu

SEQ ID NO: 424222 - RNA, 19 nt, Homo sapiens
ggaguucaguggugcaaac

SEQ ID NO: 424223 - RNA, 19 nt, Homo sapiens
ggaaauaaucaucuaagac

SEQ ID NO: 424224 - RNA, 19 nt, Homo sapiens
caaccagaaucaagauguc

SEQ ID NO: 424225 - RNA, 19 nt, Homo sapiens
gagcugagcacuuuugaaa

SEQ ID NO: 424226 - RNA, 19 nt, Homo sapiens
gggagucugugcauuugug

SEQ ID NO: 424227 - RNA, 19 nt, Homo sapiens
ggcccagaauacauaagua

SEQ ID NO: 424228 - RNA, 19 nt, Homo sapiens
acacagcucucuccacaac

SEQ ID NO: 424229 - RNA, 19 nt, Homo sapiens
ucacuacuuuguaucaauc

SEQ ID NO: 424230 - RNA, 19 nt, Homo sapiens
aagauacacugcagcugaa

SEQ ID NO: 424231 - RNA, 19 nt, Homo sapiens
uaucugaaaugcuugaaac

SEQ ID NO: 424232 - RNA, 19 nt, Homo sapiens
gagggucaucggguaauua

SEQ ID NO: 424233 - RNA, 19 nt, Homo sapiens
ccaccuugaccauaaauug

SEQ ID NO: 424234 - RNA, 19 nt, Homo sapiens
gaaaugcuugaaaccagaa

SEQ ID NO: 424235 - RNA, 19 nt, Homo sapiens
aaggaaauaugauccaucu

SEQ ID NO: 424236 - RNA, 19 nt, Homo sapiens
gaaacugggaaucucauag

SEQ ID NO: 424237 - RNA, 19 nt, Homo sapiens
ugagaucacuaaauaagcu

SEQ ID NO: 424238 - RNA, 19 nt, Homo sapiens
guucaguggugcaaacaca

SEQ ID NO: 424239 - RNA, 19 nt, Homo sapiens
gacauuacaauccugcauu

SEQ ID NO: 424240 - RNA, 19 nt, Homo sapiens
gcaauauaggccagacuug

SEQ ID NO: 424241 - RNA, 19 nt, Homo sapiens
ugagagcccacugcaguua

SEQ ID NO: 424242 - RNA, 19 nt, Homo sapiens
gaagagccaggacaugaag

SEQ ID NO: 424243 - RNA, 19 nt, Homo sapiens
ggacugaggaagcaauucu

SEQ ID NO: 424244 - RNA, 19 nt, Homo sapiens
aaggaugguucauaucaug

SEQ ID NO: 424245 - RNA, 19 nt, Homo sapiens
uagggucgcugcauaaacu

SEQ ID NO: 424246 - RNA, 19 nt, Homo sapiens
ccucagcaauugucuacau

SEQ ID NO: 424247 - RNA, 19 nt, Homo sapiens
gaauucaccuguguuucgu

SEQ ID NO: 424248 - RNA, 19 nt, Homo sapiens
ugaggcuucccacuauuua

SEQ ID NO: 424249 - RNA, 19 nt, Homo sapiens
caagaggaucugacugaga

SEQ ID NO: 424250 - RNA, 19 nt, Homo sapiens
acgcaacuguuucuacuuc

SEQ ID NO: 424251 - RNA, 19 nt, Homo sapiens
ccagaauuguuuugcauuu

SEQ ID NO: 424252 - RNA, 19 nt, Homo sapiens
aauccaggcuacaaucuuc

SEQ ID NO: 424253 - RNA, 19 nt, Homo sapiens
cgucugccuucuuuccuuu

SEQ ID NO: 424254 - RNA, 19 nt, Homo sapiens
gaagauggacauuuuagga

SEQ ID NO: 424255 - RNA, 19 nt, Homo sapiens
uauucuugcuucauucuga

SEQ ID NO: 424256 - RNA, 19 nt, Homo sapiens
uaauuggacucugucacaa

SEQ ID NO: 424257 - RNA, 19 nt, Homo sapiens
ccagaaggugugcuacauu

SEQ ID NO: 424258 - RNA, 19 nt, Homo sapiens
cgaggucacguguggaauu

SEQ ID NO: 424259 - RNA, 19 nt, Homo sapiens
gaaggugugcuacauugag

SEQ ID NO: 424260 - RNA, 19 nt, Homo sapiens
gucaagcccucgucuagag

SEQ ID NO: 424261 - RNA, 19 nt, Homo sapiens
gggagcggauggagaagca

SEQ ID NO: 424262 - RNA, 19 nt, Homo sapiens
uuucaggugugagauguaa

SEQ ID NO: 424263 - RNA, 19 nt, Homo sapiens
gguccaugccuuuaauguu

SEQ ID NO: 424264 - RNA, 19 nt, Homo sapiens
gcauaacgucugccuucuu

SEQ ID NO: 424265 - RNA, 19 nt, Homo sapiens
guaauuaaucuggccaaug

SEQ ID NO: 424266 - RNA, 19 nt, Homo sapiens
gccagaaggugugcuacau

SEQ ID NO: 424267 - RNA, 19 nt, Homo sapiens
aguccaaggcuuuaucuuu

SEQ ID NO: 424268 - RNA, 19 nt, Homo sapiens
gugggagucugugcauuug

SEQ ID NO: 424269 - RNA, 19 nt, Homo sapiens
gagaaagcaaaucguauac

SEQ ID NO: 424270 - RNA, 19 nt, Homo sapiens
gugaggcuucccacuauuu

SEQ ID NO: 424271 - RNA, 19 nt, Homo sapiens
ggaaauaugauccaucuua

SEQ ID NO: 424272 - RNA, 19 nt, Homo sapiens
ggagaaggaugguucauau

SEQ ID NO: 424273 - RNA, 19 nt, Homo sapiens
ggaaggaaauaaucaucua

SEQ ID NO: 424274 - RNA, 19 nt, Homo sapiens
uaauuaaucuggccaauga

SEQ ID NO: 424275 - RNA, 19 nt, Homo sapiens
ucucagagcauuucaauua

SEQ ID NO: 424276 - RNA, 19 nt, Homo sapiens
uaccugagaucacuaaaua

SEQ ID NO: 424277 - RNA, 19 nt, Homo sapiens
ggacaaagacuaccugaga

SEQ ID NO: 424278 - RNA, 19 nt, Homo sapiens
uaacccaccuugaccauaa

SEQ ID NO: 424279 - RNA, 19 nt, Homo sapiens
cauaacgucugccuucuuu

SEQ ID NO: 424280 - RNA, 19 nt, Homo sapiens
gaaacuguauucuggacaa

SEQ ID NO: 424281 - RNA, 19 nt, Homo sapiens
gcaauugucuacauucagu

SEQ ID NO: 424282 - RNA, 19 nt, Homo sapiens
guucaucgcugcuggagaa

SEQ ID NO: 424283 - RNA, 19 nt, Homo sapiens
gcaaaucguauaccuuauu

SEQ ID NO: 424284 - RNA, 19 nt, Homo sapiens
gcaccugccucagcaauug

SEQ ID NO: 424285 - RNA, 19 nt, Homo sapiens
ccacauaauuggacucugu

SEQ ID NO: 424286 - RNA, 19 nt, Homo sapiens
ggaaggaggcggugacaga

SEQ ID NO: 424287 - RNA, 19 nt, Homo sapiens
guccaaggcuuuaucuuug

SEQ ID NO: 424288 - RNA, 19 nt, Homo sapiens
cgucagugcucagaaauuu

SEQ ID NO: 424289 - RNA, 19 nt, Homo sapiens
aagcaaaucguauaccuua

SEQ ID NO: 424290 - RNA, 19 nt, Homo sapiens
guccaugccuuuaauguug

SEQ ID NO: 424291 - RNA, 19 nt, Homo sapiens
ggaaugcacuuggaaacug

SEQ ID NO: 424292 - RNA, 19 nt, Homo sapiens
cagaaggugugcuacauug

SEQ ID NO: 424293 - RNA, 19 nt, Homo sapiens
ugagaaagcaaaucguaua

SEQ ID NO: 424294 - RNA, 19 nt, Homo sapiens
gaaagcaaaucguauaccu

SEQ ID NO: 424295 - RNA, 19 nt, Homo sapiens
gauguugguuaugguguua

SEQ ID NO: 424296 - RNA, 19 nt, Homo sapiens
gaggucacguguggaauuu

SEQ ID NO: 424297 - RNA, 19 nt, Homo sapiens
aggcuacaaucuucauuua

SEQ ID NO: 424298 - RNA, 19 nt, Homo sapiens
ucacgucagugcucagaaa

SEQ ID NO: 424299 - RNA, 19 nt, Homo sapiens
uaugauccaucuuaacuga

SEQ ID NO: 424300 - RNA, 19 nt, Homo sapiens
ggagaaagacuuccuugca

SEQ ID NO: 424301 - RNA, 19 nt, Homo sapiens
ccaguugccucuugaagug

SEQ ID NO: 424302 - RNA, 19 nt, Homo sapiens
gaaggaugguucauaucau

SEQ ID NO: 424303 - RNA, 19 nt, Homo sapiens
caucgcugcuggagaauga

SEQ ID NO: 424304 - RNA, 19 nt, Homo sapiens
gcagaagccugagcucauc

SEQ ID NO: 424305 - RNA, 19 nt, Homo sapiens
ucaugaagauguugguuau

SEQ ID NO: 424306 - RNA, 19 nt, Homo sapiens
gacaaagacuaccugagau

SEQ ID NO: 424307 - RNA, 19 nt, Homo sapiens
ucauagugcucagauguuu

SEQ ID NO: 424308 - RNA, 19 nt, Homo sapiens
gaaugcacuuggaaacugu

SEQ ID NO: 424309 - RNA, 19 nt, Homo sapiens
ggaagagccaggacaugaa

SEQ ID NO: 424310 - RNA, 19 nt, Homo sapiens
gcacuuggaaacuguauuc

SEQ ID NO: 424311 - RNA, 19 nt, Homo sapiens
ggaaacugggaaucucaua

SEQ ID NO: 424312 - RNA, 19 nt, Homo sapiens
gaccaacgcacaacaggaa

SEQ ID NO: 424313 - RNA, 19 nt, Homo sapiens
gaagacaacucugaaaagu

SEQ ID NO: 424314 - RNA, 19 nt, Homo sapiens
aguuagagcugagcacuuu

SEQ ID NO: 424315 - RNA, 19 nt, Homo sapiens
cagcaauugucuacauuca

SEQ ID NO: 424316 - RNA, 19 nt, Homo sapiens
uaacuaaagcgaagagaca

SEQ ID NO: 424317 - RNA, 19 nt, Homo sapiens
ccucaacaauggcaaguuc

SEQ ID NO: 424318 - RNA, 19 nt, Homo sapiens
gaucucagagcauuucaau

SEQ ID NO: 424319 - RNA, 19 nt, Homo sapiens
ucaccuguguuucguguau

SEQ ID NO: 424320 - RNA, 19 nt, Homo sapiens
ugagauguuugguuacaau

SEQ ID NO: 424321 - RNA, 19 nt, Homo sapiens
ggucaucggguaauuaauc

SEQ ID NO: 424322 - RNA, 19 nt, Homo sapiens
ggaauucaccuguguuucg

SEQ ID NO: 424323 - RNA, 19 nt, Homo sapiens
ccacgccaguugccucuug

SEQ ID NO: 424324 - RNA, 19 nt, Homo sapiens
uugcuuaucugaaaugcuu

SEQ ID NO: 424325 - RNA, 19 nt, Homo sapiens
ggaguucaguggugcaaac

SEQ ID NO: 424326 - RNA, 19 nt, Homo sapiens
ggaaauaaucaucuaagac

SEQ ID NO: 424327 - RNA, 19 nt, Homo sapiens
caaccagaaucaagauguc

SEQ ID NO: 424328 - RNA, 19 nt, Homo sapiens
gagcugagcacuuuugaaa

SEQ ID NO: 424329 - RNA, 19 nt, Homo sapiens
ggcccagaauacauaagua

SEQ ID NO: 424330 - RNA, 19 nt, Homo sapiens
gggagucugugcauuugug

SEQ ID NO: 424331 - RNA, 19 nt, Homo sapiens
acacagcucucuccacaac

SEQ ID NO: 424332 - RNA, 19 nt, Homo sapiens
ucacuacuuuguaucaauc

SEQ ID NO: 424333 - RNA, 19 nt, Homo sapiens
ucaguguccucuucaacuu

SEQ ID NO: 424334 - RNA, 19 nt, Homo sapiens
aagauacacugcagcugaa

SEQ ID NO: 424335 - RNA, 19 nt, Homo sapiens
uaucugaaaugcuugaaac

SEQ ID NO: 424336 - RNA, 19 nt, Homo sapiens
gagggucaucggguaauua

SEQ ID NO: 424337 - RNA, 19 nt, Homo sapiens
ccaccuugaccauaaauug

SEQ ID NO: 424338 - RNA, 19 nt, Homo sapiens
gaaaugcuugaaaccagaa

SEQ ID NO: 424339 - RNA, 19 nt, Homo sapiens
aaggaaauaugauccaucu

SEQ ID NO: 424340 - RNA, 19 nt, Homo sapiens
gaaacugggaaucucauag

SEQ ID NO: 424341 - RNA, 19 nt, Homo sapiens
ugagaucacuaaauaagcu

SEQ ID NO: 424342 - RNA, 19 nt, Homo sapiens
guucaguggugcaaacaca

SEQ ID NO: 424343 - RNA, 19 nt, Homo sapiens
gacauuacaauccugcauu

SEQ ID NO: 424344 - RNA, 19 nt, Homo sapiens
gcaauauaggccagacuug

SEQ ID NO: 424345 - RNA, 19 nt, Homo sapiens
ugagagcccacugcaguua

SEQ ID NO: 424346 - RNA, 19 nt, Homo sapiens
ggacugaggaagcaauucu

SEQ ID NO: 424347 - RNA, 19 nt, Homo sapiens
gaagagccaggacaugaag

SEQ ID NO: 424348 - RNA, 19 nt, Homo sapiens
aaggaugguucauaucaug

SEQ ID NO: 424349 - RNA, 19 nt, Homo sapiens
uagggucgcugcauaaacu

SEQ ID NO: 424350 - RNA, 19 nt, Homo sapiens
ccucagcaauugucuacau

SEQ ID NO: 424351 - RNA, 19 nt, Homo sapiens
gaauucaccuguguuucgu

SEQ ID NO: 424352 - RNA, 19 nt, Homo sapiens
ugaggcuucccacuauuua

SEQ ID NO: 424353 - RNA, 19 nt, Homo sapiens
caagaggaucugacugaga

SEQ ID NO: 424354 - RNA, 19 nt, Homo sapiens
agaaggaugguucauauca

SEQ ID NO: 424355 - RNA, 19 nt, Homo sapiens
acgcaacuguuucuacuuc

SEQ ID NO: 424356 - RNA, 19 nt, Homo sapiens
ccagaauuguuuugcauuu

SEQ ID NO: 424357 - RNA, 19 nt, Homo sapiens
aauccaggcuacaaucuuc

SEQ ID NO: 424358 - RNA, 19 nt, Homo sapiens
cgucugccuucuuuccuuu

SEQ ID NO: 424359 - RNA, 19 nt, Homo sapiens
gaagauggacauuuuagga

SEQ ID NO: 424360 - RNA, 19 nt, Homo sapiens
uaauuggacucugucacaa

SEQ ID NO: 424361 - RNA, 19 nt, Homo sapiens
cgaggucacguguggaauu

SEQ ID NO: 424362 - RNA, 19 nt, Homo sapiens
gaaggugugcuacauugag

SEQ ID NO: 424363 - RNA, 19 nt, Homo sapiens
uuaucuugcuucauucuga

SEQ ID NO: 424364 - RNA, 19 nt, Homo sapiens
gucaagcccucgucuagag

SEQ ID NO: 424365 - RNA, 19 nt, Homo sapiens
gggagcggauggagaagca

SEQ ID NO: 424366 - RNA, 19 nt, Homo sapiens
ccagaaggugugcuacauu

SEQ ID NO: 424367 - RNA, 19 nt, Homo sapiens
gcagaaugugggugaguau

SEQ ID NO: 424368 - RNA, 19 nt, Homo sapiens
uuucaggugugagauguaa

SEQ ID NO: 424369 - RNA, 19 nt, Homo sapiens
guaauuaaucuggccaaug

SEQ ID NO: 424370 - RNA, 19 nt, Homo sapiens
gccagaaggugugcuacau

SEQ ID NO: 424371 - RNA, 19 nt, Homo sapiens
ggaaauaugauccaucuua

SEQ ID NO: 424372 - RNA, 19 nt, Homo sapiens
ggagaaggaugguucauau

SEQ ID NO: 424373 - RNA, 19 nt, Homo sapiens
ggaaggaaauaaucaucua

SEQ ID NO: 424374 - RNA, 19 nt, Homo sapiens
uaauuaaucuggccaauga

SEQ ID NO: 424375 - RNA, 19 nt, Homo sapiens
ucucagagcauuucaauua

SEQ ID NO: 424376 - RNA, 19 nt, Homo sapiens
uaccugagaucacuaaaua

SEQ ID NO: 424377 - RNA, 19 nt, Homo sapiens
ggacaaagacuaccugaga

SEQ ID NO: 424378 - RNA, 19 nt, Homo sapiens
uaacccaccuugaccauaa

SEQ ID NO: 424379 - RNA, 19 nt, Homo sapiens
guaaauaccuugaaaugcu

SEQ ID NO: 424380 - RNA, 19 nt, Homo sapiens
cauaacgucugccuucuuu

SEQ ID NO: 424381 - RNA, 19 nt, Homo sapiens
gaaacuguauucuggacaa

SEQ ID NO: 424382 - RNA, 19 nt, Homo sapiens
gcaauugucuacauucagu

SEQ ID NO: 424383 - RNA, 19 nt, Homo sapiens
guucaucgcugcuggagaa

SEQ ID NO: 424384 - RNA, 19 nt, Homo sapiens
gcaaaucguauaccuuauu

SEQ ID NO: 424385 - RNA, 19 nt, Homo sapiens
gcaccugccucagcaauug

SEQ ID NO: 424386 - RNA, 19 nt, Homo sapiens
ccacauaauuggacucugu

SEQ ID NO: 424387 - RNA, 19 nt, Homo sapiens
ggaaggaggcggugacaga

SEQ ID NO: 424388 - RNA, 19 nt, Homo sapiens
guccaaggcuuuaucuuug

SEQ ID NO: 424389 - RNA, 19 nt, Homo sapiens
cgucagugcucagaaauuu

SEQ ID NO: 424390 - RNA, 19 nt, Homo sapiens
aagcaaaucguauaccuua

SEQ ID NO: 424391 - RNA, 19 nt, Homo sapiens
guccaugccuuuaauguug

SEQ ID NO: 424392 - RNA, 19 nt, Homo sapiens
ggaaugcacuuggaaacug

SEQ ID NO: 424393 - RNA, 19 nt, Homo sapiens
cagaaggugugcuacauug

SEQ ID NO: 424394 - RNA, 19 nt, Homo sapiens
ugagaaagcaaaucguaua

SEQ ID NO: 424395 - RNA, 19 nt, Homo sapiens
gaaagcaaaucguauaccu

SEQ ID NO: 424396 - RNA, 19 nt, Homo sapiens
gauguugguuaugguguua

SEQ ID NO: 424397 - RNA, 19 nt, Homo sapiens
gaggucacguguggaauuu

SEQ ID NO: 424398 - RNA, 19 nt, Homo sapiens
aggcuacaaucuucauuua

SEQ ID NO: 424399 - RNA, 19 nt, Homo sapiens
ucacgucagugcucagaaa

SEQ ID NO: 424400 - RNA, 19 nt, Homo sapiens
uaugauccaucuuaacuga

SEQ ID NO: 424401 - RNA, 19 nt, Homo sapiens
ggagaaagacuuccuugca

SEQ ID NO: 424402 - RNA, 19 nt, Homo sapiens
ccaguugccucuugaagug

SEQ ID NO: 424403 - RNA, 19 nt, Homo sapiens
gggaguaagugguagaauc

SEQ ID NO: 424404 - RNA, 19 nt, Homo sapiens
gaaggaugguucauaucau

SEQ ID NO: 424405 - RNA, 19 nt, Homo sapiens
caucgcugcuggagaauga

SEQ ID NO: 424406 - RNA, 19 nt, Homo sapiens
ucaugaagauguugguuau

SEQ ID NO: 424407 - RNA, 19 nt, Homo sapiens
gacaaagacuaccugagau

SEQ ID NO: 424408 - RNA, 19 nt, Homo sapiens
ucauagugcucagauguuu

SEQ ID NO: 424409 - RNA, 19 nt, Homo sapiens
gaaugcacuuggaaacugu

SEQ ID NO: 424410 - RNA, 19 nt, Homo sapiens
ggaagagccaggacaugaa

SEQ ID NO: 424411 - RNA, 19 nt, Homo sapiens
ugaaaugcuuagacucuug

SEQ ID NO: 424412 - RNA, 19 nt, Homo sapiens
gcacuuggaaacuguauuc

SEQ ID NO: 424413 - RNA, 19 nt, Homo sapiens
caagcagcguggaagguaa

SEQ ID NO: 424414 - RNA, 19 nt, Homo sapiens
guagaauccuguacucucu

SEQ ID NO: 424415 - RNA, 19 nt, Homo sapiens
gagcaaggcuuuucacuac

SEQ ID NO: 424416 - RNA, 19 nt, Homo sapiens
ggaaacugggaaucucaua

SEQ ID NO: 424417 - RNA, 19 nt, Homo sapiens
gaccaacgcacaacaggaa

SEQ ID NO: 424418 - RNA, 19 nt, Homo sapiens
gaaaugcuuagacucuuga

SEQ ID NO: 424419 - RNA, 19 nt, Homo sapiens
gaagacaacucugaaaagu

SEQ ID NO: 424420 - RNA, 19 nt, Homo sapiens
agucuaaccugcgucauuu

SEQ ID NO: 424421 - RNA, 19 nt, Homo sapiens
aguuagagcugagcacuuu

SEQ ID NO: 424422 - RNA, 19 nt, Homo sapiens
cagcaauugucuacauuca

SEQ ID NO: 424423 - RNA, 19 nt, Homo sapiens
uaacuaaagcgaagagaca

SEQ ID NO: 424424 - RNA, 19 nt, Homo sapiens
gaucucagagcauuucaau

SEQ ID NO: 424425 - RNA, 19 nt, Homo sapiens
ucaccuguguuucguguau

SEQ ID NO: 424426 - RNA, 19 nt, Homo sapiens
ugagauguuugguuacaau

SEQ ID NO: 424427 - RNA, 19 nt, Homo sapiens
ggucaucggguaauuaauc

SEQ ID NO: 424428 - RNA, 19 nt, Homo sapiens
ggaauucaccuguguuucg

SEQ ID NO: 424429 - RNA, 19 nt, Homo sapiens
ccacgccaguugccucuug

SEQ ID NO: 424430 - RNA, 19 nt, Homo sapiens
gguaacacauccacauggu

SEQ ID NO: 424431 - RNA, 19 nt, Homo sapiens
ggcccagaauacauaagua

SEQ ID NO: 424432 - RNA, 19 nt, Homo sapiens
uugcuuaucugaaaugcuu

SEQ ID NO: 424433 - RNA, 19 nt, Homo sapiens
caaccagaaucaagauguc

SEQ ID NO: 424434 - RNA, 19 nt, Homo sapiens
ggaguucaguggugcaaac

SEQ ID NO: 424435 - RNA, 19 nt, Homo sapiens
ggaaauaaucaucuaagac

SEQ ID NO: 424436 - RNA, 19 nt, Homo sapiens
gagcugagcacuuuugaaa

SEQ ID NO: 424437 - RNA, 19 nt, Homo sapiens
cagagcagauuucgauuuu

SEQ ID NO: 424438 - RNA, 19 nt, Homo sapiens
uuucagcucuugcuucaga

SEQ ID NO: 424439 - RNA, 19 nt, Homo sapiens
cauuucagcucuugcuuca

SEQ ID NO: 424440 - RNA, 19 nt, Homo sapiens
gggagucugugcauuugug

SEQ ID NO: 424441 - RNA, 19 nt, Homo sapiens
acacagcucucuccacaac

SEQ ID NO: 424442 - RNA, 19 nt, Homo sapiens
ucacuacuuuguaucaauc

SEQ ID NO: 424443 - RNA, 19 nt, Homo sapiens
caguaaauaccuugaaaug

SEQ ID NO: 424444 - RNA, 19 nt, Homo sapiens
aagauacacugcagcugaa

SEQ ID NO: 424445 - RNA, 19 nt, Homo sapiens
uaucugaaaugcuugaaac

SEQ ID NO: 424446 - RNA, 19 nt, Homo sapiens
gagggucaucggguaauua

SEQ ID NO: 424447 - RNA, 19 nt, Homo sapiens
gagucuaaccugcgucauu

SEQ ID NO: 424448 - RNA, 19 nt, Homo sapiens
ccaccuugaccauaaauug

SEQ ID NO: 424449 - RNA, 19 nt, Homo sapiens
gaaaugcuugaaaccagaa

SEQ ID NO: 424450 - RNA, 19 nt, Homo sapiens
aaggaaauaugauccaucu

SEQ ID NO: 424451 - RNA, 19 nt, Homo sapiens
gaaacugggaaucucauag

SEQ ID NO: 424452 - RNA, 19 nt, Homo sapiens
ugagaucacuaaauaagcu

SEQ ID NO: 424453 - RNA, 19 nt, Homo sapiens
ccaagcagcguggaaggua

SEQ ID NO: 424454 - RNA, 19 nt, Homo sapiens
ucagagcagauuucgauuu

SEQ ID NO: 424455 - RNA, 19 nt, Homo sapiens
ggacugaggaagcaauucu

SEQ ID NO: 424456 - RNA, 19 nt, Homo sapiens
guucaguggugcaaacaca

SEQ ID NO: 424457 - RNA, 19 nt, Homo sapiens
gacauuacaauccugcauu

SEQ ID NO: 424458 - RNA, 19 nt, Homo sapiens
gcaauauaggccagacuug

SEQ ID NO: 424459 - RNA, 19 nt, Homo sapiens
ugagagcccacugcaguua

SEQ ID NO: 424460 - RNA, 19 nt, Homo sapiens
gaagagccaggacaugaag

SEQ ID NO: 424461 - RNA, 19 nt, Homo sapiens
gcacaggaguuuugggaau

SEQ ID NO: 424462 - RNA, 19 nt, Homo sapiens
aaggaugguucauaucaug

SEQ ID NO: 424463 - RNA, 19 nt, Homo sapiens
uagggucgcugcauaaacu

SEQ ID NO: 424464 - RNA, 19 nt, Homo sapiens
ccucagcaauugucuacau

SEQ ID NO: 424465 - RNA, 19 nt, Homo sapiens
gaauucaccuguguuucgu

SEQ ID NO: 424466 - RNA, 19 nt, Homo sapiens
ugaggcuucccacuauuua

SEQ ID NO: 424467 - RNA, 19 nt, Homo sapiens
caagaggaucugacugaga

SEQ ID NO: 424468 - RNA, 19 nt, Homo sapiens
agaaggaugguucauauca

SEQ ID NO: 424469 - RNA, 19 nt, Homo sapiens
acgcaacuguuucuacuuc

SEQ ID NO: 424470 - RNA, 19 nt, Homo sapiens
ccagaauuguuuugcauuu

SEQ ID NO: 424471 - RNA, 19 nt, Homo sapiens
ggaaauaugauccaucuua

SEQ ID NO: 424472 - RNA, 19 nt, Homo sapiens
ggaaggaaauaaucaucua

SEQ ID NO: 424473 - RNA, 19 nt, Homo sapiens
uaauuaaucuggccaauga

SEQ ID NO: 424474 - RNA, 19 nt, Homo sapiens
ucucagagcauuucaauua

SEQ ID NO: 424475 - RNA, 19 nt, Homo sapiens
uaccugagaucacuaaaua

SEQ ID NO: 424476 - RNA, 19 nt, Homo sapiens
ggacaaagacuaccugaga

SEQ ID NO: 424477 - RNA, 19 nt, Homo sapiens
uaacccaccuugaccauaa

SEQ ID NO: 424478 - RNA, 19 nt, Homo sapiens
guaaauaccuugaaaugcu

SEQ ID NO: 424479 - RNA, 19 nt, Homo sapiens
cauaacgucugccuucuuu

SEQ ID NO: 424480 - RNA, 19 nt, Homo sapiens
gaaacuguauucuggacaa

SEQ ID NO: 424481 - RNA, 19 nt, Homo sapiens
gcaauugucuacauucagu

SEQ ID NO: 424482 - RNA, 19 nt, Homo sapiens
guucaucgcugcuggagaa

SEQ ID NO: 424483 - RNA, 19 nt, Homo sapiens
gcaaaucguauaccuuauu

SEQ ID NO: 424484 - RNA, 19 nt, Homo sapiens
gcaccugccucagcaauug

SEQ ID NO: 424485 - RNA, 19 nt, Homo sapiens
ccacauaauuggacucugu

SEQ ID NO: 424486 - RNA, 19 nt, Homo sapiens
ggaaggaggcggugacaga

SEQ ID NO: 424487 - RNA, 19 nt, Homo sapiens
guccaaggcuuuaucuuug

SEQ ID NO: 424488 - RNA, 19 nt, Homo sapiens
cgucagugcucagaaauuu

SEQ ID NO: 424489 - RNA, 19 nt, Homo sapiens
aagcaaaucguauaccuua

SEQ ID NO: 424490 - RNA, 19 nt, Homo sapiens
guccaugccuuuaauguug

SEQ ID NO: 424491 - RNA, 19 nt, Homo sapiens
ggaaugcacuuggaaacug

SEQ ID NO: 424492 - RNA, 19 nt, Homo sapiens
cagaaggugugcuacauug

SEQ ID NO: 424493 - RNA, 19 nt, Homo sapiens
ugagaaagcaaaucguaua

SEQ ID NO: 424494 - RNA, 19 nt, Homo sapiens
gaaagcaaaucguauaccu

SEQ ID NO: 424495 - RNA, 19 nt, Homo sapiens
gauguugguuaugguguua

SEQ ID NO: 424496 - RNA, 19 nt, Homo sapiens
gaggucacguguggaauuu

SEQ ID NO: 424497 - RNA, 19 nt, Homo sapiens
aggcuacaaucuucauuua

SEQ ID NO: 424498 - RNA, 19 nt, Homo sapiens
ucacgucagugcucagaaa

SEQ ID NO: 424499 - RNA, 19 nt, Homo sapiens
uaugauccaucuuaacuga

SEQ ID NO: 424500 - RNA, 19 nt, Homo sapiens
ggagaaagacuuccuugca

SEQ ID NO: 424501 - RNA, 19 nt, Homo sapiens
ccaguugccucuugaagug

SEQ ID NO: 424502 - RNA, 19 nt, Homo sapiens
gggaguaagugguagaauc

SEQ ID NO: 424503 - RNA, 19 nt, Homo sapiens
gaaggaugguucauaucau

SEQ ID NO: 424504 - RNA, 19 nt, Homo sapiens
caucgcugcuggagaauga

SEQ ID NO: 424505 - RNA, 19 nt, Homo sapiens
ucaugaagauguugguuau

SEQ ID NO: 424506 - RNA, 19 nt, Homo sapiens
gacaaagacuaccugagau

SEQ ID NO: 424507 - RNA, 19 nt, Homo sapiens
ucauagugcucagauguuu

SEQ ID NO: 424508 - RNA, 19 nt, Homo sapiens
gaaugcacuuggaaacugu

SEQ ID NO: 424509 - RNA, 19 nt, Homo sapiens
ggaagagccaggacaugaa

SEQ ID NO: 424510 - RNA, 19 nt, Homo sapiens
ugaaaugcuuagacucuug

SEQ ID NO: 424511 - RNA, 19 nt, Homo sapiens
gcacuuggaaacuguauuc

SEQ ID NO: 424512 - RNA, 19 nt, Homo sapiens
guagaauccuguacucucu

SEQ ID NO: 424513 - RNA, 19 nt, Homo sapiens
gagcaaggcuuuucacuac

SEQ ID NO: 424514 - RNA, 19 nt, Homo sapiens
ggaaacugggaaucucaua

SEQ ID NO: 424515 - RNA, 19 nt, Homo sapiens
gaccaacgcacaacaggaa

SEQ ID NO: 424516 - RNA, 19 nt, Homo sapiens
gaaaugcuuagacucuuga

SEQ ID NO: 424517 - RNA, 19 nt, Homo sapiens
gaagacaacucugaaaagu

SEQ ID NO: 424518 - RNA, 19 nt, Homo sapiens
aguuagagcugagcacuuu

SEQ ID NO: 424519 - RNA, 19 nt, Homo sapiens
cagcaauugucuacauuca

SEQ ID NO: 424520 - RNA, 19 nt, Homo sapiens
uaacuaaagcgaagagaca

SEQ ID NO: 424521 - RNA, 19 nt, Homo sapiens
gaucucagagcauuucaau

SEQ ID NO: 424522 - RNA, 19 nt, Homo sapiens
ucaccuguguuucguguau

SEQ ID NO: 424523 - RNA, 19 nt, Homo sapiens
ugagauguuugguuacaau

SEQ ID NO: 424524 - RNA, 19 nt, Homo sapiens
ggucaucggguaauuaauc

SEQ ID NO: 424525 - RNA, 19 nt, Homo sapiens
ggaauucaccuguguuucg

SEQ ID NO: 424526 - RNA, 19 nt, Homo sapiens
ccacgccaguugccucuug

SEQ ID NO: 424527 - RNA, 19 nt, Homo sapiens
uugcuuaucugaaaugcuu

SEQ ID NO: 424528 - RNA, 19 nt, Homo sapiens
ggaguucaguggugcaaac

SEQ ID NO: 424529 - RNA, 19 nt, Homo sapiens
ggcccagaauacauaagua

SEQ ID NO: 424530 - RNA, 19 nt, Homo sapiens
ggaaauaaucaucuaagac

SEQ ID NO: 424531 - RNA, 19 nt, Homo sapiens
caaccagaaucaagauguc

SEQ ID NO: 424532 - RNA, 19 nt, Homo sapiens
gagcugagcacuuuugaaa

SEQ ID NO: 424533 - RNA, 19 nt, Homo sapiens
gggagucugugcauuugug

SEQ ID NO: 424534 - RNA, 19 nt, Homo sapiens
acacagcucucuccacaac

SEQ ID NO: 424535 - RNA, 19 nt, Homo sapiens
ucacuacuuuguaucaauc

SEQ ID NO: 424536 - RNA, 19 nt, Homo sapiens
caguaaauaccuugaaaug

SEQ ID NO: 424537 - RNA, 19 nt, Homo sapiens
aagauacacugcagcugaa

SEQ ID NO: 424538 - RNA, 19 nt, Homo sapiens
uaucugaaaugcuugaaac

SEQ ID NO: 424539 - RNA, 19 nt, Homo sapiens
gagggucaucggguaauua

SEQ ID NO: 424540 - RNA, 19 nt, Homo sapiens
ccaccuugaccauaaauug

SEQ ID NO: 424541 - RNA, 19 nt, Homo sapiens
gaaaugcuugaaaccagaa

SEQ ID NO: 424542 - RNA, 19 nt, Homo sapiens
aaggaaauaugauccaucu

SEQ ID NO: 424543 - RNA, 19 nt, Homo sapiens
gaaacugggaaucucauag

SEQ ID NO: 424544 - RNA, 19 nt, Homo sapiens
ugagaucacuaaauaagcu

SEQ ID NO: 424545 - RNA, 19 nt, Homo sapiens
guucaguggugcaaacaca

SEQ ID NO: 424546 - RNA, 19 nt, Homo sapiens
gacauuacaauccugcauu

SEQ ID NO: 424547 - RNA, 19 nt, Homo sapiens
gcaauauaggccagacuug

SEQ ID NO: 424548 - RNA, 19 nt, Homo sapiens
ugagagcccacugcaguua

SEQ ID NO: 424549 - RNA, 19 nt, Homo sapiens
ggacugaggaagcaauucu

SEQ ID NO: 424550 - RNA, 19 nt, Homo sapiens
gaagagccaggacaugaag

SEQ ID NO: 424551 - RNA, 19 nt, Homo sapiens
gcacaggaguuuugggaau

SEQ ID NO: 424552 - RNA, 19 nt, Homo sapiens
aaggaugguucauaucaug

SEQ ID NO: 424553 - RNA, 19 nt, Homo sapiens
uagggucgcugcauaaacu

SEQ ID NO: 424554 - RNA, 19 nt, Homo sapiens
ccucagcaauugucuacau

SEQ ID NO: 424555 - RNA, 19 nt, Homo sapiens
gaauucaccuguguuucgu

SEQ ID NO: 424556 - RNA, 19 nt, Homo sapiens
ugaggcuucccacuauuua

SEQ ID NO: 424557 - RNA, 19 nt, Homo sapiens
caagaggaucugacugaga

SEQ ID NO: 424558 - RNA, 19 nt, Homo sapiens
acgcaacuguuucuacuuc

SEQ ID NO: 424559 - RNA, 19 nt, Homo sapiens
ccagaauuguuuugcauuu

SEQ ID NO: 424560 - RNA, 19 nt, Homo sapiens
aauccaggcuacaaucuuc

SEQ ID NO: 424561 - RNA, 19 nt, Homo sapiens
cgucugccuucuuuccuuu

SEQ ID NO: 424562 - RNA, 19 nt, Homo sapiens
gaagauggacauuuuagga

SEQ ID NO: 424563 - RNA, 19 nt, Homo sapiens
uaauuggacucugucacaa

SEQ ID NO: 424564 - RNA, 19 nt, Homo sapiens
cgaggucacguguggaauu

SEQ ID NO: 424565 - RNA, 19 nt, Homo sapiens
uuaucuugcuucauucuga

SEQ ID NO: 424566 - RNA, 19 nt, Homo sapiens
gucaagcccucgucuagag

SEQ ID NO: 424567 - RNA, 19 nt, Homo sapiens
gaaggugugcuacauugag

SEQ ID NO: 424568 - RNA, 19 nt, Homo sapiens
gggagcggauggagaagca

SEQ ID NO: 424569 - RNA, 19 nt, Homo sapiens
ccagaaggugugcuacauu

SEQ ID NO: 424570 - RNA, 19 nt, Homo sapiens
uuucaggugugagauguaa

SEQ ID NO: 424571 - RNA, 19 nt, Homo sapiens
gcacggagauguugcagua

SEQ ID NO: 424572 - RNA, 19 nt, Homo sapiens
gaaggagccugcuuuggua

SEQ ID NO: 424573 - RNA, 19 nt, Homo sapiens
gcaaagaacaucauccaua

SEQ ID NO: 424574 - RNA, 19 nt, Homo sapiens
gacaugaaauccaacaaua

SEQ ID NO: 424575 - RNA, 19 nt, Homo sapiens
ggaaugagcuugcaugacu

SEQ ID NO: 424576 - RNA, 19 nt, Homo sapiens
caugaaggcuuaacaguga

SEQ ID NO: 424577 - RNA, 19 nt, Homo sapiens
caaagaacaucauccauag

SEQ ID NO: 424578 - RNA, 19 nt, Homo sapiens
gauggucccucaauuaugu

SEQ ID NO: 424579 - RNA, 19 nt, Homo sapiens
uaacaucagacaacucuua

SEQ ID NO: 424580 - RNA, 19 nt, Homo sapiens
gcacuaccuucuuugacua

SEQ ID NO: 424581 - RNA, 19 nt, Homo sapiens
ggaaugagguggcuguucu

SEQ ID NO: 424582 - RNA, 19 nt, Homo sapiens
gauaacaacccauucaguu

SEQ ID NO: 424583 - RNA, 19 nt, Homo sapiens
ggaaauagaagccagugaa

SEQ ID NO: 424584 - RNA, 19 nt, Homo sapiens
gcuguuggcuacaugagua

SEQ ID NO: 424585 - RNA, 19 nt, Homo sapiens
cugcaucucuccuacaaua

SEQ ID NO: 424586 - RNA, 19 nt, Homo sapiens
acagagagauucaagcuau

SEQ ID NO: 424587 - RNA, 19 nt, Homo sapiens
ucaaguagauuuccuggau

SEQ ID NO: 424588 - RNA, 19 nt, Homo sapiens
gcaaguggauguugauggu

SEQ ID NO: 424589 - RNA, 19 nt, Homo sapiens
ggacuggaguaacaucaga

SEQ ID NO: 424590 - RNA, 19 nt, Homo sapiens
ggagcagucuuccaucaug

SEQ ID NO: 424591 - RNA, 19 nt, Homo sapiens
ccucacgccuucaccuuua

SEQ ID NO: 424592 - RNA, 19 nt, Homo sapiens
gcacauaaggcaccaaaca

SEQ ID NO: 424593 - RNA, 19 nt, Homo sapiens
aaagaacaguggucaaugu

SEQ ID NO: 424594 - RNA, 19 nt, Homo sapiens
auucaaagaugccguguuu

SEQ ID NO: 424595 - RNA, 19 nt, Homo sapiens
ggaagacgaucagcaaugg

SEQ ID NO: 424596 - RNA, 19 nt, Homo sapiens
ugaagaaaguaaaggaaga

SEQ ID NO: 424597 - RNA, 19 nt, Homo sapiens
gcagcagccucuacaaaca

SEQ ID NO: 424598 - RNA, 19 nt, Homo sapiens
gcagacggcucagggaaug

SEQ ID NO: 424599 - RNA, 19 nt, Homo sapiens
ggauuucgaugucagacuu

SEQ ID NO: 424600 - RNA, 19 nt, Homo sapiens
gcaaagaacaguggucaau

SEQ ID NO: 424601 - RNA, 19 nt, Homo sapiens
gagauucaagcuauuauug

SEQ ID NO: 424602 - RNA, 19 nt, Homo sapiens
uugcaugacugccuuauga

SEQ ID NO: 424603 - RNA, 19 nt, Homo sapiens
caucagacaacucuuauug

SEQ ID NO: 424604 - RNA, 19 nt, Homo sapiens
uacaauaguucagcaguuu

SEQ ID NO: 424605 - RNA, 19 nt, Homo sapiens
gaaauggaaugagcuugca

SEQ ID NO: 424606 - RNA, 19 nt, Homo sapiens
gcaaggcacucggccaauc

SEQ ID NO: 424607 - RNA, 19 nt, Homo sapiens
uuucagauguuccagcuaa

SEQ ID NO: 424608 - RNA, 19 nt, Homo sapiens
guucagacuucuccacgaa

SEQ ID NO: 424609 - RNA, 19 nt, Homo sapiens
caucauguguauacaagga

SEQ ID NO: 424610 - RNA, 19 nt, Homo sapiens
ccuauggcaucguauugua

SEQ ID NO: 424611 - RNA, 19 nt, Homo sapiens
gagaccaaguuucagaugu

SEQ ID NO: 424612 - RNA, 19 nt, Homo sapiens
caguaaagauccuaaaggu

SEQ ID NO: 424613 - RNA, 19 nt, Homo sapiens
gagagucuguuuccaggau

SEQ ID NO: 424614 - RNA, 19 nt, Homo sapiens
ucacagggccuuaacuuca

SEQ ID NO: 424615 - RNA, 19 nt, Homo sapiens
agaaauuccugcucaaugg

SEQ ID NO: 424616 - RNA, 19 nt, Homo sapiens
gaugcugcgucuuugauug

SEQ ID NO: 424617 - RNA, 19 nt, Homo sapiens
uguuuaagcugcaucaaug

SEQ ID NO: 424618 - RNA, 19 nt, Homo sapiens
agaccaaguuucagauguu

SEQ ID NO: 424619 - RNA, 19 nt, Homo sapiens
uaacaacccauucaguuuc

SEQ ID NO: 424620 - RNA, 19 nt, Homo sapiens
caucauccauagagacaug

SEQ ID NO: 424621 - RNA, 19 nt, Homo sapiens
gaacuguuuauaaggguaa

SEQ ID NO: 424622 - RNA, 19 nt, Homo sapiens
gcacuguagcaccaaagua

SEQ ID NO: 424623 - RNA, 19 nt, Homo sapiens
cuacaauaguucagcaguu

SEQ ID NO: 424624 - RNA, 19 nt, Homo sapiens
cuacuccuauggcaucgua

SEQ ID NO: 424625 - RNA, 19 nt, Homo sapiens
cgaaucagccucaccuuca

SEQ ID NO: 424626 - RNA, 19 nt, Homo sapiens
ucugauggucccucaauua

SEQ ID NO: 424627 - RNA, 19 nt, Homo sapiens
gauccugucuuccauugag

SEQ ID NO: 424628 - RNA, 19 nt, Homo sapiens
auagagacaugaaauccaa

SEQ ID NO: 424629 - RNA, 19 nt, Homo sapiens
uaaagauccuaaagguugu

SEQ ID NO: 424630 - RNA, 19 nt, Homo sapiens
gaaauagaagccagugaag

SEQ ID NO: 424631 - RNA, 19 nt, Homo sapiens
caacucuuauuguuuccaa

SEQ ID NO: 424632 - RNA, 19 nt, Homo sapiens
ccucacaacacacaacuuu

SEQ ID NO: 424633 - RNA, 19 nt, Homo sapiens
ucacagauccuucuaagac

SEQ ID NO: 424634 - RNA, 19 nt, Homo sapiens
ggagccugcuuugguacua

SEQ ID NO: 424635 - RNA, 19 nt, Homo sapiens
cgaaggagccugcuuuggu

SEQ ID NO: 424636 - RNA, 19 nt, Homo sapiens
cguauuguaugaacugaug

SEQ ID NO: 424637 - RNA, 19 nt, Homo sapiens
gcaugacugccuuaugaaa

SEQ ID NO: 424638 - RNA, 19 nt, Homo sapiens
cagauccugucuuccauug

SEQ ID NO: 424639 - RNA, 19 nt, Homo sapiens
gggcagcagccucuacaaa

SEQ ID NO: 424640 - RNA, 19 nt, Homo sapiens
guaaauggcacggagaugu

SEQ ID NO: 424641 - RNA, 19 nt, Homo sapiens
ucccagcacuaccuucuuu

SEQ ID NO: 424642 - RNA, 19 nt, Homo sapiens
ggaguaacaucagacaacu

SEQ ID NO: 424643 - RNA, 19 nt, Homo sapiens
caggagcagucuuccauca

SEQ ID NO: 424644 - RNA, 19 nt, Homo sapiens
ucccucagguuuaagaauu

SEQ ID NO: 424645 - RNA, 19 nt, Homo sapiens
cagagagauucaagcuauu

SEQ ID NO: 424646 - RNA, 19 nt, Homo sapiens
ggacagagagauucaagcu

SEQ ID NO: 424647 - RNA, 19 nt, Homo sapiens
caaauuucaugagcacugu

SEQ ID NO: 424648 - RNA, 19 nt, Homo sapiens
uagauuuccuggaucaugu

SEQ ID NO: 424649 - RNA, 19 nt, Homo sapiens
ccagagugcugugcagugu

SEQ ID NO: 424650 - RNA, 19 nt, Homo sapiens
guagcugacugugugaaga

SEQ ID NO: 424651 - RNA, 19 nt, Homo sapiens
uaaauggcacggagauguu

SEQ ID NO: 424652 - RNA, 19 nt, Homo sapiens
agagagauucaagcuauua

SEQ ID NO: 424653 - RNA, 19 nt, Homo sapiens
gaaauuccugcucaaugga

SEQ ID NO: 424654 - RNA, 19 nt, Homo sapiens
ccacgaacacaaagguaaa

SEQ ID NO: 424655 - RNA, 19 nt, Homo sapiens
gcucacagggccuuaacuu

SEQ ID NO: 424656 - RNA, 19 nt, Homo sapiens
agucggaugucuacuccua

SEQ ID NO: 424657 - RNA, 19 nt, Homo sapiens
cucagggaauggacuauuu

SEQ ID NO: 424658 - RNA, 19 nt, Homo sapiens
gaccaaguuucagauguuc

SEQ ID NO: 424659 - RNA, 19 nt, Homo sapiens
auacugaugcugcgucuuu

SEQ ID NO: 424660 - RNA, 19 nt, Homo sapiens
uaagguguccagugcauug

SEQ ID NO: 424661 - RNA, 19 nt, Homo sapiens
ggauguugaugguaguaca

SEQ ID NO: 424662 - RNA, 19 nt, Homo sapiens
aaagaugccguguuugaug

SEQ ID NO: 424663 - RNA, 19 nt, Homo sapiens
gcaguaaagauccuaaagg

SEQ ID NO: 424664 - RNA, 19 nt, Homo sapiens
acggagauguugcaguaaa

SEQ ID NO: 424665 - RNA, 19 nt, Homo sapiens
guggacagcaggaugauug

SEQ ID NO: 424666 - RNA, 19 nt, Homo sapiens
ccagacauuuugcacauaa

SEQ ID NO: 424667 - RNA, 19 nt, Homo sapiens
gggagaaggaagccauuug

SEQ ID NO: 424668 - RNA, 19 nt, Homo sapiens
gagcuuccuuauucucaca

SEQ ID NO: 424669 - RNA, 19 nt, Homo sapiens
gggaauggacuauuugcau

SEQ ID NO: 424670 - RNA, 19 nt, Homo sapiens
caucucuccuacaauaguu

SEQ ID NO: 424671 - RNA, 19 nt, Homo sapiens
gcagaagaguuaacauuua

SEQ ID NO: 424672 - RNA, 19 nt, Homo sapiens
gcagacaucucaacacuuu

SEQ ID NO: 424673 - RNA, 19 nt, Homo sapiens
ccaaauaccuccagaaguu

SEQ ID NO: 424674 - RNA, 19 nt, Homo sapiens
gaagagcagugaauuaaug

SEQ ID NO: 424675 - RNA, 19 nt, Homo sapiens
gcaaggaugucaugaagaa

SEQ ID NO: 424676 - RNA, 19 nt, Homo sapiens
gcaugucucugcacuaaua

SEQ ID NO: 424677 - RNA, 19 nt, Homo sapiens
gcaaagagguuccgcuaug

SEQ ID NO: 424678 - RNA, 19 nt, Homo sapiens
uaucuuggcuugcuauaua

SEQ ID NO: 424679 - RNA, 19 nt, Homo sapiens
gaauugcacuucaguuuau

SEQ ID NO: 424680 - RNA, 19 nt, Homo sapiens
gcaggaauuucaauaugua

SEQ ID NO: 424681 - RNA, 19 nt, Homo sapiens
gcaaagaucuguguguguu

SEQ ID NO: 424682 - RNA, 19 nt, Homo sapiens
gauggaagauguccugaaa

SEQ ID NO: 424683 - RNA, 19 nt, Homo sapiens
gcacaugaccuugggauua

SEQ ID NO: 424684 - RNA, 19 nt, Homo sapiens
ggaugcaguuugugaguua

SEQ ID NO: 424685 - RNA, 19 nt, Homo sapiens
ggaagaagaugaaccucaa

SEQ ID NO: 424686 - RNA, 19 nt, Homo sapiens
gcacccacauauuaaauuu

SEQ ID NO: 424687 - RNA, 19 nt, Homo sapiens
gaggaugaauggcaacuuu

SEQ ID NO: 424688 - RNA, 19 nt, Homo sapiens
gagugugggucuugcauua

SEQ ID NO: 424689 - RNA, 19 nt, Homo sapiens
gaaggagucuugugaugga

SEQ ID NO: 424690 - RNA, 19 nt, Homo sapiens
ggaguaagaugcuacagau

SEQ ID NO: 424691 - RNA, 19 nt, Homo sapiens
gcaaugaggaggucaguuu

SEQ ID NO: 424692 - RNA, 19 nt, Homo sapiens
ugacuaagagcaugauuua

SEQ ID NO: 424693 - RNA, 19 nt, Homo sapiens
gcuaugagauggaagaugu

SEQ ID NO: 424694 - RNA, 19 nt, Homo sapiens
gcacugauguuggcauuau

SEQ ID NO: 424695 - RNA, 19 nt, Homo sapiens
gcacaaccuuuccaauaau

SEQ ID NO: 424696 - RNA, 19 nt, Homo sapiens
gaccagagaugagcaaaga

SEQ ID NO: 424697 - RNA, 19 nt, Homo sapiens
gacagaugauguauucuuu

SEQ ID NO: 424698 - RNA, 19 nt, Homo sapiens
gauaauggcugaugaaaau

SEQ ID NO: 424699 - RNA, 19 nt, Homo sapiens
acuaugaucugcauccuua

SEQ ID NO: 424700 - RNA, 19 nt, Homo sapiens
gaaauucagcacccacaua

SEQ ID NO: 424701 - RNA, 19 nt, Homo sapiens
ccaggaagcucaugaccaa

SEQ ID NO: 424702 - RNA, 19 nt, Homo sapiens
gcugauugcuugaggcuuu

SEQ ID NO: 424703 - RNA, 19 nt, Homo sapiens
caaagaaauuucacgacaa

SEQ ID NO: 424704 - RNA, 19 nt, Homo sapiens
gcaaauaugugugugucuu

SEQ ID NO: 424705 - RNA, 19 nt, Homo sapiens
uaauaaacaugcacugaga

SEQ ID NO: 424706 - RNA, 19 nt, Homo sapiens
caacucagccauuguuaaa

SEQ ID NO: 424707 - RNA, 19 nt, Homo sapiens
ggucuugcauuacaucaaa

SEQ ID NO: 424708 - RNA, 19 nt, Homo sapiens
gaacucaguaucuuucauu

SEQ ID NO: 424709 - RNA, 19 nt, Homo sapiens
auacuuggcuuggaaauuu

SEQ ID NO: 424710 - RNA, 19 nt, Homo sapiens
ggaaaugagucugguaaca

SEQ ID NO: 424711 - RNA, 19 nt, Homo sapiens
cugagaaccuggaacguua

SEQ ID NO: 424712 - RNA, 19 nt, Homo sapiens
ccagugaaguccuuucuga

SEQ ID NO: 424713 - RNA, 19 nt, Homo sapiens
ccacugaguucugccauaa

SEQ ID NO: 424714 - RNA, 19 nt, Homo sapiens
cagcaugucucugcacuaa

SEQ ID NO: 424715 - RNA, 19 nt, Homo sapiens
gagcaggcauggaauuuua

SEQ ID NO: 424716 - RNA, 19 nt, Homo sapiens
gcccacagcucucagaaug

SEQ ID NO: 424717 - RNA, 19 nt, Homo sapiens
uagguuagcuugaugucua

SEQ ID NO: 424718 - RNA, 19 nt, Homo sapiens
cuacgaaguucaaguauag

SEQ ID NO: 424719 - RNA, 19 nt, Homo sapiens
caaagagguuccgcuauga

SEQ ID NO: 424720 - RNA, 19 nt, Homo sapiens
uaugacagaugauguauuc

SEQ ID NO: 424721 - RNA, 19 nt, Homo sapiens
gauaagugccuucuauuuc

SEQ ID NO: 424722 - RNA, 19 nt, Homo sapiens
uagcacaaccuuuccaaua

SEQ ID NO: 424723 - RNA, 19 nt, Homo sapiens
gaguagguguuguuauuau

SEQ ID NO: 424724 - RNA, 19 nt, Homo sapiens
caucugcugucauggauuu

SEQ ID NO: 424725 - RNA, 19 nt, Homo sapiens
gaaaugagucugguaacaa

SEQ ID NO: 424726 - RNA, 19 nt, Homo sapiens
gcacuccacugugacauug

SEQ ID NO: 424727 - RNA, 19 nt, Homo sapiens
gaggucaucugcugucaug

SEQ ID NO: 424728 - RNA, 19 nt, Homo sapiens
cagcuaaaccuuucauuga

SEQ ID NO: 424729 - RNA, 19 nt, Homo sapiens
gcagugaauuaaugcuuga

SEQ ID NO: 424730 - RNA, 19 nt, Homo sapiens
ugaagaagaucgccaacug

SEQ ID NO: 424731 - RNA, 19 nt, Homo sapiens
gauaagaggcaggauauau

SEQ ID NO: 424732 - RNA, 19 nt, Homo sapiens
gagcagagaacacacuuug

SEQ ID NO: 424733 - RNA, 19 nt, Homo sapiens
aaagugcucucaaugcauu

SEQ ID NO: 424734 - RNA, 19 nt, Homo sapiens
aaaugagucugguaacaaa

SEQ ID NO: 424735 - RNA, 19 nt, Homo sapiens
uaagaggcaggauauauaa

SEQ ID NO: 424736 - RNA, 19 nt, Homo sapiens
gauaaacccugggaacauc

SEQ ID NO: 424737 - RNA, 19 nt, Homo sapiens
gaaauuggucuugugguuu

SEQ ID NO: 424738 - RNA, 19 nt, Homo sapiens
gcuaaaccuuucauugaga

SEQ ID NO: 424739 - RNA, 19 nt, Homo sapiens
caggugaacuggaauuuag

SEQ ID NO: 424740 - RNA, 19 nt, Homo sapiens
ggauugaacucaguaucuu

SEQ ID NO: 424741 - RNA, 19 nt, Homo sapiens
ggaguagguguuguuauua

SEQ ID NO: 424742 - RNA, 19 nt, Homo sapiens
uaucagaagccaaguauga

SEQ ID NO: 424743 - RNA, 19 nt, Homo sapiens
uagaugcacuccacuguga

SEQ ID NO: 424744 - RNA, 19 nt, Homo sapiens
gacagucccuuccauagau

SEQ ID NO: 424745 - RNA, 19 nt, Homo sapiens
cuaagagcaugauuuauag

SEQ ID NO: 424746 - RNA, 19 nt, Homo sapiens
caccacaaauuaaucacua

SEQ ID NO: 424747 - RNA, 19 nt, Homo sapiens
caacaauucugaggaguag

SEQ ID NO: 424748 - RNA, 19 nt, Homo sapiens
gaacacacuuugccuucuc

SEQ ID NO: 424749 - RNA, 19 nt, Homo sapiens
caaaugcuaugagauggaa

SEQ ID NO: 424750 - RNA, 19 nt, Homo sapiens
gcuaaagagugcccagaau

SEQ ID NO: 424751 - RNA, 19 nt, Homo sapiens
ugaauucccugauggugaa

SEQ ID NO: 424752 - RNA, 19 nt, Homo sapiens
gugauuguaugacagauga

SEQ ID NO: 424753 - RNA, 19 nt, Homo sapiens
uauauaagcgccaguggua

SEQ ID NO: 424754 - RNA, 19 nt, Homo sapiens
aaacagaguucaaauucca

SEQ ID NO: 424755 - RNA, 19 nt, Homo sapiens
aaaccugaaucuacaaguu

SEQ ID NO: 424756 - RNA, 19 nt, Homo sapiens
ggaagcucaugaccaaaga

SEQ ID NO: 424757 - RNA, 19 nt, Homo sapiens
cgggugagauccuuugaaa

SEQ ID NO: 424758 - RNA, 19 nt, Homo sapiens
ugaagaagcucaaaaggaa

SEQ ID NO: 424759 - RNA, 19 nt, Homo sapiens
ggucucagcuaaaccuuuc

SEQ ID NO: 424760 - RNA, 19 nt, Homo sapiens
cagcuaaauucacauaauc

SEQ ID NO: 424761 - RNA, 19 nt, Homo sapiens
aggaguagguguuguuauu

SEQ ID NO: 424762 - RNA, 19 nt, Homo sapiens
caguacagcagaagaguua

SEQ ID NO: 424763 - RNA, 19 nt, Homo sapiens
cagcugaguucuacaagau

SEQ ID NO: 424764 - RNA, 19 nt, Homo sapiens
gcaaugcagcugaguucua

SEQ ID NO: 424765 - RNA, 19 nt, Homo sapiens
agaagaagguggagaugug

SEQ ID NO: 424766 - RNA, 19 nt, Homo sapiens
ucaaacagaguucaaauuc

SEQ ID NO: 424767 - RNA, 19 nt, Homo sapiens
gaaugcaugugacuaagag

SEQ ID NO: 424768 - RNA, 19 nt, Homo sapiens
agaaauuggucuugugguu

SEQ ID NO: 424769 - RNA, 19 nt, Homo sapiens
ggaaagccaagauucaaug

SEQ ID NO: 424770 - RNA, 19 nt, Homo sapiens
gcagcugaguucuacaaga

SEQ ID NO: 424771 - RNA, 19 nt, Homo sapiens
ugaagacucugaagaauuu

SEQ ID NO: 424772 - RNA, 19 nt, Homo sapiens
gacauucacuugccaauaa

SEQ ID NO: 424773 - RNA, 19 nt, Homo sapiens
gagacaggcuacuggauua

SEQ ID NO: 424774 - RNA, 19 nt, Homo sapiens
acaaugagguuucagauaa

SEQ ID NO: 424775 - RNA, 19 nt, Homo sapiens
gaaaugugcugaagaugau

SEQ ID NO: 424776 - RNA, 19 nt, Homo sapiens
ucucauagcuuuacagaug

SEQ ID NO: 424777 - RNA, 19 nt, Homo sapiens
caagcaacccuuuggauua

SEQ ID NO: 424778 - RNA, 19 nt, Homo sapiens
gaagguuguuugauuaguu

SEQ ID NO: 424779 - RNA, 19 nt, Homo sapiens
gaggauuucugaucugauu

SEQ ID NO: 424780 - RNA, 19 nt, Homo sapiens
aaacugaagccuacaauuu

SEQ ID NO: 424781 - RNA, 19 nt, Homo sapiens
caacugagcucaacaaacc

SEQ ID NO: 424782 - RNA, 19 nt, Homo sapiens
gauagaaauucgugagaug

SEQ ID NO: 424783 - RNA, 19 nt, Homo sapiens
caacaaacccgccaugauc

SEQ ID NO: 424784 - RNA, 19 nt, Homo sapiens
ccacauuaguguucuuuau

SEQ ID NO: 424785 - RNA, 19 nt, Homo sapiens
gcaaugagcauguggagau

SEQ ID NO: 424786 - RNA, 19 nt, Homo sapiens
ggacaacaagauagaaauu

SEQ ID NO: 424787 - RNA, 19 nt, Homo sapiens
ucuacuacaucccacauua

SEQ ID NO: 424788 - RNA, 19 nt, Homo sapiens
cuuagaagguuguuugauu

SEQ ID NO: 424789 - RNA, 19 nt, Homo sapiens
gcucauacaugccuucuac

SEQ ID NO: 424790 - RNA, 19 nt, Homo sapiens
gcuucucacugaugaauuu

SEQ ID NO: 424791 - RNA, 19 nt, Homo sapiens
uaacauagccuuaauucag

SEQ ID NO: 424792 - RNA, 19 nt, Homo sapiens
ggagauagcaagagcucua

SEQ ID NO: 424793 - RNA, 19 nt, Homo sapiens
caagugcugacaauuaaua

SEQ ID NO: 424794 - RNA, 19 nt, Homo sapiens
cccaagugcugacaauuaa

SEQ ID NO: 424795 - RNA, 19 nt, Homo sapiens
gaauuugacaccuauaaug

SEQ ID NO: 424796 - RNA, 19 nt, Homo sapiens
gaaauuaacacccaaaaga

SEQ ID NO: 424797 - RNA, 19 nt, Homo sapiens
guuaguuucucauagcuuu

SEQ ID NO: 424798 - RNA, 19 nt, Homo sapiens
gcaggaagcaacaaguauu

SEQ ID NO: 424799 - RNA, 19 nt, Homo sapiens
gcauaaccaugucaaacug

SEQ ID NO: 424800 - RNA, 19 nt, Homo sapiens
ugauggugaugaugaauuu

SEQ ID NO: 424801 - RNA, 19 nt, Homo sapiens
gcaacaucaucucuuuaga

SEQ ID NO: 424802 - RNA, 19 nt, Homo sapiens
gaagccagauauggucauu

SEQ ID NO: 424803 - RNA, 19 nt, Homo sapiens
caucauccauggagggaaa

SEQ ID NO: 424804 - RNA, 19 nt, Homo sapiens
caggaagcaacaaguauua

SEQ ID NO: 424805 - RNA, 19 nt, Homo sapiens
ggauuccacucccuuugaa

SEQ ID NO: 424806 - RNA, 19 nt, Homo sapiens
guugaaaugugcugaagau

SEQ ID NO: 424807 - RNA, 19 nt, Homo sapiens
gcuaucagcuugaaaauca

SEQ ID NO: 424808 - RNA, 19 nt, Homo sapiens
gccaaccuguacagaauaa

SEQ ID NO: 424809 - RNA, 19 nt, Homo sapiens
ggacauucacuugccaaua

SEQ ID NO: 424810 - RNA, 19 nt, Homo sapiens
gacaauuaauaccugguuu

SEQ ID NO: 424811 - RNA, 19 nt, Homo sapiens
ugacucaaacuaacaauga

SEQ ID NO: 424812 - RNA, 19 nt, Homo sapiens
caaugagcauguggagaua

SEQ ID NO: 424813 - RNA, 19 nt, Homo sapiens
gaagagcagacaacauuca

SEQ ID NO: 424814 - RNA, 19 nt, Homo sapiens
ugaaaugugcugaagauga

SEQ ID NO: 424815 - RNA, 19 nt, Homo sapiens
gcacagcaagauaugguuu

SEQ ID NO: 424816 - RNA, 19 nt, Homo sapiens
ugaagaugaugaagaagau

SEQ ID NO: 424817 - RNA, 19 nt, Homo sapiens
ggaaaacaccaaacaauga

SEQ ID NO: 424818 - RNA, 19 nt, Homo sapiens
aaagcaagaucuacuacau

SEQ ID NO: 424819 - RNA, 19 nt, Homo sapiens
gugcagaagcaaauaguuu

SEQ ID NO: 424820 - RNA, 19 nt, Homo sapiens
cagacaacauucacaaaca

SEQ ID NO: 424821 - RNA, 19 nt, Homo sapiens
gagucuugguaacaaauaa

SEQ ID NO: 424822 - RNA, 19 nt, Homo sapiens
aaucaucgagguauguuua

SEQ ID NO: 424823 - RNA, 19 nt, Homo sapiens
cacaaacagucaaacauca

SEQ ID NO: 424824 - RNA, 19 nt, Homo sapiens
caaguuaguuucucauagc

SEQ ID NO: 424825 - RNA, 19 nt, Homo sapiens
acacuuggguaccauucua

SEQ ID NO: 424826 - RNA, 19 nt, Homo sapiens
gagcagacaacauucacaa

SEQ ID NO: 424827 - RNA, 19 nt, Homo sapiens
gaauuugggugugcuacau

SEQ ID NO: 424828 - RNA, 19 nt, Homo sapiens
aaguaugggugcucucuuu

SEQ ID NO: 424829 - RNA, 19 nt, Homo sapiens
ugaacaaguuaguuucuca

SEQ ID NO: 424830 - RNA, 19 nt, Homo sapiens
gaggacaacaagauagaaa

SEQ ID NO: 424831 - RNA, 19 nt, Homo sapiens
aagcaacccuuuggauuau

SEQ ID NO: 424832 - RNA, 19 nt, Homo sapiens
gcaauccugacucaaacua

SEQ ID NO: 424833 - RNA, 19 nt, Homo sapiens
ggacaaguuuucuucuuug

SEQ ID NO: 424834 - RNA, 19 nt, Homo sapiens
ggauuaugcccaugaacaa

SEQ ID NO: 424835 - RNA, 19 nt, Homo sapiens
guaauaaucaucgagguau

SEQ ID NO: 424836 - RNA, 19 nt, Homo sapiens
ucaagcaacccuuuggauu

SEQ ID NO: 424837 - RNA, 19 nt, Homo sapiens
uaaacacccagaagcagua

SEQ ID NO: 424838 - RNA, 19 nt, Homo sapiens
cagcaggaagcaacaagua

SEQ ID NO: 424839 - RNA, 19 nt, Homo sapiens
gugcugaagaugauacuaa

SEQ ID NO: 424840 - RNA, 19 nt, Homo sapiens
ccagugcaauccugacuca

SEQ ID NO: 424841 - RNA, 19 nt, Homo sapiens
ggaagcaacacgggaaaug

SEQ ID NO: 424842 - RNA, 19 nt, Homo sapiens
gcacagagaaagacuuggu

SEQ ID NO: 424843 - RNA, 19 nt, Homo sapiens
gaauuuugauggacaaguu

SEQ ID NO: 424844 - RNA, 19 nt, Homo sapiens
ggccaaaacuuaaaagcaa

SEQ ID NO: 424845 - RNA, 19 nt, Homo sapiens
ugacaccuauaaugaagau

SEQ ID NO: 424846 - RNA, 19 nt, Homo sapiens
ucugcaacaucaucucuuu

SEQ ID NO: 424847 - RNA, 19 nt, Homo sapiens
ccaggcuucucacugauga

SEQ ID NO: 424848 - RNA, 19 nt, Homo sapiens
cauaacaauucggcaguug

SEQ ID NO: 424849 - RNA, 19 nt, Homo sapiens
ucaucgagguauguuuaua

SEQ ID NO: 424850 - RNA, 19 nt, Homo sapiens
aaugaaaucccuccguaaa

SEQ ID NO: 424851 - RNA, 19 nt, Homo sapiens
gaagaugauacuaaugaag

SEQ ID NO: 424852 - RNA, 19 nt, Homo sapiens
caaugagguuucagauaag

SEQ ID NO: 424853 - RNA, 19 nt, Homo sapiens
gaugguaacagucaguaau

SEQ ID NO: 424854 - RNA, 19 nt, Homo sapiens
ccagaagcaguaauaauca

SEQ ID NO: 424855 - RNA, 19 nt, Homo sapiens
acacccagaagcaguaaua

SEQ ID NO: 424856 - RNA, 19 nt, Homo sapiens
gcagacaacauucacaaac

SEQ ID NO: 424857 - RNA, 19 nt, Homo sapiens
cugaagaugauacuaauga

SEQ ID NO: 424858 - RNA, 19 nt, Homo sapiens
agcaagauaugguuuggaa

SEQ ID NO: 424859 - RNA, 19 nt, Homo sapiens
guaacagucaguaauaaca

SEQ ID NO: 424860 - RNA, 19 nt, Homo sapiens
caucagaaacuaugucucu

SEQ ID NO: 424861 - RNA, 19 nt, Homo sapiens
caaugaaaucccuccguaa

SEQ ID NO: 424862 - RNA, 19 nt, Homo sapiens
ugagacaggcuacuggauu

SEQ ID NO: 424863 - RNA, 19 nt, Homo sapiens
agucaaacaucaacagaag

SEQ ID NO: 424864 - RNA, 19 nt, Homo sapiens
ucacaaacagucaaacauc

SEQ ID NO: 424865 - RNA, 19 nt, Homo sapiens
ucaugucucuauugccaaa

SEQ ID NO: 424866 - RNA, 19 nt, Homo sapiens
caaacugaagccuacaauu

SEQ ID NO: 424867 - RNA, 19 nt, Homo sapiens
guaccauucuauucaacug

SEQ ID NO: 424868 - RNA, 19 nt, Homo sapiens
ugaugaauuugacaccuau

SEQ ID NO: 424869 - RNA, 19 nt, Homo sapiens
acaaguuaguuucucauag

SEQ ID NO: 424870 - RNA, 19 nt, Homo sapiens
uaauaaucaucgagguaug

SEQ ID NO: 424871 - RNA, 19 nt, Homo sapiens
ggacuacgcugcaauuaga

SEQ ID NO: 424872 - RNA, 19 nt, Homo sapiens
gcagacagcuaucggaaga

SEQ ID NO: 424873 - RNA, 19 nt, Homo sapiens
gcugagcaguggaauguua

SEQ ID NO: 424874 - RNA, 19 nt, Homo sapiens
ggaagaagguagugcuaga

SEQ ID NO: 424875 - RNA, 19 nt, Homo sapiens
gaaauucgagcgagaaaga

SEQ ID NO: 424876 - RNA, 19 nt, Homo sapiens
gagcuaauguugacaaggu

SEQ ID NO: 424877 - RNA, 19 nt, Homo sapiens
ggaaacaucugcuaaaaca

SEQ ID NO: 424878 - RNA, 19 nt, Homo sapiens
gagcagauuuuaagaguaa

SEQ ID NO: 424879 - RNA, 19 nt, Homo sapiens
ucagaauucuuuggcuuua

SEQ ID NO: 424880 - RNA, 19 nt, Homo sapiens
ucgacuaccuagcaaauaa

SEQ ID NO: 424881 - RNA, 19 nt, Homo sapiens
uuacagaaauggaauccuu

SEQ ID NO: 424882 - RNA, 19 nt, Homo sapiens
gcaguggaauguuaacuac

SEQ ID NO: 424883 - RNA, 19 nt, Homo sapiens
ccaagggucagaauucuuu

SEQ ID NO: 424884 - RNA, 19 nt, Homo sapiens
gaggaaguccagaucgaua

SEQ ID NO: 424885 - RNA, 19 nt, Homo sapiens
gauggaagacagcaaagaa

SEQ ID NO: 424886 - RNA, 19 nt, Homo sapiens
gccaagagaaucagagaaa

SEQ ID NO: 424887 - RNA, 19 nt, Homo sapiens
caagagaaucagagaaaga

SEQ ID NO: 424888 - RNA, 19 nt, Homo sapiens
gagcugagcaguggaaugu

SEQ ID NO: 424889 - RNA, 19 nt, Homo sapiens
gaagauaaaagacagguuu

SEQ ID NO: 424890 - RNA, 19 nt, Homo sapiens
ggaggacuacgcugcaauu

SEQ ID NO: 424891 - RNA, 19 nt, Homo sapiens
gggaggaaguccagaucga

SEQ ID NO: 424892 - RNA, 19 nt, Homo sapiens
ggacuaugagccuaccaaa

SEQ ID NO: 424893 - RNA, 19 nt, Homo sapiens
gcaaagaaaagaauggaaa

SEQ ID NO: 424894 - RNA, 19 nt, Homo sapiens
gagaaauucgagcgagaaa

SEQ ID NO: 424895 - RNA, 19 nt, Homo sapiens
aaagauggaagacagcaaa

SEQ ID NO: 424896 - RNA, 19 nt, Homo sapiens
gaggacuacgcugcaauua

SEQ ID NO: 424897 - RNA, 19 nt, Homo sapiens
uaccaaagcagacagcuau

SEQ ID NO: 424898 - RNA, 19 nt, Homo sapiens
uuaacuacguggaaacauc

SEQ ID NO: 424899 - RNA, 19 nt, Homo sapiens
gaauguuaacuacguggaa

SEQ ID NO: 424900 - RNA, 19 nt, Homo sapiens
ggaauccuuugcagcuaca

SEQ ID NO: 424901 - RNA, 19 nt, Homo sapiens
gaagaagguagugcuagau

SEQ ID NO: 424902 - RNA, 19 nt, Homo sapiens
ccaagagaaucagagaaag

SEQ ID NO: 424903 - RNA, 19 nt, Homo sapiens
gaaagauggaagacagcaa

SEQ ID NO: 424904 - RNA, 19 nt, Homo sapiens
gagcgagaaagauggaaga

SEQ ID NO: 424905 - RNA, 19 nt, Homo sapiens
agaauucuuuggcuuuaca

SEQ ID NO: 424906 - RNA, 19 nt, Homo sapiens
ucuacugguugguaacaaa

SEQ ID NO: 424907 - RNA, 19 nt, Homo sapiens
gcaauuagagacaacuacu

SEQ ID NO: 424908 - RNA, 19 nt, Homo sapiens
cagcugggcaggaggacua

SEQ ID NO: 424909 - RNA, 19 nt, Homo sapiens
aauguuaacuacguggaaa

SEQ ID NO: 424910 - RNA, 19 nt, Homo sapiens
cauuucuacugguugguaa

SEQ ID NO: 424911 - RNA, 19 nt, Homo sapiens
ggagcagauuuuaagagua

SEQ ID NO: 424912 - RNA, 19 nt, Homo sapiens
gaagacagcaaagaaaaga

SEQ ID NO: 424913 - RNA, 19 nt, Homo sapiens
gcccaagggucagaauucu

SEQ ID NO: 424914 - RNA, 19 nt, Homo sapiens
ggucgacuaccuagcaaau

SEQ ID NO: 424915 - RNA, 19 nt, Homo sapiens
cauguacgaugaguuugug

SEQ ID NO: 424916 - RNA, 19 nt, Homo sapiens
gucagaauucuuuggcuuu

SEQ ID NO: 424917 - RNA, 19 nt, Homo sapiens
guggaaacaucugcuaaaa

SEQ ID NO: 424918 - RNA, 19 nt, Homo sapiens
gcucugacucuacaguuca

SEQ ID NO: 424919 - RNA, 19 nt, Homo sapiens
ggaggaaguccagaucgau

SEQ ID NO: 424920 - RNA, 19 nt, Homo sapiens
agacagcuaucggaagaag

SEQ ID NO: 424921 - RNA, 19 nt, Homo sapiens
cguggaaacaucugcuaaa

SEQ ID NO: 424922 - RNA, 19 nt, Homo sapiens
caauuagagacaacuacuu

SEQ ID NO: 424923 - RNA, 19 nt, Homo sapiens
ggaaguccagaucgauauc

SEQ ID NO: 424924 - RNA, 19 nt, Homo sapiens
gggagcagauuuuaagagu

SEQ ID NO: 424925 - RNA, 19 nt, Homo sapiens
uaacuacguggaaacaucu

SEQ ID NO: 424926 - RNA, 19 nt, Homo sapiens
ggaaaaguuuagccaagag

SEQ ID NO: 424927 - RNA, 19 nt, Homo sapiens
agaaauggaauccuuugca

SEQ ID NO: 424928 - RNA, 19 nt, Homo sapiens
acagaaauggaauccuuug

SEQ ID NO: 424929 - RNA, 19 nt, Homo sapiens
aauuagagacaacuacuuc

SEQ ID NO: 424930 - RNA, 19 nt, Homo sapiens
caggaggacuacgcugcaa

SEQ ID NO: 424931 - RNA, 19 nt, Homo sapiens
cuaccaaagcagacagcua

SEQ ID NO: 424932 - RNA, 19 nt, Homo sapiens
cuaugagccuaccaaagca

SEQ ID NO: 424933 - RNA, 19 nt, Homo sapiens
gaacaaagaagaugucaga

SEQ ID NO: 424934 - RNA, 19 nt, Homo sapiens
gaaauaagcccaugcaagu

SEQ ID NO: 424935 - RNA, 19 nt, Homo sapiens
agaaagauguugcuuacua

SEQ ID NO: 424936 - RNA, 19 nt, Homo sapiens
gaaagauguugcuuacuau

SEQ ID NO: 424937 - RNA, 19 nt, Homo sapiens
gaacaugaauccuuuacag

SEQ ID NO: 424938 - RNA, 19 nt, Homo sapiens
gggaagaaguucagauaga

SEQ ID NO: 424939 - RNA, 19 nt, Homo sapiens
gaauugucauagcaucuua

SEQ ID NO: 424940 - RNA, 19 nt, Homo sapiens
gaaaucagaacaaagaaga

SEQ ID NO: 424941 - RNA, 19 nt, Homo sapiens
caaagaagaugucagaaaa

SEQ ID NO: 424942 - RNA, 19 nt, Homo sapiens
ggaagaaguucagauagau

SEQ ID NO: 424943 - RNA, 19 nt, Homo sapiens
uaccaaagcugacaguuau

SEQ ID NO: 424944 - RNA, 19 nt, Homo sapiens
gaagaaguucagauagaua

SEQ ID NO: 424945 - RNA, 19 nt, Homo sapiens
agacaagaauggcaagaaa

SEQ ID NO: 424946 - RNA, 19 nt, Homo sapiens
aaacaagucugaccuagag

SEQ ID NO: 424947 - RNA, 19 nt, Homo sapiens
uaagaugcccucccacuuu

SEQ ID NO: 424948 - RNA, 19 nt, Homo sapiens
acacagggcuggguuggua

SEQ ID NO: 424949 - RNA, 19 nt, Homo sapiens
aaagaaagauguugcuuac

SEQ ID NO: 424950 - RNA, 19 nt, Homo sapiens
ugagagaaaucagaacaaa

SEQ ID NO: 424951 - RNA, 19 nt, Homo sapiens
cacagaacaugaauccuuu

SEQ ID NO: 424952 - RNA, 19 nt, Homo sapiens
gaagccagcugcuccuaag

SEQ ID NO: 424953 - RNA, 19 nt, Homo sapiens
gucaggagguuguggaauu

SEQ ID NO: 424954 - RNA, 19 nt, Homo sapiens
gaaacaagucugaccuaga

SEQ ID NO: 424955 - RNA, 19 nt, Homo sapiens
guagaagacuaugaaccua

SEQ ID NO: 424956 - RNA, 19 nt, Homo sapiens
guauaaagugccacagaua

SEQ ID NO: 424957 - RNA, 19 nt, Homo sapiens
gcugacaguuauagaaaga

SEQ ID NO: 424958 - RNA, 19 nt, Homo sapiens
uggaagggcugcuuuguca

SEQ ID NO: 424959 - RNA, 19 nt, Homo sapiens
agaaagaauugucauagca

SEQ ID NO: 424960 - RNA, 19 nt, Homo sapiens
cuaccaaagcugacaguua

SEQ ID NO: 424961 - RNA, 19 nt, Homo sapiens
agagaaaucagaacaaaga

SEQ ID NO: 424962 - RNA, 19 nt, Homo sapiens
gcaauacccuguggaucug

SEQ ID NO: 424963 - RNA, 19 nt, Homo sapiens
gagaaagaauugucauagc

SEQ ID NO: 424964 - RNA, 19 nt, Homo sapiens
uggacaagguguucuuuga

SEQ ID NO: 424965 - RNA, 19 nt, Homo sapiens
ugugaaggcugaagaagau

SEQ ID NO: 424966 - RNA, 19 nt, Homo sapiens
ucaggagguuguggaauuu

SEQ ID NO: 424967 - RNA, 19 nt, Homo sapiens
gaagaaauaagcccaugca

SEQ ID NO: 424968 - RNA, 19 nt, Homo sapiens
acaaagaagaugucagaaa

SEQ ID NO: 424969 - RNA, 19 nt, Homo sapiens
ucacagaacaugaauccuu

SEQ ID NO: 424970 - RNA, 19 nt, Homo sapiens
cauucgagauaacuacuuu

SEQ ID NO: 424971 - RNA, 19 nt, Homo sapiens
gcuuagcuauguauaaagu

SEQ ID NO: 424972 - RNA, 19 nt, Homo sapiens
gaagaugucagaaaacaaa

SEQ ID NO: 424973 - RNA, 19 nt, Homo sapiens
gcuguuaauuacaaagaga

SEQ ID NO: 424974 - RNA, 19 nt, Homo sapiens
uacagcaacugccgaauuc

SEQ ID NO: 424975 - RNA, 19 nt, Homo sapiens
gaaagaauugucauagcau

SEQ ID NO: 424976 - RNA, 19 nt, Homo sapiens
guaaagagaaggcuauggu

SEQ ID NO: 424977 - RNA, 19 nt, Homo sapiens
gcaagaacaagaaaaguuu

SEQ ID NO: 424978 - RNA, 19 nt, Homo sapiens
gguguucuuugaccuaaug

SEQ ID NO: 424979 - RNA, 19 nt, Homo sapiens
caugaauccuuuacagcaa

SEQ ID NO: 424980 - RNA, 19 nt, Homo sapiens
caaagagaaagaauuguca

SEQ ID NO: 424981 - RNA, 19 nt, Homo sapiens
ggacuacgcagccauucga

SEQ ID NO: 424982 - RNA, 19 nt, Homo sapiens
gaaguucagauagauauuc

SEQ ID NO: 424983 - RNA, 19 nt, Homo sapiens
gaaggcugaagaagauaaa

SEQ ID NO: 424984 - RNA, 19 nt, Homo sapiens
gcagcucaaugacaaaucg

SEQ ID NO: 424985 - RNA, 19 nt, Homo sapiens
ggcuaugguugacuucuug

SEQ ID NO: 424986 - RNA, 19 nt, Homo sapiens
gguaagcuucuuggcaaua

SEQ ID NO: 424987 - RNA, 19 nt, Homo sapiens
guaagaugcccucccacuu

SEQ ID NO: 424988 - RNA, 19 nt, Homo sapiens
guggcuggcagaagaaaua

SEQ ID NO: 424989 - RNA, 19 nt, Homo sapiens
agaaggcuaugguugacuu

SEQ ID NO: 424990 - RNA, 19 nt, Homo sapiens
ggcaauacccuguggaucu

SEQ ID NO: 424991 - RNA, 19 nt, Homo sapiens
ggaggagggaguggaguaa

SEQ ID NO: 424992 - RNA, 19 nt, Homo sapiens
acauuaccauccuucguuu

SEQ ID NO: 424993 - RNA, 19 nt, Homo sapiens
gggaaacaagucugaccua

SEQ ID NO: 424994 - RNA, 19 nt, Homo sapiens
cgaauucagggaacagauu

SEQ ID NO: 424995 - RNA, 19 nt, Homo sapiens
cuucuuguguucucaauca

SEQ ID NO: 424996 - RNA, 19 nt, Homo sapiens
uguauaaagugccacagau

SEQ ID NO: 424997 - RNA, 19 nt, Homo sapiens
guaugacgaguuuguagaa

SEQ ID NO: 424998 - RNA, 19 nt, Homo sapiens
aagagaaggcuaugguuga

SEQ ID NO: 424999 - RNA, 19 nt, Homo sapiens
gggcuggguugguaaagag

SEQ ID NO: 425000 - RNA, 19 nt, Homo sapiens
cuaaugagagaaaucagaa

SEQ ID NO: 425001 - RNA, 19 nt, Homo sapiens
uaaagagaaggcuaugguu

SEQ ID NO: 425002 - RNA, 19 nt, Homo sapiens
gagaaaucagaacaaagaa

SEQ ID NO: 425003 - RNA, 19 nt, Homo sapiens
uuacagcaacugccgaauu

SEQ ID NO: 425004 - RNA, 19 nt, Homo sapiens
guuguggaauuucuuucuu

SEQ ID NO: 425005 - RNA, 19 nt, Homo sapiens
gagguuguggaauuucuuu

SEQ ID NO: 425006 - RNA, 19 nt, Homo sapiens
guaagcuucuuggcaauac

SEQ ID NO: 425007 - RNA, 19 nt, Homo sapiens
cagauguuguaguggguuu

SEQ ID NO: 425008 - RNA, 19 nt, Homo sapiens
gggccaacguggacaaggu

SEQ ID NO: 425009 - RNA, 19 nt, Homo sapiens
gaggaggccaggaguaaag

SEQ ID NO: 425010 - RNA, 19 nt, Homo sapiens
ggaggaggccaggaguaaa

SEQ ID NO: 425011 - RNA, 19 nt, Homo sapiens
caaguggaagggcugcuuu

SEQ ID NO: 425012 - RNA, 19 nt, Homo sapiens
cgacuucauucacucaaac

SEQ ID NO: 425013 - RNA, 19 nt, Homo sapiens
guggagacgucagcgaaga

SEQ ID NO: 425014 - RNA, 19 nt, Homo sapiens
acgcagccauucgagauaa

SEQ ID NO: 425015 - RNA, 19 nt, Homo sapiens
aaagcugacaguuauagaa

SEQ ID NO: 425016 - RNA, 19 nt, Homo sapiens
aagcugacaguuauagaaa

SEQ ID NO: 425017 - RNA, 19 nt, Homo sapiens
uauaaagugccacagauag

SEQ ID NO: 425018 - RNA, 19 nt, Homo sapiens
ucuuugaccuaaugagaga

SEQ ID NO: 425019 - RNA, 19 nt, Homo sapiens
ugaaggcugaagaagauaa

SEQ ID NO: 425020 - RNA, 19 nt, Homo sapiens
gaaccuaccaaagcugaca

SEQ ID NO: 425021 - RNA, 19 nt, Homo sapiens
uaaagugccacagauagga

SEQ ID NO: 425022 - RNA, 19 nt, Homo sapiens
gauguugcuuacuaugagu

SEQ ID NO: 425023 - RNA, 19 nt, Homo sapiens
gaccuaaugagagaaauca

SEQ ID NO: 425024 - RNA, 19 nt, Homo sapiens
aggagggaguggaguaaga

SEQ ID NO: 425025 - RNA, 19 nt, Homo sapiens
gaaaacaaagacaagaaug

SEQ ID NO: 425026 - RNA, 19 nt, Homo sapiens
gagagaaaucagaacaaag

SEQ ID NO: 425027 - RNA, 19 nt, Homo sapiens
ccaaagcugacaguuauag

SEQ ID NO: 425028 - RNA, 19 nt, Homo sapiens
caaagcugacaguuauaga

SEQ ID NO: 425029 - RNA, 19 nt, Homo sapiens
ucagaagaccagcgagaug

SEQ ID NO: 425030 - RNA, 19 nt, Homo sapiens
cccggcagcucaaugacaa

SEQ ID NO: 425031 - RNA, 19 nt, Homo sapiens
ggacaagguguucuuugac

SEQ ID NO: 425032 - RNA, 19 nt, Homo sapiens
cggaggcguuggcaaguca

SEQ ID NO: 425033 - RNA, 19 nt, Homo sapiens
gagaacaacuacucauuga

SEQ ID NO: 425034 - RNA, 19 nt, Homo sapiens
ggagaagccucaccucuug

SEQ ID NO: 425035 - RNA, 19 nt, Homo sapiens
gaacucuacugccaacuau

SEQ ID NO: 425036 - RNA, 19 nt, Homo sapiens
gcagaaaggacucaagauu

SEQ ID NO: 425037 - RNA, 19 nt, Homo sapiens
gaacuucucgucacuguau

SEQ ID NO: 425038 - RNA, 19 nt, Homo sapiens
ggaaucagccucacaguca

SEQ ID NO: 425039 - RNA, 19 nt, Homo sapiens
gaacacagccauugucaag

SEQ ID NO: 425040 - RNA, 19 nt, Homo sapiens
gcaaggccauggacaaaca

SEQ ID NO: 425041 - RNA, 19 nt, Homo sapiens
ggaaggaguucgaggugau

SEQ ID NO: 425042 - RNA, 19 nt, Homo sapiens
cagaaaggacucaagauug

SEQ ID NO: 425043 - RNA, 19 nt, Homo sapiens
gcugguagccaagcacuua

SEQ ID NO: 425044 - RNA, 19 nt, Homo sapiens
ggauccagcucccucacaa

SEQ ID NO: 425045 - RNA, 19 nt, Homo sapiens
cagcaccaguuccaucauu

SEQ ID NO: 425046 - RNA, 19 nt, Homo sapiens
agucggcccugaaccuuua

SEQ ID NO: 425047 - RNA, 19 nt, Homo sapiens
agaaaggacucaagauugc

SEQ ID NO: 425048 - RNA, 19 nt, Homo sapiens
gaagaacacagccauuguc

SEQ ID NO: 425049 - RNA, 19 nt, Homo sapiens
gcagcgaccucuccuacgu

SEQ ID NO: 425050 - RNA, 19 nt, Homo sapiens
ccagaggacuagcugacuu

SEQ ID NO: 425051 - RNA, 19 nt, Homo sapiens
acacugccaugaaggacua

SEQ ID NO: 425052 - RNA, 19 nt, Homo sapiens
gcaacacccucaggaccaa

SEQ ID NO: 425053 - RNA, 19 nt, Homo sapiens
gcccugaaccuuuaugaga

SEQ ID NO: 425054 - RNA, 19 nt, Homo sapiens
caugaaggacuaucuguau

SEQ ID NO: 425055 - RNA, 19 nt, Homo sapiens
gaaggagacgggcaucauc

SEQ ID NO: 425056 - RNA, 19 nt, Homo sapiens
gaccaguacucggaggauu

SEQ ID NO: 425057 - RNA, 19 nt, Homo sapiens
gaucaacggagucaucuac

SEQ ID NO: 425058 - RNA, 19 nt, Homo sapiens
ccaagggagugaaggucaa

SEQ ID NO: 425059 - RNA, 19 nt, Homo sapiens
agauaaggcuccggcugua

SEQ ID NO: 425060 - RNA, 19 nt, Homo sapiens
gcuggacacugccaugaag

SEQ ID NO: 425061 - RNA, 19 nt, Homo sapiens
gauaaggcuccggcuguaa

SEQ ID NO: 425062 - RNA, 19 nt, Homo sapiens
ccacaagcgcucugucuca

SEQ ID NO: 425063 - RNA, 19 nt, Homo sapiens
gaaucagccucacagucau

SEQ ID NO: 425064 - RNA, 19 nt, Homo sapiens
caagaagaacacagccauu

SEQ ID NO: 425065 - RNA, 19 nt, Homo sapiens
ggacaguuuccggaucuuu

SEQ ID NO: 425066 - RNA, 19 nt, Homo sapiens
ggacaauggcaacauguac

SEQ ID NO: 425067 - RNA, 19 nt, Homo sapiens
gucaccaucuuccugugua

SEQ ID NO: 425068 - RNA, 19 nt, Homo sapiens
gcaaggugcggaccgugaa

SEQ ID NO: 425069 - RNA, 19 nt, Homo sapiens
ccaugaaggacuaucugua

SEQ ID NO: 425070 - RNA, 19 nt, Homo sapiens
ugaagaagacgugggaaga

SEQ ID NO: 425071 - RNA, 19 nt, Homo sapiens
ucacccaguucaacagugu

SEQ ID NO: 425072 - RNA, 19 nt, Homo sapiens
gguguucccuccagaucug

SEQ ID NO: 425073 - RNA, 19 nt, Homo sapiens
ggacuuucccugccucaag

SEQ ID NO: 425074 - RNA, 19 nt, Homo sapiens
ucacggccuccucuagaua

SEQ ID NO: 425075 - RNA, 19 nt, Homo sapiens
gugggcgacugcuguauca

SEQ ID NO: 425076 - RNA, 19 nt, Homo sapiens
ugaacucuacugccaacua

SEQ ID NO: 425077 - RNA, 19 nt, Homo sapiens
uucagaagcugucagagau

SEQ ID NO: 425078 - RNA, 19 nt, Homo sapiens
cagaggacuagcugacuuu

SEQ ID NO: 425079 - RNA, 19 nt, Homo sapiens
agcaccaguuccaucauua

SEQ ID NO: 425080 - RNA, 19 nt, Homo sapiens
cgccaccucuguacacuuc

SEQ ID NO: 425081 - RNA, 19 nt, Homo sapiens
ggauugacgccugccauug

SEQ ID NO: 425082 - RNA, 19 nt, Homo sapiens
gggauugacgccugccauu

SEQ ID NO: 425083 - RNA, 19 nt, Homo sapiens
cagaugaccggaagcugaa

SEQ ID NO: 425084 - RNA, 19 nt, Homo sapiens
ugcagauucucucagauga

SEQ ID NO: 425085 - RNA, 19 nt, Homo sapiens
aggaggagccggaggacua

SEQ ID NO: 425086 - RNA, 19 nt, Homo sapiens
cagagaacgggcugaguga

SEQ ID NO: 425087 - RNA, 19 nt, Homo sapiens
caccugugguugcagagaa

SEQ ID NO: 425088 - RNA, 19 nt, Homo sapiens
ggagcacucggaacccauu

SEQ ID NO: 425089 - RNA, 19 nt, Homo sapiens
aagaagaacacagccauug

SEQ ID NO: 425090 - RNA, 19 nt, Homo sapiens
gccggauccucaagaacuu

SEQ ID NO: 425091 - RNA, 19 nt, Homo sapiens
gacaauggcaacauguaca

SEQ ID NO: 425092 - RNA, 19 nt, Homo sapiens
gaagaagacgugggaagac

SEQ ID NO: 425093 - RNA, 19 nt, Homo sapiens
ccagcucccucacaaacuc

SEQ ID NO: 425094 - RNA, 19 nt, Homo sapiens
agagccagcugugggacua

SEQ ID NO: 425095 - RNA, 19 nt, Homo sapiens
guacucggaggauuucugu

SEQ ID NO: 425096 - RNA, 19 nt, Homo sapiens
gauugacgccugccauugg

SEQ ID NO: 425097 - RNA, 19 nt, Homo sapiens
aagcagaaaggacucaaga

SEQ ID NO: 425098 - RNA, 19 nt, Homo sapiens
aaacgccaacgucuucuau

SEQ ID NO: 425099 - RNA, 19 nt, Homo sapiens
cagaagcugucagagaucu

SEQ ID NO: 425100 - RNA, 19 nt, Homo sapiens
ggaggagccggaggacuau

SEQ ID NO: 425101 - RNA, 19 nt, Homo sapiens
cguggacaauggcaacaug

SEQ ID NO: 425102 - RNA, 19 nt, Homo sapiens
uggcagacucaucaacuuu

SEQ ID NO: 425103 - RNA, 19 nt, Homo sapiens
gauccagcucccucacaaa

SEQ ID NO: 425104 - RNA, 19 nt, Homo sapiens
ucuguacacuucccugaca

SEQ ID NO: 425105 - RNA, 19 nt, Homo sapiens
acuaugacuuuguccugaa

SEQ ID NO: 425106 - RNA, 19 nt, Homo sapiens
uggaggagaucaacaucag

SEQ ID NO: 425107 - RNA, 19 nt, Homo sapiens
ggcagacucaucaacuuug

SEQ ID NO: 425108 - RNA, 19 nt, Homo sapiens
gagucggcccugaaccuuu

SEQ ID NO: 425109 - RNA, 19 nt, Homo sapiens
cagaugagaacaacuacuc

SEQ ID NO: 425110 - RNA, 19 nt, Homo sapiens
gagcugaucaacggaguca

SEQ ID NO: 425111 - RNA, 19 nt, Homo sapiens
aagcugaagaucccugaaa

SEQ ID NO: 425112 - RNA, 19 nt, Homo sapiens
ucucagggcucugcaacuc

SEQ ID NO: 425113 - RNA, 19 nt, Homo sapiens
gaagaggaggaaggaguuc

SEQ ID NO: 425114 - RNA, 19 nt, Homo sapiens
agaagaggaggaaggaguu

SEQ ID NO: 425115 - RNA, 19 nt, Homo sapiens
agaaugagucggcccugaa

SEQ ID NO: 425116 - RNA, 19 nt, Homo sapiens
ucuaugccaugaacucuac

SEQ ID NO: 425117 - RNA, 19 nt, Homo sapiens
ccgcaaggccauggacaaa

SEQ ID NO: 425118 - RNA, 19 nt, Homo sapiens
gcugaucaacggagucauc

SEQ ID NO: 425119 - RNA, 19 nt, Homo sapiens
gacaguuuccggaucuuuc

SEQ ID NO: 425120 - RNA, 19 nt, Homo sapiens
ucuccuacgucaccaucuu

SEQ ID NO: 425121 - RNA, 19 nt, Homo sapiens
gcaccacggaggcaacaag

SEQ ID NO: 425122 - RNA, 19 nt, Homo sapiens
gaagcagaaaggacucaag

SEQ ID NO: 425123 - RNA, 19 nt, Homo sapiens
acucuacugccaacuauga

SEQ ID NO: 425124 - RNA, 19 nt, Homo sapiens
gccuggacguggacaaugg

SEQ ID NO: 425125 - RNA, 19 nt, Homo sapiens
caaaagguacgguagaugu

SEQ ID NO: 425126 - RNA, 19 nt, Homo sapiens
agaagaacacagccauugu

SEQ ID NO: 425127 - RNA, 19 nt, Homo sapiens
aaagguacgguagauguga

SEQ ID NO: 425128 - RNA, 19 nt, Homo sapiens
uuucagaagcugucagaga

SEQ ID NO: 425129 - RNA, 19 nt, Homo sapiens
gaaugagucggcccugaac

SEQ ID NO: 425130 - RNA, 19 nt, Homo sapiens
ugaaggacuaucuguaugg

SEQ ID NO: 425131 - RNA, 19 nt, Homo sapiens
augaaggacuaucuguaug

SEQ ID NO: 425132 - RNA, 19 nt, Homo sapiens
ccucacggccuccucuaga

SEQ ID NO: 425133 - RNA, 19 nt, Homo sapiens
ggugaaaucuuguuuguua

SEQ ID NO: 425134 - RNA, 19 nt, Homo sapiens
gcaacaaaguggauauuaa

SEQ ID NO: 425135 - RNA, 19 nt, Homo sapiens
gaaauucgguggacugaga

SEQ ID NO: 425136 - RNA, 19 nt, Homo sapiens
gcaguauucuauuugguua

SEQ ID NO: 425137 - RNA, 19 nt, Homo sapiens
gaacucaucccuuguuuau

SEQ ID NO: 425138 - RNA, 19 nt, Homo sapiens
caacugcucucccggauga

SEQ ID NO: 425139 - RNA, 19 nt, Homo sapiens
ggucagcaguauucuauuu

SEQ ID NO: 425140 - RNA, 19 nt, Homo sapiens
guuuggaccugcauauuua

SEQ ID NO: 425141 - RNA, 19 nt, Homo sapiens
acucaucccuuguuuauaa

SEQ ID NO: 425142 - RNA, 19 nt, Homo sapiens
gagugaauguggcaguuua

SEQ ID NO: 425143 - RNA, 19 nt, Homo sapiens
gaacaugugcuuuaucugu

SEQ ID NO: 425144 - RNA, 19 nt, Homo sapiens
ucauuugacuggugaauuu

SEQ ID NO: 425145 - RNA, 19 nt, Homo sapiens
ucaaauaucuaagcaagug

SEQ ID NO: 425146 - RNA, 19 nt, Homo sapiens
gaaguuuuaugccauguua

SEQ ID NO: 425147 - RNA, 19 nt, Homo sapiens
gcauagagaucugguacga

SEQ ID NO: 425148 - RNA, 19 nt, Homo sapiens
cagaggaccuauuaaguuc

SEQ ID NO: 425149 - RNA, 19 nt, Homo sapiens
guucaaacuuguauugguu

SEQ ID NO: 425150 - RNA, 19 nt, Homo sapiens
guuaauuucucccuauguu

SEQ ID NO: 425151 - RNA, 19 nt, Homo sapiens
gcaguugauuccuugaguu

SEQ ID NO: 425152 - RNA, 19 nt, Homo sapiens
gacccuaacuuggaauuug

SEQ ID NO: 425153 - RNA, 19 nt, Homo sapiens
cgucagaagucuaguuuua

SEQ ID NO: 425154 - RNA, 19 nt, Homo sapiens
caacagaggaccuauuaag

SEQ ID NO: 425155 - RNA, 19 nt, Homo sapiens
caacaaaguggauauuaag

SEQ ID NO: 425156 - RNA, 19 nt, Homo sapiens
gggaauucuugcuguuaaa

SEQ ID NO: 425157 - RNA, 19 nt, Homo sapiens
ucacacaaacugaugauga

SEQ ID NO: 425158 - RNA, 19 nt, Homo sapiens
gaugaugaccugugagaau

SEQ ID NO: 425159 - RNA, 19 nt, Homo sapiens
acugagagauggcuauuau

SEQ ID NO: 425160 - RNA, 19 nt, Homo sapiens
ccacuaaaguagggaaguu

SEQ ID NO: 425161 - RNA, 19 nt, Homo sapiens
aauguuagaugcuuagugu

SEQ ID NO: 425162 - RNA, 19 nt, Homo sapiens
ugagagauggcuauuauau

SEQ ID NO: 425163 - RNA, 19 nt, Homo sapiens
gaggaccuauuaaguucaa

SEQ ID NO: 425164 - RNA, 19 nt, Homo sapiens
auaggcagcuguccuguga

SEQ ID NO: 425165 - RNA, 19 nt, Homo sapiens
gaaaacauccccauugugu

SEQ ID NO: 425166 - RNA, 19 nt, Homo sapiens
acaagaaugugccuaacug

SEQ ID NO: 425167 - RNA, 19 nt, Homo sapiens
ggcaggagguugggaauuc

SEQ ID NO: 425168 - RNA, 19 nt, Homo sapiens
ggaaagugaaggcgaaauc

SEQ ID NO: 425169 - RNA, 19 nt, Homo sapiens
acagaggaccuauuaaguu

SEQ ID NO: 425170 - RNA, 19 nt, Homo sapiens
guggugaaaucuuguuugu

SEQ ID NO: 425171 - RNA, 19 nt, Homo sapiens
ugaggaugaugaccuguga

SEQ ID NO: 425172 - RNA, 19 nt, Homo sapiens
ggcaacaaaguggauauua

SEQ ID NO: 425173 - RNA, 19 nt, Homo sapiens
gaaaucuuguuuguuacug

SEQ ID NO: 425174 - RNA, 19 nt, Homo sapiens
guugauuccuugaguuuca

SEQ ID NO: 425175 - RNA, 19 nt, Homo sapiens
cgaaauccauugucuucca

SEQ ID NO: 425176 - RNA, 19 nt, Homo sapiens
gugaacucaucccuuguuu

SEQ ID NO: 425177 - RNA, 19 nt, Homo sapiens
ugggaauucuugcuguuaa

SEQ ID NO: 425178 - RNA, 19 nt, Homo sapiens
ugaauugccuugcuuuuau

SEQ ID NO: 425179 - RNA, 19 nt, Homo sapiens
cuaagcaagugaacucauc

SEQ ID NO: 425180 - RNA, 19 nt, Homo sapiens
gaugaccugugagaaugaa

SEQ ID NO: 425181 - RNA, 19 nt, Homo sapiens
cuacgacauuucugccaaa

SEQ ID NO: 425182 - RNA, 19 nt, Homo sapiens
agagauggcuauuauaucc

SEQ ID NO: 425183 - RNA, 19 nt, Homo sapiens
agaaguauguagccaccuu

SEQ ID NO: 425184 - RNA, 19 nt, Homo sapiens
gugugccaccucauuauua

SEQ ID NO: 425185 - RNA, 19 nt, Homo sapiens
accaacagaggaccuauua

SEQ ID NO: 425186 - RNA, 19 nt, Homo sapiens
ggacugagagauggcuauu

SEQ ID NO: 425187 - RNA, 19 nt, Homo sapiens
gagagauggcuauuauauc

SEQ ID NO: 425188 - RNA, 19 nt, Homo sapiens
guuagaugcuuagugugaa

SEQ ID NO: 425189 - RNA, 19 nt, Homo sapiens
caggucagcaguauucuau

SEQ ID NO: 425190 - RNA, 19 nt, Homo sapiens
gugaauuugagaagaagua

SEQ ID NO: 425191 - RNA, 19 nt, Homo sapiens
ggagugaauguggcaguuu

SEQ ID NO: 425192 - RNA, 19 nt, Homo sapiens
uaacuggcauagagaucug

SEQ ID NO: 425193 - RNA, 19 nt, Homo sapiens
cauuggagacccuaacuug

SEQ ID NO: 425194 - RNA, 19 nt, Homo sapiens
ggcgaaauccauugucuuc

SEQ ID NO: 425195 - RNA, 19 nt, Homo sapiens
gagaaauucgguggacuga

SEQ ID NO: 425196 - RNA, 19 nt, Homo sapiens
agaguuacuuacaagaaug

SEQ ID NO: 425197 - RNA, 19 nt, Homo sapiens
ugaacucaucccuuguuua

SEQ ID NO: 425198 - RNA, 19 nt, Homo sapiens
gcaggagguugggaauucu

SEQ ID NO: 425199 - RNA, 19 nt, Homo sapiens
cuggugaauuugagaagaa

SEQ ID NO: 425200 - RNA, 19 nt, Homo sapiens
uggagacccuaacuuggaa

SEQ ID NO: 425201 - RNA, 19 nt, Homo sapiens
ccagugugccaucauaaug

SEQ ID NO: 425202 - RNA, 19 nt, Homo sapiens
ggguuaauuucucccuaug

SEQ ID NO: 425203 - RNA, 19 nt, Homo sapiens
cugcauauuuagcuguuug

SEQ ID NO: 425204 - RNA, 19 nt, Homo sapiens
ugugccaccucauuauuau

SEQ ID NO: 425205 - RNA, 19 nt, Homo sapiens
acaguaugagcacgacuua

SEQ ID NO: 425206 - RNA, 19 nt, Homo sapiens
cgacauuucugccaaaagu

SEQ ID NO: 425207 - RNA, 19 nt, Homo sapiens
guugggaauucuugcuguu

SEQ ID NO: 425208 - RNA, 19 nt, Homo sapiens
uuuggaaaccacuaaagua

SEQ ID NO: 425209 - RNA, 19 nt, Homo sapiens
gcauuuggaaaccacuaaa

SEQ ID NO: 425210 - RNA, 19 nt, Homo sapiens
uguuuggaccugcauauuu

SEQ ID NO: 425211 - RNA, 19 nt, Homo sapiens
ggaccuauuaaguucaaug

SEQ ID NO: 425212 - RNA, 19 nt, Homo sapiens
ucugugggaugcugaagga

SEQ ID NO: 425213 - RNA, 19 nt, Homo sapiens
ccaccucauuauuaucuag

SEQ ID NO: 425214 - RNA, 19 nt, Homo sapiens
cgugugugccaccucauua

SEQ ID NO: 425215 - RNA, 19 nt, Homo sapiens
aguaugagcacgacuuaga

SEQ ID NO: 425216 - RNA, 19 nt, Homo sapiens
gauauuaaggacaggaaag

SEQ ID NO: 425217 - RNA, 19 nt, Homo sapiens
acaaaguggauauuaagga

SEQ ID NO: 425218 - RNA, 19 nt, Homo sapiens
caguugauuccuugaguuu

SEQ ID NO: 425219 - RNA, 19 nt, Homo sapiens
gugggaugcugaaggagau

SEQ ID NO: 425220 - RNA, 19 nt, Homo sapiens
cuucaguacuacgacauuu

SEQ ID NO: 425221 - RNA, 19 nt, Homo sapiens
ggauauuaaggacaggaaa

SEQ ID NO: 425222 - RNA, 19 nt, Homo sapiens
gugaaaacauccccauugu

SEQ ID NO: 425223 - RNA, 19 nt, Homo sapiens
agauggcuauuauauccaa

SEQ ID NO: 425224 - RNA, 19 nt, Homo sapiens
ccucauuauuaucuagcua

SEQ ID NO: 425225 - RNA, 19 nt, Homo sapiens
gagcccagcgucagaaguc

SEQ ID NO: 425226 - RNA, 19 nt, Homo sapiens
gaugcuuagugugaaguug

SEQ ID NO: 425227 - RNA, 19 nt, Homo sapiens
gaauguuagaugcuuagug

SEQ ID NO: 425228 - RNA, 19 nt, Homo sapiens
ucagcaguauucuauuugg

SEQ ID NO: 425229 - RNA, 19 nt, Homo sapiens
uggguuaauuucucccuau

SEQ ID NO: 425230 - RNA, 19 nt, Homo sapiens
cagcuguccugugauguca

SEQ ID NO: 425231 - RNA, 19 nt, Homo sapiens
aggcagcuguccugugaug

SEQ ID NO: 425232 - RNA, 19 nt, Homo sapiens
uguuagaugcuuaguguga

SEQ ID NO: 425233 - RNA, 19 nt, Homo sapiens
ggaagaagaugaagaggaa

SEQ ID NO: 425234 - RNA, 19 nt, Homo sapiens
caagggacguuauauaaag

SEQ ID NO: 425235 - RNA, 19 nt, Homo sapiens
gcacagaaauucaaaacaa

SEQ ID NO: 425236 - RNA, 19 nt, Homo sapiens
gaagcaauaaaucgucuua

SEQ ID NO: 425237 - RNA, 19 nt, Homo sapiens
gaagaaugcaggaaagaga

SEQ ID NO: 425238 - RNA, 19 nt, Homo sapiens
gaaagcaggaucaggcaaa

SEQ ID NO: 425239 - RNA, 19 nt, Homo sapiens
uacaagggacguuauauaa

SEQ ID NO: 425240 - RNA, 19 nt, Homo sapiens
gaaagagaucgaagagaga

SEQ ID NO: 425241 - RNA, 19 nt, Homo sapiens
agaacgaucucccagaaug

SEQ ID NO: 425242 - RNA, 19 nt, Homo sapiens
uuacaagggacguuauaua

SEQ ID NO: 425243 - RNA, 19 nt, Homo sapiens
uagaagcucucucggugaa

SEQ ID NO: 425244 - RNA, 19 nt, Homo sapiens
gaacacccacgcugacuuc

SEQ ID NO: 425245 - RNA, 19 nt, Homo sapiens
gggcaaaacuguuccgauu

SEQ ID NO: 425246 - RNA, 19 nt, Homo sapiens
caugauacuuccacugaga

SEQ ID NO: 425247 - RNA, 19 nt, Homo sapiens
gccauccgcuuccugaaug

SEQ ID NO: 425248 - RNA, 19 nt, Homo sapiens
gaagaugaagaggaacuuu

SEQ ID NO: 425249 - RNA, 19 nt, Homo sapiens
gcaggaaagagaucgaaga

SEQ ID NO: 425250 - RNA, 19 nt, Homo sapiens
gacguuauauaaagaacug

SEQ ID NO: 425251 - RNA, 19 nt, Homo sapiens
caaccaugacccucaguuu

SEQ ID NO: 425252 - RNA, 19 nt, Homo sapiens
acaagggacguuauauaaa

SEQ ID NO: 425253 - RNA, 19 nt, Homo sapiens
ggaggaugcugaggagaag

SEQ ID NO: 425254 - RNA, 19 nt, Homo sapiens
ugaaggaggagaccaagga

SEQ ID NO: 425255 - RNA, 19 nt, Homo sapiens
uuaaaacacuggaagaaga

SEQ ID NO: 425256 - RNA, 19 nt, Homo sapiens
gagccaauaguuucucuuc

SEQ ID NO: 425257 - RNA, 19 nt, Homo sapiens
gaggagaagcaauaaaucg

SEQ ID NO: 425258 - RNA, 19 nt, Homo sapiens
gaacgaucucccagaaugg

SEQ ID NO: 425259 - RNA, 19 nt, Homo sapiens
cagacgaguccaaccauga

SEQ ID NO: 425260 - RNA, 19 nt, Homo sapiens
ucaagcuccugaagcacaa

SEQ ID NO: 425261 - RNA, 19 nt, Homo sapiens
aagggacguuauauaaaga

SEQ ID NO: 425262 - RNA, 19 nt, Homo sapiens
gauacuuccacugagaaua

SEQ ID NO: 425263 - RNA, 19 nt, Homo sapiens
ggaacacccacgcugacuu

SEQ ID NO: 425264 - RNA, 19 nt, Homo sapiens
gccaauaguuucucuuccu

SEQ ID NO: 425265 - RNA, 19 nt, Homo sapiens
aaaaugaucaugccgaaaa

SEQ ID NO: 425266 - RNA, 19 nt, Homo sapiens
caguuugagccaauaguuu

SEQ ID NO: 425267 - RNA, 19 nt, Homo sapiens
gaagagagagaaaagaaag

SEQ ID NO: 425268 - RNA, 19 nt, Homo sapiens
gaucugugccaaccacuac

SEQ ID NO: 425269 - RNA, 19 nt, Homo sapiens
cugaggagaagcaauaaau

SEQ ID NO: 425270 - RNA, 19 nt, Homo sapiens
cugagaaugcacagaaauu

SEQ ID NO: 425271 - RNA, 19 nt, Homo sapiens
gcugagaaugcacagaaau

SEQ ID NO: 425272 - RNA, 19 nt, Homo sapiens
gcugaggagaagcaauaaa

SEQ ID NO: 425273 - RNA, 19 nt, Homo sapiens
uuccugagcaagaaauuaa

SEQ ID NO: 425274 - RNA, 19 nt, Homo sapiens
gagaucgaagagagagaaa

SEQ ID NO: 425275 - RNA, 19 nt, Homo sapiens
accaugacccucaguuuga

SEQ ID NO: 425276 - RNA, 19 nt, Homo sapiens
ucaguuugagccaauaguu

SEQ ID NO: 425277 - RNA, 19 nt, Homo sapiens
ggacacucaugaggaccau

SEQ ID NO: 425278 - RNA, 19 nt, Homo sapiens
aaccaugacccucaguuug

SEQ ID NO: 425279 - RNA, 19 nt, Homo sapiens
guuugaagaaugcaggaaa

SEQ ID NO: 425280 - RNA, 19 nt, Homo sapiens
ggccauccgcuuccugaau

SEQ ID NO: 425281 - RNA, 19 nt, Homo sapiens
aaacacuggaagaagauga

SEQ ID NO: 425282 - RNA, 19 nt, Homo sapiens
aaaaguggcggaaaagcua

SEQ ID NO: 425283 - RNA, 19 nt, Homo sapiens
ccgccaaggacacucauga

SEQ ID NO: 425284 - RNA, 19 nt, Homo sapiens
gaaaggaaauugauacaga

SEQ ID NO: 425285 - RNA, 19 nt, Homo sapiens
gcaggaaaguagagaauua

SEQ ID NO: 425286 - RNA, 19 nt, Homo sapiens
cgaaacagcugucaagaaa

SEQ ID NO: 425287 - RNA, 19 nt, Homo sapiens
gcaguuggauugaagcuua

SEQ ID NO: 425288 - RNA, 19 nt, Homo sapiens
gagaagggaccaaguauua

SEQ ID NO: 425289 - RNA, 19 nt, Homo sapiens
gagcaaggauucaaauuug

SEQ ID NO: 425290 - RNA, 19 nt, Homo sapiens
ggagaaguguucauuauug

SEQ ID NO: 425291 - RNA, 19 nt, Homo sapiens
gagaauuacugcaaaguuu

SEQ ID NO: 425292 - RNA, 19 nt, Homo sapiens
gcggauaacuauggaauua

SEQ ID NO: 425293 - RNA, 19 nt, Homo sapiens
ggagaaggauuucaguuug

SEQ ID NO: 425294 - RNA, 19 nt, Homo sapiens
gaagauggauggaauaaac

SEQ ID NO: 425295 - RNA, 19 nt, Homo sapiens
ggcauacaaugaagaauua

SEQ ID NO: 425296 - RNA, 19 nt, Homo sapiens
acagagagcugaagaaaug

SEQ ID NO: 425297 - RNA, 19 nt, Homo sapiens
guaaacagcuuuguacaga

SEQ ID NO: 425298 - RNA, 19 nt, Homo sapiens
acaaagccguugaauguua

SEQ ID NO: 425299 - RNA, 19 nt, Homo sapiens
uugcaaagcuguauuauga

SEQ ID NO: 425300 - RNA, 19 nt, Homo sapiens
gaugaagaaucugauguua

SEQ ID NO: 425301 - RNA, 19 nt, Homo sapiens
gaagaagacgcacacauaa

SEQ ID NO: 425302 - RNA, 19 nt, Homo sapiens
gcagcggucuuaauucuuu

SEQ ID NO: 425303 - RNA, 19 nt, Homo sapiens
aaccagagcuugaagauuu

SEQ ID NO: 425304 - RNA, 19 nt, Homo sapiens
gaagaugcuuuggaugaua

SEQ ID NO: 425305 - RNA, 19 nt, Homo sapiens
gcaaggagauggcuauagu

SEQ ID NO: 425306 - RNA, 19 nt, Homo sapiens
gaauuaaacccaacacaaa

SEQ ID NO: 425307 - RNA, 19 nt, Homo sapiens
gaauaacuaucacagaaug

SEQ ID NO: 425308 - RNA, 19 nt, Homo sapiens
gagccaaacuuuauagaug

SEQ ID NO: 425309 - RNA, 19 nt, Homo sapiens
gaagacauguuugcuaaga

SEQ ID NO: 425310 - RNA, 19 nt, Homo sapiens
gaaggucacugggauugua

SEQ ID NO: 425311 - RNA, 19 nt, Homo sapiens
uguaacagcugcucauuaa

SEQ ID NO: 425312 - RNA, 19 nt, Homo sapiens
caaaccacguuauuacuaa

SEQ ID NO: 425313 - RNA, 19 nt, Homo sapiens
caagauaguuucauuugga

SEQ ID NO: 425314 - RNA, 19 nt, Homo sapiens
gcugauggauuuaaauuug

SEQ ID NO: 425315 - RNA, 19 nt, Homo sapiens
gcgaagugaugauauguuu

SEQ ID NO: 425316 - RNA, 19 nt, Homo sapiens
gcaccugaaucaauaugua

SEQ ID NO: 425317 - RNA, 19 nt, Homo sapiens
gcacagggcucucauuugc

SEQ ID NO: 425318 - RNA, 19 nt, Homo sapiens
gaagaaaccacaagagaga

SEQ ID NO: 425319 - RNA, 19 nt, Homo sapiens
gaaagggacagaaagagua

SEQ ID NO: 425320 - RNA, 19 nt, Homo sapiens
gaaaugaaguugcaugacu

SEQ ID NO: 425321 - RNA, 19 nt, Homo sapiens
gaaagucuauaccauguuc

SEQ ID NO: 425322 - RNA, 19 nt, Homo sapiens
ucaaacaacugcaauuuca

SEQ ID NO: 425323 - RNA, 19 nt, Homo sapiens
ucccaaagcucacagauuu

SEQ ID NO: 425324 - RNA, 19 nt, Homo sapiens
gaccacaacuuggauaauu

SEQ ID NO: 425325 - RNA, 19 nt, Homo sapiens
gaugguaccuucuuucugu

SEQ ID NO: 425326 - RNA, 19 nt, Homo sapiens
ggauugcaguucaugcuua

SEQ ID NO: 425327 - RNA, 19 nt, Homo sapiens
gaagaagcccagagcauuu

SEQ ID NO: 425328 - RNA, 19 nt, Homo sapiens
gauaugaaauugacaccaa

SEQ ID NO: 425329 - RNA, 19 nt, Homo sapiens
caaguugacuauuuccuuu

SEQ ID NO: 425330 - RNA, 19 nt, Homo sapiens
guaagucaguggaaagaaa

SEQ ID NO: 425331 - RNA, 19 nt, Homo sapiens
gagggaauguucacuaaga

SEQ ID NO: 425332 - RNA, 19 nt, Homo sapiens
gagggaauguucacuaaga

SEQ ID NO: 425333 - RNA, 19 nt, Homo sapiens
gagggaauguucacuaaga

SEQ ID NO: 425334 - RNA, 19 nt, Homo sapiens
gaaaugaaccuacuguauc

SEQ ID NO: 425335 - RNA, 19 nt, Homo sapiens
ugaggaagaugaagaagaa

SEQ ID NO: 425336 - RNA, 19 nt, Homo sapiens
gcacauguugcuaaacuua

SEQ ID NO: 425337 - RNA, 19 nt, Homo sapiens
aggaauaucuggagucuuu

SEQ ID NO: 425338 - RNA, 19 nt, Homo sapiens
gaggagauaucaccaaaca

SEQ ID NO: 425339 - RNA, 19 nt, Homo sapiens
agaaguagcugauuguuuc

SEQ ID NO: 425340 - RNA, 19 nt, Homo sapiens
aaagaacucugauaucgaa

SEQ ID NO: 425341 - RNA, 19 nt, Homo sapiens
gggcaaaacucuacagaua

SEQ ID NO: 425342 - RNA, 19 nt, Homo sapiens
gaccagggacuaccuaaua

SEQ ID NO: 425343 - RNA, 19 nt, Homo sapiens
ggaauucauugccugcuuu

SEQ ID NO: 425344 - RNA, 19 nt, Homo sapiens
gcagaacauuuggacuuua

SEQ ID NO: 425345 - RNA, 19 nt, Homo sapiens
gcagugagauuuaaaacua

SEQ ID NO: 425346 - RNA, 19 nt, Homo sapiens
gaagagaacaaguacuaaa

SEQ ID NO: 425347 - RNA, 19 nt, Homo sapiens
gaauagaccagauuauguu

SEQ ID NO: 425348 - RNA, 19 nt, Homo sapiens
gaauuuaagucaaccaaag

SEQ ID NO: 425349 - RNA, 19 nt, Homo sapiens
caacacagccaacuccuuu

SEQ ID NO: 425350 - RNA, 19 nt, Homo sapiens
aaaugcaccugaaucaaua

SEQ ID NO: 425351 - RNA, 19 nt, Homo sapiens
ccaaagugcucuucucuag

SEQ ID NO: 425352 - RNA, 19 nt, Homo sapiens
gagacaaauuugaagauga

SEQ ID NO: 425353 - RNA, 19 nt, Homo sapiens
gcaaaccacguuauuacua

SEQ ID NO: 425354 - RNA, 19 nt, Homo sapiens
ccaaauguauugcuuguca

SEQ ID NO: 425355 - RNA, 19 nt, Homo sapiens
ccaaauguauugcuuguca

SEQ ID NO: 425356 - RNA, 19 nt, Homo sapiens
ccaaauguauugcuuguca

SEQ ID NO: 425357 - RNA, 19 nt, Homo sapiens
ugaagaagacgcacacaua

SEQ ID NO: 425358 - RNA, 19 nt, Homo sapiens
gaagaacaguauuccugaa

SEQ ID NO: 425359 - RNA, 19 nt, Homo sapiens
ggauauacuuaccauuuga

SEQ ID NO: 425360 - RNA, 19 nt, Homo sapiens
gaguggaucugaaagcaaa

SEQ ID NO: 425361 - RNA, 19 nt, Homo sapiens
gaaccaggauauuucacaa

SEQ ID NO: 425362 - RNA, 19 nt, Homo sapiens
agacaaagccguugaaugu

SEQ ID NO: 425363 - RNA, 19 nt, Homo sapiens
cagaacauuuggacuuuaa

SEQ ID NO: 425364 - RNA, 19 nt, Homo sapiens
ggagauaucaccaaacaug

SEQ ID NO: 425365 - RNA, 19 nt, Homo sapiens
gaagaaguaguucauaaug

SEQ ID NO: 425366 - RNA, 19 nt, Homo sapiens
gaugauagugucaguagua

SEQ ID NO: 425367 - RNA, 19 nt, Homo sapiens
cgacagaagucaaugaaag

SEQ ID NO: 425368 - RNA, 19 nt, Homo sapiens
ccagggagaucuuccuaaa

SEQ ID NO: 425369 - RNA, 19 nt, Homo sapiens
cagaacaacuugcuauuag

SEQ ID NO: 425370 - RNA, 19 nt, Homo sapiens
agaaagaaaugcaggaguu

SEQ ID NO: 425371 - RNA, 19 nt, Homo sapiens
cacagaacguauagaguua

SEQ ID NO: 425372 - RNA, 19 nt, Homo sapiens
cuaaagaaguagcugauug

SEQ ID NO: 425373 - RNA, 19 nt, Homo sapiens
gggaagacuuucaaucaga

SEQ ID NO: 425374 - RNA, 19 nt, Homo sapiens
gaagggaccaaguauuaaa

SEQ ID NO: 425375 - RNA, 19 nt, Homo sapiens
gcaaguagcccugugagaa

SEQ ID NO: 425376 - RNA, 19 nt, Homo sapiens
ggaacaggauuuaaaagua

SEQ ID NO: 425377 - RNA, 19 nt, Homo sapiens
aaacagcuuuguacagaaa

SEQ ID NO: 425378 - RNA, 19 nt, Homo sapiens
gcauuuagcuguucguuuu

SEQ ID NO: 425379 - RNA, 19 nt, Homo sapiens
agaguggacugaaagauuu

SEQ ID NO: 425380 - RNA, 19 nt, Homo sapiens
gcgaagagaacaaguacua

SEQ ID NO: 425381 - RNA, 19 nt, Homo sapiens
gcaaagcuguauuaugaag

SEQ ID NO: 425382 - RNA, 19 nt, Homo sapiens
guagauuugucaacuagaa

SEQ ID NO: 425383 - RNA, 19 nt, Homo sapiens
gaagaaauaacuagcacaa

SEQ ID NO: 425384 - RNA, 19 nt, Homo sapiens
gaaaccgucuggagaauga

SEQ ID NO: 425385 - RNA, 19 nt, Homo sapiens
ggaagauucuggacccuaa

SEQ ID NO: 425386 - RNA, 19 nt, Homo sapiens
uaaaggagcugaacuuguc

SEQ ID NO: 425387 - RNA, 19 nt, Homo sapiens
gagcugaacuugucauucu

SEQ ID NO: 425388 - RNA, 19 nt, Homo sapiens
gacaacaccuucacugaga

SEQ ID NO: 425389 - RNA, 19 nt, Homo sapiens
gcaagagccucaaacucaa

SEQ ID NO: 425390 - RNA, 19 nt, Homo sapiens
gagaagaagucggaguuga

SEQ ID NO: 425391 - RNA, 19 nt, Homo sapiens
ggaagaagaggaagcagaa

SEQ ID NO: 425392 - RNA, 19 nt, Homo sapiens
gaacuugucauucugugaa

SEQ ID NO: 425393 - RNA, 19 nt, Homo sapiens
gaccgaaugucaccggaaa

SEQ ID NO: 425394 - RNA, 19 nt, Homo sapiens
gcacaugggucugcucaag

SEQ ID NO: 425395 - RNA, 19 nt, Homo sapiens
ggcaagagccucaaacuca

SEQ ID NO: 425396 - RNA, 19 nt, Homo sapiens
gcaagccucuggcccugaa

SEQ ID NO: 425397 - RNA, 19 nt, Homo sapiens
caagagcuccgugcugaua

SEQ ID NO: 425398 - RNA, 19 nt, Homo sapiens
ggaggaagaugaggaagag

SEQ ID NO: 425399 - RNA, 19 nt, Homo sapiens
ggaaggagaagaggaagaa

SEQ ID NO: 425400 - RNA, 19 nt, Homo sapiens
gguggucucugccuuccua

SEQ ID NO: 425401 - RNA, 19 nt, Homo sapiens
cuaaaggugucaucugugu

SEQ ID NO: 425402 - RNA, 19 nt, Homo sapiens
gcaacacccugggagaaga

SEQ ID NO: 425403 - RNA, 19 nt, Homo sapiens
ggaggaaggagaagaggaa

SEQ ID NO: 425404 - RNA, 19 nt, Homo sapiens
uggagaagcuggaccugaa

SEQ ID NO: 425405 - RNA, 19 nt, Homo sapiens
gcucaagagugaagacaag

SEQ ID NO: 425406 - RNA, 19 nt, Homo sapiens
uagaugcccugaugcagaa

SEQ ID NO: 425407 - RNA, 19 nt, Homo sapiens
agguggaggugauuaauuu

SEQ ID NO: 425408 - RNA, 19 nt, Homo sapiens
ggucaucgccaaggccuua

SEQ ID NO: 425409 - RNA, 19 nt, Homo sapiens
cagaagaugcuaaagaugu

SEQ ID NO: 425410 - RNA, 19 nt, Homo sapiens
gccaaggccuuagagaaga

SEQ ID NO: 425411 - RNA, 19 nt, Homo sapiens
gaacucaagcucaacaacu

SEQ ID NO: 425412 - RNA, 19 nt, Homo sapiens
ccaaggccuuagagaagaa

SEQ ID NO: 425413 - RNA, 19 nt, Homo sapiens
ugucaucuguguucaagga

SEQ ID NO: 425414 - RNA, 19 nt, Homo sapiens
acucaacacugcagaagau

SEQ ID NO: 425415 - RNA, 19 nt, Homo sapiens
ggaggaggaagaugaggaa

SEQ ID NO: 425416 - RNA, 19 nt, Homo sapiens
ugcagaagaugcuaaagau

SEQ ID NO: 425417 - RNA, 19 nt, Homo sapiens
ggacagcugaguuucaaag

SEQ ID NO: 425418 - RNA, 19 nt, Homo sapiens
ggaagaggaggaagaagag

SEQ ID NO: 425419 - RNA, 19 nt, Homo sapiens
agaagaugcuaaagaugug

SEQ ID NO: 425420 - RNA, 19 nt, Homo sapiens
ggaggaggaggaaggagaa

SEQ ID NO: 425421 - RNA, 19 nt, Homo sapiens
caaccacccuggcaucacu

SEQ ID NO: 425422 - RNA, 19 nt, Homo sapiens
cugcagcucugaccgaaug

SEQ ID NO: 425423 - RNA, 19 nt, Homo sapiens
caacacagugggcguggaa

SEQ ID NO: 425424 - RNA, 19 nt, Homo sapiens
gaagaagucggaguugaag

SEQ ID NO: 425425 - RNA, 19 nt, Homo sapiens
gcagaagaugcuaaagaug

SEQ ID NO: 425426 - RNA, 19 nt, Homo sapiens
ugcaguagaugcccugaug

SEQ ID NO: 425427 - RNA, 19 nt, Homo sapiens
agaagaagucggaguugaa

SEQ ID NO: 425428 - RNA, 19 nt, Homo sapiens
gcuaaaggagcugaacuug

SEQ ID NO: 425429 - RNA, 19 nt, Homo sapiens
gaugcuaaagaugugauua

SEQ ID NO: 425430 - RNA, 19 nt, Homo sapiens
gggagaagaaggcugugaa

SEQ ID NO: 425431 - RNA, 19 nt, Homo sapiens
agaagaggaagcagaagaa

SEQ ID NO: 425432 - RNA, 19 nt, Homo sapiens
cggaagacauugccaagcu

SEQ ID NO: 425433 - RNA, 19 nt, Homo sapiens
aagaagaggaggaggaaga

SEQ ID NO: 425434 - RNA, 19 nt, Homo sapiens
caagggugcaguugccauu

SEQ ID NO: 425435 - RNA, 19 nt, Homo sapiens
uagagaagaagucggaguu

SEQ ID NO: 425436 - RNA, 19 nt, Homo sapiens
ggugucaucuguguucaag

SEQ ID NO: 425437 - RNA, 19 nt, Homo sapiens
ggaagcagccagggucauc

SEQ ID NO: 425438 - RNA, 19 nt, Homo sapiens
cugcagacgucuccaccuu

SEQ ID NO: 425439 - RNA, 19 nt, Homo sapiens
ggaggaggaggaggaagaa

SEQ ID NO: 425440 - RNA, 19 nt, Homo sapiens
gaagaugcuaaagauguga

SEQ ID NO: 425441 - RNA, 19 nt, Homo sapiens
aagaggaggaggaagauga

SEQ ID NO: 425442 - RNA, 19 nt, Homo sapiens
caacagcgcccuggaaucc

SEQ ID NO: 425443 - RNA, 19 nt, Homo sapiens
ugauggcgcugaaccacau

SEQ ID NO: 425444 - RNA, 19 nt, Homo sapiens
gaaugucaccggaaaucca

SEQ ID NO: 425445 - RNA, 19 nt, Homo sapiens
gcugguggagcuggacuua

SEQ ID NO: 425446 - RNA, 19 nt, Homo sapiens
uccuaaaggugucaucugu

SEQ ID NO: 425447 - RNA, 19 nt, Homo sapiens
gcuaaagaugugauuaaag

SEQ ID NO: 425448 - RNA, 19 nt, Homo sapiens
uggcgucccucagugauga

SEQ ID NO: 425449 - RNA, 19 nt, Homo sapiens
gagaagaaggcugugaaca

SEQ ID NO: 425450 - RNA, 19 nt, Homo sapiens
caacacccugggagaagaa

SEQ ID NO: 425451 - RNA, 19 nt, Homo sapiens
caccagcccugaucucacu

SEQ ID NO: 425452 - RNA, 19 nt, Homo sapiens
aaaggugucaucuguguuc

SEQ ID NO: 425453 - RNA, 19 nt, Homo sapiens
caaacucaacacugcagaa

SEQ ID NO: 425454 - RNA, 19 nt, Homo sapiens
ggaggaggaggaagaagag

SEQ ID NO: 425455 - RNA, 19 nt, Homo sapiens
gcuggagggcuucaacaug

SEQ ID NO: 425456 - RNA, 19 nt, Homo sapiens
gagaagcuggaccugaaug

SEQ ID NO: 425457 - RNA, 19 nt, Homo sapiens
gcaguugccauugcagaug

SEQ ID NO: 425458 - RNA, 19 nt, Homo sapiens
ugcaggaacucaagcucaa

SEQ ID NO: 425459 - RNA, 19 nt, Homo sapiens
ugguggagcuggacuuaag

SEQ ID NO: 425460 - RNA, 19 nt, Homo sapiens
ugcagacgcuguacaaggu

SEQ ID NO: 425461 - RNA, 19 nt, Homo sapiens
uugaagacuuugacagcuu

SEQ ID NO: 425462 - RNA, 19 nt, Homo sapiens
gaagaggaagcagaagaag

SEQ ID NO: 425463 - RNA, 19 nt, Homo sapiens
agaagaggaagaagaggaa

SEQ ID NO: 425464 - RNA, 19 nt, Homo sapiens
ggaggaggaaggagaagag

SEQ ID NO: 425465 - RNA, 19 nt, Homo sapiens
ggagaagcuggaccugaau

SEQ ID NO: 425466 - RNA, 19 nt, Homo sapiens
gucauucugugaaaucaag

SEQ ID NO: 425467 - RNA, 19 nt, Homo sapiens
acaacaccuucacugagaa

SEQ ID NO: 425468 - RNA, 19 nt, Homo sapiens
ugauagcccagcagacuga

SEQ ID NO: 425469 - RNA, 19 nt, Homo sapiens
agaggaagcagaagaagag

SEQ ID NO: 425470 - RNA, 19 nt, Homo sapiens
cuaaaggagcugaacuugu

SEQ ID NO: 425471 - RNA, 19 nt, Homo sapiens
cugcagaagaugcuaaaga

SEQ ID NO: 425472 - RNA, 19 nt, Homo sapiens
ugggucugcucaagaguga

SEQ ID NO: 425473 - RNA, 19 nt, Homo sapiens
ugaggaagaggaggaagaa

SEQ ID NO: 425474 - RNA, 19 nt, Homo sapiens
aagaagaggaagcagaaga

SEQ ID NO: 425475 - RNA, 19 nt, Homo sapiens
cagguggaggugauuaauu

SEQ ID NO: 425476 - RNA, 19 nt, Homo sapiens
gcagguggaggugauuaau

SEQ ID NO: 425477 - RNA, 19 nt, Homo sapiens
ggucucugccuuccuaaag

SEQ ID NO: 425478 - RNA, 19 nt, Homo sapiens
aggaagaggaggaagaaga

SEQ ID NO: 425479 - RNA, 19 nt, Homo sapiens
gaagaggaggaggaagaug

SEQ ID NO: 425480 - RNA, 19 nt, Homo sapiens
gauuaaagagauugaagac

SEQ ID NO: 425481 - RNA, 19 nt, Homo sapiens
uggugcagcaggacuauuu

SEQ ID NO: 425482 - RNA, 19 nt, Homo sapiens
ggagaagaaggcugugaac

SEQ ID NO: 425483 - RNA, 19 nt, Homo sapiens
acaugggucugcucaagag

SEQ ID NO: 425484 - RNA, 19 nt, Homo sapiens
gaagaacuguugccuaauu

SEQ ID NO: 425485 - RNA, 19 nt, Homo sapiens
gauagaagauuccuacaga

SEQ ID NO: 425486 - RNA, 19 nt, Homo sapiens
gaacagauuuuacggguua

SEQ ID NO: 425487 - RNA, 19 nt, Homo sapiens
ggaauaucaucugucauua

SEQ ID NO: 425488 - RNA, 19 nt, Homo sapiens
gagaagagcaaagaaguua

SEQ ID NO: 425489 - RNA, 19 nt, Homo sapiens
gaagauguuccaaugauuu

SEQ ID NO: 425490 - RNA, 19 nt, Homo sapiens
cagaagaucgucaguauuu

SEQ ID NO: 425491 - RNA, 19 nt, Homo sapiens
aaacugggauaacugauuu

SEQ ID NO: 425492 - RNA, 19 nt, Homo sapiens
gaagaucgucaguauuuaa

SEQ ID NO: 425493 - RNA, 19 nt, Homo sapiens
caauaaaugugaccuggaa

SEQ ID NO: 425494 - RNA, 19 nt, Homo sapiens
gcaaugagggauuuguaua

SEQ ID NO: 425495 - RNA, 19 nt, Homo sapiens
gcaaagaaguuaaaagaga

SEQ ID NO: 425496 - RNA, 19 nt, Homo sapiens
ccugagaccuccauuuauu

SEQ ID NO: 425497 - RNA, 19 nt, Homo sapiens
gaagagcaaagaaguuaaa

SEQ ID NO: 425498 - RNA, 19 nt, Homo sapiens
ugggauaacugauuucuau

SEQ ID NO: 425499 - RNA, 19 nt, Homo sapiens
caauagcaguuauaacaga

SEQ ID NO: 425500 - RNA, 19 nt, Homo sapiens
gcaaagagcagggccagaa

SEQ ID NO: 425501 - RNA, 19 nt, Homo sapiens
gcagggacagagcaauuua

SEQ ID NO: 425502 - RNA, 19 nt, Homo sapiens
ucagacagauaaauaggaa

SEQ ID NO: 425503 - RNA, 19 nt, Homo sapiens
gcaagacagugguguaacu

SEQ ID NO: 425504 - RNA, 19 nt, Homo sapiens
gaucgucaguauuuaaaca

SEQ ID NO: 425505 - RNA, 19 nt, Homo sapiens
augaagaacuguugccuaa

SEQ ID NO: 425506 - RNA, 19 nt, Homo sapiens
aaugugaccuggaagauga

SEQ ID NO: 425507 - RNA, 19 nt, Homo sapiens
gaagucugcucugacaguu

SEQ ID NO: 425508 - RNA, 19 nt, Homo sapiens
gaagauuccuacagaaagc

SEQ ID NO: 425509 - RNA, 19 nt, Homo sapiens
gaaacucauugcagcagau

SEQ ID NO: 425510 - RNA, 19 nt, Homo sapiens
gagcagggccagaauuuag

SEQ ID NO: 425511 - RNA, 19 nt, Homo sapiens
gaagaugagcgaguaguug

SEQ ID NO: 425512 - RNA, 19 nt, Homo sapiens
aaucaugucugcugcucua

SEQ ID NO: 425513 - RNA, 19 nt, Homo sapiens
acucuaauauugcuucuug

SEQ ID NO: 425514 - RNA, 19 nt, Homo sapiens
gaucuuauauugguuugca

SEQ ID NO: 425515 - RNA, 19 nt, Homo sapiens
gaaaagaagaagccuaaaa

SEQ ID NO: 425516 - RNA, 19 nt, Homo sapiens
ugagggauuuguauaugaa

SEQ ID NO: 425517 - RNA, 19 nt, Homo sapiens
uuacagcaaugagggauuu

SEQ ID NO: 425518 - RNA, 19 nt, Homo sapiens
gcgaguaguuggcaaagag

SEQ ID NO: 425519 - RNA, 19 nt, Homo sapiens
ggaagagucagcagaagau

SEQ ID NO: 425520 - RNA, 19 nt, Homo sapiens
uauggaauaucaucuguca

SEQ ID NO: 425521 - RNA, 19 nt, Homo sapiens
gcacaaguucccuggagaa

SEQ ID NO: 425522 - RNA, 19 nt, Homo sapiens
agaagaucgucaguauuua

SEQ ID NO: 425523 - RNA, 19 nt, Homo sapiens
caaagucaaagaucaaugu

SEQ ID NO: 425524 - RNA, 19 nt, Homo sapiens
gcaagucgagggccgugua

SEQ ID NO: 425525 - RNA, 19 nt, Homo sapiens
uggaauaucaucugucauu

SEQ ID NO: 425526 - RNA, 19 nt, Homo sapiens
ggaagaugagcgaguaguu

SEQ ID NO: 425527 - RNA, 19 nt, Homo sapiens
gagcaaagaaguuaaaaga

SEQ ID NO: 425528 - RNA, 19 nt, Homo sapiens
gaccugagggaacagauuu

SEQ ID NO: 425529 - RNA, 19 nt, Homo sapiens
gcaguuauaacagauguga

SEQ ID NO: 425530 - RNA, 19 nt, Homo sapiens
gaacuguugccuaauugga

SEQ ID NO: 425531 - RNA, 19 nt, Homo sapiens
uuacaggaaugaagaacug

SEQ ID NO: 425532 - RNA, 19 nt, Homo sapiens
gaagaacggccaagguuuu

SEQ ID NO: 425533 - RNA, 19 nt, Homo sapiens
caaugagggauuuguauau

SEQ ID NO: 425534 - RNA, 19 nt, Homo sapiens
uagaagauuccuacagaaa

SEQ ID NO: 425535 - RNA, 19 nt, Homo sapiens
gcagaagaucgucaguauu

SEQ ID NO: 425536 - RNA, 19 nt, Homo sapiens
gggccagaauuuagcaaga

SEQ ID NO: 425537 - RNA, 19 nt, Homo sapiens
ugccugagaccuccauuua

SEQ ID NO: 425538 - RNA, 19 nt, Homo sapiens
ccuggaagaugagcgagua

SEQ ID NO: 425539 - RNA, 19 nt, Homo sapiens
acagagcaauuuacagcaa

SEQ ID NO: 425540 - RNA, 19 nt, Homo sapiens
ggaggagagaaaugaaauu

SEQ ID NO: 425541 - RNA, 19 nt, Homo sapiens
acagcucaguccacguuua

SEQ ID NO: 425542 - RNA, 19 nt, Homo sapiens
gaagucgauugccaacagu

SEQ ID NO: 425543 - RNA, 19 nt, Homo sapiens
cuacagaaagcaaguugaa

SEQ ID NO: 425544 - RNA, 19 nt, Homo sapiens
gaaacacuggcggcacaua

SEQ ID NO: 425545 - RNA, 19 nt, Homo sapiens
ggaaaacaccaguggaaaa

SEQ ID NO: 425546 - RNA, 19 nt, Homo sapiens
ugaagucgauugccaacag

SEQ ID NO: 425547 - RNA, 19 nt, Homo sapiens
cagcucaguccacguuuaa

SEQ ID NO: 425548 - RNA, 19 nt, Homo sapiens
agcagaagaucgucaguau

SEQ ID NO: 425549 - RNA, 19 nt, Homo sapiens
cauugcagcagauaacuuu

SEQ ID NO: 425550 - RNA, 19 nt, Homo sapiens
guguauaucucuuggaaaa

SEQ ID NO: 425551 - RNA, 19 nt, Homo sapiens
ugaagaacggccaagguuu

SEQ ID NO: 425552 - RNA, 19 nt, Homo sapiens
aaagcaaguugaagucgau

SEQ ID NO: 425553 - RNA, 19 nt, Homo sapiens
ggaagucugcucugacagu

SEQ ID NO: 425554 - RNA, 19 nt, Homo sapiens
cgagggccguguaggaguu

SEQ ID NO: 425555 - RNA, 19 nt, Homo sapiens
ugcaauagcaguuauaaca

SEQ ID NO: 425556 - RNA, 19 nt, Homo sapiens
uauauugguuugcacaagu

SEQ ID NO: 425557 - RNA, 19 nt, Homo sapiens
aagaacuguugccuaauug

SEQ ID NO: 425558 - RNA, 19 nt, Homo sapiens
cagcuuuuauggaugauua

SEQ ID NO: 425559 - RNA, 19 nt, Homo sapiens
ggaccugagggaacagauu

SEQ ID NO: 425560 - RNA, 19 nt, Homo sapiens
cagcaaugagggauuugua

SEQ ID NO: 425561 - RNA, 19 nt, Homo sapiens
ggauaacugauuucuaugg

SEQ ID NO: 425562 - RNA, 19 nt, Homo sapiens
cgagaagagcaaagaaguu

SEQ ID NO: 425563 - RNA, 19 nt, Homo sapiens
cagauuacaggaaugaaga

SEQ ID NO: 425564 - RNA, 19 nt, Homo sapiens
aaugagggauuuguauaug

SEQ ID NO: 425565 - RNA, 19 nt, Homo sapiens
caacaguguaugcucgaaa

SEQ ID NO: 425566 - RNA, 19 nt, Homo sapiens
aaauaugacccaacgauag

SEQ ID NO: 425567 - RNA, 19 nt, Homo sapiens
gcgagaagagcaaagaagu

SEQ ID NO: 425568 - RNA, 19 nt, Homo sapiens
cagcauuccagacuucaaa

SEQ ID NO: 425569 - RNA, 19 nt, Homo sapiens
gcaaagucaaagaucaaug

SEQ ID NO: 425570 - RNA, 19 nt, Homo sapiens
uaaggacacggaagauguu

SEQ ID NO: 425571 - RNA, 19 nt, Homo sapiens
guugggaagucugcucuga

SEQ ID NO: 425572 - RNA, 19 nt, Homo sapiens
aagagcagggccagaauuu

SEQ ID NO: 425573 - RNA, 19 nt, Homo sapiens
ugauuucuauggcuuucaa

SEQ ID NO: 425574 - RNA, 19 nt, Homo sapiens
gcaauagcaguuauaacag

SEQ ID NO: 425575 - RNA, 19 nt, Homo sapiens
ugagccagauuacaggaau

SEQ ID NO: 425576 - RNA, 19 nt, Homo sapiens
uagcaagacagugguguaa

SEQ ID NO: 425577 - RNA, 19 nt, Homo sapiens
ugagaccuccauuuauuug

SEQ ID NO: 425578 - RNA, 19 nt, Homo sapiens
cagagcaauuuacagcaau

SEQ ID NO: 425579 - RNA, 19 nt, Homo sapiens
auagaagauuccuacagaa

SEQ ID NO: 425580 - RNA, 19 nt, Homo sapiens
cagcagaagaucgucagua

SEQ ID NO: 425581 - RNA, 19 nt, Homo sapiens
uaugaaauguccccugaaa

SEQ ID NO: 425582 - RNA, 19 nt, Homo sapiens
gagccagauuacaggaaug

SEQ ID NO: 425583 - RNA, 19 nt, Homo sapiens
aaacaccaguggaaaagaa

SEQ ID NO: 425584 - RNA, 19 nt, Homo sapiens
gaacaacugugcauucuua

SEQ ID NO: 425585 - RNA, 19 nt, Homo sapiens
uaacuucgcuucuuugaua

SEQ ID NO: 425586 - RNA, 19 nt, Homo sapiens
ccaaagagcuccuauauag

SEQ ID NO: 425587 - RNA, 19 nt, Homo sapiens
gaacagauucuucgaguua

SEQ ID NO: 425588 - RNA, 19 nt, Homo sapiens
gaugaaagcuacuauauca

SEQ ID NO: 425589 - RNA, 19 nt, Homo sapiens
gaagaacuguugcccaauu

SEQ ID NO: 425590 - RNA, 19 nt, Homo sapiens
caugucagcugcuuuaaua

SEQ ID NO: 425591 - RNA, 19 nt, Homo sapiens
gaggcuacauccaguauua

SEQ ID NO: 425592 - RNA, 19 nt, Homo sapiens
gauaguccuuucaguauaa

SEQ ID NO: 425593 - RNA, 19 nt, Homo sapiens
gaaagcaaguugaaguaga

SEQ ID NO: 425594 - RNA, 19 nt, Homo sapiens
uaaagacacugaugauguu

SEQ ID NO: 425595 - RNA, 19 nt, Homo sapiens
ggacaaggauuugcauuag

SEQ ID NO: 425596 - RNA, 19 nt, Homo sapiens
gcauuaauguuuggaugua

SEQ ID NO: 425597 - RNA, 19 nt, Homo sapiens
gaaagcuacuauaucaguu

SEQ ID NO: 425598 - RNA, 19 nt, Homo sapiens
cagauaacuucgcuucuuu

SEQ ID NO: 425599 - RNA, 19 nt, Homo sapiens
ggacuuuccugugguggua

SEQ ID NO: 425600 - RNA, 19 nt, Homo sapiens
aaggaaauguccagacuuu

SEQ ID NO: 425601 - RNA, 19 nt, Homo sapiens
ggaaggaaauguccagacu

SEQ ID NO: 425602 - RNA, 19 nt, Homo sapiens
ucuaaucacuuuccaguau

SEQ ID NO: 425603 - RNA, 19 nt, Homo sapiens
gaccuagugcggcaaauua

SEQ ID NO: 425604 - RNA, 19 nt, Homo sapiens
caaugauucuuguugguaa

SEQ ID NO: 425605 - RNA, 19 nt, Homo sapiens
guuaaaugguggacgagua

SEQ ID NO: 425606 - RNA, 19 nt, Homo sapiens
ggaacaaggucaaaaucua

SEQ ID NO: 425607 - RNA, 19 nt, Homo sapiens
acaaggauuugcauuaguu

SEQ ID NO: 425608 - RNA, 19 nt, Homo sapiens
gcaggaacggagcaauuua

SEQ ID NO: 425609 - RNA, 19 nt, Homo sapiens
ccagauaacuucgcuucuu

SEQ ID NO: 425610 - RNA, 19 nt, Homo sapiens
ugauaguccuuucaguaua

SEQ ID NO: 425611 - RNA, 19 nt, Homo sapiens
acggugaucuugucuuuaa

SEQ ID NO: 425612 - RNA, 19 nt, Homo sapiens
gguguacuguauacuuuaa

SEQ ID NO: 425613 - RNA, 19 nt, Homo sapiens
caucaugucagcugcuuua

SEQ ID NO: 425614 - RNA, 19 nt, Homo sapiens
gcaagacaauggaacaacu

SEQ ID NO: 425615 - RNA, 19 nt, Homo sapiens
uaaauugaccaaccuaaug

SEQ ID NO: 425616 - RNA, 19 nt, Homo sapiens
guaaagauugugugucuau

SEQ ID NO: 425617 - RNA, 19 nt, Homo sapiens
gacguugccuuuaauaucu

SEQ ID NO: 425618 - RNA, 19 nt, Homo sapiens
caugauaguccuuucagua

SEQ ID NO: 425619 - RNA, 19 nt, Homo sapiens
ugaaguagaugcacaacag

SEQ ID NO: 425620 - RNA, 19 nt, Homo sapiens
guccacauuuaacgauuua

SEQ ID NO: 425621 - RNA, 19 nt, Homo sapiens
cagcacaguccacauuuaa

SEQ ID NO: 425622 - RNA, 19 nt, Homo sapiens
acagcacaguccacauuua

SEQ ID NO: 425623 - RNA, 19 nt, Homo sapiens
aaugagggauuuauacaug

SEQ ID NO: 425624 - RNA, 19 nt, Homo sapiens
uuacagcaaugagggauuu

SEQ ID NO: 425625 - RNA, 19 nt, Homo sapiens
gcauaaguguauuugcaau

SEQ ID NO: 425626 - RNA, 19 nt, Homo sapiens
gugagagguucgcagagua

SEQ ID NO: 425627 - RNA, 19 nt, Homo sapiens
gcaaugagggauuuauaca

SEQ ID NO: 425628 - RNA, 19 nt, Homo sapiens
aaaauacgauccuacgaua

SEQ ID NO: 425629 - RNA, 19 nt, Homo sapiens
gaaaaugguguacuguaua

SEQ ID NO: 425630 - RNA, 19 nt, Homo sapiens
gcaccacuauuuuagcaua

SEQ ID NO: 425631 - RNA, 19 nt, Homo sapiens
uauaucaguuugcacauuc

SEQ ID NO: 425632 - RNA, 19 nt, Homo sapiens
cuaccaacaucuuaaaugg

SEQ ID NO: 425633 - RNA, 19 nt, Homo sapiens
aaagcaaguugaaguagau

SEQ ID NO: 425634 - RNA, 19 nt, Homo sapiens
caaccuaauguuacaacua

SEQ ID NO: 425635 - RNA, 19 nt, Homo sapiens
ugaccaaccuaauguuaca

SEQ ID NO: 425636 - RNA, 19 nt, Homo sapiens
ggagcaauuuacagcaaug

SEQ ID NO: 425637 - RNA, 19 nt, Homo sapiens
ucacaaggccuaauuugca

SEQ ID NO: 425638 - RNA, 19 nt, Homo sapiens
ggacgaguacuguggaugu

SEQ ID NO: 425639 - RNA, 19 nt, Homo sapiens
gauuaacacagcuauauag

SEQ ID NO: 425640 - RNA, 19 nt, Homo sapiens
cagcugcuuuaauauacua

SEQ ID NO: 425641 - RNA, 19 nt, Homo sapiens
ggaagaugaaagaguugua

SEQ ID NO: 425642 - RNA, 19 nt, Homo sapiens
ucacagcacaguccacauu

SEQ ID NO: 425643 - RNA, 19 nt, Homo sapiens
cagcaaugagggauuuaua

SEQ ID NO: 425644 - RNA, 19 nt, Homo sapiens
cagcauuccaacuuuguua

SEQ ID NO: 425645 - RNA, 19 nt, Homo sapiens
gugccagcauuccaacuuu

SEQ ID NO: 425646 - RNA, 19 nt, Homo sapiens
uagaaagcaaguugaagua

SEQ ID NO: 425647 - RNA, 19 nt, Homo sapiens
ugucagcugcuuuaauaua

SEQ ID NO: 425648 - RNA, 19 nt, Homo sapiens
gacaaggauuugcauuagu

SEQ ID NO: 425649 - RNA, 19 nt, Homo sapiens
caacaguguaugcuugaaa

SEQ ID NO: 425650 - RNA, 19 nt, Homo sapiens
guggccaaauguaaacuaa

SEQ ID NO: 425651 - RNA, 19 nt, Homo sapiens
uuucacauguguaacguuu

SEQ ID NO: 425652 - RNA, 19 nt, Homo sapiens
gauaacuucgcuucuuuga

SEQ ID NO: 425653 - RNA, 19 nt, Homo sapiens
guccaaagagcuccuauau

SEQ ID NO: 425654 - RNA, 19 nt, Homo sapiens
gaacuguugcccaauucaa

SEQ ID NO: 425655 - RNA, 19 nt, Homo sapiens
cuuggaagaugaaagaguu

SEQ ID NO: 425656 - RNA, 19 nt, Homo sapiens
ggccaaauguaaacuaaaa

SEQ ID NO: 425657 - RNA, 19 nt, Homo sapiens
uauagacuacuccagauaa

SEQ ID NO: 425658 - RNA, 19 nt, Homo sapiens
ccuaaaagcaccacuauuu

SEQ ID NO: 425659 - RNA, 19 nt, Homo sapiens
ugacuuggaagaugaaaga

SEQ ID NO: 425660 - RNA, 19 nt, Homo sapiens
uuaaagacacugaugaugu

SEQ ID NO: 425661 - RNA, 19 nt, Homo sapiens
uugacaagcuugcaucaug

SEQ ID NO: 425662 - RNA, 19 nt, Homo sapiens
cgaguacuguggaugugaa

SEQ ID NO: 425663 - RNA, 19 nt, Homo sapiens
gcucaugcauaaguguauu

SEQ ID NO: 425664 - RNA, 19 nt, Homo sapiens
caaagagcuccuauauaga

SEQ ID NO: 425665 - RNA, 19 nt, Homo sapiens
ugcuuugacuguacaauuu

SEQ ID NO: 425666 - RNA, 19 nt, Homo sapiens
ggaugaaagcuacuauauc

SEQ ID NO: 425667 - RNA, 19 nt, Homo sapiens
gcauuaguuuauuccauca

SEQ ID NO: 425668 - RNA, 19 nt, Homo sapiens
uggacaaggauuugcauua

SEQ ID NO: 425669 - RNA, 19 nt, Homo sapiens
gcaguaacuauugcuguuu

SEQ ID NO: 425670 - RNA, 19 nt, Homo sapiens
gugaaugugggaaguaauu

SEQ ID NO: 425671 - RNA, 19 nt, Homo sapiens
gaaggaaauguccagacuu

SEQ ID NO: 425672 - RNA, 19 nt, Homo sapiens
ugagggauuuauacaugaa

SEQ ID NO: 425673 - RNA, 19 nt, Homo sapiens
ggucacaaggccuaauuug

SEQ ID NO: 425674 - RNA, 19 nt, Homo sapiens
uaauaucuguugggaagga

SEQ ID NO: 425675 - RNA, 19 nt, Homo sapiens
ggugacagcgugagagguu

SEQ ID NO: 425676 - RNA, 19 nt, Homo sapiens
aaaccuaccaacaucuuaa

SEQ ID NO: 425677 - RNA, 19 nt, Homo sapiens
uaaaccuaccaacaucuua

SEQ ID NO: 425678 - RNA, 19 nt, Homo sapiens
gaagaugaaagaguuguag

SEQ ID NO: 425679 - RNA, 19 nt, Homo sapiens
uauauagacuacuccagau

SEQ ID NO: 425680 - RNA, 19 nt, Homo sapiens
gcauuccaacuuuguuaaa

SEQ ID NO: 425681 - RNA, 19 nt, Homo sapiens
gaugauguuccaaugauuc

SEQ ID NO: 425682 - RNA, 19 nt, Homo sapiens
gaguuaaagacacugauga

SEQ ID NO: 425683 - RNA, 19 nt, Homo sapiens
uacaagaccugagagaaca

SEQ ID NO: 425684 - RNA, 19 nt, Homo sapiens
gcaaggagcauuucaauua

SEQ ID NO: 425685 - RNA, 19 nt, Homo sapiens
gaacacagaucuauuugag

SEQ ID NO: 425686 - RNA, 19 nt, Homo sapiens
ugacaaagcugaucaaugc

SEQ ID NO: 425687 - RNA, 19 nt, Homo sapiens
gagcaugucaucagcaaua

SEQ ID NO: 425688 - RNA, 19 nt, Homo sapiens
gggcaugucugcuacaaau

SEQ ID NO: 425689 - RNA, 19 nt, Homo sapiens
caaggcggcuggaauauca

SEQ ID NO: 425690 - RNA, 19 nt, Homo sapiens
gcugaucaaugcugaauau

SEQ ID NO: 425691 - RNA, 19 nt, Homo sapiens
gcacuucccucaggcacua

SEQ ID NO: 425692 - RNA, 19 nt, Homo sapiens
acaaggagaucauguuuca

SEQ ID NO: 425693 - RNA, 19 nt, Homo sapiens
gagaugaugugcccuucuu

SEQ ID NO: 425694 - RNA, 19 nt, Homo sapiens
gaagcaggauggaugaaca

SEQ ID NO: 425695 - RNA, 19 nt, Homo sapiens
gcauuucaauuacuacuca

SEQ ID NO: 425696 - RNA, 19 nt, Homo sapiens
cuacaaauggacaagauua

SEQ ID NO: 425697 - RNA, 19 nt, Homo sapiens
gagcaucccucuggacuca

SEQ ID NO: 425698 - RNA, 19 nt, Homo sapiens
gaacaaggugggagagaga

SEQ ID NO: 425699 - RNA, 19 nt, Homo sapiens
caaggaggaugugauaugu

SEQ ID NO: 425700 - RNA, 19 nt, Homo sapiens
uggcaaaguugguguguga

SEQ ID NO: 425701 - RNA, 19 nt, Homo sapiens
ugaagacugugauuacaug

SEQ ID NO: 425702 - RNA, 19 nt, Homo sapiens
ggagagagaguuugagaca

SEQ ID NO: 425703 - RNA, 19 nt, Homo sapiens
acacaugacagacaaguaa

SEQ ID NO: 425704 - RNA, 19 nt, Homo sapiens
cagaggcgcucaaggacuu

SEQ ID NO: 425705 - RNA, 19 nt, Homo sapiens
ggccaaggcggcuggaaua

SEQ ID NO: 425706 - RNA, 19 nt, Homo sapiens
ggaguuccuugaauuucuu

SEQ ID NO: 425707 - RNA, 19 nt, Homo sapiens
ucaccgaguucccuaaugu

SEQ ID NO: 425708 - RNA, 19 nt, Homo sapiens
caaaguuggugugugaaga

SEQ ID NO: 425709 - RNA, 19 nt, Homo sapiens
caaggagcauuucaauuac

SEQ ID NO: 425710 - RNA, 19 nt, Homo sapiens
uggacaagauuauuucaga

SEQ ID NO: 425711 - RNA, 19 nt, Homo sapiens
gguccugguuuccaauuug

SEQ ID NO: 425712 - RNA, 19 nt, Homo sapiens
gagaacucauccacucaga

SEQ ID NO: 425713 - RNA, 19 nt, Homo sapiens
cuacaaggcagagaaguuu

SEQ ID NO: 425714 - RNA, 19 nt, Homo sapiens
caauguggaucgguucuau

SEQ ID NO: 425715 - RNA, 19 nt, Homo sapiens
gagcagaugaggccacaga

SEQ ID NO: 425716 - RNA, 19 nt, Homo sapiens
uacaggaggugcaggagaa

SEQ ID NO: 425717 - RNA, 19 nt, Homo sapiens
caucguggcuguggucuuc

SEQ ID NO: 425718 - RNA, 19 nt, Homo sapiens
ccaccaagcugccauacac

SEQ ID NO: 425719 - RNA, 19 nt, Homo sapiens
ucaaacugcaggacuuuaa

SEQ ID NO: 425720 - RNA, 19 nt, Homo sapiens
caccuugucuucucacuca

SEQ ID NO: 425721 - RNA, 19 nt, Homo sapiens
gaggaggacuacauuccau

SEQ ID NO: 425722 - RNA, 19 nt, Homo sapiens
gcugggagcccuugugugu

SEQ ID NO: 425723 - RNA, 19 nt, Homo sapiens
gucgguaacaguuguauaa

SEQ ID NO: 425724 - RNA, 19 nt, Homo sapiens
acaugcaccugccuuagaa

SEQ ID NO: 425725 - RNA, 19 nt, Homo sapiens
agaggucacugaagacugu

SEQ ID NO: 425726 - RNA, 19 nt, Homo sapiens
ggaugucgguaacaguugu

SEQ ID NO: 425727 - RNA, 19 nt, Homo sapiens
gaugaugugcccuucuuug

SEQ ID NO: 425728 - RNA, 19 nt, Homo sapiens
caaguuuggcgucauuuau

SEQ ID NO: 425729 - RNA, 19 nt, Homo sapiens
aaacagaggaggacuacau

SEQ ID NO: 425730 - RNA, 19 nt, Homo sapiens
ggaccaagugccggacaua

SEQ ID NO: 425731 - RNA, 19 nt, Homo sapiens
ccacugcagucgcccacaa

SEQ ID NO: 425732 - RNA, 19 nt, Homo sapiens
ccgaaucuguguacugcaa

SEQ ID NO: 425733 - RNA, 19 nt, Homo sapiens
gaacucuucagcaccaaug

SEQ ID NO: 425734 - RNA, 19 nt, Homo sapiens
caucagcaauaacuucaag

SEQ ID NO: 425735 - RNA, 19 nt, Homo sapiens
gagaugcccacgaccaaga

SEQ ID NO: 425736 - RNA, 19 nt, Homo sapiens
gcuacaaggcagagaaguu

SEQ ID NO: 425737 - RNA, 19 nt, Homo sapiens
ucaaguuuggcgucauuua

SEQ ID NO: 425738 - RNA, 19 nt, Homo sapiens
cgagaccucugcccugaag

SEQ ID NO: 425739 - RNA, 19 nt, Homo sapiens
gcacaucgggaacgacauc

SEQ ID NO: 425740 - RNA, 19 nt, Homo sapiens
ccucugcccugaagaccaa

SEQ ID NO: 425741 - RNA, 19 nt, Homo sapiens
gggacuccuucaucuauag

SEQ ID NO: 425742 - RNA, 19 nt, Homo sapiens
cgggacuccuucaucuaua

SEQ ID NO: 425743 - RNA, 19 nt, Homo sapiens
gcgggacuccuucaucuau

SEQ ID NO: 425744 - RNA, 19 nt, Homo sapiens
acaaggaggaugugauaug

SEQ ID NO: 425745 - RNA, 19 nt, Homo sapiens
cuccuucacucuacccuaa

SEQ ID NO: 425746 - RNA, 19 nt, Homo sapiens
caugaucgcguccaacuuc

SEQ ID NO: 425747 - RNA, 19 nt, Homo sapiens
ucagccagcacccagcuua

SEQ ID NO: 425748 - RNA, 19 nt, Homo sapiens
cuucaaguuuggcgucauu

SEQ ID NO: 425749 - RNA, 19 nt, Homo sapiens
cgaguucccuaauguuguc

SEQ ID NO: 425750 - RNA, 19 nt, Homo sapiens
aggagcauuucaauuacua

SEQ ID NO: 425751 - RNA, 19 nt, Homo sapiens
ccuaagaacacagaucuau

SEQ ID NO: 425752 - RNA, 19 nt, Homo sapiens
cuaagaacacagaucuauu

SEQ ID NO: 425753 - RNA, 19 nt, Homo sapiens
ggucaaacugcaggacuuu

SEQ ID NO: 425754 - RNA, 19 nt, Homo sapiens
ggaccgaaucuguguacug

SEQ ID NO: 425755 - RNA, 19 nt, Homo sapiens
ugagaugauugagaagaug

SEQ ID NO: 425756 - RNA, 19 nt, Homo sapiens
ucguggaguuccuugaauu

SEQ ID NO: 425757 - RNA, 19 nt, Homo sapiens
gcaugucugcuacaaaugg

SEQ ID NO: 425758 - RNA, 19 nt, Homo sapiens
ggguccugguuuccaauuu

SEQ ID NO: 425759 - RNA, 19 nt, Homo sapiens
ggugggagagagaguuuga

SEQ ID NO: 425760 - RNA, 19 nt, Homo sapiens
aggacaagauggagaaugg

SEQ ID NO: 425761 - RNA, 19 nt, Homo sapiens
ccacagccaguccaugaug

SEQ ID NO: 425762 - RNA, 19 nt, Homo sapiens
ggagacgcucuaugaggaa

SEQ ID NO: 425763 - RNA, 19 nt, Homo sapiens
ugaauaugccugcuacaag

SEQ ID NO: 425764 - RNA, 19 nt, Homo sapiens
gcaacuuccgcaacaagga

SEQ ID NO: 425765 - RNA, 19 nt, Homo sapiens
ggcaaggagcauuucaauu

SEQ ID NO: 425766 - RNA, 19 nt, Homo sapiens
uuaguucccuccuauacuc

SEQ ID NO: 425767 - RNA, 19 nt, Homo sapiens
gcaaaguuggugugugaag

SEQ ID NO: 425768 - RNA, 19 nt, Homo sapiens
ccuauacuccuucacucua

SEQ ID NO: 425769 - RNA, 19 nt, Homo sapiens
cacccuacccugcuucuug

SEQ ID NO: 425770 - RNA, 19 nt, Homo sapiens
gcuacaaauggacaagauu

SEQ ID NO: 425771 - RNA, 19 nt, Homo sapiens
ccucugaaggugaaacuga

SEQ ID NO: 425772 - RNA, 19 nt, Homo sapiens
aagcgggacuccuucaucu

SEQ ID NO: 425773 - RNA, 19 nt, Homo sapiens
gacgcucuaugaggaacua

SEQ ID NO: 425774 - RNA, 19 nt, Homo sapiens
gcagaugaggccacagaag

SEQ ID NO: 425775 - RNA, 19 nt, Homo sapiens
acucagagcuccccagaga

SEQ ID NO: 425776 - RNA, 19 nt, Homo sapiens
aggugaagcucgagugcaa

SEQ ID NO: 425777 - RNA, 19 nt, Homo sapiens
gccuacacaugacagacaa

SEQ ID NO: 425778 - RNA, 19 nt, Homo sapiens
ccaagucggagaacucauc

SEQ ID NO: 425779 - RNA, 19 nt, Homo sapiens
ccauuggcaucgagaacau

SEQ ID NO: 425780 - RNA, 19 nt, Homo sapiens
gcggcuucuuugagucuuu

SEQ ID NO: 425781 - RNA, 19 nt, Homo sapiens
ucacucaaguacgauguca

SEQ ID NO: 425782 - RNA, 19 nt, Homo sapiens
gcaucuaccggaagcacuu

SEQ ID NO: 425783 - RNA, 19 nt, Homo sapiens
guggaugucgguaacaguu

SEQ ID NO: 425784 - RNA, 19 nt, Homo sapiens
caaaguagcuaacaucaua

SEQ ID NO: 425785 - RNA, 19 nt, Homo sapiens
gcaguaaacuacauaauga

SEQ ID NO: 425786 - RNA, 19 nt, Homo sapiens
gggaaagaauguuaaguua

SEQ ID NO: 425787 - RNA, 19 nt, Homo sapiens
ccaaugcucuuacucuuua

SEQ ID NO: 425788 - RNA, 19 nt, Homo sapiens
ggacagacauguagaagau

SEQ ID NO: 425789 - RNA, 19 nt, Homo sapiens
guuaauagaugcacaagaa

SEQ ID NO: 425790 - RNA, 19 nt, Homo sapiens
guacaaacauugcugaaga

SEQ ID NO: 425791 - RNA, 19 nt, Homo sapiens
uaacagaucccgccaauga

SEQ ID NO: 425792 - RNA, 19 nt, Homo sapiens
ggaucugucuagcuuauua

SEQ ID NO: 425793 - RNA, 19 nt, Homo sapiens
aaacauugcugaagagcua

SEQ ID NO: 425794 - RNA, 19 nt, Homo sapiens
ggagcaacauggcagauaa

SEQ ID NO: 425795 - RNA, 19 nt, Homo sapiens
gagaagugcuccugaaauc

SEQ ID NO: 425796 - RNA, 19 nt, Homo sapiens
acaagaagcugcugaacaa

SEQ ID NO: 425797 - RNA, 19 nt, Homo sapiens
aauagcagcuuuagaauug

SEQ ID NO: 425798 - RNA, 19 nt, Homo sapiens
ugagaaagaucuagaaagu

SEQ ID NO: 425799 - RNA, 19 nt, Homo sapiens
ggaauggugugaagccaaa

SEQ ID NO: 425800 - RNA, 19 nt, Homo sapiens
gugcacagauuguaauuga

SEQ ID NO: 425801 - RNA, 19 nt, Homo sapiens
uguagaagauggaaaugua

SEQ ID NO: 425802 - RNA, 19 nt, Homo sapiens
gaaugaagcucuuguugcu

SEQ ID NO: 425803 - RNA, 19 nt, Homo sapiens
gagaagcucuugacugucu

SEQ ID NO: 425804 - RNA, 19 nt, Homo sapiens
aaaguuguauggcugcuua

SEQ ID NO: 425805 - RNA, 19 nt, Homo sapiens
ugaagaagcugaagauaac

SEQ ID NO: 425806 - RNA, 19 nt, Homo sapiens
acagaaaugugucuuguug

SEQ ID NO: 425807 - RNA, 19 nt, Homo sapiens
guaccucccuaauaagauu

SEQ ID NO: 425808 - RNA, 19 nt, Homo sapiens
gcagagacuuacuguggaa

SEQ ID NO: 425809 - RNA, 19 nt, Homo sapiens
uauggcugcuuauucauua

SEQ ID NO: 425810 - RNA, 19 nt, Homo sapiens
acaaggaaguacaggauuu

SEQ ID NO: 425811 - RNA, 19 nt, Homo sapiens
caugguaccuagaguuaaa

SEQ ID NO: 425812 - RNA, 19 nt, Homo sapiens
aaaugcagcucuuacagaa

SEQ ID NO: 425813 - RNA, 19 nt, Homo sapiens
ccauaaccguucucuugua

SEQ ID NO: 425814 - RNA, 19 nt, Homo sapiens
gcaugcaugugauguucua

SEQ ID NO: 425815 - RNA, 19 nt, Homo sapiens
gaagugcuccugaaaucaa

SEQ ID NO: 425816 - RNA, 19 nt, Homo sapiens
gugcuaaacuuguacagau

SEQ ID NO: 425817 - RNA, 19 nt, Homo sapiens
guaguccuaugaugaugua

SEQ ID NO: 425818 - RNA, 19 nt, Homo sapiens
uaaccguucucuuguauuc

SEQ ID NO: 425819 - RNA, 19 nt, Homo sapiens
gcugagaacugcccgauac

SEQ ID NO: 425820 - RNA, 19 nt, Homo sapiens
gaaugugcauguuguaguc

SEQ ID NO: 425821 - RNA, 19 nt, Homo sapiens
agaagcugcugaacaauug

SEQ ID NO: 425822 - RNA, 19 nt, Homo sapiens
ccagaaaugaugcaaauug

SEQ ID NO: 425823 - RNA, 19 nt, Homo sapiens
agaugaaacugaauuggaa

SEQ ID NO: 425824 - RNA, 19 nt, Homo sapiens
gguacuacauaaugacuug

SEQ ID NO: 425825 - RNA, 19 nt, Homo sapiens
gauguaaacuugguacuac

SEQ ID NO: 425826 - RNA, 19 nt, Homo sapiens
cagaaaugaugcaaauugu

SEQ ID NO: 425827 - RNA, 19 nt, Homo sapiens
gaacaugauaagagagaaa

SEQ ID NO: 425828 - RNA, 19 nt, Homo sapiens
caucaucccaucucuaauu

SEQ ID NO: 425829 - RNA, 19 nt, Homo sapiens
uaugggaucugaaugucua

SEQ ID NO: 425830 - RNA, 19 nt, Homo sapiens
guccugauaugugcucuua

SEQ ID NO: 425831 - RNA, 19 nt, Homo sapiens
agauggaaauguaacagua

SEQ ID NO: 425832 - RNA, 19 nt, Homo sapiens
gggcagggcucuaggaaac

SEQ ID NO: 425833 - RNA, 19 nt, Homo sapiens
gcaacuagugaacauguaa

SEQ ID NO: 425834 - RNA, 19 nt, Homo sapiens
gaacaauugggaaagaaug

SEQ ID NO: 425835 - RNA, 19 nt, Homo sapiens
aaagaacaguuugccagua

SEQ ID NO: 425836 - RNA, 19 nt, Homo sapiens
uaacaucauagcagaagua

SEQ ID NO: 425837 - RNA, 19 nt, Homo sapiens
cauaaccguucucuuguau

SEQ ID NO: 425838 - RNA, 19 nt, Homo sapiens
ugagagaagugcuccugaa

SEQ ID NO: 425839 - RNA, 19 nt, Homo sapiens
guucagaucucaugguuuu

SEQ ID NO: 425840 - RNA, 19 nt, Homo sapiens
gaggauaguuuagaaggau

SEQ ID NO: 425841 - RNA, 19 nt, Homo sapiens
uuagaaggaugcuuggauu

SEQ ID NO: 425842 - RNA, 19 nt, Homo sapiens
aggcaagucuccacccaua

SEQ ID NO: 425843 - RNA, 19 nt, Homo sapiens
gcagagugguggcaucaag

SEQ ID NO: 425844 - RNA, 19 nt, Homo sapiens
ggaaagaauguuaaguuag

SEQ ID NO: 425845 - RNA, 19 nt, Homo sapiens
gcaaagccaaaguagcuaa

SEQ ID NO: 425846 - RNA, 19 nt, Homo sapiens
gagagaagugcuccugaaa

SEQ ID NO: 425847 - RNA, 19 nt, Homo sapiens
gguugaagcaggccuagua

SEQ ID NO: 425848 - RNA, 19 nt, Homo sapiens
gaaggaugcuuggauuguc

SEQ ID NO: 425849 - RNA, 19 nt, Homo sapiens
ugcaugugauguucuaaua

SEQ ID NO: 425850 - RNA, 19 nt, Homo sapiens
ccugauaugugcucuuaug

SEQ ID NO: 425851 - RNA, 19 nt, Homo sapiens
caauugggaaagaauguua

SEQ ID NO: 425852 - RNA, 19 nt, Homo sapiens
ucucuuggaucccaucaaa

SEQ ID NO: 425853 - RNA, 19 nt, Homo sapiens
uuagugugaucaugacuuu

SEQ ID NO: 425854 - RNA, 19 nt, Homo sapiens
ggcaucaucccaucucuaa

SEQ ID NO: 425855 - RNA, 19 nt, Homo sapiens
gcugaacaauugggaaaga

SEQ ID NO: 425856 - RNA, 19 nt, Homo sapiens
uauaacagaucccgccaau

SEQ ID NO: 425857 - RNA, 19 nt, Homo sapiens
ccacacaugcaguaaacua

SEQ ID NO: 425858 - RNA, 19 nt, Homo sapiens
gccauuccaguuauaaaua

SEQ ID NO: 425859 - RNA, 19 nt, Homo sapiens
gauguucuaauaccaauug

SEQ ID NO: 425860 - RNA, 19 nt, Homo sapiens
aaacuucgcagucaugaga

SEQ ID NO: 425861 - RNA, 19 nt, Homo sapiens
gcuaaacuuguacagauuu

SEQ ID NO: 425862 - RNA, 19 nt, Homo sapiens
caagacugaggauaguuua

SEQ ID NO: 425863 - RNA, 19 nt, Homo sapiens
guagaagauggaaauguaa

SEQ ID NO: 425864 - RNA, 19 nt, Homo sapiens
gagaugaauccaugcagaa

SEQ ID NO: 425865 - RNA, 19 nt, Homo sapiens
cugguaaacuagaaacaaa

SEQ ID NO: 425866 - RNA, 19 nt, Homo sapiens
ugacaagacugaggauagu

SEQ ID NO: 425867 - RNA, 19 nt, Homo sapiens
gaugucguauccaaacuuc

SEQ ID NO: 425868 - RNA, 19 nt, Homo sapiens
aaacuucugggaacauuaa

SEQ ID NO: 425869 - RNA, 19 nt, Homo sapiens
gcaugcugaugaacuauag

SEQ ID NO: 425870 - RNA, 19 nt, Homo sapiens
cugucuagcuuauuaaaga

SEQ ID NO: 425871 - RNA, 19 nt, Homo sapiens
caggaucugucuagcuuau

SEQ ID NO: 425872 - RNA, 19 nt, Homo sapiens
gacugaggauaguuuagaa

SEQ ID NO: 425873 - RNA, 19 nt, Homo sapiens
guaaacuugguacuacaua

SEQ ID NO: 425874 - RNA, 19 nt, Homo sapiens
ggauuuggcuuuucuagau

SEQ ID NO: 425875 - RNA, 19 nt, Homo sapiens
ucagugauaccuugaagaa

SEQ ID NO: 425876 - RNA, 19 nt, Homo sapiens
gcccuuauacgacacagua

SEQ ID NO: 425877 - RNA, 19 nt, Homo sapiens
guauucauaugguagacaa

SEQ ID NO: 425878 - RNA, 19 nt, Homo sapiens
gcaaauuguauucauaugg

SEQ ID NO: 425879 - RNA, 19 nt, Homo sapiens
caaauaaccaccagcuaca

SEQ ID NO: 425880 - RNA, 19 nt, Homo sapiens
uggaauacuucagcuguuu

SEQ ID NO: 425881 - RNA, 19 nt, Homo sapiens
gcucaaaacugguucagau

SEQ ID NO: 425882 - RNA, 19 nt, Homo sapiens
cuacugaugucaaauccau

SEQ ID NO: 425883 - RNA, 19 nt, Homo sapiens
ucaaacuucugggaacauu

SEQ ID NO: 425884 - RNA, 19 nt, Homo sapiens
ggaaacagacuuaucauua

SEQ ID NO: 425885 - RNA, 19 nt, Homo sapiens
uaacucagcuggcaaauga

SEQ ID NO: 425886 - RNA, 19 nt, Homo sapiens
caaguaaccucuggucuua

SEQ ID NO: 425887 - RNA, 19 nt, Homo sapiens
ccacuaagcucugacauuu

SEQ ID NO: 425888 - RNA, 19 nt, Homo sapiens
ggccauagcugucauaaau

SEQ ID NO: 425889 - RNA, 19 nt, Homo sapiens
gaagaaaguugaccuugug

SEQ ID NO: 425890 - RNA, 19 nt, Homo sapiens
gaugguaacugaugccuuu

SEQ ID NO: 425891 - RNA, 19 nt, Homo sapiens
gagauauaguucacaguua

SEQ ID NO: 425892 - RNA, 19 nt, Homo sapiens
gaccuugugucacuauuua

SEQ ID NO: 425893 - RNA, 19 nt, Homo sapiens
gaauguguuuguugagaua

SEQ ID NO: 425894 - RNA, 19 nt, Homo sapiens
uaucagcagucuuguguua

SEQ ID NO: 425895 - RNA, 19 nt, Homo sapiens
gcagagcccuugcugaaga

SEQ ID NO: 425896 - RNA, 19 nt, Homo sapiens
guagagaaguuguagauuc

SEQ ID NO: 425897 - RNA, 19 nt, Homo sapiens
gcaccuucaucgagaaaua

SEQ ID NO: 425898 - RNA, 19 nt, Homo sapiens
ugaaagauauggcagaaug

SEQ ID NO: 425899 - RNA, 19 nt, Homo sapiens
gaucaggguuucaagaaug

SEQ ID NO: 425900 - RNA, 19 nt, Homo sapiens
gaacaggaagauuacauuu

SEQ ID NO: 425901 - RNA, 19 nt, Homo sapiens
gaacaaaguggaccuggaa

SEQ ID NO: 425902 - RNA, 19 nt, Homo sapiens
uaacugaugccuuucauuu

SEQ ID NO: 425903 - RNA, 19 nt, Homo sapiens
gagagaagaguguguguuu

SEQ ID NO: 425904 - RNA, 19 nt, Homo sapiens
gaaagugccagucaucuug

SEQ ID NO: 425905 - RNA, 19 nt, Homo sapiens
gaaucuauacugcagaaua

SEQ ID NO: 425906 - RNA, 19 nt, Homo sapiens
cuucagaacugcaauauca

SEQ ID NO: 425907 - RNA, 19 nt, Homo sapiens
gucaagacaugaauaagaa

SEQ ID NO: 425908 - RNA, 19 nt, Homo sapiens
gcacaagucagagauaauu

SEQ ID NO: 425909 - RNA, 19 nt, Homo sapiens
aaacgaauuucacugugua

SEQ ID NO: 425910 - RNA, 19 nt, Homo sapiens
ggacugaacuuuugacuca

SEQ ID NO: 425911 - RNA, 19 nt, Homo sapiens
aaacauuugugucagauga

SEQ ID NO: 425912 - RNA, 19 nt, Homo sapiens
cuauaaagauuccacaguu

SEQ ID NO: 425913 - RNA, 19 nt, Homo sapiens
gauuacauuuguuggcaua

SEQ ID NO: 425914 - RNA, 19 nt, Homo sapiens
ucaaacauguagagaaguu

SEQ ID NO: 425915 - RNA, 19 nt, Homo sapiens
gaagagauacgugaaugaa

SEQ ID NO: 425916 - RNA, 19 nt, Homo sapiens
gaaauugugaggcagauga

SEQ ID NO: 425917 - RNA, 19 nt, Homo sapiens
ucacugagccugcgaucua

SEQ ID NO: 425918 - RNA, 19 nt, Homo sapiens
acaggaagauuacauuugu

SEQ ID NO: 425919 - RNA, 19 nt, Homo sapiens
ugaaccaccuuguuuauag

SEQ ID NO: 425920 - RNA, 19 nt, Homo sapiens
gcauguguguuuauuguuc

SEQ ID NO: 425921 - RNA, 19 nt, Homo sapiens
gcaaguaaccucuggucuu

SEQ ID NO: 425922 - RNA, 19 nt, Homo sapiens
ggaaagugagagagaagua

SEQ ID NO: 425923 - RNA, 19 nt, Homo sapiens
gucaguguauguaugaaua

SEQ ID NO: 425924 - RNA, 19 nt, Homo sapiens
gacgaacucuuugcagaaa

SEQ ID NO: 425925 - RNA, 19 nt, Homo sapiens
aaagaaauguugccuaagg

SEQ ID NO: 425926 - RNA, 19 nt, Homo sapiens
gaauuuggcacaagucaga

SEQ ID NO: 425927 - RNA, 19 nt, Homo sapiens
uagagaaguuguagauuca

SEQ ID NO: 425928 - RNA, 19 nt, Homo sapiens
caaugcaaauucaacaguu

SEQ ID NO: 425929 - RNA, 19 nt, Homo sapiens
ucauagucgugaaguauuu

SEQ ID NO: 425930 - RNA, 19 nt, Homo sapiens
cgaacucuuugcagaaauu

SEQ ID NO: 425931 - RNA, 19 nt, Homo sapiens
gaaacuuccgcuaagagua

SEQ ID NO: 425932 - RNA, 19 nt, Homo sapiens
acaguuguauuuggaguua

SEQ ID NO: 425933 - RNA, 19 nt, Homo sapiens
gagauaauugccuauacua

SEQ ID NO: 425934 - RNA, 19 nt, Homo sapiens
aaauauggcuguccuggau

SEQ ID NO: 425935 - RNA, 19 nt, Homo sapiens
ggacgaacucuuugcagaa

SEQ ID NO: 425936 - RNA, 19 nt, Homo sapiens
cuaaggcugucugguauuu

SEQ ID NO: 425937 - RNA, 19 nt, Homo sapiens
ucaccuuucugugguaaua

SEQ ID NO: 425938 - RNA, 19 nt, Homo sapiens
uaacuggcauuaagcuuag

SEQ ID NO: 425939 - RNA, 19 nt, Homo sapiens
ugaucagacuagcaacuua

SEQ ID NO: 425940 - RNA, 19 nt, Homo sapiens
gugcauguguguuuauugu

SEQ ID NO: 425941 - RNA, 19 nt, Homo sapiens
aaacuuccgcuaagaguaa

SEQ ID NO: 425942 - RNA, 19 nt, Homo sapiens
cagacuagcaacuuagaua

SEQ ID NO: 425943 - RNA, 19 nt, Homo sapiens
ggacaucccgaaacuggaa

SEQ ID NO: 425944 - RNA, 19 nt, Homo sapiens
gagaagaguguguguuugu

SEQ ID NO: 425945 - RNA, 19 nt, Homo sapiens
acaauagcauccaaauaug

SEQ ID NO: 425946 - RNA, 19 nt, Homo sapiens
uguuaaaccuugacauuuc

SEQ ID NO: 425947 - RNA, 19 nt, Homo sapiens
gagggacgaugcgcgagua

SEQ ID NO: 425948 - RNA, 19 nt, Homo sapiens
cuuagccaaucaaacauua

SEQ ID NO: 425949 - RNA, 19 nt, Homo sapiens
ccuuugguuuguagaauua

SEQ ID NO: 425950 - RNA, 19 nt, Homo sapiens
ugauagugaugguaacuga

SEQ ID NO: 425951 - RNA, 19 nt, Homo sapiens
uggaaaagaugaccuaaaa

SEQ ID NO: 425952 - RNA, 19 nt, Homo sapiens
gauaauugccuauacuaag

SEQ ID NO: 425953 - RNA, 19 nt, Homo sapiens
agaagaaaguugaccuugu

SEQ ID NO: 425954 - RNA, 19 nt, Homo sapiens
ggaaauucauauccaucug

SEQ ID NO: 425955 - RNA, 19 nt, Homo sapiens
guuaaaccuugacauuuca

SEQ ID NO: 425956 - RNA, 19 nt, Homo sapiens
cuaauacaacugaccauuu

SEQ ID NO: 425957 - RNA, 19 nt, Homo sapiens
aagcuuuaauugucccuua

SEQ ID NO: 425958 - RNA, 19 nt, Homo sapiens
gaauguuaauguugucagu

SEQ ID NO: 425959 - RNA, 19 nt, Homo sapiens
uucuuuagcucuugugaua

SEQ ID NO: 425960 - RNA, 19 nt, Homo sapiens
cuuaguggcuacagaagaa

SEQ ID NO: 425961 - RNA, 19 nt, Homo sapiens
gaccuaaaauuuugaguug

SEQ ID NO: 425962 - RNA, 19 nt, Homo sapiens
gaagcgguaugagaaagug

SEQ ID NO: 425963 - RNA, 19 nt, Homo sapiens
ggcagaauguaaaguggaa

SEQ ID NO: 425964 - RNA, 19 nt, Homo sapiens
ucaaggacaucccgaaacu

SEQ ID NO: 425965 - RNA, 19 nt, Homo sapiens
ugaucuggcugccugauga

SEQ ID NO: 425966 - RNA, 19 nt, Homo sapiens
gaaccaccuuguuuauagg

SEQ ID NO: 425967 - RNA, 19 nt, Homo sapiens
ccauagcugucauaaaucu

SEQ ID NO: 425968 - RNA, 19 nt, Homo sapiens
gaauuuggccuucagaacu

SEQ ID NO: 425969 - RNA, 19 nt, Homo sapiens
ggacgaugcgcgaguacaa

SEQ ID NO: 425970 - RNA, 19 nt, Homo sapiens
aaacucgccuacuccacua

SEQ ID NO: 425971 - RNA, 19 nt, Homo sapiens
ggauuugcccaaugucgua

SEQ ID NO: 425972 - RNA, 19 nt, Homo sapiens
gaaagugagagagaaguau

SEQ ID NO: 425973 - RNA, 19 nt, Homo sapiens
uggguaagcuuuaauuguc

SEQ ID NO: 425974 - RNA, 19 nt, Homo sapiens
guucuuaucagcagucuug

SEQ ID NO: 425975 - RNA, 19 nt, Homo sapiens
ugacucaaauugcuacagu

SEQ ID NO: 425976 - RNA, 19 nt, Homo sapiens
guuaauuguugcgcucuaa

SEQ ID NO: 425977 - RNA, 19 nt, Homo sapiens
agacaugaauaagaacuga

SEQ ID NO: 425978 - RNA, 19 nt, Homo sapiens
uaugaaagauauggcagaa

SEQ ID NO: 425979 - RNA, 19 nt, Homo sapiens
cauuauggcuugcuaugca

SEQ ID NO: 425980 - RNA, 19 nt, Homo sapiens
aaguggaccuggaaaguga

SEQ ID NO: 425981 - RNA, 19 nt, Homo sapiens
ucccgaaacuggaaauuca

SEQ ID NO: 425982 - RNA, 19 nt, Homo sapiens
uaaagauuccacaguuuga

SEQ ID NO: 425983 - RNA, 19 nt, Homo sapiens
gagaaguuguagauucaag

SEQ ID NO: 425984 - RNA, 19 nt, Homo sapiens
aaacaaagccucgguagac

SEQ ID NO: 425985 - RNA, 19 nt, Homo sapiens
gaacggccagggcuucauc

SEQ ID NO: 425986 - RNA, 19 nt, Homo sapiens
gagaucgugcggcagauga

SEQ ID NO: 425987 - RNA, 19 nt, Homo sapiens
cgagcuauuugccgagauc

SEQ ID NO: 425988 - RNA, 19 nt, Homo sapiens
guacgacccgaccaucgaa

SEQ ID NO: 425989 - RNA, 19 nt, Homo sapiens
gaguggagcugccccuuca

SEQ ID NO: 425990 - RNA, 19 nt, Homo sapiens
ugcgggaccuguacaucaa

SEQ ID NO: 425991 - RNA, 19 nt, Homo sapiens
uacgagcgcgugcccauga

SEQ ID NO: 425992 - RNA, 19 nt, Homo sapiens
gagcuuccaggacaucaag

SEQ ID NO: 425993 - RNA, 19 nt, Homo sapiens
ggacaaaggugcuggagaa

SEQ ID NO: 425994 - RNA, 19 nt, Homo sapiens
guacuuugcucuuuauaga

SEQ ID NO: 425995 - RNA, 19 nt, Homo sapiens
acaaggagaugcugaaguu

SEQ ID NO: 425996 - RNA, 19 nt, Homo sapiens
gcagugccauggaguguug

SEQ ID NO: 425997 - RNA, 19 nt, Homo sapiens
caaaggugcuggagaagag

SEQ ID NO: 425998 - RNA, 19 nt, Homo sapiens
ggucaaggacuacgagaaa

SEQ ID NO: 425999 - RNA, 19 nt, Homo sapiens
gaagagcucggaccucaug

SEQ ID NO: 426000 - RNA, 19 nt, Homo sapiens
gcuacgcgcacaacaauga

SEQ ID NO: 426001 - RNA, 19 nt, Homo sapiens
ccaagcagcagaucgagaa

SEQ ID NO: 426002 - RNA, 19 nt, Homo sapiens
gagaagcugugcgaguuuc

SEQ ID NO: 426003 - RNA, 19 nt, Homo sapiens
gcuggaggaugccgacuuc

SEQ ID NO: 426004 - RNA, 19 nt, Homo sapiens
gcgcgcacguugugagguu

SEQ ID NO: 426005 - RNA, 19 nt, Homo sapiens
caacuggcagcgacacgua

SEQ ID NO: 426006 - RNA, 19 nt, Homo sapiens
agaaggcccuggagagcuu

SEQ ID NO: 426007 - RNA, 19 nt, Homo sapiens
gagcauuuaccgcagcaaa

SEQ ID NO: 426008 - RNA, 19 nt, Homo sapiens
acgagaagcugugcgaguu

SEQ ID NO: 426009 - RNA, 19 nt, Homo sapiens
ugucugagcgagagcauuu

SEQ ID NO: 426010 - RNA, 19 nt, Homo sapiens
cuuuguacuuugcucuuua

SEQ ID NO: 426011 - RNA, 19 nt, Homo sapiens
acaagaccaucuccuacug

SEQ ID NO: 426012 - RNA, 19 nt, Homo sapiens
ugugaggagucuaugaaga

SEQ ID NO: 426013 - RNA, 19 nt, Homo sapiens
ccaggucguccucaccaua

SEQ ID NO: 426014 - RNA, 19 nt, Homo sapiens
gugaggagucuaugaagau

SEQ ID NO: 426015 - RNA, 19 nt, Homo sapiens
agaaggggcuccagcugua

SEQ ID NO: 426016 - RNA, 19 nt, Homo sapiens
caugccagaggcccauuua

SEQ ID NO: 426017 - RNA, 19 nt, Homo sapiens
cgagagagcccaggaucug

SEQ ID NO: 426018 - RNA, 19 nt, Homo sapiens
cgagaagcugugcgaguuu

SEQ ID NO: 426019 - RNA, 19 nt, Homo sapiens
cauugcagguguggacaaa

SEQ ID NO: 426020 - RNA, 19 nt, Homo sapiens
guugugaggagucuaugaa

SEQ ID NO: 426021 - RNA, 19 nt, Homo sapiens
gcuacaaggagaugcugaa

SEQ ID NO: 426022 - RNA, 19 nt, Homo sapiens
ugucaacaacuauggcaaa

SEQ ID NO: 426023 - RNA, 19 nt, Homo sapiens
agacagagaaggcauugca

SEQ ID NO: 426024 - RNA, 19 nt, Homo sapiens
gcagcuggcacugugauuc

SEQ ID NO: 426025 - RNA, 19 nt, Homo sapiens
gccagaggcccauuuacuc

SEQ ID NO: 426026 - RNA, 19 nt, Homo sapiens
gcgaguccauaggcgagaa

SEQ ID NO: 426027 - RNA, 19 nt, Homo sapiens
ugaggagucuaugaagauc

SEQ ID NO: 426028 - RNA, 19 nt, Homo sapiens
ucacagcccacucggagau

SEQ ID NO: 426029 - RNA, 19 nt, Homo sapiens
gcaugccagaggcccauuu

SEQ ID NO: 426030 - RNA, 19 nt, Homo sapiens
uggaggagacggagcucua

SEQ ID NO: 426031 - RNA, 19 nt, Homo sapiens
ggaguguugugaggagucu

SEQ ID NO: 426032 - RNA, 19 nt, Homo sapiens
guaccaguccaaccagaca

SEQ ID NO: 426033 - RNA, 19 nt, Homo sapiens
ucuuuguacuuugcucuuu

SEQ ID NO: 426034 - RNA, 19 nt, Homo sapiens
gcauuuaccgcagcaaagg

SEQ ID NO: 426035 - RNA, 19 nt, Homo sapiens
gucaacaacuauggcaaag

SEQ ID NO: 426036 - RNA, 19 nt, Homo sapiens
ggacaaaggugcuggagaa

SEQ ID NO: 426037 - RNA, 19 nt, Homo sapiens
guacuuugcucuuuauaga

SEQ ID NO: 426038 - RNA, 19 nt, Homo sapiens
acaaggagaugcugaaguu

SEQ ID NO: 426039 - RNA, 19 nt, Homo sapiens
gcagugccauggaguguug

SEQ ID NO: 426040 - RNA, 19 nt, Homo sapiens
caaaggugcuggagaagag

SEQ ID NO: 426041 - RNA, 19 nt, Homo sapiens
ccaagaagcagaucgagaa

SEQ ID NO: 426042 - RNA, 19 nt, Homo sapiens
ggucaaggacuacgagaaa

SEQ ID NO: 426043 - RNA, 19 nt, Homo sapiens
gaagagcucggaccucaug

SEQ ID NO: 426044 - RNA, 19 nt, Homo sapiens
gcuaugcccacaacaauga

SEQ ID NO: 426045 - RNA, 19 nt, Homo sapiens
gagaaggcccugcgcuaug

SEQ ID NO: 426046 - RNA, 19 nt, Homo sapiens
gagaagcugugcgaguuuc

SEQ ID NO: 426047 - RNA, 19 nt, Homo sapiens
gcuggaggaugccgacuuc

SEQ ID NO: 426048 - RNA, 19 nt, Homo sapiens
gggcgcacguugugagguu

SEQ ID NO: 426049 - RNA, 19 nt, Homo sapiens
agaaggcccuggagagcuu

SEQ ID NO: 426050 - RNA, 19 nt, Homo sapiens
gagcauuuaccgcagcaaa

SEQ ID NO: 426051 - RNA, 19 nt, Homo sapiens
acgagaagcugugcgaguu

SEQ ID NO: 426052 - RNA, 19 nt, Homo sapiens
ugucugagcgagagcauuu

SEQ ID NO: 426053 - RNA, 19 nt, Homo sapiens
ggcaggaccagaccaagaa

SEQ ID NO: 426054 - RNA, 19 nt, Homo sapiens
cuuuguacuuugcucuuua

SEQ ID NO: 426055 - RNA, 19 nt, Homo sapiens
acaagaccaucuccuacug

SEQ ID NO: 426056 - RNA, 19 nt, Homo sapiens
ugugaggagucuaugaaga

SEQ ID NO: 426057 - RNA, 19 nt, Homo sapiens
gcgcuaugcccacaacaau

SEQ ID NO: 426058 - RNA, 19 nt, Homo sapiens
gggcaggaccagaccaaga

SEQ ID NO: 426059 - RNA, 19 nt, Homo sapiens
ccaggucguccucaccaua

SEQ ID NO: 426060 - RNA, 19 nt, Homo sapiens
gugaggagucuaugaagau

SEQ ID NO: 426061 - RNA, 19 nt, Homo sapiens
cgagaaggcccugcgcuau

SEQ ID NO: 426062 - RNA, 19 nt, Homo sapiens
agaaggggcuccagcugua

SEQ ID NO: 426063 - RNA, 19 nt, Homo sapiens
caugccagaggcccauuua

SEQ ID NO: 426064 - RNA, 19 nt, Homo sapiens
cgagaagcugugcgaguuu

SEQ ID NO: 426065 - RNA, 19 nt, Homo sapiens
cauugcagguguggacaaa

SEQ ID NO: 426066 - RNA, 19 nt, Homo sapiens
cuaccuugcucccacaucu

SEQ ID NO: 426067 - RNA, 19 nt, Homo sapiens
guugugaggagucuaugaa

SEQ ID NO: 426068 - RNA, 19 nt, Homo sapiens
gcuacaaggagaugcugaa

SEQ ID NO: 426069 - RNA, 19 nt, Homo sapiens
ugucaacaacuauggcaaa

SEQ ID NO: 426070 - RNA, 19 nt, Homo sapiens
agacagagaaggcauugca

SEQ ID NO: 426071 - RNA, 19 nt, Homo sapiens
gcagcuggcacugugauuc

SEQ ID NO: 426072 - RNA, 19 nt, Homo sapiens
gccagaggcccauuuacuc

SEQ ID NO: 426073 - RNA, 19 nt, Homo sapiens
gcgaguccauaggcgagaa

SEQ ID NO: 426074 - RNA, 19 nt, Homo sapiens
ugaggagucuaugaagauc

SEQ ID NO: 426075 - RNA, 19 nt, Homo sapiens
ucacagcccacucggagau

SEQ ID NO: 426076 - RNA, 19 nt, Homo sapiens
gcaugccagaggcccauuu

SEQ ID NO: 426077 - RNA, 19 nt, Homo sapiens
uggaggagacggagcucua

SEQ ID NO: 426078 - RNA, 19 nt, Homo sapiens
ggaguguugugaggagucu

SEQ ID NO: 426079 - RNA, 19 nt, Homo sapiens
guaccaguccaaccagaca

SEQ ID NO: 426080 - RNA, 19 nt, Homo sapiens
agaaggcccugcgcuaugc

SEQ ID NO: 426081 - RNA, 19 nt, Homo sapiens
ucuuuguacuuugcucuuu

SEQ ID NO: 426082 - RNA, 19 nt, Homo sapiens
gcauuuaccgcagcaaagg

SEQ ID NO: 426083 - RNA, 19 nt, Homo sapiens
gucaacaacuauggcaaag

SEQ ID NO: 426084 - RNA, 19 nt, Homo sapiens
gacaagaacugcaucauca

SEQ ID NO: 426085 - RNA, 19 nt, Homo sapiens
gcaaauacacuacgaacaa

SEQ ID NO: 426086 - RNA, 19 nt, Homo sapiens
cagcaguucugaagagaua

SEQ ID NO: 426087 - RNA, 19 nt, Homo sapiens
gaacaacagcucagaacaa

SEQ ID NO: 426088 - RNA, 19 nt, Homo sapiens
gaaacaagaagaagaagga

SEQ ID NO: 426089 - RNA, 19 nt, Homo sapiens
ccacugagaucuacuggau

SEQ ID NO: 426090 - RNA, 19 nt, Homo sapiens
gcacauuuauacugaagga

SEQ ID NO: 426091 - RNA, 19 nt, Homo sapiens
gagaucuacuggauaaaga

SEQ ID NO: 426092 - RNA, 19 nt, Homo sapiens
gaaacgaccgaaacaagaa

SEQ ID NO: 426093 - RNA, 19 nt, Homo sapiens
gaauuugugcuguguauug

SEQ ID NO: 426094 - RNA, 19 nt, Homo sapiens
gaaggaauuugugcugugu

SEQ ID NO: 426095 - RNA, 19 nt, Homo sapiens
acugagaucuacuggauaa

SEQ ID NO: 426096 - RNA, 19 nt, Homo sapiens
ccaagaugcuaaugaagau

SEQ ID NO: 426097 - RNA, 19 nt, Homo sapiens
ucagugaacucuccaccaa

SEQ ID NO: 426098 - RNA, 19 nt, Homo sapiens
gagcagcaguucugaagag

SEQ ID NO: 426099 - RNA, 19 nt, Homo sapiens
ccaaggagucugugagaaa

SEQ ID NO: 426100 - RNA, 19 nt, Homo sapiens
ggacaagaacugcaucauc

SEQ ID NO: 426101 - RNA, 19 nt, Homo sapiens
gcagaagugcuuugaagug

SEQ ID NO: 426102 - RNA, 19 nt, Homo sapiens
ggcccgaguuccuccauuu

SEQ ID NO: 426103 - RNA, 19 nt, Homo sapiens
gagaaacgaccgaaacaag

SEQ ID NO: 426104 - RNA, 19 nt, Homo sapiens
gcaaagcgcaccaggaaac

SEQ ID NO: 426105 - RNA, 19 nt, Homo sapiens
cagcaccagcuuccaguua

SEQ ID NO: 426106 - RNA, 19 nt, Homo sapiens
ccaccaagugcaucauuaa

SEQ ID NO: 426107 - RNA, 19 nt, Homo sapiens
uauuaauucucgcugguuu

SEQ ID NO: 426108 - RNA, 19 nt, Homo sapiens
gcacacacacaaacacaca

SEQ ID NO: 426109 - RNA, 19 nt, Homo sapiens
ccaagugcaucauuaagac

SEQ ID NO: 426110 - RNA, 19 nt, Homo sapiens
caaauacacuacgaacaac

SEQ ID NO: 426111 - RNA, 19 nt, Homo sapiens
agaacugcaucaucaacaa

SEQ ID NO: 426112 - RNA, 19 nt, Homo sapiens
uccaccaagugcaucauua

SEQ ID NO: 426113 - RNA, 19 nt, Homo sapiens
caacagcucagaacaacgu

SEQ ID NO: 426114 - RNA, 19 nt, Homo sapiens
gcaccagcuuccaguuagu

SEQ ID NO: 426115 - RNA, 19 nt, Homo sapiens
gaccgaaacaagaagaaga

SEQ ID NO: 426116 - RNA, 19 nt, Homo sapiens
ucauuaagacuguggaguu

SEQ ID NO: 426117 - RNA, 19 nt, Homo sapiens
agaaacgaccgaaacaaga

SEQ ID NO: 426118 - RNA, 19 nt, Homo sapiens
gggugcaccuguuacuguu

SEQ ID NO: 426119 - RNA, 19 nt, Homo sapiens
guagaugggccgacacaca

SEQ ID NO: 426120 - RNA, 19 nt, Homo sapiens
cauuaagacuguggaguuc

SEQ ID NO: 426121 - RNA, 19 nt, Homo sapiens
caaggagucugugagaaac

SEQ ID NO: 426122 - RNA, 19 nt, Homo sapiens
ucagaacucacaagccauu

SEQ ID NO: 426123 - RNA, 19 nt, Homo sapiens
ugaucacgcugaagaugga

SEQ ID NO: 426124 - RNA, 19 nt, Homo sapiens
uggaggcgcuaaaggucua

SEQ ID NO: 426125 - RNA, 19 nt, Homo sapiens
cugcagaagugcuuugaag

SEQ ID NO: 426126 - RNA, 19 nt, Homo sapiens
cuguugggcuuuccacuga

SEQ ID NO: 426127 - RNA, 19 nt, Homo sapiens
guacauacccugccauacc

SEQ ID NO: 426128 - RNA, 19 nt, Homo sapiens
gaacugcaucaucaacaag

SEQ ID NO: 426129 - RNA, 19 nt, Homo sapiens
gcucaccacaucuucauca

SEQ ID NO: 426130 - RNA, 19 nt, Homo sapiens
cagcaaacgccaggacuug

SEQ ID NO: 426131 - RNA, 19 nt, Homo sapiens
ccagaucacccuccucaag

SEQ ID NO: 426132 - RNA, 19 nt, Homo sapiens
cagcugggcaaauacacua

SEQ ID NO: 426133 - RNA, 19 nt, Homo sapiens
agaagaacaugguguacac

SEQ ID NO: 426134 - RNA, 19 nt, Homo sapiens
cgucagggcccacaucauc

SEQ ID NO: 426135 - RNA, 19 nt, Homo sapiens
ggccucguguucaucaaga

SEQ ID NO: 426136 - RNA, 19 nt, Homo sapiens
ggaaauguuggagaacuca

SEQ ID NO: 426137 - RNA, 19 nt, Homo sapiens
cccaagaugcuaaugaaga

SEQ ID NO: 426138 - RNA, 19 nt, Homo sapiens
aggaauuugugcuguguau

SEQ ID NO: 426139 - RNA, 19 nt, Homo sapiens
gaucuacuggauaaagaau

SEQ ID NO: 426140 - RNA, 19 nt, Homo sapiens
caccaucgccgaccagauc

SEQ ID NO: 426141 - RNA, 19 nt, Homo sapiens
guucuccuccucagccuuu

SEQ ID NO: 426142 - RNA, 19 nt, Homo sapiens
uuacugaccugcgaagcau

SEQ ID NO: 426143 - RNA, 19 nt, Homo sapiens
gccgcagcauccagaagaa

SEQ ID NO: 426144 - RNA, 19 nt, Homo sapiens
caggaaauguuggagaacu

SEQ ID NO: 426145 - RNA, 19 nt, Homo sapiens
ccaguuaguggauauagca

SEQ ID NO: 426146 - RNA, 19 nt, Homo sapiens
agugaacucuccaccaagu

SEQ ID NO: 426147 - RNA, 19 nt, Homo sapiens
acauugaccucugggacaa

SEQ ID NO: 426148 - RNA, 19 nt, Homo sapiens
cagaacaacgugucucucu

SEQ ID NO: 426149 - RNA, 19 nt, Homo sapiens
uacauacccugccauacca

SEQ ID NO: 426150 - RNA, 19 nt, Homo sapiens
gaacucacaagccauugcu

SEQ ID NO: 426151 - RNA, 19 nt, Homo sapiens
ucagggcccacaucaucua

SEQ ID NO: 426152 - RNA, 19 nt, Homo sapiens
gugagaaacgaccgaaaca

SEQ ID NO: 426153 - RNA, 19 nt, Homo sapiens
guugggcuuuccacugaga

SEQ ID NO: 426154 - RNA, 19 nt, Homo sapiens
ggaauuugugcuguguauu

SEQ ID NO: 426155 - RNA, 19 nt, Homo sapiens
aacaacagcucagaacaac

SEQ ID NO: 426156 - RNA, 19 nt, Homo sapiens
guccucaggcuaccacuau

SEQ ID NO: 426157 - RNA, 19 nt, Homo sapiens
gcuuuucucugccuuucua

SEQ ID NO: 426158 - RNA, 19 nt, Homo sapiens
ucucauccaggaaauguug

SEQ ID NO: 426159 - RNA, 19 nt, Homo sapiens
gcgcacacacacaaacaca

SEQ ID NO: 426160 - RNA, 19 nt, Homo sapiens
caagaacugcaucaucaac

SEQ ID NO: 426161 - RNA, 19 nt, Homo sapiens
aagcacauuuauacugaag

SEQ ID NO: 426162 - RNA, 19 nt, Homo sapiens
cagaagaacaugguguaca

SEQ ID NO: 426163 - RNA, 19 nt, Homo sapiens
cugcccagcucaccacauc

SEQ ID NO: 426164 - RNA, 19 nt, Homo sapiens
cgaacaacagcucagaaca

SEQ ID NO: 426165 - RNA, 19 nt, Homo sapiens
cggaaccgcugccaguacu

SEQ ID NO: 426166 - RNA, 19 nt, Homo sapiens
gaggagggguggucugaag

SEQ ID NO: 426167 - RNA, 19 nt, Homo sapiens
gcccagcucaccacaucuu

SEQ ID NO: 426168 - RNA, 19 nt, Homo sapiens
ggugaucacgcugaagaug

SEQ ID NO: 426169 - RNA, 19 nt, Homo sapiens
ugagaaacgaccgaaacaa

SEQ ID NO: 426170 - RNA, 19 nt, Homo sapiens
guccaaggagucugugaga

SEQ ID NO: 426171 - RNA, 19 nt, Homo sapiens
ggaaauggaugacacagaa

SEQ ID NO: 426172 - RNA, 19 nt, Homo sapiens
gcacacugcucaaucaauu

SEQ ID NO: 426173 - RNA, 19 nt, Homo sapiens
caagggagaucauguuuga

SEQ ID NO: 426174 - RNA, 19 nt, Homo sapiens
gcaggagggucuauucuuu

SEQ ID NO: 426175 - RNA, 19 nt, Homo sapiens
acaccaagguuaugaaaua

SEQ ID NO: 426176 - RNA, 19 nt, Homo sapiens
gcagaaguauucagaagaa

SEQ ID NO: 426177 - RNA, 19 nt, Homo sapiens
caaagaaucugucaggaau

SEQ ID NO: 426178 - RNA, 19 nt, Homo sapiens
guagagugguuaacagaua

SEQ ID NO: 426179 - RNA, 19 nt, Homo sapiens
cagcaagccucacauguuu

SEQ ID NO: 426180 - RNA, 19 nt, Homo sapiens
gaacucagaugcacaaugc

SEQ ID NO: 426181 - RNA, 19 nt, Homo sapiens
cauagaaucugccuccuuu

SEQ ID NO: 426182 - RNA, 19 nt, Homo sapiens
gccaagggcuaauuauauu

SEQ ID NO: 426183 - RNA, 19 nt, Homo sapiens
guaaauacaccacgaauuc

SEQ ID NO: 426184 - RNA, 19 nt, Homo sapiens
caaagaaacaggcauagaa

SEQ ID NO: 426185 - RNA, 19 nt, Homo sapiens
gcacaaugcuggauuuggu

SEQ ID NO: 426186 - RNA, 19 nt, Homo sapiens
gcacagagagcuaugaaau

SEQ ID NO: 426187 - RNA, 19 nt, Homo sapiens
ggacuauuguacaguauga

SEQ ID NO: 426188 - RNA, 19 nt, Homo sapiens
acagagagcuaugaaauga

SEQ ID NO: 426189 - RNA, 19 nt, Homo sapiens
caaauucccugcacuagca

SEQ ID NO: 426190 - RNA, 19 nt, Homo sapiens
agauaaggcugaagauauu

SEQ ID NO: 426191 - RNA, 19 nt, Homo sapiens
ccaaccagcuccugccuuu

SEQ ID NO: 426192 - RNA, 19 nt, Homo sapiens
gaacaagacaccaugacuu

SEQ ID NO: 426193 - RNA, 19 nt, Homo sapiens
gccaccaagugcauuauua

SEQ ID NO: 426194 - RNA, 19 nt, Homo sapiens
gcacaguccuagcaucuca

SEQ ID NO: 426195 - RNA, 19 nt, Homo sapiens
ggaaugacaggaacaagaa

SEQ ID NO: 426196 - RNA, 19 nt, Homo sapiens
caagaaggaccaagaaguu

SEQ ID NO: 426197 - RNA, 19 nt, Homo sapiens
gaccaucgcagaccaaauu

SEQ ID NO: 426198 - RNA, 19 nt, Homo sapiens
gaaauagacuacuguacac

SEQ ID NO: 426199 - RNA, 19 nt, Homo sapiens
uaaggaaacaggacuauug

SEQ ID NO: 426200 - RNA, 19 nt, Homo sapiens
aagaaaugcuggagaauuc

SEQ ID NO: 426201 - RNA, 19 nt, Homo sapiens
ccaagugcauuauuaagau

SEQ ID NO: 426202 - RNA, 19 nt, Homo sapiens
uggcuugucugucauaauu

SEQ ID NO: 426203 - RNA, 19 nt, Homo sapiens
guacacgucuaccuagguu

SEQ ID NO: 426204 - RNA, 19 nt, Homo sapiens
gaugcacaaugcuggauuu

SEQ ID NO: 426205 - RNA, 19 nt, Homo sapiens
gaucauguuugacuguaug

SEQ ID NO: 426206 - RNA, 19 nt, Homo sapiens
uuaauaaagucaccaggaa

SEQ ID NO: 426207 - RNA, 19 nt, Homo sapiens
cgagauaagaacuguguua

SEQ ID NO: 426208 - RNA, 19 nt, Homo sapiens
guaauuaccuugaaaaugg

SEQ ID NO: 426209 - RNA, 19 nt, Homo sapiens
gagaucauguuugacugua

SEQ ID NO: 426210 - RNA, 19 nt, Homo sapiens
caagauaaggcugaagaua

SEQ ID NO: 426211 - RNA, 19 nt, Homo sapiens
ggagaauucugaaggacau

SEQ ID NO: 426212 - RNA, 19 nt, Homo sapiens
ccucacauguuuccaaaga

SEQ ID NO: 426213 - RNA, 19 nt, Homo sapiens
ggaaacaggacuauugaca

SEQ ID NO: 426214 - RNA, 19 nt, Homo sapiens
ucugaagacuuuguacaua

SEQ ID NO: 426215 - RNA, 19 nt, Homo sapiens
ggacugggaugccgagaac

SEQ ID NO: 426216 - RNA, 19 nt, Homo sapiens
ccaguucaguuaaucaaau

SEQ ID NO: 426217 - RNA, 19 nt, Homo sapiens
caagaaaugcuggagaauu

SEQ ID NO: 426218 - RNA, 19 nt, Homo sapiens
acaggacuauuguacagua

SEQ ID NO: 426219 - RNA, 19 nt, Homo sapiens
gaacacagcagagcacagu

SEQ ID NO: 426220 - RNA, 19 nt, Homo sapiens
ucacagagaagauccgaaa

SEQ ID NO: 426221 - RNA, 19 nt, Homo sapiens
ugaaauagacuacuguaca

SEQ ID NO: 426222 - RNA, 19 nt, Homo sapiens
agucaccacucgugcaaua

SEQ ID NO: 426223 - RNA, 19 nt, Homo sapiens
gaccuuguguucaccuuug

SEQ ID NO: 426224 - RNA, 19 nt, Homo sapiens
gcucucaaacugcaucuuu

SEQ ID NO: 426225 - RNA, 19 nt, Homo sapiens
ugaaaugacagcugaguug

SEQ ID NO: 426226 - RNA, 19 nt, Homo sapiens
ccaaagaaucugucaggaa

SEQ ID NO: 426227 - RNA, 19 nt, Homo sapiens
ccauuugccuccacaccua

SEQ ID NO: 426228 - RNA, 19 nt, Homo sapiens
aagcuugucuuugcucuuu

SEQ ID NO: 426229 - RNA, 19 nt, Homo sapiens
uauauuagcaagucuguga

SEQ ID NO: 426230 - RNA, 19 nt, Homo sapiens
gaagagaauucuguaucag

SEQ ID NO: 426231 - RNA, 19 nt, Homo sapiens
aaguauggcucuguucuuu

SEQ ID NO: 426232 - RNA, 19 nt, Homo sapiens
ccaagaaguuuucauaugu

SEQ ID NO: 426233 - RNA, 19 nt, Homo sapiens
uuauuaagaucguggaguu

SEQ ID NO: 426234 - RNA, 19 nt, Homo sapiens
ccaccaagugcauuauuaa

SEQ ID NO: 426235 - RNA, 19 nt, Homo sapiens
uauggaagcuugucuuugc

SEQ ID NO: 426236 - RNA, 19 nt, Homo sapiens
uguacaguaugacaagaua

SEQ ID NO: 426237 - RNA, 19 nt, Homo sapiens
caagaugcauggcaaagac

SEQ ID NO: 426238 - RNA, 19 nt, Homo sapiens
ucacagaucuccguagcau

SEQ ID NO: 426239 - RNA, 19 nt, Homo sapiens
ucacauguuuccaaagauc

SEQ ID NO: 426240 - RNA, 19 nt, Homo sapiens
aagaaucugucaggaauga

SEQ ID NO: 426241 - RNA, 19 nt, Homo sapiens
agaauucuguaucagugua

SEQ ID NO: 426242 - RNA, 19 nt, Homo sapiens
gcaaagacccagucaaaau

SEQ ID NO: 426243 - RNA, 19 nt, Homo sapiens
uggcaaagacccagucaaa

SEQ ID NO: 426244 - RNA, 19 nt, Homo sapiens
gcuggagaauucugaagga

SEQ ID NO: 426245 - RNA, 19 nt, Homo sapiens
gaaauggaugacacagaaa

SEQ ID NO: 426246 - RNA, 19 nt, Homo sapiens
ggccuuacccuaaaucgaa

SEQ ID NO: 426247 - RNA, 19 nt, Homo sapiens
cuggacauccugauucuua

SEQ ID NO: 426248 - RNA, 19 nt, Homo sapiens
gaucguggaguuugcuaaa

SEQ ID NO: 426249 - RNA, 19 nt, Homo sapiens
aagauaaggcugaagauau

SEQ ID NO: 426250 - RNA, 19 nt, Homo sapiens
gacaagauaaggcugaaga

SEQ ID NO: 426251 - RNA, 19 nt, Homo sapiens
gcaaccagaaacuaguuaa

SEQ ID NO: 426252 - RNA, 19 nt, Homo sapiens
ggaccaagaaguuuucaua

SEQ ID NO: 426253 - RNA, 19 nt, Homo sapiens
ccagcaagccucacauguu

SEQ ID NO: 426254 - RNA, 19 nt, Homo sapiens
ucagacggccuuacccuaa

SEQ ID NO: 426255 - RNA, 19 nt, Homo sapiens
aagcaagaaugcacagaga

SEQ ID NO: 426256 - RNA, 19 nt, Homo sapiens
guauggauguucugucagu

SEQ ID NO: 426257 - RNA, 19 nt, Homo sapiens
uuuaagcacuacuggaauu

SEQ ID NO: 426258 - RNA, 19 nt, Homo sapiens
ucacaagccauuagggaaa

SEQ ID NO: 426259 - RNA, 19 nt, Homo sapiens
ugacaggacuauuguacag

SEQ ID NO: 426260 - RNA, 19 nt, Homo sapiens
gagcaagccuggaaaaugg

SEQ ID NO: 426261 - RNA, 19 nt, Homo sapiens
guuaugaaauagacuacug

SEQ ID NO: 426262 - RNA, 19 nt, Homo sapiens
ggaaaaugguaaaugauca

SEQ ID NO: 426263 - RNA, 19 nt, Homo sapiens
gaaguauggcucuguucuu

SEQ ID NO: 426264 - RNA, 19 nt, Homo sapiens
uauauauacuccucacugu

SEQ ID NO: 426265 - RNA, 19 nt, Homo sapiens
cagacggccuuacccuaaa

SEQ ID NO: 426266 - RNA, 19 nt, Homo sapiens
gguaaauacaccacgaauu

SEQ ID NO: 426267 - RNA, 19 nt, Homo sapiens
ccgaaaagcucaccaggaa

SEQ ID NO: 426268 - RNA, 19 nt, Homo sapiens
agggaaauuucaugggaua

SEQ ID NO: 426269 - RNA, 19 nt, Homo sapiens
ggaauagucaagacaucaa

SEQ ID NO: 426270 - RNA, 19 nt, Homo sapiens
guauggcucuguucuuucu

SEQ ID NO: 426271 - RNA, 19 nt, Homo sapiens
ggaaauggaugacacagaa

SEQ ID NO: 426272 - RNA, 19 nt, Homo sapiens
gcaggagggucuauucuuu

SEQ ID NO: 426273 - RNA, 19 nt, Homo sapiens
acaccaagguuaugaaaua

SEQ ID NO: 426274 - RNA, 19 nt, Homo sapiens
gcagaaguauucagaagaa

SEQ ID NO: 426275 - RNA, 19 nt, Homo sapiens
caaagaaucugucaggaau

SEQ ID NO: 426276 - RNA, 19 nt, Homo sapiens
guagagugguuaacagaua

SEQ ID NO: 426277 - RNA, 19 nt, Homo sapiens
cagcaagccucacauguuu

SEQ ID NO: 426278 - RNA, 19 nt, Homo sapiens
gaacucagaugcacaaugc

SEQ ID NO: 426279 - RNA, 19 nt, Homo sapiens
cauagaaucugccuccuuu

SEQ ID NO: 426280 - RNA, 19 nt, Homo sapiens
gccaagggcuaauuauauu

SEQ ID NO: 426281 - RNA, 19 nt, Homo sapiens
guaaauacaccacgaauuc

SEQ ID NO: 426282 - RNA, 19 nt, Homo sapiens
caaagaaacaggcauagaa

SEQ ID NO: 426283 - RNA, 19 nt, Homo sapiens
gcacaaugcuggauuuggu

SEQ ID NO: 426284 - RNA, 19 nt, Homo sapiens
gcacagagagcuaugaaau

SEQ ID NO: 426285 - RNA, 19 nt, Homo sapiens
ggacuauuguacaguauga

SEQ ID NO: 426286 - RNA, 19 nt, Homo sapiens
acagagagcuaugaaauga

SEQ ID NO: 426287 - RNA, 19 nt, Homo sapiens
caaauucccugcacuagca

SEQ ID NO: 426288 - RNA, 19 nt, Homo sapiens
agauaaggcugaagauauu

SEQ ID NO: 426289 - RNA, 19 nt, Homo sapiens
ccaaccagcuccugccuuu

SEQ ID NO: 426290 - RNA, 19 nt, Homo sapiens
gaacaagacaccaugacuu

SEQ ID NO: 426291 - RNA, 19 nt, Homo sapiens
gccaccaagugcauuauua

SEQ ID NO: 426292 - RNA, 19 nt, Homo sapiens
gcacaguccuagcaucuca

SEQ ID NO: 426293 - RNA, 19 nt, Homo sapiens
ggaaugacaggaacaagaa

SEQ ID NO: 426294 - RNA, 19 nt, Homo sapiens
caagaaggaccaagaaguu

SEQ ID NO: 426295 - RNA, 19 nt, Homo sapiens
gaccaucgcagaccaaauu

SEQ ID NO: 426296 - RNA, 19 nt, Homo sapiens
gaaauagacuacuguacac

SEQ ID NO: 426297 - RNA, 19 nt, Homo sapiens
uaaggaaacaggacuauug

SEQ ID NO: 426298 - RNA, 19 nt, Homo sapiens
aagaaaugcuggagaauuc

SEQ ID NO: 426299 - RNA, 19 nt, Homo sapiens
ccaagugcauuauuaagau

SEQ ID NO: 426300 - RNA, 19 nt, Homo sapiens
guacacgucuaccuagguu

SEQ ID NO: 426301 - RNA, 19 nt, Homo sapiens
gaugcacaaugcuggauuu

SEQ ID NO: 426302 - RNA, 19 nt, Homo sapiens
uuaauaaagucaccaggaa

SEQ ID NO: 426303 - RNA, 19 nt, Homo sapiens
cgagauaagaacuguguua

SEQ ID NO: 426304 - RNA, 19 nt, Homo sapiens
guaauuaccuugaaaaugg

SEQ ID NO: 426305 - RNA, 19 nt, Homo sapiens
caagauaaggcugaagaua

SEQ ID NO: 426306 - RNA, 19 nt, Homo sapiens
ggagaauucugaaggacau

SEQ ID NO: 426307 - RNA, 19 nt, Homo sapiens
ccucacauguuuccaaaga

SEQ ID NO: 426308 - RNA, 19 nt, Homo sapiens
ggaaacaggacuauugaca

SEQ ID NO: 426309 - RNA, 19 nt, Homo sapiens
ucugaagacuuuguacaua

SEQ ID NO: 426310 - RNA, 19 nt, Homo sapiens
ggacugggaugccgagaac

SEQ ID NO: 426311 - RNA, 19 nt, Homo sapiens
ccaguucaguuaaucaaau

SEQ ID NO: 426312 - RNA, 19 nt, Homo sapiens
caagaaaugcuggagaauu

SEQ ID NO: 426313 - RNA, 19 nt, Homo sapiens
acaggacuauuguacagua

SEQ ID NO: 426314 - RNA, 19 nt, Homo sapiens
gaacacagcagagcacagu

SEQ ID NO: 426315 - RNA, 19 nt, Homo sapiens
ucacagagaagauccgaaa

SEQ ID NO: 426316 - RNA, 19 nt, Homo sapiens
ugaaauagacuacuguaca

SEQ ID NO: 426317 - RNA, 19 nt, Homo sapiens
agucaccacucgugcaaua

SEQ ID NO: 426318 - RNA, 19 nt, Homo sapiens
gaccuuguguucaccuuug

SEQ ID NO: 426319 - RNA, 19 nt, Homo sapiens
gcucucaaacugcaucuuu

SEQ ID NO: 426320 - RNA, 19 nt, Homo sapiens
ugaaaugacagcugaguug

SEQ ID NO: 426321 - RNA, 19 nt, Homo sapiens
ccaaagaaucugucaggaa

SEQ ID NO: 426322 - RNA, 19 nt, Homo sapiens
aagcuugucuuugcucuuu

SEQ ID NO: 426323 - RNA, 19 nt, Homo sapiens
uauauuagcaagucuguga

SEQ ID NO: 426324 - RNA, 19 nt, Homo sapiens
gaagagaauucuguaucag

SEQ ID NO: 426325 - RNA, 19 nt, Homo sapiens
aaguauggcucuguucuuu

SEQ ID NO: 426326 - RNA, 19 nt, Homo sapiens
ccaagaaguuuucauaugu

SEQ ID NO: 426327 - RNA, 19 nt, Homo sapiens
uuauuaagaucguggaguu

SEQ ID NO: 426328 - RNA, 19 nt, Homo sapiens
ccaccaagugcauuauuaa

SEQ ID NO: 426329 - RNA, 19 nt, Homo sapiens
uauggaagcuugucuuugc

SEQ ID NO: 426330 - RNA, 19 nt, Homo sapiens
uguacaguaugacaagaua

SEQ ID NO: 426331 - RNA, 19 nt, Homo sapiens
caagaugcauggcaaagac

SEQ ID NO: 426332 - RNA, 19 nt, Homo sapiens
ucacagaucuccguagcau

SEQ ID NO: 426333 - RNA, 19 nt, Homo sapiens
ucacauguuuccaaagauc

SEQ ID NO: 426334 - RNA, 19 nt, Homo sapiens
aagaaucugucaggaauga

SEQ ID NO: 426335 - RNA, 19 nt, Homo sapiens
agaauucuguaucagugua

SEQ ID NO: 426336 - RNA, 19 nt, Homo sapiens
gcaaagacccagucaaaau

SEQ ID NO: 426337 - RNA, 19 nt, Homo sapiens
uggcaaagacccagucaaa

SEQ ID NO: 426338 - RNA, 19 nt, Homo sapiens
gcuggagaauucugaagga

SEQ ID NO: 426339 - RNA, 19 nt, Homo sapiens
gaaauggaugacacagaaa

SEQ ID NO: 426340 - RNA, 19 nt, Homo sapiens
ggccuuacccuaaaucgaa

SEQ ID NO: 426341 - RNA, 19 nt, Homo sapiens
cuggacauccugauucuua

SEQ ID NO: 426342 - RNA, 19 nt, Homo sapiens
gaucguggaguuugcuaaa

SEQ ID NO: 426343 - RNA, 19 nt, Homo sapiens
aagauaaggcugaagauau

SEQ ID NO: 426344 - RNA, 19 nt, Homo sapiens
gacaagauaaggcugaaga

SEQ ID NO: 426345 - RNA, 19 nt, Homo sapiens
gcaaccagaaacuaguuaa

SEQ ID NO: 426346 - RNA, 19 nt, Homo sapiens
ggaccaagaaguuuucaua

SEQ ID NO: 426347 - RNA, 19 nt, Homo sapiens
ccagcaagccucacauguu

SEQ ID NO: 426348 - RNA, 19 nt, Homo sapiens
ucagacggccuuacccuaa

SEQ ID NO: 426349 - RNA, 19 nt, Homo sapiens
aagcaagaaugcacagaga

SEQ ID NO: 426350 - RNA, 19 nt, Homo sapiens
uuuaagcacuacuggaauu

SEQ ID NO: 426351 - RNA, 19 nt, Homo sapiens
ucacaagccauuagggaaa

SEQ ID NO: 426352 - RNA, 19 nt, Homo sapiens
ugacaggacuauuguacag

SEQ ID NO: 426353 - RNA, 19 nt, Homo sapiens
guuaugaaauagacuacug

SEQ ID NO: 426354 - RNA, 19 nt, Homo sapiens
gaaguauggcucuguucuu

SEQ ID NO: 426355 - RNA, 19 nt, Homo sapiens
uauauauacuccucacugu

SEQ ID NO: 426356 - RNA, 19 nt, Homo sapiens
cagacggccuuacccuaaa

SEQ ID NO: 426357 - RNA, 19 nt, Homo sapiens
gguaaauacaccacgaauu

SEQ ID NO: 426358 - RNA, 19 nt, Homo sapiens
ccgaaaagcucaccaggaa

SEQ ID NO: 426359 - RNA, 19 nt, Homo sapiens
agggaaauuucaugggaua

SEQ ID NO: 426360 - RNA, 19 nt, Homo sapiens
ggaauagucaagacaucaa

SEQ ID NO: 426361 - RNA, 19 nt, Homo sapiens
guauggcucuguucuuucu

SEQ ID NO: 426362 - RNA, 19 nt, Homo sapiens
ucacccagcucaguggaaa

SEQ ID NO: 426363 - RNA, 19 nt, Homo sapiens
gcuccugccuuuggaaaug

SEQ ID NO: 426364 - RNA, 19 nt, Homo sapiens
gauuugguccucugacuga

SEQ ID NO: 426365 - RNA, 19 nt, Homo sapiens
gugggaauguccaaagaau

SEQ ID NO: 426366 - RNA, 19 nt, Homo sapiens
uaacugucuugcuuucaug

SEQ ID NO: 426367 - RNA, 19 nt, Homo sapiens
gugcagagcguguaauuac

SEQ ID NO: 426368 - RNA, 19 nt, Homo sapiens
ucugccagcuggguaaaua

SEQ ID NO: 426369 - RNA, 19 nt, Homo sapiens
gaagugggaauguccaaag

SEQ ID NO: 426370 - RNA, 19 nt, Homo sapiens
gaaucgaugccaauacugu

SEQ ID NO: 426371 - RNA, 19 nt, Homo sapiens
ggagaacccugaaauguuu

SEQ ID NO: 426372 - RNA, 19 nt, Homo sapiens
ggaagccucuauuuauuua

SEQ ID NO: 426373 - RNA, 19 nt, Homo sapiens
gaaaugaccggaacaagaa

SEQ ID NO: 426374 - RNA, 19 nt, Homo sapiens
caaauaagauucccauugg

SEQ ID NO: 426375 - RNA, 19 nt, Homo sapiens
uagaagagcucaucaccaa

SEQ ID NO: 426376 - RNA, 19 nt, Homo sapiens
agaaagaggugaaggaaga

SEQ ID NO: 426377 - RNA, 19 nt, Homo sapiens
gaaagggccauuacucuga

SEQ ID NO: 426378 - RNA, 19 nt, Homo sapiens
caaggaagcugugcgaaau

SEQ ID NO: 426379 - RNA, 19 nt, Homo sapiens
ggaacaagaagaagaaaga

SEQ ID NO: 426380 - RNA, 19 nt, Homo sapiens
ucagugagcuggcuaccaa

SEQ ID NO: 426381 - RNA, 19 nt, Homo sapiens
aaagcugccugccuagaua

SEQ ID NO: 426382 - RNA, 19 nt, Homo sapiens
gaagaaagaggugaaggaa

SEQ ID NO: 426383 - RNA, 19 nt, Homo sapiens
ccaaauaagauucccauug

SEQ ID NO: 426384 - RNA, 19 nt, Homo sapiens
ucaacaaggugaccaggaa

SEQ ID NO: 426385 - RNA, 19 nt, Homo sapiens
cgaaaugaccggaacaaga

SEQ ID NO: 426386 - RNA, 19 nt, Homo sapiens
ccaagugcaucaucaagau

SEQ ID NO: 426387 - RNA, 19 nt, Homo sapiens
ggacccagaugcacaaugc

SEQ ID NO: 426388 - RNA, 19 nt, Homo sapiens
caauaaggagcgacucuuu

SEQ ID NO: 426389 - RNA, 19 nt, Homo sapiens
gagcaaacaggaacacuag

SEQ ID NO: 426390 - RNA, 19 nt, Homo sapiens
gaccuugucuuugccuuug

SEQ ID NO: 426391 - RNA, 19 nt, Homo sapiens
gcaaguauaccacgaacuc

SEQ ID NO: 426392 - RNA, 19 nt, Homo sapiens
gccgaagcauccagaagaa

SEQ ID NO: 426393 - RNA, 19 nt, Homo sapiens
auaaagugauggaaacuca

SEQ ID NO: 426394 - RNA, 19 nt, Homo sapiens
uaucgcauauugcugaguu

SEQ ID NO: 426395 - RNA, 19 nt, Homo sapiens
ccaaggaagcugugcgaaa

SEQ ID NO: 426396 - RNA, 19 nt, Homo sapiens
ccugugcccuccguuauaa

SEQ ID NO: 426397 - RNA, 19 nt, Homo sapiens
ucaucaagaucguggaguu

SEQ ID NO: 426398 - RNA, 19 nt, Homo sapiens
gcuaccaagugcaucauca

SEQ ID NO: 426399 - RNA, 19 nt, Homo sapiens
gauagaugcagguccauuc

SEQ ID NO: 426400 - RNA, 19 nt, Homo sapiens
caggaacacuagagaccaa

SEQ ID NO: 426401 - RNA, 19 nt, Homo sapiens
ucccaaggaugcuaaugaa

SEQ ID NO: 426402 - RNA, 19 nt, Homo sapiens
gcgguugccuggcuuuaca

SEQ ID NO: 426403 - RNA, 19 nt, Homo sapiens
ugaaagggacagauagaug

SEQ ID NO: 426404 - RNA, 19 nt, Homo sapiens
gcaaacaggaacacuagag

SEQ ID NO: 426405 - RNA, 19 nt, Homo sapiens
aaagggccauuacucugaa

SEQ ID NO: 426406 - RNA, 19 nt, Homo sapiens
gcacuaagggagcugaaag

SEQ ID NO: 426407 - RNA, 19 nt, Homo sapiens
caaacaggaacacuagaga

SEQ ID NO: 426408 - RNA, 19 nt, Homo sapiens
ggaugagccuggguuugga

SEQ ID NO: 426409 - RNA, 19 nt, Homo sapiens
uccgagagaugcuggagaa

SEQ ID NO: 426410 - RNA, 19 nt, Homo sapiens
gaaagaggugaaggaagaa

SEQ ID NO: 426411 - RNA, 19 nt, Homo sapiens
gcagcagacugaccaucuc

SEQ ID NO: 426412 - RNA, 19 nt, Homo sapiens
cugaaauguuugaggauga

SEQ ID NO: 426413 - RNA, 19 nt, Homo sapiens
ggccauuacucugaagaug

SEQ ID NO: 426414 - RNA, 19 nt, Homo sapiens
caaagcugccugccuagau

SEQ ID NO: 426415 - RNA, 19 nt, Homo sapiens
cccauuggcucccuguguu

SEQ ID NO: 426416 - RNA, 19 nt, Homo sapiens
ggugaaagggacagauaga

SEQ ID NO: 426417 - RNA, 19 nt, Homo sapiens
uggagaacccugaaauguu

SEQ ID NO: 426418 - RNA, 19 nt, Homo sapiens
caaggaugcuaaugaaaau

SEQ ID NO: 426419 - RNA, 19 nt, Homo sapiens
cugcguaucugcacaaggu

SEQ ID NO: 426420 - RNA, 19 nt, Homo sapiens
gaccggaacaagaagaaga

SEQ ID NO: 426421 - RNA, 19 nt, Homo sapiens
ggugugugcuagccucugu

SEQ ID NO: 426422 - RNA, 19 nt, Homo sapiens
aggaagccucuauuuauuu

SEQ ID NO: 426423 - RNA, 19 nt, Homo sapiens
gcugggcccugcauuucug

SEQ ID NO: 426424 - RNA, 19 nt, Homo sapiens
gaggaagacccugccauuc

SEQ ID NO: 426425 - RNA, 19 nt, Homo sapiens
aggaagcugugcgaaauga

SEQ ID NO: 426426 - RNA, 19 nt, Homo sapiens
ccaggaaucgcugccagua

SEQ ID NO: 426427 - RNA, 19 nt, Homo sapiens
aaagugauggaaacucaaa

SEQ ID NO: 426428 - RNA, 19 nt, Homo sapiens
cuagugccuuccacccuuu

SEQ ID NO: 426429 - RNA, 19 nt, Homo sapiens
agaggaagacccugccauu

SEQ ID NO: 426430 - RNA, 19 nt, Homo sapiens
cccgaugccucccuuaauc

SEQ ID NO: 426431 - RNA, 19 nt, Homo sapiens
ggagcugaaagggccauua

SEQ ID NO: 426432 - RNA, 19 nt, Homo sapiens
ccagccagcccuacauguu

SEQ ID NO: 426433 - RNA, 19 nt, Homo sapiens
uuacagggcucagcauugc

SEQ ID NO: 426434 - RNA, 19 nt, Homo sapiens
gaacaagaagaagaaagag

SEQ ID NO: 426435 - RNA, 19 nt, Homo sapiens
agaagaacaugguguacac

SEQ ID NO: 426436 - RNA, 19 nt, Homo sapiens
gggaugagccuggguuugg

SEQ ID NO: 426437 - RNA, 19 nt, Homo sapiens
cagcugccauggccaccaa

SEQ ID NO: 426438 - RNA, 19 nt, Homo sapiens
gagcugaaagggccauuac

SEQ ID NO: 426439 - RNA, 19 nt, Homo sapiens
ccaaggaugcuaaugaaaa

SEQ ID NO: 426440 - RNA, 19 nt, Homo sapiens
cgaagcauccagaagaaca

SEQ ID NO: 426441 - RNA, 19 nt, Homo sapiens
gaagaagaaagaggugaag

SEQ ID NO: 426442 - RNA, 19 nt, Homo sapiens
gcuggagaacccugaaaug

SEQ ID NO: 426443 - RNA, 19 nt, Homo sapiens
agaagaaagaggugaagga

SEQ ID NO: 426444 - RNA, 19 nt, Homo sapiens
gagccuggguuuggacucu

SEQ ID NO: 426445 - RNA, 19 nt, Homo sapiens
gcugaaagggccauuacuc

SEQ ID NO: 426446 - RNA, 19 nt, Homo sapiens
caucaagaucguggaguuu

SEQ ID NO: 426447 - RNA, 19 nt, Homo sapiens
ggaugcugcuuagcugauc

SEQ ID NO: 426448 - RNA, 19 nt, Homo sapiens
gccuggguuuggacucuaa

SEQ ID NO: 426449 - RNA, 19 nt, Homo sapiens
gcaggaacagagggugaaa

SEQ ID NO: 426450 - RNA, 19 nt, Homo sapiens
cugccuagauauccugaug

SEQ ID NO: 426451 - RNA, 19 nt, Homo sapiens
gguccauucugcaccucuu

SEQ ID NO: 426452 - RNA, 19 nt, Homo sapiens
agagcaaacaggaacacua

SEQ ID NO: 426453 - RNA, 19 nt, Homo sapiens
cgccgaagcauccagaaga

SEQ ID NO: 426454 - RNA, 19 nt, Homo sapiens
caacaaggugaccaggaau

SEQ ID NO: 426455 - RNA, 19 nt, Homo sapiens
aauaaggagcgacucuuug

SEQ ID NO: 426456 - RNA, 19 nt, Homo sapiens
aggaaucgcugccaguacu

SEQ ID NO: 426457 - RNA, 19 nt, Homo sapiens
gaagcauccagaagaacau

SEQ ID NO: 426458 - RNA, 19 nt, Homo sapiens
ucaccaaggucagcaaagc

SEQ ID NO: 426459 - RNA, 19 nt, Homo sapiens
agaagaagaaagaggugaa

SEQ ID NO: 426460 - RNA, 19 nt, Homo sapiens
ggcccgaugccucccuuaa

SEQ ID NO: 426461 - RNA, 19 nt, Homo sapiens
cagccagcccuacauguuc

SEQ ID NO: 426462 - RNA, 19 nt, Homo sapiens
ggaucccucucucccuagu

SEQ ID NO: 426463 - RNA, 19 nt, Homo sapiens
uggcucgggugcagaguuc

SEQ ID NO: 426464 - RNA, 19 nt, Homo sapiens
gcccgaugccucccuuaau

SEQ ID NO: 426465 - RNA, 19 nt, Homo sapiens
cagaagaacaugguguaca

SEQ ID NO: 426466 - RNA, 19 nt, Homo sapiens
ccagagcaggacaccauga

SEQ ID NO: 426467 - RNA, 19 nt, Homo sapiens
cccgcuguaucgcauauug

SEQ ID NO: 426468 - RNA, 19 nt, Homo sapiens
ucaagaucguggaguuugc

SEQ ID NO: 426469 - RNA, 19 nt, Homo sapiens
uaaaguaacucgagucuuc

SEQ ID NO: 426470 - RNA, 19 nt, Homo sapiens
caagauaggaugaaugaua

SEQ ID NO: 426471 - RNA, 19 nt, Homo sapiens
gcauauggcugcaucaaau

SEQ ID NO: 426472 - RNA, 19 nt, Homo sapiens
caagacaaauuuccagauu

SEQ ID NO: 426473 - RNA, 19 nt, Homo sapiens
gaaaggaacaaaccaacua

SEQ ID NO: 426474 - RNA, 19 nt, Homo sapiens
ggucuuaacugcagaggaa

SEQ ID NO: 426475 - RNA, 19 nt, Homo sapiens
aaauacagcugcuuacuug

SEQ ID NO: 426476 - RNA, 19 nt, Homo sapiens
gagaaggaauggaaacuag

SEQ ID NO: 426477 - RNA, 19 nt, Homo sapiens
gcucaucgcucaccugcaa

SEQ ID NO: 426478 - RNA, 19 nt, Homo sapiens
ugaccuggcugcuauuaaa

SEQ ID NO: 426479 - RNA, 19 nt, Homo sapiens
ccaaacaccucccagacaa

SEQ ID NO: 426480 - RNA, 19 nt, Homo sapiens
aaacuaggccggugcauuu

SEQ ID NO: 426481 - RNA, 19 nt, Homo sapiens
gaaauacagcugcuuacuu

SEQ ID NO: 426482 - RNA, 19 nt, Homo sapiens
ggagaaagauagacagacu

SEQ ID NO: 426483 - RNA, 19 nt, Homo sapiens
gaggaaauacagcugcuua

SEQ ID NO: 426484 - RNA, 19 nt, Homo sapiens
caucaaauaugcugaccuu

SEQ ID NO: 426485 - RNA, 19 nt, Homo sapiens
gaugauggcagaaagauug

SEQ ID NO: 426486 - RNA, 19 nt, Homo sapiens
caucugaccuggcugcuau

SEQ ID NO: 426487 - RNA, 19 nt, Homo sapiens
gaagcgagcauaucagugu

SEQ ID NO: 426488 - RNA, 19 nt, Homo sapiens
gguaugacgugcucagguu

SEQ ID NO: 426489 - RNA, 19 nt, Homo sapiens
gaaaggauuuuguaucaga

SEQ ID NO: 426490 - RNA, 19 nt, Homo sapiens
gcacuuccagacaauauuu

SEQ ID NO: 426491 - RNA, 19 nt, Homo sapiens
ggucuuuggucaugcaauu

SEQ ID NO: 426492 - RNA, 19 nt, Homo sapiens
agaagagguuugauacuga

SEQ ID NO: 426493 - RNA, 19 nt, Homo sapiens
ggacacaagcauaaguaaa

SEQ ID NO: 426494 - RNA, 19 nt, Homo sapiens
gggaauccuucuaucaaga

SEQ ID NO: 426495 - RNA, 19 nt, Homo sapiens
gacuacaucuucuccuuug

SEQ ID NO: 426496 - RNA, 19 nt, Homo sapiens
cagguuaaaucauguagga

SEQ ID NO: 426497 - RNA, 19 nt, Homo sapiens
gaguauaagccgccucuuu

SEQ ID NO: 426498 - RNA, 19 nt, Homo sapiens
gcacgucuggccaauauug

SEQ ID NO: 426499 - RNA, 19 nt, Homo sapiens
gaaauugaccgguugaaaa

SEQ ID NO: 426500 - RNA, 19 nt, Homo sapiens
ucaaaugauugguugguau

SEQ ID NO: 426501 - RNA, 19 nt, Homo sapiens
gugcucagguuaaaucaug

SEQ ID NO: 426502 - RNA, 19 nt, Homo sapiens
gcauuggacgucucuuuaa

SEQ ID NO: 426503 - RNA, 19 nt, Homo sapiens
gacugaauauucuucgaaa

SEQ ID NO: 426504 - RNA, 19 nt, Homo sapiens
gaaacuaggccggugcauu

SEQ ID NO: 426505 - RNA, 19 nt, Homo sapiens
gcaggaagaagagauuaaa

SEQ ID NO: 426506 - RNA, 19 nt, Homo sapiens
augcugaccuuucccauaa

SEQ ID NO: 426507 - RNA, 19 nt, Homo sapiens
ggaaaauccuccucugcua

SEQ ID NO: 426508 - RNA, 19 nt, Homo sapiens
gauguaauccuucauaggu

SEQ ID NO: 426509 - RNA, 19 nt, Homo sapiens
caagucagcaggccaaguu

SEQ ID NO: 426510 - RNA, 19 nt, Homo sapiens
gcuacuguguggagaaaga

SEQ ID NO: 426511 - RNA, 19 nt, Homo sapiens
gcauaucaguguguaguuc

SEQ ID NO: 426512 - RNA, 19 nt, Homo sapiens
gaacaauugaccagucuuc

SEQ ID NO: 426513 - RNA, 19 nt, Homo sapiens
cauuggcacuguuugcuuu

SEQ ID NO: 426514 - RNA, 19 nt, Homo sapiens
caaauaugcugaccuuucc

SEQ ID NO: 426515 - RNA, 19 nt, Homo sapiens
uaagccgccucuuugaauu

SEQ ID NO: 426516 - RNA, 19 nt, Homo sapiens
gcagaaaggaacaaaccaa

SEQ ID NO: 426517 - RNA, 19 nt, Homo sapiens
ggcguaugcugcuauguga

SEQ ID NO: 426518 - RNA, 19 nt, Homo sapiens
aaagauagacagacuggaa

SEQ ID NO: 426519 - RNA, 19 nt, Homo sapiens
agacauccguugcauaugg

SEQ ID NO: 426520 - RNA, 19 nt, Homo sapiens
ucaaauaugcugaccuuuc

SEQ ID NO: 426521 - RNA, 19 nt, Homo sapiens
ucagacauccguugcauau

SEQ ID NO: 426522 - RNA, 19 nt, Homo sapiens
ucuaagaagagguuugaua

SEQ ID NO: 426523 - RNA, 19 nt, Homo sapiens
ugaccagucuucuagugaa

SEQ ID NO: 426524 - RNA, 19 nt, Homo sapiens
uguaauccuucauagguuu

SEQ ID NO: 426525 - RNA, 19 nt, Homo sapiens
gacacaagcauaaguaaag

SEQ ID NO: 426526 - RNA, 19 nt, Homo sapiens
gcuggcaacugcuuucaca

SEQ ID NO: 426527 - RNA, 19 nt, Homo sapiens
auacugaggaggaauuuaa

SEQ ID NO: 426528 - RNA, 19 nt, Homo sapiens
aagaagagguuugauacug

SEQ ID NO: 426529 - RNA, 19 nt, Homo sapiens
acacaagcauaaguaaaga

SEQ ID NO: 426530 - RNA, 19 nt, Homo sapiens
ggccaauauugaugaagaa

SEQ ID NO: 426531 - RNA, 19 nt, Homo sapiens
cuagaugacagaggaaaua

SEQ ID NO: 426532 - RNA, 19 nt, Homo sapiens
gcgagcauaucagugugua

SEQ ID NO: 426533 - RNA, 19 nt, Homo sapiens
uaucauaggagagaguaua

SEQ ID NO: 426534 - RNA, 19 nt, Homo sapiens
gcaacugcuuucacagagu

SEQ ID NO: 426535 - RNA, 19 nt, Homo sapiens
uuaagaagcgagcauauca

SEQ ID NO: 426536 - RNA, 19 nt, Homo sapiens
gauaggaugaaugauauug

SEQ ID NO: 426537 - RNA, 19 nt, Homo sapiens
guauaagccgccucuuuga

SEQ ID NO: 426538 - RNA, 19 nt, Homo sapiens
gcagcaggaagaagagauu

SEQ ID NO: 426539 - RNA, 19 nt, Homo sapiens
gaugaagaaaugcuccaaa

SEQ ID NO: 426540 - RNA, 19 nt, Homo sapiens
uauugaaggugaacaugug

SEQ ID NO: 426541 - RNA, 19 nt, Homo sapiens
cauauggcugcaucaaaua

SEQ ID NO: 426542 - RNA, 19 nt, Homo sapiens
cauuggacgucucuuuaau

SEQ ID NO: 426543 - RNA, 19 nt, Homo sapiens
gcaagacaaauuuccagau

SEQ ID NO: 426544 - RNA, 19 nt, Homo sapiens
ccuaauauagcuaaagaga

SEQ ID NO: 426545 - RNA, 19 nt, Homo sapiens
caauugaccagucuucuag

SEQ ID NO: 426546 - RNA, 19 nt, Homo sapiens
gguuugauauccugggaau

SEQ ID NO: 426547 - RNA, 19 nt, Homo sapiens
aaaggaacaaaccaacuaa

SEQ ID NO: 426548 - RNA, 19 nt, Homo sapiens
uggccaauauugaugaaga

SEQ ID NO: 426549 - RNA, 19 nt, Homo sapiens
uugcacgucuggccaauau

SEQ ID NO: 426550 - RNA, 19 nt, Homo sapiens
gguuauaccuaugauacau

SEQ ID NO: 426551 - RNA, 19 nt, Homo sapiens
gaauaaaaccuguccaaag

SEQ ID NO: 426552 - RNA, 19 nt, Homo sapiens
uuugauauccugggaauaa

SEQ ID NO: 426553 - RNA, 19 nt, Homo sapiens
gugaacauguggcguaugc

SEQ ID NO: 426554 - RNA, 19 nt, Homo sapiens
ugacuuauuucuccacacu

SEQ ID NO: 426555 - RNA, 19 nt, Homo sapiens
uacagcugcuuacuuguug

SEQ ID NO: 426556 - RNA, 19 nt, Homo sapiens
cauaaccgguugaaugacu

SEQ ID NO: 426557 - RNA, 19 nt, Homo sapiens
gcucagacauccguugcau

SEQ ID NO: 426558 - RNA, 19 nt, Homo sapiens
caaaugauugguugguaug

SEQ ID NO: 426559 - RNA, 19 nt, Homo sapiens
gacaaucugugcacuucca

SEQ ID NO: 426560 - RNA, 19 nt, Homo sapiens
gaccagucuucuagugaau

SEQ ID NO: 426561 - RNA, 19 nt, Homo sapiens
cccauaaccgguugaauga

SEQ ID NO: 426562 - RNA, 19 nt, Homo sapiens
cgacugaauauucuucgaa

SEQ ID NO: 426563 - RNA, 19 nt, Homo sapiens
guaugacccuaaaguaacu

SEQ ID NO: 426564 - RNA, 19 nt, Homo sapiens
ucaccugcaagacaaauuu

SEQ ID NO: 426565 - RNA, 19 nt, Homo sapiens
aguauaagccgccucuuug

SEQ ID NO: 426566 - RNA, 19 nt, Homo sapiens
cagaacaauugaccagucu

SEQ ID NO: 426567 - RNA, 19 nt, Homo sapiens
gcaauuaaggcugcauauc

SEQ ID NO: 426568 - RNA, 19 nt, Homo sapiens
uaacugcagaggaauugaa

SEQ ID NO: 426569 - RNA, 19 nt, Homo sapiens
guacacggcucaucgagaa

SEQ ID NO: 426570 - RNA, 19 nt, Homo sapiens
caugugaacuucuaauuuc

SEQ ID NO: 426571 - RNA, 19 nt, Homo sapiens
ggauuuggcuuuccuugga

SEQ ID NO: 426572 - RNA, 19 nt, Homo sapiens
aaagagggauguaaaguuc

SEQ ID NO: 426573 - RNA, 19 nt, Homo sapiens
gcaaaugaagcaacugaaa

SEQ ID NO: 426574 - RNA, 19 nt, Homo sapiens
ccacaagaguuacaaucaa

SEQ ID NO: 426575 - RNA, 19 nt, Homo sapiens
cacaagaguuacaaucaaa

SEQ ID NO: 426576 - RNA, 19 nt, Homo sapiens
caagaguuguaaucacauu

SEQ ID NO: 426577 - RNA, 19 nt, Homo sapiens
ucaaaguggucuccuuaga

SEQ ID NO: 426578 - RNA, 19 nt, Homo sapiens
aaagacaacaagaggauua

SEQ ID NO: 426579 - RNA, 19 nt, Homo sapiens
gauaaucauggacauauug

SEQ ID NO: 426580 - RNA, 19 nt, Homo sapiens
uggcacagcucacuagugu

SEQ ID NO: 426581 - RNA, 19 nt, Homo sapiens
uggaagcucuuacgugaug

SEQ ID NO: 426582 - RNA, 19 nt, Homo sapiens
aaucaaaguggucuccuua

SEQ ID NO: 426583 - RNA, 19 nt, Homo sapiens
gcuacaacccagagucuuu

SEQ ID NO: 426584 - RNA, 19 nt, Homo sapiens
gcgcuucacuucuucaacu

SEQ ID NO: 426585 - RNA, 19 nt, Homo sapiens
caaucaaaguggucuccuu

SEQ ID NO: 426586 - RNA, 19 nt, Homo sapiens
cuacaacccagagucuuua

SEQ ID NO: 426587 - RNA, 19 nt, Homo sapiens
caacccagagucuuuacuu

SEQ ID NO: 426588 - RNA, 19 nt, Homo sapiens
ggaaauagucagcauaccu

SEQ ID NO: 426589 - RNA, 19 nt, Homo sapiens
gaaaagacaacaagaggau

SEQ ID NO: 426590 - RNA, 19 nt, Homo sapiens
ggaaggugagggacguuug

SEQ ID NO: 426591 - RNA, 19 nt, Homo sapiens
uacgugaugugggaaauga

SEQ ID NO: 426592 - RNA, 19 nt, Homo sapiens
caucugggauuuggcuuuc

SEQ ID NO: 426593 - RNA, 19 nt, Homo sapiens
gccacaagaguuacaauca

SEQ ID NO: 426594 - RNA, 19 nt, Homo sapiens
gugaggcaguggguaagaa

SEQ ID NO: 426595 - RNA, 19 nt, Homo sapiens
caaaugaagcaacugaaaa

SEQ ID NO: 426596 - RNA, 19 nt, Homo sapiens
agacucaucugggauuugg

SEQ ID NO: 426597 - RNA, 19 nt, Homo sapiens
acaagcaaaugaagcaacu

SEQ ID NO: 426598 - RNA, 19 nt, Homo sapiens
cauauugaucccucucuga

SEQ ID NO: 426599 - RNA, 19 nt, Homo sapiens
aaucagaaacccagaccaa

SEQ ID NO: 426600 - RNA, 19 nt, Homo sapiens
caagaguuacaaucaaagu

SEQ ID NO: 426601 - RNA, 19 nt, Homo sapiens
gaaggugagggacguuugg

SEQ ID NO: 426602 - RNA, 19 nt, Homo sapiens
guaaaguucacguggucuu

SEQ ID NO: 426603 - RNA, 19 nt, Homo sapiens
aagcaaaugaagcaacuga

SEQ ID NO: 426604 - RNA, 19 nt, Homo sapiens
cauaucaagaguuguaauc

SEQ ID NO: 426605 - RNA, 19 nt, Homo sapiens
uaucaagaguuguaaucac

SEQ ID NO: 426606 - RNA, 19 nt, Homo sapiens
aucaagaguuguaaucaca

SEQ ID NO: 426607 - RNA, 19 nt, Homo sapiens
ugaggcaguggguaagaaa

SEQ ID NO: 426608 - RNA, 19 nt, Homo sapiens
uccuuagacugaauucaug

SEQ ID NO: 426609 - RNA, 19 nt, Homo sapiens
gaagaaacccgagugcaaa

SEQ ID NO: 426610 - RNA, 19 nt, Homo sapiens
ggaagaaacccgagugcaa

SEQ ID NO: 426611 - RNA, 19 nt, Homo sapiens
gaagagggacuggaagaaa

SEQ ID NO: 426612 - RNA, 19 nt, Homo sapiens
cagacaagcugccggaaga

SEQ ID NO: 426613 - RNA, 19 nt, Homo sapiens
gcaucaaacugggcucuga

SEQ ID NO: 426614 - RNA, 19 nt, Homo sapiens
cuacuucccuggacaguuc

SEQ ID NO: 426615 - RNA, 19 nt, Homo sapiens
ggaagagggacuggaagaa

SEQ ID NO: 426616 - RNA, 19 nt, Homo sapiens
uaaagcugcucucccaaaa

SEQ ID NO: 426617 - RNA, 19 nt, Homo sapiens
gcagcuaagccagcacuga

SEQ ID NO: 426618 - RNA, 19 nt, Homo sapiens
gcaaagucaggcccaaugg

SEQ ID NO: 426619 - RNA, 19 nt, Homo sapiens
gaaacccgagugcaaaguc

SEQ ID NO: 426620 - RNA, 19 nt, Homo sapiens
aaacccgagugcaaaguca

SEQ ID NO: 426621 - RNA, 19 nt, Homo sapiens
aagagggacuggaagaaac

SEQ ID NO: 426622 - RNA, 19 nt, Homo sapiens
uggaggaauuucacaagca

SEQ ID NO: 426623 - RNA, 19 nt, Homo sapiens
auaaagcugcucucccaaa

SEQ ID NO: 426624 - RNA, 19 nt, Homo sapiens
cggaagagggacuggaaga

SEQ ID NO: 426625 - RNA, 19 nt, Homo sapiens
aaacaagacugaaggauca

SEQ ID NO: 426626 - RNA, 19 nt, Homo sapiens
gcacugggcccuguauaua

SEQ ID NO: 426627 - RNA, 19 nt, Homo sapiens
gaagaugaaguacaguauu

SEQ ID NO: 426628 - RNA, 19 nt, Homo sapiens
ggagaugguuggucagaag

SEQ ID NO: 426629 - RNA, 19 nt, Homo sapiens
aagaugaaguacaguauug

SEQ ID NO: 426630 - RNA, 19 nt, Homo sapiens
cauaaaagcugauccacaa

SEQ ID NO: 426631 - RNA, 19 nt, Homo sapiens
gcgauuaggagauaccaaa

SEQ ID NO: 426632 - RNA, 19 nt, Homo sapiens
caagacugaaggaucaaua

SEQ ID NO: 426633 - RNA, 19 nt, Homo sapiens
caggaacugugagcacuuu

SEQ ID NO: 426634 - RNA, 19 nt, Homo sapiens
caacagugcagaggugaaa

SEQ ID NO: 426635 - RNA, 19 nt, Homo sapiens
ggcguucucuagauccuuu

SEQ ID NO: 426636 - RNA, 19 nt, Homo sapiens
cagaagaugaaguacagua

SEQ ID NO: 426637 - RNA, 19 nt, Homo sapiens
acugaaggaucaauaaaca

SEQ ID NO: 426638 - RNA, 19 nt, Homo sapiens
uagauccuuuccucuguuu

SEQ ID NO: 426639 - RNA, 19 nt, Homo sapiens
cuggagaccugauugagau

SEQ ID NO: 426640 - RNA, 19 nt, Homo sapiens
gucagaagaugaaguacag

SEQ ID NO: 426641 - RNA, 19 nt, Homo sapiens
gcaagucccgcuguaaaca

SEQ ID NO: 426642 - RNA, 19 nt, Homo sapiens
gaugguuggucagaagaug

SEQ ID NO: 426643 - RNA, 19 nt, Homo sapiens
ucucaggcguucucuagau

SEQ ID NO: 426644 - RNA, 19 nt, Homo sapiens
gaacugugagcacuuuguc

SEQ ID NO: 426645 - RNA, 19 nt, Homo sapiens
ggagaccugauugagauuu

SEQ ID NO: 426646 - RNA, 19 nt, Homo sapiens
cuaauugaaacaagacuga

SEQ ID NO: 426647 - RNA, 19 nt, Homo sapiens
gagcacugggcccuguaua

SEQ ID NO: 426648 - RNA, 19 nt, Homo sapiens
cuagauccuuuccucuguu

SEQ ID NO: 426649 - RNA, 19 nt, Homo sapiens
uauggcaagucccgcugua

SEQ ID NO: 426650 - RNA, 19 nt, Homo sapiens
acaacagcuuggaccauga

SEQ ID NO: 426651 - RNA, 19 nt, Homo sapiens
ccaucuggcuccuccaagu

SEQ ID NO: 426652 - RNA, 19 nt, Homo sapiens
agacugaaggaucaauaaa

SEQ ID NO: 426653 - RNA, 19 nt, Homo sapiens
cagcugagauauggcaagu

SEQ ID NO: 426654 - RNA, 19 nt, Homo sapiens
gaugaaguacaguauugug

SEQ ID NO: 426655 - RNA, 19 nt, Homo sapiens
ggucagaagaugaaguaca

SEQ ID NO: 426656 - RNA, 19 nt, Homo sapiens
ucuagauccuuuccucugu

SEQ ID NO: 426657 - RNA, 19 nt, Homo sapiens
ggaacugugagcacuuugu

SEQ ID NO: 426658 - RNA, 19 nt, Homo sapiens
uggcaagucccgcuguaaa

SEQ ID NO: 426659 - RNA, 19 nt, Homo sapiens
gcaggaacugugagcacuu

SEQ ID NO: 426660 - RNA, 19 nt, Homo sapiens
gagaccugauugagauuuu

SEQ ID NO: 426661 - RNA, 19 nt, Homo sapiens
ggaaaaggccaagguugaa

SEQ ID NO: 426662 - RNA, 19 nt, Homo sapiens
gagaugguuggucagaaga

SEQ ID NO: 426663 - RNA, 19 nt, Homo sapiens
aagacugaaggaucaauaa

SEQ ID NO: 426664 - RNA, 19 nt, Homo sapiens
agaagaugaaguacaguau

SEQ ID NO: 426665 - RNA, 19 nt, Homo sapiens
cagcuuggaccaugaguac

SEQ ID NO: 426666 - RNA, 19 nt, Homo sapiens
gcaacagugcagaggugaa

SEQ ID NO: 426667 - RNA, 19 nt, Homo sapiens
acaaaauccuguguuagaa

SEQ ID NO: 426668 - RNA, 19 nt, Homo sapiens
caacaacagcuuggaccau

SEQ ID NO: 426669 - RNA, 19 nt, Homo sapiens
ccuggagaccugauugaga

SEQ ID NO: 426670 - RNA, 19 nt, Homo sapiens
ccacggcgcuuggaauccu

SEQ ID NO: 426671 - RNA, 19 nt, Homo sapiens
aaaccuggagaccugauug

SEQ ID NO: 426672 - RNA, 19 nt, Homo sapiens
gaaaucaacugacaagaaa

SEQ ID NO: 426673 - RNA, 19 nt, Homo sapiens
ggaagaagauccacaugaa

SEQ ID NO: 426674 - RNA, 19 nt, Homo sapiens
gaacauacuuucagagcuu

SEQ ID NO: 426675 - RNA, 19 nt, Homo sapiens
ggauguggguuacaaauuu

SEQ ID NO: 426676 - RNA, 19 nt, Homo sapiens
ggagauauguucauuguuc

SEQ ID NO: 426677 - RNA, 19 nt, Homo sapiens
gcaaggaaaucuauaauac

SEQ ID NO: 426678 - RNA, 19 nt, Homo sapiens
gaacaaucuuugcuguaua

SEQ ID NO: 426679 - RNA, 19 nt, Homo sapiens
uaacagaacugcuucaaca

SEQ ID NO: 426680 - RNA, 19 nt, Homo sapiens
uagcaaaucuuguggaauu

SEQ ID NO: 426681 - RNA, 19 nt, Homo sapiens
gaaagguuaucuucugaaa

SEQ ID NO: 426682 - RNA, 19 nt, Homo sapiens
caacaaacaucguaugauc

SEQ ID NO: 426683 - RNA, 19 nt, Homo sapiens
ggaacaaucuuugcuguau

SEQ ID NO: 426684 - RNA, 19 nt, Homo sapiens
gauaguaguucagcacuuu

SEQ ID NO: 426685 - RNA, 19 nt, Homo sapiens
caggauauuugcacuauuu

SEQ ID NO: 426686 - RNA, 19 nt, Homo sapiens
ccaccgacauugagauaua

SEQ ID NO: 426687 - RNA, 19 nt, Homo sapiens
gauguggguuacaaauuua

SEQ ID NO: 426688 - RNA, 19 nt, Homo sapiens
ccacggauguucaauauca

SEQ ID NO: 426689 - RNA, 19 nt, Homo sapiens
agaaaucuguucagcauaa

SEQ ID NO: 426690 - RNA, 19 nt, Homo sapiens
auucauggcuucagaaaua

SEQ ID NO: 426691 - RNA, 19 nt, Homo sapiens
gcacgauacucuauggaaa

SEQ ID NO: 426692 - RNA, 19 nt, Homo sapiens
caagaacacugauauuagu

SEQ ID NO: 426693 - RNA, 19 nt, Homo sapiens
gaaauaagcauggaagaug

SEQ ID NO: 426694 - RNA, 19 nt, Homo sapiens
uaaggaaccuguaccaaug

SEQ ID NO: 426695 - RNA, 19 nt, Homo sapiens
agacauggcucucaccaaa

SEQ ID NO: 426696 - RNA, 19 nt, Homo sapiens
gaaaugcuaugacuguauc

SEQ ID NO: 426697 - RNA, 19 nt, Homo sapiens
gaacuucgaacgcucagua

SEQ ID NO: 426698 - RNA, 19 nt, Homo sapiens
gaagaagaguacagugaau

SEQ ID NO: 426699 - RNA, 19 nt, Homo sapiens
gaacuuagcaaaucuugug

SEQ ID NO: 426700 - RNA, 19 nt, Homo sapiens
gaagaguacagugaauuua

SEQ ID NO: 426701 - RNA, 19 nt, Homo sapiens
ugaaaggucugcaggcauu

SEQ ID NO: 426702 - RNA, 19 nt, Homo sapiens
gcaccuugauggagcagua

SEQ ID NO: 426703 - RNA, 19 nt, Homo sapiens
gaaagggcaugccacagau

SEQ ID NO: 426704 - RNA, 19 nt, Homo sapiens
uguaacaucuaccugaaua

SEQ ID NO: 426705 - RNA, 19 nt, Homo sapiens
gaacaaguacucaaugaca

SEQ ID NO: 426706 - RNA, 19 nt, Homo sapiens
ccacauggaaucaaucuuu

SEQ ID NO: 426707 - RNA, 19 nt, Homo sapiens
gcaagaacacugauauuag

SEQ ID NO: 426708 - RNA, 19 nt, Homo sapiens
cagcauaaguggccuacaa

SEQ ID NO: 426709 - RNA, 19 nt, Homo sapiens
uaacacaccuauugaacau

SEQ ID NO: 426710 - RNA, 19 nt, Homo sapiens
ccagcaaccuuguaagcua

SEQ ID NO: 426711 - RNA, 19 nt, Homo sapiens
cacauggaaucaaucuuua

SEQ ID NO: 426712 - RNA, 19 nt, Homo sapiens
uuucagagcuuguggagaa

SEQ ID NO: 426713 - RNA, 19 nt, Homo sapiens
gaagaugugaacacuaauu

SEQ ID NO: 426714 - RNA, 19 nt, Homo sapiens
ugaagccacuacccuauuu

SEQ ID NO: 426715 - RNA, 19 nt, Homo sapiens
uguaacuacuuccugauua

SEQ ID NO: 426716 - RNA, 19 nt, Homo sapiens
cauaaguggccuacaaaua

SEQ ID NO: 426717 - RNA, 19 nt, Homo sapiens
ccaaacaggaagcuuauaa

SEQ ID NO: 426718 - RNA, 19 nt, Homo sapiens
gaagauagaaggcguguac

SEQ ID NO: 426719 - RNA, 19 nt, Homo sapiens
gugcagaacuuagcaaauc

SEQ ID NO: 426720 - RNA, 19 nt, Homo sapiens
gagaaagaacuaugaaauc

SEQ ID NO: 426721 - RNA, 19 nt, Homo sapiens
cuacacaguuuguucauca

SEQ ID NO: 426722 - RNA, 19 nt, Homo sapiens
aaauaagcauggaagauga

SEQ ID NO: 426723 - RNA, 19 nt, Homo sapiens
ggacaagaccgaacacuac

SEQ ID NO: 426724 - RNA, 19 nt, Homo sapiens
ggaacuucauguagucuau

SEQ ID NO: 426725 - RNA, 19 nt, Homo sapiens
ccugauaucuuauuuaugc

SEQ ID NO: 426726 - RNA, 19 nt, Homo sapiens
aagcaaagauccugauauc

SEQ ID NO: 426727 - RNA, 19 nt, Homo sapiens
uauaauaccauccgucgua

SEQ ID NO: 426728 - RNA, 19 nt, Homo sapiens
ucaccaaacugcccacuuc

SEQ ID NO: 426729 - RNA, 19 nt, Homo sapiens
acagucauguuucuuguuu

SEQ ID NO: 426730 - RNA, 19 nt, Homo sapiens
gaacuucugacuacuuguu

SEQ ID NO: 426731 - RNA, 19 nt, Homo sapiens
gcagacuguucuuacugua

SEQ ID NO: 426732 - RNA, 19 nt, Homo sapiens
gguaauucacuucaguuua

SEQ ID NO: 426733 - RNA, 19 nt, Homo sapiens
gaacacuacuggccagcau

SEQ ID NO: 426734 - RNA, 19 nt, Homo sapiens
gcccauaaacucccaguaa

SEQ ID NO: 426735 - RNA, 19 nt, Homo sapiens
uaauagaucucaguguaug

SEQ ID NO: 426736 - RNA, 19 nt, Homo sapiens
uuaggaauaugaccauuug

SEQ ID NO: 426737 - RNA, 19 nt, Homo sapiens
gaacuaugaaaucaacuga

SEQ ID NO: 426738 - RNA, 19 nt, Homo sapiens
uagaugaacuugggaaugu

SEQ ID NO: 426739 - RNA, 19 nt, Homo sapiens
augaagaugugaacacuaa

SEQ ID NO: 426740 - RNA, 19 nt, Homo sapiens
ggcaaggaaaucuauaaua

SEQ ID NO: 426741 - RNA, 19 nt, Homo sapiens
accagacacugaugaaaua

SEQ ID NO: 426742 - RNA, 19 nt, Homo sapiens
guguggagauuacuacauu

SEQ ID NO: 426743 - RNA, 19 nt, Homo sapiens
ugaaaucaacugacaagaa

SEQ ID NO: 426744 - RNA, 19 nt, Homo sapiens
guuaaguccaucaaaguua

SEQ ID NO: 426745 - RNA, 19 nt, Homo sapiens
aagaacaaguacucaauga

SEQ ID NO: 426746 - RNA, 19 nt, Homo sapiens
guaacuacuuccugauuag

SEQ ID NO: 426747 - RNA, 19 nt, Homo sapiens
guacagaccaccuuucaca

SEQ ID NO: 426748 - RNA, 19 nt, Homo sapiens
cagcucccauauaccauua

SEQ ID NO: 426749 - RNA, 19 nt, Homo sapiens
gcaggcauuuugcaauuua

SEQ ID NO: 426750 - RNA, 19 nt, Homo sapiens
uacgagcuauucuaccuua

SEQ ID NO: 426751 - RNA, 19 nt, Homo sapiens
gcagggaagucuggcaguu

SEQ ID NO: 426752 - RNA, 19 nt, Homo sapiens
cccauaaacucccaguaaa

SEQ ID NO: 426753 - RNA, 19 nt, Homo sapiens
gcagaggauuggaugaaag

SEQ ID NO: 426754 - RNA, 19 nt, Homo sapiens
caagaguuguuagugguuu

SEQ ID NO: 426755 - RNA, 19 nt, Homo sapiens
acaaauaccaccaugagaa

SEQ ID NO: 426756 - RNA, 19 nt, Homo sapiens
gggaagaagauccacauga

SEQ ID NO: 426757 - RNA, 19 nt, Homo sapiens
agagcgggcuucaacauga

SEQ ID NO: 426758 - RNA, 19 nt, Homo sapiens
ggaggccgguauuauaaca

SEQ ID NO: 426759 - RNA, 19 nt, Homo sapiens
gaugaacaaggccuuauug

SEQ ID NO: 426760 - RNA, 19 nt, Homo sapiens
gagauauguucauuguuca

SEQ ID NO: 426761 - RNA, 19 nt, Homo sapiens
ccaagauucugcuggugaa

SEQ ID NO: 426762 - RNA, 19 nt, Homo sapiens
gauucuccaucuccuauug

SEQ ID NO: 426763 - RNA, 19 nt, Homo sapiens
ugaagaagcccauaaacuc

SEQ ID NO: 426764 - RNA, 19 nt, Homo sapiens
ggauggauguggguuacaa

SEQ ID NO: 426765 - RNA, 19 nt, Homo sapiens
uaacuggauugcagacugu

SEQ ID NO: 426766 - RNA, 19 nt, Homo sapiens
ucauguagucuaugcuuua

SEQ ID NO: 426767 - RNA, 19 nt, Homo sapiens
ugccacagaugaaugguuu

SEQ ID NO: 426768 - RNA, 19 nt, Homo sapiens
aaggagauauguucauugu

SEQ ID NO: 426769 - RNA, 19 nt, Homo sapiens
ugacaauuguguauaacug

SEQ ID NO: 426770 - RNA, 19 nt, Homo sapiens
cuugauaucucgaacuuuc

SEQ ID NO: 426771 - RNA, 19 nt, Homo sapiens
gcaggauauuugcacuauu

SEQ ID NO: 426772 - RNA, 19 nt, Homo sapiens
gaaaucaacugacaagaaa

SEQ ID NO: 426773 - RNA, 19 nt, Homo sapiens
ggaagaagauccacaugaa

SEQ ID NO: 426774 - RNA, 19 nt, Homo sapiens
gaacauacuuucagagcuu

SEQ ID NO: 426775 - RNA, 19 nt, Homo sapiens
ggauguggguuacaaauuu

SEQ ID NO: 426776 - RNA, 19 nt, Homo sapiens
ggagauauguucauuguuc

SEQ ID NO: 426777 - RNA, 19 nt, Homo sapiens
gcaaggaaaucuauaauac

SEQ ID NO: 426778 - RNA, 19 nt, Homo sapiens
gaacaaucuuugcuguaua

SEQ ID NO: 426779 - RNA, 19 nt, Homo sapiens
uaacagaacugcuucaaca

SEQ ID NO: 426780 - RNA, 19 nt, Homo sapiens
uagcaaaucuuguggaauu

SEQ ID NO: 426781 - RNA, 19 nt, Homo sapiens
gaaagguuaucuucugaaa

SEQ ID NO: 426782 - RNA, 19 nt, Homo sapiens
caacaaacaucguaugauc

SEQ ID NO: 426783 - RNA, 19 nt, Homo sapiens
ggaacaaucuuugcuguau

SEQ ID NO: 426784 - RNA, 19 nt, Homo sapiens
gauaguaguucagcacuuu

SEQ ID NO: 426785 - RNA, 19 nt, Homo sapiens
gaaaagaaguggaaaugaa

SEQ ID NO: 426786 - RNA, 19 nt, Homo sapiens
caggauauuugcacuauuu

SEQ ID NO: 426787 - RNA, 19 nt, Homo sapiens
ccaccgacauugagauaua

SEQ ID NO: 426788 - RNA, 19 nt, Homo sapiens
gauguggguuacaaauuua

SEQ ID NO: 426789 - RNA, 19 nt, Homo sapiens
ccacggauguucaauauca

SEQ ID NO: 426790 - RNA, 19 nt, Homo sapiens
agaaaucuguucagcauaa

SEQ ID NO: 426791 - RNA, 19 nt, Homo sapiens
auucauggcuucagaaaua

SEQ ID NO: 426792 - RNA, 19 nt, Homo sapiens
gcacgauacucuauggaaa

SEQ ID NO: 426793 - RNA, 19 nt, Homo sapiens
caagaacacugauauuagu

SEQ ID NO: 426794 - RNA, 19 nt, Homo sapiens
gaaauaagcauggaagaug

SEQ ID NO: 426795 - RNA, 19 nt, Homo sapiens
uaaggaaccuguaccaaug

SEQ ID NO: 426796 - RNA, 19 nt, Homo sapiens
gaaaugcuaugacuguauc

SEQ ID NO: 426797 - RNA, 19 nt, Homo sapiens
gaacuucgaacgcucagua

SEQ ID NO: 426798 - RNA, 19 nt, Homo sapiens
gaagaagaguacagugaau

SEQ ID NO: 426799 - RNA, 19 nt, Homo sapiens
gaacuuagcaaaucuugug

SEQ ID NO: 426800 - RNA, 19 nt, Homo sapiens
gaagaguacagugaauuua

SEQ ID NO: 426801 - RNA, 19 nt, Homo sapiens
ugaaaggucugcaggcauu

SEQ ID NO: 426802 - RNA, 19 nt, Homo sapiens
gcaccuugauggagcagua

SEQ ID NO: 426803 - RNA, 19 nt, Homo sapiens
gaaagggcaugccacagau

SEQ ID NO: 426804 - RNA, 19 nt, Homo sapiens
uguaacaucuaccugaaua

SEQ ID NO: 426805 - RNA, 19 nt, Homo sapiens
gaacaaguacucaaugaca

SEQ ID NO: 426806 - RNA, 19 nt, Homo sapiens
ccacauggaaucaaucuuu

SEQ ID NO: 426807 - RNA, 19 nt, Homo sapiens
gcaagaacacugauauuag

SEQ ID NO: 426808 - RNA, 19 nt, Homo sapiens
cagcauaaguggccuacaa

SEQ ID NO: 426809 - RNA, 19 nt, Homo sapiens
uaacacaccuauugaacau

SEQ ID NO: 426810 - RNA, 19 nt, Homo sapiens
ccagcaaccuuguaagcua

SEQ ID NO: 426811 - RNA, 19 nt, Homo sapiens
cacauggaaucaaucuuua

SEQ ID NO: 426812 - RNA, 19 nt, Homo sapiens
uuucagagcuuguggagaa

SEQ ID NO: 426813 - RNA, 19 nt, Homo sapiens
gaagaugugaacacuaauu

SEQ ID NO: 426814 - RNA, 19 nt, Homo sapiens
ugaagccacuacccuauuu

SEQ ID NO: 426815 - RNA, 19 nt, Homo sapiens
uguaacuacuuccugauua

SEQ ID NO: 426816 - RNA, 19 nt, Homo sapiens
cauaaguggccuacaaaua

SEQ ID NO: 426817 - RNA, 19 nt, Homo sapiens
ccaaacaggaagcuuauaa

SEQ ID NO: 426818 - RNA, 19 nt, Homo sapiens
gaagauagaaggcguguac

SEQ ID NO: 426819 - RNA, 19 nt, Homo sapiens
gugcagaacuuagcaaauc

SEQ ID NO: 426820 - RNA, 19 nt, Homo sapiens
uaagacugcuguucaggaa

SEQ ID NO: 426821 - RNA, 19 nt, Homo sapiens
gagaaagaacuaugaaauc

SEQ ID NO: 426822 - RNA, 19 nt, Homo sapiens
cuacacaguuuguucauca

SEQ ID NO: 426823 - RNA, 19 nt, Homo sapiens
aaauaagcauggaagauga

SEQ ID NO: 426824 - RNA, 19 nt, Homo sapiens
ggacaagaccgaacacuac

SEQ ID NO: 426825 - RNA, 19 nt, Homo sapiens
ggaacuucauguagucuau

SEQ ID NO: 426826 - RNA, 19 nt, Homo sapiens
ccugauaucuuauuuaugc

SEQ ID NO: 426827 - RNA, 19 nt, Homo sapiens
aagcaaagauccugauauc

SEQ ID NO: 426828 - RNA, 19 nt, Homo sapiens
uauaauaccauccgucgua

SEQ ID NO: 426829 - RNA, 19 nt, Homo sapiens
acagucauguuucuuguuu

SEQ ID NO: 426830 - RNA, 19 nt, Homo sapiens
gaacuucugacuacuuguu

SEQ ID NO: 426831 - RNA, 19 nt, Homo sapiens
gcagacuguucuuacugua

SEQ ID NO: 426832 - RNA, 19 nt, Homo sapiens
gguaauucacuucaguuua

SEQ ID NO: 426833 - RNA, 19 nt, Homo sapiens
gaacacuacuggccagcau

SEQ ID NO: 426834 - RNA, 19 nt, Homo sapiens
gcccauaaacucccaguaa

SEQ ID NO: 426835 - RNA, 19 nt, Homo sapiens
uaauagaucucaguguaug

SEQ ID NO: 426836 - RNA, 19 nt, Homo sapiens
uuaggaauaugaccauuug

SEQ ID NO: 426837 - RNA, 19 nt, Homo sapiens
gaacuaugaaaucaacuga

SEQ ID NO: 426838 - RNA, 19 nt, Homo sapiens
uagaugaacuugggaaugu

SEQ ID NO: 426839 - RNA, 19 nt, Homo sapiens
augaagaugugaacacuaa

SEQ ID NO: 426840 - RNA, 19 nt, Homo sapiens
ggcaaggaaaucuauaaua

SEQ ID NO: 426841 - RNA, 19 nt, Homo sapiens
accagacacugaugaaaua

SEQ ID NO: 426842 - RNA, 19 nt, Homo sapiens
guguggagauuacuacauu

SEQ ID NO: 426843 - RNA, 19 nt, Homo sapiens
ugaaaucaacugacaagaa

SEQ ID NO: 426844 - RNA, 19 nt, Homo sapiens
guuaaguccaucaaaguua

SEQ ID NO: 426845 - RNA, 19 nt, Homo sapiens
aagaacaaguacucaauga

SEQ ID NO: 426846 - RNA, 19 nt, Homo sapiens
guaacuacuuccugauuag

SEQ ID NO: 426847 - RNA, 19 nt, Homo sapiens
guacagaccaccuuucaca

SEQ ID NO: 426848 - RNA, 19 nt, Homo sapiens
gcagggaagucuggcaguu

SEQ ID NO: 426849 - RNA, 19 nt, Homo sapiens
cagcucccauauaccauua

SEQ ID NO: 426850 - RNA, 19 nt, Homo sapiens
gcaggcauuuugcaauuua

SEQ ID NO: 426851 - RNA, 19 nt, Homo sapiens
uacgagcuauucuaccuua

SEQ ID NO: 426852 - RNA, 19 nt, Homo sapiens
agacugcuguucaggaauu

SEQ ID NO: 426853 - RNA, 19 nt, Homo sapiens
cccauaaacucccaguaaa

SEQ ID NO: 426854 - RNA, 19 nt, Homo sapiens
gcagaggauuggaugaaag

SEQ ID NO: 426855 - RNA, 19 nt, Homo sapiens
caagaguuguuagugguuu

SEQ ID NO: 426856 - RNA, 19 nt, Homo sapiens
acaaauaccaccaugagaa

SEQ ID NO: 426857 - RNA, 19 nt, Homo sapiens
gggaagaagauccacauga

SEQ ID NO: 426858 - RNA, 19 nt, Homo sapiens
ggaggccgguauuauaaca

SEQ ID NO: 426859 - RNA, 19 nt, Homo sapiens
gaugaacaaggccuuauug

SEQ ID NO: 426860 - RNA, 19 nt, Homo sapiens
gagauauguucauuguuca

SEQ ID NO: 426861 - RNA, 19 nt, Homo sapiens
ccaagauucugcuggugaa

SEQ ID NO: 426862 - RNA, 19 nt, Homo sapiens
gauucuccaucuccuauug

SEQ ID NO: 426863 - RNA, 19 nt, Homo sapiens
ugaagaagcccauaaacuc

SEQ ID NO: 426864 - RNA, 19 nt, Homo sapiens
ggauggauguggguuacaa

SEQ ID NO: 426865 - RNA, 19 nt, Homo sapiens
uaacuggauugcagacugu

SEQ ID NO: 426866 - RNA, 19 nt, Homo sapiens
ucauguagucuaugcuuua

SEQ ID NO: 426867 - RNA, 19 nt, Homo sapiens
ugccacagaugaaugguuu

SEQ ID NO: 426868 - RNA, 19 nt, Homo sapiens
aaggagauauguucauugu

SEQ ID NO: 426869 - RNA, 19 nt, Homo sapiens
ugacaauuguguauaacug

SEQ ID NO: 426870 - RNA, 19 nt, Homo sapiens
cuugauaucucgaacuuuc

SEQ ID NO: 426871 - RNA, 19 nt, Homo sapiens
gcaggauauuugcacuauu

SEQ ID NO: 426872 - RNA, 19 nt, Homo sapiens
gaaagcaucuuagaguuua

SEQ ID NO: 426873 - RNA, 19 nt, Homo sapiens
gaaagagccugaugauuau

SEQ ID NO: 426874 - RNA, 19 nt, Homo sapiens
gaaagaaggugagauguau

SEQ ID NO: 426875 - RNA, 19 nt, Homo sapiens
agaaagagccugaugauua

SEQ ID NO: 426876 - RNA, 19 nt, Homo sapiens
gaauuagacuugaaggaua

SEQ ID NO: 426877 - RNA, 19 nt, Homo sapiens
acaaagagaucuccguaua

SEQ ID NO: 426878 - RNA, 19 nt, Homo sapiens
gaaauuggcucugcuguca

SEQ ID NO: 426879 - RNA, 19 nt, Homo sapiens
caagaacuuuccaguauuu

SEQ ID NO: 426880 - RNA, 19 nt, Homo sapiens
gcaaauaacuguguagaag

SEQ ID NO: 426881 - RNA, 19 nt, Homo sapiens
gcagagagcucaccuacca

SEQ ID NO: 426882 - RNA, 19 nt, Homo sapiens
gcagauggcuacucagaga

SEQ ID NO: 426883 - RNA, 19 nt, Homo sapiens
gaaguaaccagauccagua

SEQ ID NO: 426884 - RNA, 19 nt, Homo sapiens
gcagacauccaaauagaua

SEQ ID NO: 426885 - RNA, 19 nt, Homo sapiens
gaaagagggagauaaugua

SEQ ID NO: 426886 - RNA, 19 nt, Homo sapiens
guaacaaccuuuaagacaa

SEQ ID NO: 426887 - RNA, 19 nt, Homo sapiens
gaaacgaugguucugcuua

SEQ ID NO: 426888 - RNA, 19 nt, Homo sapiens
uaaaagagcucaaggaaga

SEQ ID NO: 426889 - RNA, 19 nt, Homo sapiens
ggaaagcaucuuagaguuu

SEQ ID NO: 426890 - RNA, 19 nt, Homo sapiens
guacuaugguccuuugaaa

SEQ ID NO: 426891 - RNA, 19 nt, Homo sapiens
gcaauccgcaguuuaauga

SEQ ID NO: 426892 - RNA, 19 nt, Homo sapiens
aaagaagacuuguguaauc

SEQ ID NO: 426893 - RNA, 19 nt, Homo sapiens
ggaagaggcuuguggaacu

SEQ ID NO: 426894 - RNA, 19 nt, Homo sapiens
gcagugagcagcuuuguau

SEQ ID NO: 426895 - RNA, 19 nt, Homo sapiens
guaaccagauccaguaguu

SEQ ID NO: 426896 - RNA, 19 nt, Homo sapiens
gaagaacucggauuggaaa

SEQ ID NO: 426897 - RNA, 19 nt, Homo sapiens
gaagaggcuuguggaacua

SEQ ID NO: 426898 - RNA, 19 nt, Homo sapiens
gauuguuucuguaccauaa

SEQ ID NO: 426899 - RNA, 19 nt, Homo sapiens
gggaaagcaucuuagaguu

SEQ ID NO: 426900 - RNA, 19 nt, Homo sapiens
gaagacagagaaacagaaa

SEQ ID NO: 426901 - RNA, 19 nt, Homo sapiens
acucagagauuuccuaaug

SEQ ID NO: 426902 - RNA, 19 nt, Homo sapiens
caagcaauccgcaguuuaa

SEQ ID NO: 426903 - RNA, 19 nt, Homo sapiens
cagaagaacuggaaaauau

SEQ ID NO: 426904 - RNA, 19 nt, Homo sapiens
cauuaacucucaucucaaa

SEQ ID NO: 426905 - RNA, 19 nt, Homo sapiens
ggaaacaagucauccaaaa

SEQ ID NO: 426906 - RNA, 19 nt, Homo sapiens
ccaagaacuuuccaguauu

SEQ ID NO: 426907 - RNA, 19 nt, Homo sapiens
aaacgaugguucugcuuaa

SEQ ID NO: 426908 - RNA, 19 nt, Homo sapiens
agugaaauaugucgagaua

SEQ ID NO: 426909 - RNA, 19 nt, Homo sapiens
ccagaugcacagacaauua

SEQ ID NO: 426910 - RNA, 19 nt, Homo sapiens
ccaaagcugugacccuuau

SEQ ID NO: 426911 - RNA, 19 nt, Homo sapiens
uccaagaacuuuccaguau

SEQ ID NO: 426912 - RNA, 19 nt, Homo sapiens
aaugagagauuguuucugu

SEQ ID NO: 426913 - RNA, 19 nt, Homo sapiens
gcaagucaaguuucaaaga

SEQ ID NO: 426914 - RNA, 19 nt, Homo sapiens
uaaggcagauggcuacuca

SEQ ID NO: 426915 - RNA, 19 nt, Homo sapiens
agagggagauaauguagaa

SEQ ID NO: 426916 - RNA, 19 nt, Homo sapiens
ugaaagaaggugagaugua

SEQ ID NO: 426917 - RNA, 19 nt, Homo sapiens
gcacagacaauuagaacau

SEQ ID NO: 426918 - RNA, 19 nt, Homo sapiens
gagauuaagguuccuguga

SEQ ID NO: 426919 - RNA, 19 nt, Homo sapiens
cagagaaacagaaagaauu

SEQ ID NO: 426920 - RNA, 19 nt, Homo sapiens
uguagaagcuaaugaaugg

SEQ ID NO: 426921 - RNA, 19 nt, Homo sapiens
ggaagaacucggauuggaa

SEQ ID NO: 426922 - RNA, 19 nt, Homo sapiens
caaggaagaacucggauug

SEQ ID NO: 426923 - RNA, 19 nt, Homo sapiens
ugugaaaucgauccuauua

SEQ ID NO: 426924 - RNA, 19 nt, Homo sapiens
caagaugcaaacacaauuu

SEQ ID NO: 426925 - RNA, 19 nt, Homo sapiens
acagauugguucagaagaa

SEQ ID NO: 426926 - RNA, 19 nt, Homo sapiens
gcaccaugauaaacuuguu

SEQ ID NO: 426927 - RNA, 19 nt, Homo sapiens
ggcaagaucugugaagcaa

SEQ ID NO: 426928 - RNA, 19 nt, Homo sapiens
caagucaaguuucaaagag

SEQ ID NO: 426929 - RNA, 19 nt, Homo sapiens
aacauuaacucucaucuca

SEQ ID NO: 426930 - RNA, 19 nt, Homo sapiens
gccguaguaucaccucaua

SEQ ID NO: 426931 - RNA, 19 nt, Homo sapiens
gaagaggaggacauugaaa

SEQ ID NO: 426932 - RNA, 19 nt, Homo sapiens
auucagagguucaggguaa

SEQ ID NO: 426933 - RNA, 19 nt, Homo sapiens
ggagaaaccacucuauguc

SEQ ID NO: 426934 - RNA, 19 nt, Homo sapiens
gugagcagcuuuguauuuc

SEQ ID NO: 426935 - RNA, 19 nt, Homo sapiens
gaacugauaacggagaaug

SEQ ID NO: 426936 - RNA, 19 nt, Homo sapiens
gaacuauugcagucuauca

SEQ ID NO: 426937 - RNA, 19 nt, Homo sapiens
guggaacaauggaaaccua

SEQ ID NO: 426938 - RNA, 19 nt, Homo sapiens
caucuuagaguuuaacaga

SEQ ID NO: 426939 - RNA, 19 nt, Homo sapiens
cugcagacauccaaauaga

SEQ ID NO: 426940 - RNA, 19 nt, Homo sapiens
gugagccgaugcaaucaaa

SEQ ID NO: 426941 - RNA, 19 nt, Homo sapiens
ugaaagagggagauaaugu

SEQ ID NO: 426942 - RNA, 19 nt, Homo sapiens
ggagggcacuaccugaaag

SEQ ID NO: 426943 - RNA, 19 nt, Homo sapiens
uagaagaggaggacauuga

SEQ ID NO: 426944 - RNA, 19 nt, Homo sapiens
acuaaagaguccaguggua

SEQ ID NO: 426945 - RNA, 19 nt, Homo sapiens
caagaucugugaagcaaaa

SEQ ID NO: 426946 - RNA, 19 nt, Homo sapiens
ggaccaggaagaaguuuau

SEQ ID NO: 426947 - RNA, 19 nt, Homo sapiens
ugccucagcugcuuacauu

SEQ ID NO: 426948 - RNA, 19 nt, Homo sapiens
caccagauguucaaccaau

SEQ ID NO: 426949 - RNA, 19 nt, Homo sapiens
gaaaccuaguccaagaugu

SEQ ID NO: 426950 - RNA, 19 nt, Homo sapiens
agacagagaaacagaaaga

SEQ ID NO: 426951 - RNA, 19 nt, Homo sapiens
ccaggcaaauaacugugua

SEQ ID NO: 426952 - RNA, 19 nt, Homo sapiens
aaacauucuugcuguggaa

SEQ ID NO: 426953 - RNA, 19 nt, Homo sapiens
ccacaaacagccaggcaaa

SEQ ID NO: 426954 - RNA, 19 nt, Homo sapiens
gaaucugcgcuacuaugua

SEQ ID NO: 426955 - RNA, 19 nt, Homo sapiens
gggcacuaccugaaaguaa

SEQ ID NO: 426956 - RNA, 19 nt, Homo sapiens
gccagcagcuuguuguaca

SEQ ID NO: 426957 - RNA, 19 nt, Homo sapiens
caaggaaaauccaauuguu

SEQ ID NO: 426958 - RNA, 19 nt, Homo sapiens
uaauugagaagcuggauga

SEQ ID NO: 426959 - RNA, 19 nt, Homo sapiens
gauggcuacucagagauuu

SEQ ID NO: 426960 - RNA, 19 nt, Homo sapiens
agauuaagguuccugugaa

SEQ ID NO: 426961 - RNA, 19 nt, Homo sapiens
aaagagaucuccguauagg

SEQ ID NO: 426962 - RNA, 19 nt, Homo sapiens
uacuuaagcugcagaagau

SEQ ID NO: 426963 - RNA, 19 nt, Homo sapiens
gagaaucugcgcuacuaug

SEQ ID NO: 426964 - RNA, 19 nt, Homo sapiens
guggaacuauugcagucua

SEQ ID NO: 426965 - RNA, 19 nt, Homo sapiens
gagcucaccuaccacaaac

SEQ ID NO: 426966 - RNA, 19 nt, Homo sapiens
aagaaggugagauguauaa

SEQ ID NO: 426967 - RNA, 19 nt, Homo sapiens
aggagaaucugcgcuacua

SEQ ID NO: 426968 - RNA, 19 nt, Homo sapiens
caaagagaucuccguauag

SEQ ID NO: 426969 - RNA, 19 nt, Homo sapiens
ggaaaccuaguccaagaug

SEQ ID NO: 426970 - RNA, 19 nt, Homo sapiens
gaacaauggaaaccuaguc

SEQ ID NO: 426971 - RNA, 19 nt, Homo sapiens
aagaagacuuguguaauca

SEQ ID NO: 426972 - RNA, 19 nt, Homo sapiens
ucaagaagauuccuuauga

SEQ ID NO: 426973 - RNA, 19 nt, Homo sapiens
gaggagcuguccagaauaa

SEQ ID NO: 426974 - RNA, 19 nt, Homo sapiens
gaccaagaauggagucaua

SEQ ID NO: 426975 - RNA, 19 nt, Homo sapiens
gagaucaccucguccauga

SEQ ID NO: 426976 - RNA, 19 nt, Homo sapiens
ccaacaagauuccagauga

SEQ ID NO: 426977 - RNA, 19 nt, Homo sapiens
gagacaagguucccucauu

SEQ ID NO: 426978 - RNA, 19 nt, Homo sapiens
ccacuaagcacuucaauga

SEQ ID NO: 426979 - RNA, 19 nt, Homo sapiens
aagcaaagguaacgcaaua

SEQ ID NO: 426980 - RNA, 19 nt, Homo sapiens
ucaacaaacugccuacaaa

SEQ ID NO: 426981 - RNA, 19 nt, Homo sapiens
ggacaaggauggaugaaac

SEQ ID NO: 426982 - RNA, 19 nt, Homo sapiens
ggagucauaucccucauug

SEQ ID NO: 426983 - RNA, 19 nt, Homo sapiens
gucgugaacuggacaauaa

SEQ ID NO: 426984 - RNA, 19 nt, Homo sapiens
guacauauucguuugguuu

SEQ ID NO: 426985 - RNA, 19 nt, Homo sapiens
ggacaugugcuagaugaua

SEQ ID NO: 426986 - RNA, 19 nt, Homo sapiens
gaaccgcagugcaaucuuc

SEQ ID NO: 426987 - RNA, 19 nt, Homo sapiens
gaugaacgcauuugaagaa

SEQ ID NO: 426988 - RNA, 19 nt, Homo sapiens
agacauagaucacuuggau

SEQ ID NO: 426989 - RNA, 19 nt, Homo sapiens
ucacaucccugcucaagga

SEQ ID NO: 426990 - RNA, 19 nt, Homo sapiens
ggaccaaucuuuuguaaug

SEQ ID NO: 426991 - RNA, 19 nt, Homo sapiens
gcacuucaaugacaucagu

SEQ ID NO: 426992 - RNA, 19 nt, Homo sapiens
caagaagccucccaucaca

SEQ ID NO: 426993 - RNA, 19 nt, Homo sapiens
gaagacagcgacaucaaga

SEQ ID NO: 426994 - RNA, 19 nt, Homo sapiens
ccacagagcaugaggcauu

SEQ ID NO: 426995 - RNA, 19 nt, Homo sapiens
caaaucguccuuguucuua

SEQ ID NO: 426996 - RNA, 19 nt, Homo sapiens
gcaaagguaacgcaauauu

SEQ ID NO: 426997 - RNA, 19 nt, Homo sapiens
ccaacuaaaucuccaacaa

SEQ ID NO: 426998 - RNA, 19 nt, Homo sapiens
guucuuagauuccuguaga

SEQ ID NO: 426999 - RNA, 19 nt, Homo sapiens
caaagguaacgcaauauuu

SEQ ID NO: 427000 - RNA, 19 nt, Homo sapiens
gaccaacgaugagcucaaa

SEQ ID NO: 427001 - RNA, 19 nt, Homo sapiens
ggagucagauauugaucaa

SEQ ID NO: 427002 - RNA, 19 nt, Homo sapiens
ccaaggagccgcuggagaa

SEQ ID NO: 427003 - RNA, 19 nt, Homo sapiens
uaacuugauugcuucagaa

SEQ ID NO: 427004 - RNA, 19 nt, Homo sapiens
gaacagcgaaaccaucaug

SEQ ID NO: 427005 - RNA, 19 nt, Homo sapiens
caacuacaaugccguacug

SEQ ID NO: 427006 - RNA, 19 nt, Homo sapiens
ggccguagcugacauaugc

SEQ ID NO: 427007 - RNA, 19 nt, Homo sapiens
ggaugaaacuggaaaagaa

SEQ ID NO: 427008 - RNA, 19 nt, Homo sapiens
caacaacacccaaaucagu

SEQ ID NO: 427009 - RNA, 19 nt, Homo sapiens
ggagaaacagcauuacuuc

SEQ ID NO: 427010 - RNA, 19 nt, Homo sapiens
caagcacucucaggacuuu

SEQ ID NO: 427011 - RNA, 19 nt, Homo sapiens
gagggaagcuucacuugac

SEQ ID NO: 427012 - RNA, 19 nt, Homo sapiens
caacaucuaccaagaguuc

SEQ ID NO: 427013 - RNA, 19 nt, Homo sapiens
gacuaaagcuuugauugau

SEQ ID NO: 427014 - RNA, 19 nt, Homo sapiens
ccagaauaaugcacgauga

SEQ ID NO: 427015 - RNA, 19 nt, Homo sapiens
cgagucuucucuccgaaua

SEQ ID NO: 427016 - RNA, 19 nt, Homo sapiens
guaacuugauugcuucaga

SEQ ID NO: 427017 - RNA, 19 nt, Homo sapiens
ucaaugacaucaguaacuu

SEQ ID NO: 427018 - RNA, 19 nt, Homo sapiens
gaauggagacaaggaguuu

SEQ ID NO: 427019 - RNA, 19 nt, Homo sapiens
uuaagaaggugcagagcuu

SEQ ID NO: 427020 - RNA, 19 nt, Homo sapiens
acgaugagcucaaaugcaa

SEQ ID NO: 427021 - RNA, 19 nt, Homo sapiens
gagaggagucagauauuga

SEQ ID NO: 427022 - RNA, 19 nt, Homo sapiens
ggagggaagcuucacuuga

SEQ ID NO: 427023 - RNA, 19 nt, Homo sapiens
ggaguucggacaacacaaa

SEQ ID NO: 427024 - RNA, 19 nt, Homo sapiens
acugaaacaucaccaacua

SEQ ID NO: 427025 - RNA, 19 nt, Homo sapiens
gagagaggagucagauauu

SEQ ID NO: 427026 - RNA, 19 nt, Homo sapiens
ccaguggccagaacaauaa

SEQ ID NO: 427027 - RNA, 19 nt, Homo sapiens
gacauucgcuucagcaaaa

SEQ ID NO: 427028 - RNA, 19 nt, Homo sapiens
agacaagguucccucauuc

SEQ ID NO: 427029 - RNA, 19 nt, Homo sapiens
gaaccggaauaugaauuuc

SEQ ID NO: 427030 - RNA, 19 nt, Homo sapiens
gaugauacuguacauauuc

SEQ ID NO: 427031 - RNA, 19 nt, Homo sapiens
aaauagagcaccaagcaaa

SEQ ID NO: 427032 - RNA, 19 nt, Homo sapiens
agacuaaagcuuugauuga

SEQ ID NO: 427033 - RNA, 19 nt, Homo sapiens
ggcggaagcucucccugaa

SEQ ID NO: 427034 - RNA, 19 nt, Homo sapiens
aaacaucaccaacuaaauc

SEQ ID NO: 427035 - RNA, 19 nt, Homo sapiens
gaaacaucaccaacuaaau

SEQ ID NO: 427036 - RNA, 19 nt, Homo sapiens
ugaaacaucaccaacuaaa

SEQ ID NO: 427037 - RNA, 19 nt, Homo sapiens
caacaagauuccagaugag

SEQ ID NO: 427038 - RNA, 19 nt, Homo sapiens
acauagaucacuuggauuu

SEQ ID NO: 427039 - RNA, 19 nt, Homo sapiens
cuaagcaucugauuaucug

SEQ ID NO: 427040 - RNA, 19 nt, Homo sapiens
aauaaugcacgaugaagua

SEQ ID NO: 427041 - RNA, 19 nt, Homo sapiens
ucauuaccaucuacaagaa

SEQ ID NO: 427042 - RNA, 19 nt, Homo sapiens
gccaagacauagaucacuu

SEQ ID NO: 427043 - RNA, 19 nt, Homo sapiens
uagaucaccucgucuucaa

SEQ ID NO: 427044 - RNA, 19 nt, Homo sapiens
ugagagaggagucagauau

SEQ ID NO: 427045 - RNA, 19 nt, Homo sapiens
cacagagcaugaggcauua

SEQ ID NO: 427046 - RNA, 19 nt, Homo sapiens
agagaggagucagauauug

SEQ ID NO: 427047 - RNA, 19 nt, Homo sapiens
aagcagagcucagaagucu

SEQ ID NO: 427048 - RNA, 19 nt, Homo sapiens
gaauaaugcacgaugaagu

SEQ ID NO: 427049 - RNA, 19 nt, Homo sapiens
caagaagauuccuuaugag

SEQ ID NO: 427050 - RNA, 19 nt, Homo sapiens
ggacagaggacgcaaaaga

SEQ ID NO: 427051 - RNA, 19 nt, Homo sapiens
gguccgacgccuccuuaua

SEQ ID NO: 427052 - RNA, 19 nt, Homo sapiens
ccucauugacugcacuuua

SEQ ID NO: 427053 - RNA, 19 nt, Homo sapiens
ggaauggagacaaggaguu

SEQ ID NO: 427054 - RNA, 19 nt, Homo sapiens
ccagaggaauggagacaag

SEQ ID NO: 427055 - RNA, 19 nt, Homo sapiens
gagaaguaccggaggaugu

SEQ ID NO: 427056 - RNA, 19 nt, Homo sapiens
cggaagcucucccugaaca

SEQ ID NO: 427057 - RNA, 19 nt, Homo sapiens
gaccagggaagcagaaaug

SEQ ID NO: 427058 - RNA, 19 nt, Homo sapiens
caaaggauccggccaagac

SEQ ID NO: 427059 - RNA, 19 nt, Homo sapiens
gaacuucagccaugagaac

SEQ ID NO: 427060 - RNA, 19 nt, Homo sapiens
ugugcuagaugauacugua

SEQ ID NO: 427061 - RNA, 19 nt, Homo sapiens
gacaugugcuagaugauac

SEQ ID NO: 427062 - RNA, 19 nt, Homo sapiens
gaaagccucuacgagucuu

SEQ ID NO: 427063 - RNA, 19 nt, Homo sapiens
acuaagcacuucaaugaca

SEQ ID NO: 427064 - RNA, 19 nt, Homo sapiens
agaggacgcuggagaccuu

SEQ ID NO: 427065 - RNA, 19 nt, Homo sapiens
gaacaauaagcuccuguac

SEQ ID NO: 427066 - RNA, 19 nt, Homo sapiens
uaagugagacggagaacau

SEQ ID NO: 427067 - RNA, 19 nt, Homo sapiens
ggagcuguccagaauaaug

SEQ ID NO: 427068 - RNA, 19 nt, Homo sapiens
ggaggagcuguccagaaua

SEQ ID NO: 427069 - RNA, 19 nt, Homo sapiens
gaaccugcucuucuacuuc

SEQ ID NO: 427070 - RNA, 19 nt, Homo sapiens
agacagcgacaucaagaaa

SEQ ID NO: 427071 - RNA, 19 nt, Homo sapiens
gagcaccaagcaaagguaa

SEQ ID NO: 427072 - RNA, 19 nt, Homo sapiens
ucaagaagauuccuuauga

SEQ ID NO: 427073 - RNA, 19 nt, Homo sapiens
gcaauguucuggauguaua

SEQ ID NO: 427074 - RNA, 19 nt, Homo sapiens
gagaucaccucguccauga

SEQ ID NO: 427075 - RNA, 19 nt, Homo sapiens
ccaacaagauuccagauga

SEQ ID NO: 427076 - RNA, 19 nt, Homo sapiens
ccacuaagcacuucaauga

SEQ ID NO: 427077 - RNA, 19 nt, Homo sapiens
aagcaaagguaacgcaaua

SEQ ID NO: 427078 - RNA, 19 nt, Homo sapiens
ucaacaaacugccuacaaa

SEQ ID NO: 427079 - RNA, 19 nt, Homo sapiens
ggacaaggauggaugaaac

SEQ ID NO: 427080 - RNA, 19 nt, Homo sapiens
gucgugaacuggacaauaa

SEQ ID NO: 427081 - RNA, 19 nt, Homo sapiens
guacauauucguuugguuu

SEQ ID NO: 427082 - RNA, 19 nt, Homo sapiens
ggacaugugcuagaugaua

SEQ ID NO: 427083 - RNA, 19 nt, Homo sapiens
gaaccgcagugcaaucuuc

SEQ ID NO: 427084 - RNA, 19 nt, Homo sapiens
ggaccaaucuuuuguaaug

SEQ ID NO: 427085 - RNA, 19 nt, Homo sapiens
gcacuucaaugacaucagu

SEQ ID NO: 427086 - RNA, 19 nt, Homo sapiens
caaaucguccuuguucuua

SEQ ID NO: 427087 - RNA, 19 nt, Homo sapiens
gcaaagguaacgcaauauu

SEQ ID NO: 427088 - RNA, 19 nt, Homo sapiens
ccaacuaaaucuccaacaa

SEQ ID NO: 427089 - RNA, 19 nt, Homo sapiens
guucuuagauuccuguaga

SEQ ID NO: 427090 - RNA, 19 nt, Homo sapiens
caaagguaacgcaauauuu

SEQ ID NO: 427091 - RNA, 19 nt, Homo sapiens
gaccaacgaugagcucaaa

SEQ ID NO: 427092 - RNA, 19 nt, Homo sapiens
ggagucagauauugaucaa

SEQ ID NO: 427093 - RNA, 19 nt, Homo sapiens
uaacuugauugcuucagaa

SEQ ID NO: 427094 - RNA, 19 nt, Homo sapiens
gaucaauccuauccugugu

SEQ ID NO: 427095 - RNA, 19 nt, Homo sapiens
caacuacaaugccguacug

SEQ ID NO: 427096 - RNA, 19 nt, Homo sapiens
ggccguagcugacauaugc

SEQ ID NO: 427097 - RNA, 19 nt, Homo sapiens
ggaugaaacuggaaaagaa

SEQ ID NO: 427098 - RNA, 19 nt, Homo sapiens
caacaacacccaaaucagu

SEQ ID NO: 427099 - RNA, 19 nt, Homo sapiens
ucugaaaccucaaugauca

SEQ ID NO: 427100 - RNA, 19 nt, Homo sapiens
caagcacucucaggacuuu

SEQ ID NO: 427101 - RNA, 19 nt, Homo sapiens
gacaagcuaugguuugcaa

SEQ ID NO: 427102 - RNA, 19 nt, Homo sapiens
aaaccucaaugaucagauu

SEQ ID NO: 427103 - RNA, 19 nt, Homo sapiens
gacuaaagcuuugauugau

SEQ ID NO: 427104 - RNA, 19 nt, Homo sapiens
cgagucuucucuccgaaua

SEQ ID NO: 427105 - RNA, 19 nt, Homo sapiens
guaacuugauugcuucaga

SEQ ID NO: 427106 - RNA, 19 nt, Homo sapiens
gagcagacagccucgauga

SEQ ID NO: 427107 - RNA, 19 nt, Homo sapiens
ucaaugacaucaguaacuu

SEQ ID NO: 427108 - RNA, 19 nt, Homo sapiens
gaauggagacaaggaguuu

SEQ ID NO: 427109 - RNA, 19 nt, Homo sapiens
gcagacagccucgaugaga

SEQ ID NO: 427110 - RNA, 19 nt, Homo sapiens
acgaugagcucaaaugcaa

SEQ ID NO: 427111 - RNA, 19 nt, Homo sapiens
gagaggagucagauauuga

SEQ ID NO: 427112 - RNA, 19 nt, Homo sapiens
gcagagcuccugaaucaca

SEQ ID NO: 427113 - RNA, 19 nt, Homo sapiens
acugaaacaucaccaacua

SEQ ID NO: 427114 - RNA, 19 nt, Homo sapiens
gagagaggagucagauauu

SEQ ID NO: 427115 - RNA, 19 nt, Homo sapiens
ccaguggccagaacaauaa

SEQ ID NO: 427116 - RNA, 19 nt, Homo sapiens
gggcaacagugaggguuaa

SEQ ID NO: 427117 - RNA, 19 nt, Homo sapiens
ugacauuccugcaguuauc

SEQ ID NO: 427118 - RNA, 19 nt, Homo sapiens
gaaccggaauaugaauuuc

SEQ ID NO: 427119 - RNA, 19 nt, Homo sapiens
gaugauacuguacauauuc

SEQ ID NO: 427120 - RNA, 19 nt, Homo sapiens
aaauagagcaccaagcaaa

SEQ ID NO: 427121 - RNA, 19 nt, Homo sapiens
agacuaaagcuuugauuga

SEQ ID NO: 427122 - RNA, 19 nt, Homo sapiens
ggcggaagcucucccugaa

SEQ ID NO: 427123 - RNA, 19 nt, Homo sapiens
aaacaucaccaacuaaauc

SEQ ID NO: 427124 - RNA, 19 nt, Homo sapiens
gaaacaucaccaacuaaau

SEQ ID NO: 427125 - RNA, 19 nt, Homo sapiens
ugaaacaucaccaacuaaa

SEQ ID NO: 427126 - RNA, 19 nt, Homo sapiens
caacaagauuccagaugag

SEQ ID NO: 427127 - RNA, 19 nt, Homo sapiens
gcuaugguuugcaauguuc

SEQ ID NO: 427128 - RNA, 19 nt, Homo sapiens
uagaucaccucgucuucaa

SEQ ID NO: 427129 - RNA, 19 nt, Homo sapiens
caggaaugguaggugauua

SEQ ID NO: 427130 - RNA, 19 nt, Homo sapiens
ugagagaggagucagauau

SEQ ID NO: 427131 - RNA, 19 nt, Homo sapiens
gaugagacaagcuaugguu

SEQ ID NO: 427132 - RNA, 19 nt, Homo sapiens
ggaauaagagugccuacgu

SEQ ID NO: 427133 - RNA, 19 nt, Homo sapiens
aaugguaggugauuaucuu

SEQ ID NO: 427134 - RNA, 19 nt, Homo sapiens
agagaggagucagauauug

SEQ ID NO: 427135 - RNA, 19 nt, Homo sapiens
aagcagagcucagaagucu

SEQ ID NO: 427136 - RNA, 19 nt, Homo sapiens
caagaagauuccuuaugag

SEQ ID NO: 427137 - RNA, 19 nt, Homo sapiens
ggaauggagacaaggaguu

SEQ ID NO: 427138 - RNA, 19 nt, Homo sapiens
ccagaggaauggagacaag

SEQ ID NO: 427139 - RNA, 19 nt, Homo sapiens
gagaaguaccggaggaugu

SEQ ID NO: 427140 - RNA, 19 nt, Homo sapiens
cggaagcucucccugaaca

SEQ ID NO: 427141 - RNA, 19 nt, Homo sapiens
gaacuucugaaaccucaau

SEQ ID NO: 427142 - RNA, 19 nt, Homo sapiens
ugugcuagaugauacugua

SEQ ID NO: 427143 - RNA, 19 nt, Homo sapiens
gacaugugcuagaugauac

SEQ ID NO: 427144 - RNA, 19 nt, Homo sapiens
gaaagccucuacgagucuu

SEQ ID NO: 427145 - RNA, 19 nt, Homo sapiens
acuaagcacuucaaugaca

SEQ ID NO: 427146 - RNA, 19 nt, Homo sapiens
cuaauggacuucacugcau

SEQ ID NO: 427147 - RNA, 19 nt, Homo sapiens
gaacaauaagcuccuguac

SEQ ID NO: 427148 - RNA, 19 nt, Homo sapiens
gagcaccaagcaaagguaa

SEQ ID NO: 427149 - RNA, 19 nt, Homo sapiens
cauauuauccgagagauuc

SEQ ID NO: 427150 - RNA, 19 nt, Homo sapiens
gucaacuucuccaagauga

SEQ ID NO: 427151 - RNA, 19 nt, Homo sapiens
ccaccaaucgugucuugaa

SEQ ID NO: 427152 - RNA, 19 nt, Homo sapiens
gcaagcagagcucagaagu

SEQ ID NO: 427153 - RNA, 19 nt, Homo sapiens
gagacaagcuaugguuugc

SEQ ID NO: 427154 - RNA, 19 nt, Homo sapiens
gcugagucccuuaaccuuu

SEQ ID NO: 427155 - RNA, 19 nt, Homo sapiens
ccgagagauucgccaguuu

SEQ ID NO: 427156 - RNA, 19 nt, Homo sapiens
ggguacaucuugccucucu

SEQ ID NO: 427157 - RNA, 19 nt, Homo sapiens
ggaacccugucaugaggau

SEQ ID NO: 427158 - RNA, 19 nt, Homo sapiens
acaaagaggcugguucaga

SEQ ID NO: 427159 - RNA, 19 nt, Homo sapiens
aguaugugcuucuccaaga

SEQ ID NO: 427160 - RNA, 19 nt, Homo sapiens
uguaauggaugaagaaagc

SEQ ID NO: 427161 - RNA, 19 nt, Homo sapiens
gccgcugccuccacaacua

SEQ ID NO: 427162 - RNA, 19 nt, Homo sapiens
gcaacgcaacgacccagaa

SEQ ID NO: 427163 - RNA, 19 nt, Homo sapiens
gaaaaccacuaagcacuuc

SEQ ID NO: 427164 - RNA, 19 nt, Homo sapiens
uggaggagaucacgcagau

SEQ ID NO: 427165 - RNA, 19 nt, Homo sapiens
uaacaauggagucgucaug

SEQ ID NO: 427166 - RNA, 19 nt, Homo sapiens
gaugauggugauacugaaa

SEQ ID NO: 427167 - RNA, 19 nt, Homo sapiens
cagcuucaccaacaagauu

SEQ ID NO: 427168 - RNA, 19 nt, Homo sapiens
gaaaacagaagcaaacauc

SEQ ID NO: 427169 - RNA, 19 nt, Homo sapiens
cuguagaaccggaauauga

SEQ ID NO: 427170 - RNA, 19 nt, Homo sapiens
ucaccgaccuggccuucau

SEQ ID NO: 427171 - RNA, 19 nt, Homo sapiens
gugaugauggugauacuga

SEQ ID NO: 427172 - RNA, 19 nt, Homo sapiens
gaaaggacaugugaacuua

SEQ ID NO: 427173 - RNA, 19 nt, Homo sapiens
gaagaaguaugauguauug

SEQ ID NO: 427174 - RNA, 19 nt, Homo sapiens
gaacaggagugcacggaua

SEQ ID NO: 427175 - RNA, 19 nt, Homo sapiens
gaagaacgauuauccauuc

SEQ ID NO: 427176 - RNA, 19 nt, Homo sapiens
gaaaugacuucuacucgaa

SEQ ID NO: 427177 - RNA, 19 nt, Homo sapiens
gaacgauuauccauucaaa

SEQ ID NO: 427178 - RNA, 19 nt, Homo sapiens
gcucucagauucaccuuua

SEQ ID NO: 427179 - RNA, 19 nt, Homo sapiens
gaagcaaaguauaaccaua

SEQ ID NO: 427180 - RNA, 19 nt, Homo sapiens
ggagggaacaucuauauuu

SEQ ID NO: 427181 - RNA, 19 nt, Homo sapiens
guucaaagccacauuauuu

SEQ ID NO: 427182 - RNA, 19 nt, Homo sapiens
aaacuacgcuuugauauug

SEQ ID NO: 427183 - RNA, 19 nt, Homo sapiens
guacaccucuggauucauu

SEQ ID NO: 427184 - RNA, 19 nt, Homo sapiens
uguaagaucuccaaagaaa

SEQ ID NO: 427185 - RNA, 19 nt, Homo sapiens
gaacacuauccaacaauua

SEQ ID NO: 427186 - RNA, 19 nt, Homo sapiens
cgaaaucaguguccauaaa

SEQ ID NO: 427187 - RNA, 19 nt, Homo sapiens
ggauauaggauacaucuuu

SEQ ID NO: 427188 - RNA, 19 nt, Homo sapiens
aaaguaaccuugaugaaga

SEQ ID NO: 427189 - RNA, 19 nt, Homo sapiens
ggucaagggcuuacuauuu

SEQ ID NO: 427190 - RNA, 19 nt, Homo sapiens
gaaaucuggucuuguuaga

SEQ ID NO: 427191 - RNA, 19 nt, Homo sapiens
uaaaacagcugcauuagaa

SEQ ID NO: 427192 - RNA, 19 nt, Homo sapiens
cuucagagaucguguauug

SEQ ID NO: 427193 - RNA, 19 nt, Homo sapiens
acaaagugaucgaaaguuu

SEQ ID NO: 427194 - RNA, 19 nt, Homo sapiens
gaaaauguguccuaucuau

SEQ ID NO: 427195 - RNA, 19 nt, Homo sapiens
gaaucugcuuguccucuua

SEQ ID NO: 427196 - RNA, 19 nt, Homo sapiens
gagggaacaucuauauuuc

SEQ ID NO: 427197 - RNA, 19 nt, Homo sapiens
gcaaacuucugaaugacaa

SEQ ID NO: 427198 - RNA, 19 nt, Homo sapiens
cauaucaucuggacccuuu

SEQ ID NO: 427199 - RNA, 19 nt, Homo sapiens
gcucaaagaaccauauaaa

SEQ ID NO: 427200 - RNA, 19 nt, Homo sapiens
gaugagaugucguucacuu

SEQ ID NO: 427201 - RNA, 19 nt, Homo sapiens
gcauauaggugauguuugc

SEQ ID NO: 427202 - RNA, 19 nt, Homo sapiens
ucgaagcccuuacaaguuu

SEQ ID NO: 427203 - RNA, 19 nt, Homo sapiens
caacuacgcguguaaauuc

SEQ ID NO: 427204 - RNA, 19 nt, Homo sapiens
ucacagcgauacaaacuug

SEQ ID NO: 427205 - RNA, 19 nt, Homo sapiens
ggacaugugaacuuauaua

SEQ ID NO: 427206 - RNA, 19 nt, Homo sapiens
caagggucauuauggguua

SEQ ID NO: 427207 - RNA, 19 nt, Homo sapiens
gaaauaaauucugcauugg

SEQ ID NO: 427208 - RNA, 19 nt, Homo sapiens
caagacuguugaagaagua

SEQ ID NO: 427209 - RNA, 19 nt, Homo sapiens
gggaaucuguaucuuuauu

SEQ ID NO: 427210 - RNA, 19 nt, Homo sapiens
ugaagcagauggaaguaaa

SEQ ID NO: 427211 - RNA, 19 nt, Homo sapiens
gaagaggaguaugauucua

SEQ ID NO: 427212 - RNA, 19 nt, Homo sapiens
gaacaucgaaucauggaau

SEQ ID NO: 427213 - RNA, 19 nt, Homo sapiens
uuagcaaacuucugaauga

SEQ ID NO: 427214 - RNA, 19 nt, Homo sapiens
ggaaaggacaugugaacuu

SEQ ID NO: 427215 - RNA, 19 nt, Homo sapiens
gauaccagaucaugucaga

SEQ ID NO: 427216 - RNA, 19 nt, Homo sapiens
uagagaugcuguaacuuaa

SEQ ID NO: 427217 - RNA, 19 nt, Homo sapiens
uaagccacuugaaauguua

SEQ ID NO: 427218 - RNA, 19 nt, Homo sapiens
cagaagccauugaaaucua

SEQ ID NO: 427219 - RNA, 19 nt, Homo sapiens
gaaaucaguguccauaaau

SEQ ID NO: 427220 - RNA, 19 nt, Homo sapiens
gucaagggcuuacuauuuc

SEQ ID NO: 427221 - RNA, 19 nt, Homo sapiens
uuagagaugcuguaacuua

SEQ ID NO: 427222 - RNA, 19 nt, Homo sapiens
cauuauggguuaggcauua

SEQ ID NO: 427223 - RNA, 19 nt, Homo sapiens
aaucuggucuuguuagaaa

SEQ ID NO: 427224 - RNA, 19 nt, Homo sapiens
ugacuacuuugccuucuuu

SEQ ID NO: 427225 - RNA, 19 nt, Homo sapiens
ucaaagaagaggaguauga

SEQ ID NO: 427226 - RNA, 19 nt, Homo sapiens
ccuguaagaucuccaaaga

SEQ ID NO: 427227 - RNA, 19 nt, Homo sapiens
gaacuucagagaucgugua

SEQ ID NO: 427228 - RNA, 19 nt, Homo sapiens
gcauuaauguuucuaucug

SEQ ID NO: 427229 - RNA, 19 nt, Homo sapiens
guacaucucagaaucuuga

SEQ ID NO: 427230 - RNA, 19 nt, Homo sapiens
uauguguccuugacuauuu

SEQ ID NO: 427231 - RNA, 19 nt, Homo sapiens
aaggacaugugaacuuaua

SEQ ID NO: 427232 - RNA, 19 nt, Homo sapiens
gcaaagugaagaauauaga

SEQ ID NO: 427233 - RNA, 19 nt, Homo sapiens
ggugauuucauuucaguua

SEQ ID NO: 427234 - RNA, 19 nt, Homo sapiens
caaaagaagugcugaagga

SEQ ID NO: 427235 - RNA, 19 nt, Homo sapiens
gugaacgccuucugucuga

SEQ ID NO: 427236 - RNA, 19 nt, Homo sapiens
guaccaaaguugauaaugc

SEQ ID NO: 427237 - RNA, 19 nt, Homo sapiens
ugagaugucguucacuuua

SEQ ID NO: 427238 - RNA, 19 nt, Homo sapiens
ucuggguccugaagaauua

SEQ ID NO: 427239 - RNA, 19 nt, Homo sapiens
gaucaaagaagaggaguau

SEQ ID NO: 427240 - RNA, 19 nt, Homo sapiens
ggacuuguaacaucuaaug

SEQ ID NO: 427241 - RNA, 19 nt, Homo sapiens
gagagagcuugguuaacuu

SEQ ID NO: 427242 - RNA, 19 nt, Homo sapiens
uuucauaccucagaaugua

SEQ ID NO: 427243 - RNA, 19 nt, Homo sapiens
cagauucaccuuuauuuga

SEQ ID NO: 427244 - RNA, 19 nt, Homo sapiens
ugaacacuauccaacaauu

SEQ ID NO: 427245 - RNA, 19 nt, Homo sapiens
ggaaguauuacaaauggaa

SEQ ID NO: 427246 - RNA, 19 nt, Homo sapiens
aaacuugacuccauuucau

SEQ ID NO: 427247 - RNA, 19 nt, Homo sapiens
aaacagaagaaccugauuu

SEQ ID NO: 427248 - RNA, 19 nt, Homo sapiens
caacugaucaccuugaauc

SEQ ID NO: 427249 - RNA, 19 nt, Homo sapiens
caaaguugauaaugcuaug

SEQ ID NO: 427250 - RNA, 19 nt, Homo sapiens
gauauacugugugcuuguu

SEQ ID NO: 427251 - RNA, 19 nt, Homo sapiens
caaagcagaaggcaacuug

SEQ ID NO: 427252 - RNA, 19 nt, Homo sapiens
agaaguacaucucagaauc

SEQ ID NO: 427253 - RNA, 19 nt, Homo sapiens
gcuuaaaucagaagaagaa

SEQ ID NO: 427254 - RNA, 19 nt, Homo sapiens
aauaaaagcuggaagcaaa

SEQ ID NO: 427255 - RNA, 19 nt, Homo sapiens
ggaaucugauauacugugu

SEQ ID NO: 427256 - RNA, 19 nt, Homo sapiens
cuaagccacuugaaauguu

SEQ ID NO: 427257 - RNA, 19 nt, Homo sapiens
gcagaaacuggcagaaaug

SEQ ID NO: 427258 - RNA, 19 nt, Homo sapiens
uaugauguguuccauguau

SEQ ID NO: 427259 - RNA, 19 nt, Homo sapiens
gagugaaggauauaggaua

SEQ ID NO: 427260 - RNA, 19 nt, Homo sapiens
gugcaaaagcuucaaauua

SEQ ID NO: 427261 - RNA, 19 nt, Homo sapiens
auucugcccuccuuaauuu

SEQ ID NO: 427262 - RNA, 19 nt, Homo sapiens
ccugaagaguccauauaaa

SEQ ID NO: 427263 - RNA, 19 nt, Homo sapiens
gagaaggaccaacugauca

SEQ ID NO: 427264 - RNA, 19 nt, Homo sapiens
ggaguucgcuuguauuacc

SEQ ID NO: 427265 - RNA, 19 nt, Homo sapiens
caaagccacauuauuucua

SEQ ID NO: 427266 - RNA, 19 nt, Homo sapiens
gaugugacuguauaacuuu

SEQ ID NO: 427267 - RNA, 19 nt, Homo sapiens
ggaccuugguggacacugu

SEQ ID NO: 427268 - RNA, 19 nt, Homo sapiens
aaacaaggaagagaaauga

SEQ ID NO: 427269 - RNA, 19 nt, Homo sapiens
ggaagcaacccuccuaaac

SEQ ID NO: 427270 - RNA, 19 nt, Homo sapiens
agagagagcuugguuaacu

SEQ ID NO: 427271 - RNA, 19 nt, Homo sapiens
uaugaacacuauccaacaa

SEQ ID NO: 427272 - RNA, 19 nt, Homo sapiens
gaaaguaucucuaugguuu

SEQ ID NO: 427273 - RNA, 19 nt, Homo sapiens
ggaagaaacugaaagcaaa

SEQ ID NO: 427274 - RNA, 19 nt, Homo sapiens
gagaauugcucgagaugua

SEQ ID NO: 427275 - RNA, 19 nt, Homo sapiens
uaacagaagugaagaguga

SEQ ID NO: 427276 - RNA, 19 nt, Homo sapiens
gaaccaaagugaaaguaaa

SEQ ID NO: 427277 - RNA, 19 nt, Homo sapiens
gguauuaucuugcaacuug

SEQ ID NO: 427278 - RNA, 19 nt, Homo sapiens
ggacaaagguggaccaaag

SEQ ID NO: 427279 - RNA, 19 nt, Homo sapiens
gaaaggacauuaaggaagu

SEQ ID NO: 427280 - RNA, 19 nt, Homo sapiens
gagcgaacauugagacgua

SEQ ID NO: 427281 - RNA, 19 nt, Homo sapiens
gguacaagaugaccaagua

SEQ ID NO: 427282 - RNA, 19 nt, Homo sapiens
ggugaaggcugacaggaua

SEQ ID NO: 427283 - RNA, 19 nt, Homo sapiens
ggauguagaugaugacuau

SEQ ID NO: 427284 - RNA, 19 nt, Homo sapiens
cagaagaaguuaagaaaga

SEQ ID NO: 427285 - RNA, 19 nt, Homo sapiens
gaaagcaagcaucuucuua

SEQ ID NO: 427286 - RNA, 19 nt, Homo sapiens
aaucugagcucuccacuaa

SEQ ID NO: 427287 - RNA, 19 nt, Homo sapiens
gaagugaaccucauauaga

SEQ ID NO: 427288 - RNA, 19 nt, Homo sapiens
ggagaggacugaaugguau

SEQ ID NO: 427289 - RNA, 19 nt, Homo sapiens
gcacacaauuaugcaaaua

SEQ ID NO: 427290 - RNA, 19 nt, Homo sapiens
uuacccagcugaauaguua

SEQ ID NO: 427291 - RNA, 19 nt, Homo sapiens
ggacucaaaugcagccuuu

SEQ ID NO: 427292 - RNA, 19 nt, Homo sapiens
gaauggaaaugacaaauac

SEQ ID NO: 427293 - RNA, 19 nt, Homo sapiens
ggaauggaaaugacaaaua

SEQ ID NO: 427294 - RNA, 19 nt, Homo sapiens
uaaagaagauagugaagug

SEQ ID NO: 427295 - RNA, 19 nt, Homo sapiens
ccaaagauuucugcacaua

SEQ ID NO: 427296 - RNA, 19 nt, Homo sapiens
ggaagcaaauuuauaugga

SEQ ID NO: 427297 - RNA, 19 nt, Homo sapiens
gaaguguaguugacugaaa

SEQ ID NO: 427298 - RNA, 19 nt, Homo sapiens
agaaaugccuuuaacagaa

SEQ ID NO: 427299 - RNA, 19 nt, Homo sapiens
gaacaaagggcacuuagca

SEQ ID NO: 427300 - RNA, 19 nt, Homo sapiens
gaaaggaccagugauugua

SEQ ID NO: 427301 - RNA, 19 nt, Homo sapiens
ucugguaccuguaguauaa

SEQ ID NO: 427302 - RNA, 19 nt, Homo sapiens
caacauaacuuuucaguag

SEQ ID NO: 427303 - RNA, 19 nt, Homo sapiens
ggaagaacuugauccugaa

SEQ ID NO: 427304 - RNA, 19 nt, Homo sapiens
gaaaggaaguguaguugac

SEQ ID NO: 427305 - RNA, 19 nt, Homo sapiens
gcacuuagcaaauuugaau

SEQ ID NO: 427306 - RNA, 19 nt, Homo sapiens
gguuugacauugcuaagua

SEQ ID NO: 427307 - RNA, 19 nt, Homo sapiens
ggacaaagcagugauagug

SEQ ID NO: 427308 - RNA, 19 nt, Homo sapiens
ugaagaaucucaagaaggu

SEQ ID NO: 427309 - RNA, 19 nt, Homo sapiens
gaaaugccuuuaacagaag

SEQ ID NO: 427310 - RNA, 19 nt, Homo sapiens
gaacuccaguaauugcaaa

SEQ ID NO: 427311 - RNA, 19 nt, Homo sapiens
agaaagcacucaacugguu

SEQ ID NO: 427312 - RNA, 19 nt, Homo sapiens
ggaaauaguggauuaaugg

SEQ ID NO: 427313 - RNA, 19 nt, Homo sapiens
ggaaaugacaaauacugua

SEQ ID NO: 427314 - RNA, 19 nt, Homo sapiens
ggacaaucaucgccagaga

SEQ ID NO: 427315 - RNA, 19 nt, Homo sapiens
aaucaacccucucaucaaa

SEQ ID NO: 427316 - RNA, 19 nt, Homo sapiens
gaccuuggcauuccuauuu

SEQ ID NO: 427317 - RNA, 19 nt, Homo sapiens
acaguggaauugugaauaa

SEQ ID NO: 427318 - RNA, 19 nt, Homo sapiens
ugauggaaauaguggauua

SEQ ID NO: 427319 - RNA, 19 nt, Homo sapiens
caagaaaggaccagugauu

SEQ ID NO: 427320 - RNA, 19 nt, Homo sapiens
uauagaagcucauagucuu

SEQ ID NO: 427321 - RNA, 19 nt, Homo sapiens
uagaaacccugaaguuaga

SEQ ID NO: 427322 - RNA, 19 nt, Homo sapiens
ugaaacagaagaugcuuua

SEQ ID NO: 427323 - RNA, 19 nt, Homo sapiens
aaacaugccguauggcuua

SEQ ID NO: 427324 - RNA, 19 nt, Homo sapiens
ggaaauugaagaagagaaa

SEQ ID NO: 427325 - RNA, 19 nt, Homo sapiens
gaaguagauuuggaugauu

SEQ ID NO: 427326 - RNA, 19 nt, Homo sapiens
uggagagaaugaacaaaua

SEQ ID NO: 427327 - RNA, 19 nt, Homo sapiens
ugacaaagacucagaugaa

SEQ ID NO: 427328 - RNA, 19 nt, Homo sapiens
gaucaagaaaugccuuuaa

SEQ ID NO: 427329 - RNA, 19 nt, Homo sapiens
ggaaguagacauucucaau

SEQ ID NO: 427330 - RNA, 19 nt, Homo sapiens
agagaaagauaaacacaga

SEQ ID NO: 427331 - RNA, 19 nt, Homo sapiens
caagaaaggacauuaagga

SEQ ID NO: 427332 - RNA, 19 nt, Homo sapiens
caucaaacaugccguaugg

SEQ ID NO: 427333 - RNA, 19 nt, Homo sapiens
ugaaauugaugacggagaa

SEQ ID NO: 427334 - RNA, 19 nt, Homo sapiens
cuaugaaacugcagagaaa

SEQ ID NO: 427335 - RNA, 19 nt, Homo sapiens
gcaaauauucaguucagaa

SEQ ID NO: 427336 - RNA, 19 nt, Homo sapiens
cagcagcuuuauaaguuua

SEQ ID NO: 427337 - RNA, 19 nt, Homo sapiens
guaccgaggugccuucugu

SEQ ID NO: 427338 - RNA, 19 nt, Homo sapiens
cgauugaaguugauaguau

SEQ ID NO: 427339 - RNA, 19 nt, Homo sapiens
gaaugaagcaggaagugaa

SEQ ID NO: 427340 - RNA, 19 nt, Homo sapiens
gguauaccgugguguuuga

SEQ ID NO: 427341 - RNA, 19 nt, Homo sapiens
uuacagaaaucguagacaa

SEQ ID NO: 427342 - RNA, 19 nt, Homo sapiens
ucaguagcuucaccacuua

SEQ ID NO: 427343 - RNA, 19 nt, Homo sapiens
ccacacaauugguacaaga

SEQ ID NO: 427344 - RNA, 19 nt, Homo sapiens
aaagggcacuuagcaaauu

SEQ ID NO: 427345 - RNA, 19 nt, Homo sapiens
cuaacucucuuguuucuau

SEQ ID NO: 427346 - RNA, 19 nt, Homo sapiens
guugaaagcucugagucua

SEQ ID NO: 427347 - RNA, 19 nt, Homo sapiens
ggaagugaaccucauauag

SEQ ID NO: 427348 - RNA, 19 nt, Homo sapiens
caaaugcagccuuuagaaa

SEQ ID NO: 427349 - RNA, 19 nt, Homo sapiens
aacagaagaugcuuuagaa

SEQ ID NO: 427350 - RNA, 19 nt, Homo sapiens
gaucuucucuuccuguuac

SEQ ID NO: 427351 - RNA, 19 nt, Homo sapiens
gauaauaccacacaauugg

SEQ ID NO: 427352 - RNA, 19 nt, Homo sapiens
uaucuuaucccuugacaaa

SEQ ID NO: 427353 - RNA, 19 nt, Homo sapiens
caacaacugacuagugaaa

SEQ ID NO: 427354 - RNA, 19 nt, Homo sapiens
caagauuucuaaagcugaa

SEQ ID NO: 427355 - RNA, 19 nt, Homo sapiens
gcacuuucacuaagaugua

SEQ ID NO: 427356 - RNA, 19 nt, Homo sapiens
gagaauggaauggaaauga

SEQ ID NO: 427357 - RNA, 19 nt, Homo sapiens
gcaaagauuaagacuguga

SEQ ID NO: 427358 - RNA, 19 nt, Homo sapiens
agacucagaugaagaggaa

SEQ ID NO: 427359 - RNA, 19 nt, Homo sapiens
aagcaagcaucuucuuaaa

SEQ ID NO: 427360 - RNA, 19 nt, Homo sapiens
guguuuaguucgaucauuu

SEQ ID NO: 427361 - RNA, 19 nt, Homo sapiens
aggcaaagauuaagacugu

SEQ ID NO: 427362 - RNA, 19 nt, Homo sapiens
gaagacagagguacuccaa

SEQ ID NO: 427363 - RNA, 19 nt, Homo sapiens
agaaagcagugaagaggaa

SEQ ID NO: 427364 - RNA, 19 nt, Homo sapiens
gaacaggacaaagcaguga

SEQ ID NO: 427365 - RNA, 19 nt, Homo sapiens
guuagaaguuggagagaau

SEQ ID NO: 427366 - RNA, 19 nt, Homo sapiens
ggaaccaaagugaaaguaa

SEQ ID NO: 427367 - RNA, 19 nt, Homo sapiens
acaggaggauucugacaaa

SEQ ID NO: 427368 - RNA, 19 nt, Homo sapiens
gacaagcgccgucucaaug

SEQ ID NO: 427369 - RNA, 19 nt, Homo sapiens
gaccagugauuguauugga

SEQ ID NO: 427370 - RNA, 19 nt, Homo sapiens
gcaggaagugaaccucaua

SEQ ID NO: 427371 - RNA, 19 nt, Homo sapiens
ggguggaugugacaauauu

SEQ ID NO: 427372 - RNA, 19 nt, Homo sapiens
gaaaguaucucuaugguuu

SEQ ID NO: 427373 - RNA, 19 nt, Homo sapiens
ggaagaaacugaaagcaaa

SEQ ID NO: 427374 - RNA, 19 nt, Homo sapiens
gagaauugcucgagaugua

SEQ ID NO: 427375 - RNA, 19 nt, Homo sapiens
uaacagaagugaagaguga

SEQ ID NO: 427376 - RNA, 19 nt, Homo sapiens
gaaccaaagugaaaguaaa

SEQ ID NO: 427377 - RNA, 19 nt, Homo sapiens
gguauuaucuugcaacuug

SEQ ID NO: 427378 - RNA, 19 nt, Homo sapiens
ggacaaagguggaccaaag

SEQ ID NO: 427379 - RNA, 19 nt, Homo sapiens
gaaaggacauuaaggaagu

SEQ ID NO: 427380 - RNA, 19 nt, Homo sapiens
gagcgaacauugagacgua

SEQ ID NO: 427381 - RNA, 19 nt, Homo sapiens
gguacaagaugaccaagua

SEQ ID NO: 427382 - RNA, 19 nt, Homo sapiens
ggugaaggcugacaggaua

SEQ ID NO: 427383 - RNA, 19 nt, Homo sapiens
ggauguagaugaugacuau

SEQ ID NO: 427384 - RNA, 19 nt, Homo sapiens
cagaagaaguuaagaaaga

SEQ ID NO: 427385 - RNA, 19 nt, Homo sapiens
gaaagcaagcaucuucuua

SEQ ID NO: 427386 - RNA, 19 nt, Homo sapiens
aaucugagcucuccacuaa

SEQ ID NO: 427387 - RNA, 19 nt, Homo sapiens
gaagugaaccucauauaga

SEQ ID NO: 427388 - RNA, 19 nt, Homo sapiens
ggagaggacugaaugguau

SEQ ID NO: 427389 - RNA, 19 nt, Homo sapiens
gcacacaauuaugcaaaua

SEQ ID NO: 427390 - RNA, 19 nt, Homo sapiens
uuacccagcugaauaguua

SEQ ID NO: 427391 - RNA, 19 nt, Homo sapiens
ggacucaaaugcagccuuu

SEQ ID NO: 427392 - RNA, 19 nt, Homo sapiens
gaauggaaaugacaaauac

SEQ ID NO: 427393 - RNA, 19 nt, Homo sapiens
ggaauggaaaugacaaaua

SEQ ID NO: 427394 - RNA, 19 nt, Homo sapiens
uaaagaagauagugaagug

SEQ ID NO: 427395 - RNA, 19 nt, Homo sapiens
ccaaagauuucugcacaua

SEQ ID NO: 427396 - RNA, 19 nt, Homo sapiens
ggaagcaaauuuauaugga

SEQ ID NO: 427397 - RNA, 19 nt, Homo sapiens
gaaguguaguugacugaaa

SEQ ID NO: 427398 - RNA, 19 nt, Homo sapiens
agaaaugccuuuaacagaa

SEQ ID NO: 427399 - RNA, 19 nt, Homo sapiens
gaacaaagggcacuuagca

SEQ ID NO: 427400 - RNA, 19 nt, Homo sapiens
gaaaggaccagugauugua

SEQ ID NO: 427401 - RNA, 19 nt, Homo sapiens
ucugguaccuguaguauaa

SEQ ID NO: 427402 - RNA, 19 nt, Homo sapiens
caacauaacuuuucaguag

SEQ ID NO: 427403 - RNA, 19 nt, Homo sapiens
ggaagaacuugauccugaa

SEQ ID NO: 427404 - RNA, 19 nt, Homo sapiens
gaaaggaaguguaguugac

SEQ ID NO: 427405 - RNA, 19 nt, Homo sapiens
gcacuuagcaaauuugaau

SEQ ID NO: 427406 - RNA, 19 nt, Homo sapiens
gguuugacauugcuaagua

SEQ ID NO: 427407 - RNA, 19 nt, Homo sapiens
ggacaaagcagugauagug

SEQ ID NO: 427408 - RNA, 19 nt, Homo sapiens
ugaagaaucucaagaaggu

SEQ ID NO: 427409 - RNA, 19 nt, Homo sapiens
gaaaugccuuuaacagaag

SEQ ID NO: 427410 - RNA, 19 nt, Homo sapiens
gaacuccaguaauugcaaa

SEQ ID NO: 427411 - RNA, 19 nt, Homo sapiens
agaaagcacucaacugguu

SEQ ID NO: 427412 - RNA, 19 nt, Homo sapiens
ggaaauaguggauuaaugg

SEQ ID NO: 427413 - RNA, 19 nt, Homo sapiens
ggaaaugacaaauacugua

SEQ ID NO: 427414 - RNA, 19 nt, Homo sapiens
ggacaaucaucgccagaga

SEQ ID NO: 427415 - RNA, 19 nt, Homo sapiens
aaucaacccucucaucaaa

SEQ ID NO: 427416 - RNA, 19 nt, Homo sapiens
gaccuuggcauuccuauuu

SEQ ID NO: 427417 - RNA, 19 nt, Homo sapiens
acaguggaauugugaauaa

SEQ ID NO: 427418 - RNA, 19 nt, Homo sapiens
ugauggaaauaguggauua

SEQ ID NO: 427419 - RNA, 19 nt, Homo sapiens
caagaaaggaccagugauu

SEQ ID NO: 427420 - RNA, 19 nt, Homo sapiens
uauagaagcucauagucuu

SEQ ID NO: 427421 - RNA, 19 nt, Homo sapiens
uagaaacccugaaguuaga

SEQ ID NO: 427422 - RNA, 19 nt, Homo sapiens
ugaaacagaagaugcuuua

SEQ ID NO: 427423 - RNA, 19 nt, Homo sapiens
aaacaugccguauggcuua

SEQ ID NO: 427424 - RNA, 19 nt, Homo sapiens
ggaaauugaagaagagaaa

SEQ ID NO: 427425 - RNA, 19 nt, Homo sapiens
gaaguagauuuggaugauu

SEQ ID NO: 427426 - RNA, 19 nt, Homo sapiens
uggagagaaugaacaaaua

SEQ ID NO: 427427 - RNA, 19 nt, Homo sapiens
ugacaaagacucagaugaa

SEQ ID NO: 427428 - RNA, 19 nt, Homo sapiens
gaucaagaaaugccuuuaa

SEQ ID NO: 427429 - RNA, 19 nt, Homo sapiens
ggaaguagacauucucaau

SEQ ID NO: 427430 - RNA, 19 nt, Homo sapiens
caagaaaggacauuaagga

SEQ ID NO: 427431 - RNA, 19 nt, Homo sapiens
caucaaacaugccguaugg

SEQ ID NO: 427432 - RNA, 19 nt, Homo sapiens
ugaaauugaugacggagaa

SEQ ID NO: 427433 - RNA, 19 nt, Homo sapiens
cuaugaaacugcagagaaa

SEQ ID NO: 427434 - RNA, 19 nt, Homo sapiens
gcaaauauucaguucagaa

SEQ ID NO: 427435 - RNA, 19 nt, Homo sapiens
cagcagcuuuauaaguuua

SEQ ID NO: 427436 - RNA, 19 nt, Homo sapiens
guaccgaggugccuucugu

SEQ ID NO: 427437 - RNA, 19 nt, Homo sapiens
cgauugaaguugauaguau

SEQ ID NO: 427438 - RNA, 19 nt, Homo sapiens
gaaugaagcaggaagugaa

SEQ ID NO: 427439 - RNA, 19 nt, Homo sapiens
gguauaccgugguguuuga

SEQ ID NO: 427440 - RNA, 19 nt, Homo sapiens
uuacagaaaucguagacaa

SEQ ID NO: 427441 - RNA, 19 nt, Homo sapiens
ucaguagcuucaccacuua

SEQ ID NO: 427442 - RNA, 19 nt, Homo sapiens
ccacacaauugguacaaga

SEQ ID NO: 427443 - RNA, 19 nt, Homo sapiens
aaagggcacuuagcaaauu

SEQ ID NO: 427444 - RNA, 19 nt, Homo sapiens
cuaacucucuuguuucuau

SEQ ID NO: 427445 - RNA, 19 nt, Homo sapiens
guugaaagcucugagucua

SEQ ID NO: 427446 - RNA, 19 nt, Homo sapiens
ggaagugaaccucauauag

SEQ ID NO: 427447 - RNA, 19 nt, Homo sapiens
caaaugcagccuuuagaaa

SEQ ID NO: 427448 - RNA, 19 nt, Homo sapiens
aacagaagaugcuuuagaa

SEQ ID NO: 427449 - RNA, 19 nt, Homo sapiens
gaucuucucuuccuguuac

SEQ ID NO: 427450 - RNA, 19 nt, Homo sapiens
gauaauaccacacaauugg

SEQ ID NO: 427451 - RNA, 19 nt, Homo sapiens
uaucuuaucccuugacaaa

SEQ ID NO: 427452 - RNA, 19 nt, Homo sapiens
caacaacugacuagugaaa

SEQ ID NO: 427453 - RNA, 19 nt, Homo sapiens
caagauuucuaaagcugaa

SEQ ID NO: 427454 - RNA, 19 nt, Homo sapiens
gcacuuucacuaagaugua

SEQ ID NO: 427455 - RNA, 19 nt, Homo sapiens
gagaauggaauggaaauga

SEQ ID NO: 427456 - RNA, 19 nt, Homo sapiens
gcaaagauuaagacuguga

SEQ ID NO: 427457 - RNA, 19 nt, Homo sapiens
agacucagaugaagaggaa

SEQ ID NO: 427458 - RNA, 19 nt, Homo sapiens
aagcaagcaucuucuuaaa

SEQ ID NO: 427459 - RNA, 19 nt, Homo sapiens
guguuuaguucgaucauuu

SEQ ID NO: 427460 - RNA, 19 nt, Homo sapiens
aggcaaagauuaagacugu

SEQ ID NO: 427461 - RNA, 19 nt, Homo sapiens
gaagacagagguacuccaa

SEQ ID NO: 427462 - RNA, 19 nt, Homo sapiens
agaaagcagugaagaggaa

SEQ ID NO: 427463 - RNA, 19 nt, Homo sapiens
gaacaggacaaagcaguga

SEQ ID NO: 427464 - RNA, 19 nt, Homo sapiens
guuagaaguuggagagaau

SEQ ID NO: 427465 - RNA, 19 nt, Homo sapiens
ggaaccaaagugaaaguaa

SEQ ID NO: 427466 - RNA, 19 nt, Homo sapiens
acaggaggauucugacaaa

SEQ ID NO: 427467 - RNA, 19 nt, Homo sapiens
gacaagcgccgucucaaug

SEQ ID NO: 427468 - RNA, 19 nt, Homo sapiens
gaccagugauuguauugga

SEQ ID NO: 427469 - RNA, 19 nt, Homo sapiens
gcaggaagugaaccucaua

SEQ ID NO: 427470 - RNA, 19 nt, Homo sapiens
ggguggaugugacaauauu

SEQ ID NO: 427471 - RNA, 19 nt, Homo sapiens
agacagagguacuccaauc

SEQ ID NO: 427472 - RNA, 19 nt, Homo sapiens
gaaaguaucucuaugguuu

SEQ ID NO: 427473 - RNA, 19 nt, Homo sapiens
ggaagaaacugaaagcaaa

SEQ ID NO: 427474 - RNA, 19 nt, Homo sapiens
gaauggaacagaugaauua

SEQ ID NO: 427475 - RNA, 19 nt, Homo sapiens
gagaauugcucgagaugua

SEQ ID NO: 427476 - RNA, 19 nt, Homo sapiens
uaacagaagugaagaguga

SEQ ID NO: 427477 - RNA, 19 nt, Homo sapiens
gaaccaaagugaaaguaaa

SEQ ID NO: 427478 - RNA, 19 nt, Homo sapiens
gguauuaucuugcaacuug

SEQ ID NO: 427479 - RNA, 19 nt, Homo sapiens
ggacaaagguggaccaaag

SEQ ID NO: 427480 - RNA, 19 nt, Homo sapiens
gaaaggacauuaaggaagu

SEQ ID NO: 427481 - RNA, 19 nt, Homo sapiens
gagcgaacauugagacgua

SEQ ID NO: 427482 - RNA, 19 nt, Homo sapiens
gguacaagaugaccaagua

SEQ ID NO: 427483 - RNA, 19 nt, Homo sapiens
ggugaaggcugacaggaua

SEQ ID NO: 427484 - RNA, 19 nt, Homo sapiens
ggauguagaugaugacuau

SEQ ID NO: 427485 - RNA, 19 nt, Homo sapiens
cagaagaaguuaagaaaga

SEQ ID NO: 427486 - RNA, 19 nt, Homo sapiens
gaaagcaagcaucuucuua

SEQ ID NO: 427487 - RNA, 19 nt, Homo sapiens
aaucugagcucuccacuaa

SEQ ID NO: 427488 - RNA, 19 nt, Homo sapiens
gaagugaaccucauauaga

SEQ ID NO: 427489 - RNA, 19 nt, Homo sapiens
ggagaggacugaaugguau

SEQ ID NO: 427490 - RNA, 19 nt, Homo sapiens
gcacacaauuaugcaaaua

SEQ ID NO: 427491 - RNA, 19 nt, Homo sapiens
uuacccagcugaauaguua

SEQ ID NO: 427492 - RNA, 19 nt, Homo sapiens
ggacucaaaugcagccuuu

SEQ ID NO: 427493 - RNA, 19 nt, Homo sapiens
gaauggaaaugacaaauac

SEQ ID NO: 427494 - RNA, 19 nt, Homo sapiens
ggaauggaaaugacaaaua

SEQ ID NO: 427495 - RNA, 19 nt, Homo sapiens
uaaagaagauagugaagug

SEQ ID NO: 427496 - RNA, 19 nt, Homo sapiens
ccaaagauuucugcacaua

SEQ ID NO: 427497 - RNA, 19 nt, Homo sapiens
ggaagcaaauuuauaugga

SEQ ID NO: 427498 - RNA, 19 nt, Homo sapiens
gaaguguaguugacugaaa

SEQ ID NO: 427499 - RNA, 19 nt, Homo sapiens
agaaaugccuuuaacagaa

SEQ ID NO: 427500 - RNA, 19 nt, Homo sapiens
gaacaaagggcacuuagca

SEQ ID NO: 427501 - RNA, 19 nt, Homo sapiens
gaaaggaccagugauugua

SEQ ID NO: 427502 - RNA, 19 nt, Homo sapiens
ucugguaccuguaguauaa

SEQ ID NO: 427503 - RNA, 19 nt, Homo sapiens
caacauaacuuuucaguag

SEQ ID NO: 427504 - RNA, 19 nt, Homo sapiens
ggaagaacuugauccugaa

SEQ ID NO: 427505 - RNA, 19 nt, Homo sapiens
gaaaggaaguguaguugac

SEQ ID NO: 427506 - RNA, 19 nt, Homo sapiens
gcacuuagcaaauuugaau

SEQ ID NO: 427507 - RNA, 19 nt, Homo sapiens
gguuugacauugcuaagua

SEQ ID NO: 427508 - RNA, 19 nt, Homo sapiens
ugaagaaucucaagaaggu

SEQ ID NO: 427509 - RNA, 19 nt, Homo sapiens
gaaaugccuuuaacagaag

SEQ ID NO: 427510 - RNA, 19 nt, Homo sapiens
gaacuccaguaauugcaaa

SEQ ID NO: 427511 - RNA, 19 nt, Homo sapiens
agaaagcacucaacugguu

SEQ ID NO: 427512 - RNA, 19 nt, Homo sapiens
ggaaauaguggauuaaugg

SEQ ID NO: 427513 - RNA, 19 nt, Homo sapiens
ggaaaugacaaauacugua

SEQ ID NO: 427514 - RNA, 19 nt, Homo sapiens
ggacaaucaucgccagaga

SEQ ID NO: 427515 - RNA, 19 nt, Homo sapiens
aaucaacccucucaucaaa

SEQ ID NO: 427516 - RNA, 19 nt, Homo sapiens
gaccuuggcauuccuauuu

SEQ ID NO: 427517 - RNA, 19 nt, Homo sapiens
acaguggaauugugaauaa

SEQ ID NO: 427518 - RNA, 19 nt, Homo sapiens
ugauggaaauaguggauua

SEQ ID NO: 427519 - RNA, 19 nt, Homo sapiens
caagaaaggaccagugauu

SEQ ID NO: 427520 - RNA, 19 nt, Homo sapiens
uauagaagcucauagucuu

SEQ ID NO: 427521 - RNA, 19 nt, Homo sapiens
uagaaacccugaaguuaga

SEQ ID NO: 427522 - RNA, 19 nt, Homo sapiens
ugaaacagaagaugcuuua

SEQ ID NO: 427523 - RNA, 19 nt, Homo sapiens
aaacaugccguauggcuua

SEQ ID NO: 427524 - RNA, 19 nt, Homo sapiens
ggaaauugaagaagagaaa

SEQ ID NO: 427525 - RNA, 19 nt, Homo sapiens
gaaguagauuuggaugauu

SEQ ID NO: 427526 - RNA, 19 nt, Homo sapiens
uggagagaaugaacaaaua

SEQ ID NO: 427527 - RNA, 19 nt, Homo sapiens
ugacaaagacucagaugaa

SEQ ID NO: 427528 - RNA, 19 nt, Homo sapiens
gaucaagaaaugccuuuaa

SEQ ID NO: 427529 - RNA, 19 nt, Homo sapiens
ggaaguagacauucucaau

SEQ ID NO: 427530 - RNA, 19 nt, Homo sapiens
caagaaaggacauuaagga

SEQ ID NO: 427531 - RNA, 19 nt, Homo sapiens
caucaaacaugccguaugg

SEQ ID NO: 427532 - RNA, 19 nt, Homo sapiens
ugaaauugaugacggagaa

SEQ ID NO: 427533 - RNA, 19 nt, Homo sapiens
cuaugaaacugcagagaaa

SEQ ID NO: 427534 - RNA, 19 nt, Homo sapiens
gcaaauauucaguucagaa

SEQ ID NO: 427535 - RNA, 19 nt, Homo sapiens
cagcagcuuuauaaguuua

SEQ ID NO: 427536 - RNA, 19 nt, Homo sapiens
guaccgaggugccuucugu

SEQ ID NO: 427537 - RNA, 19 nt, Homo sapiens
cgauugaaguugauaguau

SEQ ID NO: 427538 - RNA, 19 nt, Homo sapiens
gaaugaagcaggaagugaa

SEQ ID NO: 427539 - RNA, 19 nt, Homo sapiens
gguauaccgugguguuuga

SEQ ID NO: 427540 - RNA, 19 nt, Homo sapiens
uuacagaaaucguagacaa

SEQ ID NO: 427541 - RNA, 19 nt, Homo sapiens
ucaguagcuucaccacuua

SEQ ID NO: 427542 - RNA, 19 nt, Homo sapiens
ccacacaauugguacaaga

SEQ ID NO: 427543 - RNA, 19 nt, Homo sapiens
aaagggcacuuagcaaauu

SEQ ID NO: 427544 - RNA, 19 nt, Homo sapiens
cuaacucucuuguuucuau

SEQ ID NO: 427545 - RNA, 19 nt, Homo sapiens
guugaaagcucugagucua

SEQ ID NO: 427546 - RNA, 19 nt, Homo sapiens
ggaagugaaccucauauag

SEQ ID NO: 427547 - RNA, 19 nt, Homo sapiens
caaaugcagccuuuagaaa

SEQ ID NO: 427548 - RNA, 19 nt, Homo sapiens
aacagaagaugcuuuagaa

SEQ ID NO: 427549 - RNA, 19 nt, Homo sapiens
gaucuucucuuccuguuac

SEQ ID NO: 427550 - RNA, 19 nt, Homo sapiens
gauaauaccacacaauugg

SEQ ID NO: 427551 - RNA, 19 nt, Homo sapiens
uaucuuaucccuugacaaa

SEQ ID NO: 427552 - RNA, 19 nt, Homo sapiens
caacaacugacuagugaaa

SEQ ID NO: 427553 - RNA, 19 nt, Homo sapiens
caagauuucuaaagcugaa

SEQ ID NO: 427554 - RNA, 19 nt, Homo sapiens
gcacuuucacuaagaugua

SEQ ID NO: 427555 - RNA, 19 nt, Homo sapiens
gagaauggaauggaaauga

SEQ ID NO: 427556 - RNA, 19 nt, Homo sapiens
gcaaagauuaagacuguga

SEQ ID NO: 427557 - RNA, 19 nt, Homo sapiens
agacucagaugaagaggaa

SEQ ID NO: 427558 - RNA, 19 nt, Homo sapiens
aagcaagcaucuucuuaaa

SEQ ID NO: 427559 - RNA, 19 nt, Homo sapiens
guguuuaguucgaucauuu

SEQ ID NO: 427560 - RNA, 19 nt, Homo sapiens
aggcaaagauuaagacugu

SEQ ID NO: 427561 - RNA, 19 nt, Homo sapiens
gaagacagagguacuccaa

SEQ ID NO: 427562 - RNA, 19 nt, Homo sapiens
agaaagcagugaagaggaa

SEQ ID NO: 427563 - RNA, 19 nt, Homo sapiens
guuagaaguuggagagaau

SEQ ID NO: 427564 - RNA, 19 nt, Homo sapiens
ggaaccaaagugaaaguaa

SEQ ID NO: 427565 - RNA, 19 nt, Homo sapiens
acaggaggauucugacaaa

SEQ ID NO: 427566 - RNA, 19 nt, Homo sapiens
gacaagcgccgucucaaug

SEQ ID NO: 427567 - RNA, 19 nt, Homo sapiens
uggaacagaugaauuagau

SEQ ID NO: 427568 - RNA, 19 nt, Homo sapiens
gaccagugauuguauugga

SEQ ID NO: 427569 - RNA, 19 nt, Homo sapiens
gcaggaagugaaccucaua

SEQ ID NO: 427570 - RNA, 19 nt, Homo sapiens
ggguggaugugacaauauu

SEQ ID NO: 427571 - RNA, 19 nt, Homo sapiens
agacagagguacuccaauc

SEQ ID NO: 427572 - RNA, 19 nt, Homo sapiens
ggacaucucugguaugaaa

SEQ ID NO: 427573 - RNA, 19 nt, Homo sapiens
ggacgagacucaacacaua

SEQ ID NO: 427574 - RNA, 19 nt, Homo sapiens
guuagaggcuuacaacuua

SEQ ID NO: 427575 - RNA, 19 nt, Homo sapiens
caaagaagcugaauaaacu

SEQ ID NO: 427576 - RNA, 19 nt, Homo sapiens
gagcagauaucuccucaaa

SEQ ID NO: 427577 - RNA, 19 nt, Homo sapiens
caacacauauggcggauuu

SEQ ID NO: 427578 - RNA, 19 nt, Homo sapiens
ggaaauacccagagaauga

SEQ ID NO: 427579 - RNA, 19 nt, Homo sapiens
gaagucacauuaugaaaga

SEQ ID NO: 427580 - RNA, 19 nt, Homo sapiens
gauaguaguuagaggcuua

SEQ ID NO: 427581 - RNA, 19 nt, Homo sapiens
gcuuggaucuccuucauua

SEQ ID NO: 427582 - RNA, 19 nt, Homo sapiens
ugaauaaacuggccaagaa

SEQ ID NO: 427583 - RNA, 19 nt, Homo sapiens
ggacaaaccuagaaagaag

SEQ ID NO: 427584 - RNA, 19 nt, Homo sapiens
gcuaugaguuggcaagaua

SEQ ID NO: 427585 - RNA, 19 nt, Homo sapiens
gaaaggcacucucucuguu

SEQ ID NO: 427586 - RNA, 19 nt, Homo sapiens
caagggaguuguauuugua

SEQ ID NO: 427587 - RNA, 19 nt, Homo sapiens
ggacuaugaugaugaagaa

SEQ ID NO: 427588 - RNA, 19 nt, Homo sapiens
gagaagaaauggucuaaag

SEQ ID NO: 427589 - RNA, 19 nt, Homo sapiens
gaggaucacuggaguuauu

SEQ ID NO: 427590 - RNA, 19 nt, Homo sapiens
caacacuggugauuucuaa

SEQ ID NO: 427591 - RNA, 19 nt, Homo sapiens
gacaaacaauggacuauga

SEQ ID NO: 427592 - RNA, 19 nt, Homo sapiens
gagaggcccugcaguguuu

SEQ ID NO: 427593 - RNA, 19 nt, Homo sapiens
ugacagcuaucauacauuu

SEQ ID NO: 427594 - RNA, 19 nt, Homo sapiens
gcagaugcuugguuaguuu

SEQ ID NO: 427595 - RNA, 19 nt, Homo sapiens
gcacaaggaugaacauucu

SEQ ID NO: 427596 - RNA, 19 nt, Homo sapiens
uaacaugccuguccuggaa

SEQ ID NO: 427597 - RNA, 19 nt, Homo sapiens
gggaaacaaugaagauaaa

SEQ ID NO: 427598 - RNA, 19 nt, Homo sapiens
gagggugucuucuuuggua

SEQ ID NO: 427599 - RNA, 19 nt, Homo sapiens
gagcaagaccagcaaauaa

SEQ ID NO: 427600 - RNA, 19 nt, Homo sapiens
gcucuaggguggcugguua

SEQ ID NO: 427601 - RNA, 19 nt, Homo sapiens
caaguagagugguuuauau

SEQ ID NO: 427602 - RNA, 19 nt, Homo sapiens
agaaugaucucuuucgaaa

SEQ ID NO: 427603 - RNA, 19 nt, Homo sapiens
gaaacacgauuaagagagu

SEQ ID NO: 427604 - RNA, 19 nt, Homo sapiens
ggaaugugcuucucuucuu

SEQ ID NO: 427605 - RNA, 19 nt, Homo sapiens
gaagaggaauaugcacuuu

SEQ ID NO: 427606 - RNA, 19 nt, Homo sapiens
gaagaagaaacacgauuaa

SEQ ID NO: 427607 - RNA, 19 nt, Homo sapiens
gauaucaucuagaucagaa

SEQ ID NO: 427608 - RNA, 19 nt, Homo sapiens
uagaagaacaucccaaaua

SEQ ID NO: 427609 - RNA, 19 nt, Homo sapiens
agaagaagaugacgaguau

SEQ ID NO: 427610 - RNA, 19 nt, Homo sapiens
ggaaugguaucacagucua

SEQ ID NO: 427611 - RNA, 19 nt, Homo sapiens
uaagaguuguucucaagua

SEQ ID NO: 427612 - RNA, 19 nt, Homo sapiens
gaaugugcuucucuucuuu

SEQ ID NO: 427613 - RNA, 19 nt, Homo sapiens
gaguuguucucaaguauuu

SEQ ID NO: 427614 - RNA, 19 nt, Homo sapiens
gcaaagacugguuccauaa

SEQ ID NO: 427615 - RNA, 19 nt, Homo sapiens
ugaagaagauguuauugug

SEQ ID NO: 427616 - RNA, 19 nt, Homo sapiens
aaagaauucucuacccaua

SEQ ID NO: 427617 - RNA, 19 nt, Homo sapiens
gauccaggcuucugccaaa

SEQ ID NO: 427618 - RNA, 19 nt, Homo sapiens
gauaugggcucuagucucu

SEQ ID NO: 427619 - RNA, 19 nt, Homo sapiens
ccacagugaugcaugcuuu

SEQ ID NO: 427620 - RNA, 19 nt, Homo sapiens
caacaggucagacgcauuu

SEQ ID NO: 427621 - RNA, 19 nt, Homo sapiens
gaagaaauggucuaaagug

SEQ ID NO: 427622 - RNA, 19 nt, Homo sapiens
ggaccgacauugguguaua

SEQ ID NO: 427623 - RNA, 19 nt, Homo sapiens
gggcggacguuucuuaaga

SEQ ID NO: 427624 - RNA, 19 nt, Homo sapiens
gaagaaacacgauuaagag

SEQ ID NO: 427625 - RNA, 19 nt, Homo sapiens
gagauuggauuucuuggau

SEQ ID NO: 427626 - RNA, 19 nt, Homo sapiens
ugaaugaacuugaggcaau

SEQ ID NO: 427627 - RNA, 19 nt, Homo sapiens
gagaagaagaugacgagua

SEQ ID NO: 427628 - RNA, 19 nt, Homo sapiens
caagaacauuccagccuuu

SEQ ID NO: 427629 - RNA, 19 nt, Homo sapiens
gauaggaaauacccagaga

SEQ ID NO: 427630 - RNA, 19 nt, Homo sapiens
gaccagucguacuaucuua

SEQ ID NO: 427631 - RNA, 19 nt, Homo sapiens
gagaagaaccuacuacaag

SEQ ID NO: 427632 - RNA, 19 nt, Homo sapiens
gaacauuccagccuuucua

SEQ ID NO: 427633 - RNA, 19 nt, Homo sapiens
caacugaaggugcuaauug

SEQ ID NO: 427634 - RNA, 19 nt, Homo sapiens
gaagagauucccaucaaau

SEQ ID NO: 427635 - RNA, 19 nt, Homo sapiens
gcaaguggaaucacaggua

SEQ ID NO: 427636 - RNA, 19 nt, Homo sapiens
cagccaagcucggcaagua

SEQ ID NO: 427637 - RNA, 19 nt, Homo sapiens
ugaagaagaaacacgauua

SEQ ID NO: 427638 - RNA, 19 nt, Homo sapiens
ucucaugacugaagaagaa

SEQ ID NO: 427639 - RNA, 19 nt, Homo sapiens
gaagaucccugugguagag

SEQ ID NO: 427640 - RNA, 19 nt, Homo sapiens
agaagaacaucccaaauag

SEQ ID NO: 427641 - RNA, 19 nt, Homo sapiens
ccacuuucuuccacuguua

SEQ ID NO: 427642 - RNA, 19 nt, Homo sapiens
gcauauaggauguggcuuu

SEQ ID NO: 427643 - RNA, 19 nt, Homo sapiens
ggguguaucuccagaaaug

SEQ ID NO: 427644 - RNA, 19 nt, Homo sapiens
gcaauuacgcuuauuugga

SEQ ID NO: 427645 - RNA, 19 nt, Homo sapiens
gaaagaagccuuacaaaag

SEQ ID NO: 427646 - RNA, 19 nt, Homo sapiens
gcaaagaauugacucucau

SEQ ID NO: 427647 - RNA, 19 nt, Homo sapiens
gcacugauacccaaacuuc

SEQ ID NO: 427648 - RNA, 19 nt, Homo sapiens
gacagauucuugcauauca

SEQ ID NO: 427649 - RNA, 19 nt, Homo sapiens
gaacaggcggcucgagaaa

SEQ ID NO: 427650 - RNA, 19 nt, Homo sapiens
gcagauaucuccucaaaag

SEQ ID NO: 427651 - RNA, 19 nt, Homo sapiens
gaggauaucaucuagauca

SEQ ID NO: 427652 - RNA, 19 nt, Homo sapiens
caagacagccaguggguuu

SEQ ID NO: 427653 - RNA, 19 nt, Homo sapiens
ggacgucaauguguaaauc

SEQ ID NO: 427654 - RNA, 19 nt, Homo sapiens
gcugugaacuucuguacug

SEQ ID NO: 427655 - RNA, 19 nt, Homo sapiens
ucagugugcuggcgaguuu

SEQ ID NO: 427656 - RNA, 19 nt, Homo sapiens
cgagaagccuuuggauuug

SEQ ID NO: 427657 - RNA, 19 nt, Homo sapiens
gugcagagcaugcuuauuc

SEQ ID NO: 427658 - RNA, 19 nt, Homo sapiens
cuccagauguugauagaua

SEQ ID NO: 427659 - RNA, 19 nt, Homo sapiens
ccacagaacuaguagaaaa

SEQ ID NO: 427660 - RNA, 19 nt, Homo sapiens
ucgagaagccuuuggauuu

SEQ ID NO: 427661 - RNA, 19 nt, Homo sapiens
gaaaggaaaggacucuuca

SEQ ID NO: 427662 - RNA, 19 nt, Homo sapiens
gaggaaggauuggaggaaa

SEQ ID NO: 427663 - RNA, 19 nt, Homo sapiens
ggaacucccugaauuacca

SEQ ID NO: 427664 - RNA, 19 nt, Homo sapiens
gcucucacauguuccugua

SEQ ID NO: 427665 - RNA, 19 nt, Homo sapiens
ggaccacauugagaccuua

SEQ ID NO: 427666 - RNA, 19 nt, Homo sapiens
gaauaaacuggccaagaaa

SEQ ID NO: 427667 - RNA, 19 nt, Homo sapiens
aaaauuaggugcagacaaa

SEQ ID NO: 427668 - RNA, 19 nt, Homo sapiens
gcuagagacuauucuguca

SEQ ID NO: 427669 - RNA, 19 nt, Homo sapiens
gagcuugucugcgaaagga

SEQ ID NO: 427670 - RNA, 19 nt, Homo sapiens
gaaagcaauggcugaacua

SEQ ID NO: 427671 - RNA, 19 nt, Homo sapiens
gccuaucacucuggauuua

SEQ ID NO: 427672 - RNA, 19 nt, Homo sapiens
caacaaagccacagacuua

SEQ ID NO: 427673 - RNA, 19 nt, Homo sapiens
gaagugaacugccuuucuu

SEQ ID NO: 427674 - RNA, 19 nt, Homo sapiens
gauacucguucaaacaaua

SEQ ID NO: 427675 - RNA, 19 nt, Homo sapiens
ugagaagagugaaucaaua

SEQ ID NO: 427676 - RNA, 19 nt, Homo sapiens
gcuaugggcuuucuuggaa

SEQ ID NO: 427677 - RNA, 19 nt, Homo sapiens
uaaaguagcuacagaaagg

SEQ ID NO: 427678 - RNA, 19 nt, Homo sapiens
gaucaaccaugaaggagaa

SEQ ID NO: 427679 - RNA, 19 nt, Homo sapiens
gaacugccuuucuuucaau

SEQ ID NO: 427680 - RNA, 19 nt, Homo sapiens
gagaagagugaaucaauaa

SEQ ID NO: 427681 - RNA, 19 nt, Homo sapiens
cuagauaugucuuuacuug

SEQ ID NO: 427682 - RNA, 19 nt, Homo sapiens
ccaccagaguuguuguuua

SEQ ID NO: 427683 - RNA, 19 nt, Homo sapiens
gaacaccccuuuucuuuau

SEQ ID NO: 427684 - RNA, 19 nt, Homo sapiens
caaagacuccuuccaguga

SEQ ID NO: 427685 - RNA, 19 nt, Homo sapiens
gaucaacgaggaauacaaa

SEQ ID NO: 427686 - RNA, 19 nt, Homo sapiens
aaacaacacguuccucuuu

SEQ ID NO: 427687 - RNA, 19 nt, Homo sapiens
caaugaaccuugggugauu

SEQ ID NO: 427688 - RNA, 19 nt, Homo sapiens
caccagaguuguuguuuau

SEQ ID NO: 427689 - RNA, 19 nt, Homo sapiens
gguccuagauaugucuuua

SEQ ID NO: 427690 - RNA, 19 nt, Homo sapiens
ccagaacccuuguaucauc

SEQ ID NO: 427691 - RNA, 19 nt, Homo sapiens
ccaccaaguuguaaagaug

SEQ ID NO: 427692 - RNA, 19 nt, Homo sapiens
uggcagagaacauuuauaa

SEQ ID NO: 427693 - RNA, 19 nt, Homo sapiens
aaaucaagaucaaccauga

SEQ ID NO: 427694 - RNA, 19 nt, Homo sapiens
ccacagacuuaacguugaa

SEQ ID NO: 427695 - RNA, 19 nt, Homo sapiens
guucuugucuuugacuaua

SEQ ID NO: 427696 - RNA, 19 nt, Homo sapiens
uaaugaugaugcucaguuu

SEQ ID NO: 427697 - RNA, 19 nt, Homo sapiens
gaccagaagggaaagauuu

SEQ ID NO: 427698 - RNA, 19 nt, Homo sapiens
guagaccaguuuccucuug

SEQ ID NO: 427699 - RNA, 19 nt, Homo sapiens
ucugagccaugaaguauaa

SEQ ID NO: 427700 - RNA, 19 nt, Homo sapiens
ggucuaaaguagcuacaga

SEQ ID NO: 427701 - RNA, 19 nt, Homo sapiens
cagguagacugucaaguug

SEQ ID NO: 427702 - RNA, 19 nt, Homo sapiens
uaacccaggucuaaaguag

SEQ ID NO: 427703 - RNA, 19 nt, Homo sapiens
gauaugucuuuacuuguug

SEQ ID NO: 427704 - RNA, 19 nt, Homo sapiens
ccagaguuguuguuuauuc

SEQ ID NO: 427705 - RNA, 19 nt, Homo sapiens
ucagcuaucccucuauaua

SEQ ID NO: 427706 - RNA, 19 nt, Homo sapiens
gacaauaucaugcaagugu

SEQ ID NO: 427707 - RNA, 19 nt, Homo sapiens
uauagugaguucauucuug

SEQ ID NO: 427708 - RNA, 19 nt, Homo sapiens
gugugcagcucccuaauga

SEQ ID NO: 427709 - RNA, 19 nt, Homo sapiens
guaggugucugagccauga

SEQ ID NO: 427710 - RNA, 19 nt, Homo sapiens
gugauguucuugucuuuga

SEQ ID NO: 427711 - RNA, 19 nt, Homo sapiens
gagccaugaaguauaaaua

SEQ ID NO: 427712 - RNA, 19 nt, Homo sapiens
cagcuaucccucuauauaa

SEQ ID NO: 427713 - RNA, 19 nt, Homo sapiens
aaacaauacuuccaaacca

SEQ ID NO: 427714 - RNA, 19 nt, Homo sapiens
cugaaugucugggauuuaa

SEQ ID NO: 427715 - RNA, 19 nt, Homo sapiens
ggacaucagugccguucca

SEQ ID NO: 427716 - RNA, 19 nt, Homo sapiens
gcauacggcaguaguagaa

SEQ ID NO: 427717 - RNA, 19 nt, Homo sapiens
gggaauauuaugugugauu

SEQ ID NO: 427718 - RNA, 19 nt, Homo sapiens
aaaccaagccacucaguug

SEQ ID NO: 427719 - RNA, 19 nt, Homo sapiens
caagaucaaccaugaagga

SEQ ID NO: 427720 - RNA, 19 nt, Homo sapiens
uaauagguaccaccgauaa

SEQ ID NO: 427721 - RNA, 19 nt, Homo sapiens
caacgaggaauacaaaaua

SEQ ID NO: 427722 - RNA, 19 nt, Homo sapiens
gcuaucccucuauauaaua

SEQ ID NO: 427723 - RNA, 19 nt, Homo sapiens
uaucugauuucuccuggaa

SEQ ID NO: 427724 - RNA, 19 nt, Homo sapiens
ccagugauguucuugucuu

SEQ ID NO: 427725 - RNA, 19 nt, Homo sapiens
caagucguauagauuccua

SEQ ID NO: 427726 - RNA, 19 nt, Homo sapiens
uaaguaaaggcuagaguga

SEQ ID NO: 427727 - RNA, 19 nt, Homo sapiens
ccaguggcuuccagaugua

SEQ ID NO: 427728 - RNA, 19 nt, Homo sapiens
gaugaucagaaacuuauga

SEQ ID NO: 427729 - RNA, 19 nt, Homo sapiens
gaguucaagucguauagau

SEQ ID NO: 427730 - RNA, 19 nt, Homo sapiens
gccacagacuuaacguuga

SEQ ID NO: 427731 - RNA, 19 nt, Homo sapiens
cugccaagauaucugauuu

SEQ ID NO: 427732 - RNA, 19 nt, Homo sapiens
gacugaaugucugggauuu

SEQ ID NO: 427733 - RNA, 19 nt, Homo sapiens
gaagagugaaucaauaacu

SEQ ID NO: 427734 - RNA, 19 nt, Homo sapiens
caaccaugaaggagaagua

SEQ ID NO: 427735 - RNA, 19 nt, Homo sapiens
gcagcucccuaaugaugau

SEQ ID NO: 427736 - RNA, 19 nt, Homo sapiens
gacagacuuuauucagcua

SEQ ID NO: 427737 - RNA, 19 nt, Homo sapiens
cugagaaaucugaaacuua

SEQ ID NO: 427738 - RNA, 19 nt, Homo sapiens
ccucuugguuucuucaguu

SEQ ID NO: 427739 - RNA, 19 nt, Homo sapiens
gaaccuugggugauuuguu

SEQ ID NO: 427740 - RNA, 19 nt, Homo sapiens
ggucauacugccaagauau

SEQ ID NO: 427741 - RNA, 19 nt, Homo sapiens
cagaguuguuguuuauuca

SEQ ID NO: 427742 - RNA, 19 nt, Homo sapiens
ggauacucguucaaacaau

SEQ ID NO: 427743 - RNA, 19 nt, Homo sapiens
ggaaggcuaugggcuuucu

SEQ ID NO: 427744 - RNA, 19 nt, Homo sapiens
ccaguuuccucuugguuuc

SEQ ID NO: 427745 - RNA, 19 nt, Homo sapiens
guucaagucguauagauuc

SEQ ID NO: 427746 - RNA, 19 nt, Homo sapiens
uaaaggcuagagugaguaa

SEQ ID NO: 427747 - RNA, 19 nt, Homo sapiens
aagcguggauccagaagga

SEQ ID NO: 427748 - RNA, 19 nt, Homo sapiens
gaugaagacccugaaggaa

SEQ ID NO: 427749 - RNA, 19 nt, Homo sapiens
gccaagauaucugauuucu

SEQ ID NO: 427750 - RNA, 19 nt, Homo sapiens
gaguuguuguuuauucaug

SEQ ID NO: 427751 - RNA, 19 nt, Homo sapiens
gaagacgggccaccagagu

SEQ ID NO: 427752 - RNA, 19 nt, Homo sapiens
gccuuucuuucaauccuua

SEQ ID NO: 427753 - RNA, 19 nt, Homo sapiens
ccaagccacucaguugaug

SEQ ID NO: 427754 - RNA, 19 nt, Homo sapiens
gggauacucguucaaacaa

SEQ ID NO: 427755 - RNA, 19 nt, Homo sapiens
ugagaaaggagaauuugga

SEQ ID NO: 427756 - RNA, 19 nt, Homo sapiens
gcucguuaguguauuucuu

SEQ ID NO: 427757 - RNA, 19 nt, Homo sapiens
guauagauuccuacucgaa

SEQ ID NO: 427758 - RNA, 19 nt, Homo sapiens
gacaaggguccuagauaug

SEQ ID NO: 427759 - RNA, 19 nt, Homo sapiens
gugcagcucccuaaugaug

SEQ ID NO: 427760 - RNA, 19 nt, Homo sapiens
ucagugccguuccaaagga

SEQ ID NO: 427761 - RNA, 19 nt, Homo sapiens
cccaguggcuuccagaugu

SEQ ID NO: 427762 - RNA, 19 nt, Homo sapiens
cuagagugaguaaggaaua

SEQ ID NO: 427763 - RNA, 19 nt, Homo sapiens
auucagcuaucccucuaua

SEQ ID NO: 427764 - RNA, 19 nt, Homo sapiens
uaaguugcauuccuuugag

SEQ ID NO: 427765 - RNA, 19 nt, Homo sapiens
gaucagcugacaagacugu

SEQ ID NO: 427766 - RNA, 19 nt, Homo sapiens
gauuugggauacucguuca

SEQ ID NO: 427767 - RNA, 19 nt, Homo sapiens
aguaaaggcuagagugagu

SEQ ID NO: 427768 - RNA, 19 nt, Homo sapiens
gauguaaccagaccagaag

SEQ ID NO: 427769 - RNA, 19 nt, Homo sapiens
ucuaguaacccaggucuaa

SEQ ID NO: 427770 - RNA, 19 nt, Homo sapiens
agaagacaauaucaugcaa

SEQ ID NO: 427771 - RNA, 19 nt, Homo sapiens
gaaugucugggauuuaagu

SEQ ID NO: 427772 - RNA, 19 nt, Homo sapiens
ccagauaccuccuauauuu

SEQ ID NO: 427773 - RNA, 19 nt, Homo sapiens
caaaggcucuauuguauuu

SEQ ID NO: 427774 - RNA, 19 nt, Homo sapiens
gaaagugcuugaaagauuu

SEQ ID NO: 427775 - RNA, 19 nt, Homo sapiens
ccacauaguucaaaucaaa

SEQ ID NO: 427776 - RNA, 19 nt, Homo sapiens
gcagagaaaucuuaacaug

SEQ ID NO: 427777 - RNA, 19 nt, Homo sapiens
gcaguuggcuguaaugaug

SEQ ID NO: 427778 - RNA, 19 nt, Homo sapiens
gaaagccuguaucuauuaa

SEQ ID NO: 427779 - RNA, 19 nt, Homo sapiens
ucaagaagcugggcuguaa

SEQ ID NO: 427780 - RNA, 19 nt, Homo sapiens
gaaaucugcuccugucaug

SEQ ID NO: 427781 - RNA, 19 nt, Homo sapiens
gaaugaagauuugugaaga

SEQ ID NO: 427782 - RNA, 19 nt, Homo sapiens
gagccgagauggucauaaa

SEQ ID NO: 427783 - RNA, 19 nt, Homo sapiens
agaaagugcuugaaagauu

SEQ ID NO: 427784 - RNA, 19 nt, Homo sapiens
gcagaacuauccagaggaa

SEQ ID NO: 427785 - RNA, 19 nt, Homo sapiens
cagcaaagaaucaucaaua

SEQ ID NO: 427786 - RNA, 19 nt, Homo sapiens
caaauagacucucaggaau

SEQ ID NO: 427787 - RNA, 19 nt, Homo sapiens
gcaccagacuucaaagaau

SEQ ID NO: 427788 - RNA, 19 nt, Homo sapiens
ggugaaagccuguaucuau

SEQ ID NO: 427789 - RNA, 19 nt, Homo sapiens
ggacucauuuaaacuuuga

SEQ ID NO: 427790 - RNA, 19 nt, Homo sapiens
ccaaauagacucucaggaa

SEQ ID NO: 427791 - RNA, 19 nt, Homo sapiens
uaacacggcagaucgaaua

SEQ ID NO: 427792 - RNA, 19 nt, Homo sapiens
gugaaagccuguaucuauu

SEQ ID NO: 427793 - RNA, 19 nt, Homo sapiens
gaagauuugugaagacauc

SEQ ID NO: 427794 - RNA, 19 nt, Homo sapiens
gaacuguuaugaagaccuu

SEQ ID NO: 427795 - RNA, 19 nt, Homo sapiens
agagaaaucuuaacaugug

SEQ ID NO: 427796 - RNA, 19 nt, Homo sapiens
gaacucagccagcccuuga

SEQ ID NO: 427797 - RNA, 19 nt, Homo sapiens
gaaagggaaucaggguuug

SEQ ID NO: 427798 - RNA, 19 nt, Homo sapiens
gaucgaauaaucagaguuu

SEQ ID NO: 427799 - RNA, 19 nt, Homo sapiens
gaagugaauuauggaagaa

SEQ ID NO: 427800 - RNA, 19 nt, Homo sapiens
uaaauacugugcuuacugu

SEQ ID NO: 427801 - RNA, 19 nt, Homo sapiens
aaucaaagaucaaggugaa

SEQ ID NO: 427802 - RNA, 19 nt, Homo sapiens
gaacuccucuuggauguag

SEQ ID NO: 427803 - RNA, 19 nt, Homo sapiens
ccacagccauuaagucaau

SEQ ID NO: 427804 - RNA, 19 nt, Homo sapiens
aagcugggcuguaacaauu

SEQ ID NO: 427805 - RNA, 19 nt, Homo sapiens
gguuugauauugaagauga

SEQ ID NO: 427806 - RNA, 19 nt, Homo sapiens
ugaaagccuguaucuauua

SEQ ID NO: 427807 - RNA, 19 nt, Homo sapiens
aagcauaaguccaaauaga

SEQ ID NO: 427808 - RNA, 19 nt, Homo sapiens
ggaggugggaggugaauuu

SEQ ID NO: 427809 - RNA, 19 nt, Homo sapiens
uauagaacuucaaggagua

SEQ ID NO: 427810 - RNA, 19 nt, Homo sapiens
gguagaagacccagaagaa

SEQ ID NO: 427811 - RNA, 19 nt, Homo sapiens
ggaagcugauggaacuuug

SEQ ID NO: 427812 - RNA, 19 nt, Homo sapiens
ggaaaucuauccucaucag

SEQ ID NO: 427813 - RNA, 19 nt, Homo sapiens
gaagacaucagauaggaau

SEQ ID NO: 427814 - RNA, 19 nt, Homo sapiens
gcaauaccacagccauuaa

SEQ ID NO: 427815 - RNA, 19 nt, Homo sapiens
ggaaagcuuuuguuggaua

SEQ ID NO: 427816 - RNA, 19 nt, Homo sapiens
ggagcaaucucagaacugu

SEQ ID NO: 427817 - RNA, 19 nt, Homo sapiens
gauggcaaauccaagaaga

SEQ ID NO: 427818 - RNA, 19 nt, Homo sapiens
caccagacuucaaagaauu

SEQ ID NO: 427819 - RNA, 19 nt, Homo sapiens
gaaaagggcucaguagcuu

SEQ ID NO: 427820 - RNA, 19 nt, Homo sapiens
gaaaagaaagugcuugaaa

SEQ ID NO: 427821 - RNA, 19 nt, Homo sapiens
ugagugacuucuuaucuga

SEQ ID NO: 427822 - RNA, 19 nt, Homo sapiens
gauggaacuuuggauugua

SEQ ID NO: 427823 - RNA, 19 nt, Homo sapiens
ucucagaacuguuaugaag

SEQ ID NO: 427824 - RNA, 19 nt, Homo sapiens
gcuuugacuugcaccuuua

SEQ ID NO: 427825 - RNA, 19 nt, Homo sapiens
cagauuggauagaugugua

SEQ ID NO: 427826 - RNA, 19 nt, Homo sapiens
ggaggugaauuuuauguuu

SEQ ID NO: 427827 - RNA, 19 nt, Homo sapiens
caauauagaacuucaagga

SEQ ID NO: 427828 - RNA, 19 nt, Homo sapiens
caaccaauauagaacuuca

SEQ ID NO: 427829 - RNA, 19 nt, Homo sapiens
augaagagcuggaagauuc

SEQ ID NO: 427830 - RNA, 19 nt, Homo sapiens
gagaacuccucuuggaugu

SEQ ID NO: 427831 - RNA, 19 nt, Homo sapiens
gacgaugacuccgauuuga

SEQ ID NO: 427832 - RNA, 19 nt, Homo sapiens
gaauugucaucugggauuu

SEQ ID NO: 427833 - RNA, 19 nt, Homo sapiens
gcaaccacauaguucaaau

SEQ ID NO: 427834 - RNA, 19 nt, Homo sapiens
ucaagcauaaguccaaaua

SEQ ID NO: 427835 - RNA, 19 nt, Homo sapiens
agaagugaauuauggaaga

SEQ ID NO: 427836 - RNA, 19 nt, Homo sapiens
cagccuaggugacagaaug

SEQ ID NO: 427837 - RNA, 19 nt, Homo sapiens
caaagaucaaggugaauuu

SEQ ID NO: 427838 - RNA, 19 nt, Homo sapiens
ggacgaugacuccgauuug

SEQ ID NO: 427839 - RNA, 19 nt, Homo sapiens
gacaagaggcauugcuaaa

SEQ ID NO: 427840 - RNA, 19 nt, Homo sapiens
ucucaggaaugaagauuug

SEQ ID NO: 427841 - RNA, 19 nt, Homo sapiens
gaagaagugaauuauggaa

SEQ ID NO: 427842 - RNA, 19 nt, Homo sapiens
ccaguggagugguaucuau

SEQ ID NO: 427843 - RNA, 19 nt, Homo sapiens
aaagaaagugcuugaaaga

SEQ ID NO: 427844 - RNA, 19 nt, Homo sapiens
gugaagacaucagauagga

SEQ ID NO: 427845 - RNA, 19 nt, Homo sapiens
aauagacucucaggaauga

SEQ ID NO: 427846 - RNA, 19 nt, Homo sapiens
uucaaaggcucuauuguau

SEQ ID NO: 427847 - RNA, 19 nt, Homo sapiens
gcacagaaucaaguagaaa

SEQ ID NO: 427848 - RNA, 19 nt, Homo sapiens
caucugggauuucuugaca

SEQ ID NO: 427849 - RNA, 19 nt, Homo sapiens
ccucaucagucauugcauu

SEQ ID NO: 427850 - RNA, 19 nt, Homo sapiens
guggaaaucuauccucauc

SEQ ID NO: 427851 - RNA, 19 nt, Homo sapiens
guaaaaccauccagaauca

SEQ ID NO: 427852 - RNA, 19 nt, Homo sapiens
gcaaagaaucaucaauagu

SEQ ID NO: 427853 - RNA, 19 nt, Homo sapiens
cuacugguauccuaggaaa

SEQ ID NO: 427854 - RNA, 19 nt, Homo sapiens
ggaaugaagauuugugaag

SEQ ID NO: 427855 - RNA, 19 nt, Homo sapiens
gccauuaagucaauugagu

SEQ ID NO: 427856 - RNA, 19 nt, Homo sapiens
gaccagagguuucgauucc

SEQ ID NO: 427857 - RNA, 19 nt, Homo sapiens
ucaaagcagcaaccacaua

SEQ ID NO: 427858 - RNA, 19 nt, Homo sapiens
guagaagacccagaagaaa

SEQ ID NO: 427859 - RNA, 19 nt, Homo sapiens
gaagcugggcuguaacaau

SEQ ID NO: 427860 - RNA, 19 nt, Homo sapiens
gugaaagguugcuuagcuu

SEQ ID NO: 427861 - RNA, 19 nt, Homo sapiens
ccaggugucucucaacaag

SEQ ID NO: 427862 - RNA, 19 nt, Homo sapiens
gcaaauccaagaagaagca

SEQ ID NO: 427863 - RNA, 19 nt, Homo sapiens
agaggaagcugauggaacu

SEQ ID NO: 427864 - RNA, 19 nt, Homo sapiens
ggaagugcuuaaucuggau

SEQ ID NO: 427865 - RNA, 19 nt, Homo sapiens
guacauuugguguuugaaa

SEQ ID NO: 427866 - RNA, 19 nt, Homo sapiens
uaacagauuggauagaugu

SEQ ID NO: 427867 - RNA, 19 nt, Homo sapiens
gaaacaaacccaggugucu

SEQ ID NO: 427868 - RNA, 19 nt, Homo sapiens
ggaugaaccucgaguugcu

SEQ ID NO: 427869 - RNA, 19 nt, Homo sapiens
gcauguuucccuccaauau

SEQ ID NO: 427870 - RNA, 19 nt, Homo sapiens
acagugggauguucuuuca

SEQ ID NO: 427871 - RNA, 19 nt, Homo sapiens
gucuuugagugacuucuua

SEQ ID NO: 427872 - RNA, 19 nt, Homo sapiens
gcaaggauauuaugacuga

SEQ ID NO: 427873 - RNA, 19 nt, Homo sapiens
gcagacagcucauucaaau

SEQ ID NO: 427874 - RNA, 19 nt, Homo sapiens
gagaggagcugcuacagaa

SEQ ID NO: 427875 - RNA, 19 nt, Homo sapiens
gaacagcacuccuggaauc

SEQ ID NO: 427876 - RNA, 19 nt, Homo sapiens
gaucugaaccuccaauuaa

SEQ ID NO: 427877 - RNA, 19 nt, Homo sapiens
ccaaagaugucaaaucaga

SEQ ID NO: 427878 - RNA, 19 nt, Homo sapiens
caagaagccuaaugagaaa

SEQ ID NO: 427879 - RNA, 19 nt, Homo sapiens
gaagaaggacuauuccaaa

SEQ ID NO: 427880 - RNA, 19 nt, Homo sapiens
gaugagaucuccgauauca

SEQ ID NO: 427881 - RNA, 19 nt, Homo sapiens
gaagugaaagauccuaaua

SEQ ID NO: 427882 - RNA, 19 nt, Homo sapiens
ucauagaagucgaaacaua

SEQ ID NO: 427883 - RNA, 19 nt, Homo sapiens
ggaaacagaacgugaauau

SEQ ID NO: 427884 - RNA, 19 nt, Homo sapiens
gaaggacuauuccaaagau

SEQ ID NO: 427885 - RNA, 19 nt, Homo sapiens
cuaaggaauugauggaaua

SEQ ID NO: 427886 - RNA, 19 nt, Homo sapiens
ccaagaagccuaaugagaa

SEQ ID NO: 427887 - RNA, 19 nt, Homo sapiens
gggaagaauucuauagaga

SEQ ID NO: 427888 - RNA, 19 nt, Homo sapiens
gaugaugccacaccuguua

SEQ ID NO: 427889 - RNA, 19 nt, Homo sapiens
cagaaaagcuaacaacuaa

SEQ ID NO: 427890 - RNA, 19 nt, Homo sapiens
gguagcaacuauccagaaa

SEQ ID NO: 427891 - RNA, 19 nt, Homo sapiens
gggacagucuccuaauaaa

SEQ ID NO: 427892 - RNA, 19 nt, Homo sapiens
gcagaagcauaugcaauug

SEQ ID NO: 427893 - RNA, 19 nt, Homo sapiens
caacaaacuuggcuaucug

SEQ ID NO: 427894 - RNA, 19 nt, Homo sapiens
gcaauuaccgcucuuaugg

SEQ ID NO: 427895 - RNA, 19 nt, Homo sapiens
gcuaacaacuaaggaagaa

SEQ ID NO: 427896 - RNA, 19 nt, Homo sapiens
ccacuuaacaucaggaauu

SEQ ID NO: 427897 - RNA, 19 nt, Homo sapiens
gaacauuccaacaaacuug

SEQ ID NO: 427898 - RNA, 19 nt, Homo sapiens
cagaaaagcucacucuaaa

SEQ ID NO: 427899 - RNA, 19 nt, Homo sapiens
aaagaacgcuaccgagaau

SEQ ID NO: 427900 - RNA, 19 nt, Homo sapiens
cuagaugaguuuacaaaug

SEQ ID NO: 427901 - RNA, 19 nt, Homo sapiens
aagggaaccuccucaauug

SEQ ID NO: 427902 - RNA, 19 nt, Homo sapiens
ccuagacccucagcaaaua

SEQ ID NO: 427903 - RNA, 19 nt, Homo sapiens
ggaaucagaugagcacaca

SEQ ID NO: 427904 - RNA, 19 nt, Homo sapiens
gagaaagggauaaaccaaa

SEQ ID NO: 427905 - RNA, 19 nt, Homo sapiens
gaaggauaauacaaaguca

SEQ ID NO: 427906 - RNA, 19 nt, Homo sapiens
gcuaaggaauugauggaau

SEQ ID NO: 427907 - RNA, 19 nt, Homo sapiens
uaugaaaggugcaaugcuu

SEQ ID NO: 427908 - RNA, 19 nt, Homo sapiens
ucaaauaccaucccaacaa

SEQ ID NO: 427909 - RNA, 19 nt, Homo sapiens
cauaucaguucauucagaa

SEQ ID NO: 427910 - RNA, 19 nt, Homo sapiens
ugucucaucugcaaggaua

SEQ ID NO: 427911 - RNA, 19 nt, Homo sapiens
aaaccaaacggaagaauga

SEQ ID NO: 427912 - RNA, 19 nt, Homo sapiens
gacaagagagaaagggaua

SEQ ID NO: 427913 - RNA, 19 nt, Homo sapiens
caagagauggucacaauca

SEQ ID NO: 427914 - RNA, 19 nt, Homo sapiens
uauagagagugguaugaaa

SEQ ID NO: 427915 - RNA, 19 nt, Homo sapiens
aaagggaaccuccucaauu

SEQ ID NO: 427916 - RNA, 19 nt, Homo sapiens
ccagugacaucuucaucaa

SEQ ID NO: 427917 - RNA, 19 nt, Homo sapiens
aaaugaaacuggcuauaca

SEQ ID NO: 427918 - RNA, 19 nt, Homo sapiens
gaugaauuguugugucuca

SEQ ID NO: 427919 - RNA, 19 nt, Homo sapiens
agaagaagaugauccuauc

SEQ ID NO: 427920 - RNA, 19 nt, Homo sapiens
ggaauucucccuucacaag

SEQ ID NO: 427921 - RNA, 19 nt, Homo sapiens
ccauaucaguucauucaga

SEQ ID NO: 427922 - RNA, 19 nt, Homo sapiens
ggaaauaagcauaagaaac

SEQ ID NO: 427923 - RNA, 19 nt, Homo sapiens
gguaaaggaaauaagcaua

SEQ ID NO: 427924 - RNA, 19 nt, Homo sapiens
gucuagaucucauggauau

SEQ ID NO: 427925 - RNA, 19 nt, Homo sapiens
ucacccagcuccgucuaua

SEQ ID NO: 427926 - RNA, 19 nt, Homo sapiens
cugaugagaucuccgauau

SEQ ID NO: 427927 - RNA, 19 nt, Homo sapiens
agugaaagauccuaauaug

SEQ ID NO: 427928 - RNA, 19 nt, Homo sapiens
uuccaaagaugucaaauca

SEQ ID NO: 427929 - RNA, 19 nt, Homo sapiens
gaaguuccaccaccauaug

SEQ ID NO: 427930 - RNA, 19 nt, Homo sapiens
ggaauugauggaauacaaa

SEQ ID NO: 427931 - RNA, 19 nt, Homo sapiens
gaaccuacaaccucugaug

SEQ ID NO: 427932 - RNA, 19 nt, Homo sapiens
uaucccagaugaauuguug

SEQ ID NO: 427933 - RNA, 19 nt, Homo sapiens
ugguaaaccuggacauuau

SEQ ID NO: 427934 - RNA, 19 nt, Homo sapiens
gaaaauauagagaguggua

SEQ ID NO: 427935 - RNA, 19 nt, Homo sapiens
gagaaguuccaccaccaua

SEQ ID NO: 427936 - RNA, 19 nt, Homo sapiens
gaaacagaacgugaauauu

SEQ ID NO: 427937 - RNA, 19 nt, Homo sapiens
caacacaagcaccaccuuu

SEQ ID NO: 427938 - RNA, 19 nt, Homo sapiens
caaauaccaucccaacaac

SEQ ID NO: 427939 - RNA, 19 nt, Homo sapiens
gacugaugcuguugugauu

SEQ ID NO: 427940 - RNA, 19 nt, Homo sapiens
gugguaaaccuggacauua

SEQ ID NO: 427941 - RNA, 19 nt, Homo sapiens
uaucaucgaucuaggucaa

SEQ ID NO: 427942 - RNA, 19 nt, Homo sapiens
gcaauaccaacuauagaug

SEQ ID NO: 427943 - RNA, 19 nt, Homo sapiens
cgaagacugacaauacuaa

SEQ ID NO: 427944 - RNA, 19 nt, Homo sapiens
ccacaccuguuagagauga

SEQ ID NO: 427945 - RNA, 19 nt, Homo sapiens
ggagaugguaaaggaaaua

SEQ ID NO: 427946 - RNA, 19 nt, Homo sapiens
gagauggucacaaucagaa

SEQ ID NO: 427947 - RNA, 19 nt, Homo sapiens
gaggcaagagccgcaauua

SEQ ID NO: 427948 - RNA, 19 nt, Homo sapiens
caagcuagaugaguuuaca

SEQ ID NO: 427949 - RNA, 19 nt, Homo sapiens
ucagaaggauaauacaaag

SEQ ID NO: 427950 - RNA, 19 nt, Homo sapiens
gguaaaccuggacauuaua

SEQ ID NO: 427951 - RNA, 19 nt, Homo sapiens
uauagugguucuucguauu

SEQ ID NO: 427952 - RNA, 19 nt, Homo sapiens
ggagaggagcugcuacaga

SEQ ID NO: 427953 - RNA, 19 nt, Homo sapiens
gguccaguaagaauaaaua

SEQ ID NO: 427954 - RNA, 19 nt, Homo sapiens
gaagacugacaauacuaaa

SEQ ID NO: 427955 - RNA, 19 nt, Homo sapiens
uguuagagaugaaccaaug

SEQ ID NO: 427956 - RNA, 19 nt, Homo sapiens
gaaaaggggaggaaaguga

SEQ ID NO: 427957 - RNA, 19 nt, Homo sapiens
gcaaauagagagaacuuuu

SEQ ID NO: 427958 - RNA, 19 nt, Homo sapiens
gcaauugggaagaaagaga

SEQ ID NO: 427959 - RNA, 19 nt, Homo sapiens
gaaaagcucacucuaaauc

SEQ ID NO: 427960 - RNA, 19 nt, Homo sapiens
gugaaagauccuaauauga

SEQ ID NO: 427961 - RNA, 19 nt, Homo sapiens
gagcugcuacagaaguaua

SEQ ID NO: 427962 - RNA, 19 nt, Homo sapiens
gaucuccgauaucaagaca

SEQ ID NO: 427963 - RNA, 19 nt, Homo sapiens
cauaugcaauugggaagaa

SEQ ID NO: 427964 - RNA, 19 nt, Homo sapiens
gaacccagaguuauuagag

SEQ ID NO: 427965 - RNA, 19 nt, Homo sapiens
caaaagagaaggagaguga

SEQ ID NO: 427966 - RNA, 19 nt, Homo sapiens
ggaaccuccucaauugcaa

SEQ ID NO: 427967 - RNA, 19 nt, Homo sapiens
cagaggagccaucuucuuc

SEQ ID NO: 427968 - RNA, 19 nt, Homo sapiens
caaaccacuugauaauaag

SEQ ID NO: 427969 - RNA, 19 nt, Homo sapiens
gccaagaagccuaaugaga

SEQ ID NO: 427970 - RNA, 19 nt, Homo sapiens
caagagagaaagggauaaa

SEQ ID NO: 427971 - RNA, 19 nt, Homo sapiens
guccaccaccuccaucuua

SEQ ID NO: 427972 - RNA, 19 nt, Homo sapiens
gaaagaacaucaccauuga

SEQ ID NO: 427973 - RNA, 19 nt, Homo sapiens
guaaagagauguuugaaga

SEQ ID NO: 427974 - RNA, 19 nt, Homo sapiens
gaauguugcuuaagaaaga

SEQ ID NO: 427975 - RNA, 19 nt, Homo sapiens
gaagaauguugcuuaagaa

SEQ ID NO: 427976 - RNA, 19 nt, Homo sapiens
gcaaauggcugaaaauauu

SEQ ID NO: 427977 - RNA, 19 nt, Homo sapiens
gaagaagaauacaccguuu

SEQ ID NO: 427978 - RNA, 19 nt, Homo sapiens
gcagaauccucacaucauu

SEQ ID NO: 427979 - RNA, 19 nt, Homo sapiens
cuacaugaaugcuugauuu

SEQ ID NO: 427980 - RNA, 19 nt, Homo sapiens
gaacuccuguuuauucaug

SEQ ID NO: 427981 - RNA, 19 nt, Homo sapiens
ggauaagaccguagcuuua

SEQ ID NO: 427982 - RNA, 19 nt, Homo sapiens
gaguacauauucccaauga

SEQ ID NO: 427983 - RNA, 19 nt, Homo sapiens
gaauacaccguuucuauau

SEQ ID NO: 427984 - RNA, 19 nt, Homo sapiens
agaagaauguugcuuaaga

SEQ ID NO: 427985 - RNA, 19 nt, Homo sapiens
caaaguacgagaaauguuu

SEQ ID NO: 427986 - RNA, 19 nt, Homo sapiens
cugcuaagauuucagauuu

SEQ ID NO: 427987 - RNA, 19 nt, Homo sapiens
ucccaaauaugcaagaaua

SEQ ID NO: 427988 - RNA, 19 nt, Homo sapiens
gauaacaucaugcagauau

SEQ ID NO: 427989 - RNA, 19 nt, Homo sapiens
gauuggcuuugcagaaaua

SEQ ID NO: 427990 - RNA, 19 nt, Homo sapiens
ccacucagcuguuguagag

SEQ ID NO: 427991 - RNA, 19 nt, Homo sapiens
gacgcaagauggcgaguaa

SEQ ID NO: 427992 - RNA, 19 nt, Homo sapiens
ccacuggucuccacauaau

SEQ ID NO: 427993 - RNA, 19 nt, Homo sapiens
gcuauggucucuccuggaa

SEQ ID NO: 427994 - RNA, 19 nt, Homo sapiens
caaugaugaugcacaguuu

SEQ ID NO: 427995 - RNA, 19 nt, Homo sapiens
agagaagaauguugcuuaa

SEQ ID NO: 427996 - RNA, 19 nt, Homo sapiens
ggacacacugcuaagauuu

SEQ ID NO: 427997 - RNA, 19 nt, Homo sapiens
gaaguaaaccgugcucguu

SEQ ID NO: 427998 - RNA, 19 nt, Homo sapiens
gaagaacaaucagcagaag

SEQ ID NO: 427999 - RNA, 19 nt, Homo sapiens
gaagucaacugccucucau

SEQ ID NO: 428000 - RNA, 19 nt, Homo sapiens
ugacuaaaccugaaggaaa

SEQ ID NO: 428001 - RNA, 19 nt, Homo sapiens
agaaagaacaucaccauug

SEQ ID NO: 428002 - RNA, 19 nt, Homo sapiens
ccagaacuccuguuuauuc

SEQ ID NO: 428003 - RNA, 19 nt, Homo sapiens
ggaagaacaaucagcagaa

SEQ ID NO: 428004 - RNA, 19 nt, Homo sapiens
guacauauucccaaugaug

SEQ ID NO: 428005 - RNA, 19 nt, Homo sapiens
ggaggagcgugucaucaau

SEQ ID NO: 428006 - RNA, 19 nt, Homo sapiens
caugaaugcuugauuuauc

SEQ ID NO: 428007 - RNA, 19 nt, Homo sapiens
ggacaucuccuaagugcau

SEQ ID NO: 428008 - RNA, 19 nt, Homo sapiens
auacaccguuucuauauga

SEQ ID NO: 428009 - RNA, 19 nt, Homo sapiens
ggagggacaaggaucuuaa

SEQ ID NO: 428010 - RNA, 19 nt, Homo sapiens
ugacaagggugaauuuggu

SEQ ID NO: 428011 - RNA, 19 nt, Homo sapiens
aagagaagaauguugcuua

SEQ ID NO: 428012 - RNA, 19 nt, Homo sapiens
uuacaaugaugaagaguca

SEQ ID NO: 428013 - RNA, 19 nt, Homo sapiens
cuccagaacuccuguuuau

SEQ ID NO: 428014 - RNA, 19 nt, Homo sapiens
gcaaaauuguggaugcuaa

SEQ ID NO: 428015 - RNA, 19 nt, Homo sapiens
uauggucucuccuggaauu

SEQ ID NO: 428016 - RNA, 19 nt, Homo sapiens
ugaagugacuaaaccugaa

SEQ ID NO: 428017 - RNA, 19 nt, Homo sapiens
gaugaagagucagauguca

SEQ ID NO: 428018 - RNA, 19 nt, Homo sapiens
gaguggacaucuccuaagu

SEQ ID NO: 428019 - RNA, 19 nt, Homo sapiens
aaaccgugcucguuacaug

SEQ ID NO: 428020 - RNA, 19 nt, Homo sapiens
guagcaggguauugccuuu

SEQ ID NO: 428021 - RNA, 19 nt, Homo sapiens
gagagaagagcgccucaga

SEQ ID NO: 428022 - RNA, 19 nt, Homo sapiens
gaucuuaaacccaaaguac

SEQ ID NO: 428023 - RNA, 19 nt, Homo sapiens
cguacuguaucauauugua

SEQ ID NO: 428024 - RNA, 19 nt, Homo sapiens
gcuuauggcuucuuuaucc

SEQ ID NO: 428025 - RNA, 19 nt, Homo sapiens
cagaacuccuguuuauuca

SEQ ID NO: 428026 - RNA, 19 nt, Homo sapiens
gaagaugggccuccagaac

SEQ ID NO: 428027 - RNA, 19 nt, Homo sapiens
aaacuauucuggcuucaag

SEQ ID NO: 428028 - RNA, 19 nt, Homo sapiens
ucaacugccucucauucaa

SEQ ID NO: 428029 - RNA, 19 nt, Homo sapiens
gaugaucagaaacuuauga

SEQ ID NO: 428030 - RNA, 19 nt, Homo sapiens
cggauaagaccguagcuuu

SEQ ID NO: 428031 - RNA, 19 nt, Homo sapiens
uaaaaucaaucacgaagga

SEQ ID NO: 428032 - RNA, 19 nt, Homo sapiens
gacuaaaccugaaggaaaa

SEQ ID NO: 428033 - RNA, 19 nt, Homo sapiens
caucuuuacuggccacuca

SEQ ID NO: 428034 - RNA, 19 nt, Homo sapiens
ccacauaaugaaacuauuc

SEQ ID NO: 428035 - RNA, 19 nt, Homo sapiens
gggugaauuugguggcuuu

SEQ ID NO: 428036 - RNA, 19 nt, Homo sapiens
cgaguaaagagauguuuga

SEQ ID NO: 428037 - RNA, 19 nt, Homo sapiens
uuccaacacuucuugauug

SEQ ID NO: 428038 - RNA, 19 nt, Homo sapiens
gcaagauggcgaguaaaga

SEQ ID NO: 428039 - RNA, 19 nt, Homo sapiens
uauaugaccugguuaugac

SEQ ID NO: 428040 - RNA, 19 nt, Homo sapiens
guccacuggucuccacaua

SEQ ID NO: 428041 - RNA, 19 nt, Homo sapiens
uaagaggucaccagaagga

SEQ ID NO: 428042 - RNA, 19 nt, Homo sapiens
ccaaugaugaugcacaguu

SEQ ID NO: 428043 - RNA, 19 nt, Homo sapiens
uaagaaagaacaucaccau

SEQ ID NO: 428044 - RNA, 19 nt, Homo sapiens
gcuguugcguacuguauca

SEQ ID NO: 428045 - RNA, 19 nt, Homo sapiens
ggcauuguauaguaggaaa

SEQ ID NO: 428046 - RNA, 19 nt, Homo sapiens
cugaaugugugggauuuaa

SEQ ID NO: 428047 - RNA, 19 nt, Homo sapiens
aaagucucguuccaaguuu

SEQ ID NO: 428048 - RNA, 19 nt, Homo sapiens
uaugggaucugcguaacuu

SEQ ID NO: 428049 - RNA, 19 nt, Homo sapiens
cgaacgacccgacgcaaga

SEQ ID NO: 428050 - RNA, 19 nt, Homo sapiens
uugauuggcuuugcagaaa

SEQ ID NO: 428051 - RNA, 19 nt, Homo sapiens
ggaggaggcaggaaagaag

SEQ ID NO: 428052 - RNA, 19 nt, Homo sapiens
gaacuggagggacaaggau

SEQ ID NO: 428053 - RNA, 19 nt, Homo sapiens
ggugguugcucgaguacau

SEQ ID NO: 428054 - RNA, 19 nt, Homo sapiens
gaggacacacugcuaagau

SEQ ID NO: 428055 - RNA, 19 nt, Homo sapiens
gauauaaacgcaggaccaa

SEQ ID NO: 428056 - RNA, 19 nt, Homo sapiens
aaguaaaccgugcucguua

SEQ ID NO: 428057 - RNA, 19 nt, Homo sapiens
cagcagaagaugcagaaga

SEQ ID NO: 428058 - RNA, 19 nt, Homo sapiens
gaacaaucagcagaagaug

SEQ ID NO: 428059 - RNA, 19 nt, Homo sapiens
caagauggcgaguaaagag

SEQ ID NO: 428060 - RNA, 19 nt, Homo sapiens
caaucacgaaggagaagua

SEQ ID NO: 428061 - RNA, 19 nt, Homo sapiens
gaauuugguggcuuugguu

SEQ ID NO: 428062 - RNA, 19 nt, Homo sapiens
aagauuaugcccuucauug

SEQ ID NO: 428063 - RNA, 19 nt, Homo sapiens
gaagagaagaauguugcuu

SEQ ID NO: 428064 - RNA, 19 nt, Homo sapiens
gguggcuuauggcuucuuu

SEQ ID NO: 428065 - RNA, 19 nt, Homo sapiens
ucuguugaauguaaugcua

SEQ ID NO: 428066 - RNA, 19 nt, Homo sapiens
ggaggacacacugcuaaga

SEQ ID NO: 428067 - RNA, 19 nt, Homo sapiens
gaaugugugggauuuaagu

SEQ ID NO: 428068 - RNA, 19 nt, Homo sapiens
gaaacuauucuggcuucaa

SEQ ID NO: 428069 - RNA, 19 nt, Homo sapiens
guuugucugugggauauaa

SEQ ID NO: 428070 - RNA, 19 nt, Homo sapiens
agacccaaguggagaaugu

SEQ ID NO: 428071 - RNA, 19 nt, Homo sapiens
gagggacaaggaucuuaaa

SEQ ID NO: 428072 - RNA, 19 nt, Homo sapiens
gagcagaccuuucucagua

SEQ ID NO: 428073 - RNA, 19 nt, Homo sapiens
ggaaagagguuauauuaag

SEQ ID NO: 428074 - RNA, 19 nt, Homo sapiens
ggaaggaaaucacaagaaa

SEQ ID NO: 428075 - RNA, 19 nt, Homo sapiens
gcaaggagcagaagacaua

SEQ ID NO: 428076 - RNA, 19 nt, Homo sapiens
gauaacagccuucucauuu

SEQ ID NO: 428077 - RNA, 19 nt, Homo sapiens
ggaagaaagugaacaugaa

SEQ ID NO: 428078 - RNA, 19 nt, Homo sapiens
gaagugaacaagaucauua

SEQ ID NO: 428079 - RNA, 19 nt, Homo sapiens
gaagggaccuggcuggaaa

SEQ ID NO: 428080 - RNA, 19 nt, Homo sapiens
caaccaagauguauccuuu

SEQ ID NO: 428081 - RNA, 19 nt, Homo sapiens
caaagaaacuacacacuca

SEQ ID NO: 428082 - RNA, 19 nt, Homo sapiens
caagauguauccuuugaaa

SEQ ID NO: 428083 - RNA, 19 nt, Homo sapiens
ggagcuaccucuaguauca

SEQ ID NO: 428084 - RNA, 19 nt, Homo sapiens
ggacaacacaugaagagua

SEQ ID NO: 428085 - RNA, 19 nt, Homo sapiens
ggacauggacuguacauug

SEQ ID NO: 428086 - RNA, 19 nt, Homo sapiens
ggaauacucuacaggaaga

SEQ ID NO: 428087 - RNA, 19 nt, Homo sapiens
aaugauagcuuggaagaua

SEQ ID NO: 428088 - RNA, 19 nt, Homo sapiens
gagguuauauuaaggaaga

SEQ ID NO: 428089 - RNA, 19 nt, Homo sapiens
uaaaugcucuccagacaau

SEQ ID NO: 428090 - RNA, 19 nt, Homo sapiens
gagacuagcuugcaaaauu

SEQ ID NO: 428091 - RNA, 19 nt, Homo sapiens
gaagaaaacugaggaagaa

SEQ ID NO: 428092 - RNA, 19 nt, Homo sapiens
cagcagaaucuuaaacuua

SEQ ID NO: 428093 - RNA, 19 nt, Homo sapiens
ggacaaaacuaaaagaaug

SEQ ID NO: 428094 - RNA, 19 nt, Homo sapiens
gaaagagguuauauuaagg

SEQ ID NO: 428095 - RNA, 19 nt, Homo sapiens
gacaacacaugaagaguau

SEQ ID NO: 428096 - RNA, 19 nt, Homo sapiens
ggaccuggcuggaaagcuu

SEQ ID NO: 428097 - RNA, 19 nt, Homo sapiens
caucaguucuucaguuaaa

SEQ ID NO: 428098 - RNA, 19 nt, Homo sapiens
gcaagugacucuuuaugag

SEQ ID NO: 428099 - RNA, 19 nt, Homo sapiens
gagacugugugauggauaa

SEQ ID NO: 428100 - RNA, 19 nt, Homo sapiens
guaaagauucuaacacuga

SEQ ID NO: 428101 - RNA, 19 nt, Homo sapiens
gcacaaagacuagaagaau

SEQ ID NO: 428102 - RNA, 19 nt, Homo sapiens
caauaaggcgcuuucauuu

SEQ ID NO: 428103 - RNA, 19 nt, Homo sapiens
caacucauccacaacauaa

SEQ ID NO: 428104 - RNA, 19 nt, Homo sapiens
guagaaguguggagcauau

SEQ ID NO: 428105 - RNA, 19 nt, Homo sapiens
gcagaccuuucucaguaua

SEQ ID NO: 428106 - RNA, 19 nt, Homo sapiens
gcagaaaguccuucaugaa

SEQ ID NO: 428107 - RNA, 19 nt, Homo sapiens
caaagucaaucuccaaugg

SEQ ID NO: 428108 - RNA, 19 nt, Homo sapiens
ucuaguagcugacacuuau

SEQ ID NO: 428109 - RNA, 19 nt, Homo sapiens
gugaaaccguucucuuaaa

SEQ ID NO: 428110 - RNA, 19 nt, Homo sapiens
ggucugaagugaacaagau

SEQ ID NO: 428111 - RNA, 19 nt, Homo sapiens
aaaugugccucucgccuua

SEQ ID NO: 428112 - RNA, 19 nt, Homo sapiens
gaauggagacugugugaug

SEQ ID NO: 428113 - RNA, 19 nt, Homo sapiens
uagcaacacuuguauaucu

SEQ ID NO: 428114 - RNA, 19 nt, Homo sapiens
caagaaauacugaagauag

SEQ ID NO: 428115 - RNA, 19 nt, Homo sapiens
cagaaaaggucagaaaaua

SEQ ID NO: 428116 - RNA, 19 nt, Homo sapiens
gaucuucuguaaauggauu

SEQ ID NO: 428117 - RNA, 19 nt, Homo sapiens
agaagaaucugaaacucaa

SEQ ID NO: 428118 - RNA, 19 nt, Homo sapiens
cacaaagacuagaagaauu

SEQ ID NO: 428119 - RNA, 19 nt, Homo sapiens
aguacaagguuuacaagua

SEQ ID NO: 428120 - RNA, 19 nt, Homo sapiens
cuugauaccucuauaaugu

SEQ ID NO: 428121 - RNA, 19 nt, Homo sapiens
guccaaagacgacuugaua

SEQ ID NO: 428122 - RNA, 19 nt, Homo sapiens
gaaagugaacaugaaguaa

SEQ ID NO: 428123 - RNA, 19 nt, Homo sapiens
cagaaaguccuucaugaaa

SEQ ID NO: 428124 - RNA, 19 nt, Homo sapiens
gaaguguggagcauauuaa

SEQ ID NO: 428125 - RNA, 19 nt, Homo sapiens
cagaagacauagacguuga

SEQ ID NO: 428126 - RNA, 19 nt, Homo sapiens
gcagcagaaucuuaaacuu

SEQ ID NO: 428127 - RNA, 19 nt, Homo sapiens
gaaaugucccgugcaguuu

SEQ ID NO: 428128 - RNA, 19 nt, Homo sapiens
gcacguugcccaaagauuc

SEQ ID NO: 428129 - RNA, 19 nt, Homo sapiens
caaagacuccuccucaaga

SEQ ID NO: 428130 - RNA, 19 nt, Homo sapiens
ugaggaaucuacaagaaau

SEQ ID NO: 428131 - RNA, 19 nt, Homo sapiens
gaaggaugaaggacaguuu

SEQ ID NO: 428132 - RNA, 19 nt, Homo sapiens
gauaaucaguuuuccauga

SEQ ID NO: 428133 - RNA, 19 nt, Homo sapiens
caagaagaauuaccuacuc

SEQ ID NO: 428134 - RNA, 19 nt, Homo sapiens
acaauaaggcgcuuucauu

SEQ ID NO: 428135 - RNA, 19 nt, Homo sapiens
agacauagacguugaaaca

SEQ ID NO: 428136 - RNA, 19 nt, Homo sapiens
gaggaggaauugucuacug

SEQ ID NO: 428137 - RNA, 19 nt, Homo sapiens
caacacaugaagaguauga

SEQ ID NO: 428138 - RNA, 19 nt, Homo sapiens
ucaguuaaauccauguaga

SEQ ID NO: 428139 - RNA, 19 nt, Homo sapiens
ggauaaaccucuggaucug

SEQ ID NO: 428140 - RNA, 19 nt, Homo sapiens
gaaacagccuuuugaggaa

SEQ ID NO: 428141 - RNA, 19 nt, Homo sapiens
cauagacguugaaacagaa

SEQ ID NO: 428142 - RNA, 19 nt, Homo sapiens
uagugaaaccguucucuua

SEQ ID NO: 428143 - RNA, 19 nt, Homo sapiens
uuaggcaagugacucuuua

SEQ ID NO: 428144 - RNA, 19 nt, Homo sapiens
gaacagaauaggacugagu

SEQ ID NO: 428145 - RNA, 19 nt, Homo sapiens
agugucaucuccuguauuu

SEQ ID NO: 428146 - RNA, 19 nt, Homo sapiens
guagugauaccuaauacaa

SEQ ID NO: 428147 - RNA, 19 nt, Homo sapiens
gacauggacuguacauugg

SEQ ID NO: 428148 - RNA, 19 nt, Homo sapiens
gagagacaguggacaugga

SEQ ID NO: 428149 - RNA, 19 nt, Homo sapiens
gugaaaguuuggagacuga

SEQ ID NO: 428150 - RNA, 19 nt, Homo sapiens
ugcaucaguucuucaguua

SEQ ID NO: 428151 - RNA, 19 nt, Homo sapiens
ugugaucgcugugcaguaa

SEQ ID NO: 428152 - RNA, 19 nt, Homo sapiens
acauagacguugaaacaga

SEQ ID NO: 428153 - RNA, 19 nt, Homo sapiens
ccaacacaccagagaauuu

SEQ ID NO: 428154 - RNA, 19 nt, Homo sapiens
caagaucauuauccaguca

SEQ ID NO: 428155 - RNA, 19 nt, Homo sapiens
aaagacuccuccucaagaa

SEQ ID NO: 428156 - RNA, 19 nt, Homo sapiens
gaaacucaaggucccauga

SEQ ID NO: 428157 - RNA, 19 nt, Homo sapiens
ccugauaagucaucuuuua

SEQ ID NO: 428158 - RNA, 19 nt, Homo sapiens
ugaaaugucccgugcaguu

SEQ ID NO: 428159 - RNA, 19 nt, Homo sapiens
gaacaacuccagcagaaaa

SEQ ID NO: 428160 - RNA, 19 nt, Homo sapiens
gcacacguguaaggaaugu

SEQ ID NO: 428161 - RNA, 19 nt, Homo sapiens
gggcacacguguaaggaau

SEQ ID NO: 428162 - RNA, 19 nt, Homo sapiens
uuaaauccauguagaacug

SEQ ID NO: 428163 - RNA, 19 nt, Homo sapiens
gacaauaaaccaucauuac

SEQ ID NO: 428164 - RNA, 19 nt, Homo sapiens
gaagaaagugaacaugaag

SEQ ID NO: 428165 - RNA, 19 nt, Homo sapiens
auagagaaguacaagguuu

SEQ ID NO: 428166 - RNA, 19 nt, Homo sapiens
aauaaaugcucuccagaca

SEQ ID NO: 428167 - RNA, 19 nt, Homo sapiens
cugaacaacuccagcagaa

SEQ ID NO: 428168 - RNA, 19 nt, Homo sapiens
gaacuuaugaaugaaagga

SEQ ID NO: 428169 - RNA, 19 nt, Homo sapiens
gaaaguccuucaugaaacc

SEQ ID NO: 428170 - RNA, 19 nt, Homo sapiens
uagagaaguacaagguuua

SEQ ID NO: 428171 - RNA, 19 nt, Homo sapiens
gaaacagaaggaugaagga

SEQ ID NO: 428172 - RNA, 19 nt, Homo sapiens
gaagagauaugcaaccauu

SEQ ID NO: 428173 - RNA, 19 nt, Homo sapiens
gcgauuaugugcccaaaua

SEQ ID NO: 428174 - RNA, 19 nt, Homo sapiens
caagagaaguuguggcaua

SEQ ID NO: 428175 - RNA, 19 nt, Homo sapiens
cagcagcacuccauuuaua

SEQ ID NO: 428176 - RNA, 19 nt, Homo sapiens
acagaaaggucuaucauuu

SEQ ID NO: 428177 - RNA, 19 nt, Homo sapiens
gagaaguuguggcauauaa

SEQ ID NO: 428178 - RNA, 19 nt, Homo sapiens
gcaaagcagugaauaagga

SEQ ID NO: 428179 - RNA, 19 nt, Homo sapiens
aaagagaacuggguccuua

SEQ ID NO: 428180 - RNA, 19 nt, Homo sapiens
gagcaaaucauuaauguug

SEQ ID NO: 428181 - RNA, 19 nt, Homo sapiens
ggacauaaaguuacaauuc

SEQ ID NO: 428182 - RNA, 19 nt, Homo sapiens
gaaguuguggcauauaaua

SEQ ID NO: 428183 - RNA, 19 nt, Homo sapiens
gaagucauuugcacugaaa

SEQ ID NO: 428184 - RNA, 19 nt, Homo sapiens
ggaauaaacaggccaaaga

SEQ ID NO: 428185 - RNA, 19 nt, Homo sapiens
caaaggaaaugcuuaugga

SEQ ID NO: 428186 - RNA, 19 nt, Homo sapiens
gaaaaucgcuccuucuuca

SEQ ID NO: 428187 - RNA, 19 nt, Homo sapiens
ugaagaaccaccaaaguua

SEQ ID NO: 428188 - RNA, 19 nt, Homo sapiens
gccuauagcucaccucgua

SEQ ID NO: 428189 - RNA, 19 nt, Homo sapiens
ugaggugucuacuguaaua

SEQ ID NO: 428190 - RNA, 19 nt, Homo sapiens
gacuaaagcuggcagaaau

SEQ ID NO: 428191 - RNA, 19 nt, Homo sapiens
uagaaaggcuagagagaaa

SEQ ID NO: 428192 - RNA, 19 nt, Homo sapiens
gaagcgcucugcuguacaa

SEQ ID NO: 428193 - RNA, 19 nt, Homo sapiens
gccaaugucuccucuaaug

SEQ ID NO: 428194 - RNA, 19 nt, Homo sapiens
ucacauagacuuugcugua

SEQ ID NO: 428195 - RNA, 19 nt, Homo sapiens
gauagauugugacuuagaa

SEQ ID NO: 428196 - RNA, 19 nt, Homo sapiens
gaauaaaggagcacuacuu

SEQ ID NO: 428197 - RNA, 19 nt, Homo sapiens
ucaaaugaguuacgaagga

SEQ ID NO: 428198 - RNA, 19 nt, Homo sapiens
caagggacauggugaaaca

SEQ ID NO: 428199 - RNA, 19 nt, Homo sapiens
gaaauuggaacaccucgaa

SEQ ID NO: 428200 - RNA, 19 nt, Homo sapiens
gaggauaaauaaucugcuu

SEQ ID NO: 428201 - RNA, 19 nt, Homo sapiens
gagccacccugcaucauug

SEQ ID NO: 428202 - RNA, 19 nt, Homo sapiens
ugacagagauguauuuuga

SEQ ID NO: 428203 - RNA, 19 nt, Homo sapiens
aaacgcgucugucaagaaa

SEQ ID NO: 428204 - RNA, 19 nt, Homo sapiens
caucauugcuguacugugu

SEQ ID NO: 428205 - RNA, 19 nt, Homo sapiens
uaauagccaucgauaguga

SEQ ID NO: 428206 - RNA, 19 nt, Homo sapiens
ggacaugucaguucuuuua

SEQ ID NO: 428207 - RNA, 19 nt, Homo sapiens
aggcuaauguggaguauaa

SEQ ID NO: 428208 - RNA, 19 nt, Homo sapiens
uaaggaguaugaagaguau

SEQ ID NO: 428209 - RNA, 19 nt, Homo sapiens
gauaauagcaaagcaguga

SEQ ID NO: 428210 - RNA, 19 nt, Homo sapiens
gaucauaacagaaggaaca

SEQ ID NO: 428211 - RNA, 19 nt, Homo sapiens
gaaaggcuagagagaaauu

SEQ ID NO: 428212 - RNA, 19 nt, Homo sapiens
ggauggacaugucaaaucu

SEQ ID NO: 428213 - RNA, 19 nt, Homo sapiens
ggagaaaccccauaacuuu

SEQ ID NO: 428214 - RNA, 19 nt, Homo sapiens
caagaguccuguaucacuu

SEQ ID NO: 428215 - RNA, 19 nt, Homo sapiens
ucacuguccugaucuaaug

SEQ ID NO: 428216 - RNA, 19 nt, Homo sapiens
caaaugaguuacgaaggaa

SEQ ID NO: 428217 - RNA, 19 nt, Homo sapiens
gacuaaagcacaagaggua

SEQ ID NO: 428218 - RNA, 19 nt, Homo sapiens
gcauguucauuauauguug

SEQ ID NO: 428219 - RNA, 19 nt, Homo sapiens
ccaccaaaguuaccacgaa

SEQ ID NO: 428220 - RNA, 19 nt, Homo sapiens
ugucaaaucuaccacaaga

SEQ ID NO: 428221 - RNA, 19 nt, Homo sapiens
guccugaucuaaugaaaga

SEQ ID NO: 428222 - RNA, 19 nt, Homo sapiens
gucaaacucuucuaacaau

SEQ ID NO: 428223 - RNA, 19 nt, Homo sapiens
gaauggacaugucaguucu

SEQ ID NO: 428224 - RNA, 19 nt, Homo sapiens
ggagagacuuucugucaac

SEQ ID NO: 428225 - RNA, 19 nt, Homo sapiens
gugaaagagcaaaucauua

SEQ ID NO: 428226 - RNA, 19 nt, Homo sapiens
gcgcucugcuguacaaguu

SEQ ID NO: 428227 - RNA, 19 nt, Homo sapiens
aagaaugggucaggccuua

SEQ ID NO: 428228 - RNA, 19 nt, Homo sapiens
ggaauggacaugucaguuc

SEQ ID NO: 428229 - RNA, 19 nt, Homo sapiens
ggauuggaaaggaauauuu

SEQ ID NO: 428230 - RNA, 19 nt, Homo sapiens
gcuaauagucacguauaua

SEQ ID NO: 428231 - RNA, 19 nt, Homo sapiens
cacauagacuuugcuguaa

SEQ ID NO: 428232 - RNA, 19 nt, Homo sapiens
gaagagccacccugcauca

SEQ ID NO: 428233 - RNA, 19 nt, Homo sapiens
gaacaacaggacauaaagu

SEQ ID NO: 428234 - RNA, 19 nt, Homo sapiens
guuggcauguucauuauau

SEQ ID NO: 428235 - RNA, 19 nt, Homo sapiens
uaggaagagugaagucauu

SEQ ID NO: 428236 - RNA, 19 nt, Homo sapiens
ucacguauauagaaguguu

SEQ ID NO: 428237 - RNA, 19 nt, Homo sapiens
gaucagcuccuccuuugug

SEQ ID NO: 428238 - RNA, 19 nt, Homo sapiens
uauuguggcuggucugaaa

SEQ ID NO: 428239 - RNA, 19 nt, Homo sapiens
uacaggauguugucaguga

SEQ ID NO: 428240 - RNA, 19 nt, Homo sapiens
caaaguuccuaccugugaa

SEQ ID NO: 428241 - RNA, 19 nt, Homo sapiens
gaacagauuuuggagaguu

SEQ ID NO: 428242 - RNA, 19 nt, Homo sapiens
cuugauggcuuguuguuug

SEQ ID NO: 428243 - RNA, 19 nt, Homo sapiens
ugaauaaggaguaugaaga

SEQ ID NO: 428244 - RNA, 19 nt, Homo sapiens
ggaaggcaacuguguuuca

SEQ ID NO: 428245 - RNA, 19 nt, Homo sapiens
agaauuucgugaacguaua

SEQ ID NO: 428246 - RNA, 19 nt, Homo sapiens
ccacaagaauuucgugaac

SEQ ID NO: 428247 - RNA, 19 nt, Homo sapiens
ggucaaacucuucuaacaa

SEQ ID NO: 428248 - RNA, 19 nt, Homo sapiens
gcuccuucuucaagcauua

SEQ ID NO: 428249 - RNA, 19 nt, Homo sapiens
gaacagccaggaucucaca

SEQ ID NO: 428250 - RNA, 19 nt, Homo sapiens
gugagccgguuacagagua

SEQ ID NO: 428251 - RNA, 19 nt, Homo sapiens
aagaguauguucuaacugu

SEQ ID NO: 428252 - RNA, 19 nt, Homo sapiens
agaaauggauggacauguc

SEQ ID NO: 428253 - RNA, 19 nt, Homo sapiens
ugaaacgacuacaggaugu

SEQ ID NO: 428254 - RNA, 19 nt, Homo sapiens
gaaauacgacuuggcgaau

SEQ ID NO: 428255 - RNA, 19 nt, Homo sapiens
uggaucagcuccuccuuug

SEQ ID NO: 428256 - RNA, 19 nt, Homo sapiens
agaaaggucuaucauuugg

SEQ ID NO: 428257 - RNA, 19 nt, Homo sapiens
gagguacauucaacuggaa

SEQ ID NO: 428258 - RNA, 19 nt, Homo sapiens
gcacaagagguacauucaa

SEQ ID NO: 428259 - RNA, 19 nt, Homo sapiens
gacaagaucauaacagaag

SEQ ID NO: 428260 - RNA, 19 nt, Homo sapiens
ggacaagaucauaacagaa

SEQ ID NO: 428261 - RNA, 19 nt, Homo sapiens
uaaacagcauugaagaaca

SEQ ID NO: 428262 - RNA, 19 nt, Homo sapiens
ggaaucagccccaagcuaa

SEQ ID NO: 428263 - RNA, 19 nt, Homo sapiens
gcaacuguguuucacuuac

SEQ ID NO: 428264 - RNA, 19 nt, Homo sapiens
ggauguuucaaaugaguua

SEQ ID NO: 428265 - RNA, 19 nt, Homo sapiens
cagaaaggucuaucauuug

SEQ ID NO: 428266 - RNA, 19 nt, Homo sapiens
uggacaagaucauaacaga

SEQ ID NO: 428267 - RNA, 19 nt, Homo sapiens
ugaaacaccuaaacagcau

SEQ ID NO: 428268 - RNA, 19 nt, Homo sapiens
gaccggacggagauauuua

SEQ ID NO: 428269 - RNA, 19 nt, Homo sapiens
gaauaaggaguaugaagag

SEQ ID NO: 428270 - RNA, 19 nt, Homo sapiens
gcacuacuuuaagccauau

SEQ ID NO: 428271 - RNA, 19 nt, Homo sapiens
aaauaaaugucuccuucug

SEQ ID NO: 428272 - RNA, 19 nt, Homo sapiens
caacagaacuaaacaaaga

SEQ ID NO: 428273 - RNA, 19 nt, Homo sapiens
gagcagagcuuaaucgaau

SEQ ID NO: 428274 - RNA, 19 nt, Homo sapiens
gagaauagcccuuguguga

SEQ ID NO: 428275 - RNA, 19 nt, Homo sapiens
ggaaagggcagaugaaauu

SEQ ID NO: 428276 - RNA, 19 nt, Homo sapiens
ggacuuaguuuauggaaau

SEQ ID NO: 428277 - RNA, 19 nt, Homo sapiens
gaauuuagaugagcggaua

SEQ ID NO: 428278 - RNA, 19 nt, Homo sapiens
uaauccagcugaugaguua

SEQ ID NO: 428279 - RNA, 19 nt, Homo sapiens
gaacagagacugcugaaag

SEQ ID NO: 428280 - RNA, 19 nt, Homo sapiens
gcaagucccuggucaagug

SEQ ID NO: 428281 - RNA, 19 nt, Homo sapiens
gaagaacuguguuucaagu

SEQ ID NO: 428282 - RNA, 19 nt, Homo sapiens
caacaguccuucaaagaga

SEQ ID NO: 428283 - RNA, 19 nt, Homo sapiens
gaaggcggcuauuuguuga

SEQ ID NO: 428284 - RNA, 19 nt, Homo sapiens
aaacagaguuccuacaugu

SEQ ID NO: 428285 - RNA, 19 nt, Homo sapiens
cggagaugcuuuacuauaa

SEQ ID NO: 428286 - RNA, 19 nt, Homo sapiens
uaacuagaauccugaaaug

SEQ ID NO: 428287 - RNA, 19 nt, Homo sapiens
cuuaugaccucuuccuuua

SEQ ID NO: 428288 - RNA, 19 nt, Homo sapiens
ggcuaaacauccaauauuu

SEQ ID NO: 428289 - RNA, 19 nt, Homo sapiens
guaaccagcaguaguaaua

SEQ ID NO: 428290 - RNA, 19 nt, Homo sapiens
ucaaagagacugagagaaa

SEQ ID NO: 428291 - RNA, 19 nt, Homo sapiens
gaagauggccuuuguagag

SEQ ID NO: 428292 - RNA, 19 nt, Homo sapiens
cgaauacaguugucucaaa

SEQ ID NO: 428293 - RNA, 19 nt, Homo sapiens
gaaggaaacuauguaucuu

SEQ ID NO: 428294 - RNA, 19 nt, Homo sapiens
gagugaaccuguauaagug

SEQ ID NO: 428295 - RNA, 19 nt, Homo sapiens
ggacuuggaaggagcauaa

SEQ ID NO: 428296 - RNA, 19 nt, Homo sapiens
ggauuuaucugguauucug

SEQ ID NO: 428297 - RNA, 19 nt, Homo sapiens
gggaagacauggcaaaucu

SEQ ID NO: 428298 - RNA, 19 nt, Homo sapiens
gcuaacagacugaaagaaa

SEQ ID NO: 428299 - RNA, 19 nt, Homo sapiens
gaaacuguguuccuuacau

SEQ ID NO: 428300 - RNA, 19 nt, Homo sapiens
caaagagacugagagaaau

SEQ ID NO: 428301 - RNA, 19 nt, Homo sapiens
gauaaguccuuccagaaca

SEQ ID NO: 428302 - RNA, 19 nt, Homo sapiens
ccaaccacauuauacgaua

SEQ ID NO: 428303 - RNA, 19 nt, Homo sapiens
gcugugugcuuuggacuua

SEQ ID NO: 428304 - RNA, 19 nt, Homo sapiens
gaaaaguccuugauuguuc

SEQ ID NO: 428305 - RNA, 19 nt, Homo sapiens
ggaaggaaacuauguaucu

SEQ ID NO: 428306 - RNA, 19 nt, Homo sapiens
gaauagcccuugugugacu

SEQ ID NO: 428307 - RNA, 19 nt, Homo sapiens
cagaagaacuguguuucaa

SEQ ID NO: 428308 - RNA, 19 nt, Homo sapiens
caacaacaucuacaucaaa

SEQ ID NO: 428309 - RNA, 19 nt, Homo sapiens
gcagaagccaucagaauuc

SEQ ID NO: 428310 - RNA, 19 nt, Homo sapiens
gacgaggauuucaguaauu

SEQ ID NO: 428311 - RNA, 19 nt, Homo sapiens
uaaaggaacauuucuggaa

SEQ ID NO: 428312 - RNA, 19 nt, Homo sapiens
gaaaaucuguuccaacugu

SEQ ID NO: 428313 - RNA, 19 nt, Homo sapiens
gaaauacugcaagaaauga

SEQ ID NO: 428314 - RNA, 19 nt, Homo sapiens
ggugagaaaugggacuuaa

SEQ ID NO: 428315 - RNA, 19 nt, Homo sapiens
uaacaucuccaaccacauu

SEQ ID NO: 428316 - RNA, 19 nt, Homo sapiens
ggugauagaaguauucauu

SEQ ID NO: 428317 - RNA, 19 nt, Homo sapiens
gacauggauuuaucuggua

SEQ ID NO: 428318 - RNA, 19 nt, Homo sapiens
gaacuugugaacccuaauu

SEQ ID NO: 428319 - RNA, 19 nt, Homo sapiens
gcuacacgcuggagggaaa

SEQ ID NO: 428320 - RNA, 19 nt, Homo sapiens
gauagcacuuucuacaaug

SEQ ID NO: 428321 - RNA, 19 nt, Homo sapiens
ugucaaggcugcuuacaau

SEQ ID NO: 428322 - RNA, 19 nt, Homo sapiens
agguuagucucuuguauua

SEQ ID NO: 428323 - RNA, 19 nt, Homo sapiens
uauuugaugugccucuuua

SEQ ID NO: 428324 - RNA, 19 nt, Homo sapiens
caagaugcauuccacagau

SEQ ID NO: 428325 - RNA, 19 nt, Homo sapiens
gcggagaugcuuuacuaua

SEQ ID NO: 428326 - RNA, 19 nt, Homo sapiens
guuagcaugugccuuauau

SEQ ID NO: 428327 - RNA, 19 nt, Homo sapiens
gcagaugaaauuugcauug

SEQ ID NO: 428328 - RNA, 19 nt, Homo sapiens
gugagaaacuggaacagau

SEQ ID NO: 428329 - RNA, 19 nt, Homo sapiens
ugauagcacuuucuacaau

SEQ ID NO: 428330 - RNA, 19 nt, Homo sapiens
ggagagcacacccagguuu

SEQ ID NO: 428331 - RNA, 19 nt, Homo sapiens
gaauacaguugucucaaaa

SEQ ID NO: 428332 - RNA, 19 nt, Homo sapiens
gaacagauucucaggacau

SEQ ID NO: 428333 - RNA, 19 nt, Homo sapiens
gagaaacuguguuccuuac

SEQ ID NO: 428334 - RNA, 19 nt, Homo sapiens
gugaugauuuggucaauuc

SEQ ID NO: 428335 - RNA, 19 nt, Homo sapiens
gagcauaggaggcuucugu

SEQ ID NO: 428336 - RNA, 19 nt, Homo sapiens
gccuugaggucgucacuuu

SEQ ID NO: 428337 - RNA, 19 nt, Homo sapiens
ucuagaaccugggaacuuu

SEQ ID NO: 428338 - RNA, 19 nt, Homo sapiens
gcuaaagauucuaaaccuu

SEQ ID NO: 428339 - RNA, 19 nt, Homo sapiens
gagagaaauauggaacuua

SEQ ID NO: 428340 - RNA, 19 nt, Homo sapiens
ggaucucugugccaaacua

SEQ ID NO: 428341 - RNA, 19 nt, Homo sapiens
gaaagggcagaugaaauuu

SEQ ID NO: 428342 - RNA, 19 nt, Homo sapiens
ggaaggagcauaacaucuc

SEQ ID NO: 428343 - RNA, 19 nt, Homo sapiens
ccagaagggugacugaagu

SEQ ID NO: 428344 - RNA, 19 nt, Homo sapiens
uugcggagaugcuuuacua

SEQ ID NO: 428345 - RNA, 19 nt, Homo sapiens
caacccaggcuauugcuaa

SEQ ID NO: 428346 - RNA, 19 nt, Homo sapiens
gaugagcggauauuucuug

SEQ ID NO: 428347 - RNA, 19 nt, Homo sapiens
gaagaagugggaagacaug

SEQ ID NO: 428348 - RNA, 19 nt, Homo sapiens
cuaacagacugaaagaaau

SEQ ID NO: 428349 - RNA, 19 nt, Homo sapiens
gagauuagaaagaaacuuc

SEQ ID NO: 428350 - RNA, 19 nt, Homo sapiens
guccugaacuuaugaugga

SEQ ID NO: 428351 - RNA, 19 nt, Homo sapiens
guagagaggugguaaaaca

SEQ ID NO: 428352 - RNA, 19 nt, Homo sapiens
uuagguacauuaaggagaa

SEQ ID NO: 428353 - RNA, 19 nt, Homo sapiens
gcugaaagggugcagauga

SEQ ID NO: 428354 - RNA, 19 nt, Homo sapiens
gaaauugggacucucucaa

SEQ ID NO: 428355 - RNA, 19 nt, Homo sapiens
cuagaauccugaaauguuc

SEQ ID NO: 428356 - RNA, 19 nt, Homo sapiens
gagguuagucucuuguauu

SEQ ID NO: 428357 - RNA, 19 nt, Homo sapiens
uccaagauguagcuaauga

SEQ ID NO: 428358 - RNA, 19 nt, Homo sapiens
acagugacauggaagaaga

SEQ ID NO: 428359 - RNA, 19 nt, Homo sapiens
gcagagcuuaaucgaauuu

SEQ ID NO: 428360 - RNA, 19 nt, Homo sapiens
ggagccagguguauagaag

SEQ ID NO: 428361 - RNA, 19 nt, Homo sapiens
caugauuagugaugauuug

SEQ ID NO: 428362 - RNA, 19 nt, Homo sapiens
gagaacguacugagagauu

SEQ ID NO: 428363 - RNA, 19 nt, Homo sapiens
ggguguuccuggcaguuua

SEQ ID NO: 428364 - RNA, 19 nt, Homo sapiens
gugccaaacuagauauuuc

SEQ ID NO: 428365 - RNA, 19 nt, Homo sapiens
gaagcaaggccagucugua

SEQ ID NO: 428366 - RNA, 19 nt, Homo sapiens
agaacguacugagagauua

SEQ ID NO: 428367 - RNA, 19 nt, Homo sapiens
cuagguaacuucauauugc

SEQ ID NO: 428368 - RNA, 19 nt, Homo sapiens
cauaggaggcuucuguuga

SEQ ID NO: 428369 - RNA, 19 nt, Homo sapiens
gcagcagccuuuaaugcau

SEQ ID NO: 428370 - RNA, 19 nt, Homo sapiens
ccacugagguuagucucuu

SEQ ID NO: 428371 - RNA, 19 nt, Homo sapiens
uaggagacauggauuuauc

SEQ ID NO: 428372 - RNA, 19 nt, Homo sapiens
gaagagagaucagauuguu

SEQ ID NO: 428373 - RNA, 19 nt, Homo sapiens
gaacugccauguccucuga

SEQ ID NO: 428374 - RNA, 19 nt, Homo sapiens
gaagcaauuucccaaugua

SEQ ID NO: 428375 - RNA, 19 nt, Homo sapiens
gaaaugagacaugcacaua

SEQ ID NO: 428376 - RNA, 19 nt, Homo sapiens
gcacugaagcaucuuauuu

SEQ ID NO: 428377 - RNA, 19 nt, Homo sapiens
guagaaagaaguagacaua

SEQ ID NO: 428378 - RNA, 19 nt, Homo sapiens
gagaucagauuguuacugu

SEQ ID NO: 428379 - RNA, 19 nt, Homo sapiens
uagaagaguuggcuuuaaa

SEQ ID NO: 428380 - RNA, 19 nt, Homo sapiens
gaaagaaguagacauagga

SEQ ID NO: 428381 - RNA, 19 nt, Homo sapiens
ugggagggcucaacuuuaa

SEQ ID NO: 428382 - RNA, 19 nt, Homo sapiens
uaugacaacugaaaugaga

SEQ ID NO: 428383 - RNA, 19 nt, Homo sapiens
ggaaauguguaucaagaac

SEQ ID NO: 428384 - RNA, 19 nt, Homo sapiens
uuagacaguucccaucuuu

SEQ ID NO: 428385 - RNA, 19 nt, Homo sapiens
gagcugcacugaagcaucu

SEQ ID NO: 428386 - RNA, 19 nt, Homo sapiens
gagacaugcacauaauaua

SEQ ID NO: 428387 - RNA, 19 nt, Homo sapiens
agacaauuaugacaacuga

SEQ ID NO: 428388 - RNA, 19 nt, Homo sapiens
aaggaaauguguaucaaga

SEQ ID NO: 428389 - RNA, 19 nt, Homo sapiens
ggauuucuauaguuugaug

SEQ ID NO: 428390 - RNA, 19 nt, Homo sapiens
ccaauguaccuauaagaaa

SEQ ID NO: 428391 - RNA, 19 nt, Homo sapiens
cacaaggaauaauuucuga

SEQ ID NO: 428392 - RNA, 19 nt, Homo sapiens
aguuugagcucuuagguuu

SEQ ID NO: 428393 - RNA, 19 nt, Homo sapiens
ggaguggcagguauuauga

SEQ ID NO: 428394 - RNA, 19 nt, Homo sapiens
gcuguguccucucagaauu

SEQ ID NO: 428395 - RNA, 19 nt, Homo sapiens
gaaugguauuucuucaguu

SEQ ID NO: 428396 - RNA, 19 nt, Homo sapiens
ggaggaaauuacagagaca

SEQ ID NO: 428397 - RNA, 19 nt, Homo sapiens
aaaugucgauguugagaau

SEQ ID NO: 428398 - RNA, 19 nt, Homo sapiens
aaugagacaugcacauaau

SEQ ID NO: 428399 - RNA, 19 nt, Homo sapiens
ggucgcagcuacucuagag

SEQ ID NO: 428400 - RNA, 19 nt, Homo sapiens
ucaagaacaugauuaucca

SEQ ID NO: 428401 - RNA, 19 nt, Homo sapiens
gcuaagaucgcgccacugu

SEQ ID NO: 428402 - RNA, 19 nt, Homo sapiens
gacaaauuaugggacguuu

SEQ ID NO: 428403 - RNA, 19 nt, Homo sapiens
gaucagauuguuacugugu

SEQ ID NO: 428404 - RNA, 19 nt, Homo sapiens
uugcaaaugucgauguuga

SEQ ID NO: 428405 - RNA, 19 nt, Homo sapiens
gccuugagauucuguuaau

SEQ ID NO: 428406 - RNA, 19 nt, Homo sapiens
gcaaaugucgauguugaga

SEQ ID NO: 428407 - RNA, 19 nt, Homo sapiens
uauagaagaguuggcuuua

SEQ ID NO: 428408 - RNA, 19 nt, Homo sapiens
gcaggagaaucgcuugaac

SEQ ID NO: 428409 - RNA, 19 nt, Homo sapiens
gacaugcacauaauauaga

SEQ ID NO: 428410 - RNA, 19 nt, Homo sapiens
ggaagagagaucagauugu

SEQ ID NO: 428411 - RNA, 19 nt, Homo sapiens
gggaguggcagguauuaug

SEQ ID NO: 428412 - RNA, 19 nt, Homo sapiens
auagaagaguuggcuuuaa

SEQ ID NO: 428413 - RNA, 19 nt, Homo sapiens
gaaauguguaucaagaaca

SEQ ID NO: 428414 - RNA, 19 nt, Homo sapiens
uuguagaaccugaguauuu

SEQ ID NO: 428415 - RNA, 19 nt, Homo sapiens
caaggaauaauuucugauc

SEQ ID NO: 428416 - RNA, 19 nt, Homo sapiens
agaaagaaguagacauagg

SEQ ID NO: 428417 - RNA, 19 nt, Homo sapiens
gaggguauggauauggaua

SEQ ID NO: 428418 - RNA, 19 nt, Homo sapiens
uggccagacugacuucaaa

SEQ ID NO: 428419 - RNA, 19 nt, Homo sapiens
aaaugagacaugcacauaa

SEQ ID NO: 428420 - RNA, 19 nt, Homo sapiens
ugagacaugcacauaauau

SEQ ID NO: 428421 - RNA, 19 nt, Homo sapiens
ggacguuccagagacuaua

SEQ ID NO: 428422 - RNA, 19 nt, Homo sapiens
gugggagggcucaacuuua

SEQ ID NO: 428423 - RNA, 19 nt, Homo sapiens
agaguuggcuuuaaaaugu

SEQ ID NO: 428424 - RNA, 19 nt, Homo sapiens
uaagaucgcgccacuguac

SEQ ID NO: 428425 - RNA, 19 nt, Homo sapiens
gcaaguuuggccagacuga

SEQ ID NO: 428426 - RNA, 19 nt, Homo sapiens
ucucugagguggucguugu

SEQ ID NO: 428427 - RNA, 19 nt, Homo sapiens
ggaucguccuuccaaaugg

SEQ ID NO: 428428 - RNA, 19 nt, Homo sapiens
ucaaggaccgggagacuca

SEQ ID NO: 428429 - RNA, 19 nt, Homo sapiens
cagagacaauuaugacaac

SEQ ID NO: 428430 - RNA, 19 nt, Homo sapiens
ggacuugaacugccauguc

SEQ ID NO: 428431 - RNA, 19 nt, Homo sapiens
ggagguugcagugagcuaa

SEQ ID NO: 428432 - RNA, 19 nt, Homo sapiens
agacaugcacauaauauag

SEQ ID NO: 428433 - RNA, 19 nt, Homo sapiens
ggagggcucaacuuuaaca

SEQ ID NO: 428434 - RNA, 19 nt, Homo sapiens
caugugcuguguccucuca

SEQ ID NO: 428435 - RNA, 19 nt, Homo sapiens
caagccagccugaccaaca

SEQ ID NO: 428436 - RNA, 19 nt, Homo sapiens
aauugguucuggcaaguuu

SEQ ID NO: 428437 - RNA, 19 nt, Homo sapiens
ccaucuguacuaaacauaa

SEQ ID NO: 428438 - RNA, 19 nt, Homo sapiens
gaaaccccaucuguacuaa

SEQ ID NO: 428439 - RNA, 19 nt, Homo sapiens
gagacuauaauggcagaaa

SEQ ID NO: 428440 - RNA, 19 nt, Homo sapiens
gaccuggaggguauggaua

SEQ ID NO: 428441 - RNA, 19 nt, Homo sapiens
uggcagguauuaugacagu

SEQ ID NO: 428442 - RNA, 19 nt, Homo sapiens
caaaugucgauguugagaa

SEQ ID NO: 428443 - RNA, 19 nt, Homo sapiens
cccaauguaccuauaagaa

SEQ ID NO: 428444 - RNA, 19 nt, Homo sapiens
cagucgaccuggaggguau

SEQ ID NO: 428445 - RNA, 19 nt, Homo sapiens
gauguugagaaugguauuu

SEQ ID NO: 428446 - RNA, 19 nt, Homo sapiens
guuugcaaaugucgauguu

SEQ ID NO: 428447 - RNA, 19 nt, Homo sapiens
aaauucuucugccuugaga

SEQ ID NO: 428448 - RNA, 19 nt, Homo sapiens
uguagaaccugaguauuuu

SEQ ID NO: 428449 - RNA, 19 nt, Homo sapiens
gacguuccagagacuauaa

SEQ ID NO: 428450 - RNA, 19 nt, Homo sapiens
cgugggagggcucaacuuu

SEQ ID NO: 428451 - RNA, 19 nt, Homo sapiens
cgugcucucugaaacaugu

SEQ ID NO: 428452 - RNA, 19 nt, Homo sapiens
aagagagaucagauuguua

SEQ ID NO: 428453 - RNA, 19 nt, Homo sapiens
uuugagcucuuagguuuau

SEQ ID NO: 428454 - RNA, 19 nt, Homo sapiens
acagagacaauuaugacaa

SEQ ID NO: 428455 - RNA, 19 nt, Homo sapiens
ugccauguccucugaagaa

SEQ ID NO: 428456 - RNA, 19 nt, Homo sapiens
acacaaggaauaauuucug

SEQ ID NO: 428457 - RNA, 19 nt, Homo sapiens
ucugaaacaugugcugugu

SEQ ID NO: 428458 - RNA, 19 nt, Homo sapiens
ccagcgguauuuucuaauu

SEQ ID NO: 428459 - RNA, 19 nt, Homo sapiens
gagacuccauuuuguuaug

SEQ ID NO: 428460 - RNA, 19 nt, Homo sapiens
gcuaugggaguggcaggua

SEQ ID NO: 428461 - RNA, 19 nt, Homo sapiens
aaccagaggagguggcuuu

SEQ ID NO: 428462 - RNA, 19 nt, Homo sapiens
agagagaucagauuguuac

SEQ ID NO: 428463 - RNA, 19 nt, Homo sapiens
aggaagagagaucagauug

SEQ ID NO: 428464 - RNA, 19 nt, Homo sapiens
ggcuguauuuauaaagguu

SEQ ID NO: 428465 - RNA, 19 nt, Homo sapiens
gcuacucaggaggaaauua

SEQ ID NO: 428466 - RNA, 19 nt, Homo sapiens
uggaggguauggauaugga

SEQ ID NO: 428467 - RNA, 19 nt, Homo sapiens
cccagagcaugcuucaguu

SEQ ID NO: 428468 - RNA, 19 nt, Homo sapiens
caacccagagcaugcuuca

SEQ ID NO: 428469 - RNA, 19 nt, Homo sapiens
guuuguagaaccugaguau

SEQ ID NO: 428470 - RNA, 19 nt, Homo sapiens
cugccuauuuaaagacaaa

SEQ ID NO: 428471 - RNA, 19 nt, Homo sapiens
cugccaagguagcugaaga

SEQ ID NO: 428472 - RNA, 19 nt, Homo sapiens
gaaagauuaugccuucgua

SEQ ID NO: 428473 - RNA, 19 nt, Homo sapiens
ggaaggugcuggaauguga

SEQ ID NO: 428474 - RNA, 19 nt, Homo sapiens
gaauacacccuucguggua

SEQ ID NO: 428475 - RNA, 19 nt, Homo sapiens
gagccaaguuugaggagua

SEQ ID NO: 428476 - RNA, 19 nt, Homo sapiens
ggaauucucuguacgacau

SEQ ID NO: 428477 - RNA, 19 nt, Homo sapiens
guucuucuguccuucaaua

SEQ ID NO: 428478 - RNA, 19 nt, Homo sapiens
cagcuuccacuucauauua

SEQ ID NO: 428479 - RNA, 19 nt, Homo sapiens
gagcagugcguacgccuua

SEQ ID NO: 428480 - RNA, 19 nt, Homo sapiens
gguaugagcgggagcagua

SEQ ID NO: 428481 - RNA, 19 nt, Homo sapiens
gaaccguggaccuuaauuu

SEQ ID NO: 428482 - RNA, 19 nt, Homo sapiens
uacgcaaccugcaccauua

SEQ ID NO: 428483 - RNA, 19 nt, Homo sapiens
gcagcugccuccguguaua

SEQ ID NO: 428484 - RNA, 19 nt, Homo sapiens
gaagccagcaagaauaaga

SEQ ID NO: 428485 - RNA, 19 nt, Homo sapiens
uccaaaggcuagaccuaua

SEQ ID NO: 428486 - RNA, 19 nt, Homo sapiens
cauuaagaauuacggcuuu

SEQ ID NO: 428487 - RNA, 19 nt, Homo sapiens
ugaccgagcaauauaauga

SEQ ID NO: 428488 - RNA, 19 nt, Homo sapiens
caggaaccguggaccuuaa

SEQ ID NO: 428489 - RNA, 19 nt, Homo sapiens
cugccuccguguauaauua

SEQ ID NO: 428490 - RNA, 19 nt, Homo sapiens
gcaauauaaugagcaauac

SEQ ID NO: 428491 - RNA, 19 nt, Homo sapiens
gugacaucgugaaagauua

SEQ ID NO: 428492 - RNA, 19 nt, Homo sapiens
caaagaguguccgauagau

SEQ ID NO: 428493 - RNA, 19 nt, Homo sapiens
ccaaagaguguccgauaga

SEQ ID NO: 428494 - RNA, 19 nt, Homo sapiens
ccggugaaauaaaugguuu

SEQ ID NO: 428495 - RNA, 19 nt, Homo sapiens
ggaugugugugggcugaaa

SEQ ID NO: 428496 - RNA, 19 nt, Homo sapiens
guccaaagaguguccgaua

SEQ ID NO: 428497 - RNA, 19 nt, Homo sapiens
gauuaugccuucguacaca

SEQ ID NO: 428498 - RNA, 19 nt, Homo sapiens
gaaugaccuuggugagagu

SEQ ID NO: 428499 - RNA, 19 nt, Homo sapiens
aaccguggaccuuaauuua

SEQ ID NO: 428500 - RNA, 19 nt, Homo sapiens
guggaagccagcaagaaua

SEQ ID NO: 428501 - RNA, 19 nt, Homo sapiens
gcuguuggauuugggaaug

SEQ ID NO: 428502 - RNA, 19 nt, Homo sapiens
gagcuucgagccaaguuug

SEQ ID NO: 428503 - RNA, 19 nt, Homo sapiens
gaccagagcggcugcuauc

SEQ ID NO: 428504 - RNA, 19 nt, Homo sapiens
guucagaccuucucuuccu

SEQ ID NO: 428505 - RNA, 19 nt, Homo sapiens
cgagcaauauaaugagcaa

SEQ ID NO: 428506 - RNA, 19 nt, Homo sapiens
ggagauucgcucacucuuc

SEQ ID NO: 428507 - RNA, 19 nt, Homo sapiens
gggaaugaccuuggugaga

SEQ ID NO: 428508 - RNA, 19 nt, Homo sapiens
cagcaagaauaagagcaaa

SEQ ID NO: 428509 - RNA, 19 nt, Homo sapiens
ucaggaaccguggaccuua

SEQ ID NO: 428510 - RNA, 19 nt, Homo sapiens
auacagccauggccaguca

SEQ ID NO: 428511 - RNA, 19 nt, Homo sapiens
gacuugaccgagcaauaua

SEQ ID NO: 428512 - RNA, 19 nt, Homo sapiens
cagcugccuccguguauaa

SEQ ID NO: 428513 - RNA, 19 nt, Homo sapiens
uggaagccagcaagaauaa

SEQ ID NO: 428514 - RNA, 19 nt, Homo sapiens
uuacggcuuugugcacaua

SEQ ID NO: 428515 - RNA, 19 nt, Homo sapiens
cuacagagcaggagauucg

SEQ ID NO: 428516 - RNA, 19 nt, Homo sapiens
agacuugaccgagcaauau

SEQ ID NO: 428517 - RNA, 19 nt, Homo sapiens
ggaguaugguccggucauc

SEQ ID NO: 428518 - RNA, 19 nt, Homo sapiens
guccuucaauacuucugua

SEQ ID NO: 428519 - RNA, 19 nt, Homo sapiens
gaccuuaauuuaccuugcu

SEQ ID NO: 428520 - RNA, 19 nt, Homo sapiens
ggagagggcuacgguuacg

SEQ ID NO: 428521 - RNA, 19 nt, Homo sapiens
gcagcuuccacuucauauu

SEQ ID NO: 428522 - RNA, 19 nt, Homo sapiens
gggcacugguccaaagagu

SEQ ID NO: 428523 - RNA, 19 nt, Homo sapiens
cuucuguccuucaauacuu

SEQ ID NO: 428524 - RNA, 19 nt, Homo sapiens
ucaggauggugaagcuguu

SEQ ID NO: 428525 - RNA, 19 nt, Homo sapiens
gugcugcccgguccuauga

SEQ ID NO: 428526 - RNA, 19 nt, Homo sapiens
cagacuugaccgagcaaua

SEQ ID NO: 428527 - RNA, 19 nt, Homo sapiens
cacagaguuucaaggcaaa

SEQ ID NO: 428528 - RNA, 19 nt, Homo sapiens
ugacaucgugaaagauuau

SEQ ID NO: 428529 - RNA, 19 nt, Homo sapiens
gcaaccugcaccauuacaa

SEQ ID NO: 428530 - RNA, 19 nt, Homo sapiens
ccagcaggccucauugugu

SEQ ID NO: 428531 - RNA, 19 nt, Homo sapiens
caagacggcagcugaggau

SEQ ID NO: 428532 - RNA, 19 nt, Homo sapiens
gaccuucucuuccuuuccu

SEQ ID NO: 428533 - RNA, 19 nt, Homo sapiens
guuacgggcaugagaguga

SEQ ID NO: 428534 - RNA, 19 nt, Homo sapiens
ccacaaguccagaauacag

SEQ ID NO: 428535 - RNA, 19 nt, Homo sapiens
gcucgaugccuacuacaag

SEQ ID NO: 428536 - RNA, 19 nt, Homo sapiens
gggcccugcugguuucugu

SEQ ID NO: 428537 - RNA, 19 nt, Homo sapiens
gauaacacagaguuucaag

SEQ ID NO: 428538 - RNA, 19 nt, Homo sapiens
uuggagagggcuacgguua

SEQ ID NO: 428539 - RNA, 19 nt, Homo sapiens
ugugacaucgugaaagauu

SEQ ID NO: 428540 - RNA, 19 nt, Homo sapiens
ggaaccguggaccuuaauu

SEQ ID NO: 428541 - RNA, 19 nt, Homo sapiens
uccaaagaguguccgauag

SEQ ID NO: 428542 - RNA, 19 nt, Homo sapiens
ccagcaagaauaagagcaa

SEQ ID NO: 428543 - RNA, 19 nt, Homo sapiens
uaagaauuacggcuuugug

SEQ ID NO: 428544 - RNA, 19 nt, Homo sapiens
uagcuucccauucauguuc

SEQ ID NO: 428545 - RNA, 19 nt, Homo sapiens
ugaguugucccaagcuuca

SEQ ID NO: 428546 - RNA, 19 nt, Homo sapiens
caaccugcaccauuacaag

SEQ ID NO: 428547 - RNA, 19 nt, Homo sapiens
ugccacaaguccagaauac

SEQ ID NO: 428548 - RNA, 19 nt, Homo sapiens
ugucccagcugccacaagu

SEQ ID NO: 428549 - RNA, 19 nt, Homo sapiens
guccggucaucgaauguga

SEQ ID NO: 428550 - RNA, 19 nt, Homo sapiens
auacgcaaccugcaccauu

SEQ ID NO: 428551 - RNA, 19 nt, Homo sapiens
cguggaagccagcaagaau

SEQ ID NO: 428552 - RNA, 19 nt, Homo sapiens
cugcagcuuccacuucaua

SEQ ID NO: 428553 - RNA, 19 nt, Homo sapiens
guccaaaggcuagaccuau

SEQ ID NO: 428554 - RNA, 19 nt, Homo sapiens
uccugcggcuguuggauuu

SEQ ID NO: 428555 - RNA, 19 nt, Homo sapiens
uucuguagcuucccauuca

SEQ ID NO: 428556 - RNA, 19 nt, Homo sapiens
uacugcagcuuccacuuca

SEQ ID NO: 428557 - RNA, 19 nt, Homo sapiens
ggagcuucgagccaaguuu

SEQ ID NO: 428558 - RNA, 19 nt, Homo sapiens
augggaaggugcuggaaug

SEQ ID NO: 428559 - RNA, 19 nt, Homo sapiens
cuucaauacuucuguagcu

SEQ ID NO: 428560 - RNA, 19 nt, Homo sapiens
ucagaccuucucuuccuuu

SEQ ID NO: 428561 - RNA, 19 nt, Homo sapiens
ccauucauguucucuucuc

SEQ ID NO: 428562 - RNA, 19 nt, Homo sapiens
ucccauucauguucucuuc

SEQ ID NO: 428563 - RNA, 19 nt, Homo sapiens
cgccuuacaccaugagcua

SEQ ID NO: 428564 - RNA, 19 nt, Homo sapiens
gcagugcguacgccuuaca

SEQ ID NO: 428565 - RNA, 19 nt, Homo sapiens
gaaagguguucuuacauga

SEQ ID NO: 428566 - RNA, 19 nt, Homo sapiens
ccauauaccuuucaaccua

SEQ ID NO: 428567 - RNA, 19 nt, Homo sapiens
gaaugacacuuacuuacga

SEQ ID NO: 428568 - RNA, 19 nt, Homo sapiens
gacagaacccaaacaaaua

SEQ ID NO: 428569 - RNA, 19 nt, Homo sapiens
gaugcaaccucaaccauau

SEQ ID NO: 428570 - RNA, 19 nt, Homo sapiens
caaguuauuucuacaagga

SEQ ID NO: 428571 - RNA, 19 nt, Homo sapiens
gaagcucugucaaccauau

SEQ ID NO: 428572 - RNA, 19 nt, Homo sapiens
gaucaauugugcuuuagga

SEQ ID NO: 428573 - RNA, 19 nt, Homo sapiens
acaaauacaucccuaaugg

SEQ ID NO: 428574 - RNA, 19 nt, Homo sapiens
gaaccuuuauuguguaagu

SEQ ID NO: 428575 - RNA, 19 nt, Homo sapiens
caauugugcuuuaggaaau

SEQ ID NO: 428576 - RNA, 19 nt, Homo sapiens
ugugaaggcugaacaauca

SEQ ID NO: 428577 - RNA, 19 nt, Homo sapiens
ggaagaccauggcauagag

SEQ ID NO: 428578 - RNA, 19 nt, Homo sapiens
cuaccaaccucuacauuuc

SEQ ID NO: 428579 - RNA, 19 nt, Homo sapiens
ucugaucaauugugcuuua

SEQ ID NO: 428580 - RNA, 19 nt, Homo sapiens
ggaugcaaccucaaccaua

SEQ ID NO: 428581 - RNA, 19 nt, Homo sapiens
agacagaacccaaacaaau

SEQ ID NO: 428582 - RNA, 19 nt, Homo sapiens
cauauaccuuucaaccuaa

SEQ ID NO: 428583 - RNA, 19 nt, Homo sapiens
cgaaugaucacucaaacuu

SEQ ID NO: 428584 - RNA, 19 nt, Homo sapiens
cguguuaacucccucaaug

SEQ ID NO: 428585 - RNA, 19 nt, Homo sapiens
uauauugcaucuccuguau

SEQ ID NO: 428586 - RNA, 19 nt, Homo sapiens
ggacaaguuauuucuacaa

SEQ ID NO: 428587 - RNA, 19 nt, Homo sapiens
caaagcaacaggaacaaga

SEQ ID NO: 428588 - RNA, 19 nt, Homo sapiens
ggaaaauagucuccacaaa

SEQ ID NO: 428589 - RNA, 19 nt, Homo sapiens
gguguuggcuuugcuagga

SEQ ID NO: 428590 - RNA, 19 nt, Homo sapiens
gcauaaaacccuuaaauuc

SEQ ID NO: 428591 - RNA, 19 nt, Homo sapiens
cuacagcccgcaucaauga

SEQ ID NO: 428592 - RNA, 19 nt, Homo sapiens
gaggcuggaaugacacuua

SEQ ID NO: 428593 - RNA, 19 nt, Homo sapiens
auacaucccuaauggaaga

SEQ ID NO: 428594 - RNA, 19 nt, Homo sapiens
cagaaccuuuauuguguaa

SEQ ID NO: 428595 - RNA, 19 nt, Homo sapiens
gcaguaauaacaacaguag

SEQ ID NO: 428596 - RNA, 19 nt, Homo sapiens
caaccucaaccauauauuc

SEQ ID NO: 428597 - RNA, 19 nt, Homo sapiens
gcuacaaaccgaaugauca

SEQ ID NO: 428598 - RNA, 19 nt, Homo sapiens
acagaaccuuuauugugua

SEQ ID NO: 428599 - RNA, 19 nt, Homo sapiens
cuacgugauuccaguggua

SEQ ID NO: 428600 - RNA, 19 nt, Homo sapiens
caaaccgaaugaucacuca

SEQ ID NO: 428601 - RNA, 19 nt, Homo sapiens
acaaggauacuacgugauu

SEQ ID NO: 428602 - RNA, 19 nt, Homo sapiens
gacaaguuauuucuacaag

SEQ ID NO: 428603 - RNA, 19 nt, Homo sapiens
auaaguaacugugagaugu

SEQ ID NO: 428604 - RNA, 19 nt, Homo sapiens
gcaaaacgaaccucuauau

SEQ ID NO: 428605 - RNA, 19 nt, Homo sapiens
ucuauuacacccuauauug

SEQ ID NO: 428606 - RNA, 19 nt, Homo sapiens
caaacaaauacaucccuaa

SEQ ID NO: 428607 - RNA, 19 nt, Homo sapiens
ccucuacauuucuaauuug

SEQ ID NO: 428608 - RNA, 19 nt, Homo sapiens
gaaaauagucuccacaaag

SEQ ID NO: 428609 - RNA, 19 nt, Homo sapiens
gugaagcucugucaaccau

SEQ ID NO: 428610 - RNA, 19 nt, Homo sapiens
aaauacaucccuaauggaa

SEQ ID NO: 428611 - RNA, 19 nt, Homo sapiens
uaaguaacugugagaugua

SEQ ID NO: 428612 - RNA, 19 nt, Homo sapiens
gagacagaacccaaacaaa

SEQ ID NO: 428613 - RNA, 19 nt, Homo sapiens
gaaggagaggcuggaauga

SEQ ID NO: 428614 - RNA, 19 nt, Homo sapiens
cagcagauguacccucagu

SEQ ID NO: 428615 - RNA, 19 nt, Homo sapiens
ucaauugugcuuuaggaaa

SEQ ID NO: 428616 - RNA, 19 nt, Homo sapiens
ggaggcaaguggucaacag

SEQ ID NO: 428617 - RNA, 19 nt, Homo sapiens
gcaccaccagcaguaauaa

SEQ ID NO: 428618 - RNA, 19 nt, Homo sapiens
uaagacaccaccaggaguu

SEQ ID NO: 428619 - RNA, 19 nt, Homo sapiens
gaaaauaugcucaaaccau

SEQ ID NO: 428620 - RNA, 19 nt, Homo sapiens
gagcacaccaugucacuac

SEQ ID NO: 428621 - RNA, 19 nt, Homo sapiens
caacuacagcugcuauaca

SEQ ID NO: 428622 - RNA, 19 nt, Homo sapiens
ggaaugacacuuacuuacg

SEQ ID NO: 428623 - RNA, 19 nt, Homo sapiens
gaacccaaacaaauacauc

SEQ ID NO: 428624 - RNA, 19 nt, Homo sapiens
ccuuucaaccuaauaagua

SEQ ID NO: 428625 - RNA, 19 nt, Homo sapiens
cuacagcugcuauacagaa

SEQ ID NO: 428626 - RNA, 19 nt, Homo sapiens
aggauggaaucaacagaaa

SEQ ID NO: 428627 - RNA, 19 nt, Homo sapiens
gagcaagaacuagaaaaua

SEQ ID NO: 428628 - RNA, 19 nt, Homo sapiens
cccuuaaauucaucuagua

SEQ ID NO: 428629 - RNA, 19 nt, Homo sapiens
gaugggaucagcucagcaa

SEQ ID NO: 428630 - RNA, 19 nt, Homo sapiens
gaugagcaagaacuagaaa

SEQ ID NO: 428631 - RNA, 19 nt, Homo sapiens
gaaugaucacucaaacuuc

SEQ ID NO: 428632 - RNA, 19 nt, Homo sapiens
caaauacaucccuaaugga

SEQ ID NO: 428633 - RNA, 19 nt, Homo sapiens
uagcagcaguagcaacuca

SEQ ID NO: 428634 - RNA, 19 nt, Homo sapiens
ccuaccaaccucuacauuu

SEQ ID NO: 428635 - RNA, 19 nt, Homo sapiens
gauuuuauccuucaccaua

SEQ ID NO: 428636 - RNA, 19 nt, Homo sapiens
ggaugagcaagaacuagaa

SEQ ID NO: 428637 - RNA, 19 nt, Homo sapiens
aaugaucacucaaacuucu

SEQ ID NO: 428638 - RNA, 19 nt, Homo sapiens
aggagaggcuggaaugaca

SEQ ID NO: 428639 - RNA, 19 nt, Homo sapiens
gaagaccauggcauagaga

SEQ ID NO: 428640 - RNA, 19 nt, Homo sapiens
caaggauacuacgugauuc

SEQ ID NO: 428641 - RNA, 19 nt, Homo sapiens
ccucaaccauauauucuac

SEQ ID NO: 428642 - RNA, 19 nt, Homo sapiens
uauugcaucuccuguaucu

SEQ ID NO: 428643 - RNA, 19 nt, Homo sapiens
agaaggagaggcuggaaug

SEQ ID NO: 428644 - RNA, 19 nt, Homo sapiens
ccauuuggacaaguuauuu

SEQ ID NO: 428645 - RNA, 19 nt, Homo sapiens
guacgccaccuacuauuac

SEQ ID NO: 428646 - RNA, 19 nt, Homo sapiens
cgagacgucuaaugaccau

SEQ ID NO: 428647 - RNA, 19 nt, Homo sapiens
uguggaaacagcagaugua

SEQ ID NO: 428648 - RNA, 19 nt, Homo sapiens
cacucaaacuucuauuaca

SEQ ID NO: 428649 - RNA, 19 nt, Homo sapiens
gcuggaaugacacuuacuu

SEQ ID NO: 428650 - RNA, 19 nt, Homo sapiens
aagcuguuauuggucauuu

SEQ ID NO: 428651 - RNA, 19 nt, Homo sapiens
aaaauagucuccacaaagg

SEQ ID NO: 428652 - RNA, 19 nt, Homo sapiens
ucacucaaacuucuauuac

SEQ ID NO: 428653 - RNA, 19 nt, Homo sapiens
gagaaggagaggcuggaau

SEQ ID NO: 428654 - RNA, 19 nt, Homo sapiens
cagcaguaauaacaacagu

SEQ ID NO: 428655 - RNA, 19 nt, Homo sapiens
aagcucaaauggcaaagca

SEQ ID NO: 428656 - RNA, 19 nt, Homo sapiens
ccgaacagguuuauuuuag

SEQ ID NO: 428657 - RNA, 19 nt, Homo sapiens
cuaauaaguaacugugaga

SEQ ID NO: 428658 - RNA, 19 nt, Homo sapiens
agagacagaacccaaacaa

SEQ ID NO: 428659 - RNA, 19 nt, Homo sapiens
uaggauggaaucaacagaa

SEQ ID NO: 428660 - RNA, 19 nt, Homo sapiens
ucaaccauaugggaaaaua

SEQ ID NO: 428661 - RNA, 19 nt, Homo sapiens
cuccauggaugagcaagaa

SEQ ID NO: 428662 - RNA, 19 nt, Homo sapiens
ggagccuacuugccacagu

SEQ ID NO: 428663 - RNA, 19 nt, Homo sapiens
ggaacauacaugccugcaa

SEQ ID NO: 428664 - RNA, 19 nt, Homo sapiens
aaaccauuuggacaaguua

SEQ ID NO: 428665 - RNA, 19 nt, Homo sapiens
gaaagguguucuuacauga

SEQ ID NO: 428666 - RNA, 19 nt, Homo sapiens
ccauauaccuuucaaccua

SEQ ID NO: 428667 - RNA, 19 nt, Homo sapiens
gaaugacacuuacuuacga

SEQ ID NO: 428668 - RNA, 19 nt, Homo sapiens
gacagaacccaaacaaaua

SEQ ID NO: 428669 - RNA, 19 nt, Homo sapiens
gaugcaaccucaaccauau

SEQ ID NO: 428670 - RNA, 19 nt, Homo sapiens
caaguuauuucuacaagga

SEQ ID NO: 428671 - RNA, 19 nt, Homo sapiens
gaagcucugucaaccauau

SEQ ID NO: 428672 - RNA, 19 nt, Homo sapiens
gaucaauugugcuuuagga

SEQ ID NO: 428673 - RNA, 19 nt, Homo sapiens
acaaauacaucccuaaugg

SEQ ID NO: 428674 - RNA, 19 nt, Homo sapiens
gaaccuuuauuguguaagu

SEQ ID NO: 428675 - RNA, 19 nt, Homo sapiens
caauugugcuuuaggaaau

SEQ ID NO: 428676 - RNA, 19 nt, Homo sapiens
ugugaaggcugaacaauca

SEQ ID NO: 428677 - RNA, 19 nt, Homo sapiens
ggaagaccauggcauagag

SEQ ID NO: 428678 - RNA, 19 nt, Homo sapiens
cuaccaaccucuacauuuc

SEQ ID NO: 428679 - RNA, 19 nt, Homo sapiens
ucugaucaauugugcuuua

SEQ ID NO: 428680 - RNA, 19 nt, Homo sapiens
ggaugcaaccucaaccaua

SEQ ID NO: 428681 - RNA, 19 nt, Homo sapiens
agacagaacccaaacaaau

SEQ ID NO: 428682 - RNA, 19 nt, Homo sapiens
cauauaccuuucaaccuaa

SEQ ID NO: 428683 - RNA, 19 nt, Homo sapiens
cgaaugaucacucaaacuu

SEQ ID NO: 428684 - RNA, 19 nt, Homo sapiens
cguguuaacucccucaaug

SEQ ID NO: 428685 - RNA, 19 nt, Homo sapiens
uauauugcaucuccuguau

SEQ ID NO: 428686 - RNA, 19 nt, Homo sapiens
gagacuugcuggaaugaca

SEQ ID NO: 428687 - RNA, 19 nt, Homo sapiens
ggugagacuugcuggaaug

SEQ ID NO: 428688 - RNA, 19 nt, Homo sapiens
ggacaaguuauuucuacaa

SEQ ID NO: 428689 - RNA, 19 nt, Homo sapiens
caaagcaacaggaacaaga

SEQ ID NO: 428690 - RNA, 19 nt, Homo sapiens
ggaaaauagucuccacaaa

SEQ ID NO: 428691 - RNA, 19 nt, Homo sapiens
gguguuggcuuugcuagga

SEQ ID NO: 428692 - RNA, 19 nt, Homo sapiens
gcauaaaacccuuaaauuc

SEQ ID NO: 428693 - RNA, 19 nt, Homo sapiens
cuacagcccgcaucaauga

SEQ ID NO: 428694 - RNA, 19 nt, Homo sapiens
gaaggagaggugagacuug

SEQ ID NO: 428695 - RNA, 19 nt, Homo sapiens
auacaucccuaauggaaga

SEQ ID NO: 428696 - RNA, 19 nt, Homo sapiens
cagaaccuuuauuguguaa

SEQ ID NO: 428697 - RNA, 19 nt, Homo sapiens
gcaguaauaacaacaguag

SEQ ID NO: 428698 - RNA, 19 nt, Homo sapiens
caaccucaaccauauauuc

SEQ ID NO: 428699 - RNA, 19 nt, Homo sapiens
gcuacaaaccgaaugauca

SEQ ID NO: 428700 - RNA, 19 nt, Homo sapiens
acagaaccuuuauugugua

SEQ ID NO: 428701 - RNA, 19 nt, Homo sapiens
cuacgugauuccaguggua

SEQ ID NO: 428702 - RNA, 19 nt, Homo sapiens
caaaccgaaugaucacuca

SEQ ID NO: 428703 - RNA, 19 nt, Homo sapiens
acaaggauacuacgugauu

SEQ ID NO: 428704 - RNA, 19 nt, Homo sapiens
gacaaguuauuucuacaag

SEQ ID NO: 428705 - RNA, 19 nt, Homo sapiens
auaaguaacugugagaugu

SEQ ID NO: 428706 - RNA, 19 nt, Homo sapiens
gcaaaacgaaccucuauau

SEQ ID NO: 428707 - RNA, 19 nt, Homo sapiens
ucuauuacacccuauauug

SEQ ID NO: 428708 - RNA, 19 nt, Homo sapiens
caaacaaauacaucccuaa

SEQ ID NO: 428709 - RNA, 19 nt, Homo sapiens
ccucuacauuucuaauuug

SEQ ID NO: 428710 - RNA, 19 nt, Homo sapiens
gaaaauagucuccacaaag

SEQ ID NO: 428711 - RNA, 19 nt, Homo sapiens
gugaagcucugucaaccau

SEQ ID NO: 428712 - RNA, 19 nt, Homo sapiens
aaauacaucccuaauggaa

SEQ ID NO: 428713 - RNA, 19 nt, Homo sapiens
uaaguaacugugagaugua

SEQ ID NO: 428714 - RNA, 19 nt, Homo sapiens
gagacagaacccaaacaaa

SEQ ID NO: 428715 - RNA, 19 nt, Homo sapiens
cagcagauguacccucagu

SEQ ID NO: 428716 - RNA, 19 nt, Homo sapiens
gcaccaccagcaguaauaa

SEQ ID NO: 428717 - RNA, 19 nt, Homo sapiens
ucaauugugcuuuaggaaa

SEQ ID NO: 428718 - RNA, 19 nt, Homo sapiens
ggaggcaaguggucaacag

SEQ ID NO: 428719 - RNA, 19 nt, Homo sapiens
uaagacaccaccaggaguu

SEQ ID NO: 428720 - RNA, 19 nt, Homo sapiens
gaaaauaugcucaaaccau

SEQ ID NO: 428721 - RNA, 19 nt, Homo sapiens
gagcacaccaugucacuac

SEQ ID NO: 428722 - RNA, 19 nt, Homo sapiens
caacuacagcugcuauaca

SEQ ID NO: 428723 - RNA, 19 nt, Homo sapiens
ggaaugacacuuacuuacg

SEQ ID NO: 428724 - RNA, 19 nt, Homo sapiens
gaacccaaacaaauacauc

SEQ ID NO: 428725 - RNA, 19 nt, Homo sapiens
ccuuucaaccuaauaagua

SEQ ID NO: 428726 - RNA, 19 nt, Homo sapiens
cuacagcugcuauacagaa

SEQ ID NO: 428727 - RNA, 19 nt, Homo sapiens
aggauggaaucaacagaaa

SEQ ID NO: 428728 - RNA, 19 nt, Homo sapiens
gagcaagaacuagaaaaua

SEQ ID NO: 428729 - RNA, 19 nt, Homo sapiens
cccuuaaauucaucuagua

SEQ ID NO: 428730 - RNA, 19 nt, Homo sapiens
gaugggaucagcucagcaa

SEQ ID NO: 428731 - RNA, 19 nt, Homo sapiens
gaggugagacuugcuggaa

SEQ ID NO: 428732 - RNA, 19 nt, Homo sapiens
gaugagcaagaacuagaaa

SEQ ID NO: 428733 - RNA, 19 nt, Homo sapiens
gaaugaucacucaaacuuc

SEQ ID NO: 428734 - RNA, 19 nt, Homo sapiens
caaauacaucccuaaugga

SEQ ID NO: 428735 - RNA, 19 nt, Homo sapiens
uagcagcaguagcaacuca

SEQ ID NO: 428736 - RNA, 19 nt, Homo sapiens
ccuaccaaccucuacauuu

SEQ ID NO: 428737 - RNA, 19 nt, Homo sapiens
gauuuuauccuucaccaua

SEQ ID NO: 428738 - RNA, 19 nt, Homo sapiens
ggaugagcaagaacuagaa

SEQ ID NO: 428739 - RNA, 19 nt, Homo sapiens
aaugaucacucaaacuucu

SEQ ID NO: 428740 - RNA, 19 nt, Homo sapiens
gaagaccauggcauagaga

SEQ ID NO: 428741 - RNA, 19 nt, Homo sapiens
caaggauacuacgugauuc

SEQ ID NO: 428742 - RNA, 19 nt, Homo sapiens
ccucaaccauauauucuac

SEQ ID NO: 428743 - RNA, 19 nt, Homo sapiens
uauugcaucuccuguaucu

SEQ ID NO: 428744 - RNA, 19 nt, Homo sapiens
ccauuuggacaaguuauuu

SEQ ID NO: 428745 - RNA, 19 nt, Homo sapiens
guacgccaccuacuauuac

SEQ ID NO: 428746 - RNA, 19 nt, Homo sapiens
cgagacgucuaaugaccau

SEQ ID NO: 428747 - RNA, 19 nt, Homo sapiens
uguggaaacagcagaugua

SEQ ID NO: 428748 - RNA, 19 nt, Homo sapiens
cacucaaacuucuauuaca

SEQ ID NO: 428749 - RNA, 19 nt, Homo sapiens
gcuggaaugacacuuacuu

SEQ ID NO: 428750 - RNA, 19 nt, Homo sapiens
aagcuguuauuggucauuu

SEQ ID NO: 428751 - RNA, 19 nt, Homo sapiens
aaaauagucuccacaaagg

SEQ ID NO: 428752 - RNA, 19 nt, Homo sapiens
ucacucaaacuucuauuac

SEQ ID NO: 428753 - RNA, 19 nt, Homo sapiens
cagcaguaauaacaacagu

SEQ ID NO: 428754 - RNA, 19 nt, Homo sapiens
aagcucaaauggcaaagca

SEQ ID NO: 428755 - RNA, 19 nt, Homo sapiens
ccgaacagguuuauuuuag

SEQ ID NO: 428756 - RNA, 19 nt, Homo sapiens
cuaauaaguaacugugaga

SEQ ID NO: 428757 - RNA, 19 nt, Homo sapiens
ucaaccauaugggaaaaua

SEQ ID NO: 428758 - RNA, 19 nt, Homo sapiens
agagacagaacccaaacaa

SEQ ID NO: 428759 - RNA, 19 nt, Homo sapiens
uaggauggaaucaacagaa

SEQ ID NO: 428760 - RNA, 19 nt, Homo sapiens
cuccauggaugagcaagaa

SEQ ID NO: 428761 - RNA, 19 nt, Homo sapiens
ggagccuacuugccacagu

SEQ ID NO: 428762 - RNA, 19 nt, Homo sapiens
ggaacauacaugccugcaa

SEQ ID NO: 428763 - RNA, 19 nt, Homo sapiens
aaaccauuuggacaaguua

SEQ ID NO: 428764 - RNA, 19 nt, Homo sapiens
gcaaagcaacaggaacaag

SEQ ID NO: 428765 - RNA, 19 nt, Homo sapiens
gaaagguguucuuacauga

SEQ ID NO: 428766 - RNA, 19 nt, Homo sapiens
ccauauaccuuucaaccua

SEQ ID NO: 428767 - RNA, 19 nt, Homo sapiens
gaaugacacuuacuuacga

SEQ ID NO: 428768 - RNA, 19 nt, Homo sapiens
gacagaacccaaacaaaua

SEQ ID NO: 428769 - RNA, 19 nt, Homo sapiens
gaugcaaccucaaccauau

SEQ ID NO: 428770 - RNA, 19 nt, Homo sapiens
caaguuauuucuacaagga

SEQ ID NO: 428771 - RNA, 19 nt, Homo sapiens
gaagcucugucaaccauau

SEQ ID NO: 428772 - RNA, 19 nt, Homo sapiens
gaucaauugugcuuuagga

SEQ ID NO: 428773 - RNA, 19 nt, Homo sapiens
acaaauacaucccuaaugg

SEQ ID NO: 428774 - RNA, 19 nt, Homo sapiens
gaaccuuuauuguguaagu

SEQ ID NO: 428775 - RNA, 19 nt, Homo sapiens
gcaaaggaaaccagagaaa

SEQ ID NO: 428776 - RNA, 19 nt, Homo sapiens
caauugugcuuuaggaaau

SEQ ID NO: 428777 - RNA, 19 nt, Homo sapiens
ugugaaggcugaacaauca

SEQ ID NO: 428778 - RNA, 19 nt, Homo sapiens
ggaagaccauggcauagag

SEQ ID NO: 428779 - RNA, 19 nt, Homo sapiens
cuaccaaccucuacauuuc

SEQ ID NO: 428780 - RNA, 19 nt, Homo sapiens
ucugaucaauugugcuuua

SEQ ID NO: 428781 - RNA, 19 nt, Homo sapiens
ggaugcaaccucaaccaua

SEQ ID NO: 428782 - RNA, 19 nt, Homo sapiens
agacagaacccaaacaaau

SEQ ID NO: 428783 - RNA, 19 nt, Homo sapiens
cauauaccuuucaaccuaa

SEQ ID NO: 428784 - RNA, 19 nt, Homo sapiens
cgaaugaucacucaaacuu

SEQ ID NO: 428785 - RNA, 19 nt, Homo sapiens
cguguuaacucccucaaug

SEQ ID NO: 428786 - RNA, 19 nt, Homo sapiens
uauauugcaucuccuguau

SEQ ID NO: 428787 - RNA, 19 nt, Homo sapiens
ggacaaguuauuucuacaa

SEQ ID NO: 428788 - RNA, 19 nt, Homo sapiens
caaagcaacaggaacaaga

SEQ ID NO: 428789 - RNA, 19 nt, Homo sapiens
ggaaaauagucuccacaaa

SEQ ID NO: 428790 - RNA, 19 nt, Homo sapiens
gguguuggcuuugcuagga

SEQ ID NO: 428791 - RNA, 19 nt, Homo sapiens
gcauaaaacccuuaaauuc

SEQ ID NO: 428792 - RNA, 19 nt, Homo sapiens
cuacagcccgcaucaauga

SEQ ID NO: 428793 - RNA, 19 nt, Homo sapiens
gaggcuggaaugacacuua

SEQ ID NO: 428794 - RNA, 19 nt, Homo sapiens
auacaucccuaauggaaga

SEQ ID NO: 428795 - RNA, 19 nt, Homo sapiens
cagaaccuuuauuguguaa

SEQ ID NO: 428796 - RNA, 19 nt, Homo sapiens
gcaguaauaacaacaguag

SEQ ID NO: 428797 - RNA, 19 nt, Homo sapiens
caaccucaaccauauauuc

SEQ ID NO: 428798 - RNA, 19 nt, Homo sapiens
gcuacaaaccgaaugauca

SEQ ID NO: 428799 - RNA, 19 nt, Homo sapiens
acagaaccuuuauugugua

SEQ ID NO: 428800 - RNA, 19 nt, Homo sapiens
cuacgugauuccaguggua

SEQ ID NO: 428801 - RNA, 19 nt, Homo sapiens
caaaccgaaugaucacuca

SEQ ID NO: 428802 - RNA, 19 nt, Homo sapiens
acaaggauacuacgugauu

SEQ ID NO: 428803 - RNA, 19 nt, Homo sapiens
gacaaguuauuucuacaag

SEQ ID NO: 428804 - RNA, 19 nt, Homo sapiens
auaaguaacugugagaugu

SEQ ID NO: 428805 - RNA, 19 nt, Homo sapiens
gcaaaacgaaccucuauau

SEQ ID NO: 428806 - RNA, 19 nt, Homo sapiens
ucuauuacacccuauauug

SEQ ID NO: 428807 - RNA, 19 nt, Homo sapiens
caaacaaauacaucccuaa

SEQ ID NO: 428808 - RNA, 19 nt, Homo sapiens
ccucuacauuucuaauuug

SEQ ID NO: 428809 - RNA, 19 nt, Homo sapiens
gaaaauagucuccacaaag

SEQ ID NO: 428810 - RNA, 19 nt, Homo sapiens
gugaagcucugucaaccau

SEQ ID NO: 428811 - RNA, 19 nt, Homo sapiens
aaauacaucccuaauggaa

SEQ ID NO: 428812 - RNA, 19 nt, Homo sapiens
uaaguaacugugagaugua

SEQ ID NO: 428813 - RNA, 19 nt, Homo sapiens
gagacagaacccaaacaaa

SEQ ID NO: 428814 - RNA, 19 nt, Homo sapiens
cagcagauguacccucagu

SEQ ID NO: 428815 - RNA, 19 nt, Homo sapiens
gaaggagaggcuggaauga

SEQ ID NO: 428816 - RNA, 19 nt, Homo sapiens
ucaauugugcuuuaggaaa

SEQ ID NO: 428817 - RNA, 19 nt, Homo sapiens
ggaggcaaguggucaacag

SEQ ID NO: 428818 - RNA, 19 nt, Homo sapiens
gcaccaccagcaguaauaa

SEQ ID NO: 428819 - RNA, 19 nt, Homo sapiens
uaagacaccaccaggaguu

SEQ ID NO: 428820 - RNA, 19 nt, Homo sapiens
gaaaauaugcucaaaccau

SEQ ID NO: 428821 - RNA, 19 nt, Homo sapiens
gagcacaccaugucacuac

SEQ ID NO: 428822 - RNA, 19 nt, Homo sapiens
caacuacagcugcuauaca

SEQ ID NO: 428823 - RNA, 19 nt, Homo sapiens
ggaaugacacuuacuuacg

SEQ ID NO: 428824 - RNA, 19 nt, Homo sapiens
gaacccaaacaaauacauc

SEQ ID NO: 428825 - RNA, 19 nt, Homo sapiens
ccuuucaaccuaauaagua

SEQ ID NO: 428826 - RNA, 19 nt, Homo sapiens
cuacagcugcuauacagaa

SEQ ID NO: 428827 - RNA, 19 nt, Homo sapiens
aggauggaaucaacagaaa

SEQ ID NO: 428828 - RNA, 19 nt, Homo sapiens
gagcaagaacuagaaaaua

SEQ ID NO: 428829 - RNA, 19 nt, Homo sapiens
cccuuaaauucaucuagua

SEQ ID NO: 428830 - RNA, 19 nt, Homo sapiens
gaugggaucagcucagcaa

SEQ ID NO: 428831 - RNA, 19 nt, Homo sapiens
gaugagcaagaacuagaaa

SEQ ID NO: 428832 - RNA, 19 nt, Homo sapiens
gaaugaucacucaaacuuc

SEQ ID NO: 428833 - RNA, 19 nt, Homo sapiens
caaauacaucccuaaugga

SEQ ID NO: 428834 - RNA, 19 nt, Homo sapiens
ccuaccaaccucuacauuu

SEQ ID NO: 428835 - RNA, 19 nt, Homo sapiens
uagcagcaguagcaacuca

SEQ ID NO: 428836 - RNA, 19 nt, Homo sapiens
gauuuuauccuucaccaua

SEQ ID NO: 428837 - RNA, 19 nt, Homo sapiens
ggaugagcaagaacuagaa

SEQ ID NO: 428838 - RNA, 19 nt, Homo sapiens
aaugaucacucaaacuucu

SEQ ID NO: 428839 - RNA, 19 nt, Homo sapiens
aggagaggcuggaaugaca

SEQ ID NO: 428840 - RNA, 19 nt, Homo sapiens
gaagaccauggcauagaga

SEQ ID NO: 428841 - RNA, 19 nt, Homo sapiens
caaggauacuacgugauuc

SEQ ID NO: 428842 - RNA, 19 nt, Homo sapiens
ccucaaccauauauucuac

SEQ ID NO: 428843 - RNA, 19 nt, Homo sapiens
ccuaccagguggcaaagga

SEQ ID NO: 428844 - RNA, 19 nt, Homo sapiens
uauugcaucuccuguaucu

SEQ ID NO: 428845 - RNA, 19 nt, Homo sapiens
agaaggagaggcuggaaug

SEQ ID NO: 428846 - RNA, 19 nt, Homo sapiens
ccauuuggacaaguuauuu

SEQ ID NO: 428847 - RNA, 19 nt, Homo sapiens
guacgccaccuacuauuac

SEQ ID NO: 428848 - RNA, 19 nt, Homo sapiens
cgagacgucuaaugaccau

SEQ ID NO: 428849 - RNA, 19 nt, Homo sapiens
cacucaaacuucuauuaca

SEQ ID NO: 428850 - RNA, 19 nt, Homo sapiens
gcuggaaugacacuuacuu

SEQ ID NO: 428851 - RNA, 19 nt, Homo sapiens
aagcuguuauuggucauuu

SEQ ID NO: 428852 - RNA, 19 nt, Homo sapiens
uguggaaacagcagaugua

SEQ ID NO: 428853 - RNA, 19 nt, Homo sapiens
aaaauagucuccacaaagg

SEQ ID NO: 428854 - RNA, 19 nt, Homo sapiens
ucacucaaacuucuauuac

SEQ ID NO: 428855 - RNA, 19 nt, Homo sapiens
gagaaggagaggcuggaau

SEQ ID NO: 428856 - RNA, 19 nt, Homo sapiens
cagcaguaauaacaacagu

SEQ ID NO: 428857 - RNA, 19 nt, Homo sapiens
aagcucaaauggcaaagca

SEQ ID NO: 428858 - RNA, 19 nt, Homo sapiens
ccgaacagguuuauuuuag

SEQ ID NO: 428859 - RNA, 19 nt, Homo sapiens
cuaauaaguaacugugaga

SEQ ID NO: 428860 - RNA, 19 nt, Homo sapiens
ucaaccauaugggaaaaua

SEQ ID NO: 428861 - RNA, 19 nt, Homo sapiens
agagacagaacccaaacaa

SEQ ID NO: 428862 - RNA, 19 nt, Homo sapiens
uaggauggaaucaacagaa

SEQ ID NO: 428863 - RNA, 19 nt, Homo sapiens
cuccauggaugagcaagaa

SEQ ID NO: 428864 - RNA, 19 nt, Homo sapiens
ggagccuacuugccacagu

SEQ ID NO: 428865 - RNA, 19 nt, Homo sapiens
gaaagguguucuuacauga

SEQ ID NO: 428866 - RNA, 19 nt, Homo sapiens
ccauauaccuuucaaccua

SEQ ID NO: 428867 - RNA, 19 nt, Homo sapiens
gaaugacacuuacuuacga

SEQ ID NO: 428868 - RNA, 19 nt, Homo sapiens
gacagaacccaaacaaaua

SEQ ID NO: 428869 - RNA, 19 nt, Homo sapiens
gaugcaaccucaaccauau

SEQ ID NO: 428870 - RNA, 19 nt, Homo sapiens
caaguuauuucuacaagga

SEQ ID NO: 428871 - RNA, 19 nt, Homo sapiens
gaagcucugucaaccauau

SEQ ID NO: 428872 - RNA, 19 nt, Homo sapiens
gaucaauugugcuuuagga

SEQ ID NO: 428873 - RNA, 19 nt, Homo sapiens
acaaauacaucccuaaugg

SEQ ID NO: 428874 - RNA, 19 nt, Homo sapiens
gaaccuuuauuguguaagu

SEQ ID NO: 428875 - RNA, 19 nt, Homo sapiens
caauugugcuuuaggaaau

SEQ ID NO: 428876 - RNA, 19 nt, Homo sapiens
ugugaaggcugaacaauca

SEQ ID NO: 428877 - RNA, 19 nt, Homo sapiens
ggaagaccauggcauagag

SEQ ID NO: 428878 - RNA, 19 nt, Homo sapiens
cuaccaaccucuacauuuc

SEQ ID NO: 428879 - RNA, 19 nt, Homo sapiens
ucugaucaauugugcuuua

SEQ ID NO: 428880 - RNA, 19 nt, Homo sapiens
ggaugcaaccucaaccaua

SEQ ID NO: 428881 - RNA, 19 nt, Homo sapiens
agacagaacccaaacaaau

SEQ ID NO: 428882 - RNA, 19 nt, Homo sapiens
cauauaccuuucaaccuaa

SEQ ID NO: 428883 - RNA, 19 nt, Homo sapiens
cgaaugaucacucaaacuu

SEQ ID NO: 428884 - RNA, 19 nt, Homo sapiens
cguguuaacucccucaaug

SEQ ID NO: 428885 - RNA, 19 nt, Homo sapiens
uauauugcaucuccuguau

SEQ ID NO: 428886 - RNA, 19 nt, Homo sapiens
gagacuugcuggaaugaca

SEQ ID NO: 428887 - RNA, 19 nt, Homo sapiens
ggugagacuugcuggaaug

SEQ ID NO: 428888 - RNA, 19 nt, Homo sapiens
ggacaaguuauuucuacaa

SEQ ID NO: 428889 - RNA, 19 nt, Homo sapiens
caaagcaacaggaacaaga

SEQ ID NO: 428890 - RNA, 19 nt, Homo sapiens
ggaaaauagucuccacaaa

SEQ ID NO: 428891 - RNA, 19 nt, Homo sapiens
gguguuggcuuugcuagga

SEQ ID NO: 428892 - RNA, 19 nt, Homo sapiens
gcauaaaacccuuaaauuc

SEQ ID NO: 428893 - RNA, 19 nt, Homo sapiens
cuacagcccgcaucaauga

SEQ ID NO: 428894 - RNA, 19 nt, Homo sapiens
gaaggagaggugagacuug

SEQ ID NO: 428895 - RNA, 19 nt, Homo sapiens
auacaucccuaauggaaga

SEQ ID NO: 428896 - RNA, 19 nt, Homo sapiens
cagaaccuuuauuguguaa

SEQ ID NO: 428897 - RNA, 19 nt, Homo sapiens
gcaguaauaacaacaguag

SEQ ID NO: 428898 - RNA, 19 nt, Homo sapiens
caaccucaaccauauauuc

SEQ ID NO: 428899 - RNA, 19 nt, Homo sapiens
gcuacaaaccgaaugauca

SEQ ID NO: 428900 - RNA, 19 nt, Homo sapiens
acagaaccuuuauugugua

SEQ ID NO: 428901 - RNA, 19 nt, Homo sapiens
cuacgugauuccaguggua

SEQ ID NO: 428902 - RNA, 19 nt, Homo sapiens
caaaccgaaugaucacuca

SEQ ID NO: 428903 - RNA, 19 nt, Homo sapiens
acaaggauacuacgugauu

SEQ ID NO: 428904 - RNA, 19 nt, Homo sapiens
gacaaguuauuucuacaag

SEQ ID NO: 428905 - RNA, 19 nt, Homo sapiens
auaaguaacugugagaugu

SEQ ID NO: 428906 - RNA, 19 nt, Homo sapiens
gcaaaacgaaccucuauau

SEQ ID NO: 428907 - RNA, 19 nt, Homo sapiens
ucuauuacacccuauauug

SEQ ID NO: 428908 - RNA, 19 nt, Homo sapiens
caaacaaauacaucccuaa

SEQ ID NO: 428909 - RNA, 19 nt, Homo sapiens
ccucuacauuucuaauuug

SEQ ID NO: 428910 - RNA, 19 nt, Homo sapiens
gugaagcucugucaaccau

SEQ ID NO: 428911 - RNA, 19 nt, Homo sapiens
gaaaauagucuccacaaag

SEQ ID NO: 428912 - RNA, 19 nt, Homo sapiens
aaauacaucccuaauggaa

SEQ ID NO: 428913 - RNA, 19 nt, Homo sapiens
uaaguaacugugagaugua

SEQ ID NO: 428914 - RNA, 19 nt, Homo sapiens
gagacagaacccaaacaaa

SEQ ID NO: 428915 - RNA, 19 nt, Homo sapiens
ucaauugugcuuuaggaaa

SEQ ID NO: 428916 - RNA, 19 nt, Homo sapiens
ggaggcaaguggucaacag

SEQ ID NO: 428917 - RNA, 19 nt, Homo sapiens
gcaccaccagcaguaauaa

SEQ ID NO: 428918 - RNA, 19 nt, Homo sapiens
uaagacaccaccaggaguu

SEQ ID NO: 428919 - RNA, 19 nt, Homo sapiens
gaaaauaugcucaaaccau

SEQ ID NO: 428920 - RNA, 19 nt, Homo sapiens
gagcacaccaugucacuac

SEQ ID NO: 428921 - RNA, 19 nt, Homo sapiens
caacuacagcugcuauaca

SEQ ID NO: 428922 - RNA, 19 nt, Homo sapiens
ggaaugacacuuacuuacg

SEQ ID NO: 428923 - RNA, 19 nt, Homo sapiens
gaacccaaacaaauacauc

SEQ ID NO: 428924 - RNA, 19 nt, Homo sapiens
ccuuucaaccuaauaagua

SEQ ID NO: 428925 - RNA, 19 nt, Homo sapiens
cuacagcugcuauacagaa

SEQ ID NO: 428926 - RNA, 19 nt, Homo sapiens
aggauggaaucaacagaaa

SEQ ID NO: 428927 - RNA, 19 nt, Homo sapiens
gagcaagaacuagaaaaua

SEQ ID NO: 428928 - RNA, 19 nt, Homo sapiens
cccuuaaauucaucuagua

SEQ ID NO: 428929 - RNA, 19 nt, Homo sapiens
gaggugagacuugcuggaa

SEQ ID NO: 428930 - RNA, 19 nt, Homo sapiens
gaugggaucagcucagcaa

SEQ ID NO: 428931 - RNA, 19 nt, Homo sapiens
gaugagcaagaacuagaaa

SEQ ID NO: 428932 - RNA, 19 nt, Homo sapiens
gaaugaucacucaaacuuc

SEQ ID NO: 428933 - RNA, 19 nt, Homo sapiens
uagcagcaguagcaacuca

SEQ ID NO: 428934 - RNA, 19 nt, Homo sapiens
caaauacaucccuaaugga

SEQ ID NO: 428935 - RNA, 19 nt, Homo sapiens
ccuaccaaccucuacauuu

SEQ ID NO: 428936 - RNA, 19 nt, Homo sapiens
gauuuuauccuucaccaua

SEQ ID NO: 428937 - RNA, 19 nt, Homo sapiens
ggaugagcaagaacuagaa

SEQ ID NO: 428938 - RNA, 19 nt, Homo sapiens
aaugaucacucaaacuucu

SEQ ID NO: 428939 - RNA, 19 nt, Homo sapiens
gaagaccauggcauagaga

SEQ ID NO: 428940 - RNA, 19 nt, Homo sapiens
caaggauacuacgugauuc

SEQ ID NO: 428941 - RNA, 19 nt, Homo sapiens
ccucaaccauauauucuac

SEQ ID NO: 428942 - RNA, 19 nt, Homo sapiens
uauugcaucuccuguaucu

SEQ ID NO: 428943 - RNA, 19 nt, Homo sapiens
ccauuuggacaaguuauuu

SEQ ID NO: 428944 - RNA, 19 nt, Homo sapiens
cgagacgucuaaugaccau

SEQ ID NO: 428945 - RNA, 19 nt, Homo sapiens
cacucaaacuucuauuaca

SEQ ID NO: 428946 - RNA, 19 nt, Homo sapiens
gcuggaaugacacuuacuu

SEQ ID NO: 428947 - RNA, 19 nt, Homo sapiens
aagcuguuauuggucauuu

SEQ ID NO: 428948 - RNA, 19 nt, Homo sapiens
cagcaguaauaacaacagu

SEQ ID NO: 428949 - RNA, 19 nt, Homo sapiens
ucacucaaacuucuauuac

SEQ ID NO: 428950 - RNA, 19 nt, Homo sapiens
aaaauagucuccacaaagg

SEQ ID NO: 428951 - RNA, 19 nt, Homo sapiens
aagcucaaauggcaaagca

SEQ ID NO: 428952 - RNA, 19 nt, Homo sapiens
ccgaacagguuuauuuuag

SEQ ID NO: 428953 - RNA, 19 nt, Homo sapiens
cuaauaaguaacugugaga

SEQ ID NO: 428954 - RNA, 19 nt, Homo sapiens
ucaaccauaugggaaaaua

SEQ ID NO: 428955 - RNA, 19 nt, Homo sapiens
agagacagaacccaaacaa

SEQ ID NO: 428956 - RNA, 19 nt, Homo sapiens
uaggauggaaucaacagaa

SEQ ID NO: 428957 - RNA, 19 nt, Homo sapiens
cuccauggaugagcaagaa

SEQ ID NO: 428958 - RNA, 19 nt, Homo sapiens
ggagccuacuugccacagu

SEQ ID NO: 428959 - RNA, 19 nt, Homo sapiens
ggaacauacaugccugcaa

SEQ ID NO: 428960 - RNA, 19 nt, Homo sapiens
augcaaagguuaugguuuu

SEQ ID NO: 428961 - RNA, 19 nt, Homo sapiens
aaaccauuuggacaaguua

SEQ ID NO: 428962 - RNA, 19 nt, Homo sapiens
gcaaagcaacaggaacaag

SEQ ID NO: 428963 - RNA, 19 nt, Homo sapiens
cuauauugcaucuccugua

SEQ ID NO: 428964 - RNA, 19 nt, Homo sapiens
caaaugcaaagguuauggu

SEQ ID NO: 428965 - RNA, 19 nt, Homo sapiens
gaaagguguucuuacauga

SEQ ID NO: 428966 - RNA, 19 nt, Homo sapiens
ccauauaccuuucaaccua

SEQ ID NO: 428967 - RNA, 19 nt, Homo sapiens
gaaugacacuuacuuacga

SEQ ID NO: 428968 - RNA, 19 nt, Homo sapiens
gacagaacccaaacaaaua

SEQ ID NO: 428969 - RNA, 19 nt, Homo sapiens
gaugcaaccucaaccauau

SEQ ID NO: 428970 - RNA, 19 nt, Homo sapiens
caaguuauuucuacaagga

SEQ ID NO: 428971 - RNA, 19 nt, Homo sapiens
gaagcucugucaaccauau

SEQ ID NO: 428972 - RNA, 19 nt, Homo sapiens
gaucaauugugcuuuagga

SEQ ID NO: 428973 - RNA, 19 nt, Homo sapiens
acaaauacaucccuaaugg

SEQ ID NO: 428974 - RNA, 19 nt, Homo sapiens
gaaccuuuauuguguaagu

SEQ ID NO: 428975 - RNA, 19 nt, Homo sapiens
gcaaaggaaaccagagaaa

SEQ ID NO: 428976 - RNA, 19 nt, Homo sapiens
gaagagugaagaacagaaa

SEQ ID NO: 428977 - RNA, 19 nt, Homo sapiens
caauugugcuuuaggaaau

SEQ ID NO: 428978 - RNA, 19 nt, Homo sapiens
ugugaaggcugaacaauca

SEQ ID NO: 428979 - RNA, 19 nt, Homo sapiens
ggaagaccauggcauagag

SEQ ID NO: 428980 - RNA, 19 nt, Homo sapiens
cuaccaaccucuacauuuc

SEQ ID NO: 428981 - RNA, 19 nt, Homo sapiens
ucugaucaauugugcuuua

SEQ ID NO: 428982 - RNA, 19 nt, Homo sapiens
ggcaaacacugugaacauu

SEQ ID NO: 428983 - RNA, 19 nt, Homo sapiens
ggaugcaaccucaaccaua

SEQ ID NO: 428984 - RNA, 19 nt, Homo sapiens
agacagaacccaaacaaau

SEQ ID NO: 428985 - RNA, 19 nt, Homo sapiens
cauauaccuuucaaccuaa

SEQ ID NO: 428986 - RNA, 19 nt, Homo sapiens
cgaaugaucacucaaacuu

SEQ ID NO: 428987 - RNA, 19 nt, Homo sapiens
gcaaacacugugaacauug

SEQ ID NO: 428988 - RNA, 19 nt, Homo sapiens
cguguuaacucccucaaug

SEQ ID NO: 428989 - RNA, 19 nt, Homo sapiens
uauauugcaucuccuguau

SEQ ID NO: 428990 - RNA, 19 nt, Homo sapiens
gagacuugcuggaaugaca

SEQ ID NO: 428991 - RNA, 19 nt, Homo sapiens
ggugagacuugcuggaaug

SEQ ID NO: 428992 - RNA, 19 nt, Homo sapiens
ggacaaguuauuucuacaa

SEQ ID NO: 428993 - RNA, 19 nt, Homo sapiens
caaagcaacaggaacaaga

SEQ ID NO: 428994 - RNA, 19 nt, Homo sapiens
ggaaaauagucuccacaaa

SEQ ID NO: 428995 - RNA, 19 nt, Homo sapiens
gguguuggcuuugcuagga

SEQ ID NO: 428996 - RNA, 19 nt, Homo sapiens
gcauaaaacccuuaaauuc

SEQ ID NO: 428997 - RNA, 19 nt, Homo sapiens
cuacagcccgcaucaauga

SEQ ID NO: 428998 - RNA, 19 nt, Homo sapiens
gaaggagaggugagacuug

SEQ ID NO: 428999 - RNA, 19 nt, Homo sapiens
auacaucccuaauggaaga

SEQ ID NO: 429000 - RNA, 19 nt, Homo sapiens
cagaaccuuuauuguguaa

SEQ ID NO: 429001 - RNA, 19 nt, Homo sapiens
gcaguaauaacaacaguag

SEQ ID NO: 429002 - RNA, 19 nt, Homo sapiens
caaccucaaccauauauuc

SEQ ID NO: 429003 - RNA, 19 nt, Homo sapiens
gcuacaaaccgaaugauca

SEQ ID NO: 429004 - RNA, 19 nt, Homo sapiens
acagaaccuuuauugugua

SEQ ID NO: 429005 - RNA, 19 nt, Homo sapiens
cuacgugauuccaguggua

SEQ ID NO: 429006 - RNA, 19 nt, Homo sapiens
caaaccgaaugaucacuca

SEQ ID NO: 429007 - RNA, 19 nt, Homo sapiens
acaaggauacuacgugauu

SEQ ID NO: 429008 - RNA, 19 nt, Homo sapiens
gacaaguuauuucuacaag

SEQ ID NO: 429009 - RNA, 19 nt, Homo sapiens
auaaguaacugugagaugu

SEQ ID NO: 429010 - RNA, 19 nt, Homo sapiens
gcaaaacgaaccucuauau

SEQ ID NO: 429011 - RNA, 19 nt, Homo sapiens
ucuauuacacccuauauug

SEQ ID NO: 429012 - RNA, 19 nt, Homo sapiens
caaacaaauacaucccuaa

SEQ ID NO: 429013 - RNA, 19 nt, Homo sapiens
ccucuacauuucuaauuug

SEQ ID NO: 429014 - RNA, 19 nt, Homo sapiens
gaaaauagucuccacaaag

SEQ ID NO: 429015 - RNA, 19 nt, Homo sapiens
gugaagcucugucaaccau

SEQ ID NO: 429016 - RNA, 19 nt, Homo sapiens
aaauacaucccuaauggaa

SEQ ID NO: 429017 - RNA, 19 nt, Homo sapiens
uaaguaacugugagaugua

SEQ ID NO: 429018 - RNA, 19 nt, Homo sapiens
gagacagaacccaaacaaa

SEQ ID NO: 429019 - RNA, 19 nt, Homo sapiens
cagcagauguacccucagu

SEQ ID NO: 429020 - RNA, 19 nt, Homo sapiens
ucaauugugcuuuaggaaa

SEQ ID NO: 429021 - RNA, 19 nt, Homo sapiens
ggaggcaaguggucaacag

SEQ ID NO: 429022 - RNA, 19 nt, Homo sapiens
uaagacaccaccaggaguu

SEQ ID NO: 429023 - RNA, 19 nt, Homo sapiens
gaaaauaugcucaaaccau

SEQ ID NO: 429024 - RNA, 19 nt, Homo sapiens
gcaccaccagcaguaauaa

SEQ ID NO: 429025 - RNA, 19 nt, Homo sapiens
caaacacugugaacauugc

SEQ ID NO: 429026 - RNA, 19 nt, Homo sapiens
gagcacaccaugucacuac

SEQ ID NO: 429027 - RNA, 19 nt, Homo sapiens
caacuacagcugcuauaca

SEQ ID NO: 429028 - RNA, 19 nt, Homo sapiens
ggaaugacacuuacuuacg

SEQ ID NO: 429029 - RNA, 19 nt, Homo sapiens
gaacccaaacaaauacauc

SEQ ID NO: 429030 - RNA, 19 nt, Homo sapiens
ccuuucaaccuaauaagua

SEQ ID NO: 429031 - RNA, 19 nt, Homo sapiens
cuacagcugcuauacagaa

SEQ ID NO: 429032 - RNA, 19 nt, Homo sapiens
aggauggaaucaacagaaa

SEQ ID NO: 429033 - RNA, 19 nt, Homo sapiens
gagcaagaacuagaaaaua

SEQ ID NO: 429034 - RNA, 19 nt, Homo sapiens
cccuuaaauucaucuagua

SEQ ID NO: 429035 - RNA, 19 nt, Homo sapiens
gaggugagacuugcuggaa

SEQ ID NO: 429036 - RNA, 19 nt, Homo sapiens
gaugagcaagaacuagaaa

SEQ ID NO: 429037 - RNA, 19 nt, Homo sapiens
ggaagagugaagaacagaa

SEQ ID NO: 429038 - RNA, 19 nt, Homo sapiens
gaugggaucagcucagcaa

SEQ ID NO: 429039 - RNA, 19 nt, Homo sapiens
gaaugaucacucaaacuuc

SEQ ID NO: 429040 - RNA, 19 nt, Homo sapiens
caaauacaucccuaaugga

SEQ ID NO: 429041 - RNA, 19 nt, Homo sapiens
ccuaccaaccucuacauuu

SEQ ID NO: 429042 - RNA, 19 nt, Homo sapiens
uagcagcaguagcaacuca

SEQ ID NO: 429043 - RNA, 19 nt, Homo sapiens
gauuuuauccuucaccaua

SEQ ID NO: 429044 - RNA, 19 nt, Homo sapiens
ggaugagcaagaacuagaa

SEQ ID NO: 429045 - RNA, 19 nt, Homo sapiens
aaugaucacucaaacuucu

SEQ ID NO: 429046 - RNA, 19 nt, Homo sapiens
gaagaccauggcauagaga

SEQ ID NO: 429047 - RNA, 19 nt, Homo sapiens
caaggauacuacgugauuc

SEQ ID NO: 429048 - RNA, 19 nt, Homo sapiens
gaaaaggaagagugaagaa

SEQ ID NO: 429049 - RNA, 19 nt, Homo sapiens
aaaggaagagugaagaaca

SEQ ID NO: 429050 - RNA, 19 nt, Homo sapiens
ccucaaccauauauucuac

SEQ ID NO: 429051 - RNA, 19 nt, Homo sapiens
ccuaccagguggcaaagga

SEQ ID NO: 429052 - RNA, 19 nt, Homo sapiens
uauugcaucuccuguaucu

SEQ ID NO: 429053 - RNA, 19 nt, Homo sapiens
ccauuuggacaaguuauuu

SEQ ID NO: 429054 - RNA, 19 nt, Homo sapiens
guacgccaccuacuauuac

SEQ ID NO: 429055 - RNA, 19 nt, Homo sapiens
cgagacgucuaaugaccau

SEQ ID NO: 429056 - RNA, 19 nt, Homo sapiens
cacucaaacuucuauuaca

SEQ ID NO: 429057 - RNA, 19 nt, Homo sapiens
gcuggaaugacacuuacuu

SEQ ID NO: 429058 - RNA, 19 nt, Homo sapiens
uguggaaacagcagaugua

SEQ ID NO: 429059 - RNA, 19 nt, Homo sapiens
aagcuguuauuggucauuu

SEQ ID NO: 429060 - RNA, 19 nt, Homo sapiens
cagcaguaauaacaacagu

SEQ ID NO: 429061 - RNA, 19 nt, Homo sapiens
ucacucaaacuucuauuac

SEQ ID NO: 429062 - RNA, 19 nt, Homo sapiens
aagcucaaauggcaaagca

SEQ ID NO: 429063 - RNA, 19 nt, Homo sapiens
aaaauagucuccacaaagg

SEQ ID NO: 429064 - RNA, 19 nt, Homo sapiens
ccgaacagguuuauuuuag

SEQ ID NO: 429065 - RNA, 19 nt, Homo sapiens
gagcuuacaucucccagua

SEQ ID NO: 429066 - RNA, 19 nt, Homo sapiens
gaaaugaauucuuggagau

SEQ ID NO: 429067 - RNA, 19 nt, Homo sapiens
gcaagauuguuuccacuaa

SEQ ID NO: 429068 - RNA, 19 nt, Homo sapiens
cagcagagguguuggcuuu

SEQ ID NO: 429069 - RNA, 19 nt, Homo sapiens
ggacaagaccacaaacaaa

SEQ ID NO: 429070 - RNA, 19 nt, Homo sapiens
ccacagcucuucagaaugg

SEQ ID NO: 429071 - RNA, 19 nt, Homo sapiens
gaaacaacaagaagccaua

SEQ ID NO: 429072 - RNA, 19 nt, Homo sapiens
gaaaugaccagcugagcaa

SEQ ID NO: 429073 - RNA, 19 nt, Homo sapiens
ucagacaucuccucuacaa

SEQ ID NO: 429074 - RNA, 19 nt, Homo sapiens
gcuauggcuuuguagauuu

SEQ ID NO: 429075 - RNA, 19 nt, Homo sapiens
gaacaggaccccacaaauu

SEQ ID NO: 429076 - RNA, 19 nt, Homo sapiens
gacaucuccucuacaagua

SEQ ID NO: 429077 - RNA, 19 nt, Homo sapiens
caccacagcucuucagaau

SEQ ID NO: 429078 - RNA, 19 nt, Homo sapiens
ggucuauucuuuccaguuc

SEQ ID NO: 429079 - RNA, 19 nt, Homo sapiens
gacaagaccacaaacaaau

SEQ ID NO: 429080 - RNA, 19 nt, Homo sapiens
ggaugcaccaccauucaua

SEQ ID NO: 429081 - RNA, 19 nt, Homo sapiens
gguguuggcuuugcaagga

SEQ ID NO: 429082 - RNA, 19 nt, Homo sapiens
caagaagccauauguguca

SEQ ID NO: 429083 - RNA, 19 nt, Homo sapiens
gccaaggaaugcagacaug

SEQ ID NO: 429084 - RNA, 19 nt, Homo sapiens
ggcuauggcuuuguagauu

SEQ ID NO: 429085 - RNA, 19 nt, Homo sapiens
caucaucacccacuuuaau

SEQ ID NO: 429086 - RNA, 19 nt, Homo sapiens
ccauauggcaagauuguuu

SEQ ID NO: 429087 - RNA, 19 nt, Homo sapiens
gagagcagcggccaacaga

SEQ ID NO: 429088 - RNA, 19 nt, Homo sapiens
ccagaggguuaaccaggaa

SEQ ID NO: 429089 - RNA, 19 nt, Homo sapiens
gaaacgacagaaccaagga

SEQ ID NO: 429090 - RNA, 19 nt, Homo sapiens
gccaucaucacccacuuua

SEQ ID NO: 429091 - RNA, 19 nt, Homo sapiens
ccacaaauuuauacaucuc

SEQ ID NO: 429092 - RNA, 19 nt, Homo sapiens
ccaagcaacaguacaccua

SEQ ID NO: 429093 - RNA, 19 nt, Homo sapiens
ccaccuagcccaagcaaca

SEQ ID NO: 429094 - RNA, 19 nt, Homo sapiens
caagauuguuuccacuaag

SEQ ID NO: 429095 - RNA, 19 nt, Homo sapiens
caacaagaagccauaugug

SEQ ID NO: 429096 - RNA, 19 nt, Homo sapiens
caagcaacaguacaccuaa

SEQ ID NO: 429097 - RNA, 19 nt, Homo sapiens
gcuuacaucucccaguaca

SEQ ID NO: 429098 - RNA, 19 nt, Homo sapiens
gaccacaaacaaauguaaa

SEQ ID NO: 429099 - RNA, 19 nt, Homo sapiens
ccuaacagcaguaguggaa

SEQ ID NO: 429100 - RNA, 19 nt, Homo sapiens
uuccugcccuuuacuauug

SEQ ID NO: 429101 - RNA, 19 nt, Homo sapiens
ggacgcacccucagagcau

SEQ ID NO: 429102 - RNA, 19 nt, Homo sapiens
ucacccacuuuaauggaaa

SEQ ID NO: 429103 - RNA, 19 nt, Homo sapiens
agacaucuccucuacaagu

SEQ ID NO: 429104 - RNA, 19 nt, Homo sapiens
ccucuccugugucuucgua

SEQ ID NO: 429105 - RNA, 19 nt, Homo sapiens
caaagaaacgacagaacca

SEQ ID NO: 429106 - RNA, 19 nt, Homo sapiens
gaagcccuuuggccagguu

SEQ ID NO: 429107 - RNA, 19 nt, Homo sapiens
gucaauggaugagcaggaa

SEQ ID NO: 429108 - RNA, 19 nt, Homo sapiens
caagaccacaaacaaaugu

SEQ ID NO: 429109 - RNA, 19 nt, Homo sapiens
cagcagauggcaccaccua

SEQ ID NO: 429110 - RNA, 19 nt, Homo sapiens
cauccgaucccuugcuuug

SEQ ID NO: 429111 - RNA, 19 nt, Homo sapiens
caauagaaacaacaagaag

SEQ ID NO: 429112 - RNA, 19 nt, Homo sapiens
gcagagguguuggcuuugc

SEQ ID NO: 429113 - RNA, 19 nt, Homo sapiens
gagcagcggccaacagaac

SEQ ID NO: 429114 - RNA, 19 nt, Homo sapiens
acucagacaucuccucuac

SEQ ID NO: 429115 - RNA, 19 nt, Homo sapiens
gaagugugaagccaucauc

SEQ ID NO: 429116 - RNA, 19 nt, Homo sapiens
acaacaagaagccauaugu

SEQ ID NO: 429117 - RNA, 19 nt, Homo sapiens
gcagcacaggcacguauau

SEQ ID NO: 429118 - RNA, 19 nt, Homo sapiens
ggcaagauuguuuccacua

SEQ ID NO: 429119 - RNA, 19 nt, Homo sapiens
cagcaguaguggaagcaau

SEQ ID NO: 429120 - RNA, 19 nt, Homo sapiens
aggcacagauggcaaagca

SEQ ID NO: 429121 - RNA, 19 nt, Homo sapiens
gcacuacugaccaagaucu

SEQ ID NO: 429122 - RNA, 19 nt, Homo sapiens
cuacguuccugcccuuuac

SEQ ID NO: 429123 - RNA, 19 nt, Homo sapiens
gagcaaaaccaaccuauac

SEQ ID NO: 429124 - RNA, 19 nt, Homo sapiens
uaacacuuagccaucguuu

SEQ ID NO: 429125 - RNA, 19 nt, Homo sapiens
cuaaggccauacuggacaa

SEQ ID NO: 429126 - RNA, 19 nt, Homo sapiens
guaguggaagcaauggaaa

SEQ ID NO: 429127 - RNA, 19 nt, Homo sapiens
cagcagcacaggcacguau

SEQ ID NO: 429128 - RNA, 19 nt, Homo sapiens
caugcagccuucagguuca

SEQ ID NO: 429129 - RNA, 19 nt, Homo sapiens
agaccacaaacaaauguaa

SEQ ID NO: 429130 - RNA, 19 nt, Homo sapiens
gauggcaaagcaacaggaa

SEQ ID NO: 429131 - RNA, 19 nt, Homo sapiens
gugcuacauucaaggagau

SEQ ID NO: 429132 - RNA, 19 nt, Homo sapiens
guuccugcccuuuacuauu

SEQ ID NO: 429133 - RNA, 19 nt, Homo sapiens
ucaaaccucccacugucaa

SEQ ID NO: 429134 - RNA, 19 nt, Homo sapiens
acaagaccacaaacaaaug

SEQ ID NO: 429135 - RNA, 19 nt, Homo sapiens
acaccuaacagcaguagug

SEQ ID NO: 429136 - RNA, 19 nt, Homo sapiens
gcuacaauagaaacaacaa

SEQ ID NO: 429137 - RNA, 19 nt, Homo sapiens
acaaguaacagugggauuc

SEQ ID NO: 429138 - RNA, 19 nt, Homo sapiens
uaccuuuccucuccugugu

SEQ ID NO: 429139 - RNA, 19 nt, Homo sapiens
ccaccacagcucuucagaa

SEQ ID NO: 429140 - RNA, 19 nt, Homo sapiens
aacaagaagccauaugugu

SEQ ID NO: 429141 - RNA, 19 nt, Homo sapiens
ucuauucuuuccaguucaa

SEQ ID NO: 429142 - RNA, 19 nt, Homo sapiens
gugccuucuuccaguguuu

SEQ ID NO: 429143 - RNA, 19 nt, Homo sapiens
uggacaagaccacaaacaa

SEQ ID NO: 429144 - RNA, 19 nt, Homo sapiens
uggcaaagcaacaggaaca

SEQ ID NO: 429145 - RNA, 19 nt, Homo sapiens
gucacuggcucagcagaug

SEQ ID NO: 429146 - RNA, 19 nt, Homo sapiens
auacucaugcucccagauu

SEQ ID NO: 429147 - RNA, 19 nt, Homo sapiens
cuuuccaguucaacaagua

SEQ ID NO: 429148 - RNA, 19 nt, Homo sapiens
caggaugcuugcucagucu

SEQ ID NO: 429149 - RNA, 19 nt, Homo sapiens
caucacccacuuuaaugga

SEQ ID NO: 429150 - RNA, 19 nt, Homo sapiens
ggauugcaaccaggcacua

SEQ ID NO: 429151 - RNA, 19 nt, Homo sapiens
ccagauuccagaggguuaa

SEQ ID NO: 429152 - RNA, 19 nt, Homo sapiens
aaacaacaagaagccauau

SEQ ID NO: 429153 - RNA, 19 nt, Homo sapiens
aagauuguuuccacuaagg

SEQ ID NO: 429154 - RNA, 19 nt, Homo sapiens
ggagagagguagauacuaa

SEQ ID NO: 429155 - RNA, 19 nt, Homo sapiens
gagaugcacuucagagaua

SEQ ID NO: 429156 - RNA, 19 nt, Homo sapiens
ccaaagauaugaauggaaa

SEQ ID NO: 429157 - RNA, 19 nt, Homo sapiens
caacaagacaugaugguua

SEQ ID NO: 429158 - RNA, 19 nt, Homo sapiens
caaguuauguggcaucuau

SEQ ID NO: 429159 - RNA, 19 nt, Homo sapiens
gagaaaugaucgcauguca

SEQ ID NO: 429160 - RNA, 19 nt, Homo sapiens
uaagaaugcugccaaagau

SEQ ID NO: 429161 - RNA, 19 nt, Homo sapiens
ggaugaaaguuauucuaga

SEQ ID NO: 429162 - RNA, 19 nt, Homo sapiens
caucgaaguucccgagaaa

SEQ ID NO: 429163 - RNA, 19 nt, Homo sapiens
gauauuaaagcaagcauug

SEQ ID NO: 429164 - RNA, 19 nt, Homo sapiens
guaauacacgagauagaua

SEQ ID NO: 429165 - RNA, 19 nt, Homo sapiens
ggaugaacauuccucuaga

SEQ ID NO: 429166 - RNA, 19 nt, Homo sapiens
gaugaaaguuauucuagag

SEQ ID NO: 429167 - RNA, 19 nt, Homo sapiens
ggaugaacauuccucuaga

SEQ ID NO: 429168 - RNA, 19 nt, Homo sapiens
gcaagaagcaauaguugga

SEQ ID NO: 429169 - RNA, 19 nt, Homo sapiens
ccaaugagaagaugcuuaa

SEQ ID NO: 429170 - RNA, 19 nt, Homo sapiens
gcagaaguugggagaguua

SEQ ID NO: 429171 - RNA, 19 nt, Homo sapiens
gaaaugaucgcaugucaac

SEQ ID NO: 429172 - RNA, 19 nt, Homo sapiens
uaacuuccuccaugaauuu

SEQ ID NO: 429173 - RNA, 19 nt, Homo sapiens
gaacaucuaaguggaaguu

SEQ ID NO: 429174 - RNA, 19 nt, Homo sapiens
gaaaguuauucuagaggau

SEQ ID NO: 429175 - RNA, 19 nt, Homo sapiens
gaaaguuauucuagaggau

SEQ ID NO: 429176 - RNA, 19 nt, Homo sapiens
cauccaaguugccaagaaa

SEQ ID NO: 429177 - RNA, 19 nt, Homo sapiens
cgagauagauauggcagaa

SEQ ID NO: 429178 - RNA, 19 nt, Homo sapiens
gcauaccaauccuuguuug

SEQ ID NO: 429179 - RNA, 19 nt, Homo sapiens
caaagaagagagaauuaug

SEQ ID NO: 429180 - RNA, 19 nt, Homo sapiens
cauccaaguucccgagaaa

SEQ ID NO: 429181 - RNA, 19 nt, Homo sapiens
ggccauggauaccgugauu

SEQ ID NO: 429182 - RNA, 19 nt, Homo sapiens
uccagaggcuuugcauuua

SEQ ID NO: 429183 - RNA, 19 nt, Homo sapiens
cagcaaauccagaggcuuu

SEQ ID NO: 429184 - RNA, 19 nt, Homo sapiens
gcauauuacugaaagaaac

SEQ ID NO: 429185 - RNA, 19 nt, Homo sapiens
gagacucgagcagauauua

SEQ ID NO: 429186 - RNA, 19 nt, Homo sapiens
cgucgaaguucccgagaaa

SEQ ID NO: 429187 - RNA, 19 nt, Homo sapiens
ggauauagaaaucaucgaa

SEQ ID NO: 429188 - RNA, 19 nt, Homo sapiens
gccaagaaacgagggauua

SEQ ID NO: 429189 - RNA, 19 nt, Homo sapiens
ccagaggcuuugcauuuau

SEQ ID NO: 429190 - RNA, 19 nt, Homo sapiens
guagagaucauucugaaca

SEQ ID NO: 429191 - RNA, 19 nt, Homo sapiens
gcagagcgacaauaucuuc

SEQ ID NO: 429192 - RNA, 19 nt, Homo sapiens
agagguagauacuaacuuc

SEQ ID NO: 429193 - RNA, 19 nt, Homo sapiens
ggucccaugucacaaagaa

SEQ ID NO: 429194 - RNA, 19 nt, Homo sapiens
ggauuaugcuccaccaucu

SEQ ID NO: 429195 - RNA, 19 nt, Homo sapiens
ggauuaugcuccaccaucu

SEQ ID NO: 429196 - RNA, 19 nt, Homo sapiens
ucacaaagaagagagaauu

SEQ ID NO: 429197 - RNA, 19 nt, Homo sapiens
cgacaugaaaguuauucua

SEQ ID NO: 429198 - RNA, 19 nt, Homo sapiens
cagaggcuuugcauuuauu

SEQ ID NO: 429199 - RNA, 19 nt, Homo sapiens
auacuaacuuccuccauga

SEQ ID NO: 429200 - RNA, 19 nt, Homo sapiens
cauuguuaccugcauauua

SEQ ID NO: 429201 - RNA, 19 nt, Homo sapiens
cuaacuuccuccaugaauu

SEQ ID NO: 429202 - RNA, 19 nt, Homo sapiens
ggaaguucuuauagagaug

SEQ ID NO: 429203 - RNA, 19 nt, Homo sapiens
auacagaaaucgucgaagu

SEQ ID NO: 429204 - RNA, 19 nt, Homo sapiens
aacaagacaugaugguuau

SEQ ID NO: 429205 - RNA, 19 nt, Homo sapiens
cacaaagaagagagaauua

SEQ ID NO: 429206 - RNA, 19 nt, Homo sapiens
caaggucccaugucacaaa

SEQ ID NO: 429207 - RNA, 19 nt, Homo sapiens
gaacaagccaagaaaccau

SEQ ID NO: 429208 - RNA, 19 nt, Homo sapiens
cuaagaaugcugccaaaga

SEQ ID NO: 429209 - RNA, 19 nt, Homo sapiens
gaugaacauuccucuagag

SEQ ID NO: 429210 - RNA, 19 nt, Homo sapiens
caugaaaguuauucuagag

SEQ ID NO: 429211 - RNA, 19 nt, Homo sapiens
gaugaacauuccucuagag

SEQ ID NO: 429212 - RNA, 19 nt, Homo sapiens
aaaggagacucgagcagau

SEQ ID NO: 429213 - RNA, 19 nt, Homo sapiens
ggauuaugcuccaccacau

SEQ ID NO: 429214 - RNA, 19 nt, Homo sapiens
ggccaugcauaccgugauu

SEQ ID NO: 429215 - RNA, 19 nt, Homo sapiens
gaucgcaugucaacaagac

SEQ ID NO: 429216 - RNA, 19 nt, Homo sapiens
ccacgcagagcgacaauau

SEQ ID NO: 429217 - RNA, 19 nt, Homo sapiens
gagaaaccaaugagaagau

SEQ ID NO: 429218 - RNA, 19 nt, Homo sapiens
ccacgcauauaguaauaca

SEQ ID NO: 429219 - RNA, 19 nt, Homo sapiens
gggaugaacauuccucuag

SEQ ID NO: 429220 - RNA, 19 nt, Homo sapiens
gggaugaacauuccucuag

SEQ ID NO: 429221 - RNA, 19 nt, Homo sapiens
caacuaacgauggaaauca

SEQ ID NO: 429222 - RNA, 19 nt, Homo sapiens
gggacucauuccaguuaaa

SEQ ID NO: 429223 - RNA, 19 nt, Homo sapiens
gaagggcaccuggaugaug

SEQ ID NO: 429224 - RNA, 19 nt, Homo sapiens
aagagagaauuauggaguu

SEQ ID NO: 429225 - RNA, 19 nt, Homo sapiens
gcaccugccacgcauauag

SEQ ID NO: 429226 - RNA, 19 nt, Homo sapiens
ugguagagaucauucugaa

SEQ ID NO: 429227 - RNA, 19 nt, Homo sapiens
gacuaugcauaccgugauu

SEQ ID NO: 429228 - RNA, 19 nt, Homo sapiens
gacaugaaaguuauucuag

SEQ ID NO: 429229 - RNA, 19 nt, Homo sapiens
ccgagaaacuagggauuau

SEQ ID NO: 429230 - RNA, 19 nt, Homo sapiens
gaucauccuggcaagcuuu

SEQ ID NO: 429231 - RNA, 19 nt, Homo sapiens
ggcuaugcauaccgugaua

SEQ ID NO: 429232 - RNA, 19 nt, Homo sapiens
agauagauauggcagaagu

SEQ ID NO: 429233 - RNA, 19 nt, Homo sapiens
gggaugaaaguuauucuag

SEQ ID NO: 429234 - RNA, 19 nt, Homo sapiens
uaaagcaguauuugggaaa

SEQ ID NO: 429235 - RNA, 19 nt, Homo sapiens
uuauguggcaucuauagua

SEQ ID NO: 429236 - RNA, 19 nt, Homo sapiens
gugagcauguuugcagaaa

SEQ ID NO: 429237 - RNA, 19 nt, Homo sapiens
ugccacgcauauaguaaua

SEQ ID NO: 429238 - RNA, 19 nt, Homo sapiens
ccgagaaacuagggaguau

SEQ ID NO: 429239 - RNA, 19 nt, Homo sapiens
uaaaggaucgaaccagcaa

SEQ ID NO: 429240 - RNA, 19 nt, Homo sapiens
caugaugguuaugcaacua

SEQ ID NO: 429241 - RNA, 19 nt, Homo sapiens
aagccaaggucccauguca

SEQ ID NO: 429242 - RNA, 19 nt, Homo sapiens
gacucgagcagauauuaaa

SEQ ID NO: 429243 - RNA, 19 nt, Homo sapiens
uggaaguucuuauagagau

SEQ ID NO: 429244 - RNA, 19 nt, Homo sapiens
gauuauggucauucuaguu

SEQ ID NO: 429245 - RNA, 19 nt, Homo sapiens
ggaagucugagaucugcaa

SEQ ID NO: 429246 - RNA, 19 nt, Homo sapiens
ggagaccaccagcuucuuc

SEQ ID NO: 429247 - RNA, 19 nt, Homo sapiens
uaccaauccuuguuugcaa

SEQ ID NO: 429248 - RNA, 19 nt, Homo sapiens
ggcagaaguugggagaguu

SEQ ID NO: 429249 - RNA, 19 nt, Homo sapiens
ggauacagaaaucgucgaa

SEQ ID NO: 429250 - RNA, 19 nt, Homo sapiens
ucuagaggauacagaaauc

SEQ ID NO: 429251 - RNA, 19 nt, Homo sapiens
gagaaacuagggauuaugc

SEQ ID NO: 429252 - RNA, 19 nt, Homo sapiens
uauguggcaucuauaguag

SEQ ID NO: 429253 - RNA, 19 nt, Homo sapiens
aaguggaaguucuuauaga

SEQ ID NO: 429254 - RNA, 19 nt, Homo sapiens
gagacaagcuccagugugu

SEQ ID NO: 429255 - RNA, 19 nt, Homo sapiens
gcaagcaaguauucaagaa

SEQ ID NO: 429256 - RNA, 19 nt, Homo sapiens
aaacaaagccaugccaaua

SEQ ID NO: 429257 - RNA, 19 nt, Homo sapiens
ggaacuacaucauggacuu

SEQ ID NO: 429258 - RNA, 19 nt, Homo sapiens
ccaauaaagugaccugugu

SEQ ID NO: 429259 - RNA, 19 nt, Homo sapiens
gcaggacggugaccauaug

SEQ ID NO: 429260 - RNA, 19 nt, Homo sapiens
aaagugaccuguguucaaa

SEQ ID NO: 429261 - RNA, 19 nt, Homo sapiens
acaaagccaugccaauaaa

SEQ ID NO: 429262 - RNA, 19 nt, Homo sapiens
gugaugagcugcaccuaga

SEQ ID NO: 429263 - RNA, 19 nt, Homo sapiens
gcaagugcaugacaacagu

SEQ ID NO: 429264 - RNA, 19 nt, Homo sapiens
gagccaggaucccucuuug

SEQ ID NO: 429265 - RNA, 19 nt, Homo sapiens
gagucugucucuuggcuuu

SEQ ID NO: 429266 - RNA, 19 nt, Homo sapiens
uaaagugaccuguguucaa

SEQ ID NO: 429267 - RNA, 19 nt, Homo sapiens
cgaaaugccagucgacuuc

SEQ ID NO: 429268 - RNA, 19 nt, Homo sapiens
caaccaaucagcaggaugu

SEQ ID NO: 429269 - RNA, 19 nt, Homo sapiens
gagcugcaccuagagauga

SEQ ID NO: 429270 - RNA, 19 nt, Homo sapiens
gaccgcaagugcaugacaa

SEQ ID NO: 429271 - RNA, 19 nt, Homo sapiens
aacaaagccaugccaauaa

SEQ ID NO: 429272 - RNA, 19 nt, Homo sapiens
acgagaauuucgaggagua

SEQ ID NO: 429273 - RNA, 19 nt, Homo sapiens
ggacggugaccauaugauc

SEQ ID NO: 429274 - RNA, 19 nt, Homo sapiens
gaugaccgcaagugcauga

SEQ ID NO: 429275 - RNA, 19 nt, Homo sapiens
gaaggaguuugaggaggau

SEQ ID NO: 429276 - RNA, 19 nt, Homo sapiens
uccagucacucccgaaaug

SEQ ID NO: 429277 - RNA, 19 nt, Homo sapiens
gaagccagacaaagagauc

SEQ ID NO: 429278 - RNA, 19 nt, Homo sapiens
ucucuuggcuuugucacuu

SEQ ID NO: 429279 - RNA, 19 nt, Homo sapiens
ggucugcaagcaaguauuc

SEQ ID NO: 429280 - RNA, 19 nt, Homo sapiens
gagcugggacggagacaag

SEQ ID NO: 429281 - RNA, 19 nt, Homo sapiens
caauguggccuugcgcaaa

SEQ ID NO: 429282 - RNA, 19 nt, Homo sapiens
uggaagguguggucugcaa

SEQ ID NO: 429283 - RNA, 19 nt, Homo sapiens
gaugagcugcaccuagaga

SEQ ID NO: 429284 - RNA, 19 nt, Homo sapiens
gaaaugccagucgacuuca

SEQ ID NO: 429285 - RNA, 19 nt, Homo sapiens
gaacuacaucauggacuuc

SEQ ID NO: 429286 - RNA, 19 nt, Homo sapiens
caauaaagugaccuguguu

SEQ ID NO: 429287 - RNA, 19 nt, Homo sapiens
gcauagaugaccgcaagug

SEQ ID NO: 429288 - RNA, 19 nt, Homo sapiens
acuggaagauguuggucaa

SEQ ID NO: 429289 - RNA, 19 nt, Homo sapiens
gugcaggacggugaccaua

SEQ ID NO: 429290 - RNA, 19 nt, Homo sapiens
gccaggaucccucuuugca

SEQ ID NO: 429291 - RNA, 19 nt, Homo sapiens
caagcaaguauucaagaag

SEQ ID NO: 429292 - RNA, 19 nt, Homo sapiens
gacggugaccauaugauca

SEQ ID NO: 429293 - RNA, 19 nt, Homo sapiens
gcugaagccagacaaagag

SEQ ID NO: 429294 - RNA, 19 nt, Homo sapiens
ugagccaggaucccucuuu

SEQ ID NO: 429295 - RNA, 19 nt, Homo sapiens
ggcccaagcagacaaccuu

SEQ ID NO: 429296 - RNA, 19 nt, Homo sapiens
gcuccagucacucccgaaa

SEQ ID NO: 429297 - RNA, 19 nt, Homo sapiens
ggauuucacuguuggagua

SEQ ID NO: 429298 - RNA, 19 nt, Homo sapiens
gaguagaguuugacgagua

SEQ ID NO: 429299 - RNA, 19 nt, Homo sapiens
ggugauaacuucaagacaa

SEQ ID NO: 429300 - RNA, 19 nt, Homo sapiens
agacgaagguuauugauca

SEQ ID NO: 429301 - RNA, 19 nt, Homo sapiens
ugaaggcccuggauauuga

SEQ ID NO: 429302 - RNA, 19 nt, Homo sapiens
gcacauuccgcaacuauga

SEQ ID NO: 429303 - RNA, 19 nt, Homo sapiens
gcaacuaugauguggauuu

SEQ ID NO: 429304 - RNA, 19 nt, Homo sapiens
ccugggagauggagaguaa

SEQ ID NO: 429305 - RNA, 19 nt, Homo sapiens
gugauaacuucaagacaaa

SEQ ID NO: 429306 - RNA, 19 nt, Homo sapiens
gaagguuauugaucaagau

SEQ ID NO: 429307 - RNA, 19 nt, Homo sapiens
gauguggauuucacuguug

SEQ ID NO: 429308 - RNA, 19 nt, Homo sapiens
caacuaugauguggauuuc

SEQ ID NO: 429309 - RNA, 19 nt, Homo sapiens
ucaagauggugauaacuuc

SEQ ID NO: 429310 - RNA, 19 nt, Homo sapiens
cgaagguuauugaucaaga

SEQ ID NO: 429311 - RNA, 19 nt, Homo sapiens
ggagaguaaugaaaacuuu

SEQ ID NO: 429312 - RNA, 19 nt, Homo sapiens
ggagauggagaguaaugaa

SEQ ID NO: 429313 - RNA, 19 nt, Homo sapiens
gagauggagaguaaugaaa

SEQ ID NO: 429314 - RNA, 19 nt, Homo sapiens
gaauggaaccugggagaug

SEQ ID NO: 429315 - RNA, 19 nt, Homo sapiens
gaccaggugugccgucaag

SEQ ID NO: 429316 - RNA, 19 nt, Homo sapiens
cuggacaaccggcauguua

SEQ ID NO: 429317 - RNA, 19 nt, Homo sapiens
gacgaagguuauugaucaa

SEQ ID NO: 429318 - RNA, 19 nt, Homo sapiens
ggugugccgucaaguguuc

SEQ ID NO: 429319 - RNA, 19 nt, Homo sapiens
ugauguggauuucacuguu

SEQ ID NO: 429320 - RNA, 19 nt, Homo sapiens
gugauguccuugugugugu

SEQ ID NO: 429321 - RNA, 19 nt, Homo sapiens
ggacaaccggcauguuaag

SEQ ID NO: 429322 - RNA, 19 nt, Homo sapiens
caugaaggcccuggauauu

SEQ ID NO: 429323 - RNA, 19 nt, Homo sapiens
gcuggaagcaguggauuga

SEQ ID NO: 429324 - RNA, 19 nt, Homo sapiens
acacaaagagccuggacaa

SEQ ID NO: 429325 - RNA, 19 nt, Homo sapiens
ccgcaacuaugauguggau

SEQ ID NO: 429326 - RNA, 19 nt, Homo sapiens
uuacucagacgaagguuau

SEQ ID NO: 429327 - RNA, 19 nt, Homo sapiens
gguuauugaucaagauggu

SEQ ID NO: 429328 - RNA, 19 nt, Homo sapiens
acaugaaggcccuggauau

SEQ ID NO: 429329 - RNA, 19 nt, Homo sapiens
uagcacauuccgcaacuau

SEQ ID NO: 429330 - RNA, 19 nt, Homo sapiens
caagauggugauaacuuca

SEQ ID NO: 429331 - RNA, 19 nt, Homo sapiens
aaacuuugagggcuacaug

SEQ ID NO: 429332 - RNA, 19 nt, Homo sapiens
uacaugaaggcccuggaua

SEQ ID NO: 429333 - RNA, 19 nt, Homo sapiens
uggacaaccggcauguuaa

SEQ ID NO: 429334 - RNA, 19 nt, Homo sapiens
gggagauggagaguaauga

SEQ ID NO: 429335 - RNA, 19 nt, Homo sapiens
ccaggugugccgucaagug

SEQ ID NO: 429336 - RNA, 19 nt, Homo sapiens
gagcacaucuggaagaaga

SEQ ID NO: 429337 - RNA, 19 nt, Homo sapiens
gagcgaagcccuuuccaua

SEQ ID NO: 429338 - RNA, 19 nt, Homo sapiens
ggacaacauuggcuacuug

SEQ ID NO: 429339 - RNA, 19 nt, Homo sapiens
gcaccuguauucugucuuu

SEQ ID NO: 429340 - RNA, 19 nt, Homo sapiens
gagcucaccuaccuuauug

SEQ ID NO: 429341 - RNA, 19 nt, Homo sapiens
ggacaaagcccaggaagug

SEQ ID NO: 429342 - RNA, 19 nt, Homo sapiens
ggaagcugguggcugauaa

SEQ ID NO: 429343 - RNA, 19 nt, Homo sapiens
gcugguggcugauaacuau

SEQ ID NO: 429344 - RNA, 19 nt, Homo sapiens
gcacacggaugccaugauc

SEQ ID NO: 429345 - RNA, 19 nt, Homo sapiens
gcugagcucugguuagguu

SEQ ID NO: 429346 - RNA, 19 nt, Homo sapiens
gcggaggaguucaccuaua

SEQ ID NO: 429347 - RNA, 19 nt, Homo sapiens
gaccaccgcuugcuagugu

SEQ ID NO: 429348 - RNA, 19 nt, Homo sapiens
ggaguucgccuuccuuaug

SEQ ID NO: 429349 - RNA, 19 nt, Homo sapiens
gaggagcucaccuaccuua

SEQ ID NO: 429350 - RNA, 19 nt, Homo sapiens
ggacaucgcgcacauccuu

SEQ ID NO: 429351 - RNA, 19 nt, Homo sapiens
gaguucaccuauaucauga

SEQ ID NO: 429352 - RNA, 19 nt, Homo sapiens
ggaguucaccuauaucaug

SEQ ID NO: 429353 - RNA, 19 nt, Homo sapiens
gcucugcuccuacuucuuu

SEQ ID NO: 429354 - RNA, 19 nt, Homo sapiens
cggaggaguucaccuauau

SEQ ID NO: 429355 - RNA, 19 nt, Homo sapiens
gaugaaggcccuccaguuc

SEQ ID NO: 429356 - RNA, 19 nt, Homo sapiens
gcuccuacuucuuugauga

SEQ ID NO: 429357 - RNA, 19 nt, Homo sapiens
ucagaugcagcuaucauua

SEQ ID NO: 429358 - RNA, 19 nt, Homo sapiens
gguuguaggugaacgcuau

SEQ ID NO: 429359 - RNA, 19 nt, Homo sapiens
ggagcucaccuaccuuauu

SEQ ID NO: 429360 - RNA, 19 nt, Homo sapiens
agaugcagcuaucauuauu

SEQ ID NO: 429361 - RNA, 19 nt, Homo sapiens
cuggagguguguauauaua

SEQ ID NO: 429362 - RNA, 19 nt, Homo sapiens
gccagcaccuguauucugu

SEQ ID NO: 429363 - RNA, 19 nt, Homo sapiens
ccacggagaucuggaccuu

SEQ ID NO: 429364 - RNA, 19 nt, Homo sapiens
ucaccagccucucagaaga

SEQ ID NO: 429365 - RNA, 19 nt, Homo sapiens
uuauauacccgagccauua

SEQ ID NO: 429366 - RNA, 19 nt, Homo sapiens
gcagcuaucauuauuccaa

SEQ ID NO: 429367 - RNA, 19 nt, Homo sapiens
ucaccuauaucaugaagag

SEQ ID NO: 429368 - RNA, 19 nt, Homo sapiens
caagauggccaccaaacug

SEQ ID NO: 429369 - RNA, 19 nt, Homo sapiens
gccaugagauucugagcau

SEQ ID NO: 429370 - RNA, 19 nt, Homo sapiens
cagcuaucauuauuccaaa

SEQ ID NO: 429371 - RNA, 19 nt, Homo sapiens
cagaggagcucaccuaccu

SEQ ID NO: 429372 - RNA, 19 nt, Homo sapiens
caucaagagccaugagauu

SEQ ID NO: 429373 - RNA, 19 nt, Homo sapiens
gcgaagcccuuuccauagc

SEQ ID NO: 429374 - RNA, 19 nt, Homo sapiens
ggacacacgcccagguugu

SEQ ID NO: 429375 - RNA, 19 nt, Homo sapiens
uaccugcgcuucgauaguu

SEQ ID NO: 429376 - RNA, 19 nt, Homo sapiens
gaggaguucaccuauauca

SEQ ID NO: 429377 - RNA, 19 nt, Homo sapiens
ucagugaacucuggacaca

SEQ ID NO: 429378 - RNA, 19 nt, Homo sapiens
ugaaggcccuccaguucug

SEQ ID NO: 429379 - RNA, 19 nt, Homo sapiens
gcagaucccuuccccugaa

SEQ ID NO: 429380 - RNA, 19 nt, Homo sapiens
gaauugugcccaugcagau

SEQ ID NO: 429381 - RNA, 19 nt, Homo sapiens
gggcugaccugcagaugcu

SEQ ID NO: 429382 - RNA, 19 nt, Homo sapiens
caugggcaccuccgccuua

SEQ ID NO: 429383 - RNA, 19 nt, Homo sapiens
gcacguggacacuaucuac

SEQ ID NO: 429384 - RNA, 19 nt, Homo sapiens
cuugagguuugacauguuu

SEQ ID NO: 429385 - RNA, 19 nt, Homo sapiens
cuaacgugcuugaggacaa

SEQ ID NO: 429386 - RNA, 19 nt, Homo sapiens
cggagcaccucaucaugga

SEQ ID NO: 429387 - RNA, 19 nt, Homo sapiens
cgcuauggcuccaagaaga

SEQ ID NO: 429388 - RNA, 19 nt, Homo sapiens
caagagccaugagauucug

SEQ ID NO: 429389 - RNA, 19 nt, Homo sapiens
gcccauaucccugagaaug

SEQ ID NO: 429390 - RNA, 19 nt, Homo sapiens
gaucgccgcaccaacauca

SEQ ID NO: 429391 - RNA, 19 nt, Homo sapiens
cagaugcagcuaucauuau

SEQ ID NO: 429392 - RNA, 19 nt, Homo sapiens
uggagucucuggccucuca

SEQ ID NO: 429393 - RNA, 19 nt, Homo sapiens
ucaccuucaucgacaauca

SEQ ID NO: 429394 - RNA, 19 nt, Homo sapiens
ggacacggagcaccucauc

SEQ ID NO: 429395 - RNA, 19 nt, Homo sapiens
ccacaagucccagcacuca

SEQ ID NO: 429396 - RNA, 19 nt, Homo sapiens
cagcccauaucccugagaa

SEQ ID NO: 429397 - RNA, 19 nt, Homo sapiens
acacaaggaccucuacauc

SEQ ID NO: 429398 - RNA, 19 nt, Homo sapiens
gaagagcugaucaaguuuu

SEQ ID NO: 429399 - RNA, 19 nt, Homo sapiens
cgaggaggcccuggacaaa

SEQ ID NO: 429400 - RNA, 19 nt, Homo sapiens
gcagagcucccugaacgau

SEQ ID NO: 429401 - RNA, 19 nt, Homo sapiens
guacggugccgacaaggau

SEQ ID NO: 429402 - RNA, 19 nt, Homo sapiens
uauauacccgagccauuaa

SEQ ID NO: 429403 - RNA, 19 nt, Homo sapiens
gaacuuggggugguauuuu

SEQ ID NO: 429404 - RNA, 19 nt, Homo sapiens
aagaagagcauggucauuc

SEQ ID NO: 429405 - RNA, 19 nt, Homo sapiens
gacacacgcccagguugua

SEQ ID NO: 429406 - RNA, 19 nt, Homo sapiens
uuccauagcccaggacaua

SEQ ID NO: 429407 - RNA, 19 nt, Homo sapiens
ggcauucccuacaucaucu

SEQ ID NO: 429408 - RNA, 19 nt, Homo sapiens
agaccuaccacguggauga

SEQ ID NO: 429409 - RNA, 19 nt, Homo sapiens
gggaagcugguggcugaua

SEQ ID NO: 429410 - RNA, 19 nt, Homo sapiens
gaguucgccuuccuuaugc

SEQ ID NO: 429411 - RNA, 19 nt, Homo sapiens
gcuggagguguguauauau

SEQ ID NO: 429412 - RNA, 19 nt, Homo sapiens
acaaccagcugagggugaa

SEQ ID NO: 429413 - RNA, 19 nt, Homo sapiens
gguugucccugcagaagag

SEQ ID NO: 429414 - RNA, 19 nt, Homo sapiens
gaauggguucugcucaugu

SEQ ID NO: 429415 - RNA, 19 nt, Homo sapiens
caagaagagcauggucauu

SEQ ID NO: 429416 - RNA, 19 nt, Homo sapiens
cgacaugagguucaacauc

SEQ ID NO: 429417 - RNA, 19 nt, Homo sapiens
gaagagcauggucauucug

SEQ ID NO: 429418 - RNA, 19 nt, Homo sapiens
ccacccagauggccaugag

SEQ ID NO: 429419 - RNA, 19 nt, Homo sapiens
gcuacaacccuggcagcua

SEQ ID NO: 429420 - RNA, 19 nt, Homo sapiens
uaugaucgccgcaccaaca

SEQ ID NO: 429421 - RNA, 19 nt, Homo sapiens
cagcuggagguguguauau

SEQ ID NO: 429422 - RNA, 19 nt, Homo sapiens
ugaugaaggcccuccaguu

SEQ ID NO: 429423 - RNA, 19 nt, Homo sapiens
cauccuccauucccaucuu

SEQ ID NO: 429424 - RNA, 19 nt, Homo sapiens
ccacggccuugcacacagu

SEQ ID NO: 429425 - RNA, 19 nt, Homo sapiens
cuugugcuccuacuucuuu

SEQ ID NO: 429426 - RNA, 19 nt, Homo sapiens
caucuugugcuccuacuuc

SEQ ID NO: 429427 - RNA, 19 nt, Homo sapiens
gacaacauuggcuacuuga

SEQ ID NO: 429428 - RNA, 19 nt, Homo sapiens
gcucacacaaggaccucua

SEQ ID NO: 429429 - RNA, 19 nt, Homo sapiens
gacaucgcgcacauccuua

SEQ ID NO: 429430 - RNA, 19 nt, Homo sapiens
ucauggaccugcgccacaa

SEQ ID NO: 429431 - RNA, 19 nt, Homo sapiens
gagcucugguuagguuaca

SEQ ID NO: 429432 - RNA, 19 nt, Homo sapiens
ugaucgaccugcgcuacaa

SEQ ID NO: 429433 - RNA, 19 nt, Homo sapiens
gcacugguggacucugugu

SEQ ID NO: 429434 - RNA, 19 nt, Homo sapiens
ccgcggaggaguucaccua

SEQ ID NO: 429435 - RNA, 19 nt, Homo sapiens
ccaagaagagcauggucau

SEQ ID NO: 429436 - RNA, 19 nt, Homo sapiens
cgacaaggcucgcuucucu

SEQ ID NO: 429437 - RNA, 19 nt, Homo sapiens
ucaagaaucuaguuucauc

SEQ ID NO: 429438 - RNA, 19 nt, Homo sapiens
gauggcagaucagaaagaa

SEQ ID NO: 429439 - RNA, 19 nt, Homo sapiens
guagcaauaucaagaaucu

SEQ ID NO: 429440 - RNA, 19 nt, Homo sapiens
gugagcagcuuccgaguca

SEQ ID NO: 429441 - RNA, 19 nt, Homo sapiens
gaaaugaugaccacuggau

SEQ ID NO: 429442 - RNA, 19 nt, Homo sapiens
cagcuacuccuucguguuu

SEQ ID NO: 429443 - RNA, 19 nt, Homo sapiens
cgaggacccugccaaguuc

SEQ ID NO: 429444 - RNA, 19 nt, Homo sapiens
acacguaugccguacagua

SEQ ID NO: 429445 - RNA, 19 nt, Homo sapiens
gacgagaccggccagauga

SEQ ID NO: 429446 - RNA, 19 nt, Homo sapiens
gguacgccauggccaagaa

SEQ ID NO: 429447 - RNA, 19 nt, Homo sapiens
gauuagcucucagucuuca

SEQ ID NO: 429448 - RNA, 19 nt, Homo sapiens
ggacgugugcgcagacaug

SEQ ID NO: 429449 - RNA, 19 nt, Homo sapiens
cagaagcgcagaagauugu

SEQ ID NO: 429450 - RNA, 19 nt, Homo sapiens
gggcguagccuccuuucug

SEQ ID NO: 429451 - RNA, 19 nt, Homo sapiens
gaagcgcagaagauuguaa

SEQ ID NO: 429452 - RNA, 19 nt, Homo sapiens
agaaucuaguuucaucuga

SEQ ID NO: 429453 - RNA, 19 nt, Homo sapiens
cuucagcucuauuuaucuu

SEQ ID NO: 429454 - RNA, 19 nt, Homo sapiens
ccgaggacccugccaaguu

SEQ ID NO: 429455 - RNA, 19 nt, Homo sapiens
ucaaggagaacuucgacaa

SEQ ID NO: 429456 - RNA, 19 nt, Homo sapiens
aaucuaguuucaucugaga

SEQ ID NO: 429457 - RNA, 19 nt, Homo sapiens
gaaaccuuuuguagcaaua

SEQ ID NO: 429458 - RNA, 19 nt, Homo sapiens
caacaucgucgcggaguuc

SEQ ID NO: 429459 - RNA, 19 nt, Homo sapiens
gucuucagcucuauuuauc

SEQ ID NO: 429460 - RNA, 19 nt, Homo sapiens
gaguuuaauuugcccuucu

SEQ ID NO: 429461 - RNA, 19 nt, Homo sapiens
ccagaagcgcagaagauug

SEQ ID NO: 429462 - RNA, 19 nt, Homo sapiens
cgacacguaugccguacag

SEQ ID NO: 429463 - RNA, 19 nt, Homo sapiens
gcagaaaggaaaugaugac

SEQ ID NO: 429464 - RNA, 19 nt, Homo sapiens
gugggcaccuucacagaca

SEQ ID NO: 429465 - RNA, 19 nt, Homo sapiens
cauaaaaccuucauuacac

SEQ ID NO: 429466 - RNA, 19 nt, Homo sapiens
ucagcucuauuuaucuuag

SEQ ID NO: 429467 - RNA, 19 nt, Homo sapiens
gaguccgucuuuugaauaa

SEQ ID NO: 429468 - RNA, 19 nt, Homo sapiens
ugugggcgcucuugcuguu

SEQ ID NO: 429469 - RNA, 19 nt, Homo sapiens
agacucugauucauuaaac

SEQ ID NO: 429470 - RNA, 19 nt, Homo sapiens
gcggauuccugggcaagau

SEQ ID NO: 429471 - RNA, 19 nt, Homo sapiens
gaucgucgacacagacuac

SEQ ID NO: 429472 - RNA, 19 nt, Homo sapiens
ccugccaaguucaagauga

SEQ ID NO: 429473 - RNA, 19 nt, Homo sapiens
ucagucuucagcucuauuu

SEQ ID NO: 429474 - RNA, 19 nt, Homo sapiens
caaggagaacuucgacaag

SEQ ID NO: 429475 - RNA, 19 nt, Homo sapiens
gcuuaagauuccagacucu

SEQ ID NO: 429476 - RNA, 19 nt, Homo sapiens
gagcagcuuccgagucaag

SEQ ID NO: 429477 - RNA, 19 nt, Homo sapiens
gcaauaucaagaaucuagu

SEQ ID NO: 429478 - RNA, 19 nt, Homo sapiens
ugaaucugcuugccuuucc

SEQ ID NO: 429479 - RNA, 19 nt, Homo sapiens
ggauuccugggcaagauga

SEQ ID NO: 429480 - RNA, 19 nt, Homo sapiens
cugcagaaaggaaaugaug

SEQ ID NO: 429481 - RNA, 19 nt, Homo sapiens
ugcgauggcagaucagaaa

SEQ ID NO: 429482 - RNA, 19 nt, Homo sapiens
cccagaagcgcagaagauu

SEQ ID NO: 429483 - RNA, 19 nt, Homo sapiens
gaacaaggacgggaaguua

SEQ ID NO: 429484 - RNA, 19 nt, Homo sapiens
ggacaucacuagucuuuca

SEQ ID NO: 429485 - RNA, 19 nt, Homo sapiens
gaagcuaacuaaagaggaa

SEQ ID NO: 429486 - RNA, 19 nt, Homo sapiens
ggacaaggaugauaaaauu

SEQ ID NO: 429487 - RNA, 19 nt, Homo sapiens
ggaagugaaugaaauaaag

SEQ ID NO: 429488 - RNA, 19 nt, Homo sapiens
guaaauccaugucuuuguu

SEQ ID NO: 429489 - RNA, 19 nt, Homo sapiens
gaagccaagcuaccaauua

SEQ ID NO: 429490 - RNA, 19 nt, Homo sapiens
gacacaaccuguacagauu

SEQ ID NO: 429491 - RNA, 19 nt, Homo sapiens
agaaaggaauuuagaggua

SEQ ID NO: 429492 - RNA, 19 nt, Homo sapiens
uagguaagcuuauuucaga

SEQ ID NO: 429493 - RNA, 19 nt, Homo sapiens
gauagacacucaccagaau

SEQ ID NO: 429494 - RNA, 19 nt, Homo sapiens
gaagcaaucaagaaagaua

SEQ ID NO: 429495 - RNA, 19 nt, Homo sapiens
guauggaucugcuaauaug

SEQ ID NO: 429496 - RNA, 19 nt, Homo sapiens
gauccucccucaagauuau

SEQ ID NO: 429497 - RNA, 19 nt, Homo sapiens
gaacauaugaaggaaauug

SEQ ID NO: 429498 - RNA, 19 nt, Homo sapiens
uaugaaaccuccaugcauu

SEQ ID NO: 429499 - RNA, 19 nt, Homo sapiens
ugaagugacugcuguguau

SEQ ID NO: 429500 - RNA, 19 nt, Homo sapiens
ggaggaagugaaugaaaua

SEQ ID NO: 429501 - RNA, 19 nt, Homo sapiens
ucagacaugugaagaacua

SEQ ID NO: 429502 - RNA, 19 nt, Homo sapiens
aaacaaggaugagaagcua

SEQ ID NO: 429503 - RNA, 19 nt, Homo sapiens
gggagcaguuuaacgaauu

SEQ ID NO: 429504 - RNA, 19 nt, Homo sapiens
gccaaagucuggaaggauu

SEQ ID NO: 429505 - RNA, 19 nt, Homo sapiens
gaauuuagagguagggaaa

SEQ ID NO: 429506 - RNA, 19 nt, Homo sapiens
caguauggaucugcuaaua

SEQ ID NO: 429507 - RNA, 19 nt, Homo sapiens
gcaguaauaugaagugacu

SEQ ID NO: 429508 - RNA, 19 nt, Homo sapiens
gagggaggcaguaauauga

SEQ ID NO: 429509 - RNA, 19 nt, Homo sapiens
ugucauaggcauucuguua

SEQ ID NO: 429510 - RNA, 19 nt, Homo sapiens
guaaggaggaagugaauga

SEQ ID NO: 429511 - RNA, 19 nt, Homo sapiens
cgaaagugguaucauccua

SEQ ID NO: 429512 - RNA, 19 nt, Homo sapiens
aagaagcaaucaagaaaga

SEQ ID NO: 429513 - RNA, 19 nt, Homo sapiens
cugcuaauaugcacaguaa

SEQ ID NO: 429514 - RNA, 19 nt, Homo sapiens
cugaagaguuugaacauau

SEQ ID NO: 429515 - RNA, 19 nt, Homo sapiens
ucaguaagauuucucucaa

SEQ ID NO: 429516 - RNA, 19 nt, Homo sapiens
ccgcagaguuucaugauuc

SEQ ID NO: 429517 - RNA, 19 nt, Homo sapiens
ggaagauuguugaucgaau

SEQ ID NO: 429518 - RNA, 19 nt, Homo sapiens
cuaaauauccuugaaccua

SEQ ID NO: 429519 - RNA, 19 nt, Homo sapiens
gaugagaagcuaacuaaag

SEQ ID NO: 429520 - RNA, 19 nt, Homo sapiens
gcuaggauacaaugcauuu

SEQ ID NO: 429521 - RNA, 19 nt, Homo sapiens
gcuaauaugcacaguaaau

SEQ ID NO: 429522 - RNA, 19 nt, Homo sapiens
ucauaggcauucuguuauu

SEQ ID NO: 429523 - RNA, 19 nt, Homo sapiens
ccaccuaaauauccuugaa

SEQ ID NO: 429524 - RNA, 19 nt, Homo sapiens
gagguaggccugaucuuug

SEQ ID NO: 429525 - RNA, 19 nt, Homo sapiens
ggacgggaaguuagacaaa

SEQ ID NO: 429526 - RNA, 19 nt, Homo sapiens
ggacaaggugauacucuga

SEQ ID NO: 429527 - RNA, 19 nt, Homo sapiens
gagcuuugauagacacuca

SEQ ID NO: 429528 - RNA, 19 nt, Homo sapiens
ggagaacuggaacauguuu

SEQ ID NO: 429529 - RNA, 19 nt, Homo sapiens
augagaagcuaacuaaaga

SEQ ID NO: 429530 - RNA, 19 nt, Homo sapiens
gaaguuagacaaagaugag

SEQ ID NO: 429531 - RNA, 19 nt, Homo sapiens
guaagugguguauaugaaa

SEQ ID NO: 429532 - RNA, 19 nt, Homo sapiens
ucacuagucuuucaguaag

SEQ ID NO: 429533 - RNA, 19 nt, Homo sapiens
caucacuagucuuucagua

SEQ ID NO: 429534 - RNA, 19 nt, Homo sapiens
ggaucaggaugaguauauu

SEQ ID NO: 429535 - RNA, 19 nt, Homo sapiens
gggauggguuuguggauca

SEQ ID NO: 429536 - RNA, 19 nt, Homo sapiens
caaugcauuuccucaguga

SEQ ID NO: 429537 - RNA, 19 nt, Homo sapiens
gugaaaaccuugguaaauu

SEQ ID NO: 429538 - RNA, 19 nt, Homo sapiens
uggaggacaucgacaagaa

SEQ ID NO: 429539 - RNA, 19 nt, Homo sapiens
ugaagaguuugaacauaug

SEQ ID NO: 429540 - RNA, 19 nt, Homo sapiens
gaugagagaagauucaaag

SEQ ID NO: 429541 - RNA, 19 nt, Homo sapiens
cagaucaucacaccuuuaa

SEQ ID NO: 429542 - RNA, 19 nt, Homo sapiens
gaaugaggacaaggugaua

SEQ ID NO: 429543 - RNA, 19 nt, Homo sapiens
guugagggaggcaguaaua

SEQ ID NO: 429544 - RNA, 19 nt, Homo sapiens
guuauugucuuggauuguu

SEQ ID NO: 429545 - RNA, 19 nt, Homo sapiens
ccugaagaguuugaacaua

SEQ ID NO: 429546 - RNA, 19 nt, Homo sapiens
acucugagcuguggacuga

SEQ ID NO: 429547 - RNA, 19 nt, Homo sapiens
ggaaugaggacaaggugau

SEQ ID NO: 429548 - RNA, 19 nt, Homo sapiens
uguaagugguguauaugaa

SEQ ID NO: 429549 - RNA, 19 nt, Homo sapiens
gguacaacaugacuuaaaa

SEQ ID NO: 429550 - RNA, 19 nt, Homo sapiens
gcaaguuuauaccucagau

SEQ ID NO: 429551 - RNA, 19 nt, Homo sapiens
gaucaaacgggugcagaaa

SEQ ID NO: 429552 - RNA, 19 nt, Homo sapiens
ggaaguuagacaaagauga

SEQ ID NO: 429553 - RNA, 19 nt, Homo sapiens
aaacaagccaccuaugguu

SEQ ID NO: 429554 - RNA, 19 nt, Homo sapiens
gauaaugucgccaaagucu

SEQ ID NO: 429555 - RNA, 19 nt, Homo sapiens
gaggaaauauuggagaacu

SEQ ID NO: 429556 - RNA, 19 nt, Homo sapiens
ugaaggaaauugugguuuu

SEQ ID NO: 429557 - RNA, 19 nt, Homo sapiens
gaagaguuugaacauauga

SEQ ID NO: 429558 - RNA, 19 nt, Homo sapiens
gaucaucacaccuuuaaaa

SEQ ID NO: 429559 - RNA, 19 nt, Homo sapiens
ccaaagucuggaaggauua

SEQ ID NO: 429560 - RNA, 19 nt, Homo sapiens
caguaagauuucucucaaa

SEQ ID NO: 429561 - RNA, 19 nt, Homo sapiens
aagaggaaauauuggagaa

SEQ ID NO: 429562 - RNA, 19 nt, Homo sapiens
ggagcaguuuaacgaauuc

SEQ ID NO: 429563 - RNA, 19 nt, Homo sapiens
ggccugaucuuugaauagu

SEQ ID NO: 429564 - RNA, 19 nt, Homo sapiens
cauccuagguaagcuuauu

SEQ ID NO: 429565 - RNA, 19 nt, Homo sapiens
cauaggcauucuguuauug

SEQ ID NO: 429566 - RNA, 19 nt, Homo sapiens
gaucaggaugaguauauug

SEQ ID NO: 429567 - RNA, 19 nt, Homo sapiens
ugacugcuguguauuuuaa

SEQ ID NO: 429568 - RNA, 19 nt, Homo sapiens
caaaacacgugaaaaccuu

SEQ ID NO: 429569 - RNA, 19 nt, Homo sapiens
uuggagaacuggaacaugu

SEQ ID NO: 429570 - RNA, 19 nt, Homo sapiens
uaucagaacgggagcaguu

SEQ ID NO: 429571 - RNA, 19 nt, Homo sapiens
cagcuuauaccauggaaug

SEQ ID NO: 429572 - RNA, 19 nt, Homo sapiens
ugagguaggccugaucuuu

SEQ ID NO: 429573 - RNA, 19 nt, Homo sapiens
ugaaaaccuugguaaauug

SEQ ID NO: 429574 - RNA, 19 nt, Homo sapiens
gaauauggcagacugucau

SEQ ID NO: 429575 - RNA, 19 nt, Homo sapiens
ggaagccaagcuaccaauu

SEQ ID NO: 429576 - RNA, 19 nt, Homo sapiens
gauagggacaaggaugaua

SEQ ID NO: 429577 - RNA, 19 nt, Homo sapiens
gaaggaaauugugguuuug

SEQ ID NO: 429578 - RNA, 19 nt, Homo sapiens
caccuaugguuacuaccua

SEQ ID NO: 429579 - RNA, 19 nt, Homo sapiens
acaguaaauccaugucuuu

SEQ ID NO: 429580 - RNA, 19 nt, Homo sapiens
uacuguaagugguguauau

SEQ ID NO: 429581 - RNA, 19 nt, Homo sapiens
guaagcuuauuucagaaca

SEQ ID NO: 429582 - RNA, 19 nt, Homo sapiens
aagcgaaagugguaucauc

SEQ ID NO: 429583 - RNA, 19 nt, Homo sapiens
gcagacagcuccaugauga

SEQ ID NO: 429584 - RNA, 19 nt, Homo sapiens
ucaagaagcuuuagaagaa

SEQ ID NO: 429585 - RNA, 19 nt, Homo sapiens
ggacuuagaccucacauau

SEQ ID NO: 429586 - RNA, 19 nt, Homo sapiens
acuuagaccucacauauua

SEQ ID NO: 429587 - RNA, 19 nt, Homo sapiens
uuaggaagcuucacuuaaa

SEQ ID NO: 429588 - RNA, 19 nt, Homo sapiens
gcauauguauagaggauaa

SEQ ID NO: 429589 - RNA, 19 nt, Homo sapiens
agagaugccugaacaauau

SEQ ID NO: 429590 - RNA, 19 nt, Homo sapiens
aggaagauguggaugaaua

SEQ ID NO: 429591 - RNA, 19 nt, Homo sapiens
guagaguacuggcuccuuu

SEQ ID NO: 429592 - RNA, 19 nt, Homo sapiens
gaacugacaggacaauguu

SEQ ID NO: 429593 - RNA, 19 nt, Homo sapiens
ccagugaagccacagauua

SEQ ID NO: 429594 - RNA, 19 nt, Homo sapiens
gacaagaagcgauuugaaa

SEQ ID NO: 429595 - RNA, 19 nt, Homo sapiens
gauguaugaucgugugauu

SEQ ID NO: 429596 - RNA, 19 nt, Homo sapiens
cagaauggauacuuguuga

SEQ ID NO: 429597 - RNA, 19 nt, Homo sapiens
ggugauggauuuguuaguu

SEQ ID NO: 429598 - RNA, 19 nt, Homo sapiens
gaacacugcucuggaugau

SEQ ID NO: 429599 - RNA, 19 nt, Homo sapiens
ugacuugggaugaauauaa

SEQ ID NO: 429600 - RNA, 19 nt, Homo sapiens
ggaugaauauguuaaacuc

SEQ ID NO: 429601 - RNA, 19 nt, Homo sapiens
cuaaauacuccaucuguuu

SEQ ID NO: 429602 - RNA, 19 nt, Homo sapiens
ggauccaacugcaaaugaa

SEQ ID NO: 429603 - RNA, 19 nt, Homo sapiens
ggaggcgcuucaucuaauu

SEQ ID NO: 429604 - RNA, 19 nt, Homo sapiens
ggauucaggucccgguuug

SEQ ID NO: 429605 - RNA, 19 nt, Homo sapiens
ggacucagauggcuuucuc

SEQ ID NO: 429606 - RNA, 19 nt, Homo sapiens
aaaugaagauccagaaugg

SEQ ID NO: 429607 - RNA, 19 nt, Homo sapiens
gugauggauuuguuaguuu

SEQ ID NO: 429608 - RNA, 19 nt, Homo sapiens
ggacaagaagcgauuugaa

SEQ ID NO: 429609 - RNA, 19 nt, Homo sapiens
ggauucagaugucuuuuaa

SEQ ID NO: 429610 - RNA, 19 nt, Homo sapiens
ccaggaagauguggaugaa

SEQ ID NO: 429611 - RNA, 19 nt, Homo sapiens
gaggaggcgcuucaucuaa

SEQ ID NO: 429612 - RNA, 19 nt, Homo sapiens
ggauacuuguugagaaaga

SEQ ID NO: 429613 - RNA, 19 nt, Homo sapiens
caaaugaagauccagaaug

SEQ ID NO: 429614 - RNA, 19 nt, Homo sapiens
uagagaugccugaacaaua

SEQ ID NO: 429615 - RNA, 19 nt, Homo sapiens
cgugaaugauuaugacaaa

SEQ ID NO: 429616 - RNA, 19 nt, Homo sapiens
ugaccgagcuauaaauuuu

SEQ ID NO: 429617 - RNA, 19 nt, Homo sapiens
ugagaacacugcucuggau

SEQ ID NO: 429618 - RNA, 19 nt, Homo sapiens
ccaaacguauugagcaaca

SEQ ID NO: 429619 - RNA, 19 nt, Homo sapiens
guucauggauucagauguc

SEQ ID NO: 429620 - RNA, 19 nt, Homo sapiens
ggaacugacaggacaaugu

SEQ ID NO: 429621 - RNA, 19 nt, Homo sapiens
gauuuaauuugggaacuga

SEQ ID NO: 429622 - RNA, 19 nt, Homo sapiens
ggaagauguggaugaauau

SEQ ID NO: 429623 - RNA, 19 nt, Homo sapiens
gaguggaauuugacauugu

SEQ ID NO: 429624 - RNA, 19 nt, Homo sapiens
gugauugacuuugaugaga

SEQ ID NO: 429625 - RNA, 19 nt, Homo sapiens
gaauggauacuuguugaga

SEQ ID NO: 429626 - RNA, 19 nt, Homo sapiens
uaaaggacaagaagcgauu

SEQ ID NO: 429627 - RNA, 19 nt, Homo sapiens
cagauggcuuucucacuga

SEQ ID NO: 429628 - RNA, 19 nt, Homo sapiens
uauggugaguggaauuuga

SEQ ID NO: 429629 - RNA, 19 nt, Homo sapiens
ccuaaauacuccaucuguu

SEQ ID NO: 429630 - RNA, 19 nt, Homo sapiens
uaaccacagucagaauuau

SEQ ID NO: 429631 - RNA, 19 nt, Homo sapiens
gcaaaugaagauccagaau

SEQ ID NO: 429632 - RNA, 19 nt, Homo sapiens
guaugugaccgagcuauaa

SEQ ID NO: 429633 - RNA, 19 nt, Homo sapiens
gugaugauacugugacuug

SEQ ID NO: 429634 - RNA, 19 nt, Homo sapiens
agauguggaugaauauguu

SEQ ID NO: 429635 - RNA, 19 nt, Homo sapiens
ugauugacuuugaugagaa

SEQ ID NO: 429636 - RNA, 19 nt, Homo sapiens
cagcuuuacuuuugugaua

SEQ ID NO: 429637 - RNA, 19 nt, Homo sapiens
ugauggauuuguuaguuug

SEQ ID NO: 429638 - RNA, 19 nt, Homo sapiens
ugaguggaauuugacauug

SEQ ID NO: 429639 - RNA, 19 nt, Homo sapiens
uuaaccacagucagaauua

SEQ ID NO: 429640 - RNA, 19 nt, Homo sapiens
ugcaggcgaucauaaagaa

SEQ ID NO: 429641 - RNA, 19 nt, Homo sapiens
gauguggaugaauauguua

SEQ ID NO: 429642 - RNA, 19 nt, Homo sapiens
uaaagaaaaucgacuugga

SEQ ID NO: 429643 - RNA, 19 nt, Homo sapiens
gauuacaggugggauccaa

SEQ ID NO: 429644 - RNA, 19 nt, Homo sapiens
ugagcauccugaagaaguu

SEQ ID NO: 429645 - RNA, 19 nt, Homo sapiens
gggauccaacugcaaauga

SEQ ID NO: 429646 - RNA, 19 nt, Homo sapiens
uguaugaucgugugauuga

SEQ ID NO: 429647 - RNA, 19 nt, Homo sapiens
gacuuagaccucacauauu

SEQ ID NO: 429648 - RNA, 19 nt, Homo sapiens
ggaagcuucacuuaaagga

SEQ ID NO: 429649 - RNA, 19 nt, Homo sapiens
gugaguggaauuugacauu

SEQ ID NO: 429650 - RNA, 19 nt, Homo sapiens
gaaaaucgacuuggacuca

SEQ ID NO: 429651 - RNA, 19 nt, Homo sapiens
gagccugucucaguagagu

SEQ ID NO: 429652 - RNA, 19 nt, Homo sapiens
ccagaauggauacuuguug

SEQ ID NO: 429653 - RNA, 19 nt, Homo sapiens
ggugggauccaacugcaaa

SEQ ID NO: 429654 - RNA, 19 nt, Homo sapiens
guuaccagcuuuacuuuug

SEQ ID NO: 429655 - RNA, 19 nt, Homo sapiens
cagugaagccacagauuau

SEQ ID NO: 429656 - RNA, 19 nt, Homo sapiens
aggaggcgcuucaucuaau

SEQ ID NO: 429657 - RNA, 19 nt, Homo sapiens
aauggauacuuguugagaa

SEQ ID NO: 429658 - RNA, 19 nt, Homo sapiens
gauuauaugacggaauuug

SEQ ID NO: 429659 - RNA, 19 nt, Homo sapiens
ggucccgguuugagucuug

SEQ ID NO: 429660 - RNA, 19 nt, Homo sapiens
gaagauguggaugaauaug

SEQ ID NO: 429661 - RNA, 19 nt, Homo sapiens
guggaauauuugaguucua

SEQ ID NO: 429662 - RNA, 19 nt, Homo sapiens
cuccgagccugucucagua

SEQ ID NO: 429663 - RNA, 19 nt, Homo sapiens
uaggaagcuucacuuaaag

SEQ ID NO: 429664 - RNA, 19 nt, Homo sapiens
aaacguauugagcaacaaa

SEQ ID NO: 429665 - RNA, 19 nt, Homo sapiens
cacagucagaauuaucuua

SEQ ID NO: 429666 - RNA, 19 nt, Homo sapiens
auggauacuuguugagaaa

SEQ ID NO: 429667 - RNA, 19 nt, Homo sapiens
agacugcaggcgaucauaa

SEQ ID NO: 429668 - RNA, 19 nt, Homo sapiens
uugaaaacauggaggauuu

SEQ ID NO: 429669 - RNA, 19 nt, Homo sapiens
uuaguacuguauuguggaa

SEQ ID NO: 429670 - RNA, 19 nt, Homo sapiens
caagaagcuuuagaagaac

SEQ ID NO: 429671 - RNA, 19 nt, Homo sapiens
gacuugggaugaauauaac

SEQ ID NO: 429672 - RNA, 19 nt, Homo sapiens
gcauuauggugaguggaau

SEQ ID NO: 429673 - RNA, 19 nt, Homo sapiens
gacugcaggcgaucauaaa

SEQ ID NO: 429674 - RNA, 19 nt, Homo sapiens
gugaccgagcuauaaauuu

SEQ ID NO: 429675 - RNA, 19 nt, Homo sapiens
ugaguucuauuuccagacu

SEQ ID NO: 429676 - RNA, 19 nt, Homo sapiens
cauggauucagaugucuuu

SEQ ID NO: 429677 - RNA, 19 nt, Homo sapiens
guacuggcuccuuuuauaa

SEQ ID NO: 429678 - RNA, 19 nt, Homo sapiens
agaggaggcgcuucaucua

SEQ ID NO: 429679 - RNA, 19 nt, Homo sapiens
ucacuuaaaggacaagaag

SEQ ID NO: 429680 - RNA, 19 nt, Homo sapiens
aaaucgacuuggacucaga

SEQ ID NO: 429681 - RNA, 19 nt, Homo sapiens
uugcauauguauagaggau

SEQ ID NO: 429682 - RNA, 19 nt, Homo sapiens
uaugugaccgagcuauaaa

SEQ ID NO: 429683 - RNA, 19 nt, Homo sapiens
aaacggaggucucaucugu

SEQ ID NO: 429684 - RNA, 19 nt, Homo sapiens
ggugcagucuuacaugauu

SEQ ID NO: 429685 - RNA, 19 nt, Homo sapiens
gcauccgucuucacaaaug

SEQ ID NO: 429686 - RNA, 19 nt, Homo sapiens
uggcaaagcagcagaaaga

SEQ ID NO: 429687 - RNA, 19 nt, Homo sapiens
gacgauggcucugaacucu

SEQ ID NO: 429688 - RNA, 19 nt, Homo sapiens
ugaacuggauccuggugaa

SEQ ID NO: 429689 - RNA, 19 nt, Homo sapiens
cugcauccgucuucacaaa

SEQ ID NO: 429690 - RNA, 19 nt, Homo sapiens
cccguuaucuaugucuuua

SEQ ID NO: 429691 - RNA, 19 nt, Homo sapiens
gcaaagcagcagaaagagu

SEQ ID NO: 429692 - RNA, 19 nt, Homo sapiens
ucacaggucucuggucucu

SEQ ID NO: 429693 - RNA, 19 nt, Homo sapiens
gcaagcccuuuggcaaugu

SEQ ID NO: 429694 - RNA, 19 nt, Homo sapiens
cguuaucuaugucuuuaug

SEQ ID NO: 429695 - RNA, 19 nt, Homo sapiens
gcauggugguggugaugau

SEQ ID NO: 429696 - RNA, 19 nt, Homo sapiens
gguugacgauggcucugaa

SEQ ID NO: 429697 - RNA, 19 nt, Homo sapiens
ccagaaggcagagaaggaa

SEQ ID NO: 429698 - RNA, 19 nt, Homo sapiens
gcauugccuucuccuggau

SEQ ID NO: 429699 - RNA, 19 nt, Homo sapiens
acggaggucucaucugugu

SEQ ID NO: 429700 - RNA, 19 nt, Homo sapiens
gugcagucuuacaugauug

SEQ ID NO: 429701 - RNA, 19 nt, Homo sapiens
gugcaagcccuuuggcaau

SEQ ID NO: 429702 - RNA, 19 nt, Homo sapiens
gcucugcuaccuccaagug

SEQ ID NO: 429703 - RNA, 19 nt, Homo sapiens
guuacgccuuccacccuuu

SEQ ID NO: 429704 - RNA, 19 nt, Homo sapiens
gugcugggccacccuaugu

SEQ ID NO: 429705 - RNA, 19 nt, Homo sapiens
gugaugaucuuugcguacu

SEQ ID NO: 429706 - RNA, 19 nt, Homo sapiens
gaaggcagagaaggaagug

SEQ ID NO: 429707 - RNA, 19 nt, Homo sapiens
ggcaaugugagauuugaug

SEQ ID NO: 429708 - RNA, 19 nt, Homo sapiens
uguaccaccucaccagugu

SEQ ID NO: 429709 - RNA, 19 nt, Homo sapiens
ggucacugcauccgucuuc

SEQ ID NO: 429710 - RNA, 19 nt, Homo sapiens
ucaccuacaccaacagcaa

SEQ ID NO: 429711 - RNA, 19 nt, Homo sapiens
gccacccgcugaacuggau

SEQ ID NO: 429712 - RNA, 19 nt, Homo sapiens
ugcaagcccuuuggcaaug

SEQ ID NO: 429713 - RNA, 19 nt, Homo sapiens
ugaaccggcaguuucgaaa

SEQ ID NO: 429714 - RNA, 19 nt, Homo sapiens
ccacccagaaggcagagaa

SEQ ID NO: 429715 - RNA, 19 nt, Homo sapiens
gaugaucuuuguggucacu

SEQ ID NO: 429716 - RNA, 19 nt, Homo sapiens
gugucuggaugaucuuugu

SEQ ID NO: 429717 - RNA, 19 nt, Homo sapiens
cuacaaccccguuaucuau

SEQ ID NO: 429718 - RNA, 19 nt, Homo sapiens
gccauccgcaggacagcua

SEQ ID NO: 429719 - RNA, 19 nt, Homo sapiens
ggggugcagucuuacauga

SEQ ID NO: 429720 - RNA, 19 nt, Homo sapiens
gguaagcaguuuccaauaa

SEQ ID NO: 429721 - RNA, 19 nt, Homo sapiens
guaagcaguuuccaauaaa

SEQ ID NO: 429722 - RNA, 19 nt, Homo sapiens
gaugauaaacuuacagaga

SEQ ID NO: 429723 - RNA, 19 nt, Homo sapiens
gagaaaggccugcacacaa

SEQ ID NO: 429724 - RNA, 19 nt, Homo sapiens
ggaaagaaugaugaugaua

SEQ ID NO: 429725 - RNA, 19 nt, Homo sapiens
agaaaggccugcacacaag

SEQ ID NO: 429726 - RNA, 19 nt, Homo sapiens
gagcaucuacgccaaguuc

SEQ ID NO: 429727 - RNA, 19 nt, Homo sapiens
agaaugaagugcuggagau

SEQ ID NO: 429728 - RNA, 19 nt, Homo sapiens
ggacacuggccaauaagga

SEQ ID NO: 429729 - RNA, 19 nt, Homo sapiens
ccaccuaccacucacauga

SEQ ID NO: 429730 - RNA, 19 nt, Homo sapiens
acacacacaugcacacaca

SEQ ID NO: 429731 - RNA, 19 nt, Homo sapiens
gagaucgucauggcuauuu

SEQ ID NO: 429732 - RNA, 19 nt, Homo sapiens
cgucauggcuauuuucaaa

SEQ ID NO: 429733 - RNA, 19 nt, Homo sapiens
gaagaacuggucgcaaauc

SEQ ID NO: 429734 - RNA, 19 nt, Homo sapiens
uggaaagaaugaugaugau

SEQ ID NO: 429735 - RNA, 19 nt, Homo sapiens
ggguaagcaguuuccaaua

SEQ ID NO: 429736 - RNA, 19 nt, Homo sapiens
ggaccaucagcaagaauga

SEQ ID NO: 429737 - RNA, 19 nt, Homo sapiens
ucuacgacguggacgguaa

SEQ ID NO: 429738 - RNA, 19 nt, Homo sapiens
cagagaaagaauucauuga

SEQ ID NO: 429739 - RNA, 19 nt, Homo sapiens
ggucgcaaauccuccuaag

SEQ ID NO: 429740 - RNA, 19 nt, Homo sapiens
gacacuggccaauaaggaa

SEQ ID NO: 429741 - RNA, 19 nt, Homo sapiens
acagagaaagaauucauug

SEQ ID NO: 429742 - RNA, 19 nt, Homo sapiens
ccaugucccugugcuaauc

SEQ ID NO: 429743 - RNA, 19 nt, Homo sapiens
gcccaugucccugugcuaa

SEQ ID NO: 429744 - RNA, 19 nt, Homo sapiens
gcacagcucccugccaaac

SEQ ID NO: 429745 - RNA, 19 nt, Homo sapiens
guaacgggaccaucagcaa

SEQ ID NO: 429746 - RNA, 19 nt, Homo sapiens
ccaaacugaagcaucugua

SEQ ID NO: 429747 - RNA, 19 nt, Homo sapiens
gacgguaacgggaccauca

SEQ ID NO: 429748 - RNA, 19 nt, Homo sapiens
gaacgccugaugccaacug

SEQ ID NO: 429749 - RNA, 19 nt, Homo sapiens
uuggaaagaaugaugauga

SEQ ID NO: 429750 - RNA, 19 nt, Homo sapiens
caaacugaagcaucuguag

SEQ ID NO: 429751 - RNA, 19 nt, Homo sapiens
ggagaucgucauggcuauu

SEQ ID NO: 429752 - RNA, 19 nt, Homo sapiens
gggcaagaccaaccagaag

SEQ ID NO: 429753 - RNA, 19 nt, Homo sapiens
cugccaaacugaagcaucu

SEQ ID NO: 429754 - RNA, 19 nt, Homo sapiens
cgaagaacuggucgcaaau

SEQ ID NO: 429755 - RNA, 19 nt, Homo sapiens
aaggaaauucugcgacuga

SEQ ID NO: 429756 - RNA, 19 nt, Homo sapiens
agagaaagaauucauugag

SEQ ID NO: 429757 - RNA, 19 nt, Homo sapiens
ccaccagcaucucggucuu

SEQ ID NO: 429758 - RNA, 19 nt, Homo sapiens
gcaucuacgccaaguucuu

SEQ ID NO: 429759 - RNA, 19 nt, Homo sapiens
gaugaaaacacgccggaaa

SEQ ID NO: 429760 - RNA, 19 nt, Homo sapiens
ggaaauucugcgacugauc

SEQ ID NO: 429761 - RNA, 19 nt, Homo sapiens
cgucaucgcccugcacaug

SEQ ID NO: 429762 - RNA, 19 nt, Homo sapiens
ccacucuuccucacucaug

SEQ ID NO: 429763 - RNA, 19 nt, Homo sapiens
agcauucccucccaucaug

SEQ ID NO: 429764 - RNA, 19 nt, Homo sapiens
acagcucccugccaaacug

SEQ ID NO: 429765 - RNA, 19 nt, Homo sapiens
gaaaagcgagccgagaaga

SEQ ID NO: 429766 - RNA, 19 nt, Homo sapiens
gaaugaagugcuggagauc

SEQ ID NO: 429767 - RNA, 19 nt, Homo sapiens
gggaccaucagcaagaaug

SEQ ID NO: 429768 - RNA, 19 nt, Homo sapiens
caucuacgccaaguucuuc

SEQ ID NO: 429769 - RNA, 19 nt, Homo sapiens
acugaagcaucuguaguga

SEQ ID NO: 429770 - RNA, 19 nt, Homo sapiens
gcuguccucccuccaccua

SEQ ID NO: 429771 - RNA, 19 nt, Homo sapiens
aaacugaagcaucuguagu

SEQ ID NO: 429772 - RNA, 19 nt, Homo sapiens
gcaagaccaaccagaagcu

SEQ ID NO: 429773 - RNA, 19 nt, Homo sapiens
uuuguggagugcuggguaa

SEQ ID NO: 429774 - RNA, 19 nt, Homo sapiens
cagagcaucuacgccaagu

SEQ ID NO: 429775 - RNA, 19 nt, Homo sapiens
acacuggccaauaaggaaa

SEQ ID NO: 429776 - RNA, 19 nt, Homo sapiens
gcaucacccagcagcaguu

SEQ ID NO: 429777 - RNA, 19 nt, Homo sapiens
aaagcgagccgagaagauc

SEQ ID NO: 429778 - RNA, 19 nt, Homo sapiens
caucagcaagaaugaagug

SEQ ID NO: 429779 - RNA, 19 nt, Homo sapiens
ggacaaggacuuugauuua

SEQ ID NO: 429780 - RNA, 19 nt, Homo sapiens
gacaaggacuuugauuuau

SEQ ID NO: 429781 - RNA, 19 nt, Homo sapiens
ggagcagucucuuaaacaa

SEQ ID NO: 429782 - RNA, 19 nt, Homo sapiens
ggacuuugauuuauuucug

SEQ ID NO: 429783 - RNA, 19 nt, Homo sapiens
ucaugaaccugaucuguga

SEQ ID NO: 429784 - RNA, 19 nt, Homo sapiens
uguaguaccugccagcuuu

SEQ ID NO: 429785 - RNA, 19 nt, Homo sapiens
gcuacugugucuccaaauu

SEQ ID NO: 429786 - RNA, 19 nt, Homo sapiens
ggguggagaugcacguuaa

SEQ ID NO: 429787 - RNA, 19 nt, Homo sapiens
gggccuuccucaccaagua

SEQ ID NO: 429788 - RNA, 19 nt, Homo sapiens
ggagaugcacguuaaggaa

SEQ ID NO: 429789 - RNA, 19 nt, Homo sapiens
gggcuacugugucuccaaa

SEQ ID NO: 429790 - RNA, 19 nt, Homo sapiens
acaccacccuguuggauau

SEQ ID NO: 429791 - RNA, 19 nt, Homo sapiens
gcaaugccuuugucuucau

SEQ ID NO: 429792 - RNA, 19 nt, Homo sapiens
ggcgggauguagcucauuu

SEQ ID NO: 429793 - RNA, 19 nt, Homo sapiens
ccaaguggguggagaugca

SEQ ID NO: 429794 - RNA, 19 nt, Homo sapiens
gaauccagccuuccagcaa

SEQ ID NO: 429795 - RNA, 19 nt, Homo sapiens
cagcaaugccuuugucuuc

SEQ ID NO: 429796 - RNA, 19 nt, Homo sapiens
gagcagucucuuaaacaaa

SEQ ID NO: 429797 - RNA, 19 nt, Homo sapiens
ccacacaggcccacuaugg

SEQ ID NO: 429798 - RNA, 19 nt, Homo sapiens
gaaggugggcagaaaugug

SEQ ID NO: 429799 - RNA, 19 nt, Homo sapiens
cuacugugucuccaaauuu

SEQ ID NO: 429800 - RNA, 19 nt, Homo sapiens
aaaagaaggugggcagaaa

SEQ ID NO: 429801 - RNA, 19 nt, Homo sapiens
ccaaguaccugaaaaugca

SEQ ID NO: 429802 - RNA, 19 nt, Homo sapiens
cguggagccugguuucuuc

SEQ ID NO: 429803 - RNA, 19 nt, Homo sapiens
uacugugucuccaaauuug

SEQ ID NO: 429804 - RNA, 19 nt, Homo sapiens
agaaaugugcccaguggaa

SEQ ID NO: 429805 - RNA, 19 nt, Homo sapiens
ucacuugggcuccagcuau

SEQ ID NO: 429806 - RNA, 19 nt, Homo sapiens
gggagcagucucuuaaaca

SEQ ID NO: 429807 - RNA, 19 nt, Homo sapiens
aggacaaggacuuugauuu

SEQ ID NO: 429808 - RNA, 19 nt, Homo sapiens
gcuauguggcugccucuuc

SEQ ID NO: 429809 - RNA, 19 nt, Homo sapiens
cacuugggcuccagcuaug

SEQ ID NO: 429810 - RNA, 19 nt, Homo sapiens
cuauguggcugccucuucu

SEQ ID NO: 429811 - RNA, 19 nt, Homo sapiens
cuggaggccuucucugaca

SEQ ID NO: 429812 - RNA, 19 nt, Homo sapiens
aaagaaggugggcagaaau

SEQ ID NO: 429813 - RNA, 19 nt, Homo sapiens
ucccaagccugcccaagca

SEQ ID NO: 429814 - RNA, 19 nt, Homo sapiens
gaucugugacccggaccua

SEQ ID NO: 429815 - RNA, 19 nt, Homo sapiens
ugguguggcugguaucauc

SEQ ID NO: 429816 - RNA, 19 nt, Homo sapiens
caaugccuuugucuucauc

SEQ ID NO: 429817 - RNA, 19 nt, Homo sapiens
ugcaacagcgcaucaugaa

SEQ ID NO: 429818 - RNA, 19 nt, Homo sapiens
gaggcgggauguagcucau

SEQ ID NO: 429819 - RNA, 19 nt, Homo sapiens
caaggacaaggacuuugau

SEQ ID NO: 429820 - RNA, 19 nt, Homo sapiens
aagaaggugggcagaaaug

SEQ ID NO: 429821 - RNA, 19 nt, Homo sapiens
ugggagcagucucuuaaac

SEQ ID NO: 429822 - RNA, 19 nt, Homo sapiens
gggcagugcugugguugcu

SEQ ID NO: 429823 - RNA, 19 nt, Homo sapiens
uaacagcugucaauagaua

SEQ ID NO: 429824 - RNA, 19 nt, Homo sapiens
gaaugaagcuaaugugaau

SEQ ID NO: 429825 - RNA, 19 nt, Homo sapiens
ggagcgaugugaugaauaa

SEQ ID NO: 429826 - RNA, 19 nt, Homo sapiens
gggaauagguuacuuugga

SEQ ID NO: 429827 - RNA, 19 nt, Homo sapiens
guuaacagcugucaauaga

SEQ ID NO: 429828 - RNA, 19 nt, Homo sapiens
ggaaugauccauacugaaa

SEQ ID NO: 429829 - RNA, 19 nt, Homo sapiens
acacacaguuguugaauga

SEQ ID NO: 429830 - RNA, 19 nt, Homo sapiens
gggaacaguccauaacuua

SEQ ID NO: 429831 - RNA, 19 nt, Homo sapiens
caagggcucuggcucauga

SEQ ID NO: 429832 - RNA, 19 nt, Homo sapiens
gaaagggaacaguccauaa

SEQ ID NO: 429833 - RNA, 19 nt, Homo sapiens
gagcaacaaucagacauga

SEQ ID NO: 429834 - RNA, 19 nt, Homo sapiens
gcucuaaacaggauucuuu

SEQ ID NO: 429835 - RNA, 19 nt, Homo sapiens
gcagguguuucaugaagaa

SEQ ID NO: 429836 - RNA, 19 nt, Homo sapiens
gaggugaccauuacaauug

SEQ ID NO: 429837 - RNA, 19 nt, Homo sapiens
gaagaagaccaucgacaug

SEQ ID NO: 429838 - RNA, 19 nt, Homo sapiens
ggacugaguuuggguucuu

SEQ ID NO: 429839 - RNA, 19 nt, Homo sapiens
cagcauaauuccuccaguu

SEQ ID NO: 429840 - RNA, 19 nt, Homo sapiens
agacaugaguccacccuuu

SEQ ID NO: 429841 - RNA, 19 nt, Homo sapiens
ggaagaggagcaacaauca

SEQ ID NO: 429842 - RNA, 19 nt, Homo sapiens
ggacuguuccugaagauug

SEQ ID NO: 429843 - RNA, 19 nt, Homo sapiens
caaggagggcaccaucuua

SEQ ID NO: 429844 - RNA, 19 nt, Homo sapiens
gaagaagcgggucaaguug

SEQ ID NO: 429845 - RNA, 19 nt, Homo sapiens
gcauggcgcuacugaaagu

SEQ ID NO: 429846 - RNA, 19 nt, Homo sapiens
gggcugcgcuaccuacaga

SEQ ID NO: 429847 - RNA, 19 nt, Homo sapiens
cagguuggccguuugcuua

SEQ ID NO: 429848 - RNA, 19 nt, Homo sapiens
gaaauagugcacuccaaga

SEQ ID NO: 429849 - RNA, 19 nt, Homo sapiens
gagaaauagugcacuccaa

SEQ ID NO: 429850 - RNA, 19 nt, Homo sapiens
gaccagauccaagauguuu

SEQ ID NO: 429851 - RNA, 19 nt, Homo sapiens
uaacuuaccucugcuucug

SEQ ID NO: 429852 - RNA, 19 nt, Homo sapiens
aaauggccauguugucuuu

SEQ ID NO: 429853 - RNA, 19 nt, Homo sapiens
ccauguugcuucacucuau

SEQ ID NO: 429854 - RNA, 19 nt, Homo sapiens
ucaagaacggcaugaagua

SEQ ID NO: 429855 - RNA, 19 nt, Homo sapiens
gaggagcgaugugaugaau

SEQ ID NO: 429856 - RNA, 19 nt, Homo sapiens
agaagaagcgggucaaguu

SEQ ID NO: 429857 - RNA, 19 nt, Homo sapiens
ggucccaaguuuaauuaga

SEQ ID NO: 429858 - RNA, 19 nt, Homo sapiens
gggaaggagagaaugauuu

SEQ ID NO: 429859 - RNA, 19 nt, Homo sapiens
gaagcuaaugugaauguga

SEQ ID NO: 429860 - RNA, 19 nt, Homo sapiens
cagaagaccagauccaaga

SEQ ID NO: 429861 - RNA, 19 nt, Homo sapiens
ucauggagcaagagaauuu

SEQ ID NO: 429862 - RNA, 19 nt, Homo sapiens
agucaaagaucgaaucaag

SEQ ID NO: 429863 - RNA, 19 nt, Homo sapiens
gcaacaaucagacaugagu

SEQ ID NO: 429864 - RNA, 19 nt, Homo sapiens
gguuugagauucaguggau

SEQ ID NO: 429865 - RNA, 19 nt, Homo sapiens
gcagggcccagcauaauuc

SEQ ID NO: 429866 - RNA, 19 nt, Homo sapiens
gcuagcaaauacaggaguu

SEQ ID NO: 429867 - RNA, 19 nt, Homo sapiens
caacucagcacacuacagu

SEQ ID NO: 429868 - RNA, 19 nt, Homo sapiens
agaacggcaugaaguacua

SEQ ID NO: 429869 - RNA, 19 nt, Homo sapiens
cgaaagaggagcgauguga

SEQ ID NO: 429870 - RNA, 19 nt, Homo sapiens
gcaagcauggcgcuacuga

SEQ ID NO: 429871 - RNA, 19 nt, Homo sapiens
gcucuaggcccacaagugu

SEQ ID NO: 429872 - RNA, 19 nt, Homo sapiens
caacaacucagcacacuac

SEQ ID NO: 429873 - RNA, 19 nt, Homo sapiens
gaagucaaagaucgaauca

SEQ ID NO: 429874 - RNA, 19 nt, Homo sapiens
gcccacaaguguaacuaug

SEQ ID NO: 429875 - RNA, 19 nt, Homo sapiens
aaaggucccugagcucuug

SEQ ID NO: 429876 - RNA, 19 nt, Homo sapiens
aaggaaugauccauacuga

SEQ ID NO: 429877 - RNA, 19 nt, Homo sapiens
gacacacaguuguugaaug

SEQ ID NO: 429878 - RNA, 19 nt, Homo sapiens
gaaagaggagcgaugugau

SEQ ID NO: 429879 - RNA, 19 nt, Homo sapiens
ggccaaggaaugauccaua

SEQ ID NO: 429880 - RNA, 19 nt, Homo sapiens
gcauugagggcucuaaaca

SEQ ID NO: 429881 - RNA, 19 nt, Homo sapiens
ugaaugaagcuaaugugaa

SEQ ID NO: 429882 - RNA, 19 nt, Homo sapiens
acucagcacacuacaguua

SEQ ID NO: 429883 - RNA, 19 nt, Homo sapiens
gcagaucgaguucaaaugc

SEQ ID NO: 429884 - RNA, 19 nt, Homo sapiens
ccucugggcucguuaaggu

SEQ ID NO: 429885 - RNA, 19 nt, Homo sapiens
gacuguuccugaagauuga

SEQ ID NO: 429886 - RNA, 19 nt, Homo sapiens
aagcauggcgcuacugaaa

SEQ ID NO: 429887 - RNA, 19 nt, Homo sapiens
gccaaggaaugauccauac

SEQ ID NO: 429888 - RNA, 19 nt, Homo sapiens
gaagaccagauccaagaug

SEQ ID NO: 429889 - RNA, 19 nt, Homo sapiens
ccgaugguguuugggaaua

SEQ ID NO: 429890 - RNA, 19 nt, Homo sapiens
ggaaggagagaaugauuuu

SEQ ID NO: 429891 - RNA, 19 nt, Homo sapiens
aaggagauucuuugagaua

SEQ ID NO: 429892 - RNA, 19 nt, Homo sapiens
ggauuuagucccacccuau

SEQ ID NO: 429893 - RNA, 19 nt, Homo sapiens
gggacugguuugagauuca

SEQ ID NO: 429894 - RNA, 19 nt, Homo sapiens
gaagauugaacuccgaaag

SEQ ID NO: 429895 - RNA, 19 nt, Homo sapiens
caaggcagggcccagcaua

SEQ ID NO: 429896 - RNA, 19 nt, Homo sapiens
aguaucagaucaccaacaa

SEQ ID NO: 429897 - RNA, 19 nt, Homo sapiens
caacaucauccucuuccuu

SEQ ID NO: 429898 - RNA, 19 nt, Homo sapiens
gugcccaacucauugauag

SEQ ID NO: 429899 - RNA, 19 nt, Homo sapiens
gacaugaguccacccuuug

SEQ ID NO: 429900 - RNA, 19 nt, Homo sapiens
cgaggugaccauuacaauu

SEQ ID NO: 429901 - RNA, 19 nt, Homo sapiens
uugcuucacucuauccaaa

SEQ ID NO: 429902 - RNA, 19 nt, Homo sapiens
ucccgaacacugagaaaua

SEQ ID NO: 429903 - RNA, 19 nt, Homo sapiens
caaagaagucaaagaucga

SEQ ID NO: 429904 - RNA, 19 nt, Homo sapiens
gucccaaguuuaauuagau

SEQ ID NO: 429905 - RNA, 19 nt, Homo sapiens
aaacacuauuucuggaaug

SEQ ID NO: 429906 - RNA, 19 nt, Homo sapiens
gugaaugaagcuaauguga

SEQ ID NO: 429907 - RNA, 19 nt, Homo sapiens
ucaaagaucgaaucaagag

SEQ ID NO: 429908 - RNA, 19 nt, Homo sapiens
cguguuggcuggcaucauc

SEQ ID NO: 429909 - RNA, 19 nt, Homo sapiens
gguauguucugggcuuaau

SEQ ID NO: 429910 - RNA, 19 nt, Homo sapiens
cagcaaagggcaaggaauc

SEQ ID NO: 429911 - RNA, 19 nt, Homo sapiens
ccauggacaacacuaauug

SEQ ID NO: 429912 - RNA, 19 nt, Homo sapiens
gcugagaaccacggugaaa

SEQ ID NO: 429913 - RNA, 19 nt, Homo sapiens
ggagcaacaaucagacaug

SEQ ID NO: 429914 - RNA, 19 nt, Homo sapiens
ugaagaagaccaucgacau

SEQ ID NO: 429915 - RNA, 19 nt, Homo sapiens
ucccugagcucuugcuauc

SEQ ID NO: 429916 - RNA, 19 nt, Homo sapiens
cuacugaaagucaaguuug

SEQ ID NO: 429917 - RNA, 19 nt, Homo sapiens
caaggaaugauccauacug

SEQ ID NO: 429918 - RNA, 19 nt, Homo sapiens
gcuacugaaagucaaguuu

SEQ ID NO: 429919 - RNA, 19 nt, Homo sapiens
gaauaauggacucuuaagg

SEQ ID NO: 429920 - RNA, 19 nt, Homo sapiens
gagggcaccaucuuacaga

SEQ ID NO: 429921 - RNA, 19 nt, Homo sapiens
ccaaggagggcaccaucuu

SEQ ID NO: 429922 - RNA, 19 nt, Homo sapiens
aaauagugcacuccaagaa

SEQ ID NO: 429923 - RNA, 19 nt, Homo sapiens
ggaaagagauuagaacauu

SEQ ID NO: 429924 - RNA, 19 nt, Homo sapiens
aaagaaagguugcguuuaa

SEQ ID NO: 429925 - RNA, 19 nt, Homo sapiens
ggcauuaaguucagaauua

SEQ ID NO: 429926 - RNA, 19 nt, Homo sapiens
gaaggaagccugauacuau

SEQ ID NO: 429927 - RNA, 19 nt, Homo sapiens
gaaggagguucuaauauuc

SEQ ID NO: 429928 - RNA, 19 nt, Homo sapiens
gagaaaugcuaaccuugua

SEQ ID NO: 429929 - RNA, 19 nt, Homo sapiens
cuacauggcuuaaacuaaa

SEQ ID NO: 429930 - RNA, 19 nt, Homo sapiens
gaaaauaucucuugugcuu

SEQ ID NO: 429931 - RNA, 19 nt, Homo sapiens
gguuauagcuuacugaaga

SEQ ID NO: 429932 - RNA, 19 nt, Homo sapiens
ggagugaaaucagaaauau

SEQ ID NO: 429933 - RNA, 19 nt, Homo sapiens
gaaugucuguaccuugaua

SEQ ID NO: 429934 - RNA, 19 nt, Homo sapiens
cacaagaucuagaaaugua

SEQ ID NO: 429935 - RNA, 19 nt, Homo sapiens
gacaaaagcucaugcaaaa

SEQ ID NO: 429936 - RNA, 19 nt, Homo sapiens
gcgagcacauguucauaua

SEQ ID NO: 429937 - RNA, 19 nt, Homo sapiens
ugaauucacugccaagauu

SEQ ID NO: 429938 - RNA, 19 nt, Homo sapiens
caacaauacuaccucacua

SEQ ID NO: 429939 - RNA, 19 nt, Homo sapiens
gaacuggcaugaagaacau

SEQ ID NO: 429940 - RNA, 19 nt, Homo sapiens
caauacaacuggcaaacaa

SEQ ID NO: 429941 - RNA, 19 nt, Homo sapiens
aaacauagcugguuaaccu

SEQ ID NO: 429942 - RNA, 19 nt, Homo sapiens
gaacaacacaaacuaacaa

SEQ ID NO: 429943 - RNA, 19 nt, Homo sapiens
caagaaccauuugcaauau

SEQ ID NO: 429944 - RNA, 19 nt, Homo sapiens
gaaagaauagaacgugaaa

SEQ ID NO: 429945 - RNA, 19 nt, Homo sapiens
gaaagguugcguuuaauau

SEQ ID NO: 429946 - RNA, 19 nt, Homo sapiens
gaauaaugcugaagcuagu

SEQ ID NO: 429947 - RNA, 19 nt, Homo sapiens
caaagcagcguaucgauga

SEQ ID NO: 429948 - RNA, 19 nt, Homo sapiens
gagcacauguucauauagu

SEQ ID NO: 429949 - RNA, 19 nt, Homo sapiens
gcuccucacugguauacua

SEQ ID NO: 429950 - RNA, 19 nt, Homo sapiens
gggauucugauuuguauua

SEQ ID NO: 429951 - RNA, 19 nt, Homo sapiens
cagcaaagguuauucuaca

SEQ ID NO: 429952 - RNA, 19 nt, Homo sapiens
uaccauagcuacaucaguu

SEQ ID NO: 429953 - RNA, 19 nt, Homo sapiens
caagagagagagagaauga

SEQ ID NO: 429954 - RNA, 19 nt, Homo sapiens
uaggagaguuuacugauga

SEQ ID NO: 429955 - RNA, 19 nt, Homo sapiens
ugaagcuagugcugaauua

SEQ ID NO: 429956 - RNA, 19 nt, Homo sapiens
agaaagaacuagaagaaca

SEQ ID NO: 429957 - RNA, 19 nt, Homo sapiens
gaacuauacaugcgaagaa

SEQ ID NO: 429958 - RNA, 19 nt, Homo sapiens
caauauggauuucuuagag

SEQ ID NO: 429959 - RNA, 19 nt, Homo sapiens
acaagaaccauuugcaaua

SEQ ID NO: 429960 - RNA, 19 nt, Homo sapiens
gaaacagccucugcaagau

SEQ ID NO: 429961 - RNA, 19 nt, Homo sapiens
guaaaucccaguaggcuuu

SEQ ID NO: 429962 - RNA, 19 nt, Homo sapiens
ggaaagggcacaauuagag

SEQ ID NO: 429963 - RNA, 19 nt, Homo sapiens
gaagagaauauuccuacuu

SEQ ID NO: 429964 - RNA, 19 nt, Homo sapiens
ccaaucaacguaagaguaa

SEQ ID NO: 429965 - RNA, 19 nt, Homo sapiens
gggaaaccaugaacuauac

SEQ ID NO: 429966 - RNA, 19 nt, Homo sapiens
gaagaaagaauacagaacu

SEQ ID NO: 429967 - RNA, 19 nt, Homo sapiens
aagagaauauuccuacuug

SEQ ID NO: 429968 - RNA, 19 nt, Homo sapiens
aagaaugucuguaccuuga

SEQ ID NO: 429969 - RNA, 19 nt, Homo sapiens
ugaaacagccucugcaaga

SEQ ID NO: 429970 - RNA, 19 nt, Homo sapiens
gggcacaauuagagaauga

SEQ ID NO: 429971 - RNA, 19 nt, Homo sapiens
uguauggagucaacuauuu

SEQ ID NO: 429972 - RNA, 19 nt, Homo sapiens
gguguuccauugccucuuu

SEQ ID NO: 429973 - RNA, 19 nt, Homo sapiens
ggggagcucuucaacauua

SEQ ID NO: 429974 - RNA, 19 nt, Homo sapiens
gacgacaaguuaacaccua

SEQ ID NO: 429975 - RNA, 19 nt, Homo sapiens
gagaauccuuuacaguuca

SEQ ID NO: 429976 - RNA, 19 nt, Homo sapiens
uaucacgucugacaaaugu

SEQ ID NO: 429977 - RNA, 19 nt, Homo sapiens
gaagaacguguaaccgaaa

SEQ ID NO: 429978 - RNA, 19 nt, Homo sapiens
gugcugaauuaucaaauga

SEQ ID NO: 429979 - RNA, 19 nt, Homo sapiens
ucagaaagaacuagaagaa

SEQ ID NO: 429980 - RNA, 19 nt, Homo sapiens
gcuaaauucuuuccugaag

SEQ ID NO: 429981 - RNA, 19 nt, Homo sapiens
gguauuacacagucaaauu

SEQ ID NO: 429982 - RNA, 19 nt, Homo sapiens
ccucgaucaucaagaaaua

SEQ ID NO: 429983 - RNA, 19 nt, Homo sapiens
aagcaggccuuugcagaua

SEQ ID NO: 429984 - RNA, 19 nt, Homo sapiens
ugaagaacauagaggaaug

SEQ ID NO: 429985 - RNA, 19 nt, Homo sapiens
gcacuaccauagcuacauc

SEQ ID NO: 429986 - RNA, 19 nt, Homo sapiens
ucagugugcccuucucuua

SEQ ID NO: 429987 - RNA, 19 nt, Homo sapiens
gcauuaaguucagaauuag

SEQ ID NO: 429988 - RNA, 19 nt, Homo sapiens
gaaagggcacaauuagaga

SEQ ID NO: 429989 - RNA, 19 nt, Homo sapiens
cgaagaaggaagccugaua

SEQ ID NO: 429990 - RNA, 19 nt, Homo sapiens
auacagaacuggcaugaag

SEQ ID NO: 429991 - RNA, 19 nt, Homo sapiens
gacaaaacauagcugguua

SEQ ID NO: 429992 - RNA, 19 nt, Homo sapiens
cuagaucacugugcuuauu

SEQ ID NO: 429993 - RNA, 19 nt, Homo sapiens
caacauuaaggcaguauga

SEQ ID NO: 429994 - RNA, 19 nt, Homo sapiens
caauuaaagcucagaaaga

SEQ ID NO: 429995 - RNA, 19 nt, Homo sapiens
gaagagcagacaauuaaag

SEQ ID NO: 429996 - RNA, 19 nt, Homo sapiens
gagcaugacgacaaguuaa

SEQ ID NO: 429997 - RNA, 19 nt, Homo sapiens
agagagaaaugcuaaccuu

SEQ ID NO: 429998 - RNA, 19 nt, Homo sapiens
gaagcagaacgacuugaaa

SEQ ID NO: 429999 - RNA, 19 nt, Homo sapiens
uugaagagcagacaauuaa

SEQ ID NO: 430000 - RNA, 19 nt, Homo sapiens
ggaaagaauagaacgugaa

SEQ ID NO: 430001 - RNA, 19 nt, Homo sapiens
cuuugggucugaauauuua

SEQ ID NO: 430002 - RNA, 19 nt, Homo sapiens
gaagauguuucugaggaau

SEQ ID NO: 430003 - RNA, 19 nt, Homo sapiens
cacaguagauucaaguugu

SEQ ID NO: 430004 - RNA, 19 nt, Homo sapiens
gcagcuagcagcagaacuu

SEQ ID NO: 430005 - RNA, 19 nt, Homo sapiens
gagcuaauggaacgucuaa

SEQ ID NO: 430006 - RNA, 19 nt, Homo sapiens
ugaauuaugugcacuacca

SEQ ID NO: 430007 - RNA, 19 nt, Homo sapiens
guucagcuacuuuccauuu

SEQ ID NO: 430008 - RNA, 19 nt, Homo sapiens
uguagaauauggcuaugaa

SEQ ID NO: 430009 - RNA, 19 nt, Homo sapiens
guuggaaagggcacaauua

SEQ ID NO: 430010 - RNA, 19 nt, Homo sapiens
gaagaaggaagccugauac

SEQ ID NO: 430011 - RNA, 19 nt, Homo sapiens
aaagaacagugggaagaaa

SEQ ID NO: 430012 - RNA, 19 nt, Homo sapiens
gcaauauggauuucuuaga

SEQ ID NO: 430013 - RNA, 19 nt, Homo sapiens
gcacaguagauucaaguug

SEQ ID NO: 430014 - RNA, 19 nt, Homo sapiens
caaagucugccauagcaaa

SEQ ID NO: 430015 - RNA, 19 nt, Homo sapiens
gaagaagcagaacgacuug

SEQ ID NO: 430016 - RNA, 19 nt, Homo sapiens
aaggaagccugauacuauu

SEQ ID NO: 430017 - RNA, 19 nt, Homo sapiens
agauguuucugaggaauua

SEQ ID NO: 430018 - RNA, 19 nt, Homo sapiens
ugaagugacuguuguacca

SEQ ID NO: 430019 - RNA, 19 nt, Homo sapiens
uagccucgaucaucaagaa

SEQ ID NO: 430020 - RNA, 19 nt, Homo sapiens
caaagcacuuacaccaguu

SEQ ID NO: 430021 - RNA, 19 nt, Homo sapiens
gcaaagguuauucuacaug

SEQ ID NO: 430022 - RNA, 19 nt, Homo sapiens
gaaaagagaaauagcagaa

SEQ ID NO: 430023 - RNA, 19 nt, Homo sapiens
gaaagacucugaacaaguu

SEQ ID NO: 430024 - RNA, 19 nt, Homo sapiens
gagcuuauguuaccaguua

SEQ ID NO: 430025 - RNA, 19 nt, Homo sapiens
gaagaaggcugcaaacaug

SEQ ID NO: 430026 - RNA, 19 nt, Homo sapiens
gaaagaacauaacagagua

SEQ ID NO: 430027 - RNA, 19 nt, Homo sapiens
gcaaggagauuuacucgaa

SEQ ID NO: 430028 - RNA, 19 nt, Homo sapiens
caccaaagccuguuuauua

SEQ ID NO: 430029 - RNA, 19 nt, Homo sapiens
ggccaaaucuauauuauga

SEQ ID NO: 430030 - RNA, 19 nt, Homo sapiens
caagggauguccaaucuuu

SEQ ID NO: 430031 - RNA, 19 nt, Homo sapiens
gaagauuauugcacacuuu

SEQ ID NO: 430032 - RNA, 19 nt, Homo sapiens
ggaaagagcuuauguuacc

SEQ ID NO: 430033 - RNA, 19 nt, Homo sapiens
gaaguucacugcuguaguc

SEQ ID NO: 430034 - RNA, 19 nt, Homo sapiens
ggagaaaccggaaaguuaa

SEQ ID NO: 430035 - RNA, 19 nt, Homo sapiens
gauaagaccacaguucaua

SEQ ID NO: 430036 - RNA, 19 nt, Homo sapiens
aacaagagcuuauucagaa

SEQ ID NO: 430037 - RNA, 19 nt, Homo sapiens
ggagguauuucuuguuaug

SEQ ID NO: 430038 - RNA, 19 nt, Homo sapiens
uaaagacagugcauuugaa

SEQ ID NO: 430039 - RNA, 19 nt, Homo sapiens
aaggagguauuucuuguua

SEQ ID NO: 430040 - RNA, 19 nt, Homo sapiens
gcuugaaacuauuaacgua

SEQ ID NO: 430041 - RNA, 19 nt, Homo sapiens
gauaacugcuguaaagaca

SEQ ID NO: 430042 - RNA, 19 nt, Homo sapiens
gcagaagcuuuaugagaug

SEQ ID NO: 430043 - RNA, 19 nt, Homo sapiens
guaaagacagugcauuuga

SEQ ID NO: 430044 - RNA, 19 nt, Homo sapiens
gaagauaagaccacaguuc

SEQ ID NO: 430045 - RNA, 19 nt, Homo sapiens
guggaaagagcuuauguua

SEQ ID NO: 430046 - RNA, 19 nt, Homo sapiens
gaauacaggagcuaagaaa

SEQ ID NO: 430047 - RNA, 19 nt, Homo sapiens
gcagaggaacugaaugaaa

SEQ ID NO: 430048 - RNA, 19 nt, Homo sapiens
gaacuggauucuauaacca

SEQ ID NO: 430049 - RNA, 19 nt, Homo sapiens
gaugguuuaugcauguaua

SEQ ID NO: 430050 - RNA, 19 nt, Homo sapiens
ugaaacugauugauucuug

SEQ ID NO: 430051 - RNA, 19 nt, Homo sapiens
gcaaucaggaaucauauau

SEQ ID NO: 430052 - RNA, 19 nt, Homo sapiens
gcaguucccuaacgcauca

SEQ ID NO: 430053 - RNA, 19 nt, Homo sapiens
gcaaccauguuaaaugcuu

SEQ ID NO: 430054 - RNA, 19 nt, Homo sapiens
caacaagagcuuauucaga

SEQ ID NO: 430055 - RNA, 19 nt, Homo sapiens
gcaauauuauacugacaga

SEQ ID NO: 430056 - RNA, 19 nt, Homo sapiens
caaaugucgucguguguug

SEQ ID NO: 430057 - RNA, 19 nt, Homo sapiens
cuaaggagcauguuaaaug

SEQ ID NO: 430058 - RNA, 19 nt, Homo sapiens
cauugaaacugauugauuc

SEQ ID NO: 430059 - RNA, 19 nt, Homo sapiens
aaagaugguuuaugcaugu

SEQ ID NO: 430060 - RNA, 19 nt, Homo sapiens
gugcuuaccaugccaauuu

SEQ ID NO: 430061 - RNA, 19 nt, Homo sapiens
ggucaagggugugcgcuuu

SEQ ID NO: 430062 - RNA, 19 nt, Homo sapiens
gaaaggcaacaagagcuua

SEQ ID NO: 430063 - RNA, 19 nt, Homo sapiens
ccucaaacacugaagauuu

SEQ ID NO: 430064 - RNA, 19 nt, Homo sapiens
gucaaacaccggagaguua

SEQ ID NO: 430065 - RNA, 19 nt, Homo sapiens
cuacggcuuuggagauaua

SEQ ID NO: 430066 - RNA, 19 nt, Homo sapiens
ccagaugugagguuuguua

SEQ ID NO: 430067 - RNA, 19 nt, Homo sapiens
ucacugcccugcucugaga

SEQ ID NO: 430068 - RNA, 19 nt, Homo sapiens
gaauugcuguggaugaagu

SEQ ID NO: 430069 - RNA, 19 nt, Homo sapiens
cugaggaacuggauucuau

SEQ ID NO: 430070 - RNA, 19 nt, Homo sapiens
aggagaaaccggaaaguua

SEQ ID NO: 430071 - RNA, 19 nt, Homo sapiens
gagaguagcagguguugug

SEQ ID NO: 430072 - RNA, 19 nt, Homo sapiens
caugaaagcagacuguauu

SEQ ID NO: 430073 - RNA, 19 nt, Homo sapiens
gagaaagccuaugaagcaa

SEQ ID NO: 430074 - RNA, 19 nt, Homo sapiens
gaagcuuuaugagauggua

SEQ ID NO: 430075 - RNA, 19 nt, Homo sapiens
ccuaacgcaucacuaauug

SEQ ID NO: 430076 - RNA, 19 nt, Homo sapiens
uaaggagcauguuaaaugg

SEQ ID NO: 430077 - RNA, 19 nt, Homo sapiens
caaagccuguuuauuagca

SEQ ID NO: 430078 - RNA, 19 nt, Homo sapiens
gaaagcagacuguauuuug

SEQ ID NO: 430079 - RNA, 19 nt, Homo sapiens
gauuauaaggcacuuggua

SEQ ID NO: 430080 - RNA, 19 nt, Homo sapiens
ucagaccacuucagcuuga

SEQ ID NO: 430081 - RNA, 19 nt, Homo sapiens
cagaggaacugaaugaaaa

SEQ ID NO: 430082 - RNA, 19 nt, Homo sapiens
gacagugcauuugaaagaa

SEQ ID NO: 430083 - RNA, 19 nt, Homo sapiens
gggcaagcaaugaauauga

SEQ ID NO: 430084 - RNA, 19 nt, Homo sapiens
gaggaacuggauucuauaa

SEQ ID NO: 430085 - RNA, 19 nt, Homo sapiens
gcucugggauaacuacugu

SEQ ID NO: 430086 - RNA, 19 nt, Homo sapiens
ugacaaaguccacgcagaa

SEQ ID NO: 430087 - RNA, 19 nt, Homo sapiens
cagcagaagcuuuaugaga

SEQ ID NO: 430088 - RNA, 19 nt, Homo sapiens
gacagcagaagcuuuauga

SEQ ID NO: 430089 - RNA, 19 nt, Homo sapiens
agagaaagccuaugaagca

SEQ ID NO: 430090 - RNA, 19 nt, Homo sapiens
gaacaaguuacgguuaguu

SEQ ID NO: 430091 - RNA, 19 nt, Homo sapiens
guuaaaugcuucuaguucu

SEQ ID NO: 430092 - RNA, 19 nt, Homo sapiens
gcuaccauuucguauuuga

SEQ ID NO: 430093 - RNA, 19 nt, Homo sapiens
uaaagcggcaguucccuaa

SEQ ID NO: 430094 - RNA, 19 nt, Homo sapiens
cagcaaccauguuaaaugc

SEQ ID NO: 430095 - RNA, 19 nt, Homo sapiens
gcccauugaucucucuuau

SEQ ID NO: 430096 - RNA, 19 nt, Homo sapiens
ccaguuaccagcauuaugu

SEQ ID NO: 430097 - RNA, 19 nt, Homo sapiens
ggaacuggauucuauaacc

SEQ ID NO: 430098 - RNA, 19 nt, Homo sapiens
ugaaucgucucaaacuugu

SEQ ID NO: 430099 - RNA, 19 nt, Homo sapiens
uaaucaagauccugaagca

SEQ ID NO: 430100 - RNA, 19 nt, Homo sapiens
gaauugauaagccagaugu

SEQ ID NO: 430101 - RNA, 19 nt, Homo sapiens
agaccacaguucauagaaa

SEQ ID NO: 430102 - RNA, 19 nt, Homo sapiens
uuguaaagcucauuaaugg

SEQ ID NO: 430103 - RNA, 19 nt, Homo sapiens
guucuaaggagcauguuaa

SEQ ID NO: 430104 - RNA, 19 nt, Homo sapiens
uauggaagaccaauuaaug

SEQ ID NO: 430105 - RNA, 19 nt, Homo sapiens
ggcaagcaaugaauaugau

SEQ ID NO: 430106 - RNA, 19 nt, Homo sapiens
cauacaaucgucuuaaguu

SEQ ID NO: 430107 - RNA, 19 nt, Homo sapiens
gaaaauggucagccaauga

SEQ ID NO: 430108 - RNA, 19 nt, Homo sapiens
gggaaagggugcagcaaaa

SEQ ID NO: 430109 - RNA, 19 nt, Homo sapiens
ccauugaaacugauugauu

SEQ ID NO: 430110 - RNA, 19 nt, Homo sapiens
agacagugcauuugaaaga

SEQ ID NO: 430111 - RNA, 19 nt, Homo sapiens
uaagccagaugugagguuu

SEQ ID NO: 430112 - RNA, 19 nt, Homo sapiens
gaggagaaaccggaaaguu

SEQ ID NO: 430113 - RNA, 19 nt, Homo sapiens
uuaugugacuccagagaaa

SEQ ID NO: 430114 - RNA, 19 nt, Homo sapiens
ggaaaggcaacaagagcuu

SEQ ID NO: 430115 - RNA, 19 nt, Homo sapiens
gaucaagggauguccaauc

SEQ ID NO: 430116 - RNA, 19 nt, Homo sapiens
gcugaaucgucucaaacuu

SEQ ID NO: 430117 - RNA, 19 nt, Homo sapiens
gauuauugcacacuuucua

SEQ ID NO: 430118 - RNA, 19 nt, Homo sapiens
agaaagaacauaacagagu

SEQ ID NO: 430119 - RNA, 19 nt, Homo sapiens
gaaagaaagaacauaacag

SEQ ID NO: 430120 - RNA, 19 nt, Homo sapiens
caaggagauuuacucgaau

SEQ ID NO: 430121 - RNA, 19 nt, Homo sapiens
uaugaagcaaggagauuua

SEQ ID NO: 430122 - RNA, 19 nt, Homo sapiens
augcuaccauuucguauuu

SEQ ID NO: 430123 - RNA, 19 nt, Homo sapiens
gaaagacucugaacaaguu

SEQ ID NO: 430124 - RNA, 19 nt, Homo sapiens
gagcuuauguuaccaguua

SEQ ID NO: 430125 - RNA, 19 nt, Homo sapiens
gaagaaggcugcaaacaug

SEQ ID NO: 430126 - RNA, 19 nt, Homo sapiens
gaaagaacauaacagagua

SEQ ID NO: 430127 - RNA, 19 nt, Homo sapiens
gcaaggagauuuacucgaa

SEQ ID NO: 430128 - RNA, 19 nt, Homo sapiens
caccaaagccuguuuauua

SEQ ID NO: 430129 - RNA, 19 nt, Homo sapiens
ggccaaaucuauauuauga

SEQ ID NO: 430130 - RNA, 19 nt, Homo sapiens
gaagauuauugcacacuuu

SEQ ID NO: 430131 - RNA, 19 nt, Homo sapiens
ggaaagagcuuauguuacc

SEQ ID NO: 430132 - RNA, 19 nt, Homo sapiens
gaaguucacugcuguaguc

SEQ ID NO: 430133 - RNA, 19 nt, Homo sapiens
gaugaugccugauaugaau

SEQ ID NO: 430134 - RNA, 19 nt, Homo sapiens
gauaagaccacaguucaua

SEQ ID NO: 430135 - RNA, 19 nt, Homo sapiens
aacaagagcuuauucagaa

SEQ ID NO: 430136 - RNA, 19 nt, Homo sapiens
ggagguauuucuuguuaug

SEQ ID NO: 430137 - RNA, 19 nt, Homo sapiens
uaaagacagugcauuugaa

SEQ ID NO: 430138 - RNA, 19 nt, Homo sapiens
aaggagguauuucuuguua

SEQ ID NO: 430139 - RNA, 19 nt, Homo sapiens
gcuugaaacuauuaacgua

SEQ ID NO: 430140 - RNA, 19 nt, Homo sapiens
gauaacugcuguaaagaca

SEQ ID NO: 430141 - RNA, 19 nt, Homo sapiens
gcagaagcuuuaugagaug

SEQ ID NO: 430142 - RNA, 19 nt, Homo sapiens
guaaagacagugcauuuga

SEQ ID NO: 430143 - RNA, 19 nt, Homo sapiens
gaagauaagaccacaguuc

SEQ ID NO: 430144 - RNA, 19 nt, Homo sapiens
guggaaagagcuuauguua

SEQ ID NO: 430145 - RNA, 19 nt, Homo sapiens
gaauacaggagcuaagaaa

SEQ ID NO: 430146 - RNA, 19 nt, Homo sapiens
gcagaggaacugaaugaaa

SEQ ID NO: 430147 - RNA, 19 nt, Homo sapiens
gaacuggauucuauaacca

SEQ ID NO: 430148 - RNA, 19 nt, Homo sapiens
ugaaacugauugauucuug

SEQ ID NO: 430149 - RNA, 19 nt, Homo sapiens
gcaaucaggaaucauauau

SEQ ID NO: 430150 - RNA, 19 nt, Homo sapiens
gcaguucccuaacgcauca

SEQ ID NO: 430151 - RNA, 19 nt, Homo sapiens
gcaaccauguuaaaugcuu

SEQ ID NO: 430152 - RNA, 19 nt, Homo sapiens
caacaagagcuuauucaga

SEQ ID NO: 430153 - RNA, 19 nt, Homo sapiens
caaaugucgucguguguug

SEQ ID NO: 430154 - RNA, 19 nt, Homo sapiens
cuaaggagcauguuaaaug

SEQ ID NO: 430155 - RNA, 19 nt, Homo sapiens
cauugaaacugauugauuc

SEQ ID NO: 430156 - RNA, 19 nt, Homo sapiens
gugcuuaccaugccaauuu

SEQ ID NO: 430157 - RNA, 19 nt, Homo sapiens
gaaaggcaacaagagcuua

SEQ ID NO: 430158 - RNA, 19 nt, Homo sapiens
ccucaaacacugaagauuu

SEQ ID NO: 430159 - RNA, 19 nt, Homo sapiens
gucaaacaccggagaguua

SEQ ID NO: 430160 - RNA, 19 nt, Homo sapiens
cuacggcuuuggagauaua

SEQ ID NO: 430161 - RNA, 19 nt, Homo sapiens
ccagaugugagguuuguua

SEQ ID NO: 430162 - RNA, 19 nt, Homo sapiens
gaauugcuguggaugaagu

SEQ ID NO: 430163 - RNA, 19 nt, Homo sapiens
cugaggaacuggauucuau

SEQ ID NO: 430164 - RNA, 19 nt, Homo sapiens
gagaguagcagguguugug

SEQ ID NO: 430165 - RNA, 19 nt, Homo sapiens
caugaaagcagacuguauu

SEQ ID NO: 430166 - RNA, 19 nt, Homo sapiens
gagaaagccuaugaagcaa

SEQ ID NO: 430167 - RNA, 19 nt, Homo sapiens
gaagcuuuaugagauggua

SEQ ID NO: 430168 - RNA, 19 nt, Homo sapiens
ccuaacgcaucacuaauug

SEQ ID NO: 430169 - RNA, 19 nt, Homo sapiens
caaagccuguuuauuagca

SEQ ID NO: 430170 - RNA, 19 nt, Homo sapiens
uaaggagcauguuaaaugg

SEQ ID NO: 430171 - RNA, 19 nt, Homo sapiens
gaaagcagacuguauuuug

SEQ ID NO: 430172 - RNA, 19 nt, Homo sapiens
gauuauaaggcacuuggua

SEQ ID NO: 430173 - RNA, 19 nt, Homo sapiens
ucagaccacuucagcuuga

SEQ ID NO: 430174 - RNA, 19 nt, Homo sapiens
cagaggaacugaaugaaaa

SEQ ID NO: 430175 - RNA, 19 nt, Homo sapiens
gacagugcauuugaaagaa

SEQ ID NO: 430176 - RNA, 19 nt, Homo sapiens
gggcaagcaaugaauauga

SEQ ID NO: 430177 - RNA, 19 nt, Homo sapiens
gaggaacuggauucuauaa

SEQ ID NO: 430178 - RNA, 19 nt, Homo sapiens
ugacaaaguccacgcagaa

SEQ ID NO: 430179 - RNA, 19 nt, Homo sapiens
cagcagaagcuuuaugaga

SEQ ID NO: 430180 - RNA, 19 nt, Homo sapiens
gacagcagaagcuuuauga

SEQ ID NO: 430181 - RNA, 19 nt, Homo sapiens
gcucugggauaacuacugu

SEQ ID NO: 430182 - RNA, 19 nt, Homo sapiens
agagaaagccuaugaagca

SEQ ID NO: 430183 - RNA, 19 nt, Homo sapiens
gaacaaguuacgguuaguu

SEQ ID NO: 430184 - RNA, 19 nt, Homo sapiens
guuaaaugcuucuaguucu

SEQ ID NO: 430185 - RNA, 19 nt, Homo sapiens
gcuaccauuucguauuuga

SEQ ID NO: 430186 - RNA, 19 nt, Homo sapiens
uaaagcggcaguucccuaa

SEQ ID NO: 430187 - RNA, 19 nt, Homo sapiens
cagcaaccauguuaaaugc

SEQ ID NO: 430188 - RNA, 19 nt, Homo sapiens
gcccauugaucucucuuau

SEQ ID NO: 430189 - RNA, 19 nt, Homo sapiens
ccaguuaccagcauuaugu

SEQ ID NO: 430190 - RNA, 19 nt, Homo sapiens
ggaacuggauucuauaacc

SEQ ID NO: 430191 - RNA, 19 nt, Homo sapiens
ugaaucgucucaaacuugu

SEQ ID NO: 430192 - RNA, 19 nt, Homo sapiens
uaaucaagauccugaagca

SEQ ID NO: 430193 - RNA, 19 nt, Homo sapiens
gaauugauaagccagaugu

SEQ ID NO: 430194 - RNA, 19 nt, Homo sapiens
agaccacaguucauagaaa

SEQ ID NO: 430195 - RNA, 19 nt, Homo sapiens
uuguaaagcucauuaaugg

SEQ ID NO: 430196 - RNA, 19 nt, Homo sapiens
guucuaaggagcauguuaa

SEQ ID NO: 430197 - RNA, 19 nt, Homo sapiens
uauggaagaccaauuaaug

SEQ ID NO: 430198 - RNA, 19 nt, Homo sapiens
ggcaagcaaugaauaugau

SEQ ID NO: 430199 - RNA, 19 nt, Homo sapiens
gaaaauggucagccaauga

SEQ ID NO: 430200 - RNA, 19 nt, Homo sapiens
gggaaagggugcagcaaaa

SEQ ID NO: 430201 - RNA, 19 nt, Homo sapiens
ccauugaaacugauugauu

SEQ ID NO: 430202 - RNA, 19 nt, Homo sapiens
agacagugcauuugaaaga

SEQ ID NO: 430203 - RNA, 19 nt, Homo sapiens
uaagccagaugugagguuu

SEQ ID NO: 430204 - RNA, 19 nt, Homo sapiens
uuaugugacuccagagaaa

SEQ ID NO: 430205 - RNA, 19 nt, Homo sapiens
ggaaaggcaacaagagcuu

SEQ ID NO: 430206 - RNA, 19 nt, Homo sapiens
gcugaaucgucucaaacuu

SEQ ID NO: 430207 - RNA, 19 nt, Homo sapiens
gauuauugcacacuuucua

SEQ ID NO: 430208 - RNA, 19 nt, Homo sapiens
agaaagaacauaacagagu

SEQ ID NO: 430209 - RNA, 19 nt, Homo sapiens
gaaagaaagaacauaacag

SEQ ID NO: 430210 - RNA, 19 nt, Homo sapiens
caaggagauuuacucgaau

SEQ ID NO: 430211 - RNA, 19 nt, Homo sapiens
uaugaagcaaggagauuua

SEQ ID NO: 430212 - RNA, 19 nt, Homo sapiens
augcuaccauuucguauuu

SEQ ID NO: 430213 - RNA, 19 nt, Homo sapiens
acagugcauuugaaagaaa

SEQ ID NO: 430214 - RNA, 19 nt, Homo sapiens
gcaaaugucgucguguguu

SEQ ID NO: 430215 - RNA, 19 nt, Homo sapiens
cagcugccauuuguugaaa

SEQ ID NO: 430216 - RNA, 19 nt, Homo sapiens
gaugugagguuuguuaucc

SEQ ID NO: 430217 - RNA, 19 nt, Homo sapiens
gaccacaguucauagaaaa

SEQ ID NO: 430218 - RNA, 19 nt, Homo sapiens
ugcgauaacugcuguaaag

SEQ ID NO: 430219 - RNA, 19 nt, Homo sapiens
agcagaagcuuuaugagau

SEQ ID NO: 430220 - RNA, 19 nt, Homo sapiens
guucaaugguggugaugga

SEQ ID NO: 430221 - RNA, 19 nt, Homo sapiens
gcagaagcccucaaacacu

SEQ ID NO: 430222 - RNA, 19 nt, Homo sapiens
cagaaaauuuugugcauug

SEQ ID NO: 430223 - RNA, 19 nt, Homo sapiens
ggaagaagcauacaacuuu

SEQ ID NO: 430224 - RNA, 19 nt, Homo sapiens
gcagauaacagcaugauaa

SEQ ID NO: 430225 - RNA, 19 nt, Homo sapiens
ucagaaagaugacauagaa

SEQ ID NO: 430226 - RNA, 19 nt, Homo sapiens
gagaauaccuguugggaau

SEQ ID NO: 430227 - RNA, 19 nt, Homo sapiens
gcauacaacuuuggacaua

SEQ ID NO: 430228 - RNA, 19 nt, Homo sapiens
caacaaugccgaugacaua

SEQ ID NO: 430229 - RNA, 19 nt, Homo sapiens
gcucacaccuguaauccua

SEQ ID NO: 430230 - RNA, 19 nt, Homo sapiens
gauaacagcaugauaaaug

SEQ ID NO: 430231 - RNA, 19 nt, Homo sapiens
gaaaaccccucauguaauu

SEQ ID NO: 430232 - RNA, 19 nt, Homo sapiens
uaacaaagaaugacccaua

SEQ ID NO: 430233 - RNA, 19 nt, Homo sapiens
gaagaagcauacaacuuug

SEQ ID NO: 430234 - RNA, 19 nt, Homo sapiens
caaagaaugacccauauaa

SEQ ID NO: 430235 - RNA, 19 nt, Homo sapiens
aggaggagaugaaauauuu

SEQ ID NO: 430236 - RNA, 19 nt, Homo sapiens
ccaacaugcugucuaauug

SEQ ID NO: 430237 - RNA, 19 nt, Homo sapiens
gaacauacccuucuaucca

SEQ ID NO: 430238 - RNA, 19 nt, Homo sapiens
gauagucaguauucaggua

SEQ ID NO: 430239 - RNA, 19 nt, Homo sapiens
uccaaauacugcagaauua

SEQ ID NO: 430240 - RNA, 19 nt, Homo sapiens
gcagagacggcuacuauga

SEQ ID NO: 430241 - RNA, 19 nt, Homo sapiens
cagaggaggagaugaaaua

SEQ ID NO: 430242 - RNA, 19 nt, Homo sapiens
gaauaccuguugggaauga

SEQ ID NO: 430243 - RNA, 19 nt, Homo sapiens
gaaagaugacauagaaguu

SEQ ID NO: 430244 - RNA, 19 nt, Homo sapiens
uuaaggauuugucguguaa

SEQ ID NO: 430245 - RNA, 19 nt, Homo sapiens
gugcugggauuacaguuaa

SEQ ID NO: 430246 - RNA, 19 nt, Homo sapiens
ugagacagcuccaucagau

SEQ ID NO: 430247 - RNA, 19 nt, Homo sapiens
gcaauaaagcaaagaaaca

SEQ ID NO: 430248 - RNA, 19 nt, Homo sapiens
gauaccaccuauauagaug

SEQ ID NO: 430249 - RNA, 19 nt, Homo sapiens
ggacacuuccuucuaauuc

SEQ ID NO: 430250 - RNA, 19 nt, Homo sapiens
ggaaguuagugaaucuaug

SEQ ID NO: 430251 - RNA, 19 nt, Homo sapiens
ugacaaaguucagaaagau

SEQ ID NO: 430252 - RNA, 19 nt, Homo sapiens
guacuaauccaaacaguca

SEQ ID NO: 430253 - RNA, 19 nt, Homo sapiens
cagauguccucuuccagua

SEQ ID NO: 430254 - RNA, 19 nt, Homo sapiens
ugaugaacaugguaauuug

SEQ ID NO: 430255 - RNA, 19 nt, Homo sapiens
ggacauagcgaauacaaaa

SEQ ID NO: 430256 - RNA, 19 nt, Homo sapiens
gauaauccaagacuucuga

SEQ ID NO: 430257 - RNA, 19 nt, Homo sapiens
uugcaaagcuaucacagaa

SEQ ID NO: 430258 - RNA, 19 nt, Homo sapiens
gugacaaaguucagaaaga

SEQ ID NO: 430259 - RNA, 19 nt, Homo sapiens
gggaaugauuuaaaugcuu

SEQ ID NO: 430260 - RNA, 19 nt, Homo sapiens
ucaaguggauugucacauc

SEQ ID NO: 430261 - RNA, 19 nt, Homo sapiens
aaagauacuuacggcaaua

SEQ ID NO: 430262 - RNA, 19 nt, Homo sapiens
uaacccguauauagagaua

SEQ ID NO: 430263 - RNA, 19 nt, Homo sapiens
ugacaaccgugcuccaaau

SEQ ID NO: 430264 - RNA, 19 nt, Homo sapiens
ugacauagucggaauggaa

SEQ ID NO: 430265 - RNA, 19 nt, Homo sapiens
gguauucgaugugugaaga

SEQ ID NO: 430266 - RNA, 19 nt, Homo sapiens
caagaacgcagaccuuugu

SEQ ID NO: 430267 - RNA, 19 nt, Homo sapiens
cagcagauuuauaugguau

SEQ ID NO: 430268 - RNA, 19 nt, Homo sapiens
gccaucagcagauuuauau

SEQ ID NO: 430269 - RNA, 19 nt, Homo sapiens
ggacaagaacgcagaccuu

SEQ ID NO: 430270 - RNA, 19 nt, Homo sapiens
gcggguggaucacuugaga

SEQ ID NO: 430271 - RNA, 19 nt, Homo sapiens
gguauuggcaguaugcaaa

SEQ ID NO: 430272 - RNA, 19 nt, Homo sapiens
caaguggauugucacauca

SEQ ID NO: 430273 - RNA, 19 nt, Homo sapiens
ccaaagugcugggauuaca

SEQ ID NO: 430274 - RNA, 19 nt, Homo sapiens
cacagaacccguaacagua

SEQ ID NO: 430275 - RNA, 19 nt, Homo sapiens
ucacagaacccguaacagu

SEQ ID NO: 430276 - RNA, 19 nt, Homo sapiens
gaacccaauuuaugacaac

SEQ ID NO: 430277 - RNA, 19 nt, Homo sapiens
caucucaaguggauuguca

SEQ ID NO: 430278 - RNA, 19 nt, Homo sapiens
gaacgcagaccuuuguuuu

SEQ ID NO: 430279 - RNA, 19 nt, Homo sapiens
gauguccucuuccaguaug

SEQ ID NO: 430280 - RNA, 19 nt, Homo sapiens
gaaguuagugaaucuaugg

SEQ ID NO: 430281 - RNA, 19 nt, Homo sapiens
gaacuauuauggaaaagga

SEQ ID NO: 430282 - RNA, 19 nt, Homo sapiens
ccaaauacugcagaauuaa

SEQ ID NO: 430283 - RNA, 19 nt, Homo sapiens
gacaagaacgcagaccuuu

SEQ ID NO: 430284 - RNA, 19 nt, Homo sapiens
caaacaguacuaauccaaa

SEQ ID NO: 430285 - RNA, 19 nt, Homo sapiens
gugccaggaucacguagaa

SEQ ID NO: 430286 - RNA, 19 nt, Homo sapiens
ccaggaaguuagugaaucu

SEQ ID NO: 430287 - RNA, 19 nt, Homo sapiens
gacaaccgugcuccaaaua

SEQ ID NO: 430288 - RNA, 19 nt, Homo sapiens
gcugaaugauauugaagau

SEQ ID NO: 430289 - RNA, 19 nt, Homo sapiens
cuauccagauuaugaacua

SEQ ID NO: 430290 - RNA, 19 nt, Homo sapiens
gggaagaagcauacaacuu

SEQ ID NO: 430291 - RNA, 19 nt, Homo sapiens
cagauaacagcaugauaaa

SEQ ID NO: 430292 - RNA, 19 nt, Homo sapiens
acagaacccguaacaguaa

SEQ ID NO: 430293 - RNA, 19 nt, Homo sapiens
gaggaggagaugaaauauu

SEQ ID NO: 430294 - RNA, 19 nt, Homo sapiens
gaauaaaggcaggaaucaa

SEQ ID NO: 430295 - RNA, 19 nt, Homo sapiens
ucucgaacccaauuuauga

SEQ ID NO: 430296 - RNA, 19 nt, Homo sapiens
aacaaagaaugacccauau

SEQ ID NO: 430297 - RNA, 19 nt, Homo sapiens
caaggcggguggaucacuu

SEQ ID NO: 430298 - RNA, 19 nt, Homo sapiens
ugacuucaguugugcagau

SEQ ID NO: 430299 - RNA, 19 nt, Homo sapiens
caagacuucugagcaugaa

SEQ ID NO: 430300 - RNA, 19 nt, Homo sapiens
gggagagacugauaaucca

SEQ ID NO: 430301 - RNA, 19 nt, Homo sapiens
ucagcagauuuauauggua

SEQ ID NO: 430302 - RNA, 19 nt, Homo sapiens
gcacagcacagacaacaac

SEQ ID NO: 430303 - RNA, 19 nt, Homo sapiens
aauacaaacccacugagua

SEQ ID NO: 430304 - RNA, 19 nt, Homo sapiens
gauguacaccgucaaguag

SEQ ID NO: 430305 - RNA, 19 nt, Homo sapiens
ugauguacaccgucaagua

SEQ ID NO: 430306 - RNA, 19 nt, Homo sapiens
caaccgugcuccaaauacu

SEQ ID NO: 430307 - RNA, 19 nt, Homo sapiens
cuacuaugaagcagaauuu

SEQ ID NO: 430308 - RNA, 19 nt, Homo sapiens
acaaucagaugcauuugag

SEQ ID NO: 430309 - RNA, 19 nt, Homo sapiens
gaugaacaugguaauuuga

SEQ ID NO: 430310 - RNA, 19 nt, Homo sapiens
gugacuccuuuccauauga

SEQ ID NO: 430311 - RNA, 19 nt, Homo sapiens
aaacaguacuaauccaaac

SEQ ID NO: 430312 - RNA, 19 nt, Homo sapiens
gcaggcgccaauuccaaua

SEQ ID NO: 430313 - RNA, 19 nt, Homo sapiens
acaaagaaugacccauaua

SEQ ID NO: 430314 - RNA, 19 nt, Homo sapiens
gaagcagaauuuggacaag

SEQ ID NO: 430315 - RNA, 19 nt, Homo sapiens
gacuucaguugugcagaua

SEQ ID NO: 430316 - RNA, 19 nt, Homo sapiens
cuucugagcaugaaucuug

SEQ ID NO: 430317 - RNA, 19 nt, Homo sapiens
gcaugggagagacugauaa

SEQ ID NO: 430318 - RNA, 19 nt, Homo sapiens
ucaagcagaauccuacuau

SEQ ID NO: 430319 - RNA, 19 nt, Homo sapiens
gguuucaagucaagcagaa

SEQ ID NO: 430320 - RNA, 19 nt, Homo sapiens
acaaaguucagaaagauga

SEQ ID NO: 430321 - RNA, 19 nt, Homo sapiens
gcgaucagcaggcagcauu

SEQ ID NO: 430322 - RNA, 19 nt, Homo sapiens
cggcuacuaugaagcagaa

SEQ ID NO: 430323 - RNA, 19 nt, Homo sapiens
gaagacaaguucuccuuug

SEQ ID NO: 430324 - RNA, 19 nt, Homo sapiens
gcacaggauuccagaaaug

SEQ ID NO: 430325 - RNA, 19 nt, Homo sapiens
gaacugauccagcaauuac

SEQ ID NO: 430326 - RNA, 19 nt, Homo sapiens
gaaaauacaugucuagaac

SEQ ID NO: 430327 - RNA, 19 nt, Homo sapiens
gcacugaugacuucaaugu

SEQ ID NO: 430328 - RNA, 19 nt, Homo sapiens
ucucuucucugcugaguuu

SEQ ID NO: 430329 - RNA, 19 nt, Homo sapiens
gaccaucucuccaacucaa

SEQ ID NO: 430330 - RNA, 19 nt, Homo sapiens
ugacuucaaugucuggauu

SEQ ID NO: 430331 - RNA, 19 nt, Homo sapiens
gaguuugccuuguuaaucu

SEQ ID NO: 430332 - RNA, 19 nt, Homo sapiens
gcuacuacuuuaaugaaga

SEQ ID NO: 430333 - RNA, 19 nt, Homo sapiens
uuuguggccucacugauua

SEQ ID NO: 430334 - RNA, 19 nt, Homo sapiens
gcucauacuucaugcugau

SEQ ID NO: 430335 - RNA, 19 nt, Homo sapiens
cagaccagcucauacuuca

SEQ ID NO: 430336 - RNA, 19 nt, Homo sapiens
uagaacugauccagcaauu

SEQ ID NO: 430337 - RNA, 19 nt, Homo sapiens
ggaugugccuugugaagac

SEQ ID NO: 430338 - RNA, 19 nt, Homo sapiens
aaauacaugucuagaacug

SEQ ID NO: 430339 - RNA, 19 nt, Homo sapiens
gccaagaggcccagacaga

SEQ ID NO: 430340 - RNA, 19 nt, Homo sapiens
gaccagcucauacuucaug

SEQ ID NO: 430341 - RNA, 19 nt, Homo sapiens
acagcuaccuggccugaga

SEQ ID NO: 430342 - RNA, 19 nt, Homo sapiens
aauccuggcuacuguguga

SEQ ID NO: 430343 - RNA, 19 nt, Homo sapiens
caauuacaacggagucaaa

SEQ ID NO: 430344 - RNA, 19 nt, Homo sapiens
gugggucccuggucuccua

SEQ ID NO: 430345 - RNA, 19 nt, Homo sapiens
cgugagaccuggguugaug

SEQ ID NO: 430346 - RNA, 19 nt, Homo sapiens
cggaucagcugcccagaag

SEQ ID NO: 430347 - RNA, 19 nt, Homo sapiens
gcugaucuccugccugaug

SEQ ID NO: 430348 - RNA, 19 nt, Homo sapiens
gaccuggguugaugcagau

SEQ ID NO: 430349 - RNA, 19 nt, Homo sapiens
cugcugaguuugccuuguu

SEQ ID NO: 430350 - RNA, 19 nt, Homo sapiens
ggaaaauacaugucuagaa

SEQ ID NO: 430351 - RNA, 19 nt, Homo sapiens
ugaagacaaguucuccuuu

SEQ ID NO: 430352 - RNA, 19 nt, Homo sapiens
auacaugucuagaacugau

SEQ ID NO: 430353 - RNA, 19 nt, Homo sapiens
uggccucacugauuaagga

SEQ ID NO: 430354 - RNA, 19 nt, Homo sapiens
aagcacaggauuccagaaa

SEQ ID NO: 430355 - RNA, 19 nt, Homo sapiens
gcucagaccagcucauacu

SEQ ID NO: 430356 - RNA, 19 nt, Homo sapiens
caaccuggacacucucuuc

SEQ ID NO: 430357 - RNA, 19 nt, Homo sapiens
gaucuccugccugauguuu

SEQ ID NO: 430358 - RNA, 19 nt, Homo sapiens
auuguugauuugccucuua

SEQ ID NO: 430359 - RNA, 19 nt, Homo sapiens
acugaugacuucaaugucu

SEQ ID NO: 430360 - RNA, 19 nt, Homo sapiens
cuacugcuacuacuuuaau

SEQ ID NO: 430361 - RNA, 19 nt, Homo sapiens
caagaggcccagacagagu

SEQ ID NO: 430362 - RNA, 19 nt, Homo sapiens
aaauuaaaccggaccaucu

SEQ ID NO: 430363 - RNA, 19 nt, Homo sapiens
gcaauuacaacggagucaa

SEQ ID NO: 430364 - RNA, 19 nt, Homo sapiens
cgggcaaccuggugucugu

SEQ ID NO: 430365 - RNA, 19 nt, Homo sapiens
aaacuagaggcaacuggaa

SEQ ID NO: 430366 - RNA, 19 nt, Homo sapiens
gugaagacaaguucuccuu

SEQ ID NO: 430367 - RNA, 19 nt, Homo sapiens
agaacugauccagcaauua

SEQ ID NO: 430368 - RNA, 19 nt, Homo sapiens
ccuggacacucucuucucu

SEQ ID NO: 430369 - RNA, 19 nt, Homo sapiens
uuaagcaagagauucauug

SEQ ID NO: 430370 - RNA, 19 nt, Homo sapiens
ugaugcagaucucuauugc

SEQ ID NO: 430371 - RNA, 19 nt, Homo sapiens
uggcacugaugacuucaau

SEQ ID NO: 430372 - RNA, 19 nt, Homo sapiens
gaucucuauugccagaaca

SEQ ID NO: 430373 - RNA, 19 nt, Homo sapiens
gucuuuggaacccuaaaua

SEQ ID NO: 430374 - RNA, 19 nt, Homo sapiens
agacucagccaacagagau

SEQ ID NO: 430375 - RNA, 19 nt, Homo sapiens
ggucccuggucuccuacaa

SEQ ID NO: 430376 - RNA, 19 nt, Homo sapiens
ucuuuggaacccuaaauaa

SEQ ID NO: 430377 - RNA, 19 nt, Homo sapiens
gaugugccuugugaagaca

SEQ ID NO: 430378 - RNA, 19 nt, Homo sapiens
uccuacugcuacuacuuua

SEQ ID NO: 430379 - RNA, 19 nt, Homo sapiens
uggcucagaccagcucaua

SEQ ID NO: 430380 - RNA, 19 nt, Homo sapiens
ugaguuugccuuguuaauc

SEQ ID NO: 430381 - RNA, 19 nt, Homo sapiens
ugcugaguuugccuuguua

SEQ ID NO: 430382 - RNA, 19 nt, Homo sapiens
gguugaugcagaucucuau

SEQ ID NO: 430383 - RNA, 19 nt, Homo sapiens
ccuuguuaaucuucaauag

SEQ ID NO: 430384 - RNA, 19 nt, Homo sapiens
ucagaccagcucauacuuc

SEQ ID NO: 430385 - RNA, 19 nt, Homo sapiens
uguuaauccuggcuacugu

SEQ ID NO: 430386 - RNA, 19 nt, Homo sapiens
ucuauugccagaacaugaa

SEQ ID NO: 430387 - RNA, 19 nt, Homo sapiens
caacagagauugcugauuu

SEQ ID NO: 430388 - RNA, 19 nt, Homo sapiens
ggaugaaucuugugagaag

SEQ ID NO: 430389 - RNA, 19 nt, Homo sapiens
gcacuuaccaacagagauu

SEQ ID NO: 430390 - RNA, 19 nt, Homo sapiens
gcucaggauucaagaaaug

SEQ ID NO: 430391 - RNA, 19 nt, Homo sapiens
gaacugguccugcaauuac

SEQ ID NO: 430392 - RNA, 19 nt, Homo sapiens
cgaaucagcugcccagaag

SEQ ID NO: 430393 - RNA, 19 nt, Homo sapiens
agacagagcugccuaaucc

SEQ ID NO: 430394 - RNA, 19 nt, Homo sapiens
gugcaagccugacuucaug

SEQ ID NO: 430395 - RNA, 19 nt, Homo sapiens
gaccaucuccucccuaaug

SEQ ID NO: 430396 - RNA, 19 nt, Homo sapiens
ggaaggaugaaucuuguga

SEQ ID NO: 430397 - RNA, 19 nt, Homo sapiens
gcuacuacuuuaaugaaga

SEQ ID NO: 430398 - RNA, 19 nt, Homo sapiens
cagaccaucuccucccuaa

SEQ ID NO: 430399 - RNA, 19 nt, Homo sapiens
gaaauggaaggaugaaucu

SEQ ID NO: 430400 - RNA, 19 nt, Homo sapiens
gagauucacugccgcuaag

SEQ ID NO: 430401 - RNA, 19 nt, Homo sapiens
gaaguucuccuuuguuugc

SEQ ID NO: 430402 - RNA, 19 nt, Homo sapiens
uagaacugguccugcaauu

SEQ ID NO: 430403 - RNA, 19 nt, Homo sapiens
gaccaacucguucuucaug

SEQ ID NO: 430404 - RNA, 19 nt, Homo sapiens
aaauggaugucuagaacug

SEQ ID NO: 430405 - RNA, 19 nt, Homo sapiens
gcacugaugacagcaaugu

SEQ ID NO: 430406 - RNA, 19 nt, Homo sapiens
gagaguagcacugaugaca

SEQ ID NO: 430407 - RNA, 19 nt, Homo sapiens
gcaauuacuaugaagucaa

SEQ ID NO: 430408 - RNA, 19 nt, Homo sapiens
aaggaugaaucuugugaga

SEQ ID NO: 430409 - RNA, 19 nt, Homo sapiens
gugggucccuggucuccua

SEQ ID NO: 430410 - RNA, 19 nt, Homo sapiens
ccugagaccuggguugaug

SEQ ID NO: 430411 - RNA, 19 nt, Homo sapiens
gcugaucuccucccugaug

SEQ ID NO: 430412 - RNA, 19 nt, Homo sapiens
cagaccaacucguucuuca

SEQ ID NO: 430413 - RNA, 19 nt, Homo sapiens
ucuccucccuaaugaguuu

SEQ ID NO: 430414 - RNA, 19 nt, Homo sapiens
guccugcaauuacuaugaa

SEQ ID NO: 430415 - RNA, 19 nt, Homo sapiens
caaggcacuuaccaacaga

SEQ ID NO: 430416 - RNA, 19 nt, Homo sapiens
gaccuggguugaugcagau

SEQ ID NO: 430417 - RNA, 19 nt, Homo sapiens
ucaagaaauggaaggauga

SEQ ID NO: 430418 - RNA, 19 nt, Homo sapiens
acaaggcacuuaccaacag

SEQ ID NO: 430419 - RNA, 19 nt, Homo sapiens
uucguggccucacugauua

SEQ ID NO: 430420 - RNA, 19 nt, Homo sapiens
uugcugauuugcuccuuaa

SEQ ID NO: 430421 - RNA, 19 nt, Homo sapiens
ucaccugucucagucucua

SEQ ID NO: 430422 - RNA, 19 nt, Homo sapiens
agaacugguccugcaauua

SEQ ID NO: 430423 - RNA, 19 nt, Homo sapiens
uggccucacugauuaagga

SEQ ID NO: 430424 - RNA, 19 nt, Homo sapiens
gguccugcaauuacuauga

SEQ ID NO: 430425 - RNA, 19 nt, Homo sapiens
gacaaggcacuuaccaaca

SEQ ID NO: 430426 - RNA, 19 nt, Homo sapiens
gaguuugcaucgcugaucu

SEQ ID NO: 430427 - RNA, 19 nt, Homo sapiens
agaaauggaaggaugaauc

SEQ ID NO: 430428 - RNA, 19 nt, Homo sapiens
cuucguggccucacugauu

SEQ ID NO: 430429 - RNA, 19 nt, Homo sapiens
cuacugcuacuacuuuaau

SEQ ID NO: 430430 - RNA, 19 nt, Homo sapiens
aauggaaggaugaaucuug

SEQ ID NO: 430431 - RNA, 19 nt, Homo sapiens
caagaaauggaaggaugaa

SEQ ID NO: 430432 - RNA, 19 nt, Homo sapiens
uagcacugaugacagcaau

SEQ ID NO: 430433 - RNA, 19 nt, Homo sapiens
uuaaggagaguagcacuga

SEQ ID NO: 430434 - RNA, 19 nt, Homo sapiens
aacagagauugcugauuug

SEQ ID NO: 430435 - RNA, 19 nt, Homo sapiens
ugaugcagaucucuauugc

SEQ ID NO: 430436 - RNA, 19 nt, Homo sapiens
gccaggagucccagacaga

SEQ ID NO: 430437 - RNA, 19 nt, Homo sapiens
gaucuccucccugauguuc

SEQ ID NO: 430438 - RNA, 19 nt, Homo sapiens
uaaggagaguagcacugau

SEQ ID NO: 430439 - RNA, 19 nt, Homo sapiens
gaucucuauugccagaaca

SEQ ID NO: 430440 - RNA, 19 nt, Homo sapiens
ggucccuggucuccuacaa

SEQ ID NO: 430441 - RNA, 19 nt, Homo sapiens
gcucagaccaacucguucu

SEQ ID NO: 430442 - RNA, 19 nt, Homo sapiens
uccuacugcuacuacuuua

SEQ ID NO: 430443 - RNA, 19 nt, Homo sapiens
ccgaaucagcugcccagaa

SEQ ID NO: 430444 - RNA, 19 nt, Homo sapiens
ccgcuaagcauggcucaga

SEQ ID NO: 430445 - RNA, 19 nt, Homo sapiens
gguugaugcagaucucuau

SEQ ID NO: 430446 - RNA, 19 nt, Homo sapiens
ucaguaccuucaccugucu

SEQ ID NO: 430447 - RNA, 19 nt, Homo sapiens
agagauucacugccgcuaa

SEQ ID NO: 430448 - RNA, 19 nt, Homo sapiens
ccaacucguucuucaugcu

SEQ ID NO: 430449 - RNA, 19 nt, Homo sapiens
ucuauugccagaacaugaa

SEQ ID NO: 430450 - RNA, 19 nt, Homo sapiens
caacaaagauugcugauuu

SEQ ID NO: 430451 - RNA, 19 nt, Homo sapiens
ggaacuaguuucaauaaug

SEQ ID NO: 430452 - RNA, 19 nt, Homo sapiens
ccucuuaucuauuguguua

SEQ ID NO: 430453 - RNA, 19 nt, Homo sapiens
aaaggaagguuuauucuug

SEQ ID NO: 430454 - RNA, 19 nt, Homo sapiens
gaauuaaacuggaccaucu

SEQ ID NO: 430455 - RNA, 19 nt, Homo sapiens
ugacugaucuuuaguaucu

SEQ ID NO: 430456 - RNA, 19 nt, Homo sapiens
ggaaggaugauucuuguaa

SEQ ID NO: 430457 - RNA, 19 nt, Homo sapiens
gaccaucucuccucugcua

SEQ ID NO: 430458 - RNA, 19 nt, Homo sapiens
aaagcaaccucucuauaaa

SEQ ID NO: 430459 - RNA, 19 nt, Homo sapiens
gaacaugaauucagguaac

SEQ ID NO: 430460 - RNA, 19 nt, Homo sapiens
gauaaacucauucucugua

SEQ ID NO: 430461 - RNA, 19 nt, Homo sapiens
ggauagcaaugucuggauu

SEQ ID NO: 430462 - RNA, 19 nt, Homo sapiens
gaccaucucucuccauauc

SEQ ID NO: 430463 - RNA, 19 nt, Homo sapiens
aaauggacgucuagaauug

SEQ ID NO: 430464 - RNA, 19 nt, Homo sapiens
gagaguggcaccaaggaua

SEQ ID NO: 430465 - RNA, 19 nt, Homo sapiens
uggcuucgcugauuaaaga

SEQ ID NO: 430466 - RNA, 19 nt, Homo sapiens
gaaccgcaagguauacuaa

SEQ ID NO: 430467 - RNA, 19 nt, Homo sapiens
ucucuccucugcuaaauuu

SEQ ID NO: 430468 - RNA, 19 nt, Homo sapiens
gaaggaugauucuuguaag

SEQ ID NO: 430469 - RNA, 19 nt, Homo sapiens
uaaaggauaucaagguucu

SEQ ID NO: 430470 - RNA, 19 nt, Homo sapiens
gguagcaucuuuauguauc

SEQ ID NO: 430471 - RNA, 19 nt, Homo sapiens
cacagaauccacacacuua

SEQ ID NO: 430472 - RNA, 19 nt, Homo sapiens
cgcaagguauacuaaauaa

SEQ ID NO: 430473 - RNA, 19 nt, Homo sapiens
gcacagaauccacacacuu

SEQ ID NO: 430474 - RNA, 19 nt, Homo sapiens
gaagguuuauucuugucuu

SEQ ID NO: 430475 - RNA, 19 nt, Homo sapiens
cuaaugcuaugcuggauau

SEQ ID NO: 430476 - RNA, 19 nt, Homo sapiens
gcuacuacuuuaaugaaga

SEQ ID NO: 430477 - RNA, 19 nt, Homo sapiens
caugagaccuggguuuaug

SEQ ID NO: 430478 - RNA, 19 nt, Homo sapiens
cuggagcccuaaacaauaa

SEQ ID NO: 430479 - RNA, 19 nt, Homo sapiens
gaguguuuccucuuuauuu

SEQ ID NO: 430480 - RNA, 19 nt, Homo sapiens
gagaaaauguggaggaaau

SEQ ID NO: 430481 - RNA, 19 nt, Homo sapiens
guuaucaucucuguuauag

SEQ ID NO: 430482 - RNA, 19 nt, Homo sapiens
uuucaggcauucacagaua

SEQ ID NO: 430483 - RNA, 19 nt, Homo sapiens
cauagguucuucgagauaa

SEQ ID NO: 430484 - RNA, 19 nt, Homo sapiens
ucaagguucuccauagguu

SEQ ID NO: 430485 - RNA, 19 nt, Homo sapiens
gauaucaagguucuccaua

SEQ ID NO: 430486 - RNA, 19 nt, Homo sapiens
ggaggcccaugcugaguug

SEQ ID NO: 430487 - RNA, 19 nt, Homo sapiens
cuacaaauccugggacauu

SEQ ID NO: 430488 - RNA, 19 nt, Homo sapiens
cagaucagcugcccagaag

SEQ ID NO: 430489 - RNA, 19 nt, Homo sapiens
gaaguucuccuuuguuugc

SEQ ID NO: 430490 - RNA, 19 nt, Homo sapiens
ggaggguaauacacucuga

SEQ ID NO: 430491 - RNA, 19 nt, Homo sapiens
gccauccucuccuauuuau

SEQ ID NO: 430492 - RNA, 19 nt, Homo sapiens
uaauggccaucuaaugcua

SEQ ID NO: 430493 - RNA, 19 nt, Homo sapiens
uguguuaucaucucuguua

SEQ ID NO: 430494 - RNA, 19 nt, Homo sapiens
gcaugacugaucuuuagua

SEQ ID NO: 430495 - RNA, 19 nt, Homo sapiens
caggaacuaguuucaauaa

SEQ ID NO: 430496 - RNA, 19 nt, Homo sapiens
ccgcaagguauacuaaaua

SEQ ID NO: 430497 - RNA, 19 nt, Homo sapiens
uguaaaggauaucaagguu

SEQ ID NO: 430498 - RNA, 19 nt, Homo sapiens
gcaccucaagcaucaguuu

SEQ ID NO: 430499 - RNA, 19 nt, Homo sapiens
caaccucucuauaaaucau

SEQ ID NO: 430500 - RNA, 19 nt, Homo sapiens
caugacugaucuuuaguau

SEQ ID NO: 430501 - RNA, 19 nt, Homo sapiens
gaaauggaaggaugauucu

SEQ ID NO: 430502 - RNA, 19 nt, Homo sapiens
gagcaugagaccuggguuu

SEQ ID NO: 430503 - RNA, 19 nt, Homo sapiens
ccaggaacuaguuucaaua

SEQ ID NO: 430504 - RNA, 19 nt, Homo sapiens
gguuuauucuugucuuaug

SEQ ID NO: 430505 - RNA, 19 nt, Homo sapiens
caacuaauggccaucuaau

SEQ ID NO: 430506 - RNA, 19 nt, Homo sapiens
uaggguagcaucuuuaugu

SEQ ID NO: 430507 - RNA, 19 nt, Homo sapiens
cuucuaggguagcaucuuu

SEQ ID NO: 430508 - RNA, 19 nt, Homo sapiens
aaaagcaaccucucuauaa

SEQ ID NO: 430509 - RNA, 19 nt, Homo sapiens
gaucucuacugccagaaca

SEQ ID NO: 430510 - RNA, 19 nt, Homo sapiens
uuaccuaccucaauuucug

SEQ ID NO: 430511 - RNA, 19 nt, Homo sapiens
uugcaugacugaucuuuag

SEQ ID NO: 430512 - RNA, 19 nt, Homo sapiens
auucuugucuuaugucuug

SEQ ID NO: 430513 - RNA, 19 nt, Homo sapiens
gcaccaaggauagcaaugu

SEQ ID NO: 430514 - RNA, 19 nt, Homo sapiens
gaccuggguuuaugcagau

SEQ ID NO: 430515 - RNA, 19 nt, Homo sapiens
gugcuagccugacuucaag

SEQ ID NO: 430516 - RNA, 19 nt, Homo sapiens
gugggucccuggucuccua

SEQ ID NO: 430517 - RNA, 19 nt, Homo sapiens
uaaauuugcaugacugauc

SEQ ID NO: 430518 - RNA, 19 nt, Homo sapiens
cauuaucaguggaguagug

SEQ ID NO: 430519 - RNA, 19 nt, Homo sapiens
cagaccaacucaugcuuca

SEQ ID NO: 430520 - RNA, 19 nt, Homo sapiens
ggaucagucugcugcaucu

SEQ ID NO: 430521 - RNA, 19 nt, Homo sapiens
agaaauggaaggaugauuc

SEQ ID NO: 430522 - RNA, 19 nt, Homo sapiens
gaaaagccaccucagauuc

SEQ ID NO: 430523 - RNA, 19 nt, Homo sapiens
guucuucgagauaagcuua

SEQ ID NO: 430524 - RNA, 19 nt, Homo sapiens
ccauagguucuucgagaua

SEQ ID NO: 430525 - RNA, 19 nt, Homo sapiens
ucaagaaauggaaggauga

SEQ ID NO: 430526 - RNA, 19 nt, Homo sapiens
cucauugucuuauaggauu

SEQ ID NO: 430527 - RNA, 19 nt, Homo sapiens
gucugaaucuucucauugu

SEQ ID NO: 430528 - RNA, 19 nt, Homo sapiens
acacagagagguaggugaa

SEQ ID NO: 430529 - RNA, 19 nt, Homo sapiens
cucauucucuguacuucua

SEQ ID NO: 430530 - RNA, 19 nt, Homo sapiens
cagauucagccaacaaaga

SEQ ID NO: 430531 - RNA, 19 nt, Homo sapiens
cagaauccacacacuuauu

SEQ ID NO: 430532 - RNA, 19 nt, Homo sapiens
aaagcugaauuuccugugu

SEQ ID NO: 430533 - RNA, 19 nt, Homo sapiens
caucuucuaccuccugauu

SEQ ID NO: 430534 - RNA, 19 nt, Homo sapiens
ucuggagcccuaaacaaua

SEQ ID NO: 430535 - RNA, 19 nt, Homo sapiens
ccaucucucuccauaucaa

SEQ ID NO: 430536 - RNA, 19 nt, Homo sapiens
agaauccacacacuuauug

SEQ ID NO: 430537 - RNA, 19 nt, Homo sapiens
caucuagaacugccauuau

SEQ ID NO: 430538 - RNA, 19 nt, Homo sapiens
gaaaauguggaggaaauaa

SEQ ID NO: 430539 - RNA, 19 nt, Homo sapiens
uaaaagcaaccucucuaua

SEQ ID NO: 430540 - RNA, 19 nt, Homo sapiens
gaaucuucucauugucuua

SEQ ID NO: 430541 - RNA, 19 nt, Homo sapiens
ggaguguuuccucuuuauu

SEQ ID NO: 430542 - RNA, 19 nt, Homo sapiens
ugucuugaccuguuucuga

SEQ ID NO: 430543 - RNA, 19 nt, Homo sapiens
gguucccuguggcaaauuu

SEQ ID NO: 430544 - RNA, 19 nt, Homo sapiens
cugaauuuccuguguguuu

SEQ ID NO: 430545 - RNA, 19 nt, Homo sapiens
uugcugauuugcuccuuaa

SEQ ID NO: 430546 - RNA, 19 nt, Homo sapiens
gauaaaagcaaccucucua

SEQ ID NO: 430547 - RNA, 19 nt, Homo sapiens
ugaaucuucucauugucuu

SEQ ID NO: 430548 - RNA, 19 nt, Homo sapiens
gcaugagaccuggguuuau

SEQ ID NO: 430549 - RNA, 19 nt, Homo sapiens
gaggaaauaauaugacacu

SEQ ID NO: 430550 - RNA, 19 nt, Homo sapiens
gaugagaucuuccuacugu

SEQ ID NO: 430551 - RNA, 19 nt, Homo sapiens
ggaguacccugaggcuaua

SEQ ID NO: 430552 - RNA, 19 nt, Homo sapiens
ucaagugccuuaauaguag

SEQ ID NO: 430553 - RNA, 19 nt, Homo sapiens
ucaagugucuuccaucaug

SEQ ID NO: 430554 - RNA, 19 nt, Homo sapiens
caaagcacuuggacucuug

SEQ ID NO: 430555 - RNA, 19 nt, Homo sapiens
ucaagagcaucaugaagaa

SEQ ID NO: 430556 - RNA, 19 nt, Homo sapiens
gcauuaacuucucuggaaa

SEQ ID NO: 430557 - RNA, 19 nt, Homo sapiens
caagaucaauggcuacaca

SEQ ID NO: 430558 - RNA, 19 nt, Homo sapiens
gaagcaggcuggagguaag

SEQ ID NO: 430559 - RNA, 19 nt, Homo sapiens
ucagugagcccauggaauu

SEQ ID NO: 430560 - RNA, 19 nt, Homo sapiens
gugacaaggugcagaaaga

SEQ ID NO: 430561 - RNA, 19 nt, Homo sapiens
ggacauaugagaccuucaa

SEQ ID NO: 430562 - RNA, 19 nt, Homo sapiens
cuucucaagugccuuaaua

SEQ ID NO: 430563 - RNA, 19 nt, Homo sapiens
caaaauaacgccccagaua

SEQ ID NO: 430564 - RNA, 19 nt, Homo sapiens
caaaagcacuuacggauuc

SEQ ID NO: 430565 - RNA, 19 nt, Homo sapiens
caacugagcccaugcugau

SEQ ID NO: 430566 - RNA, 19 nt, Homo sapiens
ggauugaggagaaacguaa

SEQ ID NO: 430567 - RNA, 19 nt, Homo sapiens
caucauggauucauuacag

SEQ ID NO: 430568 - RNA, 19 nt, Homo sapiens
uaucaagugucuuccauca

SEQ ID NO: 430569 - RNA, 19 nt, Homo sapiens
ggcuauaacucgccuagug

SEQ ID NO: 430570 - RNA, 19 nt, Homo sapiens
cucaagaucugccgaguga

SEQ ID NO: 430571 - RNA, 19 nt, Homo sapiens
gcacagauaccaccaagac

SEQ ID NO: 430572 - RNA, 19 nt, Homo sapiens
aagaggacauugaggugua

SEQ ID NO: 430573 - RNA, 19 nt, Homo sapiens
ugagcaccaucaacuauga

SEQ ID NO: 430574 - RNA, 19 nt, Homo sapiens
ggaauccagugugugaaga

SEQ ID NO: 430575 - RNA, 19 nt, Homo sapiens
gcaguuugaugaugaagac

SEQ ID NO: 430576 - RNA, 19 nt, Homo sapiens
gcagaaagaggacauugag

SEQ ID NO: 430577 - RNA, 19 nt, Homo sapiens
gggaugagaucuuccuacu

SEQ ID NO: 430578 - RNA, 19 nt, Homo sapiens
cccacgagcuuguaggaaa

SEQ ID NO: 430579 - RNA, 19 nt, Homo sapiens
ggcgagaggagcacagaua

SEQ ID NO: 430580 - RNA, 19 nt, Homo sapiens
ggucagcucccuucucugu

SEQ ID NO: 430581 - RNA, 19 nt, Homo sapiens
ucaaagcacuuggacucuu

SEQ ID NO: 430582 - RNA, 19 nt, Homo sapiens
agcauuaacuucucuggaa

SEQ ID NO: 430583 - RNA, 19 nt, Homo sapiens
gcuauaacucgccuaguga

SEQ ID NO: 430584 - RNA, 19 nt, Homo sapiens
auaguaggguaaguuguua

SEQ ID NO: 430585 - RNA, 19 nt, Homo sapiens
ugagucagaucagcuccua

SEQ ID NO: 430586 - RNA, 19 nt, Homo sapiens
cuuccaaguuccuauagaa

SEQ ID NO: 430587 - RNA, 19 nt, Homo sapiens
caacaaccccuuccaaguu

SEQ ID NO: 430588 - RNA, 19 nt, Homo sapiens
ggcaugcgcuuccgcuaca

SEQ ID NO: 430589 - RNA, 19 nt, Homo sapiens
cauaugagaccuucaagag

SEQ ID NO: 430590 - RNA, 19 nt, Homo sapiens
gcauugucccugugccuaa

SEQ ID NO: 430591 - RNA, 19 nt, Homo sapiens
ccaaguuccuauagaagag

SEQ ID NO: 430592 - RNA, 19 nt, Homo sapiens
cucaagugccuuaauagua

SEQ ID NO: 430593 - RNA, 19 nt, Homo sapiens
gggaaggaacgcugucaga

SEQ ID NO: 430594 - RNA, 19 nt, Homo sapiens
ggacauugagguguauuuc

SEQ ID NO: 430595 - RNA, 19 nt, Homo sapiens
guauggcacuggcauuguc

SEQ ID NO: 430596 - RNA, 19 nt, Homo sapiens
ucagcucccuucucuguag

SEQ ID NO: 430597 - RNA, 19 nt, Homo sapiens
aaccauggcugaaggaaac

SEQ ID NO: 430598 - RNA, 19 nt, Homo sapiens
ccacgagcuuguaggaaag

SEQ ID NO: 430599 - RNA, 19 nt, Homo sapiens
gaauccagugugugaagaa

SEQ ID NO: 430600 - RNA, 19 nt, Homo sapiens
aauaguaggguaaguuguu

SEQ ID NO: 430601 - RNA, 19 nt, Homo sapiens
gaaggaaacagugcaacag

SEQ ID NO: 430602 - RNA, 19 nt, Homo sapiens
caaccauggcugaaggaaa

SEQ ID NO: 430603 - RNA, 19 nt, Homo sapiens
gcauccagaccaacaacaa

SEQ ID NO: 430604 - RNA, 19 nt, Homo sapiens
ccagucaggaggcauaguu

SEQ ID NO: 430605 - RNA, 19 nt, Homo sapiens
cagcugcaguuugaugaug

SEQ ID NO: 430606 - RNA, 19 nt, Homo sapiens
gagaggagcacagauacca

SEQ ID NO: 430607 - RNA, 19 nt, Homo sapiens
ccucuucucaagugccuua

SEQ ID NO: 430608 - RNA, 19 nt, Homo sapiens
gugccuaacaccagcguuu

SEQ ID NO: 430609 - RNA, 19 nt, Homo sapiens
auggauucauuacagcuua

SEQ ID NO: 430610 - RNA, 19 nt, Homo sapiens
gcugcaguuugaugaugaa

SEQ ID NO: 430611 - RNA, 19 nt, Homo sapiens
uccaguaccugccagauac

SEQ ID NO: 430612 - RNA, 19 nt, Homo sapiens
caucccaucuuugacaauc

SEQ ID NO: 430613 - RNA, 19 nt, Homo sapiens
uggauucauuacagcuuaa

SEQ ID NO: 430614 - RNA, 19 nt, Homo sapiens
caacuuuguggaugucuuc

SEQ ID NO: 430615 - RNA, 19 nt, Homo sapiens
gacauugagguguauuuca

SEQ ID NO: 430616 - RNA, 19 nt, Homo sapiens
uuaauaguaggguaaguug

SEQ ID NO: 430617 - RNA, 19 nt, Homo sapiens
uggaguacccugaggcuau

SEQ ID NO: 430618 - RNA, 19 nt, Homo sapiens
cugccgagcucaagaucug

SEQ ID NO: 430619 - RNA, 19 nt, Homo sapiens
acucugaacuaauaaagcu

SEQ ID NO: 430620 - RNA, 19 nt, Homo sapiens
gccgggauggcuucuauga

SEQ ID NO: 430621 - RNA, 19 nt, Homo sapiens
gaggagaaacguaaaagga

SEQ ID NO: 430622 - RNA, 19 nt, Homo sapiens
ugaaggaaacagugcaaca

SEQ ID NO: 430623 - RNA, 19 nt, Homo sapiens
caagaucugccgagugaac

SEQ ID NO: 430624 - RNA, 19 nt, Homo sapiens
uuucucaucccaucuuuga

SEQ ID NO: 430625 - RNA, 19 nt, Homo sapiens
agaagcaggcuggagguaa

SEQ ID NO: 430626 - RNA, 19 nt, Homo sapiens
ggagccauauuuuauucuu

SEQ ID NO: 430627 - RNA, 19 nt, Homo sapiens
gggauugaagcccuccaaa

SEQ ID NO: 430628 - RNA, 19 nt, Homo sapiens
cuuggacucuugcucuuuc

SEQ ID NO: 430629 - RNA, 19 nt, Homo sapiens
cugccgggauggcuucuau

SEQ ID NO: 430630 - RNA, 19 nt, Homo sapiens
ccaacuuuguggaugucuu

SEQ ID NO: 430631 - RNA, 19 nt, Homo sapiens
ccugagcaccaucaacuau

SEQ ID NO: 430632 - RNA, 19 nt, Homo sapiens
aagagcaucaugaagaaga

SEQ ID NO: 430633 - RNA, 19 nt, Homo sapiens
ucaccggauugaggagaaa

SEQ ID NO: 430634 - RNA, 19 nt, Homo sapiens
gcaccgacaaguggccauu

SEQ ID NO: 430635 - RNA, 19 nt, Homo sapiens
ggggagccauauuuuauuc

SEQ ID NO: 430636 - RNA, 19 nt, Homo sapiens
ugaacaaucaaagcacuug

SEQ ID NO: 430637 - RNA, 19 nt, Homo sapiens
gggaauccagugugugaag

SEQ ID NO: 430638 - RNA, 19 nt, Homo sapiens
ggcuggagguaaggccuuu

SEQ ID NO: 430639 - RNA, 19 nt, Homo sapiens
ggauugaagcccuccaaaa

SEQ ID NO: 430640 - RNA, 19 nt, Homo sapiens
ucaugaagaagaguccuuu

SEQ ID NO: 430641 - RNA, 19 nt, Homo sapiens
gauugaggagaaacguaaa

SEQ ID NO: 430642 - RNA, 19 nt, Homo sapiens
ugagaucuuccuacugugu

SEQ ID NO: 430643 - RNA, 19 nt, Homo sapiens
caacacugccgagcucaag

SEQ ID NO: 430644 - RNA, 19 nt, Homo sapiens
ggacucuugcucuuucuac

SEQ ID NO: 430645 - RNA, 19 nt, Homo sapiens
uaagcagaagcauuaacuu

SEQ ID NO: 430646 - RNA, 19 nt, Homo sapiens
gauugaagcccuccaaaag

SEQ ID NO: 430647 - RNA, 19 nt, Homo sapiens
cgucaucccugagcaccau

SEQ ID NO: 430648 - RNA, 19 nt, Homo sapiens
gaagaaccaucaggaagua

SEQ ID NO: 430649 - RNA, 19 nt, Homo sapiens
caucagagcugcggauuug

SEQ ID NO: 430650 - RNA, 19 nt, Homo sapiens
gacaagaaauccacaaaca

SEQ ID NO: 430651 - RNA, 19 nt, Homo sapiens
gcagaaagaggacauauca

SEQ ID NO: 430652 - RNA, 19 nt, Homo sapiens
gcgacaaggugcagaaaga

SEQ ID NO: 430653 - RNA, 19 nt, Homo sapiens
ggacauaucagugguguuc

SEQ ID NO: 430654 - RNA, 19 nt, Homo sapiens
cugcggauuugccgaauua

SEQ ID NO: 430655 - RNA, 19 nt, Homo sapiens
gcagcgagccauugccuuu

SEQ ID NO: 430656 - RNA, 19 nt, Homo sapiens
caagaaauccacaaacaca

SEQ ID NO: 430657 - RNA, 19 nt, Homo sapiens
gcgaggagcucuacuugcu

SEQ ID NO: 430658 - RNA, 19 nt, Homo sapiens
gcccgucuaugacaagaaa

SEQ ID NO: 430659 - RNA, 19 nt, Homo sapiens
ggaaaagauuguacauaug

SEQ ID NO: 430660 - RNA, 19 nt, Homo sapiens
gccagacccugacuucuuc

SEQ ID NO: 430661 - RNA, 19 nt, Homo sapiens
uucagagucuucccaauaa

SEQ ID NO: 430662 - RNA, 19 nt, Homo sapiens
cggaaaagauuguacauau

SEQ ID NO: 430663 - RNA, 19 nt, Homo sapiens
gaaauccacaaacacauca

SEQ ID NO: 430664 - RNA, 19 nt, Homo sapiens
gcuacggcguggacaagaa

SEQ ID NO: 430665 - RNA, 19 nt, Homo sapiens
gcacagaugaauuggagau

SEQ ID NO: 430666 - RNA, 19 nt, Homo sapiens
gauugaggcugccauugag

SEQ ID NO: 430667 - RNA, 19 nt, Homo sapiens
cccgugcacuagcuuguua

SEQ ID NO: 430668 - RNA, 19 nt, Homo sapiens
uuacagaugaggaaacuga

SEQ ID NO: 430669 - RNA, 19 nt, Homo sapiens
caggagcacagaugaauug

SEQ ID NO: 430670 - RNA, 19 nt, Homo sapiens
gagcaaacggcggaagaaa

SEQ ID NO: 430671 - RNA, 19 nt, Homo sapiens
ugaggaagaaggagauuga

SEQ ID NO: 430672 - RNA, 19 nt, Homo sapiens
ccaucgagcuccgggauug

SEQ ID NO: 430673 - RNA, 19 nt, Homo sapiens
ucagagucuucccaauaaa

SEQ ID NO: 430674 - RNA, 19 nt, Homo sapiens
acgaggaccuggagauugu

SEQ ID NO: 430675 - RNA, 19 nt, Homo sapiens
ccauugagcggaagauuca

SEQ ID NO: 430676 - RNA, 19 nt, Homo sapiens
acgaguacaucaaggagaa

SEQ ID NO: 430677 - RNA, 19 nt, Homo sapiens
gaucaucgacgaguacauc

SEQ ID NO: 430678 - RNA, 19 nt, Homo sapiens
agaaagaggacauaucagu

SEQ ID NO: 430679 - RNA, 19 nt, Homo sapiens
ggagauugaggcugccauu

SEQ ID NO: 430680 - RNA, 19 nt, Homo sapiens
gaaaagauuguacauaugg

SEQ ID NO: 430681 - RNA, 19 nt, Homo sapiens
cacugacacuggacucgua

SEQ ID NO: 430682 - RNA, 19 nt, Homo sapiens
gagagcaaacggcggaaga

SEQ ID NO: 430683 - RNA, 19 nt, Homo sapiens
guaccugccucgcgaccau

SEQ ID NO: 430684 - RNA, 19 nt, Homo sapiens
ccagauugccauuguguuc

SEQ ID NO: 430685 - RNA, 19 nt, Homo sapiens
ugaagaaccaucaggaagu

SEQ ID NO: 430686 - RNA, 19 nt, Homo sapiens
cgacgugcaccgccagauu

SEQ ID NO: 430687 - RNA, 19 nt, Homo sapiens
acagaugaauuggagauca

SEQ ID NO: 430688 - RNA, 19 nt, Homo sapiens
ucacggagcagcccaagca

SEQ ID NO: 430689 - RNA, 19 nt, Homo sapiens
gacgugcaccgccagauug

SEQ ID NO: 430690 - RNA, 19 nt, Homo sapiens
ggauuugccgaauuaacaa

SEQ ID NO: 430691 - RNA, 19 nt, Homo sapiens
uuuccgagcccgucuauga

SEQ ID NO: 430692 - RNA, 19 nt, Homo sapiens
agauugaggcugccauuga

SEQ ID NO: 430693 - RNA, 19 nt, Homo sapiens
ggagaucaucgacgaguac

SEQ ID NO: 430694 - RNA, 19 nt, Homo sapiens
uggagaucaucgacgagua

SEQ ID NO: 430695 - RNA, 19 nt, Homo sapiens
gggaaggucgggcugacuu

SEQ ID NO: 430696 - RNA, 19 nt, Homo sapiens
gcugcggauuugccgaauu

SEQ ID NO: 430697 - RNA, 19 nt, Homo sapiens
cggauuugccgaauuaaca

SEQ ID NO: 430698 - RNA, 19 nt, Homo sapiens
gaagauucaacugggcauu

SEQ ID NO: 430699 - RNA, 19 nt, Homo sapiens
gccacacgcuagcgcuguu

SEQ ID NO: 430700 - RNA, 19 nt, Homo sapiens
gagcccgucuaugacaaga

SEQ ID NO: 430701 - RNA, 19 nt, Homo sapiens
ccaggagcacagaugaauu

SEQ ID NO: 430702 - RNA, 19 nt, Homo sapiens
ggaccagcagggacagaug

SEQ ID NO: 430703 - RNA, 19 nt, Homo sapiens
ucaggaaguagacaugaau

SEQ ID NO: 430704 - RNA, 19 nt, Homo sapiens
cuacgaggaccuggagauu

SEQ ID NO: 430705 - RNA, 19 nt, Homo sapiens
agauugccauuguguucaa

SEQ ID NO: 430706 - RNA, 19 nt, Homo sapiens
caucaggaaguagacauga

SEQ ID NO: 430707 - RNA, 19 nt, Homo sapiens
gagauugaggcugccauug

SEQ ID NO: 430708 - RNA, 19 nt, Homo sapiens
gagcccauuuuacagauga

SEQ ID NO: 430709 - RNA, 19 nt, Homo sapiens
agccauugccuuucacgua

SEQ ID NO: 430710 - RNA, 19 nt, Homo sapiens
agaaauccacaaacacauc

SEQ ID NO: 430711 - RNA, 19 nt, Homo sapiens
gccauugagcggaagauuc

SEQ ID NO: 430712 - RNA, 19 nt, Homo sapiens
ugccagacccugacuucuu

SEQ ID NO: 430713 - RNA, 19 nt, Homo sapiens
cugccugccugguguggaa

SEQ ID NO: 430714 - RNA, 19 nt, Homo sapiens
agaagaggcuguuugauua

SEQ ID NO: 430715 - RNA, 19 nt, Homo sapiens
gaauaaagacuucauguuc

SEQ ID NO: 430716 - RNA, 19 nt, Homo sapiens
gaacucacccuccgcuauu

SEQ ID NO: 430717 - RNA, 19 nt, Homo sapiens
caaagagaauaaagacuuc

SEQ ID NO: 430718 - RNA, 19 nt, Homo sapiens
ggaacgagguguggacaug

SEQ ID NO: 430719 - RNA, 19 nt, Homo sapiens
gcccucagauggagacauu

SEQ ID NO: 430720 - RNA, 19 nt, Homo sapiens
ccaagaagaggcuguuuga

SEQ ID NO: 430721 - RNA, 19 nt, Homo sapiens
ccaguacuauggcgagauu

SEQ ID NO: 430722 - RNA, 19 nt, Homo sapiens
aagaagaggcuguuugauu

SEQ ID NO: 430723 - RNA, 19 nt, Homo sapiens
gaagaggcuguuugauuau

SEQ ID NO: 430724 - RNA, 19 nt, Homo sapiens
ggacaaagagaauaaagac

SEQ ID NO: 430725 - RNA, 19 nt, Homo sapiens
caagcacaauggaacagaa

SEQ ID NO: 430726 - RNA, 19 nt, Homo sapiens
gaggacgucuucucuuucu

SEQ ID NO: 430727 - RNA, 19 nt, Homo sapiens
gagaauaaagacuucaugu

SEQ ID NO: 430728 - RNA, 19 nt, Homo sapiens
ucaagagaaugcccucaau

SEQ ID NO: 430729 - RNA, 19 nt, Homo sapiens
cgaaaguucuacacagagu

SEQ ID NO: 430730 - RNA, 19 nt, Homo sapiens
gaguggagccaacccauga

SEQ ID NO: 430731 - RNA, 19 nt, Homo sapiens
cagcgcggacuauguauuu

SEQ ID NO: 430732 - RNA, 19 nt, Homo sapiens
gauuaugucgugaagugua

SEQ ID NO: 430733 - RNA, 19 nt, Homo sapiens
acagacaccaccaccuuua

SEQ ID NO: 430734 - RNA, 19 nt, Homo sapiens
cgucuucucuuucuacuac

SEQ ID NO: 430735 - RNA, 19 nt, Homo sapiens
cgacagacaccaccaccuu

SEQ ID NO: 430736 - RNA, 19 nt, Homo sapiens
caccagcgcggacuaugua

SEQ ID NO: 430737 - RNA, 19 nt, Homo sapiens
uauaucaaccucaucaaga

SEQ ID NO: 430738 - RNA, 19 nt, Homo sapiens
gacuauguauuucaggaau

SEQ ID NO: 430739 - RNA, 19 nt, Homo sapiens
caccagcccuucccugcuu

SEQ ID NO: 430740 - RNA, 19 nt, Homo sapiens
ggacuauguauuucaggaa

SEQ ID NO: 430741 - RNA, 19 nt, Homo sapiens
ccaccuugcucugugaaga

SEQ ID NO: 430742 - RNA, 19 nt, Homo sapiens
uuaaacggaucuuccucaa

SEQ ID NO: 430743 - RNA, 19 nt, Homo sapiens
gacacugguucguccaaug

SEQ ID NO: 430744 - RNA, 19 nt, Homo sapiens
gagcuggaacacucucuga

SEQ ID NO: 430745 - RNA, 19 nt, Homo sapiens
gacagacaccaccaccuuu

SEQ ID NO: 430746 - RNA, 19 nt, Homo sapiens
aaaguucuacacagaguuu

SEQ ID NO: 430747 - RNA, 19 nt, Homo sapiens
gaaaguucuacacagaguu

SEQ ID NO: 430748 - RNA, 19 nt, Homo sapiens
uugauuaugucgugaagug

SEQ ID NO: 430749 - RNA, 19 nt, Homo sapiens
uccgaaaguucuacacaga

SEQ ID NO: 430750 - RNA, 19 nt, Homo sapiens
gaauuuccacuauaucaac

SEQ ID NO: 430751 - RNA, 19 nt, Homo sapiens
ggacgucuucucuuucuac

SEQ ID NO: 430752 - RNA, 19 nt, Homo sapiens
gauccucaccaacuacaug

SEQ ID NO: 430753 - RNA, 19 nt, Homo sapiens
cauccaccuugcucuguga

SEQ ID NO: 430754 - RNA, 19 nt, Homo sapiens
agacaccaccaccuuuaaa

SEQ ID NO: 430755 - RNA, 19 nt, Homo sapiens
caagagaaugcccucaauc

SEQ ID NO: 430756 - RNA, 19 nt, Homo sapiens
cagacaccaccaccuuuaa

SEQ ID NO: 430757 - RNA, 19 nt, Homo sapiens
gccaagaagaggcuguuug

SEQ ID NO: 430758 - RNA, 19 nt, Homo sapiens
ggacauggccaggcuuggu

SEQ ID NO: 430759 - RNA, 19 nt, Homo sapiens
gggccaccuucauccgaaa

SEQ ID NO: 430760 - RNA, 19 nt, Homo sapiens
ggagccaacccaugaagag

SEQ ID NO: 430761 - RNA, 19 nt, Homo sapiens
ccaccugggaggcaaagaa

SEQ ID NO: 430762 - RNA, 19 nt, Homo sapiens
gacagucaguggcuuucuc

SEQ ID NO: 430763 - RNA, 19 nt, Homo sapiens
gaggacaaagagaauaaag

SEQ ID NO: 430764 - RNA, 19 nt, Homo sapiens
gcuuaugcccucagaugga

SEQ ID NO: 430765 - RNA, 19 nt, Homo sapiens
ccuuuggucucccgacaga

SEQ ID NO: 430766 - RNA, 19 nt, Homo sapiens
ccaccuucauccgaaaguu

SEQ ID NO: 430767 - RNA, 19 nt, Homo sapiens
uuggagaggucacggagau

SEQ ID NO: 430768 - RNA, 19 nt, Homo sapiens
agagagagccccagacuga

SEQ ID NO: 430769 - RNA, 19 nt, Homo sapiens
acauggacacccaguacua

SEQ ID NO: 430770 - RNA, 19 nt, Homo sapiens
auuaugucgugaaguguaa

SEQ ID NO: 430771 - RNA, 19 nt, Homo sapiens
gugcagccgucucuacacu

SEQ ID NO: 430772 - RNA, 19 nt, Homo sapiens
gcgcggacuauguauuuca

SEQ ID NO: 430773 - RNA, 19 nt, Homo sapiens
aagaggcuguuugauuaug

SEQ ID NO: 430774 - RNA, 19 nt, Homo sapiens
gcacaauggaacagaacuc

SEQ ID NO: 430775 - RNA, 19 nt, Homo sapiens
gaggcuguuugauuauguc

SEQ ID NO: 430776 - RNA, 19 nt, Homo sapiens
cggcguaacaaccgcauug

SEQ ID NO: 430777 - RNA, 19 nt, Homo sapiens
agaggcuguuugauuaugu

SEQ ID NO: 430778 - RNA, 19 nt, Homo sapiens
gcauuacgaagggaauuuc

SEQ ID NO: 430779 - RNA, 19 nt, Homo sapiens
uugaggacaaagagaauaa

SEQ ID NO: 430780 - RNA, 19 nt, Homo sapiens
caagugcagccgucucuac

SEQ ID NO: 430781 - RNA, 19 nt, Homo sapiens
acugguucguccaauguuu

SEQ ID NO: 430782 - RNA, 19 nt, Homo sapiens
cuacauggacacccaguac

SEQ ID NO: 430783 - RNA, 19 nt, Homo sapiens
ugacacugguucguccaau

SEQ ID NO: 430784 - RNA, 19 nt, Homo sapiens
gacaggacauggagaaaga

SEQ ID NO: 430785 - RNA, 19 nt, Homo sapiens
gacaagcugugcuggagaa

SEQ ID NO: 430786 - RNA, 19 nt, Homo sapiens
caagaagugugccuuugug

SEQ ID NO: 430787 - RNA, 19 nt, Homo sapiens
ccaggaugcugauaacuuc

SEQ ID NO: 430788 - RNA, 19 nt, Homo sapiens
gcagagggauggacaagcu

SEQ ID NO: 430789 - RNA, 19 nt, Homo sapiens
ggaggcagguauggaugua

SEQ ID NO: 430790 - RNA, 19 nt, Homo sapiens
gcuggaagccggcugguuu

SEQ ID NO: 430791 - RNA, 19 nt, Homo sapiens
gcaagaagugugccuuugu

SEQ ID NO: 430792 - RNA, 19 nt, Homo sapiens
ccacgugauugacaaguuc

SEQ ID NO: 430793 - RNA, 19 nt, Homo sapiens
cgaaccaucuucagugagu

SEQ ID NO: 430794 - RNA, 19 nt, Homo sapiens
aagcugugcuggagaaugu

SEQ ID NO: 430795 - RNA, 19 nt, Homo sapiens
augaugaccucaaguaugu

SEQ ID NO: 430796 - RNA, 19 nt, Homo sapiens
gagcccacgugauugacaa

SEQ ID NO: 430797 - RNA, 19 nt, Homo sapiens
ggagaaagagcgagagacu

SEQ ID NO: 430798 - RNA, 19 nt, Homo sapiens
guacaccuuccgccaguuu

SEQ ID NO: 430799 - RNA, 19 nt, Homo sapiens
ggaccgcgaccaacucugu

SEQ ID NO: 430800 - RNA, 19 nt, Homo sapiens
cggaagcgguggagaugau

SEQ ID NO: 430801 - RNA, 19 nt, Homo sapiens
gucagaggguggcaaggaa

SEQ ID NO: 430802 - RNA, 19 nt, Homo sapiens
uguaugaugaccucaagua

SEQ ID NO: 430803 - RNA, 19 nt, Homo sapiens
gauugacaaguuccuauug

SEQ ID NO: 430804 - RNA, 19 nt, Homo sapiens
aggcagguauggauguauu

SEQ ID NO: 430805 - RNA, 19 nt, Homo sapiens
ucuaccaaguggcugagua

SEQ ID NO: 430806 - RNA, 19 nt, Homo sapiens
gaaaggcgaccccgaacuu

SEQ ID NO: 430807 - RNA, 19 nt, Homo sapiens
gcagcgaaccaucuucagu

SEQ ID NO: 430808 - RNA, 19 nt, Homo sapiens
gguguaugaugaccucaag

SEQ ID NO: 430809 - RNA, 19 nt, Homo sapiens
cagcuggagugggccauga

SEQ ID NO: 430810 - RNA, 19 nt, Homo sapiens
gauguauugucgccuguac

SEQ ID NO: 430811 - RNA, 19 nt, Homo sapiens
aaaagcagguggugaguuc

SEQ ID NO: 430812 - RNA, 19 nt, Homo sapiens
uaugaugaccucaaguaug

SEQ ID NO: 430813 - RNA, 19 nt, Homo sapiens
acacagugaagccaugauu

SEQ ID NO: 430814 - RNA, 19 nt, Homo sapiens
guaugaugaccucaaguau

SEQ ID NO: 430815 - RNA, 19 nt, Homo sapiens
caucuucagugaguguuuc

SEQ ID NO: 430816 - RNA, 19 nt, Homo sapiens
uugccuuccucauggguua

SEQ ID NO: 430817 - RNA, 19 nt, Homo sapiens
ugaccacggaggccucuuu

SEQ ID NO: 430818 - RNA, 19 nt, Homo sapiens
gaugaccucaaguaugugu

SEQ ID NO: 430819 - RNA, 19 nt, Homo sapiens
gcaagguggcccucuccau

SEQ ID NO: 430820 - RNA, 19 nt, Homo sapiens
gguuucugcuccgucauug

SEQ ID NO: 430821 - RNA, 19 nt, Homo sapiens
gacggaagcgguggagaug

SEQ ID NO: 430822 - RNA, 19 nt, Homo sapiens
agcgaaccaucuucaguga

SEQ ID NO: 430823 - RNA, 19 nt, Homo sapiens
ugauugacaaguuccuauu

SEQ ID NO: 430824 - RNA, 19 nt, Homo sapiens
cccacgugauugacaaguu

SEQ ID NO: 430825 - RNA, 19 nt, Homo sapiens
gcagguauggauguauugu

SEQ ID NO: 430826 - RNA, 19 nt, Homo sapiens
cgacaggacauggagaaag

SEQ ID NO: 430827 - RNA, 19 nt, Homo sapiens
gugcagcgaaccaucuuca

SEQ ID NO: 430828 - RNA, 19 nt, Homo sapiens
ggaaacaaguuacagaaau

SEQ ID NO: 430829 - RNA, 19 nt, Homo sapiens
ggaagacccucaucucaga

SEQ ID NO: 430830 - RNA, 19 nt, Homo sapiens
caaggucccugauaauuau

SEQ ID NO: 430831 - RNA, 19 nt, Homo sapiens
agagagagcugcugaugaa

SEQ ID NO: 430832 - RNA, 19 nt, Homo sapiens
gcuccuaccuggugcagua

SEQ ID NO: 430833 - RNA, 19 nt, Homo sapiens
ggaagucgaccuccuuuga

SEQ ID NO: 430834 - RNA, 19 nt, Homo sapiens
ucaaggucccugauaauua

SEQ ID NO: 430835 - RNA, 19 nt, Homo sapiens
gaaaggggacuacgucuua

SEQ ID NO: 430836 - RNA, 19 nt, Homo sapiens
caagauaacaucacuguca

SEQ ID NO: 430837 - RNA, 19 nt, Homo sapiens
cagggacucuuauuuauuc

SEQ ID NO: 430838 - RNA, 19 nt, Homo sapiens
ggaagcuggucaacacuau

SEQ ID NO: 430839 - RNA, 19 nt, Homo sapiens
gcagccacauuguaaauca

SEQ ID NO: 430840 - RNA, 19 nt, Homo sapiens
caaagcagccgcucuggaa

SEQ ID NO: 430841 - RNA, 19 nt, Homo sapiens
ggcagggacucuuauuuau

SEQ ID NO: 430842 - RNA, 19 nt, Homo sapiens
gaggagcuguggaaggaaa

SEQ ID NO: 430843 - RNA, 19 nt, Homo sapiens
gaagaagacaccuauuaca

SEQ ID NO: 430844 - RNA, 19 nt, Homo sapiens
gcagggacucuuauuuauu

SEQ ID NO: 430845 - RNA, 19 nt, Homo sapiens
gaguagcccuuuccucugu

SEQ ID NO: 430846 - RNA, 19 nt, Homo sapiens
uggcagggacucuuauuua

SEQ ID NO: 430847 - RNA, 19 nt, Homo sapiens
ccgagggccuucauuuaaa

SEQ ID NO: 430848 - RNA, 19 nt, Homo sapiens
gaagaucaccacgaaguug

SEQ ID NO: 430849 - RNA, 19 nt, Homo sapiens
caacggacguggaaauacu

SEQ ID NO: 430850 - RNA, 19 nt, Homo sapiens
gagccagccuucccagaug

SEQ ID NO: 430851 - RNA, 19 nt, Homo sapiens
gcucgcagacucucacuuu

SEQ ID NO: 430852 - RNA, 19 nt, Homo sapiens
uuaaaggaguacugaagaa

SEQ ID NO: 430853 - RNA, 19 nt, Homo sapiens
gagaagaucaccacgaagu

SEQ ID NO: 430854 - RNA, 19 nt, Homo sapiens
uggagaagaucaccacgaa

SEQ ID NO: 430855 - RNA, 19 nt, Homo sapiens
auaaaccgauguucuucua

SEQ ID NO: 430856 - RNA, 19 nt, Homo sapiens
gagaaucgccuacuucacu

SEQ ID NO: 430857 - RNA, 19 nt, Homo sapiens
agacaguccuggagugcua

SEQ ID NO: 430858 - RNA, 19 nt, Homo sapiens
aaaggaguacugaagaaua

SEQ ID NO: 430859 - RNA, 19 nt, Homo sapiens
gaguuuaaaucacaaaucg

SEQ ID NO: 430860 - RNA, 19 nt, Homo sapiens
gaccugggccuuaacaaga

SEQ ID NO: 430861 - RNA, 19 nt, Homo sapiens
ggugggaccugggccuuaa

SEQ ID NO: 430862 - RNA, 19 nt, Homo sapiens
cgaggaagaugaagaagac

SEQ ID NO: 430863 - RNA, 19 nt, Homo sapiens
ccagacccaugaccagauu

SEQ ID NO: 430864 - RNA, 19 nt, Homo sapiens
cgaaggcacuaucaaagca

SEQ ID NO: 430865 - RNA, 19 nt, Homo sapiens
gguauggcgucaucauugu

SEQ ID NO: 430866 - RNA, 19 nt, Homo sapiens
gauccugccugcgugguuu

SEQ ID NO: 430867 - RNA, 19 nt, Homo sapiens
gcucuagggcuuucgguuu

SEQ ID NO: 430868 - RNA, 19 nt, Homo sapiens
guucuccgcuggacucaga

SEQ ID NO: 430869 - RNA, 19 nt, Homo sapiens
gagagagagcugcugauga

SEQ ID NO: 430870 - RNA, 19 nt, Homo sapiens
ucacuuugcccaagacuga

SEQ ID NO: 430871 - RNA, 19 nt, Homo sapiens
gaagcgcaccgcagagaga

SEQ ID NO: 430872 - RNA, 19 nt, Homo sapiens
agaagagaaucgccuacuu

SEQ ID NO: 430873 - RNA, 19 nt, Homo sapiens
gggccuucauuuaaagaaa

SEQ ID NO: 430874 - RNA, 19 nt, Homo sapiens
cagcggaucgugugaagaa

SEQ ID NO: 430875 - RNA, 19 nt, Homo sapiens
uuccuaaguuugucucuaa

SEQ ID NO: 430876 - RNA, 19 nt, Homo sapiens
cauccaacaucuucuacga

SEQ ID NO: 430877 - RNA, 19 nt, Homo sapiens
augaagaagacaccuauua

SEQ ID NO: 430878 - RNA, 19 nt, Homo sapiens
uaaggaaacaaguuacaga

SEQ ID NO: 430879 - RNA, 19 nt, Homo sapiens
caacgagcaccaaggcauu

SEQ ID NO: 430880 - RNA, 19 nt, Homo sapiens
ggaccagauuggcaucauc

SEQ ID NO: 430881 - RNA, 19 nt, Homo sapiens
uggaggagcuguggaagga

SEQ ID NO: 430882 - RNA, 19 nt, Homo sapiens
ugagaagcuuccagaaaca

SEQ ID NO: 430883 - RNA, 19 nt, Homo sapiens
gcccuuuccucuguucuuu

SEQ ID NO: 430884 - RNA, 19 nt, Homo sapiens
ugacggggcugucccagua

SEQ ID NO: 430885 - RNA, 19 nt, Homo sapiens
uuaccuuggugacgaguuu

SEQ ID NO: 430886 - RNA, 19 nt, Homo sapiens
ccgaaggcauccugcagaa

SEQ ID NO: 430887 - RNA, 19 nt, Homo sapiens
ggaccugggagauuugaga

SEQ ID NO: 430888 - RNA, 19 nt, Homo sapiens
cgucacagcccuucucuca

SEQ ID NO: 430889 - RNA, 19 nt, Homo sapiens
ugaagacugugcugcaaag

SEQ ID NO: 430890 - RNA, 19 nt, Homo sapiens
ccaaggcaauguaacuuuu

SEQ ID NO: 430891 - RNA, 19 nt, Homo sapiens
gcaugcaccggguagguuu

SEQ ID NO: 430892 - RNA, 19 nt, Homo sapiens
gcaguuccgcuccauuuua

SEQ ID NO: 430893 - RNA, 19 nt, Homo sapiens
cauuguaaaucaccuugug

SEQ ID NO: 430894 - RNA, 19 nt, Homo sapiens
uugagaagcuuccagaaac

SEQ ID NO: 430895 - RNA, 19 nt, Homo sapiens
gcccaguggugaugugcaa

SEQ ID NO: 430896 - RNA, 19 nt, Homo sapiens
guaauaccagcaagaagug

SEQ ID NO: 430897 - RNA, 19 nt, Homo sapiens
uagcagcagccuugacaaa

SEQ ID NO: 430898 - RNA, 19 nt, Homo sapiens
ccuggaagcugcucguucu

SEQ ID NO: 430899 - RNA, 19 nt, Homo sapiens
gaagcuuccagaaacaguu

SEQ ID NO: 430900 - RNA, 19 nt, Homo sapiens
cgagggccuucauuuaaag

SEQ ID NO: 430901 - RNA, 19 nt, Homo sapiens
uccgagggccuucauuuaa

SEQ ID NO: 430902 - RNA, 19 nt, Homo sapiens
ccgauaaaccgauguucuu

SEQ ID NO: 430903 - RNA, 19 nt, Homo sapiens
ggaccugggccuuaacaag

SEQ ID NO: 430904 - RNA, 19 nt, Homo sapiens
cggcacagcagaucaacaa

SEQ ID NO: 430905 - RNA, 19 nt, Homo sapiens
ggaguuuuguuguugguuu

SEQ ID NO: 430906 - RNA, 19 nt, Homo sapiens
ccauacacgccugcaguua

SEQ ID NO: 430907 - RNA, 19 nt, Homo sapiens
cgguggaccugggagauuu

SEQ ID NO: 430908 - RNA, 19 nt, Homo sapiens
aaggaguacugaagaauac

SEQ ID NO: 430909 - RNA, 19 nt, Homo sapiens
ugaccacagccauguauga

SEQ ID NO: 430910 - RNA, 19 nt, Homo sapiens
ugaagaagacaccuauuac

SEQ ID NO: 430911 - RNA, 19 nt, Homo sapiens
ucaggaacauggacagcau

SEQ ID NO: 430912 - RNA, 19 nt, Homo sapiens
uguccuggcuggucaagau

SEQ ID NO: 430913 - RNA, 19 nt, Homo sapiens
gcacaccgaaagcccaaau

SEQ ID NO: 430914 - RNA, 19 nt, Homo sapiens
ugacgaguuuaaaucacaa

SEQ ID NO: 430915 - RNA, 19 nt, Homo sapiens
gcagcagccuugacaaacc

SEQ ID NO: 430916 - RNA, 19 nt, Homo sapiens
ugaagaauacuuuccuaag

SEQ ID NO: 430917 - RNA, 19 nt, Homo sapiens
cggaagagcuaagcaacgu

SEQ ID NO: 430918 - RNA, 19 nt, Homo sapiens
cgaaggaccuccccauaca

SEQ ID NO: 430919 - RNA, 19 nt, Homo sapiens
gaccagauuggcaugauca

SEQ ID NO: 430920 - RNA, 19 nt, Homo sapiens
gaccagauuggcaucauca

SEQ ID NO: 430921 - RNA, 19 nt, Homo sapiens
gagauaugccugcgguaca

SEQ ID NO: 430922 - RNA, 19 nt, Homo sapiens
caagacugacucugacaug

SEQ ID NO: 430923 - RNA, 19 nt, Homo sapiens
gauccgaacaccuccagau

SEQ ID NO: 430924 - RNA, 19 nt, Homo sapiens
guaccaaggcaauguaacu

SEQ ID NO: 430925 - RNA, 19 nt, Homo sapiens
cugaggguguggugucauu

SEQ ID NO: 430926 - RNA, 19 nt, Homo sapiens
uaaaggaguacugaagaau

SEQ ID NO: 430927 - RNA, 19 nt, Homo sapiens
cugcgaacguggagaagau

SEQ ID NO: 430928 - RNA, 19 nt, Homo sapiens
acaaggagauggauaaugu

SEQ ID NO: 430929 - RNA, 19 nt, Homo sapiens
agagaaagcuuccaucuac

SEQ ID NO: 430930 - RNA, 19 nt, Homo sapiens
gagcaguacuacaaagaug

SEQ ID NO: 430931 - RNA, 19 nt, Homo sapiens
uggaugaccucgaugauga

SEQ ID NO: 430932 - RNA, 19 nt, Homo sapiens
cgacuuuccuucccaucua

SEQ ID NO: 430933 - RNA, 19 nt, Homo sapiens
cgacauaucuaaggcuguu

SEQ ID NO: 430934 - RNA, 19 nt, Homo sapiens
caacaacuacugugacuuc

SEQ ID NO: 430935 - RNA, 19 nt, Homo sapiens
ccggacagcuguacuccua

SEQ ID NO: 430936 - RNA, 19 nt, Homo sapiens
cagaugacuuccuggauga

SEQ ID NO: 430937 - RNA, 19 nt, Homo sapiens
gcucagggcauccaucuug

SEQ ID NO: 430938 - RNA, 19 nt, Homo sapiens
ugaagacuaugaagaagau

SEQ ID NO: 430939 - RNA, 19 nt, Homo sapiens
ccagagcaauuguuacauc

SEQ ID NO: 430940 - RNA, 19 nt, Homo sapiens
gaaccagaacuccucuuga

SEQ ID NO: 430941 - RNA, 19 nt, Homo sapiens
uuacaaugcucgccucugu

SEQ ID NO: 430942 - RNA, 19 nt, Homo sapiens
cgcauagccucaccucuuu

SEQ ID NO: 430943 - RNA, 19 nt, Homo sapiens
caucuugccuccaauuuac

SEQ ID NO: 430944 - RNA, 19 nt, Homo sapiens
aaaggguccugauggauug

SEQ ID NO: 430945 - RNA, 19 nt, Homo sapiens
caaacaguguccuccuaga

SEQ ID NO: 430946 - RNA, 19 nt, Homo sapiens
ggaguagcccagagcaauu

SEQ ID NO: 430947 - RNA, 19 nt, Homo sapiens
ccacauagacaucccuuuc

SEQ ID NO: 430948 - RNA, 19 nt, Homo sapiens
guucugcccugucccauuc

SEQ ID NO: 430949 - RNA, 19 nt, Homo sapiens
caaccacccacuccuguuu

SEQ ID NO: 430950 - RNA, 19 nt, Homo sapiens
ggacaaggaagacucucaa

SEQ ID NO: 430951 - RNA, 19 nt, Homo sapiens
ugaugaagacuaugaagaa

SEQ ID NO: 430952 - RNA, 19 nt, Homo sapiens
cuaacucacugucgcuuug

SEQ ID NO: 430953 - RNA, 19 nt, Homo sapiens
aacaguagcuucaccuugu

SEQ ID NO: 430954 - RNA, 19 nt, Homo sapiens
ucucucugcucuccauuaa

SEQ ID NO: 430955 - RNA, 19 nt, Homo sapiens
ccagaacuccucuugaugu

SEQ ID NO: 430956 - RNA, 19 nt, Homo sapiens
uggcggcagugaagacaua

SEQ ID NO: 430957 - RNA, 19 nt, Homo sapiens
gcauccaucuugccuccaa

SEQ ID NO: 430958 - RNA, 19 nt, Homo sapiens
aaccagaacuccucuugau

SEQ ID NO: 430959 - RNA, 19 nt, Homo sapiens
gaugaagacuaugaagaag

SEQ ID NO: 430960 - RNA, 19 nt, Homo sapiens
ccaucuugccuccaauuua

SEQ ID NO: 430961 - RNA, 19 nt, Homo sapiens
gaaccgaccaggccucagu

SEQ ID NO: 430962 - RNA, 19 nt, Homo sapiens
gucuggaccuguugaaaga

SEQ ID NO: 430963 - RNA, 19 nt, Homo sapiens
acauagacaucccuuucuu

SEQ ID NO: 430964 - RNA, 19 nt, Homo sapiens
ucucugcucuccauuaagu

SEQ ID NO: 430965 - RNA, 19 nt, Homo sapiens
gagcugguguccuguucug

SEQ ID NO: 430966 - RNA, 19 nt, Homo sapiens
caaggaagacucucaacca

SEQ ID NO: 430967 - RNA, 19 nt, Homo sapiens
ccucgaugaugaagacuau

SEQ ID NO: 430968 - RNA, 19 nt, Homo sapiens
caguugcucuucugugaug

SEQ ID NO: 430969 - RNA, 19 nt, Homo sapiens
gagcagugccacaauuaca

SEQ ID NO: 430970 - RNA, 19 nt, Homo sapiens
gccacaaggagauggauaa

SEQ ID NO: 430971 - RNA, 19 nt, Homo sapiens
aaacaguguccuccuagaa

SEQ ID NO: 430972 - RNA, 19 nt, Homo sapiens
cgagaaugacgaccaguug

SEQ ID NO: 430973 - RNA, 19 nt, Homo sapiens
gaugauggcggcagugaag

SEQ ID NO: 430974 - RNA, 19 nt, Homo sapiens
uagcccagagcaauuguua

SEQ ID NO: 430975 - RNA, 19 nt, Homo sapiens
ccgcauagccucaccucuu

SEQ ID NO: 430976 - RNA, 19 nt, Homo sapiens
aagcuuccaucuaccagaa

SEQ ID NO: 430977 - RNA, 19 nt, Homo sapiens
ggagggcgaggacaaggaa

SEQ ID NO: 430978 - RNA, 19 nt, Homo sapiens
ggaccgggauaagcccuau

SEQ ID NO: 430979 - RNA, 19 nt, Homo sapiens
cagaacuccucuugaugug

SEQ ID NO: 430980 - RNA, 19 nt, Homo sapiens
gaggccacguccacaagga

SEQ ID NO: 430981 - RNA, 19 nt, Homo sapiens
gaccaggccucaguuacca

SEQ ID NO: 430982 - RNA, 19 nt, Homo sapiens
gcccuaugccugugacauu

SEQ ID NO: 430983 - RNA, 19 nt, Homo sapiens
gguggagaauguagugaag

SEQ ID NO: 430984 - RNA, 19 nt, Homo sapiens
acacagaccagacccugaa

SEQ ID NO: 430985 - RNA, 19 nt, Homo sapiens
gaucacaggguucaaacag

SEQ ID NO: 430986 - RNA, 19 nt, Homo sapiens
uggagcagugccacaauua

SEQ ID NO: 430987 - RNA, 19 nt, Homo sapiens
gcccagagcaauuguuaca

SEQ ID NO: 430988 - RNA, 19 nt, Homo sapiens
caggauggcaguaguuuag

SEQ ID NO: 430989 - RNA, 19 nt, Homo sapiens
ggucuucacacccugauuc

SEQ ID NO: 430990 - RNA, 19 nt, Homo sapiens
ggagcaguacuacaaagau

SEQ ID NO: 430991 - RNA, 19 nt, Homo sapiens
uaucuaaggcuguuucucu

SEQ ID NO: 430992 - RNA, 19 nt, Homo sapiens
gcagugccacaauuacaau

SEQ ID NO: 430993 - RNA, 19 nt, Homo sapiens
aagagaaagcuuccaucua

SEQ ID NO: 430994 - RNA, 19 nt, Homo sapiens
gcaucgagugcaaauguug

SEQ ID NO: 430995 - RNA, 19 nt, Homo sapiens
ggauggcaguaguuuagag

SEQ ID NO: 430996 - RNA, 19 nt, Homo sapiens
gggagcaguacuacaaaga

SEQ ID NO: 430997 - RNA, 19 nt, Homo sapiens
gagaaaggagcaacacacu

SEQ ID NO: 430998 - RNA, 19 nt, Homo sapiens
cggcugugguggagaaugu

SEQ ID NO: 430999 - RNA, 19 nt, Homo sapiens
cuauuaagccagacacaga

SEQ ID NO: 431000 - RNA, 19 nt, Homo sapiens
guugaggugucuuuucuuu

SEQ ID NO: 431001 - RNA, 19 nt, Homo sapiens
gcuaccacauguacugucu

SEQ ID NO: 431002 - RNA, 19 nt, Homo sapiens
accaguugcucuucuguga

SEQ ID NO: 431003 - RNA, 19 nt, Homo sapiens
cagagcaauuguuacaucu

SEQ ID NO: 431004 - RNA, 19 nt, Homo sapiens
ugaccucgaugaugaagac

SEQ ID NO: 431005 - RNA, 19 nt, Homo sapiens
ccuagaaccagaugacuuc

SEQ ID NO: 431006 - RNA, 19 nt, Homo sapiens
gacuuuccuucccaucuau

SEQ ID NO: 431007 - RNA, 19 nt, Homo sapiens
uggaauuucucaucuucug

SEQ ID NO: 431008 - RNA, 19 nt, Homo sapiens
gaguagcccagagcaauug

SEQ ID NO: 431009 - RNA, 19 nt, Homo sapiens
cagaccagacccugaagaa

SEQ ID NO: 431010 - RNA, 19 nt, Homo sapiens
ggacucaaagauuaacaag

SEQ ID NO: 431011 - RNA, 19 nt, Homo sapiens
ccugugacauuuguggaaa

SEQ ID NO: 431012 - RNA, 19 nt, Homo sapiens
gcaauuguuacaucuggau

SEQ ID NO: 431013 - RNA, 19 nt, Homo sapiens
uagcuucaccuuguuauuc

SEQ ID NO: 431014 - RNA, 19 nt, Homo sapiens
ggugaucacaggguucaaa

SEQ ID NO: 431015 - RNA, 19 nt, Homo sapiens
uaccacauguacugucuca

SEQ ID NO: 431016 - RNA, 19 nt, Homo sapiens
gguguccuguucugacugu

SEQ ID NO: 431017 - RNA, 19 nt, Homo sapiens
ucaggauggcaguaguuua

SEQ ID NO: 431018 - RNA, 19 nt, Homo sapiens
cacugucgcuuuggaguug

SEQ ID NO: 431019 - RNA, 19 nt, Homo sapiens
acaguagcuucaccuuguu

SEQ ID NO: 431020 - RNA, 19 nt, Homo sapiens
aaagagaaagcuuccaucu

SEQ ID NO: 431021 - RNA, 19 nt, Homo sapiens
cccuaugccugugacauuu

SEQ ID NO: 431022 - RNA, 19 nt, Homo sapiens
gcgaaagcggauccuagaa

SEQ ID NO: 431023 - RNA, 19 nt, Homo sapiens
ugacagccugggcgaguuu

SEQ ID NO: 431024 - RNA, 19 nt, Homo sapiens
cuccugcucuuaacugaau

SEQ ID NO: 431025 - RNA, 19 nt, Homo sapiens
ggaacaguagcuucaccuu

SEQ ID NO: 431026 - RNA, 19 nt, Homo sapiens
ucuccuccacuucauauuu

SEQ ID NO: 431027 - RNA, 19 nt, Homo sapiens
ugaaagagaaagcuuccau

SEQ ID NO: 431028 - RNA, 19 nt, Homo sapiens
aaagauagcuggcuucuaa

SEQ ID NO: 431029 - RNA, 19 nt, Homo sapiens
gaaggagccuguucagaua

SEQ ID NO: 431030 - RNA, 19 nt, Homo sapiens
gcaguuauguggccucuaa

SEQ ID NO: 431031 - RNA, 19 nt, Homo sapiens
caacgaaucuacccauauu

SEQ ID NO: 431032 - RNA, 19 nt, Homo sapiens
ggaaauugaugaagaugaa

SEQ ID NO: 431033 - RNA, 19 nt, Homo sapiens
gaaggaaccuguugagaag

SEQ ID NO: 431034 - RNA, 19 nt, Homo sapiens
ugaagagucugcugauaua

SEQ ID NO: 431035 - RNA, 19 nt, Homo sapiens
caacacaggugaaggaaau

SEQ ID NO: 431036 - RNA, 19 nt, Homo sapiens
uaacagaggugaaagagau

SEQ ID NO: 431037 - RNA, 19 nt, Homo sapiens
ggauguggcuggaaagaaa

SEQ ID NO: 431038 - RNA, 19 nt, Homo sapiens
gaaggagccuguucagaug

SEQ ID NO: 431039 - RNA, 19 nt, Homo sapiens
gaaggagccuguucagaug

SEQ ID NO: 431040 - RNA, 19 nt, Homo sapiens
aaaggaagcuggaaguuga

SEQ ID NO: 431041 - RNA, 19 nt, Homo sapiens
ggagaacgcccauauaaau

SEQ ID NO: 431042 - RNA, 19 nt, Homo sapiens
ggugaaacuuuaaauggua

SEQ ID NO: 431043 - RNA, 19 nt, Homo sapiens
ugacuugccugauaauauu

SEQ ID NO: 431044 - RNA, 19 nt, Homo sapiens
gaaucucacugguauaaau

SEQ ID NO: 431045 - RNA, 19 nt, Homo sapiens
gauggagggugcccagaua

SEQ ID NO: 431046 - RNA, 19 nt, Homo sapiens
gcaguaagccuccucagaa

SEQ ID NO: 431047 - RNA, 19 nt, Homo sapiens
ggaggaaacauuuaagaaa

SEQ ID NO: 431048 - RNA, 19 nt, Homo sapiens
gcaaaguggaggagaauaa

SEQ ID NO: 431049 - RNA, 19 nt, Homo sapiens
caagacagguucacaaugg

SEQ ID NO: 431050 - RNA, 19 nt, Homo sapiens
gccagagggugaaacuuua

SEQ ID NO: 431051 - RNA, 19 nt, Homo sapiens
ucacagugcuaagaaauuu

SEQ ID NO: 431052 - RNA, 19 nt, Homo sapiens
ccacaagaaucuagcagaa

SEQ ID NO: 431053 - RNA, 19 nt, Homo sapiens
gaugaggaaucuucaacaa

SEQ ID NO: 431054 - RNA, 19 nt, Homo sapiens
gcaguucaauugcccugua

SEQ ID NO: 431055 - RNA, 19 nt, Homo sapiens
gaucagaacacaagagaga

SEQ ID NO: 431056 - RNA, 19 nt, Homo sapiens
cauccuacuuguccuaaua

SEQ ID NO: 431057 - RNA, 19 nt, Homo sapiens
gaagugaccuaagugacaa

SEQ ID NO: 431058 - RNA, 19 nt, Homo sapiens
gcaaguccuuauugaaguu

SEQ ID NO: 431059 - RNA, 19 nt, Homo sapiens
gaaguaacccgccaugcaa

SEQ ID NO: 431060 - RNA, 19 nt, Homo sapiens
ccauagaggugguccagaa

SEQ ID NO: 431061 - RNA, 19 nt, Homo sapiens
gaggaaacauuuaagaaac

SEQ ID NO: 431062 - RNA, 19 nt, Homo sapiens
caaggaaaguauacacaug

SEQ ID NO: 431063 - RNA, 19 nt, Homo sapiens
caguauaguuugugaaaug

SEQ ID NO: 431064 - RNA, 19 nt, Homo sapiens
ggccuaaaccucuuaauug

SEQ ID NO: 431065 - RNA, 19 nt, Homo sapiens
gaaaguaggagcagaagag

SEQ ID NO: 431066 - RNA, 19 nt, Homo sapiens
caggagaacgcccauauaa

SEQ ID NO: 431067 - RNA, 19 nt, Homo sapiens
gaauggcccugccuaacga

SEQ ID NO: 431068 - RNA, 19 nt, Homo sapiens
ccacagaggcgguucagaa

SEQ ID NO: 431069 - RNA, 19 nt, Homo sapiens
caguaucacuucaaaucua

SEQ ID NO: 431070 - RNA, 19 nt, Homo sapiens
aaugugaacuuuguccuua

SEQ ID NO: 431071 - RNA, 19 nt, Homo sapiens
acaauuauguucagcaugu

SEQ ID NO: 431072 - RNA, 19 nt, Homo sapiens
ugaaggaagugaccuaagu

SEQ ID NO: 431073 - RNA, 19 nt, Homo sapiens
gauggagguugcccaggua

SEQ ID NO: 431074 - RNA, 19 nt, Homo sapiens
gauggacccuccucagaug

SEQ ID NO: 431075 - RNA, 19 nt, Homo sapiens
gccaaagggugacagcaaa

SEQ ID NO: 431076 - RNA, 19 nt, Homo sapiens
ggaagagagugcagagaag

SEQ ID NO: 431077 - RNA, 19 nt, Homo sapiens
gggaaaagauuacagcaaa

SEQ ID NO: 431078 - RNA, 19 nt, Homo sapiens
ugacgagccuguucagaug

SEQ ID NO: 431079 - RNA, 19 nt, Homo sapiens
ggaaggccgaauacaguua

SEQ ID NO: 431080 - RNA, 19 nt, Homo sapiens
guuaauguguacuaucuug

SEQ ID NO: 431081 - RNA, 19 nt, Homo sapiens
gagcagaagaggcagauga

SEQ ID NO: 431082 - RNA, 19 nt, Homo sapiens
cauggaaccugcucagaug

SEQ ID NO: 431083 - RNA, 19 nt, Homo sapiens
ggaggaggagggcuguuua

SEQ ID NO: 431084 - RNA, 19 nt, Homo sapiens
ggaagugaccuaagugaca

SEQ ID NO: 431085 - RNA, 19 nt, Homo sapiens
agacggagguugcccaaau

SEQ ID NO: 431086 - RNA, 19 nt, Homo sapiens
gaacgcccauauaaaugug

SEQ ID NO: 431087 - RNA, 19 nt, Homo sapiens
gcaggaguaaugaaacuuu

SEQ ID NO: 431088 - RNA, 19 nt, Homo sapiens
gagcaaguccuuauugaag

SEQ ID NO: 431089 - RNA, 19 nt, Homo sapiens
agacauaugcguacucauu

SEQ ID NO: 431090 - RNA, 19 nt, Homo sapiens
gcuacaauacuaaucgaua

SEQ ID NO: 431091 - RNA, 19 nt, Homo sapiens
ucagaagacucaucuaacu

SEQ ID NO: 431092 - RNA, 19 nt, Homo sapiens
ugaccuaagugacaacaug

SEQ ID NO: 431093 - RNA, 19 nt, Homo sapiens
gaggaucucucaccaccau

SEQ ID NO: 431094 - RNA, 19 nt, Homo sapiens
gaaacuccagcaacaaaga

SEQ ID NO: 431095 - RNA, 19 nt, Homo sapiens
ugacagccauucuuuacau

SEQ ID NO: 431096 - RNA, 19 nt, Homo sapiens
ucaauugcccuguauguga

SEQ ID NO: 431097 - RNA, 19 nt, Homo sapiens
ggugagaagccauuuaaau

SEQ ID NO: 431098 - RNA, 19 nt, Homo sapiens
ccacagccaugaaggaagu

SEQ ID NO: 431099 - RNA, 19 nt, Homo sapiens
gaaccaguuucaccaaugc

SEQ ID NO: 431100 - RNA, 19 nt, Homo sapiens
gacaguauaguuugugaaa

SEQ ID NO: 431101 - RNA, 19 nt, Homo sapiens
gagaacgcccauauaaaug

SEQ ID NO: 431102 - RNA, 19 nt, Homo sapiens
cgacauguaugacuugcau

SEQ ID NO: 431103 - RNA, 19 nt, Homo sapiens
gaagaaccaguuucaccaa

SEQ ID NO: 431104 - RNA, 19 nt, Homo sapiens
agaaggaaccuguugagaa

SEQ ID NO: 431105 - RNA, 19 nt, Homo sapiens
gaaguugacagccauucuu

SEQ ID NO: 431106 - RNA, 19 nt, Homo sapiens
gaggaaggccgaauacagu

SEQ ID NO: 431107 - RNA, 19 nt, Homo sapiens
gggccuaaaccucuuaauu

SEQ ID NO: 431108 - RNA, 19 nt, Homo sapiens
gcuguaagccaugccaaua

SEQ ID NO: 431109 - RNA, 19 nt, Homo sapiens
ccagauauuuacaguucaa

SEQ ID NO: 431110 - RNA, 19 nt, Homo sapiens
uaccuggucuugcugcuaa

SEQ ID NO: 431111 - RNA, 19 nt, Homo sapiens
ugaggaaucuucaacaaaa

SEQ ID NO: 431112 - RNA, 19 nt, Homo sapiens
aaucuaagcauccuacuug

SEQ ID NO: 431113 - RNA, 19 nt, Homo sapiens
acacaacagugagcgagua

SEQ ID NO: 431114 - RNA, 19 nt, Homo sapiens
ucaggaaauugaugaagau

SEQ ID NO: 431115 - RNA, 19 nt, Homo sapiens
ggagcaaguccuuauugaa

SEQ ID NO: 431116 - RNA, 19 nt, Homo sapiens
cuaauaaugugucagugau

SEQ ID NO: 431117 - RNA, 19 nt, Homo sapiens
caacagugagcgaguauca

SEQ ID NO: 431118 - RNA, 19 nt, Homo sapiens
agucuaacaugcagaguga

SEQ ID NO: 431119 - RNA, 19 nt, Homo sapiens
aagaacaguuugugcauca

SEQ ID NO: 431120 - RNA, 19 nt, Homo sapiens
caggugcuccagauauuua

SEQ ID NO: 431121 - RNA, 19 nt, Homo sapiens
cguagaaccucagccugua

SEQ ID NO: 431122 - RNA, 19 nt, Homo sapiens
ggaacucagcgucguagaa

SEQ ID NO: 431123 - RNA, 19 nt, Homo sapiens
gcuggcaaauguggccuua

SEQ ID NO: 431124 - RNA, 19 nt, Homo sapiens
gggugaaacuuuaaauggu

SEQ ID NO: 431125 - RNA, 19 nt, Homo sapiens
caggugagaagccauuuaa

SEQ ID NO: 431126 - RNA, 19 nt, Homo sapiens
gaguaucacuggaggaaac

SEQ ID NO: 431127 - RNA, 19 nt, Homo sapiens
ccaaacccuuucgcuguaa

SEQ ID NO: 431128 - RNA, 19 nt, Homo sapiens
gcaaagaccuggagaagau

SEQ ID NO: 431129 - RNA, 19 nt, Homo sapiens
gcaaagggaucaccaggaa

SEQ ID NO: 431130 - RNA, 19 nt, Homo sapiens
gcacacggcugcaugagaa

SEQ ID NO: 431131 - RNA, 19 nt, Homo sapiens
gguaagaacuccaggucua

SEQ ID NO: 431132 - RNA, 19 nt, Homo sapiens
gaacuggccuggagagagu

SEQ ID NO: 431133 - RNA, 19 nt, Homo sapiens
gcaacggccuuccaucuga

SEQ ID NO: 431134 - RNA, 19 nt, Homo sapiens
ggacacguuugauaguuaa

SEQ ID NO: 431135 - RNA, 19 nt, Homo sapiens
uuaaauggauggcaauuga

SEQ ID NO: 431136 - RNA, 19 nt, Homo sapiens
caggagggcucgccgauuu

SEQ ID NO: 431137 - RNA, 19 nt, Homo sapiens
agaugaagauuucggauuu

SEQ ID NO: 431138 - RNA, 19 nt, Homo sapiens
acacguaaaugcagaaguu

SEQ ID NO: 431139 - RNA, 19 nt, Homo sapiens
caacacuccuccagucuug

SEQ ID NO: 431140 - RNA, 19 nt, Homo sapiens
uaaucaaggugacuaagaa

SEQ ID NO: 431141 - RNA, 19 nt, Homo sapiens
cuuauuagcucuacuggaa

SEQ ID NO: 431142 - RNA, 19 nt, Homo sapiens
ugaagaugcugaaagagaa

SEQ ID NO: 431143 - RNA, 19 nt, Homo sapiens
acacuggguuuccaagaua

SEQ ID NO: 431144 - RNA, 19 nt, Homo sapiens
uggagaagaugaugguuaa

SEQ ID NO: 431145 - RNA, 19 nt, Homo sapiens
cagauaugcuuaaugauag

SEQ ID NO: 431146 - RNA, 19 nt, Homo sapiens
uaaccuggcucuaauuugg

SEQ ID NO: 431147 - RNA, 19 nt, Homo sapiens
gggaaagucuguguggaaa

SEQ ID NO: 431148 - RNA, 19 nt, Homo sapiens
gauacacugugauaaguuc

SEQ ID NO: 431149 - RNA, 19 nt, Homo sapiens
gcucuaauuugggcuguuu

SEQ ID NO: 431150 - RNA, 19 nt, Homo sapiens
ugccugcucuucagacuua

SEQ ID NO: 431151 - RNA, 19 nt, Homo sapiens
caaacucuauggcauguca

SEQ ID NO: 431152 - RNA, 19 nt, Homo sapiens
uaugcuaacuggaugcuuu

SEQ ID NO: 431153 - RNA, 19 nt, Homo sapiens
ggagaaggcgaauuuggaa

SEQ ID NO: 431154 - RNA, 19 nt, Homo sapiens
cccaagacaucaacauuug

SEQ ID NO: 431155 - RNA, 19 nt, Homo sapiens
agagacggcuggaguguga

SEQ ID NO: 431156 - RNA, 19 nt, Homo sapiens
caucugacucccugauuua

SEQ ID NO: 431157 - RNA, 19 nt, Homo sapiens
gcgagcagcgggagaagua

SEQ ID NO: 431158 - RNA, 19 nt, Homo sapiens
cuauagacaugguaaacuu

SEQ ID NO: 431159 - RNA, 19 nt, Homo sapiens
ggcggaagaugaagauuuc

SEQ ID NO: 431160 - RNA, 19 nt, Homo sapiens
ccacccacaugucaucaaa

SEQ ID NO: 431161 - RNA, 19 nt, Homo sapiens
gcaucaacguccaguacaa

SEQ ID NO: 431162 - RNA, 19 nt, Homo sapiens
ccaucugacucccugauuu

SEQ ID NO: 431163 - RNA, 19 nt, Homo sapiens
uggacacguuugauaguua

SEQ ID NO: 431164 - RNA, 19 nt, Homo sapiens
gcagaaaagagucggauua

SEQ ID NO: 431165 - RNA, 19 nt, Homo sapiens
gagaagaugaugguuaaga

SEQ ID NO: 431166 - RNA, 19 nt, Homo sapiens
ccacugcuaccacaaguuu

SEQ ID NO: 431167 - RNA, 19 nt, Homo sapiens
ccacauggauugaaaacaa

SEQ ID NO: 431168 - RNA, 19 nt, Homo sapiens
ccacaugucaucaaauugu

SEQ ID NO: 431169 - RNA, 19 nt, Homo sapiens
gaauuuauccuugaccaau

SEQ ID NO: 431170 - RNA, 19 nt, Homo sapiens
gggcggaagaugaagauuu

SEQ ID NO: 431171 - RNA, 19 nt, Homo sapiens
uuaauggacacguuugaua

SEQ ID NO: 431172 - RNA, 19 nt, Homo sapiens
uggcggugcuggucaauga

SEQ ID NO: 431173 - RNA, 19 nt, Homo sapiens
guaaucaaggugacuaaga

SEQ ID NO: 431174 - RNA, 19 nt, Homo sapiens
caaaugauaguguauaugc

SEQ ID NO: 431175 - RNA, 19 nt, Homo sapiens
ggagauguaccgccugaug

SEQ ID NO: 431176 - RNA, 19 nt, Homo sapiens
gagaccugcugucagaguu

SEQ ID NO: 431177 - RNA, 19 nt, Homo sapiens
ccgugaagaugcugaaaga

SEQ ID NO: 431178 - RNA, 19 nt, Homo sapiens
caacggccuuccaucugaa

SEQ ID NO: 431179 - RNA, 19 nt, Homo sapiens
gcgaggagguggugauggu

SEQ ID NO: 431180 - RNA, 19 nt, Homo sapiens
uauuagcucuacuggaauu

SEQ ID NO: 431181 - RNA, 19 nt, Homo sapiens
guaagaacuccaggucuaa

SEQ ID NO: 431182 - RNA, 19 nt, Homo sapiens
cagauacacugugauaagu

SEQ ID NO: 431183 - RNA, 19 nt, Homo sapiens
acacguaaccuggcucuaa

SEQ ID NO: 431184 - RNA, 19 nt, Homo sapiens
cugacucccugauuuauga

SEQ ID NO: 431185 - RNA, 19 nt, Homo sapiens
gugaagaugcugaaagaga

SEQ ID NO: 431186 - RNA, 19 nt, Homo sapiens
gucccgagauguuuaugaa

SEQ ID NO: 431187 - RNA, 19 nt, Homo sapiens
ucuaggagaaggcgaauuu

SEQ ID NO: 431188 - RNA, 19 nt, Homo sapiens
gaccguacaugacuauagg

SEQ ID NO: 431189 - RNA, 19 nt, Homo sapiens
gcacugauaggacuuaaaa

SEQ ID NO: 431190 - RNA, 19 nt, Homo sapiens
gaugaagauuucggauuuc

SEQ ID NO: 431191 - RNA, 19 nt, Homo sapiens
cacaugucaucaaauugua

SEQ ID NO: 431192 - RNA, 19 nt, Homo sapiens
cccgagauguuuaugaaga

SEQ ID NO: 431193 - RNA, 19 nt, Homo sapiens
ccacaaguuugcccacaag

SEQ ID NO: 431194 - RNA, 19 nt, Homo sapiens
gugccgaacuucacuacau

SEQ ID NO: 431195 - RNA, 19 nt, Homo sapiens
gcacuguaacuucgcagaa

SEQ ID NO: 431196 - RNA, 19 nt, Homo sapiens
acccacaugucaucaaauu

SEQ ID NO: 431197 - RNA, 19 nt, Homo sapiens
gggcgaccguacaugacua

SEQ ID NO: 431198 - RNA, 19 nt, Homo sapiens
aguaguaaucugucaguua

SEQ ID NO: 431199 - RNA, 19 nt, Homo sapiens
cagggucggauuccaguua

SEQ ID NO: 431200 - RNA, 19 nt, Homo sapiens
gacccaagacaucaacauu

SEQ ID NO: 431201 - RNA, 19 nt, Homo sapiens
gcguauacuucuccuucuu

SEQ ID NO: 431202 - RNA, 19 nt, Homo sapiens
caaaauuaauggacacguu

SEQ ID NO: 431203 - RNA, 19 nt, Homo sapiens
cugguggacuguaauaaug

SEQ ID NO: 431204 - RNA, 19 nt, Homo sapiens
uaagaggagagacuacuug

SEQ ID NO: 431205 - RNA, 19 nt, Homo sapiens
acacugugauaaguucuuu

SEQ ID NO: 431206 - RNA, 19 nt, Homo sapiens
cacguaaccuggcucuaau

SEQ ID NO: 431207 - RNA, 19 nt, Homo sapiens
ggauccuguuugugaauga

SEQ ID NO: 431208 - RNA, 19 nt, Homo sapiens
aaccagaucauguuccuuu

SEQ ID NO: 431209 - RNA, 19 nt, Homo sapiens
cauuaaaccagaucauguu

SEQ ID NO: 431210 - RNA, 19 nt, Homo sapiens
ggaagucucagcagcucuu

SEQ ID NO: 431211 - RNA, 19 nt, Homo sapiens
uccaagauauccaaaugau

SEQ ID NO: 431212 - RNA, 19 nt, Homo sapiens
ggaagcaggagccggacaa

SEQ ID NO: 431213 - RNA, 19 nt, Homo sapiens
ugggcgaccucaucucauu

SEQ ID NO: 431214 - RNA, 19 nt, Homo sapiens
guauacuucuccuucuuca

SEQ ID NO: 431215 - RNA, 19 nt, Homo sapiens
ugcgagaccugcugucaga

SEQ ID NO: 431216 - RNA, 19 nt, Homo sapiens
gucuauuccugaguuauaa

SEQ ID NO: 431217 - RNA, 19 nt, Homo sapiens
ugucuauuccugaguuaua

SEQ ID NO: 431218 - RNA, 19 nt, Homo sapiens
gaaaagagucggauuacca

SEQ ID NO: 431219 - RNA, 19 nt, Homo sapiens
agaagaugaugguuaagag

SEQ ID NO: 431220 - RNA, 19 nt, Homo sapiens
ucagauacacugugauaag

SEQ ID NO: 431221 - RNA, 19 nt, Homo sapiens
uuucagauacacugugaua

SEQ ID NO: 431222 - RNA, 19 nt, Homo sapiens
ccagagggagaguuugaaa

SEQ ID NO: 431223 - RNA, 19 nt, Homo sapiens
cacuguaacuucgcagaaa

SEQ ID NO: 431224 - RNA, 19 nt, Homo sapiens
gagaaggcgaauuuggaaa

SEQ ID NO: 431225 - RNA, 19 nt, Homo sapiens
gcuguccucuucuccuuca

SEQ ID NO: 431226 - RNA, 19 nt, Homo sapiens
ggagauggcaaagggauca

SEQ ID NO: 431227 - RNA, 19 nt, Homo sapiens
acuauaggcugguucucaa

SEQ ID NO: 431228 - RNA, 19 nt, Homo sapiens
gcaaagaccuggagaagau

SEQ ID NO: 431229 - RNA, 19 nt, Homo sapiens
gcaaagggaucaccaggaa

SEQ ID NO: 431230 - RNA, 19 nt, Homo sapiens
gcacacggcugcaugagaa

SEQ ID NO: 431231 - RNA, 19 nt, Homo sapiens
gguaagaacuccaggucua

SEQ ID NO: 431232 - RNA, 19 nt, Homo sapiens
gcaacggccuuccaucuga

SEQ ID NO: 431233 - RNA, 19 nt, Homo sapiens
uuaaauggauggcaauuga

SEQ ID NO: 431234 - RNA, 19 nt, Homo sapiens
caggagggcucgccgauuu

SEQ ID NO: 431235 - RNA, 19 nt, Homo sapiens
agaugaagauuucggauuu

SEQ ID NO: 431236 - RNA, 19 nt, Homo sapiens
acacguaaaugcagaaguu

SEQ ID NO: 431237 - RNA, 19 nt, Homo sapiens
caacacuccuccagucuug

SEQ ID NO: 431238 - RNA, 19 nt, Homo sapiens
uaaucaaggugacuaagaa

SEQ ID NO: 431239 - RNA, 19 nt, Homo sapiens
cuuauuagcucuacuggaa

SEQ ID NO: 431240 - RNA, 19 nt, Homo sapiens
ugaagaugcugaaagagaa

SEQ ID NO: 431241 - RNA, 19 nt, Homo sapiens
uggagaagaugaugguuaa

SEQ ID NO: 431242 - RNA, 19 nt, Homo sapiens
cagauaugcuuaaugauag

SEQ ID NO: 431243 - RNA, 19 nt, Homo sapiens
uaaccuggcucuaauuugg

SEQ ID NO: 431244 - RNA, 19 nt, Homo sapiens
gggaaagucuguguggaaa

SEQ ID NO: 431245 - RNA, 19 nt, Homo sapiens
gauacacugugauaaguuc

SEQ ID NO: 431246 - RNA, 19 nt, Homo sapiens
gcucuaauuugggcuguuu

SEQ ID NO: 431247 - RNA, 19 nt, Homo sapiens
ugccugcucuucagacuua

SEQ ID NO: 431248 - RNA, 19 nt, Homo sapiens
ggagaaggcgaauuuggaa

SEQ ID NO: 431249 - RNA, 19 nt, Homo sapiens
cccaagacaucaacauuug

SEQ ID NO: 431250 - RNA, 19 nt, Homo sapiens
agagacggcuggaguguga

SEQ ID NO: 431251 - RNA, 19 nt, Homo sapiens
caaacucuaugaugcacaa

SEQ ID NO: 431252 - RNA, 19 nt, Homo sapiens
caucugacucccugauuua

SEQ ID NO: 431253 - RNA, 19 nt, Homo sapiens
gcgagcagcgggagaagua

SEQ ID NO: 431254 - RNA, 19 nt, Homo sapiens
cuauagacaugguaaacuu

SEQ ID NO: 431255 - RNA, 19 nt, Homo sapiens
ggcggaagaugaagauuuc

SEQ ID NO: 431256 - RNA, 19 nt, Homo sapiens
ccacccacaugucaucaaa

SEQ ID NO: 431257 - RNA, 19 nt, Homo sapiens
gcaucaacguccaguacaa

SEQ ID NO: 431258 - RNA, 19 nt, Homo sapiens
ccaucugacucccugauuu

SEQ ID NO: 431259 - RNA, 19 nt, Homo sapiens
gcagaaaagagucggauua

SEQ ID NO: 431260 - RNA, 19 nt, Homo sapiens
gagaagaugaugguuaaga

SEQ ID NO: 431261 - RNA, 19 nt, Homo sapiens
ccacugcuaccacaaguuu

SEQ ID NO: 431262 - RNA, 19 nt, Homo sapiens
ccacauggauugaaaacaa

SEQ ID NO: 431263 - RNA, 19 nt, Homo sapiens
ccacaugucaucaaauugu

SEQ ID NO: 431264 - RNA, 19 nt, Homo sapiens
gaauuuauccuugaccaau

SEQ ID NO: 431265 - RNA, 19 nt, Homo sapiens
gggcggaagaugaagauuu

SEQ ID NO: 431266 - RNA, 19 nt, Homo sapiens
gaaaacaaacucuaugaug

SEQ ID NO: 431267 - RNA, 19 nt, Homo sapiens
uggcggugcuggucaauga

SEQ ID NO: 431268 - RNA, 19 nt, Homo sapiens
guaaucaaggugacuaaga

SEQ ID NO: 431269 - RNA, 19 nt, Homo sapiens
ggagauguaccgccugaug

SEQ ID NO: 431270 - RNA, 19 nt, Homo sapiens
gagaccugcugucagaguu

SEQ ID NO: 431271 - RNA, 19 nt, Homo sapiens
ccgugaagaugcugaaaga

SEQ ID NO: 431272 - RNA, 19 nt, Homo sapiens
caacggccuuccaucugaa

SEQ ID NO: 431273 - RNA, 19 nt, Homo sapiens
gcgaggagguggugauggu

SEQ ID NO: 431274 - RNA, 19 nt, Homo sapiens
uauuagcucuacuggaauu

SEQ ID NO: 431275 - RNA, 19 nt, Homo sapiens
guaagaacuccaggucuaa

SEQ ID NO: 431276 - RNA, 19 nt, Homo sapiens
cagauacacugugauaagu

SEQ ID NO: 431277 - RNA, 19 nt, Homo sapiens
acacguaaccuggcucuaa

SEQ ID NO: 431278 - RNA, 19 nt, Homo sapiens
cugacucccugauuuauga

SEQ ID NO: 431279 - RNA, 19 nt, Homo sapiens
gugaagaugcugaaagaga

SEQ ID NO: 431280 - RNA, 19 nt, Homo sapiens
gucccgagauguuuaugaa

SEQ ID NO: 431281 - RNA, 19 nt, Homo sapiens
ucuaggagaaggcgaauuu

SEQ ID NO: 431282 - RNA, 19 nt, Homo sapiens
gaccguacaugacuauagg

SEQ ID NO: 431283 - RNA, 19 nt, Homo sapiens
gcacugauaggacuuaaaa

SEQ ID NO: 431284 - RNA, 19 nt, Homo sapiens
gaugaagauuucggauuuc

SEQ ID NO: 431285 - RNA, 19 nt, Homo sapiens
cacaugucaucaaauugua

SEQ ID NO: 431286 - RNA, 19 nt, Homo sapiens
cccgagauguuuaugaaga

SEQ ID NO: 431287 - RNA, 19 nt, Homo sapiens
ccacaaguuugcccacaag

SEQ ID NO: 431288 - RNA, 19 nt, Homo sapiens
gugccgaacuucacuacau

SEQ ID NO: 431289 - RNA, 19 nt, Homo sapiens
gcacuguaacuucgcagaa

SEQ ID NO: 431290 - RNA, 19 nt, Homo sapiens
acccacaugucaucaaauu

SEQ ID NO: 431291 - RNA, 19 nt, Homo sapiens
gggcgaccguacaugacua

SEQ ID NO: 431292 - RNA, 19 nt, Homo sapiens
aguaguaaucugucaguua

SEQ ID NO: 431293 - RNA, 19 nt, Homo sapiens
cagggucggauuccaguua

SEQ ID NO: 431294 - RNA, 19 nt, Homo sapiens
gacccaagacaucaacauu

SEQ ID NO: 431295 - RNA, 19 nt, Homo sapiens
gcguauacuucuccuucuu

SEQ ID NO: 431296 - RNA, 19 nt, Homo sapiens
cugguggacuguaauaaug

SEQ ID NO: 431297 - RNA, 19 nt, Homo sapiens
uaagaggagagacuacuug

SEQ ID NO: 431298 - RNA, 19 nt, Homo sapiens
acacugugauaaguucuuu

SEQ ID NO: 431299 - RNA, 19 nt, Homo sapiens
cacguaaccuggcucuaau

SEQ ID NO: 431300 - RNA, 19 nt, Homo sapiens
ggauccuguuugugaauga

SEQ ID NO: 431301 - RNA, 19 nt, Homo sapiens
aaccagaucauguuccuuu

SEQ ID NO: 431302 - RNA, 19 nt, Homo sapiens
cauuaaaccagaucauguu

SEQ ID NO: 431303 - RNA, 19 nt, Homo sapiens
ggaagucucagcagcucuu

SEQ ID NO: 431304 - RNA, 19 nt, Homo sapiens
ggaagcaggagccggacaa

SEQ ID NO: 431305 - RNA, 19 nt, Homo sapiens
ugggcgaccucaucucauu

SEQ ID NO: 431306 - RNA, 19 nt, Homo sapiens
ugcgagaccugcugucaga

SEQ ID NO: 431307 - RNA, 19 nt, Homo sapiens
guauacuucuccuucuuca

SEQ ID NO: 431308 - RNA, 19 nt, Homo sapiens
gucuauuccugaguuauaa

SEQ ID NO: 431309 - RNA, 19 nt, Homo sapiens
ugucuauuccugaguuaua

SEQ ID NO: 431310 - RNA, 19 nt, Homo sapiens
gaaaagagucggauuacca

SEQ ID NO: 431311 - RNA, 19 nt, Homo sapiens
agaagaugaugguuaagag

SEQ ID NO: 431312 - RNA, 19 nt, Homo sapiens
ucagauacacugugauaag

SEQ ID NO: 431313 - RNA, 19 nt, Homo sapiens
uuucagauacacugugaua

SEQ ID NO: 431314 - RNA, 19 nt, Homo sapiens
ccagagggagaguuugaaa

SEQ ID NO: 431315 - RNA, 19 nt, Homo sapiens
cacuguaacuucgcagaaa

SEQ ID NO: 431316 - RNA, 19 nt, Homo sapiens
aaacaaacucuaugaugca

SEQ ID NO: 431317 - RNA, 19 nt, Homo sapiens
gagaaggcgaauuuggaaa

SEQ ID NO: 431318 - RNA, 19 nt, Homo sapiens
gcuguccucuucuccuuca

SEQ ID NO: 431319 - RNA, 19 nt, Homo sapiens
ggagauggcaaagggauca

SEQ ID NO: 431320 - RNA, 19 nt, Homo sapiens
acuauaggcugguucucaa

SEQ ID NO: 431321 - RNA, 19 nt, Homo sapiens
gaaccaggucuccguggau

SEQ ID NO: 431322 - RNA, 19 nt, Homo sapiens
caauuuauccuugaccaau

SEQ ID NO: 431323 - RNA, 19 nt, Homo sapiens
ggaugcguguguaauagag

SEQ ID NO: 431324 - RNA, 19 nt, Homo sapiens
gcugguggacuguaauaau

SEQ ID NO: 431325 - RNA, 19 nt, Homo sapiens
ggauggagaggccagacaa

SEQ ID NO: 431326 - RNA, 19 nt, Homo sapiens
gcauugggccucuacuucu

SEQ ID NO: 431327 - RNA, 19 nt, Homo sapiens
gaggcaaggagauggcaaa

SEQ ID NO: 431328 - RNA, 19 nt, Homo sapiens
gcaaagaccuggagaagau

SEQ ID NO: 431329 - RNA, 19 nt, Homo sapiens
gguagugucuguuaaguua

SEQ ID NO: 431330 - RNA, 19 nt, Homo sapiens
gaagaaacaugcugagaau

SEQ ID NO: 431331 - RNA, 19 nt, Homo sapiens
gaccugaacuguuggauuu

SEQ ID NO: 431332 - RNA, 19 nt, Homo sapiens
gcaaagggaucaccaggaa

SEQ ID NO: 431333 - RNA, 19 nt, Homo sapiens
gcacacggcugcaugagaa

SEQ ID NO: 431334 - RNA, 19 nt, Homo sapiens
gguaagaacuccaggucua

SEQ ID NO: 431335 - RNA, 19 nt, Homo sapiens
caagagagcacaugauauu

SEQ ID NO: 431336 - RNA, 19 nt, Homo sapiens
gaacuggccuggagagagu

SEQ ID NO: 431337 - RNA, 19 nt, Homo sapiens
ucaggacgguugucacuua

SEQ ID NO: 431338 - RNA, 19 nt, Homo sapiens
gcaacggccuuccaucuga

SEQ ID NO: 431339 - RNA, 19 nt, Homo sapiens
gaucagcucuuccuguguu

SEQ ID NO: 431340 - RNA, 19 nt, Homo sapiens
ggacacguuugauaguuaa

SEQ ID NO: 431341 - RNA, 19 nt, Homo sapiens
ggacgguugucacuuauga

SEQ ID NO: 431342 - RNA, 19 nt, Homo sapiens
uuaaauggauggcaauuga

SEQ ID NO: 431343 - RNA, 19 nt, Homo sapiens
uuaagcaguucgacaaaua

SEQ ID NO: 431344 - RNA, 19 nt, Homo sapiens
guaaaugucugacuuugca

SEQ ID NO: 431345 - RNA, 19 nt, Homo sapiens
caggagggcucgccgauuu

SEQ ID NO: 431346 - RNA, 19 nt, Homo sapiens
ggaagaaacaugcugagaa

SEQ ID NO: 431347 - RNA, 19 nt, Homo sapiens
gaacguuuccgcugcagua

SEQ ID NO: 431348 - RNA, 19 nt, Homo sapiens
agaugaagauuucggauuu

SEQ ID NO: 431349 - RNA, 19 nt, Homo sapiens
acacguaaaugcagaaguu

SEQ ID NO: 431350 - RNA, 19 nt, Homo sapiens
caacacuccuccagucuug

SEQ ID NO: 431351 - RNA, 19 nt, Homo sapiens
ccaagaacagguugaauaa

SEQ ID NO: 431352 - RNA, 19 nt, Homo sapiens
uaaucaaggugacuaagaa

SEQ ID NO: 431353 - RNA, 19 nt, Homo sapiens
cuuauuagcucuacuggaa

SEQ ID NO: 431354 - RNA, 19 nt, Homo sapiens
ugaagaugcugaaagagaa

SEQ ID NO: 431355 - RNA, 19 nt, Homo sapiens
gaaguagcaaugacaauga

SEQ ID NO: 431356 - RNA, 19 nt, Homo sapiens
acacuggguuuccaagaua

SEQ ID NO: 431357 - RNA, 19 nt, Homo sapiens
cgacaaauauacaucagau

SEQ ID NO: 431358 - RNA, 19 nt, Homo sapiens
uggagaagaugaugguuaa

SEQ ID NO: 431359 - RNA, 19 nt, Homo sapiens
gaaagguaauggacucaca

SEQ ID NO: 431360 - RNA, 19 nt, Homo sapiens
gcuacaagauguuucuguu

SEQ ID NO: 431361 - RNA, 19 nt, Homo sapiens
gaugagaacaguaugaaga

SEQ ID NO: 431362 - RNA, 19 nt, Homo sapiens
cagauaugcuuaaugauag

SEQ ID NO: 431363 - RNA, 19 nt, Homo sapiens
uaaccuggcucuaauuugg

SEQ ID NO: 431364 - RNA, 19 nt, Homo sapiens
gaaacaugcugagaaugga

SEQ ID NO: 431365 - RNA, 19 nt, Homo sapiens
gggaaagucuguguggaaa

SEQ ID NO: 431366 - RNA, 19 nt, Homo sapiens
gcccuacacugccuuagaa

SEQ ID NO: 431367 - RNA, 19 nt, Homo sapiens
gaaaacaaacucuauggua

SEQ ID NO: 431368 - RNA, 19 nt, Homo sapiens
gauacacugugauaaguuc

SEQ ID NO: 431369 - RNA, 19 nt, Homo sapiens
gcucuaauuugggcuguuu

SEQ ID NO: 431370 - RNA, 19 nt, Homo sapiens
ugccugcucuucagacuua

SEQ ID NO: 431371 - RNA, 19 nt, Homo sapiens
cuacaccucugauuacaau

SEQ ID NO: 431372 - RNA, 19 nt, Homo sapiens
cugaugaccuguccuuauu

SEQ ID NO: 431373 - RNA, 19 nt, Homo sapiens
gaaauuggaccugaacugu

SEQ ID NO: 431374 - RNA, 19 nt, Homo sapiens
cuuacuaccugguguauga

SEQ ID NO: 431375 - RNA, 19 nt, Homo sapiens
uaugcuaacuggaugcuuu

SEQ ID NO: 431376 - RNA, 19 nt, Homo sapiens
gaucagggcggaacucuca

SEQ ID NO: 431377 - RNA, 19 nt, Homo sapiens
ggagaaggcgaauuuggaa

SEQ ID NO: 431378 - RNA, 19 nt, Homo sapiens
cccaagacaucaacauuug

SEQ ID NO: 431379 - RNA, 19 nt, Homo sapiens
agagacggcuggaguguga

SEQ ID NO: 431380 - RNA, 19 nt, Homo sapiens
gaccuguccuuauucagaa

SEQ ID NO: 431381 - RNA, 19 nt, Homo sapiens
caucugacucccugauuua

SEQ ID NO: 431382 - RNA, 19 nt, Homo sapiens
gcgagcagcgggagaagua

SEQ ID NO: 431383 - RNA, 19 nt, Homo sapiens
cuauagacaugguaaacuu

SEQ ID NO: 431384 - RNA, 19 nt, Homo sapiens
cuagcuagcuguguuagaa

SEQ ID NO: 431385 - RNA, 19 nt, Homo sapiens
ggcggaagaugaagauuuc

SEQ ID NO: 431386 - RNA, 19 nt, Homo sapiens
ccacccacaugucaucaaa

SEQ ID NO: 431387 - RNA, 19 nt, Homo sapiens
gcaucaacguccaguacaa

SEQ ID NO: 431388 - RNA, 19 nt, Homo sapiens
gaugaccuguccuuauuca

SEQ ID NO: 431389 - RNA, 19 nt, Homo sapiens
gggugggaaucaagucaua

SEQ ID NO: 431390 - RNA, 19 nt, Homo sapiens
ugacuuugcauccaguuua

SEQ ID NO: 431391 - RNA, 19 nt, Homo sapiens
ccaucugacucccugauuu

SEQ ID NO: 431392 - RNA, 19 nt, Homo sapiens
uucgagaucuugagaauga

SEQ ID NO: 431393 - RNA, 19 nt, Homo sapiens
uggacacguuugauaguua

SEQ ID NO: 431394 - RNA, 19 nt, Homo sapiens
aaauaugguucuugccaaa

SEQ ID NO: 431395 - RNA, 19 nt, Homo sapiens
ggaaucaagucauaguacu

SEQ ID NO: 431396 - RNA, 19 nt, Homo sapiens
gcagaaaagagucggauua

SEQ ID NO: 431397 - RNA, 19 nt, Homo sapiens
caaugacaaugaccaagga

SEQ ID NO: 431398 - RNA, 19 nt, Homo sapiens
gggcuuguacucacuuuaa

SEQ ID NO: 431399 - RNA, 19 nt, Homo sapiens
gcuguggucuuacaaugga

SEQ ID NO: 431400 - RNA, 19 nt, Homo sapiens
gagaagaugaugguuaaga

SEQ ID NO: 431401 - RNA, 19 nt, Homo sapiens
ccacugcuaccacaaguuu

SEQ ID NO: 431402 - RNA, 19 nt, Homo sapiens
uacaagauguuucuguuuc

SEQ ID NO: 431403 - RNA, 19 nt, Homo sapiens
uagaauuucccaugcauuu

SEQ ID NO: 431404 - RNA, 19 nt, Homo sapiens
ccacauggauugaaaacaa

SEQ ID NO: 431405 - RNA, 19 nt, Homo sapiens
ccacaugucaucaaauugu

SEQ ID NO: 431406 - RNA, 19 nt, Homo sapiens
gaauuuauccuugaccaau

SEQ ID NO: 431407 - RNA, 19 nt, Homo sapiens
caugccaucuuuacuaugu

SEQ ID NO: 431408 - RNA, 19 nt, Homo sapiens
gaguuugguuugaacauca

SEQ ID NO: 431409 - RNA, 19 nt, Homo sapiens
aaaccaaagucugcucuga

SEQ ID NO: 431410 - RNA, 19 nt, Homo sapiens
gggcggaagaugaagauuu

SEQ ID NO: 431411 - RNA, 19 nt, Homo sapiens
gugaaaggcccauggauca

SEQ ID NO: 431412 - RNA, 19 nt, Homo sapiens
uggcucauccuaccuguua

SEQ ID NO: 431413 - RNA, 19 nt, Homo sapiens
uuaauggacacguuugaua

SEQ ID NO: 431414 - RNA, 19 nt, Homo sapiens
uuuccuaacuucaucauug

SEQ ID NO: 431415 - RNA, 19 nt, Homo sapiens
caguuuacauuuaggcauu

SEQ ID NO: 431416 - RNA, 19 nt, Homo sapiens
uggcggugcuggucaauga

SEQ ID NO: 431417 - RNA, 19 nt, Homo sapiens
guaaucaaggugacuaaga

SEQ ID NO: 431418 - RNA, 19 nt, Homo sapiens
aauuggaccugaacuguug

SEQ ID NO: 431419 - RNA, 19 nt, Homo sapiens
caaaugauaguguauaugc

SEQ ID NO: 431420 - RNA, 19 nt, Homo sapiens
gcgaggagguggugauggu

SEQ ID NO: 431421 - RNA, 19 nt, Homo sapiens
gguauucaguugagaaagg

SEQ ID NO: 431422 - RNA, 19 nt, Homo sapiens
aagaacagguugaauaagg

SEQ ID NO: 431423 - RNA, 19 nt, Homo sapiens
ggagauguaccgccugaug

SEQ ID NO: 431424 - RNA, 19 nt, Homo sapiens
gagaccugcugucagaguu

SEQ ID NO: 431425 - RNA, 19 nt, Homo sapiens
ccgugaagaugcugaaaga

SEQ ID NO: 431426 - RNA, 19 nt, Homo sapiens
caacggccuuccaucugaa

SEQ ID NO: 431427 - RNA, 19 nt, Homo sapiens
uauuagcucuacuggaauu

SEQ ID NO: 431428 - RNA, 19 nt, Homo sapiens
gcaaagaccuggagaagau

SEQ ID NO: 431429 - RNA, 19 nt, Homo sapiens
gaagaaacaugcugagaau

SEQ ID NO: 431430 - RNA, 19 nt, Homo sapiens
gaccugaacuguuggauuu

SEQ ID NO: 431431 - RNA, 19 nt, Homo sapiens
gcaaagggaucaccaggaa

SEQ ID NO: 431432 - RNA, 19 nt, Homo sapiens
gcacacggcugcaugagaa

SEQ ID NO: 431433 - RNA, 19 nt, Homo sapiens
gguaagaacuccaggucua

SEQ ID NO: 431434 - RNA, 19 nt, Homo sapiens
gaacuggccuggagagagu

SEQ ID NO: 431435 - RNA, 19 nt, Homo sapiens
gcaacggccuuccaucuga

SEQ ID NO: 431436 - RNA, 19 nt, Homo sapiens
gaucagcucuuccuguguu

SEQ ID NO: 431437 - RNA, 19 nt, Homo sapiens
ggacacguuugauaguuaa

SEQ ID NO: 431438 - RNA, 19 nt, Homo sapiens
uuaaauggauggcaauuga

SEQ ID NO: 431439 - RNA, 19 nt, Homo sapiens
caggagggcucgccgauuu

SEQ ID NO: 431440 - RNA, 19 nt, Homo sapiens
ggaagaaacaugcugagaa

SEQ ID NO: 431441 - RNA, 19 nt, Homo sapiens
agaugaagauuucggauuu

SEQ ID NO: 431442 - RNA, 19 nt, Homo sapiens
acacguaaaugcagaaguu

SEQ ID NO: 431443 - RNA, 19 nt, Homo sapiens
caacacuccuccagucuug

SEQ ID NO: 431444 - RNA, 19 nt, Homo sapiens
uaaucaaggugacuaagaa

SEQ ID NO: 431445 - RNA, 19 nt, Homo sapiens
cuuauuagcucuacuggaa

SEQ ID NO: 431446 - RNA, 19 nt, Homo sapiens
ugaagaugcugaaagagaa

SEQ ID NO: 431447 - RNA, 19 nt, Homo sapiens
gaaguagcaaugacaauga

SEQ ID NO: 431448 - RNA, 19 nt, Homo sapiens
acacuggguuuccaagaua

SEQ ID NO: 431449 - RNA, 19 nt, Homo sapiens
uggagaagaugaugguuaa

SEQ ID NO: 431450 - RNA, 19 nt, Homo sapiens
gaaagguaauggacucaca

SEQ ID NO: 431451 - RNA, 19 nt, Homo sapiens
gcuacaagauguuucuguu

SEQ ID NO: 431452 - RNA, 19 nt, Homo sapiens
gaugagaacaguaugaaga

SEQ ID NO: 431453 - RNA, 19 nt, Homo sapiens
cagauaugcuuaaugauag

SEQ ID NO: 431454 - RNA, 19 nt, Homo sapiens
uaaccuggcucuaauuugg

SEQ ID NO: 431455 - RNA, 19 nt, Homo sapiens
gaaacaugcugagaaugga

SEQ ID NO: 431456 - RNA, 19 nt, Homo sapiens
gggaaagucuguguggaaa

SEQ ID NO: 431457 - RNA, 19 nt, Homo sapiens
gauacacugugauaaguuc

SEQ ID NO: 431458 - RNA, 19 nt, Homo sapiens
gcucuaauuugggcuguuu

SEQ ID NO: 431459 - RNA, 19 nt, Homo sapiens
ugccugcucuucagacuua

SEQ ID NO: 431460 - RNA, 19 nt, Homo sapiens
cuacaccucugauuacaau

SEQ ID NO: 431461 - RNA, 19 nt, Homo sapiens
cugaugaccuguccuuauu

SEQ ID NO: 431462 - RNA, 19 nt, Homo sapiens
caaacucuauggcauguca

SEQ ID NO: 431463 - RNA, 19 nt, Homo sapiens
gaaauuggaccugaacugu

SEQ ID NO: 431464 - RNA, 19 nt, Homo sapiens
cuuacuaccugguguauga

SEQ ID NO: 431465 - RNA, 19 nt, Homo sapiens
uaugcuaacuggaugcuuu

SEQ ID NO: 431466 - RNA, 19 nt, Homo sapiens
ggagaaggcgaauuuggaa

SEQ ID NO: 431467 - RNA, 19 nt, Homo sapiens
cccaagacaucaacauuug

SEQ ID NO: 431468 - RNA, 19 nt, Homo sapiens
agagacggcuggaguguga

SEQ ID NO: 431469 - RNA, 19 nt, Homo sapiens
gaccuguccuuauucagaa

SEQ ID NO: 431470 - RNA, 19 nt, Homo sapiens
caucugacucccugauuua

SEQ ID NO: 431471 - RNA, 19 nt, Homo sapiens
gcgagcagcgggagaagua

SEQ ID NO: 431472 - RNA, 19 nt, Homo sapiens
cuauagacaugguaaacuu

SEQ ID NO: 431473 - RNA, 19 nt, Homo sapiens
cuagcuagcuguguuagaa

SEQ ID NO: 431474 - RNA, 19 nt, Homo sapiens
ggcggaagaugaagauuuc

SEQ ID NO: 431475 - RNA, 19 nt, Homo sapiens
ccacccacaugucaucaaa

SEQ ID NO: 431476 - RNA, 19 nt, Homo sapiens
gcaucaacguccaguacaa

SEQ ID NO: 431477 - RNA, 19 nt, Homo sapiens
gaugaccuguccuuauuca

SEQ ID NO: 431478 - RNA, 19 nt, Homo sapiens
ccaucugacucccugauuu

SEQ ID NO: 431479 - RNA, 19 nt, Homo sapiens
uucgagaucuugagaauga

SEQ ID NO: 431480 - RNA, 19 nt, Homo sapiens
uggacacguuugauaguua

SEQ ID NO: 431481 - RNA, 19 nt, Homo sapiens
gcagaaaagagucggauua

SEQ ID NO: 431482 - RNA, 19 nt, Homo sapiens
caaugacaaugaccaagga

SEQ ID NO: 431483 - RNA, 19 nt, Homo sapiens
gggcuuguacucacuuuaa

SEQ ID NO: 431484 - RNA, 19 nt, Homo sapiens
gagaagaugaugguuaaga

SEQ ID NO: 431485 - RNA, 19 nt, Homo sapiens
ccacugcuaccacaaguuu

SEQ ID NO: 431486 - RNA, 19 nt, Homo sapiens
uacaagauguuucuguuuc

SEQ ID NO: 431487 - RNA, 19 nt, Homo sapiens
ccacauggauugaaaacaa

SEQ ID NO: 431488 - RNA, 19 nt, Homo sapiens
ccacaugucaucaaauugu

SEQ ID NO: 431489 - RNA, 19 nt, Homo sapiens
gaauuuauccuugaccaau

SEQ ID NO: 431490 - RNA, 19 nt, Homo sapiens
caugccaucuuuacuaugu

SEQ ID NO: 431491 - RNA, 19 nt, Homo sapiens
gggcggaagaugaagauuu

SEQ ID NO: 431492 - RNA, 19 nt, Homo sapiens
gugaaaggcccauggauca

SEQ ID NO: 431493 - RNA, 19 nt, Homo sapiens
uggcucauccuaccuguua

SEQ ID NO: 431494 - RNA, 19 nt, Homo sapiens
uuaauggacacguuugaua

SEQ ID NO: 431495 - RNA, 19 nt, Homo sapiens
uggcggugcuggucaauga

SEQ ID NO: 431496 - RNA, 19 nt, Homo sapiens
guaaucaaggugacuaaga

SEQ ID NO: 431497 - RNA, 19 nt, Homo sapiens
aauuggaccugaacuguug

SEQ ID NO: 431498 - RNA, 19 nt, Homo sapiens
caaaugauaguguauaugc

SEQ ID NO: 431499 - RNA, 19 nt, Homo sapiens
ggagauguaccgccugaug

SEQ ID NO: 431500 - RNA, 19 nt, Homo sapiens
gagaccugcugucagaguu

SEQ ID NO: 431501 - RNA, 19 nt, Homo sapiens
ccgugaagaugcugaaaga

SEQ ID NO: 431502 - RNA, 19 nt, Homo sapiens
caacggccuuccaucugaa

SEQ ID NO: 431503 - RNA, 19 nt, Homo sapiens
gcgaggagguggugauggu

SEQ ID NO: 431504 - RNA, 19 nt, Homo sapiens
uauuagcucuacuggaauu

SEQ ID NO: 431505 - RNA, 19 nt, Homo sapiens
guaagaacuccaggucuaa

SEQ ID NO: 431506 - RNA, 19 nt, Homo sapiens
cagauacacugugauaagu

SEQ ID NO: 431507 - RNA, 19 nt, Homo sapiens
acacguaaccuggcucuaa

SEQ ID NO: 431508 - RNA, 19 nt, Homo sapiens
ucauaagcuucuugucauu

SEQ ID NO: 431509 - RNA, 19 nt, Homo sapiens
gauuacaauucugauguga

SEQ ID NO: 431510 - RNA, 19 nt, Homo sapiens
cugacucccugauuuauga

SEQ ID NO: 431511 - RNA, 19 nt, Homo sapiens
gugaagaugcugaaagaga

SEQ ID NO: 431512 - RNA, 19 nt, Homo sapiens
uaaagggacaggcuagcua

SEQ ID NO: 431513 - RNA, 19 nt, Homo sapiens
gcucagcauucgagaucuu

SEQ ID NO: 431514 - RNA, 19 nt, Homo sapiens
gcucugagucuuagugguu

SEQ ID NO: 431515 - RNA, 19 nt, Homo sapiens
gucccgagauguuuaugaa

SEQ ID NO: 431516 - RNA, 19 nt, Homo sapiens
ucuaggagaaggcgaauuu

SEQ ID NO: 431517 - RNA, 19 nt, Homo sapiens
gaccguacaugacuauagg

SEQ ID NO: 431518 - RNA, 19 nt, Homo sapiens
gcacugauaggacuuaaaa

SEQ ID NO: 431519 - RNA, 19 nt, Homo sapiens
ggucacagaugcacaacac

SEQ ID NO: 431520 - RNA, 19 nt, Homo sapiens
gaugguguuuggcucuuau

SEQ ID NO: 431521 - RNA, 19 nt, Homo sapiens
guaugaaauuggaccugaa

SEQ ID NO: 431522 - RNA, 19 nt, Homo sapiens
gaugaagauuucggauuuc

SEQ ID NO: 431523 - RNA, 19 nt, Homo sapiens
cacaugucaucaaauugua

SEQ ID NO: 431524 - RNA, 19 nt, Homo sapiens
guaauuuaaugcugcuaca

SEQ ID NO: 431525 - RNA, 19 nt, Homo sapiens
ggaccugaacuguuggauu

SEQ ID NO: 431526 - RNA, 19 nt, Homo sapiens
cccgagauguuuaugaaga

SEQ ID NO: 431527 - RNA, 19 nt, Homo sapiens
ccacaaguuugcccacaag

SEQ ID NO: 431528 - RNA, 19 nt, Homo sapiens
gaaauacccuggaucuuua

SEQ ID NO: 431529 - RNA, 19 nt, Homo sapiens
gagaguaccuccagauuua

SEQ ID NO: 431530 - RNA, 19 nt, Homo sapiens
gaaguuaucuggcugcuuu

SEQ ID NO: 431531 - RNA, 19 nt, Homo sapiens
gcuaaucccucuauaguua

SEQ ID NO: 431532 - RNA, 19 nt, Homo sapiens
ggaaauuggugaaaguuua

SEQ ID NO: 431533 - RNA, 19 nt, Homo sapiens
caaagaugcugcuacauua

SEQ ID NO: 431534 - RNA, 19 nt, Homo sapiens
gaaauggaauggagugaua

SEQ ID NO: 431535 - RNA, 19 nt, Homo sapiens
gauuagaucugguacuuua

SEQ ID NO: 431536 - RNA, 19 nt, Homo sapiens
ggaguucucugcugaguua

SEQ ID NO: 431537 - RNA, 19 nt, Homo sapiens
cugaauagcucacuucuua

SEQ ID NO: 431538 - RNA, 19 nt, Homo sapiens
acacagaaguugaguaaua

SEQ ID NO: 431539 - RNA, 19 nt, Homo sapiens
gcacagcucugaguaguuu

SEQ ID NO: 431540 - RNA, 19 nt, Homo sapiens
caaaugaucuggcugaguu

SEQ ID NO: 431541 - RNA, 19 nt, Homo sapiens
caagaagucuguagauuug

SEQ ID NO: 431542 - RNA, 19 nt, Homo sapiens
cuagugauaucuccaauua

SEQ ID NO: 431543 - RNA, 19 nt, Homo sapiens
gaaauucucuugcugauac

SEQ ID NO: 431544 - RNA, 19 nt, Homo sapiens
gaacagauuugcagcugaa

SEQ ID NO: 431545 - RNA, 19 nt, Homo sapiens
gaaacuaucuccugucaca

SEQ ID NO: 431546 - RNA, 19 nt, Homo sapiens
ucacuuugcuuucauagua

SEQ ID NO: 431547 - RNA, 19 nt, Homo sapiens
gaaagcacuuauucuauga

SEQ ID NO: 431548 - RNA, 19 nt, Homo sapiens
cagcugguaucaugaauua

SEQ ID NO: 431549 - RNA, 19 nt, Homo sapiens
ggacagcaauauugaagaa

SEQ ID NO: 431550 - RNA, 19 nt, Homo sapiens
cagcaaagaucccagauga

SEQ ID NO: 431551 - RNA, 19 nt, Homo sapiens
caagacagaucuauacaga

SEQ ID NO: 431552 - RNA, 19 nt, Homo sapiens
gcacaagucccauaaauuc

SEQ ID NO: 431553 - RNA, 19 nt, Homo sapiens
ggauguaaguccauguaua

SEQ ID NO: 431554 - RNA, 19 nt, Homo sapiens
ccaaggaguugucaauaaa

SEQ ID NO: 431555 - RNA, 19 nt, Homo sapiens
ccucaaagauagaagauaa

SEQ ID NO: 431556 - RNA, 19 nt, Homo sapiens
caacaaaggacaaauaaug

SEQ ID NO: 431557 - RNA, 19 nt, Homo sapiens
ggagcaacuuguaaagaua

SEQ ID NO: 431558 - RNA, 19 nt, Homo sapiens
ggaaaaugcugacuuauga

SEQ ID NO: 431559 - RNA, 19 nt, Homo sapiens
caagacccauuauccaaua

SEQ ID NO: 431560 - RNA, 19 nt, Homo sapiens
gaagaguacuguuaacaca

SEQ ID NO: 431561 - RNA, 19 nt, Homo sapiens
gaugaaaguggacuaaaua

SEQ ID NO: 431562 - RNA, 19 nt, Homo sapiens
cagacuccauuacuuauua

SEQ ID NO: 431563 - RNA, 19 nt, Homo sapiens
uagaggagcugccuucauu

SEQ ID NO: 431564 - RNA, 19 nt, Homo sapiens
guaagaagacuguuaauuc

SEQ ID NO: 431565 - RNA, 19 nt, Homo sapiens
gaaaugagguggcucuaac

SEQ ID NO: 431566 - RNA, 19 nt, Homo sapiens
gccaaggaguugucaauaa

SEQ ID NO: 431567 - RNA, 19 nt, Homo sapiens
gaucagaauuugccucaga

SEQ ID NO: 431568 - RNA, 19 nt, Homo sapiens
cgaaagcacuuauucuaug

SEQ ID NO: 431569 - RNA, 19 nt, Homo sapiens
gaaauaccaagcucuuuaa

SEQ ID NO: 431570 - RNA, 19 nt, Homo sapiens
ggaaauugccgaagcugua

SEQ ID NO: 431571 - RNA, 19 nt, Homo sapiens
aaacucgacuugcaaauga

SEQ ID NO: 431572 - RNA, 19 nt, Homo sapiens
gaaaugugaugaagacaag

SEQ ID NO: 431573 - RNA, 19 nt, Homo sapiens
gauaacaguuugcuucuag

SEQ ID NO: 431574 - RNA, 19 nt, Homo sapiens
cuauuaaacuggugaauga

SEQ ID NO: 431575 - RNA, 19 nt, Homo sapiens
gauaugagauucagaugca

SEQ ID NO: 431576 - RNA, 19 nt, Homo sapiens
gauuaugccuugcaaaugu

SEQ ID NO: 431577 - RNA, 19 nt, Homo sapiens
uaaaucgucuggacauuga

SEQ ID NO: 431578 - RNA, 19 nt, Homo sapiens
ggaacaagaugaaauacca

SEQ ID NO: 431579 - RNA, 19 nt, Homo sapiens
gacuuaagcugauagcaaa

SEQ ID NO: 431580 - RNA, 19 nt, Homo sapiens
gagcauaacaaagcaaaua

SEQ ID NO: 431581 - RNA, 19 nt, Homo sapiens
gaaagccaaaugccuaaua

SEQ ID NO: 431582 - RNA, 19 nt, Homo sapiens
gaaucaauuugcagcagua

SEQ ID NO: 431583 - RNA, 19 nt, Homo sapiens
cuaaaggaaucaacguuaa

SEQ ID NO: 431584 - RNA, 19 nt, Homo sapiens
gauguuaugucuaaacuag

SEQ ID NO: 431585 - RNA, 19 nt, Homo sapiens
guaaagauaugcaagaacu

SEQ ID NO: 431586 - RNA, 19 nt, Homo sapiens
ugccauacgucaucauuua

SEQ ID NO: 431587 - RNA, 19 nt, Homo sapiens
gcaaagaucccagaugaga

SEQ ID NO: 431588 - RNA, 19 nt, Homo sapiens
gaaucacuuugcuuucaua

SEQ ID NO: 431589 - RNA, 19 nt, Homo sapiens
aaauacagcuucagaggaa

SEQ ID NO: 431590 - RNA, 19 nt, Homo sapiens
gcaacuggauccugcaaga

SEQ ID NO: 431591 - RNA, 19 nt, Homo sapiens
cgagauauccauucacuuu

SEQ ID NO: 431592 - RNA, 19 nt, Homo sapiens
uaaugcagguguuggauuu

SEQ ID NO: 431593 - RNA, 19 nt, Homo sapiens
gaaauuauggcaacuuugu

SEQ ID NO: 431594 - RNA, 19 nt, Homo sapiens
gucaacaccuucagcauuu

SEQ ID NO: 431595 - RNA, 19 nt, Homo sapiens
ucaaaggccucauaaucaa

SEQ ID NO: 431596 - RNA, 19 nt, Homo sapiens
gaaaguggacuaaauaaac

SEQ ID NO: 431597 - RNA, 19 nt, Homo sapiens
gaacuauggugcauucucu

SEQ ID NO: 431598 - RNA, 19 nt, Homo sapiens
aagauuaccuuucagugua

SEQ ID NO: 431599 - RNA, 19 nt, Homo sapiens
gauguucacugucuguuau

SEQ ID NO: 431600 - RNA, 19 nt, Homo sapiens
caaggaaaaugcugacuua

SEQ ID NO: 431601 - RNA, 19 nt, Homo sapiens
ggaccaucuuuaaacaaua

SEQ ID NO: 431602 - RNA, 19 nt, Homo sapiens
caaggaggauguugauaau

SEQ ID NO: 431603 - RNA, 19 nt, Homo sapiens
ugaagaacauugugccaaa

SEQ ID NO: 431604 - RNA, 19 nt, Homo sapiens
ugaaauaccaagcucuuua

SEQ ID NO: 431605 - RNA, 19 nt, Homo sapiens
gcggagccauaaugaauaa

SEQ ID NO: 431606 - RNA, 19 nt, Homo sapiens
ccacuuauccagcuuguaa

SEQ ID NO: 431607 - RNA, 19 nt, Homo sapiens
cuaagaugguugaagauaa

SEQ ID NO: 431608 - RNA, 19 nt, Homo sapiens
gcaguaauccuucugaugu

SEQ ID NO: 431609 - RNA, 19 nt, Homo sapiens
cgaagaaacagaaaugaaa

SEQ ID NO: 431610 - RNA, 19 nt, Homo sapiens
gaggaagauuucucucaaa

SEQ ID NO: 431611 - RNA, 19 nt, Homo sapiens
gaaacagucagaagagauu

SEQ ID NO: 431612 - RNA, 19 nt, Homo sapiens
ccagugaaauugaaguuug

SEQ ID NO: 431613 - RNA, 19 nt, Homo sapiens
gggaaaguaugaugaguuc

SEQ ID NO: 431614 - RNA, 19 nt, Homo sapiens
gauaaagacaagacaguuu

SEQ ID NO: 431615 - RNA, 19 nt, Homo sapiens
ccaaggaggauguugauaa

SEQ ID NO: 431616 - RNA, 19 nt, Homo sapiens
ugaaauacccuggaucuuu

SEQ ID NO: 431617 - RNA, 19 nt, Homo sapiens
ucacaaagaugcugcuaca

SEQ ID NO: 431618 - RNA, 19 nt, Homo sapiens
ggaauggagugauaacagu

SEQ ID NO: 431619 - RNA, 19 nt, Homo sapiens
ugacucaucuucaggagaa

SEQ ID NO: 431620 - RNA, 19 nt, Homo sapiens
ggaaauggagcuuaguuug

SEQ ID NO: 431621 - RNA, 19 nt, Homo sapiens
ccacuaaacuguugugcau

SEQ ID NO: 431622 - RNA, 19 nt, Homo sapiens
cagcauggcaucuguagua

SEQ ID NO: 431623 - RNA, 19 nt, Homo sapiens
gaaaguaugaugaguucaa

SEQ ID NO: 431624 - RNA, 19 nt, Homo sapiens
aaacacagaaguugaguaa

SEQ ID NO: 431625 - RNA, 19 nt, Homo sapiens
gcugagaacuuuagcucuu

SEQ ID NO: 431626 - RNA, 19 nt, Homo sapiens
gcccuaagaugguugaaga

SEQ ID NO: 431627 - RNA, 19 nt, Homo sapiens
gcaaauaaacggacacgau

SEQ ID NO: 431628 - RNA, 19 nt, Homo sapiens
gaagaugacuuuaugugua

SEQ ID NO: 431629 - RNA, 19 nt, Homo sapiens
gaaauaagccuguaauaga

SEQ ID NO: 431630 - RNA, 19 nt, Homo sapiens
guaaauagcucccguaaag

SEQ ID NO: 431631 - RNA, 19 nt, Homo sapiens
ggaauuaauuggccugaua

SEQ ID NO: 431632 - RNA, 19 nt, Homo sapiens
gcaugaagaugaagaguuu

SEQ ID NO: 431633 - RNA, 19 nt, Homo sapiens
ggacacauauuauuugaug

SEQ ID NO: 431634 - RNA, 19 nt, Homo sapiens
aaacugagaugaagaaaga

SEQ ID NO: 431635 - RNA, 19 nt, Homo sapiens
gaggaugacuucaaacaaa

SEQ ID NO: 431636 - RNA, 19 nt, Homo sapiens
uaaagaggaugacuucaaa

SEQ ID NO: 431637 - RNA, 19 nt, Homo sapiens
ggaccuagccuggaauuua

SEQ ID NO: 431638 - RNA, 19 nt, Homo sapiens
gaaagcagccuucacaaga

SEQ ID NO: 431639 - RNA, 19 nt, Homo sapiens
guucuaagcuggcaauuau

SEQ ID NO: 431640 - RNA, 19 nt, Homo sapiens
ggacaagucagaucucuuu

SEQ ID NO: 431641 - RNA, 19 nt, Homo sapiens
agaaagagcuacaguccua

SEQ ID NO: 431642 - RNA, 19 nt, Homo sapiens
gcucugggcuccaaagaaa

SEQ ID NO: 431643 - RNA, 19 nt, Homo sapiens
ugaagaagaugacuuuaug

SEQ ID NO: 431644 - RNA, 19 nt, Homo sapiens
gaggagacguugcagguaa

SEQ ID NO: 431645 - RNA, 19 nt, Homo sapiens
ggagcagccucuucaguaa

SEQ ID NO: 431646 - RNA, 19 nt, Homo sapiens
guccaaagaucuaauaaga

SEQ ID NO: 431647 - RNA, 19 nt, Homo sapiens
ccaaagaucuaauaagaag

SEQ ID NO: 431648 - RNA, 19 nt, Homo sapiens
uuacuaaccuguuguguga

SEQ ID NO: 431649 - RNA, 19 nt, Homo sapiens
gguaugagcaguaggcuua

SEQ ID NO: 431650 - RNA, 19 nt, Homo sapiens
gaccuggccuugcauauga

SEQ ID NO: 431651 - RNA, 19 nt, Homo sapiens
gcaagaaauccaaguauga

SEQ ID NO: 431652 - RNA, 19 nt, Homo sapiens
gaagauggccuguugaauc

SEQ ID NO: 431653 - RNA, 19 nt, Homo sapiens
guaaagcauuaaccuauga

SEQ ID NO: 431654 - RNA, 19 nt, Homo sapiens
gaaacgcacuaauuaucaa

SEQ ID NO: 431655 - RNA, 19 nt, Homo sapiens
acacuaagaccaagaauaa

SEQ ID NO: 431656 - RNA, 19 nt, Homo sapiens
gauuaucugucgcuucuaa

SEQ ID NO: 431657 - RNA, 19 nt, Homo sapiens
gcacuaauuaucaagcuua

SEQ ID NO: 431658 - RNA, 19 nt, Homo sapiens
caagauaucagacagguuu

SEQ ID NO: 431659 - RNA, 19 nt, Homo sapiens
gaacaauaccagcaucaaa

SEQ ID NO: 431660 - RNA, 19 nt, Homo sapiens
ccuauuauguggugaaauu

SEQ ID NO: 431661 - RNA, 19 nt, Homo sapiens
uaucggagcuuguaugugu

SEQ ID NO: 431662 - RNA, 19 nt, Homo sapiens
gaaaagaaacgcacuaauu

SEQ ID NO: 431663 - RNA, 19 nt, Homo sapiens
uaaaggcaguuccuauuau

SEQ ID NO: 431664 - RNA, 19 nt, Homo sapiens
gcuuguaugugucaaagua

SEQ ID NO: 431665 - RNA, 19 nt, Homo sapiens
ggaaggccuuauauuugua

SEQ ID NO: 431666 - RNA, 19 nt, Homo sapiens
gaacuggguauucuuugua

SEQ ID NO: 431667 - RNA, 19 nt, Homo sapiens
gaccuggugucccauuaua

SEQ ID NO: 431668 - RNA, 19 nt, Homo sapiens
gaaagaccaagaugcuaua

SEQ ID NO: 431669 - RNA, 19 nt, Homo sapiens
ucacaagagcuuacaauaa

SEQ ID NO: 431670 - RNA, 19 nt, Homo sapiens
gaagaaagaguccaaacug

SEQ ID NO: 431671 - RNA, 19 nt, Homo sapiens
uaucgaagcuacuuaaauc

SEQ ID NO: 431672 - RNA, 19 nt, Homo sapiens
ggaagcaaaguaaauauga

SEQ ID NO: 431673 - RNA, 19 nt, Homo sapiens
gcaguugcaugaagaugaa

SEQ ID NO: 431674 - RNA, 19 nt, Homo sapiens
acaaaguucuugagacauu

SEQ ID NO: 431675 - RNA, 19 nt, Homo sapiens
cugaaugacuguagaauug

SEQ ID NO: 431676 - RNA, 19 nt, Homo sapiens
agaccaagaugcuauagaa

SEQ ID NO: 431677 - RNA, 19 nt, Homo sapiens
ggagacugcucacauguca

SEQ ID NO: 431678 - RNA, 19 nt, Homo sapiens
gaaguaaagcauuaaccua

SEQ ID NO: 431679 - RNA, 19 nt, Homo sapiens
ggccaagucucuaauugaa

SEQ ID NO: 431680 - RNA, 19 nt, Homo sapiens
cagcacaaguuucagauga

SEQ ID NO: 431681 - RNA, 19 nt, Homo sapiens
agaaacagaugaagaagau

SEQ ID NO: 431682 - RNA, 19 nt, Homo sapiens
gaucguauucccugcuuua

SEQ ID NO: 431683 - RNA, 19 nt, Homo sapiens
gauuaagggugcuaugaug

SEQ ID NO: 431684 - RNA, 19 nt, Homo sapiens
gagaauaucauggaaauca

SEQ ID NO: 431685 - RNA, 19 nt, Homo sapiens
uaaugagccuggagcagua

SEQ ID NO: 431686 - RNA, 19 nt, Homo sapiens
ucuaagggaugcacuugua

SEQ ID NO: 431687 - RNA, 19 nt, Homo sapiens
ggacuguaaacauggauua

SEQ ID NO: 431688 - RNA, 19 nt, Homo sapiens
gaccagagcugugccaaca

SEQ ID NO: 431689 - RNA, 19 nt, Homo sapiens
ccacgucucugcugugaau

SEQ ID NO: 431690 - RNA, 19 nt, Homo sapiens
gcacucgucuacaggcaaa

SEQ ID NO: 431691 - RNA, 19 nt, Homo sapiens
ccagagcugugccaacaaa

SEQ ID NO: 431692 - RNA, 19 nt, Homo sapiens
gcaauuucauucucuuauc

SEQ ID NO: 431693 - RNA, 19 nt, Homo sapiens
gcaauuacagcuugaugaa

SEQ ID NO: 431694 - RNA, 19 nt, Homo sapiens
aaacaaagucugaugaaga

SEQ ID NO: 431695 - RNA, 19 nt, Homo sapiens
agacaaaguucuugagaca

SEQ ID NO: 431696 - RNA, 19 nt, Homo sapiens
gcaguaggcuuauguacac

SEQ ID NO: 431697 - RNA, 19 nt, Homo sapiens
caaaaggacuguaaacaug

SEQ ID NO: 431698 - RNA, 19 nt, Homo sapiens
cauaugcgauggugaccua

SEQ ID NO: 431699 - RNA, 19 nt, Homo sapiens
ggaaguguccaaagaucua

SEQ ID NO: 431700 - RNA, 19 nt, Homo sapiens
gaccuagccuggaauuuag

SEQ ID NO: 431701 - RNA, 19 nt, Homo sapiens
uuaaaggcaguuccuauua

SEQ ID NO: 431702 - RNA, 19 nt, Homo sapiens
ggagucagauuuuaguuaa

SEQ ID NO: 431703 - RNA, 19 nt, Homo sapiens
gaauuaauuggccugauaa

SEQ ID NO: 431704 - RNA, 19 nt, Homo sapiens
gaccaagaauaagccuuua

SEQ ID NO: 431705 - RNA, 19 nt, Homo sapiens
gaagaucuacaaauaguca

SEQ ID NO: 431706 - RNA, 19 nt, Homo sapiens
guaaagaggaugacuucaa

SEQ ID NO: 431707 - RNA, 19 nt, Homo sapiens
gcaaagaaaggaauaaagg

SEQ ID NO: 431708 - RNA, 19 nt, Homo sapiens
aacaaagucugaugaagaa

SEQ ID NO: 431709 - RNA, 19 nt, Homo sapiens
ggaguaauaccaaguggaa

SEQ ID NO: 431710 - RNA, 19 nt, Homo sapiens
uggcaaaccuagucccuuu

SEQ ID NO: 431711 - RNA, 19 nt, Homo sapiens
ggcaagaaauccaaguaug

SEQ ID NO: 431712 - RNA, 19 nt, Homo sapiens
ugaugaagauggccuguug

SEQ ID NO: 431713 - RNA, 19 nt, Homo sapiens
gcucucugguucauuauug

SEQ ID NO: 431714 - RNA, 19 nt, Homo sapiens
cagcaaggcuaggaauuug

SEQ ID NO: 431715 - RNA, 19 nt, Homo sapiens
gugcaaacauuaagcaagu

SEQ ID NO: 431716 - RNA, 19 nt, Homo sapiens
gaggccaagucucuaauug

SEQ ID NO: 431717 - RNA, 19 nt, Homo sapiens
gagaauggaagaucuacaa

SEQ ID NO: 431718 - RNA, 19 nt, Homo sapiens
gugaaacaguaaagaagaa

SEQ ID NO: 431719 - RNA, 19 nt, Homo sapiens
gaacugguagucuuguuug

SEQ ID NO: 431720 - RNA, 19 nt, Homo sapiens
ucugugagguauauacuaa

SEQ ID NO: 431721 - RNA, 19 nt, Homo sapiens
gcaaacauuaagcaaguaa

SEQ ID NO: 431722 - RNA, 19 nt, Homo sapiens
uagacgugcuucugaauga

SEQ ID NO: 431723 - RNA, 19 nt, Homo sapiens
cuacagauacuuaugaaga

SEQ ID NO: 431724 - RNA, 19 nt, Homo sapiens
gaaacuacaccugggcuuu

SEQ ID NO: 431725 - RNA, 19 nt, Homo sapiens
ggccuuauauuuguaauca

SEQ ID NO: 431726 - RNA, 19 nt, Homo sapiens
aauuacagcuugaugaaga

SEQ ID NO: 431727 - RNA, 19 nt, Homo sapiens
gaagaugguggcaagcaaa

SEQ ID NO: 431728 - RNA, 19 nt, Homo sapiens
caacaugacuguccuuuaa

SEQ ID NO: 431729 - RNA, 19 nt, Homo sapiens
gaaacccugucuuuacuaa

SEQ ID NO: 431730 - RNA, 19 nt, Homo sapiens
ggauuuggcuucauuaaca

SEQ ID NO: 431731 - RNA, 19 nt, Homo sapiens
ggagaaccauggaaaucua

SEQ ID NO: 431732 - RNA, 19 nt, Homo sapiens
gaaauuggauacacucaca

SEQ ID NO: 431733 - RNA, 19 nt, Homo sapiens
caguaaagcugaaugaaau

SEQ ID NO: 431734 - RNA, 19 nt, Homo sapiens
gagccaagaucacaccauu

SEQ ID NO: 431735 - RNA, 19 nt, Homo sapiens
gcaaggcugugucagaaga

SEQ ID NO: 431736 - RNA, 19 nt, Homo sapiens
gaacugccguggguugaaa

SEQ ID NO: 431737 - RNA, 19 nt, Homo sapiens
ugacgaagccuacaagauu

SEQ ID NO: 431738 - RNA, 19 nt, Homo sapiens
ccauggaaaucuacucuaa

SEQ ID NO: 431739 - RNA, 19 nt, Homo sapiens
uaaauaaacucccgugacu

SEQ ID NO: 431740 - RNA, 19 nt, Homo sapiens
caacaucuuucgagugugu

SEQ ID NO: 431741 - RNA, 19 nt, Homo sapiens
ggaacucaaugcuucaaau

SEQ ID NO: 431742 - RNA, 19 nt, Homo sapiens
ucaccaggcugaugaaugu

SEQ ID NO: 431743 - RNA, 19 nt, Homo sapiens
acucaaagaugccauguug

SEQ ID NO: 431744 - RNA, 19 nt, Homo sapiens
ggcaacaucuuucgagugu

SEQ ID NO: 431745 - RNA, 19 nt, Homo sapiens
gaaugaaauugucgggaau

SEQ ID NO: 431746 - RNA, 19 nt, Homo sapiens
gaagauaucauuggcaaca

SEQ ID NO: 431747 - RNA, 19 nt, Homo sapiens
gaaauugucgggaaugaag

SEQ ID NO: 431748 - RNA, 19 nt, Homo sapiens
uggauacacucacaugaaa

SEQ ID NO: 431749 - RNA, 19 nt, Homo sapiens
gaacucaaugcuucaaaug

SEQ ID NO: 431750 - RNA, 19 nt, Homo sapiens
gggaaacccugucuuuacu

SEQ ID NO: 431751 - RNA, 19 nt, Homo sapiens
gacgaagccuacaagauuc

SEQ ID NO: 431752 - RNA, 19 nt, Homo sapiens
ccaguaaagcugaaugaaa

SEQ ID NO: 431753 - RNA, 19 nt, Homo sapiens
ugaugaauguuaucgagaa

SEQ ID NO: 431754 - RNA, 19 nt, Homo sapiens
agacuucacugacugacuu

SEQ ID NO: 431755 - RNA, 19 nt, Homo sapiens
ccuguaaucccaacacuuu

SEQ ID NO: 431756 - RNA, 19 nt, Homo sapiens
gcuucgcccuugcuuguaa

SEQ ID NO: 431757 - RNA, 19 nt, Homo sapiens
ggaaacccugucuuuacua

SEQ ID NO: 431758 - RNA, 19 nt, Homo sapiens
ucaaagaugccauguugga

SEQ ID NO: 431759 - RNA, 19 nt, Homo sapiens
ccaacaugacuguccuuua

SEQ ID NO: 431760 - RNA, 19 nt, Homo sapiens
caaggaaauuggauacacu

SEQ ID NO: 431761 - RNA, 19 nt, Homo sapiens
ugaauguuaucgagaagga

SEQ ID NO: 431762 - RNA, 19 nt, Homo sapiens
aauaaacucccgugacuug

SEQ ID NO: 431763 - RNA, 19 nt, Homo sapiens
gcaggagaaucgcuugaac

SEQ ID NO: 431764 - RNA, 19 nt, Homo sapiens
uggcaaggcugugucagaa

SEQ ID NO: 431765 - RNA, 19 nt, Homo sapiens
ggcaagaccacaagcauuc

SEQ ID NO: 431766 - RNA, 19 nt, Homo sapiens
guguaaaacuuuccaaaug

SEQ ID NO: 431767 - RNA, 19 nt, Homo sapiens
guaaagcugaaugaaauug

SEQ ID NO: 431768 - RNA, 19 nt, Homo sapiens
gaggagaaccauggaaauc

SEQ ID NO: 431769 - RNA, 19 nt, Homo sapiens
uaucauuggcaacaucuuu

SEQ ID NO: 431770 - RNA, 19 nt, Homo sapiens
gaaggaaaugugcccaaca

SEQ ID NO: 431771 - RNA, 19 nt, Homo sapiens
aaacucccgugacuugcaa

SEQ ID NO: 431772 - RNA, 19 nt, Homo sapiens
gaugaauguuaucgagaag

SEQ ID NO: 431773 - RNA, 19 nt, Homo sapiens
gcaccuguaaucccagcua

SEQ ID NO: 431774 - RNA, 19 nt, Homo sapiens
gaguuuaucaaggaaauug

SEQ ID NO: 431775 - RNA, 19 nt, Homo sapiens
ccaggcugaugaauguuau

SEQ ID NO: 431776 - RNA, 19 nt, Homo sapiens
guaaugcuucggauaagau

SEQ ID NO: 431777 - RNA, 19 nt, Homo sapiens
ggugcccuauucugaggua

SEQ ID NO: 431778 - RNA, 19 nt, Homo sapiens
gcaguccuccgguacacaa

SEQ ID NO: 431779 - RNA, 19 nt, Homo sapiens
caaagaugccauguuggaa

SEQ ID NO: 431780 - RNA, 19 nt, Homo sapiens
gaaaucuacucuaaaacca

SEQ ID NO: 431781 - RNA, 19 nt, Homo sapiens
gcuacucaccagaagauau

SEQ ID NO: 431782 - RNA, 19 nt, Homo sapiens
acuuacaggugcccuauuc

SEQ ID NO: 431783 - RNA, 19 nt, Homo sapiens
cuuguaaugcuucggauaa

SEQ ID NO: 431784 - RNA, 19 nt, Homo sapiens
gggcuacucaccagaagau

SEQ ID NO: 431785 - RNA, 19 nt, Homo sapiens
uguaaugcuucggauaaga

SEQ ID NO: 431786 - RNA, 19 nt, Homo sapiens
cauggaaaucuacucuaaa

SEQ ID NO: 431787 - RNA, 19 nt, Homo sapiens
aaagcugaaugaaauuguc

SEQ ID NO: 431788 - RNA, 19 nt, Homo sapiens
gauccagcacugugugaau

SEQ ID NO: 431789 - RNA, 19 nt, Homo sapiens
ggcaggcgcugaacaaccu

SEQ ID NO: 431790 - RNA, 19 nt, Homo sapiens
gagcaggcuagaggucuuu

SEQ ID NO: 431791 - RNA, 19 nt, Homo sapiens
gaugccauguuggaacuca

SEQ ID NO: 431792 - RNA, 19 nt, Homo sapiens
ucaaggaaauuggauacac

SEQ ID NO: 431793 - RNA, 19 nt, Homo sapiens
cucaggauuuggcuucauu

SEQ ID NO: 431794 - RNA, 19 nt, Homo sapiens
gcccuugcuuguaaugcuu

SEQ ID NO: 431795 - RNA, 19 nt, Homo sapiens
uacaggugcccuauucuga

SEQ ID NO: 431796 - RNA, 19 nt, Homo sapiens
caggauuuggcuucauuaa

SEQ ID NO: 431797 - RNA, 19 nt, Homo sapiens
ggccaguaaagcugaauga

SEQ ID NO: 431798 - RNA, 19 nt, Homo sapiens
gggcccagcacucaaagau

SEQ ID NO: 431799 - RNA, 19 nt, Homo sapiens
ugaggcaggcgcugaacaa

SEQ ID NO: 431800 - RNA, 19 nt, Homo sapiens
gaaccggcaagaccacaag

SEQ ID NO: 431801 - RNA, 19 nt, Homo sapiens
cggcaagaccacaagcauu

SEQ ID NO: 431802 - RNA, 19 nt, Homo sapiens
gccaagaucacaccauugc

SEQ ID NO: 431803 - RNA, 19 nt, Homo sapiens
ugagcaggcuagaggucuu

SEQ ID NO: 431804 - RNA, 19 nt, Homo sapiens
uggaguuuaucaaggaaau

SEQ ID NO: 431805 - RNA, 19 nt, Homo sapiens
gaucaucgagcccauucag

SEQ ID NO: 431806 - RNA, 19 nt, Homo sapiens
agauaucauuggcaacauc

SEQ ID NO: 431807 - RNA, 19 nt, Homo sapiens
acucaaugcuucaaaugac

SEQ ID NO: 431808 - RNA, 19 nt, Homo sapiens
cuacucaccagaagauauc

SEQ ID NO: 431809 - RNA, 19 nt, Homo sapiens
ggagaugauccagcacugu

SEQ ID NO: 431810 - RNA, 19 nt, Homo sapiens
gauuuggcuucauuaacag

SEQ ID NO: 431811 - RNA, 19 nt, Homo sapiens
ucaggauuuggcuucauua

SEQ ID NO: 431812 - RNA, 19 nt, Homo sapiens
gcuuguaaugcuucggaua

SEQ ID NO: 431813 - RNA, 19 nt, Homo sapiens
guagcucacgccuguaauc

SEQ ID NO: 431814 - RNA, 19 nt, Homo sapiens
cuuuccaaauggcagaaua

SEQ ID NO: 431815 - RNA, 19 nt, Homo sapiens
gugcccaacaucaucauug

SEQ ID NO: 431816 - RNA, 19 nt, Homo sapiens
ggaaccggcaagaccacaa

SEQ ID NO: 431817 - RNA, 19 nt, Homo sapiens
ugaggagaaccauggaaau

SEQ ID NO: 431818 - RNA, 19 nt, Homo sapiens
acaugacuguccuuuaaac

SEQ ID NO: 431819 - RNA, 19 nt, Homo sapiens
ggaguuuaucaaggaaauu

SEQ ID NO: 431820 - RNA, 19 nt, Homo sapiens
gguaauaacuucucuguga

SEQ ID NO: 431821 - RNA, 19 nt, Homo sapiens
gcagagaagucuuguagaa

SEQ ID NO: 431822 - RNA, 19 nt, Homo sapiens
ucucagaacuguuacauaa

SEQ ID NO: 431823 - RNA, 19 nt, Homo sapiens
gaaauuagcaccauugcaa

SEQ ID NO: 431824 - RNA, 19 nt, Homo sapiens
gcaaagccauuuaucacuu

SEQ ID NO: 431825 - RNA, 19 nt, Homo sapiens
ugacuuuccucaucuguua

SEQ ID NO: 431826 - RNA, 19 nt, Homo sapiens
ccaaauucauggcacuuua

SEQ ID NO: 431827 - RNA, 19 nt, Homo sapiens
gcaaagauuucucaguauc

SEQ ID NO: 431828 - RNA, 19 nt, Homo sapiens
gaaggaaggucugaaucuu

SEQ ID NO: 431829 - RNA, 19 nt, Homo sapiens
cacaacaacuugaaacaaa

SEQ ID NO: 431830 - RNA, 19 nt, Homo sapiens
caucacaacuccaucuaaa

SEQ ID NO: 431831 - RNA, 19 nt, Homo sapiens
caaaugcuauugucaguca

SEQ ID NO: 431832 - RNA, 19 nt, Homo sapiens
cagcaugccuugcgaagaa

SEQ ID NO: 431833 - RNA, 19 nt, Homo sapiens
uugcaaagauuucucagua

SEQ ID NO: 431834 - RNA, 19 nt, Homo sapiens
ccuauucucuuccgucuaa

SEQ ID NO: 431835 - RNA, 19 nt, Homo sapiens
uaacuucucugugaacuau

SEQ ID NO: 431836 - RNA, 19 nt, Homo sapiens
guaauaacuucucugugaa

SEQ ID NO: 431837 - RNA, 19 nt, Homo sapiens
ccucugaguuaaauaauug

SEQ ID NO: 431838 - RNA, 19 nt, Homo sapiens
agagaagucuuguagaaau

SEQ ID NO: 431839 - RNA, 19 nt, Homo sapiens
gaaguuaauccuagugaug

SEQ ID NO: 431840 - RNA, 19 nt, Homo sapiens
ucauggcacuuuauaagaa

SEQ ID NO: 431841 - RNA, 19 nt, Homo sapiens
caaagccauuuaucacuug

SEQ ID NO: 431842 - RNA, 19 nt, Homo sapiens
ucuaaucucucaccugcua

SEQ ID NO: 431843 - RNA, 19 nt, Homo sapiens
uaaaagagcuguggguaaa

SEQ ID NO: 431844 - RNA, 19 nt, Homo sapiens
uggcacaaauggcagcuua

SEQ ID NO: 431845 - RNA, 19 nt, Homo sapiens
gaacaucagaccaucacaa

SEQ ID NO: 431846 - RNA, 19 nt, Homo sapiens
aaagagcuguggguaaauu

SEQ ID NO: 431847 - RNA, 19 nt, Homo sapiens
gcuucuaacucauuguauu

SEQ ID NO: 431848 - RNA, 19 nt, Homo sapiens
aaagugaucccaccuauuc

SEQ ID NO: 431849 - RNA, 19 nt, Homo sapiens
ggcaugauguucugacuuc

SEQ ID NO: 431850 - RNA, 19 nt, Homo sapiens
gagaagucuuguagaaauc

SEQ ID NO: 431851 - RNA, 19 nt, Homo sapiens
acaaauggcagcuuacuau

SEQ ID NO: 431852 - RNA, 19 nt, Homo sapiens
cuaaagugaucccaccuau

SEQ ID NO: 431853 - RNA, 19 nt, Homo sapiens
gagcuucuaacucauugua

SEQ ID NO: 431854 - RNA, 19 nt, Homo sapiens
acaacuggcucauagacuu

SEQ ID NO: 431855 - RNA, 19 nt, Homo sapiens
ggaaauagugaccgaguag

SEQ ID NO: 431856 - RNA, 19 nt, Homo sapiens
cauggaggauggauuggaa

SEQ ID NO: 431857 - RNA, 19 nt, Homo sapiens
gcucauagacuugcagaga

SEQ ID NO: 431858 - RNA, 19 nt, Homo sapiens
gcacaaucacaacaacuug

SEQ ID NO: 431859 - RNA, 19 nt, Homo sapiens
gcaauucuacaucuaaagu

SEQ ID NO: 431860 - RNA, 19 nt, Homo sapiens
ggagauuuacacauuagaa

SEQ ID NO: 431861 - RNA, 19 nt, Homo sapiens
gaaucuuccuucacaacug

SEQ ID NO: 431862 - RNA, 19 nt, Homo sapiens
ggugcaguguggugacuuu

SEQ ID NO: 431863 - RNA, 19 nt, Homo sapiens
gaucaagaaaucccugaga

SEQ ID NO: 431864 - RNA, 19 nt, Homo sapiens
gacaaacucaccaaagaug

SEQ ID NO: 431865 - RNA, 19 nt, Homo sapiens
ucaaagggauuuuaaagug

SEQ ID NO: 431866 - RNA, 19 nt, Homo sapiens
guagcaaagccauuuauca

SEQ ID NO: 431867 - RNA, 19 nt, Homo sapiens
cagaacuguuacauaauug

SEQ ID NO: 431868 - RNA, 19 nt, Homo sapiens
uugacaaacucaccaaaga

SEQ ID NO: 431869 - RNA, 19 nt, Homo sapiens
ucucucaccugcuaaagga

SEQ ID NO: 431870 - RNA, 19 nt, Homo sapiens
cuucacaacuggcucauag

SEQ ID NO: 431871 - RNA, 19 nt, Homo sapiens
gaauugaacaucagaccau

SEQ ID NO: 431872 - RNA, 19 nt, Homo sapiens
ucagcaaacuccacaaagg

SEQ ID NO: 431873 - RNA, 19 nt, Homo sapiens
gugcaacaauauccuuuua

SEQ ID NO: 431874 - RNA, 19 nt, Homo sapiens
agaaaucccugagacagau

SEQ ID NO: 431875 - RNA, 19 nt, Homo sapiens
uaucuacuguguguaagaa

SEQ ID NO: 431876 - RNA, 19 nt, Homo sapiens
cguguuaucuacugugugu

SEQ ID NO: 431877 - RNA, 19 nt, Homo sapiens
uggaaauagugaccgagua

SEQ ID NO: 431878 - RNA, 19 nt, Homo sapiens
gaacuguuacauaauugug

SEQ ID NO: 431879 - RNA, 19 nt, Homo sapiens
gcuauugucagucagcaaa

SEQ ID NO: 431880 - RNA, 19 nt, Homo sapiens
ugggacggcuggacuauca

SEQ ID NO: 431881 - RNA, 19 nt, Homo sapiens
uaagaaggaaggucugaau

SEQ ID NO: 431882 - RNA, 19 nt, Homo sapiens
uuagcaccauugcaaguaa

SEQ ID NO: 431883 - RNA, 19 nt, Homo sapiens
guucauggaggauggauug

SEQ ID NO: 431884 - RNA, 19 nt, Homo sapiens
caaauucauggcacuuuau

SEQ ID NO: 431885 - RNA, 19 nt, Homo sapiens
acuaccaccuugaaguuaa

SEQ ID NO: 431886 - RNA, 19 nt, Homo sapiens
uaacuuagagacuuuagag

SEQ ID NO: 431887 - RNA, 19 nt, Homo sapiens
caaagauuucucaguauca

SEQ ID NO: 431888 - RNA, 19 nt, Homo sapiens
gcucccagcauugaagaua

SEQ ID NO: 431889 - RNA, 19 nt, Homo sapiens
gaaaacaguggcacaauca

SEQ ID NO: 431890 - RNA, 19 nt, Homo sapiens
ugccacagguaacaugauu

SEQ ID NO: 431891 - RNA, 19 nt, Homo sapiens
aagcauugguuauucaagu

SEQ ID NO: 431892 - RNA, 19 nt, Homo sapiens
ugucaguuauucuugcaaa

SEQ ID NO: 431893 - RNA, 19 nt, Homo sapiens
gcugcaauucuacaucuaa

SEQ ID NO: 431894 - RNA, 19 nt, Homo sapiens
acuucucugugaacuauua

SEQ ID NO: 431895 - RNA, 19 nt, Homo sapiens
cagagaagucuuguagaaa

SEQ ID NO: 431896 - RNA, 19 nt, Homo sapiens
guaacuaccaccuugaagu

SEQ ID NO: 431897 - RNA, 19 nt, Homo sapiens
ccacagguaacaugauugu

SEQ ID NO: 431898 - RNA, 19 nt, Homo sapiens
cuccugagauaauaaugaa

SEQ ID NO: 431899 - RNA, 19 nt, Homo sapiens
gagggagacugcaaaugcu

SEQ ID NO: 431900 - RNA, 19 nt, Homo sapiens
gaucccaccuauucguagu

SEQ ID NO: 431901 - RNA, 19 nt, Homo sapiens
gccucuggguggacaagua

SEQ ID NO: 431902 - RNA, 19 nt, Homo sapiens
aaauggcagcuuacuauga

SEQ ID NO: 431903 - RNA, 19 nt, Homo sapiens
uaaagugaucccaccuauu

SEQ ID NO: 431904 - RNA, 19 nt, Homo sapiens
ugaaacaaacucucaaagg

SEQ ID NO: 431905 - RNA, 19 nt, Homo sapiens
guggguaaauuaacugaac

SEQ ID NO: 431906 - RNA, 19 nt, Homo sapiens
caucagaccaucacaacuc

SEQ ID NO: 431907 - RNA, 19 nt, Homo sapiens
caaauggcagcuuacuaug

SEQ ID NO: 431908 - RNA, 19 nt, Homo sapiens
ggagacugcaaaugcuauu

SEQ ID NO: 431909 - RNA, 19 nt, Homo sapiens
ucauagacuugcagagaag

SEQ ID NO: 431910 - RNA, 19 nt, Homo sapiens
caacuggcucauagacuug

SEQ ID NO: 431911 - RNA, 19 nt, Homo sapiens
cugcaauucuacaucuaaa

SEQ ID NO: 431912 - RNA, 19 nt, Homo sapiens
gugcugcaauucuacaucu

SEQ ID NO: 431913 - RNA, 19 nt, Homo sapiens
ucacaacaacuugaaacaa

SEQ ID NO: 431914 - RNA, 19 nt, Homo sapiens
ugcaaagauuucucaguau

SEQ ID NO: 431915 - RNA, 19 nt, Homo sapiens
uuguauuccuccugagaua

SEQ ID NO: 431916 - RNA, 19 nt, Homo sapiens
cucauagacuugcagagaa

SEQ ID NO: 431917 - RNA, 19 nt, Homo sapiens
agauauuugccacguguua

SEQ ID NO: 431918 - RNA, 19 nt, Homo sapiens
gaucuugugcugcaauucu

SEQ ID NO: 431919 - RNA, 19 nt, Homo sapiens
gguauuauugacagaaguu

SEQ ID NO: 431920 - RNA, 19 nt, Homo sapiens
gaaaggagaucacagagaa

SEQ ID NO: 431921 - RNA, 19 nt, Homo sapiens
gggaauagcuuaucuuguu

SEQ ID NO: 431922 - RNA, 19 nt, Homo sapiens
ucaaagcgcuacucgauua

SEQ ID NO: 431923 - RNA, 19 nt, Homo sapiens
caacucagcucgucaauca

SEQ ID NO: 431924 - RNA, 19 nt, Homo sapiens
ggaauagcuuaucuuguua

SEQ ID NO: 431925 - RNA, 19 nt, Homo sapiens
gaccaaggaucgaggagua

SEQ ID NO: 431926 - RNA, 19 nt, Homo sapiens
gaaagugauuacagacauu

SEQ ID NO: 431927 - RNA, 19 nt, Homo sapiens
ggaugaugaugguuugaua

SEQ ID NO: 431928 - RNA, 19 nt, Homo sapiens
gcaguuaucucagaauugu

SEQ ID NO: 431929 - RNA, 19 nt, Homo sapiens
aaagguacauccaucagua

SEQ ID NO: 431930 - RNA, 19 nt, Homo sapiens
gccauuacauuucuucaaa

SEQ ID NO: 431931 - RNA, 19 nt, Homo sapiens
gauucugucuuaucuguaa

SEQ ID NO: 431932 - RNA, 19 nt, Homo sapiens
acaaguaguucgagagaaa

SEQ ID NO: 431933 - RNA, 19 nt, Homo sapiens
cagagaaagugauuacaga

SEQ ID NO: 431934 - RNA, 19 nt, Homo sapiens
gaacguggaauacaaguag

SEQ ID NO: 431935 - RNA, 19 nt, Homo sapiens
cagaauuguuaacgugaua

SEQ ID NO: 431936 - RNA, 19 nt, Homo sapiens
gcaagcauuucuuaaaggu

SEQ ID NO: 431937 - RNA, 19 nt, Homo sapiens
gcggugaccugcacgagaa

SEQ ID NO: 431938 - RNA, 19 nt, Homo sapiens
gaugaacauuugcaacuca

SEQ ID NO: 431939 - RNA, 19 nt, Homo sapiens
cagcagcgauuacuagaca

SEQ ID NO: 431940 - RNA, 19 nt, Homo sapiens
cagcaguuaucucagaauu

SEQ ID NO: 431941 - RNA, 19 nt, Homo sapiens
gaaggagacuuaagaaaag

SEQ ID NO: 431942 - RNA, 19 nt, Homo sapiens
ugucuuaucuguaacuaug

SEQ ID NO: 431943 - RNA, 19 nt, Homo sapiens
agaagucuauuaucacaga

SEQ ID NO: 431944 - RNA, 19 nt, Homo sapiens
aggacaagcuggaugauga

SEQ ID NO: 431945 - RNA, 19 nt, Homo sapiens
ggaaaggagaucacagaga

SEQ ID NO: 431946 - RNA, 19 nt, Homo sapiens
gaacauuugcaacucauca

SEQ ID NO: 431947 - RNA, 19 nt, Homo sapiens
ggaugaagcagauucuaug

SEQ ID NO: 431948 - RNA, 19 nt, Homo sapiens
caacagcagcgauuacuag

SEQ ID NO: 431949 - RNA, 19 nt, Homo sapiens
ggaaguagcggagagaaca

SEQ ID NO: 431950 - RNA, 19 nt, Homo sapiens
gcccguuauucucagauua

SEQ ID NO: 431951 - RNA, 19 nt, Homo sapiens
uagaagcuguggucaagga

SEQ ID NO: 431952 - RNA, 19 nt, Homo sapiens
cuaugucagucgaauaauu

SEQ ID NO: 431953 - RNA, 19 nt, Homo sapiens
gcggaaaccugaggaacga

SEQ ID NO: 431954 - RNA, 19 nt, Homo sapiens
ugaugaacguggaauacaa

SEQ ID NO: 431955 - RNA, 19 nt, Homo sapiens
gagggaauagcuuaucuug

SEQ ID NO: 431956 - RNA, 19 nt, Homo sapiens
acagaagucuauuaucaca

SEQ ID NO: 431957 - RNA, 19 nt, Homo sapiens
gugaugagggaauagcuua

SEQ ID NO: 431958 - RNA, 19 nt, Homo sapiens
gcuaagacuucgagaccau

SEQ ID NO: 431959 - RNA, 19 nt, Homo sapiens
gaugaagcagauucuauga

SEQ ID NO: 431960 - RNA, 19 nt, Homo sapiens
ugaguuaaaugcaucugau

SEQ ID NO: 431961 - RNA, 19 nt, Homo sapiens
ucaacuccaugaugugguu

SEQ ID NO: 431962 - RNA, 19 nt, Homo sapiens
gcuggaugaugaugguuug

SEQ ID NO: 431963 - RNA, 19 nt, Homo sapiens
uacuagacauugccaagaa

SEQ ID NO: 431964 - RNA, 19 nt, Homo sapiens
uaacuaugucagucgaaua

SEQ ID NO: 431965 - RNA, 19 nt, Homo sapiens
guaacuaugucagucgaau

SEQ ID NO: 431966 - RNA, 19 nt, Homo sapiens
ugacaaaugccuagcagau

SEQ ID NO: 431967 - RNA, 19 nt, Homo sapiens
gacguaccauggagaagga

SEQ ID NO: 431968 - RNA, 19 nt, Homo sapiens
caacucaucagccuuugug

SEQ ID NO: 431969 - RNA, 19 nt, Homo sapiens
gaagucuauuaucacagaa

SEQ ID NO: 431970 - RNA, 19 nt, Homo sapiens
ugagaaaauugauggagua

SEQ ID NO: 431971 - RNA, 19 nt, Homo sapiens
agaaagugauuacagacau

SEQ ID NO: 431972 - RNA, 19 nt, Homo sapiens
ggagaucacagagaaagug

SEQ ID NO: 431973 - RNA, 19 nt, Homo sapiens
gagaaagugauuacagaca

SEQ ID NO: 431974 - RNA, 19 nt, Homo sapiens
cagaaggagacuuaagaaa

SEQ ID NO: 431975 - RNA, 19 nt, Homo sapiens
caagcuggaugaugauggu

SEQ ID NO: 431976 - RNA, 19 nt, Homo sapiens
ccgauucugucuuaucugu

SEQ ID NO: 431977 - RNA, 19 nt, Homo sapiens
caaaauguguggaugaagu

SEQ ID NO: 431978 - RNA, 19 nt, Homo sapiens
gcucgucaaucaacuccau

SEQ ID NO: 431979 - RNA, 19 nt, Homo sapiens
gaaaaccacccgauucugu

SEQ ID NO: 431980 - RNA, 19 nt, Homo sapiens
agauugugauucuggauga

SEQ ID NO: 431981 - RNA, 19 nt, Homo sapiens
gcagcgauuacuagacauu

SEQ ID NO: 431982 - RNA, 19 nt, Homo sapiens
guaguucgagagaaaguga

SEQ ID NO: 431983 - RNA, 19 nt, Homo sapiens
gacaaaugccuagcagaug

SEQ ID NO: 431984 - RNA, 19 nt, Homo sapiens
guggaaaggagaucacaga

SEQ ID NO: 431985 - RNA, 19 nt, Homo sapiens
ucagaaggagacuuaagaa

SEQ ID NO: 431986 - RNA, 19 nt, Homo sapiens
uaugucagucgaauaauug

SEQ ID NO: 431987 - RNA, 19 nt, Homo sapiens
cauccagaaucacaaucuu

SEQ ID NO: 431988 - RNA, 19 nt, Homo sapiens
guucuugaguuaaaugcau

SEQ ID NO: 431989 - RNA, 19 nt, Homo sapiens
ggccugaacuuuuccgauu

SEQ ID NO: 431990 - RNA, 19 nt, Homo sapiens
gaaguagcggagagaacaa

SEQ ID NO: 431991 - RNA, 19 nt, Homo sapiens
caaagcgcuacucgauuaa

SEQ ID NO: 431992 - RNA, 19 nt, Homo sapiens
gucagaaggagacuuaaga

SEQ ID NO: 431993 - RNA, 19 nt, Homo sapiens
ggcagcagcuagagaacuc

SEQ ID NO: 431994 - RNA, 19 nt, Homo sapiens
cugauaaacagaagucuau

SEQ ID NO: 431995 - RNA, 19 nt, Homo sapiens
aauuagugaugagggaaua

SEQ ID NO: 431996 - RNA, 19 nt, Homo sapiens
uaagacguaccauggagaa

SEQ ID NO: 431997 - RNA, 19 nt, Homo sapiens
ggaagccguguccgccuuu

SEQ ID NO: 431998 - RNA, 19 nt, Homo sapiens
ggacaagcuggaugaugau

SEQ ID NO: 431999 - RNA, 19 nt, Homo sapiens
acuagaagcuguggucaag

SEQ ID NO: 432000 - RNA, 19 nt, Homo sapiens
uagcggagagaacaagaaa

SEQ ID NO: 432001 - RNA, 19 nt, Homo sapiens
uccagaaucacaaucuuaa

SEQ ID NO: 432002 - RNA, 19 nt, Homo sapiens
ccagaaucacaaucuuaaa

SEQ ID NO: 432003 - RNA, 19 nt, Homo sapiens
caggcagcuuuaagacgua

SEQ ID NO: 432004 - RNA, 19 nt, Homo sapiens
ucagaauuguuaacgugau

SEQ ID NO: 432005 - RNA, 19 nt, Homo sapiens
guucguguauaggagauga

SEQ ID NO: 432006 - RNA, 19 nt, Homo sapiens
uugccgaaguugacaaaug

SEQ ID NO: 432007 - RNA, 19 nt, Homo sapiens
guguauaggagaugaugaa

SEQ ID NO: 432008 - RNA, 19 nt, Homo sapiens
agaaggagacuuaagaaaa

SEQ ID NO: 432009 - RNA, 19 nt, Homo sapiens
ucaggaagucgcucagaug

SEQ ID NO: 432010 - RNA, 19 nt, Homo sapiens
gucaggaagucgcucagau

SEQ ID NO: 432011 - RNA, 19 nt, Homo sapiens
cuaacugggugaaguacca

SEQ ID NO: 432012 - RNA, 19 nt, Homo sapiens
uccaugaugugguuguaga

SEQ ID NO: 432013 - RNA, 19 nt, Homo sapiens
cuucaaagcgcuacucgau

SEQ ID NO: 432014 - RNA, 19 nt, Homo sapiens
ccauuacauuucuucaaag

SEQ ID NO: 432015 - RNA, 19 nt, Homo sapiens
gacauugccaagaaggaaa

SEQ ID NO: 432016 - RNA, 19 nt, Homo sapiens
accacccgauucugucuua

SEQ ID NO: 432017 - RNA, 19 nt, Homo sapiens
gaugaugaugguuugauag

SEQ ID NO: 432018 - RNA, 19 nt, Homo sapiens
ggcccguuauucucagauu

SEQ ID NO: 432019 - RNA, 19 nt, Homo sapiens
ccauggagaaggagucgaa

SEQ ID NO: 432020 - RNA, 19 nt, Homo sapiens
cgaaacagcuauauaaaga

SEQ ID NO: 432021 - RNA, 19 nt, Homo sapiens
gcacaaggacaauauuuaa

SEQ ID NO: 432022 - RNA, 19 nt, Homo sapiens
gcugaauccucuuacuuua

SEQ ID NO: 432023 - RNA, 19 nt, Homo sapiens
gaggacaguuccaggauaa

SEQ ID NO: 432024 - RNA, 19 nt, Homo sapiens
gaacagaagacuuucaaau

SEQ ID NO: 432025 - RNA, 19 nt, Homo sapiens
caagacaucuaccauccua

SEQ ID NO: 432026 - RNA, 19 nt, Homo sapiens
ugacagagauacacuuguu

SEQ ID NO: 432027 - RNA, 19 nt, Homo sapiens
gagccugacuguaaaccua

SEQ ID NO: 432028 - RNA, 19 nt, Homo sapiens
ccaagugucuuccuacuca

SEQ ID NO: 432029 - RNA, 19 nt, Homo sapiens
gauucugccucaucuguaa

SEQ ID NO: 432030 - RNA, 19 nt, Homo sapiens
gugcgaaacagcuauauaa

SEQ ID NO: 432031 - RNA, 19 nt, Homo sapiens
ggccgaaacuauuauacuu

SEQ ID NO: 432032 - RNA, 19 nt, Homo sapiens
gcagggauguacaaaauaa

SEQ ID NO: 432033 - RNA, 19 nt, Homo sapiens
gagaagaguaauugagaaa

SEQ ID NO: 432034 - RNA, 19 nt, Homo sapiens
ggacaauauuuaagaaagg

SEQ ID NO: 432035 - RNA, 19 nt, Homo sapiens
ggaccgauccugagcuuug

SEQ ID NO: 432036 - RNA, 19 nt, Homo sapiens
ggaaugaaagcacuaguca

SEQ ID NO: 432037 - RNA, 19 nt, Homo sapiens
ccacagacccugaaugauc

SEQ ID NO: 432038 - RNA, 19 nt, Homo sapiens
cagaaugccuugagaagag

SEQ ID NO: 432039 - RNA, 19 nt, Homo sapiens
uuagacagcuagaaagaug

SEQ ID NO: 432040 - RNA, 19 nt, Homo sapiens
cagcggaucuggucaccuu

SEQ ID NO: 432041 - RNA, 19 nt, Homo sapiens
gagcagggauguacaaaau

SEQ ID NO: 432042 - RNA, 19 nt, Homo sapiens
gaagaagagaaaguugaua

SEQ ID NO: 432043 - RNA, 19 nt, Homo sapiens
ugaguaccauucagaaguu

SEQ ID NO: 432044 - RNA, 19 nt, Homo sapiens
gguaaacauuaucuccaaa

SEQ ID NO: 432045 - RNA, 19 nt, Homo sapiens
ggaauuagccuaccccauu

SEQ ID NO: 432046 - RNA, 19 nt, Homo sapiens
gcauagaguugacuuucca

SEQ ID NO: 432047 - RNA, 19 nt, Homo sapiens
caugauauccugacagaga

SEQ ID NO: 432048 - RNA, 19 nt, Homo sapiens
gcguagggcucugaacauu

SEQ ID NO: 432049 - RNA, 19 nt, Homo sapiens
ugauauaagugaagaugga

SEQ ID NO: 432050 - RNA, 19 nt, Homo sapiens
cuacucaagguaaacauua

SEQ ID NO: 432051 - RNA, 19 nt, Homo sapiens
gacauugaguacaggcuuu

SEQ ID NO: 432052 - RNA, 19 nt, Homo sapiens
gaugagcugaauccucuua

SEQ ID NO: 432053 - RNA, 19 nt, Homo sapiens
ccucauugcugcauuucaa

SEQ ID NO: 432054 - RNA, 19 nt, Homo sapiens
aagugaagauggaaugaaa

SEQ ID NO: 432055 - RNA, 19 nt, Homo sapiens
gguuggcacugcaugauau

SEQ ID NO: 432056 - RNA, 19 nt, Homo sapiens
ugaaagcacuagucacucu

SEQ ID NO: 432057 - RNA, 19 nt, Homo sapiens
ggccacagacccugaauga

SEQ ID NO: 432058 - RNA, 19 nt, Homo sapiens
ugagaagaguaauugagaa

SEQ ID NO: 432059 - RNA, 19 nt, Homo sapiens
gaauuagccuaccccauuu

SEQ ID NO: 432060 - RNA, 19 nt, Homo sapiens
guagggcucugaacauuuu

SEQ ID NO: 432061 - RNA, 19 nt, Homo sapiens
ggaagaagagaaaguugau

SEQ ID NO: 432062 - RNA, 19 nt, Homo sapiens
acaagugacucuuccuuag

SEQ ID NO: 432063 - RNA, 19 nt, Homo sapiens
gaggaugggcaggcauuua

SEQ ID NO: 432064 - RNA, 19 nt, Homo sapiens
ucucagggcucagcaguga

SEQ ID NO: 432065 - RNA, 19 nt, Homo sapiens
ugagggccauucacaauuc

SEQ ID NO: 432066 - RNA, 19 nt, Homo sapiens
gaguugacuuuccaucuuc

SEQ ID NO: 432067 - RNA, 19 nt, Homo sapiens
gaacaugucguggaagaag

SEQ ID NO: 432068 - RNA, 19 nt, Homo sapiens
gguugagccugacuguaaa

SEQ ID NO: 432069 - RNA, 19 nt, Homo sapiens
agaggacaguuccaggaua

SEQ ID NO: 432070 - RNA, 19 nt, Homo sapiens
gagcugaauccucuuacuu

SEQ ID NO: 432071 - RNA, 19 nt, Homo sapiens
cauccuagccugugcgaaa

SEQ ID NO: 432072 - RNA, 19 nt, Homo sapiens
gguggcagaggcuguauaa

SEQ ID NO: 432073 - RNA, 19 nt, Homo sapiens
agaguugacuuuccaucuu

SEQ ID NO: 432074 - RNA, 19 nt, Homo sapiens
gcgaaacagcuauauaaag

SEQ ID NO: 432075 - RNA, 19 nt, Homo sapiens
cgucuggccgaaacuauua

SEQ ID NO: 432076 - RNA, 19 nt, Homo sapiens
gcauugugucuguaucuaa

SEQ ID NO: 432077 - RNA, 19 nt, Homo sapiens
ucuaauauuuggcauugug

SEQ ID NO: 432078 - RNA, 19 nt, Homo sapiens
gagcaccaauauggccuuu

SEQ ID NO: 432079 - RNA, 19 nt, Homo sapiens
aaccuucugucucuaauau

SEQ ID NO: 432080 - RNA, 19 nt, Homo sapiens
caagugacucuuccuuaga

SEQ ID NO: 432081 - RNA, 19 nt, Homo sapiens
ugauguguaugauaggaaa

SEQ ID NO: 432082 - RNA, 19 nt, Homo sapiens
caccacagccuacagaaau

SEQ ID NO: 432083 - RNA, 19 nt, Homo sapiens
uggaacaugucguggaaga

SEQ ID NO: 432084 - RNA, 19 nt, Homo sapiens
gaaaaccuucugucucuaa

SEQ ID NO: 432085 - RNA, 19 nt, Homo sapiens
uacaagugacucuuccuua

SEQ ID NO: 432086 - RNA, 19 nt, Homo sapiens
cagaaauauuacagaguug

SEQ ID NO: 432087 - RNA, 19 nt, Homo sapiens
gccgaaacuauuauacuuu

SEQ ID NO: 432088 - RNA, 19 nt, Homo sapiens
ggacaggcaagacaucuac

SEQ ID NO: 432089 - RNA, 19 nt, Homo sapiens
gagaggaugggcaggcauu

SEQ ID NO: 432090 - RNA, 19 nt, Homo sapiens
uggacuggauguugaauca

SEQ ID NO: 432091 - RNA, 19 nt, Homo sapiens
ccuggaacaugucguggaa

SEQ ID NO: 432092 - RNA, 19 nt, Homo sapiens
uagcacaaggacaauauuu

SEQ ID NO: 432093 - RNA, 19 nt, Homo sapiens
cauugugucuguaucuaau

SEQ ID NO: 432094 - RNA, 19 nt, Homo sapiens
ggaacagaagacuuucaaa

SEQ ID NO: 432095 - RNA, 19 nt, Homo sapiens
gaguaccauucagaaguuu

SEQ ID NO: 432096 - RNA, 19 nt, Homo sapiens
cuagugaucuuggaugaag

SEQ ID NO: 432097 - RNA, 19 nt, Homo sapiens
gcuagcacaaggacaauau

SEQ ID NO: 432098 - RNA, 19 nt, Homo sapiens
gacuuuccaucuucaguuc

SEQ ID NO: 432099 - RNA, 19 nt, Homo sapiens
cacagacccugaaugaucu

SEQ ID NO: 432100 - RNA, 19 nt, Homo sapiens
ggcauugugucuguaucua

SEQ ID NO: 432101 - RNA, 19 nt, Homo sapiens
ugcaugauauccugacaga

SEQ ID NO: 432102 - RNA, 19 nt, Homo sapiens
agucagacauugccaacau

SEQ ID NO: 432103 - RNA, 19 nt, Homo sapiens
ggcacccgcucaagucaga

SEQ ID NO: 432104 - RNA, 19 nt, Homo sapiens
cuuuagaugcuguucuuua

SEQ ID NO: 432105 - RNA, 19 nt, Homo sapiens
ggacgucuggccgaaacua

SEQ ID NO: 432106 - RNA, 19 nt, Homo sapiens
gaagaccgacugccacacu

SEQ ID NO: 432107 - RNA, 19 nt, Homo sapiens
gacagagauacacuuguuu

SEQ ID NO: 432108 - RNA, 19 nt, Homo sapiens
ccuucugucucuaauauca

SEQ ID NO: 432109 - RNA, 19 nt, Homo sapiens
ccuccuggcuggcuguguu

SEQ ID NO: 432110 - RNA, 19 nt, Homo sapiens
agguugagccugacuguaa

SEQ ID NO: 432111 - RNA, 19 nt, Homo sapiens
ggaugggcaggcauuuaaa

SEQ ID NO: 432112 - RNA, 19 nt, Homo sapiens
cauuucaagucaccagaga

SEQ ID NO: 432113 - RNA, 19 nt, Homo sapiens
uggcagacauugaguacag

SEQ ID NO: 432114 - RNA, 19 nt, Homo sapiens
guaccauucagaaguuuau

SEQ ID NO: 432115 - RNA, 19 nt, Homo sapiens
accacagccuacagaaaua

SEQ ID NO: 432116 - RNA, 19 nt, Homo sapiens
gcacuagucacucuuucca

SEQ ID NO: 432117 - RNA, 19 nt, Homo sapiens
gagaaaguugauauaagug

SEQ ID NO: 432118 - RNA, 19 nt, Homo sapiens
ccagaaugccuugagaaga

SEQ ID NO: 432119 - RNA, 19 nt, Homo sapiens
gcuagaaagaugcugacuu

SEQ ID NO: 432120 - RNA, 19 nt, Homo sapiens
guaaugagauguaucaaga

SEQ ID NO: 432121 - RNA, 19 nt, Homo sapiens
gaucacaccuccagauuug

SEQ ID NO: 432122 - RNA, 19 nt, Homo sapiens
acacaucgcuggagggaua

SEQ ID NO: 432123 - RNA, 19 nt, Homo sapiens
uaagagaggcucaguuaua

SEQ ID NO: 432124 - RNA, 19 nt, Homo sapiens
gagcagggcugaaagaauc

SEQ ID NO: 432125 - RNA, 19 nt, Homo sapiens
gaaggauucugggacaaua

SEQ ID NO: 432126 - RNA, 19 nt, Homo sapiens
ggauaaagaguauggauaa

SEQ ID NO: 432127 - RNA, 19 nt, Homo sapiens
gaccauaggugucugugaa

SEQ ID NO: 432128 - RNA, 19 nt, Homo sapiens
gaagauuguuugggaguuu

SEQ ID NO: 432129 - RNA, 19 nt, Homo sapiens
gcugaacucuugagccuaa

SEQ ID NO: 432130 - RNA, 19 nt, Homo sapiens
uaaagaagccuguaugugu

SEQ ID NO: 432131 - RNA, 19 nt, Homo sapiens
caagacauccuagaaauaa

SEQ ID NO: 432132 - RNA, 19 nt, Homo sapiens
gcagcuguaucacuccuua

SEQ ID NO: 432133 - RNA, 19 nt, Homo sapiens
ccaacuccauccucuguua

SEQ ID NO: 432134 - RNA, 19 nt, Homo sapiens
caaugucucugccuuugua

SEQ ID NO: 432135 - RNA, 19 nt, Homo sapiens
gcuguuggcuguaauccua

SEQ ID NO: 432136 - RNA, 19 nt, Homo sapiens
ccaccucuguuaugagaua

SEQ ID NO: 432137 - RNA, 19 nt, Homo sapiens
cuaaagcaguucacagaaa

SEQ ID NO: 432138 - RNA, 19 nt, Homo sapiens
agaaccagcucgaccauuu

SEQ ID NO: 432139 - RNA, 19 nt, Homo sapiens
ggcuagggcuccuuucuaa

SEQ ID NO: 432140 - RNA, 19 nt, Homo sapiens
ggcacgagcugaacucuug

SEQ ID NO: 432141 - RNA, 19 nt, Homo sapiens
gaaccagcucgaccauuua

SEQ ID NO: 432142 - RNA, 19 nt, Homo sapiens
caacgugacccaacuggua

SEQ ID NO: 432143 - RNA, 19 nt, Homo sapiens
cagcauggcucccuuuauc

SEQ ID NO: 432144 - RNA, 19 nt, Homo sapiens
ggagaaaauccaagaauua

SEQ ID NO: 432145 - RNA, 19 nt, Homo sapiens
ggacaauauuccagggauu

SEQ ID NO: 432146 - RNA, 19 nt, Homo sapiens
aaagaagccuguauguguu

SEQ ID NO: 432147 - RNA, 19 nt, Homo sapiens
aaugaaagguguauucuag

SEQ ID NO: 432148 - RNA, 19 nt, Homo sapiens
ggagagccguucaagauac

SEQ ID NO: 432149 - RNA, 19 nt, Homo sapiens
gcagucagauauggagaaa

SEQ ID NO: 432150 - RNA, 19 nt, Homo sapiens
ucuguucucuucauucuaa

SEQ ID NO: 432151 - RNA, 19 nt, Homo sapiens
gaauugaccaugcuuaagu

SEQ ID NO: 432152 - RNA, 19 nt, Homo sapiens
ccaugcagauugugaaaug

SEQ ID NO: 432153 - RNA, 19 nt, Homo sapiens
cuagaucccuuaccaguca

SEQ ID NO: 432154 - RNA, 19 nt, Homo sapiens
gcucuuaccuccccaauga

SEQ ID NO: 432155 - RNA, 19 nt, Homo sapiens
gggauucauugacuucuug

SEQ ID NO: 432156 - RNA, 19 nt, Homo sapiens
gcuauuugcugucauuucu

SEQ ID NO: 432157 - RNA, 19 nt, Homo sapiens
ugaaagguguauucuagug

SEQ ID NO: 432158 - RNA, 19 nt, Homo sapiens
ucaagacauccuagaaaua

SEQ ID NO: 432159 - RNA, 19 nt, Homo sapiens
ggcaagugcgguacaguua

SEQ ID NO: 432160 - RNA, 19 nt, Homo sapiens
gggauaaagaguauggaua

SEQ ID NO: 432161 - RNA, 19 nt, Homo sapiens
ccaguucucuugcaacauc

SEQ ID NO: 432162 - RNA, 19 nt, Homo sapiens
gauccucucugauaaucug

SEQ ID NO: 432163 - RNA, 19 nt, Homo sapiens
cuaacaaccuagacuggaa

SEQ ID NO: 432164 - RNA, 19 nt, Homo sapiens
uaaaggagcaugaguaucg

SEQ ID NO: 432165 - RNA, 19 nt, Homo sapiens
gggaauugaccaugcuuaa

SEQ ID NO: 432166 - RNA, 19 nt, Homo sapiens
gaacagcgaaccggagaga

SEQ ID NO: 432167 - RNA, 19 nt, Homo sapiens
caagauacuuccagcuucu

SEQ ID NO: 432168 - RNA, 19 nt, Homo sapiens
ucacagcuggguauccuua

SEQ ID NO: 432169 - RNA, 19 nt, Homo sapiens
ggaucacaccuccagauuu

SEQ ID NO: 432170 - RNA, 19 nt, Homo sapiens
gaguauggauaaucuuugg

SEQ ID NO: 432171 - RNA, 19 nt, Homo sapiens
uaucaagacauccuagaaa

SEQ ID NO: 432172 - RNA, 19 nt, Homo sapiens
ggugaggucuccuucuaca

SEQ ID NO: 432173 - RNA, 19 nt, Homo sapiens
ucaaggagcaaauccagaa

SEQ ID NO: 432174 - RNA, 19 nt, Homo sapiens
gccauuggaucaugagaca

SEQ ID NO: 432175 - RNA, 19 nt, Homo sapiens
auuaagagaggcucaguua

SEQ ID NO: 432176 - RNA, 19 nt, Homo sapiens
gggcagaucacuucaagca

SEQ ID NO: 432177 - RNA, 19 nt, Homo sapiens
ggauguccauguucucuac

SEQ ID NO: 432178 - RNA, 19 nt, Homo sapiens
aaagggcuguuggcuguaa

SEQ ID NO: 432179 - RNA, 19 nt, Homo sapiens
gguaugggaaagaauauug

SEQ ID NO: 432180 - RNA, 19 nt, Homo sapiens
uaaagcaguucacagaaaa

SEQ ID NO: 432181 - RNA, 19 nt, Homo sapiens
gagcuagacuuggccaucu

SEQ ID NO: 432182 - RNA, 19 nt, Homo sapiens
ugacccaacugguaaagca

SEQ ID NO: 432183 - RNA, 19 nt, Homo sapiens
ucgcucagcuagaagagaa

SEQ ID NO: 432184 - RNA, 19 nt, Homo sapiens
ucucugccuuuguaucuuu

SEQ ID NO: 432185 - RNA, 19 nt, Homo sapiens
gaggugaauucaggccaaa

SEQ ID NO: 432186 - RNA, 19 nt, Homo sapiens
cccgagagguucaaucugu

SEQ ID NO: 432187 - RNA, 19 nt, Homo sapiens
caucuacaauagcaucaau

SEQ ID NO: 432188 - RNA, 19 nt, Homo sapiens
ggaacaggcacgagcugaa

SEQ ID NO: 432189 - RNA, 19 nt, Homo sapiens
gggcuagggcuccuuucua

SEQ ID NO: 432190 - RNA, 19 nt, Homo sapiens
ugugaaauguaaugagaug

SEQ ID NO: 432191 - RNA, 19 nt, Homo sapiens
ugucacaccuucacuuucu

SEQ ID NO: 432192 - RNA, 19 nt, Homo sapiens
guuacuagaucccuuacca

SEQ ID NO: 432193 - RNA, 19 nt, Homo sapiens
gcuccuuucuaacaaccua

SEQ ID NO: 432194 - RNA, 19 nt, Homo sapiens
gagacauuauugggaggua

SEQ ID NO: 432195 - RNA, 19 nt, Homo sapiens
cggagagucuaaagcaguu

SEQ ID NO: 432196 - RNA, 19 nt, Homo sapiens
gagagggagaagauuguuu

SEQ ID NO: 432197 - RNA, 19 nt, Homo sapiens
gauaauauucugcccaacu

SEQ ID NO: 432198 - RNA, 19 nt, Homo sapiens
cuggugaggucuccuucua

SEQ ID NO: 432199 - RNA, 19 nt, Homo sapiens
gggcagugucuuuguggua

SEQ ID NO: 432200 - RNA, 19 nt, Homo sapiens
gccugauccucucugauaa

SEQ ID NO: 432201 - RNA, 19 nt, Homo sapiens
aagagaggcucaguuauac

SEQ ID NO: 432202 - RNA, 19 nt, Homo sapiens
caauaaugguggguaaugg

SEQ ID NO: 432203 - RNA, 19 nt, Homo sapiens
gcuggagggauaaagagua

SEQ ID NO: 432204 - RNA, 19 nt, Homo sapiens
ggcagugucuuugugguau

SEQ ID NO: 432205 - RNA, 19 nt, Homo sapiens
guacgugccccucuguuua

SEQ ID NO: 432206 - RNA, 19 nt, Homo sapiens
ggcuuugucuguucucuuc

SEQ ID NO: 432207 - RNA, 19 nt, Homo sapiens
ccaccuccaguguuucaua

SEQ ID NO: 432208 - RNA, 19 nt, Homo sapiens
gacuuggccaucuacaaua

SEQ ID NO: 432209 - RNA, 19 nt, Homo sapiens
ggaaggauucugggacaau

SEQ ID NO: 432210 - RNA, 19 nt, Homo sapiens
guaucaagacauccuagaa

SEQ ID NO: 432211 - RNA, 19 nt, Homo sapiens
cauguucucuaccauccuu

SEQ ID NO: 432212 - RNA, 19 nt, Homo sapiens
gcagugucuuugugguaug

SEQ ID NO: 432213 - RNA, 19 nt, Homo sapiens
uuaagugcauccuaucaag

SEQ ID NO: 432214 - RNA, 19 nt, Homo sapiens
ccaaugugccauaguuuua

SEQ ID NO: 432215 - RNA, 19 nt, Homo sapiens
aaugagauguaucaagaca

SEQ ID NO: 432216 - RNA, 19 nt, Homo sapiens
agguagaggugggagauaa

SEQ ID NO: 432217 - RNA, 19 nt, Homo sapiens
cgagagguucaaucuguuu

SEQ ID NO: 432218 - RNA, 19 nt, Homo sapiens
agccugauccucucugaua

SEQ ID NO: 432219 - RNA, 19 nt, Homo sapiens
cgacugcggccauaacauc

SEQ ID NO: 432220 - RNA, 19 nt, Homo sapiens
guaaugagauguaucaaga

SEQ ID NO: 432221 - RNA, 19 nt, Homo sapiens
gaucacaccuccagauuug

SEQ ID NO: 432222 - RNA, 19 nt, Homo sapiens
acacaucgcuggagggaua

SEQ ID NO: 432223 - RNA, 19 nt, Homo sapiens
uaagagaggcucaguuaua

SEQ ID NO: 432224 - RNA, 19 nt, Homo sapiens
gagcagggcugaaagaauc

SEQ ID NO: 432225 - RNA, 19 nt, Homo sapiens
gaaggauucugggacaaua

SEQ ID NO: 432226 - RNA, 19 nt, Homo sapiens
ggauaaagaguauggauaa

SEQ ID NO: 432227 - RNA, 19 nt, Homo sapiens
gaagauuguuugggaguuu

SEQ ID NO: 432228 - RNA, 19 nt, Homo sapiens
gcugaacucuugagccuaa

SEQ ID NO: 432229 - RNA, 19 nt, Homo sapiens
uaaagaagccuguaugugu

SEQ ID NO: 432230 - RNA, 19 nt, Homo sapiens
caagacauccuagaaauaa

SEQ ID NO: 432231 - RNA, 19 nt, Homo sapiens
gcagcuguaucacuccuua

SEQ ID NO: 432232 - RNA, 19 nt, Homo sapiens
ccaacuccauccucuguua

SEQ ID NO: 432233 - RNA, 19 nt, Homo sapiens
caaugucucugccuuugua

SEQ ID NO: 432234 - RNA, 19 nt, Homo sapiens
gcuguuggcuguaauccua

SEQ ID NO: 432235 - RNA, 19 nt, Homo sapiens
ccaccucuguuaugagaua

SEQ ID NO: 432236 - RNA, 19 nt, Homo sapiens
cuaaagcaguucacagaaa

SEQ ID NO: 432237 - RNA, 19 nt, Homo sapiens
agaaccagcucgaccauuu

SEQ ID NO: 432238 - RNA, 19 nt, Homo sapiens
ggcuagggcuccuuucuaa

SEQ ID NO: 432239 - RNA, 19 nt, Homo sapiens
ggcacgagcugaacucuug

SEQ ID NO: 432240 - RNA, 19 nt, Homo sapiens
gaaccagcucgaccauuua

SEQ ID NO: 432241 - RNA, 19 nt, Homo sapiens
caacgugacccaacuggua

SEQ ID NO: 432242 - RNA, 19 nt, Homo sapiens
cagcauggcucccuuuauc

SEQ ID NO: 432243 - RNA, 19 nt, Homo sapiens
ggagaaaauccaagaauua

SEQ ID NO: 432244 - RNA, 19 nt, Homo sapiens
ggacaauauuccagggauu

SEQ ID NO: 432245 - RNA, 19 nt, Homo sapiens
aaagaagccuguauguguu

SEQ ID NO: 432246 - RNA, 19 nt, Homo sapiens
aaugaaagguguauucuag

SEQ ID NO: 432247 - RNA, 19 nt, Homo sapiens
ggagagccguucaagauac

SEQ ID NO: 432248 - RNA, 19 nt, Homo sapiens
gcagucagauauggagaaa

SEQ ID NO: 432249 - RNA, 19 nt, Homo sapiens
ucuguucucuucauucuaa

SEQ ID NO: 432250 - RNA, 19 nt, Homo sapiens
gaauugaccaugcuuaagu

SEQ ID NO: 432251 - RNA, 19 nt, Homo sapiens
ccaugcagauugugaaaug

SEQ ID NO: 432252 - RNA, 19 nt, Homo sapiens
cuagaucccuuaccaguca

SEQ ID NO: 432253 - RNA, 19 nt, Homo sapiens
gggauucauugacuucuug

SEQ ID NO: 432254 - RNA, 19 nt, Homo sapiens
gcuauuugcugucauuucu

SEQ ID NO: 432255 - RNA, 19 nt, Homo sapiens
ugaaagguguauucuagug

SEQ ID NO: 432256 - RNA, 19 nt, Homo sapiens
ucaagacauccuagaaaua

SEQ ID NO: 432257 - RNA, 19 nt, Homo sapiens
ggcaagugcgguacaguua

SEQ ID NO: 432258 - RNA, 19 nt, Homo sapiens
gggauaaagaguauggaua

SEQ ID NO: 432259 - RNA, 19 nt, Homo sapiens
ccaguucucuugcaacauc

SEQ ID NO: 432260 - RNA, 19 nt, Homo sapiens
gauccucucugauaaucug

SEQ ID NO: 432261 - RNA, 19 nt, Homo sapiens
cuaacaaccuagacuggaa

SEQ ID NO: 432262 - RNA, 19 nt, Homo sapiens
uaaaggagcaugaguaucg

SEQ ID NO: 432263 - RNA, 19 nt, Homo sapiens
gggaauugaccaugcuuaa

SEQ ID NO: 432264 - RNA, 19 nt, Homo sapiens
caagauacuuccagcuucu

SEQ ID NO: 432265 - RNA, 19 nt, Homo sapiens
gaacagcgaaccggagaga

SEQ ID NO: 432266 - RNA, 19 nt, Homo sapiens
ucacagcuggguauccuua

SEQ ID NO: 432267 - RNA, 19 nt, Homo sapiens
ggaucacaccuccagauuu

SEQ ID NO: 432268 - RNA, 19 nt, Homo sapiens
gaguauggauaaucuuugg

SEQ ID NO: 432269 - RNA, 19 nt, Homo sapiens
uaucaagacauccuagaaa

SEQ ID NO: 432270 - RNA, 19 nt, Homo sapiens
ucaaggagcaaauccagaa

SEQ ID NO: 432271 - RNA, 19 nt, Homo sapiens
gccauuggaucaugagaca

SEQ ID NO: 432272 - RNA, 19 nt, Homo sapiens
auuaagagaggcucaguua

SEQ ID NO: 432273 - RNA, 19 nt, Homo sapiens
gggcagaucacuucaagca

SEQ ID NO: 432274 - RNA, 19 nt, Homo sapiens
ggauguccauguucucuac

SEQ ID NO: 432275 - RNA, 19 nt, Homo sapiens
aaagggcuguuggcuguaa

SEQ ID NO: 432276 - RNA, 19 nt, Homo sapiens
uaaagcaguucacagaaaa

SEQ ID NO: 432277 - RNA, 19 nt, Homo sapiens
gagcuagacuuggccaucu

SEQ ID NO: 432278 - RNA, 19 nt, Homo sapiens
ugacccaacugguaaagca

SEQ ID NO: 432279 - RNA, 19 nt, Homo sapiens
ucgcucagcuagaagagaa

SEQ ID NO: 432280 - RNA, 19 nt, Homo sapiens
ucucugccuuuguaucuuu

SEQ ID NO: 432281 - RNA, 19 nt, Homo sapiens
gaggugaauucaggccaaa

SEQ ID NO: 432282 - RNA, 19 nt, Homo sapiens
caucuacaauagcaucaau

SEQ ID NO: 432283 - RNA, 19 nt, Homo sapiens
ggaacaggcacgagcugaa

SEQ ID NO: 432284 - RNA, 19 nt, Homo sapiens
gggcuagggcuccuuucua

SEQ ID NO: 432285 - RNA, 19 nt, Homo sapiens
ugugaaauguaaugagaug

SEQ ID NO: 432286 - RNA, 19 nt, Homo sapiens
ugucacaccuucacuuucu

SEQ ID NO: 432287 - RNA, 19 nt, Homo sapiens
guuacuagaucccuuacca

SEQ ID NO: 432288 - RNA, 19 nt, Homo sapiens
gcuccuuucuaacaaccua

SEQ ID NO: 432289 - RNA, 19 nt, Homo sapiens
cggagagucuaaagcaguu

SEQ ID NO: 432290 - RNA, 19 nt, Homo sapiens
gagagggagaagauuguuu

SEQ ID NO: 432291 - RNA, 19 nt, Homo sapiens
gauaauauucugcccaacu

SEQ ID NO: 432292 - RNA, 19 nt, Homo sapiens
gccugauccucucugauaa

SEQ ID NO: 432293 - RNA, 19 nt, Homo sapiens
aagagaggcucaguuauac

SEQ ID NO: 432294 - RNA, 19 nt, Homo sapiens
caauaaugguggguaaugg

SEQ ID NO: 432295 - RNA, 19 nt, Homo sapiens
gcuggagggauaaagagua

SEQ ID NO: 432296 - RNA, 19 nt, Homo sapiens
guacgugccccucuguuua

SEQ ID NO: 432297 - RNA, 19 nt, Homo sapiens
ggcuuugucuguucucuuc

SEQ ID NO: 432298 - RNA, 19 nt, Homo sapiens
ccaccuccaguguuucaua

SEQ ID NO: 432299 - RNA, 19 nt, Homo sapiens
gacuuggccaucuacaaua

SEQ ID NO: 432300 - RNA, 19 nt, Homo sapiens
ggaaggauucugggacaau

SEQ ID NO: 432301 - RNA, 19 nt, Homo sapiens
guaucaagacauccuagaa

SEQ ID NO: 432302 - RNA, 19 nt, Homo sapiens
cauguucucuaccauccuu

SEQ ID NO: 432303 - RNA, 19 nt, Homo sapiens
uuaagugcauccuaucaag

SEQ ID NO: 432304 - RNA, 19 nt, Homo sapiens
ccaaugugccauaguuuua

SEQ ID NO: 432305 - RNA, 19 nt, Homo sapiens
aaugagauguaucaagaca

SEQ ID NO: 432306 - RNA, 19 nt, Homo sapiens
agccugauccucucugaua

SEQ ID NO: 432307 - RNA, 19 nt, Homo sapiens
cgacugcggccauaacauc

SEQ ID NO: 432308 - RNA, 19 nt, Homo sapiens
ugacggagagucuaaagca

SEQ ID NO: 432309 - RNA, 19 nt, Homo sapiens
ucacccaguucucuugcaa

SEQ ID NO: 432310 - RNA, 19 nt, Homo sapiens
agacuuggccaucuacaau

SEQ ID NO: 432311 - RNA, 19 nt, Homo sapiens
cauccucuguuacuagauc

SEQ ID NO: 432312 - RNA, 19 nt, Homo sapiens
caaccuagacuggaauaag

SEQ ID NO: 432313 - RNA, 19 nt, Homo sapiens
uggagagccguucaagaua

SEQ ID NO: 432314 - RNA, 19 nt, Homo sapiens
ggagggauaaagaguaugg

SEQ ID NO: 432315 - RNA, 19 nt, Homo sapiens
cuggagggauaaagaguau

SEQ ID NO: 432316 - RNA, 19 nt, Homo sapiens
cuccaguguuucauacuuu

SEQ ID NO: 432317 - RNA, 19 nt, Homo sapiens
ugcagauugugaaauguaa

SEQ ID NO: 432318 - RNA, 19 nt, Homo sapiens
ggaauugaccaugcuuaag

SEQ ID NO: 432319 - RNA, 19 nt, Homo sapiens
gagagccguucaagauacu

SEQ ID NO: 432320 - RNA, 19 nt, Homo sapiens
ggacauggcugcacucuuc

SEQ ID NO: 432321 - RNA, 19 nt, Homo sapiens
gggaugugcuugaguguuu

SEQ ID NO: 432322 - RNA, 19 nt, Homo sapiens
guucacaucuuguuuccua

SEQ ID NO: 432323 - RNA, 19 nt, Homo sapiens
ggaacgcucuacucgguaa

SEQ ID NO: 432324 - RNA, 19 nt, Homo sapiens
ucaauucacugcagaagga

SEQ ID NO: 432325 - RNA, 19 nt, Homo sapiens
caauagaacuucaaaucuc

SEQ ID NO: 432326 - RNA, 19 nt, Homo sapiens
gauuugacguguccauuug

SEQ ID NO: 432327 - RNA, 19 nt, Homo sapiens
gaaggugguucccaugucu

SEQ ID NO: 432328 - RNA, 19 nt, Homo sapiens
ggacaauucaugauuauac

SEQ ID NO: 432329 - RNA, 19 nt, Homo sapiens
gugacuuucuuucccaaua

SEQ ID NO: 432330 - RNA, 19 nt, Homo sapiens
caucuuguuuccuauagaa

SEQ ID NO: 432331 - RNA, 19 nt, Homo sapiens
uugaguaucuguccuguga

SEQ ID NO: 432332 - RNA, 19 nt, Homo sapiens
cgacacagccaacaacuuc

SEQ ID NO: 432333 - RNA, 19 nt, Homo sapiens
cuucguagaccgcaaguua

SEQ ID NO: 432334 - RNA, 19 nt, Homo sapiens
gguaaaagcguuauacaaa

SEQ ID NO: 432335 - RNA, 19 nt, Homo sapiens
cuacuuugcuguugcuguu

SEQ ID NO: 432336 - RNA, 19 nt, Homo sapiens
gaggcuggcuucccacauc

SEQ ID NO: 432337 - RNA, 19 nt, Homo sapiens
gaugauucgugacuuucuu

SEQ ID NO: 432338 - RNA, 19 nt, Homo sapiens
guucagagcacagugauga

SEQ ID NO: 432339 - RNA, 19 nt, Homo sapiens
gcaaagggaggauccaucu

SEQ ID NO: 432340 - RNA, 19 nt, Homo sapiens
gaccuuggaugccgacaca

SEQ ID NO: 432341 - RNA, 19 nt, Homo sapiens
ugacuuuccucuucguaga

SEQ ID NO: 432342 - RNA, 19 nt, Homo sapiens
aaagggaggauccaucuga

SEQ ID NO: 432343 - RNA, 19 nt, Homo sapiens
gcuguuccauggucucuca

SEQ ID NO: 432344 - RNA, 19 nt, Homo sapiens
ucacaucuuguuuccuaua

SEQ ID NO: 432345 - RNA, 19 nt, Homo sapiens
ccaauagaacuucaaaucu

SEQ ID NO: 432346 - RNA, 19 nt, Homo sapiens
augggacaauucaugauua

SEQ ID NO: 432347 - RNA, 19 nt, Homo sapiens
gauucuggacugugaguuu

SEQ ID NO: 432348 - RNA, 19 nt, Homo sapiens
gaggaucuacuuugcuguu

SEQ ID NO: 432349 - RNA, 19 nt, Homo sapiens
gcucagacuaucuagagaa

SEQ ID NO: 432350 - RNA, 19 nt, Homo sapiens
cauugagucuuaugguuca

SEQ ID NO: 432351 - RNA, 19 nt, Homo sapiens
guaaaagcguuauacaaag

SEQ ID NO: 432352 - RNA, 19 nt, Homo sapiens
ugacuuucuuucccaauag

SEQ ID NO: 432353 - RNA, 19 nt, Homo sapiens
agugaugauucgugacuuu

SEQ ID NO: 432354 - RNA, 19 nt, Homo sapiens
ucuuaugguucacaucuug

SEQ ID NO: 432355 - RNA, 19 nt, Homo sapiens
cguggauucuggacuguga

SEQ ID NO: 432356 - RNA, 19 nt, Homo sapiens
ugggacaauucaugauuau

SEQ ID NO: 432357 - RNA, 19 nt, Homo sapiens
gaagugggugcaucacaca

SEQ ID NO: 432358 - RNA, 19 nt, Homo sapiens
uccauggucucucagaaga

SEQ ID NO: 432359 - RNA, 19 nt, Homo sapiens
uguauucugggaucaauuu

SEQ ID NO: 432360 - RNA, 19 nt, Homo sapiens
gugggugcaucacacagaa

SEQ ID NO: 432361 - RNA, 19 nt, Homo sapiens
cccaauagaacuucaaauc

SEQ ID NO: 432362 - RNA, 19 nt, Homo sapiens
aaauaugggacaauucaug

SEQ ID NO: 432363 - RNA, 19 nt, Homo sapiens
auacaaagucauaggagaa

SEQ ID NO: 432364 - RNA, 19 nt, Homo sapiens
agcccaagcugaagaagau

SEQ ID NO: 432365 - RNA, 19 nt, Homo sapiens
aauaugggacaauucauga

SEQ ID NO: 432366 - RNA, 19 nt, Homo sapiens
gacuuucuuucccaauaga

SEQ ID NO: 432367 - RNA, 19 nt, Homo sapiens
gccgcugacuuuccucuuc

SEQ ID NO: 432368 - RNA, 19 nt, Homo sapiens
ggaugugcuugaguguuug

SEQ ID NO: 432369 - RNA, 19 nt, Homo sapiens
gagcccaagcugaagaaga

SEQ ID NO: 432370 - RNA, 19 nt, Homo sapiens
guuccauggucucucagaa

SEQ ID NO: 432371 - RNA, 19 nt, Homo sapiens
cucagacuaucuagagaaa

SEQ ID NO: 432372 - RNA, 19 nt, Homo sapiens
ugaaggugguucccauguc

SEQ ID NO: 432373 - RNA, 19 nt, Homo sapiens
gaucuacuuugcuguugcu

SEQ ID NO: 432374 - RNA, 19 nt, Homo sapiens
uaugggacaauucaugauu

SEQ ID NO: 432375 - RNA, 19 nt, Homo sapiens
agauuugacguguccauuu

SEQ ID NO: 432376 - RNA, 19 nt, Homo sapiens
gagauuugacguguccauu

SEQ ID NO: 432377 - RNA, 19 nt, Homo sapiens
gaccuugccgagagauuug

SEQ ID NO: 432378 - RNA, 19 nt, Homo sapiens
ggagccacugcacuuguuu

SEQ ID NO: 432379 - RNA, 19 nt, Homo sapiens
gcaugcagaacguuuccuu

SEQ ID NO: 432380 - RNA, 19 nt, Homo sapiens
ucagagcacagugaugauu

SEQ ID NO: 432381 - RNA, 19 nt, Homo sapiens
uuucuucccuugugcacuu

SEQ ID NO: 432382 - RNA, 19 nt, Homo sapiens
gggacaauucaugauuaua

SEQ ID NO: 432383 - RNA, 19 nt, Homo sapiens
gaggagccacugcacuugu

SEQ ID NO: 432384 - RNA, 19 nt, Homo sapiens
gggaacaagcacagaaugg

SEQ ID NO: 432385 - RNA, 19 nt, Homo sapiens
agaaucuguucaccgcaaa

SEQ ID NO: 432386 - RNA, 19 nt, Homo sapiens
cucauggucuuguucuaga

SEQ ID NO: 432387 - RNA, 19 nt, Homo sapiens
ucacacagaaucggcaaga

SEQ ID NO: 432388 - RNA, 19 nt, Homo sapiens
guuauacaaagucauagga

SEQ ID NO: 432389 - RNA, 19 nt, Homo sapiens
cagacuaucuagagaaacc

SEQ ID NO: 432390 - RNA, 19 nt, Homo sapiens
augaaaagguugucacuug

SEQ ID NO: 432391 - RNA, 19 nt, Homo sapiens
cacaucuuguuuccuauag

SEQ ID NO: 432392 - RNA, 19 nt, Homo sapiens
ucauggucuuguucuagaa

SEQ ID NO: 432393 - RNA, 19 nt, Homo sapiens
ggauggaagccgccucucu

SEQ ID NO: 432394 - RNA, 19 nt, Homo sapiens
cugggagucugcagagaau

SEQ ID NO: 432395 - RNA, 19 nt, Homo sapiens
ugaaaagguugucacuugu

SEQ ID NO: 432396 - RNA, 19 nt, Homo sapiens
ggucuuguucuagaaguga

SEQ ID NO: 432397 - RNA, 19 nt, Homo sapiens
uacaaagucauaggagaaa

SEQ ID NO: 432398 - RNA, 19 nt, Homo sapiens
ccuccaaguccaccuaaug

SEQ ID NO: 432399 - RNA, 19 nt, Homo sapiens
aggagccacugcacuuguu

SEQ ID NO: 432400 - RNA, 19 nt, Homo sapiens
ggagguggacgugggaaca

SEQ ID NO: 432401 - RNA, 19 nt, Homo sapiens
aaguggauaugaccuugga

SEQ ID NO: 432402 - RNA, 19 nt, Homo sapiens
ucaguucagagcacaguga

SEQ ID NO: 432403 - RNA, 19 nt, Homo sapiens
gaaugggaccugggagucu

SEQ ID NO: 432404 - RNA, 19 nt, Homo sapiens
agaccuugccgagagauuu

SEQ ID NO: 432405 - RNA, 19 nt, Homo sapiens
acccaaggaugcggaaguu

SEQ ID NO: 432406 - RNA, 19 nt, Homo sapiens
gaacgcucuacucgguaaa

SEQ ID NO: 432407 - RNA, 19 nt, Homo sapiens
cuaauggugauaagagugu

SEQ ID NO: 432408 - RNA, 19 nt, Homo sapiens
caauaccuuuaugcaugaa

SEQ ID NO: 432409 - RNA, 19 nt, Homo sapiens
gaguguggaugcgcugucu

SEQ ID NO: 432410 - RNA, 19 nt, Homo sapiens
gugcgaaacuguuaacuua

SEQ ID NO: 432411 - RNA, 19 nt, Homo sapiens
gcgaaacuguuaacuuauu

SEQ ID NO: 432412 - RNA, 19 nt, Homo sapiens
caacacaggcguauacuga

SEQ ID NO: 432413 - RNA, 19 nt, Homo sapiens
gggagaagcggaggaauua

SEQ ID NO: 432414 - RNA, 19 nt, Homo sapiens
ggccuuaucuguuccaguu

SEQ ID NO: 432415 - RNA, 19 nt, Homo sapiens
ccugugagauagauguuua

SEQ ID NO: 432416 - RNA, 19 nt, Homo sapiens
gagaagcggaggaauuaaa

SEQ ID NO: 432417 - RNA, 19 nt, Homo sapiens
gcagugccagccagucuua

SEQ ID NO: 432418 - RNA, 19 nt, Homo sapiens
caucauggccuuaucuguu

SEQ ID NO: 432419 - RNA, 19 nt, Homo sapiens
gcagaacaccgcacagauc

SEQ ID NO: 432420 - RNA, 19 nt, Homo sapiens
cgacaaagacgaggaggaa

SEQ ID NO: 432421 - RNA, 19 nt, Homo sapiens
gagccucccugacuucaca

SEQ ID NO: 432422 - RNA, 19 nt, Homo sapiens
cgaaacuguuaacuuauuc

SEQ ID NO: 432423 - RNA, 19 nt, Homo sapiens
caagcgauccggaacuuug

SEQ ID NO: 432424 - RNA, 19 nt, Homo sapiens
gauccaaggcggcuacaug

SEQ ID NO: 432425 - RNA, 19 nt, Homo sapiens
acaauaaauuccgcuguga

SEQ ID NO: 432426 - RNA, 19 nt, Homo sapiens
ggaacacugugaggccauu

SEQ ID NO: 432427 - RNA, 19 nt, Homo sapiens
ccagccaggugcaguaugu

SEQ ID NO: 432428 - RNA, 19 nt, Homo sapiens
gagaagcgacugcccaaag

SEQ ID NO: 432429 - RNA, 19 nt, Homo sapiens
ccucuacugccacuacuua

SEQ ID NO: 432430 - RNA, 19 nt, Homo sapiens
caaaagacgugccuuaagg

SEQ ID NO: 432431 - RNA, 19 nt, Homo sapiens
ccgcacagaucaaccagau

SEQ ID NO: 432432 - RNA, 19 nt, Homo sapiens
ccaugacuauugugcgauu

SEQ ID NO: 432433 - RNA, 19 nt, Homo sapiens
ggaccaagcacugugacaa

SEQ ID NO: 432434 - RNA, 19 nt, Homo sapiens
caaagacgaggaggaagaa

SEQ ID NO: 432435 - RNA, 19 nt, Homo sapiens
gcagcaguaccagcaauuu

SEQ ID NO: 432436 - RNA, 19 nt, Homo sapiens
gcaacuccaaguaccacua

SEQ ID NO: 432437 - RNA, 19 nt, Homo sapiens
gcugcaaacucugacacaa

SEQ ID NO: 432438 - RNA, 19 nt, Homo sapiens
gaacaccgcacagaucaac

SEQ ID NO: 432439 - RNA, 19 nt, Homo sapiens
ucaagcccauccagaagau

SEQ ID NO: 432440 - RNA, 19 nt, Homo sapiens
acaaagacgaggaggaaga

SEQ ID NO: 432441 - RNA, 19 nt, Homo sapiens
cagaacaccgcacagauca

SEQ ID NO: 432442 - RNA, 19 nt, Homo sapiens
ggagaagcggaggaauuaa

SEQ ID NO: 432443 - RNA, 19 nt, Homo sapiens
gcucauccgcuccgucuuc

SEQ ID NO: 432444 - RNA, 19 nt, Homo sapiens
cguggucacugucucugaa

SEQ ID NO: 432445 - RNA, 19 nt, Homo sapiens
ccgcugguuuguaauggaa

SEQ ID NO: 432446 - RNA, 19 nt, Homo sapiens
agauguuuauggcaagaaa

SEQ ID NO: 432447 - RNA, 19 nt, Homo sapiens
acugcccgcugguuuguaa

SEQ ID NO: 432448 - RNA, 19 nt, Homo sapiens
gcacugcccgcugguuugu

SEQ ID NO: 432449 - RNA, 19 nt, Homo sapiens
gcgcugugcugcagaacac

SEQ ID NO: 432450 - RNA, 19 nt, Homo sapiens
guggagacgcuguggaaga

SEQ ID NO: 432451 - RNA, 19 nt, Homo sapiens
cugcaaacucugacacaaa

SEQ ID NO: 432452 - RNA, 19 nt, Homo sapiens
gugcagcaguaccagcaau

SEQ ID NO: 432453 - RNA, 19 nt, Homo sapiens
gcucaagcccauccagaag

SEQ ID NO: 432454 - RNA, 19 nt, Homo sapiens
gagcaggcaccuacgugau

SEQ ID NO: 432455 - RNA, 19 nt, Homo sapiens
uugguaacuuguuggguuu

SEQ ID NO: 432456 - RNA, 19 nt, Homo sapiens
aaagacgugccuuaaggaa

SEQ ID NO: 432457 - RNA, 19 nt, Homo sapiens
agaccggcguuccuacuca

SEQ ID NO: 432458 - RNA, 19 nt, Homo sapiens
gcucuacgacgaguacaug

SEQ ID NO: 432459 - RNA, 19 nt, Homo sapiens
acacaaaagacgugccuua

SEQ ID NO: 432460 - RNA, 19 nt, Homo sapiens
cccaagcgauccggaacuu

SEQ ID NO: 432461 - RNA, 19 nt, Homo sapiens
gugacaacgugcuguacca

SEQ ID NO: 432462 - RNA, 19 nt, Homo sapiens
gcaacacaggcguauacug

SEQ ID NO: 432463 - RNA, 19 nt, Homo sapiens
ugcaaacucugacacaaaa

SEQ ID NO: 432464 - RNA, 19 nt, Homo sapiens
ccacggagcacccucuacu

SEQ ID NO: 432465 - RNA, 19 nt, Homo sapiens
gagcuguuuucuaccuuuu

SEQ ID NO: 432466 - RNA, 19 nt, Homo sapiens
cuagugugccgagcuguuu

SEQ ID NO: 432467 - RNA, 19 nt, Homo sapiens
cauccgcuccgucuucaug

SEQ ID NO: 432468 - RNA, 19 nt, Homo sapiens
agaagcgacugcccaaagc

SEQ ID NO: 432469 - RNA, 19 nt, Homo sapiens
cagaagauggaaggcauga

SEQ ID NO: 432470 - RNA, 19 nt, Homo sapiens
gaccaagcacugugacaac

SEQ ID NO: 432471 - RNA, 19 nt, Homo sapiens
gaacguuucuuaugaaugu

SEQ ID NO: 432472 - RNA, 19 nt, Homo sapiens
ggagugcccuugucuggua

SEQ ID NO: 432473 - RNA, 19 nt, Homo sapiens
gaugugauguuuacuuuga

SEQ ID NO: 432474 - RNA, 19 nt, Homo sapiens
gaccauggguuccuuauuc

SEQ ID NO: 432475 - RNA, 19 nt, Homo sapiens
ggaaggaguuuguccaaca

SEQ ID NO: 432476 - RNA, 19 nt, Homo sapiens
gaaguucucuuuacaacca

SEQ ID NO: 432477 - RNA, 19 nt, Homo sapiens
gcacucaacuggaaccaau

SEQ ID NO: 432478 - RNA, 19 nt, Homo sapiens
ggaauaaucacacuguuug

SEQ ID NO: 432479 - RNA, 19 nt, Homo sapiens
gcaacucgaaguaccauua

SEQ ID NO: 432480 - RNA, 19 nt, Homo sapiens
gcccaaaccuuaguugaaa

SEQ ID NO: 432481 - RNA, 19 nt, Homo sapiens
caagcugguuucugccuua

SEQ ID NO: 432482 - RNA, 19 nt, Homo sapiens
gaaaucagacagaaagaau

SEQ ID NO: 432483 - RNA, 19 nt, Homo sapiens
gaaggcugguugacaaaug

SEQ ID NO: 432484 - RNA, 19 nt, Homo sapiens
gaaagcaguuguugaagcu

SEQ ID NO: 432485 - RNA, 19 nt, Homo sapiens
ugaaagggcugugcugaga

SEQ ID NO: 432486 - RNA, 19 nt, Homo sapiens
cagcacggcuucuuacuuc

SEQ ID NO: 432487 - RNA, 19 nt, Homo sapiens
cuaacgaaaugcaauaguu

SEQ ID NO: 432488 - RNA, 19 nt, Homo sapiens
ccucuuagaugaugugaug

SEQ ID NO: 432489 - RNA, 19 nt, Homo sapiens
ugacaaaugccaugaguga

SEQ ID NO: 432490 - RNA, 19 nt, Homo sapiens
gaaggaaucacaucacaca

SEQ ID NO: 432491 - RNA, 19 nt, Homo sapiens
gaccugagcaugcagaauu

SEQ ID NO: 432492 - RNA, 19 nt, Homo sapiens
gcucacaguuaacggauug

SEQ ID NO: 432493 - RNA, 19 nt, Homo sapiens
gcacuggccucugcacuca

SEQ ID NO: 432494 - RNA, 19 nt, Homo sapiens
aaacaaauauucgggacuu

SEQ ID NO: 432495 - RNA, 19 nt, Homo sapiens
cagcucacguggccuuuaa

SEQ ID NO: 432496 - RNA, 19 nt, Homo sapiens
gaaggaaagcaguuguuga

SEQ ID NO: 432497 - RNA, 19 nt, Homo sapiens
guacauugcaguauauuca

SEQ ID NO: 432498 - RNA, 19 nt, Homo sapiens
caaaccaacugcagagaag

SEQ ID NO: 432499 - RNA, 19 nt, Homo sapiens
gaaccaauuuucaccauga

SEQ ID NO: 432500 - RNA, 19 nt, Homo sapiens
ggaaucacaucacacaaaa

SEQ ID NO: 432501 - RNA, 19 nt, Homo sapiens
ucguauagcccaaaccuua

SEQ ID NO: 432502 - RNA, 19 nt, Homo sapiens
ggacgcgauuucuaacgaa

SEQ ID NO: 432503 - RNA, 19 nt, Homo sapiens
caaauuagugccucuuaga

SEQ ID NO: 432504 - RNA, 19 nt, Homo sapiens
aaacugauccguucugugu

SEQ ID NO: 432505 - RNA, 19 nt, Homo sapiens
gcuguuggauaauuaugaa

SEQ ID NO: 432506 - RNA, 19 nt, Homo sapiens
gcgaaggaaucacaucaca

SEQ ID NO: 432507 - RNA, 19 nt, Homo sapiens
gggaauaaucacacuguuu

SEQ ID NO: 432508 - RNA, 19 nt, Homo sapiens
ugacacaggccauccguaa

SEQ ID NO: 432509 - RNA, 19 nt, Homo sapiens
uggcagagcccgacuagaa

SEQ ID NO: 432510 - RNA, 19 nt, Homo sapiens
ugacgcugcucgacaaaga

SEQ ID NO: 432511 - RNA, 19 nt, Homo sapiens
gcacugcgaggcaacugua

SEQ ID NO: 432512 - RNA, 19 nt, Homo sapiens
ggucaguguucaagaagga

SEQ ID NO: 432513 - RNA, 19 nt, Homo sapiens
cagaacacgucccagauca

SEQ ID NO: 432514 - RNA, 19 nt, Homo sapiens
gcacagcacuccggaacag

SEQ ID NO: 432515 - RNA, 19 nt, Homo sapiens
gaacagccuacaccuacaa

SEQ ID NO: 432516 - RNA, 19 nt, Homo sapiens
cgaggcaacuguagaugug

SEQ ID NO: 432517 - RNA, 19 nt, Homo sapiens
ggaaacugauccguucugu

SEQ ID NO: 432518 - RNA, 19 nt, Homo sapiens
acacguagccgcugcaguu

SEQ ID NO: 432519 - RNA, 19 nt, Homo sapiens
gaaaguggagugcccuugu

SEQ ID NO: 432520 - RNA, 19 nt, Homo sapiens
caaagacgcgugcucacuu

SEQ ID NO: 432521 - RNA, 19 nt, Homo sapiens
gaacaccucccucugaacu

SEQ ID NO: 432522 - RNA, 19 nt, Homo sapiens
ccucugcacucaacuggaa

SEQ ID NO: 432523 - RNA, 19 nt, Homo sapiens
uagaugaugugauguuuac

SEQ ID NO: 432524 - RNA, 19 nt, Homo sapiens
caacugcagagaagaaaga

SEQ ID NO: 432525 - RNA, 19 nt, Homo sapiens
caaaugccaugagugacuu

SEQ ID NO: 432526 - RNA, 19 nt, Homo sapiens
gaaggaguuuguccaacag

SEQ ID NO: 432527 - RNA, 19 nt, Homo sapiens
ccaaauuagugccucuuag

SEQ ID NO: 432528 - RNA, 19 nt, Homo sapiens
caccggcuccaccaaauua

SEQ ID NO: 432529 - RNA, 19 nt, Homo sapiens
ucaacgaucucgccucucu

SEQ ID NO: 432530 - RNA, 19 nt, Homo sapiens
acaccucccucugaacuaa

SEQ ID NO: 432531 - RNA, 19 nt, Homo sapiens
ccguggagacuguuacuua

SEQ ID NO: 432532 - RNA, 19 nt, Homo sapiens
aaccuuaguugaaaucaga

SEQ ID NO: 432533 - RNA, 19 nt, Homo sapiens
acacagaagguacuaaugu

SEQ ID NO: 432534 - RNA, 19 nt, Homo sapiens
gcagaacacgucccagauc

SEQ ID NO: 432535 - RNA, 19 nt, Homo sapiens
gaaaagcugggaauaauca

SEQ ID NO: 432536 - RNA, 19 nt, Homo sapiens
aaggaaagcaguuguugaa

SEQ ID NO: 432537 - RNA, 19 nt, Homo sapiens
gaugaugugauguuuacuu

SEQ ID NO: 432538 - RNA, 19 nt, Homo sapiens
cggcaguucuugcugaaau

SEQ ID NO: 432539 - RNA, 19 nt, Homo sapiens
acugauccguucuguguuu

SEQ ID NO: 432540 - RNA, 19 nt, Homo sapiens
ccaccuggaccucuucaaa

SEQ ID NO: 432541 - RNA, 19 nt, Homo sapiens
gcagcacggcuucuuacuu

SEQ ID NO: 432542 - RNA, 19 nt, Homo sapiens
auuagugccucuuagauga

SEQ ID NO: 432543 - RNA, 19 nt, Homo sapiens
gacgcgugcucacuuuaga

SEQ ID NO: 432544 - RNA, 19 nt, Homo sapiens
ccaaguuugucuccaugga

SEQ ID NO: 432545 - RNA, 19 nt, Homo sapiens
gauccguucuguguuuaug

SEQ ID NO: 432546 - RNA, 19 nt, Homo sapiens
aaagaacaagccacagaaa

SEQ ID NO: 432547 - RNA, 19 nt, Homo sapiens
gcagauccgcagcucgaaa

SEQ ID NO: 432548 - RNA, 19 nt, Homo sapiens
ccagcagcacggcuucuua

SEQ ID NO: 432549 - RNA, 19 nt, Homo sapiens
aagaugacaugggcgauga

SEQ ID NO: 432550 - RNA, 19 nt, Homo sapiens
caaaagcgguuuacucaac

SEQ ID NO: 432551 - RNA, 19 nt, Homo sapiens
ccaaaccaacugcagagaa

SEQ ID NO: 432552 - RNA, 19 nt, Homo sapiens
ggcagagcccgacuagaaa

SEQ ID NO: 432553 - RNA, 19 nt, Homo sapiens
ggagacuguuacuuaccaa

SEQ ID NO: 432554 - RNA, 19 nt, Homo sapiens
aagccggacucaccacuga

SEQ ID NO: 432555 - RNA, 19 nt, Homo sapiens
gaugggagaguucaacgau

SEQ ID NO: 432556 - RNA, 19 nt, Homo sapiens
gaacacgucccagaucaac

SEQ ID NO: 432557 - RNA, 19 nt, Homo sapiens
guugacaaaugccaugagu

SEQ ID NO: 432558 - RNA, 19 nt, Homo sapiens
cacagaagguacuaauguc

SEQ ID NO: 432559 - RNA, 19 nt, Homo sapiens
ugagugacuucccacaaca

SEQ ID NO: 432560 - RNA, 19 nt, Homo sapiens
uuggaaggcugguugacaa

SEQ ID NO: 432561 - RNA, 19 nt, Homo sapiens
caccagcaguacauagaug

SEQ ID NO: 432562 - RNA, 19 nt, Homo sapiens
gcaccaccagcaguacaua

SEQ ID NO: 432563 - RNA, 19 nt, Homo sapiens
cuguuugucuggucguaua

SEQ ID NO: 432564 - RNA, 19 nt, Homo sapiens
gaauaaucacacuguuugu

SEQ ID NO: 432565 - RNA, 19 nt, Homo sapiens
ucacacagaagguacuaau

SEQ ID NO: 432566 - RNA, 19 nt, Homo sapiens
aaaauucagucccaaaugu

SEQ ID NO: 432567 - RNA, 19 nt, Homo sapiens
cguagccgcugcaguugga

SEQ ID NO: 432568 - RNA, 19 nt, Homo sapiens
aaguuugucuccauggaaa

SEQ ID NO: 432569 - RNA, 19 nt, Homo sapiens
ggaccucuucaaagucaaa

SEQ ID NO: 432570 - RNA, 19 nt, Homo sapiens
gccaggagcacaagcuaga

SEQ ID NO: 432571 - RNA, 19 nt, Homo sapiens
gaacguuucuuaugaaugu

SEQ ID NO: 432572 - RNA, 19 nt, Homo sapiens
ggagugcccuugucuggua

SEQ ID NO: 432573 - RNA, 19 nt, Homo sapiens
gaugugauguuuacuuuga

SEQ ID NO: 432574 - RNA, 19 nt, Homo sapiens
gaccauggguuccuuauuc

SEQ ID NO: 432575 - RNA, 19 nt, Homo sapiens
ggaaggaguuuguccaaca

SEQ ID NO: 432576 - RNA, 19 nt, Homo sapiens
gaaguucucuuuacaacca

SEQ ID NO: 432577 - RNA, 19 nt, Homo sapiens
gcacucaacuggaaccaau

SEQ ID NO: 432578 - RNA, 19 nt, Homo sapiens
ggaauaaucacacuguuug

SEQ ID NO: 432579 - RNA, 19 nt, Homo sapiens
gcaacucgaaguaccauua

SEQ ID NO: 432580 - RNA, 19 nt, Homo sapiens
gcccaaaccuuaguugaaa

SEQ ID NO: 432581 - RNA, 19 nt, Homo sapiens
caagcugguuucugccuua

SEQ ID NO: 432582 - RNA, 19 nt, Homo sapiens
gaaaucagacagaaagaau

SEQ ID NO: 432583 - RNA, 19 nt, Homo sapiens
gaaggcugguugacaaaug

SEQ ID NO: 432584 - RNA, 19 nt, Homo sapiens
gaaagcaguuguugaagcu

SEQ ID NO: 432585 - RNA, 19 nt, Homo sapiens
ugaaagggcugugcugaga

SEQ ID NO: 432586 - RNA, 19 nt, Homo sapiens
cagcacggcuucuuacuuc

SEQ ID NO: 432587 - RNA, 19 nt, Homo sapiens
cuaacgaaaugcaauaguu

SEQ ID NO: 432588 - RNA, 19 nt, Homo sapiens
ccucuuagaugaugugaug

SEQ ID NO: 432589 - RNA, 19 nt, Homo sapiens
ugacaaaugccaugaguga

SEQ ID NO: 432590 - RNA, 19 nt, Homo sapiens
gaccugagcaugcagaauu

SEQ ID NO: 432591 - RNA, 19 nt, Homo sapiens
gcucacaguuaacggauug

SEQ ID NO: 432592 - RNA, 19 nt, Homo sapiens
gcacuggccucugcacuca

SEQ ID NO: 432593 - RNA, 19 nt, Homo sapiens
aaacaaauauucgggacuu

SEQ ID NO: 432594 - RNA, 19 nt, Homo sapiens
cagcucacguggccuuuaa

SEQ ID NO: 432595 - RNA, 19 nt, Homo sapiens
gaaggaaagcaguuguuga

SEQ ID NO: 432596 - RNA, 19 nt, Homo sapiens
guacauugcaguauauuca

SEQ ID NO: 432597 - RNA, 19 nt, Homo sapiens
caaaccaacugcagagaag

SEQ ID NO: 432598 - RNA, 19 nt, Homo sapiens
gaaccaauuuucaccauga

SEQ ID NO: 432599 - RNA, 19 nt, Homo sapiens
ucguauagcccaaaccuua

SEQ ID NO: 432600 - RNA, 19 nt, Homo sapiens
ggacgcgauuucuaacgaa

SEQ ID NO: 432601 - RNA, 19 nt, Homo sapiens
caaauuagugccucuuaga

SEQ ID NO: 432602 - RNA, 19 nt, Homo sapiens
aaacugauccguucugugu

SEQ ID NO: 432603 - RNA, 19 nt, Homo sapiens
gcuguuggauaauuaugaa

SEQ ID NO: 432604 - RNA, 19 nt, Homo sapiens
gggaauaaucacacuguuu

SEQ ID NO: 432605 - RNA, 19 nt, Homo sapiens
ugacacaggccauccguaa

SEQ ID NO: 432606 - RNA, 19 nt, Homo sapiens
uggcagagcccgacuagaa

SEQ ID NO: 432607 - RNA, 19 nt, Homo sapiens
ugacgcugcucgacaaaga

SEQ ID NO: 432608 - RNA, 19 nt, Homo sapiens
gcacugcgaggcaacugua

SEQ ID NO: 432609 - RNA, 19 nt, Homo sapiens
ggucaguguucaagaagga

SEQ ID NO: 432610 - RNA, 19 nt, Homo sapiens
cagaacacgucccagauca

SEQ ID NO: 432611 - RNA, 19 nt, Homo sapiens
gcacagcacuccggaacag

SEQ ID NO: 432612 - RNA, 19 nt, Homo sapiens
gaacagccuacaccuacaa

SEQ ID NO: 432613 - RNA, 19 nt, Homo sapiens
cgaggcaacuguagaugug

SEQ ID NO: 432614 - RNA, 19 nt, Homo sapiens
ggaaacugauccguucugu

SEQ ID NO: 432615 - RNA, 19 nt, Homo sapiens
acacguagccgcugcaguu

SEQ ID NO: 432616 - RNA, 19 nt, Homo sapiens
gaaaguggagugcccuugu

SEQ ID NO: 432617 - RNA, 19 nt, Homo sapiens
caaagacgcgugcucacuu

SEQ ID NO: 432618 - RNA, 19 nt, Homo sapiens
gaacaccucccucugaacu

SEQ ID NO: 432619 - RNA, 19 nt, Homo sapiens
ccucugcacucaacuggaa

SEQ ID NO: 432620 - RNA, 19 nt, Homo sapiens
uagaugaugugauguuuac

SEQ ID NO: 432621 - RNA, 19 nt, Homo sapiens
caacugcagagaagaaaga

SEQ ID NO: 432622 - RNA, 19 nt, Homo sapiens
caaaugccaugagugacuu

SEQ ID NO: 432623 - RNA, 19 nt, Homo sapiens
gaaggaguuuguccaacag

SEQ ID NO: 432624 - RNA, 19 nt, Homo sapiens
ccaaauuagugccucuuag

SEQ ID NO: 432625 - RNA, 19 nt, Homo sapiens
caccggcuccaccaaauua

SEQ ID NO: 432626 - RNA, 19 nt, Homo sapiens
ucaacgaucucgccucucu

SEQ ID NO: 432627 - RNA, 19 nt, Homo sapiens
acaccucccucugaacuaa

SEQ ID NO: 432628 - RNA, 19 nt, Homo sapiens
ccguggagacuguuacuua

SEQ ID NO: 432629 - RNA, 19 nt, Homo sapiens
aaccuuaguugaaaucaga

SEQ ID NO: 432630 - RNA, 19 nt, Homo sapiens
acacagaagguacuaaugu

SEQ ID NO: 432631 - RNA, 19 nt, Homo sapiens
gcagaacacgucccagauc

SEQ ID NO: 432632 - RNA, 19 nt, Homo sapiens
gaaaagcugggaauaauca

SEQ ID NO: 432633 - RNA, 19 nt, Homo sapiens
aaggaaagcaguuguugaa

SEQ ID NO: 432634 - RNA, 19 nt, Homo sapiens
gaugaugugauguuuacuu

SEQ ID NO: 432635 - RNA, 19 nt, Homo sapiens
cggcaguucuugcugaaau

SEQ ID NO: 432636 - RNA, 19 nt, Homo sapiens
acugauccguucuguguuu

SEQ ID NO: 432637 - RNA, 19 nt, Homo sapiens
ccaccuggaccucuucaaa

SEQ ID NO: 432638 - RNA, 19 nt, Homo sapiens
auuagugccucuuagauga

SEQ ID NO: 432639 - RNA, 19 nt, Homo sapiens
gcagcacggcuucuuacuu

SEQ ID NO: 432640 - RNA, 19 nt, Homo sapiens
gacgcgugcucacuuuaga

SEQ ID NO: 432641 - RNA, 19 nt, Homo sapiens
ccaaguuugucuccaugga

SEQ ID NO: 432642 - RNA, 19 nt, Homo sapiens
gauccguucuguguuuaug

SEQ ID NO: 432643 - RNA, 19 nt, Homo sapiens
ccagcagcacggcuucuua

SEQ ID NO: 432644 - RNA, 19 nt, Homo sapiens
aaagaacaagccacagaaa

SEQ ID NO: 432645 - RNA, 19 nt, Homo sapiens
gcagauccgcagcucgaaa

SEQ ID NO: 432646 - RNA, 19 nt, Homo sapiens
aagaugacaugggcgauga

SEQ ID NO: 432647 - RNA, 19 nt, Homo sapiens
ccaaaccaacugcagagaa

SEQ ID NO: 432648 - RNA, 19 nt, Homo sapiens
ggcagagcccgacuagaaa

SEQ ID NO: 432649 - RNA, 19 nt, Homo sapiens
ggagacuguuacuuaccaa

SEQ ID NO: 432650 - RNA, 19 nt, Homo sapiens
aagccggacucaccacuga

SEQ ID NO: 432651 - RNA, 19 nt, Homo sapiens
gaugggagaguucaacgau

SEQ ID NO: 432652 - RNA, 19 nt, Homo sapiens
gaacacgucccagaucaac

SEQ ID NO: 432653 - RNA, 19 nt, Homo sapiens
guugacaaaugccaugagu

SEQ ID NO: 432654 - RNA, 19 nt, Homo sapiens
cacagaagguacuaauguc

SEQ ID NO: 432655 - RNA, 19 nt, Homo sapiens
ugagugacuucccacaaca

SEQ ID NO: 432656 - RNA, 19 nt, Homo sapiens
uuggaaggcugguugacaa

SEQ ID NO: 432657 - RNA, 19 nt, Homo sapiens
caccagcaguacauagaug

SEQ ID NO: 432658 - RNA, 19 nt, Homo sapiens
gcaccaccagcaguacaua

SEQ ID NO: 432659 - RNA, 19 nt, Homo sapiens
cuguuugucuggucguaua

SEQ ID NO: 432660 - RNA, 19 nt, Homo sapiens
gaauaaucacacuguuugu

SEQ ID NO: 432661 - RNA, 19 nt, Homo sapiens
ucacacagaagguacuaau

SEQ ID NO: 432662 - RNA, 19 nt, Homo sapiens
gccaggagcacaagcuaga

SEQ ID NO: 432663 - RNA, 19 nt, Homo sapiens
aaaauucagucccaaaugu

SEQ ID NO: 432664 - RNA, 19 nt, Homo sapiens
cguagccgcugcaguugga

SEQ ID NO: 432665 - RNA, 19 nt, Homo sapiens
aaguuugucuccauggaaa

SEQ ID NO: 432666 - RNA, 19 nt, Homo sapiens
ggaccucuucaaagucaaa

SEQ ID NO: 432667 - RNA, 19 nt, Homo sapiens
auauacaucuccucuccuu

SEQ ID NO: 432668 - RNA, 19 nt, Homo sapiens
uguguacauugcaguauau

SEQ ID NO: 432669 - RNA, 19 nt, Homo sapiens
gcccaggacgcgauuucua

SEQ ID NO: 432670 - RNA, 19 nt, Homo sapiens
caacagggucagugucaca

SEQ ID NO: 432671 - RNA, 19 nt, Homo sapiens
gaauuacacuucagucuaa

SEQ ID NO: 432672 - RNA, 19 nt, Homo sapiens
gaaacagacuucaagauga

SEQ ID NO: 432673 - RNA, 19 nt, Homo sapiens
gaacaacaacguauccuua

SEQ ID NO: 432674 - RNA, 19 nt, Homo sapiens
gagaaccacuggaauauga

SEQ ID NO: 432675 - RNA, 19 nt, Homo sapiens
ugagauacguucuacuuua

SEQ ID NO: 432676 - RNA, 19 nt, Homo sapiens
guucagcacuggcuuauuu

SEQ ID NO: 432677 - RNA, 19 nt, Homo sapiens
gcacagaaagguuaaauga

SEQ ID NO: 432678 - RNA, 19 nt, Homo sapiens
gaagauacacgucgcuuaa

SEQ ID NO: 432679 - RNA, 19 nt, Homo sapiens
ggaauuacuuugauacuca

SEQ ID NO: 432680 - RNA, 19 nt, Homo sapiens
ggaaugugucucuauauua

SEQ ID NO: 432681 - RNA, 19 nt, Homo sapiens
ggagggaauuacuuugaua

SEQ ID NO: 432682 - RNA, 19 nt, Homo sapiens
gcaaagggcugggaauaca

SEQ ID NO: 432683 - RNA, 19 nt, Homo sapiens
gaacaauauuccacagaga

SEQ ID NO: 432684 - RNA, 19 nt, Homo sapiens
caauuuagccugauagaaa

SEQ ID NO: 432685 - RNA, 19 nt, Homo sapiens
gagauacguucuacuuuau

SEQ ID NO: 432686 - RNA, 19 nt, Homo sapiens
gcagaugguuucacaggaa

SEQ ID NO: 432687 - RNA, 19 nt, Homo sapiens
gagaauacguugaguuugg

SEQ ID NO: 432688 - RNA, 19 nt, Homo sapiens
ccaaugccaugaacaauau

SEQ ID NO: 432689 - RNA, 19 nt, Homo sapiens
gaaaguucauggaaugugu

SEQ ID NO: 432690 - RNA, 19 nt, Homo sapiens
caaaucaaccagaugcuua

SEQ ID NO: 432691 - RNA, 19 nt, Homo sapiens
gcaacucaauggagaauuc

SEQ ID NO: 432692 - RNA, 19 nt, Homo sapiens
caacguauccuuacacaga

SEQ ID NO: 432693 - RNA, 19 nt, Homo sapiens
aagaagacaugcaguauau

SEQ ID NO: 432694 - RNA, 19 nt, Homo sapiens
ggagugagccuucccagaa

SEQ ID NO: 432695 - RNA, 19 nt, Homo sapiens
ggagaauucuggucacuca

SEQ ID NO: 432696 - RNA, 19 nt, Homo sapiens
ccacagagaaugauacaaa

SEQ ID NO: 432697 - RNA, 19 nt, Homo sapiens
ggaauacaauggaaaggau

SEQ ID NO: 432698 - RNA, 19 nt, Homo sapiens
aacaagggcugguuaauau

SEQ ID NO: 432699 - RNA, 19 nt, Homo sapiens
guucuuaugugcuuaauca

SEQ ID NO: 432700 - RNA, 19 nt, Homo sapiens
caacaugguucagagacua

SEQ ID NO: 432701 - RNA, 19 nt, Homo sapiens
aagcaaagcugauaacucu

SEQ ID NO: 432702 - RNA, 19 nt, Homo sapiens
guacaagccuaugcagaaa

SEQ ID NO: 432703 - RNA, 19 nt, Homo sapiens
cauggaaugugucucuaua

SEQ ID NO: 432704 - RNA, 19 nt, Homo sapiens
gcugauaacucugugcaaa

SEQ ID NO: 432705 - RNA, 19 nt, Homo sapiens
gcacuaccauuaccgaauc

SEQ ID NO: 432706 - RNA, 19 nt, Homo sapiens
gaaacccuaugaaggaaga

SEQ ID NO: 432707 - RNA, 19 nt, Homo sapiens
caagaagacaugcaguaua

SEQ ID NO: 432708 - RNA, 19 nt, Homo sapiens
gacacaggcucgacaguga

SEQ ID NO: 432709 - RNA, 19 nt, Homo sapiens
ucagaacacuucccaaauc

SEQ ID NO: 432710 - RNA, 19 nt, Homo sapiens
gcacaucuguugagcaaac

SEQ ID NO: 432711 - RNA, 19 nt, Homo sapiens
aaacaucuguggcuaguca

SEQ ID NO: 432712 - RNA, 19 nt, Homo sapiens
gauuggugcuccugauaaa

SEQ ID NO: 432713 - RNA, 19 nt, Homo sapiens
ugcaagaguuccuuaaauu

SEQ ID NO: 432714 - RNA, 19 nt, Homo sapiens
gguaagagaggcugaaaga

SEQ ID NO: 432715 - RNA, 19 nt, Homo sapiens
guacuaccuuugaggauau

SEQ ID NO: 432716 - RNA, 19 nt, Homo sapiens
gaggcacaguucuauguuu

SEQ ID NO: 432717 - RNA, 19 nt, Homo sapiens
ucaaccagaugcuuaguga

SEQ ID NO: 432718 - RNA, 19 nt, Homo sapiens
caacaacaccacaauaauc

SEQ ID NO: 432719 - RNA, 19 nt, Homo sapiens
gagggacuguggaguuauu

SEQ ID NO: 432720 - RNA, 19 nt, Homo sapiens
gauacugucuauaccaaug

SEQ ID NO: 432721 - RNA, 19 nt, Homo sapiens
ccaaauaccacuacuaugg

SEQ ID NO: 432722 - RNA, 19 nt, Homo sapiens
gaagcacucuguacaacca

SEQ ID NO: 432723 - RNA, 19 nt, Homo sapiens
ccucaaccgugucgacuuu

SEQ ID NO: 432724 - RNA, 19 nt, Homo sapiens
caacaacccaugcaacaga

SEQ ID NO: 432725 - RNA, 19 nt, Homo sapiens
caagggcugguuaauauaa

SEQ ID NO: 432726 - RNA, 19 nt, Homo sapiens
gauacguucuacuuuauuc

SEQ ID NO: 432727 - RNA, 19 nt, Homo sapiens
gcaagaguuccuuaaauuc

SEQ ID NO: 432728 - RNA, 19 nt, Homo sapiens
caaacauucuggcgcuauu

SEQ ID NO: 432729 - RNA, 19 nt, Homo sapiens
gguacaagccuaugcagaa

SEQ ID NO: 432730 - RNA, 19 nt, Homo sapiens
acacagauguacagccaaa

SEQ ID NO: 432731 - RNA, 19 nt, Homo sapiens
ggagcaauccgaacaacaa

SEQ ID NO: 432732 - RNA, 19 nt, Homo sapiens
gcacugugaggcaauauug

SEQ ID NO: 432733 - RNA, 19 nt, Homo sapiens
acacagagacacagaugua

SEQ ID NO: 432734 - RNA, 19 nt, Homo sapiens
uggaaugugucucuauauu

SEQ ID NO: 432735 - RNA, 19 nt, Homo sapiens
cagaacacuucccaaauca

SEQ ID NO: 432736 - RNA, 19 nt, Homo sapiens
gaaucaagcgccauaguca

SEQ ID NO: 432737 - RNA, 19 nt, Homo sapiens
ccaacaucaucaacaguuu

SEQ ID NO: 432738 - RNA, 19 nt, Homo sapiens
gcaagaagacaugcaguau

SEQ ID NO: 432739 - RNA, 19 nt, Homo sapiens
guuuauaccuugucgaauc

SEQ ID NO: 432740 - RNA, 19 nt, Homo sapiens
gcacuggcuuauuuuguua

SEQ ID NO: 432741 - RNA, 19 nt, Homo sapiens
gcacugaaacccuaugaag

SEQ ID NO: 432742 - RNA, 19 nt, Homo sapiens
caaucugagugaaauagaa

SEQ ID NO: 432743 - RNA, 19 nt, Homo sapiens
gaaggaagcgauacugucu

SEQ ID NO: 432744 - RNA, 19 nt, Homo sapiens
uagagaauacguugaguuu

SEQ ID NO: 432745 - RNA, 19 nt, Homo sapiens
ccaagaacaaaguaaauga

SEQ ID NO: 432746 - RNA, 19 nt, Homo sapiens
ugaaauggauguguaacug

SEQ ID NO: 432747 - RNA, 19 nt, Homo sapiens
gcaaagcugauaacucugu

SEQ ID NO: 432748 - RNA, 19 nt, Homo sapiens
gaagcgauacugucuauac

SEQ ID NO: 432749 - RNA, 19 nt, Homo sapiens
gcagguacaacaugucuau

SEQ ID NO: 432750 - RNA, 19 nt, Homo sapiens
acagugaccuuacaaacau

SEQ ID NO: 432751 - RNA, 19 nt, Homo sapiens
caauaagcauccgagguuu

SEQ ID NO: 432752 - RNA, 19 nt, Homo sapiens
gaagacaugcaguauaugg

SEQ ID NO: 432753 - RNA, 19 nt, Homo sapiens
gcgauacugucuauaccaa

SEQ ID NO: 432754 - RNA, 19 nt, Homo sapiens
ucuaaccacuaaugaugua

SEQ ID NO: 432755 - RNA, 19 nt, Homo sapiens
cuaaggcacagaaagguua

SEQ ID NO: 432756 - RNA, 19 nt, Homo sapiens
acaauaagcauccgagguu

SEQ ID NO: 432757 - RNA, 19 nt, Homo sapiens
cuacgacgaauauauguuu

SEQ ID NO: 432758 - RNA, 19 nt, Homo sapiens
ucaagucacugcagagucu

SEQ ID NO: 432759 - RNA, 19 nt, Homo sapiens
cugcguggcuugacaaugu

SEQ ID NO: 432760 - RNA, 19 nt, Homo sapiens
agaaacagacuucaagaug

SEQ ID NO: 432761 - RNA, 19 nt, Homo sapiens
ggugggcacuggugggauu

SEQ ID NO: 432762 - RNA, 19 nt, Homo sapiens
gaguuuggcucuggaagga

SEQ ID NO: 432763 - RNA, 19 nt, Homo sapiens
gaaauggauguguaacugu

SEQ ID NO: 432764 - RNA, 19 nt, Homo sapiens
guauauggcuaugagacaa

SEQ ID NO: 432765 - RNA, 19 nt, Homo sapiens
uuaaucgucugcaagaaga

SEQ ID NO: 432766 - RNA, 19 nt, Homo sapiens
cuagaggaaacuccaaaua

SEQ ID NO: 432767 - RNA, 19 nt, Homo sapiens
gaaccacuggaauaugaaa

SEQ ID NO: 432768 - RNA, 19 nt, Homo sapiens
ccagugugaugacaacaug

SEQ ID NO: 432769 - RNA, 19 nt, Homo sapiens
cgaagauacacgucgcuua

SEQ ID NO: 432770 - RNA, 19 nt, Homo sapiens
uucuacagcucaaugguua

SEQ ID NO: 432771 - RNA, 19 nt, Homo sapiens
gaaacagacuucaagauga

SEQ ID NO: 432772 - RNA, 19 nt, Homo sapiens
gaacaacaacguauccuua

SEQ ID NO: 432773 - RNA, 19 nt, Homo sapiens
gcacuucugugaaauauca

SEQ ID NO: 432774 - RNA, 19 nt, Homo sapiens
gaagauacacgucgcuuaa

SEQ ID NO: 432775 - RNA, 19 nt, Homo sapiens
ggaauuacuuugauacuca

SEQ ID NO: 432776 - RNA, 19 nt, Homo sapiens
ggagggaauuacuuugaua

SEQ ID NO: 432777 - RNA, 19 nt, Homo sapiens
gcagugaaguagaaaguga

SEQ ID NO: 432778 - RNA, 19 nt, Homo sapiens
gaacaauauuccacagaga

SEQ ID NO: 432779 - RNA, 19 nt, Homo sapiens
caauuuagccugauagaaa

SEQ ID NO: 432780 - RNA, 19 nt, Homo sapiens
gcagaugguuucacaggaa

SEQ ID NO: 432781 - RNA, 19 nt, Homo sapiens
gagaauacguugaguuugg

SEQ ID NO: 432782 - RNA, 19 nt, Homo sapiens
ccaaugccaugaacaauau

SEQ ID NO: 432783 - RNA, 19 nt, Homo sapiens
caaaucaaccagaugcuua

SEQ ID NO: 432784 - RNA, 19 nt, Homo sapiens
gcaacucaauggagaauuc

SEQ ID NO: 432785 - RNA, 19 nt, Homo sapiens
caacguauccuuacacaga

SEQ ID NO: 432786 - RNA, 19 nt, Homo sapiens
ggaauggguguauguauuu

SEQ ID NO: 432787 - RNA, 19 nt, Homo sapiens
uaucugugcugaacauuaa

SEQ ID NO: 432788 - RNA, 19 nt, Homo sapiens
aagaagacaugcaguauau

SEQ ID NO: 432789 - RNA, 19 nt, Homo sapiens
ggagugagccuucccagaa

SEQ ID NO: 432790 - RNA, 19 nt, Homo sapiens
ggagaauucuggucacuca

SEQ ID NO: 432791 - RNA, 19 nt, Homo sapiens
ggucgacuguugucaaauu

SEQ ID NO: 432792 - RNA, 19 nt, Homo sapiens
ccacagagaaugauacaaa

SEQ ID NO: 432793 - RNA, 19 nt, Homo sapiens
gggcgaguuuggugauuua

SEQ ID NO: 432794 - RNA, 19 nt, Homo sapiens
ugaaauggaugaagaacug

SEQ ID NO: 432795 - RNA, 19 nt, Homo sapiens
caacaugguucagagacua

SEQ ID NO: 432796 - RNA, 19 nt, Homo sapiens
aagcaaagcugauaacucu

SEQ ID NO: 432797 - RNA, 19 nt, Homo sapiens
guacaagccuaugcagaaa

SEQ ID NO: 432798 - RNA, 19 nt, Homo sapiens
gcugauaacucugugcaaa

SEQ ID NO: 432799 - RNA, 19 nt, Homo sapiens
gcacuaccauuaccgaauc

SEQ ID NO: 432800 - RNA, 19 nt, Homo sapiens
uagaugcacuucugugaaa

SEQ ID NO: 432801 - RNA, 19 nt, Homo sapiens
aaagugaaauggaugaaga

SEQ ID NO: 432802 - RNA, 19 nt, Homo sapiens
gaaacccuaugaaggaaga

SEQ ID NO: 432803 - RNA, 19 nt, Homo sapiens
caagaagacaugcaguaua

SEQ ID NO: 432804 - RNA, 19 nt, Homo sapiens
gacacaggcucgacaguga

SEQ ID NO: 432805 - RNA, 19 nt, Homo sapiens
ucagaacacuucccaaauc

SEQ ID NO: 432806 - RNA, 19 nt, Homo sapiens
gcacaucuguugagcaaac

SEQ ID NO: 432807 - RNA, 19 nt, Homo sapiens
gaaauggaauggguguaug

SEQ ID NO: 432808 - RNA, 19 nt, Homo sapiens
gggcuuaaguugaaaauuu

SEQ ID NO: 432809 - RNA, 19 nt, Homo sapiens
cauuaacccuguugauauu

SEQ ID NO: 432810 - RNA, 19 nt, Homo sapiens
cuggaaaucuggauaaaga

SEQ ID NO: 432811 - RNA, 19 nt, Homo sapiens
aaacaucuguggcuaguca

SEQ ID NO: 432812 - RNA, 19 nt, Homo sapiens
guacuaccuuugaggauau

SEQ ID NO: 432813 - RNA, 19 nt, Homo sapiens
ugaaggcagugaaguagaa

SEQ ID NO: 432814 - RNA, 19 nt, Homo sapiens
ucaaccagaugcuuaguga

SEQ ID NO: 432815 - RNA, 19 nt, Homo sapiens
caacaacaccacaauaauc

SEQ ID NO: 432816 - RNA, 19 nt, Homo sapiens
gauauugggcuuaaguuga

SEQ ID NO: 432817 - RNA, 19 nt, Homo sapiens
gauacugucuauaccaaug

SEQ ID NO: 432818 - RNA, 19 nt, Homo sapiens
uaccuacacugcagucuaa

SEQ ID NO: 432819 - RNA, 19 nt, Homo sapiens
ccaaauaccacuacuaugg

SEQ ID NO: 432820 - RNA, 19 nt, Homo sapiens
gaagcacucuguacaacca

SEQ ID NO: 432821 - RNA, 19 nt, Homo sapiens
cgaguuuggugauuuaaau

SEQ ID NO: 432822 - RNA, 19 nt, Homo sapiens
ccucaaccgugucgacuuu

SEQ ID NO: 432823 - RNA, 19 nt, Homo sapiens
caacaacccaugcaacaga

SEQ ID NO: 432824 - RNA, 19 nt, Homo sapiens
caaccaagccuccugaauc

SEQ ID NO: 432825 - RNA, 19 nt, Homo sapiens
caaacauucuggcgcuauu

SEQ ID NO: 432826 - RNA, 19 nt, Homo sapiens
gguacaagccuaugcagaa

SEQ ID NO: 432827 - RNA, 19 nt, Homo sapiens
acacagauguacagccaaa

SEQ ID NO: 432828 - RNA, 19 nt, Homo sapiens
ggagcaauccgaacaacaa

SEQ ID NO: 432829 - RNA, 19 nt, Homo sapiens
gcacugugaggcaauauug

SEQ ID NO: 432830 - RNA, 19 nt, Homo sapiens
acacagagacacagaugua

SEQ ID NO: 432831 - RNA, 19 nt, Homo sapiens
uggaauggguguauguauu

SEQ ID NO: 432832 - RNA, 19 nt, Homo sapiens
cgacuguugucaaauucua

SEQ ID NO: 432833 - RNA, 19 nt, Homo sapiens
gugcagcgcuacaggaaau

SEQ ID NO: 432834 - RNA, 19 nt, Homo sapiens
cagaacacuucccaaauca

SEQ ID NO: 432835 - RNA, 19 nt, Homo sapiens
ccaacaucaucaacaguuu

SEQ ID NO: 432836 - RNA, 19 nt, Homo sapiens
gcaagaagacaugcaguau

SEQ ID NO: 432837 - RNA, 19 nt, Homo sapiens
gaaucaagcgccauaguca

SEQ ID NO: 432838 - RNA, 19 nt, Homo sapiens
uuaauuagaugcacuucug

SEQ ID NO: 432839 - RNA, 19 nt, Homo sapiens
gcacugaaacccuaugaag

SEQ ID NO: 432840 - RNA, 19 nt, Homo sapiens
caaucugagugaaauagaa

SEQ ID NO: 432841 - RNA, 19 nt, Homo sapiens
gaaggaagcgauacugucu

SEQ ID NO: 432842 - RNA, 19 nt, Homo sapiens
uagagaauacguugaguuu

SEQ ID NO: 432843 - RNA, 19 nt, Homo sapiens
ugaaauggauguguaacug

SEQ ID NO: 432844 - RNA, 19 nt, Homo sapiens
gcaaagcugauaacucugu

SEQ ID NO: 432845 - RNA, 19 nt, Homo sapiens
gaagcgauacugucuauac

SEQ ID NO: 432846 - RNA, 19 nt, Homo sapiens
gcagguacaacaugucuau

SEQ ID NO: 432847 - RNA, 19 nt, Homo sapiens
acagugaccuuacaaacau

SEQ ID NO: 432848 - RNA, 19 nt, Homo sapiens
gaagacaugcaguauaugg

SEQ ID NO: 432849 - RNA, 19 nt, Homo sapiens
gcgauacugucuauaccaa

SEQ ID NO: 432850 - RNA, 19 nt, Homo sapiens
gaaggucgacuguugucaa

SEQ ID NO: 432851 - RNA, 19 nt, Homo sapiens
cuacgacgaauauauguuu

SEQ ID NO: 432852 - RNA, 19 nt, Homo sapiens
ucaagucacugcagagucu

SEQ ID NO: 432853 - RNA, 19 nt, Homo sapiens
ucacaaguacucagacuau

SEQ ID NO: 432854 - RNA, 19 nt, Homo sapiens
cugcguggcuugacaaugu

SEQ ID NO: 432855 - RNA, 19 nt, Homo sapiens
agaaacagacuucaagaug

SEQ ID NO: 432856 - RNA, 19 nt, Homo sapiens
ggugggcacuggugggauu

SEQ ID NO: 432857 - RNA, 19 nt, Homo sapiens
gaguuuggcucuggaagga

SEQ ID NO: 432858 - RNA, 19 nt, Homo sapiens
gaaauggauguguaacugu

SEQ ID NO: 432859 - RNA, 19 nt, Homo sapiens
guauauggcuaugagacaa

SEQ ID NO: 432860 - RNA, 19 nt, Homo sapiens
uuaaucgucugcaagaaga

SEQ ID NO: 432861 - RNA, 19 nt, Homo sapiens
cuagaggaaacuccaaaua

SEQ ID NO: 432862 - RNA, 19 nt, Homo sapiens
gccugaaggucgacuguug

SEQ ID NO: 432863 - RNA, 19 nt, Homo sapiens
acacugcagucuaaagaau

SEQ ID NO: 432864 - RNA, 19 nt, Homo sapiens
guacucagacuaucagaca

SEQ ID NO: 432865 - RNA, 19 nt, Homo sapiens
ugaaguagaaagugaaaug

SEQ ID NO: 432866 - RNA, 19 nt, Homo sapiens
ccagugugaugacaacaug

SEQ ID NO: 432867 - RNA, 19 nt, Homo sapiens
cgaagauacacgucgcuua

SEQ ID NO: 432868 - RNA, 19 nt, Homo sapiens
gaugcacuucugugaaaua

SEQ ID NO: 432869 - RNA, 19 nt, Homo sapiens
uucuacagcucaaugguua

SEQ ID NO: 432870 - RNA, 19 nt, Homo sapiens
cccaagccauucgaaauuu

SEQ ID NO: 432871 - RNA, 19 nt, Homo sapiens
aaagaaagcucccaauauu

SEQ ID NO: 432872 - RNA, 19 nt, Homo sapiens
gaacacugcugccagaauu

SEQ ID NO: 432873 - RNA, 19 nt, Homo sapiens
gaaagaaagcucccaauau

SEQ ID NO: 432874 - RNA, 19 nt, Homo sapiens
ggcauuaccugacagcuua

SEQ ID NO: 432875 - RNA, 19 nt, Homo sapiens
ccaauuauaucaggaguuu

SEQ ID NO: 432876 - RNA, 19 nt, Homo sapiens
ugaaagaugucucaacgaa

SEQ ID NO: 432877 - RNA, 19 nt, Homo sapiens
uaacucaggugauucgaaa

SEQ ID NO: 432878 - RNA, 19 nt, Homo sapiens
gcaaacagacaguggcaua

SEQ ID NO: 432879 - RNA, 19 nt, Homo sapiens
gcagcaguuuccucaguua

SEQ ID NO: 432880 - RNA, 19 nt, Homo sapiens
gaggagaacuaugagauug

SEQ ID NO: 432881 - RNA, 19 nt, Homo sapiens
gaaacucaucacccaauua

SEQ ID NO: 432882 - RNA, 19 nt, Homo sapiens
ggaaacucaucacccaauu

SEQ ID NO: 432883 - RNA, 19 nt, Homo sapiens
ccacugcauucuagccuua

SEQ ID NO: 432884 - RNA, 19 nt, Homo sapiens
acugagagcuggauugaaa

SEQ ID NO: 432885 - RNA, 19 nt, Homo sapiens
ugaaagaaagcucccaaua

SEQ ID NO: 432886 - RNA, 19 nt, Homo sapiens
cagcuuaacucaggugauu

SEQ ID NO: 432887 - RNA, 19 nt, Homo sapiens
ggaggaacguggaccugaa

SEQ ID NO: 432888 - RNA, 19 nt, Homo sapiens
uagaaucucugcacuguca

SEQ ID NO: 432889 - RNA, 19 nt, Homo sapiens
gaaaguggcccagcaguuc

SEQ ID NO: 432890 - RNA, 19 nt, Homo sapiens
gaugugauguauuccaaga

SEQ ID NO: 432891 - RNA, 19 nt, Homo sapiens
caacgaaagugaaaacaaa

SEQ ID NO: 432892 - RNA, 19 nt, Homo sapiens
ggaagacucucgcgaugag

SEQ ID NO: 432893 - RNA, 19 nt, Homo sapiens
cggcaaacaucacuaaauc

SEQ ID NO: 432894 - RNA, 19 nt, Homo sapiens
ccacugugcugcaggcauu

SEQ ID NO: 432895 - RNA, 19 nt, Homo sapiens
guaauaagagccaacuuug

SEQ ID NO: 432896 - RNA, 19 nt, Homo sapiens
gggaauguuucuaaugaug

SEQ ID NO: 432897 - RNA, 19 nt, Homo sapiens
aaagaugucucaacgaaag

SEQ ID NO: 432898 - RNA, 19 nt, Homo sapiens
gcagugcccucuauaugca

SEQ ID NO: 432899 - RNA, 19 nt, Homo sapiens
ucaccuaauucacuuaaug

SEQ ID NO: 432900 - RNA, 19 nt, Homo sapiens
gcagacaucacguuccaaa

SEQ ID NO: 432901 - RNA, 19 nt, Homo sapiens
gaaagaugucucaacgaaa

SEQ ID NO: 432902 - RNA, 19 nt, Homo sapiens
ugaaugacguacagguauu

SEQ ID NO: 432903 - RNA, 19 nt, Homo sapiens
aaacaucaaguucgaauug

SEQ ID NO: 432904 - RNA, 19 nt, Homo sapiens
agaaagcucccaauauuau

SEQ ID NO: 432905 - RNA, 19 nt, Homo sapiens
gaucauaaggcagcaguuu

SEQ ID NO: 432906 - RNA, 19 nt, Homo sapiens
gcaaacaucacuaaaucau

SEQ ID NO: 432907 - RNA, 19 nt, Homo sapiens
gaaaggggcugagacagaa

SEQ ID NO: 432908 - RNA, 19 nt, Homo sapiens
ccaauauuaugaugugaug

SEQ ID NO: 432909 - RNA, 19 nt, Homo sapiens
gacagucaaaguaccauua

SEQ ID NO: 432910 - RNA, 19 nt, Homo sapiens
ggaggagaacuaugagauu

SEQ ID NO: 432911 - RNA, 19 nt, Homo sapiens
cauucuagccuuagugaua

SEQ ID NO: 432912 - RNA, 19 nt, Homo sapiens
aagaaagcucccaauauua

SEQ ID NO: 432913 - RNA, 19 nt, Homo sapiens
gagcuggauugaaagaugu

SEQ ID NO: 432914 - RNA, 19 nt, Homo sapiens
gguaguuaauguuugaaga

SEQ ID NO: 432915 - RNA, 19 nt, Homo sapiens
ucaccaagcaaacccuuua

SEQ ID NO: 432916 - RNA, 19 nt, Homo sapiens
ucaggugauucgaaaguuu

SEQ ID NO: 432917 - RNA, 19 nt, Homo sapiens
agaaagaagugagcaaaca

SEQ ID NO: 432918 - RNA, 19 nt, Homo sapiens
gaacauugucggcgugugu

SEQ ID NO: 432919 - RNA, 19 nt, Homo sapiens
gagaauacuggacacugua

SEQ ID NO: 432920 - RNA, 19 nt, Homo sapiens
gaacacacugucagagaau

SEQ ID NO: 432921 - RNA, 19 nt, Homo sapiens
guuagaaucucugcacugu

SEQ ID NO: 432922 - RNA, 19 nt, Homo sapiens
gcacuacagguaauggaaa

SEQ ID NO: 432923 - RNA, 19 nt, Homo sapiens
ggaguuugaccaucucuug

SEQ ID NO: 432924 - RNA, 19 nt, Homo sapiens
ccagaaaacuugcgaaaca

SEQ ID NO: 432925 - RNA, 19 nt, Homo sapiens
agaacacacugucagagaa

SEQ ID NO: 432926 - RNA, 19 nt, Homo sapiens
caagaaagaagugagcaaa

SEQ ID NO: 432927 - RNA, 19 nt, Homo sapiens
ggaauguuucuaaugauga

SEQ ID NO: 432928 - RNA, 19 nt, Homo sapiens
gcagaaguccgagaagaga

SEQ ID NO: 432929 - RNA, 19 nt, Homo sapiens
ugugauguauuccaagaaa

SEQ ID NO: 432930 - RNA, 19 nt, Homo sapiens
ugcaauggcuggaggagaa

SEQ ID NO: 432931 - RNA, 19 nt, Homo sapiens
guuggcaaauuaagcauau

SEQ ID NO: 432932 - RNA, 19 nt, Homo sapiens
acguacagguauucauuua

SEQ ID NO: 432933 - RNA, 19 nt, Homo sapiens
gaaggaagcacugcagaag

SEQ ID NO: 432934 - RNA, 19 nt, Homo sapiens
gcccagcaguuccucuuga

SEQ ID NO: 432935 - RNA, 19 nt, Homo sapiens
gcauugcagugaaagaaag

SEQ ID NO: 432936 - RNA, 19 nt, Homo sapiens
aaacucaucacccaauuau

SEQ ID NO: 432937 - RNA, 19 nt, Homo sapiens
ggagaacuaugagauugca

SEQ ID NO: 432938 - RNA, 19 nt, Homo sapiens
ugacguacagguauucauu

SEQ ID NO: 432939 - RNA, 19 nt, Homo sapiens
agacaucacguuccaaaug

SEQ ID NO: 432940 - RNA, 19 nt, Homo sapiens
gaaacaucaaguucgaauu

SEQ ID NO: 432941 - RNA, 19 nt, Homo sapiens
uaauaagagccaacuuuga

SEQ ID NO: 432942 - RNA, 19 nt, Homo sapiens
gaaagcucccaauauuaug

SEQ ID NO: 432943 - RNA, 19 nt, Homo sapiens
guugaccgcuguguuguga

SEQ ID NO: 432944 - RNA, 19 nt, Homo sapiens
uacauugaguggcuggaua

SEQ ID NO: 432945 - RNA, 19 nt, Homo sapiens
acucaucacccaauuauau

SEQ ID NO: 432946 - RNA, 19 nt, Homo sapiens
gaacagcaucaccaagcaa

SEQ ID NO: 432947 - RNA, 19 nt, Homo sapiens
uaagagccaacuuugauga

SEQ ID NO: 432948 - RNA, 19 nt, Homo sapiens
uguaauaagagccaacuuu

SEQ ID NO: 432949 - RNA, 19 nt, Homo sapiens
gaagaaugauacccaaccu

SEQ ID NO: 432950 - RNA, 19 nt, Homo sapiens
ccagacaucuuggcucaca

SEQ ID NO: 432951 - RNA, 19 nt, Homo sapiens
agagaauacuggacacugu

SEQ ID NO: 432952 - RNA, 19 nt, Homo sapiens
cuacgugcucuaccuguua

SEQ ID NO: 432953 - RNA, 19 nt, Homo sapiens
gacaucacguuccaaaugc

SEQ ID NO: 432954 - RNA, 19 nt, Homo sapiens
gauccacagugcagacauc

SEQ ID NO: 432955 - RNA, 19 nt, Homo sapiens
acuggacacuguaauaaga

SEQ ID NO: 432956 - RNA, 19 nt, Homo sapiens
cuggguaucuuccuggauu

SEQ ID NO: 432957 - RNA, 19 nt, Homo sapiens
guuaauguuugaagaaagg

SEQ ID NO: 432958 - RNA, 19 nt, Homo sapiens
ggccucagcacuacaggua

SEQ ID NO: 432959 - RNA, 19 nt, Homo sapiens
caaauucugagacggcaaa

SEQ ID NO: 432960 - RNA, 19 nt, Homo sapiens
aauaagagccaacuuugau

SEQ ID NO: 432961 - RNA, 19 nt, Homo sapiens
gcaagaaagaagugagcaa

SEQ ID NO: 432962 - RNA, 19 nt, Homo sapiens
ggcagcaguuuccucaguu

SEQ ID NO: 432963 - RNA, 19 nt, Homo sapiens
aaacagacaguggcauauu

SEQ ID NO: 432964 - RNA, 19 nt, Homo sapiens
ucuccaaacuccugugugu

SEQ ID NO: 432965 - RNA, 19 nt, Homo sapiens
aaacauucuucucccacaa

SEQ ID NO: 432966 - RNA, 19 nt, Homo sapiens
uaauggaaaguccuucaaa

SEQ ID NO: 432967 - RNA, 19 nt, Homo sapiens
ccacugagagcuggauuga

SEQ ID NO: 432968 - RNA, 19 nt, Homo sapiens
gaaagaagugagcaaacag

SEQ ID NO: 432969 - RNA, 19 nt, Homo sapiens
agagcuggauugaaagaug

SEQ ID NO: 432970 - RNA, 19 nt, Homo sapiens
ucaguuaaccaccagaaga

SEQ ID NO: 432971 - RNA, 19 nt, Homo sapiens
gaagaggucuguucuguau

SEQ ID NO: 432972 - RNA, 19 nt, Homo sapiens
aaagaaagcucccaauauu

SEQ ID NO: 432973 - RNA, 19 nt, Homo sapiens
gaacacugcugccagaauu

SEQ ID NO: 432974 - RNA, 19 nt, Homo sapiens
gaaagaaagcucccaauau

SEQ ID NO: 432975 - RNA, 19 nt, Homo sapiens
gcagaaauaucacggaaug

SEQ ID NO: 432976 - RNA, 19 nt, Homo sapiens
ggcauuaccugacagcuua

SEQ ID NO: 432977 - RNA, 19 nt, Homo sapiens
gauggaaccuuguuugaug

SEQ ID NO: 432978 - RNA, 19 nt, Homo sapiens
gcacauaauuuaccaagag

SEQ ID NO: 432979 - RNA, 19 nt, Homo sapiens
ggaacaaacuuuaacuuac

SEQ ID NO: 432980 - RNA, 19 nt, Homo sapiens
ccaauuauaucaggaguuu

SEQ ID NO: 432981 - RNA, 19 nt, Homo sapiens
uaacucaggugauucgaaa

SEQ ID NO: 432982 - RNA, 19 nt, Homo sapiens
ucauaggcauccauauuua

SEQ ID NO: 432983 - RNA, 19 nt, Homo sapiens
ccagaagacuuuaucucua

SEQ ID NO: 432984 - RNA, 19 nt, Homo sapiens
caggagcaaugcagucuua

SEQ ID NO: 432985 - RNA, 19 nt, Homo sapiens
gcaaacagacaguggcaua

SEQ ID NO: 432986 - RNA, 19 nt, Homo sapiens
gcucugcuguguuaacuuu

SEQ ID NO: 432987 - RNA, 19 nt, Homo sapiens
caaaaucucuuuagucuug

SEQ ID NO: 432988 - RNA, 19 nt, Homo sapiens
ccacuaagcagaaauauca

SEQ ID NO: 432989 - RNA, 19 nt, Homo sapiens
cagaagacuuuaucucuau

SEQ ID NO: 432990 - RNA, 19 nt, Homo sapiens
gaaacucaucacccaauua

SEQ ID NO: 432991 - RNA, 19 nt, Homo sapiens
ggaaacucaucacccaauu

SEQ ID NO: 432992 - RNA, 19 nt, Homo sapiens
gauucgagaugcccacuaa

SEQ ID NO: 432993 - RNA, 19 nt, Homo sapiens
guacaguugugcaagauau

SEQ ID NO: 432994 - RNA, 19 nt, Homo sapiens
gaaauaucacggaauggua

SEQ ID NO: 432995 - RNA, 19 nt, Homo sapiens
gaacaaacuuuaacuuacc

SEQ ID NO: 432996 - RNA, 19 nt, Homo sapiens
gaaacuggauggaacaaac

SEQ ID NO: 432997 - RNA, 19 nt, Homo sapiens
agacuugacuguuucugua

SEQ ID NO: 432998 - RNA, 19 nt, Homo sapiens
ugaaagaaagcucccaaua

SEQ ID NO: 432999 - RNA, 19 nt, Homo sapiens
gcaacuguucuguaaauaa

SEQ ID NO: 433000 - RNA, 19 nt, Homo sapiens
cagcaacuguucuguaaau

SEQ ID NO: 433001 - RNA, 19 nt, Homo sapiens
ggagcuaucuggaaacucu

SEQ ID NO: 433002 - RNA, 19 nt, Homo sapiens
cagcuuaacucaggugauu

SEQ ID NO: 433003 - RNA, 19 nt, Homo sapiens
ggaggaacguggaccugaa

SEQ ID NO: 433004 - RNA, 19 nt, Homo sapiens
ggaaggcaguuaugacagu

SEQ ID NO: 433005 - RNA, 19 nt, Homo sapiens
uagaaucucugcacuguca

SEQ ID NO: 433006 - RNA, 19 nt, Homo sapiens
gaaaguggcccagcaguuc

SEQ ID NO: 433007 - RNA, 19 nt, Homo sapiens
gaugugauguauuccaaga

SEQ ID NO: 433008 - RNA, 19 nt, Homo sapiens
gcaacacuuuccuggcuuu

SEQ ID NO: 433009 - RNA, 19 nt, Homo sapiens
ggaagacucucgcgaugag

SEQ ID NO: 433010 - RNA, 19 nt, Homo sapiens
gaaacucuagugacaugua

SEQ ID NO: 433011 - RNA, 19 nt, Homo sapiens
gcacaguacccuuuuaaua

SEQ ID NO: 433012 - RNA, 19 nt, Homo sapiens
cggcaaacaucacuaaauc

SEQ ID NO: 433013 - RNA, 19 nt, Homo sapiens
ccacugugcugcaggcauu

SEQ ID NO: 433014 - RNA, 19 nt, Homo sapiens
guaauaagagccaacuuug

SEQ ID NO: 433015 - RNA, 19 nt, Homo sapiens
ggugguaccaucccuauuu

SEQ ID NO: 433016 - RNA, 19 nt, Homo sapiens
cagaaggcauucagauaga

SEQ ID NO: 433017 - RNA, 19 nt, Homo sapiens
agacuucgcucagcacaaa

SEQ ID NO: 433018 - RNA, 19 nt, Homo sapiens
ggaagaggucuguucugua

SEQ ID NO: 433019 - RNA, 19 nt, Homo sapiens
ugcaagauaugaaugguuu

SEQ ID NO: 433020 - RNA, 19 nt, Homo sapiens
guaguaauuugugagguuu

SEQ ID NO: 433021 - RNA, 19 nt, Homo sapiens
ucaccuaauucacuuaaug

SEQ ID NO: 433022 - RNA, 19 nt, Homo sapiens
gcagacaucacguuccaaa

SEQ ID NO: 433023 - RNA, 19 nt, Homo sapiens
guucuuggaugggcacaua

SEQ ID NO: 433024 - RNA, 19 nt, Homo sapiens
aaacaucaaguucgaauug

SEQ ID NO: 433025 - RNA, 19 nt, Homo sapiens
agaaagcucccaauauuau

SEQ ID NO: 433026 - RNA, 19 nt, Homo sapiens
gagguuuguuagagauuaa

SEQ ID NO: 433027 - RNA, 19 nt, Homo sapiens
ggauuuauggcauugagua

SEQ ID NO: 433028 - RNA, 19 nt, Homo sapiens
ggauuugucuuaaguuugc

SEQ ID NO: 433029 - RNA, 19 nt, Homo sapiens
gauggauacuggagacaga

SEQ ID NO: 433030 - RNA, 19 nt, Homo sapiens
gaucaaugugggaugaaua

SEQ ID NO: 433031 - RNA, 19 nt, Homo sapiens
gcaaacaucacuaaaucau

SEQ ID NO: 433032 - RNA, 19 nt, Homo sapiens
ccaauauuaugaugugaug

SEQ ID NO: 433033 - RNA, 19 nt, Homo sapiens
aauaauauccgacacuuug

SEQ ID NO: 433034 - RNA, 19 nt, Homo sapiens
gcaccaagugugaaaguga

SEQ ID NO: 433035 - RNA, 19 nt, Homo sapiens
gaauguaagcacugucuug

SEQ ID NO: 433036 - RNA, 19 nt, Homo sapiens
uggaugggcacauaauuua

SEQ ID NO: 433037 - RNA, 19 nt, Homo sapiens
aagaaagcucccaauauua

SEQ ID NO: 433038 - RNA, 19 nt, Homo sapiens
agaggucuguucuguauug

SEQ ID NO: 433039 - RNA, 19 nt, Homo sapiens
gaaacaggacuuacuaaaa

SEQ ID NO: 433040 - RNA, 19 nt, Homo sapiens
uaucauaggcauccauauu

SEQ ID NO: 433041 - RNA, 19 nt, Homo sapiens
ucaccaagcaaacccuuua

SEQ ID NO: 433042 - RNA, 19 nt, Homo sapiens
ucaggugauucgaaaguuu

SEQ ID NO: 433043 - RNA, 19 nt, Homo sapiens
agaaagaagugagcaaaca

SEQ ID NO: 433044 - RNA, 19 nt, Homo sapiens
ggaaggaagaggucuguuc

SEQ ID NO: 433045 - RNA, 19 nt, Homo sapiens
aagccagacuugacuguuu

SEQ ID NO: 433046 - RNA, 19 nt, Homo sapiens
gaacauugucggcgugugu

SEQ ID NO: 433047 - RNA, 19 nt, Homo sapiens
gagaauacuggacacugua

SEQ ID NO: 433048 - RNA, 19 nt, Homo sapiens
gaacacacugucagagaau

SEQ ID NO: 433049 - RNA, 19 nt, Homo sapiens
gaaggcaguuaugacaguu

SEQ ID NO: 433050 - RNA, 19 nt, Homo sapiens
gaaucugguuuguguucuu

SEQ ID NO: 433051 - RNA, 19 nt, Homo sapiens
guuagaaucucugcacugu

SEQ ID NO: 433052 - RNA, 19 nt, Homo sapiens
guugagaaguaguagaaga

SEQ ID NO: 433053 - RNA, 19 nt, Homo sapiens
caauuaugguggaccuauu

SEQ ID NO: 433054 - RNA, 19 nt, Homo sapiens
ugagguuuguuagagauua

SEQ ID NO: 433055 - RNA, 19 nt, Homo sapiens
ucagaaacaggacuuacua

SEQ ID NO: 433056 - RNA, 19 nt, Homo sapiens
acacacaggauaccaguuu

SEQ ID NO: 433057 - RNA, 19 nt, Homo sapiens
ggaguuugaccaucucuug

SEQ ID NO: 433058 - RNA, 19 nt, Homo sapiens
ccagaaaacuugcgaaaca

SEQ ID NO: 433059 - RNA, 19 nt, Homo sapiens
agaacacacugucagagaa

SEQ ID NO: 433060 - RNA, 19 nt, Homo sapiens
caagaaagaagugagcaaa

SEQ ID NO: 433061 - RNA, 19 nt, Homo sapiens
guguauguguggaaauaaa

SEQ ID NO: 433062 - RNA, 19 nt, Homo sapiens
gcauucaccuugccaucug

SEQ ID NO: 433063 - RNA, 19 nt, Homo sapiens
gacaaaaucucuuuagucu

SEQ ID NO: 433064 - RNA, 19 nt, Homo sapiens
cggaaacucuagugacaug

SEQ ID NO: 433065 - RNA, 19 nt, Homo sapiens
ccacagagaggaacaugga

SEQ ID NO: 433066 - RNA, 19 nt, Homo sapiens
gcagaaguccgagaagaga

SEQ ID NO: 433067 - RNA, 19 nt, Homo sapiens
ugugauguauuccaagaaa

SEQ ID NO: 433068 - RNA, 19 nt, Homo sapiens
cggagggucugaauucuuc

SEQ ID NO: 433069 - RNA, 19 nt, Homo sapiens
uuaugacaguugagaagua

SEQ ID NO: 433070 - RNA, 19 nt, Homo sapiens
gaaggaagcacugcagaag

SEQ ID NO: 433071 - RNA, 19 nt, Homo sapiens
gaacagagagguaggcaua

SEQ ID NO: 433072 - RNA, 19 nt, Homo sapiens
gaugauacaugcuaauuug

SEQ ID NO: 433073 - RNA, 19 nt, Homo sapiens
gaucuucccugacaucaaa

SEQ ID NO: 433074 - RNA, 19 nt, Homo sapiens
caaagaagcagaagauaaa

SEQ ID NO: 433075 - RNA, 19 nt, Homo sapiens
gaaaugggcccagaaguaa

SEQ ID NO: 433076 - RNA, 19 nt, Homo sapiens
guagugaccuuaccuguau

SEQ ID NO: 433077 - RNA, 19 nt, Homo sapiens
gaauggagauggcaaagau

SEQ ID NO: 433078 - RNA, 19 nt, Homo sapiens
gcaaugaggaguacaugua

SEQ ID NO: 433079 - RNA, 19 nt, Homo sapiens
gcaguaaaccaacuaauau

SEQ ID NO: 433080 - RNA, 19 nt, Homo sapiens
caaguacacugagcaauga

SEQ ID NO: 433081 - RNA, 19 nt, Homo sapiens
gcgaaguaauggaauaauu

SEQ ID NO: 433082 - RNA, 19 nt, Homo sapiens
gaguauaucuaacgugaau

SEQ ID NO: 433083 - RNA, 19 nt, Homo sapiens
ggaagaagaguguaguuga

SEQ ID NO: 433084 - RNA, 19 nt, Homo sapiens
gacuucauguguucauuua

SEQ ID NO: 433085 - RNA, 19 nt, Homo sapiens
ccaaagaagcagaagauaa

SEQ ID NO: 433086 - RNA, 19 nt, Homo sapiens
gaagaagaguguaguugag

SEQ ID NO: 433087 - RNA, 19 nt, Homo sapiens
gcccuaauauucacacuga

SEQ ID NO: 433088 - RNA, 19 nt, Homo sapiens
caagaggacagcugaagua

SEQ ID NO: 433089 - RNA, 19 nt, Homo sapiens
gaacggucaucuaaaccaa

SEQ ID NO: 433090 - RNA, 19 nt, Homo sapiens
caacuagagugaaagacuu

SEQ ID NO: 433091 - RNA, 19 nt, Homo sapiens
agauggagcuccuuccuuu

SEQ ID NO: 433092 - RNA, 19 nt, Homo sapiens
gugaagacuugacccagua

SEQ ID NO: 433093 - RNA, 19 nt, Homo sapiens
ggaggaugauacaugcuaa

SEQ ID NO: 433094 - RNA, 19 nt, Homo sapiens
caaagcaaaguguuuauga

SEQ ID NO: 433095 - RNA, 19 nt, Homo sapiens
ggaaugggcuaaguaugau

SEQ ID NO: 433096 - RNA, 19 nt, Homo sapiens
cagcaaagcaggauauaga

SEQ ID NO: 433097 - RNA, 19 nt, Homo sapiens
gaaccuaccacccuucuuc

SEQ ID NO: 433098 - RNA, 19 nt, Homo sapiens
agaaaugggcccagaagua

SEQ ID NO: 433099 - RNA, 19 nt, Homo sapiens
gcauuucccucaauacaag

SEQ ID NO: 433100 - RNA, 19 nt, Homo sapiens
caaagaaugguuuagagaa

SEQ ID NO: 433101 - RNA, 19 nt, Homo sapiens
gugagagucuugccuguug

SEQ ID NO: 433102 - RNA, 19 nt, Homo sapiens
agagagaucuucccugaca

SEQ ID NO: 433103 - RNA, 19 nt, Homo sapiens
gggaagccauucuccucua

SEQ ID NO: 433104 - RNA, 19 nt, Homo sapiens
uaacaccaggcuacucuua

SEQ ID NO: 433105 - RNA, 19 nt, Homo sapiens
ccauuuauguccaaucaga

SEQ ID NO: 433106 - RNA, 19 nt, Homo sapiens
gcagcugugcccaucauua

SEQ ID NO: 433107 - RNA, 19 nt, Homo sapiens
aagaugagccugaugcuaa

SEQ ID NO: 433108 - RNA, 19 nt, Homo sapiens
gaaagacuuccuagccauu

SEQ ID NO: 433109 - RNA, 19 nt, Homo sapiens
uaccagaaaucucagcaaa

SEQ ID NO: 433110 - RNA, 19 nt, Homo sapiens
guacauguaugccuauagg

SEQ ID NO: 433111 - RNA, 19 nt, Homo sapiens
ucagggagaugguacuguu

SEQ ID NO: 433112 - RNA, 19 nt, Homo sapiens
ggaugauacaugcuaauuu

SEQ ID NO: 433113 - RNA, 19 nt, Homo sapiens
acuagaaaguccauaggua

SEQ ID NO: 433114 - RNA, 19 nt, Homo sapiens
gcacuugcuucucauuugg

SEQ ID NO: 433115 - RNA, 19 nt, Homo sapiens
gaggacagcugaaguaccu

SEQ ID NO: 433116 - RNA, 19 nt, Homo sapiens
acaccaggcuacucuuauu

SEQ ID NO: 433117 - RNA, 19 nt, Homo sapiens
gauacaugcuaauuugcuu

SEQ ID NO: 433118 - RNA, 19 nt, Homo sapiens
guuuauaucccuacguuaa

SEQ ID NO: 433119 - RNA, 19 nt, Homo sapiens
ugcaagauguacagaaauu

SEQ ID NO: 433120 - RNA, 19 nt, Homo sapiens
ccaaggccgugcagaacaa

SEQ ID NO: 433121 - RNA, 19 nt, Homo sapiens
gaagaugagccugaugcua

SEQ ID NO: 433122 - RNA, 19 nt, Homo sapiens
gaaguccauucuccucugu

SEQ ID NO: 433123 - RNA, 19 nt, Homo sapiens
gggcagagcggauccugaa

SEQ ID NO: 433124 - RNA, 19 nt, Homo sapiens
ccugcaagauguacagaaa

SEQ ID NO: 433125 - RNA, 19 nt, Homo sapiens
cuuccuagccauuucauua

SEQ ID NO: 433126 - RNA, 19 nt, Homo sapiens
cagcugugcccaucauuaa

SEQ ID NO: 433127 - RNA, 19 nt, Homo sapiens
gcagguuaaugcccuagug

SEQ ID NO: 433128 - RNA, 19 nt, Homo sapiens
uaccaacuguuccugcuuu

SEQ ID NO: 433129 - RNA, 19 nt, Homo sapiens
ccaaguacacugagcaaug

SEQ ID NO: 433130 - RNA, 19 nt, Homo sapiens
ggaagccauucuccucuag

SEQ ID NO: 433131 - RNA, 19 nt, Homo sapiens
ggauuuauugguucaugua

SEQ ID NO: 433132 - RNA, 19 nt, Homo sapiens
gaagguaggaaugggcuaa

SEQ ID NO: 433133 - RNA, 19 nt, Homo sapiens
acaggguaauaaagacuua

SEQ ID NO: 433134 - RNA, 19 nt, Homo sapiens
guccaaauauugcuacagu

SEQ ID NO: 433135 - RNA, 19 nt, Homo sapiens
gaaguacugugagagucuu

SEQ ID NO: 433136 - RNA, 19 nt, Homo sapiens
cagggaaucuugguucuuc

SEQ ID NO: 433137 - RNA, 19 nt, Homo sapiens
gcaaaagcccuaauauuca

SEQ ID NO: 433138 - RNA, 19 nt, Homo sapiens
ccaaagaaugguuuagaga

SEQ ID NO: 433139 - RNA, 19 nt, Homo sapiens
ccuaaaggguucugagagu

SEQ ID NO: 433140 - RNA, 19 nt, Homo sapiens
ggcaagaucaucagagaga

SEQ ID NO: 433141 - RNA, 19 nt, Homo sapiens
gcaagauguacagaaauuu

SEQ ID NO: 433142 - RNA, 19 nt, Homo sapiens
caugcuaauuugcuuauuc

SEQ ID NO: 433143 - RNA, 19 nt, Homo sapiens
gguaggaaugggcuaagua

SEQ ID NO: 433144 - RNA, 19 nt, Homo sapiens
gaggauacagcaagugaug

SEQ ID NO: 433145 - RNA, 19 nt, Homo sapiens
cuaaauaccggacugacuu

SEQ ID NO: 433146 - RNA, 19 nt, Homo sapiens
aacaugaucuuaccaacug

SEQ ID NO: 433147 - RNA, 19 nt, Homo sapiens
uaucggaaguacugugaga

SEQ ID NO: 433148 - RNA, 19 nt, Homo sapiens
gaguacauguaugccuaua

SEQ ID NO: 433149 - RNA, 19 nt, Homo sapiens
cagggagacuucauguguu

SEQ ID NO: 433150 - RNA, 19 nt, Homo sapiens
ggguuuagguuagauguca

SEQ ID NO: 433151 - RNA, 19 nt, Homo sapiens
ucauacgugucaggacuua

SEQ ID NO: 433152 - RNA, 19 nt, Homo sapiens
agcuagaccugcuuucuuu

SEQ ID NO: 433153 - RNA, 19 nt, Homo sapiens
gccagcauuccuaagauua

SEQ ID NO: 433154 - RNA, 19 nt, Homo sapiens
caagcuguaucucuaccuu

SEQ ID NO: 433155 - RNA, 19 nt, Homo sapiens
guggcagcaucuugucaua

SEQ ID NO: 433156 - RNA, 19 nt, Homo sapiens
gaaggagagggaagccauu

SEQ ID NO: 433157 - RNA, 19 nt, Homo sapiens
guaggaaugggcuaaguau

SEQ ID NO: 433158 - RNA, 19 nt, Homo sapiens
caucuaaaccaaagaaugg

SEQ ID NO: 433159 - RNA, 19 nt, Homo sapiens
uaucauggacaacaccuuu

SEQ ID NO: 433160 - RNA, 19 nt, Homo sapiens
aggaaugggcuaaguauga

SEQ ID NO: 433161 - RNA, 19 nt, Homo sapiens
guguuuauaucccuacguu

SEQ ID NO: 433162 - RNA, 19 nt, Homo sapiens
aaagaaugguuuagagaac

SEQ ID NO: 433163 - RNA, 19 nt, Homo sapiens
cgugugcccugaccuguga

SEQ ID NO: 433164 - RNA, 19 nt, Homo sapiens
cuucagaggcuccgaggua

SEQ ID NO: 433165 - RNA, 19 nt, Homo sapiens
ugcagacccuccagaugua

SEQ ID NO: 433166 - RNA, 19 nt, Homo sapiens
ggucaggcggcaccaauga

SEQ ID NO: 433167 - RNA, 19 nt, Homo sapiens
gaucagcuagaccugcuuu

SEQ ID NO: 433168 - RNA, 19 nt, Homo sapiens
uaaauaccggacugacuuu

SEQ ID NO: 433169 - RNA, 19 nt, Homo sapiens
ccuuuaguguaaccaauaa

SEQ ID NO: 433170 - RNA, 19 nt, Homo sapiens
gagaugguacuguuuccaa

SEQ ID NO: 433171 - RNA, 19 nt, Homo sapiens
cagcuuaucuuuccaaaua

SEQ ID NO: 433172 - RNA, 19 nt, Homo sapiens
ugaguuagcugauuucuuu

SEQ ID NO: 433173 - RNA, 19 nt, Homo sapiens
gcaacaagauguacaagga

SEQ ID NO: 433174 - RNA, 19 nt, Homo sapiens
ggaaagugcagauaacaua

SEQ ID NO: 433175 - RNA, 19 nt, Homo sapiens
caauaacacuccuaagaaa

SEQ ID NO: 433176 - RNA, 19 nt, Homo sapiens
ggacgaggcggaccuguua

SEQ ID NO: 433177 - RNA, 19 nt, Homo sapiens
caauuggguucucuuaaua

SEQ ID NO: 433178 - RNA, 19 nt, Homo sapiens
guaugugucucaaguuuaa

SEQ ID NO: 433179 - RNA, 19 nt, Homo sapiens
aaucauggcuguucuaaga

SEQ ID NO: 433180 - RNA, 19 nt, Homo sapiens
aagcagacauuucuuguuu

SEQ ID NO: 433181 - RNA, 19 nt, Homo sapiens
caagagaguauauccaaua

SEQ ID NO: 433182 - RNA, 19 nt, Homo sapiens
uaaguaaucuggauaccuu

SEQ ID NO: 433183 - RNA, 19 nt, Homo sapiens
ugagggaacuuaccaagaa

SEQ ID NO: 433184 - RNA, 19 nt, Homo sapiens
uaagguagcugccuguuca

SEQ ID NO: 433185 - RNA, 19 nt, Homo sapiens
caucuacugucuguuauua

SEQ ID NO: 433186 - RNA, 19 nt, Homo sapiens
acaguuggcuucucucuuu

SEQ ID NO: 433187 - RNA, 19 nt, Homo sapiens
guaauaaucuaugccugua

SEQ ID NO: 433188 - RNA, 19 nt, Homo sapiens
gaaaagggacugaauuuaa

SEQ ID NO: 433189 - RNA, 19 nt, Homo sapiens
aagcuuaaguuacccuuua

SEQ ID NO: 433190 - RNA, 19 nt, Homo sapiens
gcaguuacuuucuguggaa

SEQ ID NO: 433191 - RNA, 19 nt, Homo sapiens
gaagucagcuuaucuuucc

SEQ ID NO: 433192 - RNA, 19 nt, Homo sapiens
agacauuucuuguuuguug

SEQ ID NO: 433193 - RNA, 19 nt, Homo sapiens
acuaagaaguccagaagua

SEQ ID NO: 433194 - RNA, 19 nt, Homo sapiens
gaauucaucuacugucugu

SEQ ID NO: 433195 - RNA, 19 nt, Homo sapiens
gcaauugagcuaucugaaa

SEQ ID NO: 433196 - RNA, 19 nt, Homo sapiens
guaaggaaagugauuauug

SEQ ID NO: 433197 - RNA, 19 nt, Homo sapiens
gagaggcucagaaucuuua

SEQ ID NO: 433198 - RNA, 19 nt, Homo sapiens
gcagacauuucuuguuugu

SEQ ID NO: 433199 - RNA, 19 nt, Homo sapiens
ggaugugucuccuacaguu

SEQ ID NO: 433200 - RNA, 19 nt, Homo sapiens
ucaaagagguaagcacauu

SEQ ID NO: 433201 - RNA, 19 nt, Homo sapiens
gcuauuaaaucagcaaguu

SEQ ID NO: 433202 - RNA, 19 nt, Homo sapiens
ggacaauauucaacacaau

SEQ ID NO: 433203 - RNA, 19 nt, Homo sapiens
uguaagaacuuugugauga

SEQ ID NO: 433204 - RNA, 19 nt, Homo sapiens
gaaaggagggaaaauaaua

SEQ ID NO: 433205 - RNA, 19 nt, Homo sapiens
gcaaagacaacagcaguuu

SEQ ID NO: 433206 - RNA, 19 nt, Homo sapiens
gaaacagcaacagcuauua

SEQ ID NO: 433207 - RNA, 19 nt, Homo sapiens
gauaacauacucuccauug

SEQ ID NO: 433208 - RNA, 19 nt, Homo sapiens
uaaauguucugcaguguca

SEQ ID NO: 433209 - RNA, 19 nt, Homo sapiens
ccaauaacacuccuaagaa

SEQ ID NO: 433210 - RNA, 19 nt, Homo sapiens
guaagaacuuugugaugau

SEQ ID NO: 433211 - RNA, 19 nt, Homo sapiens
uguuagugcugaucucuua

SEQ ID NO: 433212 - RNA, 19 nt, Homo sapiens
gccaggaaaugcuaaaugu

SEQ ID NO: 433213 - RNA, 19 nt, Homo sapiens
gcugauuucuuuauucugu

SEQ ID NO: 433214 - RNA, 19 nt, Homo sapiens
aagaacaucuacaugguuu

SEQ ID NO: 433215 - RNA, 19 nt, Homo sapiens
guuguugaccuuugaguua

SEQ ID NO: 433216 - RNA, 19 nt, Homo sapiens
ucuuugauguuaccuguua

SEQ ID NO: 433217 - RNA, 19 nt, Homo sapiens
uuucagagguguguuagua

SEQ ID NO: 433218 - RNA, 19 nt, Homo sapiens
acaauuggguucucuuaau

SEQ ID NO: 433219 - RNA, 19 nt, Homo sapiens
gaacuuaccaagaacaucu

SEQ ID NO: 433220 - RNA, 19 nt, Homo sapiens
ucagagguguguuaguaaa

SEQ ID NO: 433221 - RNA, 19 nt, Homo sapiens
aguaaaaccugacggauua

SEQ ID NO: 433222 - RNA, 19 nt, Homo sapiens
gccaauaacacuccuaaga

SEQ ID NO: 433223 - RNA, 19 nt, Homo sapiens
guagcugccuguucaugaa

SEQ ID NO: 433224 - RNA, 19 nt, Homo sapiens
ggagggaaaugggaaaugg

SEQ ID NO: 433225 - RNA, 19 nt, Homo sapiens
gacugaagcugucaaagag

SEQ ID NO: 433226 - RNA, 19 nt, Homo sapiens
caauugagcuaucugaaaa

SEQ ID NO: 433227 - RNA, 19 nt, Homo sapiens
aacuaacacuccaguauuu

SEQ ID NO: 433228 - RNA, 19 nt, Homo sapiens
gcuucucucuuugauguua

SEQ ID NO: 433229 - RNA, 19 nt, Homo sapiens
ccaagaacaucuacauggu

SEQ ID NO: 433230 - RNA, 19 nt, Homo sapiens
aaacagcaacagcuauuaa

SEQ ID NO: 433231 - RNA, 19 nt, Homo sapiens
gcucagugguucucaucaa

SEQ ID NO: 433232 - RNA, 19 nt, Homo sapiens
gaagguaaugaagcaguua

SEQ ID NO: 433233 - RNA, 19 nt, Homo sapiens
ggauggaaaugggaaagga

SEQ ID NO: 433234 - RNA, 19 nt, Homo sapiens
aaacuaacacuccaguauu

SEQ ID NO: 433235 - RNA, 19 nt, Homo sapiens
gagguaagcacauuuuaua

SEQ ID NO: 433236 - RNA, 19 nt, Homo sapiens
gcaagaaacaccgcaacaa

SEQ ID NO: 433237 - RNA, 19 nt, Homo sapiens
ucauuaaaguccaguuguu

SEQ ID NO: 433238 - RNA, 19 nt, Homo sapiens
agacauaaaugggguaaua

SEQ ID NO: 433239 - RNA, 19 nt, Homo sapiens
guccagaaguagugcaauu

SEQ ID NO: 433240 - RNA, 19 nt, Homo sapiens
guacaaggacaaguauaaa

SEQ ID NO: 433241 - RNA, 19 nt, Homo sapiens
gcagaggaauucaucuacu

SEQ ID NO: 433242 - RNA, 19 nt, Homo sapiens
cagcguguccugagucuuu

SEQ ID NO: 433243 - RNA, 19 nt, Homo sapiens
aaaggcaaaccuaccaaua

SEQ ID NO: 433244 - RNA, 19 nt, Homo sapiens
agcaacagcuauuaaauca

SEQ ID NO: 433245 - RNA, 19 nt, Homo sapiens
cuuacgauguugagaguuu

SEQ ID NO: 433246 - RNA, 19 nt, Homo sapiens
gaucucagcccaccaaugc

SEQ ID NO: 433247 - RNA, 19 nt, Homo sapiens
gauaagaauaguaggacaa

SEQ ID NO: 433248 - RNA, 19 nt, Homo sapiens
caagaaacaccgcaacaag

SEQ ID NO: 433249 - RNA, 19 nt, Homo sapiens
caaagagguaagcacauuu

SEQ ID NO: 433250 - RNA, 19 nt, Homo sapiens
gaaaauaauagcccaguga

SEQ ID NO: 433251 - RNA, 19 nt, Homo sapiens
ccaccaaugccaagacaaa

SEQ ID NO: 433252 - RNA, 19 nt, Homo sapiens
agacugaagcugucaaaga

SEQ ID NO: 433253 - RNA, 19 nt, Homo sapiens
cuacaauuggguucucuua

SEQ ID NO: 433254 - RNA, 19 nt, Homo sapiens
agacugucguuacuaagaa

SEQ ID NO: 433255 - RNA, 19 nt, Homo sapiens
aaaagacugucguuacuaa

SEQ ID NO: 433256 - RNA, 19 nt, Homo sapiens
uaagaacuuugugaugaug

SEQ ID NO: 433257 - RNA, 19 nt, Homo sapiens
aacauuagcuuaugcuucu

SEQ ID NO: 433258 - RNA, 19 nt, Homo sapiens
cagaggaauucaucuacug

SEQ ID NO: 433259 - RNA, 19 nt, Homo sapiens
caggaaaugcuaaauguuc

SEQ ID NO: 433260 - RNA, 19 nt, Homo sapiens
uaaugaagcaguuacuuuc

SEQ ID NO: 433261 - RNA, 19 nt, Homo sapiens
ugaagguaaugaagcaguu

SEQ ID NO: 433262 - RNA, 19 nt, Homo sapiens
aaugggaaauggauggaaa

SEQ ID NO: 433263 - RNA, 19 nt, Homo sapiens
aaauguaugugucucaagu

SEQ ID NO: 433264 - RNA, 19 nt, Homo sapiens
uggcuucucucuuugaugu

SEQ ID NO: 433265 - RNA, 19 nt, Homo sapiens
uaacacuccuaagaaaugu

SEQ ID NO: 433266 - RNA, 19 nt, Homo sapiens
ugaagcaguuacuuucugu

SEQ ID NO: 433267 - RNA, 19 nt, Homo sapiens
caagaacaucuacaugguu

SEQ ID NO: 433268 - RNA, 19 nt, Homo sapiens
uguacaaggacaaguauaa

SEQ ID NO: 433269 - RNA, 19 nt, Homo sapiens
aaaccugacggauuaacua

SEQ ID NO: 433270 - RNA, 19 nt, Homo sapiens
guggaagucauaaaguuaa

SEQ ID NO: 433271 - RNA, 19 nt, Homo sapiens
gagaacaugugguauuuga

SEQ ID NO: 433272 - RNA, 19 nt, Homo sapiens
ccacguguauguauucuuu

SEQ ID NO: 433273 - RNA, 19 nt, Homo sapiens
gauauauucuggauacaug

SEQ ID NO: 433274 - RNA, 19 nt, Homo sapiens
ccauuucucugaugacuuu

SEQ ID NO: 433275 - RNA, 19 nt, Homo sapiens
gauacaugguuugcaaaua

SEQ ID NO: 433276 - RNA, 19 nt, Homo sapiens
ggagaaaucaccauacugu

SEQ ID NO: 433277 - RNA, 19 nt, Homo sapiens
gugagaacaugugguauuu

SEQ ID NO: 433278 - RNA, 19 nt, Homo sapiens
uaauagccauucucauuug

SEQ ID NO: 433279 - RNA, 19 nt, Homo sapiens
guguauagguguucccuuu

SEQ ID NO: 433280 - RNA, 19 nt, Homo sapiens
caagugagaacauguggua

SEQ ID NO: 433281 - RNA, 19 nt, Homo sapiens
gacacaggauucagaaaga

SEQ ID NO: 433282 - RNA, 19 nt, Homo sapiens
guaaccaucacccuaauaa

SEQ ID NO: 433283 - RNA, 19 nt, Homo sapiens
caaaagacaugaucucguu

SEQ ID NO: 433284 - RNA, 19 nt, Homo sapiens
guagauaccaguaguagga

SEQ ID NO: 433285 - RNA, 19 nt, Homo sapiens
auaaugaccuccaguuuca

SEQ ID NO: 433286 - RNA, 19 nt, Homo sapiens
acaccaggcugcacagaaa

SEQ ID NO: 433287 - RNA, 19 nt, Homo sapiens
gaucaaugccaucaacuau

SEQ ID NO: 433288 - RNA, 19 nt, Homo sapiens
gcacguuguucauucuguu

SEQ ID NO: 433289 - RNA, 19 nt, Homo sapiens
agaaaucaccauacuguuu

SEQ ID NO: 433290 - RNA, 19 nt, Homo sapiens
aaccaucacccuaauaaua

SEQ ID NO: 433291 - RNA, 19 nt, Homo sapiens
ucaauacccugaccaucuu

SEQ ID NO: 433292 - RNA, 19 nt, Homo sapiens
gcauacaagugcagguuuc

SEQ ID NO: 433293 - RNA, 19 nt, Homo sapiens
gacaugaucucguucuuuu

SEQ ID NO: 433294 - RNA, 19 nt, Homo sapiens
ccaucacccuaauaauaua

SEQ ID NO: 433295 - RNA, 19 nt, Homo sapiens
gguauuugacuuucuguuu

SEQ ID NO: 433296 - RNA, 19 nt, Homo sapiens
ccacguguacacauuauuu

SEQ ID NO: 433297 - RNA, 19 nt, Homo sapiens
gaagcucucuccggucuca

SEQ ID NO: 433298 - RNA, 19 nt, Homo sapiens
ggacacaggauucagaaag

SEQ ID NO: 433299 - RNA, 19 nt, Homo sapiens
gcacagaaagagccagaug

SEQ ID NO: 433300 - RNA, 19 nt, Homo sapiens
guacagugcaguuuuguua

SEQ ID NO: 433301 - RNA, 19 nt, Homo sapiens
gagaaggaccgaaccaagu

SEQ ID NO: 433302 - RNA, 19 nt, Homo sapiens
gaguggccaucuccaggua

SEQ ID NO: 433303 - RNA, 19 nt, Homo sapiens
gaaaucaccauacuguuuu

SEQ ID NO: 433304 - RNA, 19 nt, Homo sapiens
gaucaaaugguagcucuau

SEQ ID NO: 433305 - RNA, 19 nt, Homo sapiens
ccauaucuuugcuacugua

SEQ ID NO: 433306 - RNA, 19 nt, Homo sapiens
gaacaugugguauuugacu

SEQ ID NO: 433307 - RNA, 19 nt, Homo sapiens
ucuccaaugucuauuauuc

SEQ ID NO: 433308 - RNA, 19 nt, Homo sapiens
cccauuaaguuauuucuca

SEQ ID NO: 433309 - RNA, 19 nt, Homo sapiens
uuaagucccauuugucuaa

SEQ ID NO: 433310 - RNA, 19 nt, Homo sapiens
gcaguguaguauuccauuc

SEQ ID NO: 433311 - RNA, 19 nt, Homo sapiens
ggugaagucugggcuuuua

SEQ ID NO: 433312 - RNA, 19 nt, Homo sapiens
cguuguacccauuaaguua

SEQ ID NO: 433313 - RNA, 19 nt, Homo sapiens
aauauacguuguacccauu

SEQ ID NO: 433314 - RNA, 19 nt, Homo sapiens
ucaaugccaucaacuaugc

SEQ ID NO: 433315 - RNA, 19 nt, Homo sapiens
aaauaaugaccuccaguuu

SEQ ID NO: 433316 - RNA, 19 nt, Homo sapiens
gagucuccaaugucuauua

SEQ ID NO: 433317 - RNA, 19 nt, Homo sapiens
acagaaacuucaccagcuu

SEQ ID NO: 433318 - RNA, 19 nt, Homo sapiens
ggauaauagucuggauaau

SEQ ID NO: 433319 - RNA, 19 nt, Homo sapiens
uaguaggacugcuggauca

SEQ ID NO: 433320 - RNA, 19 nt, Homo sapiens
uuauuuagcucccacuuac

SEQ ID NO: 433321 - RNA, 19 nt, Homo sapiens
gaaggaccgaaccaaguga

SEQ ID NO: 433322 - RNA, 19 nt, Homo sapiens
uggauaauagucuggauaa

SEQ ID NO: 433323 - RNA, 19 nt, Homo sapiens
gccauucucauuuguguga

SEQ ID NO: 433324 - RNA, 19 nt, Homo sapiens
gagaaaucaccauacuguu

SEQ ID NO: 433325 - RNA, 19 nt, Homo sapiens
uagauugccuaguggugaa

SEQ ID NO: 433326 - RNA, 19 nt, Homo sapiens
cacgaucacuuccuacagu

SEQ ID NO: 433327 - RNA, 19 nt, Homo sapiens
ucaucacgaucacuuccua

SEQ ID NO: 433328 - RNA, 19 nt, Homo sapiens
ggauacaugguuugcaaau

SEQ ID NO: 433329 - RNA, 19 nt, Homo sapiens
uaggacugcuggaucaaau

SEQ ID NO: 433330 - RNA, 19 nt, Homo sapiens
uacaagugcagguuucuuu

SEQ ID NO: 433331 - RNA, 19 nt, Homo sapiens
auggauagauugccuagug

SEQ ID NO: 433332 - RNA, 19 nt, Homo sapiens
ucauucuguugaugguuua

SEQ ID NO: 433333 - RNA, 19 nt, Homo sapiens
uaucuuugcuacuguaaac

SEQ ID NO: 433334 - RNA, 19 nt, Homo sapiens
uaagucccauuugucuaaa

SEQ ID NO: 433335 - RNA, 19 nt, Homo sapiens
cuggauacaugguuugcaa

SEQ ID NO: 433336 - RNA, 19 nt, Homo sapiens
ugacagcguuggccagcau

SEQ ID NO: 433337 - RNA, 19 nt, Homo sapiens
cauagggguuguacuaauu

SEQ ID NO: 433338 - RNA, 19 nt, Homo sapiens
guaguauuccauuccauau

SEQ ID NO: 433339 - RNA, 19 nt, Homo sapiens
guggugaagucugggcuuu

SEQ ID NO: 433340 - RNA, 19 nt, Homo sapiens
cuggauauauucuggauac

SEQ ID NO: 433341 - RNA, 19 nt, Homo sapiens
uguaguauuccauuccaua

SEQ ID NO: 433342 - RNA, 19 nt, Homo sapiens
uuauggcaguguaguauuc

SEQ ID NO: 433343 - RNA, 19 nt, Homo sapiens
aauaaugaccuccaguuuc

SEQ ID NO: 433344 - RNA, 19 nt, Homo sapiens
cgaucaaugccaucaacua

SEQ ID NO: 433345 - RNA, 19 nt, Homo sapiens
ccuaugccauccuguaucu

SEQ ID NO: 433346 - RNA, 19 nt, Homo sapiens
guggccaucuccagguaaa

SEQ ID NO: 433347 - RNA, 19 nt, Homo sapiens
uaaggucucauugugguuu

SEQ ID NO: 433348 - RNA, 19 nt, Homo sapiens
uagccauucucauuugugu

SEQ ID NO: 433349 - RNA, 19 nt, Homo sapiens
cacguguacacauuauuua

SEQ ID NO: 433350 - RNA, 19 nt, Homo sapiens
ccauguccuucuucaacuu

SEQ ID NO: 433351 - RNA, 19 nt, Homo sapiens
uuaagacaguauggagaaa

SEQ ID NO: 433352 - RNA, 19 nt, Homo sapiens
cagccugaaugcccucguu

SEQ ID NO: 433353 - RNA, 19 nt, Homo sapiens
acugcuggaucaaauggua

SEQ ID NO: 433354 - RNA, 19 nt, Homo sapiens
uauacguuguacccauuaa

SEQ ID NO: 433355 - RNA, 19 nt, Homo sapiens
acagaaagagccagaugga

SEQ ID NO: 433356 - RNA, 19 nt, Homo sapiens
ucgcagacgugacuuccau

SEQ ID NO: 433357 - RNA, 19 nt, Homo sapiens
aagacaguauggagaaauc

SEQ ID NO: 433358 - RNA, 19 nt, Homo sapiens
ggacugcuggaucaaaugg

SEQ ID NO: 433359 - RNA, 19 nt, Homo sapiens
gagcugugauaagcauaca

SEQ ID NO: 433360 - RNA, 19 nt, Homo sapiens
agacaugaucucguucuuu

SEQ ID NO: 433361 - RNA, 19 nt, Homo sapiens
ggauauauucuggauacau

SEQ ID NO: 433362 - RNA, 19 nt, Homo sapiens
ucugcauccuuaccaauau

SEQ ID NO: 433363 - RNA, 19 nt, Homo sapiens
uucauucuguugaugguuu

SEQ ID NO: 433364 - RNA, 19 nt, Homo sapiens
uauucuggauacaugguuu

SEQ ID NO: 433365 - RNA, 19 nt, Homo sapiens
guaggacugcuggaucaaa

SEQ ID NO: 433366 - RNA, 19 nt, Homo sapiens
uuuauccaaucaucuguug

SEQ ID NO: 433367 - RNA, 19 nt, Homo sapiens
agucuccaaugucuauuau

SEQ ID NO: 433368 - RNA, 19 nt, Homo sapiens
gacaccaggcugcacagaa

SEQ ID NO: 433369 - RNA, 19 nt, Homo sapiens
gcuggacacaggauucaga

SEQ ID NO: 433370 - RNA, 19 nt, Homo sapiens
uaauuaagucccauuuguc

SEQ ID NO: 433371 - RNA, 19 nt, Homo sapiens
gagaugaacuguguauuua

SEQ ID NO: 433372 - RNA, 19 nt, Homo sapiens
uaaaugaccugcaggcuaa

SEQ ID NO: 433373 - RNA, 19 nt, Homo sapiens
ggaggaagauacuguggua

SEQ ID NO: 433374 - RNA, 19 nt, Homo sapiens
ggaauguucuucucugcua

SEQ ID NO: 433375 - RNA, 19 nt, Homo sapiens
guacugagcuauugaaguc

SEQ ID NO: 433376 - RNA, 19 nt, Homo sapiens
ugaagggaauuaacagaua

SEQ ID NO: 433377 - RNA, 19 nt, Homo sapiens
gaaggaaugugccaguaug

SEQ ID NO: 433378 - RNA, 19 nt, Homo sapiens
caucuccacuccaaaguua

SEQ ID NO: 433379 - RNA, 19 nt, Homo sapiens
gaaguuuccuaaagucuga

SEQ ID NO: 433380 - RNA, 19 nt, Homo sapiens
gaaaggaaccacucauuca

SEQ ID NO: 433381 - RNA, 19 nt, Homo sapiens
ccaaaggaauugaaaggaa

SEQ ID NO: 433382 - RNA, 19 nt, Homo sapiens
gaagggaauuaacagauag

SEQ ID NO: 433383 - RNA, 19 nt, Homo sapiens
guggagcucuguauuagaa

SEQ ID NO: 433384 - RNA, 19 nt, Homo sapiens
guaaugcaauggucucaau

SEQ ID NO: 433385 - RNA, 19 nt, Homo sapiens
gaagagaugaacuguguau

SEQ ID NO: 433386 - RNA, 19 nt, Homo sapiens
gcgcagaguugaagaagca

SEQ ID NO: 433387 - RNA, 19 nt, Homo sapiens
uggaagagaugaacugugu

SEQ ID NO: 433388 - RNA, 19 nt, Homo sapiens
ugaagaagcauaagcaaga

SEQ ID NO: 433389 - RNA, 19 nt, Homo sapiens
gaagaacaaaugacucaga

SEQ ID NO: 433390 - RNA, 19 nt, Homo sapiens
gcauuuauuccucagauuu

SEQ ID NO: 433391 - RNA, 19 nt, Homo sapiens
ucuggaaucuggaaugaaa

SEQ ID NO: 433392 - RNA, 19 nt, Homo sapiens
aagcauaccugagaucuau

SEQ ID NO: 433393 - RNA, 19 nt, Homo sapiens
cagaaacugugacuaaagu

SEQ ID NO: 433394 - RNA, 19 nt, Homo sapiens
cagaagagauauauaaagc

SEQ ID NO: 433395 - RNA, 19 nt, Homo sapiens
guaaagcagaagagauaua

SEQ ID NO: 433396 - RNA, 19 nt, Homo sapiens
ugaaacugauuacaacaga

SEQ ID NO: 433397 - RNA, 19 nt, Homo sapiens
gaauguucuucucugcuaa

SEQ ID NO: 433398 - RNA, 19 nt, Homo sapiens
gaugaacuguguauuuaac

SEQ ID NO: 433399 - RNA, 19 nt, Homo sapiens
gcagccaucuccacuccaa

SEQ ID NO: 433400 - RNA, 19 nt, Homo sapiens
agagaugaacuguguauuu

SEQ ID NO: 433401 - RNA, 19 nt, Homo sapiens
aagaacaaaugacucagaa

SEQ ID NO: 433402 - RNA, 19 nt, Homo sapiens
cagaaggaaugugccagua

SEQ ID NO: 433403 - RNA, 19 nt, Homo sapiens
gagaaucuacagccaagaa

SEQ ID NO: 433404 - RNA, 19 nt, Homo sapiens
ggagucagaauauauuugu

SEQ ID NO: 433405 - RNA, 19 nt, Homo sapiens
caaauugccauugcuacua

SEQ ID NO: 433406 - RNA, 19 nt, Homo sapiens
ggaagauacugugguacug

SEQ ID NO: 433407 - RNA, 19 nt, Homo sapiens
caucuggaaucuggaauga

SEQ ID NO: 433408 - RNA, 19 nt, Homo sapiens
gaagcaauuucuguuuaca

SEQ ID NO: 433409 - RNA, 19 nt, Homo sapiens
ccagguuccucaaaucaga

SEQ ID NO: 433410 - RNA, 19 nt, Homo sapiens
gcagaagagauauauaaag

SEQ ID NO: 433411 - RNA, 19 nt, Homo sapiens
uacauguccuugcuacuuu

SEQ ID NO: 433412 - RNA, 19 nt, Homo sapiens
aaauugccauugcuacuau

SEQ ID NO: 433413 - RNA, 19 nt, Homo sapiens
gcuauugaagucccauuaa

SEQ ID NO: 433414 - RNA, 19 nt, Homo sapiens
ucagugaggagaauauuga

SEQ ID NO: 433415 - RNA, 19 nt, Homo sapiens
cuacagccaagaagauuaa

SEQ ID NO: 433416 - RNA, 19 nt, Homo sapiens
gcuugucgguguuauuuua

SEQ ID NO: 433417 - RNA, 19 nt, Homo sapiens
aaaccagggagucagaaua

SEQ ID NO: 433418 - RNA, 19 nt, Homo sapiens
auacugugguacugucaua

SEQ ID NO: 433419 - RNA, 19 nt, Homo sapiens
aaacagagagaccgcagaa

SEQ ID NO: 433420 - RNA, 19 nt, Homo sapiens
gcugcuaaacaaaucaaua

SEQ ID NO: 433421 - RNA, 19 nt, Homo sapiens
cuguaaagcagaagagaua

SEQ ID NO: 433422 - RNA, 19 nt, Homo sapiens
gaaugaaaucuuccaaguc

SEQ ID NO: 433423 - RNA, 19 nt, Homo sapiens
aaucuggaaugaaaucuuc

SEQ ID NO: 433424 - RNA, 19 nt, Homo sapiens
caauuucuguuuacauguc

SEQ ID NO: 433425 - RNA, 19 nt, Homo sapiens
guuaaaucauuggugcuaa

SEQ ID NO: 433426 - RNA, 19 nt, Homo sapiens
ccagggagucagaauauau

SEQ ID NO: 433427 - RNA, 19 nt, Homo sapiens
gaagaagcauaagcaagac

SEQ ID NO: 433428 - RNA, 19 nt, Homo sapiens
uaaagcauuugugcauuca

SEQ ID NO: 433429 - RNA, 19 nt, Homo sapiens
ugaaaggaaccacucauuc

SEQ ID NO: 433430 - RNA, 19 nt, Homo sapiens
cuaugaaacugauuacaac

SEQ ID NO: 433431 - RNA, 19 nt, Homo sapiens
caguggagcucuguauuag

SEQ ID NO: 433432 - RNA, 19 nt, Homo sapiens
auaaagcauuugugcauuc

SEQ ID NO: 433433 - RNA, 19 nt, Homo sapiens
gaagauacugugguacugu

SEQ ID NO: 433434 - RNA, 19 nt, Homo sapiens
gugaggagaauauugaguu

SEQ ID NO: 433435 - RNA, 19 nt, Homo sapiens
guccaaggauguacuuucu

SEQ ID NO: 433436 - RNA, 19 nt, Homo sapiens
ggaaggccagguaacucua

SEQ ID NO: 433437 - RNA, 19 nt, Homo sapiens
gaaucuacagccaagaaga

SEQ ID NO: 433438 - RNA, 19 nt, Homo sapiens
uaucccagguuccucaaau

SEQ ID NO: 433439 - RNA, 19 nt, Homo sapiens
ugaggagaauauugaguuc

SEQ ID NO: 433440 - RNA, 19 nt, Homo sapiens
gaaagcauaccugagaucu

SEQ ID NO: 433441 - RNA, 19 nt, Homo sapiens
uaacccaaaggaauugaaa

SEQ ID NO: 433442 - RNA, 19 nt, Homo sapiens
ggagcucuguauuagaaag

SEQ ID NO: 433443 - RNA, 19 nt, Homo sapiens
aagcauuugugcauucaga

SEQ ID NO: 433444 - RNA, 19 nt, Homo sapiens
gaaccacucauucacuucu

SEQ ID NO: 433445 - RNA, 19 nt, Homo sapiens
gaagcauaagcaagacaaa

SEQ ID NO: 433446 - RNA, 19 nt, Homo sapiens
cagaguugaagaagcauaa

SEQ ID NO: 433447 - RNA, 19 nt, Homo sapiens
gcagaguugaagaagcaua

SEQ ID NO: 433448 - RNA, 19 nt, Homo sapiens
ccaagaagaacaaaugacu

SEQ ID NO: 433449 - RNA, 19 nt, Homo sapiens
gcagaaggaggaagauacu

SEQ ID NO: 433450 - RNA, 19 nt, Homo sapiens
cagagagaccgcagaagga

SEQ ID NO: 433451 - RNA, 19 nt, Homo sapiens
gaaucuggaaugaaaucuu

SEQ ID NO: 433452 - RNA, 19 nt, Homo sapiens
cagggagucagaauauauu

SEQ ID NO: 433453 - RNA, 19 nt, Homo sapiens
ggaagagaugaacugugua

SEQ ID NO: 433454 - RNA, 19 nt, Homo sapiens
ucaacugacaucuaugcua

SEQ ID NO: 433455 - RNA, 19 nt, Homo sapiens
aagaagaacaaaugacuca

SEQ ID NO: 433456 - RNA, 19 nt, Homo sapiens
gugaacagcuuggccuuuu

SEQ ID NO: 433457 - RNA, 19 nt, Homo sapiens
gggaauuaacagauaguau

SEQ ID NO: 433458 - RNA, 19 nt, Homo sapiens
agcaauuucuguuuacaug

SEQ ID NO: 433459 - RNA, 19 nt, Homo sapiens
gaucccacaucuggaaucu

SEQ ID NO: 433460 - RNA, 19 nt, Homo sapiens
aggaaccacucauucacuu

SEQ ID NO: 433461 - RNA, 19 nt, Homo sapiens
uauaguuuguacugagcua

SEQ ID NO: 433462 - RNA, 19 nt, Homo sapiens
aagaaucaaagucaacuga

SEQ ID NO: 433463 - RNA, 19 nt, Homo sapiens
cugcugaaguaaugcaaug

SEQ ID NO: 433464 - RNA, 19 nt, Homo sapiens
uuacauguccuugcuacuu

SEQ ID NO: 433465 - RNA, 19 nt, Homo sapiens
gcaauuucuguuuacaugu

SEQ ID NO: 433466 - RNA, 19 nt, Homo sapiens
cagaugcugcuaaacaaau

SEQ ID NO: 433467 - RNA, 19 nt, Homo sapiens
ugaaaucuuccaaguccaa

SEQ ID NO: 433468 - RNA, 19 nt, Homo sapiens
ccacaucuggaaucuggaa

SEQ ID NO: 433469 - RNA, 19 nt, Homo sapiens
gaaggccagguaacucuag

SEQ ID NO: 433470 - RNA, 19 nt, Homo sapiens
caaaaugccaggaauguuc

SEQ ID NO: 433471 - RNA, 19 nt, Homo sapiens
gaaggcagcuacacuuuga

SEQ ID NO: 433472 - RNA, 19 nt, Homo sapiens
ggaggacauuucauucuuu

SEQ ID NO: 433473 - RNA, 19 nt, Homo sapiens
gcaaagugcuauguucuug

SEQ ID NO: 433474 - RNA, 19 nt, Homo sapiens
cauaaagacugaccuugaa

SEQ ID NO: 433475 - RNA, 19 nt, Homo sapiens
guacuguugucucauguaa

SEQ ID NO: 433476 - RNA, 19 nt, Homo sapiens
aaacaucacucagaacuau

SEQ ID NO: 433477 - RNA, 19 nt, Homo sapiens
caauagaucugggauuaug

SEQ ID NO: 433478 - RNA, 19 nt, Homo sapiens
gaugaaagagacaauguaa

SEQ ID NO: 433479 - RNA, 19 nt, Homo sapiens
acaaguggcugcuuuacaa

SEQ ID NO: 433480 - RNA, 19 nt, Homo sapiens
guacaucuuucccuaaauc

SEQ ID NO: 433481 - RNA, 19 nt, Homo sapiens
ggagaacgauaaugcaaag

SEQ ID NO: 433482 - RNA, 19 nt, Homo sapiens
ugaaauagaaugagugcua

SEQ ID NO: 433483 - RNA, 19 nt, Homo sapiens
gggaauagguggucugaac

SEQ ID NO: 433484 - RNA, 19 nt, Homo sapiens
caggaaacaucacucagaa

SEQ ID NO: 433485 - RNA, 19 nt, Homo sapiens
gaccacagaucaucaguac

SEQ ID NO: 433486 - RNA, 19 nt, Homo sapiens
cagcuucccucacugugua

SEQ ID NO: 433487 - RNA, 19 nt, Homo sapiens
acagugaaguguuuacuau

SEQ ID NO: 433488 - RNA, 19 nt, Homo sapiens
aggagaagcugguaucaga

SEQ ID NO: 433489 - RNA, 19 nt, Homo sapiens
ggaagacccguuugagcua

SEQ ID NO: 433490 - RNA, 19 nt, Homo sapiens
caucaguacuguugucuca

SEQ ID NO: 433491 - RNA, 19 nt, Homo sapiens
aagcaggaauguaagauga

SEQ ID NO: 433492 - RNA, 19 nt, Homo sapiens
gaaguggucuuugaauacu

SEQ ID NO: 433493 - RNA, 19 nt, Homo sapiens
gaaacaucacucagaacua

SEQ ID NO: 433494 - RNA, 19 nt, Homo sapiens
gagacaauguaauacuguu

SEQ ID NO: 433495 - RNA, 19 nt, Homo sapiens
aaaguuggguagugaauca

SEQ ID NO: 433496 - RNA, 19 nt, Homo sapiens
gcaggaauguaagaugaug

SEQ ID NO: 433497 - RNA, 19 nt, Homo sapiens
cagaacagcuucccucacu

SEQ ID NO: 433498 - RNA, 19 nt, Homo sapiens
ugauggagaacaacucuua

SEQ ID NO: 433499 - RNA, 19 nt, Homo sapiens
uugaaguggucuuugaaua

SEQ ID NO: 433500 - RNA, 19 nt, Homo sapiens
cuaaaucgauccauguuac

SEQ ID NO: 433501 - RNA, 19 nt, Homo sapiens
acucagaacuauugauuca

SEQ ID NO: 433502 - RNA, 19 nt, Homo sapiens
aaacugcaguguccguuau

SEQ ID NO: 433503 - RNA, 19 nt, Homo sapiens
guccguguuugcauuguua

SEQ ID NO: 433504 - RNA, 19 nt, Homo sapiens
ccacagaucaucaguacug

SEQ ID NO: 433505 - RNA, 19 nt, Homo sapiens
aucaauagaucugggauua

SEQ ID NO: 433506 - RNA, 19 nt, Homo sapiens
ccauaaagacugaccuuga

SEQ ID NO: 433507 - RNA, 19 nt, Homo sapiens
aauauggucuugcugcauu

SEQ ID NO: 433508 - RNA, 19 nt, Homo sapiens
gaaacggacccuuuuaaaa

SEQ ID NO: 433509 - RNA, 19 nt, Homo sapiens
gaccugccauaaagacuga

SEQ ID NO: 433510 - RNA, 19 nt, Homo sapiens
gaucaucaguacuguuguc

SEQ ID NO: 433511 - RNA, 19 nt, Homo sapiens
uuagguagcugguuguaca

SEQ ID NO: 433512 - RNA, 19 nt, Homo sapiens
acagcaagcuuucaucaag

SEQ ID NO: 433513 - RNA, 19 nt, Homo sapiens
ggaaacaucacucagaacu

SEQ ID NO: 433514 - RNA, 19 nt, Homo sapiens
ggacugugaccugccauaa

SEQ ID NO: 433515 - RNA, 19 nt, Homo sapiens
gcaaacagcaagcuuucau

SEQ ID NO: 433516 - RNA, 19 nt, Homo sapiens
gcagacccauggacaagag

SEQ ID NO: 433517 - RNA, 19 nt, Homo sapiens
ucacucagaacuauugauu

SEQ ID NO: 433518 - RNA, 19 nt, Homo sapiens
gaauucagccuggguguuc

SEQ ID NO: 433519 - RNA, 19 nt, Homo sapiens
gaauauacaagaagcuaca

SEQ ID NO: 433520 - RNA, 19 nt, Homo sapiens
ugagugcuaugguguugaa

SEQ ID NO: 433521 - RNA, 19 nt, Homo sapiens
ucaguacuguugucucaug

SEQ ID NO: 433522 - RNA, 19 nt, Homo sapiens
uaaagacugaccuugaauu

SEQ ID NO: 433523 - RNA, 19 nt, Homo sapiens
gggauuauguggccuuagg

SEQ ID NO: 433524 - RNA, 19 nt, Homo sapiens
gaaagagacaauguaauac

SEQ ID NO: 433525 - RNA, 19 nt, Homo sapiens
gcuacaaguggcugcuuua

SEQ ID NO: 433526 - RNA, 19 nt, Homo sapiens
cccaaaagcuguccucaaa

SEQ ID NO: 433527 - RNA, 19 nt, Homo sapiens
gaaaugguccguguuugca

SEQ ID NO: 433528 - RNA, 19 nt, Homo sapiens
gaauguaagaugaugaaag

SEQ ID NO: 433529 - RNA, 19 nt, Homo sapiens
uaaagucggaauucuguga

SEQ ID NO: 433530 - RNA, 19 nt, Homo sapiens
gcccagaaauggaggacau

SEQ ID NO: 433531 - RNA, 19 nt, Homo sapiens
caaaagcuguccucaaaag

SEQ ID NO: 433532 - RNA, 19 nt, Homo sapiens
gcuguggucagaagcauuu

SEQ ID NO: 433533 - RNA, 19 nt, Homo sapiens
acuguugucucauguaaug

SEQ ID NO: 433534 - RNA, 19 nt, Homo sapiens
cagaucaucaguacuguug

SEQ ID NO: 433535 - RNA, 19 nt, Homo sapiens
gggagaacgauaaugcaaa

SEQ ID NO: 433536 - RNA, 19 nt, Homo sapiens
uggaggacauuucauucuu

SEQ ID NO: 433537 - RNA, 19 nt, Homo sapiens
gaaugagugcuaugguguu

SEQ ID NO: 433538 - RNA, 19 nt, Homo sapiens
gauuauguggccuuaggua

SEQ ID NO: 433539 - RNA, 19 nt, Homo sapiens
gcuauguucuuggcuguuc

SEQ ID NO: 433540 - RNA, 19 nt, Homo sapiens
ucaggaaacaucacucaga

SEQ ID NO: 433541 - RNA, 19 nt, Homo sapiens
caacucuuauccucguuuc

SEQ ID NO: 433542 - RNA, 19 nt, Homo sapiens
cuuuacaacugcccagaaa

SEQ ID NO: 433543 - RNA, 19 nt, Homo sapiens
guauugaaguucuuaugac

SEQ ID NO: 433544 - RNA, 19 nt, Homo sapiens
gugaaguguuuacuaugug

SEQ ID NO: 433545 - RNA, 19 nt, Homo sapiens
agugaaguguuuacuaugu

SEQ ID NO: 433546 - RNA, 19 nt, Homo sapiens
guagcugguuguacaucuu

SEQ ID NO: 433547 - RNA, 19 nt, Homo sapiens
gaacguggugucucacucu

SEQ ID NO: 433548 - RNA, 19 nt, Homo sapiens
ugaaucaggaagccaguaa

SEQ ID NO: 433549 - RNA, 19 nt, Homo sapiens
gaggacauuucauucuuuu

SEQ ID NO: 433550 - RNA, 19 nt, Homo sapiens
aaacagcaagcuuucauca

SEQ ID NO: 433551 - RNA, 19 nt, Homo sapiens
uaccaggacuuguguaaaa

SEQ ID NO: 433552 - RNA, 19 nt, Homo sapiens
ccuaaaucgauccauguua

SEQ ID NO: 433553 - RNA, 19 nt, Homo sapiens
ggagaagcugguaucagaa

SEQ ID NO: 433554 - RNA, 19 nt, Homo sapiens
aaaggaagcuccaaaagag

SEQ ID NO: 433555 - RNA, 19 nt, Homo sapiens
gaugugugaaauagaauga

SEQ ID NO: 433556 - RNA, 19 nt, Homo sapiens
aagagacaauguaauacug

SEQ ID NO: 433557 - RNA, 19 nt, Homo sapiens
aagaugaaacggacccuuu

SEQ ID NO: 433558 - RNA, 19 nt, Homo sapiens
acugugaccugccauaaag

SEQ ID NO: 433559 - RNA, 19 nt, Homo sapiens
aaagggagcccagaaaugg

SEQ ID NO: 433560 - RNA, 19 nt, Homo sapiens
cagaauauacaagaagcua

SEQ ID NO: 433561 - RNA, 19 nt, Homo sapiens
gaaaagcaggaauguaaga

SEQ ID NO: 433562 - RNA, 19 nt, Homo sapiens
ugaaguggucuuugaauac

SEQ ID NO: 433563 - RNA, 19 nt, Homo sapiens
gauuggaagacccguuuga

SEQ ID NO: 433564 - RNA, 19 nt, Homo sapiens
ugaugaaagagacaaugua

SEQ ID NO: 433565 - RNA, 19 nt, Homo sapiens
cguggugucucacucugaa

SEQ ID NO: 433566 - RNA, 19 nt, Homo sapiens
auucaaaguuggguaguga

SEQ ID NO: 433567 - RNA, 19 nt, Homo sapiens
gauucaaaguuggguagug

SEQ ID NO: 433568 - RNA, 19 nt, Homo sapiens
ccacauaguaguuuuaguu

SEQ ID NO: 433569 - RNA, 19 nt, Homo sapiens
uguaagaugaugaaagaga

SEQ ID NO: 433570 - RNA, 19 nt, Homo sapiens
aaugcaaagugcuauguuc

SEQ ID NO: 433571 - RNA, 19 nt, Homo sapiens
gaagaucuuugcugaauac

SEQ ID NO: 433572 - RNA, 19 nt, Homo sapiens
gggagaagcugccaugcaa

SEQ ID NO: 433573 - RNA, 19 nt, Homo sapiens
ggacagacggauagacaua

SEQ ID NO: 433574 - RNA, 19 nt, Homo sapiens
ccaaggacaugaagaacaa

SEQ ID NO: 433575 - RNA, 19 nt, Homo sapiens
gaucuuugcugaauacauc

SEQ ID NO: 433576 - RNA, 19 nt, Homo sapiens
ucaagaaggucaagucaca

SEQ ID NO: 433577 - RNA, 19 nt, Homo sapiens
ugaccaaguuccuuaaaga

SEQ ID NO: 433578 - RNA, 19 nt, Homo sapiens
uaaaaggccuguguuauuu

SEQ ID NO: 433579 - RNA, 19 nt, Homo sapiens
gaaggaagccaaggacaug

SEQ ID NO: 433580 - RNA, 19 nt, Homo sapiens
ggacaccauucuccagcuu

SEQ ID NO: 433581 - RNA, 19 nt, Homo sapiens
uggagaagcugcugguuca

SEQ ID NO: 433582 - RNA, 19 nt, Homo sapiens
caaauacggguuagcaaug

SEQ ID NO: 433583 - RNA, 19 nt, Homo sapiens
agaagaucuuugcugaaua

SEQ ID NO: 433584 - RNA, 19 nt, Homo sapiens
gccaaguucuggagcaaau

SEQ ID NO: 433585 - RNA, 19 nt, Homo sapiens
caaguucuggagcaaauaa

SEQ ID NO: 433586 - RNA, 19 nt, Homo sapiens
gaccaaguuccuuaaagaa

SEQ ID NO: 433587 - RNA, 19 nt, Homo sapiens
ggacucguacccucgcuuu

SEQ ID NO: 433588 - RNA, 19 nt, Homo sapiens
ggcacgucguccuguaaua

SEQ ID NO: 433589 - RNA, 19 nt, Homo sapiens
gcuucgaccuggcacagaa

SEQ ID NO: 433590 - RNA, 19 nt, Homo sapiens
gcacgucguccuguaauag

SEQ ID NO: 433591 - RNA, 19 nt, Homo sapiens
gagaagcugccaugcaaag

SEQ ID NO: 433592 - RNA, 19 nt, Homo sapiens
gcguugaccaaguuccuua

SEQ ID NO: 433593 - RNA, 19 nt, Homo sapiens
gagucgagcucagcguuca

SEQ ID NO: 433594 - RNA, 19 nt, Homo sapiens
aaauacggguuagcaaugu

SEQ ID NO: 433595 - RNA, 19 nt, Homo sapiens
agaagcugcugguucacaa

SEQ ID NO: 433596 - RNA, 19 nt, Homo sapiens
ccacacaguagccaaguuc

SEQ ID NO: 433597 - RNA, 19 nt, Homo sapiens
ggagaagcugccaugcaaa

SEQ ID NO: 433598 - RNA, 19 nt, Homo sapiens
gugaggagaaucuggaguu

SEQ ID NO: 433599 - RNA, 19 nt, Homo sapiens
gaagcgaggccuggaccaa

SEQ ID NO: 433600 - RNA, 19 nt, Homo sapiens
cauccaaggccaagaagau

SEQ ID NO: 433601 - RNA, 19 nt, Homo sapiens
gaagcugcugguucacaaa

SEQ ID NO: 433602 - RNA, 19 nt, Homo sapiens
gcaaauaaaaggccugugu

SEQ ID NO: 433603 - RNA, 19 nt, Homo sapiens
gaagcugccaugcaaaggu

SEQ ID NO: 433604 - RNA, 19 nt, Homo sapiens
ucaagucacaguccaagau

SEQ ID NO: 433605 - RNA, 19 nt, Homo sapiens
gcugcugguucacaaauac

SEQ ID NO: 433606 - RNA, 19 nt, Homo sapiens
acaaauacggguuagcaau

SEQ ID NO: 433607 - RNA, 19 nt, Homo sapiens
cuuauuaaccagaagaaga

SEQ ID NO: 433608 - RNA, 19 nt, Homo sapiens
caagucacaguccaagaug

SEQ ID NO: 433609 - RNA, 19 nt, Homo sapiens
ucacaaauacggguuagca

SEQ ID NO: 433610 - RNA, 19 nt, Homo sapiens
gcuucgcguugaccaaguu

SEQ ID NO: 433611 - RNA, 19 nt, Homo sapiens
cagaggcgacacacgauga

SEQ ID NO: 433612 - RNA, 19 nt, Homo sapiens
gcagacacaugccccuuuc

SEQ ID NO: 433613 - RNA, 19 nt, Homo sapiens
aaauaaaaggccuguguua

SEQ ID NO: 433614 - RNA, 19 nt, Homo sapiens
ugaggagaaucuggaguuc

SEQ ID NO: 433615 - RNA, 19 nt, Homo sapiens
cauucaagcccaccucaga

SEQ ID NO: 433616 - RNA, 19 nt, Homo sapiens
aaaggccuguguuauuucu

SEQ ID NO: 433617 - RNA, 19 nt, Homo sapiens
caucuucgggcucauggaa

SEQ ID NO: 433618 - RNA, 19 nt, Homo sapiens
ugaguucagugaggagaau

SEQ ID NO: 433619 - RNA, 19 nt, Homo sapiens
gggcaaggcagacaaaaug

SEQ ID NO: 433620 - RNA, 19 nt, Homo sapiens
gccaaggacaugaagaaca

SEQ ID NO: 433621 - RNA, 19 nt, Homo sapiens
aggccuguguuauuucuug

SEQ ID NO: 433622 - RNA, 19 nt, Homo sapiens
gagaagcugcugguucaca

SEQ ID NO: 433623 - RNA, 19 nt, Homo sapiens
gaagccaaggacaugaaga

SEQ ID NO: 433624 - RNA, 19 nt, Homo sapiens
ccuguguuauuucuuguuc

SEQ ID NO: 433625 - RNA, 19 nt, Homo sapiens
aagccaaggacaugaagaa

SEQ ID NO: 433626 - RNA, 19 nt, Homo sapiens
acaccauucuccagcuuca

SEQ ID NO: 433627 - RNA, 19 nt, Homo sapiens
ucucaggguuggccagaag

SEQ ID NO: 433628 - RNA, 19 nt, Homo sapiens
ggaccuuauuaaccagaag

SEQ ID NO: 433629 - RNA, 19 nt, Homo sapiens
cugaauacaucgcgaucca

SEQ ID NO: 433630 - RNA, 19 nt, Homo sapiens
ugaaggaagccaaggacau

SEQ ID NO: 433631 - RNA, 19 nt, Homo sapiens
gaccucuaccuggaccuua

SEQ ID NO: 433632 - RNA, 19 nt, Homo sapiens
gggagcacaccaaggacaa

SEQ ID NO: 433633 - RNA, 19 nt, Homo sapiens
gaccuuauuaaccagaaga

SEQ ID NO: 433634 - RNA, 19 nt, Homo sapiens
ggguuggccagaaggaauu

SEQ ID NO: 433635 - RNA, 19 nt, Homo sapiens
ggaagccaaggacaugaag

SEQ ID NO: 433636 - RNA, 19 nt, Homo sapiens
ccaaguucuggagcaaaua

SEQ ID NO: 433637 - RNA, 19 nt, Homo sapiens
gcugugggcuucaccauua

SEQ ID NO: 433638 - RNA, 19 nt, Homo sapiens
gaagaucuuugcugaauac

SEQ ID NO: 433639 - RNA, 19 nt, Homo sapiens
gggagaagcugccaugcaa

SEQ ID NO: 433640 - RNA, 19 nt, Homo sapiens
ggacagacggauagacaua

SEQ ID NO: 433641 - RNA, 19 nt, Homo sapiens
ccaaggacaugaagaacaa

SEQ ID NO: 433642 - RNA, 19 nt, Homo sapiens
gaucuuugcugaauacauc

SEQ ID NO: 433643 - RNA, 19 nt, Homo sapiens
ucaagaaggucaagucaca

SEQ ID NO: 433644 - RNA, 19 nt, Homo sapiens
ugaccaaguuccuuaaaga

SEQ ID NO: 433645 - RNA, 19 nt, Homo sapiens
guacaauaguggauguuug

SEQ ID NO: 433646 - RNA, 19 nt, Homo sapiens
ugacuugcauuucugguuu

SEQ ID NO: 433647 - RNA, 19 nt, Homo sapiens
uaaaaggccuguguuauuu

SEQ ID NO: 433648 - RNA, 19 nt, Homo sapiens
cagggcagcuguacaauag

SEQ ID NO: 433649 - RNA, 19 nt, Homo sapiens
gaaccacuguccagcaaag

SEQ ID NO: 433650 - RNA, 19 nt, Homo sapiens
gacgaagccucccggaaga

SEQ ID NO: 433651 - RNA, 19 nt, Homo sapiens
ccagcacccucaagaaaga

SEQ ID NO: 433652 - RNA, 19 nt, Homo sapiens
ggagauggccuuggaggaa

SEQ ID NO: 433653 - RNA, 19 nt, Homo sapiens
ggacaccauucuccagcuu

SEQ ID NO: 433654 - RNA, 19 nt, Homo sapiens
uggagaagcugcugguuca

SEQ ID NO: 433655 - RNA, 19 nt, Homo sapiens
agaagaucuuugcugaaua

SEQ ID NO: 433656 - RNA, 19 nt, Homo sapiens
gggcagcuguacaauagug

SEQ ID NO: 433657 - RNA, 19 nt, Homo sapiens
gccaaguucuggagcaaau

SEQ ID NO: 433658 - RNA, 19 nt, Homo sapiens
gguuuggccucgauuuaga

SEQ ID NO: 433659 - RNA, 19 nt, Homo sapiens
gcaccaccuuucccucuuc

SEQ ID NO: 433660 - RNA, 19 nt, Homo sapiens
caaguucuggagcaaauaa

SEQ ID NO: 433661 - RNA, 19 nt, Homo sapiens
gaccaaguuccuuaaagaa

SEQ ID NO: 433662 - RNA, 19 nt, Homo sapiens
gcccagcacccucaagaaa

SEQ ID NO: 433663 - RNA, 19 nt, Homo sapiens
gcugcuuccuuccgucuuu

SEQ ID NO: 433664 - RNA, 19 nt, Homo sapiens
ggacucguacccucgcuuu

SEQ ID NO: 433665 - RNA, 19 nt, Homo sapiens
gggaggaggacgaggauga

SEQ ID NO: 433666 - RNA, 19 nt, Homo sapiens
gcagaggcaggcugacuug

SEQ ID NO: 433667 - RNA, 19 nt, Homo sapiens
gccaagcgcagcagcauga

SEQ ID NO: 433668 - RNA, 19 nt, Homo sapiens
agagggagauggccuugga

SEQ ID NO: 433669 - RNA, 19 nt, Homo sapiens
ggcacgucguccuguaaua

SEQ ID NO: 433670 - RNA, 19 nt, Homo sapiens
gcuucgaccuggcacagaa

SEQ ID NO: 433671 - RNA, 19 nt, Homo sapiens
gaggcaggcugacuugcau

SEQ ID NO: 433672 - RNA, 19 nt, Homo sapiens
caccagcgaugacaacuac

SEQ ID NO: 433673 - RNA, 19 nt, Homo sapiens
ucagggcagcuguacaaua

SEQ ID NO: 433674 - RNA, 19 nt, Homo sapiens
gcacgucguccuguaauag

SEQ ID NO: 433675 - RNA, 19 nt, Homo sapiens
gagaagcugccaugcaaag

SEQ ID NO: 433676 - RNA, 19 nt, Homo sapiens
ugaggaggaugcagaagag

SEQ ID NO: 433677 - RNA, 19 nt, Homo sapiens
gcguugaccaaguuccuua

SEQ ID NO: 433678 - RNA, 19 nt, Homo sapiens
aagaaccacuguccagcaa

SEQ ID NO: 433679 - RNA, 19 nt, Homo sapiens
uacaauaguggauguuuga

SEQ ID NO: 433680 - RNA, 19 nt, Homo sapiens
gagucgagcucagcguuca

SEQ ID NO: 433681 - RNA, 19 nt, Homo sapiens
agaagcugcugguucacaa

SEQ ID NO: 433682 - RNA, 19 nt, Homo sapiens
gcuguacaauaguggaugu

SEQ ID NO: 433683 - RNA, 19 nt, Homo sapiens
ccacacaguagccaaguuc

SEQ ID NO: 433684 - RNA, 19 nt, Homo sapiens
ggagaagcugccaugcaaa

SEQ ID NO: 433685 - RNA, 19 nt, Homo sapiens
gugaggagaaucuggaguu

SEQ ID NO: 433686 - RNA, 19 nt, Homo sapiens
gaagcgaggccuggaccaa

SEQ ID NO: 433687 - RNA, 19 nt, Homo sapiens
cauccaaggccaagaagau

SEQ ID NO: 433688 - RNA, 19 nt, Homo sapiens
gaagcugcugguucacaaa

SEQ ID NO: 433689 - RNA, 19 nt, Homo sapiens
ccugagguccggcuggaua

SEQ ID NO: 433690 - RNA, 19 nt, Homo sapiens
cagcuucgagcauggcuuu

SEQ ID NO: 433691 - RNA, 19 nt, Homo sapiens
gcaaauaaaaggccugugu

SEQ ID NO: 433692 - RNA, 19 nt, Homo sapiens
gaagcugccaugcaaaggu

SEQ ID NO: 433693 - RNA, 19 nt, Homo sapiens
ucaagucacaguccaagau

SEQ ID NO: 433694 - RNA, 19 nt, Homo sapiens
gcugcugguucacaaauac

SEQ ID NO: 433695 - RNA, 19 nt, Homo sapiens
agacggaggcagaugagaa

SEQ ID NO: 433696 - RNA, 19 nt, Homo sapiens
uagccaaggacaugaagaa

SEQ ID NO: 433697 - RNA, 19 nt, Homo sapiens
ccuaccugcuggucaagaa

SEQ ID NO: 433698 - RNA, 19 nt, Homo sapiens
caauaguggauguuugaga

SEQ ID NO: 433699 - RNA, 19 nt, Homo sapiens
cuuauuaaccagaagaaga

SEQ ID NO: 433700 - RNA, 19 nt, Homo sapiens
caagucacaguccaagaug

SEQ ID NO: 433701 - RNA, 19 nt, Homo sapiens
ucacaaauacggguuagca

SEQ ID NO: 433702 - RNA, 19 nt, Homo sapiens
caccaggacccucuacuca

SEQ ID NO: 433703 - RNA, 19 nt, Homo sapiens
ccaaggacuaucagagaug

SEQ ID NO: 433704 - RNA, 19 nt, Homo sapiens
gcuucgcguugaccaaguu

SEQ ID NO: 433705 - RNA, 19 nt, Homo sapiens
aaaccuagccaaggacaug

SEQ ID NO: 433706 - RNA, 19 nt, Homo sapiens
ugucagggcagcuguacaa

SEQ ID NO: 433707 - RNA, 19 nt, Homo sapiens
uucaaagacuucucagcuu

SEQ ID NO: 433708 - RNA, 19 nt, Homo sapiens
aaauaaaaggccuguguua

SEQ ID NO: 433709 - RNA, 19 nt, Homo sapiens
ugaggagaaucuggaguuc

SEQ ID NO: 433710 - RNA, 19 nt, Homo sapiens
cauucaagcccaccucaga

SEQ ID NO: 433711 - RNA, 19 nt, Homo sapiens
ggacaccagcgaugacaac

SEQ ID NO: 433712 - RNA, 19 nt, Homo sapiens
cccaaggacuaucagagau

SEQ ID NO: 433713 - RNA, 19 nt, Homo sapiens
aaaggccuguguuauuucu

SEQ ID NO: 433714 - RNA, 19 nt, Homo sapiens
caucuucgggcucauggaa

SEQ ID NO: 433715 - RNA, 19 nt, Homo sapiens
ugaguucagugaggagaau

SEQ ID NO: 433716 - RNA, 19 nt, Homo sapiens
aaauacggguuagcagugu

SEQ ID NO: 433717 - RNA, 19 nt, Homo sapiens
gggcaaggcagacaaaaug

SEQ ID NO: 433718 - RNA, 19 nt, Homo sapiens
gccaaggacaugaagaaca

SEQ ID NO: 433719 - RNA, 19 nt, Homo sapiens
gaagccucccggaagagaa

SEQ ID NO: 433720 - RNA, 19 nt, Homo sapiens
acaggacacaggaagauga

SEQ ID NO: 433721 - RNA, 19 nt, Homo sapiens
caggcugacuugcauuucu

SEQ ID NO: 433722 - RNA, 19 nt, Homo sapiens
aggccuguguuauuucuug

SEQ ID NO: 433723 - RNA, 19 nt, Homo sapiens
gagaagcugcugguucaca

SEQ ID NO: 433724 - RNA, 19 nt, Homo sapiens
ggcaggcugacuugcauuu

SEQ ID NO: 433725 - RNA, 19 nt, Homo sapiens
ccuguguuauuucuuguuc

SEQ ID NO: 433726 - RNA, 19 nt, Homo sapiens
acaccauucuccagcuuca

SEQ ID NO: 433727 - RNA, 19 nt, Homo sapiens
gggcuucaaagacuucuca

SEQ ID NO: 433728 - RNA, 19 nt, Homo sapiens
ggaccuuauuaaccagaag

SEQ ID NO: 433729 - RNA, 19 nt, Homo sapiens
cugaauacaucgcgaucca

SEQ ID NO: 433730 - RNA, 19 nt, Homo sapiens
ccaccuuucccucuucuuc

SEQ ID NO: 433731 - RNA, 19 nt, Homo sapiens
gaccucuaccuggaccuua

SEQ ID NO: 433732 - RNA, 19 nt, Homo sapiens
gggagcacaccaaggacaa

SEQ ID NO: 433733 - RNA, 19 nt, Homo sapiens
ucacaggacacaggaagau

SEQ ID NO: 433734 - RNA, 19 nt, Homo sapiens
gaccuuauuaaccagaaga

SEQ ID NO: 433735 - RNA, 19 nt, Homo sapiens
ccaaguucuggagcaaaua

SEQ ID NO: 433736 - RNA, 19 nt, Homo sapiens
cagaggagcugcugcugua

SEQ ID NO: 433737 - RNA, 19 nt, Homo sapiens
gaagaucuuugcugaauac

SEQ ID NO: 433738 - RNA, 19 nt, Homo sapiens
gggagaagcugccaugcaa

SEQ ID NO: 433739 - RNA, 19 nt, Homo sapiens
ggacagacggauagacaua

SEQ ID NO: 433740 - RNA, 19 nt, Homo sapiens
ccaaggacaugaagaacaa

SEQ ID NO: 433741 - RNA, 19 nt, Homo sapiens
gaucuuugcugaauacauc

SEQ ID NO: 433742 - RNA, 19 nt, Homo sapiens
ucaagaaggucaagucaca

SEQ ID NO: 433743 - RNA, 19 nt, Homo sapiens
ugaccaaguuccuuaaaga

SEQ ID NO: 433744 - RNA, 19 nt, Homo sapiens
uaaaaggccuguguuauuu

SEQ ID NO: 433745 - RNA, 19 nt, Homo sapiens
gaaggcagagugcuuauuc

SEQ ID NO: 433746 - RNA, 19 nt, Homo sapiens
gaaccacuguccagcaaag

SEQ ID NO: 433747 - RNA, 19 nt, Homo sapiens
gaacaucgccaagcagcaa

SEQ ID NO: 433748 - RNA, 19 nt, Homo sapiens
gguguucccugucuuuguu

SEQ ID NO: 433749 - RNA, 19 nt, Homo sapiens
gaggugauuuccugccauu

SEQ ID NO: 433750 - RNA, 19 nt, Homo sapiens
gacgaagccucccggaaga

SEQ ID NO: 433751 - RNA, 19 nt, Homo sapiens
ccagcacccucaagaaaga

SEQ ID NO: 433752 - RNA, 19 nt, Homo sapiens
ggagauggccuuggaggaa

SEQ ID NO: 433753 - RNA, 19 nt, Homo sapiens
gaaauucugcgugcucuau

SEQ ID NO: 433754 - RNA, 19 nt, Homo sapiens
gaagaagucccggcugaug

SEQ ID NO: 433755 - RNA, 19 nt, Homo sapiens
ggacaccauucuccagcuu

SEQ ID NO: 433756 - RNA, 19 nt, Homo sapiens
uggagaagcugcugguuca

SEQ ID NO: 433757 - RNA, 19 nt, Homo sapiens
agaagaucuuugcugaaua

SEQ ID NO: 433758 - RNA, 19 nt, Homo sapiens
gcuggugccugucggagaa

SEQ ID NO: 433759 - RNA, 19 nt, Homo sapiens
gcugccaccugguauguga

SEQ ID NO: 433760 - RNA, 19 nt, Homo sapiens
ccacagcugccaccuggua

SEQ ID NO: 433761 - RNA, 19 nt, Homo sapiens
ccaacaaacgggagaagaa

SEQ ID NO: 433762 - RNA, 19 nt, Homo sapiens
gccaaguucuggagcaaau

SEQ ID NO: 433763 - RNA, 19 nt, Homo sapiens
gcaccaccuuucccucuuc

SEQ ID NO: 433764 - RNA, 19 nt, Homo sapiens
caaguucuggagcaaauaa

SEQ ID NO: 433765 - RNA, 19 nt, Homo sapiens
gaccaaguuccuuaaagaa

SEQ ID NO: 433766 - RNA, 19 nt, Homo sapiens
gcccagcacccucaagaaa

SEQ ID NO: 433767 - RNA, 19 nt, Homo sapiens
ugacacuguuugccuauuc

SEQ ID NO: 433768 - RNA, 19 nt, Homo sapiens
ggacucguacccucgcuuu

SEQ ID NO: 433769 - RNA, 19 nt, Homo sapiens
gggaggaggacgaggauga

SEQ ID NO: 433770 - RNA, 19 nt, Homo sapiens
guggagcacuggaaaugug

SEQ ID NO: 433771 - RNA, 19 nt, Homo sapiens
ucaaugggcucugcaaggu

SEQ ID NO: 433772 - RNA, 19 nt, Homo sapiens
gccaagcgcagcagcauga

SEQ ID NO: 433773 - RNA, 19 nt, Homo sapiens
agagggagauggccuugga

SEQ ID NO: 433774 - RNA, 19 nt, Homo sapiens
ggacccuccugcugucaga

SEQ ID NO: 433775 - RNA, 19 nt, Homo sapiens
ggcacgucguccuguaaua

SEQ ID NO: 433776 - RNA, 19 nt, Homo sapiens
gcuucgaccuggcacagaa

SEQ ID NO: 433777 - RNA, 19 nt, Homo sapiens
ccagugagaucauccuacu

SEQ ID NO: 433778 - RNA, 19 nt, Homo sapiens
caccagcgaugacaacuac

SEQ ID NO: 433779 - RNA, 19 nt, Homo sapiens
acacggugcugcagcugaa

SEQ ID NO: 433780 - RNA, 19 nt, Homo sapiens
agagaaggcagagugcuua

SEQ ID NO: 433781 - RNA, 19 nt, Homo sapiens
gcacgucguccuguaauag

SEQ ID NO: 433782 - RNA, 19 nt, Homo sapiens
gagcagaagaagagagugu

SEQ ID NO: 433783 - RNA, 19 nt, Homo sapiens
gagaagcugccaugcaaag

SEQ ID NO: 433784 - RNA, 19 nt, Homo sapiens
ugaggaggaugcagaagag

SEQ ID NO: 433785 - RNA, 19 nt, Homo sapiens
gugauuuccugccauucuu

SEQ ID NO: 433786 - RNA, 19 nt, Homo sapiens
gcguugaccaaguuccuua

SEQ ID NO: 433787 - RNA, 19 nt, Homo sapiens
aagaaccacuguccagcaa

SEQ ID NO: 433788 - RNA, 19 nt, Homo sapiens
gagucgagcucagcguuca

SEQ ID NO: 433789 - RNA, 19 nt, Homo sapiens
agaagcugcugguucacaa

SEQ ID NO: 433790 - RNA, 19 nt, Homo sapiens
ccaguaaagggaaguccua

SEQ ID NO: 433791 - RNA, 19 nt, Homo sapiens
cggagaacaucgccaagca

SEQ ID NO: 433792 - RNA, 19 nt, Homo sapiens
aggagcugcugcuguauga

SEQ ID NO: 433793 - RNA, 19 nt, Homo sapiens
ccacacaguagccaaguuc

SEQ ID NO: 433794 - RNA, 19 nt, Homo sapiens
ggagaagcugccaugcaaa

SEQ ID NO: 433795 - RNA, 19 nt, Homo sapiens
gugaggagaaucuggaguu

SEQ ID NO: 433796 - RNA, 19 nt, Homo sapiens
gaagcgaggccuggaccaa

SEQ ID NO: 433797 - RNA, 19 nt, Homo sapiens
cauccaaggccaagaagau

SEQ ID NO: 433798 - RNA, 19 nt, Homo sapiens
gaagcugcugguucacaaa

SEQ ID NO: 433799 - RNA, 19 nt, Homo sapiens
ccugagguccggcuggaua

SEQ ID NO: 433800 - RNA, 19 nt, Homo sapiens
ugaagacagugcagaccau

SEQ ID NO: 433801 - RNA, 19 nt, Homo sapiens
gcaaauaaaaggccugugu

SEQ ID NO: 433802 - RNA, 19 nt, Homo sapiens
gaagcugccaugcaaaggu

SEQ ID NO: 433803 - RNA, 19 nt, Homo sapiens
ggaggugagaggugauuuc

SEQ ID NO: 433804 - RNA, 19 nt, Homo sapiens
ucaagucacaguccaagau

SEQ ID NO: 433805 - RNA, 19 nt, Homo sapiens
gcugcugguucacaaauac

SEQ ID NO: 433806 - RNA, 19 nt, Homo sapiens
ggggagagcuggguuuuca

SEQ ID NO: 433807 - RNA, 19 nt, Homo sapiens
agacggaggcagaugagaa

SEQ ID NO: 433808 - RNA, 19 nt, Homo sapiens
gccacgcacucaagcuaug

SEQ ID NO: 433809 - RNA, 19 nt, Homo sapiens
agacagugcagaccaugaa

SEQ ID NO: 433810 - RNA, 19 nt, Homo sapiens
ggcuuuggcuucaccaucu

SEQ ID NO: 433811 - RNA, 19 nt, Homo sapiens
uagccaaggacaugaagaa

SEQ ID NO: 433812 - RNA, 19 nt, Homo sapiens
ccuaccugcuggucaagaa

SEQ ID NO: 433813 - RNA, 19 nt, Homo sapiens
cuuauuaaccagaagaaga

SEQ ID NO: 433814 - RNA, 19 nt, Homo sapiens
caagucacaguccaagaug

SEQ ID NO: 433815 - RNA, 19 nt, Homo sapiens
ucacaaauacggguuagca

SEQ ID NO: 433816 - RNA, 19 nt, Homo sapiens
caccaggacccucuacuca

SEQ ID NO: 433817 - RNA, 19 nt, Homo sapiens
gagcugcugcuguaugaag

SEQ ID NO: 433818 - RNA, 19 nt, Homo sapiens
gaggagcugcugcuguaug

SEQ ID NO: 433819 - RNA, 19 nt, Homo sapiens
gcuucgcguugaccaaguu

SEQ ID NO: 433820 - RNA, 19 nt, Homo sapiens
aaaccuagccaaggacaug

SEQ ID NO: 433821 - RNA, 19 nt, Homo sapiens
gagaaggcagagugcuuau

SEQ ID NO: 433822 - RNA, 19 nt, Homo sapiens
aaauaaaaggccuguguua

SEQ ID NO: 433823 - RNA, 19 nt, Homo sapiens
ugaggagaaucuggaguuc

SEQ ID NO: 433824 - RNA, 19 nt, Homo sapiens
cauucaagcccaccucaga

SEQ ID NO: 433825 - RNA, 19 nt, Homo sapiens
ggacaccagcgaugacaac

SEQ ID NO: 433826 - RNA, 19 nt, Homo sapiens
gacagcaagauguuugaga

SEQ ID NO: 433827 - RNA, 19 nt, Homo sapiens
aaaggccuguguuauuucu

SEQ ID NO: 433828 - RNA, 19 nt, Homo sapiens
caucuucgggcucauggaa

SEQ ID NO: 433829 - RNA, 19 nt, Homo sapiens
ugaguucagugaggagaau

SEQ ID NO: 433830 - RNA, 19 nt, Homo sapiens
aaauacggguuagcagugu

SEQ ID NO: 433831 - RNA, 19 nt, Homo sapiens
gggcaaggcagacaaaaug

SEQ ID NO: 433832 - RNA, 19 nt, Homo sapiens
gccaaggacaugaagaaca

SEQ ID NO: 433833 - RNA, 19 nt, Homo sapiens
gaagccucccggaagagaa

SEQ ID NO: 433834 - RNA, 19 nt, Homo sapiens
acaggacacaggaagauga

SEQ ID NO: 433835 - RNA, 19 nt, Homo sapiens
cagagaaggcagagugcuu

SEQ ID NO: 433836 - RNA, 19 nt, Homo sapiens
gaagaucuuugcugaauac

SEQ ID NO: 433837 - RNA, 19 nt, Homo sapiens
gggagaagcugccaugcaa

SEQ ID NO: 433838 - RNA, 19 nt, Homo sapiens
ggacagacggauagacaua

SEQ ID NO: 433839 - RNA, 19 nt, Homo sapiens
ccaaggacaugaagaacaa

SEQ ID NO: 433840 - RNA, 19 nt, Homo sapiens
gaucuuugcugaauacauc

SEQ ID NO: 433841 - RNA, 19 nt, Homo sapiens
ucaagaaggucaagucaca

SEQ ID NO: 433842 - RNA, 19 nt, Homo sapiens
ccaggacccucuucuuuga

SEQ ID NO: 433843 - RNA, 19 nt, Homo sapiens
ugaccaaguuccuuaaaga

SEQ ID NO: 433844 - RNA, 19 nt, Homo sapiens
uaaaaggccuguguuauuu

SEQ ID NO: 433845 - RNA, 19 nt, Homo sapiens
gcccaggacccucuucuuu

SEQ ID NO: 433846 - RNA, 19 nt, Homo sapiens
ggacaccauucuccagcuu

SEQ ID NO: 433847 - RNA, 19 nt, Homo sapiens
uggagaagcugcugguuca

SEQ ID NO: 433848 - RNA, 19 nt, Homo sapiens
gagccaaggacaugaagaa

SEQ ID NO: 433849 - RNA, 19 nt, Homo sapiens
agaagaucuuugcugaaua

SEQ ID NO: 433850 - RNA, 19 nt, Homo sapiens
gccaaguucuggagcaaau

SEQ ID NO: 433851 - RNA, 19 nt, Homo sapiens
caaguucuggagcaaauaa

SEQ ID NO: 433852 - RNA, 19 nt, Homo sapiens
gaccaaguuccuuaaagaa

SEQ ID NO: 433853 - RNA, 19 nt, Homo sapiens
ggacucguacccucgcuuu

SEQ ID NO: 433854 - RNA, 19 nt, Homo sapiens
ggcacgucguccuguaaua

SEQ ID NO: 433855 - RNA, 19 nt, Homo sapiens
gcuucgaccuggcacagaa

SEQ ID NO: 433856 - RNA, 19 nt, Homo sapiens
gcacgucguccuguaauag

SEQ ID NO: 433857 - RNA, 19 nt, Homo sapiens
gagaagcugccaugcaaag

SEQ ID NO: 433858 - RNA, 19 nt, Homo sapiens
gcguugaccaaguuccuua

SEQ ID NO: 433859 - RNA, 19 nt, Homo sapiens
gagucgagcucagcguuca

SEQ ID NO: 433860 - RNA, 19 nt, Homo sapiens
agaagcugcugguucacaa

SEQ ID NO: 433861 - RNA, 19 nt, Homo sapiens
aaagaaauccagccucucu

SEQ ID NO: 433862 - RNA, 19 nt, Homo sapiens
ccacacaguagccaaguuc

SEQ ID NO: 433863 - RNA, 19 nt, Homo sapiens
ggagaagcugccaugcaaa

SEQ ID NO: 433864 - RNA, 19 nt, Homo sapiens
gugaggagaaucuggaguu

SEQ ID NO: 433865 - RNA, 19 nt, Homo sapiens
gaagcgaggccuggaccaa

SEQ ID NO: 433866 - RNA, 19 nt, Homo sapiens
gacaggagccaaggacaug

SEQ ID NO: 433867 - RNA, 19 nt, Homo sapiens
cauccaaggccaagaagau

SEQ ID NO: 433868 - RNA, 19 nt, Homo sapiens
gaagcugcugguucacaaa

SEQ ID NO: 433869 - RNA, 19 nt, Homo sapiens
gcaaauaaaaggccugugu

SEQ ID NO: 433870 - RNA, 19 nt, Homo sapiens
gaagcugccaugcaaaggu

SEQ ID NO: 433871 - RNA, 19 nt, Homo sapiens
ucaagucacaguccaagau

SEQ ID NO: 433872 - RNA, 19 nt, Homo sapiens
gcugcugguucacaaauac

SEQ ID NO: 433873 - RNA, 19 nt, Homo sapiens
cuuauuaaccagaagaaga

SEQ ID NO: 433874 - RNA, 19 nt, Homo sapiens
caagucacaguccaagaug

SEQ ID NO: 433875 - RNA, 19 nt, Homo sapiens
ucacaaauacggguuagca

SEQ ID NO: 433876 - RNA, 19 nt, Homo sapiens
gcuucgcguugaccaaguu

SEQ ID NO: 433877 - RNA, 19 nt, Homo sapiens
aaauaaaaggccuguguua

SEQ ID NO: 433878 - RNA, 19 nt, Homo sapiens
ugaggagaaucuggaguuc

SEQ ID NO: 433879 - RNA, 19 nt, Homo sapiens
cauucaagcccaccucaga

SEQ ID NO: 433880 - RNA, 19 nt, Homo sapiens
aaaggccuguguuauuucu

SEQ ID NO: 433881 - RNA, 19 nt, Homo sapiens
caucuucgggcucauggaa

SEQ ID NO: 433882 - RNA, 19 nt, Homo sapiens
ugaguucagugaggagaau

SEQ ID NO: 433883 - RNA, 19 nt, Homo sapiens
aaauacggguuagcagugu

SEQ ID NO: 433884 - RNA, 19 nt, Homo sapiens
gccaaggacaugaagaaca

SEQ ID NO: 433885 - RNA, 19 nt, Homo sapiens
gggcaaggcagacaaaaug

SEQ ID NO: 433886 - RNA, 19 nt, Homo sapiens
aggccuguguuauuucuug

SEQ ID NO: 433887 - RNA, 19 nt, Homo sapiens
gagaagcugcugguucaca

SEQ ID NO: 433888 - RNA, 19 nt, Homo sapiens
ccuguguuauuucuuguuc

SEQ ID NO: 433889 - RNA, 19 nt, Homo sapiens
acaccauucuccagcuuca

SEQ ID NO: 433890 - RNA, 19 nt, Homo sapiens
cccaggacccucuucuuug

SEQ ID NO: 433891 - RNA, 19 nt, Homo sapiens
ggaccuuauuaaccagaag

SEQ ID NO: 433892 - RNA, 19 nt, Homo sapiens
cugaauacaucgcgaucca

SEQ ID NO: 433893 - RNA, 19 nt, Homo sapiens
gaccucuaccuggaccuua

SEQ ID NO: 433894 - RNA, 19 nt, Homo sapiens
gggagcacaccaaggacaa

SEQ ID NO: 433895 - RNA, 19 nt, Homo sapiens
gaccuuauuaaccagaaga

SEQ ID NO: 433896 - RNA, 19 nt, Homo sapiens
ccaaguucuggagcaaaua

SEQ ID NO: 433897 - RNA, 19 nt, Homo sapiens
cagaggagcugcugcugua

SEQ ID NO: 433898 - RNA, 19 nt, Homo sapiens
guaaaggccugaucagcaa

SEQ ID NO: 433899 - RNA, 19 nt, Homo sapiens
gaagaucuuugcugaauac

SEQ ID NO: 433900 - RNA, 19 nt, Homo sapiens
gggagaagcugccaugcaa

SEQ ID NO: 433901 - RNA, 19 nt, Homo sapiens
ggacagacggauagacaua

SEQ ID NO: 433902 - RNA, 19 nt, Homo sapiens
ccaaggacaugaagaacaa

SEQ ID NO: 433903 - RNA, 19 nt, Homo sapiens
gaucuuugcugaauacauc

SEQ ID NO: 433904 - RNA, 19 nt, Homo sapiens
ucaagaaggucaagucaca

SEQ ID NO: 433905 - RNA, 19 nt, Homo sapiens
ugaccaaguuccuuaaaga

SEQ ID NO: 433906 - RNA, 19 nt, Homo sapiens
uaaaaggccuguguuauuu

SEQ ID NO: 433907 - RNA, 19 nt, Homo sapiens
gagaaugggaagaaacuaa

SEQ ID NO: 433908 - RNA, 19 nt, Homo sapiens
gaaggcagagugcuuauuc

SEQ ID NO: 433909 - RNA, 19 nt, Homo sapiens
ggaagaaacuaaagaucac

SEQ ID NO: 433910 - RNA, 19 nt, Homo sapiens
gggaagaaacuaaagauca

SEQ ID NO: 433911 - RNA, 19 nt, Homo sapiens
gaaccacuguccagcaaag

SEQ ID NO: 433912 - RNA, 19 nt, Homo sapiens
gaacaucgccaagcagcaa

SEQ ID NO: 433913 - RNA, 19 nt, Homo sapiens
gguguucccugucuuuguu

SEQ ID NO: 433914 - RNA, 19 nt, Homo sapiens
gacgaagccucccggaaga

SEQ ID NO: 433915 - RNA, 19 nt, Homo sapiens
ccagcacccucaagaaaga

SEQ ID NO: 433916 - RNA, 19 nt, Homo sapiens
gagaugaggaggaugcaaa

SEQ ID NO: 433917 - RNA, 19 nt, Homo sapiens
ggagauggccuuggaggaa

SEQ ID NO: 433918 - RNA, 19 nt, Homo sapiens
cagaagcgucucuugguua

SEQ ID NO: 433919 - RNA, 19 nt, Homo sapiens
gaagguaaaggccugauca

SEQ ID NO: 433920 - RNA, 19 nt, Homo sapiens
gaaauucugcgugcucuau

SEQ ID NO: 433921 - RNA, 19 nt, Homo sapiens
gaagaagucccggcugaug

SEQ ID NO: 433922 - RNA, 19 nt, Homo sapiens
gagacccgcugcugagaau

SEQ ID NO: 433923 - RNA, 19 nt, Homo sapiens
ggacaccauucuccagcuu

SEQ ID NO: 433924 - RNA, 19 nt, Homo sapiens
uggagaagcugcugguuca

SEQ ID NO: 433925 - RNA, 19 nt, Homo sapiens
guucugcugcuucacauua

SEQ ID NO: 433926 - RNA, 19 nt, Homo sapiens
ccacgagcacuucuucuuu

SEQ ID NO: 433927 - RNA, 19 nt, Homo sapiens
gaucacgcaugccaaaguc

SEQ ID NO: 433928 - RNA, 19 nt, Homo sapiens
ucagaagcgucucuugguu

SEQ ID NO: 433929 - RNA, 19 nt, Homo sapiens
agaagaucuuugcugaaua

SEQ ID NO: 433930 - RNA, 19 nt, Homo sapiens
gcuggugccugucggagaa

SEQ ID NO: 433931 - RNA, 19 nt, Homo sapiens
gcugccaccugguauguga

SEQ ID NO: 433932 - RNA, 19 nt, Homo sapiens
ccacagcugccaccuggua

SEQ ID NO: 433933 - RNA, 19 nt, Homo sapiens
ccaacaaacgggagaagaa

SEQ ID NO: 433934 - RNA, 19 nt, Homo sapiens
gccaaguucuggagcaaau

SEQ ID NO: 433935 - RNA, 19 nt, Homo sapiens
gcaccaccuuucccucuuc

SEQ ID NO: 433936 - RNA, 19 nt, Homo sapiens
caaguucuggagcaaauaa

SEQ ID NO: 433937 - RNA, 19 nt, Homo sapiens
gaccaaguuccuuaaagaa

SEQ ID NO: 433938 - RNA, 19 nt, Homo sapiens
gcccagcacccucaagaaa

SEQ ID NO: 433939 - RNA, 19 nt, Homo sapiens
ugacacuguuugccuauuc

SEQ ID NO: 433940 - RNA, 19 nt, Homo sapiens
ggacucguacccucgcuuu

SEQ ID NO: 433941 - RNA, 19 nt, Homo sapiens
gaggaucacgcaugccaaa

SEQ ID NO: 433942 - RNA, 19 nt, Homo sapiens
gggaggaggacgaggauga

SEQ ID NO: 433943 - RNA, 19 nt, Homo sapiens
guggagcacuggaaaugug

SEQ ID NO: 433944 - RNA, 19 nt, Homo sapiens
gccaagcgcagcagcauga

SEQ ID NO: 433945 - RNA, 19 nt, Homo sapiens
agagggagauggccuugga

SEQ ID NO: 433946 - RNA, 19 nt, Homo sapiens
ggacccuccugcugucaga

SEQ ID NO: 433947 - RNA, 19 nt, Homo sapiens
gaucagugguugguacuac

SEQ ID NO: 433948 - RNA, 19 nt, Homo sapiens
gcagagacccggcuuucca

SEQ ID NO: 433949 - RNA, 19 nt, Homo sapiens
ggcacgucguccuguaaua

SEQ ID NO: 433950 - RNA, 19 nt, Homo sapiens
gcuucgaccuggcacagaa

SEQ ID NO: 433951 - RNA, 19 nt, Homo sapiens
ccagugagaucauccuacu

SEQ ID NO: 433952 - RNA, 19 nt, Homo sapiens
caccagcgaugacaacuac

SEQ ID NO: 433953 - RNA, 19 nt, Homo sapiens
cacgagcacuucuucuuuc

SEQ ID NO: 433954 - RNA, 19 nt, Homo sapiens
gcaccugggauccguaugu

SEQ ID NO: 433955 - RNA, 19 nt, Homo sapiens
agagaaggcagagugcuua

SEQ ID NO: 433956 - RNA, 19 nt, Homo sapiens
acacggugcugcagcugaa

SEQ ID NO: 433957 - RNA, 19 nt, Homo sapiens
gcacgucguccuguaauag

SEQ ID NO: 433958 - RNA, 19 nt, Homo sapiens
gagcagaagaagagagugu

SEQ ID NO: 433959 - RNA, 19 nt, Homo sapiens
gagaagcugccaugcaaag

SEQ ID NO: 433960 - RNA, 19 nt, Homo sapiens
gcguugaccaaguuccuua

SEQ ID NO: 433961 - RNA, 19 nt, Homo sapiens
aagaaccacuguccagcaa

SEQ ID NO: 433962 - RNA, 19 nt, Homo sapiens
gagucgagcucagcguuca

SEQ ID NO: 433963 - RNA, 19 nt, Homo sapiens
agaagcugcugguucacaa

SEQ ID NO: 433964 - RNA, 19 nt, Homo sapiens
ccaguaaagggaaguccua

SEQ ID NO: 433965 - RNA, 19 nt, Homo sapiens
cggagaacaucgccaagca

SEQ ID NO: 433966 - RNA, 19 nt, Homo sapiens
aggagcugcugcuguauga

SEQ ID NO: 433967 - RNA, 19 nt, Homo sapiens
aaacuucuccagccaggaa

SEQ ID NO: 433968 - RNA, 19 nt, Homo sapiens
agaggaggaugaucagaag

SEQ ID NO: 433969 - RNA, 19 nt, Homo sapiens
ccacacaguagccaaguuc

SEQ ID NO: 433970 - RNA, 19 nt, Homo sapiens
ggagaagcugccaugcaaa

SEQ ID NO: 433971 - RNA, 19 nt, Homo sapiens
gugaggagaaucuggaguu

SEQ ID NO: 433972 - RNA, 19 nt, Homo sapiens
agaaugggaagaaacuaaa

SEQ ID NO: 433973 - RNA, 19 nt, Homo sapiens
gaagcgaggccuggaccaa

SEQ ID NO: 433974 - RNA, 19 nt, Homo sapiens
cauccaaggccaagaagau

SEQ ID NO: 433975 - RNA, 19 nt, Homo sapiens
gaagcugcugguucacaaa

SEQ ID NO: 433976 - RNA, 19 nt, Homo sapiens
ccugagguccggcuggaua

SEQ ID NO: 433977 - RNA, 19 nt, Homo sapiens
ugaagacagugcagaccau

SEQ ID NO: 433978 - RNA, 19 nt, Homo sapiens
agacuacgccaccagaaga

SEQ ID NO: 433979 - RNA, 19 nt, Homo sapiens
gcaaauaaaaggccugugu

SEQ ID NO: 433980 - RNA, 19 nt, Homo sapiens
gaagcugccaugcaaaggu

SEQ ID NO: 433981 - RNA, 19 nt, Homo sapiens
ggucaagucacaguccaaa

SEQ ID NO: 433982 - RNA, 19 nt, Homo sapiens
gcugcugguucacaaauac

SEQ ID NO: 433983 - RNA, 19 nt, Homo sapiens
agacggaggcagaugagaa

SEQ ID NO: 433984 - RNA, 19 nt, Homo sapiens
gccacgcacucaagcuaug

SEQ ID NO: 433985 - RNA, 19 nt, Homo sapiens
agacagugcagaccaugaa

SEQ ID NO: 433986 - RNA, 19 nt, Homo sapiens
ggaccggguucugcugcuu

SEQ ID NO: 433987 - RNA, 19 nt, Homo sapiens
gacaaggagaucagugguu

SEQ ID NO: 433988 - RNA, 19 nt, Homo sapiens
uagccaaggacaugaagaa

SEQ ID NO: 433989 - RNA, 19 nt, Homo sapiens
ccuaccugcuggucaagaa

SEQ ID NO: 433990 - RNA, 19 nt, Homo sapiens
ggcuuuggcuucaccaucu

SEQ ID NO: 433991 - RNA, 19 nt, Homo sapiens
acacugagaaugggaagaa

SEQ ID NO: 433992 - RNA, 19 nt, Homo sapiens
cuuauuaaccagaagaaga

SEQ ID NO: 433993 - RNA, 19 nt, Homo sapiens
ucacaaauacggguuagca

SEQ ID NO: 433994 - RNA, 19 nt, Homo sapiens
caccaggacccucuacuca

SEQ ID NO: 433995 - RNA, 19 nt, Homo sapiens
gagcugcugcuguaugaag

SEQ ID NO: 433996 - RNA, 19 nt, Homo sapiens
gaggagcugcugcuguaug

SEQ ID NO: 433997 - RNA, 19 nt, Homo sapiens
gaagaucuuuguugaauac

SEQ ID NO: 433998 - RNA, 19 nt, Homo sapiens
gggagaagcugccaugcaa

SEQ ID NO: 433999 - RNA, 19 nt, Homo sapiens
ggacagacggauagacaua

SEQ ID NO: 434000 - RNA, 19 nt, Homo sapiens
ccaaggacaugaagaacaa

SEQ ID NO: 434001 - RNA, 19 nt, Homo sapiens
ucaagaaggucaagucaca

SEQ ID NO: 434002 - RNA, 19 nt, Homo sapiens
ugaccaaguuccuuaaaga

SEQ ID NO: 434003 - RNA, 19 nt, Homo sapiens
uaaaaggccuguguuauuu

SEQ ID NO: 434004 - RNA, 19 nt, Homo sapiens
ggaggccagucacaaauag

SEQ ID NO: 434005 - RNA, 19 nt, Homo sapiens
gaucuuuguugaauacauc

SEQ ID NO: 434006 - RNA, 19 nt, Homo sapiens
ggacaccauucuccagcuu

SEQ ID NO: 434007 - RNA, 19 nt, Homo sapiens
uggagaagcugcugguuca

SEQ ID NO: 434008 - RNA, 19 nt, Homo sapiens
gccaaguucuggagcaaau

SEQ ID NO: 434009 - RNA, 19 nt, Homo sapiens
caaguucuggagcaaauaa

SEQ ID NO: 434010 - RNA, 19 nt, Homo sapiens
gaccaaguuccuuaaagaa

SEQ ID NO: 434011 - RNA, 19 nt, Homo sapiens
ggacucguacccucgcuuu

SEQ ID NO: 434012 - RNA, 19 nt, Homo sapiens
gaaggaggccaaggacaug

SEQ ID NO: 434013 - RNA, 19 nt, Homo sapiens
ggcacgucguccuguaaua

SEQ ID NO: 434014 - RNA, 19 nt, Homo sapiens
gcuucgaccuggcacagaa

SEQ ID NO: 434015 - RNA, 19 nt, Homo sapiens
cgaggaggccagucacaaa

SEQ ID NO: 434016 - RNA, 19 nt, Homo sapiens
gcacgucguccuguaauag

SEQ ID NO: 434017 - RNA, 19 nt, Homo sapiens
gagaagcugccaugcaaag

SEQ ID NO: 434018 - RNA, 19 nt, Homo sapiens
gaggaggccagucacaaau

SEQ ID NO: 434019 - RNA, 19 nt, Homo sapiens
gcguugaccaaguuccuua

SEQ ID NO: 434020 - RNA, 19 nt, Homo sapiens
gagucgagcucagcguuca

SEQ ID NO: 434021 - RNA, 19 nt, Homo sapiens
agaagcugcugguucacaa

SEQ ID NO: 434022 - RNA, 19 nt, Homo sapiens
guaacgaggaggccaguca

SEQ ID NO: 434023 - RNA, 19 nt, Homo sapiens
ccacacaguagccaaguuc

SEQ ID NO: 434024 - RNA, 19 nt, Homo sapiens
ggagaagcugccaugcaaa

SEQ ID NO: 434025 - RNA, 19 nt, Homo sapiens
gugaggagaaucuggaguu

SEQ ID NO: 434026 - RNA, 19 nt, Homo sapiens
gaagcgaggccuggaccaa

SEQ ID NO: 434027 - RNA, 19 nt, Homo sapiens
cauccaaggccaagaagau

SEQ ID NO: 434028 - RNA, 19 nt, Homo sapiens
gaagcugcugguucacaaa

SEQ ID NO: 434029 - RNA, 19 nt, Homo sapiens
gcaaauaaaaggccugugu

SEQ ID NO: 434030 - RNA, 19 nt, Homo sapiens
gaagcugccaugcaaaggu

SEQ ID NO: 434031 - RNA, 19 nt, Homo sapiens
ucaagucacaguccaagau

SEQ ID NO: 434032 - RNA, 19 nt, Homo sapiens
gcugcugguucacaaauac

SEQ ID NO: 434033 - RNA, 19 nt, Homo sapiens
cuuauuaaccagaagaaga

SEQ ID NO: 434034 - RNA, 19 nt, Homo sapiens
caagucacaguccaagaug

SEQ ID NO: 434035 - RNA, 19 nt, Homo sapiens
ucacaaauacggguuagca

SEQ ID NO: 434036 - RNA, 19 nt, Homo sapiens
ugaaggaggccaaggacau

SEQ ID NO: 434037 - RNA, 19 nt, Homo sapiens
gcagacacaugccccuuuc

SEQ ID NO: 434038 - RNA, 19 nt, Homo sapiens
gcuucgcguugaccaaguu

SEQ ID NO: 434039 - RNA, 19 nt, Homo sapiens
cagaggcgacacacgauga

SEQ ID NO: 434040 - RNA, 19 nt, Homo sapiens
aaauaaaaggccuguguua

SEQ ID NO: 434041 - RNA, 19 nt, Homo sapiens
ugaggagaaucuggaguuc

SEQ ID NO: 434042 - RNA, 19 nt, Homo sapiens
cauucaagcccaccucaga

SEQ ID NO: 434043 - RNA, 19 nt, Homo sapiens
aaaggccuguguuauuucu

SEQ ID NO: 434044 - RNA, 19 nt, Homo sapiens
caucuucgggcucauggaa

SEQ ID NO: 434045 - RNA, 19 nt, Homo sapiens
ugaguucagugaggagaau

SEQ ID NO: 434046 - RNA, 19 nt, Homo sapiens
aaauacggguuagcagugu

SEQ ID NO: 434047 - RNA, 19 nt, Homo sapiens
gggcaaggcagacaaaaug

SEQ ID NO: 434048 - RNA, 19 nt, Homo sapiens
ucucaggguuggucagaag

SEQ ID NO: 434049 - RNA, 19 nt, Homo sapiens
gccaaggacaugaagaaca

SEQ ID NO: 434050 - RNA, 19 nt, Homo sapiens
aggccuguguuauuucuug

SEQ ID NO: 434051 - RNA, 19 nt, Homo sapiens
gagaagcugcugguucaca

SEQ ID NO: 434052 - RNA, 19 nt, Homo sapiens
ccuguguuauuucuuguuc

SEQ ID NO: 434053 - RNA, 19 nt, Homo sapiens
cgaugaaggaggccaagga

SEQ ID NO: 434054 - RNA, 19 nt, Homo sapiens
acaccauucuccagcuuca

SEQ ID NO: 434055 - RNA, 19 nt, Homo sapiens
ggaccuuauuaaccagaag

SEQ ID NO: 434056 - RNA, 19 nt, Homo sapiens
gaccucuaccuggaccuua

SEQ ID NO: 434057 - RNA, 19 nt, Homo sapiens
gggagcacaccaaggacaa

SEQ ID NO: 434058 - RNA, 19 nt, Homo sapiens
aggaggccagucacaaaua

SEQ ID NO: 434059 - RNA, 19 nt, Homo sapiens
gaccuuauuaaccagaaga

SEQ ID NO: 434060 - RNA, 19 nt, Homo sapiens
ccaaguucuggagcaaaua

SEQ ID NO: 434061 - RNA, 19 nt, Homo sapiens
acaauaaccugcuuugaug

SEQ ID NO: 434062 - RNA, 19 nt, Homo sapiens
caaaucaccaucuaaacua

SEQ ID NO: 434063 - RNA, 19 nt, Homo sapiens
ccucaagucucgauucuau

SEQ ID NO: 434064 - RNA, 19 nt, Homo sapiens
uaaauaagaugugcaaagg

SEQ ID NO: 434065 - RNA, 19 nt, Homo sapiens
gaucagcugugaagaguac

SEQ ID NO: 434066 - RNA, 19 nt, Homo sapiens
gaaaggagccaagaguuca

SEQ ID NO: 434067 - RNA, 19 nt, Homo sapiens
caagaaaugggcugaauca

SEQ ID NO: 434068 - RNA, 19 nt, Homo sapiens
aagaggaagucaagaaaug

SEQ ID NO: 434069 - RNA, 19 nt, Homo sapiens
gaauauagugaggagaaua

SEQ ID NO: 434070 - RNA, 19 nt, Homo sapiens
aauauugacuucuggauca

SEQ ID NO: 434071 - RNA, 19 nt, Homo sapiens
gaagagacaagccggaaca

SEQ ID NO: 434072 - RNA, 19 nt, Homo sapiens
gcagaaaggagccaagagu

SEQ ID NO: 434073 - RNA, 19 nt, Homo sapiens
caacaagaaggacaaagug

SEQ ID NO: 434074 - RNA, 19 nt, Homo sapiens
ccaagaggaagucaagaaa

SEQ ID NO: 434075 - RNA, 19 nt, Homo sapiens
caagaaggacaaagugguu

SEQ ID NO: 434076 - RNA, 19 nt, Homo sapiens
gauucuaucuugauuuggu

SEQ ID NO: 434077 - RNA, 19 nt, Homo sapiens
ucgauucuaucuugauuug

SEQ ID NO: 434078 - RNA, 19 nt, Homo sapiens
uccaagcuguuaaauaaga

SEQ ID NO: 434079 - RNA, 19 nt, Homo sapiens
gaugaggcccagaagaaga

SEQ ID NO: 434080 - RNA, 19 nt, Homo sapiens
gaagggagagggaugaaaa

SEQ ID NO: 434081 - RNA, 19 nt, Homo sapiens
caugcuagagccuacaaua

SEQ ID NO: 434082 - RNA, 19 nt, Homo sapiens
gagagugagccaagaggaa

SEQ ID NO: 434083 - RNA, 19 nt, Homo sapiens
gaaggacaaagugguuauu

SEQ ID NO: 434084 - RNA, 19 nt, Homo sapiens
cgaauuccaagcuguuaaa

SEQ ID NO: 434085 - RNA, 19 nt, Homo sapiens
caagaggaagucaagaaau

SEQ ID NO: 434086 - RNA, 19 nt, Homo sapiens
gccaagaggaagucaagaa

SEQ ID NO: 434087 - RNA, 19 nt, Homo sapiens
ccgcauuucuuuccugcuu

SEQ ID NO: 434088 - RNA, 19 nt, Homo sapiens
uacaauaaccugcuuugau

SEQ ID NO: 434089 - RNA, 19 nt, Homo sapiens
gcugugaagaguacaagaa

SEQ ID NO: 434090 - RNA, 19 nt, Homo sapiens
ugaggagaauauugacuuc

SEQ ID NO: 434091 - RNA, 19 nt, Homo sapiens
cagaaaggagccaagaguu

SEQ ID NO: 434092 - RNA, 19 nt, Homo sapiens
cuugaagucugaauauagu

SEQ ID NO: 434093 - RNA, 19 nt, Homo sapiens
acacaauucuucccacaac

SEQ ID NO: 434094 - RNA, 19 nt, Homo sapiens
ucucgauucuaucuugauu

SEQ ID NO: 434095 - RNA, 19 nt, Homo sapiens
ucaaaucaccaucuaaacu

SEQ ID NO: 434096 - RNA, 19 nt, Homo sapiens
ccugauuagucaugaaugu

SEQ ID NO: 434097 - RNA, 19 nt, Homo sapiens
uggaaaaccugauuaguca

SEQ ID NO: 434098 - RNA, 19 nt, Homo sapiens
gucaagaaaugggcugaau

SEQ ID NO: 434099 - RNA, 19 nt, Homo sapiens
auagcacguucgcaaagua

SEQ ID NO: 434100 - RNA, 19 nt, Homo sapiens
ucagugugccuaauucuca

SEQ ID NO: 434101 - RNA, 19 nt, Homo sapiens
agaaaggagccaagaguuc

SEQ ID NO: 434102 - RNA, 19 nt, Homo sapiens
caauaaccugcuuugauga

SEQ ID NO: 434103 - RNA, 19 nt, Homo sapiens
gcgaauuccaagcuguuaa

SEQ ID NO: 434104 - RNA, 19 nt, Homo sapiens
gugaggagaauauugacuu

SEQ ID NO: 434105 - RNA, 19 nt, Homo sapiens
guuauuugccagagaguga

SEQ ID NO: 434106 - RNA, 19 nt, Homo sapiens
auagugaggagaauauuga

SEQ ID NO: 434107 - RNA, 19 nt, Homo sapiens
aaaccugauuagucaugaa

SEQ ID NO: 434108 - RNA, 19 nt, Homo sapiens
gagccaagaggaagucaag

SEQ ID NO: 434109 - RNA, 19 nt, Homo sapiens
ccaagcuguuaaauaagau

SEQ ID NO: 434110 - RNA, 19 nt, Homo sapiens
cauagcacguucgcaaagu

SEQ ID NO: 434111 - RNA, 19 nt, Homo sapiens
gcuagagccuacaauaacc

SEQ ID NO: 434112 - RNA, 19 nt, Homo sapiens
ugaauauagugaggagaau

SEQ ID NO: 434113 - RNA, 19 nt, Homo sapiens
ugaagucugaauauaguga

SEQ ID NO: 434114 - RNA, 19 nt, Homo sapiens
uaugaaacaucggcuaggu

SEQ ID NO: 434115 - RNA, 19 nt, Homo sapiens
aagucucgauucuaucuug

SEQ ID NO: 434116 - RNA, 19 nt, Homo sapiens
ucaaccugauggagaagga

SEQ ID NO: 434117 - RNA, 19 nt, Homo sapiens
uugaugaggcccagaagaa

SEQ ID NO: 434118 - RNA, 19 nt, Homo sapiens
uggaucagcugugaagagu

SEQ ID NO: 434119 - RNA, 19 nt, Homo sapiens
gaaaaucaaaucaccaucu

SEQ ID NO: 434120 - RNA, 19 nt, Homo sapiens
aagcuuucuugaagucuga

SEQ ID NO: 434121 - RNA, 19 nt, Homo sapiens
acaacaagaaggacaaagu

SEQ ID NO: 434122 - RNA, 19 nt, Homo sapiens
cugaauauagugaggagaa

SEQ ID NO: 434123 - RNA, 19 nt, Homo sapiens
gaaaaccugauuagucaug

SEQ ID NO: 434124 - RNA, 19 nt, Homo sapiens
agaaaugggcugaaucacu

SEQ ID NO: 434125 - RNA, 19 nt, Homo sapiens
gaagaguacaagaaaauca

SEQ ID NO: 434126 - RNA, 19 nt, Homo sapiens
uauagugaggagaauauug

SEQ ID NO: 434127 - RNA, 19 nt, Homo sapiens
gccagagagugagccaaga

SEQ ID NO: 434128 - RNA, 19 nt, Homo sapiens
aagaaggacaaagugguua

SEQ ID NO: 434129 - RNA, 19 nt, Homo sapiens
ucaagucucgauucuaucu

SEQ ID NO: 434130 - RNA, 19 nt, Homo sapiens
gacaagccggaacaugcua

SEQ ID NO: 434131 - RNA, 19 nt, Homo sapiens
ccacaacaagaaggacaaa

SEQ ID NO: 434132 - RNA, 19 nt, Homo sapiens
gccuaauucucaccugaag

SEQ ID NO: 434133 - RNA, 19 nt, Homo sapiens
ccuccugccgcauuucuuu

SEQ ID NO: 434134 - RNA, 19 nt, Homo sapiens
cuacaauaaccugcuuuga

SEQ ID NO: 434135 - RNA, 19 nt, Homo sapiens
augcuagagccuacaauaa

SEQ ID NO: 434136 - RNA, 19 nt, Homo sapiens
gaacaugcuagagccuaca

SEQ ID NO: 434137 - RNA, 19 nt, Homo sapiens
gaauuccaagcuguuaaau

SEQ ID NO: 434138 - RNA, 19 nt, Homo sapiens
acaauucuucccacaacaa

SEQ ID NO: 434139 - RNA, 19 nt, Homo sapiens
aaggacaaagugguuauuu

SEQ ID NO: 434140 - RNA, 19 nt, Homo sapiens
caaaggaccuaaauuguua

SEQ ID NO: 434141 - RNA, 19 nt, Homo sapiens
gaaacaaacucaugucuuc

SEQ ID NO: 434142 - RNA, 19 nt, Homo sapiens
caacugaaguggacauuaa

SEQ ID NO: 434143 - RNA, 19 nt, Homo sapiens
ggaaaucucucacguccaa

SEQ ID NO: 434144 - RNA, 19 nt, Homo sapiens
gaaguacccucaagaguuc

SEQ ID NO: 434145 - RNA, 19 nt, Homo sapiens
ggaaauauggcaagaguuu

SEQ ID NO: 434146 - RNA, 19 nt, Homo sapiens
ggaagucugucuaugguuu

SEQ ID NO: 434147 - RNA, 19 nt, Homo sapiens
gaaggaaccuggacgauac

SEQ ID NO: 434148 - RNA, 19 nt, Homo sapiens
gagacaagauugaaaggaa

SEQ ID NO: 434149 - RNA, 19 nt, Homo sapiens
gcaaaggaccuaaauuguu

SEQ ID NO: 434150 - RNA, 19 nt, Homo sapiens
gagcaaaggaccuaaauug

SEQ ID NO: 434151 - RNA, 19 nt, Homo sapiens
ucucaaagcuucaguuaga

SEQ ID NO: 434152 - RNA, 19 nt, Homo sapiens
gcaaauacaguuagauaga

SEQ ID NO: 434153 - RNA, 19 nt, Homo sapiens
cuaaacggaucaucuugua

SEQ ID NO: 434154 - RNA, 19 nt, Homo sapiens
aaagaggccuauuaaagaa

SEQ ID NO: 434155 - RNA, 19 nt, Homo sapiens
gaagaugaguuacaacaac

SEQ ID NO: 434156 - RNA, 19 nt, Homo sapiens
gaauacgacccguuucuuu

SEQ ID NO: 434157 - RNA, 19 nt, Homo sapiens
gagcacauuuacaaacuga

SEQ ID NO: 434158 - RNA, 19 nt, Homo sapiens
gaggagggcacacugauaa

SEQ ID NO: 434159 - RNA, 19 nt, Homo sapiens
gaagagagacaagauugaa

SEQ ID NO: 434160 - RNA, 19 nt, Homo sapiens
gacuggagcucgcagacua

SEQ ID NO: 434161 - RNA, 19 nt, Homo sapiens
aaacuaaaccuccaacaga

SEQ ID NO: 434162 - RNA, 19 nt, Homo sapiens
gaucauguccucacacuca

SEQ ID NO: 434163 - RNA, 19 nt, Homo sapiens
gcagaggacauuagaacaa

SEQ ID NO: 434164 - RNA, 19 nt, Homo sapiens
uaaguuacacggaacagua

SEQ ID NO: 434165 - RNA, 19 nt, Homo sapiens
aaagauggaagacgucaua

SEQ ID NO: 434166 - RNA, 19 nt, Homo sapiens
ggaggagggcacacugaua

SEQ ID NO: 434167 - RNA, 19 nt, Homo sapiens
uagcacggaugcaagauga

SEQ ID NO: 434168 - RNA, 19 nt, Homo sapiens
gaagucugucuaugguuua

SEQ ID NO: 434169 - RNA, 19 nt, Homo sapiens
gugccuggauguguaaaua

SEQ ID NO: 434170 - RNA, 19 nt, Homo sapiens
guugaucccuucucuguca

SEQ ID NO: 434171 - RNA, 19 nt, Homo sapiens
ccaaacuguugucugcuuu

SEQ ID NO: 434172 - RNA, 19 nt, Homo sapiens
gcacacugauaauucuugu

SEQ ID NO: 434173 - RNA, 19 nt, Homo sapiens
caacagaagaugaguuaca

SEQ ID NO: 434174 - RNA, 19 nt, Homo sapiens
cucaagaguucaggaaaua

SEQ ID NO: 434175 - RNA, 19 nt, Homo sapiens
gaaguggacauuaagaagu

SEQ ID NO: 434176 - RNA, 19 nt, Homo sapiens
caggaaauauggcaagagu

SEQ ID NO: 434177 - RNA, 19 nt, Homo sapiens
ugaguuacaacaacagaua

SEQ ID NO: 434178 - RNA, 19 nt, Homo sapiens
gcccgugccuggaugugua

SEQ ID NO: 434179 - RNA, 19 nt, Homo sapiens
uaaaguugaucccuucucu

SEQ ID NO: 434180 - RNA, 19 nt, Homo sapiens
ugaaggaaccuggacgaua

SEQ ID NO: 434181 - RNA, 19 nt, Homo sapiens
agaaguacccucaagaguu

SEQ ID NO: 434182 - RNA, 19 nt, Homo sapiens
cugacagucuacuaaguua

SEQ ID NO: 434183 - RNA, 19 nt, Homo sapiens
caagaagagagacaagauu

SEQ ID NO: 434184 - RNA, 19 nt, Homo sapiens
acuguugucugcuuucuuu

SEQ ID NO: 434185 - RNA, 19 nt, Homo sapiens
acacagauuaugccguuua

SEQ ID NO: 434186 - RNA, 19 nt, Homo sapiens
uggaagaacuguaaaagaa

SEQ ID NO: 434187 - RNA, 19 nt, Homo sapiens
uaaagaaguacccucaaga

SEQ ID NO: 434188 - RNA, 19 nt, Homo sapiens
uggcaaauacaguuagaua

SEQ ID NO: 434189 - RNA, 19 nt, Homo sapiens
gaaacuaaaccuccaacag

SEQ ID NO: 434190 - RNA, 19 nt, Homo sapiens
uaagaagucauccagaaug

SEQ ID NO: 434191 - RNA, 19 nt, Homo sapiens
gucuguacauucuccguua

SEQ ID NO: 434192 - RNA, 19 nt, Homo sapiens
ucacugcacacacuuugua

SEQ ID NO: 434193 - RNA, 19 nt, Homo sapiens
ccagugcuauuaacuugga

SEQ ID NO: 434194 - RNA, 19 nt, Homo sapiens
ccucaagaguucaggaaau

SEQ ID NO: 434195 - RNA, 19 nt, Homo sapiens
acccauggcuguccgauga

SEQ ID NO: 434196 - RNA, 19 nt, Homo sapiens
gcacggaugcaagaugaaa

SEQ ID NO: 434197 - RNA, 19 nt, Homo sapiens
gauggaagacgucauagca

SEQ ID NO: 434198 - RNA, 19 nt, Homo sapiens
ggagggcacacugauaauu

SEQ ID NO: 434199 - RNA, 19 nt, Homo sapiens
gcacauuuacaaacugaug

SEQ ID NO: 434200 - RNA, 19 nt, Homo sapiens
uuagauagacaucgguuaa

SEQ ID NO: 434201 - RNA, 19 nt, Homo sapiens
caauaaauuccgcacagaa

SEQ ID NO: 434202 - RNA, 19 nt, Homo sapiens
gagcagaggacauuagaac

SEQ ID NO: 434203 - RNA, 19 nt, Homo sapiens
gcugacagucuacuaaguu

SEQ ID NO: 434204 - RNA, 19 nt, Homo sapiens
caagugaaguaaaaccuuu

SEQ ID NO: 434205 - RNA, 19 nt, Homo sapiens
uauaagauccagugccuau

SEQ ID NO: 434206 - RNA, 19 nt, Homo sapiens
gaaccuggacgauacacau

SEQ ID NO: 434207 - RNA, 19 nt, Homo sapiens
uuaaagaaguacccucaag

SEQ ID NO: 434208 - RNA, 19 nt, Homo sapiens
acacggaacaguauuuaga

SEQ ID NO: 434209 - RNA, 19 nt, Homo sapiens
caaauacaguuagauagac

SEQ ID NO: 434210 - RNA, 19 nt, Homo sapiens
auuaagaagucauccagaa

SEQ ID NO: 434211 - RNA, 19 nt, Homo sapiens
aaaagucgcugacagucua

SEQ ID NO: 434212 - RNA, 19 nt, Homo sapiens
aacuaaaccuccaacagaa

SEQ ID NO: 434213 - RNA, 19 nt, Homo sapiens
ccacacacccacaccagaa

SEQ ID NO: 434214 - RNA, 19 nt, Homo sapiens
gcaagcagaagcacaagca

SEQ ID NO: 434215 - RNA, 19 nt, Homo sapiens
cuacuucuuuccaaucuca

SEQ ID NO: 434216 - RNA, 19 nt, Homo sapiens
gaucugugucucuuccuuu

SEQ ID NO: 434217 - RNA, 19 nt, Homo sapiens
gagggcacacugauaauuc

SEQ ID NO: 434218 - RNA, 19 nt, Homo sapiens
ggagcacauuuacaaacug

SEQ ID NO: 434219 - RNA, 19 nt, Homo sapiens
caagaguucaggaaauaug

SEQ ID NO: 434220 - RNA, 19 nt, Homo sapiens
uccaacagaagaugaguua

SEQ ID NO: 434221 - RNA, 19 nt, Homo sapiens
gacgauacacauuugaaga

SEQ ID NO: 434222 - RNA, 19 nt, Homo sapiens
ggacucuuccgucucaaug

SEQ ID NO: 434223 - RNA, 19 nt, Homo sapiens
uaagauccagugccuauca

SEQ ID NO: 434224 - RNA, 19 nt, Homo sapiens
cgauacacauuugaagaug

SEQ ID NO: 434225 - RNA, 19 nt, Homo sapiens
aaaagaggccuauuaaaga

SEQ ID NO: 434226 - RNA, 19 nt, Homo sapiens
gcccacggcuacuucuuuc

SEQ ID NO: 434227 - RNA, 19 nt, Homo sapiens
aauaaauuccgcacagaaa

SEQ ID NO: 434228 - RNA, 19 nt, Homo sapiens
acaauaaauuccgcacaga

SEQ ID NO: 434229 - RNA, 19 nt, Homo sapiens
ccacacauaacgugaagga

SEQ ID NO: 434230 - RNA, 19 nt, Homo sapiens
ccuuaaauuucuagaguca

SEQ ID NO: 434231 - RNA, 19 nt, Homo sapiens
gaguuacaacaacagauaa

SEQ ID NO: 434232 - RNA, 19 nt, Homo sapiens
aacagaagaugaguuacaa

SEQ ID NO: 434233 - RNA, 19 nt, Homo sapiens
ggaagugggaguucauuuu

SEQ ID NO: 434234 - RNA, 19 nt, Homo sapiens
ggaucugugucucuuccuu

SEQ ID NO: 434235 - RNA, 19 nt, Homo sapiens
ccuagcgucuucucugguu

SEQ ID NO: 434236 - RNA, 19 nt, Homo sapiens
aagaagagagacaagauug

SEQ ID NO: 434237 - RNA, 19 nt, Homo sapiens
aauggacucuuccgucuca

SEQ ID NO: 434238 - RNA, 19 nt, Homo sapiens
cagaggacauuagaacaag

SEQ ID NO: 434239 - RNA, 19 nt, Homo sapiens
cuuuguagcucaauguugu

SEQ ID NO: 434240 - RNA, 19 nt, Homo sapiens
uaaaagagcuuccagaauu

SEQ ID NO: 434241 - RNA, 19 nt, Homo sapiens
gaagaagauuugccugaug

SEQ ID NO: 434242 - RNA, 19 nt, Homo sapiens
ggaagaagauuugccugau

SEQ ID NO: 434243 - RNA, 19 nt, Homo sapiens
caaaggagaucuacaugac

SEQ ID NO: 434244 - RNA, 19 nt, Homo sapiens
gcaaaggagaucuacauga

SEQ ID NO: 434245 - RNA, 19 nt, Homo sapiens
ggaagaggaagaagauuug

SEQ ID NO: 434246 - RNA, 19 nt, Homo sapiens
ggacgugccggguuuauca

SEQ ID NO: 434247 - RNA, 19 nt, Homo sapiens
gagcuuccagaauuuauaa

SEQ ID NO: 434248 - RNA, 19 nt, Homo sapiens
uggagaaucugcuggaaga

SEQ ID NO: 434249 - RNA, 19 nt, Homo sapiens
gaaccgcacccucugaugu

SEQ ID NO: 434250 - RNA, 19 nt, Homo sapiens
gaagaaccgcacccucuga

SEQ ID NO: 434251 - RNA, 19 nt, Homo sapiens
ggacuggcagcuuuaagaa

SEQ ID NO: 434252 - RNA, 19 nt, Homo sapiens
gaaccgaggaagaggaaga

SEQ ID NO: 434253 - RNA, 19 nt, Homo sapiens
gaucuuuaaucucaugaag

SEQ ID NO: 434254 - RNA, 19 nt, Homo sapiens
ggacugaaauguacaaaac

SEQ ID NO: 434255 - RNA, 19 nt, Homo sapiens
uguaaggacugaaauguac

SEQ ID NO: 434256 - RNA, 19 nt, Homo sapiens
acgagaagauccuggaaga

SEQ ID NO: 434257 - RNA, 19 nt, Homo sapiens
cggcaucccuggagaaucu

SEQ ID NO: 434258 - RNA, 19 nt, Homo sapiens
aaagagcuuccagaauuua

SEQ ID NO: 434259 - RNA, 19 nt, Homo sapiens
gcuagcaugugaagauuuu

SEQ ID NO: 434260 - RNA, 19 nt, Homo sapiens
caagagcacagccaaaugg

SEQ ID NO: 434261 - RNA, 19 nt, Homo sapiens
aaaagagcuuccagaauuu

SEQ ID NO: 434262 - RNA, 19 nt, Homo sapiens
gagaagauccuggaagaac

SEQ ID NO: 434263 - RNA, 19 nt, Homo sapiens
gggacuggcagcuuuaaga

SEQ ID NO: 434264 - RNA, 19 nt, Homo sapiens
uacagccgcuuucuuaagu

SEQ ID NO: 434265 - RNA, 19 nt, Homo sapiens
ggagaucuacaugaccuuu

SEQ ID NO: 434266 - RNA, 19 nt, Homo sapiens
gugaaaagauuuagggaau

SEQ ID NO: 434267 - RNA, 19 nt, Homo sapiens
cgaggaagaggaagaagau

SEQ ID NO: 434268 - RNA, 19 nt, Homo sapiens
cgacagcuacagccgcuuu

SEQ ID NO: 434269 - RNA, 19 nt, Homo sapiens
gcuacagccgcuuucuuaa

SEQ ID NO: 434270 - RNA, 19 nt, Homo sapiens
aggaagaggaagaagauuu

SEQ ID NO: 434271 - RNA, 19 nt, Homo sapiens
cagaaggcgugaaaagauu

SEQ ID NO: 434272 - RNA, 19 nt, Homo sapiens
gccgcuuucuuaagucuga

SEQ ID NO: 434273 - RNA, 19 nt, Homo sapiens
gaaacuccaggaccagauc

SEQ ID NO: 434274 - RNA, 19 nt, Homo sapiens
ugaccuuucuguccagcaa

SEQ ID NO: 434275 - RNA, 19 nt, Homo sapiens
gguuuaucauugcuuuguu

SEQ ID NO: 434276 - RNA, 19 nt, Homo sapiens
agcuacagccgcuuucuua

SEQ ID NO: 434277 - RNA, 19 nt, Homo sapiens
uccaggaccagaucuuuaa

SEQ ID NO: 434278 - RNA, 19 nt, Homo sapiens
agacgcagaugcaggaaaa

SEQ ID NO: 434279 - RNA, 19 nt, Homo sapiens
ccggguuuaucauugcuuu

SEQ ID NO: 434280 - RNA, 19 nt, Homo sapiens
gcgaaccgaggaagaggaa

SEQ ID NO: 434281 - RNA, 19 nt, Homo sapiens
caacgagaagauccuggaa

SEQ ID NO: 434282 - RNA, 19 nt, Homo sapiens
gcuaaaagagcuuccagaa

SEQ ID NO: 434283 - RNA, 19 nt, Homo sapiens
ucaagagcacagccaaaug

SEQ ID NO: 434284 - RNA, 19 nt, Homo sapiens
agauuugccugaugcucaa

SEQ ID NO: 434285 - RNA, 19 nt, Homo sapiens
uggcuagcaugugaagauu

SEQ ID NO: 434286 - RNA, 19 nt, Homo sapiens
cucaggacgugccggguuu

SEQ ID NO: 434287 - RNA, 19 nt, Homo sapiens
agccgggacuggcagcuuu

SEQ ID NO: 434288 - RNA, 19 nt, Homo sapiens
cuccaggaccagaucuuua

SEQ ID NO: 434289 - RNA, 19 nt, Homo sapiens
cgugccggguuuaucauug

SEQ ID NO: 434290 - RNA, 19 nt, Homo sapiens
cuacagccgcuuucuuaag

SEQ ID NO: 434291 - RNA, 19 nt, Homo sapiens
ggcaaaggagaucuacaug

SEQ ID NO: 434292 - RNA, 19 nt, Homo sapiens
gaaggcgugaaaagauuua

SEQ ID NO: 434293 - RNA, 19 nt, Homo sapiens
caccagagcauggaacaca

SEQ ID NO: 434294 - RNA, 19 nt, Homo sapiens
agagcuuccagaauuuaua

SEQ ID NO: 434295 - RNA, 19 nt, Homo sapiens
cgagaagauccuggaagaa

SEQ ID NO: 434296 - RNA, 19 nt, Homo sapiens
aagauaagacgcagaugca

SEQ ID NO: 434297 - RNA, 19 nt, Homo sapiens
uaaggacugaaauguacaa

SEQ ID NO: 434298 - RNA, 19 nt, Homo sapiens
ucaugaaguacgacagcua

SEQ ID NO: 434299 - RNA, 19 nt, Homo sapiens
gaacacagcuguaaauucc

SEQ ID NO: 434300 - RNA, 19 nt, Homo sapiens
ggaaaggcauccgcagaua

SEQ ID NO: 434301 - RNA, 19 nt, Homo sapiens
gaaagacuaaggaagauaa

SEQ ID NO: 434302 - RNA, 19 nt, Homo sapiens
gaagugcucugguguccuu

SEQ ID NO: 434303 - RNA, 19 nt, Homo sapiens
gaagcccgcuguguucaua

SEQ ID NO: 434304 - RNA, 19 nt, Homo sapiens
ucagagcccuugaaauuga

SEQ ID NO: 434305 - RNA, 19 nt, Homo sapiens
gccaagggcuuuagcaaga

SEQ ID NO: 434306 - RNA, 19 nt, Homo sapiens
ggacgaagcagaggaguuu

SEQ ID NO: 434307 - RNA, 19 nt, Homo sapiens
caacagagcagaugaccaa

SEQ ID NO: 434308 - RNA, 19 nt, Homo sapiens
ucaugaagauguagugaaa

SEQ ID NO: 434309 - RNA, 19 nt, Homo sapiens
gaaaggcauccgcagauaa

SEQ ID NO: 434310 - RNA, 19 nt, Homo sapiens
gauacuugcugucaaugaa

SEQ ID NO: 434311 - RNA, 19 nt, Homo sapiens
gaaauguucgaaagacuaa

SEQ ID NO: 434312 - RNA, 19 nt, Homo sapiens
ucaaugaaaucaacgugaa

SEQ ID NO: 434313 - RNA, 19 nt, Homo sapiens
gaaggaagaccugguguug

SEQ ID NO: 434314 - RNA, 19 nt, Homo sapiens
gagaagaaucuauugcaaa

SEQ ID NO: 434315 - RNA, 19 nt, Homo sapiens
uccaagagauucaguauca

SEQ ID NO: 434316 - RNA, 19 nt, Homo sapiens
gaugaucgugggcuacuua

SEQ ID NO: 434317 - RNA, 19 nt, Homo sapiens
ccaacaugcuuucuaagga

SEQ ID NO: 434318 - RNA, 19 nt, Homo sapiens
ccagauacuugcugucaau

SEQ ID NO: 434319 - RNA, 19 nt, Homo sapiens
gaacacuaggcaagucuaa

SEQ ID NO: 434320 - RNA, 19 nt, Homo sapiens
cuaaagcacuagguauaaa

SEQ ID NO: 434321 - RNA, 19 nt, Homo sapiens
ucaugaaguuugauagcua

SEQ ID NO: 434322 - RNA, 19 nt, Homo sapiens
gacccagacuuguuuaauc

SEQ ID NO: 434323 - RNA, 19 nt, Homo sapiens
agaagaaucuauugcaaag

SEQ ID NO: 434324 - RNA, 19 nt, Homo sapiens
gccgaucccugaaugaaga

SEQ ID NO: 434325 - RNA, 19 nt, Homo sapiens
agacaugggugagcugauu

SEQ ID NO: 434326 - RNA, 19 nt, Homo sapiens
uagaaagucaugacgauuu

SEQ ID NO: 434327 - RNA, 19 nt, Homo sapiens
guucaucucuguccuguac

SEQ ID NO: 434328 - RNA, 19 nt, Homo sapiens
gaagaggcagucucaggaa

SEQ ID NO: 434329 - RNA, 19 nt, Homo sapiens
caagcuggauucuaaagca

SEQ ID NO: 434330 - RNA, 19 nt, Homo sapiens
gugcucagcugcgucauga

SEQ ID NO: 434331 - RNA, 19 nt, Homo sapiens
uagcauuugucuugaguga

SEQ ID NO: 434332 - RNA, 19 nt, Homo sapiens
caacgugggcugcuaagga

SEQ ID NO: 434333 - RNA, 19 nt, Homo sapiens
gaaagaacacuaggcaagu

SEQ ID NO: 434334 - RNA, 19 nt, Homo sapiens
ccaggacucuuacacagau

SEQ ID NO: 434335 - RNA, 19 nt, Homo sapiens
ccagcgaccaggacucuua

SEQ ID NO: 434336 - RNA, 19 nt, Homo sapiens
agcccaagcuggauucuaa

SEQ ID NO: 434337 - RNA, 19 nt, Homo sapiens
caagggaccugcgccuaga

SEQ ID NO: 434338 - RNA, 19 nt, Homo sapiens
cuuggaagcucaucagaau

SEQ ID NO: 434339 - RNA, 19 nt, Homo sapiens
gaaaggugugccagugaaa

SEQ ID NO: 434340 - RNA, 19 nt, Homo sapiens
ccaaaucccaacaugcuuu

SEQ ID NO: 434341 - RNA, 19 nt, Homo sapiens
agagaagaaucuauugcaa

SEQ ID NO: 434342 - RNA, 19 nt, Homo sapiens
cuaggcaagucuaauucua

SEQ ID NO: 434343 - RNA, 19 nt, Homo sapiens
gaaggccuuuggaaugcaa

SEQ ID NO: 434344 - RNA, 19 nt, Homo sapiens
agaaaggugugccagugaa

SEQ ID NO: 434345 - RNA, 19 nt, Homo sapiens
gaaguuugauagcuacacu

SEQ ID NO: 434346 - RNA, 19 nt, Homo sapiens
caagauccaccaaggcauu

SEQ ID NO: 434347 - RNA, 19 nt, Homo sapiens
aaaggcauccgcagauaaa

SEQ ID NO: 434348 - RNA, 19 nt, Homo sapiens
caggaaggccuuuggaaug

SEQ ID NO: 434349 - RNA, 19 nt, Homo sapiens
ugccagaguuccuccguuu

SEQ ID NO: 434350 - RNA, 19 nt, Homo sapiens
ggaaggaagaccugguguu

SEQ ID NO: 434351 - RNA, 19 nt, Homo sapiens
gagagaagaaucuauugca

SEQ ID NO: 434352 - RNA, 19 nt, Homo sapiens
acacuaggcaagucuaauu

SEQ ID NO: 434353 - RNA, 19 nt, Homo sapiens
uaaauuccagcuccagaaa

SEQ ID NO: 434354 - RNA, 19 nt, Homo sapiens
guaaauuccagcuccagaa

SEQ ID NO: 434355 - RNA, 19 nt, Homo sapiens
gcugggccguguccuuuga

SEQ ID NO: 434356 - RNA, 19 nt, Homo sapiens
aggcaagucuaauucuauu

SEQ ID NO: 434357 - RNA, 19 nt, Homo sapiens
aagcucaucagaauguuua

SEQ ID NO: 434358 - RNA, 19 nt, Homo sapiens
guaaguuucucugcagcaa

SEQ ID NO: 434359 - RNA, 19 nt, Homo sapiens
gauccaagagauucaguau

SEQ ID NO: 434360 - RNA, 19 nt, Homo sapiens
cuaaggaggaaauaucaaa

SEQ ID NO: 434361 - RNA, 19 nt, Homo sapiens
uguuggacaugaaaguaua

SEQ ID NO: 434362 - RNA, 19 nt, Homo sapiens
gaagcucaucagaauguuu

SEQ ID NO: 434363 - RNA, 19 nt, Homo sapiens
gcagcgaggucugggaaca

SEQ ID NO: 434364 - RNA, 19 nt, Homo sapiens
uggcaggccugugaauauu

SEQ ID NO: 434365 - RNA, 19 nt, Homo sapiens
gcuggauucuaaagcacua

SEQ ID NO: 434366 - RNA, 19 nt, Homo sapiens
ggagaggaaagaacacuag

SEQ ID NO: 434367 - RNA, 19 nt, Homo sapiens
ugaaauuaauugggaagug

SEQ ID NO: 434368 - RNA, 19 nt, Homo sapiens
gaucuugagucugcaacug

SEQ ID NO: 434369 - RNA, 19 nt, Homo sapiens
gaagaucaugcacgacugu

SEQ ID NO: 434370 - RNA, 19 nt, Homo sapiens
ggccgcaacucgauuugau

SEQ ID NO: 434371 - RNA, 19 nt, Homo sapiens
ucacgggcauuucucaaag

SEQ ID NO: 434372 - RNA, 19 nt, Homo sapiens
gaagugaagcccgcugugu

SEQ ID NO: 434373 - RNA, 19 nt, Homo sapiens
gcucggcgguuuggguuug

SEQ ID NO: 434374 - RNA, 19 nt, Homo sapiens
gguggaauuuucaauauga

SEQ ID NO: 434375 - RNA, 19 nt, Homo sapiens
caagggcuuuagcaagaga

SEQ ID NO: 434376 - RNA, 19 nt, Homo sapiens
caaagagagaagaaucuau

SEQ ID NO: 434377 - RNA, 19 nt, Homo sapiens
gcaggccugugaauauuuu

SEQ ID NO: 434378 - RNA, 19 nt, Homo sapiens
uaaggaaagaauucaguga

SEQ ID NO: 434379 - RNA, 19 nt, Homo sapiens
cuacuucucugauuuucua

SEQ ID NO: 434380 - RNA, 19 nt, Homo sapiens
caauggcugucuggaauuc

SEQ ID NO: 434381 - RNA, 19 nt, Homo sapiens
gguggacccagacuuguuu

SEQ ID NO: 434382 - RNA, 19 nt, Homo sapiens
ccacaaauaccagaaacug

SEQ ID NO: 434383 - RNA, 19 nt, Homo sapiens
ucaaagagagaagaaucua

SEQ ID NO: 434384 - RNA, 19 nt, Homo sapiens
ggaagcucaucagaauguu

SEQ ID NO: 434385 - RNA, 19 nt, Homo sapiens
caacagugacagcggcauu

SEQ ID NO: 434386 - RNA, 19 nt, Homo sapiens
ggaggcauuccuuuccaaa

SEQ ID NO: 434387 - RNA, 19 nt, Homo sapiens
acaaugagacgugcucuug

SEQ ID NO: 434388 - RNA, 19 nt, Homo sapiens
uagcuacacucgcuuucug

SEQ ID NO: 434389 - RNA, 19 nt, Homo sapiens
cgaaagacuaaggaagaua

SEQ ID NO: 434390 - RNA, 19 nt, Homo sapiens
gcaccagcagcaacaguga

SEQ ID NO: 434391 - RNA, 19 nt, Homo sapiens
cccuugaaauugaaacaaa

SEQ ID NO: 434392 - RNA, 19 nt, Homo sapiens
ggcuacggauucacgcuuu

SEQ ID NO: 434393 - RNA, 19 nt, Homo sapiens
cagagcagaugaccaacgu

SEQ ID NO: 434394 - RNA, 19 nt, Homo sapiens
gaccagauacuugcuguca

SEQ ID NO: 434395 - RNA, 19 nt, Homo sapiens
ccaggaaggccuuuggaau

SEQ ID NO: 434396 - RNA, 19 nt, Homo sapiens
acccagacuuguuuaauca

SEQ ID NO: 434397 - RNA, 19 nt, Homo sapiens
ggacccagacuuguuuaau

SEQ ID NO: 434398 - RNA, 19 nt, Homo sapiens
uaauccaaaucccaacaug

SEQ ID NO: 434399 - RNA, 19 nt, Homo sapiens
caacaacaguuucugacua

SEQ ID NO: 434400 - RNA, 19 nt, Homo sapiens
cuagagagauuaacauuga

SEQ ID NO: 434401 - RNA, 19 nt, Homo sapiens
ucaaacggaucauaacaaa

SEQ ID NO: 434402 - RNA, 19 nt, Homo sapiens
cuacauugcuauaaggaua

SEQ ID NO: 434403 - RNA, 19 nt, Homo sapiens
gaagcuugaugauauucua

SEQ ID NO: 434404 - RNA, 19 nt, Homo sapiens
cagaaacacaguacaaaua

SEQ ID NO: 434405 - RNA, 19 nt, Homo sapiens
ugaagaagcucagaaaaua

SEQ ID NO: 434406 - RNA, 19 nt, Homo sapiens
gagagacuaucaucaggaa

SEQ ID NO: 434407 - RNA, 19 nt, Homo sapiens
ggauauauuugucaaugga

SEQ ID NO: 434408 - RNA, 19 nt, Homo sapiens
caaagaggagaucaaauuu

SEQ ID NO: 434409 - RNA, 19 nt, Homo sapiens
caucgaagguaauuauaga

SEQ ID NO: 434410 - RNA, 19 nt, Homo sapiens
acaaagaggagaucaaauu

SEQ ID NO: 434411 - RNA, 19 nt, Homo sapiens
gaagguaauuauagagaca

SEQ ID NO: 434412 - RNA, 19 nt, Homo sapiens
aaacggaucauaacaaaga

SEQ ID NO: 434413 - RNA, 19 nt, Homo sapiens
gcaugaauguucuauagag

SEQ ID NO: 434414 - RNA, 19 nt, Homo sapiens
uagcaugaauguucuauag

SEQ ID NO: 434415 - RNA, 19 nt, Homo sapiens
ggaacccacugaaacaugu

SEQ ID NO: 434416 - RNA, 19 nt, Homo sapiens
uaacaaagaggagaucaaa

SEQ ID NO: 434417 - RNA, 19 nt, Homo sapiens
ggaauuguuggauuuguaa

SEQ ID NO: 434418 - RNA, 19 nt, Homo sapiens
gcaagccuauguaguucaa

SEQ ID NO: 434419 - RNA, 19 nt, Homo sapiens
aagaggagaucaaauuuag

SEQ ID NO: 434420 - RNA, 19 nt, Homo sapiens
gauggcaugugaaaccuau

SEQ ID NO: 434421 - RNA, 19 nt, Homo sapiens
ccagauuucuaaagucaga

SEQ ID NO: 434422 - RNA, 19 nt, Homo sapiens
uguaagaugugcagagaug

SEQ ID NO: 434423 - RNA, 19 nt, Homo sapiens
gcacagugacgagaauauu

SEQ ID NO: 434424 - RNA, 19 nt, Homo sapiens
caggauauauuugucaaug

SEQ ID NO: 434425 - RNA, 19 nt, Homo sapiens
gacaaaugcuacucacagu

SEQ ID NO: 434426 - RNA, 19 nt, Homo sapiens
cggaauuguuggauuugua

SEQ ID NO: 434427 - RNA, 19 nt, Homo sapiens
gagauuaacauugacaguu

SEQ ID NO: 434428 - RNA, 19 nt, Homo sapiens
gcaucuacauugcuauaag

SEQ ID NO: 434429 - RNA, 19 nt, Homo sapiens
gauuucaaacggaucauaa

SEQ ID NO: 434430 - RNA, 19 nt, Homo sapiens
ggagcacagugacgagaau

SEQ ID NO: 434431 - RNA, 19 nt, Homo sapiens
acagcaagccuauguaguu

SEQ ID NO: 434432 - RNA, 19 nt, Homo sapiens
caaaagcaauggaaucuag

SEQ ID NO: 434433 - RNA, 19 nt, Homo sapiens
gaaagugguggguuugauc

SEQ ID NO: 434434 - RNA, 19 nt, Homo sapiens
caugugaaaccuauaagaa

SEQ ID NO: 434435 - RNA, 19 nt, Homo sapiens
ggacugcucgacaggauau

SEQ ID NO: 434436 - RNA, 19 nt, Homo sapiens
uauugaaagugguggguuu

SEQ ID NO: 434437 - RNA, 19 nt, Homo sapiens
agauuaacauugacaguuc

SEQ ID NO: 434438 - RNA, 19 nt, Homo sapiens
caagagagacuaucaucag

SEQ ID NO: 434439 - RNA, 19 nt, Homo sapiens
agagugccaucgaagguaa

SEQ ID NO: 434440 - RNA, 19 nt, Homo sapiens
caaacuucuuuaucacaug

SEQ ID NO: 434441 - RNA, 19 nt, Homo sapiens
aggcggaauuguuggauuu

SEQ ID NO: 434442 - RNA, 19 nt, Homo sapiens
gaggagaucaaauuuagca

SEQ ID NO: 434443 - RNA, 19 nt, Homo sapiens
ugaauuguguuucuagcau

SEQ ID NO: 434444 - RNA, 19 nt, Homo sapiens
cagcaagccuauguaguuc

SEQ ID NO: 434445 - RNA, 19 nt, Homo sapiens
gagacuaucaucaggaaca

SEQ ID NO: 434446 - RNA, 19 nt, Homo sapiens
uauuauaccaccaacauga

SEQ ID NO: 434447 - RNA, 19 nt, Homo sapiens
aagccuauguaguucaauu

SEQ ID NO: 434448 - RNA, 19 nt, Homo sapiens
caacaguuucugacuacaa

SEQ ID NO: 434449 - RNA, 19 nt, Homo sapiens
gcaugugaaaccuauaaga

SEQ ID NO: 434450 - RNA, 19 nt, Homo sapiens
gugacgagaauauucaauu

SEQ ID NO: 434451 - RNA, 19 nt, Homo sapiens
ugaauguucuauagaguac

SEQ ID NO: 434452 - RNA, 19 nt, Homo sapiens
aaacuaugcaguccaacaa

SEQ ID NO: 434453 - RNA, 19 nt, Homo sapiens
gacaagagagacuaucauc

SEQ ID NO: 434454 - RNA, 19 nt, Homo sapiens
ucacgguggagcagaauuu

SEQ ID NO: 434455 - RNA, 19 nt, Homo sapiens
uacaaaauaugguccagua

SEQ ID NO: 434456 - RNA, 19 nt, Homo sapiens
ccacauauuauaccaccaa

SEQ ID NO: 434457 - RNA, 19 nt, Homo sapiens
gcucuugcaucuacauugc

SEQ ID NO: 434458 - RNA, 19 nt, Homo sapiens
uaucacauguaucuucuac

SEQ ID NO: 434459 - RNA, 19 nt, Homo sapiens
aaugugaacucaucgugau

SEQ ID NO: 434460 - RNA, 19 nt, Homo sapiens
ucagaaacacaguacaaau

SEQ ID NO: 434461 - RNA, 19 nt, Homo sapiens
gagcacagugacgagaaua

SEQ ID NO: 434462 - RNA, 19 nt, Homo sapiens
cauauuauaccaccaacau

SEQ ID NO: 434463 - RNA, 19 nt, Homo sapiens
uaagaugugcagagaugaa

SEQ ID NO: 434464 - RNA, 19 nt, Homo sapiens
caucuacauugcuauaagg

SEQ ID NO: 434465 - RNA, 19 nt, Homo sapiens
caugaauguucuauagagu

SEQ ID NO: 434466 - RNA, 19 nt, Homo sapiens
aaaccuuacuuuggaggaa

SEQ ID NO: 434467 - RNA, 19 nt, Homo sapiens
cauuugcucuugcaucuac

SEQ ID NO: 434468 - RNA, 19 nt, Homo sapiens
ugaaagugguggguuugau

SEQ ID NO: 434469 - RNA, 19 nt, Homo sapiens
aaaaugagcaggcggaauu

SEQ ID NO: 434470 - RNA, 19 nt, Homo sapiens
cuucaugauacaagcauua

SEQ ID NO: 434471 - RNA, 19 nt, Homo sapiens
aaucagaaacacaguacaa

SEQ ID NO: 434472 - RNA, 19 nt, Homo sapiens
ggucuuucuucaugauaca

SEQ ID NO: 434473 - RNA, 19 nt, Homo sapiens
agucagaaauguaccaaaa

SEQ ID NO: 434474 - RNA, 19 nt, Homo sapiens
caucaggaacauucaggaa

SEQ ID NO: 434475 - RNA, 19 nt, Homo sapiens
uacagugggcccagucuuu

SEQ ID NO: 434476 - RNA, 19 nt, Homo sapiens
guaguagucaauuaaugga

SEQ ID NO: 434477 - RNA, 19 nt, Homo sapiens
gccuauguaguucaauuaa

SEQ ID NO: 434478 - RNA, 19 nt, Homo sapiens
agugguggguuugaucuuu

SEQ ID NO: 434479 - RNA, 19 nt, Homo sapiens
gccaucgaagguaauuaua

SEQ ID NO: 434480 - RNA, 19 nt, Homo sapiens
caggcggaauuguuggauu

SEQ ID NO: 434481 - RNA, 19 nt, Homo sapiens
ugagcaggcggaauuguug

SEQ ID NO: 434482 - RNA, 19 nt, Homo sapiens
aacaacaguuucugacuac

SEQ ID NO: 434483 - RNA, 19 nt, Homo sapiens
ugaaaacuaugcaguccaa

SEQ ID NO: 434484 - RNA, 19 nt, Homo sapiens
uggcaugugaaaccuauaa

SEQ ID NO: 434485 - RNA, 19 nt, Homo sapiens
cuuacaaugugaacucauc

SEQ ID NO: 434486 - RNA, 19 nt, Homo sapiens
gcggaauuguuggauuugu

SEQ ID NO: 434487 - RNA, 19 nt, Homo sapiens
gcucgacaggauauauuug

SEQ ID NO: 434488 - RNA, 19 nt, Homo sapiens
gaacccacugaaacauguu

SEQ ID NO: 434489 - RNA, 19 nt, Homo sapiens
aauucuggauggcauguga

SEQ ID NO: 434490 - RNA, 19 nt, Homo sapiens
ucuugcaucuacauugcua

SEQ ID NO: 434491 - RNA, 19 nt, Homo sapiens
guggacugcucgacaggau

SEQ ID NO: 434492 - RNA, 19 nt, Homo sapiens
caaaaucagaaacacagua

SEQ ID NO: 434493 - RNA, 19 nt, Homo sapiens
uuuguaagaugugcagaga

SEQ ID NO: 434494 - RNA, 19 nt, Homo sapiens
gugaacucaucgugaucuu

SEQ ID NO: 434495 - RNA, 19 nt, Homo sapiens
aauuguguuucuagcauga

SEQ ID NO: 434496 - RNA, 19 nt, Homo sapiens
cagagugccaucgaaggua

SEQ ID NO: 434497 - RNA, 19 nt, Homo sapiens
ccuagagagauuaacauug

SEQ ID NO: 434498 - RNA, 19 nt, Homo sapiens
guuucuagcaugaauguuc

SEQ ID NO: 434499 - RNA, 19 nt, Homo sapiens
caacaacaguuucugacua

SEQ ID NO: 434500 - RNA, 19 nt, Homo sapiens
cuagagagauuaacauuga

SEQ ID NO: 434501 - RNA, 19 nt, Homo sapiens
ucaaacggaucauaacaaa

SEQ ID NO: 434502 - RNA, 19 nt, Homo sapiens
cuacauugcuauaaggaua

SEQ ID NO: 434503 - RNA, 19 nt, Homo sapiens
cagaaacacaguacaaaua

SEQ ID NO: 434504 - RNA, 19 nt, Homo sapiens
ugaagaagcucagaaaaua

SEQ ID NO: 434505 - RNA, 19 nt, Homo sapiens
gagagacuaucaucaggaa

SEQ ID NO: 434506 - RNA, 19 nt, Homo sapiens
ggauauauuugucaaugga

SEQ ID NO: 434507 - RNA, 19 nt, Homo sapiens
caaagaggagaucaaauuu

SEQ ID NO: 434508 - RNA, 19 nt, Homo sapiens
caucgaagguaauuauaga

SEQ ID NO: 434509 - RNA, 19 nt, Homo sapiens
acaaagaggagaucaaauu

SEQ ID NO: 434510 - RNA, 19 nt, Homo sapiens
gaagguaauuauagagaca

SEQ ID NO: 434511 - RNA, 19 nt, Homo sapiens
aaacggaucauaacaaaga

SEQ ID NO: 434512 - RNA, 19 nt, Homo sapiens
gcaugaauguucuauagag

SEQ ID NO: 434513 - RNA, 19 nt, Homo sapiens
uagcaugaauguucuauag

SEQ ID NO: 434514 - RNA, 19 nt, Homo sapiens
ggaacccacugaaacaugu

SEQ ID NO: 434515 - RNA, 19 nt, Homo sapiens
uaacaaagaggagaucaaa

SEQ ID NO: 434516 - RNA, 19 nt, Homo sapiens
ggaauuguuggauuuguaa

SEQ ID NO: 434517 - RNA, 19 nt, Homo sapiens
gcaagccuauguaguucaa

SEQ ID NO: 434518 - RNA, 19 nt, Homo sapiens
aagaggagaucaaauuuag

SEQ ID NO: 434519 - RNA, 19 nt, Homo sapiens
gauggcaugugaaaccuau

SEQ ID NO: 434520 - RNA, 19 nt, Homo sapiens
ccagauuucuaaagucaga

SEQ ID NO: 434521 - RNA, 19 nt, Homo sapiens
uguaagaugugcagagaug

SEQ ID NO: 434522 - RNA, 19 nt, Homo sapiens
gcacagugacgagaauauu

SEQ ID NO: 434523 - RNA, 19 nt, Homo sapiens
caggauauauuugucaaug

SEQ ID NO: 434524 - RNA, 19 nt, Homo sapiens
gacaaaugcuacucacagu

SEQ ID NO: 434525 - RNA, 19 nt, Homo sapiens
cggaauuguuggauuugua

SEQ ID NO: 434526 - RNA, 19 nt, Homo sapiens
gagauuaacauugacaguu

SEQ ID NO: 434527 - RNA, 19 nt, Homo sapiens
gcaucuacauugcuauaag

SEQ ID NO: 434528 - RNA, 19 nt, Homo sapiens
gauuucaaacggaucauaa

SEQ ID NO: 434529 - RNA, 19 nt, Homo sapiens
ggagcacagugacgagaau

SEQ ID NO: 434530 - RNA, 19 nt, Homo sapiens
acagcaagccuauguaguu

SEQ ID NO: 434531 - RNA, 19 nt, Homo sapiens
caaaagcaauggaaucuag

SEQ ID NO: 434532 - RNA, 19 nt, Homo sapiens
gaaagugguggguuugauc

SEQ ID NO: 434533 - RNA, 19 nt, Homo sapiens
caugugaaaccuauaagaa

SEQ ID NO: 434534 - RNA, 19 nt, Homo sapiens
ggacugcucgacaggauau

SEQ ID NO: 434535 - RNA, 19 nt, Homo sapiens
uauugaaagugguggguuu

SEQ ID NO: 434536 - RNA, 19 nt, Homo sapiens
agauuaacauugacaguuc

SEQ ID NO: 434537 - RNA, 19 nt, Homo sapiens
caagagagacuaucaucag

SEQ ID NO: 434538 - RNA, 19 nt, Homo sapiens
agagugccaucgaagguaa

SEQ ID NO: 434539 - RNA, 19 nt, Homo sapiens
caaacuucuuuaucacaug

SEQ ID NO: 434540 - RNA, 19 nt, Homo sapiens
aggcggaauuguuggauuu

SEQ ID NO: 434541 - RNA, 19 nt, Homo sapiens
gaggagaucaaauuuagca

SEQ ID NO: 434542 - RNA, 19 nt, Homo sapiens
ugaauuguguuucuagcau

SEQ ID NO: 434543 - RNA, 19 nt, Homo sapiens
cagcaagccuauguaguuc

SEQ ID NO: 434544 - RNA, 19 nt, Homo sapiens
gagacuaucaucaggaaca

SEQ ID NO: 434545 - RNA, 19 nt, Homo sapiens
uauuauaccaccaacauga

SEQ ID NO: 434546 - RNA, 19 nt, Homo sapiens
aagccuauguaguucaauu

SEQ ID NO: 434547 - RNA, 19 nt, Homo sapiens
caacaguuucugacuacaa

SEQ ID NO: 434548 - RNA, 19 nt, Homo sapiens
gcaugugaaaccuauaaga

SEQ ID NO: 434549 - RNA, 19 nt, Homo sapiens
gugacgagaauauucaauu

SEQ ID NO: 434550 - RNA, 19 nt, Homo sapiens
ugaauguucuauagaguac

SEQ ID NO: 434551 - RNA, 19 nt, Homo sapiens
aaacuaugcaguccaacaa

SEQ ID NO: 434552 - RNA, 19 nt, Homo sapiens
gacaagagagacuaucauc

SEQ ID NO: 434553 - RNA, 19 nt, Homo sapiens
ucacgguggagcagaauuu

SEQ ID NO: 434554 - RNA, 19 nt, Homo sapiens
uacaaaauaugguccagua

SEQ ID NO: 434555 - RNA, 19 nt, Homo sapiens
ccacauauuauaccaccaa

SEQ ID NO: 434556 - RNA, 19 nt, Homo sapiens
gcucuugcaucuacauugc

SEQ ID NO: 434557 - RNA, 19 nt, Homo sapiens
uaucacauguaucuucuac

SEQ ID NO: 434558 - RNA, 19 nt, Homo sapiens
aaugugaacucaucgugau

SEQ ID NO: 434559 - RNA, 19 nt, Homo sapiens
ucagaaacacaguacaaau

SEQ ID NO: 434560 - RNA, 19 nt, Homo sapiens
gagcacagugacgagaaua

SEQ ID NO: 434561 - RNA, 19 nt, Homo sapiens
cauauuauaccaccaacau

SEQ ID NO: 434562 - RNA, 19 nt, Homo sapiens
uaagaugugcagagaugaa

SEQ ID NO: 434563 - RNA, 19 nt, Homo sapiens
caucuacauugcuauaagg

SEQ ID NO: 434564 - RNA, 19 nt, Homo sapiens
caugaauguucuauagagu

SEQ ID NO: 434565 - RNA, 19 nt, Homo sapiens
aaaccuuacuuuggaggaa

SEQ ID NO: 434566 - RNA, 19 nt, Homo sapiens
cauuugcucuugcaucuac

SEQ ID NO: 434567 - RNA, 19 nt, Homo sapiens
ugaaagugguggguuugau

SEQ ID NO: 434568 - RNA, 19 nt, Homo sapiens
aaaaugagcaggcggaauu

SEQ ID NO: 434569 - RNA, 19 nt, Homo sapiens
cuucaugauacaagcauua

SEQ ID NO: 434570 - RNA, 19 nt, Homo sapiens
aaucagaaacacaguacaa

SEQ ID NO: 434571 - RNA, 19 nt, Homo sapiens
ggucuuucuucaugauaca

SEQ ID NO: 434572 - RNA, 19 nt, Homo sapiens
agucagaaauguaccaaaa

SEQ ID NO: 434573 - RNA, 19 nt, Homo sapiens
caucaggaacauucaggaa

SEQ ID NO: 434574 - RNA, 19 nt, Homo sapiens
uacagugggcccagucuuu

SEQ ID NO: 434575 - RNA, 19 nt, Homo sapiens
guaguagucaauuaaugga

SEQ ID NO: 434576 - RNA, 19 nt, Homo sapiens
gccuauguaguucaauuaa

SEQ ID NO: 434577 - RNA, 19 nt, Homo sapiens
agugguggguuugaucuuu

SEQ ID NO: 434578 - RNA, 19 nt, Homo sapiens
caggcggaauuguuggauu

SEQ ID NO: 434579 - RNA, 19 nt, Homo sapiens
ugagcaggcggaauuguug

SEQ ID NO: 434580 - RNA, 19 nt, Homo sapiens
gccaucgaagguaauuaua

SEQ ID NO: 434581 - RNA, 19 nt, Homo sapiens
aacaacaguuucugacuac

SEQ ID NO: 434582 - RNA, 19 nt, Homo sapiens
ugaaaacuaugcaguccaa

SEQ ID NO: 434583 - RNA, 19 nt, Homo sapiens
uggcaugugaaaccuauaa

SEQ ID NO: 434584 - RNA, 19 nt, Homo sapiens
cuuacaaugugaacucauc

SEQ ID NO: 434585 - RNA, 19 nt, Homo sapiens
gcggaauuguuggauuugu

SEQ ID NO: 434586 - RNA, 19 nt, Homo sapiens
gcucgacaggauauauuug

SEQ ID NO: 434587 - RNA, 19 nt, Homo sapiens
gaacccacugaaacauguu

SEQ ID NO: 434588 - RNA, 19 nt, Homo sapiens
aauucuggauggcauguga

SEQ ID NO: 434589 - RNA, 19 nt, Homo sapiens
ucuugcaucuacauugcua

SEQ ID NO: 434590 - RNA, 19 nt, Homo sapiens
guggacugcucgacaggau

SEQ ID NO: 434591 - RNA, 19 nt, Homo sapiens
caaaaucagaaacacagua

SEQ ID NO: 434592 - RNA, 19 nt, Homo sapiens
uuuguaagaugugcagaga

SEQ ID NO: 434593 - RNA, 19 nt, Homo sapiens
gugaacucaucgugaucuu

SEQ ID NO: 434594 - RNA, 19 nt, Homo sapiens
aauuguguuucuagcauga

SEQ ID NO: 434595 - RNA, 19 nt, Homo sapiens
cagagugccaucgaaggua

SEQ ID NO: 434596 - RNA, 19 nt, Homo sapiens
ccuagagagauuaacauug

SEQ ID NO: 434597 - RNA, 19 nt, Homo sapiens
guuucuagcaugaauguuc

SEQ ID NO: 434598 - RNA, 19 nt, Homo sapiens
aaagcaauggaaucuagaa

SEQ ID NO: 434599 - RNA, 19 nt, Homo sapiens
gaacaaacauuuccugaug

SEQ ID NO: 434600 - RNA, 19 nt, Homo sapiens
gaauaagggcuaaugauga

SEQ ID NO: 434601 - RNA, 19 nt, Homo sapiens
ggaaacauguggauaaagg

SEQ ID NO: 434602 - RNA, 19 nt, Homo sapiens
ggagcugguuuccuagaua

SEQ ID NO: 434603 - RNA, 19 nt, Homo sapiens
aaauggagcugguuuccua

SEQ ID NO: 434604 - RNA, 19 nt, Homo sapiens
gggcaucacugaacaaaca

SEQ ID NO: 434605 - RNA, 19 nt, Homo sapiens
ggagagagccaaagaguuc

SEQ ID NO: 434606 - RNA, 19 nt, Homo sapiens
gaagacacguacccugaug

SEQ ID NO: 434607 - RNA, 19 nt, Homo sapiens
ggaaagacauccagaucag

SEQ ID NO: 434608 - RNA, 19 nt, Homo sapiens
gcaaagagaauagaaacuu

SEQ ID NO: 434609 - RNA, 19 nt, Homo sapiens
gaaguguucuagugugguu

SEQ ID NO: 434610 - RNA, 19 nt, Homo sapiens
caaagagaauagaaacuuc

SEQ ID NO: 434611 - RNA, 19 nt, Homo sapiens
gaugugcccucucugaguu

SEQ ID NO: 434612 - RNA, 19 nt, Homo sapiens
gagcugguuuccuagauau

SEQ ID NO: 434613 - RNA, 19 nt, Homo sapiens
acuccucacuguuuaaaua

SEQ ID NO: 434614 - RNA, 19 nt, Homo sapiens
gaaggaaguguucuagugu

SEQ ID NO: 434615 - RNA, 19 nt, Homo sapiens
gaucuuucuucacaaauca

SEQ ID NO: 434616 - RNA, 19 nt, Homo sapiens
cagagucccuuagcuugua

SEQ ID NO: 434617 - RNA, 19 nt, Homo sapiens
gauaaagggaaccaugaaa

SEQ ID NO: 434618 - RNA, 19 nt, Homo sapiens
aaacacagcaaagagaaua

SEQ ID NO: 434619 - RNA, 19 nt, Homo sapiens
gcaguaaacacagcaaaga

SEQ ID NO: 434620 - RNA, 19 nt, Homo sapiens
gugaggaguucaagaagau

SEQ ID NO: 434621 - RNA, 19 nt, Homo sapiens
gagcugggcugcgauacug

SEQ ID NO: 434622 - RNA, 19 nt, Homo sapiens
gaacuccucacuguuuaaa

SEQ ID NO: 434623 - RNA, 19 nt, Homo sapiens
uaggaaacauguggauaaa

SEQ ID NO: 434624 - RNA, 19 nt, Homo sapiens
gggaagagagguugaguca

SEQ ID NO: 434625 - RNA, 19 nt, Homo sapiens
gggcacaccagaucuuuga

SEQ ID NO: 434626 - RNA, 19 nt, Homo sapiens
guaaacacagcaaagagaa

SEQ ID NO: 434627 - RNA, 19 nt, Homo sapiens
ugagaguccugcugaaauc

SEQ ID NO: 434628 - RNA, 19 nt, Homo sapiens
aaaggauccuaggaaauaa

SEQ ID NO: 434629 - RNA, 19 nt, Homo sapiens
ugaauaagggcuaaugaug

SEQ ID NO: 434630 - RNA, 19 nt, Homo sapiens
ggaucuuucuucacaaauc

SEQ ID NO: 434631 - RNA, 19 nt, Homo sapiens
ugaaauccagccaguguuu

SEQ ID NO: 434632 - RNA, 19 nt, Homo sapiens
ggauaaagggaaccaugaa

SEQ ID NO: 434633 - RNA, 19 nt, Homo sapiens
uuaggaaacauguggauaa

SEQ ID NO: 434634 - RNA, 19 nt, Homo sapiens
guucuagugugguuuagga

SEQ ID NO: 434635 - RNA, 19 nt, Homo sapiens
uccaggagauuauuuaagu

SEQ ID NO: 434636 - RNA, 19 nt, Homo sapiens
uuggugcuguuguuauuua

SEQ ID NO: 434637 - RNA, 19 nt, Homo sapiens
gaggaaagacauccagauc

SEQ ID NO: 434638 - RNA, 19 nt, Homo sapiens
cgagauauuuauaccucaa

SEQ ID NO: 434639 - RNA, 19 nt, Homo sapiens
acaaacauuuccugaugga

SEQ ID NO: 434640 - RNA, 19 nt, Homo sapiens
gaacaaggcagaaaaggau

SEQ ID NO: 434641 - RNA, 19 nt, Homo sapiens
aaaaggauccuaggaaaua

SEQ ID NO: 434642 - RNA, 19 nt, Homo sapiens
cucaaacacuggccuguga

SEQ ID NO: 434643 - RNA, 19 nt, Homo sapiens
ugacaaauggagcugguuu

SEQ ID NO: 434644 - RNA, 19 nt, Homo sapiens
aauaagggcuaaugaugag

SEQ ID NO: 434645 - RNA, 19 nt, Homo sapiens
gaagccagccgggaagaga

SEQ ID NO: 434646 - RNA, 19 nt, Homo sapiens
ggaacuccucacuguuuaa

SEQ ID NO: 434647 - RNA, 19 nt, Homo sapiens
agaaaaggauccuaggaaa

SEQ ID NO: 434648 - RNA, 19 nt, Homo sapiens
gcagggcccaggagaacaa

SEQ ID NO: 434649 - RNA, 19 nt, Homo sapiens
gcuuguaccucguaacacu

SEQ ID NO: 434650 - RNA, 19 nt, Homo sapiens
cacguacccugauggagaa

SEQ ID NO: 434651 - RNA, 19 nt, Homo sapiens
ccaggauaaucaacacugu

SEQ ID NO: 434652 - RNA, 19 nt, Homo sapiens
gcaagugcaagaggacaaa

SEQ ID NO: 434653 - RNA, 19 nt, Homo sapiens
ccaggagauuauuuaagug

SEQ ID NO: 434654 - RNA, 19 nt, Homo sapiens
caucacugaacaaacauuu

SEQ ID NO: 434655 - RNA, 19 nt, Homo sapiens
gaccauggcacccuuagag

SEQ ID NO: 434656 - RNA, 19 nt, Homo sapiens
ggaggaaagacauccagau

SEQ ID NO: 434657 - RNA, 19 nt, Homo sapiens
guacccugauggagaagga

SEQ ID NO: 434658 - RNA, 19 nt, Homo sapiens
ggaagacacguacccugau

SEQ ID NO: 434659 - RNA, 19 nt, Homo sapiens
ugugaggaguucaagaaga

SEQ ID NO: 434660 - RNA, 19 nt, Homo sapiens
guggagagcccugaaagga

SEQ ID NO: 434661 - RNA, 19 nt, Homo sapiens
gcagcagucucuccuucag

SEQ ID NO: 434662 - RNA, 19 nt, Homo sapiens
gcagugaggccccuaaaga

SEQ ID NO: 434663 - RNA, 19 nt, Homo sapiens
ccagaucuuugaggaguuc

SEQ ID NO: 434664 - RNA, 19 nt, Homo sapiens
ugaaugauguuugcaaucc

SEQ ID NO: 434665 - RNA, 19 nt, Homo sapiens
uguuggugcuguuguuauu

SEQ ID NO: 434666 - RNA, 19 nt, Homo sapiens
ugugagcccuuuccaaguc

SEQ ID NO: 434667 - RNA, 19 nt, Homo sapiens
uaauuucaguuugccucua

SEQ ID NO: 434668 - RNA, 19 nt, Homo sapiens
uaucauugguuuucuguga

SEQ ID NO: 434669 - RNA, 19 nt, Homo sapiens
gaaaaggauccuaggaaau

SEQ ID NO: 434670 - RNA, 19 nt, Homo sapiens
gugauugucauaacauugu

SEQ ID NO: 434671 - RNA, 19 nt, Homo sapiens
gcaagcugaugugacucuu

SEQ ID NO: 434672 - RNA, 19 nt, Homo sapiens
gcagucucuccuucagaua

SEQ ID NO: 434673 - RNA, 19 nt, Homo sapiens
gugaggagaaccuggaguu

SEQ ID NO: 434674 - RNA, 19 nt, Homo sapiens
guuucagcauguuauauuc

SEQ ID NO: 434675 - RNA, 19 nt, Homo sapiens
gccaccauccugccuacua

SEQ ID NO: 434676 - RNA, 19 nt, Homo sapiens
ccaccauccugccuacuac

SEQ ID NO: 434677 - RNA, 19 nt, Homo sapiens
aaagagaugccccgagaua

SEQ ID NO: 434678 - RNA, 19 nt, Homo sapiens
ugaguucugugcugucucu

SEQ ID NO: 434679 - RNA, 19 nt, Homo sapiens
ggaugugcccucucugagu

SEQ ID NO: 434680 - RNA, 19 nt, Homo sapiens
gcccagagucccuuagcuu

SEQ ID NO: 434681 - RNA, 19 nt, Homo sapiens
ccuaaagaggucaacauug

SEQ ID NO: 434682 - RNA, 19 nt, Homo sapiens
gaucuuugaggaguucauu

SEQ ID NO: 434683 - RNA, 19 nt, Homo sapiens
gcugguuuccuagauauga

SEQ ID NO: 434684 - RNA, 19 nt, Homo sapiens
gugaauaagggcuaaugau

SEQ ID NO: 434685 - RNA, 19 nt, Homo sapiens
ccugugaggaguucaagaa

SEQ ID NO: 434686 - RNA, 19 nt, Homo sapiens
uccuagauaugaaugaugu

SEQ ID NO: 434687 - RNA, 19 nt, Homo sapiens
ucagagcugggcugcgaua

SEQ ID NO: 434688 - RNA, 19 nt, Homo sapiens
gauccuaggaaauaagucu

SEQ ID NO: 434689 - RNA, 19 nt, Homo sapiens
acauccagaucagcuguuu

SEQ ID NO: 434690 - RNA, 19 nt, Homo sapiens
agauaugaaugauguuugc

SEQ ID NO: 434691 - RNA, 19 nt, Homo sapiens
acgcuuuccugaagacaga

SEQ ID NO: 434692 - RNA, 19 nt, Homo sapiens
caggagauuauuuaagugu

SEQ ID NO: 434693 - RNA, 19 nt, Homo sapiens
uguucucucuguaccauga

SEQ ID NO: 434694 - RNA, 19 nt, Homo sapiens
cagcaaagagaauagaaac

SEQ ID NO: 434695 - RNA, 19 nt, Homo sapiens
guccagccuugcagucaug

SEQ ID NO: 434696 - RNA, 19 nt, Homo sapiens
uggauaaagggaaccauga

SEQ ID NO: 434697 - RNA, 19 nt, Homo sapiens
acagccacaugcuuugaug

SEQ ID NO: 434698 - RNA, 19 nt, Homo sapiens
ccacagccacaugcuuuga

SEQ ID NO: 434699 - RNA, 19 nt, Homo sapiens
ggacagaaauuuaacauug

SEQ ID NO: 434700 - RNA, 19 nt, Homo sapiens
gcaacgagcucaaaugcua

SEQ ID NO: 434701 - RNA, 19 nt, Homo sapiens
cgagauaacuugacaauca

SEQ ID NO: 434702 - RNA, 19 nt, Homo sapiens
gaaauugccaugauuguuu

SEQ ID NO: 434703 - RNA, 19 nt, Homo sapiens
gaugacagguuuaauucua

SEQ ID NO: 434704 - RNA, 19 nt, Homo sapiens
ccacaguucugauaucuuu

SEQ ID NO: 434705 - RNA, 19 nt, Homo sapiens
gcuggaaccugaagucuaa

SEQ ID NO: 434706 - RNA, 19 nt, Homo sapiens
gaccagaacugcuaugaug

SEQ ID NO: 434707 - RNA, 19 nt, Homo sapiens
caacagacaugggcauauu

SEQ ID NO: 434708 - RNA, 19 nt, Homo sapiens
gggcauauucuuugaguua

SEQ ID NO: 434709 - RNA, 19 nt, Homo sapiens
gagcucaaaugcuaucuga

SEQ ID NO: 434710 - RNA, 19 nt, Homo sapiens
gaacugcuaugaugauucu

SEQ ID NO: 434711 - RNA, 19 nt, Homo sapiens
ccauuugguucuaugauua

SEQ ID NO: 434712 - RNA, 19 nt, Homo sapiens
caaaugcuaucugaucaaa

SEQ ID NO: 434713 - RNA, 19 nt, Homo sapiens
gcauguguguaaaguagua

SEQ ID NO: 434714 - RNA, 19 nt, Homo sapiens
gcaauucacccauuugguu

SEQ ID NO: 434715 - RNA, 19 nt, Homo sapiens
gugaguaaauacagaguaa

SEQ ID NO: 434716 - RNA, 19 nt, Homo sapiens
aaacugaggauccaugaua

SEQ ID NO: 434717 - RNA, 19 nt, Homo sapiens
gcaggcaucuuguaucgau

SEQ ID NO: 434718 - RNA, 19 nt, Homo sapiens
caugauaaaugcagacuuc

SEQ ID NO: 434719 - RNA, 19 nt, Homo sapiens
ccagcuuccuuucccauua

SEQ ID NO: 434720 - RNA, 19 nt, Homo sapiens
gcuaugaugauucuguuua

SEQ ID NO: 434721 - RNA, 19 nt, Homo sapiens
ggguuuggcuuccucauga

SEQ ID NO: 434722 - RNA, 19 nt, Homo sapiens
gauccuaagucccaaaugg

SEQ ID NO: 434723 - RNA, 19 nt, Homo sapiens
gaaaggggcaugaaaauga

SEQ ID NO: 434724 - RNA, 19 nt, Homo sapiens
cacaaugaauaccugguua

SEQ ID NO: 434725 - RNA, 19 nt, Homo sapiens
augaauaccugguuaguga

SEQ ID NO: 434726 - RNA, 19 nt, Homo sapiens
ugaguuauauccucuguuc

SEQ ID NO: 434727 - RNA, 19 nt, Homo sapiens
cagaaucaaguccaaauaa

SEQ ID NO: 434728 - RNA, 19 nt, Homo sapiens
gcaaagccagggacagaaa

SEQ ID NO: 434729 - RNA, 19 nt, Homo sapiens
guuccaagauguacauguu

SEQ ID NO: 434730 - RNA, 19 nt, Homo sapiens
ggaccagagugaauagauc

SEQ ID NO: 434731 - RNA, 19 nt, Homo sapiens
guaucgaucuggacugaga

SEQ ID NO: 434732 - RNA, 19 nt, Homo sapiens
gaugugagaaaucuaugua

SEQ ID NO: 434733 - RNA, 19 nt, Homo sapiens
gcacuggguuccucuaucg

SEQ ID NO: 434734 - RNA, 19 nt, Homo sapiens
cggcuuaccugguguagug

SEQ ID NO: 434735 - RNA, 19 nt, Homo sapiens
gaggcaagcucaacauggu

SEQ ID NO: 434736 - RNA, 19 nt, Homo sapiens
gaagcaagaauagauguga

SEQ ID NO: 434737 - RNA, 19 nt, Homo sapiens
ugaaacccaugaagcaaga

SEQ ID NO: 434738 - RNA, 19 nt, Homo sapiens
caacaugguucacauucag

SEQ ID NO: 434739 - RNA, 19 nt, Homo sapiens
gacagaaauuuaacauugg

SEQ ID NO: 434740 - RNA, 19 nt, Homo sapiens
caugucaguuucuuaaugu

SEQ ID NO: 434741 - RNA, 19 nt, Homo sapiens
gaggggauguuacucauaa

SEQ ID NO: 434742 - RNA, 19 nt, Homo sapiens
cagagugaauagauccuaa

SEQ ID NO: 434743 - RNA, 19 nt, Homo sapiens
gugcggauauggcaauuca

SEQ ID NO: 434744 - RNA, 19 nt, Homo sapiens
agacaugggcauauucuuu

SEQ ID NO: 434745 - RNA, 19 nt, Homo sapiens
ggaaauugccaugauuguu

SEQ ID NO: 434746 - RNA, 19 nt, Homo sapiens
agacuuguuugcaaugauu

SEQ ID NO: 434747 - RNA, 19 nt, Homo sapiens
gcucaaaugcuaucugauc

SEQ ID NO: 434748 - RNA, 19 nt, Homo sapiens
gaaacggaccagacuguuc

SEQ ID NO: 434749 - RNA, 19 nt, Homo sapiens
gcuauaguccuggaaauug

SEQ ID NO: 434750 - RNA, 19 nt, Homo sapiens
gaggucugaugacagguuu

SEQ ID NO: 434751 - RNA, 19 nt, Homo sapiens
gagcaucaaugacgaucca

SEQ ID NO: 434752 - RNA, 19 nt, Homo sapiens
uauauccucuguuccaaga

SEQ ID NO: 434753 - RNA, 19 nt, Homo sapiens
agaaaugcauguguguaaa

SEQ ID NO: 434754 - RNA, 19 nt, Homo sapiens
gacaugggcauauucuuug

SEQ ID NO: 434755 - RNA, 19 nt, Homo sapiens
ggaguaaccaaagagagua

SEQ ID NO: 434756 - RNA, 19 nt, Homo sapiens
ccugguuagugaaauauuu

SEQ ID NO: 434757 - RNA, 19 nt, Homo sapiens
gaaaugcauguguguaaag

SEQ ID NO: 434758 - RNA, 19 nt, Homo sapiens
ccagaaucaaguccaaaua

SEQ ID NO: 434759 - RNA, 19 nt, Homo sapiens
gaauaccugguuagugaaa

SEQ ID NO: 434760 - RNA, 19 nt, Homo sapiens
gauaaaugcagacuucagu

SEQ ID NO: 434761 - RNA, 19 nt, Homo sapiens
aagaaaugcauguguguaa

SEQ ID NO: 434762 - RNA, 19 nt, Homo sapiens
gagauaacuugacaaucag

SEQ ID NO: 434763 - RNA, 19 nt, Homo sapiens
uaaggccucugacauugga

SEQ ID NO: 434764 - RNA, 19 nt, Homo sapiens
auaccugguuagugaaaua

SEQ ID NO: 434765 - RNA, 19 nt, Homo sapiens
caagauguacauguuauga

SEQ ID NO: 434766 - RNA, 19 nt, Homo sapiens
gcuaucugaucaaagucua

SEQ ID NO: 434767 - RNA, 19 nt, Homo sapiens
cagcuuccuuucccauuau

SEQ ID NO: 434768 - RNA, 19 nt, Homo sapiens
gccagggacagaaauuuaa

SEQ ID NO: 434769 - RNA, 19 nt, Homo sapiens
gcacuauuguacagggaau

SEQ ID NO: 434770 - RNA, 19 nt, Homo sapiens
aaugcuaucugaucaaagu

SEQ ID NO: 434771 - RNA, 19 nt, Homo sapiens
ccaaauggccaguguaaaa

SEQ ID NO: 434772 - RNA, 19 nt, Homo sapiens
guauggaccagagugaaua

SEQ ID NO: 434773 - RNA, 19 nt, Homo sapiens
caagaauagaugugagaaa

SEQ ID NO: 434774 - RNA, 19 nt, Homo sapiens
acaugucaguuucuuaaug

SEQ ID NO: 434775 - RNA, 19 nt, Homo sapiens
gaugcugucucuugcucuu

SEQ ID NO: 434776 - RNA, 19 nt, Homo sapiens
gaaucaaguccaaauaaac

SEQ ID NO: 434777 - RNA, 19 nt, Homo sapiens
cagaacugcuaugaugauu

SEQ ID NO: 434778 - RNA, 19 nt, Homo sapiens
ucaacaugguucacauuca

SEQ ID NO: 434779 - RNA, 19 nt, Homo sapiens
gauugggacucucuuucug

SEQ ID NO: 434780 - RNA, 19 nt, Homo sapiens
ccuggaaauugccaugauu

SEQ ID NO: 434781 - RNA, 19 nt, Homo sapiens
ccuaagacgagauaacuug

SEQ ID NO: 434782 - RNA, 19 nt, Homo sapiens
aaacaugagguucacauuc

SEQ ID NO: 434783 - RNA, 19 nt, Homo sapiens
gauuuuagguagugcuuuu

SEQ ID NO: 434784 - RNA, 19 nt, Homo sapiens
uaaagaaaugcaugugugu

SEQ ID NO: 434785 - RNA, 19 nt, Homo sapiens
gcaagaauagaugugagaa

SEQ ID NO: 434786 - RNA, 19 nt, Homo sapiens
ggcagugaguaaauacaga

SEQ ID NO: 434787 - RNA, 19 nt, Homo sapiens
aaaauguccuuaugucuga

SEQ ID NO: 434788 - RNA, 19 nt, Homo sapiens
ggucugaugacagguuuaa

SEQ ID NO: 434789 - RNA, 19 nt, Homo sapiens
cccauuugguucuaugauu

SEQ ID NO: 434790 - RNA, 19 nt, Homo sapiens
auacuacucagacuuguuu

SEQ ID NO: 434791 - RNA, 19 nt, Homo sapiens
caaacaugagguucacauu

SEQ ID NO: 434792 - RNA, 19 nt, Homo sapiens
ccacaaugaauaccugguu

SEQ ID NO: 434793 - RNA, 19 nt, Homo sapiens
caaaugcugaucaugacaa

SEQ ID NO: 434794 - RNA, 19 nt, Homo sapiens
guuguauccuugcaugaau

SEQ ID NO: 434795 - RNA, 19 nt, Homo sapiens
gggaguaaccaaagagagu

SEQ ID NO: 434796 - RNA, 19 nt, Homo sapiens
gacgagauaacuugacaau

SEQ ID NO: 434797 - RNA, 19 nt, Homo sapiens
ucugaugacagguuuaauu

SEQ ID NO: 434798 - RNA, 19 nt, Homo sapiens
uagcaggcaucuuguaucg

SEQ ID NO: 434799 - RNA, 19 nt, Homo sapiens
caaagucuccuuauguaua

SEQ ID NO: 434800 - RNA, 19 nt, Homo sapiens
ucauuuggcuguuggauuu

SEQ ID NO: 434801 - RNA, 19 nt, Homo sapiens
ggaagcagcucucauucuc

SEQ ID NO: 434802 - RNA, 19 nt, Homo sapiens
gcaaaagcauccaagaaaa

SEQ ID NO: 434803 - RNA, 19 nt, Homo sapiens
caacacagacuaccacaug

SEQ ID NO: 434804 - RNA, 19 nt, Homo sapiens
ggucaucaguaauaucuuc

SEQ ID NO: 434805 - RNA, 19 nt, Homo sapiens
ggacacaggaugagcucua

SEQ ID NO: 434806 - RNA, 19 nt, Homo sapiens
gccaagaucugaccgugau

SEQ ID NO: 434807 - RNA, 19 nt, Homo sapiens
ccacuaugacgcuuccuua

SEQ ID NO: 434808 - RNA, 19 nt, Homo sapiens
cagcaaagucuccuuaugu

SEQ ID NO: 434809 - RNA, 19 nt, Homo sapiens
ugacagguuugcuccuaaa

SEQ ID NO: 434810 - RNA, 19 nt, Homo sapiens
cagcuuggccaucgugaua

SEQ ID NO: 434811 - RNA, 19 nt, Homo sapiens
agcaaagucuccuuaugua

SEQ ID NO: 434812 - RNA, 19 nt, Homo sapiens
ugacagcaaagucuccuua

SEQ ID NO: 434813 - RNA, 19 nt, Homo sapiens
gacacaggaugagcucuaa

SEQ ID NO: 434814 - RNA, 19 nt, Homo sapiens
guaauaucuucaacacaga

SEQ ID NO: 434815 - RNA, 19 nt, Homo sapiens
gcaaagucuccuuauguau

SEQ ID NO: 434816 - RNA, 19 nt, Homo sapiens
gcaacgauacccaguuugu

SEQ ID NO: 434817 - RNA, 19 nt, Homo sapiens
ucauucuccucuucuauuu

SEQ ID NO: 434818 - RNA, 19 nt, Homo sapiens
gaaacgcucaugacagcaa

SEQ ID NO: 434819 - RNA, 19 nt, Homo sapiens
ggaagguggucaucacacu

SEQ ID NO: 434820 - RNA, 19 nt, Homo sapiens
caaggucagagacagauuu

SEQ ID NO: 434821 - RNA, 19 nt, Homo sapiens
ggucagagacagauuugau

SEQ ID NO: 434822 - RNA, 19 nt, Homo sapiens
cagguuugcuccuaaaucu

SEQ ID NO: 434823 - RNA, 19 nt, Homo sapiens
acuguugccugcauuugua

SEQ ID NO: 434824 - RNA, 19 nt, Homo sapiens
ggagcaguguggccuucaa

SEQ ID NO: 434825 - RNA, 19 nt, Homo sapiens
gucagagacagauuugaua

SEQ ID NO: 434826 - RNA, 19 nt, Homo sapiens
acagcaaagucuccuuaug

SEQ ID NO: 434827 - RNA, 19 nt, Homo sapiens
cuaugacgcuuccuuagag

SEQ ID NO: 434828 - RNA, 19 nt, Homo sapiens
ucaguaauaucuucaacac

SEQ ID NO: 434829 - RNA, 19 nt, Homo sapiens
ugguggaggugacagcuuu

SEQ ID NO: 434830 - RNA, 19 nt, Homo sapiens
gcucguggcauccuaucaa

SEQ ID NO: 434831 - RNA, 19 nt, Homo sapiens
ucagagacagauuugauau

SEQ ID NO: 434832 - RNA, 19 nt, Homo sapiens
aaacaaggucagagacaga

SEQ ID NO: 434833 - RNA, 19 nt, Homo sapiens
aaacgcucaugacagcaaa

SEQ ID NO: 434834 - RNA, 19 nt, Homo sapiens
cagagacagauuugauauu

SEQ ID NO: 434835 - RNA, 19 nt, Homo sapiens
gcucaugacagcaaagucu

SEQ ID NO: 434836 - RNA, 19 nt, Homo sapiens
guauucggcuggccaccau

SEQ ID NO: 434837 - RNA, 19 nt, Homo sapiens
acaacuuccucucacuguu

SEQ ID NO: 434838 - RNA, 19 nt, Homo sapiens
acacagacuaccacaugaa

SEQ ID NO: 434839 - RNA, 19 nt, Homo sapiens
gacaacuuccucucacugu

SEQ ID NO: 434840 - RNA, 19 nt, Homo sapiens
acaagacaacuuccucuca

SEQ ID NO: 434841 - RNA, 19 nt, Homo sapiens
gcccucuucuuguggaugu

SEQ ID NO: 434842 - RNA, 19 nt, Homo sapiens
ugaaacaaggucagagaca

SEQ ID NO: 434843 - RNA, 19 nt, Homo sapiens
acaggaugagcucuaagua

SEQ ID NO: 434844 - RNA, 19 nt, Homo sapiens
cugacagguuugcuccuaa

SEQ ID NO: 434845 - RNA, 19 nt, Homo sapiens
aacacagacuaccacauga

SEQ ID NO: 434846 - RNA, 19 nt, Homo sapiens
acuggaagcagcucucauu

SEQ ID NO: 434847 - RNA, 19 nt, Homo sapiens
gcuguuggauuuuaagcaa

SEQ ID NO: 434848 - RNA, 19 nt, Homo sapiens
caaguuuucuggaaguuuc

SEQ ID NO: 434849 - RNA, 19 nt, Homo sapiens
caucaguaauaucuucaac

SEQ ID NO: 434850 - RNA, 19 nt, Homo sapiens
gacagcaaagucuccuuau

SEQ ID NO: 434851 - RNA, 19 nt, Homo sapiens
cucaagcccucaaguaggu

SEQ ID NO: 434852 - RNA, 19 nt, Homo sapiens
aaugaaacaaggucagaga

SEQ ID NO: 434853 - RNA, 19 nt, Homo sapiens
gguggaggugacagcuuua

SEQ ID NO: 434854 - RNA, 19 nt, Homo sapiens
cagguccuccucagcauug

SEQ ID NO: 434855 - RNA, 19 nt, Homo sapiens
ggccuucaaccucuucaug

SEQ ID NO: 434856 - RNA, 19 nt, Homo sapiens
caaagucuccuuauguaua

SEQ ID NO: 434857 - RNA, 19 nt, Homo sapiens
ucauuuggcuguuggauuu

SEQ ID NO: 434858 - RNA, 19 nt, Homo sapiens
ggaagcagcucucauucuc

SEQ ID NO: 434859 - RNA, 19 nt, Homo sapiens
gcaaaagcauccaagaaaa

SEQ ID NO: 434860 - RNA, 19 nt, Homo sapiens
ggucaucaguaauaucuuc

SEQ ID NO: 434861 - RNA, 19 nt, Homo sapiens
ggacacaggaugagcucua

SEQ ID NO: 434862 - RNA, 19 nt, Homo sapiens
gccaagaucugaccgugau

SEQ ID NO: 434863 - RNA, 19 nt, Homo sapiens
ccacuaugacgcuuccuua

SEQ ID NO: 434864 - RNA, 19 nt, Homo sapiens
cagcaaagucuccuuaugu

SEQ ID NO: 434865 - RNA, 19 nt, Homo sapiens
ugacagguuugcuccuaaa

SEQ ID NO: 434866 - RNA, 19 nt, Homo sapiens
cagcuuggccaucgugaua

SEQ ID NO: 434867 - RNA, 19 nt, Homo sapiens
agcaaagucuccuuaugua

SEQ ID NO: 434868 - RNA, 19 nt, Homo sapiens
ugacagcaaagucuccuua

SEQ ID NO: 434869 - RNA, 19 nt, Homo sapiens
gacacaggaugagcucuaa

SEQ ID NO: 434870 - RNA, 19 nt, Homo sapiens
gcaaagucuccuuauguau

SEQ ID NO: 434871 - RNA, 19 nt, Homo sapiens
ucauucuccucuucuauuu

SEQ ID NO: 434872 - RNA, 19 nt, Homo sapiens
gaaacgcucaugacagcaa

SEQ ID NO: 434873 - RNA, 19 nt, Homo sapiens
ggaagguggucaucacacu

SEQ ID NO: 434874 - RNA, 19 nt, Homo sapiens
caaggucagagacagauuu

SEQ ID NO: 434875 - RNA, 19 nt, Homo sapiens
ggucagagacagauuugau

SEQ ID NO: 434876 - RNA, 19 nt, Homo sapiens
cagguuugcuccuaaaucu

SEQ ID NO: 434877 - RNA, 19 nt, Homo sapiens
ucaguaauaucuucaacgu

SEQ ID NO: 434878 - RNA, 19 nt, Homo sapiens
acuguugccugcauuugua

SEQ ID NO: 434879 - RNA, 19 nt, Homo sapiens
ggagcaguguggccuucaa

SEQ ID NO: 434880 - RNA, 19 nt, Homo sapiens
gucagagacagauuugaua

SEQ ID NO: 434881 - RNA, 19 nt, Homo sapiens
acagcaaagucuccuuaug

SEQ ID NO: 434882 - RNA, 19 nt, Homo sapiens
cuaugacgcuuccuuagag

SEQ ID NO: 434883 - RNA, 19 nt, Homo sapiens
ugguggaggugacagcuuu

SEQ ID NO: 434884 - RNA, 19 nt, Homo sapiens
gcucguggcauccuaucaa

SEQ ID NO: 434885 - RNA, 19 nt, Homo sapiens
ucagagacagauuugauau

SEQ ID NO: 434886 - RNA, 19 nt, Homo sapiens
aaacaaggucagagacaga

SEQ ID NO: 434887 - RNA, 19 nt, Homo sapiens
aaacgcucaugacagcaaa

SEQ ID NO: 434888 - RNA, 19 nt, Homo sapiens
cagagacagauuugauauu

SEQ ID NO: 434889 - RNA, 19 nt, Homo sapiens
gcucaugacagcaaagucu

SEQ ID NO: 434890 - RNA, 19 nt, Homo sapiens
guauucggcuggccaccau

SEQ ID NO: 434891 - RNA, 19 nt, Homo sapiens
acaacuuccucucacuguu

SEQ ID NO: 434892 - RNA, 19 nt, Homo sapiens
gacaacuuccucucacugu

SEQ ID NO: 434893 - RNA, 19 nt, Homo sapiens
acaagacaacuuccucuca

SEQ ID NO: 434894 - RNA, 19 nt, Homo sapiens
acuggaagcagcucucauu

SEQ ID NO: 434895 - RNA, 19 nt, Homo sapiens
ugaaacaaggucagagaca

SEQ ID NO: 434896 - RNA, 19 nt, Homo sapiens
cugacagguuugcuccuaa

SEQ ID NO: 434897 - RNA, 19 nt, Homo sapiens
acaggaugagcucuaagua

SEQ ID NO: 434898 - RNA, 19 nt, Homo sapiens
gcuguuggauuuuaagcaa

SEQ ID NO: 434899 - RNA, 19 nt, Homo sapiens
caaguuuucuggaaguuuc

SEQ ID NO: 434900 - RNA, 19 nt, Homo sapiens
caucaguaauaucuucaac

SEQ ID NO: 434901 - RNA, 19 nt, Homo sapiens
cucaagcccucaaguaggu

SEQ ID NO: 434902 - RNA, 19 nt, Homo sapiens
gacagcaaagucuccuuau

SEQ ID NO: 434903 - RNA, 19 nt, Homo sapiens
aaugaaacaaggucagaga

SEQ ID NO: 434904 - RNA, 19 nt, Homo sapiens
gguggaggugacagcuuua

SEQ ID NO: 434905 - RNA, 19 nt, Homo sapiens
cagguccuccucagcauug

SEQ ID NO: 434906 - RNA, 19 nt, Homo sapiens
ggccuucaaccucuucaug

SEQ ID NO: 434907 - RNA, 19 nt, Homo sapiens
cagcaaagcuccuuaugua

SEQ ID NO: 434908 - RNA, 19 nt, Homo sapiens
gcaaagcuccuuauguaua

SEQ ID NO: 434909 - RNA, 19 nt, Homo sapiens
gaacggcaauggcaugauu

SEQ ID NO: 434910 - RNA, 19 nt, Homo sapiens
ucauuuggcuguuggauuu

SEQ ID NO: 434911 - RNA, 19 nt, Homo sapiens
ggaagcagcucucauucuc

SEQ ID NO: 434912 - RNA, 19 nt, Homo sapiens
gcaaaagcauccaagaaaa

SEQ ID NO: 434913 - RNA, 19 nt, Homo sapiens
ggucaucaguaauaucuuc

SEQ ID NO: 434914 - RNA, 19 nt, Homo sapiens
gcuccuaaaucucaaaaua

SEQ ID NO: 434915 - RNA, 19 nt, Homo sapiens
ggacacaggaugagcucua

SEQ ID NO: 434916 - RNA, 19 nt, Homo sapiens
gccaagaucugaccgugau

SEQ ID NO: 434917 - RNA, 19 nt, Homo sapiens
ccacuaugacgcuuccuua

SEQ ID NO: 434918 - RNA, 19 nt, Homo sapiens
gacacaggaugagcucuaa

SEQ ID NO: 434919 - RNA, 19 nt, Homo sapiens
ucauucuccucuucuauuu

SEQ ID NO: 434920 - RNA, 19 nt, Homo sapiens
gaaacgcucaugacagcaa

SEQ ID NO: 434921 - RNA, 19 nt, Homo sapiens
ggaagguggucaucacacu

SEQ ID NO: 434922 - RNA, 19 nt, Homo sapiens
caaggucagagacagauuu

SEQ ID NO: 434923 - RNA, 19 nt, Homo sapiens
ggucagagacagauuugau

SEQ ID NO: 434924 - RNA, 19 nt, Homo sapiens
acuguugccugcauuugua

SEQ ID NO: 434925 - RNA, 19 nt, Homo sapiens
ggagcaguguggccuucaa

SEQ ID NO: 434926 - RNA, 19 nt, Homo sapiens
gucagagacagauuugaua

SEQ ID NO: 434927 - RNA, 19 nt, Homo sapiens
cuaugacgcuuccuuagag

SEQ ID NO: 434928 - RNA, 19 nt, Homo sapiens
ucaguaauaucuucaacac

SEQ ID NO: 434929 - RNA, 19 nt, Homo sapiens
ugguggaggugacagcuuu

SEQ ID NO: 434930 - RNA, 19 nt, Homo sapiens
gcucguggcauccuaucaa

SEQ ID NO: 434931 - RNA, 19 nt, Homo sapiens
ucagagacagauuugauau

SEQ ID NO: 434932 - RNA, 19 nt, Homo sapiens
aaacaaggucagagacaga

SEQ ID NO: 434933 - RNA, 19 nt, Homo sapiens
aaacgcucaugacagcaaa

SEQ ID NO: 434934 - RNA, 19 nt, Homo sapiens
uggcaugauugcuccuaaa

SEQ ID NO: 434935 - RNA, 19 nt, Homo sapiens
cagagacagauuugauauu

SEQ ID NO: 434936 - RNA, 19 nt, Homo sapiens
caacacuuaugugcacagu

SEQ ID NO: 434937 - RNA, 19 nt, Homo sapiens
guauucggcuggccaccau

SEQ ID NO: 434938 - RNA, 19 nt, Homo sapiens
ugacagcaaagcuccuuau

SEQ ID NO: 434939 - RNA, 19 nt, Homo sapiens
acaacuuccucucacuguu

SEQ ID NO: 434940 - RNA, 19 nt, Homo sapiens
gacaacuuccucucacugu

SEQ ID NO: 434941 - RNA, 19 nt, Homo sapiens
acaagacaacuuccucuca

SEQ ID NO: 434942 - RNA, 19 nt, Homo sapiens
ugaaacaaggucagagaca

SEQ ID NO: 434943 - RNA, 19 nt, Homo sapiens
acuggaagcagcucucauu

SEQ ID NO: 434944 - RNA, 19 nt, Homo sapiens
acaggaugagcucuaagua

SEQ ID NO: 434945 - RNA, 19 nt, Homo sapiens
gcuguuggauuuuaagcaa

SEQ ID NO: 434946 - RNA, 19 nt, Homo sapiens
caaguuuucuggaaguuuc

SEQ ID NO: 434947 - RNA, 19 nt, Homo sapiens
caucaguaauaucuucaac

SEQ ID NO: 434948 - RNA, 19 nt, Homo sapiens
gacagcaaagcuccuuaug

SEQ ID NO: 434949 - RNA, 19 nt, Homo sapiens
cucaagcccucaaguaggu

SEQ ID NO: 434950 - RNA, 19 nt, Homo sapiens
aaugaaacaaggucagaga

SEQ ID NO: 434951 - RNA, 19 nt, Homo sapiens
acagcaaagcuccuuaugu

SEQ ID NO: 434952 - RNA, 19 nt, Homo sapiens
ggcaugauugcuccuaaau

SEQ ID NO: 434953 - RNA, 19 nt, Homo sapiens
gguggaggugacagcuuua

SEQ ID NO: 434954 - RNA, 19 nt, Homo sapiens
ggccuucaaccucuucaug

SEQ ID NO: 434955 - RNA, 19 nt, Homo sapiens
caaagucuccuuauguaua

SEQ ID NO: 434956 - RNA, 19 nt, Homo sapiens
ucauuuggcuguuggauuu

SEQ ID NO: 434957 - RNA, 19 nt, Homo sapiens
ggaagcagcucucauucuc

SEQ ID NO: 434958 - RNA, 19 nt, Homo sapiens
ccaagugccugccggauug

SEQ ID NO: 434959 - RNA, 19 nt, Homo sapiens
gcaaaagcauccaagaaaa

SEQ ID NO: 434960 - RNA, 19 nt, Homo sapiens
caacacagacuaccacaug

SEQ ID NO: 434961 - RNA, 19 nt, Homo sapiens
ggucaucaguaauaucuuc

SEQ ID NO: 434962 - RNA, 19 nt, Homo sapiens
ggacacaggaugagcucua

SEQ ID NO: 434963 - RNA, 19 nt, Homo sapiens
gccaagaucugaccgugau

SEQ ID NO: 434964 - RNA, 19 nt, Homo sapiens
ccacuaugacgcuuccuua

SEQ ID NO: 434965 - RNA, 19 nt, Homo sapiens
cagcaaagucuccuuaugu

SEQ ID NO: 434966 - RNA, 19 nt, Homo sapiens
ugacagguuugcuccuaaa

SEQ ID NO: 434967 - RNA, 19 nt, Homo sapiens
cagcuuggccaucgugaua

SEQ ID NO: 434968 - RNA, 19 nt, Homo sapiens
agcaaagucuccuuaugua

SEQ ID NO: 434969 - RNA, 19 nt, Homo sapiens
ugacagcaaagucuccuua

SEQ ID NO: 434970 - RNA, 19 nt, Homo sapiens
gacacaggaugagcucuaa

SEQ ID NO: 434971 - RNA, 19 nt, Homo sapiens
guaauaucuucaacacaga

SEQ ID NO: 434972 - RNA, 19 nt, Homo sapiens
gcaaagucuccuuauguau

SEQ ID NO: 434973 - RNA, 19 nt, Homo sapiens
gcaacgauacccaguuugu

SEQ ID NO: 434974 - RNA, 19 nt, Homo sapiens
ucauucuccucuucuauuu

SEQ ID NO: 434975 - RNA, 19 nt, Homo sapiens
gaaacgcucaugacagcaa

SEQ ID NO: 434976 - RNA, 19 nt, Homo sapiens
ggaagguggucaucacacu

SEQ ID NO: 434977 - RNA, 19 nt, Homo sapiens
caaggucagagacagauuu

SEQ ID NO: 434978 - RNA, 19 nt, Homo sapiens
ggucagagacagauuugau

SEQ ID NO: 434979 - RNA, 19 nt, Homo sapiens
cagguuugcuccuaaaucu

SEQ ID NO: 434980 - RNA, 19 nt, Homo sapiens
acuguugccugcauuugua

SEQ ID NO: 434981 - RNA, 19 nt, Homo sapiens
ggagcaguguggccuucaa

SEQ ID NO: 434982 - RNA, 19 nt, Homo sapiens
gucagagacagauuugaua

SEQ ID NO: 434983 - RNA, 19 nt, Homo sapiens
acagcaaagucuccuuaug

SEQ ID NO: 434984 - RNA, 19 nt, Homo sapiens
cuaugacgcuuccuuagag

SEQ ID NO: 434985 - RNA, 19 nt, Homo sapiens
ucaguaauaucuucaacac

SEQ ID NO: 434986 - RNA, 19 nt, Homo sapiens
ugguggaggugacagcuuu

SEQ ID NO: 434987 - RNA, 19 nt, Homo sapiens
gcucguggcauccuaucaa

SEQ ID NO: 434988 - RNA, 19 nt, Homo sapiens
ucagagacagauuugauau

SEQ ID NO: 434989 - RNA, 19 nt, Homo sapiens
aaacaaggucagagacaga

SEQ ID NO: 434990 - RNA, 19 nt, Homo sapiens
aaacgcucaugacagcaaa

SEQ ID NO: 434991 - RNA, 19 nt, Homo sapiens
cagagacagauuugauauu

SEQ ID NO: 434992 - RNA, 19 nt, Homo sapiens
gcucaugacagcaaagucu

SEQ ID NO: 434993 - RNA, 19 nt, Homo sapiens
gccaagugccugccggauu

SEQ ID NO: 434994 - RNA, 19 nt, Homo sapiens
guauucggcuggccaccau

SEQ ID NO: 434995 - RNA, 19 nt, Homo sapiens
acaacuuccucucacuguu

SEQ ID NO: 434996 - RNA, 19 nt, Homo sapiens
uggcugggcugaucuccau

SEQ ID NO: 434997 - RNA, 19 nt, Homo sapiens
acacagacuaccacaugaa

SEQ ID NO: 434998 - RNA, 19 nt, Homo sapiens
gacaacuuccucucacugu

SEQ ID NO: 434999 - RNA, 19 nt, Homo sapiens
acaagacaacuuccucuca

SEQ ID NO: 435000 - RNA, 19 nt, Homo sapiens
gcccucuucuuguggaugu

SEQ ID NO: 435001 - RNA, 19 nt, Homo sapiens
acaggaugagcucuaagua

SEQ ID NO: 435002 - RNA, 19 nt, Homo sapiens
ugaaacaaggucagagaca

SEQ ID NO: 435003 - RNA, 19 nt, Homo sapiens
cugacagguuugcuccuaa

SEQ ID NO: 435004 - RNA, 19 nt, Homo sapiens
aacacagacuaccacauga

SEQ ID NO: 435005 - RNA, 19 nt, Homo sapiens
acuggaagcagcucucauu

SEQ ID NO: 435006 - RNA, 19 nt, Homo sapiens
gcuguuggauuuuaagcaa

SEQ ID NO: 435007 - RNA, 19 nt, Homo sapiens
caaguuuucuggaaguuuc

SEQ ID NO: 435008 - RNA, 19 nt, Homo sapiens
caucaguaauaucuucaac

SEQ ID NO: 435009 - RNA, 19 nt, Homo sapiens
gacagcaaagucuccuuau

SEQ ID NO: 435010 - RNA, 19 nt, Homo sapiens
cucaagcccucaaguaggu

SEQ ID NO: 435011 - RNA, 19 nt, Homo sapiens
aaugaaacaaggucagaga

SEQ ID NO: 435012 - RNA, 19 nt, Homo sapiens
gguggaggugacagcuuua

SEQ ID NO: 435013 - RNA, 19 nt, Homo sapiens
cagguccuccucagcauug

SEQ ID NO: 435014 - RNA, 19 nt, Homo sapiens
ggccuucaaccucuucaug

SEQ ID NO: 435015 - RNA, 19 nt, Homo sapiens
ugaacaagcuaacaaacua

SEQ ID NO: 435016 - RNA, 19 nt, Homo sapiens
caccacaucuggcuaauuu

SEQ ID NO: 435017 - RNA, 19 nt, Homo sapiens
caaaguagcugggauuaca

SEQ ID NO: 435018 - RNA, 19 nt, Homo sapiens
gaacuccauugcuuaagaa

SEQ ID NO: 435019 - RNA, 19 nt, Homo sapiens
gcaaucaugugcuucauag

SEQ ID NO: 435020 - RNA, 19 nt, Homo sapiens
ucauuuggcuguuggauuu

SEQ ID NO: 435021 - RNA, 19 nt, Homo sapiens
guaaacaacagacugcaua

SEQ ID NO: 435022 - RNA, 19 nt, Homo sapiens
ggaagcagcucucauucuc

SEQ ID NO: 435023 - RNA, 19 nt, Homo sapiens
caacagacugcauauauga

SEQ ID NO: 435024 - RNA, 19 nt, Homo sapiens
ccacuagagucuucagauu

SEQ ID NO: 435025 - RNA, 19 nt, Homo sapiens
cauagaaacugcuuugaca

SEQ ID NO: 435026 - RNA, 19 nt, Homo sapiens
gcaaagucuccaacaauaa

SEQ ID NO: 435027 - RNA, 19 nt, Homo sapiens
gaaguccaaucgaaaggaa

SEQ ID NO: 435028 - RNA, 19 nt, Homo sapiens
gcugagaaguccaaucgaa

SEQ ID NO: 435029 - RNA, 19 nt, Homo sapiens
gcaaaagcauccaagaaaa

SEQ ID NO: 435030 - RNA, 19 nt, Homo sapiens
caacacagacuaccacaug

SEQ ID NO: 435031 - RNA, 19 nt, Homo sapiens
caaagucuccaacaauaaa

SEQ ID NO: 435032 - RNA, 19 nt, Homo sapiens
agcaaagucuccaacaaua

SEQ ID NO: 435033 - RNA, 19 nt, Homo sapiens
ggucaucaguaauaucuuc

SEQ ID NO: 435034 - RNA, 19 nt, Homo sapiens
ccaguaagcuaagguuaau

SEQ ID NO: 435035 - RNA, 19 nt, Homo sapiens
ggaagaaugccguguucaa

SEQ ID NO: 435036 - RNA, 19 nt, Homo sapiens
ugacaggguuucaccaugu

SEQ ID NO: 435037 - RNA, 19 nt, Homo sapiens
ggacacaggaugagcucua

SEQ ID NO: 435038 - RNA, 19 nt, Homo sapiens
cauaacaacaucuugguaa

SEQ ID NO: 435039 - RNA, 19 nt, Homo sapiens
agaauuaacagcuuuguga

SEQ ID NO: 435040 - RNA, 19 nt, Homo sapiens
ugaacuccauugcuuaaga

SEQ ID NO: 435041 - RNA, 19 nt, Homo sapiens
gccaagaucugaccgugau

SEQ ID NO: 435042 - RNA, 19 nt, Homo sapiens
ccacuaugacgcuuccuua

SEQ ID NO: 435043 - RNA, 19 nt, Homo sapiens
ugacagguuugcuccuaaa

SEQ ID NO: 435044 - RNA, 19 nt, Homo sapiens
cagcuuggccaucgugaua

SEQ ID NO: 435045 - RNA, 19 nt, Homo sapiens
gacacaggaugagcucuaa

SEQ ID NO: 435046 - RNA, 19 nt, Homo sapiens
uaacagacaauuggucaaa

SEQ ID NO: 435047 - RNA, 19 nt, Homo sapiens
gaaaaugaauaagcgguuu

SEQ ID NO: 435048 - RNA, 19 nt, Homo sapiens
ccaaagugcugggauuaca

SEQ ID NO: 435049 - RNA, 19 nt, Homo sapiens
agaaacugcuuugacauga

SEQ ID NO: 435050 - RNA, 19 nt, Homo sapiens
acaacagacugcauauaug

SEQ ID NO: 435051 - RNA, 19 nt, Homo sapiens
guaauaucuucaacacaga

SEQ ID NO: 435052 - RNA, 19 nt, Homo sapiens
ucauucuccucuucuauuu

SEQ ID NO: 435053 - RNA, 19 nt, Homo sapiens
gcaacgauacccaguuugu

SEQ ID NO: 435054 - RNA, 19 nt, Homo sapiens
gaauuaacagcuuugugaa

SEQ ID NO: 435055 - RNA, 19 nt, Homo sapiens
ggagugcagugccgcaauc

SEQ ID NO: 435056 - RNA, 19 nt, Homo sapiens
ucacugaacauagcuauau

SEQ ID NO: 435057 - RNA, 19 nt, Homo sapiens
gcccagccuuguuugcuuu

SEQ ID NO: 435058 - RNA, 19 nt, Homo sapiens
gaaacgcucaugacagcaa

SEQ ID NO: 435059 - RNA, 19 nt, Homo sapiens
ggaagguggucaucacacu

SEQ ID NO: 435060 - RNA, 19 nt, Homo sapiens
uggcagugcuugugauuca

SEQ ID NO: 435061 - RNA, 19 nt, Homo sapiens
ugacugcaaucaugugcuu

SEQ ID NO: 435062 - RNA, 19 nt, Homo sapiens
gcucauagaaacugcuuug

SEQ ID NO: 435063 - RNA, 19 nt, Homo sapiens
uggccaggcugaucucaaa

SEQ ID NO: 435064 - RNA, 19 nt, Homo sapiens
gaacguggcagugcuugug

SEQ ID NO: 435065 - RNA, 19 nt, Homo sapiens
cagcaaagucuccaacaau

SEQ ID NO: 435066 - RNA, 19 nt, Homo sapiens
caucaugggcuacaacuuc

SEQ ID NO: 435067 - RNA, 19 nt, Homo sapiens
cauguuggcuaggauaguu

SEQ ID NO: 435068 - RNA, 19 nt, Homo sapiens
cagguuugcuccuaaaucu

SEQ ID NO: 435069 - RNA, 19 nt, Homo sapiens
ccgaguagcugggauuaca

SEQ ID NO: 435070 - RNA, 19 nt, Homo sapiens
gauaacagugugcucauag

SEQ ID NO: 435071 - RNA, 19 nt, Homo sapiens
agauaacagugugcucaua

SEQ ID NO: 435072 - RNA, 19 nt, Homo sapiens
aaacaacagacugcauaua

SEQ ID NO: 435073 - RNA, 19 nt, Homo sapiens
gacaggguuucaccauguu

SEQ ID NO: 435074 - RNA, 19 nt, Homo sapiens
uaccacacccagcuaauuu

SEQ ID NO: 435075 - RNA, 19 nt, Homo sapiens
acuguugccugcauuugua

SEQ ID NO: 435076 - RNA, 19 nt, Homo sapiens
ggagcaguguggccuucaa

SEQ ID NO: 435077 - RNA, 19 nt, Homo sapiens
gcacuaccacacccagcua

SEQ ID NO: 435078 - RNA, 19 nt, Homo sapiens
gaaacugcuuugacaugac

SEQ ID NO: 435079 - RNA, 19 nt, Homo sapiens
uaacagugugcucauagaa

SEQ ID NO: 435080 - RNA, 19 nt, Homo sapiens
aacaacagacugcauauau

SEQ ID NO: 435081 - RNA, 19 nt, Homo sapiens
gauuauaccacuagagucu

SEQ ID NO: 435082 - RNA, 19 nt, Homo sapiens
aaucaugugcuucauagaa

SEQ ID NO: 435083 - RNA, 19 nt, Homo sapiens
gcuuugacaugacugcaau

SEQ ID NO: 435084 - RNA, 19 nt, Homo sapiens
acagcaaagucuccaacaa

SEQ ID NO: 435085 - RNA, 19 nt, Homo sapiens
cuccauugcuuaagaaaca

SEQ ID NO: 435086 - RNA, 19 nt, Homo sapiens
cuaugacgcuuccuuagag

SEQ ID NO: 435087 - RNA, 19 nt, Homo sapiens
gaagaaugccguguucaac

SEQ ID NO: 435088 - RNA, 19 nt, Homo sapiens
cacuagagucuucagauuu

SEQ ID NO: 435089 - RNA, 19 nt, Homo sapiens
ucaaacuccugaccucaag

SEQ ID NO: 435090 - RNA, 19 nt, Homo sapiens
ugccucagccuccaaagua

SEQ ID NO: 435091 - RNA, 19 nt, Homo sapiens
ucaguaauaucuucaacac

SEQ ID NO: 435092 - RNA, 19 nt, Homo sapiens
ugguggaggugacagcuuu

SEQ ID NO: 435093 - RNA, 19 nt, Homo sapiens
gacaauuggucaaaaugaa

SEQ ID NO: 435094 - RNA, 19 nt, Homo sapiens
gcaucccaagauuauauua

SEQ ID NO: 435095 - RNA, 19 nt, Homo sapiens
gcucguggcauccuaucaa

SEQ ID NO: 435096 - RNA, 19 nt, Homo sapiens
ccuccuggguucaagcaaa

SEQ ID NO: 435097 - RNA, 19 nt, Homo sapiens
aacaacaucuugguaaaca

SEQ ID NO: 435098 - RNA, 19 nt, Homo sapiens
uagaaacugcuuugacaug

SEQ ID NO: 435099 - RNA, 19 nt, Homo sapiens
agaaacacauaaacaccau

SEQ ID NO: 435100 - RNA, 19 nt, Homo sapiens
guguggcaguguuuaaaug

SEQ ID NO: 435101 - RNA, 19 nt, Homo sapiens
aaacgcucaugacagcaaa

SEQ ID NO: 435102 - RNA, 19 nt, Homo sapiens
aaggaagaaugccguguuc

SEQ ID NO: 435103 - RNA, 19 nt, Homo sapiens
gcuauauguaugguuguua

SEQ ID NO: 435104 - RNA, 19 nt, Homo sapiens
uaaacaacagacugcauau

SEQ ID NO: 435105 - RNA, 19 nt, Homo sapiens
gcucaugacagcaaagucu

SEQ ID NO: 435106 - RNA, 19 nt, Homo sapiens
gaaacacauaaacaccauu

SEQ ID NO: 435107 - RNA, 19 nt, Homo sapiens
ucucuuggccucaugauca

SEQ ID NO: 435108 - RNA, 19 nt, Homo sapiens
gaagaauuaacagcuuugu

SEQ ID NO: 435109 - RNA, 19 nt, Homo sapiens
aaaggaagaaugccguguu

SEQ ID NO: 435110 - RNA, 19 nt, Homo sapiens
uagauuauaccacuagagu

SEQ ID NO: 435111 - RNA, 19 nt, Homo sapiens
aaacugcuuugacaugacu

SEQ ID NO: 435112 - RNA, 19 nt, Homo sapiens
acagugugcucauagaaac

SEQ ID NO: 435113 - RNA, 19 nt, Homo sapiens
guauucggcuggccaccau

SEQ ID NO: 435114 - RNA, 19 nt, Homo sapiens
guuacuaugggaaaucuug

SEQ ID NO: 435115 - RNA, 19 nt, Homo sapiens
ugaacaagcuaacaaacua

SEQ ID NO: 435116 - RNA, 19 nt, Homo sapiens
caccacaucuggcuaauuu

SEQ ID NO: 435117 - RNA, 19 nt, Homo sapiens
caaaguagcugggauuaca

SEQ ID NO: 435118 - RNA, 19 nt, Homo sapiens
gaacuccauugcuuaagaa

SEQ ID NO: 435119 - RNA, 19 nt, Homo sapiens
gcaaucaugugcuucauag

SEQ ID NO: 435120 - RNA, 19 nt, Homo sapiens
ccaaguaccugccgguuug

SEQ ID NO: 435121 - RNA, 19 nt, Homo sapiens
ucauuuggcuguuggauuu

SEQ ID NO: 435122 - RNA, 19 nt, Homo sapiens
guaaacaacagacugcaua

SEQ ID NO: 435123 - RNA, 19 nt, Homo sapiens
ggaagcagcucucauucuc

SEQ ID NO: 435124 - RNA, 19 nt, Homo sapiens
caacagacugcauauauga

SEQ ID NO: 435125 - RNA, 19 nt, Homo sapiens
ccacuagagucuucagauu

SEQ ID NO: 435126 - RNA, 19 nt, Homo sapiens
cauagaaacugcuuugaca

SEQ ID NO: 435127 - RNA, 19 nt, Homo sapiens
gcaaagucuccaacaauaa

SEQ ID NO: 435128 - RNA, 19 nt, Homo sapiens
gaaguccaaucgaaaggaa

SEQ ID NO: 435129 - RNA, 19 nt, Homo sapiens
gcugagaaguccaaucgaa

SEQ ID NO: 435130 - RNA, 19 nt, Homo sapiens
gcaaaagcauccaagaaaa

SEQ ID NO: 435131 - RNA, 19 nt, Homo sapiens
caacacagacuaccacaug

SEQ ID NO: 435132 - RNA, 19 nt, Homo sapiens
caaagucuccaacaauaaa

SEQ ID NO: 435133 - RNA, 19 nt, Homo sapiens
agcaaagucuccaacaaua

SEQ ID NO: 435134 - RNA, 19 nt, Homo sapiens
gguuugcuccuaaaucuua

SEQ ID NO: 435135 - RNA, 19 nt, Homo sapiens
ggucaucaguaauaucuuc

SEQ ID NO: 435136 - RNA, 19 nt, Homo sapiens
ccaguaagcuaagguuaau

SEQ ID NO: 435137 - RNA, 19 nt, Homo sapiens
ggaagaaugccguguucaa

SEQ ID NO: 435138 - RNA, 19 nt, Homo sapiens
ugacaggguuucaccaugu

SEQ ID NO: 435139 - RNA, 19 nt, Homo sapiens
cauaacaacaucuugguaa

SEQ ID NO: 435140 - RNA, 19 nt, Homo sapiens
ggacacaggaugagcucua

SEQ ID NO: 435141 - RNA, 19 nt, Homo sapiens
agaauuaacagcuuuguga

SEQ ID NO: 435142 - RNA, 19 nt, Homo sapiens
ugaacuccauugcuuaaga

SEQ ID NO: 435143 - RNA, 19 nt, Homo sapiens
gccaagaucugaccgugau

SEQ ID NO: 435144 - RNA, 19 nt, Homo sapiens
ccacuaugacgcuuccuua

SEQ ID NO: 435145 - RNA, 19 nt, Homo sapiens
gacacaggaugagcucuaa

SEQ ID NO: 435146 - RNA, 19 nt, Homo sapiens
uaacagacaauuggucaaa

SEQ ID NO: 435147 - RNA, 19 nt, Homo sapiens
gaaaaugaauaagcgguuu

SEQ ID NO: 435148 - RNA, 19 nt, Homo sapiens
ccaaagugcugggauuaca

SEQ ID NO: 435149 - RNA, 19 nt, Homo sapiens
agaaacugcuuugacauga

SEQ ID NO: 435150 - RNA, 19 nt, Homo sapiens
acaacagacugcauauaug

SEQ ID NO: 435151 - RNA, 19 nt, Homo sapiens
guaauaucuucaacacaga

SEQ ID NO: 435152 - RNA, 19 nt, Homo sapiens
ucauucuccucuucuauuu

SEQ ID NO: 435153 - RNA, 19 nt, Homo sapiens
gcaacgauacccaguuugu

SEQ ID NO: 435154 - RNA, 19 nt, Homo sapiens
gaauuaacagcuuugugaa

SEQ ID NO: 435155 - RNA, 19 nt, Homo sapiens
ggagugcagugccgcaauc

SEQ ID NO: 435156 - RNA, 19 nt, Homo sapiens
ucacugaacauagcuauau

SEQ ID NO: 435157 - RNA, 19 nt, Homo sapiens
gcccagccuuguuugcuuu

SEQ ID NO: 435158 - RNA, 19 nt, Homo sapiens
gaaacgcucaugacagcaa

SEQ ID NO: 435159 - RNA, 19 nt, Homo sapiens
ggaagguggucaucacacu

SEQ ID NO: 435160 - RNA, 19 nt, Homo sapiens
uggcagugcuugugauuca

SEQ ID NO: 435161 - RNA, 19 nt, Homo sapiens
ugacugcaaucaugugcuu

SEQ ID NO: 435162 - RNA, 19 nt, Homo sapiens
gcucauagaaacugcuuug

SEQ ID NO: 435163 - RNA, 19 nt, Homo sapiens
uggccaggcugaucucaaa

SEQ ID NO: 435164 - RNA, 19 nt, Homo sapiens
cucaugaggcuaaauauuu

SEQ ID NO: 435165 - RNA, 19 nt, Homo sapiens
gaacguggcagugcuugug

SEQ ID NO: 435166 - RNA, 19 nt, Homo sapiens
cagcaaagucuccaacaau

SEQ ID NO: 435167 - RNA, 19 nt, Homo sapiens
cauguuggcuaggauaguu

SEQ ID NO: 435168 - RNA, 19 nt, Homo sapiens
ccgaguagcugggauuaca

SEQ ID NO: 435169 - RNA, 19 nt, Homo sapiens
gauaacagugugcucauag

SEQ ID NO: 435170 - RNA, 19 nt, Homo sapiens
agauaacagugugcucaua

SEQ ID NO: 435171 - RNA, 19 nt, Homo sapiens
aaacaacagacugcauaua

SEQ ID NO: 435172 - RNA, 19 nt, Homo sapiens
gacaggguuucaccauguu

SEQ ID NO: 435173 - RNA, 19 nt, Homo sapiens
uaccacacccagcuaauuu

SEQ ID NO: 435174 - RNA, 19 nt, Homo sapiens
acuguugccugcauuugua

SEQ ID NO: 435175 - RNA, 19 nt, Homo sapiens
ggagcaguguggccuucaa

SEQ ID NO: 435176 - RNA, 19 nt, Homo sapiens
gcacuaccacacccagcua

SEQ ID NO: 435177 - RNA, 19 nt, Homo sapiens
gaaacugcuuugacaugac

SEQ ID NO: 435178 - RNA, 19 nt, Homo sapiens
uaacagugugcucauagaa

SEQ ID NO: 435179 - RNA, 19 nt, Homo sapiens
aacaacagacugcauauau

SEQ ID NO: 435180 - RNA, 19 nt, Homo sapiens
gauuauaccacuagagucu

SEQ ID NO: 435181 - RNA, 19 nt, Homo sapiens
aaucaugugcuucauagaa

SEQ ID NO: 435182 - RNA, 19 nt, Homo sapiens
gcuuugacaugacugcaau

SEQ ID NO: 435183 - RNA, 19 nt, Homo sapiens
acagcaaagucuccaacaa

SEQ ID NO: 435184 - RNA, 19 nt, Homo sapiens
cuccauugcuuaagaaaca

SEQ ID NO: 435185 - RNA, 19 nt, Homo sapiens
cuaugacgcuuccuuagag

SEQ ID NO: 435186 - RNA, 19 nt, Homo sapiens
gaagaaugccguguucaac

SEQ ID NO: 435187 - RNA, 19 nt, Homo sapiens
cacuagagucuucagauuu

SEQ ID NO: 435188 - RNA, 19 nt, Homo sapiens
ucaaacuccugaccucaag

SEQ ID NO: 435189 - RNA, 19 nt, Homo sapiens
ugccucagccuccaaagua

SEQ ID NO: 435190 - RNA, 19 nt, Homo sapiens
ucaguaauaucuucaacac

SEQ ID NO: 435191 - RNA, 19 nt, Homo sapiens
ugguggaggugacagcuuu

SEQ ID NO: 435192 - RNA, 19 nt, Homo sapiens
gacaauuggucaaaaugaa

SEQ ID NO: 435193 - RNA, 19 nt, Homo sapiens
gcaucccaagauuauauua

SEQ ID NO: 435194 - RNA, 19 nt, Homo sapiens
gcucguggcauccuaucaa

SEQ ID NO: 435195 - RNA, 19 nt, Homo sapiens
ccuccuggguucaagcaaa

SEQ ID NO: 435196 - RNA, 19 nt, Homo sapiens
aacaacaucuugguaaaca

SEQ ID NO: 435197 - RNA, 19 nt, Homo sapiens
uagaaacugcuuugacaug

SEQ ID NO: 435198 - RNA, 19 nt, Homo sapiens
agaaacacauaaacaccau

SEQ ID NO: 435199 - RNA, 19 nt, Homo sapiens
guguggcaguguuuaaaug

SEQ ID NO: 435200 - RNA, 19 nt, Homo sapiens
aaacgcucaugacagcaaa

SEQ ID NO: 435201 - RNA, 19 nt, Homo sapiens
aaggaagaaugccguguuc

SEQ ID NO: 435202 - RNA, 19 nt, Homo sapiens
gcuauauguaugguuguua

SEQ ID NO: 435203 - RNA, 19 nt, Homo sapiens
uaaacaacagacugcauau

SEQ ID NO: 435204 - RNA, 19 nt, Homo sapiens
gcucaugacagcaaagucu

SEQ ID NO: 435205 - RNA, 19 nt, Homo sapiens
ccgguuugcuccuaaaucu

SEQ ID NO: 435206 - RNA, 19 nt, Homo sapiens
gccaaguaccugccgguuu

SEQ ID NO: 435207 - RNA, 19 nt, Homo sapiens
gaaacacauaaacaccauu

SEQ ID NO: 435208 - RNA, 19 nt, Homo sapiens
ucucuuggccucaugauca

SEQ ID NO: 435209 - RNA, 19 nt, Homo sapiens
gaagaauuaacagcuuugu

SEQ ID NO: 435210 - RNA, 19 nt, Homo sapiens
aaaggaagaaugccguguu

SEQ ID NO: 435211 - RNA, 19 nt, Homo sapiens
uagauuauaccacuagagu

SEQ ID NO: 435212 - RNA, 19 nt, Homo sapiens
aaacugcuuugacaugacu

SEQ ID NO: 435213 - RNA, 19 nt, Homo sapiens
acagugugcucauagaaac

SEQ ID NO: 435214 - RNA, 19 nt, Homo sapiens
guauucggcuggccaccau

SEQ ID NO: 435215 - RNA, 19 nt, Homo sapiens
uggaaagggugaucaguua

SEQ ID NO: 435216 - RNA, 19 nt, Homo sapiens
caaaguugaucacaguaaa

SEQ ID NO: 435217 - RNA, 19 nt, Homo sapiens
agaaagaccugcauaugga

SEQ ID NO: 435218 - RNA, 19 nt, Homo sapiens
gcuauauucuuguguauuc

SEQ ID NO: 435219 - RNA, 19 nt, Homo sapiens
ggugaucaguuaugaagaa

SEQ ID NO: 435220 - RNA, 19 nt, Homo sapiens
caguguaguuuguuguuua

SEQ ID NO: 435221 - RNA, 19 nt, Homo sapiens
caaaugaguucacuuccau

SEQ ID NO: 435222 - RNA, 19 nt, Homo sapiens
ggaaagcuuuggcagaauc

SEQ ID NO: 435223 - RNA, 19 nt, Homo sapiens
gaagcaaacugcccguucu

SEQ ID NO: 435224 - RNA, 19 nt, Homo sapiens
cacaguaaauggacaagaa

SEQ ID NO: 435225 - RNA, 19 nt, Homo sapiens
cagacauacuccauagaua

SEQ ID NO: 435226 - RNA, 19 nt, Homo sapiens
ugaggacacugggaauaua

SEQ ID NO: 435227 - RNA, 19 nt, Homo sapiens
gaauaucaucuucaacuug

SEQ ID NO: 435228 - RNA, 19 nt, Homo sapiens
gcaaauuguuggauauggu

SEQ ID NO: 435229 - RNA, 19 nt, Homo sapiens
cauggcaaauuguuggaua

SEQ ID NO: 435230 - RNA, 19 nt, Homo sapiens
uuacaaaguugaucacagu

SEQ ID NO: 435231 - RNA, 19 nt, Homo sapiens
gaaagggugaucaguuaug

SEQ ID NO: 435232 - RNA, 19 nt, Homo sapiens
ucuguuaaccugaaagaua

SEQ ID NO: 435233 - RNA, 19 nt, Homo sapiens
uaagaaagaccugcauaug

SEQ ID NO: 435234 - RNA, 19 nt, Homo sapiens
gaaagaccugcauauggaa

SEQ ID NO: 435235 - RNA, 19 nt, Homo sapiens
gacauacuccauagauauu

SEQ ID NO: 435236 - RNA, 19 nt, Homo sapiens
aaagggugaucaguuauga

SEQ ID NO: 435237 - RNA, 19 nt, Homo sapiens
ggaaaguacaaauaccuau

SEQ ID NO: 435238 - RNA, 19 nt, Homo sapiens
ccaaaugaguucacuucca

SEQ ID NO: 435239 - RNA, 19 nt, Homo sapiens
agacauacuccauagauau

SEQ ID NO: 435240 - RNA, 19 nt, Homo sapiens
ccugaaagauaucauuugg

SEQ ID NO: 435241 - RNA, 19 nt, Homo sapiens
caugcucggugaugugauu

SEQ ID NO: 435242 - RNA, 19 nt, Homo sapiens
ccucagacauacuccauag

SEQ ID NO: 435243 - RNA, 19 nt, Homo sapiens
gccaauuuguggacuccua

SEQ ID NO: 435244 - RNA, 19 nt, Homo sapiens
cuguuaaccugaaagauau

SEQ ID NO: 435245 - RNA, 19 nt, Homo sapiens
uuuggaaucuucugcuaaa

SEQ ID NO: 435246 - RNA, 19 nt, Homo sapiens
agggaaagcuuuggcagaa

SEQ ID NO: 435247 - RNA, 19 nt, Homo sapiens
gggaaaguacaaauaccua

SEQ ID NO: 435248 - RNA, 19 nt, Homo sapiens
uauucuaucuuuccucaga

SEQ ID NO: 435249 - RNA, 19 nt, Homo sapiens
ggaaagggugaucaguuau

SEQ ID NO: 435250 - RNA, 19 nt, Homo sapiens
gaaggugggagggucauga

SEQ ID NO: 435251 - RNA, 19 nt, Homo sapiens
gaugugauucugcugcaaa

SEQ ID NO: 435252 - RNA, 19 nt, Homo sapiens
ucaguguaguuuguuguuu

SEQ ID NO: 435253 - RNA, 19 nt, Homo sapiens
gaggacacugggaauauau

SEQ ID NO: 435254 - RNA, 19 nt, Homo sapiens
cuccuacgauccaaccaua

SEQ ID NO: 435255 - RNA, 19 nt, Homo sapiens
caaacugcccguucuccuu

SEQ ID NO: 435256 - RNA, 19 nt, Homo sapiens
ggcagaaucuuggaaugca

SEQ ID NO: 435257 - RNA, 19 nt, Homo sapiens
gcaagaugaauauucuauc

SEQ ID NO: 435258 - RNA, 19 nt, Homo sapiens
ggcaagaugaauauucuau

SEQ ID NO: 435259 - RNA, 19 nt, Homo sapiens
guaaauggacaagaauauc

SEQ ID NO: 435260 - RNA, 19 nt, Homo sapiens
caguaaauggacaagaaua

SEQ ID NO: 435261 - RNA, 19 nt, Homo sapiens
gggaaagcuuuggcagaau

SEQ ID NO: 435262 - RNA, 19 nt, Homo sapiens
ugaagaagggaaagcuuug

SEQ ID NO: 435263 - RNA, 19 nt, Homo sapiens
ggaaauccucauugacgau

SEQ ID NO: 435264 - RNA, 19 nt, Homo sapiens
aauaagaaagaccugcaua

SEQ ID NO: 435265 - RNA, 19 nt, Homo sapiens
aguuauccauggcaaauug

SEQ ID NO: 435266 - RNA, 19 nt, Homo sapiens
acaaaguugaucacaguaa

SEQ ID NO: 435267 - RNA, 19 nt, Homo sapiens
ccaagaugccgcaguccaa

SEQ ID NO: 435268 - RNA, 19 nt, Homo sapiens
aagaaagaccugcauaugg

SEQ ID NO: 435269 - RNA, 19 nt, Homo sapiens
ucagacauacuccauagau

SEQ ID NO: 435270 - RNA, 19 nt, Homo sapiens
uaauggcuauauucuugug

SEQ ID NO: 435271 - RNA, 19 nt, Homo sapiens
gaucacaguaaauggacaa

SEQ ID NO: 435272 - RNA, 19 nt, Homo sapiens
caaggcaagucuucaugcu

SEQ ID NO: 435273 - RNA, 19 nt, Homo sapiens
gaauaagaaagaccugcau

SEQ ID NO: 435274 - RNA, 19 nt, Homo sapiens
ugaguucacuuccauuuuc

SEQ ID NO: 435275 - RNA, 19 nt, Homo sapiens
aaucuuggaaugcagcuuu

SEQ ID NO: 435276 - RNA, 19 nt, Homo sapiens
uaaaguuauccauggcaaa

SEQ ID NO: 435277 - RNA, 19 nt, Homo sapiens
ccguucuccuugaagauaa

SEQ ID NO: 435278 - RNA, 19 nt, Homo sapiens
gaagaagggaaagcuuugg

SEQ ID NO: 435279 - RNA, 19 nt, Homo sapiens
auaagaaagaccugcauau

SEQ ID NO: 435280 - RNA, 19 nt, Homo sapiens
aaaguuauccauggcaaau

SEQ ID NO: 435281 - RNA, 19 nt, Homo sapiens
guccaaaugaguucacuuc

SEQ ID NO: 435282 - RNA, 19 nt, Homo sapiens
ccuugaagauaaacuaugc

SEQ ID NO: 435283 - RNA, 19 nt, Homo sapiens
guugaucacaguaaaugga

SEQ ID NO: 435284 - RNA, 19 nt, Homo sapiens
ggucaugacgcagcgaguu

SEQ ID NO: 435285 - RNA, 19 nt, Homo sapiens
ggcaaauuguuggauaugg

SEQ ID NO: 435286 - RNA, 19 nt, Homo sapiens
gagcuccccucccuucaga

SEQ ID NO: 435287 - RNA, 19 nt, Homo sapiens
ucacaaggcaagucuucau

SEQ ID NO: 435288 - RNA, 19 nt, Homo sapiens
gggcaagaugaauauucua

SEQ ID NO: 435289 - RNA, 19 nt, Homo sapiens
gucaugacgcagcgaguuu

SEQ ID NO: 435290 - RNA, 19 nt, Homo sapiens
uuucuucuguuaaccugaa

SEQ ID NO: 435291 - RNA, 19 nt, Homo sapiens
uggcuauauucuuguguau

SEQ ID NO: 435292 - RNA, 19 nt, Homo sapiens
ccugaggacacugggaaua

SEQ ID NO: 435293 - RNA, 19 nt, Homo sapiens
guggggaaauccucauuga

SEQ ID NO: 435294 - RNA, 19 nt, Homo sapiens
ccuacgauccaaccauaga

SEQ ID NO: 435295 - RNA, 19 nt, Homo sapiens
cuaucuuuccucagacaua

SEQ ID NO: 435296 - RNA, 19 nt, Homo sapiens
uaucuuuccucagacauac

SEQ ID NO: 435297 - RNA, 19 nt, Homo sapiens
gcaagaagcuguacagauu

SEQ ID NO: 435298 - RNA, 19 nt, Homo sapiens
gaauuaagcugccucagua

SEQ ID NO: 435299 - RNA, 19 nt, Homo sapiens
gaacauaucuauccucuca

SEQ ID NO: 435300 - RNA, 19 nt, Homo sapiens
cacaguaggugcuuaauaa

SEQ ID NO: 435301 - RNA, 19 nt, Homo sapiens
cacauaggcuccuuaauuu

SEQ ID NO: 435302 - RNA, 19 nt, Homo sapiens
gaagggacauccaccaaga

SEQ ID NO: 435303 - RNA, 19 nt, Homo sapiens
ucacauaggcuccuuaauu

SEQ ID NO: 435304 - RNA, 19 nt, Homo sapiens
gaagggagaacauaucuau

SEQ ID NO: 435305 - RNA, 19 nt, Homo sapiens
ggucaucgcuuuccugauc

SEQ ID NO: 435306 - RNA, 19 nt, Homo sapiens
cuacaacccugucaucuau

SEQ ID NO: 435307 - RNA, 19 nt, Homo sapiens
caacuucggucccaucuuc

SEQ ID NO: 435308 - RNA, 19 nt, Homo sapiens
ggaaaagugucccagcuua

SEQ ID NO: 435309 - RNA, 19 nt, Homo sapiens
acacgaggauucuugcuuu

SEQ ID NO: 435310 - RNA, 19 nt, Homo sapiens
gagcagcgccugugcagaa

SEQ ID NO: 435311 - RNA, 19 nt, Homo sapiens
ucgaagagcuuagaaacaa

SEQ ID NO: 435312 - RNA, 19 nt, Homo sapiens
cuaaugauauggagcaguu

SEQ ID NO: 435313 - RNA, 19 nt, Homo sapiens
ggacauccaccaagaccua

SEQ ID NO: 435314 - RNA, 19 nt, Homo sapiens
gcuccuauguugguauuaa

SEQ ID NO: 435315 - RNA, 19 nt, Homo sapiens
aaacaaagagugggaaauu

SEQ ID NO: 435316 - RNA, 19 nt, Homo sapiens
gcacagaaggcccuaacuu

SEQ ID NO: 435317 - RNA, 19 nt, Homo sapiens
gcacgccucucaacuacau

SEQ ID NO: 435318 - RNA, 19 nt, Homo sapiens
ccacaucucugagguguca

SEQ ID NO: 435319 - RNA, 19 nt, Homo sapiens
ucacuuucuucuccuauaa

SEQ ID NO: 435320 - RNA, 19 nt, Homo sapiens
gaaugaacgaagucacaua

SEQ ID NO: 435321 - RNA, 19 nt, Homo sapiens
gagcauggagccucuagaa

SEQ ID NO: 435322 - RNA, 19 nt, Homo sapiens
acaccucucugcauggaua

SEQ ID NO: 435323 - RNA, 19 nt, Homo sapiens
gcuaguccauucuccauuc

SEQ ID NO: 435324 - RNA, 19 nt, Homo sapiens
guacagauucuaguuaaug

SEQ ID NO: 435325 - RNA, 19 nt, Homo sapiens
gguacguggugguguguaa

SEQ ID NO: 435326 - RNA, 19 nt, Homo sapiens
cgaagagcuuagaaacaaa

SEQ ID NO: 435327 - RNA, 19 nt, Homo sapiens
auacuuggcuaaugauaug

SEQ ID NO: 435328 - RNA, 19 nt, Homo sapiens
uauuaacggugguggguuu

SEQ ID NO: 435329 - RNA, 19 nt, Homo sapiens
aguaggugcuuaauaaaug

SEQ ID NO: 435330 - RNA, 19 nt, Homo sapiens
gcuguacagauucuaguua

SEQ ID NO: 435331 - RNA, 19 nt, Homo sapiens
gaagccaccugcucuuuug

SEQ ID NO: 435332 - RNA, 19 nt, Homo sapiens
ggaaggaauggaggaauga

SEQ ID NO: 435333 - RNA, 19 nt, Homo sapiens
cagcgccugugcagaauga

SEQ ID NO: 435334 - RNA, 19 nt, Homo sapiens
caauuuggagggcuucuuu

SEQ ID NO: 435335 - RNA, 19 nt, Homo sapiens
gcauggauacuucgucuuc

SEQ ID NO: 435336 - RNA, 19 nt, Homo sapiens
ccacacagaaggcagagaa

SEQ ID NO: 435337 - RNA, 19 nt, Homo sapiens
gcgcacgccucucaacuac

SEQ ID NO: 435338 - RNA, 19 nt, Homo sapiens
cuguacagauucuaguuaa

SEQ ID NO: 435339 - RNA, 19 nt, Homo sapiens
uaaauagcaagaagcugua

SEQ ID NO: 435340 - RNA, 19 nt, Homo sapiens
cagcagcaacucauacuug

SEQ ID NO: 435341 - RNA, 19 nt, Homo sapiens
gcagggacagucacaggaa

SEQ ID NO: 435342 - RNA, 19 nt, Homo sapiens
gagauugggcauucagaug

SEQ ID NO: 435343 - RNA, 19 nt, Homo sapiens
acacaguaggugcuuaaua

SEQ ID NO: 435344 - RNA, 19 nt, Homo sapiens
caacgagucuuuugucauc

SEQ ID NO: 435345 - RNA, 19 nt, Homo sapiens
ggacggugaaggccaaguu

SEQ ID NO: 435346 - RNA, 19 nt, Homo sapiens
acacgcagcuacugagaag

SEQ ID NO: 435347 - RNA, 19 nt, Homo sapiens
gcagcagcagcaacucaua

SEQ ID NO: 435348 - RNA, 19 nt, Homo sapiens
acauaucuauccucucaga

SEQ ID NO: 435349 - RNA, 19 nt, Homo sapiens
auaagugucuagcacagaa

SEQ ID NO: 435350 - RNA, 19 nt, Homo sapiens
gagaagggacauccaccaa

SEQ ID NO: 435351 - RNA, 19 nt, Homo sapiens
gaagucacauaggcuccuu

SEQ ID NO: 435352 - RNA, 19 nt, Homo sapiens
cguguggaaucgacuacua

SEQ ID NO: 435353 - RNA, 19 nt, Homo sapiens
gaaacaaagagugggaaau

SEQ ID NO: 435354 - RNA, 19 nt, Homo sapiens
ggaagggagaacauaucua

SEQ ID NO: 435355 - RNA, 19 nt, Homo sapiens
ucaacuacauccugcucaa

SEQ ID NO: 435356 - RNA, 19 nt, Homo sapiens
cagcuccuauguugguauu

SEQ ID NO: 435357 - RNA, 19 nt, Homo sapiens
gcaaauugggccauuaaaa

SEQ ID NO: 435358 - RNA, 19 nt, Homo sapiens
uaaggcaaauugggccauu

SEQ ID NO: 435359 - RNA, 19 nt, Homo sapiens
gagcuuagaaacaaagagu

SEQ ID NO: 435360 - RNA, 19 nt, Homo sapiens
gaagagcuuagaaacaaag

SEQ ID NO: 435361 - RNA, 19 nt, Homo sapiens
acaacccugucaucuauau

SEQ ID NO: 435362 - RNA, 19 nt, Homo sapiens
gaccaucccagcguucuuu

SEQ ID NO: 435363 - RNA, 19 nt, Homo sapiens
cugcagugcucguguggaa

SEQ ID NO: 435364 - RNA, 19 nt, Homo sapiens
gagccaagcagcacagagu

SEQ ID NO: 435365 - RNA, 19 nt, Homo sapiens
ccucccaacucaucuuuca

SEQ ID NO: 435366 - RNA, 19 nt, Homo sapiens
ccaccaagaccuacugauc

SEQ ID NO: 435367 - RNA, 19 nt, Homo sapiens
ucaacuuccucacgcucua

SEQ ID NO: 435368 - RNA, 19 nt, Homo sapiens
gauugggcauucagaugau

SEQ ID NO: 435369 - RNA, 19 nt, Homo sapiens
gauucuaguuaauguugug

SEQ ID NO: 435370 - RNA, 19 nt, Homo sapiens
cagauucuaguuaauguug

SEQ ID NO: 435371 - RNA, 19 nt, Homo sapiens
gcaacucauacuuggcuaa

SEQ ID NO: 435372 - RNA, 19 nt, Homo sapiens
guaagcccaugagcaacuu

SEQ ID NO: 435373 - RNA, 19 nt, Homo sapiens
gcccacaggaugcaauuug

SEQ ID NO: 435374 - RNA, 19 nt, Homo sapiens
aagcccaucuucagcaguu

SEQ ID NO: 435375 - RNA, 19 nt, Homo sapiens
gcagugcucguguggaauc

SEQ ID NO: 435376 - RNA, 19 nt, Homo sapiens
gcucagcuccuauguuggu

SEQ ID NO: 435377 - RNA, 19 nt, Homo sapiens
gaaggaauggaggaaugaa

SEQ ID NO: 435378 - RNA, 19 nt, Homo sapiens
aggaaggaauggaggaaug

SEQ ID NO: 435379 - RNA, 19 nt, Homo sapiens
cgaggauucuugcuuucug

SEQ ID NO: 435380 - RNA, 19 nt, Homo sapiens
gaagcuguacagauucuag

SEQ ID NO: 435381 - RNA, 19 nt, Homo sapiens
uggcugaccucuucauggu

SEQ ID NO: 435382 - RNA, 19 nt, Homo sapiens
cauauaagcaaagccagaa

SEQ ID NO: 435383 - RNA, 19 nt, Homo sapiens
caagaagcuguacagauuc

SEQ ID NO: 435384 - RNA, 19 nt, Homo sapiens
ggaauggaggaaugaaugg

SEQ ID NO: 435385 - RNA, 19 nt, Homo sapiens
cuacaccucucugcaugga

SEQ ID NO: 435386 - RNA, 19 nt, Homo sapiens
cagaaugaacgaagucaca

SEQ ID NO: 435387 - RNA, 19 nt, Homo sapiens
aaggcaaauugggccauua

SEQ ID NO: 435388 - RNA, 19 nt, Homo sapiens
aacaaagagugggaaauuc

SEQ ID NO: 435389 - RNA, 19 nt, Homo sapiens
uacgugcccuucuccaaug

SEQ ID NO: 435390 - RNA, 19 nt, Homo sapiens
aaaauuagcuaggcaucaa

SEQ ID NO: 435391 - RNA, 19 nt, Homo sapiens
guaggugcuuaauaaaugc

SEQ ID NO: 435392 - RNA, 19 nt, Homo sapiens
ucuacaacccugucaucua

SEQ ID NO: 435393 - RNA, 19 nt, Homo sapiens
caguuucccuugccagaca

SEQ ID NO: 435394 - RNA, 19 nt, Homo sapiens
agauugggcauucagauga

SEQ ID NO: 435395 - RNA, 19 nt, Homo sapiens
uguguaagcccaugagcaa

SEQ ID NO: 435396 - RNA, 19 nt, Homo sapiens
gcugagccauggcaguucu

SEQ ID NO: 435397 - RNA, 19 nt, Homo sapiens
gcaagaagcugaacaagaa

SEQ ID NO: 435398 - RNA, 19 nt, Homo sapiens
ggaaagacaucgaggacua

SEQ ID NO: 435399 - RNA, 19 nt, Homo sapiens
gaaguacccugauaaguuc

SEQ ID NO: 435400 - RNA, 19 nt, Homo sapiens
gagagaagguggagaacaa

SEQ ID NO: 435401 - RNA, 19 nt, Homo sapiens
ggaugugucugguuuccua

SEQ ID NO: 435402 - RNA, 19 nt, Homo sapiens
ucucagagcccgugaagua

SEQ ID NO: 435403 - RNA, 19 nt, Homo sapiens
ugaaguacccugauaaguu

SEQ ID NO: 435404 - RNA, 19 nt, Homo sapiens
ucagggaugugucugguuu

SEQ ID NO: 435405 - RNA, 19 nt, Homo sapiens
gaucgagacgggcaucuuu

SEQ ID NO: 435406 - RNA, 19 nt, Homo sapiens
ggauaguggcgaaguuuaa

SEQ ID NO: 435407 - RNA, 19 nt, Homo sapiens
acaagaagcggcugaagaa

SEQ ID NO: 435408 - RNA, 19 nt, Homo sapiens
ggauggauuucgggucuuu

SEQ ID NO: 435409 - RNA, 19 nt, Homo sapiens
ggccaacucugccuucauc

SEQ ID NO: 435410 - RNA, 19 nt, Homo sapiens
gcaauguccggaucucuga

SEQ ID NO: 435411 - RNA, 19 nt, Homo sapiens
gugcuaugguggagaagaa

SEQ ID NO: 435412 - RNA, 19 nt, Homo sapiens
gaagcuccgggauggauuu

SEQ ID NO: 435413 - RNA, 19 nt, Homo sapiens
gggauaguggcgaaguuua

SEQ ID NO: 435414 - RNA, 19 nt, Homo sapiens
gaaagacaucgaggacuau

SEQ ID NO: 435415 - RNA, 19 nt, Homo sapiens
ggccugcucugucugugaa

SEQ ID NO: 435416 - RNA, 19 nt, Homo sapiens
agaaguaccuggccaagcu

SEQ ID NO: 435417 - RNA, 19 nt, Homo sapiens
aaacagacacagaauucuu

SEQ ID NO: 435418 - RNA, 19 nt, Homo sapiens
agaagcggcugaagaagag

SEQ ID NO: 435419 - RNA, 19 nt, Homo sapiens
ccaaaacugucuacgcaaa

SEQ ID NO: 435420 - RNA, 19 nt, Homo sapiens
gagaugagaccugcgacaa

SEQ ID NO: 435421 - RNA, 19 nt, Homo sapiens
gacaucagguaccacaucu

SEQ ID NO: 435422 - RNA, 19 nt, Homo sapiens
gaagcucuuucagcaguuc

SEQ ID NO: 435423 - RNA, 19 nt, Homo sapiens
ucagguaccacaucuacaa

SEQ ID NO: 435424 - RNA, 19 nt, Homo sapiens
caucgugucucuggccuau

SEQ ID NO: 435425 - RNA, 19 nt, Homo sapiens
aaccaaagccgaccucugu

SEQ ID NO: 435426 - RNA, 19 nt, Homo sapiens
gcagguucaucgugucucu

SEQ ID NO: 435427 - RNA, 19 nt, Homo sapiens
gagcugaagcaccggauca

SEQ ID NO: 435428 - RNA, 19 nt, Homo sapiens
caaaacagacacagaauuc

SEQ ID NO: 435429 - RNA, 19 nt, Homo sapiens
cccgugaaguacccugaua

SEQ ID NO: 435430 - RNA, 19 nt, Homo sapiens
ccacaucuacaacgugaau

SEQ ID NO: 435431 - RNA, 19 nt, Homo sapiens
caacgugaaugaggagaac

SEQ ID NO: 435432 - RNA, 19 nt, Homo sapiens
gaagauucugaugaaagua

SEQ ID NO: 435433 - RNA, 19 nt, Homo sapiens
gaacaagaagcggcugaag

SEQ ID NO: 435434 - RNA, 19 nt, Homo sapiens
gcuggacaaugacggcaau

SEQ ID NO: 435435 - RNA, 19 nt, Homo sapiens
agaacgugcugcuggacaa

SEQ ID NO: 435436 - RNA, 19 nt, Homo sapiens
aagaagcggcugaagaaga

SEQ ID NO: 435437 - RNA, 19 nt, Homo sapiens
guggagagaagguggagaa

SEQ ID NO: 435438 - RNA, 19 nt, Homo sapiens
gaggugacaucagguacca

SEQ ID NO: 435439 - RNA, 19 nt, Homo sapiens
uuucagcaguuccuacaau

SEQ ID NO: 435440 - RNA, 19 nt, Homo sapiens
gagcagcccaucggcaaga

SEQ ID NO: 435441 - RNA, 19 nt, Homo sapiens
ggagagaagguggagaaca

SEQ ID NO: 435442 - RNA, 19 nt, Homo sapiens
gccuggaguuugagagugu

SEQ ID NO: 435443 - RNA, 19 nt, Homo sapiens
aacagacacagaauucuuu

SEQ ID NO: 435444 - RNA, 19 nt, Homo sapiens
ggagaaggacccggagaag

SEQ ID NO: 435445 - RNA, 19 nt, Homo sapiens
ucagaugccggacgacaug

SEQ ID NO: 435446 - RNA, 19 nt, Homo sapiens
ugacaaaacagacacagaa

SEQ ID NO: 435447 - RNA, 19 nt, Homo sapiens
gccucagccuggaguuuga

SEQ ID NO: 435448 - RNA, 19 nt, Homo sapiens
ggaagcuccgggauggauu

SEQ ID NO: 435449 - RNA, 19 nt, Homo sapiens
cuggagcucuggaaagaca

SEQ ID NO: 435450 - RNA, 19 nt, Homo sapiens
cccuggagcucuggaaaga

SEQ ID NO: 435451 - RNA, 19 nt, Homo sapiens
gggcgaggaguacgacuuc

SEQ ID NO: 435452 - RNA, 19 nt, Homo sapiens
gguaccacaucuacaacgu

SEQ ID NO: 435453 - RNA, 19 nt, Homo sapiens
cgaccucugucuggugaug

SEQ ID NO: 435454 - RNA, 19 nt, Homo sapiens
agucaggccugcucugucu

SEQ ID NO: 435455 - RNA, 19 nt, Homo sapiens
cacagaauucuuucaggaa

SEQ ID NO: 435456 - RNA, 19 nt, Homo sapiens
caucagguaccacaucuac

SEQ ID NO: 435457 - RNA, 19 nt, Homo sapiens
ugcaagaagcugaacaaga

SEQ ID NO: 435458 - RNA, 19 nt, Homo sapiens
gugucggccugccagauga

SEQ ID NO: 435459 - RNA, 19 nt, Homo sapiens
ugacaucagguaccacauc

SEQ ID NO: 435460 - RNA, 19 nt, Homo sapiens
aacaagaagcggcugaaga

SEQ ID NO: 435461 - RNA, 19 nt, Homo sapiens
ggacugguuccuggacuuc

SEQ ID NO: 435462 - RNA, 19 nt, Homo sapiens
gccuguacuuccugagguu

SEQ ID NO: 435463 - RNA, 19 nt, Homo sapiens
gaacgugcugcuggacaau

SEQ ID NO: 435464 - RNA, 19 nt, Homo sapiens
gauaguggcgaaguuuaag

SEQ ID NO: 435465 - RNA, 19 nt, Homo sapiens
cacccuguaugagaugauu

SEQ ID NO: 435466 - RNA, 19 nt, Homo sapiens
aaaguacacagcagguuca

SEQ ID NO: 435467 - RNA, 19 nt, Homo sapiens
gcuguaugccugcaagaag

SEQ ID NO: 435468 - RNA, 19 nt, Homo sapiens
gaagcaccggaucaucuca

SEQ ID NO: 435469 - RNA, 19 nt, Homo sapiens
gaaggacgauguuauuaaa

SEQ ID NO: 435470 - RNA, 19 nt, Homo sapiens
cagcaauccuucagaauua

SEQ ID NO: 435471 - RNA, 19 nt, Homo sapiens
aaaggucucuugcuaaaua

SEQ ID NO: 435472 - RNA, 19 nt, Homo sapiens
ugagaaauguugccuaauu

SEQ ID NO: 435473 - RNA, 19 nt, Homo sapiens
gugcacaucuugucuaauu

SEQ ID NO: 435474 - RNA, 19 nt, Homo sapiens
caacaaagauacagaaacu

SEQ ID NO: 435475 - RNA, 19 nt, Homo sapiens
gagaaauguugccuaauug

SEQ ID NO: 435476 - RNA, 19 nt, Homo sapiens
ggaaggacgauguuauuaa

SEQ ID NO: 435477 - RNA, 19 nt, Homo sapiens
uaccagagcuacagcagua

SEQ ID NO: 435478 - RNA, 19 nt, Homo sapiens
ggaagaugcuccucagaca

SEQ ID NO: 435479 - RNA, 19 nt, Homo sapiens
guauguaccugcauuaaag

SEQ ID NO: 435480 - RNA, 19 nt, Homo sapiens
ugucaggucccacuaauua

SEQ ID NO: 435481 - RNA, 19 nt, Homo sapiens
gcgcgcagauugccauuug

SEQ ID NO: 435482 - RNA, 19 nt, Homo sapiens
caaaaggucucuugcuaaa

SEQ ID NO: 435483 - RNA, 19 nt, Homo sapiens
gaaauuguaccauccuuca

SEQ ID NO: 435484 - RNA, 19 nt, Homo sapiens
guaccugcauuaaaggauu

SEQ ID NO: 435485 - RNA, 19 nt, Homo sapiens
gaauucuguuuacuacuga

SEQ ID NO: 435486 - RNA, 19 nt, Homo sapiens
agacagcaauccuucagaa

SEQ ID NO: 435487 - RNA, 19 nt, Homo sapiens
gcuagaauucuguuuacua

SEQ ID NO: 435488 - RNA, 19 nt, Homo sapiens
guaaaugacacuuucuaug

SEQ ID NO: 435489 - RNA, 19 nt, Homo sapiens
uuucuaugcugaagucuuu

SEQ ID NO: 435490 - RNA, 19 nt, Homo sapiens
ugagaggcaaccaucauua

SEQ ID NO: 435491 - RNA, 19 nt, Homo sapiens
uaaaugacacuuucuaugc

SEQ ID NO: 435492 - RNA, 19 nt, Homo sapiens
uuugagaaauguugccuaa

SEQ ID NO: 435493 - RNA, 19 nt, Homo sapiens
gcuaaauauugcugagaug

SEQ ID NO: 435494 - RNA, 19 nt, Homo sapiens
agaauucuguuuacuacug

SEQ ID NO: 435495 - RNA, 19 nt, Homo sapiens
ucacacauagucuugauga

SEQ ID NO: 435496 - RNA, 19 nt, Homo sapiens
gaagcuaauugugcacauc

SEQ ID NO: 435497 - RNA, 19 nt, Homo sapiens
guaccauccuucaucaaca

SEQ ID NO: 435498 - RNA, 19 nt, Homo sapiens
cuagaauucuguuuacuac

SEQ ID NO: 435499 - RNA, 19 nt, Homo sapiens
ccaaauggaaggacgaugu

SEQ ID NO: 435500 - RNA, 19 nt, Homo sapiens
gcugagaugaagcuaauug

SEQ ID NO: 435501 - RNA, 19 nt, Homo sapiens
acagcaauccuucagaauu

SEQ ID NO: 435502 - RNA, 19 nt, Homo sapiens
caaauggaaggacgauguu

SEQ ID NO: 435503 - RNA, 19 nt, Homo sapiens
gacccuacguggcacuguu

SEQ ID NO: 435504 - RNA, 19 nt, Homo sapiens
gcaauccuucagaauuaaa

SEQ ID NO: 435505 - RNA, 19 nt, Homo sapiens
gaaauguugccuaauuggu

SEQ ID NO: 435506 - RNA, 19 nt, Homo sapiens
cauccuucaucaacaaaga

SEQ ID NO: 435507 - RNA, 19 nt, Homo sapiens
cacauagucuugaugacau

SEQ ID NO: 435508 - RNA, 19 nt, Homo sapiens
caucaacaaagauacagaa

SEQ ID NO: 435509 - RNA, 19 nt, Homo sapiens
guuuacuacugaaccaauu

SEQ ID NO: 435510 - RNA, 19 nt, Homo sapiens
ucaggucccacuaauuauu

SEQ ID NO: 435511 - RNA, 19 nt, Homo sapiens
ugaaggcagcccuaucuga

SEQ ID NO: 435512 - RNA, 19 nt, Homo sapiens
uggaaggacgauguuauua

SEQ ID NO: 435513 - RNA, 19 nt, Homo sapiens
gcacaucuugucuaauuuu

SEQ ID NO: 435514 - RNA, 19 nt, Homo sapiens
uugcugagaugaagcuaau

SEQ ID NO: 435515 - RNA, 19 nt, Homo sapiens
aaauauugcugagaugaag

SEQ ID NO: 435516 - RNA, 19 nt, Homo sapiens
ccugcuagaauucuguuua

SEQ ID NO: 435517 - RNA, 19 nt, Homo sapiens
uaccauccuucaucaacaa

SEQ ID NO: 435518 - RNA, 19 nt, Homo sapiens
gcuaauugugcacaucuug

SEQ ID NO: 435519 - RNA, 19 nt, Homo sapiens
ggucucuugcuaaauauug

SEQ ID NO: 435520 - RNA, 19 nt, Homo sapiens
aaauguugccuaauugguu

SEQ ID NO: 435521 - RNA, 19 nt, Homo sapiens
gagaggcaaccaucauuac

SEQ ID NO: 435522 - RNA, 19 nt, Homo sapiens
uguuggaauucauugcuaa

SEQ ID NO: 435523 - RNA, 19 nt, Homo sapiens
cagaaauuguaccauccuu

SEQ ID NO: 435524 - RNA, 19 nt, Homo sapiens
cuagaccaguggcagaaau

SEQ ID NO: 435525 - RNA, 19 nt, Homo sapiens
cuaaauauugcugagauga

SEQ ID NO: 435526 - RNA, 19 nt, Homo sapiens
ugaugacauuucacugaug

SEQ ID NO: 435527 - RNA, 19 nt, Homo sapiens
gcuuggauacucauucuca

SEQ ID NO: 435528 - RNA, 19 nt, Homo sapiens
aaaugacacuuucuaugcu

SEQ ID NO: 435529 - RNA, 19 nt, Homo sapiens
acauagucuugaugacauu

SEQ ID NO: 435530 - RNA, 19 nt, Homo sapiens
auuccaaucuuagcuuuga

SEQ ID NO: 435531 - RNA, 19 nt, Homo sapiens
guaugauuguaguuucugu

SEQ ID NO: 435532 - RNA, 19 nt, Homo sapiens
acacauagucuugaugaca

SEQ ID NO: 435533 - RNA, 19 nt, Homo sapiens
ccaaaaggucucuugcuaa

SEQ ID NO: 435534 - RNA, 19 nt, Homo sapiens
uggcacuguuugagaaaug

SEQ ID NO: 435535 - RNA, 19 nt, Homo sapiens
gcagacagcaauccuucag

SEQ ID NO: 435536 - RNA, 19 nt, Homo sapiens
cuugaugacauuucacuga

SEQ ID NO: 435537 - RNA, 19 nt, Homo sapiens
auaaaaccuuugccacuuu

SEQ ID NO: 435538 - RNA, 19 nt, Homo sapiens
acauuucacugaugcuucu

SEQ ID NO: 435539 - RNA, 19 nt, Homo sapiens
uguuccaccugcuagaauu

SEQ ID NO: 435540 - RNA, 19 nt, Homo sapiens
gaccaguggcagaaauugu

SEQ ID NO: 435541 - RNA, 19 nt, Homo sapiens
caugagcaccuggagcaaa

SEQ ID NO: 435542 - RNA, 19 nt, Homo sapiens
uugaugacauuucacugau

SEQ ID NO: 435543 - RNA, 19 nt, Homo sapiens
uugugcacaucuugucuaa

SEQ ID NO: 435544 - RNA, 19 nt, Homo sapiens
cugcuagaauucuguuuac

SEQ ID NO: 435545 - RNA, 19 nt, Homo sapiens
agcaauccuucagaauuaa

SEQ ID NO: 435546 - RNA, 19 nt, Homo sapiens
gacagcaauccuucagaau

SEQ ID NO: 435547 - RNA, 19 nt, Homo sapiens
caguauguaccugcauuaa

SEQ ID NO: 435548 - RNA, 19 nt, Homo sapiens
aaauggaaggacgauguua

SEQ ID NO: 435549 - RNA, 19 nt, Homo sapiens
ucugucaggucccacuaau

SEQ ID NO: 435550 - RNA, 19 nt, Homo sapiens
ugagaugaagcuaauugug

SEQ ID NO: 435551 - RNA, 19 nt, Homo sapiens
gaggcaaccaucauuacca

SEQ ID NO: 435552 - RNA, 19 nt, Homo sapiens
aauaaaaccuuugccacuu

SEQ ID NO: 435553 - RNA, 19 nt, Homo sapiens
ucauuugguguguaagaaa

SEQ ID NO: 435554 - RNA, 19 nt, Homo sapiens
ugcuaaauauugcugagau

SEQ ID NO: 435555 - RNA, 19 nt, Homo sapiens
aguauguaccugcauuaaa

SEQ ID NO: 435556 - RNA, 19 nt, Homo sapiens
accaguggcagaaauugua

SEQ ID NO: 435557 - RNA, 19 nt, Homo sapiens
gcauucugcuucaauauua

SEQ ID NO: 435558 - RNA, 19 nt, Homo sapiens
gacaugauaucuuugcuuu

SEQ ID NO: 435559 - RNA, 19 nt, Homo sapiens
gcaaugacaaugcaguuua

SEQ ID NO: 435560 - RNA, 19 nt, Homo sapiens
ucaggaggcugccaaguuu

SEQ ID NO: 435561 - RNA, 19 nt, Homo sapiens
guucuuaccucguacuaaa

SEQ ID NO: 435562 - RNA, 19 nt, Homo sapiens
aaauugaucuggaacaguu

SEQ ID NO: 435563 - RNA, 19 nt, Homo sapiens
uggauaugcuguuuaguuu

SEQ ID NO: 435564 - RNA, 19 nt, Homo sapiens
gaaaagaaacugaagagaa

SEQ ID NO: 435565 - RNA, 19 nt, Homo sapiens
caaugacaaugcaguuuau

SEQ ID NO: 435566 - RNA, 19 nt, Homo sapiens
gcauaucuguaccucuuga

SEQ ID NO: 435567 - RNA, 19 nt, Homo sapiens
caaugcaguuuauuaguca

SEQ ID NO: 435568 - RNA, 19 nt, Homo sapiens
uaucaugacccuacuauag

SEQ ID NO: 435569 - RNA, 19 nt, Homo sapiens
gucucucucucuuuaaaua

SEQ ID NO: 435570 - RNA, 19 nt, Homo sapiens
ugagggaaauucgcaagaa

SEQ ID NO: 435571 - RNA, 19 nt, Homo sapiens
ucaaucagcuggauaugcu

SEQ ID NO: 435572 - RNA, 19 nt, Homo sapiens
acaaugagccagcuuacuu

SEQ ID NO: 435573 - RNA, 19 nt, Homo sapiens
cugcauaucuguaccucuu

SEQ ID NO: 435574 - RNA, 19 nt, Homo sapiens
ucaugacccuacuauagaa

SEQ ID NO: 435575 - RNA, 19 nt, Homo sapiens
acaaugcaguuuauuaguc

SEQ ID NO: 435576 - RNA, 19 nt, Homo sapiens
ugaugguucuuaccucgua

SEQ ID NO: 435577 - RNA, 19 nt, Homo sapiens
aaagcaagcucugcauauc

SEQ ID NO: 435578 - RNA, 19 nt, Homo sapiens
gagggaaauucgcaagaag

SEQ ID NO: 435579 - RNA, 19 nt, Homo sapiens
cagcuuacuuggacaucuu

SEQ ID NO: 435580 - RNA, 19 nt, Homo sapiens
ugacaaugcaguuuauuag

SEQ ID NO: 435581 - RNA, 19 nt, Homo sapiens
gcccaagaauauaauugug

SEQ ID NO: 435582 - RNA, 19 nt, Homo sapiens
cggguaagauggagguaga

SEQ ID NO: 435583 - RNA, 19 nt, Homo sapiens
ugacacaguuuuagaguug

SEQ ID NO: 435584 - RNA, 19 nt, Homo sapiens
caugauaucuuugcuuuug

SEQ ID NO: 435585 - RNA, 19 nt, Homo sapiens
uuuaacaguuggauggauu

SEQ ID NO: 435586 - RNA, 19 nt, Homo sapiens
gugucucucucucuuuaaa

SEQ ID NO: 435587 - RNA, 19 nt, Homo sapiens
guacuaaaaccuuugcuuu

SEQ ID NO: 435588 - RNA, 19 nt, Homo sapiens
uagaguugcuuaauauucg

SEQ ID NO: 435589 - RNA, 19 nt, Homo sapiens
caaugagccagcuuacuug

SEQ ID NO: 435590 - RNA, 19 nt, Homo sapiens
gcccgacgcugaugguucu

SEQ ID NO: 435591 - RNA, 19 nt, Homo sapiens
gagaguacaaggugguaau

SEQ ID NO: 435592 - RNA, 19 nt, Homo sapiens
gagagaaaauaugacauga

SEQ ID NO: 435593 - RNA, 19 nt, Homo sapiens
gggaaauucgcaagaagga

SEQ ID NO: 435594 - RNA, 19 nt, Homo sapiens
gcuucaauauuaucucucu

SEQ ID NO: 435595 - RNA, 19 nt, Homo sapiens
ccgccacaccuaugaaauu

SEQ ID NO: 435596 - RNA, 19 nt, Homo sapiens
ugacacgggugacuuucuc

SEQ ID NO: 435597 - RNA, 19 nt, Homo sapiens
gaagagagaaaauaugaca

SEQ ID NO: 435598 - RNA, 19 nt, Homo sapiens
gguaaaagcgcaaugacaa

SEQ ID NO: 435599 - RNA, 19 nt, Homo sapiens
cuggauaugcuguuuaguu

SEQ ID NO: 435600 - RNA, 19 nt, Homo sapiens
augugucucucucucuuua

SEQ ID NO: 435601 - RNA, 19 nt, Homo sapiens
uagaagaugcuuauaagac

SEQ ID NO: 435602 - RNA, 19 nt, Homo sapiens
gacaaugcaguuuauuagu

SEQ ID NO: 435603 - RNA, 19 nt, Homo sapiens
gguaagauggagguagaaa

SEQ ID NO: 435604 - RNA, 19 nt, Homo sapiens
gaagaagagagaaaauaug

SEQ ID NO: 435605 - RNA, 19 nt, Homo sapiens
gcugguggguaacaaaauu

SEQ ID NO: 435606 - RNA, 19 nt, Homo sapiens
cgccacaccuaugaaauuc

SEQ ID NO: 435607 - RNA, 19 nt, Homo sapiens
guuuauuagucaucaguuc

SEQ ID NO: 435608 - RNA, 19 nt, Homo sapiens
gcgcaaugacaaugcaguu

SEQ ID NO: 435609 - RNA, 19 nt, Homo sapiens
acauuccaauugccucaaa

SEQ ID NO: 435610 - RNA, 19 nt, Homo sapiens
gacaauuccauauguagca

SEQ ID NO: 435611 - RNA, 19 nt, Homo sapiens
cuaugugucucucucucuu

SEQ ID NO: 435612 - RNA, 19 nt, Homo sapiens
ccucacgcucucugaauuu

SEQ ID NO: 435613 - RNA, 19 nt, Homo sapiens
aauaucugccuguagguaa

SEQ ID NO: 435614 - RNA, 19 nt, Homo sapiens
cuuuaaauaucugccugua

SEQ ID NO: 435615 - RNA, 19 nt, Homo sapiens
uaucuuugcuuuugaguuc

SEQ ID NO: 435616 - RNA, 19 nt, Homo sapiens
acuaaaaccuuugcuuuga

SEQ ID NO: 435617 - RNA, 19 nt, Homo sapiens
uaaaagcaagcucugcaua

SEQ ID NO: 435618 - RNA, 19 nt, Homo sapiens
aaauaucugccuguaggua

SEQ ID NO: 435619 - RNA, 19 nt, Homo sapiens
cagaagaaggcuugagucu

SEQ ID NO: 435620 - RNA, 19 nt, Homo sapiens
caagcucugcauaucugua

SEQ ID NO: 435621 - RNA, 19 nt, Homo sapiens
ggaggcugccaaguuuaaa

SEQ ID NO: 435622 - RNA, 19 nt, Homo sapiens
caggaggcugccaaguuua

SEQ ID NO: 435623 - RNA, 19 nt, Homo sapiens
agauggagguagaaaauga

SEQ ID NO: 435624 - RNA, 19 nt, Homo sapiens
guaccucuugagauaguuu

SEQ ID NO: 435625 - RNA, 19 nt, Homo sapiens
gaagaagaagagagaaaau

SEQ ID NO: 435626 - RNA, 19 nt, Homo sapiens
cgacgcugaugguucuuac

SEQ ID NO: 435627 - RNA, 19 nt, Homo sapiens
ugacaugauaucuuugcuu

SEQ ID NO: 435628 - RNA, 19 nt, Homo sapiens
cuacuauagaagaugcuua

SEQ ID NO: 435629 - RNA, 19 nt, Homo sapiens
auaucugccuguagguaaa

SEQ ID NO: 435630 - RNA, 19 nt, Homo sapiens
ucaggcggguccagagagu

SEQ ID NO: 435631 - RNA, 19 nt, Homo sapiens
gauuaucaugacccuacua

SEQ ID NO: 435632 - RNA, 19 nt, Homo sapiens
aaagcgcaaugacaaugca

SEQ ID NO: 435633 - RNA, 19 nt, Homo sapiens
agcaagcucugcauaucug

SEQ ID NO: 435634 - RNA, 19 nt, Homo sapiens
uaagauggagguagaaaau

SEQ ID NO: 435635 - RNA, 19 nt, Homo sapiens
ugacccuacuauagaagau

SEQ ID NO: 435636 - RNA, 19 nt, Homo sapiens
gaaagaagcugguguccaa

SEQ ID NO: 435637 - RNA, 19 nt, Homo sapiens
gcauugagcuccagcauug

SEQ ID NO: 435638 - RNA, 19 nt, Homo sapiens
gaacucaugugcccuaucu

SEQ ID NO: 435639 - RNA, 19 nt, Homo sapiens
gaucagaccacaacgauga

SEQ ID NO: 435640 - RNA, 19 nt, Homo sapiens
gagaagaugugagcucaga

SEQ ID NO: 435641 - RNA, 19 nt, Homo sapiens
caccaaggauccaaaguga

SEQ ID NO: 435642 - RNA, 19 nt, Homo sapiens
gaagaacccucccauucac

SEQ ID NO: 435643 - RNA, 19 nt, Homo sapiens
aauaagaggacacaaauga

SEQ ID NO: 435644 - RNA, 19 nt, Homo sapiens
caacuuugaugcccugauc

SEQ ID NO: 435645 - RNA, 19 nt, Homo sapiens
uauacgagguguuggagaa

SEQ ID NO: 435646 - RNA, 19 nt, Homo sapiens
ccaauaagaggacacaaau

SEQ ID NO: 435647 - RNA, 19 nt, Homo sapiens
caucaagaccgagugcuua

SEQ ID NO: 435648 - RNA, 19 nt, Homo sapiens
gugaagaacccucccauuc

SEQ ID NO: 435649 - RNA, 19 nt, Homo sapiens
agaauacgaugaccaccaa

SEQ ID NO: 435650 - RNA, 19 nt, Homo sapiens
cccuggagcuggugaauga

SEQ ID NO: 435651 - RNA, 19 nt, Homo sapiens
uugaugcccugaucucuaa

SEQ ID NO: 435652 - RNA, 19 nt, Homo sapiens
agagccagguggagaaauu

SEQ ID NO: 435653 - RNA, 19 nt, Homo sapiens
uguccuaccugccgaaaga

SEQ ID NO: 435654 - RNA, 19 nt, Homo sapiens
gccaauaagaggacacaaa

SEQ ID NO: 435655 - RNA, 19 nt, Homo sapiens
ccaccuuucuacucacuga

SEQ ID NO: 435656 - RNA, 19 nt, Homo sapiens
ggaauacgaggcccaucaa

SEQ ID NO: 435657 - RNA, 19 nt, Homo sapiens
caacgucccaucuauacga

SEQ ID NO: 435658 - RNA, 19 nt, Homo sapiens
cagcccagccagccaauaa

SEQ ID NO: 435659 - RNA, 19 nt, Homo sapiens
guacuuggcccugcgcauu

SEQ ID NO: 435660 - RNA, 19 nt, Homo sapiens
cgagguaugugaagacaac

SEQ ID NO: 435661 - RNA, 19 nt, Homo sapiens
gcuaugcucccaccaagga

SEQ ID NO: 435662 - RNA, 19 nt, Homo sapiens
acacguggcuuuuauacaa

SEQ ID NO: 435663 - RNA, 19 nt, Homo sapiens
gcacaaccagcaggcauug

SEQ ID NO: 435664 - RNA, 19 nt, Homo sapiens
gccuggacaugcugaagaa

SEQ ID NO: 435665 - RNA, 19 nt, Homo sapiens
gcaguacaccaucuacauc

SEQ ID NO: 435666 - RNA, 19 nt, Homo sapiens
gaaaagcaguacaccaucu

SEQ ID NO: 435667 - RNA, 19 nt, Homo sapiens
cacaccaccuuucuacuca

SEQ ID NO: 435668 - RNA, 19 nt, Homo sapiens
uaaaaccccuuucccucua

SEQ ID NO: 435669 - RNA, 19 nt, Homo sapiens
ccaccaaggauccaaagug

SEQ ID NO: 435670 - RNA, 19 nt, Homo sapiens
gaggacacguggcuuuuau

SEQ ID NO: 435671 - RNA, 19 nt, Homo sapiens
cagacgagguaugugaaga

SEQ ID NO: 435672 - RNA, 19 nt, Homo sapiens
gaagaugugagcucagacu

SEQ ID NO: 435673 - RNA, 19 nt, Homo sapiens
ggugaagaacccucccauu

SEQ ID NO: 435674 - RNA, 19 nt, Homo sapiens
ccuguguccuggucuauca

SEQ ID NO: 435675 - RNA, 19 nt, Homo sapiens
gaccaccucuccaaguacu

SEQ ID NO: 435676 - RNA, 19 nt, Homo sapiens
ccugcaacgucccaucuau

SEQ ID NO: 435677 - RNA, 19 nt, Homo sapiens
caauaagaggacacaaaug

SEQ ID NO: 435678 - RNA, 19 nt, Homo sapiens
gacgagguaugugaagaca

SEQ ID NO: 435679 - RNA, 19 nt, Homo sapiens
ccacaccaccuuucuacuc

SEQ ID NO: 435680 - RNA, 19 nt, Homo sapiens
ucacugcauucagaacuca

SEQ ID NO: 435681 - RNA, 19 nt, Homo sapiens
auucugcucugacugcauu

SEQ ID NO: 435682 - RNA, 19 nt, Homo sapiens
uggacaugcugaagaauac

SEQ ID NO: 435683 - RNA, 19 nt, Homo sapiens
cuggacaugcugaagaaua

SEQ ID NO: 435684 - RNA, 19 nt, Homo sapiens
caacaacaaacgugcuuuu

SEQ ID NO: 435685 - RNA, 19 nt, Homo sapiens
cugcaacgucccaucuaua

SEQ ID NO: 435686 - RNA, 19 nt, Homo sapiens
cagaucagaccacaacgau

SEQ ID NO: 435687 - RNA, 19 nt, Homo sapiens
gcccagccagccaauaaga

SEQ ID NO: 435688 - RNA, 19 nt, Homo sapiens
gagaaauugagcucguguu

SEQ ID NO: 435689 - RNA, 19 nt, Homo sapiens
ccacuggagcugugcuaug

SEQ ID NO: 435690 - RNA, 19 nt, Homo sapiens
agaaauugagcucguguuc

SEQ ID NO: 435691 - RNA, 19 nt, Homo sapiens
aauacgaggcccaucaaga

SEQ ID NO: 435692 - RNA, 19 nt, Homo sapiens
ggccagaccccaacuuuga

SEQ ID NO: 435693 - RNA, 19 nt, Homo sapiens
aaugaggacacguggcuuu

SEQ ID NO: 435694 - RNA, 19 nt, Homo sapiens
ggagcuggugaaugagaaa

SEQ ID NO: 435695 - RNA, 19 nt, Homo sapiens
cuggagggcgucagugaaa

SEQ ID NO: 435696 - RNA, 19 nt, Homo sapiens
ggcauugagcuccagcauu

SEQ ID NO: 435697 - RNA, 19 nt, Homo sapiens
gagccagguggagaaauug

SEQ ID NO: 435698 - RNA, 19 nt, Homo sapiens
gagaagaugugaaguguuu

SEQ ID NO: 435699 - RNA, 19 nt, Homo sapiens
gaagaaagauucaguaacu

SEQ ID NO: 435700 - RNA, 19 nt, Homo sapiens
gaacugcagugcuguauca

SEQ ID NO: 435701 - RNA, 19 nt, Homo sapiens
gcauaccgcuacuauauug

SEQ ID NO: 435702 - RNA, 19 nt, Homo sapiens
gaagaagaaagauucagua

SEQ ID NO: 435703 - RNA, 19 nt, Homo sapiens
ggagaaggguuuaucaucu

SEQ ID NO: 435704 - RNA, 19 nt, Homo sapiens
uaucaaagcaguccaguaa

SEQ ID NO: 435705 - RNA, 19 nt, Homo sapiens
gaagaugcuuauaagauca

SEQ ID NO: 435706 - RNA, 19 nt, Homo sapiens
ggagauacguaggaaagaa

SEQ ID NO: 435707 - RNA, 19 nt, Homo sapiens
uaagacaggucaccaagga

SEQ ID NO: 435708 - RNA, 19 nt, Homo sapiens
gaagagaagaugugaagug

SEQ ID NO: 435709 - RNA, 19 nt, Homo sapiens
gaaagauucaguaacuuga

SEQ ID NO: 435710 - RNA, 19 nt, Homo sapiens
gaauucagcugucccuuuu

SEQ ID NO: 435711 - RNA, 19 nt, Homo sapiens
gcuacuauauugaugaugu

SEQ ID NO: 435712 - RNA, 19 nt, Homo sapiens
ugaagaugcuuauaagauc

SEQ ID NO: 435713 - RNA, 19 nt, Homo sapiens
gagaaggguuuaucaucug

SEQ ID NO: 435714 - RNA, 19 nt, Homo sapiens
gaugugaaguguuuaucug

SEQ ID NO: 435715 - RNA, 19 nt, Homo sapiens
aaacaagucagaccucaaa

SEQ ID NO: 435716 - RNA, 19 nt, Homo sapiens
gugaaguguuuaucuguga

SEQ ID NO: 435717 - RNA, 19 nt, Homo sapiens
gaagaugugaaguguuuau

SEQ ID NO: 435718 - RNA, 19 nt, Homo sapiens
gacaauggauucuggaacu

SEQ ID NO: 435719 - RNA, 19 nt, Homo sapiens
ugagacaucugcugcauac

SEQ ID NO: 435720 - RNA, 19 nt, Homo sapiens
ccauugaagaugcuuauaa

SEQ ID NO: 435721 - RNA, 19 nt, Homo sapiens
ggaagaagaaagauucagu

SEQ ID NO: 435722 - RNA, 19 nt, Homo sapiens
gcugggugcugguggugua

SEQ ID NO: 435723 - RNA, 19 nt, Homo sapiens
gagauacguaggaaagaaa

SEQ ID NO: 435724 - RNA, 19 nt, Homo sapiens
aaggguuuaucaucuguua

SEQ ID NO: 435725 - RNA, 19 nt, Homo sapiens
cauugaagaugcuuauaag

SEQ ID NO: 435726 - RNA, 19 nt, Homo sapiens
ggauccguauugaugauga

SEQ ID NO: 435727 - RNA, 19 nt, Homo sapiens
guauggugcuugcucuuuc

SEQ ID NO: 435728 - RNA, 19 nt, Homo sapiens
ucacggaucgucgaaguuu

SEQ ID NO: 435729 - RNA, 19 nt, Homo sapiens
uaucaucuguuacucuauc

SEQ ID NO: 435730 - RNA, 19 nt, Homo sapiens
gugcuugcucuuucacuua

SEQ ID NO: 435731 - RNA, 19 nt, Homo sapiens
aagagaagaugugaagugu

SEQ ID NO: 435732 - RNA, 19 nt, Homo sapiens
cugcauaccgcuacuauau

SEQ ID NO: 435733 - RNA, 19 nt, Homo sapiens
gcaggagaaggguuuauca

SEQ ID NO: 435734 - RNA, 19 nt, Homo sapiens
gaaacaagucagaccucaa

SEQ ID NO: 435735 - RNA, 19 nt, Homo sapiens
agagggacaugccuacuag

SEQ ID NO: 435736 - RNA, 19 nt, Homo sapiens
agaaagauucaguaacuug

SEQ ID NO: 435737 - RNA, 19 nt, Homo sapiens
ucaguaacuugaagagaag

SEQ ID NO: 435738 - RNA, 19 nt, Homo sapiens
ggaguacaaacuagugaug

SEQ ID NO: 435739 - RNA, 19 nt, Homo sapiens
cgucgaaguuuccaugaag

SEQ ID NO: 435740 - RNA, 19 nt, Homo sapiens
cucuuucacuuaacugaua

SEQ ID NO: 435741 - RNA, 19 nt, Homo sapiens
ggugcuugcucuuucacuu

SEQ ID NO: 435742 - RNA, 19 nt, Homo sapiens
ucacgggaguacaaacuag

SEQ ID NO: 435743 - RNA, 19 nt, Homo sapiens
ccaagaggacaauggauuc

SEQ ID NO: 435744 - RNA, 19 nt, Homo sapiens
uaucacggaucgucgaagu

SEQ ID NO: 435745 - RNA, 19 nt, Homo sapiens
cgauacaccugugguucuu

SEQ ID NO: 435746 - RNA, 19 nt, Homo sapiens
gagggcaggagaaggguuu

SEQ ID NO: 435747 - RNA, 19 nt, Homo sapiens
agaauucagcugucccuuu

SEQ ID NO: 435748 - RNA, 19 nt, Homo sapiens
cugcagugcuguaucaaag

SEQ ID NO: 435749 - RNA, 19 nt, Homo sapiens
ugaaguguuuaucugugaa

SEQ ID NO: 435750 - RNA, 19 nt, Homo sapiens
gaaagaaaaggaggcagua

SEQ ID NO: 435751 - RNA, 19 nt, Homo sapiens
caccaaggaagaaggauug

SEQ ID NO: 435752 - RNA, 19 nt, Homo sapiens
ggaagagugccaugaccau

SEQ ID NO: 435753 - RNA, 19 nt, Homo sapiens
ucaaagcaguccaguaacc

SEQ ID NO: 435754 - RNA, 19 nt, Homo sapiens
caagucagaccucaaacag

SEQ ID NO: 435755 - RNA, 19 nt, Homo sapiens
guucaucagccaccgauuc

SEQ ID NO: 435756 - RNA, 19 nt, Homo sapiens
caggauccguauugaugau

SEQ ID NO: 435757 - RNA, 19 nt, Homo sapiens
ugcuugcucuuucacuuaa

SEQ ID NO: 435758 - RNA, 19 nt, Homo sapiens
guaucaaagcaguccagua

SEQ ID NO: 435759 - RNA, 19 nt, Homo sapiens
cccaagaggacaauggauu

SEQ ID NO: 435760 - RNA, 19 nt, Homo sapiens
aaaucaccauuccggaaga

SEQ ID NO: 435761 - RNA, 19 nt, Homo sapiens
agaaggguuuaucaucugu

SEQ ID NO: 435762 - RNA, 19 nt, Homo sapiens
aagagggacaugccuacua

SEQ ID NO: 435763 - RNA, 19 nt, Homo sapiens
uaacuugaagagaagaugu

SEQ ID NO: 435764 - RNA, 19 nt, Homo sapiens
gcugcauaccgcuacuaua

SEQ ID NO: 435765 - RNA, 19 nt, Homo sapiens
guagggaagagugccauga

SEQ ID NO: 435766 - RNA, 19 nt, Homo sapiens
ugaugagccugccaaucug

SEQ ID NO: 435767 - RNA, 19 nt, Homo sapiens
gagugaaggaagacgaaug

SEQ ID NO: 435768 - RNA, 19 nt, Homo sapiens
guauaugagggcaggagaa

SEQ ID NO: 435769 - RNA, 19 nt, Homo sapiens
ucaggauccguauugauga

SEQ ID NO: 435770 - RNA, 19 nt, Homo sapiens
uauggugcuugcucuuuca

SEQ ID NO: 435771 - RNA, 19 nt, Homo sapiens
caccauuccggaagaagaa

SEQ ID NO: 435772 - RNA, 19 nt, Homo sapiens
ccgcuacuauauugaugau

SEQ ID NO: 435773 - RNA, 19 nt, Homo sapiens
ucaccaaggaagaaggauu

SEQ ID NO: 435774 - RNA, 19 nt, Homo sapiens
ucagaccucaaacagcuaa

SEQ ID NO: 435775 - RNA, 19 nt, Homo sapiens
auacaccugugguucuugu

SEQ ID NO: 435776 - RNA, 19 nt, Homo sapiens
cagcuggacaggcagaguu

SEQ ID NO: 435777 - RNA, 19 nt, Homo sapiens
cugccaaucuggacauuuu

SEQ ID NO: 435778 - RNA, 19 nt, Homo sapiens
ggucaccaaggaagaagga

SEQ ID NO: 435779 - RNA, 19 nt, Homo sapiens
ggacaggcagaguuuacag

SEQ ID NO: 435780 - RNA, 19 nt, Homo sapiens
ccaccgauucccagaagau

SEQ ID NO: 435781 - RNA, 19 nt, Homo sapiens
uaucgaguccgacguacug

SEQ ID NO: 435782 - RNA, 19 nt, Homo sapiens
ccaguugguagcugcugua

SEQ ID NO: 435783 - RNA, 19 nt, Homo sapiens
gaaggguuuaucaucuguu

SEQ ID NO: 435784 - RNA, 19 nt, Homo sapiens
ucaccauuccggaagaaga

SEQ ID NO: 435785 - RNA, 19 nt, Homo sapiens
aggcaguacuggccaugga

SEQ ID NO: 435786 - RNA, 19 nt, Homo sapiens
gaccggcugugguguucca

SEQ ID NO: 435787 - RNA, 19 nt, Homo sapiens
gaucccaccauugaagaug

SEQ ID NO: 435788 - RNA, 19 nt, Homo sapiens
ugacgauacaccugugguu

SEQ ID NO: 435789 - RNA, 19 nt, Homo sapiens
ggaaagggcugcuugagau

SEQ ID NO: 435790 - RNA, 19 nt, Homo sapiens
gggaugaccuuucugguuu

SEQ ID NO: 435791 - RNA, 19 nt, Homo sapiens
gcaguacccugagcucuuu

SEQ ID NO: 435792 - RNA, 19 nt, Homo sapiens
gaacacagccuucugaaaa

SEQ ID NO: 435793 - RNA, 19 nt, Homo sapiens
caaagacucgaauucauuu

SEQ ID NO: 435794 - RNA, 19 nt, Homo sapiens
caugguaccugaagaggaa

SEQ ID NO: 435795 - RNA, 19 nt, Homo sapiens
uggagaagcugcuggagaa

SEQ ID NO: 435796 - RNA, 19 nt, Homo sapiens
gcacgcugcccaaguauga

SEQ ID NO: 435797 - RNA, 19 nt, Homo sapiens
cgagugagcucagguguca

SEQ ID NO: 435798 - RNA, 19 nt, Homo sapiens
gcucagaggcuaugugaau

SEQ ID NO: 435799 - RNA, 19 nt, Homo sapiens
gcaggcauauugcuucauc

SEQ ID NO: 435800 - RNA, 19 nt, Homo sapiens
agaagcugcuggagaauga

SEQ ID NO: 435801 - RNA, 19 nt, Homo sapiens
ucaaagacucgaauucauu

SEQ ID NO: 435802 - RNA, 19 nt, Homo sapiens
gaacccagguccaacuuuu

SEQ ID NO: 435803 - RNA, 19 nt, Homo sapiens
gucaugcucuucaacauug

SEQ ID NO: 435804 - RNA, 19 nt, Homo sapiens
gcuguccgcugcaccauug

SEQ ID NO: 435805 - RNA, 19 nt, Homo sapiens
caccugcccuugaagcuuu

SEQ ID NO: 435806 - RNA, 19 nt, Homo sapiens
guucaaagccauccacuuc

SEQ ID NO: 435807 - RNA, 19 nt, Homo sapiens
gaacuggcaaagucaagaa

SEQ ID NO: 435808 - RNA, 19 nt, Homo sapiens
uguguaagguuguauuuca

SEQ ID NO: 435809 - RNA, 19 nt, Homo sapiens
uaacagaguuuuacgacuu

SEQ ID NO: 435810 - RNA, 19 nt, Homo sapiens
ggagaggccaggacagaga

SEQ ID NO: 435811 - RNA, 19 nt, Homo sapiens
gcccugacuuccuauccua

SEQ ID NO: 435812 - RNA, 19 nt, Homo sapiens
ggacuucagaucucaggaa

SEQ ID NO: 435813 - RNA, 19 nt, Homo sapiens
ucaggaagaugguggacau

SEQ ID NO: 435814 - RNA, 19 nt, Homo sapiens
ucaaagccauccacuucau

SEQ ID NO: 435815 - RNA, 19 nt, Homo sapiens
ggucaugcucuucaacauu

SEQ ID NO: 435816 - RNA, 19 nt, Homo sapiens
caacgugggccgugccuau

SEQ ID NO: 435817 - RNA, 19 nt, Homo sapiens
cggagagggugcaagagaa

SEQ ID NO: 435818 - RNA, 19 nt, Homo sapiens
gaaagggcugcuugagaug

SEQ ID NO: 435819 - RNA, 19 nt, Homo sapiens
ggaccauggaccugucuuu

SEQ ID NO: 435820 - RNA, 19 nt, Homo sapiens
ggaagaugguggacaugcu

SEQ ID NO: 435821 - RNA, 19 nt, Homo sapiens
gaggaaacucaaaucaaug

SEQ ID NO: 435822 - RNA, 19 nt, Homo sapiens
gauaaaagagagaggaaaa

SEQ ID NO: 435823 - RNA, 19 nt, Homo sapiens
guaagguuguauuucaaag

SEQ ID NO: 435824 - RNA, 19 nt, Homo sapiens
agaacauccugcccucuga

SEQ ID NO: 435825 - RNA, 19 nt, Homo sapiens
ggaugaccuuucugguuuc

SEQ ID NO: 435826 - RNA, 19 nt, Homo sapiens
ucagaggcuaugugaauuu

SEQ ID NO: 435827 - RNA, 19 nt, Homo sapiens
gcggagagggugcaagaga

SEQ ID NO: 435828 - RNA, 19 nt, Homo sapiens
uggaagagaagaacuugaa

SEQ ID NO: 435829 - RNA, 19 nt, Homo sapiens
cucaaucauuuccuuugua

SEQ ID NO: 435830 - RNA, 19 nt, Homo sapiens
ggcccaagcugagaacaca

SEQ ID NO: 435831 - RNA, 19 nt, Homo sapiens
accaggagaucgaugagaa

SEQ ID NO: 435832 - RNA, 19 nt, Homo sapiens
ugcgagagcugcaggagau

SEQ ID NO: 435833 - RNA, 19 nt, Homo sapiens
ccaaggacucugugucuuc

SEQ ID NO: 435834 - RNA, 19 nt, Homo sapiens
guguaagguuguauuucaa

SEQ ID NO: 435835 - RNA, 19 nt, Homo sapiens
aucaauggcuucugcauca

SEQ ID NO: 435836 - RNA, 19 nt, Homo sapiens
cagaggcuaugugaauuuc

SEQ ID NO: 435837 - RNA, 19 nt, Homo sapiens
gagaagcugcuggagaaug

SEQ ID NO: 435838 - RNA, 19 nt, Homo sapiens
ggacucugugucuuccaua

SEQ ID NO: 435839 - RNA, 19 nt, Homo sapiens
ucauuuccuuuguaacaga

SEQ ID NO: 435840 - RNA, 19 nt, Homo sapiens
ucucaaucauuuccuuugu

SEQ ID NO: 435841 - RNA, 19 nt, Homo sapiens
ucaccacgaccuacaaugu

SEQ ID NO: 435842 - RNA, 19 nt, Homo sapiens
ucucuagucgggacaagua

SEQ ID NO: 435843 - RNA, 19 nt, Homo sapiens
ugaauuuccggcugcagua

SEQ ID NO: 435844 - RNA, 19 nt, Homo sapiens
gaccauggaccugucuuug

SEQ ID NO: 435845 - RNA, 19 nt, Homo sapiens
ccugccagcugaacuguag

SEQ ID NO: 435846 - RNA, 19 nt, Homo sapiens
ugaccuuucugguuucuac

SEQ ID NO: 435847 - RNA, 19 nt, Homo sapiens
auugagaacuggcaaaguc

SEQ ID NO: 435848 - RNA, 19 nt, Homo sapiens
gcuccaggacauucaggua

SEQ ID NO: 435849 - RNA, 19 nt, Homo sapiens
gagaggccaggacagagaa

SEQ ID NO: 435850 - RNA, 19 nt, Homo sapiens
caccuuugaugagaucuug

SEQ ID NO: 435851 - RNA, 19 nt, Homo sapiens
ccaaggaugagcugaacga

SEQ ID NO: 435852 - RNA, 19 nt, Homo sapiens
ggagagggugcaagagaag

SEQ ID NO: 435853 - RNA, 19 nt, Homo sapiens
gagaacuucaagggcuuua

SEQ ID NO: 435854 - RNA, 19 nt, Homo sapiens
ugcagaaggccaaggauga

SEQ ID NO: 435855 - RNA, 19 nt, Homo sapiens
agguagagcuccaggacau

SEQ ID NO: 435856 - RNA, 19 nt, Homo sapiens
ucaagggcuuuaccaugca

SEQ ID NO: 435857 - RNA, 19 nt, Homo sapiens
guagagcuccaggacauuc

SEQ ID NO: 435858 - RNA, 19 nt, Homo sapiens
gcagaaggccaaggaugag

SEQ ID NO: 435859 - RNA, 19 nt, Homo sapiens
gggcacguuccgcauggua

SEQ ID NO: 435860 - RNA, 19 nt, Homo sapiens
ucacccuguucucaaguug

SEQ ID NO: 435861 - RNA, 19 nt, Homo sapiens
agacugggguuaaaucuca

SEQ ID NO: 435862 - RNA, 19 nt, Homo sapiens
gaguggucaugcucuucaa

SEQ ID NO: 435863 - RNA, 19 nt, Homo sapiens
gcagggaacaaccaagacu

SEQ ID NO: 435864 - RNA, 19 nt, Homo sapiens
gccugcaaguggaagagaa

SEQ ID NO: 435865 - RNA, 19 nt, Homo sapiens
ggccaaggaugagcugaac

SEQ ID NO: 435866 - RNA, 19 nt, Homo sapiens
cauccugcccucugacuuc

SEQ ID NO: 435867 - RNA, 19 nt, Homo sapiens
cucagaggcuaugugaauu

SEQ ID NO: 435868 - RNA, 19 nt, Homo sapiens
uuucaaagacucgaauuca

SEQ ID NO: 435869 - RNA, 19 nt, Homo sapiens
aggaaagggcugcuugaga

SEQ ID NO: 435870 - RNA, 19 nt, Homo sapiens
cuggcaaagucaagaaauc

SEQ ID NO: 435871 - RNA, 19 nt, Homo sapiens
gcaaguggaagagaagaac

SEQ ID NO: 435872 - RNA, 19 nt, Homo sapiens
uucaaagacucgaauucau

SEQ ID NO: 435873 - RNA, 19 nt, Homo sapiens
gacucugugucuuccauag

SEQ ID NO: 435874 - RNA, 19 nt, Homo sapiens
ggaagagaagaacuugaac

SEQ ID NO: 435875 - RNA, 19 nt, Homo sapiens
cgaguggucaugcucuuca

SEQ ID NO: 435876 - RNA, 19 nt, Homo sapiens
gccgaguggucaugcucuu

SEQ ID NO: 435877 - RNA, 19 nt, Homo sapiens
gaaagcagcucaguauuug

SEQ ID NO: 435878 - RNA, 19 nt, Homo sapiens
gcagaucccuguauaaaga

SEQ ID NO: 435879 - RNA, 19 nt, Homo sapiens
ggagucacaugaugcauua

SEQ ID NO: 435880 - RNA, 19 nt, Homo sapiens
ggaauguuguggcaaauaa

SEQ ID NO: 435881 - RNA, 19 nt, Homo sapiens
gaagagauuugacagauca

SEQ ID NO: 435882 - RNA, 19 nt, Homo sapiens
gaacuucuguuacgcuuga

SEQ ID NO: 435883 - RNA, 19 nt, Homo sapiens
gaaaugaaggcaucaguuu

SEQ ID NO: 435884 - RNA, 19 nt, Homo sapiens
gaacaaaggcugagaagca

SEQ ID NO: 435885 - RNA, 19 nt, Homo sapiens
caacaagaaugcaucagaa

SEQ ID NO: 435886 - RNA, 19 nt, Homo sapiens
guggagagcuugccuuaaa

SEQ ID NO: 435887 - RNA, 19 nt, Homo sapiens
gaugaguagugccuauuua

SEQ ID NO: 435888 - RNA, 19 nt, Homo sapiens
gaaaguagcaaaugagaga

SEQ ID NO: 435889 - RNA, 19 nt, Homo sapiens
ggaguaaacugcaaagaag

SEQ ID NO: 435890 - RNA, 19 nt, Homo sapiens
aaagggaacuugucaaaug

SEQ ID NO: 435891 - RNA, 19 nt, Homo sapiens
caaauucucuucgauguga

SEQ ID NO: 435892 - RNA, 19 nt, Homo sapiens
aaagugaacugccauguga

SEQ ID NO: 435893 - RNA, 19 nt, Homo sapiens
gauauggaguucuuacuug

SEQ ID NO: 435894 - RNA, 19 nt, Homo sapiens
ccuaaacccugcucagaua

SEQ ID NO: 435895 - RNA, 19 nt, Homo sapiens
gcacguccauacuuaacua

SEQ ID NO: 435896 - RNA, 19 nt, Homo sapiens
cagaaagggugcauagaaa

SEQ ID NO: 435897 - RNA, 19 nt, Homo sapiens
guacaacaaagaacaguua

SEQ ID NO: 435898 - RNA, 19 nt, Homo sapiens
ugaagcagaucccuguaua

SEQ ID NO: 435899 - RNA, 19 nt, Homo sapiens
gcaaaugagagacuacuaa

SEQ ID NO: 435900 - RNA, 19 nt, Homo sapiens
gagggugcuuuguguaaua

SEQ ID NO: 435901 - RNA, 19 nt, Homo sapiens
cagagcaacucacaaacua

SEQ ID NO: 435902 - RNA, 19 nt, Homo sapiens
gaacauauuguguaucuuc

SEQ ID NO: 435903 - RNA, 19 nt, Homo sapiens
agacgagccugucagcuua

SEQ ID NO: 435904 - RNA, 19 nt, Homo sapiens
gaauugacccuucuuuaga

SEQ ID NO: 435905 - RNA, 19 nt, Homo sapiens
caacaacaguuccuuccuu

SEQ ID NO: 435906 - RNA, 19 nt, Homo sapiens
caaaggucauuuacaagaa

SEQ ID NO: 435907 - RNA, 19 nt, Homo sapiens
ccuauuggcucuucugaaa

SEQ ID NO: 435908 - RNA, 19 nt, Homo sapiens
gcuccaaacugcaagugua

SEQ ID NO: 435909 - RNA, 19 nt, Homo sapiens
aaauggaacuguacacuug

SEQ ID NO: 435910 - RNA, 19 nt, Homo sapiens
uguaggaaguucauaagua

SEQ ID NO: 435911 - RNA, 19 nt, Homo sapiens
guucuaugcucccuaauga

SEQ ID NO: 435912 - RNA, 19 nt, Homo sapiens
gaaguugacauaccucauu

SEQ ID NO: 435913 - RNA, 19 nt, Homo sapiens
gaaaagaaagccccaauaa

SEQ ID NO: 435914 - RNA, 19 nt, Homo sapiens
ccauuucagugucauauuu

SEQ ID NO: 435915 - RNA, 19 nt, Homo sapiens
ccagaagauuuagaaguua

SEQ ID NO: 435916 - RNA, 19 nt, Homo sapiens
caacucagaucaagugaag

SEQ ID NO: 435917 - RNA, 19 nt, Homo sapiens
cggaggaagucaauaaauu

SEQ ID NO: 435918 - RNA, 19 nt, Homo sapiens
guacugaguuguuucgaau

SEQ ID NO: 435919 - RNA, 19 nt, Homo sapiens
guaggaaguucauaaguag

SEQ ID NO: 435920 - RNA, 19 nt, Homo sapiens
uuacaaaccuaugggauuu

SEQ ID NO: 435921 - RNA, 19 nt, Homo sapiens
gggaaauacauucagauua

SEQ ID NO: 435922 - RNA, 19 nt, Homo sapiens
ggagaaagacaaagcaaga

SEQ ID NO: 435923 - RNA, 19 nt, Homo sapiens
caagaggaaugcagaaaca

SEQ ID NO: 435924 - RNA, 19 nt, Homo sapiens
ggaaagggauauggaguuc

SEQ ID NO: 435925 - RNA, 19 nt, Homo sapiens
aauaguagcugaaacaaca

SEQ ID NO: 435926 - RNA, 19 nt, Homo sapiens
ucaggaaagugaagagaaa

SEQ ID NO: 435927 - RNA, 19 nt, Homo sapiens
uaugcaggauguauuguua

SEQ ID NO: 435928 - RNA, 19 nt, Homo sapiens
cuacuuaaccaaacugaua

SEQ ID NO: 435929 - RNA, 19 nt, Homo sapiens
ugucggaggucucaucuuu

SEQ ID NO: 435930 - RNA, 19 nt, Homo sapiens
gcaaguguauauuguucuu

SEQ ID NO: 435931 - RNA, 19 nt, Homo sapiens
guacuagacaucauuugua

SEQ ID NO: 435932 - RNA, 19 nt, Homo sapiens
ccaguugguuuaaugauug

SEQ ID NO: 435933 - RNA, 19 nt, Homo sapiens
caacaaagaacaguuaugu

SEQ ID NO: 435934 - RNA, 19 nt, Homo sapiens
guacagaggauaccauguu

SEQ ID NO: 435935 - RNA, 19 nt, Homo sapiens
cagaaaaccugaaagaaaa

SEQ ID NO: 435936 - RNA, 19 nt, Homo sapiens
agaaaucagugaaacuuga

SEQ ID NO: 435937 - RNA, 19 nt, Homo sapiens
ggaccuuccuuucugcaaa

SEQ ID NO: 435938 - RNA, 19 nt, Homo sapiens
aaucccaccuuuaauagua

SEQ ID NO: 435939 - RNA, 19 nt, Homo sapiens
gccagaaaguagcaaauga

SEQ ID NO: 435940 - RNA, 19 nt, Homo sapiens
ggaacagcauaauauugaa

SEQ ID NO: 435941 - RNA, 19 nt, Homo sapiens
aauaaacgcuuccuguguu

SEQ ID NO: 435942 - RNA, 19 nt, Homo sapiens
aaacacaccuuaggauuca

SEQ ID NO: 435943 - RNA, 19 nt, Homo sapiens
caucagaacauauugugua

SEQ ID NO: 435944 - RNA, 19 nt, Homo sapiens
gcaacuuccuuggcuguaa

SEQ ID NO: 435945 - RNA, 19 nt, Homo sapiens
gaaggcaucaguuuguaaa

SEQ ID NO: 435946 - RNA, 19 nt, Homo sapiens
ggagcgcugucgucaguuu

SEQ ID NO: 435947 - RNA, 19 nt, Homo sapiens
gggaacuugucaaauguaa

SEQ ID NO: 435948 - RNA, 19 nt, Homo sapiens
aaaccacacugucauccua

SEQ ID NO: 435949 - RNA, 19 nt, Homo sapiens
ugacagagcaacucacaaa

SEQ ID NO: 435950 - RNA, 19 nt, Homo sapiens
aaucaccucucaaugcaua

SEQ ID NO: 435951 - RNA, 19 nt, Homo sapiens
gcagauuaguacugaguug

SEQ ID NO: 435952 - RNA, 19 nt, Homo sapiens
caaauuaagugugcaugau

SEQ ID NO: 435953 - RNA, 19 nt, Homo sapiens
uccauuagcucuccaguug

SEQ ID NO: 435954 - RNA, 19 nt, Homo sapiens
gaaugacagugaaccugaa

SEQ ID NO: 435955 - RNA, 19 nt, Homo sapiens
uggagaaucuuguuguuug

SEQ ID NO: 435956 - RNA, 19 nt, Homo sapiens
gauggagaaucuuguuguu

SEQ ID NO: 435957 - RNA, 19 nt, Homo sapiens
cuaaaggaaaucuguguua

SEQ ID NO: 435958 - RNA, 19 nt, Homo sapiens
gaacauaaucagacaacug

SEQ ID NO: 435959 - RNA, 19 nt, Homo sapiens
gaaugcaucagaacauauu

SEQ ID NO: 435960 - RNA, 19 nt, Homo sapiens
caggauguauuguuaucua

SEQ ID NO: 435961 - RNA, 19 nt, Homo sapiens
cuagaucacucugaaacua

SEQ ID NO: 435962 - RNA, 19 nt, Homo sapiens
caacuuccuuggcuguaaa

SEQ ID NO: 435963 - RNA, 19 nt, Homo sapiens
gaagaagagauuugacaga

SEQ ID NO: 435964 - RNA, 19 nt, Homo sapiens
ggacaagaagccucagauu

SEQ ID NO: 435965 - RNA, 19 nt, Homo sapiens
aaacggaggaagucaauaa

SEQ ID NO: 435966 - RNA, 19 nt, Homo sapiens
cuacaaauauugguucaug

SEQ ID NO: 435967 - RNA, 19 nt, Homo sapiens
gauuaguacugaguuguuu

SEQ ID NO: 435968 - RNA, 19 nt, Homo sapiens
cuagaacaguguaauauag

SEQ ID NO: 435969 - RNA, 19 nt, Homo sapiens
agaaagcagcucaguauuu

SEQ ID NO: 435970 - RNA, 19 nt, Homo sapiens
gagcaacucacaaacuauu

SEQ ID NO: 435971 - RNA, 19 nt, Homo sapiens
gaaggucuagaucacaaua

SEQ ID NO: 435972 - RNA, 19 nt, Homo sapiens
cagaacauauuguguaucu

SEQ ID NO: 435973 - RNA, 19 nt, Homo sapiens
gcaaggaaguacuagacau

SEQ ID NO: 435974 - RNA, 19 nt, Homo sapiens
ugacugcaaucccaccuuu

SEQ ID NO: 435975 - RNA, 19 nt, Homo sapiens
gaucaaagaaucagaaacu

SEQ ID NO: 435976 - RNA, 19 nt, Homo sapiens
gaagauggcggacggaaag

SEQ ID NO: 435977 - RNA, 19 nt, Homo sapiens
gugcacaucucguauaaua

SEQ ID NO: 435978 - RNA, 19 nt, Homo sapiens
cagcaguccuucagaauua

SEQ ID NO: 435979 - RNA, 19 nt, Homo sapiens
gauauuaggucccaucaau

SEQ ID NO: 435980 - RNA, 19 nt, Homo sapiens
gcacaucucguauaauauu

SEQ ID NO: 435981 - RNA, 19 nt, Homo sapiens
ggaagaugcuccucagaca

SEQ ID NO: 435982 - RNA, 19 nt, Homo sapiens
gcgcgcagauugccauuug

SEQ ID NO: 435983 - RNA, 19 nt, Homo sapiens
caacauguaccuguauuaa

SEQ ID NO: 435984 - RNA, 19 nt, Homo sapiens
caacaaagauacagaaacc

SEQ ID NO: 435985 - RNA, 19 nt, Homo sapiens
ugucagaauuuguugcuaa

SEQ ID NO: 435986 - RNA, 19 nt, Homo sapiens
gcuaggagucuguuuacua

SEQ ID NO: 435987 - RNA, 19 nt, Homo sapiens
caggucccaucaauucuua

SEQ ID NO: 435988 - RNA, 19 nt, Homo sapiens
caaagauacagaaaccaua

SEQ ID NO: 435989 - RNA, 19 nt, Homo sapiens
acaacaacauguaccugua

SEQ ID NO: 435990 - RNA, 19 nt, Homo sapiens
ggauggaggaaguuauuaa

SEQ ID NO: 435991 - RNA, 19 nt, Homo sapiens
acagugcauuggcuaauaa

SEQ ID NO: 435992 - RNA, 19 nt, Homo sapiens
agacagcaguccuucagaa

SEQ ID NO: 435993 - RNA, 19 nt, Homo sapiens
ccacaggagcugaaguuaa

SEQ ID NO: 435994 - RNA, 19 nt, Homo sapiens
ggagucuguuuacuacuga

SEQ ID NO: 435995 - RNA, 19 nt, Homo sapiens
uaggucccaucaauucuua

SEQ ID NO: 435996 - RNA, 19 nt, Homo sapiens
gauggaggaaguuauuaaa

SEQ ID NO: 435997 - RNA, 19 nt, Homo sapiens
uaucaggucccaucaauuc

SEQ ID NO: 435998 - RNA, 19 nt, Homo sapiens
cacaggagcugaaguuaac

SEQ ID NO: 435999 - RNA, 19 nt, Homo sapiens
gaaaauguucuuuguguga

SEQ ID NO: 436000 - RNA, 19 nt, Homo sapiens
aauaaauguugccauguug

SEQ ID NO: 436001 - RNA, 19 nt, Homo sapiens
caacaacauguaccuguau

SEQ ID NO: 436002 - RNA, 19 nt, Homo sapiens
gaagcuaauugugcacauc

SEQ ID NO: 436003 - RNA, 19 nt, Homo sapiens
uacagugcauuggcuaaua

SEQ ID NO: 436004 - RNA, 19 nt, Homo sapiens
ggagggaaagcacugagaa

SEQ ID NO: 436005 - RNA, 19 nt, Homo sapiens
uaccacagcuacaacaaca

SEQ ID NO: 436006 - RNA, 19 nt, Homo sapiens
gcugagaugaagcuaauug

SEQ ID NO: 436007 - RNA, 19 nt, Homo sapiens
cuaggagucuguuuacuac

SEQ ID NO: 436008 - RNA, 19 nt, Homo sapiens
caaauugugccauccuuca

SEQ ID NO: 436009 - RNA, 19 nt, Homo sapiens
gcaggugauuuuauucaaa

SEQ ID NO: 436010 - RNA, 19 nt, Homo sapiens
ucuaucaggucccaucaau

SEQ ID NO: 436011 - RNA, 19 nt, Homo sapiens
agacaacucuacagugcau

SEQ ID NO: 436012 - RNA, 19 nt, Homo sapiens
cauccuucaucaacaaaga

SEQ ID NO: 436013 - RNA, 19 nt, Homo sapiens
uaauugugcacaucucgua

SEQ ID NO: 436014 - RNA, 19 nt, Homo sapiens
guuuacuacugaaccaauu

SEQ ID NO: 436015 - RNA, 19 nt, Homo sapiens
caucaacaaagauacagaa

SEQ ID NO: 436016 - RNA, 19 nt, Homo sapiens
ccacagcuacaacaacaug

SEQ ID NO: 436017 - RNA, 19 nt, Homo sapiens
uugcugagaugaagcuaau

SEQ ID NO: 436018 - RNA, 19 nt, Homo sapiens
agauuccagucuucucuuu

SEQ ID NO: 436019 - RNA, 19 nt, Homo sapiens
uauuaggucccaucaauuc

SEQ ID NO: 436020 - RNA, 19 nt, Homo sapiens
gcagacagcaguccuucag

SEQ ID NO: 436021 - RNA, 19 nt, Homo sapiens
acucauggauggaggaagu

SEQ ID NO: 436022 - RNA, 19 nt, Homo sapiens
acaacauguaccuguauua

SEQ ID NO: 436023 - RNA, 19 nt, Homo sapiens
gucagaauuuguugcuaau

SEQ ID NO: 436024 - RNA, 19 nt, Homo sapiens
aacaacauguaccuguauu

SEQ ID NO: 436025 - RNA, 19 nt, Homo sapiens
ugaaguuaacccugucuga

SEQ ID NO: 436026 - RNA, 19 nt, Homo sapiens
uugugcacaucucguauaa

SEQ ID NO: 436027 - RNA, 19 nt, Homo sapiens
gacagcaguccuucagaau

SEQ ID NO: 436028 - RNA, 19 nt, Homo sapiens
auuccagucuucucuuuga

SEQ ID NO: 436029 - RNA, 19 nt, Homo sapiens
ccugcuaggagucuguuua

SEQ ID NO: 436030 - RNA, 19 nt, Homo sapiens
gcaguccuucagaauuaaa

SEQ ID NO: 436031 - RNA, 19 nt, Homo sapiens
acagcaguccuucagaauu

SEQ ID NO: 436032 - RNA, 19 nt, Homo sapiens
gcacugagaacaggaagcu

SEQ ID NO: 436033 - RNA, 19 nt, Homo sapiens
acaaagauacagaaaccau

SEQ ID NO: 436034 - RNA, 19 nt, Homo sapiens
acauuucacugaugcuucu

SEQ ID NO: 436035 - RNA, 19 nt, Homo sapiens
gaccaguggcaggugauuu

SEQ ID NO: 436036 - RNA, 19 nt, Homo sapiens
ugccauccuucaucaacaa

SEQ ID NO: 436037 - RNA, 19 nt, Homo sapiens
gugccauccuucaucaaca

SEQ ID NO: 436038 - RNA, 19 nt, Homo sapiens
caugagcaccuggagcaaa

SEQ ID NO: 436039 - RNA, 19 nt, Homo sapiens
ggauacucauucucgaaaa

SEQ ID NO: 436040 - RNA, 19 nt, Homo sapiens
gccacaggagcugaaguua

SEQ ID NO: 436041 - RNA, 19 nt, Homo sapiens
gggaaagcacugagaacag

SEQ ID NO: 436042 - RNA, 19 nt, Homo sapiens
aggagucuguuuacuacug

SEQ ID NO: 436043 - RNA, 19 nt, Homo sapiens
ugagaugaagcuaauugug

SEQ ID NO: 436044 - RNA, 19 nt, Homo sapiens
uggauacucauucucgaaa

SEQ ID NO: 436045 - RNA, 19 nt, Homo sapiens
aaguuaacccugucugaga

SEQ ID NO: 436046 - RNA, 19 nt, Homo sapiens
gugcacaucucguauaaua

SEQ ID NO: 436047 - RNA, 19 nt, Homo sapiens
cagcaguccuucagaauua

SEQ ID NO: 436048 - RNA, 19 nt, Homo sapiens
gauauuaggucccaucaau

SEQ ID NO: 436049 - RNA, 19 nt, Homo sapiens
gcacaucucguauaauauu

SEQ ID NO: 436050 - RNA, 19 nt, Homo sapiens
ggaagaugcuccucagaca

SEQ ID NO: 436051 - RNA, 19 nt, Homo sapiens
gcgcgcagauugccauuug

SEQ ID NO: 436052 - RNA, 19 nt, Homo sapiens
caacauguaccuguauuaa

SEQ ID NO: 436053 - RNA, 19 nt, Homo sapiens
caacaaagauacagaaacc

SEQ ID NO: 436054 - RNA, 19 nt, Homo sapiens
ugucagaauuuguugcuaa

SEQ ID NO: 436055 - RNA, 19 nt, Homo sapiens
gcuaggagucuguuuacua

SEQ ID NO: 436056 - RNA, 19 nt, Homo sapiens
caggucccaucaauucuua

SEQ ID NO: 436057 - RNA, 19 nt, Homo sapiens
caaagauacagaaaccaua

SEQ ID NO: 436058 - RNA, 19 nt, Homo sapiens
gaaauugugccauccuuca

SEQ ID NO: 436059 - RNA, 19 nt, Homo sapiens
acaacaacauguaccugua

SEQ ID NO: 436060 - RNA, 19 nt, Homo sapiens
ggauggaggaaguuauuaa

SEQ ID NO: 436061 - RNA, 19 nt, Homo sapiens
acagugcauuggcuaauaa

SEQ ID NO: 436062 - RNA, 19 nt, Homo sapiens
agacagcaguccuucagaa

SEQ ID NO: 436063 - RNA, 19 nt, Homo sapiens
ccacaggagcugaaguuaa

SEQ ID NO: 436064 - RNA, 19 nt, Homo sapiens
ggagucuguuuacuacuga

SEQ ID NO: 436065 - RNA, 19 nt, Homo sapiens
uaggucccaucaauucuua

SEQ ID NO: 436066 - RNA, 19 nt, Homo sapiens
gauggaggaaguuauuaaa

SEQ ID NO: 436067 - RNA, 19 nt, Homo sapiens
uaucaggucccaucaauuc

SEQ ID NO: 436068 - RNA, 19 nt, Homo sapiens
cacaggagcugaaguuaac

SEQ ID NO: 436069 - RNA, 19 nt, Homo sapiens
gaaaauguucuuuguguga

SEQ ID NO: 436070 - RNA, 19 nt, Homo sapiens
aauaaauguugccauguug

SEQ ID NO: 436071 - RNA, 19 nt, Homo sapiens
caacaacauguaccuguau

SEQ ID NO: 436072 - RNA, 19 nt, Homo sapiens
gaagcuaauugugcacauc

SEQ ID NO: 436073 - RNA, 19 nt, Homo sapiens
uacagugcauuggcuaaua

SEQ ID NO: 436074 - RNA, 19 nt, Homo sapiens
uaccacagcuacaacaaca

SEQ ID NO: 436075 - RNA, 19 nt, Homo sapiens
gcugagaugaagcuaauug

SEQ ID NO: 436076 - RNA, 19 nt, Homo sapiens
cuaggagucuguuuacuac

SEQ ID NO: 436077 - RNA, 19 nt, Homo sapiens
ucuaucaggucccaucaau

SEQ ID NO: 436078 - RNA, 19 nt, Homo sapiens
agacaacucuacagugcau

SEQ ID NO: 436079 - RNA, 19 nt, Homo sapiens
cagaaauugugccauccuu

SEQ ID NO: 436080 - RNA, 19 nt, Homo sapiens
cauccuucaucaacaaaga

SEQ ID NO: 436081 - RNA, 19 nt, Homo sapiens
uaauugugcacaucucgua

SEQ ID NO: 436082 - RNA, 19 nt, Homo sapiens
guuuacuacugaaccaauu

SEQ ID NO: 436083 - RNA, 19 nt, Homo sapiens
caucaacaaagauacagaa

SEQ ID NO: 436084 - RNA, 19 nt, Homo sapiens
ccacagcuacaacaacaug

SEQ ID NO: 436085 - RNA, 19 nt, Homo sapiens
uugcugagaugaagcuaau

SEQ ID NO: 436086 - RNA, 19 nt, Homo sapiens
agauuccagucuucucuuu

SEQ ID NO: 436087 - RNA, 19 nt, Homo sapiens
uauuaggucccaucaauuc

SEQ ID NO: 436088 - RNA, 19 nt, Homo sapiens
gcagacagcaguccuucag

SEQ ID NO: 436089 - RNA, 19 nt, Homo sapiens
acucauggauggaggaagu

SEQ ID NO: 436090 - RNA, 19 nt, Homo sapiens
acaacauguaccuguauua

SEQ ID NO: 436091 - RNA, 19 nt, Homo sapiens
gucagaauuuguugcuaau

SEQ ID NO: 436092 - RNA, 19 nt, Homo sapiens
cuagaccaguggcagaaau

SEQ ID NO: 436093 - RNA, 19 nt, Homo sapiens
aacaacauguaccuguauu

SEQ ID NO: 436094 - RNA, 19 nt, Homo sapiens
ugaaguuaacccugucuga

SEQ ID NO: 436095 - RNA, 19 nt, Homo sapiens
uugugcacaucucguauaa

SEQ ID NO: 436096 - RNA, 19 nt, Homo sapiens
gacagcaguccuucagaau

SEQ ID NO: 436097 - RNA, 19 nt, Homo sapiens
auuccagucuucucuuuga

SEQ ID NO: 436098 - RNA, 19 nt, Homo sapiens
ccugcuaggagucuguuua

SEQ ID NO: 436099 - RNA, 19 nt, Homo sapiens
gcaguccuucagaauuaaa

SEQ ID NO: 436100 - RNA, 19 nt, Homo sapiens
acagcaguccuucagaauu

SEQ ID NO: 436101 - RNA, 19 nt, Homo sapiens
acaaagauacagaaaccau

SEQ ID NO: 436102 - RNA, 19 nt, Homo sapiens
acauuucacugaugcuucu

SEQ ID NO: 436103 - RNA, 19 nt, Homo sapiens
gaccaguggcagaaauugu

SEQ ID NO: 436104 - RNA, 19 nt, Homo sapiens
ugccauccuucaucaacaa

SEQ ID NO: 436105 - RNA, 19 nt, Homo sapiens
gugccauccuucaucaaca

SEQ ID NO: 436106 - RNA, 19 nt, Homo sapiens
ggauacucauucucgaaaa

SEQ ID NO: 436107 - RNA, 19 nt, Homo sapiens
gccacaggagcugaaguua

SEQ ID NO: 436108 - RNA, 19 nt, Homo sapiens
caugagcaccuggagcaaa

SEQ ID NO: 436109 - RNA, 19 nt, Homo sapiens
aggagucuguuuacuacug

SEQ ID NO: 436110 - RNA, 19 nt, Homo sapiens
ugagaugaagcuaauugug

SEQ ID NO: 436111 - RNA, 19 nt, Homo sapiens
uggauacucauucucgaaa

SEQ ID NO: 436112 - RNA, 19 nt, Homo sapiens
aaguuaacccugucugaga

SEQ ID NO: 436113 - RNA, 19 nt, Homo sapiens
gcaaaccagugaacaccuu

SEQ ID NO: 436114 - RNA, 19 nt, Homo sapiens
aaacgcaguugcaaacaau

SEQ ID NO: 436115 - RNA, 19 nt, Homo sapiens
gaaggagagacacaucauu

SEQ ID NO: 436116 - RNA, 19 nt, Homo sapiens
aaacuggccuuccaucucu

SEQ ID NO: 436117 - RNA, 19 nt, Homo sapiens
ugacaaacggcuccaggua

SEQ ID NO: 436118 - RNA, 19 nt, Homo sapiens
cagggcaacugcuacaaga

SEQ ID NO: 436119 - RNA, 19 nt, Homo sapiens
cauauggacucagacaguu

SEQ ID NO: 436120 - RNA, 19 nt, Homo sapiens
gaaacuggccuuccaucuc

SEQ ID NO: 436121 - RNA, 19 nt, Homo sapiens
gcagcuccaccuacuguaa

SEQ ID NO: 436122 - RNA, 19 nt, Homo sapiens
ggugaagaguggguuguga

SEQ ID NO: 436123 - RNA, 19 nt, Homo sapiens
gcauauggacucagacagu

SEQ ID NO: 436124 - RNA, 19 nt, Homo sapiens
ggcagcauauggacucaga

SEQ ID NO: 436125 - RNA, 19 nt, Homo sapiens
acaccaagcugcagaucca

SEQ ID NO: 436126 - RNA, 19 nt, Homo sapiens
ugguagauguccagaaugu

SEQ ID NO: 436127 - RNA, 19 nt, Homo sapiens
ucccaucccugcgugauuu

SEQ ID NO: 436128 - RNA, 19 nt, Homo sapiens
ccauggcucuggagaaguc

SEQ ID NO: 436129 - RNA, 19 nt, Homo sapiens
ccacucuuucuuucaauaa

SEQ ID NO: 436130 - RNA, 19 nt, Homo sapiens
ccuccacucuuucuuucaa

SEQ ID NO: 436131 - RNA, 19 nt, Homo sapiens
caccuacuguaaccaaaug

SEQ ID NO: 436132 - RNA, 19 nt, Homo sapiens
gagcugagugauugcagaa

SEQ ID NO: 436133 - RNA, 19 nt, Homo sapiens
guuaaccccuccacucuuu

SEQ ID NO: 436134 - RNA, 19 nt, Homo sapiens
cccgggagcugagugauug

SEQ ID NO: 436135 - RNA, 19 nt, Homo sapiens
caccauggcucuggagaag

SEQ ID NO: 436136 - RNA, 19 nt, Homo sapiens
ggucagagcagcgagauac

SEQ ID NO: 436137 - RNA, 19 nt, Homo sapiens
guggaggacucuaccuaag

SEQ ID NO: 436138 - RNA, 19 nt, Homo sapiens
aaggagagacacaucauug

SEQ ID NO: 436139 - RNA, 19 nt, Homo sapiens
gcugagugauugcagaaac

SEQ ID NO: 436140 - RNA, 19 nt, Homo sapiens
guagauguccagaaugucu

SEQ ID NO: 436141 - RNA, 19 nt, Homo sapiens
gugaagggagcccauaugu

SEQ ID NO: 436142 - RNA, 19 nt, Homo sapiens
uccacucuuucuuucaaua

SEQ ID NO: 436143 - RNA, 19 nt, Homo sapiens
ccaguccacuuugaugcuu

SEQ ID NO: 436144 - RNA, 19 nt, Homo sapiens
ccaccucccucaaccucau

SEQ ID NO: 436145 - RNA, 19 nt, Homo sapiens
caaaccagugaacaccuuu

SEQ ID NO: 436146 - RNA, 19 nt, Homo sapiens
cagcagcuccaccuacugu

SEQ ID NO: 436147 - RNA, 19 nt, Homo sapiens
gcagaaacuggccuuccau

SEQ ID NO: 436148 - RNA, 19 nt, Homo sapiens
acacacaugcuucccuuuc

SEQ ID NO: 436149 - RNA, 19 nt, Homo sapiens
uguggaggacucuaccuaa

SEQ ID NO: 436150 - RNA, 19 nt, Homo sapiens
cagacugccgccugacaaa

SEQ ID NO: 436151 - RNA, 19 nt, Homo sapiens
ugaagggagcccauaugug

SEQ ID NO: 436152 - RNA, 19 nt, Homo sapiens
cgaaggagagacacaucau

SEQ ID NO: 436153 - RNA, 19 nt, Homo sapiens
uacuguaaccaaaugauga

SEQ ID NO: 436154 - RNA, 19 nt, Homo sapiens
cuacuguaaccaaaugaug

SEQ ID NO: 436155 - RNA, 19 nt, Homo sapiens
gcaaacauguucuauauag

SEQ ID NO: 436156 - RNA, 19 nt, Homo sapiens
caucuaagcuccuguauca

SEQ ID NO: 436157 - RNA, 19 nt, Homo sapiens
cagcaaacauguucuauau

SEQ ID NO: 436158 - RNA, 19 nt, Homo sapiens
gaucccaucucuccauaua

SEQ ID NO: 436159 - RNA, 19 nt, Homo sapiens
aauaugaccuguccuagua

SEQ ID NO: 436160 - RNA, 19 nt, Homo sapiens
gagcugaagugccuuguga

SEQ ID NO: 436161 - RNA, 19 nt, Homo sapiens
gaagccaggugccuuuaau

SEQ ID NO: 436162 - RNA, 19 nt, Homo sapiens
gccaagcuccucaaucaua

SEQ ID NO: 436163 - RNA, 19 nt, Homo sapiens
gacgagacccuccacagua

SEQ ID NO: 436164 - RNA, 19 nt, Homo sapiens
uaccugggcucaaugguuu

SEQ ID NO: 436165 - RNA, 19 nt, Homo sapiens
gcaggucauuaacaauuau

SEQ ID NO: 436166 - RNA, 19 nt, Homo sapiens
uaaacugcuuugcaaauuc

SEQ ID NO: 436167 - RNA, 19 nt, Homo sapiens
acaaccagcuggaucaguu

SEQ ID NO: 436168 - RNA, 19 nt, Homo sapiens
ccaaauaugaccuguccua

SEQ ID NO: 436169 - RNA, 19 nt, Homo sapiens
ccaaguccacagaauauuu

SEQ ID NO: 436170 - RNA, 19 nt, Homo sapiens
gcagacaccagcaaacaug

SEQ ID NO: 436171 - RNA, 19 nt, Homo sapiens
gaccuguccuaguaacaaa

SEQ ID NO: 436172 - RNA, 19 nt, Homo sapiens
gaaacccagcacaucaaua

SEQ ID NO: 436173 - RNA, 19 nt, Homo sapiens
cugccaagcuccucaauca

SEQ ID NO: 436174 - RNA, 19 nt, Homo sapiens
cacagaauauuucaaacug

SEQ ID NO: 436175 - RNA, 19 nt, Homo sapiens
ugcaggucauuaacaauua

SEQ ID NO: 436176 - RNA, 19 nt, Homo sapiens
aaacccagcacaucaauau

SEQ ID NO: 436177 - RNA, 19 nt, Homo sapiens
ccagcaaacauguucuaua

SEQ ID NO: 436178 - RNA, 19 nt, Homo sapiens
aauaugaccucccagcaau

SEQ ID NO: 436179 - RNA, 19 nt, Homo sapiens
guaguuaauguuuguggua

SEQ ID NO: 436180 - RNA, 19 nt, Homo sapiens
acuguucacuucccaaauu

SEQ ID NO: 436181 - RNA, 19 nt, Homo sapiens
ugugguaacccaaauauga

SEQ ID NO: 436182 - RNA, 19 nt, Homo sapiens
ggaagccaggugccuuuaa

SEQ ID NO: 436183 - RNA, 19 nt, Homo sapiens
uaucagcacuccucaucau

SEQ ID NO: 436184 - RNA, 19 nt, Homo sapiens
ccaagcuccucaaucauag

SEQ ID NO: 436185 - RNA, 19 nt, Homo sapiens
caauaugaccucccagcaa

SEQ ID NO: 436186 - RNA, 19 nt, Homo sapiens
caaauuugucugcuucuuc

SEQ ID NO: 436187 - RNA, 19 nt, Homo sapiens
caauaaacugcuuugcaaa

SEQ ID NO: 436188 - RNA, 19 nt, Homo sapiens
guccacagaauauuucaaa

SEQ ID NO: 436189 - RNA, 19 nt, Homo sapiens
acgagacccuccacaguau

SEQ ID NO: 436190 - RNA, 19 nt, Homo sapiens
ucuauauaguugcauguga

SEQ ID NO: 436191 - RNA, 19 nt, Homo sapiens
ccaaauuugucugcuucuu

SEQ ID NO: 436192 - RNA, 19 nt, Homo sapiens
ugugaacccugcaauaaac

SEQ ID NO: 436193 - RNA, 19 nt, Homo sapiens
caaguccacagaauauuuc

SEQ ID NO: 436194 - RNA, 19 nt, Homo sapiens
ccaaaauacuuuccuucuu

SEQ ID NO: 436195 - RNA, 19 nt, Homo sapiens
aaauuugucugcuucuucu

SEQ ID NO: 436196 - RNA, 19 nt, Homo sapiens
caucuguccucaucagucu

SEQ ID NO: 436197 - RNA, 19 nt, Homo sapiens
ccacagaauauuucaaacu

SEQ ID NO: 436198 - RNA, 19 nt, Homo sapiens
caguuuaccugggcucaau

SEQ ID NO: 436199 - RNA, 19 nt, Homo sapiens
cuugugaacccugcaauaa

SEQ ID NO: 436200 - RNA, 19 nt, Homo sapiens
gcgcagacaccagcaaaca

SEQ ID NO: 436201 - RNA, 19 nt, Homo sapiens
gaaacaugguuccaaaacu

SEQ ID NO: 436202 - RNA, 19 nt, Homo sapiens
ccaucucuccauauacuuu

SEQ ID NO: 436203 - RNA, 19 nt, Homo sapiens
ccagcuggaucaguucuca

SEQ ID NO: 436204 - RNA, 19 nt, Homo sapiens
cgacgagacccuccacagu

SEQ ID NO: 436205 - RNA, 19 nt, Homo sapiens
aaacuguucacuucccaaa

SEQ ID NO: 436206 - RNA, 19 nt, Homo sapiens
ugccuuuaauccacuguaa

SEQ ID NO: 436207 - RNA, 19 nt, Homo sapiens
gggcucacuccaugucaaa

SEQ ID NO: 436208 - RNA, 19 nt, Homo sapiens
caacuccaaguccacagaa

SEQ ID NO: 436209 - RNA, 19 nt, Homo sapiens
aaacaugguuccaaaacug

SEQ ID NO: 436210 - RNA, 19 nt, Homo sapiens
cagcaucuguccucaucag

SEQ ID NO: 436211 - RNA, 19 nt, Homo sapiens
guccucaucagucuccaua

SEQ ID NO: 436212 - RNA, 19 nt, Homo sapiens
ugacaacagagaucaacga

SEQ ID NO: 436213 - RNA, 19 nt, Homo sapiens
acuccaaguccacagaaua

SEQ ID NO: 436214 - RNA, 19 nt, Homo sapiens
guggaagccaggugccuuu

SEQ ID NO: 436215 - RNA, 19 nt, Homo sapiens
ucccagcaaugcaccaaug

SEQ ID NO: 436216 - RNA, 19 nt, Homo sapiens
agaacaaccagcuggauca

SEQ ID NO: 436217 - RNA, 19 nt, Homo sapiens
cuguucacuucccaaauuu

SEQ ID NO: 436218 - RNA, 19 nt, Homo sapiens
ucccaucucuccauauacu

SEQ ID NO: 436219 - RNA, 19 nt, Homo sapiens
ccucaaucauagccaagau

SEQ ID NO: 436220 - RNA, 19 nt, Homo sapiens
aaucaucuaagcuccugua

SEQ ID NO: 436221 - RNA, 19 nt, Homo sapiens
gacaccagcaaacauguuc

SEQ ID NO: 436222 - RNA, 19 nt, Homo sapiens
auacuuuccuucuuacaac

SEQ ID NO: 436223 - RNA, 19 nt, Homo sapiens
acccagcacaucaauauga

SEQ ID NO: 436224 - RNA, 19 nt, Homo sapiens
guucacuucccaaauuugu

SEQ ID NO: 436225 - RNA, 19 nt, Homo sapiens
ucagcacuccucaucauca

SEQ ID NO: 436226 - RNA, 19 nt, Homo sapiens
cauguucuauauaguugca

SEQ ID NO: 436227 - RNA, 19 nt, Homo sapiens
caccagcaaacauguucua

SEQ ID NO: 436228 - RNA, 19 nt, Homo sapiens
aaauaugaccuguccuagu

SEQ ID NO: 436229 - RNA, 19 nt, Homo sapiens
gagacugggaaacaugguu

SEQ ID NO: 436230 - RNA, 19 nt, Homo sapiens
ugaccuguccuaguaacaa

SEQ ID NO: 436231 - RNA, 19 nt, Homo sapiens
augcaggucauuaacaauu

SEQ ID NO: 436232 - RNA, 19 nt, Homo sapiens
uaacagaacucucaacaau

SEQ ID NO: 436233 - RNA, 19 nt, Homo sapiens
ggaaggagguucuauguag

SEQ ID NO: 436234 - RNA, 19 nt, Homo sapiens
caucuaagcuccuguauca

SEQ ID NO: 436235 - RNA, 19 nt, Homo sapiens
acagaacucucaacaauug

SEQ ID NO: 436236 - RNA, 19 nt, Homo sapiens
gagcugaaguccuugugaa

SEQ ID NO: 436237 - RNA, 19 nt, Homo sapiens
aguauacgcugcccucaua

SEQ ID NO: 436238 - RNA, 19 nt, Homo sapiens
gccaagcuccucaaucaua

SEQ ID NO: 436239 - RNA, 19 nt, Homo sapiens
gaaggagguucuauguagu

SEQ ID NO: 436240 - RNA, 19 nt, Homo sapiens
uaaacugcuuugcaaauuc

SEQ ID NO: 436241 - RNA, 19 nt, Homo sapiens
acaaccagcuggaucaguu

SEQ ID NO: 436242 - RNA, 19 nt, Homo sapiens
gcaaugcgggcaauuaaca

SEQ ID NO: 436243 - RNA, 19 nt, Homo sapiens
gaucccaucccuccaugua

SEQ ID NO: 436244 - RNA, 19 nt, Homo sapiens
aaacugcuuugcaaauuca

SEQ ID NO: 436245 - RNA, 19 nt, Homo sapiens
cugccaagcuccucaauca

SEQ ID NO: 436246 - RNA, 19 nt, Homo sapiens
cacagaauauuucaaacug

SEQ ID NO: 436247 - RNA, 19 nt, Homo sapiens
gcacagaauauuucaaacu

SEQ ID NO: 436248 - RNA, 19 nt, Homo sapiens
gugcacagaauauuucaaa

SEQ ID NO: 436249 - RNA, 19 nt, Homo sapiens
guaguuaauguuuguggua

SEQ ID NO: 436250 - RNA, 19 nt, Homo sapiens
acuguucacuucccaaauu

SEQ ID NO: 436251 - RNA, 19 nt, Homo sapiens
gcucagagacugggaaaca

SEQ ID NO: 436252 - RNA, 19 nt, Homo sapiens
ccaagcuccucaaucauag

SEQ ID NO: 436253 - RNA, 19 nt, Homo sapiens
gcagacagaccaggaagga

SEQ ID NO: 436254 - RNA, 19 nt, Homo sapiens
gagguucuauguaguugca

SEQ ID NO: 436255 - RNA, 19 nt, Homo sapiens
ccaggugcacagaauauuu

SEQ ID NO: 436256 - RNA, 19 nt, Homo sapiens
ccucauaacagaacucuca

SEQ ID NO: 436257 - RNA, 19 nt, Homo sapiens
guacaacuuuugcuaaugu

SEQ ID NO: 436258 - RNA, 19 nt, Homo sapiens
ccacugugaccucauaaau

SEQ ID NO: 436259 - RNA, 19 nt, Homo sapiens
uacgagggcucagugguuu

SEQ ID NO: 436260 - RNA, 19 nt, Homo sapiens
caaauuugucugcuucuuc

SEQ ID NO: 436261 - RNA, 19 nt, Homo sapiens
caauaaacugcuuugcaaa

SEQ ID NO: 436262 - RNA, 19 nt, Homo sapiens
guagauuccgggugccuuu

SEQ ID NO: 436263 - RNA, 19 nt, Homo sapiens
ccaaauuugucugcuucuu

SEQ ID NO: 436264 - RNA, 19 nt, Homo sapiens
ugugaacccugcaauaaac

SEQ ID NO: 436265 - RNA, 19 nt, Homo sapiens
gaacucucaacaauuguca

SEQ ID NO: 436266 - RNA, 19 nt, Homo sapiens
acgcugcccucauaacaga

SEQ ID NO: 436267 - RNA, 19 nt, Homo sapiens
aaauuugucugcuucuucu

SEQ ID NO: 436268 - RNA, 19 nt, Homo sapiens
uuccugagcugaaguccuu

SEQ ID NO: 436269 - RNA, 19 nt, Homo sapiens
ucuauguaguugcauguga

SEQ ID NO: 436270 - RNA, 19 nt, Homo sapiens
cauaacagaacucucaaca

SEQ ID NO: 436271 - RNA, 19 nt, Homo sapiens
acuccacugugaccucaua

SEQ ID NO: 436272 - RNA, 19 nt, Homo sapiens
caggaaggagguucuaugu

SEQ ID NO: 436273 - RNA, 19 nt, Homo sapiens
aaauccaggugcacagaau

SEQ ID NO: 436274 - RNA, 19 nt, Homo sapiens
cuugugaacccugcaauaa

SEQ ID NO: 436275 - RNA, 19 nt, Homo sapiens
ccagcuggaucaguucuca

SEQ ID NO: 436276 - RNA, 19 nt, Homo sapiens
ccaggaaggagguucuaug

SEQ ID NO: 436277 - RNA, 19 nt, Homo sapiens
gaaacaugguuccaaaacu

SEQ ID NO: 436278 - RNA, 19 nt, Homo sapiens
aaacuguucacuucccaaa

SEQ ID NO: 436279 - RNA, 19 nt, Homo sapiens
ugccuuuacuccacuguga

SEQ ID NO: 436280 - RNA, 19 nt, Homo sapiens
aaacaugguuccaaaacug

SEQ ID NO: 436281 - RNA, 19 nt, Homo sapiens
cagcaacuguccucaucag

SEQ ID NO: 436282 - RNA, 19 nt, Homo sapiens
caagaucccaucccuccau

SEQ ID NO: 436283 - RNA, 19 nt, Homo sapiens
guccucaucagucuccaua

SEQ ID NO: 436284 - RNA, 19 nt, Homo sapiens
cuguucacuucccaaauuu

SEQ ID NO: 436285 - RNA, 19 nt, Homo sapiens
uuacgagggcucagugguu

SEQ ID NO: 436286 - RNA, 19 nt, Homo sapiens
agaacaaccagcuggauca

SEQ ID NO: 436287 - RNA, 19 nt, Homo sapiens
uaaauccaggugcacagaa

SEQ ID NO: 436288 - RNA, 19 nt, Homo sapiens
ccucaaucauagccaagau

SEQ ID NO: 436289 - RNA, 19 nt, Homo sapiens
ucagagacugggaaacaug

SEQ ID NO: 436290 - RNA, 19 nt, Homo sapiens
caggugcacagaauauuuc

SEQ ID NO: 436291 - RNA, 19 nt, Homo sapiens
guucacuucccaaauuugu

SEQ ID NO: 436292 - RNA, 19 nt, Homo sapiens
gagacugggaaacaugguu

SEQ ID NO: 436293 - RNA, 19 nt, Homo sapiens
acugugaccucauaaaucc

SEQ ID NO: 436294 - RNA, 19 nt, Homo sapiens
caccaucuaagcuccugua

SEQ ID NO: 436295 - RNA, 19 nt, Homo sapiens
aacagaacucucaacaauu

SEQ ID NO: 436296 - RNA, 19 nt, Homo sapiens
aauuaucgauggcguugca

SEQ ID NO: 436297 - RNA, 19 nt, Homo sapiens
gaagauaucuggaacauuc

SEQ ID NO: 436298 - RNA, 19 nt, Homo sapiens
gcugaagacuguaaaguua

SEQ ID NO: 436299 - RNA, 19 nt, Homo sapiens
ggaaauguaugccagcaaa

SEQ ID NO: 436300 - RNA, 19 nt, Homo sapiens
ggaagaagcgggugagaaa

SEQ ID NO: 436301 - RNA, 19 nt, Homo sapiens
gacggaagaugacuuugua

SEQ ID NO: 436302 - RNA, 19 nt, Homo sapiens
ccacagcacuuauaaugau

SEQ ID NO: 436303 - RNA, 19 nt, Homo sapiens
gcagaggacccauucauug

SEQ ID NO: 436304 - RNA, 19 nt, Homo sapiens
gcucaaaguuaagggauuu

SEQ ID NO: 436305 - RNA, 19 nt, Homo sapiens
gaacugccaugagggugua

SEQ ID NO: 436306 - RNA, 19 nt, Homo sapiens
cuccucagcucauuucuua

SEQ ID NO: 436307 - RNA, 19 nt, Homo sapiens
gauccuauccuguggaauu

SEQ ID NO: 436308 - RNA, 19 nt, Homo sapiens
gacauaaaccuguaaugaa

SEQ ID NO: 436309 - RNA, 19 nt, Homo sapiens
gcacccaacugcagauauc

SEQ ID NO: 436310 - RNA, 19 nt, Homo sapiens
ggaagaugacuuuguauca

SEQ ID NO: 436311 - RNA, 19 nt, Homo sapiens
gggauuugcugaagacugu

SEQ ID NO: 436312 - RNA, 19 nt, Homo sapiens
ggagacagguggcagugau

SEQ ID NO: 436313 - RNA, 19 nt, Homo sapiens
uaugugcucuuacugauug

SEQ ID NO: 436314 - RNA, 19 nt, Homo sapiens
gaaucacccuaguaaguca

SEQ ID NO: 436315 - RNA, 19 nt, Homo sapiens
ccaaagagauauggagaca

SEQ ID NO: 436316 - RNA, 19 nt, Homo sapiens
gcaagaacggcaagaugaa

SEQ ID NO: 436317 - RNA, 19 nt, Homo sapiens
gugguugaccuuacacuua

SEQ ID NO: 436318 - RNA, 19 nt, Homo sapiens
ccaccaauauccaaugcaa

SEQ ID NO: 436319 - RNA, 19 nt, Homo sapiens
agacauaaaccuguaauga

SEQ ID NO: 436320 - RNA, 19 nt, Homo sapiens
gaagaugacuuuguaucac

SEQ ID NO: 436321 - RNA, 19 nt, Homo sapiens
gcaacuugaugaugcaaag

SEQ ID NO: 436322 - RNA, 19 nt, Homo sapiens
gaucgcuacugcaacuuga

SEQ ID NO: 436323 - RNA, 19 nt, Homo sapiens
gcacuuugacgguuagaug

SEQ ID NO: 436324 - RNA, 19 nt, Homo sapiens
uauaauacuggucagcuua

SEQ ID NO: 436325 - RNA, 19 nt, Homo sapiens
uaaauacauugcaccaaag

SEQ ID NO: 436326 - RNA, 19 nt, Homo sapiens
uaauaccacagcacuuaua

SEQ ID NO: 436327 - RNA, 19 nt, Homo sapiens
gcucauuucuuacucuuuu

SEQ ID NO: 436328 - RNA, 19 nt, Homo sapiens
uaaauagcagugaguaaug

SEQ ID NO: 436329 - RNA, 19 nt, Homo sapiens
cacuagacguguugucauu

SEQ ID NO: 436330 - RNA, 19 nt, Homo sapiens
ccuguggaauuuaguuauu

SEQ ID NO: 436331 - RNA, 19 nt, Homo sapiens
gggauuaucgcgagugguu

SEQ ID NO: 436332 - RNA, 19 nt, Homo sapiens
gguuagaugccaccaugua

SEQ ID NO: 436333 - RNA, 19 nt, Homo sapiens
gaggacccauucauugcuu

SEQ ID NO: 436334 - RNA, 19 nt, Homo sapiens
gcaagcgcuucaacaccuu

SEQ ID NO: 436335 - RNA, 19 nt, Homo sapiens
caaggaauguuuugaaagu

SEQ ID NO: 436336 - RNA, 19 nt, Homo sapiens
guuaauggaagaauugaga

SEQ ID NO: 436337 - RNA, 19 nt, Homo sapiens
uaccacagcacuuauaaug

SEQ ID NO: 436338 - RNA, 19 nt, Homo sapiens
gcgagugguugaccuuaca

SEQ ID NO: 436339 - RNA, 19 nt, Homo sapiens
uuuaauaccacagcacuua

SEQ ID NO: 436340 - RNA, 19 nt, Homo sapiens
agacuuaugugcucuuacu

SEQ ID NO: 436341 - RNA, 19 nt, Homo sapiens
cugcagauaucgggccaua

SEQ ID NO: 436342 - RNA, 19 nt, Homo sapiens
guuaagggauuugcugaag

SEQ ID NO: 436343 - RNA, 19 nt, Homo sapiens
gaccuuacacuuacuccuu

SEQ ID NO: 436344 - RNA, 19 nt, Homo sapiens
cagauccuauccuguggaa

SEQ ID NO: 436345 - RNA, 19 nt, Homo sapiens
augcaaagcaggauucaaa

SEQ ID NO: 436346 - RNA, 19 nt, Homo sapiens
acacuuacuccuuaaauag

SEQ ID NO: 436347 - RNA, 19 nt, Homo sapiens
uaagggauuugcugaagac

SEQ ID NO: 436348 - RNA, 19 nt, Homo sapiens
caaaacuucuuuccauugu

SEQ ID NO: 436349 - RNA, 19 nt, Homo sapiens
uuaagggauuugcugaaga

SEQ ID NO: 436350 - RNA, 19 nt, Homo sapiens
caaaaugcuuucaucuaug

SEQ ID NO: 436351 - RNA, 19 nt, Homo sapiens
gauuaucgcgagugguuga

SEQ ID NO: 436352 - RNA, 19 nt, Homo sapiens
gcagauaucgggccauagc

SEQ ID NO: 436353 - RNA, 19 nt, Homo sapiens
aaaccgaagguaccugaaa

SEQ ID NO: 436354 - RNA, 19 nt, Homo sapiens
cauauagaagcucaaaguu

SEQ ID NO: 436355 - RNA, 19 nt, Homo sapiens
ccaugaggguguagugaag

SEQ ID NO: 436356 - RNA, 19 nt, Homo sapiens
gcaagaugaacugccauga

SEQ ID NO: 436357 - RNA, 19 nt, Homo sapiens
gaaugaggcugggcuuuuc

SEQ ID NO: 436358 - RNA, 19 nt, Homo sapiens
gcaccaccaauauccaaug

SEQ ID NO: 436359 - RNA, 19 nt, Homo sapiens
augcaaagacggaagauga

SEQ ID NO: 436360 - RNA, 19 nt, Homo sapiens
uguacuagaucauuaagac

SEQ ID NO: 436361 - RNA, 19 nt, Homo sapiens
aaugugagcucuguauuuu

SEQ ID NO: 436362 - RNA, 19 nt, Homo sapiens
gcugggcuuuucuguaaua

SEQ ID NO: 436363 - RNA, 19 nt, Homo sapiens
accuuacacuuacuccuua

SEQ ID NO: 436364 - RNA, 19 nt, Homo sapiens
ggccauagcgagcacuaga

SEQ ID NO: 436365 - RNA, 19 nt, Homo sapiens
gaagcgggugagaaacaaa

SEQ ID NO: 436366 - RNA, 19 nt, Homo sapiens
gcacuagacguguugucau

SEQ ID NO: 436367 - RNA, 19 nt, Homo sapiens
ugcaagaacggcaagauga

SEQ ID NO: 436368 - RNA, 19 nt, Homo sapiens
caaagacggaagaugacuu

SEQ ID NO: 436369 - RNA, 19 nt, Homo sapiens
cacaaggaauguuuugaaa

SEQ ID NO: 436370 - RNA, 19 nt, Homo sapiens
auggaagaauugagacaaa

SEQ ID NO: 436371 - RNA, 19 nt, Homo sapiens
acauugcaccaaagagaua

SEQ ID NO: 436372 - RNA, 19 nt, Homo sapiens
gcagugaguaaugcauuug

SEQ ID NO: 436373 - RNA, 19 nt, Homo sapiens
acauauagaagcucaaagu

SEQ ID NO: 436374 - RNA, 19 nt, Homo sapiens
uuauaauacuggucagcuu

SEQ ID NO: 436375 - RNA, 19 nt, Homo sapiens
aggcugggcuuuucuguaa

SEQ ID NO: 436376 - RNA, 19 nt, Homo sapiens
cagcucauuucuuacucuu

SEQ ID NO: 436377 - RNA, 19 nt, Homo sapiens
caaagcaggauucaaaaga

SEQ ID NO: 436378 - RNA, 19 nt, Homo sapiens
cuacauauagaagcucaaa

SEQ ID NO: 436379 - RNA, 19 nt, Homo sapiens
agaagcgggugagaaacaa

SEQ ID NO: 436380 - RNA, 19 nt, Homo sapiens
ggagacauaaaccuguaau

SEQ ID NO: 436381 - RNA, 19 nt, Homo sapiens
caagaugaacugccaugag

SEQ ID NO: 436382 - RNA, 19 nt, Homo sapiens
ucuggaacauucguaguau

SEQ ID NO: 436383 - RNA, 19 nt, Homo sapiens
aaagcaggauucaaaagaa

SEQ ID NO: 436384 - RNA, 19 nt, Homo sapiens
cuguaaaguuaauggaaga

SEQ ID NO: 436385 - RNA, 19 nt, Homo sapiens
ccuauccuguggaauuuag

SEQ ID NO: 436386 - RNA, 19 nt, Homo sapiens
cauaaaccuguaaugaaug

SEQ ID NO: 436387 - RNA, 19 nt, Homo sapiens
gaacaucuuugcguuuucu

SEQ ID NO: 436388 - RNA, 19 nt, Homo sapiens
auacauugcaccaaagaga

SEQ ID NO: 436389 - RNA, 19 nt, Homo sapiens
gauaucuggaacauucgua

SEQ ID NO: 436390 - RNA, 19 nt, Homo sapiens
gacuguaaaguuaauggaa

SEQ ID NO: 436391 - RNA, 19 nt, Homo sapiens
gcccguuucugcggacuug

SEQ ID NO: 436392 - RNA, 19 nt, Homo sapiens
gccaugaggguguagugaa

SEQ ID NO: 436393 - RNA, 19 nt, Homo sapiens
cugaagacuguaaaguuaa

SEQ ID NO: 436394 - RNA, 19 nt, Homo sapiens
gauuugcugaagacuguaa

SEQ ID NO: 436395 - RNA, 19 nt, Homo sapiens
aauaccacagcacuuauaa

SEQ ID NO: 436396 - RNA, 19 nt, Homo sapiens
cuuaugugcucuuacugau

SEQ ID NO: 436397 - RNA, 19 nt, Homo sapiens
gaacaggugugaaagucua

SEQ ID NO: 436398 - RNA, 19 nt, Homo sapiens
ugacauagcuucuguuaca

SEQ ID NO: 436399 - RNA, 19 nt, Homo sapiens
ugaguggcaucaacaauua

SEQ ID NO: 436400 - RNA, 19 nt, Homo sapiens
gcaaagaaagauucagauu

SEQ ID NO: 436401 - RNA, 19 nt, Homo sapiens
gaaagguguuuggagaauu

SEQ ID NO: 436402 - RNA, 19 nt, Homo sapiens
ucagucauguuguuucuuu

SEQ ID NO: 436403 - RNA, 19 nt, Homo sapiens
gugaaagucuaagaguuua

SEQ ID NO: 436404 - RNA, 19 nt, Homo sapiens
gcucaaagccugucaacau

SEQ ID NO: 436405 - RNA, 19 nt, Homo sapiens
guugguuccuguacacuua

SEQ ID NO: 436406 - RNA, 19 nt, Homo sapiens
cuucugagcuuuggacuaa

SEQ ID NO: 436407 - RNA, 19 nt, Homo sapiens
gguuuagccuuccuguaua

SEQ ID NO: 436408 - RNA, 19 nt, Homo sapiens
uuaaagaacaggugugaaa

SEQ ID NO: 436409 - RNA, 19 nt, Homo sapiens
gaauagggaagacagcaaa

SEQ ID NO: 436410 - RNA, 19 nt, Homo sapiens
gcucagcauugucugcaaa

SEQ ID NO: 436411 - RNA, 19 nt, Homo sapiens
ggaagacagcaaagaaaga

SEQ ID NO: 436412 - RNA, 19 nt, Homo sapiens
gaaagaagaaagguguuug

SEQ ID NO: 436413 - RNA, 19 nt, Homo sapiens
caguacaaauucuucauug

SEQ ID NO: 436414 - RNA, 19 nt, Homo sapiens
gaagaaaggcagacaacag

SEQ ID NO: 436415 - RNA, 19 nt, Homo sapiens
caaguccucuccaaugcaa

SEQ ID NO: 436416 - RNA, 19 nt, Homo sapiens
cauagcuucuguuacaauu

SEQ ID NO: 436417 - RNA, 19 nt, Homo sapiens
ccuguacacuuagauagua

SEQ ID NO: 436418 - RNA, 19 nt, Homo sapiens
gugcuaugcuuuccucuuc

SEQ ID NO: 436419 - RNA, 19 nt, Homo sapiens
gaagacagcaaagaaagau

SEQ ID NO: 436420 - RNA, 19 nt, Homo sapiens
uaaggcauccacugcauuu

SEQ ID NO: 436421 - RNA, 19 nt, Homo sapiens
aaagguguuuggagaauuc

SEQ ID NO: 436422 - RNA, 19 nt, Homo sapiens
gcaaugaguggcaucaaca

SEQ ID NO: 436423 - RNA, 19 nt, Homo sapiens
gaaaggcagacaacagcuu

SEQ ID NO: 436424 - RNA, 19 nt, Homo sapiens
ugugaaagucuaagaguuu

SEQ ID NO: 436425 - RNA, 19 nt, Homo sapiens
agaccagaguugagacaaa

SEQ ID NO: 436426 - RNA, 19 nt, Homo sapiens
gcucacugguuugaaauuc

SEQ ID NO: 436427 - RNA, 19 nt, Homo sapiens
cagcaaagaaagauucaga

SEQ ID NO: 436428 - RNA, 19 nt, Homo sapiens
uuucuaacccugcaacuuu

SEQ ID NO: 436429 - RNA, 19 nt, Homo sapiens
gaauucgagugccuaggau

SEQ ID NO: 436430 - RNA, 19 nt, Homo sapiens
acacuuagauaguauucuc

SEQ ID NO: 436431 - RNA, 19 nt, Homo sapiens
gugugaaagucuaagaguu

SEQ ID NO: 436432 - RNA, 19 nt, Homo sapiens
agaaagguguuuggagaau

SEQ ID NO: 436433 - RNA, 19 nt, Homo sapiens
gcuaugcuuuccucuucuu

SEQ ID NO: 436434 - RNA, 19 nt, Homo sapiens
cagaaaagauggugcuaug

SEQ ID NO: 436435 - RNA, 19 nt, Homo sapiens
ucgaaggguuagagaagaa

SEQ ID NO: 436436 - RNA, 19 nt, Homo sapiens
gagaagggaauagggaaga

SEQ ID NO: 436437 - RNA, 19 nt, Homo sapiens
cagacucacuucaggaaag

SEQ ID NO: 436438 - RNA, 19 nt, Homo sapiens
ggaauagggaagacagcaa

SEQ ID NO: 436439 - RNA, 19 nt, Homo sapiens
ugcauuuccuuucauuuga

SEQ ID NO: 436440 - RNA, 19 nt, Homo sapiens
cucaaagccugucaacaug

SEQ ID NO: 436441 - RNA, 19 nt, Homo sapiens
aaggcucacugguuugaaa

SEQ ID NO: 436442 - RNA, 19 nt, Homo sapiens
gaccagaguugagacaaaa

SEQ ID NO: 436443 - RNA, 19 nt, Homo sapiens
ccaguacaaauucuucauu

SEQ ID NO: 436444 - RNA, 19 nt, Homo sapiens
gagaagaaaggcagacaac

SEQ ID NO: 436445 - RNA, 19 nt, Homo sapiens
gggaagacagcaaagaaag

SEQ ID NO: 436446 - RNA, 19 nt, Homo sapiens
gacauagcuucuguuacaa

SEQ ID NO: 436447 - RNA, 19 nt, Homo sapiens
gccaaguccucuccaaugc

SEQ ID NO: 436448 - RNA, 19 nt, Homo sapiens
ggccuaagcgucucaccaa

SEQ ID NO: 436449 - RNA, 19 nt, Homo sapiens
cagucauguuguuucuuua

SEQ ID NO: 436450 - RNA, 19 nt, Homo sapiens
aagaacaggugugaaaguc

SEQ ID NO: 436451 - RNA, 19 nt, Homo sapiens
ccacugcauuuccuuucau

SEQ ID NO: 436452 - RNA, 19 nt, Homo sapiens
caaguugguuccuguacac

SEQ ID NO: 436453 - RNA, 19 nt, Homo sapiens
ucaaagccugucaacauga

SEQ ID NO: 436454 - RNA, 19 nt, Homo sapiens
gcucgaaggguuagagaag

SEQ ID NO: 436455 - RNA, 19 nt, Homo sapiens
uagccuuccuguauacaug

SEQ ID NO: 436456 - RNA, 19 nt, Homo sapiens
uagggaagacagcaaagaa

SEQ ID NO: 436457 - RNA, 19 nt, Homo sapiens
agaaagaagaaagguguuu

SEQ ID NO: 436458 - RNA, 19 nt, Homo sapiens
cauuugacauagcuucugu

SEQ ID NO: 436459 - RNA, 19 nt, Homo sapiens
gcagacucacuucaggaaa

SEQ ID NO: 436460 - RNA, 19 nt, Homo sapiens
ggcaaugaguggcaucaac

SEQ ID NO: 436461 - RNA, 19 nt, Homo sapiens
gaaguuaaucugccaaacc

SEQ ID NO: 436462 - RNA, 19 nt, Homo sapiens
uacaauugcauccacguuu

SEQ ID NO: 436463 - RNA, 19 nt, Homo sapiens
uggcugcugucugugauuu

SEQ ID NO: 436464 - RNA, 19 nt, Homo sapiens
ugguuuagccuuccuguau

SEQ ID NO: 436465 - RNA, 19 nt, Homo sapiens
agacagcaaagaaagauuc

SEQ ID NO: 436466 - RNA, 19 nt, Homo sapiens
aaaauaccuuucugcauga

SEQ ID NO: 436467 - RNA, 19 nt, Homo sapiens
caaugcaacagggcaauga

SEQ ID NO: 436468 - RNA, 19 nt, Homo sapiens
ccaaggcucacugguuuga

SEQ ID NO: 436469 - RNA, 19 nt, Homo sapiens
cuguauacaugugauaaug

SEQ ID NO: 436470 - RNA, 19 nt, Homo sapiens
gcuuuguaguucuguacuu

SEQ ID NO: 436471 - RNA, 19 nt, Homo sapiens
guagaagaaagaagaaagg

SEQ ID NO: 436472 - RNA, 19 nt, Homo sapiens
uagcuucuguuacaauugc

SEQ ID NO: 436473 - RNA, 19 nt, Homo sapiens
acaaguugguuccuguaca

SEQ ID NO: 436474 - RNA, 19 nt, Homo sapiens
cagcauauacagccaaguc

SEQ ID NO: 436475 - RNA, 19 nt, Homo sapiens
cuuuguaguucuguacuuu

SEQ ID NO: 436476 - RNA, 19 nt, Homo sapiens
cugcauuuccuuucauuug

SEQ ID NO: 436477 - RNA, 19 nt, Homo sapiens
caacuuuugccaagcuuua

SEQ ID NO: 436478 - RNA, 19 nt, Homo sapiens
agaauucgagugccuagga

SEQ ID NO: 436479 - RNA, 19 nt, Homo sapiens
caugugauaaugauacugu

SEQ ID NO: 436480 - RNA, 19 nt, Homo sapiens
uuugacauagcuucuguua

SEQ ID NO: 436481 - RNA, 19 nt, Homo sapiens
gcauuuccuuucauuugac

SEQ ID NO: 436482 - RNA, 19 nt, Homo sapiens
guuccuguacacuuagaua

SEQ ID NO: 436483 - RNA, 19 nt, Homo sapiens
aaagaacaggugugaaagu

SEQ ID NO: 436484 - RNA, 19 nt, Homo sapiens
ggauucuccuucugaaagc

SEQ ID NO: 436485 - RNA, 19 nt, Homo sapiens
acaauugcauccacguuuu

SEQ ID NO: 436486 - RNA, 19 nt, Homo sapiens
aauuauacccagcacugua

SEQ ID NO: 436487 - RNA, 19 nt, Homo sapiens
ccaacacugagaccagaaa

SEQ ID NO: 436488 - RNA, 19 nt, Homo sapiens
gagcuuuggacuaaucaca

SEQ ID NO: 436489 - RNA, 19 nt, Homo sapiens
guacacuuagauaguauuc

SEQ ID NO: 436490 - RNA, 19 nt, Homo sapiens
ucugagcuuuggacuaauc

SEQ ID NO: 436491 - RNA, 19 nt, Homo sapiens
gcaggagccccaacacuga

SEQ ID NO: 436492 - RNA, 19 nt, Homo sapiens
gaagggaauagggaagaca

SEQ ID NO: 436493 - RNA, 19 nt, Homo sapiens
guuuagccuuccuguauac

SEQ ID NO: 436494 - RNA, 19 nt, Homo sapiens
uaaagaacaggugugaaag

SEQ ID NO: 436495 - RNA, 19 nt, Homo sapiens
ucuaaggcauccacugcau

SEQ ID NO: 436496 - RNA, 19 nt, Homo sapiens
cugcugcccaguacaaauu

SEQ ID NO: 436497 - RNA, 19 nt, Homo sapiens
gaaauguccugucaucuau

SEQ ID NO: 436498 - RNA, 19 nt, Homo sapiens
cgacuaagauuaaugaaug

SEQ ID NO: 436499 - RNA, 19 nt, Homo sapiens
gaagguggagccaauguua

SEQ ID NO: 436500 - RNA, 19 nt, Homo sapiens
gagaacacauugaugaaga

SEQ ID NO: 436501 - RNA, 19 nt, Homo sapiens
ggaagucucuugucugcaa

SEQ ID NO: 436502 - RNA, 19 nt, Homo sapiens
guaaacgccugugacaaua

SEQ ID NO: 436503 - RNA, 19 nt, Homo sapiens
gaggagggacucagauuua

SEQ ID NO: 436504 - RNA, 19 nt, Homo sapiens
caaacaagccucaguguga

SEQ ID NO: 436505 - RNA, 19 nt, Homo sapiens
ggacugauuugcuggaguu

SEQ ID NO: 436506 - RNA, 19 nt, Homo sapiens
caagugggaauguuuaaua

SEQ ID NO: 436507 - RNA, 19 nt, Homo sapiens
ggacucagauuuauuuacu

SEQ ID NO: 436508 - RNA, 19 nt, Homo sapiens
ugaaggaucuccacagaau

SEQ ID NO: 436509 - RNA, 19 nt, Homo sapiens
gccagagaaucccaauuua

SEQ ID NO: 436510 - RNA, 19 nt, Homo sapiens
ggagguaucuagcaaugga

SEQ ID NO: 436511 - RNA, 19 nt, Homo sapiens
gaagaggugguucaacuuu

SEQ ID NO: 436512 - RNA, 19 nt, Homo sapiens
gaagggaagcaucucauuu

SEQ ID NO: 436513 - RNA, 19 nt, Homo sapiens
gaacacagaauauagaaag

SEQ ID NO: 436514 - RNA, 19 nt, Homo sapiens
ggaaaugaauccgacauca

SEQ ID NO: 436515 - RNA, 19 nt, Homo sapiens
gaucugaaagcucaaagua

SEQ ID NO: 436516 - RNA, 19 nt, Homo sapiens
uagaagggcugcaguggaa

SEQ ID NO: 436517 - RNA, 19 nt, Homo sapiens
ggcccaagauuauucaauu

SEQ ID NO: 436518 - RNA, 19 nt, Homo sapiens
gaccagggaugcugccaaa

SEQ ID NO: 436519 - RNA, 19 nt, Homo sapiens
ggacgacuaagauuaauga

SEQ ID NO: 436520 - RNA, 19 nt, Homo sapiens
caagagcacauagagauua

SEQ ID NO: 436521 - RNA, 19 nt, Homo sapiens
cgaaauguccugucaucua

SEQ ID NO: 436522 - RNA, 19 nt, Homo sapiens
ugaagauucuccuugauga

SEQ ID NO: 436523 - RNA, 19 nt, Homo sapiens
gcauaacgcaguacaaaug

SEQ ID NO: 436524 - RNA, 19 nt, Homo sapiens
gagggacucagauuuauuu

SEQ ID NO: 436525 - RNA, 19 nt, Homo sapiens
ccagggcucuuccagauga

SEQ ID NO: 436526 - RNA, 19 nt, Homo sapiens
uaaaggagcagaugucaau

SEQ ID NO: 436527 - RNA, 19 nt, Homo sapiens
gagcagggaucauaacaac

SEQ ID NO: 436528 - RNA, 19 nt, Homo sapiens
gcccaagauuauucaauuu

SEQ ID NO: 436529 - RNA, 19 nt, Homo sapiens
cagaagacauuuccagauc

SEQ ID NO: 436530 - RNA, 19 nt, Homo sapiens
gaaaugaauccgacaucaa

SEQ ID NO: 436531 - RNA, 19 nt, Homo sapiens
gaacuucugcuucgucaug

SEQ ID NO: 436532 - RNA, 19 nt, Homo sapiens
gaaccaucuucguacauga

SEQ ID NO: 436533 - RNA, 19 nt, Homo sapiens
gaagacauuuccagaucug

SEQ ID NO: 436534 - RNA, 19 nt, Homo sapiens
uaaaguucauccggaauuu

SEQ ID NO: 436535 - RNA, 19 nt, Homo sapiens
ucugaaagcucaaaguaau

SEQ ID NO: 436536 - RNA, 19 nt, Homo sapiens
uugugaagcuuacucaaua

SEQ ID NO: 436537 - RNA, 19 nt, Homo sapiens
ugaaugaaccaucuucgua

SEQ ID NO: 436538 - RNA, 19 nt, Homo sapiens
gggaagauguggaaaauga

SEQ ID NO: 436539 - RNA, 19 nt, Homo sapiens
gaugaggaaacuaagguua

SEQ ID NO: 436540 - RNA, 19 nt, Homo sapiens
cuacagaacacagaauaua

SEQ ID NO: 436541 - RNA, 19 nt, Homo sapiens
cauaagcuuuacccacuaa

SEQ ID NO: 436542 - RNA, 19 nt, Homo sapiens
caucguguauuccauaugu

SEQ ID NO: 436543 - RNA, 19 nt, Homo sapiens
gaacuacuuauuagcugua

SEQ ID NO: 436544 - RNA, 19 nt, Homo sapiens
gaauauaccgcccuaugau

SEQ ID NO: 436545 - RNA, 19 nt, Homo sapiens
agaagaagcacuuggguuu

SEQ ID NO: 436546 - RNA, 19 nt, Homo sapiens
ucagggaacuacuuauuag

SEQ ID NO: 436547 - RNA, 19 nt, Homo sapiens
gaauuugggagaacacauu

SEQ ID NO: 436548 - RNA, 19 nt, Homo sapiens
gcuaggagauaaauuugca

SEQ ID NO: 436549 - RNA, 19 nt, Homo sapiens
guauagcuaggaaguguua

SEQ ID NO: 436550 - RNA, 19 nt, Homo sapiens
gagaaaaccugacuuaagg

SEQ ID NO: 436551 - RNA, 19 nt, Homo sapiens
ugggugaucugcuaaaguu

SEQ ID NO: 436552 - RNA, 19 nt, Homo sapiens
gaaagacaaaggaggauca

SEQ ID NO: 436553 - RNA, 19 nt, Homo sapiens
caccuggacaugucaauua

SEQ ID NO: 436554 - RNA, 19 nt, Homo sapiens
gcuaggaaguguuacuauc

SEQ ID NO: 436555 - RNA, 19 nt, Homo sapiens
gaucuguagugauggaguu

SEQ ID NO: 436556 - RNA, 19 nt, Homo sapiens
guccugucaucuauauuua

SEQ ID NO: 436557 - RNA, 19 nt, Homo sapiens
ugacagcgaggcggaauua

SEQ ID NO: 436558 - RNA, 19 nt, Homo sapiens
gagaggagcaaaugugaau

SEQ ID NO: 436559 - RNA, 19 nt, Homo sapiens
gagauggagcuuuguaaug

SEQ ID NO: 436560 - RNA, 19 nt, Homo sapiens
ccaaugaucuugcaaaaca

SEQ ID NO: 436561 - RNA, 19 nt, Homo sapiens
aaaugaauccgacaucaaa

SEQ ID NO: 436562 - RNA, 19 nt, Homo sapiens
caaaauugcugauacuuca

SEQ ID NO: 436563 - RNA, 19 nt, Homo sapiens
gaaggaucuccacagaaua

SEQ ID NO: 436564 - RNA, 19 nt, Homo sapiens
gcaagagcacauagagauu

SEQ ID NO: 436565 - RNA, 19 nt, Homo sapiens
gacaauaugggcagaaaug

SEQ ID NO: 436566 - RNA, 19 nt, Homo sapiens
ggucaaagcccuaaaauuc

SEQ ID NO: 436567 - RNA, 19 nt, Homo sapiens
cagcgaggcggaauuauga

SEQ ID NO: 436568 - RNA, 19 nt, Homo sapiens
ggaauaaaacaguaccuua

SEQ ID NO: 436569 - RNA, 19 nt, Homo sapiens
aaacuuaacuauccuucca

SEQ ID NO: 436570 - RNA, 19 nt, Homo sapiens
cauggaagccgcuguguau

SEQ ID NO: 436571 - RNA, 19 nt, Homo sapiens
gcgugaagcugcugaaacu

SEQ ID NO: 436572 - RNA, 19 nt, Homo sapiens
gauuaaagcuguucaaaac

SEQ ID NO: 436573 - RNA, 19 nt, Homo sapiens
gguagcagguggcauuuac

SEQ ID NO: 436574 - RNA, 19 nt, Homo sapiens
ggcacuggaugcaugaauu

SEQ ID NO: 436575 - RNA, 19 nt, Homo sapiens
ggugaucuaugucuacaca

SEQ ID NO: 436576 - RNA, 19 nt, Homo sapiens
ggagacccuucccuguauu

SEQ ID NO: 436577 - RNA, 19 nt, Homo sapiens
gcuggacaccucugcauaa

SEQ ID NO: 436578 - RNA, 19 nt, Homo sapiens
gcuggaagguggagccaau

SEQ ID NO: 436579 - RNA, 19 nt, Homo sapiens
caucuucguacaugaauaa

SEQ ID NO: 436580 - RNA, 19 nt, Homo sapiens
uaucuucacugccaagcaa

SEQ ID NO: 436581 - RNA, 19 nt, Homo sapiens
uaucaauggugcugagguu

SEQ ID NO: 436582 - RNA, 19 nt, Homo sapiens
guuacaauucucucacuua

SEQ ID NO: 436583 - RNA, 19 nt, Homo sapiens
ggaggacauucugcuaaga

SEQ ID NO: 436584 - RNA, 19 nt, Homo sapiens
ugaucuaugucuacacaaa

SEQ ID NO: 436585 - RNA, 19 nt, Homo sapiens
cacaggaagucaagagaga

SEQ ID NO: 436586 - RNA, 19 nt, Homo sapiens
gugaagcugcugaaacuuu

SEQ ID NO: 436587 - RNA, 19 nt, Homo sapiens
uugguucucugauuuguaa

SEQ ID NO: 436588 - RNA, 19 nt, Homo sapiens
gauaaauagauaccacuga

SEQ ID NO: 436589 - RNA, 19 nt, Homo sapiens
gcuacuggcccaagauuau

SEQ ID NO: 436590 - RNA, 19 nt, Homo sapiens
aaacuaaggaccucauuca

SEQ ID NO: 436591 - RNA, 19 nt, Homo sapiens
gaaucccaauuuacacuca

SEQ ID NO: 436592 - RNA, 19 nt, Homo sapiens
gaacucaaacugaagaaaa

SEQ ID NO: 436593 - RNA, 19 nt, Homo sapiens
gaagaagcacuuggguuug

SEQ ID NO: 436594 - RNA, 19 nt, Homo sapiens
agacaaaggaggaucaaga

SEQ ID NO: 436595 - RNA, 19 nt, Homo sapiens
guaaugagcaccuggacau

SEQ ID NO: 436596 - RNA, 19 nt, Homo sapiens
gcacugaagagagcauuug

SEQ ID NO: 436597 - RNA, 19 nt, Homo sapiens
aaacggaacucaaccauua

SEQ ID NO: 436598 - RNA, 19 nt, Homo sapiens
guucaaagcuucccuaauu

SEQ ID NO: 436599 - RNA, 19 nt, Homo sapiens
gagguuagcuuuagaagaa

SEQ ID NO: 436600 - RNA, 19 nt, Homo sapiens
ggaagggacugcaauuauu

SEQ ID NO: 436601 - RNA, 19 nt, Homo sapiens
ggcuagagcuugauaauaa

SEQ ID NO: 436602 - RNA, 19 nt, Homo sapiens
ugacuuggguguuauauuu

SEQ ID NO: 436603 - RNA, 19 nt, Homo sapiens
gagaaauacuggaaaguga

SEQ ID NO: 436604 - RNA, 19 nt, Homo sapiens
ccacauaaguuucaagaau

SEQ ID NO: 436605 - RNA, 19 nt, Homo sapiens
gagaagcaguauaccauuu

SEQ ID NO: 436606 - RNA, 19 nt, Homo sapiens
gcacagacgagauacauaa

SEQ ID NO: 436607 - RNA, 19 nt, Homo sapiens
caagauauguucaaagcuu

SEQ ID NO: 436608 - RNA, 19 nt, Homo sapiens
gagcacaaaugagccuuua

SEQ ID NO: 436609 - RNA, 19 nt, Homo sapiens
gcacaaaugagccuuuaaa

SEQ ID NO: 436610 - RNA, 19 nt, Homo sapiens
gacauuagauuaguaguug

SEQ ID NO: 436611 - RNA, 19 nt, Homo sapiens
uaaagucugucuagucauu

SEQ ID NO: 436612 - RNA, 19 nt, Homo sapiens
gauaggguauugaguguau

SEQ ID NO: 436613 - RNA, 19 nt, Homo sapiens
ggagauauuuugcacuuua

SEQ ID NO: 436614 - RNA, 19 nt, Homo sapiens
acagauggcuuagaaauug

SEQ ID NO: 436615 - RNA, 19 nt, Homo sapiens
ggauauaaacugcaucauu

SEQ ID NO: 436616 - RNA, 19 nt, Homo sapiens
ccagaaagcuuuguugaca

SEQ ID NO: 436617 - RNA, 19 nt, Homo sapiens
gaacaaacccauggaacuu

SEQ ID NO: 436618 - RNA, 19 nt, Homo sapiens
caaaccagaugaaccuuga

SEQ ID NO: 436619 - RNA, 19 nt, Homo sapiens
gcaagaaacaacagauuga

SEQ ID NO: 436620 - RNA, 19 nt, Homo sapiens
ugacagaucagaaauaaga

SEQ ID NO: 436621 - RNA, 19 nt, Homo sapiens
guugacagaucagaaauaa

SEQ ID NO: 436622 - RNA, 19 nt, Homo sapiens
ggauggugcuagugaaauu

SEQ ID NO: 436623 - RNA, 19 nt, Homo sapiens
aauaacagauggcuuagaa

SEQ ID NO: 436624 - RNA, 19 nt, Homo sapiens
ggcaauaacagauggcuua

SEQ ID NO: 436625 - RNA, 19 nt, Homo sapiens
uaaacugcaucauuaguga

SEQ ID NO: 436626 - RNA, 19 nt, Homo sapiens
cuugagcccugcuuuaaua

SEQ ID NO: 436627 - RNA, 19 nt, Homo sapiens
gcacacagaacaauggaaa

SEQ ID NO: 436628 - RNA, 19 nt, Homo sapiens
gaacccaaggcucaaauuu

SEQ ID NO: 436629 - RNA, 19 nt, Homo sapiens
acaaacccauggaacuuua

SEQ ID NO: 436630 - RNA, 19 nt, Homo sapiens
caaguggugugaaggcuuu

SEQ ID NO: 436631 - RNA, 19 nt, Homo sapiens
gaagcaguauaccauuuau

SEQ ID NO: 436632 - RNA, 19 nt, Homo sapiens
cgagauacauaaagacuuc

SEQ ID NO: 436633 - RNA, 19 nt, Homo sapiens
gaacucaaccauuaagcaa

SEQ ID NO: 436634 - RNA, 19 nt, Homo sapiens
uaacuaaauucccauugug

SEQ ID NO: 436635 - RNA, 19 nt, Homo sapiens
aagauugacuuggguguua

SEQ ID NO: 436636 - RNA, 19 nt, Homo sapiens
ccaguaccuuuguaacuaa

SEQ ID NO: 436637 - RNA, 19 nt, Homo sapiens
gaaacuuaguguccauugu

SEQ ID NO: 436638 - RNA, 19 nt, Homo sapiens
guaaagucauucuacuguu

SEQ ID NO: 436639 - RNA, 19 nt, Homo sapiens
cagacgagauacauaaaga

SEQ ID NO: 436640 - RNA, 19 nt, Homo sapiens
uaaagucauucuacuguuc

SEQ ID NO: 436641 - RNA, 19 nt, Homo sapiens
gaagcaaaggugaaucaaa

SEQ ID NO: 436642 - RNA, 19 nt, Homo sapiens
ggcaauugauccaguaaug

SEQ ID NO: 436643 - RNA, 19 nt, Homo sapiens
gaagcaggcccuaguaaca

SEQ ID NO: 436644 - RNA, 19 nt, Homo sapiens
ccaguaggguaaagucauu

SEQ ID NO: 436645 - RNA, 19 nt, Homo sapiens
gagcuugagcccugcuuua

SEQ ID NO: 436646 - RNA, 19 nt, Homo sapiens
gaagguuaauagagcuuga

SEQ ID NO: 436647 - RNA, 19 nt, Homo sapiens
guaucuggcugugagguua

SEQ ID NO: 436648 - RNA, 19 nt, Homo sapiens
uaauaacaaugcagcaaug

SEQ ID NO: 436649 - RNA, 19 nt, Homo sapiens
aguaaugcauccacacaua

SEQ ID NO: 436650 - RNA, 19 nt, Homo sapiens
cuagguauauuuccaacuu

SEQ ID NO: 436651 - RNA, 19 nt, Homo sapiens
gagcccugcuuuaauaugu

SEQ ID NO: 436652 - RNA, 19 nt, Homo sapiens
uaucugaaguuucuugugu

SEQ ID NO: 436653 - RNA, 19 nt, Homo sapiens
uuaaagauguacuggcauu

SEQ ID NO: 436654 - RNA, 19 nt, Homo sapiens
ucaacaagcacaauaauca

SEQ ID NO: 436655 - RNA, 19 nt, Homo sapiens
gguguaauguuaaaguugu

SEQ ID NO: 436656 - RNA, 19 nt, Homo sapiens
gaagggacugcaauuauuc

SEQ ID NO: 436657 - RNA, 19 nt, Homo sapiens
ugaaggcuuuggguacuua

SEQ ID NO: 436658 - RNA, 19 nt, Homo sapiens
aaagacauguuugcauuga

SEQ ID NO: 436659 - RNA, 19 nt, Homo sapiens
cccggagucuuguauauuu

SEQ ID NO: 436660 - RNA, 19 nt, Homo sapiens
cuacaaaggagcacaaaug

SEQ ID NO: 436661 - RNA, 19 nt, Homo sapiens
uaacagauggcuuagaaau

SEQ ID NO: 436662 - RNA, 19 nt, Homo sapiens
gagaguuauuugugacuau

SEQ ID NO: 436663 - RNA, 19 nt, Homo sapiens
uguaaucugugccaugaaa

SEQ ID NO: 436664 - RNA, 19 nt, Homo sapiens
gguguuauauuucaucucu

SEQ ID NO: 436665 - RNA, 19 nt, Homo sapiens
uaacauggcacacagaaca

SEQ ID NO: 436666 - RNA, 19 nt, Homo sapiens
gaucuuggauauguuguuc

SEQ ID NO: 436667 - RNA, 19 nt, Homo sapiens
ggaauuggucagugagaaa

SEQ ID NO: 436668 - RNA, 19 nt, Homo sapiens
guucugcugucacuucauu

SEQ ID NO: 436669 - RNA, 19 nt, Homo sapiens
gcucaaauuuacuguccuu

SEQ ID NO: 436670 - RNA, 19 nt, Homo sapiens
uuauggagaucuuggauau

SEQ ID NO: 436671 - RNA, 19 nt, Homo sapiens
ggaucaacaagcacaauaa

SEQ ID NO: 436672 - RNA, 19 nt, Homo sapiens
acauaaagacuucugguaa

SEQ ID NO: 436673 - RNA, 19 nt, Homo sapiens
acaaaggaguguuuacauc

SEQ ID NO: 436674 - RNA, 19 nt, Homo sapiens
guuuggauauguugaagaa

SEQ ID NO: 436675 - RNA, 19 nt, Homo sapiens
agacauguuugcauugaga

SEQ ID NO: 436676 - RNA, 19 nt, Homo sapiens
agaaagcuuuguugacaga

SEQ ID NO: 436677 - RNA, 19 nt, Homo sapiens
aagcaaaggugaaucaaac

SEQ ID NO: 436678 - RNA, 19 nt, Homo sapiens
gcacucaucagcaaaauuu

SEQ ID NO: 436679 - RNA, 19 nt, Homo sapiens
acauauacauagccacauu

SEQ ID NO: 436680 - RNA, 19 nt, Homo sapiens
cagagauaauggagauauu

SEQ ID NO: 436681 - RNA, 19 nt, Homo sapiens
cacuucauuuccuguauua

SEQ ID NO: 436682 - RNA, 19 nt, Homo sapiens
ucacuucauuuccuguauu

SEQ ID NO: 436683 - RNA, 19 nt, Homo sapiens
gcacaauaaucagcaagca

SEQ ID NO: 436684 - RNA, 19 nt, Homo sapiens
ccuuagaaguggcaacaaa

SEQ ID NO: 436685 - RNA, 19 nt, Homo sapiens
gcaugcccacugaauauaa

SEQ ID NO: 436686 - RNA, 19 nt, Homo sapiens
gguaaagucauucuacugu

SEQ ID NO: 436687 - RNA, 19 nt, Homo sapiens
agaagcaguauaccauuua

SEQ ID NO: 436688 - RNA, 19 nt, Homo sapiens
cauaaagacuucugguaac

SEQ ID NO: 436689 - RNA, 19 nt, Homo sapiens
ugacauauucugcugaaga

SEQ ID NO: 436690 - RNA, 19 nt, Homo sapiens
ccggagucuuguauauuua

SEQ ID NO: 436691 - RNA, 19 nt, Homo sapiens
gcugugagguuagcuuuag

SEQ ID NO: 436692 - RNA, 19 nt, Homo sapiens
gggcuagagcuugauaaua

SEQ ID NO: 436693 - RNA, 19 nt, Homo sapiens
gcacucagucacagcauug

SEQ ID NO: 436694 - RNA, 19 nt, Homo sapiens
gaucaacaagcacaauaau

SEQ ID NO: 436695 - RNA, 19 nt, Homo sapiens
gaaguggcaacaaagaaug

SEQ ID NO: 436696 - RNA, 19 nt, Homo sapiens
agaacaccaugacuacaaa

SEQ ID NO: 436697 - RNA, 19 nt, Homo sapiens
agaaagggcucaucgcuua

SEQ ID NO: 436698 - RNA, 19 nt, Homo sapiens
cagaagagauugagauuga

SEQ ID NO: 436699 - RNA, 19 nt, Homo sapiens
gaagagagcaggcccauga

SEQ ID NO: 436700 - RNA, 19 nt, Homo sapiens
ggaguuugcugcugaugua

SEQ ID NO: 436701 - RNA, 19 nt, Homo sapiens
gaaaagauauuccuacaga

SEQ ID NO: 436702 - RNA, 19 nt, Homo sapiens
ggaacuggcuuuggagaaa

SEQ ID NO: 436703 - RNA, 19 nt, Homo sapiens
caagaaagcgaaugagaaa

SEQ ID NO: 436704 - RNA, 19 nt, Homo sapiens
ggacauggguacuauuaag

SEQ ID NO: 436705 - RNA, 19 nt, Homo sapiens
gaaaagcgguuacaagaug

SEQ ID NO: 436706 - RNA, 19 nt, Homo sapiens
cggaagcccuacaccauua

SEQ ID NO: 436707 - RNA, 19 nt, Homo sapiens
gaugaaggcucuguggaaa

SEQ ID NO: 436708 - RNA, 19 nt, Homo sapiens
gaccacagcucagccaauu

SEQ ID NO: 436709 - RNA, 19 nt, Homo sapiens
ggacagcucaauucuacua

SEQ ID NO: 436710 - RNA, 19 nt, Homo sapiens
cagaguguaugcaagauuu

SEQ ID NO: 436711 - RNA, 19 nt, Homo sapiens
caccagagcucuaagaaag

SEQ ID NO: 436712 - RNA, 19 nt, Homo sapiens
gcagggacauuuacugaag

SEQ ID NO: 436713 - RNA, 19 nt, Homo sapiens
ucaagaggauuucaaagau

SEQ ID NO: 436714 - RNA, 19 nt, Homo sapiens
gaacaagagcugguaguga

SEQ ID NO: 436715 - RNA, 19 nt, Homo sapiens
caacagcgggcuauauuga

SEQ ID NO: 436716 - RNA, 19 nt, Homo sapiens
caagaggauuucaaagaug

SEQ ID NO: 436717 - RNA, 19 nt, Homo sapiens
gcggacagcucaauucuac

SEQ ID NO: 436718 - RNA, 19 nt, Homo sapiens
gaagagauugagauugauu

SEQ ID NO: 436719 - RNA, 19 nt, Homo sapiens
guagcagugucacgccuua

SEQ ID NO: 436720 - RNA, 19 nt, Homo sapiens
uaagaagcaugcugccuau

SEQ ID NO: 436721 - RNA, 19 nt, Homo sapiens
gaugccagaugaaccacua

SEQ ID NO: 436722 - RNA, 19 nt, Homo sapiens
caagcccacugaugauauu

SEQ ID NO: 436723 - RNA, 19 nt, Homo sapiens
ggacugucuuuguugauuc

SEQ ID NO: 436724 - RNA, 19 nt, Homo sapiens
uuaagaagccugugggaaa

SEQ ID NO: 436725 - RNA, 19 nt, Homo sapiens
uagcagaacuacaggaaca

SEQ ID NO: 436726 - RNA, 19 nt, Homo sapiens
cacgaaagcuacaggaugu

SEQ ID NO: 436727 - RNA, 19 nt, Homo sapiens
gggccgaguugugcauaua

SEQ ID NO: 436728 - RNA, 19 nt, Homo sapiens
guagugaccaucccuaaga

SEQ ID NO: 436729 - RNA, 19 nt, Homo sapiens
acaacaagcccacugauga

SEQ ID NO: 436730 - RNA, 19 nt, Homo sapiens
ggagcagccucuagaacga

SEQ ID NO: 436731 - RNA, 19 nt, Homo sapiens
ccaagaaagcgaaugagaa

SEQ ID NO: 436732 - RNA, 19 nt, Homo sapiens
caacaacaccagagcucua

SEQ ID NO: 436733 - RNA, 19 nt, Homo sapiens
aagagucagucccuccuua

SEQ ID NO: 436734 - RNA, 19 nt, Homo sapiens
gccuggacaucaacaaauu

SEQ ID NO: 436735 - RNA, 19 nt, Homo sapiens
uacagaagguugcaucaau

SEQ ID NO: 436736 - RNA, 19 nt, Homo sapiens
cucaagccauccacacuua

SEQ ID NO: 436737 - RNA, 19 nt, Homo sapiens
ccuaagaaguccaagaaag

SEQ ID NO: 436738 - RNA, 19 nt, Homo sapiens
agagcaggcccaugaguua

SEQ ID NO: 436739 - RNA, 19 nt, Homo sapiens
gcucaucgcuuagcagaac

SEQ ID NO: 436740 - RNA, 19 nt, Homo sapiens
guauuugaguuccguuaug

SEQ ID NO: 436741 - RNA, 19 nt, Homo sapiens
gcacuuggccugcaugacu

SEQ ID NO: 436742 - RNA, 19 nt, Homo sapiens
gugccugcuuugcaacuua

SEQ ID NO: 436743 - RNA, 19 nt, Homo sapiens
gucagucccuccuuaguug

SEQ ID NO: 436744 - RNA, 19 nt, Homo sapiens
acagaagguugcaucaaug

SEQ ID NO: 436745 - RNA, 19 nt, Homo sapiens
gacaagcagcagcguuaua

SEQ ID NO: 436746 - RNA, 19 nt, Homo sapiens
gagagcaggcccaugaguu

SEQ ID NO: 436747 - RNA, 19 nt, Homo sapiens
caacugcuauaaguacaau

SEQ ID NO: 436748 - RNA, 19 nt, Homo sapiens
guaaagcggaaagcagaua

SEQ ID NO: 436749 - RNA, 19 nt, Homo sapiens
ucaccaacuguuacauuua

SEQ ID NO: 436750 - RNA, 19 nt, Homo sapiens
ugacgacggugucugagau

SEQ ID NO: 436751 - RNA, 19 nt, Homo sapiens
uaagaagccugugggaaag

SEQ ID NO: 436752 - RNA, 19 nt, Homo sapiens
gaggaaaguagcagugaga

SEQ ID NO: 436753 - RNA, 19 nt, Homo sapiens
ggcaauggcacgaaagcua

SEQ ID NO: 436754 - RNA, 19 nt, Homo sapiens
ccagagcucuaagaaagga

SEQ ID NO: 436755 - RNA, 19 nt, Homo sapiens
caucuuggcuccugguucu

SEQ ID NO: 436756 - RNA, 19 nt, Homo sapiens
ugaaggcucuguggaaaca

SEQ ID NO: 436757 - RNA, 19 nt, Homo sapiens
gaaggagggacauggacaa

SEQ ID NO: 436758 - RNA, 19 nt, Homo sapiens
gccuacagguuaugauuca

SEQ ID NO: 436759 - RNA, 19 nt, Homo sapiens
ggaacagcuucgggcagua

SEQ ID NO: 436760 - RNA, 19 nt, Homo sapiens
caacaagcccacugaugau

SEQ ID NO: 436761 - RNA, 19 nt, Homo sapiens
ggagguguccaaucccaaa

SEQ ID NO: 436762 - RNA, 19 nt, Homo sapiens
augcuuggccuuucuauaa

SEQ ID NO: 436763 - RNA, 19 nt, Homo sapiens
caacaccagagcucuaaga

SEQ ID NO: 436764 - RNA, 19 nt, Homo sapiens
uuaauaccauguucaccaa

SEQ ID NO: 436765 - RNA, 19 nt, Homo sapiens
uuaccaaccagcugcaaua

SEQ ID NO: 436766 - RNA, 19 nt, Homo sapiens
aacccucucucuuguauga

SEQ ID NO: 436767 - RNA, 19 nt, Homo sapiens
caacuuagcggguuaugcu

SEQ ID NO: 436768 - RNA, 19 nt, Homo sapiens
ccuuggaaaugaaguuuau

SEQ ID NO: 436769 - RNA, 19 nt, Homo sapiens
caccagugauucagacuca

SEQ ID NO: 436770 - RNA, 19 nt, Homo sapiens
gagaagcugggccgaguug

SEQ ID NO: 436771 - RNA, 19 nt, Homo sapiens
gaacaacuggcugcucugu

SEQ ID NO: 436772 - RNA, 19 nt, Homo sapiens
ccuaagaacagccacaaga

SEQ ID NO: 436773 - RNA, 19 nt, Homo sapiens
guccuuuccugccuacgua

SEQ ID NO: 436774 - RNA, 19 nt, Homo sapiens
caccaacuguuacauuuac

SEQ ID NO: 436775 - RNA, 19 nt, Homo sapiens
acugacaccuuggaaauga

SEQ ID NO: 436776 - RNA, 19 nt, Homo sapiens
ugacugacaccuuggaaau

SEQ ID NO: 436777 - RNA, 19 nt, Homo sapiens
uggacaagcagcagcguua

SEQ ID NO: 436778 - RNA, 19 nt, Homo sapiens
gagccuggacaucaacaaa

SEQ ID NO: 436779 - RNA, 19 nt, Homo sapiens
cuaagaacagccacaagaa

SEQ ID NO: 436780 - RNA, 19 nt, Homo sapiens
gccuguggaugcugucaaa

SEQ ID NO: 436781 - RNA, 19 nt, Homo sapiens
ggacaaaacaacauugaau

SEQ ID NO: 436782 - RNA, 19 nt, Homo sapiens
aggaggaacuggcuuugga

SEQ ID NO: 436783 - RNA, 19 nt, Homo sapiens
ggaagcccuacaccauuaa

SEQ ID NO: 436784 - RNA, 19 nt, Homo sapiens
ggacgaggaggaagaagag

SEQ ID NO: 436785 - RNA, 19 nt, Homo sapiens
gcugauguacggcuuaugu

SEQ ID NO: 436786 - RNA, 19 nt, Homo sapiens
aaagcuuucagaacaguua

SEQ ID NO: 436787 - RNA, 19 nt, Homo sapiens
caucaaugccacaagaaga

SEQ ID NO: 436788 - RNA, 19 nt, Homo sapiens
cuucgcugcugcugccuua

SEQ ID NO: 436789 - RNA, 19 nt, Homo sapiens
ccaaccagcugcaauaccu

SEQ ID NO: 436790 - RNA, 19 nt, Homo sapiens
gauuccagcuccuccucuu

SEQ ID NO: 436791 - RNA, 19 nt, Homo sapiens
gaacuggcuuuggagaaaa

SEQ ID NO: 436792 - RNA, 19 nt, Homo sapiens
cagcugagccuggacauca

SEQ ID NO: 436793 - RNA, 19 nt, Homo sapiens
ggaagaagagagugaaagc

SEQ ID NO: 436794 - RNA, 19 nt, Homo sapiens
ccauggaccucagcacugu

SEQ ID NO: 436795 - RNA, 19 nt, Homo sapiens
gcuuggcagucuccaguug

SEQ ID NO: 436796 - RNA, 19 nt, Homo sapiens
gacauggguacuauuaaga

SEQ ID NO: 436797 - RNA, 19 nt, Homo sapiens
caacuucagugguuaauua

SEQ ID NO: 436798 - RNA, 19 nt, Homo sapiens
gcacagaauucacuuuaga

SEQ ID NO: 436799 - RNA, 19 nt, Homo sapiens
ccaaagagcacaaugagua

SEQ ID NO: 436800 - RNA, 19 nt, Homo sapiens
gcacaggacaugcaagaua

SEQ ID NO: 436801 - RNA, 19 nt, Homo sapiens
gaaagcagcggacuugaaa

SEQ ID NO: 436802 - RNA, 19 nt, Homo sapiens
caauaaaggccauucguua

SEQ ID NO: 436803 - RNA, 19 nt, Homo sapiens
ggaaacugcuggagaugaa

SEQ ID NO: 436804 - RNA, 19 nt, Homo sapiens
ccaguuaguuugaaugaaa

SEQ ID NO: 436805 - RNA, 19 nt, Homo sapiens
gaaagaagaagaccaagga

SEQ ID NO: 436806 - RNA, 19 nt, Homo sapiens
ggacagagacguauaugug

SEQ ID NO: 436807 - RNA, 19 nt, Homo sapiens
gggaaagguugguaugaaa

SEQ ID NO: 436808 - RNA, 19 nt, Homo sapiens
gaauggacgucucaucguu

SEQ ID NO: 436809 - RNA, 19 nt, Homo sapiens
gcaauaaauucuagacaag

SEQ ID NO: 436810 - RNA, 19 nt, Homo sapiens
guucaacucuuucuuuguu

SEQ ID NO: 436811 - RNA, 19 nt, Homo sapiens
caaugacucuguugugauu

SEQ ID NO: 436812 - RNA, 19 nt, Homo sapiens
aaagacaacuucagugguu

SEQ ID NO: 436813 - RNA, 19 nt, Homo sapiens
ucauugaucugcagugauu

SEQ ID NO: 436814 - RNA, 19 nt, Homo sapiens
gcuaauacuugcccaacuu

SEQ ID NO: 436815 - RNA, 19 nt, Homo sapiens
uagcaugucugcccucuga

SEQ ID NO: 436816 - RNA, 19 nt, Homo sapiens
cacaggacaugcaagauaa

SEQ ID NO: 436817 - RNA, 19 nt, Homo sapiens
ggacuccucugcuaguguu

SEQ ID NO: 436818 - RNA, 19 nt, Homo sapiens
gcacaaugaguacaagaaa

SEQ ID NO: 436819 - RNA, 19 nt, Homo sapiens
ggacaugcaagauaaauag

SEQ ID NO: 436820 - RNA, 19 nt, Homo sapiens
caugaaagguugagaacau

SEQ ID NO: 436821 - RNA, 19 nt, Homo sapiens
guuacuucguccuaaauua

SEQ ID NO: 436822 - RNA, 19 nt, Homo sapiens
ggaagcagaacccauagaa

SEQ ID NO: 436823 - RNA, 19 nt, Homo sapiens
cagcacagaauucacuuua

SEQ ID NO: 436824 - RNA, 19 nt, Homo sapiens
gcaauaaaggccauucguu

SEQ ID NO: 436825 - RNA, 19 nt, Homo sapiens
gaaaccaacaucugauaug

SEQ ID NO: 436826 - RNA, 19 nt, Homo sapiens
ggaaagcagcggacuugaa

SEQ ID NO: 436827 - RNA, 19 nt, Homo sapiens
gcaccaaagagcacaauga

SEQ ID NO: 436828 - RNA, 19 nt, Homo sapiens
ugaagaaugcuaauacuug

SEQ ID NO: 436829 - RNA, 19 nt, Homo sapiens
caucauugccauuaacuuu

SEQ ID NO: 436830 - RNA, 19 nt, Homo sapiens
ggacaucauugccauuaac

SEQ ID NO: 436831 - RNA, 19 nt, Homo sapiens
gagugucccuccucuaugu

SEQ ID NO: 436832 - RNA, 19 nt, Homo sapiens
uaaaauccaucccguguuu

SEQ ID NO: 436833 - RNA, 19 nt, Homo sapiens
gaagcgaacucgggaagca

SEQ ID NO: 436834 - RNA, 19 nt, Homo sapiens
acucagagaucgugcagaa

SEQ ID NO: 436835 - RNA, 19 nt, Homo sapiens
ugacuucccugcaaaccuu

SEQ ID NO: 436836 - RNA, 19 nt, Homo sapiens
ggacggauacucagagauc

SEQ ID NO: 436837 - RNA, 19 nt, Homo sapiens
gaaaggaaaggcaccaaag

SEQ ID NO: 436838 - RNA, 19 nt, Homo sapiens
ggaaaggaaaggcaccaaa

SEQ ID NO: 436839 - RNA, 19 nt, Homo sapiens
gaaagguugagaacauuug

SEQ ID NO: 436840 - RNA, 19 nt, Homo sapiens
ccgcagcucucaucauugu

SEQ ID NO: 436841 - RNA, 19 nt, Homo sapiens
ccauagaacucguggaaac

SEQ ID NO: 436842 - RNA, 19 nt, Homo sapiens
ccacugggcuuggaugcuu

SEQ ID NO: 436843 - RNA, 19 nt, Homo sapiens
gaaccuggcccaccugucu

SEQ ID NO: 436844 - RNA, 19 nt, Homo sapiens
cacaagauguagcacuauu

SEQ ID NO: 436845 - RNA, 19 nt, Homo sapiens
gccauucguuaccuacuuu

SEQ ID NO: 436846 - RNA, 19 nt, Homo sapiens
uuuguuaucuccaguuuga

SEQ ID NO: 436847 - RNA, 19 nt, Homo sapiens
ggcaguaauuguggccuua

SEQ ID NO: 436848 - RNA, 19 nt, Homo sapiens
gaagaagaccaaggaggaa

SEQ ID NO: 436849 - RNA, 19 nt, Homo sapiens
gcuuuggacuccucugcua

SEQ ID NO: 436850 - RNA, 19 nt, Homo sapiens
ggacucagcacagaauuca

SEQ ID NO: 436851 - RNA, 19 nt, Homo sapiens
gcacuccccuguuuccuaa

SEQ ID NO: 436852 - RNA, 19 nt, Homo sapiens
gccagguucuccaguggua

SEQ ID NO: 436853 - RNA, 19 nt, Homo sapiens
gacagagacguauauguga

SEQ ID NO: 436854 - RNA, 19 nt, Homo sapiens
ccagagggcaugaaagguu

SEQ ID NO: 436855 - RNA, 19 nt, Homo sapiens
cugcaaaccuugguauaga

SEQ ID NO: 436856 - RNA, 19 nt, Homo sapiens
ucaguccacucauaaaaua

SEQ ID NO: 436857 - RNA, 19 nt, Homo sapiens
gcagcucucaucauuguga

SEQ ID NO: 436858 - RNA, 19 nt, Homo sapiens
gagaggugguggcaguaau

SEQ ID NO: 436859 - RNA, 19 nt, Homo sapiens
cagcagcccacaagaugua

SEQ ID NO: 436860 - RNA, 19 nt, Homo sapiens
gccugcaccuuaucauuga

SEQ ID NO: 436861 - RNA, 19 nt, Homo sapiens
ucucaucguuuccacagaa

SEQ ID NO: 436862 - RNA, 19 nt, Homo sapiens
ucagagaucgugcagaaug

SEQ ID NO: 436863 - RNA, 19 nt, Homo sapiens
cuccuucgcuccacaggua

SEQ ID NO: 436864 - RNA, 19 nt, Homo sapiens
gcccaccugucuuggcuuu

SEQ ID NO: 436865 - RNA, 19 nt, Homo sapiens
acaagauguagcacuauua

SEQ ID NO: 436866 - RNA, 19 nt, Homo sapiens
gaggaucccagguugaaga

SEQ ID NO: 436867 - RNA, 19 nt, Homo sapiens
gcagugacgaugaggaguu

SEQ ID NO: 436868 - RNA, 19 nt, Homo sapiens
cccacaagauguagcacua

SEQ ID NO: 436869 - RNA, 19 nt, Homo sapiens
guugagaacauuugacuuc

SEQ ID NO: 436870 - RNA, 19 nt, Homo sapiens
gauucugccugcaccuuau

SEQ ID NO: 436871 - RNA, 19 nt, Homo sapiens
ggaaaucuguccggaucca

SEQ ID NO: 436872 - RNA, 19 nt, Homo sapiens
gauaucagucugcuuugga

SEQ ID NO: 436873 - RNA, 19 nt, Homo sapiens
guaaccagagggcaugaaa

SEQ ID NO: 436874 - RNA, 19 nt, Homo sapiens
ccgcucaguuccaggcuuu

SEQ ID NO: 436875 - RNA, 19 nt, Homo sapiens
caagauguagcacuauuag

SEQ ID NO: 436876 - RNA, 19 nt, Homo sapiens
gacgaaagaagaagaccaa

SEQ ID NO: 436877 - RNA, 19 nt, Homo sapiens
ugguauagaucacuuccuu

SEQ ID NO: 436878 - RNA, 19 nt, Homo sapiens
ggccauucguuaccuacuu

SEQ ID NO: 436879 - RNA, 19 nt, Homo sapiens
agugguaucugccuccauu

SEQ ID NO: 436880 - RNA, 19 nt, Homo sapiens
gaaauuguggaccucacuu

SEQ ID NO: 436881 - RNA, 19 nt, Homo sapiens
cguggaaacugcuggagau

SEQ ID NO: 436882 - RNA, 19 nt, Homo sapiens
ggauaucagucugcuuugg

SEQ ID NO: 436883 - RNA, 19 nt, Homo sapiens
gaaaauacuggaaaucugu

SEQ ID NO: 436884 - RNA, 19 nt, Homo sapiens
gcucacuuccaguuaguuu

SEQ ID NO: 436885 - RNA, 19 nt, Homo sapiens
guuuggguguccucucuuu

SEQ ID NO: 436886 - RNA, 19 nt, Homo sapiens
cuucuucccuugagaguca

SEQ ID NO: 436887 - RNA, 19 nt, Homo sapiens
uauguaaacugcucuuuug

SEQ ID NO: 436888 - RNA, 19 nt, Homo sapiens
aaacugcgaacuagggaaa

SEQ ID NO: 436889 - RNA, 19 nt, Homo sapiens
cugcacauuugccaagaaa

SEQ ID NO: 436890 - RNA, 19 nt, Homo sapiens
aaaggaaaggcaccaaaga

SEQ ID NO: 436891 - RNA, 19 nt, Homo sapiens
gguaacacccauuuuaaaa

SEQ ID NO: 436892 - RNA, 19 nt, Homo sapiens
gggcaucacggcaguguca

SEQ ID NO: 436893 - RNA, 19 nt, Homo sapiens
ucacuuccaguuaguuuga

SEQ ID NO: 436894 - RNA, 19 nt, Homo sapiens
ccaacccagugccguuuau

SEQ ID NO: 436895 - RNA, 19 nt, Homo sapiens
ccagaaacgccagggauga

SEQ ID NO: 436896 - RNA, 19 nt, Homo sapiens
guggagcaauaaauucuag

SEQ ID NO: 436897 - RNA, 19 nt, Homo sapiens
gcaagaguguccaguaugu

SEQ ID NO: 436898 - RNA, 19 nt, Homo sapiens
gaccuucgaauguaauaua

SEQ ID NO: 436899 - RNA, 19 nt, Homo sapiens
gcgcgaccuucgaauguaa

SEQ ID NO: 436900 - RNA, 19 nt, Homo sapiens
gggaagcuguggucagugu

SEQ ID NO: 436901 - RNA, 19 nt, Homo sapiens
agaagguugucccgcuuua

SEQ ID NO: 436902 - RNA, 19 nt, Homo sapiens
gggcuuccacuucucauuu

SEQ ID NO: 436903 - RNA, 19 nt, Homo sapiens
cggcaagaguguccaguau

SEQ ID NO: 436904 - RNA, 19 nt, Homo sapiens
ucaaugcccaugagccuuu

SEQ ID NO: 436905 - RNA, 19 nt, Homo sapiens
gagaagguugucccgcuuu

SEQ ID NO: 436906 - RNA, 19 nt, Homo sapiens
ggcgcgaccuucgaaugua

SEQ ID NO: 436907 - RNA, 19 nt, Homo sapiens
guggccaccuguacuguug

SEQ ID NO: 436908 - RNA, 19 nt, Homo sapiens
ccacuucucauuugguguu

SEQ ID NO: 436909 - RNA, 19 nt, Homo sapiens
aagaguguccaguauguaa

SEQ ID NO: 436910 - RNA, 19 nt, Homo sapiens
ggcuuccacuucucauuug

SEQ ID NO: 436911 - RNA, 19 nt, Homo sapiens
caagaguguccaguaugua

SEQ ID NO: 436912 - RNA, 19 nt, Homo sapiens
gccccaggaucccagauua

SEQ ID NO: 436913 - RNA, 19 nt, Homo sapiens
ggauucccucuuccuguuu

SEQ ID NO: 436914 - RNA, 19 nt, Homo sapiens
gaagguugucccgcuuuau

SEQ ID NO: 436915 - RNA, 19 nt, Homo sapiens
gaagcuguggucagugugu

SEQ ID NO: 436916 - RNA, 19 nt, Homo sapiens
gauucccucuuccuguuuc

SEQ ID NO: 436917 - RNA, 19 nt, Homo sapiens
ggagacugcucgggaagcu

SEQ ID NO: 436918 - RNA, 19 nt, Homo sapiens
gaucagcagagagaagguu

SEQ ID NO: 436919 - RNA, 19 nt, Homo sapiens
gccuccagcuggcaggauu

SEQ ID NO: 436920 - RNA, 19 nt, Homo sapiens
ucaccaccgucuucaaugc

SEQ ID NO: 436921 - RNA, 19 nt, Homo sapiens
cauuugguguuggugcuuu

SEQ ID NO: 436922 - RNA, 19 nt, Homo sapiens
uuccagccauuuggugaua

SEQ ID NO: 436923 - RNA, 19 nt, Homo sapiens
ggcaagaguguccaguaug

SEQ ID NO: 436924 - RNA, 19 nt, Homo sapiens
ucgggaagcuguggucagu

SEQ ID NO: 436925 - RNA, 19 nt, Homo sapiens
cccaggaucccagauuaaa

SEQ ID NO: 436926 - RNA, 19 nt, Homo sapiens
gcgaccuucgaauguaaua

SEQ ID NO: 436927 - RNA, 19 nt, Homo sapiens
gaaacaagcucaggcaauu

SEQ ID NO: 436928 - RNA, 19 nt, Homo sapiens
gaugggaucuacucaaaua

SEQ ID NO: 436929 - RNA, 19 nt, Homo sapiens
gaagaaaccuuaccucaag

SEQ ID NO: 436930 - RNA, 19 nt, Homo sapiens
gagcauaacaguauugaua

SEQ ID NO: 436931 - RNA, 19 nt, Homo sapiens
caacaaaggucaacuaguc

SEQ ID NO: 436932 - RNA, 19 nt, Homo sapiens
gaacaaacccgaacaaugg

SEQ ID NO: 436933 - RNA, 19 nt, Homo sapiens
gaaaggggauucagauaua

SEQ ID NO: 436934 - RNA, 19 nt, Homo sapiens
gaagaucuguuucuaccaa

SEQ ID NO: 436935 - RNA, 19 nt, Homo sapiens
gagaagaggccuauuauca

SEQ ID NO: 436936 - RNA, 19 nt, Homo sapiens
gcauauggcacaauguuua

SEQ ID NO: 436937 - RNA, 19 nt, Homo sapiens
gguaaaaucuguaguguuu

SEQ ID NO: 436938 - RNA, 19 nt, Homo sapiens
gaagaggccuauuaucagu

SEQ ID NO: 436939 - RNA, 19 nt, Homo sapiens
uaacuuguguucagccuuu

SEQ ID NO: 436940 - RNA, 19 nt, Homo sapiens
agucagaacuucaaagaaa

SEQ ID NO: 436941 - RNA, 19 nt, Homo sapiens
guauuuggcugaauguuug

SEQ ID NO: 436942 - RNA, 19 nt, Homo sapiens
gaacugaguaacuuaggua

SEQ ID NO: 436943 - RNA, 19 nt, Homo sapiens
gaacgagaacgcagaggua

SEQ ID NO: 436944 - RNA, 19 nt, Homo sapiens
ugaaggaucuuucucaaca

SEQ ID NO: 436945 - RNA, 19 nt, Homo sapiens
gauuagagccaauaagauu

SEQ ID NO: 436946 - RNA, 19 nt, Homo sapiens
gaaauaacaucagaagaac

SEQ ID NO: 436947 - RNA, 19 nt, Homo sapiens
gcugaauguuugcuauaua

SEQ ID NO: 436948 - RNA, 19 nt, Homo sapiens
gguaguaguuccaacauuc

SEQ ID NO: 436949 - RNA, 19 nt, Homo sapiens
gauaguaacagagaucaua

SEQ ID NO: 436950 - RNA, 19 nt, Homo sapiens
gaugaagauuaucggcuua

SEQ ID NO: 436951 - RNA, 19 nt, Homo sapiens
gcaagagcgucuccacaga

SEQ ID NO: 436952 - RNA, 19 nt, Homo sapiens
gaaagaguauuuggcugaa

SEQ ID NO: 436953 - RNA, 19 nt, Homo sapiens
gguauucgaaccuauguua

SEQ ID NO: 436954 - RNA, 19 nt, Homo sapiens
gcacaauucaguagguuaa

SEQ ID NO: 436955 - RNA, 19 nt, Homo sapiens
ccaaagagcagauugacaa

SEQ ID NO: 436956 - RNA, 19 nt, Homo sapiens
gaagguuccucucaagaca

SEQ ID NO: 436957 - RNA, 19 nt, Homo sapiens
gcaaauaggcaacaaaggu

SEQ ID NO: 436958 - RNA, 19 nt, Homo sapiens
gugaugggaucuacucaaa

SEQ ID NO: 436959 - RNA, 19 nt, Homo sapiens
ggagaagaauccagcagau

SEQ ID NO: 436960 - RNA, 19 nt, Homo sapiens
gcaaaccacuagaagaucu

SEQ ID NO: 436961 - RNA, 19 nt, Homo sapiens
gcugaguuauuugugauua

SEQ ID NO: 436962 - RNA, 19 nt, Homo sapiens
gaucaugacuggguuugga

SEQ ID NO: 436963 - RNA, 19 nt, Homo sapiens
ggucuaacauagcaaacaa

SEQ ID NO: 436964 - RNA, 19 nt, Homo sapiens
gaaaauggggcuagaagua

SEQ ID NO: 436965 - RNA, 19 nt, Homo sapiens
ccaaucaggugguagugaa

SEQ ID NO: 436966 - RNA, 19 nt, Homo sapiens
gaaauccacguaaaucaug

SEQ ID NO: 436967 - RNA, 19 nt, Homo sapiens
gaagauuaucggcuuauga

SEQ ID NO: 436968 - RNA, 19 nt, Homo sapiens
ggaauacaaaccaaagauu

SEQ ID NO: 436969 - RNA, 19 nt, Homo sapiens
ugagagauggaacgaauua

SEQ ID NO: 436970 - RNA, 19 nt, Homo sapiens
acagagaagaggccuauua

SEQ ID NO: 436971 - RNA, 19 nt, Homo sapiens
gaucgaauacgugguuuaa

SEQ ID NO: 436972 - RNA, 19 nt, Homo sapiens
uaacuuagguacagauaac

SEQ ID NO: 436973 - RNA, 19 nt, Homo sapiens
uaaagaaucagaugcauag

SEQ ID NO: 436974 - RNA, 19 nt, Homo sapiens
gaaaauagagaucgggaua

SEQ ID NO: 436975 - RNA, 19 nt, Homo sapiens
gugauuagcuaaccaggau

SEQ ID NO: 436976 - RNA, 19 nt, Homo sapiens
ggaggccgauucugaguca

SEQ ID NO: 436977 - RNA, 19 nt, Homo sapiens
gacauuccacuuucagaua

SEQ ID NO: 436978 - RNA, 19 nt, Homo sapiens
ccaggaaucucaggaugaa

SEQ ID NO: 436979 - RNA, 19 nt, Homo sapiens
ugaugaugaugaucgaaua

SEQ ID NO: 436980 - RNA, 19 nt, Homo sapiens
gaaccuauguuaguaccau

SEQ ID NO: 436981 - RNA, 19 nt, Homo sapiens
gauaccauggcauauguua

SEQ ID NO: 436982 - RNA, 19 nt, Homo sapiens
ucaaagaaauggccagcau

SEQ ID NO: 436983 - RNA, 19 nt, Homo sapiens
gaauuucaaugguaguagu

SEQ ID NO: 436984 - RNA, 19 nt, Homo sapiens
gagagaccauaaucuuuua

SEQ ID NO: 436985 - RNA, 19 nt, Homo sapiens
ccagaaauacagaauaguu

SEQ ID NO: 436986 - RNA, 19 nt, Homo sapiens
ugaaagugaugaugaugau

SEQ ID NO: 436987 - RNA, 19 nt, Homo sapiens
agguagaacucgagucuuu

SEQ ID NO: 436988 - RNA, 19 nt, Homo sapiens
gcugaaggaucuuucucaa

SEQ ID NO: 436989 - RNA, 19 nt, Homo sapiens
gagaguuucgguuuaguuu

SEQ ID NO: 436990 - RNA, 19 nt, Homo sapiens
gacagcaagcaauauauaa

SEQ ID NO: 436991 - RNA, 19 nt, Homo sapiens
gacaguaucuuuucaugaa

SEQ ID NO: 436992 - RNA, 19 nt, Homo sapiens
ccaaauaaccucuaaaaug

SEQ ID NO: 436993 - RNA, 19 nt, Homo sapiens
gcucuucggucaauuuuaa

SEQ ID NO: 436994 - RNA, 19 nt, Homo sapiens
gcaaauagaacucgaucca

SEQ ID NO: 436995 - RNA, 19 nt, Homo sapiens
cccaagaccuggagagaug

SEQ ID NO: 436996 - RNA, 19 nt, Homo sapiens
gagaucauacugcaaauag

SEQ ID NO: 436997 - RNA, 19 nt, Homo sapiens
ggaaaugcaacucgaagug

SEQ ID NO: 436998 - RNA, 19 nt, Homo sapiens
ucagaagucccuagagaaa

SEQ ID NO: 436999 - RNA, 19 nt, Homo sapiens
gaucuguuucuaccaauaa

SEQ ID NO: 437000 - RNA, 19 nt, Homo sapiens
caaaguaugcauugaagau

SEQ ID NO: 437001 - RNA, 19 nt, Homo sapiens
aagcgucucugacaaucua

SEQ ID NO: 437002 - RNA, 19 nt, Homo sapiens
ucuacaaguuugguucuua

SEQ ID NO: 437003 - RNA, 19 nt, Homo sapiens
ggaaacaagcucaggcaau

SEQ ID NO: 437004 - RNA, 19 nt, Homo sapiens
gccgaaccauuucucguuu

SEQ ID NO: 437005 - RNA, 19 nt, Homo sapiens
guacagcaaaccacuagaa

SEQ ID NO: 437006 - RNA, 19 nt, Homo sapiens
ggagaagauuauacagaca

SEQ ID NO: 437007 - RNA, 19 nt, Homo sapiens
agacagcaagcaauauaua

SEQ ID NO: 437008 - RNA, 19 nt, Homo sapiens
cuacaaguuugguucuuau

SEQ ID NO: 437009 - RNA, 19 nt, Homo sapiens
uucauaggcuuaguacuua

SEQ ID NO: 437010 - RNA, 19 nt, Homo sapiens
gcauaacaguauugauagu

SEQ ID NO: 437011 - RNA, 19 nt, Homo sapiens
cgaagccguucaccaauuc

SEQ ID NO: 437012 - RNA, 19 nt, Homo sapiens
guagugaacucaggcaaag

SEQ ID NO: 437013 - RNA, 19 nt, Homo sapiens
auacagacauuccacuuuc

SEQ ID NO: 437014 - RNA, 19 nt, Homo sapiens
ggagaaauaacaucagaag

SEQ ID NO: 437015 - RNA, 19 nt, Homo sapiens
aaacacaaaguaugcauug

SEQ ID NO: 437016 - RNA, 19 nt, Homo sapiens
gcuuaguacuuauaucuag

SEQ ID NO: 437017 - RNA, 19 nt, Homo sapiens
agacagcacugaaaugcau

SEQ ID NO: 437018 - RNA, 19 nt, Homo sapiens
uaccagacaugcacucaga

SEQ ID NO: 437019 - RNA, 19 nt, Homo sapiens
ggaaauccacguaaaucau

SEQ ID NO: 437020 - RNA, 19 nt, Homo sapiens
aauggagaguuucgguuua

SEQ ID NO: 437021 - RNA, 19 nt, Homo sapiens
caauggagaguuucgguuu

SEQ ID NO: 437022 - RNA, 19 nt, Homo sapiens
cgaacaaacccgaacaaug

SEQ ID NO: 437023 - RNA, 19 nt, Homo sapiens
gcgguuagauggcgucaag

SEQ ID NO: 437024 - RNA, 19 nt, Homo sapiens
uaauggaggccgauucuga

SEQ ID NO: 437025 - RNA, 19 nt, Homo sapiens
ccgaaccauuucucguuua

SEQ ID NO: 437026 - RNA, 19 nt, Homo sapiens
ccacguaaaucaugaaaau

SEQ ID NO: 437027 - RNA, 19 nt, Homo sapiens
gcaacaagcugggugaugu

SEQ ID NO: 437028 - RNA, 19 nt, Homo sapiens
ucaaggagcucacgguuag

SEQ ID NO: 437029 - RNA, 19 nt, Homo sapiens
ggagggugcugaagaggaa

SEQ ID NO: 437030 - RNA, 19 nt, Homo sapiens
gcaacgagcugggcgaugu

SEQ ID NO: 437031 - RNA, 19 nt, Homo sapiens
gaagagaaacgcucagauc

SEQ ID NO: 437032 - RNA, 19 nt, Homo sapiens
gcucagauccgcuuauuuc

SEQ ID NO: 437033 - RNA, 19 nt, Homo sapiens
ggaggucucuggcuuugug

SEQ ID NO: 437034 - RNA, 19 nt, Homo sapiens
gaaccuccuuccauauuca

SEQ ID NO: 437035 - RNA, 19 nt, Homo sapiens
gcaacaacgacaucaauga

SEQ ID NO: 437036 - RNA, 19 nt, Homo sapiens
gcuuauuucugccaguaua

SEQ ID NO: 437037 - RNA, 19 nt, Homo sapiens
gacaucagcucugcacuuc

SEQ ID NO: 437038 - RNA, 19 nt, Homo sapiens
ggacaucagcucugcacuu

SEQ ID NO: 437039 - RNA, 19 nt, Homo sapiens
gaauguauccaccaaccaa

SEQ ID NO: 437040 - RNA, 19 nt, Homo sapiens
ggauucaguuccuccaugu

SEQ ID NO: 437041 - RNA, 19 nt, Homo sapiens
uggagcagcugguccugua

SEQ ID NO: 437042 - RNA, 19 nt, Homo sapiens
gagcugcggugugacauca

SEQ ID NO: 437043 - RNA, 19 nt, Homo sapiens
caucagcucugcacuucga

SEQ ID NO: 437044 - RNA, 19 nt, Homo sapiens
cagaaucuccggccuguga

SEQ ID NO: 437045 - RNA, 19 nt, Homo sapiens
ccaaggagagccugaagga

SEQ ID NO: 437046 - RNA, 19 nt, Homo sapiens
cuggagagcugcgguguga

SEQ ID NO: 437047 - RNA, 19 nt, Homo sapiens
uauccuagguuugaagaga

SEQ ID NO: 437048 - RNA, 19 nt, Homo sapiens
caacaacgacaucaaugag

SEQ ID NO: 437049 - RNA, 19 nt, Homo sapiens
ccgcuuauuucugccagua

SEQ ID NO: 437050 - RNA, 19 nt, Homo sapiens
aggaggaggugcccacaga

SEQ ID NO: 437051 - RNA, 19 nt, Homo sapiens
uuacuggucugaggagaug

SEQ ID NO: 437052 - RNA, 19 nt, Homo sapiens
ggagagcugcggugugaca

SEQ ID NO: 437053 - RNA, 19 nt, Homo sapiens
gcucugcacuucgagucaa

SEQ ID NO: 437054 - RNA, 19 nt, Homo sapiens
cugcauauccuagguuuga

SEQ ID NO: 437055 - RNA, 19 nt, Homo sapiens
cuacagauaagcaacaaca

SEQ ID NO: 437056 - RNA, 19 nt, Homo sapiens
gugcccgacugcuguguga

SEQ ID NO: 437057 - RNA, 19 nt, Homo sapiens
cagggaauguauccaccaa

SEQ ID NO: 437058 - RNA, 19 nt, Homo sapiens
gcugcggugugacaucaga

SEQ ID NO: 437059 - RNA, 19 nt, Homo sapiens
uagcaacaacgacaucaau

SEQ ID NO: 437060 - RNA, 19 nt, Homo sapiens
caagccuccucuccagguu

SEQ ID NO: 437061 - RNA, 19 nt, Homo sapiens
aguggauccugccaacuuu

SEQ ID NO: 437062 - RNA, 19 nt, Homo sapiens
gagcuacagauaagcaaca

SEQ ID NO: 437063 - RNA, 19 nt, Homo sapiens
gaaucuccggccugugaaa

SEQ ID NO: 437064 - RNA, 19 nt, Homo sapiens
gguccuguuugcagaaucu

SEQ ID NO: 437065 - RNA, 19 nt, Homo sapiens
ggcaggugcucagggaaug

SEQ ID NO: 437066 - RNA, 19 nt, Homo sapiens
cagcugggguugcaucauu

SEQ ID NO: 437067 - RNA, 19 nt, Homo sapiens
ccucagcgacaaccucuug

SEQ ID NO: 437068 - RNA, 19 nt, Homo sapiens
gcucucagggccucaggaa

SEQ ID NO: 437069 - RNA, 19 nt, Homo sapiens
caacaagcugggugaugug

SEQ ID NO: 437070 - RNA, 19 nt, Homo sapiens
ggaccugugcggcauugug

SEQ ID NO: 437071 - RNA, 19 nt, Homo sapiens
ugggcuggcaucugcauua

SEQ ID NO: 437072 - RNA, 19 nt, Homo sapiens
acgcucagauccgcuuauu

SEQ ID NO: 437073 - RNA, 19 nt, Homo sapiens
uggagucgcugugggugaa

SEQ ID NO: 437074 - RNA, 19 nt, Homo sapiens
gucucugccugaccacuuu

SEQ ID NO: 437075 - RNA, 19 nt, Homo sapiens
ccuugugccuccacucaug

SEQ ID NO: 437076 - RNA, 19 nt, Homo sapiens
gcaccaggagccucucaag

SEQ ID NO: 437077 - RNA, 19 nt, Homo sapiens
agcccagccuugcgucuuu

SEQ ID NO: 437078 - RNA, 19 nt, Homo sapiens
gagcucacgguuagcaaca

SEQ ID NO: 437079 - RNA, 19 nt, Homo sapiens
gguccuguccagcacacua

SEQ ID NO: 437080 - RNA, 19 nt, Homo sapiens
ggugugacaucagacaacu

SEQ ID NO: 437081 - RNA, 19 nt, Homo sapiens
aagcugagccuccagaacu

SEQ ID NO: 437082 - RNA, 19 nt, Homo sapiens
gggcuggcaucugcauuac

SEQ ID NO: 437083 - RNA, 19 nt, Homo sapiens
ugggaggucucuggcuuug

SEQ ID NO: 437084 - RNA, 19 nt, Homo sapiens
gcucacgguuagcaacaac

SEQ ID NO: 437085 - RNA, 19 nt, Homo sapiens
gcucucacccugcauaucc

SEQ ID NO: 437086 - RNA, 19 nt, Homo sapiens
gaagagagguccaaauaag

SEQ ID NO: 437087 - RNA, 19 nt, Homo sapiens
ggacaucacuggagaggaa

SEQ ID NO: 437088 - RNA, 19 nt, Homo sapiens
gagaagagagguccaaaua

SEQ ID NO: 437089 - RNA, 19 nt, Homo sapiens
gcaaagggcuggcauucug

SEQ ID NO: 437090 - RNA, 19 nt, Homo sapiens
ggagacacauacccaagua

SEQ ID NO: 437091 - RNA, 19 nt, Homo sapiens
gauaagauccuccagaaau

SEQ ID NO: 437092 - RNA, 19 nt, Homo sapiens
ggaacuuacuucucuauag

SEQ ID NO: 437093 - RNA, 19 nt, Homo sapiens
cgacacgccugcuguuaaa

SEQ ID NO: 437094 - RNA, 19 nt, Homo sapiens
caugagaucucccacaguu

SEQ ID NO: 437095 - RNA, 19 nt, Homo sapiens
gaacuuacuucucuauagc

SEQ ID NO: 437096 - RNA, 19 nt, Homo sapiens
ccgaggagcuggacaugaa

SEQ ID NO: 437097 - RNA, 19 nt, Homo sapiens
gcugagcccugccugauug

SEQ ID NO: 437098 - RNA, 19 nt, Homo sapiens
ucuccaggcuuucagaaua

SEQ ID NO: 437099 - RNA, 19 nt, Homo sapiens
caaauaaguucuucuucca

SEQ ID NO: 437100 - RNA, 19 nt, Homo sapiens
gaagccugcugaagagcua

SEQ ID NO: 437101 - RNA, 19 nt, Homo sapiens
gauaaucuauucucuagcu

SEQ ID NO: 437102 - RNA, 19 nt, Homo sapiens
gaauauuucccugagcuua

SEQ ID NO: 437103 - RNA, 19 nt, Homo sapiens
caaauuccgaagcaucuua

SEQ ID NO: 437104 - RNA, 19 nt, Homo sapiens
gacgacaccuauaaugaga

SEQ ID NO: 437105 - RNA, 19 nt, Homo sapiens
ggugggaacuuacuucucu

SEQ ID NO: 437106 - RNA, 19 nt, Homo sapiens
ggacuucuacuuggaauau

SEQ ID NO: 437107 - RNA, 19 nt, Homo sapiens
ggccaaaucguccuuaaga

SEQ ID NO: 437108 - RNA, 19 nt, Homo sapiens
ggacaugaaggccauugaa

SEQ ID NO: 437109 - RNA, 19 nt, Homo sapiens
uuugaucgauggcugaaua

SEQ ID NO: 437110 - RNA, 19 nt, Homo sapiens
ggugaauucuggcucaaug

SEQ ID NO: 437111 - RNA, 19 nt, Homo sapiens
guauucagcucuuauugag

SEQ ID NO: 437112 - RNA, 19 nt, Homo sapiens
gcagacagcaggaaagaag

SEQ ID NO: 437113 - RNA, 19 nt, Homo sapiens
ucucauaccuggcccacuu

SEQ ID NO: 437114 - RNA, 19 nt, Homo sapiens
gccaaaucguccuuaagaa

SEQ ID NO: 437115 - RNA, 19 nt, Homo sapiens
aaagagaguggauaucauu

SEQ ID NO: 437116 - RNA, 19 nt, Homo sapiens
uaagaacgaccaccaggaa

SEQ ID NO: 437117 - RNA, 19 nt, Homo sapiens
ccaccguccuuuccauuug

SEQ ID NO: 437118 - RNA, 19 nt, Homo sapiens
gguauucuccucccaccua

SEQ ID NO: 437119 - RNA, 19 nt, Homo sapiens
gaagagcuagcccaacugu

SEQ ID NO: 437120 - RNA, 19 nt, Homo sapiens
ggacgacaccuauaaugag

SEQ ID NO: 437121 - RNA, 19 nt, Homo sapiens
ucaacaagcuccgcgugaa

SEQ ID NO: 437122 - RNA, 19 nt, Homo sapiens
gaucuccaccauccucuuu

SEQ ID NO: 437123 - RNA, 19 nt, Homo sapiens
caugaagccugcugaagag

SEQ ID NO: 437124 - RNA, 19 nt, Homo sapiens
aggaucaguuugacaguuu

SEQ ID NO: 437125 - RNA, 19 nt, Homo sapiens
ucaugaagccugcugaaga

SEQ ID NO: 437126 - RNA, 19 nt, Homo sapiens
gggccaggcuguccuaaac

SEQ ID NO: 437127 - RNA, 19 nt, Homo sapiens
cuaugugcaugaauucaaa

SEQ ID NO: 437128 - RNA, 19 nt, Homo sapiens
aggauaaucuauucucuag

SEQ ID NO: 437129 - RNA, 19 nt, Homo sapiens
guuagaggcucgugugcau

SEQ ID NO: 437130 - RNA, 19 nt, Homo sapiens
ucaacuauguccagcagau

SEQ ID NO: 437131 - RNA, 19 nt, Homo sapiens
gagcagacagcaggaaaga

SEQ ID NO: 437132 - RNA, 19 nt, Homo sapiens
gaagguaugacuugcucuu

SEQ ID NO: 437133 - RNA, 19 nt, Homo sapiens
agaagagagguccaaauaa

SEQ ID NO: 437134 - RNA, 19 nt, Homo sapiens
ggacugaugcucuucuuuu

SEQ ID NO: 437135 - RNA, 19 nt, Homo sapiens
caaguauucagcucuuauu

SEQ ID NO: 437136 - RNA, 19 nt, Homo sapiens
gaggacugaugcucuucuu

SEQ ID NO: 437137 - RNA, 19 nt, Homo sapiens
gaaguggagaggacugaug

SEQ ID NO: 437138 - RNA, 19 nt, Homo sapiens
ccuguucccugaucaacuu

SEQ ID NO: 437139 - RNA, 19 nt, Homo sapiens
ccuuugagcugcugcacuu

SEQ ID NO: 437140 - RNA, 19 nt, Homo sapiens
acacgccugcuguuaaaua

SEQ ID NO: 437141 - RNA, 19 nt, Homo sapiens
gaacccuugucugaccuuu

SEQ ID NO: 437142 - RNA, 19 nt, Homo sapiens
gaauggagaacccuugucu

SEQ ID NO: 437143 - RNA, 19 nt, Homo sapiens
gcaacaggagagaagcuuu

SEQ ID NO: 437144 - RNA, 19 nt, Homo sapiens
guauucuccucccaccuaa

SEQ ID NO: 437145 - RNA, 19 nt, Homo sapiens
cuccaggcuuucagaauaa

SEQ ID NO: 437146 - RNA, 19 nt, Homo sapiens
gaacgaccaccaggaagau

SEQ ID NO: 437147 - RNA, 19 nt, Homo sapiens
ggagaagagagguccaaau

SEQ ID NO: 437148 - RNA, 19 nt, Homo sapiens
ggucccagauggcuucaca

SEQ ID NO: 437149 - RNA, 19 nt, Homo sapiens
agagagguccaaauaaguu

SEQ ID NO: 437150 - RNA, 19 nt, Homo sapiens
gggaacuuacuucucuaua

SEQ ID NO: 437151 - RNA, 19 nt, Homo sapiens
ggaagcagaaguauacacu

SEQ ID NO: 437152 - RNA, 19 nt, Homo sapiens
auaagauccuccagaaauc

SEQ ID NO: 437153 - RNA, 19 nt, Homo sapiens
gguuucggcugaaguugga

SEQ ID NO: 437154 - RNA, 19 nt, Homo sapiens
uacaaguauucagcucuua

SEQ ID NO: 437155 - RNA, 19 nt, Homo sapiens
caggaucaguuugacaguu

SEQ ID NO: 437156 - RNA, 19 nt, Homo sapiens
caggauaaucuauucucua

SEQ ID NO: 437157 - RNA, 19 nt, Homo sapiens
ggauaucauuccagguuuu

SEQ ID NO: 437158 - RNA, 19 nt, Homo sapiens
aggccuaugugcaugaauu

SEQ ID NO: 437159 - RNA, 19 nt, Homo sapiens
caaagggcuggcauucuga

SEQ ID NO: 437160 - RNA, 19 nt, Homo sapiens
ccucccagcuccacagcaa

SEQ ID NO: 437161 - RNA, 19 nt, Homo sapiens
cugaagagcuagcccaacu

SEQ ID NO: 437162 - RNA, 19 nt, Homo sapiens
cggacgacaccuauaauga

SEQ ID NO: 437163 - RNA, 19 nt, Homo sapiens
cuaagucucugggaagaag

SEQ ID NO: 437164 - RNA, 19 nt, Homo sapiens
uaucucaaaugcccggaau

SEQ ID NO: 437165 - RNA, 19 nt, Homo sapiens
ccgaugacuuucuggacuu

SEQ ID NO: 437166 - RNA, 19 nt, Homo sapiens
caaggccuaugugcaugaa

SEQ ID NO: 437167 - RNA, 19 nt, Homo sapiens
aaucuauucucuagcuuag

SEQ ID NO: 437168 - RNA, 19 nt, Homo sapiens
ccaaaucguccuuaagaac

SEQ ID NO: 437169 - RNA, 19 nt, Homo sapiens
cgccugcuguuaaauacaa

SEQ ID NO: 437170 - RNA, 19 nt, Homo sapiens
uuagguaucugugacucuu

SEQ ID NO: 437171 - RNA, 19 nt, Homo sapiens
aauauuucccugagcuuaa

SEQ ID NO: 437172 - RNA, 19 nt, Homo sapiens
gaucucccacaguugguuu

SEQ ID NO: 437173 - RNA, 19 nt, Homo sapiens
caucggagaucugguuucg

SEQ ID NO: 437174 - RNA, 19 nt, Homo sapiens
ucuauucucuagcuuaggu

SEQ ID NO: 437175 - RNA, 19 nt, Homo sapiens
gcacccaagggcaguuaga

SEQ ID NO: 437176 - RNA, 19 nt, Homo sapiens
guuucugcuuugucucaua

SEQ ID NO: 437177 - RNA, 19 nt, Homo sapiens
caacaagcuccgcgugaag

SEQ ID NO: 437178 - RNA, 19 nt, Homo sapiens
ugaauucuggcucaaugaa

SEQ ID NO: 437179 - RNA, 19 nt, Homo sapiens
uaaguucuucuuccagaug

SEQ ID NO: 437180 - RNA, 19 nt, Homo sapiens
ucaggauaaucuauucucu

SEQ ID NO: 437181 - RNA, 19 nt, Homo sapiens
ucgacacgccugcuguuaa

SEQ ID NO: 437182 - RNA, 19 nt, Homo sapiens
ggccaucggagaucugguu

SEQ ID NO: 437183 - RNA, 19 nt, Homo sapiens
gugggaacuuacuucucua

SEQ ID NO: 437184 - RNA, 19 nt, Homo sapiens
gagagguccaaauaaguuc

SEQ ID NO: 437185 - RNA, 19 nt, Homo sapiens
uucaggcucuccaggcuuu

SEQ ID NO: 437186 - RNA, 19 nt, Homo sapiens
caucaaaccucaauaugua

SEQ ID NO: 437187 - RNA, 19 nt, Homo sapiens
gaagacauuucaagcuaua

SEQ ID NO: 437188 - RNA, 19 nt, Homo sapiens
gaaauuacauucagaagag

SEQ ID NO: 437189 - RNA, 19 nt, Homo sapiens
gaggaagaguguuuacuaa

SEQ ID NO: 437190 - RNA, 19 nt, Homo sapiens
gaacacaguugcaaacagu

SEQ ID NO: 437191 - RNA, 19 nt, Homo sapiens
ugacuaaacuggaauuaug

SEQ ID NO: 437192 - RNA, 19 nt, Homo sapiens
gaggagaguugcagagauu

SEQ ID NO: 437193 - RNA, 19 nt, Homo sapiens
gcugaugucuauuuaauug

SEQ ID NO: 437194 - RNA, 19 nt, Homo sapiens
gcagacaaguuaacgagaa

SEQ ID NO: 437195 - RNA, 19 nt, Homo sapiens
uaaugaaacugcccuuauu

SEQ ID NO: 437196 - RNA, 19 nt, Homo sapiens
caaaucaacuggaaguguu

SEQ ID NO: 437197 - RNA, 19 nt, Homo sapiens
uaagaaaugucgacaggaa

SEQ ID NO: 437198 - RNA, 19 nt, Homo sapiens
ccaguuggguucuaaauug

SEQ ID NO: 437199 - RNA, 19 nt, Homo sapiens
gaacuaaugguauuggaaa

SEQ ID NO: 437200 - RNA, 19 nt, Homo sapiens
ugacaaacuuuaagagcua

SEQ ID NO: 437201 - RNA, 19 nt, Homo sapiens
gaacaugaucuaaguguau

SEQ ID NO: 437202 - RNA, 19 nt, Homo sapiens
caaagauucuagaagauga

SEQ ID NO: 437203 - RNA, 19 nt, Homo sapiens
gacauuaucugguggugaa

SEQ ID NO: 437204 - RNA, 19 nt, Homo sapiens
guauaaauauccaggaaug

SEQ ID NO: 437205 - RNA, 19 nt, Homo sapiens
gaaacucuuuguauugguu

SEQ ID NO: 437206 - RNA, 19 nt, Homo sapiens
aaacuggaauuaugaguga

SEQ ID NO: 437207 - RNA, 19 nt, Homo sapiens
ggaacaugaucuaagugua

SEQ ID NO: 437208 - RNA, 19 nt, Homo sapiens
gugaauauguaaaggguuu

SEQ ID NO: 437209 - RNA, 19 nt, Homo sapiens
ugaaauaacagaagucuug

SEQ ID NO: 437210 - RNA, 19 nt, Homo sapiens
aauuguagcuggagaguuu

SEQ ID NO: 437211 - RNA, 19 nt, Homo sapiens
gacagcaaaugaagaagaa

SEQ ID NO: 437212 - RNA, 19 nt, Homo sapiens
gggcaaaccugcugauguc

SEQ ID NO: 437213 - RNA, 19 nt, Homo sapiens
agagaugcaucacuuguuu

SEQ ID NO: 437214 - RNA, 19 nt, Homo sapiens
gccaaugccuucaaacuuc

SEQ ID NO: 437215 - RNA, 19 nt, Homo sapiens
uaacgagaauugcuauugu

SEQ ID NO: 437216 - RNA, 19 nt, Homo sapiens
gcuagaaaguaugguuuaa

SEQ ID NO: 437217 - RNA, 19 nt, Homo sapiens
ccacgaauaaacaaacuua

SEQ ID NO: 437218 - RNA, 19 nt, Homo sapiens
gcaaaugaagaagaaguua

SEQ ID NO: 437219 - RNA, 19 nt, Homo sapiens
uugaugagccuucuaguua

SEQ ID NO: 437220 - RNA, 19 nt, Homo sapiens
gaccaguguugcuccauuu

SEQ ID NO: 437221 - RNA, 19 nt, Homo sapiens
ugaagccucugcaaauuga

SEQ ID NO: 437222 - RNA, 19 nt, Homo sapiens
ugugguaucuguauuaaga

SEQ ID NO: 437223 - RNA, 19 nt, Homo sapiens
uaccagcguuugaauuuaa

SEQ ID NO: 437224 - RNA, 19 nt, Homo sapiens
gaaaauuagucccaaauca

SEQ ID NO: 437225 - RNA, 19 nt, Homo sapiens
ggcaggagauuuugacuua

SEQ ID NO: 437226 - RNA, 19 nt, Homo sapiens
caugacaaauguaaaccua

SEQ ID NO: 437227 - RNA, 19 nt, Homo sapiens
caaaccugcugaugucuau

SEQ ID NO: 437228 - RNA, 19 nt, Homo sapiens
guaaaggguuuguuuugua

SEQ ID NO: 437229 - RNA, 19 nt, Homo sapiens
ggaggaaauuagaaacugu

SEQ ID NO: 437230 - RNA, 19 nt, Homo sapiens
gaagaguggaaacuacuuu

SEQ ID NO: 437231 - RNA, 19 nt, Homo sapiens
agagaaggcauaaacauuu

SEQ ID NO: 437232 - RNA, 19 nt, Homo sapiens
gaaguaccaguucuaaaug

SEQ ID NO: 437233 - RNA, 19 nt, Homo sapiens
gagaauugcuauugucaac

SEQ ID NO: 437234 - RNA, 19 nt, Homo sapiens
gauauucuuucgcccaguu

SEQ ID NO: 437235 - RNA, 19 nt, Homo sapiens
guaaugaagccucugcaaa

SEQ ID NO: 437236 - RNA, 19 nt, Homo sapiens
cuacagacucgaaaucuuu

SEQ ID NO: 437237 - RNA, 19 nt, Homo sapiens
gcuggagaguuuacagauu

SEQ ID NO: 437238 - RNA, 19 nt, Homo sapiens
gguggaacaugaucuaagu

SEQ ID NO: 437239 - RNA, 19 nt, Homo sapiens
gaacuacagacucgaaauc

SEQ ID NO: 437240 - RNA, 19 nt, Homo sapiens
gaaacugcccuuauuuuaa

SEQ ID NO: 437241 - RNA, 19 nt, Homo sapiens
guaaugaaacugcccuuau

SEQ ID NO: 437242 - RNA, 19 nt, Homo sapiens
gauggcagcucgaguuguc

SEQ ID NO: 437243 - RNA, 19 nt, Homo sapiens
caaauaauggcuagaaagu

SEQ ID NO: 437244 - RNA, 19 nt, Homo sapiens
gaauugcuauugucaacca

SEQ ID NO: 437245 - RNA, 19 nt, Homo sapiens
ucaaagauuccacugauug

SEQ ID NO: 437246 - RNA, 19 nt, Homo sapiens
uaaugaagccucugcaaau

SEQ ID NO: 437247 - RNA, 19 nt, Homo sapiens
gacuucaucugcuguuuau

SEQ ID NO: 437248 - RNA, 19 nt, Homo sapiens
cacauacucuggaacuuga

SEQ ID NO: 437249 - RNA, 19 nt, Homo sapiens
uggaaguguucgccaguua

SEQ ID NO: 437250 - RNA, 19 nt, Homo sapiens
gaaaccacacaucgauauu

SEQ ID NO: 437251 - RNA, 19 nt, Homo sapiens
aaagaguuguccuguaguu

SEQ ID NO: 437252 - RNA, 19 nt, Homo sapiens
guuaccagcguuugaauuu

SEQ ID NO: 437253 - RNA, 19 nt, Homo sapiens
cuuuaaagauggugccuaa

SEQ ID NO: 437254 - RNA, 19 nt, Homo sapiens
aauauuugcuucccuuaga

SEQ ID NO: 437255 - RNA, 19 nt, Homo sapiens
gagaaggcauaaacauuuu

SEQ ID NO: 437256 - RNA, 19 nt, Homo sapiens
aaaggcugcuauuacuaua

SEQ ID NO: 437257 - RNA, 19 nt, Homo sapiens
uaaaggcugcuauuacuau

SEQ ID NO: 437258 - RNA, 19 nt, Homo sapiens
ggaggagaguugcagagau

SEQ ID NO: 437259 - RNA, 19 nt, Homo sapiens
gcaaauaauggcuagaaag

SEQ ID NO: 437260 - RNA, 19 nt, Homo sapiens
ugaggaagaguguuuacua

SEQ ID NO: 437261 - RNA, 19 nt, Homo sapiens
uaaagauggugccuaagca

SEQ ID NO: 437262 - RNA, 19 nt, Homo sapiens
uccaugagguucuguauuc

SEQ ID NO: 437263 - RNA, 19 nt, Homo sapiens
ugacaaauguaaaccuaag

SEQ ID NO: 437264 - RNA, 19 nt, Homo sapiens
gaaggcaagagcucauuug

SEQ ID NO: 437265 - RNA, 19 nt, Homo sapiens
uggcuggcaugaauaaauu

SEQ ID NO: 437266 - RNA, 19 nt, Homo sapiens
gaaauaacagaagucuuga

SEQ ID NO: 437267 - RNA, 19 nt, Homo sapiens
gcacauuaucuaaaccauu

SEQ ID NO: 437268 - RNA, 19 nt, Homo sapiens
gguaccacauauauucauu

SEQ ID NO: 437269 - RNA, 19 nt, Homo sapiens
ggccaaggauuauaaacca

SEQ ID NO: 437270 - RNA, 19 nt, Homo sapiens
uuaccugguuugccaagua

SEQ ID NO: 437271 - RNA, 19 nt, Homo sapiens
caucauggccaccuaucua

SEQ ID NO: 437272 - RNA, 19 nt, Homo sapiens
aaugaagccucugcaaauu

SEQ ID NO: 437273 - RNA, 19 nt, Homo sapiens
cgacuucaucugcuguuua

SEQ ID NO: 437274 - RNA, 19 nt, Homo sapiens
agaacgaaauguugaagau

SEQ ID NO: 437275 - RNA, 19 nt, Homo sapiens
caaagauuccacugauuga

SEQ ID NO: 437276 - RNA, 19 nt, Homo sapiens
aaagaagaguggaaacuac

SEQ ID NO: 437277 - RNA, 19 nt, Homo sapiens
gcggaucgcgucaucguuu

SEQ ID NO: 437278 - RNA, 19 nt, Homo sapiens
gcaaaccugcugaugucua

SEQ ID NO: 437279 - RNA, 19 nt, Homo sapiens
uuaccagcguuugaauuua

SEQ ID NO: 437280 - RNA, 19 nt, Homo sapiens
gagcucauuuggccucugu

SEQ ID NO: 437281 - RNA, 19 nt, Homo sapiens
ccuaagcaucuauguauuu

SEQ ID NO: 437282 - RNA, 19 nt, Homo sapiens
ugucucagcuugaaauuac

SEQ ID NO: 437283 - RNA, 19 nt, Homo sapiens
cagaaugcuugcuggaaga

SEQ ID NO: 437284 - RNA, 19 nt, Homo sapiens
uagacuaucucuccgacuu

SEQ ID NO: 437285 - RNA, 19 nt, Homo sapiens
caaagacacaggcaauugu

SEQ ID NO: 437286 - RNA, 19 nt, Homo sapiens
gcaacaagaugaauuagaa

SEQ ID NO: 437287 - RNA, 19 nt, Homo sapiens
gaaagggagucaacuauga

SEQ ID NO: 437288 - RNA, 19 nt, Homo sapiens
gaucugauguugguuauua

SEQ ID NO: 437289 - RNA, 19 nt, Homo sapiens
gcagacacguggccuaaua

SEQ ID NO: 437290 - RNA, 19 nt, Homo sapiens
ggagucaacuaugaaauua

SEQ ID NO: 437291 - RNA, 19 nt, Homo sapiens
gaacaucccugucuuaacu

SEQ ID NO: 437292 - RNA, 19 nt, Homo sapiens
gaaagcucaugaucacuua

SEQ ID NO: 437293 - RNA, 19 nt, Homo sapiens
gaucaacagucucaguaua

SEQ ID NO: 437294 - RNA, 19 nt, Homo sapiens
cacaagggcucucaaagua

SEQ ID NO: 437295 - RNA, 19 nt, Homo sapiens
aaacggaacugcaauucua

SEQ ID NO: 437296 - RNA, 19 nt, Homo sapiens
gaaucagacugguuaguuu

SEQ ID NO: 437297 - RNA, 19 nt, Homo sapiens
caagggcucucaaaguaua

SEQ ID NO: 437298 - RNA, 19 nt, Homo sapiens
caacauuucuguagaugaa

SEQ ID NO: 437299 - RNA, 19 nt, Homo sapiens
gaaauacagucacauuauc

SEQ ID NO: 437300 - RNA, 19 nt, Homo sapiens
gaaaggacguggaaacaag

SEQ ID NO: 437301 - RNA, 19 nt, Homo sapiens
gagcaacuccaacaucuua

SEQ ID NO: 437302 - RNA, 19 nt, Homo sapiens
gaagagacccaguaacuug

SEQ ID NO: 437303 - RNA, 19 nt, Homo sapiens
agaaacaucugccauuaaa

SEQ ID NO: 437304 - RNA, 19 nt, Homo sapiens
ccaagacucucgaaucaaa

SEQ ID NO: 437305 - RNA, 19 nt, Homo sapiens
gggcaaagcugaagcaucu

SEQ ID NO: 437306 - RNA, 19 nt, Homo sapiens
ggaugacagugcagaauuu

SEQ ID NO: 437307 - RNA, 19 nt, Homo sapiens
gaagacagguuguugacau

SEQ ID NO: 437308 - RNA, 19 nt, Homo sapiens
uuaaaggacucaaaccuaa

SEQ ID NO: 437309 - RNA, 19 nt, Homo sapiens
caagaugccuccugucaga

SEQ ID NO: 437310 - RNA, 19 nt, Homo sapiens
gaaacggacuuacuaguac

SEQ ID NO: 437311 - RNA, 19 nt, Homo sapiens
gagagaccaucauuuguga

SEQ ID NO: 437312 - RNA, 19 nt, Homo sapiens
acaaagagccuuccuauuc

SEQ ID NO: 437313 - RNA, 19 nt, Homo sapiens
gcaacaacaugaacaaugg

SEQ ID NO: 437314 - RNA, 19 nt, Homo sapiens
gauaugaaauccgagauga

SEQ ID NO: 437315 - RNA, 19 nt, Homo sapiens
aagaggauauucuaccuua

SEQ ID NO: 437316 - RNA, 19 nt, Homo sapiens
ugaaagcuaugaccaagaa

SEQ ID NO: 437317 - RNA, 19 nt, Homo sapiens
gaaacucgauaccacauca

SEQ ID NO: 437318 - RNA, 19 nt, Homo sapiens
ccaagaggcuuaugagauc

SEQ ID NO: 437319 - RNA, 19 nt, Homo sapiens
gaaagaggagaagauaaua

SEQ ID NO: 437320 - RNA, 19 nt, Homo sapiens
gugcagaauuuaaauguga

SEQ ID NO: 437321 - RNA, 19 nt, Homo sapiens
gaaaaggcgugcaguacua

SEQ ID NO: 437322 - RNA, 19 nt, Homo sapiens
gcagguacuuggaggauau

SEQ ID NO: 437323 - RNA, 19 nt, Homo sapiens
ggugacagcuggugacaug

SEQ ID NO: 437324 - RNA, 19 nt, Homo sapiens
gcauugcacugcuuauaug

SEQ ID NO: 437325 - RNA, 19 nt, Homo sapiens
gaggagaagauaauaauga

SEQ ID NO: 437326 - RNA, 19 nt, Homo sapiens
gagggcagcuaaugcauau

SEQ ID NO: 437327 - RNA, 19 nt, Homo sapiens
aaugacagauggugaagua

SEQ ID NO: 437328 - RNA, 19 nt, Homo sapiens
gacaaaugaugcccucuga

SEQ ID NO: 437329 - RNA, 19 nt, Homo sapiens
gaacagacagaucaucaga

SEQ ID NO: 437330 - RNA, 19 nt, Homo sapiens
gcagaaauacagucacauu

SEQ ID NO: 437331 - RNA, 19 nt, Homo sapiens
cuuaugagaucuaauguga

SEQ ID NO: 437332 - RNA, 19 nt, Homo sapiens
gcagagaaaccuacacaga

SEQ ID NO: 437333 - RNA, 19 nt, Homo sapiens
ccuacaagauuuccuuaaa

SEQ ID NO: 437334 - RNA, 19 nt, Homo sapiens
gucgaaaccuacaagauuu

SEQ ID NO: 437335 - RNA, 19 nt, Homo sapiens
gcaaauguaggucgaagaa

SEQ ID NO: 437336 - RNA, 19 nt, Homo sapiens
gagcaaaccauuauaccuu

SEQ ID NO: 437337 - RNA, 19 nt, Homo sapiens
ggauguauuugcaacaaga

SEQ ID NO: 437338 - RNA, 19 nt, Homo sapiens
ucaacagucucaguauaua

SEQ ID NO: 437339 - RNA, 19 nt, Homo sapiens
gacaguagaucaacagucu

SEQ ID NO: 437340 - RNA, 19 nt, Homo sapiens
ugucuuaacuggccuaaau

SEQ ID NO: 437341 - RNA, 19 nt, Homo sapiens
gagaugaucauaccuugaa

SEQ ID NO: 437342 - RNA, 19 nt, Homo sapiens
gaggaaagcucaugaucac

SEQ ID NO: 437343 - RNA, 19 nt, Homo sapiens
uaacuggccuaaauuucuu

SEQ ID NO: 437344 - RNA, 19 nt, Homo sapiens
gcuauaaagucaccuacug

SEQ ID NO: 437345 - RNA, 19 nt, Homo sapiens
caagauguccuaccaacaa

SEQ ID NO: 437346 - RNA, 19 nt, Homo sapiens
acucaaaccuaaugcaauu

SEQ ID NO: 437347 - RNA, 19 nt, Homo sapiens
gagagagaguggagacaga

SEQ ID NO: 437348 - RNA, 19 nt, Homo sapiens
agacucaucucauccaaga

SEQ ID NO: 437349 - RNA, 19 nt, Homo sapiens
aauaucagauccagugaaa

SEQ ID NO: 437350 - RNA, 19 nt, Homo sapiens
cagaaauacagucacauua

SEQ ID NO: 437351 - RNA, 19 nt, Homo sapiens
ucaagaaccuccacauuuu

SEQ ID NO: 437352 - RNA, 19 nt, Homo sapiens
ggaaagcucaugaucacuu

SEQ ID NO: 437353 - RNA, 19 nt, Homo sapiens
caaucagaguguacaaauu

SEQ ID NO: 437354 - RNA, 19 nt, Homo sapiens
aaauguaggucgaagaaau

SEQ ID NO: 437355 - RNA, 19 nt, Homo sapiens
gaggauauucuaccuuauu

SEQ ID NO: 437356 - RNA, 19 nt, Homo sapiens
agagaaaccuacacagaug

SEQ ID NO: 437357 - RNA, 19 nt, Homo sapiens
caaagauuaucgagcaaau

SEQ ID NO: 437358 - RNA, 19 nt, Homo sapiens
aaaacaagcugaacaaaga

SEQ ID NO: 437359 - RNA, 19 nt, Homo sapiens
ggagcagccuguuggauca

SEQ ID NO: 437360 - RNA, 19 nt, Homo sapiens
ucaaacaguuggagaaugg

SEQ ID NO: 437361 - RNA, 19 nt, Homo sapiens
guaacuguauccaagaaug

SEQ ID NO: 437362 - RNA, 19 nt, Homo sapiens
gacaagguccugugaauca

SEQ ID NO: 437363 - RNA, 19 nt, Homo sapiens
cgggaugacuucagacaaa

SEQ ID NO: 437364 - RNA, 19 nt, Homo sapiens
uauaguacauggacggaaa

SEQ ID NO: 437365 - RNA, 19 nt, Homo sapiens
gcaaucagaguguacaaau

SEQ ID NO: 437366 - RNA, 19 nt, Homo sapiens
guacuuggaggauaugaaa

SEQ ID NO: 437367 - RNA, 19 nt, Homo sapiens
gaagaacuccagcccaugu

SEQ ID NO: 437368 - RNA, 19 nt, Homo sapiens
gcaacuccaacaucuuaua

SEQ ID NO: 437369 - RNA, 19 nt, Homo sapiens
acagaugucagcagaaaua

SEQ ID NO: 437370 - RNA, 19 nt, Homo sapiens
cacaaugacugcuccauca

SEQ ID NO: 437371 - RNA, 19 nt, Homo sapiens
agaaacggacuuacuagua

SEQ ID NO: 437372 - RNA, 19 nt, Homo sapiens
ggaaguuacagaugugauu

SEQ ID NO: 437373 - RNA, 19 nt, Homo sapiens
gauaucacuccucagcuua

SEQ ID NO: 437374 - RNA, 19 nt, Homo sapiens
aaacaaaacugaaccacaa

SEQ ID NO: 437375 - RNA, 19 nt, Homo sapiens
agaguaugcuggucugaaa

SEQ ID NO: 437376 - RNA, 19 nt, Homo sapiens
gaagagaaacggacuuacu

SEQ ID NO: 437377 - RNA, 19 nt, Homo sapiens
ggaggaaagcucaugauca

SEQ ID NO: 437378 - RNA, 19 nt, Homo sapiens
gcaaaugcagaaccacaaa

SEQ ID NO: 437379 - RNA, 19 nt, Homo sapiens
gauaaaauguucagugcaa

SEQ ID NO: 437380 - RNA, 19 nt, Homo sapiens
ugaaagaggagaagauaau

SEQ ID NO: 437381 - RNA, 19 nt, Homo sapiens
guaggucgaagaaauauug

SEQ ID NO: 437382 - RNA, 19 nt, Homo sapiens
ggcaagaacacccaaggua

SEQ ID NO: 437383 - RNA, 19 nt, Homo sapiens
ggaaugguccaagaguaua

SEQ ID NO: 437384 - RNA, 19 nt, Homo sapiens
gggagucaacuaugaaauu

SEQ ID NO: 437385 - RNA, 19 nt, Homo sapiens
ugacagugcagaauuuaaa

SEQ ID NO: 437386 - RNA, 19 nt, Homo sapiens
gcaacaagaugaauuagaa

SEQ ID NO: 437387 - RNA, 19 nt, Homo sapiens
gaaagggagucaacuauga

SEQ ID NO: 437388 - RNA, 19 nt, Homo sapiens
gaucugauguugguuauua

SEQ ID NO: 437389 - RNA, 19 nt, Homo sapiens
gcagacacguggccuaaua

SEQ ID NO: 437390 - RNA, 19 nt, Homo sapiens
ggagucaacuaugaaauua

SEQ ID NO: 437391 - RNA, 19 nt, Homo sapiens
gaacaucccugucuuaacu

SEQ ID NO: 437392 - RNA, 19 nt, Homo sapiens
gaaagcucaugaucacuua

SEQ ID NO: 437393 - RNA, 19 nt, Homo sapiens
gaucaacagucucaguaua

SEQ ID NO: 437394 - RNA, 19 nt, Homo sapiens
cacaagggcucucaaagua

SEQ ID NO: 437395 - RNA, 19 nt, Homo sapiens
aaacggaacugcaauucua

SEQ ID NO: 437396 - RNA, 19 nt, Homo sapiens
gaaucagacugguuaguuu

SEQ ID NO: 437397 - RNA, 19 nt, Homo sapiens
caagggcucucaaaguaua

SEQ ID NO: 437398 - RNA, 19 nt, Homo sapiens
caacauuucuguagaugaa

SEQ ID NO: 437399 - RNA, 19 nt, Homo sapiens
gaaauacagucacauuauc

SEQ ID NO: 437400 - RNA, 19 nt, Homo sapiens
gaaaggacguggaaacaag

SEQ ID NO: 437401 - RNA, 19 nt, Homo sapiens
gagcaacuccaacaucuua

SEQ ID NO: 437402 - RNA, 19 nt, Homo sapiens
gaagagacccaguaacuug

SEQ ID NO: 437403 - RNA, 19 nt, Homo sapiens
agaaacaucugccauuaaa

SEQ ID NO: 437404 - RNA, 19 nt, Homo sapiens
ccaagacucucgaaucaaa

SEQ ID NO: 437405 - RNA, 19 nt, Homo sapiens
gggcaaagcugaagcaucu

SEQ ID NO: 437406 - RNA, 19 nt, Homo sapiens
ggaugacagugcagaauuu

SEQ ID NO: 437407 - RNA, 19 nt, Homo sapiens
gaagacagguuguugacau

SEQ ID NO: 437408 - RNA, 19 nt, Homo sapiens
uuaaaggacucaaaccuaa

SEQ ID NO: 437409 - RNA, 19 nt, Homo sapiens
gccgggagcugccucuuua

SEQ ID NO: 437410 - RNA, 19 nt, Homo sapiens
caagaugccuccugucaga

SEQ ID NO: 437411 - RNA, 19 nt, Homo sapiens
gaaacggacuuacuaguac

SEQ ID NO: 437412 - RNA, 19 nt, Homo sapiens
gagagaccaucauuuguga

SEQ ID NO: 437413 - RNA, 19 nt, Homo sapiens
gaagacaaaccuuggaauu

SEQ ID NO: 437414 - RNA, 19 nt, Homo sapiens
acaaagagccuuccuauuc

SEQ ID NO: 437415 - RNA, 19 nt, Homo sapiens
gcaacaacaugaacaaugg

SEQ ID NO: 437416 - RNA, 19 nt, Homo sapiens
gauaugaaauccgagauga

SEQ ID NO: 437417 - RNA, 19 nt, Homo sapiens
aagaggauauucuaccuua

SEQ ID NO: 437418 - RNA, 19 nt, Homo sapiens
ugaaagcuaugaccaagaa

SEQ ID NO: 437419 - RNA, 19 nt, Homo sapiens
gaaacucgauaccacauca

SEQ ID NO: 437420 - RNA, 19 nt, Homo sapiens
ccaagaggcuuaugagauc

SEQ ID NO: 437421 - RNA, 19 nt, Homo sapiens
gaaagaggagaagauaaua

SEQ ID NO: 437422 - RNA, 19 nt, Homo sapiens
gugcagaauuuaaauguga

SEQ ID NO: 437423 - RNA, 19 nt, Homo sapiens
gaaaaggcgugcaguacua

SEQ ID NO: 437424 - RNA, 19 nt, Homo sapiens
gcagguacuuggaggauau

SEQ ID NO: 437425 - RNA, 19 nt, Homo sapiens
ggugacagcuggugacaug

SEQ ID NO: 437426 - RNA, 19 nt, Homo sapiens
gcauugcacugcuuauaug

SEQ ID NO: 437427 - RNA, 19 nt, Homo sapiens
gaggagaagauaauaauga

SEQ ID NO: 437428 - RNA, 19 nt, Homo sapiens
gagggcagcuaaugcauau

SEQ ID NO: 437429 - RNA, 19 nt, Homo sapiens
aaugacagauggugaagua

SEQ ID NO: 437430 - RNA, 19 nt, Homo sapiens
ggauuaauaugucucuguu

SEQ ID NO: 437431 - RNA, 19 nt, Homo sapiens
gacaaaugaugcccucuga

SEQ ID NO: 437432 - RNA, 19 nt, Homo sapiens
gaacagacagaucaucaga

SEQ ID NO: 437433 - RNA, 19 nt, Homo sapiens
gcagaaauacagucacauu

SEQ ID NO: 437434 - RNA, 19 nt, Homo sapiens
cuuaugagaucuaauguga

SEQ ID NO: 437435 - RNA, 19 nt, Homo sapiens
gcagagaaaccuacacaga

SEQ ID NO: 437436 - RNA, 19 nt, Homo sapiens
ccuacaagauuuccuuaaa

SEQ ID NO: 437437 - RNA, 19 nt, Homo sapiens
gucgaaaccuacaagauuu

SEQ ID NO: 437438 - RNA, 19 nt, Homo sapiens
gcaaauguaggucgaagaa

SEQ ID NO: 437439 - RNA, 19 nt, Homo sapiens
ccggaaaggucgacgagua

SEQ ID NO: 437440 - RNA, 19 nt, Homo sapiens
gagcaaaccauuauaccuu

SEQ ID NO: 437441 - RNA, 19 nt, Homo sapiens
ggauguauuugcaacaaga

SEQ ID NO: 437442 - RNA, 19 nt, Homo sapiens
ucaacagucucaguauaua

SEQ ID NO: 437443 - RNA, 19 nt, Homo sapiens
gacaguagaucaacagucu

SEQ ID NO: 437444 - RNA, 19 nt, Homo sapiens
ugucuuaacuggccuaaau

SEQ ID NO: 437445 - RNA, 19 nt, Homo sapiens
gagaugaucauaccuugaa

SEQ ID NO: 437446 - RNA, 19 nt, Homo sapiens
gaggaaagcucaugaucac

SEQ ID NO: 437447 - RNA, 19 nt, Homo sapiens
uaacuggccuaaauuucuu

SEQ ID NO: 437448 - RNA, 19 nt, Homo sapiens
gcuauaaagucaccuacug

SEQ ID NO: 437449 - RNA, 19 nt, Homo sapiens
caagauguccuaccaacaa

SEQ ID NO: 437450 - RNA, 19 nt, Homo sapiens
acucaaaccuaaugcaauu

SEQ ID NO: 437451 - RNA, 19 nt, Homo sapiens
gagagagaguggagacaga

SEQ ID NO: 437452 - RNA, 19 nt, Homo sapiens
agacucaucucauccaaga

SEQ ID NO: 437453 - RNA, 19 nt, Homo sapiens
aauaucagauccagugaaa

SEQ ID NO: 437454 - RNA, 19 nt, Homo sapiens
cagaaauacagucacauua

SEQ ID NO: 437455 - RNA, 19 nt, Homo sapiens
ucaagaaccuccacauuuu

SEQ ID NO: 437456 - RNA, 19 nt, Homo sapiens
ggaaagcucaugaucacuu

SEQ ID NO: 437457 - RNA, 19 nt, Homo sapiens
caaucagaguguacaaauu

SEQ ID NO: 437458 - RNA, 19 nt, Homo sapiens
aaauguaggucgaagaaau

SEQ ID NO: 437459 - RNA, 19 nt, Homo sapiens
gaggauauucuaccuuauu

SEQ ID NO: 437460 - RNA, 19 nt, Homo sapiens
agagaaaccuacacagaug

SEQ ID NO: 437461 - RNA, 19 nt, Homo sapiens
caaagauuaucgagcaaau

SEQ ID NO: 437462 - RNA, 19 nt, Homo sapiens
aaaacaagcugaacaaaga

SEQ ID NO: 437463 - RNA, 19 nt, Homo sapiens
ggagcagccuguuggauca

SEQ ID NO: 437464 - RNA, 19 nt, Homo sapiens
ucaaacaguuggagaaugg

SEQ ID NO: 437465 - RNA, 19 nt, Homo sapiens
guaacuguauccaagaaug

SEQ ID NO: 437466 - RNA, 19 nt, Homo sapiens
gacaagguccugugaauca

SEQ ID NO: 437467 - RNA, 19 nt, Homo sapiens
cgggaugacuucagacaaa

SEQ ID NO: 437468 - RNA, 19 nt, Homo sapiens
uauaguacauggacggaaa

SEQ ID NO: 437469 - RNA, 19 nt, Homo sapiens
gcaaucagaguguacaaau

SEQ ID NO: 437470 - RNA, 19 nt, Homo sapiens
guacuuggaggauaugaaa

SEQ ID NO: 437471 - RNA, 19 nt, Homo sapiens
gaagaacuccagcccaugu

SEQ ID NO: 437472 - RNA, 19 nt, Homo sapiens
gcaacuccaacaucuuaua

SEQ ID NO: 437473 - RNA, 19 nt, Homo sapiens
acagaugucagcagaaaua

SEQ ID NO: 437474 - RNA, 19 nt, Homo sapiens
gagcugcugcuucuacuuu

SEQ ID NO: 437475 - RNA, 19 nt, Homo sapiens
cacaaugacugcuccauca

SEQ ID NO: 437476 - RNA, 19 nt, Homo sapiens
agaaacggacuuacuagua

SEQ ID NO: 437477 - RNA, 19 nt, Homo sapiens
ggaaguuacagaugugauu

SEQ ID NO: 437478 - RNA, 19 nt, Homo sapiens
gaaaggucgacgaguaauu

SEQ ID NO: 437479 - RNA, 19 nt, Homo sapiens
aaacaaaacugaaccacaa

SEQ ID NO: 437480 - RNA, 19 nt, Homo sapiens
agaguaugcuggucugaaa

SEQ ID NO: 437481 - RNA, 19 nt, Homo sapiens
gaagagaaacggacuuacu

SEQ ID NO: 437482 - RNA, 19 nt, Homo sapiens
ggaggaaagcucaugauca

SEQ ID NO: 437483 - RNA, 19 nt, Homo sapiens
guguguggcuucauacauu

SEQ ID NO: 437484 - RNA, 19 nt, Homo sapiens
gcaaaugcagaaccacaaa

SEQ ID NO: 437485 - RNA, 19 nt, Homo sapiens
gauaaaauguucagugcaa

SEQ ID NO: 437486 - RNA, 19 nt, Homo sapiens
ggacacagcuguaagauug

SEQ ID NO: 437487 - RNA, 19 nt, Homo sapiens
gacaagagauuacagauaa

SEQ ID NO: 437488 - RNA, 19 nt, Homo sapiens
gaagaaacauucccuauuc

SEQ ID NO: 437489 - RNA, 19 nt, Homo sapiens
gagaugagcaagucaauua

SEQ ID NO: 437490 - RNA, 19 nt, Homo sapiens
ggaaugagcuucagaugca

SEQ ID NO: 437491 - RNA, 19 nt, Homo sapiens
gaaugaaagcugaagauua

SEQ ID NO: 437492 - RNA, 19 nt, Homo sapiens
gcaaagagagugauauuga

SEQ ID NO: 437493 - RNA, 19 nt, Homo sapiens
ugaagcaucucaaacauaa

SEQ ID NO: 437494 - RNA, 19 nt, Homo sapiens
ccacagagaucacuuagau

SEQ ID NO: 437495 - RNA, 19 nt, Homo sapiens
aagaacagcugcauaauga

SEQ ID NO: 437496 - RNA, 19 nt, Homo sapiens
guauagagcugaaacugaa

SEQ ID NO: 437497 - RNA, 19 nt, Homo sapiens
cagcaaauccuaaugauaa

SEQ ID NO: 437498 - RNA, 19 nt, Homo sapiens
gaagcaaucucagcagaaa

SEQ ID NO: 437499 - RNA, 19 nt, Homo sapiens
ugucgaagaugccauguua

SEQ ID NO: 437500 - RNA, 19 nt, Homo sapiens
gaagguauaugcuaugaag

SEQ ID NO: 437501 - RNA, 19 nt, Homo sapiens
gauaaaagcuugcaggaaa

SEQ ID NO: 437502 - RNA, 19 nt, Homo sapiens
caauauuucucgacacuuu

SEQ ID NO: 437503 - RNA, 19 nt, Homo sapiens
gaaagaggacuuaauuugu

SEQ ID NO: 437504 - RNA, 19 nt, Homo sapiens
agaagaagccaaugacuua

SEQ ID NO: 437505 - RNA, 19 nt, Homo sapiens
gaaaugguguagaagaaau

SEQ ID NO: 437506 - RNA, 19 nt, Homo sapiens
ucacaaaggccaugaguuu

SEQ ID NO: 437507 - RNA, 19 nt, Homo sapiens
gcaauugcgugcuaaacuu

SEQ ID NO: 437508 - RNA, 19 nt, Homo sapiens
ggaagcaaagagauuauua

SEQ ID NO: 437509 - RNA, 19 nt, Homo sapiens
ucacuuaccuuuccugaug

SEQ ID NO: 437510 - RNA, 19 nt, Homo sapiens
cuacaaguguugcuaguuu

SEQ ID NO: 437511 - RNA, 19 nt, Homo sapiens
gugcagaaccucaaacaua

SEQ ID NO: 437512 - RNA, 19 nt, Homo sapiens
uaacagaacuagcuccaau

SEQ ID NO: 437513 - RNA, 19 nt, Homo sapiens
gaaagaaagcuaauacaca

SEQ ID NO: 437514 - RNA, 19 nt, Homo sapiens
caaauuggcagaaauaaug

SEQ ID NO: 437515 - RNA, 19 nt, Homo sapiens
gaacagcugcauaaugaaa

SEQ ID NO: 437516 - RNA, 19 nt, Homo sapiens
guaugaagaugaauaagga

SEQ ID NO: 437517 - RNA, 19 nt, Homo sapiens
caagagauaugcugcuguu

SEQ ID NO: 437518 - RNA, 19 nt, Homo sapiens
ccaaauagaggaaauauca

SEQ ID NO: 437519 - RNA, 19 nt, Homo sapiens
caagucaauuagucaguua

SEQ ID NO: 437520 - RNA, 19 nt, Homo sapiens
caaauaagcggcuguuguu

SEQ ID NO: 437521 - RNA, 19 nt, Homo sapiens
gaaagucagucagaauuca

SEQ ID NO: 437522 - RNA, 19 nt, Homo sapiens
gaagaacagcugcauaaug

SEQ ID NO: 437523 - RNA, 19 nt, Homo sapiens
guacuuguaugaagaugaa

SEQ ID NO: 437524 - RNA, 19 nt, Homo sapiens
gcugcaagcuauauuagaa

SEQ ID NO: 437525 - RNA, 19 nt, Homo sapiens
gcuguaagauugaggaaga

SEQ ID NO: 437526 - RNA, 19 nt, Homo sapiens
ugaaagaauuggaugaaga

SEQ ID NO: 437527 - RNA, 19 nt, Homo sapiens
gcgaaaugguguagaagaa

SEQ ID NO: 437528 - RNA, 19 nt, Homo sapiens
guggagaucuuguaaacuu

SEQ ID NO: 437529 - RNA, 19 nt, Homo sapiens
gaagagaagaaauguagaa

SEQ ID NO: 437530 - RNA, 19 nt, Homo sapiens
caaacgacaucucuucuuc

SEQ ID NO: 437531 - RNA, 19 nt, Homo sapiens
gccaaugacuuacuuagga

SEQ ID NO: 437532 - RNA, 19 nt, Homo sapiens
gaagaugccauguuaagug

SEQ ID NO: 437533 - RNA, 19 nt, Homo sapiens
gaaggcagaggaagaauau

SEQ ID NO: 437534 - RNA, 19 nt, Homo sapiens
cgaauuacaucuuuacaag

SEQ ID NO: 437535 - RNA, 19 nt, Homo sapiens
ccaaggagauguguauaga

SEQ ID NO: 437536 - RNA, 19 nt, Homo sapiens
aauauaaacuggagaagga

SEQ ID NO: 437537 - RNA, 19 nt, Homo sapiens
gaagaaggcagaggaagaa

SEQ ID NO: 437538 - RNA, 19 nt, Homo sapiens
gauaaagaucacacuguua

SEQ ID NO: 437539 - RNA, 19 nt, Homo sapiens
gaaacaguauagaggaaau

SEQ ID NO: 437540 - RNA, 19 nt, Homo sapiens
uggaacaccugauuauauu

SEQ ID NO: 437541 - RNA, 19 nt, Homo sapiens
gaauaaggaaggcauggua

SEQ ID NO: 437542 - RNA, 19 nt, Homo sapiens
gauaacaugcugcuggaua

SEQ ID NO: 437543 - RNA, 19 nt, Homo sapiens
gaagugaauucggauuguu

SEQ ID NO: 437544 - RNA, 19 nt, Homo sapiens
gcagaaauaaugaaucgaa

SEQ ID NO: 437545 - RNA, 19 nt, Homo sapiens
gcaagucaauuagucaguu

SEQ ID NO: 437546 - RNA, 19 nt, Homo sapiens
uaaagaaagucagucagaa

SEQ ID NO: 437547 - RNA, 19 nt, Homo sapiens
gagaagagaagaaauguag

SEQ ID NO: 437548 - RNA, 19 nt, Homo sapiens
gaagagggaaaucaaagaa

SEQ ID NO: 437549 - RNA, 19 nt, Homo sapiens
auucacagcuugcuaauga

SEQ ID NO: 437550 - RNA, 19 nt, Homo sapiens
ugcagaaccucaaacauaa

SEQ ID NO: 437551 - RNA, 19 nt, Homo sapiens
caaaggccaugaguuuauu

SEQ ID NO: 437552 - RNA, 19 nt, Homo sapiens
aagaaaggauggaggauga

SEQ ID NO: 437553 - RNA, 19 nt, Homo sapiens
agagguaaaugaacacaaa

SEQ ID NO: 437554 - RNA, 19 nt, Homo sapiens
gaagaaaucaaacgacauc

SEQ ID NO: 437555 - RNA, 19 nt, Homo sapiens
caacaacgguuagaacaag

SEQ ID NO: 437556 - RNA, 19 nt, Homo sapiens
agacagaggucaugauucu

SEQ ID NO: 437557 - RNA, 19 nt, Homo sapiens
acagagaucacuuagauaa

SEQ ID NO: 437558 - RNA, 19 nt, Homo sapiens
ccaaagcucguuuaacuga

SEQ ID NO: 437559 - RNA, 19 nt, Homo sapiens
ggaaaucaaagaagaaauc

SEQ ID NO: 437560 - RNA, 19 nt, Homo sapiens
ucuauaagcuggaagaaca

SEQ ID NO: 437561 - RNA, 19 nt, Homo sapiens
gaaacauucccuauuccua

SEQ ID NO: 437562 - RNA, 19 nt, Homo sapiens
ggccaugaguuuauuccua

SEQ ID NO: 437563 - RNA, 19 nt, Homo sapiens
ggaacugaaugacaugcaa

SEQ ID NO: 437564 - RNA, 19 nt, Homo sapiens
gagagaaauucaaccagau

SEQ ID NO: 437565 - RNA, 19 nt, Homo sapiens
acacaagauuugagaaaga

SEQ ID NO: 437566 - RNA, 19 nt, Homo sapiens
gguaaaggaacuuaaagaa

SEQ ID NO: 437567 - RNA, 19 nt, Homo sapiens
gcagaugaaacaggaaaua

SEQ ID NO: 437568 - RNA, 19 nt, Homo sapiens
gaaaugcaguuaaaagaug

SEQ ID NO: 437569 - RNA, 19 nt, Homo sapiens
uagcaaucguagauacuua

SEQ ID NO: 437570 - RNA, 19 nt, Homo sapiens
cgacaucucuucuucaaaa

SEQ ID NO: 437571 - RNA, 19 nt, Homo sapiens
uggagaaguucaauuggua

SEQ ID NO: 437572 - RNA, 19 nt, Homo sapiens
aaagaggacuuaauuuguc

SEQ ID NO: 437573 - RNA, 19 nt, Homo sapiens
agaaagaggacuuaauuug

SEQ ID NO: 437574 - RNA, 19 nt, Homo sapiens
gaaaagauguagagaugga

SEQ ID NO: 437575 - RNA, 19 nt, Homo sapiens
gcaauccaauccaucuaug

SEQ ID NO: 437576 - RNA, 19 nt, Homo sapiens
caaagucuguggcaaugug

SEQ ID NO: 437577 - RNA, 19 nt, Homo sapiens
gaccuucaagcucgaauua

SEQ ID NO: 437578 - RNA, 19 nt, Homo sapiens
uaaaggaucaguuggaaga

SEQ ID NO: 437579 - RNA, 19 nt, Homo sapiens
gaacaccugauuauauuuc

SEQ ID NO: 437580 - RNA, 19 nt, Homo sapiens
ccaggaagguauaugcuau

SEQ ID NO: 437581 - RNA, 19 nt, Homo sapiens
gcaaacagcaugcuaacca

SEQ ID NO: 437582 - RNA, 19 nt, Homo sapiens
gcagaaacuagaacauuug

SEQ ID NO: 437583 - RNA, 19 nt, Homo sapiens
gaacacaaaguaaccaaag

SEQ ID NO: 437584 - RNA, 19 nt, Homo sapiens
gguaaaugaacacaaagua

SEQ ID NO: 437585 - RNA, 19 nt, Homo sapiens
aaacauucccuauuccuaa

SEQ ID NO: 437586 - RNA, 19 nt, Homo sapiens
ccagugggcugaaagauau

SEQ ID NO: 437587 - RNA, 19 nt, Homo sapiens
ggaggcugauucugauaua

SEQ ID NO: 437588 - RNA, 19 nt, Homo sapiens
gcugaaagauaugcugaaa

SEQ ID NO: 437589 - RNA, 19 nt, Homo sapiens
ccaaaaggcugguggauga

SEQ ID NO: 437590 - RNA, 19 nt, Homo sapiens
gagaagcaccucccaagga

SEQ ID NO: 437591 - RNA, 19 nt, Homo sapiens
ccaaggaggaucuaucuga

SEQ ID NO: 437592 - RNA, 19 nt, Homo sapiens
gaacagcaaagaacagagu

SEQ ID NO: 437593 - RNA, 19 nt, Homo sapiens
ccucacaacuccuuaccaa

SEQ ID NO: 437594 - RNA, 19 nt, Homo sapiens
gacccagggcuaucucuuu

SEQ ID NO: 437595 - RNA, 19 nt, Homo sapiens
ugacugccuuggcucacua

SEQ ID NO: 437596 - RNA, 19 nt, Homo sapiens
cagcagccguuaccuggau

SEQ ID NO: 437597 - RNA, 19 nt, Homo sapiens
agaacagagugaugggaaa

SEQ ID NO: 437598 - RNA, 19 nt, Homo sapiens
gaccggauccagagcaaug

SEQ ID NO: 437599 - RNA, 19 nt, Homo sapiens
gaacagagugaugggaaag

SEQ ID NO: 437600 - RNA, 19 nt, Homo sapiens
caauguagaaggccuauac

SEQ ID NO: 437601 - RNA, 19 nt, Homo sapiens
ugaaagauaugcugaaaac

SEQ ID NO: 437602 - RNA, 19 nt, Homo sapiens
ggccugcgguaccugcaaa

SEQ ID NO: 437603 - RNA, 19 nt, Homo sapiens
ggacugggguaagaaagaa

SEQ ID NO: 437604 - RNA, 19 nt, Homo sapiens
gggauggacaagucugaaa

SEQ ID NO: 437605 - RNA, 19 nt, Homo sapiens
gauccagagcaauguagaa

SEQ ID NO: 437606 - RNA, 19 nt, Homo sapiens
ccuggaggcugauucugau

SEQ ID NO: 437607 - RNA, 19 nt, Homo sapiens
gggaacagcaaagaacaga

SEQ ID NO: 437608 - RNA, 19 nt, Homo sapiens
gcacucccuugggcagaga

SEQ ID NO: 437609 - RNA, 19 nt, Homo sapiens
gagcuggacugggguaaga

SEQ ID NO: 437610 - RNA, 19 nt, Homo sapiens
guggaugagcugcaacuga

SEQ ID NO: 437611 - RNA, 19 nt, Homo sapiens
gcugguggaugagcugcaa

SEQ ID NO: 437612 - RNA, 19 nt, Homo sapiens
gagggauggacaagucuga

SEQ ID NO: 437613 - RNA, 19 nt, Homo sapiens
gaggcugauucugauauag

SEQ ID NO: 437614 - RNA, 19 nt, Homo sapiens
acagagugaugggaaagug

SEQ ID NO: 437615 - RNA, 19 nt, Homo sapiens
gaaaaccucacaacuccuu

SEQ ID NO: 437616 - RNA, 19 nt, Homo sapiens
ggagagacccagggcuauc

SEQ ID NO: 437617 - RNA, 19 nt, Homo sapiens
ggcgucauccuccucugua

SEQ ID NO: 437618 - RNA, 19 nt, Homo sapiens
ggcauuagcccagcucaag

SEQ ID NO: 437619 - RNA, 19 nt, Homo sapiens
gggaaagugacaugagaag

SEQ ID NO: 437620 - RNA, 19 nt, Homo sapiens
acccagggcuaucucuuuc

SEQ ID NO: 437621 - RNA, 19 nt, Homo sapiens
ccagggaacagcaaagaac

SEQ ID NO: 437622 - RNA, 19 nt, Homo sapiens
agggagggauggacaaguc

SEQ ID NO: 437623 - RNA, 19 nt, Homo sapiens
augggaaagugacaugaga

SEQ ID NO: 437624 - RNA, 19 nt, Homo sapiens
ggccuauaccugacugaug

SEQ ID NO: 437625 - RNA, 19 nt, Homo sapiens
gcaauguagaaggccuaua

SEQ ID NO: 437626 - RNA, 19 nt, Homo sapiens
ggaaagaguuuauguucua

SEQ ID NO: 437627 - RNA, 19 nt, Homo sapiens
cagaagaacuguuugauug

SEQ ID NO: 437628 - RNA, 19 nt, Homo sapiens
gagaagagcuccagcagau

SEQ ID NO: 437629 - RNA, 19 nt, Homo sapiens
gcaauugugugccaucaaa

SEQ ID NO: 437630 - RNA, 19 nt, Homo sapiens
uaagggaguucuucucuuu

SEQ ID NO: 437631 - RNA, 19 nt, Homo sapiens
gaagagcuccagcagauaa

SEQ ID NO: 437632 - RNA, 19 nt, Homo sapiens
ggagacaaaucaucaggaa

SEQ ID NO: 437633 - RNA, 19 nt, Homo sapiens
gcaaauugauggguaaaug

SEQ ID NO: 437634 - RNA, 19 nt, Homo sapiens
caagaucuguggagacaaa

SEQ ID NO: 437635 - RNA, 19 nt, Homo sapiens
guuguucacuucagaauuu

SEQ ID NO: 437636 - RNA, 19 nt, Homo sapiens
gcaccugacugaagaugaa

SEQ ID NO: 437637 - RNA, 19 nt, Homo sapiens
gaaauuauuccaugcaaga

SEQ ID NO: 437638 - RNA, 19 nt, Homo sapiens
caaggugucuacauuaaga

SEQ ID NO: 437639 - RNA, 19 nt, Homo sapiens
ccgagaagauggaauacua

SEQ ID NO: 437640 - RNA, 19 nt, Homo sapiens
ggaagaaauugagaacuau

SEQ ID NO: 437641 - RNA, 19 nt, Homo sapiens
gaagauggaauacuaacaa

SEQ ID NO: 437642 - RNA, 19 nt, Homo sapiens
gcagauggguaaccaggaa

SEQ ID NO: 437643 - RNA, 19 nt, Homo sapiens
uagaaugucugaaguacaa

SEQ ID NO: 437644 - RNA, 19 nt, Homo sapiens
gaucaaauugugcuucuaa

SEQ ID NO: 437645 - RNA, 19 nt, Homo sapiens
cagcuuguaugcagaagua

SEQ ID NO: 437646 - RNA, 19 nt, Homo sapiens
caaacgcauugauggauuu

SEQ ID NO: 437647 - RNA, 19 nt, Homo sapiens
gcagagagacagcuuguau

SEQ ID NO: 437648 - RNA, 19 nt, Homo sapiens
ggguaaauguuaucaccua

SEQ ID NO: 437649 - RNA, 19 nt, Homo sapiens
gaagaacuguuugauugau

SEQ ID NO: 437650 - RNA, 19 nt, Homo sapiens
aggaagaaauugagaacua

SEQ ID NO: 437651 - RNA, 19 nt, Homo sapiens
uagaacaccuugcacagaa

SEQ ID NO: 437652 - RNA, 19 nt, Homo sapiens
gaacaccuugcacagaaua

SEQ ID NO: 437653 - RNA, 19 nt, Homo sapiens
ccuaagcacuucuagaaug

SEQ ID NO: 437654 - RNA, 19 nt, Homo sapiens
ggagccaucugucugauca

SEQ ID NO: 437655 - RNA, 19 nt, Homo sapiens
aaucaaaccagaaccaaua

SEQ ID NO: 437656 - RNA, 19 nt, Homo sapiens
gaggugauguggcaauugu

SEQ ID NO: 437657 - RNA, 19 nt, Homo sapiens
guagggaugucucgagaug

SEQ ID NO: 437658 - RNA, 19 nt, Homo sapiens
gcucauggcugcaagaaaa

SEQ ID NO: 437659 - RNA, 19 nt, Homo sapiens
gaggugguguuuaucagaa

SEQ ID NO: 437660 - RNA, 19 nt, Homo sapiens
ccaaacgcauugauggauu

SEQ ID NO: 437661 - RNA, 19 nt, Homo sapiens
uuacagaagcuauacagua

SEQ ID NO: 437662 - RNA, 19 nt, Homo sapiens
ggaaaccugccaauacuug

SEQ ID NO: 437663 - RNA, 19 nt, Homo sapiens
gguaaauguuaucaccuaa

SEQ ID NO: 437664 - RNA, 19 nt, Homo sapiens
gaaccaauaugugacuaca

SEQ ID NO: 437665 - RNA, 19 nt, Homo sapiens
uaaccgagacacuuuauau

SEQ ID NO: 437666 - RNA, 19 nt, Homo sapiens
caacacguccuacagaaga

SEQ ID NO: 437667 - RNA, 19 nt, Homo sapiens
gugaagacuuuauuagcuu

SEQ ID NO: 437668 - RNA, 19 nt, Homo sapiens
uaugcaaggugucuacauu

SEQ ID NO: 437669 - RNA, 19 nt, Homo sapiens
ucaccgagaagauggaaua

SEQ ID NO: 437670 - RNA, 19 nt, Homo sapiens
gcacauaaacugggaugga

SEQ ID NO: 437671 - RNA, 19 nt, Homo sapiens
gauggaauacuaacaaagu

SEQ ID NO: 437672 - RNA, 19 nt, Homo sapiens
gaaugugccgugccuuuga

SEQ ID NO: 437673 - RNA, 19 nt, Homo sapiens
ccagucaggucuugauauc

SEQ ID NO: 437674 - RNA, 19 nt, Homo sapiens
cagccaagaacuuuauuaa

SEQ ID NO: 437675 - RNA, 19 nt, Homo sapiens
caccuaagcacuucuagaa

SEQ ID NO: 437676 - RNA, 19 nt, Homo sapiens
ugcaaggugucuacauuaa

SEQ ID NO: 437677 - RNA, 19 nt, Homo sapiens
ggagaagucagcaaagcaa

SEQ ID NO: 437678 - RNA, 19 nt, Homo sapiens
gaagaaucaccgagaagau

SEQ ID NO: 437679 - RNA, 19 nt, Homo sapiens
acagaagaaucaccgagaa

SEQ ID NO: 437680 - RNA, 19 nt, Homo sapiens
gcacuucuagaaugucuga

SEQ ID NO: 437681 - RNA, 19 nt, Homo sapiens
cuaagcacuucuagaaugu

SEQ ID NO: 437682 - RNA, 19 nt, Homo sapiens
cgaccucaguaacuacauu

SEQ ID NO: 437683 - RNA, 19 nt, Homo sapiens
ucagaagaacuguuugauu

SEQ ID NO: 437684 - RNA, 19 nt, Homo sapiens
caaaccagaaccaauaugu

SEQ ID NO: 437685 - RNA, 19 nt, Homo sapiens
gacugaagaugaaauugca

SEQ ID NO: 437686 - RNA, 19 nt, Homo sapiens
agacaaaucaucaggaauc

SEQ ID NO: 437687 - RNA, 19 nt, Homo sapiens
uacaguaugugguggaguu

SEQ ID NO: 437688 - RNA, 19 nt, Homo sapiens
gccaauacuugagagaaga

SEQ ID NO: 437689 - RNA, 19 nt, Homo sapiens
gaaaccugccaauacuuga

SEQ ID NO: 437690 - RNA, 19 nt, Homo sapiens
guccauggcagaauuagaa

SEQ ID NO: 437691 - RNA, 19 nt, Homo sapiens
aaucaugggucauugucuu

SEQ ID NO: 437692 - RNA, 19 nt, Homo sapiens
ccacacacugcacaucuuu

SEQ ID NO: 437693 - RNA, 19 nt, Homo sapiens
gacauugugcgacuucauu

SEQ ID NO: 437694 - RNA, 19 nt, Homo sapiens
aaauucagcuagcucuuca

SEQ ID NO: 437695 - RNA, 19 nt, Homo sapiens
ccacagccaagaacuuuau

SEQ ID NO: 437696 - RNA, 19 nt, Homo sapiens
caaauugauggguaaaugu

SEQ ID NO: 437697 - RNA, 19 nt, Homo sapiens
cgagaagauggaauacuaa

SEQ ID NO: 437698 - RNA, 19 nt, Homo sapiens
aaauuaaccgagacacuuu

SEQ ID NO: 437699 - RNA, 19 nt, Homo sapiens
cuaugcaccugacugaaga

SEQ ID NO: 437700 - RNA, 19 nt, Homo sapiens
cgacgucuucaaauccuua

SEQ ID NO: 437701 - RNA, 19 nt, Homo sapiens
cagaaugugccgugccuuu

SEQ ID NO: 437702 - RNA, 19 nt, Homo sapiens
gggaggugauguggcaauu

SEQ ID NO: 437703 - RNA, 19 nt, Homo sapiens
gaaucaaaccagaaccaau

SEQ ID NO: 437704 - RNA, 19 nt, Homo sapiens
agaaaccgcugccaacacu

SEQ ID NO: 437705 - RNA, 19 nt, Homo sapiens
cccaggagacagugacuua

SEQ ID NO: 437706 - RNA, 19 nt, Homo sapiens
ucaaauccuuagguuguga

SEQ ID NO: 437707 - RNA, 19 nt, Homo sapiens
gaagaaauugagaacuauc

SEQ ID NO: 437708 - RNA, 19 nt, Homo sapiens
ccaacgggcugacggaacu

SEQ ID NO: 437709 - RNA, 19 nt, Homo sapiens
gaucuguggagacaaauca

SEQ ID NO: 437710 - RNA, 19 nt, Homo sapiens
ugucugaaguacaaacaug

SEQ ID NO: 437711 - RNA, 19 nt, Homo sapiens
uaaauguuaucaccuaagc

SEQ ID NO: 437712 - RNA, 19 nt, Homo sapiens
ggaggcagauggguaacca

SEQ ID NO: 437713 - RNA, 19 nt, Homo sapiens
ucagcuagcucuucaacac

SEQ ID NO: 437714 - RNA, 19 nt, Homo sapiens
gguugugaagacuuuauua

SEQ ID NO: 437715 - RNA, 19 nt, Homo sapiens
agagugccguggucaauca

SEQ ID NO: 437716 - RNA, 19 nt, Homo sapiens
aaccagaaccaauauguga

SEQ ID NO: 437717 - RNA, 19 nt, Homo sapiens
gcuucuaccuggacauaca

SEQ ID NO: 437718 - RNA, 19 nt, Homo sapiens
ucgagaugcuguaaaauuu

SEQ ID NO: 437719 - RNA, 19 nt, Homo sapiens
aaucaucaggaauccauua

SEQ ID NO: 437720 - RNA, 19 nt, Homo sapiens
guaugcagaaguacagaaa

SEQ ID NO: 437721 - RNA, 19 nt, Homo sapiens
caaaucaucaggaauccau

SEQ ID NO: 437722 - RNA, 19 nt, Homo sapiens
ggagacagugacuuagaga

SEQ ID NO: 437723 - RNA, 19 nt, Homo sapiens
acgcauugauggauuuaug

SEQ ID NO: 437724 - RNA, 19 nt, Homo sapiens
ggaaucaaaccagaaccaa

SEQ ID NO: 437725 - RNA, 19 nt, Homo sapiens
ucacagggccucugagcau

SEQ ID NO: 437726 - RNA, 19 nt, Homo sapiens
ggaaagaguuuauguucua

SEQ ID NO: 437727 - RNA, 19 nt, Homo sapiens
cagaagaacuguuugauug

SEQ ID NO: 437728 - RNA, 19 nt, Homo sapiens
gagaagagcuccagcagau

SEQ ID NO: 437729 - RNA, 19 nt, Homo sapiens
gcaauugugugccaucaaa

SEQ ID NO: 437730 - RNA, 19 nt, Homo sapiens
gaagagcuccagcagauaa

SEQ ID NO: 437731 - RNA, 19 nt, Homo sapiens
ggagacaaaucaucaggaa

SEQ ID NO: 437732 - RNA, 19 nt, Homo sapiens
gcaaauugauggguaaaug

SEQ ID NO: 437733 - RNA, 19 nt, Homo sapiens
caagaucuguggagacaaa

SEQ ID NO: 437734 - RNA, 19 nt, Homo sapiens
guuguucacuucagaauuu

SEQ ID NO: 437735 - RNA, 19 nt, Homo sapiens
gcaccugacugaagaugaa

SEQ ID NO: 437736 - RNA, 19 nt, Homo sapiens
gaaauuauuccaugcaaga

SEQ ID NO: 437737 - RNA, 19 nt, Homo sapiens
caaggugucuacauuaaga

SEQ ID NO: 437738 - RNA, 19 nt, Homo sapiens
ccgagaagauggaauacua

SEQ ID NO: 437739 - RNA, 19 nt, Homo sapiens
ggaagaaauugagaacuau

SEQ ID NO: 437740 - RNA, 19 nt, Homo sapiens
gaagauggaauacuaacaa

SEQ ID NO: 437741 - RNA, 19 nt, Homo sapiens
gcagauggguaaccaggaa

SEQ ID NO: 437742 - RNA, 19 nt, Homo sapiens
uagaaugucugaaguacaa

SEQ ID NO: 437743 - RNA, 19 nt, Homo sapiens
gaucaaauugugcuucuaa

SEQ ID NO: 437744 - RNA, 19 nt, Homo sapiens
cagcuuguaugcagaagua

SEQ ID NO: 437745 - RNA, 19 nt, Homo sapiens
caaacgcauugauggauuu

SEQ ID NO: 437746 - RNA, 19 nt, Homo sapiens
gcagagagacagcuuguau

SEQ ID NO: 437747 - RNA, 19 nt, Homo sapiens
aaaggaagauaaggaagua

SEQ ID NO: 437748 - RNA, 19 nt, Homo sapiens
ggguaaauguuaucaccua

SEQ ID NO: 437749 - RNA, 19 nt, Homo sapiens
gaagaacuguuugauugau

SEQ ID NO: 437750 - RNA, 19 nt, Homo sapiens
aggaagaaauugagaacua

SEQ ID NO: 437751 - RNA, 19 nt, Homo sapiens
uagaacaccuugcacagaa

SEQ ID NO: 437752 - RNA, 19 nt, Homo sapiens
gaacaccuugcacagaaua

SEQ ID NO: 437753 - RNA, 19 nt, Homo sapiens
ccuaagcacuucuagaaug

SEQ ID NO: 437754 - RNA, 19 nt, Homo sapiens
ggagccaucugucugauca

SEQ ID NO: 437755 - RNA, 19 nt, Homo sapiens
aaucaaaccagaaccaaua

SEQ ID NO: 437756 - RNA, 19 nt, Homo sapiens
gaggugauguggcaauugu

SEQ ID NO: 437757 - RNA, 19 nt, Homo sapiens
guagggaugucucgagaug

SEQ ID NO: 437758 - RNA, 19 nt, Homo sapiens
caaacuggauacaugaaug

SEQ ID NO: 437759 - RNA, 19 nt, Homo sapiens
gcucauggcugcaagaaaa

SEQ ID NO: 437760 - RNA, 19 nt, Homo sapiens
gaggugguguuuaucagaa

SEQ ID NO: 437761 - RNA, 19 nt, Homo sapiens
ccaaacgcauugauggauu

SEQ ID NO: 437762 - RNA, 19 nt, Homo sapiens
uuacagaagcuauacagua

SEQ ID NO: 437763 - RNA, 19 nt, Homo sapiens
ggaaaccugccaauacuug

SEQ ID NO: 437764 - RNA, 19 nt, Homo sapiens
gguaaauguuaucaccuaa

SEQ ID NO: 437765 - RNA, 19 nt, Homo sapiens
gaaccaauaugugacuaca

SEQ ID NO: 437766 - RNA, 19 nt, Homo sapiens
guacaaacuggauacauga

SEQ ID NO: 437767 - RNA, 19 nt, Homo sapiens
caaauacuccaucagugua

SEQ ID NO: 437768 - RNA, 19 nt, Homo sapiens
uaaccgagacacuuuauau

SEQ ID NO: 437769 - RNA, 19 nt, Homo sapiens
caacacguccuacagaaga

SEQ ID NO: 437770 - RNA, 19 nt, Homo sapiens
gaagauaaggaaguacaaa

SEQ ID NO: 437771 - RNA, 19 nt, Homo sapiens
gugaagacuuuauuagcuu

SEQ ID NO: 437772 - RNA, 19 nt, Homo sapiens
uaugcaaggugucuacauu

SEQ ID NO: 437773 - RNA, 19 nt, Homo sapiens
ucaccgagaagauggaaua

SEQ ID NO: 437774 - RNA, 19 nt, Homo sapiens
gauggaauacuaacaaagu

SEQ ID NO: 437775 - RNA, 19 nt, Homo sapiens
gaaugugccgugccuuuga

SEQ ID NO: 437776 - RNA, 19 nt, Homo sapiens
ccagucaggucuugauauc

SEQ ID NO: 437777 - RNA, 19 nt, Homo sapiens
caccuaagcacuucuagaa

SEQ ID NO: 437778 - RNA, 19 nt, Homo sapiens
ugcaaggugucuacauuaa

SEQ ID NO: 437779 - RNA, 19 nt, Homo sapiens
ggagaagucagcaaagcaa

SEQ ID NO: 437780 - RNA, 19 nt, Homo sapiens
gaagaaucaccgagaagau

SEQ ID NO: 437781 - RNA, 19 nt, Homo sapiens
acagaagaaucaccgagaa

SEQ ID NO: 437782 - RNA, 19 nt, Homo sapiens
ccaaauacuccaucagugu

SEQ ID NO: 437783 - RNA, 19 nt, Homo sapiens
gcacuucuagaaugucuga

SEQ ID NO: 437784 - RNA, 19 nt, Homo sapiens
cuaagcacuucuagaaugu

SEQ ID NO: 437785 - RNA, 19 nt, Homo sapiens
cgaccucaguaacuacauu

SEQ ID NO: 437786 - RNA, 19 nt, Homo sapiens
ucagaagaacuguuugauu

SEQ ID NO: 437787 - RNA, 19 nt, Homo sapiens
caaaccagaaccaauaugu

SEQ ID NO: 437788 - RNA, 19 nt, Homo sapiens
gacugaagaugaaauugca

SEQ ID NO: 437789 - RNA, 19 nt, Homo sapiens
agacaaaucaucaggaauc

SEQ ID NO: 437790 - RNA, 19 nt, Homo sapiens
uacaguaugugguggaguu

SEQ ID NO: 437791 - RNA, 19 nt, Homo sapiens
gccaauacuugagagaaga

SEQ ID NO: 437792 - RNA, 19 nt, Homo sapiens
gaaaccugccaauacuuga

SEQ ID NO: 437793 - RNA, 19 nt, Homo sapiens
guccauggcagaauuagaa

SEQ ID NO: 437794 - RNA, 19 nt, Homo sapiens
aguacaaacuggauacaug

SEQ ID NO: 437795 - RNA, 19 nt, Homo sapiens
aaucaugggucauugucuu

SEQ ID NO: 437796 - RNA, 19 nt, Homo sapiens
ccacacacugcacaucuuu

SEQ ID NO: 437797 - RNA, 19 nt, Homo sapiens
gacauugugcgacuucauu

SEQ ID NO: 437798 - RNA, 19 nt, Homo sapiens
aaauucagcuagcucuuca

SEQ ID NO: 437799 - RNA, 19 nt, Homo sapiens
gauaaggaaguacaaacug

SEQ ID NO: 437800 - RNA, 19 nt, Homo sapiens
caaauugauggguaaaugu

SEQ ID NO: 437801 - RNA, 19 nt, Homo sapiens
cgagaagauggaauacuaa

SEQ ID NO: 437802 - RNA, 19 nt, Homo sapiens
aaauuaaccgagacacuuu

SEQ ID NO: 437803 - RNA, 19 nt, Homo sapiens
cccaggagacagugacuua

SEQ ID NO: 437804 - RNA, 19 nt, Homo sapiens
cuaugcaccugacugaaga

SEQ ID NO: 437805 - RNA, 19 nt, Homo sapiens
cgacgucuucaaauccuua

SEQ ID NO: 437806 - RNA, 19 nt, Homo sapiens
cagaaugugccgugccuuu

SEQ ID NO: 437807 - RNA, 19 nt, Homo sapiens
gggaggugauguggcaauu

SEQ ID NO: 437808 - RNA, 19 nt, Homo sapiens
gaaucaaaccagaaccaau

SEQ ID NO: 437809 - RNA, 19 nt, Homo sapiens
agaaaccgcugccaacacu

SEQ ID NO: 437810 - RNA, 19 nt, Homo sapiens
ucaaauccuuagguuguga

SEQ ID NO: 437811 - RNA, 19 nt, Homo sapiens
gaagaaauugagaacuauc

SEQ ID NO: 437812 - RNA, 19 nt, Homo sapiens
ccaacgggcugacggaacu

SEQ ID NO: 437813 - RNA, 19 nt, Homo sapiens
gaucuguggagacaaauca

SEQ ID NO: 437814 - RNA, 19 nt, Homo sapiens
ggaagauaaggaaguacaa

SEQ ID NO: 437815 - RNA, 19 nt, Homo sapiens
ugucugaaguacaaacaug

SEQ ID NO: 437816 - RNA, 19 nt, Homo sapiens
uaaauguuaucaccuaagc

SEQ ID NO: 437817 - RNA, 19 nt, Homo sapiens
ucagcuagcucuucaacac

SEQ ID NO: 437818 - RNA, 19 nt, Homo sapiens
gguugugaagacuuuauua

SEQ ID NO: 437819 - RNA, 19 nt, Homo sapiens
ggaggcagauggguaacca

SEQ ID NO: 437820 - RNA, 19 nt, Homo sapiens
aaccagaaccaauauguga

SEQ ID NO: 437821 - RNA, 19 nt, Homo sapiens
gcuucuaccuggacauaca

SEQ ID NO: 437822 - RNA, 19 nt, Homo sapiens
ucgagaugcuguaaaauuu

SEQ ID NO: 437823 - RNA, 19 nt, Homo sapiens
aaucaucaggaauccauua

SEQ ID NO: 437824 - RNA, 19 nt, Homo sapiens
agagugccguggucaauca

SEQ ID NO: 437825 - RNA, 19 nt, Homo sapiens
guaugcagaaguacagaaa

SEQ ID NO: 437826 - RNA, 19 nt, Homo sapiens
ggaaagaguuuauguucua

SEQ ID NO: 437827 - RNA, 19 nt, Homo sapiens
cagaagaacuguuugauug

SEQ ID NO: 437828 - RNA, 19 nt, Homo sapiens
gagaagagcuccagcagau

SEQ ID NO: 437829 - RNA, 19 nt, Homo sapiens
acacauacaucucaaauug

SEQ ID NO: 437830 - RNA, 19 nt, Homo sapiens
gcaauugugugccaucaaa

SEQ ID NO: 437831 - RNA, 19 nt, Homo sapiens
gaagagcuccagcagauaa

SEQ ID NO: 437832 - RNA, 19 nt, Homo sapiens
ggagacaaaucaucaggaa

SEQ ID NO: 437833 - RNA, 19 nt, Homo sapiens
gcaaauugauggguaaaug

SEQ ID NO: 437834 - RNA, 19 nt, Homo sapiens
caagaucuguggagacaaa

SEQ ID NO: 437835 - RNA, 19 nt, Homo sapiens
cagcagagguaucucagua

SEQ ID NO: 437836 - RNA, 19 nt, Homo sapiens
guuguucacuucagaauuu

SEQ ID NO: 437837 - RNA, 19 nt, Homo sapiens
gcaccugacugaagaugaa

SEQ ID NO: 437838 - RNA, 19 nt, Homo sapiens
gaaauuauuccaugcaaga

SEQ ID NO: 437839 - RNA, 19 nt, Homo sapiens
caaggugucuacauuaaga

SEQ ID NO: 437840 - RNA, 19 nt, Homo sapiens
ccgagaagauggaauacua

SEQ ID NO: 437841 - RNA, 19 nt, Homo sapiens
ggaagaaauugagaacuau

SEQ ID NO: 437842 - RNA, 19 nt, Homo sapiens
gaagauggaauacuaacaa

SEQ ID NO: 437843 - RNA, 19 nt, Homo sapiens
uagaaugucugaaguacaa

SEQ ID NO: 437844 - RNA, 19 nt, Homo sapiens
gaucaaauugugcuucuaa

SEQ ID NO: 437845 - RNA, 19 nt, Homo sapiens
cagcuuguaugcagaagua

SEQ ID NO: 437846 - RNA, 19 nt, Homo sapiens
caaacgcauugauggauuu

SEQ ID NO: 437847 - RNA, 19 nt, Homo sapiens
gcagagagacagcuuguau

SEQ ID NO: 437848 - RNA, 19 nt, Homo sapiens
ggguaaauguuaucaccua

SEQ ID NO: 437849 - RNA, 19 nt, Homo sapiens
gaagaacuguuugauugau

SEQ ID NO: 437850 - RNA, 19 nt, Homo sapiens
aggaagaaauugagaacua

SEQ ID NO: 437851 - RNA, 19 nt, Homo sapiens
uagaacaccuugcacagaa

SEQ ID NO: 437852 - RNA, 19 nt, Homo sapiens
gaagacacauacaucucaa

SEQ ID NO: 437853 - RNA, 19 nt, Homo sapiens
gaacaccuugcacagaaua

SEQ ID NO: 437854 - RNA, 19 nt, Homo sapiens
ccuaagcacuucuagaaug

SEQ ID NO: 437855 - RNA, 19 nt, Homo sapiens
aaucaaaccagaaccaaua

SEQ ID NO: 437856 - RNA, 19 nt, Homo sapiens
gaggugauguggcaauugu

SEQ ID NO: 437857 - RNA, 19 nt, Homo sapiens
guagggaugucucgagaug

SEQ ID NO: 437858 - RNA, 19 nt, Homo sapiens
gcucauggcugcaagaaaa

SEQ ID NO: 437859 - RNA, 19 nt, Homo sapiens
gaggugguguuuaucagaa

SEQ ID NO: 437860 - RNA, 19 nt, Homo sapiens
ccaaacgcauugauggauu

SEQ ID NO: 437861 - RNA, 19 nt, Homo sapiens
uuacagaagcuauacagua

SEQ ID NO: 437862 - RNA, 19 nt, Homo sapiens
ggaaaccugccaauacuug

SEQ ID NO: 437863 - RNA, 19 nt, Homo sapiens
gguaaauguuaucaccuaa

SEQ ID NO: 437864 - RNA, 19 nt, Homo sapiens
gaaccaauaugugacuaca

SEQ ID NO: 437865 - RNA, 19 nt, Homo sapiens
gaagaagacacauacaucu

SEQ ID NO: 437866 - RNA, 19 nt, Homo sapiens
uaaccgagacacuuuauau

SEQ ID NO: 437867 - RNA, 19 nt, Homo sapiens
caacacguccuacagaaga

SEQ ID NO: 437868 - RNA, 19 nt, Homo sapiens
gugaagacuuuauuagcuu

SEQ ID NO: 437869 - RNA, 19 nt, Homo sapiens
uaugcaaggugucuacauu

SEQ ID NO: 437870 - RNA, 19 nt, Homo sapiens
ucaccgagaagauggaaua

SEQ ID NO: 437871 - RNA, 19 nt, Homo sapiens
gauggaauacuaacaaagu

SEQ ID NO: 437872 - RNA, 19 nt, Homo sapiens
gaaugugccgugccuuuga

SEQ ID NO: 437873 - RNA, 19 nt, Homo sapiens
ccagucaggucuugauauc

SEQ ID NO: 437874 - RNA, 19 nt, Homo sapiens
caccuaagcacuucuagaa

SEQ ID NO: 437875 - RNA, 19 nt, Homo sapiens
ugcaaggugucuacauuaa

SEQ ID NO: 437876 - RNA, 19 nt, Homo sapiens
ggagaagucagcaaagcaa

SEQ ID NO: 437877 - RNA, 19 nt, Homo sapiens
gaagaaucaccgagaagau

SEQ ID NO: 437878 - RNA, 19 nt, Homo sapiens
acagaagaaucaccgagaa

SEQ ID NO: 437879 - RNA, 19 nt, Homo sapiens
gcagagguaucucaguaac

SEQ ID NO: 437880 - RNA, 19 nt, Homo sapiens
ccagcgaucucuacauugg

SEQ ID NO: 437881 - RNA, 19 nt, Homo sapiens
gcacuucuagaaugucuga

SEQ ID NO: 437882 - RNA, 19 nt, Homo sapiens
cuaagcacuucuagaaugu

SEQ ID NO: 437883 - RNA, 19 nt, Homo sapiens
guaacgaagaagacacaua

SEQ ID NO: 437884 - RNA, 19 nt, Homo sapiens
cgaccucaguaacuacauu

SEQ ID NO: 437885 - RNA, 19 nt, Homo sapiens
ucagaagaacuguuugauu

SEQ ID NO: 437886 - RNA, 19 nt, Homo sapiens
caaaccagaaccaauaugu

SEQ ID NO: 437887 - RNA, 19 nt, Homo sapiens
uaacgaagaagacacauac

SEQ ID NO: 437888 - RNA, 19 nt, Homo sapiens
gacugaagaugaaauugca

SEQ ID NO: 437889 - RNA, 19 nt, Homo sapiens
agacaaaucaucaggaauc

SEQ ID NO: 437890 - RNA, 19 nt, Homo sapiens
uacaguaugugguggaguu

SEQ ID NO: 437891 - RNA, 19 nt, Homo sapiens
gccaauacuugagagaaga

SEQ ID NO: 437892 - RNA, 19 nt, Homo sapiens
gaaaccugccaauacuuga

SEQ ID NO: 437893 - RNA, 19 nt, Homo sapiens
guccauggcagaauuagaa

SEQ ID NO: 437894 - RNA, 19 nt, Homo sapiens
cgaagaagacacauacauc

SEQ ID NO: 437895 - RNA, 19 nt, Homo sapiens
ccacacacugcacaucuuu

SEQ ID NO: 437896 - RNA, 19 nt, Homo sapiens
gacauugugcgacuucauu

SEQ ID NO: 437897 - RNA, 19 nt, Homo sapiens
aaauucagcuagcucuuca

SEQ ID NO: 437898 - RNA, 19 nt, Homo sapiens
caaauugauggguaaaugu

SEQ ID NO: 437899 - RNA, 19 nt, Homo sapiens
cuccagcgaucucuacauu

SEQ ID NO: 437900 - RNA, 19 nt, Homo sapiens
cgagaagauggaauacuaa

SEQ ID NO: 437901 - RNA, 19 nt, Homo sapiens
aaauuaaccgagacacuuu

SEQ ID NO: 437902 - RNA, 19 nt, Homo sapiens
cuaugcaccugacugaaga

SEQ ID NO: 437903 - RNA, 19 nt, Homo sapiens
cgacgucuucaaauccuua

SEQ ID NO: 437904 - RNA, 19 nt, Homo sapiens
cagaaugugccgugccuuu

SEQ ID NO: 437905 - RNA, 19 nt, Homo sapiens
gggaggugauguggcaauu

SEQ ID NO: 437906 - RNA, 19 nt, Homo sapiens
agagguaucucaguaacga

SEQ ID NO: 437907 - RNA, 19 nt, Homo sapiens
gaaucaaaccagaaccaau

SEQ ID NO: 437908 - RNA, 19 nt, Homo sapiens
agaaaccgcugccaacacu

SEQ ID NO: 437909 - RNA, 19 nt, Homo sapiens
gaucuguggagacaaauca

SEQ ID NO: 437910 - RNA, 19 nt, Homo sapiens
ucaaauccuuagguuguga

SEQ ID NO: 437911 - RNA, 19 nt, Homo sapiens
gaagaaauugagaacuauc

SEQ ID NO: 437912 - RNA, 19 nt, Homo sapiens
ccaacgggcugacggaacu

SEQ ID NO: 437913 - RNA, 19 nt, Homo sapiens
ugucugaaguacaaacaug

SEQ ID NO: 437914 - RNA, 19 nt, Homo sapiens
uaaauguuaucaccuaagc

SEQ ID NO: 437915 - RNA, 19 nt, Homo sapiens
ucagcuagcucuucaacac

SEQ ID NO: 437916 - RNA, 19 nt, Homo sapiens
gguugugaagacuuuauua

SEQ ID NO: 437917 - RNA, 19 nt, Homo sapiens
aaccagaaccaauauguga

SEQ ID NO: 437918 - RNA, 19 nt, Homo sapiens
aaucaucaggaauccauua

SEQ ID NO: 437919 - RNA, 19 nt, Homo sapiens
gcuucuaccuggacauaca

SEQ ID NO: 437920 - RNA, 19 nt, Homo sapiens
ucgagaugcuguaaaauuu

SEQ ID NO: 437921 - RNA, 19 nt, Homo sapiens
caaaucaucaggaauccau

SEQ ID NO: 437922 - RNA, 19 nt, Homo sapiens
guaugcagaaguacagaaa

SEQ ID NO: 437923 - RNA, 19 nt, Homo sapiens
guaucucaguaacgaagaa

SEQ ID NO: 437924 - RNA, 19 nt, Homo sapiens
acgcauugauggauuuaug

SEQ ID NO: 437925 - RNA, 19 nt, Homo sapiens
ggaaucaaaccagaaccaa

SEQ ID NO: 437926 - RNA, 19 nt, Homo sapiens
ggaaagaguuuauguucua

SEQ ID NO: 437927 - RNA, 19 nt, Homo sapiens
cagaagaacuguuugauug

SEQ ID NO: 437928 - RNA, 19 nt, Homo sapiens
gagaagagcuccagcagau

SEQ ID NO: 437929 - RNA, 19 nt, Homo sapiens
gcaauugugugccaucaaa

SEQ ID NO: 437930 - RNA, 19 nt, Homo sapiens
gcaccgcgcuuaaaugaug

SEQ ID NO: 437931 - RNA, 19 nt, Homo sapiens
gaagagcuccagcagauaa

SEQ ID NO: 437932 - RNA, 19 nt, Homo sapiens
ggagacaaaucaucaggaa

SEQ ID NO: 437933 - RNA, 19 nt, Homo sapiens
gcaaauugauggguaaaug

SEQ ID NO: 437934 - RNA, 19 nt, Homo sapiens
caagaucuguggagacaaa

SEQ ID NO: 437935 - RNA, 19 nt, Homo sapiens
guuguucacuucagaauuu

SEQ ID NO: 437936 - RNA, 19 nt, Homo sapiens
gcaccugacugaagaugaa

SEQ ID NO: 437937 - RNA, 19 nt, Homo sapiens
gaaauuauuccaugcaaga

SEQ ID NO: 437938 - RNA, 19 nt, Homo sapiens
caaggugucuacauuaaga

SEQ ID NO: 437939 - RNA, 19 nt, Homo sapiens
ccgagaagauggaauacua

SEQ ID NO: 437940 - RNA, 19 nt, Homo sapiens
ggaagaaauugagaacuau

SEQ ID NO: 437941 - RNA, 19 nt, Homo sapiens
gaagauggaauacuaacaa

SEQ ID NO: 437942 - RNA, 19 nt, Homo sapiens
uagaaugucugaaguacaa

SEQ ID NO: 437943 - RNA, 19 nt, Homo sapiens
gaucaaauugugcuucuaa

SEQ ID NO: 437944 - RNA, 19 nt, Homo sapiens
cagcuuguaugcagaagua

SEQ ID NO: 437945 - RNA, 19 nt, Homo sapiens
caaacgcauugauggauuu

SEQ ID NO: 437946 - RNA, 19 nt, Homo sapiens
gcagagagacagcuuguau

SEQ ID NO: 437947 - RNA, 19 nt, Homo sapiens
ggguaaauguuaucaccua

SEQ ID NO: 437948 - RNA, 19 nt, Homo sapiens
gaagaacuguuugauugau

SEQ ID NO: 437949 - RNA, 19 nt, Homo sapiens
aggaagaaauugagaacua

SEQ ID NO: 437950 - RNA, 19 nt, Homo sapiens
uagaacaccuugcacagaa

SEQ ID NO: 437951 - RNA, 19 nt, Homo sapiens
gaacaccuugcacagaaua

SEQ ID NO: 437952 - RNA, 19 nt, Homo sapiens
ccuaagcacuucuagaaug

SEQ ID NO: 437953 - RNA, 19 nt, Homo sapiens
aaucaaaccagaaccaaua

SEQ ID NO: 437954 - RNA, 19 nt, Homo sapiens
gaggugauguggcaauugu

SEQ ID NO: 437955 - RNA, 19 nt, Homo sapiens
guagggaugucucgagaug

SEQ ID NO: 437956 - RNA, 19 nt, Homo sapiens
gcucauggcugcaagaaaa

SEQ ID NO: 437957 - RNA, 19 nt, Homo sapiens
gaggugguguuuaucagaa

SEQ ID NO: 437958 - RNA, 19 nt, Homo sapiens
ccaaacgcauugauggauu

SEQ ID NO: 437959 - RNA, 19 nt, Homo sapiens
uuacagaagcuauacagua

SEQ ID NO: 437960 - RNA, 19 nt, Homo sapiens
ggaaaccugccaauacuug

SEQ ID NO: 437961 - RNA, 19 nt, Homo sapiens
gguaaauguuaucaccuaa

SEQ ID NO: 437962 - RNA, 19 nt, Homo sapiens
gaaccaauaugugacuaca

SEQ ID NO: 437963 - RNA, 19 nt, Homo sapiens
uaaccgagacacuuuauau

SEQ ID NO: 437964 - RNA, 19 nt, Homo sapiens
caacacguccuacagaaga

SEQ ID NO: 437965 - RNA, 19 nt, Homo sapiens
gugaagacuuuauuagcuu

SEQ ID NO: 437966 - RNA, 19 nt, Homo sapiens
uaugcaaggugucuacauu

SEQ ID NO: 437967 - RNA, 19 nt, Homo sapiens
gcgaugaaagcucaaauug

SEQ ID NO: 437968 - RNA, 19 nt, Homo sapiens
ucaccgagaagauggaaua

SEQ ID NO: 437969 - RNA, 19 nt, Homo sapiens
gauggaauacuaacaaagu

SEQ ID NO: 437970 - RNA, 19 nt, Homo sapiens
gaaugugccgugccuuuga

SEQ ID NO: 437971 - RNA, 19 nt, Homo sapiens
ccagucaggucuugauauc

SEQ ID NO: 437972 - RNA, 19 nt, Homo sapiens
caccuaagcacuucuagaa

SEQ ID NO: 437973 - RNA, 19 nt, Homo sapiens
ugcaaggugucuacauuaa

SEQ ID NO: 437974 - RNA, 19 nt, Homo sapiens
ggagaagucagcaaagcaa

SEQ ID NO: 437975 - RNA, 19 nt, Homo sapiens
gaagaaucaccgagaagau

SEQ ID NO: 437976 - RNA, 19 nt, Homo sapiens
acagaagaaucaccgagaa

SEQ ID NO: 437977 - RNA, 19 nt, Homo sapiens
gcacuucuagaaugucuga

SEQ ID NO: 437978 - RNA, 19 nt, Homo sapiens
cuaagcacuucuagaaugu

SEQ ID NO: 437979 - RNA, 19 nt, Homo sapiens
cgaccucaguaacuacauu

SEQ ID NO: 437980 - RNA, 19 nt, Homo sapiens
ucagaagaacuguuugauu

SEQ ID NO: 437981 - RNA, 19 nt, Homo sapiens
caaaccagaaccaauaugu

SEQ ID NO: 437982 - RNA, 19 nt, Homo sapiens
gacugaagaugaaauugca

SEQ ID NO: 437983 - RNA, 19 nt, Homo sapiens
agacaaaucaucaggaauc

SEQ ID NO: 437984 - RNA, 19 nt, Homo sapiens
uacaguaugugguggaguu

SEQ ID NO: 437985 - RNA, 19 nt, Homo sapiens
gccaauacuugagagaaga

SEQ ID NO: 437986 - RNA, 19 nt, Homo sapiens
gaaaccugccaauacuuga

SEQ ID NO: 437987 - RNA, 19 nt, Homo sapiens
guccauggcagaauuagaa

SEQ ID NO: 437988 - RNA, 19 nt, Homo sapiens
ccacacacugcacaucuuu

SEQ ID NO: 437989 - RNA, 19 nt, Homo sapiens
gacauugugcgacuucauu

SEQ ID NO: 437990 - RNA, 19 nt, Homo sapiens
aaauucagcuagcucuuca

SEQ ID NO: 437991 - RNA, 19 nt, Homo sapiens
caaauugauggguaaaugu

SEQ ID NO: 437992 - RNA, 19 nt, Homo sapiens
cgagaagauggaauacuaa

SEQ ID NO: 437993 - RNA, 19 nt, Homo sapiens
aaauuaaccgagacacuuu

SEQ ID NO: 437994 - RNA, 19 nt, Homo sapiens
cuaugcaccugacugaaga

SEQ ID NO: 437995 - RNA, 19 nt, Homo sapiens
cgacgucuucaaauccuua

SEQ ID NO: 437996 - RNA, 19 nt, Homo sapiens
cagaaugugccgugccuuu

SEQ ID NO: 437997 - RNA, 19 nt, Homo sapiens
gggaggugauguggcaauu

SEQ ID NO: 437998 - RNA, 19 nt, Homo sapiens
gaaucaaaccagaaccaau

SEQ ID NO: 437999 - RNA, 19 nt, Homo sapiens
agaaaccgcugccaacacu

SEQ ID NO: 438000 - RNA, 19 nt, Homo sapiens
gaucuguggagacaaauca

SEQ ID NO: 438001 - RNA, 19 nt, Homo sapiens
ucaaauccuuagguuguga

SEQ ID NO: 438002 - RNA, 19 nt, Homo sapiens
gaagaaauugagaacuauc

SEQ ID NO: 438003 - RNA, 19 nt, Homo sapiens
ccaacgggcugacggaacu

SEQ ID NO: 438004 - RNA, 19 nt, Homo sapiens
ugucugaaguacaaacaug

SEQ ID NO: 438005 - RNA, 19 nt, Homo sapiens
uaaauguuaucaccuaagc

SEQ ID NO: 438006 - RNA, 19 nt, Homo sapiens
aaucaucaggaauccauua

SEQ ID NO: 438007 - RNA, 19 nt, Homo sapiens
ucagcuagcucuucaacac

SEQ ID NO: 438008 - RNA, 19 nt, Homo sapiens
gguugugaagacuuuauua

SEQ ID NO: 438009 - RNA, 19 nt, Homo sapiens
ccgcaccgcgcuuaaauga

SEQ ID NO: 438010 - RNA, 19 nt, Homo sapiens
aaccagaaccaauauguga

SEQ ID NO: 438011 - RNA, 19 nt, Homo sapiens
gcuucuaccuggacauaca

SEQ ID NO: 438012 - RNA, 19 nt, Homo sapiens
ucgagaugcuguaaaauuu

SEQ ID NO: 438013 - RNA, 19 nt, Homo sapiens
caaaucaucaggaauccau

SEQ ID NO: 438014 - RNA, 19 nt, Homo sapiens
guaugcagaaguacagaaa

SEQ ID NO: 438015 - RNA, 19 nt, Homo sapiens
acgcauugauggauuuaug

SEQ ID NO: 438016 - RNA, 19 nt, Homo sapiens
ggaaucaaaccagaaccaa

SEQ ID NO: 438017 - RNA, 19 nt, Homo sapiens
cuuagguugugaagacuuu

SEQ ID NO: 438018 - RNA, 19 nt, Homo sapiens
gccacacacugcacaucuu

SEQ ID NO: 438019 - RNA, 19 nt, Homo sapiens
agaagaacuguuugauuga

SEQ ID NO: 438020 - RNA, 19 nt, Homo sapiens
aaugcaaauugauggguaa

SEQ ID NO: 438021 - RNA, 19 nt, Homo sapiens
cuucaaauccuuagguugu

SEQ ID NO: 438022 - RNA, 19 nt, Homo sapiens
guuaucaccuaagcacuuc

SEQ ID NO: 438023 - RNA, 19 nt, Homo sapiens
gcaaggugucuacauuaag

SEQ ID NO: 438024 - RNA, 19 nt, Homo sapiens
ugugaagacuuuauuagcu

SEQ ID NO: 438025 - RNA, 19 nt, Homo sapiens
cugccaacacugucgauua

SEQ ID NO: 438026 - RNA, 19 nt, Homo sapiens
ggagacaacuguuuauaga

SEQ ID NO: 438027 - RNA, 19 nt, Homo sapiens
ugauuuaccuucuguguua

SEQ ID NO: 438028 - RNA, 19 nt, Homo sapiens
gaagucagguugcuuggaa

SEQ ID NO: 438029 - RNA, 19 nt, Homo sapiens
ugacaugacuggaaucaaa

SEQ ID NO: 438030 - RNA, 19 nt, Homo sapiens
gggagaagcugcagguauu

SEQ ID NO: 438031 - RNA, 19 nt, Homo sapiens
ggaaaguacugugcaugua

SEQ ID NO: 438032 - RNA, 19 nt, Homo sapiens
gaacaaugcuucuuauucc

SEQ ID NO: 438033 - RNA, 19 nt, Homo sapiens
gcacagaacaucauuaagu

SEQ ID NO: 438034 - RNA, 19 nt, Homo sapiens
gggagcagcuucaugacua

SEQ ID NO: 438035 - RNA, 19 nt, Homo sapiens
gcaguuagcaccagggaua

SEQ ID NO: 438036 - RNA, 19 nt, Homo sapiens
ccacaccuaugaagaaauu

SEQ ID NO: 438037 - RNA, 19 nt, Homo sapiens
ggaauguccugcacuuaau

SEQ ID NO: 438038 - RNA, 19 nt, Homo sapiens
gaucaaauucuacuucuga

SEQ ID NO: 438039 - RNA, 19 nt, Homo sapiens
ucaaacagauaaagcaaga

SEQ ID NO: 438040 - RNA, 19 nt, Homo sapiens
gcaaauguucaaagccuua

SEQ ID NO: 438041 - RNA, 19 nt, Homo sapiens
gaugagaccuuggcaaagu

SEQ ID NO: 438042 - RNA, 19 nt, Homo sapiens
caagagaugcugugaaguu

SEQ ID NO: 438043 - RNA, 19 nt, Homo sapiens
agaauuaggccacagauaa

SEQ ID NO: 438044 - RNA, 19 nt, Homo sapiens
ggauaaccaugacugaaau

SEQ ID NO: 438045 - RNA, 19 nt, Homo sapiens
gaaaguacugugcauguau

SEQ ID NO: 438046 - RNA, 19 nt, Homo sapiens
gcaagaaccuaucuaugac

SEQ ID NO: 438047 - RNA, 19 nt, Homo sapiens
ggaaggagacaguauuuua

SEQ ID NO: 438048 - RNA, 19 nt, Homo sapiens
cauaauguguggccucuau

SEQ ID NO: 438049 - RNA, 19 nt, Homo sapiens
guacugugcauguauguaa

SEQ ID NO: 438050 - RNA, 19 nt, Homo sapiens
ccagacagccagaacauuu

SEQ ID NO: 438051 - RNA, 19 nt, Homo sapiens
guagcugucuuggaaagua

SEQ ID NO: 438052 - RNA, 19 nt, Homo sapiens
gacccagagugaagaagua

SEQ ID NO: 438053 - RNA, 19 nt, Homo sapiens
ugucacuacugcaacauua

SEQ ID NO: 438054 - RNA, 19 nt, Homo sapiens
gagcacaaauugaagugau

SEQ ID NO: 438055 - RNA, 19 nt, Homo sapiens
gcaagcacauuggagagaa

SEQ ID NO: 438056 - RNA, 19 nt, Homo sapiens
gucaggcucucuucuauga

SEQ ID NO: 438057 - RNA, 19 nt, Homo sapiens
gguaguugaugcaugugua

SEQ ID NO: 438058 - RNA, 19 nt, Homo sapiens
acaaggagcucuuuaaucc

SEQ ID NO: 438059 - RNA, 19 nt, Homo sapiens
gaagcacuguggcaacaau

SEQ ID NO: 438060 - RNA, 19 nt, Homo sapiens
gaccaaacaguagauauuu

SEQ ID NO: 438061 - RNA, 19 nt, Homo sapiens
gcgguacuuuacaugauua

SEQ ID NO: 438062 - RNA, 19 nt, Homo sapiens
gcaucaccauuaagacaaa

SEQ ID NO: 438063 - RNA, 19 nt, Homo sapiens
gggauaaccaugacugaaa

SEQ ID NO: 438064 - RNA, 19 nt, Homo sapiens
gcaggacgguaccaacuca

SEQ ID NO: 438065 - RNA, 19 nt, Homo sapiens
gugcauguauguaauaagu

SEQ ID NO: 438066 - RNA, 19 nt, Homo sapiens
gaguggggcucuuuuauuu

SEQ ID NO: 438067 - RNA, 19 nt, Homo sapiens
cugaugaccuagugaauga

SEQ ID NO: 438068 - RNA, 19 nt, Homo sapiens
ggacuugacaugacuggaa

SEQ ID NO: 438069 - RNA, 19 nt, Homo sapiens
gaauguccugcacuuaaua

SEQ ID NO: 438070 - RNA, 19 nt, Homo sapiens
uaaauaccauaccuacuag

SEQ ID NO: 438071 - RNA, 19 nt, Homo sapiens
gagcgguacuuuacaugau

SEQ ID NO: 438072 - RNA, 19 nt, Homo sapiens
aaagcaauguguucaugaa

SEQ ID NO: 438073 - RNA, 19 nt, Homo sapiens
gagaagcugcagguauuua

SEQ ID NO: 438074 - RNA, 19 nt, Homo sapiens
ugacugaaaucgaccgaau

SEQ ID NO: 438075 - RNA, 19 nt, Homo sapiens
caacaugugauucagaaga

SEQ ID NO: 438076 - RNA, 19 nt, Homo sapiens
cuauagcucuuucaacaau

SEQ ID NO: 438077 - RNA, 19 nt, Homo sapiens
gagaugcugugaaguuugg

SEQ ID NO: 438078 - RNA, 19 nt, Homo sapiens
aaacuugacagacuagaaa

SEQ ID NO: 438079 - RNA, 19 nt, Homo sapiens
caaacucuauuucugucaa

SEQ ID NO: 438080 - RNA, 19 nt, Homo sapiens
gaaugcaaauguucaaagc

SEQ ID NO: 438081 - RNA, 19 nt, Homo sapiens
cuaggaaugucaagagaug

SEQ ID NO: 438082 - RNA, 19 nt, Homo sapiens
aaacaagcuugauuucagu

SEQ ID NO: 438083 - RNA, 19 nt, Homo sapiens
guugaugcauguguaaauu

SEQ ID NO: 438084 - RNA, 19 nt, Homo sapiens
gucaagagaugcugugaag

SEQ ID NO: 438085 - RNA, 19 nt, Homo sapiens
ggaggcauauuauaaaaug

SEQ ID NO: 438086 - RNA, 19 nt, Homo sapiens
gagaagacccagagugaag

SEQ ID NO: 438087 - RNA, 19 nt, Homo sapiens
gauuaugacuaccagcaau

SEQ ID NO: 438088 - RNA, 19 nt, Homo sapiens
caggcucucuucuaugauu

SEQ ID NO: 438089 - RNA, 19 nt, Homo sapiens
gaccuuggcaaaguuaaua

SEQ ID NO: 438090 - RNA, 19 nt, Homo sapiens
guguacagcagcagcauua

SEQ ID NO: 438091 - RNA, 19 nt, Homo sapiens
gaagugucuugcccuagga

SEQ ID NO: 438092 - RNA, 19 nt, Homo sapiens
caaaguuaauagccaagau

SEQ ID NO: 438093 - RNA, 19 nt, Homo sapiens
agaagaaucaccuggauga

SEQ ID NO: 438094 - RNA, 19 nt, Homo sapiens
caaggaaaguccagaagcu

SEQ ID NO: 438095 - RNA, 19 nt, Homo sapiens
ucacucacgccauccaaua

SEQ ID NO: 438096 - RNA, 19 nt, Homo sapiens
gcaccagggauaaccauga

SEQ ID NO: 438097 - RNA, 19 nt, Homo sapiens
ccaagucugaggguuauua

SEQ ID NO: 438098 - RNA, 19 nt, Homo sapiens
caagcacauuggagagaaa

SEQ ID NO: 438099 - RNA, 19 nt, Homo sapiens
ugaccaaacaguagauauu

SEQ ID NO: 438100 - RNA, 19 nt, Homo sapiens
gaaggagacaguauuuuaa

SEQ ID NO: 438101 - RNA, 19 nt, Homo sapiens
ugaugcauguguaaauuug

SEQ ID NO: 438102 - RNA, 19 nt, Homo sapiens
ucacauccguacccaacuu

SEQ ID NO: 438103 - RNA, 19 nt, Homo sapiens
ugagcaaccugaacaacga

SEQ ID NO: 438104 - RNA, 19 nt, Homo sapiens
aagagaugcugugaaguuu

SEQ ID NO: 438105 - RNA, 19 nt, Homo sapiens
guccugcacuuaauagaau

SEQ ID NO: 438106 - RNA, 19 nt, Homo sapiens
gcaauguguucaugaagac

SEQ ID NO: 438107 - RNA, 19 nt, Homo sapiens
guucaaagccuuagguucu

SEQ ID NO: 438108 - RNA, 19 nt, Homo sapiens
ggaagugguuuuagugaga

SEQ ID NO: 438109 - RNA, 19 nt, Homo sapiens
cacagaacaucauuaaguc

SEQ ID NO: 438110 - RNA, 19 nt, Homo sapiens
agcaagaaccuaucuauga

SEQ ID NO: 438111 - RNA, 19 nt, Homo sapiens
gaaucaaacagauaaagca

SEQ ID NO: 438112 - RNA, 19 nt, Homo sapiens
ugacuggaaucaaacagau

SEQ ID NO: 438113 - RNA, 19 nt, Homo sapiens
gaagugauaccaugcaaaa

SEQ ID NO: 438114 - RNA, 19 nt, Homo sapiens
uaccauaccuacuagcaau

SEQ ID NO: 438115 - RNA, 19 nt, Homo sapiens
gggaagcacuguggcaaca

SEQ ID NO: 438116 - RNA, 19 nt, Homo sapiens
uuucaacaaugggcaguua

SEQ ID NO: 438117 - RNA, 19 nt, Homo sapiens
gcacauuggagagaaagaa

SEQ ID NO: 438118 - RNA, 19 nt, Homo sapiens
ccagagugaagaaguaauu

SEQ ID NO: 438119 - RNA, 19 nt, Homo sapiens
ccuucuguguuauauguua

SEQ ID NO: 438120 - RNA, 19 nt, Homo sapiens
uuagguaguugaugcaugu

SEQ ID NO: 438121 - RNA, 19 nt, Homo sapiens
gcuacaguuugaagaaugu

SEQ ID NO: 438122 - RNA, 19 nt, Homo sapiens
aggaggagaucgcuuuguu

SEQ ID NO: 438123 - RNA, 19 nt, Homo sapiens
gcggauaacaggcuucaug

SEQ ID NO: 438124 - RNA, 19 nt, Homo sapiens
ccaacuuguuuaccuauag

SEQ ID NO: 438125 - RNA, 19 nt, Homo sapiens
ucaagaugguucauauugg

SEQ ID NO: 438126 - RNA, 19 nt, Homo sapiens
uagaacagcugcaguacaa

SEQ ID NO: 438127 - RNA, 19 nt, Homo sapiens
agagagagcuucuauagca

SEQ ID NO: 438128 - RNA, 19 nt, Homo sapiens
gcagagagagcuucuauag

SEQ ID NO: 438129 - RNA, 19 nt, Homo sapiens
ggccagggcuccaagagaa

SEQ ID NO: 438130 - RNA, 19 nt, Homo sapiens
gagcuggccuuucaucauc

SEQ ID NO: 438131 - RNA, 19 nt, Homo sapiens
gagcagauacccucaccua

SEQ ID NO: 438132 - RNA, 19 nt, Homo sapiens
gcucaucagcuccaucuuu

SEQ ID NO: 438133 - RNA, 19 nt, Homo sapiens
gcagauacccucaccuaca

SEQ ID NO: 438134 - RNA, 19 nt, Homo sapiens
gcucugggcccucauauuc

SEQ ID NO: 438135 - RNA, 19 nt, Homo sapiens
gaagugaucccuugcaaaa

SEQ ID NO: 438136 - RNA, 19 nt, Homo sapiens
uggaaaggcugcagaucuu

SEQ ID NO: 438137 - RNA, 19 nt, Homo sapiens
gaacagcugcaguacaauc

SEQ ID NO: 438138 - RNA, 19 nt, Homo sapiens
ucaccgaggccauucagua

SEQ ID NO: 438139 - RNA, 19 nt, Homo sapiens
acccacaccucacaaauug

SEQ ID NO: 438140 - RNA, 19 nt, Homo sapiens
caaagcaggagcaauggaa

SEQ ID NO: 438141 - RNA, 19 nt, Homo sapiens
ccucaugccaccuugaaua

SEQ ID NO: 438142 - RNA, 19 nt, Homo sapiens
gacccacaccucacaaauu

SEQ ID NO: 438143 - RNA, 19 nt, Homo sapiens
cggcagcgcuccaacaucu

SEQ ID NO: 438144 - RNA, 19 nt, Homo sapiens
ggaaguccaugugggagau

SEQ ID NO: 438145 - RNA, 19 nt, Homo sapiens
gggagcugcuggcugcaaa

SEQ ID NO: 438146 - RNA, 19 nt, Homo sapiens
gggcagagagagcuucuau

SEQ ID NO: 438147 - RNA, 19 nt, Homo sapiens
ccgagaugcugucaaguuc

SEQ ID NO: 438148 - RNA, 19 nt, Homo sapiens
aggaugagauugcccucua

SEQ ID NO: 438149 - RNA, 19 nt, Homo sapiens
ucucaaagcaggagcaaug

SEQ ID NO: 438150 - RNA, 19 nt, Homo sapiens
ccacaccucacaaauugaa

SEQ ID NO: 438151 - RNA, 19 nt, Homo sapiens
gcaaauacgguggcaugga

SEQ ID NO: 438152 - RNA, 19 nt, Homo sapiens
gcugcuggcugcaaagaag

SEQ ID NO: 438153 - RNA, 19 nt, Homo sapiens
caccagcucuuuggaagug

SEQ ID NO: 438154 - RNA, 19 nt, Homo sapiens
acacagcccuuguucucau

SEQ ID NO: 438155 - RNA, 19 nt, Homo sapiens
cucaucagcuccaucuuug

SEQ ID NO: 438156 - RNA, 19 nt, Homo sapiens
gaaguggugcugguuagga

SEQ ID NO: 438157 - RNA, 19 nt, Homo sapiens
ggagcuggccuuucaucau

SEQ ID NO: 438158 - RNA, 19 nt, Homo sapiens
ccucauauuccaacaacuu

SEQ ID NO: 438159 - RNA, 19 nt, Homo sapiens
gaccagauugugcuucuca

SEQ ID NO: 438160 - RNA, 19 nt, Homo sapiens
gcaacagcagcaacaggaa

SEQ ID NO: 438161 - RNA, 19 nt, Homo sapiens
ggaugagauugcccucuac

SEQ ID NO: 438162 - RNA, 19 nt, Homo sapiens
gaagacccacaccucacaa

SEQ ID NO: 438163 - RNA, 19 nt, Homo sapiens
caucaucaucucugcaaga

SEQ ID NO: 438164 - RNA, 19 nt, Homo sapiens
aaguagaacagcugcagua

SEQ ID NO: 438165 - RNA, 19 nt, Homo sapiens
cuacacagcccuuguucuc

SEQ ID NO: 438166 - RNA, 19 nt, Homo sapiens
ugagauugcccucuacaca

SEQ ID NO: 438167 - RNA, 19 nt, Homo sapiens
gauguggacuucguuuuga

SEQ ID NO: 438168 - RNA, 19 nt, Homo sapiens
cagauacccucaccuacac

SEQ ID NO: 438169 - RNA, 19 nt, Homo sapiens
gcagcgcuccaacaucuuc

SEQ ID NO: 438170 - RNA, 19 nt, Homo sapiens
gacagggcccagacagcua

SEQ ID NO: 438171 - RNA, 19 nt, Homo sapiens
guggaaaggcugcagaucu

SEQ ID NO: 438172 - RNA, 19 nt, Homo sapiens
gcaagacucaucgccaaag

SEQ ID NO: 438173 - RNA, 19 nt, Homo sapiens
ucagcuccaucuuugacuu

SEQ ID NO: 438174 - RNA, 19 nt, Homo sapiens
ccagauugugcuucucaaa

SEQ ID NO: 438175 - RNA, 19 nt, Homo sapiens
ggaaaggcugcagaucuuc

SEQ ID NO: 438176 - RNA, 19 nt, Homo sapiens
guagaacagcugcaguaca

SEQ ID NO: 438177 - RNA, 19 nt, Homo sapiens
gcccucauauuccaacaac

SEQ ID NO: 438178 - RNA, 19 nt, Homo sapiens
gucccgagaugcugucaag

SEQ ID NO: 438179 - RNA, 19 nt, Homo sapiens
ggcagagagagcuucuaua

SEQ ID NO: 438180 - RNA, 19 nt, Homo sapiens
ugaagugaucccuugcaaa

SEQ ID NO: 438181 - RNA, 19 nt, Homo sapiens
ggccuacaaugcugacaac

SEQ ID NO: 438182 - RNA, 19 nt, Homo sapiens
uggaaguggugcugguuag

SEQ ID NO: 438183 - RNA, 19 nt, Homo sapiens
cugccagaaugaccagauu

SEQ ID NO: 438184 - RNA, 19 nt, Homo sapiens
caaagcauccuggcaaagc

SEQ ID NO: 438185 - RNA, 19 nt, Homo sapiens
caagacucaucgccaaagc

SEQ ID NO: 438186 - RNA, 19 nt, Homo sapiens
cccgagaugcugucaaguu

SEQ ID NO: 438187 - RNA, 19 nt, Homo sapiens
gaggcucucaggcuuuaug

SEQ ID NO: 438188 - RNA, 19 nt, Homo sapiens
ugaccgauguggacuucgu

SEQ ID NO: 438189 - RNA, 19 nt, Homo sapiens
uugaagugaucccuugcaa

SEQ ID NO: 438190 - RNA, 19 nt, Homo sapiens
caugccaccuugaauacag

SEQ ID NO: 438191 - RNA, 19 nt, Homo sapiens
guagccagcauguggaaag

SEQ ID NO: 438192 - RNA, 19 nt, Homo sapiens
gagcugcuggcugcaaaga

SEQ ID NO: 438193 - RNA, 19 nt, Homo sapiens
gccagaaugaccagauugu

SEQ ID NO: 438194 - RNA, 19 nt, Homo sapiens
gcaaggcugagggcagaga

SEQ ID NO: 438195 - RNA, 19 nt, Homo sapiens
ucccuccacucuacaagga

SEQ ID NO: 438196 - RNA, 19 nt, Homo sapiens
gaugagauugcccucuaca

SEQ ID NO: 438197 - RNA, 19 nt, Homo sapiens
cagauugugcuucucaaag

SEQ ID NO: 438198 - RNA, 19 nt, Homo sapiens
gaaugaccagauugugcuu

SEQ ID NO: 438199 - RNA, 19 nt, Homo sapiens
uucaguacgugguggaguu

SEQ ID NO: 438200 - RNA, 19 nt, Homo sapiens
caacauaccugguuuauua

SEQ ID NO: 438201 - RNA, 19 nt, Homo sapiens
ggacagaaguuuccaauuu

SEQ ID NO: 438202 - RNA, 19 nt, Homo sapiens
gaggagaccuucuuacuua

SEQ ID NO: 438203 - RNA, 19 nt, Homo sapiens
ggagaaagcugaagauaau

SEQ ID NO: 438204 - RNA, 19 nt, Homo sapiens
gaagcagaaucuaguauua

SEQ ID NO: 438205 - RNA, 19 nt, Homo sapiens
gaagaaggcugccaacaug

SEQ ID NO: 438206 - RNA, 19 nt, Homo sapiens
ucacaaaucuacaaccuua

SEQ ID NO: 438207 - RNA, 19 nt, Homo sapiens
gguaauugcucuaacuuua

SEQ ID NO: 438208 - RNA, 19 nt, Homo sapiens
uuacagagguucaggauua

SEQ ID NO: 438209 - RNA, 19 nt, Homo sapiens
gaacaaaccuaagcaugaa

SEQ ID NO: 438210 - RNA, 19 nt, Homo sapiens
gaaagagcacuucaaauaa

SEQ ID NO: 438211 - RNA, 19 nt, Homo sapiens
ccagaaagcuuuaagacaa

SEQ ID NO: 438212 - RNA, 19 nt, Homo sapiens
agacaaaccucacauggua

SEQ ID NO: 438213 - RNA, 19 nt, Homo sapiens
agaaagagcacuucaaaua

SEQ ID NO: 438214 - RNA, 19 nt, Homo sapiens
gaugaucuguggaauuuaa

SEQ ID NO: 438215 - RNA, 19 nt, Homo sapiens
gguggaagaugacauuuaa

SEQ ID NO: 438216 - RNA, 19 nt, Homo sapiens
aaacagcucugacuugaaa

SEQ ID NO: 438217 - RNA, 19 nt, Homo sapiens
aaacaacaguggagucaua

SEQ ID NO: 438218 - RNA, 19 nt, Homo sapiens
cgagaaggguuaaacuaua

SEQ ID NO: 438219 - RNA, 19 nt, Homo sapiens
caacauacaugauacagau

SEQ ID NO: 438220 - RNA, 19 nt, Homo sapiens
uuaaauagcugccuaaagu

SEQ ID NO: 438221 - RNA, 19 nt, Homo sapiens
gaaaugugguguacagaga

SEQ ID NO: 438222 - RNA, 19 nt, Homo sapiens
gaagaugggcuuuggagua

SEQ ID NO: 438223 - RNA, 19 nt, Homo sapiens
gaaacugcaccuuugauua

SEQ ID NO: 438224 - RNA, 19 nt, Homo sapiens
gaacagcaguggacaucuu

SEQ ID NO: 438225 - RNA, 19 nt, Homo sapiens
gaacacuaguuugcaauuu

SEQ ID NO: 438226 - RNA, 19 nt, Homo sapiens
uaaacacucucauucagua

SEQ ID NO: 438227 - RNA, 19 nt, Homo sapiens
gaauucagaugacauuaug

SEQ ID NO: 438228 - RNA, 19 nt, Homo sapiens
gaaauagagaguugagaua

SEQ ID NO: 438229 - RNA, 19 nt, Homo sapiens
gagaaggguuaaacuauau

SEQ ID NO: 438230 - RNA, 19 nt, Homo sapiens
caguauagcucuuauugaa

SEQ ID NO: 438231 - RNA, 19 nt, Homo sapiens
gagaaccaguuuccaguuu

SEQ ID NO: 438232 - RNA, 19 nt, Homo sapiens
gaguaguggugguuuauaa

SEQ ID NO: 438233 - RNA, 19 nt, Homo sapiens
ggauggagaucuuauauac

SEQ ID NO: 438234 - RNA, 19 nt, Homo sapiens
ggaacaaaccuaagcauga

SEQ ID NO: 438235 - RNA, 19 nt, Homo sapiens
ggaaucagugagaauauua

SEQ ID NO: 438236 - RNA, 19 nt, Homo sapiens
guaggcauaucuuggcuua

SEQ ID NO: 438237 - RNA, 19 nt, Homo sapiens
caaauacuaucuacagguu

SEQ ID NO: 438238 - RNA, 19 nt, Homo sapiens
gugaugggcuccuguauug

SEQ ID NO: 438239 - RNA, 19 nt, Homo sapiens
gagaugggucugauuaaua

SEQ ID NO: 438240 - RNA, 19 nt, Homo sapiens
gaguuugucugcugaauga

SEQ ID NO: 438241 - RNA, 19 nt, Homo sapiens
gaaagcaccagacuaaaug

SEQ ID NO: 438242 - RNA, 19 nt, Homo sapiens
gaagcuggacuuauacuaa

SEQ ID NO: 438243 - RNA, 19 nt, Homo sapiens
gcaaacuucucuggaguaa

SEQ ID NO: 438244 - RNA, 19 nt, Homo sapiens
gcagugcagcucauuaaua

SEQ ID NO: 438245 - RNA, 19 nt, Homo sapiens
gcaaguauuugauguugau

SEQ ID NO: 438246 - RNA, 19 nt, Homo sapiens
caucagaaaucaacccauu

SEQ ID NO: 438247 - RNA, 19 nt, Homo sapiens
agaaugcacugauguacua

SEQ ID NO: 438248 - RNA, 19 nt, Homo sapiens
gcucaaacaucgaggaaau

SEQ ID NO: 438249 - RNA, 19 nt, Homo sapiens
ugaaggaacucucauaugg

SEQ ID NO: 438250 - RNA, 19 nt, Homo sapiens
gaagauaauggauguagaa

SEQ ID NO: 438251 - RNA, 19 nt, Homo sapiens
gaaaagagauuuggggaaa

SEQ ID NO: 438252 - RNA, 19 nt, Homo sapiens
gaauuuagguggaacaaac

SEQ ID NO: 438253 - RNA, 19 nt, Homo sapiens
ggacacacagacauuguua

SEQ ID NO: 438254 - RNA, 19 nt, Homo sapiens
gcuaugaaauacaagguuu

SEQ ID NO: 438255 - RNA, 19 nt, Homo sapiens
ggaaccacaugcagacaaa

SEQ ID NO: 438256 - RNA, 19 nt, Homo sapiens
gagaccuucuuacuuauuu

SEQ ID NO: 438257 - RNA, 19 nt, Homo sapiens
gcuuaugucuguaauauca

SEQ ID NO: 438258 - RNA, 19 nt, Homo sapiens
ucauaacucuucuugguaa

SEQ ID NO: 438259 - RNA, 19 nt, Homo sapiens
ggaguaaaccauuaaauag

SEQ ID NO: 438260 - RNA, 19 nt, Homo sapiens
gcuaaugccugcuaugcaa

SEQ ID NO: 438261 - RNA, 19 nt, Homo sapiens
ggaaccaacuauacuuaau

SEQ ID NO: 438262 - RNA, 19 nt, Homo sapiens
ggaaagcaccagacuaaau

SEQ ID NO: 438263 - RNA, 19 nt, Homo sapiens
uaucauggcugugaaagaa

SEQ ID NO: 438264 - RNA, 19 nt, Homo sapiens
aaacucugcuagaaugaua

SEQ ID NO: 438265 - RNA, 19 nt, Homo sapiens
gaaauuguccugaugaucu

SEQ ID NO: 438266 - RNA, 19 nt, Homo sapiens
ugacagugcuuauaaacga

SEQ ID NO: 438267 - RNA, 19 nt, Homo sapiens
uaagaaagagcacuucaaa

SEQ ID NO: 438268 - RNA, 19 nt, Homo sapiens
gaagugaugaagaacauuu

SEQ ID NO: 438269 - RNA, 19 nt, Homo sapiens
caagagaucugggcaaugg

SEQ ID NO: 438270 - RNA, 19 nt, Homo sapiens
gcuaccagauguucuacua

SEQ ID NO: 438271 - RNA, 19 nt, Homo sapiens
aucaauggcuuuaggauua

SEQ ID NO: 438272 - RNA, 19 nt, Homo sapiens
gaauguauuucaucaugga

SEQ ID NO: 438273 - RNA, 19 nt, Homo sapiens
cugggaagcuggacuuaua

SEQ ID NO: 438274 - RNA, 19 nt, Homo sapiens
aaacugugcuuuaaagugu

SEQ ID NO: 438275 - RNA, 19 nt, Homo sapiens
uuccgaagcuugucaauuu

SEQ ID NO: 438276 - RNA, 19 nt, Homo sapiens
ggagaugggucugauuaau

SEQ ID NO: 438277 - RNA, 19 nt, Homo sapiens
gaagauggcgaugugauuu

SEQ ID NO: 438278 - RNA, 19 nt, Homo sapiens
ggaaccuuaugccuuauuu

SEQ ID NO: 438279 - RNA, 19 nt, Homo sapiens
ggacacagagaaccaguuu

SEQ ID NO: 438280 - RNA, 19 nt, Homo sapiens
gauggaaucuucacuacuc

SEQ ID NO: 438281 - RNA, 19 nt, Homo sapiens
gaacggaugcauuucauuc

SEQ ID NO: 438282 - RNA, 19 nt, Homo sapiens
gcucugacuugaaauauag

SEQ ID NO: 438283 - RNA, 19 nt, Homo sapiens
gaugggauauuaugcugaa

SEQ ID NO: 438284 - RNA, 19 nt, Homo sapiens
uuagagaacugcucaaaca

SEQ ID NO: 438285 - RNA, 19 nt, Homo sapiens
ugaugaagcccaaauaauu

SEQ ID NO: 438286 - RNA, 19 nt, Homo sapiens
gauaaacacucucauucag

SEQ ID NO: 438287 - RNA, 19 nt, Homo sapiens
ccaggaaucugaaucuugu

SEQ ID NO: 438288 - RNA, 19 nt, Homo sapiens
gaaaauagcaccucacuuc

SEQ ID NO: 438289 - RNA, 19 nt, Homo sapiens
ggaccacacucuauucagu

SEQ ID NO: 438290 - RNA, 19 nt, Homo sapiens
ccugagagauggcauuuau

SEQ ID NO: 438291 - RNA, 19 nt, Homo sapiens
gggagaaagcugaagauaa

SEQ ID NO: 438292 - RNA, 19 nt, Homo sapiens
cagaaagcuuuaagacaaa

SEQ ID NO: 438293 - RNA, 19 nt, Homo sapiens
gaaugaaguugugguggaa

SEQ ID NO: 438294 - RNA, 19 nt, Homo sapiens
ggaaaaugcugcaacaaga

SEQ ID NO: 438295 - RNA, 19 nt, Homo sapiens
ggaaagacauaugugauac

SEQ ID NO: 438296 - RNA, 19 nt, Homo sapiens
gaaauuacuccacccucua

SEQ ID NO: 438297 - RNA, 19 nt, Homo sapiens
ccaagaaauuguccugaug

SEQ ID NO: 438298 - RNA, 19 nt, Homo sapiens
gaauauuucugguuguuac

SEQ ID NO: 438299 - RNA, 19 nt, Homo sapiens
cuacagaaguggaaauaca

SEQ ID NO: 438300 - RNA, 19 nt, Homo sapiens
gcaaauggcuucugaaaga

SEQ ID NO: 438301 - RNA, 19 nt, Homo sapiens
ggagaggucuguucacuua

SEQ ID NO: 438302 - RNA, 19 nt, Homo sapiens
gcaagccacugaagaauua

SEQ ID NO: 438303 - RNA, 19 nt, Homo sapiens
gaacaaaucucaaccaagu

SEQ ID NO: 438304 - RNA, 19 nt, Homo sapiens
caacaaaucuucagaaaca

SEQ ID NO: 438305 - RNA, 19 nt, Homo sapiens
gaacagguaucuaguaguu

SEQ ID NO: 438306 - RNA, 19 nt, Homo sapiens
gaauaaggcuuguuuccua

SEQ ID NO: 438307 - RNA, 19 nt, Homo sapiens
gaucagacuucuaugaaua

SEQ ID NO: 438308 - RNA, 19 nt, Homo sapiens
caagauaagugugauguua

SEQ ID NO: 438309 - RNA, 19 nt, Homo sapiens
guugagaccuccuuaaaua

SEQ ID NO: 438310 - RNA, 19 nt, Homo sapiens
gaaagucgaucaucugguu

SEQ ID NO: 438311 - RNA, 19 nt, Homo sapiens
ggaagaggaagacauauua

SEQ ID NO: 438312 - RNA, 19 nt, Homo sapiens
gcauauacuuccuuugaua

SEQ ID NO: 438313 - RNA, 19 nt, Homo sapiens
gaagcugacucuuuggaua

SEQ ID NO: 438314 - RNA, 19 nt, Homo sapiens
gaauagacauaaccucaaa

SEQ ID NO: 438315 - RNA, 19 nt, Homo sapiens
ggaagaagguaauuuaaag

SEQ ID NO: 438316 - RNA, 19 nt, Homo sapiens
ugacagacccugaauauaa

SEQ ID NO: 438317 - RNA, 19 nt, Homo sapiens
caauagaucuuucugcaaa

SEQ ID NO: 438318 - RNA, 19 nt, Homo sapiens
gaaaugagguuacauaucc

SEQ ID NO: 438319 - RNA, 19 nt, Homo sapiens
ucaaguagauccuauagaa

SEQ ID NO: 438320 - RNA, 19 nt, Homo sapiens
gaacauaaauccauaucca

SEQ ID NO: 438321 - RNA, 19 nt, Homo sapiens
gaauggaguuguucaaaug

SEQ ID NO: 438322 - RNA, 19 nt, Homo sapiens
gaaauaaaccuagcuagaa

SEQ ID NO: 438323 - RNA, 19 nt, Homo sapiens
gcaaagaagaguuuaguuu

SEQ ID NO: 438324 - RNA, 19 nt, Homo sapiens
agaaagaggugaugacauu

SEQ ID NO: 438325 - RNA, 19 nt, Homo sapiens
ggacaagaauuauauccuu

SEQ ID NO: 438326 - RNA, 19 nt, Homo sapiens
gagaauaaauccaaagaca

SEQ ID NO: 438327 - RNA, 19 nt, Homo sapiens
gagaccuccuuaaauauua

SEQ ID NO: 438328 - RNA, 19 nt, Homo sapiens
gcacaucugucacucauuc

SEQ ID NO: 438329 - RNA, 19 nt, Homo sapiens
gcagugagguaccauauuc

SEQ ID NO: 438330 - RNA, 19 nt, Homo sapiens
aaacauaguucucuagaug

SEQ ID NO: 438331 - RNA, 19 nt, Homo sapiens
aagcagaacuugauaagaa

SEQ ID NO: 438332 - RNA, 19 nt, Homo sapiens
gaaugaugcuuauuugguu

SEQ ID NO: 438333 - RNA, 19 nt, Homo sapiens
gcaaagaaucugauauuga

SEQ ID NO: 438334 - RNA, 19 nt, Homo sapiens
ucacaaggcuaccaacaaa

SEQ ID NO: 438335 - RNA, 19 nt, Homo sapiens
gaaaugauagugcaagauu

SEQ ID NO: 438336 - RNA, 19 nt, Homo sapiens
aaacugagguucaagagaa

SEQ ID NO: 438337 - RNA, 19 nt, Homo sapiens
gaagaaccaggcucaauaa

SEQ ID NO: 438338 - RNA, 19 nt, Homo sapiens
caacugucauuacuucuuu

SEQ ID NO: 438339 - RNA, 19 nt, Homo sapiens
gaaccaggcucaauaacca

SEQ ID NO: 438340 - RNA, 19 nt, Homo sapiens
gacagacccugaauauaaa

SEQ ID NO: 438341 - RNA, 19 nt, Homo sapiens
ugagggagcuugcccaauu

SEQ ID NO: 438342 - RNA, 19 nt, Homo sapiens
ggaggaagauguaguugau

SEQ ID NO: 438343 - RNA, 19 nt, Homo sapiens
ucagaaagcagaaagauaa

SEQ ID NO: 438344 - RNA, 19 nt, Homo sapiens
ggaaguuucuaucugguuu

SEQ ID NO: 438345 - RNA, 19 nt, Homo sapiens
uaaggaaguuucaggauga

SEQ ID NO: 438346 - RNA, 19 nt, Homo sapiens
ggucaacccucgcuccuuu

SEQ ID NO: 438347 - RNA, 19 nt, Homo sapiens
agaggaagcugaugacuug

SEQ ID NO: 438348 - RNA, 19 nt, Homo sapiens
aaacugguccuucuaauaa

SEQ ID NO: 438349 - RNA, 19 nt, Homo sapiens
gcacacauaugucuucaag

SEQ ID NO: 438350 - RNA, 19 nt, Homo sapiens
gaaauuacaagucagaaga

SEQ ID NO: 438351 - RNA, 19 nt, Homo sapiens
ggaaauaaaccuagcuaga

SEQ ID NO: 438352 - RNA, 19 nt, Homo sapiens
aaacgagugugguaaauug

SEQ ID NO: 438353 - RNA, 19 nt, Homo sapiens
gaaaaugauuggacaguuu

SEQ ID NO: 438354 - RNA, 19 nt, Homo sapiens
gugcuaaggacaagaauua

SEQ ID NO: 438355 - RNA, 19 nt, Homo sapiens
uaagggacguuucaaguug

SEQ ID NO: 438356 - RNA, 19 nt, Homo sapiens
ggaaaguaauaagcacaua

SEQ ID NO: 438357 - RNA, 19 nt, Homo sapiens
gaaagaguaugcacaucug

SEQ ID NO: 438358 - RNA, 19 nt, Homo sapiens
ccaugacacugauaucuuu

SEQ ID NO: 438359 - RNA, 19 nt, Homo sapiens
ggaagcugaugacuugaaa

SEQ ID NO: 438360 - RNA, 19 nt, Homo sapiens
gcucaucauucaauucaaa

SEQ ID NO: 438361 - RNA, 19 nt, Homo sapiens
caagggaaaugcaaaguca

SEQ ID NO: 438362 - RNA, 19 nt, Homo sapiens
gauaaacuguaugcucuuu

SEQ ID NO: 438363 - RNA, 19 nt, Homo sapiens
gaaagaacaagacaugguu

SEQ ID NO: 438364 - RNA, 19 nt, Homo sapiens
gaaagcugcuguugccaau

SEQ ID NO: 438365 - RNA, 19 nt, Homo sapiens
caaugacacuggugaagaa

SEQ ID NO: 438366 - RNA, 19 nt, Homo sapiens
gauaaaguguuuccucaca

SEQ ID NO: 438367 - RNA, 19 nt, Homo sapiens
gcaauaagugcugguguua

SEQ ID NO: 438368 - RNA, 19 nt, Homo sapiens
ccacgacaaucucauaguu

SEQ ID NO: 438369 - RNA, 19 nt, Homo sapiens
guagagaacaagaagauuu

SEQ ID NO: 438370 - RNA, 19 nt, Homo sapiens
uaacacauuugacuugaug

SEQ ID NO: 438371 - RNA, 19 nt, Homo sapiens
gaagagaacaauaaagcaa

SEQ ID NO: 438372 - RNA, 19 nt, Homo sapiens
gugaugacauucagaaaga

SEQ ID NO: 438373 - RNA, 19 nt, Homo sapiens
gcagaugugucaccuaugg

SEQ ID NO: 438374 - RNA, 19 nt, Homo sapiens
gcucaaggucccagauuua

SEQ ID NO: 438375 - RNA, 19 nt, Homo sapiens
gcaggaagggagccauuua

SEQ ID NO: 438376 - RNA, 19 nt, Homo sapiens
gaagaggaagacauauuaa

SEQ ID NO: 438377 - RNA, 19 nt, Homo sapiens
gaaagaauagcaaaucauc

SEQ ID NO: 438378 - RNA, 19 nt, Homo sapiens
ggaaagacaagauaagugu

SEQ ID NO: 438379 - RNA, 19 nt, Homo sapiens
gagguuacauauccaguga

SEQ ID NO: 438380 - RNA, 19 nt, Homo sapiens
gcaaccaaaggaauucuua

SEQ ID NO: 438381 - RNA, 19 nt, Homo sapiens
gcaauaaauuccagguauc

SEQ ID NO: 438382 - RNA, 19 nt, Homo sapiens
agacucagguucucuuauu

SEQ ID NO: 438383 - RNA, 19 nt, Homo sapiens
gaaaucggucaaagagaua

SEQ ID NO: 438384 - RNA, 19 nt, Homo sapiens
cgaaucaguuucuacaaga

SEQ ID NO: 438385 - RNA, 19 nt, Homo sapiens
ggagaccaaugaaggagaa

SEQ ID NO: 438386 - RNA, 19 nt, Homo sapiens
ugaagaaccaggcucaaua

SEQ ID NO: 438387 - RNA, 19 nt, Homo sapiens
gaaacauaguucucuagau

SEQ ID NO: 438388 - RNA, 19 nt, Homo sapiens
gaggagucaucauuagaaa

SEQ ID NO: 438389 - RNA, 19 nt, Homo sapiens
cgaugagaauaacaacuua

SEQ ID NO: 438390 - RNA, 19 nt, Homo sapiens
gcagaaagauaagcacaca

SEQ ID NO: 438391 - RNA, 19 nt, Homo sapiens
uauaagauauccacgacaa

SEQ ID NO: 438392 - RNA, 19 nt, Homo sapiens
gcacacaucauuguuaguu

SEQ ID NO: 438393 - RNA, 19 nt, Homo sapiens
acagugagcagccauauaa

SEQ ID NO: 438394 - RNA, 19 nt, Homo sapiens
cuaaagggaaguaugaaua

SEQ ID NO: 438395 - RNA, 19 nt, Homo sapiens
ccagggaacucaagaccaa

SEQ ID NO: 438396 - RNA, 19 nt, Homo sapiens
gcuaaggacaagaauuaua

SEQ ID NO: 438397 - RNA, 19 nt, Homo sapiens
gcacacucauucuuuguca

SEQ ID NO: 438398 - RNA, 19 nt, Homo sapiens
gaugugcacuguaaauaag

SEQ ID NO: 438399 - RNA, 19 nt, Homo sapiens
caugaacacuguacuuugu

SEQ ID NO: 438400 - RNA, 19 nt, Homo sapiens
gaggagagcuacuuguuua

SEQ ID NO: 438401 - RNA, 19 nt, Homo sapiens
gaaauaggcaugaugauaa

SEQ ID NO: 438402 - RNA, 19 nt, Homo sapiens
guacacauauccaguuaua

SEQ ID NO: 438403 - RNA, 19 nt, Homo sapiens
ugaauuagcuuuccaguuc

SEQ ID NO: 438404 - RNA, 19 nt, Homo sapiens
caacaacucaggaauauaa

SEQ ID NO: 438405 - RNA, 19 nt, Homo sapiens
gcucaaagcuguucguguu

SEQ ID NO: 438406 - RNA, 19 nt, Homo sapiens
ggacaacaguuucucauuc

SEQ ID NO: 438407 - RNA, 19 nt, Homo sapiens
ccacuacacuuauuaucua

SEQ ID NO: 438408 - RNA, 19 nt, Homo sapiens
guagaaagcuggaagucuu

SEQ ID NO: 438409 - RNA, 19 nt, Homo sapiens
ggauggugcuguagaagua

SEQ ID NO: 438410 - RNA, 19 nt, Homo sapiens
cuaaguaucuucgacaaua

SEQ ID NO: 438411 - RNA, 19 nt, Homo sapiens
caaaggaaguguccaugaa

SEQ ID NO: 438412 - RNA, 19 nt, Homo sapiens
gcuuauuucucuugcauua

SEQ ID NO: 438413 - RNA, 19 nt, Homo sapiens
gacaauacauggaguaaca

SEQ ID NO: 438414 - RNA, 19 nt, Homo sapiens
ggaguaacauucaugacuu

SEQ ID NO: 438415 - RNA, 19 nt, Homo sapiens
ccaaagagcugggauuaca

SEQ ID NO: 438416 - RNA, 19 nt, Homo sapiens
uauaauugcuuccuaguug

SEQ ID NO: 438417 - RNA, 19 nt, Homo sapiens
uaagagggauuuguuacua

SEQ ID NO: 438418 - RNA, 19 nt, Homo sapiens
gagcaacaacucaggaaua

SEQ ID NO: 438419 - RNA, 19 nt, Homo sapiens
cuacaacuuugcugauaua

SEQ ID NO: 438420 - RNA, 19 nt, Homo sapiens
ggaccaagauguuuguauc

SEQ ID NO: 438421 - RNA, 19 nt, Homo sapiens
caaguaauguucaaguaug

SEQ ID NO: 438422 - RNA, 19 nt, Homo sapiens
ggaguugacauaauacuuu

SEQ ID NO: 438423 - RNA, 19 nt, Homo sapiens
acauggaguugacauaaua

SEQ ID NO: 438424 - RNA, 19 nt, Homo sapiens
cauuagcacugcaucauuu

SEQ ID NO: 438425 - RNA, 19 nt, Homo sapiens
aaagguauaugcaaugcua

SEQ ID NO: 438426 - RNA, 19 nt, Homo sapiens
gaagagcagcgaugaauca

SEQ ID NO: 438427 - RNA, 19 nt, Homo sapiens
gaguaacauucaugacuuu

SEQ ID NO: 438428 - RNA, 19 nt, Homo sapiens
gacaacaguuucucauuca

SEQ ID NO: 438429 - RNA, 19 nt, Homo sapiens
guuacuagucgaucaauua

SEQ ID NO: 438430 - RNA, 19 nt, Homo sapiens
uaaacgagauauucaaugg

SEQ ID NO: 438431 - RNA, 19 nt, Homo sapiens
ggaagugccugagcuagug

SEQ ID NO: 438432 - RNA, 19 nt, Homo sapiens
guuauugccuuggaguuua

SEQ ID NO: 438433 - RNA, 19 nt, Homo sapiens
caacuuugcugauauacag

SEQ ID NO: 438434 - RNA, 19 nt, Homo sapiens
cacuacaccuggcuaauuu

SEQ ID NO: 438435 - RNA, 19 nt, Homo sapiens
ggucagacggcauuaguuu

SEQ ID NO: 438436 - RNA, 19 nt, Homo sapiens
caaaucuaccugaucauaa

SEQ ID NO: 438437 - RNA, 19 nt, Homo sapiens
uaagaaauaggcaugauga

SEQ ID NO: 438438 - RNA, 19 nt, Homo sapiens
guaaacauuccuaugauug

SEQ ID NO: 438439 - RNA, 19 nt, Homo sapiens
guacauggaguugacauaa

SEQ ID NO: 438440 - RNA, 19 nt, Homo sapiens
cuagugagcuggccaacga

SEQ ID NO: 438441 - RNA, 19 nt, Homo sapiens
ugacuguacuaacugcaua

SEQ ID NO: 438442 - RNA, 19 nt, Homo sapiens
ccaaaucuaccugaucaua

SEQ ID NO: 438443 - RNA, 19 nt, Homo sapiens
ccagaaaacuaauugauga

SEQ ID NO: 438444 - RNA, 19 nt, Homo sapiens
agaaauaggcaugaugaua

SEQ ID NO: 438445 - RNA, 19 nt, Homo sapiens
uugaugagaugguugguaa

SEQ ID NO: 438446 - RNA, 19 nt, Homo sapiens
gaguugacauaauacuuug

SEQ ID NO: 438447 - RNA, 19 nt, Homo sapiens
gcaaaugccagaaaacuaa

SEQ ID NO: 438448 - RNA, 19 nt, Homo sapiens
auaagggcauucaauacua

SEQ ID NO: 438449 - RNA, 19 nt, Homo sapiens
ugagaacuguaacaucuau

SEQ ID NO: 438450 - RNA, 19 nt, Homo sapiens
ggagagcuacuuguuuaaa

SEQ ID NO: 438451 - RNA, 19 nt, Homo sapiens
accaaacccuugugacuuu

SEQ ID NO: 438452 - RNA, 19 nt, Homo sapiens
acuagucgaucaauuagaa

SEQ ID NO: 438453 - RNA, 19 nt, Homo sapiens
ugaaacaguaggucgcuua

SEQ ID NO: 438454 - RNA, 19 nt, Homo sapiens
gaauuagcuuuccaguuca

SEQ ID NO: 438455 - RNA, 19 nt, Homo sapiens
guuggugacagauuuaaua

SEQ ID NO: 438456 - RNA, 19 nt, Homo sapiens
gugcuaugguuguuucuau

SEQ ID NO: 438457 - RNA, 19 nt, Homo sapiens
guagugcuaugguuguuuc

SEQ ID NO: 438458 - RNA, 19 nt, Homo sapiens
gaucucggcucaccacaac

SEQ ID NO: 438459 - RNA, 19 nt, Homo sapiens
ggccuugugcuaaccauua

SEQ ID NO: 438460 - RNA, 19 nt, Homo sapiens
gaugauaagcuaugcagau

SEQ ID NO: 438461 - RNA, 19 nt, Homo sapiens
caauuagaaugaaccuaug

SEQ ID NO: 438462 - RNA, 19 nt, Homo sapiens
gaaucaugcuuagugguau

SEQ ID NO: 438463 - RNA, 19 nt, Homo sapiens
auguuaaggugcagaaaua

SEQ ID NO: 438464 - RNA, 19 nt, Homo sapiens
gacuccauaucauugcuua

SEQ ID NO: 438465 - RNA, 19 nt, Homo sapiens
gaaaacagaaguagcuaaa

SEQ ID NO: 438466 - RNA, 19 nt, Homo sapiens
ugaaucaugcuuaguggua

SEQ ID NO: 438467 - RNA, 19 nt, Homo sapiens
gguagcaggacaacaguuu

SEQ ID NO: 438468 - RNA, 19 nt, Homo sapiens
cacauuagccugccaacaa

SEQ ID NO: 438469 - RNA, 19 nt, Homo sapiens
gcuaugguuguuucuauaa

SEQ ID NO: 438470 - RNA, 19 nt, Homo sapiens
ccacuacaccuggcuaauu

SEQ ID NO: 438471 - RNA, 19 nt, Homo sapiens
caggaggugucaauagguu

SEQ ID NO: 438472 - RNA, 19 nt, Homo sapiens
caauuaagagggauuuguu

SEQ ID NO: 438473 - RNA, 19 nt, Homo sapiens
gacuugguauuaagccuuu

SEQ ID NO: 438474 - RNA, 19 nt, Homo sapiens
guacuauccugaauuagcu

SEQ ID NO: 438475 - RNA, 19 nt, Homo sapiens
ugugagaacuguaacaucu

SEQ ID NO: 438476 - RNA, 19 nt, Homo sapiens
gcacugcaucauuucaauu

SEQ ID NO: 438477 - RNA, 19 nt, Homo sapiens
cuauaugacucuucugcuu

SEQ ID NO: 438478 - RNA, 19 nt, Homo sapiens
cuuccuaguugcauuauau

SEQ ID NO: 438479 - RNA, 19 nt, Homo sapiens
ccacagaagccaauagaag

SEQ ID NO: 438480 - RNA, 19 nt, Homo sapiens
augguacuauccugaauua

SEQ ID NO: 438481 - RNA, 19 nt, Homo sapiens
cauauaagggagauguuaa

SEQ ID NO: 438482 - RNA, 19 nt, Homo sapiens
ggccaugaugauauuauua

SEQ ID NO: 438483 - RNA, 19 nt, Homo sapiens
aaagaugcagggcuaagua

SEQ ID NO: 438484 - RNA, 19 nt, Homo sapiens
gaccaugggcugcuucuuc

SEQ ID NO: 438485 - RNA, 19 nt, Homo sapiens
gugauuacacuauugcaaa

SEQ ID NO: 438486 - RNA, 19 nt, Homo sapiens
gguauuauuugcuggugau

SEQ ID NO: 438487 - RNA, 19 nt, Homo sapiens
gagucuuccucaaauauca

SEQ ID NO: 438488 - RNA, 19 nt, Homo sapiens
gagagcuacuuguuuaaaa

SEQ ID NO: 438489 - RNA, 19 nt, Homo sapiens
ucccaaaucuaccugauca

SEQ ID NO: 438490 - RNA, 19 nt, Homo sapiens
gguaagaaauaggcaugau

SEQ ID NO: 438491 - RNA, 19 nt, Homo sapiens
cuucguaaguaguaugauu

SEQ ID NO: 438492 - RNA, 19 nt, Homo sapiens
uaacucuacuaacagaugu

SEQ ID NO: 438493 - RNA, 19 nt, Homo sapiens
gaagugcaauguggaacca

SEQ ID NO: 438494 - RNA, 19 nt, Homo sapiens
gcuggugauuacacuauug

SEQ ID NO: 438495 - RNA, 19 nt, Homo sapiens
gcaacaacucaggaauaua

SEQ ID NO: 438496 - RNA, 19 nt, Homo sapiens
ccucagugcuccaugauac

SEQ ID NO: 438497 - RNA, 19 nt, Homo sapiens
gaauaugaagugcaaugug

SEQ ID NO: 438498 - RNA, 19 nt, Homo sapiens
ucaaugggaccaagauguu

SEQ ID NO: 438499 - RNA, 19 nt, Homo sapiens
aaaaguuggugacagauuu

SEQ ID NO: 438500 - RNA, 19 nt, Homo sapiens
gaagaaaugucagaaauga

SEQ ID NO: 438501 - RNA, 19 nt, Homo sapiens
gaaguaaaguuucugauag

SEQ ID NO: 438502 - RNA, 19 nt, Homo sapiens
aaacagagauccuaucaga

SEQ ID NO: 438503 - RNA, 19 nt, Homo sapiens
ggaaccagauuauuugcua

SEQ ID NO: 438504 - RNA, 19 nt, Homo sapiens
ggauacagcucuuacugaa

SEQ ID NO: 438505 - RNA, 19 nt, Homo sapiens
gauagcaguucauuagaaa

SEQ ID NO: 438506 - RNA, 19 nt, Homo sapiens
ccaaguguauuguaaugua

SEQ ID NO: 438507 - RNA, 19 nt, Homo sapiens
gaaagaaccaaugaugaua

SEQ ID NO: 438508 - RNA, 19 nt, Homo sapiens
gcagauagcaguucauuag

SEQ ID NO: 438509 - RNA, 19 nt, Homo sapiens
gaccaaagaagcagagaua

SEQ ID NO: 438510 - RNA, 19 nt, Homo sapiens
ccaaagucauugagaauau

SEQ ID NO: 438511 - RNA, 19 nt, Homo sapiens
gauauuaccauucagcuuu

SEQ ID NO: 438512 - RNA, 19 nt, Homo sapiens
gaaggugcauggaggaaga

SEQ ID NO: 438513 - RNA, 19 nt, Homo sapiens
gauaucggccuuauguaua

SEQ ID NO: 438514 - RNA, 19 nt, Homo sapiens
caacagauggugagcuaua

SEQ ID NO: 438515 - RNA, 19 nt, Homo sapiens
guagaaagccuuggagaaa

SEQ ID NO: 438516 - RNA, 19 nt, Homo sapiens
ucacacagcuuugauaaca

SEQ ID NO: 438517 - RNA, 19 nt, Homo sapiens
gacuuggacuggagaauuu

SEQ ID NO: 438518 - RNA, 19 nt, Homo sapiens
gcagaaagaaccaaugaug

SEQ ID NO: 438519 - RNA, 19 nt, Homo sapiens
aagcagagauagauaauuc

SEQ ID NO: 438520 - RNA, 19 nt, Homo sapiens
uagaugaaaugaccaaaga

SEQ ID NO: 438521 - RNA, 19 nt, Homo sapiens
cagaugaccuuacagacaa

SEQ ID NO: 438522 - RNA, 19 nt, Homo sapiens
cagauuauuugcuagauga

SEQ ID NO: 438523 - RNA, 19 nt, Homo sapiens
gagagaaaccuccaagaga

SEQ ID NO: 438524 - RNA, 19 nt, Homo sapiens
cagaggaaccagauuauuu

SEQ ID NO: 438525 - RNA, 19 nt, Homo sapiens
uaacagauaucggccuuau

SEQ ID NO: 438526 - RNA, 19 nt, Homo sapiens
gaaagaagggaaagcaugu

SEQ ID NO: 438527 - RNA, 19 nt, Homo sapiens
gaacacuaccuccaauaga

SEQ ID NO: 438528 - RNA, 19 nt, Homo sapiens
guuguuaccggaaauaaua

SEQ ID NO: 438529 - RNA, 19 nt, Homo sapiens
caaauucucccuaaagugu

SEQ ID NO: 438530 - RNA, 19 nt, Homo sapiens
cagaauaucccaccaacaa

SEQ ID NO: 438531 - RNA, 19 nt, Homo sapiens
gagcagaaagaaccaauga

SEQ ID NO: 438532 - RNA, 19 nt, Homo sapiens
gagagugucuuaucugaac

SEQ ID NO: 438533 - RNA, 19 nt, Homo sapiens
aaggauacaugcuugauga

SEQ ID NO: 438534 - RNA, 19 nt, Homo sapiens
gggaucaaacaauaaguua

SEQ ID NO: 438535 - RNA, 19 nt, Homo sapiens
cauccgagcauaagauuaa

SEQ ID NO: 438536 - RNA, 19 nt, Homo sapiens
uaucucaaauucucccuaa

SEQ ID NO: 438537 - RNA, 19 nt, Homo sapiens
ggaaaccugucuccuggau

SEQ ID NO: 438538 - RNA, 19 nt, Homo sapiens
cuauaagugugaccaguuu

SEQ ID NO: 438539 - RNA, 19 nt, Homo sapiens
gaauaucccaccaacaaau

SEQ ID NO: 438540 - RNA, 19 nt, Homo sapiens
gaaaguguuccuacagguu

SEQ ID NO: 438541 - RNA, 19 nt, Homo sapiens
ggaaggagcagaggauuca

SEQ ID NO: 438542 - RNA, 19 nt, Homo sapiens
gagccugaauuccaaugaa

SEQ ID NO: 438543 - RNA, 19 nt, Homo sapiens
gauaauucuucaacuguag

SEQ ID NO: 438544 - RNA, 19 nt, Homo sapiens
caaagaagcagagauagau

SEQ ID NO: 438545 - RNA, 19 nt, Homo sapiens
gcaagugaccauugggaaa

SEQ ID NO: 438546 - RNA, 19 nt, Homo sapiens
caaaagaguccccucaaua

SEQ ID NO: 438547 - RNA, 19 nt, Homo sapiens
gaaacaacaccaagcaaag

SEQ ID NO: 438548 - RNA, 19 nt, Homo sapiens
ggacuuggacuggagaauu

SEQ ID NO: 438549 - RNA, 19 nt, Homo sapiens
gagaacacuaccuccaaua

SEQ ID NO: 438550 - RNA, 19 nt, Homo sapiens
gagaaacuacugauaucuu

SEQ ID NO: 438551 - RNA, 19 nt, Homo sapiens
ggagaaggugauccaagua

SEQ ID NO: 438552 - RNA, 19 nt, Homo sapiens
caacaaauacagagagaag

SEQ ID NO: 438553 - RNA, 19 nt, Homo sapiens
agauagcaguucauuagaa

SEQ ID NO: 438554 - RNA, 19 nt, Homo sapiens
gaacgggccauuugugagu

SEQ ID NO: 438555 - RNA, 19 nt, Homo sapiens
cagaaagaaccaaugauga

SEQ ID NO: 438556 - RNA, 19 nt, Homo sapiens
gaagaaaacugugggagau

SEQ ID NO: 438557 - RNA, 19 nt, Homo sapiens
agcagaggaucaugaauuu

SEQ ID NO: 438558 - RNA, 19 nt, Homo sapiens
caaagcagaggaucaugaa

SEQ ID NO: 438559 - RNA, 19 nt, Homo sapiens
gguagaagcaaaugaggaa

SEQ ID NO: 438560 - RNA, 19 nt, Homo sapiens
gaaggaaggagcagaggau

SEQ ID NO: 438561 - RNA, 19 nt, Homo sapiens
acacagcuuugauaacaga

SEQ ID NO: 438562 - RNA, 19 nt, Homo sapiens
cuaaaguguuguggccuua

SEQ ID NO: 438563 - RNA, 19 nt, Homo sapiens
acagagauccuaucagaug

SEQ ID NO: 438564 - RNA, 19 nt, Homo sapiens
cuacgacuaucgaagcauu

SEQ ID NO: 438565 - RNA, 19 nt, Homo sapiens
gaagagcugaugcccgauu

SEQ ID NO: 438566 - RNA, 19 nt, Homo sapiens
ccaaagaagcagagauaga

SEQ ID NO: 438567 - RNA, 19 nt, Homo sapiens
gaagggcaaauugguuuaa

SEQ ID NO: 438568 - RNA, 19 nt, Homo sapiens
agaaggaggcaauguauau

SEQ ID NO: 438569 - RNA, 19 nt, Homo sapiens
ugaaacaacaccaagcaaa

SEQ ID NO: 438570 - RNA, 19 nt, Homo sapiens
cgauucgggugcuguguuu

SEQ ID NO: 438571 - RNA, 19 nt, Homo sapiens
aaaguguuccuacagguua

SEQ ID NO: 438572 - RNA, 19 nt, Homo sapiens
gaagaaaggagaaaacaga

SEQ ID NO: 438573 - RNA, 19 nt, Homo sapiens
gggaaagcauguaaacaac

SEQ ID NO: 438574 - RNA, 19 nt, Homo sapiens
aaacgaugauagugaugaa

SEQ ID NO: 438575 - RNA, 19 nt, Homo sapiens
aacacuaccuccaauagaa

SEQ ID NO: 438576 - RNA, 19 nt, Homo sapiens
aacaacagauggugagcua

SEQ ID NO: 438577 - RNA, 19 nt, Homo sapiens
caacugguggaaauaauga

SEQ ID NO: 438578 - RNA, 19 nt, Homo sapiens
caccaaguguauuguaaug

SEQ ID NO: 438579 - RNA, 19 nt, Homo sapiens
gggagaugaugaaaguguu

SEQ ID NO: 438580 - RNA, 19 nt, Homo sapiens
cagagauccuaucagauga

SEQ ID NO: 438581 - RNA, 19 nt, Homo sapiens
gaagggaaagcauguaaac

SEQ ID NO: 438582 - RNA, 19 nt, Homo sapiens
ucacuucauuccuacuuug

SEQ ID NO: 438583 - RNA, 19 nt, Homo sapiens
gaacccaaagucauugaga

SEQ ID NO: 438584 - RNA, 19 nt, Homo sapiens
gaaauaaugaaggacaguu

SEQ ID NO: 438585 - RNA, 19 nt, Homo sapiens
guuguggccuuaacuguuc

SEQ ID NO: 438586 - RNA, 19 nt, Homo sapiens
gagaccagaucauuuuaaa

SEQ ID NO: 438587 - RNA, 19 nt, Homo sapiens
gcagagauagauaauucuu

SEQ ID NO: 438588 - RNA, 19 nt, Homo sapiens
cagcuuugauaacagauau

SEQ ID NO: 438589 - RNA, 19 nt, Homo sapiens
gagaaaaucacacagcuuu

SEQ ID NO: 438590 - RNA, 19 nt, Homo sapiens
ugucugaaauuccggagaa

SEQ ID NO: 438591 - RNA, 19 nt, Homo sapiens
aagcagaggaucaugaauu

SEQ ID NO: 438592 - RNA, 19 nt, Homo sapiens
cgaugauagugaugaauau

SEQ ID NO: 438593 - RNA, 19 nt, Homo sapiens
accaaucacuucauuccua

SEQ ID NO: 438594 - RNA, 19 nt, Homo sapiens
gagaauauuagggaucaaa

SEQ ID NO: 438595 - RNA, 19 nt, Homo sapiens
ucacggagaaugcugugua

SEQ ID NO: 438596 - RNA, 19 nt, Homo sapiens
cggagaaggugauccaagu

SEQ ID NO: 438597 - RNA, 19 nt, Homo sapiens
ggugcuguguuuacauuug

SEQ ID NO: 438598 - RNA, 19 nt, Homo sapiens
cuggaucucuuguggauau

SEQ ID NO: 438599 - RNA, 19 nt, Homo sapiens
gucagaaucaucagaauau

SEQ ID NO: 438600 - RNA, 19 nt, Homo sapiens
ggaagaugcugauaaauuu

SEQ ID NO: 438601 - RNA, 19 nt, Homo sapiens
gaagucagcugaagcaguu

SEQ ID NO: 438602 - RNA, 19 nt, Homo sapiens
gacaaguucuuuccucuua

SEQ ID NO: 438603 - RNA, 19 nt, Homo sapiens
ggaauggguucuacuguuu

SEQ ID NO: 438604 - RNA, 19 nt, Homo sapiens
ggaauuaugucguaaguca

SEQ ID NO: 438605 - RNA, 19 nt, Homo sapiens
gggcagaaguuugcaaaua

SEQ ID NO: 438606 - RNA, 19 nt, Homo sapiens
gcaauaggguagaaugauu

SEQ ID NO: 438607 - RNA, 19 nt, Homo sapiens
gcaauccagugcccuauaa

SEQ ID NO: 438608 - RNA, 19 nt, Homo sapiens
gcaaauaggcagaauggaa

SEQ ID NO: 438609 - RNA, 19 nt, Homo sapiens
guaguuaucuugauggaau

SEQ ID NO: 438610 - RNA, 19 nt, Homo sapiens
cgaaggcucucucuuucua

SEQ ID NO: 438611 - RNA, 19 nt, Homo sapiens
gaagugcgacaccgaauuu

SEQ ID NO: 438612 - RNA, 19 nt, Homo sapiens
gggaagaugcugauaaauu

SEQ ID NO: 438613 - RNA, 19 nt, Homo sapiens
gcaaagagaacugcaugua

SEQ ID NO: 438614 - RNA, 19 nt, Homo sapiens
uaacgagacuuccgucaug

SEQ ID NO: 438615 - RNA, 19 nt, Homo sapiens
gaacaagguguauuauuuc

SEQ ID NO: 438616 - RNA, 19 nt, Homo sapiens
gcucaugagugauggauug

SEQ ID NO: 438617 - RNA, 19 nt, Homo sapiens
gagaguaguuaucuugaug

SEQ ID NO: 438618 - RNA, 19 nt, Homo sapiens
gaagugcauugaugugaga

SEQ ID NO: 438619 - RNA, 19 nt, Homo sapiens
gaacaggcauuugaagaag

SEQ ID NO: 438620 - RNA, 19 nt, Homo sapiens
gagaugaccuucaauaacg

SEQ ID NO: 438621 - RNA, 19 nt, Homo sapiens
gaaguugccaagaggaaua

SEQ ID NO: 438622 - RNA, 19 nt, Homo sapiens
gaaaggcacccugaagauu

SEQ ID NO: 438623 - RNA, 19 nt, Homo sapiens
gggaauggguucuacuguu

SEQ ID NO: 438624 - RNA, 19 nt, Homo sapiens
caaguucuuuccucuuauu

SEQ ID NO: 438625 - RNA, 19 nt, Homo sapiens
ugacgaaaguggugaaauc

SEQ ID NO: 438626 - RNA, 19 nt, Homo sapiens
ucaaaggcauaucuucuau

SEQ ID NO: 438627 - RNA, 19 nt, Homo sapiens
caauaggguagaaugauua

SEQ ID NO: 438628 - RNA, 19 nt, Homo sapiens
ggcagaaguuugcaaauag

SEQ ID NO: 438629 - RNA, 19 nt, Homo sapiens
caacuuccgaucuuucaua

SEQ ID NO: 438630 - RNA, 19 nt, Homo sapiens
gaagcuauccuuggacaaa

SEQ ID NO: 438631 - RNA, 19 nt, Homo sapiens
gaaggagaguaguuaucuu

SEQ ID NO: 438632 - RNA, 19 nt, Homo sapiens
gaacaauuguccagcaacu

SEQ ID NO: 438633 - RNA, 19 nt, Homo sapiens
ugaacacucuauccucuuu

SEQ ID NO: 438634 - RNA, 19 nt, Homo sapiens
aagcaggaauuaugucgua

SEQ ID NO: 438635 - RNA, 19 nt, Homo sapiens
cgacaagccggacuacuuu

SEQ ID NO: 438636 - RNA, 19 nt, Homo sapiens
gcugauaaauuugaugguu

SEQ ID NO: 438637 - RNA, 19 nt, Homo sapiens
guaagugugucuuccuaga

SEQ ID NO: 438638 - RNA, 19 nt, Homo sapiens
gugugacgaucccauguua

SEQ ID NO: 438639 - RNA, 19 nt, Homo sapiens
caaaggagcccgagucucu

SEQ ID NO: 438640 - RNA, 19 nt, Homo sapiens
ugaggacgaccaucauuua

SEQ ID NO: 438641 - RNA, 19 nt, Homo sapiens
caggagaagugcauugaug

SEQ ID NO: 438642 - RNA, 19 nt, Homo sapiens
gcaugauccugucaguaaa

SEQ ID NO: 438643 - RNA, 19 nt, Homo sapiens
ggaguaacaccaacuggaa

SEQ ID NO: 438644 - RNA, 19 nt, Homo sapiens
gcaguucacagcuguuaaa

SEQ ID NO: 438645 - RNA, 19 nt, Homo sapiens
acucaggacugcaauaaga

SEQ ID NO: 438646 - RNA, 19 nt, Homo sapiens
ggagaguaguuaucuugau

SEQ ID NO: 438647 - RNA, 19 nt, Homo sapiens
acacauuccugcauucaug

SEQ ID NO: 438648 - RNA, 19 nt, Homo sapiens
gcaaguggacaaguucuuu

SEQ ID NO: 438649 - RNA, 19 nt, Homo sapiens
gaugguggacuaagcaauu

SEQ ID NO: 438650 - RNA, 19 nt, Homo sapiens
caaauaggcagaauggaau

SEQ ID NO: 438651 - RNA, 19 nt, Homo sapiens
caacauccgucccauuacu

SEQ ID NO: 438652 - RNA, 19 nt, Homo sapiens
gcaguuggagugaagauug

SEQ ID NO: 438653 - RNA, 19 nt, Homo sapiens
gaggaccgcugauaagcau

SEQ ID NO: 438654 - RNA, 19 nt, Homo sapiens
gaacccaucgguaggcaaa

SEQ ID NO: 438655 - RNA, 19 nt, Homo sapiens
gagcccgagucucugauuu

SEQ ID NO: 438656 - RNA, 19 nt, Homo sapiens
cagauucacagauuuauug

SEQ ID NO: 438657 - RNA, 19 nt, Homo sapiens
gcucacaacuuggguucuu

SEQ ID NO: 438658 - RNA, 19 nt, Homo sapiens
cuuccgaucuuucauauuc

SEQ ID NO: 438659 - RNA, 19 nt, Homo sapiens
ggacugcaauaagaaagug

SEQ ID NO: 438660 - RNA, 19 nt, Homo sapiens
ucgaaagacucacuuguag

SEQ ID NO: 438661 - RNA, 19 nt, Homo sapiens
guucuuuccucuuauugaa

SEQ ID NO: 438662 - RNA, 19 nt, Homo sapiens
acagugaggucuaacaaca

SEQ ID NO: 438663 - RNA, 19 nt, Homo sapiens
gcuaugaagacgccacuaa

SEQ ID NO: 438664 - RNA, 19 nt, Homo sapiens
gcagaaguuugcaaauagg

SEQ ID NO: 438665 - RNA, 19 nt, Homo sapiens
gagaaucagugggugacuu

SEQ ID NO: 438666 - RNA, 19 nt, Homo sapiens
gauccugucaguaaauauu

SEQ ID NO: 438667 - RNA, 19 nt, Homo sapiens
gaagaugcugauaaauuug

SEQ ID NO: 438668 - RNA, 19 nt, Homo sapiens
gaaagacucacuuguagac

SEQ ID NO: 438669 - RNA, 19 nt, Homo sapiens
uaccuacgguucaguuuga

SEQ ID NO: 438670 - RNA, 19 nt, Homo sapiens
gaauggcaauaggguagaa

SEQ ID NO: 438671 - RNA, 19 nt, Homo sapiens
uagaggugcuacauaguug

SEQ ID NO: 438672 - RNA, 19 nt, Homo sapiens
gaauuaaggccacugugau

SEQ ID NO: 438673 - RNA, 19 nt, Homo sapiens
cgaauuaaggccacuguga

SEQ ID NO: 438674 - RNA, 19 nt, Homo sapiens
gcgacaagccggacuacuu

SEQ ID NO: 438675 - RNA, 19 nt, Homo sapiens
gaaagacggaaggagagua

SEQ ID NO: 438676 - RNA, 19 nt, Homo sapiens
caaaggcauaucuucuaua

SEQ ID NO: 438677 - RNA, 19 nt, Homo sapiens
ggugcuacauaguugguaa

SEQ ID NO: 438678 - RNA, 19 nt, Homo sapiens
gagaagugcauugauguga

SEQ ID NO: 438679 - RNA, 19 nt, Homo sapiens
gaagaaguuuuccagaaug

SEQ ID NO: 438680 - RNA, 19 nt, Homo sapiens
ggaaggagaguaguuaucu

SEQ ID NO: 438681 - RNA, 19 nt, Homo sapiens
uaucaucaagcaggaauua

SEQ ID NO: 438682 - RNA, 19 nt, Homo sapiens
ucuauccucuuucauguug

SEQ ID NO: 438683 - RNA, 19 nt, Homo sapiens
gucgaaagacucacuugua

SEQ ID NO: 438684 - RNA, 19 nt, Homo sapiens
ggacgaccaucauuuaccu

SEQ ID NO: 438685 - RNA, 19 nt, Homo sapiens
gaagugaacaagguguauu

SEQ ID NO: 438686 - RNA, 19 nt, Homo sapiens
ccacugugauggacgugaa

SEQ ID NO: 438687 - RNA, 19 nt, Homo sapiens
ugaacaggcauuugaagaa

SEQ ID NO: 438688 - RNA, 19 nt, Homo sapiens
cgcaugauccugucaguaa

SEQ ID NO: 438689 - RNA, 19 nt, Homo sapiens
uugaugaccucgagaacaa

SEQ ID NO: 438690 - RNA, 19 nt, Homo sapiens
gacggaaggagaguaguua

SEQ ID NO: 438691 - RNA, 19 nt, Homo sapiens
cuacauaguugguaaugcu

SEQ ID NO: 438692 - RNA, 19 nt, Homo sapiens
cgacucaggacugcaauaa

SEQ ID NO: 438693 - RNA, 19 nt, Homo sapiens
agaggaauaucuacuugau

SEQ ID NO: 438694 - RNA, 19 nt, Homo sapiens
acagagaaguugccaagag

SEQ ID NO: 438695 - RNA, 19 nt, Homo sapiens
gacccuaacugcagaccau

SEQ ID NO: 438696 - RNA, 19 nt, Homo sapiens
ccaagaggaauaucuacuu

SEQ ID NO: 438697 - RNA, 19 nt, Homo sapiens
aaaggcacccugaagauug

SEQ ID NO: 438698 - RNA, 19 nt, Homo sapiens
uaugccagauucacagauu

SEQ ID NO: 438699 - RNA, 19 nt, Homo sapiens
cguguuggcuaucaaagga

SEQ ID NO: 438700 - RNA, 19 nt, Homo sapiens
ggaaguagguuucaucuau

SEQ ID NO: 438701 - RNA, 19 nt, Homo sapiens
caagauagauggaauugga

SEQ ID NO: 438702 - RNA, 19 nt, Homo sapiens
ggagaguacuuacauagug

SEQ ID NO: 438703 - RNA, 19 nt, Homo sapiens
uaucaaaugucuccucuga

SEQ ID NO: 438704 - RNA, 19 nt, Homo sapiens
gaauugcacuuuccugcuu

SEQ ID NO: 438705 - RNA, 19 nt, Homo sapiens
ggaccuaguuucacaaucu

SEQ ID NO: 438706 - RNA, 19 nt, Homo sapiens
gcagagcccuagccgagaa

SEQ ID NO: 438707 - RNA, 19 nt, Homo sapiens
ggcauuacuuucagaauug

SEQ ID NO: 438708 - RNA, 19 nt, Homo sapiens
gaaguagguuucaucuauc

SEQ ID NO: 438709 - RNA, 19 nt, Homo sapiens
gaucaaugcacacauggua

SEQ ID NO: 438710 - RNA, 19 nt, Homo sapiens
ucaggaguuucucuucuua

SEQ ID NO: 438711 - RNA, 19 nt, Homo sapiens
caaaauagaugacaugaca

SEQ ID NO: 438712 - RNA, 19 nt, Homo sapiens
ccaggagaguacuuacaua

SEQ ID NO: 438713 - RNA, 19 nt, Homo sapiens
gaaacuuacugcucuucug

SEQ ID NO: 438714 - RNA, 19 nt, Homo sapiens
cagaauaacuggaucuaac

SEQ ID NO: 438715 - RNA, 19 nt, Homo sapiens
ccacacauauucuggaagu

SEQ ID NO: 438716 - RNA, 19 nt, Homo sapiens
gggcacaucuauucuacug

SEQ ID NO: 438717 - RNA, 19 nt, Homo sapiens
ggagaaucgugaccaagau

SEQ ID NO: 438718 - RNA, 19 nt, Homo sapiens
ggagagcaccuaucagcaa

SEQ ID NO: 438719 - RNA, 19 nt, Homo sapiens
gcagggagagcaccuauca

SEQ ID NO: 438720 - RNA, 19 nt, Homo sapiens
caucagacaugcagagaag

SEQ ID NO: 438721 - RNA, 19 nt, Homo sapiens
uggcauuacuuucagaauu

SEQ ID NO: 438722 - RNA, 19 nt, Homo sapiens
ucaaaugucuccucugacu

SEQ ID NO: 438723 - RNA, 19 nt, Homo sapiens
gagagcaccuaucagcaau

SEQ ID NO: 438724 - RNA, 19 nt, Homo sapiens
guuacaacaucaagauaga

SEQ ID NO: 438725 - RNA, 19 nt, Homo sapiens
uuacugcucuucuguuuua

SEQ ID NO: 438726 - RNA, 19 nt, Homo sapiens
gaugacaccagcagugaaa

SEQ ID NO: 438727 - RNA, 19 nt, Homo sapiens
agagggagaugggcaauug

SEQ ID NO: 438728 - RNA, 19 nt, Homo sapiens
uaucagcaauccaggaaug

SEQ ID NO: 438729 - RNA, 19 nt, Homo sapiens
uaacuggguaccugagaua

SEQ ID NO: 438730 - RNA, 19 nt, Homo sapiens
ugaaacacaugucuguauc

SEQ ID NO: 438731 - RNA, 19 nt, Homo sapiens
gguuucaucuaucaaaugu

SEQ ID NO: 438732 - RNA, 19 nt, Homo sapiens
cuggguaccugagauauuu

SEQ ID NO: 438733 - RNA, 19 nt, Homo sapiens
aaaaccagguguugaauuu

SEQ ID NO: 438734 - RNA, 19 nt, Homo sapiens
ggugggauuucuugaggaa

SEQ ID NO: 438735 - RNA, 19 nt, Homo sapiens
auccacagaugcagaauaa

SEQ ID NO: 438736 - RNA, 19 nt, Homo sapiens
caagcaagcuguggauuuu

SEQ ID NO: 438737 - RNA, 19 nt, Homo sapiens
uggaggauaugaaugaguu

SEQ ID NO: 438738 - RNA, 19 nt, Homo sapiens
gccaguggguugacacaga

SEQ ID NO: 438739 - RNA, 19 nt, Homo sapiens
ugacguguguuucugugaa

SEQ ID NO: 438740 - RNA, 19 nt, Homo sapiens
gcacuuuccugcuugucau

SEQ ID NO: 438741 - RNA, 19 nt, Homo sapiens
gcaggaccagggcguuaua

SEQ ID NO: 438742 - RNA, 19 nt, Homo sapiens
gagcaggaccagggcguua

SEQ ID NO: 438743 - RNA, 19 nt, Homo sapiens
gcagaauaacuggaucuaa

SEQ ID NO: 438744 - RNA, 19 nt, Homo sapiens
ucaagcaagcuguggauuu

SEQ ID NO: 438745 - RNA, 19 nt, Homo sapiens
agaaacauaugugaaagug

SEQ ID NO: 438746 - RNA, 19 nt, Homo sapiens
guuuacugcugaaagauga

SEQ ID NO: 438747 - RNA, 19 nt, Homo sapiens
aaccagguguugaauuuga

SEQ ID NO: 438748 - RNA, 19 nt, Homo sapiens
gagugaagcagggaacuuu

SEQ ID NO: 438749 - RNA, 19 nt, Homo sapiens
gcacacaugguacuaagca

SEQ ID NO: 438750 - RNA, 19 nt, Homo sapiens
acauagugcucaggaguuu

SEQ ID NO: 438751 - RNA, 19 nt, Homo sapiens
ucaagaaccagcugaaaca

SEQ ID NO: 438752 - RNA, 19 nt, Homo sapiens
guggaacaguggauucgaa

SEQ ID NO: 438753 - RNA, 19 nt, Homo sapiens
gcucaggaguuucucuucu

SEQ ID NO: 438754 - RNA, 19 nt, Homo sapiens
guucagaauugggaauguu

SEQ ID NO: 438755 - RNA, 19 nt, Homo sapiens
aauguuuacugcugaaaga

SEQ ID NO: 438756 - RNA, 19 nt, Homo sapiens
ccugaaggguugaacuuuc

SEQ ID NO: 438757 - RNA, 19 nt, Homo sapiens
aggaguuucucuucuuaaa

SEQ ID NO: 438758 - RNA, 19 nt, Homo sapiens
ugaggaaguuacaaauaag

SEQ ID NO: 438759 - RNA, 19 nt, Homo sapiens
guagguuucaucuaucaaa

SEQ ID NO: 438760 - RNA, 19 nt, Homo sapiens
agaaccagcugaaacacau

SEQ ID NO: 438761 - RNA, 19 nt, Homo sapiens
uuucacaggucacuauugu

SEQ ID NO: 438762 - RNA, 19 nt, Homo sapiens
gaacaguggauucgaaagc

SEQ ID NO: 438763 - RNA, 19 nt, Homo sapiens
gcucuucuguuuuauuuug

SEQ ID NO: 438764 - RNA, 19 nt, Homo sapiens
gagcaccgauuggcugaag

SEQ ID NO: 438765 - RNA, 19 nt, Homo sapiens
gaacuuuggugggaauagc

SEQ ID NO: 438766 - RNA, 19 nt, Homo sapiens
caccacacauauucuggaa

SEQ ID NO: 438767 - RNA, 19 nt, Homo sapiens
ccagaaacauaugugaaag

SEQ ID NO: 438768 - RNA, 19 nt, Homo sapiens
gaauugggaauguugagau

SEQ ID NO: 438769 - RNA, 19 nt, Homo sapiens
uaaauccacagaugcagaa

SEQ ID NO: 438770 - RNA, 19 nt, Homo sapiens
cagagaaggcuccaaccaa

SEQ ID NO: 438771 - RNA, 19 nt, Homo sapiens
ccacagaugcagaauaacu

SEQ ID NO: 438772 - RNA, 19 nt, Homo sapiens
gaagugaucaaugcacaca

SEQ ID NO: 438773 - RNA, 19 nt, Homo sapiens
gaguucaccacacauauuc

SEQ ID NO: 438774 - RNA, 19 nt, Homo sapiens
ccaguggguugacacagau

SEQ ID NO: 438775 - RNA, 19 nt, Homo sapiens
gcuaccaggagaguacuua

SEQ ID NO: 438776 - RNA, 19 nt, Homo sapiens
ggaaguuacaaauaagcuu

SEQ ID NO: 438777 - RNA, 19 nt, Homo sapiens
gcaauugacagggaugcaa

SEQ ID NO: 438778 - RNA, 19 nt, Homo sapiens
ugaguucaccacacauauu

SEQ ID NO: 438779 - RNA, 19 nt, Homo sapiens
ccugguagccuuuaagauc

SEQ ID NO: 438780 - RNA, 19 nt, Homo sapiens
gcaaugaggggcacaucua

SEQ ID NO: 438781 - RNA, 19 nt, Homo sapiens
gaacuuucaggaucucaag

SEQ ID NO: 438782 - RNA, 19 nt, Homo sapiens
gaccugaaggguugaacuu

SEQ ID NO: 438783 - RNA, 19 nt, Homo sapiens
acaguggauucgaaagcua

SEQ ID NO: 438784 - RNA, 19 nt, Homo sapiens
cauugugcccuguacuaua

SEQ ID NO: 438785 - RNA, 19 nt, Homo sapiens
guacuaagcaaagccaaca

SEQ ID NO: 438786 - RNA, 19 nt, Homo sapiens
acacauauucuggaaguga

SEQ ID NO: 438787 - RNA, 19 nt, Homo sapiens
gcagagaaggcuccaacca

SEQ ID NO: 438788 - RNA, 19 nt, Homo sapiens
cuugaggaaguuacaaaua

SEQ ID NO: 438789 - RNA, 19 nt, Homo sapiens
acuuacugcucuucuguuu

SEQ ID NO: 438790 - RNA, 19 nt, Homo sapiens
auugugcccuguacuauau

SEQ ID NO: 438791 - RNA, 19 nt, Homo sapiens
gagaaucgugaccaagaug

SEQ ID NO: 438792 - RNA, 19 nt, Homo sapiens
gcaauccaggaaugaguga

SEQ ID NO: 438793 - RNA, 19 nt, Homo sapiens
cugguagccuuuaagauca

SEQ ID NO: 438794 - RNA, 19 nt, Homo sapiens
gaccuaguuucacaaucug

SEQ ID NO: 438795 - RNA, 19 nt, Homo sapiens
gaauaacuggaucuaacug

SEQ ID NO: 438796 - RNA, 19 nt, Homo sapiens
caucuauucuacuguggau

SEQ ID NO: 438797 - RNA, 19 nt, Homo sapiens
cagcaaauggccucacugu

SEQ ID NO: 438798 - RNA, 19 nt, Homo sapiens
cggagaaucgugaccaaga

SEQ ID NO: 438799 - RNA, 19 nt, Homo sapiens
acacaugguacuaagcaaa

SEQ ID NO: 438800 - RNA, 19 nt, Homo sapiens
gaagaaaucucuggaauug

SEQ ID NO: 438801 - RNA, 19 nt, Homo sapiens
gcucaagaauguucacuua

SEQ ID NO: 438802 - RNA, 19 nt, Homo sapiens
cgaggaagcuacucagaua

SEQ ID NO: 438803 - RNA, 19 nt, Homo sapiens
ggaagugguuggaagagua

SEQ ID NO: 438804 - RNA, 19 nt, Homo sapiens
caucuuauguccaguuuaa

SEQ ID NO: 438805 - RNA, 19 nt, Homo sapiens
ggaauacaauaguuucaga

SEQ ID NO: 438806 - RNA, 19 nt, Homo sapiens
agaaagugcucaagaaugu

SEQ ID NO: 438807 - RNA, 19 nt, Homo sapiens
ggacaacacacauuuacaa

SEQ ID NO: 438808 - RNA, 19 nt, Homo sapiens
caacacacauuuacaaucg

SEQ ID NO: 438809 - RNA, 19 nt, Homo sapiens
gcaacaugauugaucuuga

SEQ ID NO: 438810 - RNA, 19 nt, Homo sapiens
ugaagaaagugaucaagau

SEQ ID NO: 438811 - RNA, 19 nt, Homo sapiens
uagagaaagugcucaagaa

SEQ ID NO: 438812 - RNA, 19 nt, Homo sapiens
ugauugaucuugauggauu

SEQ ID NO: 438813 - RNA, 19 nt, Homo sapiens
caacaugauugaucuugau

SEQ ID NO: 438814 - RNA, 19 nt, Homo sapiens
agaaaucucuggaauugug

SEQ ID NO: 438815 - RNA, 19 nt, Homo sapiens
cagcagagcaccugggaua

SEQ ID NO: 438816 - RNA, 19 nt, Homo sapiens
ggagaaaguggagaaagua

SEQ ID NO: 438817 - RNA, 19 nt, Homo sapiens
ggaggacaacacacauuua

SEQ ID NO: 438818 - RNA, 19 nt, Homo sapiens
gaagauagccauccuuuug

SEQ ID NO: 438819 - RNA, 19 nt, Homo sapiens
gcaaaagccugaagaaagu

SEQ ID NO: 438820 - RNA, 19 nt, Homo sapiens
gagcaucccuaaccaagca

SEQ ID NO: 438821 - RNA, 19 nt, Homo sapiens
gaucuuggacuuuacaaug

SEQ ID NO: 438822 - RNA, 19 nt, Homo sapiens
acagcgcgauugcgauuua

SEQ ID NO: 438823 - RNA, 19 nt, Homo sapiens
gacacuaauuuaccacauu

SEQ ID NO: 438824 - RNA, 19 nt, Homo sapiens
ggaagcuacucagauaaga

SEQ ID NO: 438825 - RNA, 19 nt, Homo sapiens
uaaugaagacaccaugaua

SEQ ID NO: 438826 - RNA, 19 nt, Homo sapiens
caugcuagcucaauucauc

SEQ ID NO: 438827 - RNA, 19 nt, Homo sapiens
gcugauuggugccgagaaa

SEQ ID NO: 438828 - RNA, 19 nt, Homo sapiens
caaugaagcugugaaaauu

SEQ ID NO: 438829 - RNA, 19 nt, Homo sapiens
gcgcuagucuucgcugauu

SEQ ID NO: 438830 - RNA, 19 nt, Homo sapiens
ugacgcagcuaagggagua

SEQ ID NO: 438831 - RNA, 19 nt, Homo sapiens
gagaaagugcucaagaaug

SEQ ID NO: 438832 - RNA, 19 nt, Homo sapiens
gaagugguuggaagaguaa

SEQ ID NO: 438833 - RNA, 19 nt, Homo sapiens
gcacagggaauacaauagu

SEQ ID NO: 438834 - RNA, 19 nt, Homo sapiens
caagaauguucacuuacug

SEQ ID NO: 438835 - RNA, 19 nt, Homo sapiens
ccacguaucauuccgcaaa

SEQ ID NO: 438836 - RNA, 19 nt, Homo sapiens
gcaacaauguaaugaagac

SEQ ID NO: 438837 - RNA, 19 nt, Homo sapiens
ccacauucuucuuacuuau

SEQ ID NO: 438838 - RNA, 19 nt, Homo sapiens
ucaagaauguucacuuacu

SEQ ID NO: 438839 - RNA, 19 nt, Homo sapiens
ugaagaaaucucuggaauu

SEQ ID NO: 438840 - RNA, 19 nt, Homo sapiens
gaauguucacuuacugauu

SEQ ID NO: 438841 - RNA, 19 nt, Homo sapiens
gauugaucuugauggauuu

SEQ ID NO: 438842 - RNA, 19 nt, Homo sapiens
gaaaguggagaaaguagag

SEQ ID NO: 438843 - RNA, 19 nt, Homo sapiens
caugauugaucuugaugga

SEQ ID NO: 438844 - RNA, 19 nt, Homo sapiens
cgauugcgauuuagguuuc

SEQ ID NO: 438845 - RNA, 19 nt, Homo sapiens
acacuaauuuaccacauuc

SEQ ID NO: 438846 - RNA, 19 nt, Homo sapiens
gcagagcaccugggauaga

SEQ ID NO: 438847 - RNA, 19 nt, Homo sapiens
uacaauaguuucagaucug

SEQ ID NO: 438848 - RNA, 19 nt, Homo sapiens
caucuuguguacaucuuau

SEQ ID NO: 438849 - RNA, 19 nt, Homo sapiens
gaggaagcuacucagauaa

SEQ ID NO: 438850 - RNA, 19 nt, Homo sapiens
cgagaaaucugccccauag

SEQ ID NO: 438851 - RNA, 19 nt, Homo sapiens
gaaucuggagcaucccuaa

SEQ ID NO: 438852 - RNA, 19 nt, Homo sapiens
gaugaagaaaucucuggaa

SEQ ID NO: 438853 - RNA, 19 nt, Homo sapiens
uggagaaaguggagaaagu

SEQ ID NO: 438854 - RNA, 19 nt, Homo sapiens
uaaagaagauagccauccu

SEQ ID NO: 438855 - RNA, 19 nt, Homo sapiens
cagauaagaggcuccaaga

SEQ ID NO: 438856 - RNA, 19 nt, Homo sapiens
cacagggaauacaauaguu

SEQ ID NO: 438857 - RNA, 19 nt, Homo sapiens
gcauuuaauuggcgaagcu

SEQ ID NO: 438858 - RNA, 19 nt, Homo sapiens
aagaagauagccauccuuu

SEQ ID NO: 438859 - RNA, 19 nt, Homo sapiens
accacauucuucuuacuua

SEQ ID NO: 438860 - RNA, 19 nt, Homo sapiens
agacaaugcacagggaaua

SEQ ID NO: 438861 - RNA, 19 nt, Homo sapiens
guaaugaagacaccaugau

SEQ ID NO: 438862 - RNA, 19 nt, Homo sapiens
ccgcagucuuggaccauaa

SEQ ID NO: 438863 - RNA, 19 nt, Homo sapiens
aaaaggaugugaagacaau

SEQ ID NO: 438864 - RNA, 19 nt, Homo sapiens
gaggacaacacacauuuac

SEQ ID NO: 438865 - RNA, 19 nt, Homo sapiens
gacaacacacauuuacaau

SEQ ID NO: 438866 - RNA, 19 nt, Homo sapiens
gcgauugcgauuuagguuu

SEQ ID NO: 438867 - RNA, 19 nt, Homo sapiens
gaaggaggacaacacacau

SEQ ID NO: 438868 - RNA, 19 nt, Homo sapiens
ggauugugcaacaugauug

SEQ ID NO: 438869 - RNA, 19 nt, Homo sapiens
gggauugugcaacaugauu

SEQ ID NO: 438870 - RNA, 19 nt, Homo sapiens
gccaccaucuuguguacau

SEQ ID NO: 438871 - RNA, 19 nt, Homo sapiens
gguuuccgcgcauuuaauu

SEQ ID NO: 438872 - RNA, 19 nt, Homo sapiens
gaagaauggggaaacagua

SEQ ID NO: 438873 - RNA, 19 nt, Homo sapiens
gagaaaguggagaaaguag

SEQ ID NO: 438874 - RNA, 19 nt, Homo sapiens
gaaagugcucaagaauguu

SEQ ID NO: 438875 - RNA, 19 nt, Homo sapiens
ggauagagaaagugcucaa

SEQ ID NO: 438876 - RNA, 19 nt, Homo sapiens
uuacaaugaagcugugaaa

SEQ ID NO: 438877 - RNA, 19 nt, Homo sapiens
acaaugagaaggaggacaa

SEQ ID NO: 438878 - RNA, 19 nt, Homo sapiens
augaagaaaucucuggaau

SEQ ID NO: 438879 - RNA, 19 nt, Homo sapiens
agacagcgcgauugcgauu

SEQ ID NO: 438880 - RNA, 19 nt, Homo sapiens
cccuguaucugucaacuuc

SEQ ID NO: 438881 - RNA, 19 nt, Homo sapiens
cugcaacaauguaaugaag

SEQ ID NO: 438882 - RNA, 19 nt, Homo sapiens
caagagggaaggcgagaca

SEQ ID NO: 438883 - RNA, 19 nt, Homo sapiens
cgacacuaauuuaccacau

SEQ ID NO: 438884 - RNA, 19 nt, Homo sapiens
caccugggauagagaaagu

SEQ ID NO: 438885 - RNA, 19 nt, Homo sapiens
uagggauugugcaacauga

SEQ ID NO: 438886 - RNA, 19 nt, Homo sapiens
cacauuuacaaucgucuua

SEQ ID NO: 438887 - RNA, 19 nt, Homo sapiens
acagggaauacaauaguuu

SEQ ID NO: 438888 - RNA, 19 nt, Homo sapiens
uagcucaauucaucgacaa

SEQ ID NO: 438889 - RNA, 19 nt, Homo sapiens
ucacuaagcagccaaucuc

SEQ ID NO: 438890 - RNA, 19 nt, Homo sapiens
gagcaccugggauagagaa

SEQ ID NO: 438891 - RNA, 19 nt, Homo sapiens
gauacuauucuuccaaggu

SEQ ID NO: 438892 - RNA, 19 nt, Homo sapiens
gauugugcaacaugauuga

SEQ ID NO: 438893 - RNA, 19 nt, Homo sapiens
aaugaagacaccaugauau

SEQ ID NO: 438894 - RNA, 19 nt, Homo sapiens
guucacuuacugauuacua

SEQ ID NO: 438895 - RNA, 19 nt, Homo sapiens
agagaaagugcucaagaau

SEQ ID NO: 438896 - RNA, 19 nt, Homo sapiens
ugaagacaccaugauauca

SEQ ID NO: 438897 - RNA, 19 nt, Homo sapiens
ggaaaaugaggcugaaaug

SEQ ID NO: 438898 - RNA, 19 nt, Homo sapiens
gccgcagucuuggaccaua

SEQ ID NO: 438899 - RNA, 19 nt, Homo sapiens
agaaagguagucucagguu

SEQ ID NO: 438900 - RNA, 19 nt, Homo sapiens
cauauuagcuacacuacaa

SEQ ID NO: 438901 - RNA, 19 nt, Homo sapiens
gauauggccuugguuauga

SEQ ID NO: 438902 - RNA, 19 nt, Homo sapiens
ggacccaguucccaucuuu

SEQ ID NO: 438903 - RNA, 19 nt, Homo sapiens
uaaauacucuugcuguguu

SEQ ID NO: 438904 - RNA, 19 nt, Homo sapiens
ggcaggagcuaacaugauu

SEQ ID NO: 438905 - RNA, 19 nt, Homo sapiens
gauacagagucaauccaua

SEQ ID NO: 438906 - RNA, 19 nt, Homo sapiens
agaauaugcucaacacaaa

SEQ ID NO: 438907 - RNA, 19 nt, Homo sapiens
guacuagucccagaauuua

SEQ ID NO: 438908 - RNA, 19 nt, Homo sapiens
gaauuaagagcuaacacua

SEQ ID NO: 438909 - RNA, 19 nt, Homo sapiens
guaaaucaccucuauaagu

SEQ ID NO: 438910 - RNA, 19 nt, Homo sapiens
gcgaaaagaugacaggaua

SEQ ID NO: 438911 - RNA, 19 nt, Homo sapiens
gagcuaacacuauauaugu

SEQ ID NO: 438912 - RNA, 19 nt, Homo sapiens
ggucagaaauuggugugua

SEQ ID NO: 438913 - RNA, 19 nt, Homo sapiens
ucuaagaggucagaaauug

SEQ ID NO: 438914 - RNA, 19 nt, Homo sapiens
uaagaaauguuugcucaga

SEQ ID NO: 438915 - RNA, 19 nt, Homo sapiens
agaaugggaugaagucuug

SEQ ID NO: 438916 - RNA, 19 nt, Homo sapiens
acagcgaccuggccaauuu

SEQ ID NO: 438917 - RNA, 19 nt, Homo sapiens
aaggaagucuuuaugguuu

SEQ ID NO: 438918 - RNA, 19 nt, Homo sapiens
uaacaaaucacccaaucuu

SEQ ID NO: 438919 - RNA, 19 nt, Homo sapiens
uggaagauaugaugccaaa

SEQ ID NO: 438920 - RNA, 19 nt, Homo sapiens
ugucuuauuuccagucuaa

SEQ ID NO: 438921 - RNA, 19 nt, Homo sapiens
gagguaauauuggguugaa

SEQ ID NO: 438922 - RNA, 19 nt, Homo sapiens
gaauauugacuaccaaauc

SEQ ID NO: 438923 - RNA, 19 nt, Homo sapiens
gggcuaaucagauagauau

SEQ ID NO: 438924 - RNA, 19 nt, Homo sapiens
cucagaagcugcucagaaa

SEQ ID NO: 438925 - RNA, 19 nt, Homo sapiens
gaagauaugaugccaaagg

SEQ ID NO: 438926 - RNA, 19 nt, Homo sapiens
agaggucgaugguggagua

SEQ ID NO: 438927 - RNA, 19 nt, Homo sapiens
aaacugauugugcagaaua

SEQ ID NO: 438928 - RNA, 19 nt, Homo sapiens
guucccaucuuuggauaua

SEQ ID NO: 438929 - RNA, 19 nt, Homo sapiens
gaaauucauggaagauaug

SEQ ID NO: 438930 - RNA, 19 nt, Homo sapiens
gguaauauuggguugaauu

SEQ ID NO: 438931 - RNA, 19 nt, Homo sapiens
cuugaucggugaaaccaua

SEQ ID NO: 438932 - RNA, 19 nt, Homo sapiens
gcucagaagcugcucagaa

SEQ ID NO: 438933 - RNA, 19 nt, Homo sapiens
uguaaaguuuccaguacua

SEQ ID NO: 438934 - RNA, 19 nt, Homo sapiens
cuuucuagcuggaccuuua

SEQ ID NO: 438935 - RNA, 19 nt, Homo sapiens
uuaaagacauucgggagaa

SEQ ID NO: 438936 - RNA, 19 nt, Homo sapiens
gagucaauccauaaacuaa

SEQ ID NO: 438937 - RNA, 19 nt, Homo sapiens
gcauuaggguuacaaacag

SEQ ID NO: 438938 - RNA, 19 nt, Homo sapiens
gaaauugguguguauaacu

SEQ ID NO: 438939 - RNA, 19 nt, Homo sapiens
guuauucauuccagugauu

SEQ ID NO: 438940 - RNA, 19 nt, Homo sapiens
aaacaggaauauugacuac

SEQ ID NO: 438941 - RNA, 19 nt, Homo sapiens
ugccaaagguucacugguu

SEQ ID NO: 438942 - RNA, 19 nt, Homo sapiens
ggcagaaauucauggaaga

SEQ ID NO: 438943 - RNA, 19 nt, Homo sapiens
cuacuucauuccuguaaau

SEQ ID NO: 438944 - RNA, 19 nt, Homo sapiens
ccagauggcugagaaaauu

SEQ ID NO: 438945 - RNA, 19 nt, Homo sapiens
ggagcuaacaugauugugu

SEQ ID NO: 438946 - RNA, 19 nt, Homo sapiens
ugucaaagcagguuauuca

SEQ ID NO: 438947 - RNA, 19 nt, Homo sapiens
accaugggcuaaucagaua

SEQ ID NO: 438948 - RNA, 19 nt, Homo sapiens
auacagagucaauccauaa

SEQ ID NO: 438949 - RNA, 19 nt, Homo sapiens
uagcuggaccuuuaacaaa

SEQ ID NO: 438950 - RNA, 19 nt, Homo sapiens
cagaaauugguguguauaa

SEQ ID NO: 438951 - RNA, 19 nt, Homo sapiens
aaauacucuugcuguguua

SEQ ID NO: 438952 - RNA, 19 nt, Homo sapiens
gcgucgggcugcaagauug

SEQ ID NO: 438953 - RNA, 19 nt, Homo sapiens
agaaccagauggcugagaa

SEQ ID NO: 438954 - RNA, 19 nt, Homo sapiens
ccuuauacuugauguguga

SEQ ID NO: 438955 - RNA, 19 nt, Homo sapiens
ucugggaagugguagaauu

SEQ ID NO: 438956 - RNA, 19 nt, Homo sapiens
gucagaaauugguguguau

SEQ ID NO: 438957 - RNA, 19 nt, Homo sapiens
aaagaugacaggauacaga

SEQ ID NO: 438958 - RNA, 19 nt, Homo sapiens
ggagguggguuagguaaaa

SEQ ID NO: 438959 - RNA, 19 nt, Homo sapiens
uagaauaugcucaacacaa

SEQ ID NO: 438960 - RNA, 19 nt, Homo sapiens
ccauauucuugguucuuaa

SEQ ID NO: 438961 - RNA, 19 nt, Homo sapiens
gggcauauuagcuacacua

SEQ ID NO: 438962 - RNA, 19 nt, Homo sapiens
gaaccagauggcugagaaa

SEQ ID NO: 438963 - RNA, 19 nt, Homo sapiens
gucccagaauuuagaauau

SEQ ID NO: 438964 - RNA, 19 nt, Homo sapiens
uauguaaaguuuccaguac

SEQ ID NO: 438965 - RNA, 19 nt, Homo sapiens
guguuucucuaaagucauu

SEQ ID NO: 438966 - RNA, 19 nt, Homo sapiens
guuaaauaaugcuguugug

SEQ ID NO: 438967 - RNA, 19 nt, Homo sapiens
guaaauacucuugcugugu

SEQ ID NO: 438968 - RNA, 19 nt, Homo sapiens
cagagucaauccauaaacu

SEQ ID NO: 438969 - RNA, 19 nt, Homo sapiens
gaauuucuggucuguacuu

SEQ ID NO: 438970 - RNA, 19 nt, Homo sapiens
cuguaaaucaccucuauaa

SEQ ID NO: 438971 - RNA, 19 nt, Homo sapiens
cacaaaguaaacagcauua

SEQ ID NO: 438972 - RNA, 19 nt, Homo sapiens
gcucugaguagaaaggaaa

SEQ ID NO: 438973 - RNA, 19 nt, Homo sapiens
gcuguuguguuagcucuga

SEQ ID NO: 438974 - RNA, 19 nt, Homo sapiens
uagcaggagccaaucagua

SEQ ID NO: 438975 - RNA, 19 nt, Homo sapiens
aagaaauguuugcucagaa

SEQ ID NO: 438976 - RNA, 19 nt, Homo sapiens
auagauauggccuugguua

SEQ ID NO: 438977 - RNA, 19 nt, Homo sapiens
gagaaugggaugaagucuu

SEQ ID NO: 438978 - RNA, 19 nt, Homo sapiens
gcuggaccuuuaacaaauc

SEQ ID NO: 438979 - RNA, 19 nt, Homo sapiens
acagaaaagugucuuaaug

SEQ ID NO: 438980 - RNA, 19 nt, Homo sapiens
agaaauguuugcucagaag

SEQ ID NO: 438981 - RNA, 19 nt, Homo sapiens
gcacagucagggcccauug

SEQ ID NO: 438982 - RNA, 19 nt, Homo sapiens
gcuacuucauuccuguaaa

SEQ ID NO: 438983 - RNA, 19 nt, Homo sapiens
aauauuggguugaauucug

SEQ ID NO: 438984 - RNA, 19 nt, Homo sapiens
aaagcagguuauucaguga

SEQ ID NO: 438985 - RNA, 19 nt, Homo sapiens
gagccaaucaguacaccuu

SEQ ID NO: 438986 - RNA, 19 nt, Homo sapiens
gucuaaggagggcauauua

SEQ ID NO: 438987 - RNA, 19 nt, Homo sapiens
gaguagguccugacacugu

SEQ ID NO: 438988 - RNA, 19 nt, Homo sapiens
cagaaauucauggaagaua

SEQ ID NO: 438989 - RNA, 19 nt, Homo sapiens
ugugucagcuacuucauuc

SEQ ID NO: 438990 - RNA, 19 nt, Homo sapiens
guugagaauuaagagcuaa

SEQ ID NO: 438991 - RNA, 19 nt, Homo sapiens
guaauauuggguugaauuc

SEQ ID NO: 438992 - RNA, 19 nt, Homo sapiens
uguguuagcucugaguaga

SEQ ID NO: 438993 - RNA, 19 nt, Homo sapiens
ggaauauugacuaccaaau

SEQ ID NO: 438994 - RNA, 19 nt, Homo sapiens
acaggaauauugacuacca

SEQ ID NO: 438995 - RNA, 19 nt, Homo sapiens
ccaguguuccuguucauga

SEQ ID NO: 438996 - RNA, 19 nt, Homo sapiens
ggauauagaggucgauggu

SEQ ID NO: 438997 - RNA, 19 nt, Homo sapiens
aaauaugugucagcuacuu

SEQ ID NO: 438998 - RNA, 19 nt, Homo sapiens
gaucugggaagugguagaa

SEQ ID NO: 438999 - RNA, 19 nt, Homo sapiens
guucaugaaaucucccuuu

SEQ ID NO: 439000 - RNA, 19 nt, Homo sapiens
ggaagaagaugauggugua

SEQ ID NO: 439001 - RNA, 19 nt, Homo sapiens
ggaaaugaauguggacuua

SEQ ID NO: 439002 - RNA, 19 nt, Homo sapiens
gcaagcaauuccuuuauuu

SEQ ID NO: 439003 - RNA, 19 nt, Homo sapiens
uaacaucccugucaccuuu

SEQ ID NO: 439004 - RNA, 19 nt, Homo sapiens
ggagauauguacuuccuuu

SEQ ID NO: 439005 - RNA, 19 nt, Homo sapiens
gcacagagaccaacuuuau

SEQ ID NO: 439006 - RNA, 19 nt, Homo sapiens
ccagaucccugcaagaaua

SEQ ID NO: 439007 - RNA, 19 nt, Homo sapiens
guaccuaucugcuccaauu

SEQ ID NO: 439008 - RNA, 19 nt, Homo sapiens
ggcaagagccugauucaua

SEQ ID NO: 439009 - RNA, 19 nt, Homo sapiens
gcucacagcucauguaaca

SEQ ID NO: 439010 - RNA, 19 nt, Homo sapiens
caucuuacguucauaguuu

SEQ ID NO: 439011 - RNA, 19 nt, Homo sapiens
gcaaguacauauaguagug

SEQ ID NO: 439012 - RNA, 19 nt, Homo sapiens
gggcugaaguggagauuaa

SEQ ID NO: 439013 - RNA, 19 nt, Homo sapiens
ccaacuacauggauuguuu

SEQ ID NO: 439014 - RNA, 19 nt, Homo sapiens
cguaacugcucaaagauua

SEQ ID NO: 439015 - RNA, 19 nt, Homo sapiens
ccucuacacuugauuuaua

SEQ ID NO: 439016 - RNA, 19 nt, Homo sapiens
gaaaggauuugaguuuguu

SEQ ID NO: 439017 - RNA, 19 nt, Homo sapiens
gcaaucaaauucuguucaa

SEQ ID NO: 439018 - RNA, 19 nt, Homo sapiens
guacuuccuuugaauauug

SEQ ID NO: 439019 - RNA, 19 nt, Homo sapiens
gcaagagccugauucauac

SEQ ID NO: 439020 - RNA, 19 nt, Homo sapiens
ggacuuggcuugaaucacu

SEQ ID NO: 439021 - RNA, 19 nt, Homo sapiens
ggaaaggauuugaguuugu

SEQ ID NO: 439022 - RNA, 19 nt, Homo sapiens
gagaccaacuuuauuacaa

SEQ ID NO: 439023 - RNA, 19 nt, Homo sapiens
gcaaucaaauaggaaauga

SEQ ID NO: 439024 - RNA, 19 nt, Homo sapiens
gauggaaccguuuacaaua

SEQ ID NO: 439025 - RNA, 19 nt, Homo sapiens
gauauguacuuccuuugaa

SEQ ID NO: 439026 - RNA, 19 nt, Homo sapiens
gggauaauguugcaggauu

SEQ ID NO: 439027 - RNA, 19 nt, Homo sapiens
auacguaacugcucaaaga

SEQ ID NO: 439028 - RNA, 19 nt, Homo sapiens
acagagaccaacuuuauua

SEQ ID NO: 439029 - RNA, 19 nt, Homo sapiens
gaaaaugucuauccagguu

SEQ ID NO: 439030 - RNA, 19 nt, Homo sapiens
caacaccuaugaagacaau

SEQ ID NO: 439031 - RNA, 19 nt, Homo sapiens
gcaggauuauacuuuauug

SEQ ID NO: 439032 - RNA, 19 nt, Homo sapiens
gaauguggacuuacuaaau

SEQ ID NO: 439033 - RNA, 19 nt, Homo sapiens
ugggaaaccuuacacauau

SEQ ID NO: 439034 - RNA, 19 nt, Homo sapiens
caaggaagauccaauaagc

SEQ ID NO: 439035 - RNA, 19 nt, Homo sapiens
gcaacuaugucucugucaa

SEQ ID NO: 439036 - RNA, 19 nt, Homo sapiens
ccagaaguauugugggaaa

SEQ ID NO: 439037 - RNA, 19 nt, Homo sapiens
guugcaggauuauacuuua

SEQ ID NO: 439038 - RNA, 19 nt, Homo sapiens
ggaaguaucaugcaauaag

SEQ ID NO: 439039 - RNA, 19 nt, Homo sapiens
aaggaaguaucaugcaaua

SEQ ID NO: 439040 - RNA, 19 nt, Homo sapiens
ccuaucugcuccaauuaua

SEQ ID NO: 439041 - RNA, 19 nt, Homo sapiens
gaaguuaggagauauguac

SEQ ID NO: 439042 - RNA, 19 nt, Homo sapiens
aaucauacuuccucuguga

SEQ ID NO: 439043 - RNA, 19 nt, Homo sapiens
gcacugaguugagcaagca

SEQ ID NO: 439044 - RNA, 19 nt, Homo sapiens
cuucaggucugcaaucaaa

SEQ ID NO: 439045 - RNA, 19 nt, Homo sapiens
gagauuaacaucccuguca

SEQ ID NO: 439046 - RNA, 19 nt, Homo sapiens
gugggaaaccuuacacaua

SEQ ID NO: 439047 - RNA, 19 nt, Homo sapiens
ucaaaucaauuaccagaag

SEQ ID NO: 439048 - RNA, 19 nt, Homo sapiens
gaaguaucaugcaauaagg

SEQ ID NO: 439049 - RNA, 19 nt, Homo sapiens
caucagaacccaucuuugu

SEQ ID NO: 439050 - RNA, 19 nt, Homo sapiens
agagaucguuguacaauuc

SEQ ID NO: 439051 - RNA, 19 nt, Homo sapiens
agacaaggaagauccaaua

SEQ ID NO: 439052 - RNA, 19 nt, Homo sapiens
gaagacaauggguuucuga

SEQ ID NO: 439053 - RNA, 19 nt, Homo sapiens
ggagccaacuacauggauu

SEQ ID NO: 439054 - RNA, 19 nt, Homo sapiens
ucaaguuccuuucuucaug

SEQ ID NO: 439055 - RNA, 19 nt, Homo sapiens
ccagagaccuuggagacaa

SEQ ID NO: 439056 - RNA, 19 nt, Homo sapiens
gaacugggaagaggugaaa

SEQ ID NO: 439057 - RNA, 19 nt, Homo sapiens
uuaagcagguugaucuuug

SEQ ID NO: 439058 - RNA, 19 nt, Homo sapiens
gccaaggacuuaagugaag

SEQ ID NO: 439059 - RNA, 19 nt, Homo sapiens
agaagaugaugguguaguu

SEQ ID NO: 439060 - RNA, 19 nt, Homo sapiens
ugacacaggcaagaauuua

SEQ ID NO: 439061 - RNA, 19 nt, Homo sapiens
ccaauaagcaagucagaga

SEQ ID NO: 439062 - RNA, 19 nt, Homo sapiens
ccaggacucuuugaaguug

SEQ ID NO: 439063 - RNA, 19 nt, Homo sapiens
aauguggacuuacuaaaug

SEQ ID NO: 439064 - RNA, 19 nt, Homo sapiens
ucagaacccaucuuuguuu

SEQ ID NO: 439065 - RNA, 19 nt, Homo sapiens
ggaaccguuuacaauauug

SEQ ID NO: 439066 - RNA, 19 nt, Homo sapiens
gcacaauuuugcaauguuu

SEQ ID NO: 439067 - RNA, 19 nt, Homo sapiens
gaagguucauccgcacuga

SEQ ID NO: 439068 - RNA, 19 nt, Homo sapiens
ucaaggaaguaucaugcaa

SEQ ID NO: 439069 - RNA, 19 nt, Homo sapiens
gagcaagcaauuccuuuau

SEQ ID NO: 439070 - RNA, 19 nt, Homo sapiens
ggccaggacucuuugaagu

SEQ ID NO: 439071 - RNA, 19 nt, Homo sapiens
cagggacuaucaucuaaga

SEQ ID NO: 439072 - RNA, 19 nt, Homo sapiens
gaacccaucuuuguuucuc

SEQ ID NO: 439073 - RNA, 19 nt, Homo sapiens
gaacuucuccuuucaaccu

SEQ ID NO: 439074 - RNA, 19 nt, Homo sapiens
gacaaggaagauccaauaa

SEQ ID NO: 439075 - RNA, 19 nt, Homo sapiens
ggacuuacuaaauggcuuu

SEQ ID NO: 439076 - RNA, 19 nt, Homo sapiens
ugagacaggccauaacuga

SEQ ID NO: 439077 - RNA, 19 nt, Homo sapiens
gaagauccaauaagcaagu

SEQ ID NO: 439078 - RNA, 19 nt, Homo sapiens
ggcaagcccuccugcacaa

SEQ ID NO: 439079 - RNA, 19 nt, Homo sapiens
ugagcaagcaauuccuuua

SEQ ID NO: 439080 - RNA, 19 nt, Homo sapiens
gcuuaucuccugauucuga

SEQ ID NO: 439081 - RNA, 19 nt, Homo sapiens
ucacccagaugccuuggaa

SEQ ID NO: 439082 - RNA, 19 nt, Homo sapiens
ucuguaagcugaaugucaa

SEQ ID NO: 439083 - RNA, 19 nt, Homo sapiens
gaucucugcugcuggaaag

SEQ ID NO: 439084 - RNA, 19 nt, Homo sapiens
cagagaucguuguacaauu

SEQ ID NO: 439085 - RNA, 19 nt, Homo sapiens
uaaagaaggacaugucaca

SEQ ID NO: 439086 - RNA, 19 nt, Homo sapiens
ggucugacucccaacuaua

SEQ ID NO: 439087 - RNA, 19 nt, Homo sapiens
agacaggccauaacugaaa

SEQ ID NO: 439088 - RNA, 19 nt, Homo sapiens
gggaaaccuuacacauaug

SEQ ID NO: 439089 - RNA, 19 nt, Homo sapiens
caaaucaauuaccagaagu

SEQ ID NO: 439090 - RNA, 19 nt, Homo sapiens
auguuaaccuuuccguuua

SEQ ID NO: 439091 - RNA, 19 nt, Homo sapiens
aauguuaaccuuuccguuu

SEQ ID NO: 439092 - RNA, 19 nt, Homo sapiens
guuaggagauauguacuuc

SEQ ID NO: 439093 - RNA, 19 nt, Homo sapiens
uggaaccguuuacaauauu

SEQ ID NO: 439094 - RNA, 19 nt, Homo sapiens
ggucugcaaucaaauucug

SEQ ID NO: 439095 - RNA, 19 nt, Homo sapiens
guauggacuuggcuugaau

SEQ ID NO: 439096 - RNA, 19 nt, Homo sapiens
aaccugaaguuaggagaua

SEQ ID NO: 439097 - RNA, 19 nt, Homo sapiens
caagccaucuuacguucau

SEQ ID NO: 439098 - RNA, 19 nt, Homo sapiens
caauuaagcagguugaucu

SEQ ID NO: 439099 - RNA, 19 nt, Homo sapiens
gaagauuacuacgcuugca

SEQ ID NO: 439100 - RNA, 19 nt, Homo sapiens
gcacugagaucaacaagaa

SEQ ID NO: 439101 - RNA, 19 nt, Homo sapiens
gcaagaggcguuucuauaa

SEQ ID NO: 439102 - RNA, 19 nt, Homo sapiens
gauccaaggugaacaagaa

SEQ ID NO: 439103 - RNA, 19 nt, Homo sapiens
gaagaaggcccaccugaug

SEQ ID NO: 439104 - RNA, 19 nt, Homo sapiens
gcaagaagcagcuggagaa

SEQ ID NO: 439105 - RNA, 19 nt, Homo sapiens
gaagaaagaccgaauugca

SEQ ID NO: 439106 - RNA, 19 nt, Homo sapiens
gaagauugaccuuaaguuc

SEQ ID NO: 439107 - RNA, 19 nt, Homo sapiens
uggagaagauugaccuuaa

SEQ ID NO: 439108 - RNA, 19 nt, Homo sapiens
gcaagcugaucaagaacaa

SEQ ID NO: 439109 - RNA, 19 nt, Homo sapiens
agaagcagcuggagaagga

SEQ ID NO: 439110 - RNA, 19 nt, Homo sapiens
ggccagggcuaccuuauca

SEQ ID NO: 439111 - RNA, 19 nt, Homo sapiens
gaccuuaaguucauugaca

SEQ ID NO: 439112 - RNA, 19 nt, Homo sapiens
uggcauaaaucuaagaaga

SEQ ID NO: 439113 - RNA, 19 nt, Homo sapiens
gcauaaaucuaagaagaag

SEQ ID NO: 439114 - RNA, 19 nt, Homo sapiens
gagaucaacaagaagauuu

SEQ ID NO: 439115 - RNA, 19 nt, Homo sapiens
caagaggcguuucuauaag

SEQ ID NO: 439116 - RNA, 19 nt, Homo sapiens
ucacagccuuccugggaua

SEQ ID NO: 439117 - RNA, 19 nt, Homo sapiens
ggagaagauugaccuuaag

SEQ ID NO: 439118 - RNA, 19 nt, Homo sapiens
agaaggccuuuaccaagua

SEQ ID NO: 439119 - RNA, 19 nt, Homo sapiens
gaagaaguacugccaaguc

SEQ ID NO: 439120 - RNA, 19 nt, Homo sapiens
gcaagaaauggcaggauga

SEQ ID NO: 439121 - RNA, 19 nt, Homo sapiens
ggaagaaggagcuuaaugc

SEQ ID NO: 439122 - RNA, 19 nt, Homo sapiens
ugacaccaccuccaaguuu

SEQ ID NO: 439123 - RNA, 19 nt, Homo sapiens
ucagcagcaugaagaagua

SEQ ID NO: 439124 - RNA, 19 nt, Homo sapiens
gacaccaccuccaaguuug

SEQ ID NO: 439125 - RNA, 19 nt, Homo sapiens
ggaugaggauggcaagaag

SEQ ID NO: 439126 - RNA, 19 nt, Homo sapiens
aaaggaagaaggagcuuaa

SEQ ID NO: 439127 - RNA, 19 nt, Homo sapiens
gggauuugauggcgugaug

SEQ ID NO: 439128 - RNA, 19 nt, Homo sapiens
ggagaagaaagcauucaug

SEQ ID NO: 439129 - RNA, 19 nt, Homo sapiens
aagaggcguuucuauaaga

SEQ ID NO: 439130 - RNA, 19 nt, Homo sapiens
gaaguacugccaagucauc

SEQ ID NO: 439131 - RNA, 19 nt, Homo sapiens
aagaaggccuuuaccaagu

SEQ ID NO: 439132 - RNA, 19 nt, Homo sapiens
gguggaggcugugaccauu

SEQ ID NO: 439133 - RNA, 19 nt, Homo sapiens
acggcaagcugaucaagaa

SEQ ID NO: 439134 - RNA, 19 nt, Homo sapiens
caaaggaagaaggagcuua

SEQ ID NO: 439135 - RNA, 19 nt, Homo sapiens
gugggaaggugaagagcuu

SEQ ID NO: 439136 - RNA, 19 nt, Homo sapiens
gaauuggcauaaaucuaag

SEQ ID NO: 439137 - RNA, 19 nt, Homo sapiens
agaaagaccgaauugcaaa

SEQ ID NO: 439138 - RNA, 19 nt, Homo sapiens
aagaaguacugccaaguca

SEQ ID NO: 439139 - RNA, 19 nt, Homo sapiens
gaaauggcaggaugaggau

SEQ ID NO: 439140 - RNA, 19 nt, Homo sapiens
ugcaagaggcguuucuaua

SEQ ID NO: 439141 - RNA, 19 nt, Homo sapiens
caagucauccgugucauug

SEQ ID NO: 439142 - RNA, 19 nt, Homo sapiens
auacaaggcuggcaugacu

SEQ ID NO: 439143 - RNA, 19 nt, Homo sapiens
ggcauaaaucuaagaagaa

SEQ ID NO: 439144 - RNA, 19 nt, Homo sapiens
agaagaaggccuuuaccaa

SEQ ID NO: 439145 - RNA, 19 nt, Homo sapiens
ccaaguacugcaagaaaug

SEQ ID NO: 439146 - RNA, 19 nt, Homo sapiens
agaccgaauugcaaaggaa

SEQ ID NO: 439147 - RNA, 19 nt, Homo sapiens
agauugaccuuaaguucau

SEQ ID NO: 439148 - RNA, 19 nt, Homo sapiens
gcagaaaggcuaccaucac

SEQ ID NO: 439149 - RNA, 19 nt, Homo sapiens
acuaugaccuaucugacaa

SEQ ID NO: 439150 - RNA, 19 nt, Homo sapiens
gagaagauugaccuuaagu

SEQ ID NO: 439151 - RNA, 19 nt, Homo sapiens
caagggcaaaggcuacaaa

SEQ ID NO: 439152 - RNA, 19 nt, Homo sapiens
gaggcacuguggccgagaa

SEQ ID NO: 439153 - RNA, 19 nt, Homo sapiens
gaaagaccgaauugcaaag

SEQ ID NO: 439154 - RNA, 19 nt, Homo sapiens
gaccauggaggagaagaaa

SEQ ID NO: 439155 - RNA, 19 nt, Homo sapiens
ccaagucauccgugucauu

SEQ ID NO: 439156 - RNA, 19 nt, Homo sapiens
aagaaagaccgaauugcaa

SEQ ID NO: 439157 - RNA, 19 nt, Homo sapiens
agaacaaugccuccacuga

SEQ ID NO: 439158 - RNA, 19 nt, Homo sapiens
gaaggccuuuaccaaguac

SEQ ID NO: 439159 - RNA, 19 nt, Homo sapiens
uaccaaguacugcaagaaa

SEQ ID NO: 439160 - RNA, 19 nt, Homo sapiens
guucuccgcucccagacau

SEQ ID NO: 439161 - RNA, 19 nt, Homo sapiens
gacuaugaccuaucugaca

SEQ ID NO: 439162 - RNA, 19 nt, Homo sapiens
cuaagaagaaggccuuuac

SEQ ID NO: 439163 - RNA, 19 nt, Homo sapiens
gagcuuaaugccaggaaca

SEQ ID NO: 439164 - RNA, 19 nt, Homo sapiens
uaccaucaccgcacugaga

SEQ ID NO: 439165 - RNA, 19 nt, Homo sapiens
ggaggagaagaaagcauuc

SEQ ID NO: 439166 - RNA, 19 nt, Homo sapiens
aagauugaccuuaaguuca

SEQ ID NO: 439167 - RNA, 19 nt, Homo sapiens
ccaaggugaacaagaagga

SEQ ID NO: 439168 - RNA, 19 nt, Homo sapiens
ggauacaaggcuggcauga

SEQ ID NO: 439169 - RNA, 19 nt, Homo sapiens
uggaggagaagaaagcauu

SEQ ID NO: 439170 - RNA, 19 nt, Homo sapiens
gcugugaccauuguagaga

SEQ ID NO: 439171 - RNA, 19 nt, Homo sapiens
gauugaccuuaaguucauu

SEQ ID NO: 439172 - RNA, 19 nt, Homo sapiens
cugaagaaagaccgaauug

SEQ ID NO: 439173 - RNA, 19 nt, Homo sapiens
uggaggcugugaccauugu

SEQ ID NO: 439174 - RNA, 19 nt, Homo sapiens
accaaguacugcaagaaau

SEQ ID NO: 439175 - RNA, 19 nt, Homo sapiens
uuaaugccaggaacagauu

SEQ ID NO: 439176 - RNA, 19 nt, Homo sapiens
aacaaugccuccacugacu

SEQ ID NO: 439177 - RNA, 19 nt, Homo sapiens
agaagaaggcccaccugau

SEQ ID NO: 439178 - RNA, 19 nt, Homo sapiens
gguggggucucaauaaaag

SEQ ID NO: 439179 - RNA, 19 nt, Homo sapiens
uaugaccuaucugacaaga

SEQ ID NO: 439180 - RNA, 19 nt, Homo sapiens
aagcugaucaagaacaaug

SEQ ID NO: 439181 - RNA, 19 nt, Homo sapiens
gacggcaagcugaucaaga

SEQ ID NO: 439182 - RNA, 19 nt, Homo sapiens
ggcagaaaggcuaccauca

SEQ ID NO: 439183 - RNA, 19 nt, Homo sapiens
gcaaaggaagaaggagcuu

SEQ ID NO: 439184 - RNA, 19 nt, Homo sapiens
cauggugguugugggcauu

SEQ ID NO: 439185 - RNA, 19 nt, Homo sapiens
caaugccuccacugacuau

SEQ ID NO: 439186 - RNA, 19 nt, Homo sapiens
ugagaucaacaagaagauu

SEQ ID NO: 439187 - RNA, 19 nt, Homo sapiens
gcacuguggccgagaagcu

SEQ ID NO: 439188 - RNA, 19 nt, Homo sapiens
gagcuucccuaaggaugac

SEQ ID NO: 439189 - RNA, 19 nt, Homo sapiens
gaggagaagaaagcauuca

SEQ ID NO: 439190 - RNA, 19 nt, Homo sapiens
ucuaagaagaaggccuuua

SEQ ID NO: 439191 - RNA, 19 nt, Homo sapiens
gaaugcaagaggcguuucu

SEQ ID NO: 439192 - RNA, 19 nt, Homo sapiens
gcacggagcucaacaagaa

SEQ ID NO: 439193 - RNA, 19 nt, Homo sapiens
agacaaagccgauucauua

SEQ ID NO: 439194 - RNA, 19 nt, Homo sapiens
gaagaaggcccacaucaug

SEQ ID NO: 439195 - RNA, 19 nt, Homo sapiens
caaagccgauucauuaaga

SEQ ID NO: 439196 - RNA, 19 nt, Homo sapiens
gaauugcaauagagaaaga

SEQ ID NO: 439197 - RNA, 19 nt, Homo sapiens
gcagaacaccucagugaug

SEQ ID NO: 439198 - RNA, 19 nt, Homo sapiens
cagaacaccucagugauga

SEQ ID NO: 439199 - RNA, 19 nt, Homo sapiens
ggaagcuggugaagaacaa

SEQ ID NO: 439200 - RNA, 19 nt, Homo sapiens
gccaagccguggagaauau

SEQ ID NO: 439201 - RNA, 19 nt, Homo sapiens
agaagcaucuggagaagga

SEQ ID NO: 439202 - RNA, 19 nt, Homo sapiens
agagugaggucauugaugu

SEQ ID NO: 439203 - RNA, 19 nt, Homo sapiens
gacaaagccgauucauuaa

SEQ ID NO: 439204 - RNA, 19 nt, Homo sapiens
acgggaagcuggugaagaa

SEQ ID NO: 439205 - RNA, 19 nt, Homo sapiens
aaagaguaauucacacaga

SEQ ID NO: 439206 - RNA, 19 nt, Homo sapiens
uacaaggacuggcacaaga

SEQ ID NO: 439207 - RNA, 19 nt, Homo sapiens
gcacaagagcaagaagaaa

SEQ ID NO: 439208 - RNA, 19 nt, Homo sapiens
ccaagaagcgggucauuac

SEQ ID NO: 439209 - RNA, 19 nt, Homo sapiens
gggaauugcaauagagaaa

SEQ ID NO: 439210 - RNA, 19 nt, Homo sapiens
ugaggucauugaugucauu

SEQ ID NO: 439211 - RNA, 19 nt, Homo sapiens
gaccggaguuuuauguuuu

SEQ ID NO: 439212 - RNA, 19 nt, Homo sapiens
ggagaccucgggagacuug

SEQ ID NO: 439213 - RNA, 19 nt, Homo sapiens
ccagacagcccaagagaag

SEQ ID NO: 439214 - RNA, 19 nt, Homo sapiens
caaggucauucgggucauu

SEQ ID NO: 439215 - RNA, 19 nt, Homo sapiens
gucacaagccgcuggcaua

SEQ ID NO: 439216 - RNA, 19 nt, Homo sapiens
gaaguacugcaaggucauu

SEQ ID NO: 439217 - RNA, 19 nt, Homo sapiens
agagaaagaguaauucaca

SEQ ID NO: 439218 - RNA, 19 nt, Homo sapiens
ugacaccaccuccaaguuc

SEQ ID NO: 439219 - RNA, 19 nt, Homo sapiens
gcugaaggguuguauugcu

SEQ ID NO: 439220 - RNA, 19 nt, Homo sapiens
ggucauugaugucauugcu

SEQ ID NO: 439221 - RNA, 19 nt, Homo sapiens
aaaagcagcuacagaagga

SEQ ID NO: 439222 - RNA, 19 nt, Homo sapiens
ugcaauagagaaagaguaa

SEQ ID NO: 439223 - RNA, 19 nt, Homo sapiens
uuacucaaaucgaucucuu

SEQ ID NO: 439224 - RNA, 19 nt, Homo sapiens
uggaggcggugacaauugu

SEQ ID NO: 439225 - RNA, 19 nt, Homo sapiens
ggucucagagcgcugugua

SEQ ID NO: 439226 - RNA, 19 nt, Homo sapiens
ucauuacgcugagaaaguc

SEQ ID NO: 439227 - RNA, 19 nt, Homo sapiens
cagaagaaggcccacauca

SEQ ID NO: 439228 - RNA, 19 nt, Homo sapiens
uagacaaagccgauucauu

SEQ ID NO: 439229 - RNA, 19 nt, Homo sapiens
gaagcgcaccgcacugucu

SEQ ID NO: 439230 - RNA, 19 nt, Homo sapiens
acaagccgcuggcauacca

SEQ ID NO: 439231 - RNA, 19 nt, Homo sapiens
ggcacaagagcaagaagaa

SEQ ID NO: 439232 - RNA, 19 nt, Homo sapiens
gcagaagaaggcccacauc

SEQ ID NO: 439233 - RNA, 19 nt, Homo sapiens
aaagaagcaucuggagaag

SEQ ID NO: 439234 - RNA, 19 nt, Homo sapiens
aaaagaagcaucuggagaa

SEQ ID NO: 439235 - RNA, 19 nt, Homo sapiens
cacaagagcaagaagaaag

SEQ ID NO: 439236 - RNA, 19 nt, Homo sapiens
uugcagaacaccucaguga

SEQ ID NO: 439237 - RNA, 19 nt, Homo sapiens
ggugacaauuguagaaacg

SEQ ID NO: 439238 - RNA, 19 nt, Homo sapiens
uguccacacucagaugaaa

SEQ ID NO: 439239 - RNA, 19 nt, Homo sapiens
gaccaucuuugcagaacac

SEQ ID NO: 439240 - RNA, 19 nt, Homo sapiens
ccaugaagaaguacugcaa

SEQ ID NO: 439241 - RNA, 19 nt, Homo sapiens
ggaauugcaauagagaaag

SEQ ID NO: 439242 - RNA, 19 nt, Homo sapiens
guauugcugguaccaagaa

SEQ ID NO: 439243 - RNA, 19 nt, Homo sapiens
gagcucaacaagaagaucu

SEQ ID NO: 439244 - RNA, 19 nt, Homo sapiens
gcgcaagguggccugcauu

SEQ ID NO: 439245 - RNA, 19 nt, Homo sapiens
cagccagagugaggucauu

SEQ ID NO: 439246 - RNA, 19 nt, Homo sapiens
agaagaaggcccacaucau

SEQ ID NO: 439247 - RNA, 19 nt, Homo sapiens
gcgggagaccggaguuuua

SEQ ID NO: 439248 - RNA, 19 nt, Homo sapiens
agaaagaguaauucacaca

SEQ ID NO: 439249 - RNA, 19 nt, Homo sapiens
accaagaagcgggucauua

SEQ ID NO: 439250 - RNA, 19 nt, Homo sapiens
gguggaggcggugacaauu

SEQ ID NO: 439251 - RNA, 19 nt, Homo sapiens
gcggugacaauuguagaaa

SEQ ID NO: 439252 - RNA, 19 nt, Homo sapiens
ggaggcggugacaauugua

SEQ ID NO: 439253 - RNA, 19 nt, Homo sapiens
cgaggucuccggagcuuca

SEQ ID NO: 439254 - RNA, 19 nt, Homo sapiens
gggaagcuggugaagaaca

SEQ ID NO: 439255 - RNA, 19 nt, Homo sapiens
agaccggaguuuuauguuu

SEQ ID NO: 439256 - RNA, 19 nt, Homo sapiens
gucauuacgcugagaaagu

SEQ ID NO: 439257 - RNA, 19 nt, Homo sapiens
guggaggcggugacaauug

SEQ ID NO: 439258 - RNA, 19 nt, Homo sapiens
agagguggcgggacacaga

SEQ ID NO: 439259 - RNA, 19 nt, Homo sapiens
gcgggacacagacgggaaa

SEQ ID NO: 439260 - RNA, 19 nt, Homo sapiens
gaagaagccugcugcauaa

SEQ ID NO: 439261 - RNA, 19 nt, Homo sapiens
gaaguuagaugaauuguac

SEQ ID NO: 439262 - RNA, 19 nt, Homo sapiens
gaccagauauugugaacuu

SEQ ID NO: 439263 - RNA, 19 nt, Homo sapiens
gcagaguccuaaagaagaa

SEQ ID NO: 439264 - RNA, 19 nt, Homo sapiens
gaucuuagcagaaucuuga

SEQ ID NO: 439265 - RNA, 19 nt, Homo sapiens
cuuaaagccuggaaugaua

SEQ ID NO: 439266 - RNA, 19 nt, Homo sapiens
agaagaagccugcugcaua

SEQ ID NO: 439267 - RNA, 19 nt, Homo sapiens
agaaacaucccuggaauua

SEQ ID NO: 439268 - RNA, 19 nt, Homo sapiens
ggacguuucugcauuugga

SEQ ID NO: 439269 - RNA, 19 nt, Homo sapiens
agaaucauguugaagcuaa

SEQ ID NO: 439270 - RNA, 19 nt, Homo sapiens
ccgcuucccucaagaguaa

SEQ ID NO: 439271 - RNA, 19 nt, Homo sapiens
uaagcaagcugaacauuuu

SEQ ID NO: 439272 - RNA, 19 nt, Homo sapiens
guaagcaagcugaacauuu

SEQ ID NO: 439273 - RNA, 19 nt, Homo sapiens
ggcagcagcuaccaagaaa

SEQ ID NO: 439274 - RNA, 19 nt, Homo sapiens
aaacaucccuggaauuacu

SEQ ID NO: 439275 - RNA, 19 nt, Homo sapiens
guugaaggcuacaagaaga

SEQ ID NO: 439276 - RNA, 19 nt, Homo sapiens
cagcacuggucaugucuaa

SEQ ID NO: 439277 - RNA, 19 nt, Homo sapiens
auacagaucuuagcagaau

SEQ ID NO: 439278 - RNA, 19 nt, Homo sapiens
ucagaaacaucccuggaau

SEQ ID NO: 439279 - RNA, 19 nt, Homo sapiens
uguugaagcuaaacccaua

SEQ ID NO: 439280 - RNA, 19 nt, Homo sapiens
ggaaguuagaugaauugua

SEQ ID NO: 439281 - RNA, 19 nt, Homo sapiens
gcacuggucaugucuaaag

SEQ ID NO: 439282 - RNA, 19 nt, Homo sapiens
gaaucauguugaagcuaaa

SEQ ID NO: 439283 - RNA, 19 nt, Homo sapiens
uaaagaagaacccacugaa

SEQ ID NO: 439284 - RNA, 19 nt, Homo sapiens
gugggacguuucugcauuu

SEQ ID NO: 439285 - RNA, 19 nt, Homo sapiens
gaagccugcugcauaaacu

SEQ ID NO: 439286 - RNA, 19 nt, Homo sapiens
aaagaagaacccacugaaa

SEQ ID NO: 439287 - RNA, 19 nt, Homo sapiens
ggacagcuucuuuugaaua

SEQ ID NO: 439288 - RNA, 19 nt, Homo sapiens
gaagcuguuuugcuccuua

SEQ ID NO: 439289 - RNA, 19 nt, Homo sapiens
gcuccuauucgaccagaua

SEQ ID NO: 439290 - RNA, 19 nt, Homo sapiens
gcccuaugcugucagugaa

SEQ ID NO: 439291 - RNA, 19 nt, Homo sapiens
gaagcuaaacccauaugca

SEQ ID NO: 439292 - RNA, 19 nt, Homo sapiens
ucacuuugccugcuguauu

SEQ ID NO: 439293 - RNA, 19 nt, Homo sapiens
aaacuuaaagccuggaaug

SEQ ID NO: 439294 - RNA, 19 nt, Homo sapiens
gacagcuucuuuugaauaa

SEQ ID NO: 439295 - RNA, 19 nt, Homo sapiens
cagauauugugaacuuugu

SEQ ID NO: 439296 - RNA, 19 nt, Homo sapiens
gauuauacaggcagugaga

SEQ ID NO: 439297 - RNA, 19 nt, Homo sapiens
ccucaagaguaacuacaau

SEQ ID NO: 439298 - RNA, 19 nt, Homo sapiens
caucaaggccuucagaaac

SEQ ID NO: 439299 - RNA, 19 nt, Homo sapiens
ccugcugcauaaacucuua

SEQ ID NO: 439300 - RNA, 19 nt, Homo sapiens
gcuaaacccauaugcaaag

SEQ ID NO: 439301 - RNA, 19 nt, Homo sapiens
gguaguugaagauaaaguu

SEQ ID NO: 439302 - RNA, 19 nt, Homo sapiens
caagccaaaucagaugaga

SEQ ID NO: 439303 - RNA, 19 nt, Homo sapiens
cuaaagaagaacccacuga

SEQ ID NO: 439304 - RNA, 19 nt, Homo sapiens
gagcaccacgcaagaagau

SEQ ID NO: 439305 - RNA, 19 nt, Homo sapiens
ccagauauugugaacuuug

SEQ ID NO: 439306 - RNA, 19 nt, Homo sapiens
aagcuaaacccauaugcaa

SEQ ID NO: 439307 - RNA, 19 nt, Homo sapiens
caucgcagaguccuaaaga

SEQ ID NO: 439308 - RNA, 19 nt, Homo sapiens
ugcacaagaugauuaauac

SEQ ID NO: 439309 - RNA, 19 nt, Homo sapiens
cagaaacaucccuggaauu

SEQ ID NO: 439310 - RNA, 19 nt, Homo sapiens
gaagaccaaggaagcuguu

SEQ ID NO: 439311 - RNA, 19 nt, Homo sapiens
gcuacaagaagaccaagga

SEQ ID NO: 439312 - RNA, 19 nt, Homo sapiens
cacuuugccugcuguauuc

SEQ ID NO: 439313 - RNA, 19 nt, Homo sapiens
caucguagagugaacacaa

SEQ ID NO: 439314 - RNA, 19 nt, Homo sapiens
gaaaccagccccugaaaag

SEQ ID NO: 439315 - RNA, 19 nt, Homo sapiens
gcacaagaugauuaauaca

SEQ ID NO: 439316 - RNA, 19 nt, Homo sapiens
ugugggacguuucugcauu

SEQ ID NO: 439317 - RNA, 19 nt, Homo sapiens
ccuaugcugucagugaauu

SEQ ID NO: 439318 - RNA, 19 nt, Homo sapiens
cuaaacccauaugcaaaga

SEQ ID NO: 439319 - RNA, 19 nt, Homo sapiens
auucaaggcuccuauucga

SEQ ID NO: 439320 - RNA, 19 nt, Homo sapiens
gcucgaauucccagaguuc

SEQ ID NO: 439321 - RNA, 19 nt, Homo sapiens
agagugaacacaacccaaa

SEQ ID NO: 439322 - RNA, 19 nt, Homo sapiens
ucaucaaggccuucagaaa

SEQ ID NO: 439323 - RNA, 19 nt, Homo sapiens
gcgaaugagagcuggcaaa

SEQ ID NO: 439324 - RNA, 19 nt, Homo sapiens
guaguugaagauaaaguug

SEQ ID NO: 439325 - RNA, 19 nt, Homo sapiens
ccuauucgaccagauauug

SEQ ID NO: 439326 - RNA, 19 nt, Homo sapiens
gagaggagcguggcugucu

SEQ ID NO: 439327 - RNA, 19 nt, Homo sapiens
cuacaagccaaaucagaug

SEQ ID NO: 439328 - RNA, 19 nt, Homo sapiens
gagaaucauguugaagcua

SEQ ID NO: 439329 - RNA, 19 nt, Homo sapiens
aaacuugagaaucauguug

SEQ ID NO: 439330 - RNA, 19 nt, Homo sapiens
ccaugcacaagaugauuaa

SEQ ID NO: 439331 - RNA, 19 nt, Homo sapiens
gcccacugauaucggugua

SEQ ID NO: 439332 - RNA, 19 nt, Homo sapiens
cccaugcacaagaugauua

SEQ ID NO: 439333 - RNA, 19 nt, Homo sapiens
agccuggaaugauaucaaa

SEQ ID NO: 439334 - RNA, 19 nt, Homo sapiens
gcagugagaaacaugaaaa

SEQ ID NO: 439335 - RNA, 19 nt, Homo sapiens
cuacuacagaggagaagaa

SEQ ID NO: 439336 - RNA, 19 nt, Homo sapiens
cacaagcuccggguggaua

SEQ ID NO: 439337 - RNA, 19 nt, Homo sapiens
gaaacaucccuggaauuac

SEQ ID NO: 439338 - RNA, 19 nt, Homo sapiens
gagaagaagccugcugcau

SEQ ID NO: 439339 - RNA, 19 nt, Homo sapiens
ccacugauaucgguguacu

SEQ ID NO: 439340 - RNA, 19 nt, Homo sapiens
aagaagaacccacugaaaa

SEQ ID NO: 439341 - RNA, 19 nt, Homo sapiens
caacagacagcccuaugcu

SEQ ID NO: 439342 - RNA, 19 nt, Homo sapiens
uccggaaguuagaugaauu

SEQ ID NO: 439343 - RNA, 19 nt, Homo sapiens
gaaacuuaaagccuggaau

SEQ ID NO: 439344 - RNA, 19 nt, Homo sapiens
guauucaaggcuccuauuc

SEQ ID NO: 439345 - RNA, 19 nt, Homo sapiens
ugagaaucauguugaagcu

SEQ ID NO: 439346 - RNA, 19 nt, Homo sapiens
acuacaaucuucccaugca

SEQ ID NO: 439347 - RNA, 19 nt, Homo sapiens
ucaagaguaacuacaaucu

SEQ ID NO: 439348 - RNA, 19 nt, Homo sapiens
ccuggaauuacucugcuua

SEQ ID NO: 439349 - RNA, 19 nt, Homo sapiens
aucaaggccuucagaaaca

SEQ ID NO: 439350 - RNA, 19 nt, Homo sapiens
uaucaucaaggccuucaga

SEQ ID NO: 439351 - RNA, 19 nt, Homo sapiens
gcaaaggcaaaaugagaaa

SEQ ID NO: 439352 - RNA, 19 nt, Homo sapiens
aaaguugaaggcuacaaga

SEQ ID NO: 439353 - RNA, 19 nt, Homo sapiens
ugugguagguaagaaagga

SEQ ID NO: 439354 - RNA, 19 nt, Homo sapiens
uuaaagccuggaaugauau

SEQ ID NO: 439355 - RNA, 19 nt, Homo sapiens
uaaaguugaaggcuacaag

SEQ ID NO: 439356 - RNA, 19 nt, Homo sapiens
uuauacaggcagugagaaa

SEQ ID NO: 439357 - RNA, 19 nt, Homo sapiens
cgcagaguccuaaagaaga

SEQ ID NO: 439358 - RNA, 19 nt, Homo sapiens
gaugaauuguacggcacuu

SEQ ID NO: 439359 - RNA, 19 nt, Homo sapiens
gugggcaugugggacguuu

SEQ ID NO: 439360 - RNA, 19 nt, Homo sapiens
ggaauuuaaugcagaagua

SEQ ID NO: 439361 - RNA, 19 nt, Homo sapiens
gccagaauguugcagauua

SEQ ID NO: 439362 - RNA, 19 nt, Homo sapiens
gaagggagcuguggaugga

SEQ ID NO: 439363 - RNA, 19 nt, Homo sapiens
ugaagaugcuuacaagaaa

SEQ ID NO: 439364 - RNA, 19 nt, Homo sapiens
acaguucucucaauacaua

SEQ ID NO: 439365 - RNA, 19 nt, Homo sapiens
gagcuaaacccagcaauuu

SEQ ID NO: 439366 - RNA, 19 nt, Homo sapiens
ggaggugacuggugaugaa

SEQ ID NO: 439367 - RNA, 19 nt, Homo sapiens
gagagaauccagucuauga

SEQ ID NO: 439368 - RNA, 19 nt, Homo sapiens
gaaagcucaugcugcuaua

SEQ ID NO: 439369 - RNA, 19 nt, Homo sapiens
gaacuaccacuggcaauaa

SEQ ID NO: 439370 - RNA, 19 nt, Homo sapiens
ggaagaagaugaagaugcu

SEQ ID NO: 439371 - RNA, 19 nt, Homo sapiens
gaugauaguucgugugaca

SEQ ID NO: 439372 - RNA, 19 nt, Homo sapiens
gaauaaggccuacuuuaag

SEQ ID NO: 439373 - RNA, 19 nt, Homo sapiens
agaauaaggccuacuuuaa

SEQ ID NO: 439374 - RNA, 19 nt, Homo sapiens
cagcguaacuccagacaug

SEQ ID NO: 439375 - RNA, 19 nt, Homo sapiens
uaagagauaccaagugaaa

SEQ ID NO: 439376 - RNA, 19 nt, Homo sapiens
uggaggagauguauaagaa

SEQ ID NO: 439377 - RNA, 19 nt, Homo sapiens
ccaaacgauucccugguua

SEQ ID NO: 439378 - RNA, 19 nt, Homo sapiens
acagagauaucauuuguca

SEQ ID NO: 439379 - RNA, 19 nt, Homo sapiens
aaacaguucucucaauaca

SEQ ID NO: 439380 - RNA, 19 nt, Homo sapiens
aauaaggccuacuuuaaga

SEQ ID NO: 439381 - RNA, 19 nt, Homo sapiens
gaggagauguauaagaaag

SEQ ID NO: 439382 - RNA, 19 nt, Homo sapiens
caaggaauuuaaugcagaa

SEQ ID NO: 439383 - RNA, 19 nt, Homo sapiens
gaaagcaaggaauuuaaug

SEQ ID NO: 439384 - RNA, 19 nt, Homo sapiens
gauaccaagugaaauuuag

SEQ ID NO: 439385 - RNA, 19 nt, Homo sapiens
gagaauccagucuaugaaa

SEQ ID NO: 439386 - RNA, 19 nt, Homo sapiens
uuuaagagauaccaaguga

SEQ ID NO: 439387 - RNA, 19 nt, Homo sapiens
gaagaaggaucggguagcu

SEQ ID NO: 439388 - RNA, 19 nt, Homo sapiens
gcauggacaagaucuauga

SEQ ID NO: 439389 - RNA, 19 nt, Homo sapiens
gcaggcuucucaauagguu

SEQ ID NO: 439390 - RNA, 19 nt, Homo sapiens
agguuggccugacaaauua

SEQ ID NO: 439391 - RNA, 19 nt, Homo sapiens
ggaaacgcuuggugauaca

SEQ ID NO: 439392 - RNA, 19 nt, Homo sapiens
aagaauaaggccuacuuua

SEQ ID NO: 439393 - RNA, 19 nt, Homo sapiens
gaagaugcuuacaagaaac

SEQ ID NO: 439394 - RNA, 19 nt, Homo sapiens
aaaugucccuugcucagaa

SEQ ID NO: 439395 - RNA, 19 nt, Homo sapiens
ugauggaggagauguauaa

SEQ ID NO: 439396 - RNA, 19 nt, Homo sapiens
gagauaccaagugaaauuu

SEQ ID NO: 439397 - RNA, 19 nt, Homo sapiens
agagauaccaagugaaauu

SEQ ID NO: 439398 - RNA, 19 nt, Homo sapiens
agagauaucauuugucaga

SEQ ID NO: 439399 - RNA, 19 nt, Homo sapiens
gacaaacagagauaucauu

SEQ ID NO: 439400 - RNA, 19 nt, Homo sapiens
aaaagaagcccaagaaaga

SEQ ID NO: 439401 - RNA, 19 nt, Homo sapiens
gauuacaugcgcuacuuaa

SEQ ID NO: 439402 - RNA, 19 nt, Homo sapiens
cagauuacaugcgcuacuu

SEQ ID NO: 439403 - RNA, 19 nt, Homo sapiens
gcccgcaggcuucucaaua

SEQ ID NO: 439404 - RNA, 19 nt, Homo sapiens
gaaacaguucucucaauac

SEQ ID NO: 439405 - RNA, 19 nt, Homo sapiens
cacacgaacugccaaaaua

SEQ ID NO: 439406 - RNA, 19 nt, Homo sapiens
ccaaauacaggaugauagu

SEQ ID NO: 439407 - RNA, 19 nt, Homo sapiens
gaaaagaagcccaagaaag

SEQ ID NO: 439408 - RNA, 19 nt, Homo sapiens
ucugaaagcaaggaauuua

SEQ ID NO: 439409 - RNA, 19 nt, Homo sapiens
aagguuggccugacaaauu

SEQ ID NO: 439410 - RNA, 19 nt, Homo sapiens
ggaggagauguauaagaaa

SEQ ID NO: 439411 - RNA, 19 nt, Homo sapiens
agaugaagaugcuuacaag

SEQ ID NO: 439412 - RNA, 19 nt, Homo sapiens
aagaagaugaagaugcuua

SEQ ID NO: 439413 - RNA, 19 nt, Homo sapiens
uaagaauaaggccuacuuu

SEQ ID NO: 439414 - RNA, 19 nt, Homo sapiens
aggccuacuuuaagagaua

SEQ ID NO: 439415 - RNA, 19 nt, Homo sapiens
uacaugcgcuacuuaaugg

SEQ ID NO: 439416 - RNA, 19 nt, Homo sapiens
cggaaacgcuuggugauac

SEQ ID NO: 439417 - RNA, 19 nt, Homo sapiens
uuacaugcgcuacuuaaug

SEQ ID NO: 439418 - RNA, 19 nt, Homo sapiens
gcuacuuaauggaagaaga

SEQ ID NO: 439419 - RNA, 19 nt, Homo sapiens
uaaauacaacacacccaaa

SEQ ID NO: 439420 - RNA, 19 nt, Homo sapiens
guacaucggaagcacauca

SEQ ID NO: 439421 - RNA, 19 nt, Homo sapiens
ccagaauguugcagauuac

SEQ ID NO: 439422 - RNA, 19 nt, Homo sapiens
gcacaucaugggccagaau

SEQ ID NO: 439423 - RNA, 19 nt, Homo sapiens
aauacaacacacccaaaua

SEQ ID NO: 439424 - RNA, 19 nt, Homo sapiens
ggugacuggugaugaauac

SEQ ID NO: 439425 - RNA, 19 nt, Homo sapiens
gcccaagaaagaaguuaaa

SEQ ID NO: 439426 - RNA, 19 nt, Homo sapiens
caaacgauucccugguuau

SEQ ID NO: 439427 - RNA, 19 nt, Homo sapiens
acacccaaauacaggauga

SEQ ID NO: 439428 - RNA, 19 nt, Homo sapiens
agaaagcucaugcugcuau

SEQ ID NO: 439429 - RNA, 19 nt, Homo sapiens
ggagauguauaagaaagcu

SEQ ID NO: 439430 - RNA, 19 nt, Homo sapiens
gagauaucauuugucagau

SEQ ID NO: 439431 - RNA, 19 nt, Homo sapiens
aaagaagcccaagaaagaa

SEQ ID NO: 439432 - RNA, 19 nt, Homo sapiens
gaugaagaugcuuacaaga

SEQ ID NO: 439433 - RNA, 19 nt, Homo sapiens
agaacuaccacuggcaaua

SEQ ID NO: 439434 - RNA, 19 nt, Homo sapiens
gacuggugaugaauacaau

SEQ ID NO: 439435 - RNA, 19 nt, Homo sapiens
ucaauagguuuggcaugga

SEQ ID NO: 439436 - RNA, 19 nt, Homo sapiens
aaauacaggaugauaguuc

SEQ ID NO: 439437 - RNA, 19 nt, Homo sapiens
acgagagaauccagucuau

SEQ ID NO: 439438 - RNA, 19 nt, Homo sapiens
gguuuggcauggacaagau

SEQ ID NO: 439439 - RNA, 19 nt, Homo sapiens
gaagguuggccugacaaau

SEQ ID NO: 439440 - RNA, 19 nt, Homo sapiens
gggccagaauguugcagau

SEQ ID NO: 439441 - RNA, 19 nt, Homo sapiens
ucacaguaccaaacgauuc

SEQ ID NO: 439442 - RNA, 19 nt, Homo sapiens
gaucuaugaaggccaagug

SEQ ID NO: 439443 - RNA, 19 nt, Homo sapiens
cuuaugaacagcaacuaaa

SEQ ID NO: 439444 - RNA, 19 nt, Homo sapiens
gagguggaaccgucccaaa

SEQ ID NO: 439445 - RNA, 19 nt, Homo sapiens
augaagaugcuuacaagaa

SEQ ID NO: 439446 - RNA, 19 nt, Homo sapiens
aaauacaacacacccaaau

SEQ ID NO: 439447 - RNA, 19 nt, Homo sapiens
caucaugggccagaauguu

SEQ ID NO: 439448 - RNA, 19 nt, Homo sapiens
cugaaagcaaggaauuuaa

SEQ ID NO: 439449 - RNA, 19 nt, Homo sapiens
ugauuauuaugcucggaaa

SEQ ID NO: 439450 - RNA, 19 nt, Homo sapiens
gcgggcugcugagagcuaa

SEQ ID NO: 439451 - RNA, 19 nt, Homo sapiens
acgauucccugguuaugau

SEQ ID NO: 439452 - RNA, 19 nt, Homo sapiens
uuaagaauaaggccuacuu

SEQ ID NO: 439453 - RNA, 19 nt, Homo sapiens
caaauacaggaugauaguu

SEQ ID NO: 439454 - RNA, 19 nt, Homo sapiens
guuaugauucugaaagcaa

SEQ ID NO: 439455 - RNA, 19 nt, Homo sapiens
uaaggccuacuuuaagaga

SEQ ID NO: 439456 - RNA, 19 nt, Homo sapiens
ugacuggugaugaauacaa

SEQ ID NO: 439457 - RNA, 19 nt, Homo sapiens
cccgcaggcuucucaauag

SEQ ID NO: 439458 - RNA, 19 nt, Homo sapiens
aacuaccacuggcaauaaa

SEQ ID NO: 439459 - RNA, 19 nt, Homo sapiens
gaugggguuuguuaaaguu

SEQ ID NO: 439460 - RNA, 19 nt, Homo sapiens
gaagaacacaccagaaauu

SEQ ID NO: 439461 - RNA, 19 nt, Homo sapiens
gcagcuggcuaguggcuua

SEQ ID NO: 439462 - RNA, 19 nt, Homo sapiens
gaacacaccagaaauuugu

SEQ ID NO: 439463 - RNA, 19 nt, Homo sapiens
ucagaaagcuguggacuca

SEQ ID NO: 439464 - RNA, 19 nt, Homo sapiens
gcgcaagauugaucagaaa

SEQ ID NO: 439465 - RNA, 19 nt, Homo sapiens
aaacugcgagccagcauua

SEQ ID NO: 439466 - RNA, 19 nt, Homo sapiens
gaaguacucagccgcuaaa

SEQ ID NO: 439467 - RNA, 19 nt, Homo sapiens
caccagaaauuugucauug

SEQ ID NO: 439468 - RNA, 19 nt, Homo sapiens
gcuggcuaguggcuuauua

SEQ ID NO: 439469 - RNA, 19 nt, Homo sapiens
gaagccagauacuaaagag

SEQ ID NO: 439470 - RNA, 19 nt, Homo sapiens
caaauugguguucuaaaug

SEQ ID NO: 439471 - RNA, 19 nt, Homo sapiens
aggguaaccucaaagcuaa

SEQ ID NO: 439472 - RNA, 19 nt, Homo sapiens
ggaaguacucagccgcuaa

SEQ ID NO: 439473 - RNA, 19 nt, Homo sapiens
cuaaaugucuuaagaaccu

SEQ ID NO: 439474 - RNA, 19 nt, Homo sapiens
uuaauucucuuucccaucu

SEQ ID NO: 439475 - RNA, 19 nt, Homo sapiens
ucagaggaauuggcaggua

SEQ ID NO: 439476 - RNA, 19 nt, Homo sapiens
cagaggaauuggcagguau

SEQ ID NO: 439477 - RNA, 19 nt, Homo sapiens
uggaauuuauccucacaaa

SEQ ID NO: 439478 - RNA, 19 nt, Homo sapiens
uugagaagccagauacuaa

SEQ ID NO: 439479 - RNA, 19 nt, Homo sapiens
ucacaaauugguguucuaa

SEQ ID NO: 439480 - RNA, 19 nt, Homo sapiens
ucagucagcacgugagaaa

SEQ ID NO: 439481 - RNA, 19 nt, Homo sapiens
guacucagccgcuaaaucc

SEQ ID NO: 439482 - RNA, 19 nt, Homo sapiens
ugagaagccagauacuaaa

SEQ ID NO: 439483 - RNA, 19 nt, Homo sapiens
aagaacacaccagaaauuu

SEQ ID NO: 439484 - RNA, 19 nt, Homo sapiens
caagauugaucagaaagcu

SEQ ID NO: 439485 - RNA, 19 nt, Homo sapiens
ccgcaacccuguccuuguc

SEQ ID NO: 439486 - RNA, 19 nt, Homo sapiens
aaggguaaccucaaagcua

SEQ ID NO: 439487 - RNA, 19 nt, Homo sapiens
gcucugacgaauggaauuu

SEQ ID NO: 439488 - RNA, 19 nt, Homo sapiens
cauugccacuucaaccaaa

SEQ ID NO: 439489 - RNA, 19 nt, Homo sapiens
guacccgggugguuaaacu

SEQ ID NO: 439490 - RNA, 19 nt, Homo sapiens
ucugacgaauggaauuuau

SEQ ID NO: 439491 - RNA, 19 nt, Homo sapiens
guugagaagccagauacua

SEQ ID NO: 439492 - RNA, 19 nt, Homo sapiens
gagaagccagauacuaaag

SEQ ID NO: 439493 - RNA, 19 nt, Homo sapiens
aaaguugagaagccagaua

SEQ ID NO: 439494 - RNA, 19 nt, Homo sapiens
aauccaagguugaaaagaa

SEQ ID NO: 439495 - RNA, 19 nt, Homo sapiens
gaaacccgaagccaagaag

SEQ ID NO: 439496 - RNA, 19 nt, Homo sapiens
agaacacaccagaaauuug

SEQ ID NO: 439497 - RNA, 19 nt, Homo sapiens
ggaccauucugaucauccu

SEQ ID NO: 439498 - RNA, 19 nt, Homo sapiens
gcgguacccgggugguuaa

SEQ ID NO: 439499 - RNA, 19 nt, Homo sapiens
gguuaaacuucgcaaaaug

SEQ ID NO: 439500 - RNA, 19 nt, Homo sapiens
gccagauacuaaagagaag

SEQ ID NO: 439501 - RNA, 19 nt, Homo sapiens
uaccugcgaucuguguuug

SEQ ID NO: 439502 - RNA, 19 nt, Homo sapiens
cagauacuaaagagaagaa

SEQ ID NO: 439503 - RNA, 19 nt, Homo sapiens
uucccgaucugccauguau

SEQ ID NO: 439504 - RNA, 19 nt, Homo sapiens
uggcagguauucccgaucu

SEQ ID NO: 439505 - RNA, 19 nt, Homo sapiens
cgaucuguguuugcucuga

SEQ ID NO: 439506 - RNA, 19 nt, Homo sapiens
agagaaauaugagauuacg

SEQ ID NO: 439507 - RNA, 19 nt, Homo sapiens
ugccauguauuccagaaag

SEQ ID NO: 439508 - RNA, 19 nt, Homo sapiens
agccagauacuaaagagaa

SEQ ID NO: 439509 - RNA, 19 nt, Homo sapiens
uguuugcucugacgaaugg

SEQ ID NO: 439510 - RNA, 19 nt, Homo sapiens
gcuguugagccacggcaaa

SEQ ID NO: 439511 - RNA, 19 nt, Homo sapiens
gcuaaauccaagguugaaa

SEQ ID NO: 439512 - RNA, 19 nt, Homo sapiens
ccgcuaaauccaagguuga

SEQ ID NO: 439513 - RNA, 19 nt, Homo sapiens
cuaccugcgaucuguguuu

SEQ ID NO: 439514 - RNA, 19 nt, Homo sapiens
acaccagaaauuugucauu

SEQ ID NO: 439515 - RNA, 19 nt, Homo sapiens
ggaggaagcuuaucuauga

SEQ ID NO: 439516 - RNA, 19 nt, Homo sapiens
gaacuaaggugucuaccau

SEQ ID NO: 439517 - RNA, 19 nt, Homo sapiens
gaauugcuuugacagauaa

SEQ ID NO: 439518 - RNA, 19 nt, Homo sapiens
cgucaaaucuucaauggaa

SEQ ID NO: 439519 - RNA, 19 nt, Homo sapiens
caugagaucuauacuguug

SEQ ID NO: 439520 - RNA, 19 nt, Homo sapiens
cgaauugcuuugacagaua

SEQ ID NO: 439521 - RNA, 19 nt, Homo sapiens
cagaucaacaggcuuauua

SEQ ID NO: 439522 - RNA, 19 nt, Homo sapiens
caacaaggcuucgauuaac

SEQ ID NO: 439523 - RNA, 19 nt, Homo sapiens
uaaggugucuaccaugauu

SEQ ID NO: 439524 - RNA, 19 nt, Homo sapiens
caacaggcuuauuagaaga

SEQ ID NO: 439525 - RNA, 19 nt, Homo sapiens
gaccagaucaacaggcuua

SEQ ID NO: 439526 - RNA, 19 nt, Homo sapiens
ucaacaaggcuucgauuaa

SEQ ID NO: 439527 - RNA, 19 nt, Homo sapiens
ucaacaggcuuauuagaag

SEQ ID NO: 439528 - RNA, 19 nt, Homo sapiens
aacaguaccugcucucaaa

SEQ ID NO: 439529 - RNA, 19 nt, Homo sapiens
gaagucaguaaaugaacua

SEQ ID NO: 439530 - RNA, 19 nt, Homo sapiens
acagauaacgcuuugauug

SEQ ID NO: 439531 - RNA, 19 nt, Homo sapiens
gucaguaaaugaacuaauc

SEQ ID NO: 439532 - RNA, 19 nt, Homo sapiens
aaucagagguaucaaugga

SEQ ID NO: 439533 - RNA, 19 nt, Homo sapiens
gaauauaggcagauguaca

SEQ ID NO: 439534 - RNA, 19 nt, Homo sapiens
aaucuucaauggaaccuuu

SEQ ID NO: 439535 - RNA, 19 nt, Homo sapiens
gaucaacaggcuuauuaga

SEQ ID NO: 439536 - RNA, 19 nt, Homo sapiens
gcgaauugcuuugacagau

SEQ ID NO: 439537 - RNA, 19 nt, Homo sapiens
gaggaagcuuaucuaugaa

SEQ ID NO: 439538 - RNA, 19 nt, Homo sapiens
gaaccuuugugaagcucaa

SEQ ID NO: 439539 - RNA, 19 nt, Homo sapiens
gcugguugguuaauaaaca

SEQ ID NO: 439540 - RNA, 19 nt, Homo sapiens
gaucuauacuguuggaaaa

SEQ ID NO: 439541 - RNA, 19 nt, Homo sapiens
uggaggauuugauucauga

SEQ ID NO: 439542 - RNA, 19 nt, Homo sapiens
gcuggcaacuucuauguac

SEQ ID NO: 439543 - RNA, 19 nt, Homo sapiens
gcaaggaggaagcuuaucu

SEQ ID NO: 439544 - RNA, 19 nt, Homo sapiens
gcauggaggauuugauuca

SEQ ID NO: 439545 - RNA, 19 nt, Homo sapiens
uagaagagaagaagaagga

SEQ ID NO: 439546 - RNA, 19 nt, Homo sapiens
acuaaggugucuaccauga

SEQ ID NO: 439547 - RNA, 19 nt, Homo sapiens
caagcgugguuauggcaaa

SEQ ID NO: 439548 - RNA, 19 nt, Homo sapiens
aagaaaagcuggcaacuuc

SEQ ID NO: 439549 - RNA, 19 nt, Homo sapiens
uggcgaggauggcaagaaa

SEQ ID NO: 439550 - RNA, 19 nt, Homo sapiens
ggauuugauucaugagauc

SEQ ID NO: 439551 - RNA, 19 nt, Homo sapiens
cucgaucucuugguaaaua

SEQ ID NO: 439552 - RNA, 19 nt, Homo sapiens
gcccaaagguucgaaaggu

SEQ ID NO: 439553 - RNA, 19 nt, Homo sapiens
caaggaggaagcuuaucua

SEQ ID NO: 439554 - RNA, 19 nt, Homo sapiens
caacagggaggaccagauc

SEQ ID NO: 439555 - RNA, 19 nt, Homo sapiens
ccagaaacccuuaagaaaa

SEQ ID NO: 439556 - RNA, 19 nt, Homo sapiens
cgauuaacaugcugaggau

SEQ ID NO: 439557 - RNA, 19 nt, Homo sapiens
caauggaaccuuugugaag

SEQ ID NO: 439558 - RNA, 19 nt, Homo sapiens
guaaauacggcaucaucug

SEQ ID NO: 439559 - RNA, 19 nt, Homo sapiens
ugagaucuauacuguugga

SEQ ID NO: 439560 - RNA, 19 nt, Homo sapiens
ucaucugcauggaggauuu

SEQ ID NO: 439561 - RNA, 19 nt, Homo sapiens
ucaauggagugagcccaaa

SEQ ID NO: 439562 - RNA, 19 nt, Homo sapiens
gaaaagcuggcaacuucua

SEQ ID NO: 439563 - RNA, 19 nt, Homo sapiens
gugucuaccaugauuauuu

SEQ ID NO: 439564 - RNA, 19 nt, Homo sapiens
uucaugagaucuauacugu

SEQ ID NO: 439565 - RNA, 19 nt, Homo sapiens
ggaagcuuaucuaugaaaa

SEQ ID NO: 439566 - RNA, 19 nt, Homo sapiens
cuucuucgccuucgucaaa

SEQ ID NO: 439567 - RNA, 19 nt, Homo sapiens
agaaugaacuaaggugucu

SEQ ID NO: 439568 - RNA, 19 nt, Homo sapiens
cauggaggguguagaagag

SEQ ID NO: 439569 - RNA, 19 nt, Homo sapiens
ugacagauaacgcuuugau

SEQ ID NO: 439570 - RNA, 19 nt, Homo sapiens
gcucaacaaggcuucgauu

SEQ ID NO: 439571 - RNA, 19 nt, Homo sapiens
gacagauaacgcuuugauu

SEQ ID NO: 439572 - RNA, 19 nt, Homo sapiens
agaaucagagguaucaaug

SEQ ID NO: 439573 - RNA, 19 nt, Homo sapiens
ucaauggaaccuuugugaa

SEQ ID NO: 439574 - RNA, 19 nt, Homo sapiens
aguaccugcucucaaauug

SEQ ID NO: 439575 - RNA, 19 nt, Homo sapiens
aaacaguaccugcucucaa

SEQ ID NO: 439576 - RNA, 19 nt, Homo sapiens
cccaaaagaugcuucgaaa

SEQ ID NO: 439577 - RNA, 19 nt, Homo sapiens
gaauuucgcagagcugaag

SEQ ID NO: 439578 - RNA, 19 nt, Homo sapiens
ugaagucaguaaaugaacu

SEQ ID NO: 439579 - RNA, 19 nt, Homo sapiens
gaggauuugauucaugaga

SEQ ID NO: 439580 - RNA, 19 nt, Homo sapiens
ccauggaggguguagaaga

SEQ ID NO: 439581 - RNA, 19 nt, Homo sapiens
cagaaucagagguaucaau

SEQ ID NO: 439582 - RNA, 19 nt, Homo sapiens
guguagaagagaagaagaa

SEQ ID NO: 439583 - RNA, 19 nt, Homo sapiens
gucaucagaaucagaggua

SEQ ID NO: 439584 - RNA, 19 nt, Homo sapiens
gcaacagggaggaccagau

SEQ ID NO: 439585 - RNA, 19 nt, Homo sapiens
cugcauggaggauuugauu

SEQ ID NO: 439586 - RNA, 19 nt, Homo sapiens
caaaagaugcuucgaaagg

SEQ ID NO: 439587 - RNA, 19 nt, Homo sapiens
aacaaggcuucgauuaaca

SEQ ID NO: 439588 - RNA, 19 nt, Homo sapiens
gcguuugucaucagaauca

SEQ ID NO: 439589 - RNA, 19 nt, Homo sapiens
uuugacagauaacgcuuug

SEQ ID NO: 439590 - RNA, 19 nt, Homo sapiens
cucaacaaggcuucgauua

SEQ ID NO: 439591 - RNA, 19 nt, Homo sapiens
uguagaagguggagaugcu

SEQ ID NO: 439592 - RNA, 19 nt, Homo sapiens
aaggcaaggaggaagcuua

SEQ ID NO: 439593 - RNA, 19 nt, Homo sapiens
gguaaauacggcaucaucu

SEQ ID NO: 439594 - RNA, 19 nt, Homo sapiens
uuaacaugcugaggauugu

SEQ ID NO: 439595 - RNA, 19 nt, Homo sapiens
aaauuggcguuugucauca

SEQ ID NO: 439596 - RNA, 19 nt, Homo sapiens
ggaauuucgcagagcugaa

SEQ ID NO: 439597 - RNA, 19 nt, Homo sapiens
gaaucagagguaucaaugg

SEQ ID NO: 439598 - RNA, 19 nt, Homo sapiens
gggaggaccagaucaacag

SEQ ID NO: 439599 - RNA, 19 nt, Homo sapiens
cagauaacgcuuugauugc

SEQ ID NO: 439600 - RNA, 19 nt, Homo sapiens
caguaccugcucucaaauu

SEQ ID NO: 439601 - RNA, 19 nt, Homo sapiens
uggaggguguagaagagaa

SEQ ID NO: 439602 - RNA, 19 nt, Homo sapiens
aggcuuauuagaagaauga

SEQ ID NO: 439603 - RNA, 19 nt, Homo sapiens
ccagaucaacaggcuuauu

SEQ ID NO: 439604 - RNA, 19 nt, Homo sapiens
aggauuugauucaugagau

SEQ ID NO: 439605 - RNA, 19 nt, Homo sapiens
cauggaggauuugauucau

SEQ ID NO: 439606 - RNA, 19 nt, Homo sapiens
gguuauggcaaaaucaaua

SEQ ID NO: 439607 - RNA, 19 nt, Homo sapiens
uaaucuacaagcgugguua

SEQ ID NO: 439608 - RNA, 19 nt, Homo sapiens
uaacaugcugaggauugua

SEQ ID NO: 439609 - RNA, 19 nt, Homo sapiens
aaccauggaggguguagaa

SEQ ID NO: 439610 - RNA, 19 nt, Homo sapiens
uuugauugcucgaucucuu

SEQ ID NO: 439611 - RNA, 19 nt, Homo sapiens
cuaaagaacuugccacuaa

SEQ ID NO: 439612 - RNA, 19 nt, Homo sapiens
gaaagugccuccugcgauu

SEQ ID NO: 439613 - RNA, 19 nt, Homo sapiens
gaaagaaggccaagggaaa

SEQ ID NO: 439614 - RNA, 19 nt, Homo sapiens
uaaagaacuugccacuaaa

SEQ ID NO: 439615 - RNA, 19 nt, Homo sapiens
ccaauuacaaugacagaua

SEQ ID NO: 439616 - RNA, 19 nt, Homo sapiens
ggcaaaggcuaaagaacuu

SEQ ID NO: 439617 - RNA, 19 nt, Homo sapiens
gaagcuaucaggaccaauu

SEQ ID NO: 439618 - RNA, 19 nt, Homo sapiens
gcaauguccuggguccuaa

SEQ ID NO: 439619 - RNA, 19 nt, Homo sapiens
aauguacacuguugaguuu

SEQ ID NO: 439620 - RNA, 19 nt, Homo sapiens
agacaaagcaagagaagaa

SEQ ID NO: 439621 - RNA, 19 nt, Homo sapiens
gagaaaaggccuaagaauu

SEQ ID NO: 439622 - RNA, 19 nt, Homo sapiens
gaccagagacaaagcaaga

SEQ ID NO: 439623 - RNA, 19 nt, Homo sapiens
agaaaaggccuaagaauuu

SEQ ID NO: 439624 - RNA, 19 nt, Homo sapiens
gaagaagcagagacuguug

SEQ ID NO: 439625 - RNA, 19 nt, Homo sapiens
gagaagaagcagagacugu

SEQ ID NO: 439626 - RNA, 19 nt, Homo sapiens
ccaagaugccgaaaggaaa

SEQ ID NO: 439627 - RNA, 19 nt, Homo sapiens
caauuacaaugacagauac

SEQ ID NO: 439628 - RNA, 19 nt, Homo sapiens
ugacagauacgaugagauc

SEQ ID NO: 439629 - RNA, 19 nt, Homo sapiens
ggugaacucggaagacaaa

SEQ ID NO: 439630 - RNA, 19 nt, Homo sapiens
gagaccaccuguccuucga

SEQ ID NO: 439631 - RNA, 19 nt, Homo sapiens
cuaagucuguggcucguau

SEQ ID NO: 439632 - RNA, 19 nt, Homo sapiens
cgagcugguugucuucuug

SEQ ID NO: 439633 - RNA, 19 nt, Homo sapiens
ccaucgagcugguugucuu

SEQ ID NO: 439634 - RNA, 19 nt, Homo sapiens
guacagaccagagacaaag

SEQ ID NO: 439635 - RNA, 19 nt, Homo sapiens
gcuaaagaacuugccacua

SEQ ID NO: 439636 - RNA, 19 nt, Homo sapiens
uaucaggaccaauuacaau

SEQ ID NO: 439637 - RNA, 19 nt, Homo sapiens
caggugaacucggaagaca

SEQ ID NO: 439638 - RNA, 19 nt, Homo sapiens
aaauguacacuguugaguu

SEQ ID NO: 439639 - RNA, 19 nt, Homo sapiens
ucaggaccaauuacaauga

SEQ ID NO: 439640 - RNA, 19 nt, Homo sapiens
ucuauaagcggcugaaagu

SEQ ID NO: 439641 - RNA, 19 nt, Homo sapiens
caaagcaagagaagaagca

SEQ ID NO: 439642 - RNA, 19 nt, Homo sapiens
acaaugacagauacgauga

SEQ ID NO: 439643 - RNA, 19 nt, Homo sapiens
aagcuaucaggaccaauua

SEQ ID NO: 439644 - RNA, 19 nt, Homo sapiens
aaaggcaaaggcuaaagaa

SEQ ID NO: 439645 - RNA, 19 nt, Homo sapiens
gucccuuacugcauuauca

SEQ ID NO: 439646 - RNA, 19 nt, Homo sapiens
cuucuugccugcccugugu

SEQ ID NO: 439647 - RNA, 19 nt, Homo sapiens
ccagagacaaagcaagaga

SEQ ID NO: 439648 - RNA, 19 nt, Homo sapiens
gcaaaggcuaaagaacuug

SEQ ID NO: 439649 - RNA, 19 nt, Homo sapiens
caagaugccgaaaggaaag

SEQ ID NO: 439650 - RNA, 19 nt, Homo sapiens
gcuaucaggaccaauuaca

SEQ ID NO: 439651 - RNA, 19 nt, Homo sapiens
ggcaauguccuggguccua

SEQ ID NO: 439652 - RNA, 19 nt, Homo sapiens
agaagaagcagagacuguu

SEQ ID NO: 439653 - RNA, 19 nt, Homo sapiens
uaagcuggcccacaaguac

SEQ ID NO: 439654 - RNA, 19 nt, Homo sapiens
ggaagaccugcaccacugu

SEQ ID NO: 439655 - RNA, 19 nt, Homo sapiens
cuccugcgauuaaccaguu

SEQ ID NO: 439656 - RNA, 19 nt, Homo sapiens
ggacauccagcccaaaaga

SEQ ID NO: 439657 - RNA, 19 nt, Homo sapiens
cccaagaugccgaaaggaa

SEQ ID NO: 439658 - RNA, 19 nt, Homo sapiens
aaugacagauacgaugaga

SEQ ID NO: 439659 - RNA, 19 nt, Homo sapiens
gaccaauuacaaugacaga

SEQ ID NO: 439660 - RNA, 19 nt, Homo sapiens
aaagugccuccugcgauua

SEQ ID NO: 439661 - RNA, 19 nt, Homo sapiens
ugaauccccuguuugagaa

SEQ ID NO: 439662 - RNA, 19 nt, Homo sapiens
ugcuuaagcuggcccacaa

SEQ ID NO: 439663 - RNA, 19 nt, Homo sapiens
cagcugucgugaagaagca

SEQ ID NO: 439664 - RNA, 19 nt, Homo sapiens
uuaagcuggcccacaagua

SEQ ID NO: 439665 - RNA, 19 nt, Homo sapiens
gagacaaagcaagagaaga

SEQ ID NO: 439666 - RNA, 19 nt, Homo sapiens
cagagacaaagcaagagaa

SEQ ID NO: 439667 - RNA, 19 nt, Homo sapiens
gcaccacugucgccuucac

SEQ ID NO: 439668 - RNA, 19 nt, Homo sapiens
gcucagcugguggugauug

SEQ ID NO: 439669 - RNA, 19 nt, Homo sapiens
uuaacaccgucaccaccuu

SEQ ID NO: 439670 - RNA, 19 nt, Homo sapiens
gaaggccaagggaaagaag

SEQ ID NO: 439671 - RNA, 19 nt, Homo sapiens
gcaagagaagaagcagaga

SEQ ID NO: 439672 - RNA, 19 nt, Homo sapiens
ugccugcccugugucguaa

SEQ ID NO: 439673 - RNA, 19 nt, Homo sapiens
caaguacagaccagagaca

SEQ ID NO: 439674 - RNA, 19 nt, Homo sapiens
ggacggagcuguucauugc

SEQ ID NO: 439675 - RNA, 19 nt, Homo sapiens
gaacugcuggccacgagua

SEQ ID NO: 439676 - RNA, 19 nt, Homo sapiens
ccaagacugugcaggagaa

SEQ ID NO: 439677 - RNA, 19 nt, Homo sapiens
gcaagaaggcccagcucaa

SEQ ID NO: 439678 - RNA, 19 nt, Homo sapiens
ggagguggccgaauugaca

SEQ ID NO: 439679 - RNA, 19 nt, Homo sapiens
gaacuaugccaccguuauc

SEQ ID NO: 439680 - RNA, 19 nt, Homo sapiens
ggaacuaugccaccguuau

SEQ ID NO: 439681 - RNA, 19 nt, Homo sapiens
caaagugggucucauugcu

SEQ ID NO: 439682 - RNA, 19 nt, Homo sapiens
ucaagggcaucgucaagga

SEQ ID NO: 439683 - RNA, 19 nt, Homo sapiens
caagaagacccgugugaag

SEQ ID NO: 439684 - RNA, 19 nt, Homo sapiens
ugacaaacccaucuugaag

SEQ ID NO: 439685 - RNA, 19 nt, Homo sapiens
cgggauccguaucgguuua

SEQ ID NO: 439686 - RNA, 19 nt, Homo sapiens
gcacgugaagcaccguaaa

SEQ ID NO: 439687 - RNA, 19 nt, Homo sapiens
ggcuggagguggccgaauu

SEQ ID NO: 439688 - RNA, 19 nt, Homo sapiens
gaaggcccagcucaacauu

SEQ ID NO: 439689 - RNA, 19 nt, Homo sapiens
gagcggcacggcuacauca

SEQ ID NO: 439690 - RNA, 19 nt, Homo sapiens
aauauaaggcaaagaggaa

SEQ ID NO: 439691 - RNA, 19 nt, Homo sapiens
ccaagaagacccgugugaa

SEQ ID NO: 439692 - RNA, 19 nt, Homo sapiens
gggccucaauaaaguuugu

SEQ ID NO: 439693 - RNA, 19 nt, Homo sapiens
ccgcaaagugggucucauu

SEQ ID NO: 439694 - RNA, 19 nt, Homo sapiens
gaauugacaaacccaucuu

SEQ ID NO: 439695 - RNA, 19 nt, Homo sapiens
caagaaggcccagcucaac

SEQ ID NO: 439696 - RNA, 19 nt, Homo sapiens
ccaccguuaucucccacaa

SEQ ID NO: 439697 - RNA, 19 nt, Homo sapiens
gcuggagguggccgaauug

SEQ ID NO: 439698 - RNA, 19 nt, Homo sapiens
gaagcggacggagcuguuc

SEQ ID NO: 439699 - RNA, 19 nt, Homo sapiens
caucaagggcaucgucaag

SEQ ID NO: 439700 - RNA, 19 nt, Homo sapiens
gauccguaucgguuuaaga

SEQ ID NO: 439701 - RNA, 19 nt, Homo sapiens
cgaauugacaaacccaucu

SEQ ID NO: 439702 - RNA, 19 nt, Homo sapiens
caccaugccugaggguaca

SEQ ID NO: 439703 - RNA, 19 nt, Homo sapiens
ggacggagcuguucauugc

SEQ ID NO: 439704 - RNA, 19 nt, Homo sapiens
gaacugcuggccacgagua

SEQ ID NO: 439705 - RNA, 19 nt, Homo sapiens
ccaagacugugcaggagaa

SEQ ID NO: 439706 - RNA, 19 nt, Homo sapiens
gcaagaaggcccagcucaa

SEQ ID NO: 439707 - RNA, 19 nt, Homo sapiens
ggagguggccgaauugaca

SEQ ID NO: 439708 - RNA, 19 nt, Homo sapiens
gaacuaugccaccguuauc

SEQ ID NO: 439709 - RNA, 19 nt, Homo sapiens
ggaacuaugccaccguuau

SEQ ID NO: 439710 - RNA, 19 nt, Homo sapiens
caaagugggucucauugcu

SEQ ID NO: 439711 - RNA, 19 nt, Homo sapiens
ucaagggcaucgucaagga

SEQ ID NO: 439712 - RNA, 19 nt, Homo sapiens
caagaagacccgugugaag

SEQ ID NO: 439713 - RNA, 19 nt, Homo sapiens
ugacaaacccaucuugaag

SEQ ID NO: 439714 - RNA, 19 nt, Homo sapiens
cgggauccguaucgguuua

SEQ ID NO: 439715 - RNA, 19 nt, Homo sapiens
gcacgugaagcaccguaaa

SEQ ID NO: 439716 - RNA, 19 nt, Homo sapiens
ggcuggagguggccgaauu

SEQ ID NO: 439717 - RNA, 19 nt, Homo sapiens
gaaggcccagcucaacauu

SEQ ID NO: 439718 - RNA, 19 nt, Homo sapiens
gagcggcacggcuacauca

SEQ ID NO: 439719 - RNA, 19 nt, Homo sapiens
aauauaaggcaaagaggaa

SEQ ID NO: 439720 - RNA, 19 nt, Homo sapiens
ccaagaagacccgugugaa

SEQ ID NO: 439721 - RNA, 19 nt, Homo sapiens
gggccucaauaaaguuugu

SEQ ID NO: 439722 - RNA, 19 nt, Homo sapiens
ccgcaaagugggucucauu

SEQ ID NO: 439723 - RNA, 19 nt, Homo sapiens
gaauugacaaacccaucuu

SEQ ID NO: 439724 - RNA, 19 nt, Homo sapiens
caagaaggcccagcucaac

SEQ ID NO: 439725 - RNA, 19 nt, Homo sapiens
ccaccguuaucucccacaa

SEQ ID NO: 439726 - RNA, 19 nt, Homo sapiens
gcuggagguggccgaauug

SEQ ID NO: 439727 - RNA, 19 nt, Homo sapiens
gaagcggacggagcuguuc

SEQ ID NO: 439728 - RNA, 19 nt, Homo sapiens
caucaagggcaucgucaag

SEQ ID NO: 439729 - RNA, 19 nt, Homo sapiens
gauccguaucgguuuaaga

SEQ ID NO: 439730 - RNA, 19 nt, Homo sapiens
cgaauugacaaacccaucu

SEQ ID NO: 439731 - RNA, 19 nt, Homo sapiens
caccaugccugaggguaca

SEQ ID NO: 439732 - RNA, 19 nt, Homo sapiens
gaaagaagaugccagauga

SEQ ID NO: 439733 - RNA, 19 nt, Homo sapiens
ccagaaagaugaauuaauc

SEQ ID NO: 439734 - RNA, 19 nt, Homo sapiens
ggacuucaaucacaucaau

SEQ ID NO: 439735 - RNA, 19 nt, Homo sapiens
aaacaaggauaucaggaaa

SEQ ID NO: 439736 - RNA, 19 nt, Homo sapiens
gaugccagaugacacuuaa

SEQ ID NO: 439737 - RNA, 19 nt, Homo sapiens
acaaggauaucaggaaauu

SEQ ID NO: 439738 - RNA, 19 nt, Homo sapiens
agaguuaccuggcuacaga

SEQ ID NO: 439739 - RNA, 19 nt, Homo sapiens
gaccagguguugcuuguuc

SEQ ID NO: 439740 - RNA, 19 nt, Homo sapiens
caaucagacugucgacauu

SEQ ID NO: 439741 - RNA, 19 nt, Homo sapiens
acacugggcuuccguuaca

SEQ ID NO: 439742 - RNA, 19 nt, Homo sapiens
gggcuuccguuacaagaug

SEQ ID NO: 439743 - RNA, 19 nt, Homo sapiens
ugaagacuauucucagcaa

SEQ ID NO: 439744 - RNA, 19 nt, Homo sapiens
agaccuacuugugauauuu

SEQ ID NO: 439745 - RNA, 19 nt, Homo sapiens
uuaccuggcuacagaaaga

SEQ ID NO: 439746 - RNA, 19 nt, Homo sapiens
gaccuacuugugauauuua

SEQ ID NO: 439747 - RNA, 19 nt, Homo sapiens
gagaccagguguugcuugu

SEQ ID NO: 439748 - RNA, 19 nt, Homo sapiens
ggagggacuucaaucacau

SEQ ID NO: 439749 - RNA, 19 nt, Homo sapiens
agaugacacuuaagaccua

SEQ ID NO: 439750 - RNA, 19 nt, Homo sapiens
cugaagggacgcacaguua

SEQ ID NO: 439751 - RNA, 19 nt, Homo sapiens
aaagaccuauugauuugga

SEQ ID NO: 439752 - RNA, 19 nt, Homo sapiens
gaagacuauucucagcaau

SEQ ID NO: 439753 - RNA, 19 nt, Homo sapiens
gcaaucagacugucgacau

SEQ ID NO: 439754 - RNA, 19 nt, Homo sapiens
gaagaugccagaugacacu

SEQ ID NO: 439755 - RNA, 19 nt, Homo sapiens
caagaugaggucuguguau

SEQ ID NO: 439756 - RNA, 19 nt, Homo sapiens
gguguugcuuguucaguau

SEQ ID NO: 439757 - RNA, 19 nt, Homo sapiens
gaagggacgcacaguuauc

SEQ ID NO: 439758 - RNA, 19 nt, Homo sapiens
agacuauucucagcaauca

SEQ ID NO: 439759 - RNA, 19 nt, Homo sapiens
aaauucagcggcuuugauu

SEQ ID NO: 439760 - RNA, 19 nt, Homo sapiens
cggagggacuucaaucaca

SEQ ID NO: 439761 - RNA, 19 nt, Homo sapiens
guuacaagaugaggucugu

SEQ ID NO: 439762 - RNA, 19 nt, Homo sapiens
agaaagaagaugccagaug

SEQ ID NO: 439763 - RNA, 19 nt, Homo sapiens
cuuaagaccuacuugugau

SEQ ID NO: 439764 - RNA, 19 nt, Homo sapiens
aagaugaggucuguguaug

SEQ ID NO: 439765 - RNA, 19 nt, Homo sapiens
gcuccggguugacaaaugg

SEQ ID NO: 439766 - RNA, 19 nt, Homo sapiens
cugcgagaaugaagacuau

SEQ ID NO: 439767 - RNA, 19 nt, Homo sapiens
gaugaggucuguguaugcu

SEQ ID NO: 439768 - RNA, 19 nt, Homo sapiens
uaucucaagcccagaaaga

SEQ ID NO: 439769 - RNA, 19 nt, Homo sapiens
gcccagaaagaugaauuaa

SEQ ID NO: 439770 - RNA, 19 nt, Homo sapiens
ugaagggacgcacaguuau

SEQ ID NO: 439771 - RNA, 19 nt, Homo sapiens
agguguugcuuguucagua

SEQ ID NO: 439772 - RNA, 19 nt, Homo sapiens
guaucuaugucucugaaaa

SEQ ID NO: 439773 - RNA, 19 nt, Homo sapiens
uuaagaccuacuugugaua

SEQ ID NO: 439774 - RNA, 19 nt, Homo sapiens
gacgcacaguuaucgugaa

SEQ ID NO: 439775 - RNA, 19 nt, Homo sapiens
aagaccuacuugugauauu

SEQ ID NO: 439776 - RNA, 19 nt, Homo sapiens
uaagaccuacuugugauau

SEQ ID NO: 439777 - RNA, 19 nt, Homo sapiens
gaugagaccagguguugcu

SEQ ID NO: 439778 - RNA, 19 nt, Homo sapiens
cggaugagaccagguguug

SEQ ID NO: 439779 - RNA, 19 nt, Homo sapiens
aaaagaggcuccggguuga

SEQ ID NO: 439780 - RNA, 19 nt, Homo sapiens
ccgcaggguucggaugaga

SEQ ID NO: 439781 - RNA, 19 nt, Homo sapiens
uuacacugggcuuccguua

SEQ ID NO: 439782 - RNA, 19 nt, Homo sapiens
gcuaccguucggacuauuu

SEQ ID NO: 439783 - RNA, 19 nt, Homo sapiens
acuuaagaccuacuuguga

SEQ ID NO: 439784 - RNA, 19 nt, Homo sapiens
acacuuaagaccuacuugu

SEQ ID NO: 439785 - RNA, 19 nt, Homo sapiens
ugccagaugacacuuaaga

SEQ ID NO: 439786 - RNA, 19 nt, Homo sapiens
ugguaucuaugucucugaa

SEQ ID NO: 439787 - RNA, 19 nt, Homo sapiens
ucucaagcccagaaagaug

SEQ ID NO: 439788 - RNA, 19 nt, Homo sapiens
caaggauaucaggaaauuu

SEQ ID NO: 439789 - RNA, 19 nt, Homo sapiens
gaugaauuaauccuugaag

SEQ ID NO: 439790 - RNA, 19 nt, Homo sapiens
acaagaugaggucugugua

SEQ ID NO: 439791 - RNA, 19 nt, Homo sapiens
gcaccaagcugcagaacaa

SEQ ID NO: 439792 - RNA, 19 nt, Homo sapiens
gaacaaggagcaugugauu

SEQ ID NO: 439793 - RNA, 19 nt, Homo sapiens
uaacaggccugacugcauu

SEQ ID NO: 439794 - RNA, 19 nt, Homo sapiens
gaccugaacuauuguagaa

SEQ ID NO: 439795 - RNA, 19 nt, Homo sapiens
acaguuguguugcuuauua

SEQ ID NO: 439796 - RNA, 19 nt, Homo sapiens
gcagaagccuguaccaaca

SEQ ID NO: 439797 - RNA, 19 nt, Homo sapiens
ugucugaccugaacuauug

SEQ ID NO: 439798 - RNA, 19 nt, Homo sapiens
gaccagcagcguuuauuua

SEQ ID NO: 439799 - RNA, 19 nt, Homo sapiens
gccaauaaguacaugguaa

SEQ ID NO: 439800 - RNA, 19 nt, Homo sapiens
uuacauaacuggugcagau

SEQ ID NO: 439801 - RNA, 19 nt, Homo sapiens
gaacagcgcuggcuuuugg

SEQ ID NO: 439802 - RNA, 19 nt, Homo sapiens
gaaggaguuugauauagca

SEQ ID NO: 439803 - RNA, 19 nt, Homo sapiens
ggaaggaguuugauauagc

SEQ ID NO: 439804 - RNA, 19 nt, Homo sapiens
caugagggcuuccaaugug

SEQ ID NO: 439805 - RNA, 19 nt, Homo sapiens
acaaggagcaugugauuga

SEQ ID NO: 439806 - RNA, 19 nt, Homo sapiens
gggaaggaguuugauauag

SEQ ID NO: 439807 - RNA, 19 nt, Homo sapiens
gagcagcuguccucugaag

SEQ ID NO: 439808 - RNA, 19 nt, Homo sapiens
ccaaacauaccugggaaua

SEQ ID NO: 439809 - RNA, 19 nt, Homo sapiens
gcuaaccuuuggucauuug

SEQ ID NO: 439810 - RNA, 19 nt, Homo sapiens
caacacaugcggaccaaga

SEQ ID NO: 439811 - RNA, 19 nt, Homo sapiens
ggucuaggcuaaccuuugg

SEQ ID NO: 439812 - RNA, 19 nt, Homo sapiens
cagcagcguuuauuuagca

SEQ ID NO: 439813 - RNA, 19 nt, Homo sapiens
guggaugaguuuccgcuuu

SEQ ID NO: 439814 - RNA, 19 nt, Homo sapiens
aagcacagcugcagcaaag

SEQ ID NO: 439815 - RNA, 19 nt, Homo sapiens
uuccugaccucucuucuuu

SEQ ID NO: 439816 - RNA, 19 nt, Homo sapiens
ccaauaaguacaugguaaa

SEQ ID NO: 439817 - RNA, 19 nt, Homo sapiens
ccuggaggcugcccgaauu

SEQ ID NO: 439818 - RNA, 19 nt, Homo sapiens
ggaguuugauauagcagau

SEQ ID NO: 439819 - RNA, 19 nt, Homo sapiens
guagaacagcgcuggcuuu

SEQ ID NO: 439820 - RNA, 19 nt, Homo sapiens
caacucagcccugcucaug

SEQ ID NO: 439821 - RNA, 19 nt, Homo sapiens
ccaccuaugucuuuguauc

SEQ ID NO: 439822 - RNA, 19 nt, Homo sapiens
gaagacaugguggcugaaa

SEQ ID NO: 439823 - RNA, 19 nt, Homo sapiens
aaccuuuggucauuuguaa

SEQ ID NO: 439824 - RNA, 19 nt, Homo sapiens
cuacaguuguguugcuuau

SEQ ID NO: 439825 - RNA, 19 nt, Homo sapiens
ugucuacucuggagcuuga

SEQ ID NO: 439826 - RNA, 19 nt, Homo sapiens
ggucauugcccuuucacuu

SEQ ID NO: 439827 - RNA, 19 nt, Homo sapiens
guccaccuaugucuuugua

SEQ ID NO: 439828 - RNA, 19 nt, Homo sapiens
uuacagccauuucuuaggu

SEQ ID NO: 439829 - RNA, 19 nt, Homo sapiens
guaacaagaccucggaaca

SEQ ID NO: 439830 - RNA, 19 nt, Homo sapiens
caaugcugaugaauuugaa

SEQ ID NO: 439831 - RNA, 19 nt, Homo sapiens
uggaugaguuuccgcuuug

SEQ ID NO: 439832 - RNA, 19 nt, Homo sapiens
guucaccggauuauaauga

SEQ ID NO: 439833 - RNA, 19 nt, Homo sapiens
aggcuaaccuuuggucauu

SEQ ID NO: 439834 - RNA, 19 nt, Homo sapiens
ugaugaauuugaagacaug

SEQ ID NO: 439835 - RNA, 19 nt, Homo sapiens
guucacauuggccaaguua

SEQ ID NO: 439836 - RNA, 19 nt, Homo sapiens
ucuuaccaauccacaauaa

SEQ ID NO: 439837 - RNA, 19 nt, Homo sapiens
gaagcacagcugcagcaaa

SEQ ID NO: 439838 - RNA, 19 nt, Homo sapiens
ggugucagaugaauaugag

SEQ ID NO: 439839 - RNA, 19 nt, Homo sapiens
aacaagaccucggaacaga

SEQ ID NO: 439840 - RNA, 19 nt, Homo sapiens
augagcagcuguccucuga

SEQ ID NO: 439841 - RNA, 19 nt, Homo sapiens
gcagggccaaguucaaguu

SEQ ID NO: 439842 - RNA, 19 nt, Homo sapiens
uaacacaugacccuucuag

SEQ ID NO: 439843 - RNA, 19 nt, Homo sapiens
ucauugcccuuucacuuca

SEQ ID NO: 439844 - RNA, 19 nt, Homo sapiens
gcugaugaauuugaagaca

SEQ ID NO: 439845 - RNA, 19 nt, Homo sapiens
aaacauaccugggaauacc

SEQ ID NO: 439846 - RNA, 19 nt, Homo sapiens
ccugaacuauuguagaaca

SEQ ID NO: 439847 - RNA, 19 nt, Homo sapiens
cauggugucagaugaauau

SEQ ID NO: 439848 - RNA, 19 nt, Homo sapiens
ugauauagcagauuaacca

SEQ ID NO: 439849 - RNA, 19 nt, Homo sapiens
cagggaaggaguuugauau

SEQ ID NO: 439850 - RNA, 19 nt, Homo sapiens
uuagaugucugaccugaac

SEQ ID NO: 439851 - RNA, 19 nt, Homo sapiens
ucagggaaggaguuugaua

SEQ ID NO: 439852 - RNA, 19 nt, Homo sapiens
guuaacacaugacccuucu

SEQ ID NO: 439853 - RNA, 19 nt, Homo sapiens
ugaccagcagcguuuauuu

SEQ ID NO: 439854 - RNA, 19 nt, Homo sapiens
ccaauaaauucuacuuccu

SEQ ID NO: 439855 - RNA, 19 nt, Homo sapiens
ccauuggcauaucugcaaa

SEQ ID NO: 439856 - RNA, 19 nt, Homo sapiens
gggaaccuuugggucauug

SEQ ID NO: 439857 - RNA, 19 nt, Homo sapiens
cagauuaaccacccuccuu

SEQ ID NO: 439858 - RNA, 19 nt, Homo sapiens
guucucacccaucugguuu

SEQ ID NO: 439859 - RNA, 19 nt, Homo sapiens
ucacauuggccaaguuauc

SEQ ID NO: 439860 - RNA, 19 nt, Homo sapiens
ccacccuccuuguagcuau

SEQ ID NO: 439861 - RNA, 19 nt, Homo sapiens
agggaaggaguuugauaua

SEQ ID NO: 439862 - RNA, 19 nt, Homo sapiens
caaaauguuucccgguguu

SEQ ID NO: 439863 - RNA, 19 nt, Homo sapiens
cauaacuggugcagauuuu

SEQ ID NO: 439864 - RNA, 19 nt, Homo sapiens
acagccauuucuuagguuu

SEQ ID NO: 439865 - RNA, 19 nt, Homo sapiens
ggacaccuggguucacaca

SEQ ID NO: 439866 - RNA, 19 nt, Homo sapiens
uuccaaaccauaaauguga

SEQ ID NO: 439867 - RNA, 19 nt, Homo sapiens
cggauuauaaugagccaaa

SEQ ID NO: 439868 - RNA, 19 nt, Homo sapiens
auuguucaccggauuauaa

SEQ ID NO: 439869 - RNA, 19 nt, Homo sapiens
caagaccucggaacagaca

SEQ ID NO: 439870 - RNA, 19 nt, Homo sapiens
uaaccuuuggucauuugua

SEQ ID NO: 439871 - RNA, 19 nt, Homo sapiens
ggccuuaugucaguugucu

SEQ ID NO: 439872 - RNA, 19 nt, Homo sapiens
ccaaguucaaugcugauga

SEQ ID NO: 439873 - RNA, 19 nt, Homo sapiens
ccugaccucucuucuuugg

SEQ ID NO: 439874 - RNA, 19 nt, Homo sapiens
ccagggacaggacuccaaa

SEQ ID NO: 439875 - RNA, 19 nt, Homo sapiens
ggaugaguuuccgcuuugu

SEQ ID NO: 439876 - RNA, 19 nt, Homo sapiens
uaacaagaccucggaacag

SEQ ID NO: 439877 - RNA, 19 nt, Homo sapiens
ggcuaaccuuuggucauuu

SEQ ID NO: 439878 - RNA, 19 nt, Homo sapiens
ccaauccacaauaaacaug

SEQ ID NO: 439879 - RNA, 19 nt, Homo sapiens
gguuuccuggugauucuua

SEQ ID NO: 439880 - RNA, 19 nt, Homo sapiens
cagaacaaggagcauguga

SEQ ID NO: 439881 - RNA, 19 nt, Homo sapiens
guggagauguugccuugac

SEQ ID NO: 439882 - RNA, 19 nt, Homo sapiens
acauaacuggugcagauuu

SEQ ID NO: 439883 - RNA, 19 nt, Homo sapiens
caaggagcaugugauugag

SEQ ID NO: 439884 - RNA, 19 nt, Homo sapiens
ggugggaaucauccaggua

SEQ ID NO: 439885 - RNA, 19 nt, Homo sapiens
uaugucaguugucuacucu

SEQ ID NO: 439886 - RNA, 19 nt, Homo sapiens
gccaaguuaucauguccau

SEQ ID NO: 439887 - RNA, 19 nt, Homo sapiens
ccuguccaccuaugucuuu

SEQ ID NO: 439888 - RNA, 19 nt, Homo sapiens
uauuggggcuuaaugguuu

SEQ ID NO: 439889 - RNA, 19 nt, Homo sapiens
gggccaaguucaaguuucc

SEQ ID NO: 439890 - RNA, 19 nt, Homo sapiens
ccaagcugcagaacaagga

SEQ ID NO: 439891 - RNA, 19 nt, Homo sapiens
gaucauccuuccuggcaaa

SEQ ID NO: 439892 - RNA, 19 nt, Homo sapiens
cauccuuccuggcaaauaa

SEQ ID NO: 439893 - RNA, 19 nt, Homo sapiens
uaaaggugcgggaguauga

SEQ ID NO: 439894 - RNA, 19 nt, Homo sapiens
gaacuucgcauccgcaaac

SEQ ID NO: 439895 - RNA, 19 nt, Homo sapiens
gggaguaugaguuaagaaa

SEQ ID NO: 439896 - RNA, 19 nt, Homo sapiens
aaagcuagauacacuguca

SEQ ID NO: 439897 - RNA, 19 nt, Homo sapiens
gcgggaguaugaguuaaga

SEQ ID NO: 439898 - RNA, 19 nt, Homo sapiens
ggugcgggaguaugaguua

SEQ ID NO: 439899 - RNA, 19 nt, Homo sapiens
gagaguggagacagacuga

SEQ ID NO: 439900 - RNA, 19 nt, Homo sapiens
gucuaaaggugcgggagua

SEQ ID NO: 439901 - RNA, 19 nt, Homo sapiens
gauacacugucagauccuu

SEQ ID NO: 439902 - RNA, 19 nt, Homo sapiens
cuagauacacugucagauc

SEQ ID NO: 439903 - RNA, 19 nt, Homo sapiens
gguuccagcagaaguauga

SEQ ID NO: 439904 - RNA, 19 nt, Homo sapiens
ccggagaaaugaaaagauu

SEQ ID NO: 439905 - RNA, 19 nt, Homo sapiens
ucagauacuggaaacuuug

SEQ ID NO: 439906 - RNA, 19 nt, Homo sapiens
gugcgggaguaugaguuaa

SEQ ID NO: 439907 - RNA, 19 nt, Homo sapiens
ggcaaauaaauucccguuu

SEQ ID NO: 439908 - RNA, 19 nt, Homo sapiens
ccaaacacagaaucagcaa

SEQ ID NO: 439909 - RNA, 19 nt, Homo sapiens
caaacacagaaucagcaaa

SEQ ID NO: 439910 - RNA, 19 nt, Homo sapiens
caucauggcgcaggaucaa

SEQ ID NO: 439911 - RNA, 19 nt, Homo sapiens
ggcgcaggaucaaggugaa

SEQ ID NO: 439912 - RNA, 19 nt, Homo sapiens
ggcauccggagaaaugaaa

SEQ ID NO: 439913 - RNA, 19 nt, Homo sapiens
gaacagacaggcccagauu

SEQ ID NO: 439914 - RNA, 19 nt, Homo sapiens
ucagugggcuguaauguug

SEQ ID NO: 439915 - RNA, 19 nt, Homo sapiens
caucaaagcccucaaggaa

SEQ ID NO: 439916 - RNA, 19 nt, Homo sapiens
gaugagauugucaacauug

SEQ ID NO: 439917 - RNA, 19 nt, Homo sapiens
uaaaggaucauuugacaac

SEQ ID NO: 439918 - RNA, 19 nt, Homo sapiens
ugaugagauugucaacauu

SEQ ID NO: 439919 - RNA, 19 nt, Homo sapiens
acagacaggcccagauuga

SEQ ID NO: 439920 - RNA, 19 nt, Homo sapiens
gaugcggcaccgauccuua

SEQ ID NO: 439921 - RNA, 19 nt, Homo sapiens
aaaaguuggugaugacauu

SEQ ID NO: 439922 - RNA, 19 nt, Homo sapiens
gaucaucaaagcccucaag

SEQ ID NO: 439923 - RNA, 19 nt, Homo sapiens
gugggaauaucacuuuuga

SEQ ID NO: 439924 - RNA, 19 nt, Homo sapiens
cgagaucaaagucguauac

SEQ ID NO: 439925 - RNA, 19 nt, Homo sapiens
ggaggaggccaaggugcaa

SEQ ID NO: 439926 - RNA, 19 nt, Homo sapiens
aaggaucauuugacaacug

SEQ ID NO: 439927 - RNA, 19 nt, Homo sapiens
gucagugggcuguaauguu

SEQ ID NO: 439928 - RNA, 19 nt, Homo sapiens
ggagaaagcucgagucauc

SEQ ID NO: 439929 - RNA, 19 nt, Homo sapiens
caacaugucagaacuacua

SEQ ID NO: 439930 - RNA, 19 nt, Homo sapiens
ggaauggcauggucuugaa

SEQ ID NO: 439931 - RNA, 19 nt, Homo sapiens
ggauaaugcuuuacuuucu

SEQ ID NO: 439932 - RNA, 19 nt, Homo sapiens
gaagcacuguugguuguuu

SEQ ID NO: 439933 - RNA, 19 nt, Homo sapiens
aaagaaaucagccaugaaa

SEQ ID NO: 439934 - RNA, 19 nt, Homo sapiens
gauaaugcuuuacuuucug

SEQ ID NO: 439935 - RNA, 19 nt, Homo sapiens
auaaagaaaucagccauga

SEQ ID NO: 439936 - RNA, 19 nt, Homo sapiens
gagguuggcugggaguuca

SEQ ID NO: 439937 - RNA, 19 nt, Homo sapiens
guuagugacugauguaaaa

SEQ ID NO: 439938 - RNA, 19 nt, Homo sapiens
acuguugguuguuugguua

SEQ ID NO: 439939 - RNA, 19 nt, Homo sapiens
uaaagaaaucagccaugaa

SEQ ID NO: 439940 - RNA, 19 nt, Homo sapiens
ucagaguggacuuguguuu

SEQ ID NO: 439941 - RNA, 19 nt, Homo sapiens
uccggaacgucuauaagaa

SEQ ID NO: 439942 - RNA, 19 nt, Homo sapiens
guccggaacgucuauaaga

SEQ ID NO: 439943 - RNA, 19 nt, Homo sapiens
uguaaucccagcacuuuga

SEQ ID NO: 439944 - RNA, 19 nt, Homo sapiens
uugaagcacuguugguugu

SEQ ID NO: 439945 - RNA, 19 nt, Homo sapiens
gaaucagucggcagucaug

SEQ ID NO: 439946 - RNA, 19 nt, Homo sapiens
gccaacaugucagaacuac

SEQ ID NO: 439947 - RNA, 19 nt, Homo sapiens
gguuagugacugauguaaa

SEQ ID NO: 439948 - RNA, 19 nt, Homo sapiens
gcccggaccaucggcauuu

SEQ ID NO: 439949 - RNA, 19 nt, Homo sapiens
ggccaacaugucagaacua

SEQ ID NO: 439950 - RNA, 19 nt, Homo sapiens
cgaggaggcggaacaaguc

SEQ ID NO: 439951 - RNA, 19 nt, Homo sapiens
ggaaucagucggcagucau

SEQ ID NO: 439952 - RNA, 19 nt, Homo sapiens
uuucaaagccuucgcuagu

SEQ ID NO: 439953 - RNA, 19 nt, Homo sapiens
uggauaaugcuuuacuuuc

SEQ ID NO: 439954 - RNA, 19 nt, Homo sapiens
agcccuggauaaugcuuua

SEQ ID NO: 439955 - RNA, 19 nt, Homo sapiens
cuggauaaugcuuuacuuu

SEQ ID NO: 439956 - RNA, 19 nt, Homo sapiens
ccuggauaaugcuuuacuu

SEQ ID NO: 439957 - RNA, 19 nt, Homo sapiens
cggaauggcauggucuuga

SEQ ID NO: 439958 - RNA, 19 nt, Homo sapiens
guaccgcuccaaacucauc

SEQ ID NO: 439959 - RNA, 19 nt, Homo sapiens
gguuacagaggcugacuuc

SEQ ID NO: 439960 - RNA, 19 nt, Homo sapiens
aagcacuguugguuguuug

SEQ ID NO: 439961 - RNA, 19 nt, Homo sapiens
uggaaucagucggcaguca

SEQ ID NO: 439962 - RNA, 19 nt, Homo sapiens
cagccuggccaacauguca

SEQ ID NO: 439963 - RNA, 19 nt, Homo sapiens
ggagaaagcucgagucauc

SEQ ID NO: 439964 - RNA, 19 nt, Homo sapiens
caacaugucagaacuacua

SEQ ID NO: 439965 - RNA, 19 nt, Homo sapiens
ggaauggcauggucuugaa

SEQ ID NO: 439966 - RNA, 19 nt, Homo sapiens
ggauaaugcuuuacuuucu

SEQ ID NO: 439967 - RNA, 19 nt, Homo sapiens
gaagcacuguugguuguuu

SEQ ID NO: 439968 - RNA, 19 nt, Homo sapiens
aaagaaaucagccaugaaa

SEQ ID NO: 439969 - RNA, 19 nt, Homo sapiens
gauaaugcuuuacuuucug

SEQ ID NO: 439970 - RNA, 19 nt, Homo sapiens
auaaagaaaucagccauga

SEQ ID NO: 439971 - RNA, 19 nt, Homo sapiens
gagguuggcugggaguuca

SEQ ID NO: 439972 - RNA, 19 nt, Homo sapiens
guuagugacugauguaaaa

SEQ ID NO: 439973 - RNA, 19 nt, Homo sapiens
acuguugguuguuugguua

SEQ ID NO: 439974 - RNA, 19 nt, Homo sapiens
uaaagaaaucagccaugaa

SEQ ID NO: 439975 - RNA, 19 nt, Homo sapiens
ucagaguggacuuguguuu

SEQ ID NO: 439976 - RNA, 19 nt, Homo sapiens
uccggaacgucuauaagaa

SEQ ID NO: 439977 - RNA, 19 nt, Homo sapiens
guccggaacgucuauaaga

SEQ ID NO: 439978 - RNA, 19 nt, Homo sapiens
uguaaucccagcacuuuga

SEQ ID NO: 439979 - RNA, 19 nt, Homo sapiens
uugaagcacuguugguugu

SEQ ID NO: 439980 - RNA, 19 nt, Homo sapiens
gaaucagucggcagucaug

SEQ ID NO: 439981 - RNA, 19 nt, Homo sapiens
gccaacaugucagaacuac

SEQ ID NO: 439982 - RNA, 19 nt, Homo sapiens
gguuagugacugauguaaa

SEQ ID NO: 439983 - RNA, 19 nt, Homo sapiens
gcccggaccaucggcauuu

SEQ ID NO: 439984 - RNA, 19 nt, Homo sapiens
ggccaacaugucagaacua

SEQ ID NO: 439985 - RNA, 19 nt, Homo sapiens
cgaggaggcggaacaaguc

SEQ ID NO: 439986 - RNA, 19 nt, Homo sapiens
ggaaucagucggcagucau

SEQ ID NO: 439987 - RNA, 19 nt, Homo sapiens
uuucaaagccuucgcuagu

SEQ ID NO: 439988 - RNA, 19 nt, Homo sapiens
uggauaaugcuuuacuuuc

SEQ ID NO: 439989 - RNA, 19 nt, Homo sapiens
agcccuggauaaugcuuua

SEQ ID NO: 439990 - RNA, 19 nt, Homo sapiens
cuggauaaugcuuuacuuu

SEQ ID NO: 439991 - RNA, 19 nt, Homo sapiens
ccuggauaaugcuuuacuu

SEQ ID NO: 439992 - RNA, 19 nt, Homo sapiens
gguuacagaggcugacuuc

SEQ ID NO: 439993 - RNA, 19 nt, Homo sapiens
cggaauggcauggucuuga

SEQ ID NO: 439994 - RNA, 19 nt, Homo sapiens
guaccgcuccaaacucauc

SEQ ID NO: 439995 - RNA, 19 nt, Homo sapiens
aagcacuguugguuguuug

SEQ ID NO: 439996 - RNA, 19 nt, Homo sapiens
uggaaucagucggcaguca

SEQ ID NO: 439997 - RNA, 19 nt, Homo sapiens
cagccuggccaacauguca

SEQ ID NO: 439998 - RNA, 19 nt, Homo sapiens
gaugaaaccugcagcuuua

SEQ ID NO: 439999 - RNA, 19 nt, Homo sapiens
gcaaugcucugcugguuua

SEQ ID NO: 440000 - RNA, 19 nt, Homo sapiens
caagcaagguuacguuaua

SEQ ID NO: 440001 - RNA, 19 nt, Homo sapiens
ugacuuugcugacuuaauu

SEQ ID NO: 440002 - RNA, 19 nt, Homo sapiens
gaaguugaaugugcgauaa

SEQ ID NO: 440003 - RNA, 19 nt, Homo sapiens
gacaauaagugguggugua

SEQ ID NO: 440004 - RNA, 19 nt, Homo sapiens
gaaacuagcccuguagauu

SEQ ID NO: 440005 - RNA, 19 nt, Homo sapiens
ccacaaaguuggaccauca

SEQ ID NO: 440006 - RNA, 19 nt, Homo sapiens
ccauaaagcuaucagaaga

SEQ ID NO: 440007 - RNA, 19 nt, Homo sapiens
gcaguuauuucucuuguuc

SEQ ID NO: 440008 - RNA, 19 nt, Homo sapiens
gcaauaauguuugaagaca

SEQ ID NO: 440009 - RNA, 19 nt, Homo sapiens
aaacuagucugcagauguu

SEQ ID NO: 440010 - RNA, 19 nt, Homo sapiens
gcacccacuuugacuauga

SEQ ID NO: 440011 - RNA, 19 nt, Homo sapiens
ccacauugcauuucuguuu

SEQ ID NO: 440012 - RNA, 19 nt, Homo sapiens
caagaugggugcauacaag

SEQ ID NO: 440013 - RNA, 19 nt, Homo sapiens
aaacuagcccuguagauuu

SEQ ID NO: 440014 - RNA, 19 nt, Homo sapiens
gguguuauuugucuguuaa

SEQ ID NO: 440015 - RNA, 19 nt, Homo sapiens
gauaaauaccuuucaagug

SEQ ID NO: 440016 - RNA, 19 nt, Homo sapiens
gcaagguuacguuauauau

SEQ ID NO: 440017 - RNA, 19 nt, Homo sapiens
ugguguaucuuguuucuaa

SEQ ID NO: 440018 - RNA, 19 nt, Homo sapiens
gcagauguuucuugaaugc

SEQ ID NO: 440019 - RNA, 19 nt, Homo sapiens
gaagauuccacauacaaau

SEQ ID NO: 440020 - RNA, 19 nt, Homo sapiens
gccauuagauaaauaccuu

SEQ ID NO: 440021 - RNA, 19 nt, Homo sapiens
gcuuacagguguuauuugu

SEQ ID NO: 440022 - RNA, 19 nt, Homo sapiens
gaaguacucauagcaaguu

SEQ ID NO: 440023 - RNA, 19 nt, Homo sapiens
caacugaaggaauaaaugu

SEQ ID NO: 440024 - RNA, 19 nt, Homo sapiens
ggagaaggcgcaauacucu

SEQ ID NO: 440025 - RNA, 19 nt, Homo sapiens
acucauagcaaguucauaa

SEQ ID NO: 440026 - RNA, 19 nt, Homo sapiens
gugcaauaauguuugaaga

SEQ ID NO: 440027 - RNA, 19 nt, Homo sapiens
gauguuucuugaaugcuuu

SEQ ID NO: 440028 - RNA, 19 nt, Homo sapiens
auacuuaaccguaaugcua

SEQ ID NO: 440029 - RNA, 19 nt, Homo sapiens
cugcagauguuucuugaau

SEQ ID NO: 440030 - RNA, 19 nt, Homo sapiens
ucauugauccauuccauaa

SEQ ID NO: 440031 - RNA, 19 nt, Homo sapiens
gagacuagacuacuguugu

SEQ ID NO: 440032 - RNA, 19 nt, Homo sapiens
ccacuuugacuaugaguau

SEQ ID NO: 440033 - RNA, 19 nt, Homo sapiens
ugaugaaaccugcagcuuu

SEQ ID NO: 440034 - RNA, 19 nt, Homo sapiens
uuacagguguuauuugucu

SEQ ID NO: 440035 - RNA, 19 nt, Homo sapiens
ccaaaccaguccacaagca

SEQ ID NO: 440036 - RNA, 19 nt, Homo sapiens
gccaagcaagguuacguua

SEQ ID NO: 440037 - RNA, 19 nt, Homo sapiens
cacauugcauuucuguuug

SEQ ID NO: 440038 - RNA, 19 nt, Homo sapiens
uaaccguaaugcuaauugu

SEQ ID NO: 440039 - RNA, 19 nt, Homo sapiens
ccaguggccauuagauaaa

SEQ ID NO: 440040 - RNA, 19 nt, Homo sapiens
guggugguguaucuuguuu

SEQ ID NO: 440041 - RNA, 19 nt, Homo sapiens
gcuuggagaaggcgcaaua

SEQ ID NO: 440042 - RNA, 19 nt, Homo sapiens
ggagaugcgugggcugaca

SEQ ID NO: 440043 - RNA, 19 nt, Homo sapiens
uuuaaaugcucguucugaa

SEQ ID NO: 440044 - RNA, 19 nt, Homo sapiens
ccaggagacuagacuacug

SEQ ID NO: 440045 - RNA, 19 nt, Homo sapiens
aaauaccuuucaaguguga

SEQ ID NO: 440046 - RNA, 19 nt, Homo sapiens
aagccaagaugggugcaua

SEQ ID NO: 440047 - RNA, 19 nt, Homo sapiens
aaagagccguggccuugga

SEQ ID NO: 440048 - RNA, 19 nt, Homo sapiens
uugguaagcuagcaaugaa

SEQ ID NO: 440049 - RNA, 19 nt, Homo sapiens
ucauggcauucagugauua

SEQ ID NO: 440050 - RNA, 19 nt, Homo sapiens
aauaaguggugguguaucu

SEQ ID NO: 440051 - RNA, 19 nt, Homo sapiens
gugaagauuccacauacaa

SEQ ID NO: 440052 - RNA, 19 nt, Homo sapiens
ggugaagauuccacauaca

SEQ ID NO: 440053 - RNA, 19 nt, Homo sapiens
gguaagcuagcaaugaaug

SEQ ID NO: 440054 - RNA, 19 nt, Homo sapiens
uuuggcagguguagacuuu

SEQ ID NO: 440055 - RNA, 19 nt, Homo sapiens
augcucugcugguuuauuu

SEQ ID NO: 440056 - RNA, 19 nt, Homo sapiens
gaaaacgcccaguuccuaa

SEQ ID NO: 440057 - RNA, 19 nt, Homo sapiens
uuacuggguuggugaagau

SEQ ID NO: 440058 - RNA, 19 nt, Homo sapiens
ggaaguacucauagcaagu

SEQ ID NO: 440059 - RNA, 19 nt, Homo sapiens
caaaagacucaguuaauug

SEQ ID NO: 440060 - RNA, 19 nt, Homo sapiens
agauuugucuggugcaugu

SEQ ID NO: 440061 - RNA, 19 nt, Homo sapiens
aagcaagguuacguuauau

SEQ ID NO: 440062 - RNA, 19 nt, Homo sapiens
ugaaguugaaugugcgaua

SEQ ID NO: 440063 - RNA, 19 nt, Homo sapiens
ggugguguaucuuguuucu

SEQ ID NO: 440064 - RNA, 19 nt, Homo sapiens
ugaagauuccacauacaaa

SEQ ID NO: 440065 - RNA, 19 nt, Homo sapiens
aaagcuaucagaagaaauc

SEQ ID NO: 440066 - RNA, 19 nt, Homo sapiens
agacuagacuacuguuguc

SEQ ID NO: 440067 - RNA, 19 nt, Homo sapiens
ucacuugugcacccacuuu

SEQ ID NO: 440068 - RNA, 19 nt, Homo sapiens
cggcaagccuguccaucau

SEQ ID NO: 440069 - RNA, 19 nt, Homo sapiens
aacuagcccuguagauuug

SEQ ID NO: 440070 - RNA, 19 nt, Homo sapiens
acaaggccaagcaagguua

SEQ ID NO: 440071 - RNA, 19 nt, Homo sapiens
cauaaagcuaucagaagaa

SEQ ID NO: 440072 - RNA, 19 nt, Homo sapiens
gaaccaauuuucuccuauc

SEQ ID NO: 440073 - RNA, 19 nt, Homo sapiens
uaaguggugguguaucuug

SEQ ID NO: 440074 - RNA, 19 nt, Homo sapiens
cugaaggaauaaaugucua

SEQ ID NO: 440075 - RNA, 19 nt, Homo sapiens
ccaauuuucuccuaucuuc

SEQ ID NO: 440076 - RNA, 19 nt, Homo sapiens
gauccauuccauaaagcua

SEQ ID NO: 440077 - RNA, 19 nt, Homo sapiens
aaauguagacaaggaauug

SEQ ID NO: 440078 - RNA, 19 nt, Homo sapiens
uuauuagccuuaagauugg

SEQ ID NO: 440079 - RNA, 19 nt, Homo sapiens
uggcaaugcucugcugguu

SEQ ID NO: 440080 - RNA, 19 nt, Homo sapiens
aagaagcagucugauguca

SEQ ID NO: 440081 - RNA, 19 nt, Homo sapiens
ccucauugauccauuccau

SEQ ID NO: 440082 - RNA, 19 nt, Homo sapiens
ccaagcaagguuacguuau

SEQ ID NO: 440083 - RNA, 19 nt, Homo sapiens
ggagacuagacuacuguug

SEQ ID NO: 440084 - RNA, 19 nt, Homo sapiens
gcuauaaguacgucauucu

SEQ ID NO: 440085 - RNA, 19 nt, Homo sapiens
uaagauugguaagcuagca

SEQ ID NO: 440086 - RNA, 19 nt, Homo sapiens
uuucuugaaugcuuuguca

SEQ ID NO: 440087 - RNA, 19 nt, Homo sapiens
ucaacugaaggaauaaaug

SEQ ID NO: 440088 - RNA, 19 nt, Homo sapiens
uuaauuguguagagguugu

SEQ ID NO: 440089 - RNA, 19 nt, Homo sapiens
gaguauaccaccacauugc

SEQ ID NO: 440090 - RNA, 19 nt, Homo sapiens
acaagcgcaugguuuccaa

SEQ ID NO: 440091 - RNA, 19 nt, Homo sapiens
cuuaguccagucagucuua

SEQ ID NO: 440092 - RNA, 19 nt, Homo sapiens
ccuuucaagugugagcuua

SEQ ID NO: 440093 - RNA, 19 nt, Homo sapiens
ugccucagccuccacagua

SEQ ID NO: 440094 - RNA, 19 nt, Homo sapiens
ggcaaugcucugcugguuu

SEQ ID NO: 440095 - RNA, 19 nt, Homo sapiens
gaaaccugcagcuuuaucg

SEQ ID NO: 440096 - RNA, 19 nt, Homo sapiens
gucugcagauguuucuuga

SEQ ID NO: 440097 - RNA, 19 nt, Homo sapiens
gccaucagguaagccaaga

SEQ ID NO: 440098 - RNA, 19 nt, Homo sapiens
gggaguaaauucagcauua

SEQ ID NO: 440099 - RNA, 19 nt, Homo sapiens
gaacaaagcaccuaagaug

SEQ ID NO: 440100 - RNA, 19 nt, Homo sapiens
ggacaccuuuggauuaaua

SEQ ID NO: 440101 - RNA, 19 nt, Homo sapiens
ggaguaaauucagcauuaa

SEQ ID NO: 440102 - RNA, 19 nt, Homo sapiens
gaaacaguguguaccauuc

SEQ ID NO: 440103 - RNA, 19 nt, Homo sapiens
gaaaacaacuacucucuga

SEQ ID NO: 440104 - RNA, 19 nt, Homo sapiens
agaagaaacugaagaaaca

SEQ ID NO: 440105 - RNA, 19 nt, Homo sapiens
gaacuuaaggguuuagaug

SEQ ID NO: 440106 - RNA, 19 nt, Homo sapiens
gagaugauccuuacggaaa

SEQ ID NO: 440107 - RNA, 19 nt, Homo sapiens
guaaguacguauugacaga

SEQ ID NO: 440108 - RNA, 19 nt, Homo sapiens
uagauucucuggucauuga

SEQ ID NO: 440109 - RNA, 19 nt, Homo sapiens
guacguauugacagaauua

SEQ ID NO: 440110 - RNA, 19 nt, Homo sapiens
gcgaugauggcauuucuua

SEQ ID NO: 440111 - RNA, 19 nt, Homo sapiens
caucaaggguaugcauaua

SEQ ID NO: 440112 - RNA, 19 nt, Homo sapiens
uaagaacacucgugaaacu

SEQ ID NO: 440113 - RNA, 19 nt, Homo sapiens
gaaaaugguucgcuauuca

SEQ ID NO: 440114 - RNA, 19 nt, Homo sapiens
gaaaucaugcaaaucaaga

SEQ ID NO: 440115 - RNA, 19 nt, Homo sapiens
gaaaguauggcugcgauga

SEQ ID NO: 440116 - RNA, 19 nt, Homo sapiens
aaagauaucccagaagaaa

SEQ ID NO: 440117 - RNA, 19 nt, Homo sapiens
uaggacaccuuuggauuaa

SEQ ID NO: 440118 - RNA, 19 nt, Homo sapiens
gaguaaugcugaacuuaag

SEQ ID NO: 440119 - RNA, 19 nt, Homo sapiens
uguaguuacuggaagauaa

SEQ ID NO: 440120 - RNA, 19 nt, Homo sapiens
agaugucacuuuacagaaa

SEQ ID NO: 440121 - RNA, 19 nt, Homo sapiens
uuaggacaccuuuggauua

SEQ ID NO: 440122 - RNA, 19 nt, Homo sapiens
cggauuaacccauacauga

SEQ ID NO: 440123 - RNA, 19 nt, Homo sapiens
gagaguaaugcugaacuua

SEQ ID NO: 440124 - RNA, 19 nt, Homo sapiens
aagaggagguugcccagaa

SEQ ID NO: 440125 - RNA, 19 nt, Homo sapiens
augcugaacuuaaggguuu

SEQ ID NO: 440126 - RNA, 19 nt, Homo sapiens
ccacgaaguaucugaaaga

SEQ ID NO: 440127 - RNA, 19 nt, Homo sapiens
ggguuuagauguagauucu

SEQ ID NO: 440128 - RNA, 19 nt, Homo sapiens
guacuuuccucuaggugau

SEQ ID NO: 440129 - RNA, 19 nt, Homo sapiens
acuuaaggguuuagaugua

SEQ ID NO: 440130 - RNA, 19 nt, Homo sapiens
caaucuucguguucacuuu

SEQ ID NO: 440131 - RNA, 19 nt, Homo sapiens
ggagguugcccagaagaaa

SEQ ID NO: 440132 - RNA, 19 nt, Homo sapiens
agaguaaugcugaacuuaa

SEQ ID NO: 440133 - RNA, 19 nt, Homo sapiens
acacuguacuuuccucuag

SEQ ID NO: 440134 - RNA, 19 nt, Homo sapiens
guaguuacuggaagauaaa

SEQ ID NO: 440135 - RNA, 19 nt, Homo sapiens
cacgaaaucaugcaaauca

SEQ ID NO: 440136 - RNA, 19 nt, Homo sapiens
gaugauggcauuucuuagg

SEQ ID NO: 440137 - RNA, 19 nt, Homo sapiens
gaagaaacugaagaaacaa

SEQ ID NO: 440138 - RNA, 19 nt, Homo sapiens
uggcugcgaugauggcauu

SEQ ID NO: 440139 - RNA, 19 nt, Homo sapiens
uuuaagaacacucgugaaa

SEQ ID NO: 440140 - RNA, 19 nt, Homo sapiens
ucaugcaaaucaagagguu

SEQ ID NO: 440141 - RNA, 19 nt, Homo sapiens
gagcagcuguucgaaucau

SEQ ID NO: 440142 - RNA, 19 nt, Homo sapiens
cugagcagcuguucgaauc

SEQ ID NO: 440143 - RNA, 19 nt, Homo sapiens
agagaguaaugcugaacuu

SEQ ID NO: 440144 - RNA, 19 nt, Homo sapiens
caaggucgguggcccaaaa

SEQ ID NO: 440145 - RNA, 19 nt, Homo sapiens
ccugaggguugacuggauu

SEQ ID NO: 440146 - RNA, 19 nt, Homo sapiens
gaaaagccacgaaguaucu

SEQ ID NO: 440147 - RNA, 19 nt, Homo sapiens
uaagcagccugaggguuga

SEQ ID NO: 440148 - RNA, 19 nt, Homo sapiens
cagaagaaacugaagaaac

SEQ ID NO: 440149 - RNA, 19 nt, Homo sapiens
guuccaaucuucguguuca

SEQ ID NO: 440150 - RNA, 19 nt, Homo sapiens
gagcucauggucggauuaa

SEQ ID NO: 440151 - RNA, 19 nt, Homo sapiens
gugaacaaagcaccuaaga

SEQ ID NO: 440152 - RNA, 19 nt, Homo sapiens
gaugucacuuuacagaaac

SEQ ID NO: 440153 - RNA, 19 nt, Homo sapiens
aaucuucguguucacuuua

SEQ ID NO: 440154 - RNA, 19 nt, Homo sapiens
caaaucaagagguuccaau

SEQ ID NO: 440155 - RNA, 19 nt, Homo sapiens
ggauuaacccauacaugag

SEQ ID NO: 440156 - RNA, 19 nt, Homo sapiens
agaaacaguguguaccauu

SEQ ID NO: 440157 - RNA, 19 nt, Homo sapiens
guuuagauguagauucucu

SEQ ID NO: 440158 - RNA, 19 nt, Homo sapiens
aaguauggcugcgaugaug

SEQ ID NO: 440159 - RNA, 19 nt, Homo sapiens
uguagauucucuggucauu

SEQ ID NO: 440160 - RNA, 19 nt, Homo sapiens
ccagaagaaacugaagaaa

SEQ ID NO: 440161 - RNA, 19 nt, Homo sapiens
gccaucaaggguaugcaua

SEQ ID NO: 440162 - RNA, 19 nt, Homo sapiens
aaacugcucaggccaucaa

SEQ ID NO: 440163 - RNA, 19 nt, Homo sapiens
cccacgaaaucaugcaaau

SEQ ID NO: 440164 - RNA, 19 nt, Homo sapiens
cagaaacaguguguaccau

SEQ ID NO: 440165 - RNA, 19 nt, Homo sapiens
ccaucaaggguaugcauau

SEQ ID NO: 440166 - RNA, 19 nt, Homo sapiens
augguucgcuauucacuug

SEQ ID NO: 440167 - RNA, 19 nt, Homo sapiens
gcaaaucaagagguuccaa

SEQ ID NO: 440168 - RNA, 19 nt, Homo sapiens
cuuaaggguuuagauguag

SEQ ID NO: 440169 - RNA, 19 nt, Homo sapiens
cgaaaucaugcaaaucaag

SEQ ID NO: 440170 - RNA, 19 nt, Homo sapiens
gugcgcaggccaagcaaug

SEQ ID NO: 440171 - RNA, 19 nt, Homo sapiens
uguguaccauuccgacguu

SEQ ID NO: 440172 - RNA, 19 nt, Homo sapiens
gccacgaaguaucugaaag

SEQ ID NO: 440173 - RNA, 19 nt, Homo sapiens
acgaaaucaugcaaaucaa

SEQ ID NO: 440174 - RNA, 19 nt, Homo sapiens
ugaacaaagcaccuaagau

SEQ ID NO: 440175 - RNA, 19 nt, Homo sapiens
uuaaggguuuagauguaga

SEQ ID NO: 440176 - RNA, 19 nt, Homo sapiens
ugaaaaugguucgcuauuc

SEQ ID NO: 440177 - RNA, 19 nt, Homo sapiens
augauggcauuucuuagga

SEQ ID NO: 440178 - RNA, 19 nt, Homo sapiens
cagagcucauggucggauu

SEQ ID NO: 440179 - RNA, 19 nt, Homo sapiens
cuuaggacaccuuuggauu

SEQ ID NO: 440180 - RNA, 19 nt, Homo sapiens
guaccauuccgacguuaca

SEQ ID NO: 440181 - RNA, 19 nt, Homo sapiens
gaggagguugcccagaaga

SEQ ID NO: 440182 - RNA, 19 nt, Homo sapiens
caauggggcuggacacaag

SEQ ID NO: 440183 - RNA, 19 nt, Homo sapiens
uaggugaucugugaaaaug

SEQ ID NO: 440184 - RNA, 19 nt, Homo sapiens
uccucuaggugaucuguga

SEQ ID NO: 440185 - RNA, 19 nt, Homo sapiens
gaccauaacugaugaugug

SEQ ID NO: 440186 - RNA, 19 nt, Homo sapiens
uugaagagguuguuuauga

SEQ ID NO: 440187 - RNA, 19 nt, Homo sapiens
ggauccuacucucuuauua

SEQ ID NO: 440188 - RNA, 19 nt, Homo sapiens
gaagaaccaacuccacauu

SEQ ID NO: 440189 - RNA, 19 nt, Homo sapiens
uaacaaggaccgaaagguu

SEQ ID NO: 440190 - RNA, 19 nt, Homo sapiens
gcaagauccucacuuucga

SEQ ID NO: 440191 - RNA, 19 nt, Homo sapiens
gauccuacucucuuauuaa

SEQ ID NO: 440192 - RNA, 19 nt, Homo sapiens
ggaguggacauccgccaua

SEQ ID NO: 440193 - RNA, 19 nt, Homo sapiens
gaguggacauccgccauaa

SEQ ID NO: 440194 - RNA, 19 nt, Homo sapiens
gaaccaacuccacauucaa

SEQ ID NO: 440195 - RNA, 19 nt, Homo sapiens
ggacauccgccauaacaag

SEQ ID NO: 440196 - RNA, 19 nt, Homo sapiens
aaacuaacccuggauccua

SEQ ID NO: 440197 - RNA, 19 nt, Homo sapiens
agaaccaacuccacauuca

SEQ ID NO: 440198 - RNA, 19 nt, Homo sapiens
ccuggauccuacucucuua

SEQ ID NO: 440199 - RNA, 19 nt, Homo sapiens
ccaagagccaggauaucua

SEQ ID NO: 440200 - RNA, 19 nt, Homo sapiens
ggcuguuggucaaguuaua

SEQ ID NO: 440201 - RNA, 19 nt, Homo sapiens
cgagagguguaccggcauu

SEQ ID NO: 440202 - RNA, 19 nt, Homo sapiens
gcaagggccgagaggugua

SEQ ID NO: 440203 - RNA, 19 nt, Homo sapiens
aaacaagacggccgugguu

SEQ ID NO: 440204 - RNA, 19 nt, Homo sapiens
gaagagguuguuuaugagu

SEQ ID NO: 440205 - RNA, 19 nt, Homo sapiens
ugaagagguuguuuaugag

SEQ ID NO: 440206 - RNA, 19 nt, Homo sapiens
ggucaaguuauacagguuu

SEQ ID NO: 440207 - RNA, 19 nt, Homo sapiens
gaaagguucggcgcaagga

SEQ ID NO: 440208 - RNA, 19 nt, Homo sapiens
gaggcuguuggucaaguua

SEQ ID NO: 440209 - RNA, 19 nt, Homo sapiens
ggaccauaacugaugaugu

SEQ ID NO: 440210 - RNA, 19 nt, Homo sapiens
guggacauccgccauaaca

SEQ ID NO: 440211 - RNA, 19 nt, Homo sapiens
guguugaagagguuguuua

SEQ ID NO: 440212 - RNA, 19 nt, Homo sapiens
gagcccaagagccaggaua

SEQ ID NO: 440213 - RNA, 19 nt, Homo sapiens
caagagccaggauaucuac

SEQ ID NO: 440214 - RNA, 19 nt, Homo sapiens
gccauaacaaggaccgaaa

SEQ ID NO: 440215 - RNA, 19 nt, Homo sapiens
caagacggccgugguugug

SEQ ID NO: 440216 - RNA, 19 nt, Homo sapiens
ugaggcuguuggucaaguu

SEQ ID NO: 440217 - RNA, 19 nt, Homo sapiens
uaaagaagaugaagaaguc

SEQ ID NO: 440218 - RNA, 19 nt, Homo sapiens
guacuuuguaucucaguua

SEQ ID NO: 440219 - RNA, 19 nt, Homo sapiens
gcggagagcacgccaugaa

SEQ ID NO: 440220 - RNA, 19 nt, Homo sapiens
gcuacgagaguacaaggua

SEQ ID NO: 440221 - RNA, 19 nt, Homo sapiens
ccaagucccgcuucuggua

SEQ ID NO: 440222 - RNA, 19 nt, Homo sapiens
guaucucaguuaaagaaga

SEQ ID NO: 440223 - RNA, 19 nt, Homo sapiens
gugggcagguguuugagaa

SEQ ID NO: 440224 - RNA, 19 nt, Homo sapiens
ucaugaagguggaggagau

SEQ ID NO: 440225 - RNA, 19 nt, Homo sapiens
cgagcccacuccauucaga

SEQ ID NO: 440226 - RNA, 19 nt, Homo sapiens
gggcagguguuugagaagu

SEQ ID NO: 440227 - RNA, 19 nt, Homo sapiens
ucugguacuuuguaucuca

SEQ ID NO: 440228 - RNA, 19 nt, Homo sapiens
gaaucuuugcgccuaauca

SEQ ID NO: 440229 - RNA, 19 nt, Homo sapiens
gguacuuuguaucucaguu

SEQ ID NO: 440230 - RNA, 19 nt, Homo sapiens
gcgaaucuuugcgccuaau

SEQ ID NO: 440231 - RNA, 19 nt, Homo sapiens
ccacuccauucagaucaug

SEQ ID NO: 440232 - RNA, 19 nt, Homo sapiens
ccagugcuaccgagacaug

SEQ ID NO: 440233 - RNA, 19 nt, Homo sapiens
ggcagguguuugagaaguc

SEQ ID NO: 440234 - RNA, 19 nt, Homo sapiens
ccgcuucugguacuuugua

SEQ ID NO: 440235 - RNA, 19 nt, Homo sapiens
gcacgcuacgagaguacaa

SEQ ID NO: 440236 - RNA, 19 nt, Homo sapiens
gaagaucgaucgccacaug

SEQ ID NO: 440237 - RNA, 19 nt, Homo sapiens
uuacauagaucagccauua

SEQ ID NO: 440238 - RNA, 19 nt, Homo sapiens
gaagagaccaagaaauaaa

SEQ ID NO: 440239 - RNA, 19 nt, Homo sapiens
ggaagagaccaagaaauaa

SEQ ID NO: 440240 - RNA, 19 nt, Homo sapiens
aggaagagaccaagaaaua

SEQ ID NO: 440241 - RNA, 19 nt, Homo sapiens
gcaagaagaaggucugguu

SEQ ID NO: 440242 - RNA, 19 nt, Homo sapiens
gagaaggucacauggauga

SEQ ID NO: 440243 - RNA, 19 nt, Homo sapiens
ccaaugagaccaaugaaau

SEQ ID NO: 440244 - RNA, 19 nt, Homo sapiens
caagaagaaggucugguua

SEQ ID NO: 440245 - RNA, 19 nt, Homo sapiens
auacuggccucugugauua

SEQ ID NO: 440246 - RNA, 19 nt, Homo sapiens
ccaaugaaaucgccaaugc

SEQ ID NO: 440247 - RNA, 19 nt, Homo sapiens
cagagaaggucacauggau

SEQ ID NO: 440248 - RNA, 19 nt, Homo sapiens
ggaggaagagaccaagaaa

SEQ ID NO: 440249 - RNA, 19 nt, Homo sapiens
ucacauggaugaggagaau

SEQ ID NO: 440250 - RNA, 19 nt, Homo sapiens
agaagaaggucugguuaga

SEQ ID NO: 440251 - RNA, 19 nt, Homo sapiens
gaggagaucaucaagacuu

SEQ ID NO: 440252 - RNA, 19 nt, Homo sapiens
uccggaagcucaucaaaga

SEQ ID NO: 440253 - RNA, 19 nt, Homo sapiens
gagaucaucaagacuuuau

SEQ ID NO: 440254 - RNA, 19 nt, Homo sapiens
cauacuggccucugugauu

SEQ ID NO: 440255 - RNA, 19 nt, Homo sapiens
ggagaucaucaagacuuua

SEQ ID NO: 440256 - RNA, 19 nt, Homo sapiens
acauagaucagccauuaaa

SEQ ID NO: 440257 - RNA, 19 nt, Homo sapiens
uggccucugugauuacaua

SEQ ID NO: 440258 - RNA, 19 nt, Homo sapiens
gaaauaaaaccucccacuu

SEQ ID NO: 440259 - RNA, 19 nt, Homo sapiens
gcacaugggcauagguaag

SEQ ID NO: 440260 - RNA, 19 nt, Homo sapiens
aauaaaaccucccacuuug

SEQ ID NO: 440261 - RNA, 19 nt, Homo sapiens
caagcggauucucauggaa

SEQ ID NO: 440262 - RNA, 19 nt, Homo sapiens
ccucugugauuacauagau

SEQ ID NO: 440263 - RNA, 19 nt, Homo sapiens
ucaagacuuuauccaagga

SEQ ID NO: 440264 - RNA, 19 nt, Homo sapiens
gaaggggaauguguucaaa

SEQ ID NO: 440265 - RNA, 19 nt, Homo sapiens
gcucagaagauaccgugaa

SEQ ID NO: 440266 - RNA, 19 nt, Homo sapiens
acaagcggauucucaugga

SEQ ID NO: 440267 - RNA, 19 nt, Homo sapiens
uaccgugaaucuaagaaga

SEQ ID NO: 440268 - RNA, 19 nt, Homo sapiens
gcggaaggguacagccaau

SEQ ID NO: 440269 - RNA, 19 nt, Homo sapiens
aaauaaaaccucccacuuu

SEQ ID NO: 440270 - RNA, 19 nt, Homo sapiens
caaugagaccaaugaaauc

SEQ ID NO: 440271 - RNA, 19 nt, Homo sapiens
gaaggaggagaucaucaag

SEQ ID NO: 440272 - RNA, 19 nt, Homo sapiens
gaucgaucgccacauguau

SEQ ID NO: 440273 - RNA, 19 nt, Homo sapiens
gaggaagagaccaagaaau

SEQ ID NO: 440274 - RNA, 19 nt, Homo sapiens
aggagaucaucaagacuuu

SEQ ID NO: 440275 - RNA, 19 nt, Homo sapiens
gauccggaagcucaucaaa

SEQ ID NO: 440276 - RNA, 19 nt, Homo sapiens
agaaggaggagaucaucaa

SEQ ID NO: 440277 - RNA, 19 nt, Homo sapiens
gccggcugcucagaagaua

SEQ ID NO: 440278 - RNA, 19 nt, Homo sapiens
ccagagaaggucacaugga

SEQ ID NO: 440279 - RNA, 19 nt, Homo sapiens
ccaagaaggaggagaucau

SEQ ID NO: 440280 - RNA, 19 nt, Homo sapiens
ccaaggaggaagagaccaa

SEQ ID NO: 440281 - RNA, 19 nt, Homo sapiens
aggaggagaucaucaagac

SEQ ID NO: 440282 - RNA, 19 nt, Homo sapiens
caacucccgucagcagauc

SEQ ID NO: 440283 - RNA, 19 nt, Homo sapiens
guacagccaaugcccgaau

SEQ ID NO: 440284 - RNA, 19 nt, Homo sapiens
gaucgccacauguaucaca

SEQ ID NO: 440285 - RNA, 19 nt, Homo sapiens
ggaaggguacagccaaugc

SEQ ID NO: 440286 - RNA, 19 nt, Homo sapiens
ucaaagaugggcugaucau

SEQ ID NO: 440287 - RNA, 19 nt, Homo sapiens
caagaaggaggagaucauc

SEQ ID NO: 440288 - RNA, 19 nt, Homo sapiens
aaacaagcggauucucaug

SEQ ID NO: 440289 - RNA, 19 nt, Homo sapiens
cucagaagauaccgugaau

SEQ ID NO: 440290 - RNA, 19 nt, Homo sapiens
ucaucaagacuuuauccaa

SEQ ID NO: 440291 - RNA, 19 nt, Homo sapiens
augaggagaaugaggauuu

SEQ ID NO: 440292 - RNA, 19 nt, Homo sapiens
acauggaugaggagaauga

SEQ ID NO: 440293 - RNA, 19 nt, Homo sapiens
gcaggcacaugggcauagg

SEQ ID NO: 440294 - RNA, 19 nt, Homo sapiens
gggcaggcacaugggcaua

SEQ ID NO: 440295 - RNA, 19 nt, Homo sapiens
guccuccgcuguggcaaga

SEQ ID NO: 440296 - RNA, 19 nt, Homo sapiens
gaaagaagccaaagagaaa

SEQ ID NO: 440297 - RNA, 19 nt, Homo sapiens
cgagauagcuuccugaaac

SEQ ID NO: 440298 - RNA, 19 nt, Homo sapiens
guaccuggguucaacuaaa

SEQ ID NO: 440299 - RNA, 19 nt, Homo sapiens
gggaauggguacuguucaa

SEQ ID NO: 440300 - RNA, 19 nt, Homo sapiens
agaaagaagccaaagagaa

SEQ ID NO: 440301 - RNA, 19 nt, Homo sapiens
gagaggcacccgauauaug

SEQ ID NO: 440302 - RNA, 19 nt, Homo sapiens
caaguuaagggcaagauuc

SEQ ID NO: 440303 - RNA, 19 nt, Homo sapiens
ggaauggguacuguucaaa

SEQ ID NO: 440304 - RNA, 19 nt, Homo sapiens
gaaagguaccuggguucaa

SEQ ID NO: 440305 - RNA, 19 nt, Homo sapiens
gaagccaaagagaaaggua

SEQ ID NO: 440306 - RNA, 19 nt, Homo sapiens
aaagaaagaagccaaagag

SEQ ID NO: 440307 - RNA, 19 nt, Homo sapiens
acauggaguuguuccuuug

SEQ ID NO: 440308 - RNA, 19 nt, Homo sapiens
cccgauauauguucucuag

SEQ ID NO: 440309 - RNA, 19 nt, Homo sapiens
ugacgaacacaaagggaaa

SEQ ID NO: 440310 - RNA, 19 nt, Homo sapiens
aaagguaccuggguucaac

SEQ ID NO: 440311 - RNA, 19 nt, Homo sapiens
ucaagggaauggguacugu

SEQ ID NO: 440312 - RNA, 19 nt, Homo sapiens
agaggcacccgauauaugu

SEQ ID NO: 440313 - RNA, 19 nt, Homo sapiens
caaguguuaccauggcaaa

SEQ ID NO: 440314 - RNA, 19 nt, Homo sapiens
uaccuggguucaacuaaag

SEQ ID NO: 440315 - RNA, 19 nt, Homo sapiens
uggcauaauagguguuaaa

SEQ ID NO: 440316 - RNA, 19 nt, Homo sapiens
gagcugcuggaaccuauuc

SEQ ID NO: 440317 - RNA, 19 nt, Homo sapiens
aaggugauauuguagacau

SEQ ID NO: 440318 - RNA, 19 nt, Homo sapiens
cauggcauaauagguguua

SEQ ID NO: 440319 - RNA, 19 nt, Homo sapiens
ugaauucauggcauaauag

SEQ ID NO: 440320 - RNA, 19 nt, Homo sapiens
ccaaaaugacgaacacaaa

SEQ ID NO: 440321 - RNA, 19 nt, Homo sapiens
gaauggguacuguucaaaa

SEQ ID NO: 440322 - RNA, 19 nt, Homo sapiens
guaaacaaacaaguuaagg

SEQ ID NO: 440323 - RNA, 19 nt, Homo sapiens
gaauucauggcauaauagg

SEQ ID NO: 440324 - RNA, 19 nt, Homo sapiens
caagggaauggguacuguu

SEQ ID NO: 440325 - RNA, 19 nt, Homo sapiens
aagaaagaagccaaagaga

SEQ ID NO: 440326 - RNA, 19 nt, Homo sapiens
ggaagacgaggauuaaauu

SEQ ID NO: 440327 - RNA, 19 nt, Homo sapiens
uuacguuacuuccagauua

SEQ ID NO: 440328 - RNA, 19 nt, Homo sapiens
guucgccacucauuuauuu

SEQ ID NO: 440329 - RNA, 19 nt, Homo sapiens
gaaguucacucuugauugc

SEQ ID NO: 440330 - RNA, 19 nt, Homo sapiens
ggaggaagacgaggauuaa

SEQ ID NO: 440331 - RNA, 19 nt, Homo sapiens
gaagaagaauaaucuacgu

SEQ ID NO: 440332 - RNA, 19 nt, Homo sapiens
gaagacgaggauuaaauuu

SEQ ID NO: 440333 - RNA, 19 nt, Homo sapiens
gaagcaaguucugaaguuc

SEQ ID NO: 440334 - RNA, 19 nt, Homo sapiens
agacgaggauuaaauuuca

SEQ ID NO: 440335 - RNA, 19 nt, Homo sapiens
cgccauggcuccugugaaa

SEQ ID NO: 440336 - RNA, 19 nt, Homo sapiens
cgaggugccuuucuccaaa

SEQ ID NO: 440337 - RNA, 19 nt, Homo sapiens
uguagaagauggaaucaug

SEQ ID NO: 440338 - RNA, 19 nt, Homo sapiens
gcacccacccuguagaaga

SEQ ID NO: 440339 - RNA, 19 nt, Homo sapiens
gccacucauuuauuuguaa

SEQ ID NO: 440340 - RNA, 19 nt, Homo sapiens
ggacgaagaagaggaggaa

SEQ ID NO: 440341 - RNA, 19 nt, Homo sapiens
uacguuacuuccagauuaa

SEQ ID NO: 440342 - RNA, 19 nt, Homo sapiens
ucauggaugcugccaauuu

SEQ ID NO: 440343 - RNA, 19 nt, Homo sapiens
aaucauggaugcugccaau

SEQ ID NO: 440344 - RNA, 19 nt, Homo sapiens
caguguggauugaacagaa

SEQ ID NO: 440345 - RNA, 19 nt, Homo sapiens
gaauaaaacuugggaacca

SEQ ID NO: 440346 - RNA, 19 nt, Homo sapiens
gauuaaccaggacgaagaa

SEQ ID NO: 440347 - RNA, 19 nt, Homo sapiens
gaacagaaaauuggaaauc

SEQ ID NO: 440348 - RNA, 19 nt, Homo sapiens
ugacauccgaggugccuuu

SEQ ID NO: 440349 - RNA, 19 nt, Homo sapiens
aggaggaagacgaggauua

SEQ ID NO: 440350 - RNA, 19 nt, Homo sapiens
cauggaugcugccaauuuu

SEQ ID NO: 440351 - RNA, 19 nt, Homo sapiens
cgccacucauuuauuugua

SEQ ID NO: 440352 - RNA, 19 nt, Homo sapiens
gaggaagacgaggauuaaa

SEQ ID NO: 440353 - RNA, 19 nt, Homo sapiens
cacccacccuguagaagau

SEQ ID NO: 440354 - RNA, 19 nt, Homo sapiens
uugguucgccacucauuua

SEQ ID NO: 440355 - RNA, 19 nt, Homo sapiens
gguuuauccuuguaucucu

SEQ ID NO: 440356 - RNA, 19 nt, Homo sapiens
cauccgaggugccuuucuc

SEQ ID NO: 440357 - RNA, 19 nt, Homo sapiens
uaaccaggacgaagaagag

SEQ ID NO: 440358 - RNA, 19 nt, Homo sapiens
ucucugcaguguggauuga

SEQ ID NO: 440359 - RNA, 19 nt, Homo sapiens
ccuuguaucucugcagugu

SEQ ID NO: 440360 - RNA, 19 nt, Homo sapiens
ugauugcacccacccugua

SEQ ID NO: 440361 - RNA, 19 nt, Homo sapiens
gacgaggauuaaauuucau

SEQ ID NO: 440362 - RNA, 19 nt, Homo sapiens
aggaagacgaggauuaaau

SEQ ID NO: 440363 - RNA, 19 nt, Homo sapiens
ccacucauuuauuuguaac

SEQ ID NO: 440364 - RNA, 19 nt, Homo sapiens
ggugguuuauccuuguauc

SEQ ID NO: 440365 - RNA, 19 nt, Homo sapiens
aagacgaggauuaaauuuc

SEQ ID NO: 440366 - RNA, 19 nt, Homo sapiens
cggaaaagcugggaaccuu

SEQ ID NO: 440367 - RNA, 19 nt, Homo sapiens
agauuaaccaggacgaaga

SEQ ID NO: 440368 - RNA, 19 nt, Homo sapiens
aguguggauugaacagaaa

SEQ ID NO: 440369 - RNA, 19 nt, Homo sapiens
aauggugguuuauccuugu

SEQ ID NO: 440370 - RNA, 19 nt, Homo sapiens
gaggugccuuucuccaaaa

SEQ ID NO: 440371 - RNA, 19 nt, Homo sapiens
uagaagauggaaucaugga

SEQ ID NO: 440372 - RNA, 19 nt, Homo sapiens
uuacgaauuacguuacuuc

SEQ ID NO: 440373 - RNA, 19 nt, Homo sapiens
gguugcgcguaguugcuaa

SEQ ID NO: 440374 - RNA, 19 nt, Homo sapiens
gaaacaagcuugaccacua

SEQ ID NO: 440375 - RNA, 19 nt, Homo sapiens
ugaagaagcuguaugacau

SEQ ID NO: 440376 - RNA, 19 nt, Homo sapiens
ccaacaagcaccagauuaa

SEQ ID NO: 440377 - RNA, 19 nt, Homo sapiens
gaagaaggcauauguucga

SEQ ID NO: 440378 - RNA, 19 nt, Homo sapiens
ugaagaagauagaagacaa

SEQ ID NO: 440379 - RNA, 19 nt, Homo sapiens
gaagauagaagacaacaac

SEQ ID NO: 440380 - RNA, 19 nt, Homo sapiens
aaacaagcuugaccacuau

SEQ ID NO: 440381 - RNA, 19 nt, Homo sapiens
gagagaagaaggcauaugu

SEQ ID NO: 440382 - RNA, 19 nt, Homo sapiens
gaguccagcugccuaauuc

SEQ ID NO: 440383 - RNA, 19 nt, Homo sapiens
gaagcuguaugacauugau

SEQ ID NO: 440384 - RNA, 19 nt, Homo sapiens
gagaagaaggcauauguuc

SEQ ID NO: 440385 - RNA, 19 nt, Homo sapiens
gaagaagcuguaugacauu

SEQ ID NO: 440386 - RNA, 19 nt, Homo sapiens
caagaaggcaguguugaaa

SEQ ID NO: 440387 - RNA, 19 nt, Homo sapiens
caacaagcaccagauuaaa

SEQ ID NO: 440388 - RNA, 19 nt, Homo sapiens
ggagacagcccaaauaucc

SEQ ID NO: 440389 - RNA, 19 nt, Homo sapiens
gauagaagacaacaacaca

SEQ ID NO: 440390 - RNA, 19 nt, Homo sapiens
gggaucaucuaaacugagu

SEQ ID NO: 440391 - RNA, 19 nt, Homo sapiens
gccaacaagcaccagauua

SEQ ID NO: 440392 - RNA, 19 nt, Homo sapiens
ccaagaaggcaguguugaa

SEQ ID NO: 440393 - RNA, 19 nt, Homo sapiens
uccuaaagcugaagccaaa

SEQ ID NO: 440394 - RNA, 19 nt, Homo sapiens
ccacugagucugccaugaa

SEQ ID NO: 440395 - RNA, 19 nt, Homo sapiens
ccaaauauccucggaagag

SEQ ID NO: 440396 - RNA, 19 nt, Homo sapiens
aaauugggaucaucuaaac

SEQ ID NO: 440397 - RNA, 19 nt, Homo sapiens
uuacgaugcuuuggauguu

SEQ ID NO: 440398 - RNA, 19 nt, Homo sapiens
ugauuacgaugcuuuggau

SEQ ID NO: 440399 - RNA, 19 nt, Homo sapiens
gugaagaagcuguaugaca

SEQ ID NO: 440400 - RNA, 19 nt, Homo sapiens
ccaugaagaagauagaaga

SEQ ID NO: 440401 - RNA, 19 nt, Homo sapiens
ugaccacuaugcuaucauc

SEQ ID NO: 440402 - RNA, 19 nt, Homo sapiens
ccagcugccuaauucugaa

SEQ ID NO: 440403 - RNA, 19 nt, Homo sapiens
caaggucaacacccugauu

SEQ ID NO: 440404 - RNA, 19 nt, Homo sapiens
agaaggcaguguugaaagg

SEQ ID NO: 440405 - RNA, 19 nt, Homo sapiens
gaagaagauagaagacaac

SEQ ID NO: 440406 - RNA, 19 nt, Homo sapiens
aagaagcuguaugacauug

SEQ ID NO: 440407 - RNA, 19 nt, Homo sapiens
acaagcaccagauuaaaca

SEQ ID NO: 440408 - RNA, 19 nt, Homo sapiens
caacaaaauugggaucauc

SEQ ID NO: 440409 - RNA, 19 nt, Homo sapiens
ggagagaagaaggcauaug

SEQ ID NO: 440410 - RNA, 19 nt, Homo sapiens
ccggagacagcccaaauau

SEQ ID NO: 440411 - RNA, 19 nt, Homo sapiens
ucgacuggcuccugauuac

SEQ ID NO: 440412 - RNA, 19 nt, Homo sapiens
guucauuguggauguuaaa

SEQ ID NO: 440413 - RNA, 19 nt, Homo sapiens
caaaauugggaucaucuaa

SEQ ID NO: 440414 - RNA, 19 nt, Homo sapiens
ggccaagaaggcaguguug

SEQ ID NO: 440415 - RNA, 19 nt, Homo sapiens
ugaguccagcugccuaauu

SEQ ID NO: 440416 - RNA, 19 nt, Homo sapiens
agucugccaugaagaagau

SEQ ID NO: 440417 - RNA, 19 nt, Homo sapiens
ggagacccuuuucacaaga

SEQ ID NO: 440418 - RNA, 19 nt, Homo sapiens
aagcuugaccacuaugcua

SEQ ID NO: 440419 - RNA, 19 nt, Homo sapiens
ccaggagaaacaagcuuga

SEQ ID NO: 440420 - RNA, 19 nt, Homo sapiens
agagaagaaggcauauguu

SEQ ID NO: 440421 - RNA, 19 nt, Homo sapiens
ggccugauggagagaagaa

SEQ ID NO: 440422 - RNA, 19 nt, Homo sapiens
gccgaaagcgaagaaggaa

SEQ ID NO: 440423 - RNA, 19 nt, Homo sapiens
gaaggcaguguugaaaggu

SEQ ID NO: 440424 - RNA, 19 nt, Homo sapiens
cagcauggcucuaacaaga

SEQ ID NO: 440425 - RNA, 19 nt, Homo sapiens
gagaagagaucacagaaac

SEQ ID NO: 440426 - RNA, 19 nt, Homo sapiens
gaaccaacuucuucauuca

SEQ ID NO: 440427 - RNA, 19 nt, Homo sapiens
ggguggaccucaggaauua

SEQ ID NO: 440428 - RNA, 19 nt, Homo sapiens
ucaagaagccggacuacaa

SEQ ID NO: 440429 - RNA, 19 nt, Homo sapiens
cgaaccaacuucuucauuc

SEQ ID NO: 440430 - RNA, 19 nt, Homo sapiens
gagcagucccgacaccuaa

SEQ ID NO: 440431 - RNA, 19 nt, Homo sapiens
caagagaagagaucacaga

SEQ ID NO: 440432 - RNA, 19 nt, Homo sapiens
gaaacgugaggaucaagaa

SEQ ID NO: 440433 - RNA, 19 nt, Homo sapiens
gaagagaucacagaaacgu

SEQ ID NO: 440434 - RNA, 19 nt, Homo sapiens
gaaagacgagagcccugaa

SEQ ID NO: 440435 - RNA, 19 nt, Homo sapiens
caagaagccggacuacaag

SEQ ID NO: 440436 - RNA, 19 nt, Homo sapiens
ggaucaagaagccggacua

SEQ ID NO: 440437 - RNA, 19 nt, Homo sapiens
acagaaacgugaggaucaa

SEQ ID NO: 440438 - RNA, 19 nt, Homo sapiens
gcccacaacuucggguguu

SEQ ID NO: 440439 - RNA, 19 nt, Homo sapiens
cacagaaacgugaggauca

SEQ ID NO: 440440 - RNA, 19 nt, Homo sapiens
agagaagagaucacagaaa

SEQ ID NO: 440441 - RNA, 19 nt, Homo sapiens
ccgaaccaacuucuucauu

SEQ ID NO: 440442 - RNA, 19 nt, Homo sapiens
cagaucuguuucccgagaa

SEQ ID NO: 440443 - RNA, 19 nt, Homo sapiens
gcagucccgacaccuaaau

SEQ ID NO: 440444 - RNA, 19 nt, Homo sapiens
cacguucccagaucuguuu

SEQ ID NO: 440445 - RNA, 19 nt, Homo sapiens
gucccgacaccuaaauaaa

SEQ ID NO: 440446 - RNA, 19 nt, Homo sapiens
gaccuucacguucccagau

SEQ ID NO: 440447 - RNA, 19 nt, Homo sapiens
aagagaagagaucacagaa

SEQ ID NO: 440448 - RNA, 19 nt, Homo sapiens
gggugcagcauggcucuaa

SEQ ID NO: 440449 - RNA, 19 nt, Homo sapiens
caaggguggaccucaggaa

SEQ ID NO: 440450 - RNA, 19 nt, Homo sapiens
ccgaggacaccgugcaguu

SEQ ID NO: 440451 - RNA, 19 nt, Homo sapiens
acgcuaaacuggcagauua

SEQ ID NO: 440452 - RNA, 19 nt, Homo sapiens
uagaaaggcucaacgagaa

SEQ ID NO: 440453 - RNA, 19 nt, Homo sapiens
uaucagggcugcuaaggaa

SEQ ID NO: 440454 - RNA, 19 nt, Homo sapiens
uaaacuggcagauuagauu

SEQ ID NO: 440455 - RNA, 19 nt, Homo sapiens
cuacaaaggcagcaccuaa

SEQ ID NO: 440456 - RNA, 19 nt, Homo sapiens
ggaauccucggcagauaaa

SEQ ID NO: 440457 - RNA, 19 nt, Homo sapiens
cggaagaaauucaaaagaa

SEQ ID NO: 440458 - RNA, 19 nt, Homo sapiens
cgaaaugcgagucggcuuu

SEQ ID NO: 440459 - RNA, 19 nt, Homo sapiens
gggacagucggaagaaauu

SEQ ID NO: 440460 - RNA, 19 nt, Homo sapiens
ugugaagccugugaaaguu

SEQ ID NO: 440461 - RNA, 19 nt, Homo sapiens
gcucaacgagaacaagcua

SEQ ID NO: 440462 - RNA, 19 nt, Homo sapiens
aaacuggcagauuagauuu

SEQ ID NO: 440463 - RNA, 19 nt, Homo sapiens
guggagcugucgccaugaa

SEQ ID NO: 440464 - RNA, 19 nt, Homo sapiens
gugaagccugugaaaguuu

SEQ ID NO: 440465 - RNA, 19 nt, Homo sapiens
gaaaggcucaacgagaaca

SEQ ID NO: 440466 - RNA, 19 nt, Homo sapiens
gcgagucggcuuuccuuuc

SEQ ID NO: 440467 - RNA, 19 nt, Homo sapiens
aaaggcagcaccuaagcaa

SEQ ID NO: 440468 - RNA, 19 nt, Homo sapiens
gcuaaggcaccuacaaagg

SEQ ID NO: 440469 - RNA, 19 nt, Homo sapiens
ugcaauggcugcugcuaag

SEQ ID NO: 440470 - RNA, 19 nt, Homo sapiens
caacgagaacaagcuauca

SEQ ID NO: 440471 - RNA, 19 nt, Homo sapiens
caagaggaaucagaaaccu

SEQ ID NO: 440472 - RNA, 19 nt, Homo sapiens
gauugugaagccugugaaa

SEQ ID NO: 440473 - RNA, 19 nt, Homo sapiens
caagcuaucagggcugcua

SEQ ID NO: 440474 - RNA, 19 nt, Homo sapiens
cgagucggcuuuccuuucc

SEQ ID NO: 440475 - RNA, 19 nt, Homo sapiens
gcugauauaauggccaaga

SEQ ID NO: 440476 - RNA, 19 nt, Homo sapiens
gucgagcugugcaguuuua

SEQ ID NO: 440477 - RNA, 19 nt, Homo sapiens
caaaggcagcaccuaagca

SEQ ID NO: 440478 - RNA, 19 nt, Homo sapiens
cugcuaaggcaccuacaaa

SEQ ID NO: 440479 - RNA, 19 nt, Homo sapiens
gaaguuagaaaggcucaac

SEQ ID NO: 440480 - RNA, 19 nt, Homo sapiens
gaaaccugaaguuagaaag

SEQ ID NO: 440481 - RNA, 19 nt, Homo sapiens
cggcuuuccuuuccaagag

SEQ ID NO: 440482 - RNA, 19 nt, Homo sapiens
aggucgagcugugcaguuu

SEQ ID NO: 440483 - RNA, 19 nt, Homo sapiens
gacagucggaagaaauuca

SEQ ID NO: 440484 - RNA, 19 nt, Homo sapiens
gcaccuaagcaaaagauug

SEQ ID NO: 440485 - RNA, 19 nt, Homo sapiens
ggacagucggaagaaauuc

SEQ ID NO: 440486 - RNA, 19 nt, Homo sapiens
ggccaagaggaaucagaaa

SEQ ID NO: 440487 - RNA, 19 nt, Homo sapiens
uauaauggccaagaggaau

SEQ ID NO: 440488 - RNA, 19 nt, Homo sapiens
gcaaaguaguccagguuua

SEQ ID NO: 440489 - RNA, 19 nt, Homo sapiens
ccaaagagcugagacagaa

SEQ ID NO: 440490 - RNA, 19 nt, Homo sapiens
gaagaaaccauugagaaga

SEQ ID NO: 440491 - RNA, 19 nt, Homo sapiens
gcaaggugguuaucacuag

SEQ ID NO: 440492 - RNA, 19 nt, Homo sapiens
ccgaaaggaugaugaaguu

SEQ ID NO: 440493 - RNA, 19 nt, Homo sapiens
uugagaagaugcaggaaua

SEQ ID NO: 440494 - RNA, 19 nt, Homo sapiens
agccaaaucucgccaagua

SEQ ID NO: 440495 - RNA, 19 nt, Homo sapiens
cuauaaaggucagcaaauu

SEQ ID NO: 440496 - RNA, 19 nt, Homo sapiens
uggcacaacuguccacgua

SEQ ID NO: 440497 - RNA, 19 nt, Homo sapiens
gaaguuuaaucccuuugug

SEQ ID NO: 440498 - RNA, 19 nt, Homo sapiens
ggaagaaaccauugagaag

SEQ ID NO: 440499 - RNA, 19 nt, Homo sapiens
ucagcaaauuggcaaagua

SEQ ID NO: 440500 - RNA, 19 nt, Homo sapiens
gaagaugcaggaauaaagu

SEQ ID NO: 440501 - RNA, 19 nt, Homo sapiens
gcaaauacaaggaagaaac

SEQ ID NO: 440502 - RNA, 19 nt, Homo sapiens
gagaagaugcaggaauaaa

SEQ ID NO: 440503 - RNA, 19 nt, Homo sapiens
cacauucgaaggaagauua

SEQ ID NO: 440504 - RNA, 19 nt, Homo sapiens
aagaaaccauugagaagau

SEQ ID NO: 440505 - RNA, 19 nt, Homo sapiens
gaaaggaaaagggcaaaua

SEQ ID NO: 440506 - RNA, 19 nt, Homo sapiens
gcaaauuggcaaaguaguc

SEQ ID NO: 440507 - RNA, 19 nt, Homo sapiens
gaacgggugcagcgggaaa

SEQ ID NO: 440508 - RNA, 19 nt, Homo sapiens
gaacggaaagccaaaucuc

SEQ ID NO: 440509 - RNA, 19 nt, Homo sapiens
uauaaaggucagcaaauug

SEQ ID NO: 440510 - RNA, 19 nt, Homo sapiens
gggcaaauacaaggaagaa

SEQ ID NO: 440511 - RNA, 19 nt, Homo sapiens
gugguuaucacuaggcuaa

SEQ ID NO: 440512 - RNA, 19 nt, Homo sapiens
gauccaugcccauccgaaa

SEQ ID NO: 440513 - RNA, 19 nt, Homo sapiens
gcaggaauaaaguaaucuu

SEQ ID NO: 440514 - RNA, 19 nt, Homo sapiens
gagcugagacagaaguaca

SEQ ID NO: 440515 - RNA, 19 nt, Homo sapiens
ggcuaaaacuggacaaaga

SEQ ID NO: 440516 - RNA, 19 nt, Homo sapiens
caaaguaguccagguuuac

SEQ ID NO: 440517 - RNA, 19 nt, Homo sapiens
aggaagaaaccauugagaa

SEQ ID NO: 440518 - RNA, 19 nt, Homo sapiens
ggcaaaguaguccagguuu

SEQ ID NO: 440519 - RNA, 19 nt, Homo sapiens
auacaaggaagaaaccauu

SEQ ID NO: 440520 - RNA, 19 nt, Homo sapiens
gcaccuucccacauucgaa

SEQ ID NO: 440521 - RNA, 19 nt, Homo sapiens
acaaggaagaaaccauuga

SEQ ID NO: 440522 - RNA, 19 nt, Homo sapiens
cagcaaauuggcaaaguag

SEQ ID NO: 440523 - RNA, 19 nt, Homo sapiens
uuuaaucccuuugugacuu

SEQ ID NO: 440524 - RNA, 19 nt, Homo sapiens
aaagauccucgaacggaaa

SEQ ID NO: 440525 - RNA, 19 nt, Homo sapiens
cggccaaaaugaaguuuaa

SEQ ID NO: 440526 - RNA, 19 nt, Homo sapiens
agaagaugcaggaauaaag

SEQ ID NO: 440527 - RNA, 19 nt, Homo sapiens
ugagaagaugcaggaauaa

SEQ ID NO: 440528 - RNA, 19 nt, Homo sapiens
uuaaucccuuugugacuuc

SEQ ID NO: 440529 - RNA, 19 nt, Homo sapiens
agaaaccauugagaagaug

SEQ ID NO: 440530 - RNA, 19 nt, Homo sapiens
caaaucucgccaaguagga

SEQ ID NO: 440531 - RNA, 19 nt, Homo sapiens
ucaaugcaccuucccacau

SEQ ID NO: 440532 - RNA, 19 nt, Homo sapiens
uaguccagguuuacaggaa

SEQ ID NO: 440533 - RNA, 19 nt, Homo sapiens
caaggaagaaaccauugag

SEQ ID NO: 440534 - RNA, 19 nt, Homo sapiens
ccagcaaggugguuaucac

SEQ ID NO: 440535 - RNA, 19 nt, Homo sapiens
gaugcaggaauaaaguaau

SEQ ID NO: 440536 - RNA, 19 nt, Homo sapiens
aagaugcaggaauaaagua

SEQ ID NO: 440537 - RNA, 19 nt, Homo sapiens
aaagggcaaauacaaggaa

SEQ ID NO: 440538 - RNA, 19 nt, Homo sapiens
ggaaaagggcaaauacaag

SEQ ID NO: 440539 - RNA, 19 nt, Homo sapiens
agguuuacaggaagaaaua

SEQ ID NO: 440540 - RNA, 19 nt, Homo sapiens
guccagguuuacaggaaga

SEQ ID NO: 440541 - RNA, 19 nt, Homo sapiens
gauuaugucuuccccucuu

SEQ ID NO: 440542 - RNA, 19 nt, Homo sapiens
uggcaaaguaguccagguu

SEQ ID NO: 440543 - RNA, 19 nt, Homo sapiens
augcaggaauaaaguaauc

SEQ ID NO: 440544 - RNA, 19 nt, Homo sapiens
gcaaagcugucaucgugaa

SEQ ID NO: 440545 - RNA, 19 nt, Homo sapiens
gaaaugggcaaguucauga

SEQ ID NO: 440546 - RNA, 19 nt, Homo sapiens
caauaaggaugucuucaga

SEQ ID NO: 440547 - RNA, 19 nt, Homo sapiens
ggugguugcugccgaaaug

SEQ ID NO: 440548 - RNA, 19 nt, Homo sapiens
gaagaagaucgccaagaga

SEQ ID NO: 440549 - RNA, 19 nt, Homo sapiens
agaagaagaucgccaagag

SEQ ID NO: 440550 - RNA, 19 nt, Homo sapiens
acaaaacugucgucaauaa

SEQ ID NO: 440551 - RNA, 19 nt, Homo sapiens
auaaggaugucuucagaga

SEQ ID NO: 440552 - RNA, 19 nt, Homo sapiens
gguuuuagaugcuuuguuu

SEQ ID NO: 440553 - RNA, 19 nt, Homo sapiens
aaacugucgucaauaagga

SEQ ID NO: 440554 - RNA, 19 nt, Homo sapiens
caagguacucuguggauau

SEQ ID NO: 440555 - RNA, 19 nt, Homo sapiens
gaugauggcaccucagauc

SEQ ID NO: 440556 - RNA, 19 nt, Homo sapiens
acaagguacucuguggaua

SEQ ID NO: 440557 - RNA, 19 nt, Homo sapiens
aaggaugucuucagagauc

SEQ ID NO: 440558 - RNA, 19 nt, Homo sapiens
gauacaagacaggcaagaa

SEQ ID NO: 440559 - RNA, 19 nt, Homo sapiens
ggaggccaaggucaaguuu

SEQ ID NO: 440560 - RNA, 19 nt, Homo sapiens
gugaagaacauugaugaug

SEQ ID NO: 440561 - RNA, 19 nt, Homo sapiens
aagcugucaucgugaagaa

SEQ ID NO: 440562 - RNA, 19 nt, Homo sapiens
cgaaaugggcaaguucaug

SEQ ID NO: 440563 - RNA, 19 nt, Homo sapiens
gauauccccuuggacaaaa

SEQ ID NO: 440564 - RNA, 19 nt, Homo sapiens
aagaagaucgccaagagau

SEQ ID NO: 440565 - RNA, 19 nt, Homo sapiens
gggaggccaaggucaaguu

SEQ ID NO: 440566 - RNA, 19 nt, Homo sapiens
agacaggcaagaacaagug

SEQ ID NO: 440567 - RNA, 19 nt, Homo sapiens
gccaugggcaagaagaaga

SEQ ID NO: 440568 - RNA, 19 nt, Homo sapiens
cugggaagguggugcuugu

SEQ ID NO: 440569 - RNA, 19 nt, Homo sapiens
ucaauaaggaugucuucag

SEQ ID NO: 440570 - RNA, 19 nt, Homo sapiens
gcugucaucgugaagaaca

SEQ ID NO: 440571 - RNA, 19 nt, Homo sapiens
gacgggaggccaaggucaa

SEQ ID NO: 440572 - RNA, 19 nt, Homo sapiens
caagacaggcaagaacaag

SEQ ID NO: 440573 - RNA, 19 nt, Homo sapiens
ggaagaugguggccgcaaa

SEQ ID NO: 440574 - RNA, 19 nt, Homo sapiens
gcuaacaacugcccagcuu

SEQ ID NO: 440575 - RNA, 19 nt, Homo sapiens
aaacugguguccaucacua

SEQ ID NO: 440576 - RNA, 19 nt, Homo sapiens
gaucaacucuaggcuccaa

SEQ ID NO: 440577 - RNA, 19 nt, Homo sapiens
agaguacuaugcuauguug

SEQ ID NO: 440578 - RNA, 19 nt, Homo sapiens
ccuuaaaccugcaaaauuu

SEQ ID NO: 440579 - RNA, 19 nt, Homo sapiens
uaacaacugcccagcuuug

SEQ ID NO: 440580 - RNA, 19 nt, Homo sapiens
ggaaaauacuacagagugu

SEQ ID NO: 440581 - RNA, 19 nt, Homo sapiens
acuaugcuauguuggcuaa

SEQ ID NO: 440582 - RNA, 19 nt, Homo sapiens
caucuuagcggcugcuguu

SEQ ID NO: 440583 - RNA, 19 nt, Homo sapiens
gaugguggccgcaaagaag

SEQ ID NO: 440584 - RNA, 19 nt, Homo sapiens
gaugaucagacaaggcaaa

SEQ ID NO: 440585 - RNA, 19 nt, Homo sapiens
gaagaugguggccgcaaag

SEQ ID NO: 440586 - RNA, 19 nt, Homo sapiens
gacaaggcaaagcgaaauu

SEQ ID NO: 440587 - RNA, 19 nt, Homo sapiens
aaagcgaaauuggucauuc

SEQ ID NO: 440588 - RNA, 19 nt, Homo sapiens
gcuccaacucguuaugaaa

SEQ ID NO: 440589 - RNA, 19 nt, Homo sapiens
aaaagucgcuggagucgau

SEQ ID NO: 440590 - RNA, 19 nt, Homo sapiens
ucuaggcuccaacucguua

SEQ ID NO: 440591 - RNA, 19 nt, Homo sapiens
gcaaagcgaaauuggucau

SEQ ID NO: 440592 - RNA, 19 nt, Homo sapiens
aaguaaaccuuuucaccua

SEQ ID NO: 440593 - RNA, 19 nt, Homo sapiens
aagcgaaauuggucauucu

SEQ ID NO: 440594 - RNA, 19 nt, Homo sapiens
cagacaaggcaaagcgaaa

SEQ ID NO: 440595 - RNA, 19 nt, Homo sapiens
ccugcaaaauuuuccuuua

SEQ ID NO: 440596 - RNA, 19 nt, Homo sapiens
ggcuccaacucguuaugaa

SEQ ID NO: 440597 - RNA, 19 nt, Homo sapiens
caaagcgaaauuggucauu

SEQ ID NO: 440598 - RNA, 19 nt, Homo sapiens
gcacagcaugcggaaaaua

SEQ ID NO: 440599 - RNA, 19 nt, Homo sapiens
acagacuggugaaaaguaa

SEQ ID NO: 440600 - RNA, 19 nt, Homo sapiens
uagaguacuaugcuauguu

SEQ ID NO: 440601 - RNA, 19 nt, Homo sapiens
ggagggaguuucauuaaau

SEQ ID NO: 440602 - RNA, 19 nt, Homo sapiens
ggaucaacuucgacaaaua

SEQ ID NO: 440603 - RNA, 19 nt, Homo sapiens
uaugaagcauuaccacuua

SEQ ID NO: 440604 - RNA, 19 nt, Homo sapiens
gagcugaggagaagauuaa

SEQ ID NO: 440605 - RNA, 19 nt, Homo sapiens
aggaagacccggaaacuua

SEQ ID NO: 440606 - RNA, 19 nt, Homo sapiens
cagaagagcugaggagaag

SEQ ID NO: 440607 - RNA, 19 nt, Homo sapiens
gcagaagagcugaggagaa

SEQ ID NO: 440608 - RNA, 19 nt, Homo sapiens
cgucugggcugccaacaug

SEQ ID NO: 440609 - RNA, 19 nt, Homo sapiens
aaguugguaugaagcauua

SEQ ID NO: 440610 - RNA, 19 nt, Homo sapiens
aggagaagauuaagagugu

SEQ ID NO: 440611 - RNA, 19 nt, Homo sapiens
gaagagcugaggagaagau

SEQ ID NO: 440612 - RNA, 19 nt, Homo sapiens
cauggagggaguuucauua

SEQ ID NO: 440613 - RNA, 19 nt, Homo sapiens
gggcugcucccaucauuga

SEQ ID NO: 440614 - RNA, 19 nt, Homo sapiens
gagaagauuaagaguguug

SEQ ID NO: 440615 - RNA, 19 nt, Homo sapiens
uggagggaguuucauuaaa

SEQ ID NO: 440616 - RNA, 19 nt, Homo sapiens
guaugaagcauuaccacuu

SEQ ID NO: 440617 - RNA, 19 nt, Homo sapiens
gaucaacuucgacaaauac

SEQ ID NO: 440618 - RNA, 19 nt, Homo sapiens
ggaagacccggaaacuuag

SEQ ID NO: 440619 - RNA, 19 nt, Homo sapiens
ccacauggagggaguuuca

SEQ ID NO: 440620 - RNA, 19 nt, Homo sapiens
gaaaguugguaugaagcau

SEQ ID NO: 440621 - RNA, 19 nt, Homo sapiens
ggagaagauuaagaguguu

SEQ ID NO: 440622 - RNA, 19 nt, Homo sapiens
gaggaagacccggaaacuu

SEQ ID NO: 440623 - RNA, 19 nt, Homo sapiens
ggaaaguugguaugaagca

SEQ ID NO: 440624 - RNA, 19 nt, Homo sapiens
uaaagaggaaccagagcuu

SEQ ID NO: 440625 - RNA, 19 nt, Homo sapiens
ugggaaaguugguaugaag

SEQ ID NO: 440626 - RNA, 19 nt, Homo sapiens
cggaucaacuucgacaaau

SEQ ID NO: 440627 - RNA, 19 nt, Homo sapiens
gaagcauuaccacuuaaag

SEQ ID NO: 440628 - RNA, 19 nt, Homo sapiens
aacaugccauccagacuga

SEQ ID NO: 440629 - RNA, 19 nt, Homo sapiens
aagcauuaccacuuaaaga

SEQ ID NO: 440630 - RNA, 19 nt, Homo sapiens
ugaagcauuaccacuuaaa

SEQ ID NO: 440631 - RNA, 19 nt, Homo sapiens
ccggaucaacuucgacaaa

SEQ ID NO: 440632 - RNA, 19 nt, Homo sapiens
gcugaggagaagauuaaga

SEQ ID NO: 440633 - RNA, 19 nt, Homo sapiens
caucgugaaggccaaauuc

SEQ ID NO: 440634 - RNA, 19 nt, Homo sapiens
aaaguugguaugaagcauu

SEQ ID NO: 440635 - RNA, 19 nt, Homo sapiens
gcacugagcccaauaacuu

SEQ ID NO: 440636 - RNA, 19 nt, Homo sapiens
ggaccaccaucaacaagaa

SEQ ID NO: 440637 - RNA, 19 nt, Homo sapiens
ggaauaagcagaccuacag

SEQ ID NO: 440638 - RNA, 19 nt, Homo sapiens
gcaauuccuuccgcuacaa

SEQ ID NO: 440639 - RNA, 19 nt, Homo sapiens
ggacugauucaccgcaaga

SEQ ID NO: 440640 - RNA, 19 nt, Homo sapiens
ggaagccugccaccuccua

SEQ ID NO: 440641 - RNA, 19 nt, Homo sapiens
cuacagcacugagcccaau

SEQ ID NO: 440642 - RNA, 19 nt, Homo sapiens
ccaguuuccugaucaagag

SEQ ID NO: 440643 - RNA, 19 nt, Homo sapiens
ucagcuggcuuucucaaaa

SEQ ID NO: 440644 - RNA, 19 nt, Homo sapiens
gccagaagccugugauggu

SEQ ID NO: 440645 - RNA, 19 nt, Homo sapiens
agaagccugugauggugaa

SEQ ID NO: 440646 - RNA, 19 nt, Homo sapiens
gcuccaguuuccugaucaa

SEQ ID NO: 440647 - RNA, 19 nt, Homo sapiens
cugcgcaucugcaauggau

SEQ ID NO: 440648 - RNA, 19 nt, Homo sapiens
gugucgugguggucauuaa

SEQ ID NO: 440649 - RNA, 19 nt, Homo sapiens
agaggaauaagcagaccua

SEQ ID NO: 440650 - RNA, 19 nt, Homo sapiens
ccgcuacaacggacugauu

SEQ ID NO: 440651 - RNA, 19 nt, Homo sapiens
gugcggaccaccaucaaca

SEQ ID NO: 440652 - RNA, 19 nt, Homo sapiens
gaagccugccaccuccuau

SEQ ID NO: 440653 - RNA, 19 nt, Homo sapiens
ugucugcgcaucugcaaug

SEQ ID NO: 440654 - RNA, 19 nt, Homo sapiens
gaaaugguaucaagaaacc

SEQ ID NO: 440655 - RNA, 19 nt, Homo sapiens
gaagaugcaggccaacaau

SEQ ID NO: 440656 - RNA, 19 nt, Homo sapiens
gugcagacauggccaaguc

SEQ ID NO: 440657 - RNA, 19 nt, Homo sapiens
guaaagcccaaggagguua

SEQ ID NO: 440658 - RNA, 19 nt, Homo sapiens
gcucaggcucccaaacgua

SEQ ID NO: 440659 - RNA, 19 nt, Homo sapiens
caacaugaggacagaagga

SEQ ID NO: 440660 - RNA, 19 nt, Homo sapiens
gaucacaaagauacgaauc

SEQ ID NO: 440661 - RNA, 19 nt, Homo sapiens
aacaugcgcuuugccaaga

SEQ ID NO: 440662 - RNA, 19 nt, Homo sapiens
uaaagcccaaggagguuaa

SEQ ID NO: 440663 - RNA, 19 nt, Homo sapiens
agaagaugcaggccaacaa

SEQ ID NO: 440664 - RNA, 19 nt, Homo sapiens
cggcguuguugacccuauu

SEQ ID NO: 440665 - RNA, 19 nt, Homo sapiens
gacauggccaaguccaaga

SEQ ID NO: 440666 - RNA, 19 nt, Homo sapiens
ucaaagagauucggaaauu

SEQ ID NO: 440667 - RNA, 19 nt, Homo sapiens
caaagagauucggaaauuu

SEQ ID NO: 440668 - RNA, 19 nt, Homo sapiens
gaauaaggaaugugccaua

SEQ ID NO: 440669 - RNA, 19 nt, Homo sapiens
gaugggaacuccagaugug

SEQ ID NO: 440670 - RNA, 19 nt, Homo sapiens
caauguggaugagaacuaa

SEQ ID NO: 440671 - RNA, 19 nt, Homo sapiens
cagaauggcucccgcaaag

SEQ ID NO: 440672 - RNA, 19 nt, Homo sapiens
gaauggcucccgcaaagaa

SEQ ID NO: 440673 - RNA, 19 nt, Homo sapiens
gagaauacaccaucaacau

SEQ ID NO: 440674 - RNA, 19 nt, Homo sapiens
ggaaauuugccaugaagga

SEQ ID NO: 440675 - RNA, 19 nt, Homo sapiens
caacuuggacgcugcagaa

SEQ ID NO: 440676 - RNA, 19 nt, Homo sapiens
ccaaaggaauaaggaaugu

SEQ ID NO: 440677 - RNA, 19 nt, Homo sapiens
aaagagauucggaaauuug

SEQ ID NO: 440678 - RNA, 19 nt, Homo sapiens
aaagaaggguggcgagaag

SEQ ID NO: 440679 - RNA, 19 nt, Homo sapiens
cgucagaucaaauaaaguu

SEQ ID NO: 440680 - RNA, 19 nt, Homo sapiens
gcagaauggcucccgcaaa

SEQ ID NO: 440681 - RNA, 19 nt, Homo sapiens
auacuuugguuaccuaugu

SEQ ID NO: 440682 - RNA, 19 nt, Homo sapiens
ggaaugugccauaccgaau

SEQ ID NO: 440683 - RNA, 19 nt, Homo sapiens
caaagaaggguggcgagaa

SEQ ID NO: 440684 - RNA, 19 nt, Homo sapiens
agaauacaccaucaacauu

SEQ ID NO: 440685 - RNA, 19 nt, Homo sapiens
gaaggguggcgagaagaaa

SEQ ID NO: 440686 - RNA, 19 nt, Homo sapiens
gagaugggaacuccagaug

SEQ ID NO: 440687 - RNA, 19 nt, Homo sapiens
gaaugugccauaccgaauc

SEQ ID NO: 440688 - RNA, 19 nt, Homo sapiens
gugugcggcuguccagaaa

SEQ ID NO: 440689 - RNA, 19 nt, Homo sapiens
gccaaaggaauaaggaaug

SEQ ID NO: 440690 - RNA, 19 nt, Homo sapiens
ucaauguggaugagaacua

SEQ ID NO: 440691 - RNA, 19 nt, Homo sapiens
acaccaggcucaacaaagc

SEQ ID NO: 440692 - RNA, 19 nt, Homo sapiens
cagucaauguggaugagaa

SEQ ID NO: 440693 - RNA, 19 nt, Homo sapiens
guucugccaucaacgaagu

SEQ ID NO: 440694 - RNA, 19 nt, Homo sapiens
caccaaauaagcuauauac

SEQ ID NO: 440695 - RNA, 19 nt, Homo sapiens
aauacaccaucaacauuca

SEQ ID NO: 440696 - RNA, 19 nt, Homo sapiens
cuuggacgcugcagaaugg

SEQ ID NO: 440697 - RNA, 19 nt, Homo sapiens
gguuaccuauguaccuguu

SEQ ID NO: 440698 - RNA, 19 nt, Homo sapiens
ugacaccaggcucaacaaa

SEQ ID NO: 440699 - RNA, 19 nt, Homo sapiens
ccagaugugcgcauugaca

SEQ ID NO: 440700 - RNA, 19 nt, Homo sapiens
ggccaaaggaauaaggaau

SEQ ID NO: 440701 - RNA, 19 nt, Homo sapiens
cuccagaugugcgcauuga

SEQ ID NO: 440702 - RNA, 19 nt, Homo sapiens
ucggaaauuugccaugaag

SEQ ID NO: 440703 - RNA, 19 nt, Homo sapiens
auucggaaauuugccauga

SEQ ID NO: 440704 - RNA, 19 nt, Homo sapiens
gcaccucgggcacucaaag

SEQ ID NO: 440705 - RNA, 19 nt, Homo sapiens
aauaaggaaugugccauac

SEQ ID NO: 440706 - RNA, 19 nt, Homo sapiens
agacagucaauguggauga

SEQ ID NO: 440707 - RNA, 19 nt, Homo sapiens
cgagaauacaccaucaaca

SEQ ID NO: 440708 - RNA, 19 nt, Homo sapiens
acucaaagagauucggaaa

SEQ ID NO: 440709 - RNA, 19 nt, Homo sapiens
ugccaucaacgaaguggua

SEQ ID NO: 440710 - RNA, 19 nt, Homo sapiens
gacagucaauguggaugag

SEQ ID NO: 440711 - RNA, 19 nt, Homo sapiens
uacuuugguuaccuaugua

SEQ ID NO: 440712 - RNA, 19 nt, Homo sapiens
agaaggguggcgagaagaa

SEQ ID NO: 440713 - RNA, 19 nt, Homo sapiens
ggaaagagcugcccaacug

SEQ ID NO: 440714 - RNA, 19 nt, Homo sapiens
caacaggguucguagaaga

SEQ ID NO: 440715 - RNA, 19 nt, Homo sapiens
gcaaagccaucguggaaag

SEQ ID NO: 440716 - RNA, 19 nt, Homo sapiens
gacaacaggguucguagaa

SEQ ID NO: 440717 - RNA, 19 nt, Homo sapiens
gcaccagucagaccgauau

SEQ ID NO: 440718 - RNA, 19 nt, Homo sapiens
ccgcaaagccaucguggaa

SEQ ID NO: 440719 - RNA, 19 nt, Homo sapiens
gcggaaacccagaggcauu

SEQ ID NO: 440720 - RNA, 19 nt, Homo sapiens
uggaagugcugcugaugug

SEQ ID NO: 440721 - RNA, 19 nt, Homo sapiens
ugaugugcaacaaaucuua

SEQ ID NO: 440722 - RNA, 19 nt, Homo sapiens
cugcugaugugcaacaaau

SEQ ID NO: 440723 - RNA, 19 nt, Homo sapiens
ccagaggcauugacaacag

SEQ ID NO: 440724 - RNA, 19 nt, Homo sapiens
gaucuugaugcccaacauu

SEQ ID NO: 440725 - RNA, 19 nt, Homo sapiens
aagcguaacuggcggaaac

SEQ ID NO: 440726 - RNA, 19 nt, Homo sapiens
agaccgauaugucaaaauu

SEQ ID NO: 440727 - RNA, 19 nt, Homo sapiens
gugcaacaaaucuuacugu

SEQ ID NO: 440728 - RNA, 19 nt, Homo sapiens
ugacaacaggguucguaga

SEQ ID NO: 440729 - RNA, 19 nt, Homo sapiens
gcagugaagaaaaugagua

SEQ ID NO: 440730 - RNA, 19 nt, Homo sapiens
ggaaacccagaggcauuga

SEQ ID NO: 440731 - RNA, 19 nt, Homo sapiens
gaagcccaagaucgucaaa

SEQ ID NO: 440732 - RNA, 19 nt, Homo sapiens
gcugaugugcaacaaaucu

SEQ ID NO: 440733 - RNA, 19 nt, Homo sapiens
ccagucagaccgauauguc

SEQ ID NO: 440734 - RNA, 19 nt, Homo sapiens
caacgucaaggagcuggaa

SEQ ID NO: 440735 - RNA, 19 nt, Homo sapiens
gugcaucucuuuccaguuu

SEQ ID NO: 440736 - RNA, 19 nt, Homo sapiens
caggagcucugauauauau

SEQ ID NO: 440737 - RNA, 19 nt, Homo sapiens
gcacaucccuagauacuac

SEQ ID NO: 440738 - RNA, 19 nt, Homo sapiens
gaaaagacgcuguccaaua

SEQ ID NO: 440739 - RNA, 19 nt, Homo sapiens
ucugguacauguuugauaa

SEQ ID NO: 440740 - RNA, 19 nt, Homo sapiens
gguacauguuugauaauga

SEQ ID NO: 440741 - RNA, 19 nt, Homo sapiens
ucagaaugguccagcguuu

SEQ ID NO: 440742 - RNA, 19 nt, Homo sapiens
cuagauacuacucaaguua

SEQ ID NO: 440743 - RNA, 19 nt, Homo sapiens
gaaaaucguugugaaagug

SEQ ID NO: 440744 - RNA, 19 nt, Homo sapiens
gcuguaagaccuaaaguuc

SEQ ID NO: 440745 - RNA, 19 nt, Homo sapiens
aaaagacgcuguccaauag

SEQ ID NO: 440746 - RNA, 19 nt, Homo sapiens
auacuucgauucuguaaag

SEQ ID NO: 440747 - RNA, 19 nt, Homo sapiens
gagagcuggagguuaaaua

SEQ ID NO: 440748 - RNA, 19 nt, Homo sapiens
guacauguuugauaaugac

SEQ ID NO: 440749 - RNA, 19 nt, Homo sapiens
ucgauucuguaaagaguuu

SEQ ID NO: 440750 - RNA, 19 nt, Homo sapiens
accaggagcucugauauau

SEQ ID NO: 440751 - RNA, 19 nt, Homo sapiens
caagaagguugggaaagca

SEQ ID NO: 440752 - RNA, 19 nt, Homo sapiens
cauguuugauaaugacuug

SEQ ID NO: 440753 - RNA, 19 nt, Homo sapiens
caaguuacaguauaugauc

SEQ ID NO: 440754 - RNA, 19 nt, Homo sapiens
guauuuacaccucagcaaa

SEQ ID NO: 440755 - RNA, 19 nt, Homo sapiens
ccaggagcucugauauaua

SEQ ID NO: 440756 - RNA, 19 nt, Homo sapiens
ccuagauacuacucaaguu

SEQ ID NO: 440757 - RNA, 19 nt, Homo sapiens
agaccuaaaguucuuauga

SEQ ID NO: 440758 - RNA, 19 nt, Homo sapiens
gguaccaggagcucugaua

SEQ ID NO: 440759 - RNA, 19 nt, Homo sapiens
uaccaggagcucugauaua

SEQ ID NO: 440760 - RNA, 19 nt, Homo sapiens
gcagaaaaucguugugaaa

SEQ ID NO: 440761 - RNA, 19 nt, Homo sapiens
guaccaggagcucugauau

SEQ ID NO: 440762 - RNA, 19 nt, Homo sapiens
ccaguugugugcaucucuu

SEQ ID NO: 440763 - RNA, 19 nt, Homo sapiens
aagacgcuguccaauagaa

SEQ ID NO: 440764 - RNA, 19 nt, Homo sapiens
accagcacaucccuagaua

SEQ ID NO: 440765 - RNA, 19 nt, Homo sapiens
agcuggagguuaaauacua

SEQ ID NO: 440766 - RNA, 19 nt, Homo sapiens
guuauggugagaguauuua

SEQ ID NO: 440767 - RNA, 19 nt, Homo sapiens
agaaugguccagcguuuga

SEQ ID NO: 440768 - RNA, 19 nt, Homo sapiens
gagagccaguugugugcau

SEQ ID NO: 440769 - RNA, 19 nt, Homo sapiens
cguuugacauaccgacgua

SEQ ID NO: 440770 - RNA, 19 nt, Homo sapiens
gcuggagguuaaauacuac

SEQ ID NO: 440771 - RNA, 19 nt, Homo sapiens
gugguuccaugugugcuaa

SEQ ID NO: 440772 - RNA, 19 nt, Homo sapiens
uuccaugugugcuaaaugu

SEQ ID NO: 440773 - RNA, 19 nt, Homo sapiens
gaguuuaggguuugauuuu

SEQ ID NO: 440774 - RNA, 19 nt, Homo sapiens
cagcacaucccuagauacu

SEQ ID NO: 440775 - RNA, 19 nt, Homo sapiens
uauaucugguacauguuug

SEQ ID NO: 440776 - RNA, 19 nt, Homo sapiens
aauauaguaugcucuuggu

SEQ ID NO: 440777 - RNA, 19 nt, Homo sapiens
cuaauauaguaugcucuug

SEQ ID NO: 440778 - RNA, 19 nt, Homo sapiens
ccugguaauagaauuguuu

SEQ ID NO: 440779 - RNA, 19 nt, Homo sapiens
cuaccucaccucagcuuga

SEQ ID NO: 440780 - RNA, 19 nt, Homo sapiens
uaaauacuaccagcacauc

SEQ ID NO: 440781 - RNA, 19 nt, Homo sapiens
cuucgauucuguaaagagu

SEQ ID NO: 440782 - RNA, 19 nt, Homo sapiens
ugguacauguuugauaaug

SEQ ID NO: 440783 - RNA, 19 nt, Homo sapiens
agauacuacucaaguuaca

SEQ ID NO: 440784 - RNA, 19 nt, Homo sapiens
acauaccgacguaggcuuu

SEQ ID NO: 440785 - RNA, 19 nt, Homo sapiens
ugagauuguuauggugaga

SEQ ID NO: 440786 - RNA, 19 nt, Homo sapiens
gugcaucucuuuccaguuu

SEQ ID NO: 440787 - RNA, 19 nt, Homo sapiens
caggagcucugauauauau

SEQ ID NO: 440788 - RNA, 19 nt, Homo sapiens
gcacaucccuagauacuac

SEQ ID NO: 440789 - RNA, 19 nt, Homo sapiens
gaaaagacgcuguccaaua

SEQ ID NO: 440790 - RNA, 19 nt, Homo sapiens
ucugguacauguuugauaa

SEQ ID NO: 440791 - RNA, 19 nt, Homo sapiens
gguacauguuugauaauga

SEQ ID NO: 440792 - RNA, 19 nt, Homo sapiens
ucagaaugguccagcguuu

SEQ ID NO: 440793 - RNA, 19 nt, Homo sapiens
cuagauacuacucaaguua

SEQ ID NO: 440794 - RNA, 19 nt, Homo sapiens
gaaaaucguugugaaagug

SEQ ID NO: 440795 - RNA, 19 nt, Homo sapiens
gcuguaagaccuaaaguuc

SEQ ID NO: 440796 - RNA, 19 nt, Homo sapiens
aaaagacgcuguccaauag

SEQ ID NO: 440797 - RNA, 19 nt, Homo sapiens
auacuucgauucuguaaag

SEQ ID NO: 440798 - RNA, 19 nt, Homo sapiens
gagagcuggagguuaaaua

SEQ ID NO: 440799 - RNA, 19 nt, Homo sapiens
guacauguuugauaaugac

SEQ ID NO: 440800 - RNA, 19 nt, Homo sapiens
ucgauucuguaaagaguuu

SEQ ID NO: 440801 - RNA, 19 nt, Homo sapiens
accaggagcucugauauau

SEQ ID NO: 440802 - RNA, 19 nt, Homo sapiens
caagaagguugggaaagca

SEQ ID NO: 440803 - RNA, 19 nt, Homo sapiens
cauguuugauaaugacuug

SEQ ID NO: 440804 - RNA, 19 nt, Homo sapiens
caaguuacaguauaugauc

SEQ ID NO: 440805 - RNA, 19 nt, Homo sapiens
guauuuacaccucagcaaa

SEQ ID NO: 440806 - RNA, 19 nt, Homo sapiens
ccaggagcucugauauaua

SEQ ID NO: 440807 - RNA, 19 nt, Homo sapiens
ccuagauacuacucaaguu

SEQ ID NO: 440808 - RNA, 19 nt, Homo sapiens
agaccuaaaguucuuauga

SEQ ID NO: 440809 - RNA, 19 nt, Homo sapiens
gguaccaggagcucugaua

SEQ ID NO: 440810 - RNA, 19 nt, Homo sapiens
uaccaggagcucugauaua

SEQ ID NO: 440811 - RNA, 19 nt, Homo sapiens
gcagaaaaucguugugaaa

SEQ ID NO: 440812 - RNA, 19 nt, Homo sapiens
guaccaggagcucugauau

SEQ ID NO: 440813 - RNA, 19 nt, Homo sapiens
ccaguugugugcaucucuu

SEQ ID NO: 440814 - RNA, 19 nt, Homo sapiens
aagacgcuguccaauagaa

SEQ ID NO: 440815 - RNA, 19 nt, Homo sapiens
agaaugguccagcguuuga

SEQ ID NO: 440816 - RNA, 19 nt, Homo sapiens
accagcacaucccuagaua

SEQ ID NO: 440817 - RNA, 19 nt, Homo sapiens
agcuggagguuaaauacua

SEQ ID NO: 440818 - RNA, 19 nt, Homo sapiens
guuauggugagaguauuua

SEQ ID NO: 440819 - RNA, 19 nt, Homo sapiens
cguuugacauaccgacgua

SEQ ID NO: 440820 - RNA, 19 nt, Homo sapiens
gagagccaguugugugcau

SEQ ID NO: 440821 - RNA, 19 nt, Homo sapiens
gcuggagguuaaauacuac

SEQ ID NO: 440822 - RNA, 19 nt, Homo sapiens
gugguuccaugugugcuaa

SEQ ID NO: 440823 - RNA, 19 nt, Homo sapiens
uuccaugugugcuaaaugu

SEQ ID NO: 440824 - RNA, 19 nt, Homo sapiens
gaguuuaggguuugauuuu

SEQ ID NO: 440825 - RNA, 19 nt, Homo sapiens
gagcugaggaagccuagag

SEQ ID NO: 440826 - RNA, 19 nt, Homo sapiens
cagcacaucccuagauacu

SEQ ID NO: 440827 - RNA, 19 nt, Homo sapiens
cucagaagcaguccuuuga

SEQ ID NO: 440828 - RNA, 19 nt, Homo sapiens
uauaucugguacauguuug

SEQ ID NO: 440829 - RNA, 19 nt, Homo sapiens
aauauaguaugcucuuggu

SEQ ID NO: 440830 - RNA, 19 nt, Homo sapiens
cuaauauaguaugcucuug

SEQ ID NO: 440831 - RNA, 19 nt, Homo sapiens
ccugguaauagaauuguuu

SEQ ID NO: 440832 - RNA, 19 nt, Homo sapiens
cuaccucaccucagcuuga

SEQ ID NO: 440833 - RNA, 19 nt, Homo sapiens
gcucucagaagcaguccuu

SEQ ID NO: 440834 - RNA, 19 nt, Homo sapiens
uaaauacuaccagcacauc

SEQ ID NO: 440835 - RNA, 19 nt, Homo sapiens
cuucgauucuguaaagagu

SEQ ID NO: 440836 - RNA, 19 nt, Homo sapiens
ugguacauguuugauaaug

SEQ ID NO: 440837 - RNA, 19 nt, Homo sapiens
agauacuacucaaguuaca

SEQ ID NO: 440838 - RNA, 19 nt, Homo sapiens
acauaccgacguaggcuuu

SEQ ID NO: 440839 - RNA, 19 nt, Homo sapiens
ugagauuguuauggugaga

SEQ ID NO: 440840 - RNA, 19 nt, Homo sapiens
ucucagaagcaguccuuug

SEQ ID NO: 440841 - RNA, 19 nt, Homo sapiens
gcacacagcucuucuuaaa

SEQ ID NO: 440842 - RNA, 19 nt, Homo sapiens
gagaugcgcuuauguauau

SEQ ID NO: 440843 - RNA, 19 nt, Homo sapiens
gauuugugcucuuguauuu

SEQ ID NO: 440844 - RNA, 19 nt, Homo sapiens
ccucaaggauuuaaacuaa

SEQ ID NO: 440845 - RNA, 19 nt, Homo sapiens
caagagaugcgcuuaugua

SEQ ID NO: 440846 - RNA, 19 nt, Homo sapiens
gaaacagaauucuauuugg

SEQ ID NO: 440847 - RNA, 19 nt, Homo sapiens
ggacacagaauccgaguga

SEQ ID NO: 440848 - RNA, 19 nt, Homo sapiens
gcaaagaacaacacaguca

SEQ ID NO: 440849 - RNA, 19 nt, Homo sapiens
gagaugaaacagaauucua

SEQ ID NO: 440850 - RNA, 19 nt, Homo sapiens
ggcaagagaugcgcuuaug

SEQ ID NO: 440851 - RNA, 19 nt, Homo sapiens
gaacgggacuucuaaaagg

SEQ ID NO: 440852 - RNA, 19 nt, Homo sapiens
gaauccgagugaugcugua

SEQ ID NO: 440853 - RNA, 19 nt, Homo sapiens
guggauuugugcucuugua

SEQ ID NO: 440854 - RNA, 19 nt, Homo sapiens
acacagcucuucuuaaaau

SEQ ID NO: 440855 - RNA, 19 nt, Homo sapiens
agagaugcgcuuauguaua

SEQ ID NO: 440856 - RNA, 19 nt, Homo sapiens
ggauuugugcucuuguauu

SEQ ID NO: 440857 - RNA, 19 nt, Homo sapiens
uggaaacaguggcaugguu

SEQ ID NO: 440858 - RNA, 19 nt, Homo sapiens
gcaagagaugcgcuuaugu

SEQ ID NO: 440859 - RNA, 19 nt, Homo sapiens
gcaugguucgugccaaauu

SEQ ID NO: 440860 - RNA, 19 nt, Homo sapiens
gcugggaacgggacuucua

SEQ ID NO: 440861 - RNA, 19 nt, Homo sapiens
cgcccgagaugaaacagaa

SEQ ID NO: 440862 - RNA, 19 nt, Homo sapiens
acacagaauccgagugaug

SEQ ID NO: 440863 - RNA, 19 nt, Homo sapiens
caugguucgugccaaauuc

SEQ ID NO: 440864 - RNA, 19 nt, Homo sapiens
uaaggccauuggacacaga

SEQ ID NO: 440865 - RNA, 19 nt, Homo sapiens
ucaaggauuuaaacuaacg

SEQ ID NO: 440866 - RNA, 19 nt, Homo sapiens
aagcaaagaacaacacagu

SEQ ID NO: 440867 - RNA, 19 nt, Homo sapiens
gaaccaaagggagcacaca

SEQ ID NO: 440868 - RNA, 19 nt, Homo sapiens
gggcaagagaugcgcuuau

SEQ ID NO: 440869 - RNA, 19 nt, Homo sapiens
caaauuccgaagcaaucuu

SEQ ID NO: 440870 - RNA, 19 nt, Homo sapiens
gccaaauuccgaagcaauc

SEQ ID NO: 440871 - RNA, 19 nt, Homo sapiens
aaaggaacuaugucuggaa

SEQ ID NO: 440872 - RNA, 19 nt, Homo sapiens
aagagaugcgcuuauguau

SEQ ID NO: 440873 - RNA, 19 nt, Homo sapiens
gaauucuauuugggcaaga

SEQ ID NO: 440874 - RNA, 19 nt, Homo sapiens
uaaagcaaagaacaacaca

SEQ ID NO: 440875 - RNA, 19 nt, Homo sapiens
cagcucuucuuaaaauuga

SEQ ID NO: 440876 - RNA, 19 nt, Homo sapiens
aaacaaaaccagagucauc

SEQ ID NO: 440877 - RNA, 19 nt, Homo sapiens
caaagaagauugugcuaag

SEQ ID NO: 440878 - RNA, 19 nt, Homo sapiens
guucuaaacuuugggauau

SEQ ID NO: 440879 - RNA, 19 nt, Homo sapiens
gaagagaaagggccaagug

SEQ ID NO: 440880 - RNA, 19 nt, Homo sapiens
gcuaagaccacaaagaaga

SEQ ID NO: 440881 - RNA, 19 nt, Homo sapiens
ggaaggaggcgcuaugauc

SEQ ID NO: 440882 - RNA, 19 nt, Homo sapiens
gaggagauaagaagagaaa

SEQ ID NO: 440883 - RNA, 19 nt, Homo sapiens
caagugauccaguucuaaa

SEQ ID NO: 440884 - RNA, 19 nt, Homo sapiens
gaacugggaggagauaaga

SEQ ID NO: 440885 - RNA, 19 nt, Homo sapiens
gggcagacaaagccaauuu

SEQ ID NO: 440886 - RNA, 19 nt, Homo sapiens
gccaagugauccaguucua

SEQ ID NO: 440887 - RNA, 19 nt, Homo sapiens
uggaauguguugagccuaa

SEQ ID NO: 440888 - RNA, 19 nt, Homo sapiens
gagaaagggccaagugauc

SEQ ID NO: 440889 - RNA, 19 nt, Homo sapiens
gggaggagauaagaagaga

SEQ ID NO: 440890 - RNA, 19 nt, Homo sapiens
acaaagugacacaguauaa

SEQ ID NO: 440891 - RNA, 19 nt, Homo sapiens
gaagcagaguggcuauggu

SEQ ID NO: 440892 - RNA, 19 nt, Homo sapiens
aaagugacacaguauaaga

SEQ ID NO: 440893 - RNA, 19 nt, Homo sapiens
gauggucaacguaccuaaa

SEQ ID NO: 440894 - RNA, 19 nt, Homo sapiens
cugcaaagauggucaacgu

SEQ ID NO: 440895 - RNA, 19 nt, Homo sapiens
ggagauaagaagagaaagg

SEQ ID NO: 440896 - RNA, 19 nt, Homo sapiens
uauaagaagggcaaggauu

SEQ ID NO: 440897 - RNA, 19 nt, Homo sapiens
aggcuaagaccacaaagaa

SEQ ID NO: 440898 - RNA, 19 nt, Homo sapiens
cacaaagugacacaguaua

SEQ ID NO: 440899 - RNA, 19 nt, Homo sapiens
ccaagugauccaguucuaa

SEQ ID NO: 440900 - RNA, 19 nt, Homo sapiens
gcuauggugggcagacaaa

SEQ ID NO: 440901 - RNA, 19 nt, Homo sapiens
ggaagcagaguggcuaugg

SEQ ID NO: 440902 - RNA, 19 nt, Homo sapiens
ugcuaaggcuggaaugugu

SEQ ID NO: 440903 - RNA, 19 nt, Homo sapiens
caaagugacacaguauaag

SEQ ID NO: 440904 - RNA, 19 nt, Homo sapiens
gaaagggccaagugaucca

SEQ ID NO: 440905 - RNA, 19 nt, Homo sapiens
auaagaagggcaaggauuc

SEQ ID NO: 440906 - RNA, 19 nt, Homo sapiens
agaaggcuaagaccacaaa

SEQ ID NO: 440907 - RNA, 19 nt, Homo sapiens
aagagaaagggccaaguga

SEQ ID NO: 440908 - RNA, 19 nt, Homo sapiens
aaagaagauugugcuaagg

SEQ ID NO: 440909 - RNA, 19 nt, Homo sapiens
gagggaaaauaaauacagu

SEQ ID NO: 440910 - RNA, 19 nt, Homo sapiens
gugaagccauagaaaaguu

SEQ ID NO: 440911 - RNA, 19 nt, Homo sapiens
ggaauguguugagccuaac

SEQ ID NO: 440912 - RNA, 19 nt, Homo sapiens
uaagaccacaaagaagauu

SEQ ID NO: 440913 - RNA, 19 nt, Homo sapiens
gggaaaauaaauacaguga

SEQ ID NO: 440914 - RNA, 19 nt, Homo sapiens
ggaggagauaagaagagaa

SEQ ID NO: 440915 - RNA, 19 nt, Homo sapiens
gcaauaagacgcacacguu

SEQ ID NO: 440916 - RNA, 19 nt, Homo sapiens
ggaaagcgucgcaauaaga

SEQ ID NO: 440917 - RNA, 19 nt, Homo sapiens
caccggaacuggucgaaug

SEQ ID NO: 440918 - RNA, 19 nt, Homo sapiens
gaaugucaacgauuaguca

SEQ ID NO: 440919 - RNA, 19 nt, Homo sapiens
gcaagagaaaguauaacug

SEQ ID NO: 440920 - RNA, 19 nt, Homo sapiens
gcagaagcgagaugacgaa

SEQ ID NO: 440921 - RNA, 19 nt, Homo sapiens
gaaagcgucgcaauaagac

SEQ ID NO: 440922 - RNA, 19 nt, Homo sapiens
caagagggcagcuguugca

SEQ ID NO: 440923 - RNA, 19 nt, Homo sapiens
cgaaauaccaccggaacug

SEQ ID NO: 440924 - RNA, 19 nt, Homo sapiens
uuggaaagcgucgcaauaa

SEQ ID NO: 440925 - RNA, 19 nt, Homo sapiens
gcagauucaggcauggauu

SEQ ID NO: 440926 - RNA, 19 nt, Homo sapiens
aggcauggauuccgugaag

SEQ ID NO: 440927 - RNA, 19 nt, Homo sapiens
uggaaagcgucgcaauaag

SEQ ID NO: 440928 - RNA, 19 nt, Homo sapiens
gccaagcgcaagagaaagu

SEQ ID NO: 440929 - RNA, 19 nt, Homo sapiens
cugccaagcgcaagagaaa

SEQ ID NO: 440930 - RNA, 19 nt, Homo sapiens
uuuggaaagcgucgcaaua

SEQ ID NO: 440931 - RNA, 19 nt, Homo sapiens
uaagaaugucaacgauuag

SEQ ID NO: 440932 - RNA, 19 nt, Homo sapiens
aagcgcaagagaaaguaua

SEQ ID NO: 440933 - RNA, 19 nt, Homo sapiens
ccaagcgcaagagaaagua

SEQ ID NO: 440934 - RNA, 19 nt, Homo sapiens
ucuuaagaaugucaacgau

SEQ ID NO: 440935 - RNA, 19 nt, Homo sapiens
ggccaaacguaccaagaaa

SEQ ID NO: 440936 - RNA, 19 nt, Homo sapiens
agacgcuccucuacucuuu

SEQ ID NO: 440937 - RNA, 19 nt, Homo sapiens
ccaaacguaccaagaaagu

SEQ ID NO: 440938 - RNA, 19 nt, Homo sapiens
guacacuugcucuuucugu

SEQ ID NO: 440939 - RNA, 19 nt, Homo sapiens
gcuccucuacucuuugaga

SEQ ID NO: 440940 - RNA, 19 nt, Homo sapiens
acgcuccucuacucuuuga

SEQ ID NO: 440941 - RNA, 19 nt, Homo sapiens
uggccaaacguaccaagaa

SEQ ID NO: 440942 - RNA, 19 nt, Homo sapiens
ccucuacucuuugagacau

SEQ ID NO: 440943 - RNA, 19 nt, Homo sapiens
ggcgacauggccaaacgua

SEQ ID NO: 440944 - RNA, 19 nt, Homo sapiens
gaaaggaugccaaaucugu

SEQ ID NO: 440945 - RNA, 19 nt, Homo sapiens
caacgugaaguuuaaaguu

SEQ ID NO: 440946 - RNA, 19 nt, Homo sapiens
ggugauacgugggugagaa

SEQ ID NO: 440947 - RNA, 19 nt, Homo sapiens
gagugucucuagggugaua

SEQ ID NO: 440948 - RNA, 19 nt, Homo sapiens
aggacaacgugaaguuuaa

SEQ ID NO: 440949 - RNA, 19 nt, Homo sapiens
gcucacagcccgacgaaag

SEQ ID NO: 440950 - RNA, 19 nt, Homo sapiens
gacgaaaggaugccaaauc

SEQ ID NO: 440951 - RNA, 19 nt, Homo sapiens
ggacaacgugaaguuuaaa

SEQ ID NO: 440952 - RNA, 19 nt, Homo sapiens
aaggacaacgugaaguuua

SEQ ID NO: 440953 - RNA, 19 nt, Homo sapiens
acgaaaggaugccaaaucu

SEQ ID NO: 440954 - RNA, 19 nt, Homo sapiens
uaaggacaacgugaaguuu

SEQ ID NO: 440955 - RNA, 19 nt, Homo sapiens
aacgugaaguuuaaaguuc

SEQ ID NO: 440956 - RNA, 19 nt, Homo sapiens
gaugccaaaucugucaaga

SEQ ID NO: 440957 - RNA, 19 nt, Homo sapiens
acacugauuggaacuguau

SEQ ID NO: 440958 - RNA, 19 nt, Homo sapiens
auaaggacaacgugaaguu

SEQ ID NO: 440959 - RNA, 19 nt, Homo sapiens
acacccuggucaucacuga

SEQ ID NO: 440960 - RNA, 19 nt, Homo sapiens
cacacugauuggaacugua

SEQ ID NO: 440961 - RNA, 19 nt, Homo sapiens
acugauuggaacuguauua

SEQ ID NO: 440962 - RNA, 19 nt, Homo sapiens
gugauacgugggugagaaa

SEQ ID NO: 440963 - RNA, 19 nt, Homo sapiens
gaaggucacgaucauguua

SEQ ID NO: 440964 - RNA, 19 nt, Homo sapiens
ugagauggcacacauauuu

SEQ ID NO: 440965 - RNA, 19 nt, Homo sapiens
uauaaggaauugcacauga

SEQ ID NO: 440966 - RNA, 19 nt, Homo sapiens
gagauggcacacauauuua

SEQ ID NO: 440967 - RNA, 19 nt, Homo sapiens
ucacgaucauguuaccaua

SEQ ID NO: 440968 - RNA, 19 nt, Homo sapiens
uuggcuggauucaguaaua

SEQ ID NO: 440969 - RNA, 19 nt, Homo sapiens
gaaaaugucaccacuaucu

SEQ ID NO: 440970 - RNA, 19 nt, Homo sapiens
cacaugagauggcacacau

SEQ ID NO: 440971 - RNA, 19 nt, Homo sapiens
caugagauggcacacauau

SEQ ID NO: 440972 - RNA, 19 nt, Homo sapiens
uggcuggauucaguaauaa

SEQ ID NO: 440973 - RNA, 19 nt, Homo sapiens
cgccaugucuucucacaag

SEQ ID NO: 440974 - RNA, 19 nt, Homo sapiens
aaggagacauuggagaaga

SEQ ID NO: 440975 - RNA, 19 nt, Homo sapiens
ccaguggauucggaugaaa

SEQ ID NO: 440976 - RNA, 19 nt, Homo sapiens
uaaggaauugcacaugaga

SEQ ID NO: 440977 - RNA, 19 nt, Homo sapiens
ggaugaaaacuggaaauaa

SEQ ID NO: 440978 - RNA, 19 nt, Homo sapiens
gcuggauucaguaauaaau

SEQ ID NO: 440979 - RNA, 19 nt, Homo sapiens
gcacaugagauggcacaca

SEQ ID NO: 440980 - RNA, 19 nt, Homo sapiens
aggagacauuggagaagaa

SEQ ID NO: 440981 - RNA, 19 nt, Homo sapiens
cacguugguuggcuggauu

SEQ ID NO: 440982 - RNA, 19 nt, Homo sapiens
ggaaauaaaaucagguaca

SEQ ID NO: 440983 - RNA, 19 nt, Homo sapiens
cugaaaaugucaccacuau

SEQ ID NO: 440984 - RNA, 19 nt, Homo sapiens
uugguuggcuggauucagu

SEQ ID NO: 440985 - RNA, 19 nt, Homo sapiens
auaaggaauugcacaugag

SEQ ID NO: 440986 - RNA, 19 nt, Homo sapiens
gcgauuccuggccaagaaa

SEQ ID NO: 440987 - RNA, 19 nt, Homo sapiens
caucgugguguguucuuga

SEQ ID NO: 440988 - RNA, 19 nt, Homo sapiens
uuuccucucugaaucuguu

SEQ ID NO: 440989 - RNA, 19 nt, Homo sapiens
ugaaggucacgaucauguu

SEQ ID NO: 440990 - RNA, 19 nt, Homo sapiens
cccaguggauucggaugaa

SEQ ID NO: 440991 - RNA, 19 nt, Homo sapiens
guaaaccgcuagcuuguug

SEQ ID NO: 440992 - RNA, 19 nt, Homo sapiens
gaguguaacaaccauauaa

SEQ ID NO: 440993 - RNA, 19 nt, Homo sapiens
aggcagagguccaaguaaa

SEQ ID NO: 440994 - RNA, 19 nt, Homo sapiens
ggacuauuucuguguuuau

SEQ ID NO: 440995 - RNA, 19 nt, Homo sapiens
ccaaguaaaccgcuagcuu

SEQ ID NO: 440996 - RNA, 19 nt, Homo sapiens
agacggaacuucgccuuuc

SEQ ID NO: 440997 - RNA, 19 nt, Homo sapiens
ugaggcagagguccaagua

SEQ ID NO: 440998 - RNA, 19 nt, Homo sapiens
gcccuggaccugugacauu

SEQ ID NO: 440999 - RNA, 19 nt, Homo sapiens
uggacuauuucuguguuua

SEQ ID NO: 441000 - RNA, 19 nt, Homo sapiens
gggaugcugguacaaguug

SEQ ID NO: 441001 - RNA, 19 nt, Homo sapiens
cgaguguaacaaccauaua

SEQ ID NO: 441002 - RNA, 19 nt, Homo sapiens
gacggaacuucgccuuucu

SEQ ID NO: 441003 - RNA, 19 nt, Homo sapiens
gaggcagagguccaaguaa

SEQ ID NO: 441004 - RNA, 19 nt, Homo sapiens
guugugggacugcaugcua

SEQ ID NO: 441005 - RNA, 19 nt, Homo sapiens
gagccaaguggaggaagaa

SEQ ID NO: 441006 - RNA, 19 nt, Homo sapiens
agagccaaguggaggaaga

SEQ ID NO: 441007 - RNA, 19 nt, Homo sapiens
uccauuaaauagccguaga

SEQ ID NO: 441008 - RNA, 19 nt, Homo sapiens
ggacugcaugcuacugucu

SEQ ID NO: 441009 - RNA, 19 nt, Homo sapiens
caaagaagauugugcuaag

SEQ ID NO: 441010 - RNA, 19 nt, Homo sapiens
agagaaugcuggcuauuaa

SEQ ID NO: 441011 - RNA, 19 nt, Homo sapiens
gagcccaacugcagaucua

SEQ ID NO: 441012 - RNA, 19 nt, Homo sapiens
gaagagaaagggccaagug

SEQ ID NO: 441013 - RNA, 19 nt, Homo sapiens
ggaaagcggcguuaugaca

SEQ ID NO: 441014 - RNA, 19 nt, Homo sapiens
gggcaaggauucucuguac

SEQ ID NO: 441015 - RNA, 19 nt, Homo sapiens
gaggagauaagaagagaaa

SEQ ID NO: 441016 - RNA, 19 nt, Homo sapiens
gaacugggaggagauaaga

SEQ ID NO: 441017 - RNA, 19 nt, Homo sapiens
cccauaaagugacacagua

SEQ ID NO: 441018 - RNA, 19 nt, Homo sapiens
gccaagugauccaguucua

SEQ ID NO: 441019 - RNA, 19 nt, Homo sapiens
gagaaagggccaagugauc

SEQ ID NO: 441020 - RNA, 19 nt, Homo sapiens
gggaggagauaagaagaga

SEQ ID NO: 441021 - RNA, 19 nt, Homo sapiens
aagagaaugcuggcuauua

SEQ ID NO: 441022 - RNA, 19 nt, Homo sapiens
gagaaugcuggcuauuaaa

SEQ ID NO: 441023 - RNA, 19 nt, Homo sapiens
cuaagagaaugcuggcuau

SEQ ID NO: 441024 - RNA, 19 nt, Homo sapiens
gaagcagaguggcuauggu

SEQ ID NO: 441025 - RNA, 19 nt, Homo sapiens
caacugcagaucuaagaga

SEQ ID NO: 441026 - RNA, 19 nt, Homo sapiens
gcuauggugggcaaacuaa

SEQ ID NO: 441027 - RNA, 19 nt, Homo sapiens
gcucacgcaagcaugguua

SEQ ID NO: 441028 - RNA, 19 nt, Homo sapiens
gggcaaacuaagccgauuu

SEQ ID NO: 441029 - RNA, 19 nt, Homo sapiens
ggagauaagaagagaaagg

SEQ ID NO: 441030 - RNA, 19 nt, Homo sapiens
cugcagaucuaagagaaug

SEQ ID NO: 441031 - RNA, 19 nt, Homo sapiens
acaagaagggcaaggauuc

SEQ ID NO: 441032 - RNA, 19 nt, Homo sapiens
caagugauccaguucuaag

SEQ ID NO: 441033 - RNA, 19 nt, Homo sapiens
cgccggacuuucuguaaga

SEQ ID NO: 441034 - RNA, 19 nt, Homo sapiens
gugauccaguucuaagugu

SEQ ID NO: 441035 - RNA, 19 nt, Homo sapiens
ccaagugauccaguucuaa

SEQ ID NO: 441036 - RNA, 19 nt, Homo sapiens
guacaagaagggcaaggau

SEQ ID NO: 441037 - RNA, 19 nt, Homo sapiens
aaagugacacaguacaaga

SEQ ID NO: 441038 - RNA, 19 nt, Homo sapiens
gcaccaaccccauaaagug

SEQ ID NO: 441039 - RNA, 19 nt, Homo sapiens
ggaagcagaguggcuaugg

SEQ ID NO: 441040 - RNA, 19 nt, Homo sapiens
aguucuaagugucaucuuu

SEQ ID NO: 441041 - RNA, 19 nt, Homo sapiens
gaaagggccaagugaucca

SEQ ID NO: 441042 - RNA, 19 nt, Homo sapiens
gauccaguucuaaguguca

SEQ ID NO: 441043 - RNA, 19 nt, Homo sapiens
gcaagcaccaaccccauaa

SEQ ID NO: 441044 - RNA, 19 nt, Homo sapiens
agggaaagcggcguuauga

SEQ ID NO: 441045 - RNA, 19 nt, Homo sapiens
aagagaaagggccaaguga

SEQ ID NO: 441046 - RNA, 19 nt, Homo sapiens
aaagaagauugugcuaagg

SEQ ID NO: 441047 - RNA, 19 nt, Homo sapiens
uacaagaagggcaaggauu

SEQ ID NO: 441048 - RNA, 19 nt, Homo sapiens
uaagagaaugcuggcuauu

SEQ ID NO: 441049 - RNA, 19 nt, Homo sapiens
uaaagugacacaguacaag

SEQ ID NO: 441050 - RNA, 19 nt, Homo sapiens
cagggaaagcggcguuaug

SEQ ID NO: 441051 - RNA, 19 nt, Homo sapiens
gcaugguuaacgucccuaa

SEQ ID NO: 441052 - RNA, 19 nt, Homo sapiens
guaagaaguguggcaagca

SEQ ID NO: 441053 - RNA, 19 nt, Homo sapiens
aacugcagaucuaagagaa

SEQ ID NO: 441054 - RNA, 19 nt, Homo sapiens
ggaggagauaagaagagaa

SEQ ID NO: 441055 - RNA, 19 nt, Homo sapiens
gaagugacaucgucuuuaa

SEQ ID NO: 441056 - RNA, 19 nt, Homo sapiens
gaucaagacuggagacaaa

SEQ ID NO: 441057 - RNA, 19 nt, Homo sapiens
acaaggaaauaaaggcuua

SEQ ID NO: 441058 - RNA, 19 nt, Homo sapiens
ggacgaggauaugggauuu

SEQ ID NO: 441059 - RNA, 19 nt, Homo sapiens
gauuacaccuucccacuug

SEQ ID NO: 441060 - RNA, 19 nt, Homo sapiens
ggaaauaaaggcuuacuuc

SEQ ID NO: 441061 - RNA, 19 nt, Homo sapiens
gagaaacugcugccucaua

SEQ ID NO: 441062 - RNA, 19 nt, Homo sapiens
gauuuggucucuuugacua

SEQ ID NO: 441063 - RNA, 19 nt, Homo sapiens
ggaagugacaucgucuuua

SEQ ID NO: 441064 - RNA, 19 nt, Homo sapiens
ccauugaaauccugaguga

SEQ ID NO: 441065 - RNA, 19 nt, Homo sapiens
cuacaacccugaagugcuu

SEQ ID NO: 441066 - RNA, 19 nt, Homo sapiens
acauguugcuggccaauaa

SEQ ID NO: 441067 - RNA, 19 nt, Homo sapiens
agaaacugcugccucauau

SEQ ID NO: 441068 - RNA, 19 nt, Homo sapiens
gaaauaaaggcuuacuucu

SEQ ID NO: 441069 - RNA, 19 nt, Homo sapiens
ccaagcagaugcagcagau

SEQ ID NO: 441070 - RNA, 19 nt, Homo sapiens
uaugggauuuggucucuuu

SEQ ID NO: 441071 - RNA, 19 nt, Homo sapiens
gaaugugggcuuuguguuc

SEQ ID NO: 441072 - RNA, 19 nt, Homo sapiens
uaagaucauccaacuauug

SEQ ID NO: 441073 - RNA, 19 nt, Homo sapiens
ccaacuacuuccuuaagau

SEQ ID NO: 441074 - RNA, 19 nt, Homo sapiens
ggaaggcuguggugcugau

SEQ ID NO: 441075 - RNA, 19 nt, Homo sapiens
gauaugggauuuggucucu

SEQ ID NO: 441076 - RNA, 19 nt, Homo sapiens
gaggguguccgcaauguug

SEQ ID NO: 441077 - RNA, 19 nt, Homo sapiens
cuuaagaucauccaacuau

SEQ ID NO: 441078 - RNA, 19 nt, Homo sapiens
ggauuacaccuucccacuu

SEQ ID NO: 441079 - RNA, 19 nt, Homo sapiens
ugaagugcuugauaucaca

SEQ ID NO: 441080 - RNA, 19 nt, Homo sapiens
cagcagguguucgacaaug

SEQ ID NO: 441081 - RNA, 19 nt, Homo sapiens
gcugauccaucugccuuug

SEQ ID NO: 441082 - RNA, 19 nt, Homo sapiens
gacaauggcagcaucuaca

SEQ ID NO: 441083 - RNA, 19 nt, Homo sapiens
cuucuuggcugauccaucu

SEQ ID NO: 441084 - RNA, 19 nt, Homo sapiens
caacuacuuccuuaagauc

SEQ ID NO: 441085 - RNA, 19 nt, Homo sapiens
gaugugcagcugaucaaga

SEQ ID NO: 441086 - RNA, 19 nt, Homo sapiens
ugagugaugugcagcugau

SEQ ID NO: 441087 - RNA, 19 nt, Homo sapiens
ggaaugugggcuuuguguu

SEQ ID NO: 441088 - RNA, 19 nt, Homo sapiens
acccugaagugcuugauau

SEQ ID NO: 441089 - RNA, 19 nt, Homo sapiens
uccaacuacuuccuuaaga

SEQ ID NO: 441090 - RNA, 19 nt, Homo sapiens
gagggcaccuggaaaacaa

SEQ ID NO: 441091 - RNA, 19 nt, Homo sapiens
caucaacggguacaaacga

SEQ ID NO: 441092 - RNA, 19 nt, Homo sapiens
ugaacaugcucaacaucuc

SEQ ID NO: 441093 - RNA, 19 nt, Homo sapiens
aagccacgcugcugaacau

SEQ ID NO: 441094 - RNA, 19 nt, Homo sapiens
ugagaucagggacauguug

SEQ ID NO: 441095 - RNA, 19 nt, Homo sapiens
gaugauuauccgaaauguu

SEQ ID NO: 441096 - RNA, 19 nt, Homo sapiens
gggcaagaacaccaugaug

SEQ ID NO: 441097 - RNA, 19 nt, Homo sapiens
ggaggagucggacgaggau

SEQ ID NO: 441098 - RNA, 19 nt, Homo sapiens
gaagccacgcugcugaaca

SEQ ID NO: 441099 - RNA, 19 nt, Homo sapiens
gggaaugugggcuuugugu

SEQ ID NO: 441100 - RNA, 19 nt, Homo sapiens
gcaaaacaaggaaauaaag

SEQ ID NO: 441101 - RNA, 19 nt, Homo sapiens
uaucaucaacggguacaaa

SEQ ID NO: 441102 - RNA, 19 nt, Homo sapiens
caucuacaacccugaagug

SEQ ID NO: 441103 - RNA, 19 nt, Homo sapiens
gcgaagccacgcugcugaa

SEQ ID NO: 441104 - RNA, 19 nt, Homo sapiens
gggauuuggucucuuugac

SEQ ID NO: 441105 - RNA, 19 nt, Homo sapiens
aaugugggcuuuguguuca

SEQ ID NO: 441106 - RNA, 19 nt, Homo sapiens
ugauccaucugccuuugug

SEQ ID NO: 441107 - RNA, 19 nt, Homo sapiens
ggaggguguccgcaauguu

SEQ ID NO: 441108 - RNA, 19 nt, Homo sapiens
gaaacugcugccucauauc

SEQ ID NO: 441109 - RNA, 19 nt, Homo sapiens
gcuuuguguucaccaagga

SEQ ID NO: 441110 - RNA, 19 nt, Homo sapiens
cagacaaugugggcuccaa

SEQ ID NO: 441111 - RNA, 19 nt, Homo sapiens
caagacuggagacaaagug

SEQ ID NO: 441112 - RNA, 19 nt, Homo sapiens
uggaagugacaucgucuuu

SEQ ID NO: 441113 - RNA, 19 nt, Homo sapiens
ucacugugccagcccagaa

SEQ ID NO: 441114 - RNA, 19 nt, Homo sapiens
gacauguugcuggccaaua

SEQ ID NO: 441115 - RNA, 19 nt, Homo sapiens
ggagucggacgaggauaug

SEQ ID NO: 441116 - RNA, 19 nt, Homo sapiens
uaagguugaagccaaggaa

SEQ ID NO: 441117 - RNA, 19 nt, Homo sapiens
caauguugccagugucugu

SEQ ID NO: 441118 - RNA, 19 nt, Homo sapiens
gaggaaacucugcauucuc

SEQ ID NO: 441119 - RNA, 19 nt, Homo sapiens
ccacgcugcugaacaugcu

SEQ ID NO: 441120 - RNA, 19 nt, Homo sapiens
auugaaauccugagugaug

SEQ ID NO: 441121 - RNA, 19 nt, Homo sapiens
uccagcagguguucgacaa

SEQ ID NO: 441122 - RNA, 19 nt, Homo sapiens
ccuggaggguguccgcaau

SEQ ID NO: 441123 - RNA, 19 nt, Homo sapiens
cauccgagggcaccuggaa

SEQ ID NO: 441124 - RNA, 19 nt, Homo sapiens
gaucaagacuggagacaaa

SEQ ID NO: 441125 - RNA, 19 nt, Homo sapiens
acaaggaaauaaaggcuua

SEQ ID NO: 441126 - RNA, 19 nt, Homo sapiens
ucagugacaucgucuuuaa

SEQ ID NO: 441127 - RNA, 19 nt, Homo sapiens
ggacgaggauaugggauuu

SEQ ID NO: 441128 - RNA, 19 nt, Homo sapiens
gauuacaccuucccacuug

SEQ ID NO: 441129 - RNA, 19 nt, Homo sapiens
ggaaauaaaggcuuacuuc

SEQ ID NO: 441130 - RNA, 19 nt, Homo sapiens
gagaaacugcugccucaua

SEQ ID NO: 441131 - RNA, 19 nt, Homo sapiens
gauuuggucucuuugacua

SEQ ID NO: 441132 - RNA, 19 nt, Homo sapiens
ccauugaaauccugaguga

SEQ ID NO: 441133 - RNA, 19 nt, Homo sapiens
cuacaacccugaagugcuu

SEQ ID NO: 441134 - RNA, 19 nt, Homo sapiens
acauguugcuggccaauaa

SEQ ID NO: 441135 - RNA, 19 nt, Homo sapiens
agaaacugcugccucauau

SEQ ID NO: 441136 - RNA, 19 nt, Homo sapiens
gaaauaaaggcuuacuucu

SEQ ID NO: 441137 - RNA, 19 nt, Homo sapiens
ccaagcagaugcagcagau

SEQ ID NO: 441138 - RNA, 19 nt, Homo sapiens
uaugggauuuggucucuuu

SEQ ID NO: 441139 - RNA, 19 nt, Homo sapiens
gaaugugggcuuuguguuc

SEQ ID NO: 441140 - RNA, 19 nt, Homo sapiens
uaagaucauccaacuauug

SEQ ID NO: 441141 - RNA, 19 nt, Homo sapiens
ccaacuacuuccuuaagau

SEQ ID NO: 441142 - RNA, 19 nt, Homo sapiens
ggaaggcuguggugcugau

SEQ ID NO: 441143 - RNA, 19 nt, Homo sapiens
gauaugggauuuggucucu

SEQ ID NO: 441144 - RNA, 19 nt, Homo sapiens
gaggguguccgcaauguug

SEQ ID NO: 441145 - RNA, 19 nt, Homo sapiens
cuuaagaucauccaacuau

SEQ ID NO: 441146 - RNA, 19 nt, Homo sapiens
ggauuacaccuucccacuu

SEQ ID NO: 441147 - RNA, 19 nt, Homo sapiens
ugaagugcuugauaucaca

SEQ ID NO: 441148 - RNA, 19 nt, Homo sapiens
cagcagguguucgacaaug

SEQ ID NO: 441149 - RNA, 19 nt, Homo sapiens
gcugauccaucugccuuug

SEQ ID NO: 441150 - RNA, 19 nt, Homo sapiens
gacaauggcagcaucuaca

SEQ ID NO: 441151 - RNA, 19 nt, Homo sapiens
cuucuuggcugauccaucu

SEQ ID NO: 441152 - RNA, 19 nt, Homo sapiens
caacuacuuccuuaagauc

SEQ ID NO: 441153 - RNA, 19 nt, Homo sapiens
gaugugcagcugaucaaga

SEQ ID NO: 441154 - RNA, 19 nt, Homo sapiens
ugagugaugugcagcugau

SEQ ID NO: 441155 - RNA, 19 nt, Homo sapiens
ggaaugugggcuuuguguu

SEQ ID NO: 441156 - RNA, 19 nt, Homo sapiens
acccugaagugcuugauau

SEQ ID NO: 441157 - RNA, 19 nt, Homo sapiens
uccaacuacuuccuuaaga

SEQ ID NO: 441158 - RNA, 19 nt, Homo sapiens
gagggcaccuggaaaacaa

SEQ ID NO: 441159 - RNA, 19 nt, Homo sapiens
caucaacggguacaaacga

SEQ ID NO: 441160 - RNA, 19 nt, Homo sapiens
ugaacaugcucaacaucuc

SEQ ID NO: 441161 - RNA, 19 nt, Homo sapiens
aagccacgcugcugaacau

SEQ ID NO: 441162 - RNA, 19 nt, Homo sapiens
ugagaucagggacauguug

SEQ ID NO: 441163 - RNA, 19 nt, Homo sapiens
gaugauuauccgaaauguu

SEQ ID NO: 441164 - RNA, 19 nt, Homo sapiens
gggcaagaacaccaugaug

SEQ ID NO: 441165 - RNA, 19 nt, Homo sapiens
ggaggagucggacgaggau

SEQ ID NO: 441166 - RNA, 19 nt, Homo sapiens
gaagccacgcugcugaaca

SEQ ID NO: 441167 - RNA, 19 nt, Homo sapiens
gggaaugugggcuuugugu

SEQ ID NO: 441168 - RNA, 19 nt, Homo sapiens
gcaaaacaaggaaauaaag

SEQ ID NO: 441169 - RNA, 19 nt, Homo sapiens
ccucagugacaucgucuuu

SEQ ID NO: 441170 - RNA, 19 nt, Homo sapiens
uaucaucaacggguacaaa

SEQ ID NO: 441171 - RNA, 19 nt, Homo sapiens
caucuacaacccugaagug

SEQ ID NO: 441172 - RNA, 19 nt, Homo sapiens
gcgaagccacgcugcugaa

SEQ ID NO: 441173 - RNA, 19 nt, Homo sapiens
gggauuuggucucuuugac

SEQ ID NO: 441174 - RNA, 19 nt, Homo sapiens
aaugugggcuuuguguuca

SEQ ID NO: 441175 - RNA, 19 nt, Homo sapiens
ugauccaucugccuuugug

SEQ ID NO: 441176 - RNA, 19 nt, Homo sapiens
ggaggguguccgcaauguu

SEQ ID NO: 441177 - RNA, 19 nt, Homo sapiens
gaaacugcugccucauauc

SEQ ID NO: 441178 - RNA, 19 nt, Homo sapiens
gcuuuguguucaccaagga

SEQ ID NO: 441179 - RNA, 19 nt, Homo sapiens
cccugucucuccucaguga

SEQ ID NO: 441180 - RNA, 19 nt, Homo sapiens
cagacaaugugggcuccaa

SEQ ID NO: 441181 - RNA, 19 nt, Homo sapiens
caagacuggagacaaagug

SEQ ID NO: 441182 - RNA, 19 nt, Homo sapiens
ucacugugccagcccagaa

SEQ ID NO: 441183 - RNA, 19 nt, Homo sapiens
gacauguugcuggccaaua

SEQ ID NO: 441184 - RNA, 19 nt, Homo sapiens
ggagucggacgaggauaug

SEQ ID NO: 441185 - RNA, 19 nt, Homo sapiens
uaagguugaagccaaggaa

SEQ ID NO: 441186 - RNA, 19 nt, Homo sapiens
caauguugccagugucugu

SEQ ID NO: 441187 - RNA, 19 nt, Homo sapiens
gaggaaacucugcauucuc

SEQ ID NO: 441188 - RNA, 19 nt, Homo sapiens
ccacgcugcugaacaugcu

SEQ ID NO: 441189 - RNA, 19 nt, Homo sapiens
auugaaauccugagugaug

SEQ ID NO: 441190 - RNA, 19 nt, Homo sapiens
uccagcagguguucgacaa

SEQ ID NO: 441191 - RNA, 19 nt, Homo sapiens
ccuggaggguguccgcaau

SEQ ID NO: 441192 - RNA, 19 nt, Homo sapiens
cauccgagggcaccuggaa

SEQ ID NO: 441193 - RNA, 19 nt, Homo sapiens
gaaaguggaagcaaagaaa

SEQ ID NO: 441194 - RNA, 19 nt, Homo sapiens
gacaugggcuuuggucuuu

SEQ ID NO: 441195 - RNA, 19 nt, Homo sapiens
uaaagcagccgguguaaau

SEQ ID NO: 441196 - RNA, 19 nt, Homo sapiens
agaagaaaguggaagcaaa

SEQ ID NO: 441197 - RNA, 19 nt, Homo sapiens
gaagaaaguggaagcaaag

SEQ ID NO: 441198 - RNA, 19 nt, Homo sapiens
guguaaauguugagccuuu

SEQ ID NO: 441199 - RNA, 19 nt, Homo sapiens
gcacgacgaugaggugaca

SEQ ID NO: 441200 - RNA, 19 nt, Homo sapiens
ggagucugaugaugacaug

SEQ ID NO: 441201 - RNA, 19 nt, Homo sapiens
ggaagcaaagaaagaagaa

SEQ ID NO: 441202 - RNA, 19 nt, Homo sapiens
cauuaaagcagccggugua

SEQ ID NO: 441203 - RNA, 19 nt, Homo sapiens
gagaagaaaguggaagcaa

SEQ ID NO: 441204 - RNA, 19 nt, Homo sapiens
ccgaggagucugaugauga

SEQ ID NO: 441205 - RNA, 19 nt, Homo sapiens
ugacaugggcuuuggucuu

SEQ ID NO: 441206 - RNA, 19 nt, Homo sapiens
cgaggagucugaugaugac

SEQ ID NO: 441207 - RNA, 19 nt, Homo sapiens
gaugaugacaugggcuuug

SEQ ID NO: 441208 - RNA, 19 nt, Homo sapiens
cagccgguguaaauguuga

SEQ ID NO: 441209 - RNA, 19 nt, Homo sapiens
aagcaaagaaagaagaauc

SEQ ID NO: 441210 - RNA, 19 nt, Homo sapiens
gaagcaaagaaagaagaau

SEQ ID NO: 441211 - RNA, 19 nt, Homo sapiens
agaaaguggaagcaaagaa

SEQ ID NO: 441212 - RNA, 19 nt, Homo sapiens
aauccgaggagucugauga

SEQ ID NO: 441213 - RNA, 19 nt, Homo sapiens
aagaauccgaggagucuga

SEQ ID NO: 441214 - RNA, 19 nt, Homo sapiens
ggagaagaaaguggaagca

SEQ ID NO: 441215 - RNA, 19 nt, Homo sapiens
gcagccgguguaaauguug

SEQ ID NO: 441216 - RNA, 19 nt, Homo sapiens
ccaaggacaucaagaagau

SEQ ID NO: 441217 - RNA, 19 nt, Homo sapiens
gacaugggauuuggccuuu

SEQ ID NO: 441218 - RNA, 19 nt, Homo sapiens
aaacauugaagacgucauu

SEQ ID NO: 441219 - RNA, 19 nt, Homo sapiens
gaugaugacaugggauuug

SEQ ID NO: 441220 - RNA, 19 nt, Homo sapiens
gcgccaaggacaucaagaa

SEQ ID NO: 441221 - RNA, 19 nt, Homo sapiens
gccaaggacaucaagaaga

SEQ ID NO: 441222 - RNA, 19 nt, Homo sapiens
cagaugaugacaugggauu

SEQ ID NO: 441223 - RNA, 19 nt, Homo sapiens
ucaaggaaaucaagaacua

SEQ ID NO: 441224 - RNA, 19 nt, Homo sapiens
ucaacgagcuccugaagaa

SEQ ID NO: 441225 - RNA, 19 nt, Homo sapiens
cgaaagaacggacacauuu

SEQ ID NO: 441226 - RNA, 19 nt, Homo sapiens
ggaagaagauauccccaua

SEQ ID NO: 441227 - RNA, 19 nt, Homo sapiens
gcaccgugguucuggagua

SEQ ID NO: 441228 - RNA, 19 nt, Homo sapiens
caaagccaaugucgccaaa

SEQ ID NO: 441229 - RNA, 19 nt, Homo sapiens
aagugaagcugaucaagga

SEQ ID NO: 441230 - RNA, 19 nt, Homo sapiens
gcgaaagaacggacacauu

SEQ ID NO: 441231 - RNA, 19 nt, Homo sapiens
ucugguggcugcugagaaa

SEQ ID NO: 441232 - RNA, 19 nt, Homo sapiens
ggaaaucucagaccucaac

SEQ ID NO: 441233 - RNA, 19 nt, Homo sapiens
cagccucacucucuuggaa

SEQ ID NO: 441234 - RNA, 19 nt, Homo sapiens
gccgauggguggugugaug

SEQ ID NO: 441235 - RNA, 19 nt, Homo sapiens
ggacaucgccagccucacu

SEQ ID NO: 441236 - RNA, 19 nt, Homo sapiens
ggaaaucaagaacuacauc

SEQ ID NO: 441237 - RNA, 19 nt, Homo sapiens
ggaaaucaaagccaauguc

SEQ ID NO: 441238 - RNA, 19 nt, Homo sapiens
ggcgacaggugccaugugu

SEQ ID NO: 441239 - RNA, 19 nt, Homo sapiens
gcucggaggacuuguguuc

SEQ ID NO: 441240 - RNA, 19 nt, Homo sapiens
ugaagcugaucaaggaaau

SEQ ID NO: 441241 - RNA, 19 nt, Homo sapiens
cgaagcccguggacaaagu

SEQ ID NO: 441242 - RNA, 19 nt, Homo sapiens
aaagaacggacacauuuca

SEQ ID NO: 441243 - RNA, 19 nt, Homo sapiens
ccaaagcugaggcggagaa

SEQ ID NO: 441244 - RNA, 19 nt, Homo sapiens
ggacaaagugaagcugauc

SEQ ID NO: 441245 - RNA, 19 nt, Homo sapiens
gaucaaggaaaucaagaac

SEQ ID NO: 441246 - RNA, 19 nt, Homo sapiens
aggaggcgguggaagaaga

SEQ ID NO: 441247 - RNA, 19 nt, Homo sapiens
caacgagcuccugaagaaa

SEQ ID NO: 441248 - RNA, 19 nt, Homo sapiens
gggaaccgcgugugaccuu

SEQ ID NO: 441249 - RNA, 19 nt, Homo sapiens
gaagaaaacguugaagauc

SEQ ID NO: 441250 - RNA, 19 nt, Homo sapiens
aagcugaggcggagaagau

SEQ ID NO: 441251 - RNA, 19 nt, Homo sapiens
gugaagcugaucaaggaaa

SEQ ID NO: 441252 - RNA, 19 nt, Homo sapiens
aaucaagaacuacauccaa

SEQ ID NO: 441253 - RNA, 19 nt, Homo sapiens
ccaggaggcgguggaagaa

SEQ ID NO: 441254 - RNA, 19 nt, Homo sapiens
gacaaagugaagcugauca

SEQ ID NO: 441255 - RNA, 19 nt, Homo sapiens
gccucacucucuuggaaau

SEQ ID NO: 441256 - RNA, 19 nt, Homo sapiens
aggcgaagcccguggacaa

SEQ ID NO: 441257 - RNA, 19 nt, Homo sapiens
gauggguggugugaugucu

SEQ ID NO: 441258 - RNA, 19 nt, Homo sapiens
ggaccacuauuaagccaua

SEQ ID NO: 441259 - RNA, 19 nt, Homo sapiens
ucagagcgaggcuaaauuu

SEQ ID NO: 441260 - RNA, 19 nt, Homo sapiens
acccuuggcuccuguguuu

SEQ ID NO: 441261 - RNA, 19 nt, Homo sapiens
gagcgaggcuaaauuuacg

SEQ ID NO: 441262 - RNA, 19 nt, Homo sapiens
caacacgucccuaacuugu

SEQ ID NO: 441263 - RNA, 19 nt, Homo sapiens
gcaccagauuguccuugug

SEQ ID NO: 441264 - RNA, 19 nt, Homo sapiens
gcaugagggccugugguua

SEQ ID NO: 441265 - RNA, 19 nt, Homo sapiens
ccacucagagcgaggcuaa

SEQ ID NO: 441266 - RNA, 19 nt, Homo sapiens
gcgucaagcucaccguugu

SEQ ID NO: 441267 - RNA, 19 nt, Homo sapiens
acggagggacuuucuguua

SEQ ID NO: 441268 - RNA, 19 nt, Homo sapiens
ggcagccacucauggauuc

SEQ ID NO: 441269 - RNA, 19 nt, Homo sapiens
gugguccugugcacguuua

SEQ ID NO: 441270 - RNA, 19 nt, Homo sapiens
ggagggacuuucuguuagc

SEQ ID NO: 441271 - RNA, 19 nt, Homo sapiens
cggagggacuuucuguuag

SEQ ID NO: 441272 - RNA, 19 nt, Homo sapiens
uccaucaggaccacuauua

SEQ ID NO: 441273 - RNA, 19 nt, Homo sapiens
cagagcgaggcuaaauuua

SEQ ID NO: 441274 - RNA, 19 nt, Homo sapiens
cccuggcgcuugugaugua

SEQ ID NO: 441275 - RNA, 19 nt, Homo sapiens
ccaucaggaccacuauuaa

SEQ ID NO: 441276 - RNA, 19 nt, Homo sapiens
caugagggccugugguuag

SEQ ID NO: 441277 - RNA, 19 nt, Homo sapiens
uggcuacccugaaccagau

SEQ ID NO: 441278 - RNA, 19 nt, Homo sapiens
gcugggacaagacacugua

SEQ ID NO: 441279 - RNA, 19 nt, Homo sapiens
caucaggaccacuauuaag

SEQ ID NO: 441280 - RNA, 19 nt, Homo sapiens
ggccucaacacgucccuaa

SEQ ID NO: 441281 - RNA, 19 nt, Homo sapiens
ucaacacgucccuaacuug

SEQ ID NO: 441282 - RNA, 19 nt, Homo sapiens
gacccuggcgcuugugaug

SEQ ID NO: 441283 - RNA, 19 nt, Homo sapiens
guccgcgaccucaccuuua

SEQ ID NO: 441284 - RNA, 19 nt, Homo sapiens
guggccacgugcagaagaa

SEQ ID NO: 441285 - RNA, 19 nt, Homo sapiens
gccugugguuagaccuaua

SEQ ID NO: 441286 - RNA, 19 nt, Homo sapiens
cucaacacgucccuaacuu

SEQ ID NO: 441287 - RNA, 19 nt, Homo sapiens
gggacaagacacuguacug

SEQ ID NO: 441288 - RNA, 19 nt, Homo sapiens
gagggacuuucuguuagca

SEQ ID NO: 441289 - RNA, 19 nt, Homo sapiens
ggccugugguuagaccuau

SEQ ID NO: 441290 - RNA, 19 nt, Homo sapiens
ggaccacuauuaagccaua

SEQ ID NO: 441291 - RNA, 19 nt, Homo sapiens
acccuuggcuccuguguuu

SEQ ID NO: 441292 - RNA, 19 nt, Homo sapiens
caacacgucccuaacuugu

SEQ ID NO: 441293 - RNA, 19 nt, Homo sapiens
gcaccagauuguccuugug

SEQ ID NO: 441294 - RNA, 19 nt, Homo sapiens
gcgucaagcucaccguugu

SEQ ID NO: 441295 - RNA, 19 nt, Homo sapiens
ggcagccacucauggauuc

SEQ ID NO: 441296 - RNA, 19 nt, Homo sapiens
gugguccugugcacguuua

SEQ ID NO: 441297 - RNA, 19 nt, Homo sapiens
uccaucaggaccacuauua

SEQ ID NO: 441298 - RNA, 19 nt, Homo sapiens
cccuggcgcuugugaugua

SEQ ID NO: 441299 - RNA, 19 nt, Homo sapiens
ccaucaggaccacuauuaa

SEQ ID NO: 441300 - RNA, 19 nt, Homo sapiens
uggcuacccugaaccagau

SEQ ID NO: 441301 - RNA, 19 nt, Homo sapiens
gcugggacaagacacugua

SEQ ID NO: 441302 - RNA, 19 nt, Homo sapiens
caucaggaccacuauuaag

SEQ ID NO: 441303 - RNA, 19 nt, Homo sapiens
ggccucaacacgucccuaa

SEQ ID NO: 441304 - RNA, 19 nt, Homo sapiens
ucaacacgucccuaacuug

SEQ ID NO: 441305 - RNA, 19 nt, Homo sapiens
gacccuggcgcuugugaug

SEQ ID NO: 441306 - RNA, 19 nt, Homo sapiens
guggccacgugcagaagaa

SEQ ID NO: 441307 - RNA, 19 nt, Homo sapiens
guccgcgaccucaccuuua

SEQ ID NO: 441308 - RNA, 19 nt, Homo sapiens
cucaacacgucccuaacuu

SEQ ID NO: 441309 - RNA, 19 nt, Homo sapiens
gggacaagacacuguacug

SEQ ID NO: 441310 - RNA, 19 nt, Homo sapiens
ggaccacuauuaagccaua

SEQ ID NO: 441311 - RNA, 19 nt, Homo sapiens
ucagagcgaggcuaaauuu

SEQ ID NO: 441312 - RNA, 19 nt, Homo sapiens
acccuuggcuccuguguuu

SEQ ID NO: 441313 - RNA, 19 nt, Homo sapiens
gagcgaggcuaaauuuacg

SEQ ID NO: 441314 - RNA, 19 nt, Homo sapiens
caacacgucccuaacuugu

SEQ ID NO: 441315 - RNA, 19 nt, Homo sapiens
gcaccagauuguccuugug

SEQ ID NO: 441316 - RNA, 19 nt, Homo sapiens
gcaugagggccugugguua

SEQ ID NO: 441317 - RNA, 19 nt, Homo sapiens
ccacucagagcgaggcuaa

SEQ ID NO: 441318 - RNA, 19 nt, Homo sapiens
gcgucaagcucaccguugu

SEQ ID NO: 441319 - RNA, 19 nt, Homo sapiens
acggagggacuuucuguua

SEQ ID NO: 441320 - RNA, 19 nt, Homo sapiens
ggcagccacucauggauuc

SEQ ID NO: 441321 - RNA, 19 nt, Homo sapiens
gugguccugugcacguuua

SEQ ID NO: 441322 - RNA, 19 nt, Homo sapiens
ggagggacuuucuguuagc

SEQ ID NO: 441323 - RNA, 19 nt, Homo sapiens
cggagggacuuucuguuag

SEQ ID NO: 441324 - RNA, 19 nt, Homo sapiens
uccaucaggaccacuauua

SEQ ID NO: 441325 - RNA, 19 nt, Homo sapiens
cagagcgaggcuaaauuua

SEQ ID NO: 441326 - RNA, 19 nt, Homo sapiens
cccuggcgcuugugaugua

SEQ ID NO: 441327 - RNA, 19 nt, Homo sapiens
ccaucaggaccacuauuaa

SEQ ID NO: 441328 - RNA, 19 nt, Homo sapiens
caugagggccugugguuag

SEQ ID NO: 441329 - RNA, 19 nt, Homo sapiens
uggcuacccugaaccagau

SEQ ID NO: 441330 - RNA, 19 nt, Homo sapiens
gcugggacaagacacugua

SEQ ID NO: 441331 - RNA, 19 nt, Homo sapiens
caucaggaccacuauuaag

SEQ ID NO: 441332 - RNA, 19 nt, Homo sapiens
ggccucaacacgucccuaa

SEQ ID NO: 441333 - RNA, 19 nt, Homo sapiens
ucaacacgucccuaacuug

SEQ ID NO: 441334 - RNA, 19 nt, Homo sapiens
gacccuggcgcuugugaug

SEQ ID NO: 441335 - RNA, 19 nt, Homo sapiens
guccgcgaccucaccuuua

SEQ ID NO: 441336 - RNA, 19 nt, Homo sapiens
guggccacgugcagaagaa

SEQ ID NO: 441337 - RNA, 19 nt, Homo sapiens
gccugugguuagaccuaua

SEQ ID NO: 441338 - RNA, 19 nt, Homo sapiens
cucaacacgucccuaacuu

SEQ ID NO: 441339 - RNA, 19 nt, Homo sapiens
gggacaagacacuguacug

SEQ ID NO: 441340 - RNA, 19 nt, Homo sapiens
gagggacuuucuguuagca

SEQ ID NO: 441341 - RNA, 19 nt, Homo sapiens
ggccugugguuagaccuau

SEQ ID NO: 441342 - RNA, 19 nt, Homo sapiens
ggaaguacgugaaaccaaa

SEQ ID NO: 441343 - RNA, 19 nt, Homo sapiens
ccaagaacauugaaauuga

SEQ ID NO: 441344 - RNA, 19 nt, Homo sapiens
gaagacccauuacaucguu

SEQ ID NO: 441345 - RNA, 19 nt, Homo sapiens
gaagguagccugcaucaca

SEQ ID NO: 441346 - RNA, 19 nt, Homo sapiens
ucaaggagcuggugcugaa

SEQ ID NO: 441347 - RNA, 19 nt, Homo sapiens
ggaagaaaauguggacuua

SEQ ID NO: 441348 - RNA, 19 nt, Homo sapiens
gcuacaaccucccaagcua

SEQ ID NO: 441349 - RNA, 19 nt, Homo sapiens
gcaggcagauuggguggua

SEQ ID NO: 441350 - RNA, 19 nt, Homo sapiens
cugaggaccuacuggauua

SEQ ID NO: 441351 - RNA, 19 nt, Homo sapiens
gcuaugaguaccucuauaa

SEQ ID NO: 441352 - RNA, 19 nt, Homo sapiens
agaagagccuggagacuga

SEQ ID NO: 441353 - RNA, 19 nt, Homo sapiens
uaauuugggugaccaguau

SEQ ID NO: 441354 - RNA, 19 nt, Homo sapiens
uaauauugcuguggaagaa

SEQ ID NO: 441355 - RNA, 19 nt, Homo sapiens
agugaaagcugacaucugu

SEQ ID NO: 441356 - RNA, 19 nt, Homo sapiens
agaaagacacguacauuga

SEQ ID NO: 441357 - RNA, 19 nt, Homo sapiens
agagaacaauuuggaagua

SEQ ID NO: 441358 - RNA, 19 nt, Homo sapiens
gagaagaugaggaagagaa

SEQ ID NO: 441359 - RNA, 19 nt, Homo sapiens
gaaccauuauuucuacucu

SEQ ID NO: 441360 - RNA, 19 nt, Homo sapiens
gcacuacaccuaucuggau

SEQ ID NO: 441361 - RNA, 19 nt, Homo sapiens
gcacugaagaugagguuug

SEQ ID NO: 441362 - RNA, 19 nt, Homo sapiens
gaacaaauggaaauaaagc

SEQ ID NO: 441363 - RNA, 19 nt, Homo sapiens
caagaaagacacguacauu

SEQ ID NO: 441364 - RNA, 19 nt, Homo sapiens
gaaggagccaagaacauug

SEQ ID NO: 441365 - RNA, 19 nt, Homo sapiens
ggccaagauuucagucauu

SEQ ID NO: 441366 - RNA, 19 nt, Homo sapiens
gggagauucuucacaguca

SEQ ID NO: 441367 - RNA, 19 nt, Homo sapiens
uagauucucugacugugaa

SEQ ID NO: 441368 - RNA, 19 nt, Homo sapiens
gagaugugccugccuauag

SEQ ID NO: 441369 - RNA, 19 nt, Homo sapiens
aagcuugccucucgaaaug

SEQ ID NO: 441370 - RNA, 19 nt, Homo sapiens
gguauucuguucugaaguc

SEQ ID NO: 441371 - RNA, 19 nt, Homo sapiens
ugaaagcugacaucuguaa

SEQ ID NO: 441372 - RNA, 19 nt, Homo sapiens
gaaagacacguacauugag

SEQ ID NO: 441373 - RNA, 19 nt, Homo sapiens
cagaugagcugcacuacac

SEQ ID NO: 441374 - RNA, 19 nt, Homo sapiens
gccaagaacauugaaauug

SEQ ID NO: 441375 - RNA, 19 nt, Homo sapiens
gaugaacaagugauagauu

SEQ ID NO: 441376 - RNA, 19 nt, Homo sapiens
ggaagagaacaauuuggaa

SEQ ID NO: 441377 - RNA, 19 nt, Homo sapiens
aaagacacguacauugaga

SEQ ID NO: 441378 - RNA, 19 nt, Homo sapiens
gccaagauuucagucauug

SEQ ID NO: 441379 - RNA, 19 nt, Homo sapiens
cccaugugcuucauccaua

SEQ ID NO: 441380 - RNA, 19 nt, Homo sapiens
gaaauaaagcagggacugu

SEQ ID NO: 441381 - RNA, 19 nt, Homo sapiens
uaaagcgugugugaacaaa

SEQ ID NO: 441382 - RNA, 19 nt, Homo sapiens
gcaggagaauugcuugaac

SEQ ID NO: 441383 - RNA, 19 nt, Homo sapiens
cuggcaagcucaagaaaga

SEQ ID NO: 441384 - RNA, 19 nt, Homo sapiens
gaagcuugccucucgaaau

SEQ ID NO: 441385 - RNA, 19 nt, Homo sapiens
gucaauagguacaagcaau

SEQ ID NO: 441386 - RNA, 19 nt, Homo sapiens
gagcugcacuacaccuauc

SEQ ID NO: 441387 - RNA, 19 nt, Homo sapiens
ugaaggagccaagaacauu

SEQ ID NO: 441388 - RNA, 19 nt, Homo sapiens
gggagaagaugaggaagag

SEQ ID NO: 441389 - RNA, 19 nt, Homo sapiens
gagccaagaacauugaaau

SEQ ID NO: 441390 - RNA, 19 nt, Homo sapiens
acagccagauaguggaaua

SEQ ID NO: 441391 - RNA, 19 nt, Homo sapiens
uaccagagacagccagaua

SEQ ID NO: 441392 - RNA, 19 nt, Homo sapiens
gaaagcugacaucuguaaa

SEQ ID NO: 441393 - RNA, 19 nt, Homo sapiens
caagugauagauucucuga

SEQ ID NO: 441394 - RNA, 19 nt, Homo sapiens
aagcgugugugaacaaaug

SEQ ID NO: 441395 - RNA, 19 nt, Homo sapiens
acaagagaauaggccuuua

SEQ ID NO: 441396 - RNA, 19 nt, Homo sapiens
ggaugaagguagccugcau

SEQ ID NO: 441397 - RNA, 19 nt, Homo sapiens
gcagguaaagggagaagau

SEQ ID NO: 441398 - RNA, 19 nt, Homo sapiens
gagaacaauuuggaaguac

SEQ ID NO: 441399 - RNA, 19 nt, Homo sapiens
ccucuuuccugcuggcuuu

SEQ ID NO: 441400 - RNA, 19 nt, Homo sapiens
ucaccaagaucgaccacau

SEQ ID NO: 441401 - RNA, 19 nt, Homo sapiens
guacgugaaaccaaaauua

SEQ ID NO: 441402 - RNA, 19 nt, Homo sapiens
cgacagagugagcgaaaug

SEQ ID NO: 441403 - RNA, 19 nt, Homo sapiens
ccuauagucaggauacuuu

SEQ ID NO: 441404 - RNA, 19 nt, Homo sapiens
caacgaagacacaaaccau

SEQ ID NO: 441405 - RNA, 19 nt, Homo sapiens
ggagauucuucacagucaa

SEQ ID NO: 441406 - RNA, 19 nt, Homo sapiens
gaucacccagucagagaaa

SEQ ID NO: 441407 - RNA, 19 nt, Homo sapiens
ggacaucuccacccucaac

SEQ ID NO: 441408 - RNA, 19 nt, Homo sapiens
aaagggagaagaugaggaa

SEQ ID NO: 441409 - RNA, 19 nt, Homo sapiens
gaguaccucuauaauuugg

SEQ ID NO: 441410 - RNA, 19 nt, Homo sapiens
gggccaagauuucagucau

SEQ ID NO: 441411 - RNA, 19 nt, Homo sapiens
aagaaagacacguacauug

SEQ ID NO: 441412 - RNA, 19 nt, Homo sapiens
gaugaggaagagaacaauu

SEQ ID NO: 441413 - RNA, 19 nt, Homo sapiens
acgagaccgucaauaggua

SEQ ID NO: 441414 - RNA, 19 nt, Homo sapiens
guaauauugcuguggaaga

SEQ ID NO: 441415 - RNA, 19 nt, Homo sapiens
ugaggaagagaacaauuug

SEQ ID NO: 441416 - RNA, 19 nt, Homo sapiens
ccaugugcuucauccauau

SEQ ID NO: 441417 - RNA, 19 nt, Homo sapiens
gguggaagacccauuacau

SEQ ID NO: 441418 - RNA, 19 nt, Homo sapiens
caagauuucagucauugug

SEQ ID NO: 441419 - RNA, 19 nt, Homo sapiens
aguccaggcugaagacaga

SEQ ID NO: 441420 - RNA, 19 nt, Homo sapiens
ccucaacaguggcaagaag

SEQ ID NO: 441421 - RNA, 19 nt, Homo sapiens
ucacagagcaggucuugac

SEQ ID NO: 441422 - RNA, 19 nt, Homo sapiens
ucaacaaggugcucaugcu

SEQ ID NO: 441423 - RNA, 19 nt, Homo sapiens
uggaccauguguuugauga

SEQ ID NO: 441424 - RNA, 19 nt, Homo sapiens
gaagaucauccugccugaa

SEQ ID NO: 441425 - RNA, 19 nt, Homo sapiens
agugauagauucucugacu

SEQ ID NO: 441426 - RNA, 19 nt, Homo sapiens
augaacaagugauagauuc

SEQ ID NO: 441427 - RNA, 19 nt, Homo sapiens
gaccauguguuugaugaac

SEQ ID NO: 441428 - RNA, 19 nt, Homo sapiens
ccagccaccuccuuauuuu

SEQ ID NO: 441429 - RNA, 19 nt, Homo sapiens
cugcccaggauguuuauua

SEQ ID NO: 441430 - RNA, 19 nt, Homo sapiens
uauccuccauccguucuuu

SEQ ID NO: 441431 - RNA, 19 nt, Homo sapiens
cucgaaauguggagagcua

SEQ ID NO: 441432 - RNA, 19 nt, Homo sapiens
ccacuacacguucaacaag

SEQ ID NO: 441433 - RNA, 19 nt, Homo sapiens
gaacaagugauagauucuc

SEQ ID NO: 441434 - RNA, 19 nt, Homo sapiens
guuuguggaccauguguuu

SEQ ID NO: 441435 - RNA, 19 nt, Homo sapiens
ggaagacccauuacaucgu

SEQ ID NO: 441436 - RNA, 19 nt, Homo sapiens
cgucaggcagugugaguuu

SEQ ID NO: 441437 - RNA, 19 nt, Homo sapiens
caagagaauaggccuuuac

SEQ ID NO: 441438 - RNA, 19 nt, Homo sapiens
gggccuuucucacgcuaug

SEQ ID NO: 441439 - RNA, 19 nt, Homo sapiens
gaucaaugaggacgugaag

SEQ ID NO: 441440 - RNA, 19 nt, Homo sapiens
gucccgagcuaccucuuuc

SEQ ID NO: 441441 - RNA, 19 nt, Homo sapiens
gcucccaguugcucuugau

SEQ ID NO: 441442 - RNA, 19 nt, Homo sapiens
guaagaagcugugaauauu

SEQ ID NO: 441443 - RNA, 19 nt, Homo sapiens
ggacucagcucaacauguu

SEQ ID NO: 441444 - RNA, 19 nt, Homo sapiens
ggacugagccauccauuaa

SEQ ID NO: 441445 - RNA, 19 nt, Homo sapiens
gaugugagaucucuauuuc

SEQ ID NO: 441446 - RNA, 19 nt, Homo sapiens
gagcucagauagucucuuu

SEQ ID NO: 441447 - RNA, 19 nt, Homo sapiens
caagaacaauucacaguau

SEQ ID NO: 441448 - RNA, 19 nt, Homo sapiens
caccuacacucucuacuua

SEQ ID NO: 441449 - RNA, 19 nt, Homo sapiens
ggaaacaacagcguuauuu

SEQ ID NO: 441450 - RNA, 19 nt, Homo sapiens
gaaguuggcaucacaaaug

SEQ ID NO: 441451 - RNA, 19 nt, Homo sapiens
gcacauuaguuccagaaga

SEQ ID NO: 441452 - RNA, 19 nt, Homo sapiens
ucacaaauguugaucuuuc

SEQ ID NO: 441453 - RNA, 19 nt, Homo sapiens
gaauaaagaggguaacaau

SEQ ID NO: 441454 - RNA, 19 nt, Homo sapiens
guaccuacaucagaucuaa

SEQ ID NO: 441455 - RNA, 19 nt, Homo sapiens
acaagaacguguacaaguu

SEQ ID NO: 441456 - RNA, 19 nt, Homo sapiens
gaaacaacagcguuauuug

SEQ ID NO: 441457 - RNA, 19 nt, Homo sapiens
gaaaaggagucaagaacaa

SEQ ID NO: 441458 - RNA, 19 nt, Homo sapiens
gagucaagaucuccacuga

SEQ ID NO: 441459 - RNA, 19 nt, Homo sapiens
cacauuaguuccagaagaa

SEQ ID NO: 441460 - RNA, 19 nt, Homo sapiens
ggauaaggaucagagcauu

SEQ ID NO: 441461 - RNA, 19 nt, Homo sapiens
ggugacaaccgguauauug

SEQ ID NO: 441462 - RNA, 19 nt, Homo sapiens
gaagaaggacuggaaacaa

SEQ ID NO: 441463 - RNA, 19 nt, Homo sapiens
caaaugagaccaaagaucu

SEQ ID NO: 441464 - RNA, 19 nt, Homo sapiens
gcuccuagcacgauuauau

SEQ ID NO: 441465 - RNA, 19 nt, Homo sapiens
gaacacuggugcugaacuc

SEQ ID NO: 441466 - RNA, 19 nt, Homo sapiens
ccuacaagcucauggauca

SEQ ID NO: 441467 - RNA, 19 nt, Homo sapiens
gaucgcccuuucacaaauu

SEQ ID NO: 441468 - RNA, 19 nt, Homo sapiens
caagagaacagcacauuag

SEQ ID NO: 441469 - RNA, 19 nt, Homo sapiens
caagaacguguacaaguuu

SEQ ID NO: 441470 - RNA, 19 nt, Homo sapiens
ggagaugccacuuugaaga

SEQ ID NO: 441471 - RNA, 19 nt, Homo sapiens
ggauaccucugaaagaaag

SEQ ID NO: 441472 - RNA, 19 nt, Homo sapiens
caagaucuccacugaaguu

SEQ ID NO: 441473 - RNA, 19 nt, Homo sapiens
ucaggccacuguuaaacua

SEQ ID NO: 441474 - RNA, 19 nt, Homo sapiens
caauguggauucccucuuc

SEQ ID NO: 441475 - RNA, 19 nt, Homo sapiens
gccaaugucuccaacuuca

SEQ ID NO: 441476 - RNA, 19 nt, Homo sapiens
gaagcucccucgacugucu

SEQ ID NO: 441477 - RNA, 19 nt, Homo sapiens
gaaggugacaaccgguaua

SEQ ID NO: 441478 - RNA, 19 nt, Homo sapiens
gaacugcaaggcccuguga

SEQ ID NO: 441479 - RNA, 19 nt, Homo sapiens
ugugagaucucuauuucaa

SEQ ID NO: 441480 - RNA, 19 nt, Homo sapiens
gagaugccacuuugaagaa

SEQ ID NO: 441481 - RNA, 19 nt, Homo sapiens
gaacuggauaccucugaaa

SEQ ID NO: 441482 - RNA, 19 nt, Homo sapiens
aaacuacccgggugacaua

SEQ ID NO: 441483 - RNA, 19 nt, Homo sapiens
ucaagaacaauucacagua

SEQ ID NO: 441484 - RNA, 19 nt, Homo sapiens
gcaccuacacucucuacuu

SEQ ID NO: 441485 - RNA, 19 nt, Homo sapiens
gucaagaucuccacugaag

SEQ ID NO: 441486 - RNA, 19 nt, Homo sapiens
ucaccaauguucugucuca

SEQ ID NO: 441487 - RNA, 19 nt, Homo sapiens
gccuguaucuccaguguga

SEQ ID NO: 441488 - RNA, 19 nt, Homo sapiens
ggugccagaugcaaagaaa

SEQ ID NO: 441489 - RNA, 19 nt, Homo sapiens
ucaagagaacagcacauua

SEQ ID NO: 441490 - RNA, 19 nt, Homo sapiens
gcagacagcaucccaccuu

SEQ ID NO: 441491 - RNA, 19 nt, Homo sapiens
gaccaaagaucugcuucug

SEQ ID NO: 441492 - RNA, 19 nt, Homo sapiens
ggaugugagaucucuauuu

SEQ ID NO: 441493 - RNA, 19 nt, Homo sapiens
ggaucgcccuuucacaaau

SEQ ID NO: 441494 - RNA, 19 nt, Homo sapiens
cuucugugcucucgcauaa

SEQ ID NO: 441495 - RNA, 19 nt, Homo sapiens
uguaagaagcugugaauau

SEQ ID NO: 441496 - RNA, 19 nt, Homo sapiens
cauuggagaugccacuuug

SEQ ID NO: 441497 - RNA, 19 nt, Homo sapiens
uaugaacacuggugcugaa

SEQ ID NO: 441498 - RNA, 19 nt, Homo sapiens
gccaggaagugguguuugu

SEQ ID NO: 441499 - RNA, 19 nt, Homo sapiens
caaccgguauauugcaaau

SEQ ID NO: 441500 - RNA, 19 nt, Homo sapiens
gagccacuguccuccagaa

SEQ ID NO: 441501 - RNA, 19 nt, Homo sapiens
ugacucaggccacuguuaa

SEQ ID NO: 441502 - RNA, 19 nt, Homo sapiens
uaaagaggguaacaauagg

SEQ ID NO: 441503 - RNA, 19 nt, Homo sapiens
ggaauaaagaggguaacaa

SEQ ID NO: 441504 - RNA, 19 nt, Homo sapiens
gacaaccgguauauugcaa

SEQ ID NO: 441505 - RNA, 19 nt, Homo sapiens
gggacugagccauccauua

SEQ ID NO: 441506 - RNA, 19 nt, Homo sapiens
auaaagaggguaacaauag

SEQ ID NO: 441507 - RNA, 19 nt, Homo sapiens
cuggauaccucugaaagaa

SEQ ID NO: 441508 - RNA, 19 nt, Homo sapiens
gaccugugcuuagaacuca

SEQ ID NO: 441509 - RNA, 19 nt, Homo sapiens
cuagcacgauuauauuuca

SEQ ID NO: 441510 - RNA, 19 nt, Homo sapiens
gaacguguacaaguuugaa

SEQ ID NO: 441511 - RNA, 19 nt, Homo sapiens
gaaagauggaaauucugaa

SEQ ID NO: 441512 - RNA, 19 nt, Homo sapiens
gugccaaugucuccaacuu

SEQ ID NO: 441513 - RNA, 19 nt, Homo sapiens
ucagagcauugcacccaaa

SEQ ID NO: 441514 - RNA, 19 nt, Homo sapiens
gauaaggaucagagcauug

SEQ ID NO: 441515 - RNA, 19 nt, Homo sapiens
caaagaaagcauguaccua

SEQ ID NO: 441516 - RNA, 19 nt, Homo sapiens
ggaaauucagcaccuguuc

SEQ ID NO: 441517 - RNA, 19 nt, Homo sapiens
ccuacacucucuacuuaau

SEQ ID NO: 441518 - RNA, 19 nt, Homo sapiens
ggagauugaggaccuuguu

SEQ ID NO: 441519 - RNA, 19 nt, Homo sapiens
caagcacugucuuccuguu

SEQ ID NO: 441520 - RNA, 19 nt, Homo sapiens
gcaagucaccaauguucug

SEQ ID NO: 441521 - RNA, 19 nt, Homo sapiens
gcaaagaaagcauguaccu

SEQ ID NO: 441522 - RNA, 19 nt, Homo sapiens
caccagaacuucgccuugu

SEQ ID NO: 441523 - RNA, 19 nt, Homo sapiens
acuagaacaugcuaaaucu

SEQ ID NO: 441524 - RNA, 19 nt, Homo sapiens
gguugcaagucaccaaugu

SEQ ID NO: 441525 - RNA, 19 nt, Homo sapiens
aagaaggacuggaaacaac

SEQ ID NO: 441526 - RNA, 19 nt, Homo sapiens
gcagacagccaccagaacu

SEQ ID NO: 441527 - RNA, 19 nt, Homo sapiens
uaaggaggaucaggucauc

SEQ ID NO: 441528 - RNA, 19 nt, Homo sapiens
ccagaucuaccaugcaguu

SEQ ID NO: 441529 - RNA, 19 nt, Homo sapiens
uaaccuugaucccagcaau

SEQ ID NO: 441530 - RNA, 19 nt, Homo sapiens
uaagaagcugugaauauuc

SEQ ID NO: 441531 - RNA, 19 nt, Homo sapiens
acaauucacaguaugagaa

SEQ ID NO: 441532 - RNA, 19 nt, Homo sapiens
ugaacuggauaccucugaa

SEQ ID NO: 441533 - RNA, 19 nt, Homo sapiens
ucagcaagaagaacuuuga

SEQ ID NO: 441534 - RNA, 19 nt, Homo sapiens
ucagauagucucuuucucu

SEQ ID NO: 441535 - RNA, 19 nt, Homo sapiens
gcucagauagucucuuucu

SEQ ID NO: 441536 - RNA, 19 nt, Homo sapiens
aagaacaauucacaguaug

SEQ ID NO: 441537 - RNA, 19 nt, Homo sapiens
cagaagaaagauggaaauu

SEQ ID NO: 441538 - RNA, 19 nt, Homo sapiens
uacacucucuacuuaauca

SEQ ID NO: 441539 - RNA, 19 nt, Homo sapiens
uagaacaugcuaaaucugu

SEQ ID NO: 441540 - RNA, 19 nt, Homo sapiens
gggccuguaucuccagugu

SEQ ID NO: 441541 - RNA, 19 nt, Homo sapiens
gaagcugugaauauuccua

SEQ ID NO: 441542 - RNA, 19 nt, Homo sapiens
gcaccagguucaaggcauu

SEQ ID NO: 441543 - RNA, 19 nt, Homo sapiens
ucaaggacaugaagaucaa

SEQ ID NO: 441544 - RNA, 19 nt, Homo sapiens
gggccucucucaaggauga

SEQ ID NO: 441545 - RNA, 19 nt, Homo sapiens
gaugagguuuugaagauua

SEQ ID NO: 441546 - RNA, 19 nt, Homo sapiens
ucaagucccuggaggagau

SEQ ID NO: 441547 - RNA, 19 nt, Homo sapiens
gagacuguauucaccaagu

SEQ ID NO: 441548 - RNA, 19 nt, Homo sapiens
ucaaggcauuuguugcuau

SEQ ID NO: 441549 - RNA, 19 nt, Homo sapiens
ggaugcccgucaccaaguu

SEQ ID NO: 441550 - RNA, 19 nt, Homo sapiens
uaaggaaucagagaucauu

SEQ ID NO: 441551 - RNA, 19 nt, Homo sapiens
cagcuguggcuacaacaua

SEQ ID NO: 441552 - RNA, 19 nt, Homo sapiens
ggaaggagacuguauucac

SEQ ID NO: 441553 - RNA, 19 nt, Homo sapiens
caaggcauuuguugcuauc

SEQ ID NO: 441554 - RNA, 19 nt, Homo sapiens
ucaccaagucucccuauca

SEQ ID NO: 441555 - RNA, 19 nt, Homo sapiens
ccacgucggucuggguguu

SEQ ID NO: 441556 - RNA, 19 nt, Homo sapiens
uuucuaagaccuacagcua

SEQ ID NO: 441557 - RNA, 19 nt, Homo sapiens
caccaagucucccuaucag

SEQ ID NO: 441558 - RNA, 19 nt, Homo sapiens
cugcggcucugugcuggua

SEQ ID NO: 441559 - RNA, 19 nt, Homo sapiens
gucaaggacaugaagauca

SEQ ID NO: 441560 - RNA, 19 nt, Homo sapiens
aaagugaauuaagcgugaa

SEQ ID NO: 441561 - RNA, 19 nt, Homo sapiens
uggccaagcucuccaucgu

SEQ ID NO: 441562 - RNA, 19 nt, Homo sapiens
aacaccaaauggcggauga

SEQ ID NO: 441563 - RNA, 19 nt, Homo sapiens
ggaugagguuuugaagauu

SEQ ID NO: 441564 - RNA, 19 nt, Homo sapiens
ggucaaggacaugaagauc

SEQ ID NO: 441565 - RNA, 19 nt, Homo sapiens
ggacccaacugguaagauu

SEQ ID NO: 441566 - RNA, 19 nt, Homo sapiens
ggauguugcucucuaaaga

SEQ ID NO: 441567 - RNA, 19 nt, Homo sapiens
caagauggcagugcaaaua

SEQ ID NO: 441568 - RNA, 19 nt, Homo sapiens
gugcaaauauccaagaaga

SEQ ID NO: 441569 - RNA, 19 nt, Homo sapiens
gcggagacccuguuaacua

SEQ ID NO: 441570 - RNA, 19 nt, Homo sapiens
cuaaauccaugaaguuugu

SEQ ID NO: 441571 - RNA, 19 nt, Homo sapiens
ggaguugaggugcgaguua

SEQ ID NO: 441572 - RNA, 19 nt, Homo sapiens
gagacccuguuaacuacua

SEQ ID NO: 441573 - RNA, 19 nt, Homo sapiens
cagaagagguuuggcuuuc

SEQ ID NO: 441574 - RNA, 19 nt, Homo sapiens
gaagagguuuggcuuucca

SEQ ID NO: 441575 - RNA, 19 nt, Homo sapiens
gcaucaaggugaagaucau

SEQ ID NO: 441576 - RNA, 19 nt, Homo sapiens
ccaagaagaggaaguuugu

SEQ ID NO: 441577 - RNA, 19 nt, Homo sapiens
ggacagagggcuaaaucca

SEQ ID NO: 441578 - RNA, 19 nt, Homo sapiens
gggcuaaauccaugaaguu

SEQ ID NO: 441579 - RNA, 19 nt, Homo sapiens
ggaacccaaagaugagaua

SEQ ID NO: 441580 - RNA, 19 nt, Homo sapiens
ugacugcuguaguucagaa

SEQ ID NO: 441581 - RNA, 19 nt, Homo sapiens
gguaagauuggcccuaaga

SEQ ID NO: 441582 - RNA, 19 nt, Homo sapiens
ggccaaaggcugcgagguu

SEQ ID NO: 441583 - RNA, 19 nt, Homo sapiens
guagagcuuuaugcugaaa

SEQ ID NO: 441584 - RNA, 19 nt, Homo sapiens
gaggacagagggcuaaauc

SEQ ID NO: 441585 - RNA, 19 nt, Homo sapiens
gcagugcaaauauccaaga

SEQ ID NO: 441586 - RNA, 19 nt, Homo sapiens
ucaaagcugaacugaauga

SEQ ID NO: 441587 - RNA, 19 nt, Homo sapiens
gcuaaauccaugaaguuug

SEQ ID NO: 441588 - RNA, 19 nt, Homo sapiens
cggagacccuguuaacuac

SEQ ID NO: 441589 - RNA, 19 nt, Homo sapiens
gaggaaguuugucgcugau

SEQ ID NO: 441590 - RNA, 19 nt, Homo sapiens
gcaagauggcagugcaaau

SEQ ID NO: 441591 - RNA, 19 nt, Homo sapiens
acaccaaccaggacagaaa

SEQ ID NO: 441592 - RNA, 19 nt, Homo sapiens
cugguaagauuggcccuaa

SEQ ID NO: 441593 - RNA, 19 nt, Homo sapiens
ucagaagagguuuggcuuu

SEQ ID NO: 441594 - RNA, 19 nt, Homo sapiens
gagcauuguggaacccaaa

SEQ ID NO: 441595 - RNA, 19 nt, Homo sapiens
cucgggagcuggcugaaga

SEQ ID NO: 441596 - RNA, 19 nt, Homo sapiens
guaagauuggcccuaagaa

SEQ ID NO: 441597 - RNA, 19 nt, Homo sapiens
cagugcaaauauccaagaa

SEQ ID NO: 441598 - RNA, 19 nt, Homo sapiens
guuuguggauggccugaug

SEQ ID NO: 441599 - RNA, 19 nt, Homo sapiens
ggcuaaauccaugaaguuu

SEQ ID NO: 441600 - RNA, 19 nt, Homo sapiens
ggcugaagauggcuacucu

SEQ ID NO: 441601 - RNA, 19 nt, Homo sapiens
ucuggauguugcucucuaa

SEQ ID NO: 441602 - RNA, 19 nt, Homo sapiens
uaagauuggcccuaagaag

SEQ ID NO: 441603 - RNA, 19 nt, Homo sapiens
gaguugaggugcgaguuac

SEQ ID NO: 441604 - RNA, 19 nt, Homo sapiens
aaccaggacagaaaucauu

SEQ ID NO: 441605 - RNA, 19 nt, Homo sapiens
uaacuacuacguugacacu

SEQ ID NO: 441606 - RNA, 19 nt, Homo sapiens
agaggucugugugccauug

SEQ ID NO: 441607 - RNA, 19 nt, Homo sapiens
agagggcaguguagagcuu

SEQ ID NO: 441608 - RNA, 19 nt, Homo sapiens
acccaaagaugagauacug

SEQ ID NO: 441609 - RNA, 19 nt, Homo sapiens
gacagagggcuaaauccau

SEQ ID NO: 441610 - RNA, 19 nt, Homo sapiens
aaauauccaagaagaggaa

SEQ ID NO: 441611 - RNA, 19 nt, Homo sapiens
gacccaacugguaagauug

SEQ ID NO: 441612 - RNA, 19 nt, Homo sapiens
cagcggagacccuguuaac

SEQ ID NO: 441613 - RNA, 19 nt, Homo sapiens
uguagagcuuuaugcugaa

SEQ ID NO: 441614 - RNA, 19 nt, Homo sapiens
guugcucucuaaagaccuu

SEQ ID NO: 441615 - RNA, 19 nt, Homo sapiens
gucuggauguugcucucua

SEQ ID NO: 441616 - RNA, 19 nt, Homo sapiens
aagauggcagugcaaauau

SEQ ID NO: 441617 - RNA, 19 nt, Homo sapiens
agauggcagugcaaauauc

SEQ ID NO: 441618 - RNA, 19 nt, Homo sapiens
ccaccagaacacagaaugu

SEQ ID NO: 441619 - RNA, 19 nt, Homo sapiens
gaaagugguugauccauuu

SEQ ID NO: 441620 - RNA, 19 nt, Homo sapiens
ugaaagaaguggucaauaa

SEQ ID NO: 441621 - RNA, 19 nt, Homo sapiens
ccaagaaucuguuuaaagu

SEQ ID NO: 441622 - RNA, 19 nt, Homo sapiens
gaaagaaguggucaauaaa

SEQ ID NO: 441623 - RNA, 19 nt, Homo sapiens
ugaacgagcugauggauau

SEQ ID NO: 441624 - RNA, 19 nt, Homo sapiens
cgagacaggugcuaaaguu

SEQ ID NO: 441625 - RNA, 19 nt, Homo sapiens
ugaagaagcccaaguuuga

SEQ ID NO: 441626 - RNA, 19 nt, Homo sapiens
gaacaagcgccuuacgaaa

SEQ ID NO: 441627 - RNA, 19 nt, Homo sapiens
gauugaagcucacguugau

SEQ ID NO: 441628 - RNA, 19 nt, Homo sapiens
ucucaagggucguguguuu

SEQ ID NO: 441629 - RNA, 19 nt, Homo sapiens
ccugcuauguucaauauaa

SEQ ID NO: 441630 - RNA, 19 nt, Homo sapiens
guucagacuucaaauagug

SEQ ID NO: 441631 - RNA, 19 nt, Homo sapiens
gaagugagucuugcugauu

SEQ ID NO: 441632 - RNA, 19 nt, Homo sapiens
caugaugucuucguuagaa

SEQ ID NO: 441633 - RNA, 19 nt, Homo sapiens
gcagaaugaugaaguugca

SEQ ID NO: 441634 - RNA, 19 nt, Homo sapiens
gaaaaggcuugccaaucua

SEQ ID NO: 441635 - RNA, 19 nt, Homo sapiens
agaaagugguugauccauu

SEQ ID NO: 441636 - RNA, 19 nt, Homo sapiens
gacaggugcuaaaguugaa

SEQ ID NO: 441637 - RNA, 19 nt, Homo sapiens
aauucaagcugauuacuga

SEQ ID NO: 441638 - RNA, 19 nt, Homo sapiens
ggacgagacaggugcuaaa

SEQ ID NO: 441639 - RNA, 19 nt, Homo sapiens
ucaagacuaccgaugguua

SEQ ID NO: 441640 - RNA, 19 nt, Homo sapiens
caccugcuauguucaauau

SEQ ID NO: 441641 - RNA, 19 nt, Homo sapiens
gaagaagcccaaguuugaa

SEQ ID NO: 441642 - RNA, 19 nt, Homo sapiens
ugaugaaguugcauuuaga

SEQ ID NO: 441643 - RNA, 19 nt, Homo sapiens
ggcaagaacaagcgccuua

SEQ ID NO: 441644 - RNA, 19 nt, Homo sapiens
gacuaccgaugguuacuug

SEQ ID NO: 441645 - RNA, 19 nt, Homo sapiens
ggucguguguuugaaguga

SEQ ID NO: 441646 - RNA, 19 nt, Homo sapiens
aagugagucuugcugauuu

SEQ ID NO: 441647 - RNA, 19 nt, Homo sapiens
gaaggcaguaguucuggaa

SEQ ID NO: 441648 - RNA, 19 nt, Homo sapiens
gcaccugcuauguucaaua

SEQ ID NO: 441649 - RNA, 19 nt, Homo sapiens
cuauuuauccucuccauga

SEQ ID NO: 441650 - RNA, 19 nt, Homo sapiens
gaagaaagugguugaucca

SEQ ID NO: 441651 - RNA, 19 nt, Homo sapiens
ucaagcugauuacugaaga

SEQ ID NO: 441652 - RNA, 19 nt, Homo sapiens
ugugaugguuugcuucuga

SEQ ID NO: 441653 - RNA, 19 nt, Homo sapiens
guccaagaaucuguuuaaa

SEQ ID NO: 441654 - RNA, 19 nt, Homo sapiens
gaugaaguugcauuuagaa

SEQ ID NO: 441655 - RNA, 19 nt, Homo sapiens
uugcugauuugcagaauga

SEQ ID NO: 441656 - RNA, 19 nt, Homo sapiens
ccaagaagaaagugguuga

SEQ ID NO: 441657 - RNA, 19 nt, Homo sapiens
agauugguaugaugugaaa

SEQ ID NO: 441658 - RNA, 19 nt, Homo sapiens
aaagauugguaugauguga

SEQ ID NO: 441659 - RNA, 19 nt, Homo sapiens
aagaaagauugguaugaug

SEQ ID NO: 441660 - RNA, 19 nt, Homo sapiens
gaagcccaaguuugaauug

SEQ ID NO: 441661 - RNA, 19 nt, Homo sapiens
aaagggagccaagaagaaa

SEQ ID NO: 441662 - RNA, 19 nt, Homo sapiens
gcugaagaagcccaaguuu

SEQ ID NO: 441663 - RNA, 19 nt, Homo sapiens
caacagguccgccaaaucc

SEQ ID NO: 441664 - RNA, 19 nt, Homo sapiens
gaaagauugguaugaugug

SEQ ID NO: 441665 - RNA, 19 nt, Homo sapiens
agaaaaggcuugccaaucu

SEQ ID NO: 441666 - RNA, 19 nt, Homo sapiens
agaacaagcgccuuacgaa

SEQ ID NO: 441667 - RNA, 19 nt, Homo sapiens
cuucaaauaguggcaaaua

SEQ ID NO: 441668 - RNA, 19 nt, Homo sapiens
agacaggugcuaaaguuga

SEQ ID NO: 441669 - RNA, 19 nt, Homo sapiens
cuaagaaagauugguauga

SEQ ID NO: 441670 - RNA, 19 nt, Homo sapiens
ugaagugagucuugcugau

SEQ ID NO: 441671 - RNA, 19 nt, Homo sapiens
ccauggcgguuggcaagaa

SEQ ID NO: 441672 - RNA, 19 nt, Homo sapiens
gagacaggugcuaaaguug

SEQ ID NO: 441673 - RNA, 19 nt, Homo sapiens
agaaagauugguaugaugu

SEQ ID NO: 441674 - RNA, 19 nt, Homo sapiens
gugaugguuugcuucugaa

SEQ ID NO: 441675 - RNA, 19 nt, Homo sapiens
gacuucaaauaguggcaaa

SEQ ID NO: 441676 - RNA, 19 nt, Homo sapiens
gaagcucacguugauguca

SEQ ID NO: 441677 - RNA, 19 nt, Homo sapiens
ggaucuuacccgugacaaa

SEQ ID NO: 441678 - RNA, 19 nt, Homo sapiens
caagggucguguguuugaa

SEQ ID NO: 441679 - RNA, 19 nt, Homo sapiens
augaugaaguugcauuuag

SEQ ID NO: 441680 - RNA, 19 nt, Homo sapiens
aguccaagaaucuguuuaa

SEQ ID NO: 441681 - RNA, 19 nt, Homo sapiens
ggugaaggcaguaguucug

SEQ ID NO: 441682 - RNA, 19 nt, Homo sapiens
guugauccauuuucuaaga

SEQ ID NO: 441683 - RNA, 19 nt, Homo sapiens
aggcuugccaaucuauuua

SEQ ID NO: 441684 - RNA, 19 nt, Homo sapiens
aaaacugccugacuaacuu

SEQ ID NO: 441685 - RNA, 19 nt, Homo sapiens
cugaagaagcccaaguuug

SEQ ID NO: 441686 - RNA, 19 nt, Homo sapiens
ugauugaagcucacguuga

SEQ ID NO: 441687 - RNA, 19 nt, Homo sapiens
uccaugaugucuucguuag

SEQ ID NO: 441688 - RNA, 19 nt, Homo sapiens
uuuauccucuccaugaugu

SEQ ID NO: 441689 - RNA, 19 nt, Homo sapiens
gcuugccaaucuauuuauc

SEQ ID NO: 441690 - RNA, 19 nt, Homo sapiens
ugucaagacuaccgauggu

SEQ ID NO: 441691 - RNA, 19 nt, Homo sapiens
aacaagcgccuuacgaaag

SEQ ID NO: 441692 - RNA, 19 nt, Homo sapiens
uaccgaugguuacuugcuu

SEQ ID NO: 441693 - RNA, 19 nt, Homo sapiens
gggacgagacaggugcuaa

SEQ ID NO: 441694 - RNA, 19 nt, Homo sapiens
ucuccaugaugucuucguu

SEQ ID NO: 441695 - RNA, 19 nt, Homo sapiens
cugauuugcagaaugauga

SEQ ID NO: 441696 - RNA, 19 nt, Homo sapiens
uauuugugaugguuugcuu

SEQ ID NO: 441697 - RNA, 19 nt, Homo sapiens
ccaacagguccgccaaauc

SEQ ID NO: 441698 - RNA, 19 nt, Homo sapiens
aaacgcaacaaucagauac

SEQ ID NO: 441699 - RNA, 19 nt, Homo sapiens
ggagagaauuuccgucuga

SEQ ID NO: 441700 - RNA, 19 nt, Homo sapiens
gacaggagaugaaguaaag

SEQ ID NO: 441701 - RNA, 19 nt, Homo sapiens
uaaauugaccgguguguuu

SEQ ID NO: 441702 - RNA, 19 nt, Homo sapiens
gagaugaaguaaagaagau

SEQ ID NO: 441703 - RNA, 19 nt, Homo sapiens
caagauuacugauuucauc

SEQ ID NO: 441704 - RNA, 19 nt, Homo sapiens
ggaacagacuuaaguaugc

SEQ ID NO: 441705 - RNA, 19 nt, Homo sapiens
ugucagaucuuuguacgua

SEQ ID NO: 441706 - RNA, 19 nt, Homo sapiens
gcaugcagcgguucauuaa

SEQ ID NO: 441707 - RNA, 19 nt, Homo sapiens
ggcaagguccgaacugaua

SEQ ID NO: 441708 - RNA, 19 nt, Homo sapiens
uaaagaagauuugcaugca

SEQ ID NO: 441709 - RNA, 19 nt, Homo sapiens
ggagaugaaguaaagaaga

SEQ ID NO: 441710 - RNA, 19 nt, Homo sapiens
ggcaacaaaccauggauuu

SEQ ID NO: 441711 - RNA, 19 nt, Homo sapiens
cuggcaagauuacugauuu

SEQ ID NO: 441712 - RNA, 19 nt, Homo sapiens
ccacucgacuuuccaacau

SEQ ID NO: 441713 - RNA, 19 nt, Homo sapiens
caacaaaccauggauuucu

SEQ ID NO: 441714 - RNA, 19 nt, Homo sapiens
gaggaacagacuuaaguau

SEQ ID NO: 441715 - RNA, 19 nt, Homo sapiens
gguggcagcuccaaagcau

SEQ ID NO: 441716 - RNA, 19 nt, Homo sapiens
gcaacaaaccauggauuuc

SEQ ID NO: 441717 - RNA, 19 nt, Homo sapiens
gcuaaccuaggaagaauug

SEQ ID NO: 441718 - RNA, 19 nt, Homo sapiens
ucagaucuuuguacguaau

SEQ ID NO: 441719 - RNA, 19 nt, Homo sapiens
gugcuaaccuaggaagaau

SEQ ID NO: 441720 - RNA, 19 nt, Homo sapiens
caccugaggaggccaagua

SEQ ID NO: 441721 - RNA, 19 nt, Homo sapiens
gguccgaacugauauaacc

SEQ ID NO: 441722 - RNA, 19 nt, Homo sapiens
gcaaagugagaaagaucuu

SEQ ID NO: 441723 - RNA, 19 nt, Homo sapiens
acaagacgggagagaauuu

SEQ ID NO: 441724 - RNA, 19 nt, Homo sapiens
ugacaagacgggagagaau

SEQ ID NO: 441725 - RNA, 19 nt, Homo sapiens
caagguccgaacugauaua

SEQ ID NO: 441726 - RNA, 19 nt, Homo sapiens
gaaguaaagaagauuugca

SEQ ID NO: 441727 - RNA, 19 nt, Homo sapiens
ugaggaacagacuuaagua

SEQ ID NO: 441728 - RNA, 19 nt, Homo sapiens
gcaagguccgaacugauau

SEQ ID NO: 441729 - RNA, 19 nt, Homo sapiens
aaauauuguggcaggauua

SEQ ID NO: 441730 - RNA, 19 nt, Homo sapiens
acucgacuuuccaacauuu

SEQ ID NO: 441731 - RNA, 19 nt, Homo sapiens
auuggaugcuggauaaauu

SEQ ID NO: 441732 - RNA, 19 nt, Homo sapiens
ugacaggagaugaaguaaa

SEQ ID NO: 441733 - RNA, 19 nt, Homo sapiens
gacaagacgggagagaauu

SEQ ID NO: 441734 - RNA, 19 nt, Homo sapiens
gggcaacaaaccauggauu

SEQ ID NO: 441735 - RNA, 19 nt, Homo sapiens
ggaagaauuggugugauca

SEQ ID NO: 441736 - RNA, 19 nt, Homo sapiens
gcaagauuacugauuucau

SEQ ID NO: 441737 - RNA, 19 nt, Homo sapiens
caaguugugcaaagugaga

SEQ ID NO: 441738 - RNA, 19 nt, Homo sapiens
caggagaugaaguaaagaa

SEQ ID NO: 441739 - RNA, 19 nt, Homo sapiens
guggcaggauuaauagcaa

SEQ ID NO: 441740 - RNA, 19 nt, Homo sapiens
aggaagaauuggugugauc

SEQ ID NO: 441741 - RNA, 19 nt, Homo sapiens
ggugcuaaccuaggaagaa

SEQ ID NO: 441742 - RNA, 19 nt, Homo sapiens
augauaccauucagauuga

SEQ ID NO: 441743 - RNA, 19 nt, Homo sapiens
ggaggccaaguacaaguug

SEQ ID NO: 441744 - RNA, 19 nt, Homo sapiens
gauaccauucagauugauu

SEQ ID NO: 441745 - RNA, 19 nt, Homo sapiens
uggcaggauuaauagcaaa

SEQ ID NO: 441746 - RNA, 19 nt, Homo sapiens
gaggcacccuggaucuuuu

SEQ ID NO: 441747 - RNA, 19 nt, Homo sapiens
agacuggcaagauuacuga

SEQ ID NO: 441748 - RNA, 19 nt, Homo sapiens
gagacuggcaagauuacug

SEQ ID NO: 441749 - RNA, 19 nt, Homo sapiens
caagggucgcuuugcugua

SEQ ID NO: 441750 - RNA, 19 nt, Homo sapiens
ugcaugcagcgguucauua

SEQ ID NO: 441751 - RNA, 19 nt, Homo sapiens
gucagaucuuuguacguaa

SEQ ID NO: 441752 - RNA, 19 nt, Homo sapiens
gagaggcacccuggaucuu

SEQ ID NO: 441753 - RNA, 19 nt, Homo sapiens
cuaggaagaauugguguga

SEQ ID NO: 441754 - RNA, 19 nt, Homo sapiens
uggcagcuccaaagcauug

SEQ ID NO: 441755 - RNA, 19 nt, Homo sapiens
uggcaagauuacugauuuc

SEQ ID NO: 441756 - RNA, 19 nt, Homo sapiens
gcuuugcuguacaucguau

SEQ ID NO: 441757 - RNA, 19 nt, Homo sapiens
cugaggaggccaaguacaa

SEQ ID NO: 441758 - RNA, 19 nt, Homo sapiens
ugacaccaagggucgcuuu

SEQ ID NO: 441759 - RNA, 19 nt, Homo sapiens
agaggcacccuggaucuuu

SEQ ID NO: 441760 - RNA, 19 nt, Homo sapiens
aggaacagacuuaaguaug

SEQ ID NO: 441761 - RNA, 19 nt, Homo sapiens
gaggaggccaaguacaagu

SEQ ID NO: 441762 - RNA, 19 nt, Homo sapiens
caccaagggucgcuuugcu

SEQ ID NO: 441763 - RNA, 19 nt, Homo sapiens
ucaaguucgacacugguaa

SEQ ID NO: 441764 - RNA, 19 nt, Homo sapiens
caagacgggagagaauuuc

SEQ ID NO: 441765 - RNA, 19 nt, Homo sapiens
augcagcgguucauuaaaa

SEQ ID NO: 441766 - RNA, 19 nt, Homo sapiens
ggaaagggcauucgacuua

SEQ ID NO: 441767 - RNA, 19 nt, Homo sapiens
gaagacaggugaacauuuc

SEQ ID NO: 441768 - RNA, 19 nt, Homo sapiens
ggaauagacucaaguaugc

SEQ ID NO: 441769 - RNA, 19 nt, Homo sapiens
gaacgauacugugcagauu

SEQ ID NO: 441770 - RNA, 19 nt, Homo sapiens
caaacuaacggguguauuu

SEQ ID NO: 441771 - RNA, 19 nt, Homo sapiens
gagaugagguaaagaagau

SEQ ID NO: 441772 - RNA, 19 nt, Homo sapiens
ggaaagacauccugguucu

SEQ ID NO: 441773 - RNA, 19 nt, Homo sapiens
gcaauaaaccuuggauuuc

SEQ ID NO: 441774 - RNA, 19 nt, Homo sapiens
ccacgaggcuuuccaacau

SEQ ID NO: 441775 - RNA, 19 nt, Homo sapiens
ggcaauaaaccuuggauuu

SEQ ID NO: 441776 - RNA, 19 nt, Homo sapiens
ggcaagauaaucaacuuua

SEQ ID NO: 441777 - RNA, 19 nt, Homo sapiens
ucacauacccugcuggauu

SEQ ID NO: 441778 - RNA, 19 nt, Homo sapiens
acagugaauucucguuuaa

SEQ ID NO: 441779 - RNA, 19 nt, Homo sapiens
acagagcaguggcuaaauu

SEQ ID NO: 441780 - RNA, 19 nt, Homo sapiens
gcacaaauaaacagugaau

SEQ ID NO: 441781 - RNA, 19 nt, Homo sapiens
gaagauauguaugcaacgu

SEQ ID NO: 441782 - RNA, 19 nt, Homo sapiens
gcaguagcagcauaucuuu

SEQ ID NO: 441783 - RNA, 19 nt, Homo sapiens
uuuagggacuggcaagaua

SEQ ID NO: 441784 - RNA, 19 nt, Homo sapiens
aaacagagcaguggcuaaa

SEQ ID NO: 441785 - RNA, 19 nt, Homo sapiens
caaauuugauacaggcaau

SEQ ID NO: 441786 - RNA, 19 nt, Homo sapiens
aacagugaauucucguuua

SEQ ID NO: 441787 - RNA, 19 nt, Homo sapiens
agauauguaugcaacguuu

SEQ ID NO: 441788 - RNA, 19 nt, Homo sapiens
guaaagaagauauguaugc

SEQ ID NO: 441789 - RNA, 19 nt, Homo sapiens
gaaagggcauucgacuuac

SEQ ID NO: 441790 - RNA, 19 nt, Homo sapiens
ggagaugagguaaagaaga

SEQ ID NO: 441791 - RNA, 19 nt, Homo sapiens
gagaagacaggugaacauu

SEQ ID NO: 441792 - RNA, 19 nt, Homo sapiens
uaugcaacguuucaucaaa

SEQ ID NO: 441793 - RNA, 19 nt, Homo sapiens
caaaauugauggcaagguu

SEQ ID NO: 441794 - RNA, 19 nt, Homo sapiens
cacauacccugcuggauuc

SEQ ID NO: 441795 - RNA, 19 nt, Homo sapiens
gagguaaagaagauaugua

SEQ ID NO: 441796 - RNA, 19 nt, Homo sapiens
auaagaggcuggccaccaa

SEQ ID NO: 441797 - RNA, 19 nt, Homo sapiens
caauaaaccuuggauuucc

SEQ ID NO: 441798 - RNA, 19 nt, Homo sapiens
gcaaagugaggaagauuac

SEQ ID NO: 441799 - RNA, 19 nt, Homo sapiens
aaauugcaguagcagcaua

SEQ ID NO: 441800 - RNA, 19 nt, Homo sapiens
ggcauucgacuuacuguug

SEQ ID NO: 441801 - RNA, 19 nt, Homo sapiens
gcacuuaaagcguguugca

SEQ ID NO: 441802 - RNA, 19 nt, Homo sapiens
ggacuggcaagauaaucaa

SEQ ID NO: 441803 - RNA, 19 nt, Homo sapiens
gacuuacuguugcugaaga

SEQ ID NO: 441804 - RNA, 19 nt, Homo sapiens
caauuuguguauggugauu

SEQ ID NO: 441805 - RNA, 19 nt, Homo sapiens
ucaggaauagacucaagua

SEQ ID NO: 441806 - RNA, 19 nt, Homo sapiens
uugcacaaauaaacaguga

SEQ ID NO: 441807 - RNA, 19 nt, Homo sapiens
acgauacugugcagauuga

SEQ ID NO: 441808 - RNA, 19 nt, Homo sapiens
agaagacaggugaacauuu

SEQ ID NO: 441809 - RNA, 19 nt, Homo sapiens
gaugagguaaagaagauau

SEQ ID NO: 441810 - RNA, 19 nt, Homo sapiens
auacugugcagauugauuu

SEQ ID NO: 441811 - RNA, 19 nt, Homo sapiens
gauacugugcagauugauu

SEQ ID NO: 441812 - RNA, 19 nt, Homo sapiens
cuacccagauccugucauc

SEQ ID NO: 441813 - RNA, 19 nt, Homo sapiens
gaagaggcaaaguacaagu

SEQ ID NO: 441814 - RNA, 19 nt, Homo sapiens
gacuggagaugagguaaag

SEQ ID NO: 441815 - RNA, 19 nt, Homo sapiens
caaacagagcaguggcuaa

SEQ ID NO: 441816 - RNA, 19 nt, Homo sapiens
cacgaggcuuuccaacauu

SEQ ID NO: 441817 - RNA, 19 nt, Homo sapiens
ucaucaaggugaacgauac

SEQ ID NO: 441818 - RNA, 19 nt, Homo sapiens
gagcaguggcuaaauugca

SEQ ID NO: 441819 - RNA, 19 nt, Homo sapiens
cagagcaguggcuaaauug

SEQ ID NO: 441820 - RNA, 19 nt, Homo sapiens
acgaggcuuuccaacauuu

SEQ ID NO: 441821 - RNA, 19 nt, Homo sapiens
aggaauagacucaaguaug

SEQ ID NO: 441822 - RNA, 19 nt, Homo sapiens
uggaagaggcaaaguacaa

SEQ ID NO: 441823 - RNA, 19 nt, Homo sapiens
aaacuaacggguguauuug

SEQ ID NO: 441824 - RNA, 19 nt, Homo sapiens
gggaaagggcauucgacuu

SEQ ID NO: 441825 - RNA, 19 nt, Homo sapiens
ugcaaagugaggaagauua

SEQ ID NO: 441826 - RNA, 19 nt, Homo sapiens
uugcagcgccgaagcauug

SEQ ID NO: 441827 - RNA, 19 nt, Homo sapiens
gggacuggcaagauaauca

SEQ ID NO: 441828 - RNA, 19 nt, Homo sapiens
ggcaauggcaauaaaccuu

SEQ ID NO: 441829 - RNA, 19 nt, Homo sapiens
ggaagaggcaaaguacaag

SEQ ID NO: 441830 - RNA, 19 nt, Homo sapiens
cccacaagcugagggaaug

SEQ ID NO: 441831 - RNA, 19 nt, Homo sapiens
cgagaagacaggugaacau

SEQ ID NO: 441832 - RNA, 19 nt, Homo sapiens
uuggaugcuugacaaacua

SEQ ID NO: 441833 - RNA, 19 nt, Homo sapiens
caguggaagaggcaaagua

SEQ ID NO: 441834 - RNA, 19 nt, Homo sapiens
gcaagguucgaguggaugu

SEQ ID NO: 441835 - RNA, 19 nt, Homo sapiens
caacguuucaucaaaauug

SEQ ID NO: 441836 - RNA, 19 nt, Homo sapiens
acaggcaauuuguguaugg

SEQ ID NO: 441837 - RNA, 19 nt, Homo sapiens
cagauccugucaucaaggu

SEQ ID NO: 441838 - RNA, 19 nt, Homo sapiens
ccucaggaauagacucaag

SEQ ID NO: 441839 - RNA, 19 nt, Homo sapiens
gguaaagaagauauguaug

SEQ ID NO: 441840 - RNA, 19 nt, Homo sapiens
uggcaagguucgaguggau

SEQ ID NO: 441841 - RNA, 19 nt, Homo sapiens
guaugcaacguuucaucaa

SEQ ID NO: 441842 - RNA, 19 nt, Homo sapiens
ugacuggagaugagguaaa

SEQ ID NO: 441843 - RNA, 19 nt, Homo sapiens
uacuguugcugaagagaga

SEQ ID NO: 441844 - RNA, 19 nt, Homo sapiens
gaucaccaacagggaaaga

SEQ ID NO: 441845 - RNA, 19 nt, Homo sapiens
cuggcaagauaaucaacuu

SEQ ID NO: 441846 - RNA, 19 nt, Homo sapiens
ugaacgauacugugcagau

SEQ ID NO: 441847 - RNA, 19 nt, Homo sapiens
gacaaacuaacggguguau

SEQ ID NO: 441848 - RNA, 19 nt, Homo sapiens
aaagugaggaagauuacug

SEQ ID NO: 441849 - RNA, 19 nt, Homo sapiens
ugauacaggcaauuugugu

SEQ ID NO: 441850 - RNA, 19 nt, Homo sapiens
gcugaagagagagauaaga

SEQ ID NO: 441851 - RNA, 19 nt, Homo sapiens
gcaauuuguguauggugau

SEQ ID NO: 441852 - RNA, 19 nt, Homo sapiens
uuagggacuggcaagauaa

SEQ ID NO: 441853 - RNA, 19 nt, Homo sapiens
acuaacggguguauuugca

SEQ ID NO: 441854 - RNA, 19 nt, Homo sapiens
auacccugcuggauucaug

SEQ ID NO: 441855 - RNA, 19 nt, Homo sapiens
gcaagaagcucaugacugu

SEQ ID NO: 441856 - RNA, 19 nt, Homo sapiens
acauuucccugcaggauua

SEQ ID NO: 441857 - RNA, 19 nt, Homo sapiens
ggagaaguaugccaaguac

SEQ ID NO: 441858 - RNA, 19 nt, Homo sapiens
gccaaacgcuuccgcaaag

SEQ ID NO: 441859 - RNA, 19 nt, Homo sapiens
ggaaguggagcaccgauga

SEQ ID NO: 441860 - RNA, 19 nt, Homo sapiens
gccaagggcuccucgaacu

SEQ ID NO: 441861 - RNA, 19 nt, Homo sapiens
caaguccaaccgcugauuu

SEQ ID NO: 441862 - RNA, 19 nt, Homo sapiens
aaagcucagugucccauug

SEQ ID NO: 441863 - RNA, 19 nt, Homo sapiens
cucacuaacuccaugauga

SEQ ID NO: 441864 - RNA, 19 nt, Homo sapiens
gaucauacaccugcucaca

SEQ ID NO: 441865 - RNA, 19 nt, Homo sapiens
aagcaugccuucgagauca

SEQ ID NO: 441866 - RNA, 19 nt, Homo sapiens
ggauuacauugcagugaag

SEQ ID NO: 441867 - RNA, 19 nt, Homo sapiens
aggauuacauugcagugaa

SEQ ID NO: 441868 - RNA, 19 nt, Homo sapiens
ucgaacuccuaugccauua

SEQ ID NO: 441869 - RNA, 19 nt, Homo sapiens
gacauuucccugcaggauu

SEQ ID NO: 441870 - RNA, 19 nt, Homo sapiens
gcagugaaggagaaguaug

SEQ ID NO: 441871 - RNA, 19 nt, Homo sapiens
acauugcagugaaggagaa

SEQ ID NO: 441872 - RNA, 19 nt, Homo sapiens
ccagacaucaagcucuuug

SEQ ID NO: 441873 - RNA, 19 nt, Homo sapiens
gaaguggagcaccgaugau

SEQ ID NO: 441874 - RNA, 19 nt, Homo sapiens
aggagaaguaugccaagua

SEQ ID NO: 441875 - RNA, 19 nt, Homo sapiens
gcugccuuccggaacauua

SEQ ID NO: 441876 - RNA, 19 nt, Homo sapiens
ucacuaacuccaugaugau

SEQ ID NO: 441877 - RNA, 19 nt, Homo sapiens
cgaacuccuaugccauuaa

SEQ ID NO: 441878 - RNA, 19 nt, Homo sapiens
caagcaugccuucgagauc

SEQ ID NO: 441879 - RNA, 19 nt, Homo sapiens
ggugaacgccaucaucaac

SEQ ID NO: 441880 - RNA, 19 nt, Homo sapiens
guggagcgccucacuaacu

SEQ ID NO: 441881 - RNA, 19 nt, Homo sapiens
cuaacuccaugaugaugca

SEQ ID NO: 441882 - RNA, 19 nt, Homo sapiens
ugaacgccaucaucaacag

SEQ ID NO: 441883 - RNA, 19 nt, Homo sapiens
gcagagaccccagacauca

SEQ ID NO: 441884 - RNA, 19 nt, Homo sapiens
gcaacaacggcaagaagcu

SEQ ID NO: 441885 - RNA, 19 nt, Homo sapiens
cgccaaacgcuuccgcaaa

SEQ ID NO: 441886 - RNA, 19 nt, Homo sapiens
gagacgcucaggcuguguu

SEQ ID NO: 441887 - RNA, 19 nt, Homo sapiens
guggagcaccgaugaugug

SEQ ID NO: 441888 - RNA, 19 nt, Homo sapiens
gaacgccaucaucaacagu

SEQ ID NO: 441889 - RNA, 19 nt, Homo sapiens
gaugugcagaucaaugaca

SEQ ID NO: 441890 - RNA, 19 nt, Homo sapiens
ucaagcaugccuucgagau

SEQ ID NO: 441891 - RNA, 19 nt, Homo sapiens
agaagaggcugcagaauau

SEQ ID NO: 441892 - RNA, 19 nt, Homo sapiens
agaaagcccuuaaauaaag

SEQ ID NO: 441893 - RNA, 19 nt, Homo sapiens
gaaagcccuuaaauaaaga

SEQ ID NO: 441894 - RNA, 19 nt, Homo sapiens
gccaguauguuguaagaaa

SEQ ID NO: 441895 - RNA, 19 nt, Homo sapiens
aaggagaacuggagaaaga

SEQ ID NO: 441896 - RNA, 19 nt, Homo sapiens
gaacgcaaacuucguacuu

SEQ ID NO: 441897 - RNA, 19 nt, Homo sapiens
aagaagaggcugcagaaua

SEQ ID NO: 441898 - RNA, 19 nt, Homo sapiens
gaagcagcguaccaagaaa

SEQ ID NO: 441899 - RNA, 19 nt, Homo sapiens
caaaagagcuagcagaauc

SEQ ID NO: 441900 - RNA, 19 nt, Homo sapiens
guucucaacuugguuauug

SEQ ID NO: 441901 - RNA, 19 nt, Homo sapiens
gaugaacgcaaacuucgua

SEQ ID NO: 441902 - RNA, 19 nt, Homo sapiens
gccagaaacucauugaagu

SEQ ID NO: 441903 - RNA, 19 nt, Homo sapiens
ugaauccagucagaaauaa

SEQ ID NO: 441904 - RNA, 19 nt, Homo sapiens
ccaaagcacccaagauuca

SEQ ID NO: 441905 - RNA, 19 nt, Homo sapiens
uaaagaagaggcugcagaa

SEQ ID NO: 441906 - RNA, 19 nt, Homo sapiens
gcguucagcugcuucaaga

SEQ ID NO: 441907 - RNA, 19 nt, Homo sapiens
gcaaacuucguacuuucua

SEQ ID NO: 441908 - RNA, 19 nt, Homo sapiens
guaaggggcauuccuguua

SEQ ID NO: 441909 - RNA, 19 nt, Homo sapiens
gcagaauaugcuaaacuuu

SEQ ID NO: 441910 - RNA, 19 nt, Homo sapiens
gugaagaauggaaggguua

SEQ ID NO: 441911 - RNA, 19 nt, Homo sapiens
ggagaacuggagaaagaaa

SEQ ID NO: 441912 - RNA, 19 nt, Homo sapiens
caaacuucguacuuucuau

SEQ ID NO: 441913 - RNA, 19 nt, Homo sapiens
agaagcagcguaccaagaa

SEQ ID NO: 441914 - RNA, 19 nt, Homo sapiens
gaugauguccgccaguaug

SEQ ID NO: 441915 - RNA, 19 nt, Homo sapiens
ggauauuccuggacugacu

SEQ ID NO: 441916 - RNA, 19 nt, Homo sapiens
aagaugauguccgccagua

SEQ ID NO: 441917 - RNA, 19 nt, Homo sapiens
ccaaggagaacuggagaaa

SEQ ID NO: 441918 - RNA, 19 nt, Homo sapiens
ugcagaauaugcuaaacuu

SEQ ID NO: 441919 - RNA, 19 nt, Homo sapiens
ggacgaugaacgcaaacuu

SEQ ID NO: 441920 - RNA, 19 nt, Homo sapiens
gauguccgccaguauguug

SEQ ID NO: 441921 - RNA, 19 nt, Homo sapiens
gcguauggccacagaaguu

SEQ ID NO: 441922 - RNA, 19 nt, Homo sapiens
ccgccaguauguuguaaga

SEQ ID NO: 441923 - RNA, 19 nt, Homo sapiens
cuucguacuuucuaugaga

SEQ ID NO: 441924 - RNA, 19 nt, Homo sapiens
agcagaauccgcaaacuuu

SEQ ID NO: 441925 - RNA, 19 nt, Homo sapiens
ggagaaagaaagagaaaau

SEQ ID NO: 441926 - RNA, 19 nt, Homo sapiens
ccaguauguuguaagaaag

SEQ ID NO: 441927 - RNA, 19 nt, Homo sapiens
gacgaugaacgcaaacuuc

SEQ ID NO: 441928 - RNA, 19 nt, Homo sapiens
ccagaaacucauugaagug

SEQ ID NO: 441929 - RNA, 19 nt, Homo sapiens
guucagcugcuucaagaug

SEQ ID NO: 441930 - RNA, 19 nt, Homo sapiens
ugaagaagcagcguaccaa

SEQ ID NO: 441931 - RNA, 19 nt, Homo sapiens
aacgcaaacuucguacuuu

SEQ ID NO: 441932 - RNA, 19 nt, Homo sapiens
uagcagaauccgcaaacuu

SEQ ID NO: 441933 - RNA, 19 nt, Homo sapiens
agaagcguauggccacaga

SEQ ID NO: 441934 - RNA, 19 nt, Homo sapiens
acgcaaacuucguacuuuc

SEQ ID NO: 441935 - RNA, 19 nt, Homo sapiens
gaagaggcugcagaauaug

SEQ ID NO: 441936 - RNA, 19 nt, Homo sapiens
uucaaucucucuaaagaag

SEQ ID NO: 441937 - RNA, 19 nt, Homo sapiens
gcguauugcucugaagaag

SEQ ID NO: 441938 - RNA, 19 nt, Homo sapiens
aguggacgaugaacgcaaa

SEQ ID NO: 441939 - RNA, 19 nt, Homo sapiens
cauuguggaugcaaaucug

SEQ ID NO: 441940 - RNA, 19 nt, Homo sapiens
gaagaauggaaggguuaug

SEQ ID NO: 441941 - RNA, 19 nt, Homo sapiens
aaacuucguacuuucuaug

SEQ ID NO: 441942 - RNA, 19 nt, Homo sapiens
aagaagcagcguaccaaga

SEQ ID NO: 441943 - RNA, 19 nt, Homo sapiens
caugaagcagggugucuug

SEQ ID NO: 441944 - RNA, 19 nt, Homo sapiens
aauccagucagaaauaaga

SEQ ID NO: 441945 - RNA, 19 nt, Homo sapiens
gcagaauccgcaaacuuuu

SEQ ID NO: 441946 - RNA, 19 nt, Homo sapiens
ucucaacuugguuauugua

SEQ ID NO: 441947 - RNA, 19 nt, Homo sapiens
ucaguucgugguugcauug

SEQ ID NO: 441948 - RNA, 19 nt, Homo sapiens
gagaacuggagaaagaaag

SEQ ID NO: 441949 - RNA, 19 nt, Homo sapiens
gguuaugugguccgaauca

SEQ ID NO: 441950 - RNA, 19 nt, Homo sapiens
uggacugacugauacuaca

SEQ ID NO: 441951 - RNA, 19 nt, Homo sapiens
gaacuggagaaagaaagag

SEQ ID NO: 441952 - RNA, 19 nt, Homo sapiens
ggaaagcgauucacuguau

SEQ ID NO: 441953 - RNA, 19 nt, Homo sapiens
ugaaagauguguaugauga

SEQ ID NO: 441954 - RNA, 19 nt, Homo sapiens
gaacacaguuucagagaca

SEQ ID NO: 441955 - RNA, 19 nt, Homo sapiens
ggaccaagauggagagaga

SEQ ID NO: 441956 - RNA, 19 nt, Homo sapiens
gaaagcgauucacuguaua

SEQ ID NO: 441957 - RNA, 19 nt, Homo sapiens
gaugacaccuucuacuuug

SEQ ID NO: 441958 - RNA, 19 nt, Homo sapiens
ggaggaggaugugaaguuu

SEQ ID NO: 441959 - RNA, 19 nt, Homo sapiens
guccauggccuuucuaaua

SEQ ID NO: 441960 - RNA, 19 nt, Homo sapiens
gagaaugggcuccucauga

SEQ ID NO: 441961 - RNA, 19 nt, Homo sapiens
ggcaggauauacuccauuu

SEQ ID NO: 441962 - RNA, 19 nt, Homo sapiens
uccauggccuuucuaauaa

SEQ ID NO: 441963 - RNA, 19 nt, Homo sapiens
gaaggcaacgcugaaagua

SEQ ID NO: 441964 - RNA, 19 nt, Homo sapiens
gcgauucacuguauaaacu

SEQ ID NO: 441965 - RNA, 19 nt, Homo sapiens
ggaaauuggaacacaguuu

SEQ ID NO: 441966 - RNA, 19 nt, Homo sapiens
gaucggcagugggaaguuu

SEQ ID NO: 441967 - RNA, 19 nt, Homo sapiens
cuaugaaggugcugaagaa

SEQ ID NO: 441968 - RNA, 19 nt, Homo sapiens
gaagaaggcaacgcugaaa

SEQ ID NO: 441969 - RNA, 19 nt, Homo sapiens
caucaucacucugaaagau

SEQ ID NO: 441970 - RNA, 19 nt, Homo sapiens
caagcgggauccuucagaa

SEQ ID NO: 441971 - RNA, 19 nt, Homo sapiens
ggugcuagcuugacagagu

SEQ ID NO: 441972 - RNA, 19 nt, Homo sapiens
ggcaagcucuaucucauuc

SEQ ID NO: 441973 - RNA, 19 nt, Homo sapiens
caucaaccaccauggauuu

SEQ ID NO: 441974 - RNA, 19 nt, Homo sapiens
gcaccuguaugcuaugaag

SEQ ID NO: 441975 - RNA, 19 nt, Homo sapiens
acaccaugcuggcaggaua

SEQ ID NO: 441976 - RNA, 19 nt, Homo sapiens
caugacaccuugcuacaca

SEQ ID NO: 441977 - RNA, 19 nt, Homo sapiens
ccacaaggccaccaacaug

SEQ ID NO: 441978 - RNA, 19 nt, Homo sapiens
ccaccggccugauggaaga

SEQ ID NO: 441979 - RNA, 19 nt, Homo sapiens
ggaaggagaccaugacacu

SEQ ID NO: 441980 - RNA, 19 nt, Homo sapiens
gaaaucaagcggcaugucu

SEQ ID NO: 441981 - RNA, 19 nt, Homo sapiens
caacaucaucacucugaaa

SEQ ID NO: 441982 - RNA, 19 nt, Homo sapiens
ccagagagaggauguggaa

SEQ ID NO: 441983 - RNA, 19 nt, Homo sapiens
caagauccauuugccuuuc

SEQ ID NO: 441984 - RNA, 19 nt, Homo sapiens
gcaaaacuguggaguaucu

SEQ ID NO: 441985 - RNA, 19 nt, Homo sapiens
ccaugacacugauucugaa

SEQ ID NO: 441986 - RNA, 19 nt, Homo sapiens
gcacagccuggguaucauu

SEQ ID NO: 441987 - RNA, 19 nt, Homo sapiens
caucaaacucacugacuuu

SEQ ID NO: 441988 - RNA, 19 nt, Homo sapiens
ccaccaacauggaguaugc

SEQ ID NO: 441989 - RNA, 19 nt, Homo sapiens
gcuauaccgucgugagauc

SEQ ID NO: 441990 - RNA, 19 nt, Homo sapiens
ugaugacaccuucuacuuu

SEQ ID NO: 441991 - RNA, 19 nt, Homo sapiens
ccauggccuuucuaauaaa

SEQ ID NO: 441992 - RNA, 19 nt, Homo sapiens
gcgcaucugugacuuuggu

SEQ ID NO: 441993 - RNA, 19 nt, Homo sapiens
gggagcugcuggacaagau

SEQ ID NO: 441994 - RNA, 19 nt, Homo sapiens
caccagcgccucacagcua

SEQ ID NO: 441995 - RNA, 19 nt, Homo sapiens
ccucacagcuaagcagguu

SEQ ID NO: 441996 - RNA, 19 nt, Homo sapiens
gugggcaccuguaugcuau

SEQ ID NO: 441997 - RNA, 19 nt, Homo sapiens
gggcaagcucuaucucauu

SEQ ID NO: 441998 - RNA, 19 nt, Homo sapiens
gaaagauguguaugaugau

SEQ ID NO: 441999 - RNA, 19 nt, Homo sapiens
gggcaccuguaugcuauga

SEQ ID NO: 442000 - RNA, 19 nt, Homo sapiens
ccauugaccacgagaagaa

SEQ ID NO: 442001 - RNA, 19 nt, Homo sapiens
gcuaugaaggugcugaaga

SEQ ID NO: 442002 - RNA, 19 nt, Homo sapiens
gcaagcgggauccuucaga

SEQ ID NO: 442003 - RNA, 19 nt, Homo sapiens
gagagaggauguggaaagc

SEQ ID NO: 442004 - RNA, 19 nt, Homo sapiens
gcaucaaccaccauggauu

SEQ ID NO: 442005 - RNA, 19 nt, Homo sapiens
agaaugggcuccucaugac

SEQ ID NO: 442006 - RNA, 19 nt, Homo sapiens
aaagauguguaugaugaug

SEQ ID NO: 442007 - RNA, 19 nt, Homo sapiens
acaucaaacucacugacuu

SEQ ID NO: 442008 - RNA, 19 nt, Homo sapiens
ugaggagggccacaucaaa

SEQ ID NO: 442009 - RNA, 19 nt, Homo sapiens
caagcucuaucucauucug

SEQ ID NO: 442010 - RNA, 19 nt, Homo sapiens
aaagcgauucacuguauaa

SEQ ID NO: 442011 - RNA, 19 nt, Homo sapiens
gggcggugcuagcuugaca

SEQ ID NO: 442012 - RNA, 19 nt, Homo sapiens
gcauucugcuguacaccau

SEQ ID NO: 442013 - RNA, 19 nt, Homo sapiens
ucugaaagauguguaugau

SEQ ID NO: 442014 - RNA, 19 nt, Homo sapiens
ucaagcggcaugucuucua

SEQ ID NO: 442015 - RNA, 19 nt, Homo sapiens
aaggagaccaugacacuga

SEQ ID NO: 442016 - RNA, 19 nt, Homo sapiens
gagcaaagaggccauugac

SEQ ID NO: 442017 - RNA, 19 nt, Homo sapiens
aggaggaugugaaguuuua

SEQ ID NO: 442018 - RNA, 19 nt, Homo sapiens
caacaggacagaguucaca

SEQ ID NO: 442019 - RNA, 19 nt, Homo sapiens
caauuggugugggcuccua

SEQ ID NO: 442020 - RNA, 19 nt, Homo sapiens
caagcggcaugucuucuac

SEQ ID NO: 442021 - RNA, 19 nt, Homo sapiens
ugaagaaggcaacgcugaa

SEQ ID NO: 442022 - RNA, 19 nt, Homo sapiens
guggaaagcgauucacugu

SEQ ID NO: 442023 - RNA, 19 nt, Homo sapiens
cggaggaggaugugaaguu

SEQ ID NO: 442024 - RNA, 19 nt, Homo sapiens
ggaccuacagcuugugaag

SEQ ID NO: 442025 - RNA, 19 nt, Homo sapiens
gcugauccaucccauuucg

SEQ ID NO: 442026 - RNA, 19 nt, Homo sapiens
ccaacaucaucacucugaa

SEQ ID NO: 442027 - RNA, 19 nt, Homo sapiens
aggcugauccaucccauuu

SEQ ID NO: 442028 - RNA, 19 nt, Homo sapiens
cuagaaccacuuccugcua

SEQ ID NO: 442029 - RNA, 19 nt, Homo sapiens
gagcagaaacagccauugc

SEQ ID NO: 442030 - RNA, 19 nt, Homo sapiens
uggugaagcugcacuaugc

SEQ ID NO: 442031 - RNA, 19 nt, Homo sapiens
gagggcaagcucuaucuca

SEQ ID NO: 442032 - RNA, 19 nt, Homo sapiens
gacuucagccguccaagga

SEQ ID NO: 442033 - RNA, 19 nt, Homo sapiens
uuccucagcugguuacuca

SEQ ID NO: 442034 - RNA, 19 nt, Homo sapiens
ugaagcccaucgagucauc

SEQ ID NO: 442035 - RNA, 19 nt, Homo sapiens
gaggagggccacaucaaac

SEQ ID NO: 442036 - RNA, 19 nt, Homo sapiens
gcugaagcccaucgaguca

SEQ ID NO: 442037 - RNA, 19 nt, Homo sapiens
gaccugaagcccagcaaca

SEQ ID NO: 442038 - RNA, 19 nt, Homo sapiens
gagcaagcgggauccuuca

SEQ ID NO: 442039 - RNA, 19 nt, Homo sapiens
cauggaguaugcugucaag

SEQ ID NO: 442040 - RNA, 19 nt, Homo sapiens
gcgggacaguggaguacau

SEQ ID NO: 442041 - RNA, 19 nt, Homo sapiens
acaagauccauuugccuuu

SEQ ID NO: 442042 - RNA, 19 nt, Homo sapiens
uaaugagggugugagaagu

SEQ ID NO: 442043 - RNA, 19 nt, Homo sapiens
cuaaugagggugugagaag

SEQ ID NO: 442044 - RNA, 19 nt, Homo sapiens
gugaggaaguugccaucca

SEQ ID NO: 442045 - RNA, 19 nt, Homo sapiens
uguguaugaugauggcaaa

SEQ ID NO: 442046 - RNA, 19 nt, Homo sapiens
cccaacaucaucacucuga

SEQ ID NO: 442047 - RNA, 19 nt, Homo sapiens
gcaacuccaugggaagaac

SEQ ID NO: 442048 - RNA, 19 nt, Homo sapiens
ugacuggaauaagcuauac

SEQ ID NO: 442049 - RNA, 19 nt, Homo sapiens
acguguaccuggugacaga

SEQ ID NO: 442050 - RNA, 19 nt, Homo sapiens
gaccggaaggagaccauga

SEQ ID NO: 442051 - RNA, 19 nt, Homo sapiens
ugacacaccagaggaaauc

SEQ ID NO: 442052 - RNA, 19 nt, Homo sapiens
ggacaaggauccuauggaa

SEQ ID NO: 442053 - RNA, 19 nt, Homo sapiens
gaucgaagauggagagaga

SEQ ID NO: 442054 - RNA, 19 nt, Homo sapiens
ggaagaaggugucgugaag

SEQ ID NO: 442055 - RNA, 19 nt, Homo sapiens
ucaaggaugucuaugauga

SEQ ID NO: 442056 - RNA, 19 nt, Homo sapiens
gaggacaccuuccacuuug

SEQ ID NO: 442057 - RNA, 19 nt, Homo sapiens
gcugcgagcucucuucaaa

SEQ ID NO: 442058 - RNA, 19 nt, Homo sapiens
ggaggaggaugucaaguuc

SEQ ID NO: 442059 - RNA, 19 nt, Homo sapiens
gcaaaugggccagacgaua

SEQ ID NO: 442060 - RNA, 19 nt, Homo sapiens
gaagcuucauuaugccuuu

SEQ ID NO: 442061 - RNA, 19 nt, Homo sapiens
cuacuuugcucuaaacaga

SEQ ID NO: 442062 - RNA, 19 nt, Homo sapiens
gcagauccuucccaguuug

SEQ ID NO: 442063 - RNA, 19 nt, Homo sapiens
gaaggcaggcuggaucuuu

SEQ ID NO: 442064 - RNA, 19 nt, Homo sapiens
cuaaagacgucguguccaa

SEQ ID NO: 442065 - RNA, 19 nt, Homo sapiens
acacacggguccuucauug

SEQ ID NO: 442066 - RNA, 19 nt, Homo sapiens
gcugugcucuacuucauug

SEQ ID NO: 442067 - RNA, 19 nt, Homo sapiens
acagcuaucuggaggcuuu

SEQ ID NO: 442068 - RNA, 19 nt, Homo sapiens
auacauggcuucuguuucu

SEQ ID NO: 442069 - RNA, 19 nt, Homo sapiens
cgccaucccuucuuuguga

SEQ ID NO: 442070 - RNA, 19 nt, Homo sapiens
uaagcgccaucccuucuuu

SEQ ID NO: 442071 - RNA, 19 nt, Homo sapiens
ccaaagaggucauguucac

SEQ ID NO: 442072 - RNA, 19 nt, Homo sapiens
ggcagauccuucccaguuu

SEQ ID NO: 442073 - RNA, 19 nt, Homo sapiens
caagcgaugugugcauaaa

SEQ ID NO: 442074 - RNA, 19 nt, Homo sapiens
gcgaugcacuuuguagaug

SEQ ID NO: 442075 - RNA, 19 nt, Homo sapiens
ccaccuacuuugcucuaaa

SEQ ID NO: 442076 - RNA, 19 nt, Homo sapiens
gagaguaccuguccccaaa

SEQ ID NO: 442077 - RNA, 19 nt, Homo sapiens
ucacccggcucuccaaaga

SEQ ID NO: 442078 - RNA, 19 nt, Homo sapiens
guggagaaacugugaauug

SEQ ID NO: 442079 - RNA, 19 nt, Homo sapiens
ucucauacauggcuucugu

SEQ ID NO: 442080 - RNA, 19 nt, Homo sapiens
gcagaggcaugaagagacu

SEQ ID NO: 442081 - RNA, 19 nt, Homo sapiens
aaggaaagcucuaccugau

SEQ ID NO: 442082 - RNA, 19 nt, Homo sapiens
caggagcgaugcacuuugu

SEQ ID NO: 442083 - RNA, 19 nt, Homo sapiens
gagaucuguuuuccaauua

SEQ ID NO: 442084 - RNA, 19 nt, Homo sapiens
ggaacgggcugcucaugac

SEQ ID NO: 442085 - RNA, 19 nt, Homo sapiens
gagcuggccuuggcuuuag

SEQ ID NO: 442086 - RNA, 19 nt, Homo sapiens
gaaggagggcuuugagaag

SEQ ID NO: 442087 - RNA, 19 nt, Homo sapiens
ggacaggagcgaugcacuu

SEQ ID NO: 442088 - RNA, 19 nt, Homo sapiens
gcgauggaccugagcauga

SEQ ID NO: 442089 - RNA, 19 nt, Homo sapiens
gaucggcagugggaaguau

SEQ ID NO: 442090 - RNA, 19 nt, Homo sapiens
ccucaaggaugucuaugau

SEQ ID NO: 442091 - RNA, 19 nt, Homo sapiens
uaagaaagccacccuaaaa

SEQ ID NO: 442092 - RNA, 19 nt, Homo sapiens
gggcagcucuacgccauga

SEQ ID NO: 442093 - RNA, 19 nt, Homo sapiens
gcuaugaugcggcguguga

SEQ ID NO: 442094 - RNA, 19 nt, Homo sapiens
ugaggacaccuuccacuuu

SEQ ID NO: 442095 - RNA, 19 nt, Homo sapiens
gcagguucuucucugugua

SEQ ID NO: 442096 - RNA, 19 nt, Homo sapiens
ggaagucgcgcuccaagag

SEQ ID NO: 442097 - RNA, 19 nt, Homo sapiens
cgagagaucuguuuuccaa

SEQ ID NO: 442098 - RNA, 19 nt, Homo sapiens
caucagccaucaugugaag

SEQ ID NO: 442099 - RNA, 19 nt, Homo sapiens
ucaccaagaccauggacua

SEQ ID NO: 442100 - RNA, 19 nt, Homo sapiens
gaugauggcaaguuugugu

SEQ ID NO: 442101 - RNA, 19 nt, Homo sapiens
cuaugaugauggcaaguuu

SEQ ID NO: 442102 - RNA, 19 nt, Homo sapiens
agcaagaucugcacaaagu

SEQ ID NO: 442103 - RNA, 19 nt, Homo sapiens
gcucaucaccuguuuagag

SEQ ID NO: 442104 - RNA, 19 nt, Homo sapiens
ggccuuggcuuuagaccau

SEQ ID NO: 442105 - RNA, 19 nt, Homo sapiens
gaccugagcaugaagaagu

SEQ ID NO: 442106 - RNA, 19 nt, Homo sapiens
ggagaaacugugaauugga

SEQ ID NO: 442107 - RNA, 19 nt, Homo sapiens
ccagguacccggugggaaa

SEQ ID NO: 442108 - RNA, 19 nt, Homo sapiens
gaaacugggacucgauauc

SEQ ID NO: 442109 - RNA, 19 nt, Homo sapiens
gggaaacugggacucgaua

SEQ ID NO: 442110 - RNA, 19 nt, Homo sapiens
caaaugggccagacgauac

SEQ ID NO: 442111 - RNA, 19 nt, Homo sapiens
cgauggaccugagcaugaa

SEQ ID NO: 442112 - RNA, 19 nt, Homo sapiens
ugaaggagggcuuugagaa

SEQ ID NO: 442113 - RNA, 19 nt, Homo sapiens
aagaaggugucgugaagga

SEQ ID NO: 442114 - RNA, 19 nt, Homo sapiens
cgaguaacauccuguacag

SEQ ID NO: 442115 - RNA, 19 nt, Homo sapiens
aggaggaugucaaguucua

SEQ ID NO: 442116 - RNA, 19 nt, Homo sapiens
guccuucauuguccuguaa

SEQ ID NO: 442117 - RNA, 19 nt, Homo sapiens
gacaggagcgaugcacuuu

SEQ ID NO: 442118 - RNA, 19 nt, Homo sapiens
gggaacgggcugcucauga

SEQ ID NO: 442119 - RNA, 19 nt, Homo sapiens
ggaacaacauccacuucac

SEQ ID NO: 442120 - RNA, 19 nt, Homo sapiens
acagcaagaucugcacaaa

SEQ ID NO: 442121 - RNA, 19 nt, Homo sapiens
gaaagccacccuaaaaguu

SEQ ID NO: 442122 - RNA, 19 nt, Homo sapiens
gaacacacggguccuucau

SEQ ID NO: 442123 - RNA, 19 nt, Homo sapiens
gccaugcugugcucuacuu

SEQ ID NO: 442124 - RNA, 19 nt, Homo sapiens
cgugugacaucuggaguuu

SEQ ID NO: 442125 - RNA, 19 nt, Homo sapiens
gaacaucaucacccucaag

SEQ ID NO: 442126 - RNA, 19 nt, Homo sapiens
gcaagcgaugugugcauaa

SEQ ID NO: 442127 - RNA, 19 nt, Homo sapiens
ugaguaaggaggccauuga

SEQ ID NO: 442128 - RNA, 19 nt, Homo sapiens
gaaacugugaauuggagaa

SEQ ID NO: 442129 - RNA, 19 nt, Homo sapiens
acaaggauccuauggaaag

SEQ ID NO: 442130 - RNA, 19 nt, Homo sapiens
uuaugaagccggucgguuu

SEQ ID NO: 442131 - RNA, 19 nt, Homo sapiens
gcucagcgcagaggcauga

SEQ ID NO: 442132 - RNA, 19 nt, Homo sapiens
acaccaugcuggcaggauu

SEQ ID NO: 442133 - RNA, 19 nt, Homo sapiens
gaccugaagccgaguaaca

SEQ ID NO: 442134 - RNA, 19 nt, Homo sapiens
caucaccuguuuagaggau

SEQ ID NO: 442135 - RNA, 19 nt, Homo sapiens
gcgggacgaucgaguacau

SEQ ID NO: 442136 - RNA, 19 nt, Homo sapiens
caucuuggcagaagugaau

SEQ ID NO: 442137 - RNA, 19 nt, Homo sapiens
ugaaggagauagacaucag

SEQ ID NO: 442138 - RNA, 19 nt, Homo sapiens
ccuccucgcccuucaguuu

SEQ ID NO: 442139 - RNA, 19 nt, Homo sapiens
cgaugcaagugcucaaaca

SEQ ID NO: 442140 - RNA, 19 nt, Homo sapiens
caucaucacccucaaggau

SEQ ID NO: 442141 - RNA, 19 nt, Homo sapiens
gggaacaacauccacuuca

SEQ ID NO: 442142 - RNA, 19 nt, Homo sapiens
gcacaaagucccaguucac

SEQ ID NO: 442143 - RNA, 19 nt, Homo sapiens
guuuagaggauucagcuuu

SEQ ID NO: 442144 - RNA, 19 nt, Homo sapiens
gaagaggggcacauuaaga

SEQ ID NO: 442145 - RNA, 19 nt, Homo sapiens
gguccuucauuguccugua

SEQ ID NO: 442146 - RNA, 19 nt, Homo sapiens
gagcgaugcacuuuguaga

SEQ ID NO: 442147 - RNA, 19 nt, Homo sapiens
cagauucaaaugaggagua

SEQ ID NO: 442148 - RNA, 19 nt, Homo sapiens
uuaagaaagccacccuaaa

SEQ ID NO: 442149 - RNA, 19 nt, Homo sapiens
uuuagaggauucagcuuug

SEQ ID NO: 442150 - RNA, 19 nt, Homo sapiens
gacaaggauccuauggaaa

SEQ ID NO: 442151 - RNA, 19 nt, Homo sapiens
agauucaaaugaggaguaa

SEQ ID NO: 442152 - RNA, 19 nt, Homo sapiens
gaagggaaguuguaucuua

SEQ ID NO: 442153 - RNA, 19 nt, Homo sapiens
caaaggaccuggugucaaa

SEQ ID NO: 442154 - RNA, 19 nt, Homo sapiens
ggaauaaacuguauagaag

SEQ ID NO: 442155 - RNA, 19 nt, Homo sapiens
guauauggcuccagaagua

SEQ ID NO: 442156 - RNA, 19 nt, Homo sapiens
uaacagaacuuaugaaagg

SEQ ID NO: 442157 - RNA, 19 nt, Homo sapiens
gagaauggacagcaaauua

SEQ ID NO: 442158 - RNA, 19 nt, Homo sapiens
gaaaguauguguauguagu

SEQ ID NO: 442159 - RNA, 19 nt, Homo sapiens
ggacagcauccaaacauua

SEQ ID NO: 442160 - RNA, 19 nt, Homo sapiens
agaagaagaugucaaauuc

SEQ ID NO: 442161 - RNA, 19 nt, Homo sapiens
gaagaaggccacacugaaa

SEQ ID NO: 442162 - RNA, 19 nt, Homo sapiens
ggaggugaauugcuggaua

SEQ ID NO: 442163 - RNA, 19 nt, Homo sapiens
cuacauagccugggaauaa

SEQ ID NO: 442164 - RNA, 19 nt, Homo sapiens
caaagaugcuucauguaga

SEQ ID NO: 442165 - RNA, 19 nt, Homo sapiens
auacaaugcuuaccgguua

SEQ ID NO: 442166 - RNA, 19 nt, Homo sapiens
gaggugaauugcuggauaa

SEQ ID NO: 442167 - RNA, 19 nt, Homo sapiens
gcagugaagauuauugaua

SEQ ID NO: 442168 - RNA, 19 nt, Homo sapiens
gggaccaacugccacaaua

SEQ ID NO: 442169 - RNA, 19 nt, Homo sapiens
gggcagggaucauuuggaa

SEQ ID NO: 442170 - RNA, 19 nt, Homo sapiens
gaaggucacaucaaguuaa

SEQ ID NO: 442171 - RNA, 19 nt, Homo sapiens
gggaaguuguaucuuauuu

SEQ ID NO: 442172 - RNA, 19 nt, Homo sapiens
gcaaaugguccugaugaua

SEQ ID NO: 442173 - RNA, 19 nt, Homo sapiens
caaagaaauugcaaucaca

SEQ ID NO: 442174 - RNA, 19 nt, Homo sapiens
caagagagacccaacagaa

SEQ ID NO: 442175 - RNA, 19 nt, Homo sapiens
gacagcaaauuauggauga

SEQ ID NO: 442176 - RNA, 19 nt, Homo sapiens
caucgagacuugaaaccua

SEQ ID NO: 442177 - RNA, 19 nt, Homo sapiens
ggauguauaugaugaugga

SEQ ID NO: 442178 - RNA, 19 nt, Homo sapiens
gcuauuaccucagaugaug

SEQ ID NO: 442179 - RNA, 19 nt, Homo sapiens
cguaaucagucaccaguuu

SEQ ID NO: 442180 - RNA, 19 nt, Homo sapiens
acauaaagcuacaaacaug

SEQ ID NO: 442181 - RNA, 19 nt, Homo sapiens
ggaacgugauaucuuggua

SEQ ID NO: 442182 - RNA, 19 nt, Homo sapiens
ugucaaagaugcuucaugu

SEQ ID NO: 442183 - RNA, 19 nt, Homo sapiens
gaggaaauauuggcacgaa

SEQ ID NO: 442184 - RNA, 19 nt, Homo sapiens
gcgaaauccugcaaacaga

SEQ ID NO: 442185 - RNA, 19 nt, Homo sapiens
ugaagaaggucacaucaag

SEQ ID NO: 442186 - RNA, 19 nt, Homo sapiens
gcagacaguugguguacau

SEQ ID NO: 442187 - RNA, 19 nt, Homo sapiens
gaaacaaugacuaugauuc

SEQ ID NO: 442188 - RNA, 19 nt, Homo sapiens
ccaugaagguauugaagaa

SEQ ID NO: 442189 - RNA, 19 nt, Homo sapiens
gaaauucuucuucguuaug

SEQ ID NO: 442190 - RNA, 19 nt, Homo sapiens
gagauuaacccacaaacug

SEQ ID NO: 442191 - RNA, 19 nt, Homo sapiens
gcagauccuucccaguuug

SEQ ID NO: 442192 - RNA, 19 nt, Homo sapiens
gaagucaguaucaaagaaa

SEQ ID NO: 442193 - RNA, 19 nt, Homo sapiens
gcuguccuguucacuauaa

SEQ ID NO: 442194 - RNA, 19 nt, Homo sapiens
cgacagcgcugagaaugga

SEQ ID NO: 442195 - RNA, 19 nt, Homo sapiens
gaagaagucaguaucaaag

SEQ ID NO: 442196 - RNA, 19 nt, Homo sapiens
gggcaggccugaagauaca

SEQ ID NO: 442197 - RNA, 19 nt, Homo sapiens
cagaagaagaugucaaauu

SEQ ID NO: 442198 - RNA, 19 nt, Homo sapiens
ggaacaguauucaguuuac

SEQ ID NO: 442199 - RNA, 19 nt, Homo sapiens
agauggaguugaagaaauu

SEQ ID NO: 442200 - RNA, 19 nt, Homo sapiens
gcucagcggagagguauua

SEQ ID NO: 442201 - RNA, 19 nt, Homo sapiens
aaaccuagcaacauucuuu

SEQ ID NO: 442202 - RNA, 19 nt, Homo sapiens
caggaacaguauucaguuu

SEQ ID NO: 442203 - RNA, 19 nt, Homo sapiens
ugugauauauggagucuug

SEQ ID NO: 442204 - RNA, 19 nt, Homo sapiens
guggaacuguggaguauau

SEQ ID NO: 442205 - RNA, 19 nt, Homo sapiens
guaaaggaaggacaugaaa

SEQ ID NO: 442206 - RNA, 19 nt, Homo sapiens
gcuaugaugcugcuuguga

SEQ ID NO: 442207 - RNA, 19 nt, Homo sapiens
gaaaauggucuucucauga

SEQ ID NO: 442208 - RNA, 19 nt, Homo sapiens
gggaggagauuuguuuaca

SEQ ID NO: 442209 - RNA, 19 nt, Homo sapiens
ggcagauccuucccaguuu

SEQ ID NO: 442210 - RNA, 19 nt, Homo sapiens
ucaaagaugcuucauguag

SEQ ID NO: 442211 - RNA, 19 nt, Homo sapiens
ugaugcugcuugugauaua

SEQ ID NO: 442212 - RNA, 19 nt, Homo sapiens
cacaucaaguuaacagauu

SEQ ID NO: 442213 - RNA, 19 nt, Homo sapiens
gaaauugcaaucacacauc

SEQ ID NO: 442214 - RNA, 19 nt, Homo sapiens
cuugaaaccuagcaacauu

SEQ ID NO: 442215 - RNA, 19 nt, Homo sapiens
ggccagugcuguccuguuc

SEQ ID NO: 442216 - RNA, 19 nt, Homo sapiens
ccaaacauuaucacucuaa

SEQ ID NO: 442217 - RNA, 19 nt, Homo sapiens
uaaagagucuauugaccau

SEQ ID NO: 442218 - RNA, 19 nt, Homo sapiens
cuacuuggcugaacuugca

SEQ ID NO: 442219 - RNA, 19 nt, Homo sapiens
caaaugguccugaugauac

SEQ ID NO: 442220 - RNA, 19 nt, Homo sapiens
ggaaaauggucuucucaug

SEQ ID NO: 442221 - RNA, 19 nt, Homo sapiens
uaugaaaggaggugaauug

SEQ ID NO: 442222 - RNA, 19 nt, Homo sapiens
guauguguauguaguaaca

SEQ ID NO: 442223 - RNA, 19 nt, Homo sapiens
gacaguugguguacauuca

SEQ ID NO: 442224 - RNA, 19 nt, Homo sapiens
gaauggacagcaaauuaug

SEQ ID NO: 442225 - RNA, 19 nt, Homo sapiens
agaagucaguaucaaagaa

SEQ ID NO: 442226 - RNA, 19 nt, Homo sapiens
guaguaacagaacuuauga

SEQ ID NO: 442227 - RNA, 19 nt, Homo sapiens
gauccugaguuuacugcaa

SEQ ID NO: 442228 - RNA, 19 nt, Homo sapiens
cagauggaguugaagaaau

SEQ ID NO: 442229 - RNA, 19 nt, Homo sapiens
aauggaacgugauaucuug

SEQ ID NO: 442230 - RNA, 19 nt, Homo sapiens
aagagucuauugaccauga

SEQ ID NO: 442231 - RNA, 19 nt, Homo sapiens
gggaucauuuggaaagguu

SEQ ID NO: 442232 - RNA, 19 nt, Homo sapiens
ugaagaagucaguaucaaa

SEQ ID NO: 442233 - RNA, 19 nt, Homo sapiens
cauuaucacucuaaaggau

SEQ ID NO: 442234 - RNA, 19 nt, Homo sapiens
gcagggaucauuuggaaag

SEQ ID NO: 442235 - RNA, 19 nt, Homo sapiens
gaguuugcagugaagauua

SEQ ID NO: 442236 - RNA, 19 nt, Homo sapiens
gagacugacugcugcucuu

SEQ ID NO: 442237 - RNA, 19 nt, Homo sapiens
uuacuggaauucuguuuca

SEQ ID NO: 442238 - RNA, 19 nt, Homo sapiens
ucaaagaaauugcaaucac

SEQ ID NO: 442239 - RNA, 19 nt, Homo sapiens
agacuggaauaaacuguau

SEQ ID NO: 442240 - RNA, 19 nt, Homo sapiens
gaacuugcacuugcuuuag

SEQ ID NO: 442241 - RNA, 19 nt, Homo sapiens
cuacauauucugcuuugaa

SEQ ID NO: 442242 - RNA, 19 nt, Homo sapiens
gugcuguccuguucacuau

SEQ ID NO: 442243 - RNA, 19 nt, Homo sapiens
uggaaaguauguguaugua

SEQ ID NO: 442244 - RNA, 19 nt, Homo sapiens
uguagacccucaucagaga

SEQ ID NO: 442245 - RNA, 19 nt, Homo sapiens
gccugaagauacauucuau

SEQ ID NO: 442246 - RNA, 19 nt, Homo sapiens
gagaaauucauccgccauu

SEQ ID NO: 442247 - RNA, 19 nt, Homo sapiens
gaagaaggucacaucaagu

SEQ ID NO: 442248 - RNA, 19 nt, Homo sapiens
ugaagaaggccacacugaa

SEQ ID NO: 442249 - RNA, 19 nt, Homo sapiens
gaugauacaccagaggaaa

SEQ ID NO: 442250 - RNA, 19 nt, Homo sapiens
gguguacauucaauuguuc

SEQ ID NO: 442251 - RNA, 19 nt, Homo sapiens
gcuaaugcacaucagcuuu

SEQ ID NO: 442252 - RNA, 19 nt, Homo sapiens
gcaaacaaccugaaucuuu

SEQ ID NO: 442253 - RNA, 19 nt, Homo sapiens
ggaagacacugccugcuuu

SEQ ID NO: 442254 - RNA, 19 nt, Homo sapiens
gaaagagagggaauauuua

SEQ ID NO: 442255 - RNA, 19 nt, Homo sapiens
gaagaaagccagacaacuu

SEQ ID NO: 442256 - RNA, 19 nt, Homo sapiens
ggacauggcaggaguguuu

SEQ ID NO: 442257 - RNA, 19 nt, Homo sapiens
agaaagagagggaauauuu

SEQ ID NO: 442258 - RNA, 19 nt, Homo sapiens
uaguauugcugaacucuua

SEQ ID NO: 442259 - RNA, 19 nt, Homo sapiens
gagaauaucaugcuuaauc

SEQ ID NO: 442260 - RNA, 19 nt, Homo sapiens
ggaaacaaguggcauagag

SEQ ID NO: 442261 - RNA, 19 nt, Homo sapiens
gcaaugauaguaagaaaug

SEQ ID NO: 442262 - RNA, 19 nt, Homo sapiens
gaugagaaguggccacaau

SEQ ID NO: 442263 - RNA, 19 nt, Homo sapiens
gcagauggaugugacaaug

SEQ ID NO: 442264 - RNA, 19 nt, Homo sapiens
ccagaugacucaacucuca

SEQ ID NO: 442265 - RNA, 19 nt, Homo sapiens
ccugaaaucuugaugagaa

SEQ ID NO: 442266 - RNA, 19 nt, Homo sapiens
gaacuuggcauggaacauu

SEQ ID NO: 442267 - RNA, 19 nt, Homo sapiens
caaauuagcaugcaagcuu

SEQ ID NO: 442268 - RNA, 19 nt, Homo sapiens
guugaugacucgaaacuga

SEQ ID NO: 442269 - RNA, 19 nt, Homo sapiens
gaggagaacuauuuaugca

SEQ ID NO: 442270 - RNA, 19 nt, Homo sapiens
ggaauauucuggaggaagu

SEQ ID NO: 442271 - RNA, 19 nt, Homo sapiens
ggaacauugugagaaauuu

SEQ ID NO: 442272 - RNA, 19 nt, Homo sapiens
gaaacaagacucaaaauga

SEQ ID NO: 442273 - RNA, 19 nt, Homo sapiens
ccgaucaccucgaagauuu

SEQ ID NO: 442274 - RNA, 19 nt, Homo sapiens
gaaacuaacagacuuugga

SEQ ID NO: 442275 - RNA, 19 nt, Homo sapiens
cggagaauaucaugcuuaa

SEQ ID NO: 442276 - RNA, 19 nt, Homo sapiens
cauggaacauugugagaaa

SEQ ID NO: 442277 - RNA, 19 nt, Homo sapiens
caaacaaccugaaucuuuu

SEQ ID NO: 442278 - RNA, 19 nt, Homo sapiens
gcauagagcagauggaugu

SEQ ID NO: 442279 - RNA, 19 nt, Homo sapiens
ucaguuugauuccaaguuu

SEQ ID NO: 442280 - RNA, 19 nt, Homo sapiens
caacuucuguuucuucucu

SEQ ID NO: 442281 - RNA, 19 nt, Homo sapiens
gguaggauguugcucugaa

SEQ ID NO: 442282 - RNA, 19 nt, Homo sapiens
ugacucaacucucagugaa

SEQ ID NO: 442283 - RNA, 19 nt, Homo sapiens
gaaaauauuugccaugaag

SEQ ID NO: 442284 - RNA, 19 nt, Homo sapiens
ccagagcaccugcguauga

SEQ ID NO: 442285 - RNA, 19 nt, Homo sapiens
gaacagucacacacacauu

SEQ ID NO: 442286 - RNA, 19 nt, Homo sapiens
gaacauugugagaaauuug

SEQ ID NO: 442287 - RNA, 19 nt, Homo sapiens
uaagucaguuugauuccaa

SEQ ID NO: 442288 - RNA, 19 nt, Homo sapiens
cgacaucuuucucaaccuu

SEQ ID NO: 442289 - RNA, 19 nt, Homo sapiens
ccucaaauguaaacucaau

SEQ ID NO: 442290 - RNA, 19 nt, Homo sapiens
uaacagacuuuggacuaug

SEQ ID NO: 442291 - RNA, 19 nt, Homo sapiens
gagagggaauauuuaugga

SEQ ID NO: 442292 - RNA, 19 nt, Homo sapiens
cauaugaacuuggcaugga

SEQ ID NO: 442293 - RNA, 19 nt, Homo sapiens
gacaaaauccucaaaugua

SEQ ID NO: 442294 - RNA, 19 nt, Homo sapiens
gauguaagucaguuugauu

SEQ ID NO: 442295 - RNA, 19 nt, Homo sapiens
cagggaagcugaggacaug

SEQ ID NO: 442296 - RNA, 19 nt, Homo sapiens
gcucauccauucuuuagac

SEQ ID NO: 442297 - RNA, 19 nt, Homo sapiens
gaacucugggccauacaaa

SEQ ID NO: 442298 - RNA, 19 nt, Homo sapiens
uuaaaccucuguugcaauc

SEQ ID NO: 442299 - RNA, 19 nt, Homo sapiens
ucaagcucauccauucuuu

SEQ ID NO: 442300 - RNA, 19 nt, Homo sapiens
gcaggaguguuugacauag

SEQ ID NO: 442301 - RNA, 19 nt, Homo sapiens
gaaacuuaccaauugaugu

SEQ ID NO: 442302 - RNA, 19 nt, Homo sapiens
caguuugauuccaaguuua

SEQ ID NO: 442303 - RNA, 19 nt, Homo sapiens
ugucagcccagucaaauuu

SEQ ID NO: 442304 - RNA, 19 nt, Homo sapiens
ggauguaagucaguuugau

SEQ ID NO: 442305 - RNA, 19 nt, Homo sapiens
aaaguaacaggagcaaaua

SEQ ID NO: 442306 - RNA, 19 nt, Homo sapiens
ggcaggaguguuugacaua

SEQ ID NO: 442307 - RNA, 19 nt, Homo sapiens
ccaaggucaugugaaacua

SEQ ID NO: 442308 - RNA, 19 nt, Homo sapiens
aaagauacagcucauacaa

SEQ ID NO: 442309 - RNA, 19 nt, Homo sapiens
ggaagcaucggcaccacuu

SEQ ID NO: 442310 - RNA, 19 nt, Homo sapiens
ucagacaccuguggaauac

SEQ ID NO: 442311 - RNA, 19 nt, Homo sapiens
gaccugaagccggagaaua

SEQ ID NO: 442312 - RNA, 19 nt, Homo sapiens
ggccagagcaccugcguau

SEQ ID NO: 442313 - RNA, 19 nt, Homo sapiens
auauguggcuccaucugua

SEQ ID NO: 442314 - RNA, 19 nt, Homo sapiens
caagcucauccauucuuua

SEQ ID NO: 442315 - RNA, 19 nt, Homo sapiens
cuaacagacuuuggacuau

SEQ ID NO: 442316 - RNA, 19 nt, Homo sapiens
caguggaggagaacuauuu

SEQ ID NO: 442317 - RNA, 19 nt, Homo sapiens
gggaaaauauuugccauga

SEQ ID NO: 442318 - RNA, 19 nt, Homo sapiens
gcaaauacugggaaaauau

SEQ ID NO: 442319 - RNA, 19 nt, Homo sapiens
ccugcaaggugaaacaaga

SEQ ID NO: 442320 - RNA, 19 nt, Homo sapiens
gcaccugcguaugaaucua

SEQ ID NO: 442321 - RNA, 19 nt, Homo sapiens
cagagcaccugcguaugaa

SEQ ID NO: 442322 - RNA, 19 nt, Homo sapiens
cgacagcccagaugacuca

SEQ ID NO: 442323 - RNA, 19 nt, Homo sapiens
caaggucaugugaaacuaa

SEQ ID NO: 442324 - RNA, 19 nt, Homo sapiens
guaggauguugcucugaau

SEQ ID NO: 442325 - RNA, 19 nt, Homo sapiens
ucaccucgaagauuuauug

SEQ ID NO: 442326 - RNA, 19 nt, Homo sapiens
gaacuucuggcucgaaagg

SEQ ID NO: 442327 - RNA, 19 nt, Homo sapiens
agauacagcucauacaaaa

SEQ ID NO: 442328 - RNA, 19 nt, Homo sapiens
gcaagcuuggucaaacuuu

SEQ ID NO: 442329 - RNA, 19 nt, Homo sapiens
cuacuucggguacuuggua

SEQ ID NO: 442330 - RNA, 19 nt, Homo sapiens
guugcaaucugaagaggau

SEQ ID NO: 442331 - RNA, 19 nt, Homo sapiens
ggaggagaacuauuuaugc

SEQ ID NO: 442332 - RNA, 19 nt, Homo sapiens
caggaguguuugacauaga

SEQ ID NO: 442333 - RNA, 19 nt, Homo sapiens
ggaaaauauuugccaugaa

SEQ ID NO: 442334 - RNA, 19 nt, Homo sapiens
caaguggcauagagcagau

SEQ ID NO: 442335 - RNA, 19 nt, Homo sapiens
ggaguuggaccauaugaac

SEQ ID NO: 442336 - RNA, 19 nt, Homo sapiens
gaggauguaagucaguuug

SEQ ID NO: 442337 - RNA, 19 nt, Homo sapiens
gaagaggauguaagucagu

SEQ ID NO: 442338 - RNA, 19 nt, Homo sapiens
ggacuaugcaaagaaucua

SEQ ID NO: 442339 - RNA, 19 nt, Homo sapiens
gcauggaacauugugagaa

SEQ ID NO: 442340 - RNA, 19 nt, Homo sapiens
gugaacagagggccagaaa

SEQ ID NO: 442341 - RNA, 19 nt, Homo sapiens
aggcaaugauaguaagaaa

SEQ ID NO: 442342 - RNA, 19 nt, Homo sapiens
gacaacuucuguuucuucu

SEQ ID NO: 442343 - RNA, 19 nt, Homo sapiens
aaaagcugcugaaaagaaa

SEQ ID NO: 442344 - RNA, 19 nt, Homo sapiens
gaaaucuugaugagaagug

SEQ ID NO: 442345 - RNA, 19 nt, Homo sapiens
ccuauaauacuugcaacua

SEQ ID NO: 442346 - RNA, 19 nt, Homo sapiens
gucauuacauagaacacuu

SEQ ID NO: 442347 - RNA, 19 nt, Homo sapiens
aaacaagcuuuucccauga

SEQ ID NO: 442348 - RNA, 19 nt, Homo sapiens
caaguacaaauugccuaua

SEQ ID NO: 442349 - RNA, 19 nt, Homo sapiens
gcugaacucuuaggcacau

SEQ ID NO: 442350 - RNA, 19 nt, Homo sapiens
cauccauucuuuagacaca

SEQ ID NO: 442351 - RNA, 19 nt, Homo sapiens
gaguuugggagcauuaaug

SEQ ID NO: 442352 - RNA, 19 nt, Homo sapiens
gcaaggagucuauccauga

SEQ ID NO: 442353 - RNA, 19 nt, Homo sapiens
gacgugagccaguuugaua

SEQ ID NO: 442354 - RNA, 19 nt, Homo sapiens
ggaagaaaaccauggauaa

SEQ ID NO: 442355 - RNA, 19 nt, Homo sapiens
gcagagaaccggaagaaaa

SEQ ID NO: 442356 - RNA, 19 nt, Homo sapiens
gagcggaacauucuagagu

SEQ ID NO: 442357 - RNA, 19 nt, Homo sapiens
ggaacauucuagagucagu

SEQ ID NO: 442358 - RNA, 19 nt, Homo sapiens
gcggaacauucuagaguca

SEQ ID NO: 442359 - RNA, 19 nt, Homo sapiens
guacauggccccugagauu

SEQ ID NO: 442360 - RNA, 19 nt, Homo sapiens
caaggagucuauccaugag

SEQ ID NO: 442361 - RNA, 19 nt, Homo sapiens
ccaggcgccucaacaguag

SEQ ID NO: 442362 - RNA, 19 nt, Homo sapiens
gggcugagcggaacauucu

SEQ ID NO: 442363 - RNA, 19 nt, Homo sapiens
ggagcgagagggcaucuuc

SEQ ID NO: 442364 - RNA, 19 nt, Homo sapiens
ggugugagugcguaugaaa

SEQ ID NO: 442365 - RNA, 19 nt, Homo sapiens
gaauugggacgaccuucug

SEQ ID NO: 442366 - RNA, 19 nt, Homo sapiens
caucaaacugaccgacuuu

SEQ ID NO: 442367 - RNA, 19 nt, Homo sapiens
ggaggacgugagccaguuu

SEQ ID NO: 442368 - RNA, 19 nt, Homo sapiens
gcuucuaccuggcugagau

SEQ ID NO: 442369 - RNA, 19 nt, Homo sapiens
acaucaaacugaccgacuu

SEQ ID NO: 442370 - RNA, 19 nt, Homo sapiens
caacuugggcaaaauauau

SEQ ID NO: 442371 - RNA, 19 nt, Homo sapiens
cccaggcgccucaacagua

SEQ ID NO: 442372 - RNA, 19 nt, Homo sapiens
caaacucuaccucauccuu

SEQ ID NO: 442373 - RNA, 19 nt, Homo sapiens
gagguggagcugacugaga

SEQ ID NO: 442374 - RNA, 19 nt, Homo sapiens
caaggacacagcacacaca

SEQ ID NO: 442375 - RNA, 19 nt, Homo sapiens
gaagauuaaagggcugaau

SEQ ID NO: 442376 - RNA, 19 nt, Homo sapiens
cagccagggccacaucaaa

SEQ ID NO: 442377 - RNA, 19 nt, Homo sapiens
agaaaaccauggauaagau

SEQ ID NO: 442378 - RNA, 19 nt, Homo sapiens
ugacugagaccagcgugaa

SEQ ID NO: 442379 - RNA, 19 nt, Homo sapiens
gugaagcaccccuuuauug

SEQ ID NO: 442380 - RNA, 19 nt, Homo sapiens
cguguuugauuuggauuug

SEQ ID NO: 442381 - RNA, 19 nt, Homo sapiens
ggccguguuugauuuggau

SEQ ID NO: 442382 - RNA, 19 nt, Homo sapiens
ggacgugagccaguuugau

SEQ ID NO: 442383 - RNA, 19 nt, Homo sapiens
ccgcagagaaccggaagaa

SEQ ID NO: 442384 - RNA, 19 nt, Homo sapiens
ccucagggaccaagaaguc

SEQ ID NO: 442385 - RNA, 19 nt, Homo sapiens
gaagaaaaccauggauaag

SEQ ID NO: 442386 - RNA, 19 nt, Homo sapiens
gcggcaccauugaguacau

SEQ ID NO: 442387 - RNA, 19 nt, Homo sapiens
guggcaaacucuaccucau

SEQ ID NO: 442388 - RNA, 19 nt, Homo sapiens
uaaggaaggccaaaauugu

SEQ ID NO: 442389 - RNA, 19 nt, Homo sapiens
uggaagauacggccugcuu

SEQ ID NO: 442390 - RNA, 19 nt, Homo sapiens
aacucuaccucauccuuga

SEQ ID NO: 442391 - RNA, 19 nt, Homo sapiens
ggaaagcuaucauaaucuu

SEQ ID NO: 442392 - RNA, 19 nt, Homo sapiens
ggaagcaugucgucuuuau

SEQ ID NO: 442393 - RNA, 19 nt, Homo sapiens
gcaaggauguuaauuuuga

SEQ ID NO: 442394 - RNA, 19 nt, Homo sapiens
gauggcagccggcucauaa

SEQ ID NO: 442395 - RNA, 19 nt, Homo sapiens
ucauaaagguucauuugga

SEQ ID NO: 442396 - RNA, 19 nt, Homo sapiens
gagaauccgcgucaaacua

SEQ ID NO: 442397 - RNA, 19 nt, Homo sapiens
gggcaaggauguuaauuuu

SEQ ID NO: 442398 - RNA, 19 nt, Homo sapiens
gcucauaaagguucauuug

SEQ ID NO: 442399 - RNA, 19 nt, Homo sapiens
gaaauugugggcaagagaa

SEQ ID NO: 442400 - RNA, 19 nt, Homo sapiens
ucggaaagcuaucauaauc

SEQ ID NO: 442401 - RNA, 19 nt, Homo sapiens
ucccagaguuucaauugua

SEQ ID NO: 442402 - RNA, 19 nt, Homo sapiens
gcgagaagccggacgaguu

SEQ ID NO: 442403 - RNA, 19 nt, Homo sapiens
gagaaagccauguucaguu

SEQ ID NO: 442404 - RNA, 19 nt, Homo sapiens
aacacaagguugaaacuuu

SEQ ID NO: 442405 - RNA, 19 nt, Homo sapiens
agaaagccauguucaguuc

SEQ ID NO: 442406 - RNA, 19 nt, Homo sapiens
caagagaauccgcgucaaa

SEQ ID NO: 442407 - RNA, 19 nt, Homo sapiens
ggucggaaagcuaucauaa

SEQ ID NO: 442408 - RNA, 19 nt, Homo sapiens
gaacacaagguugaaacuu

SEQ ID NO: 442409 - RNA, 19 nt, Homo sapiens
ggagaaagccauguucagu

SEQ ID NO: 442410 - RNA, 19 nt, Homo sapiens
gcagccggcucauaaaggu

SEQ ID NO: 442411 - RNA, 19 nt, Homo sapiens
agaggagaauucugccuaa

SEQ ID NO: 442412 - RNA, 19 nt, Homo sapiens
ugggaagcaugucgucuuu

SEQ ID NO: 442413 - RNA, 19 nt, Homo sapiens
uuccucaacugaaaucuuu

SEQ ID NO: 442414 - RNA, 19 nt, Homo sapiens
uaaggaaauugaaguuggu

SEQ ID NO: 442415 - RNA, 19 nt, Homo sapiens
agauuugggucucuuccua

SEQ ID NO: 442416 - RNA, 19 nt, Homo sapiens
gcaagagaauccgcgucaa

SEQ ID NO: 442417 - RNA, 19 nt, Homo sapiens
cccagaguuucaauuguaa

SEQ ID NO: 442418 - RNA, 19 nt, Homo sapiens
ggucuucccaagcgaaauu

SEQ ID NO: 442419 - RNA, 19 nt, Homo sapiens
cccaggagccguacucuga

SEQ ID NO: 442420 - RNA, 19 nt, Homo sapiens
acacaagguugaaacuuuu

SEQ ID NO: 442421 - RNA, 19 nt, Homo sapiens
gauuugggucucuuccuaa

SEQ ID NO: 442422 - RNA, 19 nt, Homo sapiens
gaauccgcgucaaacuaga

SEQ ID NO: 442423 - RNA, 19 nt, Homo sapiens
gaagcccaauggcgagaag

SEQ ID NO: 442424 - RNA, 19 nt, Homo sapiens
gcuaucauaaucuuuguuc

SEQ ID NO: 442425 - RNA, 19 nt, Homo sapiens
cgggcaaggauguuaauuu

SEQ ID NO: 442426 - RNA, 19 nt, Homo sapiens
gcagaacaauguggaacac

SEQ ID NO: 442427 - RNA, 19 nt, Homo sapiens
gcuaaggaaauugaaguug

SEQ ID NO: 442428 - RNA, 19 nt, Homo sapiens
uacggcagcuaaggaaauu

SEQ ID NO: 442429 - RNA, 19 nt, Homo sapiens
ugaauauuacggcagcuaa

SEQ ID NO: 442430 - RNA, 19 nt, Homo sapiens
gaugaacucggaccucaag

SEQ ID NO: 442431 - RNA, 19 nt, Homo sapiens
cgagaagccggacgaguuc

SEQ ID NO: 442432 - RNA, 19 nt, Homo sapiens
uaaagguucauuuggacaa

SEQ ID NO: 442433 - RNA, 19 nt, Homo sapiens
gaggagaauucugccuaag

SEQ ID NO: 442434 - RNA, 19 nt, Homo sapiens
gaagcucacgggcaaggau

SEQ ID NO: 442435 - RNA, 19 nt, Homo sapiens
ucacgggcaaggauguuaa

SEQ ID NO: 442436 - RNA, 19 nt, Homo sapiens
gggaagcaugucgucuuua

SEQ ID NO: 442437 - RNA, 19 nt, Homo sapiens
ucccguuccucaacugaaa

SEQ ID NO: 442438 - RNA, 19 nt, Homo sapiens
gaauauuacggcagcuaag

SEQ ID NO: 442439 - RNA, 19 nt, Homo sapiens
cgaaauugugggcaagaga

SEQ ID NO: 442440 - RNA, 19 nt, Homo sapiens
gaagcaugucgucuuuauc

SEQ ID NO: 442441 - RNA, 19 nt, Homo sapiens
cggcagcuaaggaaauuga

SEQ ID NO: 442442 - RNA, 19 nt, Homo sapiens
ggaacacaagguugaaacu

SEQ ID NO: 442443 - RNA, 19 nt, Homo sapiens
ucugacagcugugcacgau

SEQ ID NO: 442444 - RNA, 19 nt, Homo sapiens
ggugguggucggaaagcua

SEQ ID NO: 442445 - RNA, 19 nt, Homo sapiens
aaagccauguucaguucga

SEQ ID NO: 442446 - RNA, 19 nt, Homo sapiens
agaauccgcgucaaacuag

SEQ ID NO: 442447 - RNA, 19 nt, Homo sapiens
ugccuaagccaacucgaaa

SEQ ID NO: 442448 - RNA, 19 nt, Homo sapiens
cagcuaaggaaauugaagu

SEQ ID NO: 442449 - RNA, 19 nt, Homo sapiens
uucuggagcuggagaugaa

SEQ ID NO: 442450 - RNA, 19 nt, Homo sapiens
gcgaaauugugggcaagag

SEQ ID NO: 442451 - RNA, 19 nt, Homo sapiens
caggagccguacucugaca

SEQ ID NO: 442452 - RNA, 19 nt, Homo sapiens
caggagaaagccauguuca

SEQ ID NO: 442453 - RNA, 19 nt, Homo sapiens
gaagaaauaugaugaaagg

SEQ ID NO: 442454 - RNA, 19 nt, Homo sapiens
ccaagacccuggugaagaa

SEQ ID NO: 442455 - RNA, 19 nt, Homo sapiens
acaagaagcggaaguauga

SEQ ID NO: 442456 - RNA, 19 nt, Homo sapiens
agaaagcccuaccacaaga

SEQ ID NO: 442457 - RNA, 19 nt, Homo sapiens
gagaaagcccuaccacaag

SEQ ID NO: 442458 - RNA, 19 nt, Homo sapiens
agagaaagcccuaccacaa

SEQ ID NO: 442459 - RNA, 19 nt, Homo sapiens
gaagcggaaguaugaguug

SEQ ID NO: 442460 - RNA, 19 nt, Homo sapiens
gaaagcccuaccacaagaa

SEQ ID NO: 442461 - RNA, 19 nt, Homo sapiens
ccgcaaaggcaaauaaauc

SEQ ID NO: 442462 - RNA, 19 nt, Homo sapiens
ccgagcagauggcuaugug

SEQ ID NO: 442463 - RNA, 19 nt, Homo sapiens
ggcaaauaaauccuuguuu

SEQ ID NO: 442464 - RNA, 19 nt, Homo sapiens
agacccuggugaagaauug

SEQ ID NO: 442465 - RNA, 19 nt, Homo sapiens
gggcaucucucgggacaac

SEQ ID NO: 442466 - RNA, 19 nt, Homo sapiens
ugucuacaaugcaucuaau

SEQ ID NO: 442467 - RNA, 19 nt, Homo sapiens
gcaagaagggagccaagcu

SEQ ID NO: 442468 - RNA, 19 nt, Homo sapiens
gcggggagguaacaagaaa

SEQ ID NO: 442469 - RNA, 19 nt, Homo sapiens
cacaagaagcggaaguaug

SEQ ID NO: 442470 - RNA, 19 nt, Homo sapiens
uacaaugcaucuaauaacg

SEQ ID NO: 442471 - RNA, 19 nt, Homo sapiens
ccacaagaagcggaaguau

SEQ ID NO: 442472 - RNA, 19 nt, Homo sapiens
gcaagagaaagcccuacca

SEQ ID NO: 442473 - RNA, 19 nt, Homo sapiens
cuacaaugcaucuaauaac

SEQ ID NO: 442474 - RNA, 19 nt, Homo sapiens
gcccgcaaaggcaaauaaa

SEQ ID NO: 442475 - RNA, 19 nt, Homo sapiens
agaauugcaucgugcucau

SEQ ID NO: 442476 - RNA, 19 nt, Homo sapiens
gcugccaacaccaagauug

SEQ ID NO: 442477 - RNA, 19 nt, Homo sapiens
ggaagaagagauuuuaaac

SEQ ID NO: 442478 - RNA, 19 nt, Homo sapiens
ggggagguaacaagaaaua

SEQ ID NO: 442479 - RNA, 19 nt, Homo sapiens
gaacaucccguccuucauu

SEQ ID NO: 442480 - RNA, 19 nt, Homo sapiens
gcaagaugaagcuggauua

SEQ ID NO: 442481 - RNA, 19 nt, Homo sapiens
gcaagcagguggugaacau

SEQ ID NO: 442482 - RNA, 19 nt, Homo sapiens
gauagaggauuucuuagag

SEQ ID NO: 442483 - RNA, 19 nt, Homo sapiens
gcggagacccuucgagaaa

SEQ ID NO: 442484 - RNA, 19 nt, Homo sapiens
gggaacugcugacgcuuga

SEQ ID NO: 442485 - RNA, 19 nt, Homo sapiens
uaaacaggaucagcgcuuu

SEQ ID NO: 442486 - RNA, 19 nt, Homo sapiens
gaaaucucgucucgaccaa

SEQ ID NO: 442487 - RNA, 19 nt, Homo sapiens
gccugaagauagaggauuu

SEQ ID NO: 442488 - RNA, 19 nt, Homo sapiens
agaugaagcuggauuacau

SEQ ID NO: 442489 - RNA, 19 nt, Homo sapiens
ggagacccuucgagaaauc

SEQ ID NO: 442490 - RNA, 19 nt, Homo sapiens
gaacugcugacgcuugaug

SEQ ID NO: 442491 - RNA, 19 nt, Homo sapiens
ggucuggagggucaaauuu

SEQ ID NO: 442492 - RNA, 19 nt, Homo sapiens
aaacaggaucagcgcuuua

SEQ ID NO: 442493 - RNA, 19 nt, Homo sapiens
gcugcuggauugucucguu

SEQ ID NO: 442494 - RNA, 19 nt, Homo sapiens
cuccugggcugcuggauug

SEQ ID NO: 442495 - RNA, 19 nt, Homo sapiens
aaucucgucucgaccaaga

SEQ ID NO: 442496 - RNA, 19 nt, Homo sapiens
gaagcugaucggcgaguau

SEQ ID NO: 442497 - RNA, 19 nt, Homo sapiens
auagaggauuucuuagaga

SEQ ID NO: 442498 - RNA, 19 nt, Homo sapiens
agauagaggauuucuuaga

SEQ ID NO: 442499 - RNA, 19 nt, Homo sapiens
gggaagcggagccaacaug

SEQ ID NO: 442500 - RNA, 19 nt, Homo sapiens
gucuggagggucaaauuua

SEQ ID NO: 442501 - RNA, 19 nt, Homo sapiens
ugaagcugaucggcgagua

SEQ ID NO: 442502 - RNA, 19 nt, Homo sapiens
cggagacccuucgagaaau

SEQ ID NO: 442503 - RNA, 19 nt, Homo sapiens
aguaugggcuccggaacaa

SEQ ID NO: 442504 - RNA, 19 nt, Homo sapiens
gaguaugggcuccggaaca

SEQ ID NO: 442505 - RNA, 19 nt, Homo sapiens
cugcuggauugucucguuu

SEQ ID NO: 442506 - RNA, 19 nt, Homo sapiens
aauuuacccuggccaagau

SEQ ID NO: 442507 - RNA, 19 nt, Homo sapiens
aaauuuacccuggccaaga

SEQ ID NO: 442508 - RNA, 19 nt, Homo sapiens
ugcugacgcuugaugagaa

SEQ ID NO: 442509 - RNA, 19 nt, Homo sapiens
ucuggagggucaaauuuac

SEQ ID NO: 442510 - RNA, 19 nt, Homo sapiens
ggcaagaugaagcuggauu

SEQ ID NO: 442511 - RNA, 19 nt, Homo sapiens
uggaugagggcaagaugaa

SEQ ID NO: 442512 - RNA, 19 nt, Homo sapiens
gcugacgcuugaugagaag

SEQ ID NO: 442513 - RNA, 19 nt, Homo sapiens
aacaucccguccuucauug

SEQ ID NO: 442514 - RNA, 19 nt, Homo sapiens
ggagacauuucuacuggua

SEQ ID NO: 442515 - RNA, 19 nt, Homo sapiens
gcaaccgaauuccaguuua

SEQ ID NO: 442516 - RNA, 19 nt, Homo sapiens
gaauaaacuuacagccaaa

SEQ ID NO: 442517 - RNA, 19 nt, Homo sapiens
gaaccggauugccauuuau

SEQ ID NO: 442518 - RNA, 19 nt, Homo sapiens
ccaaugaggguauccagua

SEQ ID NO: 442519 - RNA, 19 nt, Homo sapiens
agaaccggauugccauuua

SEQ ID NO: 442520 - RNA, 19 nt, Homo sapiens
caaccgaauuccaguuuag

SEQ ID NO: 442521 - RNA, 19 nt, Homo sapiens
caaugaggguauccaguau

SEQ ID NO: 442522 - RNA, 19 nt, Homo sapiens
cagagauguugaugccuaa

SEQ ID NO: 442523 - RNA, 19 nt, Homo sapiens
caguuugccuggagacauu

SEQ ID NO: 442524 - RNA, 19 nt, Homo sapiens
gaggcuacgugaaggaaca

SEQ ID NO: 442525 - RNA, 19 nt, Homo sapiens
gaagaaccggauugccauu

SEQ ID NO: 442526 - RNA, 19 nt, Homo sapiens
cauuucuacugguaccuua

SEQ ID NO: 442527 - RNA, 19 nt, Homo sapiens
ggauugccauuuaugaacu

SEQ ID NO: 442528 - RNA, 19 nt, Homo sapiens
ggucagccaccucaguaaa

SEQ ID NO: 442529 - RNA, 19 nt, Homo sapiens
ggagcuggcagacaagaau

SEQ ID NO: 442530 - RNA, 19 nt, Homo sapiens
agauguugaugccuaagaa

SEQ ID NO: 442531 - RNA, 19 nt, Homo sapiens
cuacgugaaggaacaguuu

SEQ ID NO: 442532 - RNA, 19 nt, Homo sapiens
ugaaggccaugcagucucu

SEQ ID NO: 442533 - RNA, 19 nt, Homo sapiens
gagucaugguggccaagaa

SEQ ID NO: 442534 - RNA, 19 nt, Homo sapiens
gagauguugaugccuaaga

SEQ ID NO: 442535 - RNA, 19 nt, Homo sapiens
gccaugcagucucucaagu

SEQ ID NO: 442536 - RNA, 19 nt, Homo sapiens
acccggagcuggcagacaa

SEQ ID NO: 442537 - RNA, 19 nt, Homo sapiens
aaauuggagaggauucuuu

SEQ ID NO: 442538 - RNA, 19 nt, Homo sapiens
acaagaaugugcccaaccu

SEQ ID NO: 442539 - RNA, 19 nt, Homo sapiens
ccuaagaagaaccggauug

SEQ ID NO: 442540 - RNA, 19 nt, Homo sapiens
gaaugugcccaaccuucau

SEQ ID NO: 442541 - RNA, 19 nt, Homo sapiens
agaaugugcccaaccuuca

SEQ ID NO: 442542 - RNA, 19 nt, Homo sapiens
ccaguuuagaggcggauuu

SEQ ID NO: 442543 - RNA, 19 nt, Homo sapiens
gagcuggcagacaagaaug

SEQ ID NO: 442544 - RNA, 19 nt, Homo sapiens
ccggauugccauuuaugaa

SEQ ID NO: 442545 - RNA, 19 nt, Homo sapiens
gugcccaaccuucauguca

SEQ ID NO: 442546 - RNA, 19 nt, Homo sapiens
gcaccuacauugacaagaa

SEQ ID NO: 442547 - RNA, 19 nt, Homo sapiens
gagacuaucugcacuacau

SEQ ID NO: 442548 - RNA, 19 nt, Homo sapiens
ccaagaagcaguuccagaa

SEQ ID NO: 442549 - RNA, 19 nt, Homo sapiens
agaagcaguuccagaaguu

SEQ ID NO: 442550 - RNA, 19 nt, Homo sapiens
ugaccaagaugaagaugca

SEQ ID NO: 442551 - RNA, 19 nt, Homo sapiens
gaagauggcggacauucag

SEQ ID NO: 442552 - RNA, 19 nt, Homo sapiens
ggaagauggcggacauuca

SEQ ID NO: 442553 - RNA, 19 nt, Homo sapiens
gcagaggaccauugucauc

SEQ ID NO: 442554 - RNA, 19 nt, Homo sapiens
gagggcaccuacauugaca

SEQ ID NO: 442555 - RNA, 19 nt, Homo sapiens
gagaaacuggcaaggagaa

SEQ ID NO: 442556 - RNA, 19 nt, Homo sapiens
caccuacauugacaagaaa

SEQ ID NO: 442557 - RNA, 19 nt, Homo sapiens
cagccgaccaucuuucaaa

SEQ ID NO: 442558 - RNA, 19 nt, Homo sapiens
aagaagcaguuccagaagu

SEQ ID NO: 442559 - RNA, 19 nt, Homo sapiens
gacaagaaaugccccuuca

SEQ ID NO: 442560 - RNA, 19 nt, Homo sapiens
gaagaugcagaggaccauu

SEQ ID NO: 442561 - RNA, 19 nt, Homo sapiens
caagaagcaguuccagaag

SEQ ID NO: 442562 - RNA, 19 nt, Homo sapiens
gcaccaagaagcaguucca

SEQ ID NO: 442563 - RNA, 19 nt, Homo sapiens
agacugagcgugccuacca

SEQ ID NO: 442564 - RNA, 19 nt, Homo sapiens
gggaagauggcggacauuc

SEQ ID NO: 442565 - RNA, 19 nt, Homo sapiens
ccgggaagauggcggacau

SEQ ID NO: 442566 - RNA, 19 nt, Homo sapiens
gcuucaacgugcucaaggu

SEQ ID NO: 442567 - RNA, 19 nt, Homo sapiens
gacugagcgugccuaccaa

SEQ ID NO: 442568 - RNA, 19 nt, Homo sapiens
cacccaaggaggcuauuga

SEQ ID NO: 442569 - RNA, 19 nt, Homo sapiens
ugucauccgccgagacuau

SEQ ID NO: 442570 - RNA, 19 nt, Homo sapiens
ggacguuaauacugcuuua

SEQ ID NO: 442571 - RNA, 19 nt, Homo sapiens
caccaaaucaaccuaauua

SEQ ID NO: 442572 - RNA, 19 nt, Homo sapiens
gaacaccaaaucaaccuaa

SEQ ID NO: 442573 - RNA, 19 nt, Homo sapiens
gugaugagccuauguaugu

SEQ ID NO: 442574 - RNA, 19 nt, Homo sapiens
caaaucaaccuaauuaagg

SEQ ID NO: 442575 - RNA, 19 nt, Homo sapiens
ggaugucauugaagaguau

SEQ ID NO: 442576 - RNA, 19 nt, Homo sapiens
caacaagaaacuaggagaa

SEQ ID NO: 442577 - RNA, 19 nt, Homo sapiens
gagguguaauggacguuaa

SEQ ID NO: 442578 - RNA, 19 nt, Homo sapiens
acaagaaacuaggagaaug

SEQ ID NO: 442579 - RNA, 19 nt, Homo sapiens
gcgccaagcccaucuuugu

SEQ ID NO: 442580 - RNA, 19 nt, Homo sapiens
uaauacugcuuuacaagag

SEQ ID NO: 442581 - RNA, 19 nt, Homo sapiens
ccaaaucaaccuaauuaag

SEQ ID NO: 442582 - RNA, 19 nt, Homo sapiens
gccuauguaugucaaguug

SEQ ID NO: 442583 - RNA, 19 nt, Homo sapiens
guaauggacguuaauacug

SEQ ID NO: 442584 - RNA, 19 nt, Homo sapiens
uacaagagguucugaagac

SEQ ID NO: 442585 - RNA, 19 nt, Homo sapiens
caacugugaugagccuaug

SEQ ID NO: 442586 - RNA, 19 nt, Homo sapiens
cgaagcugccaaagccuua

SEQ ID NO: 442587 - RNA, 19 nt, Homo sapiens
ggagguguaauggacguua

SEQ ID NO: 442588 - RNA, 19 nt, Homo sapiens
caaaugcaagaaaugaaga

SEQ ID NO: 442589 - RNA, 19 nt, Homo sapiens
caagaaacuaggagaaugg

SEQ ID NO: 442590 - RNA, 19 nt, Homo sapiens
gaugacaacaagaaacuag

SEQ ID NO: 442591 - RNA, 19 nt, Homo sapiens
cguuaauacugcuuuacaa

SEQ ID NO: 442592 - RNA, 19 nt, Homo sapiens
gguguaauggacguuaaua

SEQ ID NO: 442593 - RNA, 19 nt, Homo sapiens
ugguugcaguuguguagua

SEQ ID NO: 442594 - RNA, 19 nt, Homo sapiens
ggaggcccuuugugcugaa

SEQ ID NO: 442595 - RNA, 19 nt, Homo sapiens
ucugaagacugcccucauc

SEQ ID NO: 442596 - RNA, 19 nt, Homo sapiens
gugcugaacaccaaaucaa

SEQ ID NO: 442597 - RNA, 19 nt, Homo sapiens
aggaugucauugaagagua

SEQ ID NO: 442598 - RNA, 19 nt, Homo sapiens
gagccuauguaugucaagu

SEQ ID NO: 442599 - RNA, 19 nt, Homo sapiens
ugccaaagccuuagacaag

SEQ ID NO: 442600 - RNA, 19 nt, Homo sapiens
ucaaaugcaagaaaugaag

SEQ ID NO: 442601 - RNA, 19 nt, Homo sapiens
gccaagcccaucuuugugu

SEQ ID NO: 442602 - RNA, 19 nt, Homo sapiens
cauugcugcuggaggugua

SEQ ID NO: 442603 - RNA, 19 nt, Homo sapiens
ugacaacaagaaacuagga

SEQ ID NO: 442604 - RNA, 19 nt, Homo sapiens
acaccaaaucaaccuaauu

SEQ ID NO: 442605 - RNA, 19 nt, Homo sapiens
cuauguaugucaaguuggu

SEQ ID NO: 442606 - RNA, 19 nt, Homo sapiens
gaugagccuauguauguca

SEQ ID NO: 442607 - RNA, 19 nt, Homo sapiens
uuacaagagguucugaaga

SEQ ID NO: 442608 - RNA, 19 nt, Homo sapiens
uggccuagcacguggaauu

SEQ ID NO: 442609 - RNA, 19 nt, Homo sapiens
gugguugguugcaguugug

SEQ ID NO: 442610 - RNA, 19 nt, Homo sapiens
guuaauacugcuuuacaag

SEQ ID NO: 442611 - RNA, 19 nt, Homo sapiens
ccuuugugcugaacaccaa

SEQ ID NO: 442612 - RNA, 19 nt, Homo sapiens
ugggugcguucaagauuca

SEQ ID NO: 442613 - RNA, 19 nt, Homo sapiens
gaagaucucuaccauuuaa

SEQ ID NO: 442614 - RNA, 19 nt, Homo sapiens
gcauaaauuugucugugua

SEQ ID NO: 442615 - RNA, 19 nt, Homo sapiens
cugaagaucucuaccauuu

SEQ ID NO: 442616 - RNA, 19 nt, Homo sapiens
gaugcuaaauuccgucuga

SEQ ID NO: 442617 - RNA, 19 nt, Homo sapiens
ugaaggagcagauuuacaa

SEQ ID NO: 442618 - RNA, 19 nt, Homo sapiens
gguugaaguugacaucuga

SEQ ID NO: 442619 - RNA, 19 nt, Homo sapiens
ccagucggcuuuacccuau

SEQ ID NO: 442620 - RNA, 19 nt, Homo sapiens
ccucugcccuggucgcaua

SEQ ID NO: 442621 - RNA, 19 nt, Homo sapiens
gaaggagcagauuuacaaa

SEQ ID NO: 442622 - RNA, 19 nt, Homo sapiens
gcccuggucgcauaaauuu

SEQ ID NO: 442623 - RNA, 19 nt, Homo sapiens
ucuguguacucaagcaaua

SEQ ID NO: 442624 - RNA, 19 nt, Homo sapiens
ccguuuggcucgauauuau

SEQ ID NO: 442625 - RNA, 19 nt, Homo sapiens
gcuaaauuccgucugauuc

SEQ ID NO: 442626 - RNA, 19 nt, Homo sapiens
uuuacaaacuggccaagaa

SEQ ID NO: 442627 - RNA, 19 nt, Homo sapiens
ugaagaucucuaccauuua

SEQ ID NO: 442628 - RNA, 19 nt, Homo sapiens
gggacuugcuccugaucuu

SEQ ID NO: 442629 - RNA, 19 nt, Homo sapiens
ccugagagauucacauggu

SEQ ID NO: 442630 - RNA, 19 nt, Homo sapiens
ggagcagauuuacaaacug

SEQ ID NO: 442631 - RNA, 19 nt, Homo sapiens
aaauuugucuguguacuca

SEQ ID NO: 442632 - RNA, 19 nt, Homo sapiens
gagccggauucaccguuug

SEQ ID NO: 442633 - RNA, 19 nt, Homo sapiens
uaagggacuugcuccugau

SEQ ID NO: 442634 - RNA, 19 nt, Homo sapiens
cgcauaaauuugucugugu

SEQ ID NO: 442635 - RNA, 19 nt, Homo sapiens
gacgugaaggagcagauuu

SEQ ID NO: 442636 - RNA, 19 nt, Homo sapiens
agagccggauucaccguuu

SEQ ID NO: 442637 - RNA, 19 nt, Homo sapiens
gagagauucacaugguguu

SEQ ID NO: 442638 - RNA, 19 nt, Homo sapiens
guuuggcucgauauuauaa

SEQ ID NO: 442639 - RNA, 19 nt, Homo sapiens
aggagcagauuuacaaacu

SEQ ID NO: 442640 - RNA, 19 nt, Homo sapiens
ggacuugcuccugaucuuc

SEQ ID NO: 442641 - RNA, 19 nt, Homo sapiens
caucugacgacgugaagga

SEQ ID NO: 442642 - RNA, 19 nt, Homo sapiens
acgugaaggagcagauuua

SEQ ID NO: 442643 - RNA, 19 nt, Homo sapiens
ugacaucugacgacgugaa

SEQ ID NO: 442644 - RNA, 19 nt, Homo sapiens
ggccuuacuccuucacaga

SEQ ID NO: 442645 - RNA, 19 nt, Homo sapiens
caucuugagaggaacagaa

SEQ ID NO: 442646 - RNA, 19 nt, Homo sapiens
cuucacagaucgguguaau

SEQ ID NO: 442647 - RNA, 19 nt, Homo sapiens
uaaauuugucuguguacuc

SEQ ID NO: 442648 - RNA, 19 nt, Homo sapiens
ccuggucgcauaaauuugu

SEQ ID NO: 442649 - RNA, 19 nt, Homo sapiens
ccucccaauuggaaauaug

SEQ ID NO: 442650 - RNA, 19 nt, Homo sapiens
gaaaccaucugccguguga

SEQ ID NO: 442651 - RNA, 19 nt, Homo sapiens
gagacgacgugcagaaaug

SEQ ID NO: 442652 - RNA, 19 nt, Homo sapiens
gaugaauccucaccauaug

SEQ ID NO: 442653 - RNA, 19 nt, Homo sapiens
gaacaagauuccucaaaau

SEQ ID NO: 442654 - RNA, 19 nt, Homo sapiens
ugaaggagagaauguauuu

SEQ ID NO: 442655 - RNA, 19 nt, Homo sapiens
gagaugaauccucaccaua

SEQ ID NO: 442656 - RNA, 19 nt, Homo sapiens
gcagaaauggcaccucgaa

SEQ ID NO: 442657 - RNA, 19 nt, Homo sapiens
gcaaggagcuggguaucac

SEQ ID NO: 442658 - RNA, 19 nt, Homo sapiens
gagaauguauuuggugucu

SEQ ID NO: 442659 - RNA, 19 nt, Homo sapiens
gaaauggcaccucgaaagg

SEQ ID NO: 442660 - RNA, 19 nt, Homo sapiens
ugaacaagauuccucaaaa

SEQ ID NO: 442661 - RNA, 19 nt, Homo sapiens
gguaaaggcagaccgagau

SEQ ID NO: 442662 - RNA, 19 nt, Homo sapiens
cgagaugaauccucaccau

SEQ ID NO: 442663 - RNA, 19 nt, Homo sapiens
uauguuggcugcccaggau

SEQ ID NO: 442664 - RNA, 19 nt, Homo sapiens
ggagacgacgugcagaaau

SEQ ID NO: 442665 - RNA, 19 nt, Homo sapiens
ggaggaaauaggaccaaga

SEQ ID NO: 442666 - RNA, 19 nt, Homo sapiens
agaugaauccucaccauau

SEQ ID NO: 442667 - RNA, 19 nt, Homo sapiens
gugaacaagauuccucaaa

SEQ ID NO: 442668 - RNA, 19 nt, Homo sapiens
agaaauggcaccucgaaag

SEQ ID NO: 442669 - RNA, 19 nt, Homo sapiens
aaaggcagaccgagaugaa

SEQ ID NO: 442670 - RNA, 19 nt, Homo sapiens
gaaggagagaauguauuug

SEQ ID NO: 442671 - RNA, 19 nt, Homo sapiens
gcugaaggagagaauguau

SEQ ID NO: 442672 - RNA, 19 nt, Homo sapiens
ucaccgcccuacacaucaa

SEQ ID NO: 442673 - RNA, 19 nt, Homo sapiens
guauuuggugucugccaua

SEQ ID NO: 442674 - RNA, 19 nt, Homo sapiens
uaucaccgcccuacacauc

SEQ ID NO: 442675 - RNA, 19 nt, Homo sapiens
guaaaggcagaccgagaug

SEQ ID NO: 442676 - RNA, 19 nt, Homo sapiens
cuggugggaugaagguaaa

SEQ ID NO: 442677 - RNA, 19 nt, Homo sapiens
gaggaaauaggaccaagac

SEQ ID NO: 442678 - RNA, 19 nt, Homo sapiens
uaucuuugcauccuucaau

SEQ ID NO: 442679 - RNA, 19 nt, Homo sapiens
gguaucaccgcccuacaca

SEQ ID NO: 442680 - RNA, 19 nt, Homo sapiens
cagaaauggcaccucgaaa

SEQ ID NO: 442681 - RNA, 19 nt, Homo sapiens
uaaaggcagaccgagauga

SEQ ID NO: 442682 - RNA, 19 nt, Homo sapiens
cgccgucugugaacaagau

SEQ ID NO: 442683 - RNA, 19 nt, Homo sapiens
aaggagagaauguauuugg

SEQ ID NO: 442684 - RNA, 19 nt, Homo sapiens
uuuggugucugccauaucu

SEQ ID NO: 442685 - RNA, 19 nt, Homo sapiens
ccaaagcgaucucuucuga

SEQ ID NO: 442686 - RNA, 19 nt, Homo sapiens
aguaauggcucagcuaaua

SEQ ID NO: 442687 - RNA, 19 nt, Homo sapiens
cuucaucccucucaaguaa

SEQ ID NO: 442688 - RNA, 19 nt, Homo sapiens
caaguaauggcucagcuaa

SEQ ID NO: 442689 - RNA, 19 nt, Homo sapiens
ggaccaaagcgaucucuuc

SEQ ID NO: 442690 - RNA, 19 nt, Homo sapiens
guaauggcucagcuaauaa

SEQ ID NO: 442691 - RNA, 19 nt, Homo sapiens
gaaguagagcagaagaaga

SEQ ID NO: 442692 - RNA, 19 nt, Homo sapiens
caagauggcagaaguagag

SEQ ID NO: 442693 - RNA, 19 nt, Homo sapiens
uggcagaaguagagcagaa

SEQ ID NO: 442694 - RNA, 19 nt, Homo sapiens
cuaauaaaggcgcacauga

SEQ ID NO: 442695 - RNA, 19 nt, Homo sapiens
ggagaucaagcccgagaug

SEQ ID NO: 442696 - RNA, 19 nt, Homo sapiens
aaguagagcagaagaagaa

SEQ ID NO: 442697 - RNA, 19 nt, Homo sapiens
uaauggcucagcuaauaaa

SEQ ID NO: 442698 - RNA, 19 nt, Homo sapiens
gcagaaguagagcagaaga

SEQ ID NO: 442699 - RNA, 19 nt, Homo sapiens
gaccaaagcgaucucuucu

SEQ ID NO: 442700 - RNA, 19 nt, Homo sapiens
gagaucaagcccgagauga

SEQ ID NO: 442701 - RNA, 19 nt, Homo sapiens
gcaagauggcagaaguaga

SEQ ID NO: 442702 - RNA, 19 nt, Homo sapiens
ucaucccucucaaguaaug

SEQ ID NO: 442703 - RNA, 19 nt, Homo sapiens
gccacuaccugggcgaguu

SEQ ID NO: 442704 - RNA, 19 nt, Homo sapiens
gcuaauaaaggcgcacaug

SEQ ID NO: 442705 - RNA, 19 nt, Homo sapiens
ucaaguaauggcucagcua

SEQ ID NO: 442706 - RNA, 19 nt, Homo sapiens
cuacaagcccguaaagcau

SEQ ID NO: 442707 - RNA, 19 nt, Homo sapiens
ccuacaagcccguaaagca

SEQ ID NO: 442708 - RNA, 19 nt, Homo sapiens
uaauaaaggcgcacaugac

SEQ ID NO: 442709 - RNA, 19 nt, Homo sapiens
cagaaguagagcagaagaa

SEQ ID NO: 442710 - RNA, 19 nt, Homo sapiens
cggcaagauggcagaagua

SEQ ID NO: 442711 - RNA, 19 nt, Homo sapiens
gcagcauggugggcgucua

SEQ ID NO: 442712 - RNA, 19 nt, Homo sapiens
ccggcaagauggcagaagu

SEQ ID NO: 442713 - RNA, 19 nt, Homo sapiens
cugaggauccggcaagaug

SEQ ID NO: 442714 - RNA, 19 nt, Homo sapiens
gcuucaucccucucaagua

SEQ ID NO: 442715 - RNA, 19 nt, Homo sapiens
ccacuccucccgcuucauc

SEQ ID NO: 442716 - RNA, 19 nt, Homo sapiens
ucaccuacaagcccguaaa

SEQ ID NO: 442717 - RNA, 19 nt, Homo sapiens
gaugaagcaugguuacauu

SEQ ID NO: 442718 - RNA, 19 nt, Homo sapiens
ccacagagcugggaaaauu

SEQ ID NO: 442719 - RNA, 19 nt, Homo sapiens
ucugagagcuccaauuuca

SEQ ID NO: 442720 - RNA, 19 nt, Homo sapiens
ccaguuugguuucauugua

SEQ ID NO: 442721 - RNA, 19 nt, Homo sapiens
gcgccauccugcaaucuaa

SEQ ID NO: 442722 - RNA, 19 nt, Homo sapiens
aaacgccaggugcuuauua

SEQ ID NO: 442723 - RNA, 19 nt, Homo sapiens
gcaaacgccaggugcuuau

SEQ ID NO: 442724 - RNA, 19 nt, Homo sapiens
ucaagaguaucaacaaugc

SEQ ID NO: 442725 - RNA, 19 nt, Homo sapiens
ccacaauggugcgcaugaa

SEQ ID NO: 442726 - RNA, 19 nt, Homo sapiens
caaagucaucguccgguuu

SEQ ID NO: 442727 - RNA, 19 nt, Homo sapiens
aaccucagcuggcaucaug

SEQ ID NO: 442728 - RNA, 19 nt, Homo sapiens
ggcaaacgccaggugcuua

SEQ ID NO: 442729 - RNA, 19 nt, Homo sapiens
caggcaggcuaaacaagug

SEQ ID NO: 442730 - RNA, 19 nt, Homo sapiens
caacaaugccgaaaagaga

SEQ ID NO: 442731 - RNA, 19 nt, Homo sapiens
ucucaagaguaucaacaau

SEQ ID NO: 442732 - RNA, 19 nt, Homo sapiens
uuacauuggcgaauuugaa

SEQ ID NO: 442733 - RNA, 19 nt, Homo sapiens
ucacaggcaggcuaaacaa

SEQ ID NO: 442734 - RNA, 19 nt, Homo sapiens
caauggugcgcaugaaugu

SEQ ID NO: 442735 - RNA, 19 nt, Homo sapiens
ugguuacauuggcgaauuu

SEQ ID NO: 442736 - RNA, 19 nt, Homo sapiens
uacauuggcgaauuugaaa

SEQ ID NO: 442737 - RNA, 19 nt, Homo sapiens
ugagagcuccaauuucauc

SEQ ID NO: 442738 - RNA, 19 nt, Homo sapiens
ccgccaguuugguuucauu

SEQ ID NO: 442739 - RNA, 19 nt, Homo sapiens
caguuugguuucauuguac

SEQ ID NO: 442740 - RNA, 19 nt, Homo sapiens
acaauggugcgcaugaaug

SEQ ID NO: 442741 - RNA, 19 nt, Homo sapiens
ugaugaugaagcaugguua

SEQ ID NO: 442742 - RNA, 19 nt, Homo sapiens
ccuggcagaugcucucaag

SEQ ID NO: 442743 - RNA, 19 nt, Homo sapiens
gaugaugaagcaugguuac

SEQ ID NO: 442744 - RNA, 19 nt, Homo sapiens
aaagucaucguccgguuuc

SEQ ID NO: 442745 - RNA, 19 nt, Homo sapiens
ccagaaauccuaccgauaa

SEQ ID NO: 442746 - RNA, 19 nt, Homo sapiens
gcaauggucucaucaaggu

SEQ ID NO: 442747 - RNA, 19 nt, Homo sapiens
ccaagaaggagaucaaaga

SEQ ID NO: 442748 - RNA, 19 nt, Homo sapiens
gaucaaagacauccucauc

SEQ ID NO: 442749 - RNA, 19 nt, Homo sapiens
ggagcgauuugcuggugua

SEQ ID NO: 442750 - RNA, 19 nt, Homo sapiens
agaaggagaucaaagacau

SEQ ID NO: 442751 - RNA, 19 nt, Homo sapiens
gcggugagguugucuaguc

SEQ ID NO: 442752 - RNA, 19 nt, Homo sapiens
ucaaagacauccucaucca

SEQ ID NO: 442753 - RNA, 19 nt, Homo sapiens
gguggccuauuaccagaaa

SEQ ID NO: 442754 - RNA, 19 nt, Homo sapiens
gcgauuugcugguguagac

SEQ ID NO: 442755 - RNA, 19 nt, Homo sapiens
ucacguggcccagauuuau

SEQ ID NO: 442756 - RNA, 19 nt, Homo sapiens
aagcccugguggccuauua

SEQ ID NO: 442757 - RNA, 19 nt, Homo sapiens
acucaaaacucacuuguau

SEQ ID NO: 442758 - RNA, 19 nt, Homo sapiens
aagacauccucauccagua

SEQ ID NO: 442759 - RNA, 19 nt, Homo sapiens
cagaaauccuaccgauaag

SEQ ID NO: 442760 - RNA, 19 nt, Homo sapiens
ggucacguggcccagauuu

SEQ ID NO: 442761 - RNA, 19 nt, Homo sapiens
uggcccagauuuaugcuau

SEQ ID NO: 442762 - RNA, 19 nt, Homo sapiens
cggcaauggucucaucaag

SEQ ID NO: 442763 - RNA, 19 nt, Homo sapiens
caucgugacucaaaacuca

SEQ ID NO: 442764 - RNA, 19 nt, Homo sapiens
gaaggagaucaaagacauc

SEQ ID NO: 442765 - RNA, 19 nt, Homo sapiens
gcacugcaaacgcggcaau

SEQ ID NO: 442766 - RNA, 19 nt, Homo sapiens
caagaaggagaucaaagac

SEQ ID NO: 442767 - RNA, 19 nt, Homo sapiens
auaagcccaucgugacuca

SEQ ID NO: 442768 - RNA, 19 nt, Homo sapiens
gucacguggcccagauuua

SEQ ID NO: 442769 - RNA, 19 nt, Homo sapiens
gcaacgacuuccacacgaa

SEQ ID NO: 442770 - RNA, 19 nt, Homo sapiens
ggagauuauugaaguagau

SEQ ID NO: 442771 - RNA, 19 nt, Homo sapiens
cuguagugcuguauuauuu

SEQ ID NO: 442772 - RNA, 19 nt, Homo sapiens
ugaaguagauccugacacu

SEQ ID NO: 442773 - RNA, 19 nt, Homo sapiens
ccaaggacccgccaacaug

SEQ ID NO: 442774 - RNA, 19 nt, Homo sapiens
ucaggagauuauugaagua

SEQ ID NO: 442775 - RNA, 19 nt, Homo sapiens
uuucuguagugcuguauua

SEQ ID NO: 442776 - RNA, 19 nt, Homo sapiens
aaguagauccugacacuaa

SEQ ID NO: 442777 - RNA, 19 nt, Homo sapiens
gaucaggagauuauugaag

SEQ ID NO: 442778 - RNA, 19 nt, Homo sapiens
gaaguagauccugacacua

SEQ ID NO: 442779 - RNA, 19 nt, Homo sapiens
gcaccaaaaccgugaagaa

SEQ ID NO: 442780 - RNA, 19 nt, Homo sapiens
gcaggaggaggagagagaa

SEQ ID NO: 442781 - RNA, 19 nt, Homo sapiens
aucaggagauuauugaagu

SEQ ID NO: 442782 - RNA, 19 nt, Homo sapiens
gccauuauccccagcaaaa

SEQ ID NO: 442783 - RNA, 19 nt, Homo sapiens
ggaucaggagauuauugaa

SEQ ID NO: 442784 - RNA, 19 nt, Homo sapiens
guagugcuguauuauuuuc

SEQ ID NO: 442785 - RNA, 19 nt, Homo sapiens
gaacgugugaucaccauua

SEQ ID NO: 442786 - RNA, 19 nt, Homo sapiens
ccaauggucuggacaacaa

SEQ ID NO: 442787 - RNA, 19 nt, Homo sapiens
ggccuugucuguuaauaaa

SEQ ID NO: 442788 - RNA, 19 nt, Homo sapiens
gaacagacagaaggaugua

SEQ ID NO: 442789 - RNA, 19 nt, Homo sapiens
gcagccaugucucuaguga

SEQ ID NO: 442790 - RNA, 19 nt, Homo sapiens
gaaaaguuccagcauauuu

SEQ ID NO: 442791 - RNA, 19 nt, Homo sapiens
cuguaggccuugucuguua

SEQ ID NO: 442792 - RNA, 19 nt, Homo sapiens
acaacaagcuccgugaaga

SEQ ID NO: 442793 - RNA, 19 nt, Homo sapiens
ccgaagauaugcucaugug

SEQ ID NO: 442794 - RNA, 19 nt, Homo sapiens
acagaaggauguaaaggau

SEQ ID NO: 442795 - RNA, 19 nt, Homo sapiens
gacagaaggauguaaagga

SEQ ID NO: 442796 - RNA, 19 nt, Homo sapiens
gacauugaccucaccaaga

SEQ ID NO: 442797 - RNA, 19 nt, Homo sapiens
ggacaacaagcuccgugaa

SEQ ID NO: 442798 - RNA, 19 nt, Homo sapiens
caagaagaaauaagucugu

SEQ ID NO: 442799 - RNA, 19 nt, Homo sapiens
gauaugcucaugugguguu

SEQ ID NO: 442800 - RNA, 19 nt, Homo sapiens
gaggaaagcagacauugac

SEQ ID NO: 442801 - RNA, 19 nt, Homo sapiens
ggugugggccgaagauaug

SEQ ID NO: 442802 - RNA, 19 nt, Homo sapiens
acauugaccucaccaagag

SEQ ID NO: 442803 - RNA, 19 nt, Homo sapiens
ggccgaagauaugcucaug

SEQ ID NO: 442804 - RNA, 19 nt, Homo sapiens
gaagaccuggagcgacuga

SEQ ID NO: 442805 - RNA, 19 nt, Homo sapiens
uguaggccuugucuguuaa

SEQ ID NO: 442806 - RNA, 19 nt, Homo sapiens
guggguguguccaagaaga

SEQ ID NO: 442807 - RNA, 19 nt, Homo sapiens
ugaggaaagcagacauuga

SEQ ID NO: 442808 - RNA, 19 nt, Homo sapiens
ccugaaaaguuccagcaua

SEQ ID NO: 442809 - RNA, 19 nt, Homo sapiens
acagacagaaggauguaaa

SEQ ID NO: 442810 - RNA, 19 nt, Homo sapiens
gaugagguggaacguguga

SEQ ID NO: 442811 - RNA, 19 nt, Homo sapiens
ugccaucacugccauuaag

SEQ ID NO: 442812 - RNA, 19 nt, Homo sapiens
auagagggcugcgucacuu

SEQ ID NO: 442813 - RNA, 19 nt, Homo sapiens
uggagcgacugaagaagau

SEQ ID NO: 442814 - RNA, 19 nt, Homo sapiens
gaucaccauuaugcagaau

SEQ ID NO: 442815 - RNA, 19 nt, Homo sapiens
ugaucaccauuaugcagaa

SEQ ID NO: 442816 - RNA, 19 nt, Homo sapiens
caugugguguugaggaaag

SEQ ID NO: 442817 - RNA, 19 nt, Homo sapiens
gaccuggagcgacugaaga

SEQ ID NO: 442818 - RNA, 19 nt, Homo sapiens
gacaacaagcuccgugaag

SEQ ID NO: 442819 - RNA, 19 nt, Homo sapiens
agccaugucucuagugauc

SEQ ID NO: 442820 - RNA, 19 nt, Homo sapiens
gcagaauccacgccaguac

SEQ ID NO: 442821 - RNA, 19 nt, Homo sapiens
guguguccaagaagaaaua

SEQ ID NO: 442822 - RNA, 19 nt, Homo sapiens
caacaagcuccgugaagac

SEQ ID NO: 442823 - RNA, 19 nt, Homo sapiens
cugaaaaguuccagcauau

SEQ ID NO: 442824 - RNA, 19 nt, Homo sapiens
gagcgacugaagaagauuc

SEQ ID NO: 442825 - RNA, 19 nt, Homo sapiens
uguaaaggauggaaaauac

SEQ ID NO: 442826 - RNA, 19 nt, Homo sapiens
guugaggaaagcagacauu

SEQ ID NO: 442827 - RNA, 19 nt, Homo sapiens
aaaauagccuuugccauca

SEQ ID NO: 442828 - RNA, 19 nt, Homo sapiens
ugaacagacagaaggaugu

SEQ ID NO: 442829 - RNA, 19 nt, Homo sapiens
gggugugggccgaagauau

SEQ ID NO: 442830 - RNA, 19 nt, Homo sapiens
ccguggguguguccaagaa

SEQ ID NO: 442831 - RNA, 19 nt, Homo sapiens
gccagguccuagccaaugg

SEQ ID NO: 442832 - RNA, 19 nt, Homo sapiens
aacgugugaucaccauuau

SEQ ID NO: 442833 - RNA, 19 nt, Homo sapiens
ucagagaaacggcgucaug

SEQ ID NO: 442834 - RNA, 19 nt, Homo sapiens
ugaaaaugguggaaaagga

SEQ ID NO: 442835 - RNA, 19 nt, Homo sapiens
ucuggcagccuuccucaaa

SEQ ID NO: 442836 - RNA, 19 nt, Homo sapiens
caagcuggccaagcacaaa

SEQ ID NO: 442837 - RNA, 19 nt, Homo sapiens
gcuccaugaccaagaucua

SEQ ID NO: 442838 - RNA, 19 nt, Homo sapiens
cacgaugccuggaguuacu

SEQ ID NO: 442839 - RNA, 19 nt, Homo sapiens
ccgucaagcuggccaagca

SEQ ID NO: 442840 - RNA, 19 nt, Homo sapiens
gcacgaugccuggaguuac

SEQ ID NO: 442841 - RNA, 19 nt, Homo sapiens
gaaaggaccaguucgaaug

SEQ ID NO: 442842 - RNA, 19 nt, Homo sapiens
ggugugugcugacuugaua

SEQ ID NO: 442843 - RNA, 19 nt, Homo sapiens
gcagauuacuuccaucagu

SEQ ID NO: 442844 - RNA, 19 nt, Homo sapiens
gaaaagaaucucaaaguga

SEQ ID NO: 442845 - RNA, 19 nt, Homo sapiens
cuaacaagccgcaacguaa

SEQ ID NO: 442846 - RNA, 19 nt, Homo sapiens
auaaauugaugaccaguug

SEQ ID NO: 442847 - RNA, 19 nt, Homo sapiens
uaacaagccgcaacguaaa

SEQ ID NO: 442848 - RNA, 19 nt, Homo sapiens
aaaggugugugcugacuug

SEQ ID NO: 442849 - RNA, 19 nt, Homo sapiens
ggaacaagucggucaggaa

SEQ ID NO: 442850 - RNA, 19 nt, Homo sapiens
gauaagaggcgcaaaagaa

SEQ ID NO: 442851 - RNA, 19 nt, Homo sapiens
gaaugccuaccaagacuuu

SEQ ID NO: 442852 - RNA, 19 nt, Homo sapiens
gagauuguuaagcagauua

SEQ ID NO: 442853 - RNA, 19 nt, Homo sapiens
ggaagacgcggucguaagg

SEQ ID NO: 442854 - RNA, 19 nt, Homo sapiens
cuucugagauuguuaagca

SEQ ID NO: 442855 - RNA, 19 nt, Homo sapiens
ggaagucaccauugcagau

SEQ ID NO: 442856 - RNA, 19 nt, Homo sapiens
gaagucaccauugcagaug

SEQ ID NO: 442857 - RNA, 19 nt, Homo sapiens
uuaagcagauuacuuccau

SEQ ID NO: 442858 - RNA, 19 nt, Homo sapiens
ugggaucguuuccagauga

SEQ ID NO: 442859 - RNA, 19 nt, Homo sapiens
caaagugaaaggaccaguu

SEQ ID NO: 442860 - RNA, 19 nt, Homo sapiens
cuaccaagacuuugagaau

SEQ ID NO: 442861 - RNA, 19 nt, Homo sapiens
gaucguuuccagaugagaa

SEQ ID NO: 442862 - RNA, 19 nt, Homo sapiens
accaagacuuugagaauca

SEQ ID NO: 442863 - RNA, 19 nt, Homo sapiens
gccaggaguugagguggaa

SEQ ID NO: 442864 - RNA, 19 nt, Homo sapiens
guucgaaugccuaccaaga

SEQ ID NO: 442865 - RNA, 19 nt, Homo sapiens
cguaagggcugaggauuuu

SEQ ID NO: 442866 - RNA, 19 nt, Homo sapiens
uaccaagacuuugagaauc

SEQ ID NO: 442867 - RNA, 19 nt, Homo sapiens
gaggaagacgcggucguaa

SEQ ID NO: 442868 - RNA, 19 nt, Homo sapiens
ugaggaagacgcggucgua

SEQ ID NO: 442869 - RNA, 19 nt, Homo sapiens
ugaaaggaccaguucgaau

SEQ ID NO: 442870 - RNA, 19 nt, Homo sapiens
guauugagccaggaguuga

SEQ ID NO: 442871 - RNA, 19 nt, Homo sapiens
agaaaagaaucucaaagug

SEQ ID NO: 442872 - RNA, 19 nt, Homo sapiens
aaagugaaaggaccaguuc

SEQ ID NO: 442873 - RNA, 19 nt, Homo sapiens
uugaugaccaguuguuaaa

SEQ ID NO: 442874 - RNA, 19 nt, Homo sapiens
ugagauuguuaagcagauu

SEQ ID NO: 442875 - RNA, 19 nt, Homo sapiens
gugaaaggaccaguucgaa

SEQ ID NO: 442876 - RNA, 19 nt, Homo sapiens
agccggagguggcaauuca

SEQ ID NO: 442877 - RNA, 19 nt, Homo sapiens
ucguaagggcugaggauuu

SEQ ID NO: 442878 - RNA, 19 nt, Homo sapiens
gaaaaggugugugcugacu

SEQ ID NO: 442879 - RNA, 19 nt, Homo sapiens
aaauugaugaccaguuguu

SEQ ID NO: 442880 - RNA, 19 nt, Homo sapiens
caacguaaaauccuuggaa

SEQ ID NO: 442881 - RNA, 19 nt, Homo sapiens
ucgaaugccuaccaagacu

SEQ ID NO: 442882 - RNA, 19 nt, Homo sapiens
ggucguaagggcugaggau

SEQ ID NO: 442883 - RNA, 19 nt, Homo sapiens
ugagucagaugauuccauu

SEQ ID NO: 442884 - RNA, 19 nt, Homo sapiens
caaggucacaggcagguuu

SEQ ID NO: 442885 - RNA, 19 nt, Homo sapiens
cagguuuaauggccaguuu

SEQ ID NO: 442886 - RNA, 19 nt, Homo sapiens
uggagagaaucacagaugu

SEQ ID NO: 442887 - RNA, 19 nt, Homo sapiens
ggaugggugagucagauga

SEQ ID NO: 442888 - RNA, 19 nt, Homo sapiens
gauguggaauauuugucau

SEQ ID NO: 442889 - RNA, 19 nt, Homo sapiens
ucacaggcagguuuaaugg

SEQ ID NO: 442890 - RNA, 19 nt, Homo sapiens
ccaaggaccacgcauccau

SEQ ID NO: 442891 - RNA, 19 nt, Homo sapiens
ggcaucgucucaaagaacu

SEQ ID NO: 442892 - RNA, 19 nt, Homo sapiens
uaggaugggugagucagau

SEQ ID NO: 442893 - RNA, 19 nt, Homo sapiens
uggccgagguugacaaggu

SEQ ID NO: 442894 - RNA, 19 nt, Homo sapiens
ugauuccauucuccgauug

SEQ ID NO: 442895 - RNA, 19 nt, Homo sapiens
ggucacaggcagguuuaau

SEQ ID NO: 442896 - RNA, 19 nt, Homo sapiens
augauuccauucuccgauu

SEQ ID NO: 442897 - RNA, 19 nt, Homo sapiens
guaggaugggugagucaga

SEQ ID NO: 442898 - RNA, 19 nt, Homo sapiens
gucacaggcagguuuaaug

SEQ ID NO: 442899 - RNA, 19 nt, Homo sapiens
gaccagaaguggcaugaua

SEQ ID NO: 442900 - RNA, 19 nt, Homo sapiens
ggaaagaccaagaucauaa

SEQ ID NO: 442901 - RNA, 19 nt, Homo sapiens
gaucaagaauggcaagaaa

SEQ ID NO: 442902 - RNA, 19 nt, Homo sapiens
gacgguugcuugaacuuua

SEQ ID NO: 442903 - RNA, 19 nt, Homo sapiens
gaaagaccaagaucauaaa

SEQ ID NO: 442904 - RNA, 19 nt, Homo sapiens
caaaguagccaauguuucu

SEQ ID NO: 442905 - RNA, 19 nt, Homo sapiens
gaaguggcaugauaaacag

SEQ ID NO: 442906 - RNA, 19 nt, Homo sapiens
gaaaaucacagccuuugua

SEQ ID NO: 442907 - RNA, 19 nt, Homo sapiens
gaaggaaagaccaagauca

SEQ ID NO: 442908 - RNA, 19 nt, Homo sapiens
caaauucugccauuaggaa

SEQ ID NO: 442909 - RNA, 19 nt, Homo sapiens
ucgcaaaggucaugcuguu

SEQ ID NO: 442910 - RNA, 19 nt, Homo sapiens
cagccaaauucugccauua

SEQ ID NO: 442911 - RNA, 19 nt, Homo sapiens
ggguccagcugaucaagaa

SEQ ID NO: 442912 - RNA, 19 nt, Homo sapiens
cuaggaagcuccguaguca

SEQ ID NO: 442913 - RNA, 19 nt, Homo sapiens
gaagccaaacagccaaauu

SEQ ID NO: 442914 - RNA, 19 nt, Homo sapiens
ggaggugcuucucaugcaa

SEQ ID NO: 442915 - RNA, 19 nt, Homo sapiens
ggcaugauaaacaguauaa

SEQ ID NO: 442916 - RNA, 19 nt, Homo sapiens
gccauuaggaaguguguaa

SEQ ID NO: 442917 - RNA, 19 nt, Homo sapiens
aaaggaaucgugcuggaaa

SEQ ID NO: 442918 - RNA, 19 nt, Homo sapiens
caagaaggaaagaccaaga

SEQ ID NO: 442919 - RNA, 19 nt, Homo sapiens
aguaggaguugaagccaaa

SEQ ID NO: 442920 - RNA, 19 nt, Homo sapiens
agaaguggcaugauaaaca

SEQ ID NO: 442921 - RNA, 19 nt, Homo sapiens
ggaaaaugaugaaguucug

SEQ ID NO: 442922 - RNA, 19 nt, Homo sapiens
caaugacgguugcuugaac

SEQ ID NO: 442923 - RNA, 19 nt, Homo sapiens
guaaggguccagcugauca

SEQ ID NO: 442924 - RNA, 19 nt, Homo sapiens
ccagaaguggcaugauaaa

SEQ ID NO: 442925 - RNA, 19 nt, Homo sapiens
guauaagaaagcucauuug

SEQ ID NO: 442926 - RNA, 19 nt, Homo sapiens
ugaggaaaaugaugaaguu

SEQ ID NO: 442927 - RNA, 19 nt, Homo sapiens
caaaggucaugcuguuggu

SEQ ID NO: 442928 - RNA, 19 nt, Homo sapiens
gccaaauucugccauuagg

SEQ ID NO: 442929 - RNA, 19 nt, Homo sapiens
gucaaaguagccaauguuu

SEQ ID NO: 442930 - RNA, 19 nt, Homo sapiens
gcuaggaagcuccguaguc

SEQ ID NO: 442931 - RNA, 19 nt, Homo sapiens
uauaagaaagcucauuugg

SEQ ID NO: 442932 - RNA, 19 nt, Homo sapiens
ggucaugcuguuggugaua

SEQ ID NO: 442933 - RNA, 19 nt, Homo sapiens
cagccuuuguacccaauga

SEQ ID NO: 442934 - RNA, 19 nt, Homo sapiens
acagccaaauucugccauu

SEQ ID NO: 442935 - RNA, 19 nt, Homo sapiens
ggacuucguacugcuagga

SEQ ID NO: 442936 - RNA, 19 nt, Homo sapiens
uacaaaggcaagaaggaaa

SEQ ID NO: 442937 - RNA, 19 nt, Homo sapiens
ugucaaaguagccaauguu

SEQ ID NO: 442938 - RNA, 19 nt, Homo sapiens
gaggugcuucucaugcaaa

SEQ ID NO: 442939 - RNA, 19 nt, Homo sapiens
guagccaauguuucucuuu

SEQ ID NO: 442940 - RNA, 19 nt, Homo sapiens
ucaaaguagccaauguuuc

SEQ ID NO: 442941 - RNA, 19 nt, Homo sapiens
ccaaugacgguugcuugaa

SEQ ID NO: 442942 - RNA, 19 nt, Homo sapiens
aagccaaacagccaaauuc

SEQ ID NO: 442943 - RNA, 19 nt, Homo sapiens
aggaaagaccaagaucaua

SEQ ID NO: 442944 - RNA, 19 nt, Homo sapiens
uagccaauguuucucuuuu

SEQ ID NO: 442945 - RNA, 19 nt, Homo sapiens
gucaugcuguuggugauau

SEQ ID NO: 442946 - RNA, 19 nt, Homo sapiens
caaaggcaagaaggaaaga

SEQ ID NO: 442947 - RNA, 19 nt, Homo sapiens
auacaaaggcaagaaggaa

SEQ ID NO: 442948 - RNA, 19 nt, Homo sapiens
gagaccagaaguggcauga

SEQ ID NO: 442949 - RNA, 19 nt, Homo sapiens
ggugaaaacacuguaguaa

SEQ ID NO: 442950 - RNA, 19 nt, Homo sapiens
aaggaaagaccaagaucau

SEQ ID NO: 442951 - RNA, 19 nt, Homo sapiens
uggaggugcuucucaugca

SEQ ID NO: 442952 - RNA, 19 nt, Homo sapiens
guguaaggguccagcugau

SEQ ID NO: 442953 - RNA, 19 nt, Homo sapiens
ucaugcuguuggugauauu

SEQ ID NO: 442954 - RNA, 19 nt, Homo sapiens
guggcaugauaaacaguau

SEQ ID NO: 442955 - RNA, 19 nt, Homo sapiens
gaaguucugguugcuggau

SEQ ID NO: 442956 - RNA, 19 nt, Homo sapiens
ugacgguugcuugaacuuu

SEQ ID NO: 442957 - RNA, 19 nt, Homo sapiens
ccaaauucugccauuagga

SEQ ID NO: 442958 - RNA, 19 nt, Homo sapiens
gaagauagaucgccaucau

SEQ ID NO: 442959 - RNA, 19 nt, Homo sapiens
gaguaaaggugcugcaaug

SEQ ID NO: 442960 - RNA, 19 nt, Homo sapiens
uaaaggugcugcaaugaug

SEQ ID NO: 442961 - RNA, 19 nt, Homo sapiens
gacauggccuguaugagaa

SEQ ID NO: 442962 - RNA, 19 nt, Homo sapiens
guaacuauccgcacuagaa

SEQ ID NO: 442963 - RNA, 19 nt, Homo sapiens
gaacgcaagaacagaauga

SEQ ID NO: 442964 - RNA, 19 nt, Homo sapiens
gcaagaacagaaugaagaa

SEQ ID NO: 442965 - RNA, 19 nt, Homo sapiens
gaacgacaccguaacuauc

SEQ ID NO: 442966 - RNA, 19 nt, Homo sapiens
gaaaggaacgcaagaacag

SEQ ID NO: 442967 - RNA, 19 nt, Homo sapiens
gcuuuggcaugauuuauga

SEQ ID NO: 442968 - RNA, 19 nt, Homo sapiens
cuagaaaguucaugaccaa

SEQ ID NO: 442969 - RNA, 19 nt, Homo sapiens
agacauggccuguaugaga

SEQ ID NO: 442970 - RNA, 19 nt, Homo sapiens
caagacauggccuguauga

SEQ ID NO: 442971 - RNA, 19 nt, Homo sapiens
cgacagugccuaagacaga

SEQ ID NO: 442972 - RNA, 19 nt, Homo sapiens
acaacuggcuuuggcauga

SEQ ID NO: 442973 - RNA, 19 nt, Homo sapiens
caagaaagcaacgaaagga

SEQ ID NO: 442974 - RNA, 19 nt, Homo sapiens
caauguuggugcuggcaaa

SEQ ID NO: 442975 - RNA, 19 nt, Homo sapiens
ggacugcaaaggccaaugu

SEQ ID NO: 442976 - RNA, 19 nt, Homo sapiens
ugcaagacauggccuguau

SEQ ID NO: 442977 - RNA, 19 nt, Homo sapiens
uaacuauccgcacuagaaa

SEQ ID NO: 442978 - RNA, 19 nt, Homo sapiens
guaaaggugcugcaaugau

SEQ ID NO: 442979 - RNA, 19 nt, Homo sapiens
gacagugccuaagacagaa

SEQ ID NO: 442980 - RNA, 19 nt, Homo sapiens
agaacagaaugaagaaagu

SEQ ID NO: 442981 - RNA, 19 nt, Homo sapiens
caacgaaaggaacgcaaga

SEQ ID NO: 442982 - RNA, 19 nt, Homo sapiens
agauagaucgccaucauga

SEQ ID NO: 442983 - RNA, 19 nt, Homo sapiens
cgaaaggaacgcaagaaca

SEQ ID NO: 442984 - RNA, 19 nt, Homo sapiens
ggaguaaaggugcugcaau

SEQ ID NO: 442985 - RNA, 19 nt, Homo sapiens
gaacagaaugaagaaaguc

SEQ ID NO: 442986 - RNA, 19 nt, Homo sapiens
gauuuaugauucccuggau

SEQ ID NO: 442987 - RNA, 19 nt, Homo sapiens
ugaacgacaccguaacuau

SEQ ID NO: 442988 - RNA, 19 nt, Homo sapiens
guucaugaccaaccgacua

SEQ ID NO: 442989 - RNA, 19 nt, Homo sapiens
cuccuuggcugucugaaga

SEQ ID NO: 442990 - RNA, 19 nt, Homo sapiens
uuuaugauucccuggauua

SEQ ID NO: 442991 - RNA, 19 nt, Homo sapiens
cgcaagaacagaaugaaga

SEQ ID NO: 442992 - RNA, 19 nt, Homo sapiens
uauccgcacuagaaaguuc

SEQ ID NO: 442993 - RNA, 19 nt, Homo sapiens
gauagaucgccaucaugaa

SEQ ID NO: 442994 - RNA, 19 nt, Homo sapiens
ccuggauuaugcaaagaaa

SEQ ID NO: 442995 - RNA, 19 nt, Homo sapiens
caacuggcuuuggcaugau

SEQ ID NO: 442996 - RNA, 19 nt, Homo sapiens
agacagaaauucgggaaaa

SEQ ID NO: 442997 - RNA, 19 nt, Homo sapiens
cuacuucagaggaaacaaa

SEQ ID NO: 442998 - RNA, 19 nt, Homo sapiens
caagaacagaaugaagaaa

SEQ ID NO: 442999 - RNA, 19 nt, Homo sapiens
cgcaagaacauuaauaaac

SEQ ID NO: 443000 - RNA, 19 nt, Homo sapiens
ggucauugauguccuucac

SEQ ID NO: 443001 - RNA, 19 nt, Homo sapiens
gcaagacauggccuguaug

SEQ ID NO: 443002 - RNA, 19 nt, Homo sapiens
gcaagacaacuggcuuugg

SEQ ID NO: 443003 - RNA, 19 nt, Homo sapiens
ggaacgcaagaacagaaug

SEQ ID NO: 443004 - RNA, 19 nt, Homo sapiens
ccuuggcugucugaagaua

SEQ ID NO: 443005 - RNA, 19 nt, Homo sapiens
ucaagaaagcaacgaaagg

SEQ ID NO: 443006 - RNA, 19 nt, Homo sapiens
ccucaagaaagcaacgaaa

SEQ ID NO: 443007 - RNA, 19 nt, Homo sapiens
gcacuagaaaguucaugac

SEQ ID NO: 443008 - RNA, 19 nt, Homo sapiens
aagaacagaaugaagaaag

SEQ ID NO: 443009 - RNA, 19 nt, Homo sapiens
aagaaagcaacgaaaggaa

SEQ ID NO: 443010 - RNA, 19 nt, Homo sapiens
gaagauagaucgccaucau

SEQ ID NO: 443011 - RNA, 19 nt, Homo sapiens
gacauggccuguaugagaa

SEQ ID NO: 443012 - RNA, 19 nt, Homo sapiens
guaacuauccgcacuagaa

SEQ ID NO: 443013 - RNA, 19 nt, Homo sapiens
gaacgcaagaacagaauga

SEQ ID NO: 443014 - RNA, 19 nt, Homo sapiens
gcaagaacagaaugaagaa

SEQ ID NO: 443015 - RNA, 19 nt, Homo sapiens
gaacgacaccguaacuauc

SEQ ID NO: 443016 - RNA, 19 nt, Homo sapiens
gaaaggaacgcaagaacag

SEQ ID NO: 443017 - RNA, 19 nt, Homo sapiens
gcuuuggcaugauuuauga

SEQ ID NO: 443018 - RNA, 19 nt, Homo sapiens
cuagaaaguucaugaccaa

SEQ ID NO: 443019 - RNA, 19 nt, Homo sapiens
agacauggccuguaugaga

SEQ ID NO: 443020 - RNA, 19 nt, Homo sapiens
caagacauggccuguauga

SEQ ID NO: 443021 - RNA, 19 nt, Homo sapiens
cgacagugccuaagacaga

SEQ ID NO: 443022 - RNA, 19 nt, Homo sapiens
acaacuggcuuuggcauga

SEQ ID NO: 443023 - RNA, 19 nt, Homo sapiens
caagaaagcaacgaaagga

SEQ ID NO: 443024 - RNA, 19 nt, Homo sapiens
ggacugcaaaggccaaugu

SEQ ID NO: 443025 - RNA, 19 nt, Homo sapiens
ugcaagacauggccuguau

SEQ ID NO: 443026 - RNA, 19 nt, Homo sapiens
uaacuauccgcacuagaaa

SEQ ID NO: 443027 - RNA, 19 nt, Homo sapiens
gacagugccuaagacagaa

SEQ ID NO: 443028 - RNA, 19 nt, Homo sapiens
agaacagaaugaagaaagu

SEQ ID NO: 443029 - RNA, 19 nt, Homo sapiens
caacgaaaggaacgcaaga

SEQ ID NO: 443030 - RNA, 19 nt, Homo sapiens
agauagaucgccaucauga

SEQ ID NO: 443031 - RNA, 19 nt, Homo sapiens
cgaaaggaacgcaagaaca

SEQ ID NO: 443032 - RNA, 19 nt, Homo sapiens
gaacagaaugaagaaaguc

SEQ ID NO: 443033 - RNA, 19 nt, Homo sapiens
ugaacgacaccguaacuau

SEQ ID NO: 443034 - RNA, 19 nt, Homo sapiens
gauuuaugauucccuggau

SEQ ID NO: 443035 - RNA, 19 nt, Homo sapiens
guucaugaccaaccgacua

SEQ ID NO: 443036 - RNA, 19 nt, Homo sapiens
cuccuuggcugucugaaga

SEQ ID NO: 443037 - RNA, 19 nt, Homo sapiens
uuuaugauucccuggauua

SEQ ID NO: 443038 - RNA, 19 nt, Homo sapiens
gauagaucgccaucaugaa

SEQ ID NO: 443039 - RNA, 19 nt, Homo sapiens
cgcaagaacagaaugaaga

SEQ ID NO: 443040 - RNA, 19 nt, Homo sapiens
uauccgcacuagaaaguuc

SEQ ID NO: 443041 - RNA, 19 nt, Homo sapiens
ccuggauuaugcaaagaaa

SEQ ID NO: 443042 - RNA, 19 nt, Homo sapiens
caacuggcuuuggcaugau

SEQ ID NO: 443043 - RNA, 19 nt, Homo sapiens
agacagaaauucgggaaaa

SEQ ID NO: 443044 - RNA, 19 nt, Homo sapiens
cuacuucagaggaaacaaa

SEQ ID NO: 443045 - RNA, 19 nt, Homo sapiens
caagaacagaaugaagaaa

SEQ ID NO: 443046 - RNA, 19 nt, Homo sapiens
cgcaagaacauuaauaaac

SEQ ID NO: 443047 - RNA, 19 nt, Homo sapiens
ggucauugauguccuucac

SEQ ID NO: 443048 - RNA, 19 nt, Homo sapiens
gcaagacauggccuguaug

SEQ ID NO: 443049 - RNA, 19 nt, Homo sapiens
gcaagacaacuggcuuugg

SEQ ID NO: 443050 - RNA, 19 nt, Homo sapiens
ggaacgcaagaacagaaug

SEQ ID NO: 443051 - RNA, 19 nt, Homo sapiens
ccuuggcugucugaagaua

SEQ ID NO: 443052 - RNA, 19 nt, Homo sapiens
ucaagaaagcaacgaaagg

SEQ ID NO: 443053 - RNA, 19 nt, Homo sapiens
ccucaagaaagcaacgaaa

SEQ ID NO: 443054 - RNA, 19 nt, Homo sapiens
gcacuagaaaguucaugac

SEQ ID NO: 443055 - RNA, 19 nt, Homo sapiens
aagaacagaaugaagaaag

SEQ ID NO: 443056 - RNA, 19 nt, Homo sapiens
aagaaagcaacgaaaggaa

SEQ ID NO: 443057 - RNA, 19 nt, Homo sapiens
gcacagagcucaaguaauu

SEQ ID NO: 443058 - RNA, 19 nt, Homo sapiens
gaaagucggccaagaaaga

SEQ ID NO: 443059 - RNA, 19 nt, Homo sapiens
guaaaggacuuaucaaacu

SEQ ID NO: 443060 - RNA, 19 nt, Homo sapiens
gggacaagcucaauaacuu

SEQ ID NO: 443061 - RNA, 19 nt, Homo sapiens
ugacaaagcuaccuaugau

SEQ ID NO: 443062 - RNA, 19 nt, Homo sapiens
ggacaagcucaauaacuua

SEQ ID NO: 443063 - RNA, 19 nt, Homo sapiens
guucccaacuauaaacuua

SEQ ID NO: 443064 - RNA, 19 nt, Homo sapiens
uggugaagaugcaugaaua

SEQ ID NO: 443065 - RNA, 19 nt, Homo sapiens
acaaagcuaccuaugauaa

SEQ ID NO: 443066 - RNA, 19 nt, Homo sapiens
uaaaggacuuaucaaacug

SEQ ID NO: 443067 - RNA, 19 nt, Homo sapiens
caaagcuaccuaugauaaa

SEQ ID NO: 443068 - RNA, 19 nt, Homo sapiens
acagagcucaaguaauuua

SEQ ID NO: 443069 - RNA, 19 nt, Homo sapiens
acaaagacccagugaacaa

SEQ ID NO: 443070 - RNA, 19 nt, Homo sapiens
gacaaagcuaccuaugaua

SEQ ID NO: 443071 - RNA, 19 nt, Homo sapiens
caaagacccagugaacaaa

SEQ ID NO: 443072 - RNA, 19 nt, Homo sapiens
aagcacagagcucaaguaa

SEQ ID NO: 443073 - RNA, 19 nt, Homo sapiens
cuaaggacgacaagaagaa

SEQ ID NO: 443074 - RNA, 19 nt, Homo sapiens
ugacgaggcugcggugucu

SEQ ID NO: 443075 - RNA, 19 nt, Homo sapiens
ucugagagacugaagauuc

SEQ ID NO: 443076 - RNA, 19 nt, Homo sapiens
agacaaagacccagugaac

SEQ ID NO: 443077 - RNA, 19 nt, Homo sapiens
ccuaugauaaacucuguaa

SEQ ID NO: 443078 - RNA, 19 nt, Homo sapiens
guucgggacaagcucaaua

SEQ ID NO: 443079 - RNA, 19 nt, Homo sapiens
ugauaaacucuguaaggaa

SEQ ID NO: 443080 - RNA, 19 nt, Homo sapiens
augauaaacucuguaagga

SEQ ID NO: 443081 - RNA, 19 nt, Homo sapiens
uaugauaaacucuguaagg

SEQ ID NO: 443082 - RNA, 19 nt, Homo sapiens
gcaaaguucgggacaagcu

SEQ ID NO: 443083 - RNA, 19 nt, Homo sapiens
gacaaagacccagugaaca

SEQ ID NO: 443084 - RNA, 19 nt, Homo sapiens
aaagcuaccuaugauaaac

SEQ ID NO: 443085 - RNA, 19 nt, Homo sapiens
gacaagcucaauaacuuag

SEQ ID NO: 443086 - RNA, 19 nt, Homo sapiens
ggaaagucggccaagaaag

SEQ ID NO: 443087 - RNA, 19 nt, Homo sapiens
ugaagaugcaugaauaggu

SEQ ID NO: 443088 - RNA, 19 nt, Homo sapiens
aaagcacagagcucaagua

SEQ ID NO: 443089 - RNA, 19 nt, Homo sapiens
aaagacaaagacccaguga

SEQ ID NO: 443090 - RNA, 19 nt, Homo sapiens
ggugaagaugcaugaauag

SEQ ID NO: 443091 - RNA, 19 nt, Homo sapiens
uaccuaugauaaacucugu

SEQ ID NO: 443092 - RNA, 19 nt, Homo sapiens
gcaugaauagguccaacca

SEQ ID NO: 443093 - RNA, 19 nt, Homo sapiens
ucuccgagcuucgcaaugc

SEQ ID NO: 443094 - RNA, 19 nt, Homo sapiens
uugacaaagcuaccuauga

SEQ ID NO: 443095 - RNA, 19 nt, Homo sapiens
ccuaaggacgacaagaaga

SEQ ID NO: 443096 - RNA, 19 nt, Homo sapiens
ugcggugucugcugcuauu

SEQ ID NO: 443097 - RNA, 19 nt, Homo sapiens
ggacaaggccauuaagaaa

SEQ ID NO: 443098 - RNA, 19 nt, Homo sapiens
acaaggccauuaagaaauu

SEQ ID NO: 443099 - RNA, 19 nt, Homo sapiens
ccuccaagaugacaaagaa

SEQ ID NO: 443100 - RNA, 19 nt, Homo sapiens
gcaauucacagcaaaguag

SEQ ID NO: 443101 - RNA, 19 nt, Homo sapiens
ccaaggacaaggccauuaa

SEQ ID NO: 443102 - RNA, 19 nt, Homo sapiens
ccuauucgcugcacuaacu

SEQ ID NO: 443103 - RNA, 19 nt, Homo sapiens
guccgugccuccaagauga

SEQ ID NO: 443104 - RNA, 19 nt, Homo sapiens
cuacauuacugugugaguu

SEQ ID NO: 443105 - RNA, 19 nt, Homo sapiens
gacaaggccauuaagaaau

SEQ ID NO: 443106 - RNA, 19 nt, Homo sapiens
caccaaagcccauguaagg

SEQ ID NO: 443107 - RNA, 19 nt, Homo sapiens
gcaaaguagucaggaaucg

SEQ ID NO: 443108 - RNA, 19 nt, Homo sapiens
cgucuucgaugccuaugug

SEQ ID NO: 443109 - RNA, 19 nt, Homo sapiens
uaagaaauucgucauucga

SEQ ID NO: 443110 - RNA, 19 nt, Homo sapiens
aggaaucgaucucgugaag

SEQ ID NO: 443111 - RNA, 19 nt, Homo sapiens
gcagcagucagggacauuu

SEQ ID NO: 443112 - RNA, 19 nt, Homo sapiens
cauguaaggagcugaguuc

SEQ ID NO: 443113 - RNA, 19 nt, Homo sapiens
cagcaaaguagucaggaau

SEQ ID NO: 443114 - RNA, 19 nt, Homo sapiens
acagcaaaguagucaggaa

SEQ ID NO: 443115 - RNA, 19 nt, Homo sapiens
uuaagaaauucgucauucg

SEQ ID NO: 443116 - RNA, 19 nt, Homo sapiens
ugugugaguugugcaauuc

SEQ ID NO: 443117 - RNA, 19 nt, Homo sapiens
aagcuacauuacuguguga

SEQ ID NO: 443118 - RNA, 19 nt, Homo sapiens
uucccaagcuguaugugaa

SEQ ID NO: 443119 - RNA, 19 nt, Homo sapiens
gagcgucuucgaugccuau

SEQ ID NO: 443120 - RNA, 19 nt, Homo sapiens
caaggccauuaagaaauuc

SEQ ID NO: 443121 - RNA, 19 nt, Homo sapiens
aggacaaggccauuaagaa

SEQ ID NO: 443122 - RNA, 19 nt, Homo sapiens
gguccgugccuccaagaug

SEQ ID NO: 443123 - RNA, 19 nt, Homo sapiens
aaaguagucaggaaucgau

SEQ ID NO: 443124 - RNA, 19 nt, Homo sapiens
caaaguagucaggaaucga

SEQ ID NO: 443125 - RNA, 19 nt, Homo sapiens
gaugcgugcccaaggacaa

SEQ ID NO: 443126 - RNA, 19 nt, Homo sapiens
gaaaccaucucaauaaaca

SEQ ID NO: 443127 - RNA, 19 nt, Homo sapiens
gaacaugccucucgcaaag

SEQ ID NO: 443128 - RNA, 19 nt, Homo sapiens
gggaaaccaucucaauaaa

SEQ ID NO: 443129 - RNA, 19 nt, Homo sapiens
gaaaugcccaggaugcuau

SEQ ID NO: 443130 - RNA, 19 nt, Homo sapiens
gagaagaggaaacacaaga

SEQ ID NO: 443131 - RNA, 19 nt, Homo sapiens
ugggaaaccaucucaauaa

SEQ ID NO: 443132 - RNA, 19 nt, Homo sapiens
ggaggaagcagcacuaaaa

SEQ ID NO: 443133 - RNA, 19 nt, Homo sapiens
gugggaaaccaucucaaua

SEQ ID NO: 443134 - RNA, 19 nt, Homo sapiens
cagaagaggagaagaggaa

SEQ ID NO: 443135 - RNA, 19 nt, Homo sapiens
gaagaggaaacacaagaag

SEQ ID NO: 443136 - RNA, 19 nt, Homo sapiens
gaggaaacacaagaagaaa

SEQ ID NO: 443137 - RNA, 19 nt, Homo sapiens
agaggaaacacaagaagaa

SEQ ID NO: 443138 - RNA, 19 nt, Homo sapiens
ggaaaccaucucaauaaac

SEQ ID NO: 443139 - RNA, 19 nt, Homo sapiens
caagaugagugggaaacca

SEQ ID NO: 443140 - RNA, 19 nt, Homo sapiens
gaggagaagaggaaacaca

SEQ ID NO: 443141 - RNA, 19 nt, Homo sapiens
ccaucucaauaaacacauu

SEQ ID NO: 443142 - RNA, 19 nt, Homo sapiens
ugaaaugcccaggaugcua

SEQ ID NO: 443143 - RNA, 19 nt, Homo sapiens
ccaggaugcuauaaaauca

SEQ ID NO: 443144 - RNA, 19 nt, Homo sapiens
agaagaggaaacacaagaa

SEQ ID NO: 443145 - RNA, 19 nt, Homo sapiens
ggaagcagcacuaaaagca

SEQ ID NO: 443146 - RNA, 19 nt, Homo sapiens
acaugccucucgcaaagga

SEQ ID NO: 443147 - RNA, 19 nt, Homo sapiens
gaagaggagaagaggaaac

SEQ ID NO: 443148 - RNA, 19 nt, Homo sapiens
ggagaagaggaaacacaag

SEQ ID NO: 443149 - RNA, 19 nt, Homo sapiens
agaacaugccucucgcaaa

SEQ ID NO: 443150 - RNA, 19 nt, Homo sapiens
ucaggaggaagcagcacua

SEQ ID NO: 443151 - RNA, 19 nt, Homo sapiens
cgaccuacgcacacgagaa

SEQ ID NO: 443152 - RNA, 19 nt, Homo sapiens
uaaaaucaccacggucuuu

SEQ ID NO: 443153 - RNA, 19 nt, Homo sapiens
aagaggaaacacaagaaga

SEQ ID NO: 443154 - RNA, 19 nt, Homo sapiens
gaccuacgcacacgagaac

SEQ ID NO: 443155 - RNA, 19 nt, Homo sapiens
gcaaauguugucugacuua

SEQ ID NO: 443156 - RNA, 19 nt, Homo sapiens
gaagacaaguaacuguaug

SEQ ID NO: 443157 - RNA, 19 nt, Homo sapiens
gaagauggacguacuuugu

SEQ ID NO: 443158 - RNA, 19 nt, Homo sapiens
uggcuguccugaaauauua

SEQ ID NO: 443159 - RNA, 19 nt, Homo sapiens
uaagcuggcuguccugaaa

SEQ ID NO: 443160 - RNA, 19 nt, Homo sapiens
agaauaagcacaagagaaa

SEQ ID NO: 443161 - RNA, 19 nt, Homo sapiens
caacaaaccagaagacaag

SEQ ID NO: 443162 - RNA, 19 nt, Homo sapiens
caaaccagaagacaaguaa

SEQ ID NO: 443163 - RNA, 19 nt, Homo sapiens
cagcagagacugaucuuug

SEQ ID NO: 443164 - RNA, 19 nt, Homo sapiens
ggacguacuuugucugacu

SEQ ID NO: 443165 - RNA, 19 nt, Homo sapiens
cacaagagaaagaagguua

SEQ ID NO: 443166 - RNA, 19 nt, Homo sapiens
gaagaauaagcacaagaga

SEQ ID NO: 443167 - RNA, 19 nt, Homo sapiens
ccaagaagaauaagcacaa

SEQ ID NO: 443168 - RNA, 19 nt, Homo sapiens
cagaagacaaguaacugua

SEQ ID NO: 443169 - RNA, 19 nt, Homo sapiens
gaccaucacccucgagguu

SEQ ID NO: 443170 - RNA, 19 nt, Homo sapiens
gaugagaauggcaaaauua

SEQ ID NO: 443171 - RNA, 19 nt, Homo sapiens
auuauaagguggaugagaa

SEQ ID NO: 443172 - RNA, 19 nt, Homo sapiens
ggaugagaauggcaaaauu

SEQ ID NO: 443173 - RNA, 19 nt, Homo sapiens
ccacucccaagaagaauaa

SEQ ID NO: 443174 - RNA, 19 nt, Homo sapiens
gacguacuuugucugacua

SEQ ID NO: 443175 - RNA, 19 nt, Homo sapiens
ggaagauggacguacuuug

SEQ ID NO: 443176 - RNA, 19 nt, Homo sapiens
uuacaccacucccaagaag

SEQ ID NO: 443177 - RNA, 19 nt, Homo sapiens
caagaagaauaagcacaag

SEQ ID NO: 443178 - RNA, 19 nt, Homo sapiens
aauguugucugacuuacug

SEQ ID NO: 443179 - RNA, 19 nt, Homo sapiens
ggcaaauguugucugacuu

SEQ ID NO: 443180 - RNA, 19 nt, Homo sapiens
gcuggaagauggacguacu

SEQ ID NO: 443181 - RNA, 19 nt, Homo sapiens
uguggcaaauguugucuga

SEQ ID NO: 443182 - RNA, 19 nt, Homo sapiens
ccaucacccucgagguuga

SEQ ID NO: 443183 - RNA, 19 nt, Homo sapiens
uggcaaauguugucugacu

SEQ ID NO: 443184 - RNA, 19 nt, Homo sapiens
aagaauaagcacaagagaa

SEQ ID NO: 443185 - RNA, 19 nt, Homo sapiens
acaccacucccaagaagaa

SEQ ID NO: 443186 - RNA, 19 nt, Homo sapiens
ucaacaaaccagaagacaa

SEQ ID NO: 443187 - RNA, 19 nt, Homo sapiens
cagacauuauuguggcaaa

SEQ ID NO: 443188 - RNA, 19 nt, Homo sapiens
guccugaaauauuauaagg

SEQ ID NO: 443189 - RNA, 19 nt, Homo sapiens
acaagagaaagaagguuaa

SEQ ID NO: 443190 - RNA, 19 nt, Homo sapiens
guugaacccucggauacga

SEQ ID NO: 443191 - RNA, 19 nt, Homo sapiens
gcacaagagaaagaagguu

SEQ ID NO: 443192 - RNA, 19 nt, Homo sapiens
aauaagcacaagagaaaga

SEQ ID NO: 443193 - RNA, 19 nt, Homo sapiens
ccagaagacaaguaacugu

SEQ ID NO: 443194 - RNA, 19 nt, Homo sapiens
agaagacaaguaacuguau

SEQ ID NO: 443195 - RNA, 19 nt, Homo sapiens
ucacuuugacagacauuau

SEQ ID NO: 443196 - RNA, 19 nt, Homo sapiens
caaauguugucugacuuac

SEQ ID NO: 443197 - RNA, 19 nt, Homo sapiens
acaaaccagaagacaagua

SEQ ID NO: 443198 - RNA, 19 nt, Homo sapiens
ugucugacuuacuguuuca

SEQ ID NO: 443199 - RNA, 19 nt, Homo sapiens
gacaaguaacuguaugagu

SEQ ID NO: 443200 - RNA, 19 nt, Homo sapiens
ugaacccucggauacgaua

SEQ ID NO: 443201 - RNA, 19 nt, Homo sapiens
ggguguuuauggcaaguca

SEQ ID NO: 443202 - RNA, 19 nt, Homo sapiens
gcuguccugaaauauuaua

SEQ ID NO: 443203 - RNA, 19 nt, Homo sapiens
gaauaagcacaagagaaag

SEQ ID NO: 443204 - RNA, 19 nt, Homo sapiens
guugucugacuuacuguuu

SEQ ID NO: 443205 - RNA, 19 nt, Homo sapiens
agacauuauuguggcaaau

SEQ ID NO: 443206 - RNA, 19 nt, Homo sapiens
agagaaagaagguuaagcu

SEQ ID NO: 443207 - RNA, 19 nt, Homo sapiens
agaagaauaagcacaagag

SEQ ID NO: 443208 - RNA, 19 nt, Homo sapiens
gagaauggcaaaauuaguc

SEQ ID NO: 443209 - RNA, 19 nt, Homo sapiens
agcuggcuguccugaaaua

SEQ ID NO: 443210 - RNA, 19 nt, Homo sapiens
gcuaagaaaaggaagaaga

SEQ ID NO: 443211 - RNA, 19 nt, Homo sapiens
uaacugagaugcuccuuua

SEQ ID NO: 443212 - RNA, 19 nt, Homo sapiens
gagaugcuccuuuaaauaa

SEQ ID NO: 443213 - RNA, 19 nt, Homo sapiens
gcguuuguguuucaaguua

SEQ ID NO: 443214 - RNA, 19 nt, Homo sapiens
ugagaugcuccuuuaaaua

SEQ ID NO: 443215 - RNA, 19 nt, Homo sapiens
auaaagcguuuguguuuca

SEQ ID NO: 443216 - RNA, 19 nt, Homo sapiens
gacacgagccgauccauca

SEQ ID NO: 443217 - RNA, 19 nt, Homo sapiens
cugagaugcuccuuuaaau

SEQ ID NO: 443218 - RNA, 19 nt, Homo sapiens
ccacuuggccgaugggaau

SEQ ID NO: 443219 - RNA, 19 nt, Homo sapiens
cgaugggaauggucuguca

SEQ ID NO: 443220 - RNA, 19 nt, Homo sapiens
guaacugagaugcuccuuu

SEQ ID NO: 443221 - RNA, 19 nt, Homo sapiens
uccaucauccgcaauguaa

SEQ ID NO: 443222 - RNA, 19 nt, Homo sapiens
aauaaagcguuuguguuuc

SEQ ID NO: 443223 - RNA, 19 nt, Homo sapiens
acugagaugcuccuuuaaa

SEQ ID NO: 443224 - RNA, 19 nt, Homo sapiens
gauccaucauccgcaaugu

SEQ ID NO: 443225 - RNA, 19 nt, Homo sapiens
gcaggugcgcguggaauuc

SEQ ID NO: 443226 - RNA, 19 nt, Homo sapiens
uaaagcguuuguguuucaa

SEQ ID NO: 443227 - RNA, 19 nt, Homo sapiens
cguuuguguuucaaguuaa

SEQ ID NO: 443228 - RNA, 19 nt, Homo sapiens
uaaaugcucuuccuucaga

SEQ ID NO: 443229 - RNA, 19 nt, Homo sapiens
ggacuaaaugcucuuccuu

SEQ ID NO: 443230 - RNA, 19 nt, Homo sapiens
acuaaaugcucuuccuuca

SEQ ID NO: 443231 - RNA, 19 nt, Homo sapiens
gcucuugucgugucuguuc

SEQ ID NO: 443232 - RNA, 19 nt, Homo sapiens
ccaggguucucgcucuugu

SEQ ID NO: 443233 - RNA, 19 nt, Homo sapiens
caauaugugccgccagugu

SEQ ID NO: 443234 - RNA, 19 nt, Homo sapiens
gccaguguuuccgucagua

SEQ ID NO: 443235 - RNA, 19 nt, Homo sapiens
ggccaggguucucgcucuu

SEQ ID NO: 443236 - RNA, 19 nt, Homo sapiens
gucaguacgcgaaggauau

SEQ ID NO: 443237 - RNA, 19 nt, Homo sapiens
cgucaguacgcgaaggaua

SEQ ID NO: 443238 - RNA, 19 nt, Homo sapiens
uaaaggcuauuuccugaua

SEQ ID NO: 443239 - RNA, 19 nt, Homo sapiens
uaugaucgcuccauuguag

SEQ ID NO: 443240 - RNA, 19 nt, Homo sapiens
gcaaguucauugagacauc

SEQ ID NO: 443241 - RNA, 19 nt, Homo sapiens
cagcagggcacaccuauga

SEQ ID NO: 443242 - RNA, 19 nt, Homo sapiens
cgagaaggccucagaacug

SEQ ID NO: 443243 - RNA, 19 nt, Homo sapiens
gcgcagggacagcaaagaa

SEQ ID NO: 443244 - RNA, 19 nt, Homo sapiens
gcucguaacagccgcaaga

SEQ ID NO: 443245 - RNA, 19 nt, Homo sapiens
aggcaucacucauggucua

SEQ ID NO: 443246 - RNA, 19 nt, Homo sapiens
ggacggagaagaggcauca

SEQ ID NO: 443247 - RNA, 19 nt, Homo sapiens
ggagaagaggcaucacuca

SEQ ID NO: 443248 - RNA, 19 nt, Homo sapiens
caaguucauugagacauca

SEQ ID NO: 443249 - RNA, 19 nt, Homo sapiens
gacugcaaguucauugaga

SEQ ID NO: 443250 - RNA, 19 nt, Homo sapiens
ggaugccuaugucauugug

SEQ ID NO: 443251 - RNA, 19 nt, Homo sapiens
aaaggcuauuuccugauaa

SEQ ID NO: 443252 - RNA, 19 nt, Homo sapiens
agaagaggcaucacucaug

SEQ ID NO: 443253 - RNA, 19 nt, Homo sapiens
gagaagaggcaucacucau

SEQ ID NO: 443254 - RNA, 19 nt, Homo sapiens
ggucauggacagauagaca

SEQ ID NO: 443255 - RNA, 19 nt, Homo sapiens
gucauuguguacucaguga

SEQ ID NO: 443256 - RNA, 19 nt, Homo sapiens
caccuaugaucgcuccauu

SEQ ID NO: 443257 - RNA, 19 nt, Homo sapiens
gcagggcacaccuaugauc

SEQ ID NO: 443258 - RNA, 19 nt, Homo sapiens
aaggcuauuuccugauaaa

SEQ ID NO: 443259 - RNA, 19 nt, Homo sapiens
ggucuuugacugcaaguuc

SEQ ID NO: 443260 - RNA, 19 nt, Homo sapiens
gcgagagagccuuggcaaa

SEQ ID NO: 443261 - RNA, 19 nt, Homo sapiens
ccuaugaucgcuccauugu

SEQ ID NO: 443262 - RNA, 19 nt, Homo sapiens
cagacgagagcguuuacaa

SEQ ID NO: 443263 - RNA, 19 nt, Homo sapiens
cgagagagccuuggcaaaa

SEQ ID NO: 443264 - RNA, 19 nt, Homo sapiens
ccugcgcgguggucuuuga

SEQ ID NO: 443265 - RNA, 19 nt, Homo sapiens
gugcacggcaaacagauga

SEQ ID NO: 443266 - RNA, 19 nt, Homo sapiens
gccacgaccucucgguucu

SEQ ID NO: 443267 - RNA, 19 nt, Homo sapiens
gcacggcaaacagaugaug

SEQ ID NO: 443268 - RNA, 19 nt, Homo sapiens
guccugagcgugucugugu

SEQ ID NO: 443269 - RNA, 19 nt, Homo sapiens
caucacucauggucuacga

SEQ ID NO: 443270 - RNA, 19 nt, Homo sapiens
cagcggcauugcaccacaa

SEQ ID NO: 443271 - RNA, 19 nt, Homo sapiens
augccuaugucauugugua

SEQ ID NO: 443272 - RNA, 19 nt, Homo sapiens
acucauggucuacgacauu

SEQ ID NO: 443273 - RNA, 19 nt, Homo sapiens
cggacgcgaugacccugaa

SEQ ID NO: 443274 - RNA, 19 nt, Homo sapiens
ugagacaucagcggcauug

SEQ ID NO: 443275 - RNA, 19 nt, Homo sapiens
cgaccucucgguucucuag

SEQ ID NO: 443276 - RNA, 19 nt, Homo sapiens
cgagugcguggccuccuaa

SEQ ID NO: 443277 - RNA, 19 nt, Homo sapiens
gucuuugacugcaaguuca

SEQ ID NO: 443278 - RNA, 19 nt, Homo sapiens
cucauggucuacgacauuu

SEQ ID NO: 443279 - RNA, 19 nt, Homo sapiens
acgagugcguggccuccua

SEQ ID NO: 443280 - RNA, 19 nt, Homo sapiens
ggaaauaccaggaacaaga

SEQ ID NO: 443281 - RNA, 19 nt, Homo sapiens
caucacauacccacccuua

SEQ ID NO: 443282 - RNA, 19 nt, Homo sapiens
aaaugucacugccaacgaa

SEQ ID NO: 443283 - RNA, 19 nt, Homo sapiens
ccgggucacugcuguauau

SEQ ID NO: 443284 - RNA, 19 nt, Homo sapiens
caaggcagaucuggaguca

SEQ ID NO: 443285 - RNA, 19 nt, Homo sapiens
gaaauaccaggaacaagag

SEQ ID NO: 443286 - RNA, 19 nt, Homo sapiens
ggucacugcuguauauaac

SEQ ID NO: 443287 - RNA, 19 nt, Homo sapiens
gagccucaauuuccucauc

SEQ ID NO: 443288 - RNA, 19 nt, Homo sapiens
aggcagaucuggagucaca

SEQ ID NO: 443289 - RNA, 19 nt, Homo sapiens
gaagaucugcaguguggau

SEQ ID NO: 443290 - RNA, 19 nt, Homo sapiens
gagaagcaaccaccacaag

SEQ ID NO: 443291 - RNA, 19 nt, Homo sapiens
ccacguggccuacuuugag

SEQ ID NO: 443292 - RNA, 19 nt, Homo sapiens
cugcugguguucgccauua

SEQ ID NO: 443293 - RNA, 19 nt, Homo sapiens
cacaagcucucgggacuag

SEQ ID NO: 443294 - RNA, 19 nt, Homo sapiens
gaagcaaccaccacaagcu

SEQ ID NO: 443295 - RNA, 19 nt, Homo sapiens
gcgcugaccauccaguuca

SEQ ID NO: 443296 - RNA, 19 nt, Homo sapiens
ucacugcuguauauaacuc

SEQ ID NO: 443297 - RNA, 19 nt, Homo sapiens
ucaaggaccgcgacgacuu

SEQ ID NO: 443298 - RNA, 19 nt, Homo sapiens
gggucacugcuguauauaa

SEQ ID NO: 443299 - RNA, 19 nt, Homo sapiens
ucacauacccacccuuacu

SEQ ID NO: 443300 - RNA, 19 nt, Homo sapiens
ucccaggacacaucacaua

SEQ ID NO: 443301 - RNA, 19 nt, Homo sapiens
caaggaccgcgacgacuuc

SEQ ID NO: 443302 - RNA, 19 nt, Homo sapiens
gcaagcucuucacgcagau

SEQ ID NO: 443303 - RNA, 19 nt, Homo sapiens
gcaagagcgcgcugaccau

SEQ ID NO: 443304 - RNA, 19 nt, Homo sapiens
aguccuacuucgugucuga

SEQ ID NO: 443305 - RNA, 19 nt, Homo sapiens
uaaaugucacugccaacga

SEQ ID NO: 443306 - RNA, 19 nt, Homo sapiens
guucauccaguccuacuuc

SEQ ID NO: 443307 - RNA, 19 nt, Homo sapiens
gaggugggcaagcucuuca

SEQ ID NO: 443308 - RNA, 19 nt, Homo sapiens
ccuacuucgugucugacua

SEQ ID NO: 443309 - RNA, 19 nt, Homo sapiens
ccacaagcucucgggacua

SEQ ID NO: 443310 - RNA, 19 nt, Homo sapiens
gcaaagagcugguggagaa

SEQ ID NO: 443311 - RNA, 19 nt, Homo sapiens
gaagauaccugaucaugau

SEQ ID NO: 443312 - RNA, 19 nt, Homo sapiens
gagaagaaguuaacaagug

SEQ ID NO: 443313 - RNA, 19 nt, Homo sapiens
gaagaagucugguucaaag

SEQ ID NO: 443314 - RNA, 19 nt, Homo sapiens
ugagaaggcuggcaucauu

SEQ ID NO: 443315 - RNA, 19 nt, Homo sapiens
ugaagaagcugcaggaaca

SEQ ID NO: 443316 - RNA, 19 nt, Homo sapiens
gaagucugguucaaagaaa

SEQ ID NO: 443317 - RNA, 19 nt, Homo sapiens
gaaggaaacgucauaugaa

SEQ ID NO: 443318 - RNA, 19 nt, Homo sapiens
gagagaauccguuccauug

SEQ ID NO: 443319 - RNA, 19 nt, Homo sapiens
ucgaagagauuguagagaa

SEQ ID NO: 443320 - RNA, 19 nt, Homo sapiens
gaaaggaaagaccaagaaa

SEQ ID NO: 443321 - RNA, 19 nt, Homo sapiens
ggaaacgucauaugaagaa

SEQ ID NO: 443322 - RNA, 19 nt, Homo sapiens
cguagaggauggugacaua

SEQ ID NO: 443323 - RNA, 19 nt, Homo sapiens
ggaagauaccugaucauga

SEQ ID NO: 443324 - RNA, 19 nt, Homo sapiens
aagccaggauggauauuua

SEQ ID NO: 443325 - RNA, 19 nt, Homo sapiens
agaagaaguuaacaaguga

SEQ ID NO: 443326 - RNA, 19 nt, Homo sapiens
ggaccuggccuccaaguug

SEQ ID NO: 443327 - RNA, 19 nt, Homo sapiens
ugaaggaaacgucauauga

SEQ ID NO: 443328 - RNA, 19 nt, Homo sapiens
ucagagaccugcagaagag

SEQ ID NO: 443329 - RNA, 19 nt, Homo sapiens
gaccuggccuccaaguuga

SEQ ID NO: 443330 - RNA, 19 nt, Homo sapiens
gggcaccucugucugaguu

SEQ ID NO: 443331 - RNA, 19 nt, Homo sapiens
gcaguugagugaaaugaag

SEQ ID NO: 443332 - RNA, 19 nt, Homo sapiens
gaaaccuaaugggaagaua

SEQ ID NO: 443333 - RNA, 19 nt, Homo sapiens
gcacaaggccacucagaag

SEQ ID NO: 443334 - RNA, 19 nt, Homo sapiens
gggcagaaauacagaugug

SEQ ID NO: 443335 - RNA, 19 nt, Homo sapiens
gagaauccguuccauugag

SEQ ID NO: 443336 - RNA, 19 nt, Homo sapiens
ccuagagucuucagaaaca

SEQ ID NO: 443337 - RNA, 19 nt, Homo sapiens
caaugugacuguccuccuu

SEQ ID NO: 443338 - RNA, 19 nt, Homo sapiens
caagagcgaagcccagaaa

SEQ ID NO: 443339 - RNA, 19 nt, Homo sapiens
ugucagcucuguagugaau

SEQ ID NO: 443340 - RNA, 19 nt, Homo sapiens
ucaucgagauccugucuga

SEQ ID NO: 443341 - RNA, 19 nt, Homo sapiens
gaagagccacguagaggau

SEQ ID NO: 443342 - RNA, 19 nt, Homo sapiens
gcaaggagauggcgaaaac

SEQ ID NO: 443343 - RNA, 19 nt, Homo sapiens
gcagcagacucgccucaag

SEQ ID NO: 443344 - RNA, 19 nt, Homo sapiens
gaggauucaugguuguuuc

SEQ ID NO: 443345 - RNA, 19 nt, Homo sapiens
ugucugaguuuccucuuug

SEQ ID NO: 443346 - RNA, 19 nt, Homo sapiens
gaaacagagcgaugagcuu

SEQ ID NO: 443347 - RNA, 19 nt, Homo sapiens
agaaagugaagaacaauga

SEQ ID NO: 443348 - RNA, 19 nt, Homo sapiens
ucagcaaggucagcaaaga

SEQ ID NO: 443349 - RNA, 19 nt, Homo sapiens
ccagaaagucgagaagaaa

SEQ ID NO: 443350 - RNA, 19 nt, Homo sapiens
agaaggacacggugaagaa

SEQ ID NO: 443351 - RNA, 19 nt, Homo sapiens
ggagcaugguguucaacga

SEQ ID NO: 443352 - RNA, 19 nt, Homo sapiens
aggcagcaguugagugaaa

SEQ ID NO: 443353 - RNA, 19 nt, Homo sapiens
cgaagagauuguagagaag

SEQ ID NO: 443354 - RNA, 19 nt, Homo sapiens
ggcaggagcucagcaaggu

SEQ ID NO: 443355 - RNA, 19 nt, Homo sapiens
gauauuuacgacacucaaa

SEQ ID NO: 443356 - RNA, 19 nt, Homo sapiens
aaggaaacgucauaugaag

SEQ ID NO: 443357 - RNA, 19 nt, Homo sapiens
gagauuguagagaagcuaa

SEQ ID NO: 443358 - RNA, 19 nt, Homo sapiens
gaaggcugccaucuuggaa

SEQ ID NO: 443359 - RNA, 19 nt, Homo sapiens
gggaagauaccugaucaug

SEQ ID NO: 443360 - RNA, 19 nt, Homo sapiens
aaaccaaccaaccuacaaa

SEQ ID NO: 443361 - RNA, 19 nt, Homo sapiens
aaauaaaccaaccaaccua

SEQ ID NO: 443362 - RNA, 19 nt, Homo sapiens
gcaccucugucugaguuuc

SEQ ID NO: 443363 - RNA, 19 nt, Homo sapiens
gaaagcaagccaggaugga

SEQ ID NO: 443364 - RNA, 19 nt, Homo sapiens
ccgaguggcugcaggaucu

SEQ ID NO: 443365 - RNA, 19 nt, Homo sapiens
ugucgggucuggagaagga

SEQ ID NO: 443366 - RNA, 19 nt, Homo sapiens
caaauaaaccaaccaaccu

SEQ ID NO: 443367 - RNA, 19 nt, Homo sapiens
gagaaggacacggugaaga

SEQ ID NO: 443368 - RNA, 19 nt, Homo sapiens
ggaggauucaugguuguuu

SEQ ID NO: 443369 - RNA, 19 nt, Homo sapiens
aggagcagcuggagaaugg

SEQ ID NO: 443370 - RNA, 19 nt, Homo sapiens
aagaagaagucugguucaa

SEQ ID NO: 443371 - RNA, 19 nt, Homo sapiens
agaaaggaaagaccaagaa

SEQ ID NO: 443372 - RNA, 19 nt, Homo sapiens
uaaaccaaccaaccuacaa

SEQ ID NO: 443373 - RNA, 19 nt, Homo sapiens
caagccaggauggauauuu

SEQ ID NO: 443374 - RNA, 19 nt, Homo sapiens
gagcgaagcccagaaacag

SEQ ID NO: 443375 - RNA, 19 nt, Homo sapiens
aagcaagccaggauggaua

SEQ ID NO: 443376 - RNA, 19 nt, Homo sapiens
ccaaggaggaaucggagaa

SEQ ID NO: 443377 - RNA, 19 nt, Homo sapiens
accagaaagucgagaagaa

SEQ ID NO: 443378 - RNA, 19 nt, Homo sapiens
ccuuacacauuccuuacaa

SEQ ID NO: 443379 - RNA, 19 nt, Homo sapiens
ugaaaugaagagccacgua

SEQ ID NO: 443380 - RNA, 19 nt, Homo sapiens
gugaggaggcccugcagaa

SEQ ID NO: 443381 - RNA, 19 nt, Homo sapiens
uucgaaggcugccaucuug

SEQ ID NO: 443382 - RNA, 19 nt, Homo sapiens
ccauccagguucucacuuc

SEQ ID NO: 443383 - RNA, 19 nt, Homo sapiens
agaaaacaguggagaagaa

SEQ ID NO: 443384 - RNA, 19 nt, Homo sapiens
gcuccugcccucucgcuuu

SEQ ID NO: 443385 - RNA, 19 nt, Homo sapiens
agaagaagucugguucaaa

SEQ ID NO: 443386 - RNA, 19 nt, Homo sapiens
ugaauuccauccagguucu

SEQ ID NO: 443387 - RNA, 19 nt, Homo sapiens
aaacucaccaccagaaagu

SEQ ID NO: 443388 - RNA, 19 nt, Homo sapiens
gggagaaggacacggugaa

SEQ ID NO: 443389 - RNA, 19 nt, Homo sapiens
gcugaaggagagacuagaa

SEQ ID NO: 443390 - RNA, 19 nt, Homo sapiens
gcagaaagugaagaacaau

SEQ ID NO: 443391 - RNA, 19 nt, Homo sapiens
cagcagaaagugaagaaca

SEQ ID NO: 443392 - RNA, 19 nt, Homo sapiens
gcucagcaaggucagcaaa

SEQ ID NO: 443393 - RNA, 19 nt, Homo sapiens
cgagccagguggagagcaa

SEQ ID NO: 443394 - RNA, 19 nt, Homo sapiens
caagaagaagucugguuca

SEQ ID NO: 443395 - RNA, 19 nt, Homo sapiens
ggcugcaggugaaaggaaa

SEQ ID NO: 443396 - RNA, 19 nt, Homo sapiens
cagugaagcaucucgaaga

SEQ ID NO: 443397 - RNA, 19 nt, Homo sapiens
gcucagagaccugcagaag

SEQ ID NO: 443398 - RNA, 19 nt, Homo sapiens
gcugcaggaucucaaagag

SEQ ID NO: 443399 - RNA, 19 nt, Homo sapiens
agcagaaagugaagaacaa

SEQ ID NO: 443400 - RNA, 19 nt, Homo sapiens
ucgagauccugucugagaa

SEQ ID NO: 443401 - RNA, 19 nt, Homo sapiens
cagcuggaguggacagaag

SEQ ID NO: 443402 - RNA, 19 nt, Homo sapiens
cggagggcaugcucagaga

SEQ ID NO: 443403 - RNA, 19 nt, Homo sapiens
gagaaggcuggcaucauuc

SEQ ID NO: 443404 - RNA, 19 nt, Homo sapiens
ucagcucuguagugaauuc

SEQ ID NO: 443405 - RNA, 19 nt, Homo sapiens
aagaagaauuggagaagcu

SEQ ID NO: 443406 - RNA, 19 nt, Homo sapiens
gaaacgucauaugaagaag

SEQ ID NO: 443407 - RNA, 19 nt, Homo sapiens
gaaaacaguggagaagaaa

SEQ ID NO: 443408 - RNA, 19 nt, Homo sapiens
agaagucugguucaaagaa

SEQ ID NO: 443409 - RNA, 19 nt, Homo sapiens
aagaggcuccugccaagaa

SEQ ID NO: 443410 - RNA, 19 nt, Homo sapiens
gaagaaagcugaugaaguc

SEQ ID NO: 443411 - RNA, 19 nt, Homo sapiens
gcaaggauaucgagaagaa

SEQ ID NO: 443412 - RNA, 19 nt, Homo sapiens
uaucauggguguuguauuu

SEQ ID NO: 443413 - RNA, 19 nt, Homo sapiens
gagcgaaccuucaccuuga

SEQ ID NO: 443414 - RNA, 19 nt, Homo sapiens
gagcgacgaugacaagaaa

SEQ ID NO: 443415 - RNA, 19 nt, Homo sapiens
gagcaaagcgucuauacuu

SEQ ID NO: 443416 - RNA, 19 nt, Homo sapiens
gacaagaagucaacacaga

SEQ ID NO: 443417 - RNA, 19 nt, Homo sapiens
ggaaaggccauacaaaugu

SEQ ID NO: 443418 - RNA, 19 nt, Homo sapiens
gaacaacccuucaauuccu

SEQ ID NO: 443419 - RNA, 19 nt, Homo sapiens
ccaccaagcucauggacuu

SEQ ID NO: 443420 - RNA, 19 nt, Homo sapiens
gaaggaaccaggaaacgaa

SEQ ID NO: 443421 - RNA, 19 nt, Homo sapiens
cacgugaugugucuacuua

SEQ ID NO: 443422 - RNA, 19 nt, Homo sapiens
gggcagaccuuucauacag

SEQ ID NO: 443423 - RNA, 19 nt, Homo sapiens
gcacagacauaugaagauc

SEQ ID NO: 443424 - RNA, 19 nt, Homo sapiens
gaacucaaggccuucauga

SEQ ID NO: 443425 - RNA, 19 nt, Homo sapiens
gaaguuuccucgcauuucu

SEQ ID NO: 443426 - RNA, 19 nt, Homo sapiens
ggaguuuguuugcaaguau

SEQ ID NO: 443427 - RNA, 19 nt, Homo sapiens
gaacaugcacagacauaug

SEQ ID NO: 443428 - RNA, 19 nt, Homo sapiens
gagaaaagguccucagaga

SEQ ID NO: 443429 - RNA, 19 nt, Homo sapiens
gcagacauccagcaaauuc

SEQ ID NO: 443430 - RNA, 19 nt, Homo sapiens
ucaaggaguuuguuugcaa

SEQ ID NO: 443431 - RNA, 19 nt, Homo sapiens
gaaaggccauacaaauguc

SEQ ID NO: 443432 - RNA, 19 nt, Homo sapiens
gggaaaggccauacaaaug

SEQ ID NO: 443433 - RNA, 19 nt, Homo sapiens
gcaaugggcagaccuuuca

SEQ ID NO: 443434 - RNA, 19 nt, Homo sapiens
gagaaggacccaacuagug

SEQ ID NO: 443435 - RNA, 19 nt, Homo sapiens
ccagugccuuaacuacuua

SEQ ID NO: 443436 - RNA, 19 nt, Homo sapiens
gaagagcgacgaugacaag

SEQ ID NO: 443437 - RNA, 19 nt, Homo sapiens
gcagaccuuucauacagaa

SEQ ID NO: 443438 - RNA, 19 nt, Homo sapiens
gcucagugccauagccuua

SEQ ID NO: 443439 - RNA, 19 nt, Homo sapiens
gcaaagcgucuauacuuca

SEQ ID NO: 443440 - RNA, 19 nt, Homo sapiens
ucagacagcuuaggagguu

SEQ ID NO: 443441 - RNA, 19 nt, Homo sapiens
cagaacaacccuucaauuc

SEQ ID NO: 443442 - RNA, 19 nt, Homo sapiens
cuacagacaccaacaaguu

SEQ ID NO: 443443 - RNA, 19 nt, Homo sapiens
ucagauaacccacuaagau

SEQ ID NO: 443444 - RNA, 19 nt, Homo sapiens
ccggaucccuccauauuau

SEQ ID NO: 443445 - RNA, 19 nt, Homo sapiens
ccaauaaggugggcagcuu

SEQ ID NO: 443446 - RNA, 19 nt, Homo sapiens
uagggaaggucacagagaa

SEQ ID NO: 443447 - RNA, 19 nt, Homo sapiens
gaaggacagcgacaaggaa

SEQ ID NO: 443448 - RNA, 19 nt, Homo sapiens
ggaaggacagcgacaagga

SEQ ID NO: 443449 - RNA, 19 nt, Homo sapiens
gggaacaugcacagacaua

SEQ ID NO: 443450 - RNA, 19 nt, Homo sapiens
caagagaagaagacaagaa

SEQ ID NO: 443451 - RNA, 19 nt, Homo sapiens
gggccaagcggaacucgua

SEQ ID NO: 443452 - RNA, 19 nt, Homo sapiens
gcgagaggccuuacaagug

SEQ ID NO: 443453 - RNA, 19 nt, Homo sapiens
gagaagaugcuggccacua

SEQ ID NO: 443454 - RNA, 19 nt, Homo sapiens
cccaagaacuucaggaaag

SEQ ID NO: 443455 - RNA, 19 nt, Homo sapiens
caauucagcuccagacacu

SEQ ID NO: 443456 - RNA, 19 nt, Homo sapiens
guucagaccuaucuuccau

SEQ ID NO: 443457 - RNA, 19 nt, Homo sapiens
gagaagaagacaagaaguc

SEQ ID NO: 443458 - RNA, 19 nt, Homo sapiens
uaaggugggcagcuugaua

SEQ ID NO: 443459 - RNA, 19 nt, Homo sapiens
caacaucugcgacuacauc

SEQ ID NO: 443460 - RNA, 19 nt, Homo sapiens
ggagaagaaagcugaugaa

SEQ ID NO: 443461 - RNA, 19 nt, Homo sapiens
caggugacuuggagaagaa

SEQ ID NO: 443462 - RNA, 19 nt, Homo sapiens
uggcagacauccagcaaau

SEQ ID NO: 443463 - RNA, 19 nt, Homo sapiens
ucucaggccuggugcgaaa

SEQ ID NO: 443464 - RNA, 19 nt, Homo sapiens
gaagaagacaagaagucaa

SEQ ID NO: 443465 - RNA, 19 nt, Homo sapiens
caacaaguucaguccguuu

SEQ ID NO: 443466 - RNA, 19 nt, Homo sapiens
gagaagaacaucgaguaug

SEQ ID NO: 443467 - RNA, 19 nt, Homo sapiens
ucacggacuucuccuguag

SEQ ID NO: 443468 - RNA, 19 nt, Homo sapiens
ccauucagauaacccacua

SEQ ID NO: 443469 - RNA, 19 nt, Homo sapiens
ggagugagagagagagaga

SEQ ID NO: 443470 - RNA, 19 nt, Homo sapiens
caaagcgucuauacuucau

SEQ ID NO: 443471 - RNA, 19 nt, Homo sapiens
gcacaugcgcucccacaca

SEQ ID NO: 443472 - RNA, 19 nt, Homo sapiens
cagagaagagcgacgauga

SEQ ID NO: 443473 - RNA, 19 nt, Homo sapiens
ggaaaggggacaaggauuu

SEQ ID NO: 443474 - RNA, 19 nt, Homo sapiens
gcauggaggccaagaucaa

SEQ ID NO: 443475 - RNA, 19 nt, Homo sapiens
ggagacccauucagauaac

SEQ ID NO: 443476 - RNA, 19 nt, Homo sapiens
auaugaagauccaugagaa

SEQ ID NO: 443477 - RNA, 19 nt, Homo sapiens
acaagaaaccaaagacaga

SEQ ID NO: 443478 - RNA, 19 nt, Homo sapiens
ccaaugacgucaaguucgu

SEQ ID NO: 443479 - RNA, 19 nt, Homo sapiens
gcaaggcagacaagaggaa

SEQ ID NO: 443480 - RNA, 19 nt, Homo sapiens
gcaacugcauccaccacau

SEQ ID NO: 443481 - RNA, 19 nt, Homo sapiens
cagauaacccacuaagaug

SEQ ID NO: 443482 - RNA, 19 nt, Homo sapiens
ucagaccuaucuuccauca

SEQ ID NO: 443483 - RNA, 19 nt, Homo sapiens
gaaagccaggcaugccaaa

SEQ ID NO: 443484 - RNA, 19 nt, Homo sapiens
gcaagcccuucgagugcaa

SEQ ID NO: 443485 - RNA, 19 nt, Homo sapiens
caaccaaggacagcauaaa

SEQ ID NO: 443486 - RNA, 19 nt, Homo sapiens
gaagacccagcaccagcua

SEQ ID NO: 443487 - RNA, 19 nt, Homo sapiens
gugagaagauuugcacuac

SEQ ID NO: 443488 - RNA, 19 nt, Homo sapiens
agaccuaucuuccaucaac

SEQ ID NO: 443489 - RNA, 19 nt, Homo sapiens
gcagagcaaagcgucuaua

SEQ ID NO: 443490 - RNA, 19 nt, Homo sapiens
gaaaagguccucagagaag

SEQ ID NO: 443491 - RNA, 19 nt, Homo sapiens
ucaggugacuuggagaaga

SEQ ID NO: 443492 - RNA, 19 nt, Homo sapiens
ggaaccaggaaacgaaaga

SEQ ID NO: 443493 - RNA, 19 nt, Homo sapiens
cauauuaucauggguguug

SEQ ID NO: 443494 - RNA, 19 nt, Homo sapiens
agaagaugcuggccacuac

SEQ ID NO: 443495 - RNA, 19 nt, Homo sapiens
gagcauggaggccaagauc

SEQ ID NO: 443496 - RNA, 19 nt, Homo sapiens
gcaaccaaggacagcauaa

SEQ ID NO: 443497 - RNA, 19 nt, Homo sapiens
guguguggccagucauuua

SEQ ID NO: 443498 - RNA, 19 nt, Homo sapiens
gagaagagcgacgaugaca

SEQ ID NO: 443499 - RNA, 19 nt, Homo sapiens
gcgggcacgucgaagaaga

SEQ ID NO: 443500 - RNA, 19 nt, Homo sapiens
uaccggaucccuccauauu

SEQ ID NO: 443501 - RNA, 19 nt, Homo sapiens
gaugacaagaaaccaaaga

SEQ ID NO: 443502 - RNA, 19 nt, Homo sapiens
gaucaucucaucuguaucc

SEQ ID NO: 443503 - RNA, 19 nt, Homo sapiens
acagaacaacccuucaauu

SEQ ID NO: 443504 - RNA, 19 nt, Homo sapiens
gauaacccacuaagaugug

SEQ ID NO: 443505 - RNA, 19 nt, Homo sapiens
cagcugaccaugcacauuc

SEQ ID NO: 443506 - RNA, 19 nt, Homo sapiens
caacgaguacuaccaagag

SEQ ID NO: 443507 - RNA, 19 nt, Homo sapiens
ccaucgagcuggcagacau

SEQ ID NO: 443508 - RNA, 19 nt, Homo sapiens
gaugacaaccaggcaauuc

SEQ ID NO: 443509 - RNA, 19 nt, Homo sapiens
gaccuuucauacagaacaa

SEQ ID NO: 443510 - RNA, 19 nt, Homo sapiens
gcaaaggaauucuucagua

SEQ ID NO: 443511 - RNA, 19 nt, Homo sapiens
gcacagaaauaguggagua

SEQ ID NO: 443512 - RNA, 19 nt, Homo sapiens
caaagaaaguguucaguga

SEQ ID NO: 443513 - RNA, 19 nt, Homo sapiens
gaacacacauacgacuuua

SEQ ID NO: 443514 - RNA, 19 nt, Homo sapiens
uaugagggcucuccaguua

SEQ ID NO: 443515 - RNA, 19 nt, Homo sapiens
agacugggauguauuauuu

SEQ ID NO: 443516 - RNA, 19 nt, Homo sapiens
gauaugguccuauagguua

SEQ ID NO: 443517 - RNA, 19 nt, Homo sapiens
ugagagaggugcuuucauu

SEQ ID NO: 443518 - RNA, 19 nt, Homo sapiens
caaaggaauucuucaguau

SEQ ID NO: 443519 - RNA, 19 nt, Homo sapiens
uggaagaccucuauaacua

SEQ ID NO: 443520 - RNA, 19 nt, Homo sapiens
gcacaaagaaacaaagaaa

SEQ ID NO: 443521 - RNA, 19 nt, Homo sapiens
caauaaagaucgccugaau

SEQ ID NO: 443522 - RNA, 19 nt, Homo sapiens
gcugaaagaccacaacaua

SEQ ID NO: 443523 - RNA, 19 nt, Homo sapiens
gaaguuggcugaagucacu

SEQ ID NO: 443524 - RNA, 19 nt, Homo sapiens
gcagaucuuugaaacuauu

SEQ ID NO: 443525 - RNA, 19 nt, Homo sapiens
aagcagaucuuugaaacua

SEQ ID NO: 443526 - RNA, 19 nt, Homo sapiens
ugaauaagcagaucuuuga

SEQ ID NO: 443527 - RNA, 19 nt, Homo sapiens
uaugaaagaugacagcauu

SEQ ID NO: 443528 - RNA, 19 nt, Homo sapiens
gaagaacacaggaaaggaa

SEQ ID NO: 443529 - RNA, 19 nt, Homo sapiens
gcugcaaccuugacuacua

SEQ ID NO: 443530 - RNA, 19 nt, Homo sapiens
gagcagggcccauacgaaa

SEQ ID NO: 443531 - RNA, 19 nt, Homo sapiens
ggacuggucuuugaugugu

SEQ ID NO: 443532 - RNA, 19 nt, Homo sapiens
ugaaacgaguggagacuaa

SEQ ID NO: 443533 - RNA, 19 nt, Homo sapiens
ccaauccaguucacucuaa

SEQ ID NO: 443534 - RNA, 19 nt, Homo sapiens
aaucaggacuggucuuuga

SEQ ID NO: 443535 - RNA, 19 nt, Homo sapiens
gagaguauauaacaacaca

SEQ ID NO: 443536 - RNA, 19 nt, Homo sapiens
gaauccagaagcuuuguua

SEQ ID NO: 443537 - RNA, 19 nt, Homo sapiens
gagaggugcuuucauugau

SEQ ID NO: 443538 - RNA, 19 nt, Homo sapiens
uaccagaaauuccugauga

SEQ ID NO: 443539 - RNA, 19 nt, Homo sapiens
gaagaccucuauaacuaca

SEQ ID NO: 443540 - RNA, 19 nt, Homo sapiens
uguaaauccucacuuauug

SEQ ID NO: 443541 - RNA, 19 nt, Homo sapiens
uaacaacacagcuagauau

SEQ ID NO: 443542 - RNA, 19 nt, Homo sapiens
gagcauagauagguauagu

SEQ ID NO: 443543 - RNA, 19 nt, Homo sapiens
ggaauucuucaguaugaua

SEQ ID NO: 443544 - RNA, 19 nt, Homo sapiens
cguauaugcucuacaaaga

SEQ ID NO: 443545 - RNA, 19 nt, Homo sapiens
gaaagaccacaacauaugu

SEQ ID NO: 443546 - RNA, 19 nt, Homo sapiens
ugaagacugggauguauua

SEQ ID NO: 443547 - RNA, 19 nt, Homo sapiens
ucacuaguaugcacuucua

SEQ ID NO: 443548 - RNA, 19 nt, Homo sapiens
uaaagaagaacacaggaaa

SEQ ID NO: 443549 - RNA, 19 nt, Homo sapiens
gagaggugguuuacucaug

SEQ ID NO: 443550 - RNA, 19 nt, Homo sapiens
caguggaacuagauacuuu

SEQ ID NO: 443551 - RNA, 19 nt, Homo sapiens
gagaaucaaaguagaaguu

SEQ ID NO: 443552 - RNA, 19 nt, Homo sapiens
ugaagucacuaaagucguu

SEQ ID NO: 443553 - RNA, 19 nt, Homo sapiens
uaagucugcuggaggaauu

SEQ ID NO: 443554 - RNA, 19 nt, Homo sapiens
gcauugaaggcauuuauga

SEQ ID NO: 443555 - RNA, 19 nt, Homo sapiens
aaggaauucuucaguauga

SEQ ID NO: 443556 - RNA, 19 nt, Homo sapiens
aagaugagguugcuguuug

SEQ ID NO: 443557 - RNA, 19 nt, Homo sapiens
gagaggaauuugagaaacu

SEQ ID NO: 443558 - RNA, 19 nt, Homo sapiens
ugaaagaccacaacauaug

SEQ ID NO: 443559 - RNA, 19 nt, Homo sapiens
gaagaucaauggaaaagug

SEQ ID NO: 443560 - RNA, 19 nt, Homo sapiens
ucagugaugugauggaaga

SEQ ID NO: 443561 - RNA, 19 nt, Homo sapiens
ccaguucacucuaaauaag

SEQ ID NO: 443562 - RNA, 19 nt, Homo sapiens
caagauggcagcugagaga

SEQ ID NO: 443563 - RNA, 19 nt, Homo sapiens
gaccugaagcaacuuuaua

SEQ ID NO: 443564 - RNA, 19 nt, Homo sapiens
ucaggagaauuucagauug

SEQ ID NO: 443565 - RNA, 19 nt, Homo sapiens
ccaagaacgagucauguuu

SEQ ID NO: 443566 - RNA, 19 nt, Homo sapiens
ugcaauggcucuauucaga

SEQ ID NO: 443567 - RNA, 19 nt, Homo sapiens
gaaagaugacagcauugaa

SEQ ID NO: 443568 - RNA, 19 nt, Homo sapiens
cuagagcggucuuauuugu

SEQ ID NO: 443569 - RNA, 19 nt, Homo sapiens
guuauggacucaauaugga

SEQ ID NO: 443570 - RNA, 19 nt, Homo sapiens
gaaagagcaaccagcagaa

SEQ ID NO: 443571 - RNA, 19 nt, Homo sapiens
gcauuuagacaucuuugaa

SEQ ID NO: 443572 - RNA, 19 nt, Homo sapiens
acaauuacuucggcuuuaa

SEQ ID NO: 443573 - RNA, 19 nt, Homo sapiens
guacugauaggaccuuuau

SEQ ID NO: 443574 - RNA, 19 nt, Homo sapiens
ggacuaauggcaauuccaa

SEQ ID NO: 443575 - RNA, 19 nt, Homo sapiens
ugacagcauugaaggcauu

SEQ ID NO: 443576 - RNA, 19 nt, Homo sapiens
ccacaacuuucuagcuguu

SEQ ID NO: 443577 - RNA, 19 nt, Homo sapiens
cuacuaagcacccugacua

SEQ ID NO: 443578 - RNA, 19 nt, Homo sapiens
ccacaaagaagacauugau

SEQ ID NO: 443579 - RNA, 19 nt, Homo sapiens
uacagggagugguuaagua

SEQ ID NO: 443580 - RNA, 19 nt, Homo sapiens
uaagucaucuugcauacag

SEQ ID NO: 443581 - RNA, 19 nt, Homo sapiens
acggauauauugagaauca

SEQ ID NO: 443582 - RNA, 19 nt, Homo sapiens
caggagaauuucagauugu

SEQ ID NO: 443583 - RNA, 19 nt, Homo sapiens
acacauacgacuuuaagaa

SEQ ID NO: 443584 - RNA, 19 nt, Homo sapiens
caauuccaauggccuugua

SEQ ID NO: 443585 - RNA, 19 nt, Homo sapiens
caagaacgagucauguuug

SEQ ID NO: 443586 - RNA, 19 nt, Homo sapiens
agaccucuauaacuacaua

SEQ ID NO: 443587 - RNA, 19 nt, Homo sapiens
cagaucaccaugaaaguaa

SEQ ID NO: 443588 - RNA, 19 nt, Homo sapiens
ugauaacucaugagaagua

SEQ ID NO: 443589 - RNA, 19 nt, Homo sapiens
augcagcaauugaaacaua

SEQ ID NO: 443590 - RNA, 19 nt, Homo sapiens
uacaauuacuucggcuuua

SEQ ID NO: 443591 - RNA, 19 nt, Homo sapiens
cgccugaauucugcuauua

SEQ ID NO: 443592 - RNA, 19 nt, Homo sapiens
uagccaaacuacuucuuga

SEQ ID NO: 443593 - RNA, 19 nt, Homo sapiens
gaaccugggaaccaucaaa

SEQ ID NO: 443594 - RNA, 19 nt, Homo sapiens
ccuggagccuuggcauuua

SEQ ID NO: 443595 - RNA, 19 nt, Homo sapiens
aagaaaguguucagugaug

SEQ ID NO: 443596 - RNA, 19 nt, Homo sapiens
caaaauaagucaucuugca

SEQ ID NO: 443597 - RNA, 19 nt, Homo sapiens
gcaaaaggaguaauugauu

SEQ ID NO: 443598 - RNA, 19 nt, Homo sapiens
agagaugaaugucugaugu

SEQ ID NO: 443599 - RNA, 19 nt, Homo sapiens
gaggugcuuucauugauca

SEQ ID NO: 443600 - RNA, 19 nt, Homo sapiens
guaaauccucacuuauuga

SEQ ID NO: 443601 - RNA, 19 nt, Homo sapiens
ccaaggagcagggcccaua

SEQ ID NO: 443602 - RNA, 19 nt, Homo sapiens
ggucguguccgcaaaguug

SEQ ID NO: 443603 - RNA, 19 nt, Homo sapiens
guauauaacaacacagcua

SEQ ID NO: 443604 - RNA, 19 nt, Homo sapiens
gugcauugauuucuaaguc

SEQ ID NO: 443605 - RNA, 19 nt, Homo sapiens
agagcggucuuauuuguug

SEQ ID NO: 443606 - RNA, 19 nt, Homo sapiens
auaaagaucgccugaauuc

SEQ ID NO: 443607 - RNA, 19 nt, Homo sapiens
ggauaugguccuauagguu

SEQ ID NO: 443608 - RNA, 19 nt, Homo sapiens
ccucugcucugaagaaagu

SEQ ID NO: 443609 - RNA, 19 nt, Homo sapiens
gagugcagaagcccaguua

SEQ ID NO: 443610 - RNA, 19 nt, Homo sapiens
gcaaggagcuucuuaaguu

SEQ ID NO: 443611 - RNA, 19 nt, Homo sapiens
uaaaugaacugaagaugug

SEQ ID NO: 443612 - RNA, 19 nt, Homo sapiens
caaggagcuucuuaaguua

SEQ ID NO: 443613 - RNA, 19 nt, Homo sapiens
aaaaucagcugaaguguua

SEQ ID NO: 443614 - RNA, 19 nt, Homo sapiens
gaugcugacuucuaaauga

SEQ ID NO: 443615 - RNA, 19 nt, Homo sapiens
guaaguagguugugugagu

SEQ ID NO: 443616 - RNA, 19 nt, Homo sapiens
gcacucuaaugaagcaaua

SEQ ID NO: 443617 - RNA, 19 nt, Homo sapiens
ggagagaguaagagaaaua

SEQ ID NO: 443618 - RNA, 19 nt, Homo sapiens
uagcagagaugaggguuua

SEQ ID NO: 443619 - RNA, 19 nt, Homo sapiens
gggaugaauugcacucuaa

SEQ ID NO: 443620 - RNA, 19 nt, Homo sapiens
gugagaagccguuucauuu

SEQ ID NO: 443621 - RNA, 19 nt, Homo sapiens
gagaagccguuucauuuua

SEQ ID NO: 443622 - RNA, 19 nt, Homo sapiens
gcgauaauagcuugauuua

SEQ ID NO: 443623 - RNA, 19 nt, Homo sapiens
gagaacccauuugacuuua

SEQ ID NO: 443624 - RNA, 19 nt, Homo sapiens
gaauugcacucuaaugaag

SEQ ID NO: 443625 - RNA, 19 nt, Homo sapiens
ggacaaagaggcuaccuau

SEQ ID NO: 443626 - RNA, 19 nt, Homo sapiens
gaagaugugcccuuacuug

SEQ ID NO: 443627 - RNA, 19 nt, Homo sapiens
ggagugaugucaaguccaa

SEQ ID NO: 443628 - RNA, 19 nt, Homo sapiens
uaaagucaguccuguguau

SEQ ID NO: 443629 - RNA, 19 nt, Homo sapiens
gcugaaguguuaccaacua

SEQ ID NO: 443630 - RNA, 19 nt, Homo sapiens
gaucugggccuucauaugu

SEQ ID NO: 443631 - RNA, 19 nt, Homo sapiens
gaacccauuugacuuuaug

SEQ ID NO: 443632 - RNA, 19 nt, Homo sapiens
ucaaacaccugguacacaa

SEQ ID NO: 443633 - RNA, 19 nt, Homo sapiens
caagucauccuuaaacaaa

SEQ ID NO: 443634 - RNA, 19 nt, Homo sapiens
gaagagaguaggcgaguau

SEQ ID NO: 443635 - RNA, 19 nt, Homo sapiens
gaggagagaguaagagaaa

SEQ ID NO: 443636 - RNA, 19 nt, Homo sapiens
gaagcccgcuguuucuaug

SEQ ID NO: 443637 - RNA, 19 nt, Homo sapiens
gcgauggcauaguaaauga

SEQ ID NO: 443638 - RNA, 19 nt, Homo sapiens
agucuuggcuuuaaaguga

SEQ ID NO: 443639 - RNA, 19 nt, Homo sapiens
caaccaguccugucuguuu

SEQ ID NO: 443640 - RNA, 19 nt, Homo sapiens
gaaacgaugccuuguguca

SEQ ID NO: 443641 - RNA, 19 nt, Homo sapiens
cauaaaagaucccaaagaa

SEQ ID NO: 443642 - RNA, 19 nt, Homo sapiens
gaacuuauuagcagagaug

SEQ ID NO: 443643 - RNA, 19 nt, Homo sapiens
gcccuuacuuggcugauuu

SEQ ID NO: 443644 - RNA, 19 nt, Homo sapiens
ggagaauauuucacuggaa

SEQ ID NO: 443645 - RNA, 19 nt, Homo sapiens
caaagaggcuaccuauggu

SEQ ID NO: 443646 - RNA, 19 nt, Homo sapiens
caccaugaauuguccguaa

SEQ ID NO: 443647 - RNA, 19 nt, Homo sapiens
caauggcagucuuggcuuu

SEQ ID NO: 443648 - RNA, 19 nt, Homo sapiens
gggaauuucucuucaaugc

SEQ ID NO: 443649 - RNA, 19 nt, Homo sapiens
gccaagaaguucagauuac

SEQ ID NO: 443650 - RNA, 19 nt, Homo sapiens
ccaacuagccacaccauga

SEQ ID NO: 443651 - RNA, 19 nt, Homo sapiens
gaguagagaacccauuuga

SEQ ID NO: 443652 - RNA, 19 nt, Homo sapiens
guagaguguugugggauaa

SEQ ID NO: 443653 - RNA, 19 nt, Homo sapiens
cuaagugacuaaaguaagu

SEQ ID NO: 443654 - RNA, 19 nt, Homo sapiens
caacgcagauuuuaauguu

SEQ ID NO: 443655 - RNA, 19 nt, Homo sapiens
ggagcgauuuagccaagaa

SEQ ID NO: 443656 - RNA, 19 nt, Homo sapiens
aaccaguccugucuguuua

SEQ ID NO: 443657 - RNA, 19 nt, Homo sapiens
uagaagacagguuguguuu

SEQ ID NO: 443658 - RNA, 19 nt, Homo sapiens
ccaagaaguucagauuaca

SEQ ID NO: 443659 - RNA, 19 nt, Homo sapiens
agcaagcgauggcauagua

SEQ ID NO: 443660 - RNA, 19 nt, Homo sapiens
guguauaccuagauauuag

SEQ ID NO: 443661 - RNA, 19 nt, Homo sapiens
ccacggagccgaaaacuaa

SEQ ID NO: 443662 - RNA, 19 nt, Homo sapiens
gagagaguaagagaaauaa

SEQ ID NO: 443663 - RNA, 19 nt, Homo sapiens
acaaagaggcuaccuaugg

SEQ ID NO: 443664 - RNA, 19 nt, Homo sapiens
ugaauuguccguaauguuc

SEQ ID NO: 443665 - RNA, 19 nt, Homo sapiens
caacuagccacaccaugaa

SEQ ID NO: 443666 - RNA, 19 nt, Homo sapiens
ugugggagcuaagguagua

SEQ ID NO: 443667 - RNA, 19 nt, Homo sapiens
aaaccuggcacuuuacaaa

SEQ ID NO: 443668 - RNA, 19 nt, Homo sapiens
guagagaacccauuugacu

SEQ ID NO: 443669 - RNA, 19 nt, Homo sapiens
caagaaacgaggacugaug

SEQ ID NO: 443670 - RNA, 19 nt, Homo sapiens
aaagggaauuucucuucaa

SEQ ID NO: 443671 - RNA, 19 nt, Homo sapiens
agagaacccauuugacuuu

SEQ ID NO: 443672 - RNA, 19 nt, Homo sapiens
cuuggaugcugacuucuaa

SEQ ID NO: 443673 - RNA, 19 nt, Homo sapiens
cagaguagagaacccauuu

SEQ ID NO: 443674 - RNA, 19 nt, Homo sapiens
aauauaaaccuggcacuuu

SEQ ID NO: 443675 - RNA, 19 nt, Homo sapiens
ccaguccugucuguuuaua

SEQ ID NO: 443676 - RNA, 19 nt, Homo sapiens
ccuguuaaguggugaaauc

SEQ ID NO: 443677 - RNA, 19 nt, Homo sapiens
gauggcauaguaaaugaaa

SEQ ID NO: 443678 - RNA, 19 nt, Homo sapiens
uaaguagguugugugaguu

SEQ ID NO: 443679 - RNA, 19 nt, Homo sapiens
ggugaucugggccuucaua

SEQ ID NO: 443680 - RNA, 19 nt, Homo sapiens
cuaaaugaacugaagaugu

SEQ ID NO: 443681 - RNA, 19 nt, Homo sapiens
ggaugggagugaugucaag

SEQ ID NO: 443682 - RNA, 19 nt, Homo sapiens
ucugaaauguauagucuuc

SEQ ID NO: 443683 - RNA, 19 nt, Homo sapiens
aguagaguguugugggaua

SEQ ID NO: 443684 - RNA, 19 nt, Homo sapiens
ugacuuaccauagcaguga

SEQ ID NO: 443685 - RNA, 19 nt, Homo sapiens
gcaagcgauggcauaguaa

SEQ ID NO: 443686 - RNA, 19 nt, Homo sapiens
uaucccauguucuggcuuu

SEQ ID NO: 443687 - RNA, 19 nt, Homo sapiens
cauuugacuuuauggagaa

SEQ ID NO: 443688 - RNA, 19 nt, Homo sapiens
ugaauugcacucuaaugaa

SEQ ID NO: 443689 - RNA, 19 nt, Homo sapiens
uucuauggcuuccaaauug

SEQ ID NO: 443690 - RNA, 19 nt, Homo sapiens
gaaguucagauuacagaag

SEQ ID NO: 443691 - RNA, 19 nt, Homo sapiens
uagguugugugaguuaauu

SEQ ID NO: 443692 - RNA, 19 nt, Homo sapiens
uuucauaugugggagcuaa

SEQ ID NO: 443693 - RNA, 19 nt, Homo sapiens
ucaguccuguguauaccua

SEQ ID NO: 443694 - RNA, 19 nt, Homo sapiens
uaccuuggaugcugacuuc

SEQ ID NO: 443695 - RNA, 19 nt, Homo sapiens
ucaaugcuguucggauaga

SEQ ID NO: 443696 - RNA, 19 nt, Homo sapiens
guggugaaaucaacuagag

SEQ ID NO: 443697 - RNA, 19 nt, Homo sapiens
gauagaagacagguugugu

SEQ ID NO: 443698 - RNA, 19 nt, Homo sapiens
ugaacguguuguagccuuu

SEQ ID NO: 443699 - RNA, 19 nt, Homo sapiens
uugaaacgaugccuugugu

SEQ ID NO: 443700 - RNA, 19 nt, Homo sapiens
guuaaguggugaaaucaac

SEQ ID NO: 443701 - RNA, 19 nt, Homo sapiens
ggaggagagaguaagagaa

SEQ ID NO: 443702 - RNA, 19 nt, Homo sapiens
ugaaacccgaggagagaua

SEQ ID NO: 443703 - RNA, 19 nt, Homo sapiens
uaaaagaucccaaagaaag

SEQ ID NO: 443704 - RNA, 19 nt, Homo sapiens
ggcgauaauagcuugauuu

SEQ ID NO: 443705 - RNA, 19 nt, Homo sapiens
uagcaagguuuucagagua

SEQ ID NO: 443706 - RNA, 19 nt, Homo sapiens
agaugaggguuuacacugu

SEQ ID NO: 443707 - RNA, 19 nt, Homo sapiens
ucgauauucuggcucaaga

SEQ ID NO: 443708 - RNA, 19 nt, Homo sapiens
caaguuguucauucuaguu

SEQ ID NO: 443709 - RNA, 19 nt, Homo sapiens
gaauauuucacuggaagga

SEQ ID NO: 443710 - RNA, 19 nt, Homo sapiens
gcacaaaccucuucuguua

SEQ ID NO: 443711 - RNA, 19 nt, Homo sapiens
gaaaggugcuggcauagga

SEQ ID NO: 443712 - RNA, 19 nt, Homo sapiens
ggacggcccuucacccuaa

SEQ ID NO: 443713 - RNA, 19 nt, Homo sapiens
gaagaacccuuggagcaaa

SEQ ID NO: 443714 - RNA, 19 nt, Homo sapiens
ggaaggacacagaauauuu

SEQ ID NO: 443715 - RNA, 19 nt, Homo sapiens
agagaaaggugcuggcaua

SEQ ID NO: 443716 - RNA, 19 nt, Homo sapiens
ucacagacaucuccuuuca

SEQ ID NO: 443717 - RNA, 19 nt, Homo sapiens
gaagagccgcugcuuacua

SEQ ID NO: 443718 - RNA, 19 nt, Homo sapiens
agaggaagcuagaccauga

SEQ ID NO: 443719 - RNA, 19 nt, Homo sapiens
gcagugcugugaugaaauc

SEQ ID NO: 443720 - RNA, 19 nt, Homo sapiens
gaaggacacagaauauuuc

SEQ ID NO: 443721 - RNA, 19 nt, Homo sapiens
acagacaucuccuuucaga

SEQ ID NO: 443722 - RNA, 19 nt, Homo sapiens
acacagagaugauccuagu

SEQ ID NO: 443723 - RNA, 19 nt, Homo sapiens
ggacacagaauauuucaag

SEQ ID NO: 443724 - RNA, 19 nt, Homo sapiens
gaagcuagaccaugagauc

SEQ ID NO: 443725 - RNA, 19 nt, Homo sapiens
gagcuggccaccucuuuaa

SEQ ID NO: 443726 - RNA, 19 nt, Homo sapiens
gaaaggcacaaaccucuuc

SEQ ID NO: 443727 - RNA, 19 nt, Homo sapiens
acacggaguugcagaggaa

SEQ ID NO: 443728 - RNA, 19 nt, Homo sapiens
ccacaucaaccauuaaagu

SEQ ID NO: 443729 - RNA, 19 nt, Homo sapiens
aagagccgcugcuuacuau

SEQ ID NO: 443730 - RNA, 19 nt, Homo sapiens
gggaagagccgcugcuuac

SEQ ID NO: 443731 - RNA, 19 nt, Homo sapiens
gaggcucuguggcagcuuu

SEQ ID NO: 443732 - RNA, 19 nt, Homo sapiens
cuauugagccgcuggauga

SEQ ID NO: 443733 - RNA, 19 nt, Homo sapiens
acucccacaucaaccauua

SEQ ID NO: 443734 - RNA, 19 nt, Homo sapiens
gagccgcugcuuacuauug

SEQ ID NO: 443735 - RNA, 19 nt, Homo sapiens
ggacacagagaugauccua

SEQ ID NO: 443736 - RNA, 19 nt, Homo sapiens
gacacagaauauuucaaga

SEQ ID NO: 443737 - RNA, 19 nt, Homo sapiens
aagcaucaguaaccaguau

SEQ ID NO: 443738 - RNA, 19 nt, Homo sapiens
cacccuggcuggcaauguu

SEQ ID NO: 443739 - RNA, 19 nt, Homo sapiens
gacaggacccucacagaca

SEQ ID NO: 443740 - RNA, 19 nt, Homo sapiens
gcagaacugggcacaagug

SEQ ID NO: 443741 - RNA, 19 nt, Homo sapiens
gggccuguguggaagaaga

SEQ ID NO: 443742 - RNA, 19 nt, Homo sapiens
cacagaauauuucaagaac

SEQ ID NO: 443743 - RNA, 19 nt, Homo sapiens
gggacagugugguaccuau

SEQ ID NO: 443744 - RNA, 19 nt, Homo sapiens
ggauacggcgcugucuaua

SEQ ID NO: 443745 - RNA, 19 nt, Homo sapiens
gcaguugggcucuggauac

SEQ ID NO: 443746 - RNA, 19 nt, Homo sapiens
gacagaaagucgggaagca

SEQ ID NO: 443747 - RNA, 19 nt, Homo sapiens
gaccaugagauccggauga

SEQ ID NO: 443748 - RNA, 19 nt, Homo sapiens
gcagaagccccucuuaaau

SEQ ID NO: 443749 - RNA, 19 nt, Homo sapiens
cacacacccuucagacaga

SEQ ID NO: 443750 - RNA, 19 nt, Homo sapiens
gcucagccucucugcauga

SEQ ID NO: 443751 - RNA, 19 nt, Homo sapiens
gcacugaagaacccuugga

SEQ ID NO: 443752 - RNA, 19 nt, Homo sapiens
guggaaggacacagaauau

SEQ ID NO: 443753 - RNA, 19 nt, Homo sapiens
cacaucaaccauuaaaguu

SEQ ID NO: 443754 - RNA, 19 nt, Homo sapiens
cccaagcacuggcaaagca

SEQ ID NO: 443755 - RNA, 19 nt, Homo sapiens
ccucacagacaucuccuuu

SEQ ID NO: 443756 - RNA, 19 nt, Homo sapiens
gauacggcgcugucuauag

SEQ ID NO: 443757 - RNA, 19 nt, Homo sapiens
cagagaugcaggacagauu

SEQ ID NO: 443758 - RNA, 19 nt, Homo sapiens
ugaagaacccuuggagcaa

SEQ ID NO: 443759 - RNA, 19 nt, Homo sapiens
cagaagccccucuuaaauu

SEQ ID NO: 443760 - RNA, 19 nt, Homo sapiens
cuauugcugucaacaagga

SEQ ID NO: 443761 - RNA, 19 nt, Homo sapiens
agaagccccucuuaaauug

SEQ ID NO: 443762 - RNA, 19 nt, Homo sapiens
gauggauuccgcacacaug

SEQ ID NO: 443763 - RNA, 19 nt, Homo sapiens
aauugugguugccauggua

SEQ ID NO: 443764 - RNA, 19 nt, Homo sapiens
acaagugcauggaguucug

SEQ ID NO: 443765 - RNA, 19 nt, Homo sapiens
ggcacaaaccucuucuguu

SEQ ID NO: 443766 - RNA, 19 nt, Homo sapiens
accaagagccugcuagugu

SEQ ID NO: 443767 - RNA, 19 nt, Homo sapiens
ggcagaagccccucuuaaa

SEQ ID NO: 443768 - RNA, 19 nt, Homo sapiens
gcucuacauucggcagaug

SEQ ID NO: 443769 - RNA, 19 nt, Homo sapiens
ggaccugaauaugcucuac

SEQ ID NO: 443770 - RNA, 19 nt, Homo sapiens
ggcuggcaauguuuacaga

SEQ ID NO: 443771 - RNA, 19 nt, Homo sapiens
gaugaugaggugacacaca

SEQ ID NO: 443772 - RNA, 19 nt, Homo sapiens
gcucuaggacggcccuuca

SEQ ID NO: 443773 - RNA, 19 nt, Homo sapiens
uggaggaccugaauaugcu

SEQ ID NO: 443774 - RNA, 19 nt, Homo sapiens
acaggacccucacagacau

SEQ ID NO: 443775 - RNA, 19 nt, Homo sapiens
auacggcgcugucuauagc

SEQ ID NO: 443776 - RNA, 19 nt, Homo sapiens
ucgcagcggugacagacau

SEQ ID NO: 443777 - RNA, 19 nt, Homo sapiens
gcagaggaagcuagaccau

SEQ ID NO: 443778 - RNA, 19 nt, Homo sapiens
gggaugaugaggugacaca

SEQ ID NO: 443779 - RNA, 19 nt, Homo sapiens
cagcucagccucucugcau

SEQ ID NO: 443780 - RNA, 19 nt, Homo sapiens
cagcagugcaagauggauu

SEQ ID NO: 443781 - RNA, 19 nt, Homo sapiens
agagaugcaggacagauug

SEQ ID NO: 443782 - RNA, 19 nt, Homo sapiens
caaagcagggguccuugua

SEQ ID NO: 443783 - RNA, 19 nt, Homo sapiens
uguggcagcuuuucuuuga

SEQ ID NO: 443784 - RNA, 19 nt, Homo sapiens
uacuauugcugucaacaag

SEQ ID NO: 443785 - RNA, 19 nt, Homo sapiens
ggacagugugguaccuauc

SEQ ID NO: 443786 - RNA, 19 nt, Homo sapiens
caggagugcagagggauaa

SEQ ID NO: 443787 - RNA, 19 nt, Homo sapiens
uuuaaagacugagggaaca

SEQ ID NO: 443788 - RNA, 19 nt, Homo sapiens
gagaaaggugcuggcauag

SEQ ID NO: 443789 - RNA, 19 nt, Homo sapiens
gacacacacccuucagaca

SEQ ID NO: 443790 - RNA, 19 nt, Homo sapiens
acaaaccucuucuguuacc

SEQ ID NO: 443791 - RNA, 19 nt, Homo sapiens
gugcauggaguucugaaag

SEQ ID NO: 443792 - RNA, 19 nt, Homo sapiens
uggauacggcgcugucuau

SEQ ID NO: 443793 - RNA, 19 nt, Homo sapiens
ugacaucgcagcggugaca

SEQ ID NO: 443794 - RNA, 19 nt, Homo sapiens
gcuggccaccucuuuaaag

SEQ ID NO: 443795 - RNA, 19 nt, Homo sapiens
gggaaggacucacaucaua

SEQ ID NO: 443796 - RNA, 19 nt, Homo sapiens
gaagaugucacgcaagaua

SEQ ID NO: 443797 - RNA, 19 nt, Homo sapiens
ggacgaggcugcucuaaag

SEQ ID NO: 443798 - RNA, 19 nt, Homo sapiens
gaacagagacccuuauugg

SEQ ID NO: 443799 - RNA, 19 nt, Homo sapiens
ggacuuaucccuggccuua

SEQ ID NO: 443800 - RNA, 19 nt, Homo sapiens
caaauaagaguucauguug

SEQ ID NO: 443801 - RNA, 19 nt, Homo sapiens
ggcaguauccuaagaguua

SEQ ID NO: 443802 - RNA, 19 nt, Homo sapiens
ggacaacacauucaccuuu

SEQ ID NO: 443803 - RNA, 19 nt, Homo sapiens
gagauuaaguucacauaca

SEQ ID NO: 443804 - RNA, 19 nt, Homo sapiens
acacaaagcagcccugaua

SEQ ID NO: 443805 - RNA, 19 nt, Homo sapiens
gggaagaugucacgcaaga

SEQ ID NO: 443806 - RNA, 19 nt, Homo sapiens
gcagcucauuuccgaguua

SEQ ID NO: 443807 - RNA, 19 nt, Homo sapiens
gcucaacagucaaggcuuu

SEQ ID NO: 443808 - RNA, 19 nt, Homo sapiens
agaaaugccugaacagaga

SEQ ID NO: 443809 - RNA, 19 nt, Homo sapiens
ggauagaaaugccugaaca

SEQ ID NO: 443810 - RNA, 19 nt, Homo sapiens
ggacacaggacaaaucuau

SEQ ID NO: 443811 - RNA, 19 nt, Homo sapiens
gaaggacucacaucauaaa

SEQ ID NO: 443812 - RNA, 19 nt, Homo sapiens
caaagcagcccugauaauu

SEQ ID NO: 443813 - RNA, 19 nt, Homo sapiens
gaaacaaccgggucuucua

SEQ ID NO: 443814 - RNA, 19 nt, Homo sapiens
gaacuggauuuacuacaag

SEQ ID NO: 443815 - RNA, 19 nt, Homo sapiens
gagaaagucagaacaaaga

SEQ ID NO: 443816 - RNA, 19 nt, Homo sapiens
ccacaacacaguacaauug

SEQ ID NO: 443817 - RNA, 19 nt, Homo sapiens
caagugcgauugccaagga

SEQ ID NO: 443818 - RNA, 19 nt, Homo sapiens
cgaaucgacugucucugua

SEQ ID NO: 443819 - RNA, 19 nt, Homo sapiens
cagagacccuuauuggaaa

SEQ ID NO: 443820 - RNA, 19 nt, Homo sapiens
acacacagcuccauuaugc

SEQ ID NO: 443821 - RNA, 19 nt, Homo sapiens
aagcagcccugauaauuug

SEQ ID NO: 443822 - RNA, 19 nt, Homo sapiens
ggaaggacucacaucauaa

SEQ ID NO: 443823 - RNA, 19 nt, Homo sapiens
ggcuauacgugacaaauga

SEQ ID NO: 443824 - RNA, 19 nt, Homo sapiens
gauauagcuuucugauuuc

SEQ ID NO: 443825 - RNA, 19 nt, Homo sapiens
gagaggcaguucagggaaa

SEQ ID NO: 443826 - RNA, 19 nt, Homo sapiens
acaguacaauugcccuuua

SEQ ID NO: 443827 - RNA, 19 nt, Homo sapiens
uaacuuuggucacgacaug

SEQ ID NO: 443828 - RNA, 19 nt, Homo sapiens
gagagcaggugguggaauc

SEQ ID NO: 443829 - RNA, 19 nt, Homo sapiens
gaaagucagaacaaagaaa

SEQ ID NO: 443830 - RNA, 19 nt, Homo sapiens
ugaacuggauuuacuacaa

SEQ ID NO: 443831 - RNA, 19 nt, Homo sapiens
ucacaguucuuaccuucaa

SEQ ID NO: 443832 - RNA, 19 nt, Homo sapiens
cagagaaagucagaacaaa

SEQ ID NO: 443833 - RNA, 19 nt, Homo sapiens
aauaagaguucauguugga

SEQ ID NO: 443834 - RNA, 19 nt, Homo sapiens
ccaaauaagaguucauguu

SEQ ID NO: 443835 - RNA, 19 nt, Homo sapiens
ccauuuaggugaucauaca

SEQ ID NO: 443836 - RNA, 19 nt, Homo sapiens
ugucacggcuuuauugaga

SEQ ID NO: 443837 - RNA, 19 nt, Homo sapiens
gaagccacauugggauuau

SEQ ID NO: 443838 - RNA, 19 nt, Homo sapiens
gcaguauccuaagaguuaa

SEQ ID NO: 443839 - RNA, 19 nt, Homo sapiens
gcaauccauuccagcaaau

SEQ ID NO: 443840 - RNA, 19 nt, Homo sapiens
gugcaaccauuaucacuag

SEQ ID NO: 443841 - RNA, 19 nt, Homo sapiens
caaaugaccacaacacagu

SEQ ID NO: 443842 - RNA, 19 nt, Homo sapiens
aaagcagcccugauaauuu

SEQ ID NO: 443843 - RNA, 19 nt, Homo sapiens
acagagacccuuauuggaa

SEQ ID NO: 443844 - RNA, 19 nt, Homo sapiens
ugacuagacucgcgcuaau

SEQ ID NO: 443845 - RNA, 19 nt, Homo sapiens
ugugaaaggugcagucuca

SEQ ID NO: 443846 - RNA, 19 nt, Homo sapiens
ggacaguagccagugguua

SEQ ID NO: 443847 - RNA, 19 nt, Homo sapiens
caaaauggcaguauccuaa

SEQ ID NO: 443848 - RNA, 19 nt, Homo sapiens
acucagaggaggcucauua

SEQ ID NO: 443849 - RNA, 19 nt, Homo sapiens
gauggacagggcuauauuu

SEQ ID NO: 443850 - RNA, 19 nt, Homo sapiens
gaccagagcgcccaauaca

SEQ ID NO: 443851 - RNA, 19 nt, Homo sapiens
ccaaguacagcgugcagua

SEQ ID NO: 443852 - RNA, 19 nt, Homo sapiens
uaugugggcugguauucuu

SEQ ID NO: 443853 - RNA, 19 nt, Homo sapiens
gaccagaucaccugcucua

SEQ ID NO: 443854 - RNA, 19 nt, Homo sapiens
uagcaaaccaaacauaguu

SEQ ID NO: 443855 - RNA, 19 nt, Homo sapiens
gaaaguuuaucaccccaaa

SEQ ID NO: 443856 - RNA, 19 nt, Homo sapiens
ucacaagccucuggguuuc

SEQ ID NO: 443857 - RNA, 19 nt, Homo sapiens
caagauagaaacauacagu

SEQ ID NO: 443858 - RNA, 19 nt, Homo sapiens
ccagagcgcccaauacaca

SEQ ID NO: 443859 - RNA, 19 nt, Homo sapiens
cugcagugcuggguagaua

SEQ ID NO: 443860 - RNA, 19 nt, Homo sapiens
augaguggaugaccaagua

SEQ ID NO: 443861 - RNA, 19 nt, Homo sapiens
ggacguucuacauaaauga

SEQ ID NO: 443862 - RNA, 19 nt, Homo sapiens
ucacggcuuuauugagauu

SEQ ID NO: 443863 - RNA, 19 nt, Homo sapiens
cuaauacagugcuggacaa

SEQ ID NO: 443864 - RNA, 19 nt, Homo sapiens
gaaucccggugcccugaga

SEQ ID NO: 443865 - RNA, 19 nt, Homo sapiens
ugaaugcggugggugagaa

SEQ ID NO: 443866 - RNA, 19 nt, Homo sapiens
ccagagaaagucagaacaa

SEQ ID NO: 443867 - RNA, 19 nt, Homo sapiens
caaccauuaucacuagauc

SEQ ID NO: 443868 - RNA, 19 nt, Homo sapiens
aaacacaggagucgagaga

SEQ ID NO: 443869 - RNA, 19 nt, Homo sapiens
gacaacacauucaccuuuu

SEQ ID NO: 443870 - RNA, 19 nt, Homo sapiens
gaagugggaaggacucaca

SEQ ID NO: 443871 - RNA, 19 nt, Homo sapiens
ccacucagggccagagaaa

SEQ ID NO: 443872 - RNA, 19 nt, Homo sapiens
gagauggacagggcuauau

SEQ ID NO: 443873 - RNA, 19 nt, Homo sapiens
uuugguauauucagaguug

SEQ ID NO: 443874 - RNA, 19 nt, Homo sapiens
uaagaguucauguuggaaa

SEQ ID NO: 443875 - RNA, 19 nt, Homo sapiens
aaacaaccgggucuucuau

SEQ ID NO: 443876 - RNA, 19 nt, Homo sapiens
ccaccuccuuggacuguau

SEQ ID NO: 443877 - RNA, 19 nt, Homo sapiens
caaggcaagugacuagacu

SEQ ID NO: 443878 - RNA, 19 nt, Homo sapiens
acauugggauuaucgucua

SEQ ID NO: 443879 - RNA, 19 nt, Homo sapiens
ccagaaugcccauaucaca

SEQ ID NO: 443880 - RNA, 19 nt, Homo sapiens
ggaguuuccucugcucaca

SEQ ID NO: 443881 - RNA, 19 nt, Homo sapiens
ucauuugcuuuaccacauu

SEQ ID NO: 443882 - RNA, 19 nt, Homo sapiens
gcaccuccacgguucagaa

SEQ ID NO: 443883 - RNA, 19 nt, Homo sapiens
aaauggcaguauccuaaga

SEQ ID NO: 443884 - RNA, 19 nt, Homo sapiens
uuaccuagggcuaccauuu

SEQ ID NO: 443885 - RNA, 19 nt, Homo sapiens
uacaauugcccuuuaccua

SEQ ID NO: 443886 - RNA, 19 nt, Homo sapiens
ggacaggcugcacaucuca

SEQ ID NO: 443887 - RNA, 19 nt, Homo sapiens
aauacacacagcuccauua

SEQ ID NO: 443888 - RNA, 19 nt, Homo sapiens
caucaucucccgcuucauc

SEQ ID NO: 443889 - RNA, 19 nt, Homo sapiens
ucuggacguucuacauaaa

SEQ ID NO: 443890 - RNA, 19 nt, Homo sapiens
ugaagccacauugggauua

SEQ ID NO: 443891 - RNA, 19 nt, Homo sapiens
ggcugcacaucucaguaua

SEQ ID NO: 443892 - RNA, 19 nt, Homo sapiens
ggaaacaaccgggucuucu

SEQ ID NO: 443893 - RNA, 19 nt, Homo sapiens
gacugucucuguagauugg

SEQ ID NO: 443894 - RNA, 19 nt, Homo sapiens
uuacuucucuuuggcuaug

SEQ ID NO: 443895 - RNA, 19 nt, Homo sapiens
ggagaaaucugcugaaaga

SEQ ID NO: 443896 - RNA, 19 nt, Homo sapiens
gaaagaacuucaugaacuu

SEQ ID NO: 443897 - RNA, 19 nt, Homo sapiens
gcucaacagucccuaguua

SEQ ID NO: 443898 - RNA, 19 nt, Homo sapiens
gaauucauccgaagaaaua

SEQ ID NO: 443899 - RNA, 19 nt, Homo sapiens
ugaaauaccuggaacaaau

SEQ ID NO: 443900 - RNA, 19 nt, Homo sapiens
gaacauuggugcauuggau

SEQ ID NO: 443901 - RNA, 19 nt, Homo sapiens
gaacaucuuucuuuacaag

SEQ ID NO: 443902 - RNA, 19 nt, Homo sapiens
gaagcuaguuuaucuguca

SEQ ID NO: 443903 - RNA, 19 nt, Homo sapiens
gaaauaccuggaacaaaua

SEQ ID NO: 443904 - RNA, 19 nt, Homo sapiens
gaaguaaucugucaaucag

SEQ ID NO: 443905 - RNA, 19 nt, Homo sapiens
gcaacagaaucaacacaaa

SEQ ID NO: 443906 - RNA, 19 nt, Homo sapiens
gaaaaugucuguccugaug

SEQ ID NO: 443907 - RNA, 19 nt, Homo sapiens
ggccauuacuugaauauga

SEQ ID NO: 443908 - RNA, 19 nt, Homo sapiens
gaaauuucacccaaacuuu

SEQ ID NO: 443909 - RNA, 19 nt, Homo sapiens
ccacaagucuccuuucauc

SEQ ID NO: 443910 - RNA, 19 nt, Homo sapiens
ggaaaucgauacagcucaa

SEQ ID NO: 443911 - RNA, 19 nt, Homo sapiens
gggaauccauaaauaagaa

SEQ ID NO: 443912 - RNA, 19 nt, Homo sapiens
uaaagaauauggccauuac

SEQ ID NO: 443913 - RNA, 19 nt, Homo sapiens
caagaacauuggugcauug

SEQ ID NO: 443914 - RNA, 19 nt, Homo sapiens
gaagaaaggcaacagaauc

SEQ ID NO: 443915 - RNA, 19 nt, Homo sapiens
ucuagggaauccauaaaua

SEQ ID NO: 443916 - RNA, 19 nt, Homo sapiens
gaaucuugcccgucuauaa

SEQ ID NO: 443917 - RNA, 19 nt, Homo sapiens
cagguaaucuggagaaauc

SEQ ID NO: 443918 - RNA, 19 nt, Homo sapiens
ugacucagaucgcauugaa

SEQ ID NO: 443919 - RNA, 19 nt, Homo sapiens
uaacagguacuucaucuga

SEQ ID NO: 443920 - RNA, 19 nt, Homo sapiens
ggucagggcauacagaauu

SEQ ID NO: 443921 - RNA, 19 nt, Homo sapiens
agacuuaggucagggcaua

SEQ ID NO: 443922 - RNA, 19 nt, Homo sapiens
gaaccugagucaagugagu

SEQ ID NO: 443923 - RNA, 19 nt, Homo sapiens
aaauaacuguugcagguaa

SEQ ID NO: 443924 - RNA, 19 nt, Homo sapiens
gcuaaacucugaaaagaaa

SEQ ID NO: 443925 - RNA, 19 nt, Homo sapiens
gaagaaguaaucugucaau

SEQ ID NO: 443926 - RNA, 19 nt, Homo sapiens
gcaguaaaccagcuucaga

SEQ ID NO: 443927 - RNA, 19 nt, Homo sapiens
gaaauaacuguugcaggua

SEQ ID NO: 443928 - RNA, 19 nt, Homo sapiens
cauuggaucucacuuuaga

SEQ ID NO: 443929 - RNA, 19 nt, Homo sapiens
acaggaagcuaguuuaucu

SEQ ID NO: 443930 - RNA, 19 nt, Homo sapiens
ucugaaagauggacccaaa

SEQ ID NO: 443931 - RNA, 19 nt, Homo sapiens
gccauuacuugaauaugaa

SEQ ID NO: 443932 - RNA, 19 nt, Homo sapiens
gaagagaagcuguagaaaa

SEQ ID NO: 443933 - RNA, 19 nt, Homo sapiens
ugcauuggaucucacuuua

SEQ ID NO: 443934 - RNA, 19 nt, Homo sapiens
gaaaauacaucugaagaag

SEQ ID NO: 443935 - RNA, 19 nt, Homo sapiens
caaauuucaucuccauaca

SEQ ID NO: 443936 - RNA, 19 nt, Homo sapiens
gcagaauucauccgaagaa

SEQ ID NO: 443937 - RNA, 19 nt, Homo sapiens
gauggccugucaaccgaua

SEQ ID NO: 443938 - RNA, 19 nt, Homo sapiens
ucaagaacauuggugcauu

SEQ ID NO: 443939 - RNA, 19 nt, Homo sapiens
caagacaggaagcuaguuu

SEQ ID NO: 443940 - RNA, 19 nt, Homo sapiens
guagaaauuucacccaaac

SEQ ID NO: 443941 - RNA, 19 nt, Homo sapiens
ccaagucucuguggcaguu

SEQ ID NO: 443942 - RNA, 19 nt, Homo sapiens
gaaugaacaguaugagguu

SEQ ID NO: 443943 - RNA, 19 nt, Homo sapiens
gcugagggccaaaccagua

SEQ ID NO: 443944 - RNA, 19 nt, Homo sapiens
ggagucagcagaagaaucu

SEQ ID NO: 443945 - RNA, 19 nt, Homo sapiens
aagcuacgaugaaaggaaa

SEQ ID NO: 443946 - RNA, 19 nt, Homo sapiens
gcacgaagaaccagggaau

SEQ ID NO: 443947 - RNA, 19 nt, Homo sapiens
gcacccagggccucaaauu

SEQ ID NO: 443948 - RNA, 19 nt, Homo sapiens
gaccuugcacuucuuguuu

SEQ ID NO: 443949 - RNA, 19 nt, Homo sapiens
gggcauacagaauucagua

SEQ ID NO: 443950 - RNA, 19 nt, Homo sapiens
cuagggaauccauaaauaa

SEQ ID NO: 443951 - RNA, 19 nt, Homo sapiens
uaaaccagcuucagaaaau

SEQ ID NO: 443952 - RNA, 19 nt, Homo sapiens
gcucaaauucagaaacauu

SEQ ID NO: 443953 - RNA, 19 nt, Homo sapiens
gcaugaaccacagauguuu

SEQ ID NO: 443954 - RNA, 19 nt, Homo sapiens
cagaucgcauugaaccuaa

SEQ ID NO: 443955 - RNA, 19 nt, Homo sapiens
gaagcuacgaugaaaggaa

SEQ ID NO: 443956 - RNA, 19 nt, Homo sapiens
gaagaaaaguauuccaucu

SEQ ID NO: 443957 - RNA, 19 nt, Homo sapiens
gagggccaaaccaguauua

SEQ ID NO: 443958 - RNA, 19 nt, Homo sapiens
uaacggcagccuugaaaga

SEQ ID NO: 443959 - RNA, 19 nt, Homo sapiens
cccagaaacuaauguugaa

SEQ ID NO: 443960 - RNA, 19 nt, Homo sapiens
aaacuaagucuuugucauc

SEQ ID NO: 443961 - RNA, 19 nt, Homo sapiens
aagagaagcuguagaaaau

SEQ ID NO: 443962 - RNA, 19 nt, Homo sapiens
gaacaguguccacaagucu

SEQ ID NO: 443963 - RNA, 19 nt, Homo sapiens
gggccaaaccaguauuaaa

SEQ ID NO: 443964 - RNA, 19 nt, Homo sapiens
cauuuccacucaggauuua

SEQ ID NO: 443965 - RNA, 19 nt, Homo sapiens
cauacagaauucaguaaca

SEQ ID NO: 443966 - RNA, 19 nt, Homo sapiens
gaggaugcacucaaucaga

SEQ ID NO: 443967 - RNA, 19 nt, Homo sapiens
caucaggccauaucuguau

SEQ ID NO: 443968 - RNA, 19 nt, Homo sapiens
ggccaaaccaguauuaaag

SEQ ID NO: 443969 - RNA, 19 nt, Homo sapiens
aacagucccuaguuacuuu

SEQ ID NO: 443970 - RNA, 19 nt, Homo sapiens
uguagaaauuucacccaaa

SEQ ID NO: 443971 - RNA, 19 nt, Homo sapiens
gaaugaacaguguccacaa

SEQ ID NO: 443972 - RNA, 19 nt, Homo sapiens
ggccauuacuccucuccaa

SEQ ID NO: 443973 - RNA, 19 nt, Homo sapiens
aauguaacccuucaucuga

SEQ ID NO: 443974 - RNA, 19 nt, Homo sapiens
uagauaaucccuugaugga

SEQ ID NO: 443975 - RNA, 19 nt, Homo sapiens
gaaccacagauguuucuag

SEQ ID NO: 443976 - RNA, 19 nt, Homo sapiens
caacuucagauggguuuaa

SEQ ID NO: 443977 - RNA, 19 nt, Homo sapiens
cagaauucauccgaagaaa

SEQ ID NO: 443978 - RNA, 19 nt, Homo sapiens
gcaucgaguuggugggaau

SEQ ID NO: 443979 - RNA, 19 nt, Homo sapiens
guaacagacaggccugaaa

SEQ ID NO: 443980 - RNA, 19 nt, Homo sapiens
ggaagagaagcuguagaaa

SEQ ID NO: 443981 - RNA, 19 nt, Homo sapiens
uggaagagaagcuguagaa

SEQ ID NO: 443982 - RNA, 19 nt, Homo sapiens
cugaagaaguaaucuguca

SEQ ID NO: 443983 - RNA, 19 nt, Homo sapiens
gcaguugucagccuucugu

SEQ ID NO: 443984 - RNA, 19 nt, Homo sapiens
gcagaaugccaaugucaag

SEQ ID NO: 443985 - RNA, 19 nt, Homo sapiens
caacagucccuaguuacuu

SEQ ID NO: 443986 - RNA, 19 nt, Homo sapiens
cgaggccauuacuugaaua

SEQ ID NO: 443987 - RNA, 19 nt, Homo sapiens
uaaggaagguguccccaaa

SEQ ID NO: 443988 - RNA, 19 nt, Homo sapiens
agaaguaaucugucaauca

SEQ ID NO: 443989 - RNA, 19 nt, Homo sapiens
uauaacggcagccuugaaa

SEQ ID NO: 443990 - RNA, 19 nt, Homo sapiens
uaguuuaucugucacaucu

SEQ ID NO: 443991 - RNA, 19 nt, Homo sapiens
gaauaugaaccaccuacca

SEQ ID NO: 443992 - RNA, 19 nt, Homo sapiens
gagaagcuguagaaaaugu

SEQ ID NO: 443993 - RNA, 19 nt, Homo sapiens
guccacaagucuccuuuca

SEQ ID NO: 443994 - RNA, 19 nt, Homo sapiens
ggaaguagaaacaucaaaa

SEQ ID NO: 443995 - RNA, 19 nt, Homo sapiens
gggaugaccuaaacaauua

SEQ ID NO: 443996 - RNA, 19 nt, Homo sapiens
gaagguaucuuucagcaaa

SEQ ID NO: 443997 - RNA, 19 nt, Homo sapiens
gaugagaaauucaacguua

SEQ ID NO: 443998 - RNA, 19 nt, Homo sapiens
gaacagagacggcagaauu

SEQ ID NO: 443999 - RNA, 19 nt, Homo sapiens
gcaagaaacuguaaauaag

SEQ ID NO: 444000 - RNA, 19 nt, Homo sapiens
ggacaggacuauugacuga

SEQ ID NO: 444001 - RNA, 19 nt, Homo sapiens
gaagguaaaucggaaauga

SEQ ID NO: 444002 - RNA, 19 nt, Homo sapiens
gaagagaacguuaaacuug

SEQ ID NO: 444003 - RNA, 19 nt, Homo sapiens
agaaagagauguagaagaa

SEQ ID NO: 444004 - RNA, 19 nt, Homo sapiens
ggaagaaacucaucagaag

SEQ ID NO: 444005 - RNA, 19 nt, Homo sapiens
gaaucuaucuccaaccuuu

SEQ ID NO: 444006 - RNA, 19 nt, Homo sapiens
gaagacacguuaaacaaau

SEQ ID NO: 444007 - RNA, 19 nt, Homo sapiens
gcaaagggcuuggaacaga

SEQ ID NO: 444008 - RNA, 19 nt, Homo sapiens
gaagaaggcuagaguccaa

SEQ ID NO: 444009 - RNA, 19 nt, Homo sapiens
agaaauaucugagcucuuu

SEQ ID NO: 444010 - RNA, 19 nt, Homo sapiens
gaucugugcucaauaauca

SEQ ID NO: 444011 - RNA, 19 nt, Homo sapiens
aaagaucugugcucaauaa

SEQ ID NO: 444012 - RNA, 19 nt, Homo sapiens
gagaagagcagcugauaaa

SEQ ID NO: 444013 - RNA, 19 nt, Homo sapiens
gcagaaauccaucaguaua

SEQ ID NO: 444014 - RNA, 19 nt, Homo sapiens
gaagaugccaugcagauaa

SEQ ID NO: 444015 - RNA, 19 nt, Homo sapiens
caggagaacucauguuauu

SEQ ID NO: 444016 - RNA, 19 nt, Homo sapiens
gcucaaggcuacugaagaa

SEQ ID NO: 444017 - RNA, 19 nt, Homo sapiens
ggagaaagaccuagcauug

SEQ ID NO: 444018 - RNA, 19 nt, Homo sapiens
guagaagaauuacagcuaa

SEQ ID NO: 444019 - RNA, 19 nt, Homo sapiens
gaaagaaagagauguagaa

SEQ ID NO: 444020 - RNA, 19 nt, Homo sapiens
ccacaaaguuaccaagauu

SEQ ID NO: 444021 - RNA, 19 nt, Homo sapiens
aaacagcucugacauacaa

SEQ ID NO: 444022 - RNA, 19 nt, Homo sapiens
gacgaaaccuucugaugaa

SEQ ID NO: 444023 - RNA, 19 nt, Homo sapiens
gaacagagccagcaagaag

SEQ ID NO: 444024 - RNA, 19 nt, Homo sapiens
gaccaaagcugacaaacuc

SEQ ID NO: 444025 - RNA, 19 nt, Homo sapiens
gagaaacaguccaagaaga

SEQ ID NO: 444026 - RNA, 19 nt, Homo sapiens
gaacagaugaccaaagaga

SEQ ID NO: 444027 - RNA, 19 nt, Homo sapiens
gggcuaaacugaugaaagu

SEQ ID NO: 444028 - RNA, 19 nt, Homo sapiens
uaauggaacuggagaaaga

SEQ ID NO: 444029 - RNA, 19 nt, Homo sapiens
gaagaagaaucaauuacca

SEQ ID NO: 444030 - RNA, 19 nt, Homo sapiens
aaagagaacucagauguga

SEQ ID NO: 444031 - RNA, 19 nt, Homo sapiens
caguauaacuagugccuua

SEQ ID NO: 444032 - RNA, 19 nt, Homo sapiens
uggaagagcugaacaaauc

SEQ ID NO: 444033 - RNA, 19 nt, Homo sapiens
gagaaacagcucugacaua

SEQ ID NO: 444034 - RNA, 19 nt, Homo sapiens
gaagaaugauggcgcuguu

SEQ ID NO: 444035 - RNA, 19 nt, Homo sapiens
ccagaugccauuacauuua

SEQ ID NO: 444036 - RNA, 19 nt, Homo sapiens
gcucaauaaucaguuguua

SEQ ID NO: 444037 - RNA, 19 nt, Homo sapiens
gcaaacaaaugcaaaacua

SEQ ID NO: 444038 - RNA, 19 nt, Homo sapiens
ggaagacacguuaaacaaa

SEQ ID NO: 444039 - RNA, 19 nt, Homo sapiens
gagacugacuucacuauag

SEQ ID NO: 444040 - RNA, 19 nt, Homo sapiens
gaaaacauguaaagcagua

SEQ ID NO: 444041 - RNA, 19 nt, Homo sapiens
aaauguaucuuccaugcua

SEQ ID NO: 444042 - RNA, 19 nt, Homo sapiens
cauagcaucuuguggcuuu

SEQ ID NO: 444043 - RNA, 19 nt, Homo sapiens
acaggaagcugaaauaaag

SEQ ID NO: 444044 - RNA, 19 nt, Homo sapiens
uacccgaccuucaaaguua

SEQ ID NO: 444045 - RNA, 19 nt, Homo sapiens
cgacgaaaccuucugauga

SEQ ID NO: 444046 - RNA, 19 nt, Homo sapiens
gaacgcccauacugugaaa

SEQ ID NO: 444047 - RNA, 19 nt, Homo sapiens
gcucugacauacaaagaaa

SEQ ID NO: 444048 - RNA, 19 nt, Homo sapiens
caacugcaaugacgacgaa

SEQ ID NO: 444049 - RNA, 19 nt, Homo sapiens
gcaagaagagaacguuaaa

SEQ ID NO: 444050 - RNA, 19 nt, Homo sapiens
gaauguacgaugagaaauu

SEQ ID NO: 444051 - RNA, 19 nt, Homo sapiens
caacguaacaccagcauug

SEQ ID NO: 444052 - RNA, 19 nt, Homo sapiens
ggaagaauuuaggaaagaa

SEQ ID NO: 444053 - RNA, 19 nt, Homo sapiens
gaaauugucggaccuggaa

SEQ ID NO: 444054 - RNA, 19 nt, Homo sapiens
gaaaagcucuuggaucuug

SEQ ID NO: 444055 - RNA, 19 nt, Homo sapiens
ccaaagagaacgagucauu

SEQ ID NO: 444056 - RNA, 19 nt, Homo sapiens
caaaagaacuccugacugu

SEQ ID NO: 444057 - RNA, 19 nt, Homo sapiens
agacgcagaugaagagaaa

SEQ ID NO: 444058 - RNA, 19 nt, Homo sapiens
ugaagucagucaagugaaa

SEQ ID NO: 444059 - RNA, 19 nt, Homo sapiens
ugaauuacgucugaaagaa

SEQ ID NO: 444060 - RNA, 19 nt, Homo sapiens
uagcagauauggaggcaaa

SEQ ID NO: 444061 - RNA, 19 nt, Homo sapiens
ggaguuagaugagccacuu

SEQ ID NO: 444062 - RNA, 19 nt, Homo sapiens
gaggcuggcucaaucaaga

SEQ ID NO: 444063 - RNA, 19 nt, Homo sapiens
agaaagaucugugcucaau

SEQ ID NO: 444064 - RNA, 19 nt, Homo sapiens
gagauaaaggcucuguaua

SEQ ID NO: 444065 - RNA, 19 nt, Homo sapiens
ggagauaaaggcucuguau

SEQ ID NO: 444066 - RNA, 19 nt, Homo sapiens
guggaugacuuucgaguug

SEQ ID NO: 444067 - RNA, 19 nt, Homo sapiens
agaaagaauuggagaggaa

SEQ ID NO: 444068 - RNA, 19 nt, Homo sapiens
gcagaaauaaugaagaugu

SEQ ID NO: 444069 - RNA, 19 nt, Homo sapiens
ugacauuugugacugcuuu

SEQ ID NO: 444070 - RNA, 19 nt, Homo sapiens
uggagaaacugagaaauga

SEQ ID NO: 444071 - RNA, 19 nt, Homo sapiens
uggaacagaugaccaaaga

SEQ ID NO: 444072 - RNA, 19 nt, Homo sapiens
gaauuacgucugaaagaaa

SEQ ID NO: 444073 - RNA, 19 nt, Homo sapiens
gaacucagaugugauagcu

SEQ ID NO: 444074 - RNA, 19 nt, Homo sapiens
ucagaaaagucacguauaa

SEQ ID NO: 444075 - RNA, 19 nt, Homo sapiens
ggacggacaugaccagcau

SEQ ID NO: 444076 - RNA, 19 nt, Homo sapiens
cagaugccauuacauuuau

SEQ ID NO: 444077 - RNA, 19 nt, Homo sapiens
ggcagaauuugcugaacua

SEQ ID NO: 444078 - RNA, 19 nt, Homo sapiens
gagaaagaccuagcauuga

SEQ ID NO: 444079 - RNA, 19 nt, Homo sapiens
caaucucccuucacaaguu

SEQ ID NO: 444080 - RNA, 19 nt, Homo sapiens
uaaagaacuuggagcuuca

SEQ ID NO: 444081 - RNA, 19 nt, Homo sapiens
gagaauccaaguucauaaa

SEQ ID NO: 444082 - RNA, 19 nt, Homo sapiens
gaagucacaagucaucaaa

SEQ ID NO: 444083 - RNA, 19 nt, Homo sapiens
cuacagaaccuccagaaga

SEQ ID NO: 444084 - RNA, 19 nt, Homo sapiens
gagagaagagcagcugaua

SEQ ID NO: 444085 - RNA, 19 nt, Homo sapiens
gaaagccaguuccgaaggu

SEQ ID NO: 444086 - RNA, 19 nt, Homo sapiens
agaaauggaagacacguua

SEQ ID NO: 444087 - RNA, 19 nt, Homo sapiens
gggaagaaacucaucagaa

SEQ ID NO: 444088 - RNA, 19 nt, Homo sapiens
gaguuugggugaauggaaa

SEQ ID NO: 444089 - RNA, 19 nt, Homo sapiens
gaagacaccuacggcuguu

SEQ ID NO: 444090 - RNA, 19 nt, Homo sapiens
uuagaugaauguacgauga

SEQ ID NO: 444091 - RNA, 19 nt, Homo sapiens
ggccagacauagcaucuug

SEQ ID NO: 444092 - RNA, 19 nt, Homo sapiens
gagcuucaacucaaagaaa

SEQ ID NO: 444093 - RNA, 19 nt, Homo sapiens
uugcagaaauccaucagua

SEQ ID NO: 444094 - RNA, 19 nt, Homo sapiens
agagaaagaugagagagaa

SEQ ID NO: 444095 - RNA, 19 nt, Homo sapiens
gaacaaagcucuuauucaa

SEQ ID NO: 444096 - RNA, 19 nt, Homo sapiens
ucgcagaacugaagaauuu

SEQ ID NO: 444097 - RNA, 19 nt, Homo sapiens
uuaaagagcuccacauuca

SEQ ID NO: 444098 - RNA, 19 nt, Homo sapiens
gaguuuguaucacauguua

SEQ ID NO: 444099 - RNA, 19 nt, Homo sapiens
ccaagucucugaagaaguu

SEQ ID NO: 444100 - RNA, 19 nt, Homo sapiens
ugaacaggcugaacacuuu

SEQ ID NO: 444101 - RNA, 19 nt, Homo sapiens
gaacaucgcagaacugaag

SEQ ID NO: 444102 - RNA, 19 nt, Homo sapiens
ucacaagguugcuuauuau

SEQ ID NO: 444103 - RNA, 19 nt, Homo sapiens
caagguugcuuauuaucaa

SEQ ID NO: 444104 - RNA, 19 nt, Homo sapiens
cuaggaaacuuggauuuaa

SEQ ID NO: 444105 - RNA, 19 nt, Homo sapiens
ugauucaccuaacucauua

SEQ ID NO: 444106 - RNA, 19 nt, Homo sapiens
gaagaauaaugacaaaucg

SEQ ID NO: 444107 - RNA, 19 nt, Homo sapiens
guucugagacauacaaaua

SEQ ID NO: 444108 - RNA, 19 nt, Homo sapiens
ggauuuaacuggccagaag

SEQ ID NO: 444109 - RNA, 19 nt, Homo sapiens
gaaauccugccgccagaua

SEQ ID NO: 444110 - RNA, 19 nt, Homo sapiens
caacugguccucagccaua

SEQ ID NO: 444111 - RNA, 19 nt, Homo sapiens
accgagauaugcuaauuua

SEQ ID NO: 444112 - RNA, 19 nt, Homo sapiens
gaguauauccguucugaga

SEQ ID NO: 444113 - RNA, 19 nt, Homo sapiens
ccaccgagauaugcuaauu

SEQ ID NO: 444114 - RNA, 19 nt, Homo sapiens
ggaacaaagcucuuauuca

SEQ ID NO: 444115 - RNA, 19 nt, Homo sapiens
gcagggaacaaagcucuua

SEQ ID NO: 444116 - RNA, 19 nt, Homo sapiens
gaacuaggaaacuuggauu

SEQ ID NO: 444117 - RNA, 19 nt, Homo sapiens
uacaacaacuugagcgaaa

SEQ ID NO: 444118 - RNA, 19 nt, Homo sapiens
caacggccucuuuaccuua

SEQ ID NO: 444119 - RNA, 19 nt, Homo sapiens
gaugucaacggccucuuua

SEQ ID NO: 444120 - RNA, 19 nt, Homo sapiens
ucacaaaguugcagauacu

SEQ ID NO: 444121 - RNA, 19 nt, Homo sapiens
aucacaagguugcuuauua

SEQ ID NO: 444122 - RNA, 19 nt, Homo sapiens
acaaagcucuuauucaacu

SEQ ID NO: 444123 - RNA, 19 nt, Homo sapiens
ucuaaugcuucccaccuua

SEQ ID NO: 444124 - RNA, 19 nt, Homo sapiens
gaaccaccgaagaagaaua

SEQ ID NO: 444125 - RNA, 19 nt, Homo sapiens
uugggaagcucacaaaguu

SEQ ID NO: 444126 - RNA, 19 nt, Homo sapiens
cgaagaagaauaaugacaa

SEQ ID NO: 444127 - RNA, 19 nt, Homo sapiens
gaggagagccgggagaaga

SEQ ID NO: 444128 - RNA, 19 nt, Homo sapiens
gccaagaacagauaaggaa

SEQ ID NO: 444129 - RNA, 19 nt, Homo sapiens
gaucaguagccuucagaaa

SEQ ID NO: 444130 - RNA, 19 nt, Homo sapiens
caccgaagaagaauaauga

SEQ ID NO: 444131 - RNA, 19 nt, Homo sapiens
auacucagccuuagggaua

SEQ ID NO: 444132 - RNA, 19 nt, Homo sapiens
ugcccugucucucaaauaa

SEQ ID NO: 444133 - RNA, 19 nt, Homo sapiens
guauauccguucugagaca

SEQ ID NO: 444134 - RNA, 19 nt, Homo sapiens
guuauaaggucuuuaaacc

SEQ ID NO: 444135 - RNA, 19 nt, Homo sapiens
ggaugucaacggccucuuu

SEQ ID NO: 444136 - RNA, 19 nt, Homo sapiens
gcuuaaagagcuccacauu

SEQ ID NO: 444137 - RNA, 19 nt, Homo sapiens
ucgaggagcugcccacaca

SEQ ID NO: 444138 - RNA, 19 nt, Homo sapiens
gggaacaaagcucuuauuc

SEQ ID NO: 444139 - RNA, 19 nt, Homo sapiens
ucaacggccucuuuaccuu

SEQ ID NO: 444140 - RNA, 19 nt, Homo sapiens
cagaaccaccgaagaagaa

SEQ ID NO: 444141 - RNA, 19 nt, Homo sapiens
ucaguagccuucagaaacu

SEQ ID NO: 444142 - RNA, 19 nt, Homo sapiens
gaacaggcugaacacuuug

SEQ ID NO: 444143 - RNA, 19 nt, Homo sapiens
cauagugggcucuggcuuu

SEQ ID NO: 444144 - RNA, 19 nt, Homo sapiens
uugcagauacucagccuua

SEQ ID NO: 444145 - RNA, 19 nt, Homo sapiens
gcucacaaaguugcagaua

SEQ ID NO: 444146 - RNA, 19 nt, Homo sapiens
ccucagccauaacaagcua

SEQ ID NO: 444147 - RNA, 19 nt, Homo sapiens
ccagaagcagguauucaaa

SEQ ID NO: 444148 - RNA, 19 nt, Homo sapiens
cgagauaugcuaauuuaac

SEQ ID NO: 444149 - RNA, 19 nt, Homo sapiens
gccagaagcagguauucaa

SEQ ID NO: 444150 - RNA, 19 nt, Homo sapiens
ggacuugacguacaacaac

SEQ ID NO: 444151 - RNA, 19 nt, Homo sapiens
guucuggacuugacguaca

SEQ ID NO: 444152 - RNA, 19 nt, Homo sapiens
cauaacaagcuaacaaugg

SEQ ID NO: 444153 - RNA, 19 nt, Homo sapiens
cauguuacuuauugacuca

SEQ ID NO: 444154 - RNA, 19 nt, Homo sapiens
caacugcgaauuccauagu

SEQ ID NO: 444155 - RNA, 19 nt, Homo sapiens
cucuuuaccuuaucccaua

SEQ ID NO: 444156 - RNA, 19 nt, Homo sapiens
gagcugcccacacagauca

SEQ ID NO: 444157 - RNA, 19 nt, Homo sapiens
ccagaaccaccgaagaaga

SEQ ID NO: 444158 - RNA, 19 nt, Homo sapiens
aaaugucacuguuaacacu

SEQ ID NO: 444159 - RNA, 19 nt, Homo sapiens
acuaggaaacuuggauuua

SEQ ID NO: 444160 - RNA, 19 nt, Homo sapiens
ccugccagcucuugagguu

SEQ ID NO: 444161 - RNA, 19 nt, Homo sapiens
gaggagcugcccacacaga

SEQ ID NO: 444162 - RNA, 19 nt, Homo sapiens
auaacaagcuaacaauggu

SEQ ID NO: 444163 - RNA, 19 nt, Homo sapiens
caccuuaccuuuuagauuc

SEQ ID NO: 444164 - RNA, 19 nt, Homo sapiens
uaggaaacuuggauuuaac

SEQ ID NO: 444165 - RNA, 19 nt, Homo sapiens
uugaguauauccguucuga

SEQ ID NO: 444166 - RNA, 19 nt, Homo sapiens
agacauacaaauaccucua

SEQ ID NO: 444167 - RNA, 19 nt, Homo sapiens
uaccuuaucccauaucaca

SEQ ID NO: 444168 - RNA, 19 nt, Homo sapiens
gauauugggaagcucacaa

SEQ ID NO: 444169 - RNA, 19 nt, Homo sapiens
caccugaaccuuggcauga

SEQ ID NO: 444170 - RNA, 19 nt, Homo sapiens
gaauaaaagaacagucuga

SEQ ID NO: 444171 - RNA, 19 nt, Homo sapiens
aaccaccgaagaagaauaa

SEQ ID NO: 444172 - RNA, 19 nt, Homo sapiens
gaagcagguauucaaagca

SEQ ID NO: 444173 - RNA, 19 nt, Homo sapiens
agaagcagguauucaaagc

SEQ ID NO: 444174 - RNA, 19 nt, Homo sapiens
uugauucaccuaacucauu

SEQ ID NO: 444175 - RNA, 19 nt, Homo sapiens
guccaagucucugaagaag

SEQ ID NO: 444176 - RNA, 19 nt, Homo sapiens
gccauaacaagcuaacaau

SEQ ID NO: 444177 - RNA, 19 nt, Homo sapiens
cuccaacacuucauucucu

SEQ ID NO: 444178 - RNA, 19 nt, Homo sapiens
ccaccgaagaagaauaaug

SEQ ID NO: 444179 - RNA, 19 nt, Homo sapiens
gaaacucaaacaccugaac

SEQ ID NO: 444180 - RNA, 19 nt, Homo sapiens
acaagguugcuuauuauca

SEQ ID NO: 444181 - RNA, 19 nt, Homo sapiens
gcagaacugaagaauuugg

SEQ ID NO: 444182 - RNA, 19 nt, Homo sapiens
uaaaagaacagucugaucu

SEQ ID NO: 444183 - RNA, 19 nt, Homo sapiens
ccauuuccauuuguuucuu

SEQ ID NO: 444184 - RNA, 19 nt, Homo sapiens
caacacuucauucucucuu

SEQ ID NO: 444185 - RNA, 19 nt, Homo sapiens
ccauaacaagcuaacaaug

SEQ ID NO: 444186 - RNA, 19 nt, Homo sapiens
ggcaugaacaggcugaaca

SEQ ID NO: 444187 - RNA, 19 nt, Homo sapiens
caccgagauaugcuaauuu

SEQ ID NO: 444188 - RNA, 19 nt, Homo sapiens
cuucccaccuuaccuuuua

SEQ ID NO: 444189 - RNA, 19 nt, Homo sapiens
caccgaacaucgcagaacu

SEQ ID NO: 444190 - RNA, 19 nt, Homo sapiens
gcagauacucagccuuagg

SEQ ID NO: 444191 - RNA, 19 nt, Homo sapiens
cuaucuaagugacaacgau

SEQ ID NO: 444192 - RNA, 19 nt, Homo sapiens
cacccugcgugcacucuau

SEQ ID NO: 444193 - RNA, 19 nt, Homo sapiens
uguccaagucucugaagaa

SEQ ID NO: 444194 - RNA, 19 nt, Homo sapiens
caaagcucuuauucaacug

SEQ ID NO: 444195 - RNA, 19 nt, Homo sapiens
gguaacagcucucuucuua

SEQ ID NO: 444196 - RNA, 19 nt, Homo sapiens
gauagagucucguggcuua

SEQ ID NO: 444197 - RNA, 19 nt, Homo sapiens
gcaaagggauuaucguaug

SEQ ID NO: 444198 - RNA, 19 nt, Homo sapiens
cgagugcucugaugcaaua

SEQ ID NO: 444199 - RNA, 19 nt, Homo sapiens
ccacugcuguuucucaaua

SEQ ID NO: 444200 - RNA, 19 nt, Homo sapiens
gaagcaagauauaugucua

SEQ ID NO: 444201 - RNA, 19 nt, Homo sapiens
acacaucucucauuucuga

SEQ ID NO: 444202 - RNA, 19 nt, Homo sapiens
acacugacaucucaauuaa

SEQ ID NO: 444203 - RNA, 19 nt, Homo sapiens
gaacagcacacuuaaggaa

SEQ ID NO: 444204 - RNA, 19 nt, Homo sapiens
uaaagacacugacaucuca

SEQ ID NO: 444205 - RNA, 19 nt, Homo sapiens
ccacuaaaguauagagaaa

SEQ ID NO: 444206 - RNA, 19 nt, Homo sapiens
gcucucuucuuacucauua

SEQ ID NO: 444207 - RNA, 19 nt, Homo sapiens
caaagaagcaaagggauua

SEQ ID NO: 444208 - RNA, 19 nt, Homo sapiens
gacuuggacuuuaagaaua

SEQ ID NO: 444209 - RNA, 19 nt, Homo sapiens
aagcagaggccuauaaaua

SEQ ID NO: 444210 - RNA, 19 nt, Homo sapiens
gaaagcagaggccuauaaa

SEQ ID NO: 444211 - RNA, 19 nt, Homo sapiens
gaccacaccuucucaacaa

SEQ ID NO: 444212 - RNA, 19 nt, Homo sapiens
guaccagcauguuaacuuu

SEQ ID NO: 444213 - RNA, 19 nt, Homo sapiens
caaguuaucuuucccucuu

SEQ ID NO: 444214 - RNA, 19 nt, Homo sapiens
uggcaaagauucaggcuaa

SEQ ID NO: 444215 - RNA, 19 nt, Homo sapiens
gaagaagacucgaguucca

SEQ ID NO: 444216 - RNA, 19 nt, Homo sapiens
gcacuuauguacuugauac

SEQ ID NO: 444217 - RNA, 19 nt, Homo sapiens
cuauugaccuguuguauug

SEQ ID NO: 444218 - RNA, 19 nt, Homo sapiens
cacauuugcuccauacaua

SEQ ID NO: 444219 - RNA, 19 nt, Homo sapiens
caagauauaugucuaaagc

SEQ ID NO: 444220 - RNA, 19 nt, Homo sapiens
gcagaggccuauaaauaca

SEQ ID NO: 444221 - RNA, 19 nt, Homo sapiens
caaagggauuaucguauga

SEQ ID NO: 444222 - RNA, 19 nt, Homo sapiens
uaaaugcuguuguggcaaa

SEQ ID NO: 444223 - RNA, 19 nt, Homo sapiens
gcuggaagauaaagacuug

SEQ ID NO: 444224 - RNA, 19 nt, Homo sapiens
gcuguuccuuguacucuua

SEQ ID NO: 444225 - RNA, 19 nt, Homo sapiens
caaggaccauuuauuggaa

SEQ ID NO: 444226 - RNA, 19 nt, Homo sapiens
caucaaggaccauuuauug

SEQ ID NO: 444227 - RNA, 19 nt, Homo sapiens
ucucguggcuuauuuaguu

SEQ ID NO: 444228 - RNA, 19 nt, Homo sapiens
uaacagcucucuucuuacu

SEQ ID NO: 444229 - RNA, 19 nt, Homo sapiens
gcucauggcugugguuuca

SEQ ID NO: 444230 - RNA, 19 nt, Homo sapiens
ccacggaagugaacaagau

SEQ ID NO: 444231 - RNA, 19 nt, Homo sapiens
gcacuuaugguaaucaguu

SEQ ID NO: 444232 - RNA, 19 nt, Homo sapiens
gacacugacaucucaauua

SEQ ID NO: 444233 - RNA, 19 nt, Homo sapiens
gcugugguuucaauguuua

SEQ ID NO: 444234 - RNA, 19 nt, Homo sapiens
ucaggaggauucuacauau

SEQ ID NO: 444235 - RNA, 19 nt, Homo sapiens
gaauaaagacacugacauc

SEQ ID NO: 444236 - RNA, 19 nt, Homo sapiens
ggaagugaacaagaucuua

SEQ ID NO: 444237 - RNA, 19 nt, Homo sapiens
gaucaccgccaucaaagaa

SEQ ID NO: 444238 - RNA, 19 nt, Homo sapiens
ucacuugugucaaccacua

SEQ ID NO: 444239 - RNA, 19 nt, Homo sapiens
gcaaauugauugucuuucc

SEQ ID NO: 444240 - RNA, 19 nt, Homo sapiens
aggaaugucuggaguggua

SEQ ID NO: 444241 - RNA, 19 nt, Homo sapiens
cugguuggauuaaucuuua

SEQ ID NO: 444242 - RNA, 19 nt, Homo sapiens
aggagcagauucagaagua

SEQ ID NO: 444243 - RNA, 19 nt, Homo sapiens
ggugagagcccaaguuauc

SEQ ID NO: 444244 - RNA, 19 nt, Homo sapiens
uuacacaucucucauuucu

SEQ ID NO: 444245 - RNA, 19 nt, Homo sapiens
uaagaggcacgcugaguaa

SEQ ID NO: 444246 - RNA, 19 nt, Homo sapiens
ugauguggcuccugaccua

SEQ ID NO: 444247 - RNA, 19 nt, Homo sapiens
ugaaagcagaggccuauaa

SEQ ID NO: 444248 - RNA, 19 nt, Homo sapiens
gcuauugaccuguuguauu

SEQ ID NO: 444249 - RNA, 19 nt, Homo sapiens
gaagugaacaagaucuuag

SEQ ID NO: 444250 - RNA, 19 nt, Homo sapiens
ggauuggugggcugauuua

SEQ ID NO: 444251 - RNA, 19 nt, Homo sapiens
uaguggaaaucgcuuauau

SEQ ID NO: 444252 - RNA, 19 nt, Homo sapiens
ggaccugguggauuccuua

SEQ ID NO: 444253 - RNA, 19 nt, Homo sapiens
acucauuacugcaaauuga

SEQ ID NO: 444254 - RNA, 19 nt, Homo sapiens
caggaggauucuacauauu

SEQ ID NO: 444255 - RNA, 19 nt, Homo sapiens
gcagacgggcaucguguuu

SEQ ID NO: 444256 - RNA, 19 nt, Homo sapiens
ggacagcgagcucaucauc

SEQ ID NO: 444257 - RNA, 19 nt, Homo sapiens
cgaccgcacuuaugguaau

SEQ ID NO: 444258 - RNA, 19 nt, Homo sapiens
aaucaucaaggaccauuua

SEQ ID NO: 444259 - RNA, 19 nt, Homo sapiens
gaugaaagcagaggccuau

SEQ ID NO: 444260 - RNA, 19 nt, Homo sapiens
guggaaaucgcuuauaugu

SEQ ID NO: 444261 - RNA, 19 nt, Homo sapiens
cuaagaggcacgcugagua

SEQ ID NO: 444262 - RNA, 19 nt, Homo sapiens
ccaguaccauaaucuuaga

SEQ ID NO: 444263 - RNA, 19 nt, Homo sapiens
ucaaagaagcaaagggauu

SEQ ID NO: 444264 - RNA, 19 nt, Homo sapiens
gaugaucucucugaagaac

SEQ ID NO: 444265 - RNA, 19 nt, Homo sapiens
cuuauguacuugauacuga

SEQ ID NO: 444266 - RNA, 19 nt, Homo sapiens
ggaggauucuacauauuuu

SEQ ID NO: 444267 - RNA, 19 nt, Homo sapiens
cuacaagucuguuuuacaa

SEQ ID NO: 444268 - RNA, 19 nt, Homo sapiens
uguuacacaucucucauuu

SEQ ID NO: 444269 - RNA, 19 nt, Homo sapiens
ggaccacaccuucucaaca

SEQ ID NO: 444270 - RNA, 19 nt, Homo sapiens
ucaaggaccauuuauugga

SEQ ID NO: 444271 - RNA, 19 nt, Homo sapiens
uacggacucuggauauuug

SEQ ID NO: 444272 - RNA, 19 nt, Homo sapiens
caauuacggacucuggaua

SEQ ID NO: 444273 - RNA, 19 nt, Homo sapiens
ggcugugguuucaauguuu

SEQ ID NO: 444274 - RNA, 19 nt, Homo sapiens
uacgugaacagcacacuua

SEQ ID NO: 444275 - RNA, 19 nt, Homo sapiens
gauauuugcacuuauguac

SEQ ID NO: 444276 - RNA, 19 nt, Homo sapiens
gggcugauuuacauguaug

SEQ ID NO: 444277 - RNA, 19 nt, Homo sapiens
gucaaccacuaaaguauag

SEQ ID NO: 444278 - RNA, 19 nt, Homo sapiens
gagcuugagaucacccuuu

SEQ ID NO: 444279 - RNA, 19 nt, Homo sapiens
aagcaaagggauuaucgua

SEQ ID NO: 444280 - RNA, 19 nt, Homo sapiens
ggaagaauccacauuugcu

SEQ ID NO: 444281 - RNA, 19 nt, Homo sapiens
ggauauuugcacuuaugua

SEQ ID NO: 444282 - RNA, 19 nt, Homo sapiens
ccucuucgguguucuucuu

SEQ ID NO: 444283 - RNA, 19 nt, Homo sapiens
gagagcccaaguuaucuuu

SEQ ID NO: 444284 - RNA, 19 nt, Homo sapiens
ugucaaccacuaaaguaua

SEQ ID NO: 444285 - RNA, 19 nt, Homo sapiens
acagcgagcucaucaucga

SEQ ID NO: 444286 - RNA, 19 nt, Homo sapiens
uguauuacuuucucuguag

SEQ ID NO: 444287 - RNA, 19 nt, Homo sapiens
gcagucgaccgcacuuaug

SEQ ID NO: 444288 - RNA, 19 nt, Homo sapiens
ucucugcaaugcuucugua

SEQ ID NO: 444289 - RNA, 19 nt, Homo sapiens
ucucuucucugcaaugcuu

SEQ ID NO: 444290 - RNA, 19 nt, Homo sapiens
acagcucucuucuuacuca

SEQ ID NO: 444291 - RNA, 19 nt, Homo sapiens
caauaucugggacuuguga

SEQ ID NO: 444292 - RNA, 19 nt, Homo sapiens
ugaaaccacuacccaagag

SEQ ID NO: 444293 - RNA, 19 nt, Homo sapiens
gaccauuuauuggaagaau

SEQ ID NO: 444294 - RNA, 19 nt, Homo sapiens
agacuuggacuuuaagaau

SEQ ID NO: 444295 - RNA, 19 nt, Homo sapiens
gaacagcuauggaaugguu

SEQ ID NO: 444296 - RNA, 19 nt, Homo sapiens
gagcuuggauuuacacugu

SEQ ID NO: 444297 - RNA, 19 nt, Homo sapiens
uagaagaccucguggauuc

SEQ ID NO: 444298 - RNA, 19 nt, Homo sapiens
gcuauggaaugguuaaaga

SEQ ID NO: 444299 - RNA, 19 nt, Homo sapiens
caaagaagcuccgucuaca

SEQ ID NO: 444300 - RNA, 19 nt, Homo sapiens
gagcugaccuucuccuaca

SEQ ID NO: 444301 - RNA, 19 nt, Homo sapiens
cgauagcacggaccaauua

SEQ ID NO: 444302 - RNA, 19 nt, Homo sapiens
aauaaagacuccuguggaa

SEQ ID NO: 444303 - RNA, 19 nt, Homo sapiens
gcaaagaagcuccgucuac

SEQ ID NO: 444304 - RNA, 19 nt, Homo sapiens
ggaacgacgacucugauuu

SEQ ID NO: 444305 - RNA, 19 nt, Homo sapiens
ccaagaacccaacagauug

SEQ ID NO: 444306 - RNA, 19 nt, Homo sapiens
gaacgacgacucugauuuu

SEQ ID NO: 444307 - RNA, 19 nt, Homo sapiens
ggacuacauuucccaagag

SEQ ID NO: 444308 - RNA, 19 nt, Homo sapiens
aggcucagaucgaccaaua

SEQ ID NO: 444309 - RNA, 19 nt, Homo sapiens
gggagugauuggucuauuc

SEQ ID NO: 444310 - RNA, 19 nt, Homo sapiens
ggucuucgcccacugcaaa

SEQ ID NO: 444311 - RNA, 19 nt, Homo sapiens
gagccacgccuucuaggaa

SEQ ID NO: 444312 - RNA, 19 nt, Homo sapiens
ggccugagcuuggauuuac

SEQ ID NO: 444313 - RNA, 19 nt, Homo sapiens
uacaagacgguuccaauuu

SEQ ID NO: 444314 - RNA, 19 nt, Homo sapiens
gcucagaucgaccaauaug

SEQ ID NO: 444315 - RNA, 19 nt, Homo sapiens
gggagcagacggaacguuu

SEQ ID NO: 444316 - RNA, 19 nt, Homo sapiens
cccaagaacccaacagauu

SEQ ID NO: 444317 - RNA, 19 nt, Homo sapiens
ugagccacaucaaagcuaa

SEQ ID NO: 444318 - RNA, 19 nt, Homo sapiens
ccaucucucucaggguuua

SEQ ID NO: 444319 - RNA, 19 nt, Homo sapiens
uuacaagacgguuccaauu

SEQ ID NO: 444320 - RNA, 19 nt, Homo sapiens
gaccuacgacuccgacuug

SEQ ID NO: 444321 - RNA, 19 nt, Homo sapiens
ggauggagccaacccuuuc

SEQ ID NO: 444322 - RNA, 19 nt, Homo sapiens
uagggacucugcgcuaauu

SEQ ID NO: 444323 - RNA, 19 nt, Homo sapiens
caaagccaaagccgaauga

SEQ ID NO: 444324 - RNA, 19 nt, Homo sapiens
gguagaagaccucguggau

SEQ ID NO: 444325 - RNA, 19 nt, Homo sapiens
ucucaggguuuaccgcaaa

SEQ ID NO: 444326 - RNA, 19 nt, Homo sapiens
acaagacgguuccaauuuu

SEQ ID NO: 444327 - RNA, 19 nt, Homo sapiens
ggacagugccucgauagca

SEQ ID NO: 444328 - RNA, 19 nt, Homo sapiens
ggagugauuggucuauuca

SEQ ID NO: 444329 - RNA, 19 nt, Homo sapiens
caagcuggcccuccucuuc

SEQ ID NO: 444330 - RNA, 19 nt, Homo sapiens
guagaagaccucguggauu

SEQ ID NO: 444331 - RNA, 19 nt, Homo sapiens
ucuccuacaucgccuuuga

SEQ ID NO: 444332 - RNA, 19 nt, Homo sapiens
gagcgaccaggacuacauu

SEQ ID NO: 444333 - RNA, 19 nt, Homo sapiens
gagggaacgacgacucuga

SEQ ID NO: 444334 - RNA, 19 nt, Homo sapiens
uagcacggaccaauuagaa

SEQ ID NO: 444335 - RNA, 19 nt, Homo sapiens
ugguuugacucuucucauu

SEQ ID NO: 444336 - RNA, 19 nt, Homo sapiens
uggcggaccugcuguacug

SEQ ID NO: 444337 - RNA, 19 nt, Homo sapiens
ggaagaacuggaccuacga

SEQ ID NO: 444338 - RNA, 19 nt, Homo sapiens
agccaaagccgaaugagaa

SEQ ID NO: 444339 - RNA, 19 nt, Homo sapiens
gcuaagauccgagcuaaaa

SEQ ID NO: 444340 - RNA, 19 nt, Homo sapiens
ucagaucgaccaauaugug

SEQ ID NO: 444341 - RNA, 19 nt, Homo sapiens
gagcagacggaacguuugu

SEQ ID NO: 444342 - RNA, 19 nt, Homo sapiens
gggauggagccaacccuuu

SEQ ID NO: 444343 - RNA, 19 nt, Homo sapiens
guuaaagacaucauugcuu

SEQ ID NO: 444344 - RNA, 19 nt, Homo sapiens
caagacgguuccaauuuug

SEQ ID NO: 444345 - RNA, 19 nt, Homo sapiens
uaaagacuccuguggaaaa

SEQ ID NO: 444346 - RNA, 19 nt, Homo sapiens
ccacaucaaagcuaagauc

SEQ ID NO: 444347 - RNA, 19 nt, Homo sapiens
ccucguggauucccucaag

SEQ ID NO: 444348 - RNA, 19 nt, Homo sapiens
ggagcagacggaacguuug

SEQ ID NO: 444349 - RNA, 19 nt, Homo sapiens
cuucgugggugccaucuuc

SEQ ID NO: 444350 - RNA, 19 nt, Homo sapiens
ggucuucacaggccugaug

SEQ ID NO: 444351 - RNA, 19 nt, Homo sapiens
ggaccuacgacuccgacuu

SEQ ID NO: 444352 - RNA, 19 nt, Homo sapiens
aggacuacauuucccaaga

SEQ ID NO: 444353 - RNA, 19 nt, Homo sapiens
gcccuccucuucuacaucu

SEQ ID NO: 444354 - RNA, 19 nt, Homo sapiens
guuugacucuucucauucu

SEQ ID NO: 444355 - RNA, 19 nt, Homo sapiens
gggaacgacgacucugauu

SEQ ID NO: 444356 - RNA, 19 nt, Homo sapiens
gagccgauauggggaguaa

SEQ ID NO: 444357 - RNA, 19 nt, Homo sapiens
uggaaugguuaaagacauc

SEQ ID NO: 444358 - RNA, 19 nt, Homo sapiens
ucuaggaacagcuauggaa

SEQ ID NO: 444359 - RNA, 19 nt, Homo sapiens
acuagggacucugcgcuaa

SEQ ID NO: 444360 - RNA, 19 nt, Homo sapiens
caacuccugauuccacaga

SEQ ID NO: 444361 - RNA, 19 nt, Homo sapiens
ccaucccgaucgcgagauu

SEQ ID NO: 444362 - RNA, 19 nt, Homo sapiens
gucaggaucacucccacua

SEQ ID NO: 444363 - RNA, 19 nt, Homo sapiens
aggaacagcuauggaaugg

SEQ ID NO: 444364 - RNA, 19 nt, Homo sapiens
ggagccacgccuucuagga

SEQ ID NO: 444365 - RNA, 19 nt, Homo sapiens
ggagcgagagccaguaagg

SEQ ID NO: 444366 - RNA, 19 nt, Homo sapiens
ccaaucaguugagccacau

SEQ ID NO: 444367 - RNA, 19 nt, Homo sapiens
ggacuuguaguugccuaga

SEQ ID NO: 444368 - RNA, 19 nt, Homo sapiens
cgacgacucugauuuucga

SEQ ID NO: 444369 - RNA, 19 nt, Homo sapiens
ccaaagccaaagccgaaug

SEQ ID NO: 444370 - RNA, 19 nt, Homo sapiens
uaggaacagcuauggaaug

SEQ ID NO: 444371 - RNA, 19 nt, Homo sapiens
cgaagagccauugcuggaa

SEQ ID NO: 444372 - RNA, 19 nt, Homo sapiens
cgccuuugaugguguagug

SEQ ID NO: 444373 - RNA, 19 nt, Homo sapiens
cggaccugcuguacuggaa

SEQ ID NO: 444374 - RNA, 19 nt, Homo sapiens
gcgaccaggacuacauuuc

SEQ ID NO: 444375 - RNA, 19 nt, Homo sapiens
gguuugacucuucucauuc

SEQ ID NO: 444376 - RNA, 19 nt, Homo sapiens
gauagcacggaccaauuag

SEQ ID NO: 444377 - RNA, 19 nt, Homo sapiens
gaacaucucuucuucuuca

SEQ ID NO: 444378 - RNA, 19 nt, Homo sapiens
uaaagcaucuggaaaggua

SEQ ID NO: 444379 - RNA, 19 nt, Homo sapiens
gaugacagauccauaaaga

SEQ ID NO: 444380 - RNA, 19 nt, Homo sapiens
acgcauagcuaauacuuua

SEQ ID NO: 444381 - RNA, 19 nt, Homo sapiens
gcacuaacaucagcucauu

SEQ ID NO: 444382 - RNA, 19 nt, Homo sapiens
gacaguagcauuagaauug

SEQ ID NO: 444383 - RNA, 19 nt, Homo sapiens
aaccagaccuguaguagua

SEQ ID NO: 444384 - RNA, 19 nt, Homo sapiens
ugacggagcuuguguccaa

SEQ ID NO: 444385 - RNA, 19 nt, Homo sapiens
gaguagagagguagaauuu

SEQ ID NO: 444386 - RNA, 19 nt, Homo sapiens
caacaaggacugccugauu

SEQ ID NO: 444387 - RNA, 19 nt, Homo sapiens
gaaauccggguucgaauga

SEQ ID NO: 444388 - RNA, 19 nt, Homo sapiens
gcacgguguuucccaagaa

SEQ ID NO: 444389 - RNA, 19 nt, Homo sapiens
gugggacaaucuuuaauuu

SEQ ID NO: 444390 - RNA, 19 nt, Homo sapiens
gcaaggaccugaccuacac

SEQ ID NO: 444391 - RNA, 19 nt, Homo sapiens
aaagauagcacuaacauca

SEQ ID NO: 444392 - RNA, 19 nt, Homo sapiens
gcaaggaccggaacgagaa

SEQ ID NO: 444393 - RNA, 19 nt, Homo sapiens
ggagugacaucuucaucug

SEQ ID NO: 444394 - RNA, 19 nt, Homo sapiens
ucaaaugccuggaacaucu

SEQ ID NO: 444395 - RNA, 19 nt, Homo sapiens
guaagcaaguacauaagga

SEQ ID NO: 444396 - RNA, 19 nt, Homo sapiens
ugacagauccauaaagaga

SEQ ID NO: 444397 - RNA, 19 nt, Homo sapiens
gaaaaugucuaaagcaucu

SEQ ID NO: 444398 - RNA, 19 nt, Homo sapiens
gaggguggccuguugguuu

SEQ ID NO: 444399 - RNA, 19 nt, Homo sapiens
ccucauguauacuuggaua

SEQ ID NO: 444400 - RNA, 19 nt, Homo sapiens
ccuaagagauguguuguca

SEQ ID NO: 444401 - RNA, 19 nt, Homo sapiens
uaaaauacaucgccauuca

SEQ ID NO: 444402 - RNA, 19 nt, Homo sapiens
uuucuucccuuucgaguaa

SEQ ID NO: 444403 - RNA, 19 nt, Homo sapiens
ggacaguagcauuagaauu

SEQ ID NO: 444404 - RNA, 19 nt, Homo sapiens
gcggagcgguuaccagugu

SEQ ID NO: 444405 - RNA, 19 nt, Homo sapiens
gcaggugugugguguaaac

SEQ ID NO: 444406 - RNA, 19 nt, Homo sapiens
aacaaggacugccugauug

SEQ ID NO: 444407 - RNA, 19 nt, Homo sapiens
gaaagcuucguccgagaaa

SEQ ID NO: 444408 - RNA, 19 nt, Homo sapiens
guugucacccuccuuauuu

SEQ ID NO: 444409 - RNA, 19 nt, Homo sapiens
uggaacaucucuucuucuu

SEQ ID NO: 444410 - RNA, 19 nt, Homo sapiens
uuaaagccuugcucuguug

SEQ ID NO: 444411 - RNA, 19 nt, Homo sapiens
uaccaauccaguucaauua

SEQ ID NO: 444412 - RNA, 19 nt, Homo sapiens
caucggccuuguaguugua

SEQ ID NO: 444413 - RNA, 19 nt, Homo sapiens
aacaugagcugcccucugu

SEQ ID NO: 444414 - RNA, 19 nt, Homo sapiens
gauggacaguagcauuaga

SEQ ID NO: 444415 - RNA, 19 nt, Homo sapiens
ggacgcauagcuaauacuu

SEQ ID NO: 444416 - RNA, 19 nt, Homo sapiens
ggacccagccuuugucagu

SEQ ID NO: 444417 - RNA, 19 nt, Homo sapiens
gcucuguuguguccuguug

SEQ ID NO: 444418 - RNA, 19 nt, Homo sapiens
ggugggacaaucuuuaauu

SEQ ID NO: 444419 - RNA, 19 nt, Homo sapiens
gaacgccugcucugguuga

SEQ ID NO: 444420 - RNA, 19 nt, Homo sapiens
ggcgcaagcugguguguca

SEQ ID NO: 444421 - RNA, 19 nt, Homo sapiens
gagaguaaagauaagagaa

SEQ ID NO: 444422 - RNA, 19 nt, Homo sapiens
gggaagaaaguguccauuc

SEQ ID NO: 444423 - RNA, 19 nt, Homo sapiens
uaaauuugcuucguguaag

SEQ ID NO: 444424 - RNA, 19 nt, Homo sapiens
ggagugaagaugccacaga

SEQ ID NO: 444425 - RNA, 19 nt, Homo sapiens
gacauggacaccaaacauu

SEQ ID NO: 444426 - RNA, 19 nt, Homo sapiens
ggugugugguguaaacaug

SEQ ID NO: 444427 - RNA, 19 nt, Homo sapiens
gggacaaucuuuaauuuuc

SEQ ID NO: 444428 - RNA, 19 nt, Homo sapiens
ccaagcggaucccacacuu

SEQ ID NO: 444429 - RNA, 19 nt, Homo sapiens
gagaaaaugucuaaagcau

SEQ ID NO: 444430 - RNA, 19 nt, Homo sapiens
ccaauccaguucaauuaag

SEQ ID NO: 444431 - RNA, 19 nt, Homo sapiens
agguugaacucgccucuuu

SEQ ID NO: 444432 - RNA, 19 nt, Homo sapiens
gcgccaucguccucuuuaa

SEQ ID NO: 444433 - RNA, 19 nt, Homo sapiens
agaccuacguggaggcaaa

SEQ ID NO: 444434 - RNA, 19 nt, Homo sapiens
ggcugggacuguuucguuu

SEQ ID NO: 444435 - RNA, 19 nt, Homo sapiens
ggacccuccuuuggugaaa

SEQ ID NO: 444436 - RNA, 19 nt, Homo sapiens
ucgcagacauggacaccaa

SEQ ID NO: 444437 - RNA, 19 nt, Homo sapiens
gcaagcuggugugucauca

SEQ ID NO: 444438 - RNA, 19 nt, Homo sapiens
gaacggggcuuuuguuucc

SEQ ID NO: 444439 - RNA, 19 nt, Homo sapiens
ccuggaacaucucuucuuc

SEQ ID NO: 444440 - RNA, 19 nt, Homo sapiens
gcauuagaauuguggaaaa

SEQ ID NO: 444441 - RNA, 19 nt, Homo sapiens
ggugaaauccggguucgaa

SEQ ID NO: 444442 - RNA, 19 nt, Homo sapiens
guaguaguauuaccaaucc

SEQ ID NO: 444443 - RNA, 19 nt, Homo sapiens
uuuaaagccuugcucuguu

SEQ ID NO: 444444 - RNA, 19 nt, Homo sapiens
ccagaccuguaguaguauu

SEQ ID NO: 444445 - RNA, 19 nt, Homo sapiens
gggcugggacuguuucguu

SEQ ID NO: 444446 - RNA, 19 nt, Homo sapiens
ccaguucaauuaaggugau

SEQ ID NO: 444447 - RNA, 19 nt, Homo sapiens
gcaggagggugcagguacu

SEQ ID NO: 444448 - RNA, 19 nt, Homo sapiens
gacccugucaccaacauuu

SEQ ID NO: 444449 - RNA, 19 nt, Homo sapiens
ucaauggcguccucaaggu

SEQ ID NO: 444450 - RNA, 19 nt, Homo sapiens
cuugggaacuuugucguuu

SEQ ID NO: 444451 - RNA, 19 nt, Homo sapiens
cgaacgacccugucaccaa

SEQ ID NO: 444452 - RNA, 19 nt, Homo sapiens
gaggagaaacaaaauauga

SEQ ID NO: 444453 - RNA, 19 nt, Homo sapiens
acauggacaccaaacauuu

SEQ ID NO: 444454 - RNA, 19 nt, Homo sapiens
uuaccaauccaguucaauu

SEQ ID NO: 444455 - RNA, 19 nt, Homo sapiens
ucucaucggccuuguaguu

SEQ ID NO: 444456 - RNA, 19 nt, Homo sapiens
auacaucgccauucaguuc

SEQ ID NO: 444457 - RNA, 19 nt, Homo sapiens
guacgauugucucugaaac

SEQ ID NO: 444458 - RNA, 19 nt, Homo sapiens
cuaaagauagcacuaacau

SEQ ID NO: 444459 - RNA, 19 nt, Homo sapiens
gaccugcagccaucuguga

SEQ ID NO: 444460 - RNA, 19 nt, Homo sapiens
acacacccauugacaccuu

SEQ ID NO: 444461 - RNA, 19 nt, Homo sapiens
ccaagcagccgacaaacag

SEQ ID NO: 444462 - RNA, 19 nt, Homo sapiens
uugauggacaguagcauua

SEQ ID NO: 444463 - RNA, 19 nt, Homo sapiens
cagcugcauucucccauca

SEQ ID NO: 444464 - RNA, 19 nt, Homo sapiens
ccauaaagagaguaaagau

SEQ ID NO: 444465 - RNA, 19 nt, Homo sapiens
ugaguuagucgcagacaug

SEQ ID NO: 444466 - RNA, 19 nt, Homo sapiens
caauccaguucaauuaagg

SEQ ID NO: 444467 - RNA, 19 nt, Homo sapiens
aagcugcccugugcucuga

SEQ ID NO: 444468 - RNA, 19 nt, Homo sapiens
gagaggagaaacaaaauau

SEQ ID NO: 444469 - RNA, 19 nt, Homo sapiens
uccguacgauugucucuga

SEQ ID NO: 444470 - RNA, 19 nt, Homo sapiens
ugaaagcuucguccgagaa

SEQ ID NO: 444471 - RNA, 19 nt, Homo sapiens
gagauugaggugaaagcuu

SEQ ID NO: 444472 - RNA, 19 nt, Homo sapiens
ugaaauccggguucgaaug

SEQ ID NO: 444473 - RNA, 19 nt, Homo sapiens
acgcaggugugugguguaa

SEQ ID NO: 444474 - RNA, 19 nt, Homo sapiens
cagccgcagucuaggaaug

SEQ ID NO: 444475 - RNA, 19 nt, Homo sapiens
ccuuuggccugaguacuuu

SEQ ID NO: 444476 - RNA, 19 nt, Homo sapiens
cugaacgccugcucugguu

SEQ ID NO: 444477 - RNA, 19 nt, Homo sapiens
gcaaagaccuuacauacuc

SEQ ID NO: 444478 - RNA, 19 nt, Homo sapiens
caaaugacccugugacuaa

SEQ ID NO: 444479 - RNA, 19 nt, Homo sapiens
ggauagagacuugcaguua

SEQ ID NO: 444480 - RNA, 19 nt, Homo sapiens
cagauuaacucaacagugu

SEQ ID NO: 444481 - RNA, 19 nt, Homo sapiens
gcacuagccuucccagcuu

SEQ ID NO: 444482 - RNA, 19 nt, Homo sapiens
gggcaaucauucuguuuaa

SEQ ID NO: 444483 - RNA, 19 nt, Homo sapiens
ggacagaagcucaggcaaa

SEQ ID NO: 444484 - RNA, 19 nt, Homo sapiens
gauagagacuugcaguuag

SEQ ID NO: 444485 - RNA, 19 nt, Homo sapiens
ggaccuugcuuccuucuca

SEQ ID NO: 444486 - RNA, 19 nt, Homo sapiens
gaagaggaucccacacuuu

SEQ ID NO: 444487 - RNA, 19 nt, Homo sapiens
gauccuggccugagaauug

SEQ ID NO: 444488 - RNA, 19 nt, Homo sapiens
ccacugggcucucccuuuc

SEQ ID NO: 444489 - RNA, 19 nt, Homo sapiens
guacagggcagaaccaaga

SEQ ID NO: 444490 - RNA, 19 nt, Homo sapiens
gagcagagcgacgggcuua

SEQ ID NO: 444491 - RNA, 19 nt, Homo sapiens
gcaguuagacucaaagaag

SEQ ID NO: 444492 - RNA, 19 nt, Homo sapiens
gggcagaaccaagaacaua

SEQ ID NO: 444493 - RNA, 19 nt, Homo sapiens
ggagaaaguguaugcauca

SEQ ID NO: 444494 - RNA, 19 nt, Homo sapiens
ucacaccgauccauugaug

SEQ ID NO: 444495 - RNA, 19 nt, Homo sapiens
gcagaaccaagaacauaaa

SEQ ID NO: 444496 - RNA, 19 nt, Homo sapiens
cgaagaggaucccacacuu

SEQ ID NO: 444497 - RNA, 19 nt, Homo sapiens
gcaaacggcuaugugcaau

SEQ ID NO: 444498 - RNA, 19 nt, Homo sapiens
gcaaucauucuguuuaauc

SEQ ID NO: 444499 - RNA, 19 nt, Homo sapiens
cuucucaucuugccucauu

SEQ ID NO: 444500 - RNA, 19 nt, Homo sapiens
gacagaagcucaggcaaac

SEQ ID NO: 444501 - RNA, 19 nt, Homo sapiens
ccaaaugacccugugacua

SEQ ID NO: 444502 - RNA, 19 nt, Homo sapiens
ccacauuggcgcugucauu

SEQ ID NO: 444503 - RNA, 19 nt, Homo sapiens
gggcuuaauucgacccaau

SEQ ID NO: 444504 - RNA, 19 nt, Homo sapiens
ggcagaaccaagaacauaa

SEQ ID NO: 444505 - RNA, 19 nt, Homo sapiens
gaggagcacacauccaaga

SEQ ID NO: 444506 - RNA, 19 nt, Homo sapiens
ggaguaggagccaucuuug

SEQ ID NO: 444507 - RNA, 19 nt, Homo sapiens
ccugggaccucuucgguau

SEQ ID NO: 444508 - RNA, 19 nt, Homo sapiens
gagaccuacugcaaacaga

SEQ ID NO: 444509 - RNA, 19 nt, Homo sapiens
cagcuaauccuccgaucaa

SEQ ID NO: 444510 - RNA, 19 nt, Homo sapiens
aggaaccgaucugcuauuu

SEQ ID NO: 444511 - RNA, 19 nt, Homo sapiens
gcaagggcuucuucaaacg

SEQ ID NO: 444512 - RNA, 19 nt, Homo sapiens
auagagacuugcaguuaga

SEQ ID NO: 444513 - RNA, 19 nt, Homo sapiens
gaguaggagccaucuuuga

SEQ ID NO: 444514 - RNA, 19 nt, Homo sapiens
caaagaccuuacauacucu

SEQ ID NO: 444515 - RNA, 19 nt, Homo sapiens
gggaugguuucacgagugu

SEQ ID NO: 444516 - RNA, 19 nt, Homo sapiens
gaagcucaggcaaacacua

SEQ ID NO: 444517 - RNA, 19 nt, Homo sapiens
ugugaagccaccagucuua

SEQ ID NO: 444518 - RNA, 19 nt, Homo sapiens
uguaggaaccgaucugcua

SEQ ID NO: 444519 - RNA, 19 nt, Homo sapiens
ccauuggccuuaagugucu

SEQ ID NO: 444520 - RNA, 19 nt, Homo sapiens
ugagggcaaucauucuguu

SEQ ID NO: 444521 - RNA, 19 nt, Homo sapiens
gcagagcgacgggcuuaau

SEQ ID NO: 444522 - RNA, 19 nt, Homo sapiens
ccgcaaagaccuuacauac

SEQ ID NO: 444523 - RNA, 19 nt, Homo sapiens
agccagggaucaugucuug

SEQ ID NO: 444524 - RNA, 19 nt, Homo sapiens
ccagguugacuaagaaaug

SEQ ID NO: 444525 - RNA, 19 nt, Homo sapiens
caguuagacucaaagaagu

SEQ ID NO: 444526 - RNA, 19 nt, Homo sapiens
gaucaauccuugggaaucc

SEQ ID NO: 444527 - RNA, 19 nt, Homo sapiens
caucgacaccuuccucaug

SEQ ID NO: 444528 - RNA, 19 nt, Homo sapiens
caaacgcaccauccgcaaa

SEQ ID NO: 444529 - RNA, 19 nt, Homo sapiens
aaacggcuaugugcaaucu

SEQ ID NO: 444530 - RNA, 19 nt, Homo sapiens
guaggaaccgaucugcuau

SEQ ID NO: 444531 - RNA, 19 nt, Homo sapiens
gaggacugguugucucucu

SEQ ID NO: 444532 - RNA, 19 nt, Homo sapiens
uuaagugucuagagcaucu

SEQ ID NO: 444533 - RNA, 19 nt, Homo sapiens
gagcagcagggacgguuug

SEQ ID NO: 444534 - RNA, 19 nt, Homo sapiens
ggacugguugucucucuuc

SEQ ID NO: 444535 - RNA, 19 nt, Homo sapiens
ggcaaucauucuguuuaau

SEQ ID NO: 444536 - RNA, 19 nt, Homo sapiens
ugcaagggcuucuucaaac

SEQ ID NO: 444537 - RNA, 19 nt, Homo sapiens
ggcaaacggcuaugugcaa

SEQ ID NO: 444538 - RNA, 19 nt, Homo sapiens
gagggcaaucauucuguuu

SEQ ID NO: 444539 - RNA, 19 nt, Homo sapiens
ccucauugccuccuucuca

SEQ ID NO: 444540 - RNA, 19 nt, Homo sapiens
gcugauggacaugagagua

SEQ ID NO: 444541 - RNA, 19 nt, Homo sapiens
cagagcgacgggcuuaauu

SEQ ID NO: 444542 - RNA, 19 nt, Homo sapiens
ccggaggccuucccuuuac

SEQ ID NO: 444543 - RNA, 19 nt, Homo sapiens
cccggaggccuucccuuua

SEQ ID NO: 444544 - RNA, 19 nt, Homo sapiens
uuucccagguugacuaaga

SEQ ID NO: 444545 - RNA, 19 nt, Homo sapiens
gacaugaggauggacaaga

SEQ ID NO: 444546 - RNA, 19 nt, Homo sapiens
aggaguaggagccaucuuu

SEQ ID NO: 444547 - RNA, 19 nt, Homo sapiens
ggcagagcuugcuguggaa

SEQ ID NO: 444548 - RNA, 19 nt, Homo sapiens
gaugugaagccaccagucu

SEQ ID NO: 444549 - RNA, 19 nt, Homo sapiens
gcaggcggagaacaacaaa

SEQ ID NO: 444550 - RNA, 19 nt, Homo sapiens
gauuaacucaacaguguca

SEQ ID NO: 444551 - RNA, 19 nt, Homo sapiens
guaggagccaucuuugauc

SEQ ID NO: 444552 - RNA, 19 nt, Homo sapiens
ccauucagcaggaguagga

SEQ ID NO: 444553 - RNA, 19 nt, Homo sapiens
cacauuggcgcugucauuu

SEQ ID NO: 444554 - RNA, 19 nt, Homo sapiens
guacugccgcuaucagaag

SEQ ID NO: 444555 - RNA, 19 nt, Homo sapiens
uugcaagggcuucuucaaa

SEQ ID NO: 444556 - RNA, 19 nt, Homo sapiens
caccgcaacucagcccauu

SEQ ID NO: 444557 - RNA, 19 nt, Homo sapiens
acaccgauccauugauguu

SEQ ID NO: 444558 - RNA, 19 nt, Homo sapiens
gcgaagaggaucccacacu

SEQ ID NO: 444559 - RNA, 19 nt, Homo sapiens
aauccaggccagagucuuu

SEQ ID NO: 444560 - RNA, 19 nt, Homo sapiens
gcuaauccuccgaucaauc

SEQ ID NO: 444561 - RNA, 19 nt, Homo sapiens
gguggcaggcggagaacaa

SEQ ID NO: 444562 - RNA, 19 nt, Homo sapiens
gaaguacagggcagaacca

SEQ ID NO: 444563 - RNA, 19 nt, Homo sapiens
caaucauucuguuuaaucc

SEQ ID NO: 444564 - RNA, 19 nt, Homo sapiens
gagguggguguuugggaaa

SEQ ID NO: 444565 - RNA, 19 nt, Homo sapiens
gauuuggggugauuucuca

SEQ ID NO: 444566 - RNA, 19 nt, Homo sapiens
cagcuauucacgcuuguug

SEQ ID NO: 444567 - RNA, 19 nt, Homo sapiens
cggaaccgcugucaguacu

SEQ ID NO: 444568 - RNA, 19 nt, Homo sapiens
cauuggcgcugucauuuug

SEQ ID NO: 444569 - RNA, 19 nt, Homo sapiens
ugaaggggcugguggagau

SEQ ID NO: 444570 - RNA, 19 nt, Homo sapiens
ccaagcugauggacaugag

SEQ ID NO: 444571 - RNA, 19 nt, Homo sapiens
caucugaagaguggaaaug

SEQ ID NO: 444572 - RNA, 19 nt, Homo sapiens
agggcaaucauucuguuua

SEQ ID NO: 444573 - RNA, 19 nt, Homo sapiens
ucacgugcaccgcaacuca

SEQ ID NO: 444574 - RNA, 19 nt, Homo sapiens
cugcgucccuucucuuugg

SEQ ID NO: 444575 - RNA, 19 nt, Homo sapiens
acaccuuccucauggagau

SEQ ID NO: 444576 - RNA, 19 nt, Homo sapiens
gugucuagagcaucuguuu

SEQ ID NO: 444577 - RNA, 19 nt, Homo sapiens
uaacugagcugguuuccaa

SEQ ID NO: 444578 - RNA, 19 nt, Homo sapiens
gaacaugaacugacgagua

SEQ ID NO: 444579 - RNA, 19 nt, Homo sapiens
gagagaggcgguaauauuu

SEQ ID NO: 444580 - RNA, 19 nt, Homo sapiens
gagggaagcugugcaagaa

SEQ ID NO: 444581 - RNA, 19 nt, Homo sapiens
gaguaaacauguauggaaa

SEQ ID NO: 444582 - RNA, 19 nt, Homo sapiens
gcgaugaccacucuuguua

SEQ ID NO: 444583 - RNA, 19 nt, Homo sapiens
aauaaagacugccucauug

SEQ ID NO: 444584 - RNA, 19 nt, Homo sapiens
ggaaggaccucaucuacac

SEQ ID NO: 444585 - RNA, 19 nt, Homo sapiens
ugaaagacaugcagaugga

SEQ ID NO: 444586 - RNA, 19 nt, Homo sapiens
gaacugacgaguaaacaug

SEQ ID NO: 444587 - RNA, 19 nt, Homo sapiens
aacaugaacugacgaguaa

SEQ ID NO: 444588 - RNA, 19 nt, Homo sapiens
caaaugacccuguuaccaa

SEQ ID NO: 444589 - RNA, 19 nt, Homo sapiens
gagcaccucuucuucuuca

SEQ ID NO: 444590 - RNA, 19 nt, Homo sapiens
uaauaaagacugccucauu

SEQ ID NO: 444591 - RNA, 19 nt, Homo sapiens
cgagagaggcgguaauauu

SEQ ID NO: 444592 - RNA, 19 nt, Homo sapiens
gggaagcugugcaagaaga

SEQ ID NO: 444593 - RNA, 19 nt, Homo sapiens
uaucagaagugccuuguca

SEQ ID NO: 444594 - RNA, 19 nt, Homo sapiens
ggaaauuauucucacuuca

SEQ ID NO: 444595 - RNA, 19 nt, Homo sapiens
gagaggcgguaauauuuag

SEQ ID NO: 444596 - RNA, 19 nt, Homo sapiens
ggaaugaauugcugauugc

SEQ ID NO: 444597 - RNA, 19 nt, Homo sapiens
aagcugaacuugcuguuga

SEQ ID NO: 444598 - RNA, 19 nt, Homo sapiens
uaaauguggucaacagugu

SEQ ID NO: 444599 - RNA, 19 nt, Homo sapiens
gcacaggagaggaacauga

SEQ ID NO: 444600 - RNA, 19 nt, Homo sapiens
gaacagccaggcagguuug

SEQ ID NO: 444601 - RNA, 19 nt, Homo sapiens
uggaaugaauugcugauug

SEQ ID NO: 444602 - RNA, 19 nt, Homo sapiens
gaagagggaagcugugcaa

SEQ ID NO: 444603 - RNA, 19 nt, Homo sapiens
acacgugucgggauaauaa

SEQ ID NO: 444604 - RNA, 19 nt, Homo sapiens
gagccauuguacucuuuaa

SEQ ID NO: 444605 - RNA, 19 nt, Homo sapiens
gaggcagauuccugacuaa

SEQ ID NO: 444606 - RNA, 19 nt, Homo sapiens
cgaguaaacauguauggaa

SEQ ID NO: 444607 - RNA, 19 nt, Homo sapiens
agaggcagauuccugacua

SEQ ID NO: 444608 - RNA, 19 nt, Homo sapiens
gcgagccauuguacucuuu

SEQ ID NO: 444609 - RNA, 19 nt, Homo sapiens
gaagcgaugaccacucuug

SEQ ID NO: 444610 - RNA, 19 nt, Homo sapiens
ccggaucucugguuaaaca

SEQ ID NO: 444611 - RNA, 19 nt, Homo sapiens
uaaggaaggaccucaucua

SEQ ID NO: 444612 - RNA, 19 nt, Homo sapiens
ggaacagccaggcagguuu

SEQ ID NO: 444613 - RNA, 19 nt, Homo sapiens
agagaggcgguaauauuua

SEQ ID NO: 444614 - RNA, 19 nt, Homo sapiens
gaaguuucccgcaggcuau

SEQ ID NO: 444615 - RNA, 19 nt, Homo sapiens
auggagaacucgacaaaug

SEQ ID NO: 444616 - RNA, 19 nt, Homo sapiens
ucucugaccucaccuugga

SEQ ID NO: 444617 - RNA, 19 nt, Homo sapiens
ggagaggauucuagaagcu

SEQ ID NO: 444618 - RNA, 19 nt, Homo sapiens
ucaagaggacgauaaggaa

SEQ ID NO: 444619 - RNA, 19 nt, Homo sapiens
gcgguaauauuuagaagcu

SEQ ID NO: 444620 - RNA, 19 nt, Homo sapiens
ggauuggaaacaugaacua

SEQ ID NO: 444621 - RNA, 19 nt, Homo sapiens
gagcugguuuccaaaauga

SEQ ID NO: 444622 - RNA, 19 nt, Homo sapiens
ucuagaagcugaacuugcu

SEQ ID NO: 444623 - RNA, 19 nt, Homo sapiens
gaugaccacucuuguuagc

SEQ ID NO: 444624 - RNA, 19 nt, Homo sapiens
gccgagagaggcgguaaua

SEQ ID NO: 444625 - RNA, 19 nt, Homo sapiens
gcagaaguauccggaacag

SEQ ID NO: 444626 - RNA, 19 nt, Homo sapiens
gggcaggguggaaugaauu

SEQ ID NO: 444627 - RNA, 19 nt, Homo sapiens
gaucucugguuaaacacau

SEQ ID NO: 444628 - RNA, 19 nt, Homo sapiens
agaauccuauggugacaug

SEQ ID NO: 444629 - RNA, 19 nt, Homo sapiens
ggagaggaacaugaacuga

SEQ ID NO: 444630 - RNA, 19 nt, Homo sapiens
uggaaauuauucucacuuc

SEQ ID NO: 444631 - RNA, 19 nt, Homo sapiens
ugaacuugcuguugaacca

SEQ ID NO: 444632 - RNA, 19 nt, Homo sapiens
gaagcugaacuugcuguug

SEQ ID NO: 444633 - RNA, 19 nt, Homo sapiens
gauaaggaaggaccucauc

SEQ ID NO: 444634 - RNA, 19 nt, Homo sapiens
uggagcaccucuucuucuu

SEQ ID NO: 444635 - RNA, 19 nt, Homo sapiens
gagagcgagcugagaguga

SEQ ID NO: 444636 - RNA, 19 nt, Homo sapiens
ggacaucaagcccuuacca

SEQ ID NO: 444637 - RNA, 19 nt, Homo sapiens
ccaaagacagaauccuaug

SEQ ID NO: 444638 - RNA, 19 nt, Homo sapiens
ccacagggaagccaaugga

SEQ ID NO: 444639 - RNA, 19 nt, Homo sapiens
aaccaaagacagaauccua

SEQ ID NO: 444640 - RNA, 19 nt, Homo sapiens
aagacugccucauugacaa

SEQ ID NO: 444641 - RNA, 19 nt, Homo sapiens
ggccacggguuuacauguc

SEQ ID NO: 444642 - RNA, 19 nt, Homo sapiens
uggagaacucgacaaauga

SEQ ID NO: 444643 - RNA, 19 nt, Homo sapiens
ucagaagugccuugucaug

SEQ ID NO: 444644 - RNA, 19 nt, Homo sapiens
ggaaagcacuacgggguau

SEQ ID NO: 444645 - RNA, 19 nt, Homo sapiens
cgacaaaugacccuguuac

SEQ ID NO: 444646 - RNA, 19 nt, Homo sapiens
gauucuagaagcugaacuu

SEQ ID NO: 444647 - RNA, 19 nt, Homo sapiens
ggaagcugugcaagaagaa

SEQ ID NO: 444648 - RNA, 19 nt, Homo sapiens
gaggcgguaauauuuagaa

SEQ ID NO: 444649 - RNA, 19 nt, Homo sapiens
gaagcugugcaagaagaaa

SEQ ID NO: 444650 - RNA, 19 nt, Homo sapiens
cacaggagaggaacaugaa

SEQ ID NO: 444651 - RNA, 19 nt, Homo sapiens
gcaguucagaggacaucaa

SEQ ID NO: 444652 - RNA, 19 nt, Homo sapiens
acaugcagauggacaaguc

SEQ ID NO: 444653 - RNA, 19 nt, Homo sapiens
acaugaauauggagaacuc

SEQ ID NO: 444654 - RNA, 19 nt, Homo sapiens
auaaagacugccucauuga

SEQ ID NO: 444655 - RNA, 19 nt, Homo sapiens
aggaagcgaugaccacucu

SEQ ID NO: 444656 - RNA, 19 nt, Homo sapiens
caaagacagaauccuaugg

SEQ ID NO: 444657 - RNA, 19 nt, Homo sapiens
gaacuugcuguugaaccaa

SEQ ID NO: 444658 - RNA, 19 nt, Homo sapiens
ugaaugggccaagcguauu

SEQ ID NO: 444659 - RNA, 19 nt, Homo sapiens
ccuauggugacaugaauau

SEQ ID NO: 444660 - RNA, 19 nt, Homo sapiens
aaagacugccucauugaca

SEQ ID NO: 444661 - RNA, 19 nt, Homo sapiens
ucaacagugucagcaguuc

SEQ ID NO: 444662 - RNA, 19 nt, Homo sapiens
agagggaagcugugcaaga

SEQ ID NO: 444663 - RNA, 19 nt, Homo sapiens
cuacacgugucgggauaau

SEQ ID NO: 444664 - RNA, 19 nt, Homo sapiens
gcaccucuucuucuucaag

SEQ ID NO: 444665 - RNA, 19 nt, Homo sapiens
gcguuccauuggcuugaaa

SEQ ID NO: 444666 - RNA, 19 nt, Homo sapiens
guggagaggauucuagaag

SEQ ID NO: 444667 - RNA, 19 nt, Homo sapiens
caacagugucagcaguuca

SEQ ID NO: 444668 - RNA, 19 nt, Homo sapiens
acaccuuccucauggagau

SEQ ID NO: 444669 - RNA, 19 nt, Homo sapiens
ggagcaccucuucuucuuc

SEQ ID NO: 444670 - RNA, 19 nt, Homo sapiens
ccugggcucuccauaucga

SEQ ID NO: 444671 - RNA, 19 nt, Homo sapiens
uagcccaaguugaagaaag

SEQ ID NO: 444672 - RNA, 19 nt, Homo sapiens
cgagccauuguacucuuua

SEQ ID NO: 444673 - RNA, 19 nt, Homo sapiens
ugacaugaauauggagaac

SEQ ID NO: 444674 - RNA, 19 nt, Homo sapiens
ugagagugaggcagaaugu

SEQ ID NO: 444675 - RNA, 19 nt, Homo sapiens
aauugcugauugccucuuu

SEQ ID NO: 444676 - RNA, 19 nt, Homo sapiens
guuaccaacauaugucaug

SEQ ID NO: 444677 - RNA, 19 nt, Homo sapiens
caacuguccugaugaauua

SEQ ID NO: 444678 - RNA, 19 nt, Homo sapiens
gaaagaugguuaccgaaua

SEQ ID NO: 444679 - RNA, 19 nt, Homo sapiens
caaaguagauucugaaguu

SEQ ID NO: 444680 - RNA, 19 nt, Homo sapiens
ugacucaccuuuaaaguuu

SEQ ID NO: 444681 - RNA, 19 nt, Homo sapiens
ucacuacgcucuauccuuu

SEQ ID NO: 444682 - RNA, 19 nt, Homo sapiens
gaacucauauuucuaaggu

SEQ ID NO: 444683 - RNA, 19 nt, Homo sapiens
gaauucugcuuucguguuu

SEQ ID NO: 444684 - RNA, 19 nt, Homo sapiens
ggaaaugguuugucuucaa

SEQ ID NO: 444685 - RNA, 19 nt, Homo sapiens
ggaauuagccuaucuuagu

SEQ ID NO: 444686 - RNA, 19 nt, Homo sapiens
gaaaugcuuuagaaucuga

SEQ ID NO: 444687 - RNA, 19 nt, Homo sapiens
gauauugccuuacaugaau

SEQ ID NO: 444688 - RNA, 19 nt, Homo sapiens
gaagggaagucauccacaa

SEQ ID NO: 444689 - RNA, 19 nt, Homo sapiens
ggugaaggauauagcaaua

SEQ ID NO: 444690 - RNA, 19 nt, Homo sapiens
acacauggcuauucagauu

SEQ ID NO: 444691 - RNA, 19 nt, Homo sapiens
gaaauucaggugacaauga

SEQ ID NO: 444692 - RNA, 19 nt, Homo sapiens
gggcagaucuguaguaaac

SEQ ID NO: 444693 - RNA, 19 nt, Homo sapiens
gcacauuugucuuccagaa

SEQ ID NO: 444694 - RNA, 19 nt, Homo sapiens
gcagaacuuuauuauguga

SEQ ID NO: 444695 - RNA, 19 nt, Homo sapiens
gaauuagccuaucuuagug

SEQ ID NO: 444696 - RNA, 19 nt, Homo sapiens
gcagaucuguaguaaacaa

SEQ ID NO: 444697 - RNA, 19 nt, Homo sapiens
gaaaugguuugucuucaag

SEQ ID NO: 444698 - RNA, 19 nt, Homo sapiens
gaaaucuucuuccuauuac

SEQ ID NO: 444699 - RNA, 19 nt, Homo sapiens
agaucaagcuucugaaauu

SEQ ID NO: 444700 - RNA, 19 nt, Homo sapiens
ugacaaugaugcucacuga

SEQ ID NO: 444701 - RNA, 19 nt, Homo sapiens
aaacugcccuugcauggaa

SEQ ID NO: 444702 - RNA, 19 nt, Homo sapiens
aguccaagguugaauauaa

SEQ ID NO: 444703 - RNA, 19 nt, Homo sapiens
gaacuggaugacagcauua

SEQ ID NO: 444704 - RNA, 19 nt, Homo sapiens
ggguagagcuuuccuguac

SEQ ID NO: 444705 - RNA, 19 nt, Homo sapiens
ugaauuauuugcugugaug

SEQ ID NO: 444706 - RNA, 19 nt, Homo sapiens
gaucaagcuucugaaauuc

SEQ ID NO: 444707 - RNA, 19 nt, Homo sapiens
gaacaccgugccuuagaaa

SEQ ID NO: 444708 - RNA, 19 nt, Homo sapiens
cagauugccuguggaauga

SEQ ID NO: 444709 - RNA, 19 nt, Homo sapiens
gaggauaacucuaaaagau

SEQ ID NO: 444710 - RNA, 19 nt, Homo sapiens
gagaagaacgacuugagaa

SEQ ID NO: 444711 - RNA, 19 nt, Homo sapiens
gggaagucauccacaaaga

SEQ ID NO: 444712 - RNA, 19 nt, Homo sapiens
ugugagaaaugaccuuauu

SEQ ID NO: 444713 - RNA, 19 nt, Homo sapiens
uccagaaagugaacucaua

SEQ ID NO: 444714 - RNA, 19 nt, Homo sapiens
ccuuagaaaugcuuuagaa

SEQ ID NO: 444715 - RNA, 19 nt, Homo sapiens
ugucagggaugcuuuguau

SEQ ID NO: 444716 - RNA, 19 nt, Homo sapiens
gccaggaacugugucauug

SEQ ID NO: 444717 - RNA, 19 nt, Homo sapiens
gagcagacacgcccaacaa

SEQ ID NO: 444718 - RNA, 19 nt, Homo sapiens
uaacacaacgccaacagaa

SEQ ID NO: 444719 - RNA, 19 nt, Homo sapiens
gaugaauuauuugcuguga

SEQ ID NO: 444720 - RNA, 19 nt, Homo sapiens
ggauggcucuugaaagucu

SEQ ID NO: 444721 - RNA, 19 nt, Homo sapiens
gguuuguugugcaguaaua

SEQ ID NO: 444722 - RNA, 19 nt, Homo sapiens
gaaguuaugauacuaaugc

SEQ ID NO: 444723 - RNA, 19 nt, Homo sapiens
agacaaauuuccugcacuu

SEQ ID NO: 444724 - RNA, 19 nt, Homo sapiens
ugaacuggaugacagcauu

SEQ ID NO: 444725 - RNA, 19 nt, Homo sapiens
aaagaugguuaccgaauag

SEQ ID NO: 444726 - RNA, 19 nt, Homo sapiens
agacacagauauuuggaau

SEQ ID NO: 444727 - RNA, 19 nt, Homo sapiens
agacacagauauuuggaau

SEQ ID NO: 444728 - RNA, 19 nt, Homo sapiens
gaaguccaagguugaauau

SEQ ID NO: 444729 - RNA, 19 nt, Homo sapiens
gcaccuagaauaugcuaug

SEQ ID NO: 444730 - RNA, 19 nt, Homo sapiens
ggaauucugcuuucguguu

SEQ ID NO: 444731 - RNA, 19 nt, Homo sapiens
gaggagaggcccaaguuuc

SEQ ID NO: 444732 - RNA, 19 nt, Homo sapiens
ggauagagaagaacgacuu

SEQ ID NO: 444733 - RNA, 19 nt, Homo sapiens
cgaaguccaagguugaaua

SEQ ID NO: 444734 - RNA, 19 nt, Homo sapiens
aaauuagccuuucugugaa

SEQ ID NO: 444735 - RNA, 19 nt, Homo sapiens
guacagugccuaacagagu

SEQ ID NO: 444736 - RNA, 19 nt, Homo sapiens
gaugcucacugaaaguugu

SEQ ID NO: 444737 - RNA, 19 nt, Homo sapiens
caaugaugcucacugaaag

SEQ ID NO: 444738 - RNA, 19 nt, Homo sapiens
acaaugaugcucacugaaa

SEQ ID NO: 444739 - RNA, 19 nt, Homo sapiens
gcucuugaaagucugguua

SEQ ID NO: 444740 - RNA, 19 nt, Homo sapiens
ccauggugauauugccuua

SEQ ID NO: 444741 - RNA, 19 nt, Homo sapiens
uuaaagaucaagcuucuga

SEQ ID NO: 444742 - RNA, 19 nt, Homo sapiens
gcagacacgcccaacaaug

SEQ ID NO: 444743 - RNA, 19 nt, Homo sapiens
gugagaaaugaccuuauua

SEQ ID NO: 444744 - RNA, 19 nt, Homo sapiens
agaaaugaccuuauuaguc

SEQ ID NO: 444745 - RNA, 19 nt, Homo sapiens
gaauagcccagccaaucaa

SEQ ID NO: 444746 - RNA, 19 nt, Homo sapiens
guacacauggcuauucaga

SEQ ID NO: 444747 - RNA, 19 nt, Homo sapiens
uaaaagauguacuccaaga

SEQ ID NO: 444748 - RNA, 19 nt, Homo sapiens
gagaaaugaccuuauuagu

SEQ ID NO: 444749 - RNA, 19 nt, Homo sapiens
agacagacuuaauaaugug

SEQ ID NO: 444750 - RNA, 19 nt, Homo sapiens
gcugaucggucuugaugca

SEQ ID NO: 444751 - RNA, 19 nt, Homo sapiens
gaaaaggauugaacuggau

SEQ ID NO: 444752 - RNA, 19 nt, Homo sapiens
guagagcuuuccuguacug

SEQ ID NO: 444753 - RNA, 19 nt, Homo sapiens
ucacuacucugggaaaugg

SEQ ID NO: 444754 - RNA, 19 nt, Homo sapiens
gcuuuagaaucugaacuuu

SEQ ID NO: 444755 - RNA, 19 nt, Homo sapiens
ucaacuguccugaugaauu

SEQ ID NO: 444756 - RNA, 19 nt, Homo sapiens
aacacuagcagaacuauuu

SEQ ID NO: 444757 - RNA, 19 nt, Homo sapiens
gaaggaaaaugugcuacaa

SEQ ID NO: 444758 - RNA, 19 nt, Homo sapiens
caacuugacaguaaauucu

SEQ ID NO: 444759 - RNA, 19 nt, Homo sapiens
gaucuguaguaaacaaugg

SEQ ID NO: 444760 - RNA, 19 nt, Homo sapiens
caacagaagcacauuuguc

SEQ ID NO: 444761 - RNA, 19 nt, Homo sapiens
caagaaaaccgaauauuag

SEQ ID NO: 444762 - RNA, 19 nt, Homo sapiens
ccaauaauccacaggcaau

SEQ ID NO: 444763 - RNA, 19 nt, Homo sapiens
gaucggucuugaugcagaa

SEQ ID NO: 444764 - RNA, 19 nt, Homo sapiens
ccacccagacgacucagua

SEQ ID NO: 444765 - RNA, 19 nt, Homo sapiens
agaacaccgugccuuagaa

SEQ ID NO: 444766 - RNA, 19 nt, Homo sapiens
cgaauagcccagccaauca

SEQ ID NO: 444767 - RNA, 19 nt, Homo sapiens
aaauucaggugacaaugau

SEQ ID NO: 444768 - RNA, 19 nt, Homo sapiens
aaagaucaagcuucugaaa

SEQ ID NO: 444769 - RNA, 19 nt, Homo sapiens
aaggcaaggugaaggauau

SEQ ID NO: 444770 - RNA, 19 nt, Homo sapiens
cagagcgggugcuugaguu

SEQ ID NO: 444771 - RNA, 19 nt, Homo sapiens
gggaaaugguuugucuuca

SEQ ID NO: 444772 - RNA, 19 nt, Homo sapiens
gauggccgcauaccugaaa

SEQ ID NO: 444773 - RNA, 19 nt, Homo sapiens
uuggauggcucuugaaagu

SEQ ID NO: 444774 - RNA, 19 nt, Homo sapiens
ccagaaagugaacucauau

SEQ ID NO: 444775 - RNA, 19 nt, Homo sapiens
gccaacagaagcacauuug

SEQ ID NO: 444776 - RNA, 19 nt, Homo sapiens
cagggaugcuuuguaucua

SEQ ID NO: 444777 - RNA, 19 nt, Homo sapiens
agacaaaccucaucaacua

SEQ ID NO: 444778 - RNA, 19 nt, Homo sapiens
caagagagauguugggauu

SEQ ID NO: 444779 - RNA, 19 nt, Homo sapiens
gcaaggaugucauugaaga

SEQ ID NO: 444780 - RNA, 19 nt, Homo sapiens
caagaacacuuauguggaa

SEQ ID NO: 444781 - RNA, 19 nt, Homo sapiens
gcacagcugucaccucuga

SEQ ID NO: 444782 - RNA, 19 nt, Homo sapiens
gaaauccaguuccugcuuu

SEQ ID NO: 444783 - RNA, 19 nt, Homo sapiens
ggaagagggugaagaggaa

SEQ ID NO: 444784 - RNA, 19 nt, Homo sapiens
gcgaugaccucuauuccua

SEQ ID NO: 444785 - RNA, 19 nt, Homo sapiens
gaacagaucaauaugcuau

SEQ ID NO: 444786 - RNA, 19 nt, Homo sapiens
gggagaagcuggcggagaa

SEQ ID NO: 444787 - RNA, 19 nt, Homo sapiens
ggaaacagcuggugaugac

SEQ ID NO: 444788 - RNA, 19 nt, Homo sapiens
ggacucgucuuccauugaa

SEQ ID NO: 444789 - RNA, 19 nt, Homo sapiens
gaagugugaugacaugaug

SEQ ID NO: 444790 - RNA, 19 nt, Homo sapiens
gaaagccgaugccgagaau

SEQ ID NO: 444791 - RNA, 19 nt, Homo sapiens
ggagaacggugaagcugaa

SEQ ID NO: 444792 - RNA, 19 nt, Homo sapiens
gggaauauccugagaauca

SEQ ID NO: 444793 - RNA, 19 nt, Homo sapiens
aagcuggacuccuucauua

SEQ ID NO: 444794 - RNA, 19 nt, Homo sapiens
gggcaaggaugucauugaa

SEQ ID NO: 444795 - RNA, 19 nt, Homo sapiens
caugauagaugaccuuuca

SEQ ID NO: 444796 - RNA, 19 nt, Homo sapiens
gaaccaccaagaacacuua

SEQ ID NO: 444797 - RNA, 19 nt, Homo sapiens
gcuccaugcucucugaaua

SEQ ID NO: 444798 - RNA, 19 nt, Homo sapiens
gaugacguguuaccuguuu

SEQ ID NO: 444799 - RNA, 19 nt, Homo sapiens
ggaacacgaccacuauuaa

SEQ ID NO: 444800 - RNA, 19 nt, Homo sapiens
gcagagaaauccuauacag

SEQ ID NO: 444801 - RNA, 19 nt, Homo sapiens
cacaagaccuguuccgauu

SEQ ID NO: 444802 - RNA, 19 nt, Homo sapiens
gcaaacuggaugaggauua

SEQ ID NO: 444803 - RNA, 19 nt, Homo sapiens
gaagaagaaggaagagaaa

SEQ ID NO: 444804 - RNA, 19 nt, Homo sapiens
gaagauguaccaagagaga

SEQ ID NO: 444805 - RNA, 19 nt, Homo sapiens
ggcagugacuacuuugaua

SEQ ID NO: 444806 - RNA, 19 nt, Homo sapiens
ggaugaaccugacaugaag

SEQ ID NO: 444807 - RNA, 19 nt, Homo sapiens
ugaaggagcugcuggaucu

SEQ ID NO: 444808 - RNA, 19 nt, Homo sapiens
ggacauuucucaggaguuc

SEQ ID NO: 444809 - RNA, 19 nt, Homo sapiens
gaagagauucgacaggauu

SEQ ID NO: 444810 - RNA, 19 nt, Homo sapiens
gcaaagagagcaacaccuu

SEQ ID NO: 444811 - RNA, 19 nt, Homo sapiens
gaacaugguguacuacuuc

SEQ ID NO: 444812 - RNA, 19 nt, Homo sapiens
gggaacacgaccacuauua

SEQ ID NO: 444813 - RNA, 19 nt, Homo sapiens
gggaauuucugcacaacaa

SEQ ID NO: 444814 - RNA, 19 nt, Homo sapiens
caacaaagucuucuaccaa

SEQ ID NO: 444815 - RNA, 19 nt, Homo sapiens
gaugaucagugccugcaaa

SEQ ID NO: 444816 - RNA, 19 nt, Homo sapiens
ugaaauuccugcagaugaa

SEQ ID NO: 444817 - RNA, 19 nt, Homo sapiens
caaccaagaucuuauuacu

SEQ ID NO: 444818 - RNA, 19 nt, Homo sapiens
aaacaaggaugagacagaa

SEQ ID NO: 444819 - RNA, 19 nt, Homo sapiens
caucaugggugacgcagaa

SEQ ID NO: 444820 - RNA, 19 nt, Homo sapiens
gacgaggccuccuggauga

SEQ ID NO: 444821 - RNA, 19 nt, Homo sapiens
ccaagaaggucgccaugau

SEQ ID NO: 444822 - RNA, 19 nt, Homo sapiens
accaagaucuuauuacuga

SEQ ID NO: 444823 - RNA, 19 nt, Homo sapiens
gaagcucgcucaggacuca

SEQ ID NO: 444824 - RNA, 19 nt, Homo sapiens
agaaugagaucaacaacau

SEQ ID NO: 444825 - RNA, 19 nt, Homo sapiens
gcacacagccgcauguauc

SEQ ID NO: 444826 - RNA, 19 nt, Homo sapiens
cccaggagcuacugaaauu

SEQ ID NO: 444827 - RNA, 19 nt, Homo sapiens
gaaccagcgcuccauguuu

SEQ ID NO: 444828 - RNA, 19 nt, Homo sapiens
gagagcgacuccaucuuga

SEQ ID NO: 444829 - RNA, 19 nt, Homo sapiens
ggaaagcacaggcuacaug

SEQ ID NO: 444830 - RNA, 19 nt, Homo sapiens
ccaagauccugcucccuuu

SEQ ID NO: 444831 - RNA, 19 nt, Homo sapiens
cggaagauaucacaaagug

SEQ ID NO: 444832 - RNA, 19 nt, Homo sapiens
gaacuccuagcuucucuaa

SEQ ID NO: 444833 - RNA, 19 nt, Homo sapiens
caagaggccuuaaggacau

SEQ ID NO: 444834 - RNA, 19 nt, Homo sapiens
cagaacaacugguccuaug

SEQ ID NO: 444835 - RNA, 19 nt, Homo sapiens
gcauagaccgccuaaaugu

SEQ ID NO: 444836 - RNA, 19 nt, Homo sapiens
uacaacaacuucuucuuug

SEQ ID NO: 444837 - RNA, 19 nt, Homo sapiens
gaugaugaauucacacaag

SEQ ID NO: 444838 - RNA, 19 nt, Homo sapiens
gaacaucaugaacaacaaa

SEQ ID NO: 444839 - RNA, 19 nt, Homo sapiens
agcacaaccuggccaauua

SEQ ID NO: 444840 - RNA, 19 nt, Homo sapiens
cgacaucaccuucuucuuc

SEQ ID NO: 444841 - RNA, 19 nt, Homo sapiens
cuacaacaacuucuucuuu

SEQ ID NO: 444842 - RNA, 19 nt, Homo sapiens
gaucagugccugcaaagga

SEQ ID NO: 444843 - RNA, 19 nt, Homo sapiens
ucacagagaacaccauuau

SEQ ID NO: 444844 - RNA, 19 nt, Homo sapiens
guucagcgguccagaaauc

SEQ ID NO: 444845 - RNA, 19 nt, Homo sapiens
uggauuaucuuaaggacaa

SEQ ID NO: 444846 - RNA, 19 nt, Homo sapiens
agaaacagauggagaagca

SEQ ID NO: 444847 - RNA, 19 nt, Homo sapiens
gaacaggagauuaaauucu

SEQ ID NO: 444848 - RNA, 19 nt, Homo sapiens
uuaacaaguuugcggagua

SEQ ID NO: 444849 - RNA, 19 nt, Homo sapiens
gaacaacaaagucuucuac

SEQ ID NO: 444850 - RNA, 19 nt, Homo sapiens
ggaacaucaugaacaacaa

SEQ ID NO: 444851 - RNA, 19 nt, Homo sapiens
gggagacgcucaagacucu

SEQ ID NO: 444852 - RNA, 19 nt, Homo sapiens
ggucaacugucuucacauc

SEQ ID NO: 444853 - RNA, 19 nt, Homo sapiens
gaacaacugguccuaugga

SEQ ID NO: 444854 - RNA, 19 nt, Homo sapiens
gaagggcugcuccagauga

SEQ ID NO: 444855 - RNA, 19 nt, Homo sapiens
ggaggaaacagcacaggaa

SEQ ID NO: 444856 - RNA, 19 nt, Homo sapiens
gaggacaaccugaagaaga

SEQ ID NO: 444857 - RNA, 19 nt, Homo sapiens
gagcgaggaugaggaugaa

SEQ ID NO: 444858 - RNA, 19 nt, Homo sapiens
gcacugcccugacggaaaa

SEQ ID NO: 444859 - RNA, 19 nt, Homo sapiens
aggaagagguggaagagaa

SEQ ID NO: 444860 - RNA, 19 nt, Homo sapiens
gggcagucguggccuguuu

SEQ ID NO: 444861 - RNA, 19 nt, Homo sapiens
gcacaacaaccuucaccuu

SEQ ID NO: 444862 - RNA, 19 nt, Homo sapiens
ggaggaggaugaggaggaa

SEQ ID NO: 444863 - RNA, 19 nt, Homo sapiens
gcugguacuucgaguuuga

SEQ ID NO: 444864 - RNA, 19 nt, Homo sapiens
agacguauaugaugagcaa

SEQ ID NO: 444865 - RNA, 19 nt, Homo sapiens
guacauggccuaugcugau

SEQ ID NO: 444866 - RNA, 19 nt, Homo sapiens
ggaugaggauuaccuguac

SEQ ID NO: 444867 - RNA, 19 nt, Homo sapiens
gguugacgcuuccuucaug

SEQ ID NO: 444868 - RNA, 19 nt, Homo sapiens
cggaggagcuguucaggau

SEQ ID NO: 444869 - RNA, 19 nt, Homo sapiens
gggaauggacgauagagaa

SEQ ID NO: 444870 - RNA, 19 nt, Homo sapiens
gaacccaacacuaagcuau

SEQ ID NO: 444871 - RNA, 19 nt, Homo sapiens
gcagagaacggcaaagaag

SEQ ID NO: 444872 - RNA, 19 nt, Homo sapiens
gcaccauccuguccucugu

SEQ ID NO: 444873 - RNA, 19 nt, Homo sapiens
cccggaagcuggaguuuga

SEQ ID NO: 444874 - RNA, 19 nt, Homo sapiens
ggccuaugcugauaucaug

SEQ ID NO: 444875 - RNA, 19 nt, Homo sapiens
ucgagaagaugguggagaa

SEQ ID NO: 444876 - RNA, 19 nt, Homo sapiens
caaaggguacccagacauu

SEQ ID NO: 444877 - RNA, 19 nt, Homo sapiens
gcaaauggcucuuuacaaa

SEQ ID NO: 444878 - RNA, 19 nt, Homo sapiens
ggaaagauguuauugauga

SEQ ID NO: 444879 - RNA, 19 nt, Homo sapiens
gaaagaugcuggaaauauu

SEQ ID NO: 444880 - RNA, 19 nt, Homo sapiens
ggacagaguucgcacagua

SEQ ID NO: 444881 - RNA, 19 nt, Homo sapiens
gcaaggagcuggugaggaa

SEQ ID NO: 444882 - RNA, 19 nt, Homo sapiens
gaauugagcuggaugaaga

SEQ ID NO: 444883 - RNA, 19 nt, Homo sapiens
gcaaggaacugagcacaua

SEQ ID NO: 444884 - RNA, 19 nt, Homo sapiens
gcaaacagaugguggauau

SEQ ID NO: 444885 - RNA, 19 nt, Homo sapiens
ugacauaucugaagaagaa

SEQ ID NO: 444886 - RNA, 19 nt, Homo sapiens
gaaggaaacugucugucua

SEQ ID NO: 444887 - RNA, 19 nt, Homo sapiens
gcaaagaguugucaugaug

SEQ ID NO: 444888 - RNA, 19 nt, Homo sapiens
ccaaagaccuacacgauaa

SEQ ID NO: 444889 - RNA, 19 nt, Homo sapiens
caacuuggcuaauuacuug

SEQ ID NO: 444890 - RNA, 19 nt, Homo sapiens
ggagaagccaucagaauua

SEQ ID NO: 444891 - RNA, 19 nt, Homo sapiens
gauauaauccgcagcaaua

SEQ ID NO: 444892 - RNA, 19 nt, Homo sapiens
guagaugugucucgaauaa

SEQ ID NO: 444893 - RNA, 19 nt, Homo sapiens
uacaauaucuugacccuua

SEQ ID NO: 444894 - RNA, 19 nt, Homo sapiens
gcaaacagcucguauuaac

SEQ ID NO: 444895 - RNA, 19 nt, Homo sapiens
guacugaacuccauugaug

SEQ ID NO: 444896 - RNA, 19 nt, Homo sapiens
gcaccacgcuucucucauu

SEQ ID NO: 444897 - RNA, 19 nt, Homo sapiens
ccacauggaugauggcaua

SEQ ID NO: 444898 - RNA, 19 nt, Homo sapiens
ggacaacgcugcagaggau

SEQ ID NO: 444899 - RNA, 19 nt, Homo sapiens
cauauaagcuauugucuga

SEQ ID NO: 444900 - RNA, 19 nt, Homo sapiens
gaaaucaaguucuuugcaa

SEQ ID NO: 444901 - RNA, 19 nt, Homo sapiens
gaaaugguacuaugaauug

SEQ ID NO: 444902 - RNA, 19 nt, Homo sapiens
gagcacaacuuggcuaauu

SEQ ID NO: 444903 - RNA, 19 nt, Homo sapiens
aaacaaagcugaaggucuu

SEQ ID NO: 444904 - RNA, 19 nt, Homo sapiens
gaacuucguuguacagaau

SEQ ID NO: 444905 - RNA, 19 nt, Homo sapiens
caacugagaccuucuauga

SEQ ID NO: 444906 - RNA, 19 nt, Homo sapiens
gaagaacaaagccagauua

SEQ ID NO: 444907 - RNA, 19 nt, Homo sapiens
gaaacugucugucuaaugg

SEQ ID NO: 444908 - RNA, 19 nt, Homo sapiens
gagaagaccuaauauugga

SEQ ID NO: 444909 - RNA, 19 nt, Homo sapiens
gagaacauuucccuuauga

SEQ ID NO: 444910 - RNA, 19 nt, Homo sapiens
gagaaacgauuugccuaua

SEQ ID NO: 444911 - RNA, 19 nt, Homo sapiens
ggagcgcaauuacaacuua

SEQ ID NO: 444912 - RNA, 19 nt, Homo sapiens
gcucaugauucguggauua

SEQ ID NO: 444913 - RNA, 19 nt, Homo sapiens
gaacucagacuggcaauaa

SEQ ID NO: 444914 - RNA, 19 nt, Homo sapiens
ccaaauagcggauccagua

SEQ ID NO: 444915 - RNA, 19 nt, Homo sapiens
caacaucgauggccucuuc

SEQ ID NO: 444916 - RNA, 19 nt, Homo sapiens
gauaugaaaugugacgaua

SEQ ID NO: 444917 - RNA, 19 nt, Homo sapiens
ggauaaauauggagaguuc

SEQ ID NO: 444918 - RNA, 19 nt, Homo sapiens
gcagagagcguccugaauu

SEQ ID NO: 444919 - RNA, 19 nt, Homo sapiens
gaaagaguauuggauauag

SEQ ID NO: 444920 - RNA, 19 nt, Homo sapiens
caacuaauguggaagaugu

SEQ ID NO: 444921 - RNA, 19 nt, Homo sapiens
gaggcaacguucugcauua

SEQ ID NO: 444922 - RNA, 19 nt, Homo sapiens
agaaugacuuggaagauua

SEQ ID NO: 444923 - RNA, 19 nt, Homo sapiens
caagaaagguguugggaau

SEQ ID NO: 444924 - RNA, 19 nt, Homo sapiens
cuuauuagcuguuguugua

SEQ ID NO: 444925 - RNA, 19 nt, Homo sapiens
cagagagcguccugaauua

SEQ ID NO: 444926 - RNA, 19 nt, Homo sapiens
gaacaaggacaacggaauu

SEQ ID NO: 444927 - RNA, 19 nt, Homo sapiens
gaaaugguguuggagauga

SEQ ID NO: 444928 - RNA, 19 nt, Homo sapiens
gaagauguaucaagaaagg

SEQ ID NO: 444929 - RNA, 19 nt, Homo sapiens
gacagcagcucccauagaa

SEQ ID NO: 444930 - RNA, 19 nt, Homo sapiens
ggaagaaaucguggaauua

SEQ ID NO: 444931 - RNA, 19 nt, Homo sapiens
agagagauaucuugacuuu

SEQ ID NO: 444932 - RNA, 19 nt, Homo sapiens
caaagaagcuacuaaacca

SEQ ID NO: 444933 - RNA, 19 nt, Homo sapiens
gcucagaacuggcuuucaa

SEQ ID NO: 444934 - RNA, 19 nt, Homo sapiens
ugacaucacuuucuucuuc

SEQ ID NO: 444935 - RNA, 19 nt, Homo sapiens
ggaaucaauuagugacuuu

SEQ ID NO: 444936 - RNA, 19 nt, Homo sapiens
gaugugggcuucuuucaga

SEQ ID NO: 444937 - RNA, 19 nt, Homo sapiens
ggcauaaacuacugucuaa

SEQ ID NO: 444938 - RNA, 19 nt, Homo sapiens
gaacaaagccagauuacag

SEQ ID NO: 444939 - RNA, 19 nt, Homo sapiens
gagaagaccuaugcaguga

SEQ ID NO: 444940 - RNA, 19 nt, Homo sapiens
gaaaagcaguuugcacuua

SEQ ID NO: 444941 - RNA, 19 nt, Homo sapiens
gauggcaaauggcucuuua

SEQ ID NO: 444942 - RNA, 19 nt, Homo sapiens
gcacuuacucagaagauua

SEQ ID NO: 444943 - RNA, 19 nt, Homo sapiens
gcacagccgucuugccauu

SEQ ID NO: 444944 - RNA, 19 nt, Homo sapiens
gaagagaagcucaugauuc

SEQ ID NO: 444945 - RNA, 19 nt, Homo sapiens
gaaaagcccucucgucuga

SEQ ID NO: 444946 - RNA, 19 nt, Homo sapiens
gaacgugccuuugccuuug

SEQ ID NO: 444947 - RNA, 19 nt, Homo sapiens
aaaggaggcucuucucauu

SEQ ID NO: 444948 - RNA, 19 nt, Homo sapiens
gaagauacgugcaugaaaa

SEQ ID NO: 444949 - RNA, 19 nt, Homo sapiens
guagaaagaguauuggaua

SEQ ID NO: 444950 - RNA, 19 nt, Homo sapiens
gcuauuagauggcaaaugg

SEQ ID NO: 444951 - RNA, 19 nt, Homo sapiens
cgauuuagccugaaagaua

SEQ ID NO: 444952 - RNA, 19 nt, Homo sapiens
caucagauuuccaucagua

SEQ ID NO: 444953 - RNA, 19 nt, Homo sapiens
ggaagaaaaucauagcaua

SEQ ID NO: 444954 - RNA, 19 nt, Homo sapiens
caugguggcugaaguguuu

SEQ ID NO: 444955 - RNA, 19 nt, Homo sapiens
caacaucaauugucaacug

SEQ ID NO: 444956 - RNA, 19 nt, Homo sapiens
gcagaacacucccaugaca

SEQ ID NO: 444957 - RNA, 19 nt, Homo sapiens
gaagagacuuguuauugca

SEQ ID NO: 444958 - RNA, 19 nt, Homo sapiens
gaaagguacuugcacuugu

SEQ ID NO: 444959 - RNA, 19 nt, Homo sapiens
gaaagauacugaggaugaa

SEQ ID NO: 444960 - RNA, 19 nt, Homo sapiens
gaacugagcacauacuauc

SEQ ID NO: 444961 - RNA, 19 nt, Homo sapiens
gaagauaaacugauagaag

SEQ ID NO: 444962 - RNA, 19 nt, Homo sapiens
caacaaagagaaagaaaug

SEQ ID NO: 444963 - RNA, 19 nt, Homo sapiens
cagcuucggugauggauaa

SEQ ID NO: 444964 - RNA, 19 nt, Homo sapiens
guaaagaacagaagaaauc

SEQ ID NO: 444965 - RNA, 19 nt, Homo sapiens
ugaauucucuguaugaguu

SEQ ID NO: 444966 - RNA, 19 nt, Homo sapiens
caccagauaugaaauguga

SEQ ID NO: 444967 - RNA, 19 nt, Homo sapiens
gaaagacagcuccuuauca

SEQ ID NO: 444968 - RNA, 19 nt, Homo sapiens
caacgaaggcggagagaaa

SEQ ID NO: 444969 - RNA, 19 nt, Homo sapiens
cagcugauccuucuguuua

SEQ ID NO: 444970 - RNA, 19 nt, Homo sapiens
ggaggaagaugacacuauc

SEQ ID NO: 444971 - RNA, 19 nt, Homo sapiens
aaagguaguucguuauuug

SEQ ID NO: 444972 - RNA, 19 nt, Homo sapiens
cagcaacacugauaucaug

SEQ ID NO: 444973 - RNA, 19 nt, Homo sapiens
gagcuuggcuggcaguaug

SEQ ID NO: 444974 - RNA, 19 nt, Homo sapiens
gaugaucucuucuccuaug

SEQ ID NO: 444975 - RNA, 19 nt, Homo sapiens
ggaagagacuuguuauugc

SEQ ID NO: 444976 - RNA, 19 nt, Homo sapiens
cuacggacaugccauauug

SEQ ID NO: 444977 - RNA, 19 nt, Homo sapiens
gauaauaacugcagucuaa

SEQ ID NO: 444978 - RNA, 19 nt, Homo sapiens
ggaaagggcuagagaagua

SEQ ID NO: 444979 - RNA, 19 nt, Homo sapiens
ugaagaagauccugaaaua

SEQ ID NO: 444980 - RNA, 19 nt, Homo sapiens
ccacauggaugauggauua

SEQ ID NO: 444981 - RNA, 19 nt, Homo sapiens
gagaagauauggagacuaa

SEQ ID NO: 444982 - RNA, 19 nt, Homo sapiens
gaaaggugaucaacaagua

SEQ ID NO: 444983 - RNA, 19 nt, Homo sapiens
gaaauacucucucauacaa

SEQ ID NO: 444984 - RNA, 19 nt, Homo sapiens
gggaggagcuguaugauuu

SEQ ID NO: 444985 - RNA, 19 nt, Homo sapiens
cagaaagugugcuaaauua

SEQ ID NO: 444986 - RNA, 19 nt, Homo sapiens
ggaaacagaugcaagaaau

SEQ ID NO: 444987 - RNA, 19 nt, Homo sapiens
caaaggaacucaaggagaa

SEQ ID NO: 444988 - RNA, 19 nt, Homo sapiens
gaagaaggauaccuacuug

SEQ ID NO: 444989 - RNA, 19 nt, Homo sapiens
gagaagagguuugccuaua

SEQ ID NO: 444990 - RNA, 19 nt, Homo sapiens
gcugagaacuaucacaaua

SEQ ID NO: 444991 - RNA, 19 nt, Homo sapiens
gaagaggaguugcucauga

SEQ ID NO: 444992 - RNA, 19 nt, Homo sapiens
aaacugcacuugaagguua

SEQ ID NO: 444993 - RNA, 19 nt, Homo sapiens
caagaaagguguugggauu

SEQ ID NO: 444994 - RNA, 19 nt, Homo sapiens
ugaagaaccuuuagaagaa

SEQ ID NO: 444995 - RNA, 19 nt, Homo sapiens
gaucuuccgucuuacuuua

SEQ ID NO: 444996 - RNA, 19 nt, Homo sapiens
caaguaaucucuaggcaaa

SEQ ID NO: 444997 - RNA, 19 nt, Homo sapiens
ucaaugaucuucacacuga

SEQ ID NO: 444998 - RNA, 19 nt, Homo sapiens
gcaaagaacaucagaguga

SEQ ID NO: 444999 - RNA, 19 nt, Homo sapiens
gacauguucuugaaacuua

SEQ ID NO: 445000 - RNA, 19 nt, Homo sapiens
guugugaucuuccgucuua

SEQ ID NO: 445001 - RNA, 19 nt, Homo sapiens
ggauaaaucugaaucaaag

SEQ ID NO: 445002 - RNA, 19 nt, Homo sapiens
caagaaauacucucucaua

SEQ ID NO: 445003 - RNA, 19 nt, Homo sapiens
ugacaaaucuuucugaaca

SEQ ID NO: 445004 - RNA, 19 nt, Homo sapiens
gaaauucuuugacauguuc

SEQ ID NO: 445005 - RNA, 19 nt, Homo sapiens
ccacugcaauaaaguaaua

SEQ ID NO: 445006 - RNA, 19 nt, Homo sapiens
gaacaaguacgagaagaua

SEQ ID NO: 445007 - RNA, 19 nt, Homo sapiens
gaacuuggcuggacuuucg

SEQ ID NO: 445008 - RNA, 19 nt, Homo sapiens
caaaguacguuuccugaug

SEQ ID NO: 445009 - RNA, 19 nt, Homo sapiens
gaaggaaggcgaagaauca

SEQ ID NO: 445010 - RNA, 19 nt, Homo sapiens
ccaagugaauggcaucaua

SEQ ID NO: 445011 - RNA, 19 nt, Homo sapiens
caacuuagccaacuacuug

SEQ ID NO: 445012 - RNA, 19 nt, Homo sapiens
uuaaagggcuggaaaucua

SEQ ID NO: 445013 - RNA, 19 nt, Homo sapiens
gauaaggccuuucaagaca

SEQ ID NO: 445014 - RNA, 19 nt, Homo sapiens
gagaacagguguguggaua

SEQ ID NO: 445015 - RNA, 19 nt, Homo sapiens
gaaggaagacaaagacaaa

SEQ ID NO: 445016 - RNA, 19 nt, Homo sapiens
gaugaggccuccuggauga

SEQ ID NO: 445017 - RNA, 19 nt, Homo sapiens
caacaaaggcucugaacuu

SEQ ID NO: 445018 - RNA, 19 nt, Homo sapiens
ggugaccucucagaaauua

SEQ ID NO: 445019 - RNA, 19 nt, Homo sapiens
gaacuaguacacuucauaa

SEQ ID NO: 445020 - RNA, 19 nt, Homo sapiens
gaagaaaucgugcauaugg

SEQ ID NO: 445021 - RNA, 19 nt, Homo sapiens
gcuguuaccuccucaagaa

SEQ ID NO: 445022 - RNA, 19 nt, Homo sapiens
gcaaaugccuucaaguuuu

SEQ ID NO: 445023 - RNA, 19 nt, Homo sapiens
ggaguuugauggccuauau

SEQ ID NO: 445024 - RNA, 19 nt, Homo sapiens
gcagaaagugugcuaaauu

SEQ ID NO: 445025 - RNA, 19 nt, Homo sapiens
gcaccucucugauugauuc

SEQ ID NO: 445026 - RNA, 19 nt, Homo sapiens
uaucaccacugaacuagua

SEQ ID NO: 445027 - RNA, 19 nt, Homo sapiens
gaacacaugccaaacgauu

SEQ ID NO: 445028 - RNA, 19 nt, Homo sapiens
guaaaggaauuaucuccaa

SEQ ID NO: 445029 - RNA, 19 nt, Homo sapiens
acacagaauuucccucuuu

SEQ ID NO: 445030 - RNA, 19 nt, Homo sapiens
ggacgaaggcucugaguau

SEQ ID NO: 445031 - RNA, 19 nt, Homo sapiens
cgaaggagcuggugaaggu

SEQ ID NO: 445032 - RNA, 19 nt, Homo sapiens
caaagaauaugacccagau

SEQ ID NO: 445033 - RNA, 19 nt, Homo sapiens
gaagaaggaacacucauug

SEQ ID NO: 445034 - RNA, 19 nt, Homo sapiens
ccagagagcuccagggaau

SEQ ID NO: 445035 - RNA, 19 nt, Homo sapiens
ggaggacgaugaagaggaa

SEQ ID NO: 445036 - RNA, 19 nt, Homo sapiens
ggagagaaaguucgaauug

SEQ ID NO: 445037 - RNA, 19 nt, Homo sapiens
gauaagcgcuagcaaaggu

SEQ ID NO: 445038 - RNA, 19 nt, Homo sapiens
ggacgggaaagaacauuua

SEQ ID NO: 445039 - RNA, 19 nt, Homo sapiens
agaagagguuugccuauaa

SEQ ID NO: 445040 - RNA, 19 nt, Homo sapiens
gaauagcaaugccgacaug

SEQ ID NO: 445041 - RNA, 19 nt, Homo sapiens
gaagaacuauaaccugcaa

SEQ ID NO: 445042 - RNA, 19 nt, Homo sapiens
agagaaaggugaucaacaa

SEQ ID NO: 445043 - RNA, 19 nt, Homo sapiens
gaagaagagcugcaccuaa

SEQ ID NO: 445044 - RNA, 19 nt, Homo sapiens
ggaagcugaugaugaagaa

SEQ ID NO: 445045 - RNA, 19 nt, Homo sapiens
agaggaagcugaugaugaa

SEQ ID NO: 445046 - RNA, 19 nt, Homo sapiens
gagaucggaugacguggua

SEQ ID NO: 445047 - RNA, 19 nt, Homo sapiens
gaagaaggaaggcgaagaa

SEQ ID NO: 445048 - RNA, 19 nt, Homo sapiens
ggcacaaacuguuaucaaa

SEQ ID NO: 445049 - RNA, 19 nt, Homo sapiens
gagcugucuucacaucuua

SEQ ID NO: 445050 - RNA, 19 nt, Homo sapiens
ucagguaucuuggaaguuu

SEQ ID NO: 445051 - RNA, 19 nt, Homo sapiens
gcgcucaauucuccaauaa

SEQ ID NO: 445052 - RNA, 19 nt, Homo sapiens
uaugaaaucucgaaugugu

SEQ ID NO: 445053 - RNA, 19 nt, Homo sapiens
gagaacaucugcggaacaa

SEQ ID NO: 445054 - RNA, 19 nt, Homo sapiens
agaaggagaaggaaauuua

SEQ ID NO: 445055 - RNA, 19 nt, Homo sapiens
uaagaaauaugacccagau

SEQ ID NO: 445056 - RNA, 19 nt, Homo sapiens
gcauuaaggaucaaacuuu

SEQ ID NO: 445057 - RNA, 19 nt, Homo sapiens
ugaccaagccuuuguguuu

SEQ ID NO: 445058 - RNA, 19 nt, Homo sapiens
caucaucucucuagucugu

SEQ ID NO: 445059 - RNA, 19 nt, Homo sapiens
gauggugacugaagaagga

SEQ ID NO: 445060 - RNA, 19 nt, Homo sapiens
gcaguguccuugauuugaa

SEQ ID NO: 445061 - RNA, 19 nt, Homo sapiens
gaugcuggauucuuucaaa

SEQ ID NO: 445062 - RNA, 19 nt, Homo sapiens
agaaagagauggagaagca

SEQ ID NO: 445063 - RNA, 19 nt, Homo sapiens
ugaaggaacucaucucaca

SEQ ID NO: 445064 - RNA, 19 nt, Homo sapiens
gaacagguguguggauauc

SEQ ID NO: 445065 - RNA, 19 nt, Homo sapiens
gaaacagaugcaagaaaua

SEQ ID NO: 445066 - RNA, 19 nt, Homo sapiens
gauuaacacugcagagaug

SEQ ID NO: 445067 - RNA, 19 nt, Homo sapiens
aaagaaagagggcagcuua

SEQ ID NO: 445068 - RNA, 19 nt, Homo sapiens
uaauguggcuguguuauug

SEQ ID NO: 445069 - RNA, 19 nt, Homo sapiens
gaagacccacccacugaua

SEQ ID NO: 445070 - RNA, 19 nt, Homo sapiens
gcugagcauucacaugaua

SEQ ID NO: 445071 - RNA, 19 nt, Homo sapiens
gcacaaagggacacuauag

SEQ ID NO: 445072 - RNA, 19 nt, Homo sapiens
gcagugagaucuggaaagu

SEQ ID NO: 445073 - RNA, 19 nt, Homo sapiens
aaacaaggauggaccuaug

SEQ ID NO: 445074 - RNA, 19 nt, Homo sapiens
gaagauauggagacuaaau

SEQ ID NO: 445075 - RNA, 19 nt, Homo sapiens
agaccaaguuacugcauua

SEQ ID NO: 445076 - RNA, 19 nt, Homo sapiens
ccacugaacuaguacacuu

SEQ ID NO: 445077 - RNA, 19 nt, Homo sapiens
ugaaggagcuagacgagaa

SEQ ID NO: 445078 - RNA, 19 nt, Homo sapiens
ccacuuaucccucuccaua

SEQ ID NO: 445079 - RNA, 19 nt, Homo sapiens
gcaagaaggagcugaaaga

SEQ ID NO: 445080 - RNA, 19 nt, Homo sapiens
gcaacucaucuuucauuaa

SEQ ID NO: 445081 - RNA, 19 nt, Homo sapiens
auuaaaggcuucucucuca

SEQ ID NO: 445082 - RNA, 19 nt, Homo sapiens
gguccaagccugcaacuca

SEQ ID NO: 445083 - RNA, 19 nt, Homo sapiens
uggacaaggugaugaagga

SEQ ID NO: 445084 - RNA, 19 nt, Homo sapiens
aguacaagcugagcaagaa

SEQ ID NO: 445085 - RNA, 19 nt, Homo sapiens
ugcaacucaucuuucauua

SEQ ID NO: 445086 - RNA, 19 nt, Homo sapiens
caccaagggcgcaagagua

SEQ ID NO: 445087 - RNA, 19 nt, Homo sapiens
gagcaagaaggagcugaaa

SEQ ID NO: 445088 - RNA, 19 nt, Homo sapiens
gccugcaacucaucuuuca

SEQ ID NO: 445089 - RNA, 19 nt, Homo sapiens
cugcaacucaucuuucauu

SEQ ID NO: 445090 - RNA, 19 nt, Homo sapiens
ggagcuagacgagaaugga

SEQ ID NO: 445091 - RNA, 19 nt, Homo sapiens
gaaggagcuagacgagaau

SEQ ID NO: 445092 - RNA, 19 nt, Homo sapiens
gcuucucucucaccagcaa

SEQ ID NO: 445093 - RNA, 19 nt, Homo sapiens
aggaguauguggugcuugu

SEQ ID NO: 445094 - RNA, 19 nt, Homo sapiens
guccaagccugcaacucau

SEQ ID NO: 445095 - RNA, 19 nt, Homo sapiens
ccaggaguauguggugcuu

SEQ ID NO: 445096 - RNA, 19 nt, Homo sapiens
uggagacccucaucaacgu

SEQ ID NO: 445097 - RNA, 19 nt, Homo sapiens
acaaguacaagcugagcaa

SEQ ID NO: 445098 - RNA, 19 nt, Homo sapiens
ccagaaggauguggaugcu

SEQ ID NO: 445099 - RNA, 19 nt, Homo sapiens
caagaaggagcugaaagag

SEQ ID NO: 445100 - RNA, 19 nt, Homo sapiens
cagccacauuugcaaccuu

SEQ ID NO: 445101 - RNA, 19 nt, Homo sapiens
ggacuuccaggaguaugug

SEQ ID NO: 445102 - RNA, 19 nt, Homo sapiens
gggaagaacuuuaaggaua

SEQ ID NO: 445103 - RNA, 19 nt, Homo sapiens
ccacagacccugaagauua

SEQ ID NO: 445104 - RNA, 19 nt, Homo sapiens
gaaaggaacugugaagaga

SEQ ID NO: 445105 - RNA, 19 nt, Homo sapiens
ggagcuagguccaugaaua

SEQ ID NO: 445106 - RNA, 19 nt, Homo sapiens
gcaaauggcuccugcaaag

SEQ ID NO: 445107 - RNA, 19 nt, Homo sapiens
ggaagaacuuuaaggauau

SEQ ID NO: 445108 - RNA, 19 nt, Homo sapiens
gagaaggacuauaccauau

SEQ ID NO: 445109 - RNA, 19 nt, Homo sapiens
gaagaacaccuaacaacaa

SEQ ID NO: 445110 - RNA, 19 nt, Homo sapiens
gaaacugaauguuccaaug

SEQ ID NO: 445111 - RNA, 19 nt, Homo sapiens
gaaggucaaugcuggcaaa

SEQ ID NO: 445112 - RNA, 19 nt, Homo sapiens
gaaaugcacaagcaacuuu

SEQ ID NO: 445113 - RNA, 19 nt, Homo sapiens
ucacucagaugauguauag

SEQ ID NO: 445114 - RNA, 19 nt, Homo sapiens
gcaaacagaucucccuuuu

SEQ ID NO: 445115 - RNA, 19 nt, Homo sapiens
caagaaggauccacguuuc

SEQ ID NO: 445116 - RNA, 19 nt, Homo sapiens
gacaacaccaucuucuuua

SEQ ID NO: 445117 - RNA, 19 nt, Homo sapiens
gaccuacacuaaagaaaug

SEQ ID NO: 445118 - RNA, 19 nt, Homo sapiens
gcacaaucuuuaccucaga

SEQ ID NO: 445119 - RNA, 19 nt, Homo sapiens
gaacaccuaacaacaaaug

SEQ ID NO: 445120 - RNA, 19 nt, Homo sapiens
gaaggacuauaccauaugg

SEQ ID NO: 445121 - RNA, 19 nt, Homo sapiens
gaagauggcugcauuuugg

SEQ ID NO: 445122 - RNA, 19 nt, Homo sapiens
ggaaccacaguaccucuua

SEQ ID NO: 445123 - RNA, 19 nt, Homo sapiens
aagaacaccuaacaacaaa

SEQ ID NO: 445124 - RNA, 19 nt, Homo sapiens
gagacuauguugugaccaa

SEQ ID NO: 445125 - RNA, 19 nt, Homo sapiens
gcucuggaauuauggagaa

SEQ ID NO: 445126 - RNA, 19 nt, Homo sapiens
gcuccaacuucaggaaaua

SEQ ID NO: 445127 - RNA, 19 nt, Homo sapiens
aaacagaauuccaagucaa

SEQ ID NO: 445128 - RNA, 19 nt, Homo sapiens
gagcacagcagccguccua

SEQ ID NO: 445129 - RNA, 19 nt, Homo sapiens
gaacuucagacuugggaaa

SEQ ID NO: 445130 - RNA, 19 nt, Homo sapiens
gaauuuggcauggcuauug

SEQ ID NO: 445131 - RNA, 19 nt, Homo sapiens
ggaccuacacuaaagaaau

SEQ ID NO: 445132 - RNA, 19 nt, Homo sapiens
gagcuagguccaugaauau

SEQ ID NO: 445133 - RNA, 19 nt, Homo sapiens
gggaagaaauccacaaagc

SEQ ID NO: 445134 - RNA, 19 nt, Homo sapiens
aaacagaucucccuuuuca

SEQ ID NO: 445135 - RNA, 19 nt, Homo sapiens
ggacacagccucccacacu

SEQ ID NO: 445136 - RNA, 19 nt, Homo sapiens
ucagaauggucgagacuau

SEQ ID NO: 445137 - RNA, 19 nt, Homo sapiens
cacagacccugaagauuau

SEQ ID NO: 445138 - RNA, 19 nt, Homo sapiens
agacaacaccaucuucuuu

SEQ ID NO: 445139 - RNA, 19 nt, Homo sapiens
gacacagccucccacacua

SEQ ID NO: 445140 - RNA, 19 nt, Homo sapiens
agagaaggacuauaccaua

SEQ ID NO: 445141 - RNA, 19 nt, Homo sapiens
gagugcagccuucauauuc

SEQ ID NO: 445142 - RNA, 19 nt, Homo sapiens
cgacaucucuacacuacca

SEQ ID NO: 445143 - RNA, 19 nt, Homo sapiens
gcaggagugcucauuguga

SEQ ID NO: 445144 - RNA, 19 nt, Homo sapiens
caagcgugcucuccgaaga

SEQ ID NO: 445145 - RNA, 19 nt, Homo sapiens
ggaccgacaucucuacacu

SEQ ID NO: 445146 - RNA, 19 nt, Homo sapiens
ccucugugauggcugauaa

SEQ ID NO: 445147 - RNA, 19 nt, Homo sapiens
caggagugcucauugugaa

SEQ ID NO: 445148 - RNA, 19 nt, Homo sapiens
gagaagaacaccuaacaac

SEQ ID NO: 445149 - RNA, 19 nt, Homo sapiens
ggucgagacuauguuguga

SEQ ID NO: 445150 - RNA, 19 nt, Homo sapiens
ucacuggccuagcuucaga

SEQ ID NO: 445151 - RNA, 19 nt, Homo sapiens
ugauuaaguucuccacaga

SEQ ID NO: 445152 - RNA, 19 nt, Homo sapiens
ggaagaaauccacaaagca

SEQ ID NO: 445153 - RNA, 19 nt, Homo sapiens
gauuaugggaagaacuuua

SEQ ID NO: 445154 - RNA, 19 nt, Homo sapiens
ggacccagcucuguuucug

SEQ ID NO: 445155 - RNA, 19 nt, Homo sapiens
cagcagccguccuaucaau

SEQ ID NO: 445156 - RNA, 19 nt, Homo sapiens
ggguuuggcacaaucuuua

SEQ ID NO: 445157 - RNA, 19 nt, Homo sapiens
aaauccaguucgagaagua

SEQ ID NO: 445158 - RNA, 19 nt, Homo sapiens
gaucucagaggcucaguau

SEQ ID NO: 445159 - RNA, 19 nt, Homo sapiens
ccaugaauaucagcauuug

SEQ ID NO: 445160 - RNA, 19 nt, Homo sapiens
gaucagacaacaccaucuu

SEQ ID NO: 445161 - RNA, 19 nt, Homo sapiens
ggaagagaagaacaccuaa

SEQ ID NO: 445162 - RNA, 19 nt, Homo sapiens
uuaugaagauggcugcauu

SEQ ID NO: 445163 - RNA, 19 nt, Homo sapiens
auggagaacuucagacuug

SEQ ID NO: 445164 - RNA, 19 nt, Homo sapiens
ucucaucaauaacaccuuu

SEQ ID NO: 445165 - RNA, 19 nt, Homo sapiens
gauccacguuucaacagau

SEQ ID NO: 445166 - RNA, 19 nt, Homo sapiens
ggauccacguuucaacaga

SEQ ID NO: 445167 - RNA, 19 nt, Homo sapiens
acaagaaggauccacguuu

SEQ ID NO: 445168 - RNA, 19 nt, Homo sapiens
ugugauggcugauaaggau

SEQ ID NO: 445169 - RNA, 19 nt, Homo sapiens
gagggacccagcucuguuu

SEQ ID NO: 445170 - RNA, 19 nt, Homo sapiens
gaaccacaguaccucuuac

SEQ ID NO: 445171 - RNA, 19 nt, Homo sapiens
uggcaaaccuacacguuca

SEQ ID NO: 445172 - RNA, 19 nt, Homo sapiens
ggaauuauggagaacuuca

SEQ ID NO: 445173 - RNA, 19 nt, Homo sapiens
gauauuacagaucucauca

SEQ ID NO: 445174 - RNA, 19 nt, Homo sapiens
ccaaaaggaccuacacuaa

SEQ ID NO: 445175 - RNA, 19 nt, Homo sapiens
gauugaugcuggucacagu

SEQ ID NO: 445176 - RNA, 19 nt, Homo sapiens
cggaagagaagaacaccua

SEQ ID NO: 445177 - RNA, 19 nt, Homo sapiens
gggcuacaaagaacaguuu

SEQ ID NO: 445178 - RNA, 19 nt, Homo sapiens
gaucgaggcauugucuauu

SEQ ID NO: 445179 - RNA, 19 nt, Homo sapiens
caaaaggaccuacacuaaa

SEQ ID NO: 445180 - RNA, 19 nt, Homo sapiens
caagucaaauucuguucca

SEQ ID NO: 445181 - RNA, 19 nt, Homo sapiens
uggaggacuuucucuguga

SEQ ID NO: 445182 - RNA, 19 nt, Homo sapiens
gaagagaaggacuauacca

SEQ ID NO: 445183 - RNA, 19 nt, Homo sapiens
gugaagagaaggacuauac

SEQ ID NO: 445184 - RNA, 19 nt, Homo sapiens
ggucaaugcuggcaaaccu

SEQ ID NO: 445185 - RNA, 19 nt, Homo sapiens
cagccucccacacuaauaa

SEQ ID NO: 445186 - RNA, 19 nt, Homo sapiens
gcaagucauccguguguca

SEQ ID NO: 445187 - RNA, 19 nt, Homo sapiens
gguuacuccuggacaaaga

SEQ ID NO: 445188 - RNA, 19 nt, Homo sapiens
agaaauccacaaagcagua

SEQ ID NO: 445189 - RNA, 19 nt, Homo sapiens
uggaugguguggaugcuuu

SEQ ID NO: 445190 - RNA, 19 nt, Homo sapiens
gcaucauuguggccauuga

SEQ ID NO: 445191 - RNA, 19 nt, Homo sapiens
caucagauuuugcgaagaa

SEQ ID NO: 445192 - RNA, 19 nt, Homo sapiens
ggaggacuuucucugugau

SEQ ID NO: 445193 - RNA, 19 nt, Homo sapiens
gcacagcagccguccuauc

SEQ ID NO: 445194 - RNA, 19 nt, Homo sapiens
uccagaccaugaucacuuu

SEQ ID NO: 445195 - RNA, 19 nt, Homo sapiens
ggcauugucuauuccaagu

SEQ ID NO: 445196 - RNA, 19 nt, Homo sapiens
gaaauccacaaagcaguau

SEQ ID NO: 445197 - RNA, 19 nt, Homo sapiens
guauagcccucagaauucu

SEQ ID NO: 445198 - RNA, 19 nt, Homo sapiens
gguaaauccaguucgagaa

SEQ ID NO: 445199 - RNA, 19 nt, Homo sapiens
caacaacacgcaccagcau

SEQ ID NO: 445200 - RNA, 19 nt, Homo sapiens
guccaugaauaucagcauu

SEQ ID NO: 445201 - RNA, 19 nt, Homo sapiens
ccagggaccccaucuauuu

SEQ ID NO: 445202 - RNA, 19 nt, Homo sapiens
ucacuaccuuccacaagua

SEQ ID NO: 445203 - RNA, 19 nt, Homo sapiens
gaccgacccugaagcagaa

SEQ ID NO: 445204 - RNA, 19 nt, Homo sapiens
gccaagagggcgacaaguu

SEQ ID NO: 445205 - RNA, 19 nt, Homo sapiens
caugugcaaugacuucuuc

SEQ ID NO: 445206 - RNA, 19 nt, Homo sapiens
ccaagagggcgacaaguuc

SEQ ID NO: 445207 - RNA, 19 nt, Homo sapiens
ggacuguugaugccuuuga

SEQ ID NO: 445208 - RNA, 19 nt, Homo sapiens
gcacucaucacugucaugu

SEQ ID NO: 445209 - RNA, 19 nt, Homo sapiens
caagagggcgacaaguuca

SEQ ID NO: 445210 - RNA, 19 nt, Homo sapiens
ugccacagauccaugaugu

SEQ ID NO: 445211 - RNA, 19 nt, Homo sapiens
caaguacuccugccaagag

SEQ ID NO: 445212 - RNA, 19 nt, Homo sapiens
gauccaugaugugcaguuc

SEQ ID NO: 445213 - RNA, 19 nt, Homo sapiens
gacaaguucaagcugagua

SEQ ID NO: 445214 - RNA, 19 nt, Homo sapiens
gucacuaccuuccacaagu

SEQ ID NO: 445215 - RNA, 19 nt, Homo sapiens
caggacuguugaugccuuu

SEQ ID NO: 445216 - RNA, 19 nt, Homo sapiens
aggaacuucugcacaagga

SEQ ID NO: 445217 - RNA, 19 nt, Homo sapiens
acaaguucaagcugaguaa

SEQ ID NO: 445218 - RNA, 19 nt, Homo sapiens
uggcugugcuggucacuac

SEQ ID NO: 445219 - RNA, 19 nt, Homo sapiens
guugaugccuuugaguuuu

SEQ ID NO: 445220 - RNA, 19 nt, Homo sapiens
uguugaugccuuugaguuu

SEQ ID NO: 445221 - RNA, 19 nt, Homo sapiens
ggaaagggccuauuuaacu

SEQ ID NO: 445222 - RNA, 19 nt, Homo sapiens
gaaagggccuauuuaacuc

SEQ ID NO: 445223 - RNA, 19 nt, Homo sapiens
gaaugugacuacaacaaau

SEQ ID NO: 445224 - RNA, 19 nt, Homo sapiens
ggaaugugacuacaacaaa

SEQ ID NO: 445225 - RNA, 19 nt, Homo sapiens
gcgaucaguuaacccauuu

SEQ ID NO: 445226 - RNA, 19 nt, Homo sapiens
ggucuucugcgaucaguua

SEQ ID NO: 445227 - RNA, 19 nt, Homo sapiens
gaugggaaagggccuauuu

SEQ ID NO: 445228 - RNA, 19 nt, Homo sapiens
gcagagcgugcaccaauga

SEQ ID NO: 445229 - RNA, 19 nt, Homo sapiens
cgacugaguuucgggaaug

SEQ ID NO: 445230 - RNA, 19 nt, Homo sapiens
ggacugcgagguggacuuu

SEQ ID NO: 445231 - RNA, 19 nt, Homo sapiens
gggccuauuuaacuccuaa

SEQ ID NO: 445232 - RNA, 19 nt, Homo sapiens
gaacuggucaacucucaag

SEQ ID NO: 445233 - RNA, 19 nt, Homo sapiens
cagcagagcgugcaccaau

SEQ ID NO: 445234 - RNA, 19 nt, Homo sapiens
acaacaaauucaugagugu

SEQ ID NO: 445235 - RNA, 19 nt, Homo sapiens
ugggaaagggccuauuuaa

SEQ ID NO: 445236 - RNA, 19 nt, Homo sapiens
gaggcgggaucugcucuga

SEQ ID NO: 445237 - RNA, 19 nt, Homo sapiens
caggaugcccagcgaauga

SEQ ID NO: 445238 - RNA, 19 nt, Homo sapiens
gaguaugugcgcucacuug

SEQ ID NO: 445239 - RNA, 19 nt, Homo sapiens
gggaaugugacuacaacaa

SEQ ID NO: 445240 - RNA, 19 nt, Homo sapiens
gggaaagggccuauuuaac

SEQ ID NO: 445241 - RNA, 19 nt, Homo sapiens
gaucaguuaacccauuuua

SEQ ID NO: 445242 - RNA, 19 nt, Homo sapiens
gacuacaacaaauucauga

SEQ ID NO: 445243 - RNA, 19 nt, Homo sapiens
gcaccaaugagaccacgau

SEQ ID NO: 445244 - RNA, 19 nt, Homo sapiens
ccgaacuggucaacucuca

SEQ ID NO: 445245 - RNA, 19 nt, Homo sapiens
ccuaggaggcccagagaug

SEQ ID NO: 445246 - RNA, 19 nt, Homo sapiens
ugacuacaacaaauucaug

SEQ ID NO: 445247 - RNA, 19 nt, Homo sapiens
cacccgaacuggucaacuc

SEQ ID NO: 445248 - RNA, 19 nt, Homo sapiens
gguggacuuuguggaguau

SEQ ID NO: 445249 - RNA, 19 nt, Homo sapiens
ugcgaucaguuaacccauu

SEQ ID NO: 445250 - RNA, 19 nt, Homo sapiens
cuacaacaaauucaugagu

SEQ ID NO: 445251 - RNA, 19 nt, Homo sapiens
gcaaagagggugacaaguu

SEQ ID NO: 445252 - RNA, 19 nt, Homo sapiens
caaagagggugacaaguuc

SEQ ID NO: 445253 - RNA, 19 nt, Homo sapiens
ugagcaaguucaauaaaga

SEQ ID NO: 445254 - RNA, 19 nt, Homo sapiens
ccucagcgcuucuucuuuc

SEQ ID NO: 445255 - RNA, 19 nt, Homo sapiens
aaacuccucugaugugguu

SEQ ID NO: 445256 - RNA, 19 nt, Homo sapiens
gauaagcagcccaggaaga

SEQ ID NO: 445257 - RNA, 19 nt, Homo sapiens
caugauguguaacgaauuc

SEQ ID NO: 445258 - RNA, 19 nt, Homo sapiens
cagauaagcagcccaggaa

SEQ ID NO: 445259 - RNA, 19 nt, Homo sapiens
gccaugauguguaacgaau

SEQ ID NO: 445260 - RNA, 19 nt, Homo sapiens
gaaaugaaaacuccucuga

SEQ ID NO: 445261 - RNA, 19 nt, Homo sapiens
uccagaagcugaugagcaa

SEQ ID NO: 445262 - RNA, 19 nt, Homo sapiens
gauguguaacgaauucuuu

SEQ ID NO: 445263 - RNA, 19 nt, Homo sapiens
cagcgcuucuucuuucuug

SEQ ID NO: 445264 - RNA, 19 nt, Homo sapiens
ggacaacgagguggacuuc

SEQ ID NO: 445265 - RNA, 19 nt, Homo sapiens
gcaaguucaauaaagauuc

SEQ ID NO: 445266 - RNA, 19 nt, Homo sapiens
gcugagcaaguucaauaaa

SEQ ID NO: 445267 - RNA, 19 nt, Homo sapiens
gggcaaagagggugacaag

SEQ ID NO: 445268 - RNA, 19 nt, Homo sapiens
gagcaaguucaauaaagau

SEQ ID NO: 445269 - RNA, 19 nt, Homo sapiens
gugacaaguucaagcucaa

SEQ ID NO: 445270 - RNA, 19 nt, Homo sapiens
aaugaaaacuccucugaug

SEQ ID NO: 445271 - RNA, 19 nt, Homo sapiens
cugagcaaguucaauaaag

SEQ ID NO: 445272 - RNA, 19 nt, Homo sapiens
ccacaaguacucgggcaaa

SEQ ID NO: 445273 - RNA, 19 nt, Homo sapiens
uguccaccuuccacaagua

SEQ ID NO: 445274 - RNA, 19 nt, Homo sapiens
uguaacgaauucuuugaag

SEQ ID NO: 445275 - RNA, 19 nt, Homo sapiens
caaguacucgggcaaagag

SEQ ID NO: 445276 - RNA, 19 nt, Homo sapiens
auaagcagcccaggaagaa

SEQ ID NO: 445277 - RNA, 19 nt, Homo sapiens
ggacuuccaagaguacugu

SEQ ID NO: 445278 - RNA, 19 nt, Homo sapiens
cuucuucuuucuugguuug

SEQ ID NO: 445279 - RNA, 19 nt, Homo sapiens
gaaaaggacagaugaagcu

SEQ ID NO: 445280 - RNA, 19 nt, Homo sapiens
aguucaagcucaacaaguc

SEQ ID NO: 445281 - RNA, 19 nt, Homo sapiens
guguaacgaauucuuugaa

SEQ ID NO: 445282 - RNA, 19 nt, Homo sapiens
caaguucaagcucaacaag

SEQ ID NO: 445283 - RNA, 19 nt, Homo sapiens
aagcagcccaggaagaaau

SEQ ID NO: 445284 - RNA, 19 nt, Homo sapiens
gcaaagagggugacaaguu

SEQ ID NO: 445285 - RNA, 19 nt, Homo sapiens
caaagagggugacaaguuc

SEQ ID NO: 445286 - RNA, 19 nt, Homo sapiens
ugagcaaguucaauaaaga

SEQ ID NO: 445287 - RNA, 19 nt, Homo sapiens
aaacuccucugaugugguu

SEQ ID NO: 445288 - RNA, 19 nt, Homo sapiens
gauaagcagcccaggaaga

SEQ ID NO: 445289 - RNA, 19 nt, Homo sapiens
caugauguguaacgaauuc

SEQ ID NO: 445290 - RNA, 19 nt, Homo sapiens
cagauaagcagcccaggaa

SEQ ID NO: 445291 - RNA, 19 nt, Homo sapiens
gccaugauguguaacgaau

SEQ ID NO: 445292 - RNA, 19 nt, Homo sapiens
gaaaugaaaacuccucuga

SEQ ID NO: 445293 - RNA, 19 nt, Homo sapiens
uccagaagcugaugagcaa

SEQ ID NO: 445294 - RNA, 19 nt, Homo sapiens
gauguguaacgaauucuuu

SEQ ID NO: 445295 - RNA, 19 nt, Homo sapiens
ugcacacgcuguugcuaua

SEQ ID NO: 445296 - RNA, 19 nt, Homo sapiens
ggacaacgagguggacuuc

SEQ ID NO: 445297 - RNA, 19 nt, Homo sapiens
acacgcuguugcuauagua

SEQ ID NO: 445298 - RNA, 19 nt, Homo sapiens
gcaaguucaauaaagauuc

SEQ ID NO: 445299 - RNA, 19 nt, Homo sapiens
gcugagcaaguucaauaaa

SEQ ID NO: 445300 - RNA, 19 nt, Homo sapiens
gggcaaagagggugacaag

SEQ ID NO: 445301 - RNA, 19 nt, Homo sapiens
gagcaaguucaauaaagau

SEQ ID NO: 445302 - RNA, 19 nt, Homo sapiens
gugacaaguucaagcucaa

SEQ ID NO: 445303 - RNA, 19 nt, Homo sapiens
aaugaaaacuccucugaug

SEQ ID NO: 445304 - RNA, 19 nt, Homo sapiens
cugagcaaguucaauaaag

SEQ ID NO: 445305 - RNA, 19 nt, Homo sapiens
uguccaccuuccacaagua

SEQ ID NO: 445306 - RNA, 19 nt, Homo sapiens
ccacaaguacucgggcaaa

SEQ ID NO: 445307 - RNA, 19 nt, Homo sapiens
uguaacgaauucuuugaag

SEQ ID NO: 445308 - RNA, 19 nt, Homo sapiens
caaguacucgggcaaagag

SEQ ID NO: 445309 - RNA, 19 nt, Homo sapiens
auaagcagcccaggaagaa

SEQ ID NO: 445310 - RNA, 19 nt, Homo sapiens
ggacuuccaagaguacugu

SEQ ID NO: 445311 - RNA, 19 nt, Homo sapiens
gaaaaggacagaugaagcu

SEQ ID NO: 445312 - RNA, 19 nt, Homo sapiens
aguucaagcucaacaaguc

SEQ ID NO: 445313 - RNA, 19 nt, Homo sapiens
guguaacgaauucuuugaa

SEQ ID NO: 445314 - RNA, 19 nt, Homo sapiens
caaguucaagcucaacaag

SEQ ID NO: 445315 - RNA, 19 nt, Homo sapiens
aagcagcccaggaagaaau

SEQ ID NO: 445316 - RNA, 19 nt, Homo sapiens
ucaaggagcugaucaagaa

SEQ ID NO: 445317 - RNA, 19 nt, Homo sapiens
ggacagagaucagggaaau

SEQ ID NO: 445318 - RNA, 19 nt, Homo sapiens
ugaagagccuggacaagaa

SEQ ID NO: 445319 - RNA, 19 nt, Homo sapiens
gaguaaaguuucugggauu

SEQ ID NO: 445320 - RNA, 19 nt, Homo sapiens
ggucagaagaguaaaguuu

SEQ ID NO: 445321 - RNA, 19 nt, Homo sapiens
gagaaggcccugaccacua

SEQ ID NO: 445322 - RNA, 19 nt, Homo sapiens
aaacugacccugaguagga

SEQ ID NO: 445323 - RNA, 19 nt, Homo sapiens
agaaggcccugaccacuau

SEQ ID NO: 445324 - RNA, 19 nt, Homo sapiens
cuacaacgacuucuuucua

SEQ ID NO: 445325 - RNA, 19 nt, Homo sapiens
uccaucagauuucagauuu

SEQ ID NO: 445326 - RNA, 19 nt, Homo sapiens
gaacagcgaccaggagauc

SEQ ID NO: 445327 - RNA, 19 nt, Homo sapiens
gagagaggguagcaaacug

SEQ ID NO: 445328 - RNA, 19 nt, Homo sapiens
acagagaucagggaaauaa

SEQ ID NO: 445329 - RNA, 19 nt, Homo sapiens
gcagugagagggaggcuau

SEQ ID NO: 445330 - RNA, 19 nt, Homo sapiens
gagcagcaucgaugacuug

SEQ ID NO: 445331 - RNA, 19 nt, Homo sapiens
uacaacgacuucuuucuag

SEQ ID NO: 445332 - RNA, 19 nt, Homo sapiens
gaacucaaggagcugauca

SEQ ID NO: 445333 - RNA, 19 nt, Homo sapiens
gcaaacugacccugaguag

SEQ ID NO: 445334 - RNA, 19 nt, Homo sapiens
ggccuacaacgacuucuuu

SEQ ID NO: 445335 - RNA, 19 nt, Homo sapiens
acaacgacuucuuucuaga

SEQ ID NO: 445336 - RNA, 19 nt, Homo sapiens
guaggaaggaacucaagga

SEQ ID NO: 445337 - RNA, 19 nt, Homo sapiens
ggagagaggguagcaaacu

SEQ ID NO: 445338 - RNA, 19 nt, Homo sapiens
caugggaggaaauaaaguu

SEQ ID NO: 445339 - RNA, 19 nt, Homo sapiens
gauuucagauuuugaguuc

SEQ ID NO: 445340 - RNA, 19 nt, Homo sapiens
agaucgacuucaaggagua

SEQ ID NO: 445341 - RNA, 19 nt, Homo sapiens
caacgacuucuuucuagag

SEQ ID NO: 445342 - RNA, 19 nt, Homo sapiens
gaaggagagcagcaucgau

SEQ ID NO: 445343 - RNA, 19 nt, Homo sapiens
caaggaagggacagagauc

SEQ ID NO: 445344 - RNA, 19 nt, Homo sapiens
ccccagcccuuguuuguaa

SEQ ID NO: 445345 - RNA, 19 nt, Homo sapiens
gcuuauuguuccaucagau

SEQ ID NO: 445346 - RNA, 19 nt, Homo sapiens
accaggagaucgacuucaa

SEQ ID NO: 445347 - RNA, 19 nt, Homo sapiens
gaucaagaaagagcugugu

SEQ ID NO: 445348 - RNA, 19 nt, Homo sapiens
gagaucagggaaauaaagg

SEQ ID NO: 445349 - RNA, 19 nt, Homo sapiens
caucagauuucagauuuug

SEQ ID NO: 445350 - RNA, 19 nt, Homo sapiens
cagccugguuucccuucuu

SEQ ID NO: 445351 - RNA, 19 nt, Homo sapiens
ucgaugacuugaugaagag

SEQ ID NO: 445352 - RNA, 19 nt, Homo sapiens
gacagagaucagggaaaua

SEQ ID NO: 445353 - RNA, 19 nt, Homo sapiens
ucaaggaguacucgguguu

SEQ ID NO: 445354 - RNA, 19 nt, Homo sapiens
gaagagccuggacaagaac

SEQ ID NO: 445355 - RNA, 19 nt, Homo sapiens
agagaggguagcaaacuga

SEQ ID NO: 445356 - RNA, 19 nt, Homo sapiens
aguaaaguuucugggauug

SEQ ID NO: 445357 - RNA, 19 nt, Homo sapiens
gucagaagaguaaaguuuc

SEQ ID NO: 445358 - RNA, 19 nt, Homo sapiens
cggcugcuccucucacaga

SEQ ID NO: 445359 - RNA, 19 nt, Homo sapiens
ucuagaggacaacaaguga

SEQ ID NO: 445360 - RNA, 19 nt, Homo sapiens
aucgaugacuugaugaaga

SEQ ID NO: 445361 - RNA, 19 nt, Homo sapiens
ucaagaaagagcugugucu

SEQ ID NO: 445362 - RNA, 19 nt, Homo sapiens
aggagcugaucaagaaaga

SEQ ID NO: 445363 - RNA, 19 nt, Homo sapiens
caaggaguacucgguguuc

SEQ ID NO: 445364 - RNA, 19 nt, Homo sapiens
augaagagccuggacaaga

SEQ ID NO: 445365 - RNA, 19 nt, Homo sapiens
caaggagcugaucaagaaa

SEQ ID NO: 445366 - RNA, 19 nt, Homo sapiens
cuucuucggcuuauuguuc

SEQ ID NO: 445367 - RNA, 19 nt, Homo sapiens
ugaaggagcugauccagaa

SEQ ID NO: 445368 - RNA, 19 nt, Homo sapiens
caaauccagugguggguaa

SEQ ID NO: 445369 - RNA, 19 nt, Homo sapiens
agaaggagcucaccauugg

SEQ ID NO: 445370 - RNA, 19 nt, Homo sapiens
gcaagaaggagcugaagga

SEQ ID NO: 445371 - RNA, 19 nt, Homo sapiens
gcaggaugcugaaauugca

SEQ ID NO: 445372 - RNA, 19 nt, Homo sapiens
gcugcaggaugcugaaauu

SEQ ID NO: 445373 - RNA, 19 nt, Homo sapiens
uugcaaggcugauggaaga

SEQ ID NO: 445374 - RNA, 19 nt, Homo sapiens
uggcuuugaucuacaauga

SEQ ID NO: 445375 - RNA, 19 nt, Homo sapiens
gcuuugaucuacaaugaag

SEQ ID NO: 445376 - RNA, 19 nt, Homo sapiens
cagaaggagcucaccauug

SEQ ID NO: 445377 - RNA, 19 nt, Homo sapiens
gguccucucugagucaaau

SEQ ID NO: 445378 - RNA, 19 nt, Homo sapiens
ggccuuggcuuugaucuac

SEQ ID NO: 445379 - RNA, 19 nt, Homo sapiens
caaggcugauggaagacuu

SEQ ID NO: 445380 - RNA, 19 nt, Homo sapiens
ccagaaggagcucaccauu

SEQ ID NO: 445381 - RNA, 19 nt, Homo sapiens
ccagugguggguaauugua

SEQ ID NO: 445382 - RNA, 19 nt, Homo sapiens
acaaggaccaggaggugaa

SEQ ID NO: 445383 - RNA, 19 nt, Homo sapiens
gaagcugcaggaugcugaa

SEQ ID NO: 445384 - RNA, 19 nt, Homo sapiens
gaacuuccaggaguauguc

SEQ ID NO: 445385 - RNA, 19 nt, Homo sapiens
ggaccaggaggugaacuuc

SEQ ID NO: 445386 - RNA, 19 nt, Homo sapiens
gggccuuggcuuugaucua

SEQ ID NO: 445387 - RNA, 19 nt, Homo sapiens
gcugagagguccauaauag

SEQ ID NO: 445388 - RNA, 19 nt, Homo sapiens
gaaugaggauaagaagauu

SEQ ID NO: 445389 - RNA, 19 nt, Homo sapiens
ggacaagaaugaggauaag

SEQ ID NO: 445390 - RNA, 19 nt, Homo sapiens
cgacauguuucacaaauac

SEQ ID NO: 445391 - RNA, 19 nt, Homo sapiens
ugacgaugaugaaggagaa

SEQ ID NO: 445392 - RNA, 19 nt, Homo sapiens
gaggauaagaagauugauu

SEQ ID NO: 445393 - RNA, 19 nt, Homo sapiens
cagagacccaggaacaaua

SEQ ID NO: 445394 - RNA, 19 nt, Homo sapiens
agacauagccacagacuac

SEQ ID NO: 445395 - RNA, 19 nt, Homo sapiens
cagacgugaugacaagauu

SEQ ID NO: 445396 - RNA, 19 nt, Homo sapiens
acaagaaugaggauaagaa

SEQ ID NO: 445397 - RNA, 19 nt, Homo sapiens
caccagacgugaugacaag

SEQ ID NO: 445398 - RNA, 19 nt, Homo sapiens
ucgacauguuucacaaaua

SEQ ID NO: 445399 - RNA, 19 nt, Homo sapiens
agaaugaggauaagaagau

SEQ ID NO: 445400 - RNA, 19 nt, Homo sapiens
gaucgacauguuucacaaa

SEQ ID NO: 445401 - RNA, 19 nt, Homo sapiens
uaauaggcaugaucgacau

SEQ ID NO: 445402 - RNA, 19 nt, Homo sapiens
gacgugaugacaagauuga

SEQ ID NO: 445403 - RNA, 19 nt, Homo sapiens
caaauacaccagacgugau

SEQ ID NO: 445404 - RNA, 19 nt, Homo sapiens
caagcugagagguccauaa

SEQ ID NO: 445405 - RNA, 19 nt, Homo sapiens
ugaucgacauguuucacaa

SEQ ID NO: 445406 - RNA, 19 nt, Homo sapiens
acacaucucacucauccuu

SEQ ID NO: 445407 - RNA, 19 nt, Homo sapiens
caagaaugaggauaagaag

SEQ ID NO: 445408 - RNA, 19 nt, Homo sapiens
acacacacaucucacucau

SEQ ID NO: 445409 - RNA, 19 nt, Homo sapiens
caagccugcugacgaugau

SEQ ID NO: 445410 - RNA, 19 nt, Homo sapiens
agagacccaggaacaauaa

SEQ ID NO: 445411 - RNA, 19 nt, Homo sapiens
ugggagacauagccacaga

SEQ ID NO: 445412 - RNA, 19 nt, Homo sapiens
uuucugaguuucuguccuu

SEQ ID NO: 445413 - RNA, 19 nt, Homo sapiens
ccaagccugcugacgauga

SEQ ID NO: 445414 - RNA, 19 nt, Homo sapiens
ugaaagcaaagaugagcaa

SEQ ID NO: 445415 - RNA, 19 nt, Homo sapiens
ccagagacccaggaacaau

SEQ ID NO: 445416 - RNA, 19 nt, Homo sapiens
aaauacaccagacgugaug

SEQ ID NO: 445417 - RNA, 19 nt, Homo sapiens
ccacagacuaccacaagca

SEQ ID NO: 445418 - RNA, 19 nt, Homo sapiens
aggacaagaaugaggauaa

SEQ ID NO: 445419 - RNA, 19 nt, Homo sapiens
aagcaaagaugagcaacac

SEQ ID NO: 445420 - RNA, 19 nt, Homo sapiens
gagacauagccacagacua

SEQ ID NO: 445421 - RNA, 19 nt, Homo sapiens
ccuuagugccugugacaaa

SEQ ID NO: 445422 - RNA, 19 nt, Homo sapiens
gaacuuccccaacuuccuu

SEQ ID NO: 445423 - RNA, 19 nt, Homo sapiens
gugaugacaagauugacaa

SEQ ID NO: 445424 - RNA, 19 nt, Homo sapiens
aagcugagagguccauaau

SEQ ID NO: 445425 - RNA, 19 nt, Homo sapiens
ggagacauagccacagacu

SEQ ID NO: 445426 - RNA, 19 nt, Homo sapiens
gacaagaaugaggauaaga

SEQ ID NO: 445427 - RNA, 19 nt, Homo sapiens
caaacacacacaucucacu

SEQ ID NO: 445428 - RNA, 19 nt, Homo sapiens
gggaugaccugaagaaauu

SEQ ID NO: 445429 - RNA, 19 nt, Homo sapiens
gagaaagccuugaacucua

SEQ ID NO: 445430 - RNA, 19 nt, Homo sapiens
gaagaaagccacaaagagu

SEQ ID NO: 445431 - RNA, 19 nt, Homo sapiens
acauguaccugcagaauaa

SEQ ID NO: 445432 - RNA, 19 nt, Homo sapiens
ucaaagaguuggauaucaa

SEQ ID NO: 445433 - RNA, 19 nt, Homo sapiens
acaaagaguagcugaguua

SEQ ID NO: 445434 - RNA, 19 nt, Homo sapiens
ccacaaguacucccugaua

SEQ ID NO: 445435 - RNA, 19 nt, Homo sapiens
cacaaguacucccugauaa

SEQ ID NO: 445436 - RNA, 19 nt, Homo sapiens
ggagaaagccuugaacucu

SEQ ID NO: 445437 - RNA, 19 nt, Homo sapiens
cugaagaaauugcuagaga

SEQ ID NO: 445438 - RNA, 19 nt, Homo sapiens
gcagaauaauaaagucauc

SEQ ID NO: 445439 - RNA, 19 nt, Homo sapiens
gacauguaccugcagaaua

SEQ ID NO: 445440 - RNA, 19 nt, Homo sapiens
gaccgaguguccucaguau

SEQ ID NO: 445441 - RNA, 19 nt, Homo sapiens
gaauuuccaugccgucuac

SEQ ID NO: 445442 - RNA, 19 nt, Homo sapiens
agaaagccuugaacucuau

SEQ ID NO: 445443 - RNA, 19 nt, Homo sapiens
ugaccgagcuggagaaagc

SEQ ID NO: 445444 - RNA, 19 nt, Homo sapiens
ugucagcugucuuucagaa

SEQ ID NO: 445445 - RNA, 19 nt, Homo sapiens
ggacauguaccugcagaau

SEQ ID NO: 445446 - RNA, 19 nt, Homo sapiens
aagaaagccacaaagagua

SEQ ID NO: 445447 - RNA, 19 nt, Homo sapiens
ccgaguguccucaguauau

SEQ ID NO: 445448 - RNA, 19 nt, Homo sapiens
cacaaagaguagcugaguu

SEQ ID NO: 445449 - RNA, 19 nt, Homo sapiens
acaaguacucccugauaaa

SEQ ID NO: 445450 - RNA, 19 nt, Homo sapiens
gcaaguccgugggcaucau

SEQ ID NO: 445451 - RNA, 19 nt, Homo sapiens
ugaagaaagccacaaagag

SEQ ID NO: 445452 - RNA, 19 nt, Homo sapiens
caaguacucccugauaaag

SEQ ID NO: 445453 - RNA, 19 nt, Homo sapiens
ccacaaagaguagcugagu

SEQ ID NO: 445454 - RNA, 19 nt, Homo sapiens
ucucuugucagcugucuuu

SEQ ID NO: 445455 - RNA, 19 nt, Homo sapiens
ccaugaagaaagccacaaa

SEQ ID NO: 445456 - RNA, 19 nt, Homo sapiens
guuccucauucuggugaua

SEQ ID NO: 445457 - RNA, 19 nt, Homo sapiens
guaccugcagaauaauaaa

SEQ ID NO: 445458 - RNA, 19 nt, Homo sapiens
guucaaagaguuggauauc

SEQ ID NO: 445459 - RNA, 19 nt, Homo sapiens
cgaguguccucaguauauc

SEQ ID NO: 445460 - RNA, 19 nt, Homo sapiens
gagaccgaguguccucagu

SEQ ID NO: 445461 - RNA, 19 nt, Homo sapiens
ucaucgacgucuaccacaa

SEQ ID NO: 445462 - RNA, 19 nt, Homo sapiens
agaccgaguguccucagua

SEQ ID NO: 445463 - RNA, 19 nt, Homo sapiens
cgacgucuaccacaaguac

SEQ ID NO: 445464 - RNA, 19 nt, Homo sapiens
ucauucuggugauaaagau

SEQ ID NO: 445465 - RNA, 19 nt, Homo sapiens
agaaagccacaaagaguag

SEQ ID NO: 445466 - RNA, 19 nt, Homo sapiens
uguaccugcagaauaauaa

SEQ ID NO: 445467 - RNA, 19 nt, Homo sapiens
gacgucugguucaaagagu

SEQ ID NO: 445468 - RNA, 19 nt, Homo sapiens
ucaaagagcuggugcgaaa

SEQ ID NO: 445469 - RNA, 19 nt, Homo sapiens
ggacacaaaugcagacaag

SEQ ID NO: 445470 - RNA, 19 nt, Homo sapiens
agaaggagaauaagaauga

SEQ ID NO: 445471 - RNA, 19 nt, Homo sapiens
uggaggaccuggacacaaa

SEQ ID NO: 445472 - RNA, 19 nt, Homo sapiens
gaaggagaauaagaaugaa

SEQ ID NO: 445473 - RNA, 19 nt, Homo sapiens
ucaagaaggagaauaagaa

SEQ ID NO: 445474 - RNA, 19 nt, Homo sapiens
ggucauagaacacaucaug

SEQ ID NO: 445475 - RNA, 19 nt, Homo sapiens
ucaacaccuuccaccaaua

SEQ ID NO: 445476 - RNA, 19 nt, Homo sapiens
caacauagagaccaucauc

SEQ ID NO: 445477 - RNA, 19 nt, Homo sapiens
ggacagagugcaagacgau

SEQ ID NO: 445478 - RNA, 19 nt, Homo sapiens
gcagcuggaacgcaacaua

SEQ ID NO: 445479 - RNA, 19 nt, Homo sapiens
gcgaaaagaucugcaaaau

SEQ ID NO: 445480 - RNA, 19 nt, Homo sapiens
caagaaggagaauaagaau

SEQ ID NO: 445481 - RNA, 19 nt, Homo sapiens
gacgaugacuugcaaaaug

SEQ ID NO: 445482 - RNA, 19 nt, Homo sapiens
caucaacaccuuccaccaa

SEQ ID NO: 445483 - RNA, 19 nt, Homo sapiens
ucauagaacacaucaugga

SEQ ID NO: 445484 - RNA, 19 nt, Homo sapiens
acauagagaccaucaucaa

SEQ ID NO: 445485 - RNA, 19 nt, Homo sapiens
gcccuggccaccaccauaa

SEQ ID NO: 445486 - RNA, 19 nt, Homo sapiens
caacaccuuccaccaauac

SEQ ID NO: 445487 - RNA, 19 nt, Homo sapiens
acacaaaugcagacaagca

SEQ ID NO: 445488 - RNA, 19 nt, Homo sapiens
cgaaaagaucugcaaaauu

SEQ ID NO: 445489 - RNA, 19 nt, Homo sapiens
ccaccaauacucugugaag

SEQ ID NO: 445490 - RNA, 19 nt, Homo sapiens
ggccaaauaaagucucuuc

SEQ ID NO: 445491 - RNA, 19 nt, Homo sapiens
ggccuguuaugucaaacug

SEQ ID NO: 445492 - RNA, 19 nt, Homo sapiens
gaaaaggucauagaacaca

SEQ ID NO: 445493 - RNA, 19 nt, Homo sapiens
ggaccuggacacaaaugca

SEQ ID NO: 445494 - RNA, 19 nt, Homo sapiens
auagagaccaucaucaaca

SEQ ID NO: 445495 - RNA, 19 nt, Homo sapiens
cagcuggaacgcaacauag

SEQ ID NO: 445496 - RNA, 19 nt, Homo sapiens
acagagugcaagacgauga

SEQ ID NO: 445497 - RNA, 19 nt, Homo sapiens
ccaaauaaagucucuuccu

SEQ ID NO: 445498 - RNA, 19 nt, Homo sapiens
ggaggaccuggacacaaau

SEQ ID NO: 445499 - RNA, 19 nt, Homo sapiens
gauaaaggcuacuuaacaa

SEQ ID NO: 445500 - RNA, 19 nt, Homo sapiens
gauaagaguuguccaaagg

SEQ ID NO: 445501 - RNA, 19 nt, Homo sapiens
ggauaaaggcuacuuaaca

SEQ ID NO: 445502 - RNA, 19 nt, Homo sapiens
guguagagauggcaaagug

SEQ ID NO: 445503 - RNA, 19 nt, Homo sapiens
ggacacuuagcaaauguaa

SEQ ID NO: 445504 - RNA, 19 nt, Homo sapiens
caaagggucgcuuaaggaa

SEQ ID NO: 445505 - RNA, 19 nt, Homo sapiens
caaauucgcuggggauaaa

SEQ ID NO: 445506 - RNA, 19 nt, Homo sapiens
gaaaaggaguucccuggau

SEQ ID NO: 445507 - RNA, 19 nt, Homo sapiens
ccaaagggucgcuuaagga

SEQ ID NO: 445508 - RNA, 19 nt, Homo sapiens
guucgcuccucccugauaa

SEQ ID NO: 445509 - RNA, 19 nt, Homo sapiens
caaaggaggaccugagagu

SEQ ID NO: 445510 - RNA, 19 nt, Homo sapiens
gcuccucccugauaagagu

SEQ ID NO: 445511 - RNA, 19 nt, Homo sapiens
gagcuucuuuucccuaauu

SEQ ID NO: 445512 - RNA, 19 nt, Homo sapiens
ccagauaagcuuuugauuu

SEQ ID NO: 445513 - RNA, 19 nt, Homo sapiens
caaaaugccaucucaaaug

SEQ ID NO: 445514 - RNA, 19 nt, Homo sapiens
uaaaggcuacuuaacaaag

SEQ ID NO: 445515 - RNA, 19 nt, Homo sapiens
uaguacacaugaagcagaa

SEQ ID NO: 445516 - RNA, 19 nt, Homo sapiens
ugauaagaguuguccaaag

SEQ ID NO: 445517 - RNA, 19 nt, Homo sapiens
aaaaggaguucccuggauu

SEQ ID NO: 445518 - RNA, 19 nt, Homo sapiens
ugacaagcagagaaagaaa

SEQ ID NO: 445519 - RNA, 19 nt, Homo sapiens
ccauagaaggauuucauga

SEQ ID NO: 445520 - RNA, 19 nt, Homo sapiens
acaugaagcagaagggaaa

SEQ ID NO: 445521 - RNA, 19 nt, Homo sapiens
aaaggaguucccuggauuu

SEQ ID NO: 445522 - RNA, 19 nt, Homo sapiens
gcagagaaagaaaaguuaa

SEQ ID NO: 445523 - RNA, 19 nt, Homo sapiens
aaaggaggaccugagagua

SEQ ID NO: 445524 - RNA, 19 nt, Homo sapiens
aggcagaaaugagcaguuc

SEQ ID NO: 445525 - RNA, 19 nt, Homo sapiens
caacggaccacaccaaaau

SEQ ID NO: 445526 - RNA, 19 nt, Homo sapiens
aaaggcuacuuaacaaagg

SEQ ID NO: 445527 - RNA, 19 nt, Homo sapiens
gaacacgccauggaaacca

SEQ ID NO: 445528 - RNA, 19 nt, Homo sapiens
cauagaaggauuucaugag

SEQ ID NO: 445529 - RNA, 19 nt, Homo sapiens
ugaagcagaagggaaagaa

SEQ ID NO: 445530 - RNA, 19 nt, Homo sapiens
gggcuuccagagcuucuuu

SEQ ID NO: 445531 - RNA, 19 nt, Homo sapiens
uccaaagggucgcuuaagg

SEQ ID NO: 445532 - RNA, 19 nt, Homo sapiens
gaagcagaagggaaagaag

SEQ ID NO: 445533 - RNA, 19 nt, Homo sapiens
cauuugacaagcagagaaa

SEQ ID NO: 445534 - RNA, 19 nt, Homo sapiens
gggauaaaggcuacuuaac

SEQ ID NO: 445535 - RNA, 19 nt, Homo sapiens
caacagugauggucagcua

SEQ ID NO: 445536 - RNA, 19 nt, Homo sapiens
gaaguaugcuggaaaggau

SEQ ID NO: 445537 - RNA, 19 nt, Homo sapiens
ugaagaaacuggacaccaa

SEQ ID NO: 445538 - RNA, 19 nt, Homo sapiens
uuccuaagcuucaugaaua

SEQ ID NO: 445539 - RNA, 19 nt, Homo sapiens
agacagaguuccuaagcuu

SEQ ID NO: 445540 - RNA, 19 nt, Homo sapiens
agaacuagcugccuucaca

SEQ ID NO: 445541 - RNA, 19 nt, Homo sapiens
ucacaaagaaccagaagga

SEQ ID NO: 445542 - RNA, 19 nt, Homo sapiens
ccaccugccaauaguaaua

SEQ ID NO: 445543 - RNA, 19 nt, Homo sapiens
cuagcugccuucacaaaga

SEQ ID NO: 445544 - RNA, 19 nt, Homo sapiens
cuucaugaauacagaacua

SEQ ID NO: 445545 - RNA, 19 nt, Homo sapiens
gugauggucagcuagauuu

SEQ ID NO: 445546 - RNA, 19 nt, Homo sapiens
uagcugccuucacaaagaa

SEQ ID NO: 445547 - RNA, 19 nt, Homo sapiens
gaacuagcugccuucacaa

SEQ ID NO: 445548 - RNA, 19 nt, Homo sapiens
uaagcuucaugaauacaga

SEQ ID NO: 445549 - RNA, 19 nt, Homo sapiens
gcacacuaaccaccucaug

SEQ ID NO: 445550 - RNA, 19 nt, Homo sapiens
gugcaucgagucccugauu

SEQ ID NO: 445551 - RNA, 19 nt, Homo sapiens
guaauaaagcaaugucacu

SEQ ID NO: 445552 - RNA, 19 nt, Homo sapiens
cuggaaaggaugguuauaa

SEQ ID NO: 445553 - RNA, 19 nt, Homo sapiens
guccuugaccgcaugauga

SEQ ID NO: 445554 - RNA, 19 nt, Homo sapiens
caagacagaguuccuaagc

SEQ ID NO: 445555 - RNA, 19 nt, Homo sapiens
cagccuuucugucaucauc

SEQ ID NO: 445556 - RNA, 19 nt, Homo sapiens
gccaauaguaauaaagcaa

SEQ ID NO: 445557 - RNA, 19 nt, Homo sapiens
guuccuaagcuucaugaau

SEQ ID NO: 445558 - RNA, 19 nt, Homo sapiens
agaaguaugcuggaaagga

SEQ ID NO: 445559 - RNA, 19 nt, Homo sapiens
gcuggaaaggaugguuaua

SEQ ID NO: 445560 - RNA, 19 nt, Homo sapiens
acacuaaccaccucaugca

SEQ ID NO: 445561 - RNA, 19 nt, Homo sapiens
caccugccaauaguaauaa

SEQ ID NO: 445562 - RNA, 19 nt, Homo sapiens
gcaaacaccaucaagaaua

SEQ ID NO: 445563 - RNA, 19 nt, Homo sapiens
caaacaccaucaagaauau

SEQ ID NO: 445564 - RNA, 19 nt, Homo sapiens
ccagcaauguccucaauga

SEQ ID NO: 445565 - RNA, 19 nt, Homo sapiens
agauaaagcugucauugau

SEQ ID NO: 445566 - RNA, 19 nt, Homo sapiens
guagcucucugaaggcuuu

SEQ ID NO: 445567 - RNA, 19 nt, Homo sapiens
gucaauaucuuccaccaau

SEQ ID NO: 445568 - RNA, 19 nt, Homo sapiens
gcugaaggcugcccauuac

SEQ ID NO: 445569 - RNA, 19 nt, Homo sapiens
ucaauaucuuccaccaaua

SEQ ID NO: 445570 - RNA, 19 nt, Homo sapiens
ggaguaagaguuaauaaac

SEQ ID NO: 445571 - RNA, 19 nt, Homo sapiens
ggucgacuuucaagaauuc

SEQ ID NO: 445572 - RNA, 19 nt, Homo sapiens
gaacaggucgacuuucaag

SEQ ID NO: 445573 - RNA, 19 nt, Homo sapiens
gggaguaagaguuaauaaa

SEQ ID NO: 445574 - RNA, 19 nt, Homo sapiens
caaugagggucuuuucuuu

SEQ ID NO: 445575 - RNA, 19 nt, Homo sapiens
cgacuuucaagaauucaua

SEQ ID NO: 445576 - RNA, 19 nt, Homo sapiens
aagauaaagcugucauuga

SEQ ID NO: 445577 - RNA, 19 nt, Homo sapiens
gauaaagcugucauugaug

SEQ ID NO: 445578 - RNA, 19 nt, Homo sapiens
caaagauaaagcugucauu

SEQ ID NO: 445579 - RNA, 19 nt, Homo sapiens
uaauaaacacacucacgaa

SEQ ID NO: 445580 - RNA, 19 nt, Homo sapiens
caggucgacuuucaagaau

SEQ ID NO: 445581 - RNA, 19 nt, Homo sapiens
ggaugcuaaucaagaugaa

SEQ ID NO: 445582 - RNA, 19 nt, Homo sapiens
aaagauaaagcugucauug

SEQ ID NO: 445583 - RNA, 19 nt, Homo sapiens
acaggucgacuuucaagaa

SEQ ID NO: 445584 - RNA, 19 nt, Homo sapiens
ccaucaagaauaucaaaga

SEQ ID NO: 445585 - RNA, 19 nt, Homo sapiens
aauaaacacacucacgaaa

SEQ ID NO: 445586 - RNA, 19 nt, Homo sapiens
aagagcaucuggagggaau

SEQ ID NO: 445587 - RNA, 19 nt, Homo sapiens
uugcaaacaccaucaagaa

SEQ ID NO: 445588 - RNA, 19 nt, Homo sapiens
acauuaggcugggaagaug

SEQ ID NO: 445589 - RNA, 19 nt, Homo sapiens
gaagaugacaaaacuugaa

SEQ ID NO: 445590 - RNA, 19 nt, Homo sapiens
uaaacacacucacgaaaag

SEQ ID NO: 445591 - RNA, 19 nt, Homo sapiens
cgcugaaggcugcccauua

SEQ ID NO: 445592 - RNA, 19 nt, Homo sapiens
caauaucuuccaccaauac

SEQ ID NO: 445593 - RNA, 19 nt, Homo sapiens
gagcaucuggagggaauug

SEQ ID NO: 445594 - RNA, 19 nt, Homo sapiens
ccuggaugcuaaucaagau

SEQ ID NO: 445595 - RNA, 19 nt, Homo sapiens
uaucuuccaccaauacuca

SEQ ID NO: 445596 - RNA, 19 nt, Homo sapiens
gcauugagggguuaacauu

SEQ ID NO: 445597 - RNA, 19 nt, Homo sapiens
agaugaacaggucgacuuu

SEQ ID NO: 445598 - RNA, 19 nt, Homo sapiens
ccacaaagaguagguagcu

SEQ ID NO: 445599 - RNA, 19 nt, Homo sapiens
agaauucauaucccuggua

SEQ ID NO: 445600 - RNA, 19 nt, Homo sapiens
gggaagaugacaaaacuug

SEQ ID NO: 445601 - RNA, 19 nt, Homo sapiens
caccaucaagaauaucaaa

SEQ ID NO: 445602 - RNA, 19 nt, Homo sapiens
aagaugaacaggucgacuu

SEQ ID NO: 445603 - RNA, 19 nt, Homo sapiens
gagcuugcaaacaccauca

SEQ ID NO: 445604 - RNA, 19 nt, Homo sapiens
gaaccgcacucuucccaaa

SEQ ID NO: 445605 - RNA, 19 nt, Homo sapiens
gagcagaaccgcacucuuc

SEQ ID NO: 445606 - RNA, 19 nt, Homo sapiens
ccaaggaaaucaggaagaa

SEQ ID NO: 445607 - RNA, 19 nt, Homo sapiens
gaagaaagaccugaagauc

SEQ ID NO: 445608 - RNA, 19 nt, Homo sapiens
caaauaaagcuuccuccuu

SEQ ID NO: 445609 - RNA, 19 nt, Homo sapiens
ggaagaagaaagaccugaa

SEQ ID NO: 445610 - RNA, 19 nt, Homo sapiens
augaagagcuuggauguga

SEQ ID NO: 445611 - RNA, 19 nt, Homo sapiens
gaagaucaggaagaaguaa

SEQ ID NO: 445612 - RNA, 19 nt, Homo sapiens
acucggagcucaaguucaa

SEQ ID NO: 445613 - RNA, 19 nt, Homo sapiens
gaaaucaggaagaagaaag

SEQ ID NO: 445614 - RNA, 19 nt, Homo sapiens
aaugaguacuggagauuga

SEQ ID NO: 445615 - RNA, 19 nt, Homo sapiens
gaagaagaaagaccugaag

SEQ ID NO: 445616 - RNA, 19 nt, Homo sapiens
cagcagaaccacugacaga

SEQ ID NO: 445617 - RNA, 19 nt, Homo sapiens
gaagagcuuggaugugaau

SEQ ID NO: 445618 - RNA, 19 nt, Homo sapiens
ggaaaucaggaagaagaaa

SEQ ID NO: 445619 - RNA, 19 nt, Homo sapiens
uaaagcuuccuccuugaaa

SEQ ID NO: 445620 - RNA, 19 nt, Homo sapiens
gcacucuucccaaauaaag

SEQ ID NO: 445621 - RNA, 19 nt, Homo sapiens
aauaaagcuuccuccuuga

SEQ ID NO: 445622 - RNA, 19 nt, Homo sapiens
aagaaagaccugaagauca

SEQ ID NO: 445623 - RNA, 19 nt, Homo sapiens
ggacucggagcucaaguuc

SEQ ID NO: 445624 - RNA, 19 nt, Homo sapiens
ugaagagcuuggaugugaa

SEQ ID NO: 445625 - RNA, 19 nt, Homo sapiens
ccgcacucuucccaaauaa

SEQ ID NO: 445626 - RNA, 19 nt, Homo sapiens
gaagaugaagagcuuggau

SEQ ID NO: 445627 - RNA, 19 nt, Homo sapiens
ugaagaucaggaagaagua

SEQ ID NO: 445628 - RNA, 19 nt, Homo sapiens
aaggaaaucaggaagaaga

SEQ ID NO: 445629 - RNA, 19 nt, Homo sapiens
gagcuuggaugugaaucag

SEQ ID NO: 445630 - RNA, 19 nt, Homo sapiens
augagaagaugaagagcuu

SEQ ID NO: 445631 - RNA, 19 nt, Homo sapiens
accgcacucuucccaaaua

SEQ ID NO: 445632 - RNA, 19 nt, Homo sapiens
gaucagggccgagcagaac

SEQ ID NO: 445633 - RNA, 19 nt, Homo sapiens
ucaaugaguacuggagauu

SEQ ID NO: 445634 - RNA, 19 nt, Homo sapiens
gagcuagaggaguccauug

SEQ ID NO: 445635 - RNA, 19 nt, Homo sapiens
agaagaaagaccugaagau

SEQ ID NO: 445636 - RNA, 19 nt, Homo sapiens
gccaaggaaaucaggaaga

SEQ ID NO: 445637 - RNA, 19 nt, Homo sapiens
ucaccaccuucuucaccuu

SEQ ID NO: 445638 - RNA, 19 nt, Homo sapiens
ggagcuggccaaggaaauc

SEQ ID NO: 445639 - RNA, 19 nt, Homo sapiens
gagcuggccaaggaaauca

SEQ ID NO: 445640 - RNA, 19 nt, Homo sapiens
aagaagaaagaccugaaga

SEQ ID NO: 445641 - RNA, 19 nt, Homo sapiens
gaugaagagcuuggaugug

SEQ ID NO: 445642 - RNA, 19 nt, Homo sapiens
ccuaauggcagcagaacca

SEQ ID NO: 445643 - RNA, 19 nt, Homo sapiens
aaaucaggaagaagaaaga

SEQ ID NO: 445644 - RNA, 19 nt, Homo sapiens
gaguacuggagauugauug

SEQ ID NO: 445645 - RNA, 19 nt, Homo sapiens
cagcgucaacgaguucaaa

SEQ ID NO: 445646 - RNA, 19 nt, Homo sapiens
gaacaugagugagauuaga

SEQ ID NO: 445647 - RNA, 19 nt, Homo sapiens
ggacucuuguuaacaguaa

SEQ ID NO: 445648 - RNA, 19 nt, Homo sapiens
uggaaacacuggacaauga

SEQ ID NO: 445649 - RNA, 19 nt, Homo sapiens
agccaaaccuuuccuguaa

SEQ ID NO: 445650 - RNA, 19 nt, Homo sapiens
caaggaagaggaugucuga

SEQ ID NO: 445651 - RNA, 19 nt, Homo sapiens
acacugcuguucuuuaaau

SEQ ID NO: 445652 - RNA, 19 nt, Homo sapiens
aaacuuccacuaccuuuaa

SEQ ID NO: 445653 - RNA, 19 nt, Homo sapiens
ggagucaggucucagugau

SEQ ID NO: 445654 - RNA, 19 nt, Homo sapiens
caucauucuuucugcuaua

SEQ ID NO: 445655 - RNA, 19 nt, Homo sapiens
gcaggauccuugccuccaa

SEQ ID NO: 445656 - RNA, 19 nt, Homo sapiens
ucaaagagcaggagguugu

SEQ ID NO: 445657 - RNA, 19 nt, Homo sapiens
agucaggucucagugauaa

SEQ ID NO: 445658 - RNA, 19 nt, Homo sapiens
ggacaaagucauggaaaca

SEQ ID NO: 445659 - RNA, 19 nt, Homo sapiens
gagacaagcacaagcugaa

SEQ ID NO: 445660 - RNA, 19 nt, Homo sapiens
gccguguuguagcuaauua

SEQ ID NO: 445661 - RNA, 19 nt, Homo sapiens
gcaagaaagcagacagcaa

SEQ ID NO: 445662 - RNA, 19 nt, Homo sapiens
ccaaaccuuuccuguaaca

SEQ ID NO: 445663 - RNA, 19 nt, Homo sapiens
gcaucauucuuucugcuau

SEQ ID NO: 445664 - RNA, 19 nt, Homo sapiens
ugagugagauuagaaagca

SEQ ID NO: 445665 - RNA, 19 nt, Homo sapiens
gaauucauggccuuuguug

SEQ ID NO: 445666 - RNA, 19 nt, Homo sapiens
uguuguagcuaauuaggaa

SEQ ID NO: 445667 - RNA, 19 nt, Homo sapiens
cagccaaaccuuuccugua

SEQ ID NO: 445668 - RNA, 19 nt, Homo sapiens
gagggccugcguucaauaa

SEQ ID NO: 445669 - RNA, 19 nt, Homo sapiens
aaagccuuauccagcauua

SEQ ID NO: 445670 - RNA, 19 nt, Homo sapiens
cuaauuaggaagcuugauu

SEQ ID NO: 445671 - RNA, 19 nt, Homo sapiens
ugagcuuucccauuucuua

SEQ ID NO: 445672 - RNA, 19 nt, Homo sapiens
uuaggaagcuugauuugcu

SEQ ID NO: 445673 - RNA, 19 nt, Homo sapiens
aaaagcaacuccaucagaa

SEQ ID NO: 445674 - RNA, 19 nt, Homo sapiens
uuaacggccugcaucauuc

SEQ ID NO: 445675 - RNA, 19 nt, Homo sapiens
gcagcaaggagaccaggaa

SEQ ID NO: 445676 - RNA, 19 nt, Homo sapiens
gaagggagggagacaagca

SEQ ID NO: 445677 - RNA, 19 nt, Homo sapiens
uaaaugcguuccucaucca

SEQ ID NO: 445678 - RNA, 19 nt, Homo sapiens
ugauuugcuuugugauuga

SEQ ID NO: 445679 - RNA, 19 nt, Homo sapiens
gcgagggccugcguucaau

SEQ ID NO: 445680 - RNA, 19 nt, Homo sapiens
ggaauucauggccuuuguu

SEQ ID NO: 445681 - RNA, 19 nt, Homo sapiens
agcacaagcugaagaaauc

SEQ ID NO: 445682 - RNA, 19 nt, Homo sapiens
gaacccugacuacagaaau

SEQ ID NO: 445683 - RNA, 19 nt, Homo sapiens
aacaguaacuuaggaguca

SEQ ID NO: 445684 - RNA, 19 nt, Homo sapiens
auauuaggccuguguguaa

SEQ ID NO: 445685 - RNA, 19 nt, Homo sapiens
uauauuaggccugugugua

SEQ ID NO: 445686 - RNA, 19 nt, Homo sapiens
gaaacacuggacaaugaug

SEQ ID NO: 445687 - RNA, 19 nt, Homo sapiens
ggaaacacuggacaaugau

SEQ ID NO: 445688 - RNA, 19 nt, Homo sapiens
ccagccguguuguagcuaa

SEQ ID NO: 445689 - RNA, 19 nt, Homo sapiens
gagcuuuccagccguguug

SEQ ID NO: 445690 - RNA, 19 nt, Homo sapiens
gacaagcacaagcugaaga

SEQ ID NO: 445691 - RNA, 19 nt, Homo sapiens
aacccugacuacagaaauu

SEQ ID NO: 445692 - RNA, 19 nt, Homo sapiens
cagggacucuuguuaacag

SEQ ID NO: 445693 - RNA, 19 nt, Homo sapiens
gagucaggucucagugaua

SEQ ID NO: 445694 - RNA, 19 nt, Homo sapiens
ugauggagacggcgaaugu

SEQ ID NO: 445695 - RNA, 19 nt, Homo sapiens
ggaacccugacuacagaaa

SEQ ID NO: 445696 - RNA, 19 nt, Homo sapiens
uugauuugcuuugugauug

SEQ ID NO: 445697 - RNA, 19 nt, Homo sapiens
gauuugcuuugugauugaa

SEQ ID NO: 445698 - RNA, 19 nt, Homo sapiens
gagacaaggaagaggaugu

SEQ ID NO: 445699 - RNA, 19 nt, Homo sapiens
ccucauccaugcagauaac

SEQ ID NO: 445700 - RNA, 19 nt, Homo sapiens
uuuaacggccugcaucauu

SEQ ID NO: 445701 - RNA, 19 nt, Homo sapiens
ggccuuuguugccaugguu

SEQ ID NO: 445702 - RNA, 19 nt, Homo sapiens
gggccugcguucaauaaaa

SEQ ID NO: 445703 - RNA, 19 nt, Homo sapiens
acaaagucauggaaacacu

SEQ ID NO: 445704 - RNA, 19 nt, Homo sapiens
acaagcacaagcugaagaa

SEQ ID NO: 445705 - RNA, 19 nt, Homo sapiens
aagcacaagcugaagaaau

SEQ ID NO: 445706 - RNA, 19 nt, Homo sapiens
gagcuuucccauuucuuag

SEQ ID NO: 445707 - RNA, 19 nt, Homo sapiens
cgagggccugcguucaaua

SEQ ID NO: 445708 - RNA, 19 nt, Homo sapiens
ggagggagacaagcacaag

SEQ ID NO: 445709 - RNA, 19 nt, Homo sapiens
ggaugucugagcuggagaa

SEQ ID NO: 445710 - RNA, 19 nt, Homo sapiens
aaucaaagagcaggagguu

SEQ ID NO: 445711 - RNA, 19 nt, Homo sapiens
gccuuauccagcauuauuu

SEQ ID NO: 445712 - RNA, 19 nt, Homo sapiens
gggacucuuguuaacagua

SEQ ID NO: 445713 - RNA, 19 nt, Homo sapiens
agacggcgaaugugacuuc

SEQ ID NO: 445714 - RNA, 19 nt, Homo sapiens
caaagccuuauccagcauu

SEQ ID NO: 445715 - RNA, 19 nt, Homo sapiens
aggaauucauggccuuugu

SEQ ID NO: 445716 - RNA, 19 nt, Homo sapiens
gcucauguaccucugauua

SEQ ID NO: 445717 - RNA, 19 nt, Homo sapiens
gaaggcaggacucaaauga

SEQ ID NO: 445718 - RNA, 19 nt, Homo sapiens
ggacuucagugaguucauc

SEQ ID NO: 445719 - RNA, 19 nt, Homo sapiens
acaaggaugccguggauaa

SEQ ID NO: 445720 - RNA, 19 nt, Homo sapiens
ucagugaguucaucguguu

SEQ ID NO: 445721 - RNA, 19 nt, Homo sapiens
agacaaggaugccguggau

SEQ ID NO: 445722 - RNA, 19 nt, Homo sapiens
gcacgcagacccugaccaa

SEQ ID NO: 445723 - RNA, 19 nt, Homo sapiens
caaaugaugcccuggagau

SEQ ID NO: 445724 - RNA, 19 nt, Homo sapiens
aggcaggacucaaaugaug

SEQ ID NO: 445725 - RNA, 19 nt, Homo sapiens
cauguaccucugauuaaua

SEQ ID NO: 445726 - RNA, 19 nt, Homo sapiens
ucauguaccucugauuaau

SEQ ID NO: 445727 - RNA, 19 nt, Homo sapiens
aggaugccguggauaaauu

SEQ ID NO: 445728 - RNA, 19 nt, Homo sapiens
uggauaaauugcucaagga

SEQ ID NO: 445729 - RNA, 19 nt, Homo sapiens
gagaaggcaggacucaaau

SEQ ID NO: 445730 - RNA, 19 nt, Homo sapiens
cuggagaugucacagauuc

SEQ ID NO: 445731 - RNA, 19 nt, Homo sapiens
caaggaugccguggauaaa

SEQ ID NO: 445732 - RNA, 19 nt, Homo sapiens
ugucacaaguacuuugaga

SEQ ID NO: 445733 - RNA, 19 nt, Homo sapiens
cagguggacuucagugagu

SEQ ID NO: 445734 - RNA, 19 nt, Homo sapiens
ggaccuggacgccaaugga

SEQ ID NO: 445735 - RNA, 19 nt, Homo sapiens
ucacaaguacuuugagaag

SEQ ID NO: 445736 - RNA, 19 nt, Homo sapiens
gagaugcccagguggacuu

SEQ ID NO: 445737 - RNA, 19 nt, Homo sapiens
gcaccaugacggaacuaga

SEQ ID NO: 445738 - RNA, 19 nt, Homo sapiens
ggaugccguggauaaauug

SEQ ID NO: 445739 - RNA, 19 nt, Homo sapiens
aaguguuuguuggcaauua

SEQ ID NO: 445740 - RNA, 19 nt, Homo sapiens
caugaucauagacgucuuu

SEQ ID NO: 445741 - RNA, 19 nt, Homo sapiens
gcaugaucauagacgucuu

SEQ ID NO: 445742 - RNA, 19 nt, Homo sapiens
gaacuaugaugcugccaaa

SEQ ID NO: 445743 - RNA, 19 nt, Homo sapiens
gagagaagccaauuacauc

SEQ ID NO: 445744 - RNA, 19 nt, Homo sapiens
ccaauuacaucggcucaga

SEQ ID NO: 445745 - RNA, 19 nt, Homo sapiens
uuacaucggcucagacaaa

SEQ ID NO: 445746 - RNA, 19 nt, Homo sapiens
cagagagaauauccagaga

SEQ ID NO: 445747 - RNA, 19 nt, Homo sapiens
ugagagaagccaauuacau

SEQ ID NO: 445748 - RNA, 19 nt, Homo sapiens
cugcuggccugccugagaa

SEQ ID NO: 445749 - RNA, 19 nt, Homo sapiens
caugagagaagccaauuac

SEQ ID NO: 445750 - RNA, 19 nt, Homo sapiens
gacaugagagaagccaauu

SEQ ID NO: 445751 - RNA, 19 nt, Homo sapiens
agccuacucugacaugaga

SEQ ID NO: 445752 - RNA, 19 nt, Homo sapiens
cagcagccgaagcuucuuu

SEQ ID NO: 445753 - RNA, 19 nt, Homo sapiens
caucggcucagacaaauac

SEQ ID NO: 445754 - RNA, 19 nt, Homo sapiens
uacaucggcucagacaaau

SEQ ID NO: 445755 - RNA, 19 nt, Homo sapiens
acaugagagaagccaauua

SEQ ID NO: 445756 - RNA, 19 nt, Homo sapiens
agacaaauacuuccaugcu

SEQ ID NO: 445757 - RNA, 19 nt, Homo sapiens
ugacaugagagaagccaau

SEQ ID NO: 445758 - RNA, 19 nt, Homo sapiens
gggcagggauucaaaguua

SEQ ID NO: 445759 - RNA, 19 nt, Homo sapiens
gaacuaugaugcugccaaa

SEQ ID NO: 445760 - RNA, 19 nt, Homo sapiens
gcacagaucagcaccauga

SEQ ID NO: 445761 - RNA, 19 nt, Homo sapiens
cagagaagcugagauaugg

SEQ ID NO: 445762 - RNA, 19 nt, Homo sapiens
gagagaagccaauuacauc

SEQ ID NO: 445763 - RNA, 19 nt, Homo sapiens
gcauauaauaggcaucuaa

SEQ ID NO: 445764 - RNA, 19 nt, Homo sapiens
auacugagcuuccucuuca

SEQ ID NO: 445765 - RNA, 19 nt, Homo sapiens
cgaucaggcugccaauaaa

SEQ ID NO: 445766 - RNA, 19 nt, Homo sapiens
ccaauuacaucggcucaga

SEQ ID NO: 445767 - RNA, 19 nt, Homo sapiens
guccagagaagcugagaua

SEQ ID NO: 445768 - RNA, 19 nt, Homo sapiens
caaaguuagugaggucuau

SEQ ID NO: 445769 - RNA, 19 nt, Homo sapiens
ccagagaagcugagauaug

SEQ ID NO: 445770 - RNA, 19 nt, Homo sapiens
uuacaucggcucagacaaa

SEQ ID NO: 445771 - RNA, 19 nt, Homo sapiens
ccgaucaggcugccaauaa

SEQ ID NO: 445772 - RNA, 19 nt, Homo sapiens
ugaggucuauguccagaga

SEQ ID NO: 445773 - RNA, 19 nt, Homo sapiens
cagagagaauauccagaga

SEQ ID NO: 445774 - RNA, 19 nt, Homo sapiens
gaucaggcugccaauaaau

SEQ ID NO: 445775 - RNA, 19 nt, Homo sapiens
ugagagaagccaauuacau

SEQ ID NO: 445776 - RNA, 19 nt, Homo sapiens
ccugagaaauacugagcuu

SEQ ID NO: 445777 - RNA, 19 nt, Homo sapiens
gcagagaccccaaucacuu

SEQ ID NO: 445778 - RNA, 19 nt, Homo sapiens
ccucuucacucugcucuca

SEQ ID NO: 445779 - RNA, 19 nt, Homo sapiens
gcuccuugguccugagugu

SEQ ID NO: 445780 - RNA, 19 nt, Homo sapiens
gaucagcaccaugaagcuu

SEQ ID NO: 445781 - RNA, 19 nt, Homo sapiens
cugcuggccugccugagaa

SEQ ID NO: 445782 - RNA, 19 nt, Homo sapiens
cagcacagaucagcaccau

SEQ ID NO: 445783 - RNA, 19 nt, Homo sapiens
caugagagaagccaauuac

SEQ ID NO: 445784 - RNA, 19 nt, Homo sapiens
gacaugagagaagccaauu

SEQ ID NO: 445785 - RNA, 19 nt, Homo sapiens
gcagggauucaaaguuagu

SEQ ID NO: 445786 - RNA, 19 nt, Homo sapiens
agccuacucugacaugaga

SEQ ID NO: 445787 - RNA, 19 nt, Homo sapiens
cagcagccgaagcuucuuu

SEQ ID NO: 445788 - RNA, 19 nt, Homo sapiens
aggacucgcuggccgauca

SEQ ID NO: 445789 - RNA, 19 nt, Homo sapiens
caucggcucagacaaauac

SEQ ID NO: 445790 - RNA, 19 nt, Homo sapiens
ggcagggauucaaaguuag

SEQ ID NO: 445791 - RNA, 19 nt, Homo sapiens
gagaaauacugagcuuccu

SEQ ID NO: 445792 - RNA, 19 nt, Homo sapiens
uacaucggcucagacaaau

SEQ ID NO: 445793 - RNA, 19 nt, Homo sapiens
acaugagagaagccaauua

SEQ ID NO: 445794 - RNA, 19 nt, Homo sapiens
agacaaauacuuccaugcu

SEQ ID NO: 445795 - RNA, 19 nt, Homo sapiens
ugacaugagagaagccaau

SEQ ID NO: 445796 - RNA, 19 nt, Homo sapiens
ucaaaguuagugaggucua

SEQ ID NO: 445797 - RNA, 19 nt, Homo sapiens
cgagaaagcugaggaaugg

SEQ ID NO: 445798 - RNA, 19 nt, Homo sapiens
ucaaacagauaucucuaug

SEQ ID NO: 445799 - RNA, 19 nt, Homo sapiens
cuagagguguucaauaaau

SEQ ID NO: 445800 - RNA, 19 nt, Homo sapiens
aaacagauaucucuaugcu

SEQ ID NO: 445801 - RNA, 19 nt, Homo sapiens
ggacaugggcagagccuau

SEQ ID NO: 445802 - RNA, 19 nt, Homo sapiens
cagggaaacugggcuguga

SEQ ID NO: 445803 - RNA, 19 nt, Homo sapiens
gggucuaucuucagggauu

SEQ ID NO: 445804 - RNA, 19 nt, Homo sapiens
ccuaagaaauacugagcuu

SEQ ID NO: 445805 - RNA, 19 nt, Homo sapiens
ggucuaucuucagggauua

SEQ ID NO: 445806 - RNA, 19 nt, Homo sapiens
gguguucaauaaauguuug

SEQ ID NO: 445807 - RNA, 19 nt, Homo sapiens
gcucugccuuuacugaaau

SEQ ID NO: 445808 - RNA, 19 nt, Homo sapiens
uagagguguucaauaaaug

SEQ ID NO: 445809 - RNA, 19 nt, Homo sapiens
cuaugaugcugcccaaaga

SEQ ID NO: 445810 - RNA, 19 nt, Homo sapiens
ggacauaaugauauccaau

SEQ ID NO: 445811 - RNA, 19 nt, Homo sapiens
cagagccuauugggacaua

SEQ ID NO: 445812 - RNA, 19 nt, Homo sapiens
caacgagaaagcugaggaa

SEQ ID NO: 445813 - RNA, 19 nt, Homo sapiens
ugaaagcuggcguucguuu

SEQ ID NO: 445814 - RNA, 19 nt, Homo sapiens
gacauaaugauauccaauc

SEQ ID NO: 445815 - RNA, 19 nt, Homo sapiens
ugucugggcugcuaaacuc

SEQ ID NO: 445816 - RNA, 19 nt, Homo sapiens
gaccugacggccugccuaa

SEQ ID NO: 445817 - RNA, 19 nt, Homo sapiens
guuccagggucuaucuuca

SEQ ID NO: 445818 - RNA, 19 nt, Homo sapiens
cuauugggacauaaugaua

SEQ ID NO: 445819 - RNA, 19 nt, Homo sapiens
gauauccaaucaccaaaau

SEQ ID NO: 445820 - RNA, 19 nt, Homo sapiens
gaaagguccacagcacaau

SEQ ID NO: 445821 - RNA, 19 nt, Homo sapiens
cuucagggauuaauagacu

SEQ ID NO: 445822 - RNA, 19 nt, Homo sapiens
gggacauaaugauauccaa

SEQ ID NO: 445823 - RNA, 19 nt, Homo sapiens
gcuccacggccagaagaua

SEQ ID NO: 445824 - RNA, 19 nt, Homo sapiens
cugacggccugccuaagaa

SEQ ID NO: 445825 - RNA, 19 nt, Homo sapiens
ucaccaaaauucaaacaga

SEQ ID NO: 445826 - RNA, 19 nt, Homo sapiens
cagggucacugagcuuugu

SEQ ID NO: 445827 - RNA, 19 nt, Homo sapiens
agugaaagcuggcguucgu

SEQ ID NO: 445828 - RNA, 19 nt, Homo sapiens
ccugacggccugccuaaga

SEQ ID NO: 445829 - RNA, 19 nt, Homo sapiens
agaaagguccacagcacaa

SEQ ID NO: 445830 - RNA, 19 nt, Homo sapiens
gacaugggcagagccuauu

SEQ ID NO: 445831 - RNA, 19 nt, Homo sapiens
uaucuucagggauuaauag

SEQ ID NO: 445832 - RNA, 19 nt, Homo sapiens
ccuagagguguucaauaaa

SEQ ID NO: 445833 - RNA, 19 nt, Homo sapiens
gagccuauugggacauaau

SEQ ID NO: 445834 - RNA, 19 nt, Homo sapiens
gaaagcuggcguucguuuu

SEQ ID NO: 445835 - RNA, 19 nt, Homo sapiens
gagguguucaauaaauguu

SEQ ID NO: 445836 - RNA, 19 nt, Homo sapiens
agggauuaauagacuacua

SEQ ID NO: 445837 - RNA, 19 nt, Homo sapiens
ugaaacaccuggauucuua

SEQ ID NO: 445838 - RNA, 19 nt, Homo sapiens
gcaaagagguugagagcuu

SEQ ID NO: 445839 - RNA, 19 nt, Homo sapiens
ggaaacccaugaccaacua

SEQ ID NO: 445840 - RNA, 19 nt, Homo sapiens
ccuccuggcucaagaauua

SEQ ID NO: 445841 - RNA, 19 nt, Homo sapiens
ccuaagaucucagcaauuu

SEQ ID NO: 445842 - RNA, 19 nt, Homo sapiens
caacaacuaugacaugaug

SEQ ID NO: 445843 - RNA, 19 nt, Homo sapiens
caaaggagaucagggauga

SEQ ID NO: 445844 - RNA, 19 nt, Homo sapiens
gaacugauccuggagauga

SEQ ID NO: 445845 - RNA, 19 nt, Homo sapiens
gaucagggaugaauaugug

SEQ ID NO: 445846 - RNA, 19 nt, Homo sapiens
gaaggaggcugaggcuuug

SEQ ID NO: 445847 - RNA, 19 nt, Homo sapiens
gggcugagcucaucaacau

SEQ ID NO: 445848 - RNA, 19 nt, Homo sapiens
gcaguugggugaagugguu

SEQ ID NO: 445849 - RNA, 19 nt, Homo sapiens
agauuuaccugucuuacua

SEQ ID NO: 445850 - RNA, 19 nt, Homo sapiens
agacggcccugcugaagua

SEQ ID NO: 445851 - RNA, 19 nt, Homo sapiens
gaccuaagaucucagcaau

SEQ ID NO: 445852 - RNA, 19 nt, Homo sapiens
ggaaggagcagcuuguguu

SEQ ID NO: 445853 - RNA, 19 nt, Homo sapiens
aggcaaaucuggaggauga

SEQ ID NO: 445854 - RNA, 19 nt, Homo sapiens
ggacacaggaauucauuga

SEQ ID NO: 445855 - RNA, 19 nt, Homo sapiens
gaaggugcaguauccauuu

SEQ ID NO: 445856 - RNA, 19 nt, Homo sapiens
ucaagagagugagaauaua

SEQ ID NO: 445857 - RNA, 19 nt, Homo sapiens
ucaaauaucugggaacgau

SEQ ID NO: 445858 - RNA, 19 nt, Homo sapiens
ggaagacccuuugggacuu

SEQ ID NO: 445859 - RNA, 19 nt, Homo sapiens
gaaggagcagcuuguguuu

SEQ ID NO: 445860 - RNA, 19 nt, Homo sapiens
uaagaucucagcaauuuga

SEQ ID NO: 445861 - RNA, 19 nt, Homo sapiens
gaucaacaacuaugacaug

SEQ ID NO: 445862 - RNA, 19 nt, Homo sapiens
ggagaucagggaugaauau

SEQ ID NO: 445863 - RNA, 19 nt, Homo sapiens
ucagcaauuugaacacuaa

SEQ ID NO: 445864 - RNA, 19 nt, Homo sapiens
gagcagauguugggagcuu

SEQ ID NO: 445865 - RNA, 19 nt, Homo sapiens
ugacgaagauccgagaguu

SEQ ID NO: 445866 - RNA, 19 nt, Homo sapiens
guagaucuccgucacuauu

SEQ ID NO: 445867 - RNA, 19 nt, Homo sapiens
ugaaggaggcugaggcuuu

SEQ ID NO: 445868 - RNA, 19 nt, Homo sapiens
ccagacaauuccuaaugaa

SEQ ID NO: 445869 - RNA, 19 nt, Homo sapiens
gagaguuuauccuccagaa

SEQ ID NO: 445870 - RNA, 19 nt, Homo sapiens
gaauauagcaucucuacac

SEQ ID NO: 445871 - RNA, 19 nt, Homo sapiens
guuucagacuuccauauuu

SEQ ID NO: 445872 - RNA, 19 nt, Homo sapiens
gaacggaccaugcaauugc

SEQ ID NO: 445873 - RNA, 19 nt, Homo sapiens
gcauaagcccaacuucuga

SEQ ID NO: 445874 - RNA, 19 nt, Homo sapiens
agaaauggcaccaguauca

SEQ ID NO: 445875 - RNA, 19 nt, Homo sapiens
acaccuggauucuuaucua

SEQ ID NO: 445876 - RNA, 19 nt, Homo sapiens
gagcaagauuuaccugucu

SEQ ID NO: 445877 - RNA, 19 nt, Homo sapiens
gaagacccuuugggacuug

SEQ ID NO: 445878 - RNA, 19 nt, Homo sapiens
cgaagucagucugcagaaa

SEQ ID NO: 445879 - RNA, 19 nt, Homo sapiens
uaucauuucuccagucugu

SEQ ID NO: 445880 - RNA, 19 nt, Homo sapiens
gaguuuauccuccagaaga

SEQ ID NO: 445881 - RNA, 19 nt, Homo sapiens
caaggcagccgcagucaga

SEQ ID NO: 445882 - RNA, 19 nt, Homo sapiens
gaaaucaucaguggaaucu

SEQ ID NO: 445883 - RNA, 19 nt, Homo sapiens
cagcuuguguuucugauca

SEQ ID NO: 445884 - RNA, 19 nt, Homo sapiens
gaauuacuccgaagucagu

SEQ ID NO: 445885 - RNA, 19 nt, Homo sapiens
gcacuacgcccuccuagac

SEQ ID NO: 445886 - RNA, 19 nt, Homo sapiens
caagagagugagaauauag

SEQ ID NO: 445887 - RNA, 19 nt, Homo sapiens
ggaguuggauaucacuucu

SEQ ID NO: 445888 - RNA, 19 nt, Homo sapiens
uaguaugacaugacacuua

SEQ ID NO: 445889 - RNA, 19 nt, Homo sapiens
gauguaaugcggaguuuca

SEQ ID NO: 445890 - RNA, 19 nt, Homo sapiens
agguggagguggagaauuu

SEQ ID NO: 445891 - RNA, 19 nt, Homo sapiens
gcuggagucaaacaacuua

SEQ ID NO: 445892 - RNA, 19 nt, Homo sapiens
ucaaggcagugacgaagau

SEQ ID NO: 445893 - RNA, 19 nt, Homo sapiens
uacagcagauugaacagaa

SEQ ID NO: 445894 - RNA, 19 nt, Homo sapiens
ggggacagcuggagucaaa

SEQ ID NO: 445895 - RNA, 19 nt, Homo sapiens
cuccucagcucuuggaauu

SEQ ID NO: 445896 - RNA, 19 nt, Homo sapiens
caacauucaccaccuuaug

SEQ ID NO: 445897 - RNA, 19 nt, Homo sapiens
ugacagagcccagguucuu

SEQ ID NO: 445898 - RNA, 19 nt, Homo sapiens
guguagaucuccgucacua

SEQ ID NO: 445899 - RNA, 19 nt, Homo sapiens
gcugggaccucagauaugg

SEQ ID NO: 445900 - RNA, 19 nt, Homo sapiens
agacuuccauauuuccauu

SEQ ID NO: 445901 - RNA, 19 nt, Homo sapiens
uccagaagauuuauuccuu

SEQ ID NO: 445902 - RNA, 19 nt, Homo sapiens
gaucucagcaauuugaaca

SEQ ID NO: 445903 - RNA, 19 nt, Homo sapiens
caucaacauucaccaccuu

SEQ ID NO: 445904 - RNA, 19 nt, Homo sapiens
gagcagcuuguguuucuga

SEQ ID NO: 445905 - RNA, 19 nt, Homo sapiens
gcgaauaccuuuucaucug

SEQ ID NO: 445906 - RNA, 19 nt, Homo sapiens
acgaagauccgagaguuua

SEQ ID NO: 445907 - RNA, 19 nt, Homo sapiens
gaggaugaguuaguaaagg

SEQ ID NO: 445908 - RNA, 19 nt, Homo sapiens
gggcugggaccucagauau

SEQ ID NO: 445909 - RNA, 19 nt, Homo sapiens
ccuccgcucuugucaguau

SEQ ID NO: 445910 - RNA, 19 nt, Homo sapiens
guucagagcguccgaagca

SEQ ID NO: 445911 - RNA, 19 nt, Homo sapiens
uaagagaacagcgaagguu

SEQ ID NO: 445912 - RNA, 19 nt, Homo sapiens
gaacagucaggagccauga

SEQ ID NO: 445913 - RNA, 19 nt, Homo sapiens
uauagcaucucuacacaac

SEQ ID NO: 445914 - RNA, 19 nt, Homo sapiens
ucagaaauggcaccaguau

SEQ ID NO: 445915 - RNA, 19 nt, Homo sapiens
ucuggaggaugaguuagua

SEQ ID NO: 445916 - RNA, 19 nt, Homo sapiens
gaagccuccucagcucuug

SEQ ID NO: 445917 - RNA, 19 nt, Homo sapiens
gccagaaaccgcccugaga

SEQ ID NO: 445918 - RNA, 19 nt, Homo sapiens
ggaaaucaucaguggaauc

SEQ ID NO: 445919 - RNA, 19 nt, Homo sapiens
ggacagcuggagucaaaca

SEQ ID NO: 445920 - RNA, 19 nt, Homo sapiens
ucaggaaacccaugaccaa

SEQ ID NO: 445921 - RNA, 19 nt, Homo sapiens
uuucagacuuccauauuuc

SEQ ID NO: 445922 - RNA, 19 nt, Homo sapiens
ucacucaacuagucaccau

SEQ ID NO: 445923 - RNA, 19 nt, Homo sapiens
gcugagcucaucaacauuc

SEQ ID NO: 445924 - RNA, 19 nt, Homo sapiens
ugaagugguuagagcugaa

SEQ ID NO: 445925 - RNA, 19 nt, Homo sapiens
guucuccgguuccguaaca

SEQ ID NO: 445926 - RNA, 19 nt, Homo sapiens
ggccguacacucagcauga

SEQ ID NO: 445927 - RNA, 19 nt, Homo sapiens
gagacgcugagcaagauuu

SEQ ID NO: 445928 - RNA, 19 nt, Homo sapiens
gacgaagauccgagaguuu

SEQ ID NO: 445929 - RNA, 19 nt, Homo sapiens
gccaugaacauucgacuuc

SEQ ID NO: 445930 - RNA, 19 nt, Homo sapiens
uagcaucucuacacaacca

SEQ ID NO: 445931 - RNA, 19 nt, Homo sapiens
ccucugagucauuguguuu

SEQ ID NO: 445932 - RNA, 19 nt, Homo sapiens
aaucaucaguggaaucucu

SEQ ID NO: 445933 - RNA, 19 nt, Homo sapiens
gcgcugaggaagacccuuu

SEQ ID NO: 445934 - RNA, 19 nt, Homo sapiens
accagacaauuccuaauga

SEQ ID NO: 445935 - RNA, 19 nt, Homo sapiens
gaaacaccuggauucuuau

SEQ ID NO: 445936 - RNA, 19 nt, Homo sapiens
cgaaaucgccaggcaguuc

SEQ ID NO: 445937 - RNA, 19 nt, Homo sapiens
ugaaacaccuggauucuua

SEQ ID NO: 445938 - RNA, 19 nt, Homo sapiens
gcaaagagguugagagcuu

SEQ ID NO: 445939 - RNA, 19 nt, Homo sapiens
gagcagagguauccauuug

SEQ ID NO: 445940 - RNA, 19 nt, Homo sapiens
ggaaacccaugaccaacua

SEQ ID NO: 445941 - RNA, 19 nt, Homo sapiens
ccuccuggcucaagaauua

SEQ ID NO: 445942 - RNA, 19 nt, Homo sapiens
ccuaagaucucagcaauuu

SEQ ID NO: 445943 - RNA, 19 nt, Homo sapiens
caacaacuaugacaugaug

SEQ ID NO: 445944 - RNA, 19 nt, Homo sapiens
caaaggagaucagggauga

SEQ ID NO: 445945 - RNA, 19 nt, Homo sapiens
gaacugauccuggagauga

SEQ ID NO: 445946 - RNA, 19 nt, Homo sapiens
gaucagggaugaauaugug

SEQ ID NO: 445947 - RNA, 19 nt, Homo sapiens
ggaagucgcugagaaagau

SEQ ID NO: 445948 - RNA, 19 nt, Homo sapiens
gaaggaggcugaggcuuug

SEQ ID NO: 445949 - RNA, 19 nt, Homo sapiens
gggcugagcucaucaacau

SEQ ID NO: 445950 - RNA, 19 nt, Homo sapiens
gcaguugggugaagugguu

SEQ ID NO: 445951 - RNA, 19 nt, Homo sapiens
agauuuaccugucuuacua

SEQ ID NO: 445952 - RNA, 19 nt, Homo sapiens
agacggcccugcugaagua

SEQ ID NO: 445953 - RNA, 19 nt, Homo sapiens
gaccuaagaucucagcaau

SEQ ID NO: 445954 - RNA, 19 nt, Homo sapiens
ggaaggagcagcuuguguu

SEQ ID NO: 445955 - RNA, 19 nt, Homo sapiens
aggcaaaucuggaggauga

SEQ ID NO: 445956 - RNA, 19 nt, Homo sapiens
ggacacaggaauucauuga

SEQ ID NO: 445957 - RNA, 19 nt, Homo sapiens
ucaagagagugagaauaua

SEQ ID NO: 445958 - RNA, 19 nt, Homo sapiens
ucaaauaucugggaacgau

SEQ ID NO: 445959 - RNA, 19 nt, Homo sapiens
gaagauacagcaaagaaag

SEQ ID NO: 445960 - RNA, 19 nt, Homo sapiens
ggaagacccuuugggacuu

SEQ ID NO: 445961 - RNA, 19 nt, Homo sapiens
gaaggagcagcuuguguuu

SEQ ID NO: 445962 - RNA, 19 nt, Homo sapiens
gaaaggauucuucucaaag

SEQ ID NO: 445963 - RNA, 19 nt, Homo sapiens
uaagaucucagcaauuuga

SEQ ID NO: 445964 - RNA, 19 nt, Homo sapiens
gaucaacaacuaugacaug

SEQ ID NO: 445965 - RNA, 19 nt, Homo sapiens
ggagaucagggaugaauau

SEQ ID NO: 445966 - RNA, 19 nt, Homo sapiens
ucagcaauuugaacacuaa

SEQ ID NO: 445967 - RNA, 19 nt, Homo sapiens
ggaagauacagcaaagaaa

SEQ ID NO: 445968 - RNA, 19 nt, Homo sapiens
gagcagauguugggagcuu

SEQ ID NO: 445969 - RNA, 19 nt, Homo sapiens
gcagagguauccauuugag

SEQ ID NO: 445970 - RNA, 19 nt, Homo sapiens
ugacgaagauccgagaguu

SEQ ID NO: 445971 - RNA, 19 nt, Homo sapiens
guagaucuccgucacuauu

SEQ ID NO: 445972 - RNA, 19 nt, Homo sapiens
ugaaggaggcugaggcuuu

SEQ ID NO: 445973 - RNA, 19 nt, Homo sapiens
guuucagacuuccauauuu

SEQ ID NO: 445974 - RNA, 19 nt, Homo sapiens
ccagacaauuccuaaugaa

SEQ ID NO: 445975 - RNA, 19 nt, Homo sapiens
gagaguuuauccuccagaa

SEQ ID NO: 445976 - RNA, 19 nt, Homo sapiens
gaauauagcaucucuacac

SEQ ID NO: 445977 - RNA, 19 nt, Homo sapiens
gaacggaccaugcaauugc

SEQ ID NO: 445978 - RNA, 19 nt, Homo sapiens
gcauaagcccaacuucuga

SEQ ID NO: 445979 - RNA, 19 nt, Homo sapiens
agaaauggcaccaguauca

SEQ ID NO: 445980 - RNA, 19 nt, Homo sapiens
acaccuggauucuuaucua

SEQ ID NO: 445981 - RNA, 19 nt, Homo sapiens
gagcaagauuuaccugucu

SEQ ID NO: 445982 - RNA, 19 nt, Homo sapiens
gaagacccuuugggacuug

SEQ ID NO: 445983 - RNA, 19 nt, Homo sapiens
cgaagucagucugcagaaa

SEQ ID NO: 445984 - RNA, 19 nt, Homo sapiens
uaucauuucuccagucugu

SEQ ID NO: 445985 - RNA, 19 nt, Homo sapiens
gaguuuauccuccagaaga

SEQ ID NO: 445986 - RNA, 19 nt, Homo sapiens
caaggcagccgcagucaga

SEQ ID NO: 445987 - RNA, 19 nt, Homo sapiens
gaaaucaucaguggaaucu

SEQ ID NO: 445988 - RNA, 19 nt, Homo sapiens
cagcuuguguuucugauca

SEQ ID NO: 445989 - RNA, 19 nt, Homo sapiens
gaauuacuccgaagucagu

SEQ ID NO: 445990 - RNA, 19 nt, Homo sapiens
gcacuacgcccuccuagac

SEQ ID NO: 445991 - RNA, 19 nt, Homo sapiens
caagagagugagaauauag

SEQ ID NO: 445992 - RNA, 19 nt, Homo sapiens
ggaguuggauaucacuucu

SEQ ID NO: 445993 - RNA, 19 nt, Homo sapiens
uaguaugacaugacacuua

SEQ ID NO: 445994 - RNA, 19 nt, Homo sapiens
gauguaaugcggaguuuca

SEQ ID NO: 445995 - RNA, 19 nt, Homo sapiens
agguggagguggagaauuu

SEQ ID NO: 445996 - RNA, 19 nt, Homo sapiens
gcuggagucaaacaacuua

SEQ ID NO: 445997 - RNA, 19 nt, Homo sapiens
gaaggugcaguaugaggaa

SEQ ID NO: 445998 - RNA, 19 nt, Homo sapiens
ucaaggcagugacgaagau

SEQ ID NO: 445999 - RNA, 19 nt, Homo sapiens
uacagcagauugaacagaa

SEQ ID NO: 446000 - RNA, 19 nt, Homo sapiens
ggggacagcuggagucaaa

SEQ ID NO: 446001 - RNA, 19 nt, Homo sapiens
cuccucagcucuuggaauu

SEQ ID NO: 446002 - RNA, 19 nt, Homo sapiens
caacauucaccaccuuaug

SEQ ID NO: 446003 - RNA, 19 nt, Homo sapiens
gagagcagagguauccauu

SEQ ID NO: 446004 - RNA, 19 nt, Homo sapiens
ugacagagcccagguucuu

SEQ ID NO: 446005 - RNA, 19 nt, Homo sapiens
guguagaucuccgucacua

SEQ ID NO: 446006 - RNA, 19 nt, Homo sapiens
gcugggaccucagauaugg

SEQ ID NO: 446007 - RNA, 19 nt, Homo sapiens
agacuuccauauuuccauu

SEQ ID NO: 446008 - RNA, 19 nt, Homo sapiens
uccagaagauuuauuccuu

SEQ ID NO: 446009 - RNA, 19 nt, Homo sapiens
gaucucagcaauuugaaca

SEQ ID NO: 446010 - RNA, 19 nt, Homo sapiens
caucaacauucaccaccuu

SEQ ID NO: 446011 - RNA, 19 nt, Homo sapiens
gagcagcuuguguuucuga

SEQ ID NO: 446012 - RNA, 19 nt, Homo sapiens
gcgaauaccuuuucaucug

SEQ ID NO: 446013 - RNA, 19 nt, Homo sapiens
acgaagauccgagaguuua

SEQ ID NO: 446014 - RNA, 19 nt, Homo sapiens
gaggaugaguuaguaaagg

SEQ ID NO: 446015 - RNA, 19 nt, Homo sapiens
gggcugggaccucagauau

SEQ ID NO: 446016 - RNA, 19 nt, Homo sapiens
uaagagaacagcgaagguu

SEQ ID NO: 446017 - RNA, 19 nt, Homo sapiens
ccuccgcucuugucaguau

SEQ ID NO: 446018 - RNA, 19 nt, Homo sapiens
guucagagcguccgaagca

SEQ ID NO: 446019 - RNA, 19 nt, Homo sapiens
ugaggaagucgcugagaaa

SEQ ID NO: 446020 - RNA, 19 nt, Homo sapiens
gaacagucaggagccauga

SEQ ID NO: 446021 - RNA, 19 nt, Homo sapiens
uauagcaucucuacacaac

SEQ ID NO: 446022 - RNA, 19 nt, Homo sapiens
ucagaaauggcaccaguau

SEQ ID NO: 446023 - RNA, 19 nt, Homo sapiens
ucuggaggaugaguuagua

SEQ ID NO: 446024 - RNA, 19 nt, Homo sapiens
gaagccuccucagcucuug

SEQ ID NO: 446025 - RNA, 19 nt, Homo sapiens
gccagaaaccgcccugaga

SEQ ID NO: 446026 - RNA, 19 nt, Homo sapiens
ggaaaucaucaguggaauc

SEQ ID NO: 446027 - RNA, 19 nt, Homo sapiens
ucaggaaacccaugaccaa

SEQ ID NO: 446028 - RNA, 19 nt, Homo sapiens
ggacagcuggagucaaaca

SEQ ID NO: 446029 - RNA, 19 nt, Homo sapiens
uuucagacuuccauauuuc

SEQ ID NO: 446030 - RNA, 19 nt, Homo sapiens
ucacucaacuagucaccau

SEQ ID NO: 446031 - RNA, 19 nt, Homo sapiens
gcugagcucaucaacauuc

SEQ ID NO: 446032 - RNA, 19 nt, Homo sapiens
ugaagugguuagagcugaa

SEQ ID NO: 446033 - RNA, 19 nt, Homo sapiens
guucuccgguuccguaaca

SEQ ID NO: 446034 - RNA, 19 nt, Homo sapiens
ggccguacacucagcauga

SEQ ID NO: 446035 - RNA, 19 nt, Homo sapiens
gagacgcugagcaagauuu

SEQ ID NO: 446036 - RNA, 19 nt, Homo sapiens
gacgaagauccgagaguuu

SEQ ID NO: 446037 - RNA, 19 nt, Homo sapiens
ggaccaagaugaucagaaa

SEQ ID NO: 446038 - RNA, 19 nt, Homo sapiens
gaagaugacucggauacaa

SEQ ID NO: 446039 - RNA, 19 nt, Homo sapiens
ggaagagggugauuuagau

SEQ ID NO: 446040 - RNA, 19 nt, Homo sapiens
uaagagggaugauaaaugu

SEQ ID NO: 446041 - RNA, 19 nt, Homo sapiens
ggaggaagaggaccuauuu

SEQ ID NO: 446042 - RNA, 19 nt, Homo sapiens
acaaggcuauguucuguua

SEQ ID NO: 446043 - RNA, 19 nt, Homo sapiens
gaaaaccucugacaaaaga

SEQ ID NO: 446044 - RNA, 19 nt, Homo sapiens
ggacuguaguaauggauaa

SEQ ID NO: 446045 - RNA, 19 nt, Homo sapiens
ucaaagaggucuagcaaag

SEQ ID NO: 446046 - RNA, 19 nt, Homo sapiens
agacggagcuccacggaaa

SEQ ID NO: 446047 - RNA, 19 nt, Homo sapiens
gaaggcaauugaagaugaa

SEQ ID NO: 446048 - RNA, 19 nt, Homo sapiens
gaugauaaaugugacagaa

SEQ ID NO: 446049 - RNA, 19 nt, Homo sapiens
ugacagaucuacaaaccuu

SEQ ID NO: 446050 - RNA, 19 nt, Homo sapiens
gcgcuaccauucugacuuu

SEQ ID NO: 446051 - RNA, 19 nt, Homo sapiens
gaagaggaccuauuugaca

SEQ ID NO: 446052 - RNA, 19 nt, Homo sapiens
ugagggcgcugaucagaaa

SEQ ID NO: 446053 - RNA, 19 nt, Homo sapiens
cgaacggacuguaguaaug

SEQ ID NO: 446054 - RNA, 19 nt, Homo sapiens
gaagaaggcaauugaagau

SEQ ID NO: 446055 - RNA, 19 nt, Homo sapiens
caucugacuucacuauauu

SEQ ID NO: 446056 - RNA, 19 nt, Homo sapiens
aaccagagcuacagauuug

SEQ ID NO: 446057 - RNA, 19 nt, Homo sapiens
ggacaaagaaacuauaaac

SEQ ID NO: 446058 - RNA, 19 nt, Homo sapiens
gagcaacagugacagaucu

SEQ ID NO: 446059 - RNA, 19 nt, Homo sapiens
aagcagaaauugauaaugg

SEQ ID NO: 446060 - RNA, 19 nt, Homo sapiens
agaaggcaauugaagauga

SEQ ID NO: 446061 - RNA, 19 nt, Homo sapiens
gaaccgaggaggaauguca

SEQ ID NO: 446062 - RNA, 19 nt, Homo sapiens
ggaggaaguuugauuuuga

SEQ ID NO: 446063 - RNA, 19 nt, Homo sapiens
uuaaucugcugccauauug

SEQ ID NO: 446064 - RNA, 19 nt, Homo sapiens
gaaaagaugaugcuaagaa

SEQ ID NO: 446065 - RNA, 19 nt, Homo sapiens
gaagaggguguggaagaua

SEQ ID NO: 446066 - RNA, 19 nt, Homo sapiens
gaugagcgcuaccauucug

SEQ ID NO: 446067 - RNA, 19 nt, Homo sapiens
gaagagggugauuuagauu

SEQ ID NO: 446068 - RNA, 19 nt, Homo sapiens
gaggacaaagaaacuauaa

SEQ ID NO: 446069 - RNA, 19 nt, Homo sapiens
gaacgagaaggacagcauu

SEQ ID NO: 446070 - RNA, 19 nt, Homo sapiens
caaccagagcuacagauuu

SEQ ID NO: 446071 - RNA, 19 nt, Homo sapiens
uauguucuguuaggaguua

SEQ ID NO: 446072 - RNA, 19 nt, Homo sapiens
ggucgcagcaguuguggua

SEQ ID NO: 446073 - RNA, 19 nt, Homo sapiens
ucaucugacuucacuauau

SEQ ID NO: 446074 - RNA, 19 nt, Homo sapiens
gaugaagcagaaauugaua

SEQ ID NO: 446075 - RNA, 19 nt, Homo sapiens
ggaugaagcagaaauugau

SEQ ID NO: 446076 - RNA, 19 nt, Homo sapiens
aagaggguguggaagauaa

SEQ ID NO: 446077 - RNA, 19 nt, Homo sapiens
ggacaucgacaucauggau

SEQ ID NO: 446078 - RNA, 19 nt, Homo sapiens
gaagguucaaggucaauga

SEQ ID NO: 446079 - RNA, 19 nt, Homo sapiens
cgaagacgaugaugcugau

SEQ ID NO: 446080 - RNA, 19 nt, Homo sapiens
gcaguugugguagaaauuu

SEQ ID NO: 446081 - RNA, 19 nt, Homo sapiens
gaagacgggaggaaguuug

SEQ ID NO: 446082 - RNA, 19 nt, Homo sapiens
guagcucaauacaauguga

SEQ ID NO: 446083 - RNA, 19 nt, Homo sapiens
ggaauccuguguccugucu

SEQ ID NO: 446084 - RNA, 19 nt, Homo sapiens
caaggagccucggaaguca

SEQ ID NO: 446085 - RNA, 19 nt, Homo sapiens
gagcuacagauuugaagaa

SEQ ID NO: 446086 - RNA, 19 nt, Homo sapiens
ugaagaaggcaauugaaga

SEQ ID NO: 446087 - RNA, 19 nt, Homo sapiens
guaaaucugagccaguaaa

SEQ ID NO: 446088 - RNA, 19 nt, Homo sapiens
guaaggaccaagaugauca

SEQ ID NO: 446089 - RNA, 19 nt, Homo sapiens
gcaaagaagacgggaggaa

SEQ ID NO: 446090 - RNA, 19 nt, Homo sapiens
gcagaaauugauaauggaa

SEQ ID NO: 446091 - RNA, 19 nt, Homo sapiens
gcaaaucagccagcagaga

SEQ ID NO: 446092 - RNA, 19 nt, Homo sapiens
agagggugauuuagauuug

SEQ ID NO: 446093 - RNA, 19 nt, Homo sapiens
ucaggaacaugcuauagag

SEQ ID NO: 446094 - RNA, 19 nt, Homo sapiens
cggagcagcuucaggaaca

SEQ ID NO: 446095 - RNA, 19 nt, Homo sapiens
ccagagauagcaaagaaga

SEQ ID NO: 446096 - RNA, 19 nt, Homo sapiens
caucaaagaggucuagcaa

SEQ ID NO: 446097 - RNA, 19 nt, Homo sapiens
gaugggagaacgagaagga

SEQ ID NO: 446098 - RNA, 19 nt, Homo sapiens
agccagagauagcaaagaa

SEQ ID NO: 446099 - RNA, 19 nt, Homo sapiens
gcgagaggacggacuguga

SEQ ID NO: 446100 - RNA, 19 nt, Homo sapiens
ugacuucacuauauuacag

SEQ ID NO: 446101 - RNA, 19 nt, Homo sapiens
auaaauguguuuccguuca

SEQ ID NO: 446102 - RNA, 19 nt, Homo sapiens
cagcaguugugguagaaau

SEQ ID NO: 446103 - RNA, 19 nt, Homo sapiens
ugaguucucccgaagauga

SEQ ID NO: 446104 - RNA, 19 nt, Homo sapiens
gccagaaaaugagaaaaua

SEQ ID NO: 446105 - RNA, 19 nt, Homo sapiens
gcgcaaaccagaagaagag

SEQ ID NO: 446106 - RNA, 19 nt, Homo sapiens
ggacagcauuacccagaac

SEQ ID NO: 446107 - RNA, 19 nt, Homo sapiens
ggacaggagagaagguuca

SEQ ID NO: 446108 - RNA, 19 nt, Homo sapiens
ggaccgcuuccacgacuuu

SEQ ID NO: 446109 - RNA, 19 nt, Homo sapiens
caaagagagagcuuccaaa

SEQ ID NO: 446110 - RNA, 19 nt, Homo sapiens
ccaaagagagagcuuccaa

SEQ ID NO: 446111 - RNA, 19 nt, Homo sapiens
gaaagaaaaccucugacaa

SEQ ID NO: 446112 - RNA, 19 nt, Homo sapiens
gagcuccacggaaagauga

SEQ ID NO: 446113 - RNA, 19 nt, Homo sapiens
gcauuaaccaccugcacaa

SEQ ID NO: 446114 - RNA, 19 nt, Homo sapiens
cagcagaagaggccacaaa

SEQ ID NO: 446115 - RNA, 19 nt, Homo sapiens
gaagaugaaggugguaauc

SEQ ID NO: 446116 - RNA, 19 nt, Homo sapiens
ccuguuagcgguagugaaa

SEQ ID NO: 446117 - RNA, 19 nt, Homo sapiens
ggauaucaguguguuggau

SEQ ID NO: 446118 - RNA, 19 nt, Homo sapiens
aaagaaaaccucugacaaa

SEQ ID NO: 446119 - RNA, 19 nt, Homo sapiens
gggaaacuuguaaaucuga

SEQ ID NO: 446120 - RNA, 19 nt, Homo sapiens
gagcugaggaaacggaaug

SEQ ID NO: 446121 - RNA, 19 nt, Homo sapiens
ugguaauccugacgaaauu

SEQ ID NO: 446122 - RNA, 19 nt, Homo sapiens
ucuguuaggaguuaccuua

SEQ ID NO: 446123 - RNA, 19 nt, Homo sapiens
gaccgaacggacuguagua

SEQ ID NO: 446124 - RNA, 19 nt, Homo sapiens
guuaguggacucucuucua

SEQ ID NO: 446125 - RNA, 19 nt, Homo sapiens
cggaagagggugauuuaga

SEQ ID NO: 446126 - RNA, 19 nt, Homo sapiens
gacaucgacaucauggaua

SEQ ID NO: 446127 - RNA, 19 nt, Homo sapiens
ugauggagcggcugaagaa

SEQ ID NO: 446128 - RNA, 19 nt, Homo sapiens
guuaggaguuaccuuaaac

SEQ ID NO: 446129 - RNA, 19 nt, Homo sapiens
ggcuauggcucugacaaga

SEQ ID NO: 446130 - RNA, 19 nt, Homo sapiens
gcgagaugaugccuauugg

SEQ ID NO: 446131 - RNA, 19 nt, Homo sapiens
aagccaggaucgcaaauca

SEQ ID NO: 446132 - RNA, 19 nt, Homo sapiens
agaguaaggaccaagauga

SEQ ID NO: 446133 - RNA, 19 nt, Homo sapiens
ggaagaggaccuauuugac

SEQ ID NO: 446134 - RNA, 19 nt, Homo sapiens
ggaaaacucuggggaugga

SEQ ID NO: 446135 - RNA, 19 nt, Homo sapiens
uguuaggaguuaccuuaaa

SEQ ID NO: 446136 - RNA, 19 nt, Homo sapiens
gaacggacuguaguaaugg

SEQ ID NO: 446137 - RNA, 19 nt, Homo sapiens
gaaugacgcugaugaguga

SEQ ID NO: 446138 - RNA, 19 nt, Homo sapiens
gaagagcuccgugcgauua

SEQ ID NO: 446139 - RNA, 19 nt, Homo sapiens
gaacagagacuacauagac

SEQ ID NO: 446140 - RNA, 19 nt, Homo sapiens
gaagaagauuaaagcauuc

SEQ ID NO: 446141 - RNA, 19 nt, Homo sapiens
ggaguuaugcugcguauga

SEQ ID NO: 446142 - RNA, 19 nt, Homo sapiens
ggaaagaaaguguauguca

SEQ ID NO: 446143 - RNA, 19 nt, Homo sapiens
ggaguuugcucgccauaau

SEQ ID NO: 446144 - RNA, 19 nt, Homo sapiens
acaaaucggugaccaucua

SEQ ID NO: 446145 - RNA, 19 nt, Homo sapiens
gaaaggaugagucuucuuc

SEQ ID NO: 446146 - RNA, 19 nt, Homo sapiens
gagaagaccgugaagaaga

SEQ ID NO: 446147 - RNA, 19 nt, Homo sapiens
gcagccagcuccacaagau

SEQ ID NO: 446148 - RNA, 19 nt, Homo sapiens
caacaaagagaucuauuuc

SEQ ID NO: 446149 - RNA, 19 nt, Homo sapiens
caagagagccugcuuaaaa

SEQ ID NO: 446150 - RNA, 19 nt, Homo sapiens
gaagaucucccgggacaaa

SEQ ID NO: 446151 - RNA, 19 nt, Homo sapiens
gguaccagcuugcucagaa

SEQ ID NO: 446152 - RNA, 19 nt, Homo sapiens
gagcaaagccccacaguuu

SEQ ID NO: 446153 - RNA, 19 nt, Homo sapiens
ggaagagagacaagaauga

SEQ ID NO: 446154 - RNA, 19 nt, Homo sapiens
gauuaaagcauucguggaa

SEQ ID NO: 446155 - RNA, 19 nt, Homo sapiens
uaaggaaaguuaucaggau

SEQ ID NO: 446156 - RNA, 19 nt, Homo sapiens
acaaagagaucuauuucca

SEQ ID NO: 446157 - RNA, 19 nt, Homo sapiens
ucugaaagaugcaggagaa

SEQ ID NO: 446158 - RNA, 19 nt, Homo sapiens
ugggaauccuggugucuua

SEQ ID NO: 446159 - RNA, 19 nt, Homo sapiens
cagagaagaccgugaagaa

SEQ ID NO: 446160 - RNA, 19 nt, Homo sapiens
gaagggaaagaaaguguau

SEQ ID NO: 446161 - RNA, 19 nt, Homo sapiens
guuaucaggaugcaaauuu

SEQ ID NO: 446162 - RNA, 19 nt, Homo sapiens
cgagaaauaaagcuuguuu

SEQ ID NO: 446163 - RNA, 19 nt, Homo sapiens
ggacccagcuaaggaaagu

SEQ ID NO: 446164 - RNA, 19 nt, Homo sapiens
ucaaagcauucgccacaga

SEQ ID NO: 446165 - RNA, 19 nt, Homo sapiens
gacguuuccugacuacuug

SEQ ID NO: 446166 - RNA, 19 nt, Homo sapiens
uggaacagguggccaaugu

SEQ ID NO: 446167 - RNA, 19 nt, Homo sapiens
guuuaguccuuuggaguua

SEQ ID NO: 446168 - RNA, 19 nt, Homo sapiens
aaaguuaucaggaugcaaa

SEQ ID NO: 446169 - RNA, 19 nt, Homo sapiens
cgaaccauguuaucuucaa

SEQ ID NO: 446170 - RNA, 19 nt, Homo sapiens
gcaagagagccugcuuaaa

SEQ ID NO: 446171 - RNA, 19 nt, Homo sapiens
gaaccgaaccauguuaucu

SEQ ID NO: 446172 - RNA, 19 nt, Homo sapiens
ggaaaaugaccuguaguua

SEQ ID NO: 446173 - RNA, 19 nt, Homo sapiens
gggaagagagacaagaaug

SEQ ID NO: 446174 - RNA, 19 nt, Homo sapiens
gaaccauguuaucuucaag

SEQ ID NO: 446175 - RNA, 19 nt, Homo sapiens
ucuacucgagugauuauua

SEQ ID NO: 446176 - RNA, 19 nt, Homo sapiens
agaagaccgugaagaagau

SEQ ID NO: 446177 - RNA, 19 nt, Homo sapiens
ggaaaguuaucaggaugca

SEQ ID NO: 446178 - RNA, 19 nt, Homo sapiens
gcacgaggacacaaaccuu

SEQ ID NO: 446179 - RNA, 19 nt, Homo sapiens
gaguuaugcugcguaugaa

SEQ ID NO: 446180 - RNA, 19 nt, Homo sapiens
gaaagaugcaggagaagcu

SEQ ID NO: 446181 - RNA, 19 nt, Homo sapiens
guucucuacucgagugauu

SEQ ID NO: 446182 - RNA, 19 nt, Homo sapiens
gaccugcgccuuccgcuau

SEQ ID NO: 446183 - RNA, 19 nt, Homo sapiens
ccagcaccaucauuaagga

SEQ ID NO: 446184 - RNA, 19 nt, Homo sapiens
ccaaugugguucucuacuc

SEQ ID NO: 446185 - RNA, 19 nt, Homo sapiens
gagaaauaaagcuuguuug

SEQ ID NO: 446186 - RNA, 19 nt, Homo sapiens
gaaaaugaccuguaguuac

SEQ ID NO: 446187 - RNA, 19 nt, Homo sapiens
gcucacagugucaggcuuu

SEQ ID NO: 446188 - RNA, 19 nt, Homo sapiens
agacaagaaugacgcugau

SEQ ID NO: 446189 - RNA, 19 nt, Homo sapiens
cgagaaaggagaggcauug

SEQ ID NO: 446190 - RNA, 19 nt, Homo sapiens
uaugaaaggaugagucuuc

SEQ ID NO: 446191 - RNA, 19 nt, Homo sapiens
acaagaaugacgcugauga

SEQ ID NO: 446192 - RNA, 19 nt, Homo sapiens
acacagagaagaccgugaa

SEQ ID NO: 446193 - RNA, 19 nt, Homo sapiens
ggaacagagacuacauaga

SEQ ID NO: 446194 - RNA, 19 nt, Homo sapiens
uuaaagcauucguggaaca

SEQ ID NO: 446195 - RNA, 19 nt, Homo sapiens
gacaaaauccccaagaaga

SEQ ID NO: 446196 - RNA, 19 nt, Homo sapiens
gaagagagacaagaaugac

SEQ ID NO: 446197 - RNA, 19 nt, Homo sapiens
cagcaccgaugccgaagag

SEQ ID NO: 446198 - RNA, 19 nt, Homo sapiens
gaacaggggcuggcuauuc

SEQ ID NO: 446199 - RNA, 19 nt, Homo sapiens
gcccguggcuauggaggaa

SEQ ID NO: 446200 - RNA, 19 nt, Homo sapiens
ugcggucucucucaacaaa

SEQ ID NO: 446201 - RNA, 19 nt, Homo sapiens
ccacaagauucagggaagu

SEQ ID NO: 446202 - RNA, 19 nt, Homo sapiens
ugacguuuccugacuacuu

SEQ ID NO: 446203 - RNA, 19 nt, Homo sapiens
ugaagggaaagaaagugua

SEQ ID NO: 446204 - RNA, 19 nt, Homo sapiens
caggaugcaaauuuaguuu

SEQ ID NO: 446205 - RNA, 19 nt, Homo sapiens
cuacucgagugauuauuac

SEQ ID NO: 446206 - RNA, 19 nt, Homo sapiens
ggcaguucuucaugucuga

SEQ ID NO: 446207 - RNA, 19 nt, Homo sapiens
uacuugcccuguucaguga

SEQ ID NO: 446208 - RNA, 19 nt, Homo sapiens
gggaacagagacuacauag

SEQ ID NO: 446209 - RNA, 19 nt, Homo sapiens
aagaggacauugacgugau

SEQ ID NO: 446210 - RNA, 19 nt, Homo sapiens
acaaucacaagguguagaa

SEQ ID NO: 446211 - RNA, 19 nt, Homo sapiens
gccuccagcaccaucauua

SEQ ID NO: 446212 - RNA, 19 nt, Homo sapiens
ucaagcacgaggacacaaa

SEQ ID NO: 446213 - RNA, 19 nt, Homo sapiens
uggccaaugugguucucua

SEQ ID NO: 446214 - RNA, 19 nt, Homo sapiens
ucaccaauaacacagagaa

SEQ ID NO: 446215 - RNA, 19 nt, Homo sapiens
caaagagaucuauuuccau

SEQ ID NO: 446216 - RNA, 19 nt, Homo sapiens
cggucucucucaacaaaga

SEQ ID NO: 446217 - RNA, 19 nt, Homo sapiens
ugcaagagagccugcuuaa

SEQ ID NO: 446218 - RNA, 19 nt, Homo sapiens
gaaguugccagggacagau

SEQ ID NO: 446219 - RNA, 19 nt, Homo sapiens
gagugauuauuacgucaag

SEQ ID NO: 446220 - RNA, 19 nt, Homo sapiens
gaagaccgugaagaagauu

SEQ ID NO: 446221 - RNA, 19 nt, Homo sapiens
gagcaacacguaccccuuu

SEQ ID NO: 446222 - RNA, 19 nt, Homo sapiens
ucaggaugcaaauuuaguu

SEQ ID NO: 446223 - RNA, 19 nt, Homo sapiens
ucacaagguguagaaguug

SEQ ID NO: 446224 - RNA, 19 nt, Homo sapiens
caucaucucagagcauaga

SEQ ID NO: 446225 - RNA, 19 nt, Homo sapiens
ggcuauucaucaucucaga

SEQ ID NO: 446226 - RNA, 19 nt, Homo sapiens
guaguuaccagugcaacga

SEQ ID NO: 446227 - RNA, 19 nt, Homo sapiens
caagaaugacgcugaugag

SEQ ID NO: 446228 - RNA, 19 nt, Homo sapiens
aucacaagguguagaaguu

SEQ ID NO: 446229 - RNA, 19 nt, Homo sapiens
gcaaagccccacaguuuag

SEQ ID NO: 446230 - RNA, 19 nt, Homo sapiens
uucaucaucucagagcaua

SEQ ID NO: 446231 - RNA, 19 nt, Homo sapiens
cagcuaaggaaaguuauca

SEQ ID NO: 446232 - RNA, 19 nt, Homo sapiens
gugaagaagauuaaagcau

SEQ ID NO: 446233 - RNA, 19 nt, Homo sapiens
uguggauggugucguguug

SEQ ID NO: 446234 - RNA, 19 nt, Homo sapiens
ugacgcugaugagugaaga

SEQ ID NO: 446235 - RNA, 19 nt, Homo sapiens
cuuaccagaucaaggugaa

SEQ ID NO: 446236 - RNA, 19 nt, Homo sapiens
gccagggacagauaacaug

SEQ ID NO: 446237 - RNA, 19 nt, Homo sapiens
gaucauggccauauucuuu

SEQ ID NO: 446238 - RNA, 19 nt, Homo sapiens
ggaaaaggcuggaaagaaa

SEQ ID NO: 446239 - RNA, 19 nt, Homo sapiens
guuggaaucuguuaacuaa

SEQ ID NO: 446240 - RNA, 19 nt, Homo sapiens
gaaagacauucucuacaga

SEQ ID NO: 446241 - RNA, 19 nt, Homo sapiens
gaacuggucucugugcaaa

SEQ ID NO: 446242 - RNA, 19 nt, Homo sapiens
ggaagguucuggcuagauu

SEQ ID NO: 446243 - RNA, 19 nt, Homo sapiens
caacagaaauggagaagag

SEQ ID NO: 446244 - RNA, 19 nt, Homo sapiens
ggaaagaaaccuucaaauc

SEQ ID NO: 446245 - RNA, 19 nt, Homo sapiens
aaacaagucugccauaauc

SEQ ID NO: 446246 - RNA, 19 nt, Homo sapiens
ccacucagcugacccagaa

SEQ ID NO: 446247 - RNA, 19 nt, Homo sapiens
ccaauggacugauaaggaa

SEQ ID NO: 446248 - RNA, 19 nt, Homo sapiens
gaagagaugcgauggaguu

SEQ ID NO: 446249 - RNA, 19 nt, Homo sapiens
guucagggcugcucuucua

SEQ ID NO: 446250 - RNA, 19 nt, Homo sapiens
aaagcaaacugcauuauca

SEQ ID NO: 446251 - RNA, 19 nt, Homo sapiens
gaaagaaaccuucaaaucc

SEQ ID NO: 446252 - RNA, 19 nt, Homo sapiens
gugcuaaucuguggaaauu

SEQ ID NO: 446253 - RNA, 19 nt, Homo sapiens
gguuuaggauuaucuguaa

SEQ ID NO: 446254 - RNA, 19 nt, Homo sapiens
cuaaugaacuggucucugu

SEQ ID NO: 446255 - RNA, 19 nt, Homo sapiens
ggaaucuguuaacuaauga

SEQ ID NO: 446256 - RNA, 19 nt, Homo sapiens
gaaacaagucugccauaau

SEQ ID NO: 446257 - RNA, 19 nt, Homo sapiens
ggagaucggguaauucuga

SEQ ID NO: 446258 - RNA, 19 nt, Homo sapiens
ugcaaacacucuccaagua

SEQ ID NO: 446259 - RNA, 19 nt, Homo sapiens
aaagaaaccuucaaaucca

SEQ ID NO: 446260 - RNA, 19 nt, Homo sapiens
ugagggcacugcauaaaga

SEQ ID NO: 446261 - RNA, 19 nt, Homo sapiens
ccucagaugugauguggaa

SEQ ID NO: 446262 - RNA, 19 nt, Homo sapiens
agaaacaagucugccauaa

SEQ ID NO: 446263 - RNA, 19 nt, Homo sapiens
agaaugauauaaccagcua

SEQ ID NO: 446264 - RNA, 19 nt, Homo sapiens
gcuaaagcuuccaacaaga

SEQ ID NO: 446265 - RNA, 19 nt, Homo sapiens
gugcaaauccugagugcua

SEQ ID NO: 446266 - RNA, 19 nt, Homo sapiens
gcacacacccacagcaguu

SEQ ID NO: 446267 - RNA, 19 nt, Homo sapiens
gaaacaggacuucaaacug

SEQ ID NO: 446268 - RNA, 19 nt, Homo sapiens
ccacagcaguuuugguuua

SEQ ID NO: 446269 - RNA, 19 nt, Homo sapiens
uggaaucuguuaacuaaug

SEQ ID NO: 446270 - RNA, 19 nt, Homo sapiens
caaacugcauuaucaccaa

SEQ ID NO: 446271 - RNA, 19 nt, Homo sapiens
ccagggagcauguguauuc

SEQ ID NO: 446272 - RNA, 19 nt, Homo sapiens
aagaggagaucggguaauu

SEQ ID NO: 446273 - RNA, 19 nt, Homo sapiens
gcuaaucuguggaaauuuu

SEQ ID NO: 446274 - RNA, 19 nt, Homo sapiens
gaauuucuccaacuaugaa

SEQ ID NO: 446275 - RNA, 19 nt, Homo sapiens
ggauauggacagacugaaa

SEQ ID NO: 446276 - RNA, 19 nt, Homo sapiens
aauuaaaccuggcucaaug

SEQ ID NO: 446277 - RNA, 19 nt, Homo sapiens
gaaugcuuguacagaauga

SEQ ID NO: 446278 - RNA, 19 nt, Homo sapiens
aggauuaucuguaaaugga

SEQ ID NO: 446279 - RNA, 19 nt, Homo sapiens
caacuaugaauccaugaaa

SEQ ID NO: 446280 - RNA, 19 nt, Homo sapiens
gggcacugcauaaagauaa

SEQ ID NO: 446281 - RNA, 19 nt, Homo sapiens
cgaaggauauggacagacu

SEQ ID NO: 446282 - RNA, 19 nt, Homo sapiens
gauacgggcugggcaaagu

SEQ ID NO: 446283 - RNA, 19 nt, Homo sapiens
uguauucacacaccauuua

SEQ ID NO: 446284 - RNA, 19 nt, Homo sapiens
gaagccuguucccuacaaa

SEQ ID NO: 446285 - RNA, 19 nt, Homo sapiens
gagaugcgauggaguuuug

SEQ ID NO: 446286 - RNA, 19 nt, Homo sapiens
guucagcaccaacuguaua

SEQ ID NO: 446287 - RNA, 19 nt, Homo sapiens
gacauucucuacagacuac

SEQ ID NO: 446288 - RNA, 19 nt, Homo sapiens
ccagaaaauuugccaauau

SEQ ID NO: 446289 - RNA, 19 nt, Homo sapiens
ucagaugugauguggaaua

SEQ ID NO: 446290 - RNA, 19 nt, Homo sapiens
caaagaggagaucggguaa

SEQ ID NO: 446291 - RNA, 19 nt, Homo sapiens
uccagaguauuucaacuuu

SEQ ID NO: 446292 - RNA, 19 nt, Homo sapiens
cgacuucuaucuugcaaac

SEQ ID NO: 446293 - RNA, 19 nt, Homo sapiens
gcaaagucugcauggagua

SEQ ID NO: 446294 - RNA, 19 nt, Homo sapiens
uaucagagaacuccagaga

SEQ ID NO: 446295 - RNA, 19 nt, Homo sapiens
gaggagaucggguaauucu

SEQ ID NO: 446296 - RNA, 19 nt, Homo sapiens
gcacugcauaaagauaaua

SEQ ID NO: 446297 - RNA, 19 nt, Homo sapiens
gcaaacacucuccaaguac

SEQ ID NO: 446298 - RNA, 19 nt, Homo sapiens
ccagagugguggcuugcaa

SEQ ID NO: 446299 - RNA, 19 nt, Homo sapiens
ccagaguauuucaacuuug

SEQ ID NO: 446300 - RNA, 19 nt, Homo sapiens
gggccuggauaucuacgaa

SEQ ID NO: 446301 - RNA, 19 nt, Homo sapiens
gaugugauguggaauaccu

SEQ ID NO: 446302 - RNA, 19 nt, Homo sapiens
agugguggcuugcaaaugu

SEQ ID NO: 446303 - RNA, 19 nt, Homo sapiens
ugagccgacuucuaucuug

SEQ ID NO: 446304 - RNA, 19 nt, Homo sapiens
gaagguucuggcuagauuu

SEQ ID NO: 446305 - RNA, 19 nt, Homo sapiens
gugaaaaucugcacuccaa

SEQ ID NO: 446306 - RNA, 19 nt, Homo sapiens
gcuguugcauccaaaugug

SEQ ID NO: 446307 - RNA, 19 nt, Homo sapiens
gaacagggacaguuuuaau

SEQ ID NO: 446308 - RNA, 19 nt, Homo sapiens
gccaauauacuuucagaag

SEQ ID NO: 446309 - RNA, 19 nt, Homo sapiens
gaucaacagaaauggagaa

SEQ ID NO: 446310 - RNA, 19 nt, Homo sapiens
uuucagcgccuagcaauuu

SEQ ID NO: 446311 - RNA, 19 nt, Homo sapiens
ccgaaugcuuguacagaau

SEQ ID NO: 446312 - RNA, 19 nt, Homo sapiens
gauguggaauaccucagau

SEQ ID NO: 446313 - RNA, 19 nt, Homo sapiens
ucuguuaacuaaugaacug

SEQ ID NO: 446314 - RNA, 19 nt, Homo sapiens
gaucggguaauucugauuc

SEQ ID NO: 446315 - RNA, 19 nt, Homo sapiens
gagaucggguaauucugau

SEQ ID NO: 446316 - RNA, 19 nt, Homo sapiens
gugcuaaagcuuccaacaa

SEQ ID NO: 446317 - RNA, 19 nt, Homo sapiens
cagaguauuucaacuuugc

SEQ ID NO: 446318 - RNA, 19 nt, Homo sapiens
gaacagcaaccccucagaa

SEQ ID NO: 446319 - RNA, 19 nt, Homo sapiens
gcaaauccugagugcuaaa

SEQ ID NO: 446320 - RNA, 19 nt, Homo sapiens
ugaugaaacaugccaguga

SEQ ID NO: 446321 - RNA, 19 nt, Homo sapiens
cauaaucuccaucuguguu

SEQ ID NO: 446322 - RNA, 19 nt, Homo sapiens
cagcaaccccucagaauuu

SEQ ID NO: 446323 - RNA, 19 nt, Homo sapiens
caucuguguuggaaucugu

SEQ ID NO: 446324 - RNA, 19 nt, Homo sapiens
ugcuaaagcuuccaacaag

SEQ ID NO: 446325 - RNA, 19 nt, Homo sapiens
gauuugacacccucagaug

SEQ ID NO: 446326 - RNA, 19 nt, Homo sapiens
ggagaagagaugcgaugga

SEQ ID NO: 446327 - RNA, 19 nt, Homo sapiens
cuggaccaauggacugaua

SEQ ID NO: 446328 - RNA, 19 nt, Homo sapiens
ccauuuuacuuccaugaua

SEQ ID NO: 446329 - RNA, 19 nt, Homo sapiens
caacccaaucuguacacua

SEQ ID NO: 446330 - RNA, 19 nt, Homo sapiens
uuuaacaacccaaucugua

SEQ ID NO: 446331 - RNA, 19 nt, Homo sapiens
ggaaaaccuucuccugcuu

SEQ ID NO: 446332 - RNA, 19 nt, Homo sapiens
gcuuguacagaaugauaua

SEQ ID NO: 446333 - RNA, 19 nt, Homo sapiens
gauccagggagcaugugua

SEQ ID NO: 446334 - RNA, 19 nt, Homo sapiens
agaagccuguucccuacaa

SEQ ID NO: 446335 - RNA, 19 nt, Homo sapiens
ucuguacacuaccuaccua

SEQ ID NO: 446336 - RNA, 19 nt, Homo sapiens
gcucgugucaccaggaaga

SEQ ID NO: 446337 - RNA, 19 nt, Homo sapiens
gggaacagcucaccuauua

SEQ ID NO: 446338 - RNA, 19 nt, Homo sapiens
gaagagcuuucacgacuaa

SEQ ID NO: 446339 - RNA, 19 nt, Homo sapiens
gcaaacacauugucuaauc

SEQ ID NO: 446340 - RNA, 19 nt, Homo sapiens
ggaaaggacugaaaguaca

SEQ ID NO: 446341 - RNA, 19 nt, Homo sapiens
uaaaggcaaucuuaaggua

SEQ ID NO: 446342 - RNA, 19 nt, Homo sapiens
aaagagaaauacccucaua

SEQ ID NO: 446343 - RNA, 19 nt, Homo sapiens
gagaggcccuuuaagugua

SEQ ID NO: 446344 - RNA, 19 nt, Homo sapiens
guaauaagcacgcagaauu

SEQ ID NO: 446345 - RNA, 19 nt, Homo sapiens
gaacaacugcagaggauuu

SEQ ID NO: 446346 - RNA, 19 nt, Homo sapiens
gauauaaccuugcuuugca

SEQ ID NO: 446347 - RNA, 19 nt, Homo sapiens
gaacagauucgucaccaaa

SEQ ID NO: 446348 - RNA, 19 nt, Homo sapiens
ugagucgucuucaauguua

SEQ ID NO: 446349 - RNA, 19 nt, Homo sapiens
gaacugcuauuuguauugu

SEQ ID NO: 446350 - RNA, 19 nt, Homo sapiens
ggacucagcucaggcauca

SEQ ID NO: 446351 - RNA, 19 nt, Homo sapiens
aaacacugcuugugacauu

SEQ ID NO: 446352 - RNA, 19 nt, Homo sapiens
uaacuuuggucuucuguau

SEQ ID NO: 446353 - RNA, 19 nt, Homo sapiens
ggaagagcuuucacgacua

SEQ ID NO: 446354 - RNA, 19 nt, Homo sapiens
cuagagugcuguaaacuug

SEQ ID NO: 446355 - RNA, 19 nt, Homo sapiens
gggauguccugaccaauga

SEQ ID NO: 446356 - RNA, 19 nt, Homo sapiens
gaacacaacggacuugaca

SEQ ID NO: 446357 - RNA, 19 nt, Homo sapiens
gcagcgaccuuucagaaca

SEQ ID NO: 446358 - RNA, 19 nt, Homo sapiens
ccagaucuaugaacuacaa

SEQ ID NO: 446359 - RNA, 19 nt, Homo sapiens
gaacagcucaccuauuagu

SEQ ID NO: 446360 - RNA, 19 nt, Homo sapiens
gaaugcaagcguuaacuuu

SEQ ID NO: 446361 - RNA, 19 nt, Homo sapiens
ccauuuauuugcacaguuu

SEQ ID NO: 446362 - RNA, 19 nt, Homo sapiens
caaaugaaugacacaguua

SEQ ID NO: 446363 - RNA, 19 nt, Homo sapiens
gcacucacauguggaauag

SEQ ID NO: 446364 - RNA, 19 nt, Homo sapiens
aagcgaagccucaacauuu

SEQ ID NO: 446365 - RNA, 19 nt, Homo sapiens
acagauucgucaccaaaua

SEQ ID NO: 446366 - RNA, 19 nt, Homo sapiens
gaaugacacaguuaacaaa

SEQ ID NO: 446367 - RNA, 19 nt, Homo sapiens
acaaaugaaugacacaguu

SEQ ID NO: 446368 - RNA, 19 nt, Homo sapiens
cuagacaacuucucugaug

SEQ ID NO: 446369 - RNA, 19 nt, Homo sapiens
ugacacagguuccuuugau

SEQ ID NO: 446370 - RNA, 19 nt, Homo sapiens
ggagagaggccauucaagu

SEQ ID NO: 446371 - RNA, 19 nt, Homo sapiens
aaacagaaugcaagcguua

SEQ ID NO: 446372 - RNA, 19 nt, Homo sapiens
ccaacgggcuggcgaugaa

SEQ ID NO: 446373 - RNA, 19 nt, Homo sapiens
cagcacauccgaaugcaua

SEQ ID NO: 446374 - RNA, 19 nt, Homo sapiens
ggagaggcccuuuaagugu

SEQ ID NO: 446375 - RNA, 19 nt, Homo sapiens
cagcaaacacauugucuaa

SEQ ID NO: 446376 - RNA, 19 nt, Homo sapiens
gaaauguuccagaaggauu

SEQ ID NO: 446377 - RNA, 19 nt, Homo sapiens
ggagagaaacccuuugcuu

SEQ ID NO: 446378 - RNA, 19 nt, Homo sapiens
cuauagaagucauaccaaa

SEQ ID NO: 446379 - RNA, 19 nt, Homo sapiens
gcagacgccucccaagaca

SEQ ID NO: 446380 - RNA, 19 nt, Homo sapiens
gcaauugaucgaacagauu

SEQ ID NO: 446381 - RNA, 19 nt, Homo sapiens
ccaaagagagaccauuuau

SEQ ID NO: 446382 - RNA, 19 nt, Homo sapiens
guacuggcaucccauaugg

SEQ ID NO: 446383 - RNA, 19 nt, Homo sapiens
cagccaaucugccagcauu

SEQ ID NO: 446384 - RNA, 19 nt, Homo sapiens
cacgcuaaguucccauuua

SEQ ID NO: 446385 - RNA, 19 nt, Homo sapiens
caagaagaacuguacuaaa

SEQ ID NO: 446386 - RNA, 19 nt, Homo sapiens
cgaguucuuugaauuauca

SEQ ID NO: 446387 - RNA, 19 nt, Homo sapiens
ugacaacacugggcaacuu

SEQ ID NO: 446388 - RNA, 19 nt, Homo sapiens
cgacuaaaggcaaucuuaa

SEQ ID NO: 446389 - RNA, 19 nt, Homo sapiens
gagagaccauuuauuugca

SEQ ID NO: 446390 - RNA, 19 nt, Homo sapiens
cagcauuaguggugugaaa

SEQ ID NO: 446391 - RNA, 19 nt, Homo sapiens
caagguacuuuacgaacau

SEQ ID NO: 446392 - RNA, 19 nt, Homo sapiens
gagaaacccuuugcuugca

SEQ ID NO: 446393 - RNA, 19 nt, Homo sapiens
cgagugcccugcagauuca

SEQ ID NO: 446394 - RNA, 19 nt, Homo sapiens
gugccgaguucuuugaauu

SEQ ID NO: 446395 - RNA, 19 nt, Homo sapiens
gacauucacuauagaaguc

SEQ ID NO: 446396 - RNA, 19 nt, Homo sapiens
caaagagagaccauuuauu

SEQ ID NO: 446397 - RNA, 19 nt, Homo sapiens
caagcgaguuugccaaugg

SEQ ID NO: 446398 - RNA, 19 nt, Homo sapiens
aaaugucacugccuuugaa

SEQ ID NO: 446399 - RNA, 19 nt, Homo sapiens
gcaacgucaucaucgagaa

SEQ ID NO: 446400 - RNA, 19 nt, Homo sapiens
uaauaugaaucugguguug

SEQ ID NO: 446401 - RNA, 19 nt, Homo sapiens
gaacuacaacauuaugaag

SEQ ID NO: 446402 - RNA, 19 nt, Homo sapiens
ccacgaaagggaaucuuaa

SEQ ID NO: 446403 - RNA, 19 nt, Homo sapiens
gcaguucaaggccaaguuu

SEQ ID NO: 446404 - RNA, 19 nt, Homo sapiens
gagagaggccauucaagug

SEQ ID NO: 446405 - RNA, 19 nt, Homo sapiens
caaccgagucgcccuacua

SEQ ID NO: 446406 - RNA, 19 nt, Homo sapiens
caaacacauugucuaaucu

SEQ ID NO: 446407 - RNA, 19 nt, Homo sapiens
uuagugggcugacgggaaa

SEQ ID NO: 446408 - RNA, 19 nt, Homo sapiens
gaggcaaucccgucaaguu

SEQ ID NO: 446409 - RNA, 19 nt, Homo sapiens
gggagaggcccuuuaagug

SEQ ID NO: 446410 - RNA, 19 nt, Homo sapiens
caacugcagaggauuuaaa

SEQ ID NO: 446411 - RNA, 19 nt, Homo sapiens
gcucuucucccaauaugaa

SEQ ID NO: 446412 - RNA, 19 nt, Homo sapiens
ggagacauagcauucauuc

SEQ ID NO: 446413 - RNA, 19 nt, Homo sapiens
gaacucacacuggagagaa

SEQ ID NO: 446414 - RNA, 19 nt, Homo sapiens
gacaacuucucugaugaaa

SEQ ID NO: 446415 - RNA, 19 nt, Homo sapiens
ugauaauccugaugaacaa

SEQ ID NO: 446416 - RNA, 19 nt, Homo sapiens
gaugaggcauucuucaaac

SEQ ID NO: 446417 - RNA, 19 nt, Homo sapiens
acuuuggucuucuguauuu

SEQ ID NO: 446418 - RNA, 19 nt, Homo sapiens
gaccuaugguggccuccua

SEQ ID NO: 446419 - RNA, 19 nt, Homo sapiens
cagaaauguuccagaagga

SEQ ID NO: 446420 - RNA, 19 nt, Homo sapiens
ugaagucaguggagaaugg

SEQ ID NO: 446421 - RNA, 19 nt, Homo sapiens
gaaaaucagaugaagauga

SEQ ID NO: 446422 - RNA, 19 nt, Homo sapiens
ucaagguacuuuacgaaca

SEQ ID NO: 446423 - RNA, 19 nt, Homo sapiens
caacagcaacgucaucauc

SEQ ID NO: 446424 - RNA, 19 nt, Homo sapiens
acagugugguucuuugaaa

SEQ ID NO: 446425 - RNA, 19 nt, Homo sapiens
uaacauuuauggcaauugc

SEQ ID NO: 446426 - RNA, 19 nt, Homo sapiens
gcuguaaacuugcuguaac

SEQ ID NO: 446427 - RNA, 19 nt, Homo sapiens
gacugaaaguacagacuga

SEQ ID NO: 446428 - RNA, 19 nt, Homo sapiens
cacauugucuaaucuuuca

SEQ ID NO: 446429 - RNA, 19 nt, Homo sapiens
ggacauucacuauagaagu

SEQ ID NO: 446430 - RNA, 19 nt, Homo sapiens
ccacaagucacccagcauu

SEQ ID NO: 446431 - RNA, 19 nt, Homo sapiens
uagacaacuucucugauga

SEQ ID NO: 446432 - RNA, 19 nt, Homo sapiens
cggaacaacugcagaggau

SEQ ID NO: 446433 - RNA, 19 nt, Homo sapiens
ggacugcagcgaccuuuca

SEQ ID NO: 446434 - RNA, 19 nt, Homo sapiens
ucccagaaauguuccagaa

SEQ ID NO: 446435 - RNA, 19 nt, Homo sapiens
caagcgaagccucaacauu

SEQ ID NO: 446436 - RNA, 19 nt, Homo sapiens
acaagaagaacuguacuaa

SEQ ID NO: 446437 - RNA, 19 nt, Homo sapiens
gaaguaugaugacuccuuu

SEQ ID NO: 446438 - RNA, 19 nt, Homo sapiens
ggaagcguguuacuuacaa

SEQ ID NO: 446439 - RNA, 19 nt, Homo sapiens
acaaagaggugcucagcuu

SEQ ID NO: 446440 - RNA, 19 nt, Homo sapiens
ugaaggagaucaugaaggu

SEQ ID NO: 446441 - RNA, 19 nt, Homo sapiens
gaggucaucuugaauugga

SEQ ID NO: 446442 - RNA, 19 nt, Homo sapiens
gcgcuaagguggccaucaa

SEQ ID NO: 446443 - RNA, 19 nt, Homo sapiens
aauggaagcguguuacuua

SEQ ID NO: 446444 - RNA, 19 nt, Homo sapiens
caaccuggcugugaacgaa

SEQ ID NO: 446445 - RNA, 19 nt, Homo sapiens
ggagacgccucugugaaga

SEQ ID NO: 446446 - RNA, 19 nt, Homo sapiens
gaagcguguuacuuacaaa

SEQ ID NO: 446447 - RNA, 19 nt, Homo sapiens
gaugaauggaagcguguua

SEQ ID NO: 446448 - RNA, 19 nt, Homo sapiens
ggauccaguuccucgugua

SEQ ID NO: 446449 - RNA, 19 nt, Homo sapiens
caaggagacgccucuguga

SEQ ID NO: 446450 - RNA, 19 nt, Homo sapiens
gagaugaucacaggcaaga

SEQ ID NO: 446451 - RNA, 19 nt, Homo sapiens
ugggcaagcucaugaaaca

SEQ ID NO: 446452 - RNA, 19 nt, Homo sapiens
gcagugaggaccaccuuca

SEQ ID NO: 446453 - RNA, 19 nt, Homo sapiens
gaauggaagcguguuacuu

SEQ ID NO: 446454 - RNA, 19 nt, Homo sapiens
gcacacuggaugaauggaa

SEQ ID NO: 446455 - RNA, 19 nt, Homo sapiens
ccgaggucaucuugaauug

SEQ ID NO: 446456 - RNA, 19 nt, Homo sapiens
gcgaggaccggauccaguu

SEQ ID NO: 446457 - RNA, 19 nt, Homo sapiens
gcaggcagacagugagaug

SEQ ID NO: 446458 - RNA, 19 nt, Homo sapiens
gccaggaggugaccaagac

SEQ ID NO: 446459 - RNA, 19 nt, Homo sapiens
gaccugggcaagcucauga

SEQ ID NO: 446460 - RNA, 19 nt, Homo sapiens
ugaaggggcugagguauau

SEQ ID NO: 446461 - RNA, 19 nt, Homo sapiens
gcacaugcgccacgagaac

SEQ ID NO: 446462 - RNA, 19 nt, Homo sapiens
gcacgacacggaagaugag

SEQ ID NO: 446463 - RNA, 19 nt, Homo sapiens
gcuaagguggccaucaaga

SEQ ID NO: 446464 - RNA, 19 nt, Homo sapiens
cugaugagacccuggauga

SEQ ID NO: 446465 - RNA, 19 nt, Homo sapiens
cguauucacuccugaugag

SEQ ID NO: 446466 - RNA, 19 nt, Homo sapiens
cuaagguggccaucaagaa

SEQ ID NO: 446467 - RNA, 19 nt, Homo sapiens
uaagguggccaucaagaag

SEQ ID NO: 446468 - RNA, 19 nt, Homo sapiens
ugacuccuuugacgacguu

SEQ ID NO: 446469 - RNA, 19 nt, Homo sapiens
ugaagggccuccccgaauu

SEQ ID NO: 446470 - RNA, 19 nt, Homo sapiens
gaauuggagaagaaggauu

SEQ ID NO: 446471 - RNA, 19 nt, Homo sapiens
cgaagacugugagcugaag

SEQ ID NO: 446472 - RNA, 19 nt, Homo sapiens
aauuggagaagaaggauuu

SEQ ID NO: 446473 - RNA, 19 nt, Homo sapiens
uggaccagcugaaggagau

SEQ ID NO: 446474 - RNA, 19 nt, Homo sapiens
gcguguuacuuacaaagag

SEQ ID NO: 446475 - RNA, 19 nt, Homo sapiens
cagcugaaggagaucauga

SEQ ID NO: 446476 - RNA, 19 nt, Homo sapiens
gaugagacccuggaugacu

SEQ ID NO: 446477 - RNA, 19 nt, Homo sapiens
ccaggcaggcagacaguga

SEQ ID NO: 446478 - RNA, 19 nt, Homo sapiens
ggacguauucacuccugau

SEQ ID NO: 446479 - RNA, 19 nt, Homo sapiens
gcuggcccaucccuacuuc

SEQ ID NO: 446480 - RNA, 19 nt, Homo sapiens
ccggcaaccuggcugugaa

SEQ ID NO: 446481 - RNA, 19 nt, Homo sapiens
uggaugacuucacggacuu

SEQ ID NO: 446482 - RNA, 19 nt, Homo sapiens
aaagaggugcucagcuuca

SEQ ID NO: 446483 - RNA, 19 nt, Homo sapiens
agaaguaugaugacuccuu

SEQ ID NO: 446484 - RNA, 19 nt, Homo sapiens
ccucuauccugaccaaugc

SEQ ID NO: 446485 - RNA, 19 nt, Homo sapiens
agaaggauuuugccucuau

SEQ ID NO: 446486 - RNA, 19 nt, Homo sapiens
cucccgaggucaucuugaa

SEQ ID NO: 446487 - RNA, 19 nt, Homo sapiens
gaagacugugagcugaaga

SEQ ID NO: 446488 - RNA, 19 nt, Homo sapiens
agacgccucugugaagauc

SEQ ID NO: 446489 - RNA, 19 nt, Homo sapiens
aagaggugcucagcuucaa

SEQ ID NO: 446490 - RNA, 19 nt, Homo sapiens
aguaugaugacuccuuuga

SEQ ID NO: 446491 - RNA, 19 nt, Homo sapiens
gaaagucucacaaaucaaa

SEQ ID NO: 446492 - RNA, 19 nt, Homo sapiens
gaugacaacuccuaugaug

SEQ ID NO: 446493 - RNA, 19 nt, Homo sapiens
gaugguagauggcuuugaa

SEQ ID NO: 446494 - RNA, 19 nt, Homo sapiens
ccaagaagaugauggacaa

SEQ ID NO: 446495 - RNA, 19 nt, Homo sapiens
cagagaaugugcugaguuu

SEQ ID NO: 446496 - RNA, 19 nt, Homo sapiens
gaugagaaguaccugauug

SEQ ID NO: 446497 - RNA, 19 nt, Homo sapiens
caagagacgucacccuaga

SEQ ID NO: 446498 - RNA, 19 nt, Homo sapiens
ggagauguuugaagagaug

SEQ ID NO: 446499 - RNA, 19 nt, Homo sapiens
ugagaagauugaacaguuu

SEQ ID NO: 446500 - RNA, 19 nt, Homo sapiens
caaagaagcagaagaagca

SEQ ID NO: 446501 - RNA, 19 nt, Homo sapiens
caugggagauguuugaaga

SEQ ID NO: 446502 - RNA, 19 nt, Homo sapiens
gaaaccauguaauaaagca

SEQ ID NO: 446503 - RNA, 19 nt, Homo sapiens
gaacugauccccuuuguga

SEQ ID NO: 446504 - RNA, 19 nt, Homo sapiens
caucaaagaagcagaagaa

SEQ ID NO: 446505 - RNA, 19 nt, Homo sapiens
gcaagacaaucggagagaa

SEQ ID NO: 446506 - RNA, 19 nt, Homo sapiens
aaagaaagcagcagcaaga

SEQ ID NO: 446507 - RNA, 19 nt, Homo sapiens
gaguuggucuccuguucua

SEQ ID NO: 446508 - RNA, 19 nt, Homo sapiens
cugaaagucucacaaauca

SEQ ID NO: 446509 - RNA, 19 nt, Homo sapiens
gcacagcucagccaguuug

SEQ ID NO: 446510 - RNA, 19 nt, Homo sapiens
gaagaaguacucucaugug

SEQ ID NO: 446511 - RNA, 19 nt, Homo sapiens
gcauagggacccaucauug

SEQ ID NO: 446512 - RNA, 19 nt, Homo sapiens
gagcaggagccaucaaaga

SEQ ID NO: 446513 - RNA, 19 nt, Homo sapiens
ucacugugccugagaaauu

SEQ ID NO: 446514 - RNA, 19 nt, Homo sapiens
gauaugggcaaaccaagaa

SEQ ID NO: 446515 - RNA, 19 nt, Homo sapiens
ggaagaaguacucucaugu

SEQ ID NO: 446516 - RNA, 19 nt, Homo sapiens
ggauguggacaacaaagua

SEQ ID NO: 446517 - RNA, 19 nt, Homo sapiens
gggcaaaccaagaagauga

SEQ ID NO: 446518 - RNA, 19 nt, Homo sapiens
cugaugaaaccauguaaua

SEQ ID NO: 446519 - RNA, 19 nt, Homo sapiens
ggaggucaccgaugcuuga

SEQ ID NO: 446520 - RNA, 19 nt, Homo sapiens
ggucaccgaugcuugaaca

SEQ ID NO: 446521 - RNA, 19 nt, Homo sapiens
caaguaugcuggccugucu

SEQ ID NO: 446522 - RNA, 19 nt, Homo sapiens
gggcuacauucccauuuau

SEQ ID NO: 446523 - RNA, 19 nt, Homo sapiens
guacagucaggaagaagua

SEQ ID NO: 446524 - RNA, 19 nt, Homo sapiens
uugagaagauugaacaguu

SEQ ID NO: 446525 - RNA, 19 nt, Homo sapiens
ugaaucaugcugccaguaa

SEQ ID NO: 446526 - RNA, 19 nt, Homo sapiens
caacuccuaugaugagaag

SEQ ID NO: 446527 - RNA, 19 nt, Homo sapiens
gcgccauccuggagaacua

SEQ ID NO: 446528 - RNA, 19 nt, Homo sapiens
caacaaaguagagaggauu

SEQ ID NO: 446529 - RNA, 19 nt, Homo sapiens
caagacaaucggagagaaa

SEQ ID NO: 446530 - RNA, 19 nt, Homo sapiens
ugaacaagcugaagaaccu

SEQ ID NO: 446531 - RNA, 19 nt, Homo sapiens
cauagggacccaucauuga

SEQ ID NO: 446532 - RNA, 19 nt, Homo sapiens
aacaggcucucauccagua

SEQ ID NO: 446533 - RNA, 19 nt, Homo sapiens
aagcagagcgguuugagaa

SEQ ID NO: 446534 - RNA, 19 nt, Homo sapiens
caccgaugcuugaacauuc

SEQ ID NO: 446535 - RNA, 19 nt, Homo sapiens
ggaccugcccaucaaguau

SEQ ID NO: 446536 - RNA, 19 nt, Homo sapiens
cggaggaccugcccaucaa

SEQ ID NO: 446537 - RNA, 19 nt, Homo sapiens
ugaagaaccuaugcagcaa

SEQ ID NO: 446538 - RNA, 19 nt, Homo sapiens
gggcagacaacuugaacaa

SEQ ID NO: 446539 - RNA, 19 nt, Homo sapiens
gaaucaugcugccaguaag

SEQ ID NO: 446540 - RNA, 19 nt, Homo sapiens
ugucucagguucuuugaau

SEQ ID NO: 446541 - RNA, 19 nt, Homo sapiens
gaaccuaugcagcaagaca

SEQ ID NO: 446542 - RNA, 19 nt, Homo sapiens
gcaucacugugccugagaa

SEQ ID NO: 446543 - RNA, 19 nt, Homo sapiens
gggauuccuuaccacauug

SEQ ID NO: 446544 - RNA, 19 nt, Homo sapiens
caacaagucaugggagaug

SEQ ID NO: 446545 - RNA, 19 nt, Homo sapiens
ugacacccguggcaucuuc

SEQ ID NO: 446546 - RNA, 19 nt, Homo sapiens
gaugaagaacuuuauaagg

SEQ ID NO: 446547 - RNA, 19 nt, Homo sapiens
gagaaccuccgagagauug

SEQ ID NO: 446548 - RNA, 19 nt, Homo sapiens
gaagcagagcgguuugaga

SEQ ID NO: 446549 - RNA, 19 nt, Homo sapiens
cgcuuuagcuaaccugaaa

SEQ ID NO: 446550 - RNA, 19 nt, Homo sapiens
gaaaacaggcugcagaaca

SEQ ID NO: 446551 - RNA, 19 nt, Homo sapiens
gagaagauugaacaguuug

SEQ ID NO: 446552 - RNA, 19 nt, Homo sapiens
uggcgacgauguagauuuc

SEQ ID NO: 446553 - RNA, 19 nt, Homo sapiens
ggagagaaaaugaagaaaa

SEQ ID NO: 446554 - RNA, 19 nt, Homo sapiens
guccauaugcucaaugcua

SEQ ID NO: 446555 - RNA, 19 nt, Homo sapiens
ggggcuacauucccauuua

SEQ ID NO: 446556 - RNA, 19 nt, Homo sapiens
ugacugaugaaaccaugua

SEQ ID NO: 446557 - RNA, 19 nt, Homo sapiens
cagccaguuugaugaagaa

SEQ ID NO: 446558 - RNA, 19 nt, Homo sapiens
ucucagagccugcccaaca

SEQ ID NO: 446559 - RNA, 19 nt, Homo sapiens
gugaguuggucuccuguuc

SEQ ID NO: 446560 - RNA, 19 nt, Homo sapiens
ucaggagccuuccgugagu

SEQ ID NO: 446561 - RNA, 19 nt, Homo sapiens
aggaagaaguacucucaug

SEQ ID NO: 446562 - RNA, 19 nt, Homo sapiens
ugacaacuccuaugaugag

SEQ ID NO: 446563 - RNA, 19 nt, Homo sapiens
aagaaccuaugcagcaaga

SEQ ID NO: 446564 - RNA, 19 nt, Homo sapiens
ucagccaguuugaugaaga

SEQ ID NO: 446565 - RNA, 19 nt, Homo sapiens
gaguuucgaugaccuuacu

SEQ ID NO: 446566 - RNA, 19 nt, Homo sapiens
cugagaaauugaaggaguu

SEQ ID NO: 446567 - RNA, 19 nt, Homo sapiens
gaacaagcugaagaaccua

SEQ ID NO: 446568 - RNA, 19 nt, Homo sapiens
gggagauguuugaagagau

SEQ ID NO: 446569 - RNA, 19 nt, Homo sapiens
gcucagccaguuugaugaa

SEQ ID NO: 446570 - RNA, 19 nt, Homo sapiens
cagcucagccaguuugaug

SEQ ID NO: 446571 - RNA, 19 nt, Homo sapiens
ucaggaagaaguacucuca

SEQ ID NO: 446572 - RNA, 19 nt, Homo sapiens
cugcagacgcuuuagcuaa

SEQ ID NO: 446573 - RNA, 19 nt, Homo sapiens
ggugcuggaucuggauuug

SEQ ID NO: 446574 - RNA, 19 nt, Homo sapiens
gcaggagccaucaaagaag

SEQ ID NO: 446575 - RNA, 19 nt, Homo sapiens
agaagaugauggacaaggu

SEQ ID NO: 446576 - RNA, 19 nt, Homo sapiens
gaagauugaacaguuugug

SEQ ID NO: 446577 - RNA, 19 nt, Homo sapiens
cagagaagggcaucacugu

SEQ ID NO: 446578 - RNA, 19 nt, Homo sapiens
gaacuaccagacagagaag

SEQ ID NO: 446579 - RNA, 19 nt, Homo sapiens
aaaccaagaagaugaugga

SEQ ID NO: 446580 - RNA, 19 nt, Homo sapiens
cgaauccgauaugggcaaa

SEQ ID NO: 446581 - RNA, 19 nt, Homo sapiens
ggugaugguagauggcuuu

SEQ ID NO: 446582 - RNA, 19 nt, Homo sapiens
gccaggcuuucauuucugu

SEQ ID NO: 446583 - RNA, 19 nt, Homo sapiens
gagaaugugcugaguuucg

SEQ ID NO: 446584 - RNA, 19 nt, Homo sapiens
aauauugucucagguucuu

SEQ ID NO: 446585 - RNA, 19 nt, Homo sapiens
ugggagauguuugaagaga

SEQ ID NO: 446586 - RNA, 19 nt, Homo sapiens
caagucaugggagauguuu

SEQ ID NO: 446587 - RNA, 19 nt, Homo sapiens
agauugaacaguuugugua

SEQ ID NO: 446588 - RNA, 19 nt, Homo sapiens
caaggacccgggacuagug

SEQ ID NO: 446589 - RNA, 19 nt, Homo sapiens
acgcggagcggauaaaguu

SEQ ID NO: 446590 - RNA, 19 nt, Homo sapiens
ccugaaagucucacaaauc

SEQ ID NO: 446591 - RNA, 19 nt, Homo sapiens
gcucaugucuggcuauuaa

SEQ ID NO: 446592 - RNA, 19 nt, Homo sapiens
ggacucuucuuuagcuuua

SEQ ID NO: 446593 - RNA, 19 nt, Homo sapiens
ugagaaaguuuagcgaaua

SEQ ID NO: 446594 - RNA, 19 nt, Homo sapiens
gcaggaaagucccuucuuc

SEQ ID NO: 446595 - RNA, 19 nt, Homo sapiens
caacaagacucgggaugaa

SEQ ID NO: 446596 - RNA, 19 nt, Homo sapiens
gagaaaguuuagcgaauau

SEQ ID NO: 446597 - RNA, 19 nt, Homo sapiens
ccuaggcccuguaauuuaa

SEQ ID NO: 446598 - RNA, 19 nt, Homo sapiens
caaagaagcaauuucaguu

SEQ ID NO: 446599 - RNA, 19 nt, Homo sapiens
caccacgccugacuaauuu

SEQ ID NO: 446600 - RNA, 19 nt, Homo sapiens
ggaaagaaguuuugauugu

SEQ ID NO: 446601 - RNA, 19 nt, Homo sapiens
gggaugaacuggaaagaag

SEQ ID NO: 446602 - RNA, 19 nt, Homo sapiens
ccaaguagcugggauuaca

SEQ ID NO: 446603 - RNA, 19 nt, Homo sapiens
ucacaacccuguaucaaca

SEQ ID NO: 446604 - RNA, 19 nt, Homo sapiens
gaauaucuagggucuguaa

SEQ ID NO: 446605 - RNA, 19 nt, Homo sapiens
ccaacgugcugggauuaua

SEQ ID NO: 446606 - RNA, 19 nt, Homo sapiens
ccaccacgccugacuaauu

SEQ ID NO: 446607 - RNA, 19 nt, Homo sapiens
agaacucuuuccuguaaua

SEQ ID NO: 446608 - RNA, 19 nt, Homo sapiens
aaacagaggaagaaacauu

SEQ ID NO: 446609 - RNA, 19 nt, Homo sapiens
gauggaauagcaagacuuu

SEQ ID NO: 446610 - RNA, 19 nt, Homo sapiens
gggaauaucuagggucugu

SEQ ID NO: 446611 - RNA, 19 nt, Homo sapiens
gguguuggacucuucuuua

SEQ ID NO: 446612 - RNA, 19 nt, Homo sapiens
gaagcaaacagacagaugu

SEQ ID NO: 446613 - RNA, 19 nt, Homo sapiens
ggagugcaauggcaugauc

SEQ ID NO: 446614 - RNA, 19 nt, Homo sapiens
uguaaucucuugcucaugu

SEQ ID NO: 446615 - RNA, 19 nt, Homo sapiens
gggcuccacugacuuccua

SEQ ID NO: 446616 - RNA, 19 nt, Homo sapiens
gcaacaagacucgggauga

SEQ ID NO: 446617 - RNA, 19 nt, Homo sapiens
ggucuucaucuuccaauuu

SEQ ID NO: 446618 - RNA, 19 nt, Homo sapiens
agacaggguuucaccaugu

SEQ ID NO: 446619 - RNA, 19 nt, Homo sapiens
ggaauagcaagacuuuaug

SEQ ID NO: 446620 - RNA, 19 nt, Homo sapiens
uggcuggccucgauuuaaa

SEQ ID NO: 446621 - RNA, 19 nt, Homo sapiens
ccaaacagaggaagaaaca

SEQ ID NO: 446622 - RNA, 19 nt, Homo sapiens
gaagcaauuucaguuccuu

SEQ ID NO: 446623 - RNA, 19 nt, Homo sapiens
acagagauccuugguguuu

SEQ ID NO: 446624 - RNA, 19 nt, Homo sapiens
caucaucggcggagucauu

SEQ ID NO: 446625 - RNA, 19 nt, Homo sapiens
gccagacuauaaggaauaa

SEQ ID NO: 446626 - RNA, 19 nt, Homo sapiens
gagccagacuauaaggaau

SEQ ID NO: 446627 - RNA, 19 nt, Homo sapiens
gaugguuuguggcggcuuu

SEQ ID NO: 446628 - RNA, 19 nt, Homo sapiens
ggagccagacuauaaggaa

SEQ ID NO: 446629 - RNA, 19 nt, Homo sapiens
gcaaagccaaacagaggaa

SEQ ID NO: 446630 - RNA, 19 nt, Homo sapiens
ggauccaguuugagaaagu

SEQ ID NO: 446631 - RNA, 19 nt, Homo sapiens
ggauagggccaaggagaaa

SEQ ID NO: 446632 - RNA, 19 nt, Homo sapiens
uggaauagcaagacuuuau

SEQ ID NO: 446633 - RNA, 19 nt, Homo sapiens
gacaggguuucaccauguu

SEQ ID NO: 446634 - RNA, 19 nt, Homo sapiens
gcuauuaaccgaagcaaac

SEQ ID NO: 446635 - RNA, 19 nt, Homo sapiens
gauccaguuugagaaaguu

SEQ ID NO: 446636 - RNA, 19 nt, Homo sapiens
gggcuggagucauucuuag

SEQ ID NO: 446637 - RNA, 19 nt, Homo sapiens
ggaagacgguccccaauac

SEQ ID NO: 446638 - RNA, 19 nt, Homo sapiens
ccagugccuuucuaugaga

SEQ ID NO: 446639 - RNA, 19 nt, Homo sapiens
gggauagggccaaggagaa

SEQ ID NO: 446640 - RNA, 19 nt, Homo sapiens
agugggagccagacuauaa

SEQ ID NO: 446641 - RNA, 19 nt, Homo sapiens
aacagaggaagaaacauua

SEQ ID NO: 446642 - RNA, 19 nt, Homo sapiens
ucaaagaagcaauuucagu

SEQ ID NO: 446643 - RNA, 19 nt, Homo sapiens
gcaccaccacgccugacua

SEQ ID NO: 446644 - RNA, 19 nt, Homo sapiens
gagucauucuuagcuguuu

SEQ ID NO: 446645 - RNA, 19 nt, Homo sapiens
gucuucaucuuccaauuug

SEQ ID NO: 446646 - RNA, 19 nt, Homo sapiens
ggguuuggcuggccucgau

SEQ ID NO: 446647 - RNA, 19 nt, Homo sapiens
gcaggauccaguuugagaa

SEQ ID NO: 446648 - RNA, 19 nt, Homo sapiens
uggccucgauuuaaagaga

SEQ ID NO: 446649 - RNA, 19 nt, Homo sapiens
ucugcucucucuaagcuuu

SEQ ID NO: 446650 - RNA, 19 nt, Homo sapiens
guguuggacucuucuuuag

SEQ ID NO: 446651 - RNA, 19 nt, Homo sapiens
cagaggaagaaacauuaaa

SEQ ID NO: 446652 - RNA, 19 nt, Homo sapiens
aagcuucugugagugcaua

SEQ ID NO: 446653 - RNA, 19 nt, Homo sapiens
aaagaagcaauuucaguuc

SEQ ID NO: 446654 - RNA, 19 nt, Homo sapiens
uucuuuagcuuuacagaga

SEQ ID NO: 446655 - RNA, 19 nt, Homo sapiens
ugccagauguguggagaaa

SEQ ID NO: 446656 - RNA, 19 nt, Homo sapiens
caacgugcugggauuauag

SEQ ID NO: 446657 - RNA, 19 nt, Homo sapiens
ggcuuugccugcuccaaga

SEQ ID NO: 446658 - RNA, 19 nt, Homo sapiens
ggagucauucuuagcuguu

SEQ ID NO: 446659 - RNA, 19 nt, Homo sapiens
gcuccaagaaugcgcuuug

SEQ ID NO: 446660 - RNA, 19 nt, Homo sapiens
cagagauccuugguguuug

SEQ ID NO: 446661 - RNA, 19 nt, Homo sapiens
ugauuguuguggcuuauuc

SEQ ID NO: 446662 - RNA, 19 nt, Homo sapiens
gagucuuccuucuccuuau

SEQ ID NO: 446663 - RNA, 19 nt, Homo sapiens
uuuggauccuucugacuuu

SEQ ID NO: 446664 - RNA, 19 nt, Homo sapiens
caaccucacaacccuguau

SEQ ID NO: 446665 - RNA, 19 nt, Homo sapiens
gacucgggaugaacuggaa

SEQ ID NO: 446666 - RNA, 19 nt, Homo sapiens
caaaucgcacaauggcaaa

SEQ ID NO: 446667 - RNA, 19 nt, Homo sapiens
uccuaggcccuguaauuua

SEQ ID NO: 446668 - RNA, 19 nt, Homo sapiens
cuuccuaggcccuguaauu

SEQ ID NO: 446669 - RNA, 19 nt, Homo sapiens
uagucaggcuggucucgaa

SEQ ID NO: 446670 - RNA, 19 nt, Homo sapiens
uugagaaaguuuagcgaau

SEQ ID NO: 446671 - RNA, 19 nt, Homo sapiens
caggauccaguuugagaaa

SEQ ID NO: 446672 - RNA, 19 nt, Homo sapiens
ggauaugggaagcuucugu

SEQ ID NO: 446673 - RNA, 19 nt, Homo sapiens
guuggacucuucuuuagcu

SEQ ID NO: 446674 - RNA, 19 nt, Homo sapiens
acagaggaagaaacauuaa

SEQ ID NO: 446675 - RNA, 19 nt, Homo sapiens
gugcaggcgcagaguauug

SEQ ID NO: 446676 - RNA, 19 nt, Homo sapiens
gaauagcaagacuuuaugc

SEQ ID NO: 446677 - RNA, 19 nt, Homo sapiens
ucuuaagcauucagacgaa

SEQ ID NO: 446678 - RNA, 19 nt, Homo sapiens
uacaugaucauccuugguu

SEQ ID NO: 446679 - RNA, 19 nt, Homo sapiens
agucuuccuucuccuuauu

SEQ ID NO: 446680 - RNA, 19 nt, Homo sapiens
cccuuccucuguccauaua

SEQ ID NO: 446681 - RNA, 19 nt, Homo sapiens
cgaagcaaacagacagaug

SEQ ID NO: 446682 - RNA, 19 nt, Homo sapiens
gcgcagaguauuggguuug

SEQ ID NO: 446683 - RNA, 19 nt, Homo sapiens
caccaccacgccugacuaa

SEQ ID NO: 446684 - RNA, 19 nt, Homo sapiens
uaaggguaaaucagggaua

SEQ ID NO: 446685 - RNA, 19 nt, Homo sapiens
augggaagcuucugugagu

SEQ ID NO: 446686 - RNA, 19 nt, Homo sapiens
caucuuccaauuuguaauc

SEQ ID NO: 446687 - RNA, 19 nt, Homo sapiens
cuucaucuuccaauuugua

SEQ ID NO: 446688 - RNA, 19 nt, Homo sapiens
acaugaucauccuugguuu

SEQ ID NO: 446689 - RNA, 19 nt, Homo sapiens
gaggauaugggaagcuucu

SEQ ID NO: 446690 - RNA, 19 nt, Homo sapiens
aagaggauaugggaagcuu

SEQ ID NO: 446691 - RNA, 19 nt, Homo sapiens
ucaaggagcuggcuaaaua

SEQ ID NO: 446692 - RNA, 19 nt, Homo sapiens
gaaaugaggucuguuuaaa

SEQ ID NO: 446693 - RNA, 19 nt, Homo sapiens
caacuucucuugcuuucua

SEQ ID NO: 446694 - RNA, 19 nt, Homo sapiens
guacuuagaguuucuguuu

SEQ ID NO: 446695 - RNA, 19 nt, Homo sapiens
gaagaggguuggagacugu

SEQ ID NO: 446696 - RNA, 19 nt, Homo sapiens
ggagcuggcuaaauaugaa

SEQ ID NO: 446697 - RNA, 19 nt, Homo sapiens
gaggagugcugcuguagau

SEQ ID NO: 446698 - RNA, 19 nt, Homo sapiens
gaaggacacagcauuguug

SEQ ID NO: 446699 - RNA, 19 nt, Homo sapiens
gaacaaguaaucuuaacug

SEQ ID NO: 446700 - RNA, 19 nt, Homo sapiens
gcacuggacuccggaagga

SEQ ID NO: 446701 - RNA, 19 nt, Homo sapiens
gaugacaaccuccauucua

SEQ ID NO: 446702 - RNA, 19 nt, Homo sapiens
ggaaugaaccauccaucaa

SEQ ID NO: 446703 - RNA, 19 nt, Homo sapiens
ggacacagcauuguugguu

SEQ ID NO: 446704 - RNA, 19 nt, Homo sapiens
caaccuccauucuauuuua

SEQ ID NO: 446705 - RNA, 19 nt, Homo sapiens
gacaaccuccauucuauuu

SEQ ID NO: 446706 - RNA, 19 nt, Homo sapiens
cuucugaucuguccaguga

SEQ ID NO: 446707 - RNA, 19 nt, Homo sapiens
acaagguggugugaucuua

SEQ ID NO: 446708 - RNA, 19 nt, Homo sapiens
ugaaaugaggucuguuuaa

SEQ ID NO: 446709 - RNA, 19 nt, Homo sapiens
gacacagcauuguugguuu

SEQ ID NO: 446710 - RNA, 19 nt, Homo sapiens
ggaaggacacagcauuguu

SEQ ID NO: 446711 - RNA, 19 nt, Homo sapiens
aaugaggucuguuuaaagu

SEQ ID NO: 446712 - RNA, 19 nt, Homo sapiens
ggagugcugcuguagauga

SEQ ID NO: 446713 - RNA, 19 nt, Homo sapiens
uggcauaggaucagaaauu

SEQ ID NO: 446714 - RNA, 19 nt, Homo sapiens
uagaguuucuguuugauuc

SEQ ID NO: 446715 - RNA, 19 nt, Homo sapiens
ggcauaggaucagaaauuc

SEQ ID NO: 446716 - RNA, 19 nt, Homo sapiens
ucagaucuuucuccuugaa

SEQ ID NO: 446717 - RNA, 19 nt, Homo sapiens
cagcaugcacuucuuggua

SEQ ID NO: 446718 - RNA, 19 nt, Homo sapiens
acaacaagguggugugauc

SEQ ID NO: 446719 - RNA, 19 nt, Homo sapiens
uauagaggcuuuggcauag

SEQ ID NO: 446720 - RNA, 19 nt, Homo sapiens
uuauagaggcuuuggcaua

SEQ ID NO: 446721 - RNA, 19 nt, Homo sapiens
uugcagaagugccgaaaga

SEQ ID NO: 446722 - RNA, 19 nt, Homo sapiens
guuggagacuguucaagau

SEQ ID NO: 446723 - RNA, 19 nt, Homo sapiens
cgugaugagugauuauaga

SEQ ID NO: 446724 - RNA, 19 nt, Homo sapiens
gaggacuucuucgugauga

SEQ ID NO: 446725 - RNA, 19 nt, Homo sapiens
agacgaaaauggcuaaauu

SEQ ID NO: 446726 - RNA, 19 nt, Homo sapiens
acacugguacuuagaguuu

SEQ ID NO: 446727 - RNA, 19 nt, Homo sapiens
ucucgugagucauuuaaau

SEQ ID NO: 446728 - RNA, 19 nt, Homo sapiens
uuccaaagcuuuauuacca

SEQ ID NO: 446729 - RNA, 19 nt, Homo sapiens
gcagcagcaugcacuucuu

SEQ ID NO: 446730 - RNA, 19 nt, Homo sapiens
acuuagaguuucuguuuga

SEQ ID NO: 446731 - RNA, 19 nt, Homo sapiens
agaucuuucuccuugaaua

SEQ ID NO: 446732 - RNA, 19 nt, Homo sapiens
ggaaccaccuccuccuacu

SEQ ID NO: 446733 - RNA, 19 nt, Homo sapiens
aaccauccaucaacuucua

SEQ ID NO: 446734 - RNA, 19 nt, Homo sapiens
gaaugaaccauccaucaac

SEQ ID NO: 446735 - RNA, 19 nt, Homo sapiens
caagguggugugaucuuaa

SEQ ID NO: 446736 - RNA, 19 nt, Homo sapiens
gaucuuucuccuugaauau

SEQ ID NO: 446737 - RNA, 19 nt, Homo sapiens
guuguugcauguuugaaau

SEQ ID NO: 446738 - RNA, 19 nt, Homo sapiens
gcuagaagaugguuuugga

SEQ ID NO: 446739 - RNA, 19 nt, Homo sapiens
aaacuucauucucgugagu

SEQ ID NO: 446740 - RNA, 19 nt, Homo sapiens
gugccagccugacugagaa

SEQ ID NO: 446741 - RNA, 19 nt, Homo sapiens
gaucaaggagcuggcuaaa

SEQ ID NO: 446742 - RNA, 19 nt, Homo sapiens
guagaugacaaccuccauu

SEQ ID NO: 446743 - RNA, 19 nt, Homo sapiens
ggagacuguucaagaucga

SEQ ID NO: 446744 - RNA, 19 nt, Homo sapiens
gguuggagacuguucaaga

SEQ ID NO: 446745 - RNA, 19 nt, Homo sapiens
gaaaagcaaaagacgaaaa

SEQ ID NO: 446746 - RNA, 19 nt, Homo sapiens
ugacaaccuccauucuauu

SEQ ID NO: 446747 - RNA, 19 nt, Homo sapiens
augacaaccuccauucuau

SEQ ID NO: 446748 - RNA, 19 nt, Homo sapiens
gagugauuauagaggcuuu

SEQ ID NO: 446749 - RNA, 19 nt, Homo sapiens
gaugcaguuuggagaguca

SEQ ID NO: 446750 - RNA, 19 nt, Homo sapiens
cccguggauuggcaaguua

SEQ ID NO: 446751 - RNA, 19 nt, Homo sapiens
caaggagcuggcuaaauau

SEQ ID NO: 446752 - RNA, 19 nt, Homo sapiens
ucuaugcuguuuguaguga

SEQ ID NO: 446753 - RNA, 19 nt, Homo sapiens
uaagccagguugcaaugag

SEQ ID NO: 446754 - RNA, 19 nt, Homo sapiens
uagaggcuuuggcauagga

SEQ ID NO: 446755 - RNA, 19 nt, Homo sapiens
gaguuucuguuugauucuu

SEQ ID NO: 446756 - RNA, 19 nt, Homo sapiens
aaacaacaaggugguguga

SEQ ID NO: 446757 - RNA, 19 nt, Homo sapiens
ggagacgaaugaggaacca

SEQ ID NO: 446758 - RNA, 19 nt, Homo sapiens
gaaccaccuccuccuacug

SEQ ID NO: 446759 - RNA, 19 nt, Homo sapiens
uaugcuguuuguagugaaa

SEQ ID NO: 446760 - RNA, 19 nt, Homo sapiens
gacauacugcggcugauca

SEQ ID NO: 446761 - RNA, 19 nt, Homo sapiens
guagcagaauggaaugaac

SEQ ID NO: 446762 - RNA, 19 nt, Homo sapiens
ggugccagccugacugaga

SEQ ID NO: 446763 - RNA, 19 nt, Homo sapiens
gcaaagggaagaaaagcaa

SEQ ID NO: 446764 - RNA, 19 nt, Homo sapiens
cgagguuccuugggucaug

SEQ ID NO: 446765 - RNA, 19 nt, Homo sapiens
aagaggugcuucugaucug

SEQ ID NO: 446766 - RNA, 19 nt, Homo sapiens
aagguggugugaucuuaau

SEQ ID NO: 446767 - RNA, 19 nt, Homo sapiens
gugcugcuguagaugacaa

SEQ ID NO: 446768 - RNA, 19 nt, Homo sapiens
agugaggagugcugcugua

SEQ ID NO: 446769 - RNA, 19 nt, Homo sapiens
uguucaagaucgacaagga

SEQ ID NO: 446770 - RNA, 19 nt, Homo sapiens
guggcguuguugcauguuu

SEQ ID NO: 446771 - RNA, 19 nt, Homo sapiens
uaaauucccaacuucucuu

SEQ ID NO: 446772 - RNA, 19 nt, Homo sapiens
cauccaucaacuucuauaa

SEQ ID NO: 446773 - RNA, 19 nt, Homo sapiens
uugaaaugaggucuguuua

SEQ ID NO: 446774 - RNA, 19 nt, Homo sapiens
uuugaaaugaggucuguuu

SEQ ID NO: 446775 - RNA, 19 nt, Homo sapiens
uagaugacaaccuccauuc

SEQ ID NO: 446776 - RNA, 19 nt, Homo sapiens
gaaccauccaucaacuucu

SEQ ID NO: 446777 - RNA, 19 nt, Homo sapiens
ugaaccauccaucaacuuc

SEQ ID NO: 446778 - RNA, 19 nt, Homo sapiens
acacagcauuguugguuuu

SEQ ID NO: 446779 - RNA, 19 nt, Homo sapiens
ucaagaucgacaaggagua

SEQ ID NO: 446780 - RNA, 19 nt, Homo sapiens
gguagcagaauggaaugaa

SEQ ID NO: 446781 - RNA, 19 nt, Homo sapiens
gaagaaucuaagccagguu

SEQ ID NO: 446782 - RNA, 19 nt, Homo sapiens
cagaugcaguuuggagagu

SEQ ID NO: 446783 - RNA, 19 nt, Homo sapiens
uguugcauguuugaaauga

SEQ ID NO: 446784 - RNA, 19 nt, Homo sapiens
caguggcguuguugcaugu

SEQ ID NO: 446785 - RNA, 19 nt, Homo sapiens
cagcagcaugcacuucuug

SEQ ID NO: 446786 - RNA, 19 nt, Homo sapiens
guuuugccauguacuauuu

SEQ ID NO: 446787 - RNA, 19 nt, Homo sapiens
acacacugguacuuagagu

SEQ ID NO: 446788 - RNA, 19 nt, Homo sapiens
uuaaaguggcaaucucaga

SEQ ID NO: 446789 - RNA, 19 nt, Homo sapiens
uauuaccaguggcguuguu

SEQ ID NO: 446790 - RNA, 19 nt, Homo sapiens
ucugaucuguccagugaag

SEQ ID NO: 446791 - RNA, 19 nt, Homo sapiens
gaaggacaauuccgguuua

SEQ ID NO: 446792 - RNA, 19 nt, Homo sapiens
gaagagaguguccaagaua

SEQ ID NO: 446793 - RNA, 19 nt, Homo sapiens
ggaggagcaugcagaauuu

SEQ ID NO: 446794 - RNA, 19 nt, Homo sapiens
caucaaggauuguuuggua

SEQ ID NO: 446795 - RNA, 19 nt, Homo sapiens
gaaggaaacacagacauua

SEQ ID NO: 446796 - RNA, 19 nt, Homo sapiens
acacagacauuaauacuga

SEQ ID NO: 446797 - RNA, 19 nt, Homo sapiens
gucaguagaucuaugaaua

SEQ ID NO: 446798 - RNA, 19 nt, Homo sapiens
guacaaacauuucaagaag

SEQ ID NO: 446799 - RNA, 19 nt, Homo sapiens
ggaaagaacauucagaaau

SEQ ID NO: 446800 - RNA, 19 nt, Homo sapiens
ggaaugcucugaaggacuu

SEQ ID NO: 446801 - RNA, 19 nt, Homo sapiens
ggaaacacagacauuaaua

SEQ ID NO: 446802 - RNA, 19 nt, Homo sapiens
cauuauaccuucugugauu

SEQ ID NO: 446803 - RNA, 19 nt, Homo sapiens
gcaaaugucucagcagcaa

SEQ ID NO: 446804 - RNA, 19 nt, Homo sapiens
caaggauuguuugguauua

SEQ ID NO: 446805 - RNA, 19 nt, Homo sapiens
ucagaaaugucuaacaaug

SEQ ID NO: 446806 - RNA, 19 nt, Homo sapiens
ggaagagaguguccaagau

SEQ ID NO: 446807 - RNA, 19 nt, Homo sapiens
ggaaggugguacaaacauu

SEQ ID NO: 446808 - RNA, 19 nt, Homo sapiens
aaacaucagucuugaacuu

SEQ ID NO: 446809 - RNA, 19 nt, Homo sapiens
gauuuccucuccuauaauu

SEQ ID NO: 446810 - RNA, 19 nt, Homo sapiens
gcagauaugcuucaagaug

SEQ ID NO: 446811 - RNA, 19 nt, Homo sapiens
gaauaagccuuuggagcaa

SEQ ID NO: 446812 - RNA, 19 nt, Homo sapiens
caaaagauaugaugguuga

SEQ ID NO: 446813 - RNA, 19 nt, Homo sapiens
gaaggugguacaaacauuu

SEQ ID NO: 446814 - RNA, 19 nt, Homo sapiens
ggaaggaaacacagacauu

SEQ ID NO: 446815 - RNA, 19 nt, Homo sapiens
aagaggagcugcugaagga

SEQ ID NO: 446816 - RNA, 19 nt, Homo sapiens
ggugaagcaucaaggauug

SEQ ID NO: 446817 - RNA, 19 nt, Homo sapiens
ccacugguauuuacuaaca

SEQ ID NO: 446818 - RNA, 19 nt, Homo sapiens
ugaaagagaccgaauauac

SEQ ID NO: 446819 - RNA, 19 nt, Homo sapiens
gguacgcgaugaacugaaa

SEQ ID NO: 446820 - RNA, 19 nt, Homo sapiens
caaacaagcauuauaccuu

SEQ ID NO: 446821 - RNA, 19 nt, Homo sapiens
gaacaauaccaugaacauu

SEQ ID NO: 446822 - RNA, 19 nt, Homo sapiens
gcgccaaucaugucaauuu

SEQ ID NO: 446823 - RNA, 19 nt, Homo sapiens
ucaaccagcugaucgaaau

SEQ ID NO: 446824 - RNA, 19 nt, Homo sapiens
gaaacuugccccuuauuua

SEQ ID NO: 446825 - RNA, 19 nt, Homo sapiens
gaacugaaacgagcaggaa

SEQ ID NO: 446826 - RNA, 19 nt, Homo sapiens
cagauaugcuucaagaugu

SEQ ID NO: 446827 - RNA, 19 nt, Homo sapiens
ccacacugaucuuuggaaa

SEQ ID NO: 446828 - RNA, 19 nt, Homo sapiens
gaaaugaagcgugcuaaag

SEQ ID NO: 446829 - RNA, 19 nt, Homo sapiens
ggaaaugaagcgugcuaaa

SEQ ID NO: 446830 - RNA, 19 nt, Homo sapiens
gaauauaccaggacgaaag

SEQ ID NO: 446831 - RNA, 19 nt, Homo sapiens
caacagguuucgaccaaca

SEQ ID NO: 446832 - RNA, 19 nt, Homo sapiens
cagcuacuauugccacuga

SEQ ID NO: 446833 - RNA, 19 nt, Homo sapiens
agaaaugucuaacaaugug

SEQ ID NO: 446834 - RNA, 19 nt, Homo sapiens
aagagaguguccaagauaa

SEQ ID NO: 446835 - RNA, 19 nt, Homo sapiens
ugaaggacuuacugaaaga

SEQ ID NO: 446836 - RNA, 19 nt, Homo sapiens
gcauugcugucucuagguu

SEQ ID NO: 446837 - RNA, 19 nt, Homo sapiens
gaaccaugcugccaguuuu

SEQ ID NO: 446838 - RNA, 19 nt, Homo sapiens
gauaauacagacugcacua

SEQ ID NO: 446839 - RNA, 19 nt, Homo sapiens
gaaagggaaaggagcuuga

SEQ ID NO: 446840 - RNA, 19 nt, Homo sapiens
gguacaaacauuucaagaa

SEQ ID NO: 446841 - RNA, 19 nt, Homo sapiens
ggaaccaugcugccaguuu

SEQ ID NO: 446842 - RNA, 19 nt, Homo sapiens
gacugaguauggaucauuu

SEQ ID NO: 446843 - RNA, 19 nt, Homo sapiens
gaacucagggcuugcuuuc

SEQ ID NO: 446844 - RNA, 19 nt, Homo sapiens
ggacaccucuuccaaaccu

SEQ ID NO: 446845 - RNA, 19 nt, Homo sapiens
gaguaugauuucuuccauu

SEQ ID NO: 446846 - RNA, 19 nt, Homo sapiens
agacuugccucccgaacaa

SEQ ID NO: 446847 - RNA, 19 nt, Homo sapiens
gaggaaggcuugggaguac

SEQ ID NO: 446848 - RNA, 19 nt, Homo sapiens
gagccucaaacaagcauua

SEQ ID NO: 446849 - RNA, 19 nt, Homo sapiens
gccagaacgugaugccauu

SEQ ID NO: 446850 - RNA, 19 nt, Homo sapiens
ccagagaacaauaccauga

SEQ ID NO: 446851 - RNA, 19 nt, Homo sapiens
uuuaugugcugucaaguuu

SEQ ID NO: 446852 - RNA, 19 nt, Homo sapiens
ggacaauuccgguuuagag

SEQ ID NO: 446853 - RNA, 19 nt, Homo sapiens
gaguauggaucauuugaac

SEQ ID NO: 446854 - RNA, 19 nt, Homo sapiens
caccuugucuucucucaga

SEQ ID NO: 446855 - RNA, 19 nt, Homo sapiens
gcaguuaccggaagcugaa

SEQ ID NO: 446856 - RNA, 19 nt, Homo sapiens
guggugaucuuuagacagu

SEQ ID NO: 446857 - RNA, 19 nt, Homo sapiens
gcaaacugaaggacaauuc

SEQ ID NO: 446858 - RNA, 19 nt, Homo sapiens
cagagcagauucagcaaca

SEQ ID NO: 446859 - RNA, 19 nt, Homo sapiens
gaagcgugcuaaagugucu

SEQ ID NO: 446860 - RNA, 19 nt, Homo sapiens
gcugaaagagaccgaauau

SEQ ID NO: 446861 - RNA, 19 nt, Homo sapiens
ggauagucuuucugagcua

SEQ ID NO: 446862 - RNA, 19 nt, Homo sapiens
ucucuagguuauucacaua

SEQ ID NO: 446863 - RNA, 19 nt, Homo sapiens
ucugugugguggaacauua

SEQ ID NO: 446864 - RNA, 19 nt, Homo sapiens
uaauacagacugcacuaaa

SEQ ID NO: 446865 - RNA, 19 nt, Homo sapiens
gaaacacagacauuaauac

SEQ ID NO: 446866 - RNA, 19 nt, Homo sapiens
cagugaaacuagaagaaga

SEQ ID NO: 446867 - RNA, 19 nt, Homo sapiens
gaucuaugaauaagccuuu

SEQ ID NO: 446868 - RNA, 19 nt, Homo sapiens
aauacagacugcacuaaau

SEQ ID NO: 446869 - RNA, 19 nt, Homo sapiens
aaaccuuuguuguucauug

SEQ ID NO: 446870 - RNA, 19 nt, Homo sapiens
gaacgugaugccauuuaug

SEQ ID NO: 446871 - RNA, 19 nt, Homo sapiens
agaggugucuuccgaaauc

SEQ ID NO: 446872 - RNA, 19 nt, Homo sapiens
guacuuacuaugcaaaugu

SEQ ID NO: 446873 - RNA, 19 nt, Homo sapiens
ggugaucuuuagacaguga

SEQ ID NO: 446874 - RNA, 19 nt, Homo sapiens
gggaaagaacauucagaaa

SEQ ID NO: 446875 - RNA, 19 nt, Homo sapiens
gggaaaccagagaacaaua

SEQ ID NO: 446876 - RNA, 19 nt, Homo sapiens
acagaggugucuuccgaaa

SEQ ID NO: 446877 - RNA, 19 nt, Homo sapiens
gggcucguaucaacaccua

SEQ ID NO: 446878 - RNA, 19 nt, Homo sapiens
acacugaucuuuggaaacu

SEQ ID NO: 446879 - RNA, 19 nt, Homo sapiens
gcacuccacacugaucuuu

SEQ ID NO: 446880 - RNA, 19 nt, Homo sapiens
ccaaguacaccaucaucaa

SEQ ID NO: 446881 - RNA, 19 nt, Homo sapiens
ugggaauccuccagaguuu

SEQ ID NO: 446882 - RNA, 19 nt, Homo sapiens
ggaaugggaaaccagagaa

SEQ ID NO: 446883 - RNA, 19 nt, Homo sapiens
augauuuccucuccuauaa

SEQ ID NO: 446884 - RNA, 19 nt, Homo sapiens
gauuugaaagacugagaua

SEQ ID NO: 446885 - RNA, 19 nt, Homo sapiens
cgauguggcagaauauaaa

SEQ ID NO: 446886 - RNA, 19 nt, Homo sapiens
cagaacgugaugccauuua

SEQ ID NO: 446887 - RNA, 19 nt, Homo sapiens
gcaaggcgccaaucauguc

SEQ ID NO: 446888 - RNA, 19 nt, Homo sapiens
aguaugauuucuuccauug

SEQ ID NO: 446889 - RNA, 19 nt, Homo sapiens
cacagaguaugauuucuuc

SEQ ID NO: 446890 - RNA, 19 nt, Homo sapiens
cagaaaaguuggaaaagga

SEQ ID NO: 446891 - RNA, 19 nt, Homo sapiens
gaacagacucucaguauaa

SEQ ID NO: 446892 - RNA, 19 nt, Homo sapiens
gguauuggccuuauauuua

SEQ ID NO: 446893 - RNA, 19 nt, Homo sapiens
ggaacagacucucaguaua

SEQ ID NO: 446894 - RNA, 19 nt, Homo sapiens
gaagauacuuggcacuauu

SEQ ID NO: 446895 - RNA, 19 nt, Homo sapiens
gaacuucauuggaaacuau

SEQ ID NO: 446896 - RNA, 19 nt, Homo sapiens
gaaacuaugcuucaacauu

SEQ ID NO: 446897 - RNA, 19 nt, Homo sapiens
gaaauaagcaugucuucug

SEQ ID NO: 446898 - RNA, 19 nt, Homo sapiens
ggugaccauucguuuauua

SEQ ID NO: 446899 - RNA, 19 nt, Homo sapiens
caagugaucugcccaccuu

SEQ ID NO: 446900 - RNA, 19 nt, Homo sapiens
gaaacuaguagcuaacauu

SEQ ID NO: 446901 - RNA, 19 nt, Homo sapiens
gaauucaccuaaagaucaa

SEQ ID NO: 446902 - RNA, 19 nt, Homo sapiens
ccaaguagcugggauuaca

SEQ ID NO: 446903 - RNA, 19 nt, Homo sapiens
aaaccuuccugaaagauaa

SEQ ID NO: 446904 - RNA, 19 nt, Homo sapiens
gaccauucguuuauuagaa

SEQ ID NO: 446905 - RNA, 19 nt, Homo sapiens
ugaagcccuuuauuucuua

SEQ ID NO: 446906 - RNA, 19 nt, Homo sapiens
gggaaagaaugccaagaug

SEQ ID NO: 446907 - RNA, 19 nt, Homo sapiens
gcaagaugcuuugguugug

SEQ ID NO: 446908 - RNA, 19 nt, Homo sapiens
uaaaucugaucccuuucua

SEQ ID NO: 446909 - RNA, 19 nt, Homo sapiens
gaaagaaugccaagauggu

SEQ ID NO: 446910 - RNA, 19 nt, Homo sapiens
uauacaaaguuccagauug

SEQ ID NO: 446911 - RNA, 19 nt, Homo sapiens
cuuuaaaucugaucccuuu

SEQ ID NO: 446912 - RNA, 19 nt, Homo sapiens
gcuuggaacuauauguuga

SEQ ID NO: 446913 - RNA, 19 nt, Homo sapiens
caauggaaguguuucaaag

SEQ ID NO: 446914 - RNA, 19 nt, Homo sapiens
ccaaagugcugggauuaca

SEQ ID NO: 446915 - RNA, 19 nt, Homo sapiens
agacaaagccacacucugu

SEQ ID NO: 446916 - RNA, 19 nt, Homo sapiens
ggaaguguuucaaaguucu

SEQ ID NO: 446917 - RNA, 19 nt, Homo sapiens
guuaugauauuccucucaa

SEQ ID NO: 446918 - RNA, 19 nt, Homo sapiens
cguaaaccuuccugaaaga

SEQ ID NO: 446919 - RNA, 19 nt, Homo sapiens
gaggaagaaguuugagaaa

SEQ ID NO: 446920 - RNA, 19 nt, Homo sapiens
ucaugaagcccuuuauuuc

SEQ ID NO: 446921 - RNA, 19 nt, Homo sapiens
ccuacaaguucuauauaug

SEQ ID NO: 446922 - RNA, 19 nt, Homo sapiens
aauggaagcugaauaugca

SEQ ID NO: 446923 - RNA, 19 nt, Homo sapiens
gaaaaccaauggaaguguu

SEQ ID NO: 446924 - RNA, 19 nt, Homo sapiens
gcagaaauaagcaugucuu

SEQ ID NO: 446925 - RNA, 19 nt, Homo sapiens
gaauggaagcugaauaugc

SEQ ID NO: 446926 - RNA, 19 nt, Homo sapiens
caugucuucuggcuacuaa

SEQ ID NO: 446927 - RNA, 19 nt, Homo sapiens
gagcagaaauaagcauguc

SEQ ID NO: 446928 - RNA, 19 nt, Homo sapiens
gauaaacguuuuccugaau

SEQ ID NO: 446929 - RNA, 19 nt, Homo sapiens
gaaaagaggaagaaguuug

SEQ ID NO: 446930 - RNA, 19 nt, Homo sapiens
ugagaauccucugcaagaa

SEQ ID NO: 446931 - RNA, 19 nt, Homo sapiens
agaauucaccuaaagauca

SEQ ID NO: 446932 - RNA, 19 nt, Homo sapiens
uaaaccuuccugaaagaua

SEQ ID NO: 446933 - RNA, 19 nt, Homo sapiens
ugaagauacuuggcacuau

SEQ ID NO: 446934 - RNA, 19 nt, Homo sapiens
guucuucucuuuaaucacu

SEQ ID NO: 446935 - RNA, 19 nt, Homo sapiens
ucucaacccuuuaaaucug

SEQ ID NO: 446936 - RNA, 19 nt, Homo sapiens
ccaauggaaguguuucaaa

SEQ ID NO: 446937 - RNA, 19 nt, Homo sapiens
cuucugaccucaagugauc

SEQ ID NO: 446938 - RNA, 19 nt, Homo sapiens
guauccagcugccuuugau

SEQ ID NO: 446939 - RNA, 19 nt, Homo sapiens
cauugggucuuuaaaucuu

SEQ ID NO: 446940 - RNA, 19 nt, Homo sapiens
aaacuaguagcuaacauug

SEQ ID NO: 446941 - RNA, 19 nt, Homo sapiens
cacguaaaccuuccugaaa

SEQ ID NO: 446942 - RNA, 19 nt, Homo sapiens
guucucggcaucaugauuu

SEQ ID NO: 446943 - RNA, 19 nt, Homo sapiens
gaaucgugcuuuuguguga

SEQ ID NO: 446944 - RNA, 19 nt, Homo sapiens
ucaaacuucugaccucaag

SEQ ID NO: 446945 - RNA, 19 nt, Homo sapiens
ccaccacgcccagcuaauu

SEQ ID NO: 446946 - RNA, 19 nt, Homo sapiens
gaaacuauugauguccaua

SEQ ID NO: 446947 - RNA, 19 nt, Homo sapiens
auacaaaguuccagauugc

SEQ ID NO: 446948 - RNA, 19 nt, Homo sapiens
uucagaaacuaguagcuaa

SEQ ID NO: 446949 - RNA, 19 nt, Homo sapiens
guugugcagucauugaaga

SEQ ID NO: 446950 - RNA, 19 nt, Homo sapiens
ucacguaaaccuuccugaa

SEQ ID NO: 446951 - RNA, 19 nt, Homo sapiens
uggaaacuaugcuucaaca

SEQ ID NO: 446952 - RNA, 19 nt, Homo sapiens
gaagcccuuuauuucuuau

SEQ ID NO: 446953 - RNA, 19 nt, Homo sapiens
caaaugaaagugucagcau

SEQ ID NO: 446954 - RNA, 19 nt, Homo sapiens
uggaacagacucucaguau

SEQ ID NO: 446955 - RNA, 19 nt, Homo sapiens
ugaauaugcacauccuuug

SEQ ID NO: 446956 - RNA, 19 nt, Homo sapiens
uggaauggaagcugaauau

SEQ ID NO: 446957 - RNA, 19 nt, Homo sapiens
ccucccaguucaagcaauu

SEQ ID NO: 446958 - RNA, 19 nt, Homo sapiens
aaucugaucccuuucuaug

SEQ ID NO: 446959 - RNA, 19 nt, Homo sapiens
augaagcccuuuauuucuu

SEQ ID NO: 446960 - RNA, 19 nt, Homo sapiens
guucaugaagcccuuuauu

SEQ ID NO: 446961 - RNA, 19 nt, Homo sapiens
ugccucagccucccaagua

SEQ ID NO: 446962 - RNA, 19 nt, Homo sapiens
guuccuaagcuuccaagaa

SEQ ID NO: 446963 - RNA, 19 nt, Homo sapiens
gcuguggaauauguagauu

SEQ ID NO: 446964 - RNA, 19 nt, Homo sapiens
agaggaagaaguuugagaa

SEQ ID NO: 446965 - RNA, 19 nt, Homo sapiens
gaauaugcacauccuuugg

SEQ ID NO: 446966 - RNA, 19 nt, Homo sapiens
gaagcugaauaugcacauc

SEQ ID NO: 446967 - RNA, 19 nt, Homo sapiens
aaagaaugccaagauggua

SEQ ID NO: 446968 - RNA, 19 nt, Homo sapiens
ugauuuguggaaccuauua

SEQ ID NO: 446969 - RNA, 19 nt, Homo sapiens
uggaaguguuucaaaguuc

SEQ ID NO: 446970 - RNA, 19 nt, Homo sapiens
gaucccuuauaguucauga

SEQ ID NO: 446971 - RNA, 19 nt, Homo sapiens
caccacgcccagcuaauuu

SEQ ID NO: 446972 - RNA, 19 nt, Homo sapiens
aaggcugucugcagagauu

SEQ ID NO: 446973 - RNA, 19 nt, Homo sapiens
ccugaaagauaaacguuuu

SEQ ID NO: 446974 - RNA, 19 nt, Homo sapiens
ccucucaacccuuuaaauc

SEQ ID NO: 446975 - RNA, 19 nt, Homo sapiens
ggaauggaagcugaauaug

SEQ ID NO: 446976 - RNA, 19 nt, Homo sapiens
ggcaagaugcuuugguugu

SEQ ID NO: 446977 - RNA, 19 nt, Homo sapiens
ucauguaauucuucuuugg

SEQ ID NO: 446978 - RNA, 19 nt, Homo sapiens
cauccuuggcuguggaaua

SEQ ID NO: 446979 - RNA, 19 nt, Homo sapiens
gugcagucauugaagauac

SEQ ID NO: 446980 - RNA, 19 nt, Homo sapiens
ccagcugccuuugauuugu

SEQ ID NO: 446981 - RNA, 19 nt, Homo sapiens
caugaagcccuuuauuucu

SEQ ID NO: 446982 - RNA, 19 nt, Homo sapiens
cugagaauccucugcaaga

SEQ ID NO: 446983 - RNA, 19 nt, Homo sapiens
gcaacaaaugaaaguguca

SEQ ID NO: 446984 - RNA, 19 nt, Homo sapiens
gagacucuaauucuuggaa

SEQ ID NO: 446985 - RNA, 19 nt, Homo sapiens
cagcugccuuugauuugug

SEQ ID NO: 446986 - RNA, 19 nt, Homo sapiens
caaccucugccucccaguu

SEQ ID NO: 446987 - RNA, 19 nt, Homo sapiens
acguaaaccuuccugaaag

SEQ ID NO: 446988 - RNA, 19 nt, Homo sapiens
uucaugaagcccuuuauuu

SEQ ID NO: 446989 - RNA, 19 nt, Homo sapiens
gggugaccauucguuuauu

SEQ ID NO: 446990 - RNA, 19 nt, Homo sapiens
cugaauaugcacauccuuu

SEQ ID NO: 446991 - RNA, 19 nt, Homo sapiens
ggaaauggcuguaagaaug

SEQ ID NO: 446992 - RNA, 19 nt, Homo sapiens
gauaagagguuacagcaaa

SEQ ID NO: 446993 - RNA, 19 nt, Homo sapiens
gaacuugucguuaguauaa

SEQ ID NO: 446994 - RNA, 19 nt, Homo sapiens
gaagauuccuacuccauuu

SEQ ID NO: 446995 - RNA, 19 nt, Homo sapiens
caaauuacaugaugaccua

SEQ ID NO: 446996 - RNA, 19 nt, Homo sapiens
ggaaauaauugccaaauac

SEQ ID NO: 446997 - RNA, 19 nt, Homo sapiens
caccaggacuuuaaucuua

SEQ ID NO: 446998 - RNA, 19 nt, Homo sapiens
ggacuaggcuauaugcauu

SEQ ID NO: 446999 - RNA, 19 nt, Homo sapiens
gauagcagguguaauaaga

SEQ ID NO: 447000 - RNA, 19 nt, Homo sapiens
ggaagggaccgcucaguua

SEQ ID NO: 447001 - RNA, 19 nt, Homo sapiens
gugcaacacugagcuauua

SEQ ID NO: 447002 - RNA, 19 nt, Homo sapiens
gugcuuacauccuuuauuu

SEQ ID NO: 447003 - RNA, 19 nt, Homo sapiens
gacacacuaucaccuauua

SEQ ID NO: 447004 - RNA, 19 nt, Homo sapiens
gagucuaccuuaccauaua

SEQ ID NO: 447005 - RNA, 19 nt, Homo sapiens
cagcagaucuguaguuugu

SEQ ID NO: 447006 - RNA, 19 nt, Homo sapiens
gcauugccauggauaagua

SEQ ID NO: 447007 - RNA, 19 nt, Homo sapiens
gaaauuugauugcccagau

SEQ ID NO: 447008 - RNA, 19 nt, Homo sapiens
gcagaucuguaguuuguau

SEQ ID NO: 447009 - RNA, 19 nt, Homo sapiens
caagauacauaguaaaugg

SEQ ID NO: 447010 - RNA, 19 nt, Homo sapiens
ugucuucgaucaugcauua

SEQ ID NO: 447011 - RNA, 19 nt, Homo sapiens
ggacaaagaaggaaauauc

SEQ ID NO: 447012 - RNA, 19 nt, Homo sapiens
acauaaaccucaccauauu

SEQ ID NO: 447013 - RNA, 19 nt, Homo sapiens
ucacugacauguucaucua

SEQ ID NO: 447014 - RNA, 19 nt, Homo sapiens
uacacaaggugguuuauuu

SEQ ID NO: 447015 - RNA, 19 nt, Homo sapiens
uauauaagcgccuacauaa

SEQ ID NO: 447016 - RNA, 19 nt, Homo sapiens
caucauagacugguauaua

SEQ ID NO: 447017 - RNA, 19 nt, Homo sapiens
guauauaagcgccuacaua

SEQ ID NO: 447018 - RNA, 19 nt, Homo sapiens
agaaggaaauaucaucgua

SEQ ID NO: 447019 - RNA, 19 nt, Homo sapiens
gaaauggcuguaagaauga

SEQ ID NO: 447020 - RNA, 19 nt, Homo sapiens
gcccaguuauucuuaagua

SEQ ID NO: 447021 - RNA, 19 nt, Homo sapiens
ccaaauaccuaggcccauu

SEQ ID NO: 447022 - RNA, 19 nt, Homo sapiens
ggacuuuaaucuuaugcuu

SEQ ID NO: 447023 - RNA, 19 nt, Homo sapiens
caaggugguuuauuuaagu

SEQ ID NO: 447024 - RNA, 19 nt, Homo sapiens
cuacauaaaccucaccaua

SEQ ID NO: 447025 - RNA, 19 nt, Homo sapiens
ccacauggccagaagauga

SEQ ID NO: 447026 - RNA, 19 nt, Homo sapiens
caacacugagcuauuauuu

SEQ ID NO: 447027 - RNA, 19 nt, Homo sapiens
gcaccauaaccaagaaaua

SEQ ID NO: 447028 - RNA, 19 nt, Homo sapiens
ccacccauguuuauuaaga

SEQ ID NO: 447029 - RNA, 19 nt, Homo sapiens
cuucaacguugguaugaua

SEQ ID NO: 447030 - RNA, 19 nt, Homo sapiens
cagcagcccuucaggaaau

SEQ ID NO: 447031 - RNA, 19 nt, Homo sapiens
gaagggaccgcucaguuau

SEQ ID NO: 447032 - RNA, 19 nt, Homo sapiens
guaaaggcauucuauaagc

SEQ ID NO: 447033 - RNA, 19 nt, Homo sapiens
gcacuacacuuuugauguu

SEQ ID NO: 447034 - RNA, 19 nt, Homo sapiens
gggauuauguagcuaaaca

SEQ ID NO: 447035 - RNA, 19 nt, Homo sapiens
gcuauuagucuucugauug

SEQ ID NO: 447036 - RNA, 19 nt, Homo sapiens
acacaaggugguuuauuua

SEQ ID NO: 447037 - RNA, 19 nt, Homo sapiens
cauccacccauguuuauua

SEQ ID NO: 447038 - RNA, 19 nt, Homo sapiens
ucaaguccgucgagagauu

SEQ ID NO: 447039 - RNA, 19 nt, Homo sapiens
gaucugggauuauguagcu

SEQ ID NO: 447040 - RNA, 19 nt, Homo sapiens
cacagaggccuucaucaua

SEQ ID NO: 447041 - RNA, 19 nt, Homo sapiens
gcuaaacauugugaugauu

SEQ ID NO: 447042 - RNA, 19 nt, Homo sapiens
gggcacugcugaggaauga

SEQ ID NO: 447043 - RNA, 19 nt, Homo sapiens
ggacaauuuccauucauga

SEQ ID NO: 447044 - RNA, 19 nt, Homo sapiens
aaggaaauguguguuguaa

SEQ ID NO: 447045 - RNA, 19 nt, Homo sapiens
gcccauugcugacgauuag

SEQ ID NO: 447046 - RNA, 19 nt, Homo sapiens
gcuaagugauggaucuugu

SEQ ID NO: 447047 - RNA, 19 nt, Homo sapiens
caccauauuuggaagauuc

SEQ ID NO: 447048 - RNA, 19 nt, Homo sapiens
acagaggccuucaucauag

SEQ ID NO: 447049 - RNA, 19 nt, Homo sapiens
aaauuugauugcccagaua

SEQ ID NO: 447050 - RNA, 19 nt, Homo sapiens
cagucaagauacauaguaa

SEQ ID NO: 447051 - RNA, 19 nt, Homo sapiens
gaaggaaauaucaucguau

SEQ ID NO: 447052 - RNA, 19 nt, Homo sapiens
caacguugguaugauaaug

SEQ ID NO: 447053 - RNA, 19 nt, Homo sapiens
gugaacaccaggacuuuaa

SEQ ID NO: 447054 - RNA, 19 nt, Homo sapiens
gaucuuguacuccguguug

SEQ ID NO: 447055 - RNA, 19 nt, Homo sapiens
ggaccgcucaguuauguga

SEQ ID NO: 447056 - RNA, 19 nt, Homo sapiens
uaggagaguuuccauaugg

SEQ ID NO: 447057 - RNA, 19 nt, Homo sapiens
auugauagcagguguaaua

SEQ ID NO: 447058 - RNA, 19 nt, Homo sapiens
uguauagccucaacaacaa

SEQ ID NO: 447059 - RNA, 19 nt, Homo sapiens
agaagaagaugcugugaac

SEQ ID NO: 447060 - RNA, 19 nt, Homo sapiens
acacugagcuauuauuuug

SEQ ID NO: 447061 - RNA, 19 nt, Homo sapiens
ggcauucuauaagcuauuu

SEQ ID NO: 447062 - RNA, 19 nt, Homo sapiens
caaagaaggaaauaucauc

SEQ ID NO: 447063 - RNA, 19 nt, Homo sapiens
ucaguuaugugaaggagau

SEQ ID NO: 447064 - RNA, 19 nt, Homo sapiens
gacaaagaaggaaauauca

SEQ ID NO: 447065 - RNA, 19 nt, Homo sapiens
cuguacaucuugguuaaua

SEQ ID NO: 447066 - RNA, 19 nt, Homo sapiens
gucgagagauuaaguuuac

SEQ ID NO: 447067 - RNA, 19 nt, Homo sapiens
ccaagacuaagcaccauaa

SEQ ID NO: 447068 - RNA, 19 nt, Homo sapiens
gcucagcucaucauacaga

SEQ ID NO: 447069 - RNA, 19 nt, Homo sapiens
ggacacacuaucaccuauu

SEQ ID NO: 447070 - RNA, 19 nt, Homo sapiens
gcagguguaauaagacuau

SEQ ID NO: 447071 - RNA, 19 nt, Homo sapiens
gcaacacugagcuauuauu

SEQ ID NO: 447072 - RNA, 19 nt, Homo sapiens
auagauuauugcccaguua

SEQ ID NO: 447073 - RNA, 19 nt, Homo sapiens
cauaaaccucaccauauuu

SEQ ID NO: 447074 - RNA, 19 nt, Homo sapiens
ccauauggauuguuugaac

SEQ ID NO: 447075 - RNA, 19 nt, Homo sapiens
cuauuagucuucugauugu

SEQ ID NO: 447076 - RNA, 19 nt, Homo sapiens
uacauaaaccucaccauau

SEQ ID NO: 447077 - RNA, 19 nt, Homo sapiens
uauaagcgccuacauaaac

SEQ ID NO: 447078 - RNA, 19 nt, Homo sapiens
uaaggaaauguguguugua

SEQ ID NO: 447079 - RNA, 19 nt, Homo sapiens
acacauaggaggcucauuc

SEQ ID NO: 447080 - RNA, 19 nt, Homo sapiens
uaagcaccauaaccaagaa

SEQ ID NO: 447081 - RNA, 19 nt, Homo sapiens
gaacaccaggacuuuaauc

SEQ ID NO: 447082 - RNA, 19 nt, Homo sapiens
gggaagggaccgcucaguu

SEQ ID NO: 447083 - RNA, 19 nt, Homo sapiens
uggcucagcucaucauaca

SEQ ID NO: 447084 - RNA, 19 nt, Homo sapiens
aauggagaguuuacaaaga

SEQ ID NO: 447085 - RNA, 19 nt, Homo sapiens
caccauauguucuuugacu

SEQ ID NO: 447086 - RNA, 19 nt, Homo sapiens
caucauacagaccaccaua

SEQ ID NO: 447087 - RNA, 19 nt, Homo sapiens
cagagucuaccuuaccaua

SEQ ID NO: 447088 - RNA, 19 nt, Homo sapiens
auugauggcuuucuucaga

SEQ ID NO: 447089 - RNA, 19 nt, Homo sapiens
gcagcagcccuucaggaaa

SEQ ID NO: 447090 - RNA, 19 nt, Homo sapiens
gauuggcggcucauucaaa

SEQ ID NO: 447091 - RNA, 19 nt, Homo sapiens
gcaaggaacugauagcuua

SEQ ID NO: 447092 - RNA, 19 nt, Homo sapiens
gaucagauuuguaugguua

SEQ ID NO: 447093 - RNA, 19 nt, Homo sapiens
gaaggcaacuguucuggua

SEQ ID NO: 447094 - RNA, 19 nt, Homo sapiens
gggaauagguuuacacaaa

SEQ ID NO: 447095 - RNA, 19 nt, Homo sapiens
gaacuaguaugugacaaua

SEQ ID NO: 447096 - RNA, 19 nt, Homo sapiens
uaaagaaccuugcgauuug

SEQ ID NO: 447097 - RNA, 19 nt, Homo sapiens
uaacaucugugacuacuaa

SEQ ID NO: 447098 - RNA, 19 nt, Homo sapiens
ccgcauagauugcaauaua

SEQ ID NO: 447099 - RNA, 19 nt, Homo sapiens
ggaugaaugugaauuauga

SEQ ID NO: 447100 - RNA, 19 nt, Homo sapiens
ucucugagcucccuucuua

SEQ ID NO: 447101 - RNA, 19 nt, Homo sapiens
gaacgagcauaaauaaaug

SEQ ID NO: 447102 - RNA, 19 nt, Homo sapiens
agagaaggguugaaaguua

SEQ ID NO: 447103 - RNA, 19 nt, Homo sapiens
gagaagagaauacucauuu

SEQ ID NO: 447104 - RNA, 19 nt, Homo sapiens
gaaagcacaugguacaguu

SEQ ID NO: 447105 - RNA, 19 nt, Homo sapiens
ggaguaggguuguacaauu

SEQ ID NO: 447106 - RNA, 19 nt, Homo sapiens
gcagcuuucucuucaaaua

SEQ ID NO: 447107 - RNA, 19 nt, Homo sapiens
cuacagaaaucaaauguga

SEQ ID NO: 447108 - RNA, 19 nt, Homo sapiens
ccacuuaccucagaucuuu

SEQ ID NO: 447109 - RNA, 19 nt, Homo sapiens
gaaggaggcagauucauuu

SEQ ID NO: 447110 - RNA, 19 nt, Homo sapiens
gcacaugcaucugcuauug

SEQ ID NO: 447111 - RNA, 19 nt, Homo sapiens
ggaggcagauucauuucua

SEQ ID NO: 447112 - RNA, 19 nt, Homo sapiens
ugacugcacugauauauau

SEQ ID NO: 447113 - RNA, 19 nt, Homo sapiens
gaagaacggcucuguuaaa

SEQ ID NO: 447114 - RNA, 19 nt, Homo sapiens
guaaaaggcucuuaaacua

SEQ ID NO: 447115 - RNA, 19 nt, Homo sapiens
gaguaggguuguacaauuu

SEQ ID NO: 447116 - RNA, 19 nt, Homo sapiens
ccagugugcuauauaguua

SEQ ID NO: 447117 - RNA, 19 nt, Homo sapiens
ucagagaacuugcuuaauc

SEQ ID NO: 447118 - RNA, 19 nt, Homo sapiens
ccagauccauuuacacuuu

SEQ ID NO: 447119 - RNA, 19 nt, Homo sapiens
uaaagaagguggaagacuu

SEQ ID NO: 447120 - RNA, 19 nt, Homo sapiens
caacuguucugguagcuaa

SEQ ID NO: 447121 - RNA, 19 nt, Homo sapiens
uagcaaacauuaacgauga

SEQ ID NO: 447122 - RNA, 19 nt, Homo sapiens
gcaggagacuggugcauau

SEQ ID NO: 447123 - RNA, 19 nt, Homo sapiens
gaacaguagcuccuaguaa

SEQ ID NO: 447124 - RNA, 19 nt, Homo sapiens
gagagagccucccaccuuu

SEQ ID NO: 447125 - RNA, 19 nt, Homo sapiens
gcagagaaacugagagaaa

SEQ ID NO: 447126 - RNA, 19 nt, Homo sapiens
gauaggaucuuuucuugua

SEQ ID NO: 447127 - RNA, 19 nt, Homo sapiens
ggaacacaaucaccaagaa

SEQ ID NO: 447128 - RNA, 19 nt, Homo sapiens
ccagccagcucuuugauuu

SEQ ID NO: 447129 - RNA, 19 nt, Homo sapiens
uagaugaccucgcuucaaa

SEQ ID NO: 447130 - RNA, 19 nt, Homo sapiens
uggcagauuuggaaaguua

SEQ ID NO: 447131 - RNA, 19 nt, Homo sapiens
aaaugugacuuuccguuua

SEQ ID NO: 447132 - RNA, 19 nt, Homo sapiens
ggaagugcaucacauguca

SEQ ID NO: 447133 - RNA, 19 nt, Homo sapiens
gacaauaaaugaccaccaa

SEQ ID NO: 447134 - RNA, 19 nt, Homo sapiens
ccaaagaaauuagaccauu

SEQ ID NO: 447135 - RNA, 19 nt, Homo sapiens
gaacugauagcuuaugguu

SEQ ID NO: 447136 - RNA, 19 nt, Homo sapiens
cuucagagaugauguuuga

SEQ ID NO: 447137 - RNA, 19 nt, Homo sapiens
gguugaaaguuacauguuu

SEQ ID NO: 447138 - RNA, 19 nt, Homo sapiens
ggaaggaggcagauucauu

SEQ ID NO: 447139 - RNA, 19 nt, Homo sapiens
aaacguggcucucccuuau

SEQ ID NO: 447140 - RNA, 19 nt, Homo sapiens
ggaauagguuuacacaaag

SEQ ID NO: 447141 - RNA, 19 nt, Homo sapiens
gcucaacucuaaacccaaa

SEQ ID NO: 447142 - RNA, 19 nt, Homo sapiens
aaagaggccagaauaaaua

SEQ ID NO: 447143 - RNA, 19 nt, Homo sapiens
ccuauaaacccaaagaaua

SEQ ID NO: 447144 - RNA, 19 nt, Homo sapiens
ugaaagauauggcucuguu

SEQ ID NO: 447145 - RNA, 19 nt, Homo sapiens
ccagagauccgaaauauca

SEQ ID NO: 447146 - RNA, 19 nt, Homo sapiens
gcaacgaccugaagaucga

SEQ ID NO: 447147 - RNA, 19 nt, Homo sapiens
caacucauguggacucaga

SEQ ID NO: 447148 - RNA, 19 nt, Homo sapiens
gggccugacugcacugaua

SEQ ID NO: 447149 - RNA, 19 nt, Homo sapiens
gaagcucggugcacagguu

SEQ ID NO: 447150 - RNA, 19 nt, Homo sapiens
caaugagccugucuccuuu

SEQ ID NO: 447151 - RNA, 19 nt, Homo sapiens
ggccuuugcuuccacauuu

SEQ ID NO: 447152 - RNA, 19 nt, Homo sapiens
guggauuacuccuuagaua

SEQ ID NO: 447153 - RNA, 19 nt, Homo sapiens
gaaggccggucuaauguag

SEQ ID NO: 447154 - RNA, 19 nt, Homo sapiens
acaaaugguucaacuguau

SEQ ID NO: 447155 - RNA, 19 nt, Homo sapiens
cuaaacacuugucccauuu

SEQ ID NO: 447156 - RNA, 19 nt, Homo sapiens
gaauacgggcugccacaua

SEQ ID NO: 447157 - RNA, 19 nt, Homo sapiens
caaggcauaugcagaguug

SEQ ID NO: 447158 - RNA, 19 nt, Homo sapiens
guuauggccuggaagaauu

SEQ ID NO: 447159 - RNA, 19 nt, Homo sapiens
gaacacaaucaccaagaaa

SEQ ID NO: 447160 - RNA, 19 nt, Homo sapiens
gaaacguggcucucccuua

SEQ ID NO: 447161 - RNA, 19 nt, Homo sapiens
gaugaccucgcuucaaaua

SEQ ID NO: 447162 - RNA, 19 nt, Homo sapiens
ccacagggcuggacuacuc

SEQ ID NO: 447163 - RNA, 19 nt, Homo sapiens
ggaaccaccuacucuuuca

SEQ ID NO: 447164 - RNA, 19 nt, Homo sapiens
gacaauacccuuuaacauc

SEQ ID NO: 447165 - RNA, 19 nt, Homo sapiens
gcucauucuugcagucaua

SEQ ID NO: 447166 - RNA, 19 nt, Homo sapiens
ggacugaacgagcauaaau

SEQ ID NO: 447167 - RNA, 19 nt, Homo sapiens
agaaucaguucaaggcaua

SEQ ID NO: 447168 - RNA, 19 nt, Homo sapiens
gaaccaccuuugacucuuc

SEQ ID NO: 447169 - RNA, 19 nt, Homo sapiens
ucagagcaguuaccaagaa

SEQ ID NO: 447170 - RNA, 19 nt, Homo sapiens
uaaagaggccagaauaaau

SEQ ID NO: 447171 - RNA, 19 nt, Homo sapiens
ucuaaacucuuaagccauu

SEQ ID NO: 447172 - RNA, 19 nt, Homo sapiens
uagaauaguuccuugacuu

SEQ ID NO: 447173 - RNA, 19 nt, Homo sapiens
ggucuaauguaggcaagua

SEQ ID NO: 447174 - RNA, 19 nt, Homo sapiens
gcacuuccuguuccuauaa

SEQ ID NO: 447175 - RNA, 19 nt, Homo sapiens
uuaaagggaugaaugugaa

SEQ ID NO: 447176 - RNA, 19 nt, Homo sapiens
gaagagcaagauauugaaa

SEQ ID NO: 447177 - RNA, 19 nt, Homo sapiens
caacaaguacuguaucuca

SEQ ID NO: 447178 - RNA, 19 nt, Homo sapiens
gaacucuaguacuguuuau

SEQ ID NO: 447179 - RNA, 19 nt, Homo sapiens
ccaaugagccugucuccuu

SEQ ID NO: 447180 - RNA, 19 nt, Homo sapiens
aaucaaacaggacucauua

SEQ ID NO: 447181 - RNA, 19 nt, Homo sapiens
cauucaagcugcagauuug

SEQ ID NO: 447182 - RNA, 19 nt, Homo sapiens
caaggaauguuuggauuuc

SEQ ID NO: 447183 - RNA, 19 nt, Homo sapiens
gggaugauuugauuucugu

SEQ ID NO: 447184 - RNA, 19 nt, Homo sapiens
ucagggcacuugcaauuau

SEQ ID NO: 447185 - RNA, 19 nt, Homo sapiens
gcaacuaaacugaacaaau

SEQ ID NO: 447186 - RNA, 19 nt, Homo sapiens
gaagacgaaccaccuuuga

SEQ ID NO: 447187 - RNA, 19 nt, Homo sapiens
ggacagggcuggucauccu

SEQ ID NO: 447188 - RNA, 19 nt, Homo sapiens
guauaccaguacaaguuua

SEQ ID NO: 447189 - RNA, 19 nt, Homo sapiens
gaggagaacuagggaagga

SEQ ID NO: 447190 - RNA, 19 nt, Homo sapiens
uacguuaccuuacugauga

SEQ ID NO: 447191 - RNA, 19 nt, Homo sapiens
ccaaugauauguuucgaua

SEQ ID NO: 447192 - RNA, 19 nt, Homo sapiens
guucaaauguucagacuuu

SEQ ID NO: 447193 - RNA, 19 nt, Homo sapiens
gauggaaucuaugcaaaua

SEQ ID NO: 447194 - RNA, 19 nt, Homo sapiens
gccgaaacgugaagaaaua

SEQ ID NO: 447195 - RNA, 19 nt, Homo sapiens
guaugcaugucccaaauua

SEQ ID NO: 447196 - RNA, 19 nt, Homo sapiens
gaacacaucagcuagcaaa

SEQ ID NO: 447197 - RNA, 19 nt, Homo sapiens
caagacauauagagcagua

SEQ ID NO: 447198 - RNA, 19 nt, Homo sapiens
agaaagagauaacucagaa

SEQ ID NO: 447199 - RNA, 19 nt, Homo sapiens
ccaguuagcagaagaaauu

SEQ ID NO: 447200 - RNA, 19 nt, Homo sapiens
gaagaaauaauggagagua

SEQ ID NO: 447201 - RNA, 19 nt, Homo sapiens
uaauaacccuugaaaguca

SEQ ID NO: 447202 - RNA, 19 nt, Homo sapiens
aaagguauaucaccaguug

SEQ ID NO: 447203 - RNA, 19 nt, Homo sapiens
gaggaugguucauauacuu

SEQ ID NO: 447204 - RNA, 19 nt, Homo sapiens
gcuaaggauucuuucauug

SEQ ID NO: 447205 - RNA, 19 nt, Homo sapiens
gggcagaggucgaaacagu

SEQ ID NO: 447206 - RNA, 19 nt, Homo sapiens
gcuauuccauaauuccaua

SEQ ID NO: 447207 - RNA, 19 nt, Homo sapiens
gaaagacgcagcugagcaa

SEQ ID NO: 447208 - RNA, 19 nt, Homo sapiens
acacagcaguucagagaaa

SEQ ID NO: 447209 - RNA, 19 nt, Homo sapiens
gacaagcccuucuuucuac

SEQ ID NO: 447210 - RNA, 19 nt, Homo sapiens
gugguacaguuuaaagaua

SEQ ID NO: 447211 - RNA, 19 nt, Homo sapiens
gcacagaaaacuagaauuu

SEQ ID NO: 447212 - RNA, 19 nt, Homo sapiens
ucagagaaauuccagugaa

SEQ ID NO: 447213 - RNA, 19 nt, Homo sapiens
gcagaggucgaaacaguaa

SEQ ID NO: 447214 - RNA, 19 nt, Homo sapiens
gaaccgaaaggccaaauuc

SEQ ID NO: 447215 - RNA, 19 nt, Homo sapiens
ggaagugggagacagaauu

SEQ ID NO: 447216 - RNA, 19 nt, Homo sapiens
gaaagacgauaaggaagag

SEQ ID NO: 447217 - RNA, 19 nt, Homo sapiens
gggcacagcauaaacacua

SEQ ID NO: 447218 - RNA, 19 nt, Homo sapiens
caaauuaccauacaacaag

SEQ ID NO: 447219 - RNA, 19 nt, Homo sapiens
ggacaaagaaauagagaag

SEQ ID NO: 447220 - RNA, 19 nt, Homo sapiens
gaaaaugacguaucuaaug

SEQ ID NO: 447221 - RNA, 19 nt, Homo sapiens
gaacuugaggcuuuggaaa

SEQ ID NO: 447222 - RNA, 19 nt, Homo sapiens
gaaccaagugcuaaggauu

SEQ ID NO: 447223 - RNA, 19 nt, Homo sapiens
gaacucuccugcagggaau

SEQ ID NO: 447224 - RNA, 19 nt, Homo sapiens
agagauaacucagaagaau

SEQ ID NO: 447225 - RNA, 19 nt, Homo sapiens
gaacauagaaaacagauug

SEQ ID NO: 447226 - RNA, 19 nt, Homo sapiens
ugaaucaagccaagacaua

SEQ ID NO: 447227 - RNA, 19 nt, Homo sapiens
acaaagaaauagagaaguc

SEQ ID NO: 447228 - RNA, 19 nt, Homo sapiens
gaaacgugaagaaauaaug

SEQ ID NO: 447229 - RNA, 19 nt, Homo sapiens
auacucagccuguuuguuu

SEQ ID NO: 447230 - RNA, 19 nt, Homo sapiens
agacgcagcugagcaaguu

SEQ ID NO: 447231 - RNA, 19 nt, Homo sapiens
ggaucccaaugauauguuu

SEQ ID NO: 447232 - RNA, 19 nt, Homo sapiens
ugucuauaguccuguaaua

SEQ ID NO: 447233 - RNA, 19 nt, Homo sapiens
uaucaccaguuguuucuga

SEQ ID NO: 447234 - RNA, 19 nt, Homo sapiens
agacagaacaguauuggaa

SEQ ID NO: 447235 - RNA, 19 nt, Homo sapiens
caauaggaaugcuaacagu

SEQ ID NO: 447236 - RNA, 19 nt, Homo sapiens
gauccauccuucucacguu

SEQ ID NO: 447237 - RNA, 19 nt, Homo sapiens
cagcagcagucagccauuu

SEQ ID NO: 447238 - RNA, 19 nt, Homo sapiens
agagaaagacgauaaggaa

SEQ ID NO: 447239 - RNA, 19 nt, Homo sapiens
uaucagugcuaaagugaau

SEQ ID NO: 447240 - RNA, 19 nt, Homo sapiens
agacaagcccuucuuucua

SEQ ID NO: 447241 - RNA, 19 nt, Homo sapiens
gagacaagcccuucuuucu

SEQ ID NO: 447242 - RNA, 19 nt, Homo sapiens
gcccaggcgugcaaccuuu

SEQ ID NO: 447243 - RNA, 19 nt, Homo sapiens
gaccaaagaguaguuaaug

SEQ ID NO: 447244 - RNA, 19 nt, Homo sapiens
gaagugggagacagaauuc

SEQ ID NO: 447245 - RNA, 19 nt, Homo sapiens
caaaccaguuagcagaaga

SEQ ID NO: 447246 - RNA, 19 nt, Homo sapiens
gagauaacucagaagaauu

SEQ ID NO: 447247 - RNA, 19 nt, Homo sapiens
gcagacgcaugcgauguau

SEQ ID NO: 447248 - RNA, 19 nt, Homo sapiens
gaaucaagccaagacauau

SEQ ID NO: 447249 - RNA, 19 nt, Homo sapiens
caagugcuaaggauucuuu

SEQ ID NO: 447250 - RNA, 19 nt, Homo sapiens
cuaaacgcaugucuucaga

SEQ ID NO: 447251 - RNA, 19 nt, Homo sapiens
uggaaucuaugcaaauaug

SEQ ID NO: 447252 - RNA, 19 nt, Homo sapiens
ccaaagaguaguuaaugga

SEQ ID NO: 447253 - RNA, 19 nt, Homo sapiens
gaaguaacaagagugauuc

SEQ ID NO: 447254 - RNA, 19 nt, Homo sapiens
gaguagaggcauuuaggaa

SEQ ID NO: 447255 - RNA, 19 nt, Homo sapiens
cagcuuacuccacgcaaua

SEQ ID NO: 447256 - RNA, 19 nt, Homo sapiens
uaaacccaaugaaacauca

SEQ ID NO: 447257 - RNA, 19 nt, Homo sapiens
ccaguggccuagaauuugu

SEQ ID NO: 447258 - RNA, 19 nt, Homo sapiens
gcaaaccaguuagcagaag

SEQ ID NO: 447259 - RNA, 19 nt, Homo sapiens
augaggaacuugaggcuuu

SEQ ID NO: 447260 - RNA, 19 nt, Homo sapiens
ugaaagucaugaacacauc

SEQ ID NO: 447261 - RNA, 19 nt, Homo sapiens
guagaggcauuuaggaacu

SEQ ID NO: 447262 - RNA, 19 nt, Homo sapiens
ggguaaugcuagaaugaug

SEQ ID NO: 447263 - RNA, 19 nt, Homo sapiens
uauagagcaguaccaaaua

SEQ ID NO: 447264 - RNA, 19 nt, Homo sapiens
auacuuacaucaguuguug

SEQ ID NO: 447265 - RNA, 19 nt, Homo sapiens
guugauuucuuguaacauc

SEQ ID NO: 447266 - RNA, 19 nt, Homo sapiens
ccaaauuaccauacaacaa

SEQ ID NO: 447267 - RNA, 19 nt, Homo sapiens
guaauacaggguaaugcua

SEQ ID NO: 447268 - RNA, 19 nt, Homo sapiens
gaaaauagcagcagcaacu

SEQ ID NO: 447269 - RNA, 19 nt, Homo sapiens
cuaaggauucuuucauuga

SEQ ID NO: 447270 - RNA, 19 nt, Homo sapiens
cauauccaguggccuagaa

SEQ ID NO: 447271 - RNA, 19 nt, Homo sapiens
aaagagauaacucagaaga

SEQ ID NO: 447272 - RNA, 19 nt, Homo sapiens
gagugauucuugcugcuau

SEQ ID NO: 447273 - RNA, 19 nt, Homo sapiens
ggagacaagcccuucuuuc

SEQ ID NO: 447274 - RNA, 19 nt, Homo sapiens
ccucagcaguucccaaauc

SEQ ID NO: 447275 - RNA, 19 nt, Homo sapiens
gcacaaccuagcccaucua

SEQ ID NO: 447276 - RNA, 19 nt, Homo sapiens
gaaauagagaagucauauc

SEQ ID NO: 447277 - RNA, 19 nt, Homo sapiens
agaaguaacaagagugauu

SEQ ID NO: 447278 - RNA, 19 nt, Homo sapiens
caaaagaaguaacaagagu

SEQ ID NO: 447279 - RNA, 19 nt, Homo sapiens
gacgcacccuucaguacaa

SEQ ID NO: 447280 - RNA, 19 nt, Homo sapiens
caccaaauaugauguaucc

SEQ ID NO: 447281 - RNA, 19 nt, Homo sapiens
uggaucaacuacuaaacaa

SEQ ID NO: 447282 - RNA, 19 nt, Homo sapiens
cucaaaagcugaaaacaaa

SEQ ID NO: 447283 - RNA, 19 nt, Homo sapiens
gacagaacaguauuggaaa

SEQ ID NO: 447284 - RNA, 19 nt, Homo sapiens
ccagcgacauccucgaaau

SEQ ID NO: 447285 - RNA, 19 nt, Homo sapiens
gcuccugucucuacuaugc

SEQ ID NO: 447286 - RNA, 19 nt, Homo sapiens
cuccaaaugugaaguacaa

SEQ ID NO: 447287 - RNA, 19 nt, Homo sapiens
ggacuccaguuaugcaaaa

SEQ ID NO: 447288 - RNA, 19 nt, Homo sapiens
aaagaaguaacaagaguga

SEQ ID NO: 447289 - RNA, 19 nt, Homo sapiens
ggcaagaccagcaucauca

SEQ ID NO: 447290 - RNA, 19 nt, Homo sapiens
auagagcaguaccaaauau

SEQ ID NO: 447291 - RNA, 19 nt, Homo sapiens
ggaauuaggcuuuagauuu

SEQ ID NO: 447292 - RNA, 19 nt, Homo sapiens
gaagauccauugguaaauu

SEQ ID NO: 447293 - RNA, 19 nt, Homo sapiens
gaacgagcuuucacaauug

SEQ ID NO: 447294 - RNA, 19 nt, Homo sapiens
cgaacgagcuuucacaauu

SEQ ID NO: 447295 - RNA, 19 nt, Homo sapiens
ccacaaagguugccaaagu

SEQ ID NO: 447296 - RNA, 19 nt, Homo sapiens
gggaagacaugccaauauu

SEQ ID NO: 447297 - RNA, 19 nt, Homo sapiens
ccagaaaccuuccagagaa

SEQ ID NO: 447298 - RNA, 19 nt, Homo sapiens
ggaauaaugcggacacuuu

SEQ ID NO: 447299 - RNA, 19 nt, Homo sapiens
aaagaaaccugaagacaau

SEQ ID NO: 447300 - RNA, 19 nt, Homo sapiens
aaacuggacugucauuauu

SEQ ID NO: 447301 - RNA, 19 nt, Homo sapiens
gaaaucacccaaagagaaa

SEQ ID NO: 447302 - RNA, 19 nt, Homo sapiens
gaaaauggauggcacacua

SEQ ID NO: 447303 - RNA, 19 nt, Homo sapiens
cgaaggcgaugacaaagaa

SEQ ID NO: 447304 - RNA, 19 nt, Homo sapiens
gaagacaugccaauauuug

SEQ ID NO: 447305 - RNA, 19 nt, Homo sapiens
ggacagaauuggacgaaag

SEQ ID NO: 447306 - RNA, 19 nt, Homo sapiens
caggaaaccucagaaauug

SEQ ID NO: 447307 - RNA, 19 nt, Homo sapiens
ggagcacacugcaaauuau

SEQ ID NO: 447308 - RNA, 19 nt, Homo sapiens
ugagccagcuucucgguua

SEQ ID NO: 447309 - RNA, 19 nt, Homo sapiens
gagaaacguugccuugugu

SEQ ID NO: 447310 - RNA, 19 nt, Homo sapiens
gcaagagcguuacuguaga

SEQ ID NO: 447311 - RNA, 19 nt, Homo sapiens
ucaacugugugacgaauaa

SEQ ID NO: 447312 - RNA, 19 nt, Homo sapiens
ccaggaaaccucagaaauu

SEQ ID NO: 447313 - RNA, 19 nt, Homo sapiens
ccaaugaacugccugucaa

SEQ ID NO: 447314 - RNA, 19 nt, Homo sapiens
gaacagcagugauucuacu

SEQ ID NO: 447315 - RNA, 19 nt, Homo sapiens
uaacgaggauuucccugaa

SEQ ID NO: 447316 - RNA, 19 nt, Homo sapiens
gcaccaggaucgugucuca

SEQ ID NO: 447317 - RNA, 19 nt, Homo sapiens
caaagaagagucuguugaa

SEQ ID NO: 447318 - RNA, 19 nt, Homo sapiens
gcacaaggacugaugaaca

SEQ ID NO: 447319 - RNA, 19 nt, Homo sapiens
gaaauugaaauccagcaaa

SEQ ID NO: 447320 - RNA, 19 nt, Homo sapiens
gcauuucaaucacauuaug

SEQ ID NO: 447321 - RNA, 19 nt, Homo sapiens
agaugaagauccauuggua

SEQ ID NO: 447322 - RNA, 19 nt, Homo sapiens
uagacaaacucauaggaaa

SEQ ID NO: 447323 - RNA, 19 nt, Homo sapiens
ggaagacaugccaauauuu

SEQ ID NO: 447324 - RNA, 19 nt, Homo sapiens
gcacagcuauggaagaaaa

SEQ ID NO: 447325 - RNA, 19 nt, Homo sapiens
gggccaaccuguccugcua

SEQ ID NO: 447326 - RNA, 19 nt, Homo sapiens
ggaaaccucagaaauugaa

SEQ ID NO: 447327 - RNA, 19 nt, Homo sapiens
ggccuacccuccaaagaaa

SEQ ID NO: 447328 - RNA, 19 nt, Homo sapiens
ggauuucccugaagcuaug

SEQ ID NO: 447329 - RNA, 19 nt, Homo sapiens
ggaaggacgggacagaauu

SEQ ID NO: 447330 - RNA, 19 nt, Homo sapiens
gcucauggaaccacacuaa

SEQ ID NO: 447331 - RNA, 19 nt, Homo sapiens
ugaaaucacccaaagagaa

SEQ ID NO: 447332 - RNA, 19 nt, Homo sapiens
ccaaggagucuucugguaa

SEQ ID NO: 447333 - RNA, 19 nt, Homo sapiens
gagcacacugcaaauuaua

SEQ ID NO: 447334 - RNA, 19 nt, Homo sapiens
gggcgaaggcgaugacaaa

SEQ ID NO: 447335 - RNA, 19 nt, Homo sapiens
uucgauagcuuucucguaa

SEQ ID NO: 447336 - RNA, 19 nt, Homo sapiens
gagcaacccucugaagaag

SEQ ID NO: 447337 - RNA, 19 nt, Homo sapiens
gagcguuacuguagaccuu

SEQ ID NO: 447338 - RNA, 19 nt, Homo sapiens
aaagaagagucuguugaaa

SEQ ID NO: 447339 - RNA, 19 nt, Homo sapiens
uaacgacuguaaucagguu

SEQ ID NO: 447340 - RNA, 19 nt, Homo sapiens
gaaggacgggacagaauug

SEQ ID NO: 447341 - RNA, 19 nt, Homo sapiens
gcacacugcaaauuauauu

SEQ ID NO: 447342 - RNA, 19 nt, Homo sapiens
agaagggaauuaggcuuua

SEQ ID NO: 447343 - RNA, 19 nt, Homo sapiens
ucgaaagggugaaagagaa

SEQ ID NO: 447344 - RNA, 19 nt, Homo sapiens
gagccacucuucaaguuag

SEQ ID NO: 447345 - RNA, 19 nt, Homo sapiens
ugaaauccagcaaaucuuu

SEQ ID NO: 447346 - RNA, 19 nt, Homo sapiens
aagaggcuauuacguguuu

SEQ ID NO: 447347 - RNA, 19 nt, Homo sapiens
ugagaaacguugccuugug

SEQ ID NO: 447348 - RNA, 19 nt, Homo sapiens
gaaagaagacauagcucau

SEQ ID NO: 447349 - RNA, 19 nt, Homo sapiens
ucucguaaauggcacguuu

SEQ ID NO: 447350 - RNA, 19 nt, Homo sapiens
aaaguggucugaacugcuu

SEQ ID NO: 447351 - RNA, 19 nt, Homo sapiens
acacacuccucuagacaaa

SEQ ID NO: 447352 - RNA, 19 nt, Homo sapiens
guuauuagccgagcacaaa

SEQ ID NO: 447353 - RNA, 19 nt, Homo sapiens
ugaacagaauuaagacgaa

SEQ ID NO: 447354 - RNA, 19 nt, Homo sapiens
ccaggaucgugucucauuu

SEQ ID NO: 447355 - RNA, 19 nt, Homo sapiens
cagcaaguaucgacagcaa

SEQ ID NO: 447356 - RNA, 19 nt, Homo sapiens
ggcaagagcguuacuguag

SEQ ID NO: 447357 - RNA, 19 nt, Homo sapiens
gguaacaucuucccauagc

SEQ ID NO: 447358 - RNA, 19 nt, Homo sapiens
ccaugaugauuucuacuug

SEQ ID NO: 447359 - RNA, 19 nt, Homo sapiens
gaucgugucucauuuugaa

SEQ ID NO: 447360 - RNA, 19 nt, Homo sapiens
caaauuauauuggcaucuc

SEQ ID NO: 447361 - RNA, 19 nt, Homo sapiens
aaaagaagcugucagaagu

SEQ ID NO: 447362 - RNA, 19 nt, Homo sapiens
gaagggaauuaggcuuuag

SEQ ID NO: 447363 - RNA, 19 nt, Homo sapiens
aaaggacacuggaucaagu

SEQ ID NO: 447364 - RNA, 19 nt, Homo sapiens
ggaugagugugauggugaa

SEQ ID NO: 447365 - RNA, 19 nt, Homo sapiens
ggaaaagauucauccgaaa

SEQ ID NO: 447366 - RNA, 19 nt, Homo sapiens
guuccaaguuguugaaauc

SEQ ID NO: 447367 - RNA, 19 nt, Homo sapiens
gaugaagauccauugguaa

SEQ ID NO: 447368 - RNA, 19 nt, Homo sapiens
aagaagcugucagaaguuu

SEQ ID NO: 447369 - RNA, 19 nt, Homo sapiens
caaguuacaccuccacuca

SEQ ID NO: 447370 - RNA, 19 nt, Homo sapiens
cugaagacaauuccaauaa

SEQ ID NO: 447371 - RNA, 19 nt, Homo sapiens
acaguucccuccuucauca

SEQ ID NO: 447372 - RNA, 19 nt, Homo sapiens
gcaucggccucaacugugu

SEQ ID NO: 447373 - RNA, 19 nt, Homo sapiens
ccucaacgguaacaucuuc

SEQ ID NO: 447374 - RNA, 19 nt, Homo sapiens
gaaaagauucauccgaaaa

SEQ ID NO: 447375 - RNA, 19 nt, Homo sapiens
caugacacccucugugaaa

SEQ ID NO: 447376 - RNA, 19 nt, Homo sapiens
uggagcacacugcaaauua

SEQ ID NO: 447377 - RNA, 19 nt, Homo sapiens
cgauagcuuucucguaaau

SEQ ID NO: 447378 - RNA, 19 nt, Homo sapiens
caacuucgauagcuuucuc

SEQ ID NO: 447379 - RNA, 19 nt, Homo sapiens
cgagcaacccucugaagaa

SEQ ID NO: 447380 - RNA, 19 nt, Homo sapiens
cacaaagguugccaaagug

SEQ ID NO: 447381 - RNA, 19 nt, Homo sapiens
caacaacagcagcagcaaa

SEQ ID NO: 447382 - RNA, 19 nt, Homo sapiens
cccaaggagucuucuggua

SEQ ID NO: 447383 - RNA, 19 nt, Homo sapiens
caaacucugugccgacauc

SEQ ID NO: 447384 - RNA, 19 nt, Homo sapiens
gcccaguccugaagugaug

SEQ ID NO: 447385 - RNA, 19 nt, Homo sapiens
caaguucagccaccgaauu

SEQ ID NO: 447386 - RNA, 19 nt, Homo sapiens
caaggagucuucugguaac

SEQ ID NO: 447387 - RNA, 19 nt, Homo sapiens
ggauggcacacuacugaaa

SEQ ID NO: 447388 - RNA, 19 nt, Homo sapiens
gcagcaaacccacaaaggu

SEQ ID NO: 447389 - RNA, 19 nt, Homo sapiens
cagaauuggacgaaaguuu

SEQ ID NO: 447390 - RNA, 19 nt, Homo sapiens
gaaaagaagcugucagaag

SEQ ID NO: 447391 - RNA, 19 nt, Homo sapiens
ggacaaguuugcagaauau

SEQ ID NO: 447392 - RNA, 19 nt, Homo sapiens
gaaagucgaaagaagauua

SEQ ID NO: 447393 - RNA, 19 nt, Homo sapiens
gaagaaagucgaaagaaga

SEQ ID NO: 447394 - RNA, 19 nt, Homo sapiens
caaauccacugaugcauau

SEQ ID NO: 447395 - RNA, 19 nt, Homo sapiens
gcaaagaucuaagcaugau

SEQ ID NO: 447396 - RNA, 19 nt, Homo sapiens
gaauuuagcaaccuagaaa

SEQ ID NO: 447397 - RNA, 19 nt, Homo sapiens
gaacgcaaucuauuucaaa

SEQ ID NO: 447398 - RNA, 19 nt, Homo sapiens
gaaagucaaacgaaugaaa

SEQ ID NO: 447399 - RNA, 19 nt, Homo sapiens
gaucuaagcaugauugugu

SEQ ID NO: 447400 - RNA, 19 nt, Homo sapiens
cagcaucacaucagcauua

SEQ ID NO: 447401 - RNA, 19 nt, Homo sapiens
cagauucucuuggcucaua

SEQ ID NO: 447402 - RNA, 19 nt, Homo sapiens
gcagaccucucaggcauga

SEQ ID NO: 447403 - RNA, 19 nt, Homo sapiens
acacuuaccucgguucaaa

SEQ ID NO: 447404 - RNA, 19 nt, Homo sapiens
gcugagaaauugauggaau

SEQ ID NO: 447405 - RNA, 19 nt, Homo sapiens
ugacugaauucaacaaauc

SEQ ID NO: 447406 - RNA, 19 nt, Homo sapiens
gaaccaaaccaaaucauac

SEQ ID NO: 447407 - RNA, 19 nt, Homo sapiens
guaaucacccuuuccuauu

SEQ ID NO: 447408 - RNA, 19 nt, Homo sapiens
ccagaagcuugaagagaaa

SEQ ID NO: 447409 - RNA, 19 nt, Homo sapiens
ggccaaacaagaauacaua

SEQ ID NO: 447410 - RNA, 19 nt, Homo sapiens
gaaauguucaucaccaguu

SEQ ID NO: 447411 - RNA, 19 nt, Homo sapiens
guugauaggucaggaaaug

SEQ ID NO: 447412 - RNA, 19 nt, Homo sapiens
augaagaguuccauuguaa

SEQ ID NO: 447413 - RNA, 19 nt, Homo sapiens
uccagaagcuugaagagaa

SEQ ID NO: 447414 - RNA, 19 nt, Homo sapiens
gaagaguuccauuguaauc

SEQ ID NO: 447415 - RNA, 19 nt, Homo sapiens
uggacaaguuugcagaaua

SEQ ID NO: 447416 - RNA, 19 nt, Homo sapiens
ccuaaauccuucuuauguu

SEQ ID NO: 447417 - RNA, 19 nt, Homo sapiens
uaaucacccuuuccuauuc

SEQ ID NO: 447418 - RNA, 19 nt, Homo sapiens
ucaccuacuucaacuaaug

SEQ ID NO: 447419 - RNA, 19 nt, Homo sapiens
caacaaauccacugaugca

SEQ ID NO: 447420 - RNA, 19 nt, Homo sapiens
caacacugcacaacagauu

SEQ ID NO: 447421 - RNA, 19 nt, Homo sapiens
acacaggaguuccagauca

SEQ ID NO: 447422 - RNA, 19 nt, Homo sapiens
caacagcauccucuucuau

SEQ ID NO: 447423 - RNA, 19 nt, Homo sapiens
ccaacagcauccucuucua

SEQ ID NO: 447424 - RNA, 19 nt, Homo sapiens
agaagaaagucgaaagaag

SEQ ID NO: 447425 - RNA, 19 nt, Homo sapiens
acaaauccacugaugcaua

SEQ ID NO: 447426 - RNA, 19 nt, Homo sapiens
cacaacagauuaagaaggu

SEQ ID NO: 447427 - RNA, 19 nt, Homo sapiens
ccaaaccaaaucauacuuu

SEQ ID NO: 447428 - RNA, 19 nt, Homo sapiens
gguggaaagucaaacgaau

SEQ ID NO: 447429 - RNA, 19 nt, Homo sapiens
caaccuagaaacacacauu

SEQ ID NO: 447430 - RNA, 19 nt, Homo sapiens
uagcaugccuuucucucuu

SEQ ID NO: 447431 - RNA, 19 nt, Homo sapiens
gaucaucaccuacuucaac

SEQ ID NO: 447432 - RNA, 19 nt, Homo sapiens
gcaaaugcuccagaagaaa

SEQ ID NO: 447433 - RNA, 19 nt, Homo sapiens
ugcaaaugcuccagaagaa

SEQ ID NO: 447434 - RNA, 19 nt, Homo sapiens
ugaaccaaaccaaaucaua

SEQ ID NO: 447435 - RNA, 19 nt, Homo sapiens
gaauacauacaaguccaua

SEQ ID NO: 447436 - RNA, 19 nt, Homo sapiens
caucaccuacuucaacuaa

SEQ ID NO: 447437 - RNA, 19 nt, Homo sapiens
caacaagcucuucggagaa

SEQ ID NO: 447438 - RNA, 19 nt, Homo sapiens
guucaucaccaguuucaaa

SEQ ID NO: 447439 - RNA, 19 nt, Homo sapiens
agacaacacugcacaacag

SEQ ID NO: 447440 - RNA, 19 nt, Homo sapiens
ucucuuggcucauauuucu

SEQ ID NO: 447441 - RNA, 19 nt, Homo sapiens
gcaacaacagauucucuug

SEQ ID NO: 447442 - RNA, 19 nt, Homo sapiens
gcagugggagaagaaauuu

SEQ ID NO: 447443 - RNA, 19 nt, Homo sapiens
aaauguucaucaccaguuu

SEQ ID NO: 447444 - RNA, 19 nt, Homo sapiens
cgugcuaucuggaguccua

SEQ ID NO: 447445 - RNA, 19 nt, Homo sapiens
auacaaaggcaaagaucua

SEQ ID NO: 447446 - RNA, 19 nt, Homo sapiens
agaagauacuaaagaggaa

SEQ ID NO: 447447 - RNA, 19 nt, Homo sapiens
aggaaaagcugcaacauau

SEQ ID NO: 447448 - RNA, 19 nt, Homo sapiens
acauacaaguccauacaga

SEQ ID NO: 447449 - RNA, 19 nt, Homo sapiens
ccuaauuccugaagguaau

SEQ ID NO: 447450 - RNA, 19 nt, Homo sapiens
gaacaacaucuucuauucc

SEQ ID NO: 447451 - RNA, 19 nt, Homo sapiens
aaagaucuaagcaugauug

SEQ ID NO: 447452 - RNA, 19 nt, Homo sapiens
caaaugcuccagaagaaag

SEQ ID NO: 447453 - RNA, 19 nt, Homo sapiens
gaaaagcugcaacauauca

SEQ ID NO: 447454 - RNA, 19 nt, Homo sapiens
ccucuucuauggcagauuc

SEQ ID NO: 447455 - RNA, 19 nt, Homo sapiens
ggccaagguccuggaaaua

SEQ ID NO: 447456 - RNA, 19 nt, Homo sapiens
gaagauacuaaagaggaaa

SEQ ID NO: 447457 - RNA, 19 nt, Homo sapiens
ccagaagaaagucgaaaga

SEQ ID NO: 447458 - RNA, 19 nt, Homo sapiens
aacaagcucuucggagaaa

SEQ ID NO: 447459 - RNA, 19 nt, Homo sapiens
cagagaacaccacaggaaa

SEQ ID NO: 447460 - RNA, 19 nt, Homo sapiens
caccaugaauucacucagu

SEQ ID NO: 447461 - RNA, 19 nt, Homo sapiens
acagagaacaccacaggaa

SEQ ID NO: 447462 - RNA, 19 nt, Homo sapiens
uaucuggaguccuacacaa

SEQ ID NO: 447463 - RNA, 19 nt, Homo sapiens
gaagccaacaccaaguuca

SEQ ID NO: 447464 - RNA, 19 nt, Homo sapiens
ggcagugggagaagaaauu

SEQ ID NO: 447465 - RNA, 19 nt, Homo sapiens
cagaagaaagucgaaagaa

SEQ ID NO: 447466 - RNA, 19 nt, Homo sapiens
uacagaugaugaggcaaua

SEQ ID NO: 447467 - RNA, 19 nt, Homo sapiens
ggucaggaaauguucauca

SEQ ID NO: 447468 - RNA, 19 nt, Homo sapiens
acacugcacaacagauuaa

SEQ ID NO: 447469 - RNA, 19 nt, Homo sapiens
guucuucacuuugaucaag

SEQ ID NO: 447470 - RNA, 19 nt, Homo sapiens
gauaccuaaauccuucuua

SEQ ID NO: 447471 - RNA, 19 nt, Homo sapiens
cacaucgaguucaccauga

SEQ ID NO: 447472 - RNA, 19 nt, Homo sapiens
uguaaucacccuuuccuau

SEQ ID NO: 447473 - RNA, 19 nt, Homo sapiens
gggaaugguggauaucuuc

SEQ ID NO: 447474 - RNA, 19 nt, Homo sapiens
cugagaaauugauggaaug

SEQ ID NO: 447475 - RNA, 19 nt, Homo sapiens
ggcaaagaucuaagcauga

SEQ ID NO: 447476 - RNA, 19 nt, Homo sapiens
uaaaauagcaugccuuucu

SEQ ID NO: 447477 - RNA, 19 nt, Homo sapiens
ccuuuccuauucuucauaa

SEQ ID NO: 447478 - RNA, 19 nt, Homo sapiens
agagagcuaugaccucaag

SEQ ID NO: 447479 - RNA, 19 nt, Homo sapiens
gaucaagucacagagaaca

SEQ ID NO: 447480 - RNA, 19 nt, Homo sapiens
ucaaagggcagugggagaa

SEQ ID NO: 447481 - RNA, 19 nt, Homo sapiens
uugauggaauggacaaguu

SEQ ID NO: 447482 - RNA, 19 nt, Homo sapiens
uggaaagucaaacgaauga

SEQ ID NO: 447483 - RNA, 19 nt, Homo sapiens
uucaaaagcuucugacuga

SEQ ID NO: 447484 - RNA, 19 nt, Homo sapiens
caaagacaacacugcacaa

SEQ ID NO: 447485 - RNA, 19 nt, Homo sapiens
caaaguggaagagagcuau

SEQ ID NO: 447486 - RNA, 19 nt, Homo sapiens
cauuagggaugguccucuu

SEQ ID NO: 447487 - RNA, 19 nt, Homo sapiens
cugcacaacagauuaagaa

SEQ ID NO: 447488 - RNA, 19 nt, Homo sapiens
agugggagaagaaauuuaa

SEQ ID NO: 447489 - RNA, 19 nt, Homo sapiens
gauuaacuccuggguggaa

SEQ ID NO: 447490 - RNA, 19 nt, Homo sapiens
agaccaguguggaaucugu

SEQ ID NO: 447491 - RNA, 19 nt, Homo sapiens
ggacaaguuugcagaauau

SEQ ID NO: 447492 - RNA, 19 nt, Homo sapiens
gaagaguucuguuguaauc

SEQ ID NO: 447493 - RNA, 19 nt, Homo sapiens
gaaagucgaaagaagauua

SEQ ID NO: 447494 - RNA, 19 nt, Homo sapiens
gcaagguucuucacuuuga

SEQ ID NO: 447495 - RNA, 19 nt, Homo sapiens
gaagaaagucgaaagaaga

SEQ ID NO: 447496 - RNA, 19 nt, Homo sapiens
caaauccacugaugcauau

SEQ ID NO: 447497 - RNA, 19 nt, Homo sapiens
gcagaagcuugaagagaaa

SEQ ID NO: 447498 - RNA, 19 nt, Homo sapiens
gcaaagaucuaagcaugau

SEQ ID NO: 447499 - RNA, 19 nt, Homo sapiens
gaacgcaaucuauuucaaa

SEQ ID NO: 447500 - RNA, 19 nt, Homo sapiens
gaaagucaaacgaaugaaa

SEQ ID NO: 447501 - RNA, 19 nt, Homo sapiens
uagcaagguucuucacuuu

SEQ ID NO: 447502 - RNA, 19 nt, Homo sapiens
gagccacggucucucagua

SEQ ID NO: 447503 - RNA, 19 nt, Homo sapiens
agacaacacugcacaacaa

SEQ ID NO: 447504 - RNA, 19 nt, Homo sapiens
cagcaucacaucagcauua

SEQ ID NO: 447505 - RNA, 19 nt, Homo sapiens
cagauucucuuggcucaua

SEQ ID NO: 447506 - RNA, 19 nt, Homo sapiens
uaucaucuccuucaacuaa

SEQ ID NO: 447507 - RNA, 19 nt, Homo sapiens
gcagaccucucaggcauga

SEQ ID NO: 447508 - RNA, 19 nt, Homo sapiens
acacuuaccucgguucaaa

SEQ ID NO: 447509 - RNA, 19 nt, Homo sapiens
gcagugggagaauaaauuu

SEQ ID NO: 447510 - RNA, 19 nt, Homo sapiens
caacacugcacaacaaauu

SEQ ID NO: 447511 - RNA, 19 nt, Homo sapiens
gcugagaaauugauggaau

SEQ ID NO: 447512 - RNA, 19 nt, Homo sapiens
ugacugaauucaacaaauc

SEQ ID NO: 447513 - RNA, 19 nt, Homo sapiens
gaaccaaaccaaaucauac

SEQ ID NO: 447514 - RNA, 19 nt, Homo sapiens
guaaucacccuuuccuauu

SEQ ID NO: 447515 - RNA, 19 nt, Homo sapiens
ggccaaacaagaauacaua

SEQ ID NO: 447516 - RNA, 19 nt, Homo sapiens
gaaauguucaucaccaguu

SEQ ID NO: 447517 - RNA, 19 nt, Homo sapiens
guugauaggucaggaaaug

SEQ ID NO: 447518 - RNA, 19 nt, Homo sapiens
ugcagaagcuugaagagaa

SEQ ID NO: 447519 - RNA, 19 nt, Homo sapiens
ggcaauacaauuccuuuaa

SEQ ID NO: 447520 - RNA, 19 nt, Homo sapiens
uggacaaguuugcagaaua

SEQ ID NO: 447521 - RNA, 19 nt, Homo sapiens
gagaaaagacguaucaauu

SEQ ID NO: 447522 - RNA, 19 nt, Homo sapiens
ccuaaauccuucuuauguu

SEQ ID NO: 447523 - RNA, 19 nt, Homo sapiens
ugccaccgcuguaguagua

SEQ ID NO: 447524 - RNA, 19 nt, Homo sapiens
uaaucacccuuuccuauuc

SEQ ID NO: 447525 - RNA, 19 nt, Homo sapiens
aaugaagaguucuguugua

SEQ ID NO: 447526 - RNA, 19 nt, Homo sapiens
uguaguaguagucgaauua

SEQ ID NO: 447527 - RNA, 19 nt, Homo sapiens
uaucuaaaguccuacacaa

SEQ ID NO: 447528 - RNA, 19 nt, Homo sapiens
caacaaauccacugaugca

SEQ ID NO: 447529 - RNA, 19 nt, Homo sapiens
gaauuaucaucuccuucaa

SEQ ID NO: 447530 - RNA, 19 nt, Homo sapiens
caacagcauccucuucuau

SEQ ID NO: 447531 - RNA, 19 nt, Homo sapiens
acacaggaguuccagauca

SEQ ID NO: 447532 - RNA, 19 nt, Homo sapiens
ccaacagcauccucuucua

SEQ ID NO: 447533 - RNA, 19 nt, Homo sapiens
agaagaaagucgaaagaag

SEQ ID NO: 447534 - RNA, 19 nt, Homo sapiens
acaaauccacugaugcaua

SEQ ID NO: 447535 - RNA, 19 nt, Homo sapiens
ucacagagaacaccacaga

SEQ ID NO: 447536 - RNA, 19 nt, Homo sapiens
ccaaaccaaaucauacuuu

SEQ ID NO: 447537 - RNA, 19 nt, Homo sapiens
cuagagguguucugguaaa

SEQ ID NO: 447538 - RNA, 19 nt, Homo sapiens
gguggaaagucaaacgaau

SEQ ID NO: 447539 - RNA, 19 nt, Homo sapiens
caaauuagcaagguucuuc

SEQ ID NO: 447540 - RNA, 19 nt, Homo sapiens
caaccuagaaacacacauu

SEQ ID NO: 447541 - RNA, 19 nt, Homo sapiens
uagcaugccuuucucucuu

SEQ ID NO: 447542 - RNA, 19 nt, Homo sapiens
cgaauuaucaucuccuuca

SEQ ID NO: 447543 - RNA, 19 nt, Homo sapiens
gcaaaugcuccagaagaaa

SEQ ID NO: 447544 - RNA, 19 nt, Homo sapiens
ugcaaaugcuccagaagaa

SEQ ID NO: 447545 - RNA, 19 nt, Homo sapiens
ugaaccaaaccaaaucaua

SEQ ID NO: 447546 - RNA, 19 nt, Homo sapiens
aaagggcagugggagaaua

SEQ ID NO: 447547 - RNA, 19 nt, Homo sapiens
acagagaacaccacagaaa

SEQ ID NO: 447548 - RNA, 19 nt, Homo sapiens
gagguguucugguaaacug

SEQ ID NO: 447549 - RNA, 19 nt, Homo sapiens
cgacacugguucuugugaa

SEQ ID NO: 447550 - RNA, 19 nt, Homo sapiens
caacaagcucuucggagaa

SEQ ID NO: 447551 - RNA, 19 nt, Homo sapiens
guucaucaccaguuucaaa

SEQ ID NO: 447552 - RNA, 19 nt, Homo sapiens
ucucuuggcucauauuucu

SEQ ID NO: 447553 - RNA, 19 nt, Homo sapiens
gcaacaacagauucucuug

SEQ ID NO: 447554 - RNA, 19 nt, Homo sapiens
guacagaugaugaggcaau

SEQ ID NO: 447555 - RNA, 19 nt, Homo sapiens
aaauguucaucaccaguuu

SEQ ID NO: 447556 - RNA, 19 nt, Homo sapiens
auacaaaggcaaagaucua

SEQ ID NO: 447557 - RNA, 19 nt, Homo sapiens
augaagaguucuguuguaa

SEQ ID NO: 447558 - RNA, 19 nt, Homo sapiens
cuaaugaagaguucuguug

SEQ ID NO: 447559 - RNA, 19 nt, Homo sapiens
ugauugugcugcugccaaa

SEQ ID NO: 447560 - RNA, 19 nt, Homo sapiens
gaacaacaucuucuauucc

SEQ ID NO: 447561 - RNA, 19 nt, Homo sapiens
aaagaucuaagcaugauug

SEQ ID NO: 447562 - RNA, 19 nt, Homo sapiens
ggcagugggagaauaaauu

SEQ ID NO: 447563 - RNA, 19 nt, Homo sapiens
caaaugcuccagaagaaag

SEQ ID NO: 447564 - RNA, 19 nt, Homo sapiens
ccucuucuauggcagauuc

SEQ ID NO: 447565 - RNA, 19 nt, Homo sapiens
cucaguaucuaaaguccua

SEQ ID NO: 447566 - RNA, 19 nt, Homo sapiens
ggccaagguccuggaaaua

SEQ ID NO: 447567 - RNA, 19 nt, Homo sapiens
ccagaagaaagucgaaaga

SEQ ID NO: 447568 - RNA, 19 nt, Homo sapiens
aacaagcucuucggagaaa

SEQ ID NO: 447569 - RNA, 19 nt, Homo sapiens
uuagcaagguucuucacuu

SEQ ID NO: 447570 - RNA, 19 nt, Homo sapiens
caccaugaauucacucagu

SEQ ID NO: 447571 - RNA, 19 nt, Homo sapiens
gaggcaauacaauuccuuu

SEQ ID NO: 447572 - RNA, 19 nt, Homo sapiens
gaugaugaggcaauacaau

SEQ ID NO: 447573 - RNA, 19 nt, Homo sapiens
gaagccaacaccaaguuca

SEQ ID NO: 447574 - RNA, 19 nt, Homo sapiens
auacgacacugguucuugu

SEQ ID NO: 447575 - RNA, 19 nt, Homo sapiens
cagaagaaagucgaaagaa

SEQ ID NO: 447576 - RNA, 19 nt, Homo sapiens
uacagaugaugaggcaaua

SEQ ID NO: 447577 - RNA, 19 nt, Homo sapiens
gauacgacacugguucuug

SEQ ID NO: 447578 - RNA, 19 nt, Homo sapiens
ggucaggaaauguucauca

SEQ ID NO: 447579 - RNA, 19 nt, Homo sapiens
guucuucacuuugaucaag

SEQ ID NO: 447580 - RNA, 19 nt, Homo sapiens
gauaccuaaauccuucuua

SEQ ID NO: 447581 - RNA, 19 nt, Homo sapiens
uguaaucacccuuuccuau

SEQ ID NO: 447582 - RNA, 19 nt, Homo sapiens
cugagaaauugauggaaug

SEQ ID NO: 447583 - RNA, 19 nt, Homo sapiens
ggcaaagaucuaagcauga

SEQ ID NO: 447584 - RNA, 19 nt, Homo sapiens
cacaucgaguucaccauga

SEQ ID NO: 447585 - RNA, 19 nt, Homo sapiens
uaaaauagcaugccuuucu

SEQ ID NO: 447586 - RNA, 19 nt, Homo sapiens
ccuuuccuauucuucauaa

SEQ ID NO: 447587 - RNA, 19 nt, Homo sapiens
agagagcuaugaccucaag

SEQ ID NO: 447588 - RNA, 19 nt, Homo sapiens
gaucaagucacagagaaca

SEQ ID NO: 447589 - RNA, 19 nt, Homo sapiens
gacaacacugcacaacaaa

SEQ ID NO: 447590 - RNA, 19 nt, Homo sapiens
ucaaagggcagugggagaa

SEQ ID NO: 447591 - RNA, 19 nt, Homo sapiens
gauauuagguccauucauu

SEQ ID NO: 447592 - RNA, 19 nt, Homo sapiens
ggaaaugucugcugguauu

SEQ ID NO: 447593 - RNA, 19 nt, Homo sapiens
gaagaucacuguaguuuag

SEQ ID NO: 447594 - RNA, 19 nt, Homo sapiens
gagaagcgguggauaacua

SEQ ID NO: 447595 - RNA, 19 nt, Homo sapiens
caacaacucugccuuuaug

SEQ ID NO: 447596 - RNA, 19 nt, Homo sapiens
gaauaugucuggagaaaca

SEQ ID NO: 447597 - RNA, 19 nt, Homo sapiens
ggagaaacaucauccuuau

SEQ ID NO: 447598 - RNA, 19 nt, Homo sapiens
ggagauuucuuaguucaua

SEQ ID NO: 447599 - RNA, 19 nt, Homo sapiens
caauucaagugacacauua

SEQ ID NO: 447600 - RNA, 19 nt, Homo sapiens
uaagauggcuguggcauuu

SEQ ID NO: 447601 - RNA, 19 nt, Homo sapiens
ucagaugccugcuugauaa

SEQ ID NO: 447602 - RNA, 19 nt, Homo sapiens
acaaggagauuucuuaguu

SEQ ID NO: 447603 - RNA, 19 nt, Homo sapiens
ggagagaguuagcauguau

SEQ ID NO: 447604 - RNA, 19 nt, Homo sapiens
ccaagaaacugaaugaauc

SEQ ID NO: 447605 - RNA, 19 nt, Homo sapiens
gagauuguguuuguucaua

SEQ ID NO: 447606 - RNA, 19 nt, Homo sapiens
aaagaugguuguagcauuu

SEQ ID NO: 447607 - RNA, 19 nt, Homo sapiens
gcaagcagcuggucagucu

SEQ ID NO: 447608 - RNA, 19 nt, Homo sapiens
gauaugcuguggugcuuaa

SEQ ID NO: 447609 - RNA, 19 nt, Homo sapiens
gaagcuaauuguacuaauc

SEQ ID NO: 447610 - RNA, 19 nt, Homo sapiens
ucaggugccuuacaucuuu

SEQ ID NO: 447611 - RNA, 19 nt, Homo sapiens
gagugugucugcugaguaa

SEQ ID NO: 447612 - RNA, 19 nt, Homo sapiens
aaagagggauguuuggaaa

SEQ ID NO: 447613 - RNA, 19 nt, Homo sapiens
uuacaguucuuuccucuuu

SEQ ID NO: 447614 - RNA, 19 nt, Homo sapiens
gcuaguaucuuggguguau

SEQ ID NO: 447615 - RNA, 19 nt, Homo sapiens
gccaacaacucugccuuua

SEQ ID NO: 447616 - RNA, 19 nt, Homo sapiens
gcugagaccugggauuuga

SEQ ID NO: 447617 - RNA, 19 nt, Homo sapiens
ucacuacccugauucuuga

SEQ ID NO: 447618 - RNA, 19 nt, Homo sapiens
uaacaucuagccuaaagua

SEQ ID NO: 447619 - RNA, 19 nt, Homo sapiens
caaccuuucuguagccuaa

SEQ ID NO: 447620 - RNA, 19 nt, Homo sapiens
gagauaaguuggagacgau

SEQ ID NO: 447621 - RNA, 19 nt, Homo sapiens
ggaagaucacuguaguuua

SEQ ID NO: 447622 - RNA, 19 nt, Homo sapiens
gagcgaacuucacauagga

SEQ ID NO: 447623 - RNA, 19 nt, Homo sapiens
guagguggcuugagcuaga

SEQ ID NO: 447624 - RNA, 19 nt, Homo sapiens
gcacaggaauucucaagac

SEQ ID NO: 447625 - RNA, 19 nt, Homo sapiens
ccacugacuugcuguguga

SEQ ID NO: 447626 - RNA, 19 nt, Homo sapiens
ccaagugccucaccucgaa

SEQ ID NO: 447627 - RNA, 19 nt, Homo sapiens
guucauauaucaagaaguc

SEQ ID NO: 447628 - RNA, 19 nt, Homo sapiens
agaaugaugucuaugaaug

SEQ ID NO: 447629 - RNA, 19 nt, Homo sapiens
gaauggaggagauaaguug

SEQ ID NO: 447630 - RNA, 19 nt, Homo sapiens
gggccugaguggaggauua

SEQ ID NO: 447631 - RNA, 19 nt, Homo sapiens
uaagagcgaacuucacaua

SEQ ID NO: 447632 - RNA, 19 nt, Homo sapiens
gacauucgcccugauauaa

SEQ ID NO: 447633 - RNA, 19 nt, Homo sapiens
gauggaggguggaaauaau

SEQ ID NO: 447634 - RNA, 19 nt, Homo sapiens
ugaaggagaggaggaauua

SEQ ID NO: 447635 - RNA, 19 nt, Homo sapiens
aaacaacuuucacuucuuc

SEQ ID NO: 447636 - RNA, 19 nt, Homo sapiens
gaagguuacugagugaguu

SEQ ID NO: 447637 - RNA, 19 nt, Homo sapiens
ccacauagcaugcuuccuu

SEQ ID NO: 447638 - RNA, 19 nt, Homo sapiens
ccagaaugaugucuaugaa

SEQ ID NO: 447639 - RNA, 19 nt, Homo sapiens
ggaaauguacacuaccaaa

SEQ ID NO: 447640 - RNA, 19 nt, Homo sapiens
gcagugcaaugcuuguaga

SEQ ID NO: 447641 - RNA, 19 nt, Homo sapiens
acauacagcugccuaccua

SEQ ID NO: 447642 - RNA, 19 nt, Homo sapiens
uaucaacucugaagcuaau

SEQ ID NO: 447643 - RNA, 19 nt, Homo sapiens
gaugccugcuugauaauau

SEQ ID NO: 447644 - RNA, 19 nt, Homo sapiens
gggaagaucacuguaguuu

SEQ ID NO: 447645 - RNA, 19 nt, Homo sapiens
gaaguaggaggaaacaguu

SEQ ID NO: 447646 - RNA, 19 nt, Homo sapiens
ccacauucuucauugauug

SEQ ID NO: 447647 - RNA, 19 nt, Homo sapiens
gggagaauauccugguuuc

SEQ ID NO: 447648 - RNA, 19 nt, Homo sapiens
ggaguacgcuagacuuguc

SEQ ID NO: 447649 - RNA, 19 nt, Homo sapiens
uguauucucuguaagugua

SEQ ID NO: 447650 - RNA, 19 nt, Homo sapiens
ucaagugacacauuaauga

SEQ ID NO: 447651 - RNA, 19 nt, Homo sapiens
gcuauucaccucaguagaa

SEQ ID NO: 447652 - RNA, 19 nt, Homo sapiens
ccacaaacccugcugaaca

SEQ ID NO: 447653 - RNA, 19 nt, Homo sapiens
cuacggcucuuucugauca

SEQ ID NO: 447654 - RNA, 19 nt, Homo sapiens
gaucaagaguccggauuuc

SEQ ID NO: 447655 - RNA, 19 nt, Homo sapiens
gaaaagcaacuucauuuga

SEQ ID NO: 447656 - RNA, 19 nt, Homo sapiens
ggcuugagcuagagauaaa

SEQ ID NO: 447657 - RNA, 19 nt, Homo sapiens
gaguaccgcuggcacauca

SEQ ID NO: 447658 - RNA, 19 nt, Homo sapiens
caagaguccggauuucuaa

SEQ ID NO: 447659 - RNA, 19 nt, Homo sapiens
guuaacaucuagccuaaag

SEQ ID NO: 447660 - RNA, 19 nt, Homo sapiens
gaggugaagucgggucaaa

SEQ ID NO: 447661 - RNA, 19 nt, Homo sapiens
caaggagauuucuuaguuc

SEQ ID NO: 447662 - RNA, 19 nt, Homo sapiens
cuacaagaguggcugaguu

SEQ ID NO: 447663 - RNA, 19 nt, Homo sapiens
ggauaauaauacugaccua

SEQ ID NO: 447664 - RNA, 19 nt, Homo sapiens
uggcuuugcucuauuaaga

SEQ ID NO: 447665 - RNA, 19 nt, Homo sapiens
caacuaccaccacuccuuu

SEQ ID NO: 447666 - RNA, 19 nt, Homo sapiens
gcauugccacggaaacaua

SEQ ID NO: 447667 - RNA, 19 nt, Homo sapiens
gcuuugcucuauuaagauu

SEQ ID NO: 447668 - RNA, 19 nt, Homo sapiens
gugcaaugcuuguagaagu

SEQ ID NO: 447669 - RNA, 19 nt, Homo sapiens
gaggaugccuuuucuguga

SEQ ID NO: 447670 - RNA, 19 nt, Homo sapiens
gauuaucaguaucacgauu

SEQ ID NO: 447671 - RNA, 19 nt, Homo sapiens
cagaggcagugaugacuug

SEQ ID NO: 447672 - RNA, 19 nt, Homo sapiens
ugagaagguuacugaguga

SEQ ID NO: 447673 - RNA, 19 nt, Homo sapiens
guugugagcuuugaaguag

SEQ ID NO: 447674 - RNA, 19 nt, Homo sapiens
cugagaaacuggugauguu

SEQ ID NO: 447675 - RNA, 19 nt, Homo sapiens
cgacauucgcccugauaua

SEQ ID NO: 447676 - RNA, 19 nt, Homo sapiens
ugaaguggcugguagaaaa

SEQ ID NO: 447677 - RNA, 19 nt, Homo sapiens
gauuggaaauguacacuac

SEQ ID NO: 447678 - RNA, 19 nt, Homo sapiens
ccacacugauggcucaaga

SEQ ID NO: 447679 - RNA, 19 nt, Homo sapiens
caucuagccuaaaguauac

SEQ ID NO: 447680 - RNA, 19 nt, Homo sapiens
gcuuagaacguuaaacuau

SEQ ID NO: 447681 - RNA, 19 nt, Homo sapiens
gaaccucucgccaugauca

SEQ ID NO: 447682 - RNA, 19 nt, Homo sapiens
gaguuagcauguaugaaug

SEQ ID NO: 447683 - RNA, 19 nt, Homo sapiens
gggagagaguuagcaugua

SEQ ID NO: 447684 - RNA, 19 nt, Homo sapiens
caacuucaccacauucuuc

SEQ ID NO: 447685 - RNA, 19 nt, Homo sapiens
aaagcgagguggccauguu

SEQ ID NO: 447686 - RNA, 19 nt, Homo sapiens
gaguggaggauuaucagua

SEQ ID NO: 447687 - RNA, 19 nt, Homo sapiens
guugccagcucuagccuuu

SEQ ID NO: 447688 - RNA, 19 nt, Homo sapiens
ggugagggcuuccacaacu

SEQ ID NO: 447689 - RNA, 19 nt, Homo sapiens
uggagaaacaucauccuua

SEQ ID NO: 447690 - RNA, 19 nt, Homo sapiens
acuauaaggugccucaguu

SEQ ID NO: 447691 - RNA, 19 nt, Homo sapiens
gagagaagcugggagaauc

SEQ ID NO: 447692 - RNA, 19 nt, Homo sapiens
cugaggacaucgucacuua

SEQ ID NO: 447693 - RNA, 19 nt, Homo sapiens
guuagugucuuuccuugaa

SEQ ID NO: 447694 - RNA, 19 nt, Homo sapiens
gggaggcccugaugcugaa

SEQ ID NO: 447695 - RNA, 19 nt, Homo sapiens
ccaauaaauccuuguggaa

SEQ ID NO: 447696 - RNA, 19 nt, Homo sapiens
ccaagaguccagcuuaaug

SEQ ID NO: 447697 - RNA, 19 nt, Homo sapiens
ggacaucgucacuuacauc

SEQ ID NO: 447698 - RNA, 19 nt, Homo sapiens
aauaaauccuuguggaauc

SEQ ID NO: 447699 - RNA, 19 nt, Homo sapiens
caauaaauccuuguggaau

SEQ ID NO: 447700 - RNA, 19 nt, Homo sapiens
gaggagaggaacaggaaga

SEQ ID NO: 447701 - RNA, 19 nt, Homo sapiens
gugccaagaguccagcuua

SEQ ID NO: 447702 - RNA, 19 nt, Homo sapiens
gcugaagcaucugcaggaa

SEQ ID NO: 447703 - RNA, 19 nt, Homo sapiens
uagguccggugccaauaaa

SEQ ID NO: 447704 - RNA, 19 nt, Homo sapiens
gaggacaucgucacuuaca

SEQ ID NO: 447705 - RNA, 19 nt, Homo sapiens
ggaggaagaggaggaggaa

SEQ ID NO: 447706 - RNA, 19 nt, Homo sapiens
ccggaacuguugagggaaa

SEQ ID NO: 447707 - RNA, 19 nt, Homo sapiens
ugccaagaguccagcuuaa

SEQ ID NO: 447708 - RNA, 19 nt, Homo sapiens
gaacaggaagagagaagcu

SEQ ID NO: 447709 - RNA, 19 nt, Homo sapiens
ccggcacuccuccuuguua

SEQ ID NO: 447710 - RNA, 19 nt, Homo sapiens
ccaacggaccggacagaga

SEQ ID NO: 447711 - RNA, 19 nt, Homo sapiens
guggcacgcucgagaacug

SEQ ID NO: 447712 - RNA, 19 nt, Homo sapiens
cuagguccggugccaauaa

SEQ ID NO: 447713 - RNA, 19 nt, Homo sapiens
gccagcggcgucucuacua

SEQ ID NO: 447714 - RNA, 19 nt, Homo sapiens
ggagaggaacaggaagaga

SEQ ID NO: 447715 - RNA, 19 nt, Homo sapiens
ugagaauccugccggaacu

SEQ ID NO: 447716 - RNA, 19 nt, Homo sapiens
ggaagaggaggaggaagca

SEQ ID NO: 447717 - RNA, 19 nt, Homo sapiens
caagaguccagcuuaaugc

SEQ ID NO: 447718 - RNA, 19 nt, Homo sapiens
gaaaagaggacugggagau

SEQ ID NO: 447719 - RNA, 19 nt, Homo sapiens
cuacuacgucugcgaguuc

SEQ ID NO: 447720 - RNA, 19 nt, Homo sapiens
gccaagaguccagcuuaau

SEQ ID NO: 447721 - RNA, 19 nt, Homo sapiens
acagagacgaggagaggaa

SEQ ID NO: 447722 - RNA, 19 nt, Homo sapiens
gcuagguccggugccaaua

SEQ ID NO: 447723 - RNA, 19 nt, Homo sapiens
ccuccuuguuagugucuuu

SEQ ID NO: 447724 - RNA, 19 nt, Homo sapiens
auaaauccuuguggaaucu

SEQ ID NO: 447725 - RNA, 19 nt, Homo sapiens
gguccggugccaauaaauc

SEQ ID NO: 447726 - RNA, 19 nt, Homo sapiens
gaauccugccggaacuguu

SEQ ID NO: 447727 - RNA, 19 nt, Homo sapiens
gaaagagaauagccauaua

SEQ ID NO: 447728 - RNA, 19 nt, Homo sapiens
ggacaaaucauaagcgaua

SEQ ID NO: 447729 - RNA, 19 nt, Homo sapiens
aagaauagcuucaucaaug

SEQ ID NO: 447730 - RNA, 19 nt, Homo sapiens
gaagauacgucuguccaaa

SEQ ID NO: 447731 - RNA, 19 nt, Homo sapiens
gcagugguccuauuucuaa

SEQ ID NO: 447732 - RNA, 19 nt, Homo sapiens
gaacggcugugaagcuaug

SEQ ID NO: 447733 - RNA, 19 nt, Homo sapiens
auuaguaccucucaacuua

SEQ ID NO: 447734 - RNA, 19 nt, Homo sapiens
aaacagauccucuugcauu

SEQ ID NO: 447735 - RNA, 19 nt, Homo sapiens
gcuauuugcuguaauguca

SEQ ID NO: 447736 - RNA, 19 nt, Homo sapiens
uaugugcucuuaacaguuu

SEQ ID NO: 447737 - RNA, 19 nt, Homo sapiens
gcuaagagagguauuauca

SEQ ID NO: 447738 - RNA, 19 nt, Homo sapiens
gaagcuaugcuacuacauu

SEQ ID NO: 447739 - RNA, 19 nt, Homo sapiens
ggaagcagugguccuauuu

SEQ ID NO: 447740 - RNA, 19 nt, Homo sapiens
ggaccuauaacuacacuuu

SEQ ID NO: 447741 - RNA, 19 nt, Homo sapiens
ugacaacuccuaugauuga

SEQ ID NO: 447742 - RNA, 19 nt, Homo sapiens
guccucagguguuuacaua

SEQ ID NO: 447743 - RNA, 19 nt, Homo sapiens
ggacaagaaacaaucugua

SEQ ID NO: 447744 - RNA, 19 nt, Homo sapiens
uuaaagguguacccauaua

SEQ ID NO: 447745 - RNA, 19 nt, Homo sapiens
agacaugaaugcaacuauu

SEQ ID NO: 447746 - RNA, 19 nt, Homo sapiens
uaggaugagccauauauua

SEQ ID NO: 447747 - RNA, 19 nt, Homo sapiens
ccacaacacuuacucaacu

SEQ ID NO: 447748 - RNA, 19 nt, Homo sapiens
guagaaaguaucucucaaa

SEQ ID NO: 447749 - RNA, 19 nt, Homo sapiens
guuacaaggucaccaguug

SEQ ID NO: 447750 - RNA, 19 nt, Homo sapiens
gaugagccauauauuagug

SEQ ID NO: 447751 - RNA, 19 nt, Homo sapiens
uaggauagauagaaugguu

SEQ ID NO: 447752 - RNA, 19 nt, Homo sapiens
cgagaucccuguggacaaa

SEQ ID NO: 447753 - RNA, 19 nt, Homo sapiens
gaaggaagcaucacuaagc

SEQ ID NO: 447754 - RNA, 19 nt, Homo sapiens
cauuuaaacugcuagauag

SEQ ID NO: 447755 - RNA, 19 nt, Homo sapiens
ccauuuaaacugcuagaua

SEQ ID NO: 447756 - RNA, 19 nt, Homo sapiens
gggaacggcugugaagcua

SEQ ID NO: 447757 - RNA, 19 nt, Homo sapiens
gcagcaccaccuucaguua

SEQ ID NO: 447758 - RNA, 19 nt, Homo sapiens
ugucaaggcgugagaauaa

SEQ ID NO: 447759 - RNA, 19 nt, Homo sapiens
guagauugguuuccauaca

SEQ ID NO: 447760 - RNA, 19 nt, Homo sapiens
gauaagaagauugauguga

SEQ ID NO: 447761 - RNA, 19 nt, Homo sapiens
gacaugaaugcaacuauuu

SEQ ID NO: 447762 - RNA, 19 nt, Homo sapiens
ggucuucuuucaaauuguu

SEQ ID NO: 447763 - RNA, 19 nt, Homo sapiens
caaggaaaaugcuuugaaa

SEQ ID NO: 447764 - RNA, 19 nt, Homo sapiens
aacagauccucuugcauua

SEQ ID NO: 447765 - RNA, 19 nt, Homo sapiens
ugaagacaguugaugaugu

SEQ ID NO: 447766 - RNA, 19 nt, Homo sapiens
uaaacuuggucuucuuuca

SEQ ID NO: 447767 - RNA, 19 nt, Homo sapiens
gagguaggaugagccauau

SEQ ID NO: 447768 - RNA, 19 nt, Homo sapiens
auacgucuguccaaacuuu

SEQ ID NO: 447769 - RNA, 19 nt, Homo sapiens
gcaguauucuacaaguuuc

SEQ ID NO: 447770 - RNA, 19 nt, Homo sapiens
ccauauauaucucuuucug

SEQ ID NO: 447771 - RNA, 19 nt, Homo sapiens
gaaguucuccguccuaugc

SEQ ID NO: 447772 - RNA, 19 nt, Homo sapiens
aaccgaauauuguaucuga

SEQ ID NO: 447773 - RNA, 19 nt, Homo sapiens
ggaaggcucugcuccuacu

SEQ ID NO: 447774 - RNA, 19 nt, Homo sapiens
caacguaugguucuucuuc

SEQ ID NO: 447775 - RNA, 19 nt, Homo sapiens
ucuccuacccugaaaguua

SEQ ID NO: 447776 - RNA, 19 nt, Homo sapiens
gcaagggugguuuggauga

SEQ ID NO: 447777 - RNA, 19 nt, Homo sapiens
aaagguguacccauauaua

SEQ ID NO: 447778 - RNA, 19 nt, Homo sapiens
cgagugacguguugcugaa

SEQ ID NO: 447779 - RNA, 19 nt, Homo sapiens
cagauccucuugcauuaug

SEQ ID NO: 447780 - RNA, 19 nt, Homo sapiens
acaaacagauccucuugca

SEQ ID NO: 447781 - RNA, 19 nt, Homo sapiens
gaugcaagaauguaccuuu

SEQ ID NO: 447782 - RNA, 19 nt, Homo sapiens
uggauuauuugccaucauu

SEQ ID NO: 447783 - RNA, 19 nt, Homo sapiens
gguaggaugagccauauau

SEQ ID NO: 447784 - RNA, 19 nt, Homo sapiens
ucugacgcauccuguaaua

SEQ ID NO: 447785 - RNA, 19 nt, Homo sapiens
agaauagcuucaucaaugu

SEQ ID NO: 447786 - RNA, 19 nt, Homo sapiens
uugcaucucucuaugaaga

SEQ ID NO: 447787 - RNA, 19 nt, Homo sapiens
ugucugauguugcaguauu

SEQ ID NO: 447788 - RNA, 19 nt, Homo sapiens
gaggaaggaagcaucacua

SEQ ID NO: 447789 - RNA, 19 nt, Homo sapiens
cauuagcuauuugcuguaa

SEQ ID NO: 447790 - RNA, 19 nt, Homo sapiens
ucagaagccaugaaauuga

SEQ ID NO: 447791 - RNA, 19 nt, Homo sapiens
aaacaaacagauccucuug

SEQ ID NO: 447792 - RNA, 19 nt, Homo sapiens
cagaagagaauuuaaaggu

SEQ ID NO: 447793 - RNA, 19 nt, Homo sapiens
aagcuaugcuacuacauug

SEQ ID NO: 447794 - RNA, 19 nt, Homo sapiens
gaaaaugacgguuacauag

SEQ ID NO: 447795 - RNA, 19 nt, Homo sapiens
gaagauugaugugauucgu

SEQ ID NO: 447796 - RNA, 19 nt, Homo sapiens
gacaagaaacaaucuguag

SEQ ID NO: 447797 - RNA, 19 nt, Homo sapiens
gaaguauucacacaaucuu

SEQ ID NO: 447798 - RNA, 19 nt, Homo sapiens
auuuaaagguguacccaua

SEQ ID NO: 447799 - RNA, 19 nt, Homo sapiens
ccucagaagagaauuuaaa

SEQ ID NO: 447800 - RNA, 19 nt, Homo sapiens
cuacauugaccgacuuaaa

SEQ ID NO: 447801 - RNA, 19 nt, Homo sapiens
guaccucucaacuuacuuu

SEQ ID NO: 447802 - RNA, 19 nt, Homo sapiens
cuuauucauugccagguua

SEQ ID NO: 447803 - RNA, 19 nt, Homo sapiens
guuugcaucucucuaugaa

SEQ ID NO: 447804 - RNA, 19 nt, Homo sapiens
gcaccaaugccuucuuagu

SEQ ID NO: 447805 - RNA, 19 nt, Homo sapiens
ggaaccgaauauuguaucu

SEQ ID NO: 447806 - RNA, 19 nt, Homo sapiens
aaaccuggauaagaagauu

SEQ ID NO: 447807 - RNA, 19 nt, Homo sapiens
gggaaguucuccguccuau

SEQ ID NO: 447808 - RNA, 19 nt, Homo sapiens
agaaagagaauagccauau

SEQ ID NO: 447809 - RNA, 19 nt, Homo sapiens
gaauagcuucaucaauguu

SEQ ID NO: 447810 - RNA, 19 nt, Homo sapiens
gcuaaguuuggaccuauaa

SEQ ID NO: 447811 - RNA, 19 nt, Homo sapiens
caagggugguuuggaugaa

SEQ ID NO: 447812 - RNA, 19 nt, Homo sapiens
ccgcaagggugguuuggau

SEQ ID NO: 447813 - RNA, 19 nt, Homo sapiens
ggauagauagaaugguuau

SEQ ID NO: 447814 - RNA, 19 nt, Homo sapiens
aguccagucuacuucuuua

SEQ ID NO: 447815 - RNA, 19 nt, Homo sapiens
cgggaaggcucugcuccua

SEQ ID NO: 447816 - RNA, 19 nt, Homo sapiens
uauauaugaugcucugcaa

SEQ ID NO: 447817 - RNA, 19 nt, Homo sapiens
ggauuauuugccaucauua

SEQ ID NO: 447818 - RNA, 19 nt, Homo sapiens
gugaagcuaugcuacuaca

SEQ ID NO: 447819 - RNA, 19 nt, Homo sapiens
uggaagcagugguccuauu

SEQ ID NO: 447820 - RNA, 19 nt, Homo sapiens
aaaugacgguuacauagag

SEQ ID NO: 447821 - RNA, 19 nt, Homo sapiens
ggucaccaguugaaaauga

SEQ ID NO: 447822 - RNA, 19 nt, Homo sapiens
gcaccaccuucaguuacaa

SEQ ID NO: 447823 - RNA, 19 nt, Homo sapiens
ucucugagcauaauuguca

SEQ ID NO: 447824 - RNA, 19 nt, Homo sapiens
gcuaugagaauuggugcua

SEQ ID NO: 447825 - RNA, 19 nt, Homo sapiens
agagguaggaugagccaua

SEQ ID NO: 447826 - RNA, 19 nt, Homo sapiens
ggcuaaguuuggaccuaua

SEQ ID NO: 447827 - RNA, 19 nt, Homo sapiens
gaacauaacugguuugaga

SEQ ID NO: 447828 - RNA, 19 nt, Homo sapiens
gaaagaaccuuccauuuau

SEQ ID NO: 447829 - RNA, 19 nt, Homo sapiens
ggaaguaucugcugucauu

SEQ ID NO: 447830 - RNA, 19 nt, Homo sapiens
gaagaaagccuguacaugu

SEQ ID NO: 447831 - RNA, 19 nt, Homo sapiens
gggcuaaucuucuuauaaa

SEQ ID NO: 447832 - RNA, 19 nt, Homo sapiens
gaacccaucuguuggaauu

SEQ ID NO: 447833 - RNA, 19 nt, Homo sapiens
guacaaagauucaaguguu

SEQ ID NO: 447834 - RNA, 19 nt, Homo sapiens
gcacuacuauguggaaaua

SEQ ID NO: 447835 - RNA, 19 nt, Homo sapiens
gaaagacgauuaagacgau

SEQ ID NO: 447836 - RNA, 19 nt, Homo sapiens
ggaagaagcagaacagaaa

SEQ ID NO: 447837 - RNA, 19 nt, Homo sapiens
gcaauuccauccaucauga

SEQ ID NO: 447838 - RNA, 19 nt, Homo sapiens
ggaauaugcugacaagguu

SEQ ID NO: 447839 - RNA, 19 nt, Homo sapiens
gcacaugaaugacuucuuc

SEQ ID NO: 447840 - RNA, 19 nt, Homo sapiens
gauggaugcucuacgaaua

SEQ ID NO: 447841 - RNA, 19 nt, Homo sapiens
gcaugcagcucuuugguaa

SEQ ID NO: 447842 - RNA, 19 nt, Homo sapiens
caagaaggcuggaauaucu

SEQ ID NO: 447843 - RNA, 19 nt, Homo sapiens
gcaaagagaaacugaauga

SEQ ID NO: 447844 - RNA, 19 nt, Homo sapiens
cagaagaacagaagaaaua

SEQ ID NO: 447845 - RNA, 19 nt, Homo sapiens
gaaauuaaaccacuugaug

SEQ ID NO: 447846 - RNA, 19 nt, Homo sapiens
gaacaaccacugaaacuga

SEQ ID NO: 447847 - RNA, 19 nt, Homo sapiens
ugaagaagcucucagaugu

SEQ ID NO: 447848 - RNA, 19 nt, Homo sapiens
ggaaacagaugaccagagu

SEQ ID NO: 447849 - RNA, 19 nt, Homo sapiens
ccauggauccuuacuauua

SEQ ID NO: 447850 - RNA, 19 nt, Homo sapiens
ggaggaacauaguauagaa

SEQ ID NO: 447851 - RNA, 19 nt, Homo sapiens
gccaaucacuacuacuuua

SEQ ID NO: 447852 - RNA, 19 nt, Homo sapiens
gcacgcugcucuuugcuuu

SEQ ID NO: 447853 - RNA, 19 nt, Homo sapiens
uuaagacgauguuggaaua

SEQ ID NO: 447854 - RNA, 19 nt, Homo sapiens
gaagacgauuucagucauu

SEQ ID NO: 447855 - RNA, 19 nt, Homo sapiens
gcacaaaggaguagcuuau

SEQ ID NO: 447856 - RNA, 19 nt, Homo sapiens
gaagaaaucggaggaagaa

SEQ ID NO: 447857 - RNA, 19 nt, Homo sapiens
aagaaagccuguacaugua

SEQ ID NO: 447858 - RNA, 19 nt, Homo sapiens
aggaguagcuuaugugaaa

SEQ ID NO: 447859 - RNA, 19 nt, Homo sapiens
ugacggaccauuucaauaa

SEQ ID NO: 447860 - RNA, 19 nt, Homo sapiens
caaaggaugugggaucuga

SEQ ID NO: 447861 - RNA, 19 nt, Homo sapiens
gaugacauguucaacuuug

SEQ ID NO: 447862 - RNA, 19 nt, Homo sapiens
gaucagcgaaagacgauua

SEQ ID NO: 447863 - RNA, 19 nt, Homo sapiens
gaucuugacuaucuuaaag

SEQ ID NO: 447864 - RNA, 19 nt, Homo sapiens
gcauauggcuaucaaacau

SEQ ID NO: 447865 - RNA, 19 nt, Homo sapiens
gguaaaagcuacaaagauu

SEQ ID NO: 447866 - RNA, 19 nt, Homo sapiens
ggacaaagaauguagauac

SEQ ID NO: 447867 - RNA, 19 nt, Homo sapiens
ccacugucuugauaucuua

SEQ ID NO: 447868 - RNA, 19 nt, Homo sapiens
ggaagaaagcaaagagaaa

SEQ ID NO: 447869 - RNA, 19 nt, Homo sapiens
guagaaaucccaauuaugg

SEQ ID NO: 447870 - RNA, 19 nt, Homo sapiens
gcaagaaggcaaagaugaa

SEQ ID NO: 447871 - RNA, 19 nt, Homo sapiens
ggacaucggcgcaccugua

SEQ ID NO: 447872 - RNA, 19 nt, Homo sapiens
caccaucuguauugucuua

SEQ ID NO: 447873 - RNA, 19 nt, Homo sapiens
gcaauggugugguuuccuu

SEQ ID NO: 447874 - RNA, 19 nt, Homo sapiens
gcaacugccucagaacauu

SEQ ID NO: 447875 - RNA, 19 nt, Homo sapiens
gaagaagcucucagaugua

SEQ ID NO: 447876 - RNA, 19 nt, Homo sapiens
gaauaugugacuaccauuu

SEQ ID NO: 447877 - RNA, 19 nt, Homo sapiens
gcaguugauuccagaaaug

SEQ ID NO: 447878 - RNA, 19 nt, Homo sapiens
cagcaaaugccuuggguua

SEQ ID NO: 447879 - RNA, 19 nt, Homo sapiens
uuugagaccuucauuguuu

SEQ ID NO: 447880 - RNA, 19 nt, Homo sapiens
ggaauaucuuugacgguuu

SEQ ID NO: 447881 - RNA, 19 nt, Homo sapiens
ccguagagauuccuuguuu

SEQ ID NO: 447882 - RNA, 19 nt, Homo sapiens
ugugaaagcugguagaaau

SEQ ID NO: 447883 - RNA, 19 nt, Homo sapiens
ugaaagugauuacauguca

SEQ ID NO: 447884 - RNA, 19 nt, Homo sapiens
ugaauaaucuccaaauugc

SEQ ID NO: 447885 - RNA, 19 nt, Homo sapiens
guaaugauccugacugugu

SEQ ID NO: 447886 - RNA, 19 nt, Homo sapiens
aaacugaucugaccauguc

SEQ ID NO: 447887 - RNA, 19 nt, Homo sapiens
gaaagaugaggaugaauuc

SEQ ID NO: 447888 - RNA, 19 nt, Homo sapiens
ucgaagacgugaauaauca

SEQ ID NO: 447889 - RNA, 19 nt, Homo sapiens
ugaaugugcuucugguuug

SEQ ID NO: 447890 - RNA, 19 nt, Homo sapiens
gaacuuggagccaucaaau

SEQ ID NO: 447891 - RNA, 19 nt, Homo sapiens
gcccaaagccaaauaguga

SEQ ID NO: 447892 - RNA, 19 nt, Homo sapiens
cuucugagcucauuuagug

SEQ ID NO: 447893 - RNA, 19 nt, Homo sapiens
ggacuguucuccauauugg

SEQ ID NO: 447894 - RNA, 19 nt, Homo sapiens
caucauauccuuccugguu

SEQ ID NO: 447895 - RNA, 19 nt, Homo sapiens
gacauaagcaucaugauuc

SEQ ID NO: 447896 - RNA, 19 nt, Homo sapiens
aaacauauuucaccaaugc

SEQ ID NO: 447897 - RNA, 19 nt, Homo sapiens
gcucuggcauuugaagaua

SEQ ID NO: 447898 - RNA, 19 nt, Homo sapiens
ucaaaucaauguggaagaa

SEQ ID NO: 447899 - RNA, 19 nt, Homo sapiens
ugaaggcuguguacaaaga

SEQ ID NO: 447900 - RNA, 19 nt, Homo sapiens
ugggaaagaucuugacuau

SEQ ID NO: 447901 - RNA, 19 nt, Homo sapiens
ggucaagccaugugccuua

SEQ ID NO: 447902 - RNA, 19 nt, Homo sapiens
uggaagaacuugaagaauc

SEQ ID NO: 447903 - RNA, 19 nt, Homo sapiens
ggaaccgauugacauauga

SEQ ID NO: 447904 - RNA, 19 nt, Homo sapiens
gggaaccgauugacauaug

SEQ ID NO: 447905 - RNA, 19 nt, Homo sapiens
gaggaugacuuugagaugu

SEQ ID NO: 447906 - RNA, 19 nt, Homo sapiens
gccuguacauguaucuuua

SEQ ID NO: 447907 - RNA, 19 nt, Homo sapiens
ugucuuauauucuggcuaa

SEQ ID NO: 447908 - RNA, 19 nt, Homo sapiens
uggcuggacuucuuaauug

SEQ ID NO: 447909 - RNA, 19 nt, Homo sapiens
ccacugaugaugauaauga

SEQ ID NO: 447910 - RNA, 19 nt, Homo sapiens
ucaauaaugugcuuacagu

SEQ ID NO: 447911 - RNA, 19 nt, Homo sapiens
gaguauagccagcauucua

SEQ ID NO: 447912 - RNA, 19 nt, Homo sapiens
gcacagcaccuuugaggau

SEQ ID NO: 447913 - RNA, 19 nt, Homo sapiens
caagagugcuaaggaaaga

SEQ ID NO: 447914 - RNA, 19 nt, Homo sapiens
gcagaugauugaacagcuu

SEQ ID NO: 447915 - RNA, 19 nt, Homo sapiens
gcucucagauguaaugauc

SEQ ID NO: 447916 - RNA, 19 nt, Homo sapiens
aagaagcucucagauguaa

SEQ ID NO: 447917 - RNA, 19 nt, Homo sapiens
gaagacgugaauaaucaua

SEQ ID NO: 447918 - RNA, 19 nt, Homo sapiens
gaaacugaaaugagaaaga

SEQ ID NO: 447919 - RNA, 19 nt, Homo sapiens
acagaaagaggccgaauuu

SEQ ID NO: 447920 - RNA, 19 nt, Homo sapiens
cggauccacugucuugaua

SEQ ID NO: 447921 - RNA, 19 nt, Homo sapiens
gaacuucaguguugcuacu

SEQ ID NO: 447922 - RNA, 19 nt, Homo sapiens
uauaauguaugcagcaguu

SEQ ID NO: 447923 - RNA, 19 nt, Homo sapiens
gcaaaugccuuggguuacu

SEQ ID NO: 447924 - RNA, 19 nt, Homo sapiens
gaaagcaaagagaaacuga

SEQ ID NO: 447925 - RNA, 19 nt, Homo sapiens
ggaagaacuugaagaaucc

SEQ ID NO: 447926 - RNA, 19 nt, Homo sapiens
uaacaaauacaguggaaga

SEQ ID NO: 447927 - RNA, 19 nt, Homo sapiens
gaagggcacugaggaguuu

SEQ ID NO: 447928 - RNA, 19 nt, Homo sapiens
ccaaagaccugcaggaucu

SEQ ID NO: 447929 - RNA, 19 nt, Homo sapiens
caugauggguaaagcaaua

SEQ ID NO: 447930 - RNA, 19 nt, Homo sapiens
ugucugagaucaugaugua

SEQ ID NO: 447931 - RNA, 19 nt, Homo sapiens
gaagauccacauugaggua

SEQ ID NO: 447932 - RNA, 19 nt, Homo sapiens
gaacuguggccaccuagaa

SEQ ID NO: 447933 - RNA, 19 nt, Homo sapiens
caucaccucugaaagcaaa

SEQ ID NO: 447934 - RNA, 19 nt, Homo sapiens
uggcagagaugauuuacug

SEQ ID NO: 447935 - RNA, 19 nt, Homo sapiens
cagagaugauuuacugcua

SEQ ID NO: 447936 - RNA, 19 nt, Homo sapiens
gggaugaccuucaaaauuc

SEQ ID NO: 447937 - RNA, 19 nt, Homo sapiens
ucaccaaugucaccuacaa

SEQ ID NO: 447938 - RNA, 19 nt, Homo sapiens
gaaguaguuuuguucauga

SEQ ID NO: 447939 - RNA, 19 nt, Homo sapiens
gcacugaggaguuugucaa

SEQ ID NO: 447940 - RNA, 19 nt, Homo sapiens
ucaagauccugcgcuauga

SEQ ID NO: 447941 - RNA, 19 nt, Homo sapiens
uggcauccaucgugucuga

SEQ ID NO: 447942 - RNA, 19 nt, Homo sapiens
gagaugauuuacugcuaca

SEQ ID NO: 447943 - RNA, 19 nt, Homo sapiens
ugauguaugugcucauugu

SEQ ID NO: 447944 - RNA, 19 nt, Homo sapiens
caucgugucugagaucaug

SEQ ID NO: 447945 - RNA, 19 nt, Homo sapiens
cauucagccucgucucuuu

SEQ ID NO: 447946 - RNA, 19 nt, Homo sapiens
gcguccagguggccgaaua

SEQ ID NO: 447947 - RNA, 19 nt, Homo sapiens
caggaucugucuaucuuca

SEQ ID NO: 447948 - RNA, 19 nt, Homo sapiens
ggaucugucuaucuucauc

SEQ ID NO: 447949 - RNA, 19 nt, Homo sapiens
gcuaugagaaugagguguu

SEQ ID NO: 447950 - RNA, 19 nt, Homo sapiens
ccucgucucuuuacagaag

SEQ ID NO: 447951 - RNA, 19 nt, Homo sapiens
ggagaaugccucggaauac

SEQ ID NO: 447952 - RNA, 19 nt, Homo sapiens
acaccagcgucgucaagaa

SEQ ID NO: 447953 - RNA, 19 nt, Homo sapiens
cgccugcucuucuucgaaa

SEQ ID NO: 447954 - RNA, 19 nt, Homo sapiens
ugcaggaucugucuaucuu

SEQ ID NO: 447955 - RNA, 19 nt, Homo sapiens
ggagaccgaggccguguau

SEQ ID NO: 447956 - RNA, 19 nt, Homo sapiens
uguaugggaugaccuucaa

SEQ ID NO: 447957 - RNA, 19 nt, Homo sapiens
cugaggaguuugucaagau

SEQ ID NO: 447958 - RNA, 19 nt, Homo sapiens
gcucguggcagagaugauu

SEQ ID NO: 447959 - RNA, 19 nt, Homo sapiens
aggagaaugccucggaaua

SEQ ID NO: 447960 - RNA, 19 nt, Homo sapiens
gucaagaagauccacauug

SEQ ID NO: 447961 - RNA, 19 nt, Homo sapiens
gucaagauccugcgcuaug

SEQ ID NO: 447962 - RNA, 19 nt, Homo sapiens
augaugggcuggagcaguu

SEQ ID NO: 447963 - RNA, 19 nt, Homo sapiens
acauugagguaguggacaa

SEQ ID NO: 447964 - RNA, 19 nt, Homo sapiens
cggaauaccuggccaucac

SEQ ID NO: 447965 - RNA, 19 nt, Homo sapiens
gagaaugccucggaauacc

SEQ ID NO: 447966 - RNA, 19 nt, Homo sapiens
gcacacauuggccgcuuca

SEQ ID NO: 447967 - RNA, 19 nt, Homo sapiens
gccaucaccucugaaagca

SEQ ID NO: 447968 - RNA, 19 nt, Homo sapiens
cuugaacuguggccaccua

SEQ ID NO: 447969 - RNA, 19 nt, Homo sapiens
gauccugcgcuaugagaau

SEQ ID NO: 447970 - RNA, 19 nt, Homo sapiens
ugaggaguuugucaagauc

SEQ ID NO: 447971 - RNA, 19 nt, Homo sapiens
gauccacauugagguagug

SEQ ID NO: 447972 - RNA, 19 nt, Homo sapiens
acacauuggccgcuucaga

SEQ ID NO: 447973 - RNA, 19 nt, Homo sapiens
caacaccagcgucgucaag

SEQ ID NO: 447974 - RNA, 19 nt, Homo sapiens
gaugauuuacugcuacaag

SEQ ID NO: 447975 - RNA, 19 nt, Homo sapiens
gcauccaucgugucugaga

SEQ ID NO: 447976 - RNA, 19 nt, Homo sapiens
caaagccaacagagacaug

SEQ ID NO: 447977 - RNA, 19 nt, Homo sapiens
cugagaucaugauguaugu

SEQ ID NO: 447978 - RNA, 19 nt, Homo sapiens
gacaaagccaacagagaca

SEQ ID NO: 447979 - RNA, 19 nt, Homo sapiens
augauuuacugcuacaaga

SEQ ID NO: 447980 - RNA, 19 nt, Homo sapiens
cuaugagaaugagguguug

SEQ ID NO: 447981 - RNA, 19 nt, Homo sapiens
ucugagaucaugauguaug

SEQ ID NO: 447982 - RNA, 19 nt, Homo sapiens
caagaagauccacauugag

SEQ ID NO: 447983 - RNA, 19 nt, Homo sapiens
agaccgaggccguguaugg

SEQ ID NO: 447984 - RNA, 19 nt, Homo sapiens
ugauuuacugcuacaagaa

SEQ ID NO: 447985 - RNA, 19 nt, Homo sapiens
agaagggcacugaggaguu

SEQ ID NO: 447986 - RNA, 19 nt, Homo sapiens
ggccaucaccucugaaagc

SEQ ID NO: 447987 - RNA, 19 nt, Homo sapiens
gauuuacugcuacaagaag

SEQ ID NO: 447988 - RNA, 19 nt, Homo sapiens
caagaaggcuggaauauuu

SEQ ID NO: 447989 - RNA, 19 nt, Homo sapiens
gaaguaggcugacauauga

SEQ ID NO: 447990 - RNA, 19 nt, Homo sapiens
gcagaaagcuuuagaugaa

SEQ ID NO: 447991 - RNA, 19 nt, Homo sapiens
gcaaagaccucaauuaucu

SEQ ID NO: 447992 - RNA, 19 nt, Homo sapiens
gcaaggagcuaaacaguga

SEQ ID NO: 447993 - RNA, 19 nt, Homo sapiens
gaaugugucugcaagauuu

SEQ ID NO: 447994 - RNA, 19 nt, Homo sapiens
caaagaagauacucucauu

SEQ ID NO: 447995 - RNA, 19 nt, Homo sapiens
gaagauacucucauugaua

SEQ ID NO: 447996 - RNA, 19 nt, Homo sapiens
ggagagauguuugauguaa

SEQ ID NO: 447997 - RNA, 19 nt, Homo sapiens
gaauucaacuccagagaaa

SEQ ID NO: 447998 - RNA, 19 nt, Homo sapiens
ggauuaaucugguguuuau

SEQ ID NO: 447999 - RNA, 19 nt, Homo sapiens
gaagacagcauaagaagaa

SEQ ID NO: 448000 - RNA, 19 nt, Homo sapiens
ggacaaagaauguggagua

SEQ ID NO: 448001 - RNA, 19 nt, Homo sapiens
ggaggugucugcuauuauu

SEQ ID NO: 448002 - RNA, 19 nt, Homo sapiens
gaacacccaucaaagaaga

SEQ ID NO: 448003 - RNA, 19 nt, Homo sapiens
gcaugcagcucuuugguaa

SEQ ID NO: 448004 - RNA, 19 nt, Homo sapiens
cagaagaacagaagaaaua

SEQ ID NO: 448005 - RNA, 19 nt, Homo sapiens
gaguauaccuuuacaggaa

SEQ ID NO: 448006 - RNA, 19 nt, Homo sapiens
aaacugaucucucuucguu

SEQ ID NO: 448007 - RNA, 19 nt, Homo sapiens
gggaaacucugguggaauu

SEQ ID NO: 448008 - RNA, 19 nt, Homo sapiens
ggaagaggcugaacagaag

SEQ ID NO: 448009 - RNA, 19 nt, Homo sapiens
gaggaggugucugcuauua

SEQ ID NO: 448010 - RNA, 19 nt, Homo sapiens
gcaauggccuccagauaau

SEQ ID NO: 448011 - RNA, 19 nt, Homo sapiens
caaagaauguggaguauac

SEQ ID NO: 448012 - RNA, 19 nt, Homo sapiens
gaagacaaagggaaagaua

SEQ ID NO: 448013 - RNA, 19 nt, Homo sapiens
guugaugucucacugguua

SEQ ID NO: 448014 - RNA, 19 nt, Homo sapiens
gcacgcugcucuuugcuuu

SEQ ID NO: 448015 - RNA, 19 nt, Homo sapiens
guucaaguguugucagaua

SEQ ID NO: 448016 - RNA, 19 nt, Homo sapiens
gcaaagagcaaugaguaua

SEQ ID NO: 448017 - RNA, 19 nt, Homo sapiens
caaagaaugugauggaaca

SEQ ID NO: 448018 - RNA, 19 nt, Homo sapiens
gaagacaaccuguacaugu

SEQ ID NO: 448019 - RNA, 19 nt, Homo sapiens
ggaaguaggcugacauaug

SEQ ID NO: 448020 - RNA, 19 nt, Homo sapiens
ggaugaaagugauuacaug

SEQ ID NO: 448021 - RNA, 19 nt, Homo sapiens
gagaaugacuuugcugaug

SEQ ID NO: 448022 - RNA, 19 nt, Homo sapiens
ggaaagauaucagggaaag

SEQ ID NO: 448023 - RNA, 19 nt, Homo sapiens
gagaacagccugagguuga

SEQ ID NO: 448024 - RNA, 19 nt, Homo sapiens
caaaggacauuggcucuga

SEQ ID NO: 448025 - RNA, 19 nt, Homo sapiens
ggacagugagcauauuuaa

SEQ ID NO: 448026 - RNA, 19 nt, Homo sapiens
gaugacauguucaacuuug

SEQ ID NO: 448027 - RNA, 19 nt, Homo sapiens
gcucuggccuuugaagaua

SEQ ID NO: 448028 - RNA, 19 nt, Homo sapiens
ugacaaacauucuguacug

SEQ ID NO: 448029 - RNA, 19 nt, Homo sapiens
uaaaguggguugcauaugg

SEQ ID NO: 448030 - RNA, 19 nt, Homo sapiens
guacggaaguucaaguguu

SEQ ID NO: 448031 - RNA, 19 nt, Homo sapiens
gaaauuaaaccgcuugaag

SEQ ID NO: 448032 - RNA, 19 nt, Homo sapiens
gaaagaacagucuggagaa

SEQ ID NO: 448033 - RNA, 19 nt, Homo sapiens
ggaaaccgaugaccagagu

SEQ ID NO: 448034 - RNA, 19 nt, Homo sapiens
gauccuacaucaaggcaaa

SEQ ID NO: 448035 - RNA, 19 nt, Homo sapiens
gaaagacaaaggcaaagaa

SEQ ID NO: 448036 - RNA, 19 nt, Homo sapiens
gaagaaauacuacaaugca

SEQ ID NO: 448037 - RNA, 19 nt, Homo sapiens
ggauaucugucucuacuuc

SEQ ID NO: 448038 - RNA, 19 nt, Homo sapiens
gagcacaauugguucgaaa

SEQ ID NO: 448039 - RNA, 19 nt, Homo sapiens
gcacaacuacugaaacaga

SEQ ID NO: 448040 - RNA, 19 nt, Homo sapiens
cagaagaaauacuacaaug

SEQ ID NO: 448041 - RNA, 19 nt, Homo sapiens
guaugcagcuguugauuca

SEQ ID NO: 448042 - RNA, 19 nt, Homo sapiens
ggaaugagggcuguuguaa

SEQ ID NO: 448043 - RNA, 19 nt, Homo sapiens
gaaggcagcacgguugaua

SEQ ID NO: 448044 - RNA, 19 nt, Homo sapiens
gcaaagagaagcuaaaugc

SEQ ID NO: 448045 - RNA, 19 nt, Homo sapiens
ccagauaauucuuccuuug

SEQ ID NO: 448046 - RNA, 19 nt, Homo sapiens
gaagcuuucugaugucaug

SEQ ID NO: 448047 - RNA, 19 nt, Homo sapiens
gcacgauucuuaccaacug

SEQ ID NO: 448048 - RNA, 19 nt, Homo sapiens
ugaaagugauuacauguca

SEQ ID NO: 448049 - RNA, 19 nt, Homo sapiens
caagaaagacaaaggcaaa

SEQ ID NO: 448050 - RNA, 19 nt, Homo sapiens
aaugagggcuguuguaaau

SEQ ID NO: 448051 - RNA, 19 nt, Homo sapiens
caagauaauugccauggau

SEQ ID NO: 448052 - RNA, 19 nt, Homo sapiens
gcaaggaugaggaugauga

SEQ ID NO: 448053 - RNA, 19 nt, Homo sapiens
aagacaaccuguacaugua

SEQ ID NO: 448054 - RNA, 19 nt, Homo sapiens
gaagcuaaaugcaacuagu

SEQ ID NO: 448055 - RNA, 19 nt, Homo sapiens
gaaagagacgguccaguuc

SEQ ID NO: 448056 - RNA, 19 nt, Homo sapiens
gggcacaacuacugaaaca

SEQ ID NO: 448057 - RNA, 19 nt, Homo sapiens
gauggaugcccuucgaaua

SEQ ID NO: 448058 - RNA, 19 nt, Homo sapiens
caucauauccuuccugguu

SEQ ID NO: 448059 - RNA, 19 nt, Homo sapiens
gagaaugugugcugaaacu

SEQ ID NO: 448060 - RNA, 19 nt, Homo sapiens
gaaauacuacaaugcaaug

SEQ ID NO: 448061 - RNA, 19 nt, Homo sapiens
ggauggauauuauguaugc

SEQ ID NO: 448062 - RNA, 19 nt, Homo sapiens
ggccaaaccaugugccuua

SEQ ID NO: 448063 - RNA, 19 nt, Homo sapiens
uggaagaacuugaagaauc

SEQ ID NO: 448064 - RNA, 19 nt, Homo sapiens
ucagagaguucuucaguag

SEQ ID NO: 448065 - RNA, 19 nt, Homo sapiens
ucaauaugcucauuaugug

SEQ ID NO: 448066 - RNA, 19 nt, Homo sapiens
caacaaaguccagcucauu

SEQ ID NO: 448067 - RNA, 19 nt, Homo sapiens
gaggaugacuuugagaugu

SEQ ID NO: 448068 - RNA, 19 nt, Homo sapiens
uggagaaucugacuuugaa

SEQ ID NO: 448069 - RNA, 19 nt, Homo sapiens
agaaugacuuugcugauga

SEQ ID NO: 448070 - RNA, 19 nt, Homo sapiens
gaucuugacuguguucugu

SEQ ID NO: 448071 - RNA, 19 nt, Homo sapiens
uaacguaggacuuggauau

SEQ ID NO: 448072 - RNA, 19 nt, Homo sapiens
agaauaugcugacaagguu

SEQ ID NO: 448073 - RNA, 19 nt, Homo sapiens
gaaaucuagugguucugaa

SEQ ID NO: 448074 - RNA, 19 nt, Homo sapiens
gcuaaacagugauuaaagg

SEQ ID NO: 448075 - RNA, 19 nt, Homo sapiens
gcaaggggcuuuuguuuag

SEQ ID NO: 448076 - RNA, 19 nt, Homo sapiens
gcccaaagccaaacaguga

SEQ ID NO: 448077 - RNA, 19 nt, Homo sapiens
aaagauaucagggaaagua

SEQ ID NO: 448078 - RNA, 19 nt, Homo sapiens
gaacuucaguguugcuacu

SEQ ID NO: 448079 - RNA, 19 nt, Homo sapiens
gcaaaugccuuggguuacu

SEQ ID NO: 448080 - RNA, 19 nt, Homo sapiens
gaaagcaaagagaagcuaa

SEQ ID NO: 448081 - RNA, 19 nt, Homo sapiens
ggaagaacuugaagaaucc

SEQ ID NO: 448082 - RNA, 19 nt, Homo sapiens
gaauguggaguauaccuuu

SEQ ID NO: 448083 - RNA, 19 nt, Homo sapiens
ccuccaaagucucuuauga

SEQ ID NO: 448084 - RNA, 19 nt, Homo sapiens
cuggagaacuucaguguug

SEQ ID NO: 448085 - RNA, 19 nt, Homo sapiens
gcuagcaccuauucuuaau

SEQ ID NO: 448086 - RNA, 19 nt, Homo sapiens
caucauagauaacuucaac

SEQ ID NO: 448087 - RNA, 19 nt, Homo sapiens
uggcuaauauucaguauca

SEQ ID NO: 448088 - RNA, 19 nt, Homo sapiens
ggccaaggcggguggauua

SEQ ID NO: 448089 - RNA, 19 nt, Homo sapiens
gagcauggaggucacagua

SEQ ID NO: 448090 - RNA, 19 nt, Homo sapiens
caacugcucugaggagaug

SEQ ID NO: 448091 - RNA, 19 nt, Homo sapiens
gaagaucauuaaccugaag

SEQ ID NO: 448092 - RNA, 19 nt, Homo sapiens
ggacuuaccaggagugcaa

SEQ ID NO: 448093 - RNA, 19 nt, Homo sapiens
aagcagagguugcagugaa

SEQ ID NO: 448094 - RNA, 19 nt, Homo sapiens
aggcaaagcuggacaugug

SEQ ID NO: 448095 - RNA, 19 nt, Homo sapiens
caacagaggccaguuucaa

SEQ ID NO: 448096 - RNA, 19 nt, Homo sapiens
acaaacaguucucccugaa

SEQ ID NO: 448097 - RNA, 19 nt, Homo sapiens
uaauaucccuuaggacugu

SEQ ID NO: 448098 - RNA, 19 nt, Homo sapiens
gauuaccuccaucuguuua

SEQ ID NO: 448099 - RNA, 19 nt, Homo sapiens
ucaagugugugaggagaaa

SEQ ID NO: 448100 - RNA, 19 nt, Homo sapiens
ggaugauggugccaaguag

SEQ ID NO: 448101 - RNA, 19 nt, Homo sapiens
caaccauuccucccuugua

SEQ ID NO: 448102 - RNA, 19 nt, Homo sapiens
gaaggcaacccggaugaug

SEQ ID NO: 448103 - RNA, 19 nt, Homo sapiens
gaggccaguuucaaaguca

SEQ ID NO: 448104 - RNA, 19 nt, Homo sapiens
ggauuaccuccaucuguuu

SEQ ID NO: 448105 - RNA, 19 nt, Homo sapiens
ccuguaaucccagcuauuu

SEQ ID NO: 448106 - RNA, 19 nt, Homo sapiens
ccagggcacugacggaaag

SEQ ID NO: 448107 - RNA, 19 nt, Homo sapiens
ugaagaucauuaaccugaa

SEQ ID NO: 448108 - RNA, 19 nt, Homo sapiens
uacaacugcuacaucauga

SEQ ID NO: 448109 - RNA, 19 nt, Homo sapiens
cuccaucuguuuaguagaa

SEQ ID NO: 448110 - RNA, 19 nt, Homo sapiens
gcuacacagugaaccacaa

SEQ ID NO: 448111 - RNA, 19 nt, Homo sapiens
cggaugauggugccaagua

SEQ ID NO: 448112 - RNA, 19 nt, Homo sapiens
ugucggugaugcugagaaa

SEQ ID NO: 448113 - RNA, 19 nt, Homo sapiens
gaaccugagcugccaaugc

SEQ ID NO: 448114 - RNA, 19 nt, Homo sapiens
gacgaugaguuccugaaac

SEQ ID NO: 448115 - RNA, 19 nt, Homo sapiens
ucuccgcccuguacaguga

SEQ ID NO: 448116 - RNA, 19 nt, Homo sapiens
ccacccgacuaacaucuca

SEQ ID NO: 448117 - RNA, 19 nt, Homo sapiens
uuacaacugcuacaucaug

SEQ ID NO: 448118 - RNA, 19 nt, Homo sapiens
ggaggcaggaggcacaugu

SEQ ID NO: 448119 - RNA, 19 nt, Homo sapiens
ccuguaaucccagcacuuu

SEQ ID NO: 448120 - RNA, 19 nt, Homo sapiens
gggcaagacggacggugaa

SEQ ID NO: 448121 - RNA, 19 nt, Homo sapiens
cagccugggugacauagag

SEQ ID NO: 448122 - RNA, 19 nt, Homo sapiens
ugacgaugaguuccugaaa

SEQ ID NO: 448123 - RNA, 19 nt, Homo sapiens
agcagaagcugagcacaga

SEQ ID NO: 448124 - RNA, 19 nt, Homo sapiens
caaaaccccaucucuacua

SEQ ID NO: 448125 - RNA, 19 nt, Homo sapiens
aaccauuccucccuuguag

SEQ ID NO: 448126 - RNA, 19 nt, Homo sapiens
gggcaaaaccccaucucua

SEQ ID NO: 448127 - RNA, 19 nt, Homo sapiens
ccauuccucccuuguaguu

SEQ ID NO: 448128 - RNA, 19 nt, Homo sapiens
caccaacagaggccaguuu

SEQ ID NO: 448129 - RNA, 19 nt, Homo sapiens
cuacacagugaaccacaaa

SEQ ID NO: 448130 - RNA, 19 nt, Homo sapiens
ugacauagagagacuccau

SEQ ID NO: 448131 - RNA, 19 nt, Homo sapiens
gaagcagagguugcaguga

SEQ ID NO: 448132 - RNA, 19 nt, Homo sapiens
gcccucguuuccauugcua

SEQ ID NO: 448133 - RNA, 19 nt, Homo sapiens
ugaugguggucaagugugu

SEQ ID NO: 448134 - RNA, 19 nt, Homo sapiens
gggcuucagugagaacucu

SEQ ID NO: 448135 - RNA, 19 nt, Homo sapiens
aacagaggccaguuucaaa

SEQ ID NO: 448136 - RNA, 19 nt, Homo sapiens
gggcuuuccugugcugaca

SEQ ID NO: 448137 - RNA, 19 nt, Homo sapiens
gugaaggcaacccggauga

SEQ ID NO: 448138 - RNA, 19 nt, Homo sapiens
cagugaaccacaaacaguu

SEQ ID NO: 448139 - RNA, 19 nt, Homo sapiens
caaggcggguggauuaccu

SEQ ID NO: 448140 - RNA, 19 nt, Homo sapiens
cagaagcugagcacagaug

SEQ ID NO: 448141 - RNA, 19 nt, Homo sapiens
auuuacaacugcuacauca

SEQ ID NO: 448142 - RNA, 19 nt, Homo sapiens
gauuuacaacugcuacauc

SEQ ID NO: 448143 - RNA, 19 nt, Homo sapiens
caauucagccugggugaca

SEQ ID NO: 448144 - RNA, 19 nt, Homo sapiens
gcaccuucaacuccugcua

SEQ ID NO: 448145 - RNA, 19 nt, Homo sapiens
guugggcccucguuuccau

SEQ ID NO: 448146 - RNA, 19 nt, Homo sapiens
aaaaccccaucucuacuaa

SEQ ID NO: 448147 - RNA, 19 nt, Homo sapiens
acacagugaaccacaaaca

SEQ ID NO: 448148 - RNA, 19 nt, Homo sapiens
caacugcuacaucaugaac

SEQ ID NO: 448149 - RNA, 19 nt, Homo sapiens
gcugaugguggucaagugu

SEQ ID NO: 448150 - RNA, 19 nt, Homo sapiens
acagugaaccacaaacagu

SEQ ID NO: 448151 - RNA, 19 nt, Homo sapiens
gcaaagagcuuaauuaucu

SEQ ID NO: 448152 - RNA, 19 nt, Homo sapiens
gaaagaaccuuccauuuau

SEQ ID NO: 448153 - RNA, 19 nt, Homo sapiens
gcaauuaccuaacaugaua

SEQ ID NO: 448154 - RNA, 19 nt, Homo sapiens
gcaauucccucuaucauga

SEQ ID NO: 448155 - RNA, 19 nt, Homo sapiens
caacaccacuuccuacuuu

SEQ ID NO: 448156 - RNA, 19 nt, Homo sapiens
ggacaaagaauguagagua

SEQ ID NO: 448157 - RNA, 19 nt, Homo sapiens
gcaaagagccgugagcaua

SEQ ID NO: 448158 - RNA, 19 nt, Homo sapiens
ggaagaagcucaggcaguu

SEQ ID NO: 448159 - RNA, 19 nt, Homo sapiens
gguaagagcuacaaagaau

SEQ ID NO: 448160 - RNA, 19 nt, Homo sapiens
gcaagaagcuacacguaau

SEQ ID NO: 448161 - RNA, 19 nt, Homo sapiens
uguaaagucuccucuaaua

SEQ ID NO: 448162 - RNA, 19 nt, Homo sapiens
gagcacaacugguuugaga

SEQ ID NO: 448163 - RNA, 19 nt, Homo sapiens
gcaugcagcucuuugguaa

SEQ ID NO: 448164 - RNA, 19 nt, Homo sapiens
caagaaggcuggaauaucu

SEQ ID NO: 448165 - RNA, 19 nt, Homo sapiens
gaacaaaguggcaaaguug

SEQ ID NO: 448166 - RNA, 19 nt, Homo sapiens
gcacuaaagcuauuacaaa

SEQ ID NO: 448167 - RNA, 19 nt, Homo sapiens
gaacaucuuugacuuugug

SEQ ID NO: 448168 - RNA, 19 nt, Homo sapiens
gcuagaauaugcugacaaa

SEQ ID NO: 448169 - RNA, 19 nt, Homo sapiens
ugaagaaucuagacagaaa

SEQ ID NO: 448170 - RNA, 19 nt, Homo sapiens
gaaaagaggucagagaaaa

SEQ ID NO: 448171 - RNA, 19 nt, Homo sapiens
gcaaauacaugacccuagu

SEQ ID NO: 448172 - RNA, 19 nt, Homo sapiens
ucucuaaacucucugauuu

SEQ ID NO: 448173 - RNA, 19 nt, Homo sapiens
gggaauugauuaugugaaa

SEQ ID NO: 448174 - RNA, 19 nt, Homo sapiens
gaaugugucugcaagauca

SEQ ID NO: 448175 - RNA, 19 nt, Homo sapiens
gcacgcugcucuuugcuuu

SEQ ID NO: 448176 - RNA, 19 nt, Homo sapiens
gaagaaacaguauacaaga

SEQ ID NO: 448177 - RNA, 19 nt, Homo sapiens
gggaagaucugguggaauc

SEQ ID NO: 448178 - RNA, 19 nt, Homo sapiens
ggaagaacuugaagaaucu

SEQ ID NO: 448179 - RNA, 19 nt, Homo sapiens
gaacacagcacauuugaag

SEQ ID NO: 448180 - RNA, 19 nt, Homo sapiens
uggcaaaguugugcaauua

SEQ ID NO: 448181 - RNA, 19 nt, Homo sapiens
gcaauucaguaguguguug

SEQ ID NO: 448182 - RNA, 19 nt, Homo sapiens
caaaggauguuggaucuga

SEQ ID NO: 448183 - RNA, 19 nt, Homo sapiens
ggaaaugcuucucaaaugg

SEQ ID NO: 448184 - RNA, 19 nt, Homo sapiens
gcauuggccuuugaagaua

SEQ ID NO: 448185 - RNA, 19 nt, Homo sapiens
caaaccaugugccuuauug

SEQ ID NO: 448186 - RNA, 19 nt, Homo sapiens
ggaccuggaucccuacuau

SEQ ID NO: 448187 - RNA, 19 nt, Homo sapiens
guucacauguuccaacuuu

SEQ ID NO: 448188 - RNA, 19 nt, Homo sapiens
ugaacaagcugaaacugaa

SEQ ID NO: 448189 - RNA, 19 nt, Homo sapiens
gaucuugccaucacuauuu

SEQ ID NO: 448190 - RNA, 19 nt, Homo sapiens
caucuaaacucaucuucuu

SEQ ID NO: 448191 - RNA, 19 nt, Homo sapiens
guuucuaucugaacaguua

SEQ ID NO: 448192 - RNA, 19 nt, Homo sapiens
aaaggaagcuggaauugau

SEQ ID NO: 448193 - RNA, 19 nt, Homo sapiens
caacuuugccuauguuaaa

SEQ ID NO: 448194 - RNA, 19 nt, Homo sapiens
gcaaccagcucaucugaag

SEQ ID NO: 448195 - RNA, 19 nt, Homo sapiens
ggaacaagauaaugaugau

SEQ ID NO: 448196 - RNA, 19 nt, Homo sapiens
gaugacauguucaacuuug

SEQ ID NO: 448197 - RNA, 19 nt, Homo sapiens
gaagcuacacguaauuaaa

SEQ ID NO: 448198 - RNA, 19 nt, Homo sapiens
acucaaaccuagaucauuu

SEQ ID NO: 448199 - RNA, 19 nt, Homo sapiens
ucaaauggguugcuuaugg

SEQ ID NO: 448200 - RNA, 19 nt, Homo sapiens
gaacagcgaaagacuauca

SEQ ID NO: 448201 - RNA, 19 nt, Homo sapiens
ggagagcgacgcaacagua

SEQ ID NO: 448202 - RNA, 19 nt, Homo sapiens
gggaauugcuauugcuaaa

SEQ ID NO: 448203 - RNA, 19 nt, Homo sapiens
aggauugacuuaccuauaa

SEQ ID NO: 448204 - RNA, 19 nt, Homo sapiens
uuuaaaggcuggauggaua

SEQ ID NO: 448205 - RNA, 19 nt, Homo sapiens
ucaaguaaguacagaagaa

SEQ ID NO: 448206 - RNA, 19 nt, Homo sapiens
guaaaccucuguggucaaa

SEQ ID NO: 448207 - RNA, 19 nt, Homo sapiens
gaagggaccuggagcuuuu

SEQ ID NO: 448208 - RNA, 19 nt, Homo sapiens
gacaacggguaacauguuu

SEQ ID NO: 448209 - RNA, 19 nt, Homo sapiens
gaucguugauguuucuuug

SEQ ID NO: 448210 - RNA, 19 nt, Homo sapiens
gaaccucuuucuggccuua

SEQ ID NO: 448211 - RNA, 19 nt, Homo sapiens
gcaauggugugguuuccuu

SEQ ID NO: 448212 - RNA, 19 nt, Homo sapiens
gaccaacuguguauuuaug

SEQ ID NO: 448213 - RNA, 19 nt, Homo sapiens
caaggaaacacacuggaua

SEQ ID NO: 448214 - RNA, 19 nt, Homo sapiens
gaaacccaauggcuaccua

SEQ ID NO: 448215 - RNA, 19 nt, Homo sapiens
guaugcagcuguugauuca

SEQ ID NO: 448216 - RNA, 19 nt, Homo sapiens
ugacuuugcugaugaugaa

SEQ ID NO: 448217 - RNA, 19 nt, Homo sapiens
ggagagcuguuggaaaguu

SEQ ID NO: 448218 - RNA, 19 nt, Homo sapiens
gaagcuuucugaugugaug

SEQ ID NO: 448219 - RNA, 19 nt, Homo sapiens
ugagauaccugucaaggau

SEQ ID NO: 448220 - RNA, 19 nt, Homo sapiens
ggauuuaugugaggucaaa

SEQ ID NO: 448221 - RNA, 19 nt, Homo sapiens
gauacugccuacugacaaa

SEQ ID NO: 448222 - RNA, 19 nt, Homo sapiens
caagaacccugucucucaa

SEQ ID NO: 448223 - RNA, 19 nt, Homo sapiens
gauccacugucuugauauu

SEQ ID NO: 448224 - RNA, 19 nt, Homo sapiens
gaagaaagcaaagagaaau

SEQ ID NO: 448225 - RNA, 19 nt, Homo sapiens
agagacagcuuucccaaau

SEQ ID NO: 448226 - RNA, 19 nt, Homo sapiens
caaaggugcuaaagaaugg

SEQ ID NO: 448227 - RNA, 19 nt, Homo sapiens
ugaacaaaguggcaaaguu

SEQ ID NO: 448228 - RNA, 19 nt, Homo sapiens
ccaaacaccuuuaguacag

SEQ ID NO: 448229 - RNA, 19 nt, Homo sapiens
caaauggguugcuuaugga

SEQ ID NO: 448230 - RNA, 19 nt, Homo sapiens
cuaauuacuugguggcuaa

SEQ ID NO: 448231 - RNA, 19 nt, Homo sapiens
ggauaguugugcaaaguga

SEQ ID NO: 448232 - RNA, 19 nt, Homo sapiens
gaagcaggguaucaacguu

SEQ ID NO: 448233 - RNA, 19 nt, Homo sapiens
gaagguaaaguauaugugu

SEQ ID NO: 448234 - RNA, 19 nt, Homo sapiens
caacaaaguccagcuuauu

SEQ ID NO: 448235 - RNA, 19 nt, Homo sapiens
caagcaagcucgguggaaa

SEQ ID NO: 448236 - RNA, 19 nt, Homo sapiens
guugauguuucuuugguua

SEQ ID NO: 448237 - RNA, 19 nt, Homo sapiens
gcacaugaacgacuucuuc

SEQ ID NO: 448238 - RNA, 19 nt, Homo sapiens
guaggaaaccuggucuuua

SEQ ID NO: 448239 - RNA, 19 nt, Homo sapiens
gaaaaugacuuugcugaug

SEQ ID NO: 448240 - RNA, 19 nt, Homo sapiens
gaugcuaucuccuaauuac

SEQ ID NO: 448241 - RNA, 19 nt, Homo sapiens
ggucaaacacucaaaccua

SEQ ID NO: 448242 - RNA, 19 nt, Homo sapiens
uagaauaguuguuccacuu

SEQ ID NO: 448243 - RNA, 19 nt, Homo sapiens
ggauugacuuaccuauaaa

SEQ ID NO: 448244 - RNA, 19 nt, Homo sapiens
caaccacuuugaaacguaa

SEQ ID NO: 448245 - RNA, 19 nt, Homo sapiens
gauggaugcccuucgaaua

SEQ ID NO: 448246 - RNA, 19 nt, Homo sapiens
caucauauccuuccugguu

SEQ ID NO: 448247 - RNA, 19 nt, Homo sapiens
gaagcucguuucccucaga

SEQ ID NO: 448248 - RNA, 19 nt, Homo sapiens
ucuguucacuggagaauuu

SEQ ID NO: 448249 - RNA, 19 nt, Homo sapiens
ggauggauauuauguaugc

SEQ ID NO: 448250 - RNA, 19 nt, Homo sapiens
uggaaaugcuucucaaaug

SEQ ID NO: 448251 - RNA, 19 nt, Homo sapiens
gcacaugcaugauuucuuc

SEQ ID NO: 448252 - RNA, 19 nt, Homo sapiens
gagcucagguuagauauuu

SEQ ID NO: 448253 - RNA, 19 nt, Homo sapiens
gaagaugacuuugagaugu

SEQ ID NO: 448254 - RNA, 19 nt, Homo sapiens
ggacuucagugucaucaug

SEQ ID NO: 448255 - RNA, 19 nt, Homo sapiens
gcaagaaccuacccaugau

SEQ ID NO: 448256 - RNA, 19 nt, Homo sapiens
gggcaucgaugauauguuc

SEQ ID NO: 448257 - RNA, 19 nt, Homo sapiens
ggccagaguugucuuuauu

SEQ ID NO: 448258 - RNA, 19 nt, Homo sapiens
agaaauagcuccucaaagc

SEQ ID NO: 448259 - RNA, 19 nt, Homo sapiens
gaaggaaggaugccacuug

SEQ ID NO: 448260 - RNA, 19 nt, Homo sapiens
ggaauaagcagauggagau

SEQ ID NO: 448261 - RNA, 19 nt, Homo sapiens
gaacggaagccacgaagug

SEQ ID NO: 448262 - RNA, 19 nt, Homo sapiens
ccaaagugauccuaagaau

SEQ ID NO: 448263 - RNA, 19 nt, Homo sapiens
ugacagaguuuguggacuu

SEQ ID NO: 448264 - RNA, 19 nt, Homo sapiens
ggagaaagaggaggaguuu

SEQ ID NO: 448265 - RNA, 19 nt, Homo sapiens
ucacagggaucuacaccuu

SEQ ID NO: 448266 - RNA, 19 nt, Homo sapiens
gcuggcacaugcaugauuu

SEQ ID NO: 448267 - RNA, 19 nt, Homo sapiens
ggcaagaaccuacccauga

SEQ ID NO: 448268 - RNA, 19 nt, Homo sapiens
gcacgugucuggguaucuu

SEQ ID NO: 448269 - RNA, 19 nt, Homo sapiens
aaagugauccuaagaaugu

SEQ ID NO: 448270 - RNA, 19 nt, Homo sapiens
cggaggaacagaagaaaua

SEQ ID NO: 448271 - RNA, 19 nt, Homo sapiens
ggaugaggauggcgagaug

SEQ ID NO: 448272 - RNA, 19 nt, Homo sapiens
caccuuaacuucaucaaca

SEQ ID NO: 448273 - RNA, 19 nt, Homo sapiens
gaagaaggacaaucacauc

SEQ ID NO: 448274 - RNA, 19 nt, Homo sapiens
gaguacggcugguguguca

SEQ ID NO: 448275 - RNA, 19 nt, Homo sapiens
ggacccagcccauggcaaa

SEQ ID NO: 448276 - RNA, 19 nt, Homo sapiens
auaagcagauggagauuga

SEQ ID NO: 448277 - RNA, 19 nt, Homo sapiens
ggaccuggaucccuacuac

SEQ ID NO: 448278 - RNA, 19 nt, Homo sapiens
ggaaauggacgcccucaag

SEQ ID NO: 448279 - RNA, 19 nt, Homo sapiens
cuacauguaccucuacuuu

SEQ ID NO: 448280 - RNA, 19 nt, Homo sapiens
guacaagugcgcccacaaa

SEQ ID NO: 448281 - RNA, 19 nt, Homo sapiens
ucagaaguuucgucuaaug

SEQ ID NO: 448282 - RNA, 19 nt, Homo sapiens
gaguggaccugugcuguga

SEQ ID NO: 448283 - RNA, 19 nt, Homo sapiens
gcucaggcgucgcuggauu

SEQ ID NO: 448284 - RNA, 19 nt, Homo sapiens
cuggguaucuuuguauaua

SEQ ID NO: 448285 - RNA, 19 nt, Homo sapiens
ggaugccacuugggaauga

SEQ ID NO: 448286 - RNA, 19 nt, Homo sapiens
aaaugugacugguucagaa

SEQ ID NO: 448287 - RNA, 19 nt, Homo sapiens
ggucagaacauucgaaucu

SEQ ID NO: 448288 - RNA, 19 nt, Homo sapiens
gcuggaacaucuuugacuu

SEQ ID NO: 448289 - RNA, 19 nt, Homo sapiens
ucgaggacaucuacauuga

SEQ ID NO: 448290 - RNA, 19 nt, Homo sapiens
caagugcgcccacaaagug

SEQ ID NO: 448291 - RNA, 19 nt, Homo sapiens
ggaacuggcuggacuucag

SEQ ID NO: 448292 - RNA, 19 nt, Homo sapiens
aggcgucgcuggauuuauu

SEQ ID NO: 448293 - RNA, 19 nt, Homo sapiens
gaucccuacuacagcaaua

SEQ ID NO: 448294 - RNA, 19 nt, Homo sapiens
gaggagggcuuugaaucug

SEQ ID NO: 448295 - RNA, 19 nt, Homo sapiens
gaagcaggcauccuacaug

SEQ ID NO: 448296 - RNA, 19 nt, Homo sapiens
gcaugagggugguggugaa

SEQ ID NO: 448297 - RNA, 19 nt, Homo sapiens
gcucaacacccucuucaug

SEQ ID NO: 448298 - RNA, 19 nt, Homo sapiens
ggcaagaccuacaugaucu

SEQ ID NO: 448299 - RNA, 19 nt, Homo sapiens
gggaccugcugcucaguaa

SEQ ID NO: 448300 - RNA, 19 nt, Homo sapiens
ucgaugauauguucaacuu

SEQ ID NO: 448301 - RNA, 19 nt, Homo sapiens
ugaacaugcucaucaagau

SEQ ID NO: 448302 - RNA, 19 nt, Homo sapiens
uggcguaccugacagaguu

SEQ ID NO: 448303 - RNA, 19 nt, Homo sapiens
acauguaccucuacuuugu

SEQ ID NO: 448304 - RNA, 19 nt, Homo sapiens
cagcaggguuggaauaucu

SEQ ID NO: 448305 - RNA, 19 nt, Homo sapiens
gcagaugcuugagaaguuc

SEQ ID NO: 448306 - RNA, 19 nt, Homo sapiens
guacggcuggugugucaua

SEQ ID NO: 448307 - RNA, 19 nt, Homo sapiens
ggaaugaauuguccuuuuc

SEQ ID NO: 448308 - RNA, 19 nt, Homo sapiens
ugugacugguucagaaaua

SEQ ID NO: 448309 - RNA, 19 nt, Homo sapiens
gaaaugugacugguucaga

SEQ ID NO: 448310 - RNA, 19 nt, Homo sapiens
gguuaugagugcaucaaga

SEQ ID NO: 448311 - RNA, 19 nt, Homo sapiens
ccaacgauaccuuugauug

SEQ ID NO: 448312 - RNA, 19 nt, Homo sapiens
ggacuugggcaacaucuca

SEQ ID NO: 448313 - RNA, 19 nt, Homo sapiens
ccagaguugucuuuauugu

SEQ ID NO: 448314 - RNA, 19 nt, Homo sapiens
ugagggcacugucccgauu

SEQ ID NO: 448315 - RNA, 19 nt, Homo sapiens
acagggaucuacaccuuug

SEQ ID NO: 448316 - RNA, 19 nt, Homo sapiens
gggccagaguugucuuuau

SEQ ID NO: 448317 - RNA, 19 nt, Homo sapiens
guugagcucagguuagaua

SEQ ID NO: 448318 - RNA, 19 nt, Homo sapiens
ucagaaauagcuccucaaa

SEQ ID NO: 448319 - RNA, 19 nt, Homo sapiens
gcagcuauaucaucaucuc

SEQ ID NO: 448320 - RNA, 19 nt, Homo sapiens
uggagaugcugcucaaaug

SEQ ID NO: 448321 - RNA, 19 nt, Homo sapiens
ggucuucaccuacaucuuc

SEQ ID NO: 448322 - RNA, 19 nt, Homo sapiens
gaccuucauugucuucaug

SEQ ID NO: 448323 - RNA, 19 nt, Homo sapiens
gaacaugcucaucaagauc

SEQ ID NO: 448324 - RNA, 19 nt, Homo sapiens
ugacggagcacuuugacaa

SEQ ID NO: 448325 - RNA, 19 nt, Homo sapiens
ugugugcccuggacuguuu

SEQ ID NO: 448326 - RNA, 19 nt, Homo sapiens
caguugagcucagguuaga

SEQ ID NO: 448327 - RNA, 19 nt, Homo sapiens
ggaggagggcuuugaaucu

SEQ ID NO: 448328 - RNA, 19 nt, Homo sapiens
ccaacaagaucaagcucau

SEQ ID NO: 448329 - RNA, 19 nt, Homo sapiens
cagaagaaauacuauaacg

SEQ ID NO: 448330 - RNA, 19 nt, Homo sapiens
aggaggaccugaagaagga

SEQ ID NO: 448331 - RNA, 19 nt, Homo sapiens
ccacaaagugcucauaugg

SEQ ID NO: 448332 - RNA, 19 nt, Homo sapiens
ccucagagaucucccuucu

SEQ ID NO: 448333 - RNA, 19 nt, Homo sapiens
gggaaugaauuguccuuuu

SEQ ID NO: 448334 - RNA, 19 nt, Homo sapiens
caacuuugccuacgucaag

SEQ ID NO: 448335 - RNA, 19 nt, Homo sapiens
gggagugcgugcucaagau

SEQ ID NO: 448336 - RNA, 19 nt, Homo sapiens
ugaacaaccugcagauugc

SEQ ID NO: 448337 - RNA, 19 nt, Homo sapiens
gcaaucuugugguccugaa

SEQ ID NO: 448338 - RNA, 19 nt, Homo sapiens
gcagaggaagaguagauga

SEQ ID NO: 448339 - RNA, 19 nt, Homo sapiens
ggguaucuuuguauauaug

SEQ ID NO: 448340 - RNA, 19 nt, Homo sapiens
ucaagugcgugacuguaug

SEQ ID NO: 448341 - RNA, 19 nt, Homo sapiens
caaagugauccuaagaaug

SEQ ID NO: 448342 - RNA, 19 nt, Homo sapiens
gcaggcauccuacauguac

SEQ ID NO: 448343 - RNA, 19 nt, Homo sapiens
aagaugacuuugagauguu

SEQ ID NO: 448344 - RNA, 19 nt, Homo sapiens
ccaagaauguggaguacac

SEQ ID NO: 448345 - RNA, 19 nt, Homo sapiens
ccaugaagcaggcauccua

SEQ ID NO: 448346 - RNA, 19 nt, Homo sapiens
ucaaccagcagaagaagaa

SEQ ID NO: 448347 - RNA, 19 nt, Homo sapiens
ucauuggcgucaucauuga

SEQ ID NO: 448348 - RNA, 19 nt, Homo sapiens
gcucauccaugcgcuguuc

SEQ ID NO: 448349 - RNA, 19 nt, Homo sapiens
agaccuacaugaucuucuu

SEQ ID NO: 448350 - RNA, 19 nt, Homo sapiens
agauuuaaccugcaaguug

SEQ ID NO: 448351 - RNA, 19 nt, Homo sapiens
gaacaagagugucuaugga

SEQ ID NO: 448352 - RNA, 19 nt, Homo sapiens
gaacuugaccggagaauug

SEQ ID NO: 448353 - RNA, 19 nt, Homo sapiens
gagaugaccuucaagauca

SEQ ID NO: 448354 - RNA, 19 nt, Homo sapiens
ucaccaaacuucauguaua

SEQ ID NO: 448355 - RNA, 19 nt, Homo sapiens
gaagcuggcugaugugaug

SEQ ID NO: 448356 - RNA, 19 nt, Homo sapiens
caacuucgcuuaugucaag

SEQ ID NO: 448357 - RNA, 19 nt, Homo sapiens
caacagggcuggaacaucu

SEQ ID NO: 448358 - RNA, 19 nt, Homo sapiens
ggagacagaugaccaaagu

SEQ ID NO: 448359 - RNA, 19 nt, Homo sapiens
ugaagaagcuggcugaugu

SEQ ID NO: 448360 - RNA, 19 nt, Homo sapiens
caccaaacuucauguauaa

SEQ ID NO: 448361 - RNA, 19 nt, Homo sapiens
ggaacuggcuggacuuuag

SEQ ID NO: 448362 - RNA, 19 nt, Homo sapiens
gaaugggcuuucauaaauu

SEQ ID NO: 448363 - RNA, 19 nt, Homo sapiens
agacacagaugaccaagaa

SEQ ID NO: 448364 - RNA, 19 nt, Homo sapiens
gauggcaaacuuccuauua

SEQ ID NO: 448365 - RNA, 19 nt, Homo sapiens
gauguugucugaacuaauc

SEQ ID NO: 448366 - RNA, 19 nt, Homo sapiens
gagcuagacccaacccuua

SEQ ID NO: 448367 - RNA, 19 nt, Homo sapiens
gagggagacuugccuuuga

SEQ ID NO: 448368 - RNA, 19 nt, Homo sapiens
cggcaccucugauguguua

SEQ ID NO: 448369 - RNA, 19 nt, Homo sapiens
gcaaagaacuaaggauuuu

SEQ ID NO: 448370 - RNA, 19 nt, Homo sapiens
uuucugaucugcuugaaua

SEQ ID NO: 448371 - RNA, 19 nt, Homo sapiens
ggaccaaggugaaagucaa

SEQ ID NO: 448372 - RNA, 19 nt, Homo sapiens
gagcaaagaacuaaggauu

SEQ ID NO: 448373 - RNA, 19 nt, Homo sapiens
cagcagagaugaccuucaa

SEQ ID NO: 448374 - RNA, 19 nt, Homo sapiens
cagaggagcagaagaagua

SEQ ID NO: 448375 - RNA, 19 nt, Homo sapiens
aaacggaugucuucaggaa

SEQ ID NO: 448376 - RNA, 19 nt, Homo sapiens
gaauacaaccucuacaugu

SEQ ID NO: 448377 - RNA, 19 nt, Homo sapiens
aaacugagacuguauaugu

SEQ ID NO: 448378 - RNA, 19 nt, Homo sapiens
gugaagaucucgccgacuu

SEQ ID NO: 448379 - RNA, 19 nt, Homo sapiens
ugacagaucuaguucucuu

SEQ ID NO: 448380 - RNA, 19 nt, Homo sapiens
cagaagaaguacuacaaug

SEQ ID NO: 448381 - RNA, 19 nt, Homo sapiens
ugagagcucugucacgauu

SEQ ID NO: 448382 - RNA, 19 nt, Homo sapiens
uggaaaugcucaagaaaga

SEQ ID NO: 448383 - RNA, 19 nt, Homo sapiens
gagagcggcugugaagauu

SEQ ID NO: 448384 - RNA, 19 nt, Homo sapiens
ugaccaaaguccugagaaa

SEQ ID NO: 448385 - RNA, 19 nt, Homo sapiens
gcacaugauggacuucuuu

SEQ ID NO: 448386 - RNA, 19 nt, Homo sapiens
ucccauaggucuugugaaa

SEQ ID NO: 448387 - RNA, 19 nt, Homo sapiens
ccauggaaaugcucaagaa

SEQ ID NO: 448388 - RNA, 19 nt, Homo sapiens
gaacggcaccucugaugug

SEQ ID NO: 448389 - RNA, 19 nt, Homo sapiens
aaaauuaccugcucaagaa

SEQ ID NO: 448390 - RNA, 19 nt, Homo sapiens
caacaugacaagugaauuc

SEQ ID NO: 448391 - RNA, 19 nt, Homo sapiens
uuccagaacugcacaauga

SEQ ID NO: 448392 - RNA, 19 nt, Homo sapiens
gaacugucacccugaggua

SEQ ID NO: 448393 - RNA, 19 nt, Homo sapiens
ccggaagucuguucucaaa

SEQ ID NO: 448394 - RNA, 19 nt, Homo sapiens
ugaagaagcugggcuccaa

SEQ ID NO: 448395 - RNA, 19 nt, Homo sapiens
gaagcaggaugagaagaug

SEQ ID NO: 448396 - RNA, 19 nt, Homo sapiens
ugacagaggagcagaagaa

SEQ ID NO: 448397 - RNA, 19 nt, Homo sapiens
ggaauacaaccucuacaug

SEQ ID NO: 448398 - RNA, 19 nt, Homo sapiens
caauaaauggcuuacauga

SEQ ID NO: 448399 - RNA, 19 nt, Homo sapiens
gcacuucucaccaaacuuc

SEQ ID NO: 448400 - RNA, 19 nt, Homo sapiens
ggaagucuguucucaaagc

SEQ ID NO: 448401 - RNA, 19 nt, Homo sapiens
ggacaugggcagcaauuca

SEQ ID NO: 448402 - RNA, 19 nt, Homo sapiens
gcagguggcaacauuuaaa

SEQ ID NO: 448403 - RNA, 19 nt, Homo sapiens
gcagagaugaccuucaaga

SEQ ID NO: 448404 - RNA, 19 nt, Homo sapiens
ggaccaaguaugucgagua

SEQ ID NO: 448405 - RNA, 19 nt, Homo sapiens
ccagaggccacucaguuua

SEQ ID NO: 448406 - RNA, 19 nt, Homo sapiens
guacuacaaugccaugaag

SEQ ID NO: 448407 - RNA, 19 nt, Homo sapiens
gagacuugccuuugaacua

SEQ ID NO: 448408 - RNA, 19 nt, Homo sapiens
gcagggaagaucuacauga

SEQ ID NO: 448409 - RNA, 19 nt, Homo sapiens
cagauaagccucaucaaca

SEQ ID NO: 448410 - RNA, 19 nt, Homo sapiens
ggaagaccaucaagguucu

SEQ ID NO: 448411 - RNA, 19 nt, Homo sapiens
ugaacacacucaucaagau

SEQ ID NO: 448412 - RNA, 19 nt, Homo sapiens
ucggagggcuggacauuug

SEQ ID NO: 448413 - RNA, 19 nt, Homo sapiens
gaggacgacuucgauaugu

SEQ ID NO: 448414 - RNA, 19 nt, Homo sapiens
gcuggaauaucuucgacuu

SEQ ID NO: 448415 - RNA, 19 nt, Homo sapiens
gaagauggucccagagcaa

SEQ ID NO: 448416 - RNA, 19 nt, Homo sapiens
ggagagcggcugugaagau

SEQ ID NO: 448417 - RNA, 19 nt, Homo sapiens
cugcugaggcgaaauauaa

SEQ ID NO: 448418 - RNA, 19 nt, Homo sapiens
cgacuucgauauguucuau

SEQ ID NO: 448419 - RNA, 19 nt, Homo sapiens
guucaucuacuccaucuuu

SEQ ID NO: 448420 - RNA, 19 nt, Homo sapiens
gagaguggaucgagaccau

SEQ ID NO: 448421 - RNA, 19 nt, Homo sapiens
caagugaauucgaggagau

SEQ ID NO: 448422 - RNA, 19 nt, Homo sapiens
uggcuggacuuuaguguga

SEQ ID NO: 448423 - RNA, 19 nt, Homo sapiens
cauccaagaucuccuacga

SEQ ID NO: 448424 - RNA, 19 nt, Homo sapiens
ucauggcgcuggagcacua

SEQ ID NO: 448425 - RNA, 19 nt, Homo sapiens
ggcgagaccuggguucuga

SEQ ID NO: 448426 - RNA, 19 nt, Homo sapiens
aaacagccaugagagaaga

SEQ ID NO: 448427 - RNA, 19 nt, Homo sapiens
guaaacagccaugagagaa

SEQ ID NO: 448428 - RNA, 19 nt, Homo sapiens
cagggaagaucuacaugau

SEQ ID NO: 448429 - RNA, 19 nt, Homo sapiens
gaccaaguaugucgaguac

SEQ ID NO: 448430 - RNA, 19 nt, Homo sapiens
gacuguauauguugugaau

SEQ ID NO: 448431 - RNA, 19 nt, Homo sapiens
uaugagaucugggagaaau

SEQ ID NO: 448432 - RNA, 19 nt, Homo sapiens
gaacuaaucgagcacuucu

SEQ ID NO: 448433 - RNA, 19 nt, Homo sapiens
ggaaggagacugugguuuu

SEQ ID NO: 448434 - RNA, 19 nt, Homo sapiens
aaaccuaaaugcagucagu

SEQ ID NO: 448435 - RNA, 19 nt, Homo sapiens
ugacgucaccaucauguuu

SEQ ID NO: 448436 - RNA, 19 nt, Homo sapiens
gaacaacaagagccagugu

SEQ ID NO: 448437 - RNA, 19 nt, Homo sapiens
gaagaagcaagaggagaaa

SEQ ID NO: 448438 - RNA, 19 nt, Homo sapiens
gcaccauccucaccaacug

SEQ ID NO: 448439 - RNA, 19 nt, Homo sapiens
gcauggacauucucuuugc

SEQ ID NO: 448440 - RNA, 19 nt, Homo sapiens
guaccagggcuucauauuc

SEQ ID NO: 448441 - RNA, 19 nt, Homo sapiens
caaguaccagggcuucaua

SEQ ID NO: 448442 - RNA, 19 nt, Homo sapiens
gcagaagaaguacuacaau

SEQ ID NO: 448443 - RNA, 19 nt, Homo sapiens
caucaucguguucaucuuu

SEQ ID NO: 448444 - RNA, 19 nt, Homo sapiens
gagcacuucucaccaaacu

SEQ ID NO: 448445 - RNA, 19 nt, Homo sapiens
ucucaaagcagaaguggaa

SEQ ID NO: 448446 - RNA, 19 nt, Homo sapiens
gagcggcugugaagauucu

SEQ ID NO: 448447 - RNA, 19 nt, Homo sapiens
ugaccaagcaggccuuuga

SEQ ID NO: 448448 - RNA, 19 nt, Homo sapiens
gaacacacucaucaagauc

SEQ ID NO: 448449 - RNA, 19 nt, Homo sapiens
gggcaaugucucagccuua

SEQ ID NO: 448450 - RNA, 19 nt, Homo sapiens
uuguagaucuccaugcuuu

SEQ ID NO: 448451 - RNA, 19 nt, Homo sapiens
gcagagaguuggugaaaua

SEQ ID NO: 448452 - RNA, 19 nt, Homo sapiens
gaucaaggcuucacaaauu

SEQ ID NO: 448453 - RNA, 19 nt, Homo sapiens
gcaagaacuuugagaauuu

SEQ ID NO: 448454 - RNA, 19 nt, Homo sapiens
gaccaaagguguuucauaa

SEQ ID NO: 448455 - RNA, 19 nt, Homo sapiens
gcaugaagcuguuugguaa

SEQ ID NO: 448456 - RNA, 19 nt, Homo sapiens
ugaagaagcuaauguauga

SEQ ID NO: 448457 - RNA, 19 nt, Homo sapiens
gaucagagaaagacaauua

SEQ ID NO: 448458 - RNA, 19 nt, Homo sapiens
gaacuggaaacccauauua

SEQ ID NO: 448459 - RNA, 19 nt, Homo sapiens
gaagauauuucugaccaua

SEQ ID NO: 448460 - RNA, 19 nt, Homo sapiens
caucugaagucaugaauaa

SEQ ID NO: 448461 - RNA, 19 nt, Homo sapiens
uaaacaagcuccaaggauu

SEQ ID NO: 448462 - RNA, 19 nt, Homo sapiens
gugaaagccuucuguuuaa

SEQ ID NO: 448463 - RNA, 19 nt, Homo sapiens
gaacaucauucuucucauc

SEQ ID NO: 448464 - RNA, 19 nt, Homo sapiens
gagaauacuuugcuuggaa

SEQ ID NO: 448465 - RNA, 19 nt, Homo sapiens
cuagcaagcuuucagauuu

SEQ ID NO: 448466 - RNA, 19 nt, Homo sapiens
guucaucuaugccguauuu

SEQ ID NO: 448467 - RNA, 19 nt, Homo sapiens
gaauggcucuucuucgauu

SEQ ID NO: 448468 - RNA, 19 nt, Homo sapiens
caaguagguuggaacauuu

SEQ ID NO: 448469 - RNA, 19 nt, Homo sapiens
auaaggagauucagaguaa

SEQ ID NO: 448470 - RNA, 19 nt, Homo sapiens
cuaagaagauugaaccaaa

SEQ ID NO: 448471 - RNA, 19 nt, Homo sapiens
caacauggccaggucauua

SEQ ID NO: 448472 - RNA, 19 nt, Homo sapiens
ggugaaauaucuaagaaga

SEQ ID NO: 448473 - RNA, 19 nt, Homo sapiens
gagaagugcuguuguucaa

SEQ ID NO: 448474 - RNA, 19 nt, Homo sapiens
gaauuugucugccacauag

SEQ ID NO: 448475 - RNA, 19 nt, Homo sapiens
gaagauaugcccauuauac

SEQ ID NO: 448476 - RNA, 19 nt, Homo sapiens
gaacaacuaucaagguuuu

SEQ ID NO: 448477 - RNA, 19 nt, Homo sapiens
ugaaagaguuuguccauag

SEQ ID NO: 448478 - RNA, 19 nt, Homo sapiens
ggaagaugcuacucucaga

SEQ ID NO: 448479 - RNA, 19 nt, Homo sapiens
ccaaagguguuucauaauc

SEQ ID NO: 448480 - RNA, 19 nt, Homo sapiens
gaacuuugauaauguugga

SEQ ID NO: 448481 - RNA, 19 nt, Homo sapiens
guagagaacaauugguuua

SEQ ID NO: 448482 - RNA, 19 nt, Homo sapiens
gcucaucgcuuuccguugu

SEQ ID NO: 448483 - RNA, 19 nt, Homo sapiens
caaucuagcucaucugaau

SEQ ID NO: 448484 - RNA, 19 nt, Homo sapiens
gggaaggucuacaugauau

SEQ ID NO: 448485 - RNA, 19 nt, Homo sapiens
uaaagaaggugccuauuuu

SEQ ID NO: 448486 - RNA, 19 nt, Homo sapiens
ucaugucccugacuaauuu

SEQ ID NO: 448487 - RNA, 19 nt, Homo sapiens
ggauggaucacuauuauga

SEQ ID NO: 448488 - RNA, 19 nt, Homo sapiens
ggauuacccugaaguacuu

SEQ ID NO: 448489 - RNA, 19 nt, Homo sapiens
ggccuuauuugcccuauuu

SEQ ID NO: 448490 - RNA, 19 nt, Homo sapiens
uaugauagauggugacaga

SEQ ID NO: 448491 - RNA, 19 nt, Homo sapiens
ugugaaagccuucuguuua

SEQ ID NO: 448492 - RNA, 19 nt, Homo sapiens
gagaacaauugguuuaagu

SEQ ID NO: 448493 - RNA, 19 nt, Homo sapiens
gaaaguauuggccaacauu

SEQ ID NO: 448494 - RNA, 19 nt, Homo sapiens
ggaccaaagguguuucaua

SEQ ID NO: 448495 - RNA, 19 nt, Homo sapiens
cugaugaucuggcugauuu

SEQ ID NO: 448496 - RNA, 19 nt, Homo sapiens
aaugagagccaaucacuua

SEQ ID NO: 448497 - RNA, 19 nt, Homo sapiens
caaaucaagagaauccuua

SEQ ID NO: 448498 - RNA, 19 nt, Homo sapiens
guacauuguuguugucaug

SEQ ID NO: 448499 - RNA, 19 nt, Homo sapiens
aggagaaucugauauagaa

SEQ ID NO: 448500 - RNA, 19 nt, Homo sapiens
aagaagauaugcccauuau

SEQ ID NO: 448501 - RNA, 19 nt, Homo sapiens
ugaagaccaugaagaagaa

SEQ ID NO: 448502 - RNA, 19 nt, Homo sapiens
cuaaagaaggugccuauuu

SEQ ID NO: 448503 - RNA, 19 nt, Homo sapiens
uguaacagcugaagagaau

SEQ ID NO: 448504 - RNA, 19 nt, Homo sapiens
guaaauggucugacuguga

SEQ ID NO: 448505 - RNA, 19 nt, Homo sapiens
caauagccaugaugauaga

SEQ ID NO: 448506 - RNA, 19 nt, Homo sapiens
gaucuucacuuggucaaau

SEQ ID NO: 448507 - RNA, 19 nt, Homo sapiens
gaccauacccuuucugaau

SEQ ID NO: 448508 - RNA, 19 nt, Homo sapiens
agaaagauaugcucuccuu

SEQ ID NO: 448509 - RNA, 19 nt, Homo sapiens
ggucugaaaucccuuguag

SEQ ID NO: 448510 - RNA, 19 nt, Homo sapiens
caaugcggcuuccaucuug

SEQ ID NO: 448511 - RNA, 19 nt, Homo sapiens
uggaagauguggacccaua

SEQ ID NO: 448512 - RNA, 19 nt, Homo sapiens
aaacaaccuuacccacuuu

SEQ ID NO: 448513 - RNA, 19 nt, Homo sapiens
ggccaagaccauacaaaua

SEQ ID NO: 448514 - RNA, 19 nt, Homo sapiens
gaaccaaaauuucaacaga

SEQ ID NO: 448515 - RNA, 19 nt, Homo sapiens
ccaugaagaagaagacuua

SEQ ID NO: 448516 - RNA, 19 nt, Homo sapiens
uacaaccgaugguaauuaa

SEQ ID NO: 448517 - RNA, 19 nt, Homo sapiens
ccagaucuaauaccacuua

SEQ ID NO: 448518 - RNA, 19 nt, Homo sapiens
agaaauagaaucaggguuu

SEQ ID NO: 448519 - RNA, 19 nt, Homo sapiens
ugacugugauccugauaaa

SEQ ID NO: 448520 - RNA, 19 nt, Homo sapiens
ggaucacuauuaugaauuc

SEQ ID NO: 448521 - RNA, 19 nt, Homo sapiens
uaucaugggaguagacuua

SEQ ID NO: 448522 - RNA, 19 nt, Homo sapiens
gcugcaagauuguagagaa

SEQ ID NO: 448523 - RNA, 19 nt, Homo sapiens
aagaaaaggucaccaauuu

SEQ ID NO: 448524 - RNA, 19 nt, Homo sapiens
gagaguuggugaaauaucu

SEQ ID NO: 448525 - RNA, 19 nt, Homo sapiens
gcuuggaauuuacacauuu

SEQ ID NO: 448526 - RNA, 19 nt, Homo sapiens
uaaauggucugacugugau

SEQ ID NO: 448527 - RNA, 19 nt, Homo sapiens
accaguaccucgcccauua

SEQ ID NO: 448528 - RNA, 19 nt, Homo sapiens
caagaagauaugcccauua

SEQ ID NO: 448529 - RNA, 19 nt, Homo sapiens
gaugauagacacugauguu

SEQ ID NO: 448530 - RNA, 19 nt, Homo sapiens
gaguaagucuggugaugga

SEQ ID NO: 448531 - RNA, 19 nt, Homo sapiens
uaacagcugaagagaauaa

SEQ ID NO: 448532 - RNA, 19 nt, Homo sapiens
ggaaauuuacugguacuuu

SEQ ID NO: 448533 - RNA, 19 nt, Homo sapiens
gauaguguuccaugguuua

SEQ ID NO: 448534 - RNA, 19 nt, Homo sapiens
gaaagaguuuguccauagg

SEQ ID NO: 448535 - RNA, 19 nt, Homo sapiens
gaaggucuacaugauauuu

SEQ ID NO: 448536 - RNA, 19 nt, Homo sapiens
ccauggaacuggcucgauu

SEQ ID NO: 448537 - RNA, 19 nt, Homo sapiens
gaagaacaacuaucaaggu

SEQ ID NO: 448538 - RNA, 19 nt, Homo sapiens
caaagguguuucauaaucu

SEQ ID NO: 448539 - RNA, 19 nt, Homo sapiens
uaaugaagaccaugaagaa

SEQ ID NO: 448540 - RNA, 19 nt, Homo sapiens
gaguuuguccauaggauua

SEQ ID NO: 448541 - RNA, 19 nt, Homo sapiens
aaacuagugcccaaagaua

SEQ ID NO: 448542 - RNA, 19 nt, Homo sapiens
ugaaggauaugugugugua

SEQ ID NO: 448543 - RNA, 19 nt, Homo sapiens
ggagaccaguauuagagaa

SEQ ID NO: 448544 - RNA, 19 nt, Homo sapiens
uaauuaguguccugauuga

SEQ ID NO: 448545 - RNA, 19 nt, Homo sapiens
cgacuacuuugaaacgaaa

SEQ ID NO: 448546 - RNA, 19 nt, Homo sapiens
ggacuaugucugccuauga

SEQ ID NO: 448547 - RNA, 19 nt, Homo sapiens
gcaauagccaugaugauag

SEQ ID NO: 448548 - RNA, 19 nt, Homo sapiens
gaacaauugguuuaagugu

SEQ ID NO: 448549 - RNA, 19 nt, Homo sapiens
uuggugagcucauuuaguu

SEQ ID NO: 448550 - RNA, 19 nt, Homo sapiens
ccacauagacaaagacugu

SEQ ID NO: 448551 - RNA, 19 nt, Homo sapiens
caacugagguggaaauuaa

SEQ ID NO: 448552 - RNA, 19 nt, Homo sapiens
gaaggaagcaccauugaua

SEQ ID NO: 448553 - RNA, 19 nt, Homo sapiens
ggaagaaggugaagaagga

SEQ ID NO: 448554 - RNA, 19 nt, Homo sapiens
uaacacagcugcaucuuga

SEQ ID NO: 448555 - RNA, 19 nt, Homo sapiens
caucaucucuuuccuaauu

SEQ ID NO: 448556 - RNA, 19 nt, Homo sapiens
gacaaagucuucaccuaua

SEQ ID NO: 448557 - RNA, 19 nt, Homo sapiens
ugaaagagauugugaacuu

SEQ ID NO: 448558 - RNA, 19 nt, Homo sapiens
ggacaaaacuaaccagaua

SEQ ID NO: 448559 - RNA, 19 nt, Homo sapiens
caagaagguuggaacauuu

SEQ ID NO: 448560 - RNA, 19 nt, Homo sapiens
gagcacaacugguuugaga

SEQ ID NO: 448561 - RNA, 19 nt, Homo sapiens
gaacaugucuuggcuguag

SEQ ID NO: 448562 - RNA, 19 nt, Homo sapiens
ucacagggauuuauacauu

SEQ ID NO: 448563 - RNA, 19 nt, Homo sapiens
ggaaacaaccaacuaauug

SEQ ID NO: 448564 - RNA, 19 nt, Homo sapiens
ggccauggcuuaugaagaa

SEQ ID NO: 448565 - RNA, 19 nt, Homo sapiens
ggaagaacgugaagaucaa

SEQ ID NO: 448566 - RNA, 19 nt, Homo sapiens
ggaacuaggugccauaaag

SEQ ID NO: 448567 - RNA, 19 nt, Homo sapiens
cuaauaagcuggagaaugg

SEQ ID NO: 448568 - RNA, 19 nt, Homo sapiens
gcacgaggcugguaucgau

SEQ ID NO: 448569 - RNA, 19 nt, Homo sapiens
ggaauaugcugacaaaguc

SEQ ID NO: 448570 - RNA, 19 nt, Homo sapiens
caaauacacuaguagaaga

SEQ ID NO: 448571 - RNA, 19 nt, Homo sapiens
ggauuaaccugguguuugu

SEQ ID NO: 448572 - RNA, 19 nt, Homo sapiens
guacuacaaugccaugaaa

SEQ ID NO: 448573 - RNA, 19 nt, Homo sapiens
ccauggaucccuacuauua

SEQ ID NO: 448574 - RNA, 19 nt, Homo sapiens
gaaaggcccuggaucucuu

SEQ ID NO: 448575 - RNA, 19 nt, Homo sapiens
ugaagaaacugucagaugu

SEQ ID NO: 448576 - RNA, 19 nt, Homo sapiens
gaacagcuguggagacucu

SEQ ID NO: 448577 - RNA, 19 nt, Homo sapiens
gaagauggcaugagaagga

SEQ ID NO: 448578 - RNA, 19 nt, Homo sapiens
ccucggagcucuucugaaa

SEQ ID NO: 448579 - RNA, 19 nt, Homo sapiens
ggaaaacucucuucagauu

SEQ ID NO: 448580 - RNA, 19 nt, Homo sapiens
gcaagugaaagauuguuua

SEQ ID NO: 448581 - RNA, 19 nt, Homo sapiens
gcaagcagauggagaacau

SEQ ID NO: 448582 - RNA, 19 nt, Homo sapiens
gaaagagauugugaacuug

SEQ ID NO: 448583 - RNA, 19 nt, Homo sapiens
gggaagaguuugccuuuca

SEQ ID NO: 448584 - RNA, 19 nt, Homo sapiens
gaaacaaccaacuaauuga

SEQ ID NO: 448585 - RNA, 19 nt, Homo sapiens
cauuguggcugucucuuua

SEQ ID NO: 448586 - RNA, 19 nt, Homo sapiens
gcaaagauaaacuagauga

SEQ ID NO: 448587 - RNA, 19 nt, Homo sapiens
cagcaaagauaaacuagau

SEQ ID NO: 448588 - RNA, 19 nt, Homo sapiens
ggaugcaacucuuuggaaa

SEQ ID NO: 448589 - RNA, 19 nt, Homo sapiens
ccauggaacugguuagauu

SEQ ID NO: 448590 - RNA, 19 nt, Homo sapiens
gcaagagguuucugcauag

SEQ ID NO: 448591 - RNA, 19 nt, Homo sapiens
gaugacauguucaacuuug

SEQ ID NO: 448592 - RNA, 19 nt, Homo sapiens
ggacagaaucaacaguaua

SEQ ID NO: 448593 - RNA, 19 nt, Homo sapiens
gaauguuccuggcagauau

SEQ ID NO: 448594 - RNA, 19 nt, Homo sapiens
ggaagaguauaucaacaau

SEQ ID NO: 448595 - RNA, 19 nt, Homo sapiens
gcagaaaaccuuuguagua

SEQ ID NO: 448596 - RNA, 19 nt, Homo sapiens
ccauugagcucaucgcuau

SEQ ID NO: 448597 - RNA, 19 nt, Homo sapiens
gacaauaucuacauguaca

SEQ ID NO: 448598 - RNA, 19 nt, Homo sapiens
gcagcagcguggagaagua

SEQ ID NO: 448599 - RNA, 19 nt, Homo sapiens
gaagaaaggcccuggaucu

SEQ ID NO: 448600 - RNA, 19 nt, Homo sapiens
gacagaaucaacaguauaa

SEQ ID NO: 448601 - RNA, 19 nt, Homo sapiens
gcuggaaccuuuacucugu

SEQ ID NO: 448602 - RNA, 19 nt, Homo sapiens
gaccaacuguguauucaug

SEQ ID NO: 448603 - RNA, 19 nt, Homo sapiens
acacacacacucacauuua

SEQ ID NO: 448604 - RNA, 19 nt, Homo sapiens
ucagagaauccaaguguua

SEQ ID NO: 448605 - RNA, 19 nt, Homo sapiens
caucauguaugcagcugua

SEQ ID NO: 448606 - RNA, 19 nt, Homo sapiens
gaacgugaagaucaacuuu

SEQ ID NO: 448607 - RNA, 19 nt, Homo sapiens
agaaugaguucgcggauga

SEQ ID NO: 448608 - RNA, 19 nt, Homo sapiens
gggaaacaaccaacuaauu

SEQ ID NO: 448609 - RNA, 19 nt, Homo sapiens
cagaagaaguacuacaaug

SEQ ID NO: 448610 - RNA, 19 nt, Homo sapiens
gcugcgaucuuuccgauug

SEQ ID NO: 448611 - RNA, 19 nt, Homo sapiens
ucugaaaucucuaaacuca

SEQ ID NO: 448612 - RNA, 19 nt, Homo sapiens
ccgaagaacagaagaagua

SEQ ID NO: 448613 - RNA, 19 nt, Homo sapiens
guucauuggugucaucauu

SEQ ID NO: 448614 - RNA, 19 nt, Homo sapiens
gaagaucuauaccaaacgu

SEQ ID NO: 448615 - RNA, 19 nt, Homo sapiens
cagcaagccuuugacauug

SEQ ID NO: 448616 - RNA, 19 nt, Homo sapiens
uaaugagacuucugaaauc

SEQ ID NO: 448617 - RNA, 19 nt, Homo sapiens
gaccacauguccuucauca

SEQ ID NO: 448618 - RNA, 19 nt, Homo sapiens
ggaacugucucagaagaug

SEQ ID NO: 448619 - RNA, 19 nt, Homo sapiens
ccacccaguucauugagua

SEQ ID NO: 448620 - RNA, 19 nt, Homo sapiens
caugggaguuaacuuguuu

SEQ ID NO: 448621 - RNA, 19 nt, Homo sapiens
uggaacagccugaggaaua

SEQ ID NO: 448622 - RNA, 19 nt, Homo sapiens
caacuaugguuacacaagu

SEQ ID NO: 448623 - RNA, 19 nt, Homo sapiens
caaugcaacuuaggacaaa

SEQ ID NO: 448624 - RNA, 19 nt, Homo sapiens
uaucaaaccagaaguagaa

SEQ ID NO: 448625 - RNA, 19 nt, Homo sapiens
ccagagggauaccagugua

SEQ ID NO: 448626 - RNA, 19 nt, Homo sapiens
aacgagagcuaucuugaaa

SEQ ID NO: 448627 - RNA, 19 nt, Homo sapiens
acucuaaccugaagaucua

SEQ ID NO: 448628 - RNA, 19 nt, Homo sapiens
gcacuacuacuucaccauu

SEQ ID NO: 448629 - RNA, 19 nt, Homo sapiens
ggacuuugacccauacuau

SEQ ID NO: 448630 - RNA, 19 nt, Homo sapiens
gaaacugucagaugugaug

SEQ ID NO: 448631 - RNA, 19 nt, Homo sapiens
ggucgaagaauguggagua

SEQ ID NO: 448632 - RNA, 19 nt, Homo sapiens
aaacuaaccagauacagaa

SEQ ID NO: 448633 - RNA, 19 nt, Homo sapiens
gcaagccuuugacauuguu

SEQ ID NO: 448634 - RNA, 19 nt, Homo sapiens
ucaaguagcaaccuucaaa

SEQ ID NO: 448635 - RNA, 19 nt, Homo sapiens
gccauaaagucccuuagga

SEQ ID NO: 448636 - RNA, 19 nt, Homo sapiens
gaaagaagaggaagcaaaa

SEQ ID NO: 448637 - RNA, 19 nt, Homo sapiens
gcucaaagagugcaaagga

SEQ ID NO: 448638 - RNA, 19 nt, Homo sapiens
gcucaaagaagccacagaa

SEQ ID NO: 448639 - RNA, 19 nt, Homo sapiens
gagugugucugcaagauca

SEQ ID NO: 448640 - RNA, 19 nt, Homo sapiens
ggcaucuucuucuuuguaa

SEQ ID NO: 448641 - RNA, 19 nt, Homo sapiens
caaaggcgccaaagggauu

SEQ ID NO: 448642 - RNA, 19 nt, Homo sapiens
ggucaggacaucuucauga

SEQ ID NO: 448643 - RNA, 19 nt, Homo sapiens
auacagagaucagauggaa

SEQ ID NO: 448644 - RNA, 19 nt, Homo sapiens
guggagaaguacaucauug

SEQ ID NO: 448645 - RNA, 19 nt, Homo sapiens
gucagaagauggcaugaga

SEQ ID NO: 448646 - RNA, 19 nt, Homo sapiens
gcaaaggaaagacguaaca

SEQ ID NO: 448647 - RNA, 19 nt, Homo sapiens
ucccuagacuuacagauuu

SEQ ID NO: 448648 - RNA, 19 nt, Homo sapiens
guagucauccucuccauug

SEQ ID NO: 448649 - RNA, 19 nt, Homo sapiens
ucagcaagccuuugacauu

SEQ ID NO: 448650 - RNA, 19 nt, Homo sapiens
gaacaauacagagaucaga

SEQ ID NO: 448651 - RNA, 19 nt, Homo sapiens
agacagagaugaugauuua

SEQ ID NO: 448652 - RNA, 19 nt, Homo sapiens
caaguaggcuggaauauuu

SEQ ID NO: 448653 - RNA, 19 nt, Homo sapiens
gaacacaguugguuugaaa

SEQ ID NO: 448654 - RNA, 19 nt, Homo sapiens
gaaagaugaugaugaagaa

SEQ ID NO: 448655 - RNA, 19 nt, Homo sapiens
gagcaaaggucacaauuuc

SEQ ID NO: 448656 - RNA, 19 nt, Homo sapiens
cagacaagaucuucacuua

SEQ ID NO: 448657 - RNA, 19 nt, Homo sapiens
aaacaaaccuuacgugaau

SEQ ID NO: 448658 - RNA, 19 nt, Homo sapiens
ugaagaagcuaaacagaaa

SEQ ID NO: 448659 - RNA, 19 nt, Homo sapiens
gcaagaggcuucuguguag

SEQ ID NO: 448660 - RNA, 19 nt, Homo sapiens
gaacaagacagaacagaaa

SEQ ID NO: 448661 - RNA, 19 nt, Homo sapiens
gaauauagccucuacaugu

SEQ ID NO: 448662 - RNA, 19 nt, Homo sapiens
gguaagagcuacaaagaau

SEQ ID NO: 448663 - RNA, 19 nt, Homo sapiens
uaacccaucuguuggaaua

SEQ ID NO: 448664 - RNA, 19 nt, Homo sapiens
gauggacgauuauuaugua

SEQ ID NO: 448665 - RNA, 19 nt, Homo sapiens
gcaugcagcucuuugguaa

SEQ ID NO: 448666 - RNA, 19 nt, Homo sapiens
uaacaaagccagacaaaga

SEQ ID NO: 448667 - RNA, 19 nt, Homo sapiens
cagaagaacagaagaaaua

SEQ ID NO: 448668 - RNA, 19 nt, Homo sapiens
gaguagagcaagcauauua

SEQ ID NO: 448669 - RNA, 19 nt, Homo sapiens
gaucuucacuuacaucuuc

SEQ ID NO: 448670 - RNA, 19 nt, Homo sapiens
gcaaacaaccuccagauug

SEQ ID NO: 448671 - RNA, 19 nt, Homo sapiens
gcaagcauauuaacaaaca

SEQ ID NO: 448672 - RNA, 19 nt, Homo sapiens
gacaagaucuucacuuaca

SEQ ID NO: 448673 - RNA, 19 nt, Homo sapiens
gaaagaagaaacagaagaa

SEQ ID NO: 448674 - RNA, 19 nt, Homo sapiens
gagcaagcauauuaacaaa

SEQ ID NO: 448675 - RNA, 19 nt, Homo sapiens
gaacaacgcauugcugaaa

SEQ ID NO: 448676 - RNA, 19 nt, Homo sapiens
ucucuaaacucucugauuu

SEQ ID NO: 448677 - RNA, 19 nt, Homo sapiens
gaaugugucugcaagauca

SEQ ID NO: 448678 - RNA, 19 nt, Homo sapiens
gcacgcugcucuuugcuuu

SEQ ID NO: 448679 - RNA, 19 nt, Homo sapiens
gcaauuccuuccaucauga

SEQ ID NO: 448680 - RNA, 19 nt, Homo sapiens
gaucauugguaacucagua

SEQ ID NO: 448681 - RNA, 19 nt, Homo sapiens
gcacacaaauucuugaucu

SEQ ID NO: 448682 - RNA, 19 nt, Homo sapiens
cagaggauaugcugaauga

SEQ ID NO: 448683 - RNA, 19 nt, Homo sapiens
caagcuaugugccuuauug

SEQ ID NO: 448684 - RNA, 19 nt, Homo sapiens
aaagggagaugcugagaaa

SEQ ID NO: 448685 - RNA, 19 nt, Homo sapiens
gcaaacaacugcccuucau

SEQ ID NO: 448686 - RNA, 19 nt, Homo sapiens
gaaacaaaccuuacgugaa

SEQ ID NO: 448687 - RNA, 19 nt, Homo sapiens
cagcugaaaugguauuaaa

SEQ ID NO: 448688 - RNA, 19 nt, Homo sapiens
ggucuuuacuggaaucuuu

SEQ ID NO: 448689 - RNA, 19 nt, Homo sapiens
gcaaauccuuccaaagugu

SEQ ID NO: 448690 - RNA, 19 nt, Homo sapiens
guacugaaccucugaguga

SEQ ID NO: 448691 - RNA, 19 nt, Homo sapiens
guucauuggugucaucaua

SEQ ID NO: 448692 - RNA, 19 nt, Homo sapiens
gcagaaacccugauuaugg

SEQ ID NO: 448693 - RNA, 19 nt, Homo sapiens
cugacaaacugcauauuua

SEQ ID NO: 448694 - RNA, 19 nt, Homo sapiens
gugaggagcugaagaggaa

SEQ ID NO: 448695 - RNA, 19 nt, Homo sapiens
caaaggaacccaaagaaga

SEQ ID NO: 448696 - RNA, 19 nt, Homo sapiens
ugggaaaccugaagcauaa

SEQ ID NO: 448697 - RNA, 19 nt, Homo sapiens
caacuuugccuauguuaaa

SEQ ID NO: 448698 - RNA, 19 nt, Homo sapiens
gauggucaaucauuuauuc

SEQ ID NO: 448699 - RNA, 19 nt, Homo sapiens
agaagaagcugaggcaauu

SEQ ID NO: 448700 - RNA, 19 nt, Homo sapiens
caacugcccuucaucuaug

SEQ ID NO: 448701 - RNA, 19 nt, Homo sapiens
uuuaagggauggacgauua

SEQ ID NO: 448702 - RNA, 19 nt, Homo sapiens
gugauuaucuccauuguag

SEQ ID NO: 448703 - RNA, 19 nt, Homo sapiens
gcacuauucugacaaacug

SEQ ID NO: 448704 - RNA, 19 nt, Homo sapiens
gaauugcucuccauauugg

SEQ ID NO: 448705 - RNA, 19 nt, Homo sapiens
gcugagaaauugucgaaau

SEQ ID NO: 448706 - RNA, 19 nt, Homo sapiens
gaaugagggucguugugaa

SEQ ID NO: 448707 - RNA, 19 nt, Homo sapiens
uaacauagagucagggaaa

SEQ ID NO: 448708 - RNA, 19 nt, Homo sapiens
cuaugugccuuauuguuua

SEQ ID NO: 448709 - RNA, 19 nt, Homo sapiens
aauauagccucuacaugua

SEQ ID NO: 448710 - RNA, 19 nt, Homo sapiens
cuacuugugugucuuauau

SEQ ID NO: 448711 - RNA, 19 nt, Homo sapiens
uaacaaacacuguggaaga

SEQ ID NO: 448712 - RNA, 19 nt, Homo sapiens
gaaauugucgaaaucagaa

SEQ ID NO: 448713 - RNA, 19 nt, Homo sapiens
gaacagaaccaggcaaaca

SEQ ID NO: 448714 - RNA, 19 nt, Homo sapiens
gaagcuuucugaugucaug

SEQ ID NO: 448715 - RNA, 19 nt, Homo sapiens
uuauagacguuaccgcuua

SEQ ID NO: 448716 - RNA, 19 nt, Homo sapiens
caacauaugacugaaguuu

SEQ ID NO: 448717 - RNA, 19 nt, Homo sapiens
ggucaaagucaacauauga

SEQ ID NO: 448718 - RNA, 19 nt, Homo sapiens
ccucagagcuuuguccauu

SEQ ID NO: 448719 - RNA, 19 nt, Homo sapiens
ccaaucaaauacacaagaa

SEQ ID NO: 448720 - RNA, 19 nt, Homo sapiens
gaagauggaauuaaugaca

SEQ ID NO: 448721 - RNA, 19 nt, Homo sapiens
guucuuaucugucucaaca

SEQ ID NO: 448722 - RNA, 19 nt, Homo sapiens
acaagcagcccaaauauga

SEQ ID NO: 448723 - RNA, 19 nt, Homo sapiens
gcuaugugccuuauuguuu

SEQ ID NO: 448724 - RNA, 19 nt, Homo sapiens
ugaauacccuagagaguga

SEQ ID NO: 448725 - RNA, 19 nt, Homo sapiens
uaacucugauuuccuaaga

SEQ ID NO: 448726 - RNA, 19 nt, Homo sapiens
gcaccuauucuuaacagua

SEQ ID NO: 448727 - RNA, 19 nt, Homo sapiens
guugauguuucuuugguua

SEQ ID NO: 448728 - RNA, 19 nt, Homo sapiens
ggacaaacacuugauggaa

SEQ ID NO: 448729 - RNA, 19 nt, Homo sapiens
gcacaugaacgacuucuuc

SEQ ID NO: 448730 - RNA, 19 nt, Homo sapiens
cauugaacaugcugauuaa

SEQ ID NO: 448731 - RNA, 19 nt, Homo sapiens
uagcagauguggaaggauu

SEQ ID NO: 448732 - RNA, 19 nt, Homo sapiens
gaggacagcaucagaagaa

SEQ ID NO: 448733 - RNA, 19 nt, Homo sapiens
gggagaugcugagaaauug

SEQ ID NO: 448734 - RNA, 19 nt, Homo sapiens
cauccaaacugagcucuaa

SEQ ID NO: 448735 - RNA, 19 nt, Homo sapiens
caucauauccuuccugguu

SEQ ID NO: 448736 - RNA, 19 nt, Homo sapiens
guuucuagcugauuugauu

SEQ ID NO: 448737 - RNA, 19 nt, Homo sapiens
aaacauauuucaccaaugc

SEQ ID NO: 448738 - RNA, 19 nt, Homo sapiens
ggaauugcucuccauauug

SEQ ID NO: 448739 - RNA, 19 nt, Homo sapiens
gaaauaugaacaagacaga

SEQ ID NO: 448740 - RNA, 19 nt, Homo sapiens
caacaaaguccagcucauu

SEQ ID NO: 448741 - RNA, 19 nt, Homo sapiens
gaggaugacuuugagaugu

SEQ ID NO: 448742 - RNA, 19 nt, Homo sapiens
caccuauucuuaacaguaa

SEQ ID NO: 448743 - RNA, 19 nt, Homo sapiens
ggaagacagugauggucaa

SEQ ID NO: 448744 - RNA, 19 nt, Homo sapiens
caaacaaccuccagauugc

SEQ ID NO: 448745 - RNA, 19 nt, Homo sapiens
uaaaucagaagaccaugua

SEQ ID NO: 448746 - RNA, 19 nt, Homo sapiens
gccucuacauguauauuua

SEQ ID NO: 448747 - RNA, 19 nt, Homo sapiens
uagacaagcagcccaaaua

SEQ ID NO: 448748 - RNA, 19 nt, Homo sapiens
gaagaucugaauacuaaga

SEQ ID NO: 448749 - RNA, 19 nt, Homo sapiens
ggagauaagacaagcagaa

SEQ ID NO: 448750 - RNA, 19 nt, Homo sapiens
agacagagagcaaugagua

SEQ ID NO: 448751 - RNA, 19 nt, Homo sapiens
gaacugaccuuccagagaa

SEQ ID NO: 448752 - RNA, 19 nt, Homo sapiens
gagcacagcugguuugaga

SEQ ID NO: 448753 - RNA, 19 nt, Homo sapiens
gaauaugucuucacuguca

SEQ ID NO: 448754 - RNA, 19 nt, Homo sapiens
gaggacaucuagcucaaua

SEQ ID NO: 448755 - RNA, 19 nt, Homo sapiens
gcaaccagcugcccaaguu

SEQ ID NO: 448756 - RNA, 19 nt, Homo sapiens
caacuucaaucaacagaaa

SEQ ID NO: 448757 - RNA, 19 nt, Homo sapiens
gacagggucuucaccuuua

SEQ ID NO: 448758 - RNA, 19 nt, Homo sapiens
gaaauauacugauccagau

SEQ ID NO: 448759 - RNA, 19 nt, Homo sapiens
gagagaaggcauagaauaa

SEQ ID NO: 448760 - RNA, 19 nt, Homo sapiens
gagauaagauccacugcuu

SEQ ID NO: 448761 - RNA, 19 nt, Homo sapiens
ugaaguggcucccaucaaa

SEQ ID NO: 448762 - RNA, 19 nt, Homo sapiens
cagaggagcagaagaaaua

SEQ ID NO: 448763 - RNA, 19 nt, Homo sapiens
gaaauggucuucaaaauca

SEQ ID NO: 448764 - RNA, 19 nt, Homo sapiens
cacaauggaucaccuuuaa

SEQ ID NO: 448765 - RNA, 19 nt, Homo sapiens
gaacaaagaaagccagaga

SEQ ID NO: 448766 - RNA, 19 nt, Homo sapiens
acaaauggcuggaaugugu

SEQ ID NO: 448767 - RNA, 19 nt, Homo sapiens
caacaucgucuuuaccaua

SEQ ID NO: 448768 - RNA, 19 nt, Homo sapiens
ugaagaaacuggcugaugu

SEQ ID NO: 448769 - RNA, 19 nt, Homo sapiens
gcaagaggauuuugucuaa

SEQ ID NO: 448770 - RNA, 19 nt, Homo sapiens
ggcaaccacugaugaaauu

SEQ ID NO: 448771 - RNA, 19 nt, Homo sapiens
gaagaacggccaucaaagu

SEQ ID NO: 448772 - RNA, 19 nt, Homo sapiens
gcacacaccggacauuuau

SEQ ID NO: 448773 - RNA, 19 nt, Homo sapiens
ggucuucaccuuuaucuuu

SEQ ID NO: 448774 - RNA, 19 nt, Homo sapiens
cagaagaaguggaauaucu

SEQ ID NO: 448775 - RNA, 19 nt, Homo sapiens
ggacauuuauggugcugaa

SEQ ID NO: 448776 - RNA, 19 nt, Homo sapiens
gaagaugaagccaccagua

SEQ ID NO: 448777 - RNA, 19 nt, Homo sapiens
ucaugaagauguucgcuuu

SEQ ID NO: 448778 - RNA, 19 nt, Homo sapiens
cagaagaaauacuacaaug

SEQ ID NO: 448779 - RNA, 19 nt, Homo sapiens
uaaacacacucaucaagau

SEQ ID NO: 448780 - RNA, 19 nt, Homo sapiens
ggaguuggauucucugaag

SEQ ID NO: 448781 - RNA, 19 nt, Homo sapiens
ggacgacuuugacauguuc

SEQ ID NO: 448782 - RNA, 19 nt, Homo sapiens
ugaaagcuuugcuggagua

SEQ ID NO: 448783 - RNA, 19 nt, Homo sapiens
gagaguggauugagaacau

SEQ ID NO: 448784 - RNA, 19 nt, Homo sapiens
acaucuagcucaauacaaa

SEQ ID NO: 448785 - RNA, 19 nt, Homo sapiens
gggugaagcucaagacaau

SEQ ID NO: 448786 - RNA, 19 nt, Homo sapiens
gagaaggcauagaauaaag

SEQ ID NO: 448787 - RNA, 19 nt, Homo sapiens
gcgaaugugucaugaagau

SEQ ID NO: 448788 - RNA, 19 nt, Homo sapiens
ggugagacguggaaagaug

SEQ ID NO: 448789 - RNA, 19 nt, Homo sapiens
ccacugcccugaugguuau

SEQ ID NO: 448790 - RNA, 19 nt, Homo sapiens
ggaggugcaucaacuauac

SEQ ID NO: 448791 - RNA, 19 nt, Homo sapiens
ggacaacguguacauguau

SEQ ID NO: 448792 - RNA, 19 nt, Homo sapiens
ggagauagagaagcaaauu

SEQ ID NO: 448793 - RNA, 19 nt, Homo sapiens
ggaggcuucuucacacuga

SEQ ID NO: 448794 - RNA, 19 nt, Homo sapiens
guggaucucuggccuuuga

SEQ ID NO: 448795 - RNA, 19 nt, Homo sapiens
gcacaugcacgacuucuuc

SEQ ID NO: 448796 - RNA, 19 nt, Homo sapiens
gaagcaagaagacauuuca

SEQ ID NO: 448797 - RNA, 19 nt, Homo sapiens
aaucugaucuugaugacuu

SEQ ID NO: 448798 - RNA, 19 nt, Homo sapiens
gguuauaucugccuuaaaa

SEQ ID NO: 448799 - RNA, 19 nt, Homo sapiens
ccacucaguuuauuaccuu

SEQ ID NO: 448800 - RNA, 19 nt, Homo sapiens
acaaugccaugaagaaguu

SEQ ID NO: 448801 - RNA, 19 nt, Homo sapiens
ugacagaggagcagaagaa

SEQ ID NO: 448802 - RNA, 19 nt, Homo sapiens
caucgucuuuaccauauuu

SEQ ID NO: 448803 - RNA, 19 nt, Homo sapiens
caaugaguguugucaguau

SEQ ID NO: 448804 - RNA, 19 nt, Homo sapiens
ugagagaaggcauagaaua

SEQ ID NO: 448805 - RNA, 19 nt, Homo sapiens
ucaaugagacaaccaacua

SEQ ID NO: 448806 - RNA, 19 nt, Homo sapiens
cagaagaacggccaucaaa

SEQ ID NO: 448807 - RNA, 19 nt, Homo sapiens
gaacaaagggaggaccauu

SEQ ID NO: 448808 - RNA, 19 nt, Homo sapiens
ggagacugaugaccaaagu

SEQ ID NO: 448809 - RNA, 19 nt, Homo sapiens
gcaaugaguguugucagua

SEQ ID NO: 448810 - RNA, 19 nt, Homo sapiens
ccagaggccacucaguuua

SEQ ID NO: 448811 - RNA, 19 nt, Homo sapiens
ucccugagcuggcagauga

SEQ ID NO: 448812 - RNA, 19 nt, Homo sapiens
auacuuagaugaaccuuuc

SEQ ID NO: 448813 - RNA, 19 nt, Homo sapiens
ucagagggcuccacagaag

SEQ ID NO: 448814 - RNA, 19 nt, Homo sapiens
ccacaauggaucaccuuua

SEQ ID NO: 448815 - RNA, 19 nt, Homo sapiens
ggaaccugguggugcuuaa

SEQ ID NO: 448816 - RNA, 19 nt, Homo sapiens
ccucgaaacuaacaacuuc

SEQ ID NO: 448817 - RNA, 19 nt, Homo sapiens
gcuggaauguguuugacuu

SEQ ID NO: 448818 - RNA, 19 nt, Homo sapiens
caacuacucaucucacaga

SEQ ID NO: 448819 - RNA, 19 nt, Homo sapiens
cuauaccgauggagaguuu

SEQ ID NO: 448820 - RNA, 19 nt, Homo sapiens
gcacuggaacaucuucuga

SEQ ID NO: 448821 - RNA, 19 nt, Homo sapiens
ccacauugcugccaacacu

SEQ ID NO: 448822 - RNA, 19 nt, Homo sapiens
caaccacucuccgauggaa

SEQ ID NO: 448823 - RNA, 19 nt, Homo sapiens
guaccuuugucgauuguga

SEQ ID NO: 448824 - RNA, 19 nt, Homo sapiens
gcuggcagaugaccuggaa

SEQ ID NO: 448825 - RNA, 19 nt, Homo sapiens
cagcuugucucagaaguau

SEQ ID NO: 448826 - RNA, 19 nt, Homo sapiens
cacagaugauggagucuuu

SEQ ID NO: 448827 - RNA, 19 nt, Homo sapiens
gauacuggcaagaggauuu

SEQ ID NO: 448828 - RNA, 19 nt, Homo sapiens
gcagaagaaauacuacaau

SEQ ID NO: 448829 - RNA, 19 nt, Homo sapiens
uuggaucccucgaaacuaa

SEQ ID NO: 448830 - RNA, 19 nt, Homo sapiens
gggugaaucugaucuugau

SEQ ID NO: 448831 - RNA, 19 nt, Homo sapiens
gauaggcaacaucgucuuu

SEQ ID NO: 448832 - RNA, 19 nt, Homo sapiens
ccacagaagacaacaaauc

SEQ ID NO: 448833 - RNA, 19 nt, Homo sapiens
ucauuacccuggcauaugu

SEQ ID NO: 448834 - RNA, 19 nt, Homo sapiens
gcagaaggaccaagaagag

SEQ ID NO: 448835 - RNA, 19 nt, Homo sapiens
aggcaaauauggaggagaa

SEQ ID NO: 448836 - RNA, 19 nt, Homo sapiens
gcuauuccuugucauguuc

SEQ ID NO: 448837 - RNA, 19 nt, Homo sapiens
ggaauguguuugacuucau

SEQ ID NO: 448838 - RNA, 19 nt, Homo sapiens
gaaugugucaugaagaugu

SEQ ID NO: 448839 - RNA, 19 nt, Homo sapiens
gguggagacugaugaccaa

SEQ ID NO: 448840 - RNA, 19 nt, Homo sapiens
cuuugucgauugugaauaa

SEQ ID NO: 448841 - RNA, 19 nt, Homo sapiens
acagugacuucaucgcuaa

SEQ ID NO: 448842 - RNA, 19 nt, Homo sapiens
guucaucgcccugcuauug

SEQ ID NO: 448843 - RNA, 19 nt, Homo sapiens
ucaucaagaucaucggaaa

SEQ ID NO: 448844 - RNA, 19 nt, Homo sapiens
uggagaagaugaacaccaa

SEQ ID NO: 448845 - RNA, 19 nt, Homo sapiens
uaacaacuuccgucgcuuu

SEQ ID NO: 448846 - RNA, 19 nt, Homo sapiens
cugaugaaauugaagcaaa

SEQ ID NO: 448847 - RNA, 19 nt, Homo sapiens
ccugaggacuucugggaaa

SEQ ID NO: 448848 - RNA, 19 nt, Homo sapiens
ggaacuggcuggauuuuag

SEQ ID NO: 448849 - RNA, 19 nt, Homo sapiens
uaaaugaguucacguaccu

SEQ ID NO: 448850 - RNA, 19 nt, Homo sapiens
uuugaagccuugauaaaga

SEQ ID NO: 448851 - RNA, 19 nt, Homo sapiens
ucaaggagcugaacuacaa

SEQ ID NO: 448852 - RNA, 19 nt, Homo sapiens
ggcaggagcucaauaaaug

SEQ ID NO: 448853 - RNA, 19 nt, Homo sapiens
gaaauggaguggccaaagu

SEQ ID NO: 448854 - RNA, 19 nt, Homo sapiens
gcagugauguuccuguuga

SEQ ID NO: 448855 - RNA, 19 nt, Homo sapiens
ggaugaaccugccuuuaug

SEQ ID NO: 448856 - RNA, 19 nt, Homo sapiens
ggaaguugcuccaagaaca

SEQ ID NO: 448857 - RNA, 19 nt, Homo sapiens
gguaagggcucaggaaguu

SEQ ID NO: 448858 - RNA, 19 nt, Homo sapiens
gcucagacaccauuacuuu

SEQ ID NO: 448859 - RNA, 19 nt, Homo sapiens
gagcagacccggguaagua

SEQ ID NO: 448860 - RNA, 19 nt, Homo sapiens
caagaacaguagcugauga

SEQ ID NO: 448861 - RNA, 19 nt, Homo sapiens
uggcugagcucgucuuuga

SEQ ID NO: 448862 - RNA, 19 nt, Homo sapiens
gacugaaucuugcccguuu

SEQ ID NO: 448863 - RNA, 19 nt, Homo sapiens
ccagagaacuccuaugcau

SEQ ID NO: 448864 - RNA, 19 nt, Homo sapiens
uauggaaacugcuauacuu

SEQ ID NO: 448865 - RNA, 19 nt, Homo sapiens
acuauaagcuccagguuga

SEQ ID NO: 448866 - RNA, 19 nt, Homo sapiens
cuacaugucugcuugagau

SEQ ID NO: 448867 - RNA, 19 nt, Homo sapiens
gaaggaaacccuggacaga

SEQ ID NO: 448868 - RNA, 19 nt, Homo sapiens
ccuaagaaaccgcugauaa

SEQ ID NO: 448869 - RNA, 19 nt, Homo sapiens
guaggcaggagcucaauaa

SEQ ID NO: 448870 - RNA, 19 nt, Homo sapiens
gcaccauacuuucuuguac

SEQ ID NO: 448871 - RNA, 19 nt, Homo sapiens
gaacgcuucugccacaucu

SEQ ID NO: 448872 - RNA, 19 nt, Homo sapiens
gcgcagagcagaaugacuu

SEQ ID NO: 448873 - RNA, 19 nt, Homo sapiens
acagguacccggaaauuaa

SEQ ID NO: 448874 - RNA, 19 nt, Homo sapiens
ucaggaaguugcuccaaga

SEQ ID NO: 448875 - RNA, 19 nt, Homo sapiens
ggagcucaauaaauguuug

SEQ ID NO: 448876 - RNA, 19 nt, Homo sapiens
ugaugaagcugcccagaag

SEQ ID NO: 448877 - RNA, 19 nt, Homo sapiens
uaucgcgacagaacaauua

SEQ ID NO: 448878 - RNA, 19 nt, Homo sapiens
caugucugcuugagauauu

SEQ ID NO: 448879 - RNA, 19 nt, Homo sapiens
gcucucugcugguuacuca

SEQ ID NO: 448880 - RNA, 19 nt, Homo sapiens
gcuauacuuucaaugacaa

SEQ ID NO: 448881 - RNA, 19 nt, Homo sapiens
gaaucuugcccguuuaugu

SEQ ID NO: 448882 - RNA, 19 nt, Homo sapiens
cagaugcuaucgcgacaga

SEQ ID NO: 448883 - RNA, 19 nt, Homo sapiens
cagcacaaccgcaugaaga

SEQ ID NO: 448884 - RNA, 19 nt, Homo sapiens
gcuccucgguguugucugu

SEQ ID NO: 448885 - RNA, 19 nt, Homo sapiens
gcaccaagaauggcaguga

SEQ ID NO: 448886 - RNA, 19 nt, Homo sapiens
uauguaugcuccaugucua

SEQ ID NO: 448887 - RNA, 19 nt, Homo sapiens
accgagagcucuucgaguu

SEQ ID NO: 448888 - RNA, 19 nt, Homo sapiens
aaucuugcccguuuaugua

SEQ ID NO: 448889 - RNA, 19 nt, Homo sapiens
uuagaacccugcucagaca

SEQ ID NO: 448890 - RNA, 19 nt, Homo sapiens
uuucauaccucuacauguc

SEQ ID NO: 448891 - RNA, 19 nt, Homo sapiens
caaagucaacaucuucuuc

SEQ ID NO: 448892 - RNA, 19 nt, Homo sapiens
acaauuacaccgucaacaa

SEQ ID NO: 448893 - RNA, 19 nt, Homo sapiens
cagaccaccugggcuguuu

SEQ ID NO: 448894 - RNA, 19 nt, Homo sapiens
caacugcggcuaagucucu

SEQ ID NO: 448895 - RNA, 19 nt, Homo sapiens
gcccauaccaggucucaug

SEQ ID NO: 448896 - RNA, 19 nt, Homo sapiens
ccucugaacacucugguuu

SEQ ID NO: 448897 - RNA, 19 nt, Homo sapiens
uauggaugaugguggcuuu

SEQ ID NO: 448898 - RNA, 19 nt, Homo sapiens
gcucaauaaauguuuguug

SEQ ID NO: 448899 - RNA, 19 nt, Homo sapiens
guagcacacuauaacaucu

SEQ ID NO: 448900 - RNA, 19 nt, Homo sapiens
caucuugucuuccccaaaa

SEQ ID NO: 448901 - RNA, 19 nt, Homo sapiens
caccauacuuucuuguaca

SEQ ID NO: 448902 - RNA, 19 nt, Homo sapiens
gagaaccuuuacccuucaa

SEQ ID NO: 448903 - RNA, 19 nt, Homo sapiens
guuuauguaugcuccaugu

SEQ ID NO: 448904 - RNA, 19 nt, Homo sapiens
cuucccaacuagacuguaa

SEQ ID NO: 448905 - RNA, 19 nt, Homo sapiens
guguugcuguugcaccaua

SEQ ID NO: 448906 - RNA, 19 nt, Homo sapiens
caacaacaagagaaaugga

SEQ ID NO: 448907 - RNA, 19 nt, Homo sapiens
cagcagguguguauucacu

SEQ ID NO: 448908 - RNA, 19 nt, Homo sapiens
ugagaaccuuuacccuuca

SEQ ID NO: 448909 - RNA, 19 nt, Homo sapiens
gaugucugcuccuccucuu

SEQ ID NO: 448910 - RNA, 19 nt, Homo sapiens
caagaauggcagugauguu

SEQ ID NO: 448911 - RNA, 19 nt, Homo sapiens
gcaaccaggcgaauuacuc

SEQ ID NO: 448912 - RNA, 19 nt, Homo sapiens
caaaucggacugcuucuac

SEQ ID NO: 448913 - RNA, 19 nt, Homo sapiens
aaacuuggagcuuugacaa

SEQ ID NO: 448914 - RNA, 19 nt, Homo sapiens
gaaacuuggagcuuugaca

SEQ ID NO: 448915 - RNA, 19 nt, Homo sapiens
ccaaacugccguugaugug

SEQ ID NO: 448916 - RNA, 19 nt, Homo sapiens
ggcaugauguacuggcaau

SEQ ID NO: 448917 - RNA, 19 nt, Homo sapiens
caaguaggcaggagcucaa

SEQ ID NO: 448918 - RNA, 19 nt, Homo sapiens
gugucucccuucccaacua

SEQ ID NO: 448919 - RNA, 19 nt, Homo sapiens
cuaagaaaccgcugauaac

SEQ ID NO: 448920 - RNA, 19 nt, Homo sapiens
ccaugucucuguccuuguc

SEQ ID NO: 448921 - RNA, 19 nt, Homo sapiens
ggccaaagucaacaucuuc

SEQ ID NO: 448922 - RNA, 19 nt, Homo sapiens
gaacaauuacaccgucaac

SEQ ID NO: 448923 - RNA, 19 nt, Homo sapiens
ggaugaugguggcuuuaac

SEQ ID NO: 448924 - RNA, 19 nt, Homo sapiens
aggaugaaccugccuuuau

SEQ ID NO: 448925 - RNA, 19 nt, Homo sapiens
gcaccuuuggcaugaugua

SEQ ID NO: 448926 - RNA, 19 nt, Homo sapiens
ggacugcuucuaccagaca

SEQ ID NO: 448927 - RNA, 19 nt, Homo sapiens
cuacagguacccggaaauu

SEQ ID NO: 448928 - RNA, 19 nt, Homo sapiens
gcaggagcucaauaaaugu

SEQ ID NO: 448929 - RNA, 19 nt, Homo sapiens
gcagacccggguaaguaaa

SEQ ID NO: 448930 - RNA, 19 nt, Homo sapiens
cgagagcucuucgaguucu

SEQ ID NO: 448931 - RNA, 19 nt, Homo sapiens
cagguacccggaaauuaaa

SEQ ID NO: 448932 - RNA, 19 nt, Homo sapiens
uggcaagauugaaggaugu

SEQ ID NO: 448933 - RNA, 19 nt, Homo sapiens
gagcugaacuacaaaacca

SEQ ID NO: 448934 - RNA, 19 nt, Homo sapiens
aggaggcccugaucgaguu

SEQ ID NO: 448935 - RNA, 19 nt, Homo sapiens
uauggcgacugcaccaaga

SEQ ID NO: 448936 - RNA, 19 nt, Homo sapiens
uggcagugauguuccuguu

SEQ ID NO: 448937 - RNA, 19 nt, Homo sapiens
gggcucccguagcacacua

SEQ ID NO: 448938 - RNA, 19 nt, Homo sapiens
gaguguggcugugccuaca

SEQ ID NO: 448939 - RNA, 19 nt, Homo sapiens
gaauggcagugauguuccu

SEQ ID NO: 448940 - RNA, 19 nt, Homo sapiens
uacagguacccggaaauua

SEQ ID NO: 448941 - RNA, 19 nt, Homo sapiens
gaguucuucugcaacaaca

SEQ ID NO: 448942 - RNA, 19 nt, Homo sapiens
ugagagggaaggagagguu

SEQ ID NO: 448943 - RNA, 19 nt, Homo sapiens
gaagguuccgaagccgaua

SEQ ID NO: 448944 - RNA, 19 nt, Homo sapiens
aaagucaacaucuucuuca

SEQ ID NO: 448945 - RNA, 19 nt, Homo sapiens
caccaagaauggcagugau

SEQ ID NO: 448946 - RNA, 19 nt, Homo sapiens
gcaacaacaccaccaucca

SEQ ID NO: 448947 - RNA, 19 nt, Homo sapiens
ggaaucaacaacggucugu

SEQ ID NO: 448948 - RNA, 19 nt, Homo sapiens
gaucagccaagcgaaacuu

SEQ ID NO: 448949 - RNA, 19 nt, Homo sapiens
gaaguugcuccaagaacag

SEQ ID NO: 448950 - RNA, 19 nt, Homo sapiens
caaaaccaauucugagucu

SEQ ID NO: 448951 - RNA, 19 nt, Homo sapiens
caagggcucugaagaauca

SEQ ID NO: 448952 - RNA, 19 nt, Homo sapiens
ccaaguggcaccugauuua

SEQ ID NO: 448953 - RNA, 19 nt, Homo sapiens
gaccaaagcaccaauauca

SEQ ID NO: 448954 - RNA, 19 nt, Homo sapiens
ggccagagcuuguguccuu

SEQ ID NO: 448955 - RNA, 19 nt, Homo sapiens
caacaucuacuuccaagaa

SEQ ID NO: 448956 - RNA, 19 nt, Homo sapiens
gaacuucacguccaucuuc

SEQ ID NO: 448957 - RNA, 19 nt, Homo sapiens
gguacaggauacaggaaua

SEQ ID NO: 448958 - RNA, 19 nt, Homo sapiens
gcaaugacacccaguacaa

SEQ ID NO: 448959 - RNA, 19 nt, Homo sapiens
gagcugagcccugcaacua

SEQ ID NO: 448960 - RNA, 19 nt, Homo sapiens
gaacugaauucggccugaa

SEQ ID NO: 448961 - RNA, 19 nt, Homo sapiens
caaccacaauggcuuaaca

SEQ ID NO: 448962 - RNA, 19 nt, Homo sapiens
gagcuuguguccuucaaca

SEQ ID NO: 448963 - RNA, 19 nt, Homo sapiens
gaauucggccugaaguuga

SEQ ID NO: 448964 - RNA, 19 nt, Homo sapiens
ggaagggaauugucaagcu

SEQ ID NO: 448965 - RNA, 19 nt, Homo sapiens
gauccuggccugccuauuc

SEQ ID NO: 448966 - RNA, 19 nt, Homo sapiens
ccaagcgcaucaucuguga

SEQ ID NO: 448967 - RNA, 19 nt, Homo sapiens
caggauacaggaauaaauu

SEQ ID NO: 448968 - RNA, 19 nt, Homo sapiens
gccaagggcucugaagaau

SEQ ID NO: 448969 - RNA, 19 nt, Homo sapiens
ggccaacccuggaacugaa

SEQ ID NO: 448970 - RNA, 19 nt, Homo sapiens
ggaccuggaugagcugaug

SEQ ID NO: 448971 - RNA, 19 nt, Homo sapiens
gcaccugauuuacucuaga

SEQ ID NO: 448972 - RNA, 19 nt, Homo sapiens
ggagaucaucaucgacuuu

SEQ ID NO: 448973 - RNA, 19 nt, Homo sapiens
gaaguugauccuggacaua

SEQ ID NO: 448974 - RNA, 19 nt, Homo sapiens
ggaagggcaucagguguag

SEQ ID NO: 448975 - RNA, 19 nt, Homo sapiens
ggagaaauacugcaacaac

SEQ ID NO: 448976 - RNA, 19 nt, Homo sapiens
cuaugcacgugaagaagua

SEQ ID NO: 448977 - RNA, 19 nt, Homo sapiens
gaagaaucagcagccaaua

SEQ ID NO: 448978 - RNA, 19 nt, Homo sapiens
caucuacuuccaagaauuu

SEQ ID NO: 448979 - RNA, 19 nt, Homo sapiens
gcaggccaccaacaucuuu

SEQ ID NO: 448980 - RNA, 19 nt, Homo sapiens
caugguccuugaucucuuu

SEQ ID NO: 448981 - RNA, 19 nt, Homo sapiens
gagcuaagccaugccaaug

SEQ ID NO: 448982 - RNA, 19 nt, Homo sapiens
guacaggauacaggaauaa

SEQ ID NO: 448983 - RNA, 19 nt, Homo sapiens
ccacuaugcacgugaagaa

SEQ ID NO: 448984 - RNA, 19 nt, Homo sapiens
agacaaccacaauggcuua

SEQ ID NO: 448985 - RNA, 19 nt, Homo sapiens
ggccaagggcucugaagaa

SEQ ID NO: 448986 - RNA, 19 nt, Homo sapiens
ggacauaggccaggaagac

SEQ ID NO: 448987 - RNA, 19 nt, Homo sapiens
uggcaacuguuacaucuuc

SEQ ID NO: 448988 - RNA, 19 nt, Homo sapiens
caccugauuuacucuagaa

SEQ ID NO: 448989 - RNA, 19 nt, Homo sapiens
ggaauugucaagcucaaca

SEQ ID NO: 448990 - RNA, 19 nt, Homo sapiens
gcccauugcuacucagauc

SEQ ID NO: 448991 - RNA, 19 nt, Homo sapiens
aagaaucagcagccaauaa

SEQ ID NO: 448992 - RNA, 19 nt, Homo sapiens
ggauacaggaauaaauugu

SEQ ID NO: 448993 - RNA, 19 nt, Homo sapiens
gaucaucaucgacuuugug

SEQ ID NO: 448994 - RNA, 19 nt, Homo sapiens
agaagaaagccaugugguu

SEQ ID NO: 448995 - RNA, 19 nt, Homo sapiens
gaagcuguccuggagagaa

SEQ ID NO: 448996 - RNA, 19 nt, Homo sapiens
gucaccaucugcaaugcua

SEQ ID NO: 448997 - RNA, 19 nt, Homo sapiens
uauggcaacuguuacaucu

SEQ ID NO: 448998 - RNA, 19 nt, Homo sapiens
gaagaaguaccugcugaag

SEQ ID NO: 448999 - RNA, 19 nt, Homo sapiens
aaucaacggugcugguaca

SEQ ID NO: 449000 - RNA, 19 nt, Homo sapiens
ugaagaaucagcagccaau

SEQ ID NO: 449001 - RNA, 19 nt, Homo sapiens
uuaacuaucgcaccauuga

SEQ ID NO: 449002 - RNA, 19 nt, Homo sapiens
aaccugaacuucuccaucu

SEQ ID NO: 449003 - RNA, 19 nt, Homo sapiens
gggagaucaucaucgacuu

SEQ ID NO: 449004 - RNA, 19 nt, Homo sapiens
ggaccaaagcaccaauauc

SEQ ID NO: 449005 - RNA, 19 nt, Homo sapiens
aagaccacaugauccguaa

SEQ ID NO: 449006 - RNA, 19 nt, Homo sapiens
gagacuauguagccucaac

SEQ ID NO: 449007 - RNA, 19 nt, Homo sapiens
gguccuugaucucuuugga

SEQ ID NO: 449008 - RNA, 19 nt, Homo sapiens
gagaucaucaucgacuuug

SEQ ID NO: 449009 - RNA, 19 nt, Homo sapiens
caucuucuacccucacuau

SEQ ID NO: 449010 - RNA, 19 nt, Homo sapiens
uggaagggcaucaggugua

SEQ ID NO: 449011 - RNA, 19 nt, Homo sapiens
gcaggaagggaauugucaa

SEQ ID NO: 449012 - RNA, 19 nt, Homo sapiens
ugaaguugauccuggacau

SEQ ID NO: 449013 - RNA, 19 nt, Homo sapiens
ugaauucggccugaaguug

SEQ ID NO: 449014 - RNA, 19 nt, Homo sapiens
ggaggcccacaccaacuuu

SEQ ID NO: 449015 - RNA, 19 nt, Homo sapiens
acaucuacuuccaagaauu

SEQ ID NO: 449016 - RNA, 19 nt, Homo sapiens
uugucaagcucaacaucua

SEQ ID NO: 449017 - RNA, 19 nt, Homo sapiens
ccgagcaggugccacuaug

SEQ ID NO: 449018 - RNA, 19 nt, Homo sapiens
gagggcaucuacgccaugu

SEQ ID NO: 449019 - RNA, 19 nt, Homo sapiens
gucccuaccuguccugauc

SEQ ID NO: 449020 - RNA, 19 nt, Homo sapiens
agcggcaacugguccguua

SEQ ID NO: 449021 - RNA, 19 nt, Homo sapiens
gcucaacaucuacuuccaa

SEQ ID NO: 449022 - RNA, 19 nt, Homo sapiens
ccaagaagaaagccaugug

SEQ ID NO: 449023 - RNA, 19 nt, Homo sapiens
guauggugcccucuccaaa

SEQ ID NO: 449024 - RNA, 19 nt, Homo sapiens
ucacugagcagccaagacu

SEQ ID NO: 449025 - RNA, 19 nt, Homo sapiens
gagcaggugccacuaugca

SEQ ID NO: 449026 - RNA, 19 nt, Homo sapiens
gacacccaguacaagauga

SEQ ID NO: 449027 - RNA, 19 nt, Homo sapiens
aggagcugcugguguggua

SEQ ID NO: 449028 - RNA, 19 nt, Homo sapiens
gcuuguguccuucaacaga

SEQ ID NO: 449029 - RNA, 19 nt, Homo sapiens
ucgcaccauugaagaauca

SEQ ID NO: 449030 - RNA, 19 nt, Homo sapiens
ugaagaaguaccugcugaa

SEQ ID NO: 449031 - RNA, 19 nt, Homo sapiens
aagcuguccuggagagaau

SEQ ID NO: 449032 - RNA, 19 nt, Homo sapiens
uccaagaauuuaacuaucg

SEQ ID NO: 449033 - RNA, 19 nt, Homo sapiens
caguguaccuuccggaacu

SEQ ID NO: 449034 - RNA, 19 nt, Homo sapiens
acuguuacaucuucaacug

SEQ ID NO: 449035 - RNA, 19 nt, Homo sapiens
caaaauggccaugagacua

SEQ ID NO: 449036 - RNA, 19 nt, Homo sapiens
gaaucagcagccaauaaca

SEQ ID NO: 449037 - RNA, 19 nt, Homo sapiens
gagcaggaagggaauuguc

SEQ ID NO: 449038 - RNA, 19 nt, Homo sapiens
gggaccaaagcaccaauau

SEQ ID NO: 449039 - RNA, 19 nt, Homo sapiens
ccauugcuacucagaucua

SEQ ID NO: 449040 - RNA, 19 nt, Homo sapiens
agcaggagcuaguagagau

SEQ ID NO: 449041 - RNA, 19 nt, Homo sapiens
aagcagcucagcaucagaa

SEQ ID NO: 449042 - RNA, 19 nt, Homo sapiens
uaucuucaccugguuccua

SEQ ID NO: 449043 - RNA, 19 nt, Homo sapiens
agaaucaacggugcuggua

SEQ ID NO: 449044 - RNA, 19 nt, Homo sapiens
ggaucaccaucaucaagcu

SEQ ID NO: 449045 - RNA, 19 nt, Homo sapiens
cagacugggcccauugcua

SEQ ID NO: 449046 - RNA, 19 nt, Homo sapiens
gcuagccccuucaaguauu

SEQ ID NO: 449047 - RNA, 19 nt, Homo sapiens
gcaacuguuacaucuucaa

SEQ ID NO: 449048 - RNA, 19 nt, Homo sapiens
gcaggagcuaguagagaug

SEQ ID NO: 449049 - RNA, 19 nt, Homo sapiens
ccagugcuacccaggcauu

SEQ ID NO: 449050 - RNA, 19 nt, Homo sapiens
ccaugguccuugaucucuu

SEQ ID NO: 449051 - RNA, 19 nt, Homo sapiens
gaacauugacucccuguac

SEQ ID NO: 449052 - RNA, 19 nt, Homo sapiens
caucagagccacagacaga

SEQ ID NO: 449053 - RNA, 19 nt, Homo sapiens
caacgucaaccucagcaaa

SEQ ID NO: 449054 - RNA, 19 nt, Homo sapiens
gcaucagggucaugguuca

SEQ ID NO: 449055 - RNA, 19 nt, Homo sapiens
gguaccacuuccacuaugu

SEQ ID NO: 449056 - RNA, 19 nt, Homo sapiens
cagggagucugcauucaag

SEQ ID NO: 449057 - RNA, 19 nt, Homo sapiens
ggagcagccuggccaaaau

SEQ ID NO: 449058 - RNA, 19 nt, Homo sapiens
gccagaggccagucagaug

SEQ ID NO: 449059 - RNA, 19 nt, Homo sapiens
aaaucaacaucgucuacca

SEQ ID NO: 449060 - RNA, 19 nt, Homo sapiens
ggagcugcuggacgaguuu

SEQ ID NO: 449061 - RNA, 19 nt, Homo sapiens
uggagcugcuggacgaguu

SEQ ID NO: 449062 - RNA, 19 nt, Homo sapiens
aacauugacucccuguaca

SEQ ID NO: 449063 - RNA, 19 nt, Homo sapiens
cuacacaacaccuccuaca

SEQ ID NO: 449064 - RNA, 19 nt, Homo sapiens
gaggagcagccuggccaaa

SEQ ID NO: 449065 - RNA, 19 nt, Homo sapiens
gaacagagauugagacaac

SEQ ID NO: 449066 - RNA, 19 nt, Homo sapiens
caaaugaucuucccacuuc

SEQ ID NO: 449067 - RNA, 19 nt, Homo sapiens
gcacagaaagauuaaguua

SEQ ID NO: 449068 - RNA, 19 nt, Homo sapiens
ccaacuggauguauuguua

SEQ ID NO: 449069 - RNA, 19 nt, Homo sapiens
caacaauggucaccucuau

SEQ ID NO: 449070 - RNA, 19 nt, Homo sapiens
agacaaagaugguggagaa

SEQ ID NO: 449071 - RNA, 19 nt, Homo sapiens
gaaaugauaugagauucga

SEQ ID NO: 449072 - RNA, 19 nt, Homo sapiens
caaagaugguggagaaaug

SEQ ID NO: 449073 - RNA, 19 nt, Homo sapiens
ggacugaugcagcucuuua

SEQ ID NO: 449074 - RNA, 19 nt, Homo sapiens
ccacaagccuggcacaaug

SEQ ID NO: 449075 - RNA, 19 nt, Homo sapiens
ggauauagacgaugaccua

SEQ ID NO: 449076 - RNA, 19 nt, Homo sapiens
gguauaagcuacacuacau

SEQ ID NO: 449077 - RNA, 19 nt, Homo sapiens
caacugugcucaaaugaca

SEQ ID NO: 449078 - RNA, 19 nt, Homo sapiens
gaauuccagugucuauaaa

SEQ ID NO: 449079 - RNA, 19 nt, Homo sapiens
aaacuguucuucaucauug

SEQ ID NO: 449080 - RNA, 19 nt, Homo sapiens
guacauaaacgaagaggaa

SEQ ID NO: 449081 - RNA, 19 nt, Homo sapiens
ucacaaggcuucaaauguc

SEQ ID NO: 449082 - RNA, 19 nt, Homo sapiens
gggaauugcuauacuuuca

SEQ ID NO: 449083 - RNA, 19 nt, Homo sapiens
cagcaacacucacaacugu

SEQ ID NO: 449084 - RNA, 19 nt, Homo sapiens
uggagccgcuugugaauaa

SEQ ID NO: 449085 - RNA, 19 nt, Homo sapiens
gcucacagaugacccacuu

SEQ ID NO: 449086 - RNA, 19 nt, Homo sapiens
gcaaacgacugugucacuu

SEQ ID NO: 449087 - RNA, 19 nt, Homo sapiens
gagcuaaggugaucaucca

SEQ ID NO: 449088 - RNA, 19 nt, Homo sapiens
gaauaugggcugcaaguca

SEQ ID NO: 449089 - RNA, 19 nt, Homo sapiens
gcucacagauacccagaug

SEQ ID NO: 449090 - RNA, 19 nt, Homo sapiens
cgaauuccagugucuauaa

SEQ ID NO: 449091 - RNA, 19 nt, Homo sapiens
caagccaacugcucacaga

SEQ ID NO: 449092 - RNA, 19 nt, Homo sapiens
gccaaacucuugauauucu

SEQ ID NO: 449093 - RNA, 19 nt, Homo sapiens
gccaacugcucacagauga

SEQ ID NO: 449094 - RNA, 19 nt, Homo sapiens
aaacgacugugucacuuug

SEQ ID NO: 449095 - RNA, 19 nt, Homo sapiens
ggacagcuacugccagaug

SEQ ID NO: 449096 - RNA, 19 nt, Homo sapiens
ccaaccagcucacagauac

SEQ ID NO: 449097 - RNA, 19 nt, Homo sapiens
uggccaaacucuugauauu

SEQ ID NO: 449098 - RNA, 19 nt, Homo sapiens
gaagaugugggaacagaga

SEQ ID NO: 449099 - RNA, 19 nt, Homo sapiens
ccaagcaaguggugggauu

SEQ ID NO: 449100 - RNA, 19 nt, Homo sapiens
uggcagagcuaggauuuga

SEQ ID NO: 449101 - RNA, 19 nt, Homo sapiens
cuccagaucugccuucauu

SEQ ID NO: 449102 - RNA, 19 nt, Homo sapiens
ggucaccucuauaggaaug

SEQ ID NO: 449103 - RNA, 19 nt, Homo sapiens
gaggagccaucggguacua

SEQ ID NO: 449104 - RNA, 19 nt, Homo sapiens
gaucaucgaggucuucuuc

SEQ ID NO: 449105 - RNA, 19 nt, Homo sapiens
gccaggaauuucacgcuuu

SEQ ID NO: 449106 - RNA, 19 nt, Homo sapiens
gcaggugacccaagacaga

SEQ ID NO: 449107 - RNA, 19 nt, Homo sapiens
ccaacugcaucgagccuuu

SEQ ID NO: 449108 - RNA, 19 nt, Homo sapiens
ggaaugcaccugacagagu

SEQ ID NO: 449109 - RNA, 19 nt, Homo sapiens
gauggaguguccugugaug

SEQ ID NO: 449110 - RNA, 19 nt, Homo sapiens
guccaugaacuaagaauuu

SEQ ID NO: 449111 - RNA, 19 nt, Homo sapiens
acgaugaccuacccacuuu

SEQ ID NO: 449112 - RNA, 19 nt, Homo sapiens
gcuggugaccugcuucuuu

SEQ ID NO: 449113 - RNA, 19 nt, Homo sapiens
ggaaagcagccuagauucu

SEQ ID NO: 449114 - RNA, 19 nt, Homo sapiens
gauaugagauucgaauucc

SEQ ID NO: 449115 - RNA, 19 nt, Homo sapiens
gaaagugccagcccugaag

SEQ ID NO: 449116 - RNA, 19 nt, Homo sapiens
cagcugggccuguggauga

SEQ ID NO: 449117 - RNA, 19 nt, Homo sapiens
gaacuccuggccucaaaug

SEQ ID NO: 449118 - RNA, 19 nt, Homo sapiens
gguacugccucaacaccaa

SEQ ID NO: 449119 - RNA, 19 nt, Homo sapiens
gaauaaacuguucuucauc

SEQ ID NO: 449120 - RNA, 19 nt, Homo sapiens
ccaaacucuugauauucua

SEQ ID NO: 449121 - RNA, 19 nt, Homo sapiens
ugagugagcccuccaguca

SEQ ID NO: 449122 - RNA, 19 nt, Homo sapiens
gaaagcagccuagauucuc

SEQ ID NO: 449123 - RNA, 19 nt, Homo sapiens
cuccagcuaucagguauua

SEQ ID NO: 449124 - RNA, 19 nt, Homo sapiens
caaacgacugugucacuuu

SEQ ID NO: 449125 - RNA, 19 nt, Homo sapiens
caagugaaggccagaguga

SEQ ID NO: 449126 - RNA, 19 nt, Homo sapiens
gagaagacagaucuaguca

SEQ ID NO: 449127 - RNA, 19 nt, Homo sapiens
ucauugacuucuucucuau

SEQ ID NO: 449128 - RNA, 19 nt, Homo sapiens
ugucucaguuuccaucaaa

SEQ ID NO: 449129 - RNA, 19 nt, Homo sapiens
caucugugguuucggagaa

SEQ ID NO: 449130 - RNA, 19 nt, Homo sapiens
gauguauuguuacuaccaa

SEQ ID NO: 449131 - RNA, 19 nt, Homo sapiens
gcaagucauuuuguacaua

SEQ ID NO: 449132 - RNA, 19 nt, Homo sapiens
caugggaauugcuauacuu

SEQ ID NO: 449133 - RNA, 19 nt, Homo sapiens
ggagugacgugccaaucag

SEQ ID NO: 449134 - RNA, 19 nt, Homo sapiens
gaauugcuauacuuucaac

SEQ ID NO: 449135 - RNA, 19 nt, Homo sapiens
gagauucgaauuccagugu

SEQ ID NO: 449136 - RNA, 19 nt, Homo sapiens
gaaccagagauccaucaug

SEQ ID NO: 449137 - RNA, 19 nt, Homo sapiens
agacuuggccaaacucuug

SEQ ID NO: 449138 - RNA, 19 nt, Homo sapiens
ccuucuagcugacuuggaa

SEQ ID NO: 449139 - RNA, 19 nt, Homo sapiens
gauuccaacugugcucaaa

SEQ ID NO: 449140 - RNA, 19 nt, Homo sapiens
ccagagaggcccugaaguc

SEQ ID NO: 449141 - RNA, 19 nt, Homo sapiens
ccacaccaaaucccuguuu

SEQ ID NO: 449142 - RNA, 19 nt, Homo sapiens
agacagacuuggccaaacu

SEQ ID NO: 449143 - RNA, 19 nt, Homo sapiens
caauggccaucugugguuu

SEQ ID NO: 449144 - RNA, 19 nt, Homo sapiens
acagaaagauuaaguuacc

SEQ ID NO: 449145 - RNA, 19 nt, Homo sapiens
gagcccagccaacaguauu

SEQ ID NO: 449146 - RNA, 19 nt, Homo sapiens
uaaacgaagaggaauacaa

SEQ ID NO: 449147 - RNA, 19 nt, Homo sapiens
gagaagaaaaucaacauga

SEQ ID NO: 449148 - RNA, 19 nt, Homo sapiens
ggagaagaucaaagccaaa

SEQ ID NO: 449149 - RNA, 19 nt, Homo sapiens
ccaccugacuccagcuauc

SEQ ID NO: 449150 - RNA, 19 nt, Homo sapiens
gguggcagagcuaggauuu

SEQ ID NO: 449151 - RNA, 19 nt, Homo sapiens
gagccuuuguccaggaaga

SEQ ID NO: 449152 - RNA, 19 nt, Homo sapiens
cuggugaccugcuucuuug

SEQ ID NO: 449153 - RNA, 19 nt, Homo sapiens
guggugggauuccaacugu

SEQ ID NO: 449154 - RNA, 19 nt, Homo sapiens
cacaaggcuucaaauguca

SEQ ID NO: 449155 - RNA, 19 nt, Homo sapiens
aaauugaggcacagaaaga

SEQ ID NO: 449156 - RNA, 19 nt, Homo sapiens
ccaaagauaggagaaagug

SEQ ID NO: 449157 - RNA, 19 nt, Homo sapiens
ugacuucuucucuaucauu

SEQ ID NO: 449158 - RNA, 19 nt, Homo sapiens
caucgaggucuucuucauu

SEQ ID NO: 449159 - RNA, 19 nt, Homo sapiens
caacaguauugagaugcuu

SEQ ID NO: 449160 - RNA, 19 nt, Homo sapiens
gaucaaagccaaaaucaag

SEQ ID NO: 449161 - RNA, 19 nt, Homo sapiens
gggagugacgugccaauca

SEQ ID NO: 449162 - RNA, 19 nt, Homo sapiens
ucgaagaugugggaacaga

SEQ ID NO: 449163 - RNA, 19 nt, Homo sapiens
ggaauugcuauacuuucaa

SEQ ID NO: 449164 - RNA, 19 nt, Homo sapiens
gcaugggaauugcuauacu

SEQ ID NO: 449165 - RNA, 19 nt, Homo sapiens
agaaauagcugcuucaauu

SEQ ID NO: 449166 - RNA, 19 nt, Homo sapiens
gaaacugucucgcauagga

SEQ ID NO: 449167 - RNA, 19 nt, Homo sapiens
ggacgaagaugaagacuac

SEQ ID NO: 449168 - RNA, 19 nt, Homo sapiens
cauaguggaucacacaaua

SEQ ID NO: 449169 - RNA, 19 nt, Homo sapiens
gagaagaggucgaucaagu

SEQ ID NO: 449170 - RNA, 19 nt, Homo sapiens
aagaagccaucgcaaauua

SEQ ID NO: 449171 - RNA, 19 nt, Homo sapiens
ggucagugguuauugauuu

SEQ ID NO: 449172 - RNA, 19 nt, Homo sapiens
gaaugaagcacgucaagaa

SEQ ID NO: 449173 - RNA, 19 nt, Homo sapiens
gaggaaaucuauuguuugg

SEQ ID NO: 449174 - RNA, 19 nt, Homo sapiens
gauggugaguuucuagauu

SEQ ID NO: 449175 - RNA, 19 nt, Homo sapiens
ggaucaagcugaagugaag

SEQ ID NO: 449176 - RNA, 19 nt, Homo sapiens
caagaggaagggagaaaua

SEQ ID NO: 449177 - RNA, 19 nt, Homo sapiens
gaaauagcugcuucaauug

SEQ ID NO: 449178 - RNA, 19 nt, Homo sapiens
caucgcaaauuaugugaaa

SEQ ID NO: 449179 - RNA, 19 nt, Homo sapiens
gaagaggaaaucuauuguu

SEQ ID NO: 449180 - RNA, 19 nt, Homo sapiens
ugaagcacgucaagaaaga

SEQ ID NO: 449181 - RNA, 19 nt, Homo sapiens
ggauauugaucacgagugu

SEQ ID NO: 449182 - RNA, 19 nt, Homo sapiens
ccacacacaugaggccaua

SEQ ID NO: 449183 - RNA, 19 nt, Homo sapiens
cuacuugggucagugguua

SEQ ID NO: 449184 - RNA, 19 nt, Homo sapiens
uaaguggugugccagguuu

SEQ ID NO: 449185 - RNA, 19 nt, Homo sapiens
guggaucacacaauaauaa

SEQ ID NO: 449186 - RNA, 19 nt, Homo sapiens
gucagugguuauugauuua

SEQ ID NO: 449187 - RNA, 19 nt, Homo sapiens
ucaagucguggaugaaaua

SEQ ID NO: 449188 - RNA, 19 nt, Homo sapiens
caaccaaaauugauucuug

SEQ ID NO: 449189 - RNA, 19 nt, Homo sapiens
cagagaaguuagagaagga

SEQ ID NO: 449190 - RNA, 19 nt, Homo sapiens
gagcuuuacuggcuggaau

SEQ ID NO: 449191 - RNA, 19 nt, Homo sapiens
gaagugaagccagugaaga

SEQ ID NO: 449192 - RNA, 19 nt, Homo sapiens
auggugaguuucuagauua

SEQ ID NO: 449193 - RNA, 19 nt, Homo sapiens
gcaguauucucuugcuaag

SEQ ID NO: 449194 - RNA, 19 nt, Homo sapiens
cgaagaugaagacuacaua

SEQ ID NO: 449195 - RNA, 19 nt, Homo sapiens
ggauuguacuuuguguaaa

SEQ ID NO: 449196 - RNA, 19 nt, Homo sapiens
uauacuggauuguacuuug

SEQ ID NO: 449197 - RNA, 19 nt, Homo sapiens
cuacagaauggccuucaua

SEQ ID NO: 449198 - RNA, 19 nt, Homo sapiens
gaagccaucgcaaauuaug

SEQ ID NO: 449199 - RNA, 19 nt, Homo sapiens
gagagaagaggucgaucaa

SEQ ID NO: 449200 - RNA, 19 nt, Homo sapiens
gaagaugaagacuacauag

SEQ ID NO: 449201 - RNA, 19 nt, Homo sapiens
guacuugauuggaccagau

SEQ ID NO: 449202 - RNA, 19 nt, Homo sapiens
guucuuugcucuucugagu

SEQ ID NO: 449203 - RNA, 19 nt, Homo sapiens
ucaauugccacacacauga

SEQ ID NO: 449204 - RNA, 19 nt, Homo sapiens
ugauucaagucguggauga

SEQ ID NO: 449205 - RNA, 19 nt, Homo sapiens
cuaguacccggacgaguua

SEQ ID NO: 449206 - RNA, 19 nt, Homo sapiens
cagaauggccuucauacca

SEQ ID NO: 449207 - RNA, 19 nt, Homo sapiens
gagaaauagcugcuucaau

SEQ ID NO: 449208 - RNA, 19 nt, Homo sapiens
cagaagaacuagaaaagau

SEQ ID NO: 449209 - RNA, 19 nt, Homo sapiens
cuaaugaagaggaaaucua

SEQ ID NO: 449210 - RNA, 19 nt, Homo sapiens
ggaaugaagcacgucaaga

SEQ ID NO: 449211 - RNA, 19 nt, Homo sapiens
auucagaguugaugcuuga

SEQ ID NO: 449212 - RNA, 19 nt, Homo sapiens
guugcuggaugcaguauuc

SEQ ID NO: 449213 - RNA, 19 nt, Homo sapiens
ucauugcccugaugucugu

SEQ ID NO: 449214 - RNA, 19 nt, Homo sapiens
aaagaagccaucgcaaauu

SEQ ID NO: 449215 - RNA, 19 nt, Homo sapiens
aaacugacaaggacuacuu

SEQ ID NO: 449216 - RNA, 19 nt, Homo sapiens
cacaugaggccauacagaa

SEQ ID NO: 449217 - RNA, 19 nt, Homo sapiens
gaacaagaggaagggagaa

SEQ ID NO: 449218 - RNA, 19 nt, Homo sapiens
caaaagaagccaucgcaaa

SEQ ID NO: 449219 - RNA, 19 nt, Homo sapiens
gcuugccucuucuugaguu

SEQ ID NO: 449220 - RNA, 19 nt, Homo sapiens
ggagaaauagcugcuucaa

SEQ ID NO: 449221 - RNA, 19 nt, Homo sapiens
uagauagcauuacaacucu

SEQ ID NO: 449222 - RNA, 19 nt, Homo sapiens
agucguggaugaaauagau

SEQ ID NO: 449223 - RNA, 19 nt, Homo sapiens
uggauuguacuuuguguaa

SEQ ID NO: 449224 - RNA, 19 nt, Homo sapiens
caaauggaaauaagaggau

SEQ ID NO: 449225 - RNA, 19 nt, Homo sapiens
aaucacauuugcuauugga

SEQ ID NO: 449226 - RNA, 19 nt, Homo sapiens
caaacugguuggcuugacu

SEQ ID NO: 449227 - RNA, 19 nt, Homo sapiens
ggaugaaauagauagcauu

SEQ ID NO: 449228 - RNA, 19 nt, Homo sapiens
cauaccaaauggaaauaag

SEQ ID NO: 449229 - RNA, 19 nt, Homo sapiens
cagauuugacuaaugaaga

SEQ ID NO: 449230 - RNA, 19 nt, Homo sapiens
cuggaagucuuuagcaauc

SEQ ID NO: 449231 - RNA, 19 nt, Homo sapiens
cgagagaagaggucgauca

SEQ ID NO: 449232 - RNA, 19 nt, Homo sapiens
ccuaguacccggacgaguu

SEQ ID NO: 449233 - RNA, 19 nt, Homo sapiens
acacaucggcaagccuuua

SEQ ID NO: 449234 - RNA, 19 nt, Homo sapiens
gauguuacccuugcguuca

SEQ ID NO: 449235 - RNA, 19 nt, Homo sapiens
gauuagggucucugccauu

SEQ ID NO: 449236 - RNA, 19 nt, Homo sapiens
gacauaccaaauggaaaua

SEQ ID NO: 449237 - RNA, 19 nt, Homo sapiens
uacgugcacucuacagaau

SEQ ID NO: 449238 - RNA, 19 nt, Homo sapiens
uggaugcaguauucucuug

SEQ ID NO: 449239 - RNA, 19 nt, Homo sapiens
ggaucacacaauaauaaug

SEQ ID NO: 449240 - RNA, 19 nt, Homo sapiens
cuacauaguggaucacaca

SEQ ID NO: 449241 - RNA, 19 nt, Homo sapiens
aggaaacugucucgcauag

SEQ ID NO: 449242 - RNA, 19 nt, Homo sapiens
agaaaaggcagagaaguua

SEQ ID NO: 449243 - RNA, 19 nt, Homo sapiens
ccaaggacgaagaugaaga

SEQ ID NO: 449244 - RNA, 19 nt, Homo sapiens
auagauagcauuacaacuc

SEQ ID NO: 449245 - RNA, 19 nt, Homo sapiens
gaagaacuagaaaagauga

SEQ ID NO: 449246 - RNA, 19 nt, Homo sapiens
auacuggauuguacuuugu

SEQ ID NO: 449247 - RNA, 19 nt, Homo sapiens
cugcauauacuggauugua

SEQ ID NO: 449248 - RNA, 19 nt, Homo sapiens
aggcagagaaguuagagaa

SEQ ID NO: 449249 - RNA, 19 nt, Homo sapiens
gucuuuagcaaucacauuu

SEQ ID NO: 449250 - RNA, 19 nt, Homo sapiens
gaggaucaagcugaaguga

SEQ ID NO: 449251 - RNA, 19 nt, Homo sapiens
auauauacgugcacucuac

SEQ ID NO: 449252 - RNA, 19 nt, Homo sapiens
ucgcaaauuaugugaaaga

SEQ ID NO: 449253 - RNA, 19 nt, Homo sapiens
gaagcacgucaagaaagaa

SEQ ID NO: 449254 - RNA, 19 nt, Homo sapiens
aaugaagcacgucaagaaa

SEQ ID NO: 449255 - RNA, 19 nt, Homo sapiens
ucuuugcucuucugaguuc

SEQ ID NO: 449256 - RNA, 19 nt, Homo sapiens
gccagagcauacagagugu

SEQ ID NO: 449257 - RNA, 19 nt, Homo sapiens
ucaaguggccagagcauac

SEQ ID NO: 449258 - RNA, 19 nt, Homo sapiens
agaggaaaucuauuguuug

SEQ ID NO: 449259 - RNA, 19 nt, Homo sapiens
ugacuaaugaagaggaaau

SEQ ID NO: 449260 - RNA, 19 nt, Homo sapiens
cagaguugaugcuugaaaa

SEQ ID NO: 449261 - RNA, 19 nt, Homo sapiens
cuuggaacuguaaagauua

SEQ ID NO: 449262 - RNA, 19 nt, Homo sapiens
cuaagaggaaggaaacugu

SEQ ID NO: 449263 - RNA, 19 nt, Homo sapiens
acaugaggccauacagaaa

SEQ ID NO: 449264 - RNA, 19 nt, Homo sapiens
cgcaaauuaugugaaagaa

SEQ ID NO: 449265 - RNA, 19 nt, Homo sapiens
gaagaaacuugaagaggaa

SEQ ID NO: 449266 - RNA, 19 nt, Homo sapiens
ggauaggauuuguuucuua

SEQ ID NO: 449267 - RNA, 19 nt, Homo sapiens
uaauagaacuucacgauug

SEQ ID NO: 449268 - RNA, 19 nt, Homo sapiens
gaauagagccugaugguau

SEQ ID NO: 449269 - RNA, 19 nt, Homo sapiens
ucagugagauauaggauaa

SEQ ID NO: 449270 - RNA, 19 nt, Homo sapiens
uuaaggagauugagaagaa

SEQ ID NO: 449271 - RNA, 19 nt, Homo sapiens
ggaggaaagugggucauaa

SEQ ID NO: 449272 - RNA, 19 nt, Homo sapiens
uaaagaagcugcaagaaaa

SEQ ID NO: 449273 - RNA, 19 nt, Homo sapiens
gaaagugggucauaaaucc

SEQ ID NO: 449274 - RNA, 19 nt, Homo sapiens
guaaagaagcugcaagaaa

SEQ ID NO: 449275 - RNA, 19 nt, Homo sapiens
caacaugggucucgcuaug

SEQ ID NO: 449276 - RNA, 19 nt, Homo sapiens
gaaaaucacuggcaacaug

SEQ ID NO: 449277 - RNA, 19 nt, Homo sapiens
gggaacaguuugugaagaa

SEQ ID NO: 449278 - RNA, 19 nt, Homo sapiens
caagaaggcuuuagcugau

SEQ ID NO: 449279 - RNA, 19 nt, Homo sapiens
gcaaauagcguggauagga

SEQ ID NO: 449280 - RNA, 19 nt, Homo sapiens
ccaaagaacuauguaaaca

SEQ ID NO: 449281 - RNA, 19 nt, Homo sapiens
cacaagaaaugaugacuga

SEQ ID NO: 449282 - RNA, 19 nt, Homo sapiens
gaaccauucccacugauaa

SEQ ID NO: 449283 - RNA, 19 nt, Homo sapiens
gauaauacauauggaggaa

SEQ ID NO: 449284 - RNA, 19 nt, Homo sapiens
gaaugugucuuggcucuug

SEQ ID NO: 449285 - RNA, 19 nt, Homo sapiens
gaucagugcuuccuaacuc

SEQ ID NO: 449286 - RNA, 19 nt, Homo sapiens
ugagaaaucuggccugaca

SEQ ID NO: 449287 - RNA, 19 nt, Homo sapiens
caagaaaugaugacugauu

SEQ ID NO: 449288 - RNA, 19 nt, Homo sapiens
aauagagccugaugguaua

SEQ ID NO: 449289 - RNA, 19 nt, Homo sapiens
gaauuuagacugaaacuac

SEQ ID NO: 449290 - RNA, 19 nt, Homo sapiens
caagaugaauacaguuuag

SEQ ID NO: 449291 - RNA, 19 nt, Homo sapiens
gcuaagcucugaagaacuc

SEQ ID NO: 449292 - RNA, 19 nt, Homo sapiens
gcaagaaaaugcuaugaga

SEQ ID NO: 449293 - RNA, 19 nt, Homo sapiens
ugucuuggcucuuggguuu

SEQ ID NO: 449294 - RNA, 19 nt, Homo sapiens
caacagcuggccaguaauu

SEQ ID NO: 449295 - RNA, 19 nt, Homo sapiens
gaugguauacuacugcuuu

SEQ ID NO: 449296 - RNA, 19 nt, Homo sapiens
caaauagcguggauaggau

SEQ ID NO: 449297 - RNA, 19 nt, Homo sapiens
gaaacuacacauuggcaaa

SEQ ID NO: 449298 - RNA, 19 nt, Homo sapiens
gcaaguuccuggugcaaag

SEQ ID NO: 449299 - RNA, 19 nt, Homo sapiens
gcacagaucccuuauucag

SEQ ID NO: 449300 - RNA, 19 nt, Homo sapiens
gagcugagaauucaagaga

SEQ ID NO: 449301 - RNA, 19 nt, Homo sapiens
gugguggacugauuucaaa

SEQ ID NO: 449302 - RNA, 19 nt, Homo sapiens
ggauuauucugcugaagau

SEQ ID NO: 449303 - RNA, 19 nt, Homo sapiens
uggaggagcugugguugua

SEQ ID NO: 449304 - RNA, 19 nt, Homo sapiens
cagcauaauuuaggcauug

SEQ ID NO: 449305 - RNA, 19 nt, Homo sapiens
gaauacaguuuagaugaag

SEQ ID NO: 449306 - RNA, 19 nt, Homo sapiens
ucucaguccuuuguuauaa

SEQ ID NO: 449307 - RNA, 19 nt, Homo sapiens
gaggaaagugggucauaaa

SEQ ID NO: 449308 - RNA, 19 nt, Homo sapiens
caguuuagaugaagugaug

SEQ ID NO: 449309 - RNA, 19 nt, Homo sapiens
ugacuggaauuccuauaau

SEQ ID NO: 449310 - RNA, 19 nt, Homo sapiens
uaucacaguuugggaauga

SEQ ID NO: 449311 - RNA, 19 nt, Homo sapiens
gcuuugagaagaauguuua

SEQ ID NO: 449312 - RNA, 19 nt, Homo sapiens
gcuaucagaaacaguauuu

SEQ ID NO: 449313 - RNA, 19 nt, Homo sapiens
gaacuaaguaagaaacaca

SEQ ID NO: 449314 - RNA, 19 nt, Homo sapiens
ccuaugcucugggugaaua

SEQ ID NO: 449315 - RNA, 19 nt, Homo sapiens
guugauagaggagauaaua

SEQ ID NO: 449316 - RNA, 19 nt, Homo sapiens
ccaaagcuguggaaauuuu

SEQ ID NO: 449317 - RNA, 19 nt, Homo sapiens
ggaacaguuugugaagaaa

SEQ ID NO: 449318 - RNA, 19 nt, Homo sapiens
ggaaagugggucauaaauc

SEQ ID NO: 449319 - RNA, 19 nt, Homo sapiens
ggccugacaccaaaugaua

SEQ ID NO: 449320 - RNA, 19 nt, Homo sapiens
ccaagaugaauacaguuua

SEQ ID NO: 449321 - RNA, 19 nt, Homo sapiens
gagcuugaacacaggcuua

SEQ ID NO: 449322 - RNA, 19 nt, Homo sapiens
gcauacaacugugcauuac

SEQ ID NO: 449323 - RNA, 19 nt, Homo sapiens
guaauagaacuucacgauu

SEQ ID NO: 449324 - RNA, 19 nt, Homo sapiens
auacaacugugcauuacaa

SEQ ID NO: 449325 - RNA, 19 nt, Homo sapiens
gaagaauggcaaaggauca

SEQ ID NO: 449326 - RNA, 19 nt, Homo sapiens
gugaagcauuuguacagaa

SEQ ID NO: 449327 - RNA, 19 nt, Homo sapiens
agacugaaacuacacauug

SEQ ID NO: 449328 - RNA, 19 nt, Homo sapiens
gcagcauaauuuaggcauu

SEQ ID NO: 449329 - RNA, 19 nt, Homo sapiens
guuccaagaugaauacagu

SEQ ID NO: 449330 - RNA, 19 nt, Homo sapiens
gcagagggcuaucuaucac

SEQ ID NO: 449331 - RNA, 19 nt, Homo sapiens
caacugugcauuacaaagu

SEQ ID NO: 449332 - RNA, 19 nt, Homo sapiens
ccaaccagcucugcaagug

SEQ ID NO: 449333 - RNA, 19 nt, Homo sapiens
uaauacauauggaggaaag

SEQ ID NO: 449334 - RNA, 19 nt, Homo sapiens
gaggagauaauacauaugg

SEQ ID NO: 449335 - RNA, 19 nt, Homo sapiens
gaguaaagaagcugcaaga

SEQ ID NO: 449336 - RNA, 19 nt, Homo sapiens
gguuugagaagaugaguaa

SEQ ID NO: 449337 - RNA, 19 nt, Homo sapiens
gaacucccuuuggcuacuu

SEQ ID NO: 449338 - RNA, 19 nt, Homo sapiens
gggucucgcuaugaaguua

SEQ ID NO: 449339 - RNA, 19 nt, Homo sapiens
aaucuggccugacaccaaa

SEQ ID NO: 449340 - RNA, 19 nt, Homo sapiens
aagcauuuguacagaagua

SEQ ID NO: 449341 - RNA, 19 nt, Homo sapiens
gugcagccauguccucuuc

SEQ ID NO: 449342 - RNA, 19 nt, Homo sapiens
auagaaccauucccacuga

SEQ ID NO: 449343 - RNA, 19 nt, Homo sapiens
ggaauuccuauaaucaaug

SEQ ID NO: 449344 - RNA, 19 nt, Homo sapiens
uaaggagauugagaagaaa

SEQ ID NO: 449345 - RNA, 19 nt, Homo sapiens
ccaggcauguguuggcuau

SEQ ID NO: 449346 - RNA, 19 nt, Homo sapiens
gccaagcucguuugaagaa

SEQ ID NO: 449347 - RNA, 19 nt, Homo sapiens
ccacugauaagcauguuga

SEQ ID NO: 449348 - RNA, 19 nt, Homo sapiens
ugggagaacuaaguaagaa

SEQ ID NO: 449349 - RNA, 19 nt, Homo sapiens
ggugugaccaauccuguuu

SEQ ID NO: 449350 - RNA, 19 nt, Homo sapiens
gcuaugaaguuacaaaauc

SEQ ID NO: 449351 - RNA, 19 nt, Homo sapiens
acucagacuuccuggcuuu

SEQ ID NO: 449352 - RNA, 19 nt, Homo sapiens
gaugaauacaguuuagaug

SEQ ID NO: 449353 - RNA, 19 nt, Homo sapiens
gcacuucaugucauuaauc

SEQ ID NO: 449354 - RNA, 19 nt, Homo sapiens
uaaggauuauucugcugaa

SEQ ID NO: 449355 - RNA, 19 nt, Homo sapiens
caaggcaaauugaaaauca

SEQ ID NO: 449356 - RNA, 19 nt, Homo sapiens
gugauggauuuaaggcaaa

SEQ ID NO: 449357 - RNA, 19 nt, Homo sapiens
augcacagaucccuuauuc

SEQ ID NO: 449358 - RNA, 19 nt, Homo sapiens
gacuggaauuccuauaauc

SEQ ID NO: 449359 - RNA, 19 nt, Homo sapiens
gagcugugguuguaacacu

SEQ ID NO: 449360 - RNA, 19 nt, Homo sapiens
uaacugugcuacugguucu

SEQ ID NO: 449361 - RNA, 19 nt, Homo sapiens
caugcuaucagaaacagua

SEQ ID NO: 449362 - RNA, 19 nt, Homo sapiens
gcugagaauucaagagacu

SEQ ID NO: 449363 - RNA, 19 nt, Homo sapiens
gggaagccuuggaauaaaa

SEQ ID NO: 449364 - RNA, 19 nt, Homo sapiens
cguucucaguccuuuguua

SEQ ID NO: 449365 - RNA, 19 nt, Homo sapiens
caauaaaggaggaaucaga

SEQ ID NO: 449366 - RNA, 19 nt, Homo sapiens
caggagcgcagcugcauuu

SEQ ID NO: 449367 - RNA, 19 nt, Homo sapiens
gcgagcaggacgcagagaa

SEQ ID NO: 449368 - RNA, 19 nt, Homo sapiens
gagcaggacgcagagaaca

SEQ ID NO: 449369 - RNA, 19 nt, Homo sapiens
gaaaguaccuccagggauu

SEQ ID NO: 449370 - RNA, 19 nt, Homo sapiens
uaagaauccugaugagaaa

SEQ ID NO: 449371 - RNA, 19 nt, Homo sapiens
gaaagggacagggaaauaa

SEQ ID NO: 449372 - RNA, 19 nt, Homo sapiens
caggauggcuggucagaaa

SEQ ID NO: 449373 - RNA, 19 nt, Homo sapiens
ggacaagggccugggauuu

SEQ ID NO: 449374 - RNA, 19 nt, Homo sapiens
ggaccagcaucaucugaga

SEQ ID NO: 449375 - RNA, 19 nt, Homo sapiens
aaacuuagaacccaagaaa

SEQ ID NO: 449376 - RNA, 19 nt, Homo sapiens
gaaacaagaggaaaugaag

SEQ ID NO: 449377 - RNA, 19 nt, Homo sapiens
gcaacuacauccacaugca

SEQ ID NO: 449378 - RNA, 19 nt, Homo sapiens
gcagaaaugguuccuuguu

SEQ ID NO: 449379 - RNA, 19 nt, Homo sapiens
cagaagaaguggcagcaau

SEQ ID NO: 449380 - RNA, 19 nt, Homo sapiens
cuaagaauccugaugagaa

SEQ ID NO: 449381 - RNA, 19 nt, Homo sapiens
cagaaaugguuccuuguuc

SEQ ID NO: 449382 - RNA, 19 nt, Homo sapiens
ccacugcacucgcaacuac

SEQ ID NO: 449383 - RNA, 19 nt, Homo sapiens
ucauggugcuguuccagua

SEQ ID NO: 449384 - RNA, 19 nt, Homo sapiens
cagaugaugucaccuacug

SEQ ID NO: 449385 - RNA, 19 nt, Homo sapiens
gaagucagccauuauaagc

SEQ ID NO: 449386 - RNA, 19 nt, Homo sapiens
ucuccauccugauuaauuu

SEQ ID NO: 449387 - RNA, 19 nt, Homo sapiens
gacaagggccugggauuug

SEQ ID NO: 449388 - RNA, 19 nt, Homo sapiens
caagaaacaagaggaaaug

SEQ ID NO: 449389 - RNA, 19 nt, Homo sapiens
agaaagggacagggaaaua

SEQ ID NO: 449390 - RNA, 19 nt, Homo sapiens
gcugcaagcuggucauggu

SEQ ID NO: 449391 - RNA, 19 nt, Homo sapiens
ccaagaaacaagaggaaau

SEQ ID NO: 449392 - RNA, 19 nt, Homo sapiens
gacacuuucuggaagaugu

SEQ ID NO: 449393 - RNA, 19 nt, Homo sapiens
ccgacuaugugacgugcua

SEQ ID NO: 449394 - RNA, 19 nt, Homo sapiens
gauccucuccauccugauu

SEQ ID NO: 449395 - RNA, 19 nt, Homo sapiens
aaagggacagggaaauaaa

SEQ ID NO: 449396 - RNA, 19 nt, Homo sapiens
ccugggauuugguucguuu

SEQ ID NO: 449397 - RNA, 19 nt, Homo sapiens
gagguggaaugcccgagau

SEQ ID NO: 449398 - RNA, 19 nt, Homo sapiens
ggacagggaaauaaauggu

SEQ ID NO: 449399 - RNA, 19 nt, Homo sapiens
ccagaaagggacagggaaa

SEQ ID NO: 449400 - RNA, 19 nt, Homo sapiens
uaugugacgugcuacaagu

SEQ ID NO: 449401 - RNA, 19 nt, Homo sapiens
gcucuucuccucagaugau

SEQ ID NO: 449402 - RNA, 19 nt, Homo sapiens
caaggacgccgugcucuuc

SEQ ID NO: 449403 - RNA, 19 nt, Homo sapiens
gagcagccagugccagguu

SEQ ID NO: 449404 - RNA, 19 nt, Homo sapiens
uaaauggugccugggauga

SEQ ID NO: 449405 - RNA, 19 nt, Homo sapiens
gaagaaguggcagcaaugg

SEQ ID NO: 449406 - RNA, 19 nt, Homo sapiens
agaaacaagaggaaaugaa

SEQ ID NO: 449407 - RNA, 19 nt, Homo sapiens
ccagggauuuguggcauuc

SEQ ID NO: 449408 - RNA, 19 nt, Homo sapiens
ccucagaugaugucaccua

SEQ ID NO: 449409 - RNA, 19 nt, Homo sapiens
uacaagugcugugggaaga

SEQ ID NO: 449410 - RNA, 19 nt, Homo sapiens
gcaccaaggccagccacuu

SEQ ID NO: 449411 - RNA, 19 nt, Homo sapiens
gguccacucuccugcugau

SEQ ID NO: 449412 - RNA, 19 nt, Homo sapiens
gcuauugccagacacuuuc

SEQ ID NO: 449413 - RNA, 19 nt, Homo sapiens
ccugauuaauuucauccuu

SEQ ID NO: 449414 - RNA, 19 nt, Homo sapiens
gugcucuucuccucagaug

SEQ ID NO: 449415 - RNA, 19 nt, Homo sapiens
ccaucuccuucuucucuga

SEQ ID NO: 449416 - RNA, 19 nt, Homo sapiens
guucguguccuucauccuu

SEQ ID NO: 449417 - RNA, 19 nt, Homo sapiens
agaagaaguggcagcaaug

SEQ ID NO: 449418 - RNA, 19 nt, Homo sapiens
uguccaacuucaucaagga

SEQ ID NO: 449419 - RNA, 19 nt, Homo sapiens
gaagcugaaagucauguac

SEQ ID NO: 449420 - RNA, 19 nt, Homo sapiens
acgagaagcggcacuccua

SEQ ID NO: 449421 - RNA, 19 nt, Homo sapiens
ugaagucagccauuauaag

SEQ ID NO: 449422 - RNA, 19 nt, Homo sapiens
ggcuauugccagacacuuu

SEQ ID NO: 449423 - RNA, 19 nt, Homo sapiens
acaagggccugggauuugg

SEQ ID NO: 449424 - RNA, 19 nt, Homo sapiens
ccacggacagagaccaaga

SEQ ID NO: 449425 - RNA, 19 nt, Homo sapiens
ggucacccacggacagaga

SEQ ID NO: 449426 - RNA, 19 nt, Homo sapiens
cagaggacgcuauggagau

SEQ ID NO: 449427 - RNA, 19 nt, Homo sapiens
gcugcuggcccucuucugu

SEQ ID NO: 449428 - RNA, 19 nt, Homo sapiens
ccuguggcguuaaugugaa

SEQ ID NO: 449429 - RNA, 19 nt, Homo sapiens
agcuggagguucagaagaa

SEQ ID NO: 449430 - RNA, 19 nt, Homo sapiens
caauggcaccuccgugagu

SEQ ID NO: 449431 - RNA, 19 nt, Homo sapiens
agaggacgcuauggagauc

SEQ ID NO: 449432 - RNA, 19 nt, Homo sapiens
aaacaagaggaaaugaagu

SEQ ID NO: 449433 - RNA, 19 nt, Homo sapiens
acuuagaacccaagaaaca

SEQ ID NO: 449434 - RNA, 19 nt, Homo sapiens
guugggugcugggacauca

SEQ ID NO: 449435 - RNA, 19 nt, Homo sapiens
aauggugccugggaugaga

SEQ ID NO: 449436 - RNA, 19 nt, Homo sapiens
ucaaggacgccgugcucuu

SEQ ID NO: 449437 - RNA, 19 nt, Homo sapiens
gagcagauuucuuuccauu

SEQ ID NO: 449438 - RNA, 19 nt, Homo sapiens
gcagauuucuuuccauugu

SEQ ID NO: 449439 - RNA, 19 nt, Homo sapiens
ugagggcaauccuguguua

SEQ ID NO: 449440 - RNA, 19 nt, Homo sapiens
gcuauguuguugcacuuua

SEQ ID NO: 449441 - RNA, 19 nt, Homo sapiens
gauaagcuauguuguugca

SEQ ID NO: 449442 - RNA, 19 nt, Homo sapiens
aaugagggcuuaauauuca

SEQ ID NO: 449443 - RNA, 19 nt, Homo sapiens
ccaaugagggcuuaauauu

SEQ ID NO: 449444 - RNA, 19 nt, Homo sapiens
gaagacaugcagaucauca

SEQ ID NO: 449445 - RNA, 19 nt, Homo sapiens
cagaagacaugcagaucau

SEQ ID NO: 449446 - RNA, 19 nt, Homo sapiens
caaugagggcuuaauauuc

SEQ ID NO: 449447 - RNA, 19 nt, Homo sapiens
cggaagauguggacagcaa

SEQ ID NO: 449448 - RNA, 19 nt, Homo sapiens
gaucugcuuggucuugaua

SEQ ID NO: 449449 - RNA, 19 nt, Homo sapiens
agauguugcuucucauuug

SEQ ID NO: 449450 - RNA, 19 nt, Homo sapiens
ggauguggccggaagaugu

SEQ ID NO: 449451 - RNA, 19 nt, Homo sapiens
gaagauguggacagcaaga

SEQ ID NO: 449452 - RNA, 19 nt, Homo sapiens
uugauaagcuauguuguug

SEQ ID NO: 449453 - RNA, 19 nt, Homo sapiens
ucaccaggcucaucaaagc

SEQ ID NO: 449454 - RNA, 19 nt, Homo sapiens
gaaauaccagcuccaucug

SEQ ID NO: 449455 - RNA, 19 nt, Homo sapiens
guacccuucuccagauguu

SEQ ID NO: 449456 - RNA, 19 nt, Homo sapiens
ccagaagacaugcagauca

SEQ ID NO: 449457 - RNA, 19 nt, Homo sapiens
cuauguuguugcacuuuaa

SEQ ID NO: 449458 - RNA, 19 nt, Homo sapiens
cagguacccuucuccagau

SEQ ID NO: 449459 - RNA, 19 nt, Homo sapiens
uaccagcccuacaccauuc

SEQ ID NO: 449460 - RNA, 19 nt, Homo sapiens
gaaacuaccagcccuacac

SEQ ID NO: 449461 - RNA, 19 nt, Homo sapiens
agaaauaccagcuccaucu

SEQ ID NO: 449462 - RNA, 19 nt, Homo sapiens
cagauguugcuucucauuu

SEQ ID NO: 449463 - RNA, 19 nt, Homo sapiens
cuccagauguugcuucuca

SEQ ID NO: 449464 - RNA, 19 nt, Homo sapiens
gaggaucugcuuggucuug

SEQ ID NO: 449465 - RNA, 19 nt, Homo sapiens
acaguuggauggguucaga

SEQ ID NO: 449466 - RNA, 19 nt, Homo sapiens
gaccagaagacaugcagau

SEQ ID NO: 449467 - RNA, 19 nt, Homo sapiens
gauguugcuucucauuugc

SEQ ID NO: 449468 - RNA, 19 nt, Homo sapiens
ccagauguugcuucucauu

SEQ ID NO: 449469 - RNA, 19 nt, Homo sapiens
cuugauaagcuauguuguu

SEQ ID NO: 449470 - RNA, 19 nt, Homo sapiens
ggcccaagccagaccagaa

SEQ ID NO: 449471 - RNA, 19 nt, Homo sapiens
gcaugcagguacccuucuc

SEQ ID NO: 449472 - RNA, 19 nt, Homo sapiens
cuaccagcccuacaccauu

SEQ ID NO: 449473 - RNA, 19 nt, Homo sapiens
cagauuucuuuccauugug

SEQ ID NO: 449474 - RNA, 19 nt, Homo sapiens
gauguggccggaagaugug

SEQ ID NO: 449475 - RNA, 19 nt, Homo sapiens
ggaucugcuuggucuugau

SEQ ID NO: 449476 - RNA, 19 nt, Homo sapiens
ggguucagaggcacagaaa

SEQ ID NO: 449477 - RNA, 19 nt, Homo sapiens
cuccaaugagggcuuaaua

SEQ ID NO: 449478 - RNA, 19 nt, Homo sapiens
aagcuauguuguugcacuu

SEQ ID NO: 449479 - RNA, 19 nt, Homo sapiens
ccagucaccugcuguuaua

SEQ ID NO: 449480 - RNA, 19 nt, Homo sapiens
ugugaaacauuaugccuua

SEQ ID NO: 449481 - RNA, 19 nt, Homo sapiens
gaaacauuaugccuuaagu

SEQ ID NO: 449482 - RNA, 19 nt, Homo sapiens
cagcaagugucccaaagaa

SEQ ID NO: 449483 - RNA, 19 nt, Homo sapiens
guuauaacuucaccaauag

SEQ ID NO: 449484 - RNA, 19 nt, Homo sapiens
ccaagaaucugcagcuaac

SEQ ID NO: 449485 - RNA, 19 nt, Homo sapiens
agaaguggguucaggauuc

SEQ ID NO: 449486 - RNA, 19 nt, Homo sapiens
ccgaagacuugaacacuca

SEQ ID NO: 449487 - RNA, 19 nt, Homo sapiens
gaaacauccaauucucaaa

SEQ ID NO: 449488 - RNA, 19 nt, Homo sapiens
agaaucugcagcuaacuua

SEQ ID NO: 449489 - RNA, 19 nt, Homo sapiens
cauagcagccaccuucauu

SEQ ID NO: 449490 - RNA, 19 nt, Homo sapiens
gcagcaagugucccaaaga

SEQ ID NO: 449491 - RNA, 19 nt, Homo sapiens
caccugcuguuauaacuuc

SEQ ID NO: 449492 - RNA, 19 nt, Homo sapiens
ucagccagaugcaaucaau

SEQ ID NO: 449493 - RNA, 19 nt, Homo sapiens
gugaaacauuaugccuuaa

SEQ ID NO: 449494 - RNA, 19 nt, Homo sapiens
cccaaacuccgaagacuug

SEQ ID NO: 449495 - RNA, 19 nt, Homo sapiens
cauccaauucucaaacuga

SEQ ID NO: 449496 - RNA, 19 nt, Homo sapiens
agacuaacccagaaacauc

SEQ ID NO: 449497 - RNA, 19 nt, Homo sapiens
gagacuaacccagaaacau

SEQ ID NO: 449498 - RNA, 19 nt, Homo sapiens
gcagaaguggguucaggau

SEQ ID NO: 449499 - RNA, 19 nt, Homo sapiens
ccaauaggaagaucucagu

SEQ ID NO: 449500 - RNA, 19 nt, Homo sapiens
aaucugcagcuaacuuauu

SEQ ID NO: 449501 - RNA, 19 nt, Homo sapiens
ggacaagcaaacccaaacu

SEQ ID NO: 449502 - RNA, 19 nt, Homo sapiens
gaaguggguucaggauucc

SEQ ID NO: 449503 - RNA, 19 nt, Homo sapiens
gaagaaucaccagcagcaa

SEQ ID NO: 449504 - RNA, 19 nt, Homo sapiens
acucucgccuccagcauga

SEQ ID NO: 449505 - RNA, 19 nt, Homo sapiens
gcuguuauaacuucaccaa

SEQ ID NO: 449506 - RNA, 19 nt, Homo sapiens
accgagaggcugagacuaa

SEQ ID NO: 449507 - RNA, 19 nt, Homo sapiens
gaaucugcagcuaacuuau

SEQ ID NO: 449508 - RNA, 19 nt, Homo sapiens
cccaagaaucugcagcuaa

SEQ ID NO: 449509 - RNA, 19 nt, Homo sapiens
cucgcgagcuauagaagaa

SEQ ID NO: 449510 - RNA, 19 nt, Homo sapiens
cagcagcaagugucccaaa

SEQ ID NO: 449511 - RNA, 19 nt, Homo sapiens
aucugcagcuaacuuauuu

SEQ ID NO: 449512 - RNA, 19 nt, Homo sapiens
cagaaguggguucaggauu

SEQ ID NO: 449513 - RNA, 19 nt, Homo sapiens
ggcugagacuaacccagaa

SEQ ID NO: 449514 - RNA, 19 nt, Homo sapiens
gcugagacuaacccagaaa

SEQ ID NO: 449515 - RNA, 19 nt, Homo sapiens
aaacauccaauucucaaac

SEQ ID NO: 449516 - RNA, 19 nt, Homo sapiens
uuucaugguacuaguguuu

SEQ ID NO: 449517 - RNA, 19 nt, Homo sapiens
uuucauagcugacuacuuu

SEQ ID NO: 449518 - RNA, 19 nt, Homo sapiens
ccaccagacugacaaaugu

SEQ ID NO: 449519 - RNA, 19 nt, Homo sapiens
aggaguggguccagaaaua

SEQ ID NO: 449520 - RNA, 19 nt, Homo sapiens
ccaguucucugcaucacuu

SEQ ID NO: 449521 - RNA, 19 nt, Homo sapiens
ccacagcuaccucuucuau

SEQ ID NO: 449522 - RNA, 19 nt, Homo sapiens
gugggacucuucuuaacuu

SEQ ID NO: 449523 - RNA, 19 nt, Homo sapiens
acagcuaccucuucuaugg

SEQ ID NO: 449524 - RNA, 19 nt, Homo sapiens
agacaguggucaguccuuu

SEQ ID NO: 449525 - RNA, 19 nt, Homo sapiens
ccucuucuauggacugguu

SEQ ID NO: 449526 - RNA, 19 nt, Homo sapiens
gugauuguuugcucugaga

SEQ ID NO: 449527 - RNA, 19 nt, Homo sapiens
agaauuucauagcugacua

SEQ ID NO: 449528 - RNA, 19 nt, Homo sapiens
ugggacucuucuuaacuua

SEQ ID NO: 449529 - RNA, 19 nt, Homo sapiens
gcaccaaagccaccagacu

SEQ ID NO: 449530 - RNA, 19 nt, Homo sapiens
gagccugagccuugggaaa

SEQ ID NO: 449531 - RNA, 19 nt, Homo sapiens
gcaccauggcucucugcaa

SEQ ID NO: 449532 - RNA, 19 nt, Homo sapiens
gccaccagacugacaaaug

SEQ ID NO: 449533 - RNA, 19 nt, Homo sapiens
caaagccaccagacugaca

SEQ ID NO: 449534 - RNA, 19 nt, Homo sapiens
acaguguguuugugauugu

SEQ ID NO: 449535 - RNA, 19 nt, Homo sapiens
caaccaguucucugcauca

SEQ ID NO: 449536 - RNA, 19 nt, Homo sapiens
caaccgaguggcugucauc

SEQ ID NO: 449537 - RNA, 19 nt, Homo sapiens
gaggaguggguccagaaau

SEQ ID NO: 449538 - RNA, 19 nt, Homo sapiens
ucauagcugacuacuuuga

SEQ ID NO: 449539 - RNA, 19 nt, Homo sapiens
aguggucaguccuuucuug

SEQ ID NO: 449540 - RNA, 19 nt, Homo sapiens
cacugugggacucuucuua

SEQ ID NO: 449541 - RNA, 19 nt, Homo sapiens
auagcugacuacuuugaga

SEQ ID NO: 449542 - RNA, 19 nt, Homo sapiens
ccagacugacaaaugugua

SEQ ID NO: 449543 - RNA, 19 nt, Homo sapiens
gugaggaguggguccagaa

SEQ ID NO: 449544 - RNA, 19 nt, Homo sapiens
gaauuucauagcugacuac

SEQ ID NO: 449545 - RNA, 19 nt, Homo sapiens
uuucauagcugacuacuuu

SEQ ID NO: 449546 - RNA, 19 nt, Homo sapiens
aggaguggguccagaaaua

SEQ ID NO: 449547 - RNA, 19 nt, Homo sapiens
agaauuucauagcugacua

SEQ ID NO: 449548 - RNA, 19 nt, Homo sapiens
gcaccauggcucucugcaa

SEQ ID NO: 449549 - RNA, 19 nt, Homo sapiens
gaggaguggguccagaaau

SEQ ID NO: 449550 - RNA, 19 nt, Homo sapiens
ucauagcugacuacuuuga

SEQ ID NO: 449551 - RNA, 19 nt, Homo sapiens
ggaguggguccagaaauac

SEQ ID NO: 449552 - RNA, 19 nt, Homo sapiens
auagcugacuacuuugaga

SEQ ID NO: 449553 - RNA, 19 nt, Homo sapiens
gugaggaguggguccagaa

SEQ ID NO: 449554 - RNA, 19 nt, Homo sapiens
gaauuucauagcugacuac

SEQ ID NO: 449555 - RNA, 19 nt, Homo sapiens
ggacacagcuggguucuga

SEQ ID NO: 449556 - RNA, 19 nt, Homo sapiens
gcaacuuugugguagauua

SEQ ID NO: 449557 - RNA, 19 nt, Homo sapiens
gaagcuuccucgcaacuuu

SEQ ID NO: 449558 - RNA, 19 nt, Homo sapiens
gcaaauacauggauaacac

SEQ ID NO: 449559 - RNA, 19 nt, Homo sapiens
guacguguaugaccuggaa

SEQ ID NO: 449560 - RNA, 19 nt, Homo sapiens
ggacuccucuccgcaguuc

SEQ ID NO: 449561 - RNA, 19 nt, Homo sapiens
uguaugaccuggaacugaa

SEQ ID NO: 449562 - RNA, 19 nt, Homo sapiens
uaguuuagccaaaggauaa

SEQ ID NO: 449563 - RNA, 19 nt, Homo sapiens
guucugaagcuucugaguu

SEQ ID NO: 449564 - RNA, 19 nt, Homo sapiens
ugugguagauuacuaugag

SEQ ID NO: 449565 - RNA, 19 nt, Homo sapiens
ucucugcuguugcaaauac

SEQ ID NO: 449566 - RNA, 19 nt, Homo sapiens
uguccugucucuccucaug

SEQ ID NO: 449567 - RNA, 19 nt, Homo sapiens
ucugcagccucaccucuga

SEQ ID NO: 449568 - RNA, 19 nt, Homo sapiens
uucugaagcuucugaguuc

SEQ ID NO: 449569 - RNA, 19 nt, Homo sapiens
gguccaggaguacguguau

SEQ ID NO: 449570 - RNA, 19 nt, Homo sapiens
cagcaccaaugggcucaga

SEQ ID NO: 449571 - RNA, 19 nt, Homo sapiens
uguugcaaauacauggaua

SEQ ID NO: 449572 - RNA, 19 nt, Homo sapiens
gcuggguucugaagcuucu

SEQ ID NO: 449573 - RNA, 19 nt, Homo sapiens
gugguagauuacuaugaga

SEQ ID NO: 449574 - RNA, 19 nt, Homo sapiens
guugcaaauacauggauaa

SEQ ID NO: 449575 - RNA, 19 nt, Homo sapiens
uuucucugcuguugcaaau

SEQ ID NO: 449576 - RNA, 19 nt, Homo sapiens
caacuuugugguagauuac

SEQ ID NO: 449577 - RNA, 19 nt, Homo sapiens
cugcgugacuguccugucu

SEQ ID NO: 449578 - RNA, 19 nt, Homo sapiens
gcagugagcugagauugug

SEQ ID NO: 449579 - RNA, 19 nt, Homo sapiens
ggaagucucuagguucuga

SEQ ID NO: 449580 - RNA, 19 nt, Homo sapiens
gaaccugaacuuacacaaa

SEQ ID NO: 449581 - RNA, 19 nt, Homo sapiens
cgaaagaaccgccaagugu

SEQ ID NO: 449582 - RNA, 19 nt, Homo sapiens
gaagucagcaugccucuag

SEQ ID NO: 449583 - RNA, 19 nt, Homo sapiens
agaaauggguucgggagua

SEQ ID NO: 449584 - RNA, 19 nt, Homo sapiens
caacccagcagucgucuuu

SEQ ID NO: 449585 - RNA, 19 nt, Homo sapiens
guucugagcucuggcuuug

SEQ ID NO: 449586 - RNA, 19 nt, Homo sapiens
caagguggguggaucacuu

SEQ ID NO: 449587 - RNA, 19 nt, Homo sapiens
aaaaucggcuuaccauuaa

SEQ ID NO: 449588 - RNA, 19 nt, Homo sapiens
gaaauggguucgggaguac

SEQ ID NO: 449589 - RNA, 19 nt, Homo sapiens
acacaaauuugccuguuuc

SEQ ID NO: 449590 - RNA, 19 nt, Homo sapiens
aaccugaacuuacacaaau

SEQ ID NO: 449591 - RNA, 19 nt, Homo sapiens
caacuaaagccuagaagag

SEQ ID NO: 449592 - RNA, 19 nt, Homo sapiens
gaaaccccaucucuacuaa

SEQ ID NO: 449593 - RNA, 19 nt, Homo sapiens
gagaguccuugaaccugaa

SEQ ID NO: 449594 - RNA, 19 nt, Homo sapiens
ucacaacaacaacaacaaa

SEQ ID NO: 449595 - RNA, 19 nt, Homo sapiens
ccacacagcagcaguuaca

SEQ ID NO: 449596 - RNA, 19 nt, Homo sapiens
uacacaaauuugccuguuu

SEQ ID NO: 449597 - RNA, 19 nt, Homo sapiens
ggagcuuacuggcaaacau

SEQ ID NO: 449598 - RNA, 19 nt, Homo sapiens
gcugucauccucauugcua

SEQ ID NO: 449599 - RNA, 19 nt, Homo sapiens
cugaggcgcugcuuuguca

SEQ ID NO: 449600 - RNA, 19 nt, Homo sapiens
gcaggagaauggcgugaac

SEQ ID NO: 449601 - RNA, 19 nt, Homo sapiens
gugcccacaucaaggagua

SEQ ID NO: 449602 - RNA, 19 nt, Homo sapiens
cagccugggugacaaagug

SEQ ID NO: 449603 - RNA, 19 nt, Homo sapiens
aaaaggaagucucuagguu

SEQ ID NO: 449604 - RNA, 19 nt, Homo sapiens
caccacacccugcugcuuu

SEQ ID NO: 449605 - RNA, 19 nt, Homo sapiens
ccucugcgcuccugcaucu

SEQ ID NO: 449606 - RNA, 19 nt, Homo sapiens
gagcuuacuggcaaacaug

SEQ ID NO: 449607 - RNA, 19 nt, Homo sapiens
ccuugaaccugaacuuaca

SEQ ID NO: 449608 - RNA, 19 nt, Homo sapiens
cggcuuaccauuaaaguuc

SEQ ID NO: 449609 - RNA, 19 nt, Homo sapiens
uuacacaaauuugccuguu

SEQ ID NO: 449610 - RNA, 19 nt, Homo sapiens
ccaacuaaagccuagaaga

SEQ ID NO: 449611 - RNA, 19 nt, Homo sapiens
ccacagguaccaugaaggu

SEQ ID NO: 449612 - RNA, 19 nt, Homo sapiens
gcaggaaaauuguuugaac

SEQ ID NO: 449613 - RNA, 19 nt, Homo sapiens
cagcuacucgggaggcuaa

SEQ ID NO: 449614 - RNA, 19 nt, Homo sapiens
acacagcagcaguuacaaa

SEQ ID NO: 449615 - RNA, 19 nt, Homo sapiens
caucaaggaguauuucuac

SEQ ID NO: 449616 - RNA, 19 nt, Homo sapiens
gagacuccgucacaacaac

SEQ ID NO: 449617 - RNA, 19 nt, Homo sapiens
ccuguaaucccagcacuuu

SEQ ID NO: 449618 - RNA, 19 nt, Homo sapiens
ccugaacuuacacaaauuu

SEQ ID NO: 449619 - RNA, 19 nt, Homo sapiens
ggagaugagcuaggaugga

SEQ ID NO: 449620 - RNA, 19 nt, Homo sapiens
aaagaaccgccaagugugu

SEQ ID NO: 449621 - RNA, 19 nt, Homo sapiens
aaggaagucucuagguucu

SEQ ID NO: 449622 - RNA, 19 nt, Homo sapiens
gugccaacccagagaagaa

SEQ ID NO: 449623 - RNA, 19 nt, Homo sapiens
guucucaaugcaaccauaa

SEQ ID NO: 449624 - RNA, 19 nt, Homo sapiens
gcaucugccuccccauauu

SEQ ID NO: 449625 - RNA, 19 nt, Homo sapiens
guccuugaaccugaacuua

SEQ ID NO: 449626 - RNA, 19 nt, Homo sapiens
ccacaucaaggaguauuuc

SEQ ID NO: 449627 - RNA, 19 nt, Homo sapiens
ucugcuugcucuuguccua

SEQ ID NO: 449628 - RNA, 19 nt, Homo sapiens
ggauggagaguccuugaac

SEQ ID NO: 449629 - RNA, 19 nt, Homo sapiens
cugcugcuuugccuacauu

SEQ ID NO: 449630 - RNA, 19 nt, Homo sapiens
gcugagauugugccacuuc

SEQ ID NO: 449631 - RNA, 19 nt, Homo sapiens
gagauugugccacuucacu

SEQ ID NO: 449632 - RNA, 19 nt, Homo sapiens
ggaagucagcaugccucua

SEQ ID NO: 449633 - RNA, 19 nt, Homo sapiens
ucacuugaggucaggaguu

SEQ ID NO: 449634 - RNA, 19 nt, Homo sapiens
gcccagauucuaccacaca

SEQ ID NO: 449635 - RNA, 19 nt, Homo sapiens
cuucugaggcgcugcuuug

SEQ ID NO: 449636 - RNA, 19 nt, Homo sapiens
cagccuggccaacaugaug

SEQ ID NO: 449637 - RNA, 19 nt, Homo sapiens
ccgaaagaaccgccaagug

SEQ ID NO: 449638 - RNA, 19 nt, Homo sapiens
gggaggcuaaggcaggaaa

SEQ ID NO: 449639 - RNA, 19 nt, Homo sapiens
cacuugaggucaggaguuc

SEQ ID NO: 449640 - RNA, 19 nt, Homo sapiens
uaccacacagcagcaguua

SEQ ID NO: 449641 - RNA, 19 nt, Homo sapiens
gaaagccucugcagcacuu

SEQ ID NO: 449642 - RNA, 19 nt, Homo sapiens
gauaugaugucccuaugga

SEQ ID NO: 449643 - RNA, 19 nt, Homo sapiens
ugaagcaccuggacaagaa

SEQ ID NO: 449644 - RNA, 19 nt, Homo sapiens
gcaagaaucagugcaaaga

SEQ ID NO: 449645 - RNA, 19 nt, Homo sapiens
cauaaagccuuggauguau

SEQ ID NO: 449646 - RNA, 19 nt, Homo sapiens
ggaauaugagcuuuaugua

SEQ ID NO: 449647 - RNA, 19 nt, Homo sapiens
agaccaaacuggacaagga

SEQ ID NO: 449648 - RNA, 19 nt, Homo sapiens
uauaaguccuugcaagaau

SEQ ID NO: 449649 - RNA, 19 nt, Homo sapiens
auaaagccuuggauguaua

SEQ ID NO: 449650 - RNA, 19 nt, Homo sapiens
uaagauaugaugucccuau

SEQ ID NO: 449651 - RNA, 19 nt, Homo sapiens
cuggagagcuacagaagga

SEQ ID NO: 449652 - RNA, 19 nt, Homo sapiens
ucaacuaccugcugcuaca

SEQ ID NO: 449653 - RNA, 19 nt, Homo sapiens
gggauuaauacuucaacua

SEQ ID NO: 449654 - RNA, 19 nt, Homo sapiens
cuaaggaauaugagcuuua

SEQ ID NO: 449655 - RNA, 19 nt, Homo sapiens
auguaugacucccaaauuu

SEQ ID NO: 449656 - RNA, 19 nt, Homo sapiens
gcugagaccaaaccagaaa

SEQ ID NO: 449657 - RNA, 19 nt, Homo sapiens
ggauuaauacuucaacuac

SEQ ID NO: 449658 - RNA, 19 nt, Homo sapiens
caguugggauuaauacuuc

SEQ ID NO: 449659 - RNA, 19 nt, Homo sapiens
guauaaguccuugcaagaa

SEQ ID NO: 449660 - RNA, 19 nt, Homo sapiens
gcucagccaguugggauua

SEQ ID NO: 449661 - RNA, 19 nt, Homo sapiens
gagugguucugagauuauu

SEQ ID NO: 449662 - RNA, 19 nt, Homo sapiens
agccaugacuugagaaaca

SEQ ID NO: 449663 - RNA, 19 nt, Homo sapiens
ccaguugggauuaauacuu

SEQ ID NO: 449664 - RNA, 19 nt, Homo sapiens
gccaugacuugagaaacaa

SEQ ID NO: 449665 - RNA, 19 nt, Homo sapiens
agcagaggcuggagagcua

SEQ ID NO: 449666 - RNA, 19 nt, Homo sapiens
uguauacccuguccuuucu

SEQ ID NO: 449667 - RNA, 19 nt, Homo sapiens
gaagcaccuggacaagaaa

SEQ ID NO: 449668 - RNA, 19 nt, Homo sapiens
ucuaaggaauaugagcuuu

SEQ ID NO: 449669 - RNA, 19 nt, Homo sapiens
uacagaaggaccaccagua

SEQ ID NO: 449670 - RNA, 19 nt, Homo sapiens
aaccagaaaccuccaauuc

SEQ ID NO: 449671 - RNA, 19 nt, Homo sapiens
cugcagcacuucugugucu

SEQ ID NO: 449672 - RNA, 19 nt, Homo sapiens
uauguaugacucccaaauu

SEQ ID NO: 449673 - RNA, 19 nt, Homo sapiens
aacccaaacuccaaagcuu

SEQ ID NO: 449674 - RNA, 19 nt, Homo sapiens
aagauaugaugucccuaug

SEQ ID NO: 449675 - RNA, 19 nt, Homo sapiens
uguauaaguccuugcaaga

SEQ ID NO: 449676 - RNA, 19 nt, Homo sapiens
uaaagccuuggauguauau

SEQ ID NO: 449677 - RNA, 19 nt, Homo sapiens
caagaaucagugcaaagau

SEQ ID NO: 449678 - RNA, 19 nt, Homo sapiens
aggaauaugagcuuuaugu

SEQ ID NO: 449679 - RNA, 19 nt, Homo sapiens
acagaaggaccaccaguag

SEQ ID NO: 449680 - RNA, 19 nt, Homo sapiens
gcccucacccuccaacaug

SEQ ID NO: 449681 - RNA, 19 nt, Homo sapiens
cagccaguugggauuaaua

SEQ ID NO: 449682 - RNA, 19 nt, Homo sapiens
uaccugcugcuacagauuu

SEQ ID NO: 449683 - RNA, 19 nt, Homo sapiens
ugucaucucagugcuguaa

SEQ ID NO: 449684 - RNA, 19 nt, Homo sapiens
aaaccagaaaccuccaauu

SEQ ID NO: 449685 - RNA, 19 nt, Homo sapiens
ggaugcuccucccuucucu

SEQ ID NO: 449686 - RNA, 19 nt, Homo sapiens
gaaaccuccaauucucaug

SEQ ID NO: 449687 - RNA, 19 nt, Homo sapiens
auaaguccuugcaagaauc

SEQ ID NO: 449688 - RNA, 19 nt, Homo sapiens
gcuccucccuucucuaccu

SEQ ID NO: 449689 - RNA, 19 nt, Homo sapiens
uauacccuguccuuucuca

SEQ ID NO: 449690 - RNA, 19 nt, Homo sapiens
gcagagagguugagaacaa

SEQ ID NO: 449691 - RNA, 19 nt, Homo sapiens
gaaaucagagcccuuaaua

SEQ ID NO: 449692 - RNA, 19 nt, Homo sapiens
gauagaaacucacaacuuc

SEQ ID NO: 449693 - RNA, 19 nt, Homo sapiens
ccaaucaccugcugcuuua

SEQ ID NO: 449694 - RNA, 19 nt, Homo sapiens
ucagagcccuuaauaguuc

SEQ ID NO: 449695 - RNA, 19 nt, Homo sapiens
guacugcuguuguugaaau

SEQ ID NO: 449696 - RNA, 19 nt, Homo sapiens
gaaacacuuugguauucuu

SEQ ID NO: 449697 - RNA, 19 nt, Homo sapiens
gugaaacacuuugguauuc

SEQ ID NO: 449698 - RNA, 19 nt, Homo sapiens
ugaagcaucuggaccaaau

SEQ ID NO: 449699 - RNA, 19 nt, Homo sapiens
gcaaucagugcuccuguaa

SEQ ID NO: 449700 - RNA, 19 nt, Homo sapiens
gcaucuggaccaaauauuu

SEQ ID NO: 449701 - RNA, 19 nt, Homo sapiens
caacuuccuuguuuuguua

SEQ ID NO: 449702 - RNA, 19 nt, Homo sapiens
ggucagggauuccaugaag

SEQ ID NO: 449703 - RNA, 19 nt, Homo sapiens
gcucucugcucccuauaaa

SEQ ID NO: 449704 - RNA, 19 nt, Homo sapiens
ccugugagcucaacuaagu

SEQ ID NO: 449705 - RNA, 19 nt, Homo sapiens
cagcuuccauucuuccuuu

SEQ ID NO: 449706 - RNA, 19 nt, Homo sapiens
gacgucagcuuccauucuu

SEQ ID NO: 449707 - RNA, 19 nt, Homo sapiens
cuggagagcuacacaagaa

SEQ ID NO: 449708 - RNA, 19 nt, Homo sapiens
gcuuuaacgugaucaauag

SEQ ID NO: 449709 - RNA, 19 nt, Homo sapiens
ggcaaucagugcuccugua

SEQ ID NO: 449710 - RNA, 19 nt, Homo sapiens
ccacagagccuaagcaaaa

SEQ ID NO: 449711 - RNA, 19 nt, Homo sapiens
uaagucaaaugugugcuuu

SEQ ID NO: 449712 - RNA, 19 nt, Homo sapiens
uaacauccacaaagagauu

SEQ ID NO: 449713 - RNA, 19 nt, Homo sapiens
ggugaaacacuuugguauu

SEQ ID NO: 449714 - RNA, 19 nt, Homo sapiens
ugucauacauccuagugaa

SEQ ID NO: 449715 - RNA, 19 nt, Homo sapiens
cuucauacauggacugaga

SEQ ID NO: 449716 - RNA, 19 nt, Homo sapiens
ggaaaucagagcccuuaau

SEQ ID NO: 449717 - RNA, 19 nt, Homo sapiens
aaucagugcuccuguaagu

SEQ ID NO: 449718 - RNA, 19 nt, Homo sapiens
caggugcagugugacauua

SEQ ID NO: 449719 - RNA, 19 nt, Homo sapiens
cauccaaugucccaaggaa

SEQ ID NO: 449720 - RNA, 19 nt, Homo sapiens
aaucagagcccuuaauagu

SEQ ID NO: 449721 - RNA, 19 nt, Homo sapiens
agucagagcuugaagaaaa

SEQ ID NO: 449722 - RNA, 19 nt, Homo sapiens
acacaagaaucaccaacau

SEQ ID NO: 449723 - RNA, 19 nt, Homo sapiens
gagcaccagcaaagccuua

SEQ ID NO: 449724 - RNA, 19 nt, Homo sapiens
cagaaaccuucaccucuca

SEQ ID NO: 449725 - RNA, 19 nt, Homo sapiens
ggugcagugugacauuauu

SEQ ID NO: 449726 - RNA, 19 nt, Homo sapiens
gcaaaauccuggugaugug

SEQ ID NO: 449727 - RNA, 19 nt, Homo sapiens
gggauuccaugaagcaucu

SEQ ID NO: 449728 - RNA, 19 nt, Homo sapiens
gagcagagagguugagaac

SEQ ID NO: 449729 - RNA, 19 nt, Homo sapiens
ccuccaagaugaagguuuc

SEQ ID NO: 449730 - RNA, 19 nt, Homo sapiens
ucaucaaggugaaacacuu

SEQ ID NO: 449731 - RNA, 19 nt, Homo sapiens
uauaacauccacaaagaga

SEQ ID NO: 449732 - RNA, 19 nt, Homo sapiens
gaagcaucuggaccaaaua

SEQ ID NO: 449733 - RNA, 19 nt, Homo sapiens
ccaaggaagcugugaucuu

SEQ ID NO: 449734 - RNA, 19 nt, Homo sapiens
uuacuucauucuuccuuga

SEQ ID NO: 449735 - RNA, 19 nt, Homo sapiens
gcucagccagauucaguuu

SEQ ID NO: 449736 - RNA, 19 nt, Homo sapiens
gcuuuguacugcuguuguu

SEQ ID NO: 449737 - RNA, 19 nt, Homo sapiens
caucaaggugaaacacuuu

SEQ ID NO: 449738 - RNA, 19 nt, Homo sapiens
ggacuugcucagccagauu

SEQ ID NO: 449739 - RNA, 19 nt, Homo sapiens
agagaugggucagggauuc

SEQ ID NO: 449740 - RNA, 19 nt, Homo sapiens
ggagagcuacacaagaauc

SEQ ID NO: 449741 - RNA, 19 nt, Homo sapiens
uuaacgugaucaauaggaa

SEQ ID NO: 449742 - RNA, 19 nt, Homo sapiens
gagagucagagcuugaaga

SEQ ID NO: 449743 - RNA, 19 nt, Homo sapiens
gcagugugacauuauuuua

SEQ ID NO: 449744 - RNA, 19 nt, Homo sapiens
ccauucuuccuuucuuaua

SEQ ID NO: 449745 - RNA, 19 nt, Homo sapiens
caucuggaccaaauauuuc

SEQ ID NO: 449746 - RNA, 19 nt, Homo sapiens
ucagugcuccuguaaguca

SEQ ID NO: 449747 - RNA, 19 nt, Homo sapiens
ccuuggcucucuuccacua

SEQ ID NO: 449748 - RNA, 19 nt, Homo sapiens
agauagaaacucacaacuu

SEQ ID NO: 449749 - RNA, 19 nt, Homo sapiens
guaagucaaaugugugcuu

SEQ ID NO: 449750 - RNA, 19 nt, Homo sapiens
cauucuuccuugauuguga

SEQ ID NO: 449751 - RNA, 19 nt, Homo sapiens
ugaaacacuuugguauucu

SEQ ID NO: 449752 - RNA, 19 nt, Homo sapiens
gagagcuacacaagaauca

SEQ ID NO: 449753 - RNA, 19 nt, Homo sapiens
uuccauucuuccuuucuua

SEQ ID NO: 449754 - RNA, 19 nt, Homo sapiens
gaaaccuucaccucucaug

SEQ ID NO: 449755 - RNA, 19 nt, Homo sapiens
caggcucucugcucccuau

SEQ ID NO: 449756 - RNA, 19 nt, Homo sapiens
aaauccuggugauguguuu

SEQ ID NO: 449757 - RNA, 19 nt, Homo sapiens
cauucuuccuuucuuauag

SEQ ID NO: 449758 - RNA, 19 nt, Homo sapiens
gguaggcccuuggcucucu

SEQ ID NO: 449759 - RNA, 19 nt, Homo sapiens
uaacgugaucaauaggaaa

SEQ ID NO: 449760 - RNA, 19 nt, Homo sapiens
cugcuguuguugaaauuga

SEQ ID NO: 449761 - RNA, 19 nt, Homo sapiens
ucccauggaucaucaaggu

SEQ ID NO: 449762 - RNA, 19 nt, Homo sapiens
gagagaugggucagggauu

SEQ ID NO: 449763 - RNA, 19 nt, Homo sapiens
uccaaucaccugcugcuuu

SEQ ID NO: 449764 - RNA, 19 nt, Homo sapiens
agagucagagcuugaagaa

SEQ ID NO: 449765 - RNA, 19 nt, Homo sapiens
gcccuuaauaguucaguga

SEQ ID NO: 449766 - RNA, 19 nt, Homo sapiens
cuucauucuuccuugauug

SEQ ID NO: 449767 - RNA, 19 nt, Homo sapiens
acacuuugguauucuuugg

SEQ ID NO: 449768 - RNA, 19 nt, Homo sapiens
gugcagugugacauuauuu

SEQ ID NO: 449769 - RNA, 19 nt, Homo sapiens
caugaagcaucuggaccaa

SEQ ID NO: 449770 - RNA, 19 nt, Homo sapiens
gaaucaccaacauccaaug

SEQ ID NO: 449771 - RNA, 19 nt, Homo sapiens
ucacacccuugcccuccaa

SEQ ID NO: 449772 - RNA, 19 nt, Homo sapiens
ccaggugcagugugacauu

SEQ ID NO: 449773 - RNA, 19 nt, Homo sapiens
aaagauagaaacucacaac

SEQ ID NO: 449774 - RNA, 19 nt, Homo sapiens
gcuggagagcuacacaaga

SEQ ID NO: 449775 - RNA, 19 nt, Homo sapiens
gauucaguuuccauuccaa

SEQ ID NO: 449776 - RNA, 19 nt, Homo sapiens
gguauucuuuggcaaucag

SEQ ID NO: 449777 - RNA, 19 nt, Homo sapiens
aaggugaaacacuuuggua

SEQ ID NO: 449778 - RNA, 19 nt, Homo sapiens
cauggaucaucaaggugaa

SEQ ID NO: 449779 - RNA, 19 nt, Homo sapiens
ucauacauccuagugaaug

SEQ ID NO: 449780 - RNA, 19 nt, Homo sapiens
aagaaucaccaacauccaa

SEQ ID NO: 449781 - RNA, 19 nt, Homo sapiens
ugcuuuaacgugaucaaua

SEQ ID NO: 449782 - RNA, 19 nt, Homo sapiens
ucaguuuccauuccaauca

SEQ ID NO: 449783 - RNA, 19 nt, Homo sapiens
cagauucaguuuccauucc

SEQ ID NO: 449784 - RNA, 19 nt, Homo sapiens
ggagcagagagguugagaa

SEQ ID NO: 449785 - RNA, 19 nt, Homo sapiens
caucccuggccuccuguua

SEQ ID NO: 449786 - RNA, 19 nt, Homo sapiens
gauggagagcaccagcaaa

SEQ ID NO: 449787 - RNA, 19 nt, Homo sapiens
gcuccuguaagucaaaugu

SEQ ID NO: 449788 - RNA, 19 nt, Homo sapiens
gggacuugcucagccagau

SEQ ID NO: 449789 - RNA, 19 nt, Homo sapiens
agaacaacccagaaaccuu

SEQ ID NO: 449790 - RNA, 19 nt, Homo sapiens
gcaaagaugaucaguauga

SEQ ID NO: 449791 - RNA, 19 nt, Homo sapiens
ccagaaagcugugaucuuc

SEQ ID NO: 449792 - RNA, 19 nt, Homo sapiens
ccaaccaccugcugcuuua

SEQ ID NO: 449793 - RNA, 19 nt, Homo sapiens
ccaaagccauaaauaauca

SEQ ID NO: 449794 - RNA, 19 nt, Homo sapiens
uggcaaagaugaucaguau

SEQ ID NO: 449795 - RNA, 19 nt, Homo sapiens
cuagagagcuacaggagaa

SEQ ID NO: 449796 - RNA, 19 nt, Homo sapiens
cccaaagugugacucauua

SEQ ID NO: 449797 - RNA, 19 nt, Homo sapiens
gggcauggguuuuauuaua

SEQ ID NO: 449798 - RNA, 19 nt, Homo sapiens
gcuuuaaccuggccaauag

SEQ ID NO: 449799 - RNA, 19 nt, Homo sapiens
gcagagaggcugagaccaa

SEQ ID NO: 449800 - RNA, 19 nt, Homo sapiens
aaacuuauccuccaugaau

SEQ ID NO: 449801 - RNA, 19 nt, Homo sapiens
guaaagcuuugugcagauu

SEQ ID NO: 449802 - RNA, 19 nt, Homo sapiens
caaagaugaucaguaugaa

SEQ ID NO: 449803 - RNA, 19 nt, Homo sapiens
gagccugaguguugccuaa

SEQ ID NO: 449804 - RNA, 19 nt, Homo sapiens
uaaagguccuggcaaagau

SEQ ID NO: 449805 - RNA, 19 nt, Homo sapiens
uacaaugcauucugaggua

SEQ ID NO: 449806 - RNA, 19 nt, Homo sapiens
guaaagguccuggcaaaga

SEQ ID NO: 449807 - RNA, 19 nt, Homo sapiens
ugaaguaucuggaccaaaa

SEQ ID NO: 449808 - RNA, 19 nt, Homo sapiens
agaccaaacuggccaagga

SEQ ID NO: 449809 - RNA, 19 nt, Homo sapiens
gagaaucaccaguggcaaa

SEQ ID NO: 449810 - RNA, 19 nt, Homo sapiens
caaagugugacucauuaaa

SEQ ID NO: 449811 - RNA, 19 nt, Homo sapiens
agaaagcugugaucuucaa

SEQ ID NO: 449812 - RNA, 19 nt, Homo sapiens
gaaggucuccgcagcacuu

SEQ ID NO: 449813 - RNA, 19 nt, Homo sapiens
agaagugggugcaggauuc

SEQ ID NO: 449814 - RNA, 19 nt, Homo sapiens
ccugaguguugccuaauuu

SEQ ID NO: 449815 - RNA, 19 nt, Homo sapiens
aaccagagccugaguguug

SEQ ID NO: 449816 - RNA, 19 nt, Homo sapiens
ccuggaaucuuguaaaggu

SEQ ID NO: 449817 - RNA, 19 nt, Homo sapiens
gaacccaaagugugacuca

SEQ ID NO: 449818 - RNA, 19 nt, Homo sapiens
gcugagaccaacccagaaa

SEQ ID NO: 449819 - RNA, 19 nt, Homo sapiens
aguguugccuaauuuguuu

SEQ ID NO: 449820 - RNA, 19 nt, Homo sapiens
caccaccucucacgccaaa

SEQ ID NO: 449821 - RNA, 19 nt, Homo sapiens
gcuuugugcagauucuuua

SEQ ID NO: 449822 - RNA, 19 nt, Homo sapiens
gaguguugccuaauuuguu

SEQ ID NO: 449823 - RNA, 19 nt, Homo sapiens
gccugaguguugccuaauu

SEQ ID NO: 449824 - RNA, 19 nt, Homo sapiens
aaucaccaguggcaaaugu

SEQ ID NO: 449825 - RNA, 19 nt, Homo sapiens
guccaaagggcauggguuu

SEQ ID NO: 449826 - RNA, 19 nt, Homo sapiens
ccaaagggcauggguuuua

SEQ ID NO: 449827 - RNA, 19 nt, Homo sapiens
acuccaaagccauaaauaa

SEQ ID NO: 449828 - RNA, 19 nt, Homo sapiens
ccaaacuggccaaggauau

SEQ ID NO: 449829 - RNA, 19 nt, Homo sapiens
ccaaagugugacucauuaa

SEQ ID NO: 449830 - RNA, 19 nt, Homo sapiens
acaaugcauucugagguaa

SEQ ID NO: 449831 - RNA, 19 nt, Homo sapiens
caacuccaaagccauaaau

SEQ ID NO: 449832 - RNA, 19 nt, Homo sapiens
uuguaaagguccuggcaaa

SEQ ID NO: 449833 - RNA, 19 nt, Homo sapiens
cagaaaccaccaccucuca

SEQ ID NO: 449834 - RNA, 19 nt, Homo sapiens
ccaauucgauccccuguca

SEQ ID NO: 449835 - RNA, 19 nt, Homo sapiens
ggcauggguuuuauuauau

SEQ ID NO: 449836 - RNA, 19 nt, Homo sapiens
cacacugucugcucccuau

SEQ ID NO: 449837 - RNA, 19 nt, Homo sapiens
gugcaggauuccaugaagu

SEQ ID NO: 449838 - RNA, 19 nt, Homo sapiens
ggugcaggauuccaugaag

SEQ ID NO: 449839 - RNA, 19 nt, Homo sapiens
aacuuauccuccaugaaua

SEQ ID NO: 449840 - RNA, 19 nt, Homo sapiens
uaaaacuuauccuccauga

SEQ ID NO: 449841 - RNA, 19 nt, Homo sapiens
caaaccagagccugagugu

SEQ ID NO: 449842 - RNA, 19 nt, Homo sapiens
cuccaaagccauaaauaau

SEQ ID NO: 449843 - RNA, 19 nt, Homo sapiens
caugaaguaucuggaccaa

SEQ ID NO: 449844 - RNA, 19 nt, Homo sapiens
ccuccaugaauaucaguua

SEQ ID NO: 449845 - RNA, 19 nt, Homo sapiens
gagagcuacaggagaauca

SEQ ID NO: 449846 - RNA, 19 nt, Homo sapiens
uguaaagcuuugugcagau

SEQ ID NO: 449847 - RNA, 19 nt, Homo sapiens
ccuucagccuccaacauga

SEQ ID NO: 449848 - RNA, 19 nt, Homo sapiens
uggcaaauguccccagaaa

SEQ ID NO: 449849 - RNA, 19 nt, Homo sapiens
caaagggcauggguuuuau

SEQ ID NO: 449850 - RNA, 19 nt, Homo sapiens
aggauuccaugaaguaucu

SEQ ID NO: 449851 - RNA, 19 nt, Homo sapiens
gcaggauuccaugaaguau

SEQ ID NO: 449852 - RNA, 19 nt, Homo sapiens
gaagaagugggugcaggau

SEQ ID NO: 449853 - RNA, 19 nt, Homo sapiens
acugucugcucccuauaaa

SEQ ID NO: 449854 - RNA, 19 nt, Homo sapiens
ugcaggauuccaugaagua

SEQ ID NO: 449855 - RNA, 19 nt, Homo sapiens
caaacuggccaaggauauc

SEQ ID NO: 449856 - RNA, 19 nt, Homo sapiens
gaugaucaguaugaaaaug

SEQ ID NO: 449857 - RNA, 19 nt, Homo sapiens
gcaaauguccccagaaagc

SEQ ID NO: 449858 - RNA, 19 nt, Homo sapiens
ccaaagcucacaccuucag

SEQ ID NO: 449859 - RNA, 19 nt, Homo sapiens
ucccuggaaucuuguaaag

SEQ ID NO: 449860 - RNA, 19 nt, Homo sapiens
cuccaugaauaucaguuau

SEQ ID NO: 449861 - RNA, 19 nt, Homo sapiens
uccaaagccauaaauaauc

SEQ ID NO: 449862 - RNA, 19 nt, Homo sapiens
gaccaaacuggccaaggau

SEQ ID NO: 449863 - RNA, 19 nt, Homo sapiens
agaaguggguccagaauua

SEQ ID NO: 449864 - RNA, 19 nt, Homo sapiens
gcaaagaaacauugugaaa

SEQ ID NO: 449865 - RNA, 19 nt, Homo sapiens
gaaccaaacugggcaagga

SEQ ID NO: 449866 - RNA, 19 nt, Homo sapiens
gaagggaugcugcaaugua

SEQ ID NO: 449867 - RNA, 19 nt, Homo sapiens
gcuauuauuugacuuguug

SEQ ID NO: 449868 - RNA, 19 nt, Homo sapiens
ggagagcucuuugugaaug

SEQ ID NO: 449869 - RNA, 19 nt, Homo sapiens
gagcagagaggcaaagaaa

SEQ ID NO: 449870 - RNA, 19 nt, Homo sapiens
guaagaagaucuccuugca

SEQ ID NO: 449871 - RNA, 19 nt, Homo sapiens
ggaguuuauuugaguauug

SEQ ID NO: 449872 - RNA, 19 nt, Homo sapiens
uggaauacuucuaccauaa

SEQ ID NO: 449873 - RNA, 19 nt, Homo sapiens
ugugagguguugcuaaaua

SEQ ID NO: 449874 - RNA, 19 nt, Homo sapiens
aaggagagcucuuugugaa

SEQ ID NO: 449875 - RNA, 19 nt, Homo sapiens
gaaggagagcucuuuguga

SEQ ID NO: 449876 - RNA, 19 nt, Homo sapiens
gguccagaauuauaugaaa

SEQ ID NO: 449877 - RNA, 19 nt, Homo sapiens
gcagagaggcaaagaaaca

SEQ ID NO: 449878 - RNA, 19 nt, Homo sapiens
guggaaagaugaaugcaau

SEQ ID NO: 449879 - RNA, 19 nt, Homo sapiens
gaucugugcugacccaaag

SEQ ID NO: 449880 - RNA, 19 nt, Homo sapiens
gcacucaacgucccaucua

SEQ ID NO: 449881 - RNA, 19 nt, Homo sapiens
ugaaaucuccaacucuuaa

SEQ ID NO: 449882 - RNA, 19 nt, Homo sapiens
ggaaggagagcucuuugug

SEQ ID NO: 449883 - RNA, 19 nt, Homo sapiens
ggaaagcucacacccugaa

SEQ ID NO: 449884 - RNA, 19 nt, Homo sapiens
aaugugagguguugcuaaa

SEQ ID NO: 449885 - RNA, 19 nt, Homo sapiens
gcaguaagaagaucuccuu

SEQ ID NO: 449886 - RNA, 19 nt, Homo sapiens
uaguaggacugcugacauu

SEQ ID NO: 449887 - RNA, 19 nt, Homo sapiens
ggaauacuucuaccauaau

SEQ ID NO: 449888 - RNA, 19 nt, Homo sapiens
gaaagaugaaugcaauagu

SEQ ID NO: 449889 - RNA, 19 nt, Homo sapiens
ggaaagaugaaugcaauag

SEQ ID NO: 449890 - RNA, 19 nt, Homo sapiens
ccucuggccuccucuucua

SEQ ID NO: 449891 - RNA, 19 nt, Homo sapiens
gugagguguugcuaaauau

SEQ ID NO: 449892 - RNA, 19 nt, Homo sapiens
gaaugugagguguugcuaa

SEQ ID NO: 449893 - RNA, 19 nt, Homo sapiens
gagaaguggguccagaauu

SEQ ID NO: 449894 - RNA, 19 nt, Homo sapiens
ugugaaaucuccaacucuu

SEQ ID NO: 449895 - RNA, 19 nt, Homo sapiens
caaguagguugcugucucu

SEQ ID NO: 449896 - RNA, 19 nt, Homo sapiens
gagaggcaaagaaacauug

SEQ ID NO: 449897 - RNA, 19 nt, Homo sapiens
guagguugcugucucuaag

SEQ ID NO: 449898 - RNA, 19 nt, Homo sapiens
gcucacacccugaagacuu

SEQ ID NO: 449899 - RNA, 19 nt, Homo sapiens
gaaguggguccagaauuau

SEQ ID NO: 449900 - RNA, 19 nt, Homo sapiens
cugaagagcuaugugauca

SEQ ID NO: 449901 - RNA, 19 nt, Homo sapiens
guaggaaggagagcucuuu

SEQ ID NO: 449902 - RNA, 19 nt, Homo sapiens
ccucuucuaugcuuuggaa

SEQ ID NO: 449903 - RNA, 19 nt, Homo sapiens
ugcagaggcugaagagcua

SEQ ID NO: 449904 - RNA, 19 nt, Homo sapiens
gcugucaucuucagaacca

SEQ ID NO: 449905 - RNA, 19 nt, Homo sapiens
gugaaaucuccaacucuua

SEQ ID NO: 449906 - RNA, 19 nt, Homo sapiens
uuggaauacuucuaccaua

SEQ ID NO: 449907 - RNA, 19 nt, Homo sapiens
aaaucaagcuggaguacgu

SEQ ID NO: 449908 - RNA, 19 nt, Homo sapiens
gaugaaugcaauaguagga

SEQ ID NO: 449909 - RNA, 19 nt, Homo sapiens
ggagaaguggguccagaau

SEQ ID NO: 449910 - RNA, 19 nt, Homo sapiens
acauuuagcaguaagaaga

SEQ ID NO: 449911 - RNA, 19 nt, Homo sapiens
gagagcucuuugugaaugu

SEQ ID NO: 449912 - RNA, 19 nt, Homo sapiens
caagcuggaguacgugaaa

SEQ ID NO: 449913 - RNA, 19 nt, Homo sapiens
cucuuaaccuucaacauga

SEQ ID NO: 449914 - RNA, 19 nt, Homo sapiens
gaguauugcugaucuuuuc

SEQ ID NO: 449915 - RNA, 19 nt, Homo sapiens
ggccuccucuucuaugcuu

SEQ ID NO: 449916 - RNA, 19 nt, Homo sapiens
gcucaugacagcagcuuuc

SEQ ID NO: 449917 - RNA, 19 nt, Homo sapiens
acuugcugcuucacauuua

SEQ ID NO: 449918 - RNA, 19 nt, Homo sapiens
acucuuaaccuucaacaug

SEQ ID NO: 449919 - RNA, 19 nt, Homo sapiens
guuuggaguuuauuugagu

SEQ ID NO: 449920 - RNA, 19 nt, Homo sapiens
gugcugacccaaaggagaa

SEQ ID NO: 449921 - RNA, 19 nt, Homo sapiens
gguguugcuaaauauguua

SEQ ID NO: 449922 - RNA, 19 nt, Homo sapiens
gagguguugcuaaauaugu

SEQ ID NO: 449923 - RNA, 19 nt, Homo sapiens
cuccaacucuuaaccuuca

SEQ ID NO: 449924 - RNA, 19 nt, Homo sapiens
augaagggaugcugcaaug

SEQ ID NO: 449925 - RNA, 19 nt, Homo sapiens
aagggaugcugcaauguag

SEQ ID NO: 449926 - RNA, 19 nt, Homo sapiens
guugcugguuuggaguuua

SEQ ID NO: 449927 - RNA, 19 nt, Homo sapiens
ucuaugcuuuggaauacuu

SEQ ID NO: 449928 - RNA, 19 nt, Homo sapiens
ggagcagagaggcaaagaa

SEQ ID NO: 449929 - RNA, 19 nt, Homo sapiens
aggcaaagaaacauuguga

SEQ ID NO: 449930 - RNA, 19 nt, Homo sapiens
ggacuugcucagccagaug

SEQ ID NO: 449931 - RNA, 19 nt, Homo sapiens
aauaggaugcauucgguuu

SEQ ID NO: 449932 - RNA, 19 nt, Homo sapiens
gcugaagagcuaugugauc

SEQ ID NO: 449933 - RNA, 19 nt, Homo sapiens
gcuggaguacgugaaauga

SEQ ID NO: 449934 - RNA, 19 nt, Homo sapiens
gaagacuugaacucugcua

SEQ ID NO: 449935 - RNA, 19 nt, Homo sapiens
uggaguacgugaaaugacu

SEQ ID NO: 449936 - RNA, 19 nt, Homo sapiens
gguuuggaguuuauuugag

SEQ ID NO: 449937 - RNA, 19 nt, Homo sapiens
cuucuaugcuuuggaauac

SEQ ID NO: 449938 - RNA, 19 nt, Homo sapiens
guccagaauuauaugaaac

SEQ ID NO: 449939 - RNA, 19 nt, Homo sapiens
ggcaaagaaacauugugaa

SEQ ID NO: 449940 - RNA, 19 nt, Homo sapiens
gggaugcugcaauguagga

SEQ ID NO: 449941 - RNA, 19 nt, Homo sapiens
gaguuuauuugaguauugc

SEQ ID NO: 449942 - RNA, 19 nt, Homo sapiens
gcuucacauuuagcaguaa

SEQ ID NO: 449943 - RNA, 19 nt, Homo sapiens
gaguacgugaaaugacuuu

SEQ ID NO: 449944 - RNA, 19 nt, Homo sapiens
ggaguacgugaaaugacuu

SEQ ID NO: 449945 - RNA, 19 nt, Homo sapiens
cucacacccugaagacuug

SEQ ID NO: 449946 - RNA, 19 nt, Homo sapiens
ccaucuacuugcugcuuca

SEQ ID NO: 449947 - RNA, 19 nt, Homo sapiens
gcugguuuggaguuuauuu

SEQ ID NO: 449948 - RNA, 19 nt, Homo sapiens
caugacagcagcuuucaac

SEQ ID NO: 449949 - RNA, 19 nt, Homo sapiens
gggacuugcucagccagau

SEQ ID NO: 449950 - RNA, 19 nt, Homo sapiens
ggcuauuauuugacuuguu

SEQ ID NO: 449951 - RNA, 19 nt, Homo sapiens
uuucaaauaggaugcauuc

SEQ ID NO: 449952 - RNA, 19 nt, Homo sapiens
ucuucuaugcuuuggaaua

SEQ ID NO: 449953 - RNA, 19 nt, Homo sapiens
ucagccagaugcacucaac

SEQ ID NO: 449954 - RNA, 19 nt, Homo sapiens
ucacauuuagcaguaagaa

SEQ ID NO: 449955 - RNA, 19 nt, Homo sapiens
gaaacugcaugguaacuau

SEQ ID NO: 449956 - RNA, 19 nt, Homo sapiens
gagcuucccugcuuugaau

SEQ ID NO: 449957 - RNA, 19 nt, Homo sapiens
gguuggaacuacaggaaua

SEQ ID NO: 449958 - RNA, 19 nt, Homo sapiens
ucaaggacaugaaggagaa

SEQ ID NO: 449959 - RNA, 19 nt, Homo sapiens
gcacagcucagagacauaa

SEQ ID NO: 449960 - RNA, 19 nt, Homo sapiens
gcugaagcccuacucaaua

SEQ ID NO: 449961 - RNA, 19 nt, Homo sapiens
caagccaggugucauauuc

SEQ ID NO: 449962 - RNA, 19 nt, Homo sapiens
gcagagacagaguuaauga

SEQ ID NO: 449963 - RNA, 19 nt, Homo sapiens
gucagcggauuauggauua

SEQ ID NO: 449964 - RNA, 19 nt, Homo sapiens
gaagcccuacucaauauaa

SEQ ID NO: 449965 - RNA, 19 nt, Homo sapiens
uuuagaaacugcaugguaa

SEQ ID NO: 449966 - RNA, 19 nt, Homo sapiens
gccuguagcuauugggaua

SEQ ID NO: 449967 - RNA, 19 nt, Homo sapiens
gcuuagaggauuagauuaa

SEQ ID NO: 449968 - RNA, 19 nt, Homo sapiens
gcucagagacauaaagaga

SEQ ID NO: 449969 - RNA, 19 nt, Homo sapiens
gaacagcuuucacuuugcu

SEQ ID NO: 449970 - RNA, 19 nt, Homo sapiens
gagacagaguuaaugaugu

SEQ ID NO: 449971 - RNA, 19 nt, Homo sapiens
gauuauggauuacuaugag

SEQ ID NO: 449972 - RNA, 19 nt, Homo sapiens
ucacaaagcaucccguguu

SEQ ID NO: 449973 - RNA, 19 nt, Homo sapiens
ucauauuccucaccaagaa

SEQ ID NO: 449974 - RNA, 19 nt, Homo sapiens
ggauccuccucuucuuaua

SEQ ID NO: 449975 - RNA, 19 nt, Homo sapiens
cagaguuaaugaugucaaa

SEQ ID NO: 449976 - RNA, 19 nt, Homo sapiens
gaauuaaagaccacucaug

SEQ ID NO: 449977 - RNA, 19 nt, Homo sapiens
gauccuccucuucuuauaa

SEQ ID NO: 449978 - RNA, 19 nt, Homo sapiens
cugaagcccuacucaauau

SEQ ID NO: 449979 - RNA, 19 nt, Homo sapiens
ucucaggcuuagaggauua

SEQ ID NO: 449980 - RNA, 19 nt, Homo sapiens
ggacaugaaggagaacuga

SEQ ID NO: 449981 - RNA, 19 nt, Homo sapiens
ucucagccuuguucucuuu

SEQ ID NO: 449982 - RNA, 19 nt, Homo sapiens
ucagagacauaaagagaag

SEQ ID NO: 449983 - RNA, 19 nt, Homo sapiens
ggauuauggauuacuauga

SEQ ID NO: 449984 - RNA, 19 nt, Homo sapiens
gcccuacucaauauaauaa

SEQ ID NO: 449985 - RNA, 19 nt, Homo sapiens
cacaaagcaucccguguuc

SEQ ID NO: 449986 - RNA, 19 nt, Homo sapiens
aauccaagagucuaagaua

SEQ ID NO: 449987 - RNA, 19 nt, Homo sapiens
gaauugucuucaucaccaa

SEQ ID NO: 449988 - RNA, 19 nt, Homo sapiens
gaacugagugacccagaag

SEQ ID NO: 449989 - RNA, 19 nt, Homo sapiens
ccaagagucuaagauaguc

SEQ ID NO: 449990 - RNA, 19 nt, Homo sapiens
acucuuccuugaaacauuu

SEQ ID NO: 449991 - RNA, 19 nt, Homo sapiens
cgaaggcacagcucagaga

SEQ ID NO: 449992 - RNA, 19 nt, Homo sapiens
agaacugagugacccagaa

SEQ ID NO: 449993 - RNA, 19 nt, Homo sapiens
gcccggaauugucuucauc

SEQ ID NO: 449994 - RNA, 19 nt, Homo sapiens
uaacaccuccugguuggaa

SEQ ID NO: 449995 - RNA, 19 nt, Homo sapiens
ggaguucaggauugcauga

SEQ ID NO: 449996 - RNA, 19 nt, Homo sapiens
gcuuguugcuguccuugga

SEQ ID NO: 449997 - RNA, 19 nt, Homo sapiens
caucuuuguccucuacuuu

SEQ ID NO: 449998 - RNA, 19 nt, Homo sapiens
gacucuuccuugaaacauu

SEQ ID NO: 449999 - RNA, 19 nt, Homo sapiens
ucuuggagcuucccugcuu

SEQ ID NO: 450000 - RNA, 19 nt, Homo sapiens
ccacaucccaauccugaau

SEQ ID NO: 450001 - RNA, 19 nt, Homo sapiens
ucaccuacacuaccuacaa

SEQ ID NO: 450002 - RNA, 19 nt, Homo sapiens
guccgggaguucaggauug

SEQ ID NO: 450003 - RNA, 19 nt, Homo sapiens
ccuccucuucuuauaaaua

SEQ ID NO: 450004 - RNA, 19 nt, Homo sapiens
agagacagaguuaaugaug

SEQ ID NO: 450005 - RNA, 19 nt, Homo sapiens
ggagcuucccugcuuugaa

SEQ ID NO: 450006 - RNA, 19 nt, Homo sapiens
gcuccaagcccggaauugu

SEQ ID NO: 450007 - RNA, 19 nt, Homo sapiens
gaaaauccaguaguucuga

SEQ ID NO: 450008 - RNA, 19 nt, Homo sapiens
ggaacuacaggaauagaac

SEQ ID NO: 450009 - RNA, 19 nt, Homo sapiens
ugaugcagagacagaguua

SEQ ID NO: 450010 - RNA, 19 nt, Homo sapiens
gaacuacaggaauagaacu

SEQ ID NO: 450011 - RNA, 19 nt, Homo sapiens
gcuucccugcuuugaauua

SEQ ID NO: 450012 - RNA, 19 nt, Homo sapiens
aggcuuagaggauuagauu

SEQ ID NO: 450013 - RNA, 19 nt, Homo sapiens
cagcucagagacauaaaga

SEQ ID NO: 450014 - RNA, 19 nt, Homo sapiens
ccuccuacaucucacaaag

SEQ ID NO: 450015 - RNA, 19 nt, Homo sapiens
guagcuauugggauaauuc

SEQ ID NO: 450016 - RNA, 19 nt, Homo sapiens
cgucagcggauuauggauu

SEQ ID NO: 450017 - RNA, 19 nt, Homo sapiens
caccuacacuaccuacaag

SEQ ID NO: 450018 - RNA, 19 nt, Homo sapiens
gcauucaccacaucccaau

SEQ ID NO: 450019 - RNA, 19 nt, Homo sapiens
uuaucugccuguagcuauu

SEQ ID NO: 450020 - RNA, 19 nt, Homo sapiens
gaauccaagagucuaagau

SEQ ID NO: 450021 - RNA, 19 nt, Homo sapiens
gacuauaucaaggacauga

SEQ ID NO: 450022 - RNA, 19 nt, Homo sapiens
caacagcuucccacagcau

SEQ ID NO: 450023 - RNA, 19 nt, Homo sapiens
ugaagcccuacucaauaua

SEQ ID NO: 450024 - RNA, 19 nt, Homo sapiens
ccaagccaggugucauauu

SEQ ID NO: 450025 - RNA, 19 nt, Homo sapiens
gagugcugcuucaccuaca

SEQ ID NO: 450026 - RNA, 19 nt, Homo sapiens
caucccguguucacucaug

SEQ ID NO: 450027 - RNA, 19 nt, Homo sapiens
uacaagggcagagcuggua

SEQ ID NO: 450028 - RNA, 19 nt, Homo sapiens
cuggauccuccucuucuua

SEQ ID NO: 450029 - RNA, 19 nt, Homo sapiens
aaacugcaugguaacuauu

SEQ ID NO: 450030 - RNA, 19 nt, Homo sapiens
agaaacugcaugguaacua

SEQ ID NO: 450031 - RNA, 19 nt, Homo sapiens
uaucucaggcuuagaggau

SEQ ID NO: 450032 - RNA, 19 nt, Homo sapiens
cuccaagccaggugucaua

SEQ ID NO: 450033 - RNA, 19 nt, Homo sapiens
caaagcaucccguguucac

SEQ ID NO: 450034 - RNA, 19 nt, Homo sapiens
cugcaugguaacuauuaua

SEQ ID NO: 450035 - RNA, 19 nt, Homo sapiens
cagcucuccucccacaaca

SEQ ID NO: 450036 - RNA, 19 nt, Homo sapiens
cuucccugcuuugaauuaa

SEQ ID NO: 450037 - RNA, 19 nt, Homo sapiens
ggauucaccacugcuaaca

SEQ ID NO: 450038 - RNA, 19 nt, Homo sapiens
gccauuccgucuguaccaa

SEQ ID NO: 450039 - RNA, 19 nt, Homo sapiens
auccuccucuucuuauaaa

SEQ ID NO: 450040 - RNA, 19 nt, Homo sapiens
ugggauaauucgggaaauc

SEQ ID NO: 450041 - RNA, 19 nt, Homo sapiens
gaaacugcaugguaacuau

SEQ ID NO: 450042 - RNA, 19 nt, Homo sapiens
gagcuucccugcuuugaau

SEQ ID NO: 450043 - RNA, 19 nt, Homo sapiens
gguuggaacuacaggaaua

SEQ ID NO: 450044 - RNA, 19 nt, Homo sapiens
ucaaggacaugaaggagaa

SEQ ID NO: 450045 - RNA, 19 nt, Homo sapiens
gcacagcucagagacauaa

SEQ ID NO: 450046 - RNA, 19 nt, Homo sapiens
gcugaagcccuacucaaua

SEQ ID NO: 450047 - RNA, 19 nt, Homo sapiens
caagccaggugucauauuc

SEQ ID NO: 450048 - RNA, 19 nt, Homo sapiens
gcagagacagaguuaauga

SEQ ID NO: 450049 - RNA, 19 nt, Homo sapiens
gucagcggauuauggauua

SEQ ID NO: 450050 - RNA, 19 nt, Homo sapiens
gaagcccuacucaauauaa

SEQ ID NO: 450051 - RNA, 19 nt, Homo sapiens
uuuagaaacugcaugguaa

SEQ ID NO: 450052 - RNA, 19 nt, Homo sapiens
gccuguagcuauugggaua

SEQ ID NO: 450053 - RNA, 19 nt, Homo sapiens
gcuuagaggauuagauuaa

SEQ ID NO: 450054 - RNA, 19 nt, Homo sapiens
gcucagagacauaaagaga

SEQ ID NO: 450055 - RNA, 19 nt, Homo sapiens
gaacagcuuucacuuugcu

SEQ ID NO: 450056 - RNA, 19 nt, Homo sapiens
gagacagaguuaaugaugu

SEQ ID NO: 450057 - RNA, 19 nt, Homo sapiens
gauuauggauuacuaugag

SEQ ID NO: 450058 - RNA, 19 nt, Homo sapiens
ucacaaagcaucccguguu

SEQ ID NO: 450059 - RNA, 19 nt, Homo sapiens
ucauauuccucaccaagaa

SEQ ID NO: 450060 - RNA, 19 nt, Homo sapiens
ggauccuccucuucuuaua

SEQ ID NO: 450061 - RNA, 19 nt, Homo sapiens
cagaguuaaugaugucaaa

SEQ ID NO: 450062 - RNA, 19 nt, Homo sapiens
gaauuaaagaccacucaug

SEQ ID NO: 450063 - RNA, 19 nt, Homo sapiens
gauccuccucuucuuauaa

SEQ ID NO: 450064 - RNA, 19 nt, Homo sapiens
cugaagcccuacucaauau

SEQ ID NO: 450065 - RNA, 19 nt, Homo sapiens
ucucaggcuuagaggauua

SEQ ID NO: 450066 - RNA, 19 nt, Homo sapiens
ggacaugaaggagaacuga

SEQ ID NO: 450067 - RNA, 19 nt, Homo sapiens
ucucagccuuguucucuuu

SEQ ID NO: 450068 - RNA, 19 nt, Homo sapiens
ucagagacauaaagagaag

SEQ ID NO: 450069 - RNA, 19 nt, Homo sapiens
ggauuauggauuacuauga

SEQ ID NO: 450070 - RNA, 19 nt, Homo sapiens
gcccuacucaauauaauaa

SEQ ID NO: 450071 - RNA, 19 nt, Homo sapiens
aaauacagcuaaaguuggu

SEQ ID NO: 450072 - RNA, 19 nt, Homo sapiens
cacaaagcaucccguguuc

SEQ ID NO: 450073 - RNA, 19 nt, Homo sapiens
aauccaagagucuaagaua

SEQ ID NO: 450074 - RNA, 19 nt, Homo sapiens
gaauugucuucaucaccaa

SEQ ID NO: 450075 - RNA, 19 nt, Homo sapiens
gaacugagugacccagaag

SEQ ID NO: 450076 - RNA, 19 nt, Homo sapiens
ccaagagucuaagauaguc

SEQ ID NO: 450077 - RNA, 19 nt, Homo sapiens
acucuuccuugaaacauuu

SEQ ID NO: 450078 - RNA, 19 nt, Homo sapiens
cgaaggcacagcucagaga

SEQ ID NO: 450079 - RNA, 19 nt, Homo sapiens
agaacugagugacccagaa

SEQ ID NO: 450080 - RNA, 19 nt, Homo sapiens
gcccggaauugucuucauc

SEQ ID NO: 450081 - RNA, 19 nt, Homo sapiens
uaacaccuccugguuggaa

SEQ ID NO: 450082 - RNA, 19 nt, Homo sapiens
acugaauccuccucacaaa

SEQ ID NO: 450083 - RNA, 19 nt, Homo sapiens
ggaguucaggauugcauga

SEQ ID NO: 450084 - RNA, 19 nt, Homo sapiens
gcuuguugcuguccuugga

SEQ ID NO: 450085 - RNA, 19 nt, Homo sapiens
caucuuuguccucuacuuu

SEQ ID NO: 450086 - RNA, 19 nt, Homo sapiens
gacucuuccuugaaacauu

SEQ ID NO: 450087 - RNA, 19 nt, Homo sapiens
ucuuggagcuucccugcuu

SEQ ID NO: 450088 - RNA, 19 nt, Homo sapiens
ucaccuacacuaccuacaa

SEQ ID NO: 450089 - RNA, 19 nt, Homo sapiens
gaauccuccucacaaacug

SEQ ID NO: 450090 - RNA, 19 nt, Homo sapiens
guccgggaguucaggauug

SEQ ID NO: 450091 - RNA, 19 nt, Homo sapiens
ccacaucccaauccugaau

SEQ ID NO: 450092 - RNA, 19 nt, Homo sapiens
ccuccucuucuuauaaaua

SEQ ID NO: 450093 - RNA, 19 nt, Homo sapiens
agagacagaguuaaugaug

SEQ ID NO: 450094 - RNA, 19 nt, Homo sapiens
ggagcuucccugcuuugaa

SEQ ID NO: 450095 - RNA, 19 nt, Homo sapiens
gcuccaagcccggaauugu

SEQ ID NO: 450096 - RNA, 19 nt, Homo sapiens
gaaaauccaguaguucuga

SEQ ID NO: 450097 - RNA, 19 nt, Homo sapiens
ggaacuacaggaauagaac

SEQ ID NO: 450098 - RNA, 19 nt, Homo sapiens
ugaugcagagacagaguua

SEQ ID NO: 450099 - RNA, 19 nt, Homo sapiens
gaacuacaggaauagaacu

SEQ ID NO: 450100 - RNA, 19 nt, Homo sapiens
gcuucccugcuuugaauua

SEQ ID NO: 450101 - RNA, 19 nt, Homo sapiens
gacugaauccuccucacaa

SEQ ID NO: 450102 - RNA, 19 nt, Homo sapiens
aggcuuagaggauuagauu

SEQ ID NO: 450103 - RNA, 19 nt, Homo sapiens
cagcucagagacauaaaga

SEQ ID NO: 450104 - RNA, 19 nt, Homo sapiens
ccuccuacaucucacaaag

SEQ ID NO: 450105 - RNA, 19 nt, Homo sapiens
guagcuauugggauaauuc

SEQ ID NO: 450106 - RNA, 19 nt, Homo sapiens
cgucagcggauuauggauu

SEQ ID NO: 450107 - RNA, 19 nt, Homo sapiens
caccuacacuaccuacaag

SEQ ID NO: 450108 - RNA, 19 nt, Homo sapiens
gcauucaccacaucccaau

SEQ ID NO: 450109 - RNA, 19 nt, Homo sapiens
uuaucugccuguagcuauu

SEQ ID NO: 450110 - RNA, 19 nt, Homo sapiens
gaauccaagagucuaagau

SEQ ID NO: 450111 - RNA, 19 nt, Homo sapiens
gacuauaucaaggacauga

SEQ ID NO: 450112 - RNA, 19 nt, Homo sapiens
caacagcuucccacagcau

SEQ ID NO: 450113 - RNA, 19 nt, Homo sapiens
ugaagcccuacucaauaua

SEQ ID NO: 450114 - RNA, 19 nt, Homo sapiens
ccaagccaggugucauauu

SEQ ID NO: 450115 - RNA, 19 nt, Homo sapiens
gagugcugcuucaccuaca

SEQ ID NO: 450116 - RNA, 19 nt, Homo sapiens
caucccguguucacucaug

SEQ ID NO: 450117 - RNA, 19 nt, Homo sapiens
uacaagggcagagcuggua

SEQ ID NO: 450118 - RNA, 19 nt, Homo sapiens
cuggauccuccucuucuua

SEQ ID NO: 450119 - RNA, 19 nt, Homo sapiens
aaacugcaugguaacuauu

SEQ ID NO: 450120 - RNA, 19 nt, Homo sapiens
agaaacugcaugguaacua

SEQ ID NO: 450121 - RNA, 19 nt, Homo sapiens
uaucucaggcuuagaggau

SEQ ID NO: 450122 - RNA, 19 nt, Homo sapiens
cuccaagccaggugucaua

SEQ ID NO: 450123 - RNA, 19 nt, Homo sapiens
caaagcaucccguguucac

SEQ ID NO: 450124 - RNA, 19 nt, Homo sapiens
cugcaugguaacuauuaua

SEQ ID NO: 450125 - RNA, 19 nt, Homo sapiens
ugaauccuccucacaaacu

SEQ ID NO: 450126 - RNA, 19 nt, Homo sapiens
cagcucuccucccacaaca

SEQ ID NO: 450127 - RNA, 19 nt, Homo sapiens
cuucccugcuuugaauuaa

SEQ ID NO: 450128 - RNA, 19 nt, Homo sapiens
ggauucaccacugcuaaca

SEQ ID NO: 450129 - RNA, 19 nt, Homo sapiens
gccauuccgucuguaccaa

SEQ ID NO: 450130 - RNA, 19 nt, Homo sapiens
ugggauaauucgggaaauc

SEQ ID NO: 450131 - RNA, 19 nt, Homo sapiens
auccuccucuucuuauaaa

SEQ ID NO: 450132 - RNA, 19 nt, Homo sapiens
gagcuucccugcuuugaau

SEQ ID NO: 450133 - RNA, 19 nt, Homo sapiens
ucaaggacaugaaggagaa

SEQ ID NO: 450134 - RNA, 19 nt, Homo sapiens
gcacagcucagagacauaa

SEQ ID NO: 450135 - RNA, 19 nt, Homo sapiens
gucagcggauuauggauua

SEQ ID NO: 450136 - RNA, 19 nt, Homo sapiens
gcucagagacauaaagaga

SEQ ID NO: 450137 - RNA, 19 nt, Homo sapiens
gauuauggauuacuaugag

SEQ ID NO: 450138 - RNA, 19 nt, Homo sapiens
gaauuaaagaccacucaug

SEQ ID NO: 450139 - RNA, 19 nt, Homo sapiens
ggacaugaaggagaacuga

SEQ ID NO: 450140 - RNA, 19 nt, Homo sapiens
ucagagacauaaagagaag

SEQ ID NO: 450141 - RNA, 19 nt, Homo sapiens
ggauuauggauuacuauga

SEQ ID NO: 450142 - RNA, 19 nt, Homo sapiens
gaauugucuucaucaccaa

SEQ ID NO: 450143 - RNA, 19 nt, Homo sapiens
gaacugagugacccagaag

SEQ ID NO: 450144 - RNA, 19 nt, Homo sapiens
cgaaggcacagcucagaga

SEQ ID NO: 450145 - RNA, 19 nt, Homo sapiens
agaacugagugacccagaa

SEQ ID NO: 450146 - RNA, 19 nt, Homo sapiens
gcccggaauugucuucauc

SEQ ID NO: 450147 - RNA, 19 nt, Homo sapiens
ucuuggagcuucccugcuu

SEQ ID NO: 450148 - RNA, 19 nt, Homo sapiens
ucaccuacacuaccuacaa

SEQ ID NO: 450149 - RNA, 19 nt, Homo sapiens
ggagcuucccugcuuugaa

SEQ ID NO: 450150 - RNA, 19 nt, Homo sapiens
gcuccaagcccggaauugu

SEQ ID NO: 450151 - RNA, 19 nt, Homo sapiens
gcuucccugcuuugaauua

SEQ ID NO: 450152 - RNA, 19 nt, Homo sapiens
cagcucagagacauaaaga

SEQ ID NO: 450153 - RNA, 19 nt, Homo sapiens
cgucagcggauuauggauu

SEQ ID NO: 450154 - RNA, 19 nt, Homo sapiens
caccuacacuaccuacaag

SEQ ID NO: 450155 - RNA, 19 nt, Homo sapiens
gacuauaucaaggacauga

SEQ ID NO: 450156 - RNA, 19 nt, Homo sapiens
caacagcuucccacagcau

SEQ ID NO: 450157 - RNA, 19 nt, Homo sapiens
gagugcugcuucaccuaca

SEQ ID NO: 450158 - RNA, 19 nt, Homo sapiens
cagcucuccucccacaaca

SEQ ID NO: 450159 - RNA, 19 nt, Homo sapiens
cuucccugcuuugaauuaa

SEQ ID NO: 450160 - RNA, 19 nt, Homo sapiens
gccauuccgucuguaccaa

SEQ ID NO: 450161 - RNA, 19 nt, Homo sapiens
gaaacugcaugguaacuau

SEQ ID NO: 450162 - RNA, 19 nt, Homo sapiens
gagcuucccugcuuugaau

SEQ ID NO: 450163 - RNA, 19 nt, Homo sapiens
gguuggaacuacaggaaua

SEQ ID NO: 450164 - RNA, 19 nt, Homo sapiens
ucaaggacaugaaggagaa

SEQ ID NO: 450165 - RNA, 19 nt, Homo sapiens
gcacagcucagagacauaa

SEQ ID NO: 450166 - RNA, 19 nt, Homo sapiens
gcugaagcccuacucaaua

SEQ ID NO: 450167 - RNA, 19 nt, Homo sapiens
caagccaggugucauauuc

SEQ ID NO: 450168 - RNA, 19 nt, Homo sapiens
gcagagacagaguuaauga

SEQ ID NO: 450169 - RNA, 19 nt, Homo sapiens
gucagcggauuauggauua

SEQ ID NO: 450170 - RNA, 19 nt, Homo sapiens
gaagcccuacucaauauaa

SEQ ID NO: 450171 - RNA, 19 nt, Homo sapiens
uuuagaaacugcaugguaa

SEQ ID NO: 450172 - RNA, 19 nt, Homo sapiens
gccuguagcuauugggaua

SEQ ID NO: 450173 - RNA, 19 nt, Homo sapiens
gcuuagaggauuagauuaa

SEQ ID NO: 450174 - RNA, 19 nt, Homo sapiens
gcucagagacauaaagaga

SEQ ID NO: 450175 - RNA, 19 nt, Homo sapiens
gaacagcuuucacuuugcu

SEQ ID NO: 450176 - RNA, 19 nt, Homo sapiens
gagacagaguuaaugaugu

SEQ ID NO: 450177 - RNA, 19 nt, Homo sapiens
gauuauggauuacuaugag

SEQ ID NO: 450178 - RNA, 19 nt, Homo sapiens
ucacaaagcaucccguguu

SEQ ID NO: 450179 - RNA, 19 nt, Homo sapiens
ucauauuccucaccaagaa

SEQ ID NO: 450180 - RNA, 19 nt, Homo sapiens
ggauccuccucuucuuaua

SEQ ID NO: 450181 - RNA, 19 nt, Homo sapiens
cagaguuaaugaugucaaa

SEQ ID NO: 450182 - RNA, 19 nt, Homo sapiens
gaauuaaagaccacucaug

SEQ ID NO: 450183 - RNA, 19 nt, Homo sapiens
gauccuccucuucuuauaa

SEQ ID NO: 450184 - RNA, 19 nt, Homo sapiens
cugaagcccuacucaauau

SEQ ID NO: 450185 - RNA, 19 nt, Homo sapiens
ucucaggcuuagaggauua

SEQ ID NO: 450186 - RNA, 19 nt, Homo sapiens
ggacaugaaggagaacuga

SEQ ID NO: 450187 - RNA, 19 nt, Homo sapiens
ucucagccuuguucucuuu

SEQ ID NO: 450188 - RNA, 19 nt, Homo sapiens
ucagagacauaaagagaag

SEQ ID NO: 450189 - RNA, 19 nt, Homo sapiens
ggauuauggauuacuauga

SEQ ID NO: 450190 - RNA, 19 nt, Homo sapiens
gcccuacucaauauaauaa

SEQ ID NO: 450191 - RNA, 19 nt, Homo sapiens
aaauacagcuaaaguuggu

SEQ ID NO: 450192 - RNA, 19 nt, Homo sapiens
cacaaagcaucccguguuc

SEQ ID NO: 450193 - RNA, 19 nt, Homo sapiens
aauccaagagucuaagaua

SEQ ID NO: 450194 - RNA, 19 nt, Homo sapiens
gaauugucuucaucaccaa

SEQ ID NO: 450195 - RNA, 19 nt, Homo sapiens
gaacugagugacccagaag

SEQ ID NO: 450196 - RNA, 19 nt, Homo sapiens
ccaagagucuaagauaguc

SEQ ID NO: 450197 - RNA, 19 nt, Homo sapiens
acucuuccuugaaacauuu

SEQ ID NO: 450198 - RNA, 19 nt, Homo sapiens
cgaaggcacagcucagaga

SEQ ID NO: 450199 - RNA, 19 nt, Homo sapiens
agaacugagugacccagaa

SEQ ID NO: 450200 - RNA, 19 nt, Homo sapiens
gcccggaauugucuucauc

SEQ ID NO: 450201 - RNA, 19 nt, Homo sapiens
uaacaccuccugguuggaa

SEQ ID NO: 450202 - RNA, 19 nt, Homo sapiens
acugaauccuccucacaaa

SEQ ID NO: 450203 - RNA, 19 nt, Homo sapiens
ggaguucaggauugcauga

SEQ ID NO: 450204 - RNA, 19 nt, Homo sapiens
gcuuguugcuguccuugga

SEQ ID NO: 450205 - RNA, 19 nt, Homo sapiens
caucuuuguccucuacuuu

SEQ ID NO: 450206 - RNA, 19 nt, Homo sapiens
gacucuuccuugaaacauu

SEQ ID NO: 450207 - RNA, 19 nt, Homo sapiens
ucuuggagcuucccugcuu

SEQ ID NO: 450208 - RNA, 19 nt, Homo sapiens
ucaccuacacuaccuacaa

SEQ ID NO: 450209 - RNA, 19 nt, Homo sapiens
gaauccuccucacaaacug

SEQ ID NO: 450210 - RNA, 19 nt, Homo sapiens
guccgggaguucaggauug

SEQ ID NO: 450211 - RNA, 19 nt, Homo sapiens
ccacaucccaauccugaau

SEQ ID NO: 450212 - RNA, 19 nt, Homo sapiens
ccuccucuucuuauaaaua

SEQ ID NO: 450213 - RNA, 19 nt, Homo sapiens
agagacagaguuaaugaug

SEQ ID NO: 450214 - RNA, 19 nt, Homo sapiens
ggagcuucccugcuuugaa

SEQ ID NO: 450215 - RNA, 19 nt, Homo sapiens
gcuccaagcccggaauugu

SEQ ID NO: 450216 - RNA, 19 nt, Homo sapiens
gaaaauccaguaguucuga

SEQ ID NO: 450217 - RNA, 19 nt, Homo sapiens
ggaacuacaggaauagaac

SEQ ID NO: 450218 - RNA, 19 nt, Homo sapiens
ugaugcagagacagaguua

SEQ ID NO: 450219 - RNA, 19 nt, Homo sapiens
gaacuacaggaauagaacu

SEQ ID NO: 450220 - RNA, 19 nt, Homo sapiens
gcuucccugcuuugaauua

SEQ ID NO: 450221 - RNA, 19 nt, Homo sapiens
gacugaauccuccucacaa

SEQ ID NO: 450222 - RNA, 19 nt, Homo sapiens
aggcuuagaggauuagauu

SEQ ID NO: 450223 - RNA, 19 nt, Homo sapiens
cagcucagagacauaaaga

SEQ ID NO: 450224 - RNA, 19 nt, Homo sapiens
ccuccuacaucucacaaag

SEQ ID NO: 450225 - RNA, 19 nt, Homo sapiens
guagcuauugggauaauuc

SEQ ID NO: 450226 - RNA, 19 nt, Homo sapiens
cgucagcggauuauggauu

SEQ ID NO: 450227 - RNA, 19 nt, Homo sapiens
caccuacacuaccuacaag

SEQ ID NO: 450228 - RNA, 19 nt, Homo sapiens
gcauucaccacaucccaau

SEQ ID NO: 450229 - RNA, 19 nt, Homo sapiens
uuaucugccuguagcuauu

SEQ ID NO: 450230 - RNA, 19 nt, Homo sapiens
gaauccaagagucuaagau

SEQ ID NO: 450231 - RNA, 19 nt, Homo sapiens
gacuauaucaaggacauga

SEQ ID NO: 450232 - RNA, 19 nt, Homo sapiens
caacagcuucccacagcau

SEQ ID NO: 450233 - RNA, 19 nt, Homo sapiens
ugaagcccuacucaauaua

SEQ ID NO: 450234 - RNA, 19 nt, Homo sapiens
ccaagccaggugucauauu

SEQ ID NO: 450235 - RNA, 19 nt, Homo sapiens
gagugcugcuucaccuaca

SEQ ID NO: 450236 - RNA, 19 nt, Homo sapiens
caucccguguucacucaug

SEQ ID NO: 450237 - RNA, 19 nt, Homo sapiens
uacaagggcagagcuggua

SEQ ID NO: 450238 - RNA, 19 nt, Homo sapiens
cuggauccuccucuucuua

SEQ ID NO: 450239 - RNA, 19 nt, Homo sapiens
aaacugcaugguaacuauu

SEQ ID NO: 450240 - RNA, 19 nt, Homo sapiens
agaaacugcaugguaacua

SEQ ID NO: 450241 - RNA, 19 nt, Homo sapiens
uaucucaggcuuagaggau

SEQ ID NO: 450242 - RNA, 19 nt, Homo sapiens
cuccaagccaggugucaua

SEQ ID NO: 450243 - RNA, 19 nt, Homo sapiens
caaagcaucccguguucac

SEQ ID NO: 450244 - RNA, 19 nt, Homo sapiens
cugcaugguaacuauuaua

SEQ ID NO: 450245 - RNA, 19 nt, Homo sapiens
ugaauccuccucacaaacu

SEQ ID NO: 450246 - RNA, 19 nt, Homo sapiens
cagcucuccucccacaaca

SEQ ID NO: 450247 - RNA, 19 nt, Homo sapiens
cuucccugcuuugaauuaa

SEQ ID NO: 450248 - RNA, 19 nt, Homo sapiens
ggauucaccacugcuaaca

SEQ ID NO: 450249 - RNA, 19 nt, Homo sapiens
gccauuccgucuguaccaa

SEQ ID NO: 450250 - RNA, 19 nt, Homo sapiens
ugggauaauucgggaaauc

SEQ ID NO: 450251 - RNA, 19 nt, Homo sapiens
auccuccucuucuuauaaa

SEQ ID NO: 450252 - RNA, 19 nt, Homo sapiens
gaaacugcaugguaacuau

SEQ ID NO: 450253 - RNA, 19 nt, Homo sapiens
gagcuucccugcuuugaau

SEQ ID NO: 450254 - RNA, 19 nt, Homo sapiens
gguuggaacuacaggaaua

SEQ ID NO: 450255 - RNA, 19 nt, Homo sapiens
ucaaggacaugaaggagaa

SEQ ID NO: 450256 - RNA, 19 nt, Homo sapiens
gcacagcucagagacauaa

SEQ ID NO: 450257 - RNA, 19 nt, Homo sapiens
gcugaagcccuacucaaua

SEQ ID NO: 450258 - RNA, 19 nt, Homo sapiens
caagccaggugucauauuc

SEQ ID NO: 450259 - RNA, 19 nt, Homo sapiens
gcagagacagaguuaauga

SEQ ID NO: 450260 - RNA, 19 nt, Homo sapiens
gucagcggauuauggauua

SEQ ID NO: 450261 - RNA, 19 nt, Homo sapiens
gaagcccuacucaauauaa

SEQ ID NO: 450262 - RNA, 19 nt, Homo sapiens
uuuagaaacugcaugguaa

SEQ ID NO: 450263 - RNA, 19 nt, Homo sapiens
gccuguagcuauugggaua

SEQ ID NO: 450264 - RNA, 19 nt, Homo sapiens
gcuuagaggauuagauuaa

SEQ ID NO: 450265 - RNA, 19 nt, Homo sapiens
gcucagagacauaaagaga

SEQ ID NO: 450266 - RNA, 19 nt, Homo sapiens
gaacagcuuucacuuugcu

SEQ ID NO: 450267 - RNA, 19 nt, Homo sapiens
gagacagaguuaaugaugu

SEQ ID NO: 450268 - RNA, 19 nt, Homo sapiens
gauuauggauuacuaugag

SEQ ID NO: 450269 - RNA, 19 nt, Homo sapiens
ucacaaagcaucccguguu

SEQ ID NO: 450270 - RNA, 19 nt, Homo sapiens
ucauauuccucaccaagaa

SEQ ID NO: 450271 - RNA, 19 nt, Homo sapiens
ggauccuccucuucuuaua

SEQ ID NO: 450272 - RNA, 19 nt, Homo sapiens
cagaguuaaugaugucaaa

SEQ ID NO: 450273 - RNA, 19 nt, Homo sapiens
gaauuaaagaccacucaug

SEQ ID NO: 450274 - RNA, 19 nt, Homo sapiens
gauccuccucuucuuauaa

SEQ ID NO: 450275 - RNA, 19 nt, Homo sapiens
cugaagcccuacucaauau

SEQ ID NO: 450276 - RNA, 19 nt, Homo sapiens
ucucaggcuuagaggauua

SEQ ID NO: 450277 - RNA, 19 nt, Homo sapiens
ggacaugaaggagaacuga

SEQ ID NO: 450278 - RNA, 19 nt, Homo sapiens
ucucagccuuguucucuuu

SEQ ID NO: 450279 - RNA, 19 nt, Homo sapiens
ucagagacauaaagagaag

SEQ ID NO: 450280 - RNA, 19 nt, Homo sapiens
ggauuauggauuacuauga

SEQ ID NO: 450281 - RNA, 19 nt, Homo sapiens
gcccuacucaauauaauaa

SEQ ID NO: 450282 - RNA, 19 nt, Homo sapiens
cacaaagcaucccguguuc

SEQ ID NO: 450283 - RNA, 19 nt, Homo sapiens
aauccaagagucuaagaua

SEQ ID NO: 450284 - RNA, 19 nt, Homo sapiens
gaauugucuucaucaccaa

SEQ ID NO: 450285 - RNA, 19 nt, Homo sapiens
gaacugagugacccagaag

SEQ ID NO: 450286 - RNA, 19 nt, Homo sapiens
ccaagagucuaagauaguc

SEQ ID NO: 450287 - RNA, 19 nt, Homo sapiens
acucuuccuugaaacauuu

SEQ ID NO: 450288 - RNA, 19 nt, Homo sapiens
cgaaggcacagcucagaga

SEQ ID NO: 450289 - RNA, 19 nt, Homo sapiens
agaacugagugacccagaa

SEQ ID NO: 450290 - RNA, 19 nt, Homo sapiens
gcccggaauugucuucauc

SEQ ID NO: 450291 - RNA, 19 nt, Homo sapiens
uaacaccuccugguuggaa

SEQ ID NO: 450292 - RNA, 19 nt, Homo sapiens
ggaguucaggauugcauga

SEQ ID NO: 450293 - RNA, 19 nt, Homo sapiens
gcuuguugcuguccuugga

SEQ ID NO: 450294 - RNA, 19 nt, Homo sapiens
caucuuuguccucuacuuu

SEQ ID NO: 450295 - RNA, 19 nt, Homo sapiens
gacucuuccuugaaacauu

SEQ ID NO: 450296 - RNA, 19 nt, Homo sapiens
ucuuggagcuucccugcuu

SEQ ID NO: 450297 - RNA, 19 nt, Homo sapiens
ccacaucccaauccugaau

SEQ ID NO: 450298 - RNA, 19 nt, Homo sapiens
ucaccuacacuaccuacaa

SEQ ID NO: 450299 - RNA, 19 nt, Homo sapiens
guccgggaguucaggauug

SEQ ID NO: 450300 - RNA, 19 nt, Homo sapiens
ccuccucuucuuauaaaua

SEQ ID NO: 450301 - RNA, 19 nt, Homo sapiens
agagacagaguuaaugaug

SEQ ID NO: 450302 - RNA, 19 nt, Homo sapiens
ggagcuucccugcuuugaa

SEQ ID NO: 450303 - RNA, 19 nt, Homo sapiens
gcuccaagcccggaauugu

SEQ ID NO: 450304 - RNA, 19 nt, Homo sapiens
gaaaauccaguaguucuga

SEQ ID NO: 450305 - RNA, 19 nt, Homo sapiens
ggaacuacaggaauagaac

SEQ ID NO: 450306 - RNA, 19 nt, Homo sapiens
ugaugcagagacagaguua

SEQ ID NO: 450307 - RNA, 19 nt, Homo sapiens
gaacuacaggaauagaacu

SEQ ID NO: 450308 - RNA, 19 nt, Homo sapiens
gcuucccugcuuugaauua

SEQ ID NO: 450309 - RNA, 19 nt, Homo sapiens
aggcuuagaggauuagauu

SEQ ID NO: 450310 - RNA, 19 nt, Homo sapiens
cagcucagagacauaaaga

SEQ ID NO: 450311 - RNA, 19 nt, Homo sapiens
ccuccuacaucucacaaag

SEQ ID NO: 450312 - RNA, 19 nt, Homo sapiens
guagcuauugggauaauuc

SEQ ID NO: 450313 - RNA, 19 nt, Homo sapiens
cgucagcggauuauggauu

SEQ ID NO: 450314 - RNA, 19 nt, Homo sapiens
caccuacacuaccuacaag

SEQ ID NO: 450315 - RNA, 19 nt, Homo sapiens
gcauucaccacaucccaau

SEQ ID NO: 450316 - RNA, 19 nt, Homo sapiens
uuaucugccuguagcuauu

SEQ ID NO: 450317 - RNA, 19 nt, Homo sapiens
gaauccaagagucuaagau

SEQ ID NO: 450318 - RNA, 19 nt, Homo sapiens
gacuauaucaaggacauga

SEQ ID NO: 450319 - RNA, 19 nt, Homo sapiens
caacagcuucccacagcau

SEQ ID NO: 450320 - RNA, 19 nt, Homo sapiens
ugaagcccuacucaauaua

SEQ ID NO: 450321 - RNA, 19 nt, Homo sapiens
ccaagccaggugucauauu

SEQ ID NO: 450322 - RNA, 19 nt, Homo sapiens
gagugcugcuucaccuaca

SEQ ID NO: 450323 - RNA, 19 nt, Homo sapiens
caucccguguucacucaug

SEQ ID NO: 450324 - RNA, 19 nt, Homo sapiens
uacaagggcagagcuggua

SEQ ID NO: 450325 - RNA, 19 nt, Homo sapiens
cuggauccuccucuucuua

SEQ ID NO: 450326 - RNA, 19 nt, Homo sapiens
aaacugcaugguaacuauu

SEQ ID NO: 450327 - RNA, 19 nt, Homo sapiens
agaaacugcaugguaacua

SEQ ID NO: 450328 - RNA, 19 nt, Homo sapiens
uaucucaggcuuagaggau

SEQ ID NO: 450329 - RNA, 19 nt, Homo sapiens
cuccaagccaggugucaua

SEQ ID NO: 450330 - RNA, 19 nt, Homo sapiens
caaagcaucccguguucac

SEQ ID NO: 450331 - RNA, 19 nt, Homo sapiens
cugcaugguaacuauuaua

SEQ ID NO: 450332 - RNA, 19 nt, Homo sapiens
cagcucuccucccacaaca

SEQ ID NO: 450333 - RNA, 19 nt, Homo sapiens
cuucccugcuuugaauuaa

SEQ ID NO: 450334 - RNA, 19 nt, Homo sapiens
ggauucaccacugcuaaca

SEQ ID NO: 450335 - RNA, 19 nt, Homo sapiens
gccauuccgucuguaccaa

SEQ ID NO: 450336 - RNA, 19 nt, Homo sapiens
auccuccucuucuuauaaa

SEQ ID NO: 450337 - RNA, 19 nt, Homo sapiens
ugggauaauucgggaaauc

SEQ ID NO: 450338 - RNA, 19 nt, Homo sapiens
gaaacugcaugguaacuau

SEQ ID NO: 450339 - RNA, 19 nt, Homo sapiens
caacaccuccugugaguuu

SEQ ID NO: 450340 - RNA, 19 nt, Homo sapiens
gguuggaacuacaggaaua

SEQ ID NO: 450341 - RNA, 19 nt, Homo sapiens
gcugaagcccuacucaaua

SEQ ID NO: 450342 - RNA, 19 nt, Homo sapiens
caagccaggugucauauuc

SEQ ID NO: 450343 - RNA, 19 nt, Homo sapiens
gcagagacagaguuaauga

SEQ ID NO: 450344 - RNA, 19 nt, Homo sapiens
gaagcccuacucaauauaa

SEQ ID NO: 450345 - RNA, 19 nt, Homo sapiens
uuuagaaacugcaugguaa

SEQ ID NO: 450346 - RNA, 19 nt, Homo sapiens
gccuguagcuauugggaua

SEQ ID NO: 450347 - RNA, 19 nt, Homo sapiens
gcuuagaggauuagauuaa

SEQ ID NO: 450348 - RNA, 19 nt, Homo sapiens
gaacagcuuucacuuugcu

SEQ ID NO: 450349 - RNA, 19 nt, Homo sapiens
gagacagaguuaaugaugu

SEQ ID NO: 450350 - RNA, 19 nt, Homo sapiens
ucacaaagcaucccguguu

SEQ ID NO: 450351 - RNA, 19 nt, Homo sapiens
ucauauuccucaccaagaa

SEQ ID NO: 450352 - RNA, 19 nt, Homo sapiens
ggauccuccucuucuuaua

SEQ ID NO: 450353 - RNA, 19 nt, Homo sapiens
cagaguuaaugaugucaaa

SEQ ID NO: 450354 - RNA, 19 nt, Homo sapiens
gauccuccucuucuuauaa

SEQ ID NO: 450355 - RNA, 19 nt, Homo sapiens
cugaagcccuacucaauau

SEQ ID NO: 450356 - RNA, 19 nt, Homo sapiens
ucucaggcuuagaggauua

SEQ ID NO: 450357 - RNA, 19 nt, Homo sapiens
ucucagccuuguucucuuu

SEQ ID NO: 450358 - RNA, 19 nt, Homo sapiens
gcccuacucaauauaauaa

SEQ ID NO: 450359 - RNA, 19 nt, Homo sapiens
cacaaagcaucccguguuc

SEQ ID NO: 450360 - RNA, 19 nt, Homo sapiens
aauccaagagucuaagaua

SEQ ID NO: 450361 - RNA, 19 nt, Homo sapiens
ccaagagucuaagauaguc

SEQ ID NO: 450362 - RNA, 19 nt, Homo sapiens
acucuuccuugaaacauuu

SEQ ID NO: 450363 - RNA, 19 nt, Homo sapiens
ggaguucaggauugcauga

SEQ ID NO: 450364 - RNA, 19 nt, Homo sapiens
gcuuguugcuguccuugga

SEQ ID NO: 450365 - RNA, 19 nt, Homo sapiens
caucuuuguccucuacuuu

SEQ ID NO: 450366 - RNA, 19 nt, Homo sapiens
uaacaccuccugguuggaa

SEQ ID NO: 450367 - RNA, 19 nt, Homo sapiens
gacucuuccuugaaacauu

SEQ ID NO: 450368 - RNA, 19 nt, Homo sapiens
guccgggaguucaggauug

SEQ ID NO: 450369 - RNA, 19 nt, Homo sapiens
ccacaucccaauccugaau

SEQ ID NO: 450370 - RNA, 19 nt, Homo sapiens
ccuccucuucuuauaaaua

SEQ ID NO: 450371 - RNA, 19 nt, Homo sapiens
agagacagaguuaaugaug

SEQ ID NO: 450372 - RNA, 19 nt, Homo sapiens
uguugugucugguaaugaa

SEQ ID NO: 450373 - RNA, 19 nt, Homo sapiens
ggaacuacaggaauagaac

SEQ ID NO: 450374 - RNA, 19 nt, Homo sapiens
gaaaauccaguaguucuga

SEQ ID NO: 450375 - RNA, 19 nt, Homo sapiens
ugaugcagagacagaguua

SEQ ID NO: 450376 - RNA, 19 nt, Homo sapiens
gaacuacaggaauagaacu

SEQ ID NO: 450377 - RNA, 19 nt, Homo sapiens
aggcuuagaggauuagauu

SEQ ID NO: 450378 - RNA, 19 nt, Homo sapiens
ccuccuacaucucacaaag

SEQ ID NO: 450379 - RNA, 19 nt, Homo sapiens
guagcuauugggauaauuc

SEQ ID NO: 450380 - RNA, 19 nt, Homo sapiens
uccaacaccuccugugagu

SEQ ID NO: 450381 - RNA, 19 nt, Homo sapiens
ugucugguaaugaaaguaa

SEQ ID NO: 450382 - RNA, 19 nt, Homo sapiens
gcauucaccacaucccaau

SEQ ID NO: 450383 - RNA, 19 nt, Homo sapiens
uuaucugccuguagcuauu

SEQ ID NO: 450384 - RNA, 19 nt, Homo sapiens
gguaaugaaaguaaugcau

SEQ ID NO: 450385 - RNA, 19 nt, Homo sapiens
gaauccaagagucuaagau

SEQ ID NO: 450386 - RNA, 19 nt, Homo sapiens
gugaguuucuuggucugaa

SEQ ID NO: 450387 - RNA, 19 nt, Homo sapiens
ugaagcccuacucaauaua

SEQ ID NO: 450388 - RNA, 19 nt, Homo sapiens
ccaagccaggugucauauu

SEQ ID NO: 450389 - RNA, 19 nt, Homo sapiens
uauauuguugugucuggua

SEQ ID NO: 450390 - RNA, 19 nt, Homo sapiens
caucccguguucacucaug

SEQ ID NO: 450391 - RNA, 19 nt, Homo sapiens
uacaagggcagagcuggua

SEQ ID NO: 450392 - RNA, 19 nt, Homo sapiens
cuggauccuccucuucuua

SEQ ID NO: 450393 - RNA, 19 nt, Homo sapiens
aaacugcaugguaacuauu

SEQ ID NO: 450394 - RNA, 19 nt, Homo sapiens
agaaacugcaugguaacua

SEQ ID NO: 450395 - RNA, 19 nt, Homo sapiens
cuccaagccaggugucaua

SEQ ID NO: 450396 - RNA, 19 nt, Homo sapiens
caaagcaucccguguucac

SEQ ID NO: 450397 - RNA, 19 nt, Homo sapiens
uaucucaggcuuagaggau

SEQ ID NO: 450398 - RNA, 19 nt, Homo sapiens
cugcaugguaacuauuaua

SEQ ID NO: 450399 - RNA, 19 nt, Homo sapiens
ccuccaacaccuccuguga

SEQ ID NO: 450400 - RNA, 19 nt, Homo sapiens
ggauucaccacugcuaaca

SEQ ID NO: 450401 - RNA, 19 nt, Homo sapiens
auccuccucuucuuauaaa

SEQ ID NO: 450402 - RNA, 19 nt, Homo sapiens
ugggauaauucgggaaauc

SEQ ID NO: 450403 - RNA, 19 nt, Homo sapiens
gaaaggcccucaacuguca

SEQ ID NO: 450404 - RNA, 19 nt, Homo sapiens
gagagaagcagaacaauga

SEQ ID NO: 450405 - RNA, 19 nt, Homo sapiens
gaaacuagccagucacauu

SEQ ID NO: 450406 - RNA, 19 nt, Homo sapiens
gcuagauccucucauauuu

SEQ ID NO: 450407 - RNA, 19 nt, Homo sapiens
caccacaccuggcuaauuu

SEQ ID NO: 450408 - RNA, 19 nt, Homo sapiens
gagagugccugauuggaaa

SEQ ID NO: 450409 - RNA, 19 nt, Homo sapiens
gagaaaguguugccaagga

SEQ ID NO: 450410 - RNA, 19 nt, Homo sapiens
gagguacgcucuuuuauuu

SEQ ID NO: 450411 - RNA, 19 nt, Homo sapiens
gaggaaauaccaaaguuaa

SEQ ID NO: 450412 - RNA, 19 nt, Homo sapiens
caucaaggaucccaaccua

SEQ ID NO: 450413 - RNA, 19 nt, Homo sapiens
ggaaagaaaggguaugaga

SEQ ID NO: 450414 - RNA, 19 nt, Homo sapiens
guacagagagugccugauu

SEQ ID NO: 450415 - RNA, 19 nt, Homo sapiens
ggaggaaauaccaaaguua

SEQ ID NO: 450416 - RNA, 19 nt, Homo sapiens
gguaaacucuuaguccaaa

SEQ ID NO: 450417 - RNA, 19 nt, Homo sapiens
gagagaagaagaagaagaa

SEQ ID NO: 450418 - RNA, 19 nt, Homo sapiens
gcagagacuuugcuagauc

SEQ ID NO: 450419 - RNA, 19 nt, Homo sapiens
ccugcugccugaaguauua

SEQ ID NO: 450420 - RNA, 19 nt, Homo sapiens
ugaccaggcuuuaguggaa

SEQ ID NO: 450421 - RNA, 19 nt, Homo sapiens
gaugggaauauucacauua

SEQ ID NO: 450422 - RNA, 19 nt, Homo sapiens
ccauagaacucuugauuuu

SEQ ID NO: 450423 - RNA, 19 nt, Homo sapiens
gaucuuggcucacuguaac

SEQ ID NO: 450424 - RNA, 19 nt, Homo sapiens
gaaaacaggggaagccuua

SEQ ID NO: 450425 - RNA, 19 nt, Homo sapiens
ggagacuaguggugggaua

SEQ ID NO: 450426 - RNA, 19 nt, Homo sapiens
gaacuuguccacgguuaaa

SEQ ID NO: 450427 - RNA, 19 nt, Homo sapiens
gaagaagaagagacacaaa

SEQ ID NO: 450428 - RNA, 19 nt, Homo sapiens
ggaugggaauauucacauu

SEQ ID NO: 450429 - RNA, 19 nt, Homo sapiens
ggccagugcacucuuaaua

SEQ ID NO: 450430 - RNA, 19 nt, Homo sapiens
gaaguauuaugagaaagug

SEQ ID NO: 450431 - RNA, 19 nt, Homo sapiens
ccugaaguauuaugagaaa

SEQ ID NO: 450432 - RNA, 19 nt, Homo sapiens
guccucauccuuaucauua

SEQ ID NO: 450433 - RNA, 19 nt, Homo sapiens
ccagugcacucuuaauaca

SEQ ID NO: 450434 - RNA, 19 nt, Homo sapiens
ggaagcccuuguuuacaga

SEQ ID NO: 450435 - RNA, 19 nt, Homo sapiens
gcagaacaaugaucaaaau

SEQ ID NO: 450436 - RNA, 19 nt, Homo sapiens
gaagaagagacacaaaucu

SEQ ID NO: 450437 - RNA, 19 nt, Homo sapiens
ggagugcaguggugugauc

SEQ ID NO: 450438 - RNA, 19 nt, Homo sapiens
cagaaaggcccucaacugu

SEQ ID NO: 450439 - RNA, 19 nt, Homo sapiens
gagaagaagaagaagaaga

SEQ ID NO: 450440 - RNA, 19 nt, Homo sapiens
agagagagaagaagaagaa

SEQ ID NO: 450441 - RNA, 19 nt, Homo sapiens
gaagagagggguaaaccua

SEQ ID NO: 450442 - RNA, 19 nt, Homo sapiens
uuugcuagauccucucaua

SEQ ID NO: 450443 - RNA, 19 nt, Homo sapiens
ggaaauaccaaaguuaagg

SEQ ID NO: 450444 - RNA, 19 nt, Homo sapiens
uaaaggagaaguauuucga

SEQ ID NO: 450445 - RNA, 19 nt, Homo sapiens
aaacuagccagucacauug

SEQ ID NO: 450446 - RNA, 19 nt, Homo sapiens
gagagagagagaagaagaa

SEQ ID NO: 450447 - RNA, 19 nt, Homo sapiens
caacagacaacaucuucau

SEQ ID NO: 450448 - RNA, 19 nt, Homo sapiens
aaagaaaggguaugagaca

SEQ ID NO: 450449 - RNA, 19 nt, Homo sapiens
gggaauauucacauuaauc

SEQ ID NO: 450450 - RNA, 19 nt, Homo sapiens
ccagucacauugagagaag

SEQ ID NO: 450451 - RNA, 19 nt, Homo sapiens
gaaguccggaugggaauau

SEQ ID NO: 450452 - RNA, 19 nt, Homo sapiens
cuccugcucucuuucaauu

SEQ ID NO: 450453 - RNA, 19 nt, Homo sapiens
gugcaguggugugaucuug

SEQ ID NO: 450454 - RNA, 19 nt, Homo sapiens
aggaggaaauaccaaaguu

SEQ ID NO: 450455 - RNA, 19 nt, Homo sapiens
ggaacuuguccacgguuaa

SEQ ID NO: 450456 - RNA, 19 nt, Homo sapiens
uacagagagugccugauug

SEQ ID NO: 450457 - RNA, 19 nt, Homo sapiens
gaagaagaagaagaagaga

SEQ ID NO: 450458 - RNA, 19 nt, Homo sapiens
agagagagagagagaagaa

SEQ ID NO: 450459 - RNA, 19 nt, Homo sapiens
caagaggaaccgagaaguc

SEQ ID NO: 450460 - RNA, 19 nt, Homo sapiens
ggaaguccggaugggaaua

SEQ ID NO: 450461 - RNA, 19 nt, Homo sapiens
ccagugaugaccaggcuuu

SEQ ID NO: 450462 - RNA, 19 nt, Homo sapiens
agagagugccugauuggaa

SEQ ID NO: 450463 - RNA, 19 nt, Homo sapiens
ccaccacaccuggcuaauu

SEQ ID NO: 450464 - RNA, 19 nt, Homo sapiens
ugagagaagcagaacaaug

SEQ ID NO: 450465 - RNA, 19 nt, Homo sapiens
uggaagcccuuguuuacag

SEQ ID NO: 450466 - RNA, 19 nt, Homo sapiens
acagaaaggcccucaacug

SEQ ID NO: 450467 - RNA, 19 nt, Homo sapiens
ucauucggcucucccugaa

SEQ ID NO: 450468 - RNA, 19 nt, Homo sapiens
agaagaagaagaagagaca

SEQ ID NO: 450469 - RNA, 19 nt, Homo sapiens
acagacaacaucuucauuc

SEQ ID NO: 450470 - RNA, 19 nt, Homo sapiens
ugagauagggucuuacucu

SEQ ID NO: 450471 - RNA, 19 nt, Homo sapiens
aaggagaaguauuucgaau

SEQ ID NO: 450472 - RNA, 19 nt, Homo sapiens
uaguggaagcccuuguuua

SEQ ID NO: 450473 - RNA, 19 nt, Homo sapiens
acgacuggguccaagagua

SEQ ID NO: 450474 - RNA, 19 nt, Homo sapiens
agacgggauucuaccaugu

SEQ ID NO: 450475 - RNA, 19 nt, Homo sapiens
gaagcagaacaaugaucaa

SEQ ID NO: 450476 - RNA, 19 nt, Homo sapiens
agaagaagagacacaaauc

SEQ ID NO: 450477 - RNA, 19 nt, Homo sapiens
agaagaagaagaagaagag

SEQ ID NO: 450478 - RNA, 19 nt, Homo sapiens
caaaagugcugggauuaca

SEQ ID NO: 450479 - RNA, 19 nt, Homo sapiens
aaacucgugugcccaagca

SEQ ID NO: 450480 - RNA, 19 nt, Homo sapiens
cagacaacaucuucauucg

SEQ ID NO: 450481 - RNA, 19 nt, Homo sapiens
cuuauuaggcugaaacuag

SEQ ID NO: 450482 - RNA, 19 nt, Homo sapiens
agagagagagagaagaaga

SEQ ID NO: 450483 - RNA, 19 nt, Homo sapiens
uuuccagccuuccagauga

SEQ ID NO: 450484 - RNA, 19 nt, Homo sapiens
gcaacagacaacaucuuca

SEQ ID NO: 450485 - RNA, 19 nt, Homo sapiens
agaagcagaacaaugauca

SEQ ID NO: 450486 - RNA, 19 nt, Homo sapiens
ccucaacucccagugauga

SEQ ID NO: 450487 - RNA, 19 nt, Homo sapiens
aggaacuuguccacgguua

SEQ ID NO: 450488 - RNA, 19 nt, Homo sapiens
ccucccauguuaagcuuug

SEQ ID NO: 450489 - RNA, 19 nt, Homo sapiens
aagaagaagagacacaaau

SEQ ID NO: 450490 - RNA, 19 nt, Homo sapiens
cccauagaacucuugauuu

SEQ ID NO: 450491 - RNA, 19 nt, Homo sapiens
ugccugaaguauuaugaga

SEQ ID NO: 450492 - RNA, 19 nt, Homo sapiens
gcacucuuaauacacagaa

SEQ ID NO: 450493 - RNA, 19 nt, Homo sapiens
gagagagagaagaagaaga

SEQ ID NO: 450494 - RNA, 19 nt, Homo sapiens
cuccuuguccucauccuua

SEQ ID NO: 450495 - RNA, 19 nt, Homo sapiens
gagaagcagaacaaugauc

SEQ ID NO: 450496 - RNA, 19 nt, Homo sapiens
ggcuagggguaaacucuua

SEQ ID NO: 450497 - RNA, 19 nt, Homo sapiens
aaagagagagagagagaag

SEQ ID NO: 450498 - RNA, 19 nt, Homo sapiens
aaaggagaaguauuucgaa

SEQ ID NO: 450499 - RNA, 19 nt, Homo sapiens
aagcagaacaaugaucaaa

SEQ ID NO: 450500 - RNA, 19 nt, Homo sapiens
gcuccucaacucccaguga

SEQ ID NO: 450501 - RNA, 19 nt, Homo sapiens
uagauccucucauauuuug

SEQ ID NO: 450502 - RNA, 19 nt, Homo sapiens
uugcagagacuuugcuaga

SEQ ID NO: 450503 - RNA, 19 nt, Homo sapiens
gcacaaagggcccagauua

SEQ ID NO: 450504 - RNA, 19 nt, Homo sapiens
ugggagagcugaauucaaa

SEQ ID NO: 450505 - RNA, 19 nt, Homo sapiens
gaagaaugcaguuaaauac

SEQ ID NO: 450506 - RNA, 19 nt, Homo sapiens
cgaagaagagccacaguga

SEQ ID NO: 450507 - RNA, 19 nt, Homo sapiens
agagggaccugcacacaga

SEQ ID NO: 450508 - RNA, 19 nt, Homo sapiens
gaaagcugaagacguggua

SEQ ID NO: 450509 - RNA, 19 nt, Homo sapiens
acaaagggcccagauuaaa

SEQ ID NO: 450510 - RNA, 19 nt, Homo sapiens
cacaaagggcccagauuaa

SEQ ID NO: 450511 - RNA, 19 nt, Homo sapiens
gagugaagaaugcaguuaa

SEQ ID NO: 450512 - RNA, 19 nt, Homo sapiens
caaagggcccagauuaaag

SEQ ID NO: 450513 - RNA, 19 nt, Homo sapiens
gggcuucucugcagcacau

SEQ ID NO: 450514 - RNA, 19 nt, Homo sapiens
agugaagaaugcaguuaaa

SEQ ID NO: 450515 - RNA, 19 nt, Homo sapiens
gggcccagauuaaagucuu

SEQ ID NO: 450516 - RNA, 19 nt, Homo sapiens
acaagagagugaagaaugc

SEQ ID NO: 450517 - RNA, 19 nt, Homo sapiens
guacuucaagggagccauu

SEQ ID NO: 450518 - RNA, 19 nt, Homo sapiens
caacaagagagugaagaau

SEQ ID NO: 450519 - RNA, 19 nt, Homo sapiens
gaagacgugguaccagaca

SEQ ID NO: 450520 - RNA, 19 nt, Homo sapiens
gaugggagagcugaauuca

SEQ ID NO: 450521 - RNA, 19 nt, Homo sapiens
aacaagagagugaagaaug

SEQ ID NO: 450522 - RNA, 19 nt, Homo sapiens
acaacaagagagugaagaa

SEQ ID NO: 450523 - RNA, 19 nt, Homo sapiens
caacaacaagagagugaag

SEQ ID NO: 450524 - RNA, 19 nt, Homo sapiens
gagagugaagaaugcaguu

SEQ ID NO: 450525 - RNA, 19 nt, Homo sapiens
agaaugcaguuaaauaccu

SEQ ID NO: 450526 - RNA, 19 nt, Homo sapiens
gcagcucgagggaccaaug

SEQ ID NO: 450527 - RNA, 19 nt, Homo sapiens
aaagggcccagauuaaagu

SEQ ID NO: 450528 - RNA, 19 nt, Homo sapiens
agagugaagaaugcaguua

SEQ ID NO: 450529 - RNA, 19 nt, Homo sapiens
gagccacagugagggagau

SEQ ID NO: 450530 - RNA, 19 nt, Homo sapiens
gugaagaaugcaguuaaau

SEQ ID NO: 450531 - RNA, 19 nt, Homo sapiens
agaaguggguccagaaaua

SEQ ID NO: 450532 - RNA, 19 nt, Homo sapiens
cagcagacauugugccaua

SEQ ID NO: 450533 - RNA, 19 nt, Homo sapiens
gagcugcauuaugaaauua

SEQ ID NO: 450534 - RNA, 19 nt, Homo sapiens
gcuaugcccagccacauua

SEQ ID NO: 450535 - RNA, 19 nt, Homo sapiens
ccacaaaaguucauaguug

SEQ ID NO: 450536 - RNA, 19 nt, Homo sapiens
ucugacaucucaugacauu

SEQ ID NO: 450537 - RNA, 19 nt, Homo sapiens
ugccauauguaucaaauga

SEQ ID NO: 450538 - RNA, 19 nt, Homo sapiens
ugagcugcauuaugaaauu

SEQ ID NO: 450539 - RNA, 19 nt, Homo sapiens
uuguugagcugcauuauga

SEQ ID NO: 450540 - RNA, 19 nt, Homo sapiens
ccauauguaucaaaugaca

SEQ ID NO: 450541 - RNA, 19 nt, Homo sapiens
cuucaacucuucguacauu

SEQ ID NO: 450542 - RNA, 19 nt, Homo sapiens
ugacaucucaugacauugu

SEQ ID NO: 450543 - RNA, 19 nt, Homo sapiens
aaaccagcauucucacugu

SEQ ID NO: 450544 - RNA, 19 nt, Homo sapiens
cuaagagucccaucugcua

SEQ ID NO: 450545 - RNA, 19 nt, Homo sapiens
gcaccaccuuuuaauauau

SEQ ID NO: 450546 - RNA, 19 nt, Homo sapiens
uaagaaguggguccagaaa

SEQ ID NO: 450547 - RNA, 19 nt, Homo sapiens
ucucugacaucucaugaca

SEQ ID NO: 450548 - RNA, 19 nt, Homo sapiens
gcccagccacauuaacuaa

SEQ ID NO: 450549 - RNA, 19 nt, Homo sapiens
ccaggugucauccuccuaa

SEQ ID NO: 450550 - RNA, 19 nt, Homo sapiens
gcagacauugugccauaug

SEQ ID NO: 450551 - RNA, 19 nt, Homo sapiens
gaaguggguccagaaauac

SEQ ID NO: 450552 - RNA, 19 nt, Homo sapiens
cacaaaaguucauaguuga

SEQ ID NO: 450553 - RNA, 19 nt, Homo sapiens
gcucugcugccucgucuau

SEQ ID NO: 450554 - RNA, 19 nt, Homo sapiens
ccagccacauuaacuaacu

SEQ ID NO: 450555 - RNA, 19 nt, Homo sapiens
uaagagucccaucugcuau

SEQ ID NO: 450556 - RNA, 19 nt, Homo sapiens
gcucagcaccaccuuuuaa

SEQ ID NO: 450557 - RNA, 19 nt, Homo sapiens
guugagcugcauuaugaaa

SEQ ID NO: 450558 - RNA, 19 nt, Homo sapiens
gaucugugcugaccccaau

SEQ ID NO: 450559 - RNA, 19 nt, Homo sapiens
caacucuucguacauucaa

SEQ ID NO: 450560 - RNA, 19 nt, Homo sapiens
gcgagggcccagugaacuu

SEQ ID NO: 450561 - RNA, 19 nt, Homo sapiens
ucaaugcauggaucaauca

SEQ ID NO: 450562 - RNA, 19 nt, Homo sapiens
ccuugcagcugcccuccuu

SEQ ID NO: 450563 - RNA, 19 nt, Homo sapiens
cauugugccauauguauca

SEQ ID NO: 450564 - RNA, 19 nt, Homo sapiens
cagccacauuaacuaacuu

SEQ ID NO: 450565 - RNA, 19 nt, Homo sapiens
cagcaccaccuuuuaauau

SEQ ID NO: 450566 - RNA, 19 nt, Homo sapiens
gcugcauuaugaaauuagu

SEQ ID NO: 450567 - RNA, 19 nt, Homo sapiens
gugcugaccccaauaagaa

SEQ ID NO: 450568 - RNA, 19 nt, Homo sapiens
cugcuccugugcacaaguu

SEQ ID NO: 450569 - RNA, 19 nt, Homo sapiens
agucaagcauugugaauua

SEQ ID NO: 450570 - RNA, 19 nt, Homo sapiens
gaaccgaggaccagaagga

SEQ ID NO: 450571 - RNA, 19 nt, Homo sapiens
ucacucacaccuugcauuu

SEQ ID NO: 450572 - RNA, 19 nt, Homo sapiens
acucacaccuugcauuuca

SEQ ID NO: 450573 - RNA, 19 nt, Homo sapiens
gcaccaaugaugcugaaga

SEQ ID NO: 450574 - RNA, 19 nt, Homo sapiens
uugcaaugcuaccaauaaa

SEQ ID NO: 450575 - RNA, 19 nt, Homo sapiens
ggaccucagccaagaugaa

SEQ ID NO: 450576 - RNA, 19 nt, Homo sapiens
gaacuuccacuaccuucuc

SEQ ID NO: 450577 - RNA, 19 nt, Homo sapiens
cgccugguguuuacaacua

SEQ ID NO: 450578 - RNA, 19 nt, Homo sapiens
gcaaugcuaccaauaaagc

SEQ ID NO: 450579 - RNA, 19 nt, Homo sapiens
ccacuaccuucucaucaag

SEQ ID NO: 450580 - RNA, 19 nt, Homo sapiens
ccgcagcaguuaaccuaug

SEQ ID NO: 450581 - RNA, 19 nt, Homo sapiens
gagggugaguguggucaga

SEQ ID NO: 450582 - RNA, 19 nt, Homo sapiens
gagucaagcauugugaauu

SEQ ID NO: 450583 - RNA, 19 nt, Homo sapiens
ggaguccgagucaagcauu

SEQ ID NO: 450584 - RNA, 19 nt, Homo sapiens
cgcagcaguuaaccuauga

SEQ ID NO: 450585 - RNA, 19 nt, Homo sapiens
gccugguguuuacaacuaa

SEQ ID NO: 450586 - RNA, 19 nt, Homo sapiens
gugaguguggucagaguaa

SEQ ID NO: 450587 - RNA, 19 nt, Homo sapiens
gucaagcauugugaauuau

SEQ ID NO: 450588 - RNA, 19 nt, Homo sapiens
uccacuaccuucucaucaa

SEQ ID NO: 450589 - RNA, 19 nt, Homo sapiens
ugaguguggucagaguaaa

SEQ ID NO: 450590 - RNA, 19 nt, Homo sapiens
cagcuggcgcucacacauu

SEQ ID NO: 450591 - RNA, 19 nt, Homo sapiens
gaguccgagucaagcauug

SEQ ID NO: 450592 - RNA, 19 nt, Homo sapiens
ggugccugcuguaguguuc

SEQ ID NO: 450593 - RNA, 19 nt, Homo sapiens
cuggguacaucgugaggaa

SEQ ID NO: 450594 - RNA, 19 nt, Homo sapiens
caccaaugaugcugaagac

SEQ ID NO: 450595 - RNA, 19 nt, Homo sapiens
uggcaccaaugaugcugaa

SEQ ID NO: 450596 - RNA, 19 nt, Homo sapiens
ggugaguguggucagagua

SEQ ID NO: 450597 - RNA, 19 nt, Homo sapiens
aaagccgccugguguuuac

SEQ ID NO: 450598 - RNA, 19 nt, Homo sapiens
auaaagccgccugguguuu

SEQ ID NO: 450599 - RNA, 19 nt, Homo sapiens
gagcagaucuguucuuuga

SEQ ID NO: 450600 - RNA, 19 nt, Homo sapiens
caucaaugcuaucaucuuu

SEQ ID NO: 450601 - RNA, 19 nt, Homo sapiens
caucauaguuugcuuuguu

SEQ ID NO: 450602 - RNA, 19 nt, Homo sapiens
ggacauagcccaagaacag

SEQ ID NO: 450603 - RNA, 19 nt, Homo sapiens
agacuugggugaaauauau

SEQ ID NO: 450604 - RNA, 19 nt, Homo sapiens
ccaaagaacuggguacuca

SEQ ID NO: 450605 - RNA, 19 nt, Homo sapiens
gcuaucaucuuucacacaa

SEQ ID NO: 450606 - RNA, 19 nt, Homo sapiens
gaucuguucuuugagcuaa

SEQ ID NO: 450607 - RNA, 19 nt, Homo sapiens
ggaauggaauuggacauag

SEQ ID NO: 450608 - RNA, 19 nt, Homo sapiens
gcuccuggcugcuuugaug

SEQ ID NO: 450609 - RNA, 19 nt, Homo sapiens
gaaguugauucauauugca

SEQ ID NO: 450610 - RNA, 19 nt, Homo sapiens
ucaaugcuaucaucuuuca

SEQ ID NO: 450611 - RNA, 19 nt, Homo sapiens
ugacaucaaugcuaucauc

SEQ ID NO: 450612 - RNA, 19 nt, Homo sapiens
cauauugcaucauaguuug

SEQ ID NO: 450613 - RNA, 19 nt, Homo sapiens
gcugugacaucaaugcuau

SEQ ID NO: 450614 - RNA, 19 nt, Homo sapiens
uauauggacuuucuugcaa

SEQ ID NO: 450615 - RNA, 19 nt, Homo sapiens
cacggcagcuggccaauga

SEQ ID NO: 450616 - RNA, 19 nt, Homo sapiens
aaacagacuugggugaaau

SEQ ID NO: 450617 - RNA, 19 nt, Homo sapiens
ugaaggcugugacaucaau

SEQ ID NO: 450618 - RNA, 19 nt, Homo sapiens
gcacaucauggaggguuua

SEQ ID NO: 450619 - RNA, 19 nt, Homo sapiens
acacugagcagaucuguuc

SEQ ID NO: 450620 - RNA, 19 nt, Homo sapiens
gaauggaauuggacauagc

SEQ ID NO: 450621 - RNA, 19 nt, Homo sapiens
aaugaaggcugugacauca

SEQ ID NO: 450622 - RNA, 19 nt, Homo sapiens
agaagcagcaagcaacuuu

SEQ ID NO: 450623 - RNA, 19 nt, Homo sapiens
gauuauauggacuuucuug

SEQ ID NO: 450624 - RNA, 19 nt, Homo sapiens
cauggaggguuuagugcuu

SEQ ID NO: 450625 - RNA, 19 nt, Homo sapiens
gaccguauucuucauccua

SEQ ID NO: 450626 - RNA, 19 nt, Homo sapiens
acacagaccguauucuuca

SEQ ID NO: 450627 - RNA, 19 nt, Homo sapiens
caaugaaggcugugacauc

SEQ ID NO: 450628 - RNA, 19 nt, Homo sapiens
ugacugcugucuuggauac

SEQ ID NO: 450629 - RNA, 19 nt, Homo sapiens
cugagcagaucuguucuuu

SEQ ID NO: 450630 - RNA, 19 nt, Homo sapiens
gaacagaaagaaccuugcu

SEQ ID NO: 450631 - RNA, 19 nt, Homo sapiens
caucauggaggguuuagug

SEQ ID NO: 450632 - RNA, 19 nt, Homo sapiens
gguuuagugcaaaguauaa

SEQ ID NO: 450633 - RNA, 19 nt, Homo sapiens
gaagcagcaagcaacuuug

SEQ ID NO: 450634 - RNA, 19 nt, Homo sapiens
gcaagcaacaagcuauuuu

SEQ ID NO: 450635 - RNA, 19 nt, Homo sapiens
gaacuggguacucaacacu

SEQ ID NO: 450636 - RNA, 19 nt, Homo sapiens
caacuuugacugcugucuu

SEQ ID NO: 450637 - RNA, 19 nt, Homo sapiens
uggaauggaauuggacaua

SEQ ID NO: 450638 - RNA, 19 nt, Homo sapiens
cagacuugggugaaauaua

SEQ ID NO: 450639 - RNA, 19 nt, Homo sapiens
caaagaacuggguacucaa

SEQ ID NO: 450640 - RNA, 19 nt, Homo sapiens
aacuuugacugcugucuug

SEQ ID NO: 450641 - RNA, 19 nt, Homo sapiens
gcagcaagcaacuuugacu

SEQ ID NO: 450642 - RNA, 19 nt, Homo sapiens
acuggguacucaacacuga

SEQ ID NO: 450643 - RNA, 19 nt, Homo sapiens
accaugugcuguaccaaga

SEQ ID NO: 450644 - RNA, 19 nt, Homo sapiens
aagcagcaagcaacuuuga

SEQ ID NO: 450645 - RNA, 19 nt, Homo sapiens
gugccucacuggacuuguc

SEQ ID NO: 450646 - RNA, 19 nt, Homo sapiens
ccaccucugcggcgaauca

SEQ ID NO: 450647 - RNA, 19 nt, Homo sapiens
auggaggguuuagugcuua

SEQ ID NO: 450648 - RNA, 19 nt, Homo sapiens
aaaacagacuugggugaaa

SEQ ID NO: 450649 - RNA, 19 nt, Homo sapiens
uccauaagcuauuuugguu

SEQ ID NO: 450650 - RNA, 19 nt, Homo sapiens
agguuucacuugcacauca

SEQ ID NO: 450651 - RNA, 19 nt, Homo sapiens
gacauagcccaagaacaga

SEQ ID NO: 450652 - RNA, 19 nt, Homo sapiens
uuucuggaauggaauugga

SEQ ID NO: 450653 - RNA, 19 nt, Homo sapiens
accguauucuucauccuaa

SEQ ID NO: 450654 - RNA, 19 nt, Homo sapiens
ccucagcucuggccucuua

SEQ ID NO: 450655 - RNA, 19 nt, Homo sapiens
gaaaggaaagggcuccaaa

SEQ ID NO: 450656 - RNA, 19 nt, Homo sapiens
gaagauucccgccaagguu

SEQ ID NO: 450657 - RNA, 19 nt, Homo sapiens
cuccaagacuggcaagaaa

SEQ ID NO: 450658 - RNA, 19 nt, Homo sapiens
caucccagcuauccuguuc

SEQ ID NO: 450659 - RNA, 19 nt, Homo sapiens
ucaaguacagccaaaggaa

SEQ ID NO: 450660 - RNA, 19 nt, Homo sapiens
gcaagaaggaggcuaugcu

SEQ ID NO: 450661 - RNA, 19 nt, Homo sapiens
gaugcaagaaggaggcuau

SEQ ID NO: 450662 - RNA, 19 nt, Homo sapiens
gaacccaagaugcaagaag

SEQ ID NO: 450663 - RNA, 19 nt, Homo sapiens
caggccagguccagagaga

SEQ ID NO: 450664 - RNA, 19 nt, Homo sapiens
gagccuccuuauccugguu

SEQ ID NO: 450665 - RNA, 19 nt, Homo sapiens
ccaagguuguccgcagcua

SEQ ID NO: 450666 - RNA, 19 nt, Homo sapiens
ucaggacuguugccucaag

SEQ ID NO: 450667 - RNA, 19 nt, Homo sapiens
cacucuuucuccugcuuua

SEQ ID NO: 450668 - RNA, 19 nt, Homo sapiens
ggacuguugccucaaguac

SEQ ID NO: 450669 - RNA, 19 nt, Homo sapiens
guacagccaaaggaagauu

SEQ ID NO: 450670 - RNA, 19 nt, Homo sapiens
uauccugguucuggccuuu

SEQ ID NO: 450671 - RNA, 19 nt, Homo sapiens
ucccagcuauccuguucuu

SEQ ID NO: 450672 - RNA, 19 nt, Homo sapiens
gcuaugugcagacccaaag

SEQ ID NO: 450673 - RNA, 19 nt, Homo sapiens
gaaaguggcugcagacaaa

SEQ ID NO: 450674 - RNA, 19 nt, Homo sapiens
ggaccaagguuucuagcua

SEQ ID NO: 450675 - RNA, 19 nt, Homo sapiens
gaccaagguuucuagcuaa

SEQ ID NO: 450676 - RNA, 19 nt, Homo sapiens
ucaauaagcugagccaaug

SEQ ID NO: 450677 - RNA, 19 nt, Homo sapiens
gaagaugauucucaauaag

SEQ ID NO: 450678 - RNA, 19 nt, Homo sapiens
ccacuucccuucaugaaug

SEQ ID NO: 450679 - RNA, 19 nt, Homo sapiens
gaacccagccugacaaauc

SEQ ID NO: 450680 - RNA, 19 nt, Homo sapiens
ccaaguagcugggauuaca

SEQ ID NO: 450681 - RNA, 19 nt, Homo sapiens
gcaguuacauaucaauaca

SEQ ID NO: 450682 - RNA, 19 nt, Homo sapiens
ugagaauguucaccuuaua

SEQ ID NO: 450683 - RNA, 19 nt, Homo sapiens
cuaccucccugccauuaua

SEQ ID NO: 450684 - RNA, 19 nt, Homo sapiens
gcuauggugugaaagacua

SEQ ID NO: 450685 - RNA, 19 nt, Homo sapiens
guaauugagugaaggaauc

SEQ ID NO: 450686 - RNA, 19 nt, Homo sapiens
gugaagaugauucucaaua

SEQ ID NO: 450687 - RNA, 19 nt, Homo sapiens
agacgaggcuucaccaugu

SEQ ID NO: 450688 - RNA, 19 nt, Homo sapiens
caagguuucuagcuaaguu

SEQ ID NO: 450689 - RNA, 19 nt, Homo sapiens
gggcucagguugaaagugu

SEQ ID NO: 450690 - RNA, 19 nt, Homo sapiens
caaagaguaggguguaauu

SEQ ID NO: 450691 - RNA, 19 nt, Homo sapiens
cacuacggcuggcuaauuu

SEQ ID NO: 450692 - RNA, 19 nt, Homo sapiens
gagcauggaucgccuacag

SEQ ID NO: 450693 - RNA, 19 nt, Homo sapiens
uugcuaaccuucagggaua

SEQ ID NO: 450694 - RNA, 19 nt, Homo sapiens
ccaaagugcugagauuaca

SEQ ID NO: 450695 - RNA, 19 nt, Homo sapiens
gacucaaggucacuagaaa

SEQ ID NO: 450696 - RNA, 19 nt, Homo sapiens
ugucgugucugcuuacauu

SEQ ID NO: 450697 - RNA, 19 nt, Homo sapiens
gaucucggcucacuacaac

SEQ ID NO: 450698 - RNA, 19 nt, Homo sapiens
gguaauuccauuucaugua

SEQ ID NO: 450699 - RNA, 19 nt, Homo sapiens
ccaaagugcugggauuaca

SEQ ID NO: 450700 - RNA, 19 nt, Homo sapiens
ccaaagugcugggauuaca

SEQ ID NO: 450701 - RNA, 19 nt, Homo sapiens
acaagugucugguccuuuc

SEQ ID NO: 450702 - RNA, 19 nt, Homo sapiens
ggagugcaguggcgugauc

SEQ ID NO: 450703 - RNA, 19 nt, Homo sapiens
gguguggucuuggcuuauu

SEQ ID NO: 450704 - RNA, 19 nt, Homo sapiens
gagauggaguuucgcucuu

SEQ ID NO: 450705 - RNA, 19 nt, Homo sapiens
ccaagcagcugguaauucc

SEQ ID NO: 450706 - RNA, 19 nt, Homo sapiens
auacuuaagaggccaaaua

SEQ ID NO: 450707 - RNA, 19 nt, Homo sapiens
ccuuugacuugguauuaua

SEQ ID NO: 450708 - RNA, 19 nt, Homo sapiens
aagcuggaguuauauaugu

SEQ ID NO: 450709 - RNA, 19 nt, Homo sapiens
uaagaggccaaauagauga

SEQ ID NO: 450710 - RNA, 19 nt, Homo sapiens
gacaaucaaauucaugcua

SEQ ID NO: 450711 - RNA, 19 nt, Homo sapiens
uaauaacccuagucacagu

SEQ ID NO: 450712 - RNA, 19 nt, Homo sapiens
gggugaagaugauucucaa

SEQ ID NO: 450713 - RNA, 19 nt, Homo sapiens
ucuccaagccucuagcaua

SEQ ID NO: 450714 - RNA, 19 nt, Homo sapiens
ggcaaagaguaggguguaa

SEQ ID NO: 450715 - RNA, 19 nt, Homo sapiens
gguauuauaagcuggaguu

SEQ ID NO: 450716 - RNA, 19 nt, Homo sapiens
caagugauccaccuuccuu

SEQ ID NO: 450717 - RNA, 19 nt, Homo sapiens
ccacuacggcuggcuaauu

SEQ ID NO: 450718 - RNA, 19 nt, Homo sapiens
agacugcacuccugguugu

SEQ ID NO: 450719 - RNA, 19 nt, Homo sapiens
gagaauguucaccuuauag

SEQ ID NO: 450720 - RNA, 19 nt, Homo sapiens
uaugugucgugucugcuua

SEQ ID NO: 450721 - RNA, 19 nt, Homo sapiens
ccagguaaaggacauaaau

SEQ ID NO: 450722 - RNA, 19 nt, Homo sapiens
gcaaagaguaggguguaau

SEQ ID NO: 450723 - RNA, 19 nt, Homo sapiens
caaucaaauucaugcuaug

SEQ ID NO: 450724 - RNA, 19 nt, Homo sapiens
gcacuagaaggacgaaucu

SEQ ID NO: 450725 - RNA, 19 nt, Homo sapiens
uauuugaaccuguggaauu

SEQ ID NO: 450726 - RNA, 19 nt, Homo sapiens
aagaguaggguguaauuga

SEQ ID NO: 450727 - RNA, 19 nt, Homo sapiens
gaacuccugaccucaagug

SEQ ID NO: 450728 - RNA, 19 nt, Homo sapiens
cacagugccuggccucuuc

SEQ ID NO: 450729 - RNA, 19 nt, Homo sapiens
gacgaggcuucaccauguu

SEQ ID NO: 450730 - RNA, 19 nt, Homo sapiens
ccagcugggucaaugugaa

SEQ ID NO: 450731 - RNA, 19 nt, Homo sapiens
aaucagagcccagaaagug

SEQ ID NO: 450732 - RNA, 19 nt, Homo sapiens
gcauagagcacugcagaca

SEQ ID NO: 450733 - RNA, 19 nt, Homo sapiens
uagcuaaguuacucuaguc

SEQ ID NO: 450734 - RNA, 19 nt, Homo sapiens
caggacugcuggaaaauaa

SEQ ID NO: 450735 - RNA, 19 nt, Homo sapiens
cuuaagaggccaaauagau

SEQ ID NO: 450736 - RNA, 19 nt, Homo sapiens
uuacaggcgugagcuauca

SEQ ID NO: 450737 - RNA, 19 nt, Homo sapiens
gugcaaugguguggucuug

SEQ ID NO: 450738 - RNA, 19 nt, Homo sapiens
ggaucuggguuccaucucu

SEQ ID NO: 450739 - RNA, 19 nt, Homo sapiens
ggaauuggaggaggccauu

SEQ ID NO: 450740 - RNA, 19 nt, Homo sapiens
gaggccaaauagaugaaug

SEQ ID NO: 450741 - RNA, 19 nt, Homo sapiens
uuacaggugugugccacua

SEQ ID NO: 450742 - RNA, 19 nt, Homo sapiens
ucaugaauguuggguucua

SEQ ID NO: 450743 - RNA, 19 nt, Homo sapiens
uuaagaggccaaauagaug

SEQ ID NO: 450744 - RNA, 19 nt, Homo sapiens
aaaggcaguuacauaucaa

SEQ ID NO: 450745 - RNA, 19 nt, Homo sapiens
aaaaggcaguuacauauca

SEQ ID NO: 450746 - RNA, 19 nt, Homo sapiens
ccaaaaggcaguuacauau

SEQ ID NO: 450747 - RNA, 19 nt, Homo sapiens
cuuaauaacccuagucaca

SEQ ID NO: 450748 - RNA, 19 nt, Homo sapiens
cugccuccuuccuuaaaua

SEQ ID NO: 450749 - RNA, 19 nt, Homo sapiens
cugaguagcugggauuaca

SEQ ID NO: 450750 - RNA, 19 nt, Homo sapiens
gauggaguuucgcucuugu

SEQ ID NO: 450751 - RNA, 19 nt, Homo sapiens
ccaaauuugcccagauuca

SEQ ID NO: 450752 - RNA, 19 nt, Homo sapiens
gcugguaauuccauuucau

SEQ ID NO: 450753 - RNA, 19 nt, Homo sapiens
cagaaucagagcccagaaa

SEQ ID NO: 450754 - RNA, 19 nt, Homo sapiens
gguucuagcucccuguucu

SEQ ID NO: 450755 - RNA, 19 nt, Homo sapiens
gcagucagaggguccuguu

SEQ ID NO: 450756 - RNA, 19 nt, Homo sapiens
gcuggaaaauaaauccuuu

SEQ ID NO: 450757 - RNA, 19 nt, Homo sapiens
ccucaggacugcuggaaaa

SEQ ID NO: 450758 - RNA, 19 nt, Homo sapiens
gugccgcucugcaggguau

SEQ ID NO: 450759 - RNA, 19 nt, Homo sapiens
ccuguaccuuucuucguuu

SEQ ID NO: 450760 - RNA, 19 nt, Homo sapiens
cuaccacgcccagcuaauu

SEQ ID NO: 450761 - RNA, 19 nt, Homo sapiens
cacccacgcuggagugcaa

SEQ ID NO: 450762 - RNA, 19 nt, Homo sapiens
gccaaaaggcaguuacaua

SEQ ID NO: 450763 - RNA, 19 nt, Homo sapiens
gcagcugguaauuccauuu

SEQ ID NO: 450764 - RNA, 19 nt, Homo sapiens
acagcagugucccagguaa

SEQ ID NO: 450765 - RNA, 19 nt, Homo sapiens
agaguaggguguaauugag

SEQ ID NO: 450766 - RNA, 19 nt, Homo sapiens
gaggaagcuggcuguggua

SEQ ID NO: 450767 - RNA, 19 nt, Homo sapiens
cuccaagccucuagcauag

SEQ ID NO: 450768 - RNA, 19 nt, Homo sapiens
ccaaacccauacuacacau

SEQ ID NO: 450769 - RNA, 19 nt, Homo sapiens
cuuaaacccuuccaugacu

SEQ ID NO: 450770 - RNA, 19 nt, Homo sapiens
aacccagccugacaaauca

SEQ ID NO: 450771 - RNA, 19 nt, Homo sapiens
cucuuccucuugagaaaua

SEQ ID NO: 450772 - RNA, 19 nt, Homo sapiens
uaagcuggaguuauauaug

SEQ ID NO: 450773 - RNA, 19 nt, Homo sapiens
caacuaccuuccugaauua

SEQ ID NO: 450774 - RNA, 19 nt, Homo sapiens
ucaacuaccuuccugaauu

SEQ ID NO: 450775 - RNA, 19 nt, Homo sapiens
cuaccuuccugaauuauuu

SEQ ID NO: 450776 - RNA, 19 nt, Homo sapiens
gacaugcucuggaggagaa

SEQ ID NO: 450777 - RNA, 19 nt, Homo sapiens
gauaagcaaguucagguuu

SEQ ID NO: 450778 - RNA, 19 nt, Homo sapiens
gcagagacagaguucauga

SEQ ID NO: 450779 - RNA, 19 nt, Homo sapiens
aaagauugguccucagaug

SEQ ID NO: 450780 - RNA, 19 nt, Homo sapiens
gagacagaguucaugaugu

SEQ ID NO: 450781 - RNA, 19 nt, Homo sapiens
cagaguucaugaugucaaa

SEQ ID NO: 450782 - RNA, 19 nt, Homo sapiens
agaguuacuuugaaacgaa

SEQ ID NO: 450783 - RNA, 19 nt, Homo sapiens
gagaguuacuuugaaacga

SEQ ID NO: 450784 - RNA, 19 nt, Homo sapiens
gcugcaggauuccaugcua

SEQ ID NO: 450785 - RNA, 19 nt, Homo sapiens
ggauuuagagcaauucauc

SEQ ID NO: 450786 - RNA, 19 nt, Homo sapiens
caggaagaauugaacuugu

SEQ ID NO: 450787 - RNA, 19 nt, Homo sapiens
ggaagaauugaacuuguca

SEQ ID NO: 450788 - RNA, 19 nt, Homo sapiens
cuggagaguuacuuugaaa

SEQ ID NO: 450789 - RNA, 19 nt, Homo sapiens
caagccgggugucaucuuc

SEQ ID NO: 450790 - RNA, 19 nt, Homo sapiens
ggugaagggacacaaguug

SEQ ID NO: 450791 - RNA, 19 nt, Homo sapiens
ucaagaccaggaagaauug

SEQ ID NO: 450792 - RNA, 19 nt, Homo sapiens
auaagcaaguucagguuug

SEQ ID NO: 450793 - RNA, 19 nt, Homo sapiens
auucuuguguucuggauuu

SEQ ID NO: 450794 - RNA, 19 nt, Homo sapiens
gaucaagaccaggaagaau

SEQ ID NO: 450795 - RNA, 19 nt, Homo sapiens
ggaucaagaccaggaagaa

SEQ ID NO: 450796 - RNA, 19 nt, Homo sapiens
gaugucaaagcuuccauug

SEQ ID NO: 450797 - RNA, 19 nt, Homo sapiens
ccaggaagaauugaacuug

SEQ ID NO: 450798 - RNA, 19 nt, Homo sapiens
ccuggagaguuacuuugaa

SEQ ID NO: 450799 - RNA, 19 nt, Homo sapiens
gaaagauugguccucagau

SEQ ID NO: 450800 - RNA, 19 nt, Homo sapiens
guccucagaugacccuuuc

SEQ ID NO: 450801 - RNA, 19 nt, Homo sapiens
gcaggauuccaugcuacua

SEQ ID NO: 450802 - RNA, 19 nt, Homo sapiens
agaaagauugguccucaga

SEQ ID NO: 450803 - RNA, 19 nt, Homo sapiens
ccaacuuucuugccucaac

SEQ ID NO: 450804 - RNA, 19 nt, Homo sapiens
agagacagaguucaugaug

SEQ ID NO: 450805 - RNA, 19 nt, Homo sapiens
cacaaaagaugcagagaca

SEQ ID NO: 450806 - RNA, 19 nt, Homo sapiens
guucagguuugcgugagaa

SEQ ID NO: 450807 - RNA, 19 nt, Homo sapiens
caaaagaugcagagacaga

SEQ ID NO: 450808 - RNA, 19 nt, Homo sapiens
caacuuucuugccucaacu

SEQ ID NO: 450809 - RNA, 19 nt, Homo sapiens
aggaagaauugaacuuguc

SEQ ID NO: 450810 - RNA, 19 nt, Homo sapiens
gcuuguuacugcccuugga

SEQ ID NO: 450811 - RNA, 19 nt, Homo sapiens
ccagugauaagcaaguuca

SEQ ID NO: 450812 - RNA, 19 nt, Homo sapiens
aagauugguccucagauga

SEQ ID NO: 450813 - RNA, 19 nt, Homo sapiens
cuuguguucuggauuuaga

SEQ ID NO: 450814 - RNA, 19 nt, Homo sapiens
ggagaguuacuuugaaacg

SEQ ID NO: 450815 - RNA, 19 nt, Homo sapiens
cauuuauucuuguguucug

SEQ ID NO: 450816 - RNA, 19 nt, Homo sapiens
gcucuggaggagaaagauu

SEQ ID NO: 450817 - RNA, 19 nt, Homo sapiens
ccucaacuaccuuccugaa

SEQ ID NO: 450818 - RNA, 19 nt, Homo sapiens
caacuaccuuccugaauua

SEQ ID NO: 450819 - RNA, 19 nt, Homo sapiens
ucaacuaccuuccugaauu

SEQ ID NO: 450820 - RNA, 19 nt, Homo sapiens
cuaccuuccugaauuauuu

SEQ ID NO: 450821 - RNA, 19 nt, Homo sapiens
gauaagcaaguucagguuu

SEQ ID NO: 450822 - RNA, 19 nt, Homo sapiens
gcagagacagaguucauga

SEQ ID NO: 450823 - RNA, 19 nt, Homo sapiens
gagacagaguucaugaugu

SEQ ID NO: 450824 - RNA, 19 nt, Homo sapiens
cagaguucaugaugucaaa

SEQ ID NO: 450825 - RNA, 19 nt, Homo sapiens
agaguuacuuugaaacgaa

SEQ ID NO: 450826 - RNA, 19 nt, Homo sapiens
gagaguuacuuugaaacga

SEQ ID NO: 450827 - RNA, 19 nt, Homo sapiens
ggauuuagagcaauucauc

SEQ ID NO: 450828 - RNA, 19 nt, Homo sapiens
caggaagaauugaacuugu

SEQ ID NO: 450829 - RNA, 19 nt, Homo sapiens
ggaagaauugaacuuguca

SEQ ID NO: 450830 - RNA, 19 nt, Homo sapiens
cuggagaguuacuuugaaa

SEQ ID NO: 450831 - RNA, 19 nt, Homo sapiens
caagccgggugucaucuuc

SEQ ID NO: 450832 - RNA, 19 nt, Homo sapiens
ggugaagggacacaaguug

SEQ ID NO: 450833 - RNA, 19 nt, Homo sapiens
ucaagaccaggaagaauug

SEQ ID NO: 450834 - RNA, 19 nt, Homo sapiens
auaagcaaguucagguuug

SEQ ID NO: 450835 - RNA, 19 nt, Homo sapiens
auucuuguguucuggauuu

SEQ ID NO: 450836 - RNA, 19 nt, Homo sapiens
gaucaagaccaggaagaau

SEQ ID NO: 450837 - RNA, 19 nt, Homo sapiens
ggaucaagaccaggaagaa

SEQ ID NO: 450838 - RNA, 19 nt, Homo sapiens
gaugucaaagcuuccauug

SEQ ID NO: 450839 - RNA, 19 nt, Homo sapiens
ccaggaagaauugaacuug

SEQ ID NO: 450840 - RNA, 19 nt, Homo sapiens
ggacagauuccaugcuacu

SEQ ID NO: 450841 - RNA, 19 nt, Homo sapiens
ccuggagaguuacuuugaa

SEQ ID NO: 450842 - RNA, 19 nt, Homo sapiens
cagauuccaugcuacuagu

SEQ ID NO: 450843 - RNA, 19 nt, Homo sapiens
agagacagaguucaugaug

SEQ ID NO: 450844 - RNA, 19 nt, Homo sapiens
ccaacuuucuugccucaac

SEQ ID NO: 450845 - RNA, 19 nt, Homo sapiens
guucagguuugcgugagaa

SEQ ID NO: 450846 - RNA, 19 nt, Homo sapiens
cacaaaagaugcagagaca

SEQ ID NO: 450847 - RNA, 19 nt, Homo sapiens
caacuuucuugccucaacu

SEQ ID NO: 450848 - RNA, 19 nt, Homo sapiens
caaaagaugcagagacaga

SEQ ID NO: 450849 - RNA, 19 nt, Homo sapiens
aggaagaauugaacuuguc

SEQ ID NO: 450850 - RNA, 19 nt, Homo sapiens
gcuuguuacugcccuugga

SEQ ID NO: 450851 - RNA, 19 nt, Homo sapiens
ccagugauaagcaaguuca

SEQ ID NO: 450852 - RNA, 19 nt, Homo sapiens
cuuguguucuggauuuaga

SEQ ID NO: 450853 - RNA, 19 nt, Homo sapiens
ggagaguuacuuugaaacg

SEQ ID NO: 450854 - RNA, 19 nt, Homo sapiens
cauuuauucuuguguucug

SEQ ID NO: 450855 - RNA, 19 nt, Homo sapiens
ccucaacuaccuuccugaa

SEQ ID NO: 450856 - RNA, 19 nt, Homo sapiens
gacagauuccaugcuacua

SEQ ID NO: 450857 - RNA, 19 nt, Homo sapiens
ccaagagaauuccugagaa

SEQ ID NO: 450858 - RNA, 19 nt, Homo sapiens
caagggcccuguccagaga

SEQ ID NO: 450859 - RNA, 19 nt, Homo sapiens
caaccaaaccaccugcuaa

SEQ ID NO: 450860 - RNA, 19 nt, Homo sapiens
gagauauccuggcaaccaa

SEQ ID NO: 450861 - RNA, 19 nt, Homo sapiens
caagagaauuccugagaac

SEQ ID NO: 450862 - RNA, 19 nt, Homo sapiens
guccagagguacaugaaga

SEQ ID NO: 450863 - RNA, 19 nt, Homo sapiens
gcaaccaaaccaccugcua

SEQ ID NO: 450864 - RNA, 19 nt, Homo sapiens
ccaagaagggccagcaguu

SEQ ID NO: 450865 - RNA, 19 nt, Homo sapiens
aggaguggguccagaggua

SEQ ID NO: 450866 - RNA, 19 nt, Homo sapiens
ggccugaugaccauaguaa

SEQ ID NO: 450867 - RNA, 19 nt, Homo sapiens
caagaagggccagcaguuc

SEQ ID NO: 450868 - RNA, 19 nt, Homo sapiens
gcauguucuuuguuuccaa

SEQ ID NO: 450869 - RNA, 19 nt, Homo sapiens
ccagggcaguggcugucaa

SEQ ID NO: 450870 - RNA, 19 nt, Homo sapiens
ccucaaggcaggagugauc

SEQ ID NO: 450871 - RNA, 19 nt, Homo sapiens
uaaccagccuucuguuccu

SEQ ID NO: 450872 - RNA, 19 nt, Homo sapiens
cauaguaaccagccuucug

SEQ ID NO: 450873 - RNA, 19 nt, Homo sapiens
uccaagagaauuccugaga

SEQ ID NO: 450874 - RNA, 19 nt, Homo sapiens
ugcugcauguucuuuguuu

SEQ ID NO: 450875 - RNA, 19 nt, Homo sapiens
gaagggccagcaguucugu

SEQ ID NO: 450876 - RNA, 19 nt, Homo sapiens
caaggcaggagugaucuuc

SEQ ID NO: 450877 - RNA, 19 nt, Homo sapiens
gaaugucucccuccugaua

SEQ ID NO: 450878 - RNA, 19 nt, Homo sapiens
guagagaagacuuaggaua

SEQ ID NO: 450879 - RNA, 19 nt, Homo sapiens
gaaguugaguucuggaaac

SEQ ID NO: 450880 - RNA, 19 nt, Homo sapiens
uaggauaccucucucacuu

SEQ ID NO: 450881 - RNA, 19 nt, Homo sapiens
ggauaccucucucacuuuc

SEQ ID NO: 450882 - RNA, 19 nt, Homo sapiens
caaucugccugcugcgaua

SEQ ID NO: 450883 - RNA, 19 nt, Homo sapiens
ggaguuggccugauuuuaa

SEQ ID NO: 450884 - RNA, 19 nt, Homo sapiens
agagggaguuggccugauu

SEQ ID NO: 450885 - RNA, 19 nt, Homo sapiens
guuaucaucguccaaguuu

SEQ ID NO: 450886 - RNA, 19 nt, Homo sapiens
gcuccuggaugcucgaaau

SEQ ID NO: 450887 - RNA, 19 nt, Homo sapiens
gagucauuccugccuguua

SEQ ID NO: 450888 - RNA, 19 nt, Homo sapiens
uagagaagacuuaggauac

SEQ ID NO: 450889 - RNA, 19 nt, Homo sapiens
aggcuaugcuuuucuauaa

SEQ ID NO: 450890 - RNA, 19 nt, Homo sapiens
gcccucaugcuguaaagaa

SEQ ID NO: 450891 - RNA, 19 nt, Homo sapiens
uaucaucguccaaguuuag

SEQ ID NO: 450892 - RNA, 19 nt, Homo sapiens
gagggaguuggccugauuu

SEQ ID NO: 450893 - RNA, 19 nt, Homo sapiens
gaugcucgaaauaagguuu

SEQ ID NO: 450894 - RNA, 19 nt, Homo sapiens
ccuggaugcucgaaauaag

SEQ ID NO: 450895 - RNA, 19 nt, Homo sapiens
gcucauuucugggcuccau

SEQ ID NO: 450896 - RNA, 19 nt, Homo sapiens
agacuuaggauaccucucu

SEQ ID NO: 450897 - RNA, 19 nt, Homo sapiens
ggccugauuuuaagccuuu

SEQ ID NO: 450898 - RNA, 19 nt, Homo sapiens
uuaucaucguccaaguuua

SEQ ID NO: 450899 - RNA, 19 nt, Homo sapiens
gagaagacuuaggauaccu

SEQ ID NO: 450900 - RNA, 19 nt, Homo sapiens
gcuguaaagaaguugaguu

SEQ ID NO: 450901 - RNA, 19 nt, Homo sapiens
auaccucucucacuuucug

SEQ ID NO: 450902 - RNA, 19 nt, Homo sapiens
ucuuuugggucaagucuua

SEQ ID NO: 450903 - RNA, 19 nt, Homo sapiens
gaaugucucccuccugaua

SEQ ID NO: 450904 - RNA, 19 nt, Homo sapiens
guagagaagacuuaggaua

SEQ ID NO: 450905 - RNA, 19 nt, Homo sapiens
gaaguugaguucuggaaac

SEQ ID NO: 450906 - RNA, 19 nt, Homo sapiens
uaggauaccucucucacuu

SEQ ID NO: 450907 - RNA, 19 nt, Homo sapiens
ggauaccucucucacuuuc

SEQ ID NO: 450908 - RNA, 19 nt, Homo sapiens
ggaguuggccugauuuuaa

SEQ ID NO: 450909 - RNA, 19 nt, Homo sapiens
agagggaguuggccugauu

SEQ ID NO: 450910 - RNA, 19 nt, Homo sapiens
guuaucaucguccaaguuu

SEQ ID NO: 450911 - RNA, 19 nt, Homo sapiens
uagagaagacuuaggauac

SEQ ID NO: 450912 - RNA, 19 nt, Homo sapiens
aggcuaugcuuuucuauaa

SEQ ID NO: 450913 - RNA, 19 nt, Homo sapiens
gcccucaugcuguaaagaa

SEQ ID NO: 450914 - RNA, 19 nt, Homo sapiens
uaucaucguccaaguuuag

SEQ ID NO: 450915 - RNA, 19 nt, Homo sapiens
gagggaguuggccugauuu

SEQ ID NO: 450916 - RNA, 19 nt, Homo sapiens
gcucauuucugggcuccau

SEQ ID NO: 450917 - RNA, 19 nt, Homo sapiens
agacuuaggauaccucucu

SEQ ID NO: 450918 - RNA, 19 nt, Homo sapiens
ggccugauuuuaagccuuu

SEQ ID NO: 450919 - RNA, 19 nt, Homo sapiens
uuaucaucguccaaguuua

SEQ ID NO: 450920 - RNA, 19 nt, Homo sapiens
gagaagacuuaggauaccu

SEQ ID NO: 450921 - RNA, 19 nt, Homo sapiens
gcuguaaagaaguugaguu

SEQ ID NO: 450922 - RNA, 19 nt, Homo sapiens
auaccucucucacuuucug

SEQ ID NO: 450923 - RNA, 19 nt, Homo sapiens
ucuuuugggucaagucuua

SEQ ID NO: 450924 - RNA, 19 nt, Homo sapiens
gggaauauguuacucuuua

SEQ ID NO: 450925 - RNA, 19 nt, Homo sapiens
ggcauaaugucaugauuua

SEQ ID NO: 450926 - RNA, 19 nt, Homo sapiens
gauguuugaugucuucuua

SEQ ID NO: 450927 - RNA, 19 nt, Homo sapiens
uaaagaaagucauccagaa

SEQ ID NO: 450928 - RNA, 19 nt, Homo sapiens
guacuuguauugucauuug

SEQ ID NO: 450929 - RNA, 19 nt, Homo sapiens
acagauaaauuccugauug

SEQ ID NO: 450930 - RNA, 19 nt, Homo sapiens
gaaauguauucucuugguu

SEQ ID NO: 450931 - RNA, 19 nt, Homo sapiens
uguaagggcuaauauauuc

SEQ ID NO: 450932 - RNA, 19 nt, Homo sapiens
cuacauggauucccuacuu

SEQ ID NO: 450933 - RNA, 19 nt, Homo sapiens
gagcaaagaaucacugguu

SEQ ID NO: 450934 - RNA, 19 nt, Homo sapiens
gauaaauuccugauugcua

SEQ ID NO: 450935 - RNA, 19 nt, Homo sapiens
ucagauaucuauuguggau

SEQ ID NO: 450936 - RNA, 19 nt, Homo sapiens
gggcuaauauauucucuuc

SEQ ID NO: 450937 - RNA, 19 nt, Homo sapiens
cuauaauucuggucacuaa

SEQ ID NO: 450938 - RNA, 19 nt, Homo sapiens
aagaaucacugguuauuag

SEQ ID NO: 450939 - RNA, 19 nt, Homo sapiens
caaagaaucacugguuauu

SEQ ID NO: 450940 - RNA, 19 nt, Homo sapiens
gagcugcguugcacuuguu

SEQ ID NO: 450941 - RNA, 19 nt, Homo sapiens
ugagggagguauccuguug

SEQ ID NO: 450942 - RNA, 19 nt, Homo sapiens
gcaaagaaucacugguuau

SEQ ID NO: 450943 - RNA, 19 nt, Homo sapiens
gaucugugcucugcaaagu

SEQ ID NO: 450944 - RNA, 19 nt, Homo sapiens
cuuacucacucuucucaua

SEQ ID NO: 450945 - RNA, 19 nt, Homo sapiens
ucugugcucugcaaaguuu

SEQ ID NO: 450946 - RNA, 19 nt, Homo sapiens
cuaggaugcuauuuaaguu

SEQ ID NO: 450947 - RNA, 19 nt, Homo sapiens
gaccaugcaucauaaaauu

SEQ ID NO: 450948 - RNA, 19 nt, Homo sapiens
ggacaguggaaacaagaaa

SEQ ID NO: 450949 - RNA, 19 nt, Homo sapiens
aaagaaagucauccagaaa

SEQ ID NO: 450950 - RNA, 19 nt, Homo sapiens
gaacgggaagcaaguuugu

SEQ ID NO: 450951 - RNA, 19 nt, Homo sapiens
gcuaauauauucucuuccu

SEQ ID NO: 450952 - RNA, 19 nt, Homo sapiens
ggaauauguuacucuuuac

SEQ ID NO: 450953 - RNA, 19 nt, Homo sapiens
gagguauccuguuguucuu

SEQ ID NO: 450954 - RNA, 19 nt, Homo sapiens
agcaaagaaucacugguua

SEQ ID NO: 450955 - RNA, 19 nt, Homo sapiens
ggagguauccuguuguucu

SEQ ID NO: 450956 - RNA, 19 nt, Homo sapiens
ccaguaagaauaagaagga

SEQ ID NO: 450957 - RNA, 19 nt, Homo sapiens
aaaagaccaugcaucauaa

SEQ ID NO: 450958 - RNA, 19 nt, Homo sapiens
acccuaggaugcuauuuaa

SEQ ID NO: 450959 - RNA, 19 nt, Homo sapiens
gaagaacgggaagcaaguu

SEQ ID NO: 450960 - RNA, 19 nt, Homo sapiens
uauauucucuuccuauggu

SEQ ID NO: 450961 - RNA, 19 nt, Homo sapiens
ggaugcuauuuaaguugua

SEQ ID NO: 450962 - RNA, 19 nt, Homo sapiens
gguuauuagucuuucaaug

SEQ ID NO: 450963 - RNA, 19 nt, Homo sapiens
gugguagccucccugaaga

SEQ ID NO: 450964 - RNA, 19 nt, Homo sapiens
uaaguucuguaagggcuaa

SEQ ID NO: 450965 - RNA, 19 nt, Homo sapiens
uacccuaggaugcuauuua

SEQ ID NO: 450966 - RNA, 19 nt, Homo sapiens
uacauggauucccuacuuu

SEQ ID NO: 450967 - RNA, 19 nt, Homo sapiens
uuagauguuugaugucuuc

SEQ ID NO: 450968 - RNA, 19 nt, Homo sapiens
cacuuuagauagaugaaga

SEQ ID NO: 450969 - RNA, 19 nt, Homo sapiens
cagauaaauuccugauugc

SEQ ID NO: 450970 - RNA, 19 nt, Homo sapiens
uaggaugacuauaauucug

SEQ ID NO: 450971 - RNA, 19 nt, Homo sapiens
uggcauaaugucaugauuu

SEQ ID NO: 450972 - RNA, 19 nt, Homo sapiens
ccugauugcuaauuuacau

SEQ ID NO: 450973 - RNA, 19 nt, Homo sapiens
ucacugguuauuagucuuu

SEQ ID NO: 450974 - RNA, 19 nt, Homo sapiens
gcuaagauuuucagauauc

SEQ ID NO: 450975 - RNA, 19 nt, Homo sapiens
ucuguaagggcuaauauau

SEQ ID NO: 450976 - RNA, 19 nt, Homo sapiens
uuacucacucuucucauaa

SEQ ID NO: 450977 - RNA, 19 nt, Homo sapiens
ggacccaguaagaauaaga

SEQ ID NO: 450978 - RNA, 19 nt, Homo sapiens
guauugucauuuggagaaa

SEQ ID NO: 450979 - RNA, 19 nt, Homo sapiens
cuuaaagucuuaccgaaaa

SEQ ID NO: 450980 - RNA, 19 nt, Homo sapiens
ccuaggaugcuauuuaagu

SEQ ID NO: 450981 - RNA, 19 nt, Homo sapiens
aaugaucugugcucugcaa

SEQ ID NO: 450982 - RNA, 19 nt, Homo sapiens
gguuuuagauguuugaugu

SEQ ID NO: 450983 - RNA, 19 nt, Homo sapiens
ugaacccuuuggcaauuga

SEQ ID NO: 450984 - RNA, 19 nt, Homo sapiens
uugguaaacugcagguguu

SEQ ID NO: 450985 - RNA, 19 nt, Homo sapiens
gguauccuguuguucuuac

SEQ ID NO: 450986 - RNA, 19 nt, Homo sapiens
ccgaaaaggcuguggauuu

SEQ ID NO: 450987 - RNA, 19 nt, Homo sapiens
aacccucucuugaccacua

SEQ ID NO: 450988 - RNA, 19 nt, Homo sapiens
ggcuguggauuucguaugg

SEQ ID NO: 450989 - RNA, 19 nt, Homo sapiens
gaaagucauccagaaaauu

SEQ ID NO: 450990 - RNA, 19 nt, Homo sapiens
cauggauucccuacuuuga

SEQ ID NO: 450991 - RNA, 19 nt, Homo sapiens
gucauuuggagaaacaaua

SEQ ID NO: 450992 - RNA, 19 nt, Homo sapiens
uacucacucuucucauaaa

SEQ ID NO: 450993 - RNA, 19 nt, Homo sapiens
uaagaaggaaggguugguu

SEQ ID NO: 450994 - RNA, 19 nt, Homo sapiens
ccuuaaagucuuaccgaaa

SEQ ID NO: 450995 - RNA, 19 nt, Homo sapiens
gaccauauugugagcaaag

SEQ ID NO: 450996 - RNA, 19 nt, Homo sapiens
gacccaguaagaauaagaa

SEQ ID NO: 450997 - RNA, 19 nt, Homo sapiens
gugcagaauauauuuccuu

SEQ ID NO: 450998 - RNA, 19 nt, Homo sapiens
guuguacuguauuagaaca

SEQ ID NO: 450999 - RNA, 19 nt, Homo sapiens
aaucacugguuauuagucu

SEQ ID NO: 451000 - RNA, 19 nt, Homo sapiens
guauuuccacuauuuacug

SEQ ID NO: 451001 - RNA, 19 nt, Homo sapiens
uggauucccuacuuugaag

SEQ ID NO: 451002 - RNA, 19 nt, Homo sapiens
uguauugucauuuggagaa

SEQ ID NO: 451003 - RNA, 19 nt, Homo sapiens
ucuggucacuaaauauaca

SEQ ID NO: 451004 - RNA, 19 nt, Homo sapiens
aggaugcuauuuaaguugu

SEQ ID NO: 451005 - RNA, 19 nt, Homo sapiens
agggagguauccuguuguu

SEQ ID NO: 451006 - RNA, 19 nt, Homo sapiens
aagaaggaaggguugguuu

SEQ ID NO: 451007 - RNA, 19 nt, Homo sapiens
gaaucacugguuauuaguc

SEQ ID NO: 451008 - RNA, 19 nt, Homo sapiens
cauauugugagcaaagaau

SEQ ID NO: 451009 - RNA, 19 nt, Homo sapiens
ugaagaacgggaagcaagu

SEQ ID NO: 451010 - RNA, 19 nt, Homo sapiens
caaaacgauugguaaacug

SEQ ID NO: 451011 - RNA, 19 nt, Homo sapiens
uaaguuauugaacccuuug

SEQ ID NO: 451012 - RNA, 19 nt, Homo sapiens
caguaagaauaagaaggaa

SEQ ID NO: 451013 - RNA, 19 nt, Homo sapiens
uuugguacuuguauuguca

SEQ ID NO: 451014 - RNA, 19 nt, Homo sapiens
uguuugaugucuucuuagu

SEQ ID NO: 451015 - RNA, 19 nt, Homo sapiens
cuguaagggcuaauauauu

SEQ ID NO: 451016 - RNA, 19 nt, Homo sapiens
gcacuuguuuacgcguuac

SEQ ID NO: 451017 - RNA, 19 nt, Homo sapiens
uuuccugugugucauguug

SEQ ID NO: 451018 - RNA, 19 nt, Homo sapiens
gguuuugaccauuuuguua

SEQ ID NO: 451019 - RNA, 19 nt, Homo sapiens
ugcacuuguuuacgcguua

SEQ ID NO: 451020 - RNA, 19 nt, Homo sapiens
agaaagucauccagaaaau

SEQ ID NO: 451021 - RNA, 19 nt, Homo sapiens
aaagaccaugcaucauaaa

SEQ ID NO: 451022 - RNA, 19 nt, Homo sapiens
gaaguuaucugucuguauu

SEQ ID NO: 451023 - RNA, 19 nt, Homo sapiens
ggacaacgaugccuaaauc

SEQ ID NO: 451024 - RNA, 19 nt, Homo sapiens
gaacauuucugucucuaga

SEQ ID NO: 451025 - RNA, 19 nt, Homo sapiens
gagaaagccuccauaaugu

SEQ ID NO: 451026 - RNA, 19 nt, Homo sapiens
gcacauauuucauaaccaa

SEQ ID NO: 451027 - RNA, 19 nt, Homo sapiens
gaaauacagucuuccugaa

SEQ ID NO: 451028 - RNA, 19 nt, Homo sapiens
ugacaagaauucuacagua

SEQ ID NO: 451029 - RNA, 19 nt, Homo sapiens
gaaacauucuuaugcauca

SEQ ID NO: 451030 - RNA, 19 nt, Homo sapiens
gcaaauguauaccuagcaa

SEQ ID NO: 451031 - RNA, 19 nt, Homo sapiens
ugagaaagccuccauaaug

SEQ ID NO: 451032 - RNA, 19 nt, Homo sapiens
aaacagaaauacagucuuc

SEQ ID NO: 451033 - RNA, 19 nt, Homo sapiens
gauauugugugcuacaguu

SEQ ID NO: 451034 - RNA, 19 nt, Homo sapiens
gcaauuaggauaugugugu

SEQ ID NO: 451035 - RNA, 19 nt, Homo sapiens
ggauauguguguuuacugu

SEQ ID NO: 451036 - RNA, 19 nt, Homo sapiens
gcaccggucuuaauuugau

SEQ ID NO: 451037 - RNA, 19 nt, Homo sapiens
ggagacauugacauuauua

SEQ ID NO: 451038 - RNA, 19 nt, Homo sapiens
guaaagcauuccucaaaca

SEQ ID NO: 451039 - RNA, 19 nt, Homo sapiens
gcaauaucuuggacacauu

SEQ ID NO: 451040 - RNA, 19 nt, Homo sapiens
aagcauuccucaaacauuu

SEQ ID NO: 451041 - RNA, 19 nt, Homo sapiens
gcugugauauugugugcua

SEQ ID NO: 451042 - RNA, 19 nt, Homo sapiens
guggagacauugacauuau

SEQ ID NO: 451043 - RNA, 19 nt, Homo sapiens
gaaaugacaagaauucuac

SEQ ID NO: 451044 - RNA, 19 nt, Homo sapiens
cuacugaaaugacaagaau

SEQ ID NO: 451045 - RNA, 19 nt, Homo sapiens
cagcaccggucuuaauuug

SEQ ID NO: 451046 - RNA, 19 nt, Homo sapiens
caucggaguuuacaaagug

SEQ ID NO: 451047 - RNA, 19 nt, Homo sapiens
acaguuaugugaaggauga

SEQ ID NO: 451048 - RNA, 19 nt, Homo sapiens
aaacaaacaugagugugaa

SEQ ID NO: 451049 - RNA, 19 nt, Homo sapiens
gaaaguggcagauauugag

SEQ ID NO: 451050 - RNA, 19 nt, Homo sapiens
caacagugcacauauuuca

SEQ ID NO: 451051 - RNA, 19 nt, Homo sapiens
gaugaaaggugggugaaag

SEQ ID NO: 451052 - RNA, 19 nt, Homo sapiens
guucaugccuauauacugu

SEQ ID NO: 451053 - RNA, 19 nt, Homo sapiens
gaaaagcuaccuuaagaaa

SEQ ID NO: 451054 - RNA, 19 nt, Homo sapiens
gucaagcccuuauaaguca

SEQ ID NO: 451055 - RNA, 19 nt, Homo sapiens
gauuugaugcuuacaacua

SEQ ID NO: 451056 - RNA, 19 nt, Homo sapiens
gaaugaaugacaaucagaa

SEQ ID NO: 451057 - RNA, 19 nt, Homo sapiens
gcaucuaugugucguaaag

SEQ ID NO: 451058 - RNA, 19 nt, Homo sapiens
gaauuccacugcccaaagg

SEQ ID NO: 451059 - RNA, 19 nt, Homo sapiens
gcagugaaaguggcagaua

SEQ ID NO: 451060 - RNA, 19 nt, Homo sapiens
uggcaacagugcacauauu

SEQ ID NO: 451061 - RNA, 19 nt, Homo sapiens
ggcaacagugcacauauuu

SEQ ID NO: 451062 - RNA, 19 nt, Homo sapiens
guuuaacugugacuacuga

SEQ ID NO: 451063 - RNA, 19 nt, Homo sapiens
gcagcaccggucuuaauuu

SEQ ID NO: 451064 - RNA, 19 nt, Homo sapiens
cuucuagauuugaugcuua

SEQ ID NO: 451065 - RNA, 19 nt, Homo sapiens
gcuuucacguucuuacuug

SEQ ID NO: 451066 - RNA, 19 nt, Homo sapiens
acagugcacauauuucaua

SEQ ID NO: 451067 - RNA, 19 nt, Homo sapiens
uccauaauguacccaagua

SEQ ID NO: 451068 - RNA, 19 nt, Homo sapiens
gaaagccuccauaauguac

SEQ ID NO: 451069 - RNA, 19 nt, Homo sapiens
cagugaaaguggcagauau

SEQ ID NO: 451070 - RNA, 19 nt, Homo sapiens
gagucaagcccuuauaagu

SEQ ID NO: 451071 - RNA, 19 nt, Homo sapiens
cagugcacauauuucauaa

SEQ ID NO: 451072 - RNA, 19 nt, Homo sapiens
gggaaacauucuuaugcau

SEQ ID NO: 451073 - RNA, 19 nt, Homo sapiens
aagcaucuaugugucguaa

SEQ ID NO: 451074 - RNA, 19 nt, Homo sapiens
guaggaaacugagacuuuu

SEQ ID NO: 451075 - RNA, 19 nt, Homo sapiens
caauaucuuggacacauuu

SEQ ID NO: 451076 - RNA, 19 nt, Homo sapiens
aauacagucuuccugaaug

SEQ ID NO: 451077 - RNA, 19 nt, Homo sapiens
uaacugugacuacugaaau

SEQ ID NO: 451078 - RNA, 19 nt, Homo sapiens
guacccaaguaacaacugu

SEQ ID NO: 451079 - RNA, 19 nt, Homo sapiens
uaaacuaccacaaccuuuc

SEQ ID NO: 451080 - RNA, 19 nt, Homo sapiens
acucaagacuaguuuaaag

SEQ ID NO: 451081 - RNA, 19 nt, Homo sapiens
ccuuucauguucagcauuu

SEQ ID NO: 451082 - RNA, 19 nt, Homo sapiens
auacagucuuccugaauga

SEQ ID NO: 451083 - RNA, 19 nt, Homo sapiens
ggaaaagggcaucugaaaa

SEQ ID NO: 451084 - RNA, 19 nt, Homo sapiens
cauaugaaguccuggaaaa

SEQ ID NO: 451085 - RNA, 19 nt, Homo sapiens
gccuaaaucccaaaucgaa

SEQ ID NO: 451086 - RNA, 19 nt, Homo sapiens
gaaaauaaaggacaacgau

SEQ ID NO: 451087 - RNA, 19 nt, Homo sapiens
agaaagccuccauaaugua

SEQ ID NO: 451088 - RNA, 19 nt, Homo sapiens
gguauacucaagacuaguu

SEQ ID NO: 451089 - RNA, 19 nt, Homo sapiens
guagggaaacauucuuaug

SEQ ID NO: 451090 - RNA, 19 nt, Homo sapiens
guacaguuaugugaaggau

SEQ ID NO: 451091 - RNA, 19 nt, Homo sapiens
ugaaaguggcagauauuga

SEQ ID NO: 451092 - RNA, 19 nt, Homo sapiens
acuauucuguugugacuau

SEQ ID NO: 451093 - RNA, 19 nt, Homo sapiens
agaggacgcugucuuugca

SEQ ID NO: 451094 - RNA, 19 nt, Homo sapiens
ucguaaagcauuccucaaa

SEQ ID NO: 451095 - RNA, 19 nt, Homo sapiens
gacauugacauuauuacug

SEQ ID NO: 451096 - RNA, 19 nt, Homo sapiens
uggagacauugacauuauu

SEQ ID NO: 451097 - RNA, 19 nt, Homo sapiens
aggaaaagcuaccuuaaga

SEQ ID NO: 451098 - RNA, 19 nt, Homo sapiens
gauauguguguuuacugua

SEQ ID NO: 451099 - RNA, 19 nt, Homo sapiens
aguaggaaacugagacuuu

SEQ ID NO: 451100 - RNA, 19 nt, Homo sapiens
aaaggacaacgaugccuaa

SEQ ID NO: 451101 - RNA, 19 nt, Homo sapiens
uggcagauauugagaaagc

SEQ ID NO: 451102 - RNA, 19 nt, Homo sapiens
uuagguauacucaagacua

SEQ ID NO: 451103 - RNA, 19 nt, Homo sapiens
ucaugccuauauacuguaa

SEQ ID NO: 451104 - RNA, 19 nt, Homo sapiens
uagcagcaccggucuuaau

SEQ ID NO: 451105 - RNA, 19 nt, Homo sapiens
gcaacagugcacauauuuc

SEQ ID NO: 451106 - RNA, 19 nt, Homo sapiens
aauuauacgcuaugggaua

SEQ ID NO: 451107 - RNA, 19 nt, Homo sapiens
ugcaucauuugguuuguuu

SEQ ID NO: 451108 - RNA, 19 nt, Homo sapiens
uagaaguuaucugucugua

SEQ ID NO: 451109 - RNA, 19 nt, Homo sapiens
guucaaggcuuccccaugu

SEQ ID NO: 451110 - RNA, 19 nt, Homo sapiens
ccaaguaacaacugugaca

SEQ ID NO: 451111 - RNA, 19 nt, Homo sapiens
uagguauacucaagacuag

SEQ ID NO: 451112 - RNA, 19 nt, Homo sapiens
caauuaggauauguguguu

SEQ ID NO: 451113 - RNA, 19 nt, Homo sapiens
gaagcaauuaggauaugug

SEQ ID NO: 451114 - RNA, 19 nt, Homo sapiens
ggagucaagcccuuauaag

SEQ ID NO: 451115 - RNA, 19 nt, Homo sapiens
gauuauuacccugaaagaa

SEQ ID NO: 451116 - RNA, 19 nt, Homo sapiens
cguaaagcauuccucaaac

SEQ ID NO: 451117 - RNA, 19 nt, Homo sapiens
cauuauuacuggagucaag

SEQ ID NO: 451118 - RNA, 19 nt, Homo sapiens
gcauuucuacuccuuccaa

SEQ ID NO: 451119 - RNA, 19 nt, Homo sapiens
uaccaucggaguuuacaaa

SEQ ID NO: 451120 - RNA, 19 nt, Homo sapiens
gugcacauauuucauaacc

SEQ ID NO: 451121 - RNA, 19 nt, Homo sapiens
ucuuaugcaucauuugguu

SEQ ID NO: 451122 - RNA, 19 nt, Homo sapiens
gaaauacacuguuaucuuc

SEQ ID NO: 451123 - RNA, 19 nt, Homo sapiens
caaagugucuugaauugua

SEQ ID NO: 451124 - RNA, 19 nt, Homo sapiens
gcaauugacuauaguguga

SEQ ID NO: 451125 - RNA, 19 nt, Homo sapiens
uaugagggcuaauaucuua

SEQ ID NO: 451126 - RNA, 19 nt, Homo sapiens
gaaaugagcacgcauggaa

SEQ ID NO: 451127 - RNA, 19 nt, Homo sapiens
gcaaggaguucaucccaaa

SEQ ID NO: 451128 - RNA, 19 nt, Homo sapiens
ugagaaggcuguggauuua

SEQ ID NO: 451129 - RNA, 19 nt, Homo sapiens
uaaagaaagucauccagaa

SEQ ID NO: 451130 - RNA, 19 nt, Homo sapiens
ggaaacguauucaaacaau

SEQ ID NO: 451131 - RNA, 19 nt, Homo sapiens
ggaaggaaauuugucuuga

SEQ ID NO: 451132 - RNA, 19 nt, Homo sapiens
gggaauauguuagagaauu

SEQ ID NO: 451133 - RNA, 19 nt, Homo sapiens
ggaaauacacuguuaucuu

SEQ ID NO: 451134 - RNA, 19 nt, Homo sapiens
gaaggaaauuugucuugau

SEQ ID NO: 451135 - RNA, 19 nt, Homo sapiens
gggcuaauaucuuaucuuc

SEQ ID NO: 451136 - RNA, 19 nt, Homo sapiens
ugauggaaauacacuguua

SEQ ID NO: 451137 - RNA, 19 nt, Homo sapiens
uagcauuucuccuuggaua

SEQ ID NO: 451138 - RNA, 19 nt, Homo sapiens
gagaauuuccuuacucuug

SEQ ID NO: 451139 - RNA, 19 nt, Homo sapiens
gaauuguaggugacuauua

SEQ ID NO: 451140 - RNA, 19 nt, Homo sapiens
ucaguaaucugcaaguguu

SEQ ID NO: 451141 - RNA, 19 nt, Homo sapiens
aaggcaaacuuaacaauga

SEQ ID NO: 451142 - RNA, 19 nt, Homo sapiens
ccauaauucugguagcuaa

SEQ ID NO: 451143 - RNA, 19 nt, Homo sapiens
aaacugccaucauuuacuu

SEQ ID NO: 451144 - RNA, 19 nt, Homo sapiens
uaagaauucuguugaugga

SEQ ID NO: 451145 - RNA, 19 nt, Homo sapiens
gcuaauaucuuaucuuccu

SEQ ID NO: 451146 - RNA, 19 nt, Homo sapiens
gauugugggauacuauuua

SEQ ID NO: 451147 - RNA, 19 nt, Homo sapiens
ugaaguguuuagcauagua

SEQ ID NO: 451148 - RNA, 19 nt, Homo sapiens
aggaaucacuggcuguuaa

SEQ ID NO: 451149 - RNA, 19 nt, Homo sapiens
acacuguuaucuucacuuu

SEQ ID NO: 451150 - RNA, 19 nt, Homo sapiens
agaauucuguugauggaaa

SEQ ID NO: 451151 - RNA, 19 nt, Homo sapiens
agaauuuccuuacucuuga

SEQ ID NO: 451152 - RNA, 19 nt, Homo sapiens
gaagaacgggaaggaaauu

SEQ ID NO: 451153 - RNA, 19 nt, Homo sapiens
gagagagcuuggaauguca

SEQ ID NO: 451154 - RNA, 19 nt, Homo sapiens
uuucacaccuuaucuaugu

SEQ ID NO: 451155 - RNA, 19 nt, Homo sapiens
ccucugcuauuugcuguua

SEQ ID NO: 451156 - RNA, 19 nt, Homo sapiens
ggaaauuugucuugaucca

SEQ ID NO: 451157 - RNA, 19 nt, Homo sapiens
gaacgggaaggaaauuugu

SEQ ID NO: 451158 - RNA, 19 nt, Homo sapiens
cauaagaauucuguugaug

SEQ ID NO: 451159 - RNA, 19 nt, Homo sapiens
uaaguucuaugagggcuaa

SEQ ID NO: 451160 - RNA, 19 nt, Homo sapiens
ggaaagauuuuguuguugu

SEQ ID NO: 451161 - RNA, 19 nt, Homo sapiens
uaucugcuaugcuauugaa

SEQ ID NO: 451162 - RNA, 19 nt, Homo sapiens
aaagaaagucauccagaaa

SEQ ID NO: 451163 - RNA, 19 nt, Homo sapiens
uuagauagaugaagaagcu

SEQ ID NO: 451164 - RNA, 19 nt, Homo sapiens
ccucgaggcccuagcauuu

SEQ ID NO: 451165 - RNA, 19 nt, Homo sapiens
aaucuucgcuccuccaauc

SEQ ID NO: 451166 - RNA, 19 nt, Homo sapiens
agacaagaaggaaagauuu

SEQ ID NO: 451167 - RNA, 19 nt, Homo sapiens
gaucaguaaucugcaagug

SEQ ID NO: 451168 - RNA, 19 nt, Homo sapiens
agagagagcuuggaauguc

SEQ ID NO: 451169 - RNA, 19 nt, Homo sapiens
ccagagagagcuuggaaug

SEQ ID NO: 451170 - RNA, 19 nt, Homo sapiens
gaauucuguugauggaaau

SEQ ID NO: 451171 - RNA, 19 nt, Homo sapiens
agaaggcuguggauuuaau

SEQ ID NO: 451172 - RNA, 19 nt, Homo sapiens
gagcugcguugcguuuguu

SEQ ID NO: 451173 - RNA, 19 nt, Homo sapiens
gggaaggaaauuugucuug

SEQ ID NO: 451174 - RNA, 19 nt, Homo sapiens
ccugacugcuaguuuauau

SEQ ID NO: 451175 - RNA, 19 nt, Homo sapiens
gcaaacugccaucauuuac

SEQ ID NO: 451176 - RNA, 19 nt, Homo sapiens
gaauuuccuuacucuugau

SEQ ID NO: 451177 - RNA, 19 nt, Homo sapiens
cugagaaggcuguggauuu

SEQ ID NO: 451178 - RNA, 19 nt, Homo sapiens
gugguagccucccugaaga

SEQ ID NO: 451179 - RNA, 19 nt, Homo sapiens
gaccagagagagcuuggaa

SEQ ID NO: 451180 - RNA, 19 nt, Homo sapiens
guaaaggcaaacuuaacaa

SEQ ID NO: 451181 - RNA, 19 nt, Homo sapiens
aaugaaguguuuagcauag

SEQ ID NO: 451182 - RNA, 19 nt, Homo sapiens
gcucgcagcgcucucuuga

SEQ ID NO: 451183 - RNA, 19 nt, Homo sapiens
auuccugacugcuaguuua

SEQ ID NO: 451184 - RNA, 19 nt, Homo sapiens
gcuaugcuauugaaguuuu

SEQ ID NO: 451185 - RNA, 19 nt, Homo sapiens
cugcuaugcuauugaaguu

SEQ ID NO: 451186 - RNA, 19 nt, Homo sapiens
aaggaaauuugucuugauc

SEQ ID NO: 451187 - RNA, 19 nt, Homo sapiens
ggcaaauuccugacugcua

SEQ ID NO: 451188 - RNA, 19 nt, Homo sapiens
gagaaggcuguggauuuaa

SEQ ID NO: 451189 - RNA, 19 nt, Homo sapiens
gagcacgcauggaaaaguu

SEQ ID NO: 451190 - RNA, 19 nt, Homo sapiens
gaaacaaggaaaacugauu

SEQ ID NO: 451191 - RNA, 19 nt, Homo sapiens
ugacugcuaguuuauauag

SEQ ID NO: 451192 - RNA, 19 nt, Homo sapiens
uuagagaauuuccuuacuc

SEQ ID NO: 451193 - RNA, 19 nt, Homo sapiens
aaaggcaaacuuaacaaug

SEQ ID NO: 451194 - RNA, 19 nt, Homo sapiens
uuuagaaagcugaguguuu

SEQ ID NO: 451195 - RNA, 19 nt, Homo sapiens
ggaaucacuggcuguuaau

SEQ ID NO: 451196 - RNA, 19 nt, Homo sapiens
ccgcugcuguguugagaga

SEQ ID NO: 451197 - RNA, 19 nt, Homo sapiens
gggaagacaagaaggaaag

SEQ ID NO: 451198 - RNA, 19 nt, Homo sapiens
caaggaaaacugauuaaga

SEQ ID NO: 451199 - RNA, 19 nt, Homo sapiens
ucacuggcuguuaaucuuu

SEQ ID NO: 451200 - RNA, 19 nt, Homo sapiens
aaccuauguuugccgcuua

SEQ ID NO: 451201 - RNA, 19 nt, Homo sapiens
gcaaacuuaacaaugacuu

SEQ ID NO: 451202 - RNA, 19 nt, Homo sapiens
guuagagaauuuccuuacu

SEQ ID NO: 451203 - RNA, 19 nt, Homo sapiens
ugaagaacgggaaggaaau

SEQ ID NO: 451204 - RNA, 19 nt, Homo sapiens
gauggaaauacacuguuau

SEQ ID NO: 451205 - RNA, 19 nt, Homo sapiens
gaaggcuguggauuuaaug

SEQ ID NO: 451206 - RNA, 19 nt, Homo sapiens
ggaaaacugauuaagagaa

SEQ ID NO: 451207 - RNA, 19 nt, Homo sapiens
cugaagaacgggaaggaaa

SEQ ID NO: 451208 - RNA, 19 nt, Homo sapiens
gauagaugaagaagcuaga

SEQ ID NO: 451209 - RNA, 19 nt, Homo sapiens
ggauuccucacuuugaaga

SEQ ID NO: 451210 - RNA, 19 nt, Homo sapiens
ggaagacaagaaggaaaga

SEQ ID NO: 451211 - RNA, 19 nt, Homo sapiens
caaacuuaacaaugacuug

SEQ ID NO: 451212 - RNA, 19 nt, Homo sapiens
gcuguuauuuuaucugcua

SEQ ID NO: 451213 - RNA, 19 nt, Homo sapiens
gcucagcuaaugaaguguu

SEQ ID NO: 451214 - RNA, 19 nt, Homo sapiens
cuggauuccucacuuugaa

SEQ ID NO: 451215 - RNA, 19 nt, Homo sapiens
aagacaagaaggaaagauu

SEQ ID NO: 451216 - RNA, 19 nt, Homo sapiens
gaagacaagaaggaaagau

SEQ ID NO: 451217 - RNA, 19 nt, Homo sapiens
ugaagaagcuagaaaacag

SEQ ID NO: 451218 - RNA, 19 nt, Homo sapiens
aaagugucuugaauuguag

SEQ ID NO: 451219 - RNA, 19 nt, Homo sapiens
ucugcuauuugcuguuauu

SEQ ID NO: 451220 - RNA, 19 nt, Homo sapiens
agagagcugcguugcguuu

SEQ ID NO: 451221 - RNA, 19 nt, Homo sapiens
ccagggaagacaagaagga

SEQ ID NO: 451222 - RNA, 19 nt, Homo sapiens
ugaaagcacugcaugaaua

SEQ ID NO: 451223 - RNA, 19 nt, Homo sapiens
ggagugaagucucagauaa

SEQ ID NO: 451224 - RNA, 19 nt, Homo sapiens
acacaucagucacaaguua

SEQ ID NO: 451225 - RNA, 19 nt, Homo sapiens
gaaagguaguguaucauug

SEQ ID NO: 451226 - RNA, 19 nt, Homo sapiens
ggugaaagcuauaucaauc

SEQ ID NO: 451227 - RNA, 19 nt, Homo sapiens
gaucacaauuugcaguaaa

SEQ ID NO: 451228 - RNA, 19 nt, Homo sapiens
uaucagaggugaaagcuau

SEQ ID NO: 451229 - RNA, 19 nt, Homo sapiens
gaaagcacugcaugaauaa

SEQ ID NO: 451230 - RNA, 19 nt, Homo sapiens
gauaagaggaccuguguga

SEQ ID NO: 451231 - RNA, 19 nt, Homo sapiens
acaauaaucucacuaccuu

SEQ ID NO: 451232 - RNA, 19 nt, Homo sapiens
ugagauguauuucaacuug

SEQ ID NO: 451233 - RNA, 19 nt, Homo sapiens
ggaaagguaguguaucauu

SEQ ID NO: 451234 - RNA, 19 nt, Homo sapiens
cuaguuaucaugcauguua

SEQ ID NO: 451235 - RNA, 19 nt, Homo sapiens
ggaaauccaacaccagaaa

SEQ ID NO: 451236 - RNA, 19 nt, Homo sapiens
gcaacaauuugagauguau

SEQ ID NO: 451237 - RNA, 19 nt, Homo sapiens
ggcaacaauuugagaugua

SEQ ID NO: 451238 - RNA, 19 nt, Homo sapiens
gacaauggcaacaauuuga

SEQ ID NO: 451239 - RNA, 19 nt, Homo sapiens
ugucuucuguauucacuua

SEQ ID NO: 451240 - RNA, 19 nt, Homo sapiens
auuaaaugcucaucuggua

SEQ ID NO: 451241 - RNA, 19 nt, Homo sapiens
gauucuggcuagugucuau

SEQ ID NO: 451242 - RNA, 19 nt, Homo sapiens
gguaguguaucauuguugu

SEQ ID NO: 451243 - RNA, 19 nt, Homo sapiens
gaagagauucuggcuagug

SEQ ID NO: 451244 - RNA, 19 nt, Homo sapiens
gcuauaucaaucucucuua

SEQ ID NO: 451245 - RNA, 19 nt, Homo sapiens
gcaauauuuccucauguga

SEQ ID NO: 451246 - RNA, 19 nt, Homo sapiens
aagaauaguucccuagucu

SEQ ID NO: 451247 - RNA, 19 nt, Homo sapiens
uaagaauaguucccuaguc

SEQ ID NO: 451248 - RNA, 19 nt, Homo sapiens
caacaggaacccagcaauc

SEQ ID NO: 451249 - RNA, 19 nt, Homo sapiens
caccagaaauaacaugauc

SEQ ID NO: 451250 - RNA, 19 nt, Homo sapiens
gggagugaagucucagaua

SEQ ID NO: 451251 - RNA, 19 nt, Homo sapiens
agggaaagguaguguauca

SEQ ID NO: 451252 - RNA, 19 nt, Homo sapiens
gaacccagcaaucgaccaa

SEQ ID NO: 451253 - RNA, 19 nt, Homo sapiens
gaaauccaacaccagaaau

SEQ ID NO: 451254 - RNA, 19 nt, Homo sapiens
ggaauaaaaugacacaacu

SEQ ID NO: 451255 - RNA, 19 nt, Homo sapiens
gccagcucauuucacuuua

SEQ ID NO: 451256 - RNA, 19 nt, Homo sapiens
gugacaauggcaacaauuu

SEQ ID NO: 451257 - RNA, 19 nt, Homo sapiens
uaaugguucuuuacacauc

SEQ ID NO: 451258 - RNA, 19 nt, Homo sapiens
acccagcaaucgaccaaua

SEQ ID NO: 451259 - RNA, 19 nt, Homo sapiens
cgaauaagcuuuuaaugcu

SEQ ID NO: 451260 - RNA, 19 nt, Homo sapiens
ucacuaccuuauuaggauu

SEQ ID NO: 451261 - RNA, 19 nt, Homo sapiens
gagauguauuucaacuugu

SEQ ID NO: 451262 - RNA, 19 nt, Homo sapiens
guguaucauuguuguuuga

SEQ ID NO: 451263 - RNA, 19 nt, Homo sapiens
ucaggagcauggacaggaa

SEQ ID NO: 451264 - RNA, 19 nt, Homo sapiens
uuugauuucugaccuugua

SEQ ID NO: 451265 - RNA, 19 nt, Homo sapiens
aaauccaacaccagaaaua

SEQ ID NO: 451266 - RNA, 19 nt, Homo sapiens
ugacaauggcaacaauuug

SEQ ID NO: 451267 - RNA, 19 nt, Homo sapiens
gaaucaagaccuacaccau

SEQ ID NO: 451268 - RNA, 19 nt, Homo sapiens
ccauuacgcuaguuaucau

SEQ ID NO: 451269 - RNA, 19 nt, Homo sapiens
gaguccagcuuguaauggu

SEQ ID NO: 451270 - RNA, 19 nt, Homo sapiens
ccagccagcucauuucacu

SEQ ID NO: 451271 - RNA, 19 nt, Homo sapiens
ccagccagccagcucauuu

SEQ ID NO: 451272 - RNA, 19 nt, Homo sapiens
cagauaagaggaccugugu

SEQ ID NO: 451273 - RNA, 19 nt, Homo sapiens
ugaaagcuauaucaaucuc

SEQ ID NO: 451274 - RNA, 19 nt, Homo sapiens
gaggugaaagcuauaucaa

SEQ ID NO: 451275 - RNA, 19 nt, Homo sapiens
ucugcucucucacugcaua

SEQ ID NO: 451276 - RNA, 19 nt, Homo sapiens
agugaagucucagauaaga

SEQ ID NO: 451277 - RNA, 19 nt, Homo sapiens
aauauuuccucaugugauc

SEQ ID NO: 451278 - RNA, 19 nt, Homo sapiens
cuauaucaaucucucuuag

SEQ ID NO: 451279 - RNA, 19 nt, Homo sapiens
cagcucauuucacuuuaca

SEQ ID NO: 451280 - RNA, 19 nt, Homo sapiens
ccgguuagcagaaucaaga

SEQ ID NO: 451281 - RNA, 19 nt, Homo sapiens
uaccaaacguggccuaaaa

SEQ ID NO: 451282 - RNA, 19 nt, Homo sapiens
ccuuguaccucucuuugau

SEQ ID NO: 451283 - RNA, 19 nt, Homo sapiens
ucccuagucuauucauuau

SEQ ID NO: 451284 - RNA, 19 nt, Homo sapiens
uaugaaagcacugcaugaa

SEQ ID NO: 451285 - RNA, 19 nt, Homo sapiens
aagagauucuggcuagugu

SEQ ID NO: 451286 - RNA, 19 nt, Homo sapiens
gaccuuguaccucucuuug

SEQ ID NO: 451287 - RNA, 19 nt, Homo sapiens
gugaucacaauuugcagua

SEQ ID NO: 451288 - RNA, 19 nt, Homo sapiens
caauaaucucacuaccuua

SEQ ID NO: 451289 - RNA, 19 nt, Homo sapiens
ggaagagauucuggcuagu

SEQ ID NO: 451290 - RNA, 19 nt, Homo sapiens
gaagguguagggagugaag

SEQ ID NO: 451291 - RNA, 19 nt, Homo sapiens
aaagguaguguaucauugu

SEQ ID NO: 451292 - RNA, 19 nt, Homo sapiens
ugaucacaauuugcaguaa

SEQ ID NO: 451293 - RNA, 19 nt, Homo sapiens
uuagcagaaucaagaccua

SEQ ID NO: 451294 - RNA, 19 nt, Homo sapiens
uguagggagugaagucuca

SEQ ID NO: 451295 - RNA, 19 nt, Homo sapiens
caacaccagaaauaacaug

SEQ ID NO: 451296 - RNA, 19 nt, Homo sapiens
ugcaauauuuccucaugug

SEQ ID NO: 451297 - RNA, 19 nt, Homo sapiens
aauccaacaccagaaauaa

SEQ ID NO: 451298 - RNA, 19 nt, Homo sapiens
gccauuacgcuaguuauca

SEQ ID NO: 451299 - RNA, 19 nt, Homo sapiens
uggcaacaauuugagaugu

SEQ ID NO: 451300 - RNA, 19 nt, Homo sapiens
gacucugacuggcuaguag

SEQ ID NO: 451301 - RNA, 19 nt, Homo sapiens
augcucaucugguaacuca

SEQ ID NO: 451302 - RNA, 19 nt, Homo sapiens
cuuggcaucugcucucuca

SEQ ID NO: 451303 - RNA, 19 nt, Homo sapiens
caauauuuccucaugugau

SEQ ID NO: 451304 - RNA, 19 nt, Homo sapiens
gaaaauaauccagucuuca

SEQ ID NO: 451305 - RNA, 19 nt, Homo sapiens
cuuagaguccagcuuguaa

SEQ ID NO: 451306 - RNA, 19 nt, Homo sapiens
gagugaagucucagauaag

SEQ ID NO: 451307 - RNA, 19 nt, Homo sapiens
uuaaaugcucaucugguaa

SEQ ID NO: 451308 - RNA, 19 nt, Homo sapiens
aucaagaccuacaccauca

SEQ ID NO: 451309 - RNA, 19 nt, Homo sapiens
uuacacaucagucacaagu

SEQ ID NO: 451310 - RNA, 19 nt, Homo sapiens
ccaauacagcugugacucu

SEQ ID NO: 451311 - RNA, 19 nt, Homo sapiens
cucacuaccuuauuaggau

SEQ ID NO: 451312 - RNA, 19 nt, Homo sapiens
caauggcaacaauuugaga

SEQ ID NO: 451313 - RNA, 19 nt, Homo sapiens
aguuacagcugugacaaug

SEQ ID NO: 451314 - RNA, 19 nt, Homo sapiens
uucccuagucuauucauua

SEQ ID NO: 451315 - RNA, 19 nt, Homo sapiens
agcaggaccucagccauga

SEQ ID NO: 451316 - RNA, 19 nt, Homo sapiens
cagcuuguaaugguucuuu

SEQ ID NO: 451317 - RNA, 19 nt, Homo sapiens
aagguaguguaucauuguu

SEQ ID NO: 451318 - RNA, 19 nt, Homo sapiens
uaaaugcucaucugguaac

SEQ ID NO: 451319 - RNA, 19 nt, Homo sapiens
acccagcgacugccgguua

SEQ ID NO: 451320 - RNA, 19 nt, Homo sapiens
caaguuacagcugugacaa

SEQ ID NO: 451321 - RNA, 19 nt, Homo sapiens
ccagaaauaacaugaucca

SEQ ID NO: 451322 - RNA, 19 nt, Homo sapiens
ggacaaggaugaucuagga

SEQ ID NO: 451323 - RNA, 19 nt, Homo sapiens
gaacacuccuucacagaug

SEQ ID NO: 451324 - RNA, 19 nt, Homo sapiens
gaacuccucuggccugugu

SEQ ID NO: 451325 - RNA, 19 nt, Homo sapiens
ggacuaacuugucuuugga

SEQ ID NO: 451326 - RNA, 19 nt, Homo sapiens
gguuagagguucccuuuga

SEQ ID NO: 451327 - RNA, 19 nt, Homo sapiens
aaggguaucuggugacuuu

SEQ ID NO: 451328 - RNA, 19 nt, Homo sapiens
gaaagagggagguaaggaa

SEQ ID NO: 451329 - RNA, 19 nt, Homo sapiens
gauccuaguuccaccauca

SEQ ID NO: 451330 - RNA, 19 nt, Homo sapiens
ggccugagcugggaugauu

SEQ ID NO: 451331 - RNA, 19 nt, Homo sapiens
ccauggacuuuguuaguuu

SEQ ID NO: 451332 - RNA, 19 nt, Homo sapiens
caaggaugaucuaggaaga

SEQ ID NO: 451333 - RNA, 19 nt, Homo sapiens
uagcuuugcucauccacua

SEQ ID NO: 451334 - RNA, 19 nt, Homo sapiens
gaugaucuaggaagacuuu

SEQ ID NO: 451335 - RNA, 19 nt, Homo sapiens
gacagucccugccaaugga

SEQ ID NO: 451336 - RNA, 19 nt, Homo sapiens
gcagagcaccuuagacagu

SEQ ID NO: 451337 - RNA, 19 nt, Homo sapiens
ucuggugacuuuccucuuu

SEQ ID NO: 451338 - RNA, 19 nt, Homo sapiens
gaaaggaaagagggaggua

SEQ ID NO: 451339 - RNA, 19 nt, Homo sapiens
gagcugugguaguaauuca

SEQ ID NO: 451340 - RNA, 19 nt, Homo sapiens
gcagagaccaucccugaag

SEQ ID NO: 451341 - RNA, 19 nt, Homo sapiens
ccaauggacuaacuugucu

SEQ ID NO: 451342 - RNA, 19 nt, Homo sapiens
cuacaguccucccaucuca

SEQ ID NO: 451343 - RNA, 19 nt, Homo sapiens
gacccaugcugcccuguga

SEQ ID NO: 451344 - RNA, 19 nt, Homo sapiens
gcucaccucucccuuggau

SEQ ID NO: 451345 - RNA, 19 nt, Homo sapiens
gaaguuguaggcauaaagu

SEQ ID NO: 451346 - RNA, 19 nt, Homo sapiens
ccaucaagccaccaacaua

SEQ ID NO: 451347 - RNA, 19 nt, Homo sapiens
cagcagagcaccuuagaca

SEQ ID NO: 451348 - RNA, 19 nt, Homo sapiens
ggaaagagggagguaagga

SEQ ID NO: 451349 - RNA, 19 nt, Homo sapiens
gcucugcccuugguuagga

SEQ ID NO: 451350 - RNA, 19 nt, Homo sapiens
gccaaaggcucaggaugga

SEQ ID NO: 451351 - RNA, 19 nt, Homo sapiens
ccacauuccugaugcuucu

SEQ ID NO: 451352 - RNA, 19 nt, Homo sapiens
ccucccaucucacacauga

SEQ ID NO: 451353 - RNA, 19 nt, Homo sapiens
gugacgaaaugcaacauca

SEQ ID NO: 451354 - RNA, 19 nt, Homo sapiens
ggcccugccuccuuuguga

SEQ ID NO: 451355 - RNA, 19 nt, Homo sapiens
ggaacacuccuucacagau

SEQ ID NO: 451356 - RNA, 19 nt, Homo sapiens
aaagauggcaggagagaug

SEQ ID NO: 451357 - RNA, 19 nt, Homo sapiens
caaacgcgcaaucaucuug

SEQ ID NO: 451358 - RNA, 19 nt, Homo sapiens
uccaagaccuucuccuuca

SEQ ID NO: 451359 - RNA, 19 nt, Homo sapiens
ccaacauacucccaucugu

SEQ ID NO: 451360 - RNA, 19 nt, Homo sapiens
ucugaaggcuggguucuga

SEQ ID NO: 451361 - RNA, 19 nt, Homo sapiens
ccacuggugacaugucuuu

SEQ ID NO: 451362 - RNA, 19 nt, Homo sapiens
gcugugguaguaauucaua

SEQ ID NO: 451363 - RNA, 19 nt, Homo sapiens
caacgucugugccauuuug

SEQ ID NO: 451364 - RNA, 19 nt, Homo sapiens
gaucuaggaagacuuugga

SEQ ID NO: 451365 - RNA, 19 nt, Homo sapiens
ggagggccuucgcuacauc

SEQ ID NO: 451366 - RNA, 19 nt, Homo sapiens
ccaagaagcccaggaaagg

SEQ ID NO: 451367 - RNA, 19 nt, Homo sapiens
ggucuacacugugcugagu

SEQ ID NO: 451368 - RNA, 19 nt, Homo sapiens
gaggcucugcccuugguua

SEQ ID NO: 451369 - RNA, 19 nt, Homo sapiens
gcaaccugauugugucucu

SEQ ID NO: 451370 - RNA, 19 nt, Homo sapiens
ucaccucucccuuggauug

SEQ ID NO: 451371 - RNA, 19 nt, Homo sapiens
uggacuaacuugucuuugg

SEQ ID NO: 451372 - RNA, 19 nt, Homo sapiens
ggacauggacaaggaugau

SEQ ID NO: 451373 - RNA, 19 nt, Homo sapiens
gggaaguuguaggcauaaa

SEQ ID NO: 451374 - RNA, 19 nt, Homo sapiens
gcccaggcuuagucacuga

SEQ ID NO: 451375 - RNA, 19 nt, Homo sapiens
cagcauggcccacgucucu

SEQ ID NO: 451376 - RNA, 19 nt, Homo sapiens
ucaaagauaccuguagcuu

SEQ ID NO: 451377 - RNA, 19 nt, Homo sapiens
ucccaucugugaaaggaaa

SEQ ID NO: 451378 - RNA, 19 nt, Homo sapiens
ggugacaugucuuuucuug

SEQ ID NO: 451379 - RNA, 19 nt, Homo sapiens
gaaauggcggcaccuucga

SEQ ID NO: 451380 - RNA, 19 nt, Homo sapiens
caacagaaccaggcaucau

SEQ ID NO: 451381 - RNA, 19 nt, Homo sapiens
ccucuuuggucuacacugu

SEQ ID NO: 451382 - RNA, 19 nt, Homo sapiens
gcaaacgcgcaaucaucuu

SEQ ID NO: 451383 - RNA, 19 nt, Homo sapiens
gcacuuuguucuggcucuu

SEQ ID NO: 451384 - RNA, 19 nt, Homo sapiens
acacugugcugagucugaa

SEQ ID NO: 451385 - RNA, 19 nt, Homo sapiens
cgaaagauggcaggagaga

SEQ ID NO: 451386 - RNA, 19 nt, Homo sapiens
uccauggacuuuguuaguu

SEQ ID NO: 451387 - RNA, 19 nt, Homo sapiens
ggaaguuguaggcauaaag

SEQ ID NO: 451388 - RNA, 19 nt, Homo sapiens
cacacacgccagauucuuu

SEQ ID NO: 451389 - RNA, 19 nt, Homo sapiens
gcagggagugaguugauag

SEQ ID NO: 451390 - RNA, 19 nt, Homo sapiens
gugucuaguuguuugauuc

SEQ ID NO: 451391 - RNA, 19 nt, Homo sapiens
ggcaaacgcgcaaucaucu

SEQ ID NO: 451392 - RNA, 19 nt, Homo sapiens
cauacucccaucugugaaa

SEQ ID NO: 451393 - RNA, 19 nt, Homo sapiens
ugacaugucuuuucuugca

SEQ ID NO: 451394 - RNA, 19 nt, Homo sapiens
cagccccaaugaacaauua

SEQ ID NO: 451395 - RNA, 19 nt, Homo sapiens
ucuaguuguuugauucaga

SEQ ID NO: 451396 - RNA, 19 nt, Homo sapiens
ccaagcaggacauggacaa

SEQ ID NO: 451397 - RNA, 19 nt, Homo sapiens
cauggacuuuguuaguuuc

SEQ ID NO: 451398 - RNA, 19 nt, Homo sapiens
ggauuuccaugauguuuuc

SEQ ID NO: 451399 - RNA, 19 nt, Homo sapiens
gcagaucggcgaggugaag

SEQ ID NO: 451400 - RNA, 19 nt, Homo sapiens
gagaaugcuccgucugaag

SEQ ID NO: 451401 - RNA, 19 nt, Homo sapiens
gccaauggacuaacuuguc

SEQ ID NO: 451402 - RNA, 19 nt, Homo sapiens
caucaagccaccaacauac

SEQ ID NO: 451403 - RNA, 19 nt, Homo sapiens
gugaggcucugcccuuggu

SEQ ID NO: 451404 - RNA, 19 nt, Homo sapiens
agagggagguaaggaauac

SEQ ID NO: 451405 - RNA, 19 nt, Homo sapiens
aagagggagguaaggaaua

SEQ ID NO: 451406 - RNA, 19 nt, Homo sapiens
aaagagggagguaaggaau

SEQ ID NO: 451407 - RNA, 19 nt, Homo sapiens
aacauacucccaucuguga

SEQ ID NO: 451408 - RNA, 19 nt, Homo sapiens
cugcugcccuaacucgaaa

SEQ ID NO: 451409 - RNA, 19 nt, Homo sapiens
gccugugucuaguuguuug

SEQ ID NO: 451410 - RNA, 19 nt, Homo sapiens
gcucauccacuaucaacag

SEQ ID NO: 451411 - RNA, 19 nt, Homo sapiens
gguccaaugcacuuuguuc

SEQ ID NO: 451412 - RNA, 19 nt, Homo sapiens
ccaggcugcugcccuaacu

SEQ ID NO: 451413 - RNA, 19 nt, Homo sapiens
cggcaaacgcgcaaucauc

SEQ ID NO: 451414 - RNA, 19 nt, Homo sapiens
ugcagggagugaguugaua

SEQ ID NO: 451415 - RNA, 19 nt, Homo sapiens
gacaucaaagauaccugua

SEQ ID NO: 451416 - RNA, 19 nt, Homo sapiens
gccaccuucugccaucuga

SEQ ID NO: 451417 - RNA, 19 nt, Homo sapiens
gcuggguucugauccuagu

SEQ ID NO: 451418 - RNA, 19 nt, Homo sapiens
aacaucacgugcagcaaga

SEQ ID NO: 451419 - RNA, 19 nt, Homo sapiens
ccggagcugugguaguaau

SEQ ID NO: 451420 - RNA, 19 nt, Homo sapiens
gcauggcccacgucucugu

SEQ ID NO: 451421 - RNA, 19 nt, Homo sapiens
accaacgucugugccauuu

SEQ ID NO: 451422 - RNA, 19 nt, Homo sapiens
gcacuuacuugcuuauuug

SEQ ID NO: 451423 - RNA, 19 nt, Homo sapiens
gcacauguuuccucuaguu

SEQ ID NO: 451424 - RNA, 19 nt, Homo sapiens
ggaagggccuguggguuua

SEQ ID NO: 451425 - RNA, 19 nt, Homo sapiens
ggagacagcaucaggguua

SEQ ID NO: 451426 - RNA, 19 nt, Homo sapiens
gagcaggacuucaccuuug

SEQ ID NO: 451427 - RNA, 19 nt, Homo sapiens
gcaggugcuuugcaagaua

SEQ ID NO: 451428 - RNA, 19 nt, Homo sapiens
ggaccuaaauggccucaug

SEQ ID NO: 451429 - RNA, 19 nt, Homo sapiens
ccacuugccucuuccuuga

SEQ ID NO: 451430 - RNA, 19 nt, Homo sapiens
ggaugacucugacaacuuc

SEQ ID NO: 451431 - RNA, 19 nt, Homo sapiens
gcuggaaucaggaauauuu

SEQ ID NO: 451432 - RNA, 19 nt, Homo sapiens
aaacuuggcucgaaucucu

SEQ ID NO: 451433 - RNA, 19 nt, Homo sapiens
ggagaggaauccggcagua

SEQ ID NO: 451434 - RNA, 19 nt, Homo sapiens
ucacacaccuguagcacuu

SEQ ID NO: 451435 - RNA, 19 nt, Homo sapiens
gggaagggccuguggguuu

SEQ ID NO: 451436 - RNA, 19 nt, Homo sapiens
gaaccuguguccgguauuc

SEQ ID NO: 451437 - RNA, 19 nt, Homo sapiens
gaugucaauuucuguguug

SEQ ID NO: 451438 - RNA, 19 nt, Homo sapiens
cgagagggcugcugaggau

SEQ ID NO: 451439 - RNA, 19 nt, Homo sapiens
ugagguaaguuaaguaagu

SEQ ID NO: 451440 - RNA, 19 nt, Homo sapiens
aaacgguacuugucauuuc

SEQ ID NO: 451441 - RNA, 19 nt, Homo sapiens
gagguaaguuaaguaaguu

SEQ ID NO: 451442 - RNA, 19 nt, Homo sapiens
uaaucuagauaucgacuug

SEQ ID NO: 451443 - RNA, 19 nt, Homo sapiens
uuauaaggcugaugucaau

SEQ ID NO: 451444 - RNA, 19 nt, Homo sapiens
uguguugucucuugaguuu

SEQ ID NO: 451445 - RNA, 19 nt, Homo sapiens
ccaaacaggaggaauucua

SEQ ID NO: 451446 - RNA, 19 nt, Homo sapiens
gcaacaggguauggacuau

SEQ ID NO: 451447 - RNA, 19 nt, Homo sapiens
ccacugccuucgcuucuug

SEQ ID NO: 451448 - RNA, 19 nt, Homo sapiens
gggcuggaaucaggaauau

SEQ ID NO: 451449 - RNA, 19 nt, Homo sapiens
cgacugcuuuggaccuaaa

SEQ ID NO: 451450 - RNA, 19 nt, Homo sapiens
ggagcaggacuucaccuuu

SEQ ID NO: 451451 - RNA, 19 nt, Homo sapiens
aggcuuaguuuguguguug

SEQ ID NO: 451452 - RNA, 19 nt, Homo sapiens
caaacaggaggaauucuau

SEQ ID NO: 451453 - RNA, 19 nt, Homo sapiens
ccaccaaacaggaggaauu

SEQ ID NO: 451454 - RNA, 19 nt, Homo sapiens
gagacagcaucaggguuaa

SEQ ID NO: 451455 - RNA, 19 nt, Homo sapiens
gggcucaucuuugcugugu

SEQ ID NO: 451456 - RNA, 19 nt, Homo sapiens
uaaacuaggagaaccaaau

SEQ ID NO: 451457 - RNA, 19 nt, Homo sapiens
caauaaacgguacuuguca

SEQ ID NO: 451458 - RNA, 19 nt, Homo sapiens
gaggcuggguucauuugug

SEQ ID NO: 451459 - RNA, 19 nt, Homo sapiens
gggaaccuguguccgguau

SEQ ID NO: 451460 - RNA, 19 nt, Homo sapiens
cgcaaauuguggcuacuaa

SEQ ID NO: 451461 - RNA, 19 nt, Homo sapiens
uaaggcugaugucaauuuc

SEQ ID NO: 451462 - RNA, 19 nt, Homo sapiens
gacaggaguccacuuuguu

SEQ ID NO: 451463 - RNA, 19 nt, Homo sapiens
uaaaguaguccugugaaug

SEQ ID NO: 451464 - RNA, 19 nt, Homo sapiens
ggagaauacggcuguagug

SEQ ID NO: 451465 - RNA, 19 nt, Homo sapiens
aaggccagguucuccguua

SEQ ID NO: 451466 - RNA, 19 nt, Homo sapiens
ugcacuuacuugcuuauuu

SEQ ID NO: 451467 - RNA, 19 nt, Homo sapiens
gugauagucuuuugcuuuu

SEQ ID NO: 451468 - RNA, 19 nt, Homo sapiens
aaauguaggcuuaguuugu

SEQ ID NO: 451469 - RNA, 19 nt, Homo sapiens
gcaaaacucuacuuaaucc

SEQ ID NO: 451470 - RNA, 19 nt, Homo sapiens
caaaauguaggcuuaguuu

SEQ ID NO: 451471 - RNA, 19 nt, Homo sapiens
uaaacgguacuugucauuu

SEQ ID NO: 451472 - RNA, 19 nt, Homo sapiens
uggcaucgcaccauucuga

SEQ ID NO: 451473 - RNA, 19 nt, Homo sapiens
caggugcuuugcaagauau

SEQ ID NO: 451474 - RNA, 19 nt, Homo sapiens
gcaucaggguuaagaagac

SEQ ID NO: 451475 - RNA, 19 nt, Homo sapiens
ccaucuugcuucccuaauc

SEQ ID NO: 451476 - RNA, 19 nt, Homo sapiens
gcaaauuguggcuacuaau

SEQ ID NO: 451477 - RNA, 19 nt, Homo sapiens
cauguuuccucuaguucuu

SEQ ID NO: 451478 - RNA, 19 nt, Homo sapiens
uggcaaaacucuacuuaau

SEQ ID NO: 451479 - RNA, 19 nt, Homo sapiens
guuuguguguugucucuug

SEQ ID NO: 451480 - RNA, 19 nt, Homo sapiens
caucuugcuucccuaaucu

SEQ ID NO: 451481 - RNA, 19 nt, Homo sapiens
gggaugacucugacaacuu

SEQ ID NO: 451482 - RNA, 19 nt, Homo sapiens
gcuggguucauuuguguaa

SEQ ID NO: 451483 - RNA, 19 nt, Homo sapiens
ugaugucaauuucuguguu

SEQ ID NO: 451484 - RNA, 19 nt, Homo sapiens
ucucugugccuucgucuuu

SEQ ID NO: 451485 - RNA, 19 nt, Homo sapiens
auaaaguaguccugugaau

SEQ ID NO: 451486 - RNA, 19 nt, Homo sapiens
ccuuguuacuucugaggua

SEQ ID NO: 451487 - RNA, 19 nt, Homo sapiens
acaggaguccacuuuguuu

SEQ ID NO: 451488 - RNA, 19 nt, Homo sapiens
auaaggcugaugucaauuu

SEQ ID NO: 451489 - RNA, 19 nt, Homo sapiens
gacucagccuucagacaga

SEQ ID NO: 451490 - RNA, 19 nt, Homo sapiens
ggccuguggguuuauuaua

SEQ ID NO: 451491 - RNA, 19 nt, Homo sapiens
acuucugccuggagacuua

SEQ ID NO: 451492 - RNA, 19 nt, Homo sapiens
ccacucugcuucucugacu

SEQ ID NO: 451493 - RNA, 19 nt, Homo sapiens
gguaaguuaaguaaguuga

SEQ ID NO: 451494 - RNA, 19 nt, Homo sapiens
uugcuuauuugacaacguu

SEQ ID NO: 451495 - RNA, 19 nt, Homo sapiens
aauguaggcuuaguuugug

SEQ ID NO: 451496 - RNA, 19 nt, Homo sapiens
caccuggcaucgcaccauu

SEQ ID NO: 451497 - RNA, 19 nt, Homo sapiens
aaaguaguccugugaaugc

SEQ ID NO: 451498 - RNA, 19 nt, Homo sapiens
agaggaauccggcaguaga

SEQ ID NO: 451499 - RNA, 19 nt, Homo sapiens
aaacuaggagaaccaaauc

SEQ ID NO: 451500 - RNA, 19 nt, Homo sapiens
uugcacauguuuccucuag

SEQ ID NO: 451501 - RNA, 19 nt, Homo sapiens
gacagcaucaggguuaaga

SEQ ID NO: 451502 - RNA, 19 nt, Homo sapiens
guaaguugauucgguaucc

SEQ ID NO: 451503 - RNA, 19 nt, Homo sapiens
cugacucgguuucuccaaa

SEQ ID NO: 451504 - RNA, 19 nt, Homo sapiens
cuuacuugcuuauuugaca

SEQ ID NO: 451505 - RNA, 19 nt, Homo sapiens
uguugucucuugaguuugu

SEQ ID NO: 451506 - RNA, 19 nt, Homo sapiens
ucugagguaaguuaaguaa

SEQ ID NO: 451507 - RNA, 19 nt, Homo sapiens
ggaguccacuuuguuucgu

SEQ ID NO: 451508 - RNA, 19 nt, Homo sapiens
aauaaacgguacuugucau

SEQ ID NO: 451509 - RNA, 19 nt, Homo sapiens
aggcugaugucaauuucug

SEQ ID NO: 451510 - RNA, 19 nt, Homo sapiens
ggaaacuuggcucgaaucu

SEQ ID NO: 451511 - RNA, 19 nt, Homo sapiens
gaguuugucgcucaugugu

SEQ ID NO: 451512 - RNA, 19 nt, Homo sapiens
cuucugagguaaguuaagu

SEQ ID NO: 451513 - RNA, 19 nt, Homo sapiens
gggagaauacggcuguagu

SEQ ID NO: 451514 - RNA, 19 nt, Homo sapiens
gaccggacuuuucugcaaa

SEQ ID NO: 451515 - RNA, 19 nt, Homo sapiens
uauaaaguaguccugugaa

SEQ ID NO: 451516 - RNA, 19 nt, Homo sapiens
agcaggacuucaccuuuga

SEQ ID NO: 451517 - RNA, 19 nt, Homo sapiens
aggcuggguucauuugugu

SEQ ID NO: 451518 - RNA, 19 nt, Homo sapiens
cagaggcuggguucauuug

SEQ ID NO: 451519 - RNA, 19 nt, Homo sapiens
gagggcugcugaggaugga

SEQ ID NO: 451520 - RNA, 19 nt, Homo sapiens
ugggaaacuuggcucgaau

SEQ ID NO: 451521 - RNA, 19 nt, Homo sapiens
ccuguagcacuuacuggua

SEQ ID NO: 451522 - RNA, 19 nt, Homo sapiens
uaaaucauguggccuaaua

SEQ ID NO: 451523 - RNA, 19 nt, Homo sapiens
gaguagagguuuaaagaaa

SEQ ID NO: 451524 - RNA, 19 nt, Homo sapiens
ccaaagauguuaacaguau

SEQ ID NO: 451525 - RNA, 19 nt, Homo sapiens
caagauaccugcucagaca

SEQ ID NO: 451526 - RNA, 19 nt, Homo sapiens
caacuuagugucucuauuu

SEQ ID NO: 451527 - RNA, 19 nt, Homo sapiens
ugaagaaacugauaaagag

SEQ ID NO: 451528 - RNA, 19 nt, Homo sapiens
gacaacagcuccauugaag

SEQ ID NO: 451529 - RNA, 19 nt, Homo sapiens
gaauagcaguggcaaaaua

SEQ ID NO: 451530 - RNA, 19 nt, Homo sapiens
guuauuggcuuucucuuug

SEQ ID NO: 451531 - RNA, 19 nt, Homo sapiens
ccacgacgcugaauauaca

SEQ ID NO: 451532 - RNA, 19 nt, Homo sapiens
caaagauacuguugacuag

SEQ ID NO: 451533 - RNA, 19 nt, Homo sapiens
ccaaagauacuguugacua

SEQ ID NO: 451534 - RNA, 19 nt, Homo sapiens
caacagcuccauugaagaa

SEQ ID NO: 451535 - RNA, 19 nt, Homo sapiens
gcacagacaauucuaaugg

SEQ ID NO: 451536 - RNA, 19 nt, Homo sapiens
agacugguguuaaugagua

SEQ ID NO: 451537 - RNA, 19 nt, Homo sapiens
guccagagcugacuacauc

SEQ ID NO: 451538 - RNA, 19 nt, Homo sapiens
auaaagacauguaccuuga

SEQ ID NO: 451539 - RNA, 19 nt, Homo sapiens
gaguguauccuauugauga

SEQ ID NO: 451540 - RNA, 19 nt, Homo sapiens
agauugaccuuaccaaguu

SEQ ID NO: 451541 - RNA, 19 nt, Homo sapiens
gaaaccacgacgcugaaua

SEQ ID NO: 451542 - RNA, 19 nt, Homo sapiens
gagcugacaucugauaaag

SEQ ID NO: 451543 - RNA, 19 nt, Homo sapiens
acagacaauucuaauggua

SEQ ID NO: 451544 - RNA, 19 nt, Homo sapiens
gaggauuugauguaaguua

SEQ ID NO: 451545 - RNA, 19 nt, Homo sapiens
caucugcaguguucuguga

SEQ ID NO: 451546 - RNA, 19 nt, Homo sapiens
gaagguacgaguagagguu

SEQ ID NO: 451547 - RNA, 19 nt, Homo sapiens
gggaggauuugauguaagu

SEQ ID NO: 451548 - RNA, 19 nt, Homo sapiens
gaagaaacugauaaagaga

SEQ ID NO: 451549 - RNA, 19 nt, Homo sapiens
ugaagugccucugauucua

SEQ ID NO: 451550 - RNA, 19 nt, Homo sapiens
gacaaagucaccugaagaa

SEQ ID NO: 451551 - RNA, 19 nt, Homo sapiens
acaaauguguauacugaga

SEQ ID NO: 451552 - RNA, 19 nt, Homo sapiens
cgaagaggauacaaaugug

SEQ ID NO: 451553 - RNA, 19 nt, Homo sapiens
caacagcaaauuaaugugu

SEQ ID NO: 451554 - RNA, 19 nt, Homo sapiens
gcugacaucugauaaagac

SEQ ID NO: 451555 - RNA, 19 nt, Homo sapiens
gauucuauguaacuuguug

SEQ ID NO: 451556 - RNA, 19 nt, Homo sapiens
gaagugccucugauucuau

SEQ ID NO: 451557 - RNA, 19 nt, Homo sapiens
cagcaaacccaaagauguu

SEQ ID NO: 451558 - RNA, 19 nt, Homo sapiens
ccucugcccucccuucuug

SEQ ID NO: 451559 - RNA, 19 nt, Homo sapiens
ggcuuucucuuugcaauuu

SEQ ID NO: 451560 - RNA, 19 nt, Homo sapiens
aaagucaccugaagaaacu

SEQ ID NO: 451561 - RNA, 19 nt, Homo sapiens
cuuagugucucuauuuaug

SEQ ID NO: 451562 - RNA, 19 nt, Homo sapiens
gagaaagaaggaugaagga

SEQ ID NO: 451563 - RNA, 19 nt, Homo sapiens
cauguggccuaauauugaa

SEQ ID NO: 451564 - RNA, 19 nt, Homo sapiens
ucauguggccuaauauuga

SEQ ID NO: 451565 - RNA, 19 nt, Homo sapiens
gaagaggauacaaaugugu

SEQ ID NO: 451566 - RNA, 19 nt, Homo sapiens
gacuacaucucgaccacuu

SEQ ID NO: 451567 - RNA, 19 nt, Homo sapiens
uuaagaaguugcugcagau

SEQ ID NO: 451568 - RNA, 19 nt, Homo sapiens
gcaaacccaaagauguuaa

SEQ ID NO: 451569 - RNA, 19 nt, Homo sapiens
aaccaaacccuaugccuuu

SEQ ID NO: 451570 - RNA, 19 nt, Homo sapiens
uaucagaaggcaccuacua

SEQ ID NO: 451571 - RNA, 19 nt, Homo sapiens
ccgaagaggauacaaaugu

SEQ ID NO: 451572 - RNA, 19 nt, Homo sapiens
ggacccagccgaagaggau

SEQ ID NO: 451573 - RNA, 19 nt, Homo sapiens
aaaccacgacgcugaauau

SEQ ID NO: 451574 - RNA, 19 nt, Homo sapiens
cugaagaaacugauaaaga

SEQ ID NO: 451575 - RNA, 19 nt, Homo sapiens
caaagucaccugaagaaac

SEQ ID NO: 451576 - RNA, 19 nt, Homo sapiens
gcagacugguguuaaugag

SEQ ID NO: 451577 - RNA, 19 nt, Homo sapiens
gugcagaaaccaacaagug

SEQ ID NO: 451578 - RNA, 19 nt, Homo sapiens
ugccguagcucccuuucaa

SEQ ID NO: 451579 - RNA, 19 nt, Homo sapiens
ugacaacagcuccauugaa

SEQ ID NO: 451580 - RNA, 19 nt, Homo sapiens
gccacuguauuuguuaauu

SEQ ID NO: 451581 - RNA, 19 nt, Homo sapiens
gaaggaugaaggaagcuau

SEQ ID NO: 451582 - RNA, 19 nt, Homo sapiens
cuaaucagaucuucuuuug

SEQ ID NO: 451583 - RNA, 19 nt, Homo sapiens
gucagcaugucucagauug

SEQ ID NO: 451584 - RNA, 19 nt, Homo sapiens
guucauggaauugguuuaa

SEQ ID NO: 451585 - RNA, 19 nt, Homo sapiens
ccaacuuagugucucuauu

SEQ ID NO: 451586 - RNA, 19 nt, Homo sapiens
aagauacuguugacuagug

SEQ ID NO: 451587 - RNA, 19 nt, Homo sapiens
aaagacauguaccuugaca

SEQ ID NO: 451588 - RNA, 19 nt, Homo sapiens
acccaaagauguuaacagu

SEQ ID NO: 451589 - RNA, 19 nt, Homo sapiens
uucauuaccuguagcuuug

SEQ ID NO: 451590 - RNA, 19 nt, Homo sapiens
ucaaagaugaaagcuguuu

SEQ ID NO: 451591 - RNA, 19 nt, Homo sapiens
ucuggcacuuuaaugauaa

SEQ ID NO: 451592 - RNA, 19 nt, Homo sapiens
gagcugaugaggauguaga

SEQ ID NO: 451593 - RNA, 19 nt, Homo sapiens
caucugauaaagacaugua

SEQ ID NO: 451594 - RNA, 19 nt, Homo sapiens
caauuugaagguacgagua

SEQ ID NO: 451595 - RNA, 19 nt, Homo sapiens
uagcugucauggugcaauu

SEQ ID NO: 451596 - RNA, 19 nt, Homo sapiens
uccuaugacucaaagauga

SEQ ID NO: 451597 - RNA, 19 nt, Homo sapiens
agaaggcaccuacuaagga

SEQ ID NO: 451598 - RNA, 19 nt, Homo sapiens
gcaugagaaagaaggauga

SEQ ID NO: 451599 - RNA, 19 nt, Homo sapiens
agacaaagucaccugaaga

SEQ ID NO: 451600 - RNA, 19 nt, Homo sapiens
cagacaaagucaccugaag

SEQ ID NO: 451601 - RNA, 19 nt, Homo sapiens
cagacaauucuaaugguaa

SEQ ID NO: 451602 - RNA, 19 nt, Homo sapiens
aacuuuaacuuccacuuug

SEQ ID NO: 451603 - RNA, 19 nt, Homo sapiens
ccucgauguucauggaauu

SEQ ID NO: 451604 - RNA, 19 nt, Homo sapiens
guugguguaucgcaugaga

SEQ ID NO: 451605 - RNA, 19 nt, Homo sapiens
uaagcacagacaauucuaa

SEQ ID NO: 451606 - RNA, 19 nt, Homo sapiens
cgaguagagguuuaaagaa

SEQ ID NO: 451607 - RNA, 19 nt, Homo sapiens
gacaucugauaaagacaug

SEQ ID NO: 451608 - RNA, 19 nt, Homo sapiens
gauugaccuuaccaaguug

SEQ ID NO: 451609 - RNA, 19 nt, Homo sapiens
guguaucgcaugagaaaga

SEQ ID NO: 451610 - RNA, 19 nt, Homo sapiens
ccacagcagagcaagaaga

SEQ ID NO: 451611 - RNA, 19 nt, Homo sapiens
ugucacugcugguggaguu

SEQ ID NO: 451612 - RNA, 19 nt, Homo sapiens
caaauguguauacugagaa

SEQ ID NO: 451613 - RNA, 19 nt, Homo sapiens
gguaacuuuuguagucuua

SEQ ID NO: 451614 - RNA, 19 nt, Homo sapiens
guugcagacugguguuaau

SEQ ID NO: 451615 - RNA, 19 nt, Homo sapiens
ucagcaaacccaaagaugu

SEQ ID NO: 451616 - RNA, 19 nt, Homo sapiens
ggugcaauuugucuuugga

SEQ ID NO: 451617 - RNA, 19 nt, Homo sapiens
agaaaguucaccucucuga

SEQ ID NO: 451618 - RNA, 19 nt, Homo sapiens
ugaugaggauguagagagu

SEQ ID NO: 451619 - RNA, 19 nt, Homo sapiens
gggagcugaugaggaugua

SEQ ID NO: 451620 - RNA, 19 nt, Homo sapiens
aauaaaucauguggccuaa

SEQ ID NO: 451621 - RNA, 19 nt, Homo sapiens
acauguaccuugacaacag

SEQ ID NO: 451622 - RNA, 19 nt, Homo sapiens
gcaggaaucugaugacuuu

SEQ ID NO: 451623 - RNA, 19 nt, Homo sapiens
gaaaagagcugagaguuua

SEQ ID NO: 451624 - RNA, 19 nt, Homo sapiens
gggauuggaucacuucuua

SEQ ID NO: 451625 - RNA, 19 nt, Homo sapiens
gaacuaaacuggcuuaacg

SEQ ID NO: 451626 - RNA, 19 nt, Homo sapiens
gcaagaaacccaucuacaa

SEQ ID NO: 451627 - RNA, 19 nt, Homo sapiens
gagaagagccggagagaug

SEQ ID NO: 451628 - RNA, 19 nt, Homo sapiens
ccaagaaacuagaggagaa

SEQ ID NO: 451629 - RNA, 19 nt, Homo sapiens
ggacagcacuauucuagag

SEQ ID NO: 451630 - RNA, 19 nt, Homo sapiens
gggaaucucugugguauau

SEQ ID NO: 451631 - RNA, 19 nt, Homo sapiens
ggacccagcugguguucuu

SEQ ID NO: 451632 - RNA, 19 nt, Homo sapiens
gcuaugaccugggcaagaa

SEQ ID NO: 451633 - RNA, 19 nt, Homo sapiens
gcacuaaccacguuucuag

SEQ ID NO: 451634 - RNA, 19 nt, Homo sapiens
gagaguuuaugcugaaaug

SEQ ID NO: 451635 - RNA, 19 nt, Homo sapiens
gcugagaguuuaugcugaa

SEQ ID NO: 451636 - RNA, 19 nt, Homo sapiens
guaaauggguacuugugau

SEQ ID NO: 451637 - RNA, 19 nt, Homo sapiens
caacuuggccuuucugaag

SEQ ID NO: 451638 - RNA, 19 nt, Homo sapiens
gcacuggcuuggacuuuag

SEQ ID NO: 451639 - RNA, 19 nt, Homo sapiens
gagagcauguccaucuguu

SEQ ID NO: 451640 - RNA, 19 nt, Homo sapiens
gugccgaggugucuucauu

SEQ ID NO: 451641 - RNA, 19 nt, Homo sapiens
agaaacccaucuacaagaa

SEQ ID NO: 451642 - RNA, 19 nt, Homo sapiens
guucauggcuacuguacug

SEQ ID NO: 451643 - RNA, 19 nt, Homo sapiens
ucuaggcucuuucaaguga

SEQ ID NO: 451644 - RNA, 19 nt, Homo sapiens
gaaucucugugguauauac

SEQ ID NO: 451645 - RNA, 19 nt, Homo sapiens
ggcacuggcuuggacuuua

SEQ ID NO: 451646 - RNA, 19 nt, Homo sapiens
gugaggauguguccaacaa

SEQ ID NO: 451647 - RNA, 19 nt, Homo sapiens
gaucggcccugaaguuguc

SEQ ID NO: 451648 - RNA, 19 nt, Homo sapiens
gauuggaucacuucuuaaa

SEQ ID NO: 451649 - RNA, 19 nt, Homo sapiens
ccaacaaggugucaauguc

SEQ ID NO: 451650 - RNA, 19 nt, Homo sapiens
ccaauacaguaaccacaug

SEQ ID NO: 451651 - RNA, 19 nt, Homo sapiens
guggaugguucuacccuuu

SEQ ID NO: 451652 - RNA, 19 nt, Homo sapiens
caagaaacccaucuacaag

SEQ ID NO: 451653 - RNA, 19 nt, Homo sapiens
ggauauuugugucuguguu

SEQ ID NO: 451654 - RNA, 19 nt, Homo sapiens
ccugcuaaguuuguauuua

SEQ ID NO: 451655 - RNA, 19 nt, Homo sapiens
cgaggugucuucauucucu

SEQ ID NO: 451656 - RNA, 19 nt, Homo sapiens
guaugaagaagaaggauga

SEQ ID NO: 451657 - RNA, 19 nt, Homo sapiens
cagcugguguucuuugguu

SEQ ID NO: 451658 - RNA, 19 nt, Homo sapiens
ggaaaagagcugagaguuu

SEQ ID NO: 451659 - RNA, 19 nt, Homo sapiens
cuugagauguuucuguaaa

SEQ ID NO: 451660 - RNA, 19 nt, Homo sapiens
gugagcaccuccucuguag

SEQ ID NO: 451661 - RNA, 19 nt, Homo sapiens
augcggcuguuuaaaguua

SEQ ID NO: 451662 - RNA, 19 nt, Homo sapiens
gggcugugcuauccaauac

SEQ ID NO: 451663 - RNA, 19 nt, Homo sapiens
uagcagaucccaaaauaua

SEQ ID NO: 451664 - RNA, 19 nt, Homo sapiens
gaaacccaucuacaagaaa

SEQ ID NO: 451665 - RNA, 19 nt, Homo sapiens
gcagggcagcaacaucuuu

SEQ ID NO: 451666 - RNA, 19 nt, Homo sapiens
gaaucucacccguugaaga

SEQ ID NO: 451667 - RNA, 19 nt, Homo sapiens
ggaaucugaugacuuugag

SEQ ID NO: 451668 - RNA, 19 nt, Homo sapiens
ggauucaacuuggccuuuc

SEQ ID NO: 451669 - RNA, 19 nt, Homo sapiens
cagcucugauuaccuuuga

SEQ ID NO: 451670 - RNA, 19 nt, Homo sapiens
agaaccaccugcaccuuga

SEQ ID NO: 451671 - RNA, 19 nt, Homo sapiens
cuggagaucuggaugacuu

SEQ ID NO: 451672 - RNA, 19 nt, Homo sapiens
ugagauguuucuguaaaug

SEQ ID NO: 451673 - RNA, 19 nt, Homo sapiens
uucauucucucgcacauuu

SEQ ID NO: 451674 - RNA, 19 nt, Homo sapiens
caugaucggcccugaaguu

SEQ ID NO: 451675 - RNA, 19 nt, Homo sapiens
gauuaccuuugaaguguuc

SEQ ID NO: 451676 - RNA, 19 nt, Homo sapiens
aaacccaucuacaagaaag

SEQ ID NO: 451677 - RNA, 19 nt, Homo sapiens
gaaguguucagaagagaca

SEQ ID NO: 451678 - RNA, 19 nt, Homo sapiens
cugauuaccuuugaagugu

SEQ ID NO: 451679 - RNA, 19 nt, Homo sapiens
gaaggaugaaggcagcuau

SEQ ID NO: 451680 - RNA, 19 nt, Homo sapiens
ugaaggggauggugggaua

SEQ ID NO: 451681 - RNA, 19 nt, Homo sapiens
caucgugggcauccucuuu

SEQ ID NO: 451682 - RNA, 19 nt, Homo sapiens
uguugucuguuacugauuu

SEQ ID NO: 451683 - RNA, 19 nt, Homo sapiens
gguccuggcagcucugauu

SEQ ID NO: 451684 - RNA, 19 nt, Homo sapiens
gaagagagugaggaugugu

SEQ ID NO: 451685 - RNA, 19 nt, Homo sapiens
aauaaaaccugguacuuuc

SEQ ID NO: 451686 - RNA, 19 nt, Homo sapiens
cucacacuguugucuguua

SEQ ID NO: 451687 - RNA, 19 nt, Homo sapiens
aaacuggcuuaacgaguca

SEQ ID NO: 451688 - RNA, 19 nt, Homo sapiens
acaugcggcuguuuaaagu

SEQ ID NO: 451689 - RNA, 19 nt, Homo sapiens
gauggugggauauuugugu

SEQ ID NO: 451690 - RNA, 19 nt, Homo sapiens
gagagaagagccggagaga

SEQ ID NO: 451691 - RNA, 19 nt, Homo sapiens
gaguuuaugcugaaaugga

SEQ ID NO: 451692 - RNA, 19 nt, Homo sapiens
gcgagagcauguccaucug

SEQ ID NO: 451693 - RNA, 19 nt, Homo sapiens
agugugguguuuccaguuu

SEQ ID NO: 451694 - RNA, 19 nt, Homo sapiens
uaacuguucauuccuuugu

SEQ ID NO: 451695 - RNA, 19 nt, Homo sapiens
gaaggcaagacugggauug

SEQ ID NO: 451696 - RNA, 19 nt, Homo sapiens
gaaacuagaggagaaugag

SEQ ID NO: 451697 - RNA, 19 nt, Homo sapiens
gguguucuuugguuugcuu

SEQ ID NO: 451698 - RNA, 19 nt, Homo sapiens
ccaccgaacccaagaaacu

SEQ ID NO: 451699 - RNA, 19 nt, Homo sapiens
gagcuuugggccucaguug

SEQ ID NO: 451700 - RNA, 19 nt, Homo sapiens
guaucuccagcucugauua

SEQ ID NO: 451701 - RNA, 19 nt, Homo sapiens
uagaggagaaugagguuau

SEQ ID NO: 451702 - RNA, 19 nt, Homo sapiens
uuuagcagaucccaaaaua

SEQ ID NO: 451703 - RNA, 19 nt, Homo sapiens
aagaaacccaucuacaaga

SEQ ID NO: 451704 - RNA, 19 nt, Homo sapiens
gcucuggagaucuggauga

SEQ ID NO: 451705 - RNA, 19 nt, Homo sapiens
auucuaggcucuuucaagu

SEQ ID NO: 451706 - RNA, 19 nt, Homo sapiens
uggaucacuucuuaaacuu

SEQ ID NO: 451707 - RNA, 19 nt, Homo sapiens
cagcaacaucuuugagaga

SEQ ID NO: 451708 - RNA, 19 nt, Homo sapiens
agagaacuaaacuggcuua

SEQ ID NO: 451709 - RNA, 19 nt, Homo sapiens
caguugcacuaaccacguu

SEQ ID NO: 451710 - RNA, 19 nt, Homo sapiens
ccacaugcggcuguuuaaa

SEQ ID NO: 451711 - RNA, 19 nt, Homo sapiens
aaccacaugcggcuguuua

SEQ ID NO: 451712 - RNA, 19 nt, Homo sapiens
ggaugguucuacccuuucu

SEQ ID NO: 451713 - RNA, 19 nt, Homo sapiens
gugguugagugagugaauu

SEQ ID NO: 451714 - RNA, 19 nt, Homo sapiens
cuccagcucugauuaccuu

SEQ ID NO: 451715 - RNA, 19 nt, Homo sapiens
agaucuggaugacuuggaa

SEQ ID NO: 451716 - RNA, 19 nt, Homo sapiens
cuagggcugugcuauccaa

SEQ ID NO: 451717 - RNA, 19 nt, Homo sapiens
uggaauaguugagguggau

SEQ ID NO: 451718 - RNA, 19 nt, Homo sapiens
gauauuugugucuguguuc

SEQ ID NO: 451719 - RNA, 19 nt, Homo sapiens
gaagagccggagagaugau

SEQ ID NO: 451720 - RNA, 19 nt, Homo sapiens
ugaagagagugaggaugug

SEQ ID NO: 451721 - RNA, 19 nt, Homo sapiens
gggccauucuaggcucuuu

SEQ ID NO: 451722 - RNA, 19 nt, Homo sapiens
gaacauaacaucugugaaa

SEQ ID NO: 451723 - RNA, 19 nt, Homo sapiens
gaguagugcugucauauua

SEQ ID NO: 451724 - RNA, 19 nt, Homo sapiens
gcaagaccuuccaguauaa

SEQ ID NO: 451725 - RNA, 19 nt, Homo sapiens
uaagaacacugguuucauu

SEQ ID NO: 451726 - RNA, 19 nt, Homo sapiens
gaagguagacaaaguaauu

SEQ ID NO: 451727 - RNA, 19 nt, Homo sapiens
gcauuugacucuuaagauu

SEQ ID NO: 451728 - RNA, 19 nt, Homo sapiens
caagagauuuacugacuuu

SEQ ID NO: 451729 - RNA, 19 nt, Homo sapiens
uagcauacuugcaucuuua

SEQ ID NO: 451730 - RNA, 19 nt, Homo sapiens
ccagaacaguuuaauggua

SEQ ID NO: 451731 - RNA, 19 nt, Homo sapiens
uaacauccauagugaaaga

SEQ ID NO: 451732 - RNA, 19 nt, Homo sapiens
ggauagcacuggacauguu

SEQ ID NO: 451733 - RNA, 19 nt, Homo sapiens
gaaggacucucaaauugca

SEQ ID NO: 451734 - RNA, 19 nt, Homo sapiens
ucugauaacuuguuccuuu

SEQ ID NO: 451735 - RNA, 19 nt, Homo sapiens
guauguagguuucaagaga

SEQ ID NO: 451736 - RNA, 19 nt, Homo sapiens
gagauugugaugauucuua

SEQ ID NO: 451737 - RNA, 19 nt, Homo sapiens
cauaacaucugugaaauca

SEQ ID NO: 451738 - RNA, 19 nt, Homo sapiens
ggauggagcucugauaaag

SEQ ID NO: 451739 - RNA, 19 nt, Homo sapiens
uauguaaccuagcuacuuu

SEQ ID NO: 451740 - RNA, 19 nt, Homo sapiens
ggagagaagauuaccauga

SEQ ID NO: 451741 - RNA, 19 nt, Homo sapiens
gugauuaggaugacuguua

SEQ ID NO: 451742 - RNA, 19 nt, Homo sapiens
ugaaaucaauggacagaau

SEQ ID NO: 451743 - RNA, 19 nt, Homo sapiens
gggauggucuuagaauauu

SEQ ID NO: 451744 - RNA, 19 nt, Homo sapiens
gcacuggacauguugguuu

SEQ ID NO: 451745 - RNA, 19 nt, Homo sapiens
gagagaagauuaccaugac

SEQ ID NO: 451746 - RNA, 19 nt, Homo sapiens
ggacgauuaccaugcauaa

SEQ ID NO: 451747 - RNA, 19 nt, Homo sapiens
ggacucaggcuuaaaucaa

SEQ ID NO: 451748 - RNA, 19 nt, Homo sapiens
agcaagaccuuccaguaua

SEQ ID NO: 451749 - RNA, 19 nt, Homo sapiens
gggcugaguuuaaaugaag

SEQ ID NO: 451750 - RNA, 19 nt, Homo sapiens
gaacacugguuucauucca

SEQ ID NO: 451751 - RNA, 19 nt, Homo sapiens
gaacugucgccuuaacuau

SEQ ID NO: 451752 - RNA, 19 nt, Homo sapiens
gaacgucuccaguuuccuu

SEQ ID NO: 451753 - RNA, 19 nt, Homo sapiens
caauuaagaacacugguuu

SEQ ID NO: 451754 - RNA, 19 nt, Homo sapiens
ugacuuuccuagaauaguu

SEQ ID NO: 451755 - RNA, 19 nt, Homo sapiens
guagcaagaccuuccagua

SEQ ID NO: 451756 - RNA, 19 nt, Homo sapiens
gaaugauugccuuugauuu

SEQ ID NO: 451757 - RNA, 19 nt, Homo sapiens
uauaagccauugugauuag

SEQ ID NO: 451758 - RNA, 19 nt, Homo sapiens
gcaagggauucgugaaguc

SEQ ID NO: 451759 - RNA, 19 nt, Homo sapiens
gaaauuaagcaagggauuc

SEQ ID NO: 451760 - RNA, 19 nt, Homo sapiens
gcauuaaacaguguaugua

SEQ ID NO: 451761 - RNA, 19 nt, Homo sapiens
uuagaaugauugccuuuga

SEQ ID NO: 451762 - RNA, 19 nt, Homo sapiens
gaaaccugaugcuuuuaua

SEQ ID NO: 451763 - RNA, 19 nt, Homo sapiens
gaagaagaaauacgugcaa

SEQ ID NO: 451764 - RNA, 19 nt, Homo sapiens
ggauggucuuagaauauuu

SEQ ID NO: 451765 - RNA, 19 nt, Homo sapiens
guaaggaucaagauggaaa

SEQ ID NO: 451766 - RNA, 19 nt, Homo sapiens
cauagcugcuuaguuguuu

SEQ ID NO: 451767 - RNA, 19 nt, Homo sapiens
gaaaucaauggacagaaug

SEQ ID NO: 451768 - RNA, 19 nt, Homo sapiens
gcuagaagaauccugcaaa

SEQ ID NO: 451769 - RNA, 19 nt, Homo sapiens
cuauuaaccugaaauguac

SEQ ID NO: 451770 - RNA, 19 nt, Homo sapiens
uuacaaucaugccugcuuu

SEQ ID NO: 451771 - RNA, 19 nt, Homo sapiens
gugcugucauauuacuuua

SEQ ID NO: 451772 - RNA, 19 nt, Homo sapiens
gcaccaagcauuaugaaaa

SEQ ID NO: 451773 - RNA, 19 nt, Homo sapiens
gcaggauggagcucugaua

SEQ ID NO: 451774 - RNA, 19 nt, Homo sapiens
ccauggaaauguagcugaa

SEQ ID NO: 451775 - RNA, 19 nt, Homo sapiens
caccauuccugagguuuaa

SEQ ID NO: 451776 - RNA, 19 nt, Homo sapiens
ccaaguacuucagaucaau

SEQ ID NO: 451777 - RNA, 19 nt, Homo sapiens
gacucaggcuuaaaucaau

SEQ ID NO: 451778 - RNA, 19 nt, Homo sapiens
uagcaagaccuuccaguau

SEQ ID NO: 451779 - RNA, 19 nt, Homo sapiens
gcauagcugcuuaguuguu

SEQ ID NO: 451780 - RNA, 19 nt, Homo sapiens
uguuaagcaucuagacuaa

SEQ ID NO: 451781 - RNA, 19 nt, Homo sapiens
caagagauugugaugauuc

SEQ ID NO: 451782 - RNA, 19 nt, Homo sapiens
caaaguaauucaggcucaa

SEQ ID NO: 451783 - RNA, 19 nt, Homo sapiens
uuacugacuuuccuagaau

SEQ ID NO: 451784 - RNA, 19 nt, Homo sapiens
guucauuuguggauuaagu

SEQ ID NO: 451785 - RNA, 19 nt, Homo sapiens
aauuauugcugccuuucua

SEQ ID NO: 451786 - RNA, 19 nt, Homo sapiens
gcugucauauuacuuuagu

SEQ ID NO: 451787 - RNA, 19 nt, Homo sapiens
aaauuggacucaggcuuaa

SEQ ID NO: 451788 - RNA, 19 nt, Homo sapiens
guaaugauguuggaauucg

SEQ ID NO: 451789 - RNA, 19 nt, Homo sapiens
ugcuugaacugucgccuua

SEQ ID NO: 451790 - RNA, 19 nt, Homo sapiens
aauaguuucucuacuggaa

SEQ ID NO: 451791 - RNA, 19 nt, Homo sapiens
ucaagagauuuacugacuu

SEQ ID NO: 451792 - RNA, 19 nt, Homo sapiens
ccacaccauuccugagguu

SEQ ID NO: 451793 - RNA, 19 nt, Homo sapiens
cgauuaccaugcauaagga

SEQ ID NO: 451794 - RNA, 19 nt, Homo sapiens
caggauggagcucugauaa

SEQ ID NO: 451795 - RNA, 19 nt, Homo sapiens
gaccaaguacuucagauca

SEQ ID NO: 451796 - RNA, 19 nt, Homo sapiens
gcccagaacaguuuaaugg

SEQ ID NO: 451797 - RNA, 19 nt, Homo sapiens
ucaagagauugugaugauu

SEQ ID NO: 451798 - RNA, 19 nt, Homo sapiens
gaagauuaccaugaccauu

SEQ ID NO: 451799 - RNA, 19 nt, Homo sapiens
cggauggcaccaagcauua

SEQ ID NO: 451800 - RNA, 19 nt, Homo sapiens
acucaggcuuaaaucaaua

SEQ ID NO: 451801 - RNA, 19 nt, Homo sapiens
gaccuuccaguauaaacua

SEQ ID NO: 451802 - RNA, 19 nt, Homo sapiens
cauguaagcauuaaacagu

SEQ ID NO: 451803 - RNA, 19 nt, Homo sapiens
gcggauggcaccaagcauu

SEQ ID NO: 451804 - RNA, 19 nt, Homo sapiens
ggucuucucacggaacaua

SEQ ID NO: 451805 - RNA, 19 nt, Homo sapiens
gaucaauggugaaaacugu

SEQ ID NO: 451806 - RNA, 19 nt, Homo sapiens
ggaauucguagagcagaaa

SEQ ID NO: 451807 - RNA, 19 nt, Homo sapiens
caacacauaauggaaacuu

SEQ ID NO: 451808 - RNA, 19 nt, Homo sapiens
guagugcugucauauuacu

SEQ ID NO: 451809 - RNA, 19 nt, Homo sapiens
gcgcaccgcucucuuacac

SEQ ID NO: 451810 - RNA, 19 nt, Homo sapiens
aggcuuagcuuugugugaa

SEQ ID NO: 451811 - RNA, 19 nt, Homo sapiens
guguaaggaucaagaugga

SEQ ID NO: 451812 - RNA, 19 nt, Homo sapiens
uaugguggcuccuguaacu

SEQ ID NO: 451813 - RNA, 19 nt, Homo sapiens
gcaaacaaaaugauaguug

SEQ ID NO: 451814 - RNA, 19 nt, Homo sapiens
guuacaggcuuagcuuugu

SEQ ID NO: 451815 - RNA, 19 nt, Homo sapiens
uuuacugacuuuccuagaa

SEQ ID NO: 451816 - RNA, 19 nt, Homo sapiens
ucgaagacuugaagguaga

SEQ ID NO: 451817 - RNA, 19 nt, Homo sapiens
guuuaaugguacuuacuga

SEQ ID NO: 451818 - RNA, 19 nt, Homo sapiens
aaccugaaauguacacuag

SEQ ID NO: 451819 - RNA, 19 nt, Homo sapiens
ugaacugucgccuuaacua

SEQ ID NO: 451820 - RNA, 19 nt, Homo sapiens
uagaaugauugccuuugau

SEQ ID NO: 451821 - RNA, 19 nt, Homo sapiens
ggaucuuacucuuucaucu

SEQ ID NO: 451822 - RNA, 19 nt, Homo sapiens
gaccaaagcuuucauguaa

SEQ ID NO: 451823 - RNA, 19 nt, Homo sapiens
ggagaaagcuuuaaacaag

SEQ ID NO: 451824 - RNA, 19 nt, Homo sapiens
gaaauuaaccucucacuau

SEQ ID NO: 451825 - RNA, 19 nt, Homo sapiens
gagauuaccuccugagaaa

SEQ ID NO: 451826 - RNA, 19 nt, Homo sapiens
ggaaguaggaaguaaauua

SEQ ID NO: 451827 - RNA, 19 nt, Homo sapiens
uaaaguggauucaggagua

SEQ ID NO: 451828 - RNA, 19 nt, Homo sapiens
gaaccaagaccauugaauu

SEQ ID NO: 451829 - RNA, 19 nt, Homo sapiens
aaacaaacaugacccuaaa

SEQ ID NO: 451830 - RNA, 19 nt, Homo sapiens
gaaacaaacaugacccuaa

SEQ ID NO: 451831 - RNA, 19 nt, Homo sapiens
ugagggaucuuuacuaguu

SEQ ID NO: 451832 - RNA, 19 nt, Homo sapiens
agaaacaacucuuugagaa

SEQ ID NO: 451833 - RNA, 19 nt, Homo sapiens
gagaaagcuuuaaacaaga

SEQ ID NO: 451834 - RNA, 19 nt, Homo sapiens
gcacucugcuuguuauuag

SEQ ID NO: 451835 - RNA, 19 nt, Homo sapiens
gaaacaacucuuugagaaa

SEQ ID NO: 451836 - RNA, 19 nt, Homo sapiens
caaccucgcuggacucuca

SEQ ID NO: 451837 - RNA, 19 nt, Homo sapiens
aaacaagcauucacaacuu

SEQ ID NO: 451838 - RNA, 19 nt, Homo sapiens
guacuugccuuauuagagu

SEQ ID NO: 451839 - RNA, 19 nt, Homo sapiens
gcaaggaaacuauguaaca

SEQ ID NO: 451840 - RNA, 19 nt, Homo sapiens
ggaaaagucucuuguaauc

SEQ ID NO: 451841 - RNA, 19 nt, Homo sapiens
caucuaaccucaucuucuu

SEQ ID NO: 451842 - RNA, 19 nt, Homo sapiens
ggaccaaagcuuucaugua

SEQ ID NO: 451843 - RNA, 19 nt, Homo sapiens
cauaacaauuccucuacua

SEQ ID NO: 451844 - RNA, 19 nt, Homo sapiens
ccacaggacauuucucuaa

SEQ ID NO: 451845 - RNA, 19 nt, Homo sapiens
gcaccaagcaggaaaugaa

SEQ ID NO: 451846 - RNA, 19 nt, Homo sapiens
gcauuuaaauacagucuuc

SEQ ID NO: 451847 - RNA, 19 nt, Homo sapiens
gagggaucuuuacuaguua

SEQ ID NO: 451848 - RNA, 19 nt, Homo sapiens
cgauagagcuguauuaagc

SEQ ID NO: 451849 - RNA, 19 nt, Homo sapiens
gaacaacaacagacaagug

SEQ ID NO: 451850 - RNA, 19 nt, Homo sapiens
gaauuugagugcucugauc

SEQ ID NO: 451851 - RNA, 19 nt, Homo sapiens
ccagcuauguuauauugaa

SEQ ID NO: 451852 - RNA, 19 nt, Homo sapiens
agaacaaugugcuauguga

SEQ ID NO: 451853 - RNA, 19 nt, Homo sapiens
gaaauauucccuagaaacu

SEQ ID NO: 451854 - RNA, 19 nt, Homo sapiens
gcuaaagcaauaugcauuu

SEQ ID NO: 451855 - RNA, 19 nt, Homo sapiens
gcauugacccgaagcuaaa

SEQ ID NO: 451856 - RNA, 19 nt, Homo sapiens
gucaguaccuucaaacuag

SEQ ID NO: 451857 - RNA, 19 nt, Homo sapiens
gaucagagccgugguccuu

SEQ ID NO: 451858 - RNA, 19 nt, Homo sapiens
aacaagagguucaagaugu

SEQ ID NO: 451859 - RNA, 19 nt, Homo sapiens
cuaagcagaccacugauaa

SEQ ID NO: 451860 - RNA, 19 nt, Homo sapiens
aaacaugacccuaaaucuu

SEQ ID NO: 451861 - RNA, 19 nt, Homo sapiens
caaccugccugacauuugg

SEQ ID NO: 451862 - RNA, 19 nt, Homo sapiens
uaaaaucugucacguagaa

SEQ ID NO: 451863 - RNA, 19 nt, Homo sapiens
cuaauaaaguucuguacuc

SEQ ID NO: 451864 - RNA, 19 nt, Homo sapiens
gauucaguguuaaauguga

SEQ ID NO: 451865 - RNA, 19 nt, Homo sapiens
aguagaaacugcagggaaa

SEQ ID NO: 451866 - RNA, 19 nt, Homo sapiens
ggaaucauuucuauuucuc

SEQ ID NO: 451867 - RNA, 19 nt, Homo sapiens
ucucaacacuccaaacugu

SEQ ID NO: 451868 - RNA, 19 nt, Homo sapiens
caauccagcuauguuauau

SEQ ID NO: 451869 - RNA, 19 nt, Homo sapiens
ugucuuguguggaauauug

SEQ ID NO: 451870 - RNA, 19 nt, Homo sapiens
ccaaagcuuucauguaaac

SEQ ID NO: 451871 - RNA, 19 nt, Homo sapiens
gaagaacaacaacagacaa

SEQ ID NO: 451872 - RNA, 19 nt, Homo sapiens
aaacugugcccuucagauu

SEQ ID NO: 451873 - RNA, 19 nt, Homo sapiens
gcagaaggcaaacccauca

SEQ ID NO: 451874 - RNA, 19 nt, Homo sapiens
aaaguucuguacucaaaug

SEQ ID NO: 451875 - RNA, 19 nt, Homo sapiens
aaacaacucuuugagaaac

SEQ ID NO: 451876 - RNA, 19 nt, Homo sapiens
gaaacugcagggaaaauua

SEQ ID NO: 451877 - RNA, 19 nt, Homo sapiens
gauacagaacucuuucaaa

SEQ ID NO: 451878 - RNA, 19 nt, Homo sapiens
gaacaaugugcuaugugaa

SEQ ID NO: 451879 - RNA, 19 nt, Homo sapiens
gacuaaggccauuauugua

SEQ ID NO: 451880 - RNA, 19 nt, Homo sapiens
ggaagucaaagcaaggaaa

SEQ ID NO: 451881 - RNA, 19 nt, Homo sapiens
caacgucaagcaucucaaa

SEQ ID NO: 451882 - RNA, 19 nt, Homo sapiens
guucuaagucuuuccauug

SEQ ID NO: 451883 - RNA, 19 nt, Homo sapiens
gagggcacucugcuuguua

SEQ ID NO: 451884 - RNA, 19 nt, Homo sapiens
gagccaacgucaagcaucu

SEQ ID NO: 451885 - RNA, 19 nt, Homo sapiens
ccauugaauucuugguuga

SEQ ID NO: 451886 - RNA, 19 nt, Homo sapiens
ugauuaaagacuccaguua

SEQ ID NO: 451887 - RNA, 19 nt, Homo sapiens
uaaccaauccuggacauga

SEQ ID NO: 451888 - RNA, 19 nt, Homo sapiens
ucaauccagcuauguuaua

SEQ ID NO: 451889 - RNA, 19 nt, Homo sapiens
gguaauuaguaacaugugu

SEQ ID NO: 451890 - RNA, 19 nt, Homo sapiens
ucuguaggguaauuaguaa

SEQ ID NO: 451891 - RNA, 19 nt, Homo sapiens
uguaacuguucgugaauuu

SEQ ID NO: 451892 - RNA, 19 nt, Homo sapiens
uaacauguaggaaguagga

SEQ ID NO: 451893 - RNA, 19 nt, Homo sapiens
agacuaaggccauuauugu

SEQ ID NO: 451894 - RNA, 19 nt, Homo sapiens
ggcgacacguagcagcuua

SEQ ID NO: 451895 - RNA, 19 nt, Homo sapiens
cugcccagcuaaagcaaua

SEQ ID NO: 451896 - RNA, 19 nt, Homo sapiens
gacccuaaaucuugacuac

SEQ ID NO: 451897 - RNA, 19 nt, Homo sapiens
cagguaauccaagauauuu

SEQ ID NO: 451898 - RNA, 19 nt, Homo sapiens
ccugagggaucuuuacuag

SEQ ID NO: 451899 - RNA, 19 nt, Homo sapiens
ccucaauccagcuauguua

SEQ ID NO: 451900 - RNA, 19 nt, Homo sapiens
gaaggcaaacccaucaaca

SEQ ID NO: 451901 - RNA, 19 nt, Homo sapiens
ugucuuguguuaccugaaa

SEQ ID NO: 451902 - RNA, 19 nt, Homo sapiens
uaaacaagagguucaagau

SEQ ID NO: 451903 - RNA, 19 nt, Homo sapiens
ccuagaaacuuccaaaucc

SEQ ID NO: 451904 - RNA, 19 nt, Homo sapiens
aauauucccuagaaacuuc

SEQ ID NO: 451905 - RNA, 19 nt, Homo sapiens
gaucgucugacugguguua

SEQ ID NO: 451906 - RNA, 19 nt, Homo sapiens
caacagacaagugugcauu

SEQ ID NO: 451907 - RNA, 19 nt, Homo sapiens
ggcagucgauagagcugua

SEQ ID NO: 451908 - RNA, 19 nt, Homo sapiens
ugugcuaugugaagaguaa

SEQ ID NO: 451909 - RNA, 19 nt, Homo sapiens
ucagagccgugguccuuug

SEQ ID NO: 451910 - RNA, 19 nt, Homo sapiens
guaccuggagaaagcuuua

SEQ ID NO: 451911 - RNA, 19 nt, Homo sapiens
caucagugcucccucacau

SEQ ID NO: 451912 - RNA, 19 nt, Homo sapiens
cauguaaacugugcaccaa

SEQ ID NO: 451913 - RNA, 19 nt, Homo sapiens
gcauaacaauuccucuacu

SEQ ID NO: 451914 - RNA, 19 nt, Homo sapiens
ccagguaauccaagauauu

SEQ ID NO: 451915 - RNA, 19 nt, Homo sapiens
gaaaaugucuuguguuacc

SEQ ID NO: 451916 - RNA, 19 nt, Homo sapiens
ucacguagaacuuggaugu

SEQ ID NO: 451917 - RNA, 19 nt, Homo sapiens
guaacuguucgugaauuua

SEQ ID NO: 451918 - RNA, 19 nt, Homo sapiens
guaggaaguaggaaguaaa

SEQ ID NO: 451919 - RNA, 19 nt, Homo sapiens
ugaggaacccuuacaguag

SEQ ID NO: 451920 - RNA, 19 nt, Homo sapiens
cugaggaacccuuacagua

SEQ ID NO: 451921 - RNA, 19 nt, Homo sapiens
ccagcuggaugagaauuug

SEQ ID NO: 451922 - RNA, 19 nt, Homo sapiens
ccauugagaugaagauaua

SEQ ID NO: 451923 - RNA, 19 nt, Homo sapiens
guagaggacuugcugguaa

SEQ ID NO: 451924 - RNA, 19 nt, Homo sapiens
gcagagcugugaaucuaga

SEQ ID NO: 451925 - RNA, 19 nt, Homo sapiens
gccgaaaccuccauaguca

SEQ ID NO: 451926 - RNA, 19 nt, Homo sapiens
gaaaauaguggcuguguuu

SEQ ID NO: 451927 - RNA, 19 nt, Homo sapiens
caucauggacuguuaaugu

SEQ ID NO: 451928 - RNA, 19 nt, Homo sapiens
ccucuuagcugggaaacuu

SEQ ID NO: 451929 - RNA, 19 nt, Homo sapiens
ccacuucacuucaccucuu

SEQ ID NO: 451930 - RNA, 19 nt, Homo sapiens
ggaaacaucccucuuagcu

SEQ ID NO: 451931 - RNA, 19 nt, Homo sapiens
cuucagcccugcacauuug

SEQ ID NO: 451932 - RNA, 19 nt, Homo sapiens
cagaacaacuacuggaaag

SEQ ID NO: 451933 - RNA, 19 nt, Homo sapiens
gaacaauauggucgaccua

SEQ ID NO: 451934 - RNA, 19 nt, Homo sapiens
ggacuguuaauguauguga

SEQ ID NO: 451935 - RNA, 19 nt, Homo sapiens
ggaaggugaaggugauuau

SEQ ID NO: 451936 - RNA, 19 nt, Homo sapiens
guggugaagcuacucaaua

SEQ ID NO: 451937 - RNA, 19 nt, Homo sapiens
uguaguaccucugcuguug

SEQ ID NO: 451938 - RNA, 19 nt, Homo sapiens
gggcuccgcgauacaguua

SEQ ID NO: 451939 - RNA, 19 nt, Homo sapiens
gagaugaagauauacaaca

SEQ ID NO: 451940 - RNA, 19 nt, Homo sapiens
augcagagcugugaaucua

SEQ ID NO: 451941 - RNA, 19 nt, Homo sapiens
uagaggacuugcugguaaa

SEQ ID NO: 451942 - RNA, 19 nt, Homo sapiens
caauauggucgaccuauca

SEQ ID NO: 451943 - RNA, 19 nt, Homo sapiens
ugaggaaggugaaggugau

SEQ ID NO: 451944 - RNA, 19 nt, Homo sapiens
ugaaggugauuaucuggau

SEQ ID NO: 451945 - RNA, 19 nt, Homo sapiens
gaagcccagugaguuguug

SEQ ID NO: 451946 - RNA, 19 nt, Homo sapiens
uggaugacagcaacaguua

SEQ ID NO: 451947 - RNA, 19 nt, Homo sapiens
ucaaacacucuuccacuga

SEQ ID NO: 451948 - RNA, 19 nt, Homo sapiens
gaggugcgguucaaacacu

SEQ ID NO: 451949 - RNA, 19 nt, Homo sapiens
cauggacuguuaauguaug

SEQ ID NO: 451950 - RNA, 19 nt, Homo sapiens
ucagaacaacuacuggaaa

SEQ ID NO: 451951 - RNA, 19 nt, Homo sapiens
gcccugcacauuugaacua

SEQ ID NO: 451952 - RNA, 19 nt, Homo sapiens
aauaguggcuguguuugga

SEQ ID NO: 451953 - RNA, 19 nt, Homo sapiens
ugucacaggagaacaauau

SEQ ID NO: 451954 - RNA, 19 nt, Homo sapiens
gggaagagugccacagugu

SEQ ID NO: 451955 - RNA, 19 nt, Homo sapiens
aucauggacuguuaaugua

SEQ ID NO: 451956 - RNA, 19 nt, Homo sapiens
gaugaagauauacaacaga

SEQ ID NO: 451957 - RNA, 19 nt, Homo sapiens
cauuugaacuagucacucu

SEQ ID NO: 451958 - RNA, 19 nt, Homo sapiens
caagucagaacaacuacug

SEQ ID NO: 451959 - RNA, 19 nt, Homo sapiens
uaggauggcuguaguaccu

SEQ ID NO: 451960 - RNA, 19 nt, Homo sapiens
ggccaugucaccauugaga

SEQ ID NO: 451961 - RNA, 19 nt, Homo sapiens
uaguaccucugcuguuguu

SEQ ID NO: 451962 - RNA, 19 nt, Homo sapiens
caugaagcccagugaguug

SEQ ID NO: 451963 - RNA, 19 nt, Homo sapiens
ggccgaaaccuccauaguc

SEQ ID NO: 451964 - RNA, 19 nt, Homo sapiens
uggugaagcuacucaauac

SEQ ID NO: 451965 - RNA, 19 nt, Homo sapiens
ggcagaagcccaccaugca

SEQ ID NO: 451966 - RNA, 19 nt, Homo sapiens
gagguacugcugucuguca

SEQ ID NO: 451967 - RNA, 19 nt, Homo sapiens
ugucaacacuggccgaaac

SEQ ID NO: 451968 - RNA, 19 nt, Homo sapiens
ucaggagcuuggcaucaug

SEQ ID NO: 451969 - RNA, 19 nt, Homo sapiens
gaaggcagaagcccaccau

SEQ ID NO: 451970 - RNA, 19 nt, Homo sapiens
acaauauggucgaccuauc

SEQ ID NO: 451971 - RNA, 19 nt, Homo sapiens
ccauccggcugacacaugu

SEQ ID NO: 451972 - RNA, 19 nt, Homo sapiens
uugcgugggucaguucuuu

SEQ ID NO: 451973 - RNA, 19 nt, Homo sapiens
guggccaugucaccauuga

SEQ ID NO: 451974 - RNA, 19 nt, Homo sapiens
guagugggcagcagucagu

SEQ ID NO: 451975 - RNA, 19 nt, Homo sapiens
ucaugaagcccagugaguu

SEQ ID NO: 451976 - RNA, 19 nt, Homo sapiens
gcuucagcccugcacauuu

SEQ ID NO: 451977 - RNA, 19 nt, Homo sapiens
uaaaacaaacugagggaaa

SEQ ID NO: 451978 - RNA, 19 nt, Homo sapiens
agacuugcgugggucaguu

SEQ ID NO: 451979 - RNA, 19 nt, Homo sapiens
agaugaagauauacaacag

SEQ ID NO: 451980 - RNA, 19 nt, Homo sapiens
ugggaucccugccacaagu

SEQ ID NO: 451981 - RNA, 19 nt, Homo sapiens
gaugacagcaacaguuacu

SEQ ID NO: 451982 - RNA, 19 nt, Homo sapiens
gccugggugucguuacuug

SEQ ID NO: 451983 - RNA, 19 nt, Homo sapiens
guggaugacagcaacaguu

SEQ ID NO: 451984 - RNA, 19 nt, Homo sapiens
caguggccaugucaccauu

SEQ ID NO: 451985 - RNA, 19 nt, Homo sapiens
gaaggugaaggugauuauc

SEQ ID NO: 451986 - RNA, 19 nt, Homo sapiens
cacuucacuucaccucuuu

SEQ ID NO: 451987 - RNA, 19 nt, Homo sapiens
ggaagugagugcuuuuggu

SEQ ID NO: 451988 - RNA, 19 nt, Homo sapiens
cauagucaccacuucacuu

SEQ ID NO: 451989 - RNA, 19 nt, Homo sapiens
gcaguggccaugucaccau

SEQ ID NO: 451990 - RNA, 19 nt, Homo sapiens
cgaccuaucagugggcaaa

SEQ ID NO: 451991 - RNA, 19 nt, Homo sapiens
cugcacauuugaacuaguc

SEQ ID NO: 451992 - RNA, 19 nt, Homo sapiens
ucaauacgcgccacaacgu

SEQ ID NO: 451993 - RNA, 19 nt, Homo sapiens
gggaaacuuuuacucuuca

SEQ ID NO: 451994 - RNA, 19 nt, Homo sapiens
ccaugucaccauugagaug

SEQ ID NO: 451995 - RNA, 19 nt, Homo sapiens
cgcacaauguucacagaca

SEQ ID NO: 451996 - RNA, 19 nt, Homo sapiens
caguuaggauggcuguagu

SEQ ID NO: 451997 - RNA, 19 nt, Homo sapiens
cugagguacugcugucugu

SEQ ID NO: 451998 - RNA, 19 nt, Homo sapiens
gggcacagcucuuaaauaa

SEQ ID NO: 451999 - RNA, 19 nt, Homo sapiens
gauaaagucccuccaauua

SEQ ID NO: 452000 - RNA, 19 nt, Homo sapiens
ggaagaaucugucaugaau

SEQ ID NO: 452001 - RNA, 19 nt, Homo sapiens
gcaagaagguugugggaaa

SEQ ID NO: 452002 - RNA, 19 nt, Homo sapiens
ggacagagccucaaguuug

SEQ ID NO: 452003 - RNA, 19 nt, Homo sapiens
uauaauagcucaugcaugu

SEQ ID NO: 452004 - RNA, 19 nt, Homo sapiens
uaaagucccuccaauuaaa

SEQ ID NO: 452005 - RNA, 19 nt, Homo sapiens
gcacagcucuuaaauaaaa

SEQ ID NO: 452006 - RNA, 19 nt, Homo sapiens
ggaagaaggaguacauuga

SEQ ID NO: 452007 - RNA, 19 nt, Homo sapiens
gagggcaucugcuaaaguu

SEQ ID NO: 452008 - RNA, 19 nt, Homo sapiens
gagggaggcauucucauua

SEQ ID NO: 452009 - RNA, 19 nt, Homo sapiens
gaagaaggaguacauugaa

SEQ ID NO: 452010 - RNA, 19 nt, Homo sapiens
gauaugauaccagcuauuu

SEQ ID NO: 452011 - RNA, 19 nt, Homo sapiens
cgaaggaccuggcgucuag

SEQ ID NO: 452012 - RNA, 19 nt, Homo sapiens
gagauaaagucccuccaau

SEQ ID NO: 452013 - RNA, 19 nt, Homo sapiens
aguaguggaucaugaauuu

SEQ ID NO: 452014 - RNA, 19 nt, Homo sapiens
ugagaaagaucacgucuac

SEQ ID NO: 452015 - RNA, 19 nt, Homo sapiens
ggugcugguugucucauua

SEQ ID NO: 452016 - RNA, 19 nt, Homo sapiens
gagcguggcacuuaccuuu

SEQ ID NO: 452017 - RNA, 19 nt, Homo sapiens
gcacgugaauggccaggau

SEQ ID NO: 452018 - RNA, 19 nt, Homo sapiens
aaacugggcacagcucuua

SEQ ID NO: 452019 - RNA, 19 nt, Homo sapiens
gacggucucugcgauauga

SEQ ID NO: 452020 - RNA, 19 nt, Homo sapiens
gauggaagcauaagaacau

SEQ ID NO: 452021 - RNA, 19 nt, Homo sapiens
gacagagccucaaguuugg

SEQ ID NO: 452022 - RNA, 19 nt, Homo sapiens
ggaagcguguugcaagaag

SEQ ID NO: 452023 - RNA, 19 nt, Homo sapiens
aaagguuuauggagcgaua

SEQ ID NO: 452024 - RNA, 19 nt, Homo sapiens
gaagaugggaagauuuauc

SEQ ID NO: 452025 - RNA, 19 nt, Homo sapiens
caugaaucuugacaaauug

SEQ ID NO: 452026 - RNA, 19 nt, Homo sapiens
gaaucugucaugaaucuug

SEQ ID NO: 452027 - RNA, 19 nt, Homo sapiens
guccauccaucgcauaaga

SEQ ID NO: 452028 - RNA, 19 nt, Homo sapiens
ggagugccguggugucauc

SEQ ID NO: 452029 - RNA, 19 nt, Homo sapiens
ggacuggccacucgcuauu

SEQ ID NO: 452030 - RNA, 19 nt, Homo sapiens
cugaagaugggaagauuua

SEQ ID NO: 452031 - RNA, 19 nt, Homo sapiens
gggaagaaucugucaugaa

SEQ ID NO: 452032 - RNA, 19 nt, Homo sapiens
gaacugaagaugggaagau

SEQ ID NO: 452033 - RNA, 19 nt, Homo sapiens
ggagguggcauuucuacga

SEQ ID NO: 452034 - RNA, 19 nt, Homo sapiens
gaccuggcgucuagagaug

SEQ ID NO: 452035 - RNA, 19 nt, Homo sapiens
caacagaagaagcccuuug

SEQ ID NO: 452036 - RNA, 19 nt, Homo sapiens
gcugauggaagcauaagaa

SEQ ID NO: 452037 - RNA, 19 nt, Homo sapiens
aagaaucugucaugaaucu

SEQ ID NO: 452038 - RNA, 19 nt, Homo sapiens
cugcuaaaguuucagauuc

SEQ ID NO: 452039 - RNA, 19 nt, Homo sapiens
auaaagucccuccaauuaa

SEQ ID NO: 452040 - RNA, 19 nt, Homo sapiens
gggaagaaggaguacauug

SEQ ID NO: 452041 - RNA, 19 nt, Homo sapiens
ggaccugguugucuuuggu

SEQ ID NO: 452042 - RNA, 19 nt, Homo sapiens
ggagauccgagaaggaaga

SEQ ID NO: 452043 - RNA, 19 nt, Homo sapiens
agggaggcauucucauuaa

SEQ ID NO: 452044 - RNA, 19 nt, Homo sapiens
ggcaugccguuuagcagaa

SEQ ID NO: 452045 - RNA, 19 nt, Homo sapiens
gaauggccaggaucagauu

SEQ ID NO: 452046 - RNA, 19 nt, Homo sapiens
gcgauaugauaccagcuau

SEQ ID NO: 452047 - RNA, 19 nt, Homo sapiens
gcguggcacuuaccuuugu

SEQ ID NO: 452048 - RNA, 19 nt, Homo sapiens
augcaggccuggagauaaa

SEQ ID NO: 452049 - RNA, 19 nt, Homo sapiens
caccgugcauuauaacaug

SEQ ID NO: 452050 - RNA, 19 nt, Homo sapiens
gcuauuuuguggaguauuu

SEQ ID NO: 452051 - RNA, 19 nt, Homo sapiens
gcuauugcacaccuuauau

SEQ ID NO: 452052 - RNA, 19 nt, Homo sapiens
gcuguggcccugagaaaga

SEQ ID NO: 452053 - RNA, 19 nt, Homo sapiens
ggaccuggcgucuagagau

SEQ ID NO: 452054 - RNA, 19 nt, Homo sapiens
aauuauggcaugccguuua

SEQ ID NO: 452055 - RNA, 19 nt, Homo sapiens
gucccuugcuucauucuug

SEQ ID NO: 452056 - RNA, 19 nt, Homo sapiens
agauaaagucccuccaauu

SEQ ID NO: 452057 - RNA, 19 nt, Homo sapiens
agucaaggcgaaagguuua

SEQ ID NO: 452058 - RNA, 19 nt, Homo sapiens
gcauucucauuaacaguca

SEQ ID NO: 452059 - RNA, 19 nt, Homo sapiens
ggaggcauucucauuaaca

SEQ ID NO: 452060 - RNA, 19 nt, Homo sapiens
cagcauguguuaccaagcu

SEQ ID NO: 452061 - RNA, 19 nt, Homo sapiens
gggcaucugcuaaaguuuc

SEQ ID NO: 452062 - RNA, 19 nt, Homo sapiens
cgacucagcaugcagaagu

SEQ ID NO: 452063 - RNA, 19 nt, Homo sapiens
gaacauggaggaggacaac

SEQ ID NO: 452064 - RNA, 19 nt, Homo sapiens
uaauagcucaugcaugugu

SEQ ID NO: 452065 - RNA, 19 nt, Homo sapiens
ggcaucugcuaaaguuuca

SEQ ID NO: 452066 - RNA, 19 nt, Homo sapiens
ccuuggaucuccugaugga

SEQ ID NO: 452067 - RNA, 19 nt, Homo sapiens
aaaucaugcugccguguuc

SEQ ID NO: 452068 - RNA, 19 nt, Homo sapiens
aaucugucaugaaucuuga

SEQ ID NO: 452069 - RNA, 19 nt, Homo sapiens
gggcaaacucgcucuugga

SEQ ID NO: 452070 - RNA, 19 nt, Homo sapiens
agagggaggcauucucauu

SEQ ID NO: 452071 - RNA, 19 nt, Homo sapiens
gacagaaucagcuuuugua

SEQ ID NO: 452072 - RNA, 19 nt, Homo sapiens
cuacugaugagacaagaug

SEQ ID NO: 452073 - RNA, 19 nt, Homo sapiens
caagaagguugugggaaaa

SEQ ID NO: 452074 - RNA, 19 nt, Homo sapiens
gaagaaucugucaugaauc

SEQ ID NO: 452075 - RNA, 19 nt, Homo sapiens
uaguggaucaugaauuuga

SEQ ID NO: 452076 - RNA, 19 nt, Homo sapiens
cuuugucccuugcuucauu

SEQ ID NO: 452077 - RNA, 19 nt, Homo sapiens
uggucgagcuagaaaauua

SEQ ID NO: 452078 - RNA, 19 nt, Homo sapiens
ugggaagcguguugcaaga

SEQ ID NO: 452079 - RNA, 19 nt, Homo sapiens
cauaagaacaucggaacug

SEQ ID NO: 452080 - RNA, 19 nt, Homo sapiens
gaaucuugacaaauugaga

SEQ ID NO: 452081 - RNA, 19 nt, Homo sapiens
cgagcugcauuuggccuuu

SEQ ID NO: 452082 - RNA, 19 nt, Homo sapiens
gagcugcauuuggccuuuc

SEQ ID NO: 452083 - RNA, 19 nt, Homo sapiens
gaggcauucucauuaacag

SEQ ID NO: 452084 - RNA, 19 nt, Homo sapiens
aagaugggaagauuuauca

SEQ ID NO: 452085 - RNA, 19 nt, Homo sapiens
aagaaggaguacauugaag

SEQ ID NO: 452086 - RNA, 19 nt, Homo sapiens
agaagucaaugcaaaauca

SEQ ID NO: 452087 - RNA, 19 nt, Homo sapiens
gcgaaggaccuggcgucua

SEQ ID NO: 452088 - RNA, 19 nt, Homo sapiens
ugccuuggaucuccugaug

SEQ ID NO: 452089 - RNA, 19 nt, Homo sapiens
guggacagagccucaaguu

SEQ ID NO: 452090 - RNA, 19 nt, Homo sapiens
caugcaggccuggagauaa

SEQ ID NO: 452091 - RNA, 19 nt, Homo sapiens
uuccauuucugcucaguau

SEQ ID NO: 452092 - RNA, 19 nt, Homo sapiens
gggaggcauucucauuaac

SEQ ID NO: 452093 - RNA, 19 nt, Homo sapiens
gugaauggccaggaucaga

SEQ ID NO: 452094 - RNA, 19 nt, Homo sapiens
cagucaaggcgaaagguuu

SEQ ID NO: 452095 - RNA, 19 nt, Homo sapiens
gaugacagaaucagcuuuu

SEQ ID NO: 452096 - RNA, 19 nt, Homo sapiens
aacagaagaagcccuuuga

SEQ ID NO: 452097 - RNA, 19 nt, Homo sapiens
gggaagcguguugcaagaa

SEQ ID NO: 452098 - RNA, 19 nt, Homo sapiens
agacaaggcuggagacaaa

SEQ ID NO: 452099 - RNA, 19 nt, Homo sapiens
caagaaauuugccaucuau

SEQ ID NO: 452100 - RNA, 19 nt, Homo sapiens
acaaauccauugagccuua

SEQ ID NO: 452101 - RNA, 19 nt, Homo sapiens
ggaaagcuauugcagagau

SEQ ID NO: 452102 - RNA, 19 nt, Homo sapiens
gguauuggaugcuuuaauc

SEQ ID NO: 452103 - RNA, 19 nt, Homo sapiens
ucaagaaauuugccaucua

SEQ ID NO: 452104 - RNA, 19 nt, Homo sapiens
gaacggagacaaauaucug

SEQ ID NO: 452105 - RNA, 19 nt, Homo sapiens
gccuaucgcuggaugauug

SEQ ID NO: 452106 - RNA, 19 nt, Homo sapiens
caacuucuaugcacaguac

SEQ ID NO: 452107 - RNA, 19 nt, Homo sapiens
ccauugagccuuauuugaa

SEQ ID NO: 452108 - RNA, 19 nt, Homo sapiens
aaccucauaugcagacuua

SEQ ID NO: 452109 - RNA, 19 nt, Homo sapiens
gaagaagaaggaugaaucu

SEQ ID NO: 452110 - RNA, 19 nt, Homo sapiens
gaaggcaucuguggcucuu

SEQ ID NO: 452111 - RNA, 19 nt, Homo sapiens
gaaugaaguugacucuacu

SEQ ID NO: 452112 - RNA, 19 nt, Homo sapiens
gaaauuugccaucuaucga

SEQ ID NO: 452113 - RNA, 19 nt, Homo sapiens
gcacaguacaaauccauug

SEQ ID NO: 452114 - RNA, 19 nt, Homo sapiens
caaccuauaaggagaagaa

SEQ ID NO: 452115 - RNA, 19 nt, Homo sapiens
agaaugaaguugacucuac

SEQ ID NO: 452116 - RNA, 19 nt, Homo sapiens
ccucauaugcagacuuaua

SEQ ID NO: 452117 - RNA, 19 nt, Homo sapiens
cauagaagagcgugagaaa

SEQ ID NO: 452118 - RNA, 19 nt, Homo sapiens
gcagagaucaagaaaauga

SEQ ID NO: 452119 - RNA, 19 nt, Homo sapiens
gaaagcuauugcagagauc

SEQ ID NO: 452120 - RNA, 19 nt, Homo sapiens
gaaggaugaaucucaggaa

SEQ ID NO: 452121 - RNA, 19 nt, Homo sapiens
ggagacaaaccucauaugc

SEQ ID NO: 452122 - RNA, 19 nt, Homo sapiens
gguggaacggagacaaaua

SEQ ID NO: 452123 - RNA, 19 nt, Homo sapiens
uaugcagacuuauaagguu

SEQ ID NO: 452124 - RNA, 19 nt, Homo sapiens
gagacaaaccucauaugca

SEQ ID NO: 452125 - RNA, 19 nt, Homo sapiens
gcaggacccauucucucua

SEQ ID NO: 452126 - RNA, 19 nt, Homo sapiens
uagaagagcgugagaaacu

SEQ ID NO: 452127 - RNA, 19 nt, Homo sapiens
ccgaagaucaugcagagaa

SEQ ID NO: 452128 - RNA, 19 nt, Homo sapiens
caggacccauucucucuau

SEQ ID NO: 452129 - RNA, 19 nt, Homo sapiens
ccagagaugacuucacaga

SEQ ID NO: 452130 - RNA, 19 nt, Homo sapiens
agaagaaggaugaaucuca

SEQ ID NO: 452131 - RNA, 19 nt, Homo sapiens
ugaagaagaaggaugaauc

SEQ ID NO: 452132 - RNA, 19 nt, Homo sapiens
gaucuugguuuuccaugaa

SEQ ID NO: 452133 - RNA, 19 nt, Homo sapiens
cagagcugaacauaauuua

SEQ ID NO: 452134 - RNA, 19 nt, Homo sapiens
gagccuuauuugaagaaga

SEQ ID NO: 452135 - RNA, 19 nt, Homo sapiens
ggaucuuguucccgauuug

SEQ ID NO: 452136 - RNA, 19 nt, Homo sapiens
uuaacuguuuccaugcuaa

SEQ ID NO: 452137 - RNA, 19 nt, Homo sapiens
cuccagagaugacuucaca

SEQ ID NO: 452138 - RNA, 19 nt, Homo sapiens
ggaggcaacacucuagcuu

SEQ ID NO: 452139 - RNA, 19 nt, Homo sapiens
gauuaagaaugaaguugac

SEQ ID NO: 452140 - RNA, 19 nt, Homo sapiens
guggaacggagacaaauau

SEQ ID NO: 452141 - RNA, 19 nt, Homo sapiens
cauugagccuuauuugaag

SEQ ID NO: 452142 - RNA, 19 nt, Homo sapiens
gcuggagacaaaccucaua

SEQ ID NO: 452143 - RNA, 19 nt, Homo sapiens
caugguauuggaugcuuua

SEQ ID NO: 452144 - RNA, 19 nt, Homo sapiens
gauuugagcaacuucuaug

SEQ ID NO: 452145 - RNA, 19 nt, Homo sapiens
cgaagaucaugcagagaag

SEQ ID NO: 452146 - RNA, 19 nt, Homo sapiens
caaauccauugagccuuau

SEQ ID NO: 452147 - RNA, 19 nt, Homo sapiens
caauggaggcaacacucua

SEQ ID NO: 452148 - RNA, 19 nt, Homo sapiens
gaugauugacuccagagau

SEQ ID NO: 452149 - RNA, 19 nt, Homo sapiens
uaucugcaguccauagaag

SEQ ID NO: 452150 - RNA, 19 nt, Homo sapiens
agccuuauuugaagaagaa

SEQ ID NO: 452151 - RNA, 19 nt, Homo sapiens
aaaugauggcaaccuauaa

SEQ ID NO: 452152 - RNA, 19 nt, Homo sapiens
ggaacggagacaaauaucu

SEQ ID NO: 452153 - RNA, 19 nt, Homo sapiens
ggaaggcaagcagcaguau

SEQ ID NO: 452154 - RNA, 19 nt, Homo sapiens
ugaguuccuuuaaagaucu

SEQ ID NO: 452155 - RNA, 19 nt, Homo sapiens
aucaugaacugcacaagga

SEQ ID NO: 452156 - RNA, 19 nt, Homo sapiens
ggacccauucucucuauac

SEQ ID NO: 452157 - RNA, 19 nt, Homo sapiens
gaaacuggacgggcucuac

SEQ ID NO: 452158 - RNA, 19 nt, Homo sapiens
gaucuuguucccgauuuga

SEQ ID NO: 452159 - RNA, 19 nt, Homo sapiens
agaaaaugauggcaaccua

SEQ ID NO: 452160 - RNA, 19 nt, Homo sapiens
uugcagagaucaagaaaau

SEQ ID NO: 452161 - RNA, 19 nt, Homo sapiens
gguugaccuuaauaaaugu

SEQ ID NO: 452162 - RNA, 19 nt, Homo sapiens
augauugacuccagagaug

SEQ ID NO: 452163 - RNA, 19 nt, Homo sapiens
cccgaaggauugacaccaa

SEQ ID NO: 452164 - RNA, 19 nt, Homo sapiens
gcuugcacccgaaggauug

SEQ ID NO: 452165 - RNA, 19 nt, Homo sapiens
ccaugguauuggaugcuuu

SEQ ID NO: 452166 - RNA, 19 nt, Homo sapiens
uaacuguuuccaugcuaaa

SEQ ID NO: 452167 - RNA, 19 nt, Homo sapiens
cucauaugcagacuuauaa

SEQ ID NO: 452168 - RNA, 19 nt, Homo sapiens
gcaacuucuaugcacagua

SEQ ID NO: 452169 - RNA, 19 nt, Homo sapiens
gaauccagggaaagcuauu

SEQ ID NO: 452170 - RNA, 19 nt, Homo sapiens
gaaggcaagcagcaguauc

SEQ ID NO: 452171 - RNA, 19 nt, Homo sapiens
gaaaaugauggcaaccuau

SEQ ID NO: 452172 - RNA, 19 nt, Homo sapiens
aaaaugauggcaaccuaua

SEQ ID NO: 452173 - RNA, 19 nt, Homo sapiens
gggucugaauccagggaaa

SEQ ID NO: 452174 - RNA, 19 nt, Homo sapiens
gccacaccaucaugaacug

SEQ ID NO: 452175 - RNA, 19 nt, Homo sapiens
gacaccaaccucaauaagg

SEQ ID NO: 452176 - RNA, 19 nt, Homo sapiens
uaagaaugaaguugacucu

SEQ ID NO: 452177 - RNA, 19 nt, Homo sapiens
agaagagcgugagaaacug

SEQ ID NO: 452178 - RNA, 19 nt, Homo sapiens
ugugauaaaggaucuuguu

SEQ ID NO: 452179 - RNA, 19 nt, Homo sapiens
uugaguuccuuuaaagauc

SEQ ID NO: 452180 - RNA, 19 nt, Homo sapiens
cacaguacaaauccauuga

SEQ ID NO: 452181 - RNA, 19 nt, Homo sapiens
gugauaaaggaucuuguuc

SEQ ID NO: 452182 - RNA, 19 nt, Homo sapiens
uuggaugcuuuaaucaaga

SEQ ID NO: 452183 - RNA, 19 nt, Homo sapiens
gcuauugcagagaucaaga

SEQ ID NO: 452184 - RNA, 19 nt, Homo sapiens
guauuggaugcuuuaauca

SEQ ID NO: 452185 - RNA, 19 nt, Homo sapiens
ccaagcugcaggacccauu

SEQ ID NO: 452186 - RNA, 19 nt, Homo sapiens
ugacaccaaccucaauaag

SEQ ID NO: 452187 - RNA, 19 nt, Homo sapiens
aggcaucuguggcucuugu

SEQ ID NO: 452188 - RNA, 19 nt, Homo sapiens
gcacuugucuucccucuca

SEQ ID NO: 452189 - RNA, 19 nt, Homo sapiens
gaaaaguucuccuuauuug

SEQ ID NO: 452190 - RNA, 19 nt, Homo sapiens
caagauggcugcgcuguug

SEQ ID NO: 452191 - RNA, 19 nt, Homo sapiens
guuauucucucuccauauu

SEQ ID NO: 452192 - RNA, 19 nt, Homo sapiens
gagcgguucuggaauaaga

SEQ ID NO: 452193 - RNA, 19 nt, Homo sapiens
cagaaaugcuguuccuuug

SEQ ID NO: 452194 - RNA, 19 nt, Homo sapiens
aaagagggcuaguuaguuc

SEQ ID NO: 452195 - RNA, 19 nt, Homo sapiens
gcacugauccacacagcua

SEQ ID NO: 452196 - RNA, 19 nt, Homo sapiens
gaacuuugagucuuauuug

SEQ ID NO: 452197 - RNA, 19 nt, Homo sapiens
cagaaaagccucuuaauuu

SEQ ID NO: 452198 - RNA, 19 nt, Homo sapiens
gaaccacggccaaagaaga

SEQ ID NO: 452199 - RNA, 19 nt, Homo sapiens
agauaaagagggcuaguua

SEQ ID NO: 452200 - RNA, 19 nt, Homo sapiens
gcacugguauugcuuugag

SEQ ID NO: 452201 - RNA, 19 nt, Homo sapiens
aagaugagguggcugcaaa

SEQ ID NO: 452202 - RNA, 19 nt, Homo sapiens
ucacccaucuuucuguuug

SEQ ID NO: 452203 - RNA, 19 nt, Homo sapiens
ucagaaaugcuguuccuuu

SEQ ID NO: 452204 - RNA, 19 nt, Homo sapiens
gggaaaaguucuccuuauu

SEQ ID NO: 452205 - RNA, 19 nt, Homo sapiens
ggaaaaggccugaagauuc

SEQ ID NO: 452206 - RNA, 19 nt, Homo sapiens
gauccacacagcuaaguuu

SEQ ID NO: 452207 - RNA, 19 nt, Homo sapiens
ggaaaaguucuccuuauuu

SEQ ID NO: 452208 - RNA, 19 nt, Homo sapiens
ggaacuuugagucuuauuu

SEQ ID NO: 452209 - RNA, 19 nt, Homo sapiens
ccacauuacuaucuacagu

SEQ ID NO: 452210 - RNA, 19 nt, Homo sapiens
cauauugggcuuugauuug

SEQ ID NO: 452211 - RNA, 19 nt, Homo sapiens
gcccacagcuugccuacuc

SEQ ID NO: 452212 - RNA, 19 nt, Homo sapiens
ugucuucccucucauguau

SEQ ID NO: 452213 - RNA, 19 nt, Homo sapiens
cugggaacuuugagucuua

SEQ ID NO: 452214 - RNA, 19 nt, Homo sapiens
uaaagagggcuaguuaguu

SEQ ID NO: 452215 - RNA, 19 nt, Homo sapiens
ccacacagcuaaguuugca

SEQ ID NO: 452216 - RNA, 19 nt, Homo sapiens
caguuauucucucuccaua

SEQ ID NO: 452217 - RNA, 19 nt, Homo sapiens
gaaacaaugccagcucugu

SEQ ID NO: 452218 - RNA, 19 nt, Homo sapiens
ugagagcccaggccauuaa

SEQ ID NO: 452219 - RNA, 19 nt, Homo sapiens
gaaaaggccugaagauucc

SEQ ID NO: 452220 - RNA, 19 nt, Homo sapiens
ggugagagcccaggccauu

SEQ ID NO: 452221 - RNA, 19 nt, Homo sapiens
uggcaugucggcccuguua

SEQ ID NO: 452222 - RNA, 19 nt, Homo sapiens
acauuacuaucuacaguug

SEQ ID NO: 452223 - RNA, 19 nt, Homo sapiens
ucgaaguaauguacccuuu

SEQ ID NO: 452224 - RNA, 19 nt, Homo sapiens
gcagccaugugaagaaagg

SEQ ID NO: 452225 - RNA, 19 nt, Homo sapiens
auggagcgguucuggaaua

SEQ ID NO: 452226 - RNA, 19 nt, Homo sapiens
gagauaaagagggcuaguu

SEQ ID NO: 452227 - RNA, 19 nt, Homo sapiens
cccaggccauuaacaacua

SEQ ID NO: 452228 - RNA, 19 nt, Homo sapiens
gagcccaggccauuaacaa

SEQ ID NO: 452229 - RNA, 19 nt, Homo sapiens
caucaucuuccuacacauu

SEQ ID NO: 452230 - RNA, 19 nt, Homo sapiens
ccagcuagagggagauaaa

SEQ ID NO: 452231 - RNA, 19 nt, Homo sapiens
ccaggccauuaacaacuaa

SEQ ID NO: 452232 - RNA, 19 nt, Homo sapiens
gugguuguccugguucuua

SEQ ID NO: 452233 - RNA, 19 nt, Homo sapiens
gggaaccacggccaaagaa

SEQ ID NO: 452234 - RNA, 19 nt, Homo sapiens
ccagaaaagccucuuaauu

SEQ ID NO: 452235 - RNA, 19 nt, Homo sapiens
gauaaagagggcuaguuag

SEQ ID NO: 452236 - RNA, 19 nt, Homo sapiens
ccauauugggcuuugauuu

SEQ ID NO: 452237 - RNA, 19 nt, Homo sapiens
uuacuguguuguccucuau

SEQ ID NO: 452238 - RNA, 19 nt, Homo sapiens
gugcaggggucucucuuuu

SEQ ID NO: 452239 - RNA, 19 nt, Homo sapiens
gcaguuauucucucuccau

SEQ ID NO: 452240 - RNA, 19 nt, Homo sapiens
gaagagauggagcgguucu

SEQ ID NO: 452241 - RNA, 19 nt, Homo sapiens
uaucagaaaugcuguuccu

SEQ ID NO: 452242 - RNA, 19 nt, Homo sapiens
cuuugagucuuauuuggaa

SEQ ID NO: 452243 - RNA, 19 nt, Homo sapiens
uggguugggugaagcuuug

SEQ ID NO: 452244 - RNA, 19 nt, Homo sapiens
gugagagcccaggccauua

SEQ ID NO: 452245 - RNA, 19 nt, Homo sapiens
gcuuaaaggacaauucucu

SEQ ID NO: 452246 - RNA, 19 nt, Homo sapiens
uggagugguuguccugguu

SEQ ID NO: 452247 - RNA, 19 nt, Homo sapiens
uggagcgguucuggaauaa

SEQ ID NO: 452248 - RNA, 19 nt, Homo sapiens
auaaagagggcuaguuagu

SEQ ID NO: 452249 - RNA, 19 nt, Homo sapiens
uggguuugcuggcuuaaag

SEQ ID NO: 452250 - RNA, 19 nt, Homo sapiens
agauggagcgguucuggaa

SEQ ID NO: 452251 - RNA, 19 nt, Homo sapiens
cugagacaguggaaacaau

SEQ ID NO: 452252 - RNA, 19 nt, Homo sapiens
ugagacaguggaaacaaug

SEQ ID NO: 452253 - RNA, 19 nt, Homo sapiens
auauugggcuuugauuugu

SEQ ID NO: 452254 - RNA, 19 nt, Homo sapiens
agucuuauuuggaacuugu

SEQ ID NO: 452255 - RNA, 19 nt, Homo sapiens
gagacacguuggucgucau

SEQ ID NO: 452256 - RNA, 19 nt, Homo sapiens
gagggcuaguuaguucuug

SEQ ID NO: 452257 - RNA, 19 nt, Homo sapiens
gcuagagggagauaaagag

SEQ ID NO: 452258 - RNA, 19 nt, Homo sapiens
gccauuaacaacuaacaca

SEQ ID NO: 452259 - RNA, 19 nt, Homo sapiens
cggccuagaagcaguuauu

SEQ ID NO: 452260 - RNA, 19 nt, Homo sapiens
caucuuccuacacauuauu

SEQ ID NO: 452261 - RNA, 19 nt, Homo sapiens
ccugggaacuuugagucuu

SEQ ID NO: 452262 - RNA, 19 nt, Homo sapiens
acaguguuauugaaagaag

SEQ ID NO: 452263 - RNA, 19 nt, Homo sapiens
uuuaugcuuucucaucgaa

SEQ ID NO: 452264 - RNA, 19 nt, Homo sapiens
caccguggcacugguauug

SEQ ID NO: 452265 - RNA, 19 nt, Homo sapiens
ccaagauggcugcgcuguu

SEQ ID NO: 452266 - RNA, 19 nt, Homo sapiens
ucaucuuccuacacauuau

SEQ ID NO: 452267 - RNA, 19 nt, Homo sapiens
agcaucaucuuccuacaca

SEQ ID NO: 452268 - RNA, 19 nt, Homo sapiens
acacguuggucgucauugc

SEQ ID NO: 452269 - RNA, 19 nt, Homo sapiens
cuccuuauuuguuuagauc

SEQ ID NO: 452270 - RNA, 19 nt, Homo sapiens
gcugauagcucauauuaua

SEQ ID NO: 452271 - RNA, 19 nt, Homo sapiens
ggacagccuucuucucuua

SEQ ID NO: 452272 - RNA, 19 nt, Homo sapiens
gggaaucucuaaugugaaa

SEQ ID NO: 452273 - RNA, 19 nt, Homo sapiens
gcucauaucucagcauuuc

SEQ ID NO: 452274 - RNA, 19 nt, Homo sapiens
gggaaauacucuuaauuca

SEQ ID NO: 452275 - RNA, 19 nt, Homo sapiens
ggaccgaccuaucccagaa

SEQ ID NO: 452276 - RNA, 19 nt, Homo sapiens
gcucugcgauggacuauuc

SEQ ID NO: 452277 - RNA, 19 nt, Homo sapiens
aacaaucuguccacaaaua

SEQ ID NO: 452278 - RNA, 19 nt, Homo sapiens
ccaaauguauucuacuugu

SEQ ID NO: 452279 - RNA, 19 nt, Homo sapiens
ucuauauucuggugaguua

SEQ ID NO: 452280 - RNA, 19 nt, Homo sapiens
gagacugaguucuauauuc

SEQ ID NO: 452281 - RNA, 19 nt, Homo sapiens
ccauuaagcucacaauaag

SEQ ID NO: 452282 - RNA, 19 nt, Homo sapiens
gaaaugcugauagcucaua

SEQ ID NO: 452283 - RNA, 19 nt, Homo sapiens
gccauuaagcucacaauaa

SEQ ID NO: 452284 - RNA, 19 nt, Homo sapiens
aaacuucccucucuagaca

SEQ ID NO: 452285 - RNA, 19 nt, Homo sapiens
gcacaaugggaaucucuaa

SEQ ID NO: 452286 - RNA, 19 nt, Homo sapiens
caaugggaaucucuaaugu

SEQ ID NO: 452287 - RNA, 19 nt, Homo sapiens
acaaagggaaauacucuua

SEQ ID NO: 452288 - RNA, 19 nt, Homo sapiens
cuacugaugguuacauaua

SEQ ID NO: 452289 - RNA, 19 nt, Homo sapiens
ggaaaagguuugagaggaa

SEQ ID NO: 452290 - RNA, 19 nt, Homo sapiens
gcgagaggguugucagugu

SEQ ID NO: 452291 - RNA, 19 nt, Homo sapiens
caaagggaaauacucuuaa

SEQ ID NO: 452292 - RNA, 19 nt, Homo sapiens
ggacaaagggaaauacucu

SEQ ID NO: 452293 - RNA, 19 nt, Homo sapiens
agacugaguucuauauucu

SEQ ID NO: 452294 - RNA, 19 nt, Homo sapiens
aaaacaaucuguccacaaa

SEQ ID NO: 452295 - RNA, 19 nt, Homo sapiens
gcuuuugccuuucaauuua

SEQ ID NO: 452296 - RNA, 19 nt, Homo sapiens
uugcugggcuuugcuauuu

SEQ ID NO: 452297 - RNA, 19 nt, Homo sapiens
gcuuugcuauuucaacuau

SEQ ID NO: 452298 - RNA, 19 nt, Homo sapiens
uguggaagcucugaccuuu

SEQ ID NO: 452299 - RNA, 19 nt, Homo sapiens
cgagaggguugucaguguu

SEQ ID NO: 452300 - RNA, 19 nt, Homo sapiens
uauaucagcuuuugccuuu

SEQ ID NO: 452301 - RNA, 19 nt, Homo sapiens
gguuugagaggaauuauau

SEQ ID NO: 452302 - RNA, 19 nt, Homo sapiens
caaucuguccacaaauaua

SEQ ID NO: 452303 - RNA, 19 nt, Homo sapiens
uuggagugcuucugaauau

SEQ ID NO: 452304 - RNA, 19 nt, Homo sapiens
acuuucagcuuuaaccuuu

SEQ ID NO: 452305 - RNA, 19 nt, Homo sapiens
acuaccaacuguaaauuga

SEQ ID NO: 452306 - RNA, 19 nt, Homo sapiens
augggaaucucuaauguga

SEQ ID NO: 452307 - RNA, 19 nt, Homo sapiens
cuucuucucuuaaucacaa

SEQ ID NO: 452308 - RNA, 19 nt, Homo sapiens
guugugagacugaguucua

SEQ ID NO: 452309 - RNA, 19 nt, Homo sapiens
gaauugauguaugccucuu

SEQ ID NO: 452310 - RNA, 19 nt, Homo sapiens
gcuuccggcugcuuauuug

SEQ ID NO: 452311 - RNA, 19 nt, Homo sapiens
gagaggguugucaguguuu

SEQ ID NO: 452312 - RNA, 19 nt, Homo sapiens
ucccaaauguauucuacuu

SEQ ID NO: 452313 - RNA, 19 nt, Homo sapiens
uaccaacuguaaauugaga

SEQ ID NO: 452314 - RNA, 19 nt, Homo sapiens
uacagaaguuccauuuaag

SEQ ID NO: 452315 - RNA, 19 nt, Homo sapiens
ccucccagcuucuuauaag

SEQ ID NO: 452316 - RNA, 19 nt, Homo sapiens
acaaugggaaucucuaaug

SEQ ID NO: 452317 - RNA, 19 nt, Homo sapiens
augcugauagcucauauua

SEQ ID NO: 452318 - RNA, 19 nt, Homo sapiens
cgagcucuguugcuucgaa

SEQ ID NO: 452319 - RNA, 19 nt, Homo sapiens
gcagaaaauuagacagugu

SEQ ID NO: 452320 - RNA, 19 nt, Homo sapiens
gggcuuugcuauuucaacu

SEQ ID NO: 452321 - RNA, 19 nt, Homo sapiens
aaaagugucuucuaugcuu

SEQ ID NO: 452322 - RNA, 19 nt, Homo sapiens
ggagugcuucugaauauac

SEQ ID NO: 452323 - RNA, 19 nt, Homo sapiens
gcugggcuuugcuauuuca

SEQ ID NO: 452324 - RNA, 19 nt, Homo sapiens
cagaccugcucauaucuca

SEQ ID NO: 452325 - RNA, 19 nt, Homo sapiens
ggaagaaauaacagauaag

SEQ ID NO: 452326 - RNA, 19 nt, Homo sapiens
cugcagcccucacucuuca

SEQ ID NO: 452327 - RNA, 19 nt, Homo sapiens
agggaaauacucuuaauuc

SEQ ID NO: 452328 - RNA, 19 nt, Homo sapiens
aauaauggacaaagggaaa

SEQ ID NO: 452329 - RNA, 19 nt, Homo sapiens
ccguagauguaucaaaaua

SEQ ID NO: 452330 - RNA, 19 nt, Homo sapiens
uggagugcuucugaauaua

SEQ ID NO: 452331 - RNA, 19 nt, Homo sapiens
ucuaaauccuaggaagaaa

SEQ ID NO: 452332 - RNA, 19 nt, Homo sapiens
gaaaagguuugagaggaau

SEQ ID NO: 452333 - RNA, 19 nt, Homo sapiens
gagugcuucugaauauaca

SEQ ID NO: 452334 - RNA, 19 nt, Homo sapiens
uaauggacaaagggaaaua

SEQ ID NO: 452335 - RNA, 19 nt, Homo sapiens
gugagacugaguucuauau

SEQ ID NO: 452336 - RNA, 19 nt, Homo sapiens
caaaauacuaccaacugua

SEQ ID NO: 452337 - RNA, 19 nt, Homo sapiens
aaagguuugagaggaauua

SEQ ID NO: 452338 - RNA, 19 nt, Homo sapiens
guggacagccuucuucucu

SEQ ID NO: 452339 - RNA, 19 nt, Homo sapiens
uugaagaauugauguaugc

SEQ ID NO: 452340 - RNA, 19 nt, Homo sapiens
ccccguagauguaucaaaa

SEQ ID NO: 452341 - RNA, 19 nt, Homo sapiens
gccuuucaauuuaucaauc

SEQ ID NO: 452342 - RNA, 19 nt, Homo sapiens
uaaguugugagacugaguu

SEQ ID NO: 452343 - RNA, 19 nt, Homo sapiens
uuucaacuaucacgaugug

SEQ ID NO: 452344 - RNA, 19 nt, Homo sapiens
uuuggcacuuucagcuuua

SEQ ID NO: 452345 - RNA, 19 nt, Homo sapiens
gcuccaaggcugcaucucu

SEQ ID NO: 452346 - RNA, 19 nt, Homo sapiens
agaaacgcuuggagugcuu

SEQ ID NO: 452347 - RNA, 19 nt, Homo sapiens
guuacugacuauguucaug

SEQ ID NO: 452348 - RNA, 19 nt, Homo sapiens
gaaaacuucccucucuaga

SEQ ID NO: 452349 - RNA, 19 nt, Homo sapiens
ccucuuugccucugcuuug

SEQ ID NO: 452350 - RNA, 19 nt, Homo sapiens
ccaacuguaaauugagauu

SEQ ID NO: 452351 - RNA, 19 nt, Homo sapiens
uagauaccaccuacugaug

SEQ ID NO: 452352 - RNA, 19 nt, Homo sapiens
ugagacugaguucuauauu

SEQ ID NO: 452353 - RNA, 19 nt, Homo sapiens
gacagccuucuucucuuaa

SEQ ID NO: 452354 - RNA, 19 nt, Homo sapiens
ucauaucucagcauuucuu

SEQ ID NO: 452355 - RNA, 19 nt, Homo sapiens
ucaaaauacuaccaacugu

SEQ ID NO: 452356 - RNA, 19 nt, Homo sapiens
aaaugcugauagcucauau

SEQ ID NO: 452357 - RNA, 19 nt, Homo sapiens
gacaaagggaaauacucuu

SEQ ID NO: 452358 - RNA, 19 nt, Homo sapiens
gggcaucugcaaagcuguu

SEQ ID NO: 452359 - RNA, 19 nt, Homo sapiens
cguuugcggugcccuagga

SEQ ID NO: 452360 - RNA, 19 nt, Homo sapiens
gggaugccuugcagaaagc

SEQ ID NO: 452361 - RNA, 19 nt, Homo sapiens
acaaucuguccacaaauau

SEQ ID NO: 452362 - RNA, 19 nt, Homo sapiens
gaauauacagaaguuccau

SEQ ID NO: 452363 - RNA, 19 nt, Homo sapiens
cuuggagugcuucugaaua

SEQ ID NO: 452364 - RNA, 19 nt, Homo sapiens
gcagcccucacucuucaug

SEQ ID NO: 452365 - RNA, 19 nt, Homo sapiens
auugauguaugccucuuug

SEQ ID NO: 452366 - RNA, 19 nt, Homo sapiens
ucaccgagccaccauucug

SEQ ID NO: 452367 - RNA, 19 nt, Homo sapiens
gcagggcuuuuggcacuuu

SEQ ID NO: 452368 - RNA, 19 nt, Homo sapiens
gaucggagaugccuuguaa

SEQ ID NO: 452369 - RNA, 19 nt, Homo sapiens
gaugaugccucaagcaaua

SEQ ID NO: 452370 - RNA, 19 nt, Homo sapiens
caacaacgcucacaccauu

SEQ ID NO: 452371 - RNA, 19 nt, Homo sapiens
gcugaaagcacucauguua

SEQ ID NO: 452372 - RNA, 19 nt, Homo sapiens
ggacacgacuccucaguga

SEQ ID NO: 452373 - RNA, 19 nt, Homo sapiens
caagugauguucaaaucua

SEQ ID NO: 452374 - RNA, 19 nt, Homo sapiens
gcacucauguuacgaggaa

SEQ ID NO: 452375 - RNA, 19 nt, Homo sapiens
ccaauuacaucaagagguu

SEQ ID NO: 452376 - RNA, 19 nt, Homo sapiens
ggaagaaacuacaagugau

SEQ ID NO: 452377 - RNA, 19 nt, Homo sapiens
caugugagcugguccauca

SEQ ID NO: 452378 - RNA, 19 nt, Homo sapiens
gaaggccaaugggaaguaa

SEQ ID NO: 452379 - RNA, 19 nt, Homo sapiens
ccaucucccugcugacuua

SEQ ID NO: 452380 - RNA, 19 nt, Homo sapiens
gcagaaacccaauuacauc

SEQ ID NO: 452381 - RNA, 19 nt, Homo sapiens
guaauuaacacuguggaua

SEQ ID NO: 452382 - RNA, 19 nt, Homo sapiens
gaagaaacuacaagugaug

SEQ ID NO: 452383 - RNA, 19 nt, Homo sapiens
gaugugguguggcauguga

SEQ ID NO: 452384 - RNA, 19 nt, Homo sapiens
gaaacccaauuacaucaag

SEQ ID NO: 452385 - RNA, 19 nt, Homo sapiens
gaaaauggugucaguaauu

SEQ ID NO: 452386 - RNA, 19 nt, Homo sapiens
ccaaaggaacuaaauaaag

SEQ ID NO: 452387 - RNA, 19 nt, Homo sapiens
gcaaccugcucaucagaca

SEQ ID NO: 452388 - RNA, 19 nt, Homo sapiens
ggucguguguucauuugga

SEQ ID NO: 452389 - RNA, 19 nt, Homo sapiens
ugaaagcacucauguuacg

SEQ ID NO: 452390 - RNA, 19 nt, Homo sapiens
ugacagagggccagcagaa

SEQ ID NO: 452391 - RNA, 19 nt, Homo sapiens
gaaguaaagaagaucaaca

SEQ ID NO: 452392 - RNA, 19 nt, Homo sapiens
gaaacuacaagugauguuc

SEQ ID NO: 452393 - RNA, 19 nt, Homo sapiens
gggcagaaacccaauuaca

SEQ ID NO: 452394 - RNA, 19 nt, Homo sapiens
ggaaggccaaugggaagua

SEQ ID NO: 452395 - RNA, 19 nt, Homo sapiens
uacaagugauguucaaauc

SEQ ID NO: 452396 - RNA, 19 nt, Homo sapiens
gauggucguguguucauuu

SEQ ID NO: 452397 - RNA, 19 nt, Homo sapiens
ggaaaauggugucaguaau

SEQ ID NO: 452398 - RNA, 19 nt, Homo sapiens
gaaggaggagcagaagcua

SEQ ID NO: 452399 - RNA, 19 nt, Homo sapiens
ccaggauggucguguguuc

SEQ ID NO: 452400 - RNA, 19 nt, Homo sapiens
ugacuggguucgagaugug

SEQ ID NO: 452401 - RNA, 19 nt, Homo sapiens
aggaagaaacuacaaguga

SEQ ID NO: 452402 - RNA, 19 nt, Homo sapiens
ucaucaagcuguggaagga

SEQ ID NO: 452403 - RNA, 19 nt, Homo sapiens
ggaaggaggagcagaagcu

SEQ ID NO: 452404 - RNA, 19 nt, Homo sapiens
ggcagaaacccaauuacau

SEQ ID NO: 452405 - RNA, 19 nt, Homo sapiens
gaggaagaaacuacaagug

SEQ ID NO: 452406 - RNA, 19 nt, Homo sapiens
gugacaaccucaucaagcu

SEQ ID NO: 452407 - RNA, 19 nt, Homo sapiens
ggauggucguguguucauu

SEQ ID NO: 452408 - RNA, 19 nt, Homo sapiens
gaacgagcagugacaagac

SEQ ID NO: 452409 - RNA, 19 nt, Homo sapiens
aaacccaauuacaucaaga

SEQ ID NO: 452410 - RNA, 19 nt, Homo sapiens
cagaaacccaauuacauca

SEQ ID NO: 452411 - RNA, 19 nt, Homo sapiens
gccaaugggaaguaaagaa

SEQ ID NO: 452412 - RNA, 19 nt, Homo sapiens
gggaaaauggugucaguaa

SEQ ID NO: 452413 - RNA, 19 nt, Homo sapiens
cagaugcagccacagauug

SEQ ID NO: 452414 - RNA, 19 nt, Homo sapiens
ccaacuaaccagacaacug

SEQ ID NO: 452415 - RNA, 19 nt, Homo sapiens
acgcccagauggacuacua

SEQ ID NO: 452416 - RNA, 19 nt, Homo sapiens
gaccggaaagucauuaucu

SEQ ID NO: 452417 - RNA, 19 nt, Homo sapiens
ccuuuggguucaggcauua

SEQ ID NO: 452418 - RNA, 19 nt, Homo sapiens
cuacaagugauguucaaau

SEQ ID NO: 452419 - RNA, 19 nt, Homo sapiens
aaucuacuguccagcugaa

SEQ ID NO: 452420 - RNA, 19 nt, Homo sapiens
gauugaucaucugccuuaa

SEQ ID NO: 452421 - RNA, 19 nt, Homo sapiens
gcagaacgagcagugacaa

SEQ ID NO: 452422 - RNA, 19 nt, Homo sapiens
aaugggaaguaaagaagau

SEQ ID NO: 452423 - RNA, 19 nt, Homo sapiens
ccaaugggaaguaaagaag

SEQ ID NO: 452424 - RNA, 19 nt, Homo sapiens
gugcuccuaugaccggaaa

SEQ ID NO: 452425 - RNA, 19 nt, Homo sapiens
uaauuaacacuguggauac

SEQ ID NO: 452426 - RNA, 19 nt, Homo sapiens
caucaagagguuugcauca

SEQ ID NO: 452427 - RNA, 19 nt, Homo sapiens
ggagaagagccacgagcau

SEQ ID NO: 452428 - RNA, 19 nt, Homo sapiens
uuacagaugcagccacaga

SEQ ID NO: 452429 - RNA, 19 nt, Homo sapiens
ccaggaggaguuacagaug

SEQ ID NO: 452430 - RNA, 19 nt, Homo sapiens
gugaugaugccucaagcaa

SEQ ID NO: 452431 - RNA, 19 nt, Homo sapiens
cagcugaaagcacucaugu

SEQ ID NO: 452432 - RNA, 19 nt, Homo sapiens
caaugggaaguaaagaaga

SEQ ID NO: 452433 - RNA, 19 nt, Homo sapiens
uuauguaccuuuggguuca

SEQ ID NO: 452434 - RNA, 19 nt, Homo sapiens
aaacuacaagugauguuca

SEQ ID NO: 452435 - RNA, 19 nt, Homo sapiens
uggaaggagucaguugaug

SEQ ID NO: 452436 - RNA, 19 nt, Homo sapiens
gaagcuagaagcgcacagu

SEQ ID NO: 452437 - RNA, 19 nt, Homo sapiens
guaccuggaagccucauag

SEQ ID NO: 452438 - RNA, 19 nt, Homo sapiens
ggucaugaggguccugugu

SEQ ID NO: 452439 - RNA, 19 nt, Homo sapiens
gaaagcacucauguuacga

SEQ ID NO: 452440 - RNA, 19 nt, Homo sapiens
aauggagggcagauccuua

SEQ ID NO: 452441 - RNA, 19 nt, Homo sapiens
agaugcagccacagauuga

SEQ ID NO: 452442 - RNA, 19 nt, Homo sapiens
uggcaucgugcuccuauga

SEQ ID NO: 452443 - RNA, 19 nt, Homo sapiens
cgaggaagaaacuacaagu

SEQ ID NO: 452444 - RNA, 19 nt, Homo sapiens
acagaugcagccacagauu

SEQ ID NO: 452445 - RNA, 19 nt, Homo sapiens
caacuccaacaggauuauu

SEQ ID NO: 452446 - RNA, 19 nt, Homo sapiens
agaacgagcagugacaaga

SEQ ID NO: 452447 - RNA, 19 nt, Homo sapiens
cguaucagcaucagugaca

SEQ ID NO: 452448 - RNA, 19 nt, Homo sapiens
caucagacagguccgucaa

SEQ ID NO: 452449 - RNA, 19 nt, Homo sapiens
ucggagaugccuuguaauc

SEQ ID NO: 452450 - RNA, 19 nt, Homo sapiens
ucagacagguccgucaaaa

SEQ ID NO: 452451 - RNA, 19 nt, Homo sapiens
gggcagugggugugcauca

SEQ ID NO: 452452 - RNA, 19 nt, Homo sapiens
caacauccuggcugucucu

SEQ ID NO: 452453 - RNA, 19 nt, Homo sapiens
ugcacaaguucaacgaugu

SEQ ID NO: 452454 - RNA, 19 nt, Homo sapiens
gugacuggguucgagaugu

SEQ ID NO: 452455 - RNA, 19 nt, Homo sapiens
caucugccuuaacgugauc

SEQ ID NO: 452456 - RNA, 19 nt, Homo sapiens
gcagugggugugcaucagu

SEQ ID NO: 452457 - RNA, 19 nt, Homo sapiens
gcugugacaaccucaucaa

SEQ ID NO: 452458 - RNA, 19 nt, Homo sapiens
gggaaguaaagaagaucaa

SEQ ID NO: 452459 - RNA, 19 nt, Homo sapiens
gaaaggaaaucaucgaaua

SEQ ID NO: 452460 - RNA, 19 nt, Homo sapiens
caggagagcugccucauua

SEQ ID NO: 452461 - RNA, 19 nt, Homo sapiens
gaacguacuuugcacauug

SEQ ID NO: 452462 - RNA, 19 nt, Homo sapiens
caauauaccagcaacauua

SEQ ID NO: 452463 - RNA, 19 nt, Homo sapiens
gauccuaacuuaacucaau

SEQ ID NO: 452464 - RNA, 19 nt, Homo sapiens
uaacucugauccuaacuua

SEQ ID NO: 452465 - RNA, 19 nt, Homo sapiens
gcauaaaguaccauucuua

SEQ ID NO: 452466 - RNA, 19 nt, Homo sapiens
gcacaugaccgcacaaaug

SEQ ID NO: 452467 - RNA, 19 nt, Homo sapiens
ccagagagaucauguguca

SEQ ID NO: 452468 - RNA, 19 nt, Homo sapiens
gcccagagauguuuauaga

SEQ ID NO: 452469 - RNA, 19 nt, Homo sapiens
ugaacagucugcaaguuua

SEQ ID NO: 452470 - RNA, 19 nt, Homo sapiens
gaagaagauugcaggaguu

SEQ ID NO: 452471 - RNA, 19 nt, Homo sapiens
gggauggccuccacgauaa

SEQ ID NO: 452472 - RNA, 19 nt, Homo sapiens
gcacaaguguaaagugaug

SEQ ID NO: 452473 - RNA, 19 nt, Homo sapiens
ccaaucgggucaucauuaa

SEQ ID NO: 452474 - RNA, 19 nt, Homo sapiens
ucacuuuccuuccuaaauu

SEQ ID NO: 452475 - RNA, 19 nt, Homo sapiens
guggagaccuggugugaaa

SEQ ID NO: 452476 - RNA, 19 nt, Homo sapiens
gaaagcagcaucagguaga

SEQ ID NO: 452477 - RNA, 19 nt, Homo sapiens
gaggguugcuguugcauug

SEQ ID NO: 452478 - RNA, 19 nt, Homo sapiens
cagaggagcuggagaacga

SEQ ID NO: 452479 - RNA, 19 nt, Homo sapiens
agagauaccugggcgauuu

SEQ ID NO: 452480 - RNA, 19 nt, Homo sapiens
ggauugacguggucucaga

SEQ ID NO: 452481 - RNA, 19 nt, Homo sapiens
caucguguuucuaccuuua

SEQ ID NO: 452482 - RNA, 19 nt, Homo sapiens
gcauggagauccugguugu

SEQ ID NO: 452483 - RNA, 19 nt, Homo sapiens
cagaauaugggauuuguuu

SEQ ID NO: 452484 - RNA, 19 nt, Homo sapiens
ucucagauauugaugcaaa

SEQ ID NO: 452485 - RNA, 19 nt, Homo sapiens
auacuaccuucgccaauua

SEQ ID NO: 452486 - RNA, 19 nt, Homo sapiens
aggaagcccugcugagaua

SEQ ID NO: 452487 - RNA, 19 nt, Homo sapiens
gaucaugugucagucuuug

SEQ ID NO: 452488 - RNA, 19 nt, Homo sapiens
ggaaaaugcugccaucguu

SEQ ID NO: 452489 - RNA, 19 nt, Homo sapiens
aagauggucuguggacuua

SEQ ID NO: 452490 - RNA, 19 nt, Homo sapiens
cagugagaguguacaaaua

SEQ ID NO: 452491 - RNA, 19 nt, Homo sapiens
cuggaggccugcuggauua

SEQ ID NO: 452492 - RNA, 19 nt, Homo sapiens
caacaagacaggugugaga

SEQ ID NO: 452493 - RNA, 19 nt, Homo sapiens
ggaccugccugguggacuu

SEQ ID NO: 452494 - RNA, 19 nt, Homo sapiens
gcugcaagcuggauguaga

SEQ ID NO: 452495 - RNA, 19 nt, Homo sapiens
ggaguggcauucuuuuaua

SEQ ID NO: 452496 - RNA, 19 nt, Homo sapiens
ccagagauguuuauagaac

SEQ ID NO: 452497 - RNA, 19 nt, Homo sapiens
aaauagcucucagauggua

SEQ ID NO: 452498 - RNA, 19 nt, Homo sapiens
ggaacguacuuugcacauu

SEQ ID NO: 452499 - RNA, 19 nt, Homo sapiens
ccacgcggcugucaacugu

SEQ ID NO: 452500 - RNA, 19 nt, Homo sapiens
gaaccagcaagucgcauuu

SEQ ID NO: 452501 - RNA, 19 nt, Homo sapiens
gaacaaugugcagcucaua

SEQ ID NO: 452502 - RNA, 19 nt, Homo sapiens
uggauuacaucgacaaaga

SEQ ID NO: 452503 - RNA, 19 nt, Homo sapiens
gacguggucucagauauug

SEQ ID NO: 452504 - RNA, 19 nt, Homo sapiens
ggacugagaccaucuacca

SEQ ID NO: 452505 - RNA, 19 nt, Homo sapiens
gagaaagcagcaucaggua

SEQ ID NO: 452506 - RNA, 19 nt, Homo sapiens
ugucauuucccauuucuua

SEQ ID NO: 452507 - RNA, 19 nt, Homo sapiens
gugcaggguucccauguga

SEQ ID NO: 452508 - RNA, 19 nt, Homo sapiens
ggaggaagcccugcugaga

SEQ ID NO: 452509 - RNA, 19 nt, Homo sapiens
ugacaaagccagagagauc

SEQ ID NO: 452510 - RNA, 19 nt, Homo sapiens
gcacgggauuuuaauauug

SEQ ID NO: 452511 - RNA, 19 nt, Homo sapiens
gaagauugcaggaguugau

SEQ ID NO: 452512 - RNA, 19 nt, Homo sapiens
ugaagguggucccugcuuu

SEQ ID NO: 452513 - RNA, 19 nt, Homo sapiens
ucgcacaaguguaaaguga

SEQ ID NO: 452514 - RNA, 19 nt, Homo sapiens
gagaucaugugucagucuu

SEQ ID NO: 452515 - RNA, 19 nt, Homo sapiens
gguaauacaauacugauag

SEQ ID NO: 452516 - RNA, 19 nt, Homo sapiens
aauuauggcugccuaugaa

SEQ ID NO: 452517 - RNA, 19 nt, Homo sapiens
ccucugaucugcaaagaag

SEQ ID NO: 452518 - RNA, 19 nt, Homo sapiens
ggagagcugccucauuaga

SEQ ID NO: 452519 - RNA, 19 nt, Homo sapiens
aaacauauuaccucacuug

SEQ ID NO: 452520 - RNA, 19 nt, Homo sapiens
uuaaaacgcugcugucauu

SEQ ID NO: 452521 - RNA, 19 nt, Homo sapiens
gcuccaugaucuccaggua

SEQ ID NO: 452522 - RNA, 19 nt, Homo sapiens
gaacuccgcauuguccauu

SEQ ID NO: 452523 - RNA, 19 nt, Homo sapiens
ggaacaaugugcagcucau

SEQ ID NO: 452524 - RNA, 19 nt, Homo sapiens
ucagagacaucuucaucau

SEQ ID NO: 452525 - RNA, 19 nt, Homo sapiens
ggaaaucaucgaauacuac

SEQ ID NO: 452526 - RNA, 19 nt, Homo sapiens
ggaaaggaaaucaucgaau

SEQ ID NO: 452527 - RNA, 19 nt, Homo sapiens
gaaaaugcuucacucaaca

SEQ ID NO: 452528 - RNA, 19 nt, Homo sapiens
ccaacgaacuccgcauugu

SEQ ID NO: 452529 - RNA, 19 nt, Homo sapiens
aguguaaagugauguacua

SEQ ID NO: 452530 - RNA, 19 nt, Homo sapiens
guggaugccucgucaguca

SEQ ID NO: 452531 - RNA, 19 nt, Homo sapiens
gcaaugaaacaauauacca

SEQ ID NO: 452532 - RNA, 19 nt, Homo sapiens
acaaaugcuuacaggguuu

SEQ ID NO: 452533 - RNA, 19 nt, Homo sapiens
caaagacuguagugcaucu

SEQ ID NO: 452534 - RNA, 19 nt, Homo sapiens
gcgguaggguucguaggua

SEQ ID NO: 452535 - RNA, 19 nt, Homo sapiens
agugguaccugaagccuuu

SEQ ID NO: 452536 - RNA, 19 nt, Homo sapiens
ucacagaagcaaaucagaa

SEQ ID NO: 452537 - RNA, 19 nt, Homo sapiens
gcucucagaugguaaacgu

SEQ ID NO: 452538 - RNA, 19 nt, Homo sapiens
gaugacaacaccagaagga

SEQ ID NO: 452539 - RNA, 19 nt, Homo sapiens
guuaguccguucauugaug

SEQ ID NO: 452540 - RNA, 19 nt, Homo sapiens
guaaaugaagaacggcuaa

SEQ ID NO: 452541 - RNA, 19 nt, Homo sapiens
ccgaccacaucaagagaua

SEQ ID NO: 452542 - RNA, 19 nt, Homo sapiens
cauuucccauuucuuagua

SEQ ID NO: 452543 - RNA, 19 nt, Homo sapiens
acauuuguguuugcucuua

SEQ ID NO: 452544 - RNA, 19 nt, Homo sapiens
gugaucaccugccuuugga

SEQ ID NO: 452545 - RNA, 19 nt, Homo sapiens
cagaagcaaaucagaauau

SEQ ID NO: 452546 - RNA, 19 nt, Homo sapiens
ggaguccugcuucuuugua

SEQ ID NO: 452547 - RNA, 19 nt, Homo sapiens
gcaggucucuucgcacaag

SEQ ID NO: 452548 - RNA, 19 nt, Homo sapiens
cugaagcucuggacugaga

SEQ ID NO: 452549 - RNA, 19 nt, Homo sapiens
caaagagauuauuccagau

SEQ ID NO: 452550 - RNA, 19 nt, Homo sapiens
uaauucacuuuccuuccua

SEQ ID NO: 452551 - RNA, 19 nt, Homo sapiens
guaguuucuguaccaauua

SEQ ID NO: 452552 - RNA, 19 nt, Homo sapiens
gcugugaucaccugccuuu

SEQ ID NO: 452553 - RNA, 19 nt, Homo sapiens
gcagguuauuugagaaucu

SEQ ID NO: 452554 - RNA, 19 nt, Homo sapiens
gggaaaagcagguuauuug

SEQ ID NO: 452555 - RNA, 19 nt, Homo sapiens
gaaaaugcugccaucguua

SEQ ID NO: 452556 - RNA, 19 nt, Homo sapiens
ccucgucagucaucacuug

SEQ ID NO: 452557 - RNA, 19 nt, Homo sapiens
aauacuaccuucgccaauu

SEQ ID NO: 452558 - RNA, 19 nt, Homo sapiens
gcaucguguuucuaccuuu

SEQ ID NO: 452559 - RNA, 19 nt, Homo sapiens
ccaaguagcuccaaaugca

SEQ ID NO: 452560 - RNA, 19 nt, Homo sapiens
ccagaucuguucaugcuuu

SEQ ID NO: 452561 - RNA, 19 nt, Homo sapiens
gagcagagccuccgcugaa

SEQ ID NO: 452562 - RNA, 19 nt, Homo sapiens
ucgaauaucugaaaugaag

SEQ ID NO: 452563 - RNA, 19 nt, Homo sapiens
aaacaaaccgacucacaaa

SEQ ID NO: 452564 - RNA, 19 nt, Homo sapiens
ccagagaaauaacagacaa

SEQ ID NO: 452565 - RNA, 19 nt, Homo sapiens
gaaggucgcagcccucaga

SEQ ID NO: 452566 - RNA, 19 nt, Homo sapiens
ggagagcgccaucuucaau

SEQ ID NO: 452567 - RNA, 19 nt, Homo sapiens
ggacccagaucuguucaug

SEQ ID NO: 452568 - RNA, 19 nt, Homo sapiens
agaaauaacagacaaguca

SEQ ID NO: 452569 - RNA, 19 nt, Homo sapiens
gcguuugugucucggguua

SEQ ID NO: 452570 - RNA, 19 nt, Homo sapiens
gguggucacugcugucuuc

SEQ ID NO: 452571 - RNA, 19 nt, Homo sapiens
ggucacugcugucuucauc

SEQ ID NO: 452572 - RNA, 19 nt, Homo sapiens
uggcacagcuggugaucaa

SEQ ID NO: 452573 - RNA, 19 nt, Homo sapiens
aaacgucuuuaguggcuuu

SEQ ID NO: 452574 - RNA, 19 nt, Homo sapiens
guucaaacccucaccacuu

SEQ ID NO: 452575 - RNA, 19 nt, Homo sapiens
ggcauucccuggccacguu

SEQ ID NO: 452576 - RNA, 19 nt, Homo sapiens
acucgaauaucugaaauga

SEQ ID NO: 452577 - RNA, 19 nt, Homo sapiens
ggacaccagagaaauaaca

SEQ ID NO: 452578 - RNA, 19 nt, Homo sapiens
aaaguuccaugacucgaau

SEQ ID NO: 452579 - RNA, 19 nt, Homo sapiens
gcaccugccgagccucuuu

SEQ ID NO: 452580 - RNA, 19 nt, Homo sapiens
gugggacaccagagaaaua

SEQ ID NO: 452581 - RNA, 19 nt, Homo sapiens
gcacagcuggugaucaaag

SEQ ID NO: 452582 - RNA, 19 nt, Homo sapiens
agagcgccaucuucaauga

SEQ ID NO: 452583 - RNA, 19 nt, Homo sapiens
uucaaacccucaccacuug

SEQ ID NO: 452584 - RNA, 19 nt, Homo sapiens
caagagccagugacaagga

SEQ ID NO: 452585 - RNA, 19 nt, Homo sapiens
caggagagcgccaucuuca

SEQ ID NO: 452586 - RNA, 19 nt, Homo sapiens
gcaggagagcgccaucuuc

SEQ ID NO: 452587 - RNA, 19 nt, Homo sapiens
acucacaaaccuccaagua

SEQ ID NO: 452588 - RNA, 19 nt, Homo sapiens
ugacucgaauaucugaaau

SEQ ID NO: 452589 - RNA, 19 nt, Homo sapiens
caacccuuguuuccauaug

SEQ ID NO: 452590 - RNA, 19 nt, Homo sapiens
gaaaacaaaccgacucaca

SEQ ID NO: 452591 - RNA, 19 nt, Homo sapiens
ggagguuucaggugcagaa

SEQ ID NO: 452592 - RNA, 19 nt, Homo sapiens
gagagcgccaucuucaaug

SEQ ID NO: 452593 - RNA, 19 nt, Homo sapiens
guuugugucucggguuaaa

SEQ ID NO: 452594 - RNA, 19 nt, Homo sapiens
ccuaaggcguccucgagau

SEQ ID NO: 452595 - RNA, 19 nt, Homo sapiens
caaaccgacucacaaaccu

SEQ ID NO: 452596 - RNA, 19 nt, Homo sapiens
uuccaugacucgaauaucu

SEQ ID NO: 452597 - RNA, 19 nt, Homo sapiens
gacccggacucccuuucug

SEQ ID NO: 452598 - RNA, 19 nt, Homo sapiens
ccaacgccuucucccaugu

SEQ ID NO: 452599 - RNA, 19 nt, Homo sapiens
cccaacccuuguuuccaua

SEQ ID NO: 452600 - RNA, 19 nt, Homo sapiens
caagucacgcuggagguuu

SEQ ID NO: 452601 - RNA, 19 nt, Homo sapiens
gagaaauaacagacaaguc

SEQ ID NO: 452602 - RNA, 19 nt, Homo sapiens
caaguagcuccaaaugcaa

SEQ ID NO: 452603 - RNA, 19 nt, Homo sapiens
ccucagacacacuggaguu

SEQ ID NO: 452604 - RNA, 19 nt, Homo sapiens
cuccgcagcacccgacuua

SEQ ID NO: 452605 - RNA, 19 nt, Homo sapiens
gcgagaacaccgucauguc

SEQ ID NO: 452606 - RNA, 19 nt, Homo sapiens
augcugggcuguacaugug

SEQ ID NO: 452607 - RNA, 19 nt, Homo sapiens
ccaugacucgaauaucuga

SEQ ID NO: 452608 - RNA, 19 nt, Homo sapiens
ugggacaccagagaaauaa

SEQ ID NO: 452609 - RNA, 19 nt, Homo sapiens
uaaggcguccucgagauga

SEQ ID NO: 452610 - RNA, 19 nt, Homo sapiens
gcacagacaccggcuugcu

SEQ ID NO: 452611 - RNA, 19 nt, Homo sapiens
cuaaggcguccucgagaug

SEQ ID NO: 452612 - RNA, 19 nt, Homo sapiens
cagacacacuggaguucag

SEQ ID NO: 452613 - RNA, 19 nt, Homo sapiens
ggacauaugagguuuauua

SEQ ID NO: 452614 - RNA, 19 nt, Homo sapiens
ccaaagaugucuccagaua

SEQ ID NO: 452615 - RNA, 19 nt, Homo sapiens
gaacccaaaucauguuuau

SEQ ID NO: 452616 - RNA, 19 nt, Homo sapiens
gcccaaccaugaaauauuu

SEQ ID NO: 452617 - RNA, 19 nt, Homo sapiens
aaagaugucuccagauauu

SEQ ID NO: 452618 - RNA, 19 nt, Homo sapiens
caccacaccuggcuaauuu

SEQ ID NO: 452619 - RNA, 19 nt, Homo sapiens
caccacaccuggcuaauuu

SEQ ID NO: 452620 - RNA, 19 nt, Homo sapiens
uaaaggagccauauauuga

SEQ ID NO: 452621 - RNA, 19 nt, Homo sapiens
ccgaguagcugagauuaua

SEQ ID NO: 452622 - RNA, 19 nt, Homo sapiens
gagacaggguuucaccaua

SEQ ID NO: 452623 - RNA, 19 nt, Homo sapiens
gagacaggguuucaccaua

SEQ ID NO: 452624 - RNA, 19 nt, Homo sapiens
gaacccaauucuccuauuc

SEQ ID NO: 452625 - RNA, 19 nt, Homo sapiens
gaacuucuuuacugauguu

SEQ ID NO: 452626 - RNA, 19 nt, Homo sapiens
guaaaggagccauauauug

SEQ ID NO: 452627 - RNA, 19 nt, Homo sapiens
acaagaagauggaauaaag

SEQ ID NO: 452628 - RNA, 19 nt, Homo sapiens
gaacaacauguacuugaaa

SEQ ID NO: 452629 - RNA, 19 nt, Homo sapiens
gggagcacuugaacaauuu

SEQ ID NO: 452630 - RNA, 19 nt, Homo sapiens
caagaucgcuccggguuga

SEQ ID NO: 452631 - RNA, 19 nt, Homo sapiens
gagcuucuacuuuguaauu

SEQ ID NO: 452632 - RNA, 19 nt, Homo sapiens
ccacagagcuaaacguuuu

SEQ ID NO: 452633 - RNA, 19 nt, Homo sapiens
cgaacaacauguacuugaa

SEQ ID NO: 452634 - RNA, 19 nt, Homo sapiens
caagugcauuugacagaaa

SEQ ID NO: 452635 - RNA, 19 nt, Homo sapiens
agacaggguuucaccauau

SEQ ID NO: 452636 - RNA, 19 nt, Homo sapiens
agacaggguuucaccauau

SEQ ID NO: 452637 - RNA, 19 nt, Homo sapiens
uaaagauguuugcucaaga

SEQ ID NO: 452638 - RNA, 19 nt, Homo sapiens
cagcuuaucuaaaccuaau

SEQ ID NO: 452639 - RNA, 19 nt, Homo sapiens
ucaagaagccaaagaaaca

SEQ ID NO: 452640 - RNA, 19 nt, Homo sapiens
gguaaaggagccauauauu

SEQ ID NO: 452641 - RNA, 19 nt, Homo sapiens
ucugggagcuucuacuuug

SEQ ID NO: 452642 - RNA, 19 nt, Homo sapiens
ugggagcacuugaacaauu

SEQ ID NO: 452643 - RNA, 19 nt, Homo sapiens
aauaguacauucugucuca

SEQ ID NO: 452644 - RNA, 19 nt, Homo sapiens
caaagaaaagcuuggauua

SEQ ID NO: 452645 - RNA, 19 nt, Homo sapiens
ggagugcaauggcaguugu

SEQ ID NO: 452646 - RNA, 19 nt, Homo sapiens
gacaggguuucaccauauu

SEQ ID NO: 452647 - RNA, 19 nt, Homo sapiens
gacaggguuucaccauauu

SEQ ID NO: 452648 - RNA, 19 nt, Homo sapiens
gaagauggaauaaagaacu

SEQ ID NO: 452649 - RNA, 19 nt, Homo sapiens
ccaaagugcugggauuaca

SEQ ID NO: 452650 - RNA, 19 nt, Homo sapiens
gggagcuucuacuuuguaa

SEQ ID NO: 452651 - RNA, 19 nt, Homo sapiens
ggagugcaguggcgcaauc

SEQ ID NO: 452652 - RNA, 19 nt, Homo sapiens
gcugggaauugucucuuug

SEQ ID NO: 452653 - RNA, 19 nt, Homo sapiens
uaaauagccuggaaaacuu

SEQ ID NO: 452654 - RNA, 19 nt, Homo sapiens
uugcuucugucacuuuaua

SEQ ID NO: 452655 - RNA, 19 nt, Homo sapiens
caauugguauuuccuugug

SEQ ID NO: 452656 - RNA, 19 nt, Homo sapiens
gagguaaaggagccauaua

SEQ ID NO: 452657 - RNA, 19 nt, Homo sapiens
caagaagauggaauaaaga

SEQ ID NO: 452658 - RNA, 19 nt, Homo sapiens
ugacauaagacaagaagau

SEQ ID NO: 452659 - RNA, 19 nt, Homo sapiens
ccaaaguacugggauuaca

SEQ ID NO: 452660 - RNA, 19 nt, Homo sapiens
ccucguagaugagaacaug

SEQ ID NO: 452661 - RNA, 19 nt, Homo sapiens
ccaaagugcuaggauuaca

SEQ ID NO: 452662 - RNA, 19 nt, Homo sapiens
ccgaguagcugggauuaca

SEQ ID NO: 452663 - RNA, 19 nt, Homo sapiens
caaagaugucuccagauau

SEQ ID NO: 452664 - RNA, 19 nt, Homo sapiens
gacaagaagauggaauaaa

SEQ ID NO: 452665 - RNA, 19 nt, Homo sapiens
gacauugcguuuccguugu

SEQ ID NO: 452666 - RNA, 19 nt, Homo sapiens
guugauacucguacuugua

SEQ ID NO: 452667 - RNA, 19 nt, Homo sapiens
gagaacccaaaucauguuu

SEQ ID NO: 452668 - RNA, 19 nt, Homo sapiens
aagacaagaagauggaaua

SEQ ID NO: 452669 - RNA, 19 nt, Homo sapiens
gguuuauuaugcuucauga

SEQ ID NO: 452670 - RNA, 19 nt, Homo sapiens
ggaaggcagaauccaaaga

SEQ ID NO: 452671 - RNA, 19 nt, Homo sapiens
ggcaguuguuucaccguaa

SEQ ID NO: 452672 - RNA, 19 nt, Homo sapiens
ucccaaagugcuaggauua

SEQ ID NO: 452673 - RNA, 19 nt, Homo sapiens
ugucucaugucacguauca

SEQ ID NO: 452674 - RNA, 19 nt, Homo sapiens
ggcugggaauugucucuuu

SEQ ID NO: 452675 - RNA, 19 nt, Homo sapiens
aagcaauucuccuucuuca

SEQ ID NO: 452676 - RNA, 19 nt, Homo sapiens
ucaagcaauucuccuucuu

SEQ ID NO: 452677 - RNA, 19 nt, Homo sapiens
aagcaauucuccuucuuca

SEQ ID NO: 452678 - RNA, 19 nt, Homo sapiens
ucaagcaauucuccuucuu

SEQ ID NO: 452679 - RNA, 19 nt, Homo sapiens
gguauuuccuugugaacag

SEQ ID NO: 452680 - RNA, 19 nt, Homo sapiens
guugagauccacagagcua

SEQ ID NO: 452681 - RNA, 19 nt, Homo sapiens
gauggaguuucgcucuguu

SEQ ID NO: 452682 - RNA, 19 nt, Homo sapiens
ugacuuacccaauucagau

SEQ ID NO: 452683 - RNA, 19 nt, Homo sapiens
gaaaagcuuggauuacauu

SEQ ID NO: 452684 - RNA, 19 nt, Homo sapiens
ugugagaacccaaaucaug

SEQ ID NO: 452685 - RNA, 19 nt, Homo sapiens
agucaagauuugguagaua

SEQ ID NO: 452686 - RNA, 19 nt, Homo sapiens
caaccauugugugcuguga

SEQ ID NO: 452687 - RNA, 19 nt, Homo sapiens
gguguauacucaggaaugu

SEQ ID NO: 452688 - RNA, 19 nt, Homo sapiens
cauaagacaagaagaugga

SEQ ID NO: 452689 - RNA, 19 nt, Homo sapiens
ccaccaugauaauccaguu

SEQ ID NO: 452690 - RNA, 19 nt, Homo sapiens
auaaagauguuugcucaag

SEQ ID NO: 452691 - RNA, 19 nt, Homo sapiens
cuccagauauugccagaug

SEQ ID NO: 452692 - RNA, 19 nt, Homo sapiens
aaaggagccauauauugaa

SEQ ID NO: 452693 - RNA, 19 nt, Homo sapiens
gaaggcagaauccaaagac

SEQ ID NO: 452694 - RNA, 19 nt, Homo sapiens
gugagaacccaaaucaugu

SEQ ID NO: 452695 - RNA, 19 nt, Homo sapiens
gaagccaaagaaacacuug

SEQ ID NO: 452696 - RNA, 19 nt, Homo sapiens
ucaggaagugcugggauua

SEQ ID NO: 452697 - RNA, 19 nt, Homo sapiens
ccacccaccucaggaagug

SEQ ID NO: 452698 - RNA, 19 nt, Homo sapiens
ccaccgugcccaaccauga

SEQ ID NO: 452699 - RNA, 19 nt, Homo sapiens
gauguccucuuggaagcaa

SEQ ID NO: 452700 - RNA, 19 nt, Homo sapiens
ucacguaucaauagaucaa

SEQ ID NO: 452701 - RNA, 19 nt, Homo sapiens
caugucacguaucaauaga

SEQ ID NO: 452702 - RNA, 19 nt, Homo sapiens
ugaacccaauucuccuauu

SEQ ID NO: 452703 - RNA, 19 nt, Homo sapiens
caagugugacaaccaaaga

SEQ ID NO: 452704 - RNA, 19 nt, Homo sapiens
gggaauugucucuuuguuc

SEQ ID NO: 452705 - RNA, 19 nt, Homo sapiens
aagcuuggauuacauuaac

SEQ ID NO: 452706 - RNA, 19 nt, Homo sapiens
ccaccagaggcuaggaaua

SEQ ID NO: 452707 - RNA, 19 nt, Homo sapiens
gauagguugaucuuaaugu

SEQ ID NO: 452708 - RNA, 19 nt, Homo sapiens
ccaccacaccuggcuaauu

SEQ ID NO: 452709 - RNA, 19 nt, Homo sapiens
ccaccacaccuggcuaauu

SEQ ID NO: 452710 - RNA, 19 nt, Homo sapiens
ccuauucgaucaagugcau

SEQ ID NO: 452711 - RNA, 19 nt, Homo sapiens
gacauaagacaagaagaug

SEQ ID NO: 452712 - RNA, 19 nt, Homo sapiens
caaguucaacgagugguuu

SEQ ID NO: 452713 - RNA, 19 nt, Homo sapiens
caaaggcucuuguauauua

SEQ ID NO: 452714 - RNA, 19 nt, Homo sapiens
gaagugggcuacaaauuua

SEQ ID NO: 452715 - RNA, 19 nt, Homo sapiens
ccaggaaacuuaaguauuu

SEQ ID NO: 452716 - RNA, 19 nt, Homo sapiens
gugaugaucugaugauuua

SEQ ID NO: 452717 - RNA, 19 nt, Homo sapiens
ggaaggaagugacauugua

SEQ ID NO: 452718 - RNA, 19 nt, Homo sapiens
gaaacaggcugacacuauu

SEQ ID NO: 452719 - RNA, 19 nt, Homo sapiens
uaaagugacugcacaagua

SEQ ID NO: 452720 - RNA, 19 nt, Homo sapiens
uaagaaagcugcugacaug

SEQ ID NO: 452721 - RNA, 19 nt, Homo sapiens
gaacaugaauuugcuaaga

SEQ ID NO: 452722 - RNA, 19 nt, Homo sapiens
gaaacaaacauucgagaua

SEQ ID NO: 452723 - RNA, 19 nt, Homo sapiens
ccagaaagcugcugaacaa

SEQ ID NO: 452724 - RNA, 19 nt, Homo sapiens
gaagcagccuugauaugua

SEQ ID NO: 452725 - RNA, 19 nt, Homo sapiens
ggaaguaugcuuagauuaa

SEQ ID NO: 452726 - RNA, 19 nt, Homo sapiens
caagaugacuaccaacuuu

SEQ ID NO: 452727 - RNA, 19 nt, Homo sapiens
gaauuaagcucggagacua

SEQ ID NO: 452728 - RNA, 19 nt, Homo sapiens
gaauacggcugccugauga

SEQ ID NO: 452729 - RNA, 19 nt, Homo sapiens
ggaagugggcuacaaauuu

SEQ ID NO: 452730 - RNA, 19 nt, Homo sapiens
ggcaaaggcucuuguauau

SEQ ID NO: 452731 - RNA, 19 nt, Homo sapiens
gaacugcgauaacugagaa

SEQ ID NO: 452732 - RNA, 19 nt, Homo sapiens
ggagaggaguucaaguuaa

SEQ ID NO: 452733 - RNA, 19 nt, Homo sapiens
gcaaauaggaguuggguuu

SEQ ID NO: 452734 - RNA, 19 nt, Homo sapiens
cgagagagauguuugagaa

SEQ ID NO: 452735 - RNA, 19 nt, Homo sapiens
gaaaugcaguauaaagguu

SEQ ID NO: 452736 - RNA, 19 nt, Homo sapiens
gcaccgauguagauuauga

SEQ ID NO: 452737 - RNA, 19 nt, Homo sapiens
gcauuugguuuguugguua

SEQ ID NO: 452738 - RNA, 19 nt, Homo sapiens
gauaucagcuuucuagagu

SEQ ID NO: 452739 - RNA, 19 nt, Homo sapiens
aaacaggccuugaaguauu

SEQ ID NO: 452740 - RNA, 19 nt, Homo sapiens
caagagagauuauaaacag

SEQ ID NO: 452741 - RNA, 19 nt, Homo sapiens
gaagauaucagcuuucuag

SEQ ID NO: 452742 - RNA, 19 nt, Homo sapiens
uaaacuaacuccaggauuc

SEQ ID NO: 452743 - RNA, 19 nt, Homo sapiens
ggaaagaugauuuguaugu

SEQ ID NO: 452744 - RNA, 19 nt, Homo sapiens
guguauagcauguguauua

SEQ ID NO: 452745 - RNA, 19 nt, Homo sapiens
gcaguggaguuguuuaaga

SEQ ID NO: 452746 - RNA, 19 nt, Homo sapiens
gagaggaguucaaguuaau

SEQ ID NO: 452747 - RNA, 19 nt, Homo sapiens
uagaagagauguacagaau

SEQ ID NO: 452748 - RNA, 19 nt, Homo sapiens
gaaagugucacagaagaua

SEQ ID NO: 452749 - RNA, 19 nt, Homo sapiens
gaagagauguacagaaucg

SEQ ID NO: 452750 - RNA, 19 nt, Homo sapiens
gugagagucuuaccacuaa

SEQ ID NO: 452751 - RNA, 19 nt, Homo sapiens
gauagaguguggcuucauu

SEQ ID NO: 452752 - RNA, 19 nt, Homo sapiens
aaacuuuccucccagauaa

SEQ ID NO: 452753 - RNA, 19 nt, Homo sapiens
guaaugggcuuuguacguu

SEQ ID NO: 452754 - RNA, 19 nt, Homo sapiens
auacuaaccuucaugcuuu

SEQ ID NO: 452755 - RNA, 19 nt, Homo sapiens
gaucacagacacagacaua

SEQ ID NO: 452756 - RNA, 19 nt, Homo sapiens
ggacuaagugggagaaauu

SEQ ID NO: 452757 - RNA, 19 nt, Homo sapiens
ggaauggaauauacuuaug

SEQ ID NO: 452758 - RNA, 19 nt, Homo sapiens
guugggagguuucuuauug

SEQ ID NO: 452759 - RNA, 19 nt, Homo sapiens
gagaaaggacugggcauua

SEQ ID NO: 452760 - RNA, 19 nt, Homo sapiens
guaucaaacuggaaugaaa

SEQ ID NO: 452761 - RNA, 19 nt, Homo sapiens
uuacagagguucggacuaa

SEQ ID NO: 452762 - RNA, 19 nt, Homo sapiens
aggauugucugguuaaaua

SEQ ID NO: 452763 - RNA, 19 nt, Homo sapiens
cuaaauaugcucugaguaa

SEQ ID NO: 452764 - RNA, 19 nt, Homo sapiens
gagcuuuacuucuuuggaa

SEQ ID NO: 452765 - RNA, 19 nt, Homo sapiens
ccaaucauguugcuaguga

SEQ ID NO: 452766 - RNA, 19 nt, Homo sapiens
gagugaacauguacacaaa

SEQ ID NO: 452767 - RNA, 19 nt, Homo sapiens
ggaaagugcagucuuguug

SEQ ID NO: 452768 - RNA, 19 nt, Homo sapiens
gagagaagcaagcauugua

SEQ ID NO: 452769 - RNA, 19 nt, Homo sapiens
gcucuuggcuuucuguaug

SEQ ID NO: 452770 - RNA, 19 nt, Homo sapiens
gcagcaagcaugaaccaua

SEQ ID NO: 452771 - RNA, 19 nt, Homo sapiens
cucaagaucucaaauugua

SEQ ID NO: 452772 - RNA, 19 nt, Homo sapiens
gcucaauacuuaccuaauc

SEQ ID NO: 452773 - RNA, 19 nt, Homo sapiens
uaaugaacaugaaggcuuu

SEQ ID NO: 452774 - RNA, 19 nt, Homo sapiens
gaacugacuccuugcacua

SEQ ID NO: 452775 - RNA, 19 nt, Homo sapiens
gcaggaagcagaaaugaug

SEQ ID NO: 452776 - RNA, 19 nt, Homo sapiens
caugguaccuaagcaaaua

SEQ ID NO: 452777 - RNA, 19 nt, Homo sapiens
ccagauaauugcuuccaaa

SEQ ID NO: 452778 - RNA, 19 nt, Homo sapiens
guacuguucuauacuauuc

SEQ ID NO: 452779 - RNA, 19 nt, Homo sapiens
gaaaauagaacuugccuuu

SEQ ID NO: 452780 - RNA, 19 nt, Homo sapiens
agaaaggacugggcauuaa

SEQ ID NO: 452781 - RNA, 19 nt, Homo sapiens
gcauaucgguaucuccaaa

SEQ ID NO: 452782 - RNA, 19 nt, Homo sapiens
agaagaggcugcuaagaga

SEQ ID NO: 452783 - RNA, 19 nt, Homo sapiens
cuacuaugcuucaggauug

SEQ ID NO: 452784 - RNA, 19 nt, Homo sapiens
gagcuuugcuacauuggaa

SEQ ID NO: 452785 - RNA, 19 nt, Homo sapiens
ucacuuacgucacuacuuc

SEQ ID NO: 452786 - RNA, 19 nt, Homo sapiens
gcuacagccucuuuccuaa

SEQ ID NO: 452787 - RNA, 19 nt, Homo sapiens
agucaucacucucaaauau

SEQ ID NO: 452788 - RNA, 19 nt, Homo sapiens
gggaaagugucacagaaga

SEQ ID NO: 452789 - RNA, 19 nt, Homo sapiens
gaauggugucuuucaaaua

SEQ ID NO: 452790 - RNA, 19 nt, Homo sapiens
aguaguugcuggucaaaua

SEQ ID NO: 452791 - RNA, 19 nt, Homo sapiens
ccacaugcaauuaaacaua

SEQ ID NO: 452792 - RNA, 19 nt, Homo sapiens
gaaaggacugggcauuaaa

SEQ ID NO: 452793 - RNA, 19 nt, Homo sapiens
ggaauggccuaccucuaug

SEQ ID NO: 452794 - RNA, 19 nt, Homo sapiens
uauccuguaugcuguaaua

SEQ ID NO: 452795 - RNA, 19 nt, Homo sapiens
uaaacucagugguugauga

SEQ ID NO: 452796 - RNA, 19 nt, Homo sapiens
cuuagaaucugaugccuuu

SEQ ID NO: 452797 - RNA, 19 nt, Homo sapiens
gaggaguucaaguuaauua

SEQ ID NO: 452798 - RNA, 19 nt, Homo sapiens
agacagcucuccacuacuu

SEQ ID NO: 452799 - RNA, 19 nt, Homo sapiens
uaaggaguaugaugaaugu

SEQ ID NO: 452800 - RNA, 19 nt, Homo sapiens
gaucucaaauuguacuugu

SEQ ID NO: 452801 - RNA, 19 nt, Homo sapiens
aaucaagagugaacaugua

SEQ ID NO: 452802 - RNA, 19 nt, Homo sapiens
aaagguuggugaaguguaa

SEQ ID NO: 452803 - RNA, 19 nt, Homo sapiens
gcauguguauuaaugucua

SEQ ID NO: 452804 - RNA, 19 nt, Homo sapiens
gcacaaggaagcauugaau

SEQ ID NO: 452805 - RNA, 19 nt, Homo sapiens
gggagaggaguucaaguua

SEQ ID NO: 452806 - RNA, 19 nt, Homo sapiens
gcuagaagaagauuugauu

SEQ ID NO: 452807 - RNA, 19 nt, Homo sapiens
ccaaagcccuggagagagu

SEQ ID NO: 452808 - RNA, 19 nt, Homo sapiens
gaguaaaggagaaaugaaa

SEQ ID NO: 452809 - RNA, 19 nt, Homo sapiens
cacuuuagccugauuauaa

SEQ ID NO: 452810 - RNA, 19 nt, Homo sapiens
aguauucucuugugcauuu

SEQ ID NO: 452811 - RNA, 19 nt, Homo sapiens
cauauggaguaacaacuuu

SEQ ID NO: 452812 - RNA, 19 nt, Homo sapiens
gaacacuugcauuugauuu

SEQ ID NO: 452813 - RNA, 19 nt, Homo sapiens
gaaauuagcugugugaaau

SEQ ID NO: 452814 - RNA, 19 nt, Homo sapiens
gaacacaaccuguacauuu

SEQ ID NO: 452815 - RNA, 19 nt, Homo sapiens
gaagaaggauuugaacuaa

SEQ ID NO: 452816 - RNA, 19 nt, Homo sapiens
gagcaagcauuuauguuua

SEQ ID NO: 452817 - RNA, 19 nt, Homo sapiens
gaaugaagaugucuaauag

SEQ ID NO: 452818 - RNA, 19 nt, Homo sapiens
gcacagaaacacaauauuu

SEQ ID NO: 452819 - RNA, 19 nt, Homo sapiens
ggagggauuugaauuauau

SEQ ID NO: 452820 - RNA, 19 nt, Homo sapiens
ccaaaggaaucuccaguuu

SEQ ID NO: 452821 - RNA, 19 nt, Homo sapiens
uaaaugcugucaacuauga

SEQ ID NO: 452822 - RNA, 19 nt, Homo sapiens
gagcgaggcuacaugaauu

SEQ ID NO: 452823 - RNA, 19 nt, Homo sapiens
gcaaugugguugaguguga

SEQ ID NO: 452824 - RNA, 19 nt, Homo sapiens
guagagaccaucaauaauu

SEQ ID NO: 452825 - RNA, 19 nt, Homo sapiens
aauagaaacucaccaugua

SEQ ID NO: 452826 - RNA, 19 nt, Homo sapiens
ucaagaaaguguuggcuaa

SEQ ID NO: 452827 - RNA, 19 nt, Homo sapiens
caugauugcuucacaguuu

SEQ ID NO: 452828 - RNA, 19 nt, Homo sapiens
ccacggaagcuaugacuua

SEQ ID NO: 452829 - RNA, 19 nt, Homo sapiens
cgaaugaagaugucuaaua

SEQ ID NO: 452830 - RNA, 19 nt, Homo sapiens
ccugagagauccuguguuu

SEQ ID NO: 452831 - RNA, 19 nt, Homo sapiens
ccaagacucugaaaucuca

SEQ ID NO: 452832 - RNA, 19 nt, Homo sapiens
uaacuuagcauguguugaa

SEQ ID NO: 452833 - RNA, 19 nt, Homo sapiens
gaauaaaguucugaguguu

SEQ ID NO: 452834 - RNA, 19 nt, Homo sapiens
gagaacaacuacugugauc

SEQ ID NO: 452835 - RNA, 19 nt, Homo sapiens
gcaaacacacaaagguaua

SEQ ID NO: 452836 - RNA, 19 nt, Homo sapiens
agaagaagcuugcccuaug

SEQ ID NO: 452837 - RNA, 19 nt, Homo sapiens
uaccuaaacuccauauuga

SEQ ID NO: 452838 - RNA, 19 nt, Homo sapiens
gaggagggauuugaauuau

SEQ ID NO: 452839 - RNA, 19 nt, Homo sapiens
gggauucagugcuucuuaa

SEQ ID NO: 452840 - RNA, 19 nt, Homo sapiens
gccaaagccuugaaucaga

SEQ ID NO: 452841 - RNA, 19 nt, Homo sapiens
cggaagcuaugacuuauga

SEQ ID NO: 452842 - RNA, 19 nt, Homo sapiens
gaucagaacagcagagguu

SEQ ID NO: 452843 - RNA, 19 nt, Homo sapiens
ugagagauccuguguuuga

SEQ ID NO: 452844 - RNA, 19 nt, Homo sapiens
aaacagagaugugauaagg

SEQ ID NO: 452845 - RNA, 19 nt, Homo sapiens
ggguuacuaugcacaauuu

SEQ ID NO: 452846 - RNA, 19 nt, Homo sapiens
acacugaaguuaacagaga

SEQ ID NO: 452847 - RNA, 19 nt, Homo sapiens
gcugugaguucuccuguga

SEQ ID NO: 452848 - RNA, 19 nt, Homo sapiens
gcccagagccuucagugua

SEQ ID NO: 452849 - RNA, 19 nt, Homo sapiens
ucaguggacucaaguguga

SEQ ID NO: 452850 - RNA, 19 nt, Homo sapiens
gcuauucaccaaguuauua

SEQ ID NO: 452851 - RNA, 19 nt, Homo sapiens
guaccuaaacuccauauug

SEQ ID NO: 452852 - RNA, 19 nt, Homo sapiens
ugucaacuaugauauggua

SEQ ID NO: 452853 - RNA, 19 nt, Homo sapiens
uguaaaugcugucaacuau

SEQ ID NO: 452854 - RNA, 19 nt, Homo sapiens
agaaaguguuggcuaauga

SEQ ID NO: 452855 - RNA, 19 nt, Homo sapiens
caacacccaucaccacuuc

SEQ ID NO: 452856 - RNA, 19 nt, Homo sapiens
caaaucauccugcaacuuc

SEQ ID NO: 452857 - RNA, 19 nt, Homo sapiens
agaaggauuugaacuaaug

SEQ ID NO: 452858 - RNA, 19 nt, Homo sapiens
ugaagaaggauuugaacua

SEQ ID NO: 452859 - RNA, 19 nt, Homo sapiens
ugaggagggauuugaauua

SEQ ID NO: 452860 - RNA, 19 nt, Homo sapiens
guguagagaccaucaauaa

SEQ ID NO: 452861 - RNA, 19 nt, Homo sapiens
ggcaugauguuaaccagaa

SEQ ID NO: 452862 - RNA, 19 nt, Homo sapiens
caucaccacuucaauagau

SEQ ID NO: 452863 - RNA, 19 nt, Homo sapiens
gacagaggcagcagugaua

SEQ ID NO: 452864 - RNA, 19 nt, Homo sapiens
gaagaagcuugcccuaugc

SEQ ID NO: 452865 - RNA, 19 nt, Homo sapiens
guggagaucuacaucaaga

SEQ ID NO: 452866 - RNA, 19 nt, Homo sapiens
gaagagauugaguaccuaa

SEQ ID NO: 452867 - RNA, 19 nt, Homo sapiens
guugaucacuggcaaugaa

SEQ ID NO: 452868 - RNA, 19 nt, Homo sapiens
cagcagagguucuuuuaaa

SEQ ID NO: 452869 - RNA, 19 nt, Homo sapiens
ugagcaagcauuuauguuu

SEQ ID NO: 452870 - RNA, 19 nt, Homo sapiens
guaaaagagucaucuggua

SEQ ID NO: 452871 - RNA, 19 nt, Homo sapiens
ggaaaagaauacagaaaga

SEQ ID NO: 452872 - RNA, 19 nt, Homo sapiens
gugcaaauccuacugaaug

SEQ ID NO: 452873 - RNA, 19 nt, Homo sapiens
gagagaacaacuacuguga

SEQ ID NO: 452874 - RNA, 19 nt, Homo sapiens
gagcauggaagccugguuu

SEQ ID NO: 452875 - RNA, 19 nt, Homo sapiens
gaccaagacucugaaaucu

SEQ ID NO: 452876 - RNA, 19 nt, Homo sapiens
ggaauugggacaacgagaa

SEQ ID NO: 452877 - RNA, 19 nt, Homo sapiens
ccaauggguucguggaaug

SEQ ID NO: 452878 - RNA, 19 nt, Homo sapiens
gagcaaauugugaacugua

SEQ ID NO: 452879 - RNA, 19 nt, Homo sapiens
acaaagaagagauugagua

SEQ ID NO: 452880 - RNA, 19 nt, Homo sapiens
uagcaaggcaugauguuaa

SEQ ID NO: 452881 - RNA, 19 nt, Homo sapiens
acacuggucuggccugcua

SEQ ID NO: 452882 - RNA, 19 nt, Homo sapiens
ggaaacuucagcuacaauu

SEQ ID NO: 452883 - RNA, 19 nt, Homo sapiens
acacacaccugguugcaau

SEQ ID NO: 452884 - RNA, 19 nt, Homo sapiens
gcuuaugucagaccuauuu

SEQ ID NO: 452885 - RNA, 19 nt, Homo sapiens
gaaauaagagagaacaacu

SEQ ID NO: 452886 - RNA, 19 nt, Homo sapiens
ucucucagcucucacuuug

SEQ ID NO: 452887 - RNA, 19 nt, Homo sapiens
gaugugcuuugcauuccua

SEQ ID NO: 452888 - RNA, 19 nt, Homo sapiens
gauguuaaccagaauaaag

SEQ ID NO: 452889 - RNA, 19 nt, Homo sapiens
uaaacuccauauugagcua

SEQ ID NO: 452890 - RNA, 19 nt, Homo sapiens
ugacauaacacuauaaagg

SEQ ID NO: 452891 - RNA, 19 nt, Homo sapiens
acagagaugugauaaggau

SEQ ID NO: 452892 - RNA, 19 nt, Homo sapiens
gaaaguguuggcuaaugaa

SEQ ID NO: 452893 - RNA, 19 nt, Homo sapiens
gggauacacugaaguuaac

SEQ ID NO: 452894 - RNA, 19 nt, Homo sapiens
gaagcuaugacuuaugaug

SEQ ID NO: 452895 - RNA, 19 nt, Homo sapiens
gagagauccuguguuugaa

SEQ ID NO: 452896 - RNA, 19 nt, Homo sapiens
ucagaccuauuugacauaa

SEQ ID NO: 452897 - RNA, 19 nt, Homo sapiens
caauagaaacucaccaugu

SEQ ID NO: 452898 - RNA, 19 nt, Homo sapiens
gaacaacugcuucccaaaa

SEQ ID NO: 452899 - RNA, 19 nt, Homo sapiens
caaguucgccuguccugaa

SEQ ID NO: 452900 - RNA, 19 nt, Homo sapiens
gaacuguacagcccuggaa

SEQ ID NO: 452901 - RNA, 19 nt, Homo sapiens
gaacaacuacugugaucag

SEQ ID NO: 452902 - RNA, 19 nt, Homo sapiens
uaagagagaacaacuacug

SEQ ID NO: 452903 - RNA, 19 nt, Homo sapiens
uaacagagacagauaacuc

SEQ ID NO: 452904 - RNA, 19 nt, Homo sapiens
gcguggagaucuacaucaa

SEQ ID NO: 452905 - RNA, 19 nt, Homo sapiens
cuacacuuccauuaacuua

SEQ ID NO: 452906 - RNA, 19 nt, Homo sapiens
gaaguuaacagagacagau

SEQ ID NO: 452907 - RNA, 19 nt, Homo sapiens
aacacaaccuguacauuug

SEQ ID NO: 452908 - RNA, 19 nt, Homo sapiens
ugacaaauccagccaaugg

SEQ ID NO: 452909 - RNA, 19 nt, Homo sapiens
ggagaucuacaucaagaga

SEQ ID NO: 452910 - RNA, 19 nt, Homo sapiens
gaacccaacaauaggcaaa

SEQ ID NO: 452911 - RNA, 19 nt, Homo sapiens
ccaggugaacccaacaaua

SEQ ID NO: 452912 - RNA, 19 nt, Homo sapiens
cuaaugaagggaaaggaua

SEQ ID NO: 452913 - RNA, 19 nt, Homo sapiens
gaacugggcugauaaugaa

SEQ ID NO: 452914 - RNA, 19 nt, Homo sapiens
gcucagaacuacauguuaa

SEQ ID NO: 452915 - RNA, 19 nt, Homo sapiens
gagaggagccgauauaguu

SEQ ID NO: 452916 - RNA, 19 nt, Homo sapiens
ccagaaagauuggauugua

SEQ ID NO: 452917 - RNA, 19 nt, Homo sapiens
gcugagaacugggcugaua

SEQ ID NO: 452918 - RNA, 19 nt, Homo sapiens
cagcauggacuuaucauua

SEQ ID NO: 452919 - RNA, 19 nt, Homo sapiens
gaaagcagguggcaucucu

SEQ ID NO: 452920 - RNA, 19 nt, Homo sapiens
gaagagggauuugcauuag

SEQ ID NO: 452921 - RNA, 19 nt, Homo sapiens
ucuggaaucuggacaaaua

SEQ ID NO: 452922 - RNA, 19 nt, Homo sapiens
gaaagaacaauaagacaug

SEQ ID NO: 452923 - RNA, 19 nt, Homo sapiens
gcagguggcaucucuaauu

SEQ ID NO: 452924 - RNA, 19 nt, Homo sapiens
gcaguagucucugugcuuu

SEQ ID NO: 452925 - RNA, 19 nt, Homo sapiens
guaaagcugugcaguguca

SEQ ID NO: 452926 - RNA, 19 nt, Homo sapiens
gcauacucauggaauauuu

SEQ ID NO: 452927 - RNA, 19 nt, Homo sapiens
ugagagcguuucaguauga

SEQ ID NO: 452928 - RNA, 19 nt, Homo sapiens
ugacucaccuguuacuuga

SEQ ID NO: 452929 - RNA, 19 nt, Homo sapiens
gcccugaucucugaacuaa

SEQ ID NO: 452930 - RNA, 19 nt, Homo sapiens
ccaaagaccaauauucaaa

SEQ ID NO: 452931 - RNA, 19 nt, Homo sapiens
caaagagacuggagcaucu

SEQ ID NO: 452932 - RNA, 19 nt, Homo sapiens
cuaaacagccugacacuga

SEQ ID NO: 452933 - RNA, 19 nt, Homo sapiens
ggacaugggugggaaccaa

SEQ ID NO: 452934 - RNA, 19 nt, Homo sapiens
ggaauuaccuuagauuagc

SEQ ID NO: 452935 - RNA, 19 nt, Homo sapiens
cuagagggccaguuacuua

SEQ ID NO: 452936 - RNA, 19 nt, Homo sapiens
ugaagagggauuugcauua

SEQ ID NO: 452937 - RNA, 19 nt, Homo sapiens
gagagaguguggagaacuu

SEQ ID NO: 452938 - RNA, 19 nt, Homo sapiens
gaaauaccagugaaccaaa

SEQ ID NO: 452939 - RNA, 19 nt, Homo sapiens
ccaaauagccaucuuguac

SEQ ID NO: 452940 - RNA, 19 nt, Homo sapiens
aaagcauacucauggaaua

SEQ ID NO: 452941 - RNA, 19 nt, Homo sapiens
gacauggaauuaccuuaga

SEQ ID NO: 452942 - RNA, 19 nt, Homo sapiens
cauaaacacccaugaauca

SEQ ID NO: 452943 - RNA, 19 nt, Homo sapiens
uacaauaggucugauaaug

SEQ ID NO: 452944 - RNA, 19 nt, Homo sapiens
gaaaugcucagaacuacau

SEQ ID NO: 452945 - RNA, 19 nt, Homo sapiens
gcugagaggagccgauaua

SEQ ID NO: 452946 - RNA, 19 nt, Homo sapiens
uaacaaaccagaaagaagu

SEQ ID NO: 452947 - RNA, 19 nt, Homo sapiens
agaguggucuuuggaauuu

SEQ ID NO: 452948 - RNA, 19 nt, Homo sapiens
gcaaauguuucugcaguag

SEQ ID NO: 452949 - RNA, 19 nt, Homo sapiens
gauauaguucggugugaua

SEQ ID NO: 452950 - RNA, 19 nt, Homo sapiens
caaacagcaugccaagaga

SEQ ID NO: 452951 - RNA, 19 nt, Homo sapiens
caaaugacccaaagaccaa

SEQ ID NO: 452952 - RNA, 19 nt, Homo sapiens
gcuccuggcuuugcuaaga

SEQ ID NO: 452953 - RNA, 19 nt, Homo sapiens
ucaaucugcucuuuccauu

SEQ ID NO: 452954 - RNA, 19 nt, Homo sapiens
cagaggagauggccaacug

SEQ ID NO: 452955 - RNA, 19 nt, Homo sapiens
gugggacgcuccuggcuuu

SEQ ID NO: 452956 - RNA, 19 nt, Homo sapiens
caagugcccagaacucuuu

SEQ ID NO: 452957 - RNA, 19 nt, Homo sapiens
gaaguuccaguuauaaauc

SEQ ID NO: 452958 - RNA, 19 nt, Homo sapiens
aaauaagccuccacagugu

SEQ ID NO: 452959 - RNA, 19 nt, Homo sapiens
cagguggcaucucuaauug

SEQ ID NO: 452960 - RNA, 19 nt, Homo sapiens
gagaguggucuuuggaauu

SEQ ID NO: 452961 - RNA, 19 nt, Homo sapiens
uaauggcucugcacaaaca

SEQ ID NO: 452962 - RNA, 19 nt, Homo sapiens
cuuaauggcucugcacaaa

SEQ ID NO: 452963 - RNA, 19 nt, Homo sapiens
gauaaugaaccuaacaaca

SEQ ID NO: 452964 - RNA, 19 nt, Homo sapiens
gguggcaucucuaauugga

SEQ ID NO: 452965 - RNA, 19 nt, Homo sapiens
gcaaaggcauagcaucacu

SEQ ID NO: 452966 - RNA, 19 nt, Homo sapiens
gugaggcuauuucguguga

SEQ ID NO: 452967 - RNA, 19 nt, Homo sapiens
ccugaucucugaacuaaca

SEQ ID NO: 452968 - RNA, 19 nt, Homo sapiens
gcuagaaggccacauguca

SEQ ID NO: 452969 - RNA, 19 nt, Homo sapiens
gguacaaucucaaauucuc

SEQ ID NO: 452970 - RNA, 19 nt, Homo sapiens
gagggccaguuacuuaaug

SEQ ID NO: 452971 - RNA, 19 nt, Homo sapiens
cgagggauauucuuugucu

SEQ ID NO: 452972 - RNA, 19 nt, Homo sapiens
gacgagggauauucuuugu

SEQ ID NO: 452973 - RNA, 19 nt, Homo sapiens
gcuaagcccucagaaugga

SEQ ID NO: 452974 - RNA, 19 nt, Homo sapiens
gagagugccucgagaccau

SEQ ID NO: 452975 - RNA, 19 nt, Homo sapiens
guggagauauacaucaaga

SEQ ID NO: 452976 - RNA, 19 nt, Homo sapiens
gaaucgcuacacagacuua

SEQ ID NO: 452977 - RNA, 19 nt, Homo sapiens
gaaucaaagacauggaauu

SEQ ID NO: 452978 - RNA, 19 nt, Homo sapiens
ggacaauggacagcaguaa

SEQ ID NO: 452979 - RNA, 19 nt, Homo sapiens
agagggauuugcauuaguu

SEQ ID NO: 452980 - RNA, 19 nt, Homo sapiens
ggagauauacaucaagagu

SEQ ID NO: 452981 - RNA, 19 nt, Homo sapiens
cugcagaccuucaggacaa

SEQ ID NO: 452982 - RNA, 19 nt, Homo sapiens
ggcauagcaucacuuccua

SEQ ID NO: 452983 - RNA, 19 nt, Homo sapiens
caagugugcuacagugcuu

SEQ ID NO: 452984 - RNA, 19 nt, Homo sapiens
gaaacaugaucugccuuca

SEQ ID NO: 452985 - RNA, 19 nt, Homo sapiens
gaacuaacaaaccagaaag

SEQ ID NO: 452986 - RNA, 19 nt, Homo sapiens
gugguacaaucucaaauuc

SEQ ID NO: 452987 - RNA, 19 nt, Homo sapiens
uaaacacccaugaaucaaa

SEQ ID NO: 452988 - RNA, 19 nt, Homo sapiens
aaucugcucuuuccauugu

SEQ ID NO: 452989 - RNA, 19 nt, Homo sapiens
ucuggaagauggucagcua

SEQ ID NO: 452990 - RNA, 19 nt, Homo sapiens
gggcugauaaugaaccuaa

SEQ ID NO: 452991 - RNA, 19 nt, Homo sapiens
ggccaagaaucaagcuaga

SEQ ID NO: 452992 - RNA, 19 nt, Homo sapiens
aaacacccaugaaucaaag

SEQ ID NO: 452993 - RNA, 19 nt, Homo sapiens
ugucauuucucuuguaaca

SEQ ID NO: 452994 - RNA, 19 nt, Homo sapiens
uaaauccacaugucaauuc

SEQ ID NO: 452995 - RNA, 19 nt, Homo sapiens
guguaaagcugugcagugu

SEQ ID NO: 452996 - RNA, 19 nt, Homo sapiens
cagaaucgcuacacagacu

SEQ ID NO: 452997 - RNA, 19 nt, Homo sapiens
agaaauuccuguagcaucu

SEQ ID NO: 452998 - RNA, 19 nt, Homo sapiens
gcaucugacucacaagaag

SEQ ID NO: 452999 - RNA, 19 nt, Homo sapiens
agcgguggcuucuacaaua

SEQ ID NO: 453000 - RNA, 19 nt, Homo sapiens
gagaauggccacuggucaa

SEQ ID NO: 453001 - RNA, 19 nt, Homo sapiens
cugcaacgcuggauucaca

SEQ ID NO: 453002 - RNA, 19 nt, Homo sapiens
uaguggccauccagaauaa

SEQ ID NO: 453003 - RNA, 19 nt, Homo sapiens
aggaagcccugacuuacuu

SEQ ID NO: 453004 - RNA, 19 nt, Homo sapiens
caugucaauucaucuguga

SEQ ID NO: 453005 - RNA, 19 nt, Homo sapiens
gagcaucugacucacaaga

SEQ ID NO: 453006 - RNA, 19 nt, Homo sapiens
cuaggaacauauggaguuu

SEQ ID NO: 453007 - RNA, 19 nt, Homo sapiens
gaccagaaagauuggauug

SEQ ID NO: 453008 - RNA, 19 nt, Homo sapiens
gcagaaggccaagaaucaa

SEQ ID NO: 453009 - RNA, 19 nt, Homo sapiens
accagacuguggagaaaua

SEQ ID NO: 453010 - RNA, 19 nt, Homo sapiens
ugcuuugacucaccuguua

SEQ ID NO: 453011 - RNA, 19 nt, Homo sapiens
gcaggaccauugacuaucc

SEQ ID NO: 453012 - RNA, 19 nt, Homo sapiens
gcauggacuuaucauuaca

SEQ ID NO: 453013 - RNA, 19 nt, Homo sapiens
ccaaggagcuuccaucuag

SEQ ID NO: 453014 - RNA, 19 nt, Homo sapiens
guaccuagauuaugauuuc

SEQ ID NO: 453015 - RNA, 19 nt, Homo sapiens
gaauaugaguaccuagauu

SEQ ID NO: 453016 - RNA, 19 nt, Homo sapiens
ggagacaggccaccgaaua

SEQ ID NO: 453017 - RNA, 19 nt, Homo sapiens
caaaagaggucuguucaua

SEQ ID NO: 453018 - RNA, 19 nt, Homo sapiens
gaggaguacugaagaguga

SEQ ID NO: 453019 - RNA, 19 nt, Homo sapiens
gcacagacaacucgacuga

SEQ ID NO: 453020 - RNA, 19 nt, Homo sapiens
ccacggagcuggccaacau

SEQ ID NO: 453021 - RNA, 19 nt, Homo sapiens
gcacugcacugccauuguc

SEQ ID NO: 453022 - RNA, 19 nt, Homo sapiens
gcaggaggccauuuacuug

SEQ ID NO: 453023 - RNA, 19 nt, Homo sapiens
caaggcaggaggccauuua

SEQ ID NO: 453024 - RNA, 19 nt, Homo sapiens
gcacagaccacucaaacca

SEQ ID NO: 453025 - RNA, 19 nt, Homo sapiens
gguggacucugucuuguuc

SEQ ID NO: 453026 - RNA, 19 nt, Homo sapiens
gagcuuccaucuagugaca

SEQ ID NO: 453027 - RNA, 19 nt, Homo sapiens
gcaauuuguccgucaacua

SEQ ID NO: 453028 - RNA, 19 nt, Homo sapiens
cauggaaccuacuaccaaa

SEQ ID NO: 453029 - RNA, 19 nt, Homo sapiens
augaguaccuagauuauga

SEQ ID NO: 453030 - RNA, 19 nt, Homo sapiens
gagacaggccaccgaauau

SEQ ID NO: 453031 - RNA, 19 nt, Homo sapiens
gcacugccauugucuuuug

SEQ ID NO: 453032 - RNA, 19 nt, Homo sapiens
gccauuuacuugagacaga

SEQ ID NO: 453033 - RNA, 19 nt, Homo sapiens
gaugaagcccagccacauu

SEQ ID NO: 453034 - RNA, 19 nt, Homo sapiens
ggaggccauuuacuugaga

SEQ ID NO: 453035 - RNA, 19 nt, Homo sapiens
cagcagcuauggagauaca

SEQ ID NO: 453036 - RNA, 19 nt, Homo sapiens
gggaaccuguccacggauu

SEQ ID NO: 453037 - RNA, 19 nt, Homo sapiens
gacaggccaccgaauauga

SEQ ID NO: 453038 - RNA, 19 nt, Homo sapiens
ccaccgagauggucugcau

SEQ ID NO: 453039 - RNA, 19 nt, Homo sapiens
cagaggcccuguccaugga

SEQ ID NO: 453040 - RNA, 19 nt, Homo sapiens
acagaccacugcaccagaa

SEQ ID NO: 453041 - RNA, 19 nt, Homo sapiens
ggaaguggacauucuaagg

SEQ ID NO: 453042 - RNA, 19 nt, Homo sapiens
ggcaggaggccauuuacuu

SEQ ID NO: 453043 - RNA, 19 nt, Homo sapiens
caccgaauaugaguaccua

SEQ ID NO: 453044 - RNA, 19 nt, Homo sapiens
ggacaccugggcagaugaa

SEQ ID NO: 453045 - RNA, 19 nt, Homo sapiens
ugacaccacuccucugacu

SEQ ID NO: 453046 - RNA, 19 nt, Homo sapiens
gcacagcuuccucccuuag

SEQ ID NO: 453047 - RNA, 19 nt, Homo sapiens
ccauggaaccuacuaccaa

SEQ ID NO: 453048 - RNA, 19 nt, Homo sapiens
ggacuucugaggcuguuuc

SEQ ID NO: 453049 - RNA, 19 nt, Homo sapiens
gguggccacuaucuucuuc

SEQ ID NO: 453050 - RNA, 19 nt, Homo sapiens
aaagaggucuguucauacc

SEQ ID NO: 453051 - RNA, 19 nt, Homo sapiens
gaaccuguccacggauuca

SEQ ID NO: 453052 - RNA, 19 nt, Homo sapiens
caauuuguccgucaacuac

SEQ ID NO: 453053 - RNA, 19 nt, Homo sapiens
ccacagaggcacagacaac

SEQ ID NO: 453054 - RNA, 19 nt, Homo sapiens
ggagauacagaccacucaa

SEQ ID NO: 453055 - RNA, 19 nt, Homo sapiens
caaggagcuuccaucuagu

SEQ ID NO: 453056 - RNA, 19 nt, Homo sapiens
uaagggaggaguacugaag

SEQ ID NO: 453057 - RNA, 19 nt, Homo sapiens
caaacaggaaguggacauu

SEQ ID NO: 453058 - RNA, 19 nt, Homo sapiens
caggaggccauuuacuuga

SEQ ID NO: 453059 - RNA, 19 nt, Homo sapiens
gcugguggccacuaucuuc

SEQ ID NO: 453060 - RNA, 19 nt, Homo sapiens
caggguggacucugucuug

SEQ ID NO: 453061 - RNA, 19 nt, Homo sapiens
ggaacucuggccacccaaa

SEQ ID NO: 453062 - RNA, 19 nt, Homo sapiens
gggcagaugaagccgagaa

SEQ ID NO: 453063 - RNA, 19 nt, Homo sapiens
cgaauaugaguaccuagau

SEQ ID NO: 453064 - RNA, 19 nt, Homo sapiens
ggacuguguggaccaagga

SEQ ID NO: 453065 - RNA, 19 nt, Homo sapiens
gaagcccagccacauuuca

SEQ ID NO: 453066 - RNA, 19 nt, Homo sapiens
ggaugaagcccagccacau

SEQ ID NO: 453067 - RNA, 19 nt, Homo sapiens
gcagcuauggagauacaga

SEQ ID NO: 453068 - RNA, 19 nt, Homo sapiens
gaccaaggagcuuccaucu

SEQ ID NO: 453069 - RNA, 19 nt, Homo sapiens
caggaaguggacauucuaa

SEQ ID NO: 453070 - RNA, 19 nt, Homo sapiens
ccagcaauuuguccgucaa

SEQ ID NO: 453071 - RNA, 19 nt, Homo sapiens
uucagcagcuauggagaua

SEQ ID NO: 453072 - RNA, 19 nt, Homo sapiens
ccgaauaugaguaccuaga

SEQ ID NO: 453073 - RNA, 19 nt, Homo sapiens
aagagugacggacuucuga

SEQ ID NO: 453074 - RNA, 19 nt, Homo sapiens
acaggaaguggacauucua

SEQ ID NO: 453075 - RNA, 19 nt, Homo sapiens
gaacucuggccacccaaac

SEQ ID NO: 453076 - RNA, 19 nt, Homo sapiens
aacaggaaguggacauucu

SEQ ID NO: 453077 - RNA, 19 nt, Homo sapiens
ccaagcagacgggcaagug

SEQ ID NO: 453078 - RNA, 19 nt, Homo sapiens
gcugcaaggcguucuacug

SEQ ID NO: 453079 - RNA, 19 nt, Homo sapiens
cugcaucucaucccuguug

SEQ ID NO: 453080 - RNA, 19 nt, Homo sapiens
cggaagcacagaccacuca

SEQ ID NO: 453081 - RNA, 19 nt, Homo sapiens
ccacggauucagcagcuau

SEQ ID NO: 453082 - RNA, 19 nt, Homo sapiens
aaacaggaaguggacauuc

SEQ ID NO: 453083 - RNA, 19 nt, Homo sapiens
ccauuuacuugagacagau

SEQ ID NO: 453084 - RNA, 19 nt, Homo sapiens
ucacugcaguaucccaacu

SEQ ID NO: 453085 - RNA, 19 nt, Homo sapiens
cugcugcuccucugacuug

SEQ ID NO: 453086 - RNA, 19 nt, Homo sapiens
ggaaccuacuaccaaaaga

SEQ ID NO: 453087 - RNA, 19 nt, Homo sapiens
gcaaugaugauaagcuuua

SEQ ID NO: 453088 - RNA, 19 nt, Homo sapiens
gcauuugccugaacgauga

SEQ ID NO: 453089 - RNA, 19 nt, Homo sapiens
ugaggaacccugucauuua

SEQ ID NO: 453090 - RNA, 19 nt, Homo sapiens
ccacugagaacaacuuuaa

SEQ ID NO: 453091 - RNA, 19 nt, Homo sapiens
cggaagagguuucuagaga

SEQ ID NO: 453092 - RNA, 19 nt, Homo sapiens
gaaccgaacacaccuguau

SEQ ID NO: 453093 - RNA, 19 nt, Homo sapiens
gaagagguuucuagagagu

SEQ ID NO: 453094 - RNA, 19 nt, Homo sapiens
gaggaacccugucauuuac

SEQ ID NO: 453095 - RNA, 19 nt, Homo sapiens
gcacagagcagggcuuguu

SEQ ID NO: 453096 - RNA, 19 nt, Homo sapiens
gcacagccacugagaacaa

SEQ ID NO: 453097 - RNA, 19 nt, Homo sapiens
ugaaguccaccaaggauua

SEQ ID NO: 453098 - RNA, 19 nt, Homo sapiens
caagugacagccagaagua

SEQ ID NO: 453099 - RNA, 19 nt, Homo sapiens
ggagguggccuucccaaug

SEQ ID NO: 453100 - RNA, 19 nt, Homo sapiens
ccaugaccaucucuucuaa

SEQ ID NO: 453101 - RNA, 19 nt, Homo sapiens
gcgcaaugaugauaagcuu

SEQ ID NO: 453102 - RNA, 19 nt, Homo sapiens
gcucuaugcugguguguac

SEQ ID NO: 453103 - RNA, 19 nt, Homo sapiens
gcacggaucaguacaacuc

SEQ ID NO: 453104 - RNA, 19 nt, Homo sapiens
gagguggccuucccaaugc

SEQ ID NO: 453105 - RNA, 19 nt, Homo sapiens
ggugcucccuaccgccuua

SEQ ID NO: 453106 - RNA, 19 nt, Homo sapiens
caacuccaaugccaacaag

SEQ ID NO: 453107 - RNA, 19 nt, Homo sapiens
gugaggaacccugucauuu

SEQ ID NO: 453108 - RNA, 19 nt, Homo sapiens
gaugauaagcuuuacuucu

SEQ ID NO: 453109 - RNA, 19 nt, Homo sapiens
ggagcgcaaugaugauaag

SEQ ID NO: 453110 - RNA, 19 nt, Homo sapiens
gcaagugacagccagaagu

SEQ ID NO: 453111 - RNA, 19 nt, Homo sapiens
gaaccuucacgccaucuau

SEQ ID NO: 453112 - RNA, 19 nt, Homo sapiens
gauaagcuuuacuucuucu

SEQ ID NO: 453113 - RNA, 19 nt, Homo sapiens
gcagccacccacucaugua

SEQ ID NO: 453114 - RNA, 19 nt, Homo sapiens
ugauaagcuuuacuucuuc

SEQ ID NO: 453115 - RNA, 19 nt, Homo sapiens
ucucugggcuucccuacug

SEQ ID NO: 453116 - RNA, 19 nt, Homo sapiens
agaaugccguggagucugu

SEQ ID NO: 453117 - RNA, 19 nt, Homo sapiens
ucauugugcugcccaagga

SEQ ID NO: 453118 - RNA, 19 nt, Homo sapiens
gcauguacgugggcagcaa

SEQ ID NO: 453119 - RNA, 19 nt, Homo sapiens
gggcgaggauggcauugag

SEQ ID NO: 453120 - RNA, 19 nt, Homo sapiens
cauccaugcugagcucauu

SEQ ID NO: 453121 - RNA, 19 nt, Homo sapiens
caacaaguggagcacauuc

SEQ ID NO: 453122 - RNA, 19 nt, Homo sapiens
gcggagcgcaaugaugaua

SEQ ID NO: 453123 - RNA, 19 nt, Homo sapiens
gcugguguguacaucgauu

SEQ ID NO: 453124 - RNA, 19 nt, Homo sapiens
gaaguccaccaaggauuau

SEQ ID NO: 453125 - RNA, 19 nt, Homo sapiens
gauauucgcauggucuuca

SEQ ID NO: 453126 - RNA, 19 nt, Homo sapiens
uauacagcauccuccaaga

SEQ ID NO: 453127 - RNA, 19 nt, Homo sapiens
ggacagugcagaaggucau

SEQ ID NO: 453128 - RNA, 19 nt, Homo sapiens
ggaccacgaccgcauguac

SEQ ID NO: 453129 - RNA, 19 nt, Homo sapiens
gcaccgcccacuucuucaa

SEQ ID NO: 453130 - RNA, 19 nt, Homo sapiens
cagcaucggcccucaucaa

SEQ ID NO: 453131 - RNA, 19 nt, Homo sapiens
gggcaaguguccguacgau

SEQ ID NO: 453132 - RNA, 19 nt, Homo sapiens
guccggcucucauucaaag

SEQ ID NO: 453133 - RNA, 19 nt, Homo sapiens
uggaggagguggaggucuu

SEQ ID NO: 453134 - RNA, 19 nt, Homo sapiens
gcucugccgugugugucua

SEQ ID NO: 453135 - RNA, 19 nt, Homo sapiens
ucaaugaggagcucuaugc

SEQ ID NO: 453136 - RNA, 19 nt, Homo sapiens
caccgaagaacccgaguga

SEQ ID NO: 453137 - RNA, 19 nt, Homo sapiens
ggagguggaggucuucaag

SEQ ID NO: 453138 - RNA, 19 nt, Homo sapiens
ccuaccgccuuaccacuau

SEQ ID NO: 453139 - RNA, 19 nt, Homo sapiens
gcaucggcccucaucaaug

SEQ ID NO: 453140 - RNA, 19 nt, Homo sapiens
ucaagaccaugaccaucuc

SEQ ID NO: 453141 - RNA, 19 nt, Homo sapiens
gaugaggugaucaacuuca

SEQ ID NO: 453142 - RNA, 19 nt, Homo sapiens
cguccaugcugcccucuuc

SEQ ID NO: 453143 - RNA, 19 nt, Homo sapiens
cguggagucugugcaguau

SEQ ID NO: 453144 - RNA, 19 nt, Homo sapiens
caggccugcucccgcuaua

SEQ ID NO: 453145 - RNA, 19 nt, Homo sapiens
ucuacuccauggcugauau

SEQ ID NO: 453146 - RNA, 19 nt, Homo sapiens
ugucauuuacgcugucuuu

SEQ ID NO: 453147 - RNA, 19 nt, Homo sapiens
caccauggacccagacuca

SEQ ID NO: 453148 - RNA, 19 nt, Homo sapiens
gcagcgcagccuuccuuga

SEQ ID NO: 453149 - RNA, 19 nt, Homo sapiens
gcacccgucaagaccauga

SEQ ID NO: 453150 - RNA, 19 nt, Homo sapiens
gcgggacagugcagaaggu

SEQ ID NO: 453151 - RNA, 19 nt, Homo sapiens
gaacuucgucaggcucauc

SEQ ID NO: 453152 - RNA, 19 nt, Homo sapiens
ccacagcgcaucgaggaau

SEQ ID NO: 453153 - RNA, 19 nt, Homo sapiens
cuuggucccuuuuaauaua

SEQ ID NO: 453154 - RNA, 19 nt, Homo sapiens
uggagucugugcaguaugg

SEQ ID NO: 453155 - RNA, 19 nt, Homo sapiens
ucauguaccaggccgugua

SEQ ID NO: 453156 - RNA, 19 nt, Homo sapiens
gcugagcucauuccugaca

SEQ ID NO: 453157 - RNA, 19 nt, Homo sapiens
ggaugucaacggcgagugu

SEQ ID NO: 453158 - RNA, 19 nt, Homo sapiens
caagaaugccguggagucu

SEQ ID NO: 453159 - RNA, 19 nt, Homo sapiens
agguggaggucuucaagga

SEQ ID NO: 453160 - RNA, 19 nt, Homo sapiens
acgccaggauuacaucuuc

SEQ ID NO: 453161 - RNA, 19 nt, Homo sapiens
ggagggagagacgcgaaga

SEQ ID NO: 453162 - RNA, 19 nt, Homo sapiens
uagacuuucuguccucaca

SEQ ID NO: 453163 - RNA, 19 nt, Homo sapiens
gccguggguucaacuccaa

SEQ ID NO: 453164 - RNA, 19 nt, Homo sapiens
gcagugccguggguucaac

SEQ ID NO: 453165 - RNA, 19 nt, Homo sapiens
gucaacaaguggagcacau

SEQ ID NO: 453166 - RNA, 19 nt, Homo sapiens
gcgcacggaucaguacaac

SEQ ID NO: 453167 - RNA, 19 nt, Homo sapiens
ggaaccgaacacaccugua

SEQ ID NO: 453168 - RNA, 19 nt, Homo sapiens
gagacgcgaagagaccuuu

SEQ ID NO: 453169 - RNA, 19 nt, Homo sapiens
gcuugucgccggucuucuu

SEQ ID NO: 453170 - RNA, 19 nt, Homo sapiens
gaccaugaccaucucuucu

SEQ ID NO: 453171 - RNA, 19 nt, Homo sapiens
ggguccggcucucauucaa

SEQ ID NO: 453172 - RNA, 19 nt, Homo sapiens
ggaaccuucacgccaucua

SEQ ID NO: 453173 - RNA, 19 nt, Homo sapiens
cgugaggaacccugucauu

SEQ ID NO: 453174 - RNA, 19 nt, Homo sapiens
gccaggauuacaucuucua

SEQ ID NO: 453175 - RNA, 19 nt, Homo sapiens
cagcgcagccuuccuugag

SEQ ID NO: 453176 - RNA, 19 nt, Homo sapiens
cagcacccgucaagaccau

SEQ ID NO: 453177 - RNA, 19 nt, Homo sapiens
gcucaacacaaccgacuac

SEQ ID NO: 453178 - RNA, 19 nt, Homo sapiens
cgggacaggugccuacaac

SEQ ID NO: 453179 - RNA, 19 nt, Homo sapiens
cacagcgcaucgaggaaug

SEQ ID NO: 453180 - RNA, 19 nt, Homo sapiens
caacuuccugcucaacaca

SEQ ID NO: 453181 - RNA, 19 nt, Homo sapiens
gcaacaaacugaauccaaa

SEQ ID NO: 453182 - RNA, 19 nt, Homo sapiens
gaccgaaacccauuauuua

SEQ ID NO: 453183 - RNA, 19 nt, Homo sapiens
gugaaaggauggaccaaua

SEQ ID NO: 453184 - RNA, 19 nt, Homo sapiens
aagaugagcuccuaguaua

SEQ ID NO: 453185 - RNA, 19 nt, Homo sapiens
caacauggauccaaagaca

SEQ ID NO: 453186 - RNA, 19 nt, Homo sapiens
gagaggaacauucaaguaa

SEQ ID NO: 453187 - RNA, 19 nt, Homo sapiens
gggauuggauauuguaauu

SEQ ID NO: 453188 - RNA, 19 nt, Homo sapiens
gaaagggaauauccaguca

SEQ ID NO: 453189 - RNA, 19 nt, Homo sapiens
gggaauagcccaucuggaa

SEQ ID NO: 453190 - RNA, 19 nt, Homo sapiens
gcagagaccaugauaaauc

SEQ ID NO: 453191 - RNA, 19 nt, Homo sapiens
gcaggaagaugacagugau

SEQ ID NO: 453192 - RNA, 19 nt, Homo sapiens
gcacagggcaagucucaaa

SEQ ID NO: 453193 - RNA, 19 nt, Homo sapiens
uagccaaacugaagagaaa

SEQ ID NO: 453194 - RNA, 19 nt, Homo sapiens
gaaagacgacuccacuaug

SEQ ID NO: 453195 - RNA, 19 nt, Homo sapiens
gaaagacgacuccacuaug

SEQ ID NO: 453196 - RNA, 19 nt, Homo sapiens
gaaaggcuguggguucaug

SEQ ID NO: 453197 - RNA, 19 nt, Homo sapiens
gaugagcuccuaguauaua

SEQ ID NO: 453198 - RNA, 19 nt, Homo sapiens
gaaggcagagaccaugaua

SEQ ID NO: 453199 - RNA, 19 nt, Homo sapiens
gaagcaagcagcugugaug

SEQ ID NO: 453200 - RNA, 19 nt, Homo sapiens
gcaguuauguucuccaaac

SEQ ID NO: 453201 - RNA, 19 nt, Homo sapiens
ucauaccaaucuucaagua

SEQ ID NO: 453202 - RNA, 19 nt, Homo sapiens
ucauaccaaucuucaagua

SEQ ID NO: 453203 - RNA, 19 nt, Homo sapiens
guuauguucuccaaacuga

SEQ ID NO: 453204 - RNA, 19 nt, Homo sapiens
gaggaacauucaaguaaag

SEQ ID NO: 453205 - RNA, 19 nt, Homo sapiens
agaggaacauucaaguaaa

SEQ ID NO: 453206 - RNA, 19 nt, Homo sapiens
ggaauagcccaucuggaaa

SEQ ID NO: 453207 - RNA, 19 nt, Homo sapiens
gauaacaauucccagucaa

SEQ ID NO: 453208 - RNA, 19 nt, Homo sapiens
aaacaaggcggaucccaaa

SEQ ID NO: 453209 - RNA, 19 nt, Homo sapiens
cgaaacccauuauuuacau

SEQ ID NO: 453210 - RNA, 19 nt, Homo sapiens
caacaucaucuuuguacuu

SEQ ID NO: 453211 - RNA, 19 nt, Homo sapiens
caagaugagcuccuaguau

SEQ ID NO: 453212 - RNA, 19 nt, Homo sapiens
caccaaauccuaagcaaga

SEQ ID NO: 453213 - RNA, 19 nt, Homo sapiens
aaagacgacuccacuaugg

SEQ ID NO: 453214 - RNA, 19 nt, Homo sapiens
aaagacgacuccacuaugg

SEQ ID NO: 453215 - RNA, 19 nt, Homo sapiens
ucuccaaacugaagagcua

SEQ ID NO: 453216 - RNA, 19 nt, Homo sapiens
caagacaaacuccaacaug

SEQ ID NO: 453217 - RNA, 19 nt, Homo sapiens
ggaacauucaaguaaagua

SEQ ID NO: 453218 - RNA, 19 nt, Homo sapiens
gaagugagagaggaacauu

SEQ ID NO: 453219 - RNA, 19 nt, Homo sapiens
gaaaggauggaccaauauc

SEQ ID NO: 453220 - RNA, 19 nt, Homo sapiens
ccuucaaacuuccaauaaa

SEQ ID NO: 453221 - RNA, 19 nt, Homo sapiens
uuacauaaaccuaccauuc

SEQ ID NO: 453222 - RNA, 19 nt, Homo sapiens
gaacauucaaguaaaguac

SEQ ID NO: 453223 - RNA, 19 nt, Homo sapiens
ccgauuaccaagugaauuu

SEQ ID NO: 453224 - RNA, 19 nt, Homo sapiens
ccaaagcaguuauguucuc

SEQ ID NO: 453225 - RNA, 19 nt, Homo sapiens
gcuguggguucauggacua

SEQ ID NO: 453226 - RNA, 19 nt, Homo sapiens
gaugcagacucccguguag

SEQ ID NO: 453227 - RNA, 19 nt, Homo sapiens
ugaauucugugauguuucu

SEQ ID NO: 453228 - RNA, 19 nt, Homo sapiens
aaauagagaacaagaccua

SEQ ID NO: 453229 - RNA, 19 nt, Homo sapiens
gcaccaagacaaacuccaa

SEQ ID NO: 453230 - RNA, 19 nt, Homo sapiens
agaacaaacuuccgucucu

SEQ ID NO: 453231 - RNA, 19 nt, Homo sapiens
ggacuaaguaaagaacaaa

SEQ ID NO: 453232 - RNA, 19 nt, Homo sapiens
caguugaccucagugaauu

SEQ ID NO: 453233 - RNA, 19 nt, Homo sapiens
uuauagagcaggaagauga

SEQ ID NO: 453234 - RNA, 19 nt, Homo sapiens
aacaagaccuacucaguca

SEQ ID NO: 453235 - RNA, 19 nt, Homo sapiens
caaucaagaucaacagcau

SEQ ID NO: 453236 - RNA, 19 nt, Homo sapiens
ccaagaugagcuccuagua

SEQ ID NO: 453237 - RNA, 19 nt, Homo sapiens
ucuggccaaucuacaaaua

SEQ ID NO: 453238 - RNA, 19 nt, Homo sapiens
aaaggccgauuaccaagug

SEQ ID NO: 453239 - RNA, 19 nt, Homo sapiens
guauuuauagccaaacuga

SEQ ID NO: 453240 - RNA, 19 nt, Homo sapiens
guauuuauagccaaacuga

SEQ ID NO: 453241 - RNA, 19 nt, Homo sapiens
guucauggacuaaguaaag

SEQ ID NO: 453242 - RNA, 19 nt, Homo sapiens
gaauagcccaucuggaaag

SEQ ID NO: 453243 - RNA, 19 nt, Homo sapiens
aggcagagaccaugauaaa

SEQ ID NO: 453244 - RNA, 19 nt, Homo sapiens
cuucaaacuuccaauaaag

SEQ ID NO: 453245 - RNA, 19 nt, Homo sapiens
gcaggcaagucucaaaucc

SEQ ID NO: 453246 - RNA, 19 nt, Homo sapiens
gagcaagagcauagccaaa

SEQ ID NO: 453247 - RNA, 19 nt, Homo sapiens
caaggcggaucccaaagca

SEQ ID NO: 453248 - RNA, 19 nt, Homo sapiens
gcaagcaacaaacugaauc

SEQ ID NO: 453249 - RNA, 19 nt, Homo sapiens
aaaugugguugaagugaga

SEQ ID NO: 453250 - RNA, 19 nt, Homo sapiens
gauuugaaugcccuacaua

SEQ ID NO: 453251 - RNA, 19 nt, Homo sapiens
ugaccucagugaauucugu

SEQ ID NO: 453252 - RNA, 19 nt, Homo sapiens
agaaagacgacuccacuau

SEQ ID NO: 453253 - RNA, 19 nt, Homo sapiens
agaaagacgacuccacuau

SEQ ID NO: 453254 - RNA, 19 nt, Homo sapiens
agaaucaacaccagacaaa

SEQ ID NO: 453255 - RNA, 19 nt, Homo sapiens
aagaaaggcuguggguuca

SEQ ID NO: 453256 - RNA, 19 nt, Homo sapiens
gaagcccaacaucaucuuu

SEQ ID NO: 453257 - RNA, 19 nt, Homo sapiens
uaacaauucccagucaaga

SEQ ID NO: 453258 - RNA, 19 nt, Homo sapiens
agauaacaauucccaguca

SEQ ID NO: 453259 - RNA, 19 nt, Homo sapiens
uaaagggcauuaccaaaau

SEQ ID NO: 453260 - RNA, 19 nt, Homo sapiens
gcucaucgugggacacaaa

SEQ ID NO: 453261 - RNA, 19 nt, Homo sapiens
gcagacucccguguaguuu

SEQ ID NO: 453262 - RNA, 19 nt, Homo sapiens
gaaagcacagggcaagucu

SEQ ID NO: 453263 - RNA, 19 nt, Homo sapiens
auaccaaucuucaaguaca

SEQ ID NO: 453264 - RNA, 19 nt, Homo sapiens
agagaggaacauucaagua

SEQ ID NO: 453265 - RNA, 19 nt, Homo sapiens
aagggaauauccagucaau

SEQ ID NO: 453266 - RNA, 19 nt, Homo sapiens
ugaaaggauggaccaauau

SEQ ID NO: 453267 - RNA, 19 nt, Homo sapiens
cuacaaauagagaacaaga

SEQ ID NO: 453268 - RNA, 19 nt, Homo sapiens
aaauaaagggcauuaccaa

SEQ ID NO: 453269 - RNA, 19 nt, Homo sapiens
ugaaugcccuacauaagac

SEQ ID NO: 453270 - RNA, 19 nt, Homo sapiens
aaacaacaacgugagacua

SEQ ID NO: 453271 - RNA, 19 nt, Homo sapiens
caagaccuacucagucaug

SEQ ID NO: 453272 - RNA, 19 nt, Homo sapiens
gagagaggaacauucaagu

SEQ ID NO: 453273 - RNA, 19 nt, Homo sapiens
acaacaacgugagacuaaa

SEQ ID NO: 453274 - RNA, 19 nt, Homo sapiens
aacaacaacgugagacuaa

SEQ ID NO: 453275 - RNA, 19 nt, Homo sapiens
aaaauggugugcagaaaga

SEQ ID NO: 453276 - RNA, 19 nt, Homo sapiens
aaaauggugugcagaaaga

SEQ ID NO: 453277 - RNA, 19 nt, Homo sapiens
ucccaaagcaguuauguuc

SEQ ID NO: 453278 - RNA, 19 nt, Homo sapiens
uugaaugcccuacauaaga

SEQ ID NO: 453279 - RNA, 19 nt, Homo sapiens
gagaagcaagcagcuguga

SEQ ID NO: 453280 - RNA, 19 nt, Homo sapiens
gcggaucccaaagcaguua

SEQ ID NO: 453281 - RNA, 19 nt, Homo sapiens
gucaacaacugcucaauua

SEQ ID NO: 453282 - RNA, 19 nt, Homo sapiens
gcaaauacauggcaagucu

SEQ ID NO: 453283 - RNA, 19 nt, Homo sapiens
aagaugagcuccuaguaua

SEQ ID NO: 453284 - RNA, 19 nt, Homo sapiens
caacaacugcucaauuaua

SEQ ID NO: 453285 - RNA, 19 nt, Homo sapiens
aagcggaucuucccaauuu

SEQ ID NO: 453286 - RNA, 19 nt, Homo sapiens
gaagaaagacgucucaaca

SEQ ID NO: 453287 - RNA, 19 nt, Homo sapiens
acagaaagauguauccaaa

SEQ ID NO: 453288 - RNA, 19 nt, Homo sapiens
gggaauagcccaucuggaa

SEQ ID NO: 453289 - RNA, 19 nt, Homo sapiens
acagaaagguguauccaaa

SEQ ID NO: 453290 - RNA, 19 nt, Homo sapiens
gauccaaacugaagagcaa

SEQ ID NO: 453291 - RNA, 19 nt, Homo sapiens
gaagacagaaauccaauau

SEQ ID NO: 453292 - RNA, 19 nt, Homo sapiens
ggaaagagcacgcagaaag

SEQ ID NO: 453293 - RNA, 19 nt, Homo sapiens
gaaagagcacgcagaaaga

SEQ ID NO: 453294 - RNA, 19 nt, Homo sapiens
gcauuucuauccaaacuga

SEQ ID NO: 453295 - RNA, 19 nt, Homo sapiens
uauccaaacugaagagaaa

SEQ ID NO: 453296 - RNA, 19 nt, Homo sapiens
uauccaaacugaagagaaa

SEQ ID NO: 453297 - RNA, 19 nt, Homo sapiens
gcagagaccaugauaaauc

SEQ ID NO: 453298 - RNA, 19 nt, Homo sapiens
gaaagacgacucaacuaug

SEQ ID NO: 453299 - RNA, 19 nt, Homo sapiens
guauuucgauccaaacuga

SEQ ID NO: 453300 - RNA, 19 nt, Homo sapiens
agacagaaauccaauaucu

SEQ ID NO: 453301 - RNA, 19 nt, Homo sapiens
agaaagacaucucaacugu

SEQ ID NO: 453302 - RNA, 19 nt, Homo sapiens
gaagaaagacgacucaacu

SEQ ID NO: 453303 - RNA, 19 nt, Homo sapiens
gagcauggccauaaggaaa

SEQ ID NO: 453304 - RNA, 19 nt, Homo sapiens
gaaaauacauggcaagucu

SEQ ID NO: 453305 - RNA, 19 nt, Homo sapiens
gagcauggccauaaggaaa

SEQ ID NO: 453306 - RNA, 19 nt, Homo sapiens
gaaaauacauggcaagucu

SEQ ID NO: 453307 - RNA, 19 nt, Homo sapiens
gaugagcuccuaguauaua

SEQ ID NO: 453308 - RNA, 19 nt, Homo sapiens
gaagcaagcagcugugaug

SEQ ID NO: 453309 - RNA, 19 nt, Homo sapiens
gaaggcagagaccaugaua

SEQ ID NO: 453310 - RNA, 19 nt, Homo sapiens
cgaccucagugaagucuuu

SEQ ID NO: 453311 - RNA, 19 nt, Homo sapiens
guauuucuauccaaacuga

SEQ ID NO: 453312 - RNA, 19 nt, Homo sapiens
gcaguuauguucuccaaac

SEQ ID NO: 453313 - RNA, 19 nt, Homo sapiens
ucuccaaacugaagaacua

SEQ ID NO: 453314 - RNA, 19 nt, Homo sapiens
gcuauggguucauggacua

SEQ ID NO: 453315 - RNA, 19 nt, Homo sapiens
gaagaaagacaucucaacu

SEQ ID NO: 453316 - RNA, 19 nt, Homo sapiens
ucauaccaaucuucaagua

SEQ ID NO: 453317 - RNA, 19 nt, Homo sapiens
gguaagaauuccuagucaa

SEQ ID NO: 453318 - RNA, 19 nt, Homo sapiens
guuauguucuccaaacuga

SEQ ID NO: 453319 - RNA, 19 nt, Homo sapiens
ucagugaagucuuugaugu

SEQ ID NO: 453320 - RNA, 19 nt, Homo sapiens
agaaagacgucucaacagu

SEQ ID NO: 453321 - RNA, 19 nt, Homo sapiens
caacauggacccaaagaca

SEQ ID NO: 453322 - RNA, 19 nt, Homo sapiens
caagacagacuccaacaug

SEQ ID NO: 453323 - RNA, 19 nt, Homo sapiens
caagguggaucccaaagca

SEQ ID NO: 453324 - RNA, 19 nt, Homo sapiens
ggaauagcccaucuggaaa

SEQ ID NO: 453325 - RNA, 19 nt, Homo sapiens
gaucaauggucuggccaaa

SEQ ID NO: 453326 - RNA, 19 nt, Homo sapiens
caccaaauccuaaucaaga

SEQ ID NO: 453327 - RNA, 19 nt, Homo sapiens
aaacaggaauccagugagu

SEQ ID NO: 453328 - RNA, 19 nt, Homo sapiens
gaaggcaagucucaaaucc

SEQ ID NO: 453329 - RNA, 19 nt, Homo sapiens
guagaaggcaagucucaaa

SEQ ID NO: 453330 - RNA, 19 nt, Homo sapiens
aaagacgacucaacuaugg

SEQ ID NO: 453331 - RNA, 19 nt, Homo sapiens
uugaaaagcuggaccaaua

SEQ ID NO: 453332 - RNA, 19 nt, Homo sapiens
ccaagaugaucauuugaca

SEQ ID NO: 453333 - RNA, 19 nt, Homo sapiens
gaggaaagagcacgcagaa

SEQ ID NO: 453334 - RNA, 19 nt, Homo sapiens
ggcaguauuucuauccaaa

SEQ ID NO: 453335 - RNA, 19 nt, Homo sapiens
caagaugagcuccuaguau

SEQ ID NO: 453336 - RNA, 19 nt, Homo sapiens
caagcaagaugaaguccau

SEQ ID NO: 453337 - RNA, 19 nt, Homo sapiens
uagucaagcucaagaguau

SEQ ID NO: 453338 - RNA, 19 nt, Homo sapiens
aaagauguaucccaaagca

SEQ ID NO: 453339 - RNA, 19 nt, Homo sapiens
ggcaguauuucgauccaaa

SEQ ID NO: 453340 - RNA, 19 nt, Homo sapiens
gguaacaauucauagucaa

SEQ ID NO: 453341 - RNA, 19 nt, Homo sapiens
caaacaagaccuacucagu

SEQ ID NO: 453342 - RNA, 19 nt, Homo sapiens
agaaagauguaucccaaag

SEQ ID NO: 453343 - RNA, 19 nt, Homo sapiens
agaaagauguauccaaagg

SEQ ID NO: 453344 - RNA, 19 nt, Homo sapiens
ccuucaaacuuccaauaaa

SEQ ID NO: 453345 - RNA, 19 nt, Homo sapiens
gcaugagguugcccaagau

SEQ ID NO: 453346 - RNA, 19 nt, Homo sapiens
caaaggcaguauuucuauc

SEQ ID NO: 453347 - RNA, 19 nt, Homo sapiens
ccaaaggcaguauuucuau

SEQ ID NO: 453348 - RNA, 19 nt, Homo sapiens
agaaaaggauguacagaaa

SEQ ID NO: 453349 - RNA, 19 nt, Homo sapiens
ucauaccaaucuucgagua

SEQ ID NO: 453350 - RNA, 19 nt, Homo sapiens
ccaaacugaagaacuagua

SEQ ID NO: 453351 - RNA, 19 nt, Homo sapiens
ccaaagcaguuauguucuc

SEQ ID NO: 453352 - RNA, 19 nt, Homo sapiens
gacagaaauccaauaucua

SEQ ID NO: 453353 - RNA, 19 nt, Homo sapiens
gguaacaauuccuagucaa

SEQ ID NO: 453354 - RNA, 19 nt, Homo sapiens
gaaggcacauaaaauauca

SEQ ID NO: 453355 - RNA, 19 nt, Homo sapiens
agugaagucuuugauguuu

SEQ ID NO: 453356 - RNA, 19 nt, Homo sapiens
aacaagaccuacucaguca

SEQ ID NO: 453357 - RNA, 19 nt, Homo sapiens
cgacucaacuauggaggaa

SEQ ID NO: 453358 - RNA, 19 nt, Homo sapiens
cuacauagcccuguugcuu

SEQ ID NO: 453359 - RNA, 19 nt, Homo sapiens
ccaaaggcagcauuucuau

SEQ ID NO: 453360 - RNA, 19 nt, Homo sapiens
ccaagaugagcuccuagua

SEQ ID NO: 453361 - RNA, 19 nt, Homo sapiens
uacauagcccuguugcuua

SEQ ID NO: 453362 - RNA, 19 nt, Homo sapiens
agaaagacgacucaacuau

SEQ ID NO: 453363 - RNA, 19 nt, Homo sapiens
caacuucaccauggagaaa

SEQ ID NO: 453364 - RNA, 19 nt, Homo sapiens
guucauggacuaaguaaag

SEQ ID NO: 453365 - RNA, 19 nt, Homo sapiens
ccaagcggaucuucccaau

SEQ ID NO: 453366 - RNA, 19 nt, Homo sapiens
gaauagcccaucuggaaag

SEQ ID NO: 453367 - RNA, 19 nt, Homo sapiens
aggcagagaccaugauaaa

SEQ ID NO: 453368 - RNA, 19 nt, Homo sapiens
cuucaaacuuccaauaaag

SEQ ID NO: 453369 - RNA, 19 nt, Homo sapiens
gaugaucauuugacacaac

SEQ ID NO: 453370 - RNA, 19 nt, Homo sapiens
aggaaagucuggucaaucu

SEQ ID NO: 453371 - RNA, 19 nt, Homo sapiens
aaaggaaagucuggucaau

SEQ ID NO: 453372 - RNA, 19 nt, Homo sapiens
uaacaauuccuagucaaga

SEQ ID NO: 453373 - RNA, 19 nt, Homo sapiens
gacaccaaauccuaaucaa

SEQ ID NO: 453374 - RNA, 19 nt, Homo sapiens
gauuugaaugcccuacaua

SEQ ID NO: 453375 - RNA, 19 nt, Homo sapiens
ucauacccgucuucacgua

SEQ ID NO: 453376 - RNA, 19 nt, Homo sapiens
ugcccaagaugaucauuug

SEQ ID NO: 453377 - RNA, 19 nt, Homo sapiens
gcagauacaaacaggaauc

SEQ ID NO: 453378 - RNA, 19 nt, Homo sapiens
agaaucaacaccagacaaa

SEQ ID NO: 453379 - RNA, 19 nt, Homo sapiens
gaaguccaucauccucuuu

SEQ ID NO: 453380 - RNA, 19 nt, Homo sapiens
ucaagagcauggccauaag

SEQ ID NO: 453381 - RNA, 19 nt, Homo sapiens
gaacauaacugaaucuugu

SEQ ID NO: 453382 - RNA, 19 nt, Homo sapiens
gaccaaagcuccuuaugua

SEQ ID NO: 453383 - RNA, 19 nt, Homo sapiens
ggagaaaucuacugaauug

SEQ ID NO: 453384 - RNA, 19 nt, Homo sapiens
gcagugagcuuucagagaa

SEQ ID NO: 453385 - RNA, 19 nt, Homo sapiens
cgaaagagauguauaaauc

SEQ ID NO: 453386 - RNA, 19 nt, Homo sapiens
ugaauuggcuuccagauuu

SEQ ID NO: 453387 - RNA, 19 nt, Homo sapiens
agaaugaccuucaaacuaa

SEQ ID NO: 453388 - RNA, 19 nt, Homo sapiens
gcaaucaccugacagugua

SEQ ID NO: 453389 - RNA, 19 nt, Homo sapiens
gagaaugaccuucaaacua

SEQ ID NO: 453390 - RNA, 19 nt, Homo sapiens
gaaacuccaucgccucauu

SEQ ID NO: 453391 - RNA, 19 nt, Homo sapiens
gaagaagccauuaagauug

SEQ ID NO: 453392 - RNA, 19 nt, Homo sapiens
caucgaggcaucuaaauua

SEQ ID NO: 453393 - RNA, 19 nt, Homo sapiens
cauagucaaugaugguuua

SEQ ID NO: 453394 - RNA, 19 nt, Homo sapiens
ucacgacucucaaagauga

SEQ ID NO: 453395 - RNA, 19 nt, Homo sapiens
caaggaaucucuucucgau

SEQ ID NO: 453396 - RNA, 19 nt, Homo sapiens
guaaguauuuccauaguca

SEQ ID NO: 453397 - RNA, 19 nt, Homo sapiens
ccagcugccugacaaauaa

SEQ ID NO: 453398 - RNA, 19 nt, Homo sapiens
gccagcaagugaagauuua

SEQ ID NO: 453399 - RNA, 19 nt, Homo sapiens
cagagcauauuccuguuua

SEQ ID NO: 453400 - RNA, 19 nt, Homo sapiens
guacagaauuggauacagu

SEQ ID NO: 453401 - RNA, 19 nt, Homo sapiens
ggaggaagaacaacaaaga

SEQ ID NO: 453402 - RNA, 19 nt, Homo sapiens
gcccacagauucagaguug

SEQ ID NO: 453403 - RNA, 19 nt, Homo sapiens
gugcaaacauggagaaauc

SEQ ID NO: 453404 - RNA, 19 nt, Homo sapiens
aagaagcucugucgaaaga

SEQ ID NO: 453405 - RNA, 19 nt, Homo sapiens
gcauauuccuguuuaucaa

SEQ ID NO: 453406 - RNA, 19 nt, Homo sapiens
gaaugaccuucaaacuaaa

SEQ ID NO: 453407 - RNA, 19 nt, Homo sapiens
guaaauugcccacagauuc

SEQ ID NO: 453408 - RNA, 19 nt, Homo sapiens
agaagaagccauuaagauu

SEQ ID NO: 453409 - RNA, 19 nt, Homo sapiens
gaacaacaaagacaugcuu

SEQ ID NO: 453410 - RNA, 19 nt, Homo sapiens
gaauaagguuucagagcau

SEQ ID NO: 453411 - RNA, 19 nt, Homo sapiens
gaguaaaacugaagaaaga

SEQ ID NO: 453412 - RNA, 19 nt, Homo sapiens
uagaagaccugcgaguaaa

SEQ ID NO: 453413 - RNA, 19 nt, Homo sapiens
gcaagaaugcaguacagaa

SEQ ID NO: 453414 - RNA, 19 nt, Homo sapiens
gaagaacaacaaagacaug

SEQ ID NO: 453415 - RNA, 19 nt, Homo sapiens
gaggagaacauaacugaau

SEQ ID NO: 453416 - RNA, 19 nt, Homo sapiens
gucgacaucugauauuuga

SEQ ID NO: 453417 - RNA, 19 nt, Homo sapiens
guauuuccauagucaauga

SEQ ID NO: 453418 - RNA, 19 nt, Homo sapiens
aaacguaaacuaugaccua

SEQ ID NO: 453419 - RNA, 19 nt, Homo sapiens
ggaccaaagcuccuuaugu

SEQ ID NO: 453420 - RNA, 19 nt, Homo sapiens
gagcauaagagaucaagau

SEQ ID NO: 453421 - RNA, 19 nt, Homo sapiens
agaaugcaguacagaauug

SEQ ID NO: 453422 - RNA, 19 nt, Homo sapiens
cuauaaaccugaccuccuu

SEQ ID NO: 453423 - RNA, 19 nt, Homo sapiens
cgacaucugauauuugaaa

SEQ ID NO: 453424 - RNA, 19 nt, Homo sapiens
gcaaacauggagaaaucua

SEQ ID NO: 453425 - RNA, 19 nt, Homo sapiens
gcacaagggucagcauagg

SEQ ID NO: 453426 - RNA, 19 nt, Homo sapiens
ccaguguucuauuugcuuu

SEQ ID NO: 453427 - RNA, 19 nt, Homo sapiens
gguaaaccaaacccuauaa

SEQ ID NO: 453428 - RNA, 19 nt, Homo sapiens
gaaaagaaauguggaaacu

SEQ ID NO: 453429 - RNA, 19 nt, Homo sapiens
cagaggagaacauaacuga

SEQ ID NO: 453430 - RNA, 19 nt, Homo sapiens
caagugaagauuuacaaga

SEQ ID NO: 453431 - RNA, 19 nt, Homo sapiens
gagauaugccagcaaguga

SEQ ID NO: 453432 - RNA, 19 nt, Homo sapiens
cuaagacucauccugauuu

SEQ ID NO: 453433 - RNA, 19 nt, Homo sapiens
gaaaaccucccaucuuuau

SEQ ID NO: 453434 - RNA, 19 nt, Homo sapiens
cuuccuaacuuucccauau

SEQ ID NO: 453435 - RNA, 19 nt, Homo sapiens
gauguggccgucuuguaua

SEQ ID NO: 453436 - RNA, 19 nt, Homo sapiens
uaaauggaagcaaagauga

SEQ ID NO: 453437 - RNA, 19 nt, Homo sapiens
gaagaaaaccaaacagaug

SEQ ID NO: 453438 - RNA, 19 nt, Homo sapiens
uuagaagaccugcgaguaa

SEQ ID NO: 453439 - RNA, 19 nt, Homo sapiens
caagaaugcaguacagaau

SEQ ID NO: 453440 - RNA, 19 nt, Homo sapiens
gauauaaggggaaagauaa

SEQ ID NO: 453441 - RNA, 19 nt, Homo sapiens
uaucacacaugaauaaagg

SEQ ID NO: 453442 - RNA, 19 nt, Homo sapiens
gauugcagcuuuugguuaa

SEQ ID NO: 453443 - RNA, 19 nt, Homo sapiens
caauuucauuuccagcauu

SEQ ID NO: 453444 - RNA, 19 nt, Homo sapiens
acaaauaagucagcagcuu

SEQ ID NO: 453445 - RNA, 19 nt, Homo sapiens
guagaagaagccauuaaga

SEQ ID NO: 453446 - RNA, 19 nt, Homo sapiens
guaaaccaaacccuauaaa

SEQ ID NO: 453447 - RNA, 19 nt, Homo sapiens
gagcugaugcugccauugu

SEQ ID NO: 453448 - RNA, 19 nt, Homo sapiens
aaaagaagcucugucgaaa

SEQ ID NO: 453449 - RNA, 19 nt, Homo sapiens
ugaccuccuuuaugguuaa

SEQ ID NO: 453450 - RNA, 19 nt, Homo sapiens
uaaauugcccacagauuca

SEQ ID NO: 453451 - RNA, 19 nt, Homo sapiens
uguggaaacugcucucuca

SEQ ID NO: 453452 - RNA, 19 nt, Homo sapiens
uagaagaagccauuaagau

SEQ ID NO: 453453 - RNA, 19 nt, Homo sapiens
caaugaugguuuaauaggu

SEQ ID NO: 453454 - RNA, 19 nt, Homo sapiens
ggaagaacaacaaagacau

SEQ ID NO: 453455 - RNA, 19 nt, Homo sapiens
ccaauuuagucuagacaca

SEQ ID NO: 453456 - RNA, 19 nt, Homo sapiens
ggucugcaaucaccugaca

SEQ ID NO: 453457 - RNA, 19 nt, Homo sapiens
ugucgaaagagauguauaa

SEQ ID NO: 453458 - RNA, 19 nt, Homo sapiens
aaccugaccuccuuuaugg

SEQ ID NO: 453459 - RNA, 19 nt, Homo sapiens
cgucuuguauaucaucuug

SEQ ID NO: 453460 - RNA, 19 nt, Homo sapiens
augcuaaacuccaaugguu

SEQ ID NO: 453461 - RNA, 19 nt, Homo sapiens
gucucuauauugcuuagua

SEQ ID NO: 453462 - RNA, 19 nt, Homo sapiens
gauaauauugucugucucu

SEQ ID NO: 453463 - RNA, 19 nt, Homo sapiens
aaacuugaguggcugucuu

SEQ ID NO: 453464 - RNA, 19 nt, Homo sapiens
gaauuggcuuccagauuuu

SEQ ID NO: 453465 - RNA, 19 nt, Homo sapiens
aaacuccaucgccucauua

SEQ ID NO: 453466 - RNA, 19 nt, Homo sapiens
gaugaagacuuuuguaaac

SEQ ID NO: 453467 - RNA, 19 nt, Homo sapiens
caucaucgaggcaucuaaa

SEQ ID NO: 453468 - RNA, 19 nt, Homo sapiens
caaccaggagcaccaaaug

SEQ ID NO: 453469 - RNA, 19 nt, Homo sapiens
ucucacgacucucaaagau

SEQ ID NO: 453470 - RNA, 19 nt, Homo sapiens
gcuaaacuccaaugguuca

SEQ ID NO: 453471 - RNA, 19 nt, Homo sapiens
ccaaauuagugaaccaaaa

SEQ ID NO: 453472 - RNA, 19 nt, Homo sapiens
aauaagguuucagagcaua

SEQ ID NO: 453473 - RNA, 19 nt, Homo sapiens
gaauggaggaagaacaaca

SEQ ID NO: 453474 - RNA, 19 nt, Homo sapiens
caaaagaagcucugucgaa

SEQ ID NO: 453475 - RNA, 19 nt, Homo sapiens
uuaaauggaagcaaagaug

SEQ ID NO: 453476 - RNA, 19 nt, Homo sapiens
aaaccugaccuccuuuaug

SEQ ID NO: 453477 - RNA, 19 nt, Homo sapiens
gaaauacuuaacacgugaa

SEQ ID NO: 453478 - RNA, 19 nt, Homo sapiens
uagaauggaggaagaacaa

SEQ ID NO: 453479 - RNA, 19 nt, Homo sapiens
gcaaccaggagcaccaaau

SEQ ID NO: 453480 - RNA, 19 nt, Homo sapiens
ugauagauguggccgucuu

SEQ ID NO: 453481 - RNA, 19 nt, Homo sapiens
caucauaucucuuugcaua

SEQ ID NO: 453482 - RNA, 19 nt, Homo sapiens
ggaaguugauucacucuaa

SEQ ID NO: 453483 - RNA, 19 nt, Homo sapiens
gaaguuagaagaugaguuc

SEQ ID NO: 453484 - RNA, 19 nt, Homo sapiens
ccaaguaucuucagcucaa

SEQ ID NO: 453485 - RNA, 19 nt, Homo sapiens
ggacacagaaagcaaguuu

SEQ ID NO: 453486 - RNA, 19 nt, Homo sapiens
cagcagacgcuucaugaua

SEQ ID NO: 453487 - RNA, 19 nt, Homo sapiens
agaagaaguuagaagauga

SEQ ID NO: 453488 - RNA, 19 nt, Homo sapiens
aaagcaaguuucugaaguu

SEQ ID NO: 453489 - RNA, 19 nt, Homo sapiens
gcaaguuucugaaguuggu

SEQ ID NO: 453490 - RNA, 19 nt, Homo sapiens
ggaugaaauuaaccggaaa

SEQ ID NO: 453491 - RNA, 19 nt, Homo sapiens
gaaguugauucacucuaag

SEQ ID NO: 453492 - RNA, 19 nt, Homo sapiens
gaugguagccgggaaguug

SEQ ID NO: 453493 - RNA, 19 nt, Homo sapiens
ucaagaagaaguuagaaga

SEQ ID NO: 453494 - RNA, 19 nt, Homo sapiens
aagaagaaguuagaagaug

SEQ ID NO: 453495 - RNA, 19 nt, Homo sapiens
gaggcuacaaguccaagua

SEQ ID NO: 453496 - RNA, 19 nt, Homo sapiens
caagaagaaguuagaagau

SEQ ID NO: 453497 - RNA, 19 nt, Homo sapiens
uugauucacucuaagaaga

SEQ ID NO: 453498 - RNA, 19 nt, Homo sapiens
gguuucaucauaucucuuu

SEQ ID NO: 453499 - RNA, 19 nt, Homo sapiens
gagagucuguguguaugug

SEQ ID NO: 453500 - RNA, 19 nt, Homo sapiens
gggagagucuguguguaug

SEQ ID NO: 453501 - RNA, 19 nt, Homo sapiens
gucccgugguuucaucaua

SEQ ID NO: 453502 - RNA, 19 nt, Homo sapiens
gauucacucuaagaagaaa

SEQ ID NO: 453503 - RNA, 19 nt, Homo sapiens
cgccuuggcucagggcuaa

SEQ ID NO: 453504 - RNA, 19 nt, Homo sapiens
ccaccggguucuuugaagu

SEQ ID NO: 453505 - RNA, 19 nt, Homo sapiens
gcagacgcuucaugauagg

SEQ ID NO: 453506 - RNA, 19 nt, Homo sapiens
agcagacgcuucaugauag

SEQ ID NO: 453507 - RNA, 19 nt, Homo sapiens
aagcaaguuucugaaguug

SEQ ID NO: 453508 - RNA, 19 nt, Homo sapiens
gcuacaaguccaaguaucu

SEQ ID NO: 453509 - RNA, 19 nt, Homo sapiens
gaagaaguuagaagaugag

SEQ ID NO: 453510 - RNA, 19 nt, Homo sapiens
cguucacgauucaauaaau

SEQ ID NO: 453511 - RNA, 19 nt, Homo sapiens
ccucaggcauccuucucaa

SEQ ID NO: 453512 - RNA, 19 nt, Homo sapiens
gauggguggguuucugauu

SEQ ID NO: 453513 - RNA, 19 nt, Homo sapiens
cgggagagucuguguguau

SEQ ID NO: 453514 - RNA, 19 nt, Homo sapiens
gcgggagagucugugugua

SEQ ID NO: 453515 - RNA, 19 nt, Homo sapiens
uugcaaccguucacgauuc

SEQ ID NO: 453516 - RNA, 19 nt, Homo sapiens
ucccgugguuucaucauau

SEQ ID NO: 453517 - RNA, 19 nt, Homo sapiens
caccuggucuuucccugau

SEQ ID NO: 453518 - RNA, 19 nt, Homo sapiens
ggagagucuguguguaugu

SEQ ID NO: 453519 - RNA, 19 nt, Homo sapiens
caaccguucacgauucaau

SEQ ID NO: 453520 - RNA, 19 nt, Homo sapiens
gcucaagaagaaguuagaa

SEQ ID NO: 453521 - RNA, 19 nt, Homo sapiens
gccgggaaguugauucacu

SEQ ID NO: 453522 - RNA, 19 nt, Homo sapiens
auggguggguuucugauug

SEQ ID NO: 453523 - RNA, 19 nt, Homo sapiens
caggauggguggguuucug

SEQ ID NO: 453524 - RNA, 19 nt, Homo sapiens
guggacaccuggucuuucc

SEQ ID NO: 453525 - RNA, 19 nt, Homo sapiens
gggaaguugauucacucua

SEQ ID NO: 453526 - RNA, 19 nt, Homo sapiens
cggguucuuugaagugaug

SEQ ID NO: 453527 - RNA, 19 nt, Homo sapiens
ccaggccaccggguucuuu

SEQ ID NO: 453528 - RNA, 19 nt, Homo sapiens
ggacagaaguggaaauauu

SEQ ID NO: 453529 - RNA, 19 nt, Homo sapiens
ucaaagaggugaacauuaa

SEQ ID NO: 453530 - RNA, 19 nt, Homo sapiens
gcaaagcacugaaguugaa

SEQ ID NO: 453531 - RNA, 19 nt, Homo sapiens
gaaagaccuuggagaaauu

SEQ ID NO: 453532 - RNA, 19 nt, Homo sapiens
gcaaggaguuuauuacaau

SEQ ID NO: 453533 - RNA, 19 nt, Homo sapiens
gaccaaaucucaguuguuu

SEQ ID NO: 453534 - RNA, 19 nt, Homo sapiens
gaacaacacugggauuuca

SEQ ID NO: 453535 - RNA, 19 nt, Homo sapiens
ggagaauggugcuguuuaa

SEQ ID NO: 453536 - RNA, 19 nt, Homo sapiens
caagcacacuggaauauaa

SEQ ID NO: 453537 - RNA, 19 nt, Homo sapiens
gcagggauauugccuuauu

SEQ ID NO: 453538 - RNA, 19 nt, Homo sapiens
gaaucgaaguguuuaugua

SEQ ID NO: 453539 - RNA, 19 nt, Homo sapiens
gcacugaaccuuaggcuuu

SEQ ID NO: 453540 - RNA, 19 nt, Homo sapiens
cauauucgcuaguguuuaa

SEQ ID NO: 453541 - RNA, 19 nt, Homo sapiens
auaaagagcuucugaaaca

SEQ ID NO: 453542 - RNA, 19 nt, Homo sapiens
gcaggucaguuguaauaaa

SEQ ID NO: 453543 - RNA, 19 nt, Homo sapiens
guacagaaggcaaaguuua

SEQ ID NO: 453544 - RNA, 19 nt, Homo sapiens
ggauuuggauguaguaaug

SEQ ID NO: 453545 - RNA, 19 nt, Homo sapiens
gacagaaguggaaauauua

SEQ ID NO: 453546 - RNA, 19 nt, Homo sapiens
gaauggugcuguuuaaagu

SEQ ID NO: 453547 - RNA, 19 nt, Homo sapiens
gaacgugcauccuuguaau

SEQ ID NO: 453548 - RNA, 19 nt, Homo sapiens
ccauguaugucgauugaua

SEQ ID NO: 453549 - RNA, 19 nt, Homo sapiens
gauauugccuuauuugucu

SEQ ID NO: 453550 - RNA, 19 nt, Homo sapiens
gaaaggagacauugcucua

SEQ ID NO: 453551 - RNA, 19 nt, Homo sapiens
gugcugauccuaagaauuu

SEQ ID NO: 453552 - RNA, 19 nt, Homo sapiens
cauggcaccugaaagaaua

SEQ ID NO: 453553 - RNA, 19 nt, Homo sapiens
cuucuucacuuacccauua

SEQ ID NO: 453554 - RNA, 19 nt, Homo sapiens
gauaucaaaccuuccaaua

SEQ ID NO: 453555 - RNA, 19 nt, Homo sapiens
gcaaauaauggcaguuaaa

SEQ ID NO: 453556 - RNA, 19 nt, Homo sapiens
gugcagggauauugccuua

SEQ ID NO: 453557 - RNA, 19 nt, Homo sapiens
gugauauucuguugcuuua

SEQ ID NO: 453558 - RNA, 19 nt, Homo sapiens
caaaccaagugggcaaaua

SEQ ID NO: 453559 - RNA, 19 nt, Homo sapiens
ugaaagaccuuggagaaau

SEQ ID NO: 453560 - RNA, 19 nt, Homo sapiens
gaauuccuccucuauuuaa

SEQ ID NO: 453561 - RNA, 19 nt, Homo sapiens
gauaugauguccgcucuga

SEQ ID NO: 453562 - RNA, 19 nt, Homo sapiens
uaagaacuguacauuguga

SEQ ID NO: 453563 - RNA, 19 nt, Homo sapiens
gcuagaaccucucguaguc

SEQ ID NO: 453564 - RNA, 19 nt, Homo sapiens
caucauaacucacuaacag

SEQ ID NO: 453565 - RNA, 19 nt, Homo sapiens
gcccauacauuguucaguu

SEQ ID NO: 453566 - RNA, 19 nt, Homo sapiens
gagcuaaucugaccguucu

SEQ ID NO: 453567 - RNA, 19 nt, Homo sapiens
gcacugaaguugaauuuug

SEQ ID NO: 453568 - RNA, 19 nt, Homo sapiens
gaagcaagacguaaagaau

SEQ ID NO: 453569 - RNA, 19 nt, Homo sapiens
gcucugaugucuggaguuu

SEQ ID NO: 453570 - RNA, 19 nt, Homo sapiens
gaaagcacuaaaccacuua

SEQ ID NO: 453571 - RNA, 19 nt, Homo sapiens
gcaaauccaccuuucaaau

SEQ ID NO: 453572 - RNA, 19 nt, Homo sapiens
guagcaaugugccuugauu

SEQ ID NO: 453573 - RNA, 19 nt, Homo sapiens
gauauucuguugcuuuaca

SEQ ID NO: 453574 - RNA, 19 nt, Homo sapiens
gugauuaucucuuugaucu

SEQ ID NO: 453575 - RNA, 19 nt, Homo sapiens
uaaagucacaucccuguaa

SEQ ID NO: 453576 - RNA, 19 nt, Homo sapiens
ucccaagccugauacuuua

SEQ ID NO: 453577 - RNA, 19 nt, Homo sapiens
ggaggaauuuacuuucuuc

SEQ ID NO: 453578 - RNA, 19 nt, Homo sapiens
gcucuucacucccaacaau

SEQ ID NO: 453579 - RNA, 19 nt, Homo sapiens
ccucagcacuguuacaaga

SEQ ID NO: 453580 - RNA, 19 nt, Homo sapiens
gaugugcucagccaaauuu

SEQ ID NO: 453581 - RNA, 19 nt, Homo sapiens
guauaaagagcuucugaaa

SEQ ID NO: 453582 - RNA, 19 nt, Homo sapiens
caucaacuuugucaacuug

SEQ ID NO: 453583 - RNA, 19 nt, Homo sapiens
uaacacaagucgugaaagg

SEQ ID NO: 453584 - RNA, 19 nt, Homo sapiens
aagcuaaugugcagggaua

SEQ ID NO: 453585 - RNA, 19 nt, Homo sapiens
ggcaaggaguuuauuacaa

SEQ ID NO: 453586 - RNA, 19 nt, Homo sapiens
acaagaggccauuuaagua

SEQ ID NO: 453587 - RNA, 19 nt, Homo sapiens
ugaaagcacuaaaccacuu

SEQ ID NO: 453588 - RNA, 19 nt, Homo sapiens
caagaggccauuuaaguau

SEQ ID NO: 453589 - RNA, 19 nt, Homo sapiens
caccaggacugaaagaaga

SEQ ID NO: 453590 - RNA, 19 nt, Homo sapiens
ccagacaccaugugcaaua

SEQ ID NO: 453591 - RNA, 19 nt, Homo sapiens
gaggucgcaugcuauguuu

SEQ ID NO: 453592 - RNA, 19 nt, Homo sapiens
gaaauauuaagcucuguga

SEQ ID NO: 453593 - RNA, 19 nt, Homo sapiens
guauggaacucaugucuac

SEQ ID NO: 453594 - RNA, 19 nt, Homo sapiens
gggcaaauaauggcaguua

SEQ ID NO: 453595 - RNA, 19 nt, Homo sapiens
uugaauuccuccucuauuu

SEQ ID NO: 453596 - RNA, 19 nt, Homo sapiens
uagggucacuuugccauua

SEQ ID NO: 453597 - RNA, 19 nt, Homo sapiens
ucaguacgaucaaguuguu

SEQ ID NO: 453598 - RNA, 19 nt, Homo sapiens
ucugaaacaucccuuuauu

SEQ ID NO: 453599 - RNA, 19 nt, Homo sapiens
acagcaagguuuacucuga

SEQ ID NO: 453600 - RNA, 19 nt, Homo sapiens
ucacaucccuguaaauugc

SEQ ID NO: 453601 - RNA, 19 nt, Homo sapiens
ugcaauagauuacugaugu

SEQ ID NO: 453602 - RNA, 19 nt, Homo sapiens
cauagaaacucgggcuuga

SEQ ID NO: 453603 - RNA, 19 nt, Homo sapiens
ugaauuccuccucuauuua

SEQ ID NO: 453604 - RNA, 19 nt, Homo sapiens
gggagaauggugcuguuua

SEQ ID NO: 453605 - RNA, 19 nt, Homo sapiens
uaagauugguguucguuuc

SEQ ID NO: 453606 - RNA, 19 nt, Homo sapiens
ggaagcaagacguaaagaa

SEQ ID NO: 453607 - RNA, 19 nt, Homo sapiens
ccacaggccgauuuccuua

SEQ ID NO: 453608 - RNA, 19 nt, Homo sapiens
ucacuaacagggagaagua

SEQ ID NO: 453609 - RNA, 19 nt, Homo sapiens
ggagacaaaggaggaauuu

SEQ ID NO: 453610 - RNA, 19 nt, Homo sapiens
ggaaggacacagugaugaa

SEQ ID NO: 453611 - RNA, 19 nt, Homo sapiens
ggcaaauaauggcaguuaa

SEQ ID NO: 453612 - RNA, 19 nt, Homo sapiens
caaauccaccuuucaaauc

SEQ ID NO: 453613 - RNA, 19 nt, Homo sapiens
gcaauagauuacugaugug

SEQ ID NO: 453614 - RNA, 19 nt, Homo sapiens
gacaccaugugcaauaaga

SEQ ID NO: 453615 - RNA, 19 nt, Homo sapiens
agcaagacguaaagaauuu

SEQ ID NO: 453616 - RNA, 19 nt, Homo sapiens
ccaaaaggccaaaguauaa

SEQ ID NO: 453617 - RNA, 19 nt, Homo sapiens
cagcaagguuuacucugaa

SEQ ID NO: 453618 - RNA, 19 nt, Homo sapiens
caaagaaggugcugauccu

SEQ ID NO: 453619 - RNA, 19 nt, Homo sapiens
ucagccaaauuuccuguuu

SEQ ID NO: 453620 - RNA, 19 nt, Homo sapiens
guaaugcggaguagugauu

SEQ ID NO: 453621 - RNA, 19 nt, Homo sapiens
aaaccaagugggcaaauaa

SEQ ID NO: 453622 - RNA, 19 nt, Homo sapiens
ggacgaggagcuuaugguu

SEQ ID NO: 453623 - RNA, 19 nt, Homo sapiens
caggucaguuguaauaaau

SEQ ID NO: 453624 - RNA, 19 nt, Homo sapiens
aaagucacaucccuguaaa

SEQ ID NO: 453625 - RNA, 19 nt, Homo sapiens
uuaaguaucuugugcuucu

SEQ ID NO: 453626 - RNA, 19 nt, Homo sapiens
aaugugccuugauugauua

SEQ ID NO: 453627 - RNA, 19 nt, Homo sapiens
gagggugacuguuggaucu

SEQ ID NO: 453628 - RNA, 19 nt, Homo sapiens
ggaaauaccuugagcagaa

SEQ ID NO: 453629 - RNA, 19 nt, Homo sapiens
gaagauaggcucucaguaa

SEQ ID NO: 453630 - RNA, 19 nt, Homo sapiens
gaaagaugaugcucaguuu

SEQ ID NO: 453631 - RNA, 19 nt, Homo sapiens
guauaaagcucucaaaugu

SEQ ID NO: 453632 - RNA, 19 nt, Homo sapiens
caacauggcuucuccuuug

SEQ ID NO: 453633 - RNA, 19 nt, Homo sapiens
caacagaccuggugcucua

SEQ ID NO: 453634 - RNA, 19 nt, Homo sapiens
uaacaucacugucaaacuu

SEQ ID NO: 453635 - RNA, 19 nt, Homo sapiens
gaagcacccuaaugcauaa

SEQ ID NO: 453636 - RNA, 19 nt, Homo sapiens
gaggaaggauuagaagaua

SEQ ID NO: 453637 - RNA, 19 nt, Homo sapiens
ccagauagcucaauacucu

SEQ ID NO: 453638 - RNA, 19 nt, Homo sapiens
gaaauagacagacuuaaug

SEQ ID NO: 453639 - RNA, 19 nt, Homo sapiens
aggagaagaugacuaaaua

SEQ ID NO: 453640 - RNA, 19 nt, Homo sapiens
gaaaucaaauggaaaucug

SEQ ID NO: 453641 - RNA, 19 nt, Homo sapiens
gauaccagauagcucaaua

SEQ ID NO: 453642 - RNA, 19 nt, Homo sapiens
gaagaugacuaaauagaac

SEQ ID NO: 453643 - RNA, 19 nt, Homo sapiens
ggaugaaggugaagaagau

SEQ ID NO: 453644 - RNA, 19 nt, Homo sapiens
aagaggcacugcauuauuu

SEQ ID NO: 453645 - RNA, 19 nt, Homo sapiens
cagaagaggucagaauuga

SEQ ID NO: 453646 - RNA, 19 nt, Homo sapiens
auaaagcucucaaauguga

SEQ ID NO: 453647 - RNA, 19 nt, Homo sapiens
gauaggcucucaguaagaa

SEQ ID NO: 453648 - RNA, 19 nt, Homo sapiens
acauguaucugucuacuuu

SEQ ID NO: 453649 - RNA, 19 nt, Homo sapiens
cgauauggaugaugaagaa

SEQ ID NO: 453650 - RNA, 19 nt, Homo sapiens
uaggagaggucaucaaaga

SEQ ID NO: 453651 - RNA, 19 nt, Homo sapiens
gaagaggcacugcauuauu

SEQ ID NO: 453652 - RNA, 19 nt, Homo sapiens
cuagauggauaguauguaa

SEQ ID NO: 453653 - RNA, 19 nt, Homo sapiens
guaacaaccuaucuagaug

SEQ ID NO: 453654 - RNA, 19 nt, Homo sapiens
uagaagauauugacgaaga

SEQ ID NO: 453655 - RNA, 19 nt, Homo sapiens
gcucuaaugccaaguuaua

SEQ ID NO: 453656 - RNA, 19 nt, Homo sapiens
ugaagaagaugaagaugau

SEQ ID NO: 453657 - RNA, 19 nt, Homo sapiens
acuaugaccuuccaaguuu

SEQ ID NO: 453658 - RNA, 19 nt, Homo sapiens
gagaagaagaugaugauga

SEQ ID NO: 453659 - RNA, 19 nt, Homo sapiens
gaguugaagugacagaauu

SEQ ID NO: 453660 - RNA, 19 nt, Homo sapiens
ggaaacguggguucaauuu

SEQ ID NO: 453661 - RNA, 19 nt, Homo sapiens
ggaaagaugaugcucaguu

SEQ ID NO: 453662 - RNA, 19 nt, Homo sapiens
gaaaggauuugacgaaacg

SEQ ID NO: 453663 - RNA, 19 nt, Homo sapiens
gaaguccaccgaaaucaaa

SEQ ID NO: 453664 - RNA, 19 nt, Homo sapiens
uguaggaucuuauuuggaa

SEQ ID NO: 453665 - RNA, 19 nt, Homo sapiens
gaaucuugcuccaauaaag

SEQ ID NO: 453666 - RNA, 19 nt, Homo sapiens
agacauccuugcaguuuaa

SEQ ID NO: 453667 - RNA, 19 nt, Homo sapiens
gaaccagagagcuucuuua

SEQ ID NO: 453668 - RNA, 19 nt, Homo sapiens
gaccagaguugaagugaca

SEQ ID NO: 453669 - RNA, 19 nt, Homo sapiens
gagaagaugacuaaauaga

SEQ ID NO: 453670 - RNA, 19 nt, Homo sapiens
ugaaggagaagaugacuaa

SEQ ID NO: 453671 - RNA, 19 nt, Homo sapiens
agaagaagaugaugaugau

SEQ ID NO: 453672 - RNA, 19 nt, Homo sapiens
ccagagagcuucuuuaccu

SEQ ID NO: 453673 - RNA, 19 nt, Homo sapiens
ccaccgaaaucaaauggaa

SEQ ID NO: 453674 - RNA, 19 nt, Homo sapiens
gaaauaccuugagcagaau

SEQ ID NO: 453675 - RNA, 19 nt, Homo sapiens
ggaaggauuagaagauauu

SEQ ID NO: 453676 - RNA, 19 nt, Homo sapiens
ugaagaggaggaaggauua

SEQ ID NO: 453677 - RNA, 19 nt, Homo sapiens
gaagaggucagaauugauc

SEQ ID NO: 453678 - RNA, 19 nt, Homo sapiens
acacauugaugaaguacaa

SEQ ID NO: 453679 - RNA, 19 nt, Homo sapiens
guaguaguguauagaauuc

SEQ ID NO: 453680 - RNA, 19 nt, Homo sapiens
gcaggaagaggcagcauga

SEQ ID NO: 453681 - RNA, 19 nt, Homo sapiens
gguauaaagcucucaaaug

SEQ ID NO: 453682 - RNA, 19 nt, Homo sapiens
ggaugaggaugaaggugaa

SEQ ID NO: 453683 - RNA, 19 nt, Homo sapiens
ugaacacauugaugaagua

SEQ ID NO: 453684 - RNA, 19 nt, Homo sapiens
ggaaaggauuugacgaaac

SEQ ID NO: 453685 - RNA, 19 nt, Homo sapiens
ucaggaaucuugcuccaau

SEQ ID NO: 453686 - RNA, 19 nt, Homo sapiens
gcagagaagcacccuaaug

SEQ ID NO: 453687 - RNA, 19 nt, Homo sapiens
cagacauccuugcaguuua

SEQ ID NO: 453688 - RNA, 19 nt, Homo sapiens
auaaaguucucuccaaaga

SEQ ID NO: 453689 - RNA, 19 nt, Homo sapiens
cuccaugguucucaauuua

SEQ ID NO: 453690 - RNA, 19 nt, Homo sapiens
ggccaaacccauuacagua

SEQ ID NO: 453691 - RNA, 19 nt, Homo sapiens
gaaccuguaggaucuuauu

SEQ ID NO: 453692 - RNA, 19 nt, Homo sapiens
agaugaagaugaugaugaa

SEQ ID NO: 453693 - RNA, 19 nt, Homo sapiens
ggaggaaggauuagaagau

SEQ ID NO: 453694 - RNA, 19 nt, Homo sapiens
ugcaggugcugaugaguua

SEQ ID NO: 453695 - RNA, 19 nt, Homo sapiens
gaaucugggugggauaaug

SEQ ID NO: 453696 - RNA, 19 nt, Homo sapiens
gagcuucuuuaccugguuu

SEQ ID NO: 453697 - RNA, 19 nt, Homo sapiens
cgagucaaacgcagaauaa

SEQ ID NO: 453698 - RNA, 19 nt, Homo sapiens
ccaugguucucaauuuauu

SEQ ID NO: 453699 - RNA, 19 nt, Homo sapiens
agacagacuuaaugaacaa

SEQ ID NO: 453700 - RNA, 19 nt, Homo sapiens
ccaagaagauaggcucuca

SEQ ID NO: 453701 - RNA, 19 nt, Homo sapiens
gaagaggcagcaugaggaa

SEQ ID NO: 453702 - RNA, 19 nt, Homo sapiens
gcaaaaguguaacaaccua

SEQ ID NO: 453703 - RNA, 19 nt, Homo sapiens
agaagcacccuaaugcaua

SEQ ID NO: 453704 - RNA, 19 nt, Homo sapiens
uauggacaguuagcauuua

SEQ ID NO: 453705 - RNA, 19 nt, Homo sapiens
auagaacacugauggauuc

SEQ ID NO: 453706 - RNA, 19 nt, Homo sapiens
gaaacguggguucaauuug

SEQ ID NO: 453707 - RNA, 19 nt, Homo sapiens
cuauguggauugaguaaug

SEQ ID NO: 453708 - RNA, 19 nt, Homo sapiens
caaacuccgccaaccauuu

SEQ ID NO: 453709 - RNA, 19 nt, Homo sapiens
gugcucuaaugccaaguua

SEQ ID NO: 453710 - RNA, 19 nt, Homo sapiens
gaucuuauuuggaauugac

SEQ ID NO: 453711 - RNA, 19 nt, Homo sapiens
cagaaccuguaggaucuua

SEQ ID NO: 453712 - RNA, 19 nt, Homo sapiens
aaacguggguucaauuugc

SEQ ID NO: 453713 - RNA, 19 nt, Homo sapiens
ggaaggagaggaggaugaa

SEQ ID NO: 453714 - RNA, 19 nt, Homo sapiens
gugaagaagaugaagauga

SEQ ID NO: 453715 - RNA, 19 nt, Homo sapiens
ggaaccagagagcuucuuu

SEQ ID NO: 453716 - RNA, 19 nt, Homo sapiens
uccaaagaauuucaucuga

SEQ ID NO: 453717 - RNA, 19 nt, Homo sapiens
caggaaucuugcuccaaua

SEQ ID NO: 453718 - RNA, 19 nt, Homo sapiens
ucucaaaugugaccaugug

SEQ ID NO: 453719 - RNA, 19 nt, Homo sapiens
cgauugaacacauugauga

SEQ ID NO: 453720 - RNA, 19 nt, Homo sapiens
agaggaggaugaaggagaa

SEQ ID NO: 453721 - RNA, 19 nt, Homo sapiens
gagaagcacccuaaugcau

SEQ ID NO: 453722 - RNA, 19 nt, Homo sapiens
caaaugugaccaugugaau

SEQ ID NO: 453723 - RNA, 19 nt, Homo sapiens
ugucuacuuucucuuguuu

SEQ ID NO: 453724 - RNA, 19 nt, Homo sapiens
agaaggagaaggagaagaa

SEQ ID NO: 453725 - RNA, 19 nt, Homo sapiens
ugaagaaggagaaggagaa

SEQ ID NO: 453726 - RNA, 19 nt, Homo sapiens
cuacuugguucccgauaug

SEQ ID NO: 453727 - RNA, 19 nt, Homo sapiens
guuaggagaggucaucaaa

SEQ ID NO: 453728 - RNA, 19 nt, Homo sapiens
ggagagaacuaugaugaua

SEQ ID NO: 453729 - RNA, 19 nt, Homo sapiens
gaacaucaguuguggaaau

SEQ ID NO: 453730 - RNA, 19 nt, Homo sapiens
gaacuaugaugauaacuca

SEQ ID NO: 453731 - RNA, 19 nt, Homo sapiens
gagaagaauucacuuacaa

SEQ ID NO: 453732 - RNA, 19 nt, Homo sapiens
gaauugggcuaugaaguuu

SEQ ID NO: 453733 - RNA, 19 nt, Homo sapiens
ccagaaaggucuacaguuc

SEQ ID NO: 453734 - RNA, 19 nt, Homo sapiens
cgacuccaauuacauuaua

SEQ ID NO: 453735 - RNA, 19 nt, Homo sapiens
gaaacagagugguccagaa

SEQ ID NO: 453736 - RNA, 19 nt, Homo sapiens
gcacaacccacacuucaaa

SEQ ID NO: 453737 - RNA, 19 nt, Homo sapiens
gaagguuugucugugaaua

SEQ ID NO: 453738 - RNA, 19 nt, Homo sapiens
gaaguaugcucaggaaauc

SEQ ID NO: 453739 - RNA, 19 nt, Homo sapiens
caacaucaacaaugcauuu

SEQ ID NO: 453740 - RNA, 19 nt, Homo sapiens
gugaaaccauuacaucuga

SEQ ID NO: 453741 - RNA, 19 nt, Homo sapiens
gggaacauguuuauaaugg

SEQ ID NO: 453742 - RNA, 19 nt, Homo sapiens
ucagggaacauguuuauaa

SEQ ID NO: 453743 - RNA, 19 nt, Homo sapiens
cuucguaccuuggaauuua

SEQ ID NO: 453744 - RNA, 19 nt, Homo sapiens
gaaaggaagguuugucugu

SEQ ID NO: 453745 - RNA, 19 nt, Homo sapiens
gaauuuauaccgaaaggaa

SEQ ID NO: 453746 - RNA, 19 nt, Homo sapiens
caacagaaagggcccaauu

SEQ ID NO: 453747 - RNA, 19 nt, Homo sapiens
guauucaccugaccucuug

SEQ ID NO: 453748 - RNA, 19 nt, Homo sapiens
ggaaaucgaugagaugaac

SEQ ID NO: 453749 - RNA, 19 nt, Homo sapiens
gauugacccuugagacuau

SEQ ID NO: 453750 - RNA, 19 nt, Homo sapiens
ugaauaugcuggugagguu

SEQ ID NO: 453751 - RNA, 19 nt, Homo sapiens
gauauaggaucuggaggaa

SEQ ID NO: 453752 - RNA, 19 nt, Homo sapiens
gaugagagccuugaagaug

SEQ ID NO: 453753 - RNA, 19 nt, Homo sapiens
agaaacaacucgcaacauc

SEQ ID NO: 453754 - RNA, 19 nt, Homo sapiens
guacugcuuuccugccuuu

SEQ ID NO: 453755 - RNA, 19 nt, Homo sapiens
uuaagcaucucaacaacuu

SEQ ID NO: 453756 - RNA, 19 nt, Homo sapiens
gaaggaacccagcaugugu

SEQ ID NO: 453757 - RNA, 19 nt, Homo sapiens
gagagaacuaugaugauaa

SEQ ID NO: 453758 - RNA, 19 nt, Homo sapiens
ugaaugaauugggcuauga

SEQ ID NO: 453759 - RNA, 19 nt, Homo sapiens
ccaacuaccacgucuuuaa

SEQ ID NO: 453760 - RNA, 19 nt, Homo sapiens
ccaaagcacuucccaaagc

SEQ ID NO: 453761 - RNA, 19 nt, Homo sapiens
gaaguucagagaagaauuc

SEQ ID NO: 453762 - RNA, 19 nt, Homo sapiens
gagaugagagccuugaaga

SEQ ID NO: 453763 - RNA, 19 nt, Homo sapiens
ucagagaagaauucacuua

SEQ ID NO: 453764 - RNA, 19 nt, Homo sapiens
gugguuggaucaagaagaa

SEQ ID NO: 453765 - RNA, 19 nt, Homo sapiens
gaaacaacucgcaacauca

SEQ ID NO: 453766 - RNA, 19 nt, Homo sapiens
caaaucauguacugcuuuc

SEQ ID NO: 453767 - RNA, 19 nt, Homo sapiens
uauaggaucuggaggaaag

SEQ ID NO: 453768 - RNA, 19 nt, Homo sapiens
cagggaacauguuuauaau

SEQ ID NO: 453769 - RNA, 19 nt, Homo sapiens
aaacagagugguccagaaa

SEQ ID NO: 453770 - RNA, 19 nt, Homo sapiens
ugaauugggcuaugaaguu

SEQ ID NO: 453771 - RNA, 19 nt, Homo sapiens
caaccacaacgaaccauuu

SEQ ID NO: 453772 - RNA, 19 nt, Homo sapiens
gaaucccggugaaaccauu

SEQ ID NO: 453773 - RNA, 19 nt, Homo sapiens
caacgaaccauuucucgau

SEQ ID NO: 453774 - RNA, 19 nt, Homo sapiens
gucagugccuccaaagaaa

SEQ ID NO: 453775 - RNA, 19 nt, Homo sapiens
caaaauccgacuccaauua

SEQ ID NO: 453776 - RNA, 19 nt, Homo sapiens
auaagugggugccucauga

SEQ ID NO: 453777 - RNA, 19 nt, Homo sapiens
cugaagaacucaaugucaa

SEQ ID NO: 453778 - RNA, 19 nt, Homo sapiens
cgacugagcagcuggaugu

SEQ ID NO: 453779 - RNA, 19 nt, Homo sapiens
ccaaagaaaggcuagauca

SEQ ID NO: 453780 - RNA, 19 nt, Homo sapiens
cacgagaaguugcugaaga

SEQ ID NO: 453781 - RNA, 19 nt, Homo sapiens
cccaggaacugcuaacgaa

SEQ ID NO: 453782 - RNA, 19 nt, Homo sapiens
uggcauuggucaacagaaa

SEQ ID NO: 453783 - RNA, 19 nt, Homo sapiens
caaaaugggucguaaagca

SEQ ID NO: 453784 - RNA, 19 nt, Homo sapiens
cauuacaucugagaaguau

SEQ ID NO: 453785 - RNA, 19 nt, Homo sapiens
acgagaaguugcugaagaa

SEQ ID NO: 453786 - RNA, 19 nt, Homo sapiens
gugcaguggugguucaaga

SEQ ID NO: 453787 - RNA, 19 nt, Homo sapiens
gcagaaacaacucgcaaca

SEQ ID NO: 453788 - RNA, 19 nt, Homo sapiens
guagaaaagucgaacauca

SEQ ID NO: 453789 - RNA, 19 nt, Homo sapiens
gagaaggaacccagcaugu

SEQ ID NO: 453790 - RNA, 19 nt, Homo sapiens
gaucaugggaaacuaagga

SEQ ID NO: 453791 - RNA, 19 nt, Homo sapiens
aaggaagguuugucuguga

SEQ ID NO: 453792 - RNA, 19 nt, Homo sapiens
uuacuguggugccaaauca

SEQ ID NO: 453793 - RNA, 19 nt, Homo sapiens
aaagaaaggcuagaucaug

SEQ ID NO: 453794 - RNA, 19 nt, Homo sapiens
caucagggaacauguuuau

SEQ ID NO: 453795 - RNA, 19 nt, Homo sapiens
agagaagaauucacuuaca

SEQ ID NO: 453796 - RNA, 19 nt, Homo sapiens
uggcggaguuuaaggagaa

SEQ ID NO: 453797 - RNA, 19 nt, Homo sapiens
gaaagggcccaauucuucu

SEQ ID NO: 453798 - RNA, 19 nt, Homo sapiens
cacuacagcuuucugaauc

SEQ ID NO: 453799 - RNA, 19 nt, Homo sapiens
agugucaucuucucuuauu

SEQ ID NO: 453800 - RNA, 19 nt, Homo sapiens
aaacaacucgcaacaucaa

SEQ ID NO: 453801 - RNA, 19 nt, Homo sapiens
gaagaauucacuuacaaac

SEQ ID NO: 453802 - RNA, 19 nt, Homo sapiens
gaaugaauugggcuaugaa

SEQ ID NO: 453803 - RNA, 19 nt, Homo sapiens
ccaguacacuccugaucau

SEQ ID NO: 453804 - RNA, 19 nt, Homo sapiens
ccaaaucauguacugcuuu

SEQ ID NO: 453805 - RNA, 19 nt, Homo sapiens
acaggaauaaaccaacuua

SEQ ID NO: 453806 - RNA, 19 nt, Homo sapiens
gauaacucaugccuuagag

SEQ ID NO: 453807 - RNA, 19 nt, Homo sapiens
gcuagaucaugggaaacua

SEQ ID NO: 453808 - RNA, 19 nt, Homo sapiens
gaaaccauuacaucugaga

SEQ ID NO: 453809 - RNA, 19 nt, Homo sapiens
cugcuggucugauccacua

SEQ ID NO: 453810 - RNA, 19 nt, Homo sapiens
gaagaugaggagcguagug

SEQ ID NO: 453811 - RNA, 19 nt, Homo sapiens
acucaugccuuagagauau

SEQ ID NO: 453812 - RNA, 19 nt, Homo sapiens
uguugacccuacuuauaua

SEQ ID NO: 453813 - RNA, 19 nt, Homo sapiens
guugagagcaaucaucgaa

SEQ ID NO: 453814 - RNA, 19 nt, Homo sapiens
aaggcuagaucaugggaaa

SEQ ID NO: 453815 - RNA, 19 nt, Homo sapiens
caacuaccacgucuuuaag

SEQ ID NO: 453816 - RNA, 19 nt, Homo sapiens
agaaguaugcucaggaaau

SEQ ID NO: 453817 - RNA, 19 nt, Homo sapiens
ccacuacagcuuucugaau

SEQ ID NO: 453818 - RNA, 19 nt, Homo sapiens
gauaagugggugccucaug

SEQ ID NO: 453819 - RNA, 19 nt, Homo sapiens
gcugaagaacucaauguca

SEQ ID NO: 453820 - RNA, 19 nt, Homo sapiens
augagagccuugaagauga

SEQ ID NO: 453821 - RNA, 19 nt, Homo sapiens
uaaagcagcagaaacaacu

SEQ ID NO: 453822 - RNA, 19 nt, Homo sapiens
caaagauauugugccagaa

SEQ ID NO: 453823 - RNA, 19 nt, Homo sapiens
ggugaaaccauuacaucug

SEQ ID NO: 453824 - RNA, 19 nt, Homo sapiens
gccaaaucauguacugcuu

SEQ ID NO: 453825 - RNA, 19 nt, Homo sapiens
caaagaaaggcuagaucau

SEQ ID NO: 453826 - RNA, 19 nt, Homo sapiens
uaacucaugccuuagagau

SEQ ID NO: 453827 - RNA, 19 nt, Homo sapiens
ccucaugagcugacugaaa

SEQ ID NO: 453828 - RNA, 19 nt, Homo sapiens
ugaaagggcuguuguaaua

SEQ ID NO: 453829 - RNA, 19 nt, Homo sapiens
gaaaggcauuguugaauuu

SEQ ID NO: 453830 - RNA, 19 nt, Homo sapiens
aagcaaagcugaacuguaa

SEQ ID NO: 453831 - RNA, 19 nt, Homo sapiens
ggaaaggcauuguugaauu

SEQ ID NO: 453832 - RNA, 19 nt, Homo sapiens
gaaaguggguuugauuaaa

SEQ ID NO: 453833 - RNA, 19 nt, Homo sapiens
gcagaaacguaaagaaaug

SEQ ID NO: 453834 - RNA, 19 nt, Homo sapiens
gaagaagccuuuagccaau

SEQ ID NO: 453835 - RNA, 19 nt, Homo sapiens
gaugugauauuuaggcuuu

SEQ ID NO: 453836 - RNA, 19 nt, Homo sapiens
gaacaucaggcaaaucuuu

SEQ ID NO: 453837 - RNA, 19 nt, Homo sapiens
gaaguaguuugaugauuug

SEQ ID NO: 453838 - RNA, 19 nt, Homo sapiens
gaagugacaugcguacuga

SEQ ID NO: 453839 - RNA, 19 nt, Homo sapiens
gaggaggccuggagagaaa

SEQ ID NO: 453840 - RNA, 19 nt, Homo sapiens
ggcaaaggauucggauuua

SEQ ID NO: 453841 - RNA, 19 nt, Homo sapiens
gauguuagcaguuuauuga

SEQ ID NO: 453842 - RNA, 19 nt, Homo sapiens
guauuaagauuguggaaug

SEQ ID NO: 453843 - RNA, 19 nt, Homo sapiens
gaacaaaugaggcgccaaa

SEQ ID NO: 453844 - RNA, 19 nt, Homo sapiens
guaaagaaaugcaauugag

SEQ ID NO: 453845 - RNA, 19 nt, Homo sapiens
gaucuauccuuuacuugaa

SEQ ID NO: 453846 - RNA, 19 nt, Homo sapiens
gaacuucacaaucaagaaa

SEQ ID NO: 453847 - RNA, 19 nt, Homo sapiens
guacgaaggcccaaacaaa

SEQ ID NO: 453848 - RNA, 19 nt, Homo sapiens
gagacgacaggaagaauua

SEQ ID NO: 453849 - RNA, 19 nt, Homo sapiens
gaaucuaccugcugauauc

SEQ ID NO: 453850 - RNA, 19 nt, Homo sapiens
gaagaugccuaucaugaac

SEQ ID NO: 453851 - RNA, 19 nt, Homo sapiens
caccuuauguuuccaauga

SEQ ID NO: 453852 - RNA, 19 nt, Homo sapiens
ccagaagaauccaauguau

SEQ ID NO: 453853 - RNA, 19 nt, Homo sapiens
ggaaccacuugaacaacua

SEQ ID NO: 453854 - RNA, 19 nt, Homo sapiens
caacaaaggcaaaggauuc

SEQ ID NO: 453855 - RNA, 19 nt, Homo sapiens
cuguaaaucuucaggaaua

SEQ ID NO: 453856 - RNA, 19 nt, Homo sapiens
ggaagucuuuggaugaaau

SEQ ID NO: 453857 - RNA, 19 nt, Homo sapiens
gcaaaggauucggauuuau

SEQ ID NO: 453858 - RNA, 19 nt, Homo sapiens
ggaagaugccuaucaugaa

SEQ ID NO: 453859 - RNA, 19 nt, Homo sapiens
gcaaagggaacaaguugaa

SEQ ID NO: 453860 - RNA, 19 nt, Homo sapiens
caagaaaugcagaaacgua

SEQ ID NO: 453861 - RNA, 19 nt, Homo sapiens
gcaugggccucaaucagaa

SEQ ID NO: 453862 - RNA, 19 nt, Homo sapiens
uaaugucccucaaguuuau

SEQ ID NO: 453863 - RNA, 19 nt, Homo sapiens
uauaaugucccucaaguuu

SEQ ID NO: 453864 - RNA, 19 nt, Homo sapiens
caaaggauucggauuuauu

SEQ ID NO: 453865 - RNA, 19 nt, Homo sapiens
gaagaaaugcauauugaag

SEQ ID NO: 453866 - RNA, 19 nt, Homo sapiens
gaaagagacaugcgaaugg

SEQ ID NO: 453867 - RNA, 19 nt, Homo sapiens
cauauuaggcuacguauuc

SEQ ID NO: 453868 - RNA, 19 nt, Homo sapiens
ccagaaauuuccaccucua

SEQ ID NO: 453869 - RNA, 19 nt, Homo sapiens
acaacuagaugaugaagau

SEQ ID NO: 453870 - RNA, 19 nt, Homo sapiens
aagcugaacuguaaaucuu

SEQ ID NO: 453871 - RNA, 19 nt, Homo sapiens
aaaugcaucuggaggcuaa

SEQ ID NO: 453872 - RNA, 19 nt, Homo sapiens
ggaaagagacaugcgaaug

SEQ ID NO: 453873 - RNA, 19 nt, Homo sapiens
gauggaagucuuuggauga

SEQ ID NO: 453874 - RNA, 19 nt, Homo sapiens
gaaauuuccaccucuagga

SEQ ID NO: 453875 - RNA, 19 nt, Homo sapiens
uggaagaucuacagggaaa

SEQ ID NO: 453876 - RNA, 19 nt, Homo sapiens
cgaugucgguuguuuguug

SEQ ID NO: 453877 - RNA, 19 nt, Homo sapiens
gugaaaguggguuugauua

SEQ ID NO: 453878 - RNA, 19 nt, Homo sapiens
gaagagaggaagagaugau

SEQ ID NO: 453879 - RNA, 19 nt, Homo sapiens
uauuggaucuucaacuuug

SEQ ID NO: 453880 - RNA, 19 nt, Homo sapiens
caaaugaggcgccaaagag

SEQ ID NO: 453881 - RNA, 19 nt, Homo sapiens
gcacguuugaguacgaaua

SEQ ID NO: 453882 - RNA, 19 nt, Homo sapiens
gcccuaugaucuauccuuu

SEQ ID NO: 453883 - RNA, 19 nt, Homo sapiens
gccaaagagaggaaaguua

SEQ ID NO: 453884 - RNA, 19 nt, Homo sapiens
caaauuggaaagugaaaug

SEQ ID NO: 453885 - RNA, 19 nt, Homo sapiens
uucguaaucuuucaccuua

SEQ ID NO: 453886 - RNA, 19 nt, Homo sapiens
ugaaaguggguuugauuaa

SEQ ID NO: 453887 - RNA, 19 nt, Homo sapiens
gaauggguguaagacaauu

SEQ ID NO: 453888 - RNA, 19 nt, Homo sapiens
gcaaagcugaacuguaaau

SEQ ID NO: 453889 - RNA, 19 nt, Homo sapiens
agaagaauccaauguauca

SEQ ID NO: 453890 - RNA, 19 nt, Homo sapiens
gcuugaaucuagagcuuug

SEQ ID NO: 453891 - RNA, 19 nt, Homo sapiens
gaucuucaacuuugccauu

SEQ ID NO: 453892 - RNA, 19 nt, Homo sapiens
caugagagguagacagcuu

SEQ ID NO: 453893 - RNA, 19 nt, Homo sapiens
gaugauuuguuuggcauau

SEQ ID NO: 453894 - RNA, 19 nt, Homo sapiens
ucaaguuuauggcagugua

SEQ ID NO: 453895 - RNA, 19 nt, Homo sapiens
gaaaguuacagccgaaugg

SEQ ID NO: 453896 - RNA, 19 nt, Homo sapiens
cagugaagguguuuucuua

SEQ ID NO: 453897 - RNA, 19 nt, Homo sapiens
cacggaggaugaauucaaa

SEQ ID NO: 453898 - RNA, 19 nt, Homo sapiens
ggaaucuaccugcugauau

SEQ ID NO: 453899 - RNA, 19 nt, Homo sapiens
acacagcgaugucgguugu

SEQ ID NO: 453900 - RNA, 19 nt, Homo sapiens
gcauauugaaguaguuuga

SEQ ID NO: 453901 - RNA, 19 nt, Homo sapiens
gaggaggaacgacguagaa

SEQ ID NO: 453902 - RNA, 19 nt, Homo sapiens
gcgccaagaucugaugaga

SEQ ID NO: 453903 - RNA, 19 nt, Homo sapiens
aaagacaaauuggaaagug

SEQ ID NO: 453904 - RNA, 19 nt, Homo sapiens
uugaacaacuagaugauga

SEQ ID NO: 453905 - RNA, 19 nt, Homo sapiens
gaagguguuuucuuacuga

SEQ ID NO: 453906 - RNA, 19 nt, Homo sapiens
ggugaaaguggguuugauu

SEQ ID NO: 453907 - RNA, 19 nt, Homo sapiens
uggaauggguguaagacaa

SEQ ID NO: 453908 - RNA, 19 nt, Homo sapiens
gagagugucuaggccuuug

SEQ ID NO: 453909 - RNA, 19 nt, Homo sapiens
gauacacccaugagaggua

SEQ ID NO: 453910 - RNA, 19 nt, Homo sapiens
gggaaucuaccugcugaua

SEQ ID NO: 453911 - RNA, 19 nt, Homo sapiens
ccuaugaucuauccuuuac

SEQ ID NO: 453912 - RNA, 19 nt, Homo sapiens
ggaagugacaugcguacug

SEQ ID NO: 453913 - RNA, 19 nt, Homo sapiens
gagauggaagaacaaauga

SEQ ID NO: 453914 - RNA, 19 nt, Homo sapiens
ggaauggguguaagacaau

SEQ ID NO: 453915 - RNA, 19 nt, Homo sapiens
guagagggagagaagagua

SEQ ID NO: 453916 - RNA, 19 nt, Homo sapiens
gcaaugaacaugggagauc

SEQ ID NO: 453917 - RNA, 19 nt, Homo sapiens
ggaggaacgacguagaaga

SEQ ID NO: 453918 - RNA, 19 nt, Homo sapiens
gaaaugcagaaacguaaag

SEQ ID NO: 453919 - RNA, 19 nt, Homo sapiens
gaaagugaaauggaagaug

SEQ ID NO: 453920 - RNA, 19 nt, Homo sapiens
cagcaaagggaacaaguug

SEQ ID NO: 453921 - RNA, 19 nt, Homo sapiens
gccaauuugucucucuuga

SEQ ID NO: 453922 - RNA, 19 nt, Homo sapiens
ggagaaccaggagaaguuu

SEQ ID NO: 453923 - RNA, 19 nt, Homo sapiens
ggcuaaguauugcuuucua

SEQ ID NO: 453924 - RNA, 19 nt, Homo sapiens
guuuggaacaggagaauuu

SEQ ID NO: 453925 - RNA, 19 nt, Homo sapiens
ccaaagagaggaaaguuac

SEQ ID NO: 453926 - RNA, 19 nt, Homo sapiens
ugagauggaagaacaaaug

SEQ ID NO: 453927 - RNA, 19 nt, Homo sapiens
uagaagagaggaagagaug

SEQ ID NO: 453928 - RNA, 19 nt, Homo sapiens
ccaaagcccuuauguuuaa

SEQ ID NO: 453929 - RNA, 19 nt, Homo sapiens
ugaagaagcuugugcugua

SEQ ID NO: 453930 - RNA, 19 nt, Homo sapiens
gaaauugggugaagagcuu

SEQ ID NO: 453931 - RNA, 19 nt, Homo sapiens
gagaaaggaugguagauuc

SEQ ID NO: 453932 - RNA, 19 nt, Homo sapiens
gcaagggccauuuagauua

SEQ ID NO: 453933 - RNA, 19 nt, Homo sapiens
gauguuaucgcuuauguua

SEQ ID NO: 453934 - RNA, 19 nt, Homo sapiens
gacaaacacccacuuauuu

SEQ ID NO: 453935 - RNA, 19 nt, Homo sapiens
ggguuuaccuggaacauaa

SEQ ID NO: 453936 - RNA, 19 nt, Homo sapiens
ugucauaacuucauagaug

SEQ ID NO: 453937 - RNA, 19 nt, Homo sapiens
cuacuucucuguugucaaa

SEQ ID NO: 453938 - RNA, 19 nt, Homo sapiens
ggaggucccuggaaguuug

SEQ ID NO: 453939 - RNA, 19 nt, Homo sapiens
ggauuucccugguagugua

SEQ ID NO: 453940 - RNA, 19 nt, Homo sapiens
gaacuugauugccuaugga

SEQ ID NO: 453941 - RNA, 19 nt, Homo sapiens
ucucugaccuuucaucgua

SEQ ID NO: 453942 - RNA, 19 nt, Homo sapiens
ucacagagcuuuccguuuu

SEQ ID NO: 453943 - RNA, 19 nt, Homo sapiens
gaucuaugccuuucaacua

SEQ ID NO: 453944 - RNA, 19 nt, Homo sapiens
aaauuaaccucucacaguu

SEQ ID NO: 453945 - RNA, 19 nt, Homo sapiens
aaaccaaugugcagacuga

SEQ ID NO: 453946 - RNA, 19 nt, Homo sapiens
ccacaaaguaucuaacaaa

SEQ ID NO: 453947 - RNA, 19 nt, Homo sapiens
gaugguagauucuguuaac

SEQ ID NO: 453948 - RNA, 19 nt, Homo sapiens
gcagugaggcuguaaagug

SEQ ID NO: 453949 - RNA, 19 nt, Homo sapiens
ucaaagaaauucagaacag

SEQ ID NO: 453950 - RNA, 19 nt, Homo sapiens
ugacaaacacccacuuauu

SEQ ID NO: 453951 - RNA, 19 nt, Homo sapiens
guucagugcucauacguau

SEQ ID NO: 453952 - RNA, 19 nt, Homo sapiens
uaaauuaaccucucacagu

SEQ ID NO: 453953 - RNA, 19 nt, Homo sapiens
gcacugaggaugaaaauaa

SEQ ID NO: 453954 - RNA, 19 nt, Homo sapiens
ggagaaaggaugguagauu

SEQ ID NO: 453955 - RNA, 19 nt, Homo sapiens
gaaaagugcaaguccauua

SEQ ID NO: 453956 - RNA, 19 nt, Homo sapiens
ucccaaagcccuuauguuu

SEQ ID NO: 453957 - RNA, 19 nt, Homo sapiens
gugaagagcuuaggauucu

SEQ ID NO: 453958 - RNA, 19 nt, Homo sapiens
cauaccacacuuacaauua

SEQ ID NO: 453959 - RNA, 19 nt, Homo sapiens
cuugaagacuccaguauga

SEQ ID NO: 453960 - RNA, 19 nt, Homo sapiens
uagauucuguuaacucuug

SEQ ID NO: 453961 - RNA, 19 nt, Homo sapiens
caagggccauuuagauuag

SEQ ID NO: 453962 - RNA, 19 nt, Homo sapiens
uuucagccauguaucaaua

SEQ ID NO: 453963 - RNA, 19 nt, Homo sapiens
aaucagagcuccaguuugc

SEQ ID NO: 453964 - RNA, 19 nt, Homo sapiens
ccgagaugcuuaaguguga

SEQ ID NO: 453965 - RNA, 19 nt, Homo sapiens
gcaggaggcucaggugauc

SEQ ID NO: 453966 - RNA, 19 nt, Homo sapiens
agcaacagcuucagaaaga

SEQ ID NO: 453967 - RNA, 19 nt, Homo sapiens
caaagccggauucuuaauu

SEQ ID NO: 453968 - RNA, 19 nt, Homo sapiens
gccugugauuuccuaauua

SEQ ID NO: 453969 - RNA, 19 nt, Homo sapiens
uuaagugauuugccuguaa

SEQ ID NO: 453970 - RNA, 19 nt, Homo sapiens
ugaaaggugugcuagaaca

SEQ ID NO: 453971 - RNA, 19 nt, Homo sapiens
gugcaaguccauuaucuaa

SEQ ID NO: 453972 - RNA, 19 nt, Homo sapiens
uuaauucucugcaacacuu

SEQ ID NO: 453973 - RNA, 19 nt, Homo sapiens
ccuugagugucauuaguua

SEQ ID NO: 453974 - RNA, 19 nt, Homo sapiens
aaaugggaauucucaggua

SEQ ID NO: 453975 - RNA, 19 nt, Homo sapiens
guaacugguugcuguguca

SEQ ID NO: 453976 - RNA, 19 nt, Homo sapiens
cauaaguaguuaccacaga

SEQ ID NO: 453977 - RNA, 19 nt, Homo sapiens
gguccagaguaguuucuuu

SEQ ID NO: 453978 - RNA, 19 nt, Homo sapiens
gcugaucuaugccuuucaa

SEQ ID NO: 453979 - RNA, 19 nt, Homo sapiens
caauaaucauucuggauag

SEQ ID NO: 453980 - RNA, 19 nt, Homo sapiens
gagguuugccugugauuug

SEQ ID NO: 453981 - RNA, 19 nt, Homo sapiens
uaagugauuugccuguaau

SEQ ID NO: 453982 - RNA, 19 nt, Homo sapiens
aaucagcgauguauauaag

SEQ ID NO: 453983 - RNA, 19 nt, Homo sapiens
cccaaagcccuuauguuua

SEQ ID NO: 453984 - RNA, 19 nt, Homo sapiens
ggucaagcccagaaaguga

SEQ ID NO: 453985 - RNA, 19 nt, Homo sapiens
ugacaaaccauuuccaaca

SEQ ID NO: 453986 - RNA, 19 nt, Homo sapiens
gaaaucugaggccaucauu

SEQ ID NO: 453987 - RNA, 19 nt, Homo sapiens
aggcucaggugaucuguuu

SEQ ID NO: 453988 - RNA, 19 nt, Homo sapiens
ucaaucagagcuccaguuu

SEQ ID NO: 453989 - RNA, 19 nt, Homo sapiens
gcaacacuuugaggacauu

SEQ ID NO: 453990 - RNA, 19 nt, Homo sapiens
guacaggaaguaguucuaa

SEQ ID NO: 453991 - RNA, 19 nt, Homo sapiens
cagucuacauugagcauuu

SEQ ID NO: 453992 - RNA, 19 nt, Homo sapiens
gcugugucauaacuucaua

SEQ ID NO: 453993 - RNA, 19 nt, Homo sapiens
gagugucauuaguuacuuu

SEQ ID NO: 453994 - RNA, 19 nt, Homo sapiens
ccuggaacauaaguaguua

SEQ ID NO: 453995 - RNA, 19 nt, Homo sapiens
gcuuaagugugacaaguuc

SEQ ID NO: 453996 - RNA, 19 nt, Homo sapiens
gguagauucuguuaacucu

SEQ ID NO: 453997 - RNA, 19 nt, Homo sapiens
uugaggacauuuaugauug

SEQ ID NO: 453998 - RNA, 19 nt, Homo sapiens
gaagaagcuugugcuguac

SEQ ID NO: 453999 - RNA, 19 nt, Homo sapiens
ggcccgagaugcuuaagug

SEQ ID NO: 454000 - RNA, 19 nt, Homo sapiens
cacaggacauggaugaaau

SEQ ID NO: 454001 - RNA, 19 nt, Homo sapiens
agaacaaggucuccugauc

SEQ ID NO: 454002 - RNA, 19 nt, Homo sapiens
gggauugggcggaaaguga

SEQ ID NO: 454003 - RNA, 19 nt, Homo sapiens
gacaaaccauuuccaacag

SEQ ID NO: 454004 - RNA, 19 nt, Homo sapiens
agaaggaccugaagaagcu

SEQ ID NO: 454005 - RNA, 19 nt, Homo sapiens
gaagaaggaccugaagaag

SEQ ID NO: 454006 - RNA, 19 nt, Homo sapiens
auacguaucugcucauuuu

SEQ ID NO: 454007 - RNA, 19 nt, Homo sapiens
ugaagacuccaguaugaaa

SEQ ID NO: 454008 - RNA, 19 nt, Homo sapiens
aaagccggauucuuaauuc

SEQ ID NO: 454009 - RNA, 19 nt, Homo sapiens
gccuauggaucaaagaaau

SEQ ID NO: 454010 - RNA, 19 nt, Homo sapiens
acagugagccugagagaga

SEQ ID NO: 454011 - RNA, 19 nt, Homo sapiens
ucuauuggcugaucuaugc

SEQ ID NO: 454012 - RNA, 19 nt, Homo sapiens
agaagaaggaccugaagaa

SEQ ID NO: 454013 - RNA, 19 nt, Homo sapiens
gaaaauggcgacaagaaga

SEQ ID NO: 454014 - RNA, 19 nt, Homo sapiens
gagcuccaguuugcauuug

SEQ ID NO: 454015 - RNA, 19 nt, Homo sapiens
gcgagccggucaugcaguu

SEQ ID NO: 454016 - RNA, 19 nt, Homo sapiens
gaccuugagugucauuagu

SEQ ID NO: 454017 - RNA, 19 nt, Homo sapiens
ucagaaagagcucaaaaua

SEQ ID NO: 454018 - RNA, 19 nt, Homo sapiens
aaucugaggccaucauuga

SEQ ID NO: 454019 - RNA, 19 nt, Homo sapiens
gaaaggugugcuagaacaa

SEQ ID NO: 454020 - RNA, 19 nt, Homo sapiens
ugacggccauccacaagug

SEQ ID NO: 454021 - RNA, 19 nt, Homo sapiens
ggugggauuuguaaagcuu

SEQ ID NO: 454022 - RNA, 19 nt, Homo sapiens
ccugugauuuccuaauuau

SEQ ID NO: 454023 - RNA, 19 nt, Homo sapiens
cccaggaccuugaguguca

SEQ ID NO: 454024 - RNA, 19 nt, Homo sapiens
auaaguaguuaccacagaa

SEQ ID NO: 454025 - RNA, 19 nt, Homo sapiens
uauauaagccaguucacuu

SEQ ID NO: 454026 - RNA, 19 nt, Homo sapiens
gaucaaagaaauucagaac

SEQ ID NO: 454027 - RNA, 19 nt, Homo sapiens
caagaguucagugcucaua

SEQ ID NO: 454028 - RNA, 19 nt, Homo sapiens
gaacuuauuugcagcauuu

SEQ ID NO: 454029 - RNA, 19 nt, Homo sapiens
ggaaaggccucuugauguu

SEQ ID NO: 454030 - RNA, 19 nt, Homo sapiens
gaguuugucuguaccauua

SEQ ID NO: 454031 - RNA, 19 nt, Homo sapiens
gagaauuacuugacaguug

SEQ ID NO: 454032 - RNA, 19 nt, Homo sapiens
ggagagaucagcuuaguaa

SEQ ID NO: 454033 - RNA, 19 nt, Homo sapiens
ccuaauaugugcauuguaa

SEQ ID NO: 454034 - RNA, 19 nt, Homo sapiens
gcacaacgcccaaaggaaa

SEQ ID NO: 454035 - RNA, 19 nt, Homo sapiens
gaacaguaguggaaugaau

SEQ ID NO: 454036 - RNA, 19 nt, Homo sapiens
ggaaaaggcuuauugcauu

SEQ ID NO: 454037 - RNA, 19 nt, Homo sapiens
acacagagguaaucacuau

SEQ ID NO: 454038 - RNA, 19 nt, Homo sapiens
guaguggaaugaauguuaa

SEQ ID NO: 454039 - RNA, 19 nt, Homo sapiens
ggcuaaugcucaaguauuu

SEQ ID NO: 454040 - RNA, 19 nt, Homo sapiens
gcagugcucuucauagaca

SEQ ID NO: 454041 - RNA, 19 nt, Homo sapiens
agacacaucuugcagcauu

SEQ ID NO: 454042 - RNA, 19 nt, Homo sapiens
guacagagaggaaaguuga

SEQ ID NO: 454043 - RNA, 19 nt, Homo sapiens
guacagaaggugaguuaaa

SEQ ID NO: 454044 - RNA, 19 nt, Homo sapiens
cuaggaaccuguauacaug

SEQ ID NO: 454045 - RNA, 19 nt, Homo sapiens
caacggugguggauguaaa

SEQ ID NO: 454046 - RNA, 19 nt, Homo sapiens
gauguuaaguggauagaca

SEQ ID NO: 454047 - RNA, 19 nt, Homo sapiens
gcgacgagcugccugucua

SEQ ID NO: 454048 - RNA, 19 nt, Homo sapiens
gagaauaauuugacaagcu

SEQ ID NO: 454049 - RNA, 19 nt, Homo sapiens
ucacaacggugguggaugu

SEQ ID NO: 454050 - RNA, 19 nt, Homo sapiens
gaaccuguauacauguguu

SEQ ID NO: 454051 - RNA, 19 nt, Homo sapiens
ucacugacaauacugaaua

SEQ ID NO: 454052 - RNA, 19 nt, Homo sapiens
auacuuaggugguuucuuc

SEQ ID NO: 454053 - RNA, 19 nt, Homo sapiens
ucaugugagugccaaauuu

SEQ ID NO: 454054 - RNA, 19 nt, Homo sapiens
agaguaaccugugugcaua

SEQ ID NO: 454055 - RNA, 19 nt, Homo sapiens
agugugagcuaacuaguuu

SEQ ID NO: 454056 - RNA, 19 nt, Homo sapiens
gaaaugagaauuacuugac

SEQ ID NO: 454057 - RNA, 19 nt, Homo sapiens
ggacauccacccugagaau

SEQ ID NO: 454058 - RNA, 19 nt, Homo sapiens
gaaagcagaaaccaucuca

SEQ ID NO: 454059 - RNA, 19 nt, Homo sapiens
gaacucaagucccgcucau

SEQ ID NO: 454060 - RNA, 19 nt, Homo sapiens
uaaccugccuccuuugcuu

SEQ ID NO: 454061 - RNA, 19 nt, Homo sapiens
gaaaaggcuuauugcauug

SEQ ID NO: 454062 - RNA, 19 nt, Homo sapiens
gaagggacagcgaaagaug

SEQ ID NO: 454063 - RNA, 19 nt, Homo sapiens
gaccguggcgugugcauuu

SEQ ID NO: 454064 - RNA, 19 nt, Homo sapiens
gggauacuuuaaucagaaa

SEQ ID NO: 454065 - RNA, 19 nt, Homo sapiens
gguguuugcuuaugcacuu

SEQ ID NO: 454066 - RNA, 19 nt, Homo sapiens
gugagaggaguuaaauaua

SEQ ID NO: 454067 - RNA, 19 nt, Homo sapiens
gaccuaauaugugcauugu

SEQ ID NO: 454068 - RNA, 19 nt, Homo sapiens
acucaagucccgcucauua

SEQ ID NO: 454069 - RNA, 19 nt, Homo sapiens
aaaggccucuugauguuga

SEQ ID NO: 454070 - RNA, 19 nt, Homo sapiens
auaaacaucucaccggaau

SEQ ID NO: 454071 - RNA, 19 nt, Homo sapiens
gcuuggcccuuuauugaga

SEQ ID NO: 454072 - RNA, 19 nt, Homo sapiens
caauuggaggcauuuauuu

SEQ ID NO: 454073 - RNA, 19 nt, Homo sapiens
gagauaaguuuuccuguca

SEQ ID NO: 454074 - RNA, 19 nt, Homo sapiens
gggaaaauaaugcuuguua

SEQ ID NO: 454075 - RNA, 19 nt, Homo sapiens
aaccacagcuggcccgaaa

SEQ ID NO: 454076 - RNA, 19 nt, Homo sapiens
gauaucuguuguugcaaug

SEQ ID NO: 454077 - RNA, 19 nt, Homo sapiens
aagcagaaaccaucucauu

SEQ ID NO: 454078 - RNA, 19 nt, Homo sapiens
uuaaggcuaugcuucaguu

SEQ ID NO: 454079 - RNA, 19 nt, Homo sapiens
gcacaugcccuggaacauc

SEQ ID NO: 454080 - RNA, 19 nt, Homo sapiens
gggcgcaccagucguagua

SEQ ID NO: 454081 - RNA, 19 nt, Homo sapiens
ggaugaugcuucuugaaaa

SEQ ID NO: 454082 - RNA, 19 nt, Homo sapiens
cuacagcuauguuauucau

SEQ ID NO: 454083 - RNA, 19 nt, Homo sapiens
gaaaggccucuugauguug

SEQ ID NO: 454084 - RNA, 19 nt, Homo sapiens
guacaggaaaggccucuug

SEQ ID NO: 454085 - RNA, 19 nt, Homo sapiens
cacaugcccuggaacauca

SEQ ID NO: 454086 - RNA, 19 nt, Homo sapiens
cugcagugcucuucauaga

SEQ ID NO: 454087 - RNA, 19 nt, Homo sapiens
caggaaaggccucuugaug

SEQ ID NO: 454088 - RNA, 19 nt, Homo sapiens
gcgaagggacagcgaaaga

SEQ ID NO: 454089 - RNA, 19 nt, Homo sapiens
ggacaauuggaggcauuua

SEQ ID NO: 454090 - RNA, 19 nt, Homo sapiens
ugggauacuuuaaucagaa

SEQ ID NO: 454091 - RNA, 19 nt, Homo sapiens
ugagcuaacuaguuuccaa

SEQ ID NO: 454092 - RNA, 19 nt, Homo sapiens
aagagaggcugcaggaaca

SEQ ID NO: 454093 - RNA, 19 nt, Homo sapiens
uucauaaccugccuccuuu

SEQ ID NO: 454094 - RNA, 19 nt, Homo sapiens
ugacaguugggauacuuua

SEQ ID NO: 454095 - RNA, 19 nt, Homo sapiens
uuagagaaguagcauaugg

SEQ ID NO: 454096 - RNA, 19 nt, Homo sapiens
gagcuaacuaguuuccaaa

SEQ ID NO: 454097 - RNA, 19 nt, Homo sapiens
ggaggauguuaaguggaua

SEQ ID NO: 454098 - RNA, 19 nt, Homo sapiens
ucaugaagauguacaacca

SEQ ID NO: 454099 - RNA, 19 nt, Homo sapiens
gugcugcgcuucuucuucu

SEQ ID NO: 454100 - RNA, 19 nt, Homo sapiens
acacaguaagcauguauuu

SEQ ID NO: 454101 - RNA, 19 nt, Homo sapiens
ugugagaggaguuaaauau

SEQ ID NO: 454102 - RNA, 19 nt, Homo sapiens
agaaggaacaguaguggaa

SEQ ID NO: 454103 - RNA, 19 nt, Homo sapiens
gaggguggcaggaagagaa

SEQ ID NO: 454104 - RNA, 19 nt, Homo sapiens
aaacuguugugcuauugga

SEQ ID NO: 454105 - RNA, 19 nt, Homo sapiens
uaacacaguaagcauguau

SEQ ID NO: 454106 - RNA, 19 nt, Homo sapiens
acaauuggaggcauuuauu

SEQ ID NO: 454107 - RNA, 19 nt, Homo sapiens
guaugucacucaucuuacu

SEQ ID NO: 454108 - RNA, 19 nt, Homo sapiens
ucuguaccauuaggaguua

SEQ ID NO: 454109 - RNA, 19 nt, Homo sapiens
aguaguggaaugaauguua

SEQ ID NO: 454110 - RNA, 19 nt, Homo sapiens
gagaucagcuuaguaaaag

SEQ ID NO: 454111 - RNA, 19 nt, Homo sapiens
aaauggagagaucagcuua

SEQ ID NO: 454112 - RNA, 19 nt, Homo sapiens
uuacuugacaguugggaua

SEQ ID NO: 454113 - RNA, 19 nt, Homo sapiens
cauuaggaguuagguacua

SEQ ID NO: 454114 - RNA, 19 nt, Homo sapiens
ugauaucuguuguugcaau

SEQ ID NO: 454115 - RNA, 19 nt, Homo sapiens
uaaccugugugcauacucu

SEQ ID NO: 454116 - RNA, 19 nt, Homo sapiens
gacaugaugguacaggaaa

SEQ ID NO: 454117 - RNA, 19 nt, Homo sapiens
cggaggauguuaaguggau

SEQ ID NO: 454118 - RNA, 19 nt, Homo sapiens
aaacaucucaccggaauuc

SEQ ID NO: 454119 - RNA, 19 nt, Homo sapiens
cacugacaauacugaauaa

SEQ ID NO: 454120 - RNA, 19 nt, Homo sapiens
gcgcaccagucguaguaau

SEQ ID NO: 454121 - RNA, 19 nt, Homo sapiens
ggugguuucuucacugaca

SEQ ID NO: 454122 - RNA, 19 nt, Homo sapiens
gacaauuggaggcauuuau

SEQ ID NO: 454123 - RNA, 19 nt, Homo sapiens
gacauccacccugagaaua

SEQ ID NO: 454124 - RNA, 19 nt, Homo sapiens
agagguaugucacucaucu

SEQ ID NO: 454125 - RNA, 19 nt, Homo sapiens
uacagaaggugaguuaaag

SEQ ID NO: 454126 - RNA, 19 nt, Homo sapiens
uaagccaucacaagccaua

SEQ ID NO: 454127 - RNA, 19 nt, Homo sapiens
gacacaucuugcagcauuu

SEQ ID NO: 454128 - RNA, 19 nt, Homo sapiens
gagggaagucucaauauua

SEQ ID NO: 454129 - RNA, 19 nt, Homo sapiens
gaagagggaagucucaaua

SEQ ID NO: 454130 - RNA, 19 nt, Homo sapiens
gagcagggcuucuucaucu

SEQ ID NO: 454131 - RNA, 19 nt, Homo sapiens
ucaaggagaucaagauaga

SEQ ID NO: 454132 - RNA, 19 nt, Homo sapiens
gaaaggaguuagggucuca

SEQ ID NO: 454133 - RNA, 19 nt, Homo sapiens
gagaugaaguuugcaguca

SEQ ID NO: 454134 - RNA, 19 nt, Homo sapiens
ucaaauucauguucuccua

SEQ ID NO: 454135 - RNA, 19 nt, Homo sapiens
agagggaagucucaauauu

SEQ ID NO: 454136 - RNA, 19 nt, Homo sapiens
ggccauagguacuagacaa

SEQ ID NO: 454137 - RNA, 19 nt, Homo sapiens
aggcggagguuucagagua

SEQ ID NO: 454138 - RNA, 19 nt, Homo sapiens
gaggagaggguaagggaaa

SEQ ID NO: 454139 - RNA, 19 nt, Homo sapiens
gcagucaaauucauguucu

SEQ ID NO: 454140 - RNA, 19 nt, Homo sapiens
gcugggacaagaagaauaa

SEQ ID NO: 454141 - RNA, 19 nt, Homo sapiens
cuacuacccuuucuucuac

SEQ ID NO: 454142 - RNA, 19 nt, Homo sapiens
gaauaaggagaugaaguuu

SEQ ID NO: 454143 - RNA, 19 nt, Homo sapiens
agaauaaggagaugaaguu

SEQ ID NO: 454144 - RNA, 19 nt, Homo sapiens
caucaaggagaucaagaua

SEQ ID NO: 454145 - RNA, 19 nt, Homo sapiens
gaugugcuccagugacuuu

SEQ ID NO: 454146 - RNA, 19 nt, Homo sapiens
caagaagaauaaggagaug

SEQ ID NO: 454147 - RNA, 19 nt, Homo sapiens
uaagcuauuugggaaaguu

SEQ ID NO: 454148 - RNA, 19 nt, Homo sapiens
gcuaagcuauuugggaaag

SEQ ID NO: 454149 - RNA, 19 nt, Homo sapiens
auaaggagaugaaguuugc

SEQ ID NO: 454150 - RNA, 19 nt, Homo sapiens
cuacugcugugaggccaua

SEQ ID NO: 454151 - RNA, 19 nt, Homo sapiens
agggaagucucaauauuag

SEQ ID NO: 454152 - RNA, 19 nt, Homo sapiens
gggacaagaagaauaagga

SEQ ID NO: 454153 - RNA, 19 nt, Homo sapiens
ggagaucaagauagagaau

SEQ ID NO: 454154 - RNA, 19 nt, Homo sapiens
caagaucugcgcccagugu

SEQ ID NO: 454155 - RNA, 19 nt, Homo sapiens
agaagaauaaggagaugaa

SEQ ID NO: 454156 - RNA, 19 nt, Homo sapiens
gagccuggccgaagugaag

SEQ ID NO: 454157 - RNA, 19 nt, Homo sapiens
acaagaagaauaaggagau

SEQ ID NO: 454158 - RNA, 19 nt, Homo sapiens
gcaucaaggagaucaagau

SEQ ID NO: 454159 - RNA, 19 nt, Homo sapiens
gguacuagacaaccaauac

SEQ ID NO: 454160 - RNA, 19 nt, Homo sapiens
ucuacuacccuuucuucua

SEQ ID NO: 454161 - RNA, 19 nt, Homo sapiens
cagaugugcuccagugacu

SEQ ID NO: 454162 - RNA, 19 nt, Homo sapiens
cucagggucucagaaagua

SEQ ID NO: 454163 - RNA, 19 nt, Homo sapiens
ggguuggguuuucuaauuu

SEQ ID NO: 454164 - RNA, 19 nt, Homo sapiens
guacuagacaaccaauaca

SEQ ID NO: 454165 - RNA, 19 nt, Homo sapiens
ggagcagggcuucuucauc

SEQ ID NO: 454166 - RNA, 19 nt, Homo sapiens
gauguugggcuuccucucu

SEQ ID NO: 454167 - RNA, 19 nt, Homo sapiens
agaugaaguuugcagucaa

SEQ ID NO: 454168 - RNA, 19 nt, Homo sapiens
agaucaagauagagaaugg

SEQ ID NO: 454169 - RNA, 19 nt, Homo sapiens
ggcggagguuucagaguag

SEQ ID NO: 454170 - RNA, 19 nt, Homo sapiens
gcugauuggagcccagaaa

SEQ ID NO: 454171 - RNA, 19 nt, Homo sapiens
gagaucaagauagagaaug

SEQ ID NO: 454172 - RNA, 19 nt, Homo sapiens
gcugcgaggaguacgacua

SEQ ID NO: 454173 - RNA, 19 nt, Homo sapiens
cauagguacuagacaacca

SEQ ID NO: 454174 - RNA, 19 nt, Homo sapiens
cagaguagaaggugauguc

SEQ ID NO: 454175 - RNA, 19 nt, Homo sapiens
aaggagaucaagauagaga

SEQ ID NO: 454176 - RNA, 19 nt, Homo sapiens
aauaaggagaugaaguuug

SEQ ID NO: 454177 - RNA, 19 nt, Homo sapiens
gaagaauaaggagaugaag

SEQ ID NO: 454178 - RNA, 19 nt, Homo sapiens
gugcuccagugacuuugug

SEQ ID NO: 454179 - RNA, 19 nt, Homo sapiens
ucgauucccgggauucauu

SEQ ID NO: 454180 - RNA, 19 nt, Homo sapiens
aagagggaagucucaauau

SEQ ID NO: 454181 - RNA, 19 nt, Homo sapiens
gcggagguuucagaguaga

SEQ ID NO: 454182 - RNA, 19 nt, Homo sapiens
ccucagggucucagaaagu

SEQ ID NO: 454183 - RNA, 19 nt, Homo sapiens
gggaagaacuggcuaauuu

SEQ ID NO: 454184 - RNA, 19 nt, Homo sapiens
guaauacgcuguacaguaa

SEQ ID NO: 454185 - RNA, 19 nt, Homo sapiens
ccaacaagauagaguauaa

SEQ ID NO: 454186 - RNA, 19 nt, Homo sapiens
gauaaacgcuggagcaauc

SEQ ID NO: 454187 - RNA, 19 nt, Homo sapiens
gagcacauuucaaucauuu

SEQ ID NO: 454188 - RNA, 19 nt, Homo sapiens
gaaagaagauaugaccuau

SEQ ID NO: 454189 - RNA, 19 nt, Homo sapiens
gggcuaaaguguugaauug

SEQ ID NO: 454190 - RNA, 19 nt, Homo sapiens
gagcguugcuauuucauuu

SEQ ID NO: 454191 - RNA, 19 nt, Homo sapiens
gcgaggaccuggagauaaa

SEQ ID NO: 454192 - RNA, 19 nt, Homo sapiens
ggauagggaggaugaauua

SEQ ID NO: 454193 - RNA, 19 nt, Homo sapiens
caauuagucucuaugauga

SEQ ID NO: 454194 - RNA, 19 nt, Homo sapiens
uaacuuaccuccagacauc

SEQ ID NO: 454195 - RNA, 19 nt, Homo sapiens
auaaguagguuuccaauug

SEQ ID NO: 454196 - RNA, 19 nt, Homo sapiens
gggaaguucuuauguuuau

SEQ ID NO: 454197 - RNA, 19 nt, Homo sapiens
ggaaagaagauaugaccua

SEQ ID NO: 454198 - RNA, 19 nt, Homo sapiens
cugaagagauggauuaaga

SEQ ID NO: 454199 - RNA, 19 nt, Homo sapiens
gcacuggugucguggaguu

SEQ ID NO: 454200 - RNA, 19 nt, Homo sapiens
gggagaaacugccuacauc

SEQ ID NO: 454201 - RNA, 19 nt, Homo sapiens
ugaagcaggugauguaugu

SEQ ID NO: 454202 - RNA, 19 nt, Homo sapiens
gggaucagauuaccaggaa

SEQ ID NO: 454203 - RNA, 19 nt, Homo sapiens
agaaugggcuaaaguguug

SEQ ID NO: 454204 - RNA, 19 nt, Homo sapiens
ggagcuggaucauuggauu

SEQ ID NO: 454205 - RNA, 19 nt, Homo sapiens
ugacagacauaacucauca

SEQ ID NO: 454206 - RNA, 19 nt, Homo sapiens
gauaugaccuaugcaguuc

SEQ ID NO: 454207 - RNA, 19 nt, Homo sapiens
caagugcuauugucacaga

SEQ ID NO: 454208 - RNA, 19 nt, Homo sapiens
gaacaccauucagaaacuu

SEQ ID NO: 454209 - RNA, 19 nt, Homo sapiens
guagaacccauguuguaua

SEQ ID NO: 454210 - RNA, 19 nt, Homo sapiens
gcaaugccaguaaacuuaa

SEQ ID NO: 454211 - RNA, 19 nt, Homo sapiens
ucacagugcuuaguuacaa

SEQ ID NO: 454212 - RNA, 19 nt, Homo sapiens
gaagagauggauuaagaau

SEQ ID NO: 454213 - RNA, 19 nt, Homo sapiens
gcccagaaguccaaguuau

SEQ ID NO: 454214 - RNA, 19 nt, Homo sapiens
gaguagaugguaaacauuu

SEQ ID NO: 454215 - RNA, 19 nt, Homo sapiens
ggagcacauuucaaucauu

SEQ ID NO: 454216 - RNA, 19 nt, Homo sapiens
gaacccauguuguauacag

SEQ ID NO: 454217 - RNA, 19 nt, Homo sapiens
ggaauuguguuuugcguuu

SEQ ID NO: 454218 - RNA, 19 nt, Homo sapiens
gauuggagcccuuaagaug

SEQ ID NO: 454219 - RNA, 19 nt, Homo sapiens
gaggaugaauuaccaggau

SEQ ID NO: 454220 - RNA, 19 nt, Homo sapiens
ccuuggagcuggaucauug

SEQ ID NO: 454221 - RNA, 19 nt, Homo sapiens
gauaaucuaguugggaaua

SEQ ID NO: 454222 - RNA, 19 nt, Homo sapiens
gaagaacuggcuaauuugu

SEQ ID NO: 454223 - RNA, 19 nt, Homo sapiens
ggaagaacuggcuaauuug

SEQ ID NO: 454224 - RNA, 19 nt, Homo sapiens
gaugaaauuggcaguauug

SEQ ID NO: 454225 - RNA, 19 nt, Homo sapiens
gaaggauucagcacgagua

SEQ ID NO: 454226 - RNA, 19 nt, Homo sapiens
ccaauuagucucuaugaug

SEQ ID NO: 454227 - RNA, 19 nt, Homo sapiens
gaucaauaauggaggcaau

SEQ ID NO: 454228 - RNA, 19 nt, Homo sapiens
guagacauaucugaagaga

SEQ ID NO: 454229 - RNA, 19 nt, Homo sapiens
agacugugauauuguguaa

SEQ ID NO: 454230 - RNA, 19 nt, Homo sapiens
gauaggauagggaggauga

SEQ ID NO: 454231 - RNA, 19 nt, Homo sapiens
agacauaacucaucauucc

SEQ ID NO: 454232 - RNA, 19 nt, Homo sapiens
gcuaaaguguugaauugca

SEQ ID NO: 454233 - RNA, 19 nt, Homo sapiens
cagaugaaauuggcaguau

SEQ ID NO: 454234 - RNA, 19 nt, Homo sapiens
uaagaugcacgauggaauu

SEQ ID NO: 454235 - RNA, 19 nt, Homo sapiens
gaggacguguucuacaaau

SEQ ID NO: 454236 - RNA, 19 nt, Homo sapiens
ggacuaaugugggaagaac

SEQ ID NO: 454237 - RNA, 19 nt, Homo sapiens
gauuaagaaugcuuuggau

SEQ ID NO: 454238 - RNA, 19 nt, Homo sapiens
ucucgaagccguagucgua

SEQ ID NO: 454239 - RNA, 19 nt, Homo sapiens
cgacaucgaccucaagaau

SEQ ID NO: 454240 - RNA, 19 nt, Homo sapiens
caaaaugcuucuuccaauu

SEQ ID NO: 454241 - RNA, 19 nt, Homo sapiens
agaacuggcuaauuuguca

SEQ ID NO: 454242 - RNA, 19 nt, Homo sapiens
agagauggauuaagaaugc

SEQ ID NO: 454243 - RNA, 19 nt, Homo sapiens
uuaguuaacuccauacucu

SEQ ID NO: 454244 - RNA, 19 nt, Homo sapiens
ucauagacaggauuguuua

SEQ ID NO: 454245 - RNA, 19 nt, Homo sapiens
uaucugcccugguuugugu

SEQ ID NO: 454246 - RNA, 19 nt, Homo sapiens
aagaagauaugaccuaugc

SEQ ID NO: 454247 - RNA, 19 nt, Homo sapiens
gcacgauggaauuguguuu

SEQ ID NO: 454248 - RNA, 19 nt, Homo sapiens
ggacauugaggacguguuc

SEQ ID NO: 454249 - RNA, 19 nt, Homo sapiens
caucuacguggguaacuua

SEQ ID NO: 454250 - RNA, 19 nt, Homo sapiens
cuggauaacacuaaguuua

SEQ ID NO: 454251 - RNA, 19 nt, Homo sapiens
cgacggcuaugauuacgau

SEQ ID NO: 454252 - RNA, 19 nt, Homo sapiens
uaaguagguuuccaauugg

SEQ ID NO: 454253 - RNA, 19 nt, Homo sapiens
gaugcacgauggaauugug

SEQ ID NO: 454254 - RNA, 19 nt, Homo sapiens
caacuuaauuggcuauucc

SEQ ID NO: 454255 - RNA, 19 nt, Homo sapiens
ggauuaagaaugcuuugga

SEQ ID NO: 454256 - RNA, 19 nt, Homo sapiens
gcgugaagcaggugaugua

SEQ ID NO: 454257 - RNA, 19 nt, Homo sapiens
gucgggagguggugugauu

SEQ ID NO: 454258 - RNA, 19 nt, Homo sapiens
ggguagcaaugccaguaaa

SEQ ID NO: 454259 - RNA, 19 nt, Homo sapiens
ucaguugucuuuagcuaca

SEQ ID NO: 454260 - RNA, 19 nt, Homo sapiens
aagcaggugauguauguua

SEQ ID NO: 454261 - RNA, 19 nt, Homo sapiens
cagcacgaguagaugguaa

SEQ ID NO: 454262 - RNA, 19 nt, Homo sapiens
caaaucauaauguggauag

SEQ ID NO: 454263 - RNA, 19 nt, Homo sapiens
aaacugaugacagacauaa

SEQ ID NO: 454264 - RNA, 19 nt, Homo sapiens
agacuuagguggguagcaa

SEQ ID NO: 454265 - RNA, 19 nt, Homo sapiens
ggacguguucuacaaauac

SEQ ID NO: 454266 - RNA, 19 nt, Homo sapiens
ucaugugucuuucuguaga

SEQ ID NO: 454267 - RNA, 19 nt, Homo sapiens
gaauaaguagguuuccaau

SEQ ID NO: 454268 - RNA, 19 nt, Homo sapiens
ggauucagcacgaguagau

SEQ ID NO: 454269 - RNA, 19 nt, Homo sapiens
guuauaaagguuuggauug

SEQ ID NO: 454270 - RNA, 19 nt, Homo sapiens
caaugccaguaaacuuaaa

SEQ ID NO: 454271 - RNA, 19 nt, Homo sapiens
gugcuauugucacagauga

SEQ ID NO: 454272 - RNA, 19 nt, Homo sapiens
uuucaugugucuuucugua

SEQ ID NO: 454273 - RNA, 19 nt, Homo sapiens
uggcaguauugaccuuaua

SEQ ID NO: 454274 - RNA, 19 nt, Homo sapiens
aauaauggaggcaauggua

SEQ ID NO: 454275 - RNA, 19 nt, Homo sapiens
cagaaugggcuaaaguguu

SEQ ID NO: 454276 - RNA, 19 nt, Homo sapiens
gaugauuggugacacuuuu

SEQ ID NO: 454277 - RNA, 19 nt, Homo sapiens
acgaguagaugguaaacau

SEQ ID NO: 454278 - RNA, 19 nt, Homo sapiens
cagauuaccaggaacauag

SEQ ID NO: 454279 - RNA, 19 nt, Homo sapiens
gugcaucuguuaaacugau

SEQ ID NO: 454280 - RNA, 19 nt, Homo sapiens
gguaugacuccaagugcua

SEQ ID NO: 454281 - RNA, 19 nt, Homo sapiens
gcuccuaacaucuacauuc

SEQ ID NO: 454282 - RNA, 19 nt, Homo sapiens
uagaacccauguuguauac

SEQ ID NO: 454283 - RNA, 19 nt, Homo sapiens
acaaauggcuguccaguuu

SEQ ID NO: 454284 - RNA, 19 nt, Homo sapiens
cuaaagcugucaagagauu

SEQ ID NO: 454285 - RNA, 19 nt, Homo sapiens
gccuaaagcugucaagaga

SEQ ID NO: 454286 - RNA, 19 nt, Homo sapiens
acaagcaacuggcuauuga

SEQ ID NO: 454287 - RNA, 19 nt, Homo sapiens
cuucagaucuaaaugguaa

SEQ ID NO: 454288 - RNA, 19 nt, Homo sapiens
ucuaaucucuucucuuaug

SEQ ID NO: 454289 - RNA, 19 nt, Homo sapiens
ccacauaguccaucgaaga

SEQ ID NO: 454290 - RNA, 19 nt, Homo sapiens
guacuuauaacauggugua

SEQ ID NO: 454291 - RNA, 19 nt, Homo sapiens
uguaugaacuuaacaugga

SEQ ID NO: 454292 - RNA, 19 nt, Homo sapiens
gcaguuguguagcaguuga

SEQ ID NO: 454293 - RNA, 19 nt, Homo sapiens
gcaaggccuuucccagugu

SEQ ID NO: 454294 - RNA, 19 nt, Homo sapiens
gaucuaaaugguaaucuga

SEQ ID NO: 454295 - RNA, 19 nt, Homo sapiens
guuauauagugcugacuuu

SEQ ID NO: 454296 - RNA, 19 nt, Homo sapiens
acagauugguaaccuaauu

SEQ ID NO: 454297 - RNA, 19 nt, Homo sapiens
uaaacagauugguaaccua

SEQ ID NO: 454298 - RNA, 19 nt, Homo sapiens
gcgguguccucuuaagaaa

SEQ ID NO: 454299 - RNA, 19 nt, Homo sapiens
ggaagcaaaugguuguaac

SEQ ID NO: 454300 - RNA, 19 nt, Homo sapiens
aaacagauugguaaccuaa

SEQ ID NO: 454301 - RNA, 19 nt, Homo sapiens
ggaacaagcaacuggcuau

SEQ ID NO: 454302 - RNA, 19 nt, Homo sapiens
cauaguccaucgaagaaga

SEQ ID NO: 454303 - RNA, 19 nt, Homo sapiens
gggccuugcauauaaauaa

SEQ ID NO: 454304 - RNA, 19 nt, Homo sapiens
acacaauucuaaucucuuc

SEQ ID NO: 454305 - RNA, 19 nt, Homo sapiens
cgaagaagaguccuuggaa

SEQ ID NO: 454306 - RNA, 19 nt, Homo sapiens
caaauggcuguccaguuua

SEQ ID NO: 454307 - RNA, 19 nt, Homo sapiens
gcuuggcuguuuccuguuu

SEQ ID NO: 454308 - RNA, 19 nt, Homo sapiens
cccgauugcuccuguguaa

SEQ ID NO: 454309 - RNA, 19 nt, Homo sapiens
gaaaacgugugcagccauu

SEQ ID NO: 454310 - RNA, 19 nt, Homo sapiens
gaacaagcaacuggcuauu

SEQ ID NO: 454311 - RNA, 19 nt, Homo sapiens
cugaucauaucuacaugua

SEQ ID NO: 454312 - RNA, 19 nt, Homo sapiens
gcgcaguuguguagcaguu

SEQ ID NO: 454313 - RNA, 19 nt, Homo sapiens
uuagugaggugaacgacuu

SEQ ID NO: 454314 - RNA, 19 nt, Homo sapiens
cuacauguaugaacuuaac

SEQ ID NO: 454315 - RNA, 19 nt, Homo sapiens
gaacuuaacauggaaaaug

SEQ ID NO: 454316 - RNA, 19 nt, Homo sapiens
guaugaacuuaacauggaa

SEQ ID NO: 454317 - RNA, 19 nt, Homo sapiens
ugguaaaucugaucauauc

SEQ ID NO: 454318 - RNA, 19 nt, Homo sapiens
agcaaaugguuguaacuuu

SEQ ID NO: 454319 - RNA, 19 nt, Homo sapiens
uaaugcugguuagcuguua

SEQ ID NO: 454320 - RNA, 19 nt, Homo sapiens
caaacacaauucuaaucuc

SEQ ID NO: 454321 - RNA, 19 nt, Homo sapiens
aaauggcuguccaguuuau

SEQ ID NO: 454322 - RNA, 19 nt, Homo sapiens
guguagcaguugaguaaug

SEQ ID NO: 454323 - RNA, 19 nt, Homo sapiens
gcacuaggcgcaguugugu

SEQ ID NO: 454324 - RNA, 19 nt, Homo sapiens
cuuauaacaugguguaucu

SEQ ID NO: 454325 - RNA, 19 nt, Homo sapiens
gcaacuggcuauugaaaag

SEQ ID NO: 454326 - RNA, 19 nt, Homo sapiens
cgacuucagauuucauuau

SEQ ID NO: 454327 - RNA, 19 nt, Homo sapiens
uaaggaagcaaaugguugu

SEQ ID NO: 454328 - RNA, 19 nt, Homo sapiens
uuuguggccuccugacuuu

SEQ ID NO: 454329 - RNA, 19 nt, Homo sapiens
cagauugguaaccuaauuu

SEQ ID NO: 454330 - RNA, 19 nt, Homo sapiens
ggagcgguguccucuuaag

SEQ ID NO: 454331 - RNA, 19 nt, Homo sapiens
cuucagauuucauuauugg

SEQ ID NO: 454332 - RNA, 19 nt, Homo sapiens
aaccauuguuucuguaguu

SEQ ID NO: 454333 - RNA, 19 nt, Homo sapiens
gagcgguguccucuuaaga

SEQ ID NO: 454334 - RNA, 19 nt, Homo sapiens
gaccacauaguccaucgaa

SEQ ID NO: 454335 - RNA, 19 nt, Homo sapiens
gaagguccaaguccaaguc

SEQ ID NO: 454336 - RNA, 19 nt, Homo sapiens
cuguuaagguggcguguug

SEQ ID NO: 454337 - RNA, 19 nt, Homo sapiens
gccauuacacacagccuaa

SEQ ID NO: 454338 - RNA, 19 nt, Homo sapiens
gagcugcgggugcaaaugg

SEQ ID NO: 454339 - RNA, 19 nt, Homo sapiens
ccucgucggucuccagauc

SEQ ID NO: 454340 - RNA, 19 nt, Homo sapiens
guuaaggaagcaaaugguu

SEQ ID NO: 454341 - RNA, 19 nt, Homo sapiens
guaaugcugguuagcuguu

SEQ ID NO: 454342 - RNA, 19 nt, Homo sapiens
gaacgacuucagauuucau

SEQ ID NO: 454343 - RNA, 19 nt, Homo sapiens
gaagcaaaugguuguaacu

SEQ ID NO: 454344 - RNA, 19 nt, Homo sapiens
cauggaaaauguuaaggaa

SEQ ID NO: 454345 - RNA, 19 nt, Homo sapiens
gauugcuccuguguaaaga

SEQ ID NO: 454346 - RNA, 19 nt, Homo sapiens
cacauaguccaucgaagaa

SEQ ID NO: 454347 - RNA, 19 nt, Homo sapiens
uaaccauuguuucuguagu

SEQ ID NO: 454348 - RNA, 19 nt, Homo sapiens
cagagugcuuggcuguuuc

SEQ ID NO: 454349 - RNA, 19 nt, Homo sapiens
aagcaacuggcuauugaaa

SEQ ID NO: 454350 - RNA, 19 nt, Homo sapiens
aagaagaguccuuggaaca

SEQ ID NO: 454351 - RNA, 19 nt, Homo sapiens
cgauugcuccuguguaaag

SEQ ID NO: 454352 - RNA, 19 nt, Homo sapiens
cuaaucucuucucuuaugu

SEQ ID NO: 454353 - RNA, 19 nt, Homo sapiens
ugaggcgcgucuucgagaa

SEQ ID NO: 454354 - RNA, 19 nt, Homo sapiens
gauuuggauauuugaggua

SEQ ID NO: 454355 - RNA, 19 nt, Homo sapiens
ccaagagggaauccaaauc

SEQ ID NO: 454356 - RNA, 19 nt, Homo sapiens
caagagggaauccaaaucc

SEQ ID NO: 454357 - RNA, 19 nt, Homo sapiens
uuuaagcuuugccucaguu

SEQ ID NO: 454358 - RNA, 19 nt, Homo sapiens
ccauuguuucuguaguuua

SEQ ID NO: 454359 - RNA, 19 nt, Homo sapiens
ccugacaacugcacuucca

SEQ ID NO: 454360 - RNA, 19 nt, Homo sapiens
uuguguagcaguugaguaa

SEQ ID NO: 454361 - RNA, 19 nt, Homo sapiens
uuaaacagauugguaaccu

SEQ ID NO: 454362 - RNA, 19 nt, Homo sapiens
agaagaguccuuggaacaa

SEQ ID NO: 454363 - RNA, 19 nt, Homo sapiens
gguguccucuuaagaaaau

SEQ ID NO: 454364 - RNA, 19 nt, Homo sapiens
guugaguaaugcugguuag

SEQ ID NO: 454365 - RNA, 19 nt, Homo sapiens
guaauuuagugaggugaac

SEQ ID NO: 454366 - RNA, 19 nt, Homo sapiens
cauuuuaugugccauuuug

SEQ ID NO: 454367 - RNA, 19 nt, Homo sapiens
caagcaacuggcuauugaa

SEQ ID NO: 454368 - RNA, 19 nt, Homo sapiens
ggccuugcauauaaauaac

SEQ ID NO: 454369 - RNA, 19 nt, Homo sapiens
uggcuguccaguuuauuaa

SEQ ID NO: 454370 - RNA, 19 nt, Homo sapiens
caauucuaaucucuucucu

SEQ ID NO: 454371 - RNA, 19 nt, Homo sapiens
gaucucggucgaccuccaa

SEQ ID NO: 454372 - RNA, 19 nt, Homo sapiens
auaaauaacggagcauaca

SEQ ID NO: 454373 - RNA, 19 nt, Homo sapiens
ggcaagaccuaaaggauua

SEQ ID NO: 454374 - RNA, 19 nt, Homo sapiens
ccacuuugguuucauauuu

SEQ ID NO: 454375 - RNA, 19 nt, Homo sapiens
ggauggaacugaagucaau

SEQ ID NO: 454376 - RNA, 19 nt, Homo sapiens
gaaguggccgagauaaaua

SEQ ID NO: 454377 - RNA, 19 nt, Homo sapiens
ggauaugguuauagaagaa

SEQ ID NO: 454378 - RNA, 19 nt, Homo sapiens
gcaagaagaagaagaagga

SEQ ID NO: 454379 - RNA, 19 nt, Homo sapiens
gaaucacgcuccagaucaa

SEQ ID NO: 454380 - RNA, 19 nt, Homo sapiens
gaucaaagucagcuucaaa

SEQ ID NO: 454381 - RNA, 19 nt, Homo sapiens
gcaaagaccaagcugaaga

SEQ ID NO: 454382 - RNA, 19 nt, Homo sapiens
gagcaaagaccaagcugaa

SEQ ID NO: 454383 - RNA, 19 nt, Homo sapiens
cagaugaugcuguuuauga

SEQ ID NO: 454384 - RNA, 19 nt, Homo sapiens
aaccaaaccuuccaucaga

SEQ ID NO: 454385 - RNA, 19 nt, Homo sapiens
gaacggauaugguuuugug

SEQ ID NO: 454386 - RNA, 19 nt, Homo sapiens
gcaguaacccauaggaaau

SEQ ID NO: 454387 - RNA, 19 nt, Homo sapiens
gcagcaagaagaagaagaa

SEQ ID NO: 454388 - RNA, 19 nt, Homo sapiens
ggcaagagccgcagcaaga

SEQ ID NO: 454389 - RNA, 19 nt, Homo sapiens
gaauagcacagucgaggaa

SEQ ID NO: 454390 - RNA, 19 nt, Homo sapiens
gagaagcgagggaguguga

SEQ ID NO: 454391 - RNA, 19 nt, Homo sapiens
agaccaagcugaagagaag

SEQ ID NO: 454392 - RNA, 19 nt, Homo sapiens
cauaggaaauaaacuguag

SEQ ID NO: 454393 - RNA, 19 nt, Homo sapiens
gaaaccaaaccuuccauca

SEQ ID NO: 454394 - RNA, 19 nt, Homo sapiens
gaagcagacauucccguaa

SEQ ID NO: 454395 - RNA, 19 nt, Homo sapiens
cagauuaguugaagacaag

SEQ ID NO: 454396 - RNA, 19 nt, Homo sapiens
gaagaaguggccgagauaa

SEQ ID NO: 454397 - RNA, 19 nt, Homo sapiens
gauguggagcgcuucuuua

SEQ ID NO: 454398 - RNA, 19 nt, Homo sapiens
cuaauggugugucuauaau

SEQ ID NO: 454399 - RNA, 19 nt, Homo sapiens
guggagcgcuucuuuaagg

SEQ ID NO: 454400 - RNA, 19 nt, Homo sapiens
gacuuauuguggagaauuu

SEQ ID NO: 454401 - RNA, 19 nt, Homo sapiens
uguaugccauuuagugaaa

SEQ ID NO: 454402 - RNA, 19 nt, Homo sapiens
aauggugugucuauaauug

SEQ ID NO: 454403 - RNA, 19 nt, Homo sapiens
acaagugauuggaguagaa

SEQ ID NO: 454404 - RNA, 19 nt, Homo sapiens
ugagaaugcuggcaccaau

SEQ ID NO: 454405 - RNA, 19 nt, Homo sapiens
uagaagaaguggccgagau

SEQ ID NO: 454406 - RNA, 19 nt, Homo sapiens
gauguaugccauuuaguga

SEQ ID NO: 454407 - RNA, 19 nt, Homo sapiens
gaacaugucacugcuguac

SEQ ID NO: 454408 - RNA, 19 nt, Homo sapiens
gcacagaguacagacuuau

SEQ ID NO: 454409 - RNA, 19 nt, Homo sapiens
ccuaauggugugucuauaa

SEQ ID NO: 454410 - RNA, 19 nt, Homo sapiens
caguggauaugguuauaga

SEQ ID NO: 454411 - RNA, 19 nt, Homo sapiens
agaagaaguggccgagaua

SEQ ID NO: 454412 - RNA, 19 nt, Homo sapiens
agaguuccauauucuggua

SEQ ID NO: 454413 - RNA, 19 nt, Homo sapiens
aggcuggaaugaccacaua

SEQ ID NO: 454414 - RNA, 19 nt, Homo sapiens
gagauccaauuccaaaucg

SEQ ID NO: 454415 - RNA, 19 nt, Homo sapiens
cccaagagccggaguccua

SEQ ID NO: 454416 - RNA, 19 nt, Homo sapiens
gcaaaagcagucauucuaa

SEQ ID NO: 454417 - RNA, 19 nt, Homo sapiens
gaagaacggauaugguuuu

SEQ ID NO: 454418 - RNA, 19 nt, Homo sapiens
ggugagcgaguaauuguug

SEQ ID NO: 454419 - RNA, 19 nt, Homo sapiens
agaugaugcuguuuaugaa

SEQ ID NO: 454420 - RNA, 19 nt, Homo sapiens
agaagaagaagaaggaaga

SEQ ID NO: 454421 - RNA, 19 nt, Homo sapiens
ggacgcaguggauaugguu

SEQ ID NO: 454422 - RNA, 19 nt, Homo sapiens
gauccaauuccaaaucgaa

SEQ ID NO: 454423 - RNA, 19 nt, Homo sapiens
gaggagagagugagaaugc

SEQ ID NO: 454424 - RNA, 19 nt, Homo sapiens
ucagauuaguugaagacaa

SEQ ID NO: 454425 - RNA, 19 nt, Homo sapiens
gcgaguaauuguugagcau

SEQ ID NO: 454426 - RNA, 19 nt, Homo sapiens
gaacuacccgagaagucuu

SEQ ID NO: 454427 - RNA, 19 nt, Homo sapiens
guggagaauuugucaaguc

SEQ ID NO: 454428 - RNA, 19 nt, Homo sapiens
gcagaaagcgaggcagcaa

SEQ ID NO: 454429 - RNA, 19 nt, Homo sapiens
ggagguggaucugaagaac

SEQ ID NO: 454430 - RNA, 19 nt, Homo sapiens
uggauaugguuauagaaga

SEQ ID NO: 454431 - RNA, 19 nt, Homo sapiens
gagaagauccaaaacaaug

SEQ ID NO: 454432 - RNA, 19 nt, Homo sapiens
gaagaagaaggaagacacu

SEQ ID NO: 454433 - RNA, 19 nt, Homo sapiens
gcagcaagagcaaggacaa

SEQ ID NO: 454434 - RNA, 19 nt, Homo sapiens
ugaugcagaugaugcuguu

SEQ ID NO: 454435 - RNA, 19 nt, Homo sapiens
uggaaugaccacauaggua

SEQ ID NO: 454436 - RNA, 19 nt, Homo sapiens
uaagugcuuccucucagua

SEQ ID NO: 454437 - RNA, 19 nt, Homo sapiens
agaagaaggaagacacuga

SEQ ID NO: 454438 - RNA, 19 nt, Homo sapiens
ggagaguggaggaggagaa

SEQ ID NO: 454439 - RNA, 19 nt, Homo sapiens
gaagagaagauccaaaaca

SEQ ID NO: 454440 - RNA, 19 nt, Homo sapiens
gcagucauucuaagaguag

SEQ ID NO: 454441 - RNA, 19 nt, Homo sapiens
uccagaagccggagucauu

SEQ ID NO: 454442 - RNA, 19 nt, Homo sapiens
ugaagaacggauaugguuu

SEQ ID NO: 454443 - RNA, 19 nt, Homo sapiens
agaaguggccgagauaaau

SEQ ID NO: 454444 - RNA, 19 nt, Homo sapiens
caguaacccauaggaaaua

SEQ ID NO: 454445 - RNA, 19 nt, Homo sapiens
gcacaagugauuggaguag

SEQ ID NO: 454446 - RNA, 19 nt, Homo sapiens
ggaacuacccgagaagucu

SEQ ID NO: 454447 - RNA, 19 nt, Homo sapiens
gcagcaagcgagacagcaa

SEQ ID NO: 454448 - RNA, 19 nt, Homo sapiens
aagcagacauucccguaag

SEQ ID NO: 454449 - RNA, 19 nt, Homo sapiens
uggcaagaccuaaaggauu

SEQ ID NO: 454450 - RNA, 19 nt, Homo sapiens
aaauugauaccugcaguaa

SEQ ID NO: 454451 - RNA, 19 nt, Homo sapiens
acagaguacagacuuauug

SEQ ID NO: 454452 - RNA, 19 nt, Homo sapiens
cgauguaugccauuuagug

SEQ ID NO: 454453 - RNA, 19 nt, Homo sapiens
cgagaagucuuuuguacau

SEQ ID NO: 454454 - RNA, 19 nt, Homo sapiens
gcagcagcaagaagaagaa

SEQ ID NO: 454455 - RNA, 19 nt, Homo sapiens
gaagagccuccgccagagu

SEQ ID NO: 454456 - RNA, 19 nt, Homo sapiens
cugaagaacggauaugguu

SEQ ID NO: 454457 - RNA, 19 nt, Homo sapiens
gcagcuggcaagaccuaaa

SEQ ID NO: 454458 - RNA, 19 nt, Homo sapiens
cgcacagaguacagacuua

SEQ ID NO: 454459 - RNA, 19 nt, Homo sapiens
cgcaguggauaugguuaua

SEQ ID NO: 454460 - RNA, 19 nt, Homo sapiens
ccauaggaaauaaacugua

SEQ ID NO: 454461 - RNA, 19 nt, Homo sapiens
guagguauggugaguucaa

SEQ ID NO: 454462 - RNA, 19 nt, Homo sapiens
cgaucucgguccaagucua

SEQ ID NO: 454463 - RNA, 19 nt, Homo sapiens
aagagaagauccaaaacaa

SEQ ID NO: 454464 - RNA, 19 nt, Homo sapiens
caaaagcagucauucuaag

SEQ ID NO: 454465 - RNA, 19 nt, Homo sapiens
cgagauccaauuccaaauc

SEQ ID NO: 454466 - RNA, 19 nt, Homo sapiens
gcaagagcaaggacaagag

SEQ ID NO: 454467 - RNA, 19 nt, Homo sapiens
cgauguggagcgcuucuuu

SEQ ID NO: 454468 - RNA, 19 nt, Homo sapiens
acuguagaguuccauauuc

SEQ ID NO: 454469 - RNA, 19 nt, Homo sapiens
ggugugucuauaauuguua

SEQ ID NO: 454470 - RNA, 19 nt, Homo sapiens
gaucuaggucccacucaag

SEQ ID NO: 454471 - RNA, 19 nt, Homo sapiens
gcgggcagcagcaagaaga

SEQ ID NO: 454472 - RNA, 19 nt, Homo sapiens
gcaggaagagaagcagaga

SEQ ID NO: 454473 - RNA, 19 nt, Homo sapiens
gaacacaagugcugucauu

SEQ ID NO: 454474 - RNA, 19 nt, Homo sapiens
ugacagagcucuuuuauaa

SEQ ID NO: 454475 - RNA, 19 nt, Homo sapiens
gugaaugucugaaguauau

SEQ ID NO: 454476 - RNA, 19 nt, Homo sapiens
aaagaacucuguagugaaa

SEQ ID NO: 454477 - RNA, 19 nt, Homo sapiens
gaaaagaacucuguaguga

SEQ ID NO: 454478 - RNA, 19 nt, Homo sapiens
caagggauauggacggaua

SEQ ID NO: 454479 - RNA, 19 nt, Homo sapiens
gcacaccgaccuaaauuaa

SEQ ID NO: 454480 - RNA, 19 nt, Homo sapiens
aaacgugguucuucaagua

SEQ ID NO: 454481 - RNA, 19 nt, Homo sapiens
gugaaaggguuacuauuga

SEQ ID NO: 454482 - RNA, 19 nt, Homo sapiens
gagcagcuguuuguuauug

SEQ ID NO: 454483 - RNA, 19 nt, Homo sapiens
cguauaaucuguucuucua

SEQ ID NO: 454484 - RNA, 19 nt, Homo sapiens
uguaugagcuugauggaaa

SEQ ID NO: 454485 - RNA, 19 nt, Homo sapiens
cagaaaugcuccaccugua

SEQ ID NO: 454486 - RNA, 19 nt, Homo sapiens
uagaauggcuugugauauc

SEQ ID NO: 454487 - RNA, 19 nt, Homo sapiens
agaaggacguggaaagauu

SEQ ID NO: 454488 - RNA, 19 nt, Homo sapiens
uagagcagcuguuuguuau

SEQ ID NO: 454489 - RNA, 19 nt, Homo sapiens
ggaaauaaaugggagaaaa

SEQ ID NO: 454490 - RNA, 19 nt, Homo sapiens
gcuuguacauaaaggcuua

SEQ ID NO: 454491 - RNA, 19 nt, Homo sapiens
gaaacgugguucuucaagu

SEQ ID NO: 454492 - RNA, 19 nt, Homo sapiens
ucaaagauuucaugagaca

SEQ ID NO: 454493 - RNA, 19 nt, Homo sapiens
caagugcugucauugcauu

SEQ ID NO: 454494 - RNA, 19 nt, Homo sapiens
ugaaaggguuacuauugaa

SEQ ID NO: 454495 - RNA, 19 nt, Homo sapiens
cgaccuaaauuaaaugaag

SEQ ID NO: 454496 - RNA, 19 nt, Homo sapiens
acaccgaccuaaauuaaau

SEQ ID NO: 454497 - RNA, 19 nt, Homo sapiens
ggacggauaagagauauug

SEQ ID NO: 454498 - RNA, 19 nt, Homo sapiens
gaaaaucgucuuauaguug

SEQ ID NO: 454499 - RNA, 19 nt, Homo sapiens
cagaugaugcuguguauga

SEQ ID NO: 454500 - RNA, 19 nt, Homo sapiens
gagaauuuauccucaagag

SEQ ID NO: 454501 - RNA, 19 nt, Homo sapiens
ggaggauggcgucuaauga

SEQ ID NO: 454502 - RNA, 19 nt, Homo sapiens
gagcaagucccguucuguu

SEQ ID NO: 454503 - RNA, 19 nt, Homo sapiens
gagacaagcuggggaagua

SEQ ID NO: 454504 - RNA, 19 nt, Homo sapiens
ggagaaggacguggaaaga

SEQ ID NO: 454505 - RNA, 19 nt, Homo sapiens
gcucuaaauuugcuuguac

SEQ ID NO: 454506 - RNA, 19 nt, Homo sapiens
ugguugaguuugccucuua

SEQ ID NO: 454507 - RNA, 19 nt, Homo sapiens
uuagagcagcuguuuguua

SEQ ID NO: 454508 - RNA, 19 nt, Homo sapiens
ucgcagaccucgaaaugau

SEQ ID NO: 454509 - RNA, 19 nt, Homo sapiens
gauauggacggauaagaga

SEQ ID NO: 454510 - RNA, 19 nt, Homo sapiens
aaugauagacgguauguga

SEQ ID NO: 454511 - RNA, 19 nt, Homo sapiens
gaaaugauagacgguaugu

SEQ ID NO: 454512 - RNA, 19 nt, Homo sapiens
guucuucuauucccacguu

SEQ ID NO: 454513 - RNA, 19 nt, Homo sapiens
ggguugggcuggauaucuu

SEQ ID NO: 454514 - RNA, 19 nt, Homo sapiens
gcaguugauucgaggaagu

SEQ ID NO: 454515 - RNA, 19 nt, Homo sapiens
gaaaugcuccaccuguaag

SEQ ID NO: 454516 - RNA, 19 nt, Homo sapiens
gaaggacguggaaagauuc

SEQ ID NO: 454517 - RNA, 19 nt, Homo sapiens
cuaaugagcgcaguugauu

SEQ ID NO: 454518 - RNA, 19 nt, Homo sapiens
guauucaucgggagacuaa

SEQ ID NO: 454519 - RNA, 19 nt, Homo sapiens
gcaagucccguucuguuag

SEQ ID NO: 454520 - RNA, 19 nt, Homo sapiens
guggauggcugcauugaac

SEQ ID NO: 454521 - RNA, 19 nt, Homo sapiens
guacuagccggacaucaug

SEQ ID NO: 454522 - RNA, 19 nt, Homo sapiens
ucaagaagcaggucucgau

SEQ ID NO: 454523 - RNA, 19 nt, Homo sapiens
ggauauggacggauaagag

SEQ ID NO: 454524 - RNA, 19 nt, Homo sapiens
ggaucgaggcuucuucaug

SEQ ID NO: 454525 - RNA, 19 nt, Homo sapiens
agaaaugcuccaccuguaa

SEQ ID NO: 454526 - RNA, 19 nt, Homo sapiens
gacgauacucugaccguuu

SEQ ID NO: 454527 - RNA, 19 nt, Homo sapiens
gcagcuguuuguuauugau

SEQ ID NO: 454528 - RNA, 19 nt, Homo sapiens
gaagagguagaggacgaua

SEQ ID NO: 454529 - RNA, 19 nt, Homo sapiens
gauaagccuucugcucaca

SEQ ID NO: 454530 - RNA, 19 nt, Homo sapiens
gcccacaguugaacacaag

SEQ ID NO: 454531 - RNA, 19 nt, Homo sapiens
ggguagcauuuaagauuca

SEQ ID NO: 454532 - RNA, 19 nt, Homo sapiens
cauuagagcagcuguuugu

SEQ ID NO: 454533 - RNA, 19 nt, Homo sapiens
uaagccuucugcucacauu

SEQ ID NO: 454534 - RNA, 19 nt, Homo sapiens
cccaaaccauacuugcuaa

SEQ ID NO: 454535 - RNA, 19 nt, Homo sapiens
gaugcacaccgaccuaaau

SEQ ID NO: 454536 - RNA, 19 nt, Homo sapiens
cacaagugcugucauugca

SEQ ID NO: 454537 - RNA, 19 nt, Homo sapiens
uaagauucaggagucauua

SEQ ID NO: 454538 - RNA, 19 nt, Homo sapiens
agugaaaggguuacuauug

SEQ ID NO: 454539 - RNA, 19 nt, Homo sapiens
aaagagcucuaaauuugcu

SEQ ID NO: 454540 - RNA, 19 nt, Homo sapiens
gaaugucugaaguauauag

SEQ ID NO: 454541 - RNA, 19 nt, Homo sapiens
caagucccguucuguuagu

SEQ ID NO: 454542 - RNA, 19 nt, Homo sapiens
ccauugugaauacgaauuu

SEQ ID NO: 454543 - RNA, 19 nt, Homo sapiens
gagaaggacguggaaagau

SEQ ID NO: 454544 - RNA, 19 nt, Homo sapiens
uauggacggauaagagaua

SEQ ID NO: 454545 - RNA, 19 nt, Homo sapiens
cugcuggacagacacauua

SEQ ID NO: 454546 - RNA, 19 nt, Homo sapiens
gaggauggcgucuaaugag

SEQ ID NO: 454547 - RNA, 19 nt, Homo sapiens
gauaucugauggcuugaac

SEQ ID NO: 454548 - RNA, 19 nt, Homo sapiens
ccucuuauggugacuuaaa

SEQ ID NO: 454549 - RNA, 19 nt, Homo sapiens
ggaaaagaacucuguagug

SEQ ID NO: 454550 - RNA, 19 nt, Homo sapiens
guaaguaugugcuuuucug

SEQ ID NO: 454551 - RNA, 19 nt, Homo sapiens
cauugcauuucuuccauug

SEQ ID NO: 454552 - RNA, 19 nt, Homo sapiens
gcagaccucgaaaugauag

SEQ ID NO: 454553 - RNA, 19 nt, Homo sapiens
aggcacaggucaagaagca

SEQ ID NO: 454554 - RNA, 19 nt, Homo sapiens
ggaugcacaccgaccuaaa

SEQ ID NO: 454555 - RNA, 19 nt, Homo sapiens
ucauugcauuucuuccauu

SEQ ID NO: 454556 - RNA, 19 nt, Homo sapiens
aaggguggauggcugcauu

SEQ ID NO: 454557 - RNA, 19 nt, Homo sapiens
gaaaggguuacuauugaac

SEQ ID NO: 454558 - RNA, 19 nt, Homo sapiens
cacauuagagcagcuguuu

SEQ ID NO: 454559 - RNA, 19 nt, Homo sapiens
gguguccuccacucuuuaa

SEQ ID NO: 454560 - RNA, 19 nt, Homo sapiens
uauauugacagagcucuuu

SEQ ID NO: 454561 - RNA, 19 nt, Homo sapiens
caguugacaguggcaauua

SEQ ID NO: 454562 - RNA, 19 nt, Homo sapiens
ugcggaggauggcgucuaa

SEQ ID NO: 454563 - RNA, 19 nt, Homo sapiens
gcuggcaggaucucaaaga

SEQ ID NO: 454564 - RNA, 19 nt, Homo sapiens
gaacagaaaaucgucuuau

SEQ ID NO: 454565 - RNA, 19 nt, Homo sapiens
ucacgagguggaagaggua

SEQ ID NO: 454566 - RNA, 19 nt, Homo sapiens
ucccaaaccauacuugcua

SEQ ID NO: 454567 - RNA, 19 nt, Homo sapiens
gaguggcugucggguauuc

SEQ ID NO: 454568 - RNA, 19 nt, Homo sapiens
caaaucuauugacggaagu

SEQ ID NO: 454569 - RNA, 19 nt, Homo sapiens
ucgaaaugauagacgguau

SEQ ID NO: 454570 - RNA, 19 nt, Homo sapiens
gggagaaggacguggaaag

SEQ ID NO: 454571 - RNA, 19 nt, Homo sapiens
cccguagucgcaaaucuua

SEQ ID NO: 454572 - RNA, 19 nt, Homo sapiens
ggaccagaaguuccucuag

SEQ ID NO: 454573 - RNA, 19 nt, Homo sapiens
gaucaaagagcaaaucuaa

SEQ ID NO: 454574 - RNA, 19 nt, Homo sapiens
gaucuaaggaugaguauga

SEQ ID NO: 454575 - RNA, 19 nt, Homo sapiens
gcagaaauauuaggcuuau

SEQ ID NO: 454576 - RNA, 19 nt, Homo sapiens
agaagacggucacgaagua

SEQ ID NO: 454577 - RNA, 19 nt, Homo sapiens
caaaugaggguguaauuga

SEQ ID NO: 454578 - RNA, 19 nt, Homo sapiens
agauuaagcucauuuagug

SEQ ID NO: 454579 - RNA, 19 nt, Homo sapiens
cgcaguagaucucgaagua

SEQ ID NO: 454580 - RNA, 19 nt, Homo sapiens
gaagauaagccacgcacaa

SEQ ID NO: 454581 - RNA, 19 nt, Homo sapiens
caaacuggauggcacagaa

SEQ ID NO: 454582 - RNA, 19 nt, Homo sapiens
ggcaagauuuaaaggauuu

SEQ ID NO: 454583 - RNA, 19 nt, Homo sapiens
gcgacaagcaggugaagua

SEQ ID NO: 454584 - RNA, 19 nt, Homo sapiens
caguuacucuuccauguuu

SEQ ID NO: 454585 - RNA, 19 nt, Homo sapiens
acucagaacuccuuguuug

SEQ ID NO: 454586 - RNA, 19 nt, Homo sapiens
gcagaucuaaggaugagua

SEQ ID NO: 454587 - RNA, 19 nt, Homo sapiens
gcaguuggcaagauuuaaa

SEQ ID NO: 454588 - RNA, 19 nt, Homo sapiens
aaucuaagcccaagucuga

SEQ ID NO: 454589 - RNA, 19 nt, Homo sapiens
ggaaaugguggcaugaaga

SEQ ID NO: 454590 - RNA, 19 nt, Homo sapiens
caggaaaucuagaucaaag

SEQ ID NO: 454591 - RNA, 19 nt, Homo sapiens
ggauacagcagucggagaa

SEQ ID NO: 454592 - RNA, 19 nt, Homo sapiens
gaaagggugauauaaaguc

SEQ ID NO: 454593 - RNA, 19 nt, Homo sapiens
uggaaagggugauauaaag

SEQ ID NO: 454594 - RNA, 19 nt, Homo sapiens
gaacaaaugaggguguaau

SEQ ID NO: 454595 - RNA, 19 nt, Homo sapiens
aagcuugaguuauguaaga

SEQ ID NO: 454596 - RNA, 19 nt, Homo sapiens
agaugaggcucuaaggaaa

SEQ ID NO: 454597 - RNA, 19 nt, Homo sapiens
ggcaggaaaucuagaucaa

SEQ ID NO: 454598 - RNA, 19 nt, Homo sapiens
gcaguuacucuuccauguu

SEQ ID NO: 454599 - RNA, 19 nt, Homo sapiens
acaaggaacgaacaaauga

SEQ ID NO: 454600 - RNA, 19 nt, Homo sapiens
caguagaucucgaaguauc

SEQ ID NO: 454601 - RNA, 19 nt, Homo sapiens
uaauugaguuucgcuccua

SEQ ID NO: 454602 - RNA, 19 nt, Homo sapiens
uuccagagauuaacucaga

SEQ ID NO: 454603 - RNA, 19 nt, Homo sapiens
ggaaagggugauauaaagu

SEQ ID NO: 454604 - RNA, 19 nt, Homo sapiens
gaagcagaucuaaggauga

SEQ ID NO: 454605 - RNA, 19 nt, Homo sapiens
gcaaaucuaagcccaaguc

SEQ ID NO: 454606 - RNA, 19 nt, Homo sapiens
gcaggaaaucuagaucaaa

SEQ ID NO: 454607 - RNA, 19 nt, Homo sapiens
ggauggcacagaaauaaau

SEQ ID NO: 454608 - RNA, 19 nt, Homo sapiens
ccacaaggaacgaacaaau

SEQ ID NO: 454609 - RNA, 19 nt, Homo sapiens
uaacucagaacuccuuguu

SEQ ID NO: 454610 - RNA, 19 nt, Homo sapiens
ucaaaggcccguucugugu

SEQ ID NO: 454611 - RNA, 19 nt, Homo sapiens
aaauggaaagggugauaua

SEQ ID NO: 454612 - RNA, 19 nt, Homo sapiens
ggcagaaauauuaggcuua

SEQ ID NO: 454613 - RNA, 19 nt, Homo sapiens
ggcaguuacucuuccaugu

SEQ ID NO: 454614 - RNA, 19 nt, Homo sapiens
ggaugaguaugagaaaucu

SEQ ID NO: 454615 - RNA, 19 nt, Homo sapiens
uggcaagauuuaaaggauu

SEQ ID NO: 454616 - RNA, 19 nt, Homo sapiens
caaauacggaccaccuguu

SEQ ID NO: 454617 - RNA, 19 nt, Homo sapiens
aaagggugauauaaaguca

SEQ ID NO: 454618 - RNA, 19 nt, Homo sapiens
ucaaagagcaaaucuaagc

SEQ ID NO: 454619 - RNA, 19 nt, Homo sapiens
ggaaaucuagaucaaagag

SEQ ID NO: 454620 - RNA, 19 nt, Homo sapiens
aagaugaggcucuaaggaa

SEQ ID NO: 454621 - RNA, 19 nt, Homo sapiens
gaaaacaggggcacacaga

SEQ ID NO: 454622 - RNA, 19 nt, Homo sapiens
gaaaauggaaagggugaua

SEQ ID NO: 454623 - RNA, 19 nt, Homo sapiens
gaucucgaaguaucucaaa

SEQ ID NO: 454624 - RNA, 19 nt, Homo sapiens
cgacaagcaggugaaguaa

SEQ ID NO: 454625 - RNA, 19 nt, Homo sapiens
gugcaguuggcaagauuua

SEQ ID NO: 454626 - RNA, 19 nt, Homo sapiens
guuuauacuuggccucuuc

SEQ ID NO: 454627 - RNA, 19 nt, Homo sapiens
gaaaugguggcaugaagac

SEQ ID NO: 454628 - RNA, 19 nt, Homo sapiens
ggucgaguuccagagauua

SEQ ID NO: 454629 - RNA, 19 nt, Homo sapiens
uaaggaugaguaugagaaa

SEQ ID NO: 454630 - RNA, 19 nt, Homo sapiens
cuaaggaugaguaugagaa

SEQ ID NO: 454631 - RNA, 19 nt, Homo sapiens
gcuacaacguccgggagaa

SEQ ID NO: 454632 - RNA, 19 nt, Homo sapiens
cacaaggaacgaacaaaug

SEQ ID NO: 454633 - RNA, 19 nt, Homo sapiens
gagcuaacguaacuuuugu

SEQ ID NO: 454634 - RNA, 19 nt, Homo sapiens
acuccuuguuugcacauua

SEQ ID NO: 454635 - RNA, 19 nt, Homo sapiens
gaaggacauccagcgcuuu

SEQ ID NO: 454636 - RNA, 19 nt, Homo sapiens
gauuaacucagaacuccuu

SEQ ID NO: 454637 - RNA, 19 nt, Homo sapiens
agggugauauaaagucaaa

SEQ ID NO: 454638 - RNA, 19 nt, Homo sapiens
gaugaggcucuaaggaaau

SEQ ID NO: 454639 - RNA, 19 nt, Homo sapiens
ucuagaagacggucacgaa

SEQ ID NO: 454640 - RNA, 19 nt, Homo sapiens
aaagagcuacuucaagauc

SEQ ID NO: 454641 - RNA, 19 nt, Homo sapiens
aaaggucgaucacguucuc

SEQ ID NO: 454642 - RNA, 19 nt, Homo sapiens
aaaugaggguguaauugag

SEQ ID NO: 454643 - RNA, 19 nt, Homo sapiens
caagccauaggcgaucuua

SEQ ID NO: 454644 - RNA, 19 nt, Homo sapiens
acaaaugaggguguaauug

SEQ ID NO: 454645 - RNA, 19 nt, Homo sapiens
gaauacuuaaggcuuuaga

SEQ ID NO: 454646 - RNA, 19 nt, Homo sapiens
aaagaugaggcucuaagga

SEQ ID NO: 454647 - RNA, 19 nt, Homo sapiens
ucaagaucccguucuagau

SEQ ID NO: 454648 - RNA, 19 nt, Homo sapiens
ucaaaaggcaggaaaucua

SEQ ID NO: 454649 - RNA, 19 nt, Homo sapiens
gauggcacagaaauaaaug

SEQ ID NO: 454650 - RNA, 19 nt, Homo sapiens
cuggauggcacagaaauaa

SEQ ID NO: 454651 - RNA, 19 nt, Homo sapiens
guuugcacauuauuaugga

SEQ ID NO: 454652 - RNA, 19 nt, Homo sapiens
gccagucccguuccaauuc

SEQ ID NO: 454653 - RNA, 19 nt, Homo sapiens
gagccagucccguuccaau

SEQ ID NO: 454654 - RNA, 19 nt, Homo sapiens
gggcucccauucacauucu

SEQ ID NO: 454655 - RNA, 19 nt, Homo sapiens
ccucgaaguagaccucaaa

SEQ ID NO: 454656 - RNA, 19 nt, Homo sapiens
gcaguagaucucgaaguau

SEQ ID NO: 454657 - RNA, 19 nt, Homo sapiens
gagcuuugaauacuuaagg

SEQ ID NO: 454658 - RNA, 19 nt, Homo sapiens
gacccucucccuucuuugu

SEQ ID NO: 454659 - RNA, 19 nt, Homo sapiens
cuacuuaggcaguuacucu

SEQ ID NO: 454660 - RNA, 19 nt, Homo sapiens
acgaacaaaugagggugua

SEQ ID NO: 454661 - RNA, 19 nt, Homo sapiens
acaagcaggugaaguaacc

SEQ ID NO: 454662 - RNA, 19 nt, Homo sapiens
ccaggucgaguuccagaga

SEQ ID NO: 454663 - RNA, 19 nt, Homo sapiens
agaucucgcucaaagucaa

SEQ ID NO: 454664 - RNA, 19 nt, Homo sapiens
aaacuggauggcacagaaa

SEQ ID NO: 454665 - RNA, 19 nt, Homo sapiens
gcuccuacucugacaugaa

SEQ ID NO: 454666 - RNA, 19 nt, Homo sapiens
aagcagaucuaaggaugag

SEQ ID NO: 454667 - RNA, 19 nt, Homo sapiens
uagagggagaacccaauuu

SEQ ID NO: 454668 - RNA, 19 nt, Homo sapiens
uaggacgccugagcuacaa

SEQ ID NO: 454669 - RNA, 19 nt, Homo sapiens
caagguccaggucgaguuc

SEQ ID NO: 454670 - RNA, 19 nt, Homo sapiens
ccucaaaggcccguucugu

SEQ ID NO: 454671 - RNA, 19 nt, Homo sapiens
aauggaaagggugauauaa

SEQ ID NO: 454672 - RNA, 19 nt, Homo sapiens
cggugcaguuggcaagauu

SEQ ID NO: 454673 - RNA, 19 nt, Homo sapiens
gcaaagaccuguuguuaau

SEQ ID NO: 454674 - RNA, 19 nt, Homo sapiens
uaaguuagcuaauccguuu

SEQ ID NO: 454675 - RNA, 19 nt, Homo sapiens
gaacaucacuauucuaugc

SEQ ID NO: 454676 - RNA, 19 nt, Homo sapiens
ccacaacauucuucuauuu

SEQ ID NO: 454677 - RNA, 19 nt, Homo sapiens
gagcaaagaccuguuguua

SEQ ID NO: 454678 - RNA, 19 nt, Homo sapiens
ucaauggucuuguuucuuu

SEQ ID NO: 454679 - RNA, 19 nt, Homo sapiens
gcuaguauguuggaaguua

SEQ ID NO: 454680 - RNA, 19 nt, Homo sapiens
gaacuaaacgaaacugauu

SEQ ID NO: 454681 - RNA, 19 nt, Homo sapiens
ccacugaugugucuaaaug

SEQ ID NO: 454682 - RNA, 19 nt, Homo sapiens
guuaguagguauuguauga

SEQ ID NO: 454683 - RNA, 19 nt, Homo sapiens
aaauggaucuggauuacua

SEQ ID NO: 454684 - RNA, 19 nt, Homo sapiens
gccaguagguucuuuauuc

SEQ ID NO: 454685 - RNA, 19 nt, Homo sapiens
caaauggauugucuuauuc

SEQ ID NO: 454686 - RNA, 19 nt, Homo sapiens
gaaagaggaacaccagauu

SEQ ID NO: 454687 - RNA, 19 nt, Homo sapiens
ggaucuggauuacuaugua

SEQ ID NO: 454688 - RNA, 19 nt, Homo sapiens
ggacugaagcucucaaguu

SEQ ID NO: 454689 - RNA, 19 nt, Homo sapiens
caugacagauccuuaaguu

SEQ ID NO: 454690 - RNA, 19 nt, Homo sapiens
uaaaugagcaugacaggaa

SEQ ID NO: 454691 - RNA, 19 nt, Homo sapiens
uaccuaggcuuguccauuu

SEQ ID NO: 454692 - RNA, 19 nt, Homo sapiens
ucacagcaguaagauaaua

SEQ ID NO: 454693 - RNA, 19 nt, Homo sapiens
caauuaagauccuccuaga

SEQ ID NO: 454694 - RNA, 19 nt, Homo sapiens
gguagaccuuagaauguua

SEQ ID NO: 454695 - RNA, 19 nt, Homo sapiens
gcaaauccgacaauuaaga

SEQ ID NO: 454696 - RNA, 19 nt, Homo sapiens
gaaagguguugguuaaguc

SEQ ID NO: 454697 - RNA, 19 nt, Homo sapiens
gacugaagcucucaaguuc

SEQ ID NO: 454698 - RNA, 19 nt, Homo sapiens
gcacuugguuagcuuuaau

SEQ ID NO: 454699 - RNA, 19 nt, Homo sapiens
gaaaugucaaugagacuaa

SEQ ID NO: 454700 - RNA, 19 nt, Homo sapiens
caaaacaccuucauguaaa

SEQ ID NO: 454701 - RNA, 19 nt, Homo sapiens
ggugaucgccguaacagua

SEQ ID NO: 454702 - RNA, 19 nt, Homo sapiens
acaccuagcuucaccuuau

SEQ ID NO: 454703 - RNA, 19 nt, Homo sapiens
auacauaccuacauucaga

SEQ ID NO: 454704 - RNA, 19 nt, Homo sapiens
gcucucaaguucacccuuu

SEQ ID NO: 454705 - RNA, 19 nt, Homo sapiens
uaacuggcaggcuuauuua

SEQ ID NO: 454706 - RNA, 19 nt, Homo sapiens
gcaaguaggaccacugaug

SEQ ID NO: 454707 - RNA, 19 nt, Homo sapiens
gguuaagucuugaacauca

SEQ ID NO: 454708 - RNA, 19 nt, Homo sapiens
gacauuaugcuuaugauug

SEQ ID NO: 454709 - RNA, 19 nt, Homo sapiens
aaagggacauuaugcuuau

SEQ ID NO: 454710 - RNA, 19 nt, Homo sapiens
ggucuuguuucuuugcuuu

SEQ ID NO: 454711 - RNA, 19 nt, Homo sapiens
gcuaauccguuugaaguug

SEQ ID NO: 454712 - RNA, 19 nt, Homo sapiens
aagaucagcuucacucaga

SEQ ID NO: 454713 - RNA, 19 nt, Homo sapiens
cugcagagauugaacaaau

SEQ ID NO: 454714 - RNA, 19 nt, Homo sapiens
gaggagaaaccaaggugua

SEQ ID NO: 454715 - RNA, 19 nt, Homo sapiens
gaucaguggugaagcaagu

SEQ ID NO: 454716 - RNA, 19 nt, Homo sapiens
uaaauucacagcaguaaga

SEQ ID NO: 454717 - RNA, 19 nt, Homo sapiens
gagcaugacaggaacuaaa

SEQ ID NO: 454718 - RNA, 19 nt, Homo sapiens
ugacagauccuuaaguuag

SEQ ID NO: 454719 - RNA, 19 nt, Homo sapiens
aaacuuggccaggaucuua

SEQ ID NO: 454720 - RNA, 19 nt, Homo sapiens
ucacgagccuuaugauauc

SEQ ID NO: 454721 - RNA, 19 nt, Homo sapiens
cagaaugucacgagccuua

SEQ ID NO: 454722 - RNA, 19 nt, Homo sapiens
gguggcauaguguuaauua

SEQ ID NO: 454723 - RNA, 19 nt, Homo sapiens
gaucggcuauagauacuuc

SEQ ID NO: 454724 - RNA, 19 nt, Homo sapiens
ucauuuggcugucaguuug

SEQ ID NO: 454725 - RNA, 19 nt, Homo sapiens
caaugagacuaaagugguu

SEQ ID NO: 454726 - RNA, 19 nt, Homo sapiens
ugaccugagucccuuauga

SEQ ID NO: 454727 - RNA, 19 nt, Homo sapiens
ggaaagauaauucaaccau

SEQ ID NO: 454728 - RNA, 19 nt, Homo sapiens
ccucgacgauuaagaucua

SEQ ID NO: 454729 - RNA, 19 nt, Homo sapiens
uagcuucaccuuauucuuu

SEQ ID NO: 454730 - RNA, 19 nt, Homo sapiens
ccaguagguucuuuauuca

SEQ ID NO: 454731 - RNA, 19 nt, Homo sapiens
gaaaccaagguguauguug

SEQ ID NO: 454732 - RNA, 19 nt, Homo sapiens
gggcgcugcuugcuaaaga

SEQ ID NO: 454733 - RNA, 19 nt, Homo sapiens
uugcaaauccgacaauuaa

SEQ ID NO: 454734 - RNA, 19 nt, Homo sapiens
gcagauaccuaggcuuguc

SEQ ID NO: 454735 - RNA, 19 nt, Homo sapiens
ggugcaaaguaauuaaaga

SEQ ID NO: 454736 - RNA, 19 nt, Homo sapiens
cuacauuaguuaaccaguu

SEQ ID NO: 454737 - RNA, 19 nt, Homo sapiens
ggcauaguguuaauuagga

SEQ ID NO: 454738 - RNA, 19 nt, Homo sapiens
caucaugacagauccuuaa

SEQ ID NO: 454739 - RNA, 19 nt, Homo sapiens
gaucuuaagggacuuugaa

SEQ ID NO: 454740 - RNA, 19 nt, Homo sapiens
ccugggcgcugcuugcuaa

SEQ ID NO: 454741 - RNA, 19 nt, Homo sapiens
auugaaagguguugguuaa

SEQ ID NO: 454742 - RNA, 19 nt, Homo sapiens
caaaggagaguuagaaagg

SEQ ID NO: 454743 - RNA, 19 nt, Homo sapiens
gauuugugaugucuguaaa

SEQ ID NO: 454744 - RNA, 19 nt, Homo sapiens
ggaauucgaagauccuaga

SEQ ID NO: 454745 - RNA, 19 nt, Homo sapiens
gacaggaacuaaacgaaac

SEQ ID NO: 454746 - RNA, 19 nt, Homo sapiens
uauaagggauuugugaugu

SEQ ID NO: 454747 - RNA, 19 nt, Homo sapiens
ccaagaagcagccgaucaa

SEQ ID NO: 454748 - RNA, 19 nt, Homo sapiens
ggaccacugaugugucuaa

SEQ ID NO: 454749 - RNA, 19 nt, Homo sapiens
gagaaaccaagguguaugu

SEQ ID NO: 454750 - RNA, 19 nt, Homo sapiens
gggucgaccugcaaacuug

SEQ ID NO: 454751 - RNA, 19 nt, Homo sapiens
gcacgcgggucugucauca

SEQ ID NO: 454752 - RNA, 19 nt, Homo sapiens
gauuugccuuuguggaauu

SEQ ID NO: 454753 - RNA, 19 nt, Homo sapiens
ggacauuaugcuuaugauu

SEQ ID NO: 454754 - RNA, 19 nt, Homo sapiens
ugacaggaacuaaacgaaa

SEQ ID NO: 454755 - RNA, 19 nt, Homo sapiens
ugaaagguguugguuaagu

SEQ ID NO: 454756 - RNA, 19 nt, Homo sapiens
ugugaugucuguaaagugu

SEQ ID NO: 454757 - RNA, 19 nt, Homo sapiens
ggauuugugaugucuguaa

SEQ ID NO: 454758 - RNA, 19 nt, Homo sapiens
ucaagauccaggucuauuu

SEQ ID NO: 454759 - RNA, 19 nt, Homo sapiens
ggaucgagguauuuccaau

SEQ ID NO: 454760 - RNA, 19 nt, Homo sapiens
gcugaauuaugguugguau

SEQ ID NO: 454761 - RNA, 19 nt, Homo sapiens
ggaaguuauuuggauuguu

SEQ ID NO: 454762 - RNA, 19 nt, Homo sapiens
caacacuccauguagcuaa

SEQ ID NO: 454763 - RNA, 19 nt, Homo sapiens
aaagaccuguuguuaaucu

SEQ ID NO: 454764 - RNA, 19 nt, Homo sapiens
gcaaaggagaguuagaaag

SEQ ID NO: 454765 - RNA, 19 nt, Homo sapiens
cagccugaaugcaucauga

SEQ ID NO: 454766 - RNA, 19 nt, Homo sapiens
ugaugucuguaaaguguaa

SEQ ID NO: 454767 - RNA, 19 nt, Homo sapiens
gaucgucguuagauugaag

SEQ ID NO: 454768 - RNA, 19 nt, Homo sapiens
ccacauucccaacuagaaa

SEQ ID NO: 454769 - RNA, 19 nt, Homo sapiens
cgacgucccuuugauccaa

SEQ ID NO: 454770 - RNA, 19 nt, Homo sapiens
guuggaaguuauuuggauu

SEQ ID NO: 454771 - RNA, 19 nt, Homo sapiens
caaguuuauucgguaguuu

SEQ ID NO: 454772 - RNA, 19 nt, Homo sapiens
ggaauacuggucugcauca

SEQ ID NO: 454773 - RNA, 19 nt, Homo sapiens
gagaagaagccucaacuua

SEQ ID NO: 454774 - RNA, 19 nt, Homo sapiens
ccaauaagcuuugcaauca

SEQ ID NO: 454775 - RNA, 19 nt, Homo sapiens
gaaguuaaaccacccgaua

SEQ ID NO: 454776 - RNA, 19 nt, Homo sapiens
gaauagaggcccuguguga

SEQ ID NO: 454777 - RNA, 19 nt, Homo sapiens
gcaaagauccaccgagaga

SEQ ID NO: 454778 - RNA, 19 nt, Homo sapiens
ucucuuaccuguauauuug

SEQ ID NO: 454779 - RNA, 19 nt, Homo sapiens
gcccagaucucuucagcaa

SEQ ID NO: 454780 - RNA, 19 nt, Homo sapiens
caaagaaggccaagaaagu

SEQ ID NO: 454781 - RNA, 19 nt, Homo sapiens
caaugaagaugaugaugau

SEQ ID NO: 454782 - RNA, 19 nt, Homo sapiens
ccagaucucuucagcaauc

SEQ ID NO: 454783 - RNA, 19 nt, Homo sapiens
ugacagugaugaugaugaa

SEQ ID NO: 454784 - RNA, 19 nt, Homo sapiens
guguuaagcuagaugauga

SEQ ID NO: 454785 - RNA, 19 nt, Homo sapiens
ucgcagcacuuguucguaa

SEQ ID NO: 454786 - RNA, 19 nt, Homo sapiens
gaagaagccucaacuuacc

SEQ ID NO: 454787 - RNA, 19 nt, Homo sapiens
gcaaagcaagcaaagcaaa

SEQ ID NO: 454788 - RNA, 19 nt, Homo sapiens
ugaguacgaugcugaguau

SEQ ID NO: 454789 - RNA, 19 nt, Homo sapiens
ugcaugaccuuucugagua

SEQ ID NO: 454790 - RNA, 19 nt, Homo sapiens
gaaauaaaaugggaggaaa

SEQ ID NO: 454791 - RNA, 19 nt, Homo sapiens
ugaagaugaugaugaugaa

SEQ ID NO: 454792 - RNA, 19 nt, Homo sapiens
aaacaaaagugacgagaaa

SEQ ID NO: 454793 - RNA, 19 nt, Homo sapiens
uaagcuagaugaugacagu

SEQ ID NO: 454794 - RNA, 19 nt, Homo sapiens
gcaaucaaggccaaagaaa

SEQ ID NO: 454795 - RNA, 19 nt, Homo sapiens
gagcacaguuugagaucau

SEQ ID NO: 454796 - RNA, 19 nt, Homo sapiens
ccaagaaugaucaaagauu

SEQ ID NO: 454797 - RNA, 19 nt, Homo sapiens
gcaaagaaggccaagaaag

SEQ ID NO: 454798 - RNA, 19 nt, Homo sapiens
gagagaagaagagaaagaa

SEQ ID NO: 454799 - RNA, 19 nt, Homo sapiens
ggaggagccuuccaaacag

SEQ ID NO: 454800 - RNA, 19 nt, Homo sapiens
ggaagcagaagcugggaaa

SEQ ID NO: 454801 - RNA, 19 nt, Homo sapiens
gaggagccuuccaaacaga

SEQ ID NO: 454802 - RNA, 19 nt, Homo sapiens
cagaagaggcucccacaga

SEQ ID NO: 454803 - RNA, 19 nt, Homo sapiens
ugaagaagaugggaauuac

SEQ ID NO: 454804 - RNA, 19 nt, Homo sapiens
gaguggagcucuugguuuu

SEQ ID NO: 454805 - RNA, 19 nt, Homo sapiens
gaagaggaggcgcgaauag

SEQ ID NO: 454806 - RNA, 19 nt, Homo sapiens
gaucacguucucccaagua

SEQ ID NO: 454807 - RNA, 19 nt, Homo sapiens
uugacaagcuggccgagua

SEQ ID NO: 454808 - RNA, 19 nt, Homo sapiens
caaggcaagaggaagaaua

SEQ ID NO: 454809 - RNA, 19 nt, Homo sapiens
caauaagcuuugcaaucaa

SEQ ID NO: 454810 - RNA, 19 nt, Homo sapiens
ccacguggaacagagauua

SEQ ID NO: 454811 - RNA, 19 nt, Homo sapiens
aggaggagcuagaagcaaa

SEQ ID NO: 454812 - RNA, 19 nt, Homo sapiens
caaagaaaaugaucugcuu

SEQ ID NO: 454813 - RNA, 19 nt, Homo sapiens
cuucaucccucucucuuug

SEQ ID NO: 454814 - RNA, 19 nt, Homo sapiens
gcucugacaaugaagauga

SEQ ID NO: 454815 - RNA, 19 nt, Homo sapiens
acuauaaguucauccagaa

SEQ ID NO: 454816 - RNA, 19 nt, Homo sapiens
gauugagcgucccgucuga

SEQ ID NO: 454817 - RNA, 19 nt, Homo sapiens
gcaagaggaagaauacaag

SEQ ID NO: 454818 - RNA, 19 nt, Homo sapiens
aaggaaagcggcguuauuu

SEQ ID NO: 454819 - RNA, 19 nt, Homo sapiens
gcgaauagaggcccugugu

SEQ ID NO: 454820 - RNA, 19 nt, Homo sapiens
ggagaagaagccucaacuu

SEQ ID NO: 454821 - RNA, 19 nt, Homo sapiens
ccgaguaugucgccaggaa

SEQ ID NO: 454822 - RNA, 19 nt, Homo sapiens
ccaaguaccauucgucauc

SEQ ID NO: 454823 - RNA, 19 nt, Homo sapiens
aaaggaaagcggcguuauu

SEQ ID NO: 454824 - RNA, 19 nt, Homo sapiens
aagcaaagaaggccaagaa

SEQ ID NO: 454825 - RNA, 19 nt, Homo sapiens
ugccaagaaugaucaaaga

SEQ ID NO: 454826 - RNA, 19 nt, Homo sapiens
acaaugaagaugaugauga

SEQ ID NO: 454827 - RNA, 19 nt, Homo sapiens
cgauaggccuucgagcaaa

SEQ ID NO: 454828 - RNA, 19 nt, Homo sapiens
aaggaggcaucguccagua

SEQ ID NO: 454829 - RNA, 19 nt, Homo sapiens
gaagguaguggacccagau

SEQ ID NO: 454830 - RNA, 19 nt, Homo sapiens
uagaggcccugugugauga

SEQ ID NO: 454831 - RNA, 19 nt, Homo sapiens
agaagaagccucaacuuac

SEQ ID NO: 454832 - RNA, 19 nt, Homo sapiens
aaagaaggccaagaaaguu

SEQ ID NO: 454833 - RNA, 19 nt, Homo sapiens
gaaguguaaccgccuugaa

SEQ ID NO: 454834 - RNA, 19 nt, Homo sapiens
ggaggaggagccuuccaaa

SEQ ID NO: 454835 - RNA, 19 nt, Homo sapiens
gaggaugggagcuacaaug

SEQ ID NO: 454836 - RNA, 19 nt, Homo sapiens
cuucagcaaucguuucuuc

SEQ ID NO: 454837 - RNA, 19 nt, Homo sapiens
cgagagaagaagagaaaga

SEQ ID NO: 454838 - RNA, 19 nt, Homo sapiens
ggagcuagaagcaaagcaa

SEQ ID NO: 454839 - RNA, 19 nt, Homo sapiens
cagugaugaugaugaagaa

SEQ ID NO: 454840 - RNA, 19 nt, Homo sapiens
agaugaugaugaugaagaa

SEQ ID NO: 454841 - RNA, 19 nt, Homo sapiens
gaaagagggacgcuacacu

SEQ ID NO: 454842 - RNA, 19 nt, Homo sapiens
ggagcacaguuugagauca

SEQ ID NO: 454843 - RNA, 19 nt, Homo sapiens
gagaagaagagaaagaaaa

SEQ ID NO: 454844 - RNA, 19 nt, Homo sapiens
uuacagcuacuacaugcua

SEQ ID NO: 454845 - RNA, 19 nt, Homo sapiens
gcgccaaacccgagaggaa

SEQ ID NO: 454846 - RNA, 19 nt, Homo sapiens
gcuagaugaugacagugau

SEQ ID NO: 454847 - RNA, 19 nt, Homo sapiens
gaaguucgagaccaguguu

SEQ ID NO: 454848 - RNA, 19 nt, Homo sapiens
gcagucucuuaccuguaua

SEQ ID NO: 454849 - RNA, 19 nt, Homo sapiens
gaggcaucguccaguaaga

SEQ ID NO: 454850 - RNA, 19 nt, Homo sapiens
ggcaagaggaagaauacaa

SEQ ID NO: 454851 - RNA, 19 nt, Homo sapiens
gaugaagagagguauuuag

SEQ ID NO: 454852 - RNA, 19 nt, Homo sapiens
gugaugaagagagguauuu

SEQ ID NO: 454853 - RNA, 19 nt, Homo sapiens
gcaugaccuuucugaguac

SEQ ID NO: 454854 - RNA, 19 nt, Homo sapiens
gaucucauggccaaaguca

SEQ ID NO: 454855 - RNA, 19 nt, Homo sapiens
gucgaggaauccagcacua

SEQ ID NO: 454856 - RNA, 19 nt, Homo sapiens
cgaguggagcucuugguuu

SEQ ID NO: 454857 - RNA, 19 nt, Homo sapiens
gaugaugacagugaugaug

SEQ ID NO: 454858 - RNA, 19 nt, Homo sapiens
ugaugaugaugaagaagau

SEQ ID NO: 454859 - RNA, 19 nt, Homo sapiens
ccagaaagccaugaaagag

SEQ ID NO: 454860 - RNA, 19 nt, Homo sapiens
agcagucucuuaccuguau

SEQ ID NO: 454861 - RNA, 19 nt, Homo sapiens
ucucauggccaaagucaga

SEQ ID NO: 454862 - RNA, 19 nt, Homo sapiens
ugaagaggaggcgcgaaua

SEQ ID NO: 454863 - RNA, 19 nt, Homo sapiens
aauaagcuuugcaaucaag

SEQ ID NO: 454864 - RNA, 19 nt, Homo sapiens
ggacgggaagcuggugaaa

SEQ ID NO: 454865 - RNA, 19 nt, Homo sapiens
ugaugaagagagguauuua

SEQ ID NO: 454866 - RNA, 19 nt, Homo sapiens
gagcugaugaagcccuuga

SEQ ID NO: 454867 - RNA, 19 nt, Homo sapiens
aggaggagccuuccaaaca

SEQ ID NO: 454868 - RNA, 19 nt, Homo sapiens
ggaggcaaggcaagaggaa

SEQ ID NO: 454869 - RNA, 19 nt, Homo sapiens
gaccagcagucucuuaccu

SEQ ID NO: 454870 - RNA, 19 nt, Homo sapiens
gauaggccuucgagcaaaa

SEQ ID NO: 454871 - RNA, 19 nt, Homo sapiens
gaugaagaaagcaaagaag

SEQ ID NO: 454872 - RNA, 19 nt, Homo sapiens
ccacaaccaccaccacaag

SEQ ID NO: 454873 - RNA, 19 nt, Homo sapiens
gagaagaagccucaacuua

SEQ ID NO: 454874 - RNA, 19 nt, Homo sapiens
ccaauaagcuuugcaauca

SEQ ID NO: 454875 - RNA, 19 nt, Homo sapiens
gaaguuaaaccacccgaua

SEQ ID NO: 454876 - RNA, 19 nt, Homo sapiens
gaauagaggcccuguguga

SEQ ID NO: 454877 - RNA, 19 nt, Homo sapiens
gaagagagaggaagaauac

SEQ ID NO: 454878 - RNA, 19 nt, Homo sapiens
gcaaagauccaccgagaga

SEQ ID NO: 454879 - RNA, 19 nt, Homo sapiens
ucucuuaccuguauauuug

SEQ ID NO: 454880 - RNA, 19 nt, Homo sapiens
gcccagaucucuucagcaa

SEQ ID NO: 454881 - RNA, 19 nt, Homo sapiens
caaagaaggccaagaaagu

SEQ ID NO: 454882 - RNA, 19 nt, Homo sapiens
caaugaagaugaugaugau

SEQ ID NO: 454883 - RNA, 19 nt, Homo sapiens
ccagaucucuucagcaauc

SEQ ID NO: 454884 - RNA, 19 nt, Homo sapiens
ugacagugaugaugaugaa

SEQ ID NO: 454885 - RNA, 19 nt, Homo sapiens
guguuaagcuagaugauga

SEQ ID NO: 454886 - RNA, 19 nt, Homo sapiens
ucgcagcacuuguucguaa

SEQ ID NO: 454887 - RNA, 19 nt, Homo sapiens
gaagaagccucaacuuacc

SEQ ID NO: 454888 - RNA, 19 nt, Homo sapiens
gcaaagcaagcaaagcaaa

SEQ ID NO: 454889 - RNA, 19 nt, Homo sapiens
ugaguacgaugcugaguau

SEQ ID NO: 454890 - RNA, 19 nt, Homo sapiens
ugcaugaccuuucugagua

SEQ ID NO: 454891 - RNA, 19 nt, Homo sapiens
gaaauaaaaugggaggaaa

SEQ ID NO: 454892 - RNA, 19 nt, Homo sapiens
ugaagaugaugaugaugaa

SEQ ID NO: 454893 - RNA, 19 nt, Homo sapiens
aaacaaaagugacgagaaa

SEQ ID NO: 454894 - RNA, 19 nt, Homo sapiens
uaagcuagaugaugacagu

SEQ ID NO: 454895 - RNA, 19 nt, Homo sapiens
gcaaucaaggccaaagaaa

SEQ ID NO: 454896 - RNA, 19 nt, Homo sapiens
gagcacaguuugagaucau

SEQ ID NO: 454897 - RNA, 19 nt, Homo sapiens
ccaagaaugaucaaagauu

SEQ ID NO: 454898 - RNA, 19 nt, Homo sapiens
gaagaauacaagcgauuga

SEQ ID NO: 454899 - RNA, 19 nt, Homo sapiens
gcaaagaaggccaagaaag

SEQ ID NO: 454900 - RNA, 19 nt, Homo sapiens
gagagaagaagagaaagaa

SEQ ID NO: 454901 - RNA, 19 nt, Homo sapiens
ggaggagccuuccaaacag

SEQ ID NO: 454902 - RNA, 19 nt, Homo sapiens
ggaagcagaagcugggaaa

SEQ ID NO: 454903 - RNA, 19 nt, Homo sapiens
gaggagccuuccaaacaga

SEQ ID NO: 454904 - RNA, 19 nt, Homo sapiens
cagaagaggcucccacaga

SEQ ID NO: 454905 - RNA, 19 nt, Homo sapiens
ugaagaagaugggaauuac

SEQ ID NO: 454906 - RNA, 19 nt, Homo sapiens
gaguggagcucuugguuuu

SEQ ID NO: 454907 - RNA, 19 nt, Homo sapiens
gaagaggaggcgcgaauag

SEQ ID NO: 454908 - RNA, 19 nt, Homo sapiens
gaucacguucucccaagua

SEQ ID NO: 454909 - RNA, 19 nt, Homo sapiens
uugacaagcuggccgagua

SEQ ID NO: 454910 - RNA, 19 nt, Homo sapiens
ggaagaauacaagcgauug

SEQ ID NO: 454911 - RNA, 19 nt, Homo sapiens
caauaagcuuugcaaucaa

SEQ ID NO: 454912 - RNA, 19 nt, Homo sapiens
ccacguggaacagagauua

SEQ ID NO: 454913 - RNA, 19 nt, Homo sapiens
aggaggagcuagaagcaaa

SEQ ID NO: 454914 - RNA, 19 nt, Homo sapiens
caaagaaaaugaucugcuu

SEQ ID NO: 454915 - RNA, 19 nt, Homo sapiens
cuucaucccucucucuuug

SEQ ID NO: 454916 - RNA, 19 nt, Homo sapiens
gcucugacaaugaagauga

SEQ ID NO: 454917 - RNA, 19 nt, Homo sapiens
acuauaaguucauccagaa

SEQ ID NO: 454918 - RNA, 19 nt, Homo sapiens
gauugagcgucccgucuga

SEQ ID NO: 454919 - RNA, 19 nt, Homo sapiens
aaggaaagcggcguuauuu

SEQ ID NO: 454920 - RNA, 19 nt, Homo sapiens
ugaagagagaggaagaaua

SEQ ID NO: 454921 - RNA, 19 nt, Homo sapiens
gcgaauagaggcccugugu

SEQ ID NO: 454922 - RNA, 19 nt, Homo sapiens
ggagaagaagccucaacuu

SEQ ID NO: 454923 - RNA, 19 nt, Homo sapiens
ccgaguaugucgccaggaa

SEQ ID NO: 454924 - RNA, 19 nt, Homo sapiens
ccaaguaccauucgucauc

SEQ ID NO: 454925 - RNA, 19 nt, Homo sapiens
aaaggaaagcggcguuauu

SEQ ID NO: 454926 - RNA, 19 nt, Homo sapiens
aagcaaagaaggccaagaa

SEQ ID NO: 454927 - RNA, 19 nt, Homo sapiens
ugccaagaaugaucaaaga

SEQ ID NO: 454928 - RNA, 19 nt, Homo sapiens
acaaugaagaugaugauga

SEQ ID NO: 454929 - RNA, 19 nt, Homo sapiens
cgauaggccuucgagcaaa

SEQ ID NO: 454930 - RNA, 19 nt, Homo sapiens
aaggaggcaucguccagua

SEQ ID NO: 454931 - RNA, 19 nt, Homo sapiens
gaagguaguggacccagau

SEQ ID NO: 454932 - RNA, 19 nt, Homo sapiens
uagaggcccugugugauga

SEQ ID NO: 454933 - RNA, 19 nt, Homo sapiens
agaagaagccucaacuuac

SEQ ID NO: 454934 - RNA, 19 nt, Homo sapiens
aaagaaggccaagaaaguu

SEQ ID NO: 454935 - RNA, 19 nt, Homo sapiens
gaaguguaaccgccuugaa

SEQ ID NO: 454936 - RNA, 19 nt, Homo sapiens
ggaggaggagccuuccaaa

SEQ ID NO: 454937 - RNA, 19 nt, Homo sapiens
gaggaugggagcuacaaug

SEQ ID NO: 454938 - RNA, 19 nt, Homo sapiens
uacaagcgauugagugaag

SEQ ID NO: 454939 - RNA, 19 nt, Homo sapiens
cuucagcaaucguuucuuc

SEQ ID NO: 454940 - RNA, 19 nt, Homo sapiens
cgagagaagaagagaaaga

SEQ ID NO: 454941 - RNA, 19 nt, Homo sapiens
ggagcuagaagcaaagcaa

SEQ ID NO: 454942 - RNA, 19 nt, Homo sapiens
cagugaugaugaugaagaa

SEQ ID NO: 454943 - RNA, 19 nt, Homo sapiens
agaugaugaugaugaagaa

SEQ ID NO: 454944 - RNA, 19 nt, Homo sapiens
gaaagagggacgcuacacu

SEQ ID NO: 454945 - RNA, 19 nt, Homo sapiens
ggagcacaguuugagauca

SEQ ID NO: 454946 - RNA, 19 nt, Homo sapiens
gcgccaaacccgagaggaa

SEQ ID NO: 454947 - RNA, 19 nt, Homo sapiens
gagaagaagagaaagaaaa

SEQ ID NO: 454948 - RNA, 19 nt, Homo sapiens
uuacagcuacuacaugcua

SEQ ID NO: 454949 - RNA, 19 nt, Homo sapiens
gcuagaugaugacagugau

SEQ ID NO: 454950 - RNA, 19 nt, Homo sapiens
gaaguucgagaccaguguu

SEQ ID NO: 454951 - RNA, 19 nt, Homo sapiens
gcagucucuuaccuguaua

SEQ ID NO: 454952 - RNA, 19 nt, Homo sapiens
gaggcaucguccaguaaga

SEQ ID NO: 454953 - RNA, 19 nt, Homo sapiens
gagagaggaagaauacaag

SEQ ID NO: 454954 - RNA, 19 nt, Homo sapiens
gcaugaccuuucugaguac

SEQ ID NO: 454955 - RNA, 19 nt, Homo sapiens
gaucucauggccaaaguca

SEQ ID NO: 454956 - RNA, 19 nt, Homo sapiens
cgaguggagcucuugguuu

SEQ ID NO: 454957 - RNA, 19 nt, Homo sapiens
gucgaggaauccagcacua

SEQ ID NO: 454958 - RNA, 19 nt, Homo sapiens
gaugaugacagugaugaug

SEQ ID NO: 454959 - RNA, 19 nt, Homo sapiens
ugaugaugaugaagaagau

SEQ ID NO: 454960 - RNA, 19 nt, Homo sapiens
ccagaaagccaugaaagag

SEQ ID NO: 454961 - RNA, 19 nt, Homo sapiens
agcagucucuuaccuguau

SEQ ID NO: 454962 - RNA, 19 nt, Homo sapiens
ugaagaggaggcgcgaaua

SEQ ID NO: 454963 - RNA, 19 nt, Homo sapiens
ucucauggccaaagucaga

SEQ ID NO: 454964 - RNA, 19 nt, Homo sapiens
aauaagcuuugcaaucaag

SEQ ID NO: 454965 - RNA, 19 nt, Homo sapiens
ggacgggaagcuggugaaa

SEQ ID NO: 454966 - RNA, 19 nt, Homo sapiens
gagcugaugaagcccuuga

SEQ ID NO: 454967 - RNA, 19 nt, Homo sapiens
aggaggagccuuccaaaca

SEQ ID NO: 454968 - RNA, 19 nt, Homo sapiens
gaccagcagucucuuaccu

SEQ ID NO: 454969 - RNA, 19 nt, Homo sapiens
agagagaggaagaauacaa

SEQ ID NO: 454970 - RNA, 19 nt, Homo sapiens
aauacaagcgauugaguga

SEQ ID NO: 454971 - RNA, 19 nt, Homo sapiens
gaugaagagagaggaagaa

SEQ ID NO: 454972 - RNA, 19 nt, Homo sapiens
gauaggccuucgagcaaaa

SEQ ID NO: 454973 - RNA, 19 nt, Homo sapiens
gauccuaacuguugucuug

SEQ ID NO: 454974 - RNA, 19 nt, Homo sapiens
agaaagagaucuaagagaa

SEQ ID NO: 454975 - RNA, 19 nt, Homo sapiens
gaaguguucucuaaauaug

SEQ ID NO: 454976 - RNA, 19 nt, Homo sapiens
caaauacacucuuguucuu

SEQ ID NO: 454977 - RNA, 19 nt, Homo sapiens
gcagaacuauucagauugu

SEQ ID NO: 454978 - RNA, 19 nt, Homo sapiens
uagcagaacuauucagauu

SEQ ID NO: 454979 - RNA, 19 nt, Homo sapiens
uggaugaacugaagacuuu

SEQ ID NO: 454980 - RNA, 19 nt, Homo sapiens
gggcaaauccugauccuaa

SEQ ID NO: 454981 - RNA, 19 nt, Homo sapiens
caggaaauacgaagaguua

SEQ ID NO: 454982 - RNA, 19 nt, Homo sapiens
gaagaucgaagccugugua

SEQ ID NO: 454983 - RNA, 19 nt, Homo sapiens
uaaagaacgugccaaugga

SEQ ID NO: 454984 - RNA, 19 nt, Homo sapiens
ggauuugccuuuguauauu

SEQ ID NO: 454985 - RNA, 19 nt, Homo sapiens
ggacuacuauagcagauca

SEQ ID NO: 454986 - RNA, 19 nt, Homo sapiens
caaaggaggcccaauuuca

SEQ ID NO: 454987 - RNA, 19 nt, Homo sapiens
caaggaagcuaaagaacgu

SEQ ID NO: 454988 - RNA, 19 nt, Homo sapiens
uaacuguugucuuggagua

SEQ ID NO: 454989 - RNA, 19 nt, Homo sapiens
gagcugggauauuguuugu

SEQ ID NO: 454990 - RNA, 19 nt, Homo sapiens
gaucgaagccuguguaaaa

SEQ ID NO: 454991 - RNA, 19 nt, Homo sapiens
gggaucagauuuauagaag

SEQ ID NO: 454992 - RNA, 19 nt, Homo sapiens
ccaauggaauggagcuuga

SEQ ID NO: 454993 - RNA, 19 nt, Homo sapiens
cgaugugucuauuguauau

SEQ ID NO: 454994 - RNA, 19 nt, Homo sapiens
caugaaacauaccauacuu

SEQ ID NO: 454995 - RNA, 19 nt, Homo sapiens
agacagggaucagauuuau

SEQ ID NO: 454996 - RNA, 19 nt, Homo sapiens
gaucgggacuacuauagca

SEQ ID NO: 454997 - RNA, 19 nt, Homo sapiens
caagaggauuugccuuugu

SEQ ID NO: 454998 - RNA, 19 nt, Homo sapiens
agccagugcuuaaugcuua

SEQ ID NO: 454999 - RNA, 19 nt, Homo sapiens
guaguuuggugcuuuguuc

SEQ ID NO: 455000 - RNA, 19 nt, Homo sapiens
gaacagugccuagugaagu

SEQ ID NO: 455001 - RNA, 19 nt, Homo sapiens
caagacagggaucagauuu

SEQ ID NO: 455002 - RNA, 19 nt, Homo sapiens
agacuuugccuguucauuu

SEQ ID NO: 455003 - RNA, 19 nt, Homo sapiens
ggugcuuuguuccaaguua

SEQ ID NO: 455004 - RNA, 19 nt, Homo sapiens
aagaggauuugccuuugua

SEQ ID NO: 455005 - RNA, 19 nt, Homo sapiens
gccgaugugucuauuguau

SEQ ID NO: 455006 - RNA, 19 nt, Homo sapiens
ggucuuacagucgagauua

SEQ ID NO: 455007 - RNA, 19 nt, Homo sapiens
gcuucaaaguacaugauaa

SEQ ID NO: 455008 - RNA, 19 nt, Homo sapiens
ggaaauacgaagaguuaca

SEQ ID NO: 455009 - RNA, 19 nt, Homo sapiens
ggauacagaucacguucca

SEQ ID NO: 455010 - RNA, 19 nt, Homo sapiens
ucaagaggauuugccuuug

SEQ ID NO: 455011 - RNA, 19 nt, Homo sapiens
aaagagaucuaagagaagu

SEQ ID NO: 455012 - RNA, 19 nt, Homo sapiens
gaaagagaucuaagagaag

SEQ ID NO: 455013 - RNA, 19 nt, Homo sapiens
cauagacgaucacguagca

SEQ ID NO: 455014 - RNA, 19 nt, Homo sapiens
caaguuaaguguuuucaga

SEQ ID NO: 455015 - RNA, 19 nt, Homo sapiens
gaugaucgggacuacuaua

SEQ ID NO: 455016 - RNA, 19 nt, Homo sapiens
gaggauuugccuuuguaua

SEQ ID NO: 455017 - RNA, 19 nt, Homo sapiens
aaauacagccagugcuuaa

SEQ ID NO: 455018 - RNA, 19 nt, Homo sapiens
gggcguaggaucagaguug

SEQ ID NO: 455019 - RNA, 19 nt, Homo sapiens
caccacaaauacacucuug

SEQ ID NO: 455020 - RNA, 19 nt, Homo sapiens
cccuagagcugggauauug

SEQ ID NO: 455021 - RNA, 19 nt, Homo sapiens
cuaaagaacgugccaaugg

SEQ ID NO: 455022 - RNA, 19 nt, Homo sapiens
auacauuccaccacaaaua

SEQ ID NO: 455023 - RNA, 19 nt, Homo sapiens
gugcuuuguuccaaguuaa

SEQ ID NO: 455024 - RNA, 19 nt, Homo sapiens
uaaagacaaaugcccguuu

SEQ ID NO: 455025 - RNA, 19 nt, Homo sapiens
gagguuggcagcuucgauu

SEQ ID NO: 455026 - RNA, 19 nt, Homo sapiens
ucacguagcaggucuuaca

SEQ ID NO: 455027 - RNA, 19 nt, Homo sapiens
gaucacguagcaggucuua

SEQ ID NO: 455028 - RNA, 19 nt, Homo sapiens
gaagcucccgaaggcauua

SEQ ID NO: 455029 - RNA, 19 nt, Homo sapiens
uuauauaccugcaacuaag

SEQ ID NO: 455030 - RNA, 19 nt, Homo sapiens
guuggcagcuucgauugaa

SEQ ID NO: 455031 - RNA, 19 nt, Homo sapiens
cagauugucaguaguaaau

SEQ ID NO: 455032 - RNA, 19 nt, Homo sapiens
ccucgucgcuauuaaagca

SEQ ID NO: 455033 - RNA, 19 nt, Homo sapiens
auacucaccucgucgcuau

SEQ ID NO: 455034 - RNA, 19 nt, Homo sapiens
uauuugggcugagcuugua

SEQ ID NO: 455035 - RNA, 19 nt, Homo sapiens
ucccauagacgaucacgua

SEQ ID NO: 455036 - RNA, 19 nt, Homo sapiens
caauacauuccaccacaaa

SEQ ID NO: 455037 - RNA, 19 nt, Homo sapiens
gcaggaaauacgaagaguu

SEQ ID NO: 455038 - RNA, 19 nt, Homo sapiens
cuauucagauugucaguag

SEQ ID NO: 455039 - RNA, 19 nt, Homo sapiens
guaaaaugcuaccaaaugg

SEQ ID NO: 455040 - RNA, 19 nt, Homo sapiens
ucugaaaccugcccuagag

SEQ ID NO: 455041 - RNA, 19 nt, Homo sapiens
ggcggucaccuucuccuua

SEQ ID NO: 455042 - RNA, 19 nt, Homo sapiens
cagcaagugacaauacauu

SEQ ID NO: 455043 - RNA, 19 nt, Homo sapiens
ggauaaugguauuucaacu

SEQ ID NO: 455044 - RNA, 19 nt, Homo sapiens
cuuaaaaggcuguuucuua

SEQ ID NO: 455045 - RNA, 19 nt, Homo sapiens
acagggaucagauuuauag

SEQ ID NO: 455046 - RNA, 19 nt, Homo sapiens
cugaagacuuugccuguuc

SEQ ID NO: 455047 - RNA, 19 nt, Homo sapiens
cuguaacucuguacugcua

SEQ ID NO: 455048 - RNA, 19 nt, Homo sapiens
gacagggaucagauuuaua

SEQ ID NO: 455049 - RNA, 19 nt, Homo sapiens
ccaagacagggaucagauu

SEQ ID NO: 455050 - RNA, 19 nt, Homo sapiens
gaguugauuucucuauaac

SEQ ID NO: 455051 - RNA, 19 nt, Homo sapiens
caaggucucgcuccaagga

SEQ ID NO: 455052 - RNA, 19 nt, Homo sapiens
uaccaaaggaggcccaauu

SEQ ID NO: 455053 - RNA, 19 nt, Homo sapiens
acaauacauuccaccacaa

SEQ ID NO: 455054 - RNA, 19 nt, Homo sapiens
ggaggauacagaucacguu

SEQ ID NO: 455055 - RNA, 19 nt, Homo sapiens
caccuucuccuuacuauag

SEQ ID NO: 455056 - RNA, 19 nt, Homo sapiens
guacaccacagaaagagau

SEQ ID NO: 455057 - RNA, 19 nt, Homo sapiens
cagucgagauuaucguaga

SEQ ID NO: 455058 - RNA, 19 nt, Homo sapiens
ccaaaggaggcccaauuuc

SEQ ID NO: 455059 - RNA, 19 nt, Homo sapiens
aaagacaaaugcccguuuu

SEQ ID NO: 455060 - RNA, 19 nt, Homo sapiens
aacagugccuagugaaguu

SEQ ID NO: 455061 - RNA, 19 nt, Homo sapiens
agugaacagugccuaguga

SEQ ID NO: 455062 - RNA, 19 nt, Homo sapiens
ggucaccuucuccuuacua

SEQ ID NO: 455063 - RNA, 19 nt, Homo sapiens
gcggucaccuucuccuuac

SEQ ID NO: 455064 - RNA, 19 nt, Homo sapiens
aagacagggaucagauuua

SEQ ID NO: 455065 - RNA, 19 nt, Homo sapiens
cagaaagagaucuaagaga

SEQ ID NO: 455066 - RNA, 19 nt, Homo sapiens
gagcuuguacaccacagaa

SEQ ID NO: 455067 - RNA, 19 nt, Homo sapiens
gacuuugccuguucauuuu

SEQ ID NO: 455068 - RNA, 19 nt, Homo sapiens
gaacgugccaauggaaugg

SEQ ID NO: 455069 - RNA, 19 nt, Homo sapiens
uguagaugaugccaaggaa

SEQ ID NO: 455070 - RNA, 19 nt, Homo sapiens
aggauuugccuuuguauau

SEQ ID NO: 455071 - RNA, 19 nt, Homo sapiens
uauaugaccagcagucuag

SEQ ID NO: 455072 - RNA, 19 nt, Homo sapiens
guauaugaccagcagucua

SEQ ID NO: 455073 - RNA, 19 nt, Homo sapiens
cugcagggcuccauaauga

SEQ ID NO: 455074 - RNA, 19 nt, Homo sapiens
gaaggacguuuguguugga

SEQ ID NO: 455075 - RNA, 19 nt, Homo sapiens
gaagaaguacaacacauau

SEQ ID NO: 455076 - RNA, 19 nt, Homo sapiens
ugaagaaguacaacacaua

SEQ ID NO: 455077 - RNA, 19 nt, Homo sapiens
guacaacacauaugccuau

SEQ ID NO: 455078 - RNA, 19 nt, Homo sapiens
gaccaucugugaguucuga

SEQ ID NO: 455079 - RNA, 19 nt, Homo sapiens
caucaaauccugcagacaa

SEQ ID NO: 455080 - RNA, 19 nt, Homo sapiens
gcauugcugucccaaggaa

SEQ ID NO: 455081 - RNA, 19 nt, Homo sapiens
gcuucgagcucaucuagau

SEQ ID NO: 455082 - RNA, 19 nt, Homo sapiens
gaugggcaguggaaugaca

SEQ ID NO: 455083 - RNA, 19 nt, Homo sapiens
guggagauguacacagaug

SEQ ID NO: 455084 - RNA, 19 nt, Homo sapiens
gugaaggacguuuguguug

SEQ ID NO: 455085 - RNA, 19 nt, Homo sapiens
gugaagaaguacaacacau

SEQ ID NO: 455086 - RNA, 19 nt, Homo sapiens
cgacugaccaucugugagu

SEQ ID NO: 455087 - RNA, 19 nt, Homo sapiens
cagaugggcaguggaauga

SEQ ID NO: 455088 - RNA, 19 nt, Homo sapiens
cccaaggaauccagaggaa

SEQ ID NO: 455089 - RNA, 19 nt, Homo sapiens
gcagggcuccauaaugaca

SEQ ID NO: 455090 - RNA, 19 nt, Homo sapiens
ccacgacuuuagacaucaa

SEQ ID NO: 455091 - RNA, 19 nt, Homo sapiens
acacagaugggcaguggaa

SEQ ID NO: 455092 - RNA, 19 nt, Homo sapiens
caaggaauccagaggaaaa

SEQ ID NO: 455093 - RNA, 19 nt, Homo sapiens
gcgaagugaaggacguuug

SEQ ID NO: 455094 - RNA, 19 nt, Homo sapiens
gggcuucgagcucaucuag

SEQ ID NO: 455095 - RNA, 19 nt, Homo sapiens
agcaguguguggagaugua

SEQ ID NO: 455096 - RNA, 19 nt, Homo sapiens
ccaaggaauccagaggaaa

SEQ ID NO: 455097 - RNA, 19 nt, Homo sapiens
cgaagugaaggacguuugu

SEQ ID NO: 455098 - RNA, 19 nt, Homo sapiens
aagccacacuccacgacuu

SEQ ID NO: 455099 - RNA, 19 nt, Homo sapiens
gaagugaaggacguuugug

SEQ ID NO: 455100 - RNA, 19 nt, Homo sapiens
ggugcugugugcgaaguga

SEQ ID NO: 455101 - RNA, 19 nt, Homo sapiens
ugccuguacucccgacuga

SEQ ID NO: 455102 - RNA, 19 nt, Homo sapiens
ggcaguggaaugacaggaa

SEQ ID NO: 455103 - RNA, 19 nt, Homo sapiens
uaaugacaguaggagagaa

SEQ ID NO: 455104 - RNA, 19 nt, Homo sapiens
gagacuuccgcuacucaga

SEQ ID NO: 455105 - RNA, 19 nt, Homo sapiens
agaaguacaacacauaugc

SEQ ID NO: 455106 - RNA, 19 nt, Homo sapiens
cgacuuuagacaucaaauc

SEQ ID NO: 455107 - RNA, 19 nt, Homo sapiens
acagaugggcaguggaaug

SEQ ID NO: 455108 - RNA, 19 nt, Homo sapiens
ggaauccagaggaaaauga

SEQ ID NO: 455109 - RNA, 19 nt, Homo sapiens
ggcaguccaucacuuuuga

SEQ ID NO: 455110 - RNA, 19 nt, Homo sapiens
gaccaucugugauuucuga

SEQ ID NO: 455111 - RNA, 19 nt, Homo sapiens
cugcagggcuccauaauga

SEQ ID NO: 455112 - RNA, 19 nt, Homo sapiens
gaaggacguuuguguugga

SEQ ID NO: 455113 - RNA, 19 nt, Homo sapiens
gaacucccuuucaacagaa

SEQ ID NO: 455114 - RNA, 19 nt, Homo sapiens
cgggagagauggugucaaa

SEQ ID NO: 455115 - RNA, 19 nt, Homo sapiens
uaacaugugccaggucuua

SEQ ID NO: 455116 - RNA, 19 nt, Homo sapiens
gagagauggugucaaagga

SEQ ID NO: 455117 - RNA, 19 nt, Homo sapiens
gugggucgcugauuucuug

SEQ ID NO: 455118 - RNA, 19 nt, Homo sapiens
agaauucacuuguggcuau

SEQ ID NO: 455119 - RNA, 19 nt, Homo sapiens
ugaagaaguacaacacaua

SEQ ID NO: 455120 - RNA, 19 nt, Homo sapiens
guaacuuucugcugaugaa

SEQ ID NO: 455121 - RNA, 19 nt, Homo sapiens
cgacugaccaucugugauu

SEQ ID NO: 455122 - RNA, 19 nt, Homo sapiens
gcagacaugacccgaguaa

SEQ ID NO: 455123 - RNA, 19 nt, Homo sapiens
caucaaauccugcagacaa

SEQ ID NO: 455124 - RNA, 19 nt, Homo sapiens
ggucuuaggaugugucuug

SEQ ID NO: 455125 - RNA, 19 nt, Homo sapiens
gcauugcugucccaaggaa

SEQ ID NO: 455126 - RNA, 19 nt, Homo sapiens
ccacacaccuugacaaaau

SEQ ID NO: 455127 - RNA, 19 nt, Homo sapiens
gagccuauaucuucaucug

SEQ ID NO: 455128 - RNA, 19 nt, Homo sapiens
agaacucccuuucaacaga

SEQ ID NO: 455129 - RNA, 19 nt, Homo sapiens
guugcugucacaauuauua

SEQ ID NO: 455130 - RNA, 19 nt, Homo sapiens
ccagagccguuacuacaca

SEQ ID NO: 455131 - RNA, 19 nt, Homo sapiens
gugugugggucgcugauuu

SEQ ID NO: 455132 - RNA, 19 nt, Homo sapiens
gaauucacuuguggcuauu

SEQ ID NO: 455133 - RNA, 19 nt, Homo sapiens
ggccaagcauaaugacaga

SEQ ID NO: 455134 - RNA, 19 nt, Homo sapiens
gaugggcaguggaaugaca

SEQ ID NO: 455135 - RNA, 19 nt, Homo sapiens
guggagauguacacagaug

SEQ ID NO: 455136 - RNA, 19 nt, Homo sapiens
guacgauucacuccuuuga

SEQ ID NO: 455137 - RNA, 19 nt, Homo sapiens
gcaguaccggccaagcaua

SEQ ID NO: 455138 - RNA, 19 nt, Homo sapiens
gcuuccagcucaucuagau

SEQ ID NO: 455139 - RNA, 19 nt, Homo sapiens
ggagagauggugucaaagg

SEQ ID NO: 455140 - RNA, 19 nt, Homo sapiens
gugaaggacguuuguguug

SEQ ID NO: 455141 - RNA, 19 nt, Homo sapiens
gguccaguuccuucacuua

SEQ ID NO: 455142 - RNA, 19 nt, Homo sapiens
ggauccacuuggucuguga

SEQ ID NO: 455143 - RNA, 19 nt, Homo sapiens
gugaagaaguacaacacau

SEQ ID NO: 455144 - RNA, 19 nt, Homo sapiens
caaugucacgggaccagua

SEQ ID NO: 455145 - RNA, 19 nt, Homo sapiens
gacaugacccgaguaacuu

SEQ ID NO: 455146 - RNA, 19 nt, Homo sapiens
ucaacagaauucacuugug

SEQ ID NO: 455147 - RNA, 19 nt, Homo sapiens
cgaguaacuuucugcugau

SEQ ID NO: 455148 - RNA, 19 nt, Homo sapiens
gacugaccaucugugauuu

SEQ ID NO: 455149 - RNA, 19 nt, Homo sapiens
cagaugggcaguggaauga

SEQ ID NO: 455150 - RNA, 19 nt, Homo sapiens
cacgggaccaguauuguuu

SEQ ID NO: 455151 - RNA, 19 nt, Homo sapiens
ccacuuggucugugagaug

SEQ ID NO: 455152 - RNA, 19 nt, Homo sapiens
cccaaggaauccagaggaa

SEQ ID NO: 455153 - RNA, 19 nt, Homo sapiens
gcagggcuccauaaugaca

SEQ ID NO: 455154 - RNA, 19 nt, Homo sapiens
uaccagagccguuacuaca

SEQ ID NO: 455155 - RNA, 19 nt, Homo sapiens
ucacaauuauuaccaucuc

SEQ ID NO: 455156 - RNA, 19 nt, Homo sapiens
ucccugagccuauaucuuc

SEQ ID NO: 455157 - RNA, 19 nt, Homo sapiens
ccaagcauaaugacagaga

SEQ ID NO: 455158 - RNA, 19 nt, Homo sapiens
gagcaguaccggccaagca

SEQ ID NO: 455159 - RNA, 19 nt, Homo sapiens
cuagaacucccuuucaaca

SEQ ID NO: 455160 - RNA, 19 nt, Homo sapiens
gauccugucuggccuucag

SEQ ID NO: 455161 - RNA, 19 nt, Homo sapiens
acacagaugggcaguggaa

SEQ ID NO: 455162 - RNA, 19 nt, Homo sapiens
ccuauaucuucaucuguga

SEQ ID NO: 455163 - RNA, 19 nt, Homo sapiens
gaguaacuuucugcugaug

SEQ ID NO: 455164 - RNA, 19 nt, Homo sapiens
ucacugaccagccuugaca

SEQ ID NO: 455165 - RNA, 19 nt, Homo sapiens
ucacgggaccaguauuguu

SEQ ID NO: 455166 - RNA, 19 nt, Homo sapiens
agacaugacccgaguaacu

SEQ ID NO: 455167 - RNA, 19 nt, Homo sapiens
gacuuccgcuacucagaug

SEQ ID NO: 455168 - RNA, 19 nt, Homo sapiens
cgacuucagacaucaaauc

SEQ ID NO: 455169 - RNA, 19 nt, Homo sapiens
ugcuagaacucccuuucaa

SEQ ID NO: 455170 - RNA, 19 nt, Homo sapiens
caaggaauccagaggaaaa

SEQ ID NO: 455171 - RNA, 19 nt, Homo sapiens
caguaccggccaagcauaa

SEQ ID NO: 455172 - RNA, 19 nt, Homo sapiens
gaggcacccuuagccacuu

SEQ ID NO: 455173 - RNA, 19 nt, Homo sapiens
gaugcuagaacucccuuuc

SEQ ID NO: 455174 - RNA, 19 nt, Homo sapiens
gcgaagugaaggacguuug

SEQ ID NO: 455175 - RNA, 19 nt, Homo sapiens
guaccggccaagcauaaug

SEQ ID NO: 455176 - RNA, 19 nt, Homo sapiens
ucugugagaugcuagaacu

SEQ ID NO: 455177 - RNA, 19 nt, Homo sapiens
cgaagugaaggacguuugu

SEQ ID NO: 455178 - RNA, 19 nt, Homo sapiens
agcaguguguggagaugua

SEQ ID NO: 455179 - RNA, 19 nt, Homo sapiens
ccaaggaauccagaggaaa

SEQ ID NO: 455180 - RNA, 19 nt, Homo sapiens
aagccacacuccacgacuu

SEQ ID NO: 455181 - RNA, 19 nt, Homo sapiens
uuacagauggcagcaguga

SEQ ID NO: 455182 - RNA, 19 nt, Homo sapiens
gaagugaaggacguuugug

SEQ ID NO: 455183 - RNA, 19 nt, Homo sapiens
gcagcuggaggcucugugu

SEQ ID NO: 455184 - RNA, 19 nt, Homo sapiens
auuaccaucucuccagcua

SEQ ID NO: 455185 - RNA, 19 nt, Homo sapiens
ccaguuccuucacuuacag

SEQ ID NO: 455186 - RNA, 19 nt, Homo sapiens
ugccuguacucccgacuga

SEQ ID NO: 455187 - RNA, 19 nt, Homo sapiens
ggcaguggaaugacaggaa

SEQ ID NO: 455188 - RNA, 19 nt, Homo sapiens
uaaugacaguaggagagaa

SEQ ID NO: 455189 - RNA, 19 nt, Homo sapiens
gagacuuccgcuacucaga

SEQ ID NO: 455190 - RNA, 19 nt, Homo sapiens
gauccaaacccaucuuccu

SEQ ID NO: 455191 - RNA, 19 nt, Homo sapiens
ugucacgggaccaguauug

SEQ ID NO: 455192 - RNA, 19 nt, Homo sapiens
cacaguacccggugacucu

SEQ ID NO: 455193 - RNA, 19 nt, Homo sapiens
ggugcugcgugcgaaguga

SEQ ID NO: 455194 - RNA, 19 nt, Homo sapiens
acagaugggcaguggaaug

SEQ ID NO: 455195 - RNA, 19 nt, Homo sapiens
ggaauccagaggaaaauga

SEQ ID NO: 455196 - RNA, 19 nt, Homo sapiens
ggcaguccaucacuuuuga

SEQ ID NO: 455197 - RNA, 19 nt, Homo sapiens
uuaacaagauggccaagga

SEQ ID NO: 455198 - RNA, 19 nt, Homo sapiens
gacaucguccacauccuua

SEQ ID NO: 455199 - RNA, 19 nt, Homo sapiens
gaugaccuaugccaagagu

SEQ ID NO: 455200 - RNA, 19 nt, Homo sapiens
guccagcccucuccagugu

SEQ ID NO: 455201 - RNA, 19 nt, Homo sapiens
gaaaagugcaagcaauuug

SEQ ID NO: 455202 - RNA, 19 nt, Homo sapiens
ccagcccucuccaguguau

SEQ ID NO: 455203 - RNA, 19 nt, Homo sapiens
gagcagcaauuccccauuc

SEQ ID NO: 455204 - RNA, 19 nt, Homo sapiens
guccacauccuuaacaaga

SEQ ID NO: 455205 - RNA, 19 nt, Homo sapiens
ccugaguucuggugccaaa

SEQ ID NO: 455206 - RNA, 19 nt, Homo sapiens
ccgaugaccuaugccaaga

SEQ ID NO: 455207 - RNA, 19 nt, Homo sapiens
gggagccgaugaccuaugc

SEQ ID NO: 455208 - RNA, 19 nt, Homo sapiens
ccaagagugugaggacauc

SEQ ID NO: 455209 - RNA, 19 nt, Homo sapiens
ugugggagccgaugaccua

SEQ ID NO: 455210 - RNA, 19 nt, Homo sapiens
ggaaaagugcaagcaauuu

SEQ ID NO: 455211 - RNA, 19 nt, Homo sapiens
gcggauccaagccaugauu

SEQ ID NO: 455212 - RNA, 19 nt, Homo sapiens
caccugggccugugcaaau

SEQ ID NO: 455213 - RNA, 19 nt, Homo sapiens
ugacucaaacggcaucugu

SEQ ID NO: 455214 - RNA, 19 nt, Homo sapiens
ugaccuaugccaagagugu

SEQ ID NO: 455215 - RNA, 19 nt, Homo sapiens
cugcagggcucugaucaag

SEQ ID NO: 455216 - RNA, 19 nt, Homo sapiens
ccacagccccgaccuuuga

SEQ ID NO: 455217 - RNA, 19 nt, Homo sapiens
ggccauaccacaggcaaug

SEQ ID NO: 455218 - RNA, 19 nt, Homo sapiens
cagcagcgagcaggccaua

SEQ ID NO: 455219 - RNA, 19 nt, Homo sapiens
gagcaggagccagggaugu

SEQ ID NO: 455220 - RNA, 19 nt, Homo sapiens
gcaacguccuccccuugaa

SEQ ID NO: 455221 - RNA, 19 nt, Homo sapiens
gggaaaagugcaagcaauu

SEQ ID NO: 455222 - RNA, 19 nt, Homo sapiens
gcaggagccagggauguca

SEQ ID NO: 455223 - RNA, 19 nt, Homo sapiens
acucaaacggcaucuguau

SEQ ID NO: 455224 - RNA, 19 nt, Homo sapiens
gacucaaacggcaucugua

SEQ ID NO: 455225 - RNA, 19 nt, Homo sapiens
gaauaaagcagccugauuu

SEQ ID NO: 455226 - RNA, 19 nt, Homo sapiens
gcaaagagguccugaugga

SEQ ID NO: 455227 - RNA, 19 nt, Homo sapiens
uaaagcagccugauuugaa

SEQ ID NO: 455228 - RNA, 19 nt, Homo sapiens
aaagcagccugauuugaaa

SEQ ID NO: 455229 - RNA, 19 nt, Homo sapiens
cauagcaccugcagcaaga

SEQ ID NO: 455230 - RNA, 19 nt, Homo sapiens
ggagaugguucuggagaug

SEQ ID NO: 455231 - RNA, 19 nt, Homo sapiens
caccugaaacgccuucuua

SEQ ID NO: 455232 - RNA, 19 nt, Homo sapiens
gaacuccugccacaacaga

SEQ ID NO: 455233 - RNA, 19 nt, Homo sapiens
gcugcuacaucaugaagau

SEQ ID NO: 455234 - RNA, 19 nt, Homo sapiens
gcgaggugccgcucuacua

SEQ ID NO: 455235 - RNA, 19 nt, Homo sapiens
ccgcagugccuacgucuaa

SEQ ID NO: 455236 - RNA, 19 nt, Homo sapiens
cagcaaagagguccugaug

SEQ ID NO: 455237 - RNA, 19 nt, Homo sapiens
gaaacacacggagaugguu

SEQ ID NO: 455238 - RNA, 19 nt, Homo sapiens
ugaaacgccuucuuaucgu

SEQ ID NO: 455239 - RNA, 19 nt, Homo sapiens
agaauaaagcagccugauu

SEQ ID NO: 455240 - RNA, 19 nt, Homo sapiens
gggaacuccugccacaaca

SEQ ID NO: 455241 - RNA, 19 nt, Homo sapiens
cacaugagccagaaacaca

SEQ ID NO: 455242 - RNA, 19 nt, Homo sapiens
gagaugguucuggagauga

SEQ ID NO: 455243 - RNA, 19 nt, Homo sapiens
aauaaagcagccugauuug

SEQ ID NO: 455244 - RNA, 19 nt, Homo sapiens
gagagcauccccagucuug

SEQ ID NO: 455245 - RNA, 19 nt, Homo sapiens
ggcaccugcugcuacauca

SEQ ID NO: 455246 - RNA, 19 nt, Homo sapiens
cugaaacgccuucuuaucg

SEQ ID NO: 455247 - RNA, 19 nt, Homo sapiens
ugagugagcaccugguuac

SEQ ID NO: 455248 - RNA, 19 nt, Homo sapiens
gccagaaacacacggagau

SEQ ID NO: 455249 - RNA, 19 nt, Homo sapiens
gcaccugcagcaagaugga

SEQ ID NO: 455250 - RNA, 19 nt, Homo sapiens
cggagaugguucuggagau

SEQ ID NO: 455251 - RNA, 19 nt, Homo sapiens
gcaccugaaacgccuucuu

SEQ ID NO: 455252 - RNA, 19 nt, Homo sapiens
ccugaaacgccuucuuauc

SEQ ID NO: 455253 - RNA, 19 nt, Homo sapiens
guucuggagaugagcauug

SEQ ID NO: 455254 - RNA, 19 nt, Homo sapiens
auaaagcagccugauuuga

SEQ ID NO: 455255 - RNA, 19 nt, Homo sapiens
ccagaaacacacggagaug

SEQ ID NO: 455256 - RNA, 19 nt, Homo sapiens
ggccagaagucaaggcuua

SEQ ID NO: 455257 - RNA, 19 nt, Homo sapiens
ugacagggcuuguggagaa

SEQ ID NO: 455258 - RNA, 19 nt, Homo sapiens
gagagucccuggucuauuc

SEQ ID NO: 455259 - RNA, 19 nt, Homo sapiens
caagacagcaggcuuugua

SEQ ID NO: 455260 - RNA, 19 nt, Homo sapiens
gaaagugggcuuccagaug

SEQ ID NO: 455261 - RNA, 19 nt, Homo sapiens
guggagaucuucaccaaug

SEQ ID NO: 455262 - RNA, 19 nt, Homo sapiens
aaagugggcuuccagaugu

SEQ ID NO: 455263 - RNA, 19 nt, Homo sapiens
guugagcucuucccaaaug

SEQ ID NO: 455264 - RNA, 19 nt, Homo sapiens
caauggcucuguuggagaa

SEQ ID NO: 455265 - RNA, 19 nt, Homo sapiens
cagggaagcccaacgauga

SEQ ID NO: 455266 - RNA, 19 nt, Homo sapiens
gcagcagguugaggccuua

SEQ ID NO: 455267 - RNA, 19 nt, Homo sapiens
aaguugagcucuucccaaa

SEQ ID NO: 455268 - RNA, 19 nt, Homo sapiens
ggacaauggcucuguugga

SEQ ID NO: 455269 - RNA, 19 nt, Homo sapiens
gaagaccuacucccacaga

SEQ ID NO: 455270 - RNA, 19 nt, Homo sapiens
aagcaggaaugaagaccua

SEQ ID NO: 455271 - RNA, 19 nt, Homo sapiens
gcugcuuucucucaguaua

SEQ ID NO: 455272 - RNA, 19 nt, Homo sapiens
caagacagagggcaaguuc

SEQ ID NO: 455273 - RNA, 19 nt, Homo sapiens
caaaggagcaaagggagaa

SEQ ID NO: 455274 - RNA, 19 nt, Homo sapiens
cugccaauauccuaauaaa

SEQ ID NO: 455275 - RNA, 19 nt, Homo sapiens
ggccuuacagggacaagua

SEQ ID NO: 455276 - RNA, 19 nt, Homo sapiens
aggcauuccuggagacaaa

SEQ ID NO: 455277 - RNA, 19 nt, Homo sapiens
uggagaaccuggaccaaag

SEQ ID NO: 455278 - RNA, 19 nt, Homo sapiens
gcacccuggucauguguag

SEQ ID NO: 455279 - RNA, 19 nt, Homo sapiens
guguggagaucuucaccaa

SEQ ID NO: 455280 - RNA, 19 nt, Homo sapiens
gugcuuggcccaggaguuu

SEQ ID NO: 455281 - RNA, 19 nt, Homo sapiens
aggagaagcugggcccaaa

SEQ ID NO: 455282 - RNA, 19 nt, Homo sapiens
ugacugauuccaagacaga

SEQ ID NO: 455283 - RNA, 19 nt, Homo sapiens
gagcguggagucccuggaa

SEQ ID NO: 455284 - RNA, 19 nt, Homo sapiens
ggagagucccuggucuauu

SEQ ID NO: 455285 - RNA, 19 nt, Homo sapiens
gacagggcuuguggagaaa

SEQ ID NO: 455286 - RNA, 19 nt, Homo sapiens
gaccuacucccacagaaca

SEQ ID NO: 455287 - RNA, 19 nt, Homo sapiens
uggagucccuggaaacaca

SEQ ID NO: 455288 - RNA, 19 nt, Homo sapiens
gggagacacugggccaagu

SEQ ID NO: 455289 - RNA, 19 nt, Homo sapiens
ggagaagauuuucaagaca

SEQ ID NO: 455290 - RNA, 19 nt, Homo sapiens
ccuccaggcugcuuucucu

SEQ ID NO: 455291 - RNA, 19 nt, Homo sapiens
ugagaaugccgccuugcaa

SEQ ID NO: 455292 - RNA, 19 nt, Homo sapiens
gcccaaaggagaaguaggu

SEQ ID NO: 455293 - RNA, 19 nt, Homo sapiens
ccaauggcaaguggaauga

SEQ ID NO: 455294 - RNA, 19 nt, Homo sapiens
caugacugauuccaagaca

SEQ ID NO: 455295 - RNA, 19 nt, Homo sapiens
gggagaagauuuucaagac

SEQ ID NO: 455296 - RNA, 19 nt, Homo sapiens
gacagcaggcuuuguaaaa

SEQ ID NO: 455297 - RNA, 19 nt, Homo sapiens
agacagcaggcuuuguaaa

SEQ ID NO: 455298 - RNA, 19 nt, Homo sapiens
aggcugcuuucucucagua

SEQ ID NO: 455299 - RNA, 19 nt, Homo sapiens
gcugccaauauccuaauaa

SEQ ID NO: 455300 - RNA, 19 nt, Homo sapiens
ggaguuuggccagaaguca

SEQ ID NO: 455301 - RNA, 19 nt, Homo sapiens
ccaggaguuuggccagaag

SEQ ID NO: 455302 - RNA, 19 nt, Homo sapiens
ucaccaauggcaaguggaa

SEQ ID NO: 455303 - RNA, 19 nt, Homo sapiens
acaggcugguggacaguug

SEQ ID NO: 455304 - RNA, 19 nt, Homo sapiens
gagaagcugggcccaaagg

SEQ ID NO: 455305 - RNA, 19 nt, Homo sapiens
gaguuuggccagaagucaa

SEQ ID NO: 455306 - RNA, 19 nt, Homo sapiens
uuccugagcaugacugauu

SEQ ID NO: 455307 - RNA, 19 nt, Homo sapiens
uuucaagacagcaggcuuu

SEQ ID NO: 455308 - RNA, 19 nt, Homo sapiens
gggagaaagugggcuucca

SEQ ID NO: 455309 - RNA, 19 nt, Homo sapiens
aauggcaaguggaaugaca

SEQ ID NO: 455310 - RNA, 19 nt, Homo sapiens
gaacccaggcucuaaacaa

SEQ ID NO: 455311 - RNA, 19 nt, Homo sapiens
ggaguaaggacauucagaa

SEQ ID NO: 455312 - RNA, 19 nt, Homo sapiens
gagaguguguggaguaagg

SEQ ID NO: 455313 - RNA, 19 nt, Homo sapiens
ggugagaguguguggagua

SEQ ID NO: 455314 - RNA, 19 nt, Homo sapiens
agggaaggcugaagagaga

SEQ ID NO: 455315 - RNA, 19 nt, Homo sapiens
gugagaguguguggaguaa

SEQ ID NO: 455316 - RNA, 19 nt, Homo sapiens
gagcaugacccguucuucu

SEQ ID NO: 455317 - RNA, 19 nt, Homo sapiens
cuacuugccugaagauggu

SEQ ID NO: 455318 - RNA, 19 nt, Homo sapiens
gaccaugagacguuucuga

SEQ ID NO: 455319 - RNA, 19 nt, Homo sapiens
guccagcccugacuucauc

SEQ ID NO: 455320 - RNA, 19 nt, Homo sapiens
guugacuggugcaauguga

SEQ ID NO: 455321 - RNA, 19 nt, Homo sapiens
aaagaagggguauacauua

SEQ ID NO: 455322 - RNA, 19 nt, Homo sapiens
aaucgggacagcuuugaua

SEQ ID NO: 455323 - RNA, 19 nt, Homo sapiens
cugcucugcucaccaauug

SEQ ID NO: 455324 - RNA, 19 nt, Homo sapiens
gaaaagaagggguauacau

SEQ ID NO: 455325 - RNA, 19 nt, Homo sapiens
aagaagggguauacauuaa

SEQ ID NO: 455326 - RNA, 19 nt, Homo sapiens
ugccggagccugcagauga

SEQ ID NO: 455327 - RNA, 19 nt, Homo sapiens
cccagaccgugacuucuug

SEQ ID NO: 455328 - RNA, 19 nt, Homo sapiens
aaaagaagggguauacauu

SEQ ID NO: 455329 - RNA, 19 nt, Homo sapiens
ggagggaaggcugaagaga

SEQ ID NO: 455330 - RNA, 19 nt, Homo sapiens
cugcugcucugcucaccaa

SEQ ID NO: 455331 - RNA, 19 nt, Homo sapiens
cgggacagcuuugauacca

SEQ ID NO: 455332 - RNA, 19 nt, Homo sapiens
ucuccacccugcccauguu

SEQ ID NO: 455333 - RNA, 19 nt, Homo sapiens
cgcguugacuggugcaaug

SEQ ID NO: 455334 - RNA, 19 nt, Homo sapiens
aaugugacccugguggaua

SEQ ID NO: 455335 - RNA, 19 nt, Homo sapiens
gaagggguauacauuaagg

SEQ ID NO: 455336 - RNA, 19 nt, Homo sapiens
aacccaggcucuaaacaag

SEQ ID NO: 455337 - RNA, 19 nt, Homo sapiens
augugacccugguggauaa

SEQ ID NO: 455338 - RNA, 19 nt, Homo sapiens
cuacaaucgggacagcuuu

SEQ ID NO: 455339 - RNA, 19 nt, Homo sapiens
agccuccacuucugucuug

SEQ ID NO: 455340 - RNA, 19 nt, Homo sapiens
ugaggucacagccuacaau

SEQ ID NO: 455341 - RNA, 19 nt, Homo sapiens
gcagauuucuagugcauua

SEQ ID NO: 455342 - RNA, 19 nt, Homo sapiens
ccaaauggcugugauagua

SEQ ID NO: 455343 - RNA, 19 nt, Homo sapiens
gcaaguaggugguauuauc

SEQ ID NO: 455344 - RNA, 19 nt, Homo sapiens
caacaaagcucaguguaga

SEQ ID NO: 455345 - RNA, 19 nt, Homo sapiens
gcacaacaguaacuuuaaa

SEQ ID NO: 455346 - RNA, 19 nt, Homo sapiens
gaaggagugucaauaaaga

SEQ ID NO: 455347 - RNA, 19 nt, Homo sapiens
caagugaagucauuaaaga

SEQ ID NO: 455348 - RNA, 19 nt, Homo sapiens
ugaagcagcuguuuagauu

SEQ ID NO: 455349 - RNA, 19 nt, Homo sapiens
gagaaggagugucaauaaa

SEQ ID NO: 455350 - RNA, 19 nt, Homo sapiens
gaucagagaaguuaagaaa

SEQ ID NO: 455351 - RNA, 19 nt, Homo sapiens
gcauuaagccugagccaua

SEQ ID NO: 455352 - RNA, 19 nt, Homo sapiens
gagcacaacaguaacuuua

SEQ ID NO: 455353 - RNA, 19 nt, Homo sapiens
gaagguguauucauuaugg

SEQ ID NO: 455354 - RNA, 19 nt, Homo sapiens
gauccacccucuuuauaaa

SEQ ID NO: 455355 - RNA, 19 nt, Homo sapiens
gaacaugggcugccaaauc

SEQ ID NO: 455356 - RNA, 19 nt, Homo sapiens
ggaggaaggcgaaaugaaa

SEQ ID NO: 455357 - RNA, 19 nt, Homo sapiens
gugauuauccucuuguuua

SEQ ID NO: 455358 - RNA, 19 nt, Homo sapiens
ugagaaggcuguugagaga

SEQ ID NO: 455359 - RNA, 19 nt, Homo sapiens
ucagagagccuaaauucua

SEQ ID NO: 455360 - RNA, 19 nt, Homo sapiens
ccaaagucauguuuaaaga

SEQ ID NO: 455361 - RNA, 19 nt, Homo sapiens
ucacaugggugguaauaug

SEQ ID NO: 455362 - RNA, 19 nt, Homo sapiens
gauagacccacuuaagaua

SEQ ID NO: 455363 - RNA, 19 nt, Homo sapiens
cagagagccuaaauucuaa

SEQ ID NO: 455364 - RNA, 19 nt, Homo sapiens
gaaaguggccugcuucgau

SEQ ID NO: 455365 - RNA, 19 nt, Homo sapiens
gaaacuugcucaacaucau

SEQ ID NO: 455366 - RNA, 19 nt, Homo sapiens
ggagugauccacccucuuu

SEQ ID NO: 455367 - RNA, 19 nt, Homo sapiens
auaaagagcacaacaguaa

SEQ ID NO: 455368 - RNA, 19 nt, Homo sapiens
guucaucuuucuagaguuu

SEQ ID NO: 455369 - RNA, 19 nt, Homo sapiens
ucaaguacauccagguuug

SEQ ID NO: 455370 - RNA, 19 nt, Homo sapiens
acaaugugguggaaauuaa

SEQ ID NO: 455371 - RNA, 19 nt, Homo sapiens
cuuuaaagcuggauacauu

SEQ ID NO: 455372 - RNA, 19 nt, Homo sapiens
gagccuaaauucuaauaca

SEQ ID NO: 455373 - RNA, 19 nt, Homo sapiens
caacauggcauuuggaauc

SEQ ID NO: 455374 - RNA, 19 nt, Homo sapiens
uuaagaaacuugcucaaca

SEQ ID NO: 455375 - RNA, 19 nt, Homo sapiens
gaacuuuacauaugugaga

SEQ ID NO: 455376 - RNA, 19 nt, Homo sapiens
agaguaagcauaucuguuu

SEQ ID NO: 455377 - RNA, 19 nt, Homo sapiens
gugguaauauggaguuaaa

SEQ ID NO: 455378 - RNA, 19 nt, Homo sapiens
gagagaaggagugucaaua

SEQ ID NO: 455379 - RNA, 19 nt, Homo sapiens
ccaaugguccuguaaagaa

SEQ ID NO: 455380 - RNA, 19 nt, Homo sapiens
uaagaaacuugcucaacau

SEQ ID NO: 455381 - RNA, 19 nt, Homo sapiens
gaaaggauuaccagcaaug

SEQ ID NO: 455382 - RNA, 19 nt, Homo sapiens
caaaaggcaucuacugaaa

SEQ ID NO: 455383 - RNA, 19 nt, Homo sapiens
gcaaugcuaccagugauuu

SEQ ID NO: 455384 - RNA, 19 nt, Homo sapiens
gcacagacuaugaaacuca

SEQ ID NO: 455385 - RNA, 19 nt, Homo sapiens
aaaguggccugcuucgauu

SEQ ID NO: 455386 - RNA, 19 nt, Homo sapiens
ggaagaaagggcaauuuag

SEQ ID NO: 455387 - RNA, 19 nt, Homo sapiens
ggauagacccacuuaagau

SEQ ID NO: 455388 - RNA, 19 nt, Homo sapiens
gggauagacccacuuaaga

SEQ ID NO: 455389 - RNA, 19 nt, Homo sapiens
ggucaucacuggcaacaac

SEQ ID NO: 455390 - RNA, 19 nt, Homo sapiens
gauuuaagcaaguaucuga

SEQ ID NO: 455391 - RNA, 19 nt, Homo sapiens
ggaccaaauggcugugaua

SEQ ID NO: 455392 - RNA, 19 nt, Homo sapiens
agagaaggagugucaauaa

SEQ ID NO: 455393 - RNA, 19 nt, Homo sapiens
caucucagcuuuaacuuuu

SEQ ID NO: 455394 - RNA, 19 nt, Homo sapiens
cuguuuagauucacuguaa

SEQ ID NO: 455395 - RNA, 19 nt, Homo sapiens
ggucugaagcagcuguuua

SEQ ID NO: 455396 - RNA, 19 nt, Homo sapiens
ccaacauguuuauaucuug

SEQ ID NO: 455397 - RNA, 19 nt, Homo sapiens
ucaccaacauguuuauauc

SEQ ID NO: 455398 - RNA, 19 nt, Homo sapiens
gaagaaagggcaauuuagc

SEQ ID NO: 455399 - RNA, 19 nt, Homo sapiens
ccuaggcauugcauguuua

SEQ ID NO: 455400 - RNA, 19 nt, Homo sapiens
gcuacaagcucugcaugug

SEQ ID NO: 455401 - RNA, 19 nt, Homo sapiens
ggaaaacaguaucauccua

SEQ ID NO: 455402 - RNA, 19 nt, Homo sapiens
gcguggaaaugaaggugua

SEQ ID NO: 455403 - RNA, 19 nt, Homo sapiens
uauaguaaguagcagaguu

SEQ ID NO: 455404 - RNA, 19 nt, Homo sapiens
gagcaucuucuacauccua

SEQ ID NO: 455405 - RNA, 19 nt, Homo sapiens
gggcaaaaccauugaauuu

SEQ ID NO: 455406 - RNA, 19 nt, Homo sapiens
ggacaacaaagcucagugu

SEQ ID NO: 455407 - RNA, 19 nt, Homo sapiens
uauccuggcugucaucaau

SEQ ID NO: 455408 - RNA, 19 nt, Homo sapiens
gcauaucuguuuuguuuga

SEQ ID NO: 455409 - RNA, 19 nt, Homo sapiens
aaaggaaagaugcagauuu

SEQ ID NO: 455410 - RNA, 19 nt, Homo sapiens
uuacagaguuugugauaac

SEQ ID NO: 455411 - RNA, 19 nt, Homo sapiens
cuggauacauuccgauuga

SEQ ID NO: 455412 - RNA, 19 nt, Homo sapiens
ugaagaucgucuccacaaa

SEQ ID NO: 455413 - RNA, 19 nt, Homo sapiens
uuagccaucugugugauua

SEQ ID NO: 455414 - RNA, 19 nt, Homo sapiens
gcucaacaucauauaguaa

SEQ ID NO: 455415 - RNA, 19 nt, Homo sapiens
gaagaucagagaaguuaag

SEQ ID NO: 455416 - RNA, 19 nt, Homo sapiens
gcaagugaagucauuaaag

SEQ ID NO: 455417 - RNA, 19 nt, Homo sapiens
gaggucaccaacauguuua

SEQ ID NO: 455418 - RNA, 19 nt, Homo sapiens
gaaaacaguaucauccuaa

SEQ ID NO: 455419 - RNA, 19 nt, Homo sapiens
gugauaguauggaguuuca

SEQ ID NO: 455420 - RNA, 19 nt, Homo sapiens
auucucaucuucuuaggua

SEQ ID NO: 455421 - RNA, 19 nt, Homo sapiens
gauacauuccgauugauga

SEQ ID NO: 455422 - RNA, 19 nt, Homo sapiens
aagcagcuguuuagauuca

SEQ ID NO: 455423 - RNA, 19 nt, Homo sapiens
gagagccuaaauucuaaua

SEQ ID NO: 455424 - RNA, 19 nt, Homo sapiens
caaguggagugaaaaguuu

SEQ ID NO: 455425 - RNA, 19 nt, Homo sapiens
aggaagaaagggcaauuua

SEQ ID NO: 455426 - RNA, 19 nt, Homo sapiens
aaacaccaucucagcuuua

SEQ ID NO: 455427 - RNA, 19 nt, Homo sapiens
uagacccacuuaagauauu

SEQ ID NO: 455428 - RNA, 19 nt, Homo sapiens
gaauuucacauggguggua

SEQ ID NO: 455429 - RNA, 19 nt, Homo sapiens
gcaaguaaccagccagaac

SEQ ID NO: 455430 - RNA, 19 nt, Homo sapiens
ggcaacaaccagccuauug

SEQ ID NO: 455431 - RNA, 19 nt, Homo sapiens
gugauccacccucuuuaua

SEQ ID NO: 455432 - RNA, 19 nt, Homo sapiens
caauaaagagcacaacagu

SEQ ID NO: 455433 - RNA, 19 nt, Homo sapiens
ggcauugcauguuuauauc

SEQ ID NO: 455434 - RNA, 19 nt, Homo sapiens
gaggaagaaagggcaauuu

SEQ ID NO: 455435 - RNA, 19 nt, Homo sapiens
caaguaaccagccagaaca

SEQ ID NO: 455436 - RNA, 19 nt, Homo sapiens
ggagaccaguuggguagug

SEQ ID NO: 455437 - RNA, 19 nt, Homo sapiens
cugaaaggauuaccagcaa

SEQ ID NO: 455438 - RNA, 19 nt, Homo sapiens
gcaauuuagccaucugugu

SEQ ID NO: 455439 - RNA, 19 nt, Homo sapiens
gcacugcuguaucuguuuu

SEQ ID NO: 455440 - RNA, 19 nt, Homo sapiens
gaagaucgucuccacaaaa

SEQ ID NO: 455441 - RNA, 19 nt, Homo sapiens
gcugaaagauuacgaguuu

SEQ ID NO: 455442 - RNA, 19 nt, Homo sapiens
ucaaagaccuuguguguau

SEQ ID NO: 455443 - RNA, 19 nt, Homo sapiens
aguaggagcugaaagauua

SEQ ID NO: 455444 - RNA, 19 nt, Homo sapiens
ggacauuguuggcagcaua

SEQ ID NO: 455445 - RNA, 19 nt, Homo sapiens
uaaguuagaugcugcgaaa

SEQ ID NO: 455446 - RNA, 19 nt, Homo sapiens
cguagaagcuuaugguaaa

SEQ ID NO: 455447 - RNA, 19 nt, Homo sapiens
ggacuuggcugcaguucug

SEQ ID NO: 455448 - RNA, 19 nt, Homo sapiens
ggaaugcuguucaggaaau

SEQ ID NO: 455449 - RNA, 19 nt, Homo sapiens
acagaaagccuaucaaaga

SEQ ID NO: 455450 - RNA, 19 nt, Homo sapiens
acaaagccauauugaagua

SEQ ID NO: 455451 - RNA, 19 nt, Homo sapiens
gaacacagaaagccuauca

SEQ ID NO: 455452 - RNA, 19 nt, Homo sapiens
gcacaguguucccuaaauc

SEQ ID NO: 455453 - RNA, 19 nt, Homo sapiens
ccagaaauguuacagugaa

SEQ ID NO: 455454 - RNA, 19 nt, Homo sapiens
aggagacucugaauucuua

SEQ ID NO: 455455 - RNA, 19 nt, Homo sapiens
ggacaagagagagacauua

SEQ ID NO: 455456 - RNA, 19 nt, Homo sapiens
ggaguacgguuucaaagca

SEQ ID NO: 455457 - RNA, 19 nt, Homo sapiens
ggaaaucaaugcagaagcu

SEQ ID NO: 455458 - RNA, 19 nt, Homo sapiens
gcucuucucugcagacaau

SEQ ID NO: 455459 - RNA, 19 nt, Homo sapiens
agacaauaaugaaguggua

SEQ ID NO: 455460 - RNA, 19 nt, Homo sapiens
gaccuuguguguaugugua

SEQ ID NO: 455461 - RNA, 19 nt, Homo sapiens
agacuaaagugcuaacuca

SEQ ID NO: 455462 - RNA, 19 nt, Homo sapiens
gaaggagacucugaauucu

SEQ ID NO: 455463 - RNA, 19 nt, Homo sapiens
ccaaagauggagagauuaa

SEQ ID NO: 455464 - RNA, 19 nt, Homo sapiens
ggaaacgaugccuguauuu

SEQ ID NO: 455465 - RNA, 19 nt, Homo sapiens
gaacgaggcagaaggucuu

SEQ ID NO: 455466 - RNA, 19 nt, Homo sapiens
ucaaagaacuaagguugga

SEQ ID NO: 455467 - RNA, 19 nt, Homo sapiens
ugacaaagccauauugaag

SEQ ID NO: 455468 - RNA, 19 nt, Homo sapiens
cggaaacgaugccuguauu

SEQ ID NO: 455469 - RNA, 19 nt, Homo sapiens
agaaggagacucugaauuc

SEQ ID NO: 455470 - RNA, 19 nt, Homo sapiens
gaacuucacaauugaugga

SEQ ID NO: 455471 - RNA, 19 nt, Homo sapiens
gguaguaggagcugaaaga

SEQ ID NO: 455472 - RNA, 19 nt, Homo sapiens
uaucaaagaccuugugugu

SEQ ID NO: 455473 - RNA, 19 nt, Homo sapiens
ugcagaagcuggcaauaug

SEQ ID NO: 455474 - RNA, 19 nt, Homo sapiens
acaagugucugccucugaa

SEQ ID NO: 455475 - RNA, 19 nt, Homo sapiens
gaagggaccagguggagau

SEQ ID NO: 455476 - RNA, 19 nt, Homo sapiens
acacagaaagccuaucaaa

SEQ ID NO: 455477 - RNA, 19 nt, Homo sapiens
ccaacccggucucuaguga

SEQ ID NO: 455478 - RNA, 19 nt, Homo sapiens
ugaccagacuaaagugcua

SEQ ID NO: 455479 - RNA, 19 nt, Homo sapiens
cgggaaugcuguucaggaa

SEQ ID NO: 455480 - RNA, 19 nt, Homo sapiens
ucaaugaccagacuaaagu

SEQ ID NO: 455481 - RNA, 19 nt, Homo sapiens
gaaugcuguucaggaaauu

SEQ ID NO: 455482 - RNA, 19 nt, Homo sapiens
gaaacggacaagagagaga

SEQ ID NO: 455483 - RNA, 19 nt, Homo sapiens
guguguggguggauauaaa

SEQ ID NO: 455484 - RNA, 19 nt, Homo sapiens
auggagagauuaaguuaga

SEQ ID NO: 455485 - RNA, 19 nt, Homo sapiens
caagagagagacauuacug

SEQ ID NO: 455486 - RNA, 19 nt, Homo sapiens
cagaaagccuaucaaagac

SEQ ID NO: 455487 - RNA, 19 nt, Homo sapiens
uggguccacuugucagaua

SEQ ID NO: 455488 - RNA, 19 nt, Homo sapiens
caaaaggaguggaaaucaa

SEQ ID NO: 455489 - RNA, 19 nt, Homo sapiens
ggagagauuaaguuagaug

SEQ ID NO: 455490 - RNA, 19 nt, Homo sapiens
agauggagagauuaaguua

SEQ ID NO: 455491 - RNA, 19 nt, Homo sapiens
gugcuaacucagcuuauaa

SEQ ID NO: 455492 - RNA, 19 nt, Homo sapiens
ggagcuggguccacuuguc

SEQ ID NO: 455493 - RNA, 19 nt, Homo sapiens
aaagugcuaacucagcuua

SEQ ID NO: 455494 - RNA, 19 nt, Homo sapiens
gacaaagccauauugaagu

SEQ ID NO: 455495 - RNA, 19 nt, Homo sapiens
gcuagaaggagacucugaa

SEQ ID NO: 455496 - RNA, 19 nt, Homo sapiens
caaagaccuuguguguaug

SEQ ID NO: 455497 - RNA, 19 nt, Homo sapiens
aguguucccuaaaucuaua

SEQ ID NO: 455498 - RNA, 19 nt, Homo sapiens
gagcggagggcacaguguu

SEQ ID NO: 455499 - RNA, 19 nt, Homo sapiens
guccugcuccucaugauuu

SEQ ID NO: 455500 - RNA, 19 nt, Homo sapiens
ggccacagguauacaaggu

SEQ ID NO: 455501 - RNA, 19 nt, Homo sapiens
cauauugaaguacggagua

SEQ ID NO: 455502 - RNA, 19 nt, Homo sapiens
cccuaaaucuauagaaaca

SEQ ID NO: 455503 - RNA, 19 nt, Homo sapiens
agugcuaacucagcuuaua

SEQ ID NO: 455504 - RNA, 19 nt, Homo sapiens
ccaucuggauucucaaagu

SEQ ID NO: 455505 - RNA, 19 nt, Homo sapiens
gagcuggguccacuuguca

SEQ ID NO: 455506 - RNA, 19 nt, Homo sapiens
ggcacaguguucccuaaau

SEQ ID NO: 455507 - RNA, 19 nt, Homo sapiens
caauaaugaagugguagua

SEQ ID NO: 455508 - RNA, 19 nt, Homo sapiens
gcggaaacgaugccuguau

SEQ ID NO: 455509 - RNA, 19 nt, Homo sapiens
gggaccagguggagaugau

SEQ ID NO: 455510 - RNA, 19 nt, Homo sapiens
gggcagaccccuucaaaga

SEQ ID NO: 455511 - RNA, 19 nt, Homo sapiens
ggucugacaaagccauauu

SEQ ID NO: 455512 - RNA, 19 nt, Homo sapiens
gacaagagagagacauuac

SEQ ID NO: 455513 - RNA, 19 nt, Homo sapiens
caucuggauucucaaaguc

SEQ ID NO: 455514 - RNA, 19 nt, Homo sapiens
gccaugaccaucuggauuc

SEQ ID NO: 455515 - RNA, 19 nt, Homo sapiens
aaacgaugccuguauuucu

SEQ ID NO: 455516 - RNA, 19 nt, Homo sapiens
uauacaagguggggauuua

SEQ ID NO: 455517 - RNA, 19 nt, Homo sapiens
gacauuguuggcagcauaa

SEQ ID NO: 455518 - RNA, 19 nt, Homo sapiens
cuaccuagacugccucaug

SEQ ID NO: 455519 - RNA, 19 nt, Homo sapiens
gugaaacggacaagagaga

SEQ ID NO: 455520 - RNA, 19 nt, Homo sapiens
cuucacaauugauggaaug

SEQ ID NO: 455521 - RNA, 19 nt, Homo sapiens
gaccaucuggauucucaaa

SEQ ID NO: 455522 - RNA, 19 nt, Homo sapiens
aacgaugccuguauuucuu

SEQ ID NO: 455523 - RNA, 19 nt, Homo sapiens
auagaaacaccuaauguca

SEQ ID NO: 455524 - RNA, 19 nt, Homo sapiens
gggcacaguguucccuaaa

SEQ ID NO: 455525 - RNA, 19 nt, Homo sapiens
uagaaggagacucugaauu

SEQ ID NO: 455526 - RNA, 19 nt, Homo sapiens
cuggugaacuuggccauga

SEQ ID NO: 455527 - RNA, 19 nt, Homo sapiens
ggguccacuugucagauaa

SEQ ID NO: 455528 - RNA, 19 nt, Homo sapiens
ccguagaagcuuaugguaa

SEQ ID NO: 455529 - RNA, 19 nt, Homo sapiens
gaaaccugaggaucacaga

SEQ ID NO: 455530 - RNA, 19 nt, Homo sapiens
ggccaugaccaucuggauu

SEQ ID NO: 455531 - RNA, 19 nt, Homo sapiens
gcagaagcuggcaauaugg

SEQ ID NO: 455532 - RNA, 19 nt, Homo sapiens
uaaugaagugguaguagga

SEQ ID NO: 455533 - RNA, 19 nt, Homo sapiens
gcgaaaaucaggcuaccua

SEQ ID NO: 455534 - RNA, 19 nt, Homo sapiens
aaagauggagagauuaagu

SEQ ID NO: 455535 - RNA, 19 nt, Homo sapiens
cuauagaaacaccuaaugu

SEQ ID NO: 455536 - RNA, 19 nt, Homo sapiens
gccagaaauguuacaguga

SEQ ID NO: 455537 - RNA, 19 nt, Homo sapiens
caaccucucuacgccaaag

SEQ ID NO: 455538 - RNA, 19 nt, Homo sapiens
gaaaaucaggcuaccuaga

SEQ ID NO: 455539 - RNA, 19 nt, Homo sapiens
uauagaaacaccuaauguc

SEQ ID NO: 455540 - RNA, 19 nt, Homo sapiens
gaucugcgucugcgccaau

SEQ ID NO: 455541 - RNA, 19 nt, Homo sapiens
gcugaaagauuacgaguuu

SEQ ID NO: 455542 - RNA, 19 nt, Homo sapiens
aguaggagcugaaagauua

SEQ ID NO: 455543 - RNA, 19 nt, Homo sapiens
cguagaagcuuaugguaaa

SEQ ID NO: 455544 - RNA, 19 nt, Homo sapiens
ggacuuggcugcaguucug

SEQ ID NO: 455545 - RNA, 19 nt, Homo sapiens
ggaaugcuguucaggaaau

SEQ ID NO: 455546 - RNA, 19 nt, Homo sapiens
acaaagccauauugaagua

SEQ ID NO: 455547 - RNA, 19 nt, Homo sapiens
gcacaguguucccuaaauc

SEQ ID NO: 455548 - RNA, 19 nt, Homo sapiens
ccagaaauguuacagugaa

SEQ ID NO: 455549 - RNA, 19 nt, Homo sapiens
aggagacucugaauucuua

SEQ ID NO: 455550 - RNA, 19 nt, Homo sapiens
ggacaagagagagacauua

SEQ ID NO: 455551 - RNA, 19 nt, Homo sapiens
ggaguacgguuucaaagca

SEQ ID NO: 455552 - RNA, 19 nt, Homo sapiens
ggaaaucaaugcagaagcu

SEQ ID NO: 455553 - RNA, 19 nt, Homo sapiens
gcucuucucugcagacaau

SEQ ID NO: 455554 - RNA, 19 nt, Homo sapiens
agacaauaaugaaguggua

SEQ ID NO: 455555 - RNA, 19 nt, Homo sapiens
agacuaaagugcuaacuca

SEQ ID NO: 455556 - RNA, 19 nt, Homo sapiens
gaaggagacucugaauucu

SEQ ID NO: 455557 - RNA, 19 nt, Homo sapiens
gagauaauggcauguauuc

SEQ ID NO: 455558 - RNA, 19 nt, Homo sapiens
auacacaucuggcucaaga

SEQ ID NO: 455559 - RNA, 19 nt, Homo sapiens
ggaaacgaugccuguauuu

SEQ ID NO: 455560 - RNA, 19 nt, Homo sapiens
ucaaagaacuaagguugga

SEQ ID NO: 455561 - RNA, 19 nt, Homo sapiens
ugacaaagccauauugaag

SEQ ID NO: 455562 - RNA, 19 nt, Homo sapiens
cggaaacgaugccuguauu

SEQ ID NO: 455563 - RNA, 19 nt, Homo sapiens
agaaggagacucugaauuc

SEQ ID NO: 455564 - RNA, 19 nt, Homo sapiens
gaacuucacaauugaugga

SEQ ID NO: 455565 - RNA, 19 nt, Homo sapiens
gguaguaggagcugaaaga

SEQ ID NO: 455566 - RNA, 19 nt, Homo sapiens
ugcagaagcuggcaauaug

SEQ ID NO: 455567 - RNA, 19 nt, Homo sapiens
gagaaggacagaaguucaa

SEQ ID NO: 455568 - RNA, 19 nt, Homo sapiens
gaagggaccagguggagau

SEQ ID NO: 455569 - RNA, 19 nt, Homo sapiens
ccaacauaauuaagcugua

SEQ ID NO: 455570 - RNA, 19 nt, Homo sapiens
ccaacccggucucuaguga

SEQ ID NO: 455571 - RNA, 19 nt, Homo sapiens
ugaccagacuaaagugcua

SEQ ID NO: 455572 - RNA, 19 nt, Homo sapiens
ccacaauccaucaaaguga

SEQ ID NO: 455573 - RNA, 19 nt, Homo sapiens
gauaauggcauguauucca

SEQ ID NO: 455574 - RNA, 19 nt, Homo sapiens
cgggaaugcuguucaggaa

SEQ ID NO: 455575 - RNA, 19 nt, Homo sapiens
ucaaugaccagacuaaagu

SEQ ID NO: 455576 - RNA, 19 nt, Homo sapiens
gaaugcuguucaggaaauu

SEQ ID NO: 455577 - RNA, 19 nt, Homo sapiens
gaugagaaggacagaaguu

SEQ ID NO: 455578 - RNA, 19 nt, Homo sapiens
gaaacggacaagagagaga

SEQ ID NO: 455579 - RNA, 19 nt, Homo sapiens
caagagagagacauuacug

SEQ ID NO: 455580 - RNA, 19 nt, Homo sapiens
uugagcagcaugauuauaa

SEQ ID NO: 455581 - RNA, 19 nt, Homo sapiens
caaaaggaguggaaaucaa

SEQ ID NO: 455582 - RNA, 19 nt, Homo sapiens
gugcuaacucagcuuauaa

SEQ ID NO: 455583 - RNA, 19 nt, Homo sapiens
aaagugcuaacucagcuua

SEQ ID NO: 455584 - RNA, 19 nt, Homo sapiens
ggccaacccuucccauaac

SEQ ID NO: 455585 - RNA, 19 nt, Homo sapiens
gacaaagccauauugaagu

SEQ ID NO: 455586 - RNA, 19 nt, Homo sapiens
gcuagaaggagacucugaa

SEQ ID NO: 455587 - RNA, 19 nt, Homo sapiens
ccaaguacagaauuauaug

SEQ ID NO: 455588 - RNA, 19 nt, Homo sapiens
aguguucccuaaaucuaua

SEQ ID NO: 455589 - RNA, 19 nt, Homo sapiens
gagcggagggcacaguguu

SEQ ID NO: 455590 - RNA, 19 nt, Homo sapiens
guccugcuccucaugauuu

SEQ ID NO: 455591 - RNA, 19 nt, Homo sapiens
ggccacagguauacaaggu

SEQ ID NO: 455592 - RNA, 19 nt, Homo sapiens
cauauugaaguacggagua

SEQ ID NO: 455593 - RNA, 19 nt, Homo sapiens
cccuaaaucuauagaaaca

SEQ ID NO: 455594 - RNA, 19 nt, Homo sapiens
agugcuaacucagcuuaua

SEQ ID NO: 455595 - RNA, 19 nt, Homo sapiens
ccaucuggauucucaaagu

SEQ ID NO: 455596 - RNA, 19 nt, Homo sapiens
auaauggcauguauuccaa

SEQ ID NO: 455597 - RNA, 19 nt, Homo sapiens
ggcacaguguucccuaaau

SEQ ID NO: 455598 - RNA, 19 nt, Homo sapiens
caauaaugaagugguagua

SEQ ID NO: 455599 - RNA, 19 nt, Homo sapiens
gcggaaacgaugccuguau

SEQ ID NO: 455600 - RNA, 19 nt, Homo sapiens
gggaccagguggagaugau

SEQ ID NO: 455601 - RNA, 19 nt, Homo sapiens
acacaucuggcucaagaaa

SEQ ID NO: 455602 - RNA, 19 nt, Homo sapiens
gggcagaccccuucaaaga

SEQ ID NO: 455603 - RNA, 19 nt, Homo sapiens
ggucugacaaagccauauu

SEQ ID NO: 455604 - RNA, 19 nt, Homo sapiens
gacaagagagagacauuac

SEQ ID NO: 455605 - RNA, 19 nt, Homo sapiens
caucuggauucucaaaguc

SEQ ID NO: 455606 - RNA, 19 nt, Homo sapiens
gccaugaccaucuggauuc

SEQ ID NO: 455607 - RNA, 19 nt, Homo sapiens
aaacgaugccuguauuucu

SEQ ID NO: 455608 - RNA, 19 nt, Homo sapiens
uauacaagguggggauuua

SEQ ID NO: 455609 - RNA, 19 nt, Homo sapiens
uggcauguauuccaaguac

SEQ ID NO: 455610 - RNA, 19 nt, Homo sapiens
gugaaacggacaagagaga

SEQ ID NO: 455611 - RNA, 19 nt, Homo sapiens
cuucacaauugauggaaug

SEQ ID NO: 455612 - RNA, 19 nt, Homo sapiens
gaccaucuggauucucaaa

SEQ ID NO: 455613 - RNA, 19 nt, Homo sapiens
aacgaugccuguauuucuu

SEQ ID NO: 455614 - RNA, 19 nt, Homo sapiens
gagccaagcagguuuuauu

SEQ ID NO: 455615 - RNA, 19 nt, Homo sapiens
gggaugagaaggacagaag

SEQ ID NO: 455616 - RNA, 19 nt, Homo sapiens
auagaaacaccuaauguca

SEQ ID NO: 455617 - RNA, 19 nt, Homo sapiens
gggcacaguguucccuaaa

SEQ ID NO: 455618 - RNA, 19 nt, Homo sapiens
uagaaggagacucugaauu

SEQ ID NO: 455619 - RNA, 19 nt, Homo sapiens
cuggugaacuuggccauga

SEQ ID NO: 455620 - RNA, 19 nt, Homo sapiens
ccguagaagcuuaugguaa

SEQ ID NO: 455621 - RNA, 19 nt, Homo sapiens
gaaaccugaggaucacaga

SEQ ID NO: 455622 - RNA, 19 nt, Homo sapiens
ggccaugaccaucuggauu

SEQ ID NO: 455623 - RNA, 19 nt, Homo sapiens
gagaggugagggaugagaa

SEQ ID NO: 455624 - RNA, 19 nt, Homo sapiens
gcagaagcuggcaauaugg

SEQ ID NO: 455625 - RNA, 19 nt, Homo sapiens
uaaugaagugguaguagga

SEQ ID NO: 455626 - RNA, 19 nt, Homo sapiens
ccaagcagguuuuauuucu

SEQ ID NO: 455627 - RNA, 19 nt, Homo sapiens
aggccaacccuucccauaa

SEQ ID NO: 455628 - RNA, 19 nt, Homo sapiens
cuauagaaacaccuaaugu

SEQ ID NO: 455629 - RNA, 19 nt, Homo sapiens
gccagaaauguuacaguga

SEQ ID NO: 455630 - RNA, 19 nt, Homo sapiens
caaccucucuacgccaaag

SEQ ID NO: 455631 - RNA, 19 nt, Homo sapiens
aaggacagaaguucaaaga

SEQ ID NO: 455632 - RNA, 19 nt, Homo sapiens
uauagaaacaccuaauguc

SEQ ID NO: 455633 - RNA, 19 nt, Homo sapiens
aaacccacaauccaucaaa

SEQ ID NO: 455634 - RNA, 19 nt, Homo sapiens
ugagcagcaugauuauaag

SEQ ID NO: 455635 - RNA, 19 nt, Homo sapiens
gaaggacagaaguucaaag

SEQ ID NO: 455636 - RNA, 19 nt, Homo sapiens
gggaaugcuguucaggaaa

SEQ ID NO: 455637 - RNA, 19 nt, Homo sapiens
caauugauggaaugggaaa

SEQ ID NO: 455638 - RNA, 19 nt, Homo sapiens
uucaaauucucucuuguca

SEQ ID NO: 455639 - RNA, 19 nt, Homo sapiens
caggccaacccuucccaua

SEQ ID NO: 455640 - RNA, 19 nt, Homo sapiens
ccaugaaaaugaaugcuau

SEQ ID NO: 455641 - RNA, 19 nt, Homo sapiens
gaaggcaucugcauagaga

SEQ ID NO: 455642 - RNA, 19 nt, Homo sapiens
gaagggaauuugagguuga

SEQ ID NO: 455643 - RNA, 19 nt, Homo sapiens
gcaaguaagucagguuuca

SEQ ID NO: 455644 - RNA, 19 nt, Homo sapiens
gaaucaguaugucuacaaa

SEQ ID NO: 455645 - RNA, 19 nt, Homo sapiens
uaagucagguuucacaaga

SEQ ID NO: 455646 - RNA, 19 nt, Homo sapiens
cauccucccuucaguuuaa

SEQ ID NO: 455647 - RNA, 19 nt, Homo sapiens
gcaagccacuauuuacugu

SEQ ID NO: 455648 - RNA, 19 nt, Homo sapiens
ggaggucacaggcagguua

SEQ ID NO: 455649 - RNA, 19 nt, Homo sapiens
agaguagccuugcucagua

SEQ ID NO: 455650 - RNA, 19 nt, Homo sapiens
acagauaaacuucgaguaa

SEQ ID NO: 455651 - RNA, 19 nt, Homo sapiens
guugugaauuuagcucuua

SEQ ID NO: 455652 - RNA, 19 nt, Homo sapiens
gcauuuccuuuauagcauu

SEQ ID NO: 455653 - RNA, 19 nt, Homo sapiens
cuauacagcauuuccuuua

SEQ ID NO: 455654 - RNA, 19 nt, Homo sapiens
cagcguggaugggaaguaa

SEQ ID NO: 455655 - RNA, 19 nt, Homo sapiens
ugucagagccgacccguuu

SEQ ID NO: 455656 - RNA, 19 nt, Homo sapiens
cauccucguugugaauuua

SEQ ID NO: 455657 - RNA, 19 nt, Homo sapiens
gcauagagaggccagagaa

SEQ ID NO: 455658 - RNA, 19 nt, Homo sapiens
gaguugccguguggaguua

SEQ ID NO: 455659 - RNA, 19 nt, Homo sapiens
gcacaucgugaaagacuga

SEQ ID NO: 455660 - RNA, 19 nt, Homo sapiens
gaaggaaguugugguuggu

SEQ ID NO: 455661 - RNA, 19 nt, Homo sapiens
gauaucuaaugcccuguug

SEQ ID NO: 455662 - RNA, 19 nt, Homo sapiens
aaucaacaguuucagauca

SEQ ID NO: 455663 - RNA, 19 nt, Homo sapiens
gagccgacccguuucaaga

SEQ ID NO: 455664 - RNA, 19 nt, Homo sapiens
caagauguaguuaaaggaa

SEQ ID NO: 455665 - RNA, 19 nt, Homo sapiens
guuucaagaccuuagauua

SEQ ID NO: 455666 - RNA, 19 nt, Homo sapiens
gacggcaagccacuauuua

SEQ ID NO: 455667 - RNA, 19 nt, Homo sapiens
cuaaugcccuguugagagu

SEQ ID NO: 455668 - RNA, 19 nt, Homo sapiens
ucaagaccuuagauuagaa

SEQ ID NO: 455669 - RNA, 19 nt, Homo sapiens
gagaguagccuugcucagu

SEQ ID NO: 455670 - RNA, 19 nt, Homo sapiens
cgacggcaagccacuauuu

SEQ ID NO: 455671 - RNA, 19 nt, Homo sapiens
gaaggggaaucagaauuuu

SEQ ID NO: 455672 - RNA, 19 nt, Homo sapiens
ggccagagaaucaguaugu

SEQ ID NO: 455673 - RNA, 19 nt, Homo sapiens
guguggaguuaauguauga

SEQ ID NO: 455674 - RNA, 19 nt, Homo sapiens
ggaaggggaaucagaauuu

SEQ ID NO: 455675 - RNA, 19 nt, Homo sapiens
ccaaaguucuauacagcau

SEQ ID NO: 455676 - RNA, 19 nt, Homo sapiens
cagagaaucaguaugucua

SEQ ID NO: 455677 - RNA, 19 nt, Homo sapiens
cccagaaugugacuguaaa

SEQ ID NO: 455678 - RNA, 19 nt, Homo sapiens
gcucuuacaauuuggauuc

SEQ ID NO: 455679 - RNA, 19 nt, Homo sapiens
uagccuugcucaguacuaa

SEQ ID NO: 455680 - RNA, 19 nt, Homo sapiens
gggagcagcugcacaucgu

SEQ ID NO: 455681 - RNA, 19 nt, Homo sapiens
guaguucauucgccagugu

SEQ ID NO: 455682 - RNA, 19 nt, Homo sapiens
cacaaaaguugacaaaaug

SEQ ID NO: 455683 - RNA, 19 nt, Homo sapiens
ugguagaaguccagaauca

SEQ ID NO: 455684 - RNA, 19 nt, Homo sapiens
aaaagucggucccaaaaug

SEQ ID NO: 455685 - RNA, 19 nt, Homo sapiens
caaucaacccagaauguga

SEQ ID NO: 455686 - RNA, 19 nt, Homo sapiens
ggccagcuguaguucauuc

SEQ ID NO: 455687 - RNA, 19 nt, Homo sapiens
ccuuugcucucauucugua

SEQ ID NO: 455688 - RNA, 19 nt, Homo sapiens
cccauuguaugccaaagaa

SEQ ID NO: 455689 - RNA, 19 nt, Homo sapiens
gaaugggccacuugugugu

SEQ ID NO: 455690 - RNA, 19 nt, Homo sapiens
uuugaaacauucugucugu

SEQ ID NO: 455691 - RNA, 19 nt, Homo sapiens
gagaaucaguaugucuaca

SEQ ID NO: 455692 - RNA, 19 nt, Homo sapiens
ggaaugcuugugcuugaug

SEQ ID NO: 455693 - RNA, 19 nt, Homo sapiens
cagauaaacuucgaguaac

SEQ ID NO: 455694 - RNA, 19 nt, Homo sapiens
uagagaggccagagaauca

SEQ ID NO: 455695 - RNA, 19 nt, Homo sapiens
aaaauuaugugccagugaa

SEQ ID NO: 455696 - RNA, 19 nt, Homo sapiens
uucaagaccuuagauuaga

SEQ ID NO: 455697 - RNA, 19 nt, Homo sapiens
aguccagaaucaacaguuu

SEQ ID NO: 455698 - RNA, 19 nt, Homo sapiens
gcucgggccagcuguaguu

SEQ ID NO: 455699 - RNA, 19 nt, Homo sapiens
guacuaaaaugccccaaag

SEQ ID NO: 455700 - RNA, 19 nt, Homo sapiens
ucauaguagugauggaaug

SEQ ID NO: 455701 - RNA, 19 nt, Homo sapiens
ugagaaggaaguugugguu

SEQ ID NO: 455702 - RNA, 19 nt, Homo sapiens
gaaucaacaguuucagauc

SEQ ID NO: 455703 - RNA, 19 nt, Homo sapiens
cagcauuuccuuuauagca

SEQ ID NO: 455704 - RNA, 19 nt, Homo sapiens
uacagcauuuccuuuauag

SEQ ID NO: 455705 - RNA, 19 nt, Homo sapiens
cagaaucaacaguuucaga

SEQ ID NO: 455706 - RNA, 19 nt, Homo sapiens
caacccagaaugugacugu

SEQ ID NO: 455707 - RNA, 19 nt, Homo sapiens
gcauuuauggcuggagaaa

SEQ ID NO: 455708 - RNA, 19 nt, Homo sapiens
cacauccucccuucaguuu

SEQ ID NO: 455709 - RNA, 19 nt, Homo sapiens
ugcugaaacugugugcuua

SEQ ID NO: 455710 - RNA, 19 nt, Homo sapiens
ggaauuugagguugaucug

SEQ ID NO: 455711 - RNA, 19 nt, Homo sapiens
agauaaacuucgaguaacu

SEQ ID NO: 455712 - RNA, 19 nt, Homo sapiens
guacacuacagccacagaa

SEQ ID NO: 455713 - RNA, 19 nt, Homo sapiens
gaggucacaggcagguuaa

SEQ ID NO: 455714 - RNA, 19 nt, Homo sapiens
gcaggaaugggccacuugu

SEQ ID NO: 455715 - RNA, 19 nt, Homo sapiens
ucacauccucccuucaguu

SEQ ID NO: 455716 - RNA, 19 nt, Homo sapiens
gaguagccuugcucaguac

SEQ ID NO: 455717 - RNA, 19 nt, Homo sapiens
caguaugucuacaaaauug

SEQ ID NO: 455718 - RNA, 19 nt, Homo sapiens
ggauaucuaaugcccuguu

SEQ ID NO: 455719 - RNA, 19 nt, Homo sapiens
gagccucuacgaaaucugu

SEQ ID NO: 455720 - RNA, 19 nt, Homo sapiens
ucgaguaacugggccugaa

SEQ ID NO: 455721 - RNA, 19 nt, Homo sapiens
aaacauucugucuguggua

SEQ ID NO: 455722 - RNA, 19 nt, Homo sapiens
gcagcugcacaucgugaaa

SEQ ID NO: 455723 - RNA, 19 nt, Homo sapiens
gaggcgcuuucucaaaugg

SEQ ID NO: 455724 - RNA, 19 nt, Homo sapiens
caacgacggcaagccacua

SEQ ID NO: 455725 - RNA, 19 nt, Homo sapiens
guagaaguccagaaucaac

SEQ ID NO: 455726 - RNA, 19 nt, Homo sapiens
gcucucauucuguaaguca

SEQ ID NO: 455727 - RNA, 19 nt, Homo sapiens
ccagugugcuuuucuuaau

SEQ ID NO: 455728 - RNA, 19 nt, Homo sapiens
cuacgaaaucugugugugu

SEQ ID NO: 455729 - RNA, 19 nt, Homo sapiens
uacaaucaacccagaaugu

SEQ ID NO: 455730 - RNA, 19 nt, Homo sapiens
cagcaggaaugggccacuu

SEQ ID NO: 455731 - RNA, 19 nt, Homo sapiens
guaagucagguuucacaag

SEQ ID NO: 455732 - RNA, 19 nt, Homo sapiens
cguguggaguuaauguaug

SEQ ID NO: 455733 - RNA, 19 nt, Homo sapiens
auggaaugcuugugcuuga

SEQ ID NO: 455734 - RNA, 19 nt, Homo sapiens
gauaaacuucgaguaacug

SEQ ID NO: 455735 - RNA, 19 nt, Homo sapiens
uagaugagaaggaaguugu

SEQ ID NO: 455736 - RNA, 19 nt, Homo sapiens
gccacuauuuacuguagau

SEQ ID NO: 455737 - RNA, 19 nt, Homo sapiens
aagccacuauuuacuguag

SEQ ID NO: 455738 - RNA, 19 nt, Homo sapiens
gguagaaguccagaaucaa

SEQ ID NO: 455739 - RNA, 19 nt, Homo sapiens
uaguagugauggaaugcuu

SEQ ID NO: 455740 - RNA, 19 nt, Homo sapiens
uuucaagaccuuagauuag

SEQ ID NO: 455741 - RNA, 19 nt, Homo sapiens
gcacaucucuggaagcuua

SEQ ID NO: 455742 - RNA, 19 nt, Homo sapiens
gaagaaagcaauccugaaa

SEQ ID NO: 455743 - RNA, 19 nt, Homo sapiens
cagcugaaaccaaauauua

SEQ ID NO: 455744 - RNA, 19 nt, Homo sapiens
aaacacagcugaaauguac

SEQ ID NO: 455745 - RNA, 19 nt, Homo sapiens
gaaguucaguccaucuuga

SEQ ID NO: 455746 - RNA, 19 nt, Homo sapiens
ggacauuguuuguuucuuc

SEQ ID NO: 455747 - RNA, 19 nt, Homo sapiens
ucagugagcucaugagguu

SEQ ID NO: 455748 - RNA, 19 nt, Homo sapiens
gaaauggucuugcaaugac

SEQ ID NO: 455749 - RNA, 19 nt, Homo sapiens
uaaagaacgucuguacauu

SEQ ID NO: 455750 - RNA, 19 nt, Homo sapiens
guauucagaugcuuaaaga

SEQ ID NO: 455751 - RNA, 19 nt, Homo sapiens
ccagacugcugacaaauug

SEQ ID NO: 455752 - RNA, 19 nt, Homo sapiens
gaaacacagcugaaaugua

SEQ ID NO: 455753 - RNA, 19 nt, Homo sapiens
ggagcugucuuguaugaga

SEQ ID NO: 455754 - RNA, 19 nt, Homo sapiens
gcugugaugacgaauauua

SEQ ID NO: 455755 - RNA, 19 nt, Homo sapiens
gaacacaacagcacaacau

SEQ ID NO: 455756 - RNA, 19 nt, Homo sapiens
guuauaagcaucaauguga

SEQ ID NO: 455757 - RNA, 19 nt, Homo sapiens
guacaauccuucccucauc

SEQ ID NO: 455758 - RNA, 19 nt, Homo sapiens
ccugggagcugucuuguau

SEQ ID NO: 455759 - RNA, 19 nt, Homo sapiens
gggcugugaugacgaauau

SEQ ID NO: 455760 - RNA, 19 nt, Homo sapiens
ggaggcaggaguuucguua

SEQ ID NO: 455761 - RNA, 19 nt, Homo sapiens
caagagaauuugcacaucu

SEQ ID NO: 455762 - RNA, 19 nt, Homo sapiens
gccaauaacuccuaugcau

SEQ ID NO: 455763 - RNA, 19 nt, Homo sapiens
gcaaugacucguauucaga

SEQ ID NO: 455764 - RNA, 19 nt, Homo sapiens
gcaaggagaacauugaaca

SEQ ID NO: 455765 - RNA, 19 nt, Homo sapiens
caucguuuauagagacuua

SEQ ID NO: 455766 - RNA, 19 nt, Homo sapiens
ggagcggaauguucuguug

SEQ ID NO: 455767 - RNA, 19 nt, Homo sapiens
cgugggacauuguuuguuu

SEQ ID NO: 455768 - RNA, 19 nt, Homo sapiens
gaacgacuuuauucagaag

SEQ ID NO: 455769 - RNA, 19 nt, Homo sapiens
ucauggagauuaagaguca

SEQ ID NO: 455770 - RNA, 19 nt, Homo sapiens
uaacuccuaugcaugcaaa

SEQ ID NO: 455771 - RNA, 19 nt, Homo sapiens
ggaugggucugaacgacuu

SEQ ID NO: 455772 - RNA, 19 nt, Homo sapiens
cagcugacaggacaucuua

SEQ ID NO: 455773 - RNA, 19 nt, Homo sapiens
cagcugaaauguacgacaa

SEQ ID NO: 455774 - RNA, 19 nt, Homo sapiens
ucacugaacaucguuuaua

SEQ ID NO: 455775 - RNA, 19 nt, Homo sapiens
aaagaggagaagcauauua

SEQ ID NO: 455776 - RNA, 19 nt, Homo sapiens
agaaagaggagaagcauau

SEQ ID NO: 455777 - RNA, 19 nt, Homo sapiens
gaucacagauggauuuugu

SEQ ID NO: 455778 - RNA, 19 nt, Homo sapiens
uguaugagaugcuguaugg

SEQ ID NO: 455779 - RNA, 19 nt, Homo sapiens
aaacuuacaggcuuauuug

SEQ ID NO: 455780 - RNA, 19 nt, Homo sapiens
gcauugcugcuacaaauau

SEQ ID NO: 455781 - RNA, 19 nt, Homo sapiens
uggcaauucucaucgcuuu

SEQ ID NO: 455782 - RNA, 19 nt, Homo sapiens
ggagaacauugaacacaac

SEQ ID NO: 455783 - RNA, 19 nt, Homo sapiens
gaaagaggagaagcauauu

SEQ ID NO: 455784 - RNA, 19 nt, Homo sapiens
gaaguguucuaugcaguca

SEQ ID NO: 455785 - RNA, 19 nt, Homo sapiens
ggaaagguucuucuagcaa

SEQ ID NO: 455786 - RNA, 19 nt, Homo sapiens
ccaaguccuucucagcaaa

SEQ ID NO: 455787 - RNA, 19 nt, Homo sapiens
gcguuagagugccgccuua

SEQ ID NO: 455788 - RNA, 19 nt, Homo sapiens
uuaauuaacugggaugauc

SEQ ID NO: 455789 - RNA, 19 nt, Homo sapiens
uuugagcgcuaacgucuuu

SEQ ID NO: 455790 - RNA, 19 nt, Homo sapiens
ggcaggaguuucguuagaa

SEQ ID NO: 455791 - RNA, 19 nt, Homo sapiens
ggucugaacgacuuuauuc

SEQ ID NO: 455792 - RNA, 19 nt, Homo sapiens
aaagaacgucuguacauug

SEQ ID NO: 455793 - RNA, 19 nt, Homo sapiens
caacgugggacauuguuug

SEQ ID NO: 455794 - RNA, 19 nt, Homo sapiens
ugggagcugucuuguauga

SEQ ID NO: 455795 - RNA, 19 nt, Homo sapiens
guccuagacuacauuaaug

SEQ ID NO: 455796 - RNA, 19 nt, Homo sapiens
caucugacuuucacuucuu

SEQ ID NO: 455797 - RNA, 19 nt, Homo sapiens
ugaaauggucuugcaauga

SEQ ID NO: 455798 - RNA, 19 nt, Homo sapiens
gagauuguguuagcuccaa

SEQ ID NO: 455799 - RNA, 19 nt, Homo sapiens
acuguucgcuggaagcuuu

SEQ ID NO: 455800 - RNA, 19 nt, Homo sapiens
cacggacucuuuccucuga

SEQ ID NO: 455801 - RNA, 19 nt, Homo sapiens
ucacuucucuuuccagacu

SEQ ID NO: 455802 - RNA, 19 nt, Homo sapiens
uguauggccugccgccuuu

SEQ ID NO: 455803 - RNA, 19 nt, Homo sapiens
cauuaaugguggagaguug

SEQ ID NO: 455804 - RNA, 19 nt, Homo sapiens
acacaaggcagaagaagug

SEQ ID NO: 455805 - RNA, 19 nt, Homo sapiens
gcuaaaccaucugacuuuc

SEQ ID NO: 455806 - RNA, 19 nt, Homo sapiens
gucuucuucuccuuaauua

SEQ ID NO: 455807 - RNA, 19 nt, Homo sapiens
ggaaagggcaguuuuggaa

SEQ ID NO: 455808 - RNA, 19 nt, Homo sapiens
guccaauccucaugcuaaa

SEQ ID NO: 455809 - RNA, 19 nt, Homo sapiens
gcaauucucaucgcuuuca

SEQ ID NO: 455810 - RNA, 19 nt, Homo sapiens
guacuguaauuaacauggu

SEQ ID NO: 455811 - RNA, 19 nt, Homo sapiens
caugucuucuucuccuuaa

SEQ ID NO: 455812 - RNA, 19 nt, Homo sapiens
gagaguuguucuaccaucu

SEQ ID NO: 455813 - RNA, 19 nt, Homo sapiens
uauuacaaauuccgcaaga

SEQ ID NO: 455814 - RNA, 19 nt, Homo sapiens
cguccaauccucaugcuaa

SEQ ID NO: 455815 - RNA, 19 nt, Homo sapiens
guauaaagaacgucuguac

SEQ ID NO: 455816 - RNA, 19 nt, Homo sapiens
ccugaucacagauggauuu

SEQ ID NO: 455817 - RNA, 19 nt, Homo sapiens
gugaugacgaauauuauga

SEQ ID NO: 455818 - RNA, 19 nt, Homo sapiens
gagauuaagagucaugucu

SEQ ID NO: 455819 - RNA, 19 nt, Homo sapiens
ugaacaucguuuauagaga

SEQ ID NO: 455820 - RNA, 19 nt, Homo sapiens
cacugaacaucguuuauag

SEQ ID NO: 455821 - RNA, 19 nt, Homo sapiens
guggagaguuguucuacca

SEQ ID NO: 455822 - RNA, 19 nt, Homo sapiens
caaggcagaagaaguguuc

SEQ ID NO: 455823 - RNA, 19 nt, Homo sapiens
caagacacaaggcagaaga

SEQ ID NO: 455824 - RNA, 19 nt, Homo sapiens
ggucuugcaaugacucgua

SEQ ID NO: 455825 - RNA, 19 nt, Homo sapiens
cgacuuuauucagaagauu

SEQ ID NO: 455826 - RNA, 19 nt, Homo sapiens
gcaguguuucaguucuuua

SEQ ID NO: 455827 - RNA, 19 nt, Homo sapiens
ggugcuaucucugaaacga

SEQ ID NO: 455828 - RNA, 19 nt, Homo sapiens
ucuggaagcuuagcaaucu

SEQ ID NO: 455829 - RNA, 19 nt, Homo sapiens
gcugaaaccaaauauuaca

SEQ ID NO: 455830 - RNA, 19 nt, Homo sapiens
gagcggaauguucuguuga

SEQ ID NO: 455831 - RNA, 19 nt, Homo sapiens
caucccaucacacaacuuu

SEQ ID NO: 455832 - RNA, 19 nt, Homo sapiens
aagaacgucuguacauugg

SEQ ID NO: 455833 - RNA, 19 nt, Homo sapiens
acaagccucuccagcugaa

SEQ ID NO: 455834 - RNA, 19 nt, Homo sapiens
ccgaaacacagcugaaaug

SEQ ID NO: 455835 - RNA, 19 nt, Homo sapiens
aggagaacauugaacacaa

SEQ ID NO: 455836 - RNA, 19 nt, Homo sapiens
agccugagcuuaugaaugc

SEQ ID NO: 455837 - RNA, 19 nt, Homo sapiens
aagaggagaagcauauuau

SEQ ID NO: 455838 - RNA, 19 nt, Homo sapiens
agucagagccguugguguu

SEQ ID NO: 455839 - RNA, 19 nt, Homo sapiens
gaagcuuagcaaucuuauu

SEQ ID NO: 455840 - RNA, 19 nt, Homo sapiens
cgacaacauucugaacaag

SEQ ID NO: 455841 - RNA, 19 nt, Homo sapiens
guagaaagcugucauuuga

SEQ ID NO: 455842 - RNA, 19 nt, Homo sapiens
gaugauggaugucuagaaa

SEQ ID NO: 455843 - RNA, 19 nt, Homo sapiens
caaagcagcuguauguaga

SEQ ID NO: 455844 - RNA, 19 nt, Homo sapiens
ccaaaucccuguccuguug

SEQ ID NO: 455845 - RNA, 19 nt, Homo sapiens
ucagauuucuugcaguuua

SEQ ID NO: 455846 - RNA, 19 nt, Homo sapiens
ggaggagugucaauccaua

SEQ ID NO: 455847 - RNA, 19 nt, Homo sapiens
guauguagauaguguauug

SEQ ID NO: 455848 - RNA, 19 nt, Homo sapiens
aaacccacauuaccuguua

SEQ ID NO: 455849 - RNA, 19 nt, Homo sapiens
ggacagagacuggauaaug

SEQ ID NO: 455850 - RNA, 19 nt, Homo sapiens
aggaggagcugacacauuu

SEQ ID NO: 455851 - RNA, 19 nt, Homo sapiens
gacagagacuggauaaugu

SEQ ID NO: 455852 - RNA, 19 nt, Homo sapiens
agaaagcugucauuugauu

SEQ ID NO: 455853 - RNA, 19 nt, Homo sapiens
gcucagauuucuugcaguu

SEQ ID NO: 455854 - RNA, 19 nt, Homo sapiens
ggaacaagaaacuccuuua

SEQ ID NO: 455855 - RNA, 19 nt, Homo sapiens
aaagaaggcuguacucaag

SEQ ID NO: 455856 - RNA, 19 nt, Homo sapiens
acaagaaacuccuuuacga

SEQ ID NO: 455857 - RNA, 19 nt, Homo sapiens
ucacuuggcugcgucuuaa

SEQ ID NO: 455858 - RNA, 19 nt, Homo sapiens
guaaagagaagaugcuaga

SEQ ID NO: 455859 - RNA, 19 nt, Homo sapiens
aaugacagcauguuucuua

SEQ ID NO: 455860 - RNA, 19 nt, Homo sapiens
guaaauggagucccuguga

SEQ ID NO: 455861 - RNA, 19 nt, Homo sapiens
ugucugagguuguacuauu

SEQ ID NO: 455862 - RNA, 19 nt, Homo sapiens
gagacuggauaauguuguu

SEQ ID NO: 455863 - RNA, 19 nt, Homo sapiens
uaaauggagucccugugaa

SEQ ID NO: 455864 - RNA, 19 nt, Homo sapiens
gaacaagaaacuccuuuac

SEQ ID NO: 455865 - RNA, 19 nt, Homo sapiens
gaaacuccuuuacgagaag

SEQ ID NO: 455866 - RNA, 19 nt, Homo sapiens
gagugucaauccauaucua

SEQ ID NO: 455867 - RNA, 19 nt, Homo sapiens
uggauaauguuguugcaaa

SEQ ID NO: 455868 - RNA, 19 nt, Homo sapiens
uaaagaaggcuguacucaa

SEQ ID NO: 455869 - RNA, 19 nt, Homo sapiens
gaaagcugucauuugauuu

SEQ ID NO: 455870 - RNA, 19 nt, Homo sapiens
gagaagaugcuagacgaaa

SEQ ID NO: 455871 - RNA, 19 nt, Homo sapiens
gcaccagcaucucuuugau

SEQ ID NO: 455872 - RNA, 19 nt, Homo sapiens
gcauuguuauacaccagua

SEQ ID NO: 455873 - RNA, 19 nt, Homo sapiens
cagauuucuugcaguuuaa

SEQ ID NO: 455874 - RNA, 19 nt, Homo sapiens
agaaacuccuuuacgagaa

SEQ ID NO: 455875 - RNA, 19 nt, Homo sapiens
gaaucugcaaugaucauaa

SEQ ID NO: 455876 - RNA, 19 nt, Homo sapiens
gaggaggagcugacacauu

SEQ ID NO: 455877 - RNA, 19 nt, Homo sapiens
gcagcuguauguagauagu

SEQ ID NO: 455878 - RNA, 19 nt, Homo sapiens
uggcuuaugugcacgugua

SEQ ID NO: 455879 - RNA, 19 nt, Homo sapiens
ggauaauguuguugcaaag

SEQ ID NO: 455880 - RNA, 19 nt, Homo sapiens
ugacaauggucuccaggau

SEQ ID NO: 455881 - RNA, 19 nt, Homo sapiens
ggagacaacauuccuaagg

SEQ ID NO: 455882 - RNA, 19 nt, Homo sapiens
caauccauaucuacaagga

SEQ ID NO: 455883 - RNA, 19 nt, Homo sapiens
ggccaagucuguagaaagc

SEQ ID NO: 455884 - RNA, 19 nt, Homo sapiens
aaaugugaaucugcaauga

SEQ ID NO: 455885 - RNA, 19 nt, Homo sapiens
gcaaguggaacaagaaacu

SEQ ID NO: 455886 - RNA, 19 nt, Homo sapiens
guuauacaccaguaaagaa

SEQ ID NO: 455887 - RNA, 19 nt, Homo sapiens
aagcagcuguauguagaua

SEQ ID NO: 455888 - RNA, 19 nt, Homo sapiens
gaugaagggaggagagaga

SEQ ID NO: 455889 - RNA, 19 nt, Homo sapiens
gaagguggagcucaugaag

SEQ ID NO: 455890 - RNA, 19 nt, Homo sapiens
guaaagaaggcuguacuca

SEQ ID NO: 455891 - RNA, 19 nt, Homo sapiens
gucugagguuguacuauuu

SEQ ID NO: 455892 - RNA, 19 nt, Homo sapiens
caaggacagagacuggaua

SEQ ID NO: 455893 - RNA, 19 nt, Homo sapiens
caugcuaucuggccuacug

SEQ ID NO: 455894 - RNA, 19 nt, Homo sapiens
gagcugacacauuucacuu

SEQ ID NO: 455895 - RNA, 19 nt, Homo sapiens
uagauaguguauugucuuc

SEQ ID NO: 455896 - RNA, 19 nt, Homo sapiens
guagauaguguauugucuu

SEQ ID NO: 455897 - RNA, 19 nt, Homo sapiens
cgaaagcggaggaguguca

SEQ ID NO: 455898 - RNA, 19 nt, Homo sapiens
gauaguguauugucuucac

SEQ ID NO: 455899 - RNA, 19 nt, Homo sapiens
aauggugucugagguugua

SEQ ID NO: 455900 - RNA, 19 nt, Homo sapiens
gauaauguuguugcaaaga

SEQ ID NO: 455901 - RNA, 19 nt, Homo sapiens
agaguucagucgagaguuc

SEQ ID NO: 455902 - RNA, 19 nt, Homo sapiens
agguggagcucaugaagga

SEQ ID NO: 455903 - RNA, 19 nt, Homo sapiens
gcuaucuggccuacuguuu

SEQ ID NO: 455904 - RNA, 19 nt, Homo sapiens
uguagaaagcugucauuug

SEQ ID NO: 455905 - RNA, 19 nt, Homo sapiens
gauccagaguaaagagaag

SEQ ID NO: 455906 - RNA, 19 nt, Homo sapiens
gauaaggauccagaguaaa

SEQ ID NO: 455907 - RNA, 19 nt, Homo sapiens
guacccagacccuccaaau

SEQ ID NO: 455908 - RNA, 19 nt, Homo sapiens
acaaagcagcuguauguag

SEQ ID NO: 455909 - RNA, 19 nt, Homo sapiens
gaggagcugacacauuuca

SEQ ID NO: 455910 - RNA, 19 nt, Homo sapiens
gacgaaagcggaggagugu

SEQ ID NO: 455911 - RNA, 19 nt, Homo sapiens
caccaggccaugaaucuug

SEQ ID NO: 455912 - RNA, 19 nt, Homo sapiens
gggcaaguggaacaagaaa

SEQ ID NO: 455913 - RNA, 19 nt, Homo sapiens
ccaacaucguggcagaguu

SEQ ID NO: 455914 - RNA, 19 nt, Homo sapiens
cuaugaaaggcucagauuu

SEQ ID NO: 455915 - RNA, 19 nt, Homo sapiens
aaagcaagacuaugaaagg

SEQ ID NO: 455916 - RNA, 19 nt, Homo sapiens
gugaaugacagcauguuuc

SEQ ID NO: 455917 - RNA, 19 nt, Homo sapiens
gaguaaagagaagaugcua

SEQ ID NO: 455918 - RNA, 19 nt, Homo sapiens
ggauccagaguaaagagaa

SEQ ID NO: 455919 - RNA, 19 nt, Homo sapiens
gcagaguucagucgagagu

SEQ ID NO: 455920 - RNA, 19 nt, Homo sapiens
ggcugcgucuuaauaaaca

SEQ ID NO: 455921 - RNA, 19 nt, Homo sapiens
auaaggauccagaguaaag

SEQ ID NO: 455922 - RNA, 19 nt, Homo sapiens
uaauguuguugcaaagaag

SEQ ID NO: 455923 - RNA, 19 nt, Homo sapiens
ggucucagaagcagauauc

SEQ ID NO: 455924 - RNA, 19 nt, Homo sapiens
gucaauccauaucuacaag

SEQ ID NO: 455925 - RNA, 19 nt, Homo sapiens
gaggagugucaauccauau

SEQ ID NO: 455926 - RNA, 19 nt, Homo sapiens
ucuuugauccggaacauga

SEQ ID NO: 455927 - RNA, 19 nt, Homo sapiens
uaaggacuuuagugaggau

SEQ ID NO: 455928 - RNA, 19 nt, Homo sapiens
acaccgaugauucugcuuu

SEQ ID NO: 455929 - RNA, 19 nt, Homo sapiens
ugaaugacagcauguuucu

SEQ ID NO: 455930 - RNA, 19 nt, Homo sapiens
gcggaggagugucaaucca

SEQ ID NO: 455931 - RNA, 19 nt, Homo sapiens
gaggcugcuucaugguguu

SEQ ID NO: 455932 - RNA, 19 nt, Homo sapiens
agaagaugcuagacgaaaa

SEQ ID NO: 455933 - RNA, 19 nt, Homo sapiens
gucgagaguuccaguugca

SEQ ID NO: 455934 - RNA, 19 nt, Homo sapiens
agaaggcuguacucaagag

SEQ ID NO: 455935 - RNA, 19 nt, Homo sapiens
cauugaagguggagcucau

SEQ ID NO: 455936 - RNA, 19 nt, Homo sapiens
aaauggagucccugugaau

SEQ ID NO: 455937 - RNA, 19 nt, Homo sapiens
cagcucaccaggccaugaa

SEQ ID NO: 455938 - RNA, 19 nt, Homo sapiens
aacagaugauggaugucua

SEQ ID NO: 455939 - RNA, 19 nt, Homo sapiens
gcugcuucaugguguuaug

SEQ ID NO: 455940 - RNA, 19 nt, Homo sapiens
acagagacuggauaauguu

SEQ ID NO: 455941 - RNA, 19 nt, Homo sapiens
gaacaucacuagaauuaag

SEQ ID NO: 455942 - RNA, 19 nt, Homo sapiens
acaaggaccuccgucauua

SEQ ID NO: 455943 - RNA, 19 nt, Homo sapiens
gggcacugcugaacccuua

SEQ ID NO: 455944 - RNA, 19 nt, Homo sapiens
cggaacaucacuagaauua

SEQ ID NO: 455945 - RNA, 19 nt, Homo sapiens
ggagagggcgcuuccuuga

SEQ ID NO: 455946 - RNA, 19 nt, Homo sapiens
gcuugaaccugugguguuu

SEQ ID NO: 455947 - RNA, 19 nt, Homo sapiens
ccacaggccagcuauugua

SEQ ID NO: 455948 - RNA, 19 nt, Homo sapiens
gcacgggaauucuagacau

SEQ ID NO: 455949 - RNA, 19 nt, Homo sapiens
gagaguguccgaagaugaa

SEQ ID NO: 455950 - RNA, 19 nt, Homo sapiens
uggcuuggguuaauucuug

SEQ ID NO: 455951 - RNA, 19 nt, Homo sapiens
gggcggaacaucacuagaa

SEQ ID NO: 455952 - RNA, 19 nt, Homo sapiens
cacgggaauucuagacaua

SEQ ID NO: 455953 - RNA, 19 nt, Homo sapiens
ggaccuccgucauuacuac

SEQ ID NO: 455954 - RNA, 19 nt, Homo sapiens
uggcuuggguuaauucuuc

SEQ ID NO: 455955 - RNA, 19 nt, Homo sapiens
uggcuuggguuaauucuuc

SEQ ID NO: 455956 - RNA, 19 nt, Homo sapiens
uggcuuggguuaauucuuc

SEQ ID NO: 455957 - RNA, 19 nt, Homo sapiens
uacggaaccuucugugaga

SEQ ID NO: 455958 - RNA, 19 nt, Homo sapiens
uggacgugcuggugccuua

SEQ ID NO: 455959 - RNA, 19 nt, Homo sapiens
ggcggaacaucacuagaau

SEQ ID NO: 455960 - RNA, 19 nt, Homo sapiens
gagaguggcgcguacaaca

SEQ ID NO: 455961 - RNA, 19 nt, Homo sapiens
gagggcgcuuccuugagua

SEQ ID NO: 455962 - RNA, 19 nt, Homo sapiens
agagggcgcuuccuugagu

SEQ ID NO: 455963 - RNA, 19 nt, Homo sapiens
uggguuaauucuuggauga

SEQ ID NO: 455964 - RNA, 19 nt, Homo sapiens
caaccucaacuucaagaug

SEQ ID NO: 455965 - RNA, 19 nt, Homo sapiens
gaacgacacacuggugauc

SEQ ID NO: 455966 - RNA, 19 nt, Homo sapiens
ggaacaucacuagaauuaa

SEQ ID NO: 455967 - RNA, 19 nt, Homo sapiens
ugacggaggcuuugagagu

SEQ ID NO: 455968 - RNA, 19 nt, Homo sapiens
caguuguccuugugucuga

SEQ ID NO: 455969 - RNA, 19 nt, Homo sapiens
uacaaggaccuccgucauu

SEQ ID NO: 455970 - RNA, 19 nt, Homo sapiens
ggagaccguguacccguuu

SEQ ID NO: 455971 - RNA, 19 nt, Homo sapiens
gugcacaaccucaacuuca

SEQ ID NO: 455972 - RNA, 19 nt, Homo sapiens
ccucugggccaccgucuuu

SEQ ID NO: 455973 - RNA, 19 nt, Homo sapiens
gggcagaagcuuaucuuuu

SEQ ID NO: 455974 - RNA, 19 nt, Homo sapiens
gaugacggaggcuuugaga

SEQ ID NO: 455975 - RNA, 19 nt, Homo sapiens
guacaaggaccuccgucau

SEQ ID NO: 455976 - RNA, 19 nt, Homo sapiens
gcacaaccucaacuucaag

SEQ ID NO: 455977 - RNA, 19 nt, Homo sapiens
gagagcggcaugggucgua

SEQ ID NO: 455978 - RNA, 19 nt, Homo sapiens
uugcucagcuucuggagau

SEQ ID NO: 455979 - RNA, 19 nt, Homo sapiens
ccgcauggaccaaggaguu

SEQ ID NO: 455980 - RNA, 19 nt, Homo sapiens
gguuucugcuucuucuguu

SEQ ID NO: 455981 - RNA, 19 nt, Homo sapiens
ggacgugcaccacuucaac

SEQ ID NO: 455982 - RNA, 19 nt, Homo sapiens
ccuugugucugaaccaugu

SEQ ID NO: 455983 - RNA, 19 nt, Homo sapiens
ugcacaaccucaacuucaa

SEQ ID NO: 455984 - RNA, 19 nt, Homo sapiens
ccucuggcuuggguuaauu

SEQ ID NO: 455985 - RNA, 19 nt, Homo sapiens
ccucuggcuuggguuaauu

SEQ ID NO: 455986 - RNA, 19 nt, Homo sapiens
ccucuggcuuggguuaauu

SEQ ID NO: 455987 - RNA, 19 nt, Homo sapiens
cguguacccguuugacuuu

SEQ ID NO: 455988 - RNA, 19 nt, Homo sapiens
ccucuggcuuggguuaauu

SEQ ID NO: 455989 - RNA, 19 nt, Homo sapiens
cguccacacucccauccaa

SEQ ID NO: 455990 - RNA, 19 nt, Homo sapiens
gcgcuuugcucagcuucug

SEQ ID NO: 455991 - RNA, 19 nt, Homo sapiens
ugagaguguccgaagauga

SEQ ID NO: 455992 - RNA, 19 nt, Homo sapiens
gagaccguguacccguuug

SEQ ID NO: 455993 - RNA, 19 nt, Homo sapiens
gaucuucacguccgacaac

SEQ ID NO: 455994 - RNA, 19 nt, Homo sapiens
caggccagcuauuguaaaa

SEQ ID NO: 455995 - RNA, 19 nt, Homo sapiens
gggagaaugugccguuccu

SEQ ID NO: 455996 - RNA, 19 nt, Homo sapiens
guuucugcuucuucuguuu

SEQ ID NO: 455997 - RNA, 19 nt, Homo sapiens
gcggaacaucacuagaauu

SEQ ID NO: 455998 - RNA, 19 nt, Homo sapiens
cacaggccagcuauuguaa

SEQ ID NO: 455999 - RNA, 19 nt, Homo sapiens
cggcguugcugggagaaug

SEQ ID NO: 456000 - RNA, 19 nt, Homo sapiens
gguuaauucuucggugaca

SEQ ID NO: 456001 - RNA, 19 nt, Homo sapiens
gguuaauucuucggugaca

SEQ ID NO: 456002 - RNA, 19 nt, Homo sapiens
gguuaauucuucggugaca

SEQ ID NO: 456003 - RNA, 19 nt, Homo sapiens
caacuucaagaugcccuuu

SEQ ID NO: 456004 - RNA, 19 nt, Homo sapiens
ugacgccgguguccugaac

SEQ ID NO: 456005 - RNA, 19 nt, Homo sapiens
ccugagugaugagcuugaa

SEQ ID NO: 456006 - RNA, 19 nt, Homo sapiens
gcagguuucagcugauugg

SEQ ID NO: 456007 - RNA, 19 nt, Homo sapiens
gagcaugugaccagagcau

SEQ ID NO: 456008 - RNA, 19 nt, Homo sapiens
ccaucgaccaggacuucua

SEQ ID NO: 456009 - RNA, 19 nt, Homo sapiens
ggaugaccggccuuucuuc

SEQ ID NO: 456010 - RNA, 19 nt, Homo sapiens
gaacaacccuggcuucaug

SEQ ID NO: 456011 - RNA, 19 nt, Homo sapiens
gagcauggcuucgaaccua

SEQ ID NO: 456012 - RNA, 19 nt, Homo sapiens
gaaggcagcugggccguuu

SEQ ID NO: 456013 - RNA, 19 nt, Homo sapiens
gaaacgagcagaugaaagu

SEQ ID NO: 456014 - RNA, 19 nt, Homo sapiens
ucagagaaguggcagguuu

SEQ ID NO: 456015 - RNA, 19 nt, Homo sapiens
gaaggaaacgagcagauga

SEQ ID NO: 456016 - RNA, 19 nt, Homo sapiens
ccagaaagcucggucacuu

SEQ ID NO: 456017 - RNA, 19 nt, Homo sapiens
ggaccugcaugucaagaug

SEQ ID NO: 456018 - RNA, 19 nt, Homo sapiens
gcagaacccagaguugaua

SEQ ID NO: 456019 - RNA, 19 nt, Homo sapiens
ggaacucucccgucuguga

SEQ ID NO: 456020 - RNA, 19 nt, Homo sapiens
gaauaaauaggcguuguga

SEQ ID NO: 456021 - RNA, 19 nt, Homo sapiens
caggaacucucccgucugu

SEQ ID NO: 456022 - RNA, 19 nt, Homo sapiens
caaguccaaccucaagaua

SEQ ID NO: 456023 - RNA, 19 nt, Homo sapiens
ggccguggcuuacuacaag

SEQ ID NO: 456024 - RNA, 19 nt, Homo sapiens
cuucgaaccuaaugaacaa

SEQ ID NO: 456025 - RNA, 19 nt, Homo sapiens
gaaaagccaucgagcucaa

SEQ ID NO: 456026 - RNA, 19 nt, Homo sapiens
cagccaacgccgucuauuu

SEQ ID NO: 456027 - RNA, 19 nt, Homo sapiens
ccacccaccuuggcccuaa

SEQ ID NO: 456028 - RNA, 19 nt, Homo sapiens
acagcaaacucggcaacua

SEQ ID NO: 456029 - RNA, 19 nt, Homo sapiens
ggaauaaauaggcguugug

SEQ ID NO: 456030 - RNA, 19 nt, Homo sapiens
gggaauaaauaggcguugu

SEQ ID NO: 456031 - RNA, 19 nt, Homo sapiens
gcauaggaccaguuucugu

SEQ ID NO: 456032 - RNA, 19 nt, Homo sapiens
ccucggaccugcaugucaa

SEQ ID NO: 456033 - RNA, 19 nt, Homo sapiens
cagcagaacccagaguuga

SEQ ID NO: 456034 - RNA, 19 nt, Homo sapiens
caagauagcggagcugaag

SEQ ID NO: 456035 - RNA, 19 nt, Homo sapiens
gagccguccugggugcaua

SEQ ID NO: 456036 - RNA, 19 nt, Homo sapiens
cuucugggcucaagaugga

SEQ ID NO: 456037 - RNA, 19 nt, Homo sapiens
caagauggacaacaagaag

SEQ ID NO: 456038 - RNA, 19 nt, Homo sapiens
agaaagcucggucacuuga

SEQ ID NO: 456039 - RNA, 19 nt, Homo sapiens
aagcugccgugcauuucua

SEQ ID NO: 456040 - RNA, 19 nt, Homo sapiens
gguagaagacagugaccuu

SEQ ID NO: 456041 - RNA, 19 nt, Homo sapiens
gaccaguuucugugacuuu

SEQ ID NO: 456042 - RNA, 19 nt, Homo sapiens
gcagcagaacccagaguug

SEQ ID NO: 456043 - RNA, 19 nt, Homo sapiens
uggaggccguggcuuacua

SEQ ID NO: 456044 - RNA, 19 nt, Homo sapiens
ggcucaagauggacaacaa

SEQ ID NO: 456045 - RNA, 19 nt, Homo sapiens
aaagcucggucacuugagu

SEQ ID NO: 456046 - RNA, 19 nt, Homo sapiens
gcaguuugcccagcagaug

SEQ ID NO: 456047 - RNA, 19 nt, Homo sapiens
gcagcugggccguuucugu

SEQ ID NO: 456048 - RNA, 19 nt, Homo sapiens
ggaccaguuucugugacuu

SEQ ID NO: 456049 - RNA, 19 nt, Homo sapiens
gauggauuuuccccuuuua

SEQ ID NO: 456050 - RNA, 19 nt, Homo sapiens
ucaagauggacaacaagaa

SEQ ID NO: 456051 - RNA, 19 nt, Homo sapiens
gagcagaugaaaguggaaa

SEQ ID NO: 456052 - RNA, 19 nt, Homo sapiens
cgcaguaccguguaucgua

SEQ ID NO: 456053 - RNA, 19 nt, Homo sapiens
uaaaacagccaccaggaaa

SEQ ID NO: 456054 - RNA, 19 nt, Homo sapiens
caugaggaacucuuuagug

SEQ ID NO: 456055 - RNA, 19 nt, Homo sapiens
cagaaagcucggucacuug

SEQ ID NO: 456056 - RNA, 19 nt, Homo sapiens
ggaaacgagcagaugaaag

SEQ ID NO: 456057 - RNA, 19 nt, Homo sapiens
cgaaggaaacgagcagaug

SEQ ID NO: 456058 - RNA, 19 nt, Homo sapiens
ccaacgccgucuauuucug

SEQ ID NO: 456059 - RNA, 19 nt, Homo sapiens
gaagcugccgugcauuucu

SEQ ID NO: 456060 - RNA, 19 nt, Homo sapiens
gugcauaggaccaguuucu

SEQ ID NO: 456061 - RNA, 19 nt, Homo sapiens
agacucugccggagauauu

SEQ ID NO: 456062 - RNA, 19 nt, Homo sapiens
gaacccagaguugauagag

SEQ ID NO: 456063 - RNA, 19 nt, Homo sapiens
guccuucuguccuggaugu

SEQ ID NO: 456064 - RNA, 19 nt, Homo sapiens
gcaugaggaacucuuuagu

SEQ ID NO: 456065 - RNA, 19 nt, Homo sapiens
cgacaacgagacauacaag

SEQ ID NO: 456066 - RNA, 19 nt, Homo sapiens
ccuacgccaucauccaguu

SEQ ID NO: 456067 - RNA, 19 nt, Homo sapiens
gaccuugcgcucccucaga

SEQ ID NO: 456068 - RNA, 19 nt, Homo sapiens
uaggcguugugaccucuaa

SEQ ID NO: 456069 - RNA, 19 nt, Homo sapiens
cagcaaacucggcaacuac

SEQ ID NO: 456070 - RNA, 19 nt, Homo sapiens
gauuucggguggcaacaac

SEQ ID NO: 456071 - RNA, 19 nt, Homo sapiens
gcuucgaaccuaaugaaca

SEQ ID NO: 456072 - RNA, 19 nt, Homo sapiens
uugaagcugccgugcauuu

SEQ ID NO: 456073 - RNA, 19 nt, Homo sapiens
gaucguguggcuuccaaag

SEQ ID NO: 456074 - RNA, 19 nt, Homo sapiens
ucuccagccucaacaagca

SEQ ID NO: 456075 - RNA, 19 nt, Homo sapiens
gccacuuccuccuguugga

SEQ ID NO: 456076 - RNA, 19 nt, Homo sapiens
agccaacgccgucuauuuc

SEQ ID NO: 456077 - RNA, 19 nt, Homo sapiens
ggaagaaacugcagaagga

SEQ ID NO: 456078 - RNA, 19 nt, Homo sapiens
gaagaaacagcaagaagua

SEQ ID NO: 456079 - RNA, 19 nt, Homo sapiens
ggagaagaaugaagaagaa

SEQ ID NO: 456080 - RNA, 19 nt, Homo sapiens
ucaaaugucucuccacaaa

SEQ ID NO: 456081 - RNA, 19 nt, Homo sapiens
ccagagaaccaucauauaa

SEQ ID NO: 456082 - RNA, 19 nt, Homo sapiens
gaaguucucugugauacaa

SEQ ID NO: 456083 - RNA, 19 nt, Homo sapiens
gcauggaaguucucuguga

SEQ ID NO: 456084 - RNA, 19 nt, Homo sapiens
gaauguuccuggagagaaa

SEQ ID NO: 456085 - RNA, 19 nt, Homo sapiens
aaaccaaacucaacagaau

SEQ ID NO: 456086 - RNA, 19 nt, Homo sapiens
uagcuagaccaucuuauua

SEQ ID NO: 456087 - RNA, 19 nt, Homo sapiens
cgaaaugguuaucaaagug

SEQ ID NO: 456088 - RNA, 19 nt, Homo sapiens
ugaagaagguggagaaacu

SEQ ID NO: 456089 - RNA, 19 nt, Homo sapiens
gcuagaccaucuuauuaau

SEQ ID NO: 456090 - RNA, 19 nt, Homo sapiens
ggaagaaacagcaagaagu

SEQ ID NO: 456091 - RNA, 19 nt, Homo sapiens
agaagagacggaagaaaua

SEQ ID NO: 456092 - RNA, 19 nt, Homo sapiens
ggagguggaugagagagaa

SEQ ID NO: 456093 - RNA, 19 nt, Homo sapiens
gaagaaugaagaagaagga

SEQ ID NO: 456094 - RNA, 19 nt, Homo sapiens
cagagaaccaucauauaaa

SEQ ID NO: 456095 - RNA, 19 nt, Homo sapiens
ggaguccucuuuccaacug

SEQ ID NO: 456096 - RNA, 19 nt, Homo sapiens
cagaagagacggaagaaau

SEQ ID NO: 456097 - RNA, 19 nt, Homo sapiens
agagaaggcugaagaaggu

SEQ ID NO: 456098 - RNA, 19 nt, Homo sapiens
ccauagcgauuaggaagaa

SEQ ID NO: 456099 - RNA, 19 nt, Homo sapiens
gagaagacgaagauuccua

SEQ ID NO: 456100 - RNA, 19 nt, Homo sapiens
gaaaugguuaucaaagugu

SEQ ID NO: 456101 - RNA, 19 nt, Homo sapiens
caggguuacugaggacuua

SEQ ID NO: 456102 - RNA, 19 nt, Homo sapiens
cagaauacuuuggcuugaa

SEQ ID NO: 456103 - RNA, 19 nt, Homo sapiens
agauauugcuggagaugaa

SEQ ID NO: 456104 - RNA, 19 nt, Homo sapiens
gaagugcuuuccagagaac

SEQ ID NO: 456105 - RNA, 19 nt, Homo sapiens
ucaaaugcgccuuaugcua

SEQ ID NO: 456106 - RNA, 19 nt, Homo sapiens
gaagcuaugaagcaacauu

SEQ ID NO: 456107 - RNA, 19 nt, Homo sapiens
ggaggaagaaacugcagaa

SEQ ID NO: 456108 - RNA, 19 nt, Homo sapiens
gacaacaggagguggauga

SEQ ID NO: 456109 - RNA, 19 nt, Homo sapiens
ugaagugcuuuccagagaa

SEQ ID NO: 456110 - RNA, 19 nt, Homo sapiens
ucucugugauacaacaaua

SEQ ID NO: 456111 - RNA, 19 nt, Homo sapiens
gaagagacggaagaaauag

SEQ ID NO: 456112 - RNA, 19 nt, Homo sapiens
ccacagaagagacggaaga

SEQ ID NO: 456113 - RNA, 19 nt, Homo sapiens
gaaacagcaagaaguagug

SEQ ID NO: 456114 - RNA, 19 nt, Homo sapiens
gguaucucccgaaucaaua

SEQ ID NO: 456115 - RNA, 19 nt, Homo sapiens
caaaccaaacucaacagaa

SEQ ID NO: 456116 - RNA, 19 nt, Homo sapiens
ccacaaaccaaacucaaca

SEQ ID NO: 456117 - RNA, 19 nt, Homo sapiens
cuacuuaucucagaaacag

SEQ ID NO: 456118 - RNA, 19 nt, Homo sapiens
ucgaaaugguuaucaaagu

SEQ ID NO: 456119 - RNA, 19 nt, Homo sapiens
gaaucaauaccuucaugug

SEQ ID NO: 456120 - RNA, 19 nt, Homo sapiens
ccaacugucgaaaugguua

SEQ ID NO: 456121 - RNA, 19 nt, Homo sapiens
cggaagaaauagccaugga

SEQ ID NO: 456122 - RNA, 19 nt, Homo sapiens
gagagacagccacagaaga

SEQ ID NO: 456123 - RNA, 19 nt, Homo sapiens
ccgaaucaauaccuucaug

SEQ ID NO: 456124 - RNA, 19 nt, Homo sapiens
ugccugaccugguuagaug

SEQ ID NO: 456125 - RNA, 19 nt, Homo sapiens
ggagagacagccacagaag

SEQ ID NO: 456126 - RNA, 19 nt, Homo sapiens
cgauagcuagaccaucuua

SEQ ID NO: 456127 - RNA, 19 nt, Homo sapiens
cugguuagauguacaugga

SEQ ID NO: 456128 - RNA, 19 nt, Homo sapiens
acagaauacuuuggcuuga

SEQ ID NO: 456129 - RNA, 19 nt, Homo sapiens
ugaagaagaaggagagaca

SEQ ID NO: 456130 - RNA, 19 nt, Homo sapiens
augaagugcuuuccagaga

SEQ ID NO: 456131 - RNA, 19 nt, Homo sapiens
cauggaaguucucugugau

SEQ ID NO: 456132 - RNA, 19 nt, Homo sapiens
uggaagcuaugaagcaaca

SEQ ID NO: 456133 - RNA, 19 nt, Homo sapiens
gaaaauggaagcuaugaag

SEQ ID NO: 456134 - RNA, 19 nt, Homo sapiens
ugugauacaacaauacgua

SEQ ID NO: 456135 - RNA, 19 nt, Homo sapiens
caaacucaacagaauacuu

SEQ ID NO: 456136 - RNA, 19 nt, Homo sapiens
gaagauuccuaggccuuuu

SEQ ID NO: 456137 - RNA, 19 nt, Homo sapiens
ucaaugaggagcaguacug

SEQ ID NO: 456138 - RNA, 19 nt, Homo sapiens
agcaagaaguaguggguuu

SEQ ID NO: 456139 - RNA, 19 nt, Homo sapiens
uggagaaacugaggcacaa

SEQ ID NO: 456140 - RNA, 19 nt, Homo sapiens
aauggaagcuaugaagcaa

SEQ ID NO: 456141 - RNA, 19 nt, Homo sapiens
gaagaagguggagaaacug

SEQ ID NO: 456142 - RNA, 19 nt, Homo sapiens
gcaguacuguggggauuuu

SEQ ID NO: 456143 - RNA, 19 nt, Homo sapiens
agaauacuuuggcuugaag

SEQ ID NO: 456144 - RNA, 19 nt, Homo sapiens
ugcgauagcuagaccaucu

SEQ ID NO: 456145 - RNA, 19 nt, Homo sapiens
gccugacagucuuggcuuu

SEQ ID NO: 456146 - RNA, 19 nt, Homo sapiens
uaugcugccugaccugguu

SEQ ID NO: 456147 - RNA, 19 nt, Homo sapiens
aaccaaacucaacagaaua

SEQ ID NO: 456148 - RNA, 19 nt, Homo sapiens
cgaagauuccuaggccuuu

SEQ ID NO: 456149 - RNA, 19 nt, Homo sapiens
aaagagggcagugaagaug

SEQ ID NO: 456150 - RNA, 19 nt, Homo sapiens
caacaggagguggaugaga

SEQ ID NO: 456151 - RNA, 19 nt, Homo sapiens
auagcuagaccaucuuauu

SEQ ID NO: 456152 - RNA, 19 nt, Homo sapiens
ucaugugccugacagucuu

SEQ ID NO: 456153 - RNA, 19 nt, Homo sapiens
uuucaugcuucauuucuuc

SEQ ID NO: 456154 - RNA, 19 nt, Homo sapiens
ggagaaacugaggcacaaa

SEQ ID NO: 456155 - RNA, 19 nt, Homo sapiens
gagaauguuccuggagaga

SEQ ID NO: 456156 - RNA, 19 nt, Homo sapiens
uuuauuccuuccuugguuu

SEQ ID NO: 456157 - RNA, 19 nt, Homo sapiens
ggaaguucucugugauaca

SEQ ID NO: 456158 - RNA, 19 nt, Homo sapiens
agaaacugcagaaggagaa

SEQ ID NO: 456159 - RNA, 19 nt, Homo sapiens
agagggcagugaagaugug

SEQ ID NO: 456160 - RNA, 19 nt, Homo sapiens
uccagagaaccaucauaua

SEQ ID NO: 456161 - RNA, 19 nt, Homo sapiens
agauguacauggagguauc

SEQ ID NO: 456162 - RNA, 19 nt, Homo sapiens
aagcuaugaagcaacauuu

SEQ ID NO: 456163 - RNA, 19 nt, Homo sapiens
aggagaagaaugaagaaga

SEQ ID NO: 456164 - RNA, 19 nt, Homo sapiens
uaugcuacuuaucucagaa

SEQ ID NO: 456165 - RNA, 19 nt, Homo sapiens
cgaaucaauaccuucaugu

SEQ ID NO: 456166 - RNA, 19 nt, Homo sapiens
agaaacagcaagaaguagu

SEQ ID NO: 456167 - RNA, 19 nt, Homo sapiens
aaauggaagcuaugaagca

SEQ ID NO: 456168 - RNA, 19 nt, Homo sapiens
cugaagcccaggagaagaa

SEQ ID NO: 456169 - RNA, 19 nt, Homo sapiens
cgacuuuaaggaauuagau

SEQ ID NO: 456170 - RNA, 19 nt, Homo sapiens
aaaugucucuccacaaacc

SEQ ID NO: 456171 - RNA, 19 nt, Homo sapiens
cuucauuucuuccacuucu

SEQ ID NO: 456172 - RNA, 19 nt, Homo sapiens
ugucgaaaugguuaucaaa

SEQ ID NO: 456173 - RNA, 19 nt, Homo sapiens
ggaagccgaggaggaggaa

SEQ ID NO: 456174 - RNA, 19 nt, Homo sapiens
agagacagccacagaagag

SEQ ID NO: 456175 - RNA, 19 nt, Homo sapiens
aaggagagacagccacaga

SEQ ID NO: 456176 - RNA, 19 nt, Homo sapiens
ccaggagaagaaugaagaa

SEQ ID NO: 456177 - RNA, 19 nt, Homo sapiens
gcaaacaccucuuacuuua

SEQ ID NO: 456178 - RNA, 19 nt, Homo sapiens
gaaauaggcuuaauguuga

SEQ ID NO: 456179 - RNA, 19 nt, Homo sapiens
gaagugggaugccaaguaa

SEQ ID NO: 456180 - RNA, 19 nt, Homo sapiens
caagaaacauggccuaaau

SEQ ID NO: 456181 - RNA, 19 nt, Homo sapiens
gaaauaaccugucucucau

SEQ ID NO: 456182 - RNA, 19 nt, Homo sapiens
cuacagcgauuaagaagaa

SEQ ID NO: 456183 - RNA, 19 nt, Homo sapiens
gaagagaugccuuuguuug

SEQ ID NO: 456184 - RNA, 19 nt, Homo sapiens
gcagcaagcaugaaccuua

SEQ ID NO: 456185 - RNA, 19 nt, Homo sapiens
agaaauaggcuuaauguug

SEQ ID NO: 456186 - RNA, 19 nt, Homo sapiens
gaugaaacucuacauauga

SEQ ID NO: 456187 - RNA, 19 nt, Homo sapiens
gaacaagaauauguaccuu

SEQ ID NO: 456188 - RNA, 19 nt, Homo sapiens
cagcaagcaugaaccuuaa

SEQ ID NO: 456189 - RNA, 19 nt, Homo sapiens
ggugauccguguauauauu

SEQ ID NO: 456190 - RNA, 19 nt, Homo sapiens
ugaggagaaugggauauua

SEQ ID NO: 456191 - RNA, 19 nt, Homo sapiens
uuucugagcuucuaaaugu

SEQ ID NO: 456192 - RNA, 19 nt, Homo sapiens
agaauuagcuuugcuucaa

SEQ ID NO: 456193 - RNA, 19 nt, Homo sapiens
ucagugaucagaauagaua

SEQ ID NO: 456194 - RNA, 19 nt, Homo sapiens
gaagaaacaacaagaugug

SEQ ID NO: 456195 - RNA, 19 nt, Homo sapiens
aaacaacucacaaucguaa

SEQ ID NO: 456196 - RNA, 19 nt, Homo sapiens
agaaauaaccugucucuca

SEQ ID NO: 456197 - RNA, 19 nt, Homo sapiens
gagaugccuuuguuugaug

SEQ ID NO: 456198 - RNA, 19 nt, Homo sapiens
cuaaguugccucauuaauu

SEQ ID NO: 456199 - RNA, 19 nt, Homo sapiens
aagcagaagugcaagcaaa

SEQ ID NO: 456200 - RNA, 19 nt, Homo sapiens
gagaaaauguaccugaaaa

SEQ ID NO: 456201 - RNA, 19 nt, Homo sapiens
guuucacacuaccuuauua

SEQ ID NO: 456202 - RNA, 19 nt, Homo sapiens
agaugaaacucuacauaug

SEQ ID NO: 456203 - RNA, 19 nt, Homo sapiens
uauggcaacuuaaguguau

SEQ ID NO: 456204 - RNA, 19 nt, Homo sapiens
gaggagaaugggauauuaa

SEQ ID NO: 456205 - RNA, 19 nt, Homo sapiens
agaaacauggccuaaauaa

SEQ ID NO: 456206 - RNA, 19 nt, Homo sapiens
gcgaucauuucccaagauu

SEQ ID NO: 456207 - RNA, 19 nt, Homo sapiens
guagauaucguagaaauag

SEQ ID NO: 456208 - RNA, 19 nt, Homo sapiens
guguauauauugcaucuuc

SEQ ID NO: 456209 - RNA, 19 nt, Homo sapiens
caaacuugaugcuaugcuu

SEQ ID NO: 456210 - RNA, 19 nt, Homo sapiens
caaguaagcuuaaaaugca

SEQ ID NO: 456211 - RNA, 19 nt, Homo sapiens
uuccuaaguugccucauua

SEQ ID NO: 456212 - RNA, 19 nt, Homo sapiens
uaucugcagcucuacauua

SEQ ID NO: 456213 - RNA, 19 nt, Homo sapiens
gaaacaacaagaugugcuu

SEQ ID NO: 456214 - RNA, 19 nt, Homo sapiens
gcagguaauguuuauguau

SEQ ID NO: 456215 - RNA, 19 nt, Homo sapiens
guaugcuggucuuuacuuu

SEQ ID NO: 456216 - RNA, 19 nt, Homo sapiens
caaacaccucuuacuuuaa

SEQ ID NO: 456217 - RNA, 19 nt, Homo sapiens
gcuucuaaauguagccuuu

SEQ ID NO: 456218 - RNA, 19 nt, Homo sapiens
aaagagaaauaaccugucu

SEQ ID NO: 456219 - RNA, 19 nt, Homo sapiens
gagaaugggauauuaacau

SEQ ID NO: 456220 - RNA, 19 nt, Homo sapiens
ugcaguguaugccuucuua

SEQ ID NO: 456221 - RNA, 19 nt, Homo sapiens
gagaaucggaaguggauga

SEQ ID NO: 456222 - RNA, 19 nt, Homo sapiens
cacacuaccuuauuaccaa

SEQ ID NO: 456223 - RNA, 19 nt, Homo sapiens
ugaagugggaugccaagua

SEQ ID NO: 456224 - RNA, 19 nt, Homo sapiens
augaagagaugccuuuguu

SEQ ID NO: 456225 - RNA, 19 nt, Homo sapiens
ggaaguggaugagagaaaa

SEQ ID NO: 456226 - RNA, 19 nt, Homo sapiens
gcucuacagcgauuaagaa

SEQ ID NO: 456227 - RNA, 19 nt, Homo sapiens
caaaagcaaacaccucuua

SEQ ID NO: 456228 - RNA, 19 nt, Homo sapiens
guuuagccauguauuguau

SEQ ID NO: 456229 - RNA, 19 nt, Homo sapiens
guaaaugcuacuauuccua

SEQ ID NO: 456230 - RNA, 19 nt, Homo sapiens
gaucagaauagauauccuu

SEQ ID NO: 456231 - RNA, 19 nt, Homo sapiens
gcuauauuacugcgauuaa

SEQ ID NO: 456232 - RNA, 19 nt, Homo sapiens
gccaagccauccuguauac

SEQ ID NO: 456233 - RNA, 19 nt, Homo sapiens
gggaugccaaguaagcuua

SEQ ID NO: 456234 - RNA, 19 nt, Homo sapiens
aaaggaagcagaagugcaa

SEQ ID NO: 456235 - RNA, 19 nt, Homo sapiens
agcaauagauucauucagu

SEQ ID NO: 456236 - RNA, 19 nt, Homo sapiens
gagagaaaauguaccugaa

SEQ ID NO: 456237 - RNA, 19 nt, Homo sapiens
aaacauggccuaaauaacc

SEQ ID NO: 456238 - RNA, 19 nt, Homo sapiens
gcacauuucagugaucaga

SEQ ID NO: 456239 - RNA, 19 nt, Homo sapiens
uaacauucccauucuuugu

SEQ ID NO: 456240 - RNA, 19 nt, Homo sapiens
guaugaguguauuagucua

SEQ ID NO: 456241 - RNA, 19 nt, Homo sapiens
ccuagaagccaacaaaaua

SEQ ID NO: 456242 - RNA, 19 nt, Homo sapiens
aagcaaacaccucuuacuu

SEQ ID NO: 456243 - RNA, 19 nt, Homo sapiens
aagaaacauggccuaaaua

SEQ ID NO: 456244 - RNA, 19 nt, Homo sapiens
gacaagaaacauggccuaa

SEQ ID NO: 456245 - RNA, 19 nt, Homo sapiens
gcuacuauuccuaagauau

SEQ ID NO: 456246 - RNA, 19 nt, Homo sapiens
aauaaccugucucucauuc

SEQ ID NO: 456247 - RNA, 19 nt, Homo sapiens
gauggugauccguguauau

SEQ ID NO: 456248 - RNA, 19 nt, Homo sapiens
uaaaaugcauucucuagca

SEQ ID NO: 456249 - RNA, 19 nt, Homo sapiens
gcacaaaagcaauagauuc

SEQ ID NO: 456250 - RNA, 19 nt, Homo sapiens
acauaugaaccacagauuu

SEQ ID NO: 456251 - RNA, 19 nt, Homo sapiens
aaguguaucugcagcucua

SEQ ID NO: 456252 - RNA, 19 nt, Homo sapiens
uaucguagaaauaguguug

SEQ ID NO: 456253 - RNA, 19 nt, Homo sapiens
gcaaagcagcaagcaugaa

SEQ ID NO: 456254 - RNA, 19 nt, Homo sapiens
agagaugccuuuguuugau

SEQ ID NO: 456255 - RNA, 19 nt, Homo sapiens
aagagaugccuuuguuuga

SEQ ID NO: 456256 - RNA, 19 nt, Homo sapiens
gaaacauggccuaaauaac

SEQ ID NO: 456257 - RNA, 19 nt, Homo sapiens
guagaaauaguguuguuac

SEQ ID NO: 456258 - RNA, 19 nt, Homo sapiens
ggagaaugggauauuaaca

SEQ ID NO: 456259 - RNA, 19 nt, Homo sapiens
ucacaugcaaacauucaaa

SEQ ID NO: 456260 - RNA, 19 nt, Homo sapiens
caccucagauuuucaauga

SEQ ID NO: 456261 - RNA, 19 nt, Homo sapiens
agcaaacaccucuuacuuu

SEQ ID NO: 456262 - RNA, 19 nt, Homo sapiens
acacuaccuuauuaccaaa

SEQ ID NO: 456263 - RNA, 19 nt, Homo sapiens
caacucacaaucguaaaug

SEQ ID NO: 456264 - RNA, 19 nt, Homo sapiens
guucuugcagguaauguuu

SEQ ID NO: 456265 - RNA, 19 nt, Homo sapiens
gagaaaauaaugcagugua

SEQ ID NO: 456266 - RNA, 19 nt, Homo sapiens
ccucuuacuuuaaacuaca

SEQ ID NO: 456267 - RNA, 19 nt, Homo sapiens
uuagccauguauuguauga

SEQ ID NO: 456268 - RNA, 19 nt, Homo sapiens
ggagaaagagaaauaaccu

SEQ ID NO: 456269 - RNA, 19 nt, Homo sapiens
gaacauuauggugauuaug

SEQ ID NO: 456270 - RNA, 19 nt, Homo sapiens
ugaagagaugccuuuguuu

SEQ ID NO: 456271 - RNA, 19 nt, Homo sapiens
gugcuugguuuccuagaag

SEQ ID NO: 456272 - RNA, 19 nt, Homo sapiens
uaaaacagguuggcgauca

SEQ ID NO: 456273 - RNA, 19 nt, Homo sapiens
agaagaaacaacaagaugu

SEQ ID NO: 456274 - RNA, 19 nt, Homo sapiens
aaacuugaugcuaugcuuu

SEQ ID NO: 456275 - RNA, 19 nt, Homo sapiens
uaaaacaacucacaaucgu

SEQ ID NO: 456276 - RNA, 19 nt, Homo sapiens
uagcaaagagauuagacuu

SEQ ID NO: 456277 - RNA, 19 nt, Homo sapiens
ggacaugccugcuguagau

SEQ ID NO: 456278 - RNA, 19 nt, Homo sapiens
ggacgaaaccucuaacaaa

SEQ ID NO: 456279 - RNA, 19 nt, Homo sapiens
ccaaggagauugagcauau

SEQ ID NO: 456280 - RNA, 19 nt, Homo sapiens
gcauuuagcuaauuaccaa

SEQ ID NO: 456281 - RNA, 19 nt, Homo sapiens
ugaagugucuaucaucuuu

SEQ ID NO: 456282 - RNA, 19 nt, Homo sapiens
gaucucggcucaaugcaaa

SEQ ID NO: 456283 - RNA, 19 nt, Homo sapiens
ggguugggauuaccauuua

SEQ ID NO: 456284 - RNA, 19 nt, Homo sapiens
ggagagcaguggccaauca

SEQ ID NO: 456285 - RNA, 19 nt, Homo sapiens
gaaacaugcuucuucucuu

SEQ ID NO: 456286 - RNA, 19 nt, Homo sapiens
cagcuucgcuucccagauu

SEQ ID NO: 456287 - RNA, 19 nt, Homo sapiens
gugaggaacuaucgcauuu

SEQ ID NO: 456288 - RNA, 19 nt, Homo sapiens
ggagggugcugguuugcua

SEQ ID NO: 456289 - RNA, 19 nt, Homo sapiens
gaagaugcuugacagacaa

SEQ ID NO: 456290 - RNA, 19 nt, Homo sapiens
caaaugaugaggcugguua

SEQ ID NO: 456291 - RNA, 19 nt, Homo sapiens
caaccaccaucaggaaaua

SEQ ID NO: 456292 - RNA, 19 nt, Homo sapiens
gacgaaaccucuaacaaag

SEQ ID NO: 456293 - RNA, 19 nt, Homo sapiens
agaaagaccugcccuugga

SEQ ID NO: 456294 - RNA, 19 nt, Homo sapiens
uaacagaucaggacccaaa

SEQ ID NO: 456295 - RNA, 19 nt, Homo sapiens
ugacauaccuaccuucaag

SEQ ID NO: 456296 - RNA, 19 nt, Homo sapiens
caccacgccuggcuaauuu

SEQ ID NO: 456297 - RNA, 19 nt, Homo sapiens
agaagcagcuguuaguaga

SEQ ID NO: 456298 - RNA, 19 nt, Homo sapiens
ggaaguaaacgaucugcaa

SEQ ID NO: 456299 - RNA, 19 nt, Homo sapiens
gguaugaagaucuuucuaa

SEQ ID NO: 456300 - RNA, 19 nt, Homo sapiens
gcagugacccugugaagau

SEQ ID NO: 456301 - RNA, 19 nt, Homo sapiens
cgaaaccucuaacaaagug

SEQ ID NO: 456302 - RNA, 19 nt, Homo sapiens
guaguucacagauucauuu

SEQ ID NO: 456303 - RNA, 19 nt, Homo sapiens
auaccuaccuucaagauga

SEQ ID NO: 456304 - RNA, 19 nt, Homo sapiens
ccaggacaccuuugcuuua

SEQ ID NO: 456305 - RNA, 19 nt, Homo sapiens
aaacaugcuucuucucuuc

SEQ ID NO: 456306 - RNA, 19 nt, Homo sapiens
uaucguaguucacagauuc

SEQ ID NO: 456307 - RNA, 19 nt, Homo sapiens
acagcugccugccaaauuu

SEQ ID NO: 456308 - RNA, 19 nt, Homo sapiens
cauaguuucucuuccugua

SEQ ID NO: 456309 - RNA, 19 nt, Homo sapiens
gcagggagauuggccacuu

SEQ ID NO: 456310 - RNA, 19 nt, Homo sapiens
ggacgaagggacucuguug

SEQ ID NO: 456311 - RNA, 19 nt, Homo sapiens
ucuggcagcuggcuucuuu

SEQ ID NO: 456312 - RNA, 19 nt, Homo sapiens
caacugauccgcccaccuu

SEQ ID NO: 456313 - RNA, 19 nt, Homo sapiens
aaacauaaaugcacaaccu

SEQ ID NO: 456314 - RNA, 19 nt, Homo sapiens
ugaagaugcuugacagaca

SEQ ID NO: 456315 - RNA, 19 nt, Homo sapiens
gcuguugccuccaauaaag

SEQ ID NO: 456316 - RNA, 19 nt, Homo sapiens
ucugugagauuuauucaug

SEQ ID NO: 456317 - RNA, 19 nt, Homo sapiens
gaaggagccaugaggaguu

SEQ ID NO: 456318 - RNA, 19 nt, Homo sapiens
gcacagcgaguaacagauc

SEQ ID NO: 456319 - RNA, 19 nt, Homo sapiens
gaaggacucuaaguucuac

SEQ ID NO: 456320 - RNA, 19 nt, Homo sapiens
gcauuggccugucccuaug

SEQ ID NO: 456321 - RNA, 19 nt, Homo sapiens
guagauggacaguugguuu

SEQ ID NO: 456322 - RNA, 19 nt, Homo sapiens
ggagugcaaugccgugauc

SEQ ID NO: 456323 - RNA, 19 nt, Homo sapiens
ccaaagugcugggauuaca

SEQ ID NO: 456324 - RNA, 19 nt, Homo sapiens
ggacggugguacccagaug

SEQ ID NO: 456325 - RNA, 19 nt, Homo sapiens
ggagggcgagguccuguuu

SEQ ID NO: 456326 - RNA, 19 nt, Homo sapiens
gugacaaacucaaguccuu

SEQ ID NO: 456327 - RNA, 19 nt, Homo sapiens
cagucaagcuuguccaaug

SEQ ID NO: 456328 - RNA, 19 nt, Homo sapiens
gagauuugauggguacaga

SEQ ID NO: 456329 - RNA, 19 nt, Homo sapiens
caggacaccuuugcuuuau

SEQ ID NO: 456330 - RNA, 19 nt, Homo sapiens
gcuagaagcccugcagcua

SEQ ID NO: 456331 - RNA, 19 nt, Homo sapiens
gcagcaugguggagcacua

SEQ ID NO: 456332 - RNA, 19 nt, Homo sapiens
ggacgaggacuaugagaag

SEQ ID NO: 456333 - RNA, 19 nt, Homo sapiens
ggugaaacaugcuucuucu

SEQ ID NO: 456334 - RNA, 19 nt, Homo sapiens
gagaagcagcuguuaguag

SEQ ID NO: 456335 - RNA, 19 nt, Homo sapiens
ggagaagcagcuguuagua

SEQ ID NO: 456336 - RNA, 19 nt, Homo sapiens
gagcuucuguuguucugau

SEQ ID NO: 456337 - RNA, 19 nt, Homo sapiens
cuaacaaagugaggaacua

SEQ ID NO: 456338 - RNA, 19 nt, Homo sapiens
ggccuuaauuugcauuuag

SEQ ID NO: 456339 - RNA, 19 nt, Homo sapiens
guacccagaugcccaaguc

SEQ ID NO: 456340 - RNA, 19 nt, Homo sapiens
ggacacagacagcuucuac

SEQ ID NO: 456341 - RNA, 19 nt, Homo sapiens
uaguauaguuugugcaugu

SEQ ID NO: 456342 - RNA, 19 nt, Homo sapiens
ucacugacauaccuaccuu

SEQ ID NO: 456343 - RNA, 19 nt, Homo sapiens
gaacuugcuuagggaguca

SEQ ID NO: 456344 - RNA, 19 nt, Homo sapiens
gaacaguggacccuaagca

SEQ ID NO: 456345 - RNA, 19 nt, Homo sapiens
gaggaccacccacaucuga

SEQ ID NO: 456346 - RNA, 19 nt, Homo sapiens
caaggagauugagcauauu

SEQ ID NO: 456347 - RNA, 19 nt, Homo sapiens
guuauggccuuaauuugca

SEQ ID NO: 456348 - RNA, 19 nt, Homo sapiens
guugguuuguuucuaguuu

SEQ ID NO: 456349 - RNA, 19 nt, Homo sapiens
ucauacagaugcaaauucu

SEQ ID NO: 456350 - RNA, 19 nt, Homo sapiens
gcacuugggcccacugaca

SEQ ID NO: 456351 - RNA, 19 nt, Homo sapiens
gacaguugguuuguuucua

SEQ ID NO: 456352 - RNA, 19 nt, Homo sapiens
agacaguucuuccgguaug

SEQ ID NO: 456353 - RNA, 19 nt, Homo sapiens
gcuguuaguagacccauuu

SEQ ID NO: 456354 - RNA, 19 nt, Homo sapiens
cagaaacugugacaaacuc

SEQ ID NO: 456355 - RNA, 19 nt, Homo sapiens
guauaguuauggccuuaau

SEQ ID NO: 456356 - RNA, 19 nt, Homo sapiens
guguauaguuauggccuua

SEQ ID NO: 456357 - RNA, 19 nt, Homo sapiens
cagauucauuucacuguca

SEQ ID NO: 456358 - RNA, 19 nt, Homo sapiens
ucucugcccuggcuuaugu

SEQ ID NO: 456359 - RNA, 19 nt, Homo sapiens
ccugaugccuugaagacuu

SEQ ID NO: 456360 - RNA, 19 nt, Homo sapiens
cauggcggcugaagagaug

SEQ ID NO: 456361 - RNA, 19 nt, Homo sapiens
ugagaaggacucuaaguuc

SEQ ID NO: 456362 - RNA, 19 nt, Homo sapiens
ccacggacaaugaagacua

SEQ ID NO: 456363 - RNA, 19 nt, Homo sapiens
gauggacaguugguuuguu

SEQ ID NO: 456364 - RNA, 19 nt, Homo sapiens
gagcaguggccaaucauag

SEQ ID NO: 456365 - RNA, 19 nt, Homo sapiens
uaguuucucuuccuguaaa

SEQ ID NO: 456366 - RNA, 19 nt, Homo sapiens
acacugagcgggcuacaga

SEQ ID NO: 456367 - RNA, 19 nt, Homo sapiens
cugcauuagugccugguua

SEQ ID NO: 456368 - RNA, 19 nt, Homo sapiens
uaagacacaggcuccagua

SEQ ID NO: 456369 - RNA, 19 nt, Homo sapiens
uauaguuagugguagugua

SEQ ID NO: 456370 - RNA, 19 nt, Homo sapiens
ccaggaugccuuugaaugu

SEQ ID NO: 456371 - RNA, 19 nt, Homo sapiens
uggcuucuuuggcucguua

SEQ ID NO: 456372 - RNA, 19 nt, Homo sapiens
gcaaccaccaucaggaaau

SEQ ID NO: 456373 - RNA, 19 nt, Homo sapiens
gcaaaucuccaggguucaa

SEQ ID NO: 456374 - RNA, 19 nt, Homo sapiens
gacccuagaauccuuguga

SEQ ID NO: 456375 - RNA, 19 nt, Homo sapiens
ccucuggccuggcugaguu

SEQ ID NO: 456376 - RNA, 19 nt, Homo sapiens
cugcaugccuggucccauu

SEQ ID NO: 456377 - RNA, 19 nt, Homo sapiens
ggacauaguuguacugaaa

SEQ ID NO: 456378 - RNA, 19 nt, Homo sapiens
gcacagagauucacuuguu

SEQ ID NO: 456379 - RNA, 19 nt, Homo sapiens
gcaaugguguucagacuua

SEQ ID NO: 456380 - RNA, 19 nt, Homo sapiens
ggaaggagcugauuaugug

SEQ ID NO: 456381 - RNA, 19 nt, Homo sapiens
aaucaaaccugcaguauaa

SEQ ID NO: 456382 - RNA, 19 nt, Homo sapiens
gauacucaaugaccaauua

SEQ ID NO: 456383 - RNA, 19 nt, Homo sapiens
gcagaaagcauaaaugaaa

SEQ ID NO: 456384 - RNA, 19 nt, Homo sapiens
gaaaggacaacaaaguuua

SEQ ID NO: 456385 - RNA, 19 nt, Homo sapiens
aaacaaaucuagagaguug

SEQ ID NO: 456386 - RNA, 19 nt, Homo sapiens
gccaauaucuggauucauu

SEQ ID NO: 456387 - RNA, 19 nt, Homo sapiens
gauaucagaugucgauuga

SEQ ID NO: 456388 - RNA, 19 nt, Homo sapiens
gcaaauauacccuguaguu

SEQ ID NO: 456389 - RNA, 19 nt, Homo sapiens
ggucacaacuaaacacuaa

SEQ ID NO: 456390 - RNA, 19 nt, Homo sapiens
gaucagcaguuccauaguu

SEQ ID NO: 456391 - RNA, 19 nt, Homo sapiens
gaagaugccugugaagaug

SEQ ID NO: 456392 - RNA, 19 nt, Homo sapiens
gaauaaugauggaagaaug

SEQ ID NO: 456393 - RNA, 19 nt, Homo sapiens
ggucauacuucaagcaauu

SEQ ID NO: 456394 - RNA, 19 nt, Homo sapiens
gaacaagaacgaaagauca

SEQ ID NO: 456395 - RNA, 19 nt, Homo sapiens
ggcaagaacuacuaaauca

SEQ ID NO: 456396 - RNA, 19 nt, Homo sapiens
ggccauaacuguagaggaa

SEQ ID NO: 456397 - RNA, 19 nt, Homo sapiens
gcaaagaccuaagacacuu

SEQ ID NO: 456398 - RNA, 19 nt, Homo sapiens
gagcagaaagcauaaauga

SEQ ID NO: 456399 - RNA, 19 nt, Homo sapiens
uagcugacaugaauaauga

SEQ ID NO: 456400 - RNA, 19 nt, Homo sapiens
gaacaacagacauaaguau

SEQ ID NO: 456401 - RNA, 19 nt, Homo sapiens
ggaaaggacaacaaaguuu

SEQ ID NO: 456402 - RNA, 19 nt, Homo sapiens
gauacccacugaucauuaa

SEQ ID NO: 456403 - RNA, 19 nt, Homo sapiens
gcugggaacugaaugugua

SEQ ID NO: 456404 - RNA, 19 nt, Homo sapiens
guaacaagauacccacuga

SEQ ID NO: 456405 - RNA, 19 nt, Homo sapiens
gcacagauaugggcacuag

SEQ ID NO: 456406 - RNA, 19 nt, Homo sapiens
ggaugggucugguuacuau

SEQ ID NO: 456407 - RNA, 19 nt, Homo sapiens
ggaugccacucucuaguuu

SEQ ID NO: 456408 - RNA, 19 nt, Homo sapiens
gaaaggagaagucaaugga

SEQ ID NO: 456409 - RNA, 19 nt, Homo sapiens
gaaaggcaacgacaacuug

SEQ ID NO: 456410 - RNA, 19 nt, Homo sapiens
ggacaacaaaguuuacauu

SEQ ID NO: 456411 - RNA, 19 nt, Homo sapiens
ccucaaagcuccuaggaau

SEQ ID NO: 456412 - RNA, 19 nt, Homo sapiens
gaacgaaagaucauagaau

SEQ ID NO: 456413 - RNA, 19 nt, Homo sapiens
gaaggaacuaagagaaaua

SEQ ID NO: 456414 - RNA, 19 nt, Homo sapiens
gcaaaugcuuggaagacuu

SEQ ID NO: 456415 - RNA, 19 nt, Homo sapiens
ggagaugaggcgucgauua

SEQ ID NO: 456416 - RNA, 19 nt, Homo sapiens
gauaguaacuugauuugcu

SEQ ID NO: 456417 - RNA, 19 nt, Homo sapiens
ggagacauagucaugguua

SEQ ID NO: 456418 - RNA, 19 nt, Homo sapiens
caacugaacauguuagaga

SEQ ID NO: 456419 - RNA, 19 nt, Homo sapiens
caagacauguggugguuug

SEQ ID NO: 456420 - RNA, 19 nt, Homo sapiens
caaauauacccuguaguua

SEQ ID NO: 456421 - RNA, 19 nt, Homo sapiens
gggagaagaugccugugaa

SEQ ID NO: 456422 - RNA, 19 nt, Homo sapiens
gaaagaaagcgacaaggau

SEQ ID NO: 456423 - RNA, 19 nt, Homo sapiens
caacagagccaccuaaguc

SEQ ID NO: 456424 - RNA, 19 nt, Homo sapiens
gaaauugcccagguuauug

SEQ ID NO: 456425 - RNA, 19 nt, Homo sapiens
gguccagggucacaacuaa

SEQ ID NO: 456426 - RNA, 19 nt, Homo sapiens
ugaucaagcuagaaacuuu

SEQ ID NO: 456427 - RNA, 19 nt, Homo sapiens
gaacuaagagaaauacaca

SEQ ID NO: 456428 - RNA, 19 nt, Homo sapiens
gaggagaacuaugugaaug

SEQ ID NO: 456429 - RNA, 19 nt, Homo sapiens
aaagaaagcgacaaggaua

SEQ ID NO: 456430 - RNA, 19 nt, Homo sapiens
aaagaaggauggcgaggaa

SEQ ID NO: 456431 - RNA, 19 nt, Homo sapiens
aaacuggccuugcgugaga

SEQ ID NO: 456432 - RNA, 19 nt, Homo sapiens
gaacaagaggacauaguug

SEQ ID NO: 456433 - RNA, 19 nt, Homo sapiens
caucaaggcugaaauacag

SEQ ID NO: 456434 - RNA, 19 nt, Homo sapiens
guaacccuccuguuucuua

SEQ ID NO: 456435 - RNA, 19 nt, Homo sapiens
acaauuuccuguuucauga

SEQ ID NO: 456436 - RNA, 19 nt, Homo sapiens
caagaaaacuccacgaaga

SEQ ID NO: 456437 - RNA, 19 nt, Homo sapiens
gagauucacuuguuacacu

SEQ ID NO: 456438 - RNA, 19 nt, Homo sapiens
gaggagaggaggaaagaaa

SEQ ID NO: 456439 - RNA, 19 nt, Homo sapiens
ggcacuagcugacaugaau

SEQ ID NO: 456440 - RNA, 19 nt, Homo sapiens
gguguucucuuugauugua

SEQ ID NO: 456441 - RNA, 19 nt, Homo sapiens
cacagaaagucauuaucua

SEQ ID NO: 456442 - RNA, 19 nt, Homo sapiens
caacaggcauuggaagguu

SEQ ID NO: 456443 - RNA, 19 nt, Homo sapiens
guucccagcuaauuaugua

SEQ ID NO: 456444 - RNA, 19 nt, Homo sapiens
caacaacuccagaagcaaa

SEQ ID NO: 456445 - RNA, 19 nt, Homo sapiens
gcagaacaguuugcacaga

SEQ ID NO: 456446 - RNA, 19 nt, Homo sapiens
caaaugcuuggaagacuua

SEQ ID NO: 456447 - RNA, 19 nt, Homo sapiens
gcacaaacaaaucuagaga

SEQ ID NO: 456448 - RNA, 19 nt, Homo sapiens
aagggaaacuucaagauau

SEQ ID NO: 456449 - RNA, 19 nt, Homo sapiens
cuucugaacuuuacauaga

SEQ ID NO: 456450 - RNA, 19 nt, Homo sapiens
gggaauggguggaugaaag

SEQ ID NO: 456451 - RNA, 19 nt, Homo sapiens
gaaagaacaagaacgaaag

SEQ ID NO: 456452 - RNA, 19 nt, Homo sapiens
gaaacagaaagaacaagaa

SEQ ID NO: 456453 - RNA, 19 nt, Homo sapiens
gaaacuagaucaaaacuac

SEQ ID NO: 456454 - RNA, 19 nt, Homo sapiens
ggagaaagaaacuagauca

SEQ ID NO: 456455 - RNA, 19 nt, Homo sapiens
cacagagauucacuuguua

SEQ ID NO: 456456 - RNA, 19 nt, Homo sapiens
gcuucaauauggaaucuuu

SEQ ID NO: 456457 - RNA, 19 nt, Homo sapiens
gcagccacauugccaaaga

SEQ ID NO: 456458 - RNA, 19 nt, Homo sapiens
cgacaaggccggagucuuc

SEQ ID NO: 456459 - RNA, 19 nt, Homo sapiens
cagaagccaugaugaaauc

SEQ ID NO: 456460 - RNA, 19 nt, Homo sapiens
gcugaaauacaggcaauua

SEQ ID NO: 456461 - RNA, 19 nt, Homo sapiens
ugaaggcaguccauuaugu

SEQ ID NO: 456462 - RNA, 19 nt, Homo sapiens
uugaagagcuggucuaugg

SEQ ID NO: 456463 - RNA, 19 nt, Homo sapiens
gaccaguucucaccagaug

SEQ ID NO: 456464 - RNA, 19 nt, Homo sapiens
gaaauggauccucggugua

SEQ ID NO: 456465 - RNA, 19 nt, Homo sapiens
gcaguuccauaguuuaaag

SEQ ID NO: 456466 - RNA, 19 nt, Homo sapiens
gaaauugagagcacaaaca

SEQ ID NO: 456467 - RNA, 19 nt, Homo sapiens
caaagaacaagaggacaua

SEQ ID NO: 456468 - RNA, 19 nt, Homo sapiens
gaagaugaacaacaacaau

SEQ ID NO: 456469 - RNA, 19 nt, Homo sapiens
ucuaggccuuguauuaaua

SEQ ID NO: 456470 - RNA, 19 nt, Homo sapiens
gagcuggucuauggaaguu

SEQ ID NO: 456471 - RNA, 19 nt, Homo sapiens
gagaugaggcgucgauuag

SEQ ID NO: 456472 - RNA, 19 nt, Homo sapiens
ugacauugaucaagaugga

SEQ ID NO: 456473 - RNA, 19 nt, Homo sapiens
aauauacccuguaguuaga

SEQ ID NO: 456474 - RNA, 19 nt, Homo sapiens
gagucuagcuuuccuguac

SEQ ID NO: 456475 - RNA, 19 nt, Homo sapiens
guacuggagucuagcuuuc

SEQ ID NO: 456476 - RNA, 19 nt, Homo sapiens
gaagagcuggucuauggaa

SEQ ID NO: 456477 - RNA, 19 nt, Homo sapiens
ggaccaagcuggaugauga

SEQ ID NO: 456478 - RNA, 19 nt, Homo sapiens
ucaaagagauggagaagaa

SEQ ID NO: 456479 - RNA, 19 nt, Homo sapiens
gaugaugacuucaaagaga

SEQ ID NO: 456480 - RNA, 19 nt, Homo sapiens
gcaaggcgcuguacgacuu

SEQ ID NO: 456481 - RNA, 19 nt, Homo sapiens
gagaugagcacacagcuuu

SEQ ID NO: 456482 - RNA, 19 nt, Homo sapiens
caacuuuggugacgcauug

SEQ ID NO: 456483 - RNA, 19 nt, Homo sapiens
agaaagaccugaaggagau

SEQ ID NO: 456484 - RNA, 19 nt, Homo sapiens
gcaaggcggugacagaagu

SEQ ID NO: 456485 - RNA, 19 nt, Homo sapiens
gcccuaagcgggaguauaa

SEQ ID NO: 456486 - RNA, 19 nt, Homo sapiens
cgagccagcuggucaguga

SEQ ID NO: 456487 - RNA, 19 nt, Homo sapiens
ccaaccagaucgaugagaa

SEQ ID NO: 456488 - RNA, 19 nt, Homo sapiens
caagcuggaugaugacuuc

SEQ ID NO: 456489 - RNA, 19 nt, Homo sapiens
gcgcagagaugagcacaca

SEQ ID NO: 456490 - RNA, 19 nt, Homo sapiens
ccaaggagguggcagaaac

SEQ ID NO: 456491 - RNA, 19 nt, Homo sapiens
gcuggaugaugacuucaaa

SEQ ID NO: 456492 - RNA, 19 nt, Homo sapiens
gggcuaagcugaccaugcu

SEQ ID NO: 456493 - RNA, 19 nt, Homo sapiens
ugaaauguacgccugaauu

SEQ ID NO: 456494 - RNA, 19 nt, Homo sapiens
cgacaucugcuuccucuau

SEQ ID NO: 456495 - RNA, 19 nt, Homo sapiens
ccaaguaccuuuucagcuu

SEQ ID NO: 456496 - RNA, 19 nt, Homo sapiens
uggacgagcuggcggagaa

SEQ ID NO: 456497 - RNA, 19 nt, Homo sapiens
ggacuuugacuacaagaag

SEQ ID NO: 456498 - RNA, 19 nt, Homo sapiens
agagauaggacccugguuu

SEQ ID NO: 456499 - RNA, 19 nt, Homo sapiens
gacuuugacuacaagaaga

SEQ ID NO: 456500 - RNA, 19 nt, Homo sapiens
ggaugccuguuuacacuag

SEQ ID NO: 456501 - RNA, 19 nt, Homo sapiens
ugaccaaccagaucgauga

SEQ ID NO: 456502 - RNA, 19 nt, Homo sapiens
gagaagaagguggauguca

SEQ ID NO: 456503 - RNA, 19 nt, Homo sapiens
gaaggacucccuggacauc

SEQ ID NO: 456504 - RNA, 19 nt, Homo sapiens
gacaucugcuuccucuauc

SEQ ID NO: 456505 - RNA, 19 nt, Homo sapiens
gauaggacccugguuuuaa

SEQ ID NO: 456506 - RNA, 19 nt, Homo sapiens
acaucgaggucaagcagaa

SEQ ID NO: 456507 - RNA, 19 nt, Homo sapiens
gcgagaaagaccugaagga

SEQ ID NO: 456508 - RNA, 19 nt, Homo sapiens
ggucaagcagaacuucauu

SEQ ID NO: 456509 - RNA, 19 nt, Homo sapiens
cagggcaaacugaaaugua

SEQ ID NO: 456510 - RNA, 19 nt, Homo sapiens
ucagaaagccaaguaccuu

SEQ ID NO: 456511 - RNA, 19 nt, Homo sapiens
caaguaccuuuucagcuuu

SEQ ID NO: 456512 - RNA, 19 nt, Homo sapiens
ccagcaaggcggugacaga

SEQ ID NO: 456513 - RNA, 19 nt, Homo sapiens
gagcaggaccccacacuug

SEQ ID NO: 456514 - RNA, 19 nt, Homo sapiens
gcccucagaaagccaagua

SEQ ID NO: 456515 - RNA, 19 nt, Homo sapiens
cagcaaggcggugacagaa

SEQ ID NO: 456516 - RNA, 19 nt, Homo sapiens
gguccagggcaaacugaaa

SEQ ID NO: 456517 - RNA, 19 nt, Homo sapiens
gagauaggacccugguuuu

SEQ ID NO: 456518 - RNA, 19 nt, Homo sapiens
ccagccaucuccucuagac

SEQ ID NO: 456519 - RNA, 19 nt, Homo sapiens
uggaugaugacuucaaaga

SEQ ID NO: 456520 - RNA, 19 nt, Homo sapiens
gccuggacuuugacuacaa

SEQ ID NO: 456521 - RNA, 19 nt, Homo sapiens
uccagaaccugugcgagaa

SEQ ID NO: 456522 - RNA, 19 nt, Homo sapiens
ggguggggaugccuguuua

SEQ ID NO: 456523 - RNA, 19 nt, Homo sapiens
ggaugaugacuucaaagag

SEQ ID NO: 456524 - RNA, 19 nt, Homo sapiens
augcacagcuggacuacca

SEQ ID NO: 456525 - RNA, 19 nt, Homo sapiens
ccagaaccugugcgagaaa

SEQ ID NO: 456526 - RNA, 19 nt, Homo sapiens
gccaucuccucuagaccaa

SEQ ID NO: 456527 - RNA, 19 nt, Homo sapiens
ucaucacgcugaccaacca

SEQ ID NO: 456528 - RNA, 19 nt, Homo sapiens
ggagcccuuugaccuugga

SEQ ID NO: 456529 - RNA, 19 nt, Homo sapiens
agggcaaacugaaauguac

SEQ ID NO: 456530 - RNA, 19 nt, Homo sapiens
gggaugccuguuuacacua

SEQ ID NO: 456531 - RNA, 19 nt, Homo sapiens
uuuccgaucuuccgacaag

SEQ ID NO: 456532 - RNA, 19 nt, Homo sapiens
cagaaaccagcaugcacaa

SEQ ID NO: 456533 - RNA, 19 nt, Homo sapiens
cugagccgcugccacuuca

SEQ ID NO: 456534 - RNA, 19 nt, Homo sapiens
gcugcaaggcgcuguacga

SEQ ID NO: 456535 - RNA, 19 nt, Homo sapiens
gaacaaauaucuucacuuc

SEQ ID NO: 456536 - RNA, 19 nt, Homo sapiens
gaagagagcuuggagauga

SEQ ID NO: 456537 - RNA, 19 nt, Homo sapiens
gaagaaaucugguauccaa

SEQ ID NO: 456538 - RNA, 19 nt, Homo sapiens
gaaccaagcuagaugauga

SEQ ID NO: 456539 - RNA, 19 nt, Homo sapiens
ucaaagagauggaaaggaa

SEQ ID NO: 456540 - RNA, 19 nt, Homo sapiens
gaugaugacuucaaagaga

SEQ ID NO: 456541 - RNA, 19 nt, Homo sapiens
aggcaaaucuuacugcuua

SEQ ID NO: 456542 - RNA, 19 nt, Homo sapiens
ggagauggauauugaacaa

SEQ ID NO: 456543 - RNA, 19 nt, Homo sapiens
gaacaucauuugugcagau

SEQ ID NO: 456544 - RNA, 19 nt, Homo sapiens
ccaauucagucgcuacuuu

SEQ ID NO: 456545 - RNA, 19 nt, Homo sapiens
gcaaaacucuuucccaauu

SEQ ID NO: 456546 - RNA, 19 nt, Homo sapiens
ucaagaagcaguuccauaa

SEQ ID NO: 456547 - RNA, 19 nt, Homo sapiens
gaaggucucuuugcauuuc

SEQ ID NO: 456548 - RNA, 19 nt, Homo sapiens
guaaauaccuuuccuuucc

SEQ ID NO: 456549 - RNA, 19 nt, Homo sapiens
caagcuagaugaugacuuc

SEQ ID NO: 456550 - RNA, 19 nt, Homo sapiens
gaaagugagugagaagguu

SEQ ID NO: 456551 - RNA, 19 nt, Homo sapiens
gcaucgcuguuuccaauaa

SEQ ID NO: 456552 - RNA, 19 nt, Homo sapiens
gaauuugucucuuaaugca

SEQ ID NO: 456553 - RNA, 19 nt, Homo sapiens
ggagaugauugcaacuuug

SEQ ID NO: 456554 - RNA, 19 nt, Homo sapiens
caaauugucuccugaucug

SEQ ID NO: 456555 - RNA, 19 nt, Homo sapiens
acaaagaucuuagggaaau

SEQ ID NO: 456556 - RNA, 19 nt, Homo sapiens
gcuagaugaugacuucaaa

SEQ ID NO: 456557 - RNA, 19 nt, Homo sapiens
caaccuaaaccacgaauga

SEQ ID NO: 456558 - RNA, 19 nt, Homo sapiens
gagaaacaguaaauaccuu

SEQ ID NO: 456559 - RNA, 19 nt, Homo sapiens
gaaacgacaaggcaagauu

SEQ ID NO: 456560 - RNA, 19 nt, Homo sapiens
aaauauugcugaagacaga

SEQ ID NO: 456561 - RNA, 19 nt, Homo sapiens
ugaaaguccuguuagguau

SEQ ID NO: 456562 - RNA, 19 nt, Homo sapiens
gucaagcucuagagaaauu

SEQ ID NO: 456563 - RNA, 19 nt, Homo sapiens
gaacuucauugacccucuu

SEQ ID NO: 456564 - RNA, 19 nt, Homo sapiens
ucauggaauugucaaagua

SEQ ID NO: 456565 - RNA, 19 nt, Homo sapiens
aggaggcugugguuuauua

SEQ ID NO: 456566 - RNA, 19 nt, Homo sapiens
gaagggaauaucaaccuaa

SEQ ID NO: 456567 - RNA, 19 nt, Homo sapiens
cagaggccaugcucaaauu

SEQ ID NO: 456568 - RNA, 19 nt, Homo sapiens
ccagaguucuauuuaucua

SEQ ID NO: 456569 - RNA, 19 nt, Homo sapiens
acaaauaucuucacuucag

SEQ ID NO: 456570 - RNA, 19 nt, Homo sapiens
aaucugguauccaagcuua

SEQ ID NO: 456571 - RNA, 19 nt, Homo sapiens
ccauaaagccacucagaaa

SEQ ID NO: 456572 - RNA, 19 nt, Homo sapiens
gagugaaaggcaaaucuua

SEQ ID NO: 456573 - RNA, 19 nt, Homo sapiens
uguguaagcuuaucagugu

SEQ ID NO: 456574 - RNA, 19 nt, Homo sapiens
gcagggcugugauggaaau

SEQ ID NO: 456575 - RNA, 19 nt, Homo sapiens
ucaaugaggaccaaauaaa

SEQ ID NO: 456576 - RNA, 19 nt, Homo sapiens
ucucagcuccucacacuua

SEQ ID NO: 456577 - RNA, 19 nt, Homo sapiens
ucaaagcauucucugcaaa

SEQ ID NO: 456578 - RNA, 19 nt, Homo sapiens
uaaggaaauugcugaguca

SEQ ID NO: 456579 - RNA, 19 nt, Homo sapiens
aagcaucgcuguuuccaau

SEQ ID NO: 456580 - RNA, 19 nt, Homo sapiens
caccgaagauauugucuau

SEQ ID NO: 456581 - RNA, 19 nt, Homo sapiens
gauaucaucacacucacua

SEQ ID NO: 456582 - RNA, 19 nt, Homo sapiens
gaaauuugaugagucuaag

SEQ ID NO: 456583 - RNA, 19 nt, Homo sapiens
gaaggaaccaagcuagaug

SEQ ID NO: 456584 - RNA, 19 nt, Homo sapiens
gagagggacugaaaagaaa

SEQ ID NO: 456585 - RNA, 19 nt, Homo sapiens
cacugucccuucccaaaua

SEQ ID NO: 456586 - RNA, 19 nt, Homo sapiens
gcaagauuccggaugaaga

SEQ ID NO: 456587 - RNA, 19 nt, Homo sapiens
cuuaaugcauccauagaaa

SEQ ID NO: 456588 - RNA, 19 nt, Homo sapiens
ggaaauucaacaucaucua

SEQ ID NO: 456589 - RNA, 19 nt, Homo sapiens
aaagcauucucugcaaaua

SEQ ID NO: 456590 - RNA, 19 nt, Homo sapiens
cuccugaucugaaugaauu

SEQ ID NO: 456591 - RNA, 19 nt, Homo sapiens
caugagccauuucacagaa

SEQ ID NO: 456592 - RNA, 19 nt, Homo sapiens
gaaggggaguugggauuua

SEQ ID NO: 456593 - RNA, 19 nt, Homo sapiens
acauagaagugaagcagaa

SEQ ID NO: 456594 - RNA, 19 nt, Homo sapiens
gaaaggaaaguggauguca

SEQ ID NO: 456595 - RNA, 19 nt, Homo sapiens
caagaagcaguuccauaaa

SEQ ID NO: 456596 - RNA, 19 nt, Homo sapiens
cugaaggucucuuugcauu

SEQ ID NO: 456597 - RNA, 19 nt, Homo sapiens
ucaggaggcugugguuuau

SEQ ID NO: 456598 - RNA, 19 nt, Homo sapiens
ucacuaaccaaauugauga

SEQ ID NO: 456599 - RNA, 19 nt, Homo sapiens
uaagacaggcuucaucuca

SEQ ID NO: 456600 - RNA, 19 nt, Homo sapiens
guucauauacugagaaaca

SEQ ID NO: 456601 - RNA, 19 nt, Homo sapiens
guacgacuuugaaccugaa

SEQ ID NO: 456602 - RNA, 19 nt, Homo sapiens
gggcugugauggaaauaau

SEQ ID NO: 456603 - RNA, 19 nt, Homo sapiens
gaauaagacaggcuucauc

SEQ ID NO: 456604 - RNA, 19 nt, Homo sapiens
uuagggaaauucaacauca

SEQ ID NO: 456605 - RNA, 19 nt, Homo sapiens
uaccuuuccuuuccacuuu

SEQ ID NO: 456606 - RNA, 19 nt, Homo sapiens
uauuaaagccagagucgua

SEQ ID NO: 456607 - RNA, 19 nt, Homo sapiens
cagaacugcuguuuacaca

SEQ ID NO: 456608 - RNA, 19 nt, Homo sapiens
uggagaugauugcaacuuu

SEQ ID NO: 456609 - RNA, 19 nt, Homo sapiens
gcagaggccaugcucaaau

SEQ ID NO: 456610 - RNA, 19 nt, Homo sapiens
guauccagaguucuauuua

SEQ ID NO: 456611 - RNA, 19 nt, Homo sapiens
guauuuaggcuauucugaa

SEQ ID NO: 456612 - RNA, 19 nt, Homo sapiens
ucaguaagacaguuaauca

SEQ ID NO: 456613 - RNA, 19 nt, Homo sapiens
cuaaccaaauugaugagaa

SEQ ID NO: 456614 - RNA, 19 nt, Homo sapiens
cacacucacuaaccaaauu

SEQ ID NO: 456615 - RNA, 19 nt, Homo sapiens
ucuuggagauggauauuga

SEQ ID NO: 456616 - RNA, 19 nt, Homo sapiens
gguauccaagcuuaaauuu

SEQ ID NO: 456617 - RNA, 19 nt, Homo sapiens
caucucagcuccucacacu

SEQ ID NO: 456618 - RNA, 19 nt, Homo sapiens
ccacaggagucauggugau

SEQ ID NO: 456619 - RNA, 19 nt, Homo sapiens
aagggaauaucaaccuaaa

SEQ ID NO: 456620 - RNA, 19 nt, Homo sapiens
ucagaaucuucaugacaaa

SEQ ID NO: 456621 - RNA, 19 nt, Homo sapiens
gcuaagcucagcaugauca

SEQ ID NO: 456622 - RNA, 19 nt, Homo sapiens
caguaaauaccuuuccuuu

SEQ ID NO: 456623 - RNA, 19 nt, Homo sapiens
uaaagagggcgauaucauc

SEQ ID NO: 456624 - RNA, 19 nt, Homo sapiens
gaaugagccuggaguuucc

SEQ ID NO: 456625 - RNA, 19 nt, Homo sapiens
cgaaugagccuggaguuuc

SEQ ID NO: 456626 - RNA, 19 nt, Homo sapiens
agaagggaauaucaaccua

SEQ ID NO: 456627 - RNA, 19 nt, Homo sapiens
aagaagcaguuccauaaag

SEQ ID NO: 456628 - RNA, 19 nt, Homo sapiens
ucaagcauguucaaucucu

SEQ ID NO: 456629 - RNA, 19 nt, Homo sapiens
ucgucaagcucuagagaaa

SEQ ID NO: 456630 - RNA, 19 nt, Homo sapiens
caacaucaucuaaagaagu

SEQ ID NO: 456631 - RNA, 19 nt, Homo sapiens
caaauaucuucacuucagu

SEQ ID NO: 456632 - RNA, 19 nt, Homo sapiens
ugacuuugguugacuugug

SEQ ID NO: 456633 - RNA, 19 nt, Homo sapiens
caaugcugcuuauaacaca

SEQ ID NO: 456634 - RNA, 19 nt, Homo sapiens
ggucagacuggaagaaaga

SEQ ID NO: 456635 - RNA, 19 nt, Homo sapiens
gaacuaaacuagacgauga

SEQ ID NO: 456636 - RNA, 19 nt, Homo sapiens
caacagcuauuuagugaaa

SEQ ID NO: 456637 - RNA, 19 nt, Homo sapiens
gaaagaagcauguuuaacu

SEQ ID NO: 456638 - RNA, 19 nt, Homo sapiens
gcaguuaugucaacgaaug

SEQ ID NO: 456639 - RNA, 19 nt, Homo sapiens
caaggagaauuaggauuua

SEQ ID NO: 456640 - RNA, 19 nt, Homo sapiens
gaaacgaguagguaagaua

SEQ ID NO: 456641 - RNA, 19 nt, Homo sapiens
gcuaauggcugaggugaaa

SEQ ID NO: 456642 - RNA, 19 nt, Homo sapiens
caauaaaguuguugcagaa

SEQ ID NO: 456643 - RNA, 19 nt, Homo sapiens
ccauaaagcuaaaggaaga

SEQ ID NO: 456644 - RNA, 19 nt, Homo sapiens
ccaguuggcuguguucaua

SEQ ID NO: 456645 - RNA, 19 nt, Homo sapiens
gacgacagguucuaacauu

SEQ ID NO: 456646 - RNA, 19 nt, Homo sapiens
guucauagaggcagcauua

SEQ ID NO: 456647 - RNA, 19 nt, Homo sapiens
gggacuguaugcugaaaua

SEQ ID NO: 456648 - RNA, 19 nt, Homo sapiens
gcugaaagaagcauguuua

SEQ ID NO: 456649 - RNA, 19 nt, Homo sapiens
ccaaggagaauuaggauuu

SEQ ID NO: 456650 - RNA, 19 nt, Homo sapiens
gugaauagcccaauaaaca

SEQ ID NO: 456651 - RNA, 19 nt, Homo sapiens
aaauaagucucacccauug

SEQ ID NO: 456652 - RNA, 19 nt, Homo sapiens
gaucgggcaucaccugaaa

SEQ ID NO: 456653 - RNA, 19 nt, Homo sapiens
uaugugugcucucuuuaua

SEQ ID NO: 456654 - RNA, 19 nt, Homo sapiens
caaaggaguuggcugaaag

SEQ ID NO: 456655 - RNA, 19 nt, Homo sapiens
uaagauaccagacgaagaa

SEQ ID NO: 456656 - RNA, 19 nt, Homo sapiens
ugaggacucucuuaaauca

SEQ ID NO: 456657 - RNA, 19 nt, Homo sapiens
ggacauacuuucguaacug

SEQ ID NO: 456658 - RNA, 19 nt, Homo sapiens
gaagaagcaguuccacaaa

SEQ ID NO: 456659 - RNA, 19 nt, Homo sapiens
cagcugcaaugaaauggua

SEQ ID NO: 456660 - RNA, 19 nt, Homo sapiens
gggauaauaugcaaucaag

SEQ ID NO: 456661 - RNA, 19 nt, Homo sapiens
aaucuuugcugggauaaua

SEQ ID NO: 456662 - RNA, 19 nt, Homo sapiens
gugaauaccuacacgugaa

SEQ ID NO: 456663 - RNA, 19 nt, Homo sapiens
aaacugguaugaaggaaug

SEQ ID NO: 456664 - RNA, 19 nt, Homo sapiens
cccaacagcuauuuaguga

SEQ ID NO: 456665 - RNA, 19 nt, Homo sapiens
agaaggagcuuuuaaguga

SEQ ID NO: 456666 - RNA, 19 nt, Homo sapiens
cuaaucaugucagugaaua

SEQ ID NO: 456667 - RNA, 19 nt, Homo sapiens
ggauguggguccugcagaa

SEQ ID NO: 456668 - RNA, 19 nt, Homo sapiens
gacauacuuucguaacuga

SEQ ID NO: 456669 - RNA, 19 nt, Homo sapiens
ccacaaagccagccaguag

SEQ ID NO: 456670 - RNA, 19 nt, Homo sapiens
ucagugcgguguucuguga

SEQ ID NO: 456671 - RNA, 19 nt, Homo sapiens
gauagaaguuggugaaucc

SEQ ID NO: 456672 - RNA, 19 nt, Homo sapiens
gaagugaucgugccuuuac

SEQ ID NO: 456673 - RNA, 19 nt, Homo sapiens
gcagugucauaaacauuga

SEQ ID NO: 456674 - RNA, 19 nt, Homo sapiens
uaaccagucuuucauggau

SEQ ID NO: 456675 - RNA, 19 nt, Homo sapiens
ucaaaggaguuggcugaaa

SEQ ID NO: 456676 - RNA, 19 nt, Homo sapiens
augaauggauggaaucuuu

SEQ ID NO: 456677 - RNA, 19 nt, Homo sapiens
ugaccaacuuaaugacuuu

SEQ ID NO: 456678 - RNA, 19 nt, Homo sapiens
gauguuaccaauaaaguug

SEQ ID NO: 456679 - RNA, 19 nt, Homo sapiens
guucuaacauucccaugga

SEQ ID NO: 456680 - RNA, 19 nt, Homo sapiens
ccacuucaguuacuacaag

SEQ ID NO: 456681 - RNA, 19 nt, Homo sapiens
ggaaggagcucggggaaga

SEQ ID NO: 456682 - RNA, 19 nt, Homo sapiens
gacgaugaauuucuugaca

SEQ ID NO: 456683 - RNA, 19 nt, Homo sapiens
ugaaggaacuaaacuagac

SEQ ID NO: 456684 - RNA, 19 nt, Homo sapiens
gaauagcccaauaaacaug

SEQ ID NO: 456685 - RNA, 19 nt, Homo sapiens
ugaagaagcaguuccacaa

SEQ ID NO: 456686 - RNA, 19 nt, Homo sapiens
gaugaaaacugguaugaag

SEQ ID NO: 456687 - RNA, 19 nt, Homo sapiens
uaggaaugcugaacacugu

SEQ ID NO: 456688 - RNA, 19 nt, Homo sapiens
gaggcugguucuuggguuu

SEQ ID NO: 456689 - RNA, 19 nt, Homo sapiens
ggaagugaucgugccuuua

SEQ ID NO: 456690 - RNA, 19 nt, Homo sapiens
aaacucaagcugcaccaua

SEQ ID NO: 456691 - RNA, 19 nt, Homo sapiens
gugaauccaugaagcuaau

SEQ ID NO: 456692 - RNA, 19 nt, Homo sapiens
gaaguuggugaauccauga

SEQ ID NO: 456693 - RNA, 19 nt, Homo sapiens
cgaugaauuucuugacaug

SEQ ID NO: 456694 - RNA, 19 nt, Homo sapiens
gguaacauuugaaacuaag

SEQ ID NO: 456695 - RNA, 19 nt, Homo sapiens
uggaaucuuugcugggaua

SEQ ID NO: 456696 - RNA, 19 nt, Homo sapiens
aacacaaacucuggacaua

SEQ ID NO: 456697 - RNA, 19 nt, Homo sapiens
uggaagugaucgugccuuu

SEQ ID NO: 456698 - RNA, 19 nt, Homo sapiens
gucaacgaauggccuauau

SEQ ID NO: 456699 - RNA, 19 nt, Homo sapiens
uaaaagagaucgggcauca

SEQ ID NO: 456700 - RNA, 19 nt, Homo sapiens
aauaaguggugcugaagga

SEQ ID NO: 456701 - RNA, 19 nt, Homo sapiens
aacucaagcugcaccauaa

SEQ ID NO: 456702 - RNA, 19 nt, Homo sapiens
gcagagcaagcuacagaug

SEQ ID NO: 456703 - RNA, 19 nt, Homo sapiens
ucaugucagugaauaccua

SEQ ID NO: 456704 - RNA, 19 nt, Homo sapiens
uuccucagcugcaaugaaa

SEQ ID NO: 456705 - RNA, 19 nt, Homo sapiens
gacauccuuugcucucuga

SEQ ID NO: 456706 - RNA, 19 nt, Homo sapiens
uuaauuacguggaagugau

SEQ ID NO: 456707 - RNA, 19 nt, Homo sapiens
ggacaucauuacauuaacc

SEQ ID NO: 456708 - RNA, 19 nt, Homo sapiens
caagcuaauaggugccuua

SEQ ID NO: 456709 - RNA, 19 nt, Homo sapiens
gauaauaugcaaucaagcu

SEQ ID NO: 456710 - RNA, 19 nt, Homo sapiens
gagcagugucauaaacauu

SEQ ID NO: 456711 - RNA, 19 nt, Homo sapiens
aaaccaaggagaauuagga

SEQ ID NO: 456712 - RNA, 19 nt, Homo sapiens
ucaccauguuggccaauau

SEQ ID NO: 456713 - RNA, 19 nt, Homo sapiens
ccgccuggauuacgauuau

SEQ ID NO: 456714 - RNA, 19 nt, Homo sapiens
ugugugcucucuuuauaau

SEQ ID NO: 456715 - RNA, 19 nt, Homo sapiens
gguguucugugacauccuu

SEQ ID NO: 456716 - RNA, 19 nt, Homo sapiens
cacaaacucuggacauacu

SEQ ID NO: 456717 - RNA, 19 nt, Homo sapiens
ugaauuucuugacauggaa

SEQ ID NO: 456718 - RNA, 19 nt, Homo sapiens
ggaaugauacacggagaau

SEQ ID NO: 456719 - RNA, 19 nt, Homo sapiens
ggagaauuaggauuuaaag

SEQ ID NO: 456720 - RNA, 19 nt, Homo sapiens
ggacucucuuaaaucagaa

SEQ ID NO: 456721 - RNA, 19 nt, Homo sapiens
ccaauaaacaugacacacu

SEQ ID NO: 456722 - RNA, 19 nt, Homo sapiens
cugaugacgucuggucuuu

SEQ ID NO: 456723 - RNA, 19 nt, Homo sapiens
ugugcucucuuuauaaugu

SEQ ID NO: 456724 - RNA, 19 nt, Homo sapiens
caaacucuggacauacuuu

SEQ ID NO: 456725 - RNA, 19 nt, Homo sapiens
uagaacaagucagccaguu

SEQ ID NO: 456726 - RNA, 19 nt, Homo sapiens
gaauaucuucagccaaauc

SEQ ID NO: 456727 - RNA, 19 nt, Homo sapiens
auugaggacucucuuaaau

SEQ ID NO: 456728 - RNA, 19 nt, Homo sapiens
uaacacaaacucuggacau

SEQ ID NO: 456729 - RNA, 19 nt, Homo sapiens
ggugaauccaugaagcuaa

SEQ ID NO: 456730 - RNA, 19 nt, Homo sapiens
guuaugaggcugguucuug

SEQ ID NO: 456731 - RNA, 19 nt, Homo sapiens
acuagacgaugaauuucuu

SEQ ID NO: 456732 - RNA, 19 nt, Homo sapiens
ucucugaccaacuuaauga

SEQ ID NO: 456733 - RNA, 19 nt, Homo sapiens
guagugaagacgacagguu

SEQ ID NO: 456734 - RNA, 19 nt, Homo sapiens
cacagacaguccacagaga

SEQ ID NO: 456735 - RNA, 19 nt, Homo sapiens
gcauaaagguauccaguua

SEQ ID NO: 456736 - RNA, 19 nt, Homo sapiens
gcaagaaacugcucaacaa

SEQ ID NO: 456737 - RNA, 19 nt, Homo sapiens
ccaaguggcuaaacaagua

SEQ ID NO: 456738 - RNA, 19 nt, Homo sapiens
ggagagugcuggcuacaug

SEQ ID NO: 456739 - RNA, 19 nt, Homo sapiens
agaaugcuguugccacuua

SEQ ID NO: 456740 - RNA, 19 nt, Homo sapiens
ccagaaagcuacccaucaa

SEQ ID NO: 456741 - RNA, 19 nt, Homo sapiens
agaaugaucucaagagcaa

SEQ ID NO: 456742 - RNA, 19 nt, Homo sapiens
gacagagccuggagacuug

SEQ ID NO: 456743 - RNA, 19 nt, Homo sapiens
gcacuugucccuccucuau

SEQ ID NO: 456744 - RNA, 19 nt, Homo sapiens
gaccugcccugcucuguga

SEQ ID NO: 456745 - RNA, 19 nt, Homo sapiens
gaccauagccgaugacuac

SEQ ID NO: 456746 - RNA, 19 nt, Homo sapiens
agaaacugcucaacaagug

SEQ ID NO: 456747 - RNA, 19 nt, Homo sapiens
cacagaggaucaugacaga

SEQ ID NO: 456748 - RNA, 19 nt, Homo sapiens
cuacucagaucccuuugau

SEQ ID NO: 456749 - RNA, 19 nt, Homo sapiens
ugacagagccuggagacuu

SEQ ID NO: 456750 - RNA, 19 nt, Homo sapiens
cggaagucauccacuacua

SEQ ID NO: 456751 - RNA, 19 nt, Homo sapiens
cauagccgaugacuacuca

SEQ ID NO: 456752 - RNA, 19 nt, Homo sapiens
aaagguauccaguuauaug

SEQ ID NO: 456753 - RNA, 19 nt, Homo sapiens
cuggaggccuggauaaaga

SEQ ID NO: 456754 - RNA, 19 nt, Homo sapiens
ugacuacucagaucccuuu

SEQ ID NO: 456755 - RNA, 19 nt, Homo sapiens
caaaggggcugagcacuug

SEQ ID NO: 456756 - RNA, 19 nt, Homo sapiens
gaagucauccacuacuaca

SEQ ID NO: 456757 - RNA, 19 nt, Homo sapiens
gguauccaguuauaugaca

SEQ ID NO: 456758 - RNA, 19 nt, Homo sapiens
gaaggacaaggugaccaua

SEQ ID NO: 456759 - RNA, 19 nt, Homo sapiens
uggagaagcaaauauggua

SEQ ID NO: 456760 - RNA, 19 nt, Homo sapiens
gaggaucaugacagaauuu

SEQ ID NO: 456761 - RNA, 19 nt, Homo sapiens
gaaagcuacccaucaaagg

SEQ ID NO: 456762 - RNA, 19 nt, Homo sapiens
gaaccugaaggccaaagug

SEQ ID NO: 456763 - RNA, 19 nt, Homo sapiens
gcacaugaaacuggccaaa

SEQ ID NO: 456764 - RNA, 19 nt, Homo sapiens
cagaggaucaugacagaau

SEQ ID NO: 456765 - RNA, 19 nt, Homo sapiens
gcucgucgcugcgcaaacu

SEQ ID NO: 456766 - RNA, 19 nt, Homo sapiens
ggagaagcaaauaugguau

SEQ ID NO: 456767 - RNA, 19 nt, Homo sapiens
gcagaggagacgccgagaa

SEQ ID NO: 456768 - RNA, 19 nt, Homo sapiens
agaggaucaugacagaauu

SEQ ID NO: 456769 - RNA, 19 nt, Homo sapiens
guugcuggcugugucguuu

SEQ ID NO: 456770 - RNA, 19 nt, Homo sapiens
gaaacuggccaaaaccaaa

SEQ ID NO: 456771 - RNA, 19 nt, Homo sapiens
gaucaugacagaauuucag

SEQ ID NO: 456772 - RNA, 19 nt, Homo sapiens
gccgaugacuacucagauc

SEQ ID NO: 456773 - RNA, 19 nt, Homo sapiens
ggcaagaaacugcucaaca

SEQ ID NO: 456774 - RNA, 19 nt, Homo sapiens
ggaagucauccacuacuac

SEQ ID NO: 456775 - RNA, 19 nt, Homo sapiens
agaagcaaauaugguauca

SEQ ID NO: 456776 - RNA, 19 nt, Homo sapiens
gagaagcaaauaugguauc

SEQ ID NO: 456777 - RNA, 19 nt, Homo sapiens
ccugaaggccaaaguguug

SEQ ID NO: 456778 - RNA, 19 nt, Homo sapiens
ucccggaagucauccacua

SEQ ID NO: 456779 - RNA, 19 nt, Homo sapiens
ggaacagccagaccagcaa

SEQ ID NO: 456780 - RNA, 19 nt, Homo sapiens
ggucccagcauaaagguau

SEQ ID NO: 456781 - RNA, 19 nt, Homo sapiens
gggcuggaggccuggauaa

SEQ ID NO: 456782 - RNA, 19 nt, Homo sapiens
ggcgcgagauuccuagcuu

SEQ ID NO: 456783 - RNA, 19 nt, Homo sapiens
ggcaacagcaagaccaaga

SEQ ID NO: 456784 - RNA, 19 nt, Homo sapiens
caagcaccgccucaucaaa

SEQ ID NO: 456785 - RNA, 19 nt, Homo sapiens
ccaagaaugaucucaagag

SEQ ID NO: 456786 - RNA, 19 nt, Homo sapiens
uaaacaaguacuucagcuu

SEQ ID NO: 456787 - RNA, 19 nt, Homo sapiens
caagaaacugcucaacaag

SEQ ID NO: 456788 - RNA, 19 nt, Homo sapiens
cuacaccaccagaaagcua

SEQ ID NO: 456789 - RNA, 19 nt, Homo sapiens
ccaaaaccaaagagaaaua

SEQ ID NO: 456790 - RNA, 19 nt, Homo sapiens
ccuuugaugccaagaauga

SEQ ID NO: 456791 - RNA, 19 nt, Homo sapiens
ccacugcaugucucuagaa

SEQ ID NO: 456792 - RNA, 19 nt, Homo sapiens
cagaaagcuacccaucaaa

SEQ ID NO: 456793 - RNA, 19 nt, Homo sapiens
ccaagcaccgccucaucaa

SEQ ID NO: 456794 - RNA, 19 nt, Homo sapiens
aaacaugggagcccugagu

SEQ ID NO: 456795 - RNA, 19 nt, Homo sapiens
gcccuggcagcacaguuua

SEQ ID NO: 456796 - RNA, 19 nt, Homo sapiens
ccgaggacgccgagaaguu

SEQ ID NO: 456797 - RNA, 19 nt, Homo sapiens
caagagcaaagcaggaaag

SEQ ID NO: 456798 - RNA, 19 nt, Homo sapiens
cgaggacgccgagaaguuc

SEQ ID NO: 456799 - RNA, 19 nt, Homo sapiens
agaaagcuacccaucaaag

SEQ ID NO: 456800 - RNA, 19 nt, Homo sapiens
ggccaaaaccaaagagaaa

SEQ ID NO: 456801 - RNA, 19 nt, Homo sapiens
gcuacauggagcccuauga

SEQ ID NO: 456802 - RNA, 19 nt, Homo sapiens
gcuggaggccuggauaaag

SEQ ID NO: 456803 - RNA, 19 nt, Homo sapiens
gaaugcuguugccacuuac

SEQ ID NO: 456804 - RNA, 19 nt, Homo sapiens
ucguuuguguuguguguau

SEQ ID NO: 456805 - RNA, 19 nt, Homo sapiens
aaccaaagagaaauacguu

SEQ ID NO: 456806 - RNA, 19 nt, Homo sapiens
gagaaccugcugcgacucu

SEQ ID NO: 456807 - RNA, 19 nt, Homo sapiens
ugccaagaaugaucucaag

SEQ ID NO: 456808 - RNA, 19 nt, Homo sapiens
gcccuccguucgacagugu

SEQ ID NO: 456809 - RNA, 19 nt, Homo sapiens
aguguccggucccagcaua

SEQ ID NO: 456810 - RNA, 19 nt, Homo sapiens
cagaggagacgccgagaac

SEQ ID NO: 456811 - RNA, 19 nt, Homo sapiens
gcaacagcaagaccaagag

SEQ ID NO: 456812 - RNA, 19 nt, Homo sapiens
gaggcacagaggaucauga

SEQ ID NO: 456813 - RNA, 19 nt, Homo sapiens
gcacugacgcuucccauua

SEQ ID NO: 456814 - RNA, 19 nt, Homo sapiens
gaacagaagccaugagauc

SEQ ID NO: 456815 - RNA, 19 nt, Homo sapiens
cagaagcugugauguagaa

SEQ ID NO: 456816 - RNA, 19 nt, Homo sapiens
gaacccaucuuggcucagu

SEQ ID NO: 456817 - RNA, 19 nt, Homo sapiens
cacugacgcuucccauuaa

SEQ ID NO: 456818 - RNA, 19 nt, Homo sapiens
caaacgccaucccaucaug

SEQ ID NO: 456819 - RNA, 19 nt, Homo sapiens
ggacaaacaggccgagauc

SEQ ID NO: 456820 - RNA, 19 nt, Homo sapiens
ccucagaagcugugaugua

SEQ ID NO: 456821 - RNA, 19 nt, Homo sapiens
ggacucaggcagaauucaa

SEQ ID NO: 456822 - RNA, 19 nt, Homo sapiens
ggacccagagggagugauu

SEQ ID NO: 456823 - RNA, 19 nt, Homo sapiens
caccagagaacccaucuug

SEQ ID NO: 456824 - RNA, 19 nt, Homo sapiens
agccaagggucgaagauga

SEQ ID NO: 456825 - RNA, 19 nt, Homo sapiens
caaacaggccgagaucuca

SEQ ID NO: 456826 - RNA, 19 nt, Homo sapiens
aaggaugacugguuuaugc

SEQ ID NO: 456827 - RNA, 19 nt, Homo sapiens
ccuuugaccucaccaagau

SEQ ID NO: 456828 - RNA, 19 nt, Homo sapiens
gagccuaucgcugucauga

SEQ ID NO: 456829 - RNA, 19 nt, Homo sapiens
auaccaacccuaaggauga

SEQ ID NO: 456830 - RNA, 19 nt, Homo sapiens
agauccaacugcacaauca

SEQ ID NO: 456831 - RNA, 19 nt, Homo sapiens
cccuaaggaugacugguuu

SEQ ID NO: 456832 - RNA, 19 nt, Homo sapiens
gcaauggcccaggacaaga

SEQ ID NO: 456833 - RNA, 19 nt, Homo sapiens
gcaaacgccaucccaucau

SEQ ID NO: 456834 - RNA, 19 nt, Homo sapiens
cucagaagcugugauguag

SEQ ID NO: 456835 - RNA, 19 nt, Homo sapiens
gaauggccuuugggcacaa

SEQ ID NO: 456836 - RNA, 19 nt, Homo sapiens
gccaagggucgaagaugaa

SEQ ID NO: 456837 - RNA, 19 nt, Homo sapiens
gaagcugugauguagaauc

SEQ ID NO: 456838 - RNA, 19 nt, Homo sapiens
ggaccacggcuggaugaug

SEQ ID NO: 456839 - RNA, 19 nt, Homo sapiens
cggcaggccugagauccaa

SEQ ID NO: 456840 - RNA, 19 nt, Homo sapiens
ccagguggaagucaagaug

SEQ ID NO: 456841 - RNA, 19 nt, Homo sapiens
ucgcugucaugaccuuuga

SEQ ID NO: 456842 - RNA, 19 nt, Homo sapiens
gcugguuccugcccuggau

SEQ ID NO: 456843 - RNA, 19 nt, Homo sapiens
gagauccaacugcacaauc

SEQ ID NO: 456844 - RNA, 19 nt, Homo sapiens
cagggacucaggcagaauu

SEQ ID NO: 456845 - RNA, 19 nt, Homo sapiens
gagccaagggucgaagaug

SEQ ID NO: 456846 - RNA, 19 nt, Homo sapiens
gggauaccaacccuaagga

SEQ ID NO: 456847 - RNA, 19 nt, Homo sapiens
auuccuggcuggacaaaca

SEQ ID NO: 456848 - RNA, 19 nt, Homo sapiens
ggauaccaacccuaaggau

SEQ ID NO: 456849 - RNA, 19 nt, Homo sapiens
aaaaggugguguugucuuc

SEQ ID NO: 456850 - RNA, 19 nt, Homo sapiens
aaacgccaucccaucauga

SEQ ID NO: 456851 - RNA, 19 nt, Homo sapiens
cuaaggaugacugguuuau

SEQ ID NO: 456852 - RNA, 19 nt, Homo sapiens
ccuaaggaugacugguuua

SEQ ID NO: 456853 - RNA, 19 nt, Homo sapiens
cagcaauggcccaggacaa

SEQ ID NO: 456854 - RNA, 19 nt, Homo sapiens
aaaccuccuccuccuuuga

SEQ ID NO: 456855 - RNA, 19 nt, Homo sapiens
gaaagugucagucaccuua

SEQ ID NO: 456856 - RNA, 19 nt, Homo sapiens
uaacugggaucgcaccuuu

SEQ ID NO: 456857 - RNA, 19 nt, Homo sapiens
uaacugggaucgcaccuuu

SEQ ID NO: 456858 - RNA, 19 nt, Homo sapiens
gaugaucccuccuauguca

SEQ ID NO: 456859 - RNA, 19 nt, Homo sapiens
ccaaagacccugugaauca

SEQ ID NO: 456860 - RNA, 19 nt, Homo sapiens
ggaguaaccugaaauuugc

SEQ ID NO: 456861 - RNA, 19 nt, Homo sapiens
gacaaucacuugcccauca

SEQ ID NO: 456862 - RNA, 19 nt, Homo sapiens
gaccacaccuggccaguau

SEQ ID NO: 456863 - RNA, 19 nt, Homo sapiens
ucagagagccugccacauu

SEQ ID NO: 456864 - RNA, 19 nt, Homo sapiens
gaguugcgcuucaaacaau

SEQ ID NO: 456865 - RNA, 19 nt, Homo sapiens
ugaggcagaugaaauuuau

SEQ ID NO: 456866 - RNA, 19 nt, Homo sapiens
gaccaucaguacuauaaug

SEQ ID NO: 456867 - RNA, 19 nt, Homo sapiens
caugcaaucuaucucauuu

SEQ ID NO: 456868 - RNA, 19 nt, Homo sapiens
cacgggagcuuugucaaua

SEQ ID NO: 456869 - RNA, 19 nt, Homo sapiens
ccacgggucucacuuauac

SEQ ID NO: 456870 - RNA, 19 nt, Homo sapiens
ucagucaccuuaucagcua

SEQ ID NO: 456871 - RNA, 19 nt, Homo sapiens
cauaccaucuguagaguug

SEQ ID NO: 456872 - RNA, 19 nt, Homo sapiens
gacuaaggaucaccgcuuu

SEQ ID NO: 456873 - RNA, 19 nt, Homo sapiens
ggugagugcuugucaugga

SEQ ID NO: 456874 - RNA, 19 nt, Homo sapiens
caggauggcuggcuuugau

SEQ ID NO: 456875 - RNA, 19 nt, Homo sapiens
gcauugagacuauaaagca

SEQ ID NO: 456876 - RNA, 19 nt, Homo sapiens
ccacauggacaaucacuug

SEQ ID NO: 456877 - RNA, 19 nt, Homo sapiens
cagagagccugccacauuc

SEQ ID NO: 456878 - RNA, 19 nt, Homo sapiens
ggaggaguaaccugaaauu

SEQ ID NO: 456879 - RNA, 19 nt, Homo sapiens
guuuaaacuuugugccuuu

SEQ ID NO: 456880 - RNA, 19 nt, Homo sapiens
ccucugggcuucaggguau

SEQ ID NO: 456881 - RNA, 19 nt, Homo sapiens
caaucuaucucauuugcau

SEQ ID NO: 456882 - RNA, 19 nt, Homo sapiens
gcagaagucagcccgaaug

SEQ ID NO: 456883 - RNA, 19 nt, Homo sapiens
gcuaccacauggacaauca

SEQ ID NO: 456884 - RNA, 19 nt, Homo sapiens
ccgaguaugucgccuaugu

SEQ ID NO: 456885 - RNA, 19 nt, Homo sapiens
ccagagaccugaggcagau

SEQ ID NO: 456886 - RNA, 19 nt, Homo sapiens
ccgaaugccugucaguuuc

SEQ ID NO: 456887 - RNA, 19 nt, Homo sapiens
ccagagaccugaggcagau

SEQ ID NO: 456888 - RNA, 19 nt, Homo sapiens
ccacauaccaucuguagag

SEQ ID NO: 456889 - RNA, 19 nt, Homo sapiens
gaaggugagugcuugucau

SEQ ID NO: 456890 - RNA, 19 nt, Homo sapiens
ggaacugcauucuuuuaaa

SEQ ID NO: 456891 - RNA, 19 nt, Homo sapiens
gauaugcaacccuuagaga

SEQ ID NO: 456892 - RNA, 19 nt, Homo sapiens
ccagaaguccgcaaacaga

SEQ ID NO: 456893 - RNA, 19 nt, Homo sapiens
gugggcagccuaagcauuu

SEQ ID NO: 456894 - RNA, 19 nt, Homo sapiens
uagcauggacucuggguuu

SEQ ID NO: 456895 - RNA, 19 nt, Homo sapiens
acaauccacuccggaauga

SEQ ID NO: 456896 - RNA, 19 nt, Homo sapiens
ccaucagucugguguguga

SEQ ID NO: 456897 - RNA, 19 nt, Homo sapiens
ugagcacccucuccgguuu

SEQ ID NO: 456898 - RNA, 19 nt, Homo sapiens
cuauaaagcaguagacaau

SEQ ID NO: 456899 - RNA, 19 nt, Homo sapiens
gcagcgaacugugucuaca

SEQ ID NO: 456900 - RNA, 19 nt, Homo sapiens
ggaccuguuugacaugaag

SEQ ID NO: 456901 - RNA, 19 nt, Homo sapiens
gaguaugucgccuauguug

SEQ ID NO: 456902 - RNA, 19 nt, Homo sapiens
ggaaugccaaucacucuca

SEQ ID NO: 456903 - RNA, 19 nt, Homo sapiens
ccugaaauuugcuggaaug

SEQ ID NO: 456904 - RNA, 19 nt, Homo sapiens
gaauuugggccucuuguac

SEQ ID NO: 456905 - RNA, 19 nt, Homo sapiens
ccacuugggagcuacauug

SEQ ID NO: 456906 - RNA, 19 nt, Homo sapiens
gaggaguaaccugaaauuu

SEQ ID NO: 456907 - RNA, 19 nt, Homo sapiens
gggucucacuuauaccaaa

SEQ ID NO: 456908 - RNA, 19 nt, Homo sapiens
ucaguacuauaaugacuuc

SEQ ID NO: 456909 - RNA, 19 nt, Homo sapiens
ccacuacccugugcuccuu

SEQ ID NO: 456910 - RNA, 19 nt, Homo sapiens
gggaugaggaggaggaaga

SEQ ID NO: 456911 - RNA, 19 nt, Homo sapiens
aggaguaaccugaaauuug

SEQ ID NO: 456912 - RNA, 19 nt, Homo sapiens
ggaccucguuugggagugu

SEQ ID NO: 456913 - RNA, 19 nt, Homo sapiens
ucgccuauguugccaaaga

SEQ ID NO: 456914 - RNA, 19 nt, Homo sapiens
ccacaugcaaucuaucuca

SEQ ID NO: 456915 - RNA, 19 nt, Homo sapiens
gaccugaggcagaugaaau

SEQ ID NO: 456916 - RNA, 19 nt, Homo sapiens
uaaaguccguauuucuucu

SEQ ID NO: 456917 - RNA, 19 nt, Homo sapiens
gaccugaggcagaugaaau

SEQ ID NO: 456918 - RNA, 19 nt, Homo sapiens
aagaugcccuccaauccuu

SEQ ID NO: 456919 - RNA, 19 nt, Homo sapiens
caaagacccugugaaucag

SEQ ID NO: 456920 - RNA, 19 nt, Homo sapiens
uuccauugcuuauucuuga

SEQ ID NO: 456921 - RNA, 19 nt, Homo sapiens
cuagcgcucucuuccagaa

SEQ ID NO: 456922 - RNA, 19 nt, Homo sapiens
ucauuaaaguccguauuuc

SEQ ID NO: 456923 - RNA, 19 nt, Homo sapiens
uaugcaacccuuagagauu

SEQ ID NO: 456924 - RNA, 19 nt, Homo sapiens
ggugacaggcccaguggaa

SEQ ID NO: 456925 - RNA, 19 nt, Homo sapiens
gaagaugcccuccaauccu

SEQ ID NO: 456926 - RNA, 19 nt, Homo sapiens
cagaagaugcccuccaauc

SEQ ID NO: 456927 - RNA, 19 nt, Homo sapiens
gagcggaaacugugaucug

SEQ ID NO: 456928 - RNA, 19 nt, Homo sapiens
aaggaucaccgcuuugaaa

SEQ ID NO: 456929 - RNA, 19 nt, Homo sapiens
aaccugcaguuccugagua

SEQ ID NO: 456930 - RNA, 19 nt, Homo sapiens
ucugggaccuguguucuug

SEQ ID NO: 456931 - RNA, 19 nt, Homo sapiens
gugagugcuugucauggaa

SEQ ID NO: 456932 - RNA, 19 nt, Homo sapiens
ccaauccuuuccacccuau

SEQ ID NO: 456933 - RNA, 19 nt, Homo sapiens
uuauuuccaucuaggacua

SEQ ID NO: 456934 - RNA, 19 nt, Homo sapiens
caucaguacuauaaugacu

SEQ ID NO: 456935 - RNA, 19 nt, Homo sapiens
gccuaggccugugagguaa

SEQ ID NO: 456936 - RNA, 19 nt, Homo sapiens
aagggagaguugaccguuu

SEQ ID NO: 456937 - RNA, 19 nt, Homo sapiens
gccuaggccugugagguaa

SEQ ID NO: 456938 - RNA, 19 nt, Homo sapiens
gagaaaaggggcauugaga

SEQ ID NO: 456939 - RNA, 19 nt, Homo sapiens
ugaauuugggccucuugua

SEQ ID NO: 456940 - RNA, 19 nt, Homo sapiens
cgccuaggccugugaggua

SEQ ID NO: 456941 - RNA, 19 nt, Homo sapiens
uuacagcucuuggcauuuu

SEQ ID NO: 456942 - RNA, 19 nt, Homo sapiens
cgccuaggccugugaggua

SEQ ID NO: 456943 - RNA, 19 nt, Homo sapiens
uuacagcucuuggcauuuu

SEQ ID NO: 456944 - RNA, 19 nt, Homo sapiens
cuacuugguucgguacaug

SEQ ID NO: 456945 - RNA, 19 nt, Homo sapiens
ggcuuggccuugugucaga

SEQ ID NO: 456946 - RNA, 19 nt, Homo sapiens
uccagaagaugcccuccaa

SEQ ID NO: 456947 - RNA, 19 nt, Homo sapiens
acgggagcuuugucaauaa

SEQ ID NO: 456948 - RNA, 19 nt, Homo sapiens
cuaaggaucaccgcuuuga

SEQ ID NO: 456949 - RNA, 19 nt, Homo sapiens
ggaagagccaccugaccau

SEQ ID NO: 456950 - RNA, 19 nt, Homo sapiens
gaucgcaccuuuuauacca

SEQ ID NO: 456951 - RNA, 19 nt, Homo sapiens
gaucgcaccuuuuauacca

SEQ ID NO: 456952 - RNA, 19 nt, Homo sapiens
uugagacuauaaagcagua

SEQ ID NO: 456953 - RNA, 19 nt, Homo sapiens
ccacgggagcuuugucaau

SEQ ID NO: 456954 - RNA, 19 nt, Homo sapiens
gggcugcuagacuuacuuu

SEQ ID NO: 456955 - RNA, 19 nt, Homo sapiens
ggaugcagcuagaggauga

SEQ ID NO: 456956 - RNA, 19 nt, Homo sapiens
guugagacaugcuacaauu

SEQ ID NO: 456957 - RNA, 19 nt, Homo sapiens
gagugaaggugucucagaa

SEQ ID NO: 456958 - RNA, 19 nt, Homo sapiens
ggaugauucucuguacaua

SEQ ID NO: 456959 - RNA, 19 nt, Homo sapiens
gaaggaggcacaaggaaga

SEQ ID NO: 456960 - RNA, 19 nt, Homo sapiens
gaggugaacuguguggauu

SEQ ID NO: 456961 - RNA, 19 nt, Homo sapiens
gaagagaguaugggaagaa

SEQ ID NO: 456962 - RNA, 19 nt, Homo sapiens
gcagucagaugcccuggau

SEQ ID NO: 456963 - RNA, 19 nt, Homo sapiens
gggaagauuggcauucaua

SEQ ID NO: 456964 - RNA, 19 nt, Homo sapiens
ugaggacguuugccacuuu

SEQ ID NO: 456965 - RNA, 19 nt, Homo sapiens
gcuaucagcccauuacuca

SEQ ID NO: 456966 - RNA, 19 nt, Homo sapiens
ggaagauuggcauucauaa

SEQ ID NO: 456967 - RNA, 19 nt, Homo sapiens
ccuggagggugcagugaua

SEQ ID NO: 456968 - RNA, 19 nt, Homo sapiens
guacucggcucaugaacag

SEQ ID NO: 456969 - RNA, 19 nt, Homo sapiens
gcccauuacucagcucuuu

SEQ ID NO: 456970 - RNA, 19 nt, Homo sapiens
gauuggcauucauaagauu

SEQ ID NO: 456971 - RNA, 19 nt, Homo sapiens
ugacagggacggcuuguug

SEQ ID NO: 456972 - RNA, 19 nt, Homo sapiens
guacauaucccaggcuaau

SEQ ID NO: 456973 - RNA, 19 nt, Homo sapiens
ggaagagaguaugggaaga

SEQ ID NO: 456974 - RNA, 19 nt, Homo sapiens
ggugcuggaugucauguau

SEQ ID NO: 456975 - RNA, 19 nt, Homo sapiens
gcaccuucacugucaagua

SEQ ID NO: 456976 - RNA, 19 nt, Homo sapiens
gggcaaggcggaagaggaa

SEQ ID NO: 456977 - RNA, 19 nt, Homo sapiens
gcucccaccuucccagaug

SEQ ID NO: 456978 - RNA, 19 nt, Homo sapiens
gagaguaugggaagaagga

SEQ ID NO: 456979 - RNA, 19 nt, Homo sapiens
gcaccagcguccggaaaug

SEQ ID NO: 456980 - RNA, 19 nt, Homo sapiens
gaacuguguggauugcaaa

SEQ ID NO: 456981 - RNA, 19 nt, Homo sapiens
ggagaggcccauccuauac

SEQ ID NO: 456982 - RNA, 19 nt, Homo sapiens
ucaggcaccuugcacuaga

SEQ ID NO: 456983 - RNA, 19 nt, Homo sapiens
ccacagguuccuccuacua

SEQ ID NO: 456984 - RNA, 19 nt, Homo sapiens
caaagggaacccagcaguu

SEQ ID NO: 456985 - RNA, 19 nt, Homo sapiens
uuacucagcucuuuuguga

SEQ ID NO: 456986 - RNA, 19 nt, Homo sapiens
gaagauuggcauucauaag

SEQ ID NO: 456987 - RNA, 19 nt, Homo sapiens
aagauuggcauucauaaga

SEQ ID NO: 456988 - RNA, 19 nt, Homo sapiens
acauaucccaggcuaauuu

SEQ ID NO: 456989 - RNA, 19 nt, Homo sapiens
cuuuggagcuuaccagaga

SEQ ID NO: 456990 - RNA, 19 nt, Homo sapiens
gcucaggcaccuugcacua

SEQ ID NO: 456991 - RNA, 19 nt, Homo sapiens
gugggcagcugaugacaca

SEQ ID NO: 456992 - RNA, 19 nt, Homo sapiens
caaguacucggcucaugaa

SEQ ID NO: 456993 - RNA, 19 nt, Homo sapiens
gaggaugauucucuguaca

SEQ ID NO: 456994 - RNA, 19 nt, Homo sapiens
cagcaguucugagugaguu

SEQ ID NO: 456995 - RNA, 19 nt, Homo sapiens
agccagaccucacccuuga

SEQ ID NO: 456996 - RNA, 19 nt, Homo sapiens
uggagaggcccauccuaua

SEQ ID NO: 456997 - RNA, 19 nt, Homo sapiens
gcacaaggaagagaguaug

SEQ ID NO: 456998 - RNA, 19 nt, Homo sapiens
ucaaguacucggcucauga

SEQ ID NO: 456999 - RNA, 19 nt, Homo sapiens
caacucgcauauuguuagu

SEQ ID NO: 457000 - RNA, 19 nt, Homo sapiens
gaggacguuugccacuuug

SEQ ID NO: 457001 - RNA, 19 nt, Homo sapiens
caccuucacugucaaguac

SEQ ID NO: 457002 - RNA, 19 nt, Homo sapiens
gaaaggugaggcugccaau

SEQ ID NO: 457003 - RNA, 19 nt, Homo sapiens
ucuaugcugcccugucuua

SEQ ID NO: 457004 - RNA, 19 nt, Homo sapiens
cgagucugguccauugcua

SEQ ID NO: 457005 - RNA, 19 nt, Homo sapiens
ugaacuguguggauugcaa

SEQ ID NO: 457006 - RNA, 19 nt, Homo sapiens
aaguggagaugcagucaga

SEQ ID NO: 457007 - RNA, 19 nt, Homo sapiens
caggcuggcuguugagaca

SEQ ID NO: 457008 - RNA, 19 nt, Homo sapiens
ggccuugcgucccuguuug

SEQ ID NO: 457009 - RNA, 19 nt, Homo sapiens
ggccaacucgcauauuguu

SEQ ID NO: 457010 - RNA, 19 nt, Homo sapiens
cuucccagaugguuccuuu

SEQ ID NO: 457011 - RNA, 19 nt, Homo sapiens
cauccuauaccccuuauua

SEQ ID NO: 457012 - RNA, 19 nt, Homo sapiens
gaugauucucuguacauau

SEQ ID NO: 457013 - RNA, 19 nt, Homo sapiens
ccugggacuuuggagcuua

SEQ ID NO: 457014 - RNA, 19 nt, Homo sapiens
gcagcuagaggaugauucu

SEQ ID NO: 457015 - RNA, 19 nt, Homo sapiens
ggaggugaacuguguggau

SEQ ID NO: 457016 - RNA, 19 nt, Homo sapiens
ccaacucgcauauuguuag

SEQ ID NO: 457017 - RNA, 19 nt, Homo sapiens
gugaaggugucucagaacu

SEQ ID NO: 457018 - RNA, 19 nt, Homo sapiens
gagaggggauucugcugaa

SEQ ID NO: 457019 - RNA, 19 nt, Homo sapiens
ugaccagugucccagugaa

SEQ ID NO: 457020 - RNA, 19 nt, Homo sapiens
agauuggcauucauaagau

SEQ ID NO: 457021 - RNA, 19 nt, Homo sapiens
cuggccaacucgcauauug

SEQ ID NO: 457022 - RNA, 19 nt, Homo sapiens
ggacguuugccacuuugug

SEQ ID NO: 457023 - RNA, 19 nt, Homo sapiens
cgagugaaggugucucaga

SEQ ID NO: 457024 - RNA, 19 nt, Homo sapiens
gggaaggaggcacaaggaa

SEQ ID NO: 457025 - RNA, 19 nt, Homo sapiens
acccagcaguucugaguga

SEQ ID NO: 457026 - RNA, 19 nt, Homo sapiens
gggccuugcgucccuguuu

SEQ ID NO: 457027 - RNA, 19 nt, Homo sapiens
uacacaccauccagacuga

SEQ ID NO: 457028 - RNA, 19 nt, Homo sapiens
gccaacucgcauauuguua

SEQ ID NO: 457029 - RNA, 19 nt, Homo sapiens
ccagugaaggaacgaguga

SEQ ID NO: 457030 - RNA, 19 nt, Homo sapiens
cagggaaaccagcuacuca

SEQ ID NO: 457031 - RNA, 19 nt, Homo sapiens
gauggugccagcuugaauc

SEQ ID NO: 457032 - RNA, 19 nt, Homo sapiens
augauucucuguacauauc

SEQ ID NO: 457033 - RNA, 19 nt, Homo sapiens
aaggugaggcugccaauag

SEQ ID NO: 457034 - RNA, 19 nt, Homo sapiens
augcugcccugucuuacaa

SEQ ID NO: 457035 - RNA, 19 nt, Homo sapiens
ccaguuccguccagauggu

SEQ ID NO: 457036 - RNA, 19 nt, Homo sapiens
gagacaugcuacaauuuuc

SEQ ID NO: 457037 - RNA, 19 nt, Homo sapiens
gaaaccaagaaagagcaaa

SEQ ID NO: 457038 - RNA, 19 nt, Homo sapiens
ucucuaugcugcccugucu

SEQ ID NO: 457039 - RNA, 19 nt, Homo sapiens
ccauugcuaucagcccauu

SEQ ID NO: 457040 - RNA, 19 nt, Homo sapiens
ccagauggugccagcuuga

SEQ ID NO: 457041 - RNA, 19 nt, Homo sapiens
ugaaggaacgagugaaggu

SEQ ID NO: 457042 - RNA, 19 nt, Homo sapiens
gcacuagaggcuucugacu

SEQ ID NO: 457043 - RNA, 19 nt, Homo sapiens
acaccuauguucgcuacug

SEQ ID NO: 457044 - RNA, 19 nt, Homo sapiens
caacagugggcagcugaug

SEQ ID NO: 457045 - RNA, 19 nt, Homo sapiens
gagaaucugggaccucaac

SEQ ID NO: 457046 - RNA, 19 nt, Homo sapiens
gucaaguacucggcucaug

SEQ ID NO: 457047 - RNA, 19 nt, Homo sapiens
ggcaugaugaggacguuug

SEQ ID NO: 457048 - RNA, 19 nt, Homo sapiens
ugagacaugcuacaauuuu

SEQ ID NO: 457049 - RNA, 19 nt, Homo sapiens
gaugggaagauuggcauuc

SEQ ID NO: 457050 - RNA, 19 nt, Homo sapiens
guggagaugcagucagaug

SEQ ID NO: 457051 - RNA, 19 nt, Homo sapiens
ggcagcugaugacacacuu

SEQ ID NO: 457052 - RNA, 19 nt, Homo sapiens
gugcuggccaacucgcaua

SEQ ID NO: 457053 - RNA, 19 nt, Homo sapiens
gggaagaucuccagaaacu

SEQ ID NO: 457054 - RNA, 19 nt, Homo sapiens
gcucggaagucaucaguuc

SEQ ID NO: 457055 - RNA, 19 nt, Homo sapiens
aagggaagaucuccagaaa

SEQ ID NO: 457056 - RNA, 19 nt, Homo sapiens
gaagggaagaucuccagaa

SEQ ID NO: 457057 - RNA, 19 nt, Homo sapiens
gaagggaaagcgcaagaga

SEQ ID NO: 457058 - RNA, 19 nt, Homo sapiens
cagcugcucuaccaaauag

SEQ ID NO: 457059 - RNA, 19 nt, Homo sapiens
ggacagcucggaagucauc

SEQ ID NO: 457060 - RNA, 19 nt, Homo sapiens
gcagcugcucuaccaaaua

SEQ ID NO: 457061 - RNA, 19 nt, Homo sapiens
cgagaugucugcugcuagu

SEQ ID NO: 457062 - RNA, 19 nt, Homo sapiens
gugcacagcgugacccuaa

SEQ ID NO: 457063 - RNA, 19 nt, Homo sapiens
cagaaacuccgagcgauuu

SEQ ID NO: 457064 - RNA, 19 nt, Homo sapiens
gaaacuccgagcgauuuaa

SEQ ID NO: 457065 - RNA, 19 nt, Homo sapiens
cggacaggcugaugacuca

SEQ ID NO: 457066 - RNA, 19 nt, Homo sapiens
acagcgacuuccucacuuu

SEQ ID NO: 457067 - RNA, 19 nt, Homo sapiens
gguguaaggacaaguugaa

SEQ ID NO: 457068 - RNA, 19 nt, Homo sapiens
ggcgagaugucugcugcua

SEQ ID NO: 457069 - RNA, 19 nt, Homo sapiens
ccgcgcaccugcucuuugu

SEQ ID NO: 457070 - RNA, 19 nt, Homo sapiens
aggacaaguugaacgcuuu

SEQ ID NO: 457071 - RNA, 19 nt, Homo sapiens
ggagcggacaggcugauga

SEQ ID NO: 457072 - RNA, 19 nt, Homo sapiens
ccagaaacuccgagcgauu

SEQ ID NO: 457073 - RNA, 19 nt, Homo sapiens
gcggucaaguccagcugaa

SEQ ID NO: 457074 - RNA, 19 nt, Homo sapiens
ggacaaguugaacgcuuug

SEQ ID NO: 457075 - RNA, 19 nt, Homo sapiens
ccaguggccaggagugaaa

SEQ ID NO: 457076 - RNA, 19 nt, Homo sapiens
agaaacuccgagcgauuua

SEQ ID NO: 457077 - RNA, 19 nt, Homo sapiens
uuacaaccccgacaucaua

SEQ ID NO: 457078 - RNA, 19 nt, Homo sapiens
gaagguaugaagggaagau

SEQ ID NO: 457079 - RNA, 19 nt, Homo sapiens
ucuccucgcugcugguaug

SEQ ID NO: 457080 - RNA, 19 nt, Homo sapiens
aggagucucugcacuacga

SEQ ID NO: 457081 - RNA, 19 nt, Homo sapiens
cgaagauggccaccacuca

SEQ ID NO: 457082 - RNA, 19 nt, Homo sapiens
gguacucgcagcugcucua

SEQ ID NO: 457083 - RNA, 19 nt, Homo sapiens
cgacaucauauuuaaggau

SEQ ID NO: 457084 - RNA, 19 nt, Homo sapiens
agggaaagcgcaagagaga

SEQ ID NO: 457085 - RNA, 19 nt, Homo sapiens
acucgcagcugcucuacca

SEQ ID NO: 457086 - RNA, 19 nt, Homo sapiens
uacagcgacuuccucacuu

SEQ ID NO: 457087 - RNA, 19 nt, Homo sapiens
gggcaccauucucaucaac

SEQ ID NO: 457088 - RNA, 19 nt, Homo sapiens
cuacagcgacuuccucacu

SEQ ID NO: 457089 - RNA, 19 nt, Homo sapiens
ucgacuggguguacuacga

SEQ ID NO: 457090 - RNA, 19 nt, Homo sapiens
gagguguaaggacaaguug

SEQ ID NO: 457091 - RNA, 19 nt, Homo sapiens
gcaaagagauucuguacaa

SEQ ID NO: 457092 - RNA, 19 nt, Homo sapiens
ggacugaguuuauugauga

SEQ ID NO: 457093 - RNA, 19 nt, Homo sapiens
gaacugaauuagcuucuga

SEQ ID NO: 457094 - RNA, 19 nt, Homo sapiens
gggcaaagcuguuagaaag

SEQ ID NO: 457095 - RNA, 19 nt, Homo sapiens
ucacguagcugaagugcaa

SEQ ID NO: 457096 - RNA, 19 nt, Homo sapiens
cagaaugucuacaagaauu

SEQ ID NO: 457097 - RNA, 19 nt, Homo sapiens
acagugauguugagguuua

SEQ ID NO: 457098 - RNA, 19 nt, Homo sapiens
gcaaagcuguuagaaagau

SEQ ID NO: 457099 - RNA, 19 nt, Homo sapiens
gcccuaggcucuugcuuaa

SEQ ID NO: 457100 - RNA, 19 nt, Homo sapiens
ggacauaauucuaggaaaa

SEQ ID NO: 457101 - RNA, 19 nt, Homo sapiens
gagcuggcaugaucuucua

SEQ ID NO: 457102 - RNA, 19 nt, Homo sapiens
ccacguccaucuucuuuga

SEQ ID NO: 457103 - RNA, 19 nt, Homo sapiens
ccaaaggagaacugaauua

SEQ ID NO: 457104 - RNA, 19 nt, Homo sapiens
ucauuuagaugguggugua

SEQ ID NO: 457105 - RNA, 19 nt, Homo sapiens
cuaugacucuggaauuuaa

SEQ ID NO: 457106 - RNA, 19 nt, Homo sapiens
cacagaaugucuacaagaa

SEQ ID NO: 457107 - RNA, 19 nt, Homo sapiens
gaaagauuguagcguuuua

SEQ ID NO: 457108 - RNA, 19 nt, Homo sapiens
gggaggagguugagagcuu

SEQ ID NO: 457109 - RNA, 19 nt, Homo sapiens
gagccacccugaaagaguu

SEQ ID NO: 457110 - RNA, 19 nt, Homo sapiens
ugacggagcugggcuacaa

SEQ ID NO: 457111 - RNA, 19 nt, Homo sapiens
gucaguagcucaaaguaug

SEQ ID NO: 457112 - RNA, 19 nt, Homo sapiens
ucucacagcuggacauaau

SEQ ID NO: 457113 - RNA, 19 nt, Homo sapiens
gagcuucgccucucucuuc

SEQ ID NO: 457114 - RNA, 19 nt, Homo sapiens
aaaguaugguguagaaaug

SEQ ID NO: 457115 - RNA, 19 nt, Homo sapiens
gagaggaaaugcccauguc

SEQ ID NO: 457116 - RNA, 19 nt, Homo sapiens
uagaaagauuguagcguuu

SEQ ID NO: 457117 - RNA, 19 nt, Homo sapiens
guaauucugggacagguua

SEQ ID NO: 457118 - RNA, 19 nt, Homo sapiens
uggagucucuuaucaauuc

SEQ ID NO: 457119 - RNA, 19 nt, Homo sapiens
ggagaacgcacgccucuuc

SEQ ID NO: 457120 - RNA, 19 nt, Homo sapiens
ccuaggcucuugcuuaaau

SEQ ID NO: 457121 - RNA, 19 nt, Homo sapiens
guauguuagucaagaguaa

SEQ ID NO: 457122 - RNA, 19 nt, Homo sapiens
caaaguaugguguagaaau

SEQ ID NO: 457123 - RNA, 19 nt, Homo sapiens
gcacugaagcaagcuauga

SEQ ID NO: 457124 - RNA, 19 nt, Homo sapiens
uaucaauucugcuguguuc

SEQ ID NO: 457125 - RNA, 19 nt, Homo sapiens
uacggaagauugcagauga

SEQ ID NO: 457126 - RNA, 19 nt, Homo sapiens
agacagugauguugagguu

SEQ ID NO: 457127 - RNA, 19 nt, Homo sapiens
ccaacucccucccguaauc

SEQ ID NO: 457128 - RNA, 19 nt, Homo sapiens
caaagacagugauguugag

SEQ ID NO: 457129 - RNA, 19 nt, Homo sapiens
aaucagaaguguauguuag

SEQ ID NO: 457130 - RNA, 19 nt, Homo sapiens
gcuaugacucuggaauuua

SEQ ID NO: 457131 - RNA, 19 nt, Homo sapiens
ggaaaggagugaaaagugu

SEQ ID NO: 457132 - RNA, 19 nt, Homo sapiens
gacagguuauuaaaggauu

SEQ ID NO: 457133 - RNA, 19 nt, Homo sapiens
caaagcuguuagaaagauu

SEQ ID NO: 457134 - RNA, 19 nt, Homo sapiens
gagguuuacaacaucauua

SEQ ID NO: 457135 - RNA, 19 nt, Homo sapiens
aaugucaccuucccaaaga

SEQ ID NO: 457136 - RNA, 19 nt, Homo sapiens
gggacugaguuuauugaug

SEQ ID NO: 457137 - RNA, 19 nt, Homo sapiens
gaagauugcagaugagaac

SEQ ID NO: 457138 - RNA, 19 nt, Homo sapiens
gauacuggcuacaucaacu

SEQ ID NO: 457139 - RNA, 19 nt, Homo sapiens
ggcccuaggcucuugcuua

SEQ ID NO: 457140 - RNA, 19 nt, Homo sapiens
ucauuaagaaggagaguaa

SEQ ID NO: 457141 - RNA, 19 nt, Homo sapiens
gagcugggcuacaaaauag

SEQ ID NO: 457142 - RNA, 19 nt, Homo sapiens
caaaggagaacugaauuag

SEQ ID NO: 457143 - RNA, 19 nt, Homo sapiens
aauacuaugucgccacuug

SEQ ID NO: 457144 - RNA, 19 nt, Homo sapiens
uggccugccugacuucuaa

SEQ ID NO: 457145 - RNA, 19 nt, Homo sapiens
gcucuugcuuaaauaacaa

SEQ ID NO: 457146 - RNA, 19 nt, Homo sapiens
ccacagaaugucuacaaga

SEQ ID NO: 457147 - RNA, 19 nt, Homo sapiens
guaaaucagaaguguaugu

SEQ ID NO: 457148 - RNA, 19 nt, Homo sapiens
ggucauaaucauuuagaug

SEQ ID NO: 457149 - RNA, 19 nt, Homo sapiens
uaaauuugaaccuggcuuu

SEQ ID NO: 457150 - RNA, 19 nt, Homo sapiens
guuuaagucucauuguuag

SEQ ID NO: 457151 - RNA, 19 nt, Homo sapiens
ugacaaccauuugauccuu

SEQ ID NO: 457152 - RNA, 19 nt, Homo sapiens
aaggagaacugaauuagcu

SEQ ID NO: 457153 - RNA, 19 nt, Homo sapiens
guaaucaggaagccaaaug

SEQ ID NO: 457154 - RNA, 19 nt, Homo sapiens
ccuggagucucuuaucaau

SEQ ID NO: 457155 - RNA, 19 nt, Homo sapiens
caagaugcacccaguaugg

SEQ ID NO: 457156 - RNA, 19 nt, Homo sapiens
agaaguguauguuagucaa

SEQ ID NO: 457157 - RNA, 19 nt, Homo sapiens
ccacuuggucauaaucauu

SEQ ID NO: 457158 - RNA, 19 nt, Homo sapiens
caucuucuuugaaucuaug

SEQ ID NO: 457159 - RNA, 19 nt, Homo sapiens
cucaaaguaugguguagaa

SEQ ID NO: 457160 - RNA, 19 nt, Homo sapiens
ggacagguuauuaaaggau

SEQ ID NO: 457161 - RNA, 19 nt, Homo sapiens
guagcccacuuuauucaca

SEQ ID NO: 457162 - RNA, 19 nt, Homo sapiens
ccucaaagacagugauguu

SEQ ID NO: 457163 - RNA, 19 nt, Homo sapiens
caaaugucaccuucccaaa

SEQ ID NO: 457164 - RNA, 19 nt, Homo sapiens
aaacaagaugcacccagua

SEQ ID NO: 457165 - RNA, 19 nt, Homo sapiens
gggacagguuauuaaagga

SEQ ID NO: 457166 - RNA, 19 nt, Homo sapiens
ggagcugggcuacaaaaua

SEQ ID NO: 457167 - RNA, 19 nt, Homo sapiens
gcaugaucuucuacaggaa

SEQ ID NO: 457168 - RNA, 19 nt, Homo sapiens
cccgaaaccuggaauaugc

SEQ ID NO: 457169 - RNA, 19 nt, Homo sapiens
cuggcuacaucaacuauga

SEQ ID NO: 457170 - RNA, 19 nt, Homo sapiens
ugaggcuucugcuguaaau

SEQ ID NO: 457171 - RNA, 19 nt, Homo sapiens
cuacaggaaaggagugaaa

SEQ ID NO: 457172 - RNA, 19 nt, Homo sapiens
cuaggcucuugcuuaaaua

SEQ ID NO: 457173 - RNA, 19 nt, Homo sapiens
gagcccugcaggccuauaa

SEQ ID NO: 457174 - RNA, 19 nt, Homo sapiens
ggaagauugcagaugagaa

SEQ ID NO: 457175 - RNA, 19 nt, Homo sapiens
uugaaucuaugcccuacaa

SEQ ID NO: 457176 - RNA, 19 nt, Homo sapiens
ugggacagguuauuaaagg

SEQ ID NO: 457177 - RNA, 19 nt, Homo sapiens
uggcgggacugaguuuauu

SEQ ID NO: 457178 - RNA, 19 nt, Homo sapiens
gccaaaggagaacugaauu

SEQ ID NO: 457179 - RNA, 19 nt, Homo sapiens
ugucgccacuuggucauaa

SEQ ID NO: 457180 - RNA, 19 nt, Homo sapiens
guccucacaugacaagaug

SEQ ID NO: 457181 - RNA, 19 nt, Homo sapiens
gggcugagaaggugcuaga

SEQ ID NO: 457182 - RNA, 19 nt, Homo sapiens
aaacuuugcuguguacacu

SEQ ID NO: 457183 - RNA, 19 nt, Homo sapiens
caccugagauaaccaacuc

SEQ ID NO: 457184 - RNA, 19 nt, Homo sapiens
gaaagaguucaaggagaga

SEQ ID NO: 457185 - RNA, 19 nt, Homo sapiens
aaccuggagucucuuauca

SEQ ID NO: 457186 - RNA, 19 nt, Homo sapiens
caagacuggcaaagagauu

SEQ ID NO: 457187 - RNA, 19 nt, Homo sapiens
acaacaucauuaagaagga

SEQ ID NO: 457188 - RNA, 19 nt, Homo sapiens
cugauugccucggagaauu

SEQ ID NO: 457189 - RNA, 19 nt, Homo sapiens
gaaccagugcaaugacgau

SEQ ID NO: 457190 - RNA, 19 nt, Homo sapiens
gcacaaccccucaaagaca

SEQ ID NO: 457191 - RNA, 19 nt, Homo sapiens
ggacugaguuuauugauga

SEQ ID NO: 457192 - RNA, 19 nt, Homo sapiens
gaacugaauuagcuucuga

SEQ ID NO: 457193 - RNA, 19 nt, Homo sapiens
gggcaaagcuguuagaaag

SEQ ID NO: 457194 - RNA, 19 nt, Homo sapiens
ucacguagcugaagugcaa

SEQ ID NO: 457195 - RNA, 19 nt, Homo sapiens
cagaaugucuacaagaauu

SEQ ID NO: 457196 - RNA, 19 nt, Homo sapiens
acagugauguugagguuua

SEQ ID NO: 457197 - RNA, 19 nt, Homo sapiens
gcaaagcuguuagaaagau

SEQ ID NO: 457198 - RNA, 19 nt, Homo sapiens
gcccuaggcucuugcuuaa

SEQ ID NO: 457199 - RNA, 19 nt, Homo sapiens
ggacauaauucuaggaaaa

SEQ ID NO: 457200 - RNA, 19 nt, Homo sapiens
gagcuggcaugaucuucua

SEQ ID NO: 457201 - RNA, 19 nt, Homo sapiens
ccacguccaucuucuuuga

SEQ ID NO: 457202 - RNA, 19 nt, Homo sapiens
ccaaaggagaacugaauua

SEQ ID NO: 457203 - RNA, 19 nt, Homo sapiens
ucauuuagaugguggugua

SEQ ID NO: 457204 - RNA, 19 nt, Homo sapiens
cuaugacucuggaauuuaa

SEQ ID NO: 457205 - RNA, 19 nt, Homo sapiens
cacagaaugucuacaagaa

SEQ ID NO: 457206 - RNA, 19 nt, Homo sapiens
gaaagauuguagcguuuua

SEQ ID NO: 457207 - RNA, 19 nt, Homo sapiens
gggaggagguugagagcuu

SEQ ID NO: 457208 - RNA, 19 nt, Homo sapiens
gagccacccugaaagaguu

SEQ ID NO: 457209 - RNA, 19 nt, Homo sapiens
ugacggagcugggcuacaa

SEQ ID NO: 457210 - RNA, 19 nt, Homo sapiens
gucaguagcucaaaguaug

SEQ ID NO: 457211 - RNA, 19 nt, Homo sapiens
ucucacagcuggacauaau

SEQ ID NO: 457212 - RNA, 19 nt, Homo sapiens
gagcuucgccucucucuuc

SEQ ID NO: 457213 - RNA, 19 nt, Homo sapiens
aaaguaugguguagaaaug

SEQ ID NO: 457214 - RNA, 19 nt, Homo sapiens
gagaggaaaugcccauguc

SEQ ID NO: 457215 - RNA, 19 nt, Homo sapiens
uagaaagauuguagcguuu

SEQ ID NO: 457216 - RNA, 19 nt, Homo sapiens
guaauucugggacagguua

SEQ ID NO: 457217 - RNA, 19 nt, Homo sapiens
ggagaacgcacgccucuuc

SEQ ID NO: 457218 - RNA, 19 nt, Homo sapiens
ccuaggcucuugcuuaaau

SEQ ID NO: 457219 - RNA, 19 nt, Homo sapiens
guauguuagucaagaguaa

SEQ ID NO: 457220 - RNA, 19 nt, Homo sapiens
caaaguaugguguagaaau

SEQ ID NO: 457221 - RNA, 19 nt, Homo sapiens
gcacugaagcaagcuauga

SEQ ID NO: 457222 - RNA, 19 nt, Homo sapiens
uacggaagauugcagauga

SEQ ID NO: 457223 - RNA, 19 nt, Homo sapiens
agacagugauguugagguu

SEQ ID NO: 457224 - RNA, 19 nt, Homo sapiens
ccaacucccucccguaauc

SEQ ID NO: 457225 - RNA, 19 nt, Homo sapiens
aaucagaaguguauguuag

SEQ ID NO: 457226 - RNA, 19 nt, Homo sapiens
gcuaugacucuggaauuua

SEQ ID NO: 457227 - RNA, 19 nt, Homo sapiens
caaagacagugauguugag

SEQ ID NO: 457228 - RNA, 19 nt, Homo sapiens
gacagguuauuaaaggauu

SEQ ID NO: 457229 - RNA, 19 nt, Homo sapiens
caaagcuguuagaaagauu

SEQ ID NO: 457230 - RNA, 19 nt, Homo sapiens
gagguuuacaacaucauua

SEQ ID NO: 457231 - RNA, 19 nt, Homo sapiens
aaugucaccuucccaaaga

SEQ ID NO: 457232 - RNA, 19 nt, Homo sapiens
gggacugaguuuauugaug

SEQ ID NO: 457233 - RNA, 19 nt, Homo sapiens
gaagauugcagaugagaac

SEQ ID NO: 457234 - RNA, 19 nt, Homo sapiens
gauacuggcuacaucaacu

SEQ ID NO: 457235 - RNA, 19 nt, Homo sapiens
ggcccuaggcucuugcuua

SEQ ID NO: 457236 - RNA, 19 nt, Homo sapiens
ucauuaagaaggagaguaa

SEQ ID NO: 457237 - RNA, 19 nt, Homo sapiens
gagcugggcuacaaaauag

SEQ ID NO: 457238 - RNA, 19 nt, Homo sapiens
caaaggagaacugaauuag

SEQ ID NO: 457239 - RNA, 19 nt, Homo sapiens
aauacuaugucgccacuug

SEQ ID NO: 457240 - RNA, 19 nt, Homo sapiens
uggccugccugacuucuaa

SEQ ID NO: 457241 - RNA, 19 nt, Homo sapiens
gcucuugcuuaaauaacaa

SEQ ID NO: 457242 - RNA, 19 nt, Homo sapiens
ccacagaaugucuacaaga

SEQ ID NO: 457243 - RNA, 19 nt, Homo sapiens
guaaaucagaaguguaugu

SEQ ID NO: 457244 - RNA, 19 nt, Homo sapiens
ggucauaaucauuuagaug

SEQ ID NO: 457245 - RNA, 19 nt, Homo sapiens
uaaauuugaaccuggcuuu

SEQ ID NO: 457246 - RNA, 19 nt, Homo sapiens
guuuaagucucauuguuag

SEQ ID NO: 457247 - RNA, 19 nt, Homo sapiens
ugacaaccauuugauccuu

SEQ ID NO: 457248 - RNA, 19 nt, Homo sapiens
aaggagaacugaauuagcu

SEQ ID NO: 457249 - RNA, 19 nt, Homo sapiens
guaaucaggaagccaaaug

SEQ ID NO: 457250 - RNA, 19 nt, Homo sapiens
caagaugcacccaguaugg

SEQ ID NO: 457251 - RNA, 19 nt, Homo sapiens
agaaguguauguuagucaa

SEQ ID NO: 457252 - RNA, 19 nt, Homo sapiens
ccacuuggucauaaucauu

SEQ ID NO: 457253 - RNA, 19 nt, Homo sapiens
caucuucuuugaaucuaug

SEQ ID NO: 457254 - RNA, 19 nt, Homo sapiens
ccucaaagacagugauguu

SEQ ID NO: 457255 - RNA, 19 nt, Homo sapiens
cucaaaguaugguguagaa

SEQ ID NO: 457256 - RNA, 19 nt, Homo sapiens
ggacagguuauuaaaggau

SEQ ID NO: 457257 - RNA, 19 nt, Homo sapiens
guagcccacuuuauucaca

SEQ ID NO: 457258 - RNA, 19 nt, Homo sapiens
caaaugucaccuucccaaa

SEQ ID NO: 457259 - RNA, 19 nt, Homo sapiens
aaacaagaugcacccagua

SEQ ID NO: 457260 - RNA, 19 nt, Homo sapiens
gggacagguuauuaaagga

SEQ ID NO: 457261 - RNA, 19 nt, Homo sapiens
ggagcugggcuacaaaaua

SEQ ID NO: 457262 - RNA, 19 nt, Homo sapiens
gcaugaucuucuacaggaa

SEQ ID NO: 457263 - RNA, 19 nt, Homo sapiens
cccgaaaccuggaauaugc

SEQ ID NO: 457264 - RNA, 19 nt, Homo sapiens
cuggcuacaucaacuauga

SEQ ID NO: 457265 - RNA, 19 nt, Homo sapiens
ugaggcuucugcuguaaau

SEQ ID NO: 457266 - RNA, 19 nt, Homo sapiens
gagcccugcaggccuauaa

SEQ ID NO: 457267 - RNA, 19 nt, Homo sapiens
cuaggcucuugcuuaaaua

SEQ ID NO: 457268 - RNA, 19 nt, Homo sapiens
ggaagauugcagaugagaa

SEQ ID NO: 457269 - RNA, 19 nt, Homo sapiens
uugaaucuaugcccuacaa

SEQ ID NO: 457270 - RNA, 19 nt, Homo sapiens
ugggacagguuauuaaagg

SEQ ID NO: 457271 - RNA, 19 nt, Homo sapiens
uggcgggacugaguuuauu

SEQ ID NO: 457272 - RNA, 19 nt, Homo sapiens
gccaaaggagaacugaauu

SEQ ID NO: 457273 - RNA, 19 nt, Homo sapiens
ugucgccacuuggucauaa

SEQ ID NO: 457274 - RNA, 19 nt, Homo sapiens
gggcugagaaggugcuaga

SEQ ID NO: 457275 - RNA, 19 nt, Homo sapiens
guccucacaugacaagaug

SEQ ID NO: 457276 - RNA, 19 nt, Homo sapiens
aaacuuugcuguguacacu

SEQ ID NO: 457277 - RNA, 19 nt, Homo sapiens
caccugagauaaccaacuc

SEQ ID NO: 457278 - RNA, 19 nt, Homo sapiens
gaaagaguucaaggagaga

SEQ ID NO: 457279 - RNA, 19 nt, Homo sapiens
acaacaucauuaagaagga

SEQ ID NO: 457280 - RNA, 19 nt, Homo sapiens
gaaccagugcaaugacgau

SEQ ID NO: 457281 - RNA, 19 nt, Homo sapiens
gcacaaccccucaaagaca

SEQ ID NO: 457282 - RNA, 19 nt, Homo sapiens
cugauugccucggagaauu

SEQ ID NO: 457283 - RNA, 19 nt, Homo sapiens
caacguccagcccuacuca

SEQ ID NO: 457284 - RNA, 19 nt, Homo sapiens
gagaaucaaccaggcuuuc

SEQ ID NO: 457285 - RNA, 19 nt, Homo sapiens
gcuguuagaaagauuguag

SEQ ID NO: 457286 - RNA, 19 nt, Homo sapiens
cagcuggacauaauucuag

SEQ ID NO: 457287 - RNA, 19 nt, Homo sapiens
ucacagcuggacauaauuc

SEQ ID NO: 457288 - RNA, 19 nt, Homo sapiens
cugccugacuucuaaagga

SEQ ID NO: 457289 - RNA, 19 nt, Homo sapiens
aaccaacucccucccguaa

SEQ ID NO: 457290 - RNA, 19 nt, Homo sapiens
agucaagaguaaacaagau

SEQ ID NO: 457291 - RNA, 19 nt, Homo sapiens
ggagaucccuuacacauuu

SEQ ID NO: 457292 - RNA, 19 nt, Homo sapiens
gagcagaggugguggauga

SEQ ID NO: 457293 - RNA, 19 nt, Homo sapiens
ggucagggcucaucuucua

SEQ ID NO: 457294 - RNA, 19 nt, Homo sapiens
gaaggcaccugggaaauga

SEQ ID NO: 457295 - RNA, 19 nt, Homo sapiens
ggacagugauccugagaug

SEQ ID NO: 457296 - RNA, 19 nt, Homo sapiens
gggaagaccucucacuuag

SEQ ID NO: 457297 - RNA, 19 nt, Homo sapiens
aaacuggccucauugacua

SEQ ID NO: 457298 - RNA, 19 nt, Homo sapiens
gcccacagacucaaaguua

SEQ ID NO: 457299 - RNA, 19 nt, Homo sapiens
ggagaguuguggacuuuau

SEQ ID NO: 457300 - RNA, 19 nt, Homo sapiens
ugagagaggugugugauga

SEQ ID NO: 457301 - RNA, 19 nt, Homo sapiens
ucaaauccuuccugcuuaa

SEQ ID NO: 457302 - RNA, 19 nt, Homo sapiens
guaacaagacuuagaagga

SEQ ID NO: 457303 - RNA, 19 nt, Homo sapiens
gaaaugaggcccacagacu

SEQ ID NO: 457304 - RNA, 19 nt, Homo sapiens
cugccaagcuccaggauuu

SEQ ID NO: 457305 - RNA, 19 nt, Homo sapiens
gcuuagaggugaagagcaa

SEQ ID NO: 457306 - RNA, 19 nt, Homo sapiens
gcacugacugcucgacuuu

SEQ ID NO: 457307 - RNA, 19 nt, Homo sapiens
ucgagucuaugcccuauaa

SEQ ID NO: 457308 - RNA, 19 nt, Homo sapiens
cuacaugucugacgucaag

SEQ ID NO: 457309 - RNA, 19 nt, Homo sapiens
gguccugucugaacaacaa

SEQ ID NO: 457310 - RNA, 19 nt, Homo sapiens
ggugugugaugaagucaaa

SEQ ID NO: 457311 - RNA, 19 nt, Homo sapiens
guuguggacuuuauagaug

SEQ ID NO: 457312 - RNA, 19 nt, Homo sapiens
gaguugcgaugcuguacuu

SEQ ID NO: 457313 - RNA, 19 nt, Homo sapiens
gaaucaacuuugccguguu

SEQ ID NO: 457314 - RNA, 19 nt, Homo sapiens
ccaggcacuuucuguuuga

SEQ ID NO: 457315 - RNA, 19 nt, Homo sapiens
ucacugguaucagguggua

SEQ ID NO: 457316 - RNA, 19 nt, Homo sapiens
ugauuugucucccucaaug

SEQ ID NO: 457317 - RNA, 19 nt, Homo sapiens
cuacacagcccuucugcaa

SEQ ID NO: 457318 - RNA, 19 nt, Homo sapiens
ucccagaauuuguaacuga

SEQ ID NO: 457319 - RNA, 19 nt, Homo sapiens
gcaagagccagguauaguc

SEQ ID NO: 457320 - RNA, 19 nt, Homo sapiens
gagaguuguggacuuuaua

SEQ ID NO: 457321 - RNA, 19 nt, Homo sapiens
ccggagaguuguggacuuu

SEQ ID NO: 457322 - RNA, 19 nt, Homo sapiens
acaaguacucggaggguua

SEQ ID NO: 457323 - RNA, 19 nt, Homo sapiens
gcuaaccugcccugaguuu

SEQ ID NO: 457324 - RNA, 19 nt, Homo sapiens
gcccaggcacuuucuguuu

SEQ ID NO: 457325 - RNA, 19 nt, Homo sapiens
cagaauuuguaacugagaa

SEQ ID NO: 457326 - RNA, 19 nt, Homo sapiens
agggaagaccucucacuua

SEQ ID NO: 457327 - RNA, 19 nt, Homo sapiens
uucaaauccuuccugcuua

SEQ ID NO: 457328 - RNA, 19 nt, Homo sapiens
gagaucccuuacacauuug

SEQ ID NO: 457329 - RNA, 19 nt, Homo sapiens
caaccuggccgucuacaca

SEQ ID NO: 457330 - RNA, 19 nt, Homo sapiens
ccacguccaucuucuucga

SEQ ID NO: 457331 - RNA, 19 nt, Homo sapiens
gcgaggcuacucacuggua

SEQ ID NO: 457332 - RNA, 19 nt, Homo sapiens
agacauggcccacaucagu

SEQ ID NO: 457333 - RNA, 19 nt, Homo sapiens
ggaagccuuugaccuggau

SEQ ID NO: 457334 - RNA, 19 nt, Homo sapiens
cagaggugguggaugaaau

SEQ ID NO: 457335 - RNA, 19 nt, Homo sapiens
cuuaaggacucagaaacaa

SEQ ID NO: 457336 - RNA, 19 nt, Homo sapiens
gcagacauggcccacauca

SEQ ID NO: 457337 - RNA, 19 nt, Homo sapiens
ggugguggaugaaauugag

SEQ ID NO: 457338 - RNA, 19 nt, Homo sapiens
cccaggcacuuucuguuug

SEQ ID NO: 457339 - RNA, 19 nt, Homo sapiens
gcuguacuucucuuuguuu

SEQ ID NO: 457340 - RNA, 19 nt, Homo sapiens
cgccuaugcucgccucauu

SEQ ID NO: 457341 - RNA, 19 nt, Homo sapiens
gaugacuuccggagaguug

SEQ ID NO: 457342 - RNA, 19 nt, Homo sapiens
aaucaacuuugccguguuc

SEQ ID NO: 457343 - RNA, 19 nt, Homo sapiens
gugggcagcuggucaggau

SEQ ID NO: 457344 - RNA, 19 nt, Homo sapiens
gcuuaaggacucagaaaca

SEQ ID NO: 457345 - RNA, 19 nt, Homo sapiens
gcucaucuucuaccggaaa

SEQ ID NO: 457346 - RNA, 19 nt, Homo sapiens
gagagaggugugugaugaa

SEQ ID NO: 457347 - RNA, 19 nt, Homo sapiens
gcagaggugguggaugaaa

SEQ ID NO: 457348 - RNA, 19 nt, Homo sapiens
gcccugaguuuccauuacu

SEQ ID NO: 457349 - RNA, 19 nt, Homo sapiens
caguagcuguggcccuaaa

SEQ ID NO: 457350 - RNA, 19 nt, Homo sapiens
acucaaaguuacucuccuu

SEQ ID NO: 457351 - RNA, 19 nt, Homo sapiens
agaccgaagugccaucaca

SEQ ID NO: 457352 - RNA, 19 nt, Homo sapiens
gcaacgcagcccagacuca

SEQ ID NO: 457353 - RNA, 19 nt, Homo sapiens
gaggaccgaaucaacuuug

SEQ ID NO: 457354 - RNA, 19 nt, Homo sapiens
ggguuauccuggcaagaga

SEQ ID NO: 457355 - RNA, 19 nt, Homo sapiens
cgaggcuacucacugguau

SEQ ID NO: 457356 - RNA, 19 nt, Homo sapiens
ggcacugacugcucgacuu

SEQ ID NO: 457357 - RNA, 19 nt, Homo sapiens
ugaaggcaccugggaaaug

SEQ ID NO: 457358 - RNA, 19 nt, Homo sapiens
gcucauugccucagagaac

SEQ ID NO: 457359 - RNA, 19 nt, Homo sapiens
acagugauccugagaugug

SEQ ID NO: 457360 - RNA, 19 nt, Homo sapiens
gcaugagagagguguguga

SEQ ID NO: 457361 - RNA, 19 nt, Homo sapiens
ccccaaaacuggccucauu

SEQ ID NO: 457362 - RNA, 19 nt, Homo sapiens
agacgcguccucuuucuug

SEQ ID NO: 457363 - RNA, 19 nt, Homo sapiens
gaauuuguaacugagaaga

SEQ ID NO: 457364 - RNA, 19 nt, Homo sapiens
uuucaaauccuuccugcuu

SEQ ID NO: 457365 - RNA, 19 nt, Homo sapiens
caagcuccaggauuucaaa

SEQ ID NO: 457366 - RNA, 19 nt, Homo sapiens
gcgaugcuguacuucucuu

SEQ ID NO: 457367 - RNA, 19 nt, Homo sapiens
uaaggacucagaaacaagu

SEQ ID NO: 457368 - RNA, 19 nt, Homo sapiens
ggagaaggacaggcagugu

SEQ ID NO: 457369 - RNA, 19 nt, Homo sapiens
gacaguuccgugaggauga

SEQ ID NO: 457370 - RNA, 19 nt, Homo sapiens
agaggugugugaugaaguc

SEQ ID NO: 457371 - RNA, 19 nt, Homo sapiens
ggccacggcucaucauagc

SEQ ID NO: 457372 - RNA, 19 nt, Homo sapiens
gcugcagccuccucuuucu

SEQ ID NO: 457373 - RNA, 19 nt, Homo sapiens
gaugcuguacuucucuuug

SEQ ID NO: 457374 - RNA, 19 nt, Homo sapiens
ugcuagagcuuguauccau

SEQ ID NO: 457375 - RNA, 19 nt, Homo sapiens
ccacuacucacaagacucu

SEQ ID NO: 457376 - RNA, 19 nt, Homo sapiens
gccgacaccagacgugauu

SEQ ID NO: 457377 - RNA, 19 nt, Homo sapiens
uaacugagaagaucuuuuc

SEQ ID NO: 457378 - RNA, 19 nt, Homo sapiens
gggaaaugaggcccacaga

SEQ ID NO: 457379 - RNA, 19 nt, Homo sapiens
uggcagacauggcccacau

SEQ ID NO: 457380 - RNA, 19 nt, Homo sapiens
ccuaugcucgccucauuga

SEQ ID NO: 457381 - RNA, 19 nt, Homo sapiens
caagagccagguauagucu

SEQ ID NO: 457382 - RNA, 19 nt, Homo sapiens
gggcaagagccagguauag

SEQ ID NO: 457383 - RNA, 19 nt, Homo sapiens
gacaucgucaccaccacua

SEQ ID NO: 457384 - RNA, 19 nt, Homo sapiens
ggcaagagccagguauagu

SEQ ID NO: 457385 - RNA, 19 nt, Homo sapiens
gcacccuccuuccuguuuu

SEQ ID NO: 457386 - RNA, 19 nt, Homo sapiens
ggaagaccucucacuuagg

SEQ ID NO: 457387 - RNA, 19 nt, Homo sapiens
agaggugguggaugaaauu

SEQ ID NO: 457388 - RNA, 19 nt, Homo sapiens
gagcucauugccucagaga

SEQ ID NO: 457389 - RNA, 19 nt, Homo sapiens
ucaugccauugcugcagua

SEQ ID NO: 457390 - RNA, 19 nt, Homo sapiens
guacuucucuuuguuuugg

SEQ ID NO: 457391 - RNA, 19 nt, Homo sapiens
ggagugaagugcaauauua

SEQ ID NO: 457392 - RNA, 19 nt, Homo sapiens
gaaagaaucccagacauua

SEQ ID NO: 457393 - RNA, 19 nt, Homo sapiens
ggucggacguucauaaaua

SEQ ID NO: 457394 - RNA, 19 nt, Homo sapiens
ggaccgacuuuauaacuuu

SEQ ID NO: 457395 - RNA, 19 nt, Homo sapiens
gaacggguguggauuugaa

SEQ ID NO: 457396 - RNA, 19 nt, Homo sapiens
ucacugagcugaacuguag

SEQ ID NO: 457397 - RNA, 19 nt, Homo sapiens
ggagagauccagagaguuu

SEQ ID NO: 457398 - RNA, 19 nt, Homo sapiens
gacaauaucccguuucaaa

SEQ ID NO: 457399 - RNA, 19 nt, Homo sapiens
uggaagagcucacggcuuu

SEQ ID NO: 457400 - RNA, 19 nt, Homo sapiens
ggacacguuugacauuaaa

SEQ ID NO: 457401 - RNA, 19 nt, Homo sapiens
ggauguggcuucacgaguu

SEQ ID NO: 457402 - RNA, 19 nt, Homo sapiens
gcauaacacuuccuaucuu

SEQ ID NO: 457403 - RNA, 19 nt, Homo sapiens
cagaagggauuuaugaaug

SEQ ID NO: 457404 - RNA, 19 nt, Homo sapiens
guaaguugaugccauuuau

SEQ ID NO: 457405 - RNA, 19 nt, Homo sapiens
gcauaaaggcgucaucuug

SEQ ID NO: 457406 - RNA, 19 nt, Homo sapiens
aaacagugaugaaaugaga

SEQ ID NO: 457407 - RNA, 19 nt, Homo sapiens
ggacccgucucauuuguau

SEQ ID NO: 457408 - RNA, 19 nt, Homo sapiens
gguaagaaggauuccauua

SEQ ID NO: 457409 - RNA, 19 nt, Homo sapiens
uaucuucucccaacauuua

SEQ ID NO: 457410 - RNA, 19 nt, Homo sapiens
ugacaucgcguugcauuua

SEQ ID NO: 457411 - RNA, 19 nt, Homo sapiens
agaauuagcuuagcgaugu

SEQ ID NO: 457412 - RNA, 19 nt, Homo sapiens
gagcuggucuccgaugaaa

SEQ ID NO: 457413 - RNA, 19 nt, Homo sapiens
ggcaugggcuggacaguug

SEQ ID NO: 457414 - RNA, 19 nt, Homo sapiens
aggagaaacugaaagaauu

SEQ ID NO: 457415 - RNA, 19 nt, Homo sapiens
uuagagaguuugccucauu

SEQ ID NO: 457416 - RNA, 19 nt, Homo sapiens
gagcugaacuguagaucca

SEQ ID NO: 457417 - RNA, 19 nt, Homo sapiens
uaacagcgcuggugaucca

SEQ ID NO: 457418 - RNA, 19 nt, Homo sapiens
gccaaacagugaugaaaug

SEQ ID NO: 457419 - RNA, 19 nt, Homo sapiens
ccaacagucuucacauuuc

SEQ ID NO: 457420 - RNA, 19 nt, Homo sapiens
gaacgcggguaaccugugu

SEQ ID NO: 457421 - RNA, 19 nt, Homo sapiens
gauucaagcuuggugguuu

SEQ ID NO: 457422 - RNA, 19 nt, Homo sapiens
gaauuagcuuagcgaugua

SEQ ID NO: 457423 - RNA, 19 nt, Homo sapiens
cauaacacuuccuaucuug

SEQ ID NO: 457424 - RNA, 19 nt, Homo sapiens
uaacacauuugcaucuuuc

SEQ ID NO: 457425 - RNA, 19 nt, Homo sapiens
gcguauaaauagugagauu

SEQ ID NO: 457426 - RNA, 19 nt, Homo sapiens
gaaaaggcguuaccucuuc

SEQ ID NO: 457427 - RNA, 19 nt, Homo sapiens
gaaugaggaccgacuuuau

SEQ ID NO: 457428 - RNA, 19 nt, Homo sapiens
gcgguuaacuacacacguu

SEQ ID NO: 457429 - RNA, 19 nt, Homo sapiens
guuaaggaauguagacaau

SEQ ID NO: 457430 - RNA, 19 nt, Homo sapiens
guggacacguuugacauua

SEQ ID NO: 457431 - RNA, 19 nt, Homo sapiens
gagaaagaaucccagacau

SEQ ID NO: 457432 - RNA, 19 nt, Homo sapiens
cuggucaacucucuuauuu

SEQ ID NO: 457433 - RNA, 19 nt, Homo sapiens
ccagagaguuuucaaguuu

SEQ ID NO: 457434 - RNA, 19 nt, Homo sapiens
ggaaaggcguaaauaacag

SEQ ID NO: 457435 - RNA, 19 nt, Homo sapiens
gcagaagggauuuaugaau

SEQ ID NO: 457436 - RNA, 19 nt, Homo sapiens
gugaugaaaugagaagaaa

SEQ ID NO: 457437 - RNA, 19 nt, Homo sapiens
cgacacacguggguaaguu

SEQ ID NO: 457438 - RNA, 19 nt, Homo sapiens
ccacuggucaacucucuua

SEQ ID NO: 457439 - RNA, 19 nt, Homo sapiens
caagagaaucagaugcaua

SEQ ID NO: 457440 - RNA, 19 nt, Homo sapiens
ggagagagagagaaagaau

SEQ ID NO: 457441 - RNA, 19 nt, Homo sapiens
gcuggacaguugcuugaaa

SEQ ID NO: 457442 - RNA, 19 nt, Homo sapiens
ggacaguugcuugaaauga

SEQ ID NO: 457443 - RNA, 19 nt, Homo sapiens
gguaaguugaugccauuua

SEQ ID NO: 457444 - RNA, 19 nt, Homo sapiens
gcaaggugucauacugaua

SEQ ID NO: 457445 - RNA, 19 nt, Homo sapiens
gagaguggcagaagggauu

SEQ ID NO: 457446 - RNA, 19 nt, Homo sapiens
ugauguauguggauuuguu

SEQ ID NO: 457447 - RNA, 19 nt, Homo sapiens
cuuccuaucuugucacuga

SEQ ID NO: 457448 - RNA, 19 nt, Homo sapiens
ggucaacucucuuauuucc

SEQ ID NO: 457449 - RNA, 19 nt, Homo sapiens
aagagaaucagaugcauaa

SEQ ID NO: 457450 - RNA, 19 nt, Homo sapiens
uaacgguauuagagaguuu

SEQ ID NO: 457451 - RNA, 19 nt, Homo sapiens
aaauagccgugcacucuug

SEQ ID NO: 457452 - RNA, 19 nt, Homo sapiens
caaggugucauacugauau

SEQ ID NO: 457453 - RNA, 19 nt, Homo sapiens
agaaucagaugcauaaagg

SEQ ID NO: 457454 - RNA, 19 nt, Homo sapiens
gauguauguggauuuguua

SEQ ID NO: 457455 - RNA, 19 nt, Homo sapiens
cuucuuacuuugugaugua

SEQ ID NO: 457456 - RNA, 19 nt, Homo sapiens
ggagugugguuguguuucu

SEQ ID NO: 457457 - RNA, 19 nt, Homo sapiens
aaugaggaccgacuuuaua

SEQ ID NO: 457458 - RNA, 19 nt, Homo sapiens
uaacuacacacguuuggaa

SEQ ID NO: 457459 - RNA, 19 nt, Homo sapiens
gggcacagccaaccaccua

SEQ ID NO: 457460 - RNA, 19 nt, Homo sapiens
gcaaacaagagaaucagau

SEQ ID NO: 457461 - RNA, 19 nt, Homo sapiens
ggagaaacugaaagaauuc

SEQ ID NO: 457462 - RNA, 19 nt, Homo sapiens
gacaucgcguugcauuuau

SEQ ID NO: 457463 - RNA, 19 nt, Homo sapiens
gcugaacuguagauccauu

SEQ ID NO: 457464 - RNA, 19 nt, Homo sapiens
ggagauccacguuccaugu

SEQ ID NO: 457465 - RNA, 19 nt, Homo sapiens
gcauuaacuuuacugacau

SEQ ID NO: 457466 - RNA, 19 nt, Homo sapiens
auagugagauuuccaaugg

SEQ ID NO: 457467 - RNA, 19 nt, Homo sapiens
ugaaugaggaccgacuuua

SEQ ID NO: 457468 - RNA, 19 nt, Homo sapiens
uaagaaggauuccauuacg

SEQ ID NO: 457469 - RNA, 19 nt, Homo sapiens
gcuuagcgauguauauucu

SEQ ID NO: 457470 - RNA, 19 nt, Homo sapiens
agaaagaaucccagacauu

SEQ ID NO: 457471 - RNA, 19 nt, Homo sapiens
gacauggagugaagugcaa

SEQ ID NO: 457472 - RNA, 19 nt, Homo sapiens
ucgcggagauggugcagaa

SEQ ID NO: 457473 - RNA, 19 nt, Homo sapiens
caacagucuucacauuucu

SEQ ID NO: 457474 - RNA, 19 nt, Homo sapiens
gcaugauuggcauuaguua

SEQ ID NO: 457475 - RNA, 19 nt, Homo sapiens
gugccaagauaucaguuug

SEQ ID NO: 457476 - RNA, 19 nt, Homo sapiens
gaauguggacuucggaauc

SEQ ID NO: 457477 - RNA, 19 nt, Homo sapiens
uauugaaacugcaaagauc

SEQ ID NO: 457478 - RNA, 19 nt, Homo sapiens
caauggaaaggcguaaaua

SEQ ID NO: 457479 - RNA, 19 nt, Homo sapiens
aaccaacagucuucacauu

SEQ ID NO: 457480 - RNA, 19 nt, Homo sapiens
uagacaauaucccguuuca

SEQ ID NO: 457481 - RNA, 19 nt, Homo sapiens
aaacuggugccuaauuuau

SEQ ID NO: 457482 - RNA, 19 nt, Homo sapiens
aaagaaucccagacauuaa

SEQ ID NO: 457483 - RNA, 19 nt, Homo sapiens
caacucucuuauuuccaua

SEQ ID NO: 457484 - RNA, 19 nt, Homo sapiens
gagaaucagaugcauaaag

SEQ ID NO: 457485 - RNA, 19 nt, Homo sapiens
ucacacaccguuucccaaa

SEQ ID NO: 457486 - RNA, 19 nt, Homo sapiens
agaagccgguuaaggaaug

SEQ ID NO: 457487 - RNA, 19 nt, Homo sapiens
ucaacucucuuauuuccau

SEQ ID NO: 457488 - RNA, 19 nt, Homo sapiens
gcaauaaggaaauaguucu

SEQ ID NO: 457489 - RNA, 19 nt, Homo sapiens
ggauuugaauguggacuuc

SEQ ID NO: 457490 - RNA, 19 nt, Homo sapiens
gcggaacggguguggauuu

SEQ ID NO: 457491 - RNA, 19 nt, Homo sapiens
uggaagagcucacggcuuu

SEQ ID NO: 457492 - RNA, 19 nt, Homo sapiens
cagaagggauuuaugaaug

SEQ ID NO: 457493 - RNA, 19 nt, Homo sapiens
gcauaaaggcgucaucuug

SEQ ID NO: 457494 - RNA, 19 nt, Homo sapiens
aaacagugaugaaaugaga

SEQ ID NO: 457495 - RNA, 19 nt, Homo sapiens
gguaagaaggauuccauua

SEQ ID NO: 457496 - RNA, 19 nt, Homo sapiens
ccaccaccaugucaagaua

SEQ ID NO: 457497 - RNA, 19 nt, Homo sapiens
aggagaaacugaaagaauu

SEQ ID NO: 457498 - RNA, 19 nt, Homo sapiens
uaacagcgcuggugaucca

SEQ ID NO: 457499 - RNA, 19 nt, Homo sapiens
gccaaacagugaugaaaug

SEQ ID NO: 457500 - RNA, 19 nt, Homo sapiens
gaacgcggguaaccugugu

SEQ ID NO: 457501 - RNA, 19 nt, Homo sapiens
gcguauaaauagugagauu

SEQ ID NO: 457502 - RNA, 19 nt, Homo sapiens
gagacgggaucuugcuuug

SEQ ID NO: 457503 - RNA, 19 nt, Homo sapiens
ggaaaggcguaaauaacag

SEQ ID NO: 457504 - RNA, 19 nt, Homo sapiens
gcagaagggauuuaugaau

SEQ ID NO: 457505 - RNA, 19 nt, Homo sapiens
gugaugaaaugagaagaaa

SEQ ID NO: 457506 - RNA, 19 nt, Homo sapiens
caagagaaucagaugcaua

SEQ ID NO: 457507 - RNA, 19 nt, Homo sapiens
ucccaaaguguuagaauua

SEQ ID NO: 457508 - RNA, 19 nt, Homo sapiens
gagaguggcagaagggauu

SEQ ID NO: 457509 - RNA, 19 nt, Homo sapiens
aagagaaucagaugcauaa

SEQ ID NO: 457510 - RNA, 19 nt, Homo sapiens
agaaucagaugcauaaagg

SEQ ID NO: 457511 - RNA, 19 nt, Homo sapiens
ccaaagugcugggaugaca

SEQ ID NO: 457512 - RNA, 19 nt, Homo sapiens
ggaguauaauggcaugauc

SEQ ID NO: 457513 - RNA, 19 nt, Homo sapiens
gggcacagccaaccaccua

SEQ ID NO: 457514 - RNA, 19 nt, Homo sapiens
gcaaacaagagaaucagau

SEQ ID NO: 457515 - RNA, 19 nt, Homo sapiens
ggagaaacugaaagaauuc

SEQ ID NO: 457516 - RNA, 19 nt, Homo sapiens
uaagaaggauuccauuacg

SEQ ID NO: 457517 - RNA, 19 nt, Homo sapiens
auagugagauuuccaaugg

SEQ ID NO: 457518 - RNA, 19 nt, Homo sapiens
caccacacccagcuaauuu

SEQ ID NO: 457519 - RNA, 19 nt, Homo sapiens
caauggaaaggcguaaaua

SEQ ID NO: 457520 - RNA, 19 nt, Homo sapiens
gagaaucagaugcauaaag

SEQ ID NO: 457521 - RNA, 19 nt, Homo sapiens
ccaaaguguuagaauuaca

SEQ ID NO: 457522 - RNA, 19 nt, Homo sapiens
ccgaguagcugggauuaca

SEQ ID NO: 457523 - RNA, 19 nt, Homo sapiens
ggcaugaucucgacucacu

SEQ ID NO: 457524 - RNA, 19 nt, Homo sapiens
caaacaagagaaucagaug

SEQ ID NO: 457525 - RNA, 19 nt, Homo sapiens
ugacaaggagaaacugaaa

SEQ ID NO: 457526 - RNA, 19 nt, Homo sapiens
agaaggauuccauuacgua

SEQ ID NO: 457527 - RNA, 19 nt, Homo sapiens
gcacagccaaccaccuaga

SEQ ID NO: 457528 - RNA, 19 nt, Homo sapiens
gaagggauuuaugaaugca

SEQ ID NO: 457529 - RNA, 19 nt, Homo sapiens
uggcagaagggauuuauga

SEQ ID NO: 457530 - RNA, 19 nt, Homo sapiens
ccaagugccgcaaacaaga

SEQ ID NO: 457531 - RNA, 19 nt, Homo sapiens
cuccugagcuccaaagauc

SEQ ID NO: 457532 - RNA, 19 nt, Homo sapiens
acaaggagaaacugaaaga

SEQ ID NO: 457533 - RNA, 19 nt, Homo sapiens
aauggaaaggcguaaauaa

SEQ ID NO: 457534 - RNA, 19 nt, Homo sapiens
ccacguagacaaugacaag

SEQ ID NO: 457535 - RNA, 19 nt, Homo sapiens
ucaaggaccacguagacaa

SEQ ID NO: 457536 - RNA, 19 nt, Homo sapiens
uggaaaggcguaaauaaca

SEQ ID NO: 457537 - RNA, 19 nt, Homo sapiens
gcccggagaccaguaauug

SEQ ID NO: 457538 - RNA, 19 nt, Homo sapiens
gacgggaucuugcuuugcu

SEQ ID NO: 457539 - RNA, 19 nt, Homo sapiens
ccaccacacccagcuaauu

SEQ ID NO: 457540 - RNA, 19 nt, Homo sapiens
ccaaacagugaugaaauga

SEQ ID NO: 457541 - RNA, 19 nt, Homo sapiens
caaggaccacguagacaau

SEQ ID NO: 457542 - RNA, 19 nt, Homo sapiens
ccaauggaaaggcguaaau

SEQ ID NO: 457543 - RNA, 19 nt, Homo sapiens
guuagaauuacaagcauga

SEQ ID NO: 457544 - RNA, 19 nt, Homo sapiens
gaugaaaugagaagaaagc

SEQ ID NO: 457545 - RNA, 19 nt, Homo sapiens
gccuuagccucccaaagug

SEQ ID NO: 457546 - RNA, 19 nt, Homo sapiens
agaagggauuuaugaaugc

SEQ ID NO: 457547 - RNA, 19 nt, Homo sapiens
gagguaagaaggauuccau

SEQ ID NO: 457548 - RNA, 19 nt, Homo sapiens
cucccaaaguguuagaauu

SEQ ID NO: 457549 - RNA, 19 nt, Homo sapiens
cgccuuagccucccaaagu

SEQ ID NO: 457550 - RNA, 19 nt, Homo sapiens
ggagcccggagaccaguaa

SEQ ID NO: 457551 - RNA, 19 nt, Homo sapiens
aaggagaaacugaaagaau

SEQ ID NO: 457552 - RNA, 19 nt, Homo sapiens
gccacugcccggugcauuu

SEQ ID NO: 457553 - RNA, 19 nt, Homo sapiens
ggcagaagggauuuaugaa

SEQ ID NO: 457554 - RNA, 19 nt, Homo sapiens
cggaugccuuuccaacaga

SEQ ID NO: 457555 - RNA, 19 nt, Homo sapiens
gagccuuacggaugccuuu

SEQ ID NO: 457556 - RNA, 19 nt, Homo sapiens
ggauuuaugaaugcaaaga

SEQ ID NO: 457557 - RNA, 19 nt, Homo sapiens
caaggagaaacugaaagaa

SEQ ID NO: 457558 - RNA, 19 nt, Homo sapiens
caccaugucaagauaaugu

SEQ ID NO: 457559 - RNA, 19 nt, Homo sapiens
gaauuacaagcaugaacca

SEQ ID NO: 457560 - RNA, 19 nt, Homo sapiens
cgucaacaugggagccuua

SEQ ID NO: 457561 - RNA, 19 nt, Homo sapiens
cuccugggcucaagcaauc

SEQ ID NO: 457562 - RNA, 19 nt, Homo sapiens
ugccucagccucccgagua

SEQ ID NO: 457563 - RNA, 19 nt, Homo sapiens
ggaugccuuuccaacagau

SEQ ID NO: 457564 - RNA, 19 nt, Homo sapiens
ggacgccaaacagugauga

SEQ ID NO: 457565 - RNA, 19 nt, Homo sapiens
gccaagugccgcaaacaag

SEQ ID NO: 457566 - RNA, 19 nt, Homo sapiens
gaagcgcgaggacgugaag

SEQ ID NO: 457567 - RNA, 19 nt, Homo sapiens
ccaugucaagauaauguuu

SEQ ID NO: 457568 - RNA, 19 nt, Homo sapiens
agggauuuaugaaugcaaa

SEQ ID NO: 457569 - RNA, 19 nt, Homo sapiens
ccacugcccggugcauuug

SEQ ID NO: 457570 - RNA, 19 nt, Homo sapiens
gcggagguaagaaggauuc

SEQ ID NO: 457571 - RNA, 19 nt, Homo sapiens
agagacgggaucuugcuuu

SEQ ID NO: 457572 - RNA, 19 nt, Homo sapiens
ggccuuuguaacuuuauuu

SEQ ID NO: 457573 - RNA, 19 nt, Homo sapiens
gggcagaccaagcugaaac

SEQ ID NO: 457574 - RNA, 19 nt, Homo sapiens
gaagagcucacggcuuuug

SEQ ID NO: 457575 - RNA, 19 nt, Homo sapiens
aagaaggauuccauuacgu

SEQ ID NO: 457576 - RNA, 19 nt, Homo sapiens
ccaagucuuuugaccagaa

SEQ ID NO: 457577 - RNA, 19 nt, Homo sapiens
guucaaggaccacguagac

SEQ ID NO: 457578 - RNA, 19 nt, Homo sapiens
gaaggcaacuuauuucuua

SEQ ID NO: 457579 - RNA, 19 nt, Homo sapiens
gaaagaagagguauacuua

SEQ ID NO: 457580 - RNA, 19 nt, Homo sapiens
gaaggauucucuauucuuu

SEQ ID NO: 457581 - RNA, 19 nt, Homo sapiens
ccauaaagguguucucaua

SEQ ID NO: 457582 - RNA, 19 nt, Homo sapiens
gauggacucuugcauagaa

SEQ ID NO: 457583 - RNA, 19 nt, Homo sapiens
caacguaggugcuuuaagg

SEQ ID NO: 457584 - RNA, 19 nt, Homo sapiens
cuacaacgauggacucuug

SEQ ID NO: 457585 - RNA, 19 nt, Homo sapiens
ggcagaagcugaaauugga

SEQ ID NO: 457586 - RNA, 19 nt, Homo sapiens
gacaguaaauuccgguuug

SEQ ID NO: 457587 - RNA, 19 nt, Homo sapiens
cgagaaauuugaugagaga

SEQ ID NO: 457588 - RNA, 19 nt, Homo sapiens
ucagaugcuuugaguuuaa

SEQ ID NO: 457589 - RNA, 19 nt, Homo sapiens
ucgaagagcuaaauguaga

SEQ ID NO: 457590 - RNA, 19 nt, Homo sapiens
gaaguucacguuaauacga

SEQ ID NO: 457591 - RNA, 19 nt, Homo sapiens
aaucagaugcuuugaguuu

SEQ ID NO: 457592 - RNA, 19 nt, Homo sapiens
ugaaucagaugcuuugagu

SEQ ID NO: 457593 - RNA, 19 nt, Homo sapiens
ggugggaaguucacagguu

SEQ ID NO: 457594 - RNA, 19 nt, Homo sapiens
ggacgaaggccagaccaaa

SEQ ID NO: 457595 - RNA, 19 nt, Homo sapiens
gugggaaguucacagguuu

SEQ ID NO: 457596 - RNA, 19 nt, Homo sapiens
ggaaggauucucuauucuu

SEQ ID NO: 457597 - RNA, 19 nt, Homo sapiens
ggaaggcaacuuauuucuu

SEQ ID NO: 457598 - RNA, 19 nt, Homo sapiens
agaggaaggcaacuuauuu

SEQ ID NO: 457599 - RNA, 19 nt, Homo sapiens
guuaccaacuuaaaugugu

SEQ ID NO: 457600 - RNA, 19 nt, Homo sapiens
gcagaaagaagagguauac

SEQ ID NO: 457601 - RNA, 19 nt, Homo sapiens
gaggaaggcaacuuauuuc

SEQ ID NO: 457602 - RNA, 19 nt, Homo sapiens
gcaaagcuacaacgaugga

SEQ ID NO: 457603 - RNA, 19 nt, Homo sapiens
aaucgaagagcuaaaugua

SEQ ID NO: 457604 - RNA, 19 nt, Homo sapiens
gaaaaucaacuccauaaag

SEQ ID NO: 457605 - RNA, 19 nt, Homo sapiens
gaagagcuaaauguagaaa

SEQ ID NO: 457606 - RNA, 19 nt, Homo sapiens
ggcgaagucggaccaauuu

SEQ ID NO: 457607 - RNA, 19 nt, Homo sapiens
gggaaggauucucuauucu

SEQ ID NO: 457608 - RNA, 19 nt, Homo sapiens
gcaacuuauuucuuaacug

SEQ ID NO: 457609 - RNA, 19 nt, Homo sapiens
agaaagaagagguauacuu

SEQ ID NO: 457610 - RNA, 19 nt, Homo sapiens
gaaggcaaagcagaaagaa

SEQ ID NO: 457611 - RNA, 19 nt, Homo sapiens
uuucuuaacugcuauuugg

SEQ ID NO: 457612 - RNA, 19 nt, Homo sapiens
aggcaaagcagaaagaaga

SEQ ID NO: 457613 - RNA, 19 nt, Homo sapiens
cuaagaaggcaaagcagaa

SEQ ID NO: 457614 - RNA, 19 nt, Homo sapiens
cagaugcuuugaguuuaaa

SEQ ID NO: 457615 - RNA, 19 nt, Homo sapiens
uaagaaggcaaagcagaaa

SEQ ID NO: 457616 - RNA, 19 nt, Homo sapiens
ggggaaggauucucuauuc

SEQ ID NO: 457617 - RNA, 19 nt, Homo sapiens
gaaagacaaacgggagaga

SEQ ID NO: 457618 - RNA, 19 nt, Homo sapiens
cuuguagagucgcaccuua

SEQ ID NO: 457619 - RNA, 19 nt, Homo sapiens
gagugcagguuugguuuca

SEQ ID NO: 457620 - RNA, 19 nt, Homo sapiens
uacgagaaauuugaugaga

SEQ ID NO: 457621 - RNA, 19 nt, Homo sapiens
cugcgaaguucacguuaau

SEQ ID NO: 457622 - RNA, 19 nt, Homo sapiens
aggauuugcugugcuguuu

SEQ ID NO: 457623 - RNA, 19 nt, Homo sapiens
cgaagucggaccaauuuca

SEQ ID NO: 457624 - RNA, 19 nt, Homo sapiens
gaguuuaaacccaccaugu

SEQ ID NO: 457625 - RNA, 19 nt, Homo sapiens
guuuaaacccaccauguau

SEQ ID NO: 457626 - RNA, 19 nt, Homo sapiens
ucugcgaaguucacguuaa

SEQ ID NO: 457627 - RNA, 19 nt, Homo sapiens
gcgcuaagaaggcaaagca

SEQ ID NO: 457628 - RNA, 19 nt, Homo sapiens
acgauggacucuugcauag

SEQ ID NO: 457629 - RNA, 19 nt, Homo sapiens
aaacaacccagacgauucu

SEQ ID NO: 457630 - RNA, 19 nt, Homo sapiens
aaaagaggaaggcaacuua

SEQ ID NO: 457631 - RNA, 19 nt, Homo sapiens
gcgaaguucacguuaauac

SEQ ID NO: 457632 - RNA, 19 nt, Homo sapiens
ugucaacguaggugcuuua

SEQ ID NO: 457633 - RNA, 19 nt, Homo sapiens
aaaaucaacuccauaaagg

SEQ ID NO: 457634 - RNA, 19 nt, Homo sapiens
ugacaguaaauuccgguuu

SEQ ID NO: 457635 - RNA, 19 nt, Homo sapiens
cuuuaaggaugccauuuca

SEQ ID NO: 457636 - RNA, 19 nt, Homo sapiens
cauaaagguguucucauag

SEQ ID NO: 457637 - RNA, 19 nt, Homo sapiens
agaauuggguuuuguagga

SEQ ID NO: 457638 - RNA, 19 nt, Homo sapiens
auaaagguguucucauagg

SEQ ID NO: 457639 - RNA, 19 nt, Homo sapiens
gugcgcaggugggaaguuc

SEQ ID NO: 457640 - RNA, 19 nt, Homo sapiens
ccaacuuaaauguguguuu

SEQ ID NO: 457641 - RNA, 19 nt, Homo sapiens
gcuuuaaggaugccauuuc

SEQ ID NO: 457642 - RNA, 19 nt, Homo sapiens
ucaacuccauaaagguguu

SEQ ID NO: 457643 - RNA, 19 nt, Homo sapiens
gaaagggauggaggacgaa

SEQ ID NO: 457644 - RNA, 19 nt, Homo sapiens
aagaggaaggcaacuuauu

SEQ ID NO: 457645 - RNA, 19 nt, Homo sapiens
aagacaaacgggagagaaa

SEQ ID NO: 457646 - RNA, 19 nt, Homo sapiens
aacgauggacucuugcaua

SEQ ID NO: 457647 - RNA, 19 nt, Homo sapiens
caauuucacccuggaacaa

SEQ ID NO: 457648 - RNA, 19 nt, Homo sapiens
ggagcugaaagaucgcaaa

SEQ ID NO: 457649 - RNA, 19 nt, Homo sapiens
aaagaggaaggcaacuuau

SEQ ID NO: 457650 - RNA, 19 nt, Homo sapiens
caagaaaaucaacuccaua

SEQ ID NO: 457651 - RNA, 19 nt, Homo sapiens
aguuuaaacccaccaugua

SEQ ID NO: 457652 - RNA, 19 nt, Homo sapiens
agaaggcaaagcagaaaga

SEQ ID NO: 457653 - RNA, 19 nt, Homo sapiens
ggcaacuuauuucuuaacu

SEQ ID NO: 457654 - RNA, 19 nt, Homo sapiens
acucgagggccuagaauug

SEQ ID NO: 457655 - RNA, 19 nt, Homo sapiens
gagcugaaagaucgcaaag

SEQ ID NO: 457656 - RNA, 19 nt, Homo sapiens
aucagaugcuuugaguuua

SEQ ID NO: 457657 - RNA, 19 nt, Homo sapiens
gaggcgaagucggaccaau

SEQ ID NO: 457658 - RNA, 19 nt, Homo sapiens
cacguuaauacgagaaauu

SEQ ID NO: 457659 - RNA, 19 nt, Homo sapiens
aaagcagaaagaagaggua

SEQ ID NO: 457660 - RNA, 19 nt, Homo sapiens
aaagacaaacgggagagaa

SEQ ID NO: 457661 - RNA, 19 nt, Homo sapiens
guagagucgcaccuuaugu

SEQ ID NO: 457662 - RNA, 19 nt, Homo sapiens
cgaagagcuaaauguagaa

SEQ ID NO: 457663 - RNA, 19 nt, Homo sapiens
gaaucagaugcuuugaguu

SEQ ID NO: 457664 - RNA, 19 nt, Homo sapiens
ccucuucccgccucacuga

SEQ ID NO: 457665 - RNA, 19 nt, Homo sapiens
gaagucggaccaauuucac

SEQ ID NO: 457666 - RNA, 19 nt, Homo sapiens
ggagaaccaaggagcaaaa

SEQ ID NO: 457667 - RNA, 19 nt, Homo sapiens
acaaaucugguaacaggau

SEQ ID NO: 457668 - RNA, 19 nt, Homo sapiens
uggcagaagcugaaauugg

SEQ ID NO: 457669 - RNA, 19 nt, Homo sapiens
gaugccauuucagcagguu

SEQ ID NO: 457670 - RNA, 19 nt, Homo sapiens
caaaaucgaagagcuaaau

SEQ ID NO: 457671 - RNA, 19 nt, Homo sapiens
gaaggcaacuuauuucuua

SEQ ID NO: 457672 - RNA, 19 nt, Homo sapiens
gaaagaagagguauacuua

SEQ ID NO: 457673 - RNA, 19 nt, Homo sapiens
ccauaaagguguucucaua

SEQ ID NO: 457674 - RNA, 19 nt, Homo sapiens
gauggacucuugcauagaa

SEQ ID NO: 457675 - RNA, 19 nt, Homo sapiens
caacguaggugcuuuaagg

SEQ ID NO: 457676 - RNA, 19 nt, Homo sapiens
cuacaacgauggacucuug

SEQ ID NO: 457677 - RNA, 19 nt, Homo sapiens
ggcagaagcugaaauugga

SEQ ID NO: 457678 - RNA, 19 nt, Homo sapiens
gacaguaaauuccgguuug

SEQ ID NO: 457679 - RNA, 19 nt, Homo sapiens
cgagaaauuugaugagaga

SEQ ID NO: 457680 - RNA, 19 nt, Homo sapiens
ucagaugcuuugaguuuaa

SEQ ID NO: 457681 - RNA, 19 nt, Homo sapiens
ucgaagagcuaaauguaga

SEQ ID NO: 457682 - RNA, 19 nt, Homo sapiens
gaaguucacguuaauacga

SEQ ID NO: 457683 - RNA, 19 nt, Homo sapiens
aaucagaugcuuugaguuu

SEQ ID NO: 457684 - RNA, 19 nt, Homo sapiens
ugaaucagaugcuuugagu

SEQ ID NO: 457685 - RNA, 19 nt, Homo sapiens
ggugggaaguucacagguu

SEQ ID NO: 457686 - RNA, 19 nt, Homo sapiens
ggacgaaggccagaccaaa

SEQ ID NO: 457687 - RNA, 19 nt, Homo sapiens
gugggaaguucacagguuu

SEQ ID NO: 457688 - RNA, 19 nt, Homo sapiens
agaaggaggcgaucacgua

SEQ ID NO: 457689 - RNA, 19 nt, Homo sapiens
ggaaggcaacuuauuucuu

SEQ ID NO: 457690 - RNA, 19 nt, Homo sapiens
agaggaaggcaacuuauuu

SEQ ID NO: 457691 - RNA, 19 nt, Homo sapiens
guuaccaacuuaaaugugu

SEQ ID NO: 457692 - RNA, 19 nt, Homo sapiens
gcagaaagaagagguauac

SEQ ID NO: 457693 - RNA, 19 nt, Homo sapiens
gaggaaggcaacuuauuuc

SEQ ID NO: 457694 - RNA, 19 nt, Homo sapiens
gcaaagcuacaacgaugga

SEQ ID NO: 457695 - RNA, 19 nt, Homo sapiens
aaucgaagagcuaaaugua

SEQ ID NO: 457696 - RNA, 19 nt, Homo sapiens
gaaaaucaacuccauaaag

SEQ ID NO: 457697 - RNA, 19 nt, Homo sapiens
gaagagcuaaauguagaaa

SEQ ID NO: 457698 - RNA, 19 nt, Homo sapiens
ggcgaagucggaccaauuu

SEQ ID NO: 457699 - RNA, 19 nt, Homo sapiens
gcaacuuauuucuuaacug

SEQ ID NO: 457700 - RNA, 19 nt, Homo sapiens
agaaagaagagguauacuu

SEQ ID NO: 457701 - RNA, 19 nt, Homo sapiens
gaaggcaaagcagaaagaa

SEQ ID NO: 457702 - RNA, 19 nt, Homo sapiens
uuucuuaacugcuauuugg

SEQ ID NO: 457703 - RNA, 19 nt, Homo sapiens
aggcaaagcagaaagaaga

SEQ ID NO: 457704 - RNA, 19 nt, Homo sapiens
cuaagaaggcaaagcagaa

SEQ ID NO: 457705 - RNA, 19 nt, Homo sapiens
cagaugcuuugaguuuaaa

SEQ ID NO: 457706 - RNA, 19 nt, Homo sapiens
uaagaaggcaaagcagaaa

SEQ ID NO: 457707 - RNA, 19 nt, Homo sapiens
gaaagacaaacgggagaga

SEQ ID NO: 457708 - RNA, 19 nt, Homo sapiens
cuuguagagucgcaccuua

SEQ ID NO: 457709 - RNA, 19 nt, Homo sapiens
gagugcagguuugguuuca

SEQ ID NO: 457710 - RNA, 19 nt, Homo sapiens
uacgagaaauuugaugaga

SEQ ID NO: 457711 - RNA, 19 nt, Homo sapiens
cugcgaaguucacguuaau

SEQ ID NO: 457712 - RNA, 19 nt, Homo sapiens
cgaagucggaccaauuuca

SEQ ID NO: 457713 - RNA, 19 nt, Homo sapiens
gaguuuaaacccaccaugu

SEQ ID NO: 457714 - RNA, 19 nt, Homo sapiens
guuuaaacccaccauguau

SEQ ID NO: 457715 - RNA, 19 nt, Homo sapiens
ucugcgaaguucacguuaa

SEQ ID NO: 457716 - RNA, 19 nt, Homo sapiens
gcgcuaagaaggcaaagca

SEQ ID NO: 457717 - RNA, 19 nt, Homo sapiens
agaaagugaaggagaagaa

SEQ ID NO: 457718 - RNA, 19 nt, Homo sapiens
acgauggacucuugcauag

SEQ ID NO: 457719 - RNA, 19 nt, Homo sapiens
aaacaacccagacgauucu

SEQ ID NO: 457720 - RNA, 19 nt, Homo sapiens
aaaagaggaaggcaacuua

SEQ ID NO: 457721 - RNA, 19 nt, Homo sapiens
gcgaaguucacguuaauac

SEQ ID NO: 457722 - RNA, 19 nt, Homo sapiens
gaaagugaaggagaagaag

SEQ ID NO: 457723 - RNA, 19 nt, Homo sapiens
ugucaacguaggugcuuua

SEQ ID NO: 457724 - RNA, 19 nt, Homo sapiens
aaaaucaacuccauaaagg

SEQ ID NO: 457725 - RNA, 19 nt, Homo sapiens
ugacaguaaauuccgguuu

SEQ ID NO: 457726 - RNA, 19 nt, Homo sapiens
cuuuaaggaugccauuuca

SEQ ID NO: 457727 - RNA, 19 nt, Homo sapiens
cauaaagguguucucauag

SEQ ID NO: 457728 - RNA, 19 nt, Homo sapiens
uuacggcguucgucuccaa

SEQ ID NO: 457729 - RNA, 19 nt, Homo sapiens
agaauuggguuuuguagga

SEQ ID NO: 457730 - RNA, 19 nt, Homo sapiens
gcccuugcccuuucagguu

SEQ ID NO: 457731 - RNA, 19 nt, Homo sapiens
auaaagguguucucauagg

SEQ ID NO: 457732 - RNA, 19 nt, Homo sapiens
accagaaagugaaggagaa

SEQ ID NO: 457733 - RNA, 19 nt, Homo sapiens
gugcgcaggugggaaguuc

SEQ ID NO: 457734 - RNA, 19 nt, Homo sapiens
ccaacuuaaauguguguuu

SEQ ID NO: 457735 - RNA, 19 nt, Homo sapiens
gcuuuaaggaugccauuuc

SEQ ID NO: 457736 - RNA, 19 nt, Homo sapiens
ucaacuccauaaagguguu

SEQ ID NO: 457737 - RNA, 19 nt, Homo sapiens
aagaggaaggcaacuuauu

SEQ ID NO: 457738 - RNA, 19 nt, Homo sapiens
aagacaaacgggagagaaa

SEQ ID NO: 457739 - RNA, 19 nt, Homo sapiens
aacgauggacucuugcaua

SEQ ID NO: 457740 - RNA, 19 nt, Homo sapiens
caauuucacccuggaacaa

SEQ ID NO: 457741 - RNA, 19 nt, Homo sapiens
gugacgcccuugcccuuuc

SEQ ID NO: 457742 - RNA, 19 nt, Homo sapiens
gaaagggauggaggacgaa

SEQ ID NO: 457743 - RNA, 19 nt, Homo sapiens
ggagcugaaagaucgcaaa

SEQ ID NO: 457744 - RNA, 19 nt, Homo sapiens
aaagaggaaggcaacuuau

SEQ ID NO: 457745 - RNA, 19 nt, Homo sapiens
caagaaaaucaacuccaua

SEQ ID NO: 457746 - RNA, 19 nt, Homo sapiens
aguuuaaacccaccaugua

SEQ ID NO: 457747 - RNA, 19 nt, Homo sapiens
agaaggcaaagcagaaaga

SEQ ID NO: 457748 - RNA, 19 nt, Homo sapiens
ggcaacuuauuucuuaacu

SEQ ID NO: 457749 - RNA, 19 nt, Homo sapiens
acucgagggccuagaauug

SEQ ID NO: 457750 - RNA, 19 nt, Homo sapiens
aucagaugcuuugaguuua

SEQ ID NO: 457751 - RNA, 19 nt, Homo sapiens
gagcugaaagaucgcaaag

SEQ ID NO: 457752 - RNA, 19 nt, Homo sapiens
gagaagaaggaggcgauca

SEQ ID NO: 457753 - RNA, 19 nt, Homo sapiens
gaggcgaagucggaccaau

SEQ ID NO: 457754 - RNA, 19 nt, Homo sapiens
cacguuaauacgagaaauu

SEQ ID NO: 457755 - RNA, 19 nt, Homo sapiens
aaagcagaaagaagaggua

SEQ ID NO: 457756 - RNA, 19 nt, Homo sapiens
aaagacaaacgggagagaa

SEQ ID NO: 457757 - RNA, 19 nt, Homo sapiens
ugacgcccuugcccuuuca

SEQ ID NO: 457758 - RNA, 19 nt, Homo sapiens
cauuucagcaggauaguca

SEQ ID NO: 457759 - RNA, 19 nt, Homo sapiens
guagagucgcaccuuaugu

SEQ ID NO: 457760 - RNA, 19 nt, Homo sapiens
cgaagagcuaaauguagaa

SEQ ID NO: 457761 - RNA, 19 nt, Homo sapiens
gaaucagaugcuuugaguu

SEQ ID NO: 457762 - RNA, 19 nt, Homo sapiens
ccaagucuuuugaccagaa

SEQ ID NO: 457763 - RNA, 19 nt, Homo sapiens
ccucuucccgccucacuga

SEQ ID NO: 457764 - RNA, 19 nt, Homo sapiens
ggagaaccaaggagcaaaa

SEQ ID NO: 457765 - RNA, 19 nt, Homo sapiens
uggcagaagcugaaauugg

SEQ ID NO: 457766 - RNA, 19 nt, Homo sapiens
caaaaucgaagagcuaaau

SEQ ID NO: 457767 - RNA, 19 nt, Homo sapiens
gaagucggaccaauuucac

SEQ ID NO: 457768 - RNA, 19 nt, Homo sapiens
gaaauaagauggcaagaaa

SEQ ID NO: 457769 - RNA, 19 nt, Homo sapiens
gaagagagguuacauaaau

SEQ ID NO: 457770 - RNA, 19 nt, Homo sapiens
ggaagaaacuuuaguguuc

SEQ ID NO: 457771 - RNA, 19 nt, Homo sapiens
gaaaucaacuggucaugaa

SEQ ID NO: 457772 - RNA, 19 nt, Homo sapiens
caaauggaauggucuauaa

SEQ ID NO: 457773 - RNA, 19 nt, Homo sapiens
gcaauaccaugaaguaauu

SEQ ID NO: 457774 - RNA, 19 nt, Homo sapiens
gaaaugacaucaacagugu

SEQ ID NO: 457775 - RNA, 19 nt, Homo sapiens
gaacaucaguuuugcauua

SEQ ID NO: 457776 - RNA, 19 nt, Homo sapiens
gagaacaggcuaugaaaua

SEQ ID NO: 457777 - RNA, 19 nt, Homo sapiens
gaucugaacuggaauacuu

SEQ ID NO: 457778 - RNA, 19 nt, Homo sapiens
cuaagucgcuggaauuaua

SEQ ID NO: 457779 - RNA, 19 nt, Homo sapiens
gcugaaaugucaaggaaua

SEQ ID NO: 457780 - RNA, 19 nt, Homo sapiens
gaauaaaguuaccuucuga

SEQ ID NO: 457781 - RNA, 19 nt, Homo sapiens
gaaugaaguuuccagcuuu

SEQ ID NO: 457782 - RNA, 19 nt, Homo sapiens
caacauguguggauaaaug

SEQ ID NO: 457783 - RNA, 19 nt, Homo sapiens
caacucagcucgcuauuca

SEQ ID NO: 457784 - RNA, 19 nt, Homo sapiens
gagauuucgucaugauuua

SEQ ID NO: 457785 - RNA, 19 nt, Homo sapiens
ggaauuauaugacgcuaug

SEQ ID NO: 457786 - RNA, 19 nt, Homo sapiens
gaagagauaugaaguacca

SEQ ID NO: 457787 - RNA, 19 nt, Homo sapiens
ccaaagcaccugaguguua

SEQ ID NO: 457788 - RNA, 19 nt, Homo sapiens
cauaagagauuucgucaug

SEQ ID NO: 457789 - RNA, 19 nt, Homo sapiens
caacaaagcaauaccauga

SEQ ID NO: 457790 - RNA, 19 nt, Homo sapiens
gaacaacuacuaaucaaug

SEQ ID NO: 457791 - RNA, 19 nt, Homo sapiens
gcuauugccuuaauuguug

SEQ ID NO: 457792 - RNA, 19 nt, Homo sapiens
gaaauuuaguggauuggaa

SEQ ID NO: 457793 - RNA, 19 nt, Homo sapiens
cagcuagacuuuacaauug

SEQ ID NO: 457794 - RNA, 19 nt, Homo sapiens
gaagacagacuuuaugaug

SEQ ID NO: 457795 - RNA, 19 nt, Homo sapiens
gaacugauggauuacauuu

SEQ ID NO: 457796 - RNA, 19 nt, Homo sapiens
guccaaauguguuaaauga

SEQ ID NO: 457797 - RNA, 19 nt, Homo sapiens
gaacuaaauuauccaccuu

SEQ ID NO: 457798 - RNA, 19 nt, Homo sapiens
gaagaacuuugcagaagau

SEQ ID NO: 457799 - RNA, 19 nt, Homo sapiens
gauggaaguacaccaauua

SEQ ID NO: 457800 - RNA, 19 nt, Homo sapiens
uaaaugauccugucaaugu

SEQ ID NO: 457801 - RNA, 19 nt, Homo sapiens
ggaacuaccuuagcauuuc

SEQ ID NO: 457802 - RNA, 19 nt, Homo sapiens
ccauuuagcauccaaguua

SEQ ID NO: 457803 - RNA, 19 nt, Homo sapiens
ugaaugagccaucaaguuu

SEQ ID NO: 457804 - RNA, 19 nt, Homo sapiens
ggaaagucauucgguguuu

SEQ ID NO: 457805 - RNA, 19 nt, Homo sapiens
aaagagggauuguaauuuc

SEQ ID NO: 457806 - RNA, 19 nt, Homo sapiens
guaaauggaacaacuacua

SEQ ID NO: 457807 - RNA, 19 nt, Homo sapiens
caagauuacugauccaaau

SEQ ID NO: 457808 - RNA, 19 nt, Homo sapiens
gaggacaauuucaaacauu

SEQ ID NO: 457809 - RNA, 19 nt, Homo sapiens
cagcugaccuccaacuaaa

SEQ ID NO: 457810 - RNA, 19 nt, Homo sapiens
gaagaaacuuuaguguuca

SEQ ID NO: 457811 - RNA, 19 nt, Homo sapiens
gaagacaugcugcucauug

SEQ ID NO: 457812 - RNA, 19 nt, Homo sapiens
gauggaauuuagucuguuu

SEQ ID NO: 457813 - RNA, 19 nt, Homo sapiens
ccaauuaugucguuaugga

SEQ ID NO: 457814 - RNA, 19 nt, Homo sapiens
ggcccugcauuacuuauua

SEQ ID NO: 457815 - RNA, 19 nt, Homo sapiens
ccaaauguguuaaaugauc

SEQ ID NO: 457816 - RNA, 19 nt, Homo sapiens
gcagcuagacuuuacaauu

SEQ ID NO: 457817 - RNA, 19 nt, Homo sapiens
caacagcaaugcaauggau

SEQ ID NO: 457818 - RNA, 19 nt, Homo sapiens
uugcagaucucaaacuuaa

SEQ ID NO: 457819 - RNA, 19 nt, Homo sapiens
acaaguaguucaacaguau

SEQ ID NO: 457820 - RNA, 19 nt, Homo sapiens
gguccagcauuuaugguua

SEQ ID NO: 457821 - RNA, 19 nt, Homo sapiens
gcauuacgauguucacaau

SEQ ID NO: 457822 - RNA, 19 nt, Homo sapiens
gaugguuuguggauugaua

SEQ ID NO: 457823 - RNA, 19 nt, Homo sapiens
gcaaaugccagaauaaagu

SEQ ID NO: 457824 - RNA, 19 nt, Homo sapiens
uauaacagcugaccuccaa

SEQ ID NO: 457825 - RNA, 19 nt, Homo sapiens
gaacuaccuuagcauuuca

SEQ ID NO: 457826 - RNA, 19 nt, Homo sapiens
caacuaagucgcuggaauu

SEQ ID NO: 457827 - RNA, 19 nt, Homo sapiens
aaaccaaccugggauauau

SEQ ID NO: 457828 - RNA, 19 nt, Homo sapiens
gaacaaauggaauggucua

SEQ ID NO: 457829 - RNA, 19 nt, Homo sapiens
gaauuuagucuguuuggaa

SEQ ID NO: 457830 - RNA, 19 nt, Homo sapiens
ccagagaaauuguggacuu

SEQ ID NO: 457831 - RNA, 19 nt, Homo sapiens
caacuccugcucuaacuua

SEQ ID NO: 457832 - RNA, 19 nt, Homo sapiens
caauguuacucuagaagaa

SEQ ID NO: 457833 - RNA, 19 nt, Homo sapiens
gaacuacuccugucaaugc

SEQ ID NO: 457834 - RNA, 19 nt, Homo sapiens
caacguggcuguguaugga

SEQ ID NO: 457835 - RNA, 19 nt, Homo sapiens
gaccaguucuucaugaguu

SEQ ID NO: 457836 - RNA, 19 nt, Homo sapiens
uuauaaagcccauguguuu

SEQ ID NO: 457837 - RNA, 19 nt, Homo sapiens
gcaauaugauggacuuugg

SEQ ID NO: 457838 - RNA, 19 nt, Homo sapiens
uaacggacucccucaauuu

SEQ ID NO: 457839 - RNA, 19 nt, Homo sapiens
cauggaagcugagcagauu

SEQ ID NO: 457840 - RNA, 19 nt, Homo sapiens
uaagacaccugcuguugau

SEQ ID NO: 457841 - RNA, 19 nt, Homo sapiens
gaacaacauaugcaaccua

SEQ ID NO: 457842 - RNA, 19 nt, Homo sapiens
ucacagcacuuacaauuuu

SEQ ID NO: 457843 - RNA, 19 nt, Homo sapiens
gaagcugagcagauucuua

SEQ ID NO: 457844 - RNA, 19 nt, Homo sapiens
gcagaaaugacgaacuaaa

SEQ ID NO: 457845 - RNA, 19 nt, Homo sapiens
gagaaauuguggacuuuua

SEQ ID NO: 457846 - RNA, 19 nt, Homo sapiens
gaaagaggacagcagaaug

SEQ ID NO: 457847 - RNA, 19 nt, Homo sapiens
gacauugacuacauggaaa

SEQ ID NO: 457848 - RNA, 19 nt, Homo sapiens
gggcaaugcucaugguguu

SEQ ID NO: 457849 - RNA, 19 nt, Homo sapiens
gaacauacagcauuuaagc

SEQ ID NO: 457850 - RNA, 19 nt, Homo sapiens
gaacgcucauuccaauuuc

SEQ ID NO: 457851 - RNA, 19 nt, Homo sapiens
gugcacacauucaucauau

SEQ ID NO: 457852 - RNA, 19 nt, Homo sapiens
gaugcuauuugguaugauu

SEQ ID NO: 457853 - RNA, 19 nt, Homo sapiens
ggauugacaugaaugaagu

SEQ ID NO: 457854 - RNA, 19 nt, Homo sapiens
gaagcuggcauaccauuug

SEQ ID NO: 457855 - RNA, 19 nt, Homo sapiens
gcaaugcaauggagauuuu

SEQ ID NO: 457856 - RNA, 19 nt, Homo sapiens
guauugaucugaccacaca

SEQ ID NO: 457857 - RNA, 19 nt, Homo sapiens
gagagaguauagacaccua

SEQ ID NO: 457858 - RNA, 19 nt, Homo sapiens
gcuaaugguggcacuguua

SEQ ID NO: 457859 - RNA, 19 nt, Homo sapiens
agaacaggcuaugaaauaa

SEQ ID NO: 457860 - RNA, 19 nt, Homo sapiens
gaugaaguuugaugguuug

SEQ ID NO: 457861 - RNA, 19 nt, Homo sapiens
gaucucaaacuuaaucuug

SEQ ID NO: 457862 - RNA, 19 nt, Homo sapiens
ucaaggcaguauuuaacua

SEQ ID NO: 457863 - RNA, 19 nt, Homo sapiens
ugaaugaaguuuccagcuu

SEQ ID NO: 457864 - RNA, 19 nt, Homo sapiens
auacacaggucacugauau

SEQ ID NO: 457865 - RNA, 19 nt, Homo sapiens
gcagaaugaugucuuuguc

SEQ ID NO: 457866 - RNA, 19 nt, Homo sapiens
gcaaugcaauggauguuac

SEQ ID NO: 457867 - RNA, 19 nt, Homo sapiens
ggaagagucauuugggauu

SEQ ID NO: 457868 - RNA, 19 nt, Homo sapiens
gaaaguggcuaauucagua

SEQ ID NO: 457869 - RNA, 19 nt, Homo sapiens
gaagagcucugugaguuua

SEQ ID NO: 457870 - RNA, 19 nt, Homo sapiens
gcccaaagcucacauguug

SEQ ID NO: 457871 - RNA, 19 nt, Homo sapiens
caacagccauuaugaauag

SEQ ID NO: 457872 - RNA, 19 nt, Homo sapiens
cagcauaaguccauuacaa

SEQ ID NO: 457873 - RNA, 19 nt, Homo sapiens
caacuuggcuauggagaaa

SEQ ID NO: 457874 - RNA, 19 nt, Homo sapiens
ucuauaaggugcucucuuu

SEQ ID NO: 457875 - RNA, 19 nt, Homo sapiens
gcaacagccauuaugaaua

SEQ ID NO: 457876 - RNA, 19 nt, Homo sapiens
caagcaagcugaaaauuuu

SEQ ID NO: 457877 - RNA, 19 nt, Homo sapiens
aagaaaggcuguuaaauac

SEQ ID NO: 457878 - RNA, 19 nt, Homo sapiens
ggaaacaguugcauguagu

SEQ ID NO: 457879 - RNA, 19 nt, Homo sapiens
ggucauaggcgacgauuga

SEQ ID NO: 457880 - RNA, 19 nt, Homo sapiens
gguggaagcuagacacaug

SEQ ID NO: 457881 - RNA, 19 nt, Homo sapiens
ccuuugagcuuaaucuuga

SEQ ID NO: 457882 - RNA, 19 nt, Homo sapiens
uaagaaaggaagcauugua

SEQ ID NO: 457883 - RNA, 19 nt, Homo sapiens
gaaacaguugcauguagua

SEQ ID NO: 457884 - RNA, 19 nt, Homo sapiens
ggaauugcaacagccauua

SEQ ID NO: 457885 - RNA, 19 nt, Homo sapiens
gaaauaacucugccacaca

SEQ ID NO: 457886 - RNA, 19 nt, Homo sapiens
caauuuaggcaucaaugua

SEQ ID NO: 457887 - RNA, 19 nt, Homo sapiens
ggagaaaguggcuaauuca

SEQ ID NO: 457888 - RNA, 19 nt, Homo sapiens
ggaagcgacuccucgaucu

SEQ ID NO: 457889 - RNA, 19 nt, Homo sapiens
gaagguuagagauaaauug

SEQ ID NO: 457890 - RNA, 19 nt, Homo sapiens
acagaugagucacaccuuu

SEQ ID NO: 457891 - RNA, 19 nt, Homo sapiens
caacugcauccaacaauga

SEQ ID NO: 457892 - RNA, 19 nt, Homo sapiens
guaacuauuuccauguguu

SEQ ID NO: 457893 - RNA, 19 nt, Homo sapiens
ggucaugggccacugcuuu

SEQ ID NO: 457894 - RNA, 19 nt, Homo sapiens
gaaaggaagcauuguaaaa

SEQ ID NO: 457895 - RNA, 19 nt, Homo sapiens
agucacaccuuugagcuua

SEQ ID NO: 457896 - RNA, 19 nt, Homo sapiens
cuagacacaugaagguaaa

SEQ ID NO: 457897 - RNA, 19 nt, Homo sapiens
gcaucaauguaacuauuuc

SEQ ID NO: 457898 - RNA, 19 nt, Homo sapiens
gcacaacugcauccaacaa

SEQ ID NO: 457899 - RNA, 19 nt, Homo sapiens
uggagaaaguggcuaauuc

SEQ ID NO: 457900 - RNA, 19 nt, Homo sapiens
cagaguggccaucuuguuu

SEQ ID NO: 457901 - RNA, 19 nt, Homo sapiens
gccaugaguuccagaaagu

SEQ ID NO: 457902 - RNA, 19 nt, Homo sapiens
gauaggaacacgcaagcaa

SEQ ID NO: 457903 - RNA, 19 nt, Homo sapiens
gcuagacacaugaagguaa

SEQ ID NO: 457904 - RNA, 19 nt, Homo sapiens
gcaagcaagcugaaaauuu

SEQ ID NO: 457905 - RNA, 19 nt, Homo sapiens
gcuguugacugggugauga

SEQ ID NO: 457906 - RNA, 19 nt, Homo sapiens
gcaguucuucgcaaucgua

SEQ ID NO: 457907 - RNA, 19 nt, Homo sapiens
ucacuucauguuagucuua

SEQ ID NO: 457908 - RNA, 19 nt, Homo sapiens
agcuuaaucuugaagguua

SEQ ID NO: 457909 - RNA, 19 nt, Homo sapiens
aagaaaggaagcauuguaa

SEQ ID NO: 457910 - RNA, 19 nt, Homo sapiens
cauguuagucuuagagaaa

SEQ ID NO: 457911 - RNA, 19 nt, Homo sapiens
gaagcgacuccucgaucua

SEQ ID NO: 457912 - RNA, 19 nt, Homo sapiens
ucuugaagguuagagauaa

SEQ ID NO: 457913 - RNA, 19 nt, Homo sapiens
aggcaucaauguaacuauu

SEQ ID NO: 457914 - RNA, 19 nt, Homo sapiens
gcaauuuaggcaucaaugu

SEQ ID NO: 457915 - RNA, 19 nt, Homo sapiens
augaagagcucugugaguu

SEQ ID NO: 457916 - RNA, 19 nt, Homo sapiens
ccaucugucugccaaccua

SEQ ID NO: 457917 - RNA, 19 nt, Homo sapiens
gaauugcaacagccauuau

SEQ ID NO: 457918 - RNA, 19 nt, Homo sapiens
ucugugaguuuaggccuua

SEQ ID NO: 457919 - RNA, 19 nt, Homo sapiens
gcaacuuggcuauggagaa

SEQ ID NO: 457920 - RNA, 19 nt, Homo sapiens
acaguugcauguaguaaca

SEQ ID NO: 457921 - RNA, 19 nt, Homo sapiens
gaguggccaucuuguuugu

SEQ ID NO: 457922 - RNA, 19 nt, Homo sapiens
gacacaugaagguaaauaa

SEQ ID NO: 457923 - RNA, 19 nt, Homo sapiens
gggauccauucgcaacuug

SEQ ID NO: 457924 - RNA, 19 nt, Homo sapiens
ugaaauggcaaucaaacau

SEQ ID NO: 457925 - RNA, 19 nt, Homo sapiens
caucagcauaaguccauua

SEQ ID NO: 457926 - RNA, 19 nt, Homo sapiens
ugaagagcucugugaguuu

SEQ ID NO: 457927 - RNA, 19 nt, Homo sapiens
aaauaugcgucuucuggau

SEQ ID NO: 457928 - RNA, 19 nt, Homo sapiens
acaacugcauccaacaaug

SEQ ID NO: 457929 - RNA, 19 nt, Homo sapiens
caugaguuccagaaaguaa

SEQ ID NO: 457930 - RNA, 19 nt, Homo sapiens
uaaauacaggaaacaguug

SEQ ID NO: 457931 - RNA, 19 nt, Homo sapiens
acagggagaggauauaguu

SEQ ID NO: 457932 - RNA, 19 nt, Homo sapiens
gcaaggcucucuggaugcu

SEQ ID NO: 457933 - RNA, 19 nt, Homo sapiens
gagcuuaaucuugaagguu

SEQ ID NO: 457934 - RNA, 19 nt, Homo sapiens
cuuugugagucaauacaua

SEQ ID NO: 457935 - RNA, 19 nt, Homo sapiens
ggcaucaauguaacuauuu

SEQ ID NO: 457936 - RNA, 19 nt, Homo sapiens
cugcuuugacuauguguua

SEQ ID NO: 457937 - RNA, 19 nt, Homo sapiens
caagcuauuuaaagcaucu

SEQ ID NO: 457938 - RNA, 19 nt, Homo sapiens
uagcaacugucgcccaaag

SEQ ID NO: 457939 - RNA, 19 nt, Homo sapiens
gaagccaugaguuccagaa

SEQ ID NO: 457940 - RNA, 19 nt, Homo sapiens
gcucuccgcccacagaaau

SEQ ID NO: 457941 - RNA, 19 nt, Homo sapiens
agaagaaggcaucgucaug

SEQ ID NO: 457942 - RNA, 19 nt, Homo sapiens
ccaaagcucacauguuguc

SEQ ID NO: 457943 - RNA, 19 nt, Homo sapiens
agaaaggaagcauuguaaa

SEQ ID NO: 457944 - RNA, 19 nt, Homo sapiens
aggaaacaguugcauguag

SEQ ID NO: 457945 - RNA, 19 nt, Homo sapiens
aaauaaggcacccaucugu

SEQ ID NO: 457946 - RNA, 19 nt, Homo sapiens
uaacuauuuccauguguug

SEQ ID NO: 457947 - RNA, 19 nt, Homo sapiens
cuugaagguuagagauaaa

SEQ ID NO: 457948 - RNA, 19 nt, Homo sapiens
ggugcucucuuucugucuu

SEQ ID NO: 457949 - RNA, 19 nt, Homo sapiens
guggccaucuuguuuguag

SEQ ID NO: 457950 - RNA, 19 nt, Homo sapiens
gcuacagacauuaaucuuc

SEQ ID NO: 457951 - RNA, 19 nt, Homo sapiens
gcccuggugcuuccuguaa

SEQ ID NO: 457952 - RNA, 19 nt, Homo sapiens
gucaugcacaguauuugua

SEQ ID NO: 457953 - RNA, 19 nt, Homo sapiens
agacacaugaagguaaaua

SEQ ID NO: 457954 - RNA, 19 nt, Homo sapiens
gaaaauaaggcacccaucu

SEQ ID NO: 457955 - RNA, 19 nt, Homo sapiens
ggugugugcguguugguuu

SEQ ID NO: 457956 - RNA, 19 nt, Homo sapiens
uggcuuucacuucauguua

SEQ ID NO: 457957 - RNA, 19 nt, Homo sapiens
gcaguccuguuuuggcuuu

SEQ ID NO: 457958 - RNA, 19 nt, Homo sapiens
aagcucacauguuguccaa

SEQ ID NO: 457959 - RNA, 19 nt, Homo sapiens
guggcuaauucaguacuuu

SEQ ID NO: 457960 - RNA, 19 nt, Homo sapiens
auaaggugcucucuuucug

SEQ ID NO: 457961 - RNA, 19 nt, Homo sapiens
cauuaugaauagcgacugu

SEQ ID NO: 457962 - RNA, 19 nt, Homo sapiens
cauaggcgacgauugacuu

SEQ ID NO: 457963 - RNA, 19 nt, Homo sapiens
gcaaucguacagcugauag

SEQ ID NO: 457964 - RNA, 19 nt, Homo sapiens
ucauguuagucuuagagaa

SEQ ID NO: 457965 - RNA, 19 nt, Homo sapiens
ggcuuucacuucauguuag

SEQ ID NO: 457966 - RNA, 19 nt, Homo sapiens
caggaaacaguugcaugua

SEQ ID NO: 457967 - RNA, 19 nt, Homo sapiens
acaggaaacaguugcaugu

SEQ ID NO: 457968 - RNA, 19 nt, Homo sapiens
gcacagggcuucuauagau

SEQ ID NO: 457969 - RNA, 19 nt, Homo sapiens
gaacagcagugucccaucu

SEQ ID NO: 457970 - RNA, 19 nt, Homo sapiens
ggagaaaccagaacaugaa

SEQ ID NO: 457971 - RNA, 19 nt, Homo sapiens
gagaauuacuggguuaaau

SEQ ID NO: 457972 - RNA, 19 nt, Homo sapiens
uagggagccugccaauuua

SEQ ID NO: 457973 - RNA, 19 nt, Homo sapiens
caacaaaguucauuaaccu

SEQ ID NO: 457974 - RNA, 19 nt, Homo sapiens
gcuaauagacacugaauca

SEQ ID NO: 457975 - RNA, 19 nt, Homo sapiens
uuagggagccugccaauuu

SEQ ID NO: 457976 - RNA, 19 nt, Homo sapiens
gacaucgucuuucuagcua

SEQ ID NO: 457977 - RNA, 19 nt, Homo sapiens
ucagugaucuuucaacagu

SEQ ID NO: 457978 - RNA, 19 nt, Homo sapiens
ccguaaaccuucaaaauua

SEQ ID NO: 457979 - RNA, 19 nt, Homo sapiens
gaacgcacgccugagauuu

SEQ ID NO: 457980 - RNA, 19 nt, Homo sapiens
caagcaagccgagaacuuu

SEQ ID NO: 457981 - RNA, 19 nt, Homo sapiens
ccggagugcuuaucuuaaa

SEQ ID NO: 457982 - RNA, 19 nt, Homo sapiens
cagcagauuccuuuacuuu

SEQ ID NO: 457983 - RNA, 19 nt, Homo sapiens
gauacuguuugucuuucua

SEQ ID NO: 457984 - RNA, 19 nt, Homo sapiens
gcaguccuguuucccugua

SEQ ID NO: 457985 - RNA, 19 nt, Homo sapiens
gaacuauagauccacauga

SEQ ID NO: 457986 - RNA, 19 nt, Homo sapiens
uuaacagucucaucaguga

SEQ ID NO: 457987 - RNA, 19 nt, Homo sapiens
ccauaugucuucacaaguc

SEQ ID NO: 457988 - RNA, 19 nt, Homo sapiens
gcagauuccuuuacuuuug

SEQ ID NO: 457989 - RNA, 19 nt, Homo sapiens
gaaccuggcuauggagaag

SEQ ID NO: 457990 - RNA, 19 nt, Homo sapiens
gaaaggguccagauuuuaa

SEQ ID NO: 457991 - RNA, 19 nt, Homo sapiens
cgagaacuuugccuacaga

SEQ ID NO: 457992 - RNA, 19 nt, Homo sapiens
gcaagcaagccgagaacuu

SEQ ID NO: 457993 - RNA, 19 nt, Homo sapiens
accagaacaugaagacaua

SEQ ID NO: 457994 - RNA, 19 nt, Homo sapiens
caauuuaacagucucauca

SEQ ID NO: 457995 - RNA, 19 nt, Homo sapiens
gauaaugggaaccuuggaa

SEQ ID NO: 457996 - RNA, 19 nt, Homo sapiens
gaaacaagagaaguacgaa

SEQ ID NO: 457997 - RNA, 19 nt, Homo sapiens
uuggauggcuggcuaauag

SEQ ID NO: 457998 - RNA, 19 nt, Homo sapiens
ggagguaggaauuguuuua

SEQ ID NO: 457999 - RNA, 19 nt, Homo sapiens
gacccaacaaaguucauua

SEQ ID NO: 458000 - RNA, 19 nt, Homo sapiens
caagucaggacccacaauu

SEQ ID NO: 458001 - RNA, 19 nt, Homo sapiens
ggaaaggguccagauuuua

SEQ ID NO: 458002 - RNA, 19 nt, Homo sapiens
aacuauagauccacaugaa

SEQ ID NO: 458003 - RNA, 19 nt, Homo sapiens
agugaucuuucaacaguaa

SEQ ID NO: 458004 - RNA, 19 nt, Homo sapiens
gguaggaauuguuuuaaug

SEQ ID NO: 458005 - RNA, 19 nt, Homo sapiens
ccuacagacuggaguugaa

SEQ ID NO: 458006 - RNA, 19 nt, Homo sapiens
uuugagaauuacuggguua

SEQ ID NO: 458007 - RNA, 19 nt, Homo sapiens
gaagacauaugugaauacc

SEQ ID NO: 458008 - RNA, 19 nt, Homo sapiens
cggagaaaccagaacauga

SEQ ID NO: 458009 - RNA, 19 nt, Homo sapiens
guuugucuuucuacuguuu

SEQ ID NO: 458010 - RNA, 19 nt, Homo sapiens
aaccuuggaaucaauguua

SEQ ID NO: 458011 - RNA, 19 nt, Homo sapiens
uggagaaacaagagaagua

SEQ ID NO: 458012 - RNA, 19 nt, Homo sapiens
gaaucacccggagugcuua

SEQ ID NO: 458013 - RNA, 19 nt, Homo sapiens
ccaacaaaguucauuaacc

SEQ ID NO: 458014 - RNA, 19 nt, Homo sapiens
gaaaccagaacaugaagac

SEQ ID NO: 458015 - RNA, 19 nt, Homo sapiens
ccauauuggucccuugaca

SEQ ID NO: 458016 - RNA, 19 nt, Homo sapiens
cgacacagccauagcacau

SEQ ID NO: 458017 - RNA, 19 nt, Homo sapiens
gacuauguccugccuccua

SEQ ID NO: 458018 - RNA, 19 nt, Homo sapiens
gcuguucugugaucuaaaa

SEQ ID NO: 458019 - RNA, 19 nt, Homo sapiens
ugacuuccguaaaccuuca

SEQ ID NO: 458020 - RNA, 19 nt, Homo sapiens
ugaugugacuuccguaaac

SEQ ID NO: 458021 - RNA, 19 nt, Homo sapiens
gcugucgacugggugauga

SEQ ID NO: 458022 - RNA, 19 nt, Homo sapiens
caugaagacauaugugaau

SEQ ID NO: 458023 - RNA, 19 nt, Homo sapiens
caugaacgcacgccugaga

SEQ ID NO: 458024 - RNA, 19 nt, Homo sapiens
gccgauacuguuugucuuu

SEQ ID NO: 458025 - RNA, 19 nt, Homo sapiens
gaucaguguguuaggaaug

SEQ ID NO: 458026 - RNA, 19 nt, Homo sapiens
gaaccuuggaaucaauguu

SEQ ID NO: 458027 - RNA, 19 nt, Homo sapiens
gaaugggguuggccuguug

SEQ ID NO: 458028 - RNA, 19 nt, Homo sapiens
gccgagaacuuugccuaca

SEQ ID NO: 458029 - RNA, 19 nt, Homo sapiens
ggagaaacaagagaaguac

SEQ ID NO: 458030 - RNA, 19 nt, Homo sapiens
ugaaucacccggagugcuu

SEQ ID NO: 458031 - RNA, 19 nt, Homo sapiens
uuuggaugcuguucuguga

SEQ ID NO: 458032 - RNA, 19 nt, Homo sapiens
cuuucuagcuacagacauu

SEQ ID NO: 458033 - RNA, 19 nt, Homo sapiens
cuaauaaacccugcagcaa

SEQ ID NO: 458034 - RNA, 19 nt, Homo sapiens
cugccugccuucccauauu

SEQ ID NO: 458035 - RNA, 19 nt, Homo sapiens
cauaugucuucacaaguca

SEQ ID NO: 458036 - RNA, 19 nt, Homo sapiens
ggucugcuuugacuauguc

SEQ ID NO: 458037 - RNA, 19 nt, Homo sapiens
cgaaggccaccagcaguuu

SEQ ID NO: 458038 - RNA, 19 nt, Homo sapiens
uggguuaaauuguggaaag

SEQ ID NO: 458039 - RNA, 19 nt, Homo sapiens
ggccucggcaguccuguuu

SEQ ID NO: 458040 - RNA, 19 nt, Homo sapiens
ugauuuggaugcuguucug

SEQ ID NO: 458041 - RNA, 19 nt, Homo sapiens
caugaugugacuuccguaa

SEQ ID NO: 458042 - RNA, 19 nt, Homo sapiens
acacagccauagcacaucu

SEQ ID NO: 458043 - RNA, 19 nt, Homo sapiens
aagucaggacccacaauua

SEQ ID NO: 458044 - RNA, 19 nt, Homo sapiens
ucccugacccugcaccaua

SEQ ID NO: 458045 - RNA, 19 nt, Homo sapiens
ggaaccuggcuauggagaa

SEQ ID NO: 458046 - RNA, 19 nt, Homo sapiens
ucagcagauuccuuuacuu

SEQ ID NO: 458047 - RNA, 19 nt, Homo sapiens
auuggucccuugacauuga

SEQ ID NO: 458048 - RNA, 19 nt, Homo sapiens
ugaacgcacgccugagauu

SEQ ID NO: 458049 - RNA, 19 nt, Homo sapiens
ccccaacccucaaauuaaa

SEQ ID NO: 458050 - RNA, 19 nt, Homo sapiens
ucuauagaucaguguguua

SEQ ID NO: 458051 - RNA, 19 nt, Homo sapiens
gccaucguccugcucauug

SEQ ID NO: 458052 - RNA, 19 nt, Homo sapiens
gugcuuaucuuaaaauugc

SEQ ID NO: 458053 - RNA, 19 nt, Homo sapiens
auagaucaguguguuagga

SEQ ID NO: 458054 - RNA, 19 nt, Homo sapiens
caaugccgccagaaguuga

SEQ ID NO: 458055 - RNA, 19 nt, Homo sapiens
gagaaaccagaacaugaag

SEQ ID NO: 458056 - RNA, 19 nt, Homo sapiens
uaaccaaugccgccagaag

SEQ ID NO: 458057 - RNA, 19 nt, Homo sapiens
caucgucuuucuagcuaca

SEQ ID NO: 458058 - RNA, 19 nt, Homo sapiens
cagugaucuuucaacagua

SEQ ID NO: 458059 - RNA, 19 nt, Homo sapiens
ccaaugccgccagaaguug

SEQ ID NO: 458060 - RNA, 19 nt, Homo sapiens
gucagcagauuccuuuacu

SEQ ID NO: 458061 - RNA, 19 nt, Homo sapiens
uggaugcuguucugugauc

SEQ ID NO: 458062 - RNA, 19 nt, Homo sapiens
uuccauaugucuucacaag

SEQ ID NO: 458063 - RNA, 19 nt, Homo sapiens
cuguuugucuuucuacugu

SEQ ID NO: 458064 - RNA, 19 nt, Homo sapiens
guuggccuguuggugauuu

SEQ ID NO: 458065 - RNA, 19 nt, Homo sapiens
ggguuggccuguuggugau

SEQ ID NO: 458066 - RNA, 19 nt, Homo sapiens
gcuucgacccaacaaaguu

SEQ ID NO: 458067 - RNA, 19 nt, Homo sapiens
agaaacaagagaaguacga

SEQ ID NO: 458068 - RNA, 19 nt, Homo sapiens
ggaauuaacugucuuauug

SEQ ID NO: 458069 - RNA, 19 nt, Homo sapiens
ggugagauguuucauauuu

SEQ ID NO: 458070 - RNA, 19 nt, Homo sapiens
gcagagaaaucgaugauca

SEQ ID NO: 458071 - RNA, 19 nt, Homo sapiens
gauccuaucucacugcuuu

SEQ ID NO: 458072 - RNA, 19 nt, Homo sapiens
gaucagagaaggcuuuaua

SEQ ID NO: 458073 - RNA, 19 nt, Homo sapiens
gcacacauaucuagcauuc

SEQ ID NO: 458074 - RNA, 19 nt, Homo sapiens
ccacacacaugcacacaua

SEQ ID NO: 458075 - RNA, 19 nt, Homo sapiens
caaaagaucuggaagaauu

SEQ ID NO: 458076 - RNA, 19 nt, Homo sapiens
cagaagagauucagccaaa

SEQ ID NO: 458077 - RNA, 19 nt, Homo sapiens
gaaagggaguuacuaugau

SEQ ID NO: 458078 - RNA, 19 nt, Homo sapiens
acacaucucuucaucugua

SEQ ID NO: 458079 - RNA, 19 nt, Homo sapiens
aaacauggcaagcagauua

SEQ ID NO: 458080 - RNA, 19 nt, Homo sapiens
gaagaaagggaguuacuau

SEQ ID NO: 458081 - RNA, 19 nt, Homo sapiens
gaaggucucucagggugua

SEQ ID NO: 458082 - RNA, 19 nt, Homo sapiens
gauuaaagggucuugguua

SEQ ID NO: 458083 - RNA, 19 nt, Homo sapiens
gugaccagguggauauuua

SEQ ID NO: 458084 - RNA, 19 nt, Homo sapiens
caucugagccguuugaauu

SEQ ID NO: 458085 - RNA, 19 nt, Homo sapiens
gcaaugcucugcaccucuu

SEQ ID NO: 458086 - RNA, 19 nt, Homo sapiens
ggacuuaacgucacucuca

SEQ ID NO: 458087 - RNA, 19 nt, Homo sapiens
gaacuuagagacucaagau

SEQ ID NO: 458088 - RNA, 19 nt, Homo sapiens
gauggaagguagagaagga

SEQ ID NO: 458089 - RNA, 19 nt, Homo sapiens
acacauaucuagcauucuu

SEQ ID NO: 458090 - RNA, 19 nt, Homo sapiens
uuaaaugaauggucucuug

SEQ ID NO: 458091 - RNA, 19 nt, Homo sapiens
ggacgacacuggguagaau

SEQ ID NO: 458092 - RNA, 19 nt, Homo sapiens
ggcaaaugcucuuccuuga

SEQ ID NO: 458093 - RNA, 19 nt, Homo sapiens
aaagacaguuuguacaaug

SEQ ID NO: 458094 - RNA, 19 nt, Homo sapiens
gguucugucuucuuugaua

SEQ ID NO: 458095 - RNA, 19 nt, Homo sapiens
gaagucugcaucuaaauau

SEQ ID NO: 458096 - RNA, 19 nt, Homo sapiens
acaaaccaaugcucuauau

SEQ ID NO: 458097 - RNA, 19 nt, Homo sapiens
gaguuacuaugauuccuuu

SEQ ID NO: 458098 - RNA, 19 nt, Homo sapiens
gauuacaucugagccguuu

SEQ ID NO: 458099 - RNA, 19 nt, Homo sapiens
aaagggaguuacuaugauu

SEQ ID NO: 458100 - RNA, 19 nt, Homo sapiens
gaacaggcagguaggauuc

SEQ ID NO: 458101 - RNA, 19 nt, Homo sapiens
ugguagaggucacagauuu

SEQ ID NO: 458102 - RNA, 19 nt, Homo sapiens
ggaaaccuccuacccaugu

SEQ ID NO: 458103 - RNA, 19 nt, Homo sapiens
cugcuuaacugcuguauag

SEQ ID NO: 458104 - RNA, 19 nt, Homo sapiens
cguaguaggugcucaguuc

SEQ ID NO: 458105 - RNA, 19 nt, Homo sapiens
cugcaucccuucucccaua

SEQ ID NO: 458106 - RNA, 19 nt, Homo sapiens
ggagauggaagguagagaa

SEQ ID NO: 458107 - RNA, 19 nt, Homo sapiens
cuacacaucucuucaucug

SEQ ID NO: 458108 - RNA, 19 nt, Homo sapiens
agaaagggaguuacuauga

SEQ ID NO: 458109 - RNA, 19 nt, Homo sapiens
ugacuucccugaacacauc

SEQ ID NO: 458110 - RNA, 19 nt, Homo sapiens
gcaaagcaguggacaacac

SEQ ID NO: 458111 - RNA, 19 nt, Homo sapiens
caagaaaccaugcaaagca

SEQ ID NO: 458112 - RNA, 19 nt, Homo sapiens
cuuagagacucaagauauu

SEQ ID NO: 458113 - RNA, 19 nt, Homo sapiens
ugaagucugcaucuaaaua

SEQ ID NO: 458114 - RNA, 19 nt, Homo sapiens
ccagaugccuugggagcua

SEQ ID NO: 458115 - RNA, 19 nt, Homo sapiens
caaggaauuccagguguua

SEQ ID NO: 458116 - RNA, 19 nt, Homo sapiens
ccaaggauuaugucaaauu

SEQ ID NO: 458117 - RNA, 19 nt, Homo sapiens
ccaaggaauuccagguguu

SEQ ID NO: 458118 - RNA, 19 nt, Homo sapiens
aaagggcccuggagugaga

SEQ ID NO: 458119 - RNA, 19 nt, Homo sapiens
ccagggcucugcacucuca

SEQ ID NO: 458120 - RNA, 19 nt, Homo sapiens
caucagggcugccaaagcu

SEQ ID NO: 458121 - RNA, 19 nt, Homo sapiens
agacugacgugugcuacua

SEQ ID NO: 458122 - RNA, 19 nt, Homo sapiens
agaauuaccuaagcaugaa

SEQ ID NO: 458123 - RNA, 19 nt, Homo sapiens
gacggaggcuaguguggaa

SEQ ID NO: 458124 - RNA, 19 nt, Homo sapiens
cuggugagauguuucauau

SEQ ID NO: 458125 - RNA, 19 nt, Homo sapiens
uaacugcuguauaggacaa

SEQ ID NO: 458126 - RNA, 19 nt, Homo sapiens
gccugcagcuccaaucuga

SEQ ID NO: 458127 - RNA, 19 nt, Homo sapiens
acucagauaucccaaagug

SEQ ID NO: 458128 - RNA, 19 nt, Homo sapiens
acccaaggauuaugucaaa

SEQ ID NO: 458129 - RNA, 19 nt, Homo sapiens
gugagauguuucauauuug

SEQ ID NO: 458130 - RNA, 19 nt, Homo sapiens
ccagucccauucuuccuuu

SEQ ID NO: 458131 - RNA, 19 nt, Homo sapiens
caagaaaucuccccagaag

SEQ ID NO: 458132 - RNA, 19 nt, Homo sapiens
ccacucagauaucccaaag

SEQ ID NO: 458133 - RNA, 19 nt, Homo sapiens
gggcaggugugcuguugug

SEQ ID NO: 458134 - RNA, 19 nt, Homo sapiens
gaucaugggacccucucua

SEQ ID NO: 458135 - RNA, 19 nt, Homo sapiens
gaauuccuggcuugguuua

SEQ ID NO: 458136 - RNA, 19 nt, Homo sapiens
gggaauuaacugucuuauu

SEQ ID NO: 458137 - RNA, 19 nt, Homo sapiens
gccaaacccucagcuuaug

SEQ ID NO: 458138 - RNA, 19 nt, Homo sapiens
gaggugugguagcagauug

SEQ ID NO: 458139 - RNA, 19 nt, Homo sapiens
ggagggccacgcacuuaaa

SEQ ID NO: 458140 - RNA, 19 nt, Homo sapiens
ggagagagaugggcuugcu

SEQ ID NO: 458141 - RNA, 19 nt, Homo sapiens
acugggugcuuaugauuaa

SEQ ID NO: 458142 - RNA, 19 nt, Homo sapiens
cuugaagucugcaucuaaa

SEQ ID NO: 458143 - RNA, 19 nt, Homo sapiens
gcaagacugacgugugcua

SEQ ID NO: 458144 - RNA, 19 nt, Homo sapiens
cauccaagcgcaagacuga

SEQ ID NO: 458145 - RNA, 19 nt, Homo sapiens
ccaaagugguaccagaauc

SEQ ID NO: 458146 - RNA, 19 nt, Homo sapiens
guacaaaguguccuacaag

SEQ ID NO: 458147 - RNA, 19 nt, Homo sapiens
gcuauugguuuggaguuga

SEQ ID NO: 458148 - RNA, 19 nt, Homo sapiens
guucugugcugucuaugug

SEQ ID NO: 458149 - RNA, 19 nt, Homo sapiens
gcuugaagucugcaucuaa

SEQ ID NO: 458150 - RNA, 19 nt, Homo sapiens
gagaaaucgaugaucauga

SEQ ID NO: 458151 - RNA, 19 nt, Homo sapiens
ucauuggucuggugagaug

SEQ ID NO: 458152 - RNA, 19 nt, Homo sapiens
gcacgugggcugcuuaacu

SEQ ID NO: 458153 - RNA, 19 nt, Homo sapiens
gacaugcucuccagauggu

SEQ ID NO: 458154 - RNA, 19 nt, Homo sapiens
guguggcucucuggacuua

SEQ ID NO: 458155 - RNA, 19 nt, Homo sapiens
uuacauaccagucccauuc

SEQ ID NO: 458156 - RNA, 19 nt, Homo sapiens
uuucuaagaucuaccugaa

SEQ ID NO: 458157 - RNA, 19 nt, Homo sapiens
ggcauucagaugagucuua

SEQ ID NO: 458158 - RNA, 19 nt, Homo sapiens
gguccagccuucccuguag

SEQ ID NO: 458159 - RNA, 19 nt, Homo sapiens
agaagaauuuggugaagca

SEQ ID NO: 458160 - RNA, 19 nt, Homo sapiens
agaaaucgaugaucaugac

SEQ ID NO: 458161 - RNA, 19 nt, Homo sapiens
ggaccaggcaucaaguuca

SEQ ID NO: 458162 - RNA, 19 nt, Homo sapiens
uaaagagucuggggaaauu

SEQ ID NO: 458163 - RNA, 19 nt, Homo sapiens
cagacaugcucuccagaug

SEQ ID NO: 458164 - RNA, 19 nt, Homo sapiens
cagaugagucuuagaggaa

SEQ ID NO: 458165 - RNA, 19 nt, Homo sapiens
gcauucagaugagucuuag

SEQ ID NO: 458166 - RNA, 19 nt, Homo sapiens
cagagaaggcuuuauagca

SEQ ID NO: 458167 - RNA, 19 nt, Homo sapiens
gacugggugcuuaugauua

SEQ ID NO: 458168 - RNA, 19 nt, Homo sapiens
ggaauuaacugucuuauug

SEQ ID NO: 458169 - RNA, 19 nt, Homo sapiens
ggugagauguuucauauuu

SEQ ID NO: 458170 - RNA, 19 nt, Homo sapiens
gcagagaaaucgaugauca

SEQ ID NO: 458171 - RNA, 19 nt, Homo sapiens
gauccuaucucacugcuuu

SEQ ID NO: 458172 - RNA, 19 nt, Homo sapiens
gaucagagaaggcuuuaua

SEQ ID NO: 458173 - RNA, 19 nt, Homo sapiens
gcacacauaucuagcauuc

SEQ ID NO: 458174 - RNA, 19 nt, Homo sapiens
ccacacacaugcacacaua

SEQ ID NO: 458175 - RNA, 19 nt, Homo sapiens
caaaagaucuggaagaauu

SEQ ID NO: 458176 - RNA, 19 nt, Homo sapiens
cagaagagauucagccaaa

SEQ ID NO: 458177 - RNA, 19 nt, Homo sapiens
gaaagggaguuacuaugau

SEQ ID NO: 458178 - RNA, 19 nt, Homo sapiens
aaacauggcaagcagauua

SEQ ID NO: 458179 - RNA, 19 nt, Homo sapiens
gaagaaagggaguuacuau

SEQ ID NO: 458180 - RNA, 19 nt, Homo sapiens
gaaggucucucagggugua

SEQ ID NO: 458181 - RNA, 19 nt, Homo sapiens
gauuaaagggucuugguua

SEQ ID NO: 458182 - RNA, 19 nt, Homo sapiens
gugaccagguggauauuua

SEQ ID NO: 458183 - RNA, 19 nt, Homo sapiens
caucugagccguuugaauu

SEQ ID NO: 458184 - RNA, 19 nt, Homo sapiens
gcaaugcucugcaccucuu

SEQ ID NO: 458185 - RNA, 19 nt, Homo sapiens
ggacuuaacgucacucuca

SEQ ID NO: 458186 - RNA, 19 nt, Homo sapiens
gaacuuagagacucaagau

SEQ ID NO: 458187 - RNA, 19 nt, Homo sapiens
gauggaagguagagaagga

SEQ ID NO: 458188 - RNA, 19 nt, Homo sapiens
acacauaucuagcauucuu

SEQ ID NO: 458189 - RNA, 19 nt, Homo sapiens
uuaaaugaauggucucuug

SEQ ID NO: 458190 - RNA, 19 nt, Homo sapiens
ggacgacacuggguagaau

SEQ ID NO: 458191 - RNA, 19 nt, Homo sapiens
ggcaaaugcucuuccuuga

SEQ ID NO: 458192 - RNA, 19 nt, Homo sapiens
aaagacaguuuguacaaug

SEQ ID NO: 458193 - RNA, 19 nt, Homo sapiens
gguucugucuucuuugaua

SEQ ID NO: 458194 - RNA, 19 nt, Homo sapiens
gaagucugcaucuaaauau

SEQ ID NO: 458195 - RNA, 19 nt, Homo sapiens
acaaaccaaugcucuauau

SEQ ID NO: 458196 - RNA, 19 nt, Homo sapiens
gaguuacuaugauuccuuu

SEQ ID NO: 458197 - RNA, 19 nt, Homo sapiens
gauuacaucugagccguuu

SEQ ID NO: 458198 - RNA, 19 nt, Homo sapiens
aaagggaguuacuaugauu

SEQ ID NO: 458199 - RNA, 19 nt, Homo sapiens
gaacaggcagguaggauuc

SEQ ID NO: 458200 - RNA, 19 nt, Homo sapiens
ugguagaggucacagauuu

SEQ ID NO: 458201 - RNA, 19 nt, Homo sapiens
ggaaaccuccuacccaugu

SEQ ID NO: 458202 - RNA, 19 nt, Homo sapiens
cugcuuaacugcuguauag

SEQ ID NO: 458203 - RNA, 19 nt, Homo sapiens
cguaguaggugcucaguuc

SEQ ID NO: 458204 - RNA, 19 nt, Homo sapiens
ggagauggaagguagagaa

SEQ ID NO: 458205 - RNA, 19 nt, Homo sapiens
agaaagggaguuacuauga

SEQ ID NO: 458206 - RNA, 19 nt, Homo sapiens
ugacuucccugaacacauc

SEQ ID NO: 458207 - RNA, 19 nt, Homo sapiens
gcaaagcaguggacaacac

SEQ ID NO: 458208 - RNA, 19 nt, Homo sapiens
caagaaaccaugcaaagca

SEQ ID NO: 458209 - RNA, 19 nt, Homo sapiens
cuuagagacucaagauauu

SEQ ID NO: 458210 - RNA, 19 nt, Homo sapiens
ugaagucugcaucuaaaua

SEQ ID NO: 458211 - RNA, 19 nt, Homo sapiens
ccagaugccuugggagcua

SEQ ID NO: 458212 - RNA, 19 nt, Homo sapiens
caaggaauuccagguguua

SEQ ID NO: 458213 - RNA, 19 nt, Homo sapiens
ccaaggauuaugucaaauu

SEQ ID NO: 458214 - RNA, 19 nt, Homo sapiens
ccaaggaauuccagguguu

SEQ ID NO: 458215 - RNA, 19 nt, Homo sapiens
aaagggcccuggagugaga

SEQ ID NO: 458216 - RNA, 19 nt, Homo sapiens
ccagggcucugcacucuca

SEQ ID NO: 458217 - RNA, 19 nt, Homo sapiens
caucagggcugccaaagcu

SEQ ID NO: 458218 - RNA, 19 nt, Homo sapiens
agacugacgugugcuacua

SEQ ID NO: 458219 - RNA, 19 nt, Homo sapiens
agaauuaccuaagcaugaa

SEQ ID NO: 458220 - RNA, 19 nt, Homo sapiens
gacggaggcuaguguggaa

SEQ ID NO: 458221 - RNA, 19 nt, Homo sapiens
cuggugagauguuucauau

SEQ ID NO: 458222 - RNA, 19 nt, Homo sapiens
uaacugcuguauaggacaa

SEQ ID NO: 458223 - RNA, 19 nt, Homo sapiens
gccugcagcuccaaucuga

SEQ ID NO: 458224 - RNA, 19 nt, Homo sapiens
acucagauaucccaaagug

SEQ ID NO: 458225 - RNA, 19 nt, Homo sapiens
acccaaggauuaugucaaa

SEQ ID NO: 458226 - RNA, 19 nt, Homo sapiens
gugagauguuucauauuug

SEQ ID NO: 458227 - RNA, 19 nt, Homo sapiens
gagaaguggugaaugucau

SEQ ID NO: 458228 - RNA, 19 nt, Homo sapiens
ccagucccauucuuccuuu

SEQ ID NO: 458229 - RNA, 19 nt, Homo sapiens
caagaaaucuccccagaag

SEQ ID NO: 458230 - RNA, 19 nt, Homo sapiens
ccacucagauaucccaaag

SEQ ID NO: 458231 - RNA, 19 nt, Homo sapiens
gggcaggugugcuguugug

SEQ ID NO: 458232 - RNA, 19 nt, Homo sapiens
gaucaugggacccucucua

SEQ ID NO: 458233 - RNA, 19 nt, Homo sapiens
gaauuccuggcuugguuua

SEQ ID NO: 458234 - RNA, 19 nt, Homo sapiens
gggaauuaacugucuuauu

SEQ ID NO: 458235 - RNA, 19 nt, Homo sapiens
gccaaacccucagcuuaug

SEQ ID NO: 458236 - RNA, 19 nt, Homo sapiens
gaggugugguagcagauug

SEQ ID NO: 458237 - RNA, 19 nt, Homo sapiens
ggagggccacgcacuuaaa

SEQ ID NO: 458238 - RNA, 19 nt, Homo sapiens
ggagagagaugggcuugcu

SEQ ID NO: 458239 - RNA, 19 nt, Homo sapiens
acugggugcuuaugauuaa

SEQ ID NO: 458240 - RNA, 19 nt, Homo sapiens
cuugaagucugcaucuaaa

SEQ ID NO: 458241 - RNA, 19 nt, Homo sapiens
gcaagacugacgugugcua

SEQ ID NO: 458242 - RNA, 19 nt, Homo sapiens
cauccaagcgcaagacuga

SEQ ID NO: 458243 - RNA, 19 nt, Homo sapiens
ccaaagugguaccagaauc

SEQ ID NO: 458244 - RNA, 19 nt, Homo sapiens
guacaaaguguccuacaag

SEQ ID NO: 458245 - RNA, 19 nt, Homo sapiens
gcuauugguuuggaguuga

SEQ ID NO: 458246 - RNA, 19 nt, Homo sapiens
guucugugcugucuaugug

SEQ ID NO: 458247 - RNA, 19 nt, Homo sapiens
ggagaaguggugaauguca

SEQ ID NO: 458248 - RNA, 19 nt, Homo sapiens
gcuugaagucugcaucuaa

SEQ ID NO: 458249 - RNA, 19 nt, Homo sapiens
gagaaaucgaugaucauga

SEQ ID NO: 458250 - RNA, 19 nt, Homo sapiens
ucauuggucuggugagaug

SEQ ID NO: 458251 - RNA, 19 nt, Homo sapiens
gcacgugggcugcuuaacu

SEQ ID NO: 458252 - RNA, 19 nt, Homo sapiens
gacaugcucuccagauggu

SEQ ID NO: 458253 - RNA, 19 nt, Homo sapiens
guguggcucucuggacuua

SEQ ID NO: 458254 - RNA, 19 nt, Homo sapiens
uuacauaccagucccauuc

SEQ ID NO: 458255 - RNA, 19 nt, Homo sapiens
uuucuaagaucuaccugaa

SEQ ID NO: 458256 - RNA, 19 nt, Homo sapiens
ggcauucagaugagucuua

SEQ ID NO: 458257 - RNA, 19 nt, Homo sapiens
gguccagccuucccuguag

SEQ ID NO: 458258 - RNA, 19 nt, Homo sapiens
agaagaauuuggugaagca

SEQ ID NO: 458259 - RNA, 19 nt, Homo sapiens
agaaaucgaugaucaugac

SEQ ID NO: 458260 - RNA, 19 nt, Homo sapiens
ggaccaggcaucaaguuca

SEQ ID NO: 458261 - RNA, 19 nt, Homo sapiens
uaaagagucuggggaaauu

SEQ ID NO: 458262 - RNA, 19 nt, Homo sapiens
cagacaugcucuccagaug

SEQ ID NO: 458263 - RNA, 19 nt, Homo sapiens
cagaugagucuuagaggaa

SEQ ID NO: 458264 - RNA, 19 nt, Homo sapiens
gcauucagaugagucuuag

SEQ ID NO: 458265 - RNA, 19 nt, Homo sapiens
cagagaaggcuuuauagca

SEQ ID NO: 458266 - RNA, 19 nt, Homo sapiens
gacugggugcuuaugauua

SEQ ID NO: 458267 - RNA, 19 nt, Homo sapiens
ccucugggaugcuugguau

SEQ ID NO: 458268 - RNA, 19 nt, Homo sapiens
ggaauuaacugucuuauug

SEQ ID NO: 458269 - RNA, 19 nt, Homo sapiens
ggugagauguuucauauuu

SEQ ID NO: 458270 - RNA, 19 nt, Homo sapiens
gauccuaucucacugcuuu

SEQ ID NO: 458271 - RNA, 19 nt, Homo sapiens
gaucagagaaggcuuuaua

SEQ ID NO: 458272 - RNA, 19 nt, Homo sapiens
gcacacauaucuagcauuc

SEQ ID NO: 458273 - RNA, 19 nt, Homo sapiens
ccacacacaugcacacaua

SEQ ID NO: 458274 - RNA, 19 nt, Homo sapiens
cagaagagauucagccaaa

SEQ ID NO: 458275 - RNA, 19 nt, Homo sapiens
aaacauggcaagcagauua

SEQ ID NO: 458276 - RNA, 19 nt, Homo sapiens
gaaggucucucagggugua

SEQ ID NO: 458277 - RNA, 19 nt, Homo sapiens
gauuaaagggucuugguua

SEQ ID NO: 458278 - RNA, 19 nt, Homo sapiens
gugaccagguggauauuua

SEQ ID NO: 458279 - RNA, 19 nt, Homo sapiens
caucugagccguuugaauu

SEQ ID NO: 458280 - RNA, 19 nt, Homo sapiens
gcaaugcucugcaccucuu

SEQ ID NO: 458281 - RNA, 19 nt, Homo sapiens
ggacuuaacgucacucuca

SEQ ID NO: 458282 - RNA, 19 nt, Homo sapiens
gaacuuagagacucaagau

SEQ ID NO: 458283 - RNA, 19 nt, Homo sapiens
gauggaagguagagaagga

SEQ ID NO: 458284 - RNA, 19 nt, Homo sapiens
acacauaucuagcauucuu

SEQ ID NO: 458285 - RNA, 19 nt, Homo sapiens
uuaaaugaauggucucuug

SEQ ID NO: 458286 - RNA, 19 nt, Homo sapiens
ggacgacacuggguagaau

SEQ ID NO: 458287 - RNA, 19 nt, Homo sapiens
ggcaaaugcucuuccuuga

SEQ ID NO: 458288 - RNA, 19 nt, Homo sapiens
aaagacaguuuguacaaug

SEQ ID NO: 458289 - RNA, 19 nt, Homo sapiens
gguucugucuucuuugaua

SEQ ID NO: 458290 - RNA, 19 nt, Homo sapiens
gaagucugcaucuaaauau

SEQ ID NO: 458291 - RNA, 19 nt, Homo sapiens
acaaaccaaugcucuauau

SEQ ID NO: 458292 - RNA, 19 nt, Homo sapiens
gauuacaucugagccguuu

SEQ ID NO: 458293 - RNA, 19 nt, Homo sapiens
gaacaggcagguaggauuc

SEQ ID NO: 458294 - RNA, 19 nt, Homo sapiens
ggaaaccuccuacccaugu

SEQ ID NO: 458295 - RNA, 19 nt, Homo sapiens
cugcuuaacugcuguauag

SEQ ID NO: 458296 - RNA, 19 nt, Homo sapiens
cguaguaggugcucaguuc

SEQ ID NO: 458297 - RNA, 19 nt, Homo sapiens
ggagauggaagguagagaa

SEQ ID NO: 458298 - RNA, 19 nt, Homo sapiens
gcaaagcaguggacaacac

SEQ ID NO: 458299 - RNA, 19 nt, Homo sapiens
caagaaaccaugcaaagca

SEQ ID NO: 458300 - RNA, 19 nt, Homo sapiens
cuuagagacucaagauauu

SEQ ID NO: 458301 - RNA, 19 nt, Homo sapiens
ugaagucugcaucuaaaua

SEQ ID NO: 458302 - RNA, 19 nt, Homo sapiens
ccagaugccuugggagcua

SEQ ID NO: 458303 - RNA, 19 nt, Homo sapiens
ccaaggauuaugucaaauu

SEQ ID NO: 458304 - RNA, 19 nt, Homo sapiens
aaagggcccuggagugaga

SEQ ID NO: 458305 - RNA, 19 nt, Homo sapiens
ccagggcucugcacucuca

SEQ ID NO: 458306 - RNA, 19 nt, Homo sapiens
caucagggcugccaaagcu

SEQ ID NO: 458307 - RNA, 19 nt, Homo sapiens
agacugacgugugcuacua

SEQ ID NO: 458308 - RNA, 19 nt, Homo sapiens
gacggaggcuaguguggaa

SEQ ID NO: 458309 - RNA, 19 nt, Homo sapiens
cuggugagauguuucauau

SEQ ID NO: 458310 - RNA, 19 nt, Homo sapiens
uaacugcuguauaggacaa

SEQ ID NO: 458311 - RNA, 19 nt, Homo sapiens
gccugcagcuccaaucuga

SEQ ID NO: 458312 - RNA, 19 nt, Homo sapiens
acucagauaucccaaagug

SEQ ID NO: 458313 - RNA, 19 nt, Homo sapiens
acccaaggauuaugucaaa

SEQ ID NO: 458314 - RNA, 19 nt, Homo sapiens
gugagauguuucauauuug

SEQ ID NO: 458315 - RNA, 19 nt, Homo sapiens
ccagucccauucuuccuuu

SEQ ID NO: 458316 - RNA, 19 nt, Homo sapiens
gagaaguggugaaugucau

SEQ ID NO: 458317 - RNA, 19 nt, Homo sapiens
caagaaaucuccccagaag

SEQ ID NO: 458318 - RNA, 19 nt, Homo sapiens
ccacucagauaucccaaag

SEQ ID NO: 458319 - RNA, 19 nt, Homo sapiens
gaucaugggacccucucua

SEQ ID NO: 458320 - RNA, 19 nt, Homo sapiens
gaauuccuggcuugguuua

SEQ ID NO: 458321 - RNA, 19 nt, Homo sapiens
gggaauuaacugucuuauu

SEQ ID NO: 458322 - RNA, 19 nt, Homo sapiens
gccaaacccucagcuuaug

SEQ ID NO: 458323 - RNA, 19 nt, Homo sapiens
gaggugugguagcagauug

SEQ ID NO: 458324 - RNA, 19 nt, Homo sapiens
ggagggccacgcacuuaaa

SEQ ID NO: 458325 - RNA, 19 nt, Homo sapiens
ggagagagaugggcuugcu

SEQ ID NO: 458326 - RNA, 19 nt, Homo sapiens
acugggugcuuaugauuaa

SEQ ID NO: 458327 - RNA, 19 nt, Homo sapiens
cuugaagucugcaucuaaa

SEQ ID NO: 458328 - RNA, 19 nt, Homo sapiens
gcaagacugacgugugcua

SEQ ID NO: 458329 - RNA, 19 nt, Homo sapiens
cauccaagcgcaagacuga

SEQ ID NO: 458330 - RNA, 19 nt, Homo sapiens
ccaaagugguaccagaauc

SEQ ID NO: 458331 - RNA, 19 nt, Homo sapiens
gcuauugguuuggaguuga

SEQ ID NO: 458332 - RNA, 19 nt, Homo sapiens
guucugugcugucuaugug

SEQ ID NO: 458333 - RNA, 19 nt, Homo sapiens
ggagaaguggugaauguca

SEQ ID NO: 458334 - RNA, 19 nt, Homo sapiens
gcuugaagucugcaucuaa

SEQ ID NO: 458335 - RNA, 19 nt, Homo sapiens
ucauuggucuggugagaug

SEQ ID NO: 458336 - RNA, 19 nt, Homo sapiens
gcacgugggcugcuuaacu

SEQ ID NO: 458337 - RNA, 19 nt, Homo sapiens
gacaugcucuccagauggu

SEQ ID NO: 458338 - RNA, 19 nt, Homo sapiens
guguggcucucuggacuua

SEQ ID NO: 458339 - RNA, 19 nt, Homo sapiens
uuacauaccagucccauuc

SEQ ID NO: 458340 - RNA, 19 nt, Homo sapiens
uuucuaagaucuaccugaa

SEQ ID NO: 458341 - RNA, 19 nt, Homo sapiens
ggcauucagaugagucuua

SEQ ID NO: 458342 - RNA, 19 nt, Homo sapiens
gguccagccuucccuguag

SEQ ID NO: 458343 - RNA, 19 nt, Homo sapiens
agaagaauuuggugaagca

SEQ ID NO: 458344 - RNA, 19 nt, Homo sapiens
cagacaugcucuccagaug

SEQ ID NO: 458345 - RNA, 19 nt, Homo sapiens
cagaugagucuuagaggaa

SEQ ID NO: 458346 - RNA, 19 nt, Homo sapiens
gcauucagaugagucuuag

SEQ ID NO: 458347 - RNA, 19 nt, Homo sapiens
cagagaaggcuuuauagca

SEQ ID NO: 458348 - RNA, 19 nt, Homo sapiens
gacugggugcuuaugauua

SEQ ID NO: 458349 - RNA, 19 nt, Homo sapiens
ccucugggaugcuugguau

SEQ ID NO: 458350 - RNA, 19 nt, Homo sapiens
agaaagggcccuggaguga

SEQ ID NO: 458351 - RNA, 19 nt, Homo sapiens
caaacccucagcuuaugua

SEQ ID NO: 458352 - RNA, 19 nt, Homo sapiens
acaucuaccugcuuggaaa

SEQ ID NO: 458353 - RNA, 19 nt, Homo sapiens
uuaguucugugcugucuau

SEQ ID NO: 458354 - RNA, 19 nt, Homo sapiens
gcucaguucaugcugguuu

SEQ ID NO: 458355 - RNA, 19 nt, Homo sapiens
gcagacaugcucuccagau

SEQ ID NO: 458356 - RNA, 19 nt, Homo sapiens
ggucagaaccuuggagauc

SEQ ID NO: 458357 - RNA, 19 nt, Homo sapiens
guagccagacaguuuauga

SEQ ID NO: 458358 - RNA, 19 nt, Homo sapiens
gacgcaguccugagguuua

SEQ ID NO: 458359 - RNA, 19 nt, Homo sapiens
ugguuuauguucugauuug

SEQ ID NO: 458360 - RNA, 19 nt, Homo sapiens
cagccaacuuccaacaaga

SEQ ID NO: 458361 - RNA, 19 nt, Homo sapiens
gucagaaccuuggagauca

SEQ ID NO: 458362 - RNA, 19 nt, Homo sapiens
agggagaaguggugaaugu

SEQ ID NO: 458363 - RNA, 19 nt, Homo sapiens
caggagggccacgcacuua

SEQ ID NO: 458364 - RNA, 19 nt, Homo sapiens
uaacaaagggagccgauac

SEQ ID NO: 458365 - RNA, 19 nt, Homo sapiens
gcacaggaucaccaaguca

SEQ ID NO: 458366 - RNA, 19 nt, Homo sapiens
cagaagcagaugaucauga

SEQ ID NO: 458367 - RNA, 19 nt, Homo sapiens
ucuaagaucuaccugaacu

SEQ ID NO: 458368 - RNA, 19 nt, Homo sapiens
gaaaggaaaucacugguua

SEQ ID NO: 458369 - RNA, 19 nt, Homo sapiens
gaagaugccuauauucuga

SEQ ID NO: 458370 - RNA, 19 nt, Homo sapiens
gcucacaccuguaaucuga

SEQ ID NO: 458371 - RNA, 19 nt, Homo sapiens
gcgaugagguggacuugua

SEQ ID NO: 458372 - RNA, 19 nt, Homo sapiens
ggaaaucacugguuaaagc

SEQ ID NO: 458373 - RNA, 19 nt, Homo sapiens
ccuguaaucugaacacuuu

SEQ ID NO: 458374 - RNA, 19 nt, Homo sapiens
ucaaggagcuguucagagu

SEQ ID NO: 458375 - RNA, 19 nt, Homo sapiens
uaucagcucuuuaaggauu

SEQ ID NO: 458376 - RNA, 19 nt, Homo sapiens
gacauuaucagcucuuuaa

SEQ ID NO: 458377 - RNA, 19 nt, Homo sapiens
gaagaugggcagagacuug

SEQ ID NO: 458378 - RNA, 19 nt, Homo sapiens
gcagugagcaaaugcauug

SEQ ID NO: 458379 - RNA, 19 nt, Homo sapiens
ggagugaagucgagcuuag

SEQ ID NO: 458380 - RNA, 19 nt, Homo sapiens
ucaucaagcugguugugua

SEQ ID NO: 458381 - RNA, 19 nt, Homo sapiens
gaagaagagcggagagaga

SEQ ID NO: 458382 - RNA, 19 nt, Homo sapiens
ggagauaaugucagcauga

SEQ ID NO: 458383 - RNA, 19 nt, Homo sapiens
ucacacagccgaugacaga

SEQ ID NO: 458384 - RNA, 19 nt, Homo sapiens
ugaagagacugaucaagca

SEQ ID NO: 458385 - RNA, 19 nt, Homo sapiens
gaagaggacccugaaagug

SEQ ID NO: 458386 - RNA, 19 nt, Homo sapiens
ggaagaggacccugaaagu

SEQ ID NO: 458387 - RNA, 19 nt, Homo sapiens
gaaggaagaggcgauguga

SEQ ID NO: 458388 - RNA, 19 nt, Homo sapiens
ugauaacccugucaucuuc

SEQ ID NO: 458389 - RNA, 19 nt, Homo sapiens
uguggaagaugccuauauu

SEQ ID NO: 458390 - RNA, 19 nt, Homo sapiens
gagauaaugucagcaugau

SEQ ID NO: 458391 - RNA, 19 nt, Homo sapiens
ucagagagguuaagagacu

SEQ ID NO: 458392 - RNA, 19 nt, Homo sapiens
ggucaggacaauuccauuu

SEQ ID NO: 458393 - RNA, 19 nt, Homo sapiens
gagcugcagugagcaaaug

SEQ ID NO: 458394 - RNA, 19 nt, Homo sapiens
gauuucaucuuccuaaacu

SEQ ID NO: 458395 - RNA, 19 nt, Homo sapiens
ggaagaugccuauauucug

SEQ ID NO: 458396 - RNA, 19 nt, Homo sapiens
gagcuugggucaggacaau

SEQ ID NO: 458397 - RNA, 19 nt, Homo sapiens
ccaggaagaugggcagaga

SEQ ID NO: 458398 - RNA, 19 nt, Homo sapiens
ccacuaugccagacaguuu

SEQ ID NO: 458399 - RNA, 19 nt, Homo sapiens
ggccugagauagacaguca

SEQ ID NO: 458400 - RNA, 19 nt, Homo sapiens
aauuaaggaucgucagaaa

SEQ ID NO: 458401 - RNA, 19 nt, Homo sapiens
gcgagaugcugcccuucuu

SEQ ID NO: 458402 - RNA, 19 nt, Homo sapiens
gggaaugaauguggaagau

SEQ ID NO: 458403 - RNA, 19 nt, Homo sapiens
guucagagagguuaagaga

SEQ ID NO: 458404 - RNA, 19 nt, Homo sapiens
gagcaaaugcauugagcuu

SEQ ID NO: 458405 - RNA, 19 nt, Homo sapiens
gaaaugucaaugagaggaa

SEQ ID NO: 458406 - RNA, 19 nt, Homo sapiens
aaacuggaaaugucaauga

SEQ ID NO: 458407 - RNA, 19 nt, Homo sapiens
cacgaagccuggccucuug

SEQ ID NO: 458408 - RNA, 19 nt, Homo sapiens
gcacgaagccuggccucuu

SEQ ID NO: 458409 - RNA, 19 nt, Homo sapiens
gaggagggaggaucucuug

SEQ ID NO: 458410 - RNA, 19 nt, Homo sapiens
gaggauggacgcacuguca

SEQ ID NO: 458411 - RNA, 19 nt, Homo sapiens
gugaagggcugaggaugga

SEQ ID NO: 458412 - RNA, 19 nt, Homo sapiens
gcaaagaucagagugaaac

SEQ ID NO: 458413 - RNA, 19 nt, Homo sapiens
ugaaugacaccaucaagga

SEQ ID NO: 458414 - RNA, 19 nt, Homo sapiens
auuaucagcucuuuaagga

SEQ ID NO: 458415 - RNA, 19 nt, Homo sapiens
gagacauuaucagcucuuu

SEQ ID NO: 458416 - RNA, 19 nt, Homo sapiens
ccucuugcuuggcgugaua

SEQ ID NO: 458417 - RNA, 19 nt, Homo sapiens
cagacaguuucgacacuuu

SEQ ID NO: 458418 - RNA, 19 nt, Homo sapiens
gaauguggaagaugccuau

SEQ ID NO: 458419 - RNA, 19 nt, Homo sapiens
gcgacaggaugggaaagaa

SEQ ID NO: 458420 - RNA, 19 nt, Homo sapiens
ggagggaggaucucuugug

SEQ ID NO: 458421 - RNA, 19 nt, Homo sapiens
ggcagagcaugucuuggaa

SEQ ID NO: 458422 - RNA, 19 nt, Homo sapiens
gggagacgcugggaaaggu

SEQ ID NO: 458423 - RNA, 19 nt, Homo sapiens
ggaacuggcaccacuacug

SEQ ID NO: 458424 - RNA, 19 nt, Homo sapiens
caaugcaugucugcgauga

SEQ ID NO: 458425 - RNA, 19 nt, Homo sapiens
ucacucagccuauggagau

SEQ ID NO: 458426 - RNA, 19 nt, Homo sapiens
gugauaacccugucaucuu

SEQ ID NO: 458427 - RNA, 19 nt, Homo sapiens
gagaugcugcccuucuuug

SEQ ID NO: 458428 - RNA, 19 nt, Homo sapiens
gaauuccugccaucccuuu

SEQ ID NO: 458429 - RNA, 19 nt, Homo sapiens
cuauggagaugaagaaacu

SEQ ID NO: 458430 - RNA, 19 nt, Homo sapiens
gagugaaacaggauaagau

SEQ ID NO: 458431 - RNA, 19 nt, Homo sapiens
gcacgguggcacacacuug

SEQ ID NO: 458432 - RNA, 19 nt, Homo sapiens
cugcaaagaucagagugaa

SEQ ID NO: 458433 - RNA, 19 nt, Homo sapiens
uccgggagcugggagauaa

SEQ ID NO: 458434 - RNA, 19 nt, Homo sapiens
ccgagaaccugaagagacu

SEQ ID NO: 458435 - RNA, 19 nt, Homo sapiens
ucacaccucugcauuucca

SEQ ID NO: 458436 - RNA, 19 nt, Homo sapiens
gggaggaggaggaggaaga

SEQ ID NO: 458437 - RNA, 19 nt, Homo sapiens
ggcagcaucuacucagcaa

SEQ ID NO: 458438 - RNA, 19 nt, Homo sapiens
ugucacaccucugcauuuc

SEQ ID NO: 458439 - RNA, 19 nt, Homo sapiens
gaucagagugaaacaggau

SEQ ID NO: 458440 - RNA, 19 nt, Homo sapiens
ccagacaguuucgacacuu

SEQ ID NO: 458441 - RNA, 19 nt, Homo sapiens
ugaaaggaaaucacugguu

SEQ ID NO: 458442 - RNA, 19 nt, Homo sapiens
cgacaggaugggaaagaaa

SEQ ID NO: 458443 - RNA, 19 nt, Homo sapiens
ggaaugaauguggaagaug

SEQ ID NO: 458444 - RNA, 19 nt, Homo sapiens
caucugguguacccugaga

SEQ ID NO: 458445 - RNA, 19 nt, Homo sapiens
ucaggacaauuccauuugg

SEQ ID NO: 458446 - RNA, 19 nt, Homo sapiens
gucaaugagaggaaauuaa

SEQ ID NO: 458447 - RNA, 19 nt, Homo sapiens
ggaggaggaggaggaagaa

SEQ ID NO: 458448 - RNA, 19 nt, Homo sapiens
agacuugaguggcgauuac

SEQ ID NO: 458449 - RNA, 19 nt, Homo sapiens
uggcagagcaugucuugga

SEQ ID NO: 458450 - RNA, 19 nt, Homo sapiens
gagcugggagauaauguca

SEQ ID NO: 458451 - RNA, 19 nt, Homo sapiens
ugaaagugcucaccuuccu

SEQ ID NO: 458452 - RNA, 19 nt, Homo sapiens
ucaaugagaggaaauuaac

SEQ ID NO: 458453 - RNA, 19 nt, Homo sapiens
gagacuugaguggcgauua

SEQ ID NO: 458454 - RNA, 19 nt, Homo sapiens
ucagcaaggucacuaagcu

SEQ ID NO: 458455 - RNA, 19 nt, Homo sapiens
gcacgaugcagacuuugag

SEQ ID NO: 458456 - RNA, 19 nt, Homo sapiens
acccagccuucaucaagua

SEQ ID NO: 458457 - RNA, 19 nt, Homo sapiens
ccacccagccuucaucaag

SEQ ID NO: 458458 - RNA, 19 nt, Homo sapiens
aaaggaaaucacugguuaa

SEQ ID NO: 458459 - RNA, 19 nt, Homo sapiens
ggacggucacucagccuau

SEQ ID NO: 458460 - RNA, 19 nt, Homo sapiens
aagaagagcggagagagaa

SEQ ID NO: 458461 - RNA, 19 nt, Homo sapiens
cgagaugcugcccuucuuu

SEQ ID NO: 458462 - RNA, 19 nt, Homo sapiens
cuuggaaccugucuugagu

SEQ ID NO: 458463 - RNA, 19 nt, Homo sapiens
gcagugaagggcugaggau

SEQ ID NO: 458464 - RNA, 19 nt, Homo sapiens
caccuuggccuccaucaau

SEQ ID NO: 458465 - RNA, 19 nt, Homo sapiens
cuucaucaaguaugucuuu

SEQ ID NO: 458466 - RNA, 19 nt, Homo sapiens
cagccuucaucaaguaugu

SEQ ID NO: 458467 - RNA, 19 nt, Homo sapiens
gaaaucacugguuaaagcu

SEQ ID NO: 458468 - RNA, 19 nt, Homo sapiens
gaaaggaaaucacugguua

SEQ ID NO: 458469 - RNA, 19 nt, Homo sapiens
gaagaugccuauauucuga

SEQ ID NO: 458470 - RNA, 19 nt, Homo sapiens
gcucacaccuguaaucuga

SEQ ID NO: 458471 - RNA, 19 nt, Homo sapiens
gcgaugagguggacuugua

SEQ ID NO: 458472 - RNA, 19 nt, Homo sapiens
ggaaaucacugguuaaagc

SEQ ID NO: 458473 - RNA, 19 nt, Homo sapiens
ccuguaaucugaacacuuu

SEQ ID NO: 458474 - RNA, 19 nt, Homo sapiens
ucaaggagcuguucagagu

SEQ ID NO: 458475 - RNA, 19 nt, Homo sapiens
uaucagcucuuuaaggauu

SEQ ID NO: 458476 - RNA, 19 nt, Homo sapiens
gacauuaucagcucuuuaa

SEQ ID NO: 458477 - RNA, 19 nt, Homo sapiens
gaagaugggcagagacuug

SEQ ID NO: 458478 - RNA, 19 nt, Homo sapiens
gcagugagcaaaugcauug

SEQ ID NO: 458479 - RNA, 19 nt, Homo sapiens
ucaucaagcugguugugua

SEQ ID NO: 458480 - RNA, 19 nt, Homo sapiens
gaagaagagcggagagaga

SEQ ID NO: 458481 - RNA, 19 nt, Homo sapiens
ggagauaaugucagcauga

SEQ ID NO: 458482 - RNA, 19 nt, Homo sapiens
ucacacagccgaugacaga

SEQ ID NO: 458483 - RNA, 19 nt, Homo sapiens
ugaagagacugaucaagca

SEQ ID NO: 458484 - RNA, 19 nt, Homo sapiens
gaagaggacccugaaagug

SEQ ID NO: 458485 - RNA, 19 nt, Homo sapiens
ggaagaggacccugaaagu

SEQ ID NO: 458486 - RNA, 19 nt, Homo sapiens
gaaggaagaggcgauguga

SEQ ID NO: 458487 - RNA, 19 nt, Homo sapiens
ugauaacccugucaucuuc

SEQ ID NO: 458488 - RNA, 19 nt, Homo sapiens
uguggaagaugccuauauu

SEQ ID NO: 458489 - RNA, 19 nt, Homo sapiens
gagauaaugucagcaugau

SEQ ID NO: 458490 - RNA, 19 nt, Homo sapiens
ucagagagguuaagagacu

SEQ ID NO: 458491 - RNA, 19 nt, Homo sapiens
ggucaggacaauuccauuu

SEQ ID NO: 458492 - RNA, 19 nt, Homo sapiens
gagcugcagugagcaaaug

SEQ ID NO: 458493 - RNA, 19 nt, Homo sapiens
gauuucaucuuccuaaacu

SEQ ID NO: 458494 - RNA, 19 nt, Homo sapiens
ggaagaugccuauauucug

SEQ ID NO: 458495 - RNA, 19 nt, Homo sapiens
gagcuugggucaggacaau

SEQ ID NO: 458496 - RNA, 19 nt, Homo sapiens
ccaggaagaugggcagaga

SEQ ID NO: 458497 - RNA, 19 nt, Homo sapiens
ccacuaugccagacaguuu

SEQ ID NO: 458498 - RNA, 19 nt, Homo sapiens
ggccugagauagacaguca

SEQ ID NO: 458499 - RNA, 19 nt, Homo sapiens
aauuaaggaucgucagaaa

SEQ ID NO: 458500 - RNA, 19 nt, Homo sapiens
gcgagaugcugcccuucuu

SEQ ID NO: 458501 - RNA, 19 nt, Homo sapiens
gggaaugaauguggaagau

SEQ ID NO: 458502 - RNA, 19 nt, Homo sapiens
guucagagagguuaagaga

SEQ ID NO: 458503 - RNA, 19 nt, Homo sapiens
gagcaaaugcauugagcuu

SEQ ID NO: 458504 - RNA, 19 nt, Homo sapiens
gaaaugucaaugagaggaa

SEQ ID NO: 458505 - RNA, 19 nt, Homo sapiens
aaacuggaaaugucaauga

SEQ ID NO: 458506 - RNA, 19 nt, Homo sapiens
cacgaagccuggccucuug

SEQ ID NO: 458507 - RNA, 19 nt, Homo sapiens
gcacgaagccuggccucuu

SEQ ID NO: 458508 - RNA, 19 nt, Homo sapiens
gaggagggaggaucucuug

SEQ ID NO: 458509 - RNA, 19 nt, Homo sapiens
gaggauggacgcacuguca

SEQ ID NO: 458510 - RNA, 19 nt, Homo sapiens
gugaagggcugaggaugga

SEQ ID NO: 458511 - RNA, 19 nt, Homo sapiens
gcaaagaucagagugaaac

SEQ ID NO: 458512 - RNA, 19 nt, Homo sapiens
ugaaugacaccaucaagga

SEQ ID NO: 458513 - RNA, 19 nt, Homo sapiens
auuaucagcucuuuaagga

SEQ ID NO: 458514 - RNA, 19 nt, Homo sapiens
gagacauuaucagcucuuu

SEQ ID NO: 458515 - RNA, 19 nt, Homo sapiens
ccucuugcuuggcgugaua

SEQ ID NO: 458516 - RNA, 19 nt, Homo sapiens
cagacaguuucgacacuuu

SEQ ID NO: 458517 - RNA, 19 nt, Homo sapiens
gaauguggaagaugccuau

SEQ ID NO: 458518 - RNA, 19 nt, Homo sapiens
gcgacaggaugggaaagaa

SEQ ID NO: 458519 - RNA, 19 nt, Homo sapiens
ggagggaggaucucuugug

SEQ ID NO: 458520 - RNA, 19 nt, Homo sapiens
ggcagagcaugucuuggaa

SEQ ID NO: 458521 - RNA, 19 nt, Homo sapiens
gggagacgcugggaaaggu

SEQ ID NO: 458522 - RNA, 19 nt, Homo sapiens
ggaacuggcaccacuacug

SEQ ID NO: 458523 - RNA, 19 nt, Homo sapiens
caaugcaugucugcgauga

SEQ ID NO: 458524 - RNA, 19 nt, Homo sapiens
ucacucagccuauggagau

SEQ ID NO: 458525 - RNA, 19 nt, Homo sapiens
gugauaacccugucaucuu

SEQ ID NO: 458526 - RNA, 19 nt, Homo sapiens
gagaugcugcccuucuuug

SEQ ID NO: 458527 - RNA, 19 nt, Homo sapiens
cuauggagaugaagaaacu

SEQ ID NO: 458528 - RNA, 19 nt, Homo sapiens
gagugaaacaggauaagau

SEQ ID NO: 458529 - RNA, 19 nt, Homo sapiens
gcacgguggcacacacuug

SEQ ID NO: 458530 - RNA, 19 nt, Homo sapiens
cugcaaagaucagagugaa

SEQ ID NO: 458531 - RNA, 19 nt, Homo sapiens
uccgggagcugggagauaa

SEQ ID NO: 458532 - RNA, 19 nt, Homo sapiens
ccgagaaccugaagagacu

SEQ ID NO: 458533 - RNA, 19 nt, Homo sapiens
gggaggaggaggaggaaga

SEQ ID NO: 458534 - RNA, 19 nt, Homo sapiens
ucacaccucugcauuucca

SEQ ID NO: 458535 - RNA, 19 nt, Homo sapiens
ggcagcaucuacucagcaa

SEQ ID NO: 458536 - RNA, 19 nt, Homo sapiens
ugucacaccucugcauuuc

SEQ ID NO: 458537 - RNA, 19 nt, Homo sapiens
gaucagagugaaacaggau

SEQ ID NO: 458538 - RNA, 19 nt, Homo sapiens
ccagacaguuucgacacuu

SEQ ID NO: 458539 - RNA, 19 nt, Homo sapiens
ugaaaggaaaucacugguu

SEQ ID NO: 458540 - RNA, 19 nt, Homo sapiens
cgacaggaugggaaagaaa

SEQ ID NO: 458541 - RNA, 19 nt, Homo sapiens
ggaaugaauguggaagaug

SEQ ID NO: 458542 - RNA, 19 nt, Homo sapiens
caucugguguacccugaga

SEQ ID NO: 458543 - RNA, 19 nt, Homo sapiens
ucaggacaauuccauuugg

SEQ ID NO: 458544 - RNA, 19 nt, Homo sapiens
gucaaugagaggaaauuaa

SEQ ID NO: 458545 - RNA, 19 nt, Homo sapiens
ggaggaggaggaggaagaa

SEQ ID NO: 458546 - RNA, 19 nt, Homo sapiens
agacuugaguggcgauuac

SEQ ID NO: 458547 - RNA, 19 nt, Homo sapiens
uggcagagcaugucuugga

SEQ ID NO: 458548 - RNA, 19 nt, Homo sapiens
gagcugggagauaauguca

SEQ ID NO: 458549 - RNA, 19 nt, Homo sapiens
ugaaagugcucaccuuccu

SEQ ID NO: 458550 - RNA, 19 nt, Homo sapiens
ucaaugagaggaaauuaac

SEQ ID NO: 458551 - RNA, 19 nt, Homo sapiens
gagacuugaguggcgauua

SEQ ID NO: 458552 - RNA, 19 nt, Homo sapiens
ucagcaaggucacuaagcu

SEQ ID NO: 458553 - RNA, 19 nt, Homo sapiens
gcacgaugcagacuuugag

SEQ ID NO: 458554 - RNA, 19 nt, Homo sapiens
acccagccuucaucaagua

SEQ ID NO: 458555 - RNA, 19 nt, Homo sapiens
ccacccagccuucaucaag

SEQ ID NO: 458556 - RNA, 19 nt, Homo sapiens
aaaggaaaucacugguuaa

SEQ ID NO: 458557 - RNA, 19 nt, Homo sapiens
aagaagagcggagagagaa

SEQ ID NO: 458558 - RNA, 19 nt, Homo sapiens
ggacggucacucagccuau

SEQ ID NO: 458559 - RNA, 19 nt, Homo sapiens
cgagaugcugcccuucuuu

SEQ ID NO: 458560 - RNA, 19 nt, Homo sapiens
cuuggaaccugucuugagu

SEQ ID NO: 458561 - RNA, 19 nt, Homo sapiens
gcagugaagggcugaggau

SEQ ID NO: 458562 - RNA, 19 nt, Homo sapiens
caccuuggccuccaucaau

SEQ ID NO: 458563 - RNA, 19 nt, Homo sapiens
cuucaucaaguaugucuuu

SEQ ID NO: 458564 - RNA, 19 nt, Homo sapiens
cagccuucaucaaguaugu

SEQ ID NO: 458565 - RNA, 19 nt, Homo sapiens
gaaaucacugguuaaagcu

SEQ ID NO: 458566 - RNA, 19 nt, Homo sapiens
ggacggcagagacaguuuc

SEQ ID NO: 458567 - RNA, 19 nt, Homo sapiens
ccccaaagauuuucacaga

SEQ ID NO: 458568 - RNA, 19 nt, Homo sapiens
ggacaacacuugcauggaa

SEQ ID NO: 458569 - RNA, 19 nt, Homo sapiens
ccaaugaggugcuggagaa

SEQ ID NO: 458570 - RNA, 19 nt, Homo sapiens
gagaagcuguuccagauag

SEQ ID NO: 458571 - RNA, 19 nt, Homo sapiens
gugaugaggugaacgugua

SEQ ID NO: 458572 - RNA, 19 nt, Homo sapiens
gggcggagcuucuguuucu

SEQ ID NO: 458573 - RNA, 19 nt, Homo sapiens
ccagcaagaucgaagucua

SEQ ID NO: 458574 - RNA, 19 nt, Homo sapiens
ggagaagcuguuccagaua

SEQ ID NO: 458575 - RNA, 19 nt, Homo sapiens
guagggagcucagcacaag

SEQ ID NO: 458576 - RNA, 19 nt, Homo sapiens
gauagugccuggcgagaac

SEQ ID NO: 458577 - RNA, 19 nt, Homo sapiens
ggaggugggacaacacuug

SEQ ID NO: 458578 - RNA, 19 nt, Homo sapiens
ccacuuugacgguaacauu

SEQ ID NO: 458579 - RNA, 19 nt, Homo sapiens
caacccagccuucuucaag

SEQ ID NO: 458580 - RNA, 19 nt, Homo sapiens
ugacccagaugguauugga

SEQ ID NO: 458581 - RNA, 19 nt, Homo sapiens
cagacuggauuauuucaag

SEQ ID NO: 458582 - RNA, 19 nt, Homo sapiens
gcaacuggcaccacuacug

SEQ ID NO: 458583 - RNA, 19 nt, Homo sapiens
ccagccuucuucaaguaua

SEQ ID NO: 458584 - RNA, 19 nt, Homo sapiens
aagaaaagguccagaucua

SEQ ID NO: 458585 - RNA, 19 nt, Homo sapiens
ccacccaccauuucaugua

SEQ ID NO: 458586 - RNA, 19 nt, Homo sapiens
ggacuagagggcugcaaug

SEQ ID NO: 458587 - RNA, 19 nt, Homo sapiens
ggacuucgaggcccacauc

SEQ ID NO: 458588 - RNA, 19 nt, Homo sapiens
cgagagaacauggaucuuc

SEQ ID NO: 458589 - RNA, 19 nt, Homo sapiens
ccaggaguauuaggaagga

SEQ ID NO: 458590 - RNA, 19 nt, Homo sapiens
gaaccacccaccauuucau

SEQ ID NO: 458591 - RNA, 19 nt, Homo sapiens
ccagucuccuccaaucaau

SEQ ID NO: 458592 - RNA, 19 nt, Homo sapiens
cuacaacccagccuucuuc

SEQ ID NO: 458593 - RNA, 19 nt, Homo sapiens
ugacggagagacccgauga

SEQ ID NO: 458594 - RNA, 19 nt, Homo sapiens
ugugcucucuguugugauu

SEQ ID NO: 458595 - RNA, 19 nt, Homo sapiens
ccugugcucucuguuguga

SEQ ID NO: 458596 - RNA, 19 nt, Homo sapiens
acccagccuucuucaagua

SEQ ID NO: 458597 - RNA, 19 nt, Homo sapiens
gccgaaccacccaccauuu

SEQ ID NO: 458598 - RNA, 19 nt, Homo sapiens
gccaggaggugggacaaca

SEQ ID NO: 458599 - RNA, 19 nt, Homo sapiens
cagccuucuucaaguauau

SEQ ID NO: 458600 - RNA, 19 nt, Homo sapiens
ggacgggcacaacuucauc

SEQ ID NO: 458601 - RNA, 19 nt, Homo sapiens
ucaagucacacaacaccaa

SEQ ID NO: 458602 - RNA, 19 nt, Homo sapiens
caucaugucccugcucuuc

SEQ ID NO: 458603 - RNA, 19 nt, Homo sapiens
ucuguggccuagcuaguga

SEQ ID NO: 458604 - RNA, 19 nt, Homo sapiens
cagccaaucaugugacuca

SEQ ID NO: 458605 - RNA, 19 nt, Homo sapiens
ccucagaugggaagcagaa

SEQ ID NO: 458606 - RNA, 19 nt, Homo sapiens
gaaaagguccagaucuaca

SEQ ID NO: 458607 - RNA, 19 nt, Homo sapiens
gaucucugcagcggaguuu

SEQ ID NO: 458608 - RNA, 19 nt, Homo sapiens
ggagaccuggacccuggua

SEQ ID NO: 458609 - RNA, 19 nt, Homo sapiens
gggaccagcaccucagaug

SEQ ID NO: 458610 - RNA, 19 nt, Homo sapiens
cguguguucucccuacaug

SEQ ID NO: 458611 - RNA, 19 nt, Homo sapiens
ucaugugacucaaggaaaa

SEQ ID NO: 458612 - RNA, 19 nt, Homo sapiens
gguuugacagccacuuuga

SEQ ID NO: 458613 - RNA, 19 nt, Homo sapiens
gauguuggcagccgaacca

SEQ ID NO: 458614 - RNA, 19 nt, Homo sapiens
acagccacuuugacgguaa

SEQ ID NO: 458615 - RNA, 19 nt, Homo sapiens
cugcugguguucaucaugu

SEQ ID NO: 458616 - RNA, 19 nt, Homo sapiens
cgaaccacccaccauuuca

SEQ ID NO: 458617 - RNA, 19 nt, Homo sapiens
gggccaggaguauuaggaa

SEQ ID NO: 458618 - RNA, 19 nt, Homo sapiens
caguucaagucacacaaca

SEQ ID NO: 458619 - RNA, 19 nt, Homo sapiens
gagccucuguggccuagcu

SEQ ID NO: 458620 - RNA, 19 nt, Homo sapiens
gaacccaaguccccugaag

SEQ ID NO: 458621 - RNA, 19 nt, Homo sapiens
uguccagucuccuccaauc

SEQ ID NO: 458622 - RNA, 19 nt, Homo sapiens
cagcaacccgcgaccaauc

SEQ ID NO: 458623 - RNA, 19 nt, Homo sapiens
gguagggagcucagcacaa

SEQ ID NO: 458624 - RNA, 19 nt, Homo sapiens
cauuucauguacccugaga

SEQ ID NO: 458625 - RNA, 19 nt, Homo sapiens
agucacacaacaccaauga

SEQ ID NO: 458626 - RNA, 19 nt, Homo sapiens
caagaccuacugcggaaag

SEQ ID NO: 458627 - RNA, 19 nt, Homo sapiens
ccgaaccacccaccauuuc

SEQ ID NO: 458628 - RNA, 19 nt, Homo sapiens
cacuuugacgguaacauuu

SEQ ID NO: 458629 - RNA, 19 nt, Homo sapiens
aaucaugugacucaaggaa

SEQ ID NO: 458630 - RNA, 19 nt, Homo sapiens
cgccaaccgugggcuuuga

SEQ ID NO: 458631 - RNA, 19 nt, Homo sapiens
caagucacacaacaccaau

SEQ ID NO: 458632 - RNA, 19 nt, Homo sapiens
ugucccugcucuucaccua

SEQ ID NO: 458633 - RNA, 19 nt, Homo sapiens
caacagccacggaagauua

SEQ ID NO: 458634 - RNA, 19 nt, Homo sapiens
gaaagaggccaguagagaa

SEQ ID NO: 458635 - RNA, 19 nt, Homo sapiens
gcaccaagagauuauuuaa

SEQ ID NO: 458636 - RNA, 19 nt, Homo sapiens
ggaaagaggccaguagaga

SEQ ID NO: 458637 - RNA, 19 nt, Homo sapiens
ucaagaaccucacguccuu

SEQ ID NO: 458638 - RNA, 19 nt, Homo sapiens
gagaccauccugagugaua

SEQ ID NO: 458639 - RNA, 19 nt, Homo sapiens
gaaccucacguccuucuga

SEQ ID NO: 458640 - RNA, 19 nt, Homo sapiens
gcagaccauucacuacuau

SEQ ID NO: 458641 - RNA, 19 nt, Homo sapiens
ggagauugcagcugacaaa

SEQ ID NO: 458642 - RNA, 19 nt, Homo sapiens
ucaagacgccaucugcuua

SEQ ID NO: 458643 - RNA, 19 nt, Homo sapiens
guuacaaaccuaccauuaa

SEQ ID NO: 458644 - RNA, 19 nt, Homo sapiens
gaugggagcuaucaagaac

SEQ ID NO: 458645 - RNA, 19 nt, Homo sapiens
gauugcagcugacaaacug

SEQ ID NO: 458646 - RNA, 19 nt, Homo sapiens
ugagaaacauggucagcaa

SEQ ID NO: 458647 - RNA, 19 nt, Homo sapiens
gccauaaugucucccaaga

SEQ ID NO: 458648 - RNA, 19 nt, Homo sapiens
ggaagcuccuggccauguu

SEQ ID NO: 458649 - RNA, 19 nt, Homo sapiens
cacggaagauuaagcagaa

SEQ ID NO: 458650 - RNA, 19 nt, Homo sapiens
acaagaagcagaccauuca

SEQ ID NO: 458651 - RNA, 19 nt, Homo sapiens
aaacagauucggauucuca

SEQ ID NO: 458652 - RNA, 19 nt, Homo sapiens
caaggccucuaagcucuuu

SEQ ID NO: 458653 - RNA, 19 nt, Homo sapiens
ccagacgccuacaacaaga

SEQ ID NO: 458654 - RNA, 19 nt, Homo sapiens
gaaacauggucagcaaguc

SEQ ID NO: 458655 - RNA, 19 nt, Homo sapiens
gagaugggagcuaucaaga

SEQ ID NO: 458656 - RNA, 19 nt, Homo sapiens
gcacuugggagcugacugu

SEQ ID NO: 458657 - RNA, 19 nt, Homo sapiens
gaacagcucacugggagau

SEQ ID NO: 458658 - RNA, 19 nt, Homo sapiens
gauuauuucugggucaaga

SEQ ID NO: 458659 - RNA, 19 nt, Homo sapiens
cuaaacagauucggauucu

SEQ ID NO: 458660 - RNA, 19 nt, Homo sapiens
agaagcagaccauucacua

SEQ ID NO: 458661 - RNA, 19 nt, Homo sapiens
ggagaugggagcuaucaag

SEQ ID NO: 458662 - RNA, 19 nt, Homo sapiens
gaaacagccuccccucauc

SEQ ID NO: 458663 - RNA, 19 nt, Homo sapiens
auaagaagcgggugcgaaa

SEQ ID NO: 458664 - RNA, 19 nt, Homo sapiens
agaccauccugagugauaa

SEQ ID NO: 458665 - RNA, 19 nt, Homo sapiens
caacaagaagcagaccauu

SEQ ID NO: 458666 - RNA, 19 nt, Homo sapiens
caaaccuaccauuaaacua

SEQ ID NO: 458667 - RNA, 19 nt, Homo sapiens
ugacagcucuccccaggaa

SEQ ID NO: 458668 - RNA, 19 nt, Homo sapiens
aaagaggccaguagagaau

SEQ ID NO: 458669 - RNA, 19 nt, Homo sapiens
gaagcagaccauucacuac

SEQ ID NO: 458670 - RNA, 19 nt, Homo sapiens
gcaacagccacggaagauu

SEQ ID NO: 458671 - RNA, 19 nt, Homo sapiens
cagcaccaagagauuauuu

SEQ ID NO: 458672 - RNA, 19 nt, Homo sapiens
ccugcugccugcugagaaa

SEQ ID NO: 458673 - RNA, 19 nt, Homo sapiens
gaugucaauccuaaacaga

SEQ ID NO: 458674 - RNA, 19 nt, Homo sapiens
gaccugggcaagagcugua

SEQ ID NO: 458675 - RNA, 19 nt, Homo sapiens
ucacuacuaugagcagauc

SEQ ID NO: 458676 - RNA, 19 nt, Homo sapiens
caccaugcgucucuucuac

SEQ ID NO: 458677 - RNA, 19 nt, Homo sapiens
caggaaagaggccaguaga

SEQ ID NO: 458678 - RNA, 19 nt, Homo sapiens
cauccugagugauaagaag

SEQ ID NO: 458679 - RNA, 19 nt, Homo sapiens
ucgcugagcaggacccaaa

SEQ ID NO: 458680 - RNA, 19 nt, Homo sapiens
agcagaccauucacuacua

SEQ ID NO: 458681 - RNA, 19 nt, Homo sapiens
uugagaccauccugaguga

SEQ ID NO: 458682 - RNA, 19 nt, Homo sapiens
uuaagcggaugcuggagau

SEQ ID NO: 458683 - RNA, 19 nt, Homo sapiens
ggugcacauugccggcuuu

SEQ ID NO: 458684 - RNA, 19 nt, Homo sapiens
ccaccaugcgucucuucua

SEQ ID NO: 458685 - RNA, 19 nt, Homo sapiens
gaagcuccuggccauguug

SEQ ID NO: 458686 - RNA, 19 nt, Homo sapiens
gcaaggccucuaagcucuu

SEQ ID NO: 458687 - RNA, 19 nt, Homo sapiens
cccugaaucugcccacuuc

SEQ ID NO: 458688 - RNA, 19 nt, Homo sapiens
gaaggggaccucaucuaga

SEQ ID NO: 458689 - RNA, 19 nt, Homo sapiens
agaccauucacuacuauga

SEQ ID NO: 458690 - RNA, 19 nt, Homo sapiens
aaggggaccucaucuagaa

SEQ ID NO: 458691 - RNA, 19 nt, Homo sapiens
uaagcucuuuggcaacuac

SEQ ID NO: 458692 - RNA, 19 nt, Homo sapiens
gugccaguaugacccacuu

SEQ ID NO: 458693 - RNA, 19 nt, Homo sapiens
gcaacuacucccgggauca

SEQ ID NO: 458694 - RNA, 19 nt, Homo sapiens
agaggccaguagagaauuc

SEQ ID NO: 458695 - RNA, 19 nt, Homo sapiens
ccaggaaagaggccaguag

SEQ ID NO: 458696 - RNA, 19 nt, Homo sapiens
ugccagcaccaagagauua

SEQ ID NO: 458697 - RNA, 19 nt, Homo sapiens
ccuaaacagauucggauuc

SEQ ID NO: 458698 - RNA, 19 nt, Homo sapiens
gucaagacgccaucugcuu

SEQ ID NO: 458699 - RNA, 19 nt, Homo sapiens
ucuaagcucuuuggcaacu

SEQ ID NO: 458700 - RNA, 19 nt, Homo sapiens
gagaaggggaccucaucua

SEQ ID NO: 458701 - RNA, 19 nt, Homo sapiens
ggaaacagccuccccucau

SEQ ID NO: 458702 - RNA, 19 nt, Homo sapiens
uaaacugccugcugaauua

SEQ ID NO: 458703 - RNA, 19 nt, Homo sapiens
gaucaaaggucaagacaau

SEQ ID NO: 458704 - RNA, 19 nt, Homo sapiens
ugaaauacaucgucuacaa

SEQ ID NO: 458705 - RNA, 19 nt, Homo sapiens
gaucaaagccaucuuguca

SEQ ID NO: 458706 - RNA, 19 nt, Homo sapiens
ggaaucacuucuccaauca

SEQ ID NO: 458707 - RNA, 19 nt, Homo sapiens
ggugaaagcucgcgucauc

SEQ ID NO: 458708 - RNA, 19 nt, Homo sapiens
uaaauaagguuggagaugu

SEQ ID NO: 458709 - RNA, 19 nt, Homo sapiens
auaaagcucuucccugaaa

SEQ ID NO: 458710 - RNA, 19 nt, Homo sapiens
gguuggagaugucaaguug

SEQ ID NO: 458711 - RNA, 19 nt, Homo sapiens
ggacuccaauucagugguu

SEQ ID NO: 458712 - RNA, 19 nt, Homo sapiens
ggauuuggcuaugacauga

SEQ ID NO: 458713 - RNA, 19 nt, Homo sapiens
cgagcgcgauucucucuuu

SEQ ID NO: 458714 - RNA, 19 nt, Homo sapiens
ugacuccgcuggacaaaca

SEQ ID NO: 458715 - RNA, 19 nt, Homo sapiens
ccaauucagugguucuuuc

SEQ ID NO: 458716 - RNA, 19 nt, Homo sapiens
ucaagacaaucugaucaaa

SEQ ID NO: 458717 - RNA, 19 nt, Homo sapiens
ggaggguagggauaauuua

SEQ ID NO: 458718 - RNA, 19 nt, Homo sapiens
cggaaucacuucuccaauc

SEQ ID NO: 458719 - RNA, 19 nt, Homo sapiens
ucaaagccaucuugucagu

SEQ ID NO: 458720 - RNA, 19 nt, Homo sapiens
ggccugcccuucaacaaug

SEQ ID NO: 458721 - RNA, 19 nt, Homo sapiens
guuccuggaugacuccuuu

SEQ ID NO: 458722 - RNA, 19 nt, Homo sapiens
gaaaucguaaaucauguga

SEQ ID NO: 458723 - RNA, 19 nt, Homo sapiens
gugguuggguucugccuuu

SEQ ID NO: 458724 - RNA, 19 nt, Homo sapiens
ucuaagcaguggcaucuga

SEQ ID NO: 458725 - RNA, 19 nt, Homo sapiens
ucggauggcuucuggaaau

SEQ ID NO: 458726 - RNA, 19 nt, Homo sapiens
gaaauacaucgucuacaag

SEQ ID NO: 458727 - RNA, 19 nt, Homo sapiens
gacaaacacuaggcucaga

SEQ ID NO: 458728 - RNA, 19 nt, Homo sapiens
aaagccaucuugucaguca

SEQ ID NO: 458729 - RNA, 19 nt, Homo sapiens
gggaggguagggauaauuu

SEQ ID NO: 458730 - RNA, 19 nt, Homo sapiens
ugacgacuaugacauugug

SEQ ID NO: 458731 - RNA, 19 nt, Homo sapiens
ucuccgcuguggucauuua

SEQ ID NO: 458732 - RNA, 19 nt, Homo sapiens
gcaggaagaggcccacuag

SEQ ID NO: 458733 - RNA, 19 nt, Homo sapiens
ugaauuagccaccaaguac

SEQ ID NO: 458734 - RNA, 19 nt, Homo sapiens
gaugggacucuugguauuu

SEQ ID NO: 458735 - RNA, 19 nt, Homo sapiens
uaggaaaucguaaaucaug

SEQ ID NO: 458736 - RNA, 19 nt, Homo sapiens
aaucguaaaucaugugaag

SEQ ID NO: 458737 - RNA, 19 nt, Homo sapiens
acacuaggcucagaguaug

SEQ ID NO: 458738 - RNA, 19 nt, Homo sapiens
cuaaacugccugcugaauu

SEQ ID NO: 458739 - RNA, 19 nt, Homo sapiens
uccugaaucuggacucuaa

SEQ ID NO: 458740 - RNA, 19 nt, Homo sapiens
gaugacuccuuucgcaagu

SEQ ID NO: 458741 - RNA, 19 nt, Homo sapiens
ggaaaucguaaaucaugug

SEQ ID NO: 458742 - RNA, 19 nt, Homo sapiens
gagcgcgauucucucuuug

SEQ ID NO: 458743 - RNA, 19 nt, Homo sapiens
gaaggacgugggcagcaaa

SEQ ID NO: 458744 - RNA, 19 nt, Homo sapiens
gaggcguucuugccaacaa

SEQ ID NO: 458745 - RNA, 19 nt, Homo sapiens
gggaguucgugccgccuuu

SEQ ID NO: 458746 - RNA, 19 nt, Homo sapiens
caaggcugcugccggaauc

SEQ ID NO: 458747 - RNA, 19 nt, Homo sapiens
agaugggacucuugguauu

SEQ ID NO: 458748 - RNA, 19 nt, Homo sapiens
ucaccaacuugccacaugu

SEQ ID NO: 458749 - RNA, 19 nt, Homo sapiens
gaucuaagcaguggcaucu

SEQ ID NO: 458750 - RNA, 19 nt, Homo sapiens
caauauccagcgagagaaa

SEQ ID NO: 458751 - RNA, 19 nt, Homo sapiens
cacaauauccagcgagaga

SEQ ID NO: 458752 - RNA, 19 nt, Homo sapiens
gaaucuggacucuaaacug

SEQ ID NO: 458753 - RNA, 19 nt, Homo sapiens
cagugguucuuuccuuuga

SEQ ID NO: 458754 - RNA, 19 nt, Homo sapiens
ggucaagacaaucugauca

SEQ ID NO: 458755 - RNA, 19 nt, Homo sapiens
cuacacaggagucuucaga

SEQ ID NO: 458756 - RNA, 19 nt, Homo sapiens
cuucaacaauggccucaug

SEQ ID NO: 458757 - RNA, 19 nt, Homo sapiens
gcgcgauucucucuuuguc

SEQ ID NO: 458758 - RNA, 19 nt, Homo sapiens
aucaguguuugguguauua

SEQ ID NO: 458759 - RNA, 19 nt, Homo sapiens
ccucuccgcuguggucauu

SEQ ID NO: 458760 - RNA, 19 nt, Homo sapiens
ccgcuguggucauuuagga

SEQ ID NO: 458761 - RNA, 19 nt, Homo sapiens
aaauaagguuggagauguc

SEQ ID NO: 458762 - RNA, 19 nt, Homo sapiens
gcaaggcugcugccggaau

SEQ ID NO: 458763 - RNA, 19 nt, Homo sapiens
ccagcgagagaaagaguuu

SEQ ID NO: 458764 - RNA, 19 nt, Homo sapiens
gguggcagucgcaggauuu

SEQ ID NO: 458765 - RNA, 19 nt, Homo sapiens
cgacacugcgcaucaccua

SEQ ID NO: 458766 - RNA, 19 nt, Homo sapiens
caucuugucagucaccaaa

SEQ ID NO: 458767 - RNA, 19 nt, Homo sapiens
aagacaaucugaucaaagc
